United States Patent 9,624,556 (VIRAL AND VIRAL ASSOCIATED MIRNAS AND USES THEREOF) - sequence listing, part 4

SEQ ID NO: 87329 - RNA, 64 nt, Human
acaggaagcaggauuugggcauuccugaagcucccagcuggacaccacuccugagcgccacauc

SEQ ID NO: 87330 - RNA, 64 nt, Human
cucacccucucuggaccucaucuguaagaggagccagcuggauaagaugauuucugaagacgcu

SEQ ID NO: 87331 - RNA, 64 nt, Human
ucaguuuaucuuuccaggauauaugaaaagggaccagcuggaagacuagccucacucuguccuc

SEQ ID NO: 87332 - RNA, 64 nt, Human
guauuggccccugcuagcccugugcuccagcuuccagcuggagauggcagccguuguuugcgga

SEQ ID NO: 87333 - RNA, 64 nt, Human
cuguuccuuaggccccacuccaugccacccccaccagcuggaggacccagccucacaguguguc

SEQ ID NO: 87334 - RNA, 64 nt, Human
auuuucuuagggaaggggagugggguccaagugacagcuggaugggagaagccauaguuucucc

SEQ ID NO: 87335 - RNA, 64 nt, Human
cucccaaagcuuuccuuggagaagggcccuccugcagcuggacccugcaggguggcucccuccu

SEQ ID NO: 87336 - RNA, 64 nt, Human
ugaggaugauggagguagacagucgacugaaugucagcuggaaaauccagucacuaguuggggu

SEQ ID NO: 87337 - RNA, 64 nt, Human
cagggcugcugucuccuggcuaauaaucuccagccagcuggaggaaggaagggcgggcugggcc

SEQ ID NO: 87338 - RNA, 64 nt, Human
gcugcuuucuccuggcuaauaauaaauauccagccagcuggaggaaggaagggcaggcugggcc

SEQ ID NO: 87339 - RNA, 64 nt, Human
acugccuccaaagcccagagccugccugucagcccagcuggagggcccgaggcugcaggguguc

SEQ ID NO: 87340 - RNA, 64 nt, Human
cugcauguaggaggucagcaggggugggcaggcccagcuggaggcagcugggugaggguccugg

SEQ ID NO: 87341 - RNA, 64 nt, Human
ugcggccccucacagggcugaggccagccccuagcagcuggauguggcagaggcaggccagagg

SEQ ID NO: 87342 - RNA, 64 nt, Human
caguccacugcugaggacacucaguguccaguugcagcuggacuucuccacccggauggccccc

SEQ ID NO: 87343 - RNA, 64 nt, Human
aagcccggggaggggagcgacccucaaggccacccagcuggacacgggagacuugagcccagcc

SEQ ID NO: 87344 - RNA, 64 nt, Human
ugauguguccaagcucauagggaagaaagagcugcagcuggagccugacccucccuggaacagg

SEQ ID NO: 87345 - RNA, 64 nt, Human
uaacccuuucaagugggugcagacuucucguuagcagcuggaagacauuccucccacacuuuuc

SEQ ID NO: 87346 - RNA, 64 nt, Human
ucauuucgccugggacucggcaccuuuccgagugcagcuggagggaucugagcgcaggaagacg

SEQ ID NO: 87347 - RNA, 64 nt, Human
aucaagaucaaagaaccaggaggccugggagaugcagcuggauggggcggccugcagacccugc

SEQ ID NO: 87348 - RNA, 64 nt, Human
gaaggccgugggagaacucgauccuagccugugucagcuggauguguuuacguggagaggcgug

SEQ ID NO: 87349 - RNA, 64 nt, Human
aacugaucgccuaggagagggccucguaguggcacagcuggagauaguuucaaagucuaaacca

SEQ ID NO: 87350 - RNA, 64 nt, Human
ccugggccagccagauggaagggccuaucuuagccagcuggagcuuaagccaaaccuguucugu

SEQ ID NO: 87351 - RNA, 64 nt, Human
ugaccacagacacuccuggggggccugaaagcaacagcuggacacccccuuggugcucgccuuc

SEQ ID NO: 87352 - RNA, 64 nt, Human
ccguaguaugcuagggugugacagcagccagccacagcuggaucugaugucuugucugccccgc

SEQ ID NO: 87353 - RNA, 64 nt, Human
uguccaugcagucagccgauccucugcucagguucagcuggacucugccaucugugggcccagc

SEQ ID NO: 87354 - RNA, 64 nt, Human
agccagaccaaggccaagccuucucacccuuggccagcuggaagggacuucagcaaccaagacc

SEQ ID NO: 87355 - RNA, 64 nt, Human
uugcccuagcacacugggacuggccccacucucccagcuggacuccugcaugcuccuccccuug

SEQ ID NO: 87356 - RNA, 64 nt, Human
cuuuuuuuuuuuuuuuuuuaacugcugcuaucugcagcuggauacucuucuuuaaaaauguuua

SEQ ID NO: 87357 - RNA, 64 nt, Human
uauuggauaggguaaagcaagaaaacucaagcugcagcuggacugcaggcuuauuuugcuuaag

SEQ ID NO: 87358 - RNA, 64 nt, Human
agcaucuguagcuacauaaccuauauaccuccagcagcuggacauggggaggcgacaguccuau

SEQ ID NO: 87359 - RNA, 64 nt, Human
gugugcuguuuuguauaguuacuauccugugcagcagcuggagaaagcacucaccucaggcuua

SEQ ID NO: 87360 - RNA, 64 nt, Human
uccauggcuguguacugaauaguauuccccgcuacagcuggacuggacuccauuuagccuuuua

SEQ ID NO: 87361 - RNA, 64 nt, Human
gagugaaugggagaaacauaguaucgggugaggccagcuggagaacugcaacgccuacgccccc

SEQ ID NO: 87362 - RNA, 64 nt, Human
ccugccugccccugcuggguuggggagggugggacagcuggaugauucaucugugggugccagg

SEQ ID NO: 87363 - RNA, 64 nt, Human
uuuaguguccauucuugauccuucugagcaccuacagcuggaaacuaagcagauacugguccug

SEQ ID NO: 87364 - RNA, 64 nt, Human
gaacccucagcuccggguguucucggcagaagggcagcuggaagggacacaguggggcaggcuu

SEQ ID NO: 87365 - RNA, 64 nt, Human
ccacaaaguaaauccuaaagccacaaccccuucuaccacugagcugcuggagguggguccuuau

SEQ ID NO: 87366 - RNA, 64 nt, Human
uccaaaguagaaaggaagcacuucugagccagugaccacugaaagguaugugcuaugauaaagc

SEQ ID NO: 87367 - RNA, 64 nt, Human
uuugagcuucuucaauacguaaaauuaaauuuauaccacugagggagagacccuuucugaaaga

SEQ ID NO: 87368 - RNA, 64 nt, Human
aaggcagcucacagcgggaaaacucugggaaugaaccacugaauucaggggauggggguggggg

SEQ ID NO: 87369 - RNA, 64 nt, Human
aggagggauccuuggcugaggauuguauuucagaaccacugacugcucuugacaguuguuaacc

SEQ ID NO: 87370 - RNA, 64 nt, Human
uggccugcugcacuggcggauuggugggggggacaccacugagcauauccagacccacuucgag

SEQ ID NO: 87371 - RNA, 64 nt, Human
agugugacuuaacuuguguauugcauuccagcagaccacugaaccagacagcgaagccaagauc

SEQ ID NO: 87372 - RNA, 64 nt, Human
acaccauuucuccuucuccugccccagggcagguaccacugaucugcaucagaguugccugcua

SEQ ID NO: 87373 - RNA, 64 nt, Human
gucauaauacuuuauaaucaauuaaauaaauagaaccacugagacaauaauguauuuuuuuaaa

SEQ ID NO: 87374 - RNA, 64 nt, Human
ucugaggcccccucuuaccacacuuuaccaguuaaccacugaagcccccaauucccacagcuuu

SEQ ID NO: 87375 - RNA, 64 nt, Human
ccuguacucuggagagacugugcugggaacauguaccacugagccugagauggggaugagggca

SEQ ID NO: 87376 - RNA, 64 nt, Human
ggagaagcauccaaggaacuucaugcuugauuugaccacugacagccuccaccuugagcacuau

SEQ ID NO: 87377 - RNA, 64 nt, Human
aaauuggaugauccaaaaauaagugauaaugaaaaccacugaguuauauacuuugcaaggguaa

SEQ ID NO: 87378 - RNA, 64 nt, Human
cagucccagccagaggggacccuggccuuuggugaccacugagaaggacacuucacgggcccag

SEQ ID NO: 87379 - RNA, 61 nt, Human
cccugaaugaugugagcugagcccaggcgccaccacugaugccacccaggaccucggaccu

SEQ ID NO: 87380 - RNA, 64 nt, Human
uacaugaugaaaacccucugcccuggccucaucuaccacugaagcagaaaggagucugggagca

SEQ ID NO: 87381 - RNA, 64 nt, Human
uccaaacugcccccuauauguaaaguucaguuuaaccacugauugccuuguuauuacuagguuu

SEQ ID NO: 87382 - RNA, 64 nt, Human
agcuagccagcccagcaucuuccccccuucuuccaccacugagucaucugcugucucuucaguc

SEQ ID NO: 87383 - RNA, 64 nt, Human
ggaaugcagucucauacugagugauuugaguagaaccacugaugaugauuuuauaaauugugug

SEQ ID NO: 87384 - RNA, 64 nt, Human
caugggcuuucagcagcagacaaaucccacuuccaccacugacuagcugugugaccuuggacaa

SEQ ID NO: 87385 - RNA, 64 nt, Human
augauucgggccuggauagacugccugcguccuuaccacugaucuggccaagaaugaggcccuc

SEQ ID NO: 87386 - RNA, 64 nt, Human
acaaaacaacauuuugagaacaaagaugaccauaaccacugaagggaaucacaucuuuuaagac

SEQ ID NO: 87387 - RNA, 64 nt, Human
accucaagagaccuggcccuguuaagacggcuuaaccacugagaucccguucuauugauuuaau

SEQ ID NO: 87388 - RNA, 64 nt, Human
ccuucaugccugggccugcaggcccaccccagccaccacugaguccacucggagugcccugugu

SEQ ID NO: 87389 - RNA, 64 nt, Human
aauaauuuuuuaauaauuuuuuaaugagguauuuaccacugaagaaauaugauaauauaaaacc

SEQ ID NO: 87390 - RNA, 64 nt, Human
gucuuaucugccuuuuuaucuuugccaaaucuuuaccacugauuuaccauugccauaaaguaga

SEQ ID NO: 87391 - RNA, 64 nt, Human
cuucgccccagcuagcuugagcuucugcccuaugaccacugagugcauuuaaauaaaaaccuca

SEQ ID NO: 87392 - RNA, 64 nt, Human
agucucagccacucugcuuugaugguaauucuucaccacugaucucuccucaccaugcccuucc

SEQ ID NO: 87393 - RNA, 64 nt, Human
cauuauacaaagagaaccuuaugcaaccugacaaaccacugaggucauggugacucagugauca

SEQ ID NO: 87394 - RNA, 64 nt, Human
cauuuaccccguaaugugucucuacagcuaccuuaccacugagccguaagacaaauguauagga

SEQ ID NO: 87395 - RNA, 64 nt, Human
cccauccagucacagggauucuguguagggaagcaccacugauugcaguuaacaucuagagugu

SEQ ID NO: 87396 - RNA, 64 nt, Human
ugaaaaggagguaucuagcaauggauaaauagauaccacugaaugaaauuaaauguugauuagg

SEQ ID NO: 87397 - RNA, 64 nt, Human
aucaugaggugugggaaguccuaguuuuaaggaaaccacugaaauauagaugggaaauguggac

SEQ ID NO: 87398 - RNA, 64 nt, Human
aauuaauuauggaaaaauaauucagaaucuaaacaccacugaaaacuuauaaaaaauguuuaga

SEQ ID NO: 87399 - RNA, 64 nt, Human
aacuuuuuugugcuuuuauuuuucaauugugagaaccacugauugguauguucaacaaauuugu

SEQ ID NO: 87400 - RNA, 64 nt, Human
ccacuaguguauaagugaucacuggaacggagugaccacugagaugcugggggucacugggccu

SEQ ID NO: 87401 - RNA, 64 nt, Human
ugccuggaacagggugauuugcuggaauggaguuaccacugagaugccaaagguugcugggucu

SEQ ID NO: 87402 - RNA, 64 nt, Human
gguuugcagcauuccugccuucaugagggcuucuaccacugaccacuuugcacguaccuggcuc

SEQ ID NO: 87403 - RNA, 64 nt, Human
cuuauuggccuaaguucuaaauaauagcuagguuaccacugaguuuuaacuauauguauaugag

SEQ ID NO: 87404 - RNA, 64 nt, Human
uacuuaauccuccuugccaccccaccaucaccagaccacugaucugcuuucuuuaugaucaguu

SEQ ID NO: 87405 - RNA, 64 nt, Human
caaggaguccgggaggugccugugguuugcacccaccacugaaaaagccgcggagaugcgcagc

SEQ ID NO: 87406 - RNA, 64 nt, Human
agguccugcgaucgccauagccguucacagccaaaccacugacauuccuccauguccucacggc

SEQ ID NO: 87407 - RNA, 64 nt, Human
gacaccaccuuccugaggcuucccuccugcugcuaccacugaugcgagggaaaggccaguggcu

SEQ ID NO: 87408 - RNA, 64 nt, Human
uagguauuguaugaucaguggugaagcaaguaggaccacugaugugucuaaaugagcaugacag

SEQ ID NO: 87409 - RNA, 64 nt, Human
uucaaaggacuuugcccaguggaugccauucauaaccacugaugaauguuaucagcuauuuauc

SEQ ID NO: 87410 - RNA, 64 nt, Human
gcugauaaaaggcauaacgagacauagugcugcuaccacugaauaagugauacuuuggaaagau

SEQ ID NO: 87411 - RNA, 64 nt, Human
cagaaguuuuuguucuguaaguaaaaaauuacuaaccacugauguucaagauuuucuuuuaaua

SEQ ID NO: 87412 - RNA, 64 nt, Human
uuuaacuaaaguuaguauuuguuuuucagaaaugaccacugaagauucauucugauuauacaau

SEQ ID NO: 87413 - RNA, 64 nt, Human
gugagagcagaggcccggaaggaaggccaugaccaccacugagggcccggagcaggguggggag

SEQ ID NO: 87414 - RNA, 64 nt, Human
gaagaguguucuucugguaaagcuaaaauucuggaccacugaagcuaaaagcccuauugcaagu

SEQ ID NO: 87415 - RNA, 64 nt, Human
gaaacucaagucccgcccuggcucuuuagaauggaccacugagagccacaggaccguuuugggg

SEQ ID NO: 87416 - RNA, 64 nt, Human
cuugggcuggcaggggcagugacccuuccaggguaccacugagggaagggccuggguucaagcc

SEQ ID NO: 87417 - RNA, 64 nt, Human
cugccaggauauggacaucuugggauaucucuuuaccacugaaguagaauugauuguucagcug

SEQ ID NO: 87418 - RNA, 64 nt, Human
uacaaccaguuguagcagaaaauauuccuguaauaccacugagugacaguccccccccuucaag

SEQ ID NO: 87419 - RNA, 64 nt, Human
auggagagccaaucucacauucaaguguucaccaaccacugauguguuuuuauuuccuucuaua

SEQ ID NO: 87420 - RNA, 64 nt, Human
auucccuugcacagucagggccaagagagcagugaccacugaggauucagacacuguaucccag

SEQ ID NO: 87421 - RNA, 64 nt, Human
uuuacauauuuacgccauuuuuacuuguuaugaaaccacugagcuauugggaacaagacuuaga

SEQ ID NO: 87422 - RNA, 64 nt, Human
ugccagaaaacacagugccaguaagguucuacauaccacugaccaucugcuuaauagacaugua

SEQ ID NO: 87423 - RNA, 64 nt, Human
ccucugagggccuccacacugccuggcagaacauaccacugaacuaguaugugcuagaggaggg

SEQ ID NO: 87424 - RNA, 64 nt, Human
ggagggcucgaaggaagugcagggagcccuggacaccacugagucugcaugaaaucccuucuag

SEQ ID NO: 87425 - RNA, 64 nt, Human
cacgacaguacuuucaaugaacauaauuguuaggaccacugaggaaucaugaaaaaugaucucu

SEQ ID NO: 87426 - RNA, 64 nt, Human
uaaaaaguacucuuuaagagugaaauaauuaaaaaccacugaacauuugcuuuguuuucuaaag

SEQ ID NO: 87427 - RNA, 64 nt, Human
ugagugcaguauucuaaacauuucagcuaggaauaccacugauuuagaaacaaaacuguuuguc

SEQ ID NO: 87428 - RNA, 64 nt, Human
uuuuguuuaccccucucugagacagguuuugauaaccacugaaaugguagaauaugugagauac

SEQ ID NO: 87429 - RNA, 64 nt, Human
caacucacaacugagcuaccucauucagcaaagaaccacugagaaccccagaguauuacaguua

SEQ ID NO: 87430 - RNA, 64 nt, Human
uugauuacugggcauccuuguaauauaauuucauaccacugacacauuauacuuguaagagaac

SEQ ID NO: 87431 - RNA, 64 nt, Human
aacagcuaugcugguaggcuccugccaguguggaaccacugacuacuggcucucauugacuucc

SEQ ID NO: 87432 - RNA, 64 nt, Human
gcaguucgcugcucccugcuuggcuuaugaaaacaccacugaacagaaauuucuccagggagcc

SEQ ID NO: 87433 - RNA, 64 nt, Human
aaauuuaaucucauuucuggacucuuuaaguuuuaccacugaaaaccagagucgauuuuucucc

SEQ ID NO: 87434 - RNA, 64 nt, Human
uucguuugucuucagucaacagcggcugaaacugaccacugagaaaugggugugggcacugaca

SEQ ID NO: 87435 - RNA, 64 nt, Human
ggggaaugaucucugaugaccuaaccuaagcaaaaccacugagcuucugggaagacaacuagga

SEQ ID NO: 87436 - RNA, 64 nt, Human
uguuuucaaauucuaaaguccacuucaguuaagaaccacugacaauguaacucucucauuguuu

SEQ ID NO: 87437 - RNA, 64 nt, Human
auccucaggcauuccuuuguguacuugguuuuucaccacugagcuuuaaauaagaauggaaaua

SEQ ID NO: 87438 - RNA, 64 nt, Human
uucacuguguuucugccgcuguccuggaguugucaccacugacugggcaaggcuucuugggcau

SEQ ID NO: 87439 - RNA, 64 nt, Human
aacuaaugucuuguuuuaagaaacugcuuaguccaccacugaagaaaauauccagaaauuauuu

SEQ ID NO: 87440 - RNA, 64 nt, Human
gggagagaaagagaagcuauauagagaaaaggaaaccacugaaucaaagagagagcuccuuuga

SEQ ID NO: 87441 - RNA, 64 nt, Human
aacaucauuacagauucugcuagccuguucuuuuaccacugacagcuagacaccuagaaaggaa

SEQ ID NO: 87442 - RNA, 64 nt, Human
ucggcuucccaaagugcugggauuacaggcgugcaccacugaguccagccuauauucuuguuua

SEQ ID NO: 87443 - RNA, 64 nt, Human
uuggcuucccaaagugcugggauuacaggcgugcaccacugaguccagccuauauucuuguuua

SEQ ID NO: 87444 - RNA, 64 nt, Human
uaguauucuuggguucaaccuuugaaucaauuuuaccacugauuaaauaaaugacucaaagaca

SEQ ID NO: 87445 - RNA, 64 nt, Human
uuuugguggcauuuuguacuucucucugcuucuaaccacugaggcucucuaaucuuccucugga

SEQ ID NO: 87446 - RNA, 64 nt, Human
ucuuagcuguggaagaacaucaugccuauuuauaaccacugaaugcacugacuuucaaaaacug

SEQ ID NO: 87447 - RNA, 64 nt, Human
cugccagauguggccaaccuuuguccauaugcaaaccacugaaaaaugaucuggauuucuauag

SEQ ID NO: 87448 - RNA, 64 nt, Human
cccuucauucaugagaacuccagaaugaguguugaccacugaagcaucuuuuaagucuguguuc

SEQ ID NO: 87449 - RNA, 64 nt, Human
uaguccaccccccgccccaccccagccccuggcaaccacugaucugcuuucacaauaaccguau

SEQ ID NO: 87450 - RNA, 64 nt, Human
cagggacugcagcugagcgcaacugccccaucugaccacugacucaaauacgaacugcuugaga

SEQ ID NO: 87451 - RNA, 64 nt, Human
uaucaauagcacaaaggaaaaccaaaaguccuuaaccacugaccauuuuuaucauauuuuaggc

SEQ ID NO: 87452 - RNA, 64 nt, Human
cauugaacuguaucauuuucauauccacuuccccaccacugaaauaucuuauuucacaauauuu

SEQ ID NO: 87453 - RNA, 64 nt, Human
ucagcagucuagccuuuggaugaccuauuugaaaaccacugaaagucguggaggaaugggcaag

SEQ ID NO: 87454 - RNA, 64 nt, Human
auuucacuuagaaaaacuucuaggaacagggugaaccacugauuuuaauuugccuaauuaucuu

SEQ ID NO: 87455 - RNA, 64 nt, Human
uucagaugauaggugaauucccugccccucccccaccacugagaagcuagacuuucaugcggga

SEQ ID NO: 87456 - RNA, 64 nt, Human
guaaguguaguucaguguaggugaagaaaacagcaccacugagaugaaucucauggcagaacaa

SEQ ID NO: 87457 - RNA, 64 nt, Human
uuguccucaucuacccucuaccccuuacugugcaaccacugaggcaaaguagcuuaauauaaaa

SEQ ID NO: 87458 - RNA, 64 nt, Human
aaacagaaaaaucaaaauaacauugacucuuccaaccacugacauguuguuuaauaaucuaagc

SEQ ID NO: 87459 - RNA, 64 nt, Human
auacacaguuacagagaucagucaaauccauaccaccacugagaucucauuuauugccacagau

SEQ ID NO: 87460 - RNA, 64 nt, Human
cucaacagccugugccucuggucuaccuuugaccaccacugauaacuaauauauuggucacaau

SEQ ID NO: 87461 - RNA, 64 nt, Human
aaacacagacaaaccaaagguaaccagcuagcccaccacugaaaggaaagaucugagacauggg

SEQ ID NO: 87462 - RNA, 64 nt, Human
cucugacucuuauagguuuacuaagaugaaaguuaccacugaaccuuaccacuauguauauaug

SEQ ID NO: 87463 - RNA, 64 nt, Human
agaacaguguuuccuaauguaaaaagccuuuccaaccacugaucagcauuggggccauacuaag

SEQ ID NO: 87464 - RNA, 64 nt, Human
uauuaacuguacagacuguuuacuaaggagcuaaaccacugagaaaacguuauuaaaauuguaa

SEQ ID NO: 87465 - RNA, 64 nt, Human
ccagcugguucccccaagccagcucaugcugcugaccacugacucagcucugaccuucacauuu

SEQ ID NO: 87466 - RNA, 64 nt, Human
ggcuugcagugggggugaacgcacauaaaaagggaccacugacguccugcucuacucucugcuu

SEQ ID NO: 87467 - RNA, 64 nt, Human
gggggaaaauagcuccccaagagcuggcaccaguaccacugauggcccugcuuccucugaguga

SEQ ID NO: 87468 - RNA, 64 nt, Human
agaacugccuaaggugugaaaagcugaagauucuaccacugaaguacugaauauguugucuagu

SEQ ID NO: 87469 - RNA, 64 nt, Human
uuaaaccucagcugugacaugaaagacuuaccggaccacugaaggucuucuguaaaauauaaug

SEQ ID NO: 87470 - RNA, 64 nt, Human
uucagucucuaguuucccuagagucauuuuugaaaccacugauugcaaaccucccugacaauuu

SEQ ID NO: 87471 - RNA, 64 nt, Human
cauuaauauggcauacugcagauuggagggcaggaccacugagggugucauagacauuagcucu

SEQ ID NO: 87472 - RNA, 64 nt, Human
auauuuauuuauguguucacauggucaaaauuucaccacugaaacccugcacuuagcuagaacc

SEQ ID NO: 87473 - RNA, 57 nt, Human
uaaacuccagcucuuucuagcugaguaaccacugaccugugagcuggguccaggaau

SEQ ID NO: 87474 - RNA, 64 nt, Human
guaaaaaaaaaaaaaaaaaccacaccuaaaauagaccacugaggagaccauagagcggaugcuu

SEQ ID NO: 87475 - RNA, 64 nt, Human
guccccugcgaggagaaaucacuccugggggagaaccacugacccaaaugaauucuaaaccaau

SEQ ID NO: 87476 - RNA, 64 nt, Human
ugucuccuggggccauaucaccccuccguuaagaaccacugaugucuuuuacaaaccaggaguu

SEQ ID NO: 87477 - RNA, 64 nt, Human
uaauagagcuuacauauauuuguauaacugcuauaccacugaacugaauuuauuuuacaacagu

SEQ ID NO: 87478 - RNA, 64 nt, Human
uugauagcuaagcaucugauugguuuacugcuuuaccacugagcugaaaugccguguuuuccau

SEQ ID NO: 87479 - RNA, 64 nt, Human
uugaauuccuuuauagauguacaguuuugcuuuaaccacugaagauugcuguaaauuauaaagg

SEQ ID NO: 87480 - RNA, 64 nt, Human
ggaggauggccugcucuugagguauccaggcagcaccacugauggcuccucugcucccauagug

SEQ ID NO: 87481 - RNA, 64 nt, Human
uggaaugcucaccacauguuggucgaagcggccgaccacugacuuugugacuuaggcggcugug

SEQ ID NO: 87482 - RNA, 64 nt, Human
auauuaaauccacaaacacacuauauacuuccucaccacugacuauuuuaucaaauuugccuua

SEQ ID NO: 87483 - RNA, 64 nt, Human
ugaguuaagugaaaggaaaaacagcacaauggugaccacugauaaaggcuuuauuagguauauc

SEQ ID NO: 87484 - RNA, 64 nt, Human
agaaccauaagaugguaaauuuguguuguuuuaaaccacugagucagugauaauuugcugaaga

SEQ ID NO: 87485 - RNA, 64 nt, Human
guggugauggcuacacauugugaauguaauuaacaccacugaguuaaacacuuaaaaugguuaa

SEQ ID NO: 87486 - RNA, 64 nt, Human
ugaaaccaccaauaacccacugaccacagugagaaccacugauuuuuuccacugaccuacugaa

SEQ ID NO: 87487 - RNA, 64 nt, Human
auuuucagcuacuauuugaauauucuugaacaccaccacugaagaguuucauauacaccaaaua

SEQ ID NO: 87488 - RNA, 64 nt, Human
aauaugguuuaauuaaccuuaguaacaucucaugaccacugacugcugaaaguucugaaaagaa

SEQ ID NO: 87489 - RNA, 64 nt, Human
uuugccacuucuucagauauuuuuauaaaaaaguaccacugagucagugagggccacagauugg

SEQ ID NO: 87490 - RNA, 64 nt, Human
uccugcucccuaaccuuucgccgaauggggcagcaccacugacguuucugggcggccagugcgg

SEQ ID NO: 87491 - RNA, 64 nt, Human
cuucuuuuuucuucaccaaaaccaacaugaaaguaccacugaaguaaaacaccaacuaccuacc

SEQ ID NO: 87492 - RNA, 64 nt, Human
ucagaaagauguggacagcuugauguuuuagacaaccacugaacuagaugacuguuguacugua

SEQ ID NO: 87493 - RNA, 64 nt, Human
agccaccugggaugagaugacacaaggcacuccuaccacugagcgccuuugccagguccagccu

SEQ ID NO: 87494 - RNA, 64 nt, Human
guaugauguggaagcugguuucagcccaggacccaccacugaggagaggaucuagacagguggg

SEQ ID NO: 87495 - RNA, 64 nt, Human
gccuucuuagaacucugcuuacuaauguauuaauaccacugagaccuucaggccuugccuggga

SEQ ID NO: 87496 - RNA, 64 nt, Human
uuugcaguggcucgcacugcuguggccacugcugaccacugaggcucccagcggaggguguuca

SEQ ID NO: 87497 - RNA, 64 nt, Human
uugcaaaggagcucacuguggugucuguguuccaaccacugaaucuggaccccaucugugaaua

SEQ ID NO: 87498 - RNA, 64 nt, Human
gcauuuccacaccaagcagcaacagcaaaucacgaccacugauagaugucuauucuuguuggag

SEQ ID NO: 87499 - RNA, 64 nt, Human
auacuuugacuuaaaaauaaauuuuuauauucaaaccacugauguugauacuuuuuauauacua

SEQ ID NO: 87500 - RNA, 64 nt, Human
ucuuucacuauacaggcugggaaguguguugaugaccacugagccaggcuuuucucaggagcuu

SEQ ID NO: 87501 - RNA, 64 nt, Human
auauucccuagaaacuuccaaauccccuaagcagaccacugauaaaaccauguagaaaauuugu

SEQ ID NO: 87502 - RNA, 64 nt, Human
caguggaaagaauacggacucuuaagucacaccuaccacugagcagcuguacgacuuuggagaa

SEQ ID NO: 87503 - RNA, 64 nt, Human
caccacugcaggugccagagcaaguggcacaagcaccacugauaccuccccugaaaaaaccccc

SEQ ID NO: 87504 - RNA, 64 nt, Human
ccuugcugcugcugcacccaacuacugagcugagaccacugaguaccaggggcugggcucccug

SEQ ID NO: 87505 - RNA, 64 nt, Human
accaaauuuuuuauuaagaugaguaaauauuugaaccacugaauuuuaauaacaaaauuuuaaa

SEQ ID NO: 87506 - RNA, 64 nt, Human
aaaguguacauugagacuggcagccaucuaugguaccacugaaacccugacccagaaaaguggc

SEQ ID NO: 87507 - RNA, 64 nt, Human
aaauuucaacuucaaugucaucuucuccaugaagaccacugaaugaacaccuuuucauccagcc

SEQ ID NO: 87508 - RNA, 55 nt, Human
auggggagagcgaccuuugaccccaaccacugagguucucuaugcaagauggaga

SEQ ID NO: 87509 - RNA, 64 nt, Human
gucaccuuggagggcagaccuaggagccccucugaccacugaauccgucuccacaccccuucug

SEQ ID NO: 87510 - RNA, 64 nt, Human
ugccaucccggcagcgaggcugggcuggccagccaccacugacuauaccaacugggccucugau

SEQ ID NO: 87511 - RNA, 64 nt, Human
ucuugggaugagugauucacccucuuacuuggcgaccacugaugagaucaacaacaggugaacu

SEQ ID NO: 87512 - RNA, 64 nt, Human
gucaguauuuccuucccuauaugucacagagggcaccacugagaacugcgugcauaggaccuca

SEQ ID NO: 87513 - RNA, 64 nt, Human
uggccaguuuugugcagcugacugucucagccaaaccacugaucuucccuggaggccuucggcc

SEQ ID NO: 87514 - RNA, 64 nt, Human
gcucaugguaaacagaaacagcaucuucgcuacaaccacugacaccagcuggcgucauagguag

SEQ ID NO: 87515 - RNA, 64 nt, Human
aaagagguggguaaggaguaggaagguagagagcaccacugaugaggcccuccuagcccauggc

SEQ ID NO: 87516 - RNA, 64 nt, Human
cuuuuuuguucuuuuuuccagcacaacauaacuuaccacugauacucccccuuuaguuauucug

SEQ ID NO: 87517 - RNA, 64 nt, Human
guauuggggucuuuuggcucugaaggauccuggaaccacugauuuugguuuauucccuccaggg

SEQ ID NO: 87518 - RNA, 64 nt, Human
gcuggcccaggauuucacagucgaaaaggaagccaccacugaugccucccacugugacaggccc

SEQ ID NO: 87519 - RNA, 64 nt, Human
cugccccaaaggcuggcuuccaccauccaggugcaccacugaagugaggacacaccggagccag

SEQ ID NO: 87520 - RNA, 64 nt, Human
ugcugucucugucuuugucucuaauguccuuugcaccacugaccuugaggagccuuuuguuccu

SEQ ID NO: 87521 - RNA, 64 nt, Human
gaaacauuucaacagccauaguacuauuuguuuuaccacugauugcacuguuuuguuuuuuuaa

SEQ ID NO: 87522 - RNA, 64 nt, Human
ugccccacuacagaacagggcuaaauuagccaccaccacugaaaacucagccgaauuuuuuuau

SEQ ID NO: 87523 - RNA, 64 nt, Human
cacugcgauggaggucccaaauauguggucuaucaccacugaauucauguaauagauaagaaaa

SEQ ID NO: 87524 - RNA, 64 nt, Human
guuuuccgaaagugacaguguuggucaucccaugaccacugaagcuuaguaaccagcgccaaaa

SEQ ID NO: 87525 - RNA, 64 nt, Human
cuauaugccaggcacugugcuaggugcugggaauaccacugaugagacagacaaggucccuacu

SEQ ID NO: 87526 - RNA, 64 nt, Human
cccccuuucauuucggccuaggcuuccccugcucaccacugaggccuaauacaagaguuccuau

SEQ ID NO: 87527 - RNA, 64 nt, Human
auauugcagauaaguagauaaggauagaagaucaaccacugacugguaguaaugguuuucugug

SEQ ID NO: 87528 - RNA, 64 nt, Human
uuauguuaucagauuaugcuauuuuguauaaagcaccacugauagcaaaucucucuccaaaauu

SEQ ID NO: 87529 - RNA, 64 nt, Human
uuuguauuauagucuaauauacaggguagcagguaccacugauuuggagauauuuaugggggga

SEQ ID NO: 87530 - RNA, 64 nt, Human
auucuguuccacugcucuucucugguucauguccaccacugacugggacccugaagaggcauuu

SEQ ID NO: 87531 - RNA, 64 nt, Human
uacuacaucuuucuggcacauaacugucuccuuaaccacugaacaguucagccauuugaauaaa

SEQ ID NO: 87532 - RNA, 64 nt, Human
gccaaggccacauccccgugcuuccagugaccagaccacugaccacccugacuguccaaaccug

SEQ ID NO: 87533 - RNA, 64 nt, Human
gagucuccaguucugcucuggccuacuaacuguuaccacugagagaacaacauguucauuugac

SEQ ID NO: 87534 - RNA, 64 nt, Human
cuguucuuguaguuuucugcauagauaaguaagcaccacugaagcaccucuguggcuugauauu

SEQ ID NO: 87535 - RNA, 64 nt, Human
guuugcuaaaacgugaaacacuguaacacuuuuaaccacugagcauuccacagugaaauguuau

SEQ ID NO: 87536 - RNA, 64 nt, Human
guugcagaauggaguuuccauggauuucuaccagaccacugaaggaguuccuggaagcccugcg

SEQ ID NO: 87537 - RNA, 64 nt, Human
aaagagccagguauuuaccugaugagcagaggggaccacugauuggcagaaaacuucccuacgu

SEQ ID NO: 87538 - RNA, 64 nt, Human
agggagaaugcuuggaaagguugcauugguugaaaccacugaggagcaucacccuggggauuuc

SEQ ID NO: 87539 - RNA, 64 nt, Human
gcacaugauugagaacaucuugggacagaccaaaaccacugacagauggcaaggcucggcgauu

SEQ ID NO: 87540 - RNA, 64 nt, Human
auuaagggguuugcugcugaaaaaaaguuggaaaaccacugacuagaccaucggcuccaaauug

SEQ ID NO: 87541 - RNA, 64 nt, Human
caugcuggccuucuaaauagcugguacauccaucaccacugacgggccuggccuggaaaccugg

SEQ ID NO: 87542 - RNA, 64 nt, Human
aggaaguugauucuuauuugauggugguauugugaccacugaauucacuccagucaacagauuc

SEQ ID NO: 87543 - RNA, 64 nt, Human
ccuugcccaacucccagccaccaccacugucccuaccacugagcccuugcacaggccacuugcu

SEQ ID NO: 87544 - RNA, 64 nt, Human
aaaggaaaaauauaucccugguaguuuuguguuaaccacugauaacuguggaaagagcuagguc

SEQ ID NO: 87545 - RNA, 64 nt, Human
uaaaggcacaacuaaaugcuuuauuaccuuucuuaccacugaacaauuugagguaaaaucauuc

SEQ ID NO: 87546 - RNA, 64 nt, Human
uccucuaacucauugaacuaucaaauuauaggcaaccacugacuagacugauaugagaugaggc

SEQ ID NO: 87547 - RNA, 64 nt, Human
aacuccacugggacgcugguuuggcauuuacuaaaccacugagcacauggggucuuucaggauc

SEQ ID NO: 87548 - RNA, 64 nt, Human
cauuuccggagccccacggggcacgcguuaggaaaccacugagaaaagacgaaaauggcaccag

SEQ ID NO: 87549 - RNA, 64 nt, Human
guuuuaauuacauuugaauaauuauauuuuuccaaccacugauuacuuuucaggaauuuaauua

SEQ ID NO: 87550 - RNA, 64 nt, Human
ccaggaguucaaggcugcagugaauucugaucgcaccacugaacuccagcccguaugacagagu

SEQ ID NO: 87551 - RNA, 64 nt, Human
agccuuccuuuguuccucaaaccccaucugucagaccacugaacaaauacacauacuaggccuc

SEQ ID NO: 87552 - RNA, 64 nt, Human
cuugaauuaaauauauuguuacaauuaaacugauaccacugaauuguaugcauuauucuugaau

SEQ ID NO: 87553 - RNA, 64 nt, Human
cucagaaucacaccucccggcugcugcugagagcaccacugaacuuagaccucucaacacagua

SEQ ID NO: 87554 - RNA, 64 nt, Human
gaugaguaauuguuauugaagauagucagugauaaccacugaccagaugcuaucaauacacuau

SEQ ID NO: 87555 - RNA, 64 nt, Human
gaaaacuaaagaaugcaaaacuuuugcuauucauaccacugauguucaucaaaaguaugcgauc

SEQ ID NO: 87556 - RNA, 64 nt, Human
guaaagggcauacauuuccugcuuucaccaauuaaccacugaauugcuauuuuuuccuuuuggc

SEQ ID NO: 87557 - RNA, 64 nt, Human
gggaacugggggaccugggccucaggccugcuccaccacugacucaccgaaugaccuugggcaa

SEQ ID NO: 87558 - RNA, 64 nt, Human
ccuuccacuucgucuccccuagcuccuagaagcaaccacugaugugauuucuaccaaauccagu

SEQ ID NO: 87559 - RNA, 64 nt, Human
auuucuggguugggucaucuuguuggauaguaguaccacugagauagggaauucaagguuuggg

SEQ ID NO: 87560 - RNA, 64 nt, Human
auguacuacacuucugaaacuuaacgugaucaucaccacugacagaugauucacagagacuguu

SEQ ID NO: 87561 - RNA, 64 nt, Human
cucggcacuccugggcuuccgaugcucccucugaaccacugaaagcugugauguccaagggggc

SEQ ID NO: 87562 - RNA, 64 nt, Human
uaaaugcugaaugacauucaagcugauuuucuagaccacugagaaaaucuuuauuuacaauaaa

SEQ ID NO: 87563 - RNA, 64 nt, Human
aucucuucccuccaguguaugcucugccuuuuuaaccacugacauguaaggaggacuacugucu

SEQ ID NO: 87564 - RNA, 64 nt, Human
ccugcacguguccagggacacugcauuucaaagaaccacugagugggugagcuaccuugggcaa

SEQ ID NO: 87565 - RNA, 64 nt, Human
uuguugcagauucugguuaagcagaggcuucagaaccacugaacuugaaacuuacccucuaggg

SEQ ID NO: 87566 - RNA, 64 nt, Human
caaacuccucaugauaacugcacacaaucugaaaaccacugaaggacaagccaaccacagcagc

SEQ ID NO: 87567 - RNA, 64 nt, Human
gcugcggcccacgcuguuccgguuggcgagugacaccacugaugacgaugaugcacucgguaag

SEQ ID NO: 87568 - RNA, 64 nt, Human
agacagacuuauuuuuuauucuaaugaugguagcaccacugaucuuggauguacauuuauguau

SEQ ID NO: 87569 - RNA, 64 nt, Human
aacacuaauauauuuaaaaauaagucaacaguaaaccacugaaaaaauauauguauauacaccc

SEQ ID NO: 87570 - RNA, 64 nt, Human
ccaucucaguuuuccuggacccugcuuccuguguaccacugaggggcagcugggccaggagcug

SEQ ID NO: 87571 - RNA, 64 nt, Human
cagagccaccgcaacucugcccagcgggagugacaccacugaugccacagaagccuuuaucguu

SEQ ID NO: 87572 - RNA, 64 nt, Human
uugggaucaugaccaggaaucacgugaagcugacaccacugaagggagaguugagaggcagaaa

SEQ ID NO: 87573 - RNA, 64 nt, Human
agaaaaucuaccaagaacagagucucaggacagaaccacugagucuuuuggaggcuccaagccu

SEQ ID NO: 87574 - RNA, 64 nt, Human
ucgauguaagauuccuccuuuagggcagagacagaccacugacaaauacacagauagacaagga

SEQ ID NO: 87575 - RNA, 64 nt, Human
uucacuuauuuaucccucccgccgugcccuggcaaccacugaucuuuuuacugucucuacaguu

SEQ ID NO: 87576 - RNA, 64 nt, Human
acuuucccaccuccuugcuuuuucuuucacugauaccacugaauggaacuggugcugugacucc

SEQ ID NO: 87577 - RNA, 64 nt, Human
gaagggaucuacuauaggaaugaaguauuuauaaaccacugaaagggauagagaagugaacauu

SEQ ID NO: 87578 - RNA, 64 nt, Human
ccaaauguaguccuaaauugcaauuaugagggcuaccacugaaucauuuuaucuuucagccaau

SEQ ID NO: 87579 - RNA, 64 nt, Human
cccaaguuauggaggagguuaagucuacauuuccaccacugagcacaauacaaauguucuuuac

SEQ ID NO: 87580 - RNA, 64 nt, Human
cuauaugcgacacaaaaugaagaccuuucccuccaccacugaugcagucccaccgaaagccucc

SEQ ID NO: 87581 - RNA, 64 nt, Human
ugaacaucaucaacccaguaauaaugauuugaacaccacugagaagcgugcagcugagaggcau

SEQ ID NO: 87582 - RNA, 64 nt, Human
agcucacagagggacugucaucuaaaccaggggaaccacugaacuaaagcccaauuugcuugca

SEQ ID NO: 87583 - RNA, 64 nt, Human
accacauaauuuuauuaaaacgaagggaaaagggaccacugaauugcaccauuuaagaugcugc

SEQ ID NO: 87584 - RNA, 64 nt, Human
gaacucagaacuuaaauccugcacguggcacuccaccacugacuggaccgagcuggcauauguu

SEQ ID NO: 87585 - RNA, 64 nt, Human
uuccucaugucuauuaauauucccaauccuaggcaccacugaguuguuuucugucuuuauaagu

SEQ ID NO: 87586 - RNA, 64 nt, Human
aacacacaaaauaccaaaggaacuuacgcaacacaccacugaguccucuaacuaaucauaugug

SEQ ID NO: 87587 - RNA, 64 nt, Human
gguuuguacucucacuuaugucacuguuuauaccaccacugacugcugccugcuuuauuauuuc

SEQ ID NO: 87588 - RNA, 64 nt, Human
cacucuuccuucucccucuccccgucccaucccaaccacugaucugcucaggcaacuaccaauc

SEQ ID NO: 87589 - RNA, 64 nt, Human
uccuuuuaucuuauuaauaaaaauguuggucuccaccacugacuacaaugauuuccccauggau

SEQ ID NO: 87590 - RNA, 64 nt, Human
ucaaaaggaauaauucaaaagacuuaggacaauuaccacugaaacacuucgagcuauuuagcua

SEQ ID NO: 87591 - RNA, 64 nt, Human
acaaucuauuuuguuacuugcacuuguuauucgaaccacugagagcgagaugggaagcauagau

SEQ ID NO: 87592 - RNA, 64 nt, Human
uguauaugguugcuuaauuguucugugauugaggaccacugaaaaauaagucuuaauaaauguu

SEQ ID NO: 87593 - RNA, 64 nt, Human
cagacaguagacacagugcccguccuggaguugcaccacugauagucacagcacacaaugauug

SEQ ID NO: 87594 - RNA, 64 nt, Human
agacacugacuguuuuuguccuauuaagaaguagaccacugagaagggagaaggugacauuuua

SEQ ID NO: 87595 - RNA, 64 nt, Human
auacacaucuaucaggcacagggcggaggugggcaccacugaguugcacucagcaaacacauug

SEQ ID NO: 87596 - RNA, 64 nt, Human
ucuuccagaaggggugaaaggguugcaggucccgaccacugacccuucccggcugcccucccuc

SEQ ID NO: 87597 - RNA, 64 nt, Human
agaauuccuauuagcgaaauaguuuuuuaauauaaccacugaagaaaaucuguggugagaggaa

SEQ ID NO: 87598 - RNA, 64 nt, Human
cucagugcucgccuucccccagaaucccuaggcaaccacugaguaguuuucacuguagguaaau

SEQ ID NO: 87599 - RNA, 64 nt, Human
cauacaauaugugguuucuugugucuggcuuuuuaccacugaacguuuucagaguucauccaug

SEQ ID NO: 87600 - RNA, 58 nt, Human
cggaucacaagcccaccugacccaccugaccacugaccgccccuauuuauucguccgc

SEQ ID NO: 87601 - RNA, 64 nt, Human
uuugucaaacaccuuuaaaaggggagaaaaaaugaccacugaacuuacauuaagagaauuuaca

SEQ ID NO: 87602 - RNA, 64 nt, Human
cccaggccccucuguaccauccccuccccuccgcaccacugaccucuugucuccuguuguuucu

SEQ ID NO: 87603 - RNA, 64 nt, Human
uuuuucacuuuaaaaaaaugacuuuuuuuuuuuuaccacugauaguauuucauauggucccuca

SEQ ID NO: 87604 - RNA, 64 nt, Human
ugggccacacugucuggacucaaagcccagcuccaccacugagcacccgugugacucuuuccau

SEQ ID NO: 87605 - RNA, 64 nt, Human
gggggcccauucuggcagcggcgccugcggccugaccacugauuguagggaugccguucccccc

SEQ ID NO: 87606 - RNA, 64 nt, Human
cuccccucucucccugguccccucccccauccccaccacugauaucauggggaguaauaggacc

SEQ ID NO: 87607 - RNA, 64 nt, Human
agugagguuuccgagccucucccugcccauccucaccacugaggccacgacaaagcacagcucc

SEQ ID NO: 87608 - RNA, 64 nt, Human
ccccugcaaggaagguccaagcaggcccuuagggaccacugaaugccccgaucccaaucagguu

SEQ ID NO: 87609 - RNA, 64 nt, Human
agcaccaucaggguuuuaauggcccucuagaauuaccacugagauacacuauuugauccaugga

SEQ ID NO: 87610 - RNA, 64 nt, Human
gugucaucuguccacagugauaccugccaagaugaccacugacccacaucuggucuuagucauu

SEQ ID NO: 87611 - RNA, 64 nt, Human
gccugaccuucacucugugguuggggcggugagaaccacugagguccaaugaugagacuuggag

SEQ ID NO: 87612 - RNA, 64 nt, Human
gguccagguccuuuccacccugagacuuggcuccaccacugauauccuccuuuggggaaaggcu

SEQ ID NO: 87613 - RNA, 64 nt, Human
ugcguguuugcauagcauaaaaucaguagacaacaccacugaggucguuacgaucaacgauauc

SEQ ID NO: 87614 - RNA, 64 nt, Human
aucaggaauguuuugguacuguguuuucacucaaaccacugacuuaacagauacugcuguguau

SEQ ID NO: 87615 - RNA, 64 nt, Human
aggagggauuugcaguuacuugggcaacaagguaaccacugaucauuacaggaagcuucagaaa

SEQ ID NO: 87616 - RNA, 64 nt, Human
aacacaguaccuaagacuaaugcuuucuguggacaccacugagcucugccucaacuccacccuc

SEQ ID NO: 87617 - RNA, 64 nt, Human
uuuuuuuuuuuauacccuaguuggucacccugucaccacugaaccuugauuuaacagaggcaaa

SEQ ID NO: 87618 - RNA, 64 nt, Human
agagagagagucuuggccauggcuuuccugcaagaccacugacgagcagucccauggugauaaa

SEQ ID NO: 87619 - RNA, 64 nt, Human
auaggcuggcaggcagcugagaugaacugucuuuaccacugaugaggggccucugccggcugag

SEQ ID NO: 87620 - RNA, 64 nt, Human
gucugcuguaugagagguaggacuggauuaaaugaccacugaacucacugaauccagaucauuc

SEQ ID NO: 87621 - RNA, 64 nt, Human
gaggggccucggccucagagucaugugcccugugaccacugaagggugucagcagagcacacgg

SEQ ID NO: 87622 - RNA, 64 nt, Human
ugaggagcugggacaugugacaggcugugguggcaccacugagccuagaccauggagccuuggc

SEQ ID NO: 87623 - RNA, 64 nt, Human
cugggcccuaggagcccuguaacucccaggagagaccacugaaaauacuggagcaacaaugccc

SEQ ID NO: 87624 - RNA, 64 nt, Human
uguacaaaauggaauucauucuggucucucuauuaccacugaagauagaagaaaaaagaauguc

SEQ ID NO: 87625 - RNA, 64 nt, Human
aauuaaucuauauugguugacaaacaagccaccaaccacugacugcaaaacugccugaugcagu

SEQ ID NO: 87626 - RNA, 64 nt, Human
guuuugaaagaagaacacaauuuacaauuuuggaaccacugacuccuuucucuuguuuuguaac

SEQ ID NO: 87627 - RNA, 64 nt, Human
auauuuuucuuaaaaaguaacuccuaguagggguaccacugaaucuguacagagccguaaaaac

SEQ ID NO: 87628 - RNA, 64 nt, Human
ggaggcugaggcugcaaugagcuauaauuauugcaccacugaacuccagccugggccacauagc

SEQ ID NO: 87629 - RNA, 64 nt, Human
ugaaagugaaaagcaaucaauuauacccaccaacaccacugaaaucauaagcuauucacgacuc

SEQ ID NO: 87630 - RNA, 64 nt, Human
acucccuaucuuccccuccaccuguccgcuggcaaccacugaucuccuuuuuauuucuguggcu

SEQ ID NO: 87631 - RNA, 64 nt, Human
agaacaacacuacccuccucucuucccagaugugaccacugagggcaguucugaguguuuaauu

SEQ ID NO: 87632 - RNA, 64 nt, Human
uuccugcaucuugggacacuccuucccugucuauaccacugacucuugcucugguuguuguacu

SEQ ID NO: 87633 - RNA, 64 nt, Human
aacaaugacacacacacaacaaaacaaacacaaaaccacugaucugugauugcucucccuuugu

SEQ ID NO: 87634 - RNA, 64 nt, Human
guuuugauaaguaauuacacuggaccuaggcaaaaccacugaagaacaaguguuccuuuuuacc

SEQ ID NO: 87635 - RNA, 64 nt, Human
gccuauaaauuuaaucauaaugauguuauuguuuaccacugagguguuaauauaacauaguauu

SEQ ID NO: 87636 - RNA, 64 nt, Human
cauaaugcauauggucaucauucuagaccugauaaccacugagaaccugcugagcaaggacggc

SEQ ID NO: 87637 - RNA, 64 nt, Human
ucacacauggagaaaccaaauuggacaaaucaucaccacugauggcgaugauuacaauaaaauc

SEQ ID NO: 87638 - RNA, 64 nt, Human
auugagagcgcucuucugauucaaauguaagcaaaccacugaugaccacugguccguauaacac

SEQ ID NO: 87639 - RNA, 64 nt, Human
uccuagcuccgcugcauucugcaucccaagugggcacguggaggaagggucugaaggaaggcuc

SEQ ID NO: 87640 - RNA, 64 nt, Human
aggcugccguggagcacggauacagaaacugagacacguggagacuggaugagggcagaugagg

SEQ ID NO: 87641 - RNA, 64 nt, Human
gucgaugucucagaacacucucccagcuguggaccacguggaccacuuagcagacucagggggu

SEQ ID NO: 87642 - RNA, 64 nt, Human
cuuaaggcacagugggagcugagcuggaaggggccacguggaugggcaaagcuugucaaagaug

SEQ ID NO: 87643 - RNA, 64 nt, Human
gcuucucuuauccuccagaauagagaccuaaggacacguggaagucaguuuaauugccagagag

SEQ ID NO: 87644 - RNA, 64 nt, Human
ggcugugucuuucuaucacggauuuccacccggacacguggaacccggccuggucugucuccac

SEQ ID NO: 87645 - RNA, 64 nt, Human
gucuccagccugcccagcaccggcagcuguggagcacguggaugcugccuaccccggcgcccgc

SEQ ID NO: 87646 - RNA, 64 nt, Human
gcacgacuuuguacucagaaauugaacucucagucacguggaagccacgggacugcuccgaagc

SEQ ID NO: 87647 - RNA, 64 nt, Human
cuucaccagcccugauggagagggcagcagcugccacguggaggaagcucaauaucagcuggga

SEQ ID NO: 87648 - RNA, 64 nt, Human
uucccuucucuauccuuccccgugguacugagcucacguggacucccagugcgaaggggcccau

SEQ ID NO: 87649 - RNA, 57 nt, Human
agggaaacccucgguugugauuucauucacguggaugcugcaagcagagagacugcc

SEQ ID NO: 87650 - RNA, 64 nt, Human
gagccaagggauugacaaacaacagagccuugaccacguggagucucugaaucagccuugucug

SEQ ID NO: 87651 - RNA, 64 nt, Human
guuuugugaaaugguccuguuuuuggguaggugacacguggacucuaguauguaaauguuacuu

SEQ ID NO: 87652 - RNA, 64 nt, Human
auuuagcagggaauggaauccauuccaacuauugcacguggauuucccagcugccccuaaauau

SEQ ID NO: 87653 - RNA, 64 nt, Human
acccugaucuggaagacagggccccggcuggacacacguggaaccaagccagggaugggcuggc

SEQ ID NO: 87654 - RNA, 64 nt, Human
gcaucgcucaagcuggggggugguguguaagaagcacguggagccacaagaggcaccuccuaua

SEQ ID NO: 87655 - RNA, 64 nt, Human
uccuuacccagcaccccuccgguagguggguggccacguggaugccucgcuggggcggucuugg

SEQ ID NO: 87656 - RNA, 64 nt, Human
uuugcucuuccccaaggaacugcucccaccucagcacguggaggccucucacgguccuccuucc

SEQ ID NO: 87657 - RNA, 64 nt, Human
ggaaguucugccuuucugaucaaucuuuuggguucacguggaaaccaggacuuggcaacaugau

SEQ ID NO: 87658 - RNA, 64 nt, Human
uguggucuccugaagggagcgccuccuccaacaacacguggaucugcaugguuugccugagcuu

SEQ ID NO: 87659 - RNA, 64 nt, Human
uggaaagcaggguuccucugccugcuaacaagcccacguggaccagucugaaugucuuuccuuu

SEQ ID NO: 87660 - RNA, 64 nt, Human
gaacagcuccuccucuuggagcugagaugagccccacguggagcucgggacggauaguagacag

SEQ ID NO: 87661 - RNA, 64 nt, Human
gacgugccuucugccaugauugugaaguucuagccacguggaacugugaguccauuaaaccucu

SEQ ID NO: 87662 - RNA, 64 nt, Human
uuuccuccccaggcaggcaggaggccgcggggagcacguggaaaguuggcugcugccuggggaa

SEQ ID NO: 87663 - RNA, 64 nt, Human
augagaaaaaagaacaguuucuuccaugugcuggcacguggaugauuagaaaaaaagaaaaagu

SEQ ID NO: 87664 - RNA, 64 nt, Human
ugcagaggaguuugggagguguaaacagcccaugcacguggaggaggagcuggcuuucagcccc

SEQ ID NO: 87665 - RNA, 64 nt, Human
cuagugccucugcuuggggaggagaaccucuguccacguggaggcuaggaggucucaggugcug

SEQ ID NO: 87666 - RNA, 64 nt, Human
gugcugcccuguccccagggaagagaaugaggaccacguggacuccgcccacacagagcuggcu

SEQ ID NO: 87667 - RNA, 64 nt, Human
cagcucagccuguggcucuugaggccgugguucccacguggacugggaggcagucucagccacc

SEQ ID NO: 87668 - RNA, 64 nt, Human
auggcagcauggggaggcucacacacagaaguugcacguggacaucuguuuuaaucagcacaag

SEQ ID NO: 87669 - RNA, 64 nt, Human
ccuaucccgugaguggauugugagaaauuccacccacguggagacagcuuacugcagcacuguu

SEQ ID NO: 87670 - RNA, 64 nt, Human
aggugcuggcaugauggagguggugcaccuuggacacguggacaaggcccaggcgcccucugcu

SEQ ID NO: 87671 - RNA, 64 nt, Human
acacaguauucgugaauaaguugauucugucccccacguggacucugugcucacccauugucuc

SEQ ID NO: 87672 - RNA, 64 nt, Human
ucccugagugucaggggaggcugugggacuucaccacguggacaaacgaaagcacaggcuacuc

SEQ ID NO: 87673 - RNA, 64 nt, Human
ggcccagcuagauaaugacuuguccaagauggcacacguggaaaguugaucugcaccagaaccc

SEQ ID NO: 87674 - RNA, 64 nt, Human
gaccugggaugaagaugaaugaagaacauggaugcacguggauguaguuuggcucagguguccc

SEQ ID NO: 87675 - RNA, 64 nt, Human
acacacacugggccaugcuugccaaggaacagcccacguggacaugccagucggaucaugaguu

SEQ ID NO: 87676 - RNA, 64 nt, Human
cagcacuuucagcgcaagaucucccugauuuugccacguggaauuguacuuguauaugauuacc

SEQ ID NO: 87677 - RNA, 64 nt, Human
uauaaugcauaugugcuuagaaauaaacagguuucacguggacucaauaaaccuggcuuuauuc

SEQ ID NO: 87678 - RNA, 64 nt, Human
ggcuaacaggcuugucugccugguuuuccuccuacacguggacauuauucuccugauccuccua

SEQ ID NO: 87679 - RNA, 64 nt, Human
auauucucacuuguaagugggagcuaaaugagaacacguggacacauagagggaaacaacacac

SEQ ID NO: 87680 - RNA, 64 nt, Human
aaaugaauguaugcccaccagagcagacaucuuccacguggagaagcugcagcucuggaaagag

SEQ ID NO: 87681 - RNA, 64 nt, Human
aguuuugcauggucuaaauuguguuuauuccaaccacguggaaagcuccuggaaagaaauuuua

SEQ ID NO: 87682 - RNA, 61 nt, Human
gccccaucgagcuggacugaacuggccaggccacguggagacaccacggucgacgacggcu

SEQ ID NO: 87683 - RNA, 64 nt, Human
cuggaggccccagcccuccguggacagcaggggccacguggagcccgggccgcucacccgccac

SEQ ID NO: 87684 - RNA, 64 nt, Human
gucuucaguugagcucucagccuuaggaaggaagcacguggaggagggacggaggagguucccu

SEQ ID NO: 87685 - RNA, 64 nt, Human
aggugcuuccaucuguggugacuggaaugggacccacguggaguaggugacauaugcuucccag

SEQ ID NO: 87686 - RNA, 64 nt, Human
gcugaagaauauauggaaaggguggcauuugcgucacguggaccagggacagugcugaaaucag

SEQ ID NO: 87687 - RNA, 64 nt, Human
ugaaaagcugugcuugagacuuagguacuuuucucacguggacacacugaucccaucccauauu

SEQ ID NO: 87688 - RNA, 64 nt, Human
aggaaugggccaugccgucucacccacaguaucacacguggaaccgcagacagggcccagaagc

SEQ ID NO: 87689 - RNA, 64 nt, Human
acagacacaguggagccgcgcucuucuccagugacacguggacaaaugcgggcucaucagcccc

SEQ ID NO: 87690 - RNA, 64 nt, Human
cauuuuaaaaacaaaaacauaauaaucguuacaacacguggaguuuuacuaacauacauauuaa

SEQ ID NO: 87691 - RNA, 64 nt, Human
uugcaguaucagaggguggagaugucagucuguccacguggagagaaguugcccuccaggccga

SEQ ID NO: 87692 - RNA, 64 nt, Human
cgaacaggaauggagagaggacucaacugggacccacguggaaaagaccgagcaggccacagag

SEQ ID NO: 87693 - RNA, 64 nt, Human
agccuccaaaaguuaagugaaaauuagucaacugcacguggaagcccccaccacuuuggggauc

SEQ ID NO: 87694 - RNA, 64 nt, Human
ggaaacacccagggccgggcggcugcuguuuccacacguggacucggaucugcugugacaccgu

SEQ ID NO: 87695 - RNA, 64 nt, Human
ccccaccuuagaaggguccccgccuuagaucaaucacguggacacuaaggcacguuuuagaguc

SEQ ID NO: 87696 - RNA, 64 nt, Human
ugaaauaauauuucugguauuuucuucauuauaacacguggaauggaacaguggcuagagguau

SEQ ID NO: 87697 - RNA, 64 nt, Human
ucuucugccaacuaacgugcucgcgcccucccagcacguggagagcuucaauugucagauaaac

SEQ ID NO: 87698 - RNA, 64 nt, Human
agcaccagcugggaggcauaggcuaggacaggcccacguggaggcugggcaggaagggccugcu

SEQ ID NO: 87699 - RNA, 64 nt, Human
ucucugcuggacguccagguggagguggcauccccacguggacaagaaagucaaugucaaugaa

SEQ ID NO: 87700 - RNA, 64 nt, Human
aaaacaaaacaaaaaaaaaagcuuggaacuccaucacguggaaaaacuagauccuguugguuau

SEQ ID NO: 87701 - RNA, 64 nt, Human
aucaucauccuuagucaagcagcagggcccuggccacguggagcaacacugacuagaaucugga

SEQ ID NO: 87702 - RNA, 64 nt, Human
cgccucggcgaggcgcgagacaggcgcugcugcucacguggagacgcucucgaagcagaguuga

SEQ ID NO: 87703 - RNA, 64 nt, Human
ggacagcuguccuucagaaagcacacggucaauccacguggaccgucucccucgcaggaacucc

SEQ ID NO: 87704 - RNA, 64 nt, Human
caguugguacaucuaaacucccuccauccugacucacguggacuuagauauguuuuguuucuau

SEQ ID NO: 87705 - RNA, 64 nt, Human
guacccugcacuccgggaggaggccccaagggaacacguggagagcuucuuccagguacuuggg

SEQ ID NO: 87706 - RNA, 64 nt, Human
cgagccuuccuuucacacagaccaccccggaggacacguggaugauggggucagagaucacuga

SEQ ID NO: 87707 - RNA, 64 nt, Human
accucccaaggacuuuccagugaggaaauggcaacacguggaggugaagucccuguucucagcu

SEQ ID NO: 87708 - RNA, 64 nt, Human
ccaagagaccaggcccgggcagcagccuaccggccacguggaacacuggcuccggaguuauucu

SEQ ID NO: 87709 - RNA, 64 nt, Human
gcagucaggugggcggugugucuuuccagaaggucacguggaaaugucucgggacuuggguccc

SEQ ID NO: 87710 - RNA, 64 nt, Human
gugucagaauauacucaggacuccagaggugucacacguggaacugacaggagacccgccaccg

SEQ ID NO: 87711 - RNA, 64 nt, Human
caagggcucagccucucugcccacagagugcccccacguggaacauucuggagcuggccauccc

SEQ ID NO: 87712 - RNA, 64 nt, Human
aaucacuuagcagcaacugaagacaauuaucaaccacguggagaaaaucaaaccgagcagggcu

SEQ ID NO: 87713 - RNA, 64 nt, Human
auucaucuuucaaaagguuacacaaaauuacugucacguggauuuugucaaggagaaucauaaa

SEQ ID NO: 87714 - RNA, 64 nt, Human
guuucuccuaaaucugaagaacgaugggaaaaugcacguggagaugaaaccagauuuuuaaaaa

SEQ ID NO: 87715 - RNA, 64 nt, Human
cugcucucuccaagcagguggcccagaucccacccacguggacuuucucaucaggugcagcgcc

SEQ ID NO: 87716 - RNA, 64 nt, Human
ccaagcuucagagacccuuugggguuccacacuucacguggacugagguagacccugcaugaag

SEQ ID NO: 87717 - RNA, 64 nt, Human
cuugcagagggguucagguuccucuuuuuccugccacguggaucaggucuguuccuguuacugu

SEQ ID NO: 87718 - RNA, 64 nt, Human
gcaugggggaagggcauaaagaaucauuuauaugcacguggagacuccuuucucaucuggggcu

SEQ ID NO: 87719 - RNA, 64 nt, Human
ccguggcuugguacacacuguuucauccaguggccacguggaagcuuuguagcauugagcagau

SEQ ID NO: 87720 - RNA, 64 nt, Human
ccccggaugccccacuaguccaacuucauggcugcacguggauggacccccaugucugagaggg

SEQ ID NO: 87721 - RNA, 64 nt, Human
ugguggggccagagaguccccagcuagggaccugcacguggacgugggcaccucaguagcggag

SEQ ID NO: 87722 - RNA, 64 nt, Human
gaucuggcgaagcucaggcaaaaacaccaccaaucacguggaaguuaauuuuauaaaaaaauuu

SEQ ID NO: 87723 - RNA, 64 nt, Human
uuugaugacuguacaacaggaagacuugaaaaaucacguggauucauauuaccaccgcucucau

SEQ ID NO: 87724 - RNA, 55 nt, Human
cccgauuccuggaaguaugauggaucacguggaaagugaccagauggccgucaua

SEQ ID NO: 87725 - RNA, 64 nt, Human
ccacacccgccccugugcucugcugucuggaggccacguggauguucaugagaugcauucucuu

SEQ ID NO: 87726 - RNA, 64 nt, Human
cuuccccgcccgcccugccagaaggccgaggaggcacguggagggccuccuuccugcaauucuu

SEQ ID NO: 87727 - RNA, 64 nt, Human
aguguuuggacaaaaacuacaugaucucaaaaugcacguggaugugagacacaaaaguugacaa

SEQ ID NO: 87728 - RNA, 64 nt, Human
ucaagggaaggaagugucguugcuguuagagccucacguggaggagucacuuaaacaccaguuu

SEQ ID NO: 87729 - RNA, 64 nt, Human
agacuggagacagggcaaugagucugguggggggcacguggacaugccccauaggggccccacc

SEQ ID NO: 87730 - RNA, 64 nt, Human
guaaccuaacauagucacaggcucuggggacugucacguggacaucuuugggaggccguuauuc

SEQ ID NO: 87731 - RNA, 64 nt, Human
uuuuucuuuugcacaucuuccugaguugaauguccacguggaauggggucaugaauuauaaaag

SEQ ID NO: 87732 - RNA, 64 nt, Human
ccuguggaugagcccucagaacccuuggcuugcccacguggaaaagggauagagguuggguuuc

SEQ ID NO: 87733 - RNA, 64 nt, Human
ggcaacagcagugugggcugcagggcuccgucugcacguggacuugcccuggaccuugagugug

SEQ ID NO: 87734 - RNA, 64 nt, Human
ucagauucugcucuuggcacucagcugugggcugcacguggagcugucccgugcgguaguagcu

SEQ ID NO: 87735 - RNA, 64 nt, Human
auccagggcucugaccaguuuaaccugaugcagucacguggaggagcagugcaggcacaguaug

SEQ ID NO: 87736 - RNA, 64 nt, Human
cacccgccugacaccgugggucauuacaaaaaaacacguggagauggaaauuuuuaccuuuauc

SEQ ID NO: 87737 - RNA, 64 nt, Human
gcccaaggcauguuuugcccaccagaucauggcccacguggaggcccaccugccucugucucac

SEQ ID NO: 87738 - RNA, 64 nt, Human
gguggccuggaggcaggcgccgggagcgcaguagcacguggacugggcaggauguugcacuagc

SEQ ID NO: 87739 - RNA, 64 nt, Human
ugcugccagugagaaggcaccccuccguguggagcacguggagauagugccagguggcucagug

SEQ ID NO: 87740 - RNA, 64 nt, Human
gcagaaggaggccagcacgcagccccuccagcuccacguggagacagaagggaucccggcacau

SEQ ID NO: 87741 - RNA, 64 nt, Human
cuaacucccucgguaggugauguaggaccaggggcacguggaacuucugggccuugcuggugau

SEQ ID NO: 87742 - RNA, 64 nt, Human
gguuuggugaaugugggugugucagcguggcagccacguggaagcagggcauguagcaggccag

SEQ ID NO: 87743 - RNA, 64 nt, Human
ccccugccagaggcucaggccugggucuaaggggcacguggagcaagagauccugguccccucc

SEQ ID NO: 87744 - RNA, 64 nt, Human
ugaugucguccaggcguccugggaucaggguagacacguggagugcuggugcugagcuguuuga

SEQ ID NO: 87745 - RNA, 64 nt, Human
uacccccugcuugcucaaucgaucacgacccucucacguggacccccuuagaguugugagcccu

SEQ ID NO: 87746 - RNA, 64 nt, Human
ggguggcugcauguuaccguccccuaccucuccccacguggaggguggagcaguuaugagggag

SEQ ID NO: 87747 - RNA, 64 nt, Human
uuuaaggcucugacagauaccacgaaacaugaagcacguggaacuacaagacccccggggucuu

SEQ ID NO: 87748 - RNA, 64 nt, Human
gaccaaugcccgcucuuggggagugaggauucugcacguggaugguacccuuucugugcugggc

SEQ ID NO: 87749 - RNA, 64 nt, Human
ggaagauggaacaggcucagaucucaugggauagcacguggagcucuuggcuggggcugacccu

SEQ ID NO: 87750 - RNA, 64 nt, Human
gaggcuggagcuggcgucugucuucaagggcuuacacguggaggaaugcucccccauccucccc

SEQ ID NO: 87751 - RNA, 64 nt, Human
gcggcccccacuugguggccggacaguggcugagcacguggaagccauugagggcagcguccag

SEQ ID NO: 87752 - RNA, 64 nt, Human
gugagccccaaaauugggguucagcgugggaggccacguggauucuuggcuuuguacaggaaga

SEQ ID NO: 87753 - RNA, 64 nt, Human
ucccgccccaucuuaauguauaaccaacaccaaacacguggaucaacagaaaaggaaaauuuca

SEQ ID NO: 87754 - RNA, 64 nt, Human
gggcacuuuccaggcuaugggugucugaugucuccacguggaagaggugggggaaagaggaguu

SEQ ID NO: 87755 - RNA, 64 nt, Human
uauaugaaacauucuuucugagauauaucaaccacacguggaaaagccuuucagucauacaugc

SEQ ID NO: 87756 - RNA, 64 nt, Human
caggaucauccuuccucuguuccucuuucccugccacguggaaacaaucaucagauccuugccc

SEQ ID NO: 87757 - RNA, 64 nt, Human
cauuaacggaguuugccaagugcauuaaagaggucacguggaggguacguucauaugaaacaau

SEQ ID NO: 87758 - RNA, 64 nt, Human
ugucacccuggggcccuccagguaggcccguuuucacguggagcaugggagccacgacccuucu

SEQ ID NO: 87759 - RNA, 64 nt, Human
ucacuggcaguucucacuuuuaacuauaagaagucacguggaacuuagugauuuuuaacaaaua

SEQ ID NO: 87760 - RNA, 64 nt, Human
guuucucauguaaugcagugacgcugucauuaaacacguggauucauguguggccgggacuggc

SEQ ID NO: 87761 - RNA, 64 nt, Human
cccacccuccaccccuagcucagccagauccuuacacguggagcccccagcaugggaaugaggg

SEQ ID NO: 87762 - RNA, 64 nt, Human
acaccugcccaaccccaacacgugcuuauguaaccacguggaaagcggccccugcugccccucc

SEQ ID NO: 87763 - RNA, 64 nt, Human
caagcagguaggggggcuugauaacuuaacuuuccacguggacagaauuuuuuuuuuuguuuug

SEQ ID NO: 87764 - RNA, 64 nt, Human
gagugugcacacgugcguguguguugcuauccagcacguggaccgggcucccagaagagcuggc

SEQ ID NO: 87765 - RNA, 64 nt, Human
ugucuguuggcuggggcagcccucagagccuggccacguggaccuccccagcaugaucaguucc

SEQ ID NO: 87766 - RNA, 64 nt, Human
gcucagggcggaaggucaggcuccccgcccccuccacguggagacauggccuagggggccaggc

SEQ ID NO: 87767 - RNA, 64 nt, Human
aggaaggagcguggugcauuggacaugggucugacacguggagaacucagagggugccucaggg

SEQ ID NO: 87768 - RNA, 64 nt, Human
cugggcauguccagaugaacgaagcgugcaaauccacguggaaccuaagugcucagaccgagga

SEQ ID NO: 87769 - RNA, 64 nt, Human
cacaccagcccucagagaccugagcucuucuggccacguggaaccucgaacccgagcuccugca

SEQ ID NO: 87770 - RNA, 64 nt, Human
agacacguuaagggacugguuggccaaacucagacacguggacagggauagacagaaagagaca

SEQ ID NO: 87771 - RNA, 64 nt, Human
gauaagcuguaggggcucaggccacccucccugccacguggagacgcagaggccgaacccaaac

SEQ ID NO: 87772 - RNA, 64 nt, Human
gcggacguccccaggggucacccugcaaccgugccacguggaggagcugggggucgccggaaac

SEQ ID NO: 87773 - RNA, 64 nt, Human
ccccucgugaugucaggggcgcaguagcuccgcccacguggagcucgggcgguguagagcucag

SEQ ID NO: 87774 - RNA, 64 nt, Human
cccugggaggccggcagccaggccacagaauccacacguggaccauugugggucccugggaggc

SEQ ID NO: 87775 - RNA, 64 nt, Human
cccugggaggccggcagccaggccacggaauccacacguggaccauugugggucccuugggagg

SEQ ID NO: 87776 - RNA, 64 nt, Human
aagggaagcuggggcagguaacacgcagagccgccacguggaacggucuguccgccggucuguc

SEQ ID NO: 87777 - RNA, 64 nt, Human
augugugaggagcugcuggcuugcagugcgcgugcacguggagagcuggugcccggagauugga

SEQ ID NO: 87778 - RNA, 64 nt, Human
ggaagagauugaguuccuggaagccaggggucaccacguggagaaaguagaugucuuauccugg

SEQ ID NO: 87779 - RNA, 64 nt, Human
ugugaaggacuggccagucugggaaaccgccugccacguggaagagccaaacccgacucucugc

SEQ ID NO: 87780 - RNA, 64 nt, Human
gggcuuuucccucuuguucggcacuuccugcugccacguggagaaggguguguuuguuucccca

SEQ ID NO: 87781 - RNA, 64 nt, Human
agaguaggggagaagguugggguguagggccuuccacguggaacagacagccccugugucucug

SEQ ID NO: 87782 - RNA, 64 nt, Human
ugcacaucugugcuuccuaaaaggaaauaugcagcacguggaggggaacacauacaugucuuga

SEQ ID NO: 87783 - RNA, 64 nt, Human
augaggugccaggcacuggguagagcaccugguccacguggauugucucagggaagccuugaaa

SEQ ID NO: 87784 - RNA, 64 nt, Human
uugauggaggcuuggugagacacacuuaaauaagcacguggagguuagaauagagggcagagua

SEQ ID NO: 87785 - RNA, 64 nt, Human
gaaaagcagcccuuggccagaagucaagcccagccacguggagccuagagugagggccugaggu

SEQ ID NO: 87786 - RNA, 64 nt, Human
cauagccacccuuuuucaucagugaccuuuucuucacguggaggucaacucaguaggugagaau

SEQ ID NO: 87787 - RNA, 64 nt, Human
acagaagaggagacacagacacagagcaggaggacacguggagacagaggcagacuggagugau

SEQ ID NO: 87788 - RNA, 64 nt, Human
gaagagcucugacucuccaggggugcugggacaucacguggaauuggaucccaggcucucuugg

SEQ ID NO: 87789 - RNA, 64 nt, Human
ucacgucucuaacaauccuucgcuuuuccucacucacguggaaaugugaacugucccggcucug

SEQ ID NO: 87790 - RNA, 64 nt, Human
aaguaccacuaacacagaugauugaucguuuccaggacaauaaaaguuucggaguugaacuauu

SEQ ID NO: 87791 - RNA, 64 nt, Human
acuggacuaauugaauaguuaagguuucuauucgggacaauaaaauguauuuugaaagugcugc

SEQ ID NO: 87792 - RNA, 64 nt, Human
uguuuugcuuucagcauugugccaugagggauuuggacaauauuuaagaacuucuuguccuaga

SEQ ID NO: 87793 - RNA, 64 nt, Human
aucccaggaucagaagccagggcuaauugggguaggacaauauucccagccccuaagcucugua

SEQ ID NO: 87794 - RNA, 51 nt, Human
uugugcaggaucugccauaaaggacaauaugaacugaugccuggacuauca

SEQ ID NO: 87795 - RNA, 64 nt, Human
cuuuauucaaguaaaaaucaauacccuuugaauuggacaauaaucucacuaccuuauuaggauu

SEQ ID NO: 87796 - RNA, 64 nt, Human
uuguugaucuuguauucagucagguuaaaacaacggacaauaaaagaaugaacacauuccucgu

SEQ ID NO: 87797 - RNA, 64 nt, Human
caagggauuugaggugaggguuggcgcuuagagaggacaauacugggguuggacuguaagggau

SEQ ID NO: 87798 - RNA, 58 nt, Human
cuucugcacagggccaauaauaagaaguggacaauacaguauuugcuucauugugugg

SEQ ID NO: 87799 - RNA, 64 nt, Human
uugaggaacagcacaucagcuuugcccuugacauggacaauagguuuuuuacuuugacggugag

SEQ ID NO: 87800 - RNA, 64 nt, Human
gcuacugauaggaccaggaagagaggaacucggaggacaauagggaggggaagucuuggaaaau

SEQ ID NO: 87801 - RNA, 64 nt, Human
guuuacugguuuuuauucccauaugccgauucugggacaauaaaguuguuuaaagcuggcacaa

SEQ ID NO: 87802 - RNA, 64 nt, Human
augguguguuuuacagucuaccuagaaaauagauggacaauauuuuucaacuguaugagcacgu

SEQ ID NO: 87803 - RNA, 64 nt, Human
gugcuccuggaacaauccuuccaagcuccucuaaggacaauauuuaauucagauacuaaaggua

SEQ ID NO: 87804 - RNA, 64 nt, Human
uucucuaucugaaguguucacacuuacacauguaggacaauaagcaggaccgucugggccgguc

SEQ ID NO: 87805 - RNA, 64 nt, Human
ugccguaguccuuuuuguaacuacccucucaaauggacaauaccagaagugaauuaucccugcu

SEQ ID NO: 87806 - RNA, 64 nt, Human
cucaguacugcaucacuguguugggaucauaccaggacaauagggucauuccauaugauaaaac

SEQ ID NO: 87807 - RNA, 64 nt, Human
auuuuauacucauggaagagauaagcuaaagaggggacaauaaugagaaauguuggugugcuuu

SEQ ID NO: 87808 - RNA, 64 nt, Human
augucagcuaccucugacccugcccuccagccugggacaauaaaagccuuuuuucuagacuguc

SEQ ID NO: 87809 - RNA, 64 nt, Human
ugugcauuuuauuaauuccuuaggggcacaaggaggacaauaauagcugaucuuuugaaauuug

SEQ ID NO: 87810 - RNA, 64 nt, Human
uccuuaggaaaaugcuucuguuguaauaguccauggacaauauaaacugaaaaaugucagucug

SEQ ID NO: 87811 - RNA, 64 nt, Human
ccaguaaucccuugugucuguugcaugaggacauggacaauaaaguaguauaugauccucagau

SEQ ID NO: 87812 - RNA, 64 nt, Human
caguuuccuuucaguaaucuuucugaaggagccaggacaauagggccuguuguuuagugaauuu

SEQ ID NO: 87813 - RNA, 64 nt, Human
aucccugguuuuaaguaucaauccuuguucagcuggacaauaugaaucuuuuccacugaaguua

SEQ ID NO: 87814 - RNA, 64 nt, Human
uguaauucuagaggguaaaaauguaaauagguuuggacaauauuugcacccuuguuuguguuau

SEQ ID NO: 87815 - RNA, 64 nt, Human
cugggaagagaucaaaauggagucuccuuaccauggacaauacaugcaaagcaauaucuuguuc

SEQ ID NO: 87816 - RNA, 64 nt, Human
aaugugauauuugaagcaucacauaaaaaugaugggacaauaaauuuugccauaaagucaaauu

SEQ ID NO: 87817 - RNA, 64 nt, Human
uuuuugccuuacaguggaucauucuaguaggaaaggacaauaagauuuuuuaucaaaauguguc

SEQ ID NO: 87818 - RNA, 64 nt, Human
guuuaaauauguuguauuguuuuguuuaguuacaggacaauaaugaaauggaguuuauauuugu

SEQ ID NO: 87819 - RNA, 64 nt, Human
ugauaaccauauccccccagugcucaucaaaguaggacaauaaaaauccauccaucucagucca

SEQ ID NO: 87820 - RNA, 64 nt, Human
gcucaucugagaagacuuaaguucuuccagcuuuggacaauaacugcuuuuagaaacuguaaag

SEQ ID NO: 87821 - RNA, 64 nt, Human
uugguuuuuaacuuccuccauacauaagcuucaaggacaauaagauguuaaaaaggaggaaaua

SEQ ID NO: 87822 - RNA, 64 nt, Human
uacaaaggcaacagcaacuuaaaaaagaaaaucuggacaauagauguggacuccaaggggccac

SEQ ID NO: 87823 - RNA, 64 nt, Human
auucuuaucuuccagaggcuacaauuauuauaauggacaauacuuuuaccuuugucucuaaaga

SEQ ID NO: 87824 - RNA, 64 nt, Human
aaagcuacugugauugauagcauuguaagaaucgggacaauauuguauucaacuguuuuauuuu

SEQ ID NO: 87825 - RNA, 64 nt, Human
ugcaugguagacuuuguggcauuugauacaacuuggacaauaccuaguuuggagggaggggaau

SEQ ID NO: 87826 - RNA, 64 nt, Human
aauugauaaauccuaaagaggaagaaaagagcugggacaauaaaacacuggcucuggaaucugg

SEQ ID NO: 87827 - RNA, 64 nt, Human
gacugcuuagccccuaaauaugguaacuacucugggacaauaugggaggaaaagugaagauugu

SEQ ID NO: 87828 - RNA, 64 nt, Human
caucuuaauuagaugcagggacagggaucagaugggacaauaucaaauuuacuuugugcccuac

SEQ ID NO: 87829 - RNA, 64 nt, Human
agcaccuuugggcuuuguuuugguguuucuacagggacaauacagacccuggagugugugugug

SEQ ID NO: 87830 - RNA, 64 nt, Human
aauuauguaaauuugcaaauuauguuaaaaacaaggacaauaaauauucaaaaugcaucccuaa

SEQ ID NO: 87831 - RNA, 64 nt, Human
aauaugguuaguccaaauugagaugugcucuaaaggacaauaaaagguuaaauaucuccuaauu

SEQ ID NO: 87832 - RNA, 64 nt, Human
ugacuaacaaugacaaaggccuuaugaacuguacggacaauacagaagacuauucuuauccuca

SEQ ID NO: 87833 - RNA, 64 nt, Human
aagcgugcacaaucaaaaguacuaugcaauuuuaggacaauaaagaacauacaguuuuuuugug

SEQ ID NO: 87834 - RNA, 64 nt, Human
uuagaucaaaaaggcaaaugauuuuauaaacaauggacaauauauacuuucuuaagaucuaagg

SEQ ID NO: 87835 - RNA, 64 nt, Human
caagggaggucaaaaggagaaaaguauaggcuguggacaauaacugaugaauauagggcccaga

SEQ ID NO: 87836 - RNA, 64 nt, Human
ugaaacacuacuugguauugaauacaccacuugaggacaauaucaugacucacgguuuaucaag

SEQ ID NO: 87837 - RNA, 64 nt, Human
ugugaugcuggugggaauuguuugcauagaggaaggacaauaacccugccaucgugaguuaaug

SEQ ID NO: 87838 - RNA, 64 nt, Human
uggccagucguauaccaucccuggaaggauucugggacaauauuccagggauucauugacuucu

SEQ ID NO: 87839 - RNA, 64 nt, Human
acccuuggccucauuuuuccugucuugugaaagaggacaauaauuccuacuucucaagauuguu

SEQ ID NO: 87840 - RNA, 64 nt, Human
gguugacuuuguuucuuuauuugugccauuguuuggacaauauuaaagcugcauguaaaagggg

SEQ ID NO: 87841 - RNA, 64 nt, Human
gauacggaauuuacacagguagggaguguuuaguggacaauaguguagguuauggauggaggug

SEQ ID NO: 87842 - RNA, 64 nt, Human
gagauggauaugauagauuacacaguuuauuggaggacaauaagaguuauggcaaaaagcaaaa

SEQ ID NO: 87843 - RNA, 64 nt, Human
guggaauuguugaaguguggcgagucugugcucgggacaauaaagcuugugacagguccaggac

SEQ ID NO: 87844 - RNA, 64 nt, Human
aguggggauuuuuuucuucuucccuuucucuuuuggacaauaguuaaauuagcaguauuaguua

SEQ ID NO: 87845 - RNA, 64 nt, Human
caugauuuuucauugucacaccaaauaaccaguuggacaauauugcauuuucaaaauggagagu

SEQ ID NO: 87846 - RNA, 64 nt, Human
guagcauuucacugaucuucacuccagucacuagggacaauagaaaccugcaaaacacagauuc

SEQ ID NO: 87847 - RNA, 64 nt, Human
ggauggaaaaguuucaugucauaagucaccaccuggacaauaauugaugcccuuaaaaugcuga

SEQ ID NO: 87848 - RNA, 64 nt, Human
agauuuuaaagugauuuuugagaagacuugggggggacaauaauagacauucaugucagauccc

SEQ ID NO: 87849 - RNA, 64 nt, Human
auugccguggguugauagcuggaggaauuguuuuggacaauacuaacaugugaauuuaugucuu

SEQ ID NO: 87850 - RNA, 64 nt, Human
ugaaagauacaaagugauuauaaaagaauugacaggacaauaaauacuucaaauacuuuuagga

SEQ ID NO: 87851 - RNA, 64 nt, Human
gcuguaggaauaaccuugcugauaagaaaaaaagggacaauauuggagaaacuaccucuuguuu

SEQ ID NO: 87852 - RNA, 64 nt, Human
ugucauucuaagauucccauaucuuuugguuaggggacaauauuagagcuuuuaaaaaggaagg

SEQ ID NO: 87853 - RNA, 64 nt, Human
gggggggguggggggugcgucuuuaguccuaaagggacaauaacucugagcaugccccaaaaaa

SEQ ID NO: 87854 - RNA, 64 nt, Human
gggaacaucuuaacuguauaugaacauuucacgaggacaauaaaaauaagacauugaaggacca

SEQ ID NO: 87855 - RNA, 64 nt, Human
ccauuuuuguaagccauaaugaacuguaguacauggacaauaagugugugguagaaacaaacuc

SEQ ID NO: 87856 - RNA, 64 nt, Human
ccugcuuucacuguguuguucaugguggcuuuuuggacaauaaagaaucuaaaaugggugggga

SEQ ID NO: 87857 - RNA, 64 nt, Human
ucaacuuuuuuuuuuuuuuuuuuuacuuuggaaaggacaauaacuauaaaccuauauccagauu

SEQ ID NO: 87858 - RNA, 64 nt, Human
ucagcaggaacuggucauacaggguaagcaccagggacaauaaggauuuuuauagauauaauuu

SEQ ID NO: 87859 - RNA, 64 nt, Human
caguuucuaaaccaaaaaaugacauguuguaaaaggacaauaaacguugggucaaaauggagcc

SEQ ID NO: 87860 - RNA, 64 nt, Human
ccaauauucaaauccagaugauuuuuacucccaaggacaauaaauccaacucaauaacuucaac

SEQ ID NO: 87861 - RNA, 64 nt, Human
gacccacaggccaugaccuuuuugaucacucugaggacaauauuuaaaugacaggaagguauau

SEQ ID NO: 87862 - RNA, 64 nt, Human
aguggcagcauucugaggccaagagacacucacuggacaauaucaaaccauggcuccuccucag

SEQ ID NO: 87863 - RNA, 64 nt, Human
ccagcuuguucugggcucagggagggagggcgguggacaauaaacaucugagcagugccucgug

SEQ ID NO: 87864 - RNA, 64 nt, Human
auuccuggcccugagaauggagcuguagccucauggacaauaaauggaugugacaccaaauacu

SEQ ID NO: 87865 - RNA, 64 nt, Human
agacgugauaccaaaauuuuguugcaaauauaauggacaauauuuauuuauacccauauucaca

SEQ ID NO: 87866 - RNA, 64 nt, Human
acuccucaacaggcauaaucaccagcaacacccgggacaauaauacgggggccaccuaccccca

SEQ ID NO: 87867 - RNA, 64 nt, Human
caacaaggguuuuuagcuuuaagccugugcauguggacaauacucugagaacaugucuggaggg

SEQ ID NO: 87868 - RNA, 64 nt, Human
ggggugugggcuggaagcacuggcucccugguagggacaauaaagguuuugggucuuucugaga

SEQ ID NO: 87869 - RNA, 64 nt, Human
aguccuauuaagaaauauuugucuuaaauauauaggacaauacauuauauuaaaauggucucuc

SEQ ID NO: 87870 - RNA, 64 nt, Human
caaccucaaccuaucuuuauguuuuaaauguuagggacaauaaguugaaauagcuagaggagcu

SEQ ID NO: 87871 - RNA, 64 nt, Human
uguuuuaaggaugauaaaaaaaaauaacaacuagggacaauacagaacccauuccauuuaucuu

SEQ ID NO: 87872 - RNA, 64 nt, Human
gccugcuguccugcgucuauccauguggaaugcuggacaauaaagcgagugcugcccacccucc

SEQ ID NO: 87873 - RNA, 63 nt, Human
cuuucauauauauggcauaauuuugaauaucauggacaauauuuagaacccaaauuuuggagu

SEQ ID NO: 87874 - RNA, 64 nt, Human
agugggggagggcaccucagcaaccucugaguguggacaauagcugcuuucuucucuauccaag

SEQ ID NO: 87875 - RNA, 64 nt, Human
cuugcaggucccuuucuacugugguguuggagcaggacaauaaaguccacuagaaaugcacccc

SEQ ID NO: 87876 - RNA, 64 nt, Human
cuuaaagaaguuaugaacuuuagaaaggaucaggggacaauaauaaucucauuuugauucuacu

SEQ ID NO: 87877 - RNA, 64 nt, Human
ccacugaacuuucuggaaugggccauaggaugcuggacaauaggacagauuuggaaugagcagu

SEQ ID NO: 87878 - RNA, 64 nt, Human
auuuuuuuaaauaacuggacauaugucauuuuaaggacaauagaaacacuuagacuuacuugaa

SEQ ID NO: 87879 - RNA, 64 nt, Human
gugcaauuuaauauagaaagauuucugccuguuuggacaauagguuuuggguaguacagauuag

SEQ ID NO: 87880 - RNA, 64 nt, Human
gaguugcuuaaaccaaugggacuaaaaccugaugggacaauaacgccuuuggaggaagcacuca

SEQ ID NO: 87881 - RNA, 64 nt, Human
uaaaaauguauauaaagcauaugagcacacaaauggacaauaaaugccacagcgcaaaagcgug

SEQ ID NO: 87882 - RNA, 64 nt, Human
acgcacacugccguccaauguggagagccugaugggacaauacccuguuggaagugacaacuga

SEQ ID NO: 87883 - RNA, 64 nt, Human
cagcaguuuagugccugcugaaaagaucccugauggacaauacuucuugguggacuccagcugc

SEQ ID NO: 87884 - RNA, 64 nt, Human
agcugccuguucaugaauuuggauaagaauaguaggacaauauucaacacaauuuaauuuuugu

SEQ ID NO: 87885 - RNA, 64 nt, Human
auaaaagcuuucugccaccccuaaacuccaggggggacaauaugugccaaucaauagcaccccu

SEQ ID NO: 87886 - RNA, 64 nt, Human
uaaaaagaagaauuuuuuuaaguauuaauuccauggacaauauaaaaucugugugauuguuugc

SEQ ID NO: 87887 - RNA, 64 nt, Human
acuggacugcucuccggcuucagaagcugcuacaggacaauaacgucauguuuaauacagagcc

SEQ ID NO: 87888 - RNA, 64 nt, Human
uuugguucauuugguuuuugucaugugcaaggaaggacaauaguccucuuuccaaguguguuag

SEQ ID NO: 87889 - RNA, 64 nt, Human
ucucauaacagcugacagaaguacauauugaagaggacaauauggcaauguccuucaaaauuau

SEQ ID NO: 87890 - RNA, 64 nt, Human
cagcguccaguccuccugggcggccccagguccuggacaauaagcaacagaugauauugagugu

SEQ ID NO: 87891 - RNA, 64 nt, Human
uuuacccauaaauaacaugaaugaaaaaagauugggacaauagagacuggaagucaucaugugc

SEQ ID NO: 87892 - RNA, 64 nt, Human
uguguggggaggggcccucagguguguguacuuuggacaauaaauggugcuaugacugccuucc

SEQ ID NO: 87893 - RNA, 64 nt, Human
cccgccugacaaacaggcagggagccacagucagggacaauaaaaacuuggugcacucugaaag

SEQ ID NO: 87894 - RNA, 64 nt, Human
aauuuguauauuagaaacuuauucaucccacucaggacaauaaaaacgaauguacaaaaagccc

SEQ ID NO: 87895 - RNA, 64 nt, Human
ggacuugacuugcaauuucuaccuagaaauacauggacaauacccccaggccucagucucccuu

SEQ ID NO: 87896 - RNA, 64 nt, Human
gaacccaggaauccuuggggguggugggaggagcggacaauaaagguguaaacacagguaccug

SEQ ID NO: 87897 - RNA, 64 nt, Human
aauuccuuaaauacauacaguaggugaauuuucaggacaauauugccucacaacccugcuuaca

SEQ ID NO: 87898 - RNA, 64 nt, Human
agggagcaggaaaucagugcuggggguggugggcggacaauaggaucacugccugccagaucuu

SEQ ID NO: 87899 - RNA, 64 nt, Human
gggcugguuccugcugcagugaggggaacagaugggacaauaaagacuggagacucaguugaau

SEQ ID NO: 87900 - RNA, 64 nt, Human
ccuccuuccccaagcugagaagcugagagcuggaggacaauauccagggacauggcucuggaaa

SEQ ID NO: 87901 - RNA, 64 nt, Human
cagaagucagaaguuuggaauguggugggucaaaggacaauaugggugggcauucuggagaguu

SEQ ID NO: 87902 - RNA, 64 nt, Human
cuuuguaucauucuugagcaaucgcucgguccguggacaauaaacaguauuaucaaagagaacg

SEQ ID NO: 87903 - RNA, 64 nt, Human
gcagcaccuggggagucccugccucuccucccugggacaauagugugcaugccacccggggucc

SEQ ID NO: 87904 - RNA, 64 nt, Human
ucaauauuuuuaaagugccaacacagucaugauaggacaauauuuuaugugugugugugcgccu

SEQ ID NO: 87905 - RNA, 64 nt, Human
agggcgggcuagaaggccaaaagaaggaugaggaggacaauaauauuuauuuuugcauccaacc

SEQ ID NO: 87906 - RNA, 64 nt, Human
cugcuuuuugaauugagaagagagacuugcgauaggacaauaaaaucuagaagaacuuggaugg

SEQ ID NO: 87907 - RNA, 64 nt, Human
cuguaaaauggaccaaucagcaggacaugggcggggacaauaagggaauaaaagcuggcgagcg

SEQ ID NO: 87908 - RNA, 64 nt, Human
guggcuuacaaggucaggaguucaagaccacccuggacaauauggugaaacccugucucuacua

SEQ ID NO: 87909 - RNA, 64 nt, Human
agugguucuuaggcagauacucuagaugcuuuauggacaauauuauuuucauuggaugauucug

SEQ ID NO: 87910 - RNA, 64 nt, Human
accggcgcgcucuucgcgcccgccccugcagcacggacaauaaaccuccgccaaugcacggccu

SEQ ID NO: 87911 - RNA, 64 nt, Human
agcacaggggacgcaaugggaggcagggacaccuggacaauauuuauuuuugcugaaacccaau

SEQ ID NO: 87912 - RNA, 64 nt, Human
caaguuuccuuccucuguaccacucugcuuccuuggacaauaucaguaauagcuuuguaaguga

SEQ ID NO: 87913 - RNA, 64 nt, Human
acuuaccuuaugcacaaagguauucccagguaggggacaauaguagcauucgcaguggugauaa

SEQ ID NO: 87914 - RNA, 64 nt, Human
ccagagucucuagggcaaggagaaacaacuagcuggacaauacucaauucacaacuuagcauuu

SEQ ID NO: 87915 - RNA, 64 nt, Human
uccccuccuuguacuuuugccuuagguucucaagggacaauagucuucauguuggauucuccaa

SEQ ID NO: 87916 - RNA, 64 nt, Human
ggaugaaacuagaguggucucagaagugccuucaggacaauaaguggaacuacauuagagcugg

SEQ ID NO: 87917 - RNA, 64 nt, Human
gaucucuggggcuuccgggggugagauucaaguaggacaauaacaagaggcuggacacccuaca

SEQ ID NO: 87918 - RNA, 64 nt, Human; identical to SEQ ID NO: 10157

SEQ ID NO: 87919 - RNA, 64 nt, Human; identical to SEQ ID NO: 10158

SEQ ID NO: 87920 - RNA, 62 nt, Human; identical to SEQ ID NO: 10159

SEQ ID NO: 87921 - RNA, 64 nt, Human; identical to SEQ ID NO: 10160

SEQ ID NO: 87922 - RNA, 64 nt, Human; identical to SEQ ID NO: 10161

SEQ ID NO: 87923 - RNA, 64 nt, Human; identical to SEQ ID NO: 10162

SEQ ID NO: 87924 - RNA, 64 nt, Human; identical to SEQ ID NO: 10163

SEQ ID NO: 87925 - RNA, 64 nt, Human; identical to SEQ ID NO: 10164

SEQ ID NO: 87926 - RNA, 64 nt, Human; identical to SEQ ID NO: 10165

SEQ ID NO: 87927 - RNA, 64 nt, Human; identical to SEQ ID NO: 10166

SEQ ID NO: 87928 - RNA, 64 nt, Human; identical to SEQ ID NO: 10167

SEQ ID NO: 87929 - RNA, 64 nt, Human; identical to SEQ ID NO: 10168

SEQ ID NO: 87930 - RNA, 64 nt, Human; identical to SEQ ID NO: 10169

SEQ ID NO: 87931 - RNA, 64 nt, Human; identical to SEQ ID NO: 10170

SEQ ID NO: 87932 - RNA, 64 nt, Human; identical to SEQ ID NO: 10171

SEQ ID NO: 87933 - RNA, 64 nt, Human; identical to SEQ ID NO: 10172

SEQ ID NO: 87934 - RNA, 64 nt, Human; identical to SEQ ID NO: 10173

SEQ ID NO: 87935 - RNA, 64 nt, Human; identical to SEQ ID NO: 10174

SEQ ID NO: 87936 - RNA, 64 nt, Human; identical to SEQ ID NO: 10175

SEQ ID NO: 87937 - RNA, 64 nt, Human; identical to SEQ ID NO: 10176

SEQ ID NO: 87938 - RNA, 64 nt, Human; identical to SEQ ID NO: 10177

SEQ ID NO: 87939 - RNA, 50 nt, Human; identical to SEQ ID NO: 10178

SEQ ID NO: 87940 - RNA, 64 nt, Human; identical to SEQ ID NO: 10179

SEQ ID NO: 87941 - RNA, 64 nt, Human; identical to SEQ ID NO: 10180

SEQ ID NO: 87942 - RNA, 64 nt, Human; identical to SEQ ID NO: 10181

SEQ ID NO: 87943 - RNA, 64 nt, Human; identical to SEQ ID NO: 10182

SEQ ID NO: 87944 - RNA, 64 nt, Human; identical to SEQ ID NO: 10183

SEQ ID NO: 87945 - RNA, 64 nt, Human; identical to SEQ ID NO: 10184

SEQ ID NO: 87946 - RNA, 64 nt, Human; identical to SEQ ID NO: 10185

SEQ ID NO: 87947 - RNA, 64 nt, Human; identical to SEQ ID NO: 10186

SEQ ID NO: 87948 - RNA, 64 nt, Human; identical to SEQ ID NO: 10187

SEQ ID NO: 87949 - RNA, 64 nt, Human; identical to SEQ ID NO: 10188

SEQ ID NO: 87950 - RNA, 64 nt, Human; identical to SEQ ID NO: 10189

SEQ ID NO: 87951 - RNA, 64 nt, Human; identical to SEQ ID NO: 10190

SEQ ID NO: 87952 - RNA, 64 nt, Human; identical to SEQ ID NO: 10191

SEQ ID NO: 87953 - RNA, 64 nt, Human; identical to SEQ ID NO: 10192

SEQ ID NO: 87954 - RNA, 64 nt, Human; identical to SEQ ID NO: 10193

SEQ ID NO: 87955 - RNA, 64 nt, Human; identical to SEQ ID NO: 10194

SEQ ID NO: 87956 - RNA, 64 nt, Human; identical to SEQ ID NO: 10195

SEQ ID NO: 87957 - RNA, 64 nt, Human; identical to SEQ ID NO: 10196

SEQ ID NO: 87958 - RNA, 64 nt, Human; identical to SEQ ID NO: 10197

SEQ ID NO: 87959 - RNA, 64 nt, Human; identical to SEQ ID NO: 10198

SEQ ID NO: 87960 - RNA, 64 nt, Human; identical to SEQ ID NO: 10199

SEQ ID NO: 87961 - RNA, 64 nt, Human; identical to SEQ ID NO: 10200

SEQ ID NO: 87962 - RNA, 64 nt, Human; identical to SEQ ID NO: 10201

SEQ ID NO: 87963 - RNA, 64 nt, Human; identical to SEQ ID NO: 10202

SEQ ID NO: 87964 - RNA, 64 nt, Human; identical to SEQ ID NO: 10203

SEQ ID NO: 87965 - RNA, 64 nt, Human; identical to SEQ ID NO: 10204

SEQ ID NO: 87966 - RNA, 64 nt, Human; identical to SEQ ID NO: 10205

SEQ ID NO: 87967 - RNA, 64 nt, Human; identical to SEQ ID NO: 10206

SEQ ID NO: 87968 - RNA, 64 nt, Human; identical to SEQ ID NO: 10207

SEQ ID NO: 87969 - RNA, 64 nt, Human; identical to SEQ ID NO: 10208

SEQ ID NO: 87970 - RNA, 64 nt, Human; identical to SEQ ID NO: 10209

SEQ ID NO: 87971 - RNA, 64 nt, Human; identical to SEQ ID NO: 10210

SEQ ID NO: 87972 - RNA, 64 nt, Human; identical to SEQ ID NO: 10211

SEQ ID NO: 87973 - RNA, 64 nt, Human; identical to SEQ ID NO: 10212

SEQ ID NO: 87974 - RNA, 64 nt, Human; identical to SEQ ID NO: 10213

SEQ ID NO: 87975 - RNA, 64 nt, Human; identical to SEQ ID NO: 10214

SEQ ID NO: 87976 - RNA, 64 nt, Human; identical to SEQ ID NO: 10215

SEQ ID NO: 87977 - RNA, 64 nt, Human; identical to SEQ ID NO: 10216

SEQ ID NO: 87978 - RNA, 64 nt, Human; identical to SEQ ID NO: 10217

SEQ ID NO: 87979 - RNA, 64 nt, Human; identical to SEQ ID NO: 10218

SEQ ID NO: 87980 - RNA, 64 nt, Human; identical to SEQ ID NO: 10219

SEQ ID NO: 87981 - RNA, 64 nt, Human; identical to SEQ ID NO: 10220

SEQ ID NO: 87982 - RNA, 64 nt, Human; identical to SEQ ID NO: 10221

SEQ ID NO: 87983 - RNA, 64 nt, Human; identical to SEQ ID NO: 10222

SEQ ID NO: 87984 - RNA, 64 nt, Human; identical to SEQ ID NO: 10223

SEQ ID NO: 87985 - RNA, 64 nt, Human; identical to SEQ ID NO: 10224

SEQ ID NO: 87986 - RNA, 64 nt, Human; identical to SEQ ID NO: 10225

SEQ ID NO: 87987 - RNA, 64 nt, Human; identical to SEQ ID NO: 10226

SEQ ID NO: 87988 - RNA, 64 nt, Human; identical to SEQ ID NO: 10227

SEQ ID NO: 87989 - RNA, 64 nt, Human; identical to SEQ ID NO: 10228

SEQ ID NO: 87990 - RNA, 64 nt, Human; identical to SEQ ID NO: 10229

SEQ ID NO: 87991 - RNA, 64 nt, Human; identical to SEQ ID NO: 10230

SEQ ID NO: 87992 - RNA, 64 nt, Human; identical to SEQ ID NO: 10231

SEQ ID NO: 87993 - RNA, 64 nt, Human; identical to SEQ ID NO: 10232

SEQ ID NO: 87994 - RNA, 64 nt, Human; identical to SEQ ID NO: 10233

SEQ ID NO: 87995 - RNA, 64 nt, Human; identical to SEQ ID NO: 10234

SEQ ID NO: 87996 - RNA, 64 nt, Human; identical to SEQ ID NO: 10235

SEQ ID NO: 87997 - RNA, 64 nt, Human; identical to SEQ ID NO: 10236

SEQ ID NO: 87998 - RNA, 64 nt, Human; identical to SEQ ID NO: 10237

SEQ ID NO: 87999 - RNA, 64 nt, Human; identical to SEQ ID NO: 10238

SEQ ID NO: 88000 - RNA, 64 nt, Human; identical to SEQ ID NO: 10239

SEQ ID NO: 88001 - RNA, 64 nt, Human; identical to SEQ ID NO: 10240

SEQ ID NO: 88002 - RNA, 64 nt, Human; identical to SEQ ID NO: 10241

SEQ ID NO: 88003 - RNA, 64 nt, Human; identical to SEQ ID NO: 10242

SEQ ID NO: 88004 - RNA, 64 nt, Human; identical to SEQ ID NO: 10243

SEQ ID NO: 88005 - RNA, 64 nt, Human; identical to SEQ ID NO: 10244

SEQ ID NO: 88006 - RNA, 64 nt, Human; identical to SEQ ID NO: 10245

SEQ ID NO: 88007 - RNA, 64 nt, Human; identical to SEQ ID NO: 10246

SEQ ID NO: 88008 - RNA, 64 nt, Human; identical to SEQ ID NO: 10247

SEQ ID NO: 88009 - RNA, 64 nt, Human; identical to SEQ ID NO: 10248

SEQ ID NO: 88010 - RNA, 64 nt, Human; identical to SEQ ID NO: 10249

SEQ ID NO: 88011 - RNA, 64 nt, Human; identical to SEQ ID NO: 10250

SEQ ID NO: 88012 - RNA, 64 nt, Human; identical to SEQ ID NO: 10251

SEQ ID NO: 88013 - RNA, 64 nt, Human; identical to SEQ ID NO: 10252

SEQ ID NO: 88014 - RNA, 64 nt, Human; identical to SEQ ID NO: 10253

SEQ ID NO: 88015 - RNA, 64 nt, Human; identical to SEQ ID NO: 10254

SEQ ID NO: 88016 - RNA, 64 nt, Human; identical to SEQ ID NO: 10255

SEQ ID NO: 88017 - RNA, 64 nt, Human; identical to SEQ ID NO: 10256

SEQ ID NO: 88018 - RNA, 64 nt, Human; identical to SEQ ID NO: 10257

SEQ ID NO: 88019 - RNA, 64 nt, Human; identical to SEQ ID NO: 10258

SEQ ID NO: 88020 - RNA, 64 nt, Human; identical to SEQ ID NO: 10259

SEQ ID NO: 88021 - RNA, 64 nt, Human; identical to SEQ ID NO: 10260

SEQ ID NO: 88022 - RNA, 64 nt, Human; identical to SEQ ID NO: 10261

SEQ ID NO: 88023 - RNA, 64 nt, Human; identical to SEQ ID NO: 10262

SEQ ID NO: 88024 - RNA, 64 nt, Human; identical to SEQ ID NO: 10263

SEQ ID NO: 88025 - RNA, 64 nt, Human; identical to SEQ ID NO: 10264

SEQ ID NO: 88026 - RNA, 64 nt, Human; identical to SEQ ID NO: 10265

SEQ ID NO: 88027 - RNA, 64 nt, Human; identical to SEQ ID NO: 10266

SEQ ID NO: 88028 - RNA, 64 nt, Human; identical to SEQ ID NO: 10267

SEQ ID NO: 88029 - RNA, 64 nt, Human; identical to SEQ ID NO: 10268

SEQ ID NO: 88030 - RNA, 64 nt, Human; identical to SEQ ID NO: 10269

SEQ ID NO: 88031 - RNA, 64 nt, Human; identical to SEQ ID NO: 10270

SEQ ID NO: 88032 - RNA, 64 nt, Human; identical to SEQ ID NO: 10271

SEQ ID NO: 88033 - RNA, 64 nt, Human; identical to SEQ ID NO: 10272

SEQ ID NO: 88034 - RNA, 64 nt, Human; identical to SEQ ID NO: 10273

SEQ ID NO: 88035 - RNA, 64 nt, Human; identical to SEQ ID NO: 10274

SEQ ID NO: 88036 - RNA, 64 nt, Human; identical to SEQ ID NO: 10275

SEQ ID NO: 88037 - RNA, 64 nt, Human; identical to SEQ ID NO: 10276

SEQ ID NO: 88038 - RNA, 64 nt, Human; identical to SEQ ID NO: 10277

SEQ ID NO: 88039 - RNA, 64 nt, Human; identical to SEQ ID NO: 10278

SEQ ID NO: 88040 - RNA, 50 nt, Human; identical to SEQ ID NO: 10279

SEQ ID NO: 88041 - RNA, 64 nt, Human; identical to SEQ ID NO: 10280

SEQ ID NO: 88042 - RNA, 64 nt, Human; identical to SEQ ID NO: 10281

SEQ ID NO: 88043 - RNA, 64 nt, Human; identical to SEQ ID NO: 10282

SEQ ID NO: 88044 - RNA, 64 nt, Human; identical to SEQ ID NO: 10283

SEQ ID NO: 88045 - RNA, 64 nt, Human; identical to SEQ ID NO: 10284

SEQ ID NO: 88046 - RNA, 64 nt, Human; identical to SEQ ID NO: 10285

SEQ ID NO: 88047 - RNA, 64 nt, Human; identical to SEQ ID NO: 10286

SEQ ID NO: 88048 - RNA, 64 nt, Human; identical to SEQ ID NO: 10287

SEQ ID NO: 88049 - RNA, 64 nt, Human; identical to SEQ ID NO: 10288

SEQ ID NO: 88050 - RNA, 64 nt, Human; identical to SEQ ID NO: 10289

SEQ ID NO: 88051 - RNA, 64 nt, Human; identical to SEQ ID NO: 10290

SEQ ID NO: 88052 - RNA, 64 nt, Human; identical to SEQ ID NO: 10291

SEQ ID NO: 88053 - RNA, 64 nt, Human; identical to SEQ ID NO: 10292

SEQ ID NO: 88054 - RNA, 64 nt, Human; identical to SEQ ID NO: 10293

SEQ ID NO: 88055 - RNA, 64 nt, Human; identical to SEQ ID NO: 10294

SEQ ID NO: 88056 - RNA, 64 nt, Human; identical to SEQ ID NO: 10295

SEQ ID NO: 88057 - RNA, 64 nt, Human; identical to SEQ ID NO: 10296

SEQ ID NO: 88058 - RNA, 64 nt, Human; identical to SEQ ID NO: 10297

SEQ ID NO: 88059 - RNA, 64 nt, Human; identical to SEQ ID NO: 10298

SEQ ID NO: 88060 - RNA, 64 nt, Human; identical to SEQ ID NO: 10299

SEQ ID NO: 88061 - RNA, 64 nt, Human; identical to SEQ ID NO: 10300

SEQ ID NO: 88062 - RNA, 64 nt, Human; identical to SEQ ID NO: 10301

SEQ ID NO: 88063 - RNA, 64 nt, Human; identical to SEQ ID NO: 10302

SEQ ID NO: 88064 - RNA, 64 nt, Human; identical to SEQ ID NO: 10303

SEQ ID NO: 88065 - RNA, 64 nt, Human; identical to SEQ ID NO: 10304

SEQ ID NO: 88066 - RNA, 64 nt, Human; identical to SEQ ID NO: 10305

SEQ ID NO: 88067 - RNA, 64 nt, Human; identical to SEQ ID NO: 10306

SEQ ID NO: 88068 - RNA, 64 nt, Human; identical to SEQ ID NO: 10307

SEQ ID NO: 88069 - RNA, 64 nt, Human; identical to SEQ ID NO: 10308

SEQ ID NO: 88070 - RNA, 64 nt, Human; identical to SEQ ID NO: 10309

SEQ ID NO: 88071 - RNA, 64 nt, Human; identical to SEQ ID NO: 10310

SEQ ID NO: 88072 - RNA, 64 nt, Human; identical to SEQ ID NO: 10311

SEQ ID NO: 88073 - RNA, 64 nt, Human; identical to SEQ ID NO: 10312

SEQ ID NO: 88074 - RNA, 64 nt, Human; identical to SEQ ID NO: 10313

SEQ ID NO: 88075 - RNA, 64 nt, Human; identical to SEQ ID NO: 10314

SEQ ID NO: 88076 - RNA, 64 nt, Human; identical to SEQ ID NO: 10315

SEQ ID NO: 88077 - RNA, 64 nt, Human; identical to SEQ ID NO: 10316

SEQ ID NO: 88078 - RNA, 64 nt, Human; identical to SEQ ID NO: 10317

SEQ ID NO: 88079 - RNA, 64 nt, Human; identical to SEQ ID NO: 10318

SEQ ID NO: 88080 - RNA, 64 nt, Human; identical to SEQ ID NO: 10319

SEQ ID NO: 88081 - RNA, 64 nt, Human; identical to SEQ ID NO: 10320

SEQ ID NO: 88082 - RNA, 64 nt, Human; identical to SEQ ID NO: 10321

SEQ ID NO: 88083 - RNA, 64 nt, Human; identical to SEQ ID NO: 10322

SEQ ID NO: 88084 - RNA, 64 nt, Human; identical to SEQ ID NO: 10323

SEQ ID NO: 88085 - RNA, 64 nt, Human; identical to SEQ ID NO: 10324

SEQ ID NO: 88086 - RNA, 64 nt, Human; identical to SEQ ID NO: 10325

SEQ ID NO: 88087 - RNA, 64 nt, Human; identical to SEQ ID NO: 10326

SEQ ID NO: 88088 - RNA, 64 nt, Human; identical to SEQ ID NO: 10327

SEQ ID NO: 88089 - RNA, 64 nt, Human; identical to SEQ ID NO: 10328

SEQ ID NO: 88090 - RNA, 64 nt, Human; identical to SEQ ID NO: 10329

SEQ ID NO: 88091 - RNA, 64 nt, Human; identical to SEQ ID NO: 10330

SEQ ID NO: 88092 - RNA, 64 nt, Human; identical to SEQ ID NO: 10331

SEQ ID NO: 88093 - RNA, 64 nt, Human; identical to SEQ ID NO: 10332

SEQ ID NO: 88094 - RNA, 64 nt, Human; identical to SEQ ID NO: 10333

SEQ ID NO: 88095 - RNA, 64 nt, Human; identical to SEQ ID NO: 10334

SEQ ID NO: 88096 - RNA, 64 nt, Human; identical to SEQ ID NO: 10335

SEQ ID NO: 88097 - RNA, 64 nt, Human; identical to SEQ ID NO: 10336

SEQ ID NO: 88098 - RNA, 58 nt, Human; identical to SEQ ID NO: 10337

SEQ ID NO: 88099 - RNA, 64 nt, Human; identical to SEQ ID NO: 10338

SEQ ID NO: 88100 - RNA, 64 nt, Human; identical to SEQ ID NO: 10339

SEQ ID NO: 88101 - RNA, 64 nt, Human; identical to SEQ ID NO: 10340

SEQ ID NO: 88102 - RNA, 64 nt, Human; identical to SEQ ID NO: 10341

SEQ ID NO: 88103 - RNA, 51 nt, Human; identical to SEQ ID NO: 10342

SEQ ID NO: 88104 - RNA, 64 nt, Human; identical to SEQ ID NO: 10343

SEQ ID NO: 88105 - RNA, 64 nt, Human; identical to SEQ ID NO: 10344

SEQ ID NO: 88106 - RNA, 64 nt, Human; identical to SEQ ID NO: 10345

SEQ ID NO: 88107 - RNA, 64 nt, Human; identical to SEQ ID NO: 10346

SEQ ID NO: 88108 - RNA, 64 nt, Human; identical to SEQ ID NO: 10347

SEQ ID NO: 88109 - RNA, 64 nt, Human; identical to SEQ ID NO: 10348

SEQ ID NO: 88110 - RNA, 64 nt, Human; identical to SEQ ID NO: 10349

SEQ ID NO: 88111 - RNA, 64 nt, Human; identical to SEQ ID NO: 10350

SEQ ID NO: 88112 - RNA, 64 nt, Human; identical to SEQ ID NO: 10351

SEQ ID NO: 88113 - RNA, 64 nt, Human; identical to SEQ ID NO: 10352

SEQ ID NO: 88114 - RNA, 64 nt, Human; identical to SEQ ID NO: 10353

SEQ ID NO: 88115 - RNA, 64 nt, Human; identical to SEQ ID NO: 10354

SEQ ID NO: 88116 - RNA, 64 nt, Human; identical to SEQ ID NO: 10355

SEQ ID NO: 88117 - RNA, 64 nt, Human; identical to SEQ ID NO: 10356

SEQ ID NO: 88118 - RNA, 64 nt, Human; identical to SEQ ID NO: 10357

SEQ ID NO: 88119 - RNA, 64 nt, Human; identical to SEQ ID NO: 10358

SEQ ID NO: 88120 - RNA, 64 nt, Human; identical to SEQ ID NO: 10359

SEQ ID NO: 88121 - RNA, 64 nt, Human; identical to SEQ ID NO: 10360

SEQ ID NO: 88122 - RNA, 64 nt, Human; identical to SEQ ID NO: 10361

SEQ ID NO: 88123 - RNA, 64 nt, Human; identical to SEQ ID NO: 10362

SEQ ID NO: 88124 - RNA, 64 nt, Human; identical to SEQ ID NO: 10363

SEQ ID NO: 88125 - RNA, 64 nt, Human; identical to SEQ ID NO: 10364

SEQ ID NO: 88126 - RNA, 64 nt, Human; identical to SEQ ID NO: 10365

SEQ ID NO: 88127 - RNA, 64 nt, Human; identical to SEQ ID NO: 10366

SEQ ID NO: 88128 - RNA, 64 nt, Human; identical to SEQ ID NO: 10367

SEQ ID NO: 88129 - RNA, 64 nt, Human; identical to SEQ ID NO: 10368

SEQ ID NO: 88130 - RNA, 64 nt, Human; identical to SEQ ID NO: 10369

SEQ ID NO: 88131 - RNA, 64 nt, Human; identical to SEQ ID NO: 10370

SEQ ID NO: 88132 - RNA, 64 nt, Human; identical to SEQ ID NO: 10371

SEQ ID NO: 88133 - RNA, 64 nt, Human; identical to SEQ ID NO: 10372

SEQ ID NO: 88134 - RNA, 64 nt, Human; identical to SEQ ID NO: 10373

SEQ ID NO: 88135 - RNA, 64 nt, Human; identical to SEQ ID NO: 10374

SEQ ID NO: 88136 - RNA, 64 nt, Human; identical to SEQ ID NO: 10375

SEQ ID NO: 88137 - RNA, 64 nt, Human; identical to SEQ ID NO: 10376

SEQ ID NO: 88138 - RNA, 64 nt, Human; identical to SEQ ID NO: 10377

SEQ ID NO: 88139 - RNA, 64 nt, Human; identical to SEQ ID NO: 10378

SEQ ID NO: 88140 - RNA, 64 nt, Human; identical to SEQ ID NO: 10379

SEQ ID NO: 88141 - RNA, 64 nt, Human; identical to SEQ ID NO: 10380

SEQ ID NO: 88142 - RNA, 64 nt, Human; identical to SEQ ID NO: 10381

SEQ ID NO: 88143 - RNA, 64 nt, Human; identical to SEQ ID NO: 10382

SEQ ID NO: 88144 - RNA, 64 nt, Human; identical to SEQ ID NO: 10383

SEQ ID NO: 88145 - RNA, 56 nt, Human; identical to SEQ ID NO: 10384

SEQ ID NO: 88146 - RNA, 64 nt, Human; identical to SEQ ID NO: 10385

SEQ ID NO: 88147 - RNA, 64 nt, Human; identical to SEQ ID NO: 10386

SEQ ID NO: 88148 - RNA, 64 nt, Human; identical to SEQ ID NO: 10387

SEQ ID NO: 88149 - RNA, 64 nt, Human; identical to SEQ ID NO: 10388

SEQ ID NO: 88150 - RNA, 64 nt, Human; identical to SEQ ID NO: 10389

SEQ ID NO: 88151 - RNA, 64 nt, Human; identical to SEQ ID NO: 10390

SEQ ID NO: 88152 - RNA, 64 nt, Human; identical to SEQ ID NO: 10391

SEQ ID NO: 88153 - RNA, 64 nt, Human; identical to SEQ ID NO: 10392

SEQ ID NO: 88154 - RNA, 64 nt, Human; identical to SEQ ID NO: 10393

SEQ ID NO: 88155 - RNA, 64 nt, Human; identical to SEQ ID NO: 10394

SEQ ID NO: 88156 - RNA, 64 nt, Human; identical to SEQ ID NO: 10395

SEQ ID NO: 88157 - RNA, 64 nt, Human; identical to SEQ ID NO: 10396

SEQ ID NO: 88158 - RNA, 64 nt, Human; identical to SEQ ID NO: 10397

SEQ ID NO: 88159 - RNA, 64 nt, Human; identical to SEQ ID NO: 10398

SEQ ID NO: 88160 - RNA, 64 nt, Human; identical to SEQ ID NO: 10399

SEQ ID NO: 88161 - RNA, 64 nt, Human; identical to SEQ ID NO: 10400

SEQ ID NO: 88162 - RNA, 64 nt, Human; identical to SEQ ID NO: 10401

SEQ ID NO: 88163 - RNA, 64 nt, Human; identical to SEQ ID NO: 10402

SEQ ID NO: 88164 - RNA, 64 nt, Human; identical to SEQ ID NO: 10403

SEQ ID NO: 88165 - RNA, 64 nt, Human; identical to SEQ ID NO: 10404

SEQ ID NO: 88166 - RNA, 64 nt, Human; identical to SEQ ID NO: 10405

SEQ ID NO: 88167 - RNA, 64 nt, Human; identical to SEQ ID NO: 10406

SEQ ID NO: 88168 - RNA, 64 nt, Human; identical to SEQ ID NO: 10407

SEQ ID NO: 88169 - RNA, 64 nt, Human; identical to SEQ ID NO: 10408

SEQ ID NO: 88170 - RNA, 64 nt, Human; identical to SEQ ID NO: 10409

SEQ ID NO: 88171 - RNA, 64 nt, Human; identical to SEQ ID NO: 10410

SEQ ID NO: 88172 - RNA, 64 nt, Human; identical to SEQ ID NO: 10411

SEQ ID NO: 88173 - RNA, 64 nt, Human; identical to SEQ ID NO: 10412

SEQ ID NO: 88174 - RNA, 64 nt, Human; identical to SEQ ID NO: 10413

SEQ ID NO: 88175 - RNA, 64 nt, Human; identical to SEQ ID NO: 10414

SEQ ID NO: 88176 - RNA, 64 nt, Human; identical to SEQ ID NO: 10415

SEQ ID NO: 88177 - RNA, 64 nt, Human; identical to SEQ ID NO: 10416

SEQ ID NO: 88178 - RNA, 64 nt, Human; identical to SEQ ID NO: 10417

SEQ ID NO: 88179 - RNA, 64 nt, Human; identical to SEQ ID NO: 10418

SEQ ID NO: 88180 - RNA, 64 nt, Human; identical to SEQ ID NO: 10419

SEQ ID NO: 88181 - RNA, 64 nt, Human; identical to SEQ ID NO: 10420

SEQ ID NO: 88182 - RNA, 64 nt, Human; identical to SEQ ID NO: 10421

SEQ ID NO: 88183 - RNA, 64 nt, Human; identical to SEQ ID NO: 10422

SEQ ID NO: 88184 - RNA, 64 nt, Human; identical to SEQ ID NO: 10423

SEQ ID NO: 88185 - RNA, 58 nt, Human; identical to SEQ ID NO: 10424

SEQ ID NO: 88186 - RNA, 64 nt, Human; identical to SEQ ID NO: 10425

SEQ ID NO: 88187 - RNA, 64 nt, Human; identical to SEQ ID NO: 10426

SEQ ID NO: 88188 - RNA, 64 nt, Human; identical to SEQ ID NO: 10427

SEQ ID NO: 88189 - RNA, 64 nt, Human; identical to SEQ ID NO: 10428

SEQ ID NO: 88190 - RNA, 64 nt, Human; identical to SEQ ID NO: 10429

SEQ ID NO: 88191 - RNA, 64 nt, Human; identical to SEQ ID NO: 10430

SEQ ID NO: 88192 - RNA, 64 nt, Human; identical to SEQ ID NO: 10431

SEQ ID NO: 88193 - RNA, 64 nt, Human; identical to SEQ ID NO: 10432

SEQ ID NO: 88194 - RNA, 64 nt, Human; identical to SEQ ID NO: 10433

SEQ ID NO: 88195 - RNA, 51 nt, Human; identical to SEQ ID NO: 10434

SEQ ID NO: 88196 - RNA, 64 nt, Human; identical to SEQ ID NO: 10435

SEQ ID NO: 88197 - RNA, 64 nt, Human; identical to SEQ ID NO: 10436

SEQ ID NO: 88198 - RNA, 64 nt, Human; identical to SEQ ID NO: 10437

SEQ ID NO: 88199 - RNA, 64 nt, Human; identical to SEQ ID NO: 10438

SEQ ID NO: 88200 - RNA, 64 nt, Human; identical to SEQ ID NO: 10439

SEQ ID NO: 88201 - RNA, 62 nt, Human; identical to SEQ ID NO: 10440

SEQ ID NO: 88202 - RNA, 64 nt, Human; identical to SEQ ID NO: 10441

SEQ ID NO: 88203 - RNA, 64 nt, Human; identical to SEQ ID NO: 10442

SEQ ID NO: 88204 - RNA, 64 nt, Human; identical to SEQ ID NO: 10443

SEQ ID NO: 88205 - RNA, 64 nt, Human; identical to SEQ ID NO: 10444

SEQ ID NO: 88206 - RNA, 64 nt, Human; identical to SEQ ID NO: 10445

SEQ ID NO: 88207 - RNA, 64 nt, Human; identical to SEQ ID NO: 10446

SEQ ID NO: 88208 - RNA, 64 nt, Human; identical to SEQ ID NO: 10447

SEQ ID NO: 88209 - RNA, 64 nt, Human; identical to SEQ ID NO: 10448

SEQ ID NO: 88210 - RNA, 64 nt, Human; identical to SEQ ID NO: 10449

SEQ ID NO: 88211 - RNA, 64 nt, Human; identical to SEQ ID NO: 10450

SEQ ID NO: 88212 - RNA, 64 nt, Human; identical to SEQ ID NO: 10451

SEQ ID NO: 88213 - RNA, 64 nt, Human; identical to SEQ ID NO: 10452

SEQ ID NO: 88214 - RNA, 64 nt, Human; identical to SEQ ID NO: 10453

SEQ ID NO: 88215 - RNA, 64 nt, Human; identical to SEQ ID NO: 10454

SEQ ID NO: 88216 - RNA, 64 nt, Human; identical to SEQ ID NO: 10455

SEQ ID NO: 88217 - RNA, 64 nt, Human; identical to SEQ ID NO: 10456

SEQ ID NO: 88218 - RNA, 64 nt, Human; identical to SEQ ID NO: 10457

SEQ ID NO: 88219 - RNA, 64 nt, Human; identical to SEQ ID NO: 10458

SEQ ID NO: 88220 - RNA, 64 nt, Human; identical to SEQ ID NO: 10459

SEQ ID NO: 88221 - RNA, 64 nt, Human; identical to SEQ ID NO: 10460

SEQ ID NO: 88222 - RNA, 64 nt, Human; identical to SEQ ID NO: 10461

SEQ ID NO: 88223 - RNA, 64 nt, Human; identical to SEQ ID NO: 10462

SEQ ID NO: 88224 - RNA, 64 nt, Human; identical to SEQ ID NO: 10463

SEQ ID NO: 88225 - RNA, 64 nt, Human; identical to SEQ ID NO: 10464

SEQ ID NO: 88226 - RNA, 64 nt, Human; identical to SEQ ID NO: 10465

SEQ ID NO: 88227 - RNA, 64 nt, Human; identical to SEQ ID NO: 10466

SEQ ID NO: 88228 - RNA, 64 nt, Human; identical to SEQ ID NO: 10467

SEQ ID NO: 88229 - RNA, 64 nt, Human; identical to SEQ ID NO: 10468

SEQ ID NO: 88230 - RNA, 64 nt, Human; identical to SEQ ID NO: 10469

SEQ ID NO: 88231 - RNA, 64 nt, Human; identical to SEQ ID NO: 10470

SEQ ID NO: 88232 - RNA, 64 nt, Human; identical to SEQ ID NO: 10471

SEQ ID NO: 88233 - RNA, 64 nt, Human; identical to SEQ ID NO: 10472

SEQ ID NO: 88234 - RNA, 64 nt, Human; identical to SEQ ID NO: 10473

SEQ ID NO: 88235 - RNA, 64 nt, Human; identical to SEQ ID NO: 10474

SEQ ID NO: 88236 - RNA, 64 nt, Human; identical to SEQ ID NO: 10475

SEQ ID NO: 88237 - RNA, 64 nt, Human; identical to SEQ ID NO: 10476

SEQ ID NO: 88238 - RNA, 64 nt, Human; identical to SEQ ID NO: 10477

SEQ ID NO: 88239 - RNA, 64 nt, Human; identical to SEQ ID NO: 10478

SEQ ID NO: 88240 - RNA, 64 nt, Human; identical to SEQ ID NO: 10479

SEQ ID NO: 88241 - RNA, 64 nt, Human; identical to SEQ ID NO: 10480

SEQ ID NO: 88242 - RNA, 64 nt, Human; identical to SEQ ID NO: 10481

SEQ ID NO: 88243 - RNA, 64 nt, Human; identical to SEQ ID NO: 10482

SEQ ID NO: 88244 - RNA, 64 nt, Human; identical to SEQ ID NO: 10483

SEQ ID NO: 88245 - RNA, 64 nt, Human; identical to SEQ ID NO: 10484

SEQ ID NO: 88246 - RNA, 64 nt, Human; identical to SEQ ID NO: 10485

SEQ ID NO: 88247 - RNA, 64 nt, Human; identical to SEQ ID NO: 10486

SEQ ID NO: 88248 - RNA, 64 nt, Human; identical to SEQ ID NO: 10487

SEQ ID NO: 88249 - RNA, 64 nt, Human; identical to SEQ ID NO: 10488

SEQ ID NO: 88250 - RNA, 64 nt, Human; identical to SEQ ID NO: 10489

SEQ ID NO: 88251 - RNA, 64 nt, Human; identical to SEQ ID NO: 10490

SEQ ID NO: 88252 - RNA, 64 nt, Human; identical to SEQ ID NO: 10491

SEQ ID NO: 88253 - RNA, 64 nt, Human; identical to SEQ ID NO: 10492

SEQ ID NO: 88254 - RNA, 64 nt, Human; identical to SEQ ID NO: 10493

SEQ ID NO: 88255 - RNA, 64 nt, Human; identical to SEQ ID NO: 10494

SEQ ID NO: 88256 - RNA, 64 nt, Human; identical to SEQ ID NO: 10495

SEQ ID NO: 88257 - RNA, 64 nt, Human; identical to SEQ ID NO: 10496

SEQ ID NO: 88258 - RNA, 64 nt, Human; identical to SEQ ID NO: 10497

SEQ ID NO: 88259 - RNA, 64 nt, Human; identical to SEQ ID NO: 10498

SEQ ID NO: 88260 - RNA, 64 nt, Human; identical to SEQ ID NO: 10499

SEQ ID NO: 88261 - RNA, 64 nt, Human; identical to SEQ ID NO: 10500

SEQ ID NO: 88262 - RNA, 64 nt, Human; identical to SEQ ID NO: 10501

SEQ ID NO: 88263 - RNA, 64 nt, Human; identical to SEQ ID NO: 10502

SEQ ID NO: 88264 - RNA, 64 nt, Human; identical to SEQ ID NO: 10503

SEQ ID NO: 88265 - RNA, 64 nt, Human; identical to SEQ ID NO: 10504

SEQ ID NO: 88266 - RNA, 64 nt, Human; identical to SEQ ID NO: 10505

SEQ ID NO: 88267 - RNA, 64 nt, Human; identical to SEQ ID NO: 10506

SEQ ID NO: 88268 - RNA, 64 nt, Human; identical to SEQ ID NO: 10507

SEQ ID NO: 88269 - RNA, 64 nt, Human; identical to SEQ ID NO: 10508

SEQ ID NO: 88270 - RNA, 64 nt, Human; identical to SEQ ID NO: 10509

SEQ ID NO: 88271 - RNA, 64 nt, Human; identical to SEQ ID NO: 10510

SEQ ID NO: 88272 - RNA, 64 nt, Human; identical to SEQ ID NO: 10511

SEQ ID NO: 88273 - RNA, 64 nt, Human; identical to SEQ ID NO: 10512

SEQ ID NO: 88274 - RNA, 64 nt, Human; identical to SEQ ID NO: 10513

SEQ ID NO: 88275 - RNA, 64 nt, Human; identical to SEQ ID NO: 10514

SEQ ID NO: 88276 - RNA, 64 nt, Human; identical to SEQ ID NO: 10515

SEQ ID NO: 88277 - RNA, 64 nt, Human; identical to SEQ ID NO: 10516

SEQ ID NO: 88278 - RNA, 64 nt, Human; identical to SEQ ID NO: 10517

SEQ ID NO: 88279 - RNA, 64 nt, Human; identical to SEQ ID NO: 10518

SEQ ID NO: 88280 - RNA, 64 nt, Human; identical to SEQ ID NO: 10519

SEQ ID NO: 88281 - RNA, 64 nt, Human; identical to SEQ ID NO: 10520

SEQ ID NO: 88282 - RNA, 64 nt, Human; identical to SEQ ID NO: 10521

SEQ ID NO: 88283 - RNA, 64 nt, Human; identical to SEQ ID NO: 10522

SEQ ID NO: 88284 - RNA, 64 nt, Human; identical to SEQ ID NO: 10523

SEQ ID NO: 88285 - RNA, 64 nt, Human; identical to SEQ ID NO: 10524

SEQ ID NO: 88286 - RNA, 64 nt, Human; identical to SEQ ID NO: 10525

SEQ ID NO: 88287 - RNA, 64 nt, Human; identical to SEQ ID NO: 10526

SEQ ID NO: 88288 - RNA, 64 nt, Human; identical to SEQ ID NO: 10527

SEQ ID NO: 88289 - RNA, 64 nt, Human; identical to SEQ ID NO: 10528

SEQ ID NO: 88290 - RNA, 64 nt, Human; identical to SEQ ID NO: 10529

SEQ ID NO: 88291 - RNA, 59 nt, Human; identical to SEQ ID NO: 10530

SEQ ID NO: 88292 - RNA, 64 nt, Human; identical to SEQ ID NO: 10531

SEQ ID NO: 88293 - RNA, 64 nt, Human; identical to SEQ ID NO: 10532

SEQ ID NO: 88294 - RNA, 64 nt, Human; identical to SEQ ID NO: 10533

SEQ ID NO: 88295 - RNA, 64 nt, Human; identical to SEQ ID NO: 10534

SEQ ID NO: 88296 - RNA, 64 nt, Human; identical to SEQ ID NO: 10535

SEQ ID NO: 88297 - RNA, 64 nt, Human; identical to SEQ ID NO: 10536

SEQ ID NO: 88298 - RNA, 64 nt, Human; identical to SEQ ID NO: 10537

SEQ ID NO: 88299 - RNA, 64 nt, Human; identical to SEQ ID NO: 10538

SEQ ID NO: 88300 - RNA, 64 nt, Human; identical to SEQ ID NO: 10539

SEQ ID NO: 88301 - RNA, 64 nt, Human; identical to SEQ ID NO: 10540

SEQ ID NO: 88302 - RNA, 64 nt, Human; identical to SEQ ID NO: 10541

SEQ ID NO: 88303 - RNA, 64 nt, Human; identical to SEQ ID NO: 10542

SEQ ID NO: 88304 - RNA, 64 nt, Human; identical to SEQ ID NO: 10543

SEQ ID NO: 88305 - RNA, 64 nt, Human; identical to SEQ ID NO: 10544

SEQ ID NO: 88306 - RNA, 64 nt, Human; identical to SEQ ID NO: 10545

SEQ ID NO: 88307 - RNA, 64 nt, Human; identical to SEQ ID NO: 10546

SEQ ID NO: 88308 - RNA, 64 nt, Human; identical to SEQ ID NO: 10547

SEQ ID NO: 88309 - RNA, 64 nt, Human; identical to SEQ ID NO: 10548

SEQ ID NO: 88310 - RNA, 64 nt, Human; identical to SEQ ID NO: 10549

SEQ ID NO: 88311 - RNA, 64 nt, Human; identical to SEQ ID NO: 10550

SEQ ID NO: 88312 - RNA, 64 nt, Human; identical to SEQ ID NO: 10551

SEQ ID NO: 88313 - RNA, 64 nt, Human; identical to SEQ ID NO: 10552

SEQ ID NO: 88314 - RNA, 64 nt, Human; identical to SEQ ID NO: 10553

SEQ ID NO: 88315 - RNA, 64 nt, Human; identical to SEQ ID NO: 10554

SEQ ID NO: 88316 - RNA, 64 nt, Human; identical to SEQ ID NO: 10555

SEQ ID NO: 88317 - RNA, 64 nt, Human; identical to SEQ ID NO: 10556

SEQ ID NO: 88318 - RNA, 64 nt, Human; identical to SEQ ID NO: 10557

SEQ ID NO: 88319 - RNA, 64 nt, Human; identical to SEQ ID NO: 10558

SEQ ID NO: 88320 - RNA, 64 nt, Human; identical to SEQ ID NO: 10559

SEQ ID NO: 88321 - RNA, 64 nt, Human; identical to SEQ ID NO: 10560

SEQ ID NO: 88322 - RNA, 64 nt, Human; identical to SEQ ID NO: 10561

SEQ ID NO: 88323 - RNA, 64 nt, Human; identical to SEQ ID NO: 10562

SEQ ID NO: 88324 - RNA, 64 nt, Human; identical to SEQ ID NO: 10563

SEQ ID NO: 88325 - RNA, 64 nt, Human; identical to SEQ ID NO: 10564

SEQ ID NO: 88326 - RNA, 64 nt, Human; identical to SEQ ID NO: 10565

SEQ ID NO: 88327 - RNA, 64 nt, Human; identical to SEQ ID NO: 10566

SEQ ID NO: 88328 - RNA, 64 nt, Human; identical to SEQ ID NO: 10567

SEQ ID NO: 88329 - RNA, 64 nt, Human; identical to SEQ ID NO: 10568

SEQ ID NO: 88330 - RNA, 64 nt, Human; identical to SEQ ID NO: 10569

SEQ ID NO: 88331 - RNA, 64 nt, Human; identical to SEQ ID NO: 10570

SEQ ID NO: 88332 - RNA, 64 nt, Human; identical to SEQ ID NO: 10571

SEQ ID NO: 88333 - RNA, 64 nt, Human; identical to SEQ ID NO: 10572

SEQ ID NO: 88334 - RNA, 64 nt, Human; identical to SEQ ID NO: 10573

SEQ ID NO: 88335 - RNA, 64 nt, Human; identical to SEQ ID NO: 10574

SEQ ID NO: 88336 - RNA, 64 nt, Human; identical to SEQ ID NO: 10575

SEQ ID NO: 88337 - RNA, 64 nt, Human; identical to SEQ ID NO: 10576

SEQ ID NO: 88338 - RNA, 64 nt, Human; identical to SEQ ID NO: 10577

SEQ ID NO: 88339 - RNA, 64 nt, Human; identical to SEQ ID NO: 10578

SEQ ID NO: 88340 - RNA, 64 nt, Human; identical to SEQ ID NO: 10579

SEQ ID NO: 88341 - RNA, 64 nt, Human; identical to SEQ ID NO: 10580

SEQ ID NO: 88342 - RNA, 64 nt, Human; identical to SEQ ID NO: 10581

SEQ ID NO: 88343 - RNA, 64 nt, Human; identical to SEQ ID NO: 10582

SEQ ID NO: 88344 - RNA, 64 nt, Human; identical to SEQ ID NO: 10583

SEQ ID NO: 88345 - RNA, 64 nt, Human; identical to SEQ ID NO: 10584

SEQ ID NO: 88346 - RNA, 64 nt, Human; identical to SEQ ID NO: 10585

SEQ ID NO: 88347 - RNA, 64 nt, Human; identical to SEQ ID NO: 10586

SEQ ID NO: 88348 - RNA, 64 nt, Human; identical to SEQ ID NO: 10587

SEQ ID NO: 88349 - RNA, 64 nt, Human; identical to SEQ ID NO: 10588

SEQ ID NO: 88350 - RNA, 64 nt, Human; identical to SEQ ID NO: 10589

SEQ ID NO: 88351 - RNA, 64 nt, Human; identical to SEQ ID NO: 10590

SEQ ID NO: 88352 - RNA, 64 nt, Human; identical to SEQ ID NO: 10591

SEQ ID NO: 88353 - RNA, 64 nt, Human; identical to SEQ ID NO: 10592

SEQ ID NO: 88354 - RNA, 64 nt, Human; identical to SEQ ID NO: 10593

SEQ ID NO: 88355 - RNA, 64 nt, Human; identical to SEQ ID NO: 10594

SEQ ID NO: 88356 - RNA, 64 nt, Human; identical to SEQ ID NO: 10595

SEQ ID NO: 88357 - RNA, 64 nt, Human; identical to SEQ ID NO: 10596

SEQ ID NO: 88358 - RNA, 64 nt, Human; identical to SEQ ID NO: 10597

SEQ ID NO: 88359 - RNA, 64 nt, Human; identical to SEQ ID NO: 10598

SEQ ID NO: 88360 - RNA, 56 nt, Human; identical to SEQ ID NO: 10599

SEQ ID NO: 88361 - RNA, 64 nt, Human; identical to SEQ ID NO: 10600

SEQ ID NO: 88362 - RNA, 64 nt, Human; identical to SEQ ID NO: 10601

SEQ ID NO: 88363 - RNA, 64 nt, Human; identical to SEQ ID NO: 10602

SEQ ID NO: 88364 - RNA, 64 nt, Human; identical to SEQ ID NO: 10603

SEQ ID NO: 88365 - RNA, 64 nt, Human; identical to SEQ ID NO: 10604

SEQ ID NO: 88366 - RNA, 64 nt, Human; identical to SEQ ID NO: 10605

SEQ ID NO: 88367 - RNA, 64 nt, Human; identical to SEQ ID NO: 10606

SEQ ID NO: 88368 - RNA, 64 nt, Human; identical to SEQ ID NO: 10607

SEQ ID NO: 88369 - RNA, 64 nt, Human; identical to SEQ ID NO: 10608

SEQ ID NO: 88370 - RNA, 64 nt, Human; identical to SEQ ID NO: 10609

SEQ ID NO: 88371 - RNA, 64 nt, Human; identical to SEQ ID NO: 10610

SEQ ID NO: 88372 - RNA, 64 nt, Human; identical to SEQ ID NO: 10611

SEQ ID NO: 88373 - RNA, 64 nt, Human; identical to SEQ ID NO: 10612

SEQ ID NO: 88374 - RNA, 64 nt, Human; identical to SEQ ID NO: 10613

SEQ ID NO: 88375 - RNA, 64 nt, Human; identical to SEQ ID NO: 10614

SEQ ID NO: 88376 - RNA, 64 nt, Human; identical to SEQ ID NO: 10615

SEQ ID NO: 88377 - RNA, 64 nt, Human; identical to SEQ ID NO: 10616

SEQ ID NO: 88378 - RNA, 64 nt, Human; identical to SEQ ID NO: 10617

SEQ ID NO: 88379 - RNA, 64 nt, Human; identical to SEQ ID NO: 10618

SEQ ID NO: 88380 - RNA, 64 nt, Human; identical to SEQ ID NO: 10619

SEQ ID NO: 88381 - RNA, 64 nt, Human; identical to SEQ ID NO: 10620

SEQ ID NO: 88382 - RNA, 64 nt, Human; identical to SEQ ID NO: 10621

SEQ ID NO: 88383 - RNA, 64 nt, Human; identical to SEQ ID NO: 10622

SEQ ID NO: 88384 - RNA, 64 nt, Human; identical to SEQ ID NO: 10623

SEQ ID NO: 88385 - RNA, 64 nt, Human; identical to SEQ ID NO: 10624

SEQ ID NO: 88386 - RNA, 64 nt, Human; identical to SEQ ID NO: 10625

SEQ ID NO: 88387 - RNA, 64 nt, Human; identical to SEQ ID NO: 10626

SEQ ID NO: 88388 - RNA, 64 nt, Human; identical to SEQ ID NO: 10627

SEQ ID NO: 88389 - RNA, 64 nt, Human; identical to SEQ ID NO: 10628

SEQ ID NO: 88390 - RNA, 64 nt, Human; identical to SEQ ID NO: 10629

SEQ ID NO: 88391 - RNA, 64 nt, Human; identical to SEQ ID NO: 10630

SEQ ID NO: 88392 - RNA, 64 nt, Human; identical to SEQ ID NO: 10631

SEQ ID NO: 88393 - RNA, 64 nt, Human; identical to SEQ ID NO: 10632

SEQ ID NO: 88394 - RNA, 64 nt, Human; identical to SEQ ID NO: 10633

SEQ ID NO: 88395 - RNA, 64 nt, Human; identical to SEQ ID NO: 10634

SEQ ID NO: 88396 - RNA, 64 nt, Human
uuuaaaaaaguaaguaccacucaggccaacaagccaacgacaaagccaaacucugccagccaca

SEQ ID NO: 88397 - RNA, 64 nt, Human
acacagcggguuacauccacacugcugaucacaccaacgacaggagcugauaagcaagaaagcg

SEQ ID NO: 88398 - RNA, 64 nt, Human
cuuaaagguuuauuucaaauuaaaacaaaaaaaucaacgacagcaguagacacaggcaccacau

SEQ ID NO: 88399 - RNA, 64 nt, Human
ccugggcgagacuucaucucuacaaaaaaagcaacaacgacaaaaaaaauuagccaagcauagu

SEQ ID NO: 88400 - RNA, 64 nt, Human
uaaauuccaugugccucuggguacaaaagugccucaacgacaugcucuggaaaucccaaaugcc

SEQ ID NO: 88401 - RNA, 64 nt, Human
cugugcuuauauaauuuuugggacccagaagaaacaacgacacaaucuuagaaucacuccugag

SEQ ID NO: 88402 - RNA, 64 nt, Human
uguaaaagugcaacaggcaauugaauccaaauuucaacgacaaaaaaaaaaaacauguauuuua

SEQ ID NO: 88403 - RNA, 64 nt, Human; identical to SEQ ID NO: 84751

SEQ ID NO: 88404 - RNA, 64 nt, Human
uugguuuaccuccaucauuaaaaaacaacaaugacaacgacaacaaaaaacaaaacuaaaacga

SEQ ID NO: 88405 - RNA, 64 nt, Human
ccaugaguuuuuuaguuucacaguuuuacagauccaacgacacaaucuuuuaaucuuuggucac

SEQ ID NO: 88406 - RNA, 64 nt, Human
ccuccuauuuuaaucagcaaaauccauaccaaaacaacgacaacaacgcccucuuaagggacca

SEQ ID NO: 88407 - RNA, 64 nt, Human
guuuguauaaaauaaacuaucucaagaaaguuuucaacgacagugauaguguucauuuguaaga

SEQ ID NO: 88408 - RNA, 64 nt, Human
cacccucucugaaaaucuuucuuguucaaaacagcaacgacauaucuuguuaacuuuuacggug

SEQ ID NO: 88409 - RNA, 64 nt, Human
aauauguuugcaaacuuguuagaucaaccuccaacaacgacacauucaggaguuaaauauuuuu

SEQ ID NO: 88410 - RNA, 64 nt, Human
aguagccucuuuaaauaauauguauagacaacaacaacgacaaaaaauagacuguuuuaaaguu

SEQ ID NO: 88411 - RNA, 64 nt, Human
auauagugugugauguguaaaucaggucaaaccucaacgacaauugaaaguuguuauuguccua

SEQ ID NO: 88412 - RNA, 64 nt, Human
ucuccccucaaagaaaagacauucagguguuucucaacgacaucuucuguccagcaagcucggu

SEQ ID NO: 88413 - RNA, 64 nt, Human
ucaagccagggaaugcauugcagaggcaccugcacaacgacaaacuugaguguuucccugccac

SEQ ID NO: 88414 - RNA, 64 nt, Human
uguaaaaaugcucaaccugguuuccaaagucuuucaacgacacccugaucuucacuaaaaauug

SEQ ID NO: 88415 - RNA, 64 nt, Human
aggaaaaguuauaaauuagcuacugcgccucugacaacgacagaagagcauuuagaagaacaaa

SEQ ID NO: 88416 - RNA, 64 nt, Human
auuauuuauauucaacugacagacaaaaaccaaccaacgacaaaacaaaaacccccaaucauga

SEQ ID NO: 88417 - RNA, 61 nt, Human
ggggaagcuccagaaggugagggagaggggacaacgacaugguucccguggaucuuuaacu

SEQ ID NO: 88418 - RNA, 64 nt, Human
gggagauguuccccgugguguauccucaugguaacaacgacaaaaaaugccgguugucuguguu

SEQ ID NO: 88419 - RNA, 64 nt, Human
uccuuuuuuuccacaguuuuaauauauuauucuucaacgacauuuuuuguaacuuuacacuuuu

SEQ ID NO: 88420 - RNA, 64 nt, Human
ucuccauuuggcccacccuggcuucucuaaaaagcaacgacagcaacagacaaacaaaaagcuc

SEQ ID NO: 88421 - RNA, 64 nt, Human
acagucugagcuagcaccacccucagccaggcuacaacgacagcacuggagggucuucccucuc

SEQ ID NO: 88422 - RNA, 64 nt, Human
gucccagcccauucuccguugaaacagaucacagcaacgacaaacgcucauggcgcugcuuugc

SEQ ID NO: 88423 - RNA, 64 nt, Human
ucaauauacaaaauaugguagcauuuuuauacaccaacgacauccaagcugagagccaaaucaa

SEQ ID NO: 88424 - RNA, 64 nt, Human
ggcagccucucgccagccuucccguccuucaguucaacgacaucuuuggaguguuuuuguuuuc

SEQ ID NO: 88425 - RNA, 64 nt, Human
caauuuuguccaacggacaagaaaaaagcaaagucaacgacaccauuaucuugucaagaucaga

SEQ ID NO: 88426 - RNA, 64 nt, Human
ucagagggaaugcaggacguggucuauggugagccaacgacacagugagaaggagcaggaaguu

SEQ ID NO: 88427 - RNA, 64 nt, Human
ucauugaguuucuuguuuuggugccugaccgaaccaacgacagccccaaucuucccgucuuuau

SEQ ID NO: 88428 - RNA, 64 nt, Human
gcgguggccaggacaacgggcuggagggucugggcaacgacagccgagacauguacauggaguc

SEQ ID NO: 88429 - RNA, 64 nt, Human
ucacacacagacacagugacaacacacaccaugacaacgacaccuauagauauggcaccaacau

SEQ ID NO: 88430 - RNA, 64 nt, Human
ggugaaggggcagaccaacgaaaccagaugagaccaacgacaccaugcgagacacgcuugcaga

SEQ ID NO: 88431 - RNA, 64 nt, Human
agaaaauaaaaauucugggccuuacuuguuuuuucaacgacaguuuuggucuucaguuaaggua

SEQ ID NO: 88432 - RNA, 64 nt, Human
cauuugcauggcugggcuccagggaaacuacugacaacgacagguggugggccauaguuuccug

SEQ ID NO: 88433 - RNA, 64 nt, Human
acuucagcagcccacagcuguggggcuucagcagccacaccagcccagcccagcccagcucucg

SEQ ID NO: 88434 - RNA, 64 nt, Human
acggaugacccuggacacucaagccaaaguuaggccacaccaggcccaacccugugcuggucaa

SEQ ID NO: 88435 - RNA, 64 nt, Human
gcagggacgacacucuccagggaggccccagcaaccacaccaucuucuugcugugagaggucuc

SEQ ID NO: 88436 - RNA, 64 nt, Human
ggucaugugcuccuagcugcacgguggcugcuggccacaccacggcaaguggcagcaggggccg

SEQ ID NO: 88437 - RNA, 64 nt, Human
ugcagccccgcgccuccuuccuugcuguccuaggccacaccaucuccuuucagggaauuucagg

SEQ ID NO: 88438 - RNA, 64 nt, Human
aggcugagcgcaggaggacaggcaccaccggaugccacaccaggcaggaggagguguggacagu

SEQ ID NO: 88439 - RNA, 64 nt, Human
gaugucucgcuccaccugggucugggaccuggcuccacaccaguuaccugggaccaguaggugc

SEQ ID NO: 88440 - RNA, 64 nt, Human
gagagaccagagccucuggaggcuacccaggggaccacaccaaguccuugccugugccgggcga

SEQ ID NO: 88441 - RNA, 64 nt, Human
cucucggcucagugacagccaaccugcccccuccccacaccaaucagccaggcugagcccccac

SEQ ID NO: 88442 - RNA, 64 nt, Human
ucuaagggaauucaggaauucagacgugcuagucccacaccaguuagguagagcugucuguuca

SEQ ID NO: 88443 - RNA, 64 nt, Human
agcccacggggaucacagcguuucaggaacguugccacaccaaucagagagccuagaacauccc

SEQ ID NO: 88444 - RNA, 64 nt, Human
gcuuuggagagguaaaacaaaguggcacagucauccacaccauugcucuggggccgucugcuga

SEQ ID NO: 88445 - RNA, 64 nt, Human
uuguuuucuguuuguuuguuuucauguugaaugcccacaccaccauccucucaucccagccagu

SEQ ID NO: 88446 - RNA, 64 nt, Human
ccccuggacugucguggcuccccucaucagcuccccacaccagucaaggcuucucagcuggaga

SEQ ID NO: 88447 - RNA, 64 nt, Human
aacuccuggugugugugagcaugcccuuugcuugccacaccauauccuuuccccagauccaccu

SEQ ID NO: 88448 - RNA, 64 nt, Human
guacauccaucccaggacacagcccagccccuccccacaccauacaagguaucagaaaagucua

SEQ ID NO: 88449 - RNA, 64 nt, Human
gccugaagacacaggguggauuauuuccuggccuccacaccaaacguucccuugcagauggaga

SEQ ID NO: 88450 - RNA, 64 nt, Human
uggaagcaauuaaauaugcguaacagugcuacggccacaccagcaccuccuggcugaaggucag

SEQ ID NO: 88451 - RNA, 64 nt, Human
uuuuuuuuggcgagucaccagugacccgagcccuccacaccagccuccuguaucucaucagguc

SEQ ID NO: 88452 - RNA, 64 nt, Human
cccuuagggcaggaagggacgaugagcaagucugccacaccaccuggugacugggaagggcugc

SEQ ID NO: 88453 - RNA, 58 nt, Human
acguguugcugcccagcugaguggccagccacaccaacccugugcucucuggccccca

SEQ ID NO: 88454 - RNA, 64 nt, Human
caauaaauauaaaauaugguaauuggaauuaacuccacaccauaguaugcauuguuauacauac

SEQ ID NO: 88455 - RNA, 64 nt, Human
aggguugccugagagccaaccucuccugccacccccacaccaagaacuauaugguuccuacuuc

SEQ ID NO: 88456 - RNA, 64 nt, Human
auggaggcugacagaggcaggagccuaccccuggccacaccaccucugggacacggcacccccc

SEQ ID NO: 88457 - RNA, 64 nt, Human
gagccuggacugacacccagugggaccaguguugccacaccaguugauaaaaugcagaaacccu

SEQ ID NO: 88458 - RNA, 64 nt, Human
gaacccugucugccccuucccaccuguccuugggccacaccaucacacugaaccacaggacaga

SEQ ID NO: 88459 - RNA, 64 nt, Human
cauacguuagccaugcugcugguauggagaaauuccacaccaugauuauuagccuccuuuaagc

SEQ ID NO: 88460 - RNA, 64 nt, Human
ucuacaggcccggcccagccuaggcccgggguggccacaccacagcaagccggcccccccucuu

SEQ ID NO: 88461 - RNA, 64 nt, Human
ucacaguuucauugauugacucuaccuccuugccccacaccacuuuugcaaucuuuaaacuuuc

SEQ ID NO: 88462 - RNA, 64 nt, Human
caggauguaauaaauacauuuuggugugacuaggccacaccaacucuuaaucaucucccauuuu

SEQ ID NO: 88463 - RNA, 64 nt, Human
acaggggauaaauguaagcuuguuaaaguaagcaccacaccauguuucugucuccccagcaccc

SEQ ID NO: 88464 - RNA, 64 nt, Human
ggagccaccacuccugccugcccccacacccacuccacaccaguaauaaaaagccaccacacac

SEQ ID NO: 88465 - RNA, 64 nt, Human
ccccccgaguggcugguauuacaagcacaugccaccacaccaggcuaauuuuuguauuuuuagu

SEQ ID NO: 88466 - RNA, 64 nt, Human
agcugccuggcagugcucccaguuuguagggaagccacaccagaucugggugccuugggagaac

SEQ ID NO: 88467 - RNA, 64 nt, Human
cauaagaaaaaucagcugaaguguuaccaacuagccacaccaugaauuguccguaauguucauu

SEQ ID NO: 88468 - RNA, 64 nt, Human
aaacucuauuuauaccuuaacaugaaauccaugaccacaccaaacuugguuauucauaauuuuu

SEQ ID NO: 88469 - RNA, 64 nt, Human
acagcccacuugucaaauauguaauucaccgaaaccacaccaaguccugcuacuguagagugga

SEQ ID NO: 88470 - RNA, 64 nt, Human
uggacaaugucuacugcauugggcagcggcgcuuccacaccauggacgagcugguggaacacua

SEQ ID NO: 88471 - RNA, 64 nt, Human
caagguccuuuaugaguguuaccccucuacacguccacaccacucaccacacauacauacacau

SEQ ID NO: 88472 - RNA, 64 nt, Human
cuuacuguuuucugcuuuuacagcagcuucucucccacaccacaacuuuauuaagguauagugg

SEQ ID NO: 88473 - RNA, 64 nt, Human
aaagaagcaggguacgcagggcuacauguagauaccacaccaaggcuggaggcuggucugucau

SEQ ID NO: 88474 - RNA, 52 nt, Human
aaggggagaccucuggcuaggcccacaccagggccuggcugggaguggcaug

SEQ ID NO: 88475 - RNA, 64 nt, Human
cuuagggagcuuccagugauugauuuuaggaggcccacaccaaacuccccaggaaaugacugcc

SEQ ID NO: 88476 - RNA, 64 nt, Human
cuggccuggcccccgcccugcagggacacagaagccacaccauuugcaccauccacgccuugcu

SEQ ID NO: 88477 - RNA, 57 nt, Human
gccuucugcccacucccuagccuuggcccacaccagauccuuggagugaagucgguc

SEQ ID NO: 88478 - RNA, 64 nt, Human
aguuggaggaucugaacauacagagcccacauuuccacaccagaacuggaacuacguagcuagu

SEQ ID NO: 88479 - RNA, 64 nt, Human
auuccucugucccugcagacucagugcagcacuuccacaccaagaaggcccucaauaaaggcuu

SEQ ID NO: 88480 - RNA, 64 nt, Human
gcagugccccaguagggacucugugugggggcucccacaccacauuucccuucugcacugcccu

SEQ ID NO: 88481 - RNA, 64 nt, Human
uagauaaaccagcgcaggccuuaaacaaggcaugccacaccauugcuguuccccaucugguacu

SEQ ID NO: 88482 - RNA, 64 nt, Human
aaaggguuugggcguugcuaggcugaaagggaagccacaccacuggccuucccuuccccagggc

SEQ ID NO: 88483 - RNA, 64 nt, Human
aggcccagcaccgagcagaacagaccagagcccaccacaccacaaagagcagcaccugacuaac

SEQ ID NO: 88484 - RNA, 64 nt, Human
cacacaugcauagccucccaccacuaucaguaucccacaccagagugguacauuuguuacaauc

SEQ ID NO: 88485 - RNA, 64 nt, Human
agggaccuugucucccagcucagggcucuuuccuccacaccauucaggucuuucuuuccgaggc

SEQ ID NO: 88486 - RNA, 64 nt, Human
uuuagaugaagaaaauuuuacaacuuuuaacaccccacaccaauuuuaguuucauuacuuuuac

SEQ ID NO: 88487 - RNA, 61 nt, Human
augcccaggacggccauuaaauguuacccugccacaccacugcacuucacuuccacuucag

SEQ ID NO: 88488 - RNA, 64 nt, Human
aucacauuacuggguaauuuuuaagacuauguacccacaccauacauacauacauauauauaua

SEQ ID NO: 88489 - RNA, 64 nt, Human
cuuuaaacccucaggaagucacagucuccggacaccacaccacaugagcccaacagguccacga

SEQ ID NO: 88490 - RNA, 64 nt, Human
auguggggaaguuaggaacuggugucuucaggggccacaccaaccuucugaggagcuguugagg

SEQ ID NO: 88491 - RNA, 64 nt, Human
gggcuuaaaagacugcuuuugaaggggcuuacagccacaccagaagacacgcuaaauauuuauu

SEQ ID NO: 88492 - RNA, 64 nt, Human
uuauuucuaagccuuucugggaaaucauuucaguccacaccaaccauauuauucaggguuccug

SEQ ID NO: 88493 - RNA, 64 nt, Human
uuuaacuuuugacuacagcauggccccauggcauccacaccaagaggguguugugaugaggugc

SEQ ID NO: 88494 - RNA, 54 nt, Human
ggguccagaaaaaccagugagcugccacaccagucacaugaccugaucacuagc

SEQ ID NO: 88495 - RNA, 64 nt, Human
uguaagugagaacaaauuacuggcccagcccaacccacaccaaauaagaaauuuaauaucccuu

SEQ ID NO: 88496 - RNA, 64 nt, Human
cccaguuccucaccagcuacucuggccauauaucccacaccagaaggaacaaguguggcugugu

SEQ ID NO: 88497 - RNA, 64 nt, Human
ggugcccgagugaucugaggauuuauaauccaagccacaccacccugguuguucucugggcuug

SEQ ID NO: 88498 - RNA, 64 nt, Human
uauuuaugagcucccuuugcccuucuccuguaucccacaccaccacauccaaccuccuugccug

SEQ ID NO: 88499 - RNA, 64 nt, Human
auugggcccuggacguugagcccagauguuggagccacaccagccuggauuucaaucccagaau

SEQ ID NO: 88500 - RNA, 64 nt, Human
gaagacucaagugcaccugaucccugcgcaacagccacaccaggagaacaggcuguccuuggcg

SEQ ID NO: 88501 - RNA, 64 nt, Human
gguuugggcuuguuguuuguaacaagaaaaugauccacaccacucccccgauucccgggugcag

SEQ ID NO: 88502 - RNA, 64 nt, Human
cggcauccugccccugguagagaggacgaauguuccacaccauggucucuacgaaaaagaaaua

SEQ ID NO: 88503 - RNA, 64 nt, Human
gccccaaccccaaacacagaguuucauggaaaccccacaccaaggcaagaggcagagaugauga

SEQ ID NO: 88504 - RNA, 64 nt, Human
cccggcucuuccuguguggaggugaugguaccugccacaccacagcugcgcacacagcugcuug

SEQ ID NO: 88505 - RNA, 64 nt, Human
agcagggucagacugggaaaccugguuggccacgccacaccaugaccgaggagccaacugggac

SEQ ID NO: 88506 - RNA, 64 nt, Human
agacuguggccugcccagcucucguauccccaagccacaccaucuggcuaaauggacaucaugu

SEQ ID NO: 88507 - RNA, 64 nt, Human
cugcuccagaaacauguguguggcuucccuaccuccacaccaaggagcugccuugcugggugga

SEQ ID NO: 88508 - RNA, 64 nt, Human
ggaccccgaccggcauggccacucagacacaaguccacaccacagcacuaccgucccauccguu

SEQ ID NO: 88509 - RNA, 64 nt, Human
ccaaccaccugggagcauuuaaaacuccagaugcccacaccacacccuggggccacccaucaga

SEQ ID NO: 88510 - RNA, 64 nt, Human
caacagcccauuugcccacuucccacugcucagcccacaccagaccuccaggagacaucccccc

SEQ ID NO: 88511 - RNA, 64 nt, Human
ggugguagaacuccaguucuguggcaaggggcagccacaccauuucucucucauugacucacag

SEQ ID NO: 88512 - RNA, 64 nt, Human
ccucccaaguagcugggauuauaggugugcgccaccacaccagcuaauuuuuguauuuuuagua

SEQ ID NO: 88513 - RNA, 64 nt, Human
gguggaggcugauucuaauugucugguugaggggccacaccaccuauuccccccaccuaacuca

SEQ ID NO: 88514 - RNA, 64 nt, Human
cccugucuucugggcacaguggacucagcagugaccacaccaacacugacccuugaaccaauaa

SEQ ID NO: 88515 - RNA, 64 nt, Human
gccuacccucucacuggcugaaaagcaaaggggcccacaccaccauggcagaugcccucuggcg

SEQ ID NO: 88516 - RNA, 64 nt, Human
guaaauauuaaggaugaccugugcaaaauuauacccacaccagcacuagugguaauuauucuaa

SEQ ID NO: 88517 - RNA, 64 nt, Human
ugaagucauuuauuauuuuauaaauugagaacaaccacaccaccaaaugucacaccuucuuaua

SEQ ID NO: 88518 - RNA, 64 nt, Human
uuacuuguuuuagaucagaaacuugcuauuccacccacaccaaguuaaaaaggaaaaaaaaaag

SEQ ID NO: 88519 - RNA, 63 nt, Human
cccugggggccuacgucugacuccucuccaaucccacaccaucaggaagaaggugccugucgg

SEQ ID NO: 88520 - RNA, 64 nt, Human
aaucuuuuagauucagcuuguaauaaucuuugagccacaccaaaaggaaugccaagggcucucu

SEQ ID NO: 88521 - RNA, 64 nt, Human
acgaacacauuugcaggaagguaacuguuauaacccacaccaucagcagggggaaagccaagcu

SEQ ID NO: 88522 - RNA, 64 nt, Human
gagaccugcggaaagcccccucccugagucgucgccacaccaggcgacaggcaccacccccucu

SEQ ID NO: 88523 - RNA, 64 nt, Human
ucugugggagcccgggugccaggcccucccaacaccacaccacccuccaggccccccugcccuc

SEQ ID NO: 88524 - RNA, 64 nt, Human
auauauugguaacauccuuucuauugaaaaaucaccacaccaaaccucucuuauuagaacaggc

SEQ ID NO: 88525 - RNA, 64 nt, Human
gcccccaagaguauacuccaccgagaaccaccagccacaccauuauaccagaaggcggaucccc

SEQ ID NO: 88526 - RNA, 64 nt, Human
ggaugaucugcucagagcucuuccaugccauucuccacaccaagaagcuuuaucaguuuuccuc

SEQ ID NO: 88527 - RNA, 64 nt, Human
cauuccaggacauucauuugcauaaggagucaaaccacaccagucuuggauuggcugugagcca

SEQ ID NO: 88528 - RNA, 57 nt, Human
uuguaguuucucgacauuaauagugaaccacaccaggagaacaaauacccaaguauc

SEQ ID NO: 88529 - RNA, 64 nt, Human
acggugguacugggggugcggcagggacacccgaccacaccagagcgugggagacggugggccu

SEQ ID NO: 88530 - RNA, 64 nt, Human
ggggcuccugagccucugcgugugcccucccagcccacaccagugcucucggccacugagcacc

SEQ ID NO: 88531 - RNA, 64 nt, Human
uguugaguugcugcuauugcacugccagugcagcccacaccaaaucacaacccaagauacucag

SEQ ID NO: 88532 - RNA, 64 nt, Human
gcuggucugaaacccuugagcucaagugaucuucccacaccagccucccaaaauacugggauua

SEQ ID NO: 88533 - RNA, 64 nt, Human
ccuccugaguagcugggauuacaggcaugcaccaccacaccaggcuaauuuuguauuuuuagua

SEQ ID NO: 88534 - RNA, 64 nt, Human
cuuguuucagaguuuguauugugauuaucaauuaccacaccaucucccaugaagaaagggaacg

SEQ ID NO: 88535 - RNA, 64 nt, Human
aaaugauauuuagccuaucaaaacuuccaaaagcccacaccaccaguuccugacucaaauuuga

SEQ ID NO: 88536 - RNA, 64 nt, Human
uugucuccagcccugccuuuauuccuccuugccuccacaccagccuccccuugcuucuccuuac

SEQ ID NO: 88537 - RNA, 64 nt, Human
cauuuuauuauauaagguauguaaaggaguuguaccacaccacuuaaacauaaaaaauggaaaa

SEQ ID NO: 88538 - RNA, 64 nt, Human
gauguagagggagauuguaaaagguuaaauauacccacaccacccaugaaagucacuguuuaag

SEQ ID NO: 88539 - RNA, 64 nt, Human
ucucuguacacaaauacuuucugcauuccccccuccacaccauccuagcgaggcaccagcacac

SEQ ID NO: 88540 - RNA, 63 nt, Human
caugcaagauugaacuguaaaaaccaaggccagccacaccacaggaucugaacuuuguuucca

SEQ ID NO: 88541 - RNA, 64 nt, Human
ccucuggagcagcugggacuacaggugugcacuaccacaccaggccaauuuuuguuuuuuuuuu

SEQ ID NO: 88542 - RNA, 64 nt, Human
uauuuuccuuccauuuucugguuuuuaaaauuagccacaccacaggaaacccacauuuuuagau

SEQ ID NO: 88543 - RNA, 64 nt, Human
ucuuuuggaaaggauuaagcugagaucuaaauuuccacaccaaugucauaaugcacagagguuu

SEQ ID NO: 88544 - RNA, 64 nt, Human
aucaacaccgccacugugcuuacuguuccuacagccacaccaggcuugaagaguuagugagacc

SEQ ID NO: 88545 - RNA, 64 nt, Human
ugcgggaugcagaugggugcuaucagagccucucccacaccacuauaguguaauaauguuauua

SEQ ID NO: 88546 - RNA, 64 nt, Human
gggaugagacagagaagacccugcuuaaagggccccacaccacagacccagacacagccaaggg

SEQ ID NO: 88547 - RNA, 64 nt, Human
cagguaauugagaauguacuacgguacuucccucccacaccauacgauaaagcaagacauuuua

SEQ ID NO: 88548 - RNA, 64 nt, Human
ugugcugccagccccaggucuuccuccgccugcuccacaccacucgccgcugucccucugcacu

SEQ ID NO: 88549 - RNA, 64 nt, Human
ugucaccucucucugaggacagagcuugaagccuccacaccagcugcugcuggagauucaaagc

SEQ ID NO: 88550 - RNA, 54 nt, Human
ugcugaaggagcugagaugaggccccacaccaggacuggacugggaugccgcua

SEQ ID NO: 88551 - RNA, 64 nt, Human
gugaugcugcugucccuaucuucaagcugucagaccacaccaucaaugauccagagcaacacag

SEQ ID NO: 88552 - RNA, 64 nt, Human
ggccacuggguuugagcccugcuucugugcacagccacaccacccucucccgacagcccucaaa

SEQ ID NO: 88553 - RNA, 64 nt, Human
ggcuagaaggcaggggaccuuggcauguggcuggccacaccaagcaggaagcacaaacuccccc

SEQ ID NO: 88554 - RNA, 64 nt, Human
agccaucugaaccugcaguccacccucccuggaaccacaccagaaagagaccuggguugucguu

SEQ ID NO: 88555 - RNA, 64 nt, Human
cacucccuccaccaccacagcacaccggugcuggccacaccagcccccuuucaccuccagugcc

SEQ ID NO: 88556 - RNA, 64 nt, Human
ggagaguggcugcugaguccaagagggcugggucccacaccaugcuggaggaagugccaucugc

SEQ ID NO: 88557 - RNA, 64 nt, Human
cacccaaaguguugagauuuacaggugugagccaccacaccaggccagagcuauauuuccaaag

SEQ ID NO: 88558 - RNA, 64 nt, Human
cuaggcucugucuggaagauggggaccagcagccccacaccagggccagccucuagagcagacu

SEQ ID NO: 88559 - RNA, 64 nt, Human
cugggugugcugucuccuucccacauccucagccccacaccagcucuauuucaggggugagagu

SEQ ID NO: 88560 - RNA, 64 nt, Human
uggcugccacuagcccaggaacaugacaacgugaccacaccacacaugccuccaacacacaccc

SEQ ID NO: 88561 - RNA, 64 nt, Human
uuucaucauauucuauugccaaguuuagucaguuccacaccaagaaugaacugcauuuccuuua

SEQ ID NO: 88562 - RNA, 64 nt, Human
agaaagcuguggugggacagccaaguacucguuuccacaccaagacucagacuuuuugagccaa

SEQ ID NO: 88563 - RNA, 64 nt, Human
ugcuuaaguacuuagcaaaaucuauucagcgaaaccacaccacuuaguuucucccagggguaaa

SEQ ID NO: 88564 - RNA, 64 nt, Human
ugccagucagccuagguuauacagaugccaugcuccacaccacgagcaguguacaaaucuggcu

SEQ ID NO: 88565 - RNA, 64 nt, Human
ccucccaaagugcugggauuacaggcgugagccaccacaccaggcccgagaaaugcuuuuuuaa

SEQ ID NO: 88566 - RNA, 64 nt, Human
gggccgcugccacccaccucccugccuccaggaaccacaccacaucuaagccugaaggggcguc

SEQ ID NO: 88567 - RNA, 64 nt, Human
guugaggaagucaggcuguuggcgugucccagcaccacaccaccccuaaagugccaggugaucu

SEQ ID NO: 88568 - RNA, 64 nt, Human
cugacuggauuuugaacgcuugaaaucaggcucuccacaccauugacuugcagaugcuucugug

SEQ ID NO: 88569 - RNA, 64 nt, Human
aaggguuucaagagcuuuguacagucucgauggcccacaccaaaacgcugaagagaguaacaac

SEQ ID NO: 88570 - RNA, 64 nt, Human
ccugaagauuuuuugaccguuccaagucuuaaugccacaccacuauuccagcgaauuuaugcua

SEQ ID NO: 88571 - RNA, 64 nt, Human
aggaagcacuugccaagcuuggucaucuaugacaccacaccagcacaguaggaccucagaaaag

SEQ ID NO: 88572 - RNA, 64 nt, Human
cccccuucacugucuguguguggugaagaccacgccacaccacccuccagcucacuggagacaa

SEQ ID NO: 88573 - RNA, 64 nt, Human
ccggccucaaauggugcugcugcccaugaugguaccacaccagggccucagccuggccccucac

SEQ ID NO: 88574 - RNA, 64 nt, Human
gcuucucaacuaaagaauagugccucagcgcugcccacaccaccgcccuccucgcugugccacc

SEQ ID NO: 88575 - RNA, 64 nt, Human
cugauccugaggggauacuguggagcagcccaguccacaccagagccccacgcggcugcccggc

SEQ ID NO: 88576 - RNA, 64 nt, Human
gagccgggcuccaacagccucugugagagaugccccacaccaaacccaacccucccgauggcug

SEQ ID NO: 88577 - RNA, 64 nt, Human
guggggcauaacgaugaggcgcuggccuugggggccacaccaggucgcagcaaauggcuucagc

SEQ ID NO: 88578 - RNA, 64 nt, Human
cuuucugcaugagaaucuaggagagaauucauaaccacaccaauaacgaaauagaaguuuuaaa

SEQ ID NO: 88579 - RNA, 64 nt, Human
aaugaugaagaccaaagaccaaguuaucaucucaccacaccacagguucucacuagaugacugu

SEQ ID NO: 88580 - RNA, 64 nt, Human
gccacaggccaaauccuuggagucccaggggcagccacaccacugccauuacccagugccgagg

SEQ ID NO: 88581 - RNA, 64 nt, Human
aaagagaaagcuuauuggacucaaacccacagauccacaccagaguucuauuuaccucaucuug

SEQ ID NO: 88582 - RNA, 64 nt, Human
gcaagcuguugaccagaugacuucucaucucuccccacaccaugaugguuuaaggugccuguug

SEQ ID NO: 88583 - RNA, 64 nt, Human
cccgggcucacucaaggagacugcggcauguugaccacaccagacuggguuucagggaaugggc

SEQ ID NO: 88584 - RNA, 53 nt, Human
uggugaagaugcugaaauaauggccacaccaguccacucuucugcaguauccu

SEQ ID NO: 88585 - RNA, 64 nt, Human
gacccaccaguuuguacaucacguccugcaugucccacaccauuuuuucaugaccuuguaauau

SEQ ID NO: 88586 - RNA, 64 nt, Human
cccggccuccgguugggucugcauuuuggagaguccacaccacggaccagguuuucccccaagg

SEQ ID NO: 88587 - RNA, 64 nt, Human
ugaggugggucgggcgcccucugcccgcccccucccacaccagccaggcuggucuccucuagcc

SEQ ID NO: 88588 - RNA, 64 nt, Human
ucccugagcucagacccccguccccggaacugggccacaccacgugcccucuuggcccagccuu

SEQ ID NO: 88589 - RNA, 64 nt, Human
uucuugugccuugaguggcagaggagccguccagccacaccagcuuuccucccaccgcucaggg

SEQ ID NO: 88590 - RNA, 64 nt, Human
auacacagaaccaccgccaccaccaccaacaccgccacaccaacaccaccacuacaaaaaaaaa

SEQ ID NO: 88591 - RNA, 64 nt, Human
aaagaagccugcguggucaacuccugucuucaggccacaccacaucuuccaugggacuuccccc

SEQ ID NO: 88592 - RNA, 64 nt, Human
gauccacuugguuguggauuccuggagccuagcaccacaccagaagcacgaggcccuugagaac

SEQ ID NO: 88593 - RNA, 64 nt, Human
gacaugaauguguauuucccauggucuccgcugcccacaccaacaguguggcaucucauaaguu

SEQ ID NO: 88594 - RNA, 64 nt, Human
acauucguugggcuuuuuuucaagguugggauuaccacaccaccuggaauaucauacugugguu

SEQ ID NO: 88595 - RNA, 64 nt, Human
uaagauuucacauuauccaucacugcauaacaaaccacaccaaaacucagugguuuaaaacaag

SEQ ID NO: 88596 - RNA, 64 nt, Human
gugacuggcagcuuuagcagccucgguacugaagccacaccaguguccggauggaagucugcau

SEQ ID NO: 88597 - RNA, 64 nt, Human
auugcuuccucagugucagggcacaugugaauuuccacaccaaacagagcaugaggaaccaguu

SEQ ID NO: 88598 - RNA, 64 nt, Human
accagggucccgggcaggcccggcgcuuugcuccccacaccagcccccugcgcguguccacucu

SEQ ID NO: 88599 - RNA, 64 nt, Human
gaggcggagguugcagugagcugagaugccaccaccacaccagccugggugacagagugaaacu

SEQ ID NO: 88600 - RNA, 64 nt, Human
uguccaaggcuggccccagaugugugggucugacccacaccagcccuguguccuguccuuucag

SEQ ID NO: 88601 - RNA, 64 nt, Human
auuucacagucagcugcucaacggaauggccucuccacaccagggauccuuagcacccaaccgg

SEQ ID NO: 88602 - RNA, 64 nt, Human
ggccguggggacucugcauccccugcacccgcuaccacaccagcucagccacagcagagccaau

SEQ ID NO: 88603 - RNA, 64 nt, Human
cacccuccaaggccuccccauggccacagugggcccacaccacacccugccccuuagcccuugc

SEQ ID NO: 88604 - RNA, 64 nt, Human
agggaagcacccagugucggcuccccauccaaauccacaccagcaccuuguuacagacaagaag

SEQ ID NO: 88605 - RNA, 64 nt, Human
uccucauuagcaguggguuuccaggguuggcagcccacaccagcauuaauuucaaugaagggga

SEQ ID NO: 88606 - RNA, 64 nt, Human
uuucagcucuaggcaugcagacaaccccacacggccacaccaccacaugcccaaguguacacac

SEQ ID NO: 88607 - RNA, 64 nt, Human
aagggaucagaugccccugacaccacgccucuggccacaccagaugccucugcaguccucgaca

SEQ ID NO: 88608 - RNA, 64 nt, Human
acaaacccuucccccucucugggcacccuucugcccacaccaguuuccagugcggagucugaga

SEQ ID NO: 88609 - RNA, 64 nt, Human
cccuuaccccccaccccaggccacugggccccucccacaccaccuggggagcugagaagaggag

SEQ ID NO: 88610 - RNA, 64 nt, Human
ggccagccuguguccccucccgcaggccuccuguccacaccagcgcccccuggggggccucaca

SEQ ID NO: 88611 - RNA, 64 nt, Human
cguagcccucccugcaggcaucaagcagauccugccacaccagaugaccacggcagggcccgug

SEQ ID NO: 88612 - RNA, 64 nt, Human
uagagaccaagguggccgagcugcuggcccagggccacaccaagccacccgagcgcagugccac

SEQ ID NO: 88613 - RNA, 64 nt, Human
cuucauuuugagagagaagaaaaacuguuuggaaccacaccaaugauauuuuucuuuguaauac

SEQ ID NO: 88614 - RNA, 64 nt, Human
aauacuguaugugacagcacauagaguaguuuucccacaccaaaguuaauuuuuaugcaugcuu

SEQ ID NO: 88615 - RNA, 64 nt, Human
ccaucaucucuuaacuacggaggcccgccggaggccacaccaucccuuaguuucuccuuuaguu

SEQ ID NO: 88616 - RNA, 64 nt, Human
uuuccuacuaagaucaggaacauggcaaggaacaccacaccacugcuuuucagcauuguacugg

SEQ ID NO: 88617 - RNA, 64 nt, Human
acuugcugggucagaucuguguggccagcccuguccacaccaugccucuccugcacuggagagc

SEQ ID NO: 88618 - RNA, 64 nt, Human
gcacagcguccuguccacacccagcucagcauuuccacaccaagcagcaacagcaaaucacgac

SEQ ID NO: 88619 - RNA, 64 nt, Human
ucagauuaaaauuacuauuugugcaaaacaaauuccacaccacauguacuguauauucuaaucu

SEQ ID NO: 88620 - RNA, 64 nt, Human
cagggagcccggcugccucaccuggccacagccuccacaccagaucuccacauugucuugaucc

SEQ ID NO: 88621 - RNA, 64 nt, Human
aagcuagugggcuucaggugcaaggguaccugugccacaccaaccugggagcacacagaauacu

SEQ ID NO: 88622 - RNA, 64 nt, Human
aaaaaagaucugaagaauccuccuuuauguaaaaccacaccaagauucugagaggaaacauuuu

SEQ ID NO: 88623 - RNA, 64 nt, Human
aucugggcucgucucucucugcuucgugaacccaccacaccagggccugucugcugugcuauuu

SEQ ID NO: 88624 - RNA, 64 nt, Human
gccucuaucucguauuuuuuucuauuucuccuccccacaccaucaaugggacuauucuguuuug

SEQ ID NO: 88625 - RNA, 61 nt, Human
aggccucccugcauggauaguccugggccagccacaccaccgagguccaaguaugagccag

SEQ ID NO: 88626 - RNA, 64 nt, Human
guaaaccaugguuccagcagccuguuccacacccccacaccaucaggauagcacagggaaacug

SEQ ID NO: 88627 - RNA, 64 nt, Human
ccaacgugaaggaaagcuacugcccccuagugccccacaccauguacugccugccccuguggca

SEQ ID NO: 88628 - RNA, 64 nt, Human
uuaacuugucauuuucaguacauauuuuacuauuccacaccaaccauaauuacaacaagggauu

SEQ ID NO: 88629 - RNA, 64 nt, Human
aaccuggguugcagacaggaaucuuaagguguagccacaccaggauagagacuggaacacuaga

SEQ ID NO: 88630 - RNA, 64 nt, Human
cauccuuaggccaaacaguacccaaggccucagcccacaccaagacuaaucucagccaaaccug

SEQ ID NO: 88631 - RNA, 64 nt, Human
cucugacuuuggaccucaggugaguccagcauauccacaccacccaagaagugaccagugcugc

SEQ ID NO: 88632 - RNA, 64 nt, Human
gcaauucugguggaaagucaaaccugucagugcuccacaccagggcugugguccucccagacau

SEQ ID NO: 88633 - RNA, 64 nt, Human
aucagggacagaccccccacccccaaggcugcagccacaccauguuucaggcuuggggcugggg

SEQ ID NO: 88634 - RNA, 64 nt, Human
cccucccuccucgucugccaagccucgccuccuaccacaccacaccaggccaccccagcugcaa

SEQ ID NO: 88635 - RNA, 64 nt, Human
ccuccucgucugccaagccucgccuccuaccacaccacaccaggccaccccagcugcaagugcc

SEQ ID NO: 88636 - RNA, 64 nt, Human
cacagcccucccgccccuuccccgagggaugaugccacaccaagcugugccacccugggcucug

SEQ ID NO: 88637 - RNA, 64 nt, Human
cgggcguccgaggggcccuggcaucugacucaggccacaccauggaaucacugcauccaaggcc

SEQ ID NO: 88638 - RNA, 64 nt, Human
gaguccccauuugcagguggguagggccuccagcccacaccacccagaccuaggcuucccucuu

SEQ ID NO: 88639 - RNA, 64 nt, Human
gguuuaucuaguuccaaaacccauguucuuucugccacaccauguuaguagaaauggaaacuau

SEQ ID NO: 88640 - RNA, 64 nt, Human
ugaugcaaugaaagaauuuaaaaagguuacaaacccacaccaauacuauuuuauaagguauuug

SEQ ID NO: 88641 - RNA, 51 nt, Human
agaccuugcuucaagaauaaaccacaccagugaacaagaaggaaaggccuu

SEQ ID NO: 88642 - RNA, 64 nt, Human
ugucuuucuguguguuuaaaaacagugggaaaauccacaccacacucuaaguggacagcucaga

SEQ ID NO: 88643 - RNA, 64 nt, Human
ugucaccggccuugugacauucacucagagaagaccacaccaaggaggcggccgcuggcccagg

SEQ ID NO: 88644 - RNA, 64 nt, Human
ggacuaugggaucacuguccccccaccuguguggccacaccauauguccugucaauccagaacu

SEQ ID NO: 88645 - RNA, 64 nt, Human
gcacucaccucagcagagccucaaugccaccuccccacaccacccaagccuagcugggugggaa

SEQ ID NO: 88646 - RNA, 64 nt, Human
gcccuaccagcgcccgcugggcugagccccuaccccacaccaggccguccucccgggcccuccc

SEQ ID NO: 88647 - RNA, 64 nt, Human
cccaaccuaaauguacuuaucuguccccauguccccacaccagccuguuuucauaauaaacuuu

SEQ ID NO: 88648 - RNA, 64 nt, Human
uugugacucuaagcucagugcucucuccacuaccccacaccagccuuggugccaccaaaagugc

SEQ ID NO: 88649 - RNA, 64 nt, Human
gaugugguaugacauacacacaccagagcaaccgccacaccagauaucgacagaguggucuucu

SEQ ID NO: 88650 - RNA, 64 nt, Human
augccaggccaggccuggggccccggggccugacccacaccacgcagaccccgggcuccaguuu

SEQ ID NO: 88651 - RNA, 64 nt, Human
ccaucugggauuucuacagccuggguacccauagccacaccaaggcuucugggagauucugcag

SEQ ID NO: 88652 - RNA, 64 nt, Human
cuguggguugccaggcuggggagggcaaccauagccacaccacaggauuuccugaaaguuuaca

SEQ ID NO: 88653 - RNA, 53 nt, Human
agcuggacagcgaggagugaggcccacaccagccuggaccuggguuauuuauu

SEQ ID NO: 88654 - RNA, 64 nt, Human
accacgucuaggaagaaucuucuugauagcucucccacaccaucaguggcccucauaacuggag

SEQ ID NO: 88655 - RNA, 64 nt, Human
guugcuguacaaaagcaaugguugaugauacuucccacaccacaaaugggacacauggucuguc

SEQ ID NO: 88656 - RNA, 64 nt, Human
ggagcaauuccaaggccccaguuacccaucaccuccacaccaggucaaguuuugucucagcccc

SEQ ID NO: 88657 - RNA, 64 nt, Human
ucugugugcauauguccugcccguguauaugcacccacaccaugugcccgugcacaccagugac

SEQ ID NO: 88658 - RNA, 64 nt, Human
caccgggagaagucggccucuuccugaugggcaaccacaccacugccuggcgccgugcccuucc

SEQ ID NO: 88659 - RNA, 64 nt, Human
agggccggaggcccaaggagggcgcgccuuggccccacaccaacccccagggccuccccgcagu

SEQ ID NO: 88660 - RNA, 64 nt, Human
cagaagccucuuucuccucucugcccccugccccccacaccacaccuguaggggaccugucuga

SEQ ID NO: 88661 - RNA, 64 nt, Human
aaaugagcccucccucggcgaagccuccagcaggccacaccagcuguuucccaccugcugugca

SEQ ID NO: 88662 - RNA, 64 nt, Human
ucccaacucucacacccagcccaggcugcagucuccacaccaaacagucaacaaaacacaaacc

SEQ ID NO: 88663 - RNA, 64 nt, Human
ucuaccgucaguccacauggcaggucugcuguguccacaccacagaugaccacaucuaauccug

SEQ ID NO: 88664 - RNA, 64 nt, Human
ggagugacgaccaccgccccaccaccuccugggaccacaccacuaccgcccccaaccacagcag

SEQ ID NO: 88665 - RNA, 64 nt, Human
cgugggcuucugggcaggcucacgcagacgccggccacaccauccaccuggccgccuccaugga

SEQ ID NO: 88666 - RNA, 64 nt, Human
ucacccaauaccaccccaaacacaacucaacuucccacaccaccaugucucucaccacaccuuc

SEQ ID NO: 88667 - RNA, 64 nt, Human
gugagaucuuuggacacccauggaauccuuuccuccacaccacccgugcacuugccaaagacag

SEQ ID NO: 88668 - RNA, 64 nt, Human
ccugccuuuguuucacccuacuucaaguacacuuccacaccaggaaaacagacccaaauuccau

SEQ ID NO: 88669 - RNA, 64 nt, Human
gugcgcugggacguugugugcaauagagaggucuccacaccagaugucuuccagauucugugcc

SEQ ID NO: 88670 - RNA, 64 nt, Human
acacucauguugauggauaguauagauuugcugcccacaccagauaucuguaaggcaucacugu

SEQ ID NO: 88671 - RNA, 64 nt, Human
uaccugcacuccggcuuccuagacucuggcccugccacaccaacacacuuucuauuugggcucc

SEQ ID NO: 88672 - RNA, 64 nt, Human
cuucccucccaucagucugguugacaggaagaaaccacaccaucaacaccaacaaguuucugug

SEQ ID NO: 88673 - RNA, 64 nt, Human
cuggauacuuucuuuuauaaaauagaaaccuuuuccacaccaguucugcagcagucgcuauuag

SEQ ID NO: 88674 - RNA, 64 nt, Human
uccaagaagacguaggcuucauuuucacaccagcccacaccauuccagugcucagccuagcaaa

SEQ ID NO: 88675 - RNA, 64 nt, Human
aguuaaaaauacgucauuuuaaagauuucccaaaccacaccacuaaauuuguuuuaugaauuga

SEQ ID NO: 88676 - RNA, 64 nt, Human
agucaccaaugauaucucgccaaagaaaccacgcccacaccaaugccaacacaaaacuguguuu

SEQ ID NO: 88677 - RNA, 64 nt, Human
gaauggcacacaaguaauccacauaaugcauaagccacaccaaaaccagacucaauuuaaaucu

SEQ ID NO: 88678 - RNA, 64 nt, Human
ucuccccaguagcugggauuacaggugcccgccaccacaccagccuaauuuuuguauuuuuaga

SEQ ID NO: 88679 - RNA, 64 nt, Human
agucaagauuacguuagagacuucguccacgaauccacaccaccuuucccaucaguucucaccg

SEQ ID NO: 88680 - RNA, 64 nt, Human
gcgccccucacccccacaccugcugcauggcuggccacaccacucagugcauggcggccgaugg

SEQ ID NO: 88681 - RNA, 64 nt, Human
ugauucucccucuggguaaccagucccaggugaaccacaccauccugcaguacuaucgcugcau

SEQ ID NO: 88682 - RNA, 64 nt, Human
uguaacacacuaacaaaagcaugaaaaauaggaaccacaccaaugcaacauuugugcagaaauu

SEQ ID NO: 88683 - RNA, 64 nt, Human
aaggaugacaaacacuauccacaucugaaaacuaccacaccauaucagggaucauaaauuaugc

SEQ ID NO: 88684 - RNA, 64 nt, Human
cauggccacucaguagauuguugaaaaagcaaagccacaccauucucuuugauguaugcagaga

SEQ ID NO: 88685 - RNA, 64 nt, Human
cuggccgccuggacccagcacugugguuguugagccacaccaguggccucugggcauucggcuc

SEQ ID NO: 88686 - RNA, 64 nt, Human
cauuccggacuggcagaagcauugccuggacugaccacaccaaccaggccuucauccuccuccc

SEQ ID NO: 88687 - RNA, 64 nt, Human
auaaaggcugacaguucuguuggcagccaagaacccacaccaugaagacagggagugaggggcc

SEQ ID NO: 88688 - RNA, 64 nt, Human
uagauuaauuuuuuuagucagaacuucaugaaauccacaccaaaggaaagguaaacugaaauuu

SEQ ID NO: 88689 - RNA, 64 nt, Human
gcugaaggaucaggaagugugggcugugcccuagccacaccacagccagccucagggagccacg

SEQ ID NO: 88690 - RNA, 64 nt, Human
caacacaccucaccucacaccacagcacaccucaccacaccacaccgcacugcaccauaccuca

SEQ ID NO: 88691 - RNA, 64 nt, Human
cacaccgcacugcaccauaccucaccacaucucaccacaccacagcacaccucaccacacaaca

SEQ ID NO: 88692 - RNA, 64 nt, Human
cgcaccgcaccgcaccguaccucgccacaucucaccacaccacaccacaccacaccucacugcc

SEQ ID NO: 88693 - RNA, 64 nt, Human
cgcaccgcaccguaccucgccacaucucaccacaccacaccacaccacaccucacugcccacac

SEQ ID NO: 88694 - RNA, 64 nt, Human
cgcaccguaccucgccacaucucaccacaccacaccacaccacaccucacugcccacacacggc

SEQ ID NO: 88695 - RNA, 64 nt, Human
ggggugaggcaaaggccucugacuuggacccuuuccacaccagacuggcagcacuucccccagg

SEQ ID NO: 88696 - RNA, 64 nt, Human
ccagauuucagcuuugaguuauucccugaagaagccacaccaaccuugcuuucaagcaaaaugc

SEQ ID NO: 88697 - RNA, 64 nt, Human
agugauaaacaccuccagcuuucuaacauccuccccacaccaucucaccauauccaucucccag

SEQ ID NO: 88698 - RNA, 64 nt, Human
cuccccagcccuguaggccugaggggagggucccccacaccacgguguccacccggccccggcc

SEQ ID NO: 88699 - RNA, 64 nt, Human
gagaagaaaagggaaagaagcugaaaauguaaaaccacaccagggaggaaaaaugacauucaga

SEQ ID NO: 88700 - RNA, 64 nt, Human
aguggcaaggccaucagaaaacuucuucccaaggccacaccacaccugcaaaaugccuaacaac

SEQ ID NO: 88701 - RNA, 64 nt, Human
gggggcgggcccgugccugcugugccccgacuucccacaccagccgcgcccaccgcagguggga

SEQ ID NO: 88702 - RNA, 63 nt, Human
uucuagccucaccucuccaagcucugccccaaguccacaccaugggucugcuucauugcauua

SEQ ID NO: 88703 - RNA, 64 nt, Human
uuucuggcaacaaucugacauuauuaguggaauuccacaccaacagggcuugugagcuuccauu

SEQ ID NO: 88704 - RNA, 64 nt, Human
cugacuuuggcagugccacauuugaccaugagcaccacaccaccauuguggccacccgucacua

SEQ ID NO: 88705 - RNA, 64 nt, Human
ucuuugcuggccugaccccugaggagcgguccuuccacaccagccgcaacccaagcagaugaca

SEQ ID NO: 88706 - RNA, 64 nt, Human
aaaggcagagcaagcagagcccguugucugggccccacaccacugcaggcagguggauagaagu

SEQ ID NO: 88707 - RNA, 64 nt, Human
gagggccuggggagccccacccuagcccuugcugccacaccacauugccucaacaaccggcccc

SEQ ID NO: 88708 - RNA, 64 nt, Human
uggcauacgucucuacucaguuuauaaagcaguuccacaccaugcaaacaaaacucuaacagca

SEQ ID NO: 88709 - RNA, 64 nt, Human
uagcccaggagguugaggcugcagugagccauguccacaccauugcacugcagccugaguaaca

SEQ ID NO: 88710 - RNA, 64 nt, Human
guagugccagcacaguccuaaaagggcuggaguaccacaccaacacagguaggggugcagggcu

SEQ ID NO: 88711 - RNA, 64 nt, Human
agcugagagcaggaagagcgaucuacuuuacaccccacaccaaaggaaaccagaugugagcugc

SEQ ID NO: 88712 - RNA, 64 nt, Human
gggacgccaccuccgccagccgccuccacccgccccacaccacaaucgcugguuuucggcauuu

SEQ ID NO: 88713 - RNA, 61 nt, Human
uggaggugaugcugaagugagcagccccuccccacaccaguugaacugcaggaagagagga

SEQ ID NO: 88714 - RNA, 64 nt, Human
gcugugcagcccgguuccuaacagaccacagaccccacaccaggucuaucucauuuggucucag

SEQ ID NO: 88715 - RNA, 64 nt, Human
caugagaagccguggguggaaccaggaaccuccuccacaccagcgcugaugcccaauaaagaug

SEQ ID NO: 88716 - RNA, 64 nt, Human
ccccgguggguuugucugcacuuggugcuccugcccacaccagccacuuuggugacaaugaccc

SEQ ID NO: 88717 - RNA, 64 nt, Human
caaaauggggauuagccuaaccccacucugucacccacaccaggaucgggugggaccuggagcu

SEQ ID NO: 88718 - RNA, 64 nt, Human
guguguguuuccuuauugucauuccauuauauauccacaccaacaugggugacgauaauucaaa

SEQ ID NO: 88719 - RNA, 64 nt, Human
agaguucagacccuucugaacucuguugauaauaccacaccauguucuggacccauagcucugg

SEQ ID NO: 88720 - RNA, 64 nt, Human
aucacucuuaggucagacagccaucagaauucucccacaccaagugcaugucaguuguggagaa

SEQ ID NO: 88721 - RNA, 64 nt, Human
acccugacggugggccuggcacacgccuguauucccacaccaggucuuccgaucaguggugucu

SEQ ID NO: 88722 - RNA, 64 nt, Human
agggcugcccugcccuggaagggccccucugccuccacaccaguggagucuucgagacuuggga

SEQ ID NO: 88723 - RNA, 64 nt, Human
cccuugagcagagcucugcacccagccugcccgcccacaccauccugcugguccucccagcgcu

SEQ ID NO: 88724 - RNA, 64 nt, Human
ccugagacccaagccauuguuagcagcuagccagccacaccaaccacgccagggggaggaaagg

SEQ ID NO: 88725 - RNA, 64 nt, Human
ccuccugagcagcugggauuacaggugcgugccaccacaccaggcugguuuucuuguauuuuua

SEQ ID NO: 88726 - RNA, 64 nt, Human
ccaccagaaucaacucagccucaggcauccaaagccacaccacagucgguggugaugcaacugg

SEQ ID NO: 88727 - RNA, 64 nt, Human
cugugggcguccccucccucccagccaccgccugccacaccacuccugccuggugcucggcaga

SEQ ID NO: 88728 - RNA, 64 nt, Human
ccaaggaugaggcuggacugaggcaaagggcuggccacaccaccugagcaugugugagggguug

SEQ ID NO: 88729 - RNA, 64 nt, Human
caggacccuuaacuuugccccaaagugaggggcuccacaccaaccccaggcggaggaacacuca

SEQ ID NO: 88730 - RNA, 64 nt, Human
cacagggagagcaguugaggcccgggcagggcccccacaccagaccccaacauagcuuccccac

SEQ ID NO: 88731 - RNA, 62 nt, Human
acgacgcccagacggaguaaccccagcccccgccacaccaccccuugccaaagucaucugcc

SEQ ID NO: 88732 - RNA, 64 nt, Human
gauccgggcugcucucuggaggacaguuucuguaccacaccagggccuugcuucagggccugaa

SEQ ID NO: 88733 - RNA, 64 nt, Human
cccaagccaaugcagacacugaccucaagaccagccacaccaagucugugcacugcccaccacc

SEQ ID NO: 88734 - RNA, 64 nt, Human
uacacagcuuccucuuuugguuccauccuuaccaccacaccacacgcacacuccacaugcccag

SEQ ID NO: 88735 - RNA, 64 nt, Human
ggcauggaaugcgugaggcuggcuucuggguuguccacaccacucucugcuguguugacuuccu

SEQ ID NO: 88736 - RNA, 64 nt, Human
ccugccccuaacuccugccuaugacacagaagccccacaccaguugcccagaugaacuggccuc

SEQ ID NO: 88737 - RNA, 64 nt, Human
gccccacagccccaucugcgggggcagugcucacccacaccauaagcuacugccauccuggccc

SEQ ID NO: 88738 - RNA, 64 nt, Human
guggcacaugcuuggccacacaucuacucccugcccacaccaucuaugcucuugguuggugcug

SEQ ID NO: 88739 - RNA, 64 nt, Human
ccagugaauucagaacagaagccauguaucucccccacaccagggcccaccauggagcuugugu

SEQ ID NO: 88740 - RNA, 64 nt, Human
cugggugagcugagauggaguccucgacuuaucaccacaccacugccccaaggaccuuacaggc

SEQ ID NO: 88741 - RNA, 64 nt, Human
augggggggucaccggccuguugcuacugcaacuccacaccauucuuggugcugggguguguua

SEQ ID NO: 88742 - RNA, 64 nt, Human
agguccagcccugacuucauccucccuucucuguccacaccacgaguggcacaucccaccugcu

SEQ ID NO: 88743 - RNA, 64 nt, Human
gugagcuccagcugcugcgcacggcggccuaccuccacaccacaaccaccuucaccuggaugug

SEQ ID NO: 88744 - RNA, 64 nt, Human
aacaagauacgcucgccacaguccuucuuugacaccacaccaucaggccgcauccugaacugcu

SEQ ID NO: 88745 - RNA, 64 nt, Human
cguccgaauccccgcaggacccauggagcuaugaccacaccaggccauucaaauggcucugcau

SEQ ID NO: 88746 - RNA, 64 nt, Human
cacgcgggccagccucucucuuuugcccugcucuccacaccagaaaugcccccaggugcuuggc

SEQ ID NO: 88747 - RNA, 64 nt, Human
ccugcggaguaccuugucccagggccagacacacccacaccacccacuguccugcaguggggcc

SEQ ID NO: 88748 - RNA, 64 nt, Human
cagcuguagguucaaugaguaguuucauccucucccacaccagcuggguugcacacuguugaua

SEQ ID NO: 88749 - RNA, 64 nt, Human
cuagaacccagagaacauuggcuuaugccagauaccacaccacaucugggcuuacauucuugua

SEQ ID NO: 88750 - RNA, 64 nt, Human
cuaccagagugaagcccacagagucccuccaccuccacaccaggcccucucuccaguuuuaucc

SEQ ID NO: 88751 - RNA, 64 nt, Human
caccucagguugggcuucccugggcacucaugcuccacaccaaagcaggacacgccauuuucca

SEQ ID NO: 88752 - RNA, 64 nt, Human
uuaaugguaucuuccuugcuggauguggcagaauccacaccagcuuaucaaccaacacagcuaa

SEQ ID NO: 88753 - RNA, 64 nt, Human
aagacaauggccauuguguugggaccugugaucuccacaccaaagucagggagccuggaagcca

SEQ ID NO: 88754 - RNA, 64 nt, Human
aauuuauuugcugcuucucccagccuuccccugcccacaccaccugcgcaugccuggcacaccc

SEQ ID NO: 88755 - RNA, 64 nt, Human
ccccugggggggcugccuuccccucagccucuccccacaccacccacccagcugcugucauucc

SEQ ID NO: 88756 - RNA, 64 nt, Human
agugagugaccucauuccccagaaaaggcuccucccacaccagaguacagccuggguaggggga

SEQ ID NO: 88757 - RNA, 64 nt, Human
aagaaucaugguggauccagaaguuauacgugacccacaccauggcuuuuaaaagucuacccau

SEQ ID NO: 88758 - RNA, 64 nt, Human
uugauugccuuuggucaguaaugcguucaggaguccacaccaggcacagauggggccuugaaac

SEQ ID NO: 88759 - RNA, 64 nt, Human
acugcggucaccccuuuaguucucuggguguagaccacaccaccucccacugggcaccccccaa

SEQ ID NO: 88760 - RNA, 64 nt, Human
ugaaaaggauuuuagaaaacccugggaaaacccaccacaccaccacaaaauggccuuuagugua

SEQ ID NO: 88761 - RNA, 64 nt, Human
ccuaaaucccaggccccuuucucagggggcguggccacaccacacacugcgccagugacacaua

SEQ ID NO: 88762 - RNA, 64 nt, Human
guugaucuguuuucagugcacacccucaaaugcaccacaccaguuuuacgaucuaagcuuuuaa

SEQ ID NO: 88763 - RNA, 64 nt, Human
ugaucucaagagguccagggacuuaacagccaagccacaccacccgacagguucuucugugaca

SEQ ID NO: 88764 - RNA, 64 nt, Human
cagcugcaggccuggcugcaggccugacuacugcccacaccaacgaggugaucuagcagauaca

SEQ ID NO: 88765 - RNA, 64 nt, Human
augugagccggcccccgagaccccggcccccaccccacaccacagacacccaccagcccggccc

SEQ ID NO: 88766 - RNA, 64 nt, Human
uucggaguccaccaccgagaucaccugcagcuggccacaccacaggcccccgugccugcagcac

SEQ ID NO: 88767 - RNA, 64 nt, Human
uaggggaggggugagacgcucgcugccgugcccgccacaccaagauguuggggcugccuggcgc

SEQ ID NO: 88768 - RNA, 64 nt, Human
ccaggauccgguaaaccugccgggcaggaccgugccacaccagcuguccagagucggaggaccc

SEQ ID NO: 88769 - RNA, 64 nt, Human
ccucccuucccugggccccuucucuccugggcagccacaccacagagcggggaggggcaggugg

SEQ ID NO: 88770 - RNA, 64 nt, Human
ccccugccaggugaggggcauggcgggcaggaggccacaccaggccccccgcccugccccucgg

SEQ ID NO: 88771 - RNA, 64 nt, Human
cacuccugaaugccuuaacauuucuuccauggccccacaccauggcauccgggggucuucggga

SEQ ID NO: 88772 - RNA, 64 nt, Human
ccucccccaaaugugcaaccuguaaaaggucucuccacaccaggggccaggauccaguucccuc

SEQ ID NO: 88773 - RNA, 64 nt, Human
ccccaaauuaacagaauauacauuuuuuucagcaccacaccacaccuauuccaaaauugaccac

SEQ ID NO: 88774 - RNA, 64 nt, Human
cccucuccucccuccuccacaccuugagugaugaccacaccaaucacuguauuuuauagcuuuu

SEQ ID NO: 88775 - RNA, 64 nt, Human
gauguacgaacgacagugauguucccagguccccccacaccaguaaacaucccccagcuccaca

SEQ ID NO: 88776 - RNA, 64 nt, Human
augaguuuuacaagugacccuucccuucccuccaccacaccacucaggggcuggggcuucucuc

SEQ ID NO: 88777 - RNA, 64 nt, Human
gggagagucuguguguaugugucuuccccggaauccacaccaccccacccuccuccugucccgu

SEQ ID NO: 88778 - RNA, 64 nt, Human
gcguucuggacucugccccaaucggguccagagaccacaccacuaaccauccccaacuccaugg

SEQ ID NO: 88779 - RNA, 64 nt, Human
ggugcuauugggguggggagcucccuccccucccccacaccagaaagggguauguugggggcuu

SEQ ID NO: 88780 - RNA, 64 nt, Human
gcugaccccaggggcucgccgcugccccuccccuccacaccaaggccugagacagcaggagccc

SEQ ID NO: 88781 - RNA, 64 nt, Human
cagacaaagcugugaauggccuaggggcugagucccacaccagcugugaauucuccugcagaca

SEQ ID NO: 88782 - RNA, 64 nt, Human
ggcauugucaucucaaaggcccaacccccagaggccacaccaguccucccagggaguccucgag

SEQ ID NO: 88783 - RNA, 64 nt, Human
uagaacuggagagagguccagauugcgacaggagccacaccagagugugcaggcuucauggagg

SEQ ID NO: 88784 - RNA, 64 nt, Human
ccauggcguggagggcacgggugccacccacaaaccacaccaggaggcgcugcagccaccaggg

SEQ ID NO: 88785 - RNA, 64 nt, Human
gucccugaucuccaggcuuggccuccagagcagcccacaccaaccccaaaauaaaaaaauguau

SEQ ID NO: 88786 - RNA, 64 nt, Human
uccagcccauuuucugccgugaaaccccagccagccacaccagacucuggaacccuuuuucgac

SEQ ID NO: 88787 - RNA, 64 nt, Human
acaacacacuuccugacguaaugcaauaggaaguccacaccaccaucuacaaagccuuauugcu

SEQ ID NO: 88788 - RNA, 64 nt, Human
uaaagguaugaaggacuucugagcaucagauaauccacaccaggaagaaacuuccaaaaauugc

SEQ ID NO: 88789 - RNA, 64 nt, Human
acuuccgaguggcugggauuacaggcgcccgccaccacaccagguugauuuuuguauuuuuagu

SEQ ID NO: 88790 - RNA, 64 nt, Human
ggcgaugcaggaccccccggagcuccugucccauccacaccagcuccccaugccagcuguggua

SEQ ID NO: 88791 - RNA, 64 nt, Human
aggggggacacuugcuuaggggcucuccugggccccacaccagugcccaccccaaaucuggucg

SEQ ID NO: 88792 - RNA, 64 nt, Human
cagccaccugcccagccgggccugggaugggccaccacaccacuggauauuccugggagucacu

SEQ ID NO: 88793 - RNA, 64 nt, Human
ccucccaaguaccugggacuacaggugugcaccaccacaccaggcuaauuuuuuguguauuuuu

SEQ ID NO: 88794 - RNA, 64 nt, Human
cucagccucccaaggagcugagauuacgaguacaccacaccaugcccggccaaauacuugguuu

SEQ ID NO: 88795 - RNA, 64 nt, Human
gcaccuggccagggaaccuucuuuauaccaaguaccacaccagucagagucaagucaggaaaua

SEQ ID NO: 88796 - RNA, 64 nt, Human
uaccgccagagagguggacccacuccggauuccuccacaccacccacacaccagucggcagccu

SEQ ID NO: 88797 - RNA, 64 nt, Human
gcuuuguuguguuuaagcuauugagagccccaggccacaccaggacuugcaguggugggaaucc

SEQ ID NO: 88798 - RNA, 64 nt, Human
ggaggcuuacuaaccagguaagccuucuaugcauccacaccaaaauccugcagaauguaaguaa

SEQ ID NO: 88799 - RNA, 64 nt, Human
ccaucuucccgagaagcaucccuuagccuaaaauccacaccaaagggagaguuccagaggaauc

SEQ ID NO: 88800 - RNA, 64 nt, Human
cgccaccuccccacuccagcagauaaggccgagcccacaccaucuggcccaggcuggcccccac

SEQ ID NO: 88801 - RNA, 64 nt, Human
uuauuuauuaauuuuauacuauuucaacuagaccccacaccagggcacccuaagaggggaaaaa

SEQ ID NO: 88802 - RNA, 64 nt, Human
gccgggguaggaggaucaccagaggccagcagguccacaccagccugggcaacacagcaagaca

SEQ ID NO: 88803 - RNA, 64 nt, Human
gagacugaggcuuagagagaggaggcagcccccuccacaccaguggccucgugguuauuagcaa

SEQ ID NO: 88804 - RNA, 64 nt, Human
uccaucacgccuguuaccagaggauccccgagagccacaccagcucuggacaucaccgccccug

SEQ ID NO: 88805 - RNA, 64 nt, Human
uagugugccacggccccaccaccuccugcaguacccacaccaucaccacugcuuucucuuccaa

SEQ ID NO: 88806 - RNA, 64 nt, Human
gggcagcugcguuuuaggaagagcaaaugaaacuccacaccauucuucuagaucucugguguuc

SEQ ID NO: 88807 - RNA, 64 nt, Human
ggacccucagcccugugccccccaccacuucaggccacaccagguucccucugcaagggccucg

SEQ ID NO: 88808 - RNA, 64 nt, Human
ccccgcagccuagaccucccaggccugugacccuccacaccagcccucagaacccuccugggcu

SEQ ID NO: 88809 - RNA, 64 nt, Human
gcagcccagagccacuggucccuacagggcgccgccacaccagcaggaaggaggauggcugugu

SEQ ID NO: 88810 - RNA, 64 nt, Human
cugcaaauuuuccccaaauagaagccaguucaguccacaccaucucuucuuugaguuguuuaug

SEQ ID NO: 88811 - RNA, 64 nt, Human
ugccaaaaagugguuaauauuaauaagacuguuuccacaccauaggcaauaauuucuuaauuua

SEQ ID NO: 88812 - RNA, 64 nt, Human
caaaauuaguuagaaacuuaaguaaaauacaaguccacaccauccccaaauuacaaaauggacu

SEQ ID NO: 88813 - RNA, 64 nt, Human
ugauccuggaaugaggcccuuucaaaagcgucauccacaccaaaggcaaauguccccaagugag

SEQ ID NO: 88814 - RNA, 64 nt, Human
agcagguguguccagagucagcugagggcucuccccacaccacccagcaggcgcuggugcuccu

SEQ ID NO: 88815 - RNA, 64 nt, Human
acuagaaaaggcccccacuggcugccugggagccccacaccaccgggccagugcaggcacugug

SEQ ID NO: 88816 - RNA, 64 nt, Human
ucauggcauccucccuguacccaggucaggcuguccacaccacaugggagcccagaggaggagg

SEQ ID NO: 88817 - RNA, 64 nt, Human
ccccauccaccgcaugcggugcccguggcccgccccacaccaccgccgccugcagaccucuccc

SEQ ID NO: 88818 - RNA, 64 nt, Human
gugcuggggccagacuggcacaaggcacucgugcccacaccacaccccagggccuugccaagcu

SEQ ID NO: 88819 - RNA, 64 nt, Human
auauuuacagauaugcccagccaguccuggucggccacaccagugucccaaagaggagagcgca

SEQ ID NO: 88820 - RNA, 64 nt, Human
ucguccacuagcccagaguguguguguucaacccccacaccagguggugguaggcggugugacu

SEQ ID NO: 88821 - RNA, 64 nt, Human
caucugcccagccucacugaggcucaggacacggccacaccaagugcagcccucguccuggguc

SEQ ID NO: 88822 - RNA, 64 nt, Human
agcccuccucccauccacacacacaggcacccacccacaccaggucggcuuguuucucacaugu

SEQ ID NO: 88823 - RNA, 64 nt, Human
cgacacaggcugccgcugcucucccaggugaaauccacaccaguccacgccgggucgccugccc

SEQ ID NO: 88824 - RNA, 64 nt, Human
ccuaccauuuucugcgcagauaugcuagguguauccacaccaacaugaagacacugaccuuguc

SEQ ID NO: 88825 - RNA, 64 nt, Human
uuuuccucugcauuuacacacacacgcacacaaaccacaccacacacacacacacacacacaca

SEQ ID NO: 88826 - RNA, 64 nt, Human
ucugcaagaaccuuucuauauuaugugccaauuaccacaccagaucaauuuuaugcagaggccu

SEQ ID NO: 88827 - RNA, 64 nt, Human
ccucuugaguagcugggacuacaggugcccgccaccacaccagcuaauuuuuguauuuuuagua

SEQ ID NO: 88828 - RNA, 64 nt, Human
uuuuugcauauuaaagauaagacuuccucuaccaccacaccaaaugacuacuacacacugcuca

SEQ ID NO: 88829 - RNA, 64 nt, Human
gauuuuuuccucugcauuuacacacacacacaaaccacaccacacacacacacacacacacaca

SEQ ID NO: 88830 - RNA, 64 nt, Human
ucugcuuaggcauuuugccccucaccccaauguuccacaccaucgacaaccaaggggugaggug

SEQ ID NO: 88831 - RNA, 64 nt, Human
auggcuccuuuuucauguugaucuuuaaauuuucccacaccauaagagaggagcaaaggaaauu

SEQ ID NO: 88832 - RNA, 64 nt, Human
ucucccaaagugcgaggaugacaugugugagcuaccacaccagcaaugucuaugcuucucgaua

SEQ ID NO: 88833 - RNA, 64 nt, Human
ccuccugaguagcugggacuacaguugugcaccaccacaccaaacaagaauugauuauauugcu

SEQ ID NO: 88834 - RNA, 64 nt, Human
uggaagaucugggggaggaaguucaaggaaggcaccacaccagaaaugggaccuaaauuaaggc

SEQ ID NO: 88835 - RNA, 64 nt, Human
aauuguaacucaggggggcagaagcucuggucacccacaccaacaccaaauccaucagcaaauu

SEQ ID NO: 88836 - RNA, 64 nt, Human
guccaccaagaagucacagagcccguucugcgccccacaccaucuggagcaggggcuucucuuc

SEQ ID NO: 88837 - RNA, 64 nt, Human
gugcgaucccacccgugguggcucaagucuggccccacaccagccccaauccaaaacuggcaag

SEQ ID NO: 88838 - RNA, 64 nt, Human
gcagaaaaaaaauuguaggcccaagugucaagaaccacaccagauuggagauagaaaagaauag

SEQ ID NO: 88839 - RNA, 64 nt, Human; identical to SEQ ID NO: 88826

SEQ ID NO: 88840 - RNA, 64 nt, Human
acccccacagcacccccacaauguaggaaaagaccucagggaaccucucccuggaaagacgggc

SEQ ID NO: 88841 - RNA, 64 nt, Human
gcguggggagguggggucucauucccccaacuuccucagggaggaccccugcccuccgcugcuc

SEQ ID NO: 88842 - RNA, 64 nt, Human
cagggggcucugcuccaaguucccuagcgggccccucagggagaaauagccucacgugcaaucu

SEQ ID NO: 88843 - RNA, 64 nt, Human
cgucucuuggaccuaagauggaauguguccccagcucagggauugccugaaccaagaggccagg

SEQ ID NO: 88844 - RNA, 64 nt, Human
gguugccaaaaccccagcaaguugaggcuucacgcucagggaaacuucugggucagagguuaau

SEQ ID NO: 88845 - RNA, 64 nt, Human
caaccucuuuccccacagugcaauucagaauaugcucagggaaugccagccaccuuguaaaacu

SEQ ID NO: 88846 - RNA, 64 nt, Human
augcucauuguucccaucuugaugaaacuugagucucagggaagugaagugacuugcccagggu

SEQ ID NO: 88847 - RNA, 64 nt, Human
uuuccugcacuguguucucagguacaugagcaaucucagggauagccagcagcagcuccagguc

SEQ ID NO: 88848 - RNA, 64 nt, Human
gugcuggaggaaccacgcuuccuaacugcugcuucucagggaauccgacaccagccaaccauuu

SEQ ID NO: 88849 - RNA, 64 nt, Human
ccacaaagcaagaccuguauuuauaagccgagggcucagggagccuaacugcgggacccgucag

SEQ ID NO: 88850 - RNA, 63 nt, Human
uggaccaccguuucuccugagcccuggggucaccucagggacagcguccaggcuucagccaag

SEQ ID NO: 88851 - RNA, 64 nt, Human
guuggacagcguuggucuauacugacucuuauuucucagggagaucacagcaaccuaaauaaac

SEQ ID NO: 88852 - RNA, 64 nt, Human
gccucucccgggaguuccugcggucccagcggaacucagggagucuauuuaugaagucuccaga

SEQ ID NO: 88853 - RNA, 64 nt, Human
uucauuccaaucuucuaauuacagugguuccuaucucagggauacuggacuuucugacgcagau

SEQ ID NO: 88854 - RNA, 64 nt, Human
gccaaaauauucucuggacaacaaauuuguauugcucagggacaguuuaccuugccugguaaac

SEQ ID NO: 88855 - RNA, 64 nt, Human
aggagggcacguaccgggugccagcccuggagcccucagggagacagacacagaccaagaauag

SEQ ID NO: 88856 - RNA, 64 nt, Human
cugccugcccuccagccccaucaccagcuucuugcucagggagacuuccgcccuccucacugag

SEQ ID NO: 88857 - RNA, 64 nt, Human
auggaagaggagugaggcagccucacugugugcccucagggauacgagauucucuguugugagu

SEQ ID NO: 88858 - RNA, 64 nt, Human
auaaagcuuuauucuuuagcccuuaacccuaaggcucagggaaauacccuauguuauugugcuc

SEQ ID NO: 88859 - RNA, 64 nt, Human
ugcugagauuacaggcgugagccaccacacccagcucagggaggcguaguuuucuuuaauuuua

SEQ ID NO: 88860 - RNA, 64 nt, Human
uggggaagggcaggccagccagcaccucugccuucucagggacaagaguaguccuuuaccaccc

SEQ ID NO: 88861 - RNA, 64 nt, Human
ugugugccguccccuuuagcugccuccuauugaucucagggaagccugggagucccuucucacc

SEQ ID NO: 88862 - RNA, 64 nt, Human
gaacauugcucuucauuuuggccuguacuucucccucagggacguagaacaauggaaugucagu

SEQ ID NO: 88863 - RNA, 64 nt, Human
cuuuuucuuuaaaauucaauuaagguacuucucccucagggacguagaacaauggaaugucagu

SEQ ID NO: 88864 - RNA, 64 nt, Human
aaauauuagccacagaccaccuacaucacaauaacucagggagcuuauagaagugaagauuccu

SEQ ID NO: 88865 - RNA, 64 nt, Human
gagacauaaucuaccuuaaauagugcauuuuuuucucagggaauuuuagaugaacuugaauaaa

SEQ ID NO: 88866 - RNA, 64 nt, Human
guugcuucuguugucaccuccaacaaaagggcaacucagggaaccuacagccccagccgucagg

SEQ ID NO: 88867 - RNA, 64 nt, Human
cacugggaggcccacuccuggcucaccucucccucucagggacccacgugggagccuggauccc

SEQ ID NO: 88868 - RNA, 64 nt, Human
uucguauuaucaugggaguacuguaaguucaguucucagggaaugcuaaauuagaguaauaagu

SEQ ID NO: 88869 - RNA, 64 nt, Human
ucuuccuccuauccugcgggaucacuggggggcucucagggaacagcagcagugccauagccag

SEQ ID NO: 88870 - RNA, 64 nt, Human
ccggggugcucagaaguuuuaggagggaaugagccucagggaggagugagcaccuaaaugaacg

SEQ ID NO: 88871 - RNA, 64 nt, Human
caggcagacucugcccagaggggcagccaggcugcucagggaaggggcugaaagcggcagagga

SEQ ID NO: 88872 - RNA, 64 nt, Human
uccuucacuucucugaaaguaaggcccuagaugccucagggaagacaguaaucaugccuuuucu

SEQ ID NO: 88873 - RNA, 64 nt, Human
caauguuuacauuuauguucugcaagacgcuguccucagggaccauuaggggaccauucuguuc

SEQ ID NO: 88874 - RNA, 64 nt, Human
uaccccuuggccccuccuggucugugcaaacucccucagggagccccccugcccuguagcucuc

SEQ ID NO: 88875 - RNA, 64 nt, Human
ggacagagggugucaaacauucgugagcuggggacucagggaccggugcugcaggaguguccug

SEQ ID NO: 88876 - RNA, 64 nt, Human
agguucucccucugcccuccacugggcccaguggcucagggaccuggggaaaggagauggagca

SEQ ID NO: 88877 - RNA, 64 nt, Human
gucuuaucagacgcccgucuuaaaguccagcaugcucagggacccuguguaggaucucguuugu

SEQ ID NO: 88878 - RNA, 64 nt, Human
ucagggguuggucugagaggccugccauccaccccucagggagcuagguuuucucagaggcuca

SEQ ID NO: 88879 - RNA, 64 nt, Human
gagccccaccuccuaacaccauggauucaaagugcucagggaauuugccucuccuugccccauu

SEQ ID NO: 88880 - RNA, 64 nt, Human
aggcuccagggcacucggaggcuggugggguggacucagggaggcccagggcuccucugguccc

SEQ ID NO: 88881 - RNA, 64 nt, Human
uccuuggaugaaacccguauaguucacaauagagcucagggagccccuaacucuuccaaaccac

SEQ ID NO: 88882 - RNA, 64 nt, Human
guggggucugaugugucccuugaugggugcugcccucagggacugcacccugacaaguguuaag

SEQ ID NO: 88883 - RNA, 64 nt, Human
gcacuagccauagcuggugacaaacagaugguugcucagggacaaggugccuuccaauggaaau

SEQ ID NO: 88884 - RNA, 64 nt, Human
uugaaccacguaucucuggguagcuacaaaauuccucagggauuucauuuugcaggcaugucuc

SEQ ID NO: 88885 - RNA, 64 nt, Human
acuacuuuuugacuucuguuugucuuacgcuucucucagggaaaaacaugcaguccucuagugu

SEQ ID NO: 88886 - RNA, 64 nt, Human
uauuucugugcccuaguccuagacacacauuagacucagggaguuuugucugaagaccaggucc

SEQ ID NO: 88887 - RNA, 64 nt, Human
cucaggagucugaacacugggcuuaugccuuacucucagggacaagcagcccccauugcugccu

SEQ ID NO: 88888 - RNA, 64 nt, Human
caagaagcagauccuggcccucccgcccccaccccucagggauauuuaaaacuuauuuuauaua

SEQ ID NO: 88889 - RNA, 64 nt, Human
aggagauuguugacccagugaccuggaguugaggcucagggagagaucugccacaugucugagg

SEQ ID NO: 88890 - RNA, 64 nt, Human
ggcuauagcucaggaccugggaccuccccugaggcucagggaaaggccagugugaaccgagggg

SEQ ID NO: 88891 - RNA, 64 nt, Human
uugacugugagcaaagugucuuccgauuagcagccucagggaugcccugguggccucuccaggg

SEQ ID NO: 88892 - RNA, 64 nt, Human
ugcucccucucuuuccaucuguuuggcuuuuucccucagggaacuuggucuagaaggcacuggg

SEQ ID NO: 88893 - RNA, 64 nt, Human
aaguagcucauuuucucuuacuaauguuugguuccucagggaagaaucucacuugacuagagag

SEQ ID NO: 88894 - RNA, 64 nt, Human
agagcggccucuccccacgcccggggcgcgccggcucagggaggcucggggccgcccaugcaga

SEQ ID NO: 88895 - RNA, 64 nt, Human
acaaaugugacccaggauacagaguguugcuguccucagggagguccgaucuggaacacauauu

SEQ ID NO: 88896 - RNA, 64 nt, Human
accuccuguaacuucuaucuguucuuuuuugaggcucagggagaaacuagcauuuuuuuuuuuc

SEQ ID NO: 88897 - RNA, 64 nt, Human
gugcccuuuucucucguggaagauaaaaccuggacucagggagcaaccacaggcucuccacuuu

SEQ ID NO: 88898 - RNA, 64 nt, Human
caggguggggcaacaguggcaucaggugcggggccucagggaaauacaucuuuagugaacgccu

SEQ ID NO: 88899 - RNA, 64 nt, Human
gaaugggugcaguuugaggggccuguguggaggccucagggagauguuggacugugccuggauc

SEQ ID NO: 88900 - RNA, 64 nt, Human
accaaaacagaacaauuaaacagccaaauaaaaccucagggacaacauuuuugguguauuugag

SEQ ID NO: 88901 - RNA, 64 nt, Human
ccucugccuccaggagggcaucagcuuucccuggcucagggaucuucucccuccccucacccgc

SEQ ID NO: 88902 - RNA, 64 nt, Human
cuguugaaaagaaagaagaaggaggcggaaaucucucagggagaauuauuuccuuucuuuucua

SEQ ID NO: 88903 - RNA, 64 nt, Human
guagcauugaaagccgaaaagagaagaaagcugacucagggaaagguguugacagggagacuug

SEQ ID NO: 88904 - RNA, 64 nt, Human
cgggguugcccaccaguugcgaaagcccccuuuccucagggagcacgcgggaccucgguggaga

SEQ ID NO: 88905 - RNA, 64 nt, Human
ugcacccauacugcuucccuaccacaaaucagggcucagggagaggccaugcggccagcccagg

SEQ ID NO: 88906 - RNA, 64 nt, Human
gauucccacauuugucuucuuucugucuuuaagacucagggaggcuaaaucaguguuugauugc

SEQ ID NO: 88907 - RNA, 64 nt, Human
acgcuggcagcaggagguaaaugcucucugugcucucagggacaccuccucugauaugcugagg

SEQ ID NO: 88908 - RNA, 64 nt, Human
ggaaggggaguucuggguggaggaggaggaguuccucagggaguuugacgagcucaccguuggc

SEQ ID NO: 88909 - RNA, 64 nt, Human
cuggucccaguagguaucaggucuuucugugcagcucagggagacccuaaguuaaggggcagau

SEQ ID NO: 88910 - RNA, 64 nt, Human
uggaggcagagccccccaggacaggagcaacugucucagggaggacagaggaaaacaucacaag

SEQ ID NO: 88911 - RNA, 61 nt, Human
gagcacucacgguccacugaagcucugaauccucagggaugccaccugcacauucucauac

SEQ ID NO: 88912 - RNA, 64 nt, Human
cacaggcuuguuaaugucagucugugcugaggaccucagggacuugagguugcauuuuugagca

SEQ ID NO: 88913 - RNA, 64 nt, Human
uagagagccuaaagagaguuguuucugagcugaucucagggaaauacaaauaacuugggagaug

SEQ ID NO: 88914 - RNA, 64 nt, Human
guguagcuccuacuuuugcacaggcaccagcuaccucagggacauggcacgggcaccugcucug

SEQ ID NO: 88915 - RNA, 64 nt, Human
ccaccucuuaaggacugguuccucagaaagcacccucagggaaaaaggugaaaacauuacaucc

SEQ ID NO: 88916 - RNA, 64 nt, Human
ucucuggagacuucuugcuggaaugaacagugugcucagggacuauuuggaacuggauguuuuu

SEQ ID NO: 88917 - RNA, 64 nt, Human
uggggauggugggguggauggucagggagggaugcucagggagggauaugcuggugugagcagc

SEQ ID NO: 88918 - RNA, 64 nt, Human
aggacuguguggguuucuuaccugccugagccaccucagggaaucuuccagccuaaugcaggca

SEQ ID NO: 88919 - RNA, 64 nt, Human
ugauaauugcuuuauaauuccuugguaaugacagcucagggaagguuucacaaggucaugauca

SEQ ID NO: 88920 - RNA, 64 nt, Human
cccuacacucagcucaugccuaaccuauguguggcucagggaccagcuuggggaaggaaaggag

SEQ ID NO: 88921 - RNA, 64 nt, Human
gguaaggugagggaauaguaaguggugagaacuacucagggaaugaaggugucagaauaauaag

SEQ ID NO: 88922 - RNA, 64 nt, Human
uggcuucuacacuggguucugcuacuccccagaccucagggacaacugccggggguucaggguu

SEQ ID NO: 88923 - RNA, 64 nt, Human
uugaggcccaggccagggcagccaguggcucuagcucagggaaagccaggcccaccugcccuau

SEQ ID NO: 88924 - RNA, 64 nt, Human
aagcacuuuuuauuuucauuuucugucacagacacucagggauagcaguaccauuuuacuuccg

SEQ ID NO: 88925 - RNA, 64 nt, Human
gcucccaucccccaagucugacgcagccaccacucucagggauccugccccaaaugcggucgga

SEQ ID NO: 88926 - RNA, 64 nt, Human
caguuuuuccaaagucaagagucuuaaccuuguacucagggaauuuugagauaacaagucccuu

SEQ ID NO: 88927 - RNA, 64 nt, Human
gaacgcgggucgguguggagucagugacugcugacucagggagcuccuuggccccgugggcacu

SEQ ID NO: 88928 - RNA, 64 nt, Human
aagccagcccccaagacccuggggguggacaccacucagggaaaccuggggugggggugggcuu

SEQ ID NO: 88929 - RNA, 64 nt, Human
gauuauuuauaugaaguccauaauguucgaguaccucagggacauuuaagaguuggaggugcaa

SEQ ID NO: 88930 - RNA, 64 nt, Human
aggccagaggaacagcuuugugcuccggcuuucccucagggaacagcagagagcaguuggcucu

SEQ ID NO: 88931 - RNA, 64 nt, Human
cugugacggaggcuaguguggaagagguccuguccucagggaauuaacugucuuauugggagac

SEQ ID NO: 88932 - RNA, 64 nt, Human
ugaaacccaggaccccaaaguucugcguaggugccucagggacuuuuggauuuggaaaguaggc

SEQ ID NO: 88933 - RNA, 64 nt, Human
aagggagcaucaggagaggaacaaaaaaagggaucucagggagaggccagugucaaacuugacc

SEQ ID NO: 88934 - RNA, 64 nt, Human
ggcaaggcacucggccaauccgcaucucagcccucucagggagcagucuuccaucaugcugaau

SEQ ID NO: 88935 - RNA, 64 nt, Human
aggccccugugcuccaggccgaggcugggcuacccucagggagauccagagacucaugcccaug

SEQ ID NO: 88936 - RNA, 64 nt, Human
agaaguugucugugggugauguuacuguaguggucucagggaaaggauuguccaguuacuuuag

SEQ ID NO: 88937 - RNA, 64 nt, Human
cccauuugugcccagaccacaauauuucuucuuccucagggacuacaugccacagaccuguauc

SEQ ID NO: 88938 - RNA, 64 nt, Human
uacccaggaguccccuccauguacacacacacaacucagggaaggagguccugggacuccaagu

SEQ ID NO: 88939 - RNA, 64 nt, Human
cuucucucuucauuccucuuaggagagugccaaacucagggacccagcacugggcuggguuggg

SEQ ID NO: 88940 - RNA, 64 nt, Human
uuuaagguccaaguagaagcuugcauccuugaggcucagggaugagagggcaccgcaaggcacc

SEQ ID NO: 88941 - RNA, 64 nt, Human
cacgccggccggggccgcgaggccuggucugagccucagggaggggccccggguccucucaguc

SEQ ID NO: 88942 - RNA, 64 nt, Human
uugaggguacaggcaaccuuguguucucugugcccucagggacuggcagagcaagaggccauca

SEQ ID NO: 88943 - RNA, 64 nt, Human
uuuucaaggcaaagugaagaugacaguccuugcucucagggagcccccacuuuaaugggagacu

SEQ ID NO: 88944 - RNA, 64 nt, Human
acaccaugcccuugaacucaaagcaaacuacgcucucagggaaauacaaauaucacguucuuau

SEQ ID NO: 88945 - RNA, 64 nt, Human
ucuaucaacaccagcuucucucucgggcuguuugcucagggaaggcaagaaagccacgugcugg

SEQ ID NO: 88946 - RNA, 64 nt, Human
auauauauauauauauuaagccccaggcugaauacucagggacagcaauucacagccugccucu

SEQ ID NO: 88947 - RNA, 64 nt, Human
cacacagaagccuagguagauuuaaaauggggugcucagggacuggggaacaagacgggguggg

SEQ ID NO: 88948 - RNA, 64 nt, Human
cacaccuuccaggcuggauuuuuaaugaaacagacucagggagguaggggcuggcagggacccu

SEQ ID NO: 88949 - RNA, 64 nt, Human
gguucacacaaaaagcaaacuacauucuggucugcucagggagaagcuugccuuugaacuggaa

SEQ ID NO: 88950 - RNA, 64 nt, Human
gcuggaaggagagaaggaagcgggaagugugcuucucagggaggaaaccggcuugccagcaagu

SEQ ID NO: 88951 - RNA, 64 nt, Human
ucugaaauauaugccgaaaauugacgucuuugaccucagggagagcaccuguccaggucugccu

SEQ ID NO: 88952 - RNA, 64 nt, Human
auagcauucgaagauccccagacuucauagaauacucagggaaagcauuuaaagggugauguac

SEQ ID NO: 88953 - RNA, 64 nt, Human
ucguccugcuucccaguggguucagaccucaccucucagggagcgaccugggcaaagacagaga

SEQ ID NO: 88954 - RNA, 64 nt, Human
uaugaagaaagauacuaauagaguacuuaauauacucagggauuccuucuaaguguacuucaua

SEQ ID NO: 88955 - RNA, 64 nt, Human
ccuuguuugcugaggggugggagccacccagcgucucagggaccugucccuccgucacgucguc

SEQ ID NO: 88956 - RNA, 64 nt, Human
ugcccuugcggccuccuggcccggugcagcugcccucagggacagggugggugcucucagaugc

SEQ ID NO: 88957 - RNA, 64 nt, Human
aaccacauucaugcuuacccugcugcucagcuuucucagggaagcaacuccaggaacacuccuu

SEQ ID NO: 88958 - RNA, 64 nt, Human
gaacuggccuuacuuugauuuuuaaaacaagagacucagggaaaguacuaaaccaaaaucucug

SEQ ID NO: 88959 - RNA, 64 nt, Human
gaagaaaccaagacagagagcuuaacucacuucucucagggaaaauuaggaguugagcacagga

SEQ ID NO: 88960 - RNA, 64 nt, Human
ucagauuucuuguucuauggaagaggaagcugagcucagggagauaugagcuccacagccacag

SEQ ID NO: 88961 - RNA, 64 nt, Human
guaaauuuuaaacucuguccauguucuguuagaacucagggacaaggauccaugaaaaagaccu

SEQ ID NO: 88962 - RNA, 64 nt, Human
gaagaguuucaguagaguggccccagggugauagcucagggaacaacaaaaaaggaauuccgug

SEQ ID NO: 88963 - RNA, 64 nt, Human
cuggaaaccccagagagggcugggcuugacucaucucagggaauguagccccugggcccuggcu

SEQ ID NO: 88964 - RNA, 64 nt, Human
cguuucuuguguugcccugaaaaaucuuugagaccucagggaggcucugucucucuuaaaaggu

SEQ ID NO: 88965 - RNA, 64 nt, Human
ggagcgugcaccaggugaggugagcgugugugcucucagggaagggcccaggaucccaugccug

SEQ ID NO: 88966 - RNA, 64 nt, Human
ugucagcucaccagucucuucccugacagggcagcucagggaacuucugagaaguuaucugcag

SEQ ID NO: 88967 - RNA, 64 nt, Human
ggcuucagugucgauugagauugcuuuuguucaucucagggauuucaauagucaagaaugaauu

SEQ ID NO: 88968 - RNA, 64 nt, Human
gcacugagccugguacccuguggcauggagaagccucagggaaaggccugcccccccagcacau

SEQ ID NO: 88969 - RNA, 64 nt, Human
ccucaaggggcccagccacgucaaacuucucucccucagggacucuccagcaccaaaaggcaga

SEQ ID NO: 88970 - RNA, 64 nt, Human
acccuccucugggagccugcuucgaauagugggacucagggagauaagaccuucuugcuggauu

SEQ ID NO: 88971 - RNA, 64 nt, Human
caccgacagugaugaggaggaagaagaaaaagugcucagggauuuauaauuuuaaaacaaauau

SEQ ID NO: 88972 - RNA, 64 nt, Human
cacauccuagcaggcagccccuggcgccugcugccucagggaugcuccaaccacccucguucuc

SEQ ID NO: 88973 - RNA, 53 nt, Human
gggagcacaccguuuccugauugcucagggacucaucuuucccuccuugguga

SEQ ID NO: 88974 - RNA, 64 nt, Human
accucuggauccagcugaccugacaggucaucuacucagggaggagcccugugcucccagcuca

SEQ ID NO: 88975 - RNA, 64 nt, Human
gugaugacugcuuguagguaugucugugccauuucucagggaaguaagauguaaauugaagaag

SEQ ID NO: 88976 - RNA, 64 nt, Human
ccugugacaggggaaagggcucucuuacaccgcacucagggagaccacuucucaggaugggguc

SEQ ID NO: 88977 - RNA, 64 nt, Human
acacggugugaaucacacauccagcugccccucccucagggagcgauccaggggaagccaguga

SEQ ID NO: 88978 - RNA, 64 nt, Human
uccgacauaaaauuccugcucugccacagcuccacucagggaucaugguugggacacuugcucu

SEQ ID NO: 88979 - RNA, 64 nt, Human
agaguuagaacggagcccucggugaugcggacaucucagggaaacuugcguacucagcacagca

SEQ ID NO: 88980 - RNA, 64 nt, Human
ggcagcgaggcccucugcaagaagcucaaggaagcucagggaaaauggacguauucagagagug

SEQ ID NO: 88981 - RNA, 64 nt, Human
cucauuuuauaucaacacgcuuggaggaaagggacucagggaagggagcagggaguguggggug

SEQ ID NO: 88982 - RNA, 64 nt, Human
uaucgcuaguaaaauagcaugcuggacuucagaccucagggauccuuuugaugcacugaccagg

SEQ ID NO: 88983 - RNA, 64 nt, Human
cugauacaaggccuggagagggcuguugggggcccucagggaggguucaacucugagacgagaa

SEQ ID NO: 88984 - RNA, 64 nt, Human
ugugaggcaugacccaaauuguaagcauagggaccucagggauggggaagaaacccgaguacga

SEQ ID NO: 88985 - RNA, 64 nt, Human
ggucuagugagcuguagaauugaaucaaugugaacucagggaacuggggaaggcugagccuccu

SEQ ID NO: 88986 - RNA, 64 nt, Human
gcugggcaggucuccucugggaggucuuggccgacucagggaccuaagccacguuaaguccaag

SEQ ID NO: 88987 - RNA, 64 nt, Human
cugcuggauguugacgaaggaagcggcggcgcagcucagggaucuccgagucaggacggucggc

SEQ ID NO: 88988 - RNA, 64 nt, Human
ccacaucaccuccccaccacccggccggggugugcucagggaauguggacucgcucaaaugccg

SEQ ID NO: 88989 - RNA, 64 nt, Human
ccucuuaucugggcagucaugugcugaguuaaaacucagggauucugugacuacaagaugaaag

SEQ ID NO: 88990 - RNA, 53 nt, Human
aagaagaaagcaagucauaaagccucagggaggccauuuuugccuaaauuuga

SEQ ID NO: 88991 - RNA, 64 nt, Human
cuuucccuuuguuaguguccuggguucccauggacucagggauuuguuggcuaagguuucucug

SEQ ID NO: 88992 - RNA, 64 nt, Human
cguuaccaauacaacacugaugugguguuugauucucagggaaaacuguuggcacgcuaccaua

SEQ ID NO: 88993 - RNA, 50 nt, Human
agcagaaacugaaugacugacucagggaggugucaccauccgaagggaac

SEQ ID NO: 88994 - RNA, 64 nt, Human
cugccauacacccgggagcucuuucccucagggucucagggagccaguucaaggucuggcuguc

SEQ ID NO: 88995 - RNA, 64 nt, Human
cauagcuaggaaagcgaaugauaagggaaaaguucucagggaauugaaguguuguugcuauggu

SEQ ID NO: 88996 - RNA, 64 nt, Human
cuggggcccuuucccuucuggaggaagcacaagccucagggaaggggaagcaggaugcggaggg

SEQ ID NO: 88997 - RNA, 64 nt, Human
ucagcacaggggucccugccccacccuccggcagcucagggaguguuuuccugugaggccuccc

SEQ ID NO: 88998 - RNA, 64 nt, Human
ccagagcaggaagcauucagagagcagcuuuaaacucagggacagagccaugcugggaagacgc

SEQ ID NO: 88999 - RNA, 64 nt, Human
gcucacccaauaaacauuaagauugaggccugcccucagggaucuugcauucccaguggucaaa

SEQ ID NO: 89000 - RNA, 64 nt, Human
ugaucuucaggaugcacgguuucuguucugcccccucagggaugugggaaucucccagacuugu

SEQ ID NO: 89001 - RNA, 64 nt, Human
agaaaaauucagacagcaucuucucuauuggccucucagggaacaucaguauagaucuuuccgg

SEQ ID NO: 89002 - RNA, 64 nt, Human
uaaauuuuagucagauuuugcccaaccuaaugcucucagggaaagccucuggcaaguagcuuuc

SEQ ID NO: 89003 - RNA, 64 nt, Human
gaggccaaacccaagaaggucuggcaaagucaggcucagggagacucugcccugcugcagaccu

SEQ ID NO: 89004 - RNA, 64 nt, Human
aacaucccgcuucugaagcugcugcagcucccuccucagggaucacacugccgucacccacucu

SEQ ID NO: 89005 - RNA, 64 nt, Human
uuuaaaaauuaaaaauggauggaucuucucugaacucagggagggcacauacuuagauaccuac

SEQ ID NO: 89006 - RNA, 64 nt, Human
caggcuugcccucaccagcggccgucagccgacacucagggauguagcuaacaccacuccgcca

SEQ ID NO: 89007 - RNA, 64 nt, Human
agggcaggaggagggggccgugccucccacccuucucagggacccccacgccuuuguuguuuga

SEQ ID NO: 89008 - RNA, 64 nt, Human
cuaaugaguggucggaccguggggaagggccccacucagggaucucagaccuagugcucccuuc

SEQ ID NO: 89009 - RNA, 64 nt, Human
ggucacaucacuaugccgagcaagaaaaguggaucucagggaggacuagcagccccugguuaag

SEQ ID NO: 89010 - RNA, 64 nt, Human
gaaggacaggcuuuccccuguauaucauaggaaacucagggacauuucaaguugcugagaguuu

SEQ ID NO: 89011 - RNA, 64 nt, Human
ccagccgacgaagaguaggaaaagagaagggcugcucagggaaacauuggcugggggcacggaa

SEQ ID NO: 89012 - RNA, 64 nt, Human
cgcaggccaccuccaccacaaccgaaaguaucaucucagggaaacuuaauuccugcccguccug

SEQ ID NO: 89013 - RNA, 64 nt, Human
accgugaaccagaggguguggcuuuccaggcacccucagggagccuccccaucuguccagcugg

SEQ ID NO: 89014 - RNA, 64 nt, Human
acaaguccuggcccuaugucccagcugucaggggcucagggaauccuacccagccaccuguccu

SEQ ID NO: 89015 - RNA, 64 nt, Human
agaugaacacugacuuuugcauauggucucuuaccucagggaagaucacuugcuagcaacucau

SEQ ID NO: 89016 - RNA, 64 nt, Human
agaaggagucccaucaggagggaagauggugggccucagggaggauggggaucaagggacaggc

SEQ ID NO: 89017 - RNA, 64 nt, Human
uguuauugaaauauuacagauggaaagaaugaggcucagggaaguuaaaugacuuggccaagau

SEQ ID NO: 89018 - RNA, 64 nt, Human
cuauccaugaagggaaagcuccucagcauaacugcucagggaaauagggcuaaauaacugaaca

SEQ ID NO: 89019 - RNA, 64 nt, Human
guaaucauuccagguguguucaguaguuccaggacucagggacucaggccagucacccugugac

SEQ ID NO: 89020 - RNA, 64 nt, Human
caucuuuccaguggggcccccauucacguugguccucagggaaaccagggucccgggcaggccc

SEQ ID NO: 89021 - RNA, 64 nt, Human
ccucucugccccuauggggcucuguccugcaccccucagggauggcgacagcaggccagacaca

SEQ ID NO: 89022 - RNA, 64 nt, Human
ccaucaggcccuauuggccucuguuagacauugacucagggagccggagcgccaaguggagguu

SEQ ID NO: 89023 - RNA, 64 nt, Human
cagccaaaacugaggcccugugcaugcugguggccucagggacccucauaacccccagacucag

SEQ ID NO: 89024 - RNA, 64 nt, Human
gaggccgaugcauaaagucagccuguucaaagugcucagggacuuagcaaaaugagaagaugug

SEQ ID NO: 89025 - RNA, 64 nt, Human
auacuguacuguguagugugucuccguaugucaucucagggagcuuaaaaugggcuugauuuaa

SEQ ID NO: 89026 - RNA, 64 nt, Human
uucucugggcuuucaaacccacaaccuuuacacacucagggauaccuccgggucugccaugaau

SEQ ID NO: 89027 - RNA, 64 nt, Human
agaacuuucccuggcagggaggggauggcagaaacucagggaggggcuuggggcccauuguauc

SEQ ID NO: 89028 - RNA, 64 nt, Human
cccuggcccucucggggcagagccgccaguguuucucagggaugugacugaggcccaggaggga

SEQ ID NO: 89029 - RNA, 64 nt, Human
gcuccagggcuggcucugguguuuacaagcuggacucagggauccuccuggccgccccgcaggg

SEQ ID NO: 89030 - RNA, 64 nt, Human
uauuauucccaucuuacagauaaaacaacugaggcucagggagauucugugacuuaccuaaggc

SEQ ID NO: 89031 - RNA, 64 nt, Human
uuggcauaaaauacggcuuacguugcuuaagauucucagggauaaacuuccuuuugcuaaaugc

SEQ ID NO: 89032 - RNA, 64 nt, Human
gcagcucugagcagagaccucugcccuccucacccucagggacaccacucggcuccauggggag

SEQ ID NO: 89033 - RNA, 64 nt, Human
gaugguguggugaugaagccugcuggguauacagcucagggaaagucaucgaugauggcucagg

SEQ ID NO: 89034 - RNA, 64 nt, Human
cagccagaguuggccucagaaugaccugcucuggcucagggaucccugguggauggggaaaagc

SEQ ID NO: 89035 - RNA, 64 nt, Human
ccuugacccacaggacgugugguggcgccuggcacucagggacccccagcugccgcagcccugg

SEQ ID NO: 89036 - RNA, 64 nt, Human
ccugcagccugagccuucuuacugugaauuauaacucagggacuguggcucguggcggugcucc

SEQ ID NO: 89037 - RNA, 64 nt, Human
cccucucgcuucuaacacagggcaccugcuggggcucagggauguuagggacgaguuccagccc

SEQ ID NO: 89038 - RNA, 64 nt, Human
uccucccagaaagcaaaccuguaagugucuugggcucagggaccauggcuuguagcccuuucca

SEQ ID NO: 89039 - RNA, 64 nt, Human
ggagaccacggggagcaaaccagcuuguucugggcucagggagggagggcgguggacaauaaac

SEQ ID NO: 89040 - RNA, 64 nt, Human
gucaaaagacacuuuccucuguuccauuccccaucucagggacuccugaauauucagccucucc

SEQ ID NO: 89041 - RNA, 64 nt, Human
gagcuccaaauugguggcauuauccuuucaaaaucucagggauuugggaugaagugaagagguc

SEQ ID NO: 89042 - RNA, 64 nt, Human
caacaucaaauuuuuagaauuaaaauacauuuaacucagggaauuuguacuacuuggaaacacu

SEQ ID NO: 89043 - RNA, 64 nt, Human
uggcucagcuugggcaagggcugggccauaugugcucagggacgugcuucucuuguaaggcagg

SEQ ID NO: 89044 - RNA, 64 nt, Human
ccccuguccccuggagaccagaagcugaggcccucucagggaggagacauccaagcaaaucauu

SEQ ID NO: 89045 - RNA, 64 nt, Human
ucuuuccucggccgagucaggcuuccuggugagccucagggagugcauggucucagaugccauc

SEQ ID NO: 89046 - RNA, 64 nt, Human
gcuccucuccagaguuuccggucaccuccguguucucagggagugcguggucuuggaugccauc

SEQ ID NO: 89047 - RNA, 64 nt, Human
caucccccagccccaagccugcgcgcaucugucacucagggacuuucuaugggucuuugugggg

SEQ ID NO: 89048 - RNA, 64 nt, Human
aaggguagggguauaagucuguuccaugcagucacucagggacccagucuccuuuugucuggug

SEQ ID NO: 89049 - RNA, 64 nt, Human
ugagcaggucagcaggaacccuuuucugcagucacucagggacccagacuuacagaguggguag

SEQ ID NO: 89050 - RNA, 64 nt, Human
cuuugaaccgcgacuacuggaaguggccuuugcucucagggaacauggugauggaggguugcau

SEQ ID NO: 89051 - RNA, 64 nt, Human
acugugccuucauuuuccagcccacagccugggucucagggaucuugagggguagaacaugucu

SEQ ID NO: 89052 - RNA, 64 nt, Human
ggccugacugugcugggggcuggguuaacguuuucucagggaaccacaaugcacgaaagaggaa

SEQ ID NO: 89053 - RNA, 64 nt, Human
auauugggggaaggagggcagacuccaucguuuccucagggagacugggcggaggugggguugg

SEQ ID NO: 89054 - RNA, 64 nt, Human
agugugaacgugauguuuucggaugcaaacucagcucagggauucauuuugugucuuaguuuua

SEQ ID NO: 89055 - RNA, 64 nt, Human
cacuaaccuccgaagccagacucuguuaugugugcucagggaguguggagcggcugguggagug

SEQ ID NO: 89056 - RNA, 64 nt, Human
accauugagccaaugcauuggugucuccucaguucucagggaguguggguggcggcuccggcgg

SEQ ID NO: 89057 - RNA, 64 nt, Human
gccaccccugccucugggccagggaaaccagcuacucagggacuucucuugccuggagggugca

SEQ ID NO: 89058 - RNA, 64 nt, Human
gaaaagagagaucuacuuuggugguuucucaggucucagggaaggucuuuuauaaacucaaugg

SEQ ID NO: 89059 - RNA, 64 nt, Human
cuuugggaagagcugcugagcucuuugccugccacucagggagugcaauuguucuuaaagagcc

SEQ ID NO: 89060 - RNA, 64 nt, Human
cacccccggacgccccccggccugauggccaggccucagggaccaaggagauggggagggcgcu

SEQ ID NO: 89061 - RNA, 64 nt, Human
cagugguucagagccugguuauacauauagaucacucagggagcuuuggaaaaauaaagauuug

SEQ ID NO: 89062 - RNA, 64 nt, Human
ugcaggaagccaggauguaauucucagaaccagucucagggagauauaugcuuggagaacucug

SEQ ID NO: 89063 - RNA, 64 nt, Human
aaacuguaggaaauacaugacagagaaaguuacacucagggagcagcagcaccuccagacugga

SEQ ID NO: 89064 - RNA, 64 nt, Human
caguagcugagcuccaaggacucaggcagagggacucagggauggggacugccaggggcaguug

SEQ ID NO: 89065 - RNA, 64 nt, Human
agcagccccaggccagagaggccucccgguccagcucagggaugcuccugccagcacaggggcc

SEQ ID NO: 89066 - RNA, 64 nt, Human
aauuuucacuguauuugagaugggaggguuaaggcucagggauuuuauuucagugaacugcugg

SEQ ID NO: 89067 - RNA, 64 nt, Human
ggcugcacgggaugcgugggaggcagaaaccuaucucagggagggaaggggauggaggccagag

SEQ ID NO: 89068 - RNA, 64 nt, Human
ggagugucagcggaggccccaggcagcccaagagcucagggagccagggaccccaaggggaguc

SEQ ID NO: 89069 - RNA, 64 nt, Human
agguggcagcucugaccaccucuggccccaggcccucagggagaaaggagcaacacacugcccc

SEQ ID NO: 89070 - RNA, 64 nt, Human
cuguccccucuugccccaacccccagcacccgggcucagggaccacagcaaggcaccugcaggu

SEQ ID NO: 89071 - RNA, 64 nt, Human
ccucgaccaccgccccucuccccauccguccccccucagggaccaagaaguccaagaggggccg

SEQ ID NO: 89072 - RNA, 64 nt, Human
aggcgauacaucugaguucaaaugucuucccaggcucagggaccuccauuccuugagauugucu

SEQ ID NO: 89073 - RNA, 64 nt, Human
ucacucuccaucucaggaaauucuagcccuugcccucagggagccacgguugagggugaggccc

SEQ ID NO: 89074 - RNA, 64 nt, Human
uuccucuacaaccccaaggacuuucaugauuauccucagggacaggauuggaggcauugagcgu

SEQ ID NO: 89075 - RNA, 64 nt, Human
ccuggucaaauuuauuuccuaucaaucacugaaucucagggauaaugggucaacccagaacuga

SEQ ID NO: 89076 - RNA, 64 nt, Human
agggcuuuggcuguuaccuuucccugcugaggggcucagggaaaagggucggggauucucaguc

SEQ ID NO: 89077 - RNA, 64 nt, Human
gccuaagaaauacugagcuuccugcuccucugcucucagggaaacugggcugugagccacacac

SEQ ID NO: 89078 - RNA, 64 nt, Human
uuccuguugaacuuccuauguucuuucucaagugcucagggaucuaaguuaguggacagcaagc

SEQ ID NO: 89079 - RNA, 64 nt, Human
uauuagccagucuuuacagcugagcacauucuggcucagggagguuaagugacuugcccaguuu

SEQ ID NO: 89080 - RNA, 64 nt, Human
guguuaacuugguuguuccagagguaaaccaggucucagggaagagccuggagcugcuauugcu

SEQ ID NO: 89081 - RNA, 64 nt, Human
agcugggcuucccaccaggcuuucccgcgggggucucagggagcuucuccccagcgcugcucgg

SEQ ID NO: 89082 - RNA, 64 nt, Human
uaucacuccacuuuuucagacaaggaaacugaggcucagggaagccaagugacaaguccaaggu

SEQ ID NO: 89083 - RNA, 64 nt, Human
guggcauuucugcgucuuacuggcaaccacacaacucagggaaaggaaugccugggaguggggg

SEQ ID NO: 89084 - RNA, 64 nt, Human
cuguacccagcugguugggaggaccagagccugucucagggaauugccugcuggggugaugcag

SEQ ID NO: 89085 - RNA, 64 nt, Human
uguguacaguggcuccuugggaacugagacauaucucagggaauggugucugugcucagcccau

SEQ ID NO: 89086 - RNA, 64 nt, Human
augagcucaacagucucagcccuagaggaauagacucagggauuucaccaggucggugcaguau

SEQ ID NO: 89087 - RNA, 64 nt, Human
gaggcuuaagagagaaacaccgaaauucagauagcucagggacugcuaacagagaacuacauuu

SEQ ID NO: 89088 - RNA, 64 nt, Human
aguccugccaccacccugucuuccucugcaagugcucagggaaauggccuucccgccggaggcc

SEQ ID NO: 89089 - RNA, 64 nt, Human
aagucacuacagcaucuggagccccuaggagauacucagggaagcaaauccuuguuugggcugg

SEQ ID NO: 89090 - RNA, 64 nt, Human
auuucccagcccugggucaagggccugccuucgccucagggacucucuuccuuuggaugagggg

SEQ ID NO: 89091 - RNA, 64 nt, Human
cuaggaaaggggguggagacaggaccgugacagucucagggaccaaucccugccucugcccauc

SEQ ID NO: 89092 - RNA, 64 nt, Human
ccucagacagcccccugccccgcaggccugccuucucagggacuucugcggggccugaggcaag

SEQ ID NO: 89093 - RNA, 64 nt, Human
gaaaacaaaauuagagcaaagcugaccuggagcccucagggagcaaaacaucaucuccaccuga

SEQ ID NO: 89094 - RNA, 64 nt, Human
ccuuaaugaagcucucaaaauauuuuaggagcugcucagggaguguuggguggaacuguuugga

SEQ ID NO: 89095 - RNA, 64 nt, Human
aaaauuuuuacuccaacacccccucaacccuuuucucagggaccacaccucuucuucccaaggu

SEQ ID NO: 89096 - RNA, 64 nt, Human
ccaggauccccuuagcaggguccuucccaccagacucagggaagggaugccccauuaaagugac

SEQ ID NO: 89097 - RNA, 64 nt, Human
guaauguguucccuuucccaccccuugccugacccucagggagucagccugcuuccauccaugg

SEQ ID NO: 89098 - RNA, 64 nt, Human
agccacucugcuuagacaugggagcuauagggaccucagggagccccagcuucuuacccaccca

SEQ ID NO: 89099 - RNA, 64 nt, Human
caucccauuaaagaccgggcugguuagcguccagcucagggagaagggcgcuagugccuaaccu

SEQ ID NO: 89100 - RNA, 64 nt, Human
ugcccagagaacguaacuccugcucccuguggcacucagggagcauuuaauggcagcuagugcc

SEQ ID NO: 89101 - RNA, 64 nt, Human
guguaaagcuguucaaguuauuugauguuuacaccucagggaaagucuuguguucagcaauauc

SEQ ID NO: 89102 - RNA, 64 nt, Human
agcacugaguggucaaaauacauuucugggccaccucagggaacccaugcaucugccuggcauu

SEQ ID NO: 89103 - RNA, 64 nt, Human
acugcuuugugccugugugacucuggcauagcugcucagggagaauuacgugccucugugugua

SEQ ID NO: 89104 - RNA, 64 nt, Human
cugaggacuggacuguggugaccaugccgauuugcucagggagaacguugcaaugcacccagca

SEQ ID NO: 89105 - RNA, 64 nt, Human
gcuggccacccuggccucagcucccucaggacgccucagggaucucgcugcgcgguccuauacg

SEQ ID NO: 89106 - RNA, 64 nt, Human
ccaauugauccucuacuuuccuucuuuagucccucucagggacgccuccauccccggcuccccu

SEQ ID NO: 89107 - RNA, 64 nt, Human
ccugggggcgggguugugggggggcugagcgacacucagggacaccucaguuguccucccgcgg

SEQ ID NO: 89108 - RNA, 64 nt, Human
uauuuuuugucucuuuuaagaugguaaaaugguucucagggauuccugccaauacuuugaauua

SEQ ID NO: 89109 - RNA, 64 nt, Human
aaaagcccagaaacccaggugcuggaccagggcccucagggaggggacccugcggcuagagugg

SEQ ID NO: 89110 - RNA, 64 nt, Human
accgcggccacgcccugcuggucgggguagggggcucagggaagcagucucuuucgaggcuggc

SEQ ID NO: 89111 - RNA, 64 nt, Human
acaggcaagccggcccccaccucucccugggggucucagggagaaccuuucacggcacccuuuc

SEQ ID NO: 89112 - RNA, 64 nt, Human
uuuuuggcacauggaucaacaaaaucggcaaggucucagggaccuuguuaacaguggaguaacu

SEQ ID NO: 89113 - RNA, 64 nt, Human
uguggaaugcugcugcaccugucccuucugcuggcucagggaagugucuucuugcccacauuuc

SEQ ID NO: 89114 - RNA, 64 nt, Human
aacauagguuuuuagucuaauugaaucccuuaaacucagggagcauuuauaaauggacaaaugc

SEQ ID NO: 89115 - RNA, 64 nt, Human
uggagacagaaaguagaauagugguugccaaugucucagggagguugaaauaggagaugaccac

SEQ ID NO: 89116 - RNA, 64 nt, Human
aggucuaguuuuuuuuuacaguuaugacaaaccccucagggauuauucacauuuaaauauuuuc

SEQ ID NO: 89117 - RNA, 64 nt, Human
uguuccacaucaucacuccagcuccuucucuuuucucagggacaaaugaggcccagagagaaua

SEQ ID NO: 89118 - RNA, 64 nt, Human
guugagggaacagacaggagaaaugcauccauuccucagggacagagacaccugcaccuccccc

SEQ ID NO: 89119 - RNA, 64 nt, Human
gagggaggcaggcuggggagaagagaacauuagacucagggaauauuuaauucugguuuuagca

SEQ ID NO: 89120 - RNA, 64 nt, Human
auaccuguauccaauuuguauuauucccccagcucucagggacaagaccagucccccagcgugg

SEQ ID NO: 89121 - RNA, 64 nt, Human
aggggggcuucagaagggggggaacaccccagaucucagggaaccccgcccccugccuuucccu

SEQ ID NO: 89122 - RNA, 64 nt, Human
uccccaccuccuucccaaacccucuugggaacuccucagggacaacuacugcugaguuugggug

SEQ ID NO: 89123 - RNA, 64 nt, Human
uauuuuauccccauuuuacugcaaaguugacaagcucagggaaaauaaauaguuggccagaauu

SEQ ID NO: 89124 - RNA, 64 nt, Human
uagcauauguauguucagugggcuagccuugguccucagggacagugugugacucuaguggucu

SEQ ID NO: 89125 - RNA, 64 nt, Human
gcgagggcagaccccaggggaaagcaaagggcgucucagggaacccccacauucucucacugaa

SEQ ID NO: 89126 - RNA, 64 nt, Human
augaaagcaauugguuaggaccucuuuuuuuccucucagggaacuaaugcucugaaaagggauc

SEQ ID NO: 89127 - RNA, 64 nt, Human
gugauuccuuaaguacauuuuuccaaugaauaaucucagggaccccucauaugggcuagucccg

SEQ ID NO: 89128 - RNA, 64 nt, Human
auucaucuuucagacaagcuuuagcagaaauggacucagggaagagacucacacgcuuugguua

SEQ ID NO: 89129 - RNA, 64 nt, Human
auucaucuuucagacaaucuuuagcagaaauggacucagggaagagacucacaugcuuugguua

SEQ ID NO: 89130 - RNA, 64 nt, Human
cacauacacacaugcgugcaggcuugugcagacacucagggauggagcugcugcugaagggacu

SEQ ID NO: 89131 - RNA, 64 nt, Human
aaaaauggacugcccacuuccaugcugagugaugcucagggaagugaugcccgcagaaggcguc

SEQ ID NO: 89132 - RNA, 64 nt, Human
gggcugggccugagauucugcauuucuaaggagucucagggaugccuaugcugcuggccuaaaa

SEQ ID NO: 89133 - RNA, 64 nt, Human
cuaaaaucugaguuuugcccagugugacaucaaacucagggaagaggaagcuaaagugacgagu

SEQ ID NO: 89134 - RNA, 64 nt, Human
uccauaucagcugcugcuagcgccagcgcagacucucagggagucaccacagcuugucuugugc

SEQ ID NO: 89135 - RNA, 64 nt, Human
caggcgugguguugcaugucuguagucacagcuacucagggagguugaggcagcaggauugcug

SEQ ID NO: 89136 - RNA, 64 nt, Human
uccuuccucucacgguuuuuugcagaagcaagugcucagggaaaugaagacaggagaacugcug

SEQ ID NO: 89137 - RNA, 64 nt, Human
acuauggggaaaaaaaaagaagaagaaaaagaaacucagggaucacugggagaagccauggcau

SEQ ID NO: 89138 - RNA, 64 nt, Human
gugugggcugugcccuagccacaccacagccagccucagggagccacggcccgucuagucgacu

SEQ ID NO: 89139 - RNA, 64 nt, Human
ccgagugauagagcagaaggagguucccaaugggcucagggacgaagcuuguggcaaggaaacu

SEQ ID NO: 89140 - RNA, 64 nt, Human
uuuagcugaugagccaucuugauguagcugaucucucagggauagaagauauuucucaugaagg

SEQ ID NO: 89141 - RNA, 64 nt, Human
gaucaaauauuaaaauuaggaauuuaggcauuaccucagggaaaagccuugacagugaaaagaa

SEQ ID NO: 89142 - RNA, 64 nt, Human
cgauaguuaauuauagacuuugguaccuuugugccucagggaagccacgugauauaacugguua

SEQ ID NO: 89143 - RNA, 64 nt, Human
cauuuugcguuuuaauauuucucuuaacccuauucucagggaagauggaauuuaguuuuaagga

SEQ ID NO: 89144 - RNA, 64 nt, Human
agcuccgcggacccauggacaagcccagccccgccucagggaaaacagggccuuucccuacagg

SEQ ID NO: 89145 - RNA, 64 nt, Human
gccgguaccugggaagggggagagugcaggccugcucagggacuguuccugucucagcaaccaa

SEQ ID NO: 89146 - RNA, 64 nt, Human
caaggaaagaaccaggagggagagugcagccaggcucagggauccccggacaccucuguccaga

SEQ ID NO: 89147 - RNA, 64 nt, Human
ucuuuccaaaauccucacucuguucauuguuugucucagggaaaaucuucccccaccgagcuug

SEQ ID NO: 89148 - RNA, 64 nt, Human
gaguucauaaauuuacuugagguugccucaagaacucagggaacaauacuguaaacugucuucc

SEQ ID NO: 89149 - RNA, 64 nt, Human
auuuuuauuggauaaauaugaauaaauauuuucucucagggaaaauaauuuuugaaaguagggu

SEQ ID NO: 89150 - RNA, 64 nt, Human
uucuucucauugcugaagccccucugugucucuucucagggacaggcugguccaguggcuuugg

SEQ ID NO: 89151 - RNA, 64 nt, Human
uuauuuauucuuaguauuuaauuuuuaacauccucucagggaccaggggccuccugcuuuucag

SEQ ID NO: 89152 - RNA, 64 nt, Human
gaugaguggcuuccauggagagauuuccugauuucucagggaggaaaaaagugaugacauuuac

SEQ ID NO: 89153 - RNA, 64 nt, Human
gagcucuccagcuuggaccacacauugcccuuuucucagggaaggaaauggaaacaaaaagcca

SEQ ID NO: 89154 - RNA, 52 nt, Human
uggaagguaauuucaccugagucucagggaaccacgaagggauauggcaaug

SEQ ID NO: 89155 - RNA, 64 nt, Human
cagcaugugcaggccuggaagagcaaagccaaaucucagggaaguccuugguugauguaucugg

SEQ ID NO: 89156 - RNA, 64 nt, Human
caaaguugagauucagcguuguugaacccccuuucucagggauggacacguuucacgaggucag

SEQ ID NO: 89157 - RNA, 64 nt, Human
aagaggaagcacacuggguaacaaugaacagugacucagggaacuuaugccccuucuguaggaa

SEQ ID NO: 89158 - RNA, 64 nt, Human
uuccagguggccauagucagucaccaugugugggcucagggacccccaggaccaggaugugucu

SEQ ID NO: 89159 - RNA, 64 nt, Human
uaauggucuuuuauuguagaauugguucuuuauacucagggaaguaauuauauuguuuuuacuu

SEQ ID NO: 89160 - RNA, 51 nt, Human
acaaccagcgcuccagauaaccucagggaaccagcacuucccaaaccgcag

SEQ ID NO: 89161 - RNA, 64 nt, Human
ccacaggcacggaggggcaucccucccugccggccucagggagcgaacguggaugaaaaccaca

SEQ ID NO: 89162 - RNA, 64 nt, Human
ugaggagguggguggaggcaugcaggggagacgacucagggaucgcgggggcggggagguggag

SEQ ID NO: 89163 - RNA, 64 nt, Human
uugcuggggggagaugaggcagccucuggaauggcucagggauucagcccucccugccgcugcc

SEQ ID NO: 89164 - RNA, 64 nt, Human
cuccugcauuugccuggcccugaucucgccuguccucagggauccagacuuccucugcuggucu

SEQ ID NO: 89165 - RNA, 64 nt, Human
gaggauguaguuguugcugccgucgucccaccaccucagggaccagagggcuagguuggcacug

SEQ ID NO: 89166 - RNA, 64 nt, Human
ggcgggauuggauggagucuugguguuuugccuucucagggaccaaaaauguaucauugacucc

SEQ ID NO: 89167 - RNA, 64 nt, Human
gauuccuggccagcuccugccaccuccagcagaccucagggaggguugaguuucucuaaggacc

SEQ ID NO: 89168 - RNA, 64 nt, Human
gggguuguagugagagcuucgggacagaccuuggcucagggacugcccucaucugauguccucu

SEQ ID NO: 89169 - RNA, 64 nt, Human
uauaacccuguuuccccucagagaagagcuauggcucagggaucuguguugacucuggcauuua

SEQ ID NO: 89170 - RNA, 64 nt, Human
guucucuguagcucaaucugcaaacaugccaggccucagggauccucugcugggugccuccuug

SEQ ID NO: 89171 - RNA, 64 nt, Human
cacugcauggucuagggacguucucucuccaguccucagggaagaggaccccaggacuucgcag

SEQ ID NO: 89172 - RNA, 64 nt, Human
ccucuuugcacuggaauggggcacuccaacaccccucagggaccacccuccccacaguaugcac

SEQ ID NO: 89173 - RNA, 64 nt, Human
cauggcaccugucgcccagugcccuggggcugaucucagggaagcccagcuccagggccagaug

SEQ ID NO: 89174 - RNA, 64 nt, Human
auuuucagaggaugugaagccacugaaagcuugacucagggaaaagaaaugugggaccaucaca

SEQ ID NO: 89175 - RNA, 64 nt, Human
uguccuucugugucuuguagcuguagggugccagcucagggagugggguguuggcggcguuucc

SEQ ID NO: 89176 - RNA, 64 nt, Human
cccucauuuuuaggaaucuagugaugccucuugccucagggaaacguuucuuugauggggaguu

SEQ ID NO: 89177 - RNA, 64 nt, Human
uggcuggcuuccuggaggcguucgccucuaguuucucagggauggagcgagagcccagccagag

SEQ ID NO: 89178 - RNA, 64 nt, Human
ucccuucacacacccaggcuggagagacacugcgcucagggacggcuugaugguagccaggacc

SEQ ID NO: 89179 - RNA, 64 nt, Human
ggcccccugcuccacacacugcugcaucuugggucucagggacccagacagauggacuuacaug

SEQ ID NO: 89180 - RNA, 50 nt, Human
acccaccgcccuccuccuagcucagggacccagccccuccucucugagaa

SEQ ID NO: 89181 - RNA, 53 nt, Human
ccuuggcucuaugcuccugaauccucagggaucucucuuguggucgguuguag

SEQ ID NO: 89182 - RNA, 64 nt, Human
agccaugugucuuuacaccucgcuguugucacaucucagggaacugacccucaggcacaccuug

SEQ ID NO: 89183 - RNA, 64 nt, Human
aucuaguggggauguggagaaccuuugugucuagcucagggaucguaaacgcaccaaucagcac

SEQ ID NO: 89184 - RNA, 64 nt, Human
aggaugacucagcacugccgcucaacagacaugacucagggauggcuuaguacugccccucagc

SEQ ID NO: 89185 - RNA, 64 nt, Human
aggaugacucagcacugccgcucaacagggaugacucagggauggcuuaguacugccccucaac

SEQ ID NO: 89186 - RNA, 64 nt, Human; identical to SEQ ID NO: 89184

SEQ ID NO: 89187 - RNA, 64 nt, Human; identical to SEQ ID NO: 89184

SEQ ID NO: 89188 - RNA, 64 nt, Human
aaggacugggagagacacaaagaccagagccagccucagggacaagagauuccaguuuuaggcc

SEQ ID NO: 89189 - RNA, 64 nt, Human
ugcacuaggaagugaaucccgcaggacagcugcacucagggauacgcccaacaccauggccugc

SEQ ID NO: 89190 - RNA, 64 nt, Human
cuuugaaaggcuugguugcucccaggcugcuguucucagggaccuuaaaagggaccugguuagu

SEQ ID NO: 89191 - RNA, 64 nt, Human
agcgccuccucccaggguggcugggccuccuguucucagggaucacaccugggugaggggccca

SEQ ID NO: 89192 - RNA, 64 nt, Human
agagacgcaagccaaauucaccuccguggagcugcucagggaauacauuucgguaagaaauuag

SEQ ID NO: 89193 - RNA, 64 nt, Human
uacuaguuucuugaauuguucuuguggacuuuuccucagggauacauuggccugcaggucccag

SEQ ID NO: 89194 - RNA, 64 nt, Human
caucuagggaaggcuggacuaggccuugcggcuccucagggacucagguggcccuacugggaga

SEQ ID NO: 89195 - RNA, 64 nt, Human
cccucggaucagggccgggaugggaggggucagccucagggagcagcugccuugggggacacac

SEQ ID NO: 89196 - RNA, 64 nt, Human
acauccuccaugugagaagcagcgaacauugaaucucagggauggcccacaacuggguccacau

SEQ ID NO: 89197 - RNA, 64 nt, Human
gggccuccuugccuggcuucuuccuccagcuauccucagggaagcuggagauucaagucaugcc

SEQ ID NO: 89198 - RNA, 64 nt, Human
ugauuaguuauuauugcaaagcacugucaccggccucagggaguuuauguguaauagaauuaaa

SEQ ID NO: 89199 - RNA, 57 nt, Human
agucuacccaucgcgacugaccagacccucagggagucagggcacgggaggcccuau

SEQ ID NO: 89200 - RNA, 64 nt, Human
agccccucagccauccagggcuacccacugcuuacucagggaccaggcagcccccauggcagua

SEQ ID NO: 89201 - RNA, 64 nt, Human
ccucccccuacuucuccccaagggccaagaacugcucagggacauuaaaggucaaaaguccagc

SEQ ID NO: 89202 - RNA, 64 nt, Human
cagaaggccaaguccgcagaagcccugauguguccucagggagcagggaaggccugacuucugc

SEQ ID NO: 89203 - RNA, 64 nt, Human
ccagggaugggcucugaugagaggguaaaagaugcucagggaaacacaggccucagcugccuag

SEQ ID NO: 89204 - RNA, 64 nt, Human
ccaccccuaccaauuguuuuacuuccucuuccugcucagggagcagaugggccucacugguuga

SEQ ID NO: 89205 - RNA, 64 nt, Human
cagucccaggugaggccaagggcuuucuggccaucucagggaggggccaccagguuccuccccu

SEQ ID NO: 89206 - RNA, 64 nt, Human
acuauaagaaaguaauaauuccauuuucuauccccucagggacugaacaaauggaaauaacucc

SEQ ID NO: 89207 - RNA, 58 nt, Human
cuuuagauagugcugacugauucuagcccucagggaugaggaugaaaagcuggaaacu

SEQ ID NO: 89208 - RNA, 64 nt, Human
gguauuucuaugucaaaggcacagccuugaugaucucagggaaaaauuuuaaucacuguguaua

SEQ ID NO: 89209 - RNA, 64 nt, Human
cagaaggaaugcacaguacuguuucaaaucaaaccucagggauuuagagauacuguuguuacuu

SEQ ID NO: 89210 - RNA, 64 nt, Human
aagugggcccuugugcugugaggaagaccaaagccucagggaagauaagagauauggagauggg

SEQ ID NO: 89211 - RNA, 64 nt, Human
ggccucugacucccgucucugugcuugcccccaucucagggaccaugaugucucagucacucca

SEQ ID NO: 89212 - RNA, 64 nt, Human
cauaaggagcgugggauccgauggaaagguggagcucagggaaaauggggguccuugccucucg

SEQ ID NO: 89213 - RNA, 64 nt, Human
acucagaggggagggaagggcucaucagcacccgcucagggagccugucccuuuauguucccaa

SEQ ID NO: 89214 - RNA, 64 nt, Human
uggagcuugcuccgggggaccgggacugucuguucucagggaccaucucggcugccuccuguac

SEQ ID NO: 89215 - RNA, 64 nt, Human
guccugcaguggggccgggggcucaggaggggcucucagggacuccuggugacuccaggaaaau

SEQ ID NO: 89216 - RNA, 64 nt, Human
ucacggcccagacugggcaccuucgcgucucagccucagggagccccacagccccaagcucgcu

SEQ ID NO: 89217 - RNA, 64 nt, Human
acagggggccccaguccagguggccuaacagcaucucagggaauguccaucuggagcuggcaag

SEQ ID NO: 89218 - RNA, 64 nt, Human
uuauccugugaaaauauuuugaaccuaaaaagcacucagggaaaugcaaauugaaaugcucagu

SEQ ID NO: 89219 - RNA, 64 nt, Human
aguuuccuacugccuuaggaggccccugcuugugcucagggaaggccucuucaugggcauguuc

SEQ ID NO: 89220 - RNA, 64 nt, Human
gagccagcacguugaccucccucucagcucccugcucagggacgguggacagguugccuacugg

SEQ ID NO: 89221 - RNA, 64 nt, Human
ucuugcccaaggugagccagcccuggggacccagcucagggaggcucugcucagaguucggcgg

SEQ ID NO: 89222 - RNA, 64 nt, Human
gcaccguggagucauuccaagacuccuguccucacucagggauucuucauuucuucuuccuacu

SEQ ID NO: 89223 - RNA, 64 nt, Human
gugggcacucagggugugcccagcccggcccuggcucagggaggaccucaggguuccuggagau

SEQ ID NO: 89224 - RNA, 64 nt, Human
gccaacaaggacuggggccugcccggcugcccgccucagggaugggcaccucaugccugucucg

SEQ ID NO: 89225 - RNA, 64 nt, Human
cuuugagggaggggagcuaugcuaggacuccaaccucagggacucggguggccugcgcuagcuu

SEQ ID NO: 89226 - RNA, 59 nt, Human
acagagcccugcugaagugaauaucuggucucagggauugcuccuauguauucagcauc

SEQ ID NO: 89227 - RNA, 64 nt, Human
gcaaugacucaggacauccccccgccaaaagcugcucagggaaaagcagcucuccccucagagu

SEQ ID NO: 89228 - RNA, 64 nt, Human
caggccugucuggggugggcgcugccgcucaccacucagggaggaccugggccccuuggcuucc

SEQ ID NO: 89229 - RNA, 64 nt, Human
gcaucggggaagggugagaaggagagccugccugcucagggauccaggcucguagagucacucc

SEQ ID NO: 89230 - RNA, 64 nt, Human
acacuauggggccccagcgacgugucugguugagcucagggaauaugguucuuagccaguuucu

SEQ ID NO: 89231 - RNA, 64 nt, Human
ucagugugggcugcugaagcuauccuccucaggccucagggaugaccuccugccugagccucuc

SEQ ID NO: 89232 - RNA, 64 nt, Human
uagaauccauguaguucccaccaguugccuuccccucagggauggaaggaagaggguuucuugg

SEQ ID NO: 89233 - RNA, 64 nt, Human
ugccuggggcaaggccaggggaaacugggggggccucagggacaggccuggaaaggccacgaug

SEQ ID NO: 89234 - RNA, 53 nt, Human
ugggaauucgccugaccuaacugcucagggaucuuucuucccagcccuggagc

SEQ ID NO: 89235 - RNA, 64 nt, Human
cccucagccccagcccagacaaagaugucuuaaccucagggagugcagacaccuaaccccaggg

SEQ ID NO: 89236 - RNA, 64 nt, Human
gcuccuggacagggacccugguaagagcucucuccucagggaggaaguagggguggggcuuugg

SEQ ID NO: 89237 - RNA, 64 nt, Human
gucauguauguaggcuguuaccucaagugagucacucagggaacaaugagcacuugaagauuuu

SEQ ID NO: 89238 - RNA, 64 nt, Human
ggagccgugacacgcagcauuuuccugccguucucucagggacucucagggcagcuccugccac

SEQ ID NO: 89239 - RNA, 64 nt, Human
ccuggacacguccuacuuaagaaaaugccuuuuacucagggaaucuccugcuacuuaaugugga

SEQ ID NO: 89240 - RNA, 64 nt, Human
ucacccucgcgcuaucuucagugacgggugacggcucagggagauggcaggcagauugggcucu

SEQ ID NO: 89241 - RNA, 64 nt, Human
cuacgcucugugcacgaagucaagaaccaaacagcucagggacccucuugccccuucaccaugg

SEQ ID NO: 89242 - RNA, 64 nt, Human
cuauuuuaaguauauuauuuauuguuggcaguuccucagggauuucccuuuucucuguauuggu

SEQ ID NO: 89243 - RNA, 64 nt, Human
ucucuuuuuuuagauauuuuucuaucucucacuucucagggaugaaauucuuuuucaaaguuuu

SEQ ID NO: 89244 - RNA, 64 nt, Human
accugugguaugaagccagaccuccccggcgggccucagggaacagaaugaucagaccuuugaa

SEQ ID NO: 89245 - RNA, 64 nt, Human
cguuauuaaaaaauuacaaaugauagaaucuuuacucagggaugggcaauaaaacagcaaagag

SEQ ID NO: 89246 - RNA, 64 nt, Human
uuuaugagggccacgggucuguguucgacucagccucagggacgacucugaccucuuggccaca

SEQ ID NO: 89247 - RNA, 64 nt, Human
ugugugugugggagagaaggaggcccguguugagcucagggagaccccgguguguccguucuuu

SEQ ID NO: 89248 - RNA, 64 nt, Human
gagaggagggcagggcgugcagggccuugugggccucagggaggacuugggcaccuacgccgag

SEQ ID NO: 89249 - RNA, 64 nt, Human
guggaggccccacucccaguugggcgucccggagcucagggacugagccccaagacgccucugu

SEQ ID NO: 89250 - RNA, 64 nt, Human
caggagccagcgggacgccgcacgcggccccagacucagggagcagggccaggcgggcucgggg

SEQ ID NO: 89251 - RNA, 55 nt, Human
gccagaaacuccaugaaugaaaugacucagggaaguguuuguugccccucaugcc

SEQ ID NO: 89252 - RNA, 64 nt, Human
uucuauucauuauuuuacgccucagagcaaggcccucagggagggucauccuccauguuuugaa

SEQ ID NO: 89253 - RNA, 64 nt, Human
ccugagugaaggccgccugccggggacucagacacucagggaacaaaauggucagccagagcug

SEQ ID NO: 89254 - RNA, 64 nt, Human
gcuagaugagcccagauuucuucccccuccaucucucagggagacaaagaaccuccuuccugga

SEQ ID NO: 89255 - RNA, 64 nt, Human
ucccugcagcagcuggggccucuggucaggaacccucagggacccaggaacucagcuuccaaac

SEQ ID NO: 89256 - RNA, 64 nt, Human
cacccccaggcuucaaaccaccuggaaugcacagcucagggaagcugguggaugccuagaggcu

SEQ ID NO: 89257 - RNA, 64 nt, Human
gaaggacagggaacucuccauuauuggggcaggacucagggaggacacuuggggccaugugucu

SEQ ID NO: 89258 - RNA, 64 nt, Human
gcccaucugucagcagcgucuucuagguccccagcucagggagccauccccagcuccaguuuuc

SEQ ID NO: 89259 - RNA, 64 nt, Human
guccuuuucugaugguggcuggggcuggggugagcucagggaggggaagaggagaauacaugca

SEQ ID NO: 89260 - RNA, 64 nt, Human
gggugugaagauuaugagaguaaaguuuugaagacucagggauagcuguaaugcuuuuuucuuu

SEQ ID NO: 89261 - RNA, 64 nt, Human
ccacccugcacuggggggagggugggcagggauacucagggacagggcaucaugggggauuugg

SEQ ID NO: 89262 - RNA, 64 nt, Human
uucugagcaccaggggcagaggcggccagacaaccucagggaggaguguccuggcguccccauc

SEQ ID NO: 89263 - RNA, 64 nt, Human
gaugcagucccaggcauccuccugccccugggcucucagggacccccugggucggcuucugucc

SEQ ID NO: 89264 - RNA, 64 nt, Human
ugagucauuccaggaugaguggcucaaguauuuccucagggaaaauacuucugugcccccugau

SEQ ID NO: 89265 - RNA, 64 nt, Human
agagaggacaaugcauccuucagcgugguggagccucagggacagaucugaugaucccaggagg

SEQ ID NO: 89266 - RNA, 64 nt, Human
ugccugugacuccucuccuccccggccccuaccccucagggauaaugaguucauugcugggcua

SEQ ID NO: 89267 - RNA, 64 nt, Human
uggaggcauguuccccucaccaccccccgugggucucagggaggccgggugugaccucaucuuu

SEQ ID NO: 89268 - RNA, 64 nt, Human
acaucuuucuuauuaguuuacagugaaauguuaucucagggacauucaaacaaaggaggaggag

SEQ ID NO: 89269 - RNA, 64 nt, Human
acaucuuucuucuuaguuuacagugaaauauuaucucagggauauuuuuuuuuuuuuuuugaga

SEQ ID NO: 89270 - RNA, 64 nt, Human
gggauuacaggcgugagccaccgcgcccggccaucucagggauauuuaaacaaaggaagaggaa

SEQ ID NO: 89271 - RNA, 64 nt, Human
gcuaccagcugugugugucaaucacuccauuuugcucagggaaggcagacuucugugcuuucuu

SEQ ID NO: 89272 - RNA, 64 nt, Human
ccacagagugugcaucagucaccaccccaacaugcucagggaggcagaguucuuccauuaguug

SEQ ID NO: 89273 - RNA, 64 nt, Human
acugaugagaaacguucauaacaugaagguaagacucagggagacagagacuuuguggaaguau

SEQ ID NO: 89274 - RNA, 64 nt, Human
gaaccaucaucccgcuucucuccggccugagcaucucagggagaccaggggccgagccgcugag

SEQ ID NO: 89275 - RNA, 64 nt, Human
ggucugugauuugccgacagccuugcaggcugggcucagggacaaagucccccccaaaacccgc

SEQ ID NO: 89276 - RNA, 64 nt, Human
gagagugaggcugggcaggggucugcggcccuuucucagggacacacccugauagcacaaucuc

SEQ ID NO: 89277 - RNA, 64 nt, Human
ucuguccacggggucucuccuuccuccucccuagcucagggaugggccuuccagccggagcacc

SEQ ID NO: 89278 - RNA, 64 nt, Human
ggucgucuuagcagagccaccgccaagguuugcacucagggaggggcugauggagggcugggcg

SEQ ID NO: 89279 - RNA, 64 nt, Human
gaaggaggggagcaggcccguggcaggaggagggcucagggagcugagaucccgacaagcccgc

SEQ ID NO: 89280 - RNA, 64 nt, Human
auauuugguaaguuuuguacauauauuauguacacucagggaaccaauaccauaaucaugauaa

SEQ ID NO: 89281 - RNA, 64 nt, Human
gcucuccaaagaguguguccaccacuccacugugcucagggaaggcagaccucuccucucucuu

SEQ ID NO: 89282 - RNA, 64 nt, Human
gacagcugcaucucccaggcgggaugccgagcuccucagggacagcugagccccaaccgggccu

SEQ ID NO: 89283 - RNA, 64 nt, Human
cacguggcaagccaggcgaggcgggugcugaggucucagggaagcugguaacacuucccugucu

SEQ ID NO: 89284 - RNA, 64 nt, Human
cugcuaguucccacuccccugugaccacuggggccucagggaagauaaagaaagcugggccugu

SEQ ID NO: 89285 - RNA, 64 nt, Human
gcguccccaccgugaccugccuggccuccccugucucagggagcaggucacaggucaccauggg

SEQ ID NO: 89286 - RNA, 64 nt, Human
aggccgucucagcucccagcccuuccccccagcccucagggagcuccgcucagccccggcgggg

SEQ ID NO: 89287 - RNA, 64 nt, Human
cccaggaaaauaacagagcuggaugcugagagaccucagggauggcccagcugaucuaaggacc

SEQ ID NO: 89288 - RNA, 64 nt, Human
cagacacccagaguuggagacagaacaacagagucucagggaaagagaaccacaauagaaaaag

SEQ ID NO: 89289 - RNA, 64 nt, Human
gagagacagagacccaaagggagagaaacagagacucagggagagggagacaaugaccuggagg

SEQ ID NO: 89290 - RNA, 64 nt, Human
uugcccacgucccgacaacuuguucccugacccccucagggauggccccaaacugucccugccu

SEQ ID NO: 89291 - RNA, 64 nt, Human
cccagccccacauccacauucuguuagaauguagcucagggagcuucguggacggccuugcuug

SEQ ID NO: 89292 - RNA, 64 nt, Human
cccguccauaccagcucccugcccaugacccucgcucagggaucccccuuugagggguuagggu

SEQ ID NO: 89293 - RNA, 64 nt, Human
cggggggcagcggggggucucccuccggaccuaccucagggagcugagcgugcaggcgcuccag

SEQ ID NO: 89294 - RNA, 64 nt, Human
ccccugccucuguuagugguuaacacucuuuucccucagggagccuaaugagguuuuuaauauc

SEQ ID NO: 89295 - RNA, 64 nt, Human
ggccacuauagcagccaccagaagccgcgaggcccucagggaagcccaaggccugcagaagccu

SEQ ID NO: 89296 - RNA, 64 nt, Human
ucaaagucuccaguggaagcucauggacaagguucucagggaaguuuuggaguuugcaaccaca

SEQ ID NO: 89297 - RNA, 64 nt, Human
aguuaaaccucaucuuguacuaaaggaggacacacucagggagaagaccucugugggcagggcu

SEQ ID NO: 89298 - RNA, 64 nt, Human
gggcuggugauucccaccuucacccugucauggucucagggaacagccugcuucccaccagcag

SEQ ID NO: 89299 - RNA, 64 nt, Human
caaucccauuuuucaguucuccuaggaugcaccccucagggagccuggccagaguuccgaggcc

SEQ ID NO: 89300 - RNA, 64 nt, Human
ggcuucacucuucccacucacggaagggagguagcucagggaccuccacugugggacccuugag

SEQ ID NO: 89301 - RNA, 64 nt, Human
cucccuccggccauacugccuuugcaguuggacucucagggauucugggcuugggguguggggu

SEQ ID NO: 89302 - RNA, 64 nt, Human
uccuccucagccagcggcagaagcagggcugaugcucagggaccccccaacccucaaaccuugc

SEQ ID NO: 89303 - RNA, 64 nt, Human
agccuccugggcaccccagaggcaaggcugugcacucagggagggagggugggacacagaggug

SEQ ID NO: 89304 - RNA, 64 nt, Human
ucuagauggugguauuugcuaacaucauauccaacucagggaagcggacugagugcugggaucc

SEQ ID NO: 89305 - RNA, 64 nt, Human
aggccccuccaggccaggguccuggggcaggcaucucagggagcagccagcccaggccuccugc

SEQ ID NO: 89306 - RNA, 64 nt, Human
ucugcccugguggaagcggcagccacaaguccuccucagggagccccaagggggauuuuguggg

SEQ ID NO: 89307 - RNA, 64 nt, Human
gcccucucccagucccccuguggcuucugaaaaucucagggacagaugaggcugagccccuagu

SEQ ID NO: 89308 - RNA, 64 nt, Human
cacaccuagccugcuugcuuacugcuuauauuugcucagggaagaguaggaaaauaaaauauau

SEQ ID NO: 89309 - RNA, 64 nt, Human
cagaccuggugcugcaaaggaaagggccugaggccucagggagccccguggagggaugacaguu

SEQ ID NO: 89310 - RNA, 64 nt, Human
gugugagggugcucgcccguacucucagcugccucucagggacugcacuguuccucuucacccc

SEQ ID NO: 89311 - RNA, 64 nt, Human
uuucugugcuacccacuuguuagauuccagccaccucagggauucugauccaugucauuaacga

SEQ ID NO: 89312 - RNA, 64 nt, Human
cccuccccugacucccaccuugguagggugcugccucagggagccauagaagucggcuguguuu

SEQ ID NO: 89313 - RNA, 64 nt, Human
guuggggugaggccugggcagccggagggcagggcucagggagcaggaggcugcauccguccac

SEQ ID NO: 89314 - RNA, 64 nt, Human
ucaucacgggaggauaccugugugccggcagccccucagggacucucagcccuggcacuggcac

SEQ ID NO: 89315 - RNA, 64 nt, Human
gagagaggcagaggggcugugccgugcuagaguccucagggagggagugaccucgacccuggcu

SEQ ID NO: 89316 - RNA, 64 nt, Human
auuacauccucccauggaggaugagagacugaggcucagggagggcaaggaauaggcccaagau

SEQ ID NO: 89317 - RNA, 64 nt, Human
auggugguauggcugaacaaggagcggcagacaacucagggagaaacucaggagugcaguacca

SEQ ID NO: 89318 - RNA, 64 nt, Human
uuuggaugccagcccaggaugaguaguuccuguucucagggaggucauccgcugagcaucccuu

SEQ ID NO: 89319 - RNA, 64 nt, Human
ggggagggauccucugggugauggccucuuccuccucagggaccucugacugcucugggccaaa

SEQ ID NO: 89320 - RNA, 64 nt, Human
accacccccaucgagugcggagagagugggagugcucagggaaagaaggugauuuguauuuguc

SEQ ID NO: 89321 - RNA, 64 nt, Human
cacccaggcgccgccccugugcuugcuccccgagcucagggauugccgaguccacguaacugac

SEQ ID NO: 89322 - RNA, 64 nt, Human
aggaucuuccucaauacugcuccucucuucucagcucagggagaggaggggauccauucucuaa

SEQ ID NO: 89323 - RNA, 64 nt, Human
gagagggggcucacaagugaccgauccugggugccucagggagcucacugagggcgugcaaagu

SEQ ID NO: 89324 - RNA, 64 nt, Human
agugcccucacucccugcuccccgcacccggagccucagggaugggcucaggcugauggucagc

SEQ ID NO: 89325 - RNA, 64 nt, Human
agggcaagggaacagcagaacuuagggucagggucucagggaacccugagcuccaagcgugcug

SEQ ID NO: 89326 - RNA, 64 nt, Human
gccaaucagaucaacucugucuugggcguuugaacucagggagggaggcccuugggagcaggug

SEQ ID NO: 89327 - RNA, 64 nt, Human
acugcccccuccacuggaggggucuccucugcagcucagggacuggcacacuggccuccagaag

SEQ ID NO: 89328 - RNA, 64 nt, Human
uucuacucucugggccuuguuuucuccucugugacucagggauaggagucaucagccuggauga

SEQ ID NO: 89329 - RNA, 64 nt, Human
cucagcccuuuauggcccauggggaacuccguggcucagggagagcugaacuccagggguguga

SEQ ID NO: 89330 - RNA, 64 nt, Human
ggucaugucaugccccaaaguguggggacagagccucagggagccccgagcaugguccagcccc

SEQ ID NO: 89331 - RNA, 64 nt, Human
agaggaaggacagagggugggcgcagggcaccaacucagggacauccccucuccugggcgacgu

SEQ ID NO: 89332 - RNA, 64 nt, Human
uuuaggccuguaggccuuuccugugugccugcaucucagggagggucucucuccauguuguugc

SEQ ID NO: 89333 - RNA, 55 nt, Human
cugaggaagaugacaaguaacuccccucagggauacgacacaugcccaugaugag

SEQ ID NO: 89334 - RNA, 64 nt, Human
ccugagacaggccagcuuggauggccuccagcaacucagggauaacaugggcuccaggagggac

SEQ ID NO: 89335 - RNA, 64 nt, Human
gcacuggguagagcaccugguccacguggauugucucagggaagccuugaaaaccacggaggug

SEQ ID NO: 89336 - RNA, 64 nt, Human
ucagcgacccugaggaagaugacgaguaacuccccucagggauacgacacaugcccaugaugag

SEQ ID NO: 89337 - RNA, 64 nt, Human
cccaaaagcagcuccaacagaauggccagagggccucagggagcugcaaaacucauccaggaga

SEQ ID NO: 89338 - RNA, 64 nt, Human
ccauaccuuagagacuuugauacuaccagggucucucagggauggagggaagaccugaaagaga

SEQ ID NO: 89339 - RNA, 64 nt, Human
ccuguagcugucaguuugauuccugugaguagggcucagggauuuaucuuguuaccaauguguc

SEQ ID NO: 89340 - RNA, 64 nt, Human
cgcccuugccgaaccaggagcugcucacuaccuccucagggauggccguuggccacgucuuccu

SEQ ID NO: 89341 - RNA, 64 nt, Human
ggcacuggggaagucaagaauggggccuggggcucucagggagaacugcuuccccuggcagagc

SEQ ID NO: 89342 - RNA, 64 nt, Human
auuauauagcauaggauauuauuacuugaauguucucagggaggcagcaagucagaaggccuag

SEQ ID NO: 89343 - RNA, 64 nt, Human
uuccuucagggcauaagccaaaaugacucuuuuucucagggaccugcaugggccuccagcuugu

SEQ ID NO: 89344 - RNA, 64 nt, Human
uuugaugcgcaugcacauuggggaagaugcgcuccucagggacacaaaggccgagugggguaaa

SEQ ID NO: 89345 - RNA, 64 nt, Human
cugagagcuagccagaacugggguacagccugggcucagggaauagcugucaacacucgggcaa

SEQ ID NO: 89346 - RNA, 64 nt, Human
aucauucugucuacaugaacaaucaagaccaggacucagggaacuuuacucuguaacagaaaga

SEQ ID NO: 89347 - RNA, 64 nt, Human
uccaaacauuguaagaauugcuugguagcauaagcucagggauaaggugggaauugaguucaaa

SEQ ID NO: 89348 - RNA, 64 nt, Human
aauaauuuuuaaucugcagacccacgaaaagggucucagggacuccuccaggggucuucagacc

SEQ ID NO: 89349 - RNA, 64 nt, Human
ccuggcucuccagaaccuucuaucccacagucaggccccagagagggcaggacaagccuugucc

SEQ ID NO: 89350 - RNA, 64 nt, Human
gugcugggauuacaggugugagcuacugcgcccagccccagaaaucucagugcuguuuggagcu

SEQ ID NO: 89351 - RNA, 64 nt, Human
aggucggguguggacuguccucacugucaguggagccccagaagcuagauggguaccagguggg

SEQ ID NO: 89352 - RNA, 64 nt, Human
gggaagcaggaaccccaccgugugcccccugccagccccagagggaguggcgagcccagcugcc

SEQ ID NO: 89353 - RNA, 64 nt, Human
ucugccaguggauccccugcggucaggcugggcagccccagagagaggauguggaaagcacuuu

SEQ ID NO: 89354 - RNA, 64 nt, Human
cagcuccccacaaggacuucucugucuggagacagccccagacccuuuugugucccaugcccac

SEQ ID NO: 89355 - RNA, 64 nt, Human
agaaaaggcacucuagcaggugugguaggagcacgccccagaagguagaaugugguggggugug

SEQ ID NO: 89356 - RNA, 64 nt, Human
acugacuuuuucauuacguggguuuugaaaucuagccccagacauacuguguugagagauacuu

SEQ ID NO: 89357 - RNA, 64 nt, Human
aacagguaagaaaugaaauugaacuauugacugggccccagaaauccauaaaauggcugcagac

SEQ ID NO: 89358 - RNA, 64 nt, Human
gaaaccuuccaggauacuagcccgccagcugugggccccagaaagccagccugccuuuuagcac

SEQ ID NO: 89359 - RNA, 64 nt, Human
auccccgaacaggugaagggacaacugacuagcagccccagagcccucacccugcggaucccag

SEQ ID NO: 89360 - RNA, 64 nt, Human
uguccuuggguuacacuaccauuuauuggaacaagccccagaggcaguauuugauuuccucagg

SEQ ID NO: 89361 - RNA, 64 nt, Human
aggcagguggggucaccugaugagcuaagauccagccccagaauccuggaggagcaggagguag

SEQ ID NO: 89362 - RNA, 64 nt, Human
ccugccccaugucaacaaauuucaggcuaaggaugccccagacccagggcucuaaccuuguaug

SEQ ID NO: 89363 - RNA, 53 nt, Human
agacucagaugaucaagugaagagccccagauucccccuaagaagcaaaggau

SEQ ID NO: 89364 - RNA, 64 nt, Human
aaguuugggauuuuuuuuccuaaucauaaaaauagccccagaaagagccuaagcuauguucaga

SEQ ID NO: 89365 - RNA, 61 nt, Human
ugcugagggagccugagugaggagaccgccagccccagaagcagagggcagucaaggucaa

SEQ ID NO: 89366 - RNA, 64 nt, Human
gaacucugagucacccaugccagcaucagcuucagccccagacccugcaguuugagaucugaug

SEQ ID NO: 89367 - RNA, 64 nt, Human
cucaugauuaggauuagugcccuuauuuaaaaaggccccagagagcuaacucacccuuccacca

SEQ ID NO: 89368 - RNA, 64 nt, Human
gcugaagcuuuugcagcacuuuaccucucugaaagccccagaggaccagagcccccagccuuac

SEQ ID NO: 89369 - RNA, 64 nt, Human
uuuguauugcaaacugugaaucaaaggcuucacagccccagaggauuccauauaaaagacauug

SEQ ID NO: 89370 - RNA, 64 nt, Human
accuaagacuauguugguacuuggacuuguucgugccccagagaugggcaaagcugugcacuug

SEQ ID NO: 89371 - RNA, 64 nt, Human
cugccugcagucagcucggccuccccgaccugcagccccagacucugcucucccagcacugacu

SEQ ID NO: 89372 - RNA, 64 nt, Human
ccacaguucuggguuaucuccucucauacaucaagccccagaggaggcggcaagaggaacagcc

SEQ ID NO: 89373 - RNA, 64 nt, Human; identical to SEQ ID NO: 84755

SEQ ID NO: 89374 - RNA, 64 nt, Human
uguucacacuuaagggaaguuuauaaagcuacuggccccagaugcucaggguaaggagcaccaa

SEQ ID NO: 89375 - RNA, 64 nt, Human
ggccugcagugauucagcaggcccuucccauucugccccagagugggucuuggaccagggcaag

SEQ ID NO: 89376 - RNA, 64 nt, Human
ugugagguguuugacuaaacuguuucucugacucgccccagaggucguggcucaaaggcacuua

SEQ ID NO: 89377 - RNA, 64 nt, Human
guaaagauuuaaauagguccugagacuguugauagccccagacauacccacagcauuauaugua

SEQ ID NO: 89378 - RNA, 64 nt, Human
ggccccaggcccaauggcagagcuagugccucgggccccagaguccccacgaguuccuuccccu

SEQ ID NO: 89379 - RNA, 64 nt, Human
cugcuggcucucgcccaccaaccaaguguuacaagccccagaaugcugcccggccugcccugcu

SEQ ID NO: 89380 - RNA, 64 nt, Human
gucagaggcuaagaugagauuugccagcacaggggccccagaucugccugggccugugcagcag

SEQ ID NO: 89381 - RNA, 64 nt, Human
acuguuggcuuucccccagccgcacgggucccaggccccagagaagaugagucuauggcaucag

SEQ ID NO: 89382 - RNA, 64 nt, Human
uucauacuccuucagucacuaucccagacagugagccccagaucuccuagcucuggcuucugug

SEQ ID NO: 89383 - RNA, 64 nt, Human
aguccaaauaagcugaaagugcagcucgcugcaggccccagagcgagcuuccccuccucccugc

SEQ ID NO: 89384 - RNA, 53 nt, Human
gggcugauucccaagugugagucgccccagaucaccagcccggccugcuccca

SEQ ID NO: 89385 - RNA, 64 nt, Human
ugggaucucaggagggcagccacggaguggggaggccccagaugcgcugugccaaagccagguc

SEQ ID NO: 89386 - RNA, 64 nt, Human
guuaacuacacagaggcacauccugacaggguuugccccagagaucuaaauuccagaaggaggg

SEQ ID NO: 89387 - RNA, 64 nt, Human
gguuugucuuuauccacccccacuguuguggucagccccagagaauuuuaucuucuuccuuggc

SEQ ID NO: 89388 - RNA, 64 nt, Human
cuguauaguguacaugguaaugauuuauugcuaugccccagauccuuaauguaguucucauccu

SEQ ID NO: 89389 - RNA, 64 nt, Human
uucccagucgcucccagcccaccucugccuccaagccccagaugguucuggaggcugcgagagc

SEQ ID NO: 89390 - RNA, 64 nt, Human
gguauucauuaaaaagcauaaaagucuuccucuugccccagaaguaauucucuauaccaagaua

SEQ ID NO: 89391 - RNA, 64 nt, Human
caguccaaacaccacggagcauuuggcaaucaaggccccagagucuccguggucagauccuccu

SEQ ID NO: 89392 - RNA, 64 nt, Human
cccucucccuggggauaugcaacccuuagagauugccccagagccccacucccggccaggcggg

SEQ ID NO: 89393 - RNA, 64 nt, Human
ggagaagcagcauugaagugggaagauuuaggcugccccagaccauaucuacuggccuuuguuu

SEQ ID NO: 89394 - RNA, 64 nt, Human
uagauauauauuuuagcagugacauucccagagagccccagagcucucaagcuccuuucuguca

SEQ ID NO: 89395 - RNA, 64 nt, Human
uucaacacuggccacuccucugcuuccucuguuggccccagauggacaguaaggggaaccucca

SEQ ID NO: 89396 - RNA, 64 nt, Human
gugcugggauuacaggcgugagccaccaugccccgccccagauggauuuuacauuugcucuuuu

SEQ ID NO: 89397 - RNA, 64 nt, Human
ggacaggaagccuugcgagaagggacguaccuaugccccagaaggcaagagaggaagacuauuu

SEQ ID NO: 89398 - RNA, 64 nt, Human
agucucagauggaaggacaagugauggggaucaggccccagagcuugcuguccccugagacccc

SEQ ID NO: 89399 - RNA, 57 nt, Human
acccgcugagcacagcaugaggccagggccccagaacacagugccuggcaaggccuc

SEQ ID NO: 89400 - RNA, 64 nt, Human
cuuuauguaucucauacgcugugauguggauggggccccagauggaagguuugaaacuggauuc

SEQ ID NO: 89401 - RNA, 64 nt, Human
uggcauucacucuuacagaugguguucacugcaagccccagaagcauauggcauguguucacua

SEQ ID NO: 89402 - RNA, 64 nt, Human
auuuuuuaaacuagaucccuucauuauucuuuaugccccagaguaaaucccagauggaucaaag

SEQ ID NO: 89403 - RNA, 64 nt, Human
agugcugggauuacaggcgugagccaccgugccugccccagaaugguuuuuaaagccacaguug

SEQ ID NO: 89404 - RNA, 64 nt, Human
uuucccacauuccaaaagggggccugggaugcuagccccagagaugccagcccuucaggaagca

SEQ ID NO: 89405 - RNA, 64 nt, Human
cuucauuguccagaaauaccuccucccgcugacugccccagagccugaaagucucacccuugga

SEQ ID NO: 89406 - RNA, 64 nt, Human
guucucgggauuagaaggacaagagcacucccaggccccagagucuaagccuaagucucuaucg

SEQ ID NO: 89407 - RNA, 64 nt, Human
gaggcuuaagggucccaggaguacugcagggacagccccagagaggcccaacucuggccccuuu

SEQ ID NO: 89408 - RNA, 64 nt, Human
ccccucuucccgaggcccugcugccauguuguaugccccagaagguaccuuggucccccggaag

SEQ ID NO: 89409 - RNA, 64 nt, Human
auaaggcgcugggagaggaugggcagcucccacugccccagagcggagcucgaagcacccaggu

SEQ ID NO: 89410 - RNA, 64 nt, Human
ggcggaacccaggcguuuaacggcucacuaggcagccccagaucuggggaacagaugagcacgu

SEQ ID NO: 89411 - RNA, 64 nt, Human
aggaauggccugacuccugcagugcagauuggaggccccagaacuccuaugaacuacugagagu

SEQ ID NO: 89412 - RNA, 64 nt, Human
ggagucaguaaaauuccacuccccaaguggcccugccccagacaaagguugcuuucccccuuuu

SEQ ID NO: 89413 - RNA, 64 nt, Human
uuccucccagagcucagcccaugucacccuccaggccccagaauccagaguggccucauuuccu

SEQ ID NO: 89414 - RNA, 64 nt, Human
aagaaaguuccugcuuuaguguuuuguucccucugccccagagagcuccccuuagugaucucag

SEQ ID NO: 89415 - RNA, 64 nt, Human
agggcgaguggcaugucugccugagcaggguguggccccagaaagcugaggagugugggcuggc

SEQ ID NO: 89416 - RNA, 64 nt, Human
ugaccucaggcacuagccuuuggcucuggagacagccccagagcaggguguugggauacugcag

SEQ ID NO: 89417 - RNA, 64 nt, Human
ucuuauuaaggaaauacuuugcauaaauuaaucagccccagagugcuuuaaaaaauucucuuaa

SEQ ID NO: 89418 - RNA, 64 nt, Human
gguugcaaaacaaaauguugguugcuguuugucagccccagaauuucuucuuaaguucgccugu

SEQ ID NO: 89419 - RNA, 64 nt, Human
ggucucggaccagaccccccuccacagcugcccggccccagacccaucucuuggauugagggug

SEQ ID NO: 89420 - RNA, 64 nt, Human
gugggauuugaugccaggcaguggaguggccucagccccagauuguaccuccugcccuguagga

SEQ ID NO: 89421 - RNA, 64 nt, Human
cugcaucgguucgcauuaucaaacccuuuccugcgccccagacuccaggccgccugcagccugc

SEQ ID NO: 89422 - RNA, 64 nt, Human
cccugcccucaccccacugccaggccgaggcucagccccagacucucagcaucugcugcccuga

SEQ ID NO: 89423 - RNA, 64 nt, Human
uugcccugugcaguaaacuuucaaggugucggcugccccagauugcuucauuugcugggugugg

SEQ ID NO: 89424 - RNA, 64 nt, Human
cgacugagcaacaggaggacucagccugggacaggccccagagagucacacaaaggaaucuuua

SEQ ID NO: 89425 - RNA, 64 nt, Human
gcucaguggcucaugcuguccugugagagccccugccccagagcggccccacuaagcgcaugug

SEQ ID NO: 89426 - RNA, 58 nt, Human
uccggagaguccagcacuaggcuccacggccccagacaccuucccugaggacacucaa

SEQ ID NO: 89427 - RNA, 64 nt, Human
cacugucucgcagcaccagcucugcagagcccuugccccagacucuuugcgguuuuauuuauau

SEQ ID NO: 89428 - RNA, 64 nt, Human
agaaaaaaaaaagaaaugcaaaacuuuaggcccugccccagauuuacuaaaucaaucugcaguu

SEQ ID NO: 89429 - RNA, 64 nt, Human
ccuccccuuggucaugggauuugcugcccucuuugccccagagcugaagagcuauaggcacugg

SEQ ID NO: 89430 - RNA, 64 nt, Human
cugcccagauuuacugaccccauuugucgacauggccccagacaggagggauccacuucucugu

SEQ ID NO: 89431 - RNA, 64 nt, Human
aggccccgacgaggagggguaugcaggcuggcaggccccagagcugguggagggcaucucacuc

SEQ ID NO: 89432 - RNA, 64 nt, Human
ccauugacaacugcucguguacaggcaccccacagccccagagcauggggcacagcaggcaugc

SEQ ID NO: 89433 - RNA, 64 nt, Human
agagccccaccgcagcccaguagggaugcagcacgccccagagggcucaugugggccccagaug

SEQ ID NO: 89434 - RNA, 64 nt, Human
uagggaugcagcacgccccagagggcucaugugggccccagauggcaaugccaccauuguugau

SEQ ID NO: 89435 - RNA, 64 nt, Human
ugggcucaugccuccaagucagaguuucccuggugccccagagacaggagcacaagugggaucu

SEQ ID NO: 89436 - RNA, 64 nt, Human
aggcuggacgacuucacccccaaaggguccugaagccccagaacuggcauguggaaggggcuga

SEQ ID NO: 89437 - RNA, 64 nt, Human
aaagacuccgcuuccguuuuccugagcuccucgggccccagagucucuguuugauuauuuauuu

SEQ ID NO: 89438 - RNA, 64 nt, Human
ccaggacugguuuuccaguacaucuuuaaacaaggccccagagacucuaugucugcccguccau

SEQ ID NO: 89439 - RNA, 64 nt, Human
gagagguuucuuggggucccagggaagaggaaucgccccagacuccuuuccucugaggaagaag

SEQ ID NO: 89440 - RNA, 64 nt, Human
ugcgcggccgaggccggagcaccacauccaccucgccccagagaggcucugcucccuccuaugg

SEQ ID NO: 89441 - RNA, 64 nt, Human
uaacuggaaaucaucacagcagugggauaucagagccccagacagcacugccucuuccucccca

SEQ ID NO: 89442 - RNA, 64 nt, Human
gagaacaucagugacuuuaacuucugcagaguuugccccagaauucagaguucuauuuagagga

SEQ ID NO: 89443 - RNA, 64 nt, Human
ggcauggccucccugaugaucaccaccaaggguagccccagaggggagcuccgagggcagguag

SEQ ID NO: 89444 - RNA, 64 nt, Human
augcuguucccgcugcacggcccaccggcggccagccccagagaccagaacugauccagagcug

SEQ ID NO: 89445 - RNA, 64 nt, Human
acacacagauggcagacgucuccccacucauccagccccagaucugagccuugacgcaggccaa

SEQ ID NO: 89446 - RNA, 64 nt, Human
gcggccacuuucauggcagcucaucaggcgcagggccccagacagcuucccagcaggcccuaga

SEQ ID NO: 89447 - RNA, 64 nt, Human
gagggcaaagggccuaccucggggcgcgaaccaugccccagacuauuaucucagggcuuucugg

SEQ ID NO: 89448 - RNA, 64 nt, Human
acuugcuugcucugugccccaugaggcagcaccugccccagauggacggggcugugaggggugu

SEQ ID NO: 89449 - RNA, 64 nt, Human; identical to SEQ ID NO: 84759

SEQ ID NO: 89450 - RNA, 64 nt, Human
aacacagugcuauucaugaagguggguucaccaugccccagacgccagaaggucagccguugau

SEQ ID NO: 89451 - RNA, 64 nt, Human
aaccuuuaaauaaauuguuuugaguguuuuuugagccccagacaaauaauguuuuaaaguuauc

SEQ ID NO: 89452 - RNA, 64 nt, Human
ggugcuccauggaggcaacaagucauuccaugaagccccagagguagaagggaccucaagcacc

SEQ ID NO: 89453 - RNA, 64 nt, Human
cagccaguuuuaaccccagccugucaccgugagcgccccagaagagcgcggcgccccuagccau

SEQ ID NO: 89454 - RNA, 64 nt, Human
aggacgugccccuucaguagagucggggaucccagccccagagcgggggagggcgccucccuau

SEQ ID NO: 89455 - RNA, 64 nt, Human
aaaugaugccuuugucugugggaaggcaaaugaugccccagagcucuaaccaaagguuuugcag

SEQ ID NO: 89456 - RNA, 64 nt, Human
accuguggcugacacacccagcccuggaaacggggccccagacgccacgucgggauuucugaca

SEQ ID NO: 89457 - RNA, 64 nt, Human
gccagacaccaccccccaccccacugucgugguggccccagaucucuguaauuuuauguagagu

SEQ ID NO: 89458 - RNA, 64 nt, Human
cugcaccaccccaagagccacgccccucgcuggcgccccagagccguggugcuugccaagggcu

SEQ ID NO: 89459 - RNA, 64 nt, Human
cacugaggccccuacugaggccagccccgagccagccccagacccagccccgguggcugaagag

SEQ ID NO: 89460 - RNA, 64 nt, Human
ggagaggaaguuguagcgccuagcgagaguuccagccccagacgcccaccugugccucagggca

SEQ ID NO: 89461 - RNA, 64 nt, Human
gaaaccacaacaaaaugaauucuauuaaagaauagccccagauauaaauucucuugaaagcaau

SEQ ID NO: 89462 - RNA, 55 nt, Human
ccgaaugcacggccuuguaggggacgccccagauugucagggauggggggauggu

SEQ ID NO: 89463 - RNA, 64 nt, Human
cuaaacucucuaaguguggacggagaaugagcaagccccagaaguauuuuacaaccagaguggg

SEQ ID NO: 89464 - RNA, 64 nt, Human
gaaugaagcuagagugggaaggacuaaagacugagccccagagugcucccagcaaccgccacgu

SEQ ID NO: 89465 - RNA, 64 nt, Human
cugugguuaugcagaagcagagaugaggaggcuggccccagagaugaucuugcccuuccuaacu

SEQ ID NO: 89466 - RNA, 64 nt, Human
uguaaccaucaagaaaccucuacaggguacuuaagccccagaagauuuugcuaccagggcucuu

SEQ ID NO: 89467 - RNA, 64 nt, Human
auacaaauagauuuuuguuuuuguuguuccugcagccccagaagaaauuagggguuaaagcaga

SEQ ID NO: 89468 - RNA, 64 nt, Human
cagcccaugcacguggaggaggagcuggcuuucagccccagaccccacgcuagcacuuuccacg

SEQ ID NO: 89469 - RNA, 64 nt, Human
uuuuuguuuuuuuuuuuuuuguauguuggaacgugccccagaaugaggcaguuggcaaacuucu

SEQ ID NO: 89470 - RNA, 64 nt, Human
gacaagauaaacggagcugguggcgggagggacagccccagagcagacccuuccuauggcggcc

SEQ ID NO: 89471 - RNA, 64 nt, Human
cugggggacccaaagggucuggccucuuugggcagccccagagaugaggggucagcagaggaga

SEQ ID NO: 89472 - RNA, 64 nt, Human
cuuuauuaaauuaugcaugcuaagauuuaaaggagccccagauaaacaugauggggaaaagcac

SEQ ID NO: 89473 - RNA, 64 nt, Human
gcagugugcaugcaacacacuuaggggaggaguggccccagaauucagcacgcacacaacacac

SEQ ID NO: 89474 - RNA, 64 nt, Human
cggccaugcacgcacacacugggccugggccagggccccagagcuccugccugagcuggaccuu

SEQ ID NO: 89475 - RNA, 64 nt, Human
uuccuguacuaacuggggcagaacucagacgggugccccagagggggcuggggggcggccaggc

SEQ ID NO: 89476 - RNA, 64 nt, Human
uuguccauaaagagguugcuucuauauacuagaggccccagauggccaggccuugggcuacguc

SEQ ID NO: 89477 - RNA, 64 nt, Human
cuccugccugacugccaagccaccugcaucccccgccccagaucucaugagaucaaucacuugu

SEQ ID NO: 89478 - RNA, 64 nt, Human
agccugaagccuccacugaggauuaagagcaacagccccagagccugggcucugcuggacuuag

SEQ ID NO: 89479 - RNA, 64 nt, Human
aacaaggacuccgaggagcaccaccaggccucgggccccagaggucccacuccucagccuacac

SEQ ID NO: 89480 - RNA, 64 nt, Human
uuugucaccugaaccuaauguauauucuccuugagccccagaucccuucaagcuggaagggaug

SEQ ID NO: 89481 - RNA, 64 nt, Human
ccccgacaguggcucuccaagcggcccccgggcagccccagagcaccccgcccgacucccauua

SEQ ID NO: 89482 - RNA, 64 nt, Human
ucagucuguccauccucggcaaggacacaacacugccccagagggugggaccacugcaagcucg

SEQ ID NO: 89483 - RNA, 64 nt, Human
cccauccacaaccuaaagaucucuguguucauacgccccagauaugugaguuacaugagauggc

SEQ ID NO: 89484 - RNA, 64 nt, Human
guccuaaaggaaggacaggagccuuauaggcaaugccccagacugacuugugagugggguuuau

SEQ ID NO: 89485 - RNA, 64 nt, Human
aagagagaaagaaguaggcaugagggaucacagggccccagaaggcagggaaaggcucugaaag

SEQ ID NO: 89486 - RNA, 64 nt, Human
uugggaccacucucucaguccccagguccucagggccccagagcgggagggucuccuaccugga

SEQ ID NO: 89487 - RNA, 64 nt, Human; identical to SEQ ID NO: 84763

SEQ ID NO: 89488 - RNA, 64 nt, Human
auggaaccugguucacccuucauaccagcuccaagccccagaccaugggagcugucugggaugu

SEQ ID NO: 89489 - RNA, 64 nt, Human
acugagggggcagaugcaggaaacaccuagagcagccccagagucacggggcugagggggcggg

SEQ ID NO: 89490 - RNA, 64 nt, Human
cauggauagaguguguuuguuuuuugccaaaaaugccccagacuuuuucccaaaccucaaaaac

SEQ ID NO: 89491 - RNA, 64 nt, Human
uuuuuuauuuuuuucugauaaaauacaaauguuggccccagauucuuuuaacgucaaggaaaug

SEQ ID NO: 89492 - RNA, 64 nt, Human
acaugcucuuggcaccaauccuagacucacgugugccccagaauaacauucagacucucagcug

SEQ ID NO: 89493 - RNA, 64 nt, Human
ugcgugcauaaccagcugccacccucaggccugggccccagagcucagggcacccagugucuua

SEQ ID NO: 89494 - RNA, 64 nt, Human
ggccugggagaggccaggugaaugggaggccagggccccagacuccccgaaguuggccugcccg

SEQ ID NO: 89495 - RNA, 64 nt, Human
cguguuggccccagccacguuuacaggaaggugugccccagaggaggaggaaucagcucccucg

SEQ ID NO: 89496 - RNA, 64 nt, Human
gcagugcgagggcgcagccauuggugguugcagggccccagagggcuggggugaccuggcaucc

SEQ ID NO: 89497 - RNA, 64 nt, Human
gccucagcugaaccugaaguuauccuaagcucgagccccagagugaggacucggggucaggcau

SEQ ID NO: 89498 - RNA, 64 nt, Human
cacccaccggacccucgcacgccgugccaggccugccccagacgcgucugcaggccgcuugccc

SEQ ID NO: 89499 - RNA, 64 nt, Human
uuggcaacaacccaagugagccugaagcagauucgccccagagccuccaggcgugaguggagcc

SEQ ID NO: 89500 - RNA, 64 nt, Human
ucugggaguaagaucccugaaggggcugcugacugccccagaaucugccgaggugagaacagca

SEQ ID NO: 89501 - RNA, 64 nt, Human
cuggucccagcaguaugugugcugacuucugggugccccagaaauagaccucuccuguagagug

SEQ ID NO: 89502 - RNA, 64 nt, Human
agaagagauaguaaugcucaggacaggagcggcagccccagaacaggccacucauuuagaauuc

SEQ ID NO: 89503 - RNA, 64 nt, Human
cuccuuccaaguaugugacguaguccugaaccacgccccagacuuccgccgggucuaccugccu

SEQ ID NO: 89504 - RNA, 64 nt, Human
gagcugaagaacaagcugcucauggcaagggcuggccccagaacccugcaagagaggccuucug

SEQ ID NO: 89505 - RNA, 64 nt, Human
gacacucugacuaccucccacugaggcggcuccagccccagacaacagcccaggcaucuccuug

SEQ ID NO: 89506 - RNA, 64 nt, Human; identical to SEQ ID NO: 84767

SEQ ID NO: 89507 - RNA, 64 nt, Human
augcccuuccuucccuugggcaggaaagccagcagccccagacugcccaaaaacuugcccacca

SEQ ID NO: 89508 - RNA, 64 nt, Human
uaaggauuucuacuuuggucuucaagaaagcugugccccagaacaccagagauuucaacuuagu

SEQ ID NO: 89509 - RNA, 64 nt, Human
uaaggacuucugguuugcucuucaagaaagcugugccccagaacaccagagaccucaaauuacu

SEQ ID NO: 89510 - RNA, 64 nt, Human
ccugggcuuggauucccagagaggaaaccuuggggccccagauguguccuccugaucucccuga

SEQ ID NO: 89511 - RNA, 64 nt, Human
ccugccaggcccggccacugagcagccccccggagccccagauccccguuccccccagguggcc

SEQ ID NO: 89512 - RNA, 64 nt, Human
uauuuauuucagggcugggcuauaacacagacgagccccagacucugcccauccccaccccacc

SEQ ID NO: 89513 - RNA, 64 nt, Human
ugagaaaauccuauuaucaaauuuggauuuccuggccccagaacuucccaaagaccuguaaaau

SEQ ID NO: 89514 - RNA, 64 nt, Human
gggugaagggaccuaagcuggccaauagcccucugccccagacaugggauguggauccuugagg

SEQ ID NO: 89515 - RNA, 64 nt, Human
agaaaaauaucaacagaacucuagccaaaggcaagccccagaacucagacaacagaaaggaaau

SEQ ID NO: 89516 - RNA, 64 nt, Human
gcuggcuccuccaggcacgucccggaccuguggggccccagagaggggacauuucccuccuggg

SEQ ID NO: 89517 - RNA, 64 nt, Human
gagaaugguggcagaaugagugagcaagcagauugccccagaggggccgguaauaaucacguga

SEQ ID NO: 89518 - RNA, 64 nt, Human
accagggcggugggagacuccuguccacaccucugccccagagcugccuccugccuggcacugc

SEQ ID NO: 89519 - RNA, 64 nt, Human
cuacaagugcagcugugaccccggguacgagcuggccccagacaagcgccgcugugagggugag

SEQ ID NO: 89520 - RNA, 64 nt, Human
cacagaaugccggaggggcgcagagcagauccaggccccagaaagccucaccuacagacagcug

SEQ ID NO: 89521 - RNA, 64 nt, Human
gcguccaggugaucccccaaacagcaugugcucagccccagaccugccgccugggaaucaggau

SEQ ID NO: 89522 - RNA, 64 nt, Human
gucaugcccuaaagcuaguccuguaaacaauggugccccagaaagcugcaggugguguuuggag

SEQ ID NO: 89523 - RNA, 64 nt, Human
ucuccauuccuuuuuaauacauucguauuucccagccccagaacccuugaaauuaacucuucca

SEQ ID NO: 89524 - RNA, 64 nt, Human
aggguauccuugggcccaaugaauuaggggugaggccccagaacccguuaucuaugaguuguau

SEQ ID NO: 89525 - RNA, 64 nt, Human; identical to SEQ ID NO: 84771

SEQ ID NO: 89526 - RNA, 64 nt, Human
ucccuuuugccuuuuccuaguuaagcccacuccagccccagauaaccacuuucuauccucauag

SEQ ID NO: 89527 - RNA, 64 nt, Human
cuucuaggacaccugugcagggucccagacccaggccccagagcagcccaggccaugacccugc

SEQ ID NO: 89528 - RNA, 64 nt, Human
ucccaccgcucagggcagggaggucugaacugcggccccagagccuuuggccuaagcuggacuc

SEQ ID NO: 89529 - RNA, 64 nt, Human
cugggacaaggauaaaggaauaugauuuuccagagccccagagccagcucaucuuccaggugcu

SEQ ID NO: 89530 - RNA, 64 nt, Human
agcagaagccuccaagcacagagccuggccccaggccccagacagggugggcuuccugcccuuc

SEQ ID NO: 89531 - RNA, 64 nt, Human
ggcagaugucuucccugggcugccaccagcccccgccccagaguggcccaccguggcacuagaa

SEQ ID NO: 89532 - RNA, 64 nt, Human
agccugggaggaucagucuguccaggucagcgaggccccagauaccagagcaucaagaguacag

SEQ ID NO: 89533 - RNA, 64 nt, Human
uggagggcccugggcucuggcagaugguccuggugccccagacgggggccgagggccugagccc

SEQ ID NO: 89534 - RNA, 63 nt, Human
ccaccucucccagcuguuagagccgcccugggggccccagaaccagagcuggcucccagcaag

SEQ ID NO: 89535 - RNA, 64 nt, Human
ucagugcuucgugccucgauugaaggugaccucugccccagauagguggugccaguggcuuauu

SEQ ID NO: 89536 - RNA, 64 nt, Human
cauugucugucucccacccucacugaucacgccugccccagagcaguguguggcggugacaccg

SEQ ID NO: 89537 - RNA, 64 nt, Human
cagcaacuuccuucugcccuagagcaagccaugagccccagagcaguagcaggagacuugagaa

SEQ ID NO: 89538 - RNA, 64 nt, Human
guucaaauuccccaaaaaggcuuguccaaggcuggccccagaugugugggucugacccacacca

SEQ ID NO: 89539 - RNA, 64 nt, Human
cuucaaggaagacagagugagccaaugcucaccagccccagagucagagcuggccacaggcugg

SEQ ID NO: 89540 - RNA, 64 nt, Human
uacagaaaaggaaucagagaaucuacaacauagggccccagaacaacaguuucacuuuguggcu

SEQ ID NO: 89541 - RNA, 64 nt, Human
gcccuuuucaggaagcucucuuaaaauacccauugccccagaccuggaagauauaacauucagu

SEQ ID NO: 89542 - RNA, 64 nt, Human
gccggcggaugcuggauccggagccccagguuccgccccagagcgguccuggacaaggccagac

SEQ ID NO: 89543 - RNA, 64 nt, Human
gguagcauccaucugguggccaaagagaaucguagccccagagcugcccaaguucacugggcuc

SEQ ID NO: 89544 - RNA, 64 nt, Human; identical to SEQ ID NO: 84774

SEQ ID NO: 89545 - RNA, 64 nt, Human
uagcaccugccccaggauuccugcccucggcuuugccccagacccuuauuccagaugcugagag

SEQ ID NO: 89546 - RNA, 64 nt, Human
augccaggacccgccagccccgcucccaccuagugccccagacugagcucuccaggccaggugg

SEQ ID NO: 89547 - RNA, 64 nt, Human
aguggcuaguggggugaacagcuggugccaaauagccccagacugggcccaggcaggucugcaa

SEQ ID NO: 89548 - RNA, 64 nt, Human
ccugccacccagggcaggggaucuucugccggcugccccagaggacaguggguggagugguacc

SEQ ID NO: 89549 - RNA, 64 nt, Human
cugcugcucgggaaggccugagggaagcccacccgccccagagacugcccacccugggccuccc

SEQ ID NO: 89550 - RNA, 64 nt, Human
gggggaugggaggguuggauugaacagccagagggccccagaguuccuuguaucuaauuucauc

SEQ ID NO: 89551 - RNA, 64 nt, Human
aaguacucccaggaaacagacgcgugaaaacugagccccagaagaggcacacuugacggcacag

SEQ ID NO: 89552 - RNA, 64 nt, Human
aaguaggaggauccacaggauuugagaugcuaaggccccagagaucguuugauccaacccucuu

SEQ ID NO: 89553 - RNA, 64 nt, Human
guaaagugguaugaucuggggcuucuccacuccugccccagaguguggaggccacaguggggcc

SEQ ID NO: 89554 - RNA, 64 nt, Human
ugcuauucuguagaaauuuaugaagaauguuauugccccagaauauggggugagagagaacugc

SEQ ID NO: 89555 - RNA, 64 nt, Human
gucaucgaugauggcucaggcucagccugggcacgccccagaggagagagauggaguggggccu

SEQ ID NO: 89556 - RNA, 64 nt, Human
agcuaccugguucguguaaauaagaauaaucaaggccccagaguguguaugcuuccagguggag

SEQ ID NO: 89557 - RNA, 64 nt, Human
uugcacacuggggugaugggugggggcggugacugccccagacuugguuuuguaaugauuugua

SEQ ID NO: 89558 - RNA, 64 nt, Human
ccuccaccaaggcagcuuuccuuacccugacacagccccagaccccacaaagccuucuggaccu

SEQ ID NO: 89559 - RNA, 64 nt, Human
aagaaguuucugggagaugcccgcagcugugcgugccccagacacaaaggcuggccugugugua

SEQ ID NO: 89560 - RNA, 64 nt, Human
cagccugcccucccugccggagccggcucugccagccccagauugggaagucuccccgcuggag

SEQ ID NO: 89561 - RNA, 64 nt, Human
uaggugaccccuggggccucagaccucugagugggccccagagcccagcugaggaagccacaca

SEQ ID NO: 89562 - RNA, 64 nt, Human
ggcaugggggggaggggggcguguuucugggccugccccagacacugcccuuggcugccagccu

SEQ ID NO: 89563 - RNA, 64 nt, Human
ccuuaggaguucuugcuucuugcguugauacuuugccccagaaaggccugggauucauucuggu

SEQ ID NO: 89564 - RNA, 64 nt, Human
gucauuaguuugugaagcaccuggucagcaaccugccccagaccuggagggucuuuguggacug

SEQ ID NO: 89565 - RNA, 64 nt, Human
augaggaaacagacagcggacugaggaagcgauggccccagagaaagggccccuguagccuggc

SEQ ID NO: 89566 - RNA, 64 nt, Human
gggaggucauuacagccucauggccucuaccaaggccccagaucacaggaucuccugggccuug

SEQ ID NO: 89567 - RNA, 64 nt, Human
ugaaaccugagacaagugcaauuccuuccaugucgccccagagugcccaggaggcaggcagugc

SEQ ID NO: 89568 - RNA, 64 nt, Human
gccacaaaugaagagaaaagccaugcccaccccagccccagagaaaccaauaagaauccucuau

SEQ ID NO: 89569 - RNA, 64 nt, Human
acaaauucagaacgugccucuuuccagaucgcuggccccagaacccugucccccacacccaggg

SEQ ID NO: 89570 - RNA, 64 nt, Human
ugcaucuuuguuugcaucuccagagacaccugaggccccagagcuugaggcaaagccaggccgu

SEQ ID NO: 89571 - RNA, 64 nt, Human
ccuucuccucaucuguggagcaagccaacucagugccccagaccccaccugaucugcaucuuug

SEQ ID NO: 89572 - RNA, 64 nt, Human
ccuagaccacccuccaugucagguacugagcaaggccccagauccuucucucuggaggaagagg

SEQ ID NO: 89573 - RNA, 64 nt, Human
caaacacugguuccccacugcccugugccuuccggccccagaaggaucuuccuggaugccaacg

SEQ ID NO: 89574 - RNA, 64 nt, Human
caggcuuugcagaagaccuugucuccuuagaaaugccccagaaauuuuccacacccuccucggu

SEQ ID NO: 89575 - RNA, 64 nt, Human
ugaaagucauuaacaaagccagccgugaaaaggugccccagaguugcuguggacagaccuguaa

SEQ ID NO: 89576 - RNA, 64 nt, Human
cgccuccaagaccagcaggccaaggccaagcccugccccagauccucauaggcagagaagcccu

SEQ ID NO: 89577 - RNA, 64 nt, Human
uucuggggccacaccccaaaacucuacacccucugccccagaacaauucugcagaguggugaag

SEQ ID NO: 89578 - RNA, 64 nt, Human
aucaagccaaaccugcugccacagcccucccccggccccagauagcagccccagggaggaugcu

SEQ ID NO: 89579 - RNA, 64 nt, Human
cccaaccaaggagcuggggcccaaggccaguccugccccagagacacuccaaguccgccagggg

SEQ ID NO: 89580 - RNA, 64 nt, Human
ucccucauaggccccaccuccacgucccggcugggccccagaccccagcuuccugcccuccacc

SEQ ID NO: 89581 - RNA, 64 nt, Human
ucccagagcugagggcuugccucuggagaccccagccccagagggcuuuguggaggacaggccu

SEQ ID NO: 89582 - RNA, 64 nt, Human
aggccacuuucaacucuuaugggguucuccaccugccccagagcuucucaagggaggguaaggg

SEQ ID NO: 89583 - RNA, 64 nt, Human
gaggcuccaggagggaauaucuguugccccugcggccccagacaccagccagacccaggcugca

SEQ ID NO: 89584 - RNA, 64 nt, Human
cuucccagcuagaauucacuccacuuggacaugggccccagauaccaugaugcugagcccggaa

SEQ ID NO: 89585 - RNA, 64 nt, Human
ggcggccucugggcuugggcaccagcucaugccagccccagagggucaggguuggaggccugug

SEQ ID NO: 89586 - RNA, 64 nt, Human
uccauggugucaugccaagacaguaucagacacagccccagaagggggcauuaugggcccugcc

SEQ ID NO: 89587 - RNA, 64 nt, Human
uacaugacaauaaaugagucagaugagcaagaaggccccagaacccaugccccaaggcacaaag

SEQ ID NO: 89588 - RNA, 64 nt, Human
ccagcccgcggcacuaacgacaggcgaggccgcggccccagaguccccgcaccaggcagagccg

SEQ ID NO: 89589 - RNA, 64 nt, Human
uuagcagggaagucacuucaccaucaacauuccugccccagauggcuuugugauucccuccagu

SEQ ID NO: 89590 - RNA, 64 nt, Human
gugccugcuauccagccgcaaauccauacccccugccccagagaagccucagucccucccuccu

SEQ ID NO: 89591 - RNA, 57 nt, Human
cuuuccaccugguccggugacccccuggccccagauggcacugaguuuuucauucau

SEQ ID NO: 89592 - RNA, 54 nt, Human
ucauccuggagaucgagugaucuugccccagaccggcagccuggccauccccaa

SEQ ID NO: 89593 - RNA, 64 nt, Human
aaagccaagaaauagcccccgcacaccacccugugccccagaugauggauugauuguacagaaa

SEQ ID NO: 89594 - RNA, 64 nt, Human
auugaauuucugcugcugcuucaaagaaaaagcugccccagagcauuaaacaugggguauuguu

SEQ ID NO: 89595 - RNA, 64 nt, Human
cucaggcaggccauggccgcucaagggaaagacugccccagaagagcaagcuggagaggcuggg

SEQ ID NO: 89596 - RNA, 64 nt, Human
uucuguuucuggaguacuucagggguggccucuggccccagagccuuugccacagugcucccac

SEQ ID NO: 89597 - RNA, 64 nt, Human
aagauucgauggacauggacaugagcccccugaggccccagaacuaucuuuucaguugugaacu

SEQ ID NO: 89598 - RNA, 64 nt, Human
cuguagcugcugcccggccugccuggggcugggagccccagacaccgacacccugaggacgugu

SEQ ID NO: 89599 - RNA, 64 nt, Human
ccuacucccuggacuagugcaguccuugcccucagccccagaccagagaugggugguauaugcc

SEQ ID NO: 89600 - RNA, 64 nt, Human
gcugugugugcccgggacccccgucuccaggggugccccagacccagagauuagccucccacuu

SEQ ID NO: 89601 - RNA, 64 nt, Human
caguacaccccaaagugaaagggauaagagugcagccccagaauaggcggggcuuggaggcggu

SEQ ID NO: 89602 - RNA, 64 nt, Human
augcaagagcccagggggcuauuguaaaaacuuggccccagaugcuugucccuucugggcugag

SEQ ID NO: 89603 - RNA, 64 nt, Human
uuuaaaaaggcagucgcugccuucagguggugcugccccagaaacuuaaaauuuagucgaggca

SEQ ID NO: 89604 - RNA, 64 nt, Human
cccuaccccaacccaagcucugcggaaaucaacagccccagagccacuuggagggaggaagaaa

SEQ ID NO: 89605 - RNA, 64 nt, Human
aaacuacucgucucccuuuucacagcacuccuuugccccagagcagagaauggaaaagccaggg

SEQ ID NO: 89606 - RNA, 64 nt, Human
aaccugauaauucauuuuggauaggccuuucucggccccagacugagguaccauggcucuggga

SEQ ID NO: 89607 - RNA, 64 nt, Human
cuucucaccuaaguccccaggguccaagggagaagccccagacccccuucucuugcagagugug

SEQ ID NO: 89608 - RNA, 64 nt, Human
ggggcuggaaauguuaggagguugccuuggugcugccccagaucuguccagcagggggcaguaa

SEQ ID NO: 89609 - RNA, 64 nt, Human
ggaggggcccuggcuauuugggaccuaagccuaggccccagagaucagcccgaacacccgcauc

SEQ ID NO: 89610 - RNA, 57 nt, Human
ccugccggaccaaguacugagagcccagccccagacagcugcugcccagagaagaac

SEQ ID NO: 89611 - RNA, 64 nt, Human
gcggcagccccucccagccuaccccuccugcgcugccccagagccugggaaggaggccgcuaug

SEQ ID NO: 89612 - RNA, 64 nt, Human
aagaaccacggcccucucccuuuacuguucuauagccccagaacugggagauggcuuccuaagu

SEQ ID NO: 89613 - RNA, 64 nt, Human
uuaggcagccagucucgggagaaggggaacuugugccccagaaagggcaguuacccggccaggg

SEQ ID NO: 89614 - RNA, 64 nt, Human
cugcaacucccccccaacaaugccauucccacuugccccagagaagcuacucggccaaaccuag

SEQ ID NO: 89615 - RNA, 64 nt, Human
ugccuucugggguguccccccacacccugcuuuggccccagaggcgagggaccaguggaggugc

SEQ ID NO: 89616 - RNA, 64 nt, Human
ggaccugaauuccugaugcccaugugauguuguugccccagaugggcacuaaauggccucacuc

SEQ ID NO: 89617 - RNA, 64 nt, Human
caccugggggggcccagcacgaagucacaucccagccccagagucacuguccagcccccacccc

SEQ ID NO: 89618 - RNA, 64 nt, Human
uaucuguguuuccgguggguguaauaggggauuagccccagaagggacugagcuaaacaguguu

SEQ ID NO: 89619 - RNA, 64 nt, Human; identical to SEQ ID NO: 89618

SEQ ID NO: 89620 - RNA, 64 nt, Human; identical to SEQ ID NO: 84777

SEQ ID NO: 89621 - RNA, 64 nt, Human
agugacugcuguggacucgccuccgugcgccgcugccccagaaggcucuuaucaauguuauuua

SEQ ID NO: 89622 - RNA, 64 nt, Human
ugccugcguccucucggugagcugugcagugccggccccagauccucacacccagggagcagcu

SEQ ID NO: 89623 - RNA, 64 nt, Human
ggcggagcacaaggcaagugaguuugcacugucagccccagaccguaagcuuggcuacacugau

SEQ ID NO: 89624 - RNA, 64 nt, Human
ggaaauccuacuguguugacuuugcugccauccagccccagaucgcuuuacuccaggaaaugca

SEQ ID NO: 89625 - RNA, 64 nt, Human
cuugagauauagccaacuaacgacgcuacuggaagccccagagcagaaaagaagcacauccuaa

SEQ ID NO: 89626 - RNA, 64 nt, Human
uccauugcucugcaccccugcaucagcaaggccagccccagaaggagccucggccgagcgugca

SEQ ID NO: 89627 - RNA, 64 nt, Human
cugaaacuucaucacacacugagaggccgucacagccccagaccacccgcuuggcccacgcagc

SEQ ID NO: 89628 - RNA, 64 nt, Human
accuaugguaaugagcaaagcucacccaaacugugccccagauggaguaaagaccuucuggugg

SEQ ID NO: 89629 - RNA, 64 nt, Human
auacuccaaacuuucgcagccaucuucccgcucagccccagacacccagcaaucaagccagaug

SEQ ID NO: 89630 - RNA, 64 nt, Human
ccaaauugucuccacaugaagauguacugaugacgccccagaaaugcugcuuccauaucagcug

SEQ ID NO: 89631 - RNA, 64 nt, Human
gaaaaucauuaggaagugguagaaacuuuaaaucgccccagaguuugccuguuuccauauuuua

SEQ ID NO: 89632 - RNA, 64 nt, Human
guuuuaaaucugcuuuaguuucacauugcaguuagccccagaaaaugaaauccgugaagucaca

SEQ ID NO: 89633 - RNA, 64 nt, Human
uguguuaggauaauuguccaguuaauuugaaaaggccccagaugaaucaauaaauauaauuuua

SEQ ID NO: 89634 - RNA, 64 nt, Human
caccugccugauugccaagggugcccagcacguggccccagaccaaucugagugacuuaguguu

SEQ ID NO: 89635 - RNA, 64 nt, Human
uucugaauuuguagacauacuuguacgcucacuugccccagaugccuccucuguccucauucuu

SEQ ID NO: 89636 - RNA, 64 nt, Human
gaaggaaaagugacgaagagagaggaggaggggggccccagauggcccuuccuuuggugcauga

SEQ ID NO: 89637 - RNA, 64 nt, Human
cagcugcuccauuuuugccacaucguggcccgcagccccagagucacuguccaugucaccaucc

SEQ ID NO: 89638 - RNA, 64 nt, Human
cucagggaaaacagggccuuucccuacaggacacgccccagagcuguggcagauugcaggagcc

SEQ ID NO: 89639 - RNA, 64 nt, Human
auccggcgacagaggacagccagaagcccagccagccccagacuccagugcaccagagcacgca

SEQ ID NO: 89640 - RNA, 50 nt, Human
ccgagagguuccugaucuaggccccagaccuggccaggccagccucccug

SEQ ID NO: 89641 - RNA, 64 nt, Human
ucucagguggaggaagauuuacggcucaagacaggccccagauccccucccaguggcacccaug

SEQ ID NO: 89642 - RNA, 64 nt, Human
gcuacagcggcucucaugaugugggcucaccugcgccccagacccugcaggggccccccugcuu

SEQ ID NO: 89643 - RNA, 64 nt, Human
acuuugggauucuugucagcgggaggcgucacuggccccagagugacuccgacucuccgcuggg

SEQ ID NO: 89644 - RNA, 64 nt, Human
cagagcccccucccucaccuucccuccaccgccagccccagaguuagauuuuaugcuugggccu

SEQ ID NO: 89645 - RNA, 64 nt, Human
aaaucuccagcccugcaugccgucucaagggugggccccagagaguuuggaguguaggauuccc

SEQ ID NO: 89646 - RNA, 64 nt, Human
gaggaccucgaaggcugcaacggcccugccccaagccccagaaaaagaaacucuuggagggagu

SEQ ID NO: 89647 - RNA, 64 nt, Human
agcaagacacguggccucgugaggggcaagcuaggccccagaggcccuggaggucuccaggggc

SEQ ID NO: 89648 - RNA, 64 nt, Human
cggggaagcugcacaugugccacacagugacuuggccccagacgcauagacugagguauaaaga

SEQ ID NO: 89649 - RNA, 64 nt, Human
gaaggaggaagcgaugccgagguaggaaaggccagccccagacauccuaucgccacaaugccau

SEQ ID NO: 89650 - RNA, 64 nt, Human
gccuggccgugguucgcuccccgccagcccacgugccccagaagggccggccucaccucucccc

SEQ ID NO: 89651 - RNA, 64 nt, Human
aucugaccccacuugccagucccuaaaggugggugccccagaguagauuccaccccugcugccc

SEQ ID NO: 89652 - RNA, 64 nt, Human
aucacacuuaagcuuguguuagcuuuuuucuuuugccccagaucaaacugaacaauguauauaa

SEQ ID NO: 89653 - RNA, 64 nt, Human
ccacaaccucgagccugggcucugguccacuacugccccagaccacccucaaagcuggucuuca

SEQ ID NO: 89654 - RNA, 64 nt, Human
agccuaauuuuauuuguuuaaauaugcuuaauaugccccagauugcaaaugcauccagucagua

SEQ ID NO: 89655 - RNA, 64 nt, Human
auguuggaauccgaagccacuuccccgccuucaagccccagaugggcugcucuccuguaacuuu

SEQ ID NO: 89656 - RNA, 64 nt, Human
ccagaaggagaccgcuaacucucagcagaccugagccccagagcaggccuccuucccugugugc

SEQ ID NO: 89657 - RNA, 64 nt, Human
ucccucaaacacaagucuugaaucaguccucagggccccagaucccccuucuaauagucugaag

SEQ ID NO: 89658 - RNA, 64 nt, Human; identical to SEQ ID NO: 84780

SEQ ID NO: 89659 - RNA, 64 nt, Human
ggugguugaaacccugcacauccucccagggccagccccagaaugggccuuucucugccugccc

SEQ ID NO: 89660 - RNA, 64 nt, Human
aggauuuucaagacaaacuggaguaagaauuaaagccccagaggauuuaauuauccugguuugc

SEQ ID NO: 89661 - RNA, 64 nt, Human
cccuugcugccacaccacauugccucaacaaccggccccagagugcccaggcacuccugaggua

SEQ ID NO: 89662 - RNA, 64 nt, Human
gccuuugcuugcaccuccagcuggagaugggugugccccagaaguaagcuuugcaucucuuaca

SEQ ID NO: 89663 - RNA, 64 nt, Human
ggaaggagccuggggauuuuaauuuuucacaagugccccagaugauucucaucaccaagcaaau

SEQ ID NO: 89664 - RNA, 64 nt, Human
aagcuccuaccacccagacacccaaacagccguggccccagagguccuggccaaauaugggggc

SEQ ID NO: 89665 - RNA, 64 nt, Human
auacauaugauugccuuuuugggugccucacagagccccagagugugagaccugaaagaauguu

SEQ ID NO: 89666 - RNA, 64 nt, Human
gugcaaccuuaugccaauaaaauguaauuuaacagccccagauauuguugaauauucaacaaua

SEQ ID NO: 89667 - RNA, 64 nt, Human
aaagggagggacuguagguuguccagcauaaggagccccagaguucuuucaccagcagacagau

SEQ ID NO: 89668 - RNA, 64 nt, Human
uuuuccacuccaacccaggccacccuuugucucugccccagaguugagaaaaaaacuuccuccc

SEQ ID NO: 89669 - RNA, 64 nt, Human
ucuucgagcuagagaaaaauagauaagcccagcagccccagaagauggucugaacagaggcauc

SEQ ID NO: 89670 - RNA, 64 nt, Human
gggccugagggcggaccggugguggggagcuggagccccagaagggaacagagcuaggaaggaa

SEQ ID NO: 89671 - RNA, 64 nt, Human
aggucacaguggacagcccgggcaguaggaugcagccccagaggcugguggcaguuuccugucc

SEQ ID NO: 89672 - RNA, 50 nt, Human
aagacgccggcuuggugugagccccagagcuggcauaucuggucagaacu

SEQ ID NO: 89673 - RNA, 64 nt, Human
ucugucucccggguucaagcgauuuccugcgucagccccagaguagcuggaauuacaggcacac

SEQ ID NO: 89674 - RNA, 64 nt, Human
ucucaguuuguuugugagcaggcugugaguuugggccccagaggcugggugacauguguuggca

SEQ ID NO: 89675 - RNA, 64 nt, Human
cggcgaggacgacuaggggacucgagagaggcgggccccagacccaugugcugggaaaugcaga

SEQ ID NO: 89676 - RNA, 64 nt, Human
uggccucuugagugaacaggggaggccaguagaugccccagauccagagccguggcugcaaauc

SEQ ID NO: 89677 - RNA, 50 nt, Human
agcaaauggccacugaguaggccccagaggucgcacuccgcaggaggacu

SEQ ID NO: 89678 - RNA, 64 nt, Human
acacagucuauauauuuauauacacuguuuccuggccccagagcucauuuggguucaggcgcac

SEQ ID NO: 89679 - RNA, 64 nt, Human
cagccuguuugaggacacccuagacccaaccugagccccagacucugccucugcacuuuuaacc

SEQ ID NO: 89680 - RNA, 64 nt, Human
cauggaggcccggcccucaccgccucgaagccaugccccagaugccacugccacagcgggcgcu

SEQ ID NO: 89681 - RNA, 64 nt, Human
cacuaaaugcacuaacaaggacuccagaccugcagccccagacccgccguaguauaagccuaac

SEQ ID NO: 89682 - RNA, 64 nt, Human
gguuaggaaagcggaggcucaugguggggcuggggccccagaggugggcuagguguaaggcauc

SEQ ID NO: 89683 - RNA, 64 nt, Human
gcuccaaaugucaggguguuugcccaauaauaaagccccagagaacugggcugggcccuauggg

SEQ ID NO: 89684 - RNA, 64 nt, Human
ugacagagugaggagggcccagagcagaauucuggccccagaacucugugcccaggagccaugc

SEQ ID NO: 89685 - RNA, 64 nt, Human
gggcuucugaggacacaaggugggcugcccucaagccccagagagccccucauccuuccucugg

SEQ ID NO: 89686 - RNA, 64 nt, Human
cgcccacccugggcuccacacagcaguguccccugccccagaggucgcagcuacccucagccuc

SEQ ID NO: 89687 - RNA, 64 nt, Human
acggggcaaucauauaagcguuugucucaggggagccccagagggaugacuuccaguuccgucu

SEQ ID NO: 89688 - RNA, 64 nt, Human
cugucuccucuccugauuuccuccaaucucuguagccccagaagugaacgccagacaggaacac

SEQ ID NO: 89689 - RNA, 64 nt, Human
ggacuuuggggaggagcaaagggaggcuccggcugccccagauuggcagcaaaaauaagccguc

SEQ ID NO: 89690 - RNA, 64 nt, Human
agcuauccucagggaagcuggagauucaagucaugccccagaagcaagguguaagcaugggggc

SEQ ID NO: 89691 - RNA, 64 nt, Human
aggacuaagguggcuuucccacuccuggcccacagccccagagagccugucugugcauccugaa

SEQ ID NO: 89692 - RNA, 64 nt, Human
ugaggauaagcccacuuuccugucauuaguggcagccccagauccagaccuaggccuccuggca

SEQ ID NO: 89693 - RNA, 64 nt, Human
cuggggcaguugugggucacugucccuuccagcugccccagacaggaagcagagucaccacgca

SEQ ID NO: 89694 - RNA, 64 nt, Human
accuuggucuggggcauuuuccucuccuuaucuugccccagagacaauucaagauuucuauaug

SEQ ID NO: 89695 - RNA, 64 nt, Human
cagccccacagacaacaguugcacagugccucaagccccagaguggcucacccuguccagaccu

SEQ ID NO: 89696 - RNA, 64 nt, Human; identical to SEQ ID NO: 84783

SEQ ID NO: 89697 - RNA, 64 nt, Human
gcccucaccccugcccggcucuggaguaccgucugccccagacaagugggagugaaaugggggu

SEQ ID NO: 89698 - RNA, 64 nt, Human
aacaccagggaugguacuagggggaagugacaaggccccagagacucagagggaggaaucgagg

SEQ ID NO: 89699 - RNA, 64 nt, Human
guccccgaggccugugggcaggccgaucaguguggccccagaucaagucaugggaggaagcuaa

SEQ ID NO: 89700 - RNA, 64 nt, Human
cuucucacucaccacuaccagccagccucagaaggccccagagagacccugcaagaccacggag

SEQ ID NO: 89701 - RNA, 64 nt, Human
cgcgagugcuggugacgcacggcauuagcuuccugccccagacagacuucaucauugugcuagc

SEQ ID NO: 89702 - RNA, 64 nt, Human
uuaggaagcuucggggagacaaguuuugagagaagccccagagggagcuauuuccuugcacccc

SEQ ID NO: 89703 - RNA, 64 nt, Human
uucugaguuccuggaauggcacguugcugccagugccccagacaguucuuuucuacccugcggg

SEQ ID NO: 89704 - RNA, 64 nt, Human
uugaugccucagggucucugaaaucucccgggaagccccagagcuuuccugaggcugccuggcc

SEQ ID NO: 89705 - RNA, 64 nt, Human
uaguuccucuccauccgccaccuccccucccgcugccccagaaguuucuaucauuccauggaga

SEQ ID NO: 89706 - RNA, 64 nt, Human
guccguucccaaagaucggccccggaaaaagucugccccagaaacucucacacuuccagacccu

SEQ ID NO: 89707 - RNA, 64 nt, Human
gcuccuccucccccuggcaggcccagcaacaugugccccagaucuggaagggccucccucucug

SEQ ID NO: 89708 - RNA, 64 nt, Human
aaagcucuggggagaagagcugcuccccacucaugccccagagggacugugaaaaggcuuccug

SEQ ID NO: 89709 - RNA, 64 nt, Human
caucggcuuucugugccgccucccacacaaaucagccccagaaggccccggggccuuggcuucu

SEQ ID NO: 89710 - RNA, 64 nt, Human
ccagcuucucugcuucucagcugccaucuccagugccccagaaugguacagcgauaauaaaaug

SEQ ID NO: 89711 - RNA, 64 nt, Human
ggcuucacagcccuacaauuggguucucagcuaagccccagaguucugguagaaccaucccggg

SEQ ID NO: 89712 - RNA, 64 nt, Human
caacuuggcuuucccggacugcaagcagggcucugccccagaggccucucucuccgucguggga

SEQ ID NO: 89713 - RNA, 64 nt, Human
cagugccucaggcucugagguacucugcucacaggccccagacagaugcuguuggguaaacuca

SEQ ID NO: 89714 - RNA, 64 nt, Human
gcagcaggccccgagccccuucaggcccagcacugccccagacucgcuggcacucaguucccuc

SEQ ID NO: 89715 - RNA, 64 nt, Human; identical to SEQ ID NO: 84786

SEQ ID NO: 89716 - RNA, 64 nt, Human
ugagaagcagaaucugugcuuccccagucuccuugccccagacaaccagcauguaagacccuuc

SEQ ID NO: 89717 - RNA, 64 nt, Human
uuacucuguugugaggggaagagacugcauuguggccccagacuuuuaaaacagcacuaaauaa

SEQ ID NO: 89718 - RNA, 64 nt, Human
agcagagcuugggaagggccauggacccaacugggccccagaagagccacaggaacaucauucc

SEQ ID NO: 89719 - RNA, 64 nt, Human
agccguaaaggacauguagacuugggggaggccugccccagagggagggcaggggcaucggaac

SEQ ID NO: 89720 - RNA, 64 nt, Human
cacagucuaggagggggauaaaugggaugcccuugccccagagagaacccaguucuagguacug

SEQ ID NO: 89721 - RNA, 64 nt, Human
accugggacuucagggaggcucagcuugcucccugccccagaccuguuucuucuaagggaggag

SEQ ID NO: 89722 - RNA, 64 nt, Human
uacacacaguguuucauugcuccgcgucuucccagccccagaaaccggcuaaaggacccugcac

SEQ ID NO: 89723 - RNA, 64 nt, Human
ccuaggcaggggcugggccagggcuccaaggcuugccccagaggccacauggccaccagcccca

SEQ ID NO: 89724 - RNA, 64 nt, Human
augacuccgaugagcugcucaucgaccuggagcggccccagagcaacagcagcgcugucacagg

SEQ ID NO: 89725 - RNA, 64 nt, Human
caugaagacuuuugcagccaguucccaccaauaugccccagacgugagacaaacaaggacuuuu

SEQ ID NO: 89726 - RNA, 64 nt, Human
uugcaaaaggagaaagauaaaauacagaagacuggccccagagagaccucagaucaguauugug

SEQ ID NO: 89727 - RNA, 50 nt, Human
ccacgagcaucguucccugagccccagaaagggagaugaaguggaaagcu

SEQ ID NO: 89728 - RNA, 64 nt, Human
gguuuuaauaacaguaaaugugcccagccucuuggccccagaacuguacaguauuguggcugca

SEQ ID NO: 89729 - RNA, 64 nt, Human
agugucacauaauuuaaaaaugaaauugcuguuugccccagauauguuuuucuguguucuuuuu

SEQ ID NO: 89730 - RNA, 64 nt, Human
cagaugccagaaaaccucugucagacgcccacuggccccagaucucauccugccucauccugag

SEQ ID NO: 89731 - RNA, 64 nt, Human
uagggcgacaggagccagcgggacgccgcacgcggccccagacucagggagcagggccaggcgg

SEQ ID NO: 89732 - RNA, 64 nt, Human
uucucagcuuaacauggaaaugaggaucccaccagccccagaacccucuggggaagaauguugg

SEQ ID NO: 89733 - RNA, 64 nt, Human
cccaagccgcaccggagcagcggcuggauugaacgccccagauuggggcccgagauguggcccu

SEQ ID NO: 89734 - RNA, 64 nt, Human
gcccuucucuccuccagcccggggacccccgcgggccccagaagcagcccaguucucagagagc

SEQ ID NO: 89735 - RNA, 64 nt, Human
gugcugggaucacaggcgugagcuaucacaccuggccccagaaguguuucaacauggaaauuuu

SEQ ID NO: 89736 - RNA, 64 nt, Human
gcuucacugcagguaaugccuuucccuucaggaagccccagaacacccacaggucuugguaaca

SEQ ID NO: 89737 - RNA, 64 nt, Human
cgccugcccccagcguggggguggccacuccugggccccagaaagccucagaguccugccgacg

SEQ ID NO: 89738 - RNA, 64 nt, Human
cccccguccccucccuuccuuauuuauuccugcugccccagaacauaggucuuggaauaaaaug

SEQ ID NO: 89739 - RNA, 64 nt, Human
cuggcaccgcugcuacggcggccuagcaaauuccgccccagaagcgccccaggaagggcgccga

SEQ ID NO: 89740 - RNA, 64 nt, Human
cuucagccgagcccagaccuccccucuuccuggagccccagaaccccaacucccagccuagggc

SEQ ID NO: 89741 - RNA, 56 nt, Human
agcugacuauguauuccugaacuggagccccagacccgcccccucacugccuugcu

SEQ ID NO: 89742 - RNA, 64 nt, Human
ggaaagcuuucauuagaaauuugcaccucaucaugccccagaaauaauccuucugaagcaaagc

SEQ ID NO: 89743 - RNA, 51 nt, Human
auggcgagagcgaccugugaggccccagagaccugacccaacacccccgac

SEQ ID NO: 89744 - RNA, 64 nt, Human
gauuuuuguauuugcucgguggugcccagucucugccccagaggcuuuggaguucaaucuugaa

SEQ ID NO: 89745 - RNA, 64 nt, Human
cccauccucauccccaacuacagccccaaacccagccccagacuaauccacagccauccccaac

SEQ ID NO: 89746 - RNA, 64 nt, Human
ggggaugucacgccgucccgcagggcccagcacagccccagacccgaaaaaaguguucugccca

SEQ ID NO: 89747 - RNA, 64 nt, Human
uggggagauggcagugcaggcuggaaccugggcugccccagaacacaguccauuacgauagaaa

SEQ ID NO: 89748 - RNA, 64 nt, Human
gugccuuggccccaagugaacucaagauuuggcagccccagagaugccaacugcagcaugccca

SEQ ID NO: 89749 - RNA, 64 nt, Human
uggaccucuuggcccccagccccuuccccacacagccccagaagggucccagagcugaccccac

SEQ ID NO: 89750 - RNA, 64 nt, Human
uuugucccuuuaucucuccugguuuuuuucuuaagccccagaaagccaaaaagaacauguaaac

SEQ ID NO: 89751 - RNA, 64 nt, Human
gggacucugagaacuccucauucccugacucuuagccccagacucuucauucaguggcccacau

SEQ ID NO: 89752 - RNA, 64 nt, Human
gaguuuuccuguaaguaauuaagaagacuaaguagccccagagauaagaccuccucggaucauu

SEQ ID NO: 89753 - RNA, 64 nt, Human
ugugcccaagcaguccucacuuugcuuaacaguggccccagagagcaggaguagugaugcuggu

SEQ ID NO: 89754 - RNA, 64 nt, Human
gguggcucaugccuauaaucccagcacuuuaggagccccagacaggaggaucacuuaagcgcag

SEQ ID NO: 89755 - RNA, 64 nt, Human
cacccggcccugagucccuggggggagcugaugggccccagaagaugggggacaucccccagcc

SEQ ID NO: 89756 - RNA, 64 nt, Human
aauaaaaugugacuguauugagucauuuucuagggccccagauccccuggugucauggacuuag

SEQ ID NO: 89757 - RNA, 64 nt, Human
acaggcacugcugccaugcugccuccccaggcuggccccagaggagcgagcaccagcacccgac

SEQ ID NO: 89758 - RNA, 64 nt, Human
gggacgagccacccgcuuucagcccugugcucuggccccagaacggccacucgagaccccgggc

SEQ ID NO: 89759 - RNA, 64 nt, Human
gucccugcagcccaagaugggacucagacccugugccccagagcuccccugccgcagaaugggg

SEQ ID NO: 89760 - RNA, 64 nt, Human
cccuacccgccaaaccugcuguuggcccgggagagccccagaggcucccggagacugcagccuc

SEQ ID NO: 89761 - RNA, 64 nt, Human
ggucugccccacccacuuccuccccaccaccugugccccagagagcagggccugcccgggaagg

SEQ ID NO: 89762 - RNA, 64 nt, Human
ucccagcagaggggauguugcagcugugaugaccgccccagaucgguuagcgcugaguucauca

SEQ ID NO: 89763 - RNA, 64 nt, Human
ccaggagcccugaccccacccgguggggcccuuggccccagaggaccgagagaguggagagugc

SEQ ID NO: 89764 - RNA, 64 nt, Human
gguuuauuuggguacauggcccgcaguggcuuuugccccagaaaggggaaaggaacacgcgggu

SEQ ID NO: 89765 - RNA, 64 nt, Human
augucaaaauuuaccagaagccaagaugauguaggccccagagguggauuguuaaaaagaugcu

SEQ ID NO: 89766 - RNA, 64 nt, Human
ugcccuugggacccaucccaguuuucaucauugagccccagacccucugagcagcaccuugaag

SEQ ID NO: 89767 - RNA, 64 nt, Human
ugagaguguccggggugggagggaccaugagggagccccagaauggggugcauuuggugcugag

SEQ ID NO: 89768 - RNA, 64 nt, Human
uaugggcucugugggcucugucccuggcugaauggccccagacugguugcagcugggcuugagg

SEQ ID NO: 89769 - RNA, 64 nt, Human
gcucucaggguggcuucugcguccccgccgccaggccccagacuauggucacagggccguccug

SEQ ID NO: 89770 - RNA, 64 nt, Human
acaggcccaggcaggaggucccaccccagacccugccccagacgcucccucacccucucggccc

SEQ ID NO: 89771 - RNA, 64 nt, Human
acacacggacagacgcagacggacacagcgacaugccccagacacguuaagggacugguuggcc

SEQ ID NO: 89772 - RNA, 64 nt, Human; identical to SEQ ID NO: 84789

SEQ ID NO: 89773 - RNA, 64 nt, Human
cggaccgcgggccggaaggaggcgcccccgccccgccccagagcugggcccccugggcagguuc

SEQ ID NO: 89774 - RNA, 64 nt, Human
ggggggugggaggguuggauugaacagccagagggccccagaguuccuugcaucuaauuucacc

SEQ ID NO: 89775 - RNA, 64 nt, Human
gacacugacagccaaauguccucacuccaggggagccccagacgcuccgcucccugcaugugua

SEQ ID NO: 89776 - RNA, 64 nt, Human
cacuuugggaggccaaggugggaggaucaguugagccccagaguucaagaccagccugggcaau

SEQ ID NO: 89777 - RNA, 64 nt, Human
caaaaauugaaacauuugcuuuugcucccuaagugccccagaauugggaaacuauucaggagua

SEQ ID NO: 89778 - RNA, 64 nt, Human
aauugaaacauuuacuuuugcuuucuaccugacugccccagaauugggcaacuauucaugagaa

SEQ ID NO: 89779 - RNA, 64 nt, Human
caaaaauugaaacauuugcuuuugcucucugagugccccagaauugggaaucuauucaugaaua

SEQ ID NO: 89780 - RNA, 64 nt, Human
aauugaaacauuuccuuuugcucucuaucugagugccccagaauugggaaucuauucaugagua

SEQ ID NO: 89781 - RNA, 64 nt, Human
aauugaaacauuugcuuuugcucucuaucugagugccccagaauugggaaacuauucaugagua

SEQ ID NO: 89782 - RNA, 64 nt, Human
aauugaaauauuugcuuuugcugucuaucugaaugccccagaauugugaaacuauucaugagua

SEQ ID NO: 89783 - RNA, 64 nt, Human
agcuacucauguauaaaugccauguggagauagagccccagauguuucagccaucucagcccag

SEQ ID NO: 89784 - RNA, 64 nt, Human
gcugaagacgcagggacaggaaugggaggggggagccccagaaaugcgguugcugaagacccca

SEQ ID NO: 89785 - RNA, 64 nt, Human
agaugaagggugggggcugcggaucccagggacugccccagaacacaaaccuaaguccugugcc

SEQ ID NO: 89786 - RNA, 64 nt, Human
ggagcaagcgcuuguggagaaccaaagcccaaaagccccagauccccuuaaagcagagagggag

SEQ ID NO: 89787 - RNA, 64 nt, Human
cagggccuggccuccuuaguggcacugccggggggccccagagcgaaugagggcagagaugccc

SEQ ID NO: 89788 - RNA, 64 nt, Human
aaauaucaguuacccacucggucccaguuuuguugccccagaaagggauguuauuauccuuggg

SEQ ID NO: 89789 - RNA, 64 nt, Human
auuuauugcaaauaauugguuuacauaauuuugggccccagaugguuaagugcuaaauuuguag

SEQ ID NO: 89790 - RNA, 64 nt, Human
gccuagauuuaaggccacugugaggagagggguugccccagaaggcaggggaaggaccugauga

SEQ ID NO: 89791 - RNA, 64 nt, Human; identical to SEQ ID NO: 84792

SEQ ID NO: 89792 - RNA, 64 nt, Human
ccgauucugguuuaggggccggacccacugagaggccccagagccgcccgugauguuccucccc

SEQ ID NO: 89793 - RNA, 64 nt, Human
uuuggcagaccaucuccagcauccugcuuccuaggccccagagcacaaguuccagcuggucuuu

SEQ ID NO: 89794 - RNA, 64 nt, Human
caguuuuccuaaugaguaaaaugaucccagaugugccccagagcaugacgccugcagcuccggu

SEQ ID NO: 89795 - RNA, 64 nt, Human
ugggacaggucaaagcauuagggccaccuccauggccccagacagacuaaagcugcccuccugg

SEQ ID NO: 89796 - RNA, 64 nt, Human
cccaacucaggcaccagguccgcaccucucccgcgccccagagccggaaauuucucccucccag

SEQ ID NO: 89797 - RNA, 64 nt, Human
caggcuccuguugcuccuucacacagaccuggaugccccagagcaaggucuucauucauggucc

SEQ ID NO: 89798 - RNA, 64 nt, Human
gauaaggcuucagccaugagucaccccgcaguaagccccagaguauauugaauagaaauucugc

SEQ ID NO: 89799 - RNA, 64 nt, Human
ugggcacccgcugugcauggagccagagugcagagccccagauccuuuaguaaugcuuccccug

SEQ ID NO: 89800 - RNA, 64 nt, Human
aauacauguuuguauaucuacauuuacauucugcgccccagagcuaagacagacugcgaaucac

SEQ ID NO: 89801 - RNA, 64 nt, Human
uagagcucaaaauacuagcugcuguuucaagcuggccccagacauuaaacucagacuagggccu

SEQ ID NO: 89802 - RNA, 64 nt, Human
ccauacugagggaccaacugggcccaagacagaugccccagagcuguuuauggccucagcugcc

SEQ ID NO: 89803 - RNA, 64 nt, Human
cucccagguuuggucucagggggaccccagggaugccccagaucaggggccagaggggaugcuu

SEQ ID NO: 89804 - RNA, 64 nt, Human
cccaagcuagugagcaaaauaugccccuucuugggccccagaccccagggcagggugggcagcc

SEQ ID NO: 89805 - RNA, 64 nt, Human
ggaccuaggaagcuccaucuugaaggcuggucuagccccagacagggcaugaggggcagagaau

SEQ ID NO: 89806 - RNA, 64 nt, Human
uuuccugcggcaccggguucaggcagcuacuccugccccagagaugaaggggcagcuuugcaag

SEQ ID NO: 89807 - RNA, 64 nt, Human
cccacagugcaccagagcacagcugcauccuggagccccagaccuguggcuggcugguccgaag

SEQ ID NO: 89808 - RNA, 64 nt, Human
cuggacagccaugccagagagaggccuuugaccggccccagagcuaaaagcaccagagaaaauc

SEQ ID NO: 89809 - RNA, 64 nt, Human
ugguggggaggccuucuggacagacggcagucgggccccagagcaagaaggcuggugagggaag

SEQ ID NO: 89810 - RNA, 64 nt, Human; identical to SEQ ID NO: 84740

SEQ ID NO: 89811 - RNA, 64 nt, Human
gaauaauugagguuaggaacccggcaugccgagugccccagaaaugccgcuguguccccgcggg

SEQ ID NO: 89812 - RNA, 64 nt, Human
cccacugccccaucucccucuccccaccaagacagccccagaaggagcagccagcugggauggg

SEQ ID NO: 89813 - RNA, 64 nt, Human
ccucgcuggggccuccuccccaggcagccaaugggccccagacaagccuuugguggggaacaga

SEQ ID NO: 89814 - RNA, 64 nt, Human
accucaaaggcagcagccucaaggagcagccauggccccagacuugucgcacggaugcagaaaa

SEQ ID NO: 89815 - RNA, 64 nt, Human
uggaaaccaagacggagcucagacccaccacaucgccccagaggcuuuuccagcacccaugaug

SEQ ID NO: 89816 - RNA, 64 nt, Human
ccuucaccaggggaugggcaggaaagaggcaggggccccagaagcuucugucccucaugccuga

SEQ ID NO: 89817 - RNA, 64 nt, Human
gggcauccuacccacugccuccccauccccgcuggccccagacccgccaaggaucauccugccu

SEQ ID NO: 89818 - RNA, 64 nt, Human
gcgcugcaggggugucggcgcgccaccucuccaggccccagaagcccuucuugcccaaaggcuu

SEQ ID NO: 89819 - RNA, 64 nt, Human
gcccauccugggaccccagaugggguaaggagaggccccagaaccccaaagcagacagcgagac

SEQ ID NO: 89820 - RNA, 64 nt, Human
uuuaagcugcuguuccuggccaguugcagguuaagccccagaaaaguucaccuuggagaagcuc

SEQ ID NO: 89821 - RNA, 64 nt, Human
acaggugcugggcuuuagagaacaugggaaggcggccccagaccugcgggaacgccuuucccuc

SEQ ID NO: 89822 - RNA, 64 nt, Human
aaacuguggcccccaggagacacuacccuuccaugccccagaccucugucuugcaugugacaau

SEQ ID NO: 89823 - RNA, 64 nt, Human
gcagcccucgaacuucccaggcacccuccuuucugccccagaggaaggagcuguaguguccugc

SEQ ID NO: 89824 - RNA, 64 nt, Human
ggggcggggcuuggccagugccuucagggagguggccccagaugcccacugugcgcaucucccc

SEQ ID NO: 89825 - RNA, 64 nt, Human
ggggaugucaacugugacaggaaaauaucuuggggccccagaaucacuaaggaaaacucaagcu

SEQ ID NO: 89826 - RNA, 64 nt, Human
ggaaggggugaggagagcagccagaggaaaaccagccccagaaugcugcaacuucucuucucuc

SEQ ID NO: 89827 - RNA, 64 nt, Human
acccccucccagcaguggcugggcacucuuugcugccccagaagcugguccccuauggauucau

SEQ ID NO: 89828 - RNA, 64 nt, Human
guuggggucaaugccuccugggcacccuugccucgccccagaccggcccguccaguccccauca

SEQ ID NO: 89829 - RNA, 64 nt, Human; identical to SEQ ID NO: 84795

SEQ ID NO: 89830 - RNA, 64 nt, Human
gcccuccccaucucccagucucccugccccccaugccccagaccggcccaccagggacuagccg

SEQ ID NO: 89831 - RNA, 64 nt, Human
ccuguggaaaggucuauaugacgggccgccugaggccccagaacucgucugugaaccaccuuuu

SEQ ID NO: 89832 - RNA, 64 nt, Human
gggacugucaggcacagaagcggccuccucccgugccccagacuguccgaauugcuuuuauuuu

SEQ ID NO: 89833 - RNA, 64 nt, Human
cucccucaggaagaagcucuggaguggggccgaggccccagaugcucugcuggggucuggggac

SEQ ID NO: 89834 - RNA, 64 nt, Human
ggcagcagugcucugggaauaaacagcugcccuagccccagagggaucccugcacccaggaggc

SEQ ID NO: 89835 - RNA, 64 nt, Human
ccugccauuuugccucuccugucucccacccccugccccagacccaggagccccccugaggcuu

SEQ ID NO: 89836 - RNA, 64 nt, Human
agcuccacagggcagggccucauuauuuuucacugccccagacacagugcccaacaccccgucg

SEQ ID NO: 89837 - RNA, 64 nt, Human
uguguucacuacaacaggauagggacaucagacagccccagaaaccccuuccagaucugauaug

SEQ ID NO: 89838 - RNA, 64 nt, Human
gcuccaccaaggggcucuugaaccccuuauuaaggccccagaugaucccagucacuccucucua

SEQ ID NO: 89839 - RNA, 64 nt, Human
uacguuagucuccagcuaaggaggaugaggcgcagccccagagggagaccucagugauagggga

SEQ ID NO: 89840 - RNA, 64 nt, Human
agaggggaagggggucucauauuggucauucccugccccagauuucuuaaaguuugauauguau

SEQ ID NO: 89841 - RNA, 64 nt, Human
uauuaaggagguccaaggggugagucccaacccagccccagaauauauuuguuuuugcaccugc

SEQ ID NO: 89842 - RNA, 50 nt, Human
auaugccccacccacacuaagccccagaauacggucccucuucaccuucu

SEQ ID NO: 89843 - RNA, 64 nt, Human
cccaggccuccaugaaggagaaccugguggcauugccccagagcucuccagagaugagccuccc

SEQ ID NO: 89844 - RNA, 64 nt, Human
aaccucacuugcuucuuauccuuacacucccccagccccagagaaacugccacauacaccacaa

SEQ ID NO: 89845 - RNA, 64 nt, Human
gcugguuuucuccugauaagaagaaaggaagaaagccccagacgcuugguuuuucucagaaccc

SEQ ID NO: 89846 - RNA, 64 nt, Human
auucccuucgacagcauuuuccucugcuuugaaagccccagaaaucaguguuggccaugaugac

SEQ ID NO: 89847 - RNA, 64 nt, Human
guuucucuucggggagggggggauugggggaggggccccagagggguuuuauaggggccuuuuc

SEQ ID NO: 89848 - RNA, 64 nt, Human
aaggucccaggccccaggaacacagggcuucuuggccccagauggcaccucccugcaccccggg

SEQ ID NO: 89849 - RNA, 64 nt, Human
uuccccgagagaaaguguuaacauugagacucuggccccagauugguaucuucuaugaagaugg

SEQ ID NO: 89850 - RNA, 64 nt, Human
cugcuuuccaaaugugguuaaauguaauugguuagccccagacuugggcuagagcagaaggcau

SEQ ID NO: 89851 - RNA, 64 nt, Human
agcuauugcuagagcaucauccuuagaaaucagugccccagauguacauguguugagcguauuc

SEQ ID NO: 89852 - RNA, 64 nt, Human
agucuguuguguggaugugcgugugugguccccagccccagacuggauuggaaaagugcauggu

SEQ ID NO: 89853 - RNA, 64 nt, Human
aucagaggacgaggcugcucuaaagacuguucuggccccagacacaggguagucuuugcuagca

SEQ ID NO: 89854 - RNA, 64 nt, Human
aggggccccgguccuggccccagcccccaccuccgccccagacacaccccccagucgagcccug

SEQ ID NO: 89855 - RNA, 57 nt, Human
agggcgcugagcgggucuaaaaccacagccccagauugcugguucgcgcccuccuca

SEQ ID NO: 89856 - RNA, 64 nt, Human
ccuggccccucccuggacugacuuuggagaccuagccccagaaagccucccuucuucuccaggu

SEQ ID NO: 89857 - RNA, 64 nt, Human
gccugugcgugcgucugucugucucuggcccccagccccagagcucuuggagcagaaacccuac

SEQ ID NO: 89858 - RNA, 64 nt, Human
aggcugccuguggggugccccuuaggcuuggagagccccagauuggaggcagacagacugcacc

SEQ ID NO: 89859 - RNA, 64 nt, Human
aacuggauacaauugcagagugcacuaaacaguugccccagaaagacaugucuuguuuuaaagc

SEQ ID NO: 89860 - RNA, 62 nt, Human
cuuucccagcuccccacccuccuugccuuugggugcgcgacaaacaaucgcuccgggcucag

SEQ ID NO: 89861 - RNA, 62 nt, Human
acguggucuuccagcccaucuccggggaagacgugcgcgaugugacagcccgugaguccguc

SEQ ID NO: 89862 - RNA, 62 nt, Human
ccgaaagagggccagguccuaagcugcugcuugugcgcgacugcacccgguauucucuucac

SEQ ID NO: 89863 - RNA, 62 nt, Human
gaaaaaccacaaagaaacaccaggcguaccuggugcgcgagagcguauccccaacugggacu

SEQ ID NO: 89864 - RNA, 62 nt, Human
gccacgacagcugugccuacgacuaucuggaggugcgcgacgggcacagugagagcagcacc

SEQ ID NO: 89865 - RNA, 62 nt, Human
uggugcugcaccgggccggggcgcggcuggacgugcgcgaugccuggggccgucugcccgug

SEQ ID NO: 89866 - RNA, 62 nt, Human
uggugcugcaccgggccggggcgcggcuggacgugcgcgaugccuggggucgucugcccgug

SEQ ID NO: 89867 - RNA, 62 nt, Human
cuuccccgcccaggcaccgccuccaggacaacgugcgcgaggaccucuaugaggcugcugac

SEQ ID NO: 89868 - RNA, 62 nt, Human
uuaauuuguauauuucuaaucaaguguugauugugcgcgacugaccaggauugugaaagagu

SEQ ID NO: 89869 - RNA, 62 nt, Human
uguauguggugugcacauguggccagaggugugugcgcgagaccgacacugugaucccugug

SEQ ID NO: 89870 - RNA, 62 nt, Human
uuuuauuuuuuuccuggcucccuuuuauuuuugugcgcgauauuuaaggucgucuggauggg

SEQ ID NO: 89871 - RNA, 62 nt, Human
ucauuucuguugggaccagacgcggagccugggugcgcgagccgcccuccgggaggaaggcg

SEQ ID NO: 89872 - RNA, 62 nt, Human
caccuggacuuggggguaggggaggggugugugugcgcgacauggggaaagaggguggcucc

SEQ ID NO: 89873 - RNA, 62 nt, Human
uggcgauguuagccaaggagcggcuacaggaggugcgcgacaaacugggucugcaguaucgg

SEQ ID NO: 89874 - RNA, 62 nt, Human
uucagcugcuuuugugcuacgagucagcguccgugcgcgaggacacugagccgggcuggcuc

SEQ ID NO: 89875 - RNA, 62 nt, Human
ccccuuucccugaucuuuuacugaggggcugugugcgcgauccuugcaaauugaugauguug

SEQ ID NO: 89876 - RNA, 62 nt, Human
aggccaaugccauaggucggggugccaagucagugcgcgaguuccuggagaagaacuauacu

SEQ ID NO: 89877 - RNA, 62 nt, Human
cgccgccgccccgccgccggcaguggaccgcugugcgcgaacccugaacccuacggucccga

SEQ ID NO: 89878 - RNA, 64 nt, Human
uuaaauguguggguuauguugcagcuguugcagucccccagauaccuauuauuuuacacaauuu

SEQ ID NO: 89879 - RNA, 64 nt, Human
gugcauccucagaagcucugggugugccagaggacccccagaacuaagaagggagggcgagugg

SEQ ID NO: 89880 - RNA, 64 nt, Human
ucucuacuccuaccucagccuagacccuccuccucccccagagggguggguuccucuuccccac

SEQ ID NO: 89881 - RNA, 64 nt, Human
ugggcaccagaaggcuccuggaccaugagcuucacccccagaauucccugcugacccugcccca

SEQ ID NO: 89882 - RNA, 64 nt, Human
ccucauucuucccuggccucuuucccacccacagcccccagaggcucuagaucaacaauguuag

SEQ ID NO: 89883 - RNA, 64 nt, Human
guuagugccccgcacugugccccaaguucuaggccccccagaaagcugccagagccggccgccu

SEQ ID NO: 89884 - RNA, 63 nt, Human
aacuauaagacguaguuuuaauuaauaaauauugcccccagauuguauuuauauuauccccca

SEQ ID NO: 89885 - RNA, 64 nt, Human
ucccuacccauuuggcucuggaagcugcuuggcccccccagaucagggccugggugaacucccu

SEQ ID NO: 89886 - RNA, 64 nt, Human
uccagggcuucuuuccaaacccccagcuccacaccccccagacccagcugguucuggaguucua

SEQ ID NO: 89887 - RNA, 64 nt, Human
cccgcguggaguucuccucaggucgugcgaaacacccccagauucuucgcacagugucuagauc

SEQ ID NO: 89888 - RNA, 63 nt, Human
gcgguggcgcugccgccugaccaggccauccggcccccagagcgccccucccuagugacccgg

SEQ ID NO: 89889 - RNA, 64 nt, Human
gccugggagccgcgggcaggcgagacuggcggagcccccagaccucccaguggggacggggcag

SEQ ID NO: 89890 - RNA, 64 nt, Human
gaggaguuggugccccucauuccagaaucuccuacccccagaaaaggggugcuggaaggaggcc

SEQ ID NO: 89891 - RNA, 64 nt, Human
ucugcccuuccucacccccacgccccaccccacucccccagaguacuccccacugugaaaagag

SEQ ID NO: 89892 - RNA, 64 nt, Human
caugggagaccccaacccagcugacaauguggagcccccagaacuucagaacuguguggaggca

SEQ ID NO: 89893 - RNA, 64 nt, Human
cuuucccugacuccuggugcccucucccuuuguccccccagagagacauaugcccccagagaga

SEQ ID NO: 89894 - RNA, 64 nt, Human
gcccucucccuuuguccccccagagagacauaugcccccagagagagcaaaucgaagcguggga

SEQ ID NO: 89895 - RNA, 64 nt, Human
caagcacaugagcucucuaacagggugggggcuacccccagaccugcuccuacacugauauuga

SEQ ID NO: 89896 - RNA, 64 nt, Human
cccuggaaaugugcuaaaguuggaaaguccccgucccccagaaccucaagucuagaaaccagua

SEQ ID NO: 89897 - RNA, 64 nt, Human
guacaaagcucaccaagccccugcccauguacagcccccagacccucugcaauaucacuuuuug

SEQ ID NO: 89898 - RNA, 64 nt, Human
ugaauacagcagucucaacugggggcaauuuugccccccagaggacauugggcaauguuuggag

SEQ ID NO: 89899 - RNA, 64 nt, Human
gggcgaugcugcagcggcugaaaccacgucaagucccccagagcccggcauucuauguaagcau

SEQ ID NO: 89900 - RNA, 64 nt, Human
aaauuccaggacaugguaaaauguguuuuaauaacccccagacccaaaugaaaauuucaaaguc

SEQ ID NO: 89901 - RNA, 64 nt, Human
aaacagggcuauuagggguaucagccacgucgagcccccagacucugugcacuucagaccagca

SEQ ID NO: 89902 - RNA, 64 nt, Human
cuucccaauuccaucaccacugccaacaacuccucccccagagaucuggcuggagcccagaaaa

SEQ ID NO: 89903 - RNA, 64 nt, Human
uugcaguaauuuauuuucuguauggacugucccucccccagaggcuuccccacccuccauugcc

SEQ ID NO: 89904 - RNA, 64 nt, Human
ccagccacugugggaccaacaccccucccacacucccccagacugcucgucuaucaccaggauc

SEQ ID NO: 89905 - RNA, 64 nt, Human
gggaaagcuguagaaggcaagaagacucgagaaucccccagaguuauuuuucuccauaaagacc

SEQ ID NO: 89906 - RNA, 64 nt, Human
aaguaaugggguguggggugccaccagaccaacacccccagacuuccccaccuucagccaccau

SEQ ID NO: 89907 - RNA, 64 nt, Human
ccugagacugguuuggaucucccugcaugacagucccccagaaacuuagugaguccuggacugg

SEQ ID NO: 89908 - RNA, 64 nt, Human
ggccaaggcagacauuggcccucccuucucccagcccccagaggccuggccuuggguucgucag

SEQ ID NO: 89909 - RNA, 64 nt, Human
acugcccccacugucccccuacccaccgauggagcccccagauagagcuggguggccuguuucu

SEQ ID NO: 89910 - RNA, 64 nt, Human
ggguccugagggggucuuuuggcuucagccuguucccccagaggcuugaucaucccacauuguc

SEQ ID NO: 89911 - RNA, 64 nt, Human
uagggcaucucauccagggauucucaaaccaugucccccagaggccuugggcugcaguugcagg

SEQ ID NO: 89912 - RNA, 64 nt, Human
caggacaccaguaaggagcuggaugaaugagaggcccccagaugcagagagacuggagagggug

SEQ ID NO: 89913 - RNA, 64 nt, Human
ccccuggggcugguggauugggcagaauccugggcccccagagaccuuugcccacacacacucc

SEQ ID NO: 89914 - RNA, 64 nt, Human
ucaucugaaagucaggccugcugcaggacaggaucccccagagaccccauuugccucucaacac

SEQ ID NO: 89915 - RNA, 64 nt, Human
uuaacuuuuuuuuuauuguggguuuugauuuuuucccccagaaauugguuuuauuugauguacc

SEQ ID NO: 89916 - RNA, 64 nt, Human
ucccaucagguuaaagacuucaucuagaugaugccccccagagaugccuuuaguguaaguagcu

SEQ ID NO: 89917 - RNA, 64 nt, Human
uuuuuuuuuauuucaaauuauaacacuuuuuuuucccccagaaguggguguuucauguugcuac

SEQ ID NO: 89918 - RNA, 64 nt, Human
uauggcucucgaaagcccaacuccaaguuccuuucccccagaaagcggggagaagccagaguuc

SEQ ID NO: 89919 - RNA, 64 nt, Human
cacacauaagugaaaauacggaaggcuuuggaaacccccagaugaacuucuauacaugugaaaa

SEQ ID NO: 89920 - RNA, 64 nt, Human
gugccaagaggaggugugaugacagcuauggaggcccccagaucucucucuccuggaggcuuua

SEQ ID NO: 89921 - RNA, 64 nt, Human
ccagccaagcugccuuaacucgccccucggggcucccccagagacugugccccgggcgggccgc

SEQ ID NO: 89922 - RNA, 64 nt, Human
guacaaauaguugcuucccacugccccccgcccgcccccagaaugauauuaauuuugccuuuuu

SEQ ID NO: 89923 - RNA, 64 nt, Human
ugccgagcccugcauguggagcccucccaccccacccccagauagagggaaauaaccaaaaaac

SEQ ID NO: 89924 - RNA, 64 nt, Human
agcgcugaucuucuauuuaauuccccacccaugacccccagaaagcaggagggcauugcccaca

SEQ ID NO: 89925 - RNA, 64 nt, Human
gcuuucuucccauuccccugcugucuauucuaagcccccagacucaagccucuagacucuugga

SEQ ID NO: 89926 - RNA, 64 nt, Human
cccuuugugugcaugggucagucaccauauguuccccccagagaaugugucuauauccuccuuc

SEQ ID NO: 89927 - RNA, 64 nt, Human
cuugauucacaaugaaaugcucuccuuuccccugcccccagaccuuuuauccacuuaccuagau

SEQ ID NO: 89928 - RNA, 64 nt, Human
acuuagcugucagugugacuuccuuucccacccacccccagaaaaacagaaagagcaucugggg

SEQ ID NO: 89929 - RNA, 64 nt, Human
aaagugcgguuucccaagccuuuguccaucucagcccccagaguauaucugugcuuggggaauc

SEQ ID NO: 89930 - RNA, 64 nt, Human
augaagugauccuuaacccccaaguaaucauuaacccccagaccagccucagaacugaaggaga

SEQ ID NO: 89931 - RNA, 64 nt, Human
ggucacagggggugucgggcggaggaaagugcaucccccagagcuuggguuccucucuccucuc

SEQ ID NO: 89932 - RNA, 64 nt, Human
aaggcaguaauugcauuuuaucugucucaugaugcccccagagaacuuccaacucaguaggacc

SEQ ID NO: 89933 - RNA, 64 nt, Human
ucccacaaccggccaaguuaugucuuauuauacacccccagaaagagagaaagcugccuucugg

SEQ ID NO: 89934 - RNA, 64 nt, Human
ccuccagcuuuucuuuuucuguauauacucaugucccccagauuccaacauuucucacugaaag

SEQ ID NO: 89935 - RNA, 64 nt, Human
ccugcccuagacccugccagaaaagggggcucuucccccagagaaguggcuuggagggaacuuc

SEQ ID NO: 89936 - RNA, 64 nt, Human
auuuggacaucuggggaaguggagauuaaccccucccccagacucgugccuugccucucaggac

SEQ ID NO: 89937 - RNA, 64 nt, Human
uacuucgagaguagcccugucuuguccccuccuacccccagauuagcaccaccccucucacucu

SEQ ID NO: 89938 - RNA, 64 nt, Human
uggaauguacucuggaucccuuccccugcuuugacccccagacuuugcuccaucuauuauugcu

SEQ ID NO: 89939 - RNA, 64 nt, Human
cuccugccuucugggcccagcccuggggccugugcccccagaggccuacaggggcaccaugcug

SEQ ID NO: 89940 - RNA, 60 nt, Human
acuuccagcagugugacuagggcaacgugccccccagaacucccugggcagagccagcuc

SEQ ID NO: 89941 - RNA, 64 nt, Human
cucuccugcuguaaccccacgcacaagccugcaacccccagagcucuuugacaggcucccaggc

SEQ ID NO: 89942 - RNA, 64 nt, Human
uaugguugacauucuuacucucaacaccuuggcucccccagaucagggccauuggugacaaugc

SEQ ID NO: 89943 - RNA, 64 nt, Human
cauuagcaaaggcaaaucuaagcaaucauuuuuccccccagaaguuacuuagaaggagaacugg

SEQ ID NO: 89944 - RNA, 64 nt, Human
ccaccuuugcugggcuuuucuaucacucccaccucccccagagucagggcuccauugcugagug

SEQ ID NO: 89945 - RNA, 64 nt, Human
gggaugucaaguggugaugucguugugcuccccucccccagagcgggugggcggggggugaaua

SEQ ID NO: 89946 - RNA, 59 nt, Human
ucaucugcgggguggugugaggcccuccucccccagaacccccugccguguuccucuuu

SEQ ID NO: 89947 - RNA, 64 nt, Human
cagagacccccgggauggggccucacacuugccacccccagaaccagcucaccuggccagagug

SEQ ID NO: 89948 - RNA, 64 nt, Human
cucgccugccgagggcugcgccccgugcugccuccccccagagggccacccgcugugcucgugg

SEQ ID NO: 89949 - RNA, 64 nt, Human
ccagggcagggcccgugccuuagacuucucccgacccccagagcgcugguacacaggucuaggc

SEQ ID NO: 89950 - RNA, 64 nt, Human
caagcuggcgccgacauggcgaaggcaaggucuucccccagaggcacauuccucuccaucuuuc

SEQ ID NO: 89951 - RNA, 64 nt, Human
guccaguggucagguuuccccugaccuucccucacccccagaaacacuugcuuacagaccgaaa

SEQ ID NO: 89952 - RNA, 64 nt, Human
guaacuggcacacgccccacgccuuccucuauaacccccagagacaggcuggggcagcgccaag

SEQ ID NO: 89953 - RNA, 64 nt, Human
aaacuuuguuugggucaagcuuccuucuuucuaacccccagacuuuggccucugagugaaaugu

SEQ ID NO: 89954 - RNA, 64 nt, Human
agggcccggagcaggguggggaggugcaguggcacccccagagccaacagagggagcaggcaga

SEQ ID NO: 89955 - RNA, 64 nt, Human
gucccugggcucuggacaagcacugggggacgugcccccagagccacccacuucucaucccaaa

SEQ ID NO: 89956 - RNA, 64 nt, Human
acacucccuuacccccggugccgggccgugcggucccccagacggacagcagcuguggcgaccu

SEQ ID NO: 89957 - RNA, 64 nt, Human
uccucccaugagguggggagaggcaacagggcagcccccagaggaguguccuggccgcuguccu

SEQ ID NO: 89958 - RNA, 64 nt, Human
ccaccaccuguaggaccuccucccacccacgcugcccccagagcuugggcugcccuccugcugg

SEQ ID NO: 89959 - RNA, 64 nt, Human
acuaacauaacuuauuaaaggaggggucccuccucccccagagcaguccucaacacuaugucag

SEQ ID NO: 89960 - RNA, 64 nt, Human
cagugcuggaaaugcagccacuggcagaucuggccccccagacgucaccgcagggccucugaag

SEQ ID NO: 89961 - RNA, 64 nt, Human
cucacacguugugcuuuuucugggcuucccuuaucccccagaacacucuaccaaccucggggaa

SEQ ID NO: 89962 - RNA, 64 nt, Human
aggaagcaaacagccaggcucccugagggccaggcccccagaccaucuuggguuggaauugagu

SEQ ID NO: 89963 - RNA, 64 nt, Human
uagauccagaugagauacagcucagagugccacgcccccagaaagaggaaucaggcaaguacug

SEQ ID NO: 89964 - RNA, 64 nt, Human
caaacuccccaaacccaaguugaaacaaaaaaaacccccagacuguaauaguauuauuauuauu

SEQ ID NO: 89965 - RNA, 64 nt, Human
uauuuaaaacaaaacaacacaaaaaaacaaugugcccccagaugucagaaugaggcgacuaggg

SEQ ID NO: 89966 - RNA, 64 nt, Human
gagcaagcucaccacagaggaguggaacugaggccccccagauguugccuccgguguccaagcc

SEQ ID NO: 89967 - RNA, 64 nt, Human
acuguggugacuucugcugcuggccccgccccugcccccagagcguccuuggcugccgucuggc

SEQ ID NO: 89968 - RNA, 64 nt, Human
uucauacugguuuaauuaagcucucuccugacaacccccagaauuaaaugaaccaugauuguga

SEQ ID NO: 89969 - RNA, 64 nt, Human
ggaccugugagaggcccaauggcccaauguacuucccccagaucccacucagaacagcagguac

SEQ ID NO: 89970 - RNA, 56 nt, Human
ccacagaggcccuggauugagccaggcccccagaaccccuggcuccaggccagggg

SEQ ID NO: 89971 - RNA, 64 nt, Human
accucaggaagaaggcccuacagauuugccaugucccccagacccugcuucugauacuaaggac

SEQ ID NO: 89972 - RNA, 64 nt, Human
ccagccucuuggcaccuccuguuuacuccccgagcccccagauucucaccuuugcccagagcca

SEQ ID NO: 89973 - RNA, 64 nt, Human
ugauucccaaauacauagcuccaacccccaacuucccccagacuuuagaucuguauugguauua

SEQ ID NO: 89974 - RNA, 64 nt, Human
gcaggcaggggcaggcugaggaguugcccuuugccccccagagacugacucucagagccagaga

SEQ ID NO: 89975 - RNA, 64 nt, Human
cucgugacuauacuggcauuucagauccaccccacccccagacucaucccacucucucccagca

SEQ ID NO: 89976 - RNA, 64 nt, Human
aacauaucaaaauaggauuucuuaaauuuuucaacccccagaccauacugacucaacauggagu

SEQ ID NO: 89977 - RNA, 64 nt, Human
cuauucuguuccacacccaaugcugcuccacccucccccagacacagcccaggucccuccgcgg

SEQ ID NO: 89978 - RNA, 63 nt, Human
uacuggguaaagacauguagcuguggcuuuggucccccagaggcauagauccuauccugggag

SEQ ID NO: 89979 - RNA, 64 nt, Human
gugugaauuugcacaccacugccugaauuggagccccccagagugucccucuacccagaguuuu

SEQ ID NO: 89980 - RNA, 64 nt, Human
ucucugacucucaaaucuuuuagucauuauagaucccccagacuuuacaugacacagcuuuauc

SEQ ID NO: 89981 - RNA, 64 nt, Human
ugccuugagaaguccugaguacagagacugguuccccccagacacgaguaacauggcaucuugc

SEQ ID NO: 89982 - RNA, 64 nt, Human
ggauuuggcuuuccugucccuuccccaugccagccccccagaguguucugccuugugcugccuc

SEQ ID NO: 89983 - RNA, 64 nt, Human
acccgcacaugggggucgcugcccuucacuccuacccccagaggccuuggccaagcugcugcuu

SEQ ID NO: 89984 - RNA, 63 nt, Human
ugcgggacgagaaccaguaggcccuguucugggcccccagaaccccuuccucuccacugcagg

SEQ ID NO: 89985 - RNA, 64 nt, Human
ggccacacaaagucccuacgccucccugcugccucccccagaugcaugugguggcaucaccauu

SEQ ID NO: 89986 - RNA, 64 nt, Human
uugcagggcagacagugccuggcacugaggggugcccccagaccccgcugggacuggaugugcc

SEQ ID NO: 89987 - RNA, 64 nt, Human
ccagcucugccucgcagcccccucagcaugggugcccccagaaguaagcagcucuuggacccac

SEQ ID NO: 89988 - RNA, 64 nt, Human
ugugguucagguggggucuccagaaggcugcuugcccccagagagccaucucuuccauuuuuga

SEQ ID NO: 89989 - RNA, 64 nt, Human
caaggucugugggcucuaggcagcccggcagcagcccccagaggaacugcucccaccucuccuu

SEQ ID NO: 89990 - RNA, 64 nt, Human
aggauccugaccugacuauccaugccauccauggcccccagacugacucugcaccuggcccuuu

SEQ ID NO: 89991 - RNA, 64 nt, Human
gggggcugagucuucccuggccccuuggaagaggcccccagaugcccaggcucacuucaguguu

SEQ ID NO: 89992 - RNA, 64 nt, Human
cccaggggagaggagagcugugagagcaccggcacccccagaagacucugcuucuuagcccaca

SEQ ID NO: 89993 - RNA, 64 nt, Human
ugucuacauguuugcuuagaggcggcuccaagagcccccagagcugccugcauagcacaccuua

SEQ ID NO: 89994 - RNA, 64 nt, Human
cuagcuuuuagcuauaaaccacucaaagauucagcccccagaucccacagucagaacugaaucu

SEQ ID NO: 89995 - RNA, 64 nt, Human
gcucaauucucagggcuggaaugagccggcuggucccccagaaagcuggagugggguacagagu

SEQ ID NO: 89996 - RNA, 64 nt, Human
gcgauggcuacaagggcuacgaccuggucuacagcccccagagcggcuucaccugcgugucccc

SEQ ID NO: 89997 - RNA, 64 nt, Human
augggacaccaggccugacucaggcagguucugccccccagaccccacacacggccgccccacg

SEQ ID NO: 89998 - RNA, 64 nt, Human
cccaccgggucugggcucuggaaggagccagaugcccccagaaaggugggugguggagacggca

SEQ ID NO: 89999 - RNA, 64 nt, Human
caggcguggagguguccccaccccuuccaccugucccccagacccaaagcucucuccccacccu

SEQ ID NO: 90000 - RNA, 64 nt, Human
ggcacuggcccugccacagagaugccacuggggacccccagacaccaguggcuugacuuugagc

SEQ ID NO: 90001 - RNA, 64 nt, Human
uuacaccucagcaaaugcugcaaaauccuguuuucccccagagagcuggagguuaaauacuacc

SEQ ID NO: 90002 - RNA, 64 nt, Human
gaaaaauuuuaaaaauuugcuuaugaaaauauaacccccagaaaguaacaaugacaaaguauua

SEQ ID NO: 90003 - RNA, 64 nt, Human
gagacccagcuccugcagcccuccugcucccacgcccccagacagcuugguggaggguccugca

SEQ ID NO: 90004 - RNA, 64 nt, Human
gggcugccuggcauuacuccuccaaagacugcugcccccagaacaggcagggggugugggaggg

SEQ ID NO: 90005 - RNA, 64 nt, Human
auggcgggaaaacacugacugacuccuuggguuucccccagacauacuuucagagcgcuagcug

SEQ ID NO: 90006 - RNA, 64 nt, Human
ccagcccuggacugaggauggaugguuccaugagcccccagaugaaaaccuggauucgacaggg

SEQ ID NO: 90007 - RNA, 64 nt, Human
aaaagagacagagccucagccagggagagugagucccccagaagaggcugggugguugcacagg

SEQ ID NO: 90008 - RNA, 64 nt, Human
gguuuuaacauauuuaaauacaugugcaaucauccccccagacaaauuguguuuucuaaaggau

SEQ ID NO: 90009 - RNA, 64 nt, Human
agacuaugggaaaauaaauuaugauuguaugugacccccagaucacuaagcuugcauuuuggca

SEQ ID NO: 90010 - RNA, 64 nt, Human
cauguguucagcucaagacuccacaggaauucaacccccagaaagacauaaacuuggaguccgu

SEQ ID NO: 90011 - RNA, 64 nt, Human
uuaaauaaccuacagcuugggucuauggcugugacccccagauucauggaggggcuuuagccau

SEQ ID NO: 90012 - RNA, 64 nt, Human
gcagaugggccaguccagggccuaccccgccuugcccccagaucccacugggguccauuugggg

SEQ ID NO: 90013 - RNA, 64 nt, Human
uaccugcacccaggccucagaguuucagggcuaacccccagaauacugguaggggccaaggcca

SEQ ID NO: 90014 - RNA, 64 nt, Human
acccccgccaggcugcccaucagggcccagggagcccccagaggacuuuauucggaccaagcag

SEQ ID NO: 90015 - RNA, 64 nt, Human
aacccacugaacacuaauuaugagcccugucuuucccccagaaugccucccuggguuucacaaa

SEQ ID NO: 90016 - RNA, 64 nt, Human
ugggcccagcuugcucagucaaggggcugccaggcccccagaaaacacuuggagccaucgggua

SEQ ID NO: 90017 - RNA, 64 nt, Human
aauucagcacgcacacaacacacaagggagagaacccccagaugagaaaauaggaaggagcaau

SEQ ID NO: 90018 - RNA, 64 nt, Human
agaguuucagaaaaugacugagaaggagcgauaacccccagaaugcaaaaucaggggcaucauu

SEQ ID NO: 90019 - RNA, 64 nt, Human
augggagcuuggagcuaauacgacacucugccuucccccagaaggugcaggcuuuccugagucu

SEQ ID NO: 90020 - RNA, 64 nt, Human
ccagggaaggaggcuggggugggaacacuggccucccccagaauaaaaccauguuuucuaccag

SEQ ID NO: 90021 - RNA, 64 nt, Human
uagcgccaucaugggcugauuuuuauuaccaggucccccagaagcaggugggaggcucugcuuc

SEQ ID NO: 90022 - RNA, 64 nt, Human
caaaguucaaaucggggcagaggcugcacuugugcccccagauguuucugaggagccagacuag

SEQ ID NO: 90023 - RNA, 64 nt, Human
agaugguaucuuuccuggccaugacagugugauucccccagaggaagcagaaggaaguuaaagg

SEQ ID NO: 90024 - RNA, 64 nt, Human
aauugugagcucauuuuucuuuguuacuuuuguccccccagauuugggggacaaaauaaaauua

SEQ ID NO: 90025 - RNA, 64 nt, Human
gagugagggaaugguaguuaaggcuucuuuuuugcccccagauacauggugaugguuagcauau

SEQ ID NO: 90026 - RNA, 64 nt, Human
aauccaaggcugagacagucgugcgacuccuacucccccagagcgugacccggagcaggugcug

SEQ ID NO: 90027 - RNA, 64 nt, Human
cuccauggcaggcaucccugccuugggcugcccucccccagaccccugaccacccccugggucc

SEQ ID NO: 90028 - RNA, 64 nt, Human
acaaugagagaccaggaguagguccuaucagugccccccagaguagagagcaauaagagcccag

SEQ ID NO: 90029 - RNA, 64 nt, Human
cagcaccaaaaggcagaagguggaagccguuuuucccccagagcccuguguuuuugugaaagcc

SEQ ID NO: 90030 - RNA, 64 nt, Human
gaaggcuuguuaaaacccaaggcugcuaggcccacccccagaguuugauacaguagaccucagg

SEQ ID NO: 90031 - RNA, 64 nt, Human
guucucccuguugucucaaagcgguacccauccucccccagaagcuguccccagcgagccuccc

SEQ ID NO: 90032 - RNA, 64 nt, Human
acuccugcugggccuucggggucucaguuggcuucccccagauucugauucuacagcugcagaa

SEQ ID NO: 90033 - RNA, 64 nt, Human
gaggugaaccagggaggggcagggcaaggcagggcccccagagcugggccacacagugggugcu

SEQ ID NO: 90034 - RNA, 64 nt, Human
cagcagcacaauucugucccugucccugccccgccccccagagccagggcuguccuuagacucc

SEQ ID NO: 90035 - RNA, 64 nt, Human
cgucuguaggguccccugaaaaucccacuuccugcccccagaaagggccuuuauuuccaacuag

SEQ ID NO: 90036 - RNA, 64 nt, Human
cagugccaagccuguggaucaggaauaucaacagcccccagagaguggugcuggcugagggucu

SEQ ID NO: 90037 - RNA, 64 nt, Human
gucacccuccucccccauggagguuuccaggggucccccagacaugaaagaggggugagcugga

SEQ ID NO: 90038 - RNA, 64 nt, Human
gauagucacauguuuuucuuccuuguccccacggcccccagaacaacauucucccugcuggcag

SEQ ID NO: 90039 - RNA, 64 nt, Human
aguaacccuaggcucagagacccaauuuuuuaagcccccagacuccuuagcccucagagccggc

SEQ ID NO: 90040 - RNA, 64 nt, Human
uccuccucgccccuuucuucaccccgccccccaacccccagacuuuccuggagcaucugcccuu

SEQ ID NO: 90041 - RNA, 64 nt, Human
auugcuucuugugaaaccacaggcccuugggguucccccagacagagccgcaaaucaaccccag

SEQ ID NO: 90042 - RNA, 64 nt, Human
cggccccggggcaaagaggggugcagagggaguucccccagaucaguaccccccaccccucccc

SEQ ID NO: 90043 - RNA, 64 nt, Human
ggagauaaaaacaccuuuggggacugguuaaagucccccagaaacuacaauaaagaacaacuuu

SEQ ID NO: 90044 - RNA, 64 nt, Human
gagccuuugccaugguacuuagguagggugugugcccccagauuuaaccauuccauaaucaugu

SEQ ID NO: 90045 - RNA, 64 nt, Human
ggcccaacuuagacgcggcucuccuccggcagggcccccagagggcagaagcagcguggagggg

SEQ ID NO: 90046 - RNA, 64 nt, Human
gcagcagcuccgcucccggcgccacccaccgacacccccagaacccucugggggccugcccagg

SEQ ID NO: 90047 - RNA, 64 nt, Human
uugcuucccaucugaagaguggaaauggggaacucccccagagguggauacuggggggcaggcc

SEQ ID NO: 90048 - RNA, 64 nt, Human
acccuucaccugcugucccuucuuaacacccaggcccccagagccagcugggccuguccagcag

SEQ ID NO: 90049 - RNA, 64 nt, Human
cuggccugcgagugaccccagcagccccucagcgcccccagagcccgucagcgugggggaaagg

SEQ ID NO: 90050 - RNA, 64 nt, Human
ccacagugucugcagcugcugcccuucucccaggcccccagacagaagagacccuguuuccccu

SEQ ID NO: 90051 - RNA, 64 nt, Human
gccagguggccacuuuauggaaaggaugcagggucccccagaccccuccucuagcccagcagcg

SEQ ID NO: 90052 - RNA, 64 nt, Human
caaggaauccucugggagcuucuuccguuucuuccccccagauacccaucuugaaaaacacuau

SEQ ID NO: 90053 - RNA, 64 nt, Human
gacaaauuugauuucaaagagcaaugcaucuucucccccagaucaucacagaaaucacuuucag

SEQ ID NO: 90054 - RNA, 64 nt, Human
guugaaaucgguguaguauccugagguuuuuuuccccccagaagauaaagaggauagacaaccu

SEQ ID NO: 90055 - RNA, 64 nt, Human
cacagcgcagaagccccugcccacgggauccggccccccagacaccgaccccacaggccguccc

SEQ ID NO: 90056 - RNA, 64 nt, Human
caaacaugcagcccccacaccccucgucugcccgcccccagaucuucccucugugcucccugcc

SEQ ID NO: 90057 - RNA, 64 nt, Human
uaggcugagucuagugccccuauuauuaacaauucccccagaacauggaaauaaccauuguuua

SEQ ID NO: 90058 - RNA, 64 nt, Human
ccagagcaccucccagccaccguccccucaagagcccccagaacgagacccuguacucugucuu

SEQ ID NO: 90059 - RNA, 64 nt, Human
agccagcggaacaguuucuauuacccccucccugcccccagacccaugugauuucugcuuucuu

SEQ ID NO: 90060 - RNA, 64 nt, Human
ccaggcuguaagucuagaauuuagauauccugaucccccagauaccgcucuucugguuauacac

SEQ ID NO: 90061 - RNA, 64 nt, Human
ccgagguggggacagugagugaguucucuuaguccccccagagcugguuguuaaagagccuggc

SEQ ID NO: 90062 - RNA, 64 nt, Human
cuccgguuggggguccccaggguggggcagggaucccccagaucugucuggucugaauggacgc

SEQ ID NO: 90063 - RNA, 64 nt, Human
caaucacuagaccggacuugaggcacgcggugcacccccagacgcuggcgcuccaccgugcucg

SEQ ID NO: 90064 - RNA, 64 nt, Human
ggcuccauggaggaggugucccaagcuuugaauacccccagagaccuuuucucucccauaccau

SEQ ID NO: 90065 - RNA, 64 nt, Human
aagcugcgccccaccuuuccagauacccacaaagcccccagacagaaucuagcaucgggacuau

SEQ ID NO: 90066 - RNA, 64 nt, Human
gagagagaagggaaggggaguguccccagccaaccccccagaaacggccuuuuuuccugccucu

SEQ ID NO: 90067 - RNA, 64 nt, Human
uccagcgugcagccuugccucggaggccagcccacccccagaagccaggaagcccccgcgcugg

SEQ ID NO: 90068 - RNA, 64 nt, Human
gggggagccuaggcccagcuccuccgcgguuggccccccagaccauaccucugacccacccagc

SEQ ID NO: 90069 - RNA, 64 nt, Human
cccugccacagggcacuggaauggacagcaggcgcccccagaugcagguaccucccuugguccc

SEQ ID NO: 90070 - RNA, 64 nt, Human
cacagacacugaccucagaggccccacucuggugcccccagacccugggcccccagccucuggc

SEQ ID NO: 90071 - RNA, 64 nt, Human
gaaggaaagggaagaagagaucacgaaacugggacccccagaagggaggagugggcuuugaacu

SEQ ID NO: 90072 - RNA, 64 nt, Human
uuuguggguuaugaggacacagaagucccugaggcccccagaccuggcucagccaaccuccuuc

SEQ ID NO: 90073 - RNA, 64 nt, Human
agacuguuaaaagcagguuucuguacuuaagagucccccagaccuccugugaggugaggcucug

SEQ ID NO: 90074 - RNA, 64 nt, Human
ucuaaauugcugcucuggaauaaggugauuucugcccccagauucuucccuagccgguagauac

SEQ ID NO: 90075 - RNA, 64 nt, Human
auucacucuaauuauaaacagggaguguaaacugcccccagauguuccugggcuggguaaaagc

SEQ ID NO: 90076 - RNA, 64 nt, Human
cuuuagauaccuuguugccaugguuugaaugugccccccagauuucaugugugugaaacuuaau

SEQ ID NO: 90077 - RNA, 58 nt, Human
uggucaccaccugcgccugaggaucgggcccccagauccccacuuuuccccuccagug

SEQ ID NO: 90078 - RNA, 64 nt, Human
cagugacacguggacaaaugcgggcucaucagcccccccagagagggucaggccgaaccccauu

SEQ ID NO: 90079 - RNA, 64 nt, Human
ucugaguccagcuccccccaagaugagcugcagccccccagagagagcucugcacgucaccaag

SEQ ID NO: 90080 - RNA, 64 nt, Human
aaagaggacugagaauacuuuggcuuaaauuuugcccccagaaucuuguuguuugccuacugaa

SEQ ID NO: 90081 - RNA, 64 nt, Human
aauuuucauguguacaccucuuugccuguucccacccccagacuugaaauaacacuucagagua

SEQ ID NO: 90082 - RNA, 64 nt, Human
cuuaugaaaaaaaaauagcaaauuaguucuuuuucccccagaggggaaaguuauguucugcaaa

SEQ ID NO: 90083 - RNA, 64 nt, Human
ugggcccugugcccuccuagaggagcaggcaccucccccagacuuggggugggggcccugccag

SEQ ID NO: 90084 - RNA, 64 nt, Human
cguuaggccucccagguccuuaggaucaggguugcccccagaaccccuucccauauccuccauu

SEQ ID NO: 90085 - RNA, 64 nt, Human
cuggggagguggggaagauucgggcaugugagugcccccagaacuguccuggcuccuuccguau

SEQ ID NO: 90086 - RNA, 64 nt, Human
cugugcaugcugguggccucagggacccucauaacccccagacucagagcccgagagcccuucc

SEQ ID NO: 90087 - RNA, 64 nt, Human
cagagagguggggugagggugagcuuacucagggcccccagaggaagcccucagccucugcccu

SEQ ID NO: 90088 - RNA, 64 nt, Human
agaagagccagccaagaucacccaggagcuugugcccccagaugggccaaagaaagagccuaug

SEQ ID NO: 90089 - RNA, 64 nt, Human
cucccugcccccugugacggagggggcaagcaagcccccagaggcugugucucuggacagacgg

SEQ ID NO: 90090 - RNA, 64 nt, Human
ugaggucauaauaucccucuaggacuuaccuguucccccagaucuugccuugggaccacauuug

SEQ ID NO: 90091 - RNA, 64 nt, Human
caaucuuaacuaccuacccaaaggauuugcauuacccccagauucugugccaacaaccuuuuaa

SEQ ID NO: 90092 - RNA, 64 nt, Human
ggaggaccgaggcuacagcuccacacgccccggucccccagagcaucugccccagguacaccuc

SEQ ID NO: 90093 - RNA, 64 nt, Human
gaaggaagagggggagcugguuuuucuggagguucccccagaggcccuccuguccgaaaagaaa

SEQ ID NO: 90094 - RNA, 64 nt, Human
acaccuugucccuucccgcagcauuuccugguuccccccagacccuugagcgcucuuugggacc

SEQ ID NO: 90095 - RNA, 64 nt, Human
cuccuggggcagagccuccggcacccaguggccucccccagacagagccaccccugccguggga

SEQ ID NO: 90096 - RNA, 64 nt, Human
ggauuggcaagaaacagggugucuuggagguggucccccagaucugcgccugggggucaggaca

SEQ ID NO: 90097 - RNA, 64 nt, Human
ccugccagccccggcauccuggaagucccgacuccccccagaccugccagccccggcguccugg

SEQ ID NO: 90098 - RNA, 64 nt, Human
gucccuguacaucuaauauauacugauuuguuugcccccagagaauuuuuaagguaucugccua

SEQ ID NO: 90099 - RNA, 64 nt, Human
agagggugaguguggucagaguaaagcugcuccacccccagauugcaaugcuaccaauaaagcc

SEQ ID NO: 90100 - RNA, 64 nt, Human
auuaccugggaaaucuuaacagaaagguaaugggcccccagaaauacccacagcauagugaccu

SEQ ID NO: 90101 - RNA, 64 nt, Human
aggaggcucugggcuuccugcuucuuccccgcuucccccagaguucacagauguugaaguuucu

SEQ ID NO: 90102 - RNA, 64 nt, Human
ccugcaggaacugaaaacaucagccauggccaggcccccagaagacaaaagaagggaccaggga

SEQ ID NO: 90103 - RNA, 64 nt, Human
uuaucucagaacagaagucaucagaucaucagagcccccagauggcuacagaccagagauucca

SEQ ID NO: 90104 - RNA, 64 nt, Human
aggaagcugaccgcacaguguccagacgaauuggcccccagaagauggggaguucuguccugcc

SEQ ID NO: 90105 - RNA, 64 nt, Human
uaucuguuuacauccagaguucugugacacaugccccccagauugcugcaaagaucccaaggca

SEQ ID NO: 90106 - RNA, 64 nt, Human
cucccaaccacauguagccaauuccucacucaggcccccagagugagccuuugaaauggaacag

SEQ ID NO: 90107 - RNA, 64 nt, Human
gaauucuguggcugugcugcguuucagaaaauaacccccagaggccuugggcuguggaccuggg

SEQ ID NO: 90108 - RNA, 64 nt, Human
cucccucucaaccucaacccaccugcaugcaucucccccagaggaaacacugaggguaggggac

SEQ ID NO: 90109 - RNA, 64 nt, Human
agccagaguugccucuccuccuccucuuccccaacccccagaccaugaccagccuuagaaaauc

SEQ ID NO: 90110 - RNA, 64 nt, Human
cugcuaauacuuucucccuaauggaagcccugaucccccagagagcuacaggucugcucccgac

SEQ ID NO: 90111 - RNA, 64 nt, Human
aucagcccuacguccagagggagaggagccgacacccccagagccagugccccaucuuaagcau

SEQ ID NO: 90112 - RNA, 64 nt, Human
ccuggcugcuucagcagguggauccauucuucgacccccagaugugacucuaaagaaggcugaa

SEQ ID NO: 90113 - RNA, 64 nt, Human
aggcccugugccauagggguggccacccgaccugcccccagaacuuuuggauacuggaggcagu

SEQ ID NO: 90114 - RNA, 64 nt, Human
cugaagauuaguucaggggauggaccaagaauuucccccagagcuuuaaagaagugggacucag

SEQ ID NO: 90115 - RNA, 64 nt, Human
ugcuuagaaagcugucuuuucagugguguugcagcccccagauguguggccaaccucugcugca

SEQ ID NO: 90116 - RNA, 64 nt, Human
uggccucucaucaggaucugccccccagagaccccccccagacacugcagggccuggugaugcu

SEQ ID NO: 90117 - RNA, 64 nt, Human
caguaaaggcuccuggccucucaucaggaucugccccccagagaccccccccagacacugcagg

SEQ ID NO: 90118 - RNA, 64 nt, Human
uccaaaacuguucuuuuagguucaaaaccuaauucccccagauuaguauacucgagaauucaaa

SEQ ID NO: 90119 - RNA, 64 nt, Human
aaccaguaucugucccgagaggaaauuccccccacccccagaaguuuacagaaaacugccucuu

SEQ ID NO: 90120 - RNA, 64 nt, Human
cuugcccauuucccugccccaaggcccagagcuccccccagacuggagagcaagcccagcccag

SEQ ID NO: 90121 - RNA, 64 nt, Human
ccugccaccugagaagauggaaaggaaggagcugcccccagagcaucaguccuugaagagcagc

SEQ ID NO: 90122 - RNA, 64 nt, Human
ugccacuuuaggauggcgaugcaggugucuuuuccccccagaucuccucuuccuucagcaaagg

SEQ ID NO: 90123 - RNA, 64 nt, Human
uacccucccaguuggccagaaucugaggggagagcccccagagagcccccuuccccaucagaag

SEQ ID NO: 90124 - RNA, 64 nt, Human
aaagaauuuagcugcaaguggacaaaggaacaagcccccagaaaagaaagggaagaacugccuu

SEQ ID NO: 90125 - RNA, 64 nt, Human
uccaccuuugcaaagaaaggaaaaacacaaauugcccccagauuggcccaguggcaugccauua

SEQ ID NO: 90126 - RNA, 64 nt, Human
aucccacguacucuaucuuccauuccucgcccugcccccagaggccaggagcucugcccuugac

SEQ ID NO: 90127 - RNA, 64 nt, Human
ugaggcacagccugugcagagagggugggucacccccccagauccaaggagaaacugcagguca

SEQ ID NO: 90128 - RNA, 64 nt, Human
gcccacaugcaccccuggccucagcaucccgguucccccagacaagagagggcaagucagccag

SEQ ID NO: 90129 - RNA, 64 nt, Human
uguugcacccggggcugcaaacgucuccgugcagcccccagagagaggcccaugggcucagacc

SEQ ID NO: 90130 - RNA, 64 nt, Human
agcuggggguccgcaucccuaccucagcuuaggacccccagagccaagguggcugggaucuggc

SEQ ID NO: 90131 - RNA, 64 nt, Human
caucugugguccaggccggcaucguccuggccaccccccagaucuggugccugcuggccggccc

SEQ ID NO: 90132 - RNA, 64 nt, Human
gggcacagugcugccccuugcaagccauaacgugcccccagaguguagggggccuugcggaagc

SEQ ID NO: 90133 - RNA, 60 nt, Human
aagaagauuacgacuccuagcgccuucugccccccagaccauagccccuuuuaguugguu

SEQ ID NO: 90134 - RNA, 64 nt, Human
aggagccuccaggauggagauggagacccagcagcccccagacuacuucuaucccugaaaacac

SEQ ID NO: 90135 - RNA, 64 nt, Human
agagacuguccuugggccuccucuggaagcagcacccccagaggacagggcuccuccugcuugc

SEQ ID NO: 90136 - RNA, 64 nt, Human
ugagaagaucuucaccauuaggaagaucucuagacccccagaucucagaaucaggccuauuugu

SEQ ID NO: 90137 - RNA, 64 nt, Human
uaaaacuaggugcugcagccccugggaccaggcacccccagaaugaccuggccgcagugaggcg

SEQ ID NO: 90138 - RNA, 64 nt, Human
ucugucccaugugaagugguagugcggugccuuucccccagaucaugcuuuaauucuuucuuuu

SEQ ID NO: 90139 - RNA, 64 nt, Human
caggcuggagacuggaccgcugacugcaccagcgcccccagaacauacacugugaacucaaucu

SEQ ID NO: 90140 - RNA, 64 nt, Human
ggugggacacccgagcugcacguuccuauacggccccccagacccagcuguccgggccacagac

SEQ ID NO: 90141 - RNA, 64 nt, Human
aggcuguggcugcggccgggagcccgccccgcuucccccagagacuguaucguggcaccguggc

SEQ ID NO: 90142 - RNA, 64 nt, Human
uuuggaucuuuccagggauagccaaugauuuuaucccccagaauccuucaccuuucaaggaguu

SEQ ID NO: 90143 - RNA, 64 nt, Human
gggaaaauaccagaaaaugagggccgcuuugagucccccagagaugucaucagagcuccucugu

SEQ ID NO: 90144 - RNA, 64 nt, Human
ucagggaaacugggcugugagccacacacuucuccccccagacagggacacagggucacugagc

SEQ ID NO: 90145 - RNA, 64 nt, Human
uggagccagguucacggggcuguuuccuccuccucccccagauguccccccugucaccgggcag

SEQ ID NO: 90146 - RNA, 64 nt, Human
ccaagcaacacagaccacucuuccccuugccccucccccagagggacuugacuuucuuucugga

SEQ ID NO: 90147 - RNA, 64 nt, Human
cuaguuccuaguuguucuuacccugcuucuuucucccccagaaucgacauaguccagaccaccc

SEQ ID NO: 90148 - RNA, 64 nt, Human
cuuggccaugggaggccuuucccuaagccagcugcccccagagccacaguuccccuauguggaa

SEQ ID NO: 90149 - RNA, 64 nt, Human
ccuggggcuuuuccauuuaacacauggagcccuucccccagaaggcuacuuccuuguuuuagag

SEQ ID NO: 90150 - RNA, 64 nt, Human
cccuucucuuucccuuauuuaggagcccugaacucccccagagucuauccauucaugccucuug

SEQ ID NO: 90151 - RNA, 64 nt, Human
uucuagcugccggccucuggaggcuccgagccugcccccagagacgucccugccccuccaggac

SEQ ID NO: 90152 - RNA, 64 nt, Human
acuugagucugaggccccaggcccuaggauuccucccccagagccacuaccuuuguccaggccu

SEQ ID NO: 90153 - RNA, 64 nt, Human
ucucaguuguccccugcauggggagauacacuaacccccagaaaugacugcuaagccucuugcc

SEQ ID NO: 90154 - RNA, 64 nt, Human
cuagaggcaagaguucagugagggccaagggggacccccagaaaaagguauggagcuaacucau

SEQ ID NO: 90155 - RNA, 64 nt, Human
aaguccuucaauucuacagcagaggaaauaaaaucccccagaagccaaagggcucaccuucaca

SEQ ID NO: 90156 - RNA, 64 nt, Human
acuuuauguugcuuuguucaguaccuuuugaauucccccagaagaguuguuuucaaaacaaaca

SEQ ID NO: 90157 - RNA, 64 nt, Human
ccagcuccuuccugugggcugccacagacagcuacccccagaagggucaauguugggagugguu

SEQ ID NO: 90158 - RNA, 64 nt, Human
uuucccuggugcccuucccuggaggucucucccucccccagagccccucaugccacagugguac

SEQ ID NO: 90159 - RNA, 64 nt, Human
ccugggaagguccagcuaaaaguggcaacauuugcccccagaauugggggccugggaacacugg

SEQ ID NO: 90160 - RNA, 64 nt, Human
accccuuggcauagggcccugccccgucggacugcccccagaaagccuccugcccccugccagu

SEQ ID NO: 90161 - RNA, 64 nt, Human
augggcaaggcgcugagggaggaugcuuaggggacccccagaaacaggagucaggaaaaugagg

SEQ ID NO: 90162 - RNA, 64 nt, Human
gacagauggccuucuuugucaucuucacucuccacccccagagaggagucagagccauaacuca

SEQ ID NO: 90163 - RNA, 64 nt, Human
aauaauuaauaauaauaauaaacccaacacccaucccccagaagacuuuaucucuauacauugu

SEQ ID NO: 90164 - RNA, 64 nt, Human
cugauugggcaauugugggcccaugggguggaagcccccagaugacugagcaguucuacaaaag

SEQ ID NO: 90165 - RNA, 64 nt, Human
guauuuaaggacuggggcauagcaugggggcagucccccagaccucuucauucccccuccugug

SEQ ID NO: 90166 - RNA, 64 nt, Human
ggguaagaaaugagccuagucaccaagaacuccacccccagaggaaguggaucugcuucuccag

SEQ ID NO: 90167 - RNA, 64 nt, Human
auauucucuugucuggcugcaccccuuuuucccgcccccagauugauaaguaaugaaagugcac

SEQ ID NO: 90168 - RNA, 64 nt, Human
gggaucucaggcagggugugcgucagcccuccaacccccagaggggcgccuguggggagggaac

SEQ ID NO: 90169 - RNA, 64 nt, Human
ccccugaggcuccaccacccacccuuucauuucccccccagaagccuaaggccuaauagcugaa

SEQ ID NO: 90170 - RNA, 64 nt, Human
ccccacagaguuaaaacuugggauuccccuggcccccccagaacacuuguauauuguuuguuug

SEQ ID NO: 90171 - RNA, 64 nt, Human
ugaaucaagucggugaacugccccuggccugugucccccagagcagcccaggguccugccagag

SEQ ID NO: 90172 - RNA, 64 nt, Human
uuccagagagaagcuagaagucccccuugaaugacccccagagccccucugagaagggcuggag

SEQ ID NO: 90173 - RNA, 64 nt, Human
uuuggggcagagggacaggcuccucuggggaaaccccccagagcucuuuaccaaggaugaaaga

SEQ ID NO: 90174 - RNA, 64 nt, Human
uuuauggcacgauuccuuuggauggcuucauuugcccccagacuguaugaaaacaucuccgaau

SEQ ID NO: 90175 - RNA, 64 nt, Human
cugauaaauugagggcacuuguacccucccugugcccccagaagguucuuggagagaagugcaa

SEQ ID NO: 90176 - RNA, 64 nt, Human
cgccccccggagguggcagcagccccgagggacgcccccagaggaccgggaggcaccccacccu

SEQ ID NO: 90177 - RNA, 64 nt, Human
augcuuucucuacucccugccucaaaccaccccucccccagaugguacuucaguuuggaucuau

SEQ ID NO: 90178 - RNA, 64 nt, Human
ccauuuucauucuuguauuauaauuaauuuucuacccccagagauaaauguuuguuuauaucac

SEQ ID NO: 90179 - RNA, 64 nt, Human
gggcccauggucaguauugcaccuguguuaugaacccccagaugcugugcagggcaggggcggg

SEQ ID NO: 90180 - RNA, 64 nt, Human
ccaugcccaucagucucugcaguuucucuaccugcccccagagcugaggccaucugcaagcccc

SEQ ID NO: 90181 - RNA, 64 nt, Human
gaaucagccagugccuugcucuuggacuucccagcccccagaacugugagaaauaaauuucugu

SEQ ID NO: 90182 - RNA, 64 nt, Human
ccccugcaccagagccugcucuuagcucccggugcccccagaccccgcagcucugugcccggca

SEQ ID NO: 90183 - RNA, 64 nt, Human
cggugauggcuuugucccaucauagggggguguccccccagagacaaagcugcagagcacauuc

SEQ ID NO: 90184 - RNA, 64 nt, Human
cuuguugcccuagagugggacccagcccucaccucccccagagcuaaccugggaggugcugaag

SEQ ID NO: 90185 - RNA, 64 nt, Human
gccuccauuccuacuaaggggcucugagcuucugcccccagaaucauuccaaccgacccacugc

SEQ ID NO: 90186 - RNA, 64 nt, Human
gcgcgccugcggggaacguaggcgggagucgugccccccagaccgguguucgcaucgcuggcuc

SEQ ID NO: 90187 - RNA, 64 nt, Human
caucucccaaaucccaaaugccacuccaaguacccccccagauaccaugucaggauauuuuuag

SEQ ID NO: 90188 - RNA, 64 nt, Human
agagccaccaaaaguuaggggacuucaguccuagcccccagauggccgcccugaagcucucugg

SEQ ID NO: 90189 - RNA, 64 nt, Human
accaauagacuggugagaggagaaaggagcuuaucccccagacccugcuuuauaccauucacau

SEQ ID NO: 90190 - RNA, 64 nt, Human
aucucuguguguccccucuugacacucacuguuucccccagagcuaacuauccugacguauggu

SEQ ID NO: 90191 - RNA, 64 nt, Human
ugaccacuucucuaccauugucccccacccccaccccccagaauaacgcugacuguccccugaa

SEQ ID NO: 90192 - RNA, 64 nt, Human
ggagaacuguaugucauggaguccucuugacguucccccagauacaaguaaagcacagguggau

SEQ ID NO: 90193 - RNA, 64 nt, Human
cgaugcccagagacacagcccccacggacaaaaccccccagauaucaucuaccuagauuuaaua

SEQ ID NO: 90194 - RNA, 64 nt, Human
gcagaacagguaguauuacaccaccggcccccuccccccagacucuuuuuuugagugacagcuu

SEQ ID NO: 90195 - RNA, 64 nt, Human
ccagcucagacucuaagcucaacaagcccuugagcccccagaaggagaccgcuaacucucagca

SEQ ID NO: 90196 - RNA, 64 nt, Human
ccugucugggucacuuuuuaagcuuguaaccgcccccccagacuuauaaucuuaaauguauuuu

SEQ ID NO: 90197 - RNA, 64 nt, Human
uuucagcaguuugccacugugacugucuggcaagcccccagauggcguuauauuaauuggauua

SEQ ID NO: 90198 - RNA, 64 nt, Human
gaauuagcaccccacccccauaccccuucuuccacccccagacuaaaggaagauacuuacucuc

SEQ ID NO: 90199 - RNA, 64 nt, Human
aguuuugggggaaagauggaguuccuauccagagcccccagauuuccagaaucgagugagcuuc

SEQ ID NO: 90200 - RNA, 64 nt, Human
acugggaauccuagggggcuccaugacaccuucccccccagacccagacuugggccguugcucu

SEQ ID NO: 90201 - RNA, 64 nt, Human
aaugagcagagauggcagagggcagagcacauggcccccagaggcuuccagucucacugacaca

SEQ ID NO: 90202 - RNA, 64 nt, Human
agcugagaggagacccuagcaucuccauguccaucccccagaccuccccugagacgcugugcca

SEQ ID NO: 90203 - RNA, 64 nt, Human
ggguuuauggauaggcuucaagagggucugugagcccccagaaauugugugugagacugaguau

SEQ ID NO: 90204 - RNA, 64 nt, Human
guggauauccaaaccaaaaagaagaaaacagaugcccccagaaggggccagugcgggcagccag

SEQ ID NO: 90205 - RNA, 64 nt, Human
agcugguccagagauacaacaggaugaauaccaucccccagacccgauccauucagucacgguu

SEQ ID NO: 90206 - RNA, 64 nt, Human
cagcccguuagcuguaacuuggagcuccacucugcccccagaaaggggcugcccuggggugugc

SEQ ID NO: 90207 - RNA, 64 nt, Human
gcaccucggccagcaucuccuaugcucccugggucccccagaccucucuguguugugugcgugg

SEQ ID NO: 90208 - RNA, 64 nt, Human
gggaccaccccucacggggcauaaggucaguuuucccccagagcccgggucccugucccccaca

SEQ ID NO: 90209 - RNA, 64 nt, Human
caaauguaagaaagaaccacuuggccagaagugucccccagaugcuuuuuuuuuuuuuuuuuug

SEQ ID NO: 90210 - RNA, 64 nt, Human
ccaccagccauggucuaaggacauggaucgggugcccccagacgugugcacaggggacccucug

SEQ ID NO: 90211 - RNA, 64 nt, Human
gcuguauggcugggggcuccucguaugcauggaacccccagaauaaauaugcucagccacccug

SEQ ID NO: 90212 - RNA, 64 nt, Human
accccugcccugggauguccacagaugccuccaccccccagaaccuguccuugcacacuccccu

SEQ ID NO: 90213 - RNA, 64 nt, Human
cggcugcauuggauuguacaacuguuuugugaugcccccagacacugucauccugggccgagaa

SEQ ID NO: 90214 - RNA, 64 nt, Human
ccugacagcucuguuuagaggaggcaacacugaucccccagaugcagggcugcaggggauucug

SEQ ID NO: 90215 - RNA, 64 nt, Human
cuuccucccacugucugcccugaacccacugcugcccccagaaaaaggccgggugacaccgggg

SEQ ID NO: 90216 - RNA, 64 nt, Human
gccuugcuccccaucccccaagugccucaccagucccccagacugggugaagguacagcuggcu

SEQ ID NO: 90217 - RNA, 64 nt, Human
gagccccaugcccagcccugccuuggucccccaacccccagagcuuggagucugggccccacac

SEQ ID NO: 90218 - RNA, 64 nt, Human
gggaccaaggucagggccccccugccccaccgcacccccagaauauaagcuaucaagaguauua

SEQ ID NO: 90219 - RNA, 64 nt, Human
ucagcaacgagaguuggaagccuucccacagcuucccccagagcgaagaggcuguagucauguc

SEQ ID NO: 90220 - RNA, 64 nt, Human
ugguacaacuggcauucaaaucuaggucagucugcccccagagccacuacccuuaccccucacu

SEQ ID NO: 90221 - RNA, 64 nt, Human
gaggcugggaauggaggggcagagccaggaagaucccccagaaaagaaagcuacagaagaaacu

SEQ ID NO: 90222 - RNA, 64 nt, Human
gagcugucgcugccuccauggcagcagccagggacccccagaacaagaagaccccgcaggaucc

SEQ ID NO: 90223 - RNA, 64 nt, Human
cucuucucuaccagcugccgcggcgggggcaaagcccccagagccucacuggccccggcgggau

SEQ ID NO: 90224 - RNA, 64 nt, Human
cccaggagcucggacugcugguccuggagagcugcccccagaagaagcuggagugcauagguca

SEQ ID NO: 90225 - RNA, 64 nt, Human
cccccaccgccauuggcauccccaccaagcuccucccccagaacccugaggccaagggggccac

SEQ ID NO: 90226 - RNA, 64 nt, Human
ugccucugagcuggugggcaggauggcuggguggcccccagagaagcacagaccugagaugggg

SEQ ID NO: 90227 - RNA, 64 nt, Human
gcagagaagccacccacguggggugugccaggcacccccagauacaaaugcagccacgcacaga

SEQ ID NO: 90228 - RNA, 64 nt, Human
cucaagagaaggcagagccccagcaccucugugccccccagagcucugugcagggaguuggcca

SEQ ID NO: 90229 - RNA, 64 nt, Human
caaaagcucagggcccugugccaggccaaagauccccccagacccccauucugacauccacaug

SEQ ID NO: 90230 - RNA, 64 nt, Human
gggagauuuguaagcuucugcugucugggcugaacccccagagguucggauugaauuggugugg

SEQ ID NO: 90231 - RNA, 64 nt, Human
cuccggcuuccagggagaccuccccgcccagcagcccccagagacacaacaaccuaccuuccag

SEQ ID NO: 90232 - RNA, 64 nt, Human
aggagguccauccccagcaaauguuuuggagguccccccagagagcagagugggccauggcaga

SEQ ID NO: 90233 - RNA, 64 nt, Human
ccuguccuaaaaauaggggccguuuucuuacacacccccagagagaggagggacugucacacug

SEQ ID NO: 90234 - RNA, 64 nt, Human
acccccggccucagccaccagcacccccauagggcccccagacaccacacacaugcgcgugcgc

SEQ ID NO: 90235 - RNA, 64 nt, Human
cccucuccugacuuguauuguggcagucugaacgcccccagaaaauugugccaaagaguuuaga

SEQ ID NO: 90236 - RNA, 64 nt, Human
gcaugaaucucguggggggucccugcccuugcgacccccagauaccuccacuugcuaccgaguc

SEQ ID NO: 90237 - RNA, 64 nt, Human
cuuaucauuuucucccuaggacauucccuuguagcccccagaauugucuggcccaaauugaaua

SEQ ID NO: 90238 - RNA, 64 nt, Human
ggauccagcaauuccugagccaagaggaacuugacccccagaguguggaaagaaagaccaucuc

SEQ ID NO: 90239 - RNA, 64 nt, Human
uuagagccccaacacagauacccucaucccagggcccccagacacaccccuccgcuggacucac

SEQ ID NO: 90240 - RNA, 64 nt, Human
gagagaagccccagagggagcuauuuccuugcaccccccagaggugaaugagguauucuauaag

SEQ ID NO: 90241 - RNA, 64 nt, Human
aauggagcagcagcaggacagacccccacgaggccccccagagaggaggaagaucccacggagg

SEQ ID NO: 90242 - RNA, 64 nt, Human
acacugccugagggacaacagacaucagaacaaacccccagagagaaacagucaaaaucagggc

SEQ ID NO: 90243 - RNA, 64 nt, Human
cacaggccaacccuggcacaggucaugucugcagcccccagaauguucuggacaugcaccacca

SEQ ID NO: 90244 - RNA, 64 nt, Human
ugagaaaugcaaaggcucauauuuauaaaucccacccccagaguggggagggucaggugccaga

SEQ ID NO: 90245 - RNA, 64 nt, Human
uccgccuggcccaccaacccgcccaccuugacugcccccagaagugugucuugagaccuccugg

SEQ ID NO: 90246 - RNA, 64 nt, Human
ugcuucuccccccaucccagggucccacccccaacccccagagguggcccuuguuuacagugag

SEQ ID NO: 90247 - RNA, 64 nt, Human
gggcagucaccacccagcccuuccuugggcgucucccccagagugcugucgggaccacaucugu

SEQ ID NO: 90248 - RNA, 64 nt, Human
gggaacuuaucgacaaugcaagcuccugggcccacccccagaccuccugaaccaaaagcuccag

SEQ ID NO: 90249 - RNA, 64 nt, Human
acaugugagauggguuagggcaagucuuugccaucccccagauggcucugucuucuuguguaug

SEQ ID NO: 90250 - RNA, 64 nt, Human
uuucuuuugccuuugcccgccccccuguccccagcccccagagcgcagggacacccccauccua

SEQ ID NO: 90251 - RNA, 64 nt, Human
cccaggccucugcccucugcccacccagcgucagcccccagaaaaaaggcaauaaagacgaguc

SEQ ID NO: 90252 - RNA, 64 nt, Human
guccugagucaaguccugccccaccgcccagcuccccccagaggccaccucgccccucccucug

SEQ ID NO: 90253 - RNA, 64 nt, Human
ccucuguccucccgugggccaucccagccuccuucccccagaggagcgcagucacuccacuugg

SEQ ID NO: 90254 - RNA, 64 nt, Human
ucaagcgguucccucccgucucagcucagcggaucccccagaguggaggaggccucuccaugag

SEQ ID NO: 90255 - RNA, 64 nt, Human
uugaaaugaaggcuguggauucaaggcucccugccccccagaucauuuccccaauccuggcaaa

SEQ ID NO: 90256 - RNA, 64 nt, Human
uauagaaaugacaauagagggccacggggaggcccccccagaagcaagauucaaaucucuugcu

SEQ ID NO: 90257 - RNA, 64 nt, Human
ggcccauccugcaggcagaagaggcccugagaggcccccagaucacugucucugcugagcaggg

SEQ ID NO: 90258 - RNA, 64 nt, Human
gagcaacaggaucugucacccaccucucucuucucccccagaucaagcgacgugccucagaggc

SEQ ID NO: 90259 - RNA, 64 nt, Human
auacacucagccuucccucucccaggcaggaggacccccagacccuguuccccugcagaccuca

SEQ ID NO: 90260 - RNA, 64 nt, Human
uuuggugaaaggaaccaacacauuaacgauuuuucccccagaagccacugaauaauucuuuuug

SEQ ID NO: 90261 - RNA, 64 nt, Human
ggacuucuagggaucucagccguggcugaggccacccccagaggagccccugguccacagaagc

SEQ ID NO: 90262 - RNA, 64 nt, Human
gaaauacguauugauaauccaaucuugauuuuuccccccagaauauaaaucucagguaauaagg

SEQ ID NO: 90263 - RNA, 64 nt, Human
gggagacucugaagcaggaaugugacucccugggcccccagauggcgagcagcaccaccuccaa

SEQ ID NO: 90264 - RNA, 64 nt, Human
gcaagugucugagagauacugcaucagcccuagacccccagagccagucccgcccuuuacagag

SEQ ID NO: 90265 - RNA, 64 nt, Human
ggaggggccgcuccaggccccacagagcaggagacccccagagaaagccggggcuggcaggagg

SEQ ID NO: 90266 - RNA, 64 nt, Human
gcaggccacgcccagcuuccuccccccgacuccccccccagagacacggucccaccauguuacc

SEQ ID NO: 90267 - RNA, 64 nt, Human
ucacauuaaaccagggguuuuacuccacauccuucccccagacacuguucccaaccugucaucg

SEQ ID NO: 90268 - RNA, 64 nt, Human
gcauggccaccuaagucuucauuuaauuuauugucccccagaaaagauuaagaugcuacuugaa

SEQ ID NO: 90269 - RNA, 64 nt, Human
uccuaaacuuggccauucccaggaggcuuggagacccccagauaaccauaacagggaagcaggg

SEQ ID NO: 90270 - RNA, 64 nt, Human
ugugugaagaucacguuccuucccccgcaaugugcccccagacgcacgugggucuucagggggc

SEQ ID NO: 90271 - RNA, 64 nt, Human
uacacacaaagcucuucaggcagcugauagauuucccccagagagcuauucaaggacuuccuaa

SEQ ID NO: 90272 - RNA, 64 nt, Human
gcccgcuccccucuccccgcgggccgggggacgccccccagacucacacgggggcuuauuuauu

SEQ ID NO: 90273 - RNA, 64 nt, Human
gguacccccaggaccagaagcucccccagcaaagcccccagagcccaggcucggccugccccca

SEQ ID NO: 90274 - RNA, 64 nt, Human
aucucaaccuuaauuuuucuuucuuuuuuuuuuucccccagaaagaaucucacucugucaccca

SEQ ID NO: 90275 - RNA, 64 nt, Human
ggcuccgcaggugaggagcccauggggcgggcagcccccagaaagcgggcagcaggccccgaua

SEQ ID NO: 90276 - RNA, 64 nt, Human
gagcagggcccuccucucucaggcuuggcccacucccccagacaccuggacacguggccacaaa

SEQ ID NO: 90277 - RNA, 64 nt, Human
aucugagaggaggcugcugggccuucggggugagcccccagagcuggaccugagcuauucucac

SEQ ID NO: 90278 - RNA, 64 nt, Human
gagcugaguaguggggauccagagaggacccccgcccccagagacuugguuuuggcuccagccu

SEQ ID NO: 90279 - RNA, 61 nt, Human
guccccaagauccuccuuagaaucccacagucccccagacccuccuuagaaugccacaguc

SEQ ID NO: 90280 - RNA, 64 nt, Human
uuagaaugccacagucccccaacccuccacagagcccccagacccaccagaacuuccacagacg

SEQ ID NO: 90281 - RNA, 64 nt, Human
ugaaggugcccaccugggccaccagaaggugacacccccagaaucccuccccagagacugcacc

SEQ ID NO: 90282 - RNA, 64 nt, Human
cugagccggcuccucuccccaucugccuucuccucccccagaaaggaccucaaccacacuccac

SEQ ID NO: 90283 - RNA, 64 nt, Human
cccacucaagcaauagggccccgccauaggaagacccccagagagagggucagcaggggggccc

SEQ ID NO: 90284 - RNA, 64 nt, Human
cucagcuguguuguguggcaguuuauuaaacugucccccagaucgacacgcagcuagccuccug

SEQ ID NO: 90285 - RNA, 64 nt, Human
gguucgagacuccaucuugguaguucugugccuccccccagaccccgccccuggggaaauagcc

SEQ ID NO: 90286 - RNA, 58 nt, Human
gccccaccaagagcuccugagcccccugcccccagagcaauaaagucagcuggcuuuc

SEQ ID NO: 90287 - RNA, 64 nt, Human
uaaacuuugggguccagcugccuucagccccccucccccagacuaacagacccuuggaggcagg

SEQ ID NO: 90288 - RNA, 64 nt, Human
ugaggcccuuaaccuuucucucagugcucgccuucccccagaaucccuaggcaaccacugagua

SEQ ID NO: 90289 - RNA, 64 nt, Human
auuugugcgagaugcagccucagaaggaacaaggcccccagagggaggucaccugggggcagcu

SEQ ID NO: 90290 - RNA, 64 nt, Human
gcugcuggugcccggggaggagcagcuauccuugcccccagaggagcagucauugcccucugcg

SEQ ID NO: 90291 - RNA, 64 nt, Human
aaagccaugggagggguguccuccucagaccaugcccccagaugauuuuuuuaaauaaagaaac

SEQ ID NO: 90292 - RNA, 64 nt, Human
gcugagcacagaccagcagcgaccucccuuccagcccccagaaagcucggucacuugaguguuu

SEQ ID NO: 90293 - RNA, 64 nt, Human
ccuccuccacucccuuuuuguaacucccuuacagcccccagacccuucuugaaacgagagccag

SEQ ID NO: 90294 - RNA, 64 nt, Human
cagggacaggggcauugucaucucaaaggcccaacccccagaggccacaccaguccucccaggg

SEQ ID NO: 90295 - RNA, 64 nt, Human
gaccugggagacgccccgagguguuugugcuucacccccagacgucagccucgaaggcaggacu

SEQ ID NO: 90296 - RNA, 64 nt, Human
aaggagugaggcuugguccaauacauggcucugccccccagaacuuaaggcucucacugccccu

SEQ ID NO: 90297 - RNA, 64 nt, Human
cccuggcuggggggauggagaggggcuggcuauccccccagagccccucuucagcauccgcccc

SEQ ID NO: 90298 - RNA, 64 nt, Human
guaccagcacuccgcggcggggccgccgccagcucccccagacccccuccaccccccggccaca

SEQ ID NO: 90299 - RNA, 64 nt, Human
gggcuggacaucacugcaguccagugcaaagccgcccccagagcccagguguccccccaaccua

SEQ ID NO: 90300 - RNA, 64 nt, Human
gcccagguggcuauuuugagaacuccagcuggugcccccagacagcugcucagagccaaggggg

SEQ ID NO: 90301 - RNA, 64 nt, Human
acagaagucgcaggcagccucucagaaaguuucacccccagaggacgaagaggucaagaaccuu

SEQ ID NO: 90302 - RNA, 64 nt, Human
gaaccccaguacugacagccuccuuaaaguuucacccccagagggagccgagacucggaaagug

SEQ ID NO: 90303 - RNA, 64 nt, Human
agccccuccggccugggcugcccacaaggcuugucccccagaggcccuggcuccuggucgggaa

SEQ ID NO: 90304 - RNA, 64 nt, Human
ugugacaaaccaggcuguucacagcuuccucagccccccagaaggggagugucaggaagagaca

SEQ ID NO: 90305 - RNA, 64 nt, Human
augaggaccuccuacccccuuggcccccuccccucccccagaccuccaccuccuccagaccccc

SEQ ID NO: 90306 - RNA, 64 nt, Human
agcggaacacccugccccagggccggacuuccagcccccagagcccucucccugucacucccug

SEQ ID NO: 90307 - RNA, 64 nt, Human
gcugcaccugcucuuggacccuggucuccuuuuccccccagacucggccuccucuccugggacu

SEQ ID NO: 90308 - RNA, 64 nt, Human
cagggacugaagggggaccccaaaacuggcucaccccccagaacacccuccucccagggagggu

SEQ ID NO: 90309 - RNA, 64 nt, Human
ggggcuccgggucacugcuguauauaacuccccucccccagaaaaauaaaugucacugccaacg

SEQ ID NO: 90310 - RNA, 52 nt, Human
cugagauccgccuggagugacacccccagaccucuggaggagacaauggaug

SEQ ID NO: 90311 - RNA, 64 nt, Human
ggcccuggacugccccuuccucccccaucgcccgcccccagaaccccugaugcugguuaggaac

SEQ ID NO: 90312 - RNA, 64 nt, Human
agaguugagaagguguggaagauagggacagcugcccccagaacucccuucaagggaggacuuc

SEQ ID NO: 90313 - RNA, 64 nt, Human
cacagcuuacugaaaaagccagaggccaugacugcccccagaaacuugccccgaguuucucugg

SEQ ID NO: 90314 - RNA, 64 nt, Human
auuuaaugucugcaguagacugaauguuugugugcccccagaauucuaauguugaaaucucauu

SEQ ID NO: 90315 - RNA, 64 nt, Human
agagugggagucagguggagccaccugcugggcucccccagaacuuugcacacaucuugcuaug

SEQ ID NO: 90316 - RNA, 64 nt, Human
ucuugcuugccugcugcccugauggccugagcaucccccagauccaagccugggggaucccggg

SEQ ID NO: 90317 - RNA, 64 nt, Human
ccugagcgaguuuguagugacucacugcacagcacccccagacuagcaugugguucuauauuug

SEQ ID NO: 90318 - RNA, 64 nt, Human
ucccucccaccacccucgccgcaggcagcugcagcccccagaggggaccacaagcccaaaaagg

SEQ ID NO: 90319 - RNA, 64 nt, Human
aaugccgaacgagaaaacuguccauuuucugagacccccagaaaggaaacugacccucagcagc

SEQ ID NO: 90320 - RNA, 64 nt, Human
acaaccugggcuuccacagucuggagcugcccuacccccagauucucugagcacuuucccccau

SEQ ID NO: 90321 - RNA, 64 nt, Human
uuucuucaagcugugauccagaaagauuuuugugcccccagaugccucuugauaggagaggcaa

SEQ ID NO: 90322 - RNA, 64 nt, Human
ugagcugccgggccuccucgaggccccuaagccacccccagaggucccaucugaagcuggagua

SEQ ID NO: 90323 - RNA, 64 nt, Human
aguagcaauaauuuggguccagggucaccuauugcccccagaggccucugaaccccaggcuggg

SEQ ID NO: 90324 - RNA, 64 nt, Human
cauuuuuucguaucaaaaagucaccacuaacccucccccagaagcucacaaaggaaaacggaga

SEQ ID NO: 90325 - RNA, 64 nt, Human
ggaagccuccugcugagugguccacauucugcugcccccagaccccauccagccaggggugggg

SEQ ID NO: 90326 - RNA, 64 nt, Human
gggagacaaagggguagagggucugucuugggcccccccagacucuagccugagcagugcagcc

SEQ ID NO: 90327 - RNA, 64 nt, Human
cccaaagccugcacaacccaaccucgcuuagggacccccagagaugcuggaaucgcuaggaggg

SEQ ID NO: 90328 - RNA, 64 nt, Human
ccucaggcugggcggcuccaguccauagacguuccccccagaaaccagggcuucucucuccuga

SEQ ID NO: 90329 - RNA, 64 nt, Human
ccagaugauggcugccugugggaccccagcuacucccccagacccaaguucugcagaacuaacc

SEQ ID NO: 90330 - RNA, 62 nt, Human
accuguaucccuccgugaauaagcaucugguggacccccagauugcacacauagggcagaug

SEQ ID NO: 90331 - RNA, 64 nt, Human
caugggcacuacucuucaugugcggugacaccagcccccagaugccuugaauuaaguguccuca

SEQ ID NO: 90332 - RNA, 64 nt, Human
ggacucccagacugcaggggagcacuuggggcagcccccagaaggaccacugcuggaucccagg

SEQ ID NO: 90333 - RNA, 64 nt, Human
cgggccaagcagaggagcccucgggucagcccugcccccagagcugccccccacgggcauccua

SEQ ID NO: 90334 - RNA, 64 nt, Human
cugaggccggcucugacugggcagcucagccccucccccagagcccagggucuugcacaccccu

SEQ ID NO: 90335 - RNA, 64 nt, Human
cuucagccccuugagcagcccauggcuuagcagacccccagauguaggucaguggccuuaccug

SEQ ID NO: 90336 - RNA, 64 nt, Human
ggggcaggggcagugggggcucgggcaggagcaccccccagacuccccgugcccgcagcccugc

SEQ ID NO: 90337 - RNA, 64 nt, Human
cugccagccugagugggcaaggaagcagguggaucccccagaaggaaccgcagcucgcgaggca

SEQ ID NO: 90338 - RNA, 64 nt, Human
aaacaaacaaacaaaaacuaaacacacacacaaacccccagaaacccacaauauguacacgcua

SEQ ID NO: 90339 - RNA, 64 nt, Human
aauaaaaauugaugucagugcaggcccaggcccgcccccagauacacuaguuucuaggucuggg

SEQ ID NO: 90340 - RNA, 64 nt, Human
guucgauucugccucuguagcucaaggggggcagcccccagaguccugugcauucugccaaggc

SEQ ID NO: 90341 - RNA, 64 nt, Human
cgguccuucccucucaugacuugcagggccguugcccccagacuuccuccuuuccguguuucug

SEQ ID NO: 90342 - RNA, 64 nt, Human
aggagccaacugagaugauggggugggggugcuccccccagacuuucucaguccugcagcggcc

SEQ ID NO: 90343 - RNA, 64 nt, Human
gggcaggcugaggcuguggaggggacaagcacgccccccagaacgcagucuccacugagggcac

SEQ ID NO: 90344 - RNA, 50 nt, Human
uggugcaaauggcccagugacccccagacgcggaaaccggguggcagcgc

SEQ ID NO: 90345 - RNA, 64 nt, Human
ucuaugugucugucuguguguccaucccgccgaccccccagacuaaccuccaggcauggacuga

SEQ ID NO: 90346 - RNA, 64 nt, Human
auugcgguauucuuugcgguauucuuguccccgucccccagaaggcucgccucuccccguggac

SEQ ID NO: 90347 - RNA, 64 nt, Human
gugggugggggccauauccuagaccucucuguaucccccagacuaucuguaacagugccaggca

SEQ ID NO: 90348 - RNA, 64 nt, Human
cuggugggcuguuuuguuuuuuuuuuuuccucuucccccagaugucuugacgggaucacugggg

SEQ ID NO: 90349 - RNA, 64 nt, Human
ucuuacuuuccugaaaauaucggggagguuuucucccccagacgccugauauugaaguaaaaaa

SEQ ID NO: 90350 - RNA, 64 nt, Human
gugacacagaauaugauucccucacugccccugccccccagaaaggagagugaaacucuuauuu

SEQ ID NO: 90351 - RNA, 64 nt, Human
gaagugcccuccagccucagagcuagccacaaagcccccagagcugaauucauugaguauuugu

SEQ ID NO: 90352 - RNA, 64 nt, Human
ccucucaggcagaugccgaggccaaguggacugacccccagauuuccuucccuuggaugcuuuc

SEQ ID NO: 90353 - RNA, 64 nt, Human
ccaaagacuucauccggcaccuucuggagcgagacccccagaagagguucaccugccaacaggc

SEQ ID NO: 90354 - RNA, 64 nt, Human
gaaaugaccuaaccaaaaacauucaaggguucugcccccagauuucgggagauccacguuccau

SEQ ID NO: 90355 - RNA, 64 nt, Human
cucaaaugucaaccccaccgaggcacccccccgucccccagaaucuuggcuguuuacaaaucac

SEQ ID NO: 90356 - RNA, 64 nt, Human
ggacugggcccccacgucccugacuaggccggcucccccagacucagagggcagcaggagcagc

SEQ ID NO: 90357 - RNA, 64 nt, Human
gacaugugccagggcaaugaugaaugagaaucuacccccagauccaagcagccugagcaacucu

SEQ ID NO: 90358 - RNA, 64 nt, Human
uggacgugaccguaucccucugccacaccccaggcccugcgaggggcuaucgagaggagcucac

SEQ ID NO: 90359 - RNA, 64 nt, Human
cguagccaaggugggcugagcccuggcaggaugacccugcgaaggggcccugguccuuccaggc

SEQ ID NO: 90360 - RNA, 64 nt, Human
cuuuuguuguaccaaauagggcuccccaccccaccccugcgacaagugcucuucuagaacaggu

SEQ ID NO: 90361 - RNA, 64 nt, Human
gcagucguggugaaaccggucagcuguggaccugcccugcgaaucggcagaggccuccguggug

SEQ ID NO: 90362 - RNA, 64 nt, Human
uugccuacagaugguuuccacacuugaaauugugcccugcgaguugcauagcuggaaguucaau

SEQ ID NO: 90363 - RNA, 64 nt, Human
gagaugaccagggaugcugggcugggcccucuuucccugcgagacgcacacagcugagcacuua

SEQ ID NO: 90364 - RNA, 64 nt, Human
aggaggacuggucagucacaagagcuucaaccugcccugcgagcccucucugcaccugcucaag

SEQ ID NO: 90365 - RNA, 64 nt, Human
ucuggugguccuuaggggaguggccccuccugagcccugcgagcagcguccuuuuccucuuccc

SEQ ID NO: 90366 - RNA, 64 nt, Human
gaaugaggcuggacagauggcggaagcagagguucccugcgaagacuugagauuuagugucugu

SEQ ID NO: 90367 - RNA, 64 nt, Human
gugaccuuaggaucacucaaguagacccuucacucccugcgagaaauuaggaugaauaacuacc

SEQ ID NO: 90368 - RNA, 64 nt, Human
gaucacacacguauacacaacauuacugaaagaacccugcgaaucaaaacaacccccacacaga

SEQ ID NO: 90369 - RNA, 64 nt, Human
gcagacugggagcucccgguccgccucccagcaucccugcgagcguucaugggguguucguguu

SEQ ID NO: 90370 - RNA, 54 nt, Human; identical to SEQ ID NO: 23168

SEQ ID NO: 90371 - RNA, 64 nt, Human
caccauguuggccaggauggucucaaucuccugacccugcgaucugcccaccucagccucccaa

SEQ ID NO: 90372 - RNA, 64 nt, Human
aaugagguuucaguacaaaaggaaccaugggugacccugcgauauccacugucauuuuccaucc

SEQ ID NO: 90373 - RNA, 64 nt, Human
ggcagacccacauggccugggcucugaaugcccacccugcgacgguggguucugcaucagcaaa

SEQ ID NO: 90374 - RNA, 64 nt, Human
gucccaaguuggaaauauucaugcuucuuccuuacccugcgauuuugccugugucugaaguggu

SEQ ID NO: 90375 - RNA, 64 nt, Human
uguacagaaugguaacuaagggugcugugcccaacccugcgacuagcaaggcucgcagcaagag

SEQ ID NO: 90376 - RNA, 64 nt, Human
gcccuggcacccuggcgugggugcccgccaaacgcccugcgaccgcucagaagcacaaaugcug

SEQ ID NO: 90377 - RNA, 64 nt, Human
ggaggaggagggagguaucuggugugagcguugccccugcgacauuugggaccacacagguggg

SEQ ID NO: 90378 - RNA, 64 nt, Human
gacaacccaaacucuccagacaucaccaacuguccccugcgaggagaaaucacuccugggggag

SEQ ID NO: 90379 - RNA, 64 nt, Human
agguggacagggccuacccagguggaggggaccacccugcgaucagguguuugcgacagggguu

SEQ ID NO: 90380 - RNA, 64 nt, Human
gagggccuggagggggugcugcgggaccagcuggcccugcgagccuuggaggaggcggugagcg

SEQ ID NO: 90381 - RNA, 64 nt, Human
acuccucugucaguuucagcaacuacaagggauacccugcgaaaguaccaugagaaauaucaga

SEQ ID NO: 90382 - RNA, 64 nt, Human
ugauugcuuuccaguuuaaugaaagcuuaaaugucccugcgaacccacaaucucugccagcaga

SEQ ID NO: 90383 - RNA, 64 nt, Human
ugcugaguggcucguguuucacagugggcggcuucccugcgacggaggcaggaccaggcauuua

SEQ ID NO: 90384 - RNA, 64 nt, Human
gauccauccaccuauuagcccugggccuggaccucccugcgauuucccacuccuuucuuagucu

SEQ ID NO: 90385 - RNA, 64 nt, Human
gaaaaggcuuggaguccucgcccagaucucucuccccugcgagcccuuuuuauuugagaaggaa

SEQ ID NO: 90386 - RNA, 64 nt, Human
gcacagaucuugcagcccagaaccaagucagccucccugcgacugcccaggcacacugcccacc

SEQ ID NO: 90387 - RNA, 64 nt, Human
cauucccacaaagugaaggaacaguuuccaaaaccccugcgaggcagaguuaagaccugugacg

SEQ ID NO: 90388 - RNA, 57 nt, Human; identical to SEQ ID NO: 23186

SEQ ID NO: 90389 - RNA, 64 nt, Human
ugccucccgcuggcccaggucuccucuccagucccccugcgacucccuguuuccugggcuaguc

SEQ ID NO: 90390 - RNA, 51 nt, Human; identical to SEQ ID NO: 23188

SEQ ID NO: 90391 - RNA, 64 nt, Human
cuugcagccccugcagacgagagucaggccagcacccugcgaccagcuucuccacugaugcaca

SEQ ID NO: 90392 - RNA, 64 nt, Human; identical to SEQ ID NO: 84744

SEQ ID NO: 90393 - RNA, 64 nt, Human
cacauauugugcagcuguugguuuucauguagugcccugcgauggaaauuagauauauuucaug

SEQ ID NO: 90394 - RNA, 64 nt, Human
agcccacaaacacaagaagcaggacccgcugcagcccugcgacacggaguaccccguguucgug

SEQ ID NO: 90395 - RNA, 64 nt, Human
gccgagcgugcaacccggagccgccuugggcccucccugcgacagccggacccgccuccgcauc

SEQ ID NO: 90396 - RNA, 64 nt, Human
cuguccgggccuggguuuccugcccuggcccuggcccugcgaucucucacugugauuccucucc

SEQ ID NO: 90397 - RNA, 64 nt, Human
aagagggagugaggagaggauugcagggacuuuucccugcgaaacaaaugagacaaugacauaa

SEQ ID NO: 90398 - RNA, 64 nt, Human
cagugaacacuguccgccgcugugaggccugcuccccugcgaccgcccugccccccgucaccga

SEQ ID NO: 90399 - RNA, 64 nt, Human
caggccagagccacagcugggagaccugcacugucccugcgaaauacuaagaacaccuagggug

SEQ ID NO: 90400 - RNA, 64 nt, Human
ggcagcuuugcagaagcccagauggaccuggugccccugcgaggucugucgccuggugcagccu

SEQ ID NO: 90401 - RNA, 64 nt, Human
gcagggccccuuccugcugucucaccccguguuucccugcgaguggacgugcccagcugucccc

SEQ ID NO: 90402 - RNA, 64 nt, Human
caaccucauggucauggacagauagacagugcugcccugcgaaguggcucucaggggccaguga

SEQ ID NO: 90403 - RNA, 64 nt, Human
accucgggucucugccagaggaagacuuaagcaucccugcgaccucacauucuagacagagaug

SEQ ID NO: 90404 - RNA, 64 nt, Human
cauccagcagcgcuaagguggacaugggauuccucccugcgaugcgugucuuucccacgcagag

SEQ ID NO: 90405 - RNA, 64 nt, Human
cucccuugaucuuuuugguuuuacuuuaauuaagcccugcgagaaugcuggauaaaugccuuga

SEQ ID NO: 90406 - RNA, 64 nt, Human
uuugagaugcaacagagaacguaugccacauagccccugcgaagaaaaggcauuauguaucugu

SEQ ID NO: 90407 - RNA, 64 nt, Human
uuaagaugcagaguggaggggaggugggcacccacccugcgauucuccacccuuuccccuucuu

SEQ ID NO: 90408 - RNA, 64 nt, Human
agcaggagcagugguggcgccugcccugaggcugcccugcgauggccugggugggagagcuggg

SEQ ID NO: 90409 - RNA, 64 nt, Human
guugugcgcuuaacgugaggguggguccagugugcccugcgaugggucccgugucacuguuuac

SEQ ID NO: 90410 - RNA, 64 nt, Human
agcaguaugagcucuugugaggaugcugccgccacccugcgacggagcggcgccccggacugcc

SEQ ID NO: 90411 - RNA, 64 nt, Human
gggacugaggacuggcagagcugccggcgccggacccugcgacaaccggggucccccaggacag

SEQ ID NO: 90412 - RNA, 64 nt, Human
agcccgugccgugugacucgaagccuagcgcccucccugcgaagcaucagacgccacccagccc

SEQ ID NO: 90413 - RNA, 64 nt, Human
ccugggugucagugagaucucagcccugaugacacccugcgagaccuggagcguagggcccagc

SEQ ID NO: 90414 - RNA, 63 nt, Human
ccaaggucggccgcuacuaggacugcccccggacccugcgaugaugacccgggcgcaaccugg

SEQ ID NO: 90415 - RNA, 64 nt, Human
cccgggagcuggaggcgcaugcgcauccgcgauucccugcgaccaggccccgagagggcgagac

SEQ ID NO: 90416 - RNA, 64 nt, Human
gcgucuaagaugagggggccaggcgguggcuucucccugcgaggaggggagaauucuuggggcu

SEQ ID NO: 90417 - RNA, 64 nt, Human
ugcgggccaccaaguucuggaaaccacguggugucccugcgaauggggcgaucaaguccagagc

SEQ ID NO: 90418 - RNA, 64 nt, Human
ccguccgcggggcuguggcugcugcugugcaugucccugcgaugggagucuugucucccagccu

SEQ ID NO: 90419 - RNA, 64 nt, Human
cacaucagugucucguuuacaucucacacagugacccugcgaggcaaggguuugcccaguuugc

SEQ ID NO: 90420 - RNA, 64 nt, Human
aaggcuucaggaagggccagccacaugccaucuucccugcgaucaggcaaaaaaguggaauuaa

SEQ ID NO: 90421 - RNA, 64 nt, Human
gcucugcgugugguccguauggaaagccugguagcccugcgaguuaaguacugcuuccauucau

SEQ ID NO: 90422 - RNA, 64 nt, Human
uccugggcuucugggccaccugcccucggggggccccugcgagggugccuggaguucccacgug

SEQ ID NO: 90423 - RNA, 64 nt, Human
cggacuucagauacguuaagcaagcaacagcagacccugcgaaugcacaucgacauacccaggg

SEQ ID NO: 90424 - RNA, 64 nt, Human
gugcuuucucaggaaccuuucaagcggccagaaccccugcgaaucacacaugaccuuugcggga

SEQ ID NO: 90425 - RNA, 64 nt, Human
augucggcuuccaagugaugcccuccugccacuccccugcgauuuauaagggaauuuuaauuuu

SEQ ID NO: 90426 - RNA, 64 nt, Human
caugugcccucaaagcugucccacaaucauggagcccugcgaccucccugcccugccgccacau

SEQ ID NO: 90427 - RNA, 64 nt, Human
caugugcccuugaagcugccccacaaucauggagcccugcgaccuacccgcccugccgccacau

SEQ ID NO: 90428 - RNA, 64 nt, Human
guacuuucucaggaaccuuucaagcggccagaaccccugcgaaucacacaugaccuuugcggga

SEQ ID NO: 90429 - RNA, 64 nt, Human
cauauacagugcuuagcacuuaauaaguauuccccccugcgacaccuagcugaacuaugguuug

SEQ ID NO: 90430 - RNA, 64 nt, Human
cccucaccuguacccacaccuccagaaugcccugcccugcgaguguguccccuguccccaccug

SEQ ID NO: 90431 - RNA, 64 nt, Human
cccguggugucaccgggacuccaggcacccgcuccccugcgaccaugccaggcacgcugggagg

SEQ ID NO: 90432 - RNA, 64 nt, Human; identical to SEQ ID NO: 90358

SEQ ID NO: 90433 - RNA, 64 nt, Human; identical to SEQ ID NO: 90359

SEQ ID NO: 90434 - RNA, 64 nt, Human; identical to SEQ ID NO: 90360

SEQ ID NO: 90435 - RNA, 64 nt, Human; identical to SEQ ID NO: 90361

SEQ ID NO: 90436 - RNA, 64 nt, Human; identical to SEQ ID NO: 90362

SEQ ID NO: 90437 - RNA, 64 nt, Human; identical to SEQ ID NO: 90363

SEQ ID NO: 90438 - RNA, 64 nt, Human; identical to SEQ ID NO: 90364

SEQ ID NO: 90439 - RNA, 64 nt, Human; identical to SEQ ID NO: 90365

SEQ ID NO: 90440 - RNA, 64 nt, Human; identical to SEQ ID NO: 90366

SEQ ID NO: 90441 - RNA, 64 nt, Human; identical to SEQ ID NO: 90367

SEQ ID NO: 90442 - RNA, 64 nt, Human; identical to SEQ ID NO: 90368

SEQ ID NO: 90443 - RNA, 64 nt, Human; identical to SEQ ID NO: 90369

SEQ ID NO: 90444 - RNA, 54 nt, Human; identical to SEQ ID NO: 23168

SEQ ID NO: 90445 - RNA, 64 nt, Human; identical to SEQ ID NO: 90371

SEQ ID NO: 90446 - RNA, 64 nt, Human; identical to SEQ ID NO: 90372

SEQ ID NO: 90447 - RNA, 64 nt, Human; identical to SEQ ID NO: 90373

SEQ ID NO: 90448 - RNA, 64 nt, Human; identical to SEQ ID NO: 90374

SEQ ID NO: 90449 - RNA, 64 nt, Human; identical to SEQ ID NO: 90375

SEQ ID NO: 90450 - RNA, 64 nt, Human; identical to SEQ ID NO: 90376

SEQ ID NO: 90451 - RNA, 64 nt, Human; identical to SEQ ID NO: 90377

SEQ ID NO: 90452 - RNA, 64 nt, Human; identical to SEQ ID NO: 90378

SEQ ID NO: 90453 - RNA, 64 nt, Human; identical to SEQ ID NO: 90379

SEQ ID NO: 90454 - RNA, 64 nt, Human; identical to SEQ ID NO: 90380

SEQ ID NO: 90455 - RNA, 64 nt, Human; identical to SEQ ID NO: 90381

SEQ ID NO: 90456 - RNA, 64 nt, Human; identical to SEQ ID NO: 90382

SEQ ID NO: 90457 - RNA, 64 nt, Human; identical to SEQ ID NO: 90383

SEQ ID NO: 90458 - RNA, 64 nt, Human; identical to SEQ ID NO: 90384

SEQ ID NO: 90459 - RNA, 64 nt, Human; identical to SEQ ID NO: 90385

SEQ ID NO: 90460 - RNA, 64 nt, Human; identical to SEQ ID NO: 90386

SEQ ID NO: 90461 - RNA, 64 nt, Human; identical to SEQ ID NO: 90387

SEQ ID NO: 90462 - RNA, 57 nt, Human; identical to SEQ ID NO: 23186

SEQ ID NO: 90463 - RNA, 64 nt, Human; identical to SEQ ID NO: 90389

SEQ ID NO: 90464 - RNA, 51 nt, Human; identical to SEQ ID NO: 23188

SEQ ID NO: 90465 - RNA, 64 nt, Human; identical to SEQ ID NO: 90391

SEQ ID NO: 90466 - RNA, 64 nt, Human; identical to SEQ ID NO: 90393

SEQ ID NO: 90467 - RNA, 64 nt, Human; identical to SEQ ID NO: 90394

SEQ ID NO: 90468 - RNA, 64 nt, Human; identical to SEQ ID NO: 90395

SEQ ID NO: 90469 - RNA, 64 nt, Human; identical to SEQ ID NO: 90396

SEQ ID NO: 90470 - RNA, 64 nt, Human; identical to SEQ ID NO: 90397

SEQ ID NO: 90471 - RNA, 64 nt, Human; identical to SEQ ID NO: 90398

SEQ ID NO: 90472 - RNA, 64 nt, Human; identical to SEQ ID NO: 90399

SEQ ID NO: 90473 - RNA, 64 nt, Human; identical to SEQ ID NO: 90400

SEQ ID NO: 90474 - RNA, 64 nt, Human; identical to SEQ ID NO: 90401

SEQ ID NO: 90475 - RNA, 64 nt, Human; identical to SEQ ID NO: 90402

SEQ ID NO: 90476 - RNA, 64 nt, Human; identical to SEQ ID NO: 90403

SEQ ID NO: 90477 - RNA, 64 nt, Human; identical to SEQ ID NO: 90404

SEQ ID NO: 90478 - RNA, 64 nt, Human; identical to SEQ ID NO: 90405

SEQ ID NO: 90479 - RNA, 64 nt, Human; identical to SEQ ID NO: 90406

SEQ ID NO: 90480 - RNA, 64 nt, Human; identical to SEQ ID NO: 90407

SEQ ID NO: 90481 - RNA, 64 nt, Human; identical to SEQ ID NO: 90408

SEQ ID NO: 90482 - RNA, 64 nt, Human; identical to SEQ ID NO: 90409

SEQ ID NO: 90483 - RNA, 64 nt, Human; identical to SEQ ID NO: 90410

SEQ ID NO: 90484 - RNA, 64 nt, Human; identical to SEQ ID NO: 90411

SEQ ID NO: 90485 - RNA, 64 nt, Human; identical to SEQ ID NO: 90412

SEQ ID NO: 90486 - RNA, 64 nt, Human; identical to SEQ ID NO: 90413

SEQ ID NO: 90487 - RNA, 63 nt, Human; identical to SEQ ID NO: 90414

SEQ ID NO: 90488 - RNA, 64 nt, Human; identical to SEQ ID NO: 90415

SEQ ID NO: 90489 - RNA, 64 nt, Human; identical to SEQ ID NO: 90416

SEQ ID NO: 90490 - RNA, 64 nt, Human; identical to SEQ ID NO: 90417

SEQ ID NO: 90491 - RNA, 64 nt, Human; identical to SEQ ID NO: 90418

SEQ ID NO: 90492 - RNA, 64 nt, Human; identical to SEQ ID NO: 90419

SEQ ID NO: 90493 - RNA, 64 nt, Human; identical to SEQ ID NO: 90420

SEQ ID NO: 90494 - RNA, 64 nt, Human; identical to SEQ ID NO: 90421

SEQ ID NO: 90495 - RNA, 64 nt, Human; identical to SEQ ID NO: 90422

SEQ ID NO: 90496 - RNA, 64 nt, Human; identical to SEQ ID NO: 90423

SEQ ID NO: 90497 - RNA, 64 nt, Human; identical to SEQ ID NO: 90424

SEQ ID NO: 90498 - RNA, 64 nt, Human; identical to SEQ ID NO: 90425

SEQ ID NO: 90499 - RNA, 64 nt, Human; identical to SEQ ID NO: 90426

SEQ ID NO: 90500 - RNA, 64 nt, Human; identical to SEQ ID NO: 90427

SEQ ID NO: 90501 - RNA, 64 nt, Human; identical to SEQ ID NO: 90428

SEQ ID NO: 90502 - RNA, 64 nt, Human; identical to SEQ ID NO: 90429

SEQ ID NO: 90503 - RNA, 64 nt, Human; identical to SEQ ID NO: 90430

SEQ ID NO: 90504 - RNA, 64 nt, Human; identical to SEQ ID NO: 90431

SEQ ID NO: 90505 - RNA, 64 nt, Human
aaaacgugucgugaauguuucuucaguuucuuguucagccaaugaggaaagggcauugccuuuc

SEQ ID NO: 90506 - RNA, 64 nt, Human
gcccuggggucaccucagggacagcguccaggcuucagccaagggcucccuggcaaggggcugu

SEQ ID NO: 90507 - RNA, 64 nt, Human
aaaugcuucuuucucagaauucaaaggagacgagucagccaaccacagcuacauuucaggcuuu

SEQ ID NO: 90508 - RNA, 64 nt, Human
ugacucggcagugugcaguggugcaugcacugucucagccaacccgcuccacuacccggcaggg

SEQ ID NO: 90509 - RNA, 64 nt, Human
uuuuguuuuguuuuguuuuguuuuucucuuucacucagccaaaugugaaaguugugaauuuagg

SEQ ID NO: 90510 - RNA, 64 nt, Human
agucuccuucucuucucuucuuugggaugcuauuucagccaaucuggacacuucuuuauacucu

SEQ ID NO: 90511 - RNA, 64 nt, Human
augucugggaauaucauagaguaacaagugcuggucagccaaagaaacauucacugcuggugaa

SEQ ID NO: 90512 - RNA, 64 nt, Human
agaggaaagccaagcugcuucuguugugagcgaaucagccaagagccugaggcugaagggaaaa

SEQ ID NO: 90513 - RNA, 64 nt, Human
guuccgcucgacaccauuguuuuauuauauuauaucagccaauugcaaaaaaagucugugccag

SEQ ID NO: 90514 - RNA, 64 nt, Human
ugcuccccuuccaucucuagcagauaucaucuucucagccaauucuguaggacacugaggcucu

SEQ ID NO: 90515 - RNA, 64 nt, Human
cugagauagucacaacccaggugacgaugcccucucagccaacacugccaaccugacccuguca

SEQ ID NO: 90516 - RNA, 64 nt, Human
guagccagcagccuguaaacuggaaacacuggucucagccaaccuccucagggcgcccuggcuu

SEQ ID NO: 90517 - RNA, 64 nt, Human
agguccccauguuuucaccaagcaaucugcuaugucagccaacccaacaucacuuucuacagga

SEQ ID NO: 90518 - RNA, 64 nt, Human
acuaaucugccugaagacuucucaugauggaaaaucagccaaggacuaagcuuccauagaaaua

SEQ ID NO: 90519 - RNA, 64 nt, Human
cucgaccuguccuucaauguugauaauaaaugucucagccaaaaaccuuccuugagcugccaug

SEQ ID NO: 90520 - RNA, 64 nt, Human
ccuguaggcacaacuggccauuuguaaagucacuucagccaaguuuucauuugggagcuaccca

SEQ ID NO: 90521 - RNA, 64 nt, Human
gugaguuugucaagcaacuaucgacuugaucaguucagccaagcaacugacaaaucaaaaaccc

SEQ ID NO: 90522 - RNA, 64 nt, Human
ggggaaaggauguauuuauuuguauuuucauauaucagccaaaagcugaauggaaaaguuaaga

SEQ ID NO: 90523 - RNA, 64 nt, Human
uuucuaucugcacuuuuugaucuccaaacaaccuucagccaaagaaucugucuaccaacuccuc

SEQ ID NO: 90524 - RNA, 64 nt, Human
agaaucgcuugaacucgggagguggagguugcagucagccaagaucgugccacugcacaccauc

SEQ ID NO: 90525 - RNA, 64 nt, Human
uuaguauuuuuuuuaaucuaggugauuccaauauucagccaacugugagaaucaauggccuaaa

SEQ ID NO: 90526 - RNA, 64 nt, Human
uggaacgacugaugauguuuuuuauaucaucaauucagccaauggaugcgaacuuaaaaucugg

SEQ ID NO: 90527 - RNA, 64 nt, Human
gggccuggugauuaauuagcaauucucauuccucucagccaaaggccugcacugggcuuuauuu

SEQ ID NO: 90528 - RNA, 64 nt, Human
auccuggagacccugaggucuaagcuacagccccucagccaaccacagacccuucucuggcucc

SEQ ID NO: 90529 - RNA, 64 nt, Human
cccacuauaagucaaguugcaguuuaagguggucucagccaauuguuacaagcuacagaauaua

SEQ ID NO: 90530 - RNA, 64 nt, Human
ucuaacgucuagugaaaaaaauauuuuuaaaauuucagccaaauaaugcauuuuauuuauaaaa

SEQ ID NO: 90531 - RNA, 64 nt, Human
uuguagcggugccaguauuucaguagaugggauuucagccaaguagguuccccuguaaccuccu

SEQ ID NO: 90532 - RNA, 64 nt, Human
uuggagcuuacagucuguucuggggaacagagauucagccaaagucaagaaacacuggaugcca

SEQ ID NO: 90533 - RNA, 64 nt, Human
cugggccggagggaccagccaccauugucucuguucagccaagugugcaaguaggcugcccgcc

SEQ ID NO: 90534 - RNA, 64 nt, Human
aguguuauuuauguacagauaagaaaaccauaugucagccaaagauuuuaucucuucuucuaac

SEQ ID NO: 90535 - RNA, 64 nt, Human
aauauuaagucauaaucuguuacacuaaaauuugucagccaaauguuagaugaaaugucugcac

SEQ ID NO: 90536 - RNA, 64 nt, Human
uggaagauagaauccaaguauuuauaacucauugucagccaaaugcuaucaugaacguaggaaa

SEQ ID NO: 90537 - RNA, 64 nt, Human
guuuuggcugaaauucuccuggaggucgguagguucagccaagguuuuauaaggcugaugucaa

SEQ ID NO: 90538 - RNA, 64 nt, Human
ccggcacuggguuugcucccugauuaaagugccuucagccaagaccaucucucccuccugguga

SEQ ID NO: 90539 - RNA, 64 nt, Human
agucuuuucuaagagucaaccacaggcauuuaagucagccaaagaauauuguuaccuuaaagca

SEQ ID NO: 90540 - RNA, 64 nt, Human
cagacucgccacuuugggugcacaggugguuaggucagccaacugguucugccugucgccuugc

SEQ ID NO: 90541 - RNA, 64 nt, Human
caccucaguuucccagcucuggcccggugaccccucagccaacagcccuaacauuugccaaguc

SEQ ID NO: 90542 - RNA, 64 nt, Human
aaaaccugugaauguggguaaugugggagagccuucagccaaaccucauugcuuuauaaacccc

SEQ ID NO: 90543 - RNA, 64 nt, Human
ccaggaagcuguagagagggacagaaggggcgguucagccaagacagauguagacggaguugga

SEQ ID NO: 90544 - RNA, 64 nt, Human
cacaaaagcacgguguuugugaauauaacaccugucagccaacuuuagacagaugguaaagacc

SEQ ID NO: 90545 - RNA, 64 nt, Human
agauauuagaccucucuuuuucugaagcuaagcuucagccaauccuccuuguuuuauauccuaa

SEQ ID NO: 90546 - RNA, 64 nt, Human
cuguucucuugucugucugucucugucuugaagcucagccaagaaacuuucccgugucacgccu

SEQ ID NO: 90547 - RNA, 64 nt, Human
guucugguguuauucugucuccucuucuuugucaucagccaaaacgugguuuuuaaagagaguc

SEQ ID NO: 90548 - RNA, 64 nt, Human
uauccuaguguuccuauagugaaauaaguaggguucagccaaagcuuucuuuguuuuguaccuu

SEQ ID NO: 90549 - RNA, 64 nt, Human
ccccuuuuuuuguacugauccaacugggagaaccucagccaaugcuggaaguaugauugaagua

SEQ ID NO: 90550 - RNA, 64 nt, Human
ccacacaaucguagcuuauaagauuggaacgaucucagccaaauauuuuagguguaauucauau

SEQ ID NO: 90551 - RNA, 64 nt, Human
agacaccuagauuagcagcucaauuuguacuacuucagccaaucugugaauguaaaaacuacac

SEQ ID NO: 90552 - RNA, 64 nt, Human
gauggagcccuugggcucucugggaaaugggaaaucagccaaaggacugagaaggaguuaccuu

SEQ ID NO: 90553 - RNA, 64 nt, Human
accuggauccaguuauggugccucaggggcugcgucagccaaggaaagggaagugcugcuuagu

SEQ ID NO: 90554 - RNA, 64 nt, Human
ccuagggcgauccaguugugcagccuucugaccaucagccaagggaagcaggccucugauggag

SEQ ID NO: 90555 - RNA, 64 nt, Human
auaaccauuuugauaaugcaacaauaaagcaucuucagccaaacaucuagucuuccauagacca

SEQ ID NO: 90556 - RNA, 64 nt, Human
gugcugcuucugauuuuucuugcauuuuaaauucucagccaaccuacagccaugaucuuuagca

SEQ ID NO: 90557 - RNA, 64 nt, Human
cacaggcaucaacacucucaaaugauucacauguucagccaaaguugagaaccaucgagccugu

SEQ ID NO: 90558 - RNA, 64 nt, Human
aaaacagauguuuaggagauuuccuguauagcagucagccaauucauaugcuuugucucugcug

SEQ ID NO: 90559 - RNA, 64 nt, Human
cagcuuuucauaagugguauguuuaauuggucauucagccaaccaucaguauuuuccccccaca

SEQ ID NO: 90560 - RNA, 64 nt, Human
gcuauuaacaugauuugucaaaugcauguuuuuuucagccaaagccuuguuuccauuuuuguug

SEQ ID NO: 90561 - RNA, 64 nt, Human
aaauuuuuauuucuaucagcaguacuaaaauguaucagccaaccagagaacaucagugacuuua

SEQ ID NO: 90562 - RNA, 64 nt, Human
aucuugggauugagagucuucuugcagaaacuucucagccaaaguaaaaaggauuuucucuuac

SEQ ID NO: 90563 - RNA, 64 nt, Human
cuuguggacuaaaagauauaagugcuguauaaaaucagccaauuauguuaaacuagcauaucug

SEQ ID NO: 90564 - RNA, 64 nt, Human
ugaaggaccaguuggaccacggaccccuagaaacucagccaaggagaccugacuuuaucugaga

SEQ ID NO: 90565 - RNA, 64 nt, Human
caccccucucucugacacuuuuuguguuggguccucagccaacacucaaggggaaaccuguagu

SEQ ID NO: 90566 - RNA, 64 nt, Human
uggggcugccacccucccccacaguccaggcccuucagccaagggcucugcaccagcaccuugg

SEQ ID NO: 90567 - RNA, 64 nt, Human
uaccccccuuaggcagguuggcuuucauaucaccucagccaacuguggcucuuaauuuauugca

SEQ ID NO: 90568 - RNA, 64 nt, Human
aaauuuuucccccuacauugacuccuggccuacaucagccaaacuuaaccuuggugggguuugg

SEQ ID NO: 90569 - RNA, 64 nt, Human
uauaaaagauauuuuuggcauuucuaggcaaguaucagccaauaaguauguuagugauaucaca

SEQ ID NO: 90570 - RNA, 64 nt, Human
uugugguccuguaaaagauacugaggaaugucuuucagccaagccaagaggaugguuucaauaa

SEQ ID NO: 90571 - RNA, 64 nt, Human
ccgggacaggccucacccaaggccaaggcuggcaucagccaaucauucagagcugaggcccugg

SEQ ID NO: 90572 - RNA, 64 nt, Human
uagaacaugagagaguggaaaaccucaggauguuucagccaaacaagaagagaagaaaauauug

SEQ ID NO: 90573 - RNA, 64 nt, Human
ugaaauguagcggcacccaauuucuagacaacgcucagccaacggauucuuuucaagcugcuca

SEQ ID NO: 90574 - RNA, 64 nt, Human
auggucaacacuuaaggguuuuagaaaacagccgucagccaaauguaauugaauaaaguugaag

SEQ ID NO: 90575 - RNA, 64 nt, Human
agugaggauuagaagugaaugacaauaaagucugucagccaagcacgaaccaagacuggcacua

SEQ ID NO: 90576 - RNA, 64 nt, Human
uauuacauagaguauguuuacaacaaauauccugucagccaaaugguuacccauauaaaaugua

SEQ ID NO: 90577 - RNA, 64 nt, Human
guuuugguauuaaaaguucauacauuagacaguaucagccaaaauuugaguuagcaacacuguu

SEQ ID NO: 90578 - RNA, 64 nt, Human
auuuucuacuuuuuuuaagugauuuuuuuguccuucagccaaacacaauaugggcucaagucac

SEQ ID NO: 90579 - RNA, 64 nt, Human
gugagaggcauccaguaucuugaagacuuuucuuucagccaagaauucuuaaauauguggaguu

SEQ ID NO: 90580 - RNA, 64 nt, Human
ccuguagccugggccauuuaagacaggggcggucucagccaaauugcacccauuuaacuauccc

SEQ ID NO: 90581 - RNA, 64 nt, Human
cugaaaucgaagcucuagugggacuggcacacauucagccaagucuaaugaaacgaagggaacu

SEQ ID NO: 90582 - RNA, 64 nt, Human
gacuaaaaucugagaauuuuuuaacauaugcaagucagccaaacauaagcuaccaaaauaaaga

SEQ ID NO: 90583 - RNA, 64 nt, Human
gcuguccugguguuuuacuacacuccaugucaggucagccaacugcccuaacuguacauuucac

SEQ ID NO: 90584 - RNA, 64 nt, Human
uauaugugcauggacuguguuuccaguacaccuuucagccaaaacagauccacaguaguuguug

SEQ ID NO: 90585 - RNA, 64 nt, Human
agaacuacuugaaccugggaggucaaagcugcagucagccaagaucuugccacuguacuccagc

SEQ ID NO: 90586 - RNA, 64 nt, Human
aucccuaaaauggcgaacauguguuuucaucauuucagccaaaguccuaacuuccugugccuuu

SEQ ID NO: 90587 - RNA, 64 nt, Human
cacauuuaaagagcacuuacuguggaacaagccuucagccaaacaauggggauagaaaaguagg

SEQ ID NO: 90588 - RNA, 64 nt, Human
cagccgcuccugucugccagccagcagccagcucucagccaacgaguaauuuauuguuuuuccu

SEQ ID NO: 90589 - RNA, 64 nt, Human
uuuuuagaaaucagcuacccauuauagcacaaaaucagccaaagcagaauuuuuaaaaauuggc

SEQ ID NO: 90590 - RNA, 64 nt, Human
gugagcucuggugucacucaucuccaugaucaucucagccaacaugcaucaguacugcaagaaa

SEQ ID NO: 90591 - RNA, 64 nt, Human
uugucuguugcagagugaagcaacauggaugcagucagccaaguccccauggaagucgugcuuc

SEQ ID NO: 90592 - RNA, 64 nt, Human
aauccagccagagaugcacauuccucggccagucucagccaacaguaccaaaagugauuuuuga

SEQ ID NO: 90593 - RNA, 64 nt, Human
uguuaguguucuauauagcacaaacuugaaucucucagccaaaaaagggaacauauauacuguu

SEQ ID NO: 90594 - RNA, 64 nt, Human
acaaaagccacauaaacucaagcaagaaauauguucagccaaaacaugauuauaguggcagcug

SEQ ID NO: 90595 - RNA, 64 nt, Human
ggcaacagacacugccacaauuucaguguuguguucagccaaggggacggucugggcaggcagc

SEQ ID NO: 90596 - RNA, 64 nt, Human
cauuucagaaggagugguagaaaaaaacacacauucagccaaccacuuauaugaauugaaugua

SEQ ID NO: 90597 - RNA, 64 nt, Human
auaauccuuucugccgaccccuaguucccucugcucagccaagcuuguuaucagcuuucagggc

SEQ ID NO: 90598 - RNA, 64 nt, Human
uuucccuuaggauuucguuaucucaccuugacccucagccaagauugguaaagcugcguccugg

SEQ ID NO: 90599 - RNA, 64 nt, Human
gaauguaccccacugcaccugagcuccuggucccucagccaagaccucagggguccccagccag

SEQ ID NO: 90600 - RNA, 64 nt, Human
gcuggaguuuuguuggugugaaaauacacuuauuucagccaaaacauaccauuucuacaccuca

SEQ ID NO: 90601 - RNA, 64 nt, Human
cuccuaaaaccacagaccuguuucagcugcuacuucagccaaaauucuucagcuucauauuguc

SEQ ID NO: 90602 - RNA, 64 nt, Human
agaggaggugguucugaaaguggcucuucuaaccucagccaaacacagagcgggagugacggga

SEQ ID NO: 90603 - RNA, 64 nt, Human
gugacgggccaggcgcagccaucgggaaggucauucagccaacccagaggauguagacccuguc

SEQ ID NO: 90604 - RNA, 64 nt, Human
cugauggugaggcugcccagucccaucaggagccucagccaaggaggggccugggcacacucag

SEQ ID NO: 90605 - RNA, 64 nt, Human
aauaugcuuccuucauauugaagcugcugauuucucagccaaaaaucaucuuagaaucuuuaaa

SEQ ID NO: 90606 - RNA, 64 nt, Human
uuuuagaugcaaaagaaaaaggucuaacguacaaucagccaauuagaauuugccugaaaucaua

SEQ ID NO: 90607 - RNA, 64 nt, Human
guuugugauauuuuaaauaucuacuacagcacauucagccaauaaagaaucugccuuuaaugua

SEQ ID NO: 90608 - RNA, 64 nt, Human
gaccgaacacgcagccaggggugggaaagcugccucagccaagcugagccucucaacuggugug

SEQ ID NO: 90609 - RNA, 64 nt, Human
aucuuuauaguuguagacuauggaaugucaguguucagccaaacaguaugauggaacagugaaa

SEQ ID NO: 90610 - RNA, 64 nt, Human
cagaagucucugaccccauuuguuuuuaauggcaucagccaaugaguuaucacccuuuuccucc

SEQ ID NO: 90611 - RNA, 64 nt, Human
cccauaagcauggugagcuccugcucucauaaggucagccaaagccccuuaagaagguacacag

SEQ ID NO: 90612 - RNA, 64 nt, Human
aaucuugucacucuuuugguuuucuuuauauagcucagccaaaucuuguuuuauguccuguccu

SEQ ID NO: 90613 - RNA, 64 nt, Human
auggaaauauuuuuaaugcagcagcuauugcacuucagccaaauguuuauuucacacaaaacgg

SEQ ID NO: 90614 - RNA, 64 nt, Human
gacuuaaaccauucauaucauguuuccuuugcguucagccaauuucaauuaaaaugaacuaaau

SEQ ID NO: 90615 - RNA, 64 nt, Human
gggguggaaggcucuuugccuuguccaccagggcucagccaagcccugcaguguguccccgcuc

SEQ ID NO: 90616 - RNA, 64 nt, Human
uggcuuuucuccuucuguauuuccauaccacuuuucagccaagaauccuaucauaauguaaucu

SEQ ID NO: 90617 - RNA, 64 nt, Human
cuuggcucguuugggcucaaggcaccgcagccugucagccaacauugccuugcauuuguaccuu

SEQ ID NO: 90618 - RNA, 64 nt, Human
uuucuauauaaaaagguucuccugaauaaugagaucagccaaccgcccaugcaacugaagacac

SEQ ID NO: 90619 - RNA, 64 nt, Human
ugucaagguccuaaaguacuggagugaaauaaauucagccaacaugugacuaauuggaagaaga

SEQ ID NO: 90620 - RNA, 64 nt, Human
auggcacaguuccacccacagaguagugaaucucucagccaaggagggaaagaaaaggaagaac

SEQ ID NO: 90621 - RNA, 64 nt, Human
gaucucaaagcuaaagugccaauuuuuacuuucuucagccaauuuguuaccucuuuuaugguuu

SEQ ID NO: 90622 - RNA, 64 nt, Human
aaugauagggaacaggaccccagucccuuuccccucagccaaggguguauuuguaaacuucggc

SEQ ID NO: 90623 - RNA, 64 nt, Human
gagcccaauucagugaaagcuccugugguuuugcucagccaaaaccaaaacgaggggaagagga

SEQ ID NO: 90624 - RNA, 64 nt, Human
ggacacagaagucccugaggcccccagaccuggcucagccaaccuccuuccucccccgguugcc

SEQ ID NO: 90625 - RNA, 64 nt, Human
ugaaccuguuauucugagaacucauaaauaaaauucagccaagauuaaucaaucaaucaaucaa

SEQ ID NO: 90626 - RNA, 64 nt, Human
gcuccgccucccagguucacgccauucuccugccucagccaaaccuuugcuauuuuuaaucuuc

SEQ ID NO: 90627 - RNA, 64 nt, Human
auuuuccacaagauucaagaaucuuguauaaaauucagccaacguacacauagcuuuaaugagg

SEQ ID NO: 90628 - RNA, 64 nt, Human
cuuuucaugaccucaaaugugggcccagccuaggucagccaacccccauccaacccuuagacuc

SEQ ID NO: 90629 - RNA, 64 nt, Human
uuuuauauuaauugugcuuauggaagaaacaaugucagccaaguccauuuuauaguuugagugc

SEQ ID NO: 90630 - RNA, 64 nt, Human
uuuuuccugugagguaugacaguuugcucaaacuucagccaacaggggugucugcuucugcugc

SEQ ID NO: 90631 - RNA, 64 nt, Human
uauucaguauacuuacauaaaaauuauuucgccaucagccaaaacucaguaaucaugacagcug

SEQ ID NO: 90632 - RNA, 64 nt, Human
gccaggagaauuaucuauagguggaaagucugugucagccaaagccaugucacucugagagaac

SEQ ID NO: 90633 - RNA, 64 nt, Human
gggaacugcugguuaugagcauuccugguuuucuucagccaaauaacagguaaucacugucaau

SEQ ID NO: 90634 - RNA, 64 nt, Human
aucaaauaauaaucaaucaaucagcauauacauuucagccaaagccauagaagaaaaagcaaua

SEQ ID NO: 90635 - RNA, 64 nt, Human
agcacauuagcuugcuugaagugcugauuccauuucagccaagcaagggaaagaggaaguggag

SEQ ID NO: 90636 - RNA, 64 nt, Human
aauugcaugcauaccgauauuggagaaaucugggucagccaaguuucauguuauugcauuuaga

SEQ ID NO: 90637 - RNA, 64 nt, Human
guaaauuaugucuuaguuauaauuagauugugaaucagccaacugaaaauccuuuuugcauauu

SEQ ID NO: 90638 - RNA, 64 nt, Human
caaagaaagucuuaugauaaaagugaggcaaauuucagccaagaaguuagaagagauguuuaaa

SEQ ID NO: 90639 - RNA, 64 nt, Human
uguuuauguccccccuucucuuccugagugauucucagccaaguccagacagugcucggcgggu

SEQ ID NO: 90640 - RNA, 64 nt, Human
uugcccugcuggccacacucuggagaagcacuucucagccaaggcaccccugcccugggacugg

SEQ ID NO: 90641 - RNA, 64 nt, Human
acauuccaaaacaauauauacacacacacauaaaucagccaaaaucagagaaaaggaacaggga

SEQ ID NO: 90642 - RNA, 64 nt, Human
aauaugggaauuuucauaauaguucauacauuugucagccaacauuaaaagguaaccaacuccu

SEQ ID NO: 90643 - RNA, 64 nt, Human
ucagaggacaccauuaggcuaauagagaaacagaucagccaaauggccgaugacacaguggcag

SEQ ID NO: 90644 - RNA, 64 nt, Human
gcccaggacacccuguggcuuuacuugcucauggucagccaagcuuacccuucacacugagaag

SEQ ID NO: 90645 - RNA, 64 nt, Human
ggggcugcguggcuguuccccuuggcuggagcauucagccaaccccagcguccccccugaggcg

SEQ ID NO: 90646 - RNA, 64 nt, Human
ccaguauggccccaccauguuugucccuccagccucagccaagcaacauggggugaaccucagc

SEQ ID NO: 90647 - RNA, 59 nt, Human
ccagcagaccaggcuccugagaagaacuuucagccaauaaagcuugugcuucccccacc

SEQ ID NO: 90648 - RNA, 64 nt, Human
ugcugaugaauucuucuuucauucugaucuuuguucagccaacaggagcguccuuuucuaaugu

SEQ ID NO: 90649 - RNA, 64 nt, Human
gucuuuacuuguggaaaccaggaaauugcuccucucagccaaccaagguugaccacacaccacc

SEQ ID NO: 90650 - RNA, 64 nt, Human
cuccuguuaccuucugaauccauauguagagauuucagccaaggcugggccagccuuuuuuggg

SEQ ID NO: 90651 - RNA, 64 nt, Human
uuuuagcggaaacuacuaaauuauuuugggugguucagccaaaccucaaaacaguuaaucuccc

SEQ ID NO: 90652 - RNA, 64 nt, Human
gcacuuagaucccuucuaacucauauaauuuuucucagccaauccauucacaagcuuggcauug

SEQ ID NO: 90653 - RNA, 64 nt, Human
aauguccaugcacccagguggccgcguugggcugucagccaaggugccugaaacgauacgugug

SEQ ID NO: 90654 - RNA, 64 nt, Human
aaguuuagccaugacaaaccaaagagugcccaggucagccaagaaagauacauaaucucauggg

SEQ ID NO: 90655 - RNA, 64 nt, Human
cagcauggaguggauuuuaggcucauuugcccucucagccaacugcccuugagcaguguacagc

SEQ ID NO: 90656 - RNA, 64 nt, Human
acuugcauuugcaaagagcucaauugcucugagcucagccaaguaggagaggcuaggccaucac

SEQ ID NO: 90657 - RNA, 64 nt, Human
ccuaauacaagcaguacggaagaugcguauggucucagccaagugacucgacguuuauccacuu

SEQ ID NO: 90658 - RNA, 64 nt, Human
guuguuuuuaaaggcaacagacuuaaaguuguccucagccaaggaaaaaugauacugcaacuuu

SEQ ID NO: 90659 - RNA, 64 nt, Human
gcucuguucccagcguuugccagagguggccacuucagccaagcccagagaagugugggcagaa

SEQ ID NO: 90660 - RNA, 64 nt, Human
ucgccccaccguucuucucugcugcauuuggacaucagccaaauuugaacccaaucaaauauaa

SEQ ID NO: 90661 - RNA, 64 nt, Human
cuucauacaguucagccucuagaaugguaacaaaucagccaauuggauucgaaacaaagaagac

SEQ ID NO: 90662 - RNA, 64 nt, Human
gucucucuucccuucuuucaggaauacuuggaccucagccaaccucucgaacaguauucaccua

SEQ ID NO: 90663 - RNA, 64 nt, Human
auuaguguucaucuguggaguaucagaauagcagucagccaacucugucucauaucauccuuca

SEQ ID NO: 90664 - RNA, 64 nt, Human
gcaucuaccugagaggcuccugcuguccacgcccucagccaauuccuucuccccgccuuggcca

SEQ ID NO: 90665 - RNA, 64 nt, Human
ccugccccacccacuccaggauguuaggguccccucagccaaaaaggcagcugccuguggcucc

SEQ ID NO: 90666 - RNA, 64 nt, Human
guacccaaggccucagcccacaccaagacuaaucucagccaaaccugcugcuugguggugccag

SEQ ID NO: 90667 - RNA, 64 nt, Human
cacacugcagggcugcuguggcccagucguccgcucagccaaggagucagauggcaauggguac

SEQ ID NO: 90668 - RNA, 64 nt, Human
cucucucuggaaagacccaacuuucucacugcugucagccaagucaugguugguaaccauguag

SEQ ID NO: 90669 - RNA, 64 nt, Human
agaucaggauguacaagauaaccccagagggcgcucagccaagcuuagagcagcuaucaaauua

SEQ ID NO: 90670 - RNA, 64 nt, Human
ucuuguauuuuuuaauugagcuaaucaaaauaauucagccaagucuauuugaaauagaaaacug

SEQ ID NO: 90671 - RNA, 64 nt, Human
aucucagagacccugaguucccacucagacccacucagccaaaucucauggaagaccaaggagg

SEQ ID NO: 90672 - RNA, 64 nt, Human
ccccaugcugcucauccuccugggccccauccacucagccaaagcagaaugcaggguuuccugc

SEQ ID NO: 90673 - RNA, 64 nt, Human
caccauggauacucgcccgugggcagggcuguggucagccaagaauagaggucauauaguuggg

SEQ ID NO: 90674 - RNA, 64 nt, Human
ucagguggaucccgcuucccccucccccaagaagucagccaacacgcagcugaggcgcaugugg

SEQ ID NO: 90675 - RNA, 64 nt, Human
uuugagugggaguguugcccccaggagccuuaucucagccaauuaccuuucuugacaguaggag

SEQ ID NO: 90676 - RNA, 64 nt, Human
gguguccugagcccaccucgcuggccuguucccuucagccaacccguuucugcaguaaaauuaa

SEQ ID NO: 90677 - RNA, 64 nt, Human
ucccugaccaaugacagagccugaaaaugcccugucagccaauggcagcucuucucggacuccc

SEQ ID NO: 90678 - RNA, 64 nt, Human
cucgugacuggccaguuuugugcagcugacugucucagccaaaccacugaucuucccuggaggc

SEQ ID NO: 90679 - RNA, 64 nt, Human
cuuauauagaaucugaguucaugcugaauacuuuucagccaauaauuuauagccuuucccuuaa

SEQ ID NO: 90680 - RNA, 64 nt, Human
agaaucgcuagaaccugggaggcggagguugcagucagccaagauagcaccacugcacuccagg

SEQ ID NO: 90681 - RNA, 64 nt, Human
gagcuaugcacucuaauguggggccacucaccagucagccaaucuuuuauuguuccuuugcuac

SEQ ID NO: 90682 - RNA, 64 nt, Human
caaugcgcaaaggaaagcagucuuucagaaucugucagccaagugucuuucuaguuacugcuaa

SEQ ID NO: 90683 - RNA, 64 nt, Human
uuccugguucugugucucagcuguuucagaacuuucagccaaguuaaaucuuuuuugguguuga

SEQ ID NO: 90684 - RNA, 64 nt, Human
gagacagauggaggguacccuauuuacaacugagucagccaagccacugaugggaauauacaga

SEQ ID NO: 90685 - RNA, 64 nt, Human
caaugucacucacccuccccuuguaguauccugcucagccaagaucugccuaagauuaugauuc

SEQ ID NO: 90686 - RNA, 64 nt, Human
ggaagaccagccccgacagcaccuccugagaaagucagccaagggccuacccugaugccagagu

SEQ ID NO: 90687 - RNA, 64 nt, Human
agcagccauuaccaacuguaccuucccuucuugcucagccaauaaauauauccucuuucacuca

SEQ ID NO: 90688 - RNA, 64 nt, Human
cuggaccauucccagcucccugcucacucuucucucagccaaagccuccaaagggacuagagag

SEQ ID NO: 90689 - RNA, 64 nt, Human
cagggaagcuacagguuacaacagauuugugaacucagccaagcacagugguggcagggccuag

SEQ ID NO: 90690 - RNA, 64 nt, Human
cauucaaaauuccuuaagaucauggguucugacuucagccaaacaaaacaaucaaaaccuacca

SEQ ID NO: 90691 - RNA, 64 nt, Human
ugugugucuacugugauuuaaguauuuuuaaucaucagccaagcauuguuaguaguauaaauau

SEQ ID NO: 90692 - RNA, 64 nt, Human
ugcugccuccccccacaagaacucccuucuccccucagccaaugaaucaaugugcuccuucaua

SEQ ID NO: 90693 - RNA, 64 nt, Human
ccagcaccagauguaaguaagcaucucauauauuucagccaaauaaaugggccaagggaaaaaa

SEQ ID NO: 90694 - RNA, 64 nt, Human
cuccgccucugcugauuggcugccacggugggagucagccaagauuuaaagggaugccagcgau

SEQ ID NO: 90695 - RNA, 64 nt, Human
ugaacuucaccugcaaagcucuguggccacauuuucagccaaagggaaauaugcuuucaucuuc

SEQ ID NO: 90696 - RNA, 64 nt, Human
acccaacugcggcuaagucucuuuuucccuuggaucagccaagcgaaacuuggagcuuugacaa

SEQ ID NO: 90697 - RNA, 64 nt, Human
uaaagccuaaagcaaaguuagauuuggggguuauucagccaaaauuaccguuuuagaccagaau

SEQ ID NO: 90698 - RNA, 64 nt, Human
uagggcggacuuaccuggcccagcccugccucccucagccaacccagcccuugggcugucugug

SEQ ID NO: 90699 - RNA, 64 nt, Human
cuaccuccaucuugagcucugaguuuacagggguucagccaagcaagacugagcagcagcaggg

SEQ ID NO: 90700 - RNA, 64 nt, Human
ugaugugcaaaaccuuuuacugguugcauggaaaucagccaaguuuuauaauccuuaaaucuua

SEQ ID NO: 90701 - RNA, 64 nt, Human; identical to SEQ ID NO: 90689

SEQ ID NO: 90702 - RNA, 64 nt, Human
ucacaauugguguucuuuuuaagguuugcaaauuucagccaauuuuguagcuaagauuguucug

SEQ ID NO: 90703 - RNA, 64 nt, Human
ggcagacagcccagcugagccuccuuaccucccuucagccaagcccaccugcacgugaucugcu

SEQ ID NO: 90704 - RNA, 64 nt, Human
cacuagugaauugacguuuaugauuuauguuaauucagccaaacauaaauaaccuuccuuaagu

SEQ ID NO: 90705 - RNA, 64 nt, Human
aaacucaguucgaccaaacucaguucaaaccauuucagccaaacuguagaugaagagggcucug

SEQ ID NO: 90706 - RNA, 64 nt, Human
ccuucgagcagaaguggcaguagaugguugccaaucagccaaugcagacuuucacugggacaac

SEQ ID NO: 90707 - RNA, 64 nt, Human
cagcauuuucuuacacccccuccccagcgugcccucagccaagugcuuuggcccggugcuuccc

SEQ ID NO: 90708 - RNA, 64 nt, Human
agucuguugugguuucccggauuccgcgccuagcucagccaauuaagcaugagacauaggccau

SEQ ID NO: 90709 - RNA, 64 nt, Human
ccgcauguccaugaagcugcgucguuccucuggcucagccaauaaauccuaaggagacaagcag

SEQ ID NO: 90710 - RNA, 64 nt, Human
cuuccuugccuuuagagugacccugcagagucacucagccaaaucugucugcugcucccucucc

SEQ ID NO: 90711 - RNA, 64 nt, Human
uccagagcccccuccuaagaaccaucaccaccacucagccaaucuguucugggcccugauuuug

SEQ ID NO: 90712 - RNA, 64 nt, Human
cccacaaacugcugguggaggaagaagauguucgucagccaauucaaccuccagccagcuucuu

SEQ ID NO: 90713 - RNA, 64 nt, Human
ggugaucauaauuucucuuuauuuucuaguuuuaucagccaauuccuagaacaauauauuuaaa

SEQ ID NO: 90714 - RNA, 64 nt, Human
uucaaagugcaugcagucuuuugcgauaccucauucagccaaguauugguauucuuccucauuc

SEQ ID NO: 90715 - RNA, 64 nt, Human
ucgaggugagaggugaugugguauucagugcccgucagccaacugugggccuucaccucuaccu

SEQ ID NO: 90716 - RNA, 64 nt, Human
aaucucuugauagacaauuuauacccaugaaaguucagccaaugcccagagugaccaagcagca

SEQ ID NO: 90717 - RNA, 64 nt, Human; identical to SEQ ID NO: 90714

SEQ ID NO: 90718 - RNA, 64 nt, Human
aaagugacagaggcuuggcuuuuuuaccuuuaguucagccaagucauuuucaaguccugagaaa

SEQ ID NO: 90719 - RNA, 64 nt, Human
acugcugccgggcacacugggaccagcaggcuccucagccaacccugucccucggcccggcccu

SEQ ID NO: 90720 - RNA, 64 nt, Human
uuggggacccuggugcaugcuagugggcaugggaucagccaagcuucguuccaucuuuuccuaa

SEQ ID NO: 90721 - RNA, 64 nt, Human
caaguauguuuuaaagaagaaauaaguuucccaaucagccaauuuaacuggcuaccuguuaccu

SEQ ID NO: 90722 - RNA, 64 nt, Human
aacuauuuugagcauuagaauggaggaaauccggucagccaagugcagaguucagacuucgcua

SEQ ID NO: 90723 - RNA, 64 nt, Human
aggcagcuuacuguguguuugcuggagcuuucacucagccaaguguuagagucaggaaacccau

SEQ ID NO: 90724 - RNA, 64 nt, Human
gucgcaggacacaugccggccaguuaauucauucucagccaaugaagguuugucuaagcugccu

SEQ ID NO: 90725 - RNA, 64 nt, Human
guugagugacaccugaggaugcggcugcacacacucagccaagggccgagucucaccugcggug

SEQ ID NO: 90726 - RNA, 64 nt, Human
gauggaaagggaaggucagcaggucaaagcaggaucagccaacaaccugccuuuggcaagcugc

SEQ ID NO: 90727 - RNA, 64 nt, Human
gcgacacugucccugccucagguuggagguuuuaucagccaaaguguuuuuuucauguaucguu

SEQ ID NO: 90728 - RNA, 64 nt, Human
ccuggggcuggacugcauggccccccucuuucccucagccaagaacaggccuggcccaaggugc

SEQ ID NO: 90729 - RNA, 64 nt, Human
ggaagggggaagcugagaaguucgugugacacccucagccaagggacagugccauccuugggga

SEQ ID NO: 90730 - RNA, 64 nt, Human
uccaacucauuaaaaaagaagaaucucugucaccucagccaagugauuuauuuuuugcuccccc

SEQ ID NO: 90731 - RNA, 64 nt, Human
aacaggcuggggccuuuugacggccuucuugguuucagccaaggggcugcgcuagcagcccuug

SEQ ID NO: 90732 - RNA, 64 nt, Human
guaagcccuguacauguacuauuaauucagucauucagccaagccuccuccucuagcagcaauu

SEQ ID NO: 90733 - RNA, 64 nt, Human
auaaaauugggaacaggaaugagcaggaagccaaucagccaaagaaaauggugaucuggaccca

SEQ ID NO: 90734 - RNA, 64 nt, Human
uacaguuacaguugauguuuggggaucgaugugcucagccaaauuuccuguuugaaauaucaug

SEQ ID NO: 90735 - RNA, 64 nt, Human
ugucaagccugaaaccaagcaauaccgucauguuucagccaagcccagagcccuaagauuacaa

SEQ ID NO: 90736 - RNA, 64 nt, Human
agaaucacuugaacccaggaggcagagguugcagucagccaagaucaugcuacugcacuccagc

SEQ ID NO: 90737 - RNA, 64 nt, Human
cauggcugucgauguaggcauucuggagugguguucagccaagugaccgggcaaaauugggcug

SEQ ID NO: 90738 - RNA, 64 nt, Human
aauuaugagggcuaccacugaaucauuuuaucuuucagccaaucaagucguuguaaacguggcu

SEQ ID NO: 90739 - RNA, 64 nt, Human
cgcauguaugaauaucuaguccuuucugugguucucagccaagacauaaaaacuaggacucaga

SEQ ID NO: 90740 - RNA, 64 nt, Human
uucuucugugacuuggacugcucuacagaagacaucagccaacugcacgagucagaguccaggg

SEQ ID NO: 90741 - RNA, 64 nt, Human
acaaaggauaaaccacggagcaacuggaaaaccaucagccaagcguucggaugagucugguuau

SEQ ID NO: 90742 - RNA, 64 nt, Human
auggaagaccaaaaauuuuuccuagaccugguugucagccaaaguccuacaaugugaaaagagu

SEQ ID NO: 90743 - RNA, 64 nt, Human
ucuuccaagugucuaacuagucuucgcugcagcgucagccaaagcuggccccugaaccacugug

SEQ ID NO: 90744 - RNA, 64 nt, Human
uuguugcaacacagguccugaguugaccucugguucagccaaggaccaaagaagguguguaagu

SEQ ID NO: 90745 - RNA, 64 nt, Human
ggcauggagcccugcccugagugucugucccucuucagccaagcccaagucuccuagaccccca

SEQ ID NO: 90746 - RNA, 64 nt, Human
ggugagcuugcuuuuggcaggccuuccucgauccucagccaaaggaaccugugcaagacacugg

SEQ ID NO: 90747 - RNA, 64 nt, Human
ccaccccagaggggaaguuccucagccagacucuucagccaaaugccccaacuuucagucugua

SEQ ID NO: 90748 - RNA, 64 nt, Human
guuuuaaaauaaguuaaaggcaguccagagcuuuucagccaauuugucuccuacucuguguaaa

SEQ ID NO: 90749 - RNA, 64 nt, Human
aauggcccggaggggcagcaaccccccgcacacgucagccaacagcagugccucugcaggcacc

SEQ ID NO: 90750 - RNA, 64 nt, Human
ccaauggcaacugccauuugaguccggugagggaucagccaaccucuucucuauggcucaccuu

SEQ ID NO: 90751 - RNA, 64 nt, Human
cugucccuagguguaggaaauggaagaaaaagauucagccaaguggggaggugacagaugcaca

SEQ ID NO: 90752 - RNA, 64 nt, Human
aguaugcuuggauccuuugguccuuggaugcuucucagccaaguggcgguagcacagauguggu

SEQ ID NO: 90753 - RNA, 64 nt, Human
uggagagggccggggucggggagguuggggggugucagccaaaacguggaggugucccucugca

SEQ ID NO: 90754 - RNA, 64 nt, Human
ggcccucagucacuuuggaagugagaagaacccuucagccaaaccuuugggaucccauuuugaa

SEQ ID NO: 90755 - RNA, 64 nt, Human
uuacauuugucaggagcauuuguauacagucagcucagccaaaggagaugccccaagugggagc

SEQ ID NO: 90756 - RNA, 64 nt, Human
aggugccaggaggagcauggguguggaaguccugucagccaagaaauaaaaguuuaccucagag

SEQ ID NO: 90757 - RNA, 64 nt, Human
ggccauugggggcuguggggccgaugagguggacucagccaaagacucagcagcacauggggca

SEQ ID NO: 90758 - RNA, 64 nt, Human
acuaggucuggggcacucccaaugcagcgccuugucagccaaggugggcaggcagggacugugg

SEQ ID NO: 90759 - RNA, 64 nt, Human
ucaccuaagauucaagggaguguugcuucucaacucagccaacugaguagcaaaucauuuguuc

SEQ ID NO: 90760 - RNA, 64 nt, Human
aauguggacaauguagugaauauggaaaaagguuucagccaaaggccuaacccuauucaacacc

SEQ ID NO: 90761 - RNA, 64 nt, Human
gcccagagucucucaugagguugcaguuaagacaucagccaaggccacuucgucugaggaaggc

SEQ ID NO: 90762 - RNA, 64 nt, Human
caccgcagcaggcagaggggcuggacaggcacugucagccaaugugggggguccugaagacacc

SEQ ID NO: 90763 - RNA, 64 nt, Human
ccgggacccgcggcucaguggcccgcuagccacgucagccaagccacuuuagguccauuuuuua

SEQ ID NO: 90764 - RNA, 64 nt, Human
aggaucucucaugccuuuacuuacaaucaagaugucagccaaagcuauagucaucuaacaucuu

SEQ ID NO: 90765 - RNA, 64 nt, Human
auucacauagguucuuuucuauuuucccuaagugucagccaacuugagaaauaaagggacagag

SEQ ID NO: 90766 - RNA, 64 nt, Human
ggguggggcacccccaaauuugacucugggagacucagccaaauccuaucugguaauaaaauuu

SEQ ID NO: 90767 - RNA, 64 nt, Human
accucagcugggucaggcacagggaggggagggaucagccaaauugggcggccacccccgccuc

SEQ ID NO: 90768 - RNA, 64 nt, Human
gccauguguacaguaaaaagcaggcaacauagugucagccaaagcucauuugcauaauaagauu

SEQ ID NO: 90769 - RNA, 64 nt, Human
gugaaaaggguuauuuuuacuuagcuuagcuaugucagccaauccgauugccuuaggugaaaga

SEQ ID NO: 90770 - RNA, 64 nt, Human
auagacaaaacauuuguuuuauagagucaguaguucagccaagugauugggagaccacacagca

SEQ ID NO: 90771 - RNA, 64 nt, Human
uucuaauugggaugaucaugguaaggucuucaguucagccaacgucuuuagauuuuuuuuuagu

SEQ ID NO: 90772 - RNA, 64 nt, Human
acucauccagccccuuccccuggagagggacugcucagccaacaccaccagcugccacauccug

SEQ ID NO: 90773 - RNA, 64 nt, Human
gagccuuauggaaguggucuuugugagaaaaucuucagccaagucaaacuucaugcagcagaau

SEQ ID NO: 90774 - RNA, 64 nt, Human
agaaggagacuaagacugcagcucuaagaaagucucagccaaacagauggggaggcccaaagca

SEQ ID NO: 90775 - RNA, 64 nt, Human
ccuaaguuuaauuacaacagcacgugcagccacgucagccaaaugacuucauuucugaugugaa

SEQ ID NO: 90776 - RNA, 64 nt, Human
ugugaauauccagacuguuucagcccagcccaucucagccaacccuccuuagacugagcuguca

SEQ ID NO: 90777 - RNA, 64 nt, Human
ccugcccaggguaggccuggcaugagggguuaggucagccaaugucagcugcuucucuuggggc

SEQ ID NO: 90778 - RNA, 64 nt, Human
agggucuugggggucggggggagaaguucuugauucagccaaaugcagggaggggaggcagaug

SEQ ID NO: 90779 - RNA, 64 nt, Human
gagaggcugucuggggccuuuaucaaaaaaagacucagccaagacaaggagguagagaggggac

SEQ ID NO: 90780 - RNA, 64 nt, Human
cguguccuucaggacagaacagaagcacaaagacucagccaagaguucucuuuauucccuuuga

SEQ ID NO: 90781 - RNA, 64 nt, Human
ccaauccggccaugcucgaagccagcucugcagcucagccaaucagugacaucauuggugagaa

SEQ ID NO: 90782 - RNA, 64 nt, Human
agucaaagucagcuuguucagacuuacuggguaaucagccaaguucauuuucuggcuccaaccu

SEQ ID NO: 90783 - RNA, 64 nt, Human
accggagugaaaacuucaggggaaggguggggagucagccaagugccucagugugcccuguuga

SEQ ID NO: 90784 - RNA, 64 nt, Human
agugcauuucuugcuugcuggguuucaacagacaucagccaaaagaacaaaagagaugucagga

SEQ ID NO: 90785 - RNA, 64 nt, Human
aaauuuaauuuucuacgccucuggggauaucugcucagccaauggaaaaucuggguucaaccag

SEQ ID NO: 90786 - RNA, 64 nt, Human
ccaauuccccucuuuuucugcccuccccuccaacucagccaacccaggugugggcagucaggga

SEQ ID NO: 90787 - RNA, 64 nt, Human
gagugggaggaaaagcaaacaucaaaacagugcuucagccaaauuccauauguaaugccauugg

SEQ ID NO: 90788 - RNA, 64 nt, Human
gaccccgauggcgauggacuacugaagcccuaacucagccaaccuuacuuacagcauaagggag

SEQ ID NO: 90789 - RNA, 64 nt, Human
cuuaguuacaguguuaucucuuaccuuaaaaaacucagccaacagguaguauugguaaaaacaa

SEQ ID NO: 90790 - RNA, 64 nt, Human
ggugcagcaggcucaaaggcauaagucauuccaaucagccaacuaaguuguccuuuucugguuu

SEQ ID NO: 90791 - RNA, 64 nt, Human
cucaaagaccccaugguccauccccugaggguggucagccaaggcucccguuccgugggaugcc

SEQ ID NO: 90792 - RNA, 64 nt, Human
ccaacgucauggaagcagcugacacuucugaaacucagccaaggacacuugauauuuuuuaauu

SEQ ID NO: 90793 - RNA, 64 nt, Human
aaguuuaucaccccaaagagaaauccugcacccaucagccaacacuccccaacccaucggccac

SEQ ID NO: 90794 - RNA, 64 nt, Human
ugaaacuagaaaugucauccugcuugauuuuucaucagccaaguuaaaccccugcuuucugucc

SEQ ID NO: 90795 - RNA, 64 nt, Human
uaauaacuguguucuaauuaacacaguaaucuguucagccaaaggauacuaacagccauucuuu

SEQ ID NO: 90796 - RNA, 64 nt, Human
uugaggaagggaaugagcuccuuucuccucuccuucagccaaucauuaucaaauguuccuucag

SEQ ID NO: 90797 - RNA, 64 nt, Human
caugguucacagcaaugugcuacgauccaagauaucagccaaggagcccacuuaggggagaacu

SEQ ID NO: 90798 - RNA, 64 nt, Human
uccacaggaaauggacuauuuuugcaguccaacaucagccaaccacacacagccguguuuggaa

SEQ ID NO: 90799 - RNA, 64 nt, Human
guuugacucuccuuucugggaugacaucucagaaucagccaaagacuucauccggcaccuucug

SEQ ID NO: 90800 - RNA, 64 nt, Human
ugaguggggcugaaggccaggcugagugccugggucagccaaaccccuggcacccccaggguga

SEQ ID NO: 90801 - RNA, 64 nt, Human
cacauauugguuccuugauacauuucauaugauaucagccaagaguuuuccugugguuccagcc

SEQ ID NO: 90802 - RNA, 64 nt, Human
aaacaaaacaaaaaagacaaaaccuaaaacugagcuaucuaagggggaggguccccgcaccuac

SEQ ID NO: 90803 - RNA, 64 nt, Human
gauucuagucugguaaauaaccacaguguaggaacuaucuaacuggcauuuguguuucuugcga

SEQ ID NO: 90804 - RNA, 64 nt, Human
accguauagagagccaagguacagccguuagagacuaucuaauugagccccuacauuuuguagu

SEQ ID NO: 90805 - RNA, 64 nt, Human
uucuauauuaaaggcucaggaugucacggagaaucuaucuaaucccacuguauuaagaggggaa

SEQ ID NO: 90806 - RNA, 64 nt, Human
uuccuacaggagauagcuuucuuucccuuacucccuaucuaacacuuuugcucugcaggcagcc

SEQ ID NO: 90807 - RNA, 64 nt, Human
uacugaauauuccuuuaaaggaacugcagugagccuaucuaaguuuuuuuaaauuaaggcuuuu

SEQ ID NO: 90808 - RNA, 64 nt, Human
ucugaguaaauuugcugaaaauauaagagagaagcuaucuaauaccuuggagguaggucaucca

SEQ ID NO: 90809 - RNA, 64 nt, Human
gguuuaccaucucacucccaguaauacccagcuccuaucuaaagccccauucugcaugagaauu

SEQ ID NO: 90810 - RNA, 64 nt, Human
uuggggaaauagcuucaggauacuguaguuuccucuaucuaauagagaacuuuuuguuaacaga

SEQ ID NO: 90811 - RNA, 64 nt, Human
ggagggacagagggaaggucacaggcaagggugccuaucuaaguggaacuaauugcccgagggc

SEQ ID NO: 90812 - RNA, 64 nt, Human
uggaccuggaguaggagacccggaugcacuggggcuaucuaacaguacuggcaucugauaggua

SEQ ID NO: 90813 - RNA, 64 nt, Human
gaucagaaaaaaaguccauauggacuguggauaccuaucuaaaagaagaaaacugauggcuaag

SEQ ID NO: 90814 - RNA, 64 nt, Human
augaaaggguguucauguuaguuucuucaaaacccuaucuaauacuaggcaaaguagccaagag

SEQ ID NO: 90815 - RNA, 64 nt, Human
auuuaaucuuuuuuagaaauguggguaaugaauucuaucuaauaagucaaggaaaccagaauuu

SEQ ID NO: 90816 - RNA, 64 nt, Human
uucacagcucuucugccugcuccucaaaguggcucuaucuaaauauuuauuacuaaaauguuuu

SEQ ID NO: 90817 - RNA, 64 nt, Human
uccauguucaaggcaauggcuuuuuaaaucuuggcuaucuaaaauuuuuucccuuuguuuugaa

SEQ ID NO: 90818 - RNA, 64 nt, Human
uuuuauuguguggccaaugucuuugggcaugaugcuaucuaaucauuguuaaugugagaacauu

SEQ ID NO: 90819 - RNA, 64 nt, Human
aagggggugcagucugaggccaccaccccccuuccuaucuaagggagggcugaagacaaggggc

SEQ ID NO: 90820 - RNA, 64 nt, Human
auacauguaaguauauaaacauuuagaaguguaccuaucuaacaaacuauuaugaaauacuuuc

SEQ ID NO: 90821 - RNA, 64 nt, Human
auuuagauuauguucuuauaagauucuauauuuccuaucuaaaauguuguuguaauucaauuua

SEQ ID NO: 90822 - RNA, 64 nt, Human
acauuuaucuuuguacguucuucuauugugcuuucuaucuaauuuuuauuaauuuguaagagua

SEQ ID NO: 90823 - RNA, 64 nt, Human
auuuuuugaucuuuauuugagauuguuuucauaucuaucuaaauuauuaggaguguguguauca

SEQ ID NO: 90824 - RNA, 64 nt, Human
cuucucuacccaagcucaagagcugcuucuguugcuaucuaagaacugcauacccuccucccug

SEQ ID NO: 90825 - RNA, 64 nt, Human
uucuguuuaaaaaggggagaugagaaagggaauacuaucuaaccaauaacuugaacaaaaacac

SEQ ID NO: 90826 - RNA, 64 nt, Human
ugcugguggccacaugggugcugguggcagggaucuaucuaauguggaggcacgguaaggguua

SEQ ID NO: 90827 - RNA, 64 nt, Human
guuggaaaccucagcaauuuucaauucaaggaaucuaucuaagacaaauagaauacauuuugua

SEQ ID NO: 90828 - RNA, 64 nt, Human
auuuaacuauuacagaaagcaguaacuauugcaacuaucuaauaguucacacaaaagaauuaaa

SEQ ID NO: 90829 - RNA, 64 nt, Human
auuuuuccuaacaaaagaugaaagcagggaauuucuaucuaaaugaugaguauuaguucccugu

SEQ ID NO: 90830 - RNA, 64 nt, Human
aacauagccucagaguauuucauauaaauuuucucuaucuaauucaaacauaucuccccaugau

SEQ ID NO: 90831 - RNA, 64 nt, Human
guuucacaucagacuguaccauugugauuuagaccuaucuaaaauucagagcauaucaucuggg

SEQ ID NO: 90832 - RNA, 64 nt, Human; identical to SEQ ID NO: 84798

SEQ ID NO: 90833 - RNA, 64 nt, Human
aaaagaauuugcaggcaaccauguuuaauuugaacuaucuaagaugguagauuuuagaagcuag

SEQ ID NO: 90834 - RNA, 64 nt, Human
auaaaucacaguaaagaaauucuuacuucucuugcuaucuaagaauagugaaaaauaacaauuu

SEQ ID NO: 90835 - RNA, 64 nt, Human
cacugccucuauuucuauaaccauuucaccuggacuaucuaaucaguccuaugaauguaucccu

SEQ ID NO: 90836 - RNA, 56 nt, Human
caacacaaccagcagagugacacauacuaucuaaaacucgaccaaaugagguucuu

SEQ ID NO: 90837 - RNA, 64 nt, Human
cucaggaaaucugaagucuguauauugauugagacuaucuaaacucauaccuguaugaauuaag

SEQ ID NO: 90838 - RNA, 64 nt, Human
ggcuuuuccuggagggaaaggauaggcuguugcucuaucuaauuuuuuguuuuuguuuuuggac

SEQ ID NO: 90839 - RNA, 64 nt, Human
agacaucuaaauaucuguagauagaaacauuuaucuaucuaaauauauugauagaccugucauu

SEQ ID NO: 90840 - RNA, 64 nt, Human
aaaaugacaguuguguccuagccacaucagacagcuaucuaagcucuggacuaccccuuugugc

SEQ ID NO: 90841 - RNA, 64 nt, Human
caaaguguaguugguagaagaaauugcuaaauaccuaucuaaugugcuauguuuaucaaaucgu

SEQ ID NO: 90842 - RNA, 64 nt, Human
uuaucagacagagcacugacuauguacuaucaaacuaucuaacaaucugcauaagucugauucu

SEQ ID NO: 90843 - RNA, 64 nt, Human
uuucacuguugcaaaaucacuuccaaaaugauagcuaucuaacaacuaauuacuaauuuuuaaa

SEQ ID NO: 90844 - RNA, 64 nt, Human
auacugaauuugccuacuauccugaauuugccuacuaucuaaucagcaauuaaauaaauugugc

SEQ ID NO: 90845 - RNA, 64 nt, Human
gcuacugaauuggugaauuuccugacagacaaugcuaucuaaccauaguucauguuaggggaag

SEQ ID NO: 90846 - RNA, 64 nt, Human
aaauuccuuacgcagugguauucaugauggugcccuaucuaaguccaggacuguuuuccuacag

SEQ ID NO: 90847 - RNA, 64 nt, Human
cuucaaugacgagagcaauauuaagaagacauugcuaucuaauuuuuaaucuuuuuaaaugaaa

SEQ ID NO: 90848 - RNA, 64 nt, Human
aaaugagguacucuccuggaaauauuaagaaagacuaucuaaauguugaaagaucaaaagguua

SEQ ID NO: 90849 - RNA, 64 nt, Human; identical to SEQ ID NO: 84748

SEQ ID NO: 90850 - RNA, 64 nt, Human
uuaacaagaaauuuguauacccacgcuucagcuacuaucuaaucaucacccgaagauuuaagau

SEQ ID NO: 90851 - RNA, 60 nt, Human
ucuuuccaaaaucuaauuaauuaauagaggcuaucuaauuuuacacucuguauugaaaau

SEQ ID NO: 90852 - RNA, 64 nt, Human
agaaaguuguucuugugauuaaacuauaaauaaacuaucuaauuuucauaaguuuguguguugu

SEQ ID NO: 90853 - RNA, 64 nt, Human
caccuguuucacuaauaacuuaccccugaugagucuaucuaaacauaugcauuuuaagccuuca

SEQ ID NO: 90854 - RNA, 64 nt, Human
ucauauugagaggaauaugggcuugauccucuuccuaucuaaaugggugggccauuugauugua

SEQ ID NO: 90855 - RNA, 64 nt, Human
aucaauuaauguuuucuggugaucacaucaggcccuaucuaagaagcucaugguauacaagggu

SEQ ID NO: 90856 - RNA, 64 nt, Human
aagaaaaugagagcagaaaguaagcauuuccagccuaucuaauuucuuuaguuuucuauuugcc

SEQ ID NO: 90857 - RNA, 64 nt, Human
augauuuaaacuggaaccugagguauuuuucaugcuaucuaaucauauaccuaagauaaaccaa

SEQ ID NO: 90858 - RNA, 64 nt, Human
gccaagacgagaagucauuucccagcgaugucugcuaucuaaucuguauucaaauccccccaau

SEQ ID NO: 90859 - RNA, 64 nt, Human
ccaucagaaauagaaaaugccuggcacgaacagucuaucuaaauucucaauuucacuucaaauu

SEQ ID NO: 90860 - RNA, 64 nt, Human
caacagggaagggguuggggacaggucugccaaucuaucuaaaagccacaauauggaagaagua

SEQ ID NO: 90861 - RNA, 64 nt, Human
gguccauuuacaucaaacagcugaucagaggacucuaucuaaauugugaucguggcagauagag

SEQ ID NO: 90862 - RNA, 64 nt, Human
guacaauguuugguuuuauuccuaaaguaaauagcuaucuaagagagggcauuuucacuuuuuu

SEQ ID NO: 90863 - RNA, 64 nt, Human
cuuuaaaauaucuuuuaauuugaggaauuacauucuaucuaaauugugugucuguuuuugaaag

SEQ ID NO: 90864 - RNA, 64 nt, Human
cucuuuucuuccuucuuuuccuuccuuuuuguuucuaucuaaauaaaagcuuucccuguguugg

SEQ ID NO: 90865 - RNA, 64 nt, Human
aguauuagugaaucacugaauagcuuaaguaugacuaucuaaguuauaaguuagucuuuagugg

SEQ ID NO: 90866 - RNA, 64 nt, Human
uauaagcaaaaacgugccguuuaaaccacuggaucuaucuaaaugccgauuugaguucgcgaca

SEQ ID NO: 90867 - RNA, 64 nt, Human
uuaguuuacuguugaauacuagaaguucuucauucuaucuaacugcauuuucauacccauuaag

SEQ ID NO: 90868 - RNA, 64 nt, Human
uauuuuuuuaaauuugauucuuuucuuugcaaugcuaucuaaccagaauacauaggggaacugu

SEQ ID NO: 90869 - RNA, 64 nt, Human
ucccauuuuuauaaaucugagcauugauaauguucuaucuaaauuuguacagugugauuuuuuu

SEQ ID NO: 90870 - RNA, 64 nt, Human
gcagaugcuugugggcugaguaauuggcacaacucuaucuaagguguuuacuaguuucugaagu

SEQ ID NO: 90871 - RNA, 64 nt, Human
caauaaaugcacaacgcccaaaggaaauaaaauccuaucuaauccuacucuccacuacacagag

SEQ ID NO: 90872 - RNA, 64 nt, Human
aaguggcaauuccauacauauuuuagaguuuuuucuaucuaaaauuaguuaaauacuuagaaug

SEQ ID NO: 90873 - RNA, 64 nt, Human
auuggauuauuacuacaaaaccguuuagucauaucuaucuaaucagaucuucuuuugggaggau

SEQ ID NO: 90874 - RNA, 64 nt, Human
cauggcacuccagccugggcgacagagcaagacucuaucuaaaaaaaaagcuuguuaauagaac

SEQ ID NO: 90875 - RNA, 64 nt, Human
auuacuuaaaaagaaaucaggggaagaaagauaucuaucuaaucuauuaaaucuuuauaaaaca

SEQ ID NO: 90876 - RNA, 64 nt, Human
ggaaauagaauaacaaucuccauuuuuuucuuuacuaucuaaaaguuuaucgguaucuugaugu

SEQ ID NO: 90877 - RNA, 64 nt, Human
aaaucagagauggggaccaggcucagaguucuaccuaucuaacccccaaccacagcccccuugg

SEQ ID NO: 90878 - RNA, 64 nt, Human
auuuccauaguccuggaauccagagccaaguggccuaucuaaaauucacagcccuuuuauucuc

SEQ ID NO: 90879 - RNA, 64 nt, Human
agaccaacacaagagcaauauugaauuguucauucuaucuaaaauuacauguauauaaaauaua

SEQ ID NO: 90880 - RNA, 64 nt, Human
uuuaucacaaguuuuccaaaccuccuuccccacccuaucuaaaguguuccuuaccuuucauggg

SEQ ID NO: 90881 - RNA, 64 nt, Human
aaaaaaauaccucaggaaagaauagaaagaaagucuaucuaaugacaugccuauaugagaagaa

SEQ ID NO: 90882 - RNA, 64 nt, Human
aacaccacugcuuuucagcauuguacuggaagugcuaucuaaugcagugauaccaaaaaaaaag

SEQ ID NO: 90883 - RNA, 64 nt, Human; identical to SEQ ID NO: 84801

SEQ ID NO: 90884 - RNA, 64 nt, Human
ugaaagacaauauaaugaagugcuccagucaggccuaucuaaacuggauucacagcucugucac

SEQ ID NO: 90885 - RNA, 64 nt, Human
aagcacccacuuuugcaauguuguucuaagcuaucuaucuaacucucagcccaugauaaaguuc

SEQ ID NO: 90886 - RNA, 64 nt, Human
agcucugucuucccccaccugccuagcccaucaucuaucuaaccgguccuugauuuaauaaaca

SEQ ID NO: 90887 - RNA, 64 nt, Human
ucgcuccguugcacgggcgccuuaaguuauuggacuaucuaauaucuauguauuuauuucgcug

SEQ ID NO: 90888 - RNA, 64 nt, Human
uuguuuuuacaugguaauugcauguacuuaggaucuaucuaauaggggcuuuaaauaaauuugg

SEQ ID NO: 90889 - RNA, 64 nt, Human
guauguauuauggauuggagaagcacuuauuacacuaucuaaccuaauauguagaacaauucuu

SEQ ID NO: 90890 - RNA, 64 nt, Human
caaggugcuaaaaggaauagguaggagaccucuucuaucuaauccuuaaaagcauaauguugaa

SEQ ID NO: 90891 - RNA, 64 nt, Human
agucucccaggcccccuugaucuguaccccaccccuaucuaacaccacccuuggcucccacucc

SEQ ID NO: 90892 - RNA, 64 nt, Human
ccaaaugcaguucauugcagacaccaccauauugcuaucuaauggggaaauguagcuaugggcc

SEQ ID NO: 90893 - RNA, 64 nt, Human
cuaauaaucuaugaaacacuaggucuuacuucuucuaucuaacagaauauuuguauucauaaug

SEQ ID NO: 90894 - RNA, 64 nt, Human
uauucucauuugggagaucuggugaucucccaagcuaucuaaaguuuguuagauagcugcaugu

SEQ ID NO: 90895 - RNA, 64 nt, Human
gguuuucuccucaucaaaagcauuucuuaagugccuaucuaaaagcaauuaaagacugugucug

SEQ ID NO: 90896 - RNA, 64 nt, Human
cccucucuacgcucuucuauuuuugguauauuuccuaucuaaccuucaaauagcuuccaauucu

SEQ ID NO: 90897 - RNA, 64 nt, Human
ugucauuuaguguccaacuuuacggauagguugacuaucuaaauaggcauuuuuagucauuaaa

SEQ ID NO: 90898 - RNA, 64 nt, Human
uuaguaaauucacaaacuuguucaaccaucaccacuaucuaauuccagacucacgcuuuuuuaa

SEQ ID NO: 90899 - RNA, 64 nt, Human
ugcuugaguccagcuugggcaacauagcgagacccuaucuaaaauaacaauaauauauggccag

SEQ ID NO: 90900 - RNA, 64 nt, Human
uaucuauuuaucuuauaucguagaucugauaacccuaucuaaaagaaagucacacgcuaaaugu

SEQ ID NO: 90901 - RNA, 64 nt, Human
cuguggagaaccagaauuugguaaaaucuagauccuaucuaaaaauauguaguuauuaaacauu

SEQ ID NO: 90902 - RNA, 64 nt, Human
aagugucaacagaagcacugaugguucuuuucuacuaucuaacaggguuaauuucaccacaaaa

SEQ ID NO: 90903 - RNA, 64 nt, Human
uaaccaguauuaagggaaaaugauccagcuucagcuaucuaauucacaaauuaauuucuggaaa

SEQ ID NO: 90904 - RNA, 64 nt, Human
uuugccacaauuauuuaaauauuauguuugugaacuaucuaagcaugagaaaauacaaagcuuu

SEQ ID NO: 90905 - RNA, 64 nt, Human
ccauggccuaaucaccuuuccaaggccccaccuucuaucuaagacaaucacgcugggaauaggu

SEQ ID NO: 90906 - RNA, 64 nt, Human
auuaaaaaucuucgcaaaggucacuuuuuaauggcuaucuaacacuccauauguggugggcaag

SEQ ID NO: 90907 - RNA, 64 nt, Human
aggaaccacaaacugcccucuaauaagacaucggcuaucuaagcgugugggugcccccuuucug

SEQ ID NO: 90908 - RNA, 64 nt, Human
uucagauagaaaauaauuuuagaauaaauauguucuaucuaauacaugggacagauguuauuuu

SEQ ID NO: 90909 - RNA, 64 nt, Human
gcuucuuacaacguucgcucuguucauggguugucuaucuaacauugagcagcauuggagaggc

SEQ ID NO: 90910 - RNA, 64 nt, Human
uuuaaccuugcugacauccaaauagaagauaggacuaucuaagcccuagguuucuuuuuaaauu

SEQ ID NO: 90911 - RNA, 64 nt, Human
uauauuuuccauagagccuaaacuuuauagaucacuaucuaaaugaaaauuuacaucaaacuag

SEQ ID NO: 90912 - RNA, 64 nt, Human
aaagaauauuuuucauaauauuuuaagauacauacuaucuaaaaguagaauuuuguucagcauu

SEQ ID NO: 90913 - RNA, 64 nt, Human
gugaccuccuauuuuguaagggcuguuagaaguucuaucuaagaaauggcauucuguagguuua

SEQ ID NO: 90914 - RNA, 64 nt, Human
auaaaguuauagaagcagaugaucuguuaauuuccuaucuaauaaaugccuuuaauuguucuca

SEQ ID NO: 90915 - RNA, 64 nt, Human
uucugggcacuaagaaggucuaugaauuaaaugccuaucuaaaauucugauuuauuccuacauu

SEQ ID NO: 90916 - RNA, 64 nt, Human
cuguguuuuauaucgaagacuuagcuaugaauugcuaucuaaaucucagagcuuagaagccaac

SEQ ID NO: 90917 - RNA, 64 nt, Human; identical to SEQ ID NO: 84752

SEQ ID NO: 90918 - RNA, 64 nt, Human
augguccuuuuuuuuucuauaaaucaccaaccaacuaucuaaauggacauuugggggaauuccc

SEQ ID NO: 90919 - RNA, 64 nt, Human
auuugcaaucacugaagucauagaaaauagguaacuaucuaauuagagaaauaauuguuguauu

SEQ ID NO: 90920 - RNA, 64 nt, Human
uuucgaacugaaaauucaugguaaaauaggauuucuaucuaauguuaauccauugcuuauuugu

SEQ ID NO: 90921 - RNA, 64 nt, Human
gauuuuuuuuuuuuuuuaacuuuggcacauugaucuaucuaaaccugguggggagaauuauccc

SEQ ID NO: 90922 - RNA, 64 nt, Human
agacuuagaguuaauguccuucaucugaucuauccuaucuaaucuguacuaugggugaaucuuu

SEQ ID NO: 90923 - RNA, 64 nt, Human
aagggcaggaugaggcugcaccgcugggaagagucuaucuaagcucuuggcuuggagucccgug

SEQ ID NO: 90924 - RNA, 64 nt, Human
ucucuuucucuccuuucuuuuucuucuucccucccuaucuaacccucccauggcaccuucagac

SEQ ID NO: 90925 - RNA, 64 nt, Human
aauguuauggccuaaugaaagcuauauacuugugcuaucuaaagcacuacuuuguaaagaugac

SEQ ID NO: 90926 - RNA, 64 nt, Human
uggucuggauacgaaguuuacaguuucauaccaacuaucuaaaaccuaauugcaaauugaccac

SEQ ID NO: 90927 - RNA, 64 nt, Human
agaucauugcagaaagucauuuuuggauaggcugcuaucuaauuugcaguugucagaaauacug

SEQ ID NO: 90928 - RNA, 64 nt, Human
ugccauguacagaggcaggagucacguuuggucaccauggaagcuuuuauugcucccacauggu

SEQ ID NO: 90929 - RNA, 64 nt, Human
gcccaccuucucuuuucacauaggagggaacagaccauggaaauuuaaacgacuuccucacggu

SEQ ID NO: 90930 - RNA, 64 nt, Human
gggagggccaguuccacauugagccagccuggucccauggaaaaugauggccugggcuuucuga

SEQ ID NO: 90931 - RNA, 64 nt, Human
guugaggaguagaagaggaugaccagcuagacucccauggaauuggaacuccuauuccuugcuu

SEQ ID NO: 90932 - RNA, 64 nt, Human
auuuauuuccaaccccaacagacacugacaggguccauggaauucuucgggaaauccuccaagg

SEQ ID NO: 90933 - RNA, 64 nt, Human
cagcugaucccagucacugcuugcuggggccaugccauggaagcuucccaucagucucccagcu

SEQ ID NO: 90934 - RNA, 64 nt, Human
ugaccccagagcucuguguauuugcauccagaggccauggaaacauucuuugcauuuaagagac

SEQ ID NO: 90935 - RNA, 64 nt, Human
ucccugccugcugcugccccauuugaucaagagaccauggaagugucagagauucagaauccaa

SEQ ID NO: 90936 - RNA, 64 nt, Human
uuacccaagcuguggcagccgucccaggccacccccauggaagcaauaaagcucuucccugagc

SEQ ID NO: 90937 - RNA, 64 nt, Human
uugcuauguauaaaugaaauuaccauuuugagaaccauggaaccacaggaaaggaaauggugaa

SEQ ID NO: 90938 - RNA, 64 nt, Human
augauggcaucuacucaagguauuuuacagauuaccauggaaaugguagauacaguuuaaaagu

SEQ ID NO: 90939 - RNA, 64 nt, Human
gugugucagccugaggcuucuuuucucucauuucccauggaaggacuucggaaaugccuuaagu

SEQ ID NO: 90940 - RNA, 64 nt, Human
cuuggggaaggccauggggaccugaaacauugccccauggaaaugucgacccugugcggacauu

SEQ ID NO: 90941 - RNA, 64 nt, Human
gccuaacugccaauaucaaguugcagauuuuaauccauggaaauuguguuuugugcugaauugu

SEQ ID NO: 90942 - RNA, 64 nt, Human
ucacaucacuuuugaaauguaauucuggucuauaccauggaagucauaaauggacauuauaguc

SEQ ID NO: 90943 - RNA, 64 nt, Human
aggugggcauuuuucugugugcccccaaaaagcuccauggaaacaggcaccugguagcugcgga

SEQ ID NO: 90944 - RNA, 64 nt, Human
uaauaucgugccaagccucaaaaauaggcuuauuccauggaacaagaauuaaaaaugaauaagc

SEQ ID NO: 90945 - RNA, 64 nt, Human
uaaaguuccuuuaauguccuuuugagauuuugagccauggaacuuacuuguucaccuggcuaag

SEQ ID NO: 90946 - RNA, 64 nt, Human
ccuuccacucugaguagcacaucuccccaggugcccauggaacaccugcuuucaucccaaauau

SEQ ID NO: 90947 - RNA, 64 nt, Human
ugaaaggcccccuugacacauccaggccaaccucccauggaauagguaggcaagccaggacucc

SEQ ID NO: 90948 - RNA, 64 nt, Human
ggaaucucuuccacgggaccagcccagagcuaugccauggaaaugauauuggauguugguaaga

SEQ ID NO: 90949 - RNA, 64 nt, Human
uuaauuauauucccaaaaaugaaaacacugagaaccauggaaaaacuaguccuuacuugguaau

SEQ ID NO: 90950 - RNA, 64 nt, Human
ugcccggcgucccgucuaaagguguucugcagauccauggaaagcuuccugggaaacguaugcu

SEQ ID NO: 90951 - RNA, 64 nt, Human
cugucuucuaccaggggcugcugacuccaguuacccauggaaugcaggaccugggagggguagc

SEQ ID NO: 90952 - RNA, 64 nt, Human
cuugagggucaaaaaaaaauacuuaggaagcuagccauggaagcuucuugccucugacccagcc

SEQ ID NO: 90953 - RNA, 64 nt, Human
ugcucaauauugggaaauauauugaggaguuauuccauggaaauacaaugcuuuccaccuacua

SEQ ID NO: 90954 - RNA, 64 nt, Human
uauguuccuuugaaaagaguccaguacccaggccccauggaaaggucugaaaauaauauuccag

SEQ ID NO: 90955 - RNA, 64 nt, Human
ucccugcccuuccuuugguugccauauggaauggccauggaaugcacgaagucacaaugcacca

SEQ ID NO: 90956 - RNA, 64 nt, Human
cuagugugauagaucgaaauuaacauauuuuugaccauggaaggaaauaaggaaauucaaccca

SEQ ID NO: 90957 - RNA, 64 nt, Human
cuggauaguaccugcaggaacaauauuccuguagccauggaagagggccaaggcucagucacuc

SEQ ID NO: 90958 - RNA, 64 nt, Human
gugggaagagaagcugaugcagccggugcuccacccauggaagaaaggcuggcuguccuugggc

SEQ ID NO: 90959 - RNA, 50 nt, Human
augccuacacacgguuuuaaccauggaaugaaugcacugcagacucucaa

SEQ ID NO: 90960 - RNA, 64 nt, Human
guuucaaaugcuuaaauauauaauacauuuuuuuccauggaagugagggaauauuucaguuucc

SEQ ID NO: 90961 - RNA, 64 nt, Human
aaccuccauguguggguccuuuguuuuauuagaaccauggaagaagguuccugggccaucagua

SEQ ID NO: 90962 - RNA, 64 nt, Human
gucgugaaagcucuccuaauacuuacuuaaauagccauggaagaaaauuaugcuugucccuucu

SEQ ID NO: 90963 - RNA, 64 nt, Human
ucuccaaaauguaaauucuaauguuuaccuuguaccauggaaaacaugaaaagagucuuagaag

SEQ ID NO: 90964 - RNA, 64 nt, Human
cccuuccugcuguguuauagaacuguaggggaggccauggaaaugacucuaaagauacaaaauu

SEQ ID NO: 90965 - RNA, 64 nt, Human
gugagauuugucuuacuuauuuuucuuuugguugccauggaaguuauggcccugaaaaucgucu

SEQ ID NO: 90966 - RNA, 64 nt, Human
agcccaguuacugcacuugccacuaccaugcuguccauggaaggaauaaucagcaguucaguug

SEQ ID NO: 90967 - RNA, 64 nt, Human
cagcagauguugcaaacuuucauaccacugcuggccauggaagccucuuaacaacacacuguca

SEQ ID NO: 90968 - RNA, 64 nt, Human
ucgucauccccggagucccuauacagagguccugccauggaaccuuccccuccccgugcgcucu

SEQ ID NO: 90969 - RNA, 64 nt, Human
cugucacccccggagucgccacacagacguccugccauggaaccuuccccucccggugcacccu

SEQ ID NO: 90970 - RNA, 64 nt, Human
acauacagaaccuguccaucuuuaagaccuucauccauggaaucuacuauacaggaggaugcag

SEQ ID NO: 90971 - RNA, 64 nt, Human
ugaaauaaguaauuuauuguaagacaacaucaagccauggaaacuuggcagaagauucaaagca

SEQ ID NO: 90972 - RNA, 64 nt, Human
cucuuuuguuuaucuuguuuuugguuacaugauaccauggaaauauuccaaauaaauuuuuuuc

SEQ ID NO: 90973 - RNA, 64 nt, Human
ccccaguucccuccucccucgguuauaaagauucccauggaaaguguccaaucagauccccaaa

SEQ ID NO: 90974 - RNA, 64 nt, Human
uauuguuuauguaaauguuuguuaaaaauaaaucccauggaauauuuccauguaacuuaguugu

SEQ ID NO: 90975 - RNA, 64 nt, Human
uucaccucuaccuugcuuucaaaaggacugcuuaccauggaagugcuccagaagaaucauuuga

SEQ ID NO: 90976 - RNA, 64 nt, Human
ucagaagacuaaccagcuuagucagaagaugguuccauggaagaaaaaggccaaggaguuugaa

SEQ ID NO: 90977 - RNA, 64 nt, Human
aagauuuaauaggagggguuaagguucaugagaaccauggaaagauguggucugagaugggugc

SEQ ID NO: 90978 - RNA, 64 nt, Human
ccuuuugugcucuucugugaucacaggaccauuuccauggaaugcagauucauacccagccagc

SEQ ID NO: 90979 - RNA, 64 nt, Human
auauaugacauguuuauauuguaaaugcacuuuuccauggaauaauuuagggaaguguuuuaau

SEQ ID NO: 90980 - RNA, 64 nt, Human
caaacauuucuuugagaucuauauuuauaagcagccauggaauuccuauuaugggauguuggca

SEQ ID NO: 90981 - RNA, 64 nt, Human
ggaggcuugaagcuuuccuuuauucuugaaucucccauggaaggguuguaccccagcugccacu

SEQ ID NO: 90982 - RNA, 64 nt, Human
uaagaaggaaugcgaguaaggauuggcuugaauuccauggaauuucuaguaugagacuauuuau

SEQ ID NO: 90983 - RNA, 64 nt, Human
guugagguaccuccaaggaccggccuuugcaccuccauggaaacgaagcaccaucauucccguu

SEQ ID NO: 90984 - RNA, 64 nt, Human
guuauaauaaccugguuaucuaaccuguuccauuccauggaaccauggaggaggaagacccuca

SEQ ID NO: 90985 - RNA, 52 nt, Human
agucagcugugauguacugacaccauggaauuccacugccagugacccacug

SEQ ID NO: 90986 - RNA, 64 nt, Human
aacugaauuauaagaggcugauaauuccagugguccauggaaugcuugaaaaaugugcaaaaca

SEQ ID NO: 90987 - RNA, 64 nt, Human
uacagcaguuuguacgagcucuuaaguguugauuccauggaacugacggcuuugcuuguuuuga

SEQ ID NO: 90988 - RNA, 64 nt, Human
acccuugccuuucugggacuuggccucaccccacccauggaauaccugccucaucccaaagauc

SEQ ID NO: 90989 - RNA, 64 nt, Human
ccagggaggaaaaccagagcacacaguuuugucaccauggaacaccccaaaugccauucuucag

SEQ ID NO: 90990 - RNA, 64 nt, Human
uaugcauauaaaucaaggaaccaaauaucuguagccauggaaaugucugacuagaaauauuuau

SEQ ID NO: 90991 - RNA, 64 nt, Human
uccuacagugagaagacacagcguuuuggcaacaccauggaaagugggcuuaaaaaaggguuuu

SEQ ID NO: 90992 - RNA, 64 nt, Human
guuacugggcuugcuacuauuuguaacuccuugaccauggaauuauacuuguuuaucuuguugc

SEQ ID NO: 90993 - RNA, 64 nt, Human
cuuuuaaaggccugguucuaaguccuuuuuaaagccauggaacaaaaccugauacaucacccua

SEQ ID NO: 90994 - RNA, 64 nt, Human
cuuuuugcuuccuaaagauuugaauuuuuuguucccauggaagaaguaaagaagaggucacuag

SEQ ID NO: 90995 - RNA, 64 nt, Human
caaaagugaaaguaguuguucacaaaagaauucgccauggaauucuuucaguuaccaagcucuc

SEQ ID NO: 90996 - RNA, 64 nt, Human
caugcuucuugaguugcuucaugguuuaugcucgccauggaaagcuaucaguaacaguuucaug

SEQ ID NO: 90997 - RNA, 64 nt, Human
agaggugcagcuuccaugucaguugguguuguaaccauggaaaagucccuuuccaaucaaacuu

SEQ ID NO: 90998 - RNA, 64 nt, Human
caguugcuaggcuucaaugccuaucgguagcaagccauggaaaaagaugugucagcuagguaaa

SEQ ID NO: 90999 - RNA, 64 nt, Human
uccaagcugaugaagggaagccuuugccaauggcccauggaagacacuugguuugagaaacccu

SEQ ID NO: 91000 - RNA, 64 nt, Human
uguaaacacuauagcaucuguuaagauccaguguccauggaaacauucccacaugccgugacuc

SEQ ID NO: 91001 - RNA, 64 nt, Human
ggcggaggcaccccgaagaaugaaaaguacacacccauggaauucaaggugggagccuucuuuu

SEQ ID NO: 91002 - RNA, 64 nt, Human
uuugacggugcaucagcaugccgcguuaggcucgccauggaaauacgcgcggggagcggccgcu

SEQ ID NO: 91003 - RNA, 64 nt, Human
aauaugagaucaucaaacauugauaguagggacuccauggaauauuugcccaguaaugguaaga

SEQ ID NO: 91004 - RNA, 64 nt, Human
uaauaguguaaaaauucccugagcuaagcuaaaaccauggaagaaacaugcuacuuuaguguuu

SEQ ID NO: 91005 - RNA, 64 nt, Human
acucugaagauggacucuaaacuuugguuuaccuccauggaaaauaaagauuuagaaaccaggu

SEQ ID NO: 91006 - RNA, 64 nt, Human
acucgcccaccuggaugucccaaagugcuagauuccauggaauuuuccugcauggagugcuaca

SEQ ID NO: 91007 - RNA, 64 nt, Human
cucucucucucuuuuuuuuuucuuuuuccuuuugccauggaaucugggugggagaggauacugc

SEQ ID NO: 91008 - RNA, 64 nt, Human
gaugcagaagcgugcgugggaaugcagcuguuuuccauggaaccagacgcuacagagacugcaa

SEQ ID NO: 91009 - RNA, 64 nt, Human
aagaauuuuaaugaaaaaauuacccagauuggcuccauggaaaaggaggaacagcguuuccgua

SEQ ID NO: 91010 - RNA, 64 nt, Human
uaccuggccagcccuggcuuuaauaggacugauaccauggaauauuucaucucaccaagaugug

SEQ ID NO: 91011 - RNA, 64 nt, Human
uauggugucacaaaaagacaaaugauuguaggauccauggaagugcacuuaggcuugcuguggu

SEQ ID NO: 91012 - RNA, 64 nt, Human
ucuauuuuagcuuucaguuauucuaguuuguuucccauggaaucuguccuaaacugguguuuuu

SEQ ID NO: 91013 - RNA, 64 nt, Human
gagugaagcaacauggaugcagucagccaaguccccauggaagucgugcuucccaagcacaucc

SEQ ID NO: 91014 - RNA, 64 nt, Human
ggcagccuggccuguggcaucagucccugagucaccauggaagcagcauccugaccacagcugg

SEQ ID NO: 91015 - RNA, 64 nt, Human
gccugucccaugugcaucuuauuuaaaauuucccccauggaaaucacucuccuguugacuauuu

SEQ ID NO: 91016 - RNA, 64 nt, Human
ccacauuaauuuacuuuucucuauaccaaaucacccauggaauaguuauugaacaccugcuuug

SEQ ID NO: 91017 - RNA, 64 nt, Human
gcuuuuagagacccagacuugguuggcagcgcugccauggaacaccccagcaagcaccucccag

SEQ ID NO: 91018 - RNA, 64 nt, Human
cacaacccucuucccuauuucccuaaaaguaucuccauggaaugaacugugcaaaaucuguagg

SEQ ID NO: 91019 - RNA, 64 nt, Human
acaugguuguuauugugcuguugacaugaauagaccauggaaacauuuucaucauuauuauuca

SEQ ID NO: 91020 - RNA, 64 nt, Human
aaagcaugaaguacguguguguguguguguguuaccauggaaaaggauauucacaguaguacag

SEQ ID NO: 91021 - RNA, 64 nt, Human
guguuguauauuguguugaugacguacguuauuuccauggaagauagccgcuguggcagcuguc

SEQ ID NO: 91022 - RNA, 64 nt, Human
gugcaggggggucauuuuaauguaacaccacaccccauggaaacacuaguccugauaauaaaca

SEQ ID NO: 91023 - RNA, 64 nt, Human
uguccuccucuucaggacaugcuccauuuauuuuccauggaagacacagggucagagaucuguc

SEQ ID NO: 91024 - RNA, 64 nt, Human
cuugagcucucuggacacugcagaggacccauggccauggaacccugaagaagcaugucuggcc

SEQ ID NO: 91025 - RNA, 64 nt, Human
ucaugucagcagaguggcgccugccugugcuggcccauggaacggagacagcauugggcugacu

SEQ ID NO: 91026 - RNA, 64 nt, Human
aguggugggguuugagcaaugcuucucugcccuuccauggaaaguggaaccagaaauggugcca

SEQ ID NO: 91027 - RNA, 64 nt, Human
uaccuaauuccucaaugaccuuuaucuaaaaucuccauggaagcaauaaauucccuuuugaugc

SEQ ID NO: 91028 - RNA, 64 nt, Human
cggggguggggggugggggugggucagaacccugccauggaacuguuuccuucaucaugaguuc

SEQ ID NO: 91029 - RNA, 64 nt, Human
guccucccucacccccuccuucauaugaaaggugccauggaagaggcuacagggccaaacgcug

SEQ ID NO: 91030 - RNA, 64 nt, Human
agggcuccacaagcgugucuggcauucccacccaccauggaagacuggauacgcaccuggaaac

SEQ ID NO: 91031 - RNA, 64 nt, Human
aacugcaaucaggaaagcagcagcccacuccuucccauggaaucuagacagcauuuaucccucu

SEQ ID NO: 91032 - RNA, 64 nt, Human
uucuuguaauuagguucuuguuaauacagucauuccauggaauuacuuuuuaaaauuccuguga

SEQ ID NO: 91033 - RNA, 64 nt, Human
aauuuucauuaccaaaauguacagcuauuauuugccauggaaaagguuagucucauuuagaaaa

SEQ ID NO: 91034 - RNA, 64 nt, Human
gaaauucagaauuuuucuuuuuaauauauuucuuccauggaagaguugucaucacuaaaacuuc

SEQ ID NO: 91035 - RNA, 64 nt, Human
ucuagagaagaaagaacaacaucagcaguaaaguccauggaauagcuaguggucuguguuucuu

SEQ ID NO: 91036 - RNA, 64 nt, Human
agcauuguggaaucauguuggaagcuccacauguccauggaaguuugugauguacggccgaccc

SEQ ID NO: 91037 - RNA, 64 nt, Human
aucaaguuauuuccuuuuauaauacuuuucuuccccauggaacaaaugggaucaauuugugagu

SEQ ID NO: 91038 - RNA, 64 nt, Human
caagauuacgaaugcuuuugacuuuuuuuuuuguccauggaauauuugacagaugaaguaggac

SEQ ID NO: 91039 - RNA, 64 nt, Human
uucuuuaaaagaaacugagguucagauacacauaccauggaaaaaucuuacuuuucuuguuacu

SEQ ID NO: 91040 - RNA, 64 nt, Human
aaaccuuuggcuacacaauuggaagucuaagaacccauggaaaaaugccaucaaaugaauaaug

SEQ ID NO: 91041 - RNA, 64 nt, Human
aaaguguauuuuauucaguaguuugaggaucuugccauggaagauacuagcccagccuagcaga

SEQ ID NO: 91042 - RNA, 64 nt, Human
aauaaugcauuuaucuucccccccaccccccgccccauggaauauuuaaucuauuuaaucuucu

SEQ ID NO: 91043 - RNA, 64 nt, Human
auaucuuuacucaaaaaaacaaaaaaacaaaaacccauggaagcaacaaaagaguuaaacauga

SEQ ID NO: 91044 - RNA, 64 nt, Human
uggacaagaaucaaauuuuaccaggaguaauugcccauggaaacauucuguuuuucaaaagaag

SEQ ID NO: 91045 - RNA, 64 nt, Human
ugauugauccaaggccuucaauguaggagugcuaccauggaaauggacagaguuaucgaggcac

SEQ ID NO: 91046 - RNA, 64 nt, Human
ccaggcgcuggugagcccuggucaaugagcgcuuccauggaaaccgcucggcugauuacauuuu

SEQ ID NO: 91047 - RNA, 64 nt, Human
cugagguaguucaugaaaaugcugugcacucauuccauggaauaaauguuggaaagcugaucuu

SEQ ID NO: 91048 - RNA, 64 nt, Human
uaugagcuuagauuaccuagauuauuccaguaucccauggaagcugaggacuuauuccgcuuuc

SEQ ID NO: 91049 - RNA, 64 nt, Human
ccugugcucaggaugcagcccugggauccagcacccauggaagcuucugcugggauggugucac

SEQ ID NO: 91050 - RNA, 64 nt, Human
cuccucuguccaggaggccgggaucaggcuguugccauggaaguucagggccauagacugcccc

SEQ ID NO: 91051 - RNA, 64 nt, Human
cgccugcauagacuuucuaaacagugaguaaauaccauggaaugucagaaaugacuuuaucauc

SEQ ID NO: 91052 - RNA, 64 nt, Human
gcaucuaaucacuuagacuccccugaagaaucccccauggaaacugcccuuauccgcuguccag

SEQ ID NO: 91053 - RNA, 64 nt, Human
gaggcagagaaacaauuuuugaaaaagagcaaacccauggaaaaugucucagaucuaauauuaa

SEQ ID NO: 91054 - RNA, 64 nt, Human
cauugccuugcauuuguaccuuauugaucuuugcccauggaagucucaaagaucuuucguuggu

SEQ ID NO: 91055 - RNA, 64 nt, Human
aaccaaaaagagaugacaaaacuaaguucaggggccauggaaaaugaaaaaguccgcuauauug

SEQ ID NO: 91056 - RNA, 64 nt, Human
uuucacucuuagaaauugaauuagcauaauugggccauggaacacauaugcuggaaaucuuuga

SEQ ID NO: 91057 - RNA, 64 nt, Human
gaugugagauggaaaaacaaauucuggggcaaauccauggaaauuguuccaauuggcacaaccc

SEQ ID NO: 91058 - RNA, 64 nt, Human; identical to SEQ ID NO: 91047

SEQ ID NO: 91059 - RNA, 64 nt, Human
cagggagggcuagggggcagguggggaggggaagccauggaaauacaagucaaaggggugagau

SEQ ID NO: 91060 - RNA, 64 nt, Human
acagaaauaucgaccaacaccucccuggucacauccauggaaucagagcaagauuuccuuucug

SEQ ID NO: 91061 - RNA, 64 nt, Human
agcuguguuccaggaaccagaucacgauuuuuagccauggaacaauauaucccaugggagaaga

SEQ ID NO: 91062 - RNA, 64 nt, Human
guuuauuauuccuuaagaacucuguguuauauuaccauggaacgccuaauaaagcaaaaugugg

SEQ ID NO: 91063 - RNA, 64 nt, Human
cccacccgcucccuuuuuuccuuagccuucagugccauggaacuaaucaagggaggaaaagguc

SEQ ID NO: 91064 - RNA, 64 nt, Human
uccgcaguuuguccuggagugacauacacauccaccauggaaagggaagcaucucugccugugg

SEQ ID NO: 91065 - RNA, 61 nt, Human
acaccauuccugagguuuaaaauucacggcaccauggaaauguagcugaacgucuccaguu

SEQ ID NO: 91066 - RNA, 53 nt, Human
uccagauacuaaauuauuagauuccauggaaacuugggacuguuaucuaccuc

SEQ ID NO: 91067 - RNA, 64 nt, Human
aguaagccacacuauaucuucaugaguugcaaauccauggaaacacaguaaaccagcccugaaa

SEQ ID NO: 91068 - RNA, 64 nt, Human
ggugugguaaagccauuggaugaggaggggacugccauggaaaggagaguuuguuacuuacggu

SEQ ID NO: 91069 - RNA, 64 nt, Human
uacugcucucaagcaguggccucucucacuuuagccauggaauggcuccgaucuaccucacagc

SEQ ID NO: 91070 - RNA, 64 nt, Human
ucacccugaggaagguucauugccauugucaucaccauggaaacaacguuccucuccaccugca

SEQ ID NO: 91071 - RNA, 64 nt, Human
aaaggagaagauaacugaggauuuuaaaaagaagccauggaaaaacuuccuaguaagcaucuac

SEQ ID NO: 91072 - RNA, 64 nt, Human
agccagcacucuggaagcuuugggaucccaggaaccauggaauuauucccaaauggacucugac

SEQ ID NO: 91073 - RNA, 64 nt, Human
caagauaggcaagaaggacagcaguaaaugaagaccauggaagaaaagaaggaaugccaaagau

SEQ ID NO: 91074 - RNA, 64 nt, Human
acuugcacccagaaucuagugauuuuagucagauccauggaacagagcagcuucguaauacauu

SEQ ID NO: 91075 - RNA, 64 nt, Human
uccgucaacugaugaguggauuaauaaaauguuuccauggaauauuccuuggauuacucagcca

SEQ ID NO: 91076 - RNA, 64 nt, Human
ugaaaacugcuguuuuaaagugguuuauuauguuccauggaagaaacuggucuuauugaaugca

SEQ ID NO: 91077 - RNA, 64 nt, Human
guaccacaugguaauucuaagacuuguucuuuacccauggaauguaauauuuuugcaaagaugg

SEQ ID NO: 91078 - RNA, 64 nt, Human
aaaaaaaaaaaaaaagccucagcauuuuaucauuccauggaaggagaaucuuuugaaagaaagc

SEQ ID NO: 91079 - RNA, 64 nt, Human
caccggcacugugcacucuacucugcgacgauccccauggaacagcccugcacgcccaggauga

SEQ ID NO: 91080 - RNA, 64 nt, Human
uggaggcuuauuguaacauauaauauuagugaaaccauggaauuauaugaaaaugauacaugag

SEQ ID NO: 91081 - RNA, 64 nt, Human
cuguucugacuuuaagccagaacuuguggcugggccauggaagcugugacuccucuguggacau

SEQ ID NO: 91082 - RNA, 64 nt, Human
ucuuuggaggaaaauguaugcauuuauaaguguuccauggaaucaguuuuuauuguaucgauau

SEQ ID NO: 91083 - RNA, 64 nt, Human
aagucaacaugccccaagucaaagucuucuuuacccauggaauaagcuggcuugcuacuucccu

SEQ ID NO: 91084 - RNA, 64 nt, Human
agagggcugcauuuuggguugaguaauauggacaccauggaaguacaggaucugaguccaacau

SEQ ID NO: 91085 - RNA, 64 nt, Human
uauuuucugcgguuuuugcaagaauaagcaaagcccauggaauuuaauuuuucauugugaucag

SEQ ID NO: 91086 - RNA, 64 nt, Human
gaacggaauuuugagggcaaagaaaccuguguuuccauggaauugcugagacguggcuccuggg

SEQ ID NO: 91087 - RNA, 64 nt, Human
gccuaaggguaauguacagcccgugcuuggagaaccauggaagcuacaccccuacaggugcaua

SEQ ID NO: 91088 - RNA, 64 nt, Human
ucuugguagcuuggacuuagugggaguguuuacaccauggaaauugacaaacuauaaaucaggg

SEQ ID NO: 91089 - RNA, 64 nt, Human
uauuucuuuuguccaucagaucucuugugaaaucccauggaagguugugcucagccugucgggu

SEQ ID NO: 91090 - RNA, 64 nt, Human
uuaaauucugagcuccugagauacugacuagcaaccauggaaugaaugugugaccagaaagugg

SEQ ID NO: 91091 - RNA, 64 nt, Human
gucugaagugaacuuugcauugaauaaauuuuugccauggaaagaacaucaaacaagccacuca

SEQ ID NO: 91092 - RNA, 64 nt, Human
guggcaaguaccgccuuauggaguauacgggcaaccauggaaucaacaaggauuuggaguagag

SEQ ID NO: 91093 - RNA, 64 nt, Human
aguauuuauuguauuuuuauguucugaaaauuacccauggaacaauaugcuuaggauuacagga

SEQ ID NO: 91094 - RNA, 64 nt, Human
gauguuuaucuaaccugacaguugcaguuuucacccauggaaagcauuagucugacaguacaau

SEQ ID NO: 91095 - RNA, 64 nt, Human
gagguucaaggugcugcuuugcaugccugccaacccauggaaguuguuucuuacuucuuuucuc

SEQ ID NO: 91096 - RNA, 64 nt, Human
gacccgcagaccuguccccccgcaacagcuuauaccauggaaugaggacaaggugauacucuga

SEQ ID NO: 91097 - RNA, 64 nt, Human
gcgcugguggagcuggaguugcaccgcggcagcuccauggaaaucaaucugggggagaaggaca

SEQ ID NO: 91098 - RNA, 64 nt, Human
uggucagugguguccccaaggauagugcuggcuuccauggaaacccucacuccuggagauucca

SEQ ID NO: 91099 - RNA, 64 nt, Human
cacugcuugccagagccccuuccucucuuguuucccauggaaacggccucuucagaaggcagau

SEQ ID NO: 91100 - RNA, 64 nt, Human
gcuuagaagccagucaccagcccucugccugcagccauggaagggggugugcacgugccucugu

SEQ ID NO: 91101 - RNA, 64 nt, Human
uggaggagggucacagaguggggcacgugaggacccauggaaccguccuggugcccaggcccuc

SEQ ID NO: 91102 - RNA, 64 nt, Human
guccgaggggcccuggcaucugacucaggccacaccauggaaucacugcauccaaggccauucc

SEQ ID NO: 91103 - RNA, 64 nt, Human
cccagaucucagaaucaggccuauuuguguaggcccauggaaaucacuacuugugaaguagaga

SEQ ID NO: 91104 - RNA, 64 nt, Human
gaucaccugugcugcucugucccuaacuagugacccauggaagcuuccaagcaguuuucucuuc

SEQ ID NO: 91105 - RNA, 64 nt, Human
gaacccuguaucuccuccauagauucuuaguauuccauggaacauauuuugaaaaccuugggau

SEQ ID NO: 91106 - RNA, 64 nt, Human
auagaggaagugauuggaaguacuccacuuaaagccauggaauuagcaauaguuugcuuuuuaa

SEQ ID NO: 91107 - RNA, 64 nt, Human
gaaucaaggcuucggccaccugugcaauauuuucccauggaaugcagcaguaaauccaaguagg

SEQ ID NO: 91108 - RNA, 64 nt, Human
gagaggggaaggguacagagaaaccaucuacauuccauggaauguuuuuaauaaguaggcaaga

SEQ ID NO: 91109 - RNA, 64 nt, Human
agaggcgguggcuguguggcccccuugaguggagccauggaagggguggcauggugccacuggg

SEQ ID NO: 91110 - RNA, 64 nt, Human
cucuagagaagagcucaacucucucccaaccucaccauggaaagaaaauaauuaugaaugccac

SEQ ID NO: 91111 - RNA, 64 nt, Human
ucacuggauugggcugagcagagaacaaggccaaccauggaaauggauaaaugguacugaaugg

SEQ ID NO: 91112 - RNA, 64 nt, Human
acgucucuaacuauugaggguaaacacaagcuuuccauggaauccugggaaaauuaauaaugau

SEQ ID NO: 91113 - RNA, 64 nt, Human
gaugagucagugauugaagccaauauucugauucccauggaagauggaugggcaagaguguacu

SEQ ID NO: 91114 - RNA, 64 nt, Human
ccaguuccaucuguaguccuaaccaggagcccccccauggaacugcagcccccugucuccccuc

SEQ ID NO: 91115 - RNA, 64 nt, Human
uucuaguuuuaucuuccuuggcuuuaagagugugccauggaaagugauaagaaaugaacuucua

SEQ ID NO: 91116 - RNA, 64 nt, Human
cuuucaggaagcacacagucuacuacggugguuuccauggaagucacagagucaucaucuggcu

SEQ ID NO: 91117 - RNA, 64 nt, Human
gggccacuagucuaacagacggucacaaccagugccauggaaaaccaaggauauuagcaaaagc

SEQ ID NO: 91118 - RNA, 64 nt, Human
uguagacgaugcuuuaaagccuccgauccauguuccauggaagguacaucagcaauuaauucua

SEQ ID NO: 91119 - RNA, 64 nt, Human
aaguugcuguggacacuuuuaagaaacuuagaacccauggaacccuuguuuaucgccaugcaaa

SEQ ID NO: 91120 - RNA, 64 nt, Human
aauuaaggaagcauuuucccauugaaaguguguuccauggaaagucacauuccagauuugaagc

SEQ ID NO: 91121 - RNA, 64 nt, Human
gugaggguguuagcagugugagaucuuuggacacccauggaauccuuuccuccacaccacccgu

SEQ ID NO: 91122 - RNA, 64 nt, Human
uccucaaaaugcaugcccauugucuucagguuugccauggaaagucaaaugauuuccacuucau

SEQ ID NO: 91123 - RNA, 64 nt, Human
auagacuggauuaagaaaauguggcacauauacaccauggaauacuaugcagccauaaagaagg

SEQ ID NO: 91124 - RNA, 64 nt, Human
ccaucucaaaaaauaaauagauaaaaauaaaaacccauggaaaugguuuaagaaaaugguucug

SEQ ID NO: 91125 - RNA, 64 nt, Human
uuuuuucuuugcacuuuggaugcugaaauuuuucccauggaacauagccacaucuagauagaug

SEQ ID NO: 91126 - RNA, 64 nt, Human
augggcacaccacaguucugcucuguggaucaucccauggaaguuuccucacaaagucagcucc

SEQ ID NO: 91127 - RNA, 64 nt, Human
ggucuuccccagguugaggagagaaguggaagccccauggaagacagugcucccagcugaggua

SEQ ID NO: 91128 - RNA, 64 nt, Human
ugaagguaauccggagugagcaauggaguggcugccauggaaggaagaaaagcugccauuuccc

SEQ ID NO: 91129 - RNA, 52 nt, Human
uacaguuuuuggacagauagucccauggaaagagacugucaucaucacccuu

SEQ ID NO: 91130 - RNA, 64 nt, Human
acacuagggcuguuguacaaaauaguaaugauagccauggaaguuuuaccuuauucugugagaa

SEQ ID NO: 91131 - RNA, 64 nt, Human
uaucucuugauguuuucuugucaucuugaaggcuccauggaaugagauaaagcauugacccacc

SEQ ID NO: 91132 - RNA, 64 nt, Human
aauccauccauccaaaggcagagaaccaaaggggccauggaagguucucugugcuccuccuacc

SEQ ID NO: 91133 - RNA, 64 nt, Human
uacauaaacuauguagcaaaaguaucuguaaaauccauggaaaauaaaaguuguaucauucuuu

SEQ ID NO: 91134 - RNA, 64 nt, Human
gugaugcccgcagaaggcgucugggccuaaggauccauggaagucaggagcauuaaaucccaaa

SEQ ID NO: 91135 - RNA, 64 nt, Human
uauuugcuuucucuucaagauaaguuguauuuuaccauggaaaaauacaguaucuaacauuacc

SEQ ID NO: 91136 - RNA, 52 nt, Human
guaacauacaguucaauuaagaccauggaaauuuuuauuucaaacaauuaga

SEQ ID NO: 91137 - RNA, 64 nt, Human
aauucuccuuggugaguuuucuaaaaguauuuccccauggaaaggagaaagugguuugggacag

SEQ ID NO: 91138 - RNA, 64 nt, Human
uauacuuaaccauauguguaacugauacuuggcaccauggaauuuuucauugaguuauuuccuc

SEQ ID NO: 91139 - RNA, 64 nt, Human
augaagaaaccaaaccaccaucuuuuauaaauugccauggaaaccaagugccuucaaugaaaca

SEQ ID NO: 91140 - RNA, 64 nt, Human
cugguuuuguuucaaaugaauaguuugcuuguuaccauggaaaccuaauggccugccaacaaaa

SEQ ID NO: 91141 - RNA, 64 nt, Human
accagugaaucccuuaagcagaacaaccgugaugccauggaacucaagcccaacggcggugcug

SEQ ID NO: 91142 - RNA, 64 nt, Human
uacucuguagucucaguucguguuugauuccauuccauggaaauaaaaaguauguuguacauac

SEQ ID NO: 91143 - RNA, 64 nt, Human
cgagcagccuucuucuuugggaccccucgauaucccauggaaugcucgcacguucucaaagacu

SEQ ID NO: 91144 - RNA, 64 nt, Human
ggaaaucauaaugaugucaugugaucaaaggaaaccauggaaggguucacgcugauagcugaua

SEQ ID NO: 91145 - RNA, 64 nt, Human
cgugccucacugacccccaggggccucauccuccccauggaaugggcuguauguccugccccaa

SEQ ID NO: 91146 - RNA, 64 nt, Human
uuuuccugaaagaauaucauccucugcauuauccccauggaacguuucacuuuaacccugacug

SEQ ID NO: 91147 - RNA, 64 nt, Human
uaaguguuuuuacuugugaggaaugagaagccauccauggaaauuugaacugagugggggcaga

SEQ ID NO: 91148 - RNA, 64 nt, Human
gaagcauggcaucuuguccuugcuuuuagaacacccauggaagaaaacacagaguagauauugc

SEQ ID NO: 91149 - RNA, 64 nt, Human
ugcaugguuacagcccacagggaggcauggagugccauggaaggauucgccacuacccagaccu

SEQ ID NO: 91150 - RNA, 64 nt, Human
ugcuugaccuguuuucuuaaaaggccuacguccuccauggaagugccagcucauuacuaccacu

SEQ ID NO: 91151 - RNA, 64 nt, Human
gagcugauccauuuauaaaugcaguuuuaauaaaccauggaauaccaaggcacaacauaucaaa

SEQ ID NO: 91152 - RNA, 58 nt, Human
auaaaagaaaaauaacuugaggacuguaccauggaaaacuaaauuuaaaaaaacaguu

SEQ ID NO: 91153 - RNA, 64 nt, Human
gggugugagggaccaauccugugaccucccagaaccauggaagccaggacgucaggcugaccaa

SEQ ID NO: 91154 - RNA, 64 nt, Human
aguucugaaacccuugauagaaacuggaagccugccauggaacacaauacuuugggcaauaauc

SEQ ID NO: 91155 - RNA, 64 nt, Human
guggcccuuccccagaggaauuguggagacugucccauggaacaaacccucaggcaccagcaca

SEQ ID NO: 91156 - RNA, 64 nt, Human
uggaaucaugggggaaacggguuggaauuuguagccauggaauauauauuagauguaaagaauu

SEQ ID NO: 91157 - RNA, 64 nt, Human
ucccauuugcccagggaacugccacuccugguugccauggaaauagcagccaacggacaccucc

SEQ ID NO: 91158 - RNA, 64 nt, Human
ucagucauuugcuguacuucccuguggcacguuaccauggaagccgcuccagggugggucaggg

SEQ ID NO: 91159 - RNA, 64 nt, Human
cuccgacccugcuccccacagagccucaguaaacccauggaacacacgucggcgcuguccgucu

SEQ ID NO: 91160 - RNA, 64 nt, Human
cuuuuuauuccuagauggaacugcgacuuccgagccauggaaggguggauugauguuuaaagaa

SEQ ID NO: 91161 - RNA, 64 nt, Human
guucucaacacauggccccagucaagacagaacaccauggaaaaaacccuguaaguauuauggc

SEQ ID NO: 91162 - RNA, 64 nt, Human
ugacuggaggaggccugucccaauucugcccgcuccauggaaaagcgggcuugacugcauugcc

SEQ ID NO: 91163 - RNA, 64 nt, Human
uugggaaagccaguugcccugaacccagcagacaccauggaauguccuuugcacgcauuaaaug

SEQ ID NO: 91164 - RNA, 64 nt, Human
aaaaaaaaaaaaaagaaaauguggcacauauacaccauggaauacuaugcagccauaaaaaaga

SEQ ID NO: 91165 - RNA, 64 nt, Human
gccucuugacugucccuucucuuccuaccuccauccauggaaaauuaguuauuuucugauccuu

SEQ ID NO: 91166 - RNA, 64 nt, Human
ugaggcuguaggacucgcagucaggggcagcugaccauggaagauugagagcccaagguuuaaa

SEQ ID NO: 91167 - RNA, 64 nt, Human
auaaaacucaaaccuacccagccuuccccccacuccauggaaguccuugggaugggcgucugcu

SEQ ID NO: 91168 - RNA, 64 nt, Human
cccaagaaaaaggucagcuccaccgaaggggcugccauggaagagcccaagaggagaucagcgc

SEQ ID NO: 91169 - RNA, 64 nt, Human
ucaaaaaaauaaaaauaaaaaaaaaaucuuaguuccauggaauuuuaagcauuguucccccucu

SEQ ID NO: 91170 - RNA, 64 nt, Human
agcccacugcccaaugccugcuuccugggcauagccauggaacccugccaggcugcuaaaggac

SEQ ID NO: 91171 - RNA, 64 nt, Human
gccucaaaauaccgacugcguccauucucugccuccauggaaacagccccuagaaucugaaagg

SEQ ID NO: 91172 - RNA, 64 nt, Human
aagaaaaaaagauacuauggggucaaguguaacuccauggaaaugccacgucugcucuucagug

SEQ ID NO: 91173 - RNA, 64 nt, Human
ugaguggauaaagacaaugcgguguacauauacaccauggaauacuauucagccacaaaaagga

SEQ ID NO: 91174 - RNA, 64 nt, Human
caagugagucugguggaggagcugagggagggagccauggaaggugccagaaggaagguuggcg

SEQ ID NO: 91175 - RNA, 64 nt, Human
uccauagcugcaacgccuccugcccagccgguuuccauggaaacaacugcucaguuccuuguga

SEQ ID NO: 91176 - RNA, 64 nt, Human
guuccaggaggauuuugacccacagaaaaggagcccauggaacacaaguuaaagagguuuugcu

SEQ ID NO: 91177 - RNA, 64 nt, Human
gaagcagccucacucuuaacuucguguucacacuccauggaaaccccagacugggacacaggcg

SEQ ID NO: 91178 - RNA, 63 nt, Human
aagucauaagugaagagugaucauguccugaugccauggaaugacugaagacaggcacaaaau

SEQ ID NO: 91179 - RNA, 64 nt, Human
guuuccagggaauuugaaugauuguauuuuguguccauggaacguuuauagacauggaggcagg

SEQ ID NO: 91180 - RNA, 64 nt, Human
uccccagcuccacacggccugcacaccuguguuuccauggaaaugccaccgugucugcucccag

SEQ ID NO: 91181 - RNA, 64 nt, Human
cugagugauacugcccuccagcucuuuccuccuuccauggaaccugacguagcugcaaaggaca

SEQ ID NO: 91182 - RNA, 64 nt, Human
ugcuagaguuggggagugagaugaguggugcuguccauggaaucaggccacagcaggaacugcc

SEQ ID NO: 91183 - RNA, 64 nt, Human
agccccccaucccugugccaccuggguguggagcccauggaacacucugguccgccucauuuua

SEQ ID NO: 91184 - RNA, 64 nt, Human
gaagcccacgcucugagucucagcgccgacgagaccauggaagagccaucuguccuucucagga

SEQ ID NO: 91185 - RNA, 64 nt, Human
gcgggcugggccuuccacgcaucccccccaccccccauggaacagaaagccauguuuuuaagca

SEQ ID NO: 91186 - RNA, 64 nt, Human
ugccugcugcaaagcuuugauuuggcaaaggagaccauggaagaaucaugguggauccagaagu

SEQ ID NO: 91187 - RNA, 64 nt, Human
auagaccggauaaagaaaacgugacacauauacaccauggaauacuaugcagccauagaaaagg

SEQ ID NO: 91188 - RNA, 64 nt, Human
guagaaaacugauaauaauacaaaugauuguuguccauggaaaggcaaauaaauuuucuacagu

SEQ ID NO: 91189 - RNA, 64 nt, Human
gcucucauugugugacucagugcugcuguccaucccauggaaacaugggcacaaucaaguauuu

SEQ ID NO: 91190 - RNA, 64 nt, Human
cguuuuuacccugcccuggcuggcaugugagaagccauggaagguugugguuguaaaugaguug

SEQ ID NO: 91191 - RNA, 64 nt, Human
accuugccgaucaccaggcauaaccuaauuuuauccauggaagaaacacagaaaggcaucuaag

SEQ ID NO: 91192 - RNA, 64 nt, Human
agcccauacucaauaaucaugccauccugccuuuccauggaauaacugauggaugguuagaaau

SEQ ID NO: 91193 - RNA, 64 nt, Human
acuagaaaguaugauaaacaacaguuggaggaauccauggaaaauagacgagaaaauguaaaua

SEQ ID NO: 91194 - RNA, 64 nt, Human
acagacauuuaaaucucuugggaauucgaugcucccauggaauuuauaccaguuauaugaauug

SEQ ID NO: 91195 - RNA, 64 nt, Human
cuuuuggaaaaauggguucaagcuuuccuauuagccauggaaaugcaaaguuuagcagaagcaa

SEQ ID NO: 91196 - RNA, 64 nt, Human
ugaauucuucuagcuccuccaaucccauuuuaucccauggaaccacuaaaaacaaggucugcuc

SEQ ID NO: 91197 - RNA, 64 nt, Human
auaagcuggacuuucuccccauggcacuggggaaccauggaaguucagggaacuucagggaaga

SEQ ID NO: 91198 - RNA, 64 nt, Human
accacauauuagugcuugacccuggcaggggaccccauggaaaagauggggaagagcaaaauac

SEQ ID NO: 91199 - RNA, 64 nt, Human
guagaccagauaaagaaaauuugguacauauacaccauggaauacuaugcagccauaaaaaaga

SEQ ID NO: 91200 - RNA, 64 nt, Human
ucgaagcccugaacuugagacaccaaguuugucuccauggaaacacguagccgcugcaguugga

SEQ ID NO: 91201 - RNA, 64 nt, Human
gaaacagauaacucagaagcaucugggaaauuugccauggaauuaaugaagaaaagcccucagc

SEQ ID NO: 91202 - RNA, 56 nt, Human
agcgcccggugcccacguagccccugccauggaaggaagaacgggacaaaggaggg

SEQ ID NO: 91203 - RNA, 64 nt, Human
guguaugggaggugcuggugucaggguucacaagccauggaacuaccuugcuucacaucacaag

SEQ ID NO: 91204 - RNA, 64 nt, Human
cagggugacccaacauccaguucuccggcucucaccauggaaacaaacugucccuguccccagg

SEQ ID NO: 91205 - RNA, 64 nt, Human
auuuaugaacuguggugacuacagguaacugaaaccauggaaagcaaagcuguggauaaggggg

SEQ ID NO: 91206 - RNA, 64 nt, Human
ugaauucuacuaguuccuccaauuccaucuucucccauggaaccucaaagagcaagacccacuc

SEQ ID NO: 91207 - RNA, 64 nt, Human
ugaauucuacuaguuccuccaauuccauuuucucccauggaaucacgaagagcaagacccacuc

SEQ ID NO: 91208 - RNA, 64 nt, Human
uaaaaaaauguauauggguaaggaccugaaagauccauggaaaaguuaacccaguugagauuuu

SEQ ID NO: 91209 - RNA, 64 nt, Human
gggaagauuuccccuuuagaucaaacugccccuuccauggaaaagcuggaaaaaaacucuggaa

SEQ ID NO: 91210 - RNA, 64 nt, Human
acaaacuuggacaacacggagcagggagagcucaccauggaaugaaccccccgcccaugcuguc

SEQ ID NO: 91211 - RNA, 64 nt, Human
gcuuaugaaggaccccacuugcaccccaccccagccauggaagagcagcuggaggguggauggg

SEQ ID NO: 91212 - RNA, 64 nt, Human
caauagcaaauucaaagcaagcaacuugcaggcuccauggaacuuuuaaugaaggacagugucu

SEQ ID NO: 91213 - RNA, 64 nt, Human
agccccgaagccagggccaugccagcaggccccaccauggaaaucaaaacaccgcaccagccag

SEQ ID NO: 91214 - RNA, 64 nt, Human
ucgcccagguuagcccacaggauuccuuugugugccauggaaugcugaaagaugggugacuggg

SEQ ID NO: 91215 - RNA, 64 nt, Human
cuccagcaggaaggaccccacauccuucucacugccauggaauucccuccugagugccccacuu

SEQ ID NO: 91216 - RNA, 64 nt, Human
uauuuacucaucaggucauuauuuuuuacaauggccauggaauaaaccauuuuuacaaaaauaa

SEQ ID NO: 91217 - RNA, 64 nt, Human
gugugcacagcaaguuaacuagaggggcugugggccauggaacugucagcguuauucucagaag

SEQ ID NO: 91218 - RNA, 64 nt, Human
ccauaagacccccaggaagcuaggcacuuucuuuccauggaaacauuuagacacaaaccucccc

SEQ ID NO: 91219 - RNA, 64 nt, Human
agggcccaccgaaagcucaggggagcacagaagcccauggaagcccagggagaugucccugggg

SEQ ID NO: 91220 - RNA, 64 nt, Human
cuuccauucauuguuuacgcuggaauuuuucuccccauggaauguaaguaaaacuuaaguguuu

SEQ ID NO: 91221 - RNA, 64 nt, Human
agggagacccugggagagugaggucaucccggggccauggaagcuggcaggagacacuggucuc

SEQ ID NO: 91222 - RNA, 64 nt, Human
ucuguaaaaacaucuccaggcuuugauuuuuguaccauggaaauuguauuuaaccauacagggu

SEQ ID NO: 91223 - RNA, 64 nt, Human
gaugaacccauuccacuguaugaggcaaaaguuuccauggaagcuguucagaaaaaucaaggaa

SEQ ID NO: 91224 - RNA, 64 nt, Human
uauauaaauugagcuugcuucuuucuugcuuugaccauggaaagaaauaugauucccuuuucuu

SEQ ID NO: 91225 - RNA, 64 nt, Human
augacggugggcagagaggccugucuuaaaguuuccauggaauuguuuuauaaaauaucuuaag

SEQ ID NO: 91226 - RNA, 64 nt, Human
uaagagcuacuuccaagugugguuacaaaugaacccauggaaugaugacuucauguucuucucg

SEQ ID NO: 91227 - RNA, 64 nt, Human
gcgggcgcccucugccaccuugcuccccgggaacccauggaaggagaagcgaggugaugcagca

SEQ ID NO: 91228 - RNA, 64 nt, Human
augaugcaagagcugcaggccggggggcucagugccauggaagcuacuccaaguugcauugccu

SEQ ID NO: 91229 - RNA, 64 nt, Human
acuugagugcgccuugcaggcacucccagagcagccauggaaggagcuggcccucacaccaucc

SEQ ID NO: 91230 - RNA, 54 nt, Human
aggcccauaccaacaaguaaaacuccauggaaucuucuccugugauaucugacu

SEQ ID NO: 91231 - RNA, 64 nt, Human
ccaacuaaguuguccuuuucugguuucguguucaccauggaacauuuugauuauaguuaauccu

SEQ ID NO: 91232 - RNA, 64 nt, Human
ucgucucugauuugccagagaaaaacggugguagccauggaaaucgggagugaaggagcacugc

SEQ ID NO: 91233 - RNA, 64 nt, Human
cugaacagcagaguuauggaguaucagaaucuuuccauggaaaccuccauauggccuuucuaua

SEQ ID NO: 91234 - RNA, 64 nt, Human
agugaagaaguagauuccuaaauuuuauuggggaccauggaaugguaguugagaagaaaacuau

SEQ ID NO: 91235 - RNA, 64 nt, Human
agggccguugccugcucagaccuugcaggcuguggagcaagaggcccugggucucuccaagcag

SEQ ID NO: 91236 - RNA, 64 nt, Human
caagauugcaccauugcacuccagccuggcgacagagcaagacucugucucaaaaaaaaaaaaa

SEQ ID NO: 91237 - RNA, 64 nt, Human
aagaucgcgcuauugcacuccagccugggugacagagcaagacucugccucagaaaaaaaaaaa

SEQ ID NO: 91238 - RNA, 64 nt, Human
ugagaucgcaccacugcacuccagccugguuacagagcaagacucugucucaaacaaaacaaaa

SEQ ID NO: 91239 - RNA, 64 nt, Human
gggacaccacugagcauauccagacccacuucgagagcaagacagagcugcugccuucccggcc

SEQ ID NO: 91240 - RNA, 64 nt, Human
uaucgggcagcagucacuggggcucaagggcagugagcaagagaaaugucuaaagcugcuucuc

SEQ ID NO: 91241 - RNA, 64 nt, Human
aaagcaaaagccuagaaauaacccagaugcccaugagcaagagaguggacaaguaaacuggaau

SEQ ID NO: 91242 - RNA, 64 nt, Human
aaaucucaauugcuaacugugacaaugaccacucgagcaagaagcccuaccacacucccaguaa

SEQ ID NO: 91243 - RNA, 64 nt, Human
uuggaaagaaaugcccaucuaugucccuugcugugagcaagaagucaaaguaaaacuugcugcc

SEQ ID NO: 91244 - RNA, 64 nt, Human
ugguugcaccacugcucuccaggcuugagugacagagcaagacuguaucucaaaggaaaaagga

SEQ ID NO: 91245 - RNA, 64 nt, Human
gaucagaauucaaccuuuguucuaacacauacuagagcaagaauuuacuugauuuggaauaauu

SEQ ID NO: 91246 - RNA, 64 nt, Human
cugugaauaaaugaaacauuucggagcucccugagagcaagagccuucacuucuucuugcggug

SEQ ID NO: 91247 - RNA, 64 nt, Human
uaguucuauaggagugaucucaagugagauagcagagcaagaugccaaaagaccauaaauagag

SEQ ID NO: 91248 - RNA, 64 nt, Human
aaauuucuuuccugucugcacaauuagcuauucagagcaagagggccugauuuuauagaagccc

SEQ ID NO: 91249 - RNA, 64 nt, Human
cugucauuccuaauagcccaaacgcagaagcacugagcaagagagcccuuucuugccaagccag

SEQ ID NO: 91250 - RNA, 64 nt, Human
uugaucacgccacugcacuccagccugggugacagagcaagacuccaucucaaaaaaaauaaua

SEQ ID NO: 91251 - RNA, 64 nt, Human
gagcccacacacguuucaucuuuuuccccucugagagcaagaagagacauggcauguucucugg

SEQ ID NO: 91252 - RNA, 64 nt, Human
guugucaguggaaaauaguauuaacagcucacucgagcaagaacccuccugacaguacuggcua

SEQ ID NO: 91253 - RNA, 64 nt, Human
aagauugugccacugcacuccacccugggcaacagagcaagaccccaucucaaaaauaaauaaa

SEQ ID NO: 91254 - RNA, 64 nt, Human
gagauugcgccacugcacuccagccuggguaacagagcaagacuccaucucaaaaaaagaaaga

SEQ ID NO: 91255 - RNA, 64 nt, Human
ugagauuccuuauaaucuaauuauaccugagguugagcaagaaaugucuuccuuuagaaaaucu

SEQ ID NO: 91256 - RNA, 64 nt, Human
gagaucgcaccacugcacuccagccugggugccagagcaagacuccaucucaaaaaaaaaaaaa

SEQ ID NO: 91257 - RNA, 64 nt, Human
gaaacggagccagcgugucacauggugagagagggagcaagagacagacaggggaggaaauuca

SEQ ID NO: 91258 - RNA, 64 nt, Human
uugcacuguacuuuucacuccagccugggugacagagcaagacucccgucucgggggcuuaaaa

SEQ ID NO: 91259 - RNA, 64 nt, Human
aagaucgcgccacugcacuccagccugggugacagagcaagacucugucuuaaaaaaaaaaaaa

SEQ ID NO: 91260 - RNA, 64 nt, Human
accucugucucuuuaaccaugcugucucuggacugagcaagagggaggagggagccugcucacc

SEQ ID NO: 91261 - RNA, 64 nt, Human
ugcagggugugaggguuuggcgagguaugcguaggagcaagaagggacagggaauuucaagaga

SEQ ID NO: 91262 - RNA, 64 nt, Human
aagccuuauucuucaacuaaaagaugaggauuaagagcaagaaguugggggggaugugaaaaua

SEQ ID NO: 91263 - RNA, 64 nt, Human
aagaucgugccacugcacaccauccuggaugacagagcaagacuccaucacaaaaaaaaaaaaa

SEQ ID NO: 91264 - RNA, 64 nt, Human
gcagagaaagggacaaugauaguagagugauauggagcaagagauauuuugggcaugugggcuu

SEQ ID NO: 91265 - RNA, 64 nt, Human
gcccacucucccuguuacacacugcccacacucagagcaagaugaguugcugcuauucuuugcc

SEQ ID NO: 91266 - RNA, 64 nt, Human
ucgauuguaccacugcacuccagccugggcgacagagcaagacucugucucaaaacaaacacaa

SEQ ID NO: 91267 - RNA, 64 nt, Human
gagaucgugcuauugcacuccagccugggcgacagagcaagacgccaucucaaaaacaaaaaaa

SEQ ID NO: 91268 - RNA, 64 nt, Human
ugaccucaagggaauuggucccagguacaacagagagcaagaccccaaacagggcguggcugcc

SEQ ID NO: 91269 - RNA, 64 nt, Human
guguucuugccacugcacuccaaucugggugacugagcaagacccugucucuuaaaaaaauaaa

SEQ ID NO: 91270 - RNA, 64 nt, Human
gagaucaugccacugcacuccagccuggcugacagagcaagacuccccugucucaaaaaaaaua

SEQ ID NO: 91271 - RNA, 64 nt, Human
aauucauaucuagaagucuggagugagcaaacaagagcaagaaacaaaaagaagccaaaagcag

SEQ ID NO: 91272 - RNA, 64 nt, Human
aaacagaaagaauagagaacaggaacgagguggagagcaagacugacagagaaagugugagcaa

SEQ ID NO: 91273 - RNA, 64 nt, Human
uuauggugcuauggacuagggguccuuugugaaagagcaagauggagcaauggagagaagaccu

SEQ ID NO: 91274 - RNA, 64 nt, Human
cagagaggaccagggugagaacuaaugcucaagagagcaagauucuguaauccucuugcccucu

SEQ ID NO: 91275 - RNA, 64 nt, Human
guaauugcaccacugcacuccagccugggugacagagcaagacccugucuuaaaaaaagaggau

SEQ ID NO: 91276 - RNA, 64 nt, Human
aaaaaguagcaucagggucuuuucccaagccagugagcaagagcauuauuucauaaagaauagg

SEQ ID NO: 91277 - RNA, 64 nt, Human
ucaucacuacagauaugcaacuaaaauagacguggagcaagagaaaugcauucccaccgaggcc

SEQ ID NO: 91278 - RNA, 64 nt, Human
gagaucauaccacuucauuccagccugggugacagagcaagacucugucucaaaaaaaaaaaaa

SEQ ID NO: 91279 - RNA, 64 nt, Human
aacucuccucaaugaggaagaaucauucacaacugagcaagacauucauaugaucauuuaagga

SEQ ID NO: 91280 - RNA, 64 nt, Human
acaugugguuacacagugugaauaaagugcugcggagcaagaggaggccguugauucacuucac

SEQ ID NO: 91281 - RNA, 64 nt, Human
acuuguggcuuuaacugacaggagcaauuaaaaagagcaagaggguucugcauuggcauagcuu

SEQ ID NO: 91282 - RNA, 64 nt, Human
gccccucaauuuauuuguggucacccaggguucagagcaagaagucuugcuuuauacaaaugua

SEQ ID NO: 91283 - RNA, 64 nt, Human
gauaucaugccccuguacuccagccugggugacagagcaagacucugucucaaaaaauaaaaau

SEQ ID NO: 91284 - RNA, 64 nt, Human
cuuggaggaccugggaggagggaguguguccuuugagcaagaggaggaacuccuggugccuuuc

SEQ ID NO: 91285 - RNA, 64 nt, Human
gcauuucugucauuucugcaacaccaugagaccugagcaagaaugugcuguggcagaggggguc

SEQ ID NO: 91286 - RNA, 64 nt, Human
cuuguacuguugcugauuuuugcaucuucuugaagagcaagagucuguacauuauuaagcuuag

SEQ ID NO: 91287 - RNA, 64 nt, Human
aaaucacgcuggaaccuugggcaaggaagaaugugagcaagaguagagagagugccuggauuuc

SEQ ID NO: 91288 - RNA, 64 nt, Human
ugagauugagcaacuguacuccagcuuggcgacagagcaagacccccucucaaaaauaaauaaa

SEQ ID NO: 91289 - RNA, 64 nt, Human
uucauacugauuauuggaaaaggacuauauaugugagcaagauuguguuuuagagaggaaacuu

SEQ ID NO: 91290 - RNA, 64 nt, Human
gugauugcaccacugcacuccagccugggcaacagagcaagacccugucuuggagaaaccagaa

SEQ ID NO: 91291 - RNA, 64 nt, Human
cgaguuugggccacugcacucuagccuggcaacagagcaagacuccgucucaaaaaaagggcaa

SEQ ID NO: 91292 - RNA, 64 nt, Human
agagcagacccuuuagaaaucagcccaagggggagagcaagagaaaacacucuagggaguaaag

SEQ ID NO: 91293 - RNA, 64 nt, Human
ggcccucuccacagggaacucuagaauaucaagggagcaagaggaagccaagaaaacuugggua

SEQ ID NO: 91294 - RNA, 64 nt, Human
gagaucgcgccacugcacugcagccuaggcgacagagcaagacugccucaaaaaaaaaacauaa

SEQ ID NO: 91295 - RNA, 64 nt, Human
ucaaaugguaaugucacaguguuuuguaugcagagagcaagaguucaaccaacagcuguuuauu

SEQ ID NO: 91296 - RNA, 64 nt, Human
gggauuacaccauugcauuccagccugggcaacagagcaagacugucucaaaaaacaaaacgaa

SEQ ID NO: 91297 - RNA, 64 nt, Human
ugaaaccauuuuuuguacaauguaaagaucaucugagcaagaugagcauuuuguaaaaaugaaa

SEQ ID NO: 91298 - RNA, 57 nt, Human
caccaaauggaaugcuguaaauuacaggagcaagagaaagaagauaauuuaaccaug

SEQ ID NO: 91299 - RNA, 64 nt, Human
cuucacggaacuuuauagcacuccgacauuuucugagcaagaggaagucaaaauuuauuuaaca

SEQ ID NO: 91300 - RNA, 64 nt, Human
accagccucuucagccucacacccauuccccugagagcaagaagccuguguggucugggccagu

SEQ ID NO: 91301 - RNA, 64 nt, Human
aauuaucaaagaaccagaaauuauaucuguuuuggagcaagagugucauaauguuucaggguag

SEQ ID NO: 91302 - RNA, 64 nt, Human
agccgagaucgagccacugcacuccugggcaacagagcaagacuucgucucaaaauaaauaaau

SEQ ID NO: 91303 - RNA, 64 nt, Human
gagauugcaccacugcacuccagccugggugacagagcaagacuccaucucaguaaauaaauaa

SEQ ID NO: 91304 - RNA, 64 nt, Human
augauuacaccacugcacuucagucugugugacugagcaagacucuuucaaaaaaaaaaaaaaa

SEQ ID NO: 91305 - RNA, 64 nt, Human
aagaucacaucacugcacuucaaccugggugacagagcaagacccugucucaaaaacaaaaaac

SEQ ID NO: 91306 - RNA, 64 nt, Human
gagaucgugccacugcacuccagccugagcaacagagcaagacucuaucucaaaaauaaaauaa

SEQ ID NO: 91307 - RNA, 64 nt, Human
gccagaaggcagaaggguaagagagggcaagagugagcaagagauggaaguugcaaccucaagc

SEQ ID NO: 91308 - RNA, 64 nt, Human
gagauggcgccacugcacuccagccuaggcaacagagcaagacuccgucucaaaaaaaaaaaaa

SEQ ID NO: 91309 - RNA, 64 nt, Human
caaggucauaccagugcacuccaggcgggugacagagcaagacugcgucucaagaaaaaaaaaa

SEQ ID NO: 91310 - RNA, 64 nt, Human
uucaccccaaccuuccauauuuaucuguucaaaggagcaagaacuuucauauaggaauagaaac

SEQ ID NO: 91311 - RNA, 64 nt, Human
augaguaugccacugcacuccagccugggggacagagcaagacccugccucaaaaaaaaaaaaa

SEQ ID NO: 91312 - RNA, 64 nt, Human
aagaucacgccacugcacuccagccugggcaacagagcaagacucugucucaaaaaaaaaaaua

SEQ ID NO: 91313 - RNA, 64 nt, Human
gaguaguccuaggaagcccacugauccccaacgggagcaagacuucuaacggcugauugguaug

SEQ ID NO: 91314 - RNA, 64 nt, Human
uuuacaaacugaagguuuguggcaggccuguguugagcaagacuaucagugccauuuuuuuuca

SEQ ID NO: 91315 - RNA, 64 nt, Human
ggugugugcacucugccuccucaccuugcacccagagcaagaggacugggugcugggcugcaga

SEQ ID NO: 91316 - RNA, 64 nt, Human
aagauugcgccguuguacuccagccugggcaacagagcaagacccaucucaaaaaaaaaauuuu

SEQ ID NO: 91317 - RNA, 64 nt, Human
gcuggcaucugaauguccauucgccaggcauggagagcaagagaagguauguacugccugaggu

SEQ ID NO: 91318 - RNA, 64 nt, Human
ugugaacugaauucaccacagacuuuagcuuucugagcaagaggauuuugcgucagagaaaugu

SEQ ID NO: 91319 - RNA, 64 nt, Human
gcacaucacaugacaaaagcaggaacaagacucagagcaagaagucacuuaucaccaaggggau

SEQ ID NO: 91320 - RNA, 64 nt, Human
gaggucgcaccacugcacuccagccuggacaacagagcaagacucugucucaaaaaaaaaauaa

SEQ ID NO: 91321 - RNA, 64 nt, Human
augauuacgacacugcacuccagccuaggcgacagagcaagaccccauucucuuacaaagucuc

SEQ ID NO: 91322 - RNA, 64 nt, Human
gaaaccuguccauaaaguaauuuugugaaagaaggagcaagagaacauuccucugcagcacuuc

SEQ ID NO: 91323 - RNA, 64 nt, Human
uagggacuacccauagacaugaaagguccccacagagcaagagauaagucuuucauggcugcug

SEQ ID NO: 91324 - RNA, 64 nt, Human
acgaucaagccacugcacuccagccugggcgacagagcaagaucguuucucuaaaauuaaaaaa

SEQ ID NO: 91325 - RNA, 64 nt, Human
gaucgugcgcuacugcacuccagccugggccacagagcaagacugucucaagaaaaaaaauuuu

SEQ ID NO: 91326 - RNA, 64 nt, Human
aagaucaugccacuccacuccagucugggcgacagagcaagacucugacucaaaaaaaaaaaaa

SEQ ID NO: 91327 - RNA, 64 nt, Human
uaaacuuucuacagaggaacgccggaaguuguuugagcaagagguggcucaacgggaggcucag

SEQ ID NO: 91328 - RNA, 54 nt, Human
uucagaauaauuuaaccuaaagcagagcaagaagagaggaagcggggguagugg

SEQ ID NO: 91329 - RNA, 64 nt, Human
gugauugcaccacuguacuccagcuugggcaacagagcaagauccugucucaaaaggaaaaaga

SEQ ID NO: 91330 - RNA, 64 nt, Human
acaccuuugcccuggcucugcauugucaccuagagagcaagaggucuauagaaacaucauguca

SEQ ID NO: 91331 - RNA, 64 nt, Human
aauaaauuucuucuugaggugggguggagguggggagcaagaauuugaccuggcucugaucccu

SEQ ID NO: 91332 - RNA, 64 nt, Human
aaccuuguguucucugugcccucagggacuggcagagcaagaggccaucagaaggacgaggugc

SEQ ID NO: 91333 - RNA, 64 nt, Human
gagauugcaccacugcacuccagccuggagagcagagcaagacucugucucaaaaaaaagaaaa

SEQ ID NO: 91334 - RNA, 64 nt, Human
uugacucuuuaguucacagguucccauugauugugagcaagauauuuaucucuuuagcccuugg

SEQ ID NO: 91335 - RNA, 64 nt, Human
agaugcuuugaguuuaaacccaccauguauggaagagcaagaaaagagaaaauauuaaaacgag

SEQ ID NO: 91336 - RNA, 64 nt, Human
ucuucacccccuuuucacucucuuuaaagagauggagcaagagaguggucagaacacaggccga

SEQ ID NO: 91337 - RNA, 64 nt, Human
acuuuuccagucuguacagaaugcuauuucacuugagcaagaugauguaauggaaaggguguug

SEQ ID NO: 91338 - RNA, 64 nt, Human
agaagaaguuccguaccccguccuuucugaagaagagcaagaagaagagugacuccugaaagcc

SEQ ID NO: 91339 - RNA, 64 nt, Human
cgagaucacaccacugcacucagccugggugacagagcaagacuccgucuccaaaaaaaaaaaa

SEQ ID NO: 91340 - RNA, 64 nt, Human
caugccacugcacuccagccuggccugggcaacagagcaagacccugucucaaaauaauaauaa

SEQ ID NO: 91341 - RNA, 64 nt, Human
uagaucaugccacugcacuccaaccugggcagcagagcaagacucugucucaaaaggggaaaaa

SEQ ID NO: 91342 - RNA, 64 nt, Human
ugagaucacaccacugcacuccagccuggugacagagcaagacuccggcucuuaaaaaaaaaaa

SEQ ID NO: 91343 - RNA, 64 nt, Human
gagaagaagaugcaaagaggcgaacgcucgcccagagcaagaaaugauagccagucauauacuc

SEQ ID NO: 91344 - RNA, 64 nt, Human
gagaucgcacuacugcacuccagccugggcgacagagcaagaccaccaucuccaaaaauuauau

SEQ ID NO: 91345 - RNA, 64 nt, Human
ggaauuuguucgcucauggaacuauaacaccuuagagcaagaggcaggaauuccagggccuccu

SEQ ID NO: 91346 - RNA, 64 nt, Human
gagauggcgccacugcucuccagccuggacgacagagcaagacuccgucucuaaaaaaaaaaaa

SEQ ID NO: 91347 - RNA, 64 nt, Human
uaacugaucuggagcuuuuggacaaaauagagaggagcaagauaguuuccaccaugaggugcaa

SEQ ID NO: 91348 - RNA, 64 nt, Human
auccugaaaagaaggagacagggauuuuuuuaaagagcaagaaagucacaauauuacuucuuuc

SEQ ID NO: 91349 - RNA, 64 nt, Human
ucaguuugaucaggaaaguguauaacacaucuuagagcaagaguuaguuugguauuaaauccuc

SEQ ID NO: 91350 - RNA, 64 nt, Human
auagguaaggagaagcuggauuaucuccuguugagagcaagagauucguuuugacauagaguga

SEQ ID NO: 91351 - RNA, 64 nt, Human
uugaucacaccacugcacuccagccugggcaacagagcaagaccccauccuccaccccccccaa

SEQ ID NO: 91352 - RNA, 64 nt, Human
gagaucgcgccacugugcuccagccugggcaacagagcaagacuccaucucaaaaaauaaaaau

SEQ ID NO: 91353 - RNA, 64 nt, Human
gagaucacgucacugcacuccagcuugggcaacagagcaagacuccaucucaaaaaaaaaaaaa

SEQ ID NO: 91354 - RNA, 64 nt, Human
cacaccacaggaaacccacauuuuuagauggaaagagcaagaaaauugugucagugcucuuagu

SEQ ID NO: 91355 - RNA, 64 nt, Human
guaccaagugccaaaacagcagaggggccaguuagagcaagagcucugggggggccggaaaguc

SEQ ID NO: 91356 - RNA, 64 nt, Human
aaugucucauuucaagcaggagauguugggucuggagcaagaucugagacugagauguccccca

SEQ ID NO: 91357 - RNA, 64 nt, Human
cuguguuucaaaccugcaaggcaaaguaaaauuagagcaagaacauucaaaccaaauaagauau

SEQ ID NO: 91358 - RNA, 64 nt, Human
gguagcagagaccaaggcgcagggugcuucagaugagcaagagaacccagucgaaccagauacc

SEQ ID NO: 91359 - RNA, 64 nt, Human
gagaucgugccacugcacuccagccugggcgacagagcaagacucagucucaaaaaaaaaaaaa

SEQ ID NO: 91360 - RNA, 64 nt, Human
aagaucgugccacugcacuccggccugggugauggagcaagaccucgucucagaaaauuggaaa

SEQ ID NO: 91361 - RNA, 64 nt, Human
caguuuagguauggugauuuagcagaacacaagagagcaagaaaaugucacaucuauaccaaau

SEQ ID NO: 91362 - RNA, 64 nt, Human
gguaaagaacaucaaaaguuuuaaaaaagaaaaugagcaagaaucagacaucacagaugcaacu

SEQ ID NO: 91363 - RNA, 64 nt, Human
aagauugcgccacugcacuccagccugggugacagagcaagacuccauuucaaaaaaaaaaaaa

SEQ ID NO: 91364 - RNA, 64 nt, Human
aagauggcgccacugcauuccagccugggcaacagagcaagacccugucugucucaaaacaaaa

SEQ ID NO: 91365 - RNA, 64 nt, Human
gcaagaguaaaaaagucucaaagucaucaaauaagagcaagaguugauagagcuuuuacaauca

SEQ ID NO: 91366 - RNA, 64 nt, Human
uuuaacuaucuacuguggccuuuuuauggaaacagagcaagaucaaugaaggcuaauggcaaga

SEQ ID NO: 91367 - RNA, 64 nt, Human
cuucguuagaauagguauaucagcuguguaaauagagcaagaaaacaguauucugcaucugugg

SEQ ID NO: 91368 - RNA, 64 nt, Human
gacaucgcgccacugcacuccagccugggcgacagagcaagacuccgucucaaaaaaaaaaaaa

SEQ ID NO: 91369 - RNA, 64 nt, Human
cccuucaaauggacggucacuacagaaacguguagagcaagacuuugucaaggggcuguuucca

SEQ ID NO: 91370 - RNA, 64 nt, Human
uuugacugaaaaaaaaaaagaagaagaagaaggagagcaagaaggaaagauuugugaacuggaa

SEQ ID NO: 91371 - RNA, 64 nt, Human
cacucuugggcuuggcccagaauuagaguuauuagagcaagagagagcuuaggaagcaugaggg

SEQ ID NO: 91372 - RNA, 64 nt, Human
gagauugugccacugcaccccagccugggugacagagcaagacuccaucacaaaaaaaaaaaaa

SEQ ID NO: 91373 - RNA, 64 nt, Human
gcuucugaaaauucaguuuuggagcaaguccugugagcaagauaagaaucuauagaaccaagau

SEQ ID NO: 91374 - RNA, 64 nt, Human
aagaucgcgccacugcacuccagcccgggugacagagcaagacuccgucucaaaaaaaagaaaa

SEQ ID NO: 91375 - RNA, 64 nt, Human
aggcagggaacaagcuucuggacuugggcuuacagagcaagaccccacaacuguaggcuggggg

SEQ ID NO: 91376 - RNA, 64 nt, Human
ugauaagaggaaugaacgugucugcaacuaaugggagcaagauaguacacuuuaacucuuucag

SEQ ID NO: 91377 - RNA, 64 nt, Human
ccagagggacaggguggacccccugagucaacuggagcaagaaggaaggaggcagacugauggc

SEQ ID NO: 91378 - RNA, 64 nt, Human
ggcaaggaguucguggcugcaaaagaaguuucuggagcaagagagagcucgcucuugggaguca

SEQ ID NO: 91379 - RNA, 64 nt, Human
ucaaccucugaacugaaaugugucaggggcagcugagcaagacagcaguuguauccccucaccu

SEQ ID NO: 91380 - RNA, 64 nt, Human
uaaauuccccuaaauagcgccccauuugggaacagagcaagaguguugaacugaagaccaaaau

SEQ ID NO: 91381 - RNA, 64 nt, Human
aaacagaaugguccuuaacagaguuugggggagagagcaagauggguuccuuggagaagcugau

SEQ ID NO: 91382 - RNA, 64 nt, Human
uugucaacuaaaagagacggaucugcaccuccuggagcaagauagcacugagcuuucaacauug

SEQ ID NO: 91383 - RNA, 64 nt, Human
ugagagaguuuuccauaaagacauuuauauaugugagcaagauuuuuuuuaaacaauuacuuua

SEQ ID NO: 91384 - RNA, 64 nt, Human
uguaacuacauuucagcucugcagaauugcugaagagcaagauauugaaaguuucaaugugguu

SEQ ID NO: 91385 - RNA, 64 nt, Human
aagauuaugccacugcacuucagccugggugacagagcaagacucuuaucucaaaaaaaauaaa

SEQ ID NO: 91386 - RNA, 64 nt, Human
cauugagggcucuaaacaggauucuuuaaucauggagcaagagaauuucaaggcaggggauuuu

SEQ ID NO: 91387 - RNA, 64 nt, Human
augaucacaucacugcaguccagccugggugacagagcaagaccugucacccugccacccauaa

SEQ ID NO: 91388 - RNA, 64 nt, Human
aagaucacgccauugcacuccagccugggggacagagcaagacucuaucuccaaaaaacaaaaa

SEQ ID NO: 91389 - RNA, 64 nt, Human
aaauguauugggggguggaggagaauaagaggcagagcaagagcuagagaauugguuuccuugc

SEQ ID NO: 91390 - RNA, 64 nt, Human
ugggcagggcacacggucuggagcugagaggguggagcaagagugcacugacuccgagccgagg

SEQ ID NO: 91391 - RNA, 64 nt, Human
cuuccacagccucugauguggaccugguacugaggagcaagacuguccaguucuccuccacauc

SEQ ID NO: 91392 - RNA, 64 nt, Human
augauugcaccacugcacuccagccugggugauagagcaagaccccaacucaaaaaaaaaaaaa

SEQ ID NO: 91393 - RNA, 64 nt, Human
gagaucgcgccacugcacuccagccugggcgacagagcaagacuccaucucaaaaaaaaaguua

SEQ ID NO: 91394 - RNA, 64 nt, Human
agaucgugccacugcacuccagccuggguggacagagcaagacuccgucucaaagaaacaaaca

SEQ ID NO: 91395 - RNA, 64 nt, Human
gagaucgugccacugcacuccagccugggugauagagcaagacugucucaaaaaagaaaaaaaa

SEQ ID NO: 91396 - RNA, 62 nt, Human
uuguugaacccacugcaugaagcaaaaguauggagcaagaccuguagugacaaaauuacaca

SEQ ID NO: 91397 - RNA, 64 nt, Human
gaggucgugccacugcacuccagccugggcgacagagcaagacuccgucucaaaaaaaaaaaaa

SEQ ID NO: 91398 - RNA, 64 nt, Human
caaaaucaugccacugcacucccgccuggcaacagagcaagagucugucucaaaaaaaaaaaga

SEQ ID NO: 91399 - RNA, 64 nt, Human
cccauuuugagugacucgaggguuggguucaucugagcaagagcuggcaaagguggcucuccag

SEQ ID NO: 91400 - RNA, 64 nt, Human
cuauuuuguauccuggaccacaaguuccuaaguagagcaagaauucaucaaccagcugccucuu

SEQ ID NO: 91401 - RNA, 64 nt, Human
uagccugacauuugaguuauacucugugcugccugagcaagauuuguagaaucauauaauuacc

SEQ ID NO: 91402 - RNA, 63 nt, Human
aacugaaaaccacuaguuaauggauuaaaaauagagcaagaaggcaacuugaagaaacgcuuc

SEQ ID NO: 91403 - RNA, 64 nt, Human
aagauugugccacugcacuccagccugggugacagagcaagacuccaucucaaaaaaaaaaaaa

SEQ ID NO: 91404 - RNA, 64 nt, Human
gugcucauagaguugcccagcccagggggaaagggagcaagaguuguccagagaagacaguggc

SEQ ID NO: 91405 - RNA, 64 nt, Human
accccccgccgccccccuggaaagcacaagugaugagcaagaaggcauuuuccuugggagagaa

SEQ ID NO: 91406 - RNA, 64 nt, Human
gaauuccagcagccauccagguauaauggugagagagcaagagagaggcaugaacacacaguca

SEQ ID NO: 91407 - RNA, 64 nt, Human
gagaucacaccacuacacuccagccuaggcaacagagcaagacucugucucaaaaaaaacaaaa

SEQ ID NO: 91408 - RNA, 64 nt, Human
ucaguagcuugaggaacaggaacauuguuuucuagagcaagauaauaaaggagaugggccauac

SEQ ID NO: 91409 - RNA, 64 nt, Human
uguuuggggugggggcaaguacaggguaauucaugagcaagacauuucacugcugucgaagucu

SEQ ID NO: 91410 - RNA, 64 nt, Human
aagauugcgccacuguacuccagcuugggcaacagagcaagacuccaucucaaaaaaaaaagag

SEQ ID NO: 91411 - RNA, 64 nt, Human
uuauuucaaccuguuuuggucacaucacuaugccgagcaagaaaaguggaucucagggaggacu

SEQ ID NO: 91412 - RNA, 64 nt, Human
guucccuucuaaguuguuugcuguguuuucuucagagcaagaagguuauauuuuuuaaaauuua

SEQ ID NO: 91413 - RNA, 64 nt, Human
gaccaacaccucccuggucacauccauggaaucagagcaagauuuccuuucugcuucuguucca

SEQ ID NO: 91414 - RNA, 64 nt, Human
augcucacaccacugcacuccagccugggugacagagcaagaucuugucucaaaaaagaaaaaa

SEQ ID NO: 91415 - RNA, 64 nt, Human
accacugcacuccagcacuccagccugggugacagagcaagacucucucucaaaaaaaaaaaaa

SEQ ID NO: 91416 - RNA, 64 nt, Human
uuaguggagcuacacauuaauauguaucgccuuagagcaagagcuguguuccaggaaccagauc

SEQ ID NO: 91417 - RNA, 64 nt, Human
gggacaaggucugaugucagugaacggaacugaagagcaagacauggagccuggcuggggcuaa

SEQ ID NO: 91418 - RNA, 64 nt, Human
acaauuacaguuagcuccucagaaaggugaaugugagcaagaacgcuacaguucgagguaugac

SEQ ID NO: 91419 - RNA, 64 nt, Human
ugaaggcaauguuuccaaggaaaggaaauguuaugagcaagagugugaggcaagagaagcugga

SEQ ID NO: 91420 - RNA, 64 nt, Human
cugaaagaauuaccgcuggccauuguagugcugagagcaagagcugaucuagcuagggcuuugu

SEQ ID NO: 91421 - RNA, 64 nt, Human
auaauagacacuggggagguaggguggggagcgggagcaagagcugaaaaacuuaccuacuggg

SEQ ID NO: 91422 - RNA, 64 nt, Human
acauggucagauuuggcuuuuuuuuucauuaacugagcaagacuuucaggauauuguagaugca

SEQ ID NO: 91423 - RNA, 64 nt, Human
guugcuuaaucaaacuaaugauagucuaacaacugagcaagauccucaucugagagugcuuaaa

SEQ ID NO: 91424 - RNA, 64 nt, Human
cugauccacucagcgcacagccuugaacaaaacagagcaagaguuauaaccuucagaugugggg

SEQ ID NO: 91425 - RNA, 64 nt, Human
gagaucguaccauggcacuccagccugggcgacagagcaagacucuaucuaaaaaaaaagcuug

SEQ ID NO: 91426 - RNA, 64 nt, Human
cuguggcccccuccgugauccauccaucuccagggagcaagacagagacgcaggaauggaaagc

SEQ ID NO: 91427 - RNA, 64 nt, Human
aaugaaaaauugaaaucagaagaacaaaaaagaagagcaagagaaaaagcaaauuugguaaguu

SEQ ID NO: 91428 - RNA, 64 nt, Human
gucucuaugaaaagcacaaggggccaaggucagggagcaagaggugugcacaccaaagcuauug

SEQ ID NO: 91429 - RNA, 64 nt, Human
ucuuugcuuucuaaacucuuccagaaaggacugugagcaagaugaauuuacuuuucuuaaaaaa

SEQ ID NO: 91430 - RNA, 64 nt, Human
ccagcauuuuacccccuuguuauaaaacugugcagagcaagaagaugauacuuauuuuugaauu

SEQ ID NO: 91431 - RNA, 64 nt, Human
aagaagaaccaagaacuguaaaacauauagaaaagagcaagaaugcacauguauaaaguuuaca

SEQ ID NO: 91432 - RNA, 64 nt, Human
cucauuugcuaccauuuggauacuuagacacuuugagcaagauuguggcaguuuuugcacaacu

SEQ ID NO: 91433 - RNA, 64 nt, Human
aucauggcaucauugcauuccagccugggcaacagagcaagaccucgucucaaaaaaaaaaaaa

SEQ ID NO: 91434 - RNA, 64 nt, Human
gagauuucaccagugcacuccagccugggugacagagcaagacuccaucucaaaaaaaaaauaa

SEQ ID NO: 91435 - RNA, 64 nt, Human
uguguuuuugcaugauuagcaugggagucuguuggagcaagaggaacaugcuuguuuugaaaac

SEQ ID NO: 91436 - RNA, 64 nt, Human
cacuuggcagaagggugcagggcugcuggugucagagcaagagggcuacagggaaagggcccuu

SEQ ID NO: 91437 - RNA, 64 nt, Human
gagauugcgccauugcacucuagccugugugacagagcaagacccugucucaaaaaaaaaaaaa

SEQ ID NO: 91438 - RNA, 64 nt, Human
guggaggcacaauggaaauccucugugggaccccgagcaagacccugcaccucuuugggccuca

SEQ ID NO: 91439 - RNA, 64 nt, Human
agucucugagcaucaggucuucaucucuaagauagagcaagaugagcaccuaaacguuucaggg

SEQ ID NO: 91440 - RNA, 64 nt, Human
uugaaaaacugagcacauagguggaaagaguuaagagcaagauggaaugauuuuuucuguucuc

SEQ ID NO: 91441 - RNA, 64 nt, Human
caccaagccaguauuugguaucucucucuagagcgagcaagagagggagagaggaggaaaaaau

SEQ ID NO: 91442 - RNA, 64 nt, Human
agcuguagacggacagcaggacauuggaccucuagagcaagaugucaguaggaugaccuccacc

SEQ ID NO: 91443 - RNA, 58 nt, Human
aagaugauaugcaacuauaaaaagggaggagcaagaagaucccagugcuugcccugcc

SEQ ID NO: 91444 - RNA, 64 nt, Human
aagacucccgcuggccauggaguggccugaaagagagcaagaacauguggaucuuugauaggau

SEQ ID NO: 91445 - RNA, 64 nt, Human
ugagauugcaccacugcacuccagccuggggacagagcaagacucuugucucaaaaaaaacaaa

SEQ ID NO: 91446 - RNA, 64 nt, Human
aagauugcgccacugcacuccagccugggugacagagcaagacuccgucucaaaaaaaaaaaaa

SEQ ID NO: 91447 - RNA, 64 nt, Human
aggaucacaccauugcuguccagccugggugacagagcaagacugcguuucaaaaaaaaaaaaa

SEQ ID NO: 91448 - RNA, 64 nt, Human
gaaauggcgccacuguacuccaaccugggcgacagagcaagacuccaucucauaaauuaaaagg

SEQ ID NO: 91449 - RNA, 64 nt, Human
gagauccugccacugcacuccagucugggugacagagcaagacuccaucucaaaaaauaaauaa

SEQ ID NO: 91450 - RNA, 64 nt, Human
gagaucgugccacugcacuccagccugggugacagagcaagacucugucucaaaaaaaaaaaaa

SEQ ID NO: 91451 - RNA, 64 nt, Human
aagauugcgccccugcacuccagccugggcaacagagcaagacuccaucucaaaaaaaaaaaaa

SEQ ID NO: 91452 - RNA, 64 nt, Human
aaagguacaccacuacacuccagccugggcaacagagcaagacucggucucaaaaacaaaauuu

SEQ ID NO: 91453 - RNA, 64 nt, Human
ugccaagaacucaggguggcccuaugacuuggaggagcaagaucagaccgcucaaagguccccg

SEQ ID NO: 91454 - RNA, 64 nt, Human
agaucgcgccauuguacuccagccugggcaacaagagcaagauucugccucaaaaaaaaaaaaa

SEQ ID NO: 91455 - RNA, 64 nt, Human
gugaucgugccacugaccuccagccugggggacagagcaagaccgugucucaaaaacaauuuag

SEQ ID NO: 91456 - RNA, 64 nt, Human
gaauaugcgccacugcacuccagccugggcaacagagcaagacuccgucuccaaaaaaaaaaaa

SEQ ID NO: 91457 - RNA, 64 nt, Human
augauggcaccacugcacuccagccugggcaacagagcaagauccugucuuuaaggaaaaaaag

SEQ ID NO: 91458 - RNA, 64 nt, Human
ugacugugccacugcaccucuagucugggugacagagcaagacccuguuuaaaaaagaaaaagg

SEQ ID NO: 91459 - RNA, 64 nt, Human
gagauuaagccaccgcacuccagccugggcgacagagcaagauuccguucccaagaaaaaaaaa

SEQ ID NO: 91460 - RNA, 64 nt, Human
gagaucaugccacugcacuccagccugggcaacagagcaagacucugccucaaaaaaaaauuaa

SEQ ID NO: 91461 - RNA, 64 nt, Human
aacauuggcuugaugugaucaucaucucauaacugagcaagaagacuaugcaaaucuuagggcg

SEQ ID NO: 91462 - RNA, 64 nt, Human
uauacuacauggacagaguacugcauugcaccaugagcaagaacugcucugcaagaaaaauauc

SEQ ID NO: 91463 - RNA, 64 nt, Human
aauaugaaauaucucugcuucaaaaaaugaggaagagcaagacuguccccuaugcugccaacau

SEQ ID NO: 91464 - RNA, 64 nt, Human
ccccuuucuccaucccuccagcuaggaggaaauggagcaagaugaacaggcagccacgaggugg

SEQ ID NO: 91465 - RNA, 64 nt, Human
ucaucucuacagagauaagaaaacaaguuuggcagagcaagagacagaagaccguggagaaauc

SEQ ID NO: 91466 - RNA, 64 nt, Human
gauauuuaacuggagcagagaacaucuggagagagagcaagauuccuguccuugagaaguugaa

SEQ ID NO: 91467 - RNA, 64 nt, Human
ggagaugagacuauacaucaggcaggugaccuuagagcaagacuccagaaugaaauuccuaaag

SEQ ID NO: 91468 - RNA, 64 nt, Human
aaagcacaugauuagaaaaugagaucuuuuaaaugagcaagagauugcauugcaguuuagacaa

SEQ ID NO: 91469 - RNA, 64 nt, Human
augaucgugucacugcacuccagccuaggcaacagagcaagacccugucucuuaaaacaaaaaa

SEQ ID NO: 91470 - RNA, 64 nt, Human
aauugggauuuaucauuuuggaggauucuuucuagagcaagauacgcucaaauucuccuguuug

SEQ ID NO: 91471 - RNA, 64 nt, Human
gguugugccacugcacugcagccugggcuacagagagcaagacucugucucaaaaaaaauaaaa

SEQ ID NO: 91472 - RNA, 64 nt, Human
gagaucacgccacugcauuccagccugggcgacagagcaagacuccaucucaaaaauaaaauaa

SEQ ID NO: 91473 - RNA, 64 nt, Human
aaggccugccaugcuguggccaacuguuucacuggagcaagaaagagaucucauaggacggagg

SEQ ID NO: 91474 - RNA, 64 nt, Human
ugcagcgauacaucgaagggcucaagaagcgccggagcaagaggcuguacgugaauuaaaaacg

SEQ ID NO: 91475 - RNA, 64 nt, Human
gaucucauuucaucugcacugccauacguggagugagcaagacagggcuuaccauccugucuac

SEQ ID NO: 91476 - RNA, 64 nt, Human
gaccugcucucagcugcccaccguuccucagugugagcaagauuugggucucuccagaccucug

SEQ ID NO: 91477 - RNA, 64 nt, Human
acagauauuuccauuucuuccucacuaugacacugagcaagaucuugucuccacuaaaugagcu

SEQ ID NO: 91478 - RNA, 64 nt, Human
uuaucaguccuuugacaaggacagguggggcagggagcaagacagguaggcuggaagaacaguu

SEQ ID NO: 91479 - RNA, 64 nt, Human
guuguuugggcauuugcuguguuggccauuucuggagcaagagggucuucuuccuccuuccccc

SEQ ID NO: 91480 - RNA, 64 nt, Human
gagaucgugccacugcacuccagccugggcgacagagcaagacugcaucucaaaaaaaaaaaaa

SEQ ID NO: 91481 - RNA, 64 nt, Human
gcugagauugcaccacugcaccagccuggcaacagagcaagacuccgucucacaaaaaugaaua

SEQ ID NO: 91482 - RNA, 64 nt, Human
cgagaucauaccacugcacuccagccuggcgacagagcaagacuccaucucaaaaauaaauaaa

SEQ ID NO: 91483 - RNA, 64 nt, Human
auuacaugguggaagggcaagagaaugcgagugagagcaagagggcaaaaugauuauccuuuua

SEQ ID NO: 91484 - RNA, 64 nt, Human
augauugcaccacugcaccccagccugggugacagagcaagacccugucucaaaaaaaauaaaa

SEQ ID NO: 91485 - RNA, 64 nt, Human
cugcccaccuggggaucccccaaagucagacacagagcaagaguccccuuggguacaccccucu

SEQ ID NO: 91486 - RNA, 64 nt, Human
cccuguccgucuucacccauccccaagccuacuagagcaagaaaccaguuguaauauaaaaugc

SEQ ID NO: 91487 - RNA, 64 nt, Human
ggaggagugauacaugacaauaaaugagucagaugagcaagaaggccccagaacccaugcccca

SEQ ID NO: 91488 - RNA, 63 nt, Human
caugugaugaacacccauaguuaagaaaccauggagcaagaaagcuuguggaaagucucucuc

SEQ ID NO: 91489 - RNA, 64 nt, Human
cagaucaugccacuguacuccagccuaggugacagagcaagacucugucucaaaaacaagcaaa

SEQ ID NO: 91490 - RNA, 64 nt, Human
accacggcguguguugugaaacgugaaauaaaaagagcaagaaagaaaaaggaaacaaaauaag

SEQ ID NO: 91491 - RNA, 64 nt, Human
acgaucguaccacuacacuccagccugggcaacagagcaagacccugucucaaagcauaaaaug

SEQ ID NO: 91492 - RNA, 64 nt, Human
caaaccucagagggauaaggcaguugaaccugaugagcaagaauuauaacagcaaggaaacauu

SEQ ID NO: 91493 - RNA, 64 nt, Human
gagaucacgccauuguacuccagccugggcgacagagcaagacuccauuucaaaaaaaaaaaaa

SEQ ID NO: 91494 - RNA, 64 nt, Human
gagauugcaccacugcacuccagccugggugacagagcaagacucccucucaaaagaaaaagaa

SEQ ID NO: 91495 - RNA, 64 nt, Human
ucugguugacaagcaaaccacaugcuaaggcuuggagcaagagagaauuugugucuauuggcaa

SEQ ID NO: 91496 - RNA, 64 nt, Human
guauacuaucauccuggagggguguuguauggcugagcaagagagagagagaaugagagagaga

SEQ ID NO: 91497 - RNA, 64 nt, Human
ugacucuuccacccuuuuuuuuucugggaaaggagagcaagaggucccgaguccccuccuaguc

SEQ ID NO: 91498 - RNA, 64 nt, Human
acauucaauggaaauugauuaggccugagagaaggagcaagaggcagaaacacugacucugaga

SEQ ID NO: 91499 - RNA, 64 nt, Human
uguuacccuuaguuccaagaggugguuuuugaaagagcaagaggaaagaaaaaagaaaagaagg

SEQ ID NO: 91500 - RNA, 64 nt, Human
augauugugccacuguacuccagccugggagauagagcaagacuccaucucuaaaaaaaaaaaa

SEQ ID NO: 91501 - RNA, 64 nt, Human
uuauuuacaaugucuugauaauucuaccuuuuuagagcaagaauaguaucugcuaauguaaggg

SEQ ID NO: 91502 - RNA, 64 nt, Human
cucuuagagguggcauuguguaaaucugagcuuugagcaagaaaguuuuggaaauuguguugcu

SEQ ID NO: 91503 - RNA, 64 nt, Human
gagauugugccacugcacuccagccugggagacagagcaagacucagucucaaaaaaaaaaaaa

SEQ ID NO: 91504 - RNA, 64 nt, Human
guugucugcuuugauguaaaagcaagaguauuuggagcaagaagcugcaaugcgccaaauacac

SEQ ID NO: 91505 - RNA, 64 nt, Human
acuggaagcuuuguagaaauuaaacauauucaaggagcaagaaaugaacuuucagcagucuaaa

SEQ ID NO: 91506 - RNA, 64 nt, Human
cacaggcgggggagagacgaaaaagaaaaggaaagagcaagauagacaaaagccaaucagcuua

SEQ ID NO: 91507 - RNA, 64 nt, Human
aagaucguaccacugcacuccagccugggcgacagagcaagacacugucucucucucucucucc

SEQ ID NO: 91508 - RNA, 64 nt, Human
aaguuuccccacuuguaggaguguggguauuccagagcaagacuguggccaccaucuuccccuc

SEQ ID NO: 91509 - RNA, 64 nt, Human
ccccaaaccccaaacaaucuuaauaaacacgacugagcaagaaaguggcgcuguguagggcuau

SEQ ID NO: 91510 - RNA, 64 nt, Human
aguauuccagacaccaggcuucaggcauggccaugagcaagaccagcaaauaacagcuuuuugc

SEQ ID NO: 91511 - RNA, 64 nt, Human
acagaaggcacaacucaaauguguaaagaaggaagagcaagaacauggccacacccaccgcccc

SEQ ID NO: 91512 - RNA, 64 nt, Human
agaucgugccguugcacuccagccugggcgacaagagcaagacucugucucagaaaaaaaaaaa

SEQ ID NO: 91513 - RNA, 64 nt, Human
agacauaaauggaaagaugaaguaccuccugacagagcaagaauggcacugaacaauguuauau

SEQ ID NO: 91514 - RNA, 64 nt, Human
gagaucgcgccacugcccuccagccugggcaacagagcaagacuccaucucaaaaaauaaauag

SEQ ID NO: 91515 - RNA, 64 nt, Human
agacucuggcaggugggucaaugcucucuccuuggagcaagaagccagcuuuuggggaaggcag

SEQ ID NO: 91516 - RNA, 64 nt, Human
gagaucgugccacugcacuccagccugggcgacagagcaagacucugucucaaaaaaaaaaaau

SEQ ID NO: 91517 - RNA, 64 nt, Human
auggcacuugucuauguacaaaacacaaacuuuagagcaagaagaccucagacaggaaacugga

SEQ ID NO: 91518 - RNA, 64 nt, Human
cccaggggcgggcggggguacgagggaggaaggggagcaagacuugggcucacaggcugguuac

SEQ ID NO: 91519 - RNA, 64 nt, Human
gaaggucccacccccaccccuacagaaaaaaugggagcaagaacuugugcuugggagcugguua

SEQ ID NO: 91520 - RNA, 64 nt, Human
cccuaaggaaaugccagagcuagcccggaaggaggagcaagagccagggggcccucuucagcgc

SEQ ID NO: 91521 - RNA, 64 nt, Human
ccagcaccaggcagagggcaagacggagagggcagagcaagaacugcacugcaucucacugcag

SEQ ID NO: 91522 - RNA, 64 nt, Human
cuuaaucauggcuguucuaagaaguacuuauggagagcaagaacguuuuuguucauuucuuaau

SEQ ID NO: 91523 - RNA, 64 nt, Human
gagaucaugccacugcacuccagccugggcaacagagcaagacuccaucucgaaaaaaaggaau

SEQ ID NO: 91524 - RNA, 64 nt, Human
uaguguuugcugggcacuaugcuaagcacuuugggagcaagaaccuccuaccuuccaguuuaaa

SEQ ID NO: 91525 - RNA, 64 nt, Human
augauugagccaccacacuccaaccuaggugacagagcaagacccugucucaaaaaaaaaaaaa

SEQ ID NO: 91526 - RNA, 64 nt, Human
accuuaaaggucaccuaccacaaauugauggcuagagcaagaccuuuuaaauuuggaugaaucu

SEQ ID NO: 91527 - RNA, 64 nt, Human
gguuucuuuuguuuaucacgccauuugcaaaucagagcaagagcucuuucucaagggcaagaaa

SEQ ID NO: 91528 - RNA, 64 nt, Human
gaguggccaugggcauguggauauggccaugaaugagcaagauccucucugauccuguagaagu

SEQ ID NO: 91529 - RNA, 64 nt, Human
agcagguuuuuccucccuguugagcaagacaggugagcaagauaggacuuggcuuucuuacaug

SEQ ID NO: 91530 - RNA, 64 nt, Human
agcagcugcagcaagcagguuuuuccucccuguugagcaagacaggugagcaagauaggacuug

SEQ ID NO: 91531 - RNA, 64 nt, Human
accggggacuugggagagugagacccaguggagggagcaagaggagagggaugucgggggggug

SEQ ID NO: 91532 - RNA, 64 nt, Human
cucagguggagaccugaagcuguaacuagaugcagagcaagauaugacuauagcccacaaccca

SEQ ID NO: 91533 - RNA, 64 nt, Human
aaggucaugccacugcacuccagccugggagacagagcaagacuccaucucaaaaacaaaaaca

SEQ ID NO: 91534 - RNA, 64 nt, Human
augaucacaccacugcacuccagccucggcgacagagcaagaccuuguuucucaaaaauaaaua

SEQ ID NO: 91535 - RNA, 64 nt, Human
gcgugugucaguggcugugugcaggagugugagugagcaagagcaagagcgcauggcuccugcu

SEQ ID NO: 91536 - RNA, 64 nt, Human
gucaguggcugugugcaggagugugagugagcaagagcaagagcgcauggcuccugcuguaccu

SEQ ID NO: 91537 - RNA, 64 nt, Human
auacucugauuaucagcaucaacaguacuuuacugagcaagacuuugaaggccugagaagagag

SEQ ID NO: 91538 - RNA, 64 nt, Human
aaaaaaaaaaggacagaaacacugccugauaugugagcaagagcaugaaaauauagaaugauua

SEQ ID NO: 91539 - RNA, 64 nt, Human
acaucugcccuagggagguccuucagaaucuguggagcaagaaaggauuuggggaagcuugggg

SEQ ID NO: 91540 - RNA, 64 nt, Human
cgggaaauaacagcacuuuagguguaguucaggugagcaagaugccagauaguuucuacuaacc

SEQ ID NO: 91541 - RNA, 64 nt, Human
aagaucgugccacugcacuccagccuuggugacagagcaagacuccgucuccaaaaaaaagaaa

SEQ ID NO: 91542 - RNA, 64 nt, Human
aaauacugauauucuccaaaccuagugguguagggagcaagagaaugcagcuggaaggcacaag

SEQ ID NO: 91543 - RNA, 64 nt, Human
cagucuggcuuucccuccaucugccccaggacaagagcaagaaggacaucaguugcccagucau

SEQ ID NO: 91544 - RNA, 64 nt, Human
acaaaaaaaaaauuugccaagagccugagugacagagcaagaccccaucucaaaaaaaaaaaca

SEQ ID NO: 91545 - RNA, 64 nt, Human
aauaugugacccagcauuagcucagcaucugucagagcaagagaccagguaauuucuaagaaca

SEQ ID NO: 91546 - RNA, 64 nt, Human
acaaauuugaugauaucugauaugccagaacugugagcaagauuaggaguucuauucuagauac

SEQ ID NO: 91547 - RNA, 64 nt, Human
uuuaucagaaacucaaagcuugggggauaaaaaggagcaagagaauacuguaacaaacuucgua

SEQ ID NO: 91548 - RNA, 64 nt, Human
accccugcauccccauuuuuuacugagcucaggagagcaagaugaagguaacaaucaucuaaaa

SEQ ID NO: 91549 - RNA, 64 nt, Human
gaagagguugcuggagcaagaggagaggaugcuggagcaagaggagaggcugcuggagcuugag

SEQ ID NO: 91550 - RNA, 64 nt, Human
agucgccugaaccaagagcaggaagagguugcuggagcaagaggagaggaugcuggagcaagag

SEQ ID NO: 91551 - RNA, 64 nt, Human
cgagagguuguuggagcaagaggagagguugcuggagcaagaggagagguugcuggagcugcag

SEQ ID NO: 91552 - RNA, 64 nt, Human
gcugagauuguuggaacaagacgagagguuguuggagcaagaggagagguugcuggagcaagag

SEQ ID NO: 91553 - RNA, 64 nt, Human
ggagagguugcuggagcaagaggagagguugcuggagcaagaggagaggcuacuggagcugcag

SEQ ID NO: 91554 - RNA, 64 nt, Human
ggagaaguugcuggagcaagaggagagguugcuggagcaagaggagagguugcuggagcaagag

SEQ ID NO: 91555 - RNA, 64 nt, Human
gcucagguuguuggagcaagaggagaaguugcuggagcaagaggagagguugcuggagcaagag

SEQ ID NO: 91556 - RNA, 64 nt, Human
aaccaagagcaggaagagguugcucagguuguuggagcaagaggagaaguugcuggagcaagag

SEQ ID NO: 91557 - RNA, 64 nt, Human
gagaucgcgccacggcacuccagccugggagacagagcaagacuccgucucaaaaaaaaaaaaa

SEQ ID NO: 91558 - RNA, 64 nt, Human
ugcuuccaugccuggugcugucugaguauccccagagcaagagagaccuggagacaccaggggu

SEQ ID NO: 91559 - RNA, 64 nt, Human
augaucaugccacugcacuucagccuggaccacagagcaagacccuguguaaaaaaauaaaaua

SEQ ID NO: 91560 - RNA, 64 nt, Human
ugaguuauuucuuaacaaguuucgagagagaagggagcaagacaagagcaagcaacggcuauua

SEQ ID NO: 91561 - RNA, 64 nt, Human
uucagagguuugcuggccuucccgguuucccaaggagcaagaccucuguccgcccuuuggcccg

SEQ ID NO: 91562 - RNA, 64 nt, Human
gagacugugccauugcacuccagucggguuaacagagcaagacacugucucaaaaaaaaaaaaa

SEQ ID NO: 91563 - RNA, 64 nt, Human
agaaguagggccucgacuugcuucagacgacacagagcaagaggaacugaccaucucaugaccu

SEQ ID NO: 91564 - RNA, 64 nt, Human
cuuggaggaaggaaacccagcucugguccauagagagcaagacgcugugcugcccugcccaccu

SEQ ID NO: 91565 - RNA, 64 nt, Human
cgagaauauucaaaauuccaaauuuuuuucuuaggagcaagaagaaaauguggcccuaaagggg

SEQ ID NO: 91566 - RNA, 64 nt, Human
ucuuacccccaggugucacacggggccgagagcugagcaagaauuuggaauggaaguuaugacc

SEQ ID NO: 91567 - RNA, 64 nt, Human
ccucugcgaaucugcucccaaaggaagcugaccagagcaagaucugggcaagcagagagugccu

SEQ ID NO: 91568 - RNA, 64 nt, Human
aguuugacccucacaguucacauucagcucagcagagcaagaccccagagaugcuuagagacag

SEQ ID NO: 91569 - RNA, 64 nt, Human
ugggugcgguguagaggaugcucuuggccggcuggagcaagaccuggcucccaccagagggacg

SEQ ID NO: 91570 - RNA, 64 nt, Human
aaaaagggaaaaagucucccacaauuuaucccaugagcaagaaccacuuuauagcuggcauaua

SEQ ID NO: 91571 - RNA, 64 nt, Human
ggggcuucagccugucccgggguugccugaggcagagcaagacggguucucaccccugacuucu

SEQ ID NO: 91572 - RNA, 64 nt, Human
uugcagugagccacugcacuccagccugaugacagagcaagacucagucucaaaaauaaauaaa

SEQ ID NO: 91573 - RNA, 64 nt, Human
ccugagggcagcaaaccgcuggugcugucgcugugagcaagagccggcuggcacauuuggaagc

SEQ ID NO: 91574 - RNA, 64 nt, Human
gagauugugccauugcacuccagccugggcaacagagcaagacucugucucaggaaaaaaaaaa

SEQ ID NO: 91575 - RNA, 64 nt, Human
cgaugccacucgcugcauucaagucuagaugacagagcaagacccugcuccuggacauacuacu

SEQ ID NO: 91576 - RNA, 64 nt, Human
ccagaggcucaggccugggucuaaggggcacguggagcaagagauccugguccccucccugcug

SEQ ID NO: 91577 - RNA, 64 nt, Human
ccacgggaaaguuucuggucuuacuaguguguaugagcaagaucugcuaaaacuuacuccacug

SEQ ID NO: 91578 - RNA, 64 nt, Human
gggcugggcagcaagccaggcacagugaguggcagagcaagagggggaaagcaggaucagugcc

SEQ ID NO: 91579 - RNA, 64 nt, Human
gagaucaugccacugcacccuagcuuggguggcagagcaagacucuaucaaaaaaauaaguaau

SEQ ID NO: 91580 - RNA, 64 nt, Human
aagaucguaccgcugcacuccagccugggugauagagcaagacccuaucucaaaaaaaaaaaaa

SEQ ID NO: 91581 - RNA, 64 nt, Human
ugccgagcuguccauagcugcagugaaagaugaagagcaagaccuucucuagguuuucuagcuu

SEQ ID NO: 91582 - RNA, 64 nt, Human
gugauugcaccacugcacuucagcuugggcaacagagcaagacccugucuccgaaacaaauaaa

SEQ ID NO: 91583 - RNA, 64 nt, Human
uguaucacuuaaauguuaccaaaaauaaauauaagagcaagaucuaggauuuacuguauuugau

SEQ ID NO: 91584 - RNA, 64 nt, Human
gagaucgugccacugcacuccagccuggucaacagagcaagacuccaucucgaagaaaaaaaaa

SEQ ID NO: 91585 - RNA, 64 nt, Human
gaagaugggggcuggagggggcagaguggccugugagcaagagccaggggugucccagucccag

SEQ ID NO: 91586 - RNA, 64 nt, Human
gaggguuucuuuuacuucaaaaucuuucuucagggagcaagacaugaacugacuaauugguauc

SEQ ID NO: 91587 - RNA, 64 nt, Human
cuuguggcacuccaaguaugagucggauacccuggagcaagaccuggagcggcuauuccaggag

SEQ ID NO: 91588 - RNA, 64 nt, Human
aagaucgugccacugcacuccagccugggcgacagagcaagacuccgucucaaaaaauaaaaaa

SEQ ID NO: 91589 - RNA, 64 nt, Human
uuccucugggcugccgcaggcuccccugggaauagagcaagacgugaguccuaaccuggccaca

SEQ ID NO: 91590 - RNA, 64 nt, Human
gagaucgcgccauugcacuccagccugggugacagagcaagacucugucucauaaauaaauaca

SEQ ID NO: 91591 - RNA, 64 nt, Human
aucuccaaggaaaaacucuacagagcaucuuuuagagcaagagauucauacaggccaagugaug

SEQ ID NO: 91592 - RNA, 64 nt, Human
aagaucgggccacugcacuccagcuugggugacagagcaagacuccaucucaaaaaaauuauaa

SEQ ID NO: 91593 - RNA, 64 nt, Human
aaaucacccuuucccuuuuucuuuguagaagcaggagcaagaguguuuggcucccaguuuggac

SEQ ID NO: 91594 - RNA, 64 nt, Human
acugaucaggcucagggccagagaggcaacaagagagcaagacccagggaaugggcccagggca

SEQ ID NO: 91595 - RNA, 64 nt, Human
cuaauuauaucuuaauaaauauauuuuauuacuagagcaagauggguuuuuaaggaaaauaaug

SEQ ID NO: 91596 - RNA, 64 nt, Human
gagaucacaccaccguacuccagucugagcgacagagcaagaaucugucucaaaaaaaaaaaaa

SEQ ID NO: 91597 - RNA, 64 nt, Human
cccaucgaccugggcccugcccacacaacagucugagcaagagaccugcagccccuguuucgug

SEQ ID NO: 91598 - RNA, 64 nt, Human
gaagccuggagccaagaaccuucuggcucugagggagcaagagcuggcaggcggcagggcuggc

SEQ ID NO: 91599 - RNA, 64 nt, Human
uuuuuuauacuuaauguacauauauugacuuuuugagcaagaaugccagaaauagccuucauuu

SEQ ID NO: 91600 - RNA, 64 nt, Human
aacccuacgcccguucuuagaagugugagucuccgagcaagagcaggaauagcuaggauccaug

SEQ ID NO: 91601 - RNA, 64 nt, Human
uuacuaaggccuucagugaacagaaaggagcagagagcaagauuagaucugagaagaugcucug

SEQ ID NO: 91602 - RNA, 64 nt, Human
aguaaggggcuuuguugaaagaggggguuagagagagcaagacagcacuugagugcacuggcag

SEQ ID NO: 91603 - RNA, 64 nt, Human
augauuccaccauugcacuccagucugggcaacagagcaagacccugucuauuuaaaaaaaaaa

SEQ ID NO: 91604 - RNA, 64 nt, Human
cugccaagguuugcuguggauucagaagcaccaggagcaagagaccagaaggaugaucugcucc

SEQ ID NO: 91605 - RNA, 64 nt, Human
aagaucgugccacugcauuccagccugggcgacagagcaagacucugucucaaaaaaaauaaaa

SEQ ID NO: 91606 - RNA, 64 nt, Human
ugaucuguagucacaugacuaagccaagaggaaggagcaagacucaagacaugauugauggaug

SEQ ID NO: 91607 - RNA, 64 nt, Human
ugauccagcuuuggucauacccaaggggaagguggagcaagaaaugaaaaggaaccugaauccc

SEQ ID NO: 91608 - RNA, 64 nt, Human
augauuguaccacugcacuccagccugggcaacagagcaagaccuugucucaaaaauaaacaaa

SEQ ID NO: 91609 - RNA, 64 nt, Human
gagucgcuugaaugcaggagguggagguugcaaugagcaagauugugccacugcacuccagccu

SEQ ID NO: 91610 - RNA, 64 nt, Human
aagauugugccacugcacuccagccugggcaacagagcaagacucugucucaaaaaaaaaaaag

SEQ ID NO: 91611 - RNA, 64 nt, Human
cccagcacgugguucuguagggaccuuugucagugagcaagacugagaucgucacaggagaagg

SEQ ID NO: 91612 - RNA, 64 nt, Human
gagaucgcaccacugcacucuagcuugggcaacagagcaagacucugucucuuaaauaaauaaa

SEQ ID NO: 91613 - RNA, 64 nt, Human
ccagaucgcaccacugcacuccagucuggcaacagagcaagacuccaucucaaaaagaaaagaa

SEQ ID NO: 91614 - RNA, 64 nt, Human
uuaggcacagcaaauggcacauacaagggccagggagcaagagagaggacagguccucaacaaa

SEQ ID NO: 91615 - RNA, 64 nt, Human
gagaucacgccauugcacuccagccugggcgacagagcaagacucugucucaagaagaaaaaaa

SEQ ID NO: 91616 - RNA, 64 nt, Human
gagaucacacuacugcacuccagccugggcaacagagcaagacugucucaaaaaaaaaaaaaaa

SEQ ID NO: 91617 - RNA, 64 nt, Human
acauggaugucuccccagcagcuugaacccuggagagcaagaauaaucugauuuuccugggggc

SEQ ID NO: 91618 - RNA, 64 nt, Human
ccuggagggucagaugggagaccaggucccaagggagcaagaccucgcgaagcgcagcagcccc

SEQ ID NO: 91619 - RNA, 64 nt, Human
aagaucgugccacugcacucuagccugggcgacagagcaagacugucucaaaaaaauuaaaauu

SEQ ID NO: 91620 - RNA, 64 nt, Human
gagaucgcgccacugcacuccagccuggacgacagagcaagacuccgucucaaaaaugaaaaaa

SEQ ID NO: 91621 - RNA, 64 nt, Human
ucuccacucuugagcauggauacagccaggcccagagcaagacccugaagacccccaaccacgg

SEQ ID NO: 91622 - RNA, 64 nt, Human
agcuaucgcaccagugcacuccagccuggcgacagagcaagacuccaucuaaaaaaaaaaaaaa

SEQ ID NO: 91623 - RNA, 64 nt, Human
caggagagggaacaggauuaagaauggguuuaaggagcaagacugagacucugauucagcgaga

SEQ ID NO: 91624 - RNA, 64 nt, Human
gacaucaugccacugcacuccagccugggcgacagagcaagacacugucucaaaaaagaaaaga

SEQ ID NO: 91625 - RNA, 64 nt, Human
aagauugcgccuuugcacuccagccugggcaagagagcaagacucugucucaaauaauaauaau

SEQ ID NO: 91626 - RNA, 64 nt, Human
gagaucgcgccacugcacuccagccuggguaacagagcaagagucugucaaaaaaaaaaaaaaa

SEQ ID NO: 91627 - RNA, 64 nt, Human
gaugggcgcaccugcugcucagggcaggguugcugagcaagaccaccucccuaggccuugccug

SEQ ID NO: 91628 - RNA, 64 nt, Human
ccuccaauuccaucuucucccauggaaccucaaagagcaagacccacucuguuccagaagcccu

SEQ ID NO: 91629 - RNA, 64 nt, Human
ccuccaauuccauuuucucccauggaaucacgaagagcaagacccacucuguuccagaagcccu

SEQ ID NO: 91630 - RNA, 64 nt, Human
aagauuguaccacuguauuccagcccgggugacagagcaagacugugucucaaaaaaaaaaaaa

SEQ ID NO: 91631 - RNA, 64 nt, Human
aagauggcaccauugcacccuagccugggcaacagagcaagacaccgucuuaaaaccaaaaguu

SEQ ID NO: 91632 - RNA, 64 nt, Human
ucugcuuccacgguccuguuaauucuagaucagagagcaagaaaaaaguacagaacauauccuc

SEQ ID NO: 91633 - RNA, 64 nt, Human
cccucuugaugucucucagcugcagguggagcuggagcaagaauaccaagacaaauucaaaaga

SEQ ID NO: 91634 - RNA, 64 nt, Human
aaucauucccuuucccauccauaaggugcaguaggagcaagagagggcaaguguucccaaauug

SEQ ID NO: 91635 - RNA, 64 nt, Human
uaaguuaaaacuacuugaauaguauuuugcugaagagcaagauaugcauuaaucaccgguuuua

SEQ ID NO: 91636 - RNA, 64 nt, Human
augguggcaccacugcacuccagccugggugacagagcaagacccugucucuaaaauaaauuuu

SEQ ID NO: 91637 - RNA, 64 nt, Human
aagugucaggagagugaagaaauuggccacagaagagcaagaagcucucuuaagaaaagggaau

SEQ ID NO: 91638 - RNA, 64 nt, Human
uugcugcugggcacaucugugcucuuggugaggagagcaagaggaaccagaagaagucucuuug

SEQ ID NO: 91639 - RNA, 64 nt, Human
uaguguggaguggaugaguguuccaugagccuaggagcaagaaagucucuucggccucgggcuu

SEQ ID NO: 91640 - RNA, 64 nt, Human
gagacugcgccacggcacuccagccugggcgacagagcaagacucugucucaauaaauaaauaa

SEQ ID NO: 91641 - RNA, 64 nt, Human
gaaguugcaccauugcacuccacccugggcgacagagcaagauucuaucaaaaaaaaaaaaagg

SEQ ID NO: 91642 - RNA, 64 nt, Human
gccuucacugcuacgccccuggccccaaaacagagagcaagacaguuguccagagaauuuagau

SEQ ID NO: 91643 - RNA, 64 nt, Human
ggaggccuucuggacagacggcagucgggccccagagcaagaaggcuggugagggaagggcuca

SEQ ID NO: 91644 - RNA, 64 nt, Human
gcuuuuucucccuuuguuuaaaaugucauuuguugagcaagaguuguauaguauuaucuacuua

SEQ ID NO: 91645 - RNA, 64 nt, Human
cccuaggcaccucugugcugcaucccaccagccugagcaagacgcccucucggggccugugccg

SEQ ID NO: 91646 - RNA, 56 nt, Human
ccaucgcauuacagccugagcaacaggagcaagagauggaguuucacugugucagc

SEQ ID NO: 91647 - RNA, 64 nt, Human
ugaaucuuugcuguuuuaugguugugaagaacgagagcaagaaaaagaugauguagauguugcc

SEQ ID NO: 91648 - RNA, 64 nt, Human
uguugauacagacucaaggacgcagcaaguggcggagcaagaaucacacucaggcagucucucu

SEQ ID NO: 91649 - RNA, 64 nt, Human
aguuacagcgucagccccucgcaagacacagaucgagcaagaagcagcauggucuccacagaaa

SEQ ID NO: 91650 - RNA, 64 nt, Human
ucucugucacggucucucuuccucacagaagcuggagcaagaacggcagaacguggaaggggga

SEQ ID NO: 91651 - RNA, 64 nt, Human
cagacaggcccugcuuuucuaggauguggccuuagagcaagaacagacccaacagccagcccuu

SEQ ID NO: 91652 - RNA, 64 nt, Human
gagcaggaugagaccuuuggauagaacagaagcugagcaagagaacauguugguuuggauaacc

SEQ ID NO: 91653 - RNA, 64 nt, Human
gagcucaugcgacugcacuccagccugggugacugagcaagacucugccucaaaaaaacaaaua

SEQ ID NO: 91654 - RNA, 64 nt, Human
uugugggccauucaucuacaaccaaguccugauggagcaagaggcccacgccuaggggaugcaa

SEQ ID NO: 91655 - RNA, 64 nt, Human
ggagguuccagggacagggcagccucccagagccgagcaagagcucaagguacaaaugagagau

SEQ ID NO: 91656 - RNA, 64 nt, Human
cagauggcgcugcugcacucaagcuuggaugacagagcaagacuccguuucaaaaaaaaaaaac

SEQ ID NO: 91657 - RNA, 64 nt, Human
gagaucacgccauugcacuccagccugggcaacagagcaagacuccaucucaaaaaaauaauaa

SEQ ID NO: 91658 - RNA, 64 nt, Human
uuucucuaucccuacccacaacccugggaaguuggagcaagaggggcauacuauugggcuggga

SEQ ID NO: 91659 - RNA, 64 nt, Human
ucccucuaucacaugcuugccaccacuguaccuugagcaagaaucauaucugacccucaaccuc

SEQ ID NO: 91660 - RNA, 64 nt, Human
ugccauucuguuagacauuagcauuuucguugaugagcaagacaugcuuaaugcauauuucggc

SEQ ID NO: 91661 - RNA, 64 nt, Human
ugccauucuguuagauacuauccuuauaauugaugagcaagacauacugaaugcauauuucggu

SEQ ID NO: 91662 - RNA, 64 nt, Human
ugccauucuguuagauacuauccuuuucaaugaugagcaagacauacuuaaugcauauuucggu

SEQ ID NO: 91663 - RNA, 64 nt, Human
ugucauucuguuagauacuaacauuuucauugaugagcaagacauacuuaaugcauauuuuggu

SEQ ID NO: 91664 - RNA, 64 nt, Human
cuuccaacuggcucaauuggccgggaaaacaugggagcaagagaagcugaaauauauuucugca

SEQ ID NO: 91665 - RNA, 64 nt, Human
gagaucacaccacugcacucuagccugggugacagagcaagacucugucuaaaaaacaaaacaa

SEQ ID NO: 91666 - RNA, 64 nt, Human
gagaucucgccacugcacuccagccugggcaacagagcaagacucugucucaaaaaaaaaaaaa

SEQ ID NO: 91667 - RNA, 64 nt, Human
uugauuuagauuuggaggggcuggggugggcagagagcaagaggcgaguaaagagaaugguggu

SEQ ID NO: 91668 - RNA, 64 nt, Human
gagaucgugccacugcacuccagccugggccacagagcaagacuccgucucaaaacauaaaaau

SEQ ID NO: 91669 - RNA, 64 nt, Human
ugucaaaaaguuguaucagaucaacuaaaauggagagcaagacagagaaugaaaagaguugauu

SEQ ID NO: 91670 - RNA, 64 nt, Human
uguuuuguccagcggaucaggauguuaggaugacgagcaagaguccaggucacugugccuuugc

SEQ ID NO: 91671 - RNA, 64 nt, Human
uagcauacaucaguauguaauguaaaagacauaugagcaagaaaaaagugauuuaacuuaccuc

SEQ ID NO: 91672 - RNA, 64 nt, Human
ugccauucuguuagauauuagcguuuucacugaugagcaagacauacuuaaugcauauuucagu

SEQ ID NO: 91673 - RNA, 64 nt, Human
ugcaauucuguuagauauuaauguuuucauugaugagcaagacaugcuuaauguguauuucggu

SEQ ID NO: 91674 - RNA, 64 nt, Human
ugucauucuguuagauauuaacauuuucacugaugagcaagacauacuuaaugcauauuuuggu

SEQ ID NO: 91675 - RNA, 64 nt, Human
ugccauucuguuagacauuagcguuuucguugaugagcaagacaugcuuaaugcauauuucggc

SEQ ID NO: 91676 - RNA, 64 nt, Human
ugccauucuguuagauauuagcguuuucauugaugagcaagacaugcuuaauguguauuucggu

SEQ ID NO: 91677 - RNA, 64 nt, Human
guagcccagagugagcuuuagcucucucuagaaugagcaagacugggccccacauggcuuagag

SEQ ID NO: 91678 - RNA, 64 nt, Human
cuggggggcaccuguuuccccagugacucagagagagcaagacugcaggaacggagggguccug

SEQ ID NO: 91679 - RNA, 64 nt, Human
augauuguaugacugcacuccagccugggugacagagcaagacccuguuucaaaaagaaaaacc

SEQ ID NO: 91680 - RNA, 64 nt, Human
ggcucugcugaguccgaccuggccugucugugaagagcaagagagcagcaaggucuugcucucc

SEQ ID NO: 91681 - RNA, 64 nt, Human
cugauugugccagugcacuccagccuggacgacagagcaagacccuguauuaaaaaaaaaauuc

SEQ ID NO: 91682 - RNA, 64 nt, Human
aagaucgcaccauugcacaccaaccugcgugacagagcaagauugcaucucaaaacaaacaaua

SEQ ID NO: 91683 - RNA, 64 nt, Human
gauauauauaaagcaaacauaagacugaaggauggagcaagaagauaaacuggugaggaaauuu

SEQ ID NO: 91684 - RNA, 64 nt, Human
agcugcaaucagcuucuuuauaugcaaauuaggcacgacccaucugugguuccugguugguggc

SEQ ID NO: 91685 - RNA, 64 nt, Human
uugguaaauggacaaaagcuagcuaguaaaaaggacgacccagcaacaugcuuuaaccccauug

SEQ ID NO: 91686 - RNA, 64 nt, Human
ucuccaaaaacaaaccagaaacagaaaagaaaugacgacccaagaccccccuacaagcauacuu

SEQ ID NO: 91687 - RNA, 64 nt, Human
auuauaaugucgaacucugaaacaaaaguauuuaacgacccagucaaugaaaacugaaucaaga

SEQ ID NO: 91688 - RNA, 64 nt, Human
uccaaguaaacuaguuaccuggguaaaagcgcuaacgacccaaaggcucuucuaagagccaccc

SEQ ID NO: 91689 - RNA, 64 nt, Human
agaaacugaaaagugagguguggaacuccaggcaacgacccaagcacuuauuuuuuaagaggga

SEQ ID NO: 91690 - RNA, 64 nt, Human
gaaucugauucaaauagucagguugauuggacuuacgacccaaaugaaccucgauacugcauuu

SEQ ID NO: 91691 - RNA, 64 nt, Human
gacaagccgcucauggaccauuagacuugagaagacgacccacguggugacugcaaagcccugg

SEQ ID NO: 91692 - RNA, 64 nt, Human
gauuccccucugcccgaugacucuguuaagagucacgacccaucaagggaaugcauagauggag

SEQ ID NO: 91693 - RNA, 64 nt, Human
aggaaaauagaggguuguccacuccucacauuccacgacccaggccugcaccccacccccaacu

SEQ ID NO: 91694 - RNA, 64 nt, Human
gguaacgcgcggccggggcgggagagacucagcaacgacccauaccucagacccgacggcccgg

SEQ ID NO: 91695 - RNA, 64 nt, Human
aucuuuuaaguuucuauacauguauucuuauaagacgacccaggaucuacuauauuagaauaga

SEQ ID NO: 91696 - RNA, 64 nt, Human
aacaguccaaacuguucugagaaggugaacuguuacgacccaggacaauuagaaaaauucaccc

SEQ ID NO: 91697 - RNA, 64 nt, Human
auuuuugaauaauccuagggcagacuaaauucagacgacccaucucagaaugguggaucaaagc

SEQ ID NO: 91698 - RNA, 64 nt, Human
guccacuuaaaaaaugaugaugaugauaaaaaccacgacccaaccaggcacaggacuuuuuugu

SEQ ID NO: 91699 - RNA, 64 nt, Human
cuuuuuguuuguacugguucauuguguuacauuaacgacccacucugcuucuugcuggugaaag

SEQ ID NO: 91700 - RNA, 64 nt, Human
aucacauaggcaauuccuuuuaaaucagauaccaacgacccauuacugagagguacagagcgua

SEQ ID NO: 91701 - RNA, 64 nt, Human
ugguucagagaacaccccacggggcuguuuguccacgacccaggcuggacgaaugccuggucag

SEQ ID NO: 91702 - RNA, 64 nt, Human
agaagacaggagugagggccccgggcagcaguggacgacccagccuccccauaccgggccucug

SEQ ID NO: 91703 - RNA, 64 nt, Human
guggucuguaauaucuuacuaaggccuuugguauacgacccagagauaacacgaugcguauuuu

SEQ ID NO: 91704 - RNA, 64 nt, Human
cucagaggauagugaacaaaucugucuuugacuuacgacccauuuugcaagacuuaaagccgga

SEQ ID NO: 91705 - RNA, 64 nt, Human
agcugugaggacuuccagaacuggaaacgcaugaacgacccagaauaccaggcccagggccuag

SEQ ID NO: 91706 - RNA, 64 nt, Human
aggaacaugacccguacacaccacgcgucacccaacgacccaugaccguucucugaggcaaagg

SEQ ID NO: 91707 - RNA, 64 nt, Human
aagaaaaaaaaaaaaauguaacugaugaaucuaaacgacccacugcaccaacaaucauuuauca

SEQ ID NO: 91708 - RNA, 64 nt, Human
auggcugagccgccuggcugugcacacaugcagcacgacccagccuggccacacacuguggugc

SEQ ID NO: 91709 - RNA, 64 nt, Human
cucuggcuggccccaggagccuuugguucaguaaacgacccagggugguucccagcaaagcugc

SEQ ID NO: 91710 - RNA, 64 nt, Human
agcccccacaucccggaaaacccacuuuccuuucacgacccacaucucaauccugaacaucuag

SEQ ID NO: 91711 - RNA, 64 nt, Human
agcucucuuacccucccuuuacuccaccagcccgacgacccaugacugaggaggggauuucuac

SEQ ID NO: 91712 - RNA, 64 nt, Human
gaaggcagagugggauuugagacccagguuaggcacgacccaggcugagaagggacguuuccau

SEQ ID NO: 91713 - RNA, 64 nt, Human
gcgcucugggucccagaggggccggguggcucagacgacccaccacucccccacccugaccgug

SEQ ID NO: 91714 - RNA, 64 nt, Human
cacaggcaugacugggaucccguguaccgaguacacgacccagguauguaccaaguaggcaccc

SEQ ID NO: 91715 - RNA, 64 nt, Human
guaacaccccuucuugcugucucuuaguaaauaaacgacccaaagcagcuuccugcauuuucuc

SEQ ID NO: 91716 - RNA, 64 nt, Human
ugugcacuuacccccaucuuucucccucggggagacgacccaaggaauuucagaguauuuuguu

SEQ ID NO: 91717 - RNA, 64 nt, Human
uuguuguaguggguguucucagaucucuagcaucacgacccaucacucuaccucuaccagcgca

SEQ ID NO: 91718 - RNA, 64 nt, Human
gccugaggagggaggcucccgggaccguccacgcacgacccagccagacccucgcggagauggu

SEQ ID NO: 91719 - RNA, 64 nt, Human
ggaagauugggaauuagucuaaacaggaaauggugguacacagaggcuaggagaggcugggccc

SEQ ID NO: 91720 - RNA, 64 nt, Human
cucucuuuggccugagguucuguauucugggaaagguacacaggguggaguagggagaagcugc

SEQ ID NO: 91721 - RNA, 64 nt, Human
cagguuaggauuauacuugaaugauggauaaggggguacacagaccaagucccuauaaacaagg

SEQ ID NO: 91722 - RNA, 64 nt, Human
ggggucucugugaagagauccaaaaucauuucuagguacacagugugucagcuagaucuguuuc

SEQ ID NO: 91723 - RNA, 64 nt, Human
aaaauguuucuuauuuucagcacuuacaucauuugguacacagggucaaauagggcaaauaauu

SEQ ID NO: 91724 - RNA, 64 nt, Human
acugucucagccaacccgcuccacuacccggcaggguacacauucgcaccccuacuucacagag

SEQ ID NO: 91725 - RNA, 64 nt, Human
uuauuaaucaccucuaauacucauccacaugaaggguacacauuagguaagcugggcguugacu

SEQ ID NO: 91726 - RNA, 64 nt, Human
uaaugaagaaacuucuugcucagaggccuagaaggguacacaaaaugucuucuaaacuagaaaa

SEQ ID NO: 91727 - RNA, 64 nt, Human
ugugggggaagggugucgugcacuccuagagaaagguacacaguugcccgguugggaaugugcu

SEQ ID NO: 91728 - RNA, 64 nt, Human
agcauggcucucacagcacagggagaaaaacugagguacacagagguaccucagaagcucugga

SEQ ID NO: 91729 - RNA, 64 nt, Human
uggaacaggucucuaagcuagugguuuucaaacugguacacauuagacucacccgaggaauuuu

SEQ ID NO: 91730 - RNA, 64 nt, Human
ggcugaaugaucucuucccuagaguugauugucggguacacagugugaacccccgaagacggaa

SEQ ID NO: 91731 - RNA, 64 nt, Human
ucacccucugagugccaggagaugagaggcuggggguacacaaucagguuggaguccuguccuu

SEQ ID NO: 91732 - RNA, 64 nt, Human
gggaaggaaccagaagcagaggggccucuacgcagguacacacguguaccugaguguguucaug

SEQ ID NO: 91733 - RNA, 64 nt, Human
ccucuuguggccaggccuuccuuugcuggaggaagguacacagggugaagcugaugcuguacuu

SEQ ID NO: 91734 - RNA, 64 nt, Human
uguuuguguuugguuuauuuguuuagcuuuacaagguacacauaaguuagguugagggguuguu

SEQ ID NO: 91735 - RNA, 64 nt, Human
cagcagugcuguugagacuuuugaaaacaacuuugguacacaaaggcagcuuugugagcagagc

SEQ ID NO: 91736 - RNA, 64 nt, Human
cgugccuuagacuucucccgacccccagagcgcugguacacaggucuaggcaccacacagugcu

SEQ ID NO: 91737 - RNA, 64 nt, Human
caaauucccccaaagacaggagguguggcugauggguacacaugcuugguaagaguuucugcuu

SEQ ID NO: 91738 - RNA, 64 nt, Human
uagaggagaaaaaauguacagagagcacccaggagguacacauacuaaagugacacaaagagaa

SEQ ID NO: 91739 - RNA, 64 nt, Human
ugucaagguauuuuucuucccuucaugaacuuuagguacacauaacuuaugucauuuauuuaug

SEQ ID NO: 91740 - RNA, 64 nt, Human
agcucggggcugggggcugcagggcugggucagggguacacagagcuaaggccaaugggcuaga

SEQ ID NO: 91741 - RNA, 64 nt, Human
auauaccaccuaaaaucaauuuucuuguacaacugguacacacuaauaaacaaacaugugagau

SEQ ID NO: 91742 - RNA, 64 nt, Human
uuauaagaaagcacucuguggaucaacauaaguggguacacaagaauuuuuuuuuucuuggugu

SEQ ID NO: 91743 - RNA, 64 nt, Human
uccuuguugaggcagaacuaaguuuacagggaaagguacacacauucucucucucucucucucu

SEQ ID NO: 91744 - RNA, 64 nt, Human
uuuuuaccuaaccacacacuugcagaccuccugagguacacagaauagcugagcaguucacuuc

SEQ ID NO: 91745 - RNA, 64 nt, Human
agaggugggagaucaggcuguuccuuugcugccagguacacagggucucuuuuuuuuguuucuc

SEQ ID NO: 91746 - RNA, 64 nt, Human
agaucugccuuauaaacauuuaaaaccgguuugugguacacaaagaggaaccagugugggaagg

SEQ ID NO: 91747 - RNA, 64 nt, Human
gcugugacgcccucagguacuccugggaaaaggagguacacagccaucaugcgagucggugcca

SEQ ID NO: 91748 - RNA, 64 nt, Human
aauaacacauacccuaacuuagcuguguggacaugguacacauccagaagguaaagaaauacau

SEQ ID NO: 91749 - RNA, 64 nt, Human
auauaccacccaaaaucaauuuucuuguacaacugguacacacuaauaaacaauuaaacauaug

SEQ ID NO: 91750 - RNA, 64 nt, Human
ccauugguaauaaggaguagccccugugaggucagguacacaguaaagaggguaaauagaaucc

SEQ ID NO: 91751 - RNA, 64 nt, Human
gucccuaaaccugcaguuucuuccugcuggugcagguacacacacacacacacacacacacaca

SEQ ID NO: 91752 - RNA, 64 nt, Human
gugcaaguaaccacgggguccaucuuuuacaucugguacacacaacagacgcucaguuguucuu

SEQ ID NO: 91753 - RNA, 64 nt, Human
ugcucagagucccugcuaauguaauuggaagcuugguacacauaagaaaaacuagagauuugaa

SEQ ID NO: 91754 - RNA, 64 nt, Human
uaucuuuaaaauuuuuuauuuuaauagcuuuagggguacacacuuuuugcuuacaggggugaau

SEQ ID NO: 91755 - RNA, 64 nt, Human
auaacuuggugaaacugaaaaaguauaucauauggguacacaaggcuauuugccagcauauauu

SEQ ID NO: 91756 - RNA, 64 nt, Human
gggugagggaggcgaccugaucaggggagguggggguacacaucaauuugaguuguucaggcua

SEQ ID NO: 91757 - RNA, 64 nt, Human
aaauuacaucuuacuguugauauauguaugcucugguacacagaugucauuuuguugucacagc

SEQ ID NO: 91758 - RNA, 64 nt, Human
aaaacacuucgagcacuguccaguauucuaccgugguacacaguggcuacagacaccaaguucc

SEQ ID NO: 91759 - RNA, 64 nt, Human
gccagcaugcuaugggcuccugcgugaggccugugguacacagagauuagguugugauacauga

SEQ ID NO: 91760 - RNA, 64 nt, Human
gcaugucagagaccuuugagacauuacacaaccugguacacaaaggggucaagguggugaugga

SEQ ID NO: 91761 - RNA, 64 nt, Human
gacugucacauuuuaaaauguucccacuugagcagguacacaacuggucauaauuccugucugu

SEQ ID NO: 91762 - RNA, 64 nt, Human
uuaauggguuuuuuaaaaaucuguggagguugcugguacacaccaaaugaguccaaacuggaau

SEQ ID NO: 91763 - RNA, 64 nt, Human
uccuacuuccaaaccugucuuacuuugguuugaugguacacauagggcuuuugaacagucuauu

SEQ ID NO: 91764 - RNA, 64 nt, Human
cugagcccaguacaacaaaggugacggguguguagguacacacccagagauggagcacugcaga

SEQ ID NO: 91765 - RNA, 64 nt, Human
aguugugaaagaguugaagacagcuucccaugccgguacacagccaguagccuaaaucuccagu

SEQ ID NO: 91766 - RNA, 64 nt, Human
acccagggaguuagggggguacgggugaaagagggguacacagggacccagcccuucucuucuu

SEQ ID NO: 91767 - RNA, 64 nt, Human
cuggagugguccguucucaccacccuucagcuuggguacacacacagaggagaccucagccuca

SEQ ID NO: 91768 - RNA, 64 nt, Human
ugcucucauaaggucagccaaagccccuuaagaagguacacagcacaucugcagucauucagga

SEQ ID NO: 91769 - RNA, 64 nt, Human
uaacucugccgcauaaacuauaaaucuguaaggugguacacagcgugucuuguuagcaaaauuu

SEQ ID NO: 91770 - RNA, 64 nt, Human
acacucugcagacgaggaagccaugcugucagcagguacacaucuugccacaaaaccaguaacc

SEQ ID NO: 91771 - RNA, 64 nt, Human
aauucacaccugaagacaugcucucacauauagagguacacaaacacaccgucaugcacauuuc

SEQ ID NO: 91772 - RNA, 64 nt, Human
acuaccuagagucaacucuggccaggaacucuaagguacacacuuucauuuaguaauuaaauuu

SEQ ID NO: 91773 - RNA, 64 nt, Human
uauuauaauguucagauuucaagaggaaggugcagguacacaugaguuagagagcuggugagac

SEQ ID NO: 91774 - RNA, 64 nt, Human
agaagugacuuugauucugugauuauauugauuugguacacaguaaaugggaguuuaaaaaauc

SEQ ID NO: 91775 - RNA, 64 nt, Human
cagccugcuguucccaacugugcccagcugcacugguacacacgcucaucaggagaaucccuac

SEQ ID NO: 91776 - RNA, 64 nt, Human
acagaaggucaggucaggaacuggugcuguacuggguacacaguaggcgcccaggacaaguggg

SEQ ID NO: 91777 - RNA, 64 nt, Human
cucaaccugggagcaucuggcaggcaggggggcagguacacacacacccacaggcacacccacc

SEQ ID NO: 91778 - RNA, 64 nt, Human
gcccaaggcccccucggccuccugggcaacuugggguacacaggauacugggggugccgcuccu

SEQ ID NO: 91779 - RNA, 64 nt, Human
aauauguuuaucaacucaagaauuuaauauaguugguacacaacuaguuuuguuuauaaauugg

SEQ ID NO: 91780 - RNA, 64 nt, Human
aggcccucagggcagggauacaaagcggggagaggguacacaauggguaucuaauaaauacuua

SEQ ID NO: 91781 - RNA, 64 nt, Human
guugugacagagggaagcauggcuggggggaggggguacacagacagugcccaugacccagucc

SEQ ID NO: 91782 - RNA, 64 nt, Human
uuacuauaaauaaauucauaaaaguuaacaaagggguacacaguauggucuuuggaaauauaau

SEQ ID NO: 91783 - RNA, 64 nt, Human
auaaguugcaaauauuacuauuuuccuaaaccaggguacacaauuuaaguugccacuuauugau

SEQ ID NO: 91784 - RNA, 64 nt, Human
gcucuacccacuucacuauacuucucuuacuacagguacacagcccuuuuaucucugcuuuccu

SEQ ID NO: 91785 - RNA, 64 nt, Human
gguuacucuucgcuucugguaucuggcguucuuugguacacaguucugguguuccuaccaggac

SEQ ID NO: 91786 - RNA, 64 nt, Human
uggucauugcaagcucaucuauuaaguacuauaugguacacagucuaugagucauuagucuuca

SEQ ID NO: 91787 - RNA, 64 nt, Human
ugugugaaugauggugccagggaauccguggcuugguacacacuguuucauccaguggccacgu

SEQ ID NO: 91788 - RNA, 64 nt, Human
cugguuaucuaaugaggaacaaacacuaaccuaagguacacaucccaucugggcgguggcuuca

SEQ ID NO: 91789 - RNA, 64 nt, Human
guugccucugccuuugugauccugaguccagaaugguacacaaugugauuuuauggugauguca

SEQ ID NO: 91790 - RNA, 64 nt, Human
aacugucaaagaaucaauccagcgguucucaaacgguacacagacuauugacaucagcaucacc

SEQ ID NO: 91791 - RNA, 64 nt, Human
guuuguucuacaauguucuagaaauucucacucagguacacagugccaacaaguggcuugugaa

SEQ ID NO: 91792 - RNA, 64 nt, Human
aauccuggcccucuguguuggcccaagcucuugugguacacacagauuacugcccaauaugcag

SEQ ID NO: 91793 - RNA, 64 nt, Human
cugucucaguaacuauuuggccaugugcucccuggguacacaaguuuucagaucuacugauaga

SEQ ID NO: 91794 - RNA, 64 nt, Human
ucucagcuacuuggcucccacagaacccaaggcagguacacaaaggaccuuagaugagaucugg

SEQ ID NO: 91795 - RNA, 64 nt, Human
aacaguacacucaaaacauccuugacuguccccugguacacauaugcaagagacuuuaugcgua

SEQ ID NO: 91796 - RNA, 64 nt, Human
uuaaaaauagauuugaaacauuuauauauagagagguacacauuuauuuacuguuuagguacug

SEQ ID NO: 91797 - RNA, 64 nt, Human
cauuucaugcccucuaaggcaguuuuuaaaugaagguacacacauccagggguguucacaggcu

SEQ ID NO: 91798 - RNA, 64 nt, Human
aacuuaaaugaacacagcucuuuaacaugguucagguacacauauuuugacccaaguggauauu

SEQ ID NO: 91799 - RNA, 64 nt, Human
ugugaguuucacugcauuguauauuuuuucauuugguacacaaagaauguauucuucauagguu

SEQ ID NO: 91800 - RNA, 64 nt, Human
aggcaaaacaaaggcagcaggagauaaugugauugguacacaaaagcuaaagcaguggcugggg

SEQ ID NO: 91801 - RNA, 64 nt, Human
ugucaccucuguuccccagccccuuggaugugaugguacacagugggugggcccccauaauaag

SEQ ID NO: 91802 - RNA, 64 nt, Human
acucuacuccuaacugacuucaauauuucagcaggguacacaggcguuuccaaguuucagugac

SEQ ID NO: 91803 - RNA, 64 nt, Human
agauuguaauauuuaaggucgaauuucgaccugugguacacagcugugcuguggcucagucagc

SEQ ID NO: 91804 - RNA, 64 nt, Human
aaguguugcucagagugaagagugaagagcauuugguacacacuugaccuucugucguccccag

SEQ ID NO: 91805 - RNA, 64 nt, Human
auaccagcagcaacugaaaaugaaugccgaauuugguacacauguguuaucuaccucaagguaa

SEQ ID NO: 91806 - RNA, 64 nt, Human
agauaacgauuagaguggggaaccgucaaagcuggguacacauuuccuaucuuccuccagcuuc

SEQ ID NO: 91807 - RNA, 64 nt, Human
uucgaauuccagugucuauaaauaaaguuuuauugguacacagccacauccauuuguucaaguu

SEQ ID NO: 91808 - RNA, 64 nt, Human
uauugagaacacuacacagugcugaaguccagcugguacacaccggggugacaccuuggcugca

SEQ ID NO: 91809 - RNA, 64 nt, Human
ccccacgugcacuccccggccugcauccggcuuggguacacaggcccagaggacuggggugacu

SEQ ID NO: 91810 - RNA, 64 nt, Human
cuauacaagaauuuaaaaauaagcugggcguggugguacacaccuguggucccagcuacuaggg

SEQ ID NO: 91811 - RNA, 64 nt, Human
acacucacauucucagaggauccagggaggcccagguacacacaggccauggcagacaccccau

SEQ ID NO: 91812 - RNA, 64 nt, Human
guugcuggaaugaaguagaggugacucucucugugguacacauugaauguacuauguauguuca

SEQ ID NO: 91813 - RNA, 64 nt, Human
ugcaaugcagaauuaacagaccucuucuccucaugguacacaguauuacaguguugaaguaaug

SEQ ID NO: 91814 - RNA, 64 nt, Human
cacccucuauucuguuucuuccuccucacauggggguacacauacacagcuuccucuuuugguu

SEQ ID NO: 91815 - RNA, 64 nt, Human
ucuccucccacccccauaggaucaguguguaccagguacacauuguuccuguuaacagcagcuu

SEQ ID NO: 91816 - RNA, 64 nt, Human
aguaauccuacuucauuaagccuuccuggggugcgguacacaccguuaauucagcaacccucag

SEQ ID NO: 91817 - RNA, 64 nt, Human
ggguggccacaccucuaucccggcuuuggugcgggguacacaagaggggaugaguugugugaau

SEQ ID NO: 91818 - RNA, 64 nt, Human
cagcaggcagcauauguugaaauaaguuauuacugguacacaccugcauugccucaccagugua

SEQ ID NO: 91819 - RNA, 64 nt, Human
aaagcguacaaaagauacuuaaaagggcuccugggguacacaagcccagcagguccugagugaa

SEQ ID NO: 91820 - RNA, 64 nt, Human
ugauaaaccccaauuuucaccccggggggggugggguacacagacacaggguggggguggggag

SEQ ID NO: 91821 - RNA, 64 nt, Human
uaagaaaacaagaaaacaaaggcagcagacuauugguacacauuauaguccaaagugcuuagcg

SEQ ID NO: 91822 - RNA, 64 nt, Human
aggaagugucugauuccagucugccuaguacguugguacacacguggcauugccgcagcaccug

SEQ ID NO: 91823 - RNA, 64 nt, Human
ucguuuugagccuacagaauauccuucccagugagguacacauuaucuccauuucaaacauauu

SEQ ID NO: 91824 - RNA, 64 nt, Human
aguuuggcaauuucaauggcauauuuuuagucaagguacacagauggcagugccauaagcaagu

SEQ ID NO: 91825 - RNA, 64 nt, Human
ccaguuguagcagguuucacuauuccuaugcugggguacacagugagaguacucacuuuucacu

SEQ ID NO: 91826 - RNA, 64 nt, Human
gugcguucauggagaagaucacuugaggccauuugguacacaucucuggaggcugagucgguuc

SEQ ID NO: 91827 - RNA, 64 nt, Human
uucauuaacuuacuugcugccuuuuuuuuuucuugguacacauuuaaauaaaguaauccuuaac

SEQ ID NO: 91828 - RNA, 64 nt, Human
auuucauuuccuccccauacaaauuugaugagcagguacacacuuucuuuaaaacauuccaagu

SEQ ID NO: 91829 - RNA, 64 nt, Human
cuggcacgggggagggcuggggcuuucucugccugguacacacggaaaggcggcugugcggacg

SEQ ID NO: 91830 - RNA, 64 nt, Human
ccauuuccucuuaugaaacaccgucugagcccaagguacacauugggcggccugcaggaaccug

SEQ ID NO: 91831 - RNA, 64 nt, Human
uuccagaacaccagguguggccaccuggggcucagguacacaguggggucucucggaagccacc

SEQ ID NO: 91832 - RNA, 64 nt, Human
cugggggagcgggccucuagcuucagccagggcggguacacacccugggcacaggguccucagc

SEQ ID NO: 91833 - RNA, 64 nt, Human
cuaucucauagggaugcugugagcauuaaauaaagguacacauggaaaacaccaguccuggugc

SEQ ID NO: 91834 - RNA, 64 nt, Human
gcugcugcucaggugccaugcccugaagaggcaggguacacauggggcugggagggcaaagaug

SEQ ID NO: 91835 - RNA, 64 nt, Human
uuuguguagcuuugcucuuugguagaaaaggcuagguacacagcucuagacacugccacacagg

SEQ ID NO: 91836 - RNA, 64 nt, Human
uccuuccuucuugcuucuaauagaccugguacaugguacacacacccccaccuccugcaauuaa

SEQ ID NO: 91837 - RNA, 64 nt, Human
uccuuccuucuugcuucuaauagcccugguacaugguacacacccccccaccuccugcaauuaa

SEQ ID NO: 91838 - RNA, 64 nt, Human
cuccuuccuuuugcuucucauagcccugguacaugguacacacacccccaccuccugcaauuaa

SEQ ID NO: 91839 - RNA, 64 nt, Human
accugugaagcccaggaggugguguuggcugcaggguacacaaauacugagugguggucuuuug

SEQ ID NO: 91840 - RNA, 64 nt, Human
cagcucuccuugggggcuggcccagcugacugaggguacacaggauugggucuagaccuugaug

SEQ ID NO: 91841 - RNA, 64 nt, Human
ugugacaaccuuuucaauaagcagaaauaacguagguacacaucacucuuuacauuuuucuaag

SEQ ID NO: 91842 - RNA, 64 nt, Human
uccugcugcugaccagcugcuccugguacacggggguacacaccuguaucccuccgugaauaag

SEQ ID NO: 91843 - RNA, 64 nt, Human
auaaacuuuauagaaguacaguauuaaagucagugguacacagacauucuguacauauccugug

SEQ ID NO: 91844 - RNA, 64 nt, Human
cucccaccccacucccugcucaguaccuggcguugguacacaggcaaggauuggcacaaccaaa

SEQ ID NO: 91845 - RNA, 64 nt, Human
guggugugacuaauuccuuaccucucccaaggaggguacacaacuagcaccauucuugaugucc

SEQ ID NO: 91846 - RNA, 64 nt, Human
acuacuguaggcuuuauaaacacagcacacuuaggguacacaaaaugcauauuaaaacauuuuc

SEQ ID NO: 91847 - RNA, 64 nt, Human
uuagacaagaaagcauaauauagcucuacucauggguacacauaccaguguauaagauuuuuag

SEQ ID NO: 91848 - RNA, 64 nt, Human
ggcugucuuaaacaucacugccgucuugaagcaggguacacacguuagguauugugaagaacau

SEQ ID NO: 91849 - RNA, 64 nt, Human
uuugugcucagugugugccaagcacugugcagaggguacacaguuccugccagguuaacacccu

SEQ ID NO: 91850 - RNA, 64 nt, Human
auuaaauuuauuaagaaaauagaugaaaaauuaggguacacagcuggccaccaaaugcgaaguc

SEQ ID NO: 91851 - RNA, 64 nt, Human; identical to SEQ ID NO: 76682

SEQ ID NO: 91852 - RNA, 64 nt, Human; identical to SEQ ID NO: 76683

SEQ ID NO: 91853 - RNA, 64 nt, Human; identical to SEQ ID NO: 76684

SEQ ID NO: 91854 - RNA, 64 nt, Human; identical to SEQ ID NO: 76685

SEQ ID NO: 91855 - RNA, 64 nt, Human; identical to SEQ ID NO: 76686

SEQ ID NO: 91856 - RNA, 64 nt, Human; identical to SEQ ID NO: 76687

SEQ ID NO: 91857 - RNA, 64 nt, Human; identical to SEQ ID NO: 76688

SEQ ID NO: 91858 - RNA, 64 nt, Human; identical to SEQ ID NO: 76689

SEQ ID NO: 91859 - RNA, 64 nt, Human; identical to SEQ ID NO: 76690

SEQ ID NO: 91860 - RNA, 64 nt, Human; identical to SEQ ID NO: 76691

SEQ ID NO: 91861 - RNA, 64 nt, Human; identical to SEQ ID NO: 76692

SEQ ID NO: 91862 - RNA, 64 nt, Human; identical to SEQ ID NO: 76693

SEQ ID NO: 91863 - RNA, 64 nt, Human; identical to SEQ ID NO: 76694

SEQ ID NO: 91864 - RNA, 62 nt, Human; identical to SEQ ID NO: 76695

SEQ ID NO: 91865 - RNA, 64 nt, Human; identical to SEQ ID NO: 76696

SEQ ID NO: 91866 - RNA, 64 nt, Human; identical to SEQ ID NO: 76697

SEQ ID NO: 91867 - RNA, 64 nt, Human; identical to SEQ ID NO: 76698

SEQ ID NO: 91868 - RNA, 64 nt, Human; identical to SEQ ID NO: 76699

SEQ ID NO: 91869 - RNA, 64 nt, Human; identical to SEQ ID NO: 76700

SEQ ID NO: 91870 - RNA, 64 nt, Human; identical to SEQ ID NO: 76701

SEQ ID NO: 91871 - RNA, 64 nt, Human; identical to SEQ ID NO: 76702

SEQ ID NO: 91872 - RNA, 64 nt, Human; identical to SEQ ID NO: 76703

SEQ ID NO: 91873 - RNA, 64 nt, Human; identical to SEQ ID NO: 76704

SEQ ID NO: 91874 - RNA, 64 nt, Human; identical to SEQ ID NO: 76705

SEQ ID NO: 91875 - RNA, 64 nt, Human; identical to SEQ ID NO: 76706

SEQ ID NO: 91876 - RNA, 64 nt, Human; identical to SEQ ID NO: 76707

SEQ ID NO: 91877 - RNA, 64 nt, Human; identical to SEQ ID NO: 76708

SEQ ID NO: 91878 - RNA, 64 nt, Human; identical to SEQ ID NO: 76709

SEQ ID NO: 91879 - RNA, 64 nt, Human; identical to SEQ ID NO: 76710

SEQ ID NO: 91880 - RNA, 64 nt, Human; identical to SEQ ID NO: 76711

SEQ ID NO: 91881 - RNA, 64 nt, Human; identical to SEQ ID NO: 76712

SEQ ID NO: 91882 - RNA, 64 nt, Human; identical to SEQ ID NO: 76713

SEQ ID NO: 91883 - RNA, 64 nt, Human; identical to SEQ ID NO: 76714

SEQ ID NO: 91884 - RNA, 64 nt, Human; identical to SEQ ID NO: 76715

SEQ ID NO: 91885 - RNA, 64 nt, Human; identical to SEQ ID NO: 76716

SEQ ID NO: 91886 - RNA, 64 nt, Human; identical to SEQ ID NO: 76717

SEQ ID NO: 91887 - RNA, 64 nt, Human; identical to SEQ ID NO: 76718

SEQ ID NO: 91888 - RNA, 64 nt, Human; identical to SEQ ID NO: 76719

SEQ ID NO: 91889 - RNA, 64 nt, Human; identical to SEQ ID NO: 76720

SEQ ID NO: 91890 - RNA, 64 nt, Human; identical to SEQ ID NO: 76721

SEQ ID NO: 91891 - RNA, 64 nt, Human; identical to SEQ ID NO: 76722

SEQ ID NO: 91892 - RNA, 64 nt, Human; identical to SEQ ID NO: 76723

SEQ ID NO: 91893 - RNA, 64 nt, Human; identical to SEQ ID NO: 76724

SEQ ID NO: 91894 - RNA, 64 nt, Human; identical to SEQ ID NO: 76725

SEQ ID NO: 91895 - RNA, 64 nt, Human; identical to SEQ ID NO: 76726

SEQ ID NO: 91896 - RNA, 64 nt, Human; identical to SEQ ID NO: 76727

SEQ ID NO: 91897 - RNA, 64 nt, Human; identical to SEQ ID NO: 76728

SEQ ID NO: 91898 - RNA, 64 nt, Human; identical to SEQ ID NO: 76729

SEQ ID NO: 91899 - RNA, 64 nt, Human; identical to SEQ ID NO: 76730

SEQ ID NO: 91900 - RNA, 64 nt, Human; identical to SEQ ID NO: 76731

SEQ ID NO: 91901 - RNA, 50 nt, Human; identical to SEQ ID NO: 76732

SEQ ID NO: 91902 - RNA, 64 nt, Human; identical to SEQ ID NO: 76733

SEQ ID NO: 91903 - RNA, 64 nt, Human; identical to SEQ ID NO: 76734

SEQ ID NO: 91904 - RNA, 64 nt, Human; identical to SEQ ID NO: 76735

SEQ ID NO: 91905 - RNA, 64 nt, Human; identical to SEQ ID NO: 76736

SEQ ID NO: 91906 - RNA, 64 nt, Human; identical to SEQ ID NO: 76737

SEQ ID NO: 91907 - RNA, 64 nt, Human; identical to SEQ ID NO: 76738

SEQ ID NO: 91908 - RNA, 64 nt, Human; identical to SEQ ID NO: 76739

SEQ ID NO: 91909 - RNA, 64 nt, Human; identical to SEQ ID NO: 76740

SEQ ID NO: 91910 - RNA, 64 nt, Human; identical to SEQ ID NO: 76741

SEQ ID NO: 91911 - RNA, 64 nt, Human; identical to SEQ ID NO: 76742

SEQ ID NO: 91912 - RNA, 64 nt, Human; identical to SEQ ID NO: 76743

SEQ ID NO: 91913 - RNA, 64 nt, Human; identical to SEQ ID NO: 76744

SEQ ID NO: 91914 - RNA, 64 nt, Human; identical to SEQ ID NO: 76745

SEQ ID NO: 91915 - RNA, 64 nt, Human; identical to SEQ ID NO: 76746

SEQ ID NO: 91916 - RNA, 64 nt, Human; identical to SEQ ID NO: 76747

SEQ ID NO: 91917 - RNA, 64 nt, Human; identical to SEQ ID NO: 76748

SEQ ID NO: 91918 - RNA, 64 nt, Human; identical to SEQ ID NO: 76749

SEQ ID NO: 91919 - RNA, 64 nt, Human; identical to SEQ ID NO: 76750

SEQ ID NO: 91920 - RNA, 64 nt, Human; identical to SEQ ID NO: 76751

SEQ ID NO: 91921 - RNA, 64 nt, Human; identical to SEQ ID NO: 76752

SEQ ID NO: 91922 - RNA, 64 nt, Human; identical to SEQ ID NO: 76753

SEQ ID NO: 91923 - RNA, 64 nt, Human; identical to SEQ ID NO: 76754

SEQ ID NO: 91924 - RNA, 64 nt, Human; identical to SEQ ID NO: 76755

SEQ ID NO: 91925 - RNA, 64 nt, Human; identical to SEQ ID NO: 76756

SEQ ID NO: 91926 - RNA, 63 nt, Human; identical to SEQ ID NO: 76757

SEQ ID NO: 91927 - RNA, 64 nt, Human; identical to SEQ ID NO: 76758

SEQ ID NO: 91928 - RNA, 64 nt, Human; identical to SEQ ID NO: 76759

SEQ ID NO: 91929 - RNA, 64 nt, Human; identical to SEQ ID NO: 76760

SEQ ID NO: 91930 - RNA, 64 nt, Human; identical to SEQ ID NO: 76761

SEQ ID NO: 91931 - RNA, 64 nt, Human; identical to SEQ ID NO: 76762

SEQ ID NO: 91932 - RNA, 64 nt, Human; identical to SEQ ID NO: 76763

SEQ ID NO: 91933 - RNA, 64 nt, Human; identical to SEQ ID NO: 76764

SEQ ID NO: 91934 - RNA, 64 nt, Human; identical to SEQ ID NO: 76765

SEQ ID NO: 91935 - RNA, 64 nt, Human; identical to SEQ ID NO: 76766

SEQ ID NO: 91936 - RNA, 64 nt, Human; identical to SEQ ID NO: 76767

SEQ ID NO: 91937 - RNA, 64 nt, Human; identical to SEQ ID NO: 76768

SEQ ID NO: 91938 - RNA, 64 nt, Human; identical to SEQ ID NO: 76769

SEQ ID NO: 91939 - RNA, 64 nt, Human; identical to SEQ ID NO: 76770

SEQ ID NO: 91940 - RNA, 64 nt, Human; identical to SEQ ID NO: 76771

SEQ ID NO: 91941 - RNA, 64 nt, Human; identical to SEQ ID NO: 76772

SEQ ID NO: 91942 - RNA, 64 nt, Human; identical to SEQ ID NO: 76773

SEQ ID NO: 91943 - RNA, 64 nt, Human; identical to SEQ ID NO: 76774

SEQ ID NO: 91944 - RNA, 64 nt, Human; identical to SEQ ID NO: 76775

SEQ ID NO: 91945 - RNA, 64 nt, Human; identical to SEQ ID NO: 76776

SEQ ID NO: 91946 - RNA, 64 nt, Human; identical to SEQ ID NO: 76777

SEQ ID NO: 91947 - RNA, 64 nt, Human; identical to SEQ ID NO: 76778

SEQ ID NO: 91948 - RNA, 64 nt, Human; identical to SEQ ID NO: 76779

SEQ ID NO: 91949 - RNA, 64 nt, Human; identical to SEQ ID NO: 76780

SEQ ID NO: 91950 - RNA, 64 nt, Human; identical to SEQ ID NO: 76781

SEQ ID NO: 91951 - RNA, 64 nt, Human; identical to SEQ ID NO: 76782

SEQ ID NO: 91952 - RNA, 64 nt, Human; identical to SEQ ID NO: 76783

SEQ ID NO: 91953 - RNA, 64 nt, Human; identical to SEQ ID NO: 76784

SEQ ID NO: 91954 - RNA, 64 nt, Human; identical to SEQ ID NO: 76785

SEQ ID NO: 91955 - RNA, 64 nt, Human; identical to SEQ ID NO: 76786

SEQ ID NO: 91956 - RNA, 64 nt, Human; identical to SEQ ID NO: 76787

SEQ ID NO: 91957 - RNA, 64 nt, Human; identical to SEQ ID NO: 76788

SEQ ID NO: 91958 - RNA, 64 nt, Human; identical to SEQ ID NO: 76789

SEQ ID NO: 91959 - RNA, 64 nt, Human; identical to SEQ ID NO: 76790

SEQ ID NO: 91960 - RNA, 64 nt, Human; identical to SEQ ID NO: 76791

SEQ ID NO: 91961 - RNA, 64 nt, Human; identical to SEQ ID NO: 76792

SEQ ID NO: 91962 - RNA, 57 nt, Human; identical to SEQ ID NO: 76793

SEQ ID NO: 91963 - RNA, 64 nt, Human; identical to SEQ ID NO: 76794

SEQ ID NO: 91964 - RNA, 64 nt, Human; identical to SEQ ID NO: 76795

SEQ ID NO: 91965 - RNA, 64 nt, Human; identical to SEQ ID NO: 76796

SEQ ID NO: 91966 - RNA, 64 nt, Human; identical to SEQ ID NO: 76797

SEQ ID NO: 91967 - RNA, 64 nt, Human; identical to SEQ ID NO: 76798

SEQ ID NO: 91968 - RNA, 64 nt, Human; identical to SEQ ID NO: 76799

SEQ ID NO: 91969 - RNA, 64 nt, Human; identical to SEQ ID NO: 76800

SEQ ID NO: 91970 - RNA, 64 nt, Human; identical to SEQ ID NO: 76801

SEQ ID NO: 91971 - RNA, 64 nt, Human; identical to SEQ ID NO: 76802

SEQ ID NO: 91972 - RNA, 64 nt, Human; identical to SEQ ID NO: 76803

SEQ ID NO: 91973 - RNA, 64 nt, Human; identical to SEQ ID NO: 76804

SEQ ID NO: 91974 - RNA, 64 nt, Human; identical to SEQ ID NO: 76805

SEQ ID NO: 91975 - RNA, 64 nt, Human; identical to SEQ ID NO: 76806

SEQ ID NO: 91976 - RNA, 64 nt, Human; identical to SEQ ID NO: 76807

SEQ ID NO: 91977 - RNA, 64 nt, Human; identical to SEQ ID NO: 76808

SEQ ID NO: 91978 - RNA, 64 nt, Human; identical to SEQ ID NO: 76809

SEQ ID NO: 91979 - RNA, 64 nt, Human; identical to SEQ ID NO: 76810

SEQ ID NO: 91980 - RNA, 64 nt, Human; identical to SEQ ID NO: 76811

SEQ ID NO: 91981 - RNA, 64 nt, Human; identical to SEQ ID NO: 76812

SEQ ID NO: 91982 - RNA, 64 nt, Human; identical to SEQ ID NO: 76813

SEQ ID NO: 91983 - RNA, 64 nt, Human; identical to SEQ ID NO: 76814

SEQ ID NO: 91984 - RNA, 64 nt, Human; identical to SEQ ID NO: 76815

SEQ ID NO: 91985 - RNA, 64 nt, Human; identical to SEQ ID NO: 76816

SEQ ID NO: 91986 - RNA, 64 nt, Human; identical to SEQ ID NO: 76817

SEQ ID NO: 91987 - RNA, 64 nt, Human; identical to SEQ ID NO: 76818

SEQ ID NO: 91988 - RNA, 64 nt, Human; identical to SEQ ID NO: 76819

SEQ ID NO: 91989 - RNA, 64 nt, Human; identical to SEQ ID NO: 76820

SEQ ID NO: 91990 - RNA, 62 nt, Human; identical to SEQ ID NO: 76821

SEQ ID NO: 91991 - RNA, 64 nt, Human; identical to SEQ ID NO: 76822

SEQ ID NO: 91992 - RNA, 64 nt, Human; identical to SEQ ID NO: 76823

SEQ ID NO: 91993 - RNA, 59 nt, Human; identical to SEQ ID NO: 76824

SEQ ID NO: 91994 - RNA, 64 nt, Human; identical to SEQ ID NO: 76825

SEQ ID NO: 91995 - RNA, 64 nt, Human; identical to SEQ ID NO: 76826

SEQ ID NO: 91996 - RNA, 64 nt, Human; identical to SEQ ID NO: 76827

SEQ ID NO: 91997 - RNA, 64 nt, Human; identical to SEQ ID NO: 76828

SEQ ID NO: 91998 - RNA, 64 nt, Human; identical to SEQ ID NO: 76829

SEQ ID NO: 91999 - RNA, 64 nt, Human; identical to SEQ ID NO: 76830

SEQ ID NO: 92000 - RNA, 64 nt, Human; identical to SEQ ID NO: 76831

SEQ ID NO: 92001 - RNA, 61 nt, Human; identical to SEQ ID NO: 76832

SEQ ID NO: 92002 - RNA, 64 nt, Human; identical to SEQ ID NO: 76833

SEQ ID NO: 92003 - RNA, 64 nt, Human; identical to SEQ ID NO: 76834

SEQ ID NO: 92004 - RNA, 64 nt, Human; identical to SEQ ID NO: 76835

SEQ ID NO: 92005 - RNA, 64 nt, Human; identical to SEQ ID NO: 76836

SEQ ID NO: 92006 - RNA, 64 nt, Human; identical to SEQ ID NO: 76837

SEQ ID NO: 92007 - RNA, 64 nt, Human; identical to SEQ ID NO: 76838

SEQ ID NO: 92008 - RNA, 64 nt, Human; identical to SEQ ID NO: 76839

SEQ ID NO: 92009 - RNA, 64 nt, Human; identical to SEQ ID NO: 76840

SEQ ID NO: 92010 - RNA, 64 nt, Human; identical to SEQ ID NO: 76841

SEQ ID NO: 92011 - RNA, 64 nt, Human; identical to SEQ ID NO: 76842

SEQ ID NO: 92012 - RNA, 64 nt, Human; identical to SEQ ID NO: 76843

SEQ ID NO: 92013 - RNA, 64 nt, Human; identical to SEQ ID NO: 76844

SEQ ID NO: 92014 - RNA, 64 nt, Human; identical to SEQ ID NO: 76845

SEQ ID NO: 92015 - RNA, 64 nt, Human; identical to SEQ ID NO: 76846

SEQ ID NO: 92016 - RNA, 64 nt, Human; identical to SEQ ID NO: 76847

SEQ ID NO: 92017 - RNA, 64 nt, Human; identical to SEQ ID NO: 76848

SEQ ID NO: 92018 - RNA, 64 nt, Human; identical to SEQ ID NO: 76849

SEQ ID NO: 92019 - RNA, 64 nt, Human; identical to SEQ ID NO: 76850

SEQ ID NO: 92020 - RNA, 64 nt, Human; identical to SEQ ID NO: 76851

SEQ ID NO: 92021 - RNA, 64 nt, Human; identical to SEQ ID NO: 76852

SEQ ID NO: 92022 - RNA, 64 nt, Human; identical to SEQ ID NO: 76853

SEQ ID NO: 92023 - RNA, 64 nt, Human; identical to SEQ ID NO: 76854

SEQ ID NO: 92024 - RNA, 64 nt, Human; identical to SEQ ID NO: 76855

SEQ ID NO: 92025 - RNA, 64 nt, Human; identical to SEQ ID NO: 76856

SEQ ID NO: 92026 - RNA, 64 nt, Human; identical to SEQ ID NO: 76857

SEQ ID NO: 92027 - RNA, 64 nt, Human; identical to SEQ ID NO: 76858

SEQ ID NO: 92028 - RNA, 64 nt, Human; identical to SEQ ID NO: 76859

SEQ ID NO: 92029 - RNA, 64 nt, Human; identical to SEQ ID NO: 76860

SEQ ID NO: 92030 - RNA, 64 nt, Human; identical to SEQ ID NO: 76861

SEQ ID NO: 92031 - RNA, 64 nt, Human; identical to SEQ ID NO: 76862

SEQ ID NO: 92032 - RNA, 64 nt, Human; identical to SEQ ID NO: 76863

SEQ ID NO: 92033 - RNA, 64 nt, Human; identical to SEQ ID NO: 76864

SEQ ID NO: 92034 - RNA, 64 nt, Human; identical to SEQ ID NO: 76865

SEQ ID NO: 92035 - RNA, 64 nt, Human; identical to SEQ ID NO: 76866

SEQ ID NO: 92036 - RNA, 64 nt, Human; identical to SEQ ID NO: 76867

SEQ ID NO: 92037 - RNA, 64 nt, Human; identical to SEQ ID NO: 76868

SEQ ID NO: 92038 - RNA, 64 nt, Human; identical to SEQ ID NO: 76869

SEQ ID NO: 92039 - RNA, 64 nt, Human; identical to SEQ ID NO: 76870

SEQ ID NO: 92040 - RNA, 64 nt, Human; identical to SEQ ID NO: 76871

SEQ ID NO: 92041 - RNA, 64 nt, Human; identical to SEQ ID NO: 76872

SEQ ID NO: 92042 - RNA, 64 nt, Human; identical to SEQ ID NO: 76873

SEQ ID NO: 92043 - RNA, 64 nt, Human; identical to SEQ ID NO: 76874

SEQ ID NO: 92044 - RNA, 64 nt, Human; identical to SEQ ID NO: 76875

SEQ ID NO: 92045 - RNA, 64 nt, Human; identical to SEQ ID NO: 76876

SEQ ID NO: 92046 - RNA, 64 nt, Human; identical to SEQ ID NO: 76877

SEQ ID NO: 92047 - RNA, 64 nt, Human; identical to SEQ ID NO: 76878

SEQ ID NO: 92048 - RNA, 64 nt, Human; identical to SEQ ID NO: 76879

SEQ ID NO: 92049 - RNA, 64 nt, Human; identical to SEQ ID NO: 76880

SEQ ID NO: 92050 - RNA, 64 nt, Human; identical to SEQ ID NO: 76881

SEQ ID NO: 92051 - RNA, 64 nt, Human; identical to SEQ ID NO: 76882

SEQ ID NO: 92052 - RNA, 64 nt, Human; identical to SEQ ID NO: 76883

SEQ ID NO: 92053 - RNA, 64 nt, Human; identical to SEQ ID NO: 76884

SEQ ID NO: 92054 - RNA, 64 nt, Human; identical to SEQ ID NO: 76885

SEQ ID NO: 92055 - RNA, 64 nt, Human; identical to SEQ ID NO: 76886

SEQ ID NO: 92056 - RNA, 64 nt, Human; identical to SEQ ID NO: 76887

SEQ ID NO: 92057 - RNA, 64 nt, Human; identical to SEQ ID NO: 76888

SEQ ID NO: 92058 - RNA, 64 nt, Human; identical to SEQ ID NO: 76889

SEQ ID NO: 92059 - RNA, 64 nt, Human; identical to SEQ ID NO: 76890

SEQ ID NO: 92060 - RNA, 64 nt, Human; identical to SEQ ID NO: 76891

SEQ ID NO: 92061 - RNA, 64 nt, Human; identical to SEQ ID NO: 76892

SEQ ID NO: 92062 - RNA, 64 nt, Human; identical to SEQ ID NO: 76893

SEQ ID NO: 92063 - RNA, 64 nt, Human; identical to SEQ ID NO: 76894

SEQ ID NO: 92064 - RNA, 64 nt, Human; identical to SEQ ID NO: 76895

SEQ ID NO: 92065 - RNA, 64 nt, Human; identical to SEQ ID NO: 76896

SEQ ID NO: 92066 - RNA, 64 nt, Human; identical to SEQ ID NO: 76897

SEQ ID NO: 92067 - RNA, 64 nt, Human; identical to SEQ ID NO: 76898

SEQ ID NO: 92068 - RNA, 64 nt, Human; identical to SEQ ID NO: 76899

SEQ ID NO: 92069 - RNA, 64 nt, Human; identical to SEQ ID NO: 76900

SEQ ID NO: 92070 - RNA, 64 nt, Human; identical to SEQ ID NO: 76901

SEQ ID NO: 92071 - RNA, 64 nt, Human; identical to SEQ ID NO: 76902

SEQ ID NO: 92072 - RNA, 64 nt, Human; identical to SEQ ID NO: 76903

SEQ ID NO: 92073 - RNA, 64 nt, Human; identical to SEQ ID NO: 76904

SEQ ID NO: 92074 - RNA, 64 nt, Human; identical to SEQ ID NO: 76905

SEQ ID NO: 92075 - RNA, 64 nt, Human; identical to SEQ ID NO: 76906

SEQ ID NO: 92076 - RNA, 64 nt, Human; identical to SEQ ID NO: 76907

SEQ ID NO: 92077 - RNA, 64 nt, Human; identical to SEQ ID NO: 76908

SEQ ID NO: 92078 - RNA, 54 nt, Human; identical to SEQ ID NO: 76909

SEQ ID NO: 92079 - RNA, 64 nt, Human; identical to SEQ ID NO: 76910

SEQ ID NO: 92080 - RNA, 64 nt, Human; identical to SEQ ID NO: 76911

SEQ ID NO: 92081 - RNA, 64 nt, Human; identical to SEQ ID NO: 76912

SEQ ID NO: 92082 - RNA, 64 nt, Human; identical to SEQ ID NO: 76913

SEQ ID NO: 92083 - RNA, 64 nt, Human; identical to SEQ ID NO: 76914

SEQ ID NO: 92084 - RNA, 64 nt, Human; identical to SEQ ID NO: 76915

SEQ ID NO: 92085 - RNA, 64 nt, Human; identical to SEQ ID NO: 76916

SEQ ID NO: 92086 - RNA, 64 nt, Human; identical to SEQ ID NO: 76917

SEQ ID NO: 92087 - RNA, 64 nt, Human; identical to SEQ ID NO: 76918

SEQ ID NO: 92088 - RNA, 64 nt, Human; identical to SEQ ID NO: 76919

SEQ ID NO: 92089 - RNA, 64 nt, Human; identical to SEQ ID NO: 76920

SEQ ID NO: 92090 - RNA, 64 nt, Human; identical to SEQ ID NO: 76921

SEQ ID NO: 92091 - RNA, 64 nt, Human; identical to SEQ ID NO: 76922

SEQ ID NO: 92092 - RNA, 64 nt, Human; identical to SEQ ID NO: 76923

SEQ ID NO: 92093 - RNA, 64 nt, Human; identical to SEQ ID NO: 76924

SEQ ID NO: 92094 - RNA, 64 nt, Human; identical to SEQ ID NO: 76925

SEQ ID NO: 92095 - RNA, 64 nt, Human; identical to SEQ ID NO: 76926

SEQ ID NO: 92096 - RNA, 64 nt, Human; identical to SEQ ID NO: 76927

SEQ ID NO: 92097 - RNA, 64 nt, Human; identical to SEQ ID NO: 76928

SEQ ID NO: 92098 - RNA, 64 nt, Human; identical to SEQ ID NO: 76929

SEQ ID NO: 92099 - RNA, 64 nt, Human; identical to SEQ ID NO: 76930

SEQ ID NO: 92100 - RNA, 64 nt, Human; identical to SEQ ID NO: 76931

SEQ ID NO: 92101 - RNA, 64 nt, Human; identical to SEQ ID NO: 76932

SEQ ID NO: 92102 - RNA, 64 nt, Human; identical to SEQ ID NO: 76933

SEQ ID NO: 92103 - RNA, 64 nt, Human; identical to SEQ ID NO: 76934

SEQ ID NO: 92104 - RNA, 64 nt, Human; identical to SEQ ID NO: 76935

SEQ ID NO: 92105 - RNA, 64 nt, Human; identical to SEQ ID NO: 76936

SEQ ID NO: 92106 - RNA, 64 nt, Human; identical to SEQ ID NO: 76937

SEQ ID NO: 92107 - RNA, 64 nt, Human; identical to SEQ ID NO: 76938

SEQ ID NO: 92108 - RNA, 64 nt, Human; identical to SEQ ID NO: 76939

SEQ ID NO: 92109 - RNA, 64 nt, Human; identical to SEQ ID NO: 76940

SEQ ID NO: 92110 - RNA, 64 nt, Human; identical to SEQ ID NO: 76941

SEQ ID NO: 92111 - RNA, 64 nt, Human; identical to SEQ ID NO: 76942

SEQ ID NO: 92112 - RNA, 64 nt, Human; identical to SEQ ID NO: 76943

SEQ ID NO: 92113 - RNA, 64 nt, Human; identical to SEQ ID NO: 76944

SEQ ID NO: 92114 - RNA, 64 nt, Human; identical to SEQ ID NO: 76945

SEQ ID NO: 92115 - RNA, 64 nt, Human; identical to SEQ ID NO: 76946

SEQ ID NO: 92116 - RNA, 64 nt, Human; identical to SEQ ID NO: 76947

SEQ ID NO: 92117 - RNA, 64 nt, Human; identical to SEQ ID NO: 76948

SEQ ID NO: 92118 - RNA, 64 nt, Human; identical to SEQ ID NO: 76949

SEQ ID NO: 92119 - RNA, 64 nt, Human; identical to SEQ ID NO: 76950

SEQ ID NO: 92120 - RNA, 64 nt, Human; identical to SEQ ID NO: 76951

SEQ ID NO: 92121 - RNA, 64 nt, Human; identical to SEQ ID NO: 76952

SEQ ID NO: 92122 - RNA, 64 nt, Human; identical to SEQ ID NO: 76953

SEQ ID NO: 92123 - RNA, 64 nt, Human; identical to SEQ ID NO: 76954

SEQ ID NO: 92124 - RNA, 64 nt, Human; identical to SEQ ID NO: 76955

SEQ ID NO: 92125 - RNA, 64 nt, Human; identical to SEQ ID NO: 76956

SEQ ID NO: 92126 - RNA, 64 nt, Human; identical to SEQ ID NO: 76957

SEQ ID NO: 92127 - RNA, 64 nt, Human; identical to SEQ ID NO: 76958

SEQ ID NO: 92128 - RNA, 64 nt, Human; identical to SEQ ID NO: 76959

SEQ ID NO: 92129 - RNA, 64 nt, Human; identical to SEQ ID NO: 76960

SEQ ID NO: 92130 - RNA, 64 nt, Human; identical to SEQ ID NO: 76961

SEQ ID NO: 92131 - RNA, 64 nt, Human; identical to SEQ ID NO: 76962

SEQ ID NO: 92132 - RNA, 64 nt, Human; identical to SEQ ID NO: 76963

SEQ ID NO: 92133 - RNA, 64 nt, Human; identical to SEQ ID NO: 76964

SEQ ID NO: 92134 - RNA, 64 nt, Human; identical to SEQ ID NO: 76965

SEQ ID NO: 92135 - RNA, 55 nt, Human; identical to SEQ ID NO: 76966

SEQ ID NO: 92136 - RNA, 64 nt, Human; identical to SEQ ID NO: 76967

SEQ ID NO: 92137 - RNA, 64 nt, Human; identical to SEQ ID NO: 76968

SEQ ID NO: 92138 - RNA, 64 nt, Human; identical to SEQ ID NO: 76969

SEQ ID NO: 92139 - RNA, 64 nt, Human; identical to SEQ ID NO: 76970

SEQ ID NO: 92140 - RNA, 64 nt, Human; identical to SEQ ID NO: 76971

SEQ ID NO: 92141 - RNA, 64 nt, Human; identical to SEQ ID NO: 76972

SEQ ID NO: 92142 - RNA, 64 nt, Human; identical to SEQ ID NO: 76973

SEQ ID NO: 92143 - RNA, 64 nt, Human; identical to SEQ ID NO: 76974

SEQ ID NO: 92144 - RNA, 64 nt, Human; identical to SEQ ID NO: 76975

SEQ ID NO: 92145 - RNA, 64 nt, Human; identical to SEQ ID NO: 76976

SEQ ID NO: 92146 - RNA, 64 nt, Human; identical to SEQ ID NO: 76977

SEQ ID NO: 92147 - RNA, 64 nt, Human; identical to SEQ ID NO: 76978

SEQ ID NO: 92148 - RNA, 64 nt, Human; identical to SEQ ID NO: 76979

SEQ ID NO: 92149 - RNA, 64 nt, Human; identical to SEQ ID NO: 76980

SEQ ID NO: 92150 - RNA, 64 nt, Human; identical to SEQ ID NO: 76981

SEQ ID NO: 92151 - RNA, 64 nt, Human; identical to SEQ ID NO: 76982

SEQ ID NO: 92152 - RNA, 64 nt, Human; identical to SEQ ID NO: 76983

SEQ ID NO: 92153 - RNA, 64 nt, Human; identical to SEQ ID NO: 76984

SEQ ID NO: 92154 - RNA, 64 nt, Human; identical to SEQ ID NO: 76985

SEQ ID NO: 92155 - RNA, 62 nt, Human; identical to SEQ ID NO: 76986

SEQ ID NO: 92156 - RNA, 61 nt, Human; identical to SEQ ID NO: 76987

SEQ ID NO: 92157 - RNA, 64 nt, Human; identical to SEQ ID NO: 76988

SEQ ID NO: 92158 - RNA, 64 nt, Human; identical to SEQ ID NO: 76989

SEQ ID NO: 92159 - RNA, 64 nt, Human; identical to SEQ ID NO: 76990

SEQ ID NO: 92160 - RNA, 64 nt, Human; identical to SEQ ID NO: 76991

SEQ ID NO: 92161 - RNA, 64 nt, Human; identical to SEQ ID NO: 76992

SEQ ID NO: 92162 - RNA, 64 nt, Human; identical to SEQ ID NO: 76993

SEQ ID NO: 92163 - RNA, 64 nt, Human; identical to SEQ ID NO: 76994

SEQ ID NO: 92164 - RNA, 64 nt, Human; identical to SEQ ID NO: 76995

SEQ ID NO: 92165 - RNA, 64 nt, Human; identical to SEQ ID NO: 76996

SEQ ID NO: 92166 - RNA, 64 nt, Human; identical to SEQ ID NO: 76997

SEQ ID NO: 92167 - RNA, 64 nt, Human; identical to SEQ ID NO: 76998

SEQ ID NO: 92168 - RNA, 64 nt, Human; identical to SEQ ID NO: 76999

SEQ ID NO: 92169 - RNA, 64 nt, Human; identical to SEQ ID NO: 77000

SEQ ID NO: 92170 - RNA, 64 nt, Human; identical to SEQ ID NO: 77001

SEQ ID NO: 92171 - RNA, 64 nt, Human; identical to SEQ ID NO: 77002

SEQ ID NO: 92172 - RNA, 64 nt, Human; identical to SEQ ID NO: 77003

SEQ ID NO: 92173 - RNA, 64 nt, Human; identical to SEQ ID NO: 77004

SEQ ID NO: 92174 - RNA, 64 nt, Human; identical to SEQ ID NO: 77005

SEQ ID NO: 92175 - RNA, 64 nt, Human; identical to SEQ ID NO: 77006

SEQ ID NO: 92176 - RNA, 64 nt, Human; identical to SEQ ID NO: 77007

SEQ ID NO: 92177 - RNA, 64 nt, Human; identical to SEQ ID NO: 77008

SEQ ID NO: 92178 - RNA, 64 nt, Human; identical to SEQ ID NO: 77009

SEQ ID NO: 92179 - RNA, 64 nt, Human; identical to SEQ ID NO: 77010

SEQ ID NO: 92180 - RNA, 64 nt, Human; identical to SEQ ID NO: 77011

SEQ ID NO: 92181 - RNA, 64 nt, Human; identical to SEQ ID NO: 77012

SEQ ID NO: 92182 - RNA, 64 nt, Human; identical to SEQ ID NO: 77013

SEQ ID NO: 92183 - RNA, 64 nt, Human; identical to SEQ ID NO: 77014

SEQ ID NO: 92184 - RNA, 64 nt, Human; identical to SEQ ID NO: 77015

SEQ ID NO: 92185 - RNA, 64 nt, Human; identical to SEQ ID NO: 77016

SEQ ID NO: 92186 - RNA, 64 nt, Human; identical to SEQ ID NO: 77017

SEQ ID NO: 92187 - RNA, 64 nt, Human; identical to SEQ ID NO: 77018

SEQ ID NO: 92188 - RNA, 64 nt, Human; identical to SEQ ID NO: 77019

SEQ ID NO: 92189 - RNA, 64 nt, Human; identical to SEQ ID NO: 77020

SEQ ID NO: 92190 - RNA, 64 nt, Human; identical to SEQ ID NO: 77021

SEQ ID NO: 92191 - RNA, 64 nt, Human; identical to SEQ ID NO: 77022

SEQ ID NO: 92192 - RNA, 64 nt, Human; identical to SEQ ID NO: 77023

SEQ ID NO: 92193 - RNA, 64 nt, Human; identical to SEQ ID NO: 77024

SEQ ID NO: 92194 - RNA, 64 nt, Human; identical to SEQ ID NO: 77025

SEQ ID NO: 92195 - RNA, 64 nt, Human; identical to SEQ ID NO: 77026

SEQ ID NO: 92196 - RNA, 64 nt, Human; identical to SEQ ID NO: 77027

SEQ ID NO: 92197 - RNA, 64 nt, Human; identical to SEQ ID NO: 77028

SEQ ID NO: 92198 - RNA, 62 nt, Human; identical to SEQ ID NO: 77029

SEQ ID NO: 92199 - RNA, 64 nt, Human; identical to SEQ ID NO: 77030

SEQ ID NO: 92200 - RNA, 64 nt, Human; identical to SEQ ID NO: 77031

SEQ ID NO: 92201 - RNA, 64 nt, Human; identical to SEQ ID NO: 77032

SEQ ID NO: 92202 - RNA, 64 nt, Human; identical to SEQ ID NO: 77033

SEQ ID NO: 92203 - RNA, 64 nt, Human; identical to SEQ ID NO: 77034

SEQ ID NO: 92204 - RNA, 64 nt, Human; identical to SEQ ID NO: 77035

SEQ ID NO: 92205 - RNA, 64 nt, Human; identical to SEQ ID NO: 77036

SEQ ID NO: 92206 - RNA, 64 nt, Human; identical to SEQ ID NO: 77037

SEQ ID NO: 92207 - RNA, 64 nt, Human; identical to SEQ ID NO: 77038

SEQ ID NO: 92208 - RNA, 64 nt, Human; identical to SEQ ID NO: 77039

SEQ ID NO: 92209 - RNA, 64 nt, Human; identical to SEQ ID NO: 77040

SEQ ID NO: 92210 - RNA, 64 nt, Human; identical to SEQ ID NO: 77041

SEQ ID NO: 92211 - RNA, 64 nt, Human; identical to SEQ ID NO: 77042

SEQ ID NO: 92212 - RNA, 64 nt, Human; identical to SEQ ID NO: 77043

SEQ ID NO: 92213 - RNA, 64 nt, Human; identical to SEQ ID NO: 77044

SEQ ID NO: 92214 - RNA, 64 nt, Human; identical to SEQ ID NO: 77045

SEQ ID NO: 92215 - RNA, 64 nt, Human; identical to SEQ ID NO: 77046

SEQ ID NO: 92216 - RNA, 64 nt, Human; identical to SEQ ID NO: 77047

SEQ ID NO: 92217 - RNA, 64 nt, Human; identical to SEQ ID NO: 77048

SEQ ID NO: 92218 - RNA, 64 nt, Human; identical to SEQ ID NO: 77049

SEQ ID NO: 92219 - RNA, 64 nt, Human; identical to SEQ ID NO: 77050

SEQ ID NO: 92220 - RNA, 64 nt, Human; identical to SEQ ID NO: 77051

SEQ ID NO: 92221 - RNA, 64 nt, Human; identical to SEQ ID NO: 77052

SEQ ID NO: 92222 - RNA, 64 nt, Human; identical to SEQ ID NO: 77053

SEQ ID NO: 92223 - RNA, 64 nt, Human; identical to SEQ ID NO: 77054

SEQ ID NO: 92224 - RNA, 64 nt, Human; identical to SEQ ID NO: 77055

SEQ ID NO: 92225 - RNA, 64 nt, Human; identical to SEQ ID NO: 77056

SEQ ID NO: 92226 - RNA, 64 nt, Human; identical to SEQ ID NO: 77057

SEQ ID NO: 92227 - RNA, 64 nt, Human; identical to SEQ ID NO: 77058

SEQ ID NO: 92228 - RNA, 64 nt, Human; identical to SEQ ID NO: 77059

SEQ ID NO: 92229 - RNA, 64 nt, Human; identical to SEQ ID NO: 77060

SEQ ID NO: 92230 - RNA, 64 nt, Human; identical to SEQ ID NO: 77061

SEQ ID NO: 92231 - RNA, 64 nt, Human; identical to SEQ ID NO: 77062

SEQ ID NO: 92232 - RNA, 64 nt, Human; identical to SEQ ID NO: 77063

SEQ ID NO: 92233 - RNA, 64 nt, Human; identical to SEQ ID NO: 77064

SEQ ID NO: 92234 - RNA, 64 nt, Human; identical to SEQ ID NO: 77065

SEQ ID NO: 92235 - RNA, 64 nt, Human; identical to SEQ ID NO: 77066

SEQ ID NO: 92236 - RNA, 64 nt, Human; identical to SEQ ID NO: 77067

SEQ ID NO: 92237 - RNA, 64 nt, Human; identical to SEQ ID NO: 77068

SEQ ID NO: 92238 - RNA, 64 nt, Human; identical to SEQ ID NO: 77069

SEQ ID NO: 92239 - RNA, 64 nt, Human; identical to SEQ ID NO: 77070

SEQ ID NO: 92240 - RNA, 64 nt, Human; identical to SEQ ID NO: 77071

SEQ ID NO: 92241 - RNA, 64 nt, Human; identical to SEQ ID NO: 77072

SEQ ID NO: 92242 - RNA, 64 nt, Human; identical to SEQ ID NO: 77073

SEQ ID NO: 92243 - RNA, 64 nt, Human; identical to SEQ ID NO: 77074

SEQ ID NO: 92244 - RNA, 64 nt, Human; identical to SEQ ID NO: 77075

SEQ ID NO: 92245 - RNA, 64 nt, Human; identical to SEQ ID NO: 77076

SEQ ID NO: 92246 - RNA, 64 nt, Human; identical to SEQ ID NO: 77077

SEQ ID NO: 92247 - RNA, 64 nt, Human; identical to SEQ ID NO: 77078

SEQ ID NO: 92248 - RNA, 64 nt, Human; identical to SEQ ID NO: 77079

SEQ ID NO: 92249 - RNA, 64 nt, Human; identical to SEQ ID NO: 77080

SEQ ID NO: 92250 - RNA, 64 nt, Human; identical to SEQ ID NO: 77081

SEQ ID NO: 92251 - RNA, 64 nt, Human; identical to SEQ ID NO: 77082

SEQ ID NO: 92252 - RNA, 64 nt, Human; identical to SEQ ID NO: 77083

SEQ ID NO: 92253 - RNA, 64 nt, Human; identical to SEQ ID NO: 77084

SEQ ID NO: 92254 - RNA, 64 nt, Human; identical to SEQ ID NO: 77085

SEQ ID NO: 92255 - RNA, 64 nt, Human; identical to SEQ ID NO: 77086

SEQ ID NO: 92256 - RNA, 64 nt, Human; identical to SEQ ID NO: 77087

SEQ ID NO: 92257 - RNA, 64 nt, Human; identical to SEQ ID NO: 77088

SEQ ID NO: 92258 - RNA, 64 nt, Human; identical to SEQ ID NO: 77089

SEQ ID NO: 92259 - RNA, 64 nt, Human; identical to SEQ ID NO: 77090

SEQ ID NO: 92260 - RNA, 64 nt, Human; identical to SEQ ID NO: 77091

SEQ ID NO: 92261 - RNA, 64 nt, Human; identical to SEQ ID NO: 77092

SEQ ID NO: 92262 - RNA, 64 nt, Human; identical to SEQ ID NO: 77093

SEQ ID NO: 92263 - RNA, 60 nt, Human; identical to SEQ ID NO: 77094

SEQ ID NO: 92264 - RNA, 64 nt, Human; identical to SEQ ID NO: 77095

SEQ ID NO: 92265 - RNA, 64 nt, Human; identical to SEQ ID NO: 77096

SEQ ID NO: 92266 - RNA, 64 nt, Human; identical to SEQ ID NO: 77097

SEQ ID NO: 92267 - RNA, 64 nt, Human; identical to SEQ ID NO: 77098

SEQ ID NO: 92268 - RNA, 64 nt, Human; identical to SEQ ID NO: 77099

SEQ ID NO: 92269 - RNA, 64 nt, Human; identical to SEQ ID NO: 77100

SEQ ID NO: 92270 - RNA, 64 nt, Human; identical to SEQ ID NO: 77101

SEQ ID NO: 92271 - RNA, 64 nt, Human; identical to SEQ ID NO: 77102

SEQ ID NO: 92272 - RNA, 64 nt, Human; identical to SEQ ID NO: 77103

SEQ ID NO: 92273 - RNA, 64 nt, Human; identical to SEQ ID NO: 77104

SEQ ID NO: 92274 - RNA, 64 nt, Human; identical to SEQ ID NO: 77105

SEQ ID NO: 92275 - RNA, 64 nt, Human; identical to SEQ ID NO: 77106

SEQ ID NO: 92276 - RNA, 64 nt, Human; identical to SEQ ID NO: 77107

SEQ ID NO: 92277 - RNA, 64 nt, Human; identical to SEQ ID NO: 77108

SEQ ID NO: 92278 - RNA, 64 nt, Human; identical to SEQ ID NO: 77109

SEQ ID NO: 92279 - RNA, 64 nt, Human; identical to SEQ ID NO: 77110

SEQ ID NO: 92280 - RNA, 64 nt, Human; identical to SEQ ID NO: 77111

SEQ ID NO: 92281 - RNA, 64 nt, Human; identical to SEQ ID NO: 77112

SEQ ID NO: 92282 - RNA, 64 nt, Human; identical to SEQ ID NO: 77113

SEQ ID NO: 92283 - RNA, 64 nt, Human; identical to SEQ ID NO: 77114

SEQ ID NO: 92284 - RNA, 64 nt, Human; identical to SEQ ID NO: 77115

SEQ ID NO: 92285 - RNA, 64 nt, Human; identical to SEQ ID NO: 77116

SEQ ID NO: 92286 - RNA, 64 nt, Human; identical to SEQ ID NO: 77117

SEQ ID NO: 92287 - RNA, 64 nt, Human; identical to SEQ ID NO: 77118

SEQ ID NO: 92288 - RNA, 64 nt, Human; identical to SEQ ID NO: 77119

SEQ ID NO: 92289 - RNA, 64 nt, Human; identical to SEQ ID NO: 77120

SEQ ID NO: 92290 - RNA, 64 nt, Human; identical to SEQ ID NO: 77121

SEQ ID NO: 92291 - RNA, 64 nt, Human; identical to SEQ ID NO: 77122

SEQ ID NO: 92292 - RNA, 64 nt, Human; identical to SEQ ID NO: 77123

SEQ ID NO: 92293 - RNA, 64 nt, Human; identical to SEQ ID NO: 77124

SEQ ID NO: 92294 - RNA, 64 nt, Human; identical to SEQ ID NO: 77125

SEQ ID NO: 92295 - RNA, 64 nt, Human; identical to SEQ ID NO: 77126

SEQ ID NO: 92296 - RNA, 64 nt, Human; identical to SEQ ID NO: 77127

SEQ ID NO: 92297 - RNA, 64 nt, Human; identical to SEQ ID NO: 77128

SEQ ID NO: 92298 - RNA, 64 nt, Human; identical to SEQ ID NO: 77129

SEQ ID NO: 92299 - RNA, 64 nt, Human; identical to SEQ ID NO: 77130

SEQ ID NO: 92300 - RNA, 64 nt, Human; identical to SEQ ID NO: 77131

SEQ ID NO: 92301 - RNA, 64 nt, Human; identical to SEQ ID NO: 77132

SEQ ID NO: 92302 - RNA, 64 nt, Human; identical to SEQ ID NO: 77133

SEQ ID NO: 92303 - RNA, 64 nt, Human; identical to SEQ ID NO: 77134

SEQ ID NO: 92304 - RNA, 64 nt, Human; identical to SEQ ID NO: 77135

SEQ ID NO: 92305 - RNA, 64 nt, Human; identical to SEQ ID NO: 77136

SEQ ID NO: 92306 - RNA, 64 nt, Human; identical to SEQ ID NO: 77137

SEQ ID NO: 92307 - RNA, 64 nt, Human; identical to SEQ ID NO: 77138

SEQ ID NO: 92308 - RNA, 64 nt, Human; identical to SEQ ID NO: 77139

SEQ ID NO: 92309 - RNA, 64 nt, Human; identical to SEQ ID NO: 77140

SEQ ID NO: 92310 - RNA, 64 nt, Human; identical to SEQ ID NO: 77141

SEQ ID NO: 92311 - RNA, 60 nt, Human; identical to SEQ ID NO: 77142

SEQ ID NO: 92312 - RNA, 64 nt, Human; identical to SEQ ID NO: 77143

SEQ ID NO: 92313 - RNA, 64 nt, Human; identical to SEQ ID NO: 77144

SEQ ID NO: 92314 - RNA, 64 nt, Human; identical to SEQ ID NO: 77145

SEQ ID NO: 92315 - RNA, 64 nt, Human; identical to SEQ ID NO: 77146

SEQ ID NO: 92316 - RNA, 64 nt, Human; identical to SEQ ID NO: 77147

SEQ ID NO: 92317 - RNA, 64 nt, Human; identical to SEQ ID NO: 77148

SEQ ID NO: 92318 - RNA, 64 nt, Human; identical to SEQ ID NO: 77149

SEQ ID NO: 92319 - RNA, 64 nt, Human; identical to SEQ ID NO: 77150

SEQ ID NO: 92320 - RNA, 64 nt, Human; identical to SEQ ID NO: 77151

SEQ ID NO: 92321 - RNA, 64 nt, Human; identical to SEQ ID NO: 77152

SEQ ID NO: 92322 - RNA, 64 nt, Human; identical to SEQ ID NO: 77153

SEQ ID NO: 92323 - RNA, 64 nt, Human; identical to SEQ ID NO: 77154

SEQ ID NO: 92324 - RNA, 64 nt, Human; identical to SEQ ID NO: 77155

SEQ ID NO: 92325 - RNA, 64 nt, Human; identical to SEQ ID NO: 77156

SEQ ID NO: 92326 - RNA, 64 nt, Human; identical to SEQ ID NO: 77157

SEQ ID NO: 92327 - RNA, 64 nt, Human; identical to SEQ ID NO: 77158

SEQ ID NO: 92328 - RNA, 64 nt, Human; identical to SEQ ID NO: 77159

SEQ ID NO: 92329 - RNA, 64 nt, Human; identical to SEQ ID NO: 77160

SEQ ID NO: 92330 - RNA, 64 nt, Human; identical to SEQ ID NO: 77161

SEQ ID NO: 92331 - RNA, 64 nt, Human; identical to SEQ ID NO: 77162

SEQ ID NO: 92332 - RNA, 64 nt, Human; identical to SEQ ID NO: 77163

SEQ ID NO: 92333 - RNA, 64 nt, Human; identical to SEQ ID NO: 77164

SEQ ID NO: 92334 - RNA, 64 nt, Human; identical to SEQ ID NO: 77165

SEQ ID NO: 92335 - RNA, 64 nt, Human; identical to SEQ ID NO: 77166

SEQ ID NO: 92336 - RNA, 64 nt, Human; identical to SEQ ID NO: 77167

SEQ ID NO: 92337 - RNA, 64 nt, Human; identical to SEQ ID NO: 77168

SEQ ID NO: 92338 - RNA, 64 nt, Human; identical to SEQ ID NO: 77169

SEQ ID NO: 92339 - RNA, 64 nt, Human; identical to SEQ ID NO: 77170

SEQ ID NO: 92340 - RNA, 64 nt, Human; identical to SEQ ID NO: 77171

SEQ ID NO: 92341 - RNA, 64 nt, Human; identical to SEQ ID NO: 77172

SEQ ID NO: 92342 - RNA, 64 nt, Human; identical to SEQ ID NO: 77173

SEQ ID NO: 92343 - RNA, 64 nt, Human; identical to SEQ ID NO: 77174

SEQ ID NO: 92344 - RNA, 64 nt, Human; identical to SEQ ID NO: 77175

SEQ ID NO: 92345 - RNA, 64 nt, Human; identical to SEQ ID NO: 77176

SEQ ID NO: 92346 - RNA, 64 nt, Human; identical to SEQ ID NO: 77177

SEQ ID NO: 92347 - RNA, 64 nt, Human; identical to SEQ ID NO: 77178

SEQ ID NO: 92348 - RNA, 64 nt, Human; identical to SEQ ID NO: 77179

SEQ ID NO: 92349 - RNA, 64 nt, Human; identical to SEQ ID NO: 77180

SEQ ID NO: 92350 - RNA, 64 nt, Human; identical to SEQ ID NO: 77181

SEQ ID NO: 92351 - RNA, 64 nt, Human; identical to SEQ ID NO: 77182

SEQ ID NO: 92352 - RNA, 64 nt, Human; identical to SEQ ID NO: 77183

SEQ ID NO: 92353 - RNA, 64 nt, Human; identical to SEQ ID NO: 77184

SEQ ID NO: 92354 - RNA, 64 nt, Human; identical to SEQ ID NO: 77185

SEQ ID NO: 92355 - RNA, 64 nt, Human; identical to SEQ ID NO: 77186

SEQ ID NO: 92356 - RNA, 64 nt, Human; identical to SEQ ID NO: 77187

SEQ ID NO: 92357 - RNA, 64 nt, Human; identical to SEQ ID NO: 77188

SEQ ID NO: 92358 - RNA, 64 nt, Human; identical to SEQ ID NO: 77189

SEQ ID NO: 92359 - RNA, 64 nt, Human; identical to SEQ ID NO: 77190

SEQ ID NO: 92360 - RNA, 64 nt, Human; identical to SEQ ID NO: 77191

SEQ ID NO: 92361 - RNA, 64 nt, Human; identical to SEQ ID NO: 77192

SEQ ID NO: 92362 - RNA, 64 nt, Human; identical to SEQ ID NO: 77193

SEQ ID NO: 92363 - RNA, 64 nt, Human; identical to SEQ ID NO: 77194

SEQ ID NO: 92364 - RNA, 64 nt, Human; identical to SEQ ID NO: 77195

SEQ ID NO: 92365 - RNA, 64 nt, Human; identical to SEQ ID NO: 77196

SEQ ID NO: 92366 - RNA, 64 nt, Human; identical to SEQ ID NO: 77197

SEQ ID NO: 92367 - RNA, 64 nt, Human; identical to SEQ ID NO: 77198

SEQ ID NO: 92368 - RNA, 64 nt, Human; identical to SEQ ID NO: 77199

SEQ ID NO: 92369 - RNA, 64 nt, Human; identical to SEQ ID NO: 77200

SEQ ID NO: 92370 - RNA, 64 nt, Human; identical to SEQ ID NO: 77201

SEQ ID NO: 92371 - RNA, 64 nt, Human; identical to SEQ ID NO: 77202

SEQ ID NO: 92372 - RNA, 64 nt, Human; identical to SEQ ID NO: 77203

SEQ ID NO: 92373 - RNA, 64 nt, Human; identical to SEQ ID NO: 77204

SEQ ID NO: 92374 - RNA, 64 nt, Human; identical to SEQ ID NO: 77205

SEQ ID NO: 92375 - RNA, 64 nt, Human; identical to SEQ ID NO: 77206

SEQ ID NO: 92376 - RNA, 64 nt, Human; identical to SEQ ID NO: 77207

SEQ ID NO: 92377 - RNA, 64 nt, Human; identical to SEQ ID NO: 77208

SEQ ID NO: 92378 - RNA, 64 nt, Human; identical to SEQ ID NO: 77209

SEQ ID NO: 92379 - RNA, 64 nt, Human; identical to SEQ ID NO: 77210

SEQ ID NO: 92380 - RNA, 64 nt, Human; identical to SEQ ID NO: 77211

SEQ ID NO: 92381 - RNA, 64 nt, Human; identical to SEQ ID NO: 77212

SEQ ID NO: 92382 - RNA, 64 nt, Human; identical to SEQ ID NO: 77213

SEQ ID NO: 92383 - RNA, 64 nt, Human; identical to SEQ ID NO: 77214

SEQ ID NO: 92384 - RNA, 64 nt, Human; identical to SEQ ID NO: 77215

SEQ ID NO: 92385 - RNA, 64 nt, Human; identical to SEQ ID NO: 77216

SEQ ID NO: 92386 - RNA, 64 nt, Human; identical to SEQ ID NO: 77217

SEQ ID NO: 92387 - RNA, 64 nt, Human; identical to SEQ ID NO: 77218

SEQ ID NO: 92388 - RNA, 64 nt, Human; identical to SEQ ID NO: 77219

SEQ ID NO: 92389 - RNA, 64 nt, Human; identical to SEQ ID NO: 77220

SEQ ID NO: 92390 - RNA, 64 nt, Human; identical to SEQ ID NO: 77221

SEQ ID NO: 92391 - RNA, 64 nt, Human; identical to SEQ ID NO: 77222

SEQ ID NO: 92392 - RNA, 64 nt, Human; identical to SEQ ID NO: 77223

SEQ ID NO: 92393 - RNA, 64 nt, Human; identical to SEQ ID NO: 77224

SEQ ID NO: 92394 - RNA, 64 nt, Human; identical to SEQ ID NO: 77225

SEQ ID NO: 92395 - RNA, 64 nt, Human; identical to SEQ ID NO: 77226

SEQ ID NO: 92396 - RNA, 64 nt, Human; identical to SEQ ID NO: 77227

SEQ ID NO: 92397 - RNA, 64 nt, Human; identical to SEQ ID NO: 77228

SEQ ID NO: 92398 - RNA, 64 nt, Human; identical to SEQ ID NO: 77229

SEQ ID NO: 92399 - RNA, 64 nt, Human; identical to SEQ ID NO: 77230

SEQ ID NO: 92400 - RNA, 64 nt, Human; identical to SEQ ID NO: 77231

SEQ ID NO: 92401 - RNA, 64 nt, Human; identical to SEQ ID NO: 77232

SEQ ID NO: 92402 - RNA, 64 nt, Human; identical to SEQ ID NO: 77233

SEQ ID NO: 92403 - RNA, 64 nt, Human; identical to SEQ ID NO: 77234

SEQ ID NO: 92404 - RNA, 64 nt, Human; identical to SEQ ID NO: 77235

SEQ ID NO: 92405 - RNA, 64 nt, Human; identical to SEQ ID NO: 77236

SEQ ID NO: 92406 - RNA, 64 nt, Human; identical to SEQ ID NO: 77237

SEQ ID NO: 92407 - RNA, 64 nt, Human; identical to SEQ ID NO: 77238

SEQ ID NO: 92408 - RNA, 64 nt, Human; identical to SEQ ID NO: 77239

SEQ ID NO: 92409 - RNA, 64 nt, Human; identical to SEQ ID NO: 77240

SEQ ID NO: 92410 - RNA, 64 nt, Human; identical to SEQ ID NO: 77241

SEQ ID NO: 92411 - RNA, 64 nt, Human; identical to SEQ ID NO: 77242

SEQ ID NO: 92412 - RNA, 64 nt, Human; identical to SEQ ID NO: 77243

SEQ ID NO: 92413 - RNA, 64 nt, Human; identical to SEQ ID NO: 77244

SEQ ID NO: 92414 - RNA, 64 nt, Human; identical to SEQ ID NO: 77245

SEQ ID NO: 92415 - RNA, 64 nt, Human; identical to SEQ ID NO: 77246

SEQ ID NO: 92416 - RNA, 64 nt, Human; identical to SEQ ID NO: 77247

SEQ ID NO: 92417 - RNA, 64 nt, Human; identical to SEQ ID NO: 77248

SEQ ID NO: 92418 - RNA, 64 nt, Human; identical to SEQ ID NO: 77249

SEQ ID NO: 92419 - RNA, 64 nt, Human; identical to SEQ ID NO: 77250

SEQ ID NO: 92420 - RNA, 64 nt, Human; identical to SEQ ID NO: 77251

SEQ ID NO: 92421 - RNA, 64 nt, Human; identical to SEQ ID NO: 77252

SEQ ID NO: 92422 - RNA, 64 nt, Human; identical to SEQ ID NO: 77253

SEQ ID NO: 92423 - RNA, 64 nt, Human; identical to SEQ ID NO: 77254

SEQ ID NO: 92424 - RNA, 64 nt, Human; identical to SEQ ID NO: 77255

SEQ ID NO: 92425 - RNA, 64 nt, Human; identical to SEQ ID NO: 77256

SEQ ID NO: 92426 - RNA, 64 nt, Human; identical to SEQ ID NO: 77257

SEQ ID NO: 92427 - RNA, 64 nt, Human; identical to SEQ ID NO: 77258

SEQ ID NO: 92428 - RNA, 64 nt, Human; identical to SEQ ID NO: 77259

SEQ ID NO: 92429 - RNA, 64 nt, Human; identical to SEQ ID NO: 77260

SEQ ID NO: 92430 - RNA, 64 nt, Human; identical to SEQ ID NO: 77261

SEQ ID NO: 92431 - RNA, 64 nt, Human; identical to SEQ ID NO: 77262

SEQ ID NO: 92432 - RNA, 64 nt, Human; identical to SEQ ID NO: 77263

SEQ ID NO: 92433 - RNA, 64 nt, Human; identical to SEQ ID NO: 77264

SEQ ID NO: 92434 - RNA, 64 nt, Human; identical to SEQ ID NO: 77265

SEQ ID NO: 92435 - RNA, 64 nt, Human; identical to SEQ ID NO: 77266

SEQ ID NO: 92436 - RNA, 64 nt, Human; identical to SEQ ID NO: 77267

SEQ ID NO: 92437 - RNA, 64 nt, Human; identical to SEQ ID NO: 77268

SEQ ID NO: 92438 - RNA, 64 nt, Human; identical to SEQ ID NO: 77269

SEQ ID NO: 92439 - RNA, 64 nt, Human; identical to SEQ ID NO: 77270

SEQ ID NO: 92440 - RNA, 64 nt, Human; identical to SEQ ID NO: 77271

SEQ ID NO: 92441 - RNA, 64 nt, Human; identical to SEQ ID NO: 77272

SEQ ID NO: 92442 - RNA, 64 nt, Human; identical to SEQ ID NO: 77273

SEQ ID NO: 92443 - RNA, 64 nt, Human; identical to SEQ ID NO: 77274

SEQ ID NO: 92444 - RNA, 64 nt, Human; identical to SEQ ID NO: 77275

SEQ ID NO: 92445 - RNA, 64 nt, Human; identical to SEQ ID NO: 77276

SEQ ID NO: 92446 - RNA, 64 nt, Human; identical to SEQ ID NO: 77277

SEQ ID NO: 92447 - RNA, 64 nt, Human; identical to SEQ ID NO: 77278

SEQ ID NO: 92448 - RNA, 64 nt, Human; identical to SEQ ID NO: 77279

SEQ ID NO: 92449 - RNA, 64 nt, Human; identical to SEQ ID NO: 77280

SEQ ID NO: 92450 - RNA, 64 nt, Human; identical to SEQ ID NO: 77281

SEQ ID NO: 92451 - RNA, 64 nt, Human; identical to SEQ ID NO: 77282

SEQ ID NO: 92452 - RNA, 64 nt, Human; identical to SEQ ID NO: 77283

SEQ ID NO: 92453 - RNA, 64 nt, Human; identical to SEQ ID NO: 77284

SEQ ID NO: 92454 - RNA, 64 nt, Human; identical to SEQ ID NO: 77285

SEQ ID NO: 92455 - RNA, 64 nt, Human; identical to SEQ ID NO: 77286

SEQ ID NO: 92456 - RNA, 64 nt, Human; identical to SEQ ID NO: 77287

SEQ ID NO: 92457 - RNA, 64 nt, Human; identical to SEQ ID NO: 77288

SEQ ID NO: 92458 - RNA, 64 nt, Human; identical to SEQ ID NO: 77289

SEQ ID NO: 92459 - RNA, 64 nt, Human; identical to SEQ ID NO: 77290

SEQ ID NO: 92460 - RNA, 64 nt, Human; identical to SEQ ID NO: 77291

SEQ ID NO: 92461 - RNA, 64 nt, Human; identical to SEQ ID NO: 77292

SEQ ID NO: 92462 - RNA, 64 nt, Human; identical to SEQ ID NO: 77293

SEQ ID NO: 92463 - RNA, 64 nt, Human; identical to SEQ ID NO: 77294

SEQ ID NO: 92464 - RNA, 64 nt, Human; identical to SEQ ID NO: 77295

SEQ ID NO: 92465 - RNA, 64 nt, Human; identical to SEQ ID NO: 77296

SEQ ID NO: 92466 - RNA, 64 nt, Human; identical to SEQ ID NO: 77297

SEQ ID NO: 92467 - RNA, 64 nt, Human; identical to SEQ ID NO: 77298

SEQ ID NO: 92468 - RNA, 64 nt, Human; identical to SEQ ID NO: 77299

SEQ ID NO: 92469 - RNA, 64 nt, Human; identical to SEQ ID NO: 77300

SEQ ID NO: 92470 - RNA, 64 nt, Human; identical to SEQ ID NO: 77301

SEQ ID NO: 92471 - RNA, 64 nt, Human; identical to SEQ ID NO: 77302

SEQ ID NO: 92472 - RNA, 64 nt, Human; identical to SEQ ID NO: 77303

SEQ ID NO: 92473 - RNA, 64 nt, Human; identical to SEQ ID NO: 77304

SEQ ID NO: 92474 - RNA, 64 nt, Human; identical to SEQ ID NO: 77305

SEQ ID NO: 92475 - RNA, 64 nt, Human; identical to SEQ ID NO: 77306

SEQ ID NO: 92476 - RNA, 64 nt, Human; identical to SEQ ID NO: 77307

SEQ ID NO: 92477 - RNA, 64 nt, Human; identical to SEQ ID NO: 77308

SEQ ID NO: 92478 - RNA, 64 nt, Human; identical to SEQ ID NO: 77309

SEQ ID NO: 92479 - RNA, 64 nt, Human; identical to SEQ ID NO: 77310

SEQ ID NO: 92480 - RNA, 64 nt, Human; identical to SEQ ID NO: 77311

SEQ ID NO: 92481 - RNA, 64 nt, Human; identical to SEQ ID NO: 77312

SEQ ID NO: 92482 - RNA, 64 nt, Human; identical to SEQ ID NO: 77313

SEQ ID NO: 92483 - RNA, 64 nt, Human; identical to SEQ ID NO: 77314

SEQ ID NO: 92484 - RNA, 64 nt, Human; identical to SEQ ID NO: 77315

SEQ ID NO: 92485 - RNA, 64 nt, Human; identical to SEQ ID NO: 77316

SEQ ID NO: 92486 - RNA, 64 nt, Human; identical to SEQ ID NO: 77317

SEQ ID NO: 92487 - RNA, 64 nt, Human; identical to SEQ ID NO: 77318

SEQ ID NO: 92488 - RNA, 64 nt, Human; identical to SEQ ID NO: 77319

SEQ ID NO: 92489 - RNA, 64 nt, Human; identical to SEQ ID NO: 77320

SEQ ID NO: 92490 - RNA, 64 nt, Human; identical to SEQ ID NO: 77321

SEQ ID NO: 92491 - RNA, 64 nt, Human; identical to SEQ ID NO: 77322

SEQ ID NO: 92492 - RNA, 64 nt, Human; identical to SEQ ID NO: 77323

SEQ ID NO: 92493 - RNA, 64 nt, Human; identical to SEQ ID NO: 77324

SEQ ID NO: 92494 - RNA, 64 nt, Human; identical to SEQ ID NO: 77325

SEQ ID NO: 92495 - RNA, 64 nt, Human; identical to SEQ ID NO: 77326

SEQ ID NO: 92496 - RNA, 61 nt, Human; identical to SEQ ID NO: 77327

SEQ ID NO: 92497 - RNA, 64 nt, Human; identical to SEQ ID NO: 77328

SEQ ID NO: 92498 - RNA, 64 nt, Human; identical to SEQ ID NO: 77329

SEQ ID NO: 92499 - RNA, 64 nt, Human; identical to SEQ ID NO: 77330

SEQ ID NO: 92500 - RNA, 64 nt, Human; identical to SEQ ID NO: 77331

SEQ ID NO: 92501 - RNA, 64 nt, Human; identical to SEQ ID NO: 77332

SEQ ID NO: 92502 - RNA, 64 nt, Human; identical to SEQ ID NO: 77333

SEQ ID NO: 92503 - RNA, 64 nt, Human; identical to SEQ ID NO: 77334

SEQ ID NO: 92504 - RNA, 64 nt, Human; identical to SEQ ID NO: 77335

SEQ ID NO: 92505 - RNA, 64 nt, Human; identical to SEQ ID NO: 77336

SEQ ID NO: 92506 - RNA, 64 nt, Human; identical to SEQ ID NO: 77337

SEQ ID NO: 92507 - RNA, 64 nt, Human; identical to SEQ ID NO: 77338

SEQ ID NO: 92508 - RNA, 64 nt, Human; identical to SEQ ID NO: 77339

SEQ ID NO: 92509 - RNA, 64 nt, Human; identical to SEQ ID NO: 77340

SEQ ID NO: 92510 - RNA, 64 nt, Human; identical to SEQ ID NO: 77341

SEQ ID NO: 92511 - RNA, 64 nt, Human; identical to SEQ ID NO: 77342

SEQ ID NO: 92512 - RNA, 64 nt, Human; identical to SEQ ID NO: 77343

SEQ ID NO: 92513 - RNA, 64 nt, Human; identical to SEQ ID NO: 77344

SEQ ID NO: 92514 - RNA, 64 nt, Human; identical to SEQ ID NO: 77345

SEQ ID NO: 92515 - RNA, 64 nt, Human; identical to SEQ ID NO: 77346

SEQ ID NO: 92516 - RNA, 64 nt, Human; identical to SEQ ID NO: 77347

SEQ ID NO: 92517 - RNA, 64 nt, Human; identical to SEQ ID NO: 77348

SEQ ID NO: 92518 - RNA, 64 nt, Human; identical to SEQ ID NO: 77349

SEQ ID NO: 92519 - RNA, 64 nt, Human; identical to SEQ ID NO: 77350

SEQ ID NO: 92520 - RNA, 64 nt, Human; identical to SEQ ID NO: 77351

SEQ ID NO: 92521 - RNA, 64 nt, Human; identical to SEQ ID NO: 77352

SEQ ID NO: 92522 - RNA, 64 nt, Human; identical to SEQ ID NO: 77353

SEQ ID NO: 92523 - RNA, 64 nt, Human; identical to SEQ ID NO: 77354

SEQ ID NO: 92524 - RNA, 64 nt, Human; identical to SEQ ID NO: 77355

SEQ ID NO: 92525 - RNA, 64 nt, Human; identical to SEQ ID NO: 77356

SEQ ID NO: 92526 - RNA, 64 nt, Human; identical to SEQ ID NO: 77357

SEQ ID NO: 92527 - RNA, 64 nt, Human; identical to SEQ ID NO: 77358

SEQ ID NO: 92528 - RNA, 64 nt, Human; identical to SEQ ID NO: 77359

SEQ ID NO: 92529 - RNA, 64 nt, Human; identical to SEQ ID NO: 77360

SEQ ID NO: 92530 - RNA, 64 nt, Human; identical to SEQ ID NO: 77361

SEQ ID NO: 92531 - RNA, 64 nt, Human; identical to SEQ ID NO: 77362

SEQ ID NO: 92532 - RNA, 64 nt, Human; identical to SEQ ID NO: 77363

SEQ ID NO: 92533 - RNA, 64 nt, Human; identical to SEQ ID NO: 77364

SEQ ID NO: 92534 - RNA, 64 nt, Human; identical to SEQ ID NO: 77365

SEQ ID NO: 92535 - RNA, 64 nt, Human; identical to SEQ ID NO: 77366

SEQ ID NO: 92536 - RNA, 64 nt, Human; identical to SEQ ID NO: 77367

SEQ ID NO: 92537 - RNA, 64 nt, Human; identical to SEQ ID NO: 77368

SEQ ID NO: 92538 - RNA, 64 nt, Human; identical to SEQ ID NO: 77369

SEQ ID NO: 92539 - RNA, 64 nt, Human; identical to SEQ ID NO: 77370

SEQ ID NO: 92540 - RNA, 64 nt, Human; identical to SEQ ID NO: 77371

SEQ ID NO: 92541 - RNA, 64 nt, Human; identical to SEQ ID NO: 77372

SEQ ID NO: 92542 - RNA, 64 nt, Human; identical to SEQ ID NO: 77373

SEQ ID NO: 92543 - RNA, 64 nt, Human; identical to SEQ ID NO: 77374

SEQ ID NO: 92544 - RNA, 64 nt, Human; identical to SEQ ID NO: 77375

SEQ ID NO: 92545 - RNA, 64 nt, Human; identical to SEQ ID NO: 77376

SEQ ID NO: 92546 - RNA, 64 nt, Human; identical to SEQ ID NO: 77377

SEQ ID NO: 92547 - RNA, 64 nt, Human; identical to SEQ ID NO: 77378

SEQ ID NO: 92548 - RNA, 64 nt, Human; identical to SEQ ID NO: 77379

SEQ ID NO: 92549 - RNA, 64 nt, Human; identical to SEQ ID NO: 77380

SEQ ID NO: 92550 - RNA, 64 nt, Human; identical to SEQ ID NO: 77381

SEQ ID NO: 92551 - RNA, 64 nt, Human; identical to SEQ ID NO: 77382

SEQ ID NO: 92552 - RNA, 64 nt, Human; identical to SEQ ID NO: 77383

SEQ ID NO: 92553 - RNA, 64 nt, Human; identical to SEQ ID NO: 77384

SEQ ID NO: 92554 - RNA, 64 nt, Human; identical to SEQ ID NO: 77385

SEQ ID NO: 92555 - RNA, 64 nt, Human; identical to SEQ ID NO: 77386

SEQ ID NO: 92556 - RNA, 57 nt, Human; identical to SEQ ID NO: 77387

SEQ ID NO: 92557 - RNA, 64 nt, Human; identical to SEQ ID NO: 77388

SEQ ID NO: 92558 - RNA, 64 nt, Human; identical to SEQ ID NO: 77389

SEQ ID NO: 92559 - RNA, 64 nt, Human; identical to SEQ ID NO: 77390

SEQ ID NO: 92560 - RNA, 64 nt, Human; identical to SEQ ID NO: 77391

SEQ ID NO: 92561 - RNA, 55 nt, Human; identical to SEQ ID NO: 77392

SEQ ID NO: 92562 - RNA, 64 nt, Human; identical to SEQ ID NO: 77393

SEQ ID NO: 92563 - RNA, 64 nt, Human; identical to SEQ ID NO: 77394

SEQ ID NO: 92564 - RNA, 64 nt, Human; identical to SEQ ID NO: 77395

SEQ ID NO: 92565 - RNA, 64 nt, Human; identical to SEQ ID NO: 77396

SEQ ID NO: 92566 - RNA, 64 nt, Human; identical to SEQ ID NO: 77397

SEQ ID NO: 92567 - RNA, 64 nt, Human; identical to SEQ ID NO: 77398

SEQ ID NO: 92568 - RNA, 64 nt, Human; identical to SEQ ID NO: 77399

SEQ ID NO: 92569 - RNA, 64 nt, Human; identical to SEQ ID NO: 77400

SEQ ID NO: 92570 - RNA, 64 nt, Human; identical to SEQ ID NO: 77401

SEQ ID NO: 92571 - RNA, 64 nt, Human; identical to SEQ ID NO: 77402

SEQ ID NO: 92572 - RNA, 64 nt, Human; identical to SEQ ID NO: 77403

SEQ ID NO: 92573 - RNA, 64 nt, Human; identical to SEQ ID NO: 77404

SEQ ID NO: 92574 - RNA, 64 nt, Human; identical to SEQ ID NO: 77405

SEQ ID NO: 92575 - RNA, 64 nt, Human; identical to SEQ ID NO: 77406

SEQ ID NO: 92576 - RNA, 64 nt, Human; identical to SEQ ID NO: 77407

SEQ ID NO: 92577 - RNA, 64 nt, Human; identical to SEQ ID NO: 77408

SEQ ID NO: 92578 - RNA, 64 nt, Human; identical to SEQ ID NO: 77409

SEQ ID NO: 92579 - RNA, 64 nt, Human; identical to SEQ ID NO: 77410

SEQ ID NO: 92580 - RNA, 64 nt, Human; identical to SEQ ID NO: 77411

SEQ ID NO: 92581 - RNA, 64 nt, Human; identical to SEQ ID NO: 77412

SEQ ID NO: 92582 - RNA, 64 nt, Human; identical to SEQ ID NO: 77413

SEQ ID NO: 92583 - RNA, 64 nt, Human; identical to SEQ ID NO: 77414

SEQ ID NO: 92584 - RNA, 64 nt, Human; identical to SEQ ID NO: 77415

SEQ ID NO: 92585 - RNA, 64 nt, Human; identical to SEQ ID NO: 77416

SEQ ID NO: 92586 - RNA, 64 nt, Human; identical to SEQ ID NO: 77417

SEQ ID NO: 92587 - RNA, 64 nt, Human; identical to SEQ ID NO: 77418

SEQ ID NO: 92588 - RNA, 64 nt, Human; identical to SEQ ID NO: 77419

SEQ ID NO: 92589 - RNA, 64 nt, Human; identical to SEQ ID NO: 77420

SEQ ID NO: 92590 - RNA, 64 nt, Human; identical to SEQ ID NO: 77421

SEQ ID NO: 92591 - RNA, 64 nt, Human; identical to SEQ ID NO: 77422

SEQ ID NO: 92592 - RNA, 64 nt, Human; identical to SEQ ID NO: 77423

SEQ ID NO: 92593 - RNA, 64 nt, Human; identical to SEQ ID NO: 77424

SEQ ID NO: 92594 - RNA, 64 nt, Human; identical to SEQ ID NO: 77425

SEQ ID NO: 92595 - RNA, 64 nt, Human; identical to SEQ ID NO: 77426

SEQ ID NO: 92596 - RNA, 64 nt, Human; identical to SEQ ID NO: 77427

SEQ ID NO: 92597 - RNA, 64 nt, Human; identical to SEQ ID NO: 77428

SEQ ID NO: 92598 - RNA, 64 nt, Human; identical to SEQ ID NO: 77429

SEQ ID NO: 92599 - RNA, 64 nt, Human; identical to SEQ ID NO: 77430

SEQ ID NO: 92600 - RNA, 64 nt, Human; identical to SEQ ID NO: 77431

SEQ ID NO: 92601 - RNA, 64 nt, Human; identical to SEQ ID NO: 77432

SEQ ID NO: 92602 - RNA, 64 nt, Human; identical to SEQ ID NO: 77433

SEQ ID NO: 92603 - RNA, 64 nt, Human; identical to SEQ ID NO: 77434

SEQ ID NO: 92604 - RNA, 64 nt, Human; identical to SEQ ID NO: 77435

SEQ ID NO: 92605 - RNA, 64 nt, Human; identical to SEQ ID NO: 77436

SEQ ID NO: 92606 - RNA, 64 nt, Human; identical to SEQ ID NO: 77437

SEQ ID NO: 92607 - RNA, 64 nt, Human; identical to SEQ ID NO: 77438

SEQ ID NO: 92608 - RNA, 64 nt, Human; identical to SEQ ID NO: 77439

SEQ ID NO: 92609 - RNA, 64 nt, Human; identical to SEQ ID NO: 77440

SEQ ID NO: 92610 - RNA, 64 nt, Human; identical to SEQ ID NO: 77441

SEQ ID NO: 92611 - RNA, 64 nt, Human; identical to SEQ ID NO: 77442

SEQ ID NO: 92612 - RNA, 64 nt, Human; identical to SEQ ID NO: 77443

SEQ ID NO: 92613 - RNA, 64 nt, Human; identical to SEQ ID NO: 77444

SEQ ID NO: 92614 - RNA, 64 nt, Human; identical to SEQ ID NO: 77445

SEQ ID NO: 92615 - RNA, 64 nt, Human; identical to SEQ ID NO: 77446

SEQ ID NO: 92616 - RNA, 64 nt, Human; identical to SEQ ID NO: 77447

SEQ ID NO: 92617 - RNA, 64 nt, Human; identical to SEQ ID NO: 77448

SEQ ID NO: 92618 - RNA, 64 nt, Human; identical to SEQ ID NO: 77449

SEQ ID NO: 92619 - RNA, 64 nt, Human; identical to SEQ ID NO: 77450

SEQ ID NO: 92620 - RNA, 64 nt, Human; identical to SEQ ID NO: 77451

SEQ ID NO: 92621 - RNA, 64 nt, Human; identical to SEQ ID NO: 77452

SEQ ID NO: 92622 - RNA, 64 nt, Human; identical to SEQ ID NO: 77453

SEQ ID NO: 92623 - RNA, 64 nt, Human; identical to SEQ ID NO: 77454

SEQ ID NO: 92624 - RNA, 64 nt, Human; identical to SEQ ID NO: 77455

SEQ ID NO: 92625 - RNA, 64 nt, Human; identical to SEQ ID NO: 77456

SEQ ID NO: 92626 - RNA, 64 nt, Human; identical to SEQ ID NO: 77457

SEQ ID NO: 92627 - RNA, 64 nt, Human; identical to SEQ ID NO: 77458

SEQ ID NO: 92628 - RNA, 64 nt, Human; identical to SEQ ID NO: 77459

SEQ ID NO: 92629 - RNA, 64 nt, Human; identical to SEQ ID NO: 77460

SEQ ID NO: 92630 - RNA, 64 nt, Human; identical to SEQ ID NO: 77461

SEQ ID NO: 92631 - RNA, 64 nt, Human; identical to SEQ ID NO: 77462

SEQ ID NO: 92632 - RNA, 64 nt, Human; identical to SEQ ID NO: 77463

SEQ ID NO: 92633 - RNA, 64 nt, Human; identical to SEQ ID NO: 77464

SEQ ID NO: 92634 - RNA, 64 nt, Human; identical to SEQ ID NO: 77465

SEQ ID NO: 92635 - RNA, 64 nt, Human; identical to SEQ ID NO: 77466

SEQ ID NO: 92636 - RNA, 64 nt, Human; identical to SEQ ID NO: 77467

SEQ ID NO: 92637 - RNA, 64 nt, Human; identical to SEQ ID NO: 77468

SEQ ID NO: 92638 - RNA, 64 nt, Human; identical to SEQ ID NO: 77469

SEQ ID NO: 92639 - RNA, 64 nt, Human; identical to SEQ ID NO: 77470

SEQ ID NO: 92640 - RNA, 64 nt, Human; identical to SEQ ID NO: 77471

SEQ ID NO: 92641 - RNA, 64 nt, Human; identical to SEQ ID NO: 77472

SEQ ID NO: 92642 - RNA, 64 nt, Human; identical to SEQ ID NO: 77473

SEQ ID NO: 92643 - RNA, 64 nt, Human; identical to SEQ ID NO: 77474

SEQ ID NO: 92644 - RNA, 64 nt, Human; identical to SEQ ID NO: 77475

SEQ ID NO: 92645 - RNA, 64 nt, Human; identical to SEQ ID NO: 77476

SEQ ID NO: 92646 - RNA, 64 nt, Human; identical to SEQ ID NO: 77477

SEQ ID NO: 92647 - RNA, 64 nt, Human; identical to SEQ ID NO: 77478

SEQ ID NO: 92648 - RNA, 64 nt, Human; identical to SEQ ID NO: 77479

SEQ ID NO: 92649 - RNA, 64 nt, Human; identical to SEQ ID NO: 77480

SEQ ID NO: 92650 - RNA, 64 nt, Human; identical to SEQ ID NO: 77481

SEQ ID NO: 92651 - RNA, 64 nt, Human; identical to SEQ ID NO: 77482

SEQ ID NO: 92652 - RNA, 64 nt, Human; identical to SEQ ID NO: 77483

SEQ ID NO: 92653 - RNA, 64 nt, Human; identical to SEQ ID NO: 77484

SEQ ID NO: 92654 - RNA, 64 nt, Human; identical to SEQ ID NO: 77485

SEQ ID NO: 92655 - RNA, 64 nt, Human; identical to SEQ ID NO: 77486

SEQ ID NO: 92656 - RNA, 64 nt, Human; identical to SEQ ID NO: 77487

SEQ ID NO: 92657 - RNA, 64 nt, Human; identical to SEQ ID NO: 77488

SEQ ID NO: 92658 - RNA, 64 nt, Human; identical to SEQ ID NO: 77489

SEQ ID NO: 92659 - RNA, 64 nt, Human; identical to SEQ ID NO: 77490

SEQ ID NO: 92660 - RNA, 64 nt, Human; identical to SEQ ID NO: 77491

SEQ ID NO: 92661 - RNA, 64 nt, Human; identical to SEQ ID NO: 77073

SEQ ID NO: 92662 - RNA, 64 nt, Human; identical to SEQ ID NO: 77493

SEQ ID NO: 92663 - RNA, 64 nt, Human; identical to SEQ ID NO: 77494

SEQ ID NO: 92664 - RNA, 64 nt, Human; identical to SEQ ID NO: 77495

SEQ ID NO: 92665 - RNA, 64 nt, Human; identical to SEQ ID NO: 77496

SEQ ID NO: 92666 - RNA, 64 nt, Human; identical to SEQ ID NO: 77497

SEQ ID NO: 92667 - RNA, 64 nt, Human; identical to SEQ ID NO: 77498

SEQ ID NO: 92668 - RNA, 64 nt, Human; identical to SEQ ID NO: 77499

SEQ ID NO: 92669 - RNA, 64 nt, Human; identical to SEQ ID NO: 77500

SEQ ID NO: 92670 - RNA, 64 nt, Human; identical to SEQ ID NO: 77501

SEQ ID NO: 92671 - RNA, 64 nt, Human; identical to SEQ ID NO: 77502

SEQ ID NO: 92672 - RNA, 64 nt, Human; identical to SEQ ID NO: 77503

SEQ ID NO: 92673 - RNA, 64 nt, Human; identical to SEQ ID NO: 77504

SEQ ID NO: 92674 - RNA, 64 nt, Human; identical to SEQ ID NO: 77505

SEQ ID NO: 92675 - RNA, 64 nt, Human; identical to SEQ ID NO: 77506

SEQ ID NO: 92676 - RNA, 64 nt, Human; identical to SEQ ID NO: 77507

SEQ ID NO: 92677 - RNA, 64 nt, Human; identical to SEQ ID NO: 77508

SEQ ID NO: 92678 - RNA, 64 nt, Human; identical to SEQ ID NO: 77509

SEQ ID NO: 92679 - RNA, 64 nt, Human; identical to SEQ ID NO: 77510

SEQ ID NO: 92680 - RNA, 64 nt, Human; identical to SEQ ID NO: 77511

SEQ ID NO: 92681 - RNA, 64 nt, Human; identical to SEQ ID NO: 77512

SEQ ID NO: 92682 - RNA, 64 nt, Human; identical to SEQ ID NO: 77513

SEQ ID NO: 92683 - RNA, 64 nt, Human; identical to SEQ ID NO: 77514

SEQ ID NO: 92684 - RNA, 64 nt, Human; identical to SEQ ID NO: 77515

SEQ ID NO: 92685 - RNA, 64 nt, Human; identical to SEQ ID NO: 77516

SEQ ID NO: 92686 - RNA, 64 nt, Human; identical to SEQ ID NO: 77517

SEQ ID NO: 92687 - RNA, 64 nt, Human; identical to SEQ ID NO: 77518

SEQ ID NO: 92688 - RNA, 64 nt, Human; identical to SEQ ID NO: 77519

SEQ ID NO: 92689 - RNA, 64 nt, Human; identical to SEQ ID NO: 77520

SEQ ID NO: 92690 - RNA, 64 nt, Human; identical to SEQ ID NO: 77521

SEQ ID NO: 92691 - RNA, 64 nt, Human; identical to SEQ ID NO: 77522

SEQ ID NO: 92692 - RNA, 64 nt, Human; identical to SEQ ID NO: 77523

SEQ ID NO: 92693 - RNA, 64 nt, Human; identical to SEQ ID NO: 77524

SEQ ID NO: 92694 - RNA, 64 nt, Human; identical to SEQ ID NO: 77525

SEQ ID NO: 92695 - RNA, 64 nt, Human; identical to SEQ ID NO: 77526

SEQ ID NO: 92696 - RNA, 64 nt, Human; identical to SEQ ID NO: 77527

SEQ ID NO: 92697 - RNA, 64 nt, Human; identical to SEQ ID NO: 77528

SEQ ID NO: 92698 - RNA, 64 nt, Human; identical to SEQ ID NO: 77529

SEQ ID NO: 92699 - RNA, 64 nt, Human; identical to SEQ ID NO: 77530

SEQ ID NO: 92700 - RNA, 64 nt, Human; identical to SEQ ID NO: 77531

SEQ ID NO: 92701 - RNA, 64 nt, Human; identical to SEQ ID NO: 77532

SEQ ID NO: 92702 - RNA, 64 nt, Human; identical to SEQ ID NO: 77533

SEQ ID NO: 92703 - RNA, 64 nt, Human; identical to SEQ ID NO: 77534

SEQ ID NO: 92704 - RNA, 64 nt, Human; identical to SEQ ID NO: 77535

SEQ ID NO: 92705 - RNA, 64 nt, Human; identical to SEQ ID NO: 77536

SEQ ID NO: 92706 - RNA, 64 nt, Human; identical to SEQ ID NO: 77537

SEQ ID NO: 92707 - RNA, 64 nt, Human
uggcaggagcagacugccucagcccaugugcccugccggccagggcgugggcuccccucggcug

SEQ ID NO: 92708 - RNA, 64 nt, Human
ugaaacccugucucuacuaaaauuacaaaaauuagccggccaugguggcaggugcuuguaaucc

SEQ ID NO: 92709 - RNA, 64 nt, Human
guggccaagaagcggaaaaaccuggccacuuauugccggccagugaaggccaagcacugucagg

SEQ ID NO: 92710 - RNA, 64 nt, Human
gaaguaaugugguccacagccaugcccuugaggagccggccaccagaugcugaauccccuaucc

SEQ ID NO: 92711 - RNA, 64 nt, Human
uuccccuugcuucauguuuguagaggaaccuugugccggccaggcccaguuuccuugugugaua

SEQ ID NO: 92712 - RNA, 64 nt, Human
gaccgcacuugaaggcuggggcccaggcaccugugccggccauucguuuucucucucucccuuu

SEQ ID NO: 92713 - RNA, 64 nt, Human
gcaccuggccuccaggagucgcuguguugggagagccggccacgcccuuggcuuuagagcugug

SEQ ID NO: 92714 - RNA, 64 nt, Human
ucuucccccgggguccaggggucaacugcuacaugccggccaauggcgagacggugacgcugcc

SEQ ID NO: 92715 - RNA, 64 nt, Human
ccgcaaccucgacuucucagccuccugggguuccgccggccaacacugucugucucaaauacug

SEQ ID NO: 92716 - RNA, 64 nt, Human
gcagccucccaggacaggcuggcaagggaggagggccggccagcauuugguggcccaucagucu

SEQ ID NO: 92717 - RNA, 64 nt, Human
ccccuucagcugcccucgauuuugcuccacgccugccggccagagccucccggcguuucuuccg

SEQ ID NO: 92718 - RNA, 64 nt, Human
auccaggccucacacccacacucgagcccacccggccggccagcuuuagaggaggggaggagca

SEQ ID NO: 92719 - RNA, 64 nt, Human
acaucagccacauggaauccugacaucccagccagccggccagacucucaucuugaugucuuga

SEQ ID NO: 92720 - RNA, 64 nt, Human
cacugcucuggauaggaaaugaccgccaucuccagccggccaccucaggccccuguugggccac

SEQ ID NO: 92721 - RNA, 64 nt, Human
ugacgagcucaccguuggcuacccggucacggaggccggccaccugcagagccucuacacaggu

SEQ ID NO: 92722 - RNA, 64 nt, Human
gagcccgagggccugacagguucccagcagcugggccggccagccuugcacugugggggcuggu

SEQ ID NO: 92723 - RNA, 64 nt, Human
gcagggcuucuggggcguugggaaacccaggcccgccggccacgacucugcccucagcuucaca

SEQ ID NO: 92724 - RNA, 64 nt, Human
gccguacuucccacagccgccuuuuugcggccuggccggccaggcuucccgugcguuauacaca

SEQ ID NO: 92725 - RNA, 64 nt, Human
aaaauggggaugacagcuaggaggcuggagcagggccggccacguguggacuguggggcugccc

SEQ ID NO: 92726 - RNA, 64 nt, Human
uagacggcaccguaucugcagugggcacgggggggccggccagacaggcagacugggaggaugg

SEQ ID NO: 92727 - RNA, 64 nt, Human
gggagacacccggaggagcaggugggaagaugaagccggccagagccccucugcccagcaugcc

SEQ ID NO: 92728 - RNA, 64 nt, Human
gcccaccgcauuugucguuuuagauacuuugcuagccggccacuuuggauuucaucagacaguc

SEQ ID NO: 92729 - RNA, 64 nt, Human
ucaguccaacaugagauuuuaggaauagaaauuugccggccauuuggaaagugaaaugccacuu

SEQ ID NO: 92730 - RNA, 51 nt, Human
ugucggaggcugagugcugaggccggccaggcccgacaccuacacucucac

SEQ ID NO: 92731 - RNA, 64 nt, Human
ccccuacuggccggccggccccccucccccagccgccggccagcucccaaauggcccauuccag

SEQ ID NO: 92732 - RNA, 64 nt, Human
acaaaacgagcacagugcugacccggcacagccagccggccacgcccacgccgcugcagagccg

SEQ ID NO: 92733 - RNA, 64 nt, Human
caugaagcuguagggacucaucuugcauggcaccgccggccagacacugcccaaggaccaguau

SEQ ID NO: 92734 - RNA, 64 nt, Human
ggucccccacccucaccccggccccccacccgcagccggccacacuggagcagcucccagcaca

SEQ ID NO: 92735 - RNA, 64 nt, Human
cccuguguccucucauccucccgccgcccgucaggccggccagccucacaucagucucuccgcc

SEQ ID NO: 92736 - RNA, 64 nt, Human
gcgggagaggcgcaguggcugcaggcugcccccugccggccacaagggagcagcguccgcgccg

SEQ ID NO: 92737 - RNA, 64 nt, Human
ucuagcagaaaugauagacacaguccaccuuucggccggccagccugaucugggcucagcaugu

SEQ ID NO: 92738 - RNA, 64 nt, Human
agaagcucuugugcaauuagccuggcaaugauuggccggccauguuugaaugccaguuucucuu

SEQ ID NO: 92739 - RNA, 53 nt, Human
cucugagucccuccgcguagucugccggccacaccgcaucuuccggccgucgg

SEQ ID NO: 92740 - RNA, 64 nt, Human
ggaacacuggcuggagacccuccgcaugcaccuggccggccaccugccacugggcccacagcug

SEQ ID NO: 92741 - RNA, 64 nt, Human
gugucugugugugaggucacccucaaacugcaccgccggccagauacccuccugaccccgagga

SEQ ID NO: 92742 - RNA, 64 nt, Human
agguccgcacccuguccugcacacccugggccacgccggccacaccccucugcugcaacaagcu

SEQ ID NO: 92743 - RNA, 64 nt, Human
cucauguccuacuuccucuacucucccgugcacugccggccagagcucaagaagcugcugcacg

SEQ ID NO: 92744 - RNA, 64 nt, Human
uccccuucgaugcccccgguucccaaccuuucacgccggccagcggucaggggccagggcugga

SEQ ID NO: 92745 - RNA, 64 nt, Human
cccucccagccuucugcugcccuugcuuaacaaugccggccaacuggcgaccucacgguugcac

SEQ ID NO: 92746 - RNA, 56 nt, Human
cugccgccgacccccuaugagacgccgccggccagcggggcgcucgggagccaggg

SEQ ID NO: 92747 - RNA, 64 nt, Human
gagaagacaccauacucagcaaucacaagagcccgccggccagugggcuuguuugcagacuggg

SEQ ID NO: 92748 - RNA, 64 nt, Human
uuggaugccaacucagcccccugaccuggaggcagccggccaaggccucuagggaagagccccc

SEQ ID NO: 92749 - RNA, 64 nt, Human
gucugucauccccacugaccugcuggugcagcaggccggccagcuggcccggcgccucugggag

SEQ ID NO: 92750 - RNA, 64 nt, Human
gcgcaucccugaggcuggacuccagaucugcaccgccggccagcugggaucugacugcacgugg

SEQ ID NO: 92751 - RNA, 64 nt, Human
ggucucagagccgugccacccacccucccacacagccggccacagggagaacuggugcuaacca

SEQ ID NO: 92752 - RNA, 64 nt, Human
gaagggcggucgccucugccacugucagggaccagccggccaacgcccacccgcaaaggugucu

SEQ ID NO: 92753 - RNA, 64 nt, Human
ucaccaaacacuacccaugggggguugggagucagccggccaaacuaacacucccccuccucca

SEQ ID NO: 92754 - RNA, 57 nt, Human
auacguuggugaguuucuaagggggaagccggccagggagcgagcccagaacggacc

SEQ ID NO: 92755 - RNA, 64 nt, Human
ugggcugggugcgaccccaucugcccaggacggggccggccaggugggcgggcagcacagcaag

SEQ ID NO: 92756 - RNA, 64 nt, Human
ugaaaccccgucucuauugggaguacaaaaauuagccggccauaguggcucgugccuguaaucu

SEQ ID NO: 92757 - RNA, 64 nt, Human
cgucuguccaucugcccgccugcccaccugccuggccggccagccagccacucuaccagugcag

SEQ ID NO: 92758 - RNA, 64 nt, Human
cguuagaauauaggucucuucucccagaaucccagccggccaauggaaaccucacgcugggucc

SEQ ID NO: 92759 - RNA, 64 nt, Human
cgcacagcagccugcuucccaccucccugcccaggccggccagccucacccuugcgaaccguga

SEQ ID NO: 92760 - RNA, 64 nt, Human
acgggcuuuaacauguuuaagaaauauggauggggccggccacaguggcucacgccuguaaucc

SEQ ID NO: 92761 - RNA, 64 nt, Human
acucuggggauggagcaggacggggacgggaggggccggccaccugucuguaaggagacuuugu

SEQ ID NO: 92762 - RNA, 64 nt, Human
gacucugccagugccugguggaacuguccacccagccggccacugugugucauggcucugcaac

SEQ ID NO: 92763 - RNA, 64 nt, Human
ggcugcgugggcuucugggcaggcucacgcagacgccggccacaccauccaccuggccgccucc

SEQ ID NO: 92764 - RNA, 64 nt, Human
ccugcgacacggaguaccccguguucguguaccagccggccauccgggaggccaacgggaucgu

SEQ ID NO: 92765 - RNA, 64 nt, Human
agcuggaaguucaccugcaggugccaaagagcaggccggccagggcuggggcagugccagacuc

SEQ ID NO: 92766 - RNA, 64 nt, Human
cugucagucguguggccugggagaaccaggagccgccggccaggagacacaaaacuccgcuccc

SEQ ID NO: 92767 - RNA, 64 nt, Human
ccuggagcagccucugagucuuacccguaauggagccggccaacccuguguguuauguugcugu

SEQ ID NO: 92768 - RNA, 64 nt, Human
aggaggcaggggcugcaggcucagccugacccaggccggccagcauggcagagagguccugcau

SEQ ID NO: 92769 - RNA, 64 nt, Human
cuccagccuaaacugacaucauccuauggacugagccggccacucucuggccgaaguggccgca

SEQ ID NO: 92770 - RNA, 64 nt, Human
aagauacuugccagucucuccagugugggcaccagccggccagaacagaugcgagcaguccaug

SEQ ID NO: 92771 - RNA, 64 nt, Human
cccuccuccccucggccuccaggaagccaccguggccggccaagcacaagcucacccacuuugg

SEQ ID NO: 92772 - RNA, 64 nt, Human
uucugaagguuguagggaccuugcccugcugucugccggccagagccucucccaucugacccag

SEQ ID NO: 92773 - RNA, 64 nt, Human
ucgccacaaugccaugucgcaauaggaagcaggggccggccaucgcuaccuucagcacacugac

SEQ ID NO: 92774 - RNA, 64 nt, Human
agccacuggaauugucacacggcgagcacagagggccggccaccaguccucgaugcuucugaac

SEQ ID NO: 92775 - RNA, 64 nt, Human
cuuuccacuugaggauagcagcuucacuaggcuggccggccagcuccacaucugacuggguucu

SEQ ID NO: 92776 - RNA, 64 nt, Human
ggguuuuacuuuuaccuguuuugagggggauggggccggccaagccauucagagagaacauggg

SEQ ID NO: 92777 - RNA, 64 nt, Human
aggggagagaugggcggccccgccccagcgcagugccggccacacccaugcacugaagcuccuc

SEQ ID NO: 92778 - RNA, 64 nt, Human
cggccagcggccacggugccagagucaccaccuugccggccacuccuccagcugccaggggcau

SEQ ID NO: 92779 - RNA, 64 nt, Human
gcccggcgcucaugcugagccccaggcacgcagggccggccaccucucuccugaagccauuggc

SEQ ID NO: 92780 - RNA, 64 nt, Human
gccguggcagguggcugagcaggagcucccaagugccggccaccgcugucagggauugcccacc

SEQ ID NO: 92781 - RNA, 64 nt, Human
gagccaggaugcaaggcuccugguccuguuugcagccggccaagaggcgcugggaggggcaaaa

SEQ ID NO: 92782 - RNA, 64 nt, Human
gccuccuuccgggccugagcugcccaucugccuagccggccacuagggcaccaucuucucaagg

SEQ ID NO: 92783 - RNA, 64 nt, Human
gcgccagcgguggaggcugagucgcaggacacaugccggccaguuaauucauucucagccaaug

SEQ ID NO: 92784 - RNA, 64 nt, Human
guaaguucuuccccagccuccagauaagagccccgccggccaaucccuucauuucaaccuaaag

SEQ ID NO: 92785 - RNA, 64 nt, Human
ggggccaugccuccucaggagccgaagcccaggggccggccaguggccuuccccagcaugcacc

SEQ ID NO: 92786 - RNA, 64 nt, Human
ccucccugcacgcacacggcgucaaaaccaagcugccggccacugucuccagaacgcaaggcuc

SEQ ID NO: 92787 - RNA, 64 nt, Human
cuccuggggagcaucagggaagagggggccaugagccggccagcaguggagacggcaguccagu

SEQ ID NO: 92788 - RNA, 64 nt, Human
auguguacauugagguugugggccuucucaaaccgccggccacacuggucacaggcaaagucca

SEQ ID NO: 92789 - RNA, 64 nt, Human
ugccaugcccccucuccugcaccucccuggcccugccggccacuguggacgcccuggggcuugg

SEQ ID NO: 92790 - RNA, 53 nt, Human
agcacgccaccgagcccuagcuggccggccaccuccuuuccucucgccaccuu

SEQ ID NO: 92791 - RNA, 64 nt, Human
ccaguacauuguagaagauggaggucauguguuugccggccagugcuaugcugagauugagguc

SEQ ID NO: 92792 - RNA, 64 nt, Human
uccuugccuugcuggacugucagccagucgcagggccggccacaagacccaugucuccaucugg

SEQ ID NO: 92793 - RNA, 64 nt, Human
caccagaccacccgcugaggacucagcuaccccggccggccacccaggaggcagggaggcagcc

SEQ ID NO: 92794 - RNA, 64 nt, Human
ggaugcagaggccacccagaggcccuuccugagggccggccacauucccgcccuccugggcaga

SEQ ID NO: 92795 - RNA, 64 nt, Human
auacacuagugggcagaaauagccccgucccagagccggccaugguggcucauaccuguuauac

SEQ ID NO: 92796 - RNA, 64 nt, Human
caugucccagacacaucccacacguguccguguggccggccagccuggggaguaguggcaacag

SEQ ID NO: 92797 - RNA, 64 nt, Human
cgcagagacgccucccaggcccgucugccagggcgccggccacaauccugcagggccaaggacu

SEQ ID NO: 92798 - RNA, 64 nt, Human
cagacucagggagcagggccaggcgggcucgggggccggccaggggagcaccccacucaacuac

SEQ ID NO: 92799 - RNA, 64 nt, Human
caggccuggccucggggcagggcagggcggcuaggccggccagcucccccuugcccgccagcca

SEQ ID NO: 92800 - RNA, 64 nt, Human
ggcugcaggccuugggcccggagggaaggccacugccggccacuuggggcagacacagacaccu

SEQ ID NO: 92801 - RNA, 64 nt, Human
gcucaucucgaacauccacgccagccuuucuggggccggccacccaggccgccuguccgucugu

SEQ ID NO: 92802 - RNA, 64 nt, Human
caacucgggcgccccggcuacagccccugacucugccggccagccccccgcccugggccccguc

SEQ ID NO: 92803 - RNA, 64 nt, Human
gcugccacccggguauagacaccugggaaguggggccggccacagccauagccccagcuaguga

SEQ ID NO: 92804 - RNA, 64 nt, Human
gccugaggccaggcccucugcacagaagccauaugccggccagccgcgccuccuccucugucca

SEQ ID NO: 92805 - RNA, 64 nt, Human
cuguuucccuccuucugcguggucccuuugacgggccggccaccguguccgaggcgcaacgcua

SEQ ID NO: 92806 - RNA, 64 nt, Human
caucuuuuuggagcccugucucacuugauugacagccggccaggcgcgguggcucacgccugua

SEQ ID NO: 92807 - RNA, 63 nt, Human
uagcaagaccacgucucuaaauaaaaaauaauaggccggccaggcacgguggcucacgccugu

SEQ ID NO: 92808 - RNA, 64 nt, Human
caggugcggggccgggaaccacacaccccacugggccggccacagucuggacccgcacguccug

SEQ ID NO: 92809 - RNA, 64 nt, Human
gcuggcggggucuccgccgccagcccugcagcgggccggccagagggggccccgggggggcggg

SEQ ID NO: 92810 - RNA, 64 nt, Human
acgcccuguucccuuccugcccuguggcccacgggccggccagcugggugccccagggacguga

SEQ ID NO: 92811 - RNA, 64 nt, Human
cugccccagugccuuuguccuucccuuggggcuugccggccagacuucucuccccugcggcucc

SEQ ID NO: 92812 - RNA, 64 nt, Human
ucccgucgcuguccucgcccuacauugaguacacgccggccagcccggccuacgcccaguaccc

SEQ ID NO: 92813 - RNA, 64 nt, Human
cccaggcgcacaggggccgccgguaacaggggccgccggccaaaggccccuuuccagucauagc

SEQ ID NO: 92814 - RNA, 63 nt, Human
ugcgcaccuuccuguccuaggccaggugccauggccggccaggugggcugcagagugggcucc

SEQ ID NO: 92815 - RNA, 64 nt, Human
cccagccugggccuugaccguccagcauucacuggccggccagcuguguccacagcaguuuuug

SEQ ID NO: 92816 - RNA, 64 nt, Human
gaagcucgcugcccagagccauguccagaacccagccggccaucuccauggugccaauuaccag

SEQ ID NO: 92817 - RNA, 64 nt, Human
aaggauggugaagcucagcaggggucugaggguagccggccagaagaggcuggaaccuccugcu

SEQ ID NO: 92818 - RNA, 64 nt, Human
uccuccgccagaggccacgggcgcccuuguucccgccggccagguccuaucaaaggaggcugcc

SEQ ID NO: 92819 - RNA, 64 nt, Human
uggaaaaacaggacaccagagcccaccagacagugccggccagcagagaagcagagagccagcg

SEQ ID NO: 92820 - RNA, 64 nt, Human
gcucggaggaagcccccaccgugggcagggagcggccggccagccccuggccccaggaccuggc

SEQ ID NO: 92821 - RNA, 64 nt, Human
gaagcugggcaggacacaggcgagcucaggugaugccggccaccagcaaugccuggccugguag

SEQ ID NO: 92822 - RNA, 64 nt, Human
gugcugcuucacauccuacagcugccuaggaaaggccggccacgcucccuguccacacacuccc

SEQ ID NO: 92823 - RNA, 51 nt, Human
ucauggagugcauugaguagggccggccagugcaaggccacugccugccga

SEQ ID NO: 92824 - RNA, 64 nt, Human
ggcccagucccagggccccaacacuauaccuugggccggccaggcagggcacccagacgggggg

SEQ ID NO: 92825 - RNA, 64 nt, Human; identical to SEQ ID NO: 92707

SEQ ID NO: 92826 - RNA, 64 nt, Human; identical to SEQ ID NO: 92708

SEQ ID NO: 92827 - RNA, 64 nt, Human; identical to SEQ ID NO: 92709

SEQ ID NO: 92828 - RNA, 64 nt, Human; identical to SEQ ID NO: 92710

SEQ ID NO: 92829 - RNA, 64 nt, Human; identical to SEQ ID NO: 92711

SEQ ID NO: 92830 - RNA, 64 nt, Human; identical to SEQ ID NO: 92712

SEQ ID NO: 92831 - RNA, 64 nt, Human; identical to SEQ ID NO: 92713

SEQ ID NO: 92832 - RNA, 64 nt, Human; identical to SEQ ID NO: 92714

SEQ ID NO: 92833 - RNA, 64 nt, Human; identical to SEQ ID NO: 92715

SEQ ID NO: 92834 - RNA, 64 nt, Human; identical to SEQ ID NO: 92716

SEQ ID NO: 92835 - RNA, 64 nt, Human; identical to SEQ ID NO: 92717

SEQ ID NO: 92836 - RNA, 64 nt, Human; identical to SEQ ID NO: 92718

SEQ ID NO: 92837 - RNA, 64 nt, Human; identical to SEQ ID NO: 92719

SEQ ID NO: 92838 - RNA, 64 nt, Human; identical to SEQ ID NO: 92720

SEQ ID NO: 92839 - RNA, 64 nt, Human; identical to SEQ ID NO: 92721

SEQ ID NO: 92840 - RNA, 64 nt, Human; identical to SEQ ID NO: 92722

SEQ ID NO: 92841 - RNA, 64 nt, Human; identical to SEQ ID NO: 92723

SEQ ID NO: 92842 - RNA, 64 nt, Human; identical to SEQ ID NO: 92724

SEQ ID NO: 92843 - RNA, 64 nt, Human; identical to SEQ ID NO: 92725

SEQ ID NO: 92844 - RNA, 64 nt, Human; identical to SEQ ID NO: 92726

SEQ ID NO: 92845 - RNA, 64 nt, Human; identical to SEQ ID NO: 92727

SEQ ID NO: 92846 - RNA, 64 nt, Human; identical to SEQ ID NO: 92728

SEQ ID NO: 92847 - RNA, 64 nt, Human; identical to SEQ ID NO: 92729

SEQ ID NO: 92848 - RNA, 51 nt, Human; identical to SEQ ID NO: 92730

SEQ ID NO: 92849 - RNA, 64 nt, Human; identical to SEQ ID NO: 92731

SEQ ID NO: 92850 - RNA, 64 nt, Human; identical to SEQ ID NO: 92732

SEQ ID NO: 92851 - RNA, 64 nt, Human; identical to SEQ ID NO: 92733

SEQ ID NO: 92852 - RNA, 64 nt, Human; identical to SEQ ID NO: 92734

SEQ ID NO: 92853 - RNA, 64 nt, Human; identical to SEQ ID NO: 92735

SEQ ID NO: 92854 - RNA, 64 nt, Human; identical to SEQ ID NO: 92736

SEQ ID NO: 92855 - RNA, 64 nt, Human; identical to SEQ ID NO: 92737

SEQ ID NO: 92856 - RNA, 64 nt, Human; identical to SEQ ID NO: 92738

SEQ ID NO: 92857 - RNA, 53 nt, Human; identical to SEQ ID NO: 92739

SEQ ID NO: 92858 - RNA, 64 nt, Human; identical to SEQ ID NO: 92740

SEQ ID NO: 92859 - RNA, 64 nt, Human; identical to SEQ ID NO: 92741

SEQ ID NO: 92860 - RNA, 64 nt, Human; identical to SEQ ID NO: 92742

SEQ ID NO: 92861 - RNA, 64 nt, Human; identical to SEQ ID NO: 92743

SEQ ID NO: 92862 - RNA, 64 nt, Human; identical to SEQ ID NO: 92744

SEQ ID NO: 92863 - RNA, 64 nt, Human; identical to SEQ ID NO: 92745

SEQ ID NO: 92864 - RNA, 56 nt, Human; identical to SEQ ID NO: 92746

SEQ ID NO: 92865 - RNA, 64 nt, Human; identical to SEQ ID NO: 92747

SEQ ID NO: 92866 - RNA, 64 nt, Human; identical to SEQ ID NO: 92748

SEQ ID NO: 92867 - RNA, 64 nt, Human; identical to SEQ ID NO: 92749

SEQ ID NO: 92868 - RNA, 64 nt, Human; identical to SEQ ID NO: 92750

SEQ ID NO: 92869 - RNA, 64 nt, Human; identical to SEQ ID NO: 92751

SEQ ID NO: 92870 - RNA, 64 nt, Human; identical to SEQ ID NO: 92752

SEQ ID NO: 92871 - RNA, 64 nt, Human; identical to SEQ ID NO: 92753

SEQ ID NO: 92872 - RNA, 57 nt, Human; identical to SEQ ID NO: 92754

SEQ ID NO: 92873 - RNA, 64 nt, Human; identical to SEQ ID NO: 92755

SEQ ID NO: 92874 - RNA, 64 nt, Human; identical to SEQ ID NO: 92756

SEQ ID NO: 92875 - RNA, 64 nt, Human; identical to SEQ ID NO: 92757

SEQ ID NO: 92876 - RNA, 64 nt, Human; identical to SEQ ID NO: 92758

SEQ ID NO: 92877 - RNA, 64 nt, Human; identical to SEQ ID NO: 92759

SEQ ID NO: 92878 - RNA, 64 nt, Human; identical to SEQ ID NO: 92760

SEQ ID NO: 92879 - RNA, 64 nt, Human; identical to SEQ ID NO: 92761

SEQ ID NO: 92880 - RNA, 64 nt, Human; identical to SEQ ID NO: 92762

SEQ ID NO: 92881 - RNA, 64 nt, Human; identical to SEQ ID NO: 92763

SEQ ID NO: 92882 - RNA, 64 nt, Human; identical to SEQ ID NO: 92764

SEQ ID NO: 92883 - RNA, 64 nt, Human; identical to SEQ ID NO: 92765

SEQ ID NO: 92884 - RNA, 64 nt, Human; identical to SEQ ID NO: 92766

SEQ ID NO: 92885 - RNA, 64 nt, Human; identical to SEQ ID NO: 92767

SEQ ID NO: 92886 - RNA, 64 nt, Human; identical to SEQ ID NO: 92768

SEQ ID NO: 92887 - RNA, 64 nt, Human; identical to SEQ ID NO: 92769

SEQ ID NO: 92888 - RNA, 64 nt, Human; identical to SEQ ID NO: 92770

SEQ ID NO: 92889 - RNA, 64 nt, Human; identical to SEQ ID NO: 92771

SEQ ID NO: 92890 - RNA, 64 nt, Human; identical to SEQ ID NO: 92772

SEQ ID NO: 92891 - RNA, 64 nt, Human; identical to SEQ ID NO: 92773

SEQ ID NO: 92892 - RNA, 64 nt, Human; identical to SEQ ID NO: 92774

SEQ ID NO: 92893 - RNA, 64 nt, Human; identical to SEQ ID NO: 92775

SEQ ID NO: 92894 - RNA, 64 nt, Human; identical to SEQ ID NO: 92776

SEQ ID NO: 92895 - RNA, 64 nt, Human; identical to SEQ ID NO: 92777

SEQ ID NO: 92896 - RNA, 64 nt, Human; identical to SEQ ID NO: 92778

SEQ ID NO: 92897 - RNA, 64 nt, Human; identical to SEQ ID NO: 92779

SEQ ID NO: 92898 - RNA, 64 nt, Human; identical to SEQ ID NO: 92780

SEQ ID NO: 92899 - RNA, 64 nt, Human; identical to SEQ ID NO: 92781

SEQ ID NO: 92900 - RNA, 64 nt, Human; identical to SEQ ID NO: 92782

SEQ ID NO: 92901 - RNA, 64 nt, Human; identical to SEQ ID NO: 92783

SEQ ID NO: 92902 - RNA, 64 nt, Human; identical to SEQ ID NO: 92784

SEQ ID NO: 92903 - RNA, 64 nt, Human; identical to SEQ ID NO: 92785

SEQ ID NO: 92904 - RNA, 64 nt, Human; identical to SEQ ID NO: 92786

SEQ ID NO: 92905 - RNA, 64 nt, Human; identical to SEQ ID NO: 92787

SEQ ID NO: 92906 - RNA, 64 nt, Human; identical to SEQ ID NO: 92788

SEQ ID NO: 92907 - RNA, 64 nt, Human; identical to SEQ ID NO: 92789

SEQ ID NO: 92908 - RNA, 53 nt, Human; identical to SEQ ID NO: 92790

SEQ ID NO: 92909 - RNA, 64 nt, Human; identical to SEQ ID NO: 92791

SEQ ID NO: 92910 - RNA, 64 nt, Human; identical to SEQ ID NO: 92792

SEQ ID NO: 92911 - RNA, 64 nt, Human; identical to SEQ ID NO: 92793

SEQ ID NO: 92912 - RNA, 64 nt, Human; identical to SEQ ID NO: 92794

SEQ ID NO: 92913 - RNA, 64 nt, Human; identical to SEQ ID NO: 92795

SEQ ID NO: 92914 - RNA, 64 nt, Human; identical to SEQ ID NO: 92796

SEQ ID NO: 92915 - RNA, 64 nt, Human; identical to SEQ ID NO: 92797

SEQ ID NO: 92916 - RNA, 64 nt, Human; identical to SEQ ID NO: 92798

SEQ ID NO: 92917 - RNA, 64 nt, Human; identical to SEQ ID NO: 92799

SEQ ID NO: 92918 - RNA, 64 nt, Human; identical to SEQ ID NO: 92800

SEQ ID NO: 92919 - RNA, 64 nt, Human; identical to SEQ ID NO: 92801

SEQ ID NO: 92920 - RNA, 64 nt, Human; identical to SEQ ID NO: 92802

SEQ ID NO: 92921 - RNA, 64 nt, Human; identical to SEQ ID NO: 92803

SEQ ID NO: 92922 - RNA, 64 nt, Human; identical to SEQ ID NO: 92804

SEQ ID NO: 92923 - RNA, 64 nt, Human; identical to SEQ ID NO: 92805

SEQ ID NO: 92924 - RNA, 64 nt, Human; identical to SEQ ID NO: 92806

SEQ ID NO: 92925 - RNA, 63 nt, Human; identical to SEQ ID NO: 92807

SEQ ID NO: 92926 - RNA, 64 nt, Human; identical to SEQ ID NO: 92808

SEQ ID NO: 92927 - RNA, 64 nt, Human; identical to SEQ ID NO: 92809

SEQ ID NO: 92928 - RNA, 64 nt, Human; identical to SEQ ID NO: 92810

SEQ ID NO: 92929 - RNA, 64 nt, Human; identical to SEQ ID NO: 92811

SEQ ID NO: 92930 - RNA, 64 nt, Human; identical to SEQ ID NO: 92812

SEQ ID NO: 92931 - RNA, 64 nt, Human; identical to SEQ ID NO: 92813

SEQ ID NO: 92932 - RNA, 63 nt, Human; identical to SEQ ID NO: 92814

SEQ ID NO: 92933 - RNA, 64 nt, Human; identical to SEQ ID NO: 92815

SEQ ID NO: 92934 - RNA, 64 nt, Human; identical to SEQ ID NO: 92816

SEQ ID NO: 92935 - RNA, 64 nt, Human; identical to SEQ ID NO: 92817

SEQ ID NO: 92936 - RNA, 64 nt, Human; identical to SEQ ID NO: 92818

SEQ ID NO: 92937 - RNA, 64 nt, Human; identical to SEQ ID NO: 92819

SEQ ID NO: 92938 - RNA, 64 nt, Human; identical to SEQ ID NO: 92820

SEQ ID NO: 92939 - RNA, 64 nt, Human; identical to SEQ ID NO: 92821

SEQ ID NO: 92940 - RNA, 64 nt, Human; identical to SEQ ID NO: 92822

SEQ ID NO: 92941 - RNA, 51 nt, Human; identical to SEQ ID NO: 92823

SEQ ID NO: 92942 - RNA, 64 nt, Human; identical to SEQ ID NO: 92824

SEQ ID NO: 92943 - RNA, 64 nt, Human; identical to SEQ ID NO: 92707

SEQ ID NO: 92944 - RNA, 64 nt, Human; identical to SEQ ID NO: 92708

SEQ ID NO: 92945 - RNA, 64 nt, Human; identical to SEQ ID NO: 92709

SEQ ID NO: 92946 - RNA, 64 nt, Human; identical to SEQ ID NO: 92710

SEQ ID NO: 92947 - RNA, 64 nt, Human; identical to SEQ ID NO: 92711

SEQ ID NO: 92948 - RNA, 64 nt, Human; identical to SEQ ID NO: 92712

SEQ ID NO: 92949 - RNA, 64 nt, Human; identical to SEQ ID NO: 92713

SEQ ID NO: 92950 - RNA, 64 nt, Human; identical to SEQ ID NO: 92714

SEQ ID NO: 92951 - RNA, 64 nt, Human; identical to SEQ ID NO: 92715

SEQ ID NO: 92952 - RNA, 64 nt, Human; identical to SEQ ID NO: 92716

SEQ ID NO: 92953 - RNA, 64 nt, Human; identical to SEQ ID NO: 92717

SEQ ID NO: 92954 - RNA, 64 nt, Human; identical to SEQ ID NO: 92718

SEQ ID NO: 92955 - RNA, 64 nt, Human; identical to SEQ ID NO: 92719

SEQ ID NO: 92956 - RNA, 64 nt, Human; identical to SEQ ID NO: 92720

SEQ ID NO: 92957 - RNA, 64 nt, Human; identical to SEQ ID NO: 92721

SEQ ID NO: 92958 - RNA, 64 nt, Human; identical to SEQ ID NO: 92722

SEQ ID NO: 92959 - RNA, 64 nt, Human; identical to SEQ ID NO: 92723

SEQ ID NO: 92960 - RNA, 64 nt, Human; identical to SEQ ID NO: 92724

SEQ ID NO: 92961 - RNA, 64 nt, Human; identical to SEQ ID NO: 92725

SEQ ID NO: 92962 - RNA, 64 nt, Human; identical to SEQ ID NO: 92726

SEQ ID NO: 92963 - RNA, 64 nt, Human; identical to SEQ ID NO: 92727

SEQ ID NO: 92964 - RNA, 64 nt, Human; identical to SEQ ID NO: 92728

SEQ ID NO: 92965 - RNA, 64 nt, Human; identical to SEQ ID NO: 92729

SEQ ID NO: 92966 - RNA, 51 nt, Human; identical to SEQ ID NO: 92730

SEQ ID NO: 92967 - RNA, 64 nt, Human; identical to SEQ ID NO: 92731

SEQ ID NO: 92968 - RNA, 64 nt, Human; identical to SEQ ID NO: 92732

SEQ ID NO: 92969 - RNA, 64 nt, Human; identical to SEQ ID NO: 92733

SEQ ID NO: 92970 - RNA, 64 nt, Human; identical to SEQ ID NO: 92734

SEQ ID NO: 92971 - RNA, 64 nt, Human; identical to SEQ ID NO: 92735

SEQ ID NO: 92972 - RNA, 64 nt, Human; identical to SEQ ID NO: 92736

SEQ ID NO: 92973 - RNA, 64 nt, Human; identical to SEQ ID NO: 92737

SEQ ID NO: 92974 - RNA, 64 nt, Human; identical to SEQ ID NO: 92738

SEQ ID NO: 92975 - RNA, 53 nt, Human; identical to SEQ ID NO: 92739

SEQ ID NO: 92976 - RNA, 64 nt, Human; identical to SEQ ID NO: 92740

SEQ ID NO: 92977 - RNA, 64 nt, Human; identical to SEQ ID NO: 92741

SEQ ID NO: 92978 - RNA, 64 nt, Human; identical to SEQ ID NO: 92742

SEQ ID NO: 92979 - RNA, 64 nt, Human; identical to SEQ ID NO: 92743

SEQ ID NO: 92980 - RNA, 64 nt, Human; identical to SEQ ID NO: 92744

SEQ ID NO: 92981 - RNA, 64 nt, Human; identical to SEQ ID NO: 92745

SEQ ID NO: 92982 - RNA, 56 nt, Human; identical to SEQ ID NO: 92746

SEQ ID NO: 92983 - RNA, 64 nt, Human; identical to SEQ ID NO: 92747

SEQ ID NO: 92984 - RNA, 64 nt, Human; identical to SEQ ID NO: 92748

SEQ ID NO: 92985 - RNA, 64 nt, Human; identical to SEQ ID NO: 92749

SEQ ID NO: 92986 - RNA, 64 nt, Human; identical to SEQ ID NO: 92750

SEQ ID NO: 92987 - RNA, 64 nt, Human; identical to SEQ ID NO: 92751

SEQ ID NO: 92988 - RNA, 64 nt, Human; identical to SEQ ID NO: 92752

SEQ ID NO: 92989 - RNA, 64 nt, Human; identical to SEQ ID NO: 92753

SEQ ID NO: 92990 - RNA, 57 nt, Human; identical to SEQ ID NO: 92754

SEQ ID NO: 92991 - RNA, 64 nt, Human; identical to SEQ ID NO: 92755

SEQ ID NO: 92992 - RNA, 64 nt, Human; identical to SEQ ID NO: 92756

SEQ ID NO: 92993 - RNA, 64 nt, Human; identical to SEQ ID NO: 92757

SEQ ID NO: 92994 - RNA, 64 nt, Human; identical to SEQ ID NO: 92758

SEQ ID NO: 92995 - RNA, 64 nt, Human; identical to SEQ ID NO: 92759

SEQ ID NO: 92996 - RNA, 64 nt, Human; identical to SEQ ID NO: 92760

SEQ ID NO: 92997 - RNA, 64 nt, Human; identical to SEQ ID NO: 92761

SEQ ID NO: 92998 - RNA, 64 nt, Human; identical to SEQ ID NO: 92762

SEQ ID NO: 92999 - RNA, 64 nt, Human; identical to SEQ ID NO: 92763

SEQ ID NO: 93000 - RNA, 64 nt, Human; identical to SEQ ID NO: 92764

SEQ ID NO: 93001 - RNA, 64 nt, Human; identical to SEQ ID NO: 92765

SEQ ID NO: 93002 - RNA, 64 nt, Human; identical to SEQ ID NO: 92766

SEQ ID NO: 93003 - RNA, 64 nt, Human; identical to SEQ ID NO: 92767

SEQ ID NO: 93004 - RNA, 64 nt, Human; identical to SEQ ID NO: 92768

SEQ ID NO: 93005 - RNA, 64 nt, Human; identical to SEQ ID NO: 92769

SEQ ID NO: 93006 - RNA, 64 nt, Human; identical to SEQ ID NO: 92770

SEQ ID NO: 93007 - RNA, 64 nt, Human; identical to SEQ ID NO: 92771

SEQ ID NO: 93008 - RNA, 64 nt, Human; identical to SEQ ID NO: 92772

SEQ ID NO: 93009 - RNA, 64 nt, Human; identical to SEQ ID NO: 92773

SEQ ID NO: 93010 - RNA, 64 nt, Human; identical to SEQ ID NO: 92774

SEQ ID NO: 93011 - RNA, 64 nt, Human; identical to SEQ ID NO: 92775

SEQ ID NO: 93012 - RNA, 64 nt, Human; identical to SEQ ID NO: 92776

SEQ ID NO: 93013 - RNA, 64 nt, Human; identical to SEQ ID NO: 92777

SEQ ID NO: 93014 - RNA, 64 nt, Human; identical to SEQ ID NO: 92778

SEQ ID NO: 93015 - RNA, 64 nt, Human; identical to SEQ ID NO: 92779

SEQ ID NO: 93016 - RNA, 64 nt, Human; identical to SEQ ID NO: 92780

SEQ ID NO: 93017 - RNA, 64 nt, Human; identical to SEQ ID NO: 92781

SEQ ID NO: 93018 - RNA, 64 nt, Human; identical to SEQ ID NO: 92782

SEQ ID NO: 93019 - RNA, 64 nt, Human; identical to SEQ ID NO: 92783

SEQ ID NO: 93020 - RNA, 64 nt, Human; identical to SEQ ID NO: 92784

SEQ ID NO: 93021 - RNA, 64 nt, Human; identical to SEQ ID NO: 92785

SEQ ID NO: 93022 - RNA, 64 nt, Human; identical to SEQ ID NO: 92786

SEQ ID NO: 93023 - RNA, 64 nt, Human; identical to SEQ ID NO: 92787

SEQ ID NO: 93024 - RNA, 64 nt, Human; identical to SEQ ID NO: 92788

SEQ ID NO: 93025 - RNA, 64 nt, Human; identical to SEQ ID NO: 92789

SEQ ID NO: 93026 - RNA, 53 nt, Human; identical to SEQ ID NO: 92790

SEQ ID NO: 93027 - RNA, 64 nt, Human; identical to SEQ ID NO: 92791

SEQ ID NO: 93028 - RNA, 64 nt, Human; identical to SEQ ID NO: 92792

SEQ ID NO: 93029 - RNA, 64 nt, Human; identical to SEQ ID NO: 92793

SEQ ID NO: 93030 - RNA, 64 nt, Human; identical to SEQ ID NO: 92794

SEQ ID NO: 93031 - RNA, 64 nt, Human; identical to SEQ ID NO: 92795

SEQ ID NO: 93032 - RNA, 64 nt, Human; identical to SEQ ID NO: 92796

SEQ ID NO: 93033 - RNA, 64 nt, Human; identical to SEQ ID NO: 92797

SEQ ID NO: 93034 - RNA, 64 nt, Human; identical to SEQ ID NO: 92798

SEQ ID NO: 93035 - RNA, 64 nt, Human; identical to SEQ ID NO: 92799

SEQ ID NO: 93036 - RNA, 64 nt, Human; identical to SEQ ID NO: 92800

SEQ ID NO: 93037 - RNA, 64 nt, Human; identical to SEQ ID NO: 92801

SEQ ID NO: 93038 - RNA, 64 nt, Human; identical to SEQ ID NO: 92802

SEQ ID NO: 93039 - RNA, 64 nt, Human; identical to SEQ ID NO: 92803

SEQ ID NO: 93040 - RNA, 64 nt, Human; identical to SEQ ID NO: 92804

SEQ ID NO: 93041 - RNA, 64 nt, Human; identical to SEQ ID NO: 92805

SEQ ID NO: 93042 - RNA, 64 nt, Human; identical to SEQ ID NO: 92806

SEQ ID NO: 93043 - RNA, 63 nt, Human; identical to SEQ ID NO: 92807

SEQ ID NO: 93044 - RNA, 64 nt, Human; identical to SEQ ID NO: 92808

SEQ ID NO: 93045 - RNA, 64 nt, Human; identical to SEQ ID NO: 92809

SEQ ID NO: 93046 - RNA, 64 nt, Human; identical to SEQ ID NO: 92810

SEQ ID NO: 93047 - RNA, 64 nt, Human; identical to SEQ ID NO: 92811

SEQ ID NO: 93048 - RNA, 64 nt, Human; identical to SEQ ID NO: 92812

SEQ ID NO: 93049 - RNA, 64 nt, Human; identical to SEQ ID NO: 92813

SEQ ID NO: 93050 - RNA, 63 nt, Human; identical to SEQ ID NO: 92814

SEQ ID NO: 93051 - RNA, 64 nt, Human; identical to SEQ ID NO: 92815

SEQ ID NO: 93052 - RNA, 64 nt, Human; identical to SEQ ID NO: 92816

SEQ ID NO: 93053 - RNA, 64 nt, Human; identical to SEQ ID NO: 92817

SEQ ID NO: 93054 - RNA, 64 nt, Human; identical to SEQ ID NO: 92818

SEQ ID NO: 93055 - RNA, 64 nt, Human; identical to SEQ ID NO: 92819

SEQ ID NO: 93056 - RNA, 64 nt, Human; identical to SEQ ID NO: 92820

SEQ ID NO: 93057 - RNA, 64 nt, Human; identical to SEQ ID NO: 92821

SEQ ID NO: 93058 - RNA, 64 nt, Human; identical to SEQ ID NO: 92822

SEQ ID NO: 93059 - RNA, 51 nt, Human; identical to SEQ ID NO: 92823

SEQ ID NO: 93060 - RNA, 64 nt, Human; identical to SEQ ID NO: 92824

SEQ ID NO: 93061 - RNA, 64 nt, Human; identical to SEQ ID NO: 92707

SEQ ID NO: 93062 - RNA, 64 nt, Human; identical to SEQ ID NO: 92708

SEQ ID NO: 93063 - RNA, 64 nt, Human; identical to SEQ ID NO: 92709

SEQ ID NO: 93064 - RNA, 64 nt, Human; identical to SEQ ID NO: 92710

SEQ ID NO: 93065 - RNA, 64 nt, Human; identical to SEQ ID NO: 92711

SEQ ID NO: 93066 - RNA, 64 nt, Human; identical to SEQ ID NO: 92712

SEQ ID NO: 93067 - RNA, 64 nt, Human; identical to SEQ ID NO: 92713

SEQ ID NO: 93068 - RNA, 64 nt, Human; identical to SEQ ID NO: 92714

SEQ ID NO: 93069 - RNA, 64 nt, Human; identical to SEQ ID NO: 92715

SEQ ID NO: 93070 - RNA, 64 nt, Human; identical to SEQ ID NO: 92716

SEQ ID NO: 93071 - RNA, 64 nt, Human; identical to SEQ ID NO: 92717

SEQ ID NO: 93072 - RNA, 64 nt, Human; identical to SEQ ID NO: 92718

SEQ ID NO: 93073 - RNA, 64 nt, Human; identical to SEQ ID NO: 92719

SEQ ID NO: 93074 - RNA, 64 nt, Human; identical to SEQ ID NO: 92720

SEQ ID NO: 93075 - RNA, 64 nt, Human; identical to SEQ ID NO: 92721

SEQ ID NO: 93076 - RNA, 64 nt, Human; identical to SEQ ID NO: 92722

SEQ ID NO: 93077 - RNA, 64 nt, Human; identical to SEQ ID NO: 92723

SEQ ID NO: 93078 - RNA, 64 nt, Human; identical to SEQ ID NO: 92724

SEQ ID NO: 93079 - RNA, 64 nt, Human; identical to SEQ ID NO: 92725

SEQ ID NO: 93080 - RNA, 64 nt, Human; identical to SEQ ID NO: 92726

SEQ ID NO: 93081 - RNA, 64 nt, Human; identical to SEQ ID NO: 92727

SEQ ID NO: 93082 - RNA, 64 nt, Human; identical to SEQ ID NO: 92728

SEQ ID NO: 93083 - RNA, 64 nt, Human; identical to SEQ ID NO: 92729

SEQ ID NO: 93084 - RNA, 51 nt, Human; identical to SEQ ID NO: 92730

SEQ ID NO: 93085 - RNA, 64 nt, Human; identical to SEQ ID NO: 92731

SEQ ID NO: 93086 - RNA, 64 nt, Human; identical to SEQ ID NO: 92732

SEQ ID NO: 93087 - RNA, 64 nt, Human; identical to SEQ ID NO: 92733

SEQ ID NO: 93088 - RNA, 64 nt, Human; identical to SEQ ID NO: 92734

SEQ ID NO: 93089 - RNA, 64 nt, Human; identical to SEQ ID NO: 92735

SEQ ID NO: 93090 - RNA, 64 nt, Human; identical to SEQ ID NO: 92736

SEQ ID NO: 93091 - RNA, 64 nt, Human; identical to SEQ ID NO: 92737

SEQ ID NO: 93092 - RNA, 64 nt, Human; identical to SEQ ID NO: 92738

SEQ ID NO: 93093 - RNA, 53 nt, Human; identical to SEQ ID NO: 92739

SEQ ID NO: 93094 - RNA, 64 nt, Human; identical to SEQ ID NO: 92740

SEQ ID NO: 93095 - RNA, 64 nt, Human; identical to SEQ ID NO: 92741

SEQ ID NO: 93096 - RNA, 64 nt, Human; identical to SEQ ID NO: 92742

SEQ ID NO: 93097 - RNA, 64 nt, Human; identical to SEQ ID NO: 92743

SEQ ID NO: 93098 - RNA, 64 nt, Human; identical to SEQ ID NO: 92744

SEQ ID NO: 93099 - RNA, 64 nt, Human; identical to SEQ ID NO: 92745

SEQ ID NO: 93100 - RNA, 56 nt, Human; identical to SEQ ID NO: 92746

SEQ ID NO: 93101 - RNA, 64 nt, Human; identical to SEQ ID NO: 92747

SEQ ID NO: 93102 - RNA, 64 nt, Human; identical to SEQ ID NO: 92748

SEQ ID NO: 93103 - RNA, 64 nt, Human; identical to SEQ ID NO: 92749

SEQ ID NO: 93104 - RNA, 64 nt, Human; identical to SEQ ID NO: 92750

SEQ ID NO: 93105 - RNA, 64 nt, Human; identical to SEQ ID NO: 92751

SEQ ID NO: 93106 - RNA, 64 nt, Human; identical to SEQ ID NO: 92752

SEQ ID NO: 93107 - RNA, 64 nt, Human; identical to SEQ ID NO: 92753

SEQ ID NO: 93108 - RNA, 57 nt, Human; identical to SEQ ID NO: 92754

SEQ ID NO: 93109 - RNA, 64 nt, Human; identical to SEQ ID NO: 92755

SEQ ID NO: 93110 - RNA, 64 nt, Human; identical to SEQ ID NO: 92756

SEQ ID NO: 93111 - RNA, 64 nt, Human; identical to SEQ ID NO: 92757

SEQ ID NO: 93112 - RNA, 64 nt, Human; identical to SEQ ID NO: 92758

SEQ ID NO: 93113 - RNA, 64 nt, Human; identical to SEQ ID NO: 92759

SEQ ID NO: 93114 - RNA, 64 nt, Human; identical to SEQ ID NO: 92760

SEQ ID NO: 93115 - RNA, 64 nt, Human; identical to SEQ ID NO: 92761

SEQ ID NO: 93116 - RNA, 64 nt, Human; identical to SEQ ID NO: 92762

SEQ ID NO: 93117 - RNA, 64 nt, Human; identical to SEQ ID NO: 92763

SEQ ID NO: 93118 - RNA, 64 nt, Human; identical to SEQ ID NO: 92764

SEQ ID NO: 93119 - RNA, 64 nt, Human; identical to SEQ ID NO: 92765

SEQ ID NO: 93120 - RNA, 64 nt, Human; identical to SEQ ID NO: 92766

SEQ ID NO: 93121 - RNA, 64 nt, Human; identical to SEQ ID NO: 92767

SEQ ID NO: 93122 - RNA, 64 nt, Human; identical to SEQ ID NO: 92768

SEQ ID NO: 93123 - RNA, 64 nt, Human; identical to SEQ ID NO: 92769

SEQ ID NO: 93124 - RNA, 64 nt, Human; identical to SEQ ID NO: 92770

SEQ ID NO: 93125 - RNA, 64 nt, Human; identical to SEQ ID NO: 92771

SEQ ID NO: 93126 - RNA, 64 nt, Human; identical to SEQ ID NO: 92772

SEQ ID NO: 93127 - RNA, 64 nt, Human; identical to SEQ ID NO: 92773

SEQ ID NO: 93128 - RNA, 64 nt, Human; identical to SEQ ID NO: 92774

SEQ ID NO: 93129 - RNA, 64 nt, Human; identical to SEQ ID NO: 92775

SEQ ID NO: 93130 - RNA, 64 nt, Human; identical to SEQ ID NO: 92776

SEQ ID NO: 93131 - RNA, 64 nt, Human; identical to SEQ ID NO: 92777

SEQ ID NO: 93132 - RNA, 64 nt, Human; identical to SEQ ID NO: 92778

SEQ ID NO: 93133 - RNA, 64 nt, Human; identical to SEQ ID NO: 92779

SEQ ID NO: 93134 - RNA, 64 nt, Human; identical to SEQ ID NO: 92780

SEQ ID NO: 93135 - RNA, 64 nt, Human; identical to SEQ ID NO: 92781

SEQ ID NO: 93136 - RNA, 64 nt, Human; identical to SEQ ID NO: 92782

SEQ ID NO: 93137 - RNA, 64 nt, Human; identical to SEQ ID NO: 92783

SEQ ID NO: 93138 - RNA, 64 nt, Human; identical to SEQ ID NO: 92784

SEQ ID NO: 93139 - RNA, 64 nt, Human; identical to SEQ ID NO: 92785

SEQ ID NO: 93140 - RNA, 64 nt, Human; identical to SEQ ID NO: 92786

SEQ ID NO: 93141 - RNA, 64 nt, Human; identical to SEQ ID NO: 92787

SEQ ID NO: 93142 - RNA, 64 nt, Human; identical to SEQ ID NO: 92788

SEQ ID NO: 93143 - RNA, 64 nt, Human; identical to SEQ ID NO: 92789

SEQ ID NO: 93144 - RNA, 53 nt, Human; identical to SEQ ID NO: 92790

SEQ ID NO: 93145 - RNA, 64 nt, Human; identical to SEQ ID NO: 92791

SEQ ID NO: 93146 - RNA, 64 nt, Human; identical to SEQ ID NO: 92792

SEQ ID NO: 93147 - RNA, 64 nt, Human; identical to SEQ ID NO: 92793

SEQ ID NO: 93148 - RNA, 64 nt, Human; identical to SEQ ID NO: 92794

SEQ ID NO: 93149 - RNA, 64 nt, Human; identical to SEQ ID NO: 92795

SEQ ID NO: 93150 - RNA, 64 nt, Human; identical to SEQ ID NO: 92796

SEQ ID NO: 93151 - RNA, 64 nt, Human; identical to SEQ ID NO: 92797

SEQ ID NO: 93152 - RNA, 64 nt, Human; identical to SEQ ID NO: 92798

SEQ ID NO: 93153 - RNA, 64 nt, Human; identical to SEQ ID NO: 92799

SEQ ID NO: 93154 - RNA, 64 nt, Human; identical to SEQ ID NO: 92800

SEQ ID NO: 93155 - RNA, 64 nt, Human; identical to SEQ ID NO: 92801

SEQ ID NO: 93156 - RNA, 64 nt, Human; identical to SEQ ID NO: 92802

SEQ ID NO: 93157 - RNA, 64 nt, Human; identical to SEQ ID NO: 92803

SEQ ID NO: 93158 - RNA, 64 nt, Human; identical to SEQ ID NO: 92804

SEQ ID NO: 93159 - RNA, 64 nt, Human; identical to SEQ ID NO: 92805

SEQ ID NO: 93160 - RNA, 64 nt, Human; identical to SEQ ID NO: 92806

SEQ ID NO: 93161 - RNA, 63 nt, Human; identical to SEQ ID NO: 92807

SEQ ID NO: 93162 - RNA, 64 nt, Human; identical to SEQ ID NO: 92808

SEQ ID NO: 93163 - RNA, 64 nt, Human; identical to SEQ ID NO: 92809

SEQ ID NO: 93164 - RNA, 64 nt, Human; identical to SEQ ID NO: 92810

SEQ ID NO: 93165 - RNA, 64 nt, Human; identical to SEQ ID NO: 92811

SEQ ID NO: 93166 - RNA, 64 nt, Human; identical to SEQ ID NO: 92812

SEQ ID NO: 93167 - RNA, 64 nt, Human; identical to SEQ ID NO: 92813

SEQ ID NO: 93168 - RNA, 63 nt, Human; identical to SEQ ID NO: 92814

SEQ ID NO: 93169 - RNA, 64 nt, Human; identical to SEQ ID NO: 92815

SEQ ID NO: 93170 - RNA, 64 nt, Human; identical to SEQ ID NO: 92816

SEQ ID NO: 93171 - RNA, 64 nt, Human; identical to SEQ ID NO: 92817

SEQ ID NO: 93172 - RNA, 64 nt, Human; identical to SEQ ID NO: 92818

SEQ ID NO: 93173 - RNA, 64 nt, Human; identical to SEQ ID NO: 92819

SEQ ID NO: 93174 - RNA, 64 nt, Human; identical to SEQ ID NO: 92820

SEQ ID NO: 93175 - RNA, 64 nt, Human; identical to SEQ ID NO: 92821

SEQ ID NO: 93176 - RNA, 64 nt, Human; identical to SEQ ID NO: 92822

SEQ ID NO: 93177 - RNA, 51 nt, Human; identical to SEQ ID NO: 92823

SEQ ID NO: 93178 - RNA, 64 nt, Human; identical to SEQ ID NO: 92824

SEQ ID NO: 93179 - RNA, 64 nt, Human; identical to SEQ ID NO: 92707

SEQ ID NO: 93180 - RNA, 64 nt, Human; identical to SEQ ID NO: 92708

SEQ ID NO: 93181 - RNA, 64 nt, Human; identical to SEQ ID NO: 92709

SEQ ID NO: 93182 - RNA, 64 nt, Human; identical to SEQ ID NO: 92710

SEQ ID NO: 93183 - RNA, 64 nt, Human; identical to SEQ ID NO: 92711

SEQ ID NO: 93184 - RNA, 64 nt, Human; identical to SEQ ID NO: 92712

SEQ ID NO: 93185 - RNA, 64 nt, Human; identical to SEQ ID NO: 92713

SEQ ID NO: 93186 - RNA, 64 nt, Human; identical to SEQ ID NO: 92714

SEQ ID NO: 93187 - RNA, 64 nt, Human; identical to SEQ ID NO: 92715

SEQ ID NO: 93188 - RNA, 64 nt, Human; identical to SEQ ID NO: 92716

SEQ ID NO: 93189 - RNA, 64 nt, Human; identical to SEQ ID NO: 92717

SEQ ID NO: 93190 - RNA, 64 nt, Human; identical to SEQ ID NO: 92718

SEQ ID NO: 93191 - RNA, 64 nt, Human; identical to SEQ ID NO: 92719

SEQ ID NO: 93192 - RNA, 64 nt, Human; identical to SEQ ID NO: 92720

SEQ ID NO: 93193 - RNA, 64 nt, Human; identical to SEQ ID NO: 92721

SEQ ID NO: 93194 - RNA, 64 nt, Human; identical to SEQ ID NO: 92722

SEQ ID NO: 93195 - RNA, 64 nt, Human; identical to SEQ ID NO: 92723

SEQ ID NO: 93196 - RNA, 64 nt, Human; identical to SEQ ID NO: 92724

SEQ ID NO: 93197 - RNA, 64 nt, Human; identical to SEQ ID NO: 92725

SEQ ID NO: 93198 - RNA, 64 nt, Human; identical to SEQ ID NO: 92726

SEQ ID NO: 93199 - RNA, 64 nt, Human; identical to SEQ ID NO: 92727

SEQ ID NO: 93200 - RNA, 64 nt, Human; identical to SEQ ID NO: 92728

SEQ ID NO: 93201 - RNA, 64 nt, Human; identical to SEQ ID NO: 92729

SEQ ID NO: 93202 - RNA, 51 nt, Human; identical to SEQ ID NO: 92730

SEQ ID NO: 93203 - RNA, 64 nt, Human; identical to SEQ ID NO: 92731

SEQ ID NO: 93204 - RNA, 64 nt, Human; identical to SEQ ID NO: 92732

SEQ ID NO: 93205 - RNA, 64 nt, Human; identical to SEQ ID NO: 92733

SEQ ID NO: 93206 - RNA, 64 nt, Human; identical to SEQ ID NO: 92734

SEQ ID NO: 93207 - RNA, 64 nt, Human; identical to SEQ ID NO: 92735

SEQ ID NO: 93208 - RNA, 64 nt, Human; identical to SEQ ID NO: 92736

SEQ ID NO: 93209 - RNA, 64 nt, Human; identical to SEQ ID NO: 92737

SEQ ID NO: 93210 - RNA, 64 nt, Human; identical to SEQ ID NO: 92738

SEQ ID NO: 93211 - RNA, 53 nt, Human; identical to SEQ ID NO: 92739

SEQ ID NO: 93212 - RNA, 64 nt, Human; identical to SEQ ID NO: 92740

SEQ ID NO: 93213 - RNA, 64 nt, Human; identical to SEQ ID NO: 92741

SEQ ID NO: 93214 - RNA, 64 nt, Human; identical to SEQ ID NO: 92742

SEQ ID NO: 93215 - RNA, 64 nt, Human; identical to SEQ ID NO: 92743

SEQ ID NO: 93216 - RNA, 64 nt, Human; identical to SEQ ID NO: 92744

SEQ ID NO: 93217 - RNA, 64 nt, Human; identical to SEQ ID NO: 92745

SEQ ID NO: 93218 - RNA, 56 nt, Human; identical to SEQ ID NO: 92746

SEQ ID NO: 93219 - RNA, 64 nt, Human; identical to SEQ ID NO: 92747

SEQ ID NO: 93220 - RNA, 64 nt, Human; identical to SEQ ID NO: 92748

SEQ ID NO: 93221 - RNA, 64 nt, Human; identical to SEQ ID NO: 92749

SEQ ID NO: 93222 - RNA, 64 nt, Human; identical to SEQ ID NO: 92750

SEQ ID NO: 93223 - RNA, 64 nt, Human; identical to SEQ ID NO: 92751

SEQ ID NO: 93224 - RNA, 64 nt, Human; identical to SEQ ID NO: 92752

SEQ ID NO: 93225 - RNA, 64 nt, Human; identical to SEQ ID NO: 92753

SEQ ID NO: 93226 - RNA, 57 nt, Human; identical to SEQ ID NO: 92754

SEQ ID NO: 93227 - RNA, 64 nt, Human; identical to SEQ ID NO: 92755

SEQ ID NO: 93228 - RNA, 64 nt, Human; identical to SEQ ID NO: 92756

SEQ ID NO: 93229 - RNA, 64 nt, Human; identical to SEQ ID NO: 92757

SEQ ID NO: 93230 - RNA, 64 nt, Human; identical to SEQ ID NO: 92758

SEQ ID NO: 93231 - RNA, 64 nt, Human; identical to SEQ ID NO: 92759

SEQ ID NO: 93232 - RNA, 64 nt, Human; identical to SEQ ID NO: 92760

SEQ ID NO: 93233 - RNA, 64 nt, Human; identical to SEQ ID NO: 92761

SEQ ID NO: 93234 - RNA, 64 nt, Human; identical to SEQ ID NO: 92762

SEQ ID NO: 93235 - RNA, 64 nt, Human; identical to SEQ ID NO: 92763

SEQ ID NO: 93236 - RNA, 64 nt, Human; identical to SEQ ID NO: 92764

SEQ ID NO: 93237 - RNA, 64 nt, Human; identical to SEQ ID NO: 92765

SEQ ID NO: 93238 - RNA, 64 nt, Human; identical to SEQ ID NO: 92766

SEQ ID NO: 93239 - RNA, 64 nt, Human; identical to SEQ ID NO: 92767

SEQ ID NO: 93240 - RNA, 64 nt, Human; identical to SEQ ID NO: 92768

SEQ ID NO: 93241 - RNA, 64 nt, Human; identical to SEQ ID NO: 92769

SEQ ID NO: 93242 - RNA, 64 nt, Human; identical to SEQ ID NO: 92770

SEQ ID NO: 93243 - RNA, 64 nt, Human; identical to SEQ ID NO: 92771

SEQ ID NO: 93244 - RNA, 64 nt, Human; identical to SEQ ID NO: 92772

SEQ ID NO: 93245 - RNA, 64 nt, Human; identical to SEQ ID NO: 92773

SEQ ID NO: 93246 - RNA, 64 nt, Human; identical to SEQ ID NO: 92774

SEQ ID NO: 93247 - RNA, 64 nt, Human; identical to SEQ ID NO: 92775

SEQ ID NO: 93248 - RNA, 64 nt, Human; identical to SEQ ID NO: 92776

SEQ ID NO: 93249 - RNA, 64 nt, Human; identical to SEQ ID NO: 92777

SEQ ID NO: 93250 - RNA, 64 nt, Human; identical to SEQ ID NO: 92778

SEQ ID NO: 93251 - RNA, 64 nt, Human; identical to SEQ ID NO: 92779

SEQ ID NO: 93252 - RNA, 64 nt, Human; identical to SEQ ID NO: 92780

SEQ ID NO: 93253 - RNA, 64 nt, Human; identical to SEQ ID NO: 92781

SEQ ID NO: 93254 - RNA, 64 nt, Human; identical to SEQ ID NO: 92782

SEQ ID NO: 93255 - RNA, 64 nt, Human; identical to SEQ ID NO: 92783

SEQ ID NO: 93256 - RNA, 64 nt, Human; identical to SEQ ID NO: 92784

SEQ ID NO: 93257 - RNA, 64 nt, Human; identical to SEQ ID NO: 92785

SEQ ID NO: 93258 - RNA, 64 nt, Human; identical to SEQ ID NO: 92786

SEQ ID NO: 93259 - RNA, 64 nt, Human; identical to SEQ ID NO: 92787

SEQ ID NO: 93260 - RNA, 64 nt, Human; identical to SEQ ID NO: 92788

SEQ ID NO: 93261 - RNA, 64 nt, Human; identical to SEQ ID NO: 92789

SEQ ID NO: 93262 - RNA, 53 nt, Human; identical to SEQ ID NO: 92790

SEQ ID NO: 93263 - RNA, 64 nt, Human; identical to SEQ ID NO: 92791

SEQ ID NO: 93264 - RNA, 64 nt, Human; identical to SEQ ID NO: 92792

SEQ ID NO: 93265 - RNA, 64 nt, Human; identical to SEQ ID NO: 92793

SEQ ID NO: 93266 - RNA, 64 nt, Human; identical to SEQ ID NO: 92794

SEQ ID NO: 93267 - RNA, 64 nt, Human; identical to SEQ ID NO: 92795

SEQ ID NO: 93268 - RNA, 64 nt, Human; identical to SEQ ID NO: 92796

SEQ ID NO: 93269 - RNA, 64 nt, Human; identical to SEQ ID NO: 92797

SEQ ID NO: 93270 - RNA, 64 nt, Human; identical to SEQ ID NO: 92798

SEQ ID NO: 93271 - RNA, 64 nt, Human; identical to SEQ ID NO: 92799

SEQ ID NO: 93272 - RNA, 64 nt, Human; identical to SEQ ID NO: 92800

SEQ ID NO: 93273 - RNA, 64 nt, Human; identical to SEQ ID NO: 92801

SEQ ID NO: 93274 - RNA, 64 nt, Human; identical to SEQ ID NO: 92802

SEQ ID NO: 93275 - RNA, 64 nt, Human; identical to SEQ ID NO: 92803

SEQ ID NO: 93276 - RNA, 64 nt, Human; identical to SEQ ID NO: 92804

SEQ ID NO: 93277 - RNA, 64 nt, Human; identical to SEQ ID NO: 92805

SEQ ID NO: 93278 - RNA, 64 nt, Human; identical to SEQ ID NO: 92806

SEQ ID NO: 93279 - RNA, 63 nt, Human; identical to SEQ ID NO: 92807

SEQ ID NO: 93280 - RNA, 64 nt, Human; identical to SEQ ID NO: 92808

SEQ ID NO: 93281 - RNA, 64 nt, Human; identical to SEQ ID NO: 92809

SEQ ID NO: 93282 - RNA, 64 nt, Human; identical to SEQ ID NO: 92810

SEQ ID NO: 93283 - RNA, 64 nt, Human; identical to SEQ ID NO: 92811

SEQ ID NO: 93284 - RNA, 64 nt, Human; identical to SEQ ID NO: 92812

SEQ ID NO: 93285 - RNA, 64 nt, Human; identical to SEQ ID NO: 92813

SEQ ID NO: 93286 - RNA, 63 nt, Human; identical to SEQ ID NO: 92814

SEQ ID NO: 93287 - RNA, 64 nt, Human; identical to SEQ ID NO: 92815

SEQ ID NO: 93288 - RNA, 64 nt, Human; identical to SEQ ID NO: 92816

SEQ ID NO: 93289 - RNA, 64 nt, Human; identical to SEQ ID NO: 92817

SEQ ID NO: 93290 - RNA, 64 nt, Human; identical to SEQ ID NO: 92818

SEQ ID NO: 93291 - RNA, 64 nt, Human; identical to SEQ ID NO: 92819

SEQ ID NO: 93292 - RNA, 64 nt, Human; identical to SEQ ID NO: 92820

SEQ ID NO: 93293 - RNA, 64 nt, Human; identical to SEQ ID NO: 92821

SEQ ID NO: 93294 - RNA, 64 nt, Human; identical to SEQ ID NO: 92822

SEQ ID NO: 93295 - RNA, 51 nt, Human; identical to SEQ ID NO: 92823

SEQ ID NO: 93296 - RNA, 64 nt, Human; identical to SEQ ID NO: 92824

SEQ ID NO: 93297 - RNA, 64 nt, Human
gaccugccccgcccagcugcaccugccagccuggcuucuggagcccuuggguuuuuuguuuguu

SEQ ID NO: 93298 - RNA, 64 nt, Human
gguugauuguaugcgucagugagccuucuaucaccuucuggaacaaagucacuugaaaucucuu

SEQ ID NO: 93299 - RNA, 64 nt, Human
gccugccuauuuggauggguaugucaaacgcuuucuucuggacacuuggaaacuaaaaccuagg

SEQ ID NO: 93300 - RNA, 64 nt, Human
gguggccuggcccuccuggcuguugcgacgcgggcuucuggagcuugucaccauuggacagucu

SEQ ID NO: 93301 - RNA, 64 nt, Human
uccccagcuggggucagucucaacaggagccagucuucuggagccucugggcagaacccuccau

SEQ ID NO: 93302 - RNA, 64 nt, Human
uuggggguaaggguaugaggugaucaggaaguuucuucuggaauuuuaucaaguccuuguauuc

SEQ ID NO: 93303 - RNA, 64 nt, Human
accccacaguaaggaugagaccccacuguguacccuucuggacuggcaggauucucuugccaag

SEQ ID NO: 93304 - RNA, 64 nt, Human
ccagccaucaaauccaauuccugguggggaaaaccuucuggagacccccaaccuucugauaaaa

SEQ ID NO: 93305 - RNA, 64 nt, Human
cgcuuuugcuguguccacagagugcaucggauggcuucuggaaaucuguggccacucgagugcc

SEQ ID NO: 93306 - RNA, 64 nt, Human
cauuucuuggacauauaccguuggacaugucuaucuucuggaaacuauggcauggacaguaagg

SEQ ID NO: 93307 - RNA, 64 nt, Human
uugaaagaauagaaugcauucaaauguaaggcugcuucuggaucauuaaagccaguuucaucaa

SEQ ID NO: 93308 - RNA, 64 nt, Human
ugaagaagaaacuaagaagcauuugcaaauuucucuucuggauauuuuguuuauuuuuucugaa

SEQ ID NO: 93309 - RNA, 64 nt, Human
cagccaguaagaauuucaguugugggccuccagucuucuggaaugucuucacugcagcugcugg

SEQ ID NO: 93310 - RNA, 64 nt, Human
ccaagcauguauuccagacuugucacugacuuuccuucuggagcagguggcuagaaaaagaggc

SEQ ID NO: 93311 - RNA, 64 nt, Human
aggcacuguggaaagaagggacucaggugagggucuucuggacucuaagacgguaaaggcacua

SEQ ID NO: 93312 - RNA, 64 nt, Human
aauuagagguaaauagaagacgucacuguggcugcuucuggaagugcuggaagcaucaccccaa

SEQ ID NO: 93313 - RNA, 64 nt, Human
acuuuggucacauuccaaguaugacacagcuguucuucuggaguacuuuagcuauuuuuuguuu

SEQ ID NO: 93314 - RNA, 64 nt, Human
ucagugugcugauuugguaguuggaagaauuauucuucuggaggucuguuagacuacauccuac

SEQ ID NO: 93315 - RNA, 64 nt, Human
aauacaaguuugguaugugauuuggaaaagaugccuucuggaucuuaagccaguugucagugga

SEQ ID NO: 93316 - RNA, 64 nt, Human
cugauguacacccaucgccaucauagcaagagugcuucuggaccuuguacuuauucuuaaagac

SEQ ID NO: 93317 - RNA, 64 nt, Human
gggugggguuuggcuucagggugggguuuggaagcuucuggaagucgugcuggucucccaggug

SEQ ID NO: 93318 - RNA, 64 nt, Human
uaaguuugucuuguggcauuaagacuauuuugcucuucuggaaugcaccacuccuuccccaggg

SEQ ID NO: 93319 - RNA, 64 nt, Human
ggcagcucaggguggaugugaagccacccuuccucuucuggacccagccuggucugcacugcaa

SEQ ID NO: 93320 - RNA, 64 nt, Human
ugagaggaagaugaccugauccaccuagccuuuucuucuggaucuguccucccucaccccuuuc

SEQ ID NO: 93321 - RNA, 64 nt, Human
acauccuucaagguggcagcuguuagggcugaaucuucuggagaaaaaggugccaucucaggag

SEQ ID NO: 93322 - RNA, 64 nt, Human
uuguagagaugcagccugcccagcugaaucuuggcuucuggaccuugaccuucagaacuucucu

SEQ ID NO: 93323 - RNA, 64 nt, Human
uuauauuauauauagaaaagauuuuuuaguuaaacuucuggacaugagcguccuguuuaaauuu

SEQ ID NO: 93324 - RNA, 64 nt, Human
guuucuuaccucuuacuguuuaaccuguugcuuccuucuggauuaauacauuuagagccauucc

SEQ ID NO: 93325 - RNA, 64 nt, Human
ggauuuucuuaaucguuuuaugucauuagucacucuucuggaaugucacucaagaccaagcggu

SEQ ID NO: 93326 - RNA, 64 nt, Human
gggaaagcuccacggugcguggcuguggcacagacuucuggaaggcuggcugaguggaaugcag

SEQ ID NO: 93327 - RNA, 64 nt, Human
gaugugggugcucugggcugaaccaaggcuaugacuucuggagagaggcucagggguuggucug

SEQ ID NO: 93328 - RNA, 64 nt, Human
ugcucugaccuugaagggggcgguguuggccuggcuucuggaauggacugaguccaucguggaa

SEQ ID NO: 93329 - RNA, 64 nt, Human
cacagcuggcauucugggggcuaccaaaacaccccuucuggaguagaagcugcuggaaggcagg

SEQ ID NO: 93330 - RNA, 64 nt, Human
ucccagcaucugagaccaaacugcagaggggagccuucuggagaagcugcugggaucggaccag

SEQ ID NO: 93331 - RNA, 64 nt, Human
uuguugcggacauccaauaaagauuuuuuuagugcuucuggaaacuuccaguagauucuacuuc

SEQ ID NO: 93332 - RNA, 64 nt, Human
gccuacccaugaaggcguguuugauuacuccaggcuucuggacacacauacccaugggugauuu

SEQ ID NO: 93333 - RNA, 64 nt, Human
aaaagcuuggaaaauacuacacacucccuuucuccuucuggagaucaacccacauuagaguguc

SEQ ID NO: 93334 - RNA, 64 nt, Human
uggcccuggggucuccugcucagcucagaagagccuucuggagaggacagucagcugagcaccu

SEQ ID NO: 93335 - RNA, 64 nt, Human
uuuacuuguaaagcuagagcacccaagcuucugccuucuggaauauagagaaauaguuucaccc

SEQ ID NO: 93336 - RNA, 64 nt, Human
aucaaaagaucuuuauugguagagcacugguuaucuucuggauacuaaaaaguuguauuacaaa

SEQ ID NO: 93337 - RNA, 64 nt, Human
ugaauaauuuugcuaacaacuuugaaauuucaaacuucuggaaaauaugaaaauauucauuguu

SEQ ID NO: 93338 - RNA, 64 nt, Human
agaucugauacccauuagagccccgagaauuccucuucuggaucccaguuugcagcaaacccca

SEQ ID NO: 93339 - RNA, 64 nt, Human
agcugccagucuuucuccccugcagcuuccucugcuucuggaaugaaccauguauccuggagac

SEQ ID NO: 93340 - RNA, 64 nt, Human
gaaauugaucgguuuuuuuaggccaaucccaucccuucuggauaaccagauguuaaaucaugag

SEQ ID NO: 93341 - RNA, 64 nt, Human
accugucucauuucccauauuccuucacacccagcuucuggaaggcaugggguggcugggauuu

SEQ ID NO: 93342 - RNA, 64 nt, Human
guugggguccuuucaucuggcuccguuucuggugcuucuggaagucucugcucagcacagggaa

SEQ ID NO: 93343 - RNA, 64 nt, Human
agagauccuggggcauuagcuuuccaguauaccucuucuggaugccauucuccauggcacuauu

SEQ ID NO: 93344 - RNA, 64 nt, Human
auggcacacugggauaaacaagcaagauugcucacuucuggaagcugcauaugacuagaggccu

SEQ ID NO: 93345 - RNA, 64 nt, Human
caccacauauacagugcgcaugcuuacagccgggcuucuggagcaccagcugcagccuggcuac

SEQ ID NO: 93346 - RNA, 64 nt, Human
uggcaucucuaauuggaagaaauuccuguagcaucuucuggagucuccagugguugcuguugau

SEQ ID NO: 93347 - RNA, 64 nt, Human
uacuuugagauagucuuauucugauuuuuuuuuucuucuggaaaccaaguagaauuagggaugg

SEQ ID NO: 93348 - RNA, 64 nt, Human
cuauuucagaguggggaagugauaaacuauuugccuucuggagcucuuugugaaaaauuaaaaa

SEQ ID NO: 93349 - RNA, 64 nt, Human
cugucuggauuucucuugggaucuaacgugggaucuucuggacagacaaccgugacaucagcag

SEQ ID NO: 93350 - RNA, 64 nt, Human
ggcacaaacuugcagcaguuccuguuuuuugagccuucuggaccaacaaaauggcagcacaucc

SEQ ID NO: 93351 - RNA, 64 nt, Human
uauggacugggacucuucagaaauucugucuuuucuucuggaagaaaaugucccucccuuaccc

SEQ ID NO: 93352 - RNA, 64 nt, Human
ucucccuccauuucuacccagaccuccaggccuccuucuggaaucauagaaccguagaauugga

SEQ ID NO: 93353 - RNA, 64 nt, Human
cugcaucucuccccuuacucuucaauuuauucuacuucuggaccuggacuuacccaaacuguga

SEQ ID NO: 93354 - RNA, 64 nt, Human
aacaucucugcuggaauauuuggaaaagaacacucuucuggaccugguugaagcaggaaagaug

SEQ ID NO: 93355 - RNA, 64 nt, Human
cuuauuauacacccccagaaagagagaaagcugccuucuggaggacugauuccacaugcuauau

SEQ ID NO: 93356 - RNA, 64 nt, Human
ucauaccuugccagaucccucucucaguuccagccuucuggacaaggccugggcuaagaggagc

SEQ ID NO: 93357 - RNA, 64 nt, Human
cucaaugacuuagauacacaguauaacugaugcucuucuggaauaccacaugagacauggucag

SEQ ID NO: 93358 - RNA, 64 nt, Human
uggaaagagcuagaagcacaguucaaaguucuggcuucuggacucugcaguccaggucucccuu

SEQ ID NO: 93359 - RNA, 64 nt, Human
ucagaggacccuuccugcccaccuucggagacggcuucuggaggaacggcuuggccagaagaca

SEQ ID NO: 93360 - RNA, 64 nt, Human
ucuucgguaacuugacauucuggagagagacuaucuucuggaguugaguacaagcacagaaaca

SEQ ID NO: 93361 - RNA, 64 nt, Human
ucuucuugugauggcauauuugcuuccuauauuucuucuggaaucauguucgcuuggcuuccug

SEQ ID NO: 93362 - RNA, 64 nt, Human
guaggcugcuugcccucuccaggccucagggccucuucuggaaaaugaagaaauucaacuagua

SEQ ID NO: 93363 - RNA, 64 nt, Human
aaagaaugguauaaugaacccccauauacccuuccuucuggauucaccaauuguuaacauuuuu

SEQ ID NO: 93364 - RNA, 64 nt, Human
ggaauccauguaaaacucucugugcaucuaaauacuucuggagggcgacagauucaugccacgg

SEQ ID NO: 93365 - RNA, 64 nt, Human
ugcaguguuaccugucacuuggaggcagccaacacuucuggacauugcauccuuauucacacau

SEQ ID NO: 93366 - RNA, 64 nt, Human
cugcuguucuguccuuccaucccucuuuugggcucuucuggagggaaguaacauuuacugagca

SEQ ID NO: 93367 - RNA, 64 nt, Human
gugaagacacugaaaaauaagugauuucaguaaccuucuggaaagcuaucaguuucaaauaaua

SEQ ID NO: 93368 - RNA, 62 nt, Human
gaacauguacacugguuugagcuuagugaaauuacuucuggauaauuauuuuuuuauaauua

SEQ ID NO: 93369 - RNA, 62 nt, Human
cuuggaauguacccaucugaaucaaaugcaaacuucuggagaaaacagagugccucuuccca

SEQ ID NO: 93370 - RNA, 64 nt, Human
ugcuccagcuuuccagugacaugugacggcgaggcuucuggaagaaaggaucccccgugacggc

SEQ ID NO: 93371 - RNA, 64 nt, Human
cagggugaggccaggcaggccuggguaggggcagcuucuggagccuugggacagagcaggccca

SEQ ID NO: 93372 - RNA, 64 nt, Human
ccuacuaauuucccuguagggaagacucccagcacuucuggaacugugcuucucuuuauuuuuc

SEQ ID NO: 93373 - RNA, 64 nt, Human
cucguccugguguuccugaucaucuugaaagguucuucuggaacuccuguccccuuagucauga

SEQ ID NO: 93374 - RNA, 64 nt, Human
acccacccacacugguaagggaggagaauuugugcuucuggagcuucucaagggauuguguuuu

SEQ ID NO: 93375 - RNA, 64 nt, Human
gcagauuccugaauagaguugcugaaagagucuacuucuggacucaggggaaguugaaggccag

SEQ ID NO: 93376 - RNA, 64 nt, Human
gagaaaguauucuguugggaucugggcuuccucacuucuggagaaguggccaucccaugcccac

SEQ ID NO: 93377 - RNA, 64 nt, Human
gcaauacugcacuuguaaaugaauuauaaacgcucuucuggaauauauuuaaauaaccauuaaa

SEQ ID NO: 93378 - RNA, 64 nt, Human
cagcacuccagauaggcagccacgaccccaaaggcuucuggaaccaaacugauuaaaguuuuac

SEQ ID NO: 93379 - RNA, 64 nt, Human
uguuuaugaaacaggcaagauaagucuguuuuuccuucuggaaccauaaggguaaccagauuuu

SEQ ID NO: 93380 - RNA, 64 nt, Human
ccauucuugaaagcugcuggggccuccuugcaggcuucuggaucucuggucagagugaacucuu

SEQ ID NO: 93381 - RNA, 64 nt, Human
cugggucggauggccccaguggguuuagucagggcuucuggauuccucgguuucugggcuaccu

SEQ ID NO: 93382 - RNA, 64 nt, Human
acaauugaagucaauuacucuauaauacagugggcuucuggauggauuuuauaggaaaaaauaa

SEQ ID NO: 93383 - RNA, 64 nt, Human
uuauuuucuugaucaaagagguguuuauuaaggacuucuggauaacuauacuuuuacucuauuu

SEQ ID NO: 93384 - RNA, 58 nt, Human
acaagaaggugaccccguaaaccuagagcuucuggagcccucgggagggccuggcuac

SEQ ID NO: 93385 - RNA, 64 nt, Human
aauuaacuuaauuuugcugacuugacuccuguggcuucuggaccccuccucugccccgcaggag

SEQ ID NO: 93386 - RNA, 64 nt, Human
ucugcaugcaguuugcaacaaauguauucucaugcuucuggauuauaaaagaaaagugaaguca

SEQ ID NO: 93387 - RNA, 64 nt, Human
ccaugcuccuuucuguaccagguuuaaauguagucuucuggagaaguauuuuugacauugagcu

SEQ ID NO: 93388 - RNA, 64 nt, Human
ccucaccccgccuccuccugcucaugcucagcugcuucuggaccuuccagggcccaugcagggu

SEQ ID NO: 93389 - RNA, 64 nt, Human
cacagagccauugugauaugaggagauacuggcucuucuggaaaagagaggcuuuucuucaucg

SEQ ID NO: 93390 - RNA, 64 nt, Human
uguuucaccuucuuggauaacacacgggccuucucuucuggauuucaucagagauuacagccag

SEQ ID NO: 93391 - RNA, 64 nt, Human
ugaaagaacagcagugguggcaacuaugccuugccuucuggagccuguagggaguuuuccaggc

SEQ ID NO: 93392 - RNA, 64 nt, Human
gcccaguucccguguaaagcacgggacggaagugcuucuggacggaagugguggcuguggaagg

SEQ ID NO: 93393 - RNA, 64 nt, Human
uuacccagcugggacuccaaaacucaaccaucaccuucuggaauaucacccuggaggaugaagg

SEQ ID NO: 93394 - RNA, 64 nt, Human
cuugcucugccacugcccgcccagcccccauggucuucuggaaggucccucggucagggauuga

SEQ ID NO: 93395 - RNA, 64 nt, Human
uuccuuuaguucacccucauacucucaggagacucuucuggauacuuuugucuuccacccugcc

SEQ ID NO: 93396 - RNA, 64 nt, Human
gcugcacucauuguggacuucauguggaucacaacuucuggauaagaagauuacaacuauuaag

SEQ ID NO: 93397 - RNA, 64 nt, Human
gaagaguguuguggucaccuuaaagagacuuccccuucuggaaauguggugacuuggcuuaguc

SEQ ID NO: 93398 - RNA, 64 nt, Human
cugauguggagacacaugggauuuuggaaaucagcuucuggaggaaugcaugucacaggcggga

SEQ ID NO: 93399 - RNA, 64 nt, Human
auuuggccaaacaaccggcuacaaugcucuuccucuucuggaauguugcugacccaggccgugg

SEQ ID NO: 93400 - RNA, 64 nt, Human
aguaaagcuguauuuucuggaaggaagacuguaucuucuggaauaguuuucuagaaaacuaguc

SEQ ID NO: 93401 - RNA, 64 nt, Human
gcuggggaagugcagcaccauguccuuuggagcccuucuggagacuccggccccuaggaguggc

SEQ ID NO: 93402 - RNA, 64 nt, Human
ugcccacaccacacccuggggccacccaucagaccuucuggaagcaagaccugggccuccaugg

SEQ ID NO: 93403 - RNA, 64 nt, Human
cccaacuugugaggcugaaggcugcucaaguucacuucuggaugcuggaagcugucguugagga

SEQ ID NO: 93404 - RNA, 64 nt, Human
caggauuuguuucccucugcuguggcggugacugcuucuggaccagaacagcuccagcucccag

SEQ ID NO: 93405 - RNA, 64 nt, Human
cuaaaggcaggagacuacuuuccaacuccuuuugcuucuggagaaggcccugaaaucacauuga

SEQ ID NO: 93406 - RNA, 64 nt, Human
uauggaaagcaaauauacaaugauuuucaguaggcuucuggaauagaaacagugguuugaagac

SEQ ID NO: 93407 - RNA, 64 nt, Human
cacauccuacccggaagaccagccucagaggguccuucuggaaccagcugucuguggagagaau

SEQ ID NO: 93408 - RNA, 64 nt, Human
caguggcaugaucucagcucacugcaaccucugccuucuggauucaagugauucuugugccuua

SEQ ID NO: 93409 - RNA, 64 nt, Human
cugucugcugcccaucugcugucugugcaagcaacuucuggacccuggcacccugggcugcugg

SEQ ID NO: 93410 - RNA, 64 nt, Human
ugaaaaucaaaagcuuuaguauuccucaucuucucuucuggaagauuugcguuagaguuuuugu

SEQ ID NO: 93411 - RNA, 64 nt, Human
ccaaugcauuggugcauagaauuuacuagggcuacuucuggaagccaaaauagaauagcauuuc

SEQ ID NO: 93412 - RNA, 64 nt, Human
acaucacauuuuucuggaaaacagacggauuuuacuucuggagacauggcauacgguuacugac

SEQ ID NO: 93413 - RNA, 64 nt, Human
aagggggggaggggaguguugcagcaggcauucucuucuggaaggagucgcugggagcagugcg

SEQ ID NO: 93414 - RNA, 53 nt, Human
accugagugaugaugauuaacaccuucuggagccagcucaucagcucagagcc

SEQ ID NO: 93415 - RNA, 64 nt, Human
uauaagauauguagaagaaaacauccaucagaaucuucuggagaauauggucagagucuuaaac

SEQ ID NO: 93416 - RNA, 64 nt, Human
uagacguagaccucuguccuuuaccaucugaggucuucuggauucuuugugggguuaauuuuga

SEQ ID NO: 93417 - RNA, 64 nt, Human
uaaccuuccuuucccacuggcucuguauaaaaaacuucuggaccaaaagccaucauuggaagau

SEQ ID NO: 93418 - RNA, 64 nt, Human
gcgggaaggugcucccuggauauacucugugaaccuucuggaaggcugcuggcaguuuuuccuu

SEQ ID NO: 93419 - RNA, 64 nt, Human
uagauauaaaggacugguuuuuaagugcacugcacuucuggaauacugaaaaagaaugaaaaca

SEQ ID NO: 93420 - RNA, 64 nt, Human
uuuuccugaauucagaaacuaguagcuaacauugcuucuggagagcagaaauaagcaugucuuc

SEQ ID NO: 93421 - RNA, 64 nt, Human
uaguuguaucugaaacuguuauguaucucucuaccuucuggaaaacagggcugguauuccuacc

SEQ ID NO: 93422 - RNA, 64 nt, Human
ggggggcugcagaagauucucagacauucuuauccuucuggagucucaacccaucagguucaga

SEQ ID NO: 93423 - RNA, 64 nt, Human
gcuaacucuauuuuuuuuuucacuugcucauaaacuucuggaaaaaaauaagcaugaaucaaau

SEQ ID NO: 93424 - RNA, 64 nt, Human
aagaguucugacugcacaaaccagcuucugguuucuucuggaaugaauacccucauaucugucc

SEQ ID NO: 93425 - RNA, 64 nt, Human
uaucauauacuuauuccuaaacugauaauucuuacuucuggauuuaaaaucaaaaauaacacac

SEQ ID NO: 93426 - RNA, 64 nt, Human
aaaagaccaccuuucuucaauuuacaaauuaaaucuucuggagggucgcuaucacaaaacauug

SEQ ID NO: 93427 - RNA, 64 nt, Human
aacgugcaaagccaaggcagcgaccccaggaccucuucuggagauggaagcuuguugaaaaccc

SEQ ID NO: 93428 - RNA, 64 nt, Human
uuccaugugcuagccagguaaagauuacacaguucuucuggacuguuaaauugugcaugguuuu

SEQ ID NO: 93429 - RNA, 64 nt, Human
gcauuuugaaauauauacagaagaaauaauaugacuucuggaacuuacuucaaaaaaaauggga

SEQ ID NO: 93430 - RNA, 64 nt, Human
uuacauuuggaacaaaaggugugggcuuuggggucuucuggaaauaguuuugaccagacaucuu

SEQ ID NO: 93431 - RNA, 64 nt, Human
auauugccaaugcuacaguaauaaaugaaugucacuucuggauauagcuaggugacauauacau

SEQ ID NO: 93432 - RNA, 64 nt, Human
uacccaucuuaaaaacaacgaaagaaggcauggacuucuggaugcccauccacuggguguaaac

SEQ ID NO: 93433 - RNA, 64 nt, Human
ugugcaauguuccugacugcaaugaagaaaaggccuucuggagauuucuguuuuuuaagcacau

SEQ ID NO: 93434 - RNA, 64 nt, Human
cuuagccaaagacaauuuggaggagaauaucagccuucuggaaguagcuacuuccugaacaaug

SEQ ID NO: 93435 - RNA, 64 nt, Human
cucuggaguuuuagugaaaggauuuauugagcagcuucuggaauauaaugugcauguccaaaau

SEQ ID NO: 93436 - RNA, 64 nt, Human
ccuggcagaugaauaauuuucacucauuuauugucuucuggaaaccauuuaacuuuuacuguuu

SEQ ID NO: 93437 - RNA, 64 nt, Human
agcuauuaugaauaauguccaguauaagaauaugcuucuggaauugaguucuccuuuuaaguac

SEQ ID NO: 93438 - RNA, 64 nt, Human
gauggccauuuccggugccugcccaguggccacucuucuggaaggggcuuggaaaagaggaagg

SEQ ID NO: 93439 - RNA, 64 nt, Human
uguugcaccugcucuaguaccauaggucaagaggcuucuggaucacaaagucauaacuagacag

SEQ ID NO: 93440 - RNA, 64 nt, Human
agcaggcgguuggaaauccugugacagcagagaucuucuggauuuuugccuggacccuucugca

SEQ ID NO: 93441 - RNA, 64 nt, Human
gcuuuuagaauaagaacagugucaaaucaucugucuucuggaaaaucauggauuuucauauuuc

SEQ ID NO: 93442 - RNA, 64 nt, Human
uuggaaggcacauuuucauuucugaugcagccaccuucuggaggcagcuuuuauccuuucucuc

SEQ ID NO: 93443 - RNA, 64 nt, Human
uggacaccacggaccugugacaggggcccccacucuucuggaccccuugaagaggcccuaccac

SEQ ID NO: 93444 - RNA, 64 nt, Human
auuuauauuccacuugggagggucaggcuguggccuucuggagcagguggcuuguuaaggaaug

SEQ ID NO: 93445 - RNA, 64 nt, Human
auuucccauuaaaaugaaguuggaggaacagcugcuucuggagccggggcaaaaauuucaaggu

SEQ ID NO: 93446 - RNA, 64 nt, Human
uuaaauucuacuuuucuugaggggaaaaagucuucuucuggaaauacauauuacugcaaaaaug

SEQ ID NO: 93447 - RNA, 64 nt, Human
cauucccacauucuccuuucugccacaucucgcccuucuggaccugcacugggagaaauucagg

SEQ ID NO: 93448 - RNA, 64 nt, Human
caggcuagcaccaguucuggcccagucuccucuucuucuggagaucacauguuuuucuucuaag

SEQ ID NO: 93449 - RNA, 64 nt, Human
agggccaagaagguugacgggccaucuugguuuucuucuggaugugcucuuugguuuucagaag

SEQ ID NO: 93450 - RNA, 64 nt, Human
gaauuuuauguuuuaauuuauguuuuuuuuuugucuucuggaaucucuuuugguuuggauauug

SEQ ID NO: 93451 - RNA, 64 nt, Human
ucgcuguguuaaaaaucaagucacagagaccucucuucuggauuugucccauggggacccugag

SEQ ID NO: 93452 - RNA, 64 nt, Human
aaagacacugcagaaacccugagcagaaagaggccuucuggauggccaaacccaagauuauuaa

SEQ ID NO: 93453 - RNA, 64 nt, Human
ccacuuccccucauaaguuuguuuaaacacuuaucuucuggauuagaaugccgguuaaauucca

SEQ ID NO: 93454 - RNA, 64 nt, Human
ucucacaggcccaauccugaaugugccccuggaccuucuggacccuugaguccaaggcagaucc

SEQ ID NO: 93455 - RNA, 64 nt, Human
uccugucagccaggcugcccuuaucagcuguccccuucuggaagcuuucugcuccugacguguu

SEQ ID NO: 93456 - RNA, 64 nt, Human
acaugccacggcgguccuccaggcagggaacaagcuucuggacuugggcuuacagagcaagacc

SEQ ID NO: 93457 - RNA, 64 nt, Human
uuguagggaguggccggguauucugggcugggcucuucuggaguagggggucagcaaacauugu

SEQ ID NO: 93458 - RNA, 64 nt, Human
accacccacagucugucaccacguggcuugggaacuucuggagccacagcaggcaucacggugc

SEQ ID NO: 93459 - RNA, 64 nt, Human
ugucuacuuguucuccagcuucuggguagcugggcuucuggaaggguggcagugggcuacuccc

SEQ ID NO: 93460 - RNA, 64 nt, Human
gugagccgcuguacccgaacuuuuuuuguuuuugcuucuggaacuuugaaacacaaaacacaag

SEQ ID NO: 93461 - RNA, 64 nt, Human
aaguacaaacgcugcuuggauaaggagagcaaagcuucuggaacuuuauuuacucuuucuuuuu

SEQ ID NO: 93462 - RNA, 64 nt, Human
cugggccaaccacguuuguuaucauggcugcugccuucuggacagcugccagcucugccuugag

SEQ ID NO: 93463 - RNA, 64 nt, Human
aggggucucacucuguugccaggcuggucucaaacuucuggacucaagugauccucccgccucg

SEQ ID NO: 93464 - RNA, 64 nt, Human
cuuuaccagaacgguucuuugaccagcacauuaacuucuggacugccggcucuaguaccuuuuc

SEQ ID NO: 93465 - RNA, 64 nt, Human
ugucccaguaggaggucaagaaaaccuccacagccuucuggaugaagaaccuguuuucaaauau

SEQ ID NO: 93466 - RNA, 64 nt, Human
ggaaaggggagguccugcugauuccucagaauggcuucuggaccuuggagaugcauaaagggca

SEQ ID NO: 93467 - RNA, 64 nt, Human
cgagcugcugagggaggcaucaccauugcaaucacuucuggaggugcuggggcugcugggggga

SEQ ID NO: 93468 - RNA, 64 nt, Human
ccacugcacccggcucucacuggucuuacgccaccuucuggacacucccuccuugagggcagaa

SEQ ID NO: 93469 - RNA, 64 nt, Human
cagcuuuccccacugagcuucuccaguccaugcucuucuggacguggacucucugaggcagaac

SEQ ID NO: 93470 - RNA, 64 nt, Human
agcaccgcaccguggcuggaguccugagcagcaccuucuggacagggggcgugaugcugcuggc

SEQ ID NO: 93471 - RNA, 64 nt, Human
auacauguguacauauauauacaaauauuuguaucuucuggagguguucaggauguggagcuuc

SEQ ID NO: 93472 - RNA, 64 nt, Human
cguguuucguaagugccugagcuuaggaaguuuucuucuggauauauaacauugcacaagggaa

SEQ ID NO: 93473 - RNA, 64 nt, Human
guuuugcccugauuguugcaaauacaauuuccaccuucuggaaagguagguuugcuguggagga

SEQ ID NO: 93474 - RNA, 64 nt, Human
aauaguuuguucucacccaguguauuuaaauggccuucuggacuuguuaauugcccucagccag

SEQ ID NO: 93475 - RNA, 64 nt, Human
auuguucaaauacccgaacuucuccggugucuggcuucuggauauucucucaauacugcuuccu

SEQ ID NO: 93476 - RNA, 64 nt, Human
ugcccaaucagagaugccaaaaauggggacaugacuucuggacagaggacaugggccacgcccc

SEQ ID NO: 93477 - RNA, 64 nt, Human
caucggagaacagacagccaggauaaaguggcaccuucuggaguacacuggagggggcagccca

SEQ ID NO: 93478 - RNA, 64 nt, Human
accaguuggaagaagauacgugggccauaagcaucuucuggacaggggaacugcuuucagagag

SEQ ID NO: 93479 - RNA, 64 nt, Human
gcaagcaccuuuggugaggagcaucacagggcuccuucuggagcauuugguggggacagcugca

SEQ ID NO: 93480 - RNA, 64 nt, Human
gggucaaaaaugucuucccaguuucuccaagcugcuucuggaaugcaggucugucggcugggug

SEQ ID NO: 93481 - RNA, 64 nt, Human
uaugacaucuguugggccucacaaggaccagggccuucuggaggaguggcacuaccccaccugg

SEQ ID NO: 93482 - RNA, 64 nt, Human
cauguuugauacacauuugauuucaaauguuuuucuucuggaucugcuuuuuauuuuacaaaaa

SEQ ID NO: 93483 - RNA, 64 nt, Human
acuauauacaucuaauaaaguaacacugugucaucuucuggaguuaucaaaaauuguauacaau

SEQ ID NO: 93484 - RNA, 64 nt, Human
auuagcccugcauuuucauaggaagacacauuaucuucuggacuauagcuguucuaauggauua

SEQ ID NO: 93485 - RNA, 64 nt, Human
aacucugugacuaauuuagauaguggcuuuccuucuucuggauucuuuucauugaauucucaca

SEQ ID NO: 93486 - RNA, 64 nt, Human
uaauuuuaaggagggcucaagugagcaaggguuucuucuggauugagugcugucagaaagugga

SEQ ID NO: 93487 - RNA, 64 nt, Human
ccucuuacucaauugauaccaacagaaauaucaacuucuggagucuauuaaauguguugucacc

SEQ ID NO: 93488 - RNA, 64 nt, Human
gggaccacccuccuaaucuacuauccagaccugccuucuggaagcucaauuaucacgagcacau

SEQ ID NO: 93489 - RNA, 64 nt, Human
uaacagggaaagcacugggguucgguuucugcaucuucuggaucaauucacggaacagagaucg

SEQ ID NO: 93490 - RNA, 64 nt, Human
gggcggcagcuccugucccuggguucaggcugugcuucuggaagcaucgaaaugggaugucuga

SEQ ID NO: 93491 - RNA, 64 nt, Human
aagcgugguuuuuugcuaagagccagaggcaggucuucuggaguucucaggggggcccugugac

SEQ ID NO: 93492 - RNA, 64 nt, Human
agcccguguuucucagacuuuaaagccaccagggcuucuggaacaccugucauagaagcaauaa

SEQ ID NO: 93493 - RNA, 64 nt, Human
agaguccagggcagcuggagcuuuguuggggagacuucuggacccaaagggagcuuucccaaga

SEQ ID NO: 93494 - RNA, 64 nt, Human
gccagggggcaguggcagcccuggggcccuuucccuucuggaggaagcacaagccucagggaag

SEQ ID NO: 93495 - RNA, 64 nt, Human
ugacccggggaccuucagccuggacacccggcagcuucuggaguuugucaguggaggcagaggg

SEQ ID NO: 93496 - RNA, 64 nt, Human
uauuuuaaggaccuucauucucuguucugcaccucuucuggaaauugaguaaauuuugcuuuuu

SEQ ID NO: 93497 - RNA, 64 nt, Human
gucccugauauuuugacuaucuuacuauugagugcuucuggaaauucuuuggaauaauugauga

SEQ ID NO: 93498 - RNA, 64 nt, Human
cucagccuuggccaugccaagagaggaguuggaccuucuggaguguuacagugagugagggucu

SEQ ID NO: 93499 - RNA, 52 nt, Human
ccuacaguuacuuggcuuaacccuucuggaagggucugacugugugacccgc

SEQ ID NO: 93500 - RNA, 64 nt, Human
uagacauaaaacaaaggauauaccugacagacuacuucuggaaaagguuuucucaaaggcccaa

SEQ ID NO: 93501 - RNA, 64 nt, Human
gcaguucugaugagcugcagguuuuuugaacucacuucuggaggugcagagccacaaacgcacu

SEQ ID NO: 93502 - RNA, 63 nt, Human
uuagccuacuuuggggauaaaggauuauuuggucuucuggauuuggaggcaaucagcggacag

SEQ ID NO: 93503 - RNA, 64 nt, Human
caaaauggagaguuauuuaaaguggauguguagccuucuggaaucugcacgugacuggcauuuu

SEQ ID NO: 93504 - RNA, 64 nt, Human
ggaagaaaaagcuaauuggucuuugaauagaagacuucuggacaauuuuucacuuucacagaua

SEQ ID NO: 93505 - RNA, 64 nt, Human
cguauguuugacgaagguuugugcaagucaggcccuucuggaacacagcagggccuacaacgag

SEQ ID NO: 93506 - RNA, 64 nt, Human
ccuguguacggagccugaugacuucacugggagccuucuggaauccugcagagggucaaggagc

SEQ ID NO: 93507 - RNA, 64 nt, Human
cagagucugucuucuugcuuccagauguggucaacuucuggaacacucgcuguagcuuuauugu

SEQ ID NO: 93508 - RNA, 64 nt, Human
agggaccaaccugcauggacugugaaaccucacccuucuggagcacggggccugggugaccgcc

SEQ ID NO: 93509 - RNA, 64 nt, Human
auaagaguaauuauauuuaaaaaaucuaccuacccuucuggaauugcuaauguuaguguuuaua

SEQ ID NO: 93510 - RNA, 64 nt, Human
gaggauugcuaucuggaggccuuccagcugcugucuucuggacaggcucugcuucuccaaggaa

SEQ ID NO: 93511 - RNA, 64 nt, Human
uuugucuucagcuaaguaguuuacugaccauuuucuucuggaaacaauaacaugucucuaagca

SEQ ID NO: 93512 - RNA, 64 nt, Human
cucauccuucagacugcaucuuaaugauuacuuccuucuggaagacuccccuaauuuucacaac

SEQ ID NO: 93513 - RNA, 64 nt, Human
uggucugugccacccagaguaaaccucuucucuucuucuggaaagauggcgugauguuuuucaa

SEQ ID NO: 93514 - RNA, 64 nt, Human
ugugcugguacgacuauguggagguccgagauggcuucuggaggaaggcgccccuccgagguaa

SEQ ID NO: 93515 - RNA, 64 nt, Human
ccccacuguauuuacaagccagaauugugcaacucuucuggaucauuaauaaaguagcaagauc

SEQ ID NO: 93516 - RNA, 64 nt, Human
ucugauuccucuacucauguagaaaacacuuguacuucuggaaauggacuggagacuuuuuaaa

SEQ ID NO: 93517 - RNA, 64 nt, Human
cucccuguccucucucacuuuacagcuuguguuucuucuggauucagcuucuccuaaacagaca

SEQ ID NO: 93518 - RNA, 64 nt, Human
uacaaaagaaaaagaagaagguucacauaaauagcuucuggagugcaaauuauaaagacaucaa

SEQ ID NO: 93519 - RNA, 64 nt, Human
uuuuuggggauaugaacuagauguucaagaacuccuucuggacuguggauacugaaucagugua

SEQ ID NO: 93520 - RNA, 64 nt, Human
aaugugugguuuaugaauacgucuguauaaucggcuucuggagugaaacagcaaaccccaaauc

SEQ ID NO: 93521 - RNA, 64 nt, Human
gugucauaugagucacuaauauuaacuccagggacuucuggauaggcuaauagaucauuggaua

SEQ ID NO: 93522 - RNA, 64 nt, Human
ccuggccacugcaucagaagaaccuccucugccccuucuggagcccgaggccuggccugucuuc

SEQ ID NO: 93523 - RNA, 64 nt, Human
cuucucagccucuguaguuggcagcugggcuggacuucuggagaacuuccccuuuccucugguu

SEQ ID NO: 93524 - RNA, 64 nt, Human
ggggugugugcgcaccuccccggcccuggcccaccuucuggagcgaacugcaccgugguccagc

SEQ ID NO: 93525 - RNA, 64 nt, Human
cuuccaucuggcaucccacgcguuguccccugcacuucuggaaggcacagggugcugcugccuc

SEQ ID NO: 93526 - RNA, 64 nt, Human
cuuccaucuggcgucccacaccuuguccccugcacuucuggaugacacagggugcugcugccuc

SEQ ID NO: 93527 - RNA, 64 nt, Human
agcuguaugguccagcaggggaguaauaagggcucuucuggaaggggaggaagcgggaggcagg

SEQ ID NO: 93528 - RNA, 64 nt, Human
ucauggccucaggagacuuguuucuccaugggcucuucuggacugcacacuuccaccauagcuu

SEQ ID NO: 93529 - RNA, 64 nt, Human
ucagugagagucuugaguucacuaacauugucaccuucuggagagagaguuaauggggggcauu

SEQ ID NO: 93530 - RNA, 64 nt, Human
gcuuuauaaguuaaauaugauguauuuuuucauacuucuggauuauacuauaauucauaugaaa

SEQ ID NO: 93531 - RNA, 64 nt, Human
uaccucccuccuccacaacccccaaguaauuagccuucuggagcuggcucuuagcugaggcucc

SEQ ID NO: 93532 - RNA, 64 nt, Human
aggcccccaggaggccuuccagacaucugcguuccuucuggacucuccaaguaagcacaggcuu

SEQ ID NO: 93533 - RNA, 64 nt, Human
gagccagggugaccugauaugacaucuaaagaagcuucuggacucugaacaagaauucgguggc

SEQ ID NO: 93534 - RNA, 64 nt, Human
gugcuauacguaggagagauccaaaauuuggaugcuucuggagacucuuagacaucuuuucauu

SEQ ID NO: 93535 - RNA, 64 nt, Human
aauuaaauuuggccucaaagagagaacuuacucccuucuggauauuuuugccacauuucuuugc

SEQ ID NO: 93536 - RNA, 64 nt, Human
ugcucgucccgggcaccgguggcaggcagcuggccuucuggacuaaggcagccuggggggacac

SEQ ID NO: 93537 - RNA, 64 nt, Human
cuuaagggaggagagcaagcagguguggccccagcuucuggaaauggcagaagagaggguuuuc

SEQ ID NO: 93538 - RNA, 64 nt, Human
cuuagcccccaaacucccagguucucacuuccuucuucuggaguuuaaccagauccuccccacc

SEQ ID NO: 93539 - RNA, 64 nt, Human
agggacucuggggcccuuugguggggccguuggacuucuggaugcuugucuauuucuaaaagcc

SEQ ID NO: 93540 - RNA, 64 nt, Human
guggccucucccuguuaggcugccacaggcccugcuucuggaaggugaacagcuccuggcugcu

SEQ ID NO: 93541 - RNA, 64 nt, Human
ccucccggccggggagccuccaggcacacacccgcuucuggacgucggggacccagcgguuggg

SEQ ID NO: 93542 - RNA, 64 nt, Human
agagcuucuaguaauugaaccaugggaaacccagcuucuggaggguuggccguggggcugugua

SEQ ID NO: 93543 - RNA, 64 nt, Human
gcugggccucagugggguguguuugucuccugcucuucuggagccuggaaggaaagggcuucag

SEQ ID NO: 93544 - RNA, 64 nt, Human
ccuuacccugacacagccccagaccccacaaagccuucuggaccuggaaagccuggggaaggac

SEQ ID NO: 93545 - RNA, 64 nt, Human
uaacaauaagaaacuuagggaagcaggcuguggacuucuggaauuaccaacaggaaugaggaaa

SEQ ID NO: 93546 - RNA, 64 nt, Human
cagcuuaagaacuucucaucucaaauccuauggccuucuggaagauccaccacuauccaaagga

SEQ ID NO: 93547 - RNA, 64 nt, Human
caccuucuccuggugcauucuuguuucaucccugcuucuggacuugggguacccucccaauugc

SEQ ID NO: 93548 - RNA, 64 nt, Human
acaagaacuucaccggugggcaggcaagaauucucuucuggaaaaugacguuuguggcucuuuc

SEQ ID NO: 93549 - RNA, 64 nt, Human
aaagcucucuggccgccuuuccucucaggacauacuucuggagaucaaaaaaaaaaauuacaaa

SEQ ID NO: 93550 - RNA, 58 nt, Human
aaagugaaaguggcuucuaagguacugucuucuggaccucagagcccacucuccuugg

SEQ ID NO: 93551 - RNA, 64 nt, Human
uuguuaauagacuuaauacaugcaacagaagugacuucuggagaaagcucauggcuguguccac

SEQ ID NO: 93552 - RNA, 64 nt, Human
ggguuuuaccauauugcccaggcuggucuucuggcuucuggauaucgcccaccuuggccuccca

SEQ ID NO: 93553 - RNA, 64 nt, Human
ggagggcugguggcugggaggucgcguccgcacacuucuggaagugagccuuugaguacgggcu

SEQ ID NO: 93554 - RNA, 64 nt, Human
ccaaguugucuuggacuucuacaccacacucagacuucuggaaaguuuucuguaccucauucuu

SEQ ID NO: 93555 - RNA, 64 nt, Human
cacccgccuggcaagugcuagaacuaaugcuauucuucuggaauaagaugccaaugauguggug

SEQ ID NO: 93556 - RNA, 64 nt, Human
cccagguccucaccucaggccuuugaaggggcagcuucuggaaguuguuuucuccucugcuugg

SEQ ID NO: 93557 - RNA, 64 nt, Human
gagguuuuauuuauucccacaguuucuccugggccuucuggaaugaccauguuuuccuguggcg

SEQ ID NO: 93558 - RNA, 64 nt, Human
ccgcagagucucggcagagcccuuugugcugcugcuucuggaaguagucccccuuccucccggg

SEQ ID NO: 93559 - RNA, 64 nt, Human
ugugggaaugauggguuuuccaugaaaugugaugcuucuggagauggggcauaaacauguucau

SEQ ID NO: 93560 - RNA, 64 nt, Human
gaguacugaaacaaggacuucuugucagaaacagcuucuggaaucuuggguuuuguuuuuguuu

SEQ ID NO: 93561 - RNA, 64 nt, Human
uuuguaggacuuaaucuguugaaaagugcaguuacuucuggaaauuaaccucaauauuagguca

SEQ ID NO: 93562 - RNA, 64 nt, Human
guagaacuguuaacugagauggcuucgagucuuccuucuggaaucuguuaaauuucacaaaguc

SEQ ID NO: 93563 - RNA, 64 nt, Human
cuagggaaggcagccuggcccugcccgccuccgccuucuggagagccucuggguucugagucag

SEQ ID NO: 93564 - RNA, 64 nt, Human
acucagauaagguaaaaugccaugaugccucugucuucuggacugguuuucacauuagaagaca

SEQ ID NO: 93565 - RNA, 57 nt, Human
aggacuuccugggcccauaggugaagccuucuggaggagaaggugacguggcccagc

SEQ ID NO: 93566 - RNA, 64 nt, Human
uauaaaccuccgaggggucaugagguccaucagucuucuggagcccuccuuggagcuggagagc

SEQ ID NO: 93567 - RNA, 64 nt, Human
ccuguaggacucucauucgggaugauuggaauagcuucuggaauuuguucaaguuuuggguaug

SEQ ID NO: 93568 - RNA, 64 nt, Human
uuuccaacaagugacuacccuugaagcacauccccuucuggaucugaaaagagcccuuggcuca

SEQ ID NO: 93569 - RNA, 64 nt, Human
gauggaaagccuggacuuaaaccuuuagaaaaaacuucuggagagaaaucccuuuuaaacaguu

SEQ ID NO: 93570 - RNA, 64 nt, Human
ugauuuugcaaaaaauaaaaaauaaaaaauaugccuucuggagugaugucuguuugguaaauca

SEQ ID NO: 93571 - RNA, 64 nt, Human
auuaguaauguaaaaucuugauacccuaaucuugcuucuggaucuguucuuuuuuuaaaaaaac

SEQ ID NO: 93572 - RNA, 64 nt, Human
uuacuccuaagcugugauuuaggguguauuucuacuucuggacugccucaauaucaagggcuga

SEQ ID NO: 93573 - RNA, 64 nt, Human
agggcuuuucuuaauacugaacguagcauaagggcuucuggaacccagaagaggagacaguuua

SEQ ID NO: 93574 - RNA, 64 nt, Human
gcagaaagaauuagaaauaaauaaaaacuaagcacuucuggagacauaauaauguacauuuauu

SEQ ID NO: 93575 - RNA, 64 nt, Human
uucuucauccaacuuccaagacaagauaccggugcuucuggaaacuaccaggugugccuggaag

SEQ ID NO: 93576 - RNA, 64 nt, Human
uuuuugaccacucagcaaaacuuccacagacauccuucuggacuuaaacacuuaacauuaacca

SEQ ID NO: 93577 - RNA, 64 nt, Human
cuuacucuguccacucuuguucaaguaucuaacucuucuggaaaccaaauaggcuuuagaagag

SEQ ID NO: 93578 - RNA, 64 nt, Human
gagggagggcugccugaucccucuccucgccugccuucuggaagacuucagaagauugagccuc

SEQ ID NO: 93579 - RNA, 64 nt, Human
uaggaaauagaccucccauuucuuaagcaaguugcuucuggaauugaugcaacagggauauuag

SEQ ID NO: 93580 - RNA, 64 nt, Human
ucugucccaggugcucagcccucauaugcauuuucuucuggagccucuuagaaucuccuccaga

SEQ ID NO: 93581 - RNA, 64 nt, Human
gagucgcuaaggggcugcggggaggccgcagcaccuucuggaagacuuggccuuccgcucugac

SEQ ID NO: 93582 - RNA, 64 nt, Human
acugguuuggucuuaauaccagucaaccguuguccuucuggaaauauacauauaugaaauaaau

SEQ ID NO: 93583 - RNA, 64 nt, Human
ucucuaguucggaugcugcucacuuucccccuugcuucuggaaggggaagcaguccuuagguuu

SEQ ID NO: 93584 - RNA, 64 nt, Human
uacaguugcauguuauauuauuacuaauugucuacuucuggagucuauaaaauguuuuuaaaca

SEQ ID NO: 93585 - RNA, 64 nt, Human
uuugcuaggccucuugcugaaagccaaggcagcucuucuggaguuucucuaaagucacuaguga

SEQ ID NO: 93586 - RNA, 64 nt, Human
cugaugcuuuuggucacagagcaucauuuuaucacuucuggaaaauguuuauuccaaaacagcu

SEQ ID NO: 93587 - RNA, 64 nt, Human
aagucuaaaaucaaagugucagcagaguugguuccuucuggaggcucuaaggaagaauccauaa

SEQ ID NO: 93588 - RNA, 64 nt, Human
cuuguggcugugugcaauucuuggaguucuuuggcuucuggacaaaucuuguccaaguauugca

SEQ ID NO: 93589 - RNA, 64 nt, Human
aaugaauggaaguacccagcuggagguuucagggcuucuggaggaugcucucgcauagcucgag

SEQ ID NO: 93590 - RNA, 64 nt, Human
cauccuggugucccacccaggucgagcccccaggcuucuggaaaagagugugugcucuacuuug

SEQ ID NO: 93591 - RNA, 64 nt, Human
ugagccugcaggguccugggccauguggguggugcuucuggaugugagucucuuauuuaucugc

SEQ ID NO: 93592 - RNA, 64 nt, Human
cacugggaaaccgggccagcguggggcucccugccuucuggacuccugaaggucguggauggau

SEQ ID NO: 93593 - RNA, 64 nt, Human
gaaaauauuucccaaacauccuuuucauccugugcuucuggaggacugauuuguuugagggaau

SEQ ID NO: 93594 - RNA, 64 nt, Human
cgcuggcgccaucugcaggagcuggcgggcuggccuucuggacccuggcuucuccccacuguaa

SEQ ID NO: 93595 - RNA, 64 nt, Human
auuuggcgauuagugaaaauucuauccugauggacuucuggaaaacugugacugggguucaaga

SEQ ID NO: 93596 - RNA, 64 nt, Human
cccuaauaauggguugaugucugaaguagcaaaucuucuggaaacgcaaacucuuuuaaggaag

SEQ ID NO: 93597 - RNA, 64 nt, Human
cccaccaaggcuauucagauuggacugugguucccuucuggacagucacaccagggacuuccca

SEQ ID NO: 93598 - RNA, 64 nt, Human
uauuaccugaauuuuggcugugucucccuucauccuucuggaauaaggagaaugaaaauucuug

SEQ ID NO: 93599 - RNA, 64 nt, Human
aauggauuuaaaaauuccuacucacagccuaaaacuucuggaguucacuaccuuuuuuucaaau

SEQ ID NO: 93600 - RNA, 64 nt, Human
gaaugugaguugaggggucucccacugaaguccucuucuggaagcugcagaugggggcccggga

SEQ ID NO: 93601 - RNA, 64 nt, Human
augugaauggaaaaugugugcuugcuuccagaaucuucuggauguuccuacagagggaaagacc

SEQ ID NO: 93602 - RNA, 64 nt, Human
cuccauccaaagaggccuuuuaacucagccuccccuucuggaagaagacuuggccuuuucucug

SEQ ID NO: 93603 - RNA, 64 nt, Human
uugcuccucaaguaagaggugcagagaugagguccuucuggacuaaaagccaaaaaaagaaaga

SEQ ID NO: 93604 - RNA, 64 nt, Human
ggcugccauggaaggaagaaaagcugccauuucccuucuggacacugagagggcaaucuuugcc

SEQ ID NO: 93605 - RNA, 64 nt, Human
cugggaagaaauaaauuccacaacugccuuuagccuucuggauacuuucuuuuauaaaauagaa

SEQ ID NO: 93606 - RNA, 64 nt, Human
cacgcauguucauucauugcuacauaauuugguucuucuggaauauuuuuauguagcucuugga

SEQ ID NO: 93607 - RNA, 64 nt, Human
uauaagugccuuuuaauaucauacuaagugugagcuucuggacauuuucaagagcuuacaaaaa

SEQ ID NO: 93608 - RNA, 64 nt, Human
auguuugaaugcaugggucuuaucuaacuuaucucuucuggacccauguuuaaauacaguuuua

SEQ ID NO: 93609 - RNA, 64 nt, Human
uggaaggagcauuuccuuagaagucauccagaugcuucuggaggaggggcaggagacacuuggg

SEQ ID NO: 93610 - RNA, 64 nt, Human
aguauucugcaugguucacugcuuaagaaaaugccuucuggaauauuuguaaacugaaauucug

SEQ ID NO: 93611 - RNA, 64 nt, Human
uucucuaaaaacuugaaguuccucaggccuguaacuucuggaaaagaugauuauucaaaauaau

SEQ ID NO: 93612 - RNA, 64 nt, Human
ugccacaaacugcaugcuaaauaaagauguaguucuucuggacagaccacaacucuaagaagcu

SEQ ID NO: 93613 - RNA, 64 nt, Human
caaaagagaucgguaguguuguguguaggccauucuucuggagagccacaagcaggaagagcag

SEQ ID NO: 93614 - RNA, 64 nt, Human
gaauaaggaauguuugcaccuccacauuuuauugcuucuggaugugaaaucauguaauuauuuc

SEQ ID NO: 93615 - RNA, 64 nt, Human
aauuaaauguucacauuuuacuuugaauguuuuucuucuggauaaaacaaauggaaucaaguug

SEQ ID NO: 93616 - RNA, 64 nt, Human
gucuguguaacauccaagccagaguuuuuaaagccuucuggauccauggggggagaagugauau

SEQ ID NO: 93617 - RNA, 64 nt, Human
aucucccuagugcagugucuccaggccugaguuucuucuggaacagauuccauuuuagaauggg

SEQ ID NO: 93618 - RNA, 64 nt, Human
gauauugugaaccguaccccuuccaguuuaguuucuucuggacuuuccuuacuuaacugacagu

SEQ ID NO: 93619 - RNA, 64 nt, Human
ccagggccacccagcggcccuggggccuacccaucuucuggacagccaagugccaccggagccu

SEQ ID NO: 93620 - RNA, 64 nt, Human
uggcuuccucucucuggcuggcaaagggaguuaucuucuggaauacauuagcucuuucaaaaac

SEQ ID NO: 93621 - RNA, 64 nt, Human
gugaaaaucagaauuuagaauauuuagagcuaagcuucuggaaccacguaguuucuacacgugg

SEQ ID NO: 93622 - RNA, 64 nt, Human
gggcucaaaucugggugucggcaguccugcacuccuucuggaggcucuaggggagaauucauuu

SEQ ID NO: 93623 - RNA, 64 nt, Human
uucuuucccugucuucuuucagauuaucucauuucuucuggaucugucucuguauuccucacuc

SEQ ID NO: 93624 - RNA, 64 nt, Human
caccaguggaugaaugcuggaccgagagcccuagcuucuggauccaggucuaggcccuucaucu

SEQ ID NO: 93625 - RNA, 64 nt, Human
ccugcuuugacuacgucaugcacuuccugacugucuucuggaaggugcuguuugccugugugcc

SEQ ID NO: 93626 - RNA, 64 nt, Human
auaaauauuuuuggggcauccuggaugauuucaucuucuggaauauuguuucuagaacaguaaa

SEQ ID NO: 93627 - RNA, 64 nt, Human
aaagacugaucauaaaccaaugcugguauugcaccuucuggaacuaugggcuugagaaaacccc

SEQ ID NO: 93628 - RNA, 64 nt, Human
uuaaauagaagcaggaaagggagacaaagacuggcuucuggacuuccucccugauccccacccu

SEQ ID NO: 93629 - RNA, 64 nt, Human
ucuccaguauguucggcccagcgcucuucgcacccuucuggaccaaagcgccaaggacugcagc

SEQ ID NO: 93630 - RNA, 64 nt, Human
ucguuuugaggauguggguuauacacauggagugcuucuggaacuaucagcccacuugaccacc

SEQ ID NO: 93631 - RNA, 64 nt, Human
aaccuccugaccucaugcuaauaaaaguccccagcuucuggagacccccugccggcagccccuu

SEQ ID NO: 93632 - RNA, 63 nt, Human
cugcucuccugccaucaugagauuuucucugcucuucuggaaacaaagggcucaagcaccccu

SEQ ID NO: 93633 - RNA, 64 nt, Human
ccggccccagagugcccaggcacuccugagguagcuucuggaaauggggacaaguccccucgaa

SEQ ID NO: 93634 - RNA, 54 nt, Human
uggaggugaccaguuuguaaugaacuucuggaucuccagucagauacuauggag

SEQ ID NO: 93635 - RNA, 64 nt, Human
gagguuaacugugaccaugguccagcuugaguggcuucuggagcagccacauuuucaaggacug

SEQ ID NO: 93636 - RNA, 64 nt, Human
acaaaacacuuuuuucccuggagucuucucuccacuucuggagaugaauuucuauguuuugcac

SEQ ID NO: 93637 - RNA, 64 nt, Human
aaaaaugacauuucugaccuucccgggacacauucuucuggaggcuuuacaucuacuggaguug

SEQ ID NO: 93638 - RNA, 64 nt, Human
ggaggucuucaguacuauugaaggagacauugaucuucuggauguacaguugugcagguuguuc

SEQ ID NO: 93639 - RNA, 64 nt, Human
ccguggcugcuucaacccaguuccccaggcccagcuucuggaauagacaguuccuucugguuag

SEQ ID NO: 93640 - RNA, 64 nt, Human
uuuuuuuauuauguauaauaaucucgacacccagcuucuggaauugcugcuuucuuuuuacaga

SEQ ID NO: 93641 - RNA, 64 nt, Human
aggaggaggagcuagcagacacauccaguaucuccuucuggagcacaggaugaaauaagggagc

SEQ ID NO: 93642 - RNA, 64 nt, Human
cuucuacuccucccucugacucuaagaauucucucuucuggaaucgcuugaacccaggaggcgg

SEQ ID NO: 93643 - RNA, 64 nt, Human
cucuccuggcagagguuggcccuuucucuaaugccuucuggaaggcggaaaaugugggaacuau

SEQ ID NO: 93644 - RNA, 64 nt, Human
acuccaucucgacccuggggcugaggccugaguccuucuggacucuugguacccacauugccuc

SEQ ID NO: 93645 - RNA, 64 nt, Human
gugaagcuggggcaucgaugacccaagacuuuaucuucuggaaaauauuuuucagacuccucaa

SEQ ID NO: 93646 - RNA, 64 nt, Human
gcuugcuccccugggccauuugcgguuuugugggcuucuggaggguuccccgccauccaggcug

SEQ ID NO: 93647 - RNA, 64 nt, Human
gccuccauagggaacccacugccaccugggccagcuucuggagcaugagaaccugagccagggu

SEQ ID NO: 93648 - RNA, 55 nt, Human
ucaaaggcuuccaaaucugaugcuacuucuggaauccucaauucaaccaacaucc

SEQ ID NO: 93649 - RNA, 64 nt, Human
cuguggaggccacccucuacaaagcuuuauagaacuucuggaucuaacucacaaacaagcuucc

SEQ ID NO: 93650 - RNA, 64 nt, Human
ggcauagagguugggcuggaggccuguccacuggcuucuggagcugaaggucugcgucacggug

SEQ ID NO: 93651 - RNA, 64 nt, Human
ggucagaggcucugacacugucugguuuccaaugcuucuggagacuuccugccuaggccucauc

SEQ ID NO: 93652 - RNA, 64 nt, Human
uacacucacugcgcccuuucugcugcuugguguucuucuggaggagcgugaguucucagcggag

SEQ ID NO: 93653 - RNA, 64 nt, Human
ccagagcagagggaaucauugcuggacuggauuucuucuggagggaagcaccaugaauuaaagg

SEQ ID NO: 93654 - RNA, 64 nt, Human
gaagugauuaaaugucacuuccucaucaguuucacuucuggagguuuucuuauccuacucccug

SEQ ID NO: 93655 - RNA, 64 nt, Human
ucuccucguacugcugggugagguucucgaucuccuucuggaaccucuucuuccccucuuccag

SEQ ID NO: 93656 - RNA, 64 nt, Human
uggugcuucccacggaggaguuuuggcagccagacuucuggaggaauugguuguauagaagauc

SEQ ID NO: 93657 - RNA, 64 nt, Human
ucccuguaggaagcccucucuguggcgccggcugcuucuggagcaggguggucuccggcuccuc

SEQ ID NO: 93658 - RNA, 64 nt, Human
ugaccaggguucucugaaucuguuauuguuuuugcuucuggaaaguucauuugggguuuacaac

SEQ ID NO: 93659 - RNA, 64 nt, Human
cguggcaaagaaacagucaguccucuucaggugucuucuggauuucuggugauggacagagaaa

SEQ ID NO: 93660 - RNA, 64 nt, Human
uguguguacaucggguccucccaugugugguguucuucuggagguugucucuuuggucaaggug

SEQ ID NO: 93661 - RNA, 64 nt, Human
cuucagccaguuugcuccuuggucacccuggaggcuucuggaugggacccuugagucuggggca

SEQ ID NO: 93662 - RNA, 64 nt, Human
ccucugguggagggccauggcguggaccuucacccuucuggacuguguggccaugcuggucauc

SEQ ID NO: 93663 - RNA, 64 nt, Human
ccuuggagcuucucuuccuuccgccucuguuccucuucuggagccuuugccucccaucucuuau

SEQ ID NO: 93664 - RNA, 64 nt, Human
auggagcgguguucauggaugcaacagacccuggcuucuggaguccucugugagugagggacca

SEQ ID NO: 93665 - RNA, 64 nt, Human
uguccucaugccuguauucuccaggaaacuuguccuucuggaaaucauauugaaugauauuucu

SEQ ID NO: 93666 - RNA, 64 nt, Human
ccugaggcagagcaagacggguucucaccccugacuucuggaggcuucccuugaagcucugugc

SEQ ID NO: 93667 - RNA, 64 nt, Human
uuccugaaaaggaccaguggagggaagagcuauacuucuggagaaguaggccuggaguuacuac

SEQ ID NO: 93668 - RNA, 64 nt, Human
uggugaacaguuuuggcauaauagucaauuucuacuucuggaagucaucucauuccacuguugg

SEQ ID NO: 93669 - RNA, 64 nt, Human
cuaauguccucuccuccacuguugaggcuggcugcuucuggaggcuacuuugcacucuuccucu

SEQ ID NO: 93670 - RNA, 64 nt, Human
ucuuucucuccugauucucgguuuuccuuugagucuucuggagcugccuucucaucaggugcac

SEQ ID NO: 93671 - RNA, 64 nt, Human
agagacguggggcuauuucugcagcaaguggaaccuucuggagcuggccaucauccuggccagc

SEQ ID NO: 93672 - RNA, 64 nt, Human
ccacaguugaaacuugagaagcagagcucgccaccuucuggaggccacugugaugaugagccaa

SEQ ID NO: 93673 - RNA, 64 nt, Human
gccuguacguucuggacgcguuuuguuggcugggcuucuggaggcacuggcaaggucaaacugc

SEQ ID NO: 93674 - RNA, 64 nt, Human
ucuggaaaagacccagcuaugauucauaaaaacacuucuggaugaaucaagaaccauuucuugu

SEQ ID NO: 93675 - RNA, 64 nt, Human
uacauaaaugccuuguggcagagcucccggugaacuucuggaucccguuucugaugcagacucu

SEQ ID NO: 93676 - RNA, 64 nt, Human
ugacacugcauugcugggcuguguuccucgggcucuucuggaccuugcaccguggauaccaggc

SEQ ID NO: 93677 - RNA, 64 nt, Human
gagaagagcuugcacagccaacgagacacauugccuucuggagcugggagacaaaggaggaauu

SEQ ID NO: 93678 - RNA, 64 nt, Human
gagggaccacauuccccugccuugccccugagcacuucuggagacugcguccuguccuaucugc

SEQ ID NO: 93679 - RNA, 64 nt, Human
uagucacagccaggaggucagaaggaauuuucuacuucuggauccaaauguuaccucuuagggg

SEQ ID NO: 93680 - RNA, 64 nt, Human
ucuaccagccaggucuuauguucccaggcccugucuucuggaaagcauuacugggaaguggaca

SEQ ID NO: 93681 - RNA, 64 nt, Human
ugcuucucccaaacccaccaguucuccacugucucuucuggaccaggaauuaguugcugugggu

SEQ ID NO: 93682 - RNA, 64 nt, Human
uuaucaaucuuuuuuccuuuuuccugacccccuccuucuggaggcaguugggagcuauccuugu

SEQ ID NO: 93683 - RNA, 64 nt, Human
gcgccucugcaggugacucucgggcccaagcaaccuucuggaaaacggguuaauaaauaaauca

SEQ ID NO: 93684 - RNA, 64 nt, Human
cuuugucacccugccguuucagggagcagaaguccuucuggacagugugaugccccugucaggu

SEQ ID NO: 93685 - RNA, 64 nt, Human
ucugguuuugguagcaggaggcccacuccuuugacuucuggagagucugugagacugccugaga

SEQ ID NO: 93686 - RNA, 64 nt, Human
aaaggcugggggcuguugcuggcuauccucuuugcuucuggaaguuucugccucacucagaaug

SEQ ID NO: 93687 - RNA, 64 nt, Human
uuugcacuaacucauauuagcuuuguccuaccaacuucuggaauuuaucuaauuauuguuuuuc

SEQ ID NO: 93688 - RNA, 64 nt, Human
cacagcaggccccauccagacagaccagcaggugcuucuggagacaagagcaaagccuuuuccg

SEQ ID NO: 93689 - RNA, 64 nt, Human
caugaaaauacuucauucagaguaugggcaaaugcuucuggaaaacccuucccugaagagagag

SEQ ID NO: 93690 - RNA, 64 nt, Human
cccacgguggccagccauuguggugccgccccagcuucuggauacagccuuuuggguaaacacu

SEQ ID NO: 93691 - RNA, 64 nt, Human
uggagaccugaagcccacacucgggucguauggacuucuggaaaaguucuugucuccuggacug

SEQ ID NO: 93692 - RNA, 64 nt, Human
ucaggcagugucccgccaccuuugcuucccgcuccuucuggacauuccagagcccugcaccaaa

SEQ ID NO: 93693 - RNA, 57 nt, Human
uccacgagagugaagagugagccagcccuucuggagcaggacagaagauaugcaaaa

SEQ ID NO: 93694 - RNA, 64 nt, Human
gacuucacuggggcugcuggauuggaugggaaaccuucuggaagaggcagaugggggucaaacc

SEQ ID NO: 93695 - RNA, 64 nt, Human
uuaaccccugcauagggagcagagggcgguacggcuucuggauuguuucacugugauuccuagg

SEQ ID NO: 93696 - RNA, 64 nt, Human
uggucuuuguaacaaaucaaaauuaccuuauauccuucuggaccuggaguagucuuuuaacgaa

SEQ ID NO: 93697 - RNA, 64 nt, Human
uuuuguguguggacugcccagaccucagccaggucuucuggagaugacauuugaggacugaugg

SEQ ID NO: 93698 - RNA, 50 nt, Human
cugaaagugaugaauuuuaacuucuggaaaucagacuuuuacaacuggau

SEQ ID NO: 93699 - RNA, 64 nt, Human
gugggauugugaagauuuacugacaucaaaaguucuucuggaaacaaaccuuuguuaaaaaaaa

SEQ ID NO: 93700 - RNA, 64 nt, Human
gccgccaggcaggcguggccgagggaagaaaaagcuucuggauguccagccagcugcccccuuc

SEQ ID NO: 93701 - RNA, 64 nt, Human
uuccaccuccuccuguugaccagugagucgguggcuucuggacugaagcuauuuucuucuccaa

SEQ ID NO: 93702 - RNA, 64 nt, Human
gaggugcagguccucggugcguuggcagaagaggcuucuggaguuucgaggccauaccuccuuu

SEQ ID NO: 93703 - RNA, 64 nt, Human
gcucuugacacuuccauugugugugggaacguuucuucuggagaauuggaacauguguggcccc

SEQ ID NO: 93704 - RNA, 64 nt, Human
cucagauaccagccuuccccagcggggacgggugcuucuggagcuggucccgccauccuccuuu

SEQ ID NO: 93705 - RNA, 64 nt, Human
aauuagguuuucaacaugggaagcaugaaauccacuucuggauuuggagcauccacuugaggag

SEQ ID NO: 93706 - RNA, 64 nt, Human
acgauuagaaaaauauaacuggauuuaggccuaccuucuggaauaccgcugauugugcucuuuu

SEQ ID NO: 93707 - RNA, 64 nt, Human
cccugcggagccugaagccggagagcaggcggcucuucuggaacgcagggcccgggcccuccag

SEQ ID NO: 93708 - RNA, 64 nt, Human
ugcguucuccugcguggcaguccugauuuccaugcuucuggagaauccauuucguuaacacuga

SEQ ID NO: 93709 - RNA, 64 nt, Human
ccgccacccuccuggaauaguggccuaggccggccuucuggaacguucucucccggcccugcgg

SEQ ID NO: 93710 - RNA, 64 nt, Human
aacacucccccuccccaugcaacaaagcaacuuacuucuggaguucucucccaaggagaggaca

SEQ ID NO: 93711 - RNA, 64 nt, Human
acuauagcuucauccuugauaacguccuaauuuccuucuggacaaccuccuugaccaauggcau

SEQ ID NO: 93712 - RNA, 64 nt, Human
ccccuaggccuggccuuugcagcauaguugggagcuucuggauuccaucugcaccugugagccc

SEQ ID NO: 93713 - RNA, 64 nt, Human
ucuuaguggacugggacgugaaccuuucgcucuccuucuggacugggagaagggaggcuugggu

SEQ ID NO: 93714 - RNA, 64 nt, Human
agcuggggaaacccagaacugacuucaaaggcagcuucuggacagguggugggaggggacccuu

SEQ ID NO: 93715 - RNA, 64 nt, Human
ugaggaggggccccccugcccuguggggucaacccuucuggaaacugugaagaucucacucugc

SEQ ID NO: 93716 - RNA, 64 nt, Human
ugauuacucggaccuacagagggugaaacaggagcuucuggaagaggugaagaaggaauugcag

SEQ ID NO: 93717 - RNA, 64 nt, Human
aaauggugaaggaaacagaaaaaaggucccugcccuucuggagaugacaacugaguggggaaaa

SEQ ID NO: 93718 - RNA, 64 nt, Human
augacacagaccuguacagcgacugucuccgaaccuucuggaccugcccccacuguggccugca

SEQ ID NO: 93719 - RNA, 64 nt, Human
uaguauccauacacuaugcacuacugcucugaagcuucuggaaucagaaaugaacccauuuuca

SEQ ID NO: 93720 - RNA, 64 nt, Human
accacuaauccacguuauaugucuagauuugccucuucuggacacuucauauaaauggagucau

SEQ ID NO: 93721 - RNA, 64 nt, Human
gugcaguggugccacagcucacugugaccuugaccuucuggacucaagugauccuccugccuca

SEQ ID NO: 93722 - RNA, 64 nt, Human
acugagccggccccgcgccggaguccaggggccccuucuggacgccccgcgacucuggcgaaau

SEQ ID NO: 93723 - RNA, 64 nt, Human
cuuuggggcuggagggagacguggguccaccaggcuucuggaaaaguccucaaugcaauaaaaa

SEQ ID NO: 93724 - RNA, 64 nt, Human
caacagcuucucaguucccacuuccugcugagcucuucuggacucaggaucgcagauccggggc

SEQ ID NO: 93725 - RNA, 64 nt, Human
auaggguacaggugggaucgacuguaaaugaggacuucuggaacauuccaaauauucugggguu

SEQ ID NO: 93726 - RNA, 64 nt, Human
ggaaaaguuaagccaucuccuccucuggcccuuccuucuggaaucuucagaugccuguuaggcc

SEQ ID NO: 93727 - RNA, 64 nt, Human
cauuuuccaacucauuuucagccugauccagcaucuucuggacagcuuccgguuuuuguuucuu

SEQ ID NO: 93728 - RNA, 63 nt, Human
uacauaauagauggauaugaauuacugcaggaacuucuggaggaaagcacucauugaucuuuc

SEQ ID NO: 93729 - RNA, 64 nt, Human
cagauugcaaaucucagucugaacaagaaaacuccuucuggaggaaagcuuugggaaagcagug

SEQ ID NO: 93730 - RNA, 64 nt, Human
ccugauggcugccccuuccccagacagggcuggacuucuggagcugcuaagccacccuccguuu

SEQ ID NO: 93731 - RNA, 64 nt, Human
uuggaguucccuggagccuggccagcccucaccucuucuggauagaggauucccccaacucccc

SEQ ID NO: 93732 - RNA, 64 nt, Human
gcgguggggcucugacagggaguacagcugaccgcuucuggaggguguuucuguucuuaggacu

SEQ ID NO: 93733 - RNA, 64 nt, Human
ucaggcuccccaagacuugacgcagccccccacgcuucuggagguggggagggccucuggacag

SEQ ID NO: 93734 - RNA, 64 nt, Human
cguggggugagggaucacugccaaaaugguacagcuucuggagcagaacuuuccagggauccag

SEQ ID NO: 93735 - RNA, 64 nt, Human
gagccagcaguacguggcuucagaggccuggcaucuucuggagaagcuugugguguuccugaag

SEQ ID NO: 93736 - RNA, 64 nt, Human
gcaagaggugguagaaccacuuggcugcucauuccuucuggaggacacacagucucaguccaga

SEQ ID NO: 93737 - RNA, 64 nt, Human
caccgccccccacccccgaccccguccuuagaaucuucuggaggagccucccuccccccccacc

SEQ ID NO: 93738 - RNA, 64 nt, Human
uaaauuccaccucaugaaaccacuuucgaggcuccuucuggacuguggcguucuuuccaggcua

SEQ ID NO: 93739 - RNA, 64 nt, Human
cuccagggugcauucguugcucccuggggcaccacuucuggauuacagugugccagguccuuug

SEQ ID NO: 93740 - RNA, 64 nt, Human
ugagguccugaggaacaguguccccaggaaccaccuucuggagccuagcggccagacguggcuu

SEQ ID NO: 93741 - RNA, 64 nt, Human
aaggccugccuccccauagggaaucuggggguuucuucuggaacggggcgugaggacacaagga

SEQ ID NO: 93742 - RNA, 64 nt, Human
auaugugacaaaucaccaccaccaguguuaagugcuucuggauucaugggugaguucccugggc

SEQ ID NO: 93743 - RNA, 64 nt, Human
uaaaauaaacuguauuugcaaauccaacauugagcuucuggacuacgcugacuccacugcugaa

SEQ ID NO: 93744 - RNA, 64 nt, Human
ucuggcccacuccucacccccuugcuccccuggucuucuggaguuugugacauugauuugaaau

SEQ ID NO: 93745 - RNA, 64 nt, Human
gcgaggcccuuccucuuugguggcauggaaggggcuucuggaccuaggguggccugagagggcg

SEQ ID NO: 93746 - RNA, 64 nt, Human
guguuucgcauuaagcacacacaucuggcccugacuucuggagauggauccuuccaucuugugg

SEQ ID NO: 93747 - RNA, 64 nt, Human
uaccgugguuucagccuuguguggucaucacuggcuucuggagcuauuggugauguccaaggga

SEQ ID NO: 93748 - RNA, 64 nt, Human
uuguuucaggaccugcuucgcugccguguccugacuucuggaaucuuugagaccaaguuccagg

SEQ ID NO: 93749 - RNA, 64 nt, Human
ucuuggcguccacaucacaccugugacggaagcacuucuggaagugaacacucguuuugaaagc

SEQ ID NO: 93750 - RNA, 64 nt, Human
cucuccccugcgccccugucuuuguaaauugacccuucuggaguggggggcggcgggcagggcu

SEQ ID NO: 93751 - RNA, 64 nt, Human
cagacucucuccaggcucucaagaguuauccugucuucuggauuccugccuaccccaacucccc

SEQ ID NO: 93752 - RNA, 64 nt, Human
cagcagacgugcagugccauaaggugccccaguccuucuggaggccugggcugcuacuguuggc

SEQ ID NO: 93753 - RNA, 64 nt, Human
uuaguuacuaagaaaggguguaggacacauuagccuucuggaaacaaguagaagccaucaccug

SEQ ID NO: 93754 - RNA, 64 nt, Human
gggccccgggacccugccugccucccucuggagccuucuggacuggccagcccagcgcaaagac

SEQ ID NO: 93755 - RNA, 64 nt, Human
gcucugucuccucccaccaguccaguuagcuucccuucuggaccaauagacgaggggagacccc

SEQ ID NO: 93756 - RNA, 64 nt, Human
gucugcuggagucuccacacagugguggggaggccuucuggacagacggcagucgggccccaga

SEQ ID NO: 93757 - RNA, 64 nt, Human
uguucauccuguuguuuaaggcauagcccugauccuucuggaaggcauagaacacgguuacagc

SEQ ID NO: 93758 - RNA, 64 nt, Human
ccacaccgugcauguccccagaccugccgccuggcuucuggagugcuucaagcagagcauggug

SEQ ID NO: 93759 - RNA, 64 nt, Human
gccuuccccaguguaauguagcuuucucucuuaccuucuggaagagggaauguuucauuuauua

SEQ ID NO: 93760 - RNA, 64 nt, Human
ggcugaugaagaaggcagccuuguacuucagugacuucuggaauaagcuggacgucggcgcaau

SEQ ID NO: 93761 - RNA, 64 nt, Human
gcuugccaaaggagaggccaugaaagaaccuguccuucuggaaaagugguccaugucugugcug

SEQ ID NO: 93762 - RNA, 64 nt, Human
gcaggugaggucuuuaaaguuucaaugaaaguuucuucuggaucuacagaaaaaauuuuuuuuu

SEQ ID NO: 93763 - RNA, 64 nt, Human
agacuguuagcucugcuaacagucaggacuauuccuucuggacucugugccuuugccugcacag

SEQ ID NO: 93764 - RNA, 64 nt, Human
auggcuuguuuguuguuuucaccagagugagcuccuucuggacauacugccuggcagccugccu

SEQ ID NO: 93765 - RNA, 64 nt, Human
cucccucggcacuccaggcuuauaauuucgaacucuucuggaaggucacucaggaacacccucc

SEQ ID NO: 93766 - RNA, 64 nt, Human
auuccaggaagggguguccaggacaauuaccuuccuucuggagaaacuucccuuaaucaaauaa

SEQ ID NO: 93767 - RNA, 64 nt, Human
aggacacuuccaggguuaggacagagcauuuagccuucuggaagaaccccugccugggguggga

SEQ ID NO: 93768 - RNA, 64 nt, Human
cuuagcagaguucugagacugggugaggcagggacuucuggaagguucuguuccugcccuuuuu

SEQ ID NO: 93769 - RNA, 64 nt, Human
ggacaggagcagauguguggugggguuggacucucuucuggagacccagacaauucagucucca

SEQ ID NO: 93770 - RNA, 64 nt, Human
ugauacagaccuuugcaggaccugaugagugacccuucuggagcuggccagguccucugcagca

SEQ ID NO: 93771 - RNA, 64 nt, Human
cccccauccccuguggcccucuaaugacaccauucuucuggaaaaugcuggagaagcaauaaag

SEQ ID NO: 93772 - RNA, 64 nt, Human
cacucaggacagagccaacccuggcuccguggaccuucuggaggaagguggggguuucaaagac

SEQ ID NO: 93773 - RNA, 64 nt, Human
ccaguguguacuuggcuuaacucaagaacaguuucuucuggauuccuuauuugauuuauuuaac

SEQ ID NO: 93774 - RNA, 64 nt, Human
uuuuuuaaaggauuccaagccaugugaaacuucccuucuggaugugauucugggucgcaagucc

SEQ ID NO: 93775 - RNA, 64 nt, Human
gucucucuguaaggaaaaucacugacagcagcuccuucuggacccagucuggaaggucuagagg

SEQ ID NO: 93776 - RNA, 64 nt, Human
ggagaugaggggguccccaugugcuuuuccaguucuucuggaauugggggacccccgccaaaga

SEQ ID NO: 93777 - RNA, 64 nt, Human
uuuugauauggagggaacacugaaagacaguuuccuucuggaguuccaaaugcaauauagaaaa

SEQ ID NO: 93778 - RNA, 64 nt, Human
uccucuugggcccaaaugaacauuguaccauagucuucuggaaagcaaacaugcuuccugcuau

SEQ ID NO: 93779 - RNA, 64 nt, Human
caguggcaugaucucagcucacugcaaccucugccuucuggauucaagugauucuccugccuca

SEQ ID NO: 93780 - RNA, 64 nt, Human
uaugacauuuaaacucugugccuacuaaagguaucuucuggaguuuuugggaggagagaaacug

SEQ ID NO: 93781 - RNA, 64 nt, Human
agccuguuucagaggaacaucgucacaacgaauacuucuggaagcuuaacaaaacuaacccugc

SEQ ID NO: 93782 - RNA, 64 nt, Human
accuccagccugggagauaggccuugcuugcugccuucuggauucuuggcccgcacagagcugg

SEQ ID NO: 93783 - RNA, 64 nt, Human
ugcaaccacgaaucgacugucucuguagauuggccuucuggacguucuacauaaaugaaaucau

SEQ ID NO: 93784 - RNA, 64 nt, Human
aggguuuucuccugccuuaggaaaaauacugcaucuucuggaaucuagaaaaaaaaaaaaaaaa

SEQ ID NO: 93785 - RNA, 64 nt, Human
gaaugcaauuccugaggcccgcugcuguguguggcuucuggaugggacaacuguagaggcaguu

SEQ ID NO: 93786 - RNA, 64 nt, Human
uuccauucaucccuugcucucuuggaucugaacucuucuggagccucagcucaggauagcugcu

SEQ ID NO: 93787 - RNA, 64 nt, Human
uuuaugcuuuuaacuuauuuucuaccuggauaaacuucuggaacuuggcuuuuaaauuuaacuu

SEQ ID NO: 93788 - RNA, 64 nt, Human
ccucccuguuccagccaaagacuucauccggcaccuucuggagcgagacccccagaagagguuc

SEQ ID NO: 93789 - RNA, 64 nt, Human
uuuuauguauuauacuuagucaaauguaauguggcuucuggaaucauuguccagagcugcuucc

SEQ ID NO: 93790 - RNA, 64 nt, Human
caaucaguagcuuaagaaaaaaccguguuugucucuucuggaaugguuagaagugagggaguuu

SEQ ID NO: 93791 - RNA, 64 nt, Human
cccggcagguuggggcgucuuccagaaccucucccuucuggagccacucugcacugcgggcuaa

SEQ ID NO: 93792 - RNA, 64 nt, Human
ggucggguccaccaugaggauaaaaccuccuucucuucuggacauguccaggaguggccguugc

SEQ ID NO: 93793 - RNA, 64 nt, Human
agccaggacugauggcaugugccuguaaucccagcuucuggaggcugaggccagagaaucgcuu

SEQ ID NO: 93794 - RNA, 64 nt, Human
ggccccgccaggcuggagcccggagggucugcugggcgagcagggcaggugcaggccgccugcc

SEQ ID NO: 93795 - RNA, 64 nt, Human
aaaguauaugccugcuggauggaagaaucucuugggcgagcaccauuuuucuuuccaucaccuu

SEQ ID NO: 93796 - RNA, 64 nt, Human
ggcuguguucucugaucuaggccuucccagaggaggcgagcagaagcugugccacuuggaauug

SEQ ID NO: 93797 - RNA, 64 nt, Human
auuacuaaaaacacaaaaauuagccagguguggcggcgagcaccuguaaucccagcuacucggg

SEQ ID NO: 93798 - RNA, 64 nt, Human
gcacuccauaaccuccaucuucucccacacugauggcgagcagccccugagcacuuucugggac

SEQ ID NO: 93799 - RNA, 64 nt, Human
cagucccuuccuuggucugaagaaauucugcaguggcgagcaguuucccacuugccaaagaucc

SEQ ID NO: 93800 - RNA, 64 nt, Human
ggggaccucggagcugcucuaaggcgccugcagaggcgagcagagcccgcagcccacgccuucu

SEQ ID NO: 93801 - RNA, 64 nt, Human
cagcuguguguccuucuccaucuacacggccuggggcgagcacugugagcaccugagcaugaaa

SEQ ID NO: 93802 - RNA, 64 nt, Human
cgccugcaagcgucaggcacacagggacagacauggcgagcacagugcaggcccggggcccacg

SEQ ID NO: 93803 - RNA, 64 nt, Human
cagagggcagcauuguguuggucaauguucccuuggcgagcaauugaaacuuguuuaggcccua

SEQ ID NO: 93804 - RNA, 64 nt, Human
ccacccccaggaagggcugauuucaaaaucugggggcgagcaaccucaaggaacacaauuuccc

SEQ ID NO: 93805 - RNA, 64 nt, Human
uuauuagagcugugagagcuugggggacacaccuggcgagcaagcucgcuuuuuaaaaaugaaa

SEQ ID NO: 93806 - RNA, 62 nt, Human
cagagaauuacagacucuagcugcugccugggggcgagcagccuaccagaugucgauuugca

SEQ ID NO: 93807 - RNA, 64 nt, Human
aggccaagguggggggaucacaaggucacuagauggcgagcauccuggccaacauggugaaacc

SEQ ID NO: 93808 - RNA, 64 nt, Human
augaaacguccacauaguauugugcuguaacuuaggcgagcagaggaaaccccuuccugggccu

SEQ ID NO: 93809 - RNA, 64 nt, Human
gcacagggagagaaacaggauaggaaagcagaauggcgagcagccuauggcccagggccuguaa

SEQ ID NO: 93810 - RNA, 64 nt, Human
ucacuggggucaggcugauggagacaguaacacuggcgagcaggugccccagcucggacuauac

SEQ ID NO: 93811 - RNA, 64 nt, Human
cccauccucucccaggaccaggaguuuaugaccaggcgagcacaaauggcuaaaagccaagcug

SEQ ID NO: 93812 - RNA, 64 nt, Human
uucgcccucauguggaaagaggagcugggaccgcggcgagcagcacggagcggaagggagagca

SEQ ID NO: 93813 - RNA, 64 nt, Human
aggaccucaccuuggcucuguugcuguccuccagggcgagcacuuuccacuuccagagggggcc

SEQ ID NO: 93814 - RNA, 64 nt, Human
gaugacagaauuucuggauaguaggauuuuaauaggcgagcaaauaaaauucaaaucaauuuca

SEQ ID NO: 93815 - RNA, 64 nt, Human
aagcacauagcaagcugaacuguccuaaggcaggggcgagcacggaacaauggggccuucagcu

SEQ ID NO: 93816 - RNA, 64 nt, Human
agugacugugugugggguuugacaacuguggaaaggcgagcagaaaacuccggcggucugaggc

SEQ ID NO: 93817 - RNA, 64 nt, Human
gcggggcaggaguggccaagcgcgcaagggcgcgggcgagcaggccugugaauucgcaggauca

SEQ ID NO: 93818 - RNA, 64 nt, Human
gauggugccaggaaagccacuggaauugucacacggcgagcacagagggccggccaccaguccu

SEQ ID NO: 93819 - RNA, 64 nt, Human
ugacgccaagaaugaaguggcccacugcagcccuggcgagcaggcuucuuggauggacagugcu

SEQ ID NO: 93820 - RNA, 64 nt, Human
gaccuggagcacaugcccaguggggagagucuggggcgagcaaccgcccugguggugcaggcug

SEQ ID NO: 93821 - RNA, 64 nt, Human
ggacccgcuucccaccugcugcggucaccaugguggcgagcacagcaaccccagguguccagag

SEQ ID NO: 93822 - RNA, 64 nt, Human
cagcuaaggccucgcugccagccuucugacggcgggcgagcacacggucucuuccccugcccca

SEQ ID NO: 93823 - RNA, 64 nt, Human
gccuuucugggaugggagagaaggugagggagccggcgagcagguucuacccucucugcuaagg

SEQ ID NO: 93824 - RNA, 64 nt, Human
ggcccaccgaugagagagaugguggcagccgccaggcgagcaggcugcuuucccugcccaguca

SEQ ID NO: 93825 - RNA, 64 nt, Human
ugcggccacgugaggcuccgcaucagcagccaggggcgagcacuaguggacaaagccagcaaau

SEQ ID NO: 93826 - RNA, 64 nt, Human
cucggcccaaaccaugcuccccagcaguggcaauggcgagcacccugcagcugggcgggcaggc

SEQ ID NO: 93827 - RNA, 60 nt, Human
ccaagaccccaucccagugaccacagugcuggcgagcaccgaugacugcugggggcugcc

SEQ ID NO: 93828 - RNA, 64 nt, Human
guuccgugagcagacacaaaacgguggcagguuuggcgagcacgaacuagaccaagcgaagggc

SEQ ID NO: 93829 - RNA, 64 nt, Human
cuccagaguccagagccaggaaggggcugcugagggcgagcauccugcugggcucucugcccgg

SEQ ID NO: 93830 - RNA, 64 nt, Human
ggcacgcacuugccuguuggcugcugcggcugugggcgagcaugggggcugccagcgucuguug

SEQ ID NO: 93831 - RNA, 64 nt, Human
uccgcuaaaaauacgaaaauuagccaggcgugguggcgagcaccugucaucccagcuacuuggg

SEQ ID NO: 93832 - RNA, 64 nt, Human
ugggacgcccaccgccccuuucccuccgcugccaggcgagcauguugugguaauucuggaacac

SEQ ID NO: 93833 - RNA, 64 nt, Human
cuuguuuucuagcuuuggaucauuuuuguaccaaggcgagcaagccuuuuugaaaaauaacaaa

SEQ ID NO: 93834 - RNA, 64 nt, Human
cgcgucgccacggcuccucugauccuuuaggguuggcgagcaucucuggaaauagcuuuugcag

SEQ ID NO: 93835 - RNA, 64 nt, Human
ugaagcaggaaugugacucccugggcccccagauggcgagcagcaccaccuccaagccgucauc

SEQ ID NO: 93836 - RNA, 64 nt, Human
cacccguccucccugcucugagacacaccccuguggcgagcaccgcagaaacgggaagccacua

SEQ ID NO: 93837 - RNA, 64 nt, Human
ucacgccuguaaucccaacacuuugggaggccgaggcgagcagaucaccugagguccggauuuc

SEQ ID NO: 93838 - RNA, 64 nt, Human
ucuggguaacagggcacaccccucuaguuucaugggcgagcacccccaucugccaccucagacu

SEQ ID NO: 93839 - RNA, 64 nt, Human
aacuuacucucuugaguucuuacauacacuucaaggcgagcagaucaaagaaaaaucccccuua

SEQ ID NO: 93840 - RNA, 64 nt, Human
uuugccccucccuucagagccuggucacacaaggggcgagcaccaggccagccugggacuggcc

SEQ ID NO: 93841 - RNA, 64 nt, Human
gccccugcaguggguguuacgggcggugugcccuggcgagcaagcuuugauucuugguucuuug

SEQ ID NO: 93842 - RNA, 64 nt, Human
uuacaccuguaaucccagcacuuugggaggccgaggcgagcagaucacgaggucaggagaccga

SEQ ID NO: 93843 - RNA, 64 nt, Human
ucccacccgucucgugcuguugcuucccguagauggcgagcaccuugcaggcagccuucugauc

SEQ ID NO: 93844 - RNA, 64 nt, Human
ggagggcuccagaccuuucugagcccugcuuggaggcgagcauuuucacugcuaggacaagcuc

SEQ ID NO: 93845 - RNA, 64 nt, Human
cagcccucucuugccaaaaagcacaagauguugaggcgagcagggcaggcccccggggaggggc

SEQ ID NO: 93846 - RNA, 64 nt, Human
ggcaucacagaagcacaggaggccaguucugaaaggcgagcagaacucccccuggggaggaagc

SEQ ID NO: 93847 - RNA, 64 nt, Human
gaaaaaacugagcagcgccaacucccugccagcgggcgagcaggacaguccgcgccugggggac

SEQ ID NO: 93848 - RNA, 64 nt, Human
cagggugggagggagggacaagggggaggaaaggggcgagcacccacgugagagaaucugccug

SEQ ID NO: 93849 - RNA, 64 nt, Human
agcggaaggagggagcucugaugagcacgguuugucacacgauaaagggauuuuuuuuuucagg

SEQ ID NO: 93850 - RNA, 64 nt, Human
ugaagacguuggacccaaguuaggugugacacguucacacgacuauguagcacaugccgggagu

SEQ ID NO: 93851 - RNA, 64 nt, Human
auuuaaaauuucuuuuccugggaaucaagguaacucacacgacuacuugcaguacaaauuuuuu

SEQ ID NO: 93852 - RNA, 64 nt, Human
auugaugaugacuacgucccgugucuccaggggaucacacgagcuagcuucugcaauguuuauc

SEQ ID NO: 93853 - RNA, 64 nt, Human
uggcaggagggaacaggugccaccugcuggacaaucacacgaaaggcaggcgggcuguguacug

SEQ ID NO: 93854 - RNA, 64 nt, Human
caggugccagccugaggcagccacuucggccaggucacacgaccggggccagcaccacuuccuu

SEQ ID NO: 93855 - RNA, 64 nt, Human
ucacguguguuuaugaaaucuaaugggaaauggaucacacgauuucuuuaagggaauuaaaaaa

SEQ ID NO: 93856 - RNA, 64 nt, Human
uugcuccaggguuauucuccuccucgagucacagucacacgaauaccugccuucucuggcuuuc

SEQ ID NO: 93857 - RNA, 64 nt, Human
acacccuggcccugcgcaacgcaagcaucggacuucacacgagggaagucaguaaaaacuacga

SEQ ID NO: 93858 - RNA, 64 nt, Human
cauguguauccaugcauuauauacccuggugcaaucacacgacugucaucuaaaguccuggccc

SEQ ID NO: 93859 - RNA, 64 nt, Human
caaugagcugaggguagcugcuuugcugaagaccucacacgauguccaaucucauccaaauaac

SEQ ID NO: 93860 - RNA, 64 nt, Human
cccccucccgaguggacuguccaagcagauaggcucacacgagaaacagugaggcugaaagggg

SEQ ID NO: 93861 - RNA, 64 nt, Human
cuuuuauuuuuuauuaagggacccugcaggaguuucacacgagagugguccuucccuuugccug

SEQ ID NO: 93862 - RNA, 64 nt, Human
acggugcuuguuugaauuuucugauaucugauuuucacacgaauauacuuuuuguuuguuuucc

SEQ ID NO: 93863 - RNA, 64 nt, Human
caguucugacccaggcccggcuccacccugcaccucacacgagggagcugccccugggugggcg

SEQ ID NO: 93864 - RNA, 64 nt, Human
ugaccaaaccccacagaacagagggcaccaggcaucacacgacaucuuucccucccaucucugc

SEQ ID NO: 93865 - RNA, 64 nt, Human
acuguaagacauuaguaacauaauaaauuaaaagucacacgaaucucaccaacauaauucgugu

SEQ ID NO: 93866 - RNA, 64 nt, Human
acauguccauacacagaaacauaauaaacaaucuucacacgaaaccaaaaauagcauacaccua

SEQ ID NO: 93867 - RNA, 64 nt, Human
agggaguagggaguggugggaagggaguugcuugucacacgaaucaggaaacugcucucccuca

SEQ ID NO: 93868 - RNA, 64 nt, Human
gcacuccuuggcgucagccucucagguccuccauucacacgagguccuccucgcucuggccgcu

SEQ ID NO: 93869 - RNA, 64 nt, Human
auaaacuguuguaugccuggugcuuugcgacuugucacacgaggucacguguggaauuuuccac

SEQ ID NO: 93870 - RNA, 64 nt, Human
guucuuccugucuccuuugaaguagacucauucuucacacgauugaccuguccucuuugugaua

SEQ ID NO: 93871 - RNA, 64 nt, Human
uuggcuuaucaagccuaguguaaauuucugcaucucacacgacuuuaguuuggccagguauuua

SEQ ID NO: 93872 - RNA, 64 nt, Human; identical to SEQ ID NO: 84804

SEQ ID NO: 93873 - RNA, 64 nt, Human
ugcuccccagauucccacccccucaauguuccucucacacgaaacccccaucagucccuuuggu

SEQ ID NO: 93874 - RNA, 64 nt, Human
ugauucuaaugaucagcuuugacuggaccucagcucacacgaaucuccaaggaaaaacucuaca

SEQ ID NO: 93875 - RNA, 64 nt, Human
ugccagguccuugcccuuuguggaaagucacaggucacacgaggggccccguguccugccuguc

SEQ ID NO: 93876 - RNA, 64 nt, Human
uuccuggcauguaagugcccacuuccucauguuuucacacgauggagaccaacaaauaggucgg

SEQ ID NO: 93877 - RNA, 64 nt, Human
guauuggagaagggauggucaguuagccugucugucacacgacggaauggauacugggcccggg

SEQ ID NO: 93878 - RNA, 64 nt, Human
uugucucagcacaugcgcacacgcacacucggacucacacgaagucacacgcacacaugcacgc

SEQ ID NO: 93879 - RNA, 60 nt, Human
aacccuuggugugggucugaggucuugacucaacgagagcacuugaaaaugaaaugacug

SEQ ID NO: 93880 - RNA, 64 nt, Human
gagcugagauggcaccacugcacuccggccuaggcaacgagagcaaaacuccaauacaaacaaa

SEQ ID NO: 93881 - RNA, 64 nt, Human
gcugccuaguggccaguggguggggcaagacugucaacgagauuuacagcuggcuuacacaugc

SEQ ID NO: 93882 - RNA, 64 nt, Human
cauuuuguuaaaggucuacuuuaaucagaaauagcaacgagaugaauguauccaacauuucaau

SEQ ID NO: 93883 - RNA, 64 nt, Human
cagaaguucaagccgagaugcugacguugcugagcaacgagauggugagcaucagugcaaaugc

SEQ ID NO: 93884 - RNA, 64 nt, Human
ugauaaagaagaugcuaccaaugaaauagaaaaccaacgagaugagaagacugugauccucaug

SEQ ID NO: 93885 - RNA, 64 nt, Human
agagcugcccuaacagaacacuucauccucacuccaacgagaaaucuacagaugcccagagguu

SEQ ID NO: 93886 - RNA, 64 nt, Human
uauuaaguuggguccuaaguugggucuuuugugucaacgagaucaucucuucuagaaauaucaa

SEQ ID NO: 93887 - RNA, 64 nt, Human
cccgcaggguggagaucgcugcaucccugcagcucaacgagacccaagugaagaucugguucca

SEQ ID NO: 93888 - RNA, 64 nt, Human
uggaggagaugcagggccaccugaagcgggccuccaacgagagcacccgccagaggcugcagca

SEQ ID NO: 93889 - RNA, 64 nt, Human
ucacugaucauuagagaaaugcaaaucgaaacaacaacgagauaccaucucacaccaguccaaa

SEQ ID NO: 93890 - RNA, 64 nt, Human
aaacuuaacaccccacugucaacauuagacacaccaacgagacagaaaguuaaaaaaggauauc

SEQ ID NO: 93891 - RNA, 64 nt, Human
uuuuucauagcagccgggcacacuuuggugaccccaacgagaacccucucggcagcagccagga

SEQ ID NO: 93892 - RNA, 64 nt, Human; identical to SEQ ID NO: 93885

SEQ ID NO: 93893 - RNA, 64 nt, Human
ugaccgaguucggcaauaaguacuggcucaugcucaacgagaaggaggcccagcaaguguaugg

SEQ ID NO: 93894 - RNA, 64 nt, Human
gagcugagaucaugccauugcacuccagccugggcaacgagagugaaacuccguccccaccccc

SEQ ID NO: 93895 - RNA, 64 nt, Human
ugcuccccagugacuuccaguguaacaguugugucaacgagaucuccacaaauaaaaggacaag

SEQ ID NO: 93896 - RNA, 64 nt, Human
cuaacugaacccucucuggcuggacuguuaaaagcaacgagaggccccggcacaccuggaagcu

SEQ ID NO: 93897 - RNA, 64 nt, Human
aaaagauuauuuaaauaggauuuaaaucaugcaacaacgagaguaucacagccaggaugacccu

SEQ ID NO: 93898 - RNA, 64 nt, Human
aaaugcguuagcacacgugggaagcugcagagagcaacgagaaaaggaacucucaccucgaucu

SEQ ID NO: 93899 - RNA, 64 nt, Human
ugcgcucguuccgguccccacagacugccccagccaacgagauugcuggaaaccaagucaggcc

SEQ ID NO: 93900 - RNA, 64 nt, Human
uuuuccuucuucauccuccuccuuuuuuaaaagucaacgagagccuucgcugacuccaccgaag

SEQ ID NO: 93901 - RNA, 64 nt, Human
gagccaagaccaugccauuacacucaagcuugggcaacgagagcaaaacucugucucaaaaaaa

SEQ ID NO: 93902 - RNA, 64 nt, Human
gggccgagccacgcagcggcuucgaggagcugaacaacgagaacaagagcacacugcaguugga

SEQ ID NO: 93903 - RNA, 64 nt, Human
cucaaaccccuuccagucaaggaacuagaaucagcaacgagaguuggaagccuucccacagcuu

SEQ ID NO: 93904 - RNA, 64 nt, Human
acuuugggaggccgaggcaggcggaucacaaggucaacgagaucgagaccauccuggccaacau

SEQ ID NO: 93905 - RNA, 64 nt, Human
aaacucgggcuugagugagaagagcuugcacagccaacgagacacauugccuucuggagcuggg

SEQ ID NO: 93906 - RNA, 64 nt, Human
ccaggccaaccuuggcuaaauggagcagcgaaaucaacgagaaacuggacuuuuuaaacccucu

SEQ ID NO: 93907 - RNA, 64 nt, Human
aaagcagggccgagacagaaagaaaauagauucucaacgagauuucacuguggcuucuccagca

SEQ ID NO: 93908 - RNA, 64 nt, Human
auguguauauauuuuuuuuuaagcucugagcugucaacgagacguuuccuaccgaucucggcug

SEQ ID NO: 93909 - RNA, 64 nt, Human
uucaucacggaaacagaccccccgagagaagccccaacgagauuuuccggugaauacgggacug

SEQ ID NO: 93910 - RNA, 64 nt, Human
ucugcuuuaagccuuagccagcuagugacgaguacaacgagauaacgcccauguguuuuggaac

SEQ ID NO: 93911 - RNA, 64 nt, Human
ugcuaggaagagcgacucaaacuaacaauggcuucaacgagaagcagguuuauuuuuuccagca

SEQ ID NO: 93912 - RNA, 59 nt, Human
cccagcaguggacuuggugagcgccgccccaacgagacucgcggccccaggcccaggcc

SEQ ID NO: 93913 - RNA, 64 nt, Human
gccccacccacaagguagaaacaaccccuagagucaacgagaaagucauuuucagaaaaucuac

SEQ ID NO: 93914 - RNA, 64 nt, Human
cagauugaccaagcgccagagacaaaauguggcacaacgagaaccccagcccuguccagguggc

SEQ ID NO: 93915 - RNA, 64 nt, Human
gagcuaagaucacgccauugcacuccagccugggcaacgagagggaaacucuguuucaaaaaaa

SEQ ID NO: 93916 - RNA, 64 nt, Human
accccaacugcccugucacgcgcuuccccgugcccaacgagaaggugcccugggaggugagcgc

SEQ ID NO: 93917 - RNA, 64 nt, Human
ccuugggggcacccucauuuuguuuccauuccaacaacgagaacagagauguucuggcaucauu

SEQ ID NO: 93918 - RNA, 64 nt, Human
gagccgagaucacgccauugcauucuagccugggcaacgagagcgaaacucugucucaaaaaaa

SEQ ID NO: 93919 - RNA, 64 nt, Human; identical to SEQ ID NO: 20268

SEQ ID NO: 93920 - RNA, 64 nt, Human; identical to SEQ ID NO: 20269

SEQ ID NO: 93921 - RNA, 64 nt, Human; identical to SEQ ID NO: 20270

SEQ ID NO: 93922 - RNA, 64 nt, Human; identical to SEQ ID NO: 20271

SEQ ID NO: 93923 - RNA, 64 nt, Human; identical to SEQ ID NO: 20272

SEQ ID NO: 93924 - RNA, 54 nt, Human; identical to SEQ ID NO: 20273

SEQ ID NO: 93925 - RNA, 64 nt, Human; identical to SEQ ID NO: 20274

SEQ ID NO: 93926 - RNA, 59 nt, Human; identical to SEQ ID NO: 20275

SEQ ID NO: 93927 - RNA, 64 nt, Human; identical to SEQ ID NO: 20276

SEQ ID NO: 93928 - RNA, 64 nt, Human; identical to SEQ ID NO: 20277

SEQ ID NO: 93929 - RNA, 64 nt, Human; identical to SEQ ID NO: 20278

SEQ ID NO: 93930 - RNA, 64 nt, Human; identical to SEQ ID NO: 20279

SEQ ID NO: 93931 - RNA, 64 nt, Human; identical to SEQ ID NO: 20280

SEQ ID NO: 93932 - RNA, 64 nt, Human; identical to SEQ ID NO: 20281

SEQ ID NO: 93933 - RNA, 59 nt, Human; identical to SEQ ID NO: 20282

SEQ ID NO: 93934 - RNA, 64 nt, Human; identical to SEQ ID NO: 20283

SEQ ID NO: 93935 - RNA, 64 nt, Human; identical to SEQ ID NO: 20284

SEQ ID NO: 93936 - RNA, 64 nt, Human; identical to SEQ ID NO: 20285

SEQ ID NO: 93937 - RNA, 64 nt, Human; identical to SEQ ID NO: 20286

SEQ ID NO: 93938 - RNA, 64 nt, Human; identical to SEQ ID NO: 20287

SEQ ID NO: 93939 - RNA, 64 nt, Human; identical to SEQ ID NO: 20288

SEQ ID NO: 93940 - RNA, 64 nt, Human; identical to SEQ ID NO: 20289

SEQ ID NO: 93941 - RNA, 64 nt, Human; identical to SEQ ID NO: 20290

SEQ ID NO: 93942 - RNA, 64 nt, Human; identical to SEQ ID NO: 20291

SEQ ID NO: 93943 - RNA, 64 nt, Human; identical to SEQ ID NO: 20292

SEQ ID NO: 93944 - RNA, 64 nt, Human; identical to SEQ ID NO: 20293

SEQ ID NO: 93945 - RNA, 64 nt, Human; identical to SEQ ID NO: 20294

SEQ ID NO: 93946 - RNA, 64 nt, Human; identical to SEQ ID NO: 20295

SEQ ID NO: 93947 - RNA, 64 nt, Human; identical to SEQ ID NO: 20296

SEQ ID NO: 93948 - RNA, 64 nt, Human; identical to SEQ ID NO: 20297

SEQ ID NO: 93949 - RNA, 64 nt, Human; identical to SEQ ID NO: 20298

SEQ ID NO: 93950 - RNA, 64 nt, Human; identical to SEQ ID NO: 20299

SEQ ID NO: 93951 - RNA, 64 nt, Human; identical to SEQ ID NO: 20300

SEQ ID NO: 93952 - RNA, 64 nt, Human; identical to SEQ ID NO: 20301

SEQ ID NO: 93953 - RNA, 64 nt, Human; identical to SEQ ID NO: 20302

SEQ ID NO: 93954 - RNA, 64 nt, Human; identical to SEQ ID NO: 20303

SEQ ID NO: 93955 - RNA, 64 nt, Human; identical to SEQ ID NO: 20304

SEQ ID NO: 93956 - RNA, 64 nt, Human; identical to SEQ ID NO: 20305

SEQ ID NO: 93957 - RNA, 64 nt, Human; identical to SEQ ID NO: 20306

SEQ ID NO: 93958 - RNA, 64 nt, Human; identical to SEQ ID NO: 20307

SEQ ID NO: 93959 - RNA, 64 nt, Human; identical to SEQ ID NO: 20308

SEQ ID NO: 93960 - RNA, 55 nt, Human; identical to SEQ ID NO: 20309

SEQ ID NO: 93961 - RNA, 60 nt, Human; identical to SEQ ID NO: 20310

SEQ ID NO: 93962 - RNA, 64 nt, Human; identical to SEQ ID NO: 20311

SEQ ID NO: 93963 - RNA, 64 nt, Human; identical to SEQ ID NO: 20312

SEQ ID NO: 93964 - RNA, 57 nt, Human; identical to SEQ ID NO: 20313

SEQ ID NO: 93965 - RNA, 64 nt, Human; identical to SEQ ID NO: 20314

SEQ ID NO: 93966 - RNA, 64 nt, Human; identical to SEQ ID NO: 20315

SEQ ID NO: 93967 - RNA, 64 nt, Human; identical to SEQ ID NO: 20316

SEQ ID NO: 93968 - RNA, 64 nt, Human; identical to SEQ ID NO: 20317

SEQ ID NO: 93969 - RNA, 64 nt, Human; identical to SEQ ID NO: 20318

SEQ ID NO: 93970 - RNA, 64 nt, Human; identical to SEQ ID NO: 20319

SEQ ID NO: 93971 - RNA, 64 nt, Human; identical to SEQ ID NO: 20320

SEQ ID NO: 93972 - RNA, 64 nt, Human; identical to SEQ ID NO: 20321

SEQ ID NO: 93973 - RNA, 64 nt, Human; identical to SEQ ID NO: 20322

SEQ ID NO: 93974 - RNA, 64 nt, Human; identical to SEQ ID NO: 20323

SEQ ID NO: 93975 - RNA, 64 nt, Human; identical to SEQ ID NO: 20324

SEQ ID NO: 93976 - RNA, 64 nt, Human; identical to SEQ ID NO: 20325

SEQ ID NO: 93977 - RNA, 64 nt, Human; identical to SEQ ID NO: 20326

SEQ ID NO: 93978 - RNA, 64 nt, Human; identical to SEQ ID NO: 20327

SEQ ID NO: 93979 - RNA, 64 nt, Human; identical to SEQ ID NO: 20328

SEQ ID NO: 93980 - RNA, 64 nt, Human; identical to SEQ ID NO: 20329

SEQ ID NO: 93981 - RNA, 64 nt, Human; identical to SEQ ID NO: 20330

SEQ ID NO: 93982 - RNA, 64 nt, Human; identical to SEQ ID NO: 20331

SEQ ID NO: 93983 - RNA, 59 nt, Human; identical to SEQ ID NO: 20282

SEQ ID NO: 93984 - RNA, 64 nt, Human; identical to SEQ ID NO: 20333

SEQ ID NO: 93985 - RNA, 64 nt, Human; identical to SEQ ID NO: 20334

SEQ ID NO: 93986 - RNA, 62 nt, Human
agccguagauuccgugccugccgccgcagcgccgccgacaacgcgggugcaggggggcgcgg

SEQ ID NO: 93987 - RNA, 62 nt, Human
auccuucggaccucaccacgcgaaacuacgcccgccgacagaaacaucugcaaagauacagu

SEQ ID NO: 93988 - RNA, 62 nt, Human
ugcgcaggcacagaggacgaggagcaagcuggcgccgacauggcgaaggcaaggucuucccc

SEQ ID NO: 93989 - RNA, 62 nt, Human
cuggaugacauggugccugaauucuuucuuuucgccgacacgauggcagccaaacugcagcu

SEQ ID NO: 93990 - RNA, 62 nt, Human
cucuuggccacguguuuccaguggcuggaccacgccgacaccugggaucuugagauacccag

SEQ ID NO: 93991 - RNA, 62 nt, Human
cuugaccgugaggagcugcuauccgcaaccagcgccgacaccaugcccccucuuccugguga

SEQ ID NO: 93992 - RNA, 62 nt, Human
ccacacguggccucugcgcccagcacggugcucgccgacaguggugucugaacccuugggga

SEQ ID NO: 93993 - RNA, 62 nt, Human
auguacauagcuuuucucagcugccugcgcgccgccgacagucagcgcugugcgcgcggaga

SEQ ID NO: 93994 - RNA, 62 nt, Human
ccccagcaccagagcacaaugagaaacggcagcgccgacaggagcggcggcagaugaagcgg

SEQ ID NO: 93995 - RNA, 62 nt, Human
gggucucagucgugcuaggcaucgggcggcagcgccgacagcccuucccucgccagugcccc

SEQ ID NO: 93996 - RNA, 56 nt, Human
ccugcaagguggaguucuagccccaucgccgacacgccccccacucagcccagccc

SEQ ID NO: 93997 - RNA, 64 nt, Human
ggccguggaggggguccuagcuccgcugcauucugcaucccaagugggcacguggaggaagggu

SEQ ID NO: 93998 - RNA, 64 nt, Human
auuugcucagaagaaggcuggucugguccuaacugcaucccacacugcccagaucauucuagaa

SEQ ID NO: 93999 - RNA, 64 nt, Human
ugauacgacagcucucugugcacugauugcauaugcaucccaagauuauauuauuguuuucuac

SEQ ID NO: 94000 - RNA, 64 nt, Human
gcuuuuggcagggaugagugaggcccugcagagagcaucccaggccaagguucccacucagccu

SEQ ID NO: 94001 - RNA, 64 nt, Human
ugcucacacagacacacccagcugcacacaugaggcaucccacaugacacgggcugacacaguc

SEQ ID NO: 94002 - RNA, 64 nt, Human
cugcugcccaggcugugcagcgcagcuggacucugcaucccagcaccugccuccucguuccuuu

SEQ ID NO: 94003 - RNA, 64 nt, Human; identical to SEQ ID NO: 94002

SEQ ID NO: 94004 - RNA, 64 nt, Human; identical to SEQ ID NO: 94002

SEQ ID NO: 94005 - RNA, 64 nt, Human
gucucgcccccugcacagcacuggccuuucggaagcaucccaguaggguuuucugaggcucgcu

SEQ ID NO: 94006 - RNA, 64 nt, Human
aucuugcagcuagacccuuugagacuuaagagcugcaucccaggaucagaagccagggcuaauu

SEQ ID NO: 94007 - RNA, 64 nt, Human
cucuauccuuagcugaagacaaacuagaggagcagcaucccagguaguuuggcuuuugacugca

SEQ ID NO: 94008 - RNA, 64 nt, Human
gucuucggggaagagaggugggguggggcuacuagcaucccaauuuagaaaacagaggaguuug

SEQ ID NO: 94009 - RNA, 64 nt, Human
cucgaucucuugaccucgugauccgcccgccucagcaucccaaagugcugggauuacaggcaug

SEQ ID NO: 94010 - RNA, 64 nt, Human
uacuuucucaaggggcuacacuccccaucaggcagcaucccaccagccugcaccacaggcuccc

SEQ ID NO: 94011 - RNA, 64 nt, Human
ccacguggugcuaugggagccggaugaggacagggcaucccagaucuggacuauccacgugcuu

SEQ ID NO: 94012 - RNA, 64 nt, Human
gaggacagucgggugaugguguauucugcccugcgcaucccacccgaggacugagggaaccuag

SEQ ID NO: 94013 - RNA, 64 nt, Human
ugcaauguugcuguucuggggacuggggagauuagcaucccauuugcccacacugugggaagac

SEQ ID NO: 94014 - RNA, 64 nt, Human
aaauagacuaaggaugccuuugcagaacaccaaagcaucccaaggaacugguagggaaguggcg

SEQ ID NO: 94015 - RNA, 64 nt, Human
aucccaguuuggcugguuaauuccauaaccccaggcaucccaucccuuggggugggggagaggg

SEQ ID NO: 94016 - RNA, 64 nt, Human
ucuggcuaccuccuugucccaccaccuccaggcugcaucccaccuucccucuuggcuacuguaa

SEQ ID NO: 94017 - RNA, 64 nt, Human
gcucaagcagcagagguaagaggaagaggcagcagcaucccaagaaggaaagagcuggagucag

SEQ ID NO: 94018 - RNA, 64 nt, Human
aauuccccuuaaaaggaaacagaucaacuacaccgcaucccaacaacccagguucuuuuccuuc

SEQ ID NO: 94019 - RNA, 64 nt, Human
cuguaaauuuuugucuccagaaaaacccucccaggcaucccauaccagcaccguuccucaucac

SEQ ID NO: 94020 - RNA, 64 nt, Human
gccuuaaucugggaggccuaucccccuaucccaggcaucccagacgaggacuggcugaggcuag

SEQ ID NO: 94021 - RNA, 64 nt, Human
uggcaccuugugagcccagcagagccaccacccagcaucccaggcugguggcaggagcuggggg

SEQ ID NO: 94022 - RNA, 64 nt, Human
ccuggaaagagaacucucccagggcccaucuccugcaucccaugaauacucuguacacauggug

SEQ ID NO: 94023 - RNA, 64 nt, Human
ggggagaugccuucucccccaccucccaggaccugcaucccagcucagaaggcugagaggguuu

SEQ ID NO: 94024 - RNA, 64 nt, Human
agaaacauuagucuuaggaauucuucaaaaaauggcaucccaaugaaaauaaauuugaugacua

SEQ ID NO: 94025 - RNA, 64 nt, Human
cagugugggguucugcugggaccuuggagagccugcaucccaggaugcuggguggcccugcagc

SEQ ID NO: 94026 - RNA, 64 nt, Human
caucuucauguaucacaauuuuuaaaguugaaaagcaucccaguuaaacuagaugugauaguua

SEQ ID NO: 94027 - RNA, 64 nt, Human
acaggacagguuucacauacaauugucccaguucgcaucccagcccuggggcacuuuucugcuu

SEQ ID NO: 94028 - RNA, 64 nt, Human
cugaaguugcaagacuuaaagaaauaauccaucugcaucccaaguccuauuuuauaaggauauu

SEQ ID NO: 94029 - RNA, 64 nt, Human
ccaugaagaggaagccucaagaucccuuggaauugcaucccaaggcaaagcuuuuggcucaccg

SEQ ID NO: 94030 - RNA, 64 nt, Human
gcugggggaaggagccugaagguugccccugguugcaucccagaagcaucugacugucaccacu

SEQ ID NO: 94031 - RNA, 64 nt, Human
cuauagauugacacccuccugccuguuuuucucugcaucccaaccuggccaaggccccuccugu

SEQ ID NO: 94032 - RNA, 64 nt, Human
gacgacagguccacccaagacugucaagggaugagcaucccaaaccugcuccacagagguagcu

SEQ ID NO: 94033 - RNA, 64 nt, Human
gauaggcuuuugucguaauaggcagagaugacuugcaucccagcuuuccaccaaccaaauucaa

SEQ ID NO: 94034 - RNA, 64 nt, Human
gcaugccagagccuggggcaucccagagcccagggcaucccaugggggugcugcagccaggagg

SEQ ID NO: 94035 - RNA, 64 nt, Human
cacgccugcccagccucgcaugccagagccuggggcaucccagagcccagggcaucccaugggg

SEQ ID NO: 94036 - RNA, 64 nt, Human
gaauuuuaugcucccgugguuggcuguuacaggagcaucccauuuugccaauuuuaaagacauu

SEQ ID NO: 94037 - RNA, 64 nt, Human
ucuuugccuaggauuauaauucuuugugcacaaugcaucccaucccaaagacaguccacagcag

SEQ ID NO: 94038 - RNA, 64 nt, Human
gaguagaccgccuggcucagcccacaggccugcagcaucccauagcaccccgcccuugccccau

SEQ ID NO: 94039 - RNA, 64 nt, Human
cgggcuggugaccuuuuuaauccaggccccaucagcaucccacgaucggccuugguaaccgccg

SEQ ID NO: 94040 - RNA, 64 nt, Human
ugugccuuagcggcaaugguuagagcuuuucagugcaucccaccucccugucgcccccaugcuc

SEQ ID NO: 94041 - RNA, 64 nt, Human
caccaucucaaagccaucccccuagccaucgugagcaucccagcggcaccgccauugucucaac

SEQ ID NO: 94042 - RNA, 64 nt, Human
aguuuggaauauuugcauuauacuuaccaguugggcaucccaaaucugaaaucugaaauguucc

SEQ ID NO: 94043 - RNA, 64 nt, Human
acacacaaccuccccuguuuucacauucaccauggcaucccagagcaaggacacaggagcccac

SEQ ID NO: 94044 - RNA, 64 nt, Human
uuauaucuguuaaaaguuguuuuaaaaagcuguggcaucccauuguucauauuugccaagucuu

SEQ ID NO: 94045 - RNA, 64 nt, Human
gcuacuccuuccuggaagccuuccuggauuucacgcaucccauccucuggccagaaauggccuc

SEQ ID NO: 94046 - RNA, 64 nt, Human
uucacaccauucauucuggucauuucccccaaaggcaucccagccugggggccaguggggaacu

SEQ ID NO: 94047 - RNA, 64 nt, Human
caccaucuuccgccaggugugccuggccucccgggcaucccaccaccggguaagaacuucaucc

SEQ ID NO: 94048 - RNA, 64 nt, Human
cagcccacagccaaugcuuauugaucuguucuaagcaucccagcugucuccucuuuucuauucc

SEQ ID NO: 94049 - RNA, 64 nt, Human
aaaccaaguguggucuuucagcuucaguguguuagcaucccagcaccugggaugggguuugugg

SEQ ID NO: 94050 - RNA, 64 nt, Human
uccaaauaggcaucaucaauaaaacaguuggcaugcaucccacugcugacuauaaugccucucc

SEQ ID NO: 94051 - RNA, 64 nt, Human
aagaacuguaaugcuguuuuggaaucaucccaaggcaucccaagacaccauaucuucccauuuc

SEQ ID NO: 94052 - RNA, 64 nt, Human
accgcucucaccuacacccugaggucuauucacugcaucccagugauacaaaguggaggccacu

SEQ ID NO: 94053 - RNA, 64 nt, Human
aagcaacaguugguuuucuuauccuuugauaaaagcaucccauaaaauauaaaguaguaaguua

SEQ ID NO: 94054 - RNA, 64 nt, Human
aagugauuugcauguauaauaucaggaaaauuaagcaucccaagugugacuggacaaagagagc

SEQ ID NO: 94055 - RNA, 64 nt, Human
guguaacugaaggcaugagacaucuguacaggaagcaucccagcgcccacaugggcaugagaca

SEQ ID NO: 94056 - RNA, 64 nt, Human
gaaccagcagaccuaccugcagugggaaccggcagcaucccagccaggguuugcuguuugcgug

SEQ ID NO: 94057 - RNA, 64 nt, Human
guuuguacaguauguuuuacauguauuuaaaguagcaucccaucccaacuuccuuuaauuauug

SEQ ID NO: 94058 - RNA, 64 nt, Human
ugagcauuuagaacgagccuggaagcacuacagagcaucccacaggaccacacgcaggccuccc

SEQ ID NO: 94059 - RNA, 64 nt, Human
aaccaccuuggaagacuagaggugauucugcccagcaucccauauugggccagccaugagccag

SEQ ID NO: 94060 - RNA, 64 nt, Human
ggucccuucacucugagagagaaaaucguggcgugcaucccaaacccuaggccacgccuguggg

SEQ ID NO: 94061 - RNA, 64 nt, Human
gucuuugcaaaccgagaagaguggcaugcuucuggcaucccaagucaggauuuuagcucagaug

SEQ ID NO: 94062 - RNA, 64 nt, Human
gaggcuuucagacuuaaacugagccaugcuaccagcaucccagggucuccagccuacagaugag

SEQ ID NO: 94063 - RNA, 64 nt, Human
caaacuccugaccucaggugaucugccugccuuggcaucccaaagugcugggauuacaagaaug

SEQ ID NO: 94064 - RNA, 64 nt, Human
caagucaccggagcuuucaaagaaggaauucuaggcaucccaggggaccacaccucccugaacc

SEQ ID NO: 94065 - RNA, 64 nt, Human
uuuuuaaccuuuuuguuuaacuucucucuucacugcaucccaauccaucuacaggcaugcacac

SEQ ID NO: 94066 - RNA, 64 nt, Human
aacacuguguccugggggggcugggaaguccccugcaucccaugguacccugguauugggacag

SEQ ID NO: 94067 - RNA, 64 nt, Human
uaugcguuuuacuccucagagaaugaaaaaaacugcaucccaucacccaaaguucugugcaaua

SEQ ID NO: 94068 - RNA, 64 nt, Human
uuucccaccuggggacucugcugucccugggcuugcaucccagggaucccagaguggccugccu

SEQ ID NO: 94069 - RNA, 64 nt, Human
uguuuccguaccacagcaggagcagggcccgcccgcaucccagcugugggccugccggucaggu

SEQ ID NO: 94070 - RNA, 64 nt, Human
ugagauaucccuaucuggucucacucaguccucugcaucccaacauucccaggacaugcaugau

SEQ ID NO: 94071 - RNA, 64 nt, Human
agcccauugcuuugccacccccucaugugccagggcaucccauuccaggcuuccugcaaggaaa

SEQ ID NO: 94072 - RNA, 64 nt, Human
gugccuacggguacuugcagcugugucccauguggcaucccagagcugcgcccugcuggucucu

SEQ ID NO: 94073 - RNA, 64 nt, Human
cuucuugguuccauuuccauccaugacagguacagcaucccaggagcccggccugaggggcugg

SEQ ID NO: 94074 - RNA, 64 nt, Human
agcaagaaaacaccugcugcugaugcaaugcaaugcaucccaaugguuguggggauugugggcu

SEQ ID NO: 94075 - RNA, 64 nt, Human
caaguuggcuucagcugaagagcuguuuugugaagcaucccaggcuugcccaggagagacauuu

SEQ ID NO: 94076 - RNA, 64 nt, Human
gggcuccucugugggugaggggcccucuggaauggcaucccaugagcuuguggccucuaucugc

SEQ ID NO: 94077 - RNA, 64 nt, Human
uggccaggucggcaucaauguaaggaccuucagagcaucccaggguuacagcaagagccacuga

SEQ ID NO: 94078 - RNA, 64 nt, Human
cuaggcuugaaucaugggcuccuuggcuuuccuagcaucccaaagcagucaacagugauuucuu

SEQ ID NO: 94079 - RNA, 64 nt, Human
augucuagccccucccauuuccaaccccucccuagcaucccaggugcccugacccaggacccaa

SEQ ID NO: 94080 - RNA, 64 nt, Human
agaaaagaauuccaauuaauuaaauaucacaauagcaucccagagagacaguaggaaauuucuc

SEQ ID NO: 94081 - RNA, 51 nt, Human
gucaugugcaggagcacugaggcaucccaggugugacacucuuccaccuag

SEQ ID NO: 94082 - RNA, 64 nt, Human
cacucuuucuccuugguggaaacucccaguucgugcaucccagccaccacccugagauuaugcg

SEQ ID NO: 94083 - RNA, 64 nt, Human
gccaauccuaaaaccuucuaaagacgauuuuugagcaucccacugggauuauuuaauuuuucuu

SEQ ID NO: 94084 - RNA, 64 nt, Human
uagagguaagaauaacaaguaacuauaaacgggugcaucccaccacucccuggaggcauuagac

SEQ ID NO: 94085 - RNA, 64 nt, Human
auuaaucacuuguuagagcaacaugacaugcccagcaucccacuucccgaaaaugucuacuccu

SEQ ID NO: 94086 - RNA, 64 nt, Human
cagccucugccccagcccacuggcaugccacccagcaucccaccugugccugucccuguuugca

SEQ ID NO: 94087 - RNA, 64 nt, Human
gaucccacccacccaccguagggugcacagcaaggcaucccagcuucuggcccgcuccucacug

SEQ ID NO: 94088 - RNA, 64 nt, Human
aguaacccuaaggaaguugcuaacuuaaaaaacugcaucccacguucuguuaauuuaguaaaua

SEQ ID NO: 94089 - RNA, 64 nt, Human
ucuuugcacuuccauccucucccacuuccaucuggcaucccacgcguuguccccugcacuucug

SEQ ID NO: 94090 - RNA, 64 nt, Human
agauguacugcaauggaacaaaacucaucuggcugcaucccagguguguagcaaaguccacaug

SEQ ID NO: 94091 - RNA, 64 nt, Human
guaaaagcuguugauuucgaguuguaagagcucagcaucccaggggcaucuucuugacuguggc

SEQ ID NO: 94092 - RNA, 64 nt, Human
ugaagacccaguggaucauguuggaaaugcaacugcaucccaggaacuugguuaugguugucuc

SEQ ID NO: 94093 - RNA, 64 nt, Human
acucagugucuaaggcacccugcuuccuuugcuugcaucccacagacuauuucccucauccuau

SEQ ID NO: 94094 - RNA, 64 nt, Human
accuagcaugcccuauuggcagugcucaggagcugcaucccacuuuucccugcucugaaucgaa

SEQ ID NO: 94095 - RNA, 64 nt, Human
acaccagcccccugcgcguguccacucugauccugcaucccacucccugggagccaauaaagug

SEQ ID NO: 94096 - RNA, 64 nt, Human
gcuagauucugcaggaaaccccagcagugugaacgcaucccaacauagguuaagagcaaguuga

SEQ ID NO: 94097 - RNA, 64 nt, Human
cagccuuugguaccuaauucucuaagcucaagaugcaucccauugccacuuuaccauucuauuu

SEQ ID NO: 94098 - RNA, 64 nt, Human
augggcugcacccggccguaggcuaguguaacucgcaucccauugcagugccguuucuugacug

SEQ ID NO: 94099 - RNA, 64 nt, Human
accccuggcuacccccacccuggcuaccccaacggcaucccaaggccaggugggcccucagcug

SEQ ID NO: 94100 - RNA, 64 nt, Human
uagcagacgaaccaguaaugggggcaaggcuggggcaucccagcccacacacccuggaugccca

SEQ ID NO: 94101 - RNA, 64 nt, Human
uucucuuuguccuuuuggaaaaaugacaagcauugcaucccagucuuguguuccgaagucaguc

SEQ ID NO: 94102 - RNA, 64 nt, Human
ucuuucuccuccacauacugcagccucccuccaugcaucccacauacaagcacucccccacucc

SEQ ID NO: 94103 - RNA, 64 nt, Human
uuuugcaauguuguuccauacuuggagucauuuugcaucccauagagguuaguccugcauagcc

SEQ ID NO: 94104 - RNA, 64 nt, Human
ggauggguaacuuuaaagacaaguuuuauaacuggcaucccaucugguuucagagucuuggggg

SEQ ID NO: 94105 - RNA, 64 nt, Human
ggguuauucucauuaugacaccuauugcaaauuagcaucccauggcaaauauauuuugaaaaaa

SEQ ID NO: 94106 - RNA, 64 nt, Human
cugccuccuggguucaagcgaaccuccugccucagcaucccaaguagcugggauuacaggcacc

SEQ ID NO: 94107 - RNA, 64 nt, Human
aagagguuucuguuuuucuguggcucuguccauggcaucccacuugcccacucuccuuccugga

SEQ ID NO: 94108 - RNA, 64 nt, Human
ggucaguaauuguugugagccccuuaggcuccuugcaucccaucccuaacccuugccugaccau

SEQ ID NO: 94109 - RNA, 64 nt, Human
cuccauggaaaucaaucugggggagaaggacacugcaucccagaucgaggccggucaguguggc

SEQ ID NO: 94110 - RNA, 64 nt, Human
ccuuuuguugcuaucggcagcugcuggcucaggggcaucccaccuccgggcucuggguuccucu

SEQ ID NO: 94111 - RNA, 64 nt, Human
uucugaaaaauggccaacaauuuuuuuagaaguagcaucccaagcagcgugccuaaacauuaca

SEQ ID NO: 94112 - RNA, 64 nt, Human
ugccucaucccugagccacacagggggcgugggagcaucccaguuaucccuggaaagcuagaag

SEQ ID NO: 94113 - RNA, 64 nt, Human
agcagcccuagcucggccacacuuggugcucccagcaucccagggagagacacagcccacugaa

SEQ ID NO: 94114 - RNA, 64 nt, Human
auauaaaaauaggcaaagccguuaguaucugcucgcaucccacuuuacaucagaguucagacuu

SEQ ID NO: 94115 - RNA, 64 nt, Human
uuuuaaaaagcagaggcccagucaaaugagcauugcaucccaugagggaagcacgacagggcug

SEQ ID NO: 94116 - RNA, 64 nt, Human
ucaagagcguguucugccagguccaugggggcuggcaucccagcuccaacucgaggagccucag

SEQ ID NO: 94117 - RNA, 64 nt, Human
agagaaaagcaggccuuugcagauaugauggaaugcaucccaccuugccaaagcacuuacacca

SEQ ID NO: 94118 - RNA, 64 nt, Human
ccccuaacuuucuugcuucaaaaauuaaaauccagcaucccaagaucauucuacaaguaauuuu

SEQ ID NO: 94119 - RNA, 64 nt, Human
accaguccuaguuuuagaccucaucuccaagauagcaucccaucucagaagauggguguuguuu

SEQ ID NO: 94120 - RNA, 64 nt, Human
aaauccgacacgacgagguccacaaacuguuucugcaucccagggcucugacgaaggcguuaag

SEQ ID NO: 94121 - RNA, 64 nt, Human
ccagaggagaagacaacccugacagcaucacgcugcaucccauugcuagcaggauuggcaacuc

SEQ ID NO: 94122 - RNA, 64 nt, Human
gacuggggcacauguggcuguugucauucuuucugcaucccacuguuccccuccaauuuauguu

SEQ ID NO: 94123 - RNA, 64 nt, Human
ggugcuuuguggccagcagcacagaaucaaacccgcaucccagcauugggccacccaucugagg

SEQ ID NO: 94124 - RNA, 64 nt, Human
gaguaccuccagucacacuccccgcgguucauacgcaucccaucucucccacuuccuccuaccu

SEQ ID NO: 94125 - RNA, 64 nt, Human
caacuugucccaaaucuagcuuugcccacgaauggcaucccaacagaguuaaagaaacugcuug

SEQ ID NO: 94126 - RNA, 64 nt, Human
ugggagggagauguggcuugaggucaagcgccaugcaucccaagccuuugaccuucccgcuaug

SEQ ID NO: 94127 - RNA, 64 nt, Human
uugaaacaaaauaguguaaucauuuuauuaaaaugcaucccacacugcaggacaaaugguccuu

SEQ ID NO: 94128 - RNA, 64 nt, Human
cuagaaacuuguuagaaaugcaaauucucaagccgcaucccagacuugcugaaucggaaucucu

SEQ ID NO: 94129 - RNA, 64 nt, Human
gcccaacuuccaaaggucaauaugucguccuuuggcaucccaacuaacaauaaagaauaggcua

SEQ ID NO: 94130 - RNA, 64 nt, Human
gcccaacuucuaaaggucaauauaucauccuuuggcaucccaacuaacaauaaagaguaggcua

SEQ ID NO: 94131 - RNA, 64 nt, Human
cuccucuuggcucucaaugcugaggcuugcagaggcaucccagcggcaccagccucccacugca

SEQ ID NO: 94132 - RNA, 64 nt, Human
cuuuuauccucuaaccaaaaaauuguuuaauuuugcaucccaaauguuuuuaaucuuuguauau

SEQ ID NO: 94133 - RNA, 64 nt, Human
ucacucuuccacagauauaaagaacaaacacuuagcaucccacacucaccccuucuaauccuga

SEQ ID NO: 94134 - RNA, 64 nt, Human
aguucagaucccuuuccagauugcaaccuggccugcaucccagcuccuuccugcucgugucuua

SEQ ID NO: 94135 - RNA, 64 nt, Human
agccaccgugcccggcccaggacuuuuaaaacaagcaucccaggggauuccggugccuaccaga

SEQ ID NO: 94136 - RNA, 64 nt, Human
uugcaaagucuuggggaacuccacguguuaguuggcaucccaguuucuuaaacaaauaguauca

SEQ ID NO: 94137 - RNA, 64 nt, Human
gagucuauuuuucuaaugaugcaguaauuaaauugcaucccaggagauuuauaaaguuuugaua

SEQ ID NO: 94138 - RNA, 64 nt, Human
aguuguuacaaaguuuaagcuuugaaccuaaccugcaucccauuuccagccucuuuucaagcug

SEQ ID NO: 94139 - RNA, 64 nt, Human
uuuugcaauuggugauauuaaguaggguaggagugcaucccauauaggccauuuuagaaggcca

SEQ ID NO: 94140 - RNA, 64 nt, Human
acugcacgcaccuggccuccauggacgagcaagggcaucccagaaacguguaaaugaccccgag

SEQ ID NO: 94141 - RNA, 64 nt, Human
auuagagauaugacugucaguugcagugaguucugcaucccaaguggagggaauuggguuugug

SEQ ID NO: 94142 - RNA, 64 nt, Human
cuacccucccaaggcaccaguacucuaccauggggcaucccaagugggguccucacccauccca

SEQ ID NO: 94143 - RNA, 64 nt, Human
aguuggaaagagauggaauguggcugggaacauugcaucccaaagagcuucucaguggaggagg

SEQ ID NO: 94144 - RNA, 64 nt, Human
cugagacaucccucaucuagucuugaccucuccagcaucccagccucagaagccuucuugcugc

SEQ ID NO: 94145 - RNA, 64 nt, Human
cuuagucacagagagaaauaagaggagguuguuugcaucccacaaggcaucguacuaguugggc

SEQ ID NO: 94146 - RNA, 64 nt, Human
cccauugauuacguccauccuagcaagcuaaauggcaucccagcugcuccuuucugugcaacca

SEQ ID NO: 94147 - RNA, 64 nt, Human
ccacuagaguuuugcccucagcuccucccugccagcaucccagucaccaccagguggcgcuucu

SEQ ID NO: 94148 - RNA, 64 nt, Human
uagcucacaggacuucccccaccccagaagauuagcaucccauacuagacucauacucaacuca

SEQ ID NO: 94149 - RNA, 64 nt, Human
uccucacaacauggugucuggauucccaggaugagcaucccaggaucgcaagagccauguagaa

SEQ ID NO: 94150 - RNA, 64 nt, Human
ggacgcugagcccaggagccugccaggcugacgugcaucccacccagacgguguccucuucuug

SEQ ID NO: 94151 - RNA, 64 nt, Human
auaggccugggaauuccgauccuagcugcagaucgcaucccacaaugcgagaaugauaaaauaa

SEQ ID NO: 94152 - RNA, 64 nt, Human
aacggaaugaccuuggcgcuggcuucaggaauaugcaucccacagccaguuuagagaaauacau

SEQ ID NO: 94153 - RNA, 64 nt, Human
aaaggaagaccucaagaaaaauucacaguugagugcaucccagcauucuguuccgggcaggcau

SEQ ID NO: 94154 - RNA, 64 nt, Human
ugcaguggcgccaucuaggcucacugcaaccuccgcaucccagauuccagcgauucuccugccu

SEQ ID NO: 94155 - RNA, 64 nt, Human
gucagacuuccugcucuaagggugucacugccuggcaucccaccacgcgaauccuagaggaagg

SEQ ID NO: 94156 - RNA, 64 nt, Human
caaaaaauuagccagguguagggguaggcaccuggcaucccagcuacuccaggggcugagguga

SEQ ID NO: 94157 - RNA, 64 nt, Human
ugaacccacaauccacaauccccaaacucagagugcaucccagaagaggccccaggcagagcuc

SEQ ID NO: 94158 - RNA, 64 nt, Human
accaccuugccggccacuccuccagcugccaggggcaucccacagacucugcagaggcucgggc

SEQ ID NO: 94159 - RNA, 64 nt, Human
caucuuucacuggggaagccaguuuccacaggcagcaucccaagguucaauaaggccuuauuua

SEQ ID NO: 94160 - RNA, 64 nt, Human
gcugaaaaggaugggcuagauugggcuucaggcugcaucccaggacuccaaacagggaucuguc

SEQ ID NO: 94161 - RNA, 64 nt, Human
auuucucugccaagcccauuuacccccaccucaugcaucccaaggcucuacugggucccuggac

SEQ ID NO: 94162 - RNA, 64 nt, Human
ggagcagcacaugcgcgugcuguggcaggaggacgcaucccaaucgggagggagagacagagac

SEQ ID NO: 94163 - RNA, 64 nt, Human
ugaggugacaucucauccccucacugaagcaacagcaucccaaggugcucagccggacucccug

SEQ ID NO: 94164 - RNA, 64 nt, Human
gguccaggacgaucccagugggcucgcuuccaaagcaucccacucaagggagacuugaaacuuc

SEQ ID NO: 94165 - RNA, 64 nt, Human
agaaagcagaagguucuagauccuggcacagacugcaucccauguucccaugcucuucuccguc

SEQ ID NO: 94166 - RNA, 64 nt, Human
accagaagccccccaccccagcuuuccugggucugcaucccagugggccucagacacugcccug

SEQ ID NO: 94167 - RNA, 64 nt, Human
cugggaugggaggggugggagcaugggaagggaggcaucccacccccaagaagaacugaauaaa

SEQ ID NO: 94168 - RNA, 64 nt, Human
ggcaccugcucccacagaagggggaacgcaagaggcaucccaagaccucaucugccugcagugu

SEQ ID NO: 94169 - RNA, 64 nt, Human
agugcugguuuguaaauggugaggggacuugggggcaucccagagugcucccuccaggccugcu

SEQ ID NO: 94170 - RNA, 64 nt, Human
ggccacuuagugggcaugguuacauugguuuauagcaucccaagaacuguagaucccuaggccc

SEQ ID NO: 94171 - RNA, 64 nt, Human
acacugcuguggacgggauagccagggcagaccugcaucccagagcaagccuagauccuugaaa

SEQ ID NO: 94172 - RNA, 64 nt, Human
ugcaauggugcaaucucagcucacugcaacuuccgcaucccagguucaagcgauucucccgccu

SEQ ID NO: 94173 - RNA, 64 nt, Human
cuagccccucuggauucccuuuugacucuuccgugcaucccagauaauggagaauguaucagcc

SEQ ID NO: 94174 - RNA, 64 nt, Human
gagacugggauucuggcuucucuuugaaccaccugcaucccagcccuucaggaagccugugaaa

SEQ ID NO: 94175 - RNA, 64 nt, Human
cgaaguccugucacugagcacagucaggggcugggcaucccagcuugcccccgcuuagccccgc

SEQ ID NO: 94176 - RNA, 64 nt, Human
cccacagagauaaggggccaggagggauugaaaggcaucccaguucuaaggcugcugcuaauua

SEQ ID NO: 94177 - RNA, 64 nt, Human
ggacucuacacugugaacuuggggaacaaggguggcaucccaguggccucaacccucccucagc

SEQ ID NO: 94178 - RNA, 64 nt, Human
gguagaugggaggacauuucuggucagggaacuggcaucccauucagcaucucaggacucacag

SEQ ID NO: 94179 - RNA, 64 nt, Human
gccccaacccccuugggguggggcagaaggugaagcaucccaacugacuagagacucaggcccu

SEQ ID NO: 94180 - RNA, 64 nt, Human
acuugguggcgggguggggugggggugggcagcagcaucccagccuugagaugcuucacuuucc

SEQ ID NO: 94181 - RNA, 64 nt, Human
guaguucugacgauacuuggagccugguccacgugcaucccaccuugggaagccucuccaaaga

SEQ ID NO: 94182 - RNA, 64 nt, Human
acaaagccggcugcccagccccagccucaccaccgcaucccaccuccugcccuccauaccucua

SEQ ID NO: 94183 - RNA, 64 nt, Human
uugcccugaauguacccugccucugcuuucuccugcaucccaugcuaagcagggucauggucug

SEQ ID NO: 94184 - RNA, 64 nt, Human
caucccuguagcccagcaacccugccccuccccagcaucccagcugggccagagagagccgagu

SEQ ID NO: 94185 - RNA, 64 nt, Human
uagagucucucugccucugaggagcaggcuacccgcaucccacucagccccucccuaccccuca

SEQ ID NO: 94186 - RNA, 64 nt, Human
ccaguaaccucgcagagagugacggugucuccuugcaucccagccucgucuaugcagcaagaga

SEQ ID NO: 94187 - RNA, 64 nt, Human
gacuucaaauugcaggaccaagcccuaaaggaaagcaucccauuugcaguaauuggcagcaaca

SEQ ID NO: 94188 - RNA, 64 nt, Human
gcagcacgugacacuggcaggaccuucaucuccagcaucccaccccugggugugggacuuuggg

SEQ ID NO: 94189 - RNA, 64 nt, Human
guuacaucuuccaaggaugucagauuagaaaauagcaucccaccucuggguaucugaguggcuc

SEQ ID NO: 94190 - RNA, 64 nt, Human
cuccuucccgugugagaagggccagaggguccaggcaucccaaguccagcgugaagggccacag

SEQ ID NO: 94191 - RNA, 64 nt, Human
uucagcugacggacccauggcagcugcucccagugcaucccaggccagcaggagcuuugugagc

SEQ ID NO: 94192 - RNA, 64 nt, Human
uagcuucuguugucauugaauacggccucccgcagcaucccacccccaaaccaccgacucucau

SEQ ID NO: 94193 - RNA, 64 nt, Human
cggcaccugcuacuuaccaacuggaaaauuuuaugcaucccaugaagcccagauacacaaaauu

SEQ ID NO: 94194 - RNA, 64 nt, Human
cugccuucugguuucaagcaacucuucugccucagcaucccaaguagcugggauaacaggugcc

SEQ ID NO: 94195 - RNA, 64 nt, Human
cuguuagacuuuagaagauugauacugaugcacugcaucccaaaccaucaagggccuuuucccc

SEQ ID NO: 94196 - RNA, 64 nt, Human
uaggaaugaugugaggugacgggcggggcggccugcaucccagggccccuccaaucccaccgga

SEQ ID NO: 94197 - RNA, 58 nt, Human
cuggaccugaggccuggugaccuugcaagcaucccauggggcgggggcgggaccaggg

SEQ ID NO: 94198 - RNA, 64 nt, Human
cucaaagacauaaaagaacauagcauucaacccagcaucccauuacuggguguauaccuaaagg

SEQ ID NO: 94199 - RNA, 64 nt, Human
aaucucauuucucccucauuaaaaucccucaguggcaucccaugguuuuuaaguuaaagcacac

SEQ ID NO: 94200 - RNA, 64 nt, Human
ccauacagccacuccuggccccaaacacugguuugcaucccagguuccucgcccaccuaccccc

SEQ ID NO: 94201 - RNA, 64 nt, Human
acaccacccaggaacacgcagacauaugcccauagcaucccacaggcccaggcaggagguccca

SEQ ID NO: 94202 - RNA, 64 nt, Human
aggacauuugcauguaaccuauccacauccuccugcaucccauaaaucaugccuagauuacuua

SEQ ID NO: 94203 - RNA, 64 nt, Human
uguccagguucccuccccgccacagugaaauaaagcaucccacccugcaguuuccacggacucc

SEQ ID NO: 94204 - RNA, 64 nt, Human
ugccgcuggucccccaccaggcuugggagcccuggcaucccaaaggggcaacgggaggaagggg

SEQ ID NO: 94205 - RNA, 64 nt, Human
cacauugauuugcuugacuauguugaaccauuuugcaucccagaaauaaguggcacuugcauau

SEQ ID NO: 94206 - RNA, 64 nt, Human
acagucccguggaaggagcagggguuggagaaaggcaucccaaagcuucgauggagagcaggga

SEQ ID NO: 94207 - RNA, 64 nt, Human
gcccuccaguccuuccuggagaugccuucagccagcaucccagacuccacaguuauuuaugaau

SEQ ID NO: 94208 - RNA, 64 nt, Human
cccaaaggcugcaccugccguguugucugggcuugcaucccagauguguuggaguaugcaugga

SEQ ID NO: 94209 - RNA, 64 nt, Human
aaucuauacuaaaaaaaauacaaaaauuagcugggcaucccagcuaugcagaagcugaagcaca

SEQ ID NO: 94210 - RNA, 64 nt, Human
gcccuguaaaguuauuuggugucauugaccaauugcaucccagcuaaaaagcaagaggcaucgu

SEQ ID NO: 94211 - RNA, 64 nt, Human
aggaaagcuggcagcaggcgccuccucccccaacgcaucccagccagugccauguccucugcag

SEQ ID NO: 94212 - RNA, 64 nt, Human
uaaccccaauuauccuucucucucuccugcccccgcaucccacucccagggugucacgagcccu

SEQ ID NO: 94213 - RNA, 64 nt, Human
aacucagaccccagcccucagcuggcugcccauagcaucccaugucccacgucccgugguucug

SEQ ID NO: 94214 - RNA, 64 nt, Human
uuggggcucgccccacccagggcucccuccuggagcaucccaggcgggcggcacgccaacagcc

SEQ ID NO: 94215 - RNA, 64 nt, Human
uucggucuaccacggagggcugugcuguuaggcugcaucccacucaaaauacaggaaaagcacg

SEQ ID NO: 94216 - RNA, 64 nt, Human
guaccagcauagacuguaugauuucugcuauuuugcaucccaauauaggaguagaauaauaucu

SEQ ID NO: 94217 - RNA, 64 nt, Human
uuaaucccucuuuguuccaagcagaagcauucuggcaucccagugaagagcucaggcccucagg

SEQ ID NO: 94218 - RNA, 64 nt, Human
aguucaugggguaguggccucucaaaggcugggcgcaucccaagacagccagcagguugucucu

SEQ ID NO: 94219 - RNA, 64 nt, Human
gagcuccuccagagcuuucuccgcccaccucacugcaucccaaguggagcuuuugguguccagu

SEQ ID NO: 94220 - RNA, 64 nt, Human
ucaagaauuugucagggagaauaauucugauagugcaucccauacugcaaaagaauuugugugu

SEQ ID NO: 94221 - RNA, 64 nt, Human
uccaggaaaguggccaagaagcaguggccuuauugcaucccaaaccacgccucuugaccaggcu

SEQ ID NO: 94222 - RNA, 64 nt, Human
ccugccuugauuucagccacaccccugcagcccugcaucccagcucuggggugugcagagguuu

SEQ ID NO: 94223 - RNA, 64 nt, Human
ggcacuggagagaugggcccaucauuaggggccagcaucccaggaacuggaccuuuccccagag

SEQ ID NO: 94224 - RNA, 64 nt, Human
ggggccuccauccgauggcaggugguggacaggcgcaucccacucuaugcgaaccacaagaccc

SEQ ID NO: 94225 - RNA, 64 nt, Human
ccugcgcagcuccuucccuaggcaccucugugcugcaucccaccagccugagcaagacgcccuc

SEQ ID NO: 94226 - RNA, 64 nt, Human
cuuucucccaagcugguggauaaugaaaaauaaagcaucccaucucucggcguuccagcauccu

SEQ ID NO: 94227 - RNA, 64 nt, Human
caagaccgcaggguagaaaucagccgggaugccugcaucccacccccggccccagggcccacca

SEQ ID NO: 94228 - RNA, 64 nt, Human
gagcugcaggaucccaggggaagggucucucucugcaucccaagccauccagcccuucucccug

SEQ ID NO: 94229 - RNA, 64 nt, Human
cccuuucccuuuucugaaagcuguuccuggccgggcaucccagggaagaaggaggggacugcgu

SEQ ID NO: 94230 - RNA, 64 nt, Human
ugcggaugcccaacuguuuuuaaggaagccagaagcaucccauggaccauggggugaguguccu

SEQ ID NO: 94231 - RNA, 64 nt, Human
ccugaggccaggaacgugcaaauuugcaggugcugcaucccaagccccucaugcuccugccuuc

SEQ ID NO: 94232 - RNA, 64 nt, Human
uccuccuccacuacaaccuccaugaccuugagacgcaucccaggaggugacgaggcaggggcuc

SEQ ID NO: 94233 - RNA, 64 nt, Human
ccuggugccaccacugcaacuuuuguauucacaggcaucccaucuccaucacagauaaaaucuu

SEQ ID NO: 94234 - RNA, 64 nt, Human
acucucguugccaccuugaccuuggcuggggcuugcaucccaaggcauccaucagagcagacgc

SEQ ID NO: 94235 - RNA, 64 nt, Human
agauuugcugguagaagucagucgguaugcucuggcaucccauuucuucuggggucuguggucc

SEQ ID NO: 94236 - RNA, 64 nt, Human
agccuguaccuuggaugagggguagccucccacugcaucccauccugaauauccuuugcaacuc

SEQ ID NO: 94237 - RNA, 64 nt, Human
guaguagaaucauccuucuuuuuugaaauuugaagcaucccaggcuuaaaaucuuguguuucag

SEQ ID NO: 94238 - RNA, 64 nt, Human
auaaauugauuauuugaaacuuuacaacacaauugcaucccaaauacaaauuguauugcuuauu

SEQ ID NO: 94239 - RNA, 64 nt, Human
aagccaacagucauguggcucgcagaugcauccugcaucccagucccccucccagcacccccag

SEQ ID NO: 94240 - RNA, 64 nt, Human
cccacauauugcacgugcagggagguaagugccugcaucccaaaucgguucuaggucaacuggc

SEQ ID NO: 94241 - RNA, 64 nt, Human
cucagcaccugaagugaccuggaaucagugaagccaaagggacuggcagucugcccugcaggga

SEQ ID NO: 94242 - RNA, 64 nt, Human
ucagugaagauguacgacuaccuguugggaaggacaaagggaugaggcuccagagagaguuggc

SEQ ID NO: 94243 - RNA, 64 nt, Human
gaugccuugccuuuucaggauuugagacuguucucaaagggauugggaacgaaggccccaucuc

SEQ ID NO: 94244 - RNA, 64 nt, Human
cucacagggagaugggauuccuuucuuguccaaacaaagggaguugcucuaaagcgagcaucag

SEQ ID NO: 94245 - RNA, 64 nt, Human
gaauucucagugccaacuguggcugguccucauucaaagggacggucaguuuggugucaacaug

SEQ ID NO: 94246 - RNA, 64 nt, Human
ugccaggugguuggguucugccuuuagccuggaccaaagggaagugaggcccaaggagcuuacc

SEQ ID NO: 94247 - RNA, 64 nt, Human
guggggcugaccaaugcaaacucaaauggugcuucaaagggagagacccacugacucuccuucc

SEQ ID NO: 94248 - RNA, 64 nt, Human
gagaaaacacagaccaaagagaaguaucuaagaccaaagggauguguuuuauuaaugucuagga

SEQ ID NO: 94249 - RNA, 64 nt, Human
uaaaaauuauucuuuaaaguaaugucuuuaaaggcaaagggaaggguaaagucggaccaguguc

SEQ ID NO: 94250 - RNA, 64 nt, Human
gccggguuuuauauuuuuauagacaaauaauaagcaaagggagcacuggguugacuuucaggua

SEQ ID NO: 94251 - RNA, 64 nt, Human
gugaucucagaacugugccaagcagacacugggacaaagggagaauaucuugcuccccuccuga

SEQ ID NO: 94252 - RNA, 64 nt, Human
agagugaucucaacuuuccaggaagaaaagagggcaaagggaacaaugugaaaagaagcagaaa

SEQ ID NO: 94253 - RNA, 64 nt, Human
aacauuuucuccagccggacauugaauguugcuacaaagggagccuugaagcuuuaacaugguu

SEQ ID NO: 94254 - RNA, 64 nt, Human
gggauguuugaaggcugaguuccaacagaauucacaaagggaauaaaacaggauugagauuuug

SEQ ID NO: 94255 - RNA, 64 nt, Human
gaaaaacaagccuccucguccuagucuuuucuagcaaagggauaaaacuuagauggcagcuugu

SEQ ID NO: 94256 - RNA, 64 nt, Human
uuaaauuuuagucucuggaacauccaaaaccaagcaaagggaugugacuauuuugaaugaauca

SEQ ID NO: 94257 - RNA, 64 nt, Human
gaaccccuucuuucauuccaacugccuccgaccccaaagggauucuuggcucucugguaaccau

SEQ ID NO: 94258 - RNA, 64 nt, Human
gagaaaaggagggaaguuugcuacaaaggggcugcaaagggaauaggcugauggagcuguucug

SEQ ID NO: 94259 - RNA, 64 nt, Human
aauuuaauguugucaucaucgucauguguuuccccaaagggaagccagucauugaccauuuaaa

SEQ ID NO: 94260 - RNA, 64 nt, Human
auacagugauuucauauuggaaucauuauuugugcaaagggacagacagaucacuuagauugcu

SEQ ID NO: 94261 - RNA, 64 nt, Human
cuauucggccuuauacaucuggucuuacaaagaccaaagggauccugcgcuugaucaacugaac

SEQ ID NO: 94262 - RNA, 63 nt, Human
gagagauggugcuggaguaaauaucauuagugccaaagggauucuucuccaaaacuuuagaug

SEQ ID NO: 94263 - RNA, 64 nt, Human
ccgaccccuuuccccaggcacagccccaggcuggcaaagggagggcccugggcugggugcaagg

SEQ ID NO: 94264 - RNA, 64 nt, Human
uacauugucccucaugucauuucaaacuguuuuccaaagggauuugagcauauacaacuacaaa

SEQ ID NO: 94265 - RNA, 64 nt, Human
cucagcacacaagugacccaggacauaugccugccaaagggauguguuagaaggcugccuucuc

SEQ ID NO: 94266 - RNA, 64 nt, Human
ccccaaagccugggccuuuguggcugccacugaccaaagggaccuugcucgugccgcuggcugc

SEQ ID NO: 94267 - RNA, 64 nt, Human
uaaaggucauacuugaaauccugccaauuuuccccaaagggaauauggaauuuuuuugacuuuc

SEQ ID NO: 94268 - RNA, 64 nt, Human
acccugcuguaaacuacugcaacccucacauccucaaagggacuuuuaugucaaacucuucugu

SEQ ID NO: 94269 - RNA, 64 nt, Human
gcuguuuggauguuuccacgggucucacuuauaccaaagggaaaacucuucauuaaaguccgua

SEQ ID NO: 94270 - RNA, 64 nt, Human
agcugcuuccuauacccagguauaacucaaaauccaaagggauagggccaggaucccuauuccu

SEQ ID NO: 94271 - RNA, 64 nt, Human
aucucugugucugagugugccugguguguguuuacaaagggagaguuggcugcuccagcuccac

SEQ ID NO: 94272 - RNA, 64 nt, Human
cagcuggaaaaggccuguggcccagaggcuucuccaaagggagggugacaugcuggcuuuugug

SEQ ID NO: 94273 - RNA, 64 nt, Human
aauggaggcuguaggaauauaaccucccacccugcaaagggaaucucuugccugcuccaucuca

SEQ ID NO: 94274 - RNA, 64 nt, Human
cucaucacacccccacagagggggucuuaccacacaaagggagagugggccuucaggagaugcc

SEQ ID NO: 94275 - RNA, 63 nt, Human
ugacacuuccagagagcugacaccagagaccaacaaagggacuuucugaaggaaaauggaaaa

SEQ ID NO: 94276 - RNA, 64 nt, Human
gggaaaaugcugggaccaaagauugggccggguucaaagggagcccagugguugcaaugaaaga

SEQ ID NO: 94277 - RNA, 64 nt, Human
ucuuuugguaauuucccugucuauaaagugagaccaaagggauaucuguucccuguuaccuuuu

SEQ ID NO: 94278 - RNA, 64 nt, Human
uucuguggggccauaaaccuauuuagucuggagccaaagggaugcccuaucugaaggaaagggg

SEQ ID NO: 94279 - RNA, 64 nt, Human
caaagugaaaacaggugagacaaugugcccaaaacaaagggaagaagagaaccuucugugacuc

SEQ ID NO: 94280 - RNA, 64 nt, Human
uugaaacgaaaacuguacuuuguacccucacauacaaagggaucaaauuugaccugguguuauu

SEQ ID NO: 94281 - RNA, 64 nt, Human
accagaauggucuuuaaugagcauggaaccugagcaaagggaauaggugggaugaauuuuuuuu

SEQ ID NO: 94282 - RNA, 64 nt, Human
cucaagacccuggagcuguacuuggccagggugucaaagggacaggccuccuuguugggagcac

SEQ ID NO: 94283 - RNA, 64 nt, Human
uauuuuacagagcuugaaaacucacuucaaugaacaaagggauucuccaggauuccaaaguuuu

SEQ ID NO: 94284 - RNA, 64 nt, Human
ucuuuugacguuggaagacacaugucuuaccccccaaagggagcccagcacugggagccuucuu

SEQ ID NO: 94285 - RNA, 64 nt, Human
uuuuucagaaauaauguuuuuuaaaagacaaaaacaaagggaagaauauuuaauuacugagcag

SEQ ID NO: 94286 - RNA, 64 nt, Human
agccaaagcuucagagauacaguccacagguggacaaagggauccccagccagagagagagaga

SEQ ID NO: 94287 - RNA, 64 nt, Human
agaaaaacuugaaaugcuacuuaacuuacuauuucaaagggaaguauauuucuuuuuaaagaau

SEQ ID NO: 94288 - RNA, 64 nt, Human
gugugcuuuucucagcuguuuucagcuuugggaccaaagggauuguugacguuuucccagcaau

SEQ ID NO: 94289 - RNA, 64 nt, Human
ccuauuauccaggggcucauccuaugcacccucccaaagggagcuauccccgccccacagagcu

SEQ ID NO: 94290 - RNA, 64 nt, Human
uagucauagcccuagaugacucucaacuacucuucaaagggaggcaucaggaauagaaugaaac

SEQ ID NO: 94291 - RNA, 64 nt, Human
uccugacugagucaccacaccccucuccccugaucaaagggaauauuaguuuuuaauuuggauc

SEQ ID NO: 94292 - RNA, 64 nt, Human
auagaggagcccucacggcugaucaauaauguugcaaagggagacuacagggaucucacgacga

SEQ ID NO: 94293 - RNA, 64 nt, Human
cugggaaaaugaaagaaaagagauaugaugccagcaaagggauggaaagucuagaggacaccuu

SEQ ID NO: 94294 - RNA, 64 nt, Human
aaagcaacuuacauacaagaacaauuaacuggagcaaagggagauauuucuuugugcagauucu

SEQ ID NO: 94295 - RNA, 64 nt, Human
ccauuugcagaccaggaaggaagagcaagcuguacaaagggaagcagagccuggggugggugug

SEQ ID NO: 94296 - RNA, 64 nt, Human
ugaguggagggguauauggaaacacggcuaugaccaaagggagaucccagccugggcaggcugc

SEQ ID NO: 94297 - RNA, 64 nt, Human
gaucuguaauaaaauaguauacuggacugugcaucaaagggauguaaaauuacaguauuccaaa

SEQ ID NO: 94298 - RNA, 64 nt, Human
ucucuuuucauucucugcccagguuuugggaucgcaaagggauuguucuuauaaaaguggcaua

SEQ ID NO: 94299 - RNA, 64 nt, Human
uuuguuuuguuuucguuuuucaucuuuugaagagcaaagggaaaucaagaggagacccccaggc

SEQ ID NO: 94300 - RNA, 64 nt, Human
uccucucaggacauuguguagccuaugguaaguacaaagggagaggaagacauuuugaauuuua

SEQ ID NO: 94301 - RNA, 64 nt, Human
gagaagccggagcagaaguccugguaguuacaagcaaagggagacaaggaaacgggcacagcga

SEQ ID NO: 94302 - RNA, 64 nt, Human
caguacaacaguuuuagauacucauuagugacuucaaagggaaaucaaggaaagaccaguuucc

SEQ ID NO: 94303 - RNA, 64 nt, Human
aacauuaauuugucuagcauuaucaucuuaaugacaaagggaauaaugaacuagaaaccagcaa

SEQ ID NO: 94304 - RNA, 64 nt, Human
aauuacuuaauagagaaauccuaacuauaucacacaaagggauacaacuauaaauguaauaaag

SEQ ID NO: 94305 - RNA, 64 nt, Human
ugccaacucggcugcaauuguggaccuucccuaccaaagggaguguugaaacucaagucccgcc

SEQ ID NO: 94306 - RNA, 64 nt, Human
agcuccugcugauguauuuuucuuuuugugaaggcaaagggacaauuaucacugcaugucaucu

SEQ ID NO: 94307 - RNA, 64 nt, Human
caccaagaggguguugugaugaggugccggugugcaaagggaacuuuaguuuuuccacugguuc

SEQ ID NO: 94308 - RNA, 64 nt, Human
gaauauaccccuuaguguuuggguauauucauuucaaagggagagagagagguuuuuuucuguu

SEQ ID NO: 94309 - RNA, 64 nt, Human
accugcuggacagccuccgccaagaucuacaggacaaagggagggagcaagcccuacucggaug

SEQ ID NO: 94310 - RNA, 64 nt, Human
guaugcggcugcagccgucucaccuguuuccccacaaagggaauuucucacucugguuggaagc

SEQ ID NO: 94311 - RNA, 64 nt, Human
aacuccaggaaacucauucugggccagcucuaugcaaagggaaaagcauguugcauucaccuag

SEQ ID NO: 94312 - RNA, 64 nt, Human
cuaugaaguguagcugaaaucugaagagucuugacaaagggauuuacacccuugacaaaaccaa

SEQ ID NO: 94313 - RNA, 64 nt, Human
cgccccguggccugcaggccugcaggggaggcagcaaagggaccuggcaguugcaacacaguaa

SEQ ID NO: 94314 - RNA, 64 nt, Human
uccaguguagggcuaucuuuuuaaaaaaugucaacaaagggaaaauaaacuaucagcuuggaug

SEQ ID NO: 94315 - RNA, 64 nt, Human
cuccucuggucccccgcgaaaagguaaauacacccaaagggagggaccuaguuaagucacuggc

SEQ ID NO: 94316 - RNA, 64 nt, Human
auaauggacagguguuccuugagugacagacuuacaaagggaguguuuaauugaaaucuagcau

SEQ ID NO: 94317 - RNA, 64 nt, Human
uaaugaucgaauacccacucugauguuuugccagcaaagggauaucuaauauuucagaagccuc

SEQ ID NO: 94318 - RNA, 64 nt, Human
auaaaaccaaaugcuugucugcuagcauacuuuucaaagggaauccacuguuuucucacuuucc

SEQ ID NO: 94319 - RNA, 64 nt, Human
auuuguccacccacccuccaauaagcuggagcgacaaagggacauuccaucccuguacccuuag

SEQ ID NO: 94320 - RNA, 64 nt, Human
guuauaaagaaagaagaucuuugucugggacccccaaagggauccuuucucuaaggucucugac

SEQ ID NO: 94321 - RNA, 64 nt, Human
uuccauuaaguagagacucagcuguugucacacccaaagggaugcucugccaaagguuuaaaca

SEQ ID NO: 94322 - RNA, 64 nt, Human
gaauugauuccgaaggguagggugggaaggugagcaaagggagcagaaacaagggaauucaaga

SEQ ID NO: 94323 - RNA, 64 nt, Human
auguuuuaugacugccugucuguuugaauacuggcaaagggauaaauaauaaauugacaucaaa

SEQ ID NO: 94324 - RNA, 64 nt, Human
agaagaagcggcaccugccaucuucugaaaacuccaaagggaaauuucaguagacauagugcac

SEQ ID NO: 94325 - RNA, 64 nt, Human
ugcugcaaaaccauagggaaaaaguucacugcuacaaagggaucccaacccacuggaggcuuug

SEQ ID NO: 94326 - RNA, 64 nt, Human
auaaguccuuuucucccugugccguuuucuugcucaaagggaacagugaauuagccagcuagaa

SEQ ID NO: 94327 - RNA, 64 nt, Human
auuuagcagucagauuagguaggugguuuuauuucaaagggaaacuuuaauccaaagaaagauu

SEQ ID NO: 94328 - RNA, 64 nt, Human
aacuguugaguugauuaagagacuuugcaaacgacaaagggaugaauuccuuacuuuaaucugu

SEQ ID NO: 94329 - RNA, 64 nt, Human
uuauguaugauauauauauauauacacacacacacaaagggauagagagauuaccucucuuaac

SEQ ID NO: 94330 - RNA, 64 nt, Human
cggagccccacccagaccugaaugcuucugagagcaaagggaaggacugacgagagauguauau

SEQ ID NO: 94331 - RNA, 64 nt, Human
ggcaaguuccuuacaaugugucacuugcaaauaacaaagggacuuugagggacauuucauuaaa

SEQ ID NO: 94332 - RNA, 64 nt, Human
uggagcauuuugcuucuggggugucuuccuuagccaaagggaacgugucauuugcucgacccug

SEQ ID NO: 94333 - RNA, 64 nt, Human
ccuugcgaccauguguagauugcguggaccccgacaaagggaaggcugcuguguagcucugucc

SEQ ID NO: 94334 - RNA, 64 nt, Human
caagguguauguguuuaagggggugugauggaugcaaagggaaugaggaauucagcacugcauu

SEQ ID NO: 94335 - RNA, 64 nt, Human
gccagcugcuggagauauguaaagaaaaaagcaccaaagggaaggcuuccuaucugugugguga

SEQ ID NO: 94336 - RNA, 64 nt, Human
aaugcaggaacucucuugguaguuuguaaauacacaaagggaugugucgagggaugggagcgau

SEQ ID NO: 94337 - RNA, 64 nt, Human
uccucuacaauuaacaaaacuuaucucugauauacaaagggauauaaauauauacacuuaaaua

SEQ ID NO: 94338 - RNA, 64 nt, Human
cugcaaagcuaugauauaaacugcucuugcaguccaaagggauaccugauuaaagaaguuucuu

SEQ ID NO: 94339 - RNA, 64 nt, Human
uuuuauaguaagcaaaaaaauccuggucuuuguccaaagggaguuauuaccccauacuugaaga

SEQ ID NO: 94340 - RNA, 64 nt, Human
uaucagauaguaauacacagugagcauuuuuaaacaaagggaaaccuauauuuauguaacugua

SEQ ID NO: 94341 - RNA, 61 nt, Human
uauucuuaacccuaagguaaaaaugcauuugcaaagggagaaaaugaaggccaaacagaag

SEQ ID NO: 94342 - RNA, 64 nt, Human
aaacagaggauacuacaggcugggaaagcugcagcaaagggagacuagagagagauuuguuaaa

SEQ ID NO: 94343 - RNA, 64 nt, Human
ucucuucauaccacguguuugaaguguuaaaauucaaagggaucauugaauaaaacggguguag

SEQ ID NO: 94344 - RNA, 64 nt, Human
aaccacugaaucaaagagagagcuccuuugauuucaaagggauguccucagugucugacaucuu

SEQ ID NO: 94345 - RNA, 64 nt, Human
cuauucaaaaucauauuccacagauguuccccuucaaagggaaaacauuugggguucuaaacag

SEQ ID NO: 94346 - RNA, 64 nt, Human
gauuucgguaacuaguuuaacuacagguaaccuucaaagggaccauuguacauuaugaacaaua

SEQ ID NO: 94347 - RNA, 64 nt, Human
acaauauguacuaccuuauacccuuccccaaaaacaaagggauuaaagaccuaaauaugaagac

SEQ ID NO: 94348 - RNA, 64 nt, Human
auauaaauuuuuaagagaaagaauuuaguauuaucaaagggauaaagaaaaaaauacuauuuaa

SEQ ID NO: 94349 - RNA, 64 nt, Human
uaaacauacaaauucugauauagagccucuguggcaaagggaauuucucaguuccugccccagc

SEQ ID NO: 94350 - RNA, 64 nt, Human
cagugauagagaauugcuguggagaguuauagagcaaagggauggguccuugaggccugccagu

SEQ ID NO: 94351 - RNA, 64 nt, Human
gcaaaauuaugcauaaauguaaaacaccccuaaacaaagggaacaaaugaauuuuugguuauau

SEQ ID NO: 94352 - RNA, 64 nt, Human
uguuugauaggcugaauguuuagaagaaacacuucaaagggauacaucauggccaggcauggug

SEQ ID NO: 94353 - RNA, 64 nt, Human
ucuuuuucccucuguaaagucauaauccuggcugcaaagggaggauuucugcgcggggugugag

SEQ ID NO: 94354 - RNA, 64 nt, Human
ggcuuucgggagugugaggcugcaucugcuggagcaaagggaaaccgugggcuuuuccggccag

SEQ ID NO: 94355 - RNA, 64 nt, Human
cugcucccugucuauguauuuggaaaccuuuucacaaagggaauugccuaacauguggacuuuu

SEQ ID NO: 94356 - RNA, 64 nt, Human
uugacuugaaacccccgaugacaaaagacucacgcaaagggacuguagucaacccacaggugcu

SEQ ID NO: 94357 - RNA, 64 nt, Human
gaaucuucugggacaggguuguaacucagccuuccaaagggaagagugcagggggacggggcca

SEQ ID NO: 94358 - RNA, 64 nt, Human
acacuuuaaucaugguuucaugagcauuaaaaagcaaagggaaaaaggauguguaaugguguac

SEQ ID NO: 94359 - RNA, 64 nt, Human
aauuguggauuaaugucaauguuaaucagccccucaaagggagagaaaagcuggaccuuuuccc

SEQ ID NO: 94360 - RNA, 64 nt, Human
ugcgaauccugacccaaggccuccugucucccuucaaagggagacccuuuugggggaugaguuu

SEQ ID NO: 94361 - RNA, 64 nt, Human
gccugugggcuuccccagguggccuggaggugggcaaagggaaguaacagacacacgauguugu

SEQ ID NO: 94362 - RNA, 64 nt, Human
aaaacaccaggccagaacuauagucauacucacacaaagggagaaauuuaaacucgaaccaagc

SEQ ID NO: 94363 - RNA, 64 nt, Human
gagguguuugcugcucugccacguagagagccagcaaagggaucaugaccaacucaacauucca

SEQ ID NO: 94364 - RNA, 64 nt, Human
ucacuuggggucaccacccuccccugucuucucucaaagggaagcuguuugugugucuggguug

SEQ ID NO: 94365 - RNA, 64 nt, Human
gacucaaaacaguuauuuuuuuacaauuaaucuacaaagggaauuaauauuguugacuuuuaaa

SEQ ID NO: 94366 - RNA, 64 nt, Human
aaccagguuauuucucccugcuuauggcuccccgcaaagggacuugcagcguguccugcaacuu

SEQ ID NO: 94367 - RNA, 64 nt, Human
aguggcacaucuucugucuucuguugggaacagccaaagggauuccaaggcuaaaucuuuguaa

SEQ ID NO: 94368 - RNA, 64 nt, Human
ugaaauacuuuaugcaaacaggcaaaauugguaccaaagggaaacauuaaccaugaggaagagc

SEQ ID NO: 94369 - RNA, 64 nt, Human
uuuuaagggaacaaucaucaauuaauuaacuuuccaaagggacugauaaaaaccaaaggaucug

SEQ ID NO: 94370 - RNA, 64 nt, Human
uuuacuacauagguuaauuuuuuaagggauguugcaaagggauuacuagagaaagacaaaaugu

SEQ ID NO: 94371 - RNA, 64 nt, Human
uuuggagacuucaaauaagauugaugcugaguuucaaagggagccaccaguaccaaacccaaua

SEQ ID NO: 94372 - RNA, 64 nt, Human
aacgauguuguguuccuucucucgaacaaaacagcaaagggaaugccagcuaacuucuuugauu

SEQ ID NO: 94373 - RNA, 64 nt, Human
cuaugugcuugucaaaauuauuucuggguugauucaaagggaggacuugcuggggaccagaauc

SEQ ID NO: 94374 - RNA, 64 nt, Human
aaccuccccaguuauguuuuuuuguuuucuaggacaaagggagucauuuugguugaacugggca

SEQ ID NO: 94375 - RNA, 64 nt, Human
ccaccccacuucuuuuagcaaggucugaaaguuucaaagggagaccuauagguuaauuguuuag

SEQ ID NO: 94376 - RNA, 64 nt, Human
cauaaaagaagaggcgaguagggcacaacaggcacaaagggagaccauaaggagacacagagga

SEQ ID NO: 94377 - RNA, 64 nt, Human
uuguacagacuuagcuucugaacucuaagaaugccaaagggaccgacgagacuccccaucacag

SEQ ID NO: 94378 - RNA, 64 nt, Human
aagagcaguuuuauguuuacagaaaaauuaggcacaaagggauucccauaucccuccucuucuu

SEQ ID NO: 94379 - RNA, 64 nt, Human
gcagcuggagcuuuguuggggagacuucuggacccaaagggagcuuucccaagaagccuuugau

SEQ ID NO: 94380 - RNA, 64 nt, Human
cgcgcucagacaugauaugcggcuaugccugccucaaagggacugccgccaugcggaacaccaa

SEQ ID NO: 94381 - RNA, 64 nt, Human
cugcuccgcuuuccucagaccccuuuuugccgugcaaagggaauucuugacauuaaauaaaagg

SEQ ID NO: 94382 - RNA, 64 nt, Human
agaggacgaagccaaggaaauuagggaggagagucaaagggaucaaggagaguuggggauuuga

SEQ ID NO: 94383 - RNA, 64 nt, Human
gcagccccagccgcagugucugaaggccaccucccaaagggagcacguugccuuuucaaacucc

SEQ ID NO: 94384 - RNA, 64 nt, Human
aggcacguggcuccagcaagagccccaggcaggacaaagggagcaggcagcagcugcagaaaca

SEQ ID NO: 94385 - RNA, 64 nt, Human
ggaaaagguuuucucaaaggcccaaggauucaagcaaagggaaguggaaucuuguggugaacag

SEQ ID NO: 94386 - RNA, 64 nt, Human
auccccuuaaagaaaaaauacaggcuuuagggaacaaagggacaagcagaacagguguggaaga

SEQ ID NO: 94387 - RNA, 64 nt, Human
cuauuuugauggcuguguguuuggccuucagagucaaagggagucugcauguaugggaacuguu

SEQ ID NO: 94388 - RNA, 64 nt, Human
uguccuuaaauaucaccuauacucugccacaucccaaagggaucucaagccuucagcucucccc

SEQ ID NO: 94389 - RNA, 64 nt, Human
aaauagcaaggaaauguacaauuuuaucuucuggcaaagggacaucauuccuguauuauagugu

SEQ ID NO: 94390 - RNA, 64 nt, Human
gcuccuggcacaaagcuaggaguaaaugugacuccaaagggaguucaguuaaucucugaaaugc

SEQ ID NO: 94391 - RNA, 64 nt, Human
cagccucaugccuggccccuugacacauccaaagcaaagggaguccugcccccuccccccacuu

SEQ ID NO: 94392 - RNA, 64 nt, Human
accuuaagaaauuuccuuccauagacagcugccucaaagggaaauccucuuuaaaccguaguug

SEQ ID NO: 94393 - RNA, 64 nt, Human
ggcauuuuaucucuggguuugagagcccuagagucaaagggaaagccucccagccuccagggcu

SEQ ID NO: 94394 - RNA, 64 nt, Human
ccguggucauuuuaauuacggggcagugucaccgcaaagggaggaaacucaaagccgaaagcaa

SEQ ID NO: 94395 - RNA, 64 nt, Human
ucccugcugcccggagcagguacauccaccagagcaaagggaaccacuuuuauuuugcaugagu

SEQ ID NO: 94396 - RNA, 64 nt, Human
gaacuaauacuacuguaccuguuauggaggacugcaaagggaagagaaaagcagaacacuguau

SEQ ID NO: 94397 - RNA, 64 nt, Human
gcacauccacuugguuggggacccagauggaacacaaagggagaagacaagcaaauucucuuuu

SEQ ID NO: 94398 - RNA, 64 nt, Human
uucugcacccccuuccaaagugaccacaaaauuucaaagggacucauacaauuugagaaaaaac

SEQ ID NO: 94399 - RNA, 64 nt, Human
aaaccagagcuucccucauuuaccuuuucuccuacaaagggaagcagccuggaagaaacagucc

SEQ ID NO: 94400 - RNA, 64 nt, Human
caaccagcuuuacuaaagggggaggaagggagggcaaagggaugagaagacaaguuucccagaa

SEQ ID NO: 94401 - RNA, 64 nt, Human
cucuacaggggacaggagaccauggauuggaccccaaagggauugaacugcaucugcaugucug

SEQ ID NO: 94402 - RNA, 64 nt, Human
ggaaaagugcaaguccauuauguaauagugacagcaaagggaccaggggagaggcauugccuuc

SEQ ID NO: 94403 - RNA, 64 nt, Human
ugaggcgaggacccccaggcuuaccuguaggacucaaagggagccaggaccccaucugaaaggg

SEQ ID NO: 94404 - RNA, 64 nt, Human
ucuuuuuuucuuuuuuucuuuuuuugcuuuaaaacaaagggaaaaaagaguuuaaacaaaaaac

SEQ ID NO: 94405 - RNA, 64 nt, Human
guuacaggcgagucauacucuugcaaguaguuagcaaagggaggcccaaauucucaagguuguu

SEQ ID NO: 94406 - RNA, 64 nt, Human
ugcagaugaaucugugacucauguuucccuguuucaaagggauccuggggaaggaggggaacau

SEQ ID NO: 94407 - RNA, 64 nt, Human
cuuguaggaguacgaaacauuuucaauaaaucuacaaagggaagccuuacuacaauuccaaaaa

SEQ ID NO: 94408 - RNA, 64 nt, Human
uucagugccccuguacugcccugccaucucaggccaaagggaggggagcaaguggggaccuggc

SEQ ID NO: 94409 - RNA, 64 nt, Human
cugccuccucuccuagcaccugcuugcuacgcagcaaagggauagguuuggaaaccuaucauuu

SEQ ID NO: 94410 - RNA, 64 nt, Human
guuucaacaagucaggagauucacagcaacugaucaaagggaguccagucaacgugagcaagcg

SEQ ID NO: 94411 - RNA, 64 nt, Human
gcauggucuugugucuuaagacagcugcugugaccaaagggagaauggagauaacagggguggc

SEQ ID NO: 94412 - RNA, 64 nt, Human
ugcuuaguauugacaacugcacaugaaaguuuugcaaagggaaacaggcuaaaugcaccaagaa

SEQ ID NO: 94413 - RNA, 64 nt, Human
gacaguagcauuagaauuguggaaaaggaacacgcaaagggagaagugugagaggagaaacaaa

SEQ ID NO: 94414 - RNA, 64 nt, Human
uccuccuggaagccaagggcccacguccucaccacaaagggacuccugugaaacugcugccaaa

SEQ ID NO: 94415 - RNA, 64 nt, Human
uuccuggacuaugugaccaggaggacugucuuuucaaagggaauuuagagccucacucuccugg

SEQ ID NO: 94416 - RNA, 64 nt, Human
uuuggcuguuuauuuuugucauuuuccauuauuucaaagggaauuuggaacauguugaauuuua

SEQ ID NO: 94417 - RNA, 64 nt, Human
agggacccaaguuagaugaugagaaaaugccaaacaaagggaggcaaggacagagaagguaccu

SEQ ID NO: 94418 - RNA, 64 nt, Human
aucucccauggacugauucccaggaagaaaagcccaaagggaaacccacgauuccuuucgagua

SEQ ID NO: 94419 - RNA, 64 nt, Human
caugguguagaacuuucuccaauagucacauuggcaaagggagaacuggggugggcggggggug

SEQ ID NO: 94420 - RNA, 64 nt, Human
accaaauuuaauuuaaaggaccacauuaauuuuucaaagggaaagagacaauuaauuguacaua

SEQ ID NO: 94421 - RNA, 64 nt, Human
aaauuuuuaaagagccugcaucauuugguucccucaaagggaagcccuugccaguggggguuug

SEQ ID NO: 94422 - RNA, 64 nt, Human
uuaugaaucuaagacaaggaaguccuauagaagccaaagggacagggacggaaaggacaggucc

SEQ ID NO: 94423 - RNA, 64 nt, Human
aaauaagugcaauuucuacacccccgaaacaauucaaagggaagcagcauuucuuguuaacuag

SEQ ID NO: 94424 - RNA, 64 nt, Human
agauuauaaugcuuuuggcuuaggugcaggguugcaaagggaucagaaaaaaaaaaucauaaua

SEQ ID NO: 94425 - RNA, 64 nt, Human
ugacaacauuggugccaggggagaugguguuuuucaaagggaccuacuguagccacuuuaauuu

SEQ ID NO: 94426 - RNA, 64 nt, Human
gcuggcauuugcacauccacaacguguugauuaacaaagggauugguggagauaaacagaugcc

SEQ ID NO: 94427 - RNA, 50 nt, Human
ugcauuccaccggaucauaacaaagggaagcauucugugcguggguuugg

SEQ ID NO: 94428 - RNA, 64 nt, Human
gagaaaagggcauucuuagcugauugaaaugagacaaagggaauaaauggcuguauuugugcua

SEQ ID NO: 94429 - RNA, 64 nt, Human
ccuuaauacuauuaguaaccacaaguucaagggucaaagggacccucugugccuucuucuuugu

SEQ ID NO: 94430 - RNA, 64 nt, Human
uccaguucuuuaaaaacguuuaugauauuaagaucaaagggaggaagggaagacagcaguauua

SEQ ID NO: 94431 - RNA, 64 nt, Human
ucugagggaggggauuuuacagccgagggaccuccaaagggaacguccauuugcaugugugccc

SEQ ID NO: 94432 - RNA, 64 nt, Human
uucccaagaaaaaaaaauuguucaacaauaagggcaaagggagagaaucauaacaucugauuaa

SEQ ID NO: 94433 - RNA, 64 nt, Human
cuuuacacaauuggagcucauguacuagagaauucaaagggauaacugcaaagacacugguaga

SEQ ID NO: 94434 - RNA, 64 nt, Human
accuaauucccccagauuaguauacucgagaauucaaagggacauuuaaggugggguaugcccu

SEQ ID NO: 94435 - RNA, 64 nt, Human
acuucaggcaagaagcucaccaccaggcacacagcaaagggacugaacugaccccuguuugcac

SEQ ID NO: 94436 - RNA, 64 nt, Human
augauuuaaagaaccucaauacuacugcaguuaccaaagggauuguuucucugccacccucaua

SEQ ID NO: 94437 - RNA, 52 nt, Human
acuuuacucuggaugacuaaaacaaagggaagaacuuuuuaugaacuccaca

SEQ ID NO: 94438 - RNA, 64 nt, Human
uguggccugguuuugcuuugaaaccaagaaagagcaaagggaacccagcaguucugagugaguu

SEQ ID NO: 94439 - RNA, 64 nt, Human
uguaccaaccgcccagccacgcuccaucgccgcccaaagggaggugccaaggccaggaacccaa

SEQ ID NO: 94440 - RNA, 64 nt, Human
acuugggggaggaaagaaacuccugaucauuggccaaagggacuuaccccuggagaggccaagu

SEQ ID NO: 94441 - RNA, 64 nt, Human
ccuuaggcccguggaccacagucuuggcugagaucaaagggaugagcaacagggacuucugcca

SEQ ID NO: 94442 - RNA, 64 nt, Human
aucagcaaguuaaaaaaaguacuuuaaaauaaagcaaagggagacuguugcucaaccaucagga

SEQ ID NO: 94443 - RNA, 64 nt, Human
uuaagcucauuuuuaggcuuugauuuuggggagacaaagggaaaugcagccauagagggccuga

SEQ ID NO: 94444 - RNA, 64 nt, Human
guucuggguguaaagaggugugcgucuugugggccaaagggaaaaacaggcaggggucagagcc

SEQ ID NO: 94445 - RNA, 64 nt, Human
aaauaaaaaccuggggaacuuuagguuauuuauacaaagggaauaaauaggcugauuuuaauuu

SEQ ID NO: 94446 - RNA, 64 nt, Human
aaaugguacaaagucaugaugauucccugaguaacaaagggaaaugaaaacuguuugugaucuu

SEQ ID NO: 94447 - RNA, 64 nt, Human
aucaaacuuccauauuugccuugggaauaauggacaaagggaaauacucuuaauucaugaauaa

SEQ ID NO: 94448 - RNA, 64 nt, Human
ucaaacacaucauaauggauucacugaggggagacaaagggagccgagacccuggauggggcuu

SEQ ID NO: 94449 - RNA, 64 nt, Human
ucugcuucucacucuuguauuaagaaggauuccacaaagggagaguggcaucccugcugcugcu

SEQ ID NO: 94450 - RNA, 64 nt, Human
caggugugcugcgcgggaagccccaugcuccaaucaaagggauuuuuaguagugccucuaagca

SEQ ID NO: 94451 - RNA, 64 nt, Human
gaaagacucacccugcagcucugaccuuuuuucccaaagggacuuaagcgauugugcaggagua

SEQ ID NO: 94452 - RNA, 64 nt, Human
cucccugcaaccagccugaguucagccccacggacaaagggacacacagcccccaauggagacc

SEQ ID NO: 94453 - RNA, 64 nt, Human
uucacuuuugugaaauguaauuuuucuguuuuugcaaagggaugaggugauuggaauugcuuug

SEQ ID NO: 94454 - RNA, 64 nt, Human
gucacugaaggccuggcccacagcaggugcugagcaaagggaacagugaggugcccagcuagcu

SEQ ID NO: 94455 - RNA, 64 nt, Human
ucagccuacagcaguguggucucuuacauggccacaaagggacacacagugacaaaaggcucgg

SEQ ID NO: 94456 - RNA, 64 nt, Human
aucagccuugggugguguguuccuauauaaacuccaaagggaaacacaccgacugccucagcaa

SEQ ID NO: 94457 - RNA, 64 nt, Human
ccucuccagccucucccaaaggaagcguuggcagcaaagggagaugaugcccuuacccaccuuc

SEQ ID NO: 94458 - RNA, 64 nt, Human
aucaugcuucuuuccaacacguguucacaaucuccaaagggacuguauuucuucucugugcuua

SEQ ID NO: 94459 - RNA, 64 nt, Human
cagauaagaaaggaccaacuuggguuccuuaaaacaaagggaaauuauuauugccacuuagaaa

SEQ ID NO: 94460 - RNA, 64 nt, Human
aaaggaugccauccucuggaauccuaauggcaggcaaagggagagaggaagggugacggcuucu

SEQ ID NO: 94461 - RNA, 64 nt, Human
uggagggccuggucuugcacuggcagcuguaauacaaagggaacucgccccacuucucccagcc

SEQ ID NO: 94462 - RNA, 64 nt, Human
gcucccugcucacucuucucucagccaaagccuccaaagggacuagagagaagccuccugcucc

SEQ ID NO: 94463 - RNA, 64 nt, Human
cugcuuuaucuuguuuuaguuuucaguaauuuaacaaagggagccugcugaauaacaaaauuaa

SEQ ID NO: 94464 - RNA, 64 nt, Human
uuucauguuggaaucuaagaugugucccuucucccaaagggauuuuaaucauucuuggccucuc

SEQ ID NO: 94465 - RNA, 64 nt, Human
caaaugcagccgggcggcagaucuagcgggagcucaaagggaugugggcgaaaucuugagucuu

SEQ ID NO: 94466 - RNA, 64 nt, Human
agugcaaaaaacauacuuacauuucagacauauccaaagggaauacucacauuuuguuaagaag

SEQ ID NO: 94467 - RNA, 64 nt, Human
acacaccauugagaugggcaaaauucuuucucuacaaagggaguaaucaaguaaauaccuguuc

SEQ ID NO: 94468 - RNA, 64 nt, Human
caauucugugacauacauauuaucucauuuuacacaaagggaagucgggcaugguggcucaugc

SEQ ID NO: 94469 - RNA, 64 nt, Human
agugcuugacaaaguagugucacucuuaagaugucaaagggaauuagccauuuuuuuuauugua

SEQ ID NO: 94470 - RNA, 64 nt, Human
uacaucucugaacguuccagaagucuuaagguuccaaagggauuuagcagugaggcagcaaugc

SEQ ID NO: 94471 - RNA, 64 nt, Human
uucaccugcaaagcucuguggccacauuuucagccaaagggaaauaugcuuucaucuucuguug

SEQ ID NO: 94472 - RNA, 64 nt, Human
guauuuaauggccugaacugagaguugauauggccaaagggagagaggccuuuuaaaauauaua

SEQ ID NO: 94473 - RNA, 64 nt, Human
cccacuuucccuucuucaaaggacaaagugcccucaaagggaauugaauuuuuuuuuuacacac

SEQ ID NO: 94474 - RNA, 64 nt, Human
acuucauggaugaggaaccuggagaccaaagagacaaagggacuuuuucaaguucacaugggga

SEQ ID NO: 94475 - RNA, 64 nt, Human
acugaggcucaggccacauaauuggacucugucacaaagggacuuuggaaaacuacuuuuuggu

SEQ ID NO: 94476 - RNA, 64 nt, Human
cucaaaaggagaagaaagcugcucgugcucguuccaaagggaaaaacucggaugaagaagcccc

SEQ ID NO: 94477 - RNA, 64 nt, Human
gucaaggucuggcgucccaaaugaaagaagcaggcaaagggaaggagccccugagaacaaccaa

SEQ ID NO: 94478 - RNA, 64 nt, Human
cucuaagaacagagaauggucuuucccagggacacaaagggagaaaugggacauggauucuuga

SEQ ID NO: 94479 - RNA, 64 nt, Human
auaaugcucauagaaucuucuagaagaagagaaacaaagggauugauaaaaugcugagaacuag

SEQ ID NO: 94480 - RNA, 64 nt, Human
uuauuccauuauaucuugucuagauauuuuaauucaaagggauacuggcucucuugaucggaau

SEQ ID NO: 94481 - RNA, 64 nt, Human
aaucuuagucccaugaucuguccccaaaggggaacaaagggaccucugacagcuuagauuuagc

SEQ ID NO: 94482 - RNA, 64 nt, Human
gaaaggagaaccggcuaggugggcucuagccacacaaagggaagcaggccugccaugagacacu

SEQ ID NO: 94483 - RNA, 64 nt, Human
caggugaugucaggccaaugccuagaacaaagggcaaagggauauggaauguuuacuggacagu

SEQ ID NO: 94484 - RNA, 64 nt, Human
cgggggccugcccugcucccaccaggagagagggcaaagggaugagccuggguuuggacucuaa

SEQ ID NO: 94485 - RNA, 64 nt, Human
uuucagcuuggauagugaggguaacaauuuuucucaaagggaucuggaaaaaauguuuaaaacu

SEQ ID NO: 94486 - RNA, 64 nt, Human
guuuuuuccuuugaugggcuuaaaagaaauuauccaaagggagaaagagcaguaugccacuucu

SEQ ID NO: 94487 - RNA, 64 nt, Human
accauuuccuccucauaugcaggaggaacaacaucaaagggaacucucucuacuucgcaaaaga

SEQ ID NO: 94488 - RNA, 64 nt, Human
cacugugaacauuuuuuauuugagaauuuuguuucaaagggauugcuuuuuccucucauugucu

SEQ ID NO: 94489 - RNA, 64 nt, Human
uugugcuucuuuguagcaggguaaaucguccugucaaagggaguugcuggaauaaugggccaaa

SEQ ID NO: 94490 - RNA, 64 nt, Human
uccacugaaggucuucacgggccuccagguggaccaaagggaugcacaggcggcucgcaugccc

SEQ ID NO: 94491 - RNA, 64 nt, Human
cuuacaagauguaccagacgguuuccaguacuaacaaagggaauaaaaauaccucacgccacaa

SEQ ID NO: 94492 - RNA, 64 nt, Human
cuucauucuuuacugcacucagauuuaagccuuacaaagggaaagccucuggccgucacacgua

SEQ ID NO: 94493 - RNA, 64 nt, Human
caaaaacauuauuugugcccucuuuuauauaugucaaagggacacugucaaguauuucauuuuu

SEQ ID NO: 94494 - RNA, 64 nt, Human
agcacugggaauggaaacuuaaucucugugacuacaaagggaaguuuuugugccuugguguucc

SEQ ID NO: 94495 - RNA, 64 nt, Human
uucucuagaagcugucugcguuuacucuuguuuucaaagggacuuuuguaaaaucaaaucaucc

SEQ ID NO: 94496 - RNA, 64 nt, Human
ucuuauugcacugaauucaacuccagacaccauacaaagggagaugauggccauuccguucaaa

SEQ ID NO: 94497 - RNA, 64 nt, Human
aagaugaauaucauagccuuuacuucuucacagccaaagggagccccuguguugucucaaguuu

SEQ ID NO: 94498 - RNA, 64 nt, Human
aggcccaggaggggcgcuauucaaagcugcacugcaaagggaguaacggacucugcuucucugc

SEQ ID NO: 94499 - RNA, 64 nt, Human
gguuauauguacaguuccuauuuuagcuugcuuacaaagggagcauuauuuuuauuuaaaguau

SEQ ID NO: 94500 - RNA, 64 nt, Human
uuuucacagauggauuaucugggguaauuuucuucaaagggaguuuguuauacacagugaaaau

SEQ ID NO: 94501 - RNA, 64 nt, Human
guaggaggagagggguuucuugcucuccagagcccaaagggacaaauagggacuuuguuuaggc

SEQ ID NO: 94502 - RNA, 64 nt, Human
aacuucgagaagcucaagaagcccaggggagaaacaaagggaaugaucuauugagagcccucuc

SEQ ID NO: 94503 - RNA, 64 nt, Human
uguuuguuaaaguugcauuuauugcagcaaguuacaaagggaaaguguugaagcuuuucauauu

SEQ ID NO: 94504 - RNA, 64 nt, Human
guauaaauuugucuaaaauuuuauaacuguugaacaaagggaagauuugaacaguguaaauucc

SEQ ID NO: 94505 - RNA, 64 nt, Human
ccuuauggggagugagagagagggcacgagaacccaaagggaauagagauucuccaggaauuuc

SEQ ID NO: 94506 - RNA, 64 nt, Human
agcuugccugccuugaagaaaagaagaccagggccaaagggaaaucagucaagggagccuguuu

SEQ ID NO: 94507 - RNA, 64 nt, Human
gaagauggacucuuggcuuccucucucuggcuggcaaagggaguuaucuucuggaauacauuag

SEQ ID NO: 94508 - RNA, 64 nt, Human
uauuauaccugacacacucaucguaugggcucugcaaagggauauuccccaaccuguccuuccu

SEQ ID NO: 94509 - RNA, 64 nt, Human
cuuguagccaaaaagaaaccucucuuaguagaaacaaagggagaguuagguuauucaaaaauua

SEQ ID NO: 94510 - RNA, 64 nt, Human
aaaaggccccugcaaagaagggagagaagguacccaaagggaaaaagagaaaagcugaugcugg

SEQ ID NO: 94511 - RNA, 64 nt, Human
agugccauccagucuuuaugcaaaugaaaugcugcaaagggaagcagauucuguauauguuggu

SEQ ID NO: 94512 - RNA, 56 nt, Human
agaagaaauuaaaaacaugauaaauacaaagggaaaacaaaaagcuacaaaaguag

SEQ ID NO: 94513 - RNA, 64 nt, Human
caccaugagaacagaaucacuggucuaaaaggaacaaagggauguucacuguaugccucugagc

SEQ ID NO: 94514 - RNA, 64 nt, Human
ccuaaaaauacaucucagacggcagcuauuacuacaaagggaggccucgugggucugguagauu

SEQ ID NO: 94515 - RNA, 64 nt, Human
aauuauaaggcauucauauuuuuaggacugaauucaaagggaaaugcuucuuugacuuuuuuuc

SEQ ID NO: 94516 - RNA, 64 nt, Human
auuaaugguaaaauaaaaugccucagcuauguagcaaagggaaugggucugcacagauucuuuu

SEQ ID NO: 94517 - RNA, 64 nt, Human
aaggaagaagaagucuaaaagaaaacaucauuugcaaagggagagaggggcaagcaugauaugu

SEQ ID NO: 94518 - RNA, 64 nt, Human
gccaagccugcugaguauugcagcugcauuugcccaaagggaauccagaacaagucccucccug

SEQ ID NO: 94519 - RNA, 64 nt, Human
gcacaacauuacagggaaugccugagugccuggccaaagggauauuugguuuggccaucucugg

SEQ ID NO: 94520 - RNA, 64 nt, Human
ccugacuucugcaaaccuacccugucaaggagaucaaagggacgcagguuucuguuuauucuga

SEQ ID NO: 94521 - RNA, 64 nt, Human
aacagauguacaagacauuuauuacacuuuuuaccaaagggaguuaccauuguaguacuuuugu

SEQ ID NO: 94522 - RNA, 64 nt, Human
ggcuggggcacaagagcaccagggggguagggcccaaagggaucaggggaagccucuggccugg

SEQ ID NO: 94523 - RNA, 64 nt, Human
cugcagccuacgacccucagcagaucuucaagugcaaagggaccuuugugggccaccagggccc

SEQ ID NO: 94524 - RNA, 64 nt, Human
ugcccugcuuggcucugaggaccugcccagcgcucaaagggaacggaagccuuccccucccgcc

SEQ ID NO: 94525 - RNA, 64 nt, Human
uuuuuuaaagguaaaccuccugggccgcagauggcaaagggagugccugggccuggugacccag

SEQ ID NO: 94526 - RNA, 64 nt, Human
caaggcuaaaagugaccuuaacuguauuuauucucaaagggaaaggaaauaucagauguuuauu

SEQ ID NO: 94527 - RNA, 64 nt, Human
auucaucucugcauagugauuuuugaauuugauucaaagggaaauuauugcagaagaaugccuu

SEQ ID NO: 94528 - RNA, 64 nt, Human
gacgcgguccagggagggcggaggcccaggagaccaaagggaggggcucugccgcuuagcagag

SEQ ID NO: 94529 - RNA, 64 nt, Human
ugggcugagccaagugugcccacggcugcaucugcaaagggacgucggagaagugcagcugcug

SEQ ID NO: 94530 - RNA, 64 nt, Human
ggagaaagggcccugggccugccucaccacggaccaaagggagucugccagggccccucucccc

SEQ ID NO: 94531 - RNA, 64 nt, Human
cacugucucccuugcccuuugacuuuuccccaaucaaagggaacugcagugcuggguggagugu

SEQ ID NO: 94532 - RNA, 64 nt, Human
ggacugaccugcgggcuugcuugcugacuccucucaaagggacagagcgccccugcuccaggga

SEQ ID NO: 94533 - RNA, 64 nt, Human
ucuuccccacaacagaagagaccagcgacucccgcaaagggacaagguuccucccucuccugca

SEQ ID NO: 94534 - RNA, 64 nt, Human
ccgcacgcagccacuucggcuaccuucuacuggccaaagggagucccagggcucacccagauuc

SEQ ID NO: 94535 - RNA, 64 nt, Human
aaucagggcuucuaccacugcugaugcaaaaccacaaagggaccuaccugagccaccguccuag

SEQ ID NO: 94536 - RNA, 64 nt, Human
cauccccuguccccaaguuccaaaagcacagacucaaagggaaaccccccagucacccacuguc

SEQ ID NO: 94537 - RNA, 64 nt, Human
gcccuaauagcagcccacggacuuuggggaggagcaaagggaggcuccggcugccccagauugg

SEQ ID NO: 94538 - RNA, 64 nt, Human
gugacccaagccuauuguaaacaagugauuaucucaaagggagaugccaauggaguaacaauuu

SEQ ID NO: 94539 - RNA, 64 nt, Human
ccagaggccaggaugccugagcccccugaguucccaaagggaggguggcagagacagugggcac

SEQ ID NO: 94540 - RNA, 64 nt, Human
gaagaccauuuuagaacuagucaguucucugcagcaaagggaacaggagccauuugaacccucu

SEQ ID NO: 94541 - RNA, 64 nt, Human
uugguccaauuuucacacacgugagaaucccuggcaaagggagcagaacugaaccggcuuuacc

SEQ ID NO: 94542 - RNA, 64 nt, Human
cuggggaugucucucaugaccaaaugcuuuuccucaaagggagagagugcuauuguagagccag

SEQ ID NO: 94543 - RNA, 64 nt, Human
aaauguaauauuuuguacaagauacacuggagaacaaagggaacucaagauucuuccagccaca

SEQ ID NO: 94544 - RNA, 64 nt, Human
cauuacaaacuccuuguacauucacugugaguuucaaagggagucagucccuaauuuacagguu

SEQ ID NO: 94545 - RNA, 64 nt, Human
cugguggcagaggaagcagguggcaccaacucaccaaagggacuugggagccaccuucucacuc

SEQ ID NO: 94546 - RNA, 64 nt, Human
uuggaugcccugugucucugugagugggguggagcaaagggaaccaaugccgaagaccgagggc

SEQ ID NO: 94547 - RNA, 64 nt, Human
acuuugacauguggcuguuugaauaagagaaggacaaagggaggagaaagcacaugugcuccag

SEQ ID NO: 94548 - RNA, 64 nt, Human
cuugguccuagggugggaaggggcuagggaggaccaaagggaugguauugagaagagagaaaga

SEQ ID NO: 94549 - RNA, 64 nt, Human
cauaaucuuuauggauccucaaagcugacuuugccaaagggauugagacccuuacuaccaucaa

SEQ ID NO: 94550 - RNA, 64 nt, Human
accucugaacauaaauuuggucaaauaauuggaacaaagggaaacagauacuugauaugaaagc

SEQ ID NO: 94551 - RNA, 64 nt, Human
ucuuucugcaccaccucacaauuuuccugaaccccaaagggagcagagagauaagaggacagaa

SEQ ID NO: 94552 - RNA, 64 nt, Human
uauuuuauucuuguaaugugaccuuuucacugugcaaagggagauuucuagccaggcauugacu

SEQ ID NO: 94553 - RNA, 64 nt, Human
aguuagaguguuuucucagagcaccucuggguggcaaagggaagcauguuccugccaagguuug

SEQ ID NO: 94554 - RNA, 64 nt, Human
cuucaggcaaaacgucgaaucagcuauuuacugccaaagggaaauaucauuuauuuuuuacauu

SEQ ID NO: 94555 - RNA, 64 nt, Human
caacaggagaaaggaaucaaaccacagaaaaauacaaagggaaacuucugcuucacuauucaga

SEQ ID NO: 94556 - RNA, 64 nt, Human
ucacacuagaccacagugacgaucucuguaagcacaaagggacuccgauguggguggggugagg

SEQ ID NO: 94557 - RNA, 64 nt, Human
uaagggcagccagagagaaaggucggguuacccacaaagggaagcccaucagacucacagcuga

SEQ ID NO: 94558 - RNA, 64 nt, Human
ucugggcagaaccagauuguuauguccuuuguuccaaagggaaaaaauugacagcagugacuug

SEQ ID NO: 94559 - RNA, 64 nt, Human
ggaguggggcaggcagugguugguggguggugugcaaagggaaugaagagcguccugggccuaa

SEQ ID NO: 94560 - RNA, 64 nt, Human
uuuauuacaguaaaaggacagagauuaagaucagcaaagggaggaggugcacagcacacguucc

SEQ ID NO: 94561 - RNA, 64 nt, Human
aggugggcaggcagggacuguggcagcuuauguccaaagggagcccccaugcacaggaagccac

SEQ ID NO: 94562 - RNA, 64 nt, Human
guuguuuuuuuuuaaagugccauucuagaauguccaaagggaaucaggauucuguggcuguaga

SEQ ID NO: 94563 - RNA, 64 nt, Human
cugccuuacccugggccucaguuuccccaccuuccaaagggaggagcaucauuccuuccuuacc

SEQ ID NO: 94564 - RNA, 64 nt, Human
cagccuuccuuguaucucuccagacucggacaaucaaagggagagaggguguaucggguccugu

SEQ ID NO: 94565 - RNA, 64 nt, Human
gguaauuuuuuguuucauggacuauggacucuuucaaagggaucugauccuuuugaauuuugca

SEQ ID NO: 94566 - RNA, 64 nt, Human
auguccucccaagacuggaguccucagcucagaacaaagggaaaggggugcagcuuccacccug

SEQ ID NO: 94567 - RNA, 64 nt, Human
ugggccgagcugguuaggugagcuccauaaaacccaaagggacuuggugucaggagaggacaug

SEQ ID NO: 94568 - RNA, 64 nt, Human
aaggaagagguggaaacccagagagacagagacccaaagggagagaaacagagacucagggaga

SEQ ID NO: 94569 - RNA, 64 nt, Human
gccccuuaauucccacaggcccccccagcaaggccaaagggaggccccuggguauuguccuccu

SEQ ID NO: 94570 - RNA, 64 nt, Human
ucccgagaagcaucccuuagccuaaaauccacaccaaagggagaguuccagaggaauccaugaa

SEQ ID NO: 94571 - RNA, 64 nt, Human
accauuuucugugaaaugcugucagcccaaacuccaaagggaugugcagccuuucguuuuacca

SEQ ID NO: 94572 - RNA, 64 nt, Human
gugaucaugcugcaaguucuuucuggaccucuggcaaagggaguggucagugaaggccaucguu

SEQ ID NO: 94573 - RNA, 64 nt, Human
ucccugaccccauuguaauaaccaacuccauauccaaagggagguggugcucucagccauugua

SEQ ID NO: 94574 - RNA, 64 nt, Human
aaaucggucugguaaaagggccuguuuucagggacaaagggaaugaggaugaucuuuggcuguu

SEQ ID NO: 94575 - RNA, 64 nt, Human
cuguggggccugauggugcucacgacucuuccugcaaagggaacugaagaccuccacauuaagu

SEQ ID NO: 94576 - RNA, 64 nt, Human
gugaacuucuauuauguaaagaaucucuaguguacaaagggacuacaucguuggcuuuugaccu

SEQ ID NO: 94577 - RNA, 64 nt, Human
uuuggggcccgguguggccgcgggcggguuuauccaaagggauggcuggaaauuggccgcuccc

SEQ ID NO: 94578 - RNA, 64 nt, Human
uuuuuucagcccaacauuuagcuuuauggagugccaaagggaaaauauauccauaucccuacaa

SEQ ID NO: 94579 - RNA, 64 nt, Human
auguuucagugagaccaugagaauuccaggcucacaaagggagaggagagaacagggcaagacg

SEQ ID NO: 94580 - RNA, 64 nt, Human
uauucaauuagguaagaagaucugguuuuuuggucaaagggaacauguucggacuggaaacauu

SEQ ID NO: 94581 - RNA, 64 nt, Human
ugggggugggcaccagcucaggggcuuccauuugcaaagggaaauuaaagaaagaauguugcuu

SEQ ID NO: 94582 - RNA, 64 nt, Human
aacaagcauaaaaaggaaaaaaaggaaacucaggcaaagggauccauaugugcaauggcaaaga

SEQ ID NO: 94583 - RNA, 64 nt, Human
ucuguauauuauguuuacuucuaaggauauagcacaaagggaacauuuuuuguuuaaagugaac

SEQ ID NO: 94584 - RNA, 64 nt, Human
aaaauucaucagagagcauuuuacuacugagcugcaaagggaaaaacuuaaaauggauaugaaa

SEQ ID NO: 94585 - RNA, 64 nt, Human
caaagcugauuuuuuuuuuaacuugaaaagauugcaaagggacauugaaguguuuaaaagagcc

SEQ ID NO: 94586 - RNA, 64 nt, Human
aauggaguguucaauagauaccacgaauugugaacaaagggaaaauucuauacaacucaaucua

SEQ ID NO: 94587 - RNA, 64 nt, Human
ggaguguaccacacagggccauugucucaccucccaaagggaccgccugcccccagcucauccc

SEQ ID NO: 94588 - RNA, 64 nt, Human
cugcaagcagacaccucgaggcagguguucuaggcaaagggaugggcaugagcgaaggcuccag

SEQ ID NO: 94589 - RNA, 64 nt, Human
cuuguuccugugcugcaucacccacucagccuuccaaagggaacaggaacaaauuuccccagca

SEQ ID NO: 94590 - RNA, 64 nt, Human
ggaggacgcgcuggggccgggaccccgggagacucaaagggagaggucucagugguuagagcug

SEQ ID NO: 94591 - RNA, 64 nt, Human
gguccuguugcguggagaucuccucugguccuuucaaagggaaacgcuguugaaccuugugccu

SEQ ID NO: 94592 - RNA, 64 nt, Human
gagcauacaguacugcggugugucuccucccauacaaagggacacauccuuauuuugaggguau

SEQ ID NO: 94593 - RNA, 64 nt, Human
augaaacuagauaauuucaagaaacugaguaggacaaagggagaaagaaauacauguucuuuuu

SEQ ID NO: 94594 - RNA, 64 nt, Human
uacgcgcugcccaugcugggucaaugaacagcaucaaagggaggcugaagagauuucaaagaau

SEQ ID NO: 94595 - RNA, 64 nt, Human
aaaaguuuuccuuucaucuuugacuguaagaugucaaagggaggcagccugcuugaacaggaaa

SEQ ID NO: 94596 - RNA, 64 nt, Human
aauuuucaugccuccugacucccaaucaguuucacaaagggauucaaucuguuuauauacguua

SEQ ID NO: 94597 - RNA, 64 nt, Human
uggaguccuguggggauacugcaaacucuauugccaaagggaugcuuuauacacauaauacuga

SEQ ID NO: 94598 - RNA, 64 nt, Human
gaaccacaguggauaugcuagcauuuuagcugugcaaagggagguagugugggaaaaguguuuc

SEQ ID NO: 94599 - RNA, 64 nt, Human
aagcaauagauaacauccaucguggcucugccuucaaagggaaauuuuacauaugucacuggga

SEQ ID NO: 94600 - RNA, 62 nt, Human
gcugugcguuuugcuaucauugcuaagagauucccgcugauugggcucagugccagcuguua

SEQ ID NO: 94601 - RNA, 62 nt, Human
uauaaaacgaagugauugccuccgaucguucucccgcugagcuguuuucaagggcaagugcu

SEQ ID NO: 94602 - RNA, 62 nt, Human
cagaaaugccacacuugugugccacagaguuccccgcugacccuugguuagggguccucuua

SEQ ID NO: 94603 - RNA, 62 nt, Human
ucgcugucaagaggguguaaguauuccaccagcccgcugagugugcacgaaauguucgcagu

SEQ ID NO: 94604 - RNA, 62 nt, Human
ucugaggcagugucacccgcuguucccucauucccgcugaccucacuggcccacuggcaaau

SEQ ID NO: 94605 - RNA, 62 nt, Human
ggcaccagcuuagacaccuccaagaaccaggccccgcugaugcaagauggcagaucugauac

SEQ ID NO: 94606 - RNA, 60 nt, Human
ccacuucugccaacuuguaggggcacgucgcccgcugagcugaguggccagccagugcca

SEQ ID NO: 94607 - RNA, 62 nt, Human
gggcuuguguguucucugcggcgggccgcguccccgcugagccucgcggugacagccgccuu

SEQ ID NO: 94608 - RNA, 62 nt, Human
gauggggucuucauuguccagaaauaccuccucccgcugacugccccagagccugaaagucu

SEQ ID NO: 94609 - RNA, 62 nt, Human
ccagaggccuacaggggcaccaugcugcacugcccgcugaacuucacuggcaccccgggccc

SEQ ID NO: 94610 - RNA, 62 nt, Human
uccuggggaaaagaagcacccagaccccgcgccccgcugaucuuugcuucaguccuugaauc

SEQ ID NO: 94611 - RNA, 62 nt, Human
cccguuugccucuccaaccucuucauccugcccccgcugaguuuucuuuauugaguauucau

SEQ ID NO: 94612 - RNA, 62 nt, Human
uaugaugcuagcuuccguugccaagucugccucccgcugacugagggaggguaggguuaccu

SEQ ID NO: 94613 - RNA, 62 nt, Human
caagguagagaaaaggacgaagaaguguaagucccgcugauucucggggguaaggcucggau

SEQ ID NO: 94614 - RNA, 62 nt, Human
uaucugcccuucuugccaggcagcuccacucucccgcugacugcccacacccugcagagugg

SEQ ID NO: 94615 - RNA, 62 nt, Human
aagugagcccagagcauggcacaugagcaucacccgcugaugguggccugcugugccuggug

SEQ ID NO: 94616 - RNA, 62 nt, Human
uccuguagccacuggcauagcccuccugagcacccgcugacauuuccguuguacauguuccu

SEQ ID NO: 94617 - RNA, 62 nt, Human
ugauauucugagauucucucauuuguagaaugcccgcugaugcauuguuuauuuuuuuugcu

SEQ ID NO: 94618 - RNA, 62 nt, Human
uuugagaggcaccucagaguuuccuucuuuaccccgcugagacagugggagagccugaagca

SEQ ID NO: 94619 - RNA, 62 nt, Human
aggcggggggugcccaagcccagcccugugcccccgcugaaccuggcuggaccgcgugugaa

SEQ ID NO: 94620 - RNA, 62 nt, Human
gugagaguagaaacccuucccuccaggaggcccccgcugacucccacagaaacccaccuacc

SEQ ID NO: 94621 - RNA, 62 nt, Human
aggcaaggaaaagccccacaaaauuccuguuacccgcugaacuccaagcucaccaaccagau

SEQ ID NO: 94622 - RNA, 62 nt, Human
guguaggugcugaaaaguggccaagggccacccccgcugaugacuccuugcauucccucccc

SEQ ID NO: 94623 - RNA, 62 nt, Human
gucuaccggcucacuaacaucuggcuugagcucccgcugaugguuuucgguaagaaaucuuc

SEQ ID NO: 94624 - RNA, 62 nt, Human
ggcguucaagauagucauucaaaaguucuuggcccgcugaagucuguuaacaguugaaacau

SEQ ID NO: 94625 - RNA, 62 nt, Human
gcggcuguuuggcucuuucucccccgcaaggacccgcugacccgcuggauggagagcaaagg

SEQ ID NO: 94626 - RNA, 62 nt, Human
uccaaaaaauggugucuauaucaagaucguaucccgcugacacagaaggcugccgggugggg

SEQ ID NO: 94627 - RNA, 62 nt, Human
cggcgccgcccuggugguuucugucuccuccucccgcugaacacguccucgcucccgcgcuc

SEQ ID NO: 94628 - RNA, 62 nt, Human
ccucugccggccucccagccgggcuccugaagcccgcugaaaggucagcgacugaaggccuu

SEQ ID NO: 94629 - RNA, 62 nt, Human
ggcuuaaacaacaccuccuccugcugcucacucccgcugagcccacucuacugccccagcuc

SEQ ID NO: 94630 - RNA, 62 nt, Human
ugugcagugacguggucaccaaggcagugagccccgcugaccccgggccagcacuuggcagg

SEQ ID NO: 94631 - RNA, 62 nt, Human
uauuuaauccccacccugggcucugggagcagcccgcugaguggacuggaguggagcauugg

SEQ ID NO: 94632 - RNA, 62 nt, Human
agugccacccaugcagcugcuccccaggccaccccgcugauggagccccaccuugucugcua

SEQ ID NO: 94633 - RNA, 62 nt, Human
augucggcacuggaugggauguacuucucagccccgcugagccccucauuugugcccagcau

SEQ ID NO: 94634 - RNA, 62 nt, Human
ggugagccaaggacagggcuggcuccucugcccccgcugacgcuucccuugccguuggcuuu

SEQ ID NO: 94635 - RNA, 62 nt, Human
ucagagcggacaaaauuaaaagacugcgaguacccgcugauuuccagaauccugcaugggcc

SEQ ID NO: 94636 - RNA, 62 nt, Human
gaaacacaacucagggcuuuugugaagguucccccgcugagaucuuuccuccugguuacugu

SEQ ID NO: 94637 - RNA, 62 nt, Human
gggaggggauggcccugagcccagcggcuccucccgcugaguguauuucuucccaccacuca

SEQ ID NO: 94638 - RNA, 62 nt, Human
aggaggaccuggaugauguccccaucccugugcccgcugagcacuuccaugaagguaaagga

SEQ ID NO: 94639 - RNA, 62 nt, Human
cugccuguucucagggcacagcaacugccaaucccgcugaagaggccucccugggcacagca

SEQ ID NO: 94640 - RNA, 62 nt, Human
ccacuccugaaugcaccacaugccucugucuccccgcugagcccaggcacuugcccaggccg

SEQ ID NO: 94641 - RNA, 62 nt, Human
ccaggcuggaguucugguucuuccagguggcucccgcugaggcagcggucucugggggaucc

SEQ ID NO: 94642 - RNA, 62 nt, Human
guagcugggauuacaggugcaugccaccaggccccgcugauuuuuguauuuuuaguagagau

SEQ ID NO: 94643 - RNA, 62 nt, Human
gauagagggaggcuagauuugaugacauauuacccgcugacccagccccagccaccccaugg

SEQ ID NO: 94644 - RNA, 62 nt, Human
agaggggaaagcagugcagaccacuuauuaagcccgcugaggacuagcuuucugucuuucau

SEQ ID NO: 94645 - RNA, 62 nt, Human
cacuucugaccucagccucggucucaugaacacccgcugaucucaggagaacaccugggcua

SEQ ID NO: 94646 - RNA, 62 nt, Human
gcccugcaauguccaaccgccaacugcagugacccgcugauagcugcgcaacagccuggguu

SEQ ID NO: 94647 - RNA, 62 nt, Human
uucacaagucacaguucuucccauaaaugaggcccgcugaccucugcgggacuuuaaaaauc

SEQ ID NO: 94648 - RNA, 62 nt, Human
acuggcacugcccaggcugagacucuucaagucccgcugacgucugagcuuugaugcuuaag

SEQ ID NO: 94649 - RNA, 60 nt, Human
ccauggagguguccuguugaagcccuugaucccgcugacgacgcccacgucgaggcccca

SEQ ID NO: 94650 - RNA, 62 nt, Human
gcuugccacaccccccaccccuaggacuuauucccgcugacugagucucugaggggcuacca

SEQ ID NO: 94651 - RNA, 62 nt, Human
agacucaacuugagggacuguuuuugacaauccccgcugaccuccgcuccucguggcgcccu

SEQ ID NO: 94652 - RNA, 62 nt, Human
cccagaugauaggccuggcccacgccgccgcccccgcugagugacgcaaucgcaccacgggg

SEQ ID NO: 94653 - RNA, 62 nt, Human
gggcugggcaucccagcuugcccccgcuuagccccgcugagcuuggaggaaguaugagugcu

SEQ ID NO: 94654 - RNA, 62 nt, Human
ccaguggcuucuccuuucugucaagacuuagccccgcugagaugcccuucugcuccagcuug

SEQ ID NO: 94655 - RNA, 62 nt, Human
gaaccuccuucuguuggaggcccucccaucuccccgcugaaaccugcgcuccuuuuuugggg

SEQ ID NO: 94656 - RNA, 62 nt, Human
gaggucacagaugugggagagucccugaugagcccgcugacacgugugcgccccuuugcacc

SEQ ID NO: 94657 - RNA, 62 nt, Human
ugcggcccccucucggccaggcauuggcucagcccgcugaguggggggucgugggccagucc

SEQ ID NO: 94658 - RNA, 62 nt, Human
ccgcacuuaccacucccccagccacgccccuccccgcugaccgcuccuccagccccgccucc

SEQ ID NO: 94659 - RNA, 62 nt, Human
cagcuguacacaaacuggccgcuggagagaugcccgcugaggguauucuccccucaacccac

SEQ ID NO: 94660 - RNA, 62 nt, Human
gugcacagcgccagguuaacgcugaagccugccccgcugagcccaggagccgggaggccugc

SEQ ID NO: 94661 - RNA, 62 nt, Human
cugcuccggcugcccccgaaggcgcugcccaccccgcugaggcccagagcucgggagaugcc

SEQ ID NO: 94662 - RNA, 62 nt, Human
cuagagccccgcuuucccuccaaggcugacuccccgcugacccuaacaauaccuuuggagcu

SEQ ID NO: 94663 - RNA, 62 nt, Human
ggacagucgucuucgaccugucggcuguggaacccgcugagcgcccgagccgggcccgccug

SEQ ID NO: 94664 - RNA, 62 nt, Human
agaagaagauggugccuggggcucuggggguccccgcugaccuggccccuguugacgucgag

SEQ ID NO: 94665 - RNA, 62 nt, Human
cuuccugcuucauccccuuuccagcuccccuucccgcugagagccacuuucaucggcaauaa

SEQ ID NO: 94666 - RNA, 62 nt, Human
uuucugccuggcagggggcaggucugugcccucccgcugacuccugcuguguccugaggugc

SEQ ID NO: 94667 - RNA, 62 nt, Human
aaagcuugguggccaagcagucugugugcuuccccgcugauggagaacguugcguuguucac

SEQ ID NO: 94668 - RNA, 62 nt, Human
uagaggugaaugugaaugaagccucccaggcacccgcugaauuucugaggccuugcuuaaag

SEQ ID NO: 94669 - RNA, 62 nt, Human
gguucaccagagggagcuugggugcagguucacccgcugaaggcgcugauaaguccugugcu

SEQ ID NO: 94670 - RNA, 62 nt, Human
guagauuaucagagcugucagcacuaccucuccccgcugaaaccagcaguucauggcuuccu

SEQ ID NO: 94671 - RNA, 62 nt, Human
ccagacccugccccaccucacuucccucccuucccgcugagcuucccuuggacacuaacucu

SEQ ID NO: 94672 - RNA, 62 nt, Human
acccaggcgcacgugcugcagcccccggaggccccgcugaaaccugggcugcccuuccccca

SEQ ID NO: 94673 - RNA, 62 nt, Human
cucagggaaagaaggugauuuguauuugucuccccgcugaaaagaacaggauucaaguccag

SEQ ID NO: 94674 - RNA, 62 nt, Human
ucucgauuucucucucucccccucagcaucuucccgcugagagugguggggaagagccuugu

SEQ ID NO: 94675 - RNA, 62 nt, Human
guggagugugccuucagggcaucuugaaaugucccgcugaaugauuugacucaguuugcuca

SEQ ID NO: 94676 - RNA, 64 nt, Human
gagaggcugagccaggaggaucgcuugagcccaggaggcggagguugcagugagcugagauggc

SEQ ID NO: 94677 - RNA, 64 nt, Human
aaucaaagagauucaaagagauuccugcaggccagaggcggaacacaccuuuauggcuggggcu

SEQ ID NO: 94678 - RNA, 59 nt, Human
accugcagcccagcagauagugggcaccugaggcggagucugcguggagaggggcggug

SEQ ID NO: 94679 - RNA, 64 nt, Human
ucgggagacugacgggagaaucgcuugaacccaggaggcggagguugcagugagcucagaucuc

SEQ ID NO: 94680 - RNA, 64 nt, Human
agagagcaucccguguggauaugaggcugguguagaggcggagaggagccaagaaacuaaaggu

SEQ ID NO: 94681 - RNA, 64 nt, Human
gggaggcugaggcaggagaaucgcuugaacccgggaggcggagguugcagugagcugagaucgc

SEQ ID NO: 94682 - RNA, 64 nt, Human
aacugccucagugucuuugccagaaaaaggcaaagaggcggacagugcagggcuccucccuccu

SEQ ID NO: 94683 - RNA, 64 nt, Human
gggaggcugaggcaggagaauugcuugaacccgggaggcggagguugcaguaagccgagaccau

SEQ ID NO: 94684 - RNA, 64 nt, Human
gggaggcugaggcaggagaauggugugaacccgggaggcggagcuugcagugagccgagauccc

SEQ ID NO: 94685 - RNA, 64 nt, Human
aggaggcugaggcaggagaauggcgugaacccgggaggcggagcuugcagugagccuugaucac

SEQ ID NO: 94686 - RNA, 64 nt, Human
gggaggcugaggcgggagaaucgcuugagccggggaggcggagguugcagugaggcgagauugu

SEQ ID NO: 94687 - RNA, 64 nt, Human
ucuucucauuuugcagaagagaaacugaggcccagaggcggagggcagucugcucaaggucacg

SEQ ID NO: 94688 - RNA, 64 nt, Human
agauugaagaugcauccaacccucugcugcugaagaggcggaagaaagcucgggcccuggaggc

SEQ ID NO: 94689 - RNA, 64 nt, Human
gggaggcugaggugggagaauugcuugaacccaggaggcggaggcagaggcugcagugacccaa

SEQ ID NO: 94690 - RNA, 64 nt, Human
ugucuccucucugguggcugggcugcuccugaaugaggcggagcuccaggauggggaggggcuc

SEQ ID NO: 94691 - RNA, 64 nt, Human
uggagguggagacaggagaauugcuugaacccuggaggcggagguugcagugagccaauaucuc

SEQ ID NO: 94692 - RNA, 64 nt, Human
agggggcugaggcaggagaauggcgugaauccgggaggcggagcuugcagggagccgagauagu

SEQ ID NO: 94693 - RNA, 64 nt, Human
agaaggccgaggugggagaauccguugaaccugggaggcggagguugugaugagccaagauuga

SEQ ID NO: 94694 - RNA, 64 nt, Human
aggaggcugaagcagaagaaucacuugaaccuaggaggcggagguugcagugagucaagaucgc

SEQ ID NO: 94695 - RNA, 64 nt, Human
aucaucccaaaagagcuggagugacaugggaggggaggcggaucugaggggcugggugcaggcc

SEQ ID NO: 94696 - RNA, 64 nt, Human
gggaggcugaggcaggagaauggcgugaacccaggaggcggagcuugcagugagucgagaucgc

SEQ ID NO: 94697 - RNA, 64 nt, Human
uuggaggcgaggcacgagaaucgcuugaaccugggaggcggaguuugcagugagccgagaucac

SEQ ID NO: 94698 - RNA, 64 nt, Human
gggaggcugaggcaggagaaucgcuugaacccgggaggcggagguuacagugagccgagaucac

SEQ ID NO: 94699 - RNA, 64 nt, Human
uucuauuucuucccuuauaguuuucuaugggaaugaggcggauacaggaaacacccuaucuccu

SEQ ID NO: 94700 - RNA, 64 nt, Human
aggaggcugaggcaggagaaucgcuugaacccgggaggcggagguugcggugagcugagaucac

SEQ ID NO: 94701 - RNA, 64 nt, Human
aggaggcugaggcaggagaaucgcuugaaccugggaggcggagguugcagugagccgagaucau

SEQ ID NO: 94702 - RNA, 64 nt, Human
gggaggcugaggcaggagaauggugugaaccugggaggcggagcuugcagugagccgagacugu

SEQ ID NO: 94703 - RNA, 64 nt, Human
ugggaggcugaggcaggagaauugccucaaccgggaggcggagguugcagugagccaagaucgc

SEQ ID NO: 94704 - RNA, 64 nt, Human
gaagagacugcgggccgugucucccuuucuuaaggaggcggaugccaagaaguguggggccaaa

SEQ ID NO: 94705 - RNA, 64 nt, Human
acaguugagguugcuguugaaaagaaagaagaaggaggcggaaaucucucagggagaauuauuu

SEQ ID NO: 94706 - RNA, 64 nt, Human
gggaggcugaggcaggagaauagugugaacccaggaggcggagcuugcagugagccaagauagu

SEQ ID NO: 94707 - RNA, 64 nt, Human
ggguggcugaggcaggagaauuguuugaaccugggaggcggaggcugcagugagcugggauuac

SEQ ID NO: 94708 - RNA, 64 nt, Human
ccaaaaucucaagaaauucccagcagguuaccuggaggcggaucaucuaauucucuguggaaug

SEQ ID NO: 94709 - RNA, 64 nt, Human
uuuuaaauuacaguuaguuuuuuuguuuguuuuugaggcggagucucuguuacccaggcuggag

SEQ ID NO: 94710 - RNA, 64 nt, Human
uggaggcucaggcacaagaaucacuugaaccuacgaggcggagguugcagugggccaggaucgu

SEQ ID NO: 94711 - RNA, 64 nt, Human
agaaggcugagguacaagaauugcuggaaccugggaggcggagguugcagugaaccaagauugc

SEQ ID NO: 94712 - RNA, 64 nt, Human
agaagagaaaaaggaauuuaaaacaaaaaccacagaggcggaaauaccggagggcuuugccuug

SEQ ID NO: 94713 - RNA, 64 nt, Human
gauaggcugaggcaggagaauugcuugaauccgggaggcggagguugcagugagccgagaucgu

SEQ ID NO: 94714 - RNA, 64 nt, Human
ucucuaaagaaaaucucugugaaaccccuauguggaggcggaauugcucucccagcccuugcau

SEQ ID NO: 94715 - RNA, 64 nt, Human
gcucacgccuguaaccucagcacuuugggaggccgaggcggacagaucacgaggucaggaguuc

SEQ ID NO: 94716 - RNA, 64 nt, Human
cggaggcugaggcaggagaauggcgugaacccgggaggcggagcuugcagugagcugagauggc

SEQ ID NO: 94717 - RNA, 64 nt, Human
gugugcaguuugauggcagcugcaaacuggaggugaggcggaggaaaggcagguaggaaggagu

SEQ ID NO: 94718 - RNA, 64 nt, Human
ggaggcugaggcaggaagaaucacuugaacccaggaggcggagguugcagugugccaagaucau

SEQ ID NO: 94719 - RNA, 64 nt, Human
ggaagggugaggcgggaggaucgcuugaaccugggaggcggagguuccagagagccaagaucgc

SEQ ID NO: 94720 - RNA, 64 nt, Human
gggaggcugaggcaggagaaucaguugaaccugggaggcggagguugcagugagcugagacugc

SEQ ID NO: 94721 - RNA, 64 nt, Human
agagaggugugcuucaauccuggaggggcagcaggaggcggagcucuuuugcuuggauucccau

SEQ ID NO: 94722 - RNA, 64 nt, Human
cuucucuccuuugcaaauggcucagugacuggaagaggcggacuaauagccagaguuaaauaua

SEQ ID NO: 94723 - RNA, 64 nt, Human
uggaggcugaggcaggagaauggcgugaacccgggaggcggagcuugcagugagccgagaucgc

SEQ ID NO: 94724 - RNA, 64 nt, Human
gggacacugaggcaggagaaucacuugaacccgggaggcggagguugcagugagccgagaucgu

SEQ ID NO: 94725 - RNA, 64 nt, Human
gaccugggcaggcgggauguguuggccacagggagaggcggaccggcacccggugggaccuccu

SEQ ID NO: 94726 - RNA, 64 nt, Human
gggaggcugaggcaugagaauugcuugaacccgggaggcggagguugcagugagccuagaucau

SEQ ID NO: 94727 - RNA, 64 nt, Human
augagguugaggcaggagaauggcgugaaccgaggaggcggagcuugcagugaguggaaauugc

SEQ ID NO: 94728 - RNA, 64 nt, Human
aggaagcuaaggcaggagaaucgcuugaauccaggaggcggagguugcagugagcugagaucgc

SEQ ID NO: 94729 - RNA, 64 nt, Human
gggaggcugaggcaggagaaucgcuugaacccgggaggcggagguugcaugagccgagauggcg

SEQ ID NO: 94730 - RNA, 64 nt, Human
aggaggcugaggcaggagaauugcuugaacccgggaggcggagguugcagugagccaagauugc

SEQ ID NO: 94731 - RNA, 64 nt, Human
gcucacuacugcgguuugccugugccuggacaaugaggcggagccacuguuguuuuguuggggc

SEQ ID NO: 94732 - RNA, 64 nt, Human
gggaggcugaggcaggagaauggcgugaacccgggaggcggagcuugcagugagccgagauccc

SEQ ID NO: 94733 - RNA, 64 nt, Human
gggaggcugaggcaggagacuggcgugaacccaggaggcggaccuuguagugagccgagaucgc

SEQ ID NO: 94734 - RNA, 64 nt, Human
gggaggcugaggcaggagaaucgcuugaacccaggaggcggagcuugcagugagccgagaucag

SEQ ID NO: 94735 - RNA, 64 nt, Human
cggaggcugaggcaggagaaucucuugaaccugggaggcggagguugcaaugagccgagaucac

SEQ ID NO: 94736 - RNA, 64 nt, Human
gugcgcgcauguaaucccagcuacucgggaggcugaggcggaagaaucacuugaacccgggagg

SEQ ID NO: 94737 - RNA, 64 nt, Human
gggaggcugaggcggaagaaucacuugaacccgggaggcggagguuccagugagccgagauggc

SEQ ID NO: 94738 - RNA, 64 nt, Human
gggaagcugaggcagaagaaucacuugaaccugggaggcggagguuguggugagccgagaucgc

SEQ ID NO: 94739 - RNA, 64 nt, Human
aggaggcugaggcaggagaauuacuugaacccgggaggcggagguugcaguaagcagagauugu

SEQ ID NO: 94740 - RNA, 64 nt, Human
gggagguugaggcaggagaaucauuugaacucaggaggcggaaguugcggugagccaagauugu

SEQ ID NO: 94741 - RNA, 64 nt, Human
uaauuuugugguguauuuuugucaguagguagcagaggcggaaguauuuuuugguguaauucuu

SEQ ID NO: 94742 - RNA, 64 nt, Human
uuguuuggccucaugggaccgaggggcuggaggagaggcggagcugugccccagcuguuccagc

SEQ ID NO: 94743 - RNA, 64 nt, Human
gggaggcugaggcaggagaauugcuugaacccgggaggcggagguuguggugagcugagaugac

SEQ ID NO: 94744 - RNA, 64 nt, Human
gggaggcugaggcuggagaauggugugaacccaggaggcggagcuugcagugagccaagaucgc

SEQ ID NO: 94745 - RNA, 64 nt, Human
uggaggcugaggcaggagaauggcgugaacccaggaggcggagcuugcagugagcagagaucac

SEQ ID NO: 94746 - RNA, 64 nt, Human
cuucagaagggcugguuuguccgaaaagugagaggaggcggaggagaggugaggagagcaagug

SEQ ID NO: 94747 - RNA, 64 nt, Human
uuggggaggcuaagguaggaucacuugaucccaggaggcggagguugcagugaguugcagucac

SEQ ID NO: 94748 - RNA, 64 nt, Human
aaccagugccagcauacucagcguggccguucgggaggcggaaaaagaugagcgcgcucugaag

SEQ ID NO: 94749 - RNA, 64 nt, Human
uagaggcugaggcagaagaauugcuuuaaccuuggaggcggagguugcauugagcugagaucau

SEQ ID NO: 94750 - RNA, 64 nt, Human
aggaggccgagacaggagaaucgcucgaacccaggaggcggacguugcagugagccaagauugc

SEQ ID NO: 94751 - RNA, 64 nt, Human
gagaggcugagacacgaaaauugcuugaaccugggaggcggagguugcaaugagccgagaucgc

SEQ ID NO: 94752 - RNA, 64 nt, Human
aggagucugaggcacgagaaucaccugaacucaggaggcggagguugcggugagcugagauggc

SEQ ID NO: 94753 - RNA, 64 nt, Human
gggaggcugagacaggagaaucacuugaacccaggaggcggaggcugcagugagcugagaucac

SEQ ID NO: 94754 - RNA, 64 nt, Human
gcacaugccuguaaucccagcuacucaggaggcugaggcggagaauugcuugaacccggaaggu

SEQ ID NO: 94755 - RNA, 64 nt, Human
uguagucuuuuuuauuuauuuauuuuuuuuuuuugaggcggagucucgcucugucacccaggcu

SEQ ID NO: 94756 - RNA, 64 nt, Human
aggaggcugagggaggagaaucccuugaacccgggaggcggagguucauggggaacccagcagg

SEQ ID NO: 94757 - RNA, 64 nt, Human
aggaggcugaggcagaagaaucgcuugaacccuggaggcggagguugccgugagccaagaucgc

SEQ ID NO: 94758 - RNA, 64 nt, Human
gggaggcugaggcaggagaauugguugaacccaggaggcggagguugcagugagcagagaucgu

SEQ ID NO: 94759 - RNA, 64 nt, Human
gcucacaccuguaaucccagcacuuugggaggcugaggcggauggaucacgaggucaggcaguc

SEQ ID NO: 94760 - RNA, 64 nt, Human
aggaggcugaggcaggagaacugcuugaaccugggaggcggagguugcagugagccgagauugc

SEQ ID NO: 94761 - RNA, 64 nt, Human
cggcucacagcaguuggggccagcggggagaagagaggcggaacugcuguguccucauguggcg

SEQ ID NO: 94762 - RNA, 64 nt, Human
gggaggcuaaggcaggagaauggcgugaacccgggaggcggagcuugcagugagccgaggucgu

SEQ ID NO: 94763 - RNA, 64 nt, Human
aggaggcugaggcaggagaauugcuugaacccgagaggcggaaguugcagugagccgagauugu

SEQ ID NO: 94764 - RNA, 64 nt, Human
gggaggcugagacaggagaaucgcuuaaaccugggaggcggagaguacagugagccaagaucgc

SEQ ID NO: 94765 - RNA, 64 nt, Human
gggaggcugaggcaggagaaucgcuugaaccugggaggcggauguugcagugagcagagaucgu

SEQ ID NO: 94766 - RNA, 64 nt, Human
gggaggcugagacaggagauuugcuugaacccgggaggcggagguugcagugagccaagauugu

SEQ ID NO: 94767 - RNA, 64 nt, Human
aggaaggcugaggcggcagaaucacuugaacccggaggcggagguugcgguaagccgagaucac

SEQ ID NO: 94768 - RNA, 64 nt, Human
acagcccacucucuaucacgagccuaacccgcgggaggcggaagagacauccauucgagaacug

SEQ ID NO: 94769 - RNA, 64 nt, Human
gggaggcugagguaggagaaucacuugaacccaggaggcggaaguugcagugagcugagaucau

SEQ ID NO: 94770 - RNA, 64 nt, Human
aggaggcugaggcaggagaaucacuugaaccugggaggcggauguugaagugagcugagauugc

SEQ ID NO: 94771 - RNA, 64 nt, Human
cucgcugggcgcccuggccgcagacacgcucgacgaggcggagcgccaguggaaggccgaguuc

SEQ ID NO: 94772 - RNA, 64 nt, Human
cucagaagggugaggcagaauugccugaacccgcgaggcggagacugcagugagccgagaucgc

SEQ ID NO: 94773 - RNA, 64 nt, Human
gggaggcugaggcaggagaauugcuugaacccaggaggcggagguugcagugagccaagaucgc

SEQ ID NO: 94774 - RNA, 64 nt, Human
gggaggccaaggcaggagaauugccugaacccgggaggcggagguugcagugagcugagaucgc

SEQ ID NO: 94775 - RNA, 64 nt, Human
acucaugccuguaaucccagcaauuugggagacagaggcggaaggaucaccugagccuaggagu

SEQ ID NO: 94776 - RNA, 64 nt, Human
gggaggcuaaggcaggagaaucgcuugaacccgggaggcggagguugcagugagccgagaucgc

SEQ ID NO: 94777 - RNA, 64 nt, Human
gggaggcugaggcaggagaauggcgggaaccugggaggcggagcuuacagugaaccgagaucac

SEQ ID NO: 94778 - RNA, 64 nt, Human
gaagaaguggcugccacacccaggggaaggcccugaggcggaggcugugcuccgccaugguguc

SEQ ID NO: 94779 - RNA, 64 nt, Human
gugggacaggagaaguuuuccaagagguucaugggaggcggaggugacuggcuggcugucuugc

SEQ ID NO: 94780 - RNA, 64 nt, Human
gggaggcugaggcaggggaaucacuugaaccccggaggcggagguuguagugggccgagauugu

SEQ ID NO: 94781 - RNA, 64 nt, Human
cagaggagcagcucuccccaggcauuugccaagggaggcggauuucccugguaguguagcugug

SEQ ID NO: 94782 - RNA, 64 nt, Human
uccccggaccgcauggccggugagaguagagucggaggcggagagccuggacgcccagaggccg

SEQ ID NO: 94783 - RNA, 64 nt, Human
auguuaauuacccagguguaggaagccauacacugaggcggaagaucgcaagucagaguggcug

SEQ ID NO: 94784 - RNA, 64 nt, Human
aagguccgccuugcaggggaggccuggcugcagagaggcggaggaggaagcuggcgcuggggga

SEQ ID NO: 94785 - RNA, 64 nt, Human
accuuggugacuagauuucagccuaugaauucuggaggcggacacaaaaauucagauuaaacua

SEQ ID NO: 94786 - RNA, 64 nt, Human
uaaccccaggccccgaggacccagacccaguggggaggcggacguuccagccggcauggcuggg

SEQ ID NO: 94787 - RNA, 64 nt, Human
cggaggcugaggcaggagaauggcgugaacccgggaggcggagcuugcagugagccgagaucgc

SEQ ID NO: 94788 - RNA, 64 nt, Human
aggaggcugaggcaggaggauugcuugaacccuggaggcggagauugaagugagcugaguucgu

SEQ ID NO: 94789 - RNA, 64 nt, Human
gggaggcugaggcaggagaaucucuugagcccaggaggcggagguugcagugagcugagaugcc

SEQ ID NO: 94790 - RNA, 64 nt, Human
gggaggcugaggcuggagaguugcucaaacccgggaggcggagauugcagugagccaagaucgc

SEQ ID NO: 94791 - RNA, 64 nt, Human
agaaggcugaggcaggagaaucacuugaaccuaggaggcggagguugcagugagccaagauggc

SEQ ID NO: 94792 - RNA, 64 nt, Human
gggaggcugaggcaggagaaucgcuugaacccaggaggcggagguugcagugagccaagauggc

SEQ ID NO: 94793 - RNA, 64 nt, Human
gccgcggagccccgcgcgcugggguugcgccccggaggcggaucucaggcacccccgccuuggc

SEQ ID NO: 94794 - RNA, 64 nt, Human
gggaggcugaggugggagaaucacuugaaccugggaggcggagguugcagugagcugaaaucgc

SEQ ID NO: 94795 - RNA, 64 nt, Human
guuugcuaaguacagaucauucaagguggccgacgaggcggagaaguacaaucugguccugggg

SEQ ID NO: 94796 - RNA, 64 nt, Human
gggcccuggcuguagccgaggccgcagccggugagaggcggagccucgagcgggccccuccucc

SEQ ID NO: 94797 - RNA, 64 nt, Human
accacuacccucagagagagccaaaaauacagaagaggcggagagcgccccuccaaccaggcug

SEQ ID NO: 94798 - RNA, 64 nt, Human
gggaggcugaggcaagagaguugcuugaacccaggaggcggagauugcagugagcugagauugc

SEQ ID NO: 94799 - RNA, 64 nt, Human
aggaggcugaggcaggagaauugcuugaacccaagaggcggagguuguggugagccgagauugc

SEQ ID NO: 94800 - RNA, 64 nt, Human
uccccccuugcuugugccuuaaaggcagagaagcgaggcggaugcccuggaagcacccagcauc

SEQ ID NO: 94801 - RNA, 64 nt, Human
gggaggcugaggcaagagaaucgcuugaaucugggaggcggagguugcagugagccaggaucac

SEQ ID NO: 94802 - RNA, 64 nt, Human
aggaggcugaggcaggagaaucacuugaauucaggaggcggagguugcagugagccaagaucau

SEQ ID NO: 94803 - RNA, 64 nt, Human
aggaggcugaggcaugagaaucgcuuaaacccaggaggcggagguugcagugagcugagaucac

SEQ ID NO: 94804 - RNA, 64 nt, Human
aggaggcugaggcagcagaaucguuugaacccgggaggcggagguugcagugaguggagaucgu

SEQ ID NO: 94805 - RNA, 64 nt, Human
caagcaaagcagcaugggggccugcccguaacgggaggcggacguggccccgcugggccucuga

SEQ ID NO: 94806 - RNA, 64 nt, Human
ucaccuacccccugccgcacagcccagcaggagggaggcggacagccagaugcagagcgagugg

SEQ ID NO: 94807 - RNA, 64 nt, Human
aggaggcugaggcaggagaauugcuugaaaccaggaggcggagguugcagugagcccagaucac

SEQ ID NO: 94808 - RNA, 64 nt, Human
acaauggcucgugcuuguaaucccagcacuuugggaggcggaggcaggcggguugcuugagcuc

SEQ ID NO: 94809 - RNA, 64 nt, Human
cuaccguggaaugucccuggaguacuauggcaucgaggcggacgacaaccccuucuucgaccuc

SEQ ID NO: 94810 - RNA, 64 nt, Human
gguaagggaaagguggaggggcucagggcacccugaggcggagguuucagaguagaagguggug

SEQ ID NO: 94811 - RNA, 64 nt, Human
aggaggcugaggcaggagaauugcuugaacccaggaggcggagguugcagugagccaggauugu

SEQ ID NO: 94812 - RNA, 64 nt, Human
gggaggcugaggcaggagaaucacuugaacgugggaggcggagguugcagcgagcugagaucau

SEQ ID NO: 94813 - RNA, 64 nt, Human
gggaggcugaggcaggagaaucgcuucaaccugggaggcggagguugcagugagccgagaucgc

SEQ ID NO: 94814 - RNA, 64 nt, Human
ugcccaccgugccccuuuguccccaugucaggcggaggcggaaggcccaccgugccagaggcug

SEQ ID NO: 94815 - RNA, 64 nt, Human
ggaccaggcacccccagaaugaccuggccgcagugaggcggauugagaaggagcucccaggagg

SEQ ID NO: 94816 - RNA, 64 nt, Human
gggaggcugaggcaggagaaucacuugaaccugggaggcggagguugcagugagccgagaucgu

SEQ ID NO: 94817 - RNA, 64 nt, Human
gggaggcugaggcaggagaauggugugaacccgggaggcggagcuugcaguggagccaagauug

SEQ ID NO: 94818 - RNA, 64 nt, Human
gggaggcugaggcaggagaaucgcuagaaccugggaggcggagguugcagucagccaagauagc

SEQ ID NO: 94819 - RNA, 64 nt, Human
cggaggcugaggcaggagaauggcgugaacccgggaggcggaucuugcagugagcggagauugc

SEQ ID NO: 94820 - RNA, 64 nt, Human
aggaggcuaaggcaggagaaucgcuuaaacccaggaggcggagguugcagugagccgagauugc

SEQ ID NO: 94821 - RNA, 64 nt, Human
gggaggcugaggcaggagaaucaccugaaccugagaggcggagguugcagugagccgagaucac

SEQ ID NO: 94822 - RNA, 64 nt, Human
aggaggcugaggcaggagaaucgcuugaacccaggaggcggaggcugcagugagcugagauugu

SEQ ID NO: 94823 - RNA, 64 nt, Human
cugaggcucagucaggagaaucgcuugaacuugggaggcggagguugcagugagcugagcucau

SEQ ID NO: 94824 - RNA, 64 nt, Human
cuuaaauggacuuuccuguggugguacccuuuaagaggcggaugaaagcuacuauaucaguuug

SEQ ID NO: 94825 - RNA, 64 nt, Human
gggagacugagacaugagaaucgcuugagccugggaggcggagguugcaaugagccaagaucgu

SEQ ID NO: 94826 - RNA, 64 nt, Human
caugcacccuccucuugcccaaguggggagcacagaggcggagaggaaucccuuaccacaccca

SEQ ID NO: 94827 - RNA, 64 nt, Human
gggaggcugaggcaggagaaucacuugaaccugggaggcggagguugcagugagcuaagaucac

SEQ ID NO: 94828 - RNA, 64 nt, Human
aggaggcugaggcaggagaauggcgugaacccgcgaggcggagcuugcaguaagcugagaucgc

SEQ ID NO: 94829 - RNA, 64 nt, Human
aaugcuggugcugucuaaagaccuggcauuaauggaggcggaggagcagccuuacgggagggau

SEQ ID NO: 94830 - RNA, 64 nt, Human
gccccauggaagacagugcucccagcugagguaggaggcggagguggggguggggguaguuuaa

SEQ ID NO: 94831 - RNA, 64 nt, Human
aggaggcugagacaggagaaucgcuugaacccuagaggcggaguuugcagugagccgagauagu

SEQ ID NO: 94832 - RNA, 64 nt, Human
gaaaauggaaaagccauuguauaaauuuuuuuuugaggcggagucuugcucuauuggccaggcu

SEQ ID NO: 94833 - RNA, 64 nt, Human
gcucacgcuugugaucccagcacuuugggagacugaggcggaucaccugaggucaggaguucua

SEQ ID NO: 94834 - RNA, 64 nt, Human
gggaggcugaggcaggagaaucgcuugaaccugggaggcggaaguugcagugagccgagauugc

SEQ ID NO: 94835 - RNA, 64 nt, Human
gggaggcugaggcacgagaaucacuugaaccugggaggcggagguugcagugagccgagaucgc

SEQ ID NO: 94836 - RNA, 64 nt, Human
uccuuaucugaguuaucacaguucaugaaucuaagaggcggaacucuacaucauuaguaagagg

SEQ ID NO: 94837 - RNA, 64 nt, Human
gcaaggcugaggcaggagaaucgcuugaaccugggaggcggagguugcagugagccaagauugc

SEQ ID NO: 94838 - RNA, 64 nt, Human
gguaggcugaggcaggagaaucgcuugaacccaggaggcggagguugcagugagacgagauugu

SEQ ID NO: 94839 - RNA, 64 nt, Human
gcgaggcugaggcaggagaauggcgugaauccgggaggcggagcuugcagcgagccaagaucgc

SEQ ID NO: 94840 - RNA, 64 nt, Human
cucggcccaaggcaggagaaucucuugaagccaggaggcggaaguuguggugagccgagaucgc

SEQ ID NO: 94841 - RNA, 64 nt, Human
aggaggcugaggcaggagaaucacaucaaccugggaggcggagguugcagugagcuuagaucau

SEQ ID NO: 94842 - RNA, 64 nt, Human
aagaauucucucuucuggaaucgcuugaacccaggaggcggagguugcaguaagccaaggucau

SEQ ID NO: 94843 - RNA, 64 nt, Human
gggaggcugagacaggagaaucgcuugaaccugggaggcggagguugcagugagccaagaucuc

SEQ ID NO: 94844 - RNA, 64 nt, Human
uacucucucuuugcuuucacuaucccagggaugggaggcggaggguagagaugaacucacugag

SEQ ID NO: 94845 - RNA, 64 nt, Human
uggaggcugaggcaggagaaucaauugaacccgggaggcggagcuuacagugagcugagauugc

SEQ ID NO: 94846 - RNA, 64 nt, Human
cagaccaccugccagccaucacaaggggaacgcagaggcggaaaccuugcagcauuuuuauuua

SEQ ID NO: 94847 - RNA, 64 nt, Human
gggaugcugaggcaggagaaucgcuugaauaugagaggcggagccaagaugaugccauugcacu

SEQ ID NO: 94848 - RNA, 64 nt, Human
cagcuacuuggaauuggaaaucgccugaacccaggaggcggagguugcagggagggagacugca

SEQ ID NO: 94849 - RNA, 64 nt, Human
ggggcuuugugggaucagggcauugccugugacugaggcggagcccagcccuccagcgucugcc

SEQ ID NO: 94850 - RNA, 64 nt, Human
uggaggcugaggcaggggaaucgcuuaaacccaggaggcggagauugcagugagccaagguucc

SEQ ID NO: 94851 - RNA, 64 nt, Human
uagcagcucaugccuguaaucuccagcacuuugggaggcggaggcaggaggaucucuugaaguc

SEQ ID NO: 94852 - RNA, 64 nt, Human
gccacccucagcagccagauugcaacaccagggagaggcggaugcagagccccaccggugggaa

SEQ ID NO: 94853 - RNA, 64 nt, Human
guuuacgccuguaaucccagcacugugggaggccgaggcggauggaucaccugaggucgggaau

SEQ ID NO: 94854 - RNA, 64 nt, Human
gggaggcugaggcaggaaaaucacuugaacccgggaggcggagguugcggugagccaagaucgc

SEQ ID NO: 94855 - RNA, 64 nt, Human
gggaggcugaggcaggagaaucgcuugaaucugggaggcggagauugcagugagccgagauccc

SEQ ID NO: 94856 - RNA, 64 nt, Human
gggaggcugaggcaggagaauugcuugaaccugggaggcggagguugcagugagccaagauugc

SEQ ID NO: 94857 - RNA, 64 nt, Human
gcuaucaagaguauuaauuuauugggaaugagcugaggcggauuuccccagagaaacaaaaagg

SEQ ID NO: 94858 - RNA, 64 nt, Human
gggaggcugaggcaggagaauugcuugaaccugggaggcggagguugcagugagccacugcacu

SEQ ID NO: 94859 - RNA, 64 nt, Human
gggaggcugaggcaggagaauggcgugaacccaggaggcggagcuugcagugagccgagauugu

SEQ ID NO: 94860 - RNA, 58 nt, Human
gggaggagaaggcggaguaagguggggugaggcggaucccgcgcgcaguuccagcagg

SEQ ID NO: 94861 - RNA, 64 nt, Human
gggaggcugaggcaggagaauugcuugaacccaggaggcggagguaguggugagcaaagaucgu

SEQ ID NO: 94862 - RNA, 64 nt, Human
gggaggcuaaagcaggagaauugcuugaaccugggaggcggagguuguggugagccgagaucgc

SEQ ID NO: 94863 - RNA, 64 nt, Human
gcccgcggugaucccagccagggccccgagcgcagaggcggagcugugcucagcacaggccugg

SEQ ID NO: 94864 - RNA, 64 nt, Human
ggacagagcucagaggcccccgagguguguguaggaggcggaggcccgcagagcacagagcagg

SEQ ID NO: 94865 - RNA, 64 nt, Human
gggcuugggggugggggucgaaacaguacuggaagaggcggagggcggcuccuagcuccgugga

SEQ ID NO: 94866 - RNA, 64 nt, Human
ccagcugccgcaucaucggccaccaagggcacaagaggcggaggcuccagucccugcugggcug

SEQ ID NO: 94867 - RNA, 64 nt, Human
gcgauggcugucgccuguaaugccagcgcuuugggaggcggaggcaggaggaucgcucaagccc

SEQ ID NO: 94868 - RNA, 64 nt, Human
gggaggcugaggcaggagaauggcgugaacccaggaggcggagcuugcagugagccaagaucgc

SEQ ID NO: 94869 - RNA, 64 nt, Human
auauuccugacaaaaguuccauauagacaccaaggaggcggaggcgcuccucccugccucagug

SEQ ID NO: 94870 - RNA, 64 nt, Human
augguggcucacgccuguaaccccagcacuuugggaggcggagacgggcagauaaccugagguc

SEQ ID NO: 94871 - RNA, 64 nt, Human
gggaggcugaggcaggagaaucucuugaacccaggaggcggagguugcagugagccgagaucgc

SEQ ID NO: 94872 - RNA, 64 nt, Human
gcacaacugccuggaaggcagguugcgagaaggagaggcggauggcaugagcagcaagggggac

SEQ ID NO: 94873 - RNA, 64 nt, Human
gggaggcugaggcaggagaauugauugaaccugggaggcggagguugcagugagccaagaucac

SEQ ID NO: 94874 - RNA, 64 nt, Human
ggcaggcugaggcaguagaaucgcuugaaccugggaggcggagauugcagugaaccaagaucgg

SEQ ID NO: 94875 - RNA, 64 nt, Human
aggaggcugaggcaggagaauugcuugaacccgggaggcggagguugcaguuagcugagauugc

SEQ ID NO: 94876 - RNA, 64 nt, Human
gggaggcugaggcaggagaauggcgugaacccgggaggcggagcuugcagugagccgagaucgc

SEQ ID NO: 94877 - RNA, 64 nt, Human
aggaggcugaggcaggagaauugcuugaacccaggaggcggagguugcacugagccgagaucac

SEQ ID NO: 94878 - RNA, 64 nt, Human
cagaggcugaggcaagagaaucacuugaacccgggaggcggagguuucagugagccgagauugc

SEQ ID NO: 94879 - RNA, 64 nt, Human
ucguagcugaggcaggagaaucgccugaacccaggaggcggagcuugcagugagccgagaucgu

SEQ ID NO: 94880 - RNA, 64 nt, Human
gggaggcugaggcaggagaaucgcuugaaccugagaggcggagguugcagugagccaaaauugc

SEQ ID NO: 94881 - RNA, 64 nt, Human
gcucacgccuguaaucccagcacuuugggaggccgaggcggaucauaaggucaggagaucaaga

SEQ ID NO: 94882 - RNA, 64 nt, Human
gcauguggaagggcacacagcagcaggcagggaggaggcggagguggcaaauaaaccugggcaa

SEQ ID NO: 94883 - RNA, 64 nt, Human
aaugcauuaagaauauucacaacauugaacccaggaggcggagcuugcagugagccgagauugc

SEQ ID NO: 94884 - RNA, 64 nt, Human
gggaggcugaggcaggagaaugacgugaacccaggaggcggagcuugcagugagccgagaucgc

SEQ ID NO: 94885 - RNA, 64 nt, Human
gagagguguccuccugaccacccauaaccuggcugaggcggaagccuugugugaccguguggcc

SEQ ID NO: 94886 - RNA, 64 nt, Human
gggaggcugaggcaggagaauggccugaacccgggaggcggagcuugcagugagccgagaucgc

SEQ ID NO: 94887 - RNA, 64 nt, Human
aaaagauaaaaagcccaaccgauguggggauagagaggcggaagagcagucaggcuugaggagc

SEQ ID NO: 94888 - RNA, 64 nt, Human
aggagggaggguggcuggaguugucacugcagucgaggcggagucagggcugugggaccucagc

SEQ ID NO: 94889 - RNA, 64 nt, Human
gggaggcugaggcaggggaauugcuugaacccgggaggcggaguuugccagccuggcaacagaa

SEQ ID NO: 94890 - RNA, 64 nt, Human
cagcuccgaggccgacgagauggccaaggcgcuggaggcggagcucaacgaccucaugugagcg

SEQ ID NO: 94891 - RNA, 64 nt, Human
cugaggcugaggcaggagaaucccuugagcccgggaggcggagguugcagugagccaagaucau

SEQ ID NO: 94892 - RNA, 64 nt, Human
aggaggcugaggcaggagaaucgcuugaauccaggaggcggagguugcagugagccgagauugc

SEQ ID NO: 94893 - RNA, 64 nt, Human
gagacccccagauaaccauaacagggaagcaggggaggcggaaaaauagaguuugagaaacuuu

SEQ ID NO: 94894 - RNA, 64 nt, Human
cuggccgggaccccgagccuggcuccaaacccucgaggcggaucuuuggacagaagcagcucuu

SEQ ID NO: 94895 - RNA, 64 nt, Human
gccuggguuagggaggccuuugccuuguuaccuagaggcggagggacugaagccauugcguucc

SEQ ID NO: 94896 - RNA, 64 nt, Human
gggaggcugagucaggagaaucgcuugaaccugggaggcggagguugcggucagcugagauggu

SEQ ID NO: 94897 - RNA, 64 nt, Human
gggaggcugaagcagaagaaucgcuugaacccgggaggcggagguuacagugagcugagauugu

SEQ ID NO: 94898 - RNA, 64 nt, Human
aggaggcugaggcaggagaauggcgugaacccgggaggcggagcuugcagugagccgagaucgc

SEQ ID NO: 94899 - RNA, 64 nt, Human
gugcacaccaguauucccagcuacucuggaggcugaggcggaggcaggauugcuugauaugagg

SEQ ID NO: 94900 - RNA, 64 nt, Human
gggaggcugaggcagaagaaucgcuugaacccaggaggcggagguugcagugagcucagauugc

SEQ ID NO: 94901 - RNA, 64 nt, Human
uugagccuuuggacuucucuccaagccccugugggaggcggacagcagugaccaccuccccuuc

SEQ ID NO: 94902 - RNA, 64 nt, Human
gggaggcugaggcaagagaaucacuugaacccaggaggcggagguugcagugagccaagauggu

SEQ ID NO: 94903 - RNA, 64 nt, Human
ggcuggugcaguagcuaccgccugacagccccuagaggcggacacacagcgacccccaucccug

SEQ ID NO: 94904 - RNA, 64 nt, Human
cgggugccuguccuugcccagcgccaccaggcuggaggcggagugggaggagcuggagccaggc

SEQ ID NO: 94905 - RNA, 64 nt, Human
gggaggcugaggcaggagaauggcgugaacuugggaggcggagcuugcggugagccaagaucgu

SEQ ID NO: 94906 - RNA, 64 nt, Human
aggaggcugaggcaagagaaucucuugaaccugagaggcggagguugcagugagccaagaucgc

SEQ ID NO: 94907 - RNA, 64 nt, Human
gaggcugaggcaggauaauuuugcuuaaacccgggaggcggagguugcagugagccgagaucac

SEQ ID NO: 94908 - RNA, 64 nt, Human
gcucaggccuguaaucucagcacuuugggaggccgaggcggaaggaaggcuugaggccaggagu

SEQ ID NO: 94909 - RNA, 64 nt, Human
aggaggcugaggcaggauaaucacuugaauccgggaggcggagguugcggugagccaagaucgc

SEQ ID NO: 94910 - RNA, 64 nt, Human
gagaggcugaggcaggagaauggcgugaacccgggaggcggagcuugcagugagccgagaucac

SEQ ID NO: 94911 - RNA, 64 nt, Human
gggaggcugaugcaugagaauugcuugaacccaggaggcggagguugcagugagcugagaucac

SEQ ID NO: 94912 - RNA, 64 nt, Human
gggaggcuaaggcaggagaaucacuugaauccaggaggcggaguuuguggugaguugagaucgc

SEQ ID NO: 94913 - RNA, 64 nt, Human
cgggaggcugaggcagagaauugcuugaauccgggaggcggagguggcggugagccgagauuga

SEQ ID NO: 94914 - RNA, 64 nt, Human
gggaggcugaggcaggagaauggcaugaaccugggaggcggagcuugcagugagccgagauugc

SEQ ID NO: 94915 - RNA, 64 nt, Human
ugggaggcugaggcaggagagugcuugaacccaggaggcggagguuguggugagccaagaucau

SEQ ID NO: 94916 - RNA, 64 nt, Human
aggaggcugaggcaggagaaucacuugaacccaggaggcggagguugcagugagccaagaucgu

SEQ ID NO: 94917 - RNA, 64 nt, Human
gggaggcugaggcaggagaaucacuugaaccugggaggcggagguugcagugagcgagaucaug

SEQ ID NO: 94918 - RNA, 64 nt, Human
cccuuuuuguuggggguggggugggggcagaggagaggcggauacagaaacuugugagaaugug

SEQ ID NO: 94919 - RNA, 64 nt, Human
gggaggcugaggcaggagaauggcgugaaccugggaggcggagcuugcagugagccaagaucgc

SEQ ID NO: 94920 - RNA, 64 nt, Human
gcgguggcucaugccuguaauaccagcacuuugggaggcggaggcgggcagaucgcgaggucag

SEQ ID NO: 94921 - RNA, 64 nt, Human
caacaauggauugaucagggcuacucagaaggcugaggcggaaggauugcuugaggccaggagu

SEQ ID NO: 94922 - RNA, 64 nt, Human
caggaggcugagguaggagaaucauugaaccugggaggcggagguugcagugagccgagauugc

SEQ ID NO: 94923 - RNA, 64 nt, Human
gggaggcugaggcacgagaaucacuugaaccugggaggcggagguugcagugagucgagauaac

SEQ ID NO: 94924 - RNA, 64 nt, Human
gggaggcugaagcaggagaggugcuggaaccugggaggcggagguugaagugagccgagauugc

SEQ ID NO: 94925 - RNA, 64 nt, Human
gggaggcugaagcaggagaauggcgugaaccugggaggcggagcuugcagugagccgagaucac

SEQ ID NO: 94926 - RNA, 64 nt, Human
uucacggugaagaaguacuaacgcauugaucucagaggcggaggccugcacuugaccauguagg

SEQ ID NO: 94927 - RNA, 64 nt, Human
gggaggcugaggcaggagaauggcuagaacccgggaggcggagguugccgugagucgagaucgc

SEQ ID NO: 94928 - RNA, 64 nt, Human
cgugaggacgcugcgggccagcggcuucagcucggaggcggacguccccacucugggugagugg

SEQ ID NO: 94929 - RNA, 64 nt, Human
ccaaccacacgcuguaccccauggucacgcgguggaggcggaacgaggauggagccaucugcag

SEQ ID NO: 94930 - RNA, 64 nt, Human
gggaggcugaggcaggagaaugguaugaaccagggaggcggagcuugcagugagccgagaucac

SEQ ID NO: 94931 - RNA, 64 nt, Human
gcucuuccgaauaaagugcugaacugugaggagagaggcggacugugaggcagccaggagccag

SEQ ID NO: 94932 - RNA, 64 nt, Human
ugaagacugaggcaggagaauggcgugaacccaggaggcggagcuugcagugagcugagaucac

SEQ ID NO: 94933 - RNA, 64 nt, Human
gguccccgcccgccagugccaaagcgcccggucggaggcggaaggaagugauauuuauuguucu

SEQ ID NO: 94934 - RNA, 64 nt, Human
aggguggcaggucuuugcagcucccggccagggugaggcggaagugagcccucauccugccacu

SEQ ID NO: 94935 - RNA, 64 nt, Human
ccaccgaagucuaaaggucccaguccaucuccuggaggcggacagauggccuggaaaccucugg

SEQ ID NO: 94936 - RNA, 64 nt, Human
cggaggcugaggcacaagaauugcuugaaccugggaggcggagguugcagugagcugagauaac

SEQ ID NO: 94937 - RNA, 64 nt, Human
agaucagcugaagcaggaccugcaggaagcacgcgaggcggagcgaagagccaagcagaagcuc

SEQ ID NO: 94938 - RNA, 64 nt, Human
gggaggcugaggcaggagaauaacuuaaacccgggaggcggagguuacagugagcugagaucgu

SEQ ID NO: 94939 - RNA, 64 nt, Human
ggaaggcugaggcaggagaaucacuugaacccaggaggcggagguugcggugagcugagauugc

SEQ ID NO: 94940 - RNA, 64 nt, Human
aggaggcugaggcaggaggaucacuugaaccugggaggcggagguugcagugagcugagauugc

SEQ ID NO: 94941 - RNA, 64 nt, Human
gggaggcugaggcacgagaaucacuugaacccaggaggcggagguugcagugagccaagaucgc

SEQ ID NO: 94942 - RNA, 64 nt, Human
aggaggcugaggcaggagaaucgcuuguacccaggaggcggagguuguagugagcugagaucgu

SEQ ID NO: 94943 - RNA, 64 nt, Human
cacagcugcccagagcagcccaggccguggugaggaggcggaggcaucggcggcggaggcucag

SEQ ID NO: 94944 - RNA, 64 nt, Human
gggaggcugaggcaggagaaucgcuugaacccgggaggcggagguugcagugagcuaagaucgc

SEQ ID NO: 94945 - RNA, 64 nt, Human
ggggugcugaggcaggagaaucaacugaacccgggaggcggaggcugcagugggccgggaucgu

SEQ ID NO: 94946 - RNA, 64 nt, Human
uagacacagcaugaaguuggggcacugguggugagaggcggaauccaaaaaaauucagaaauga

SEQ ID NO: 94947 - RNA, 64 nt, Human
ggaggcugaggcacgagacuugcuuaauaccugggaggcggagauugcagugagccgagaucac

SEQ ID NO: 94948 - RNA, 64 nt, Human
accggaccuuccuuccagggcuuuuccuuugggggaggcggagaggggagaagaaggaagggaa

SEQ ID NO: 94949 - RNA, 64 nt, Human
gggaggcugaggcaggagaauugcuugaacccgugaggcggagguuguagugagccaagaucgc

SEQ ID NO: 94950 - RNA, 64 nt, Human
gcacccgccuguaaucccagcuacucgggaggcugaggcggaagauucgcuugagcccaggagg

SEQ ID NO: 94951 - RNA, 64 nt, Human
gucguguggguccgugggugauaauugagagcgucagacccaggacuguucagggaggagcccc

SEQ ID NO: 94952 - RNA, 64 nt, Human
cagcagagccaggugagggggcgccugccagggccagacccagguggggcagccugaacccugc

SEQ ID NO: 94953 - RNA, 64 nt, Human
gccuucucacgcguuuccacaacauccccugggucagacccaccagguaccccguaggaauuuc

SEQ ID NO: 94954 - RNA, 64 nt, Human
acccaaguuguguuaauacuucaggucuguuucccagacccagaaagcuuuacagaaaaucauu

SEQ ID NO: 94955 - RNA, 64 nt, Human
cccaccucccucaagucugcgccccguccccagccagacccacucgcugccgggacccuuucac

SEQ ID NO: 94956 - RNA, 64 nt, Human
cuguggugagggcagggugcuccacagacaccuccagacccagccaagaacuacagggcggcgg

SEQ ID NO: 94957 - RNA, 64 nt, Human
gaaaccuugguacucgccccuuggccacagugcccagacccauguaacccacuggcuccugcau

SEQ ID NO: 94958 - RNA, 64 nt, Human
uuggcccagaggcucaggccgggacugagauggacagacccaggguggggugggguccaggucg

SEQ ID NO: 94959 - RNA, 64 nt, Human
ccccgcugcugagaugggcgcucccgacacagcgcagacccaccaggaggaaagaggcccagcu

SEQ ID NO: 94960 - RNA, 64 nt, Human
aaagccucuuauuuuucuagcgaacguauuucuccagacccagaggcccugaagccuccgugga

SEQ ID NO: 94961 - RNA, 64 nt, Human
aaugccuucccugagggaagaggcccuugagucacagacccacagacgucagggccagggagag

SEQ ID NO: 94962 - RNA, 64 nt, Human
gcggauuggugggggggacaccacugagcauauccagacccacuucgagagcaagacagagcug

SEQ ID NO: 94963 - RNA, 64 nt, Human
gggcuucuuuccaaacccccagcuccacaccccccagacccagcugguucuggaguucuaggac

SEQ ID NO: 94964 - RNA, 64 nt, Human
cccuggccuggggcacccacugcacacucagggccagacccaccauccuggacuggcgaggaag

SEQ ID NO: 94965 - RNA, 64 nt, Human
aaagccagccugccuuuuagcacuuggauacacacagacccacggagcucucuguguuuggccu

SEQ ID NO: 94966 - RNA, 64 nt, Human
ggaggcgccgccccacccggcccacuggcagacacagacccaggcagcaccaggccccagcucc

SEQ ID NO: 94967 - RNA, 64 nt, Human
gccugucagagcccugagggguguccaccggggacagacccaggggcgggcagagagggaagga

SEQ ID NO: 94968 - RNA, 64 nt, Human
aaggacuagauuuguuuaagaagaaaaaugaaaccagacccagaucaauauuuuaggauacuag

SEQ ID NO: 94969 - RNA, 64 nt, Human
ggugggagaggagguagauggggaagaaauaccccagacccaacaaaccuccagccagaaagcc

SEQ ID NO: 94970 - RNA, 64 nt, Human
cccagcaggcaggcacuguggcccuucuguccaccagacccaccuggagcccgcuucaagcucu

SEQ ID NO: 94971 - RNA, 64 nt, Human
gagcagcagccagcaccaccuacacaggagucuucagacccagagaaggacggugccaagggcc

SEQ ID NO: 94972 - RNA, 64 nt, Human
agggaagaaagacuucucaaggaggugccuccaucagacccaaaggacucaugggggcuagcug

SEQ ID NO: 94973 - RNA, 64 nt, Human
ggcacgaucacagugagagagcugcacucaccugcagacccagucagauggcuugucaguaucu

SEQ ID NO: 94974 - RNA, 64 nt, Human
uagggccucuucucauugaaagcucugcuuuauacagacccaagcauacacaccaggccgucac

SEQ ID NO: 94975 - RNA, 64 nt, Human
ccccaugucaacaaauuucaggcuaaggaugccccagacccagggcucuaaccuuguaugcggg

SEQ ID NO: 94976 - RNA, 64 nt, Human
gacaggaaggaagcacaaaagacaagcauugggucagacccauaaaccaccucccaaaggcugu

SEQ ID NO: 94977 - RNA, 64 nt, Human
uccaggacaugguaaaauguguuuuaauaacccccagacccaaaugaaaauuucaaagucaaua

SEQ ID NO: 94978 - RNA, 64 nt, Human
uaaacuaguuugggacuuggcuggcaugugcugccagacccaaagggauuguaucuggauuauu

SEQ ID NO: 94979 - RNA, 64 nt, Human
agucuuuauugcuuuaaaguucacuuugggcccacagacccaagagcuaauuuucugguuugug

SEQ ID NO: 94980 - RNA, 64 nt, Human
auugucuuaauuucgcuuugugcaucuuccccuccagacccaaugucucuguuuucuuuuccuu

SEQ ID NO: 94981 - RNA, 64 nt, Human
caaauucaggaagcauuucuuuagcccacaaguccagacccaggugcucuguauguuuguuuuu

SEQ ID NO: 94982 - RNA, 64 nt, Human
ccugccuguggccugucuguccuccucccuaauucagacccagccucaagaggaaagggaguaa

SEQ ID NO: 94983 - RNA, 53 nt, Human
augaagaccagcuaaauuaaacucagacccaaucaccucuaaaaaccaaaacc

SEQ ID NO: 94984 - RNA, 64 nt, Human
accucggcaggcuggacacacugcccagcacaggcagacccaccaggcuccuagguuuagcuuu

SEQ ID NO: 94985 - RNA, 64 nt, Human
caccgggcggggcaugucccugucccuucgcucccagacccaggcuagccgcuaccaggacucc

SEQ ID NO: 94986 - RNA, 64 nt, Human
ccugcagcacugaugucucuuuaccgauggguuccagacccaagguaguccuggcacugcccug

SEQ ID NO: 94987 - RNA, 64 nt, Human
aggccaaaaugaguacaaaaggucugucuuccaucagacccagugaugcugcgacucacacgcu

SEQ ID NO: 94988 - RNA, 64 nt, Human
cugggcugucuaccuuccucacuguaucuuugcccagacccaccugggccaguaggccccuguc

SEQ ID NO: 94989 - RNA, 64 nt, Human
aaauagcauuccaggcaaaggaacaaaacuggugcagacccagcugcuagaaggagcagagagc

SEQ ID NO: 94990 - RNA, 64 nt, Human
uagcaagaauggccauggaggcaaagccuucacccagacccaucccacucuccugugauccagg

SEQ ID NO: 94991 - RNA, 64 nt, Human
ggcauggucagguaacacuaguggcccagccccgcagacccacaagcccuacccgugcuggggc

SEQ ID NO: 94992 - RNA, 64 nt, Human
gagucagauuguggucaggugccucaguaaaucacagacccaggggcccugugguccaggguga

SEQ ID NO: 94993 - RNA, 64 nt, Human
cauuacucaguaccuccauacccagcccuauacgcagacccacagguggggaaacugaggcagg

SEQ ID NO: 94994 - RNA, 64 nt, Human
ggauggggugggguaccggauuucgguaucgucccagacccaagugagucacgcuuccugauuc

SEQ ID NO: 94995 - RNA, 64 nt, Human
caucuuugaauacuaugugggauucacccucuuccagacccaugacaacagagagcaucuagcc

SEQ ID NO: 94996 - RNA, 64 nt, Human
cagagguuggaggagagagguggagacuguggcucagacccaggugugcgggcauagcuggagc

SEQ ID NO: 94997 - RNA, 64 nt, Human
uaccaaguucaaauaaaauuuuuauaaucggauucagacccauaaccaaacuauguugguagua

SEQ ID NO: 94998 - RNA, 64 nt, Human
uacaaaaauacaauccuuguauuuuuucuuugaccagacccaaauuuuccccuuccccccucca

SEQ ID NO: 94999 - RNA, 64 nt, Human
acccaucugguauggaaaccugccggcuccaggccagacccaggagccaagagaaggcugaagc

SEQ ID NO: 95000 - RNA, 64 nt, Human
cuuucaccuccgcuggcucaccugggaaaucacgcagacccaguacauccuggagggcuacagc

SEQ ID NO: 95001 - RNA, 64 nt, Human
gaaaaguguccucuggcugaguggccacuaggcccagacccagcccagccugagccccaacaac

SEQ ID NO: 95002 - RNA, 64 nt, Human
ggagcaacuaacuaguuauuaugcacaucugcuccagacccagcucuuuaacuucaugguuuua

SEQ ID NO: 95003 - RNA, 64 nt, Human
caugguucugggcgccugauuuugcugugacucccagacccagccacuguuucugccacccugu

SEQ ID NO: 95004 - RNA, 64 nt, Human
gauuaccauucagcaugagauuugggcaggaacacagacccaaaccauaccacacacauuauca

SEQ ID NO: 95005 - RNA, 64 nt, Human
cguccaggccgagcgcagacuguuuaggacucagcagacccagcaagaggcaucugcccuuucc

SEQ ID NO: 95006 - RNA, 64 nt, Human
cagggcugggcugugcaccugccucccacugacccagacccacuuccuccagagaggccucucu

SEQ ID NO: 95007 - RNA, 64 nt, Human
auggacuuggaacucaggauggggcugucauagacagacccaccaguaggaacugucacagaau

SEQ ID NO: 95008 - RNA, 64 nt, Human
ucggaccucgcuguguuucacugccuccugcccacagacccaggccugccggcccggacccguc

SEQ ID NO: 95009 - RNA, 64 nt, Human
aacccucggagacccccuaagccccguuccuccgcagacccaggcccuccggaaggggugagug

SEQ ID NO: 95010 - RNA, 64 nt, Human
ucggaccagaccccccuccacagcugcccggccccagacccaucucuuggauugagggugugug

SEQ ID NO: 95011 - RNA, 64 nt, Human
cugaaauggacacacaaacacacacacgcacacacagacccacagcuuugaaugaucauguugu

SEQ ID NO: 95012 - RNA, 64 nt, Human
agcuucaugcccacggguucugccagccccagcacagacccaaacuggggcugggccucuaucc

SEQ ID NO: 95013 - RNA, 64 nt, Human
gccuggucauguacaacugaagcaaagaggaaagcagacccauggcucagguaagacaugguag

SEQ ID NO: 95014 - RNA, 64 nt, Human
ggcaggagccuagaggaggaaaaaggcugguggacagacccaggguggucuucaagccuggccc

SEQ ID NO: 95015 - RNA, 64 nt, Human
agauguugggugcagauguagaagcagccagucacagacccauucuaugcaauggacauuuauu

SEQ ID NO: 95016 - RNA, 64 nt, Human
gagcucgagaucuucauggguuagacuugcuggucagacccaggagcaccuguggcucacaccu

SEQ ID NO: 95017 - RNA, 64 nt, Human
uuuucuguccacaugcaaauuuuggauucuaucccagacccagguuuucuaguucagaagacua

SEQ ID NO: 95018 - RNA, 64 nt, Human
gcacaguaauacuuaaggcuuguacaagugucuucagacccacuuuuucauacacuugcuauau

SEQ ID NO: 95019 - RNA, 64 nt, Human
cacacacacacacacacacauauacacacacucacagacccacacacauacacacugucaugca

SEQ ID NO: 95020 - RNA, 64 nt, Human
cugccaagauccaucuaaacuggagugauguuagcagacccagcuuagaguucuucuuucuuuc

SEQ ID NO: 95021 - RNA, 64 nt, Human
gcaaugccagccccuucuugucuuggcacaugcacagacccaguccccucacgguagggcaccc

SEQ ID NO: 95022 - RNA, 64 nt, Human
ucaaguggaagaacuuguuugcuugaaaguaucucagacccaaggcaccucaggucucuuugcu

SEQ ID NO: 95023 - RNA, 64 nt, Human
cugacccaaauauguaauaaauaccauaguagcucagacccaaggagauauuuuucuaaaauca

SEQ ID NO: 95024 - RNA, 64 nt, Human
caucuagugcugaagucugagggcucugcagcaucagacccaccucuaagagaacuuucugaau

SEQ ID NO: 95025 - RNA, 64 nt, Human
ccucuaagaaccacagccacagagucaggcucugcagacccagagguaaggcugccuggcugcc

SEQ ID NO: 95026 - RNA, 64 nt, Human
cccugggcuugggguguucugguuuugagaacggcagacccaggucggagugaggaagcuucca

SEQ ID NO: 95027 - RNA, 64 nt, Human
gaagaaauagcaggagagaggacccauuagcuggcagacccagggggaagaaaggagggcugug

SEQ ID NO: 95028 - RNA, 64 nt, Human
gggaaaaacucuugcuaccuguauuacuugaucucagacccauaccugaugguucagucugucc

SEQ ID NO: 95029 - RNA, 64 nt, Human
gcaggucaaaaaggccaacacaaccauaagcagccagacccacaaggccagguccugugcuauc

SEQ ID NO: 95030 - RNA, 64 nt, Human
gcuggaaacugggauguagcuggggacgaaaggacagacccaagcguucucccugccugagaug

SEQ ID NO: 95031 - RNA, 64 nt, Human
gcucuccagaggaccaagaaauaccugugugacacagacccacuucaguguguacagcaaauuc

SEQ ID NO: 95032 - RNA, 64 nt, Human
acagccucugggauuggaggccagaggccagggucagacccagccaggacuccucauuucaucu

SEQ ID NO: 95033 - RNA, 64 nt, Human
cggcugcccuugggugacaccuccgagaggcagccagacccagagcccucugagccgccacucc

SEQ ID NO: 95034 - RNA, 64 nt, Human
cagguccccacucuccagggcccaucaagucacccagacccaugaaaugcccugccuccccauu

SEQ ID NO: 95035 - RNA, 64 nt, Human
ggggaacagcauuggacauuaauagggcacuuuucagacccauuuuuuaaagugcuagaaaaug

SEQ ID NO: 95036 - RNA, 64 nt, Human
ucgaugcaccgaugaaguaaacgccuuagugcuucagacccagcaagaaauuauugguaauauu

SEQ ID NO: 95037 - RNA, 64 nt, Human
ugucaagaggaaaagcuguaagaaaaugcugucacagacccaucccuguggcaucgucagcaga

SEQ ID NO: 95038 - RNA, 64 nt, Human
cuucuugucaccccaguucccuugguggcaaccccagacccaacccaugccccugacagaucua

SEQ ID NO: 95039 - RNA, 64 nt, Human
gaucauugcugaacucagagcuuucuucuauccccagacccacaugggagucucccagcaccuc

SEQ ID NO: 95040 - RNA, 64 nt, Human
augacaucugccugggcccugaccaauaaacccucagacccaggacccaggacccugcuguagu

SEQ ID NO: 95041 - RNA, 64 nt, Human
ccugggucuucuccuuggcggugcugucagcgcacagacccaugcgcauccccacccacaaccc

SEQ ID NO: 95042 - RNA, 64 nt, Human
ccaggcuuggcugccugacauaagcuaaaucucccagacccaccacuggcuaccgauaucuauu

SEQ ID NO: 95043 - RNA, 64 nt, Human
gcucaauucaguagcaacauagcuggcuuguucccagacccaggaaguauaagucauugacagu

SEQ ID NO: 95044 - RNA, 64 nt, Human
uaguaaggaaacugcaucacgauugaaagaggaacagacccaaaucugaaccucuuuugaguuu

SEQ ID NO: 95045 - RNA, 64 nt, Human
gcaguaauggcuuucuugucccuuaauuauucaccagacccagaaguuguacgcauuuaaugcu

SEQ ID NO: 95046 - RNA, 64 nt, Human
aacugaacauaccuguguaaucagcaucuagacccagacccagagcgucacaaauaucccccau

SEQ ID NO: 95047 - RNA, 64 nt, Human
gaggccccuacugaggccagccccgagccagccccagacccagccccgguggcugaagaggcug

SEQ ID NO: 95048 - RNA, 64 nt, Human
ccagggcuucccccaggaacuccauguaacagaacagacccaggacagggaaaagcagugcgga

SEQ ID NO: 95049 - RNA, 64 nt, Human
cguggagguguccccaccccuuccaccugucccccagacccaaagcucucuccccacccuaccu

SEQ ID NO: 95050 - RNA, 64 nt, Human
ggcacaaucauagcucacugcagcuuugaccucccagacccaagugauccucccaccucagccu

SEQ ID NO: 95051 - RNA, 64 nt, Human
uuguuuuuuacaagauauaacauaacccaggaaacagacccagcugagguuauucucaguggau

SEQ ID NO: 95052 - RNA, 64 nt, Human
cuuacucuaguuaaaaagaaaauaaaucucaugucagacccagaaaggaccaaucacuguccga

SEQ ID NO: 95053 - RNA, 64 nt, Human
uauugguuugauccugaaauguuaaacagguugucagacccaguaaaucacuucuucuuucucu

SEQ ID NO: 95054 - RNA, 64 nt, Human
gauuagugcuuuugcuagaugucaagaagcccuucagacccagacaaaucuaauauccugaggu

SEQ ID NO: 95055 - RNA, 64 nt, Human
agacccccugcaaccgcugcugcaagacacuggacagacccagcuuucgggacccucccgcgug

SEQ ID NO: 95056 - RNA, 64 nt, Human
gagcgcgagugagcaggggccaaggcgccagaugcagacccaggacuccggaaaagccguccgc

SEQ ID NO: 95057 - RNA, 64 nt, Human
gugaggagaaucccuaaacucgagguggugugcccagacccacagcccguguucccgaaguugc

SEQ ID NO: 95058 - RNA, 64 nt, Human
gaaagucacucaugaguaaacuauagaaaacguucagacccauccuguuaguaugucaaaucaa

SEQ ID NO: 95059 - RNA, 64 nt, Human
aaucugcuggccagcuauguccucuaggaaaugacagacccaaccaccagcaauaaacauuucc

SEQ ID NO: 95060 - RNA, 64 nt, Human
cugcagagcaaggaugaagccucaggaggggccucagacccagccccugcuccacacugugcca

SEQ ID NO: 95061 - RNA, 64 nt, Human
ucuccacucuggcuuguuuucagaaccuaaaaagcagacccaaguuuccuuucuccuccgccgc

SEQ ID NO: 95062 - RNA, 64 nt, Human
cugacaacccccuacacacacacacaggcauacucagacccacucaaagcugagaaugauccaa

SEQ ID NO: 95063 - RNA, 64 nt, Human
acaaacuuucugggccuccauccuaggaccugggcagacccacauggccugggcucugaaugcc

SEQ ID NO: 95064 - RNA, 64 nt, Human
ugugauuacguguauguuucuucuuucuuuuaagcagacccauaccuuuccagggucaaaguac

SEQ ID NO: 95065 - RNA, 64 nt, Human
cuugcgucccaugaggucuucccgcaaggccucucagacccagaugugacgggguguguggccc

SEQ ID NO: 95066 - RNA, 64 nt, Human
acagagaagacccugcuuaaagggccccacaccacagacccagacacagccaagggagagugcu

SEQ ID NO: 95067 - RNA, 64 nt, Human
ucugccagcuggugagggcagaggcagaccuggucagacccagcgccccuccucccugagggag

SEQ ID NO: 95068 - RNA, 64 nt, Human
caguugccuucacauagucauugucccuuacugccagacccagccagacuuugcccugacggag

SEQ ID NO: 95069 - RNA, 64 nt, Human
uggucuggaggauaaauaagaggucacccuccuccagacccaaagauagauuugugccuguguu

SEQ ID NO: 95070 - RNA, 64 nt, Human
gcauuggauauugaaaagaaaaccgaaacaaaaccagacccagcccuacacuuugguuugucau

SEQ ID NO: 95071 - RNA, 64 nt, Human
ugggguuuugagacuccccuuagagauagagaaacagacccaagaaaugugcucaauugcaaug

SEQ ID NO: 95072 - RNA, 64 nt, Human
cuucgggcuggaccguugcccucugagcagagaacagacccauuucugggagcugcccgagauc

SEQ ID NO: 95073 - RNA, 64 nt, Human
gguucccagcuggccugagcagggggccugccaccagacccacccacgcucugacgagaggcuu

SEQ ID NO: 95074 - RNA, 64 nt, Human
gagcagugaguugugaguggaaagaaggcuggugcagacccagcugccuuagacagauucccug

SEQ ID NO: 95075 - RNA, 64 nt, Human
cauucuucuccuguugguuauucugagucugacacagacccaugacaugucuuauaaagccucc

SEQ ID NO: 95076 - RNA, 64 nt, Human
cguuauguggcgggaggugaggcgggagguucagcagacccaugcagugugcugccagggcugg

SEQ ID NO: 95077 - RNA, 64 nt, Human
aguccuccccacucugggcuugugcacacugacccagacccacgucuuccccacccuucucucc

SEQ ID NO: 95078 - RNA, 64 nt, Human
uuugaugaauucuuccucuccuucccacaaaagacagacccagugagugaaucaggcaaagugc

SEQ ID NO: 95079 - RNA, 64 nt, Human
acagagcaggugcggggaagggaagggcccaggccagacccaucccaaacggaugaugggauga

SEQ ID NO: 95080 - RNA, 64 nt, Human
ccucuccuccggggggcaaggauggagucugcugcagacccauuggauuugcugcugguaacag

SEQ ID NO: 95081 - RNA, 53 nt, Human
cuccccaucaacuggccugagcucagacccagacguggugcuucucacacugg

SEQ ID NO: 95082 - RNA, 64 nt, Human
gcagcucagggaucuccgagucaggacggucggccagacccacgggguaacgggucuaaucgug

SEQ ID NO: 95083 - RNA, 64 nt, Human
ccaccucaaucuaccugccuagaguagcagcucccagacccaguucugggacugaagguuaacc

SEQ ID NO: 95084 - RNA, 64 nt, Human
gaggaaaauuauguuaugaagugcaggaacagcacagacccagacgaggggaugcagcccggag

SEQ ID NO: 95085 - RNA, 51 nt, Human
gaaauuaccacacucuguaaacagacccauugaauuaauaaggacugguga

SEQ ID NO: 95086 - RNA, 64 nt, Human
aaugucucaagacauaauauucaucucuugcugucagacccauucuauauucuaaaagcuucug

SEQ ID NO: 95087 - RNA, 64 nt, Human
caggcaagugcugacuucuuagagaauguguggccagacccagggaccuggaguguguuuggac

SEQ ID NO: 95088 - RNA, 64 nt, Human
cuaggucuugacccucauccagcaagggacucgacagacccaagggucccuggaacguagggag

SEQ ID NO: 95089 - RNA, 64 nt, Human
uggguguccuguauuucaucuggcaacccuacuucagacccagguguaagguacauggaugugc

SEQ ID NO: 95090 - RNA, 64 nt, Human
cggggugucuguauccugcaggaggacgccccuacagacccagcaacccaaguugccagcccgu

SEQ ID NO: 95091 - RNA, 64 nt, Human
gaaauucuuaggauuuuuuuaccagcuuuguuuacagacccaaauguaaauauuaaaaauaaau

SEQ ID NO: 95092 - RNA, 64 nt, Human
agcggaacaguuucuauuacccccucccugcccccagacccaugugauuucugcuuucuucuuu

SEQ ID NO: 95093 - RNA, 64 nt, Human
guucauugcacagaaguccuucuggcugcaggugcagacccaaacuuagauccccucaacuguc

SEQ ID NO: 95094 - RNA, 64 nt, Human
agaaccagugcuuccuucgucagcagcgccuccccagacccacgaggauacucacacugcacgc

SEQ ID NO: 95095 - RNA, 64 nt, Human
cuccccucuuacaccuacucagaugaggcagcagcagacccaucucgcggcggggguuuuguuc

SEQ ID NO: 95096 - RNA, 64 nt, Human
ucucuuucaaaaacaaguuuucagauuuuuauaacagacccauuuuguuuuaugaaacauguuc

SEQ ID NO: 95097 - RNA, 64 nt, Human
cagcggggcgugaugcagugugcacagcgaggagcagacccaggcagggccgccagggugacac

SEQ ID NO: 95098 - RNA, 64 nt, Human
uuuuguuuuuucuuuuuugcuguuagaauaauuucagacccaauaaggaauuucgauuauuaaa

SEQ ID NO: 95099 - RNA, 64 nt, Human
cuaggaagcaaggguuggaggcaaugugggaucucagacccaguagcugcccuuccugccugau

SEQ ID NO: 95100 - RNA, 64 nt, Human
ugccucuccagggacccuccucuccugcccaggacagacccagccagaaccacugcuaggaugg

SEQ ID NO: 95101 - RNA, 58 nt, Human
augauggugaugaauuauaagaaauaaacagacccaauucaucaacuggaaagcaauu

SEQ ID NO: 95102 - RNA, 64 nt, Human
gaaaaccacuaggaccaccaggagcacacaaccccagacccacgccggagggcaucccuccacc

SEQ ID NO: 95103 - RNA, 64 nt, Human
gagaauuaaggaacauucuuugaaaugccucucucagacccaucuuggaggcugauuacuuacu

SEQ ID NO: 95104 - RNA, 64 nt, Human
uccagcauuuuauggcuccucccucccauguccucagacccagcaaaagcguagaggcagaauu

SEQ ID NO: 95105 - RNA, 64 nt, Human
gucccaauuggcuaggacugcaggcacacaccaccagacccagcuaauguaauuucuaucuaua

SEQ ID NO: 95106 - RNA, 64 nt, Human
gccccucggcuguuccuccccuguaggguuuggacagacccacccccagccuugcccagcuuuc

SEQ ID NO: 95107 - RNA, 64 nt, Human
guggagcagaacgggaaccaccugcagagguccccagacccaaagcaggacgggagacaacugc

SEQ ID NO: 95108 - RNA, 64 nt, Human
uuuugcugugaauauuggaaaugcuuaggaucuucagacccaauagcucuaauuuuaacauuuc

SEQ ID NO: 95109 - RNA, 64 nt, Human
agaagguucuuucauucaagaucaucauucuugacagacccauaaauauuuccuauaaagacug

SEQ ID NO: 95110 - RNA, 64 nt, Human
acagagccuugagagacccagcugcagaccaugccagacccacugaaaugaccaagacagguuc

SEQ ID NO: 95111 - RNA, 64 nt, Human
cucagcugccuucuaggacaccugugcagggucccagacccaggccccagagcagcccaggcca

SEQ ID NO: 95112 - RNA, 64 nt, Human
ugccugagggcaguacccuccauugggcacaguccagacccaagucaaagaugccccauuccuu

SEQ ID NO: 95113 - RNA, 64 nt, Human
cagaccccuuugagagacgccacucccugggacacagacccaggacccccgaggggagggcagg

SEQ ID NO: 95114 - RNA, 64 nt, Human
uaacgugcugcucaaggaccaagagcaauugcagcagacccagcagcagcagcagcagcacaaa

SEQ ID NO: 95115 - RNA, 64 nt, Human
cugcaaaggcgcagugcuucucuacagacuucuccagacccaccacaccgcagaagcgggacga

SEQ ID NO: 95116 - RNA, 64 nt, Human
ucuuuggcugaaauucuucaacuuggaaaugacacagacccacagaagguguucaaacacaacc

SEQ ID NO: 95117 - RNA, 64 nt, Human
gggcucugcccuuagucaugacaucucgcugagccagacccacucuguuccuuggaaccuagag

SEQ ID NO: 95118 - RNA, 64 nt, Human
gaaauuaaacacaaaugguaacauauuccaaaaccagacccaucuuguugccuauugugauaaa

SEQ ID NO: 95119 - RNA, 64 nt, Human
ccaugucggccucuaaccccaggccccgaggacccagacccaguggggaggcggacguuccagc

SEQ ID NO: 95120 - RNA, 64 nt, Human
gugaggggcuuccuuucugcagcugagaugcacgcagacccaucucccuugucaugcugggcag

SEQ ID NO: 95121 - RNA, 64 nt, Human
cuauggauuguuuaagaacuauuuuaaaguguuccagacccaaaaaggaaaaauaaaaaaaaag

SEQ ID NO: 95122 - RNA, 64 nt, Human
ggggagguggccauaaaggggcagagucuucuuucagacccaacucuuagagggcacaucacca

SEQ ID NO: 95123 - RNA, 64 nt, Human
cuugcccggggccacugguggcuccccagagccucagacccacacagcccagaggacgaggccu

SEQ ID NO: 95124 - RNA, 64 nt, Human
aggaugacagacagggacgaagcagagaccucuacagacccaagucaccaaguggagccuuuuu

SEQ ID NO: 95125 - RNA, 64 nt, Human
cuuucugacaaaggagccugcacauuugggugagcagacccaagcuguuuacagcucuuucuug

SEQ ID NO: 95126 - RNA, 64 nt, Human
ccggcucuuccgguagaaccgcuccccggccugacagacccagggagcugcagcuggagcccgu

SEQ ID NO: 95127 - RNA, 64 nt, Human
uaccacaccagcucagccacagcagagccaaucacagacccaccacacagcccagcagcccuuc

SEQ ID NO: 95128 - RNA, 64 nt, Human
ugagguccauucauuuuacagccccuguuacacacagacccacaggcagccgucugugccccgc

SEQ ID NO: 95129 - RNA, 64 nt, Human
cauaugcauguucuccugccaaggaaccuuuacacagacccaaacaaaaaaauaauaaucaaau

SEQ ID NO: 95130 - RNA, 64 nt, Human
ggggccaaacgaggaaggacacagacccaaaagccagacccaggucccagcgcgcuucugggcu

SEQ ID NO: 95131 - RNA, 64 nt, Human
aaugcggacaauuggggccaaacgaggaaggacacagacccaaaagccagacccaggucccagc

SEQ ID NO: 95132 - RNA, 64 nt, Human
uuucugcccaucccugaugaccaagaccucuucccagacccacagcugcaggggccaaguaaua

SEQ ID NO: 95133 - RNA, 64 nt, Human
uccccuccccacagccuuccucacccuuggcuggcagacccacuggaggucaggcacggaccag

SEQ ID NO: 95134 - RNA, 64 nt, Human
ucuugcuaaaccuguuucuggugccucccauccccagacccaccagacaccacacagcagacaa

SEQ ID NO: 95135 - RNA, 64 nt, Human
acguaggauuucccaucagccucuguccugugggcagacccaggcacacgugggcagggggccu

SEQ ID NO: 95136 - RNA, 64 nt, Human
cagcgucauccuugaacgcaggauccgggaccuucagacccagggaaagggugagggagacugg

SEQ ID NO: 95137 - RNA, 64 nt, Human
ugucgcccccuucaggcuaagucucaggcagggacagacccagaaagaacacagucugcccuca

SEQ ID NO: 95138 - RNA, 64 nt, Human
ucuguuuuuaaucauaaaaaucaugacaguuacucagacccaggcauuucaacagagcuaacac

SEQ ID NO: 95139 - RNA, 64 nt, Human
gacagugcccgguccccuugagggccaucacacccagacccaacggguugcagccuccugagca

SEQ ID NO: 95140 - RNA, 64 nt, Human
gacuacacaaugaaaacacaucuguuggggugaucagacccaacacccggccaugggggcuaca

SEQ ID NO: 95141 - RNA, 64 nt, Human
cacauccagcccccccacgucucccucauauacacagacccaggauuaugcugugagccugcag

SEQ ID NO: 95142 - RNA, 64 nt, Human
ucaggcccagccaaagcccccuccucagucuccacagacccacaugugagcagcccaggcccau

SEQ ID NO: 95143 - RNA, 64 nt, Human
agagguaggugcucccucaggaucaggugcccugcagacccagagccaguuccuauccccuaac

SEQ ID NO: 95144 - RNA, 64 nt, Human
aaguuuaaccugcgugucaucugccuggucaucucagacccaugaaauuaggcgccuuguuuga

SEQ ID NO: 95145 - RNA, 64 nt, Human
uccgagacccugccuggguucaccccccacaacccagacccagaaccgcucuccccuucccugc

SEQ ID NO: 95146 - RNA, 64 nt, Human
cacuuagaacaaaguaccuggcauugaagccucccagacccagccccuuuuccuccauugaugu

SEQ ID NO: 95147 - RNA, 64 nt, Human
cacggugcuccagccggcccugcagcaguacagccagacccaagaccuagguggccuccgugag

SEQ ID NO: 95148 - RNA, 64 nt, Human
auguugucuugugcuguuccacucuuggcuccagcagacccacugucccagaaaagccugaucc

SEQ ID NO: 95149 - RNA, 64 nt, Human
uaagucuucaucucagagacccugaguucccacucagacccacucagccaaaucucauggaaga

SEQ ID NO: 95150 - RNA, 64 nt, Human
cgugggugggagcccagguccucagugucucuggcagacccaucggcagcucugccaggugcuc

SEQ ID NO: 95151 - RNA, 64 nt, Human
acuguccucuguccuuggaccagaacccuggggucagacccaucuccuguagcuguccaucaca

SEQ ID NO: 95152 - RNA, 64 nt, Human
gcgacccgaaccagccccgugccagcccgguccccagacccaagccugaccccauccgagugga

SEQ ID NO: 95153 - RNA, 64 nt, Human
gccccucucccucaagccuaagacacuaagaccccagacccaaagccaaguccaccagaguggc

SEQ ID NO: 95154 - RNA, 64 nt, Human
ugggagguggcuauccuguggaccaccuggccuccagacccacacucacagucugugaaaaacu

SEQ ID NO: 95155 - RNA, 64 nt, Human
uguucuucccccuccuuaggccccagccugggcccagacccauccucccagccagguuucccuc

SEQ ID NO: 95156 - RNA, 64 nt, Human
agucugcuccugccgcccucugcccugccagagacagacccaugcgcugccugcccaccgugcc

SEQ ID NO: 95157 - RNA, 64 nt, Human
caaccauggcaagaaccagagguccaaagaggcccagacccagguccuugugcucaguccugcg

SEQ ID NO: 95158 - RNA, 64 nt, Human
aauaucuguugccccugcggccccagacaccagccagacccaggcugcaggccucccccaggag

SEQ ID NO: 95159 - RNA, 64 nt, Human
aaagagcauccucuggcaggugcucccaccaggucagacccaguccuggacuucaagagugagg

SEQ ID NO: 95160 - RNA, 64 nt, Human
gcagcacugacaaauguguuccuaagaagacauucagacccagguguuaugcaggauuacaucc

SEQ ID NO: 95161 - RNA, 56 nt, Human
cagccauaguugagcccugauugccacagacccagcacccagcaaaucccucucua

SEQ ID NO: 95162 - RNA, 64 nt, Human
gaguuguggugaggccaccaggcugaagucagcucagacccagaccucccugcuuaggccacuc

SEQ ID NO: 95163 - RNA, 64 nt, Human
gccugugcuuguguuugcugcuaauguccagcuacagacccagaggauaagccacugggcacug

SEQ ID NO: 95164 - RNA, 64 nt, Human
ggacacccgagcugcacguuccuauacggccccccagacccagcuguccgggccacagaccccc

SEQ ID NO: 95165 - RNA, 64 nt, Human
ggggguacugugcccaccacacaugauuaggccucagacccaacucugguccuggcuccacaac

SEQ ID NO: 95166 - RNA, 64 nt, Human
agagcaccacugaugaggcccuccuagcccauggcagacccagaccucuucucccccaggaauu

SEQ ID NO: 95167 - RNA, 64 nt, Human
agcugccgcagguccgugccauggggaaguucuucagacccagugguccugugacugcugagga

SEQ ID NO: 95168 - RNA, 64 nt, Human
auacugaaagcacaggggcagggacagaccagaccagacccaggagucuccaaagcacagagug

SEQ ID NO: 95169 - RNA, 64 nt, Human
auuccagcccuuugcccucucggucaggguuggccagacccagucacaggggcagugucacccu

SEQ ID NO: 95170 - RNA, 64 nt, Human
ggaagaaaacggugcauccacgcacacauggacacagacccacacauguuuacagaacuguugu

SEQ ID NO: 95171 - RNA, 64 nt, Human
gggcuaggcccuggugguguguggagcacccaggcagacccaguccugguugggaucacaccca

SEQ ID NO: 95172 - RNA, 64 nt, Human
aaaauugauuguuauuuacucccagauccucuugcagacccagaauuaucaggaacauagcucu

SEQ ID NO: 95173 - RNA, 64 nt, Human
aaaaaacuagugugaaguuuacaguuagaagaaacagacccaaaguugccagaagguaauaaau

SEQ ID NO: 95174 - RNA, 64 nt, Human
ggggaagaacuucaccagcucuucagguucaaagcagacccagcauacaaacaagagcugagcc

SEQ ID NO: 95175 - RNA, 64 nt, Human
ucccuacugccugagcaaaccugaggccucccggcagacccacccacccccuggggcugcucag

SEQ ID NO: 95176 - RNA, 64 nt, Human
ccaaagggcucaccuucacauuguuaguucaugacagacccaggugugcuucauuagagauaac

SEQ ID NO: 95177 - RNA, 64 nt, Human
ugaagaaucaagcucauaauaugauacacccagacagacccagaaaucuuuugauuuccccagc

SEQ ID NO: 95178 - RNA, 64 nt, Human
gagaaacaaauuugcugggagagggaaagacauucagacccacagaaaggaggcagcacacaga

SEQ ID NO: 95179 - RNA, 64 nt, Human
ugugugcccgggacccccgucuccaggggugccccagacccagagauuagccucccacuucggc

SEQ ID NO: 95180 - RNA, 64 nt, Human
ggccagccggcagugaggguuggacuggugucuucagacccaggaccucagacuucuggcucac

SEQ ID NO: 95181 - RNA, 64 nt, Human
gcuaguccaucccgcuagccccacuccagggacucagacccaucuccaaccaugagcaaugcca

SEQ ID NO: 95182 - RNA, 64 nt, Human
gaccugcaagacacauggccuugaggccuuugcacagacccaccuaagauaagguuggagugau

SEQ ID NO: 95183 - RNA, 64 nt, Human
agccacucccgggaccacggcaaaaggaaccacccagacccaccacccguacacccucagcaga

SEQ ID NO: 95184 - RNA, 64 nt, Human
gcaggggaugguguggucaagcccucgucuagagcagacccagcccagaccucugacacauuag

SEQ ID NO: 95185 - RNA, 64 nt, Human
gacacccacagcugcagcaggugaccuccccuuccagacccagccaugcugugauaccggcgga

SEQ ID NO: 95186 - RNA, 64 nt, Human
caaaauaauuuaguucuuccuguacuccagaguccagacccagccaagaaagggucaguuguuu

SEQ ID NO: 95187 - RNA, 64 nt, Human
ggcuagggcuagagcagacccggguaaguaaaggcagacccagggcuccucuagccucauaccc

SEQ ID NO: 95188 - RNA, 64 nt, Human
uaaaaccucaagagcauuuuuaagcccuuuucaucagacccagugaaaacuaaggauagauguu

SEQ ID NO: 95189 - RNA, 64 nt, Human
cuauaaagacuccuaauagcuuuuccuguuaaggcagacccaguaugaaauggggauuauuaua

SEQ ID NO: 95190 - RNA, 64 nt, Human
acccuacuucaaguacacuuccacaccaggaaaacagacccaaauuccauaaacagaacugacg

SEQ ID NO: 95191 - RNA, 64 nt, Human
cugaccuaugcucuaaaacaugaaugcuuuguuacagacccaagcuguccauuucugugauggg

SEQ ID NO: 95192 - RNA, 64 nt, Human
ggucauacggcuagcgaguggcgggccugggguucagacccacagcugccucaagcaaacaggg

SEQ ID NO: 95193 - RNA, 64 nt, Human
ccccaaagacccuucaaccuccccagucccccaccagacccacccucucccugaaucuacccac

SEQ ID NO: 95194 - RNA, 64 nt, Human
ucacuucucaggagcaggaacagccaggggaccucagacccaggguauuuucauaccagacuau

SEQ ID NO: 95195 - RNA, 64 nt, Human
ucaucagggcccucugcacuccacaugaugaggucagacccacacggugcaaaucuuuggguca

SEQ ID NO: 95196 - RNA, 64 nt, Human
gugucucccaugcacauccagcguuucucagaagcagacccacccuuaaguugacaggauugau

SEQ ID NO: 95197 - RNA, 64 nt, Human
cuguguuggacccauaguagaauuuuccaggucacagacccaagcuuccauggguuguuacugu

SEQ ID NO: 95198 - RNA, 64 nt, Human
cacgugcucagccacccucuggcucagcggggcccagacccaccucggcacggacaccccuguc

SEQ ID NO: 95199 - RNA, 64 nt, Human
gcuggcuggcuggacaggcgggugugaggaguugcagacccaaacccacgugcauuuugggaca

SEQ ID NO: 95200 - RNA, 64 nt, Human
gaagaaucaaucuucaacagauaaucuuuaaguacagacccaggaauaucagaucugaaguggc

SEQ ID NO: 95201 - RNA, 64 nt, Human
cuuauaauguuucagggcucaacuuuuuaaaauccagacccaguguuaaaaccauuuauuccuu

SEQ ID NO: 95202 - RNA, 64 nt, Human
guacuacagauguaacucauuuguauauugcagacagacccaaaguggcacugaauuuucuugc

SEQ ID NO: 95203 - RNA, 64 nt, Human
cacugaaagagcgugggaagguggagggugucaccagacccacacagagcaagggagauuaagg

SEQ ID NO: 95204 - RNA, 64 nt, Human
gaggaggaggaggaaccccucgucccccuaggagcagacccaagcuuguggcaccaggcaucug

SEQ ID NO: 95205 - RNA, 64 nt, Human
ccugcaggacccuguccugcagucccacacugugcagacccagucccacacuguggccaggccu

SEQ ID NO: 95206 - RNA, 64 nt, Human
augccagauagaaaguugcgggcaacacuuuucucagacccaccauguccccaacucagacuua

SEQ ID NO: 95207 - RNA, 64 nt, Human
ggggcgggaaggaggggcaaggucuuucaggaaccagacccaacaggcccuucuguagccuccc

SEQ ID NO: 95208 - RNA, 64 nt, Human
uucuugccuccguguguaagcuccuuguacaacccagacccaucuuguauuuuguggcccagaa

SEQ ID NO: 95209 - RNA, 64 nt, Human
ucucuuugaguacuaccggggcuucacacucuuccagacccacgaaaaccgagagcaccuggug

SEQ ID NO: 95210 - RNA, 64 nt, Human
ggaggagaguugaggcuuuucuuaggugcauacacagacccaggugaacacgcugacugugaac

SEQ ID NO: 95211 - RNA, 64 nt, Human
uggagggggucagacagacgggagaguccagaaacagacccagggcuacaggaauuuaguauau

SEQ ID NO: 95212 - RNA, 64 nt, Human
ggaauccuagggggcuccaugacaccuucccccccagacccagacuugggccguugcucugaca

SEQ ID NO: 95213 - RNA, 64 nt, Human
cuagacauccucgagaggcagggcccaauccuuccagacccaccagcuggaaaagugaaggaag

SEQ ID NO: 95214 - RNA, 64 nt, Human
guuacccagggcuccagggagcccacagcagcaucagacccauccaggggcuacagggccugcc

SEQ ID NO: 95215 - RNA, 64 nt, Human
uuagugcaacugucucaacgaugcuguguggcuucagacccaaacaaggcccugaggaaggaga

SEQ ID NO: 95216 - RNA, 64 nt, Human
ggcuuggagguguucuggacaguggggagggcuccagacccaaccuggucacagaagagccucu

SEQ ID NO: 95217 - RNA, 64 nt, Human
aaccaaaacuccccaccugaagcugagcccagcccagacccagcugcucccggggacaugugcu

SEQ ID NO: 95218 - RNA, 64 nt, Human
ccucucccuagguccaaaugcccuagucacauggcagacccacggccuggcccacuguauaaaa

SEQ ID NO: 95219 - RNA, 64 nt, Human
ggccggggagcacaggugugggagcuggugaccccagacccagaauucucagggcucuaccccc

SEQ ID NO: 95220 - RNA, 64 nt, Human
ugaagauuucaccuguuuacuuaggguaucuacccagacccaucgauucugaguucgggagaug

SEQ ID NO: 95221 - RNA, 64 nt, Human
gcugaaguagggucugagagaacccuggcaucagcagacccagggugcuucugucuccugcaga

SEQ ID NO: 95222 - RNA, 64 nt, Human
uauuuaaagaauugcugacuaacuuucagguaaccagacccaucucaaagaaccaagaaaaggc

SEQ ID NO: 95223 - RNA, 64 nt, Human
ccucucuguaagggcagugugagggacugcugugcagacccaagcaaucccaaccuggugcuag

SEQ ID NO: 95224 - RNA, 64 nt, Human
gaggacgacuaggggacucgagagaggcgggccccagacccaugugcugggaaaugcagaaauc

SEQ ID NO: 95225 - RNA, 64 nt, Human
accucgaguuucugguaagacugcugguugacaucagacccaacccaugaaggcuggaaggcag

SEQ ID NO: 95226 - RNA, 64 nt, Human
agcaggcaugagcugggcuguggugcagagcaagcagacccagccacacugcucaaaggucccu

SEQ ID NO: 95227 - RNA, 64 nt, Human
cuuuucccagcaccaugccuguggaggggacagucagacccagagguccuuuacguguggaugg

SEQ ID NO: 95228 - RNA, 64 nt, Human
aggcggggaugcucccacgccacgugcacacacacagacccacauguggguggggggcacccuc

SEQ ID NO: 95229 - RNA, 64 nt, Human
ggggagacaccccaccucccuccuccauggggcacagacccaacacaaggcggggaugcuccca

SEQ ID NO: 95230 - RNA, 64 nt, Human
agcugagagacagccggcagggaaucggaacccucagacccacagccgcaaggcacuggauucu

SEQ ID NO: 95231 - RNA, 64 nt, Human
gagacaguauuucuuucugucugucccuuuggcccagacccagccugaccaacgaugagcauuu

SEQ ID NO: 95232 - RNA, 64 nt, Human
gggaucuuucagccuuuaugguauuacguagaggcagacccaugugcugcuguugcaaagaggg

SEQ ID NO: 95233 - RNA, 64 nt, Human
cacuccauccccugcuccaggcucacucccaaaacagacccaggcagccccacccccacggcag

SEQ ID NO: 95234 - RNA, 64 nt, Human
gggcuugggguugguucuggguggugaaccggggcagacccagcuaauggauuaaaaaacugcc

SEQ ID NO: 95235 - RNA, 64 nt, Human
guuguuguggaagcauguagacugugccagaggccagacccacgggcucaugcaccccugagcc

SEQ ID NO: 95236 - RNA, 64 nt, Human
ccccuccuuagggggugggcgaggagccucugggcagacccaagaaccauggggacuggggugg

SEQ ID NO: 95237 - RNA, 64 nt, Human
auagcugcugcuuuuucuugguccuuggggcuggcagacccauagaccauggccuguuaggagg

SEQ ID NO: 95238 - RNA, 64 nt, Human
agugagaagcuggaggcuccaggacuccacuggacagacccaggucuuccagaccugcuuccug

SEQ ID NO: 95239 - RNA, 64 nt, Human
gaaugagagucacagucaccuggaagaaaguauccagacccaaccuguuagcuacccucaccag

SEQ ID NO: 95240 - RNA, 64 nt, Human
gaggcucggcuuggauuauucugcagguucaucucagacccaccuuucagccuuaagcagccac

SEQ ID NO: 95241 - RNA, 64 nt, Human
gauagcugaugccacagagccuaugggcaaaugccagacccaggguuagacacaaggaccugaa

SEQ ID NO: 95242 - RNA, 64 nt, Human
gugggguagcagauggaguaauggucacgagguccagacccacucccaaagcucagacuugcca

SEQ ID NO: 95243 - RNA, 64 nt, Human
ugucuacgggggcacuuggaggaccuggcgugcucagacccaacagcaaaggaacuagaaagaa

SEQ ID NO: 95244 - RNA, 64 nt, Human
ggaaaaaaauggcuggauagaacugggacaaacacagacccaucuuuaggggucuggauuuugu

SEQ ID NO: 95245 - RNA, 64 nt, Human
gcauccagcccugagacauguaggaaacaccuuucagacccaggcucugaagauucccagaagc

SEQ ID NO: 95246 - RNA, 64 nt, Human
cuggaaguuucugccucacucagaaugggcaggacagacccacugacuggacuucagagucugg

SEQ ID NO: 95247 - RNA, 64 nt, Human
cacagcccauggguggacucggcccccugggguucagacccagguccguucggccuagugauga

SEQ ID NO: 95248 - RNA, 64 nt, Human
cuccuuccgggcagaaacaacugaaaaugcacuucagacccacuuauuucugccacaucugagu

SEQ ID NO: 95249 - RNA, 64 nt, Human
ccagugagaacugaccugaguccccuuccaaacccagacccaccuccugccccaggcccacuga

SEQ ID NO: 95250 - RNA, 64 nt, Human
cgccucucauuccugaugucucaggcaacccuggcagacccagguccaacugcugggguccaag

SEQ ID NO: 95251 - RNA, 64 nt, Human
ggauccccgcccccaccugcccccaaugcacacacagacccaccgggggccaccugcccucccc

SEQ ID NO: 95252 - RNA, 64 nt, Human
ggguuuuaggaggaaggcuuggcuccugucuucccagacccaccaugccuggagaggucaggau

SEQ ID NO: 95253 - RNA, 64 nt, Human
cugggggcucccccauauucccaggcccagaagacagacccacagcccugcccuugucucugag

SEQ ID NO: 95254 - RNA, 64 nt, Human
uuucccaaggcaggugguguguugggggccccuucagacccaaagcuuuaggcaugauuccaac

SEQ ID NO: 95255 - RNA, 64 nt, Human
augggaagcucaauguugcucagugggugagauccagacccacuggugcaaugucuuaaauaca

SEQ ID NO: 95256 - RNA, 64 nt, Human
cccccauccugccucacccaugggugcugcaccccagacccauccugccacuucuaugucucug

SEQ ID NO: 95257 - RNA, 64 nt, Human
gaacugucaccagccgcacgcgugguaaaugacccagacccaacucgccuguggacggggaggc

SEQ ID NO: 95258 - RNA, 64 nt, Human
uaacuccuuugaugagcuuccuuauuaacccuuucagacccagucuguuggagccaugaaggaa

SEQ ID NO: 95259 - RNA, 64 nt, Human
gcccaaagcuuguaaauauggggauagucugggucagacccaucucucccuuacccaucuugcu

SEQ ID NO: 95260 - RNA, 64 nt, Human
ccacauuuggaggaaguucacauuuccuggcaugcagacccaaaacuggguucuggcucugccu

SEQ ID NO: 95261 - RNA, 64 nt, Human
aaggcauauguauaaccaaacuccaagugauaaccagacccaucucuccuccaccuugacaaaa

SEQ ID NO: 95262 - RNA, 64 nt, Human
gugauacccucaccuugggguaaugguccuaacccagacccagggucuggaagcuuaauguuga

SEQ ID NO: 95263 - RNA, 64 nt, Human
ccguccuccuuuucuaguuucugauguuuguaaccagacccagcugugucauuaaacagacccg

SEQ ID NO: 95264 - RNA, 64 nt, Human
ggugcuccaggucagcuccuucccauacacucugcagacccaacagucccgcauuagcucuagc

SEQ ID NO: 95265 - RNA, 64 nt, Human
agaguaacugacaaaccaccaaaaacugaaaccccagacccaccagaaagacaagugucuagca

SEQ ID NO: 95266 - RNA, 64 nt, Human
uuuagagaguugcuuuacguggccuguuucaacacagacccacccagagcccuccugcccuccu

SEQ ID NO: 95267 - RNA, 64 nt, Human
cuuggucccccacaaccugccccggccaggccugcagacccagacuccagccagaccugccuca

SEQ ID NO: 95268 - RNA, 64 nt, Human
cgcuagcccgcggcgccgcgacgucugcacggcccagacccaggauuccaaacuugugaacucg

SEQ ID NO: 95269 - RNA, 64 nt, Human
accucucagcaagugcuauccaggcugggccaaccagacccacaauuaacugagccucagugaa

SEQ ID NO: 95270 - RNA, 64 nt, Human
gaaacagacccggacagacagacacagccugaaacagacccagacaaacagacagacagacaca

SEQ ID NO: 95271 - RNA, 64 nt, Human
cccagacaaacagacagacagacacagccugaaacagacccagacagacagacagacagccuga

SEQ ID NO: 95272 - RNA, 64 nt, Human
aacagacccagacagacagacagacagccugaaacagacccagacacagccugaaacagauccg

SEQ ID NO: 95273 - RNA, 64 nt, Human
cagauccggacagacagacagaaacagccugaaacagacccagacagacagacagacacagccu

SEQ ID NO: 95274 - RNA, 64 nt, Human
gaaacagaccuagacagacagacacagauugaaacagacccagacaaacagacagacacagccu

SEQ ID NO: 95275 - RNA, 64 nt, Human
cagacccagacaaacagacagacacagccugaaacagacccagacacagccugaaacagacccg

SEQ ID NO: 95276 - RNA, 64 nt, Human
cagacccggacagacagacagacacagccugaaacagacccagacagacagacagacacagccu

SEQ ID NO: 95277 - RNA, 64 nt, Human
cagacccagacagacagacagacacagccugaaacagacccagacagacagaccgacgcagccu

SEQ ID NO: 95278 - RNA, 64 nt, Human
ucugcaacuucuucaauuccagaguuucugagaacagacccaaauucaauggcaugaccaagaa

SEQ ID NO: 95279 - RNA, 64 nt, Human
ggccggaucuuucuccgauaaaaccgucgcccuacagacccagcuguccccacgccucugucuu

SEQ ID NO: 95280 - RNA, 64 nt, Human
uaaggaauugacuucagcaggggugggaggcucccagacccagggcaguguggugggaggggug

SEQ ID NO: 95281 - RNA, 64 nt, Human
cccuucuccaggagccagggggugacuggagagacagacccacccccaagcagggcuccucucc

SEQ ID NO: 95282 - RNA, 64 nt, Human
ucagugaccaccaccacguucagguuucugaaugcagacccaccacgagggauggauuccaccc

SEQ ID NO: 95283 - RNA, 64 nt, Human
gugagugccaaaguccccugccccccaagccagccagacccagacauuagaagauggcuagaag

SEQ ID NO: 95284 - RNA, 64 nt, Human
ccuuccagacuuagcagaagaacaaacugaagaacagacccagccagagaagcagggauuccag

SEQ ID NO: 95285 - RNA, 64 nt, Human
auggagugagggccuauuuuccaacagcucuucgcagacccaagagcuuggcacauuuccgggu

SEQ ID NO: 95286 - RNA, 64 nt, Human
caaugacgaucccccaaagagcccgucugcaccccagacccagggccucaggccuccagcuccu

SEQ ID NO: 95287 - RNA, 64 nt, Human
guugcuacccaggcggccaagcuccagaccgugccagacccaggugccccagugccuuugucua

SEQ ID NO: 95288 - RNA, 64 nt, Human
uccguguuccucggcggacucugcugaccuccugcagacccaaaccacagccacaucccagcuu

SEQ ID NO: 95289 - RNA, 64 nt, Human
cccacugccuccucuccaguggucucccaggugccagacccaaaagcuuuuccuacagugauac

SEQ ID NO: 95290 - RNA, 64 nt, Human
aaugccacagucccccaacccuccacagagcccccagacccaccagaacuuccacagacgcccc

SEQ ID NO: 95291 - RNA, 64 nt, Human
cgugccccuugucgcgcgucucccauccugaucccagacccauuccuuagcuauuuaucccuuu

SEQ ID NO: 95292 - RNA, 64 nt, Human
aguccccugguuaagaaggcaagugggguuuaaacagacccacagucuacucaucaaaccaggu

SEQ ID NO: 95293 - RNA, 64 nt, Human
aagcaauaccuauuucugacugagucucccagcccagacccagggacccuuggccccaagcuca

SEQ ID NO: 95294 - RNA, 64 nt, Human
gccccucgagcaaaaaccucuggcgccuccaauccagacccaccacagcuggagggccaggccu

SEQ ID NO: 95295 - RNA, 64 nt, Human
ccuccaugccgaccucauccuaacuccacucacgcagacccaaccuaaccuccacuagcuccaa

SEQ ID NO: 95296 - RNA, 64 nt, Human
gaaggucuuacccccucuucuauuuauuaauuugcagacccagccccuccccuacuuuuugguc

SEQ ID NO: 95297 - RNA, 64 nt, Human
cuuugucauuccuuucucuuccuguacaucugagcagacccacuccagcuuucuggugucacag

SEQ ID NO: 95298 - RNA, 64 nt, Human
cccucccugauccaggguuccaccaccaggagggcagacccagccacauaccacaaccaccccc

SEQ ID NO: 95299 - RNA, 64 nt, Human
aggaaagcccagagggagggggcccucauuccuucagacccaguuuucccccacccuccuuacc

SEQ ID NO: 95300 - RNA, 64 nt, Human
cacccugcaccucauuccaacuccuaccgcgauacagacccacagagugccaucccugagagac

SEQ ID NO: 95301 - RNA, 64 nt, Human
ccuuaacgacauguuccugcugcagauaacuagccagacccaucccuuuauuucagcccauccc

SEQ ID NO: 95302 - RNA, 64 nt, Human
cucucugccccaaacucuuccccgggaagggggacagacccaccccagcccagggcccucaccc

SEQ ID NO: 95303 - RNA, 64 nt, Human
gacccagagguccaggucccagccccuccucccucagacccagcgguccaaugccaccuagacu

SEQ ID NO: 95304 - RNA, 64 nt, Human
acucagagguccaggcccccaaccccuccuuccccagacccagagguccaggucccagccccuc

SEQ ID NO: 95305 - RNA, 64 nt, Human
cccaggaguccagaccccccagccccuccucccucagacccagggguccaggcccccaaccccu

SEQ ID NO: 95306 - RNA, 64 nt, Human
ucccucagacccaggaguccagccccuccucccucagacccaggaguccagaccccccagcccc

SEQ ID NO: 95307 - RNA, 64 nt, Human
cccaggaguccagaccccccagccccuccucccucagacccaggaguccagccccuccucccuc

SEQ ID NO: 95308 - RNA, 64 nt, Human
aaccaaggguacagauccccagccccuccucccucagacccaggaguccagaccccccagcccc

SEQ ID NO: 95309 - RNA, 64 nt, Human
acccgggaguccaggcccccagccccuccucccucagacccaggagccccaguccccagcaucc

SEQ ID NO: 95310 - RNA, 64 nt, Human
gacccaggaguccaggccccagccccuccucccucagacccaggaguccaggcccccagccccu

SEQ ID NO: 95311 - RNA, 64 nt, Human
uucguguuaauuggccuuagacucucccuguccccagacccaggacgcauguguuuccuuuuuc

SEQ ID NO: 95312 - RNA, 64 nt, Human
acccaggauucccgggccccaguaccuccucccucagacccaggacuccaggcccccagccccu

SEQ ID NO: 95313 - RNA, 64 nt, Human
auccaggagucuaguccuccagcuccuccucccucagacccaggauucccgggccccaguaccu

SEQ ID NO: 95314 - RNA, 64 nt, Human
auaugcuuacgaguaagugaauccugauuauuuccagacccaccaccagaguggaucuuauuuu

SEQ ID NO: 95315 - RNA, 64 nt, Human
uuuuagaaucuuuuaaauacauucccugggccaacagacccacacacuuagccauugaaauguc

SEQ ID NO: 95316 - RNA, 64 nt, Human
uguuuuagcgcuggguuucccaaggugggagagacagacccagccuggagcuggccccuggccu

SEQ ID NO: 95317 - RNA, 64 nt, Human
guggcuuugggccucacgugcagacccugccaugcagacccaugccccccucccccaggcagcu

SEQ ID NO: 95318 - RNA, 64 nt, Human
uucacaauagggccucauggguguagccgcauggcagacccauggcuggcgcagcugccuguug

SEQ ID NO: 95319 - RNA, 64 nt, Human
aggugucuaucccaacuggucagggagagaagggcagacccauucucaaagaccaccaugucca

SEQ ID NO: 95320 - RNA, 64 nt, Human
ggagaagagaacauuccuccuggcuuaguuguagcagacccagaccugugcccagcuuuggucc

SEQ ID NO: 95321 - RNA, 64 nt, Human
ggagcauccuuagucccaccuguagcugaauccacagacccaaagccugcacaacccaaccucg

SEQ ID NO: 95322 - RNA, 64 nt, Human
ggccgacaaccagguuggaaaccaagacggagcucagacccaccacaucgccccagaggcuuuu

SEQ ID NO: 95323 - RNA, 64 nt, Human
augauggcugccugugggaccccagcuacucccccagacccaaguucugcagaacuaaccccca

SEQ ID NO: 95324 - RNA, 64 nt, Human
auaugcuuuaauuuauuuuucuucugcguguggucagacccaauuacacuguggcuaagacucu

SEQ ID NO: 95325 - RNA, 64 nt, Human
cagcuaucuguucaaacgucaccuguucccaccccagacccaaagagguugauucaguugccuu

SEQ ID NO: 95326 - RNA, 64 nt, Human
uacaacuccagugggaaagaaagagcuuuauuuacagacccauaaaaaucccaucagugucguc

SEQ ID NO: 95327 - RNA, 64 nt, Human
agucagaggacaggaugcacauuccuucaagauacagacccagauuguugggcaucuaguucuu

SEQ ID NO: 95328 - RNA, 64 nt, Human
uuggaacugacagcugugugaggccugcacuucucagacccagacuuagaacaaaaggaggagu

SEQ ID NO: 95329 - RNA, 64 nt, Human
ugcgggauucagcaccaggcucuucccaguaccccagacccacugugggucuucccgugggaug

SEQ ID NO: 95330 - RNA, 64 nt, Human
gaccgguccccgccuccuccgcugcccaaucucucagacccaccccaccugcaggcccagacca

SEQ ID NO: 95331 - RNA, 64 nt, Human
ucccacugccagcugacccucaguuccucaaacacagacccagggugcaugcccaucuccagcc

SEQ ID NO: 95332 - RNA, 64 nt, Human
ccagcagcugaaaggcacccagacuucaaggacccagacccacccuggggggcugcaagggcaa

SEQ ID NO: 95333 - RNA, 64 nt, Human
agguggaggagagugaggggagagcugcccggugcagacccaggacgagggcugcacuuggugu

SEQ ID NO: 95334 - RNA, 64 nt, Human
aaaugugauuauuuuccaagcucaguuggaccuccagacccaucacugaccauuugccuuaccu

SEQ ID NO: 95335 - RNA, 64 nt, Human
guuggauacaggagaagaaacagcggcuccacuacagacccagccccagguucaauguccuccg

SEQ ID NO: 95336 - RNA, 64 nt, Human
ucucugccugagagagcucagcacacacacagcucagacccacggacaggaccccgggacagaa

SEQ ID NO: 95337 - RNA, 64 nt, Human
ccugcuuuucuaggauguggccuuagagcaagaacagacccaacagccagcccuucauccucca

SEQ ID NO: 95338 - RNA, 64 nt, Human
acggggcuuuugucugaugcucugggauucuggccagacccaccccagggcacauguccugcgg

SEQ ID NO: 95339 - RNA, 64 nt, Human
gcuguaacccuccgugucgccucgggugcgaaaucagacccaccugacaccaucacgcggaggc

SEQ ID NO: 95340 - RNA, 64 nt, Human
ugaccucgaccuccugaucugaccugguucucaacagacccagugagcccuucacuccugagaa

SEQ ID NO: 95341 - RNA, 64 nt, Human
cacacggugcgcccgccgccagcuccucggaggccagacccaggauggcugcaggccagguuug

SEQ ID NO: 95342 - RNA, 64 nt, Human
caagacugcagccucuuccucccucagaucccaccagacccaccaggugccauaauaaagcgga

SEQ ID NO: 95343 - RNA, 64 nt, Human
uguuuugggggcagggguuaguucuucaggucggcagacccagagcacuugauaaagaacugua

SEQ ID NO: 95344 - RNA, 64 nt, Human
cgcugggagguguacacggaggucucuguaaaagcagacccaccucccagcgccgggaagcccg

SEQ ID NO: 95345 - RNA, 64 nt, Human
ccauuuugccucuccugucucccacccccugccccagacccaggagccccccugaggcuuugcc

SEQ ID NO: 95346 - RNA, 64 nt, Human
uggaugccugcugcaucuucccacaguggcuucacagacccacaagagaagcugauggggagua

SEQ ID NO: 95347 - RNA, 64 nt, Human
caggcggggagagauguguacauagguuuuaaagcagacccagagcucaugggggccuguguuc

SEQ ID NO: 95348 - RNA, 64 nt, Human
uuguuucccucauccucggcucccacacaggugacagacccagcagauagcuucucucugggaa

SEQ ID NO: 95349 - RNA, 64 nt, Human
uccaagucccucucugagccuuuauugaacuccccagacccacugcucuccuccuuuucccacc

SEQ ID NO: 95350 - RNA, 64 nt, Human
uguggaaauugccagccaggacuuugacaugaaacagacccagggcuaaauuuuggcucugugg

SEQ ID NO: 95351 - RNA, 64 nt, Human
ugacuucucuguuugaguugggaagccucaccuucagacccaguaacuguccgcagcugucugc

SEQ ID NO: 95352 - RNA, 64 nt, Human
acccggccccaaggcuacccaguauuuuaucguccagacccauggcagggccagcgggcaggac

SEQ ID NO: 95353 - RNA, 64 nt, Human
uagaaacacacaggaacagagaaaugguugaugucagacccagacauagaauguuggagcaaaa

SEQ ID NO: 95354 - RNA, 64 nt, Human
uggaaacccguagauacagagaaguggucgauuccagacccagacauagaauguuugaacaaag

SEQ ID NO: 95355 - RNA, 64 nt, Human
acuggccagcugcccccauaacuggcagcauucccagacccaggguacucuaauaggggcggcu

SEQ ID NO: 95356 - RNA, 64 nt, Human
cuugguguuauuauacaaaauaauuuuuaaucugcagacccacgaaaagggucucagggacucc

SEQ ID NO: 95357 - RNA, 64 nt, Human
ucuuuggagaacagaaagaagaaaggaaagaaaggaaccagaggcagagagacgaggauaccca

SEQ ID NO: 95358 - RNA, 64 nt, Human
cguaucaacgcuaugaacgcaaggcugugauauggaaccagaaggcugucugaacuuuugaaac

SEQ ID NO: 95359 - RNA, 64 nt, Human
ucaaucuaaaugcauucauucuaaaaaauuuuuugaaccagauaaauaaaauuuuuuuuugaca

SEQ ID NO: 95360 - RNA, 64 nt, Human
caugccgggagugaucugccagacauucuaauuugaaccagauaucucuggguagcuacaaagu

SEQ ID NO: 95361 - RNA, 64 nt, Human
acuuaacuuguguauugcauuccagcagaccacugaaccagacagcgaagccaagaucauuguu

SEQ ID NO: 95362 - RNA, 64 nt, Human
gagaaauuuaaagaaucggacagauggacgcagagaaccagagggcaaugugggaccuucucuu

SEQ ID NO: 95363 - RNA, 64 nt, Human
auucgcaccccuacuucacagaggaagaaaccuggaaccagagggggcgugccugccaagcuca

SEQ ID NO: 95364 - RNA, 64 nt, Human
gaacuccgugggaacuaaaggaagugggaacuuagaaccagacaguuuuccaaagauguuacaa

SEQ ID NO: 95365 - RNA, 64 nt, Human
gcaccagccaagccuuaacugccugccugacccugaaccagaacccagcugaacugccccucca

SEQ ID NO: 95366 - RNA, 64 nt, Human
ugaguuaugauaacaccagugggaauugcuggaggaaccagaggcacuuccaccuuggcuggga

SEQ ID NO: 95367 - RNA, 64 nt, Human
aucauauucccacuuaaaugauuagguuaauaaagaaccagauaauuaauuaguuacuuuuuaa

SEQ ID NO: 95368 - RNA, 64 nt, Human
ggcauaagcugaaucccaaauuugaguuugggaagaaccagagagaaauggaucccugagcucu

SEQ ID NO: 95369 - RNA, 64 nt, Human
uuguaacagaauauagcucuuaacugaaaauccagaaccagaaacauaaaucuugaguuucuuu

SEQ ID NO: 95370 - RNA, 64 nt, Human
augagaagaagugcaacugccuccugcucaaagugaaccagauucgcucugugacugagucccu

SEQ ID NO: 95371 - RNA, 64 nt, Human
acgaggccaagcagaugaucgccgucgccgacgagaaccagaaccaccaccuggagcccgagga

SEQ ID NO: 95372 - RNA, 64 nt, Human
cuuucuacccucugucaguccugggggugacugggaaccagagagguugagcagaauuccugga

SEQ ID NO: 95373 - RNA, 64 nt, Human
ggugcuggggguaggacugaggcagccccacugggaaccagacugcagccuggcccauggcugu

SEQ ID NO: 95374 - RNA, 58 nt, Human
ggaucgauacagauggauaaacugccaagaaccagauuuuuaaaaggccgcaaaaaau

SEQ ID NO: 95375 - RNA, 64 nt, Human
caggccuggaaaagaaccagaaggaggcugggcagaaccagaacaaccugcacuucugccaagg

SEQ ID NO: 95376 - RNA, 64 nt, Human
gaagagagccuggaaaagaaccaggccuggaaaagaaccagaaggaggcugggcagaaccagaa

SEQ ID NO: 95377 - RNA, 64 nt, Human
gguaggacccucaccgcugcguccagcagacacugaaccagaauuggaaacgugcuugaaacaa

SEQ ID NO: 95378 - RNA, 64 nt, Human
cccaaggccagaguccuuuguccuacaucucccugaaccagagugugcccugccccucaugcuc

SEQ ID NO: 95379 - RNA, 64 nt, Human
guuuuaaauucuucaaaaacucagauuuaacccagaaccagaguaaagucaccucuacuauuua

SEQ ID NO: 95380 - RNA, 64 nt, Human
agacugggagugggacaagggacuugacucugcugaaccagaugaacaggagcuggaaaggcaa

SEQ ID NO: 95381 - RNA, 64 nt, Human
gauaccaaaggggaagacagaaccaaggcugcuugaaccagaaccuagucccgagcagcaccgc

SEQ ID NO: 95382 - RNA, 64 nt, Human
cucuugcaguauucccauacuugaugcagggaaggaaccagaagcagaggggccucuacgcagg

SEQ ID NO: 95383 - RNA, 64 nt, Human
aauagacacaggagugacagggacuuuguuaucagaaccagauuccugccggcuccuuugaaaa

SEQ ID NO: 95384 - RNA, 64 nt, Human
ugaccacguggagucucugaaucagccuugucuggaaccagaucuacaccuggacugcccaggu

SEQ ID NO: 95385 - RNA, 64 nt, Human
gcccuggaucucaccagcagccaagguugagccagaaccagaacccugucccuccggcccccag

SEQ ID NO: 95386 - RNA, 64 nt, Human
caguuuuugccaguugcuuucuuagcucaaaggagaaccagaauuuuuuugacagccacaaaca

SEQ ID NO: 95387 - RNA, 64 nt, Human
gagucuuacauauuugugcaccaaacuugaagaugaaccagaaaacagacuuaaacaaaauaua

SEQ ID NO: 95388 - RNA, 64 nt, Human
caaaaaagaacaaaaucugagcagagaugauuuugaaccagauauuuugccauuaucauuguuu

SEQ ID NO: 95389 - RNA, 64 nt, Human
gggggguggggguuacccaaauagguucacagaagaaccagaaauaaaaccugccuuucuagac

SEQ ID NO: 95390 - RNA, 64 nt, Human
accugucuaauggaaaaccuggagaagucgucaggaaccagacuacaguggacccuggagaacc

SEQ ID NO: 95391 - RNA, 64 nt, Human
cagugaaaauggccagccagagaaaagaucucaagaaccagaaauaaauaaggauggugauaga

SEQ ID NO: 95392 - RNA, 64 nt, Human
ggcaucagaacuuugccauuugucuacagaagacgaaccagagacaaaauuacuaaguauaaau

SEQ ID NO: 95393 - RNA, 64 nt, Human
aaaauuguaacccucuagaaaauaucaaagaaaugaaccagacgugguuuaaauaguugauuuu

SEQ ID NO: 95394 - RNA, 64 nt, Human
ugucuuauuuccagucuaauuuuacgcuguagcagaaccagauggcugagaaaauucuggaacu

SEQ ID NO: 95395 - RNA, 64 nt, Human
cuuuauuuugcuuuuucauagaggcagaaaguaggaaccagauagagaugaaaaggggccacug

SEQ ID NO: 95396 - RNA, 64 nt, Human
aacaguaagcaaaauuuuccagaauucccaaaaugaaccagauauccccuagaaaauuauacua

SEQ ID NO: 95397 - RNA, 64 nt, Human
aggcuugggaaaagucuuccagggugcggagauggaaccagaggcuggguuacugguaggaaua

SEQ ID NO: 95398 - RNA, 64 nt, Human
aucacauaccccucucacagagaaaauuaucaaagaaccagaaauuauaucuguuuuggagcaa

SEQ ID NO: 95399 - RNA, 64 nt, Human
gcuaugcacacuggaguccaccauaccaaagcacgaaccagacuguuucuuggggucagcccua

SEQ ID NO: 95400 - RNA, 64 nt, Human
gaauccaccugcaguuaccccgauccguuugcaagaaccagaucguacuugaaacuauaguggc

SEQ ID NO: 95401 - RNA, 64 nt, Human
cgaggaggauuuucuguuuuggaaaacaccauuagaaccagaccagcuuuguuuuggguuagag

SEQ ID NO: 95402 - RNA, 64 nt, Human
aaggagaacagcugagucaagcuuggaggucccugaaccagaggcacuaggauuaccccagggc

SEQ ID NO: 95403 - RNA, 64 nt, Human
ccuauuguccauuacacaccgaauguuaauuuaagaaccagaggcagaaguucuggcuuccugc

SEQ ID NO: 95404 - RNA, 64 nt, Human
uuaucuccccugcccugguuacagacagcuucgagaaccagaggagaagagcauagggucaugg

SEQ ID NO: 95405 - RNA, 64 nt, Human
ggaaggacuaacagaaagcaccugauuugcacuugaaccagauuauagauuuaaaaguauauga

SEQ ID NO: 95406 - RNA, 64 nt, Human
uugauuugaucugcucucugugaggccucaucuugaaccagaccuuaacgaccaaacccagacc

SEQ ID NO: 95407 - RNA, 64 nt, Human
agaagucggagcagaggaugguacagcagaggccgaaccagaagccggagcaguuccuaccgga

SEQ ID NO: 95408 - RNA, 64 nt, Human
uguugccauaucccccuagguugucuugauccaugaaccagaaccacagggcgguaucccaggc

SEQ ID NO: 95409 - RNA, 64 nt, Human
ucuuuaaaaggaaagaaaacaucuuuaaggggaggaaccagagugcugaaggaauggaagucca

SEQ ID NO: 95410 - RNA, 64 nt, Human
ccauggccacauccucauggcccaucaggggcaggaaccagacaaucucguagguguccugccc

SEQ ID NO: 95411 - RNA, 64 nt, Human
auaaaaaguccccaaacccaaacaaaugguuuaugaaccagaguauauguggaagauucuuugc

SEQ ID NO: 95412 - RNA, 64 nt, Human
ugauaaaaacuguaagaauaauuuagcagaaauagaaccagaauguagaagaguagucauguaa

SEQ ID NO: 95413 - RNA, 64 nt, Human
gaggauugaugacuccauggagccuggcccaggagaaccagagaugaucccgaggcagcugggg

SEQ ID NO: 95414 - RNA, 64 nt, Human
ccuaaacucucuggggcaggguuauuccuuuguggaaccagaggcacagagagagucaacugag

SEQ ID NO: 95415 - RNA, 64 nt, Human
ggcauuguggaagcaauaacuaguuccuaugaaagaaccagagcugggaagauggcugggaagc

SEQ ID NO: 95416 - RNA, 64 nt, Human
ggaagccauaucgcagagcuaaaugcaauagaaugaaccagaacuaguggauuccagggcuggg

SEQ ID NO: 95417 - RNA, 59 nt, Human
gaggaaugccaagugucugauucaacaaugaaccagaggcuuggucagugugcagcugc

SEQ ID NO: 95418 - RNA, 64 nt, Human
ucccuccguucuccccuuugaccauguaauaaaugaaccagaagcacugagauuaaccuaucaa

SEQ ID NO: 95419 - RNA, 64 nt, Human
auucucuuucuagcccauccaaauuugauaaauggaaccagagguuauauacaacuacaaggaa

SEQ ID NO: 95420 - RNA, 64 nt, Human
ggccacaggaaauaagacugcugaaugucugagagaaccagaguuguucucguccaagguagaa

SEQ ID NO: 95421 - RNA, 64 nt, Human
acaucuuuaauuuggcagaaauuagccuuucugugaaccagaugugguuuggggcagaucugua

SEQ ID NO: 95422 - RNA, 64 nt, Human
acacaggaucauuucgugaaggagcaaggcugaagaaccagaccuggacuuucuuaggcaagua

SEQ ID NO: 95423 - RNA, 64 nt, Human
agccacggcgcccagccuugaaaagauguuuuuagaaccagaagaaaccucgguucccacugau

SEQ ID NO: 95424 - RNA, 64 nt, Human
guauuuuaacugaauuuacccauugacuaagaaugaaccagauuugguggugguuuuguuucua

SEQ ID NO: 95425 - RNA, 64 nt, Human
gucaaggaauaggaacuacaacuucauaaaugaggaaccagaaaagguaaaaaaaaaaaaaaaa

SEQ ID NO: 95426 - RNA, 64 nt, Human
aaagaaaucacaguaaguucuauuagugaugauagaaccagauauaaaauuguucagugaugga

SEQ ID NO: 95427 - RNA, 64 nt, Human
uuugcaaaaaguauuuguuacauaaucaaaaggugaaccagaggaaauauugaacaagguuuua

SEQ ID NO: 95428 - RNA, 64 nt, Human
agaagcgugcgugggaaugcagcuguuuuccauggaaccagacgcuacagagacugcaacgugu

SEQ ID NO: 95429 - RNA, 64 nt, Human
ugaauuggccauaauuaugaauaggaauauuaaugaaccagaggacauacuagucacauguuau

SEQ ID NO: 95430 - RNA, 64 nt, Human
acaugcugucaggauggucugagcaucugggugagaaccagagaaacaggacuucuuccuucug

SEQ ID NO: 95431 - RNA, 64 nt, Human
cgaagccaggcuccuuucuccaccaaagaagauggaaccagacuggaauucugucuccagagag

SEQ ID NO: 95432 - RNA, 64 nt, Human
auguuagucaauucggugggcaauuuuuggacaugaaccagaaagcugaaagcugaggcugaca

SEQ ID NO: 95433 - RNA, 64 nt, Human
gaaaccagauacuuagccuucuacuguagcuacggaaccagauucuggugaauuuguccacaau

SEQ ID NO: 95434 - RNA, 64 nt, Human
aaggguguuaugcugaauccugagaagcuuucaagaaccagagaaccugauugcugaugauggc

SEQ ID NO: 95435 - RNA, 64 nt, Human
agccucguucauuuccaaagcaguuaaggaaugggaaccagaguguuuuaggaccugaagaauc

SEQ ID NO: 95436 - RNA, 64 nt, Human
uuaaacacgagacaaaacaauccauauguuuagggaaccagaaaaguccccuggucugucccuu

SEQ ID NO: 95437 - RNA, 64 nt, Human
gcagggugcuucagaugagcaagagaacccagucgaaccagauaccccaggugggccggaggga

SEQ ID NO: 95438 - RNA, 64 nt, Human
gucucaguggaaguguauuauuguuuuaaggauagaaccagaggccuugaagggagccaagaca

SEQ ID NO: 95439 - RNA, 64 nt, Human
cuuaucuuaguagacaaaaagagucaauaccagagaaccagaggcauccucuguauuuuaauga

SEQ ID NO: 95440 - RNA, 64 nt, Human
aaagccuccugcuccuacccaugcuacaggccaggaaccagagcccaucaucucagaggccccu

SEQ ID NO: 95441 - RNA, 64 nt, Human
gcauacaguucuugacuuuggacaauccaagagugaaccagaaugcaguuuuccuugagauacc

SEQ ID NO: 95442 - RNA, 64 nt, Human
aaaacaauuccccuguggccugcuggacugguuggaaccagaacaggcuaaggcauacaguucu

SEQ ID NO: 95443 - RNA, 64 nt, Human
ucuauuuuuaagauuagaggaaaaugaccauuaagaaccagaaaaauaauuaaucucucuggaa

SEQ ID NO: 95444 - RNA, 64 nt, Human
caugguauauaacaggaaaagaaaacuacauggggaaccagaagaccuaagccugaaaucccag

SEQ ID NO: 95445 - RNA, 64 nt, Human
aauaaggaaucaauucuuuucugccugagaaagagaaccagacgcaggaagaugaaaggcugcc

SEQ ID NO: 95446 - RNA, 64 nt, Human
ugggcuguagcaagcugucugcccuuggguucaagaaccagacuguggagccaaaggugaccgc

SEQ ID NO: 95447 - RNA, 64 nt, Human
uuggaaaaaaaugacaaaacaacgagggaagaaggaaccagaccuuagugccacauauuuuucu

SEQ ID NO: 95448 - RNA, 64 nt, Human
aacucuccuuaaaaaccgauauuuuuuuaucauggaaccagaacaucugucaugcaguguuguc

SEQ ID NO: 95449 - RNA, 64 nt, Human
gagaggaauccacaggaccaccagaagggagagggaaccagauaugcagaucagagauagagga

SEQ ID NO: 95450 - RNA, 64 nt, Human
gaaccagauaugcagaucagagauagaggaaguggaaccagagagcugggagggaccaagguug

SEQ ID NO: 95451 - RNA, 64 nt, Human
gagaggaauccacaggaccaccagagaggagagggaaccagauaugcagaucagagauagagga

SEQ ID NO: 95452 - RNA, 64 nt, Human; identical to SEQ ID NO: 95450

SEQ ID NO: 95453 - RNA, 64 nt, Human
ugagcaaugcuucucugcccuuccauggaaaguggaaccagaaauggugccaaggcuguggcug

SEQ ID NO: 95454 - RNA, 64 nt, Human
auaauucuuuuaauuuaaacaaagguucacuauggaaccagacaaaucucauuagccauguguu

SEQ ID NO: 95455 - RNA, 64 nt, Human
ccucuggaaccauauaaaguuccuggcuuugaaugaaccagaaguguuugcccacacagcaaau

SEQ ID NO: 95456 - RNA, 64 nt, Human
uggcggcgcgcccugccccacggacccgggcagugaaccagagaucacgcgccgcgccgcgagg

SEQ ID NO: 95457 - RNA, 64 nt, Human
auugaauacacaaauuuccccucuaauuauaugggaaccagaauagauaaauuuugacuugaaa

SEQ ID NO: 95458 - RNA, 64 nt, Human
gaagcuguagguuagcucugcccaggagaaaggagaaccagaccuugguaaagaauugucucuu

SEQ ID NO: 95459 - RNA, 64 nt, Human
caacauuucaugccacauaaauuauauuuaauaagaaccagauugaaaugagaacguauuggug

SEQ ID NO: 95460 - RNA, 64 nt, Human
aagacacuacuugcacuggaucuuacgcaaaaaagaaccagaacacacaguguggacaacugcc

SEQ ID NO: 95461 - RNA, 64 nt, Human
accgcaauuucuaggugguagcaaagggggacucgaaccagaugucguguguuuugcaugcaug

SEQ ID NO: 95462 - RNA, 64 nt, Human
aauaaaucuguaguguuuuguguuuauauguucagaaccagaguagacuggauugaaagaugga

SEQ ID NO: 95463 - RNA, 64 nt, Human
cugagcuuccuuccccagcuuugcugccugagaggaaccagagcagacgcacaggccggaaaag

SEQ ID NO: 95464 - RNA, 59 nt, Human
ccaaacacgaugaacucuaaaccuggcaugaaccagauggugccagggaguacgugaca

SEQ ID NO: 95465 - RNA, 64 nt, Human
uuaaagcacaguucaguccuaaaagggucugggagaaccagaugauguacuaggugaagcauug

SEQ ID NO: 95466 - RNA, 64 nt, Human
cuccccaguuauuuuuuuuuccaaacaccaacuugaaccagauccccaauuaaaacaacaguau

SEQ ID NO: 95467 - RNA, 64 nt, Human
gauucuaaggaauuucuuaucugacagagcaucagaaccagaggcuuggucccacaggccacgg

SEQ ID NO: 95468 - RNA, 64 nt, Human
caccgggcgucccugcaucugacugcuggaagaagaaccagacugaggaaaagaggcucuucaa

SEQ ID NO: 95469 - RNA, 64 nt, Human
auggggcgugaaggcacacugucccaccacaacugaaccagaagagagugaagacuccccucuu

SEQ ID NO: 95470 - RNA, 59 nt, Human
ccaaacaggaugaacucuaaaccuggcacgaaccagauggugccagggaguacgugaca

SEQ ID NO: 95471 - RNA, 64 nt, Human
uaaggaacagcuaaggaauaauuuuaauaaaagugaaccagaacaaaucacucauuuaaaaagu

SEQ ID NO: 95472 - RNA, 64 nt, Human
cucuauuaaaguauuuuacauuugacauaaaaaagaaccagauacaguuuucuauucagauaug

SEQ ID NO: 95473 - RNA, 64 nt, Human
agagaaugagccaacccauguaccugcugcaacugaaccagacuggguuuucaaggcucccaga

SEQ ID NO: 95474 - RNA, 64 nt, Human
uauguaucgccuuagagcaagagcuguguuccaggaaccagaucacgauuuuuagccauggaac

SEQ ID NO: 95475 - RNA, 64 nt, Human
cagggacccaccgcccauuccccgagagcugucggaaccagaugcaacccggcagcccagagaa

SEQ ID NO: 95476 - RNA, 64 nt, Human
cucucacauuuucuuggagcugggguuugaauaggaaccagaugauguucacugcugaaauucc

SEQ ID NO: 95477 - RNA, 64 nt, Human
gauaaaacaucugugagugaaaauccaguuucaagaaccagagaauuggguugucaugucuguu

SEQ ID NO: 95478 - RNA, 64 nt, Human
cugggugcugggaagggaggguugaaaccaccgugaaccagaggguguggcuuuccaggcaccc

SEQ ID NO: 95479 - RNA, 64 nt, Human
ucucccagcuguuagagccgcccugggggccccagaaccagagcuggcucccagcaaggguagg

SEQ ID NO: 95480 - RNA, 64 nt, Human
acagacagcgaagagauggugugaaaagcuugcagaaccagacagagaaccccacagacuuucc

SEQ ID NO: 95481 - RNA, 64 nt, Human
ugcuuuucuuuugggaggauaguaaaacaauuuagaaccagauaugcuuugucuugauucucaa

SEQ ID NO: 95482 - RNA, 64 nt, Human
gagaucgccccacugcuuuucaaccugggugacagaaccagacccugucucaaaacaaaacaaa

SEQ ID NO: 95483 - RNA, 64 nt, Human
ucuggagagugaggaugaccaucuccacuuucuggaaccagaaugagcccccuugguaaccuug

SEQ ID NO: 95484 - RNA, 64 nt, Human
cgaccccccggcucgcguucccguggggaucacugaaccagacacagcauugcugacacaugag

SEQ ID NO: 95485 - RNA, 64 nt, Human
aucuccuuucugcgucgucauauuugaacuugucgaaccagaucuucucauguacuaggaaguu

SEQ ID NO: 95486 - RNA, 64 nt, Human
uggcccauccaagacuuuuaggccauucuugauggaaccagaucccugcccugacuguccagcu

SEQ ID NO: 95487 - RNA, 64 nt, Human
aggcagaugaaguggucuuugaccacaguugauugaaccagagcacuuauugcuuaaagaauaa

SEQ ID NO: 95488 - RNA, 64 nt, Human
cucucaacccagucucccuucccagggccacucagaaccagaggucuuuagggccaguguacug

SEQ ID NO: 95489 - RNA, 64 nt, Human
gggaggcaucaggccuucuucugguugcaggagagaaccagagggugggaacggggagggaaga

SEQ ID NO: 95490 - RNA, 64 nt, Human
gagcccuucccagagagcagggagcuuauaaauggaaccagagcagaaguccccagacucagga

SEQ ID NO: 95491 - RNA, 64 nt, Human
uacacaggaugugcuucugcagccuacagaugcagaaccagaaugagggggacaauuccaccca

SEQ ID NO: 95492 - RNA, 64 nt, Human
ucuuucugcccucugcagacauccccgauugaaagaaccagagaggcucugagaaaccucggga

SEQ ID NO: 95493 - RNA, 64 nt, Human
uaaggugauuauaaaagauacauggaaggaaguggaaccagaugcagaagaggaaaugauggaa

SEQ ID NO: 95494 - RNA, 64 nt, Human
ucugauuaaaaauucuuccauguuuuaaauaucagaaccagaccuuucuuacuguguaucuuag

SEQ ID NO: 95495 - RNA, 64 nt, Human
cuaaguucuugucucuggccagaggugugguauagaaccagaaacccauaucaagggugacuaa

SEQ ID NO: 95496 - RNA, 64 nt, Human
guucccgaggccuggccuuucccucuccugcugagaaccagaacccaccaggagcaccacagag

SEQ ID NO: 95497 - RNA, 64 nt, Human
gagaauuuggccacaaccaaauugaugcuggcuggaaccagaggccagaaagccuggccuuguc

SEQ ID NO: 95498 - RNA, 64 nt, Human
accacucgcugccuuaggugccuucugcucucuggaaccagaggacuagcugacuuuugccaag

SEQ ID NO: 95499 - RNA, 64 nt, Human
gaaaaauggcugcaaauagccaaaucaaacuuaagaaccagaucucugccagauuaaacauuuu

SEQ ID NO: 95500 - RNA, 64 nt, Human
uuugcagauauucuucgguuugaauaauuaaaaugaaccagauaucagggugguuaauuaaaau

SEQ ID NO: 95501 - RNA, 64 nt, Human
aaaugaaccagauaucagggugguuaauuaaaaugaaccagauaucagggugguuuauaaagcc

SEQ ID NO: 95502 - RNA, 64 nt, Human
cuaacaaagaaaagaauaaaguauuuauuaauaagaaccagaaagcacuugaaacugauguuuu

SEQ ID NO: 95503 - RNA, 64 nt, Human
aucuugaguuaagugaguucugaggcugcugggggaaccagaucaauucaaagcuaaauacuuc

SEQ ID NO: 95504 - RNA, 64 nt, Human
ugagaauaugaagaggaggguugaggcuggagcagaaccagaaucaagcugguguggggcuuuu

SEQ ID NO: 95505 - RNA, 64 nt, Human
ggagaagcaugugccccuguagagcgucuccccagaaccagaccccgagccacucgcuuccucu

SEQ ID NO: 95506 - RNA, 64 nt, Human
ccagcacaugaaaccuuauuuuuucccaaagccagaaccagaugaguaaaggaguaagaaccuu

SEQ ID NO: 95507 - RNA, 64 nt, Human
ccccgcuaccguccuggccagcuaccgucagagagaaccagagcuccaagucuuuaauuugcca

SEQ ID NO: 95508 - RNA, 64 nt, Human
ugcugcauacccggggugggauggggugguuggagaaccagaacuauuuuuaaaacauuagguu

SEQ ID NO: 95509 - RNA, 64 nt, Human
gaggguuuauuuucaguccccucucucugggucagaaccagagggcaugcugaaugcccccugc

SEQ ID NO: 95510 - RNA, 64 nt, Human
uuaagauguacgacauuaccgaacaccuaaaauagaaccagagaaacgaaagccauucccacaa

SEQ ID NO: 95511 - RNA, 64 nt, Human
uugaguccuuucuuugugcuaagguucuugcggugaaccagaauuauaacagugagcucaucug

SEQ ID NO: 95512 - RNA, 64 nt, Human
gccuccucucguaccuuggacaaaggauacaccugaaccagaauaguuuucuuacccucacauu

SEQ ID NO: 95513 - RNA, 64 nt, Human
acuuuucuuuguaaagaaguuuaccuuuugacuggaaccagauggcacugagaaaaagaaugag

SEQ ID NO: 95514 - RNA, 64 nt, Human
ucccagagcccuacgugaagguccagcucaugcugaaccagaggaaguggaagaagagaaagac

SEQ ID NO: 95515 - RNA, 64 nt, Human
ugaauuuccaaaauagucaguaaaggaucuaauagaaccagaauuauuugggugaauucugcag

SEQ ID NO: 95516 - RNA, 64 nt, Human
ucgccuaauuccaaaggaauaaccuuucuggagugaaccagaccgucgcacccacagcgaaggc

SEQ ID NO: 95517 - RNA, 64 nt, Human
caguggacauuugugcaauugcucgcccuggagggaaccagaucauuuuuaaaccagaaauaau

SEQ ID NO: 95518 - RNA, 64 nt, Human
gucaaaucuacuccccggaccucaaccauggcaagaaccagagguccaaagaggcccagaccca

SEQ ID NO: 95519 - RNA, 64 nt, Human
ccaaagaugaaagcccagacuucaguaaucuuuugaaccagacguggauggugcugaauuguug

SEQ ID NO: 95520 - RNA, 64 nt, Human
cuugcuaaaguucucuuucuuugagaaaacugaggaaccagaaugcuuagaguucauaaaauaa

SEQ ID NO: 95521 - RNA, 64 nt, Human
caggcuggacgaaugccuggucagagggugaccugaaccagagcuggagugaggaucaaacagg

SEQ ID NO: 95522 - RNA, 50 nt, Human
cacaggugcccgaggacugagaaccagagcuugaaauucaaagcugcgau

SEQ ID NO: 95523 - RNA, 64 nt, Human
uaugccauaguguucuccaucucuagugaagacagaaccagagggaauaaggaucuuuuuuuua

SEQ ID NO: 95524 - RNA, 64 nt, Human
ugguuucaucugaaagcugccauagaaauucugugaaccagaaugagacaaggcagcaggcaua

SEQ ID NO: 95525 - RNA, 64 nt, Human
uccuccaaugugugcauggaacaaauaaucaaaagaaccagacugugucuuauucucccacuga

SEQ ID NO: 95526 - RNA, 64 nt, Human
gacagcagaauagaagaaugauucaugagaaccugaaccagaugaacagcuacuaguuauuuua

SEQ ID NO: 95527 - RNA, 64 nt, Human
agaacuaagaugaucaucuccaguuuauagaccagaaccagagcucagagaggcuagaugauug

SEQ ID NO: 95528 - RNA, 64 nt, Human
cugugagggaaguuaggaacccauuuccuccccagaaccagaaugacuggacaaucuuuuucau

SEQ ID NO: 95529 - RNA, 64 nt, Human
ggaccagcccacagcacaccaagguggcccggaagaaccagaagugcagccccucucacaggca

SEQ ID NO: 95530 - RNA, 64 nt, Human
ccuuuuucucccccacucugagguuuccccaagagaaccagauuggcagggagaagcauugugg

SEQ ID NO: 95531 - RNA, 64 nt, Human
cgcacugaauagugaaaauaauuagacauuuuaagaaccagagccauagaauuauuuuaaauua

SEQ ID NO: 95532 - RNA, 64 nt, Human
uggcuccagaauuagaguaauuaugagauggugggaaccagagcaacucaggugcaugauacaa

SEQ ID NO: 95533 - RNA, 64 nt, Human
cccucuucgucaugaccaacgugauccucaccaugaaccagacacagggccugugccccgaggu

SEQ ID NO: 95534 - RNA, 64 nt, Human
auuugaauuuagugacagcuuggcugaugucacugaaccagaaggguuuauacugagugaagga

SEQ ID NO: 95535 - RNA, 64 nt, Human
uucagaauuuugagucuguaauucauuuguacaugaaccagaaaaugugggaacucauucauuc

SEQ ID NO: 95536 - RNA, 64 nt, Human
aguuuugacgguuuaugcugggcacugccagacugaaccagagcuggaacacaauaaugugucc

SEQ ID NO: 95537 - RNA, 64 nt, Human
cugggucuuuagagauccugugggcaaguaguuggaaccagagaacagccugccugcuuugaca

SEQ ID NO: 95538 - RNA, 64 nt, Human
auuagaccagaggauuuaggaugccuccuucuaagaaccagaaguucucauuccccauuaugaa

SEQ ID NO: 95539 - RNA, 64 nt, Human
cuagcaugguuucugaagggugaauucugguggggaaccagaaacucccugucuuuggggcagg

SEQ ID NO: 95540 - RNA, 64 nt, Human
aaagcacauuggauccuacuuuucuucagauauugaaccagaucucuggcccaucaggcuuucu

SEQ ID NO: 95541 - RNA, 64 nt, Human
cauaacuuccuuccaaaggcagcucagaagauuagaaccagacuuacuaaccaauuccaccccc

SEQ ID NO: 95542 - RNA, 64 nt, Human
aacuacuucaacuaaaagccaaccacuugaacaagaaccagaagaguguguuaauugcacagau

SEQ ID NO: 95543 - RNA, 64 nt, Human
agccagugucuagaggccugaaggaaccgcugaagaaccagaggagaucuccucuuccaagaca

SEQ ID NO: 95544 - RNA, 64 nt, Human
uuucaaaaccauaaacaccauuaucuaacuucaugaaccagaaugaaucaaaucuuuuuguuug

SEQ ID NO: 95545 - RNA, 64 nt, Human
gugacagaggcuggcucuggauugggggacaacagaaccagaguaacuccucgccuguugcugc

SEQ ID NO: 95546 - RNA, 64 nt, Human
gguucuagaugaaccaauuaucuggaaaaugaaagaaccagaguuggaaggcacuugacuggcc

SEQ ID NO: 95547 - RNA, 64 nt, Human
aacaaugggaaagaggacugggagaggaaucuaagaaccagauggcuucagcucucuagaggag

SEQ ID NO: 95548 - RNA, 64 nt, Human
uacuuuguaaaacaugcugaaaccucacuguggagaaccagaauuugguaaaaucuagauccua

SEQ ID NO: 95549 - RNA, 64 nt, Human
guauacugggaacaggaugccuuagcccacaacagaaccagaaugaaucuuugaaggcacaaga

SEQ ID NO: 95550 - RNA, 64 nt, Human
aacaggauucuuguauggccaggauccugucugggaaccagaaacccuacacccucccccucca

SEQ ID NO: 95551 - RNA, 62 nt, Human
gaaagagaguccagaaguaauucagaugcugugaaccagauuuccuuuucuuuguuuucuuu

SEQ ID NO: 95552 - RNA, 64 nt, Human
aagugaaaauagccagccagaggaaaugucucaagaaccagaaauaaauaaggguggugauaga

SEQ ID NO: 95553 - RNA, 64 nt, Human
uacuguuuuaauguuugcuuugaacauaauuuaagaaccagauuuauuuucuauagugauaaac

SEQ ID NO: 95554 - RNA, 64 nt, Human
ggugggggcgggaaggaggggcaaggucuuucaggaaccagacccaacaggcccuucuguagcc

SEQ ID NO: 95555 - RNA, 64 nt, Human
gccaaggcagaggccugggcugggaaaaacuuuggaaccagacucuugccuguuucccaggccc

SEQ ID NO: 95556 - RNA, 64 nt, Human
gaauauaaagugagccugauucuugaaaaaaucagaaccagagccuguuuuguuuuguucuaaa

SEQ ID NO: 95557 - RNA, 64 nt, Human
uaggccacaggaagaagguguggagaacccaccugaaccagauugagacucaauccaucuuugg

SEQ ID NO: 95558 - RNA, 64 nt, Human
uuuuucaggucuugcuguuaagauucguuagguagaaccagagcagugcucagucaagggcuaa

SEQ ID NO: 95559 - RNA, 64 nt, Human
acauuuuucagaaauguauuuauucucagaaacagaaccagagagaaguuaaacaaaagguuau

SEQ ID NO: 95560 - RNA, 64 nt, Human
aaaauuugccuuagcaauuaucuuugaacaucccgaaccagauuuuuaaaucccauuuuuguuu

SEQ ID NO: 95561 - RNA, 64 nt, Human
guggugaguggcaaguaagggcagaauuuuaggagaaccagagucacccgcuggcucuacugag

SEQ ID NO: 95562 - RNA, 64 nt, Human
gauuacacauguaaauaugaccucagacaaaaaggaaccagaggcccaagggcaauaauaaggu

SEQ ID NO: 95563 - RNA, 64 nt, Human
aauuuucaugucugauuuauggugauuuucuuaagaaccagaacugcuggcagaaagggggcac

SEQ ID NO: 95564 - RNA, 64 nt, Human
uucuuuauugagauguaucauguauugaaugagugaaccagaaaauuagaagauggucaaaaaa

SEQ ID NO: 95565 - RNA, 64 nt, Human
aacccagcaaaucuaagcccaaggaagaagggcggaaccagaaguagggccucgacuugcuuca

SEQ ID NO: 95566 - RNA, 64 nt, Human
cuguguccaaaauuaugcacuguuuguugaaguagaaccagaaauccugaccuccuguuaaaug

SEQ ID NO: 95567 - RNA, 64 nt, Human
cccugguuuggggcugugccagcucagagcccuugaaccagaaccaacugcucaggcucacaaa

SEQ ID NO: 95568 - RNA, 64 nt, Human
augggauccugcaguggucugguggcauuucuuggaaccagauuuaccugaggagcucuguccu

SEQ ID NO: 95569 - RNA, 64 nt, Human
gagucucccuccuccuggggaaggggcugccaacgaaccagacucagugaccacgucaugacag

SEQ ID NO: 95570 - RNA, 64 nt, Human
cacaccggugcuguugggagugaccaaaccacaugaaccagacuuuucccguccaggaaauagc

SEQ ID NO: 95571 - RNA, 64 nt, Human
agccuggcgccuaggaaccagaccugaaaccaaggaaccagacccgaaaccaggccugggccgg

SEQ ID NO: 95572 - RNA, 64 nt, Human
aagcaaaacuaaaggcagguagccuggcgccuaggaaccagaccugaaaccaaggaaccagacc

SEQ ID NO: 95573 - RNA, 64 nt, Human
ggccccugagggccuggccacaugggaccaagcggaaccagaacaaggucccgacagggguaga

SEQ ID NO: 95574 - RNA, 64 nt, Human
gcuggggaugacaggaaggaaggaacacugggcagaaccagagagaugggacaugguagacugu

SEQ ID NO: 95575 - RNA, 64 nt, Human
gagaauggcguaaaccccuccagccugggcgacagaaccagacuccgucucaaaaaaaaaaaaa

SEQ ID NO: 95576 - RNA, 64 nt, Human
aacugcauggagcugcacucuaggagaaggaggggaaccagauguuagaucaggggagggagca

SEQ ID NO: 95577 - RNA, 64 nt, Human
acaaggccccagagacucagagggaggaaucgaggaaccagagccauggacucuacacugugaa

SEQ ID NO: 95578 - RNA, 64 nt, Human
cagacaguggagggguguccccucccacaggcaagaaccagaggcccaggcugcacacccauuu

SEQ ID NO: 95579 - RNA, 64 nt, Human
uaguucauuaacaagguacaugcaauagucuaaagaaccagagucacuacuauaguggcuuaac

SEQ ID NO: 95580 - RNA, 64 nt, Human
gauuaacaauguaaaguauuaauuauugaacuuugaaccagauuuuuaggaaaauuauguucuu

SEQ ID NO: 95581 - RNA, 64 nt, Human
caauguaagaagggaaagggagaagauauuugaagaaccagaauguaaauucauguguuuccac

SEQ ID NO: 95582 - RNA, 64 nt, Human
ucacaguaauaaagcgucguaagaugguugggaagaaccagaggugacuuaugcaaaagcuuua

SEQ ID NO: 95583 - RNA, 64 nt, Human
augguuagcgcugaccuucauugaggucccuuuggaaccagaugucuuguuacagacaccuucc

SEQ ID NO: 95584 - RNA, 64 nt, Human
cuugaaggaaccauuagauauggaaaauagugaugaaccagaguuucuugguugcuuuuucaaa

SEQ ID NO: 95585 - RNA, 64 nt, Human
cucucacuuccuucuagaaggagcuuccugacuggaaccagagaaugcaugucuguccacuugg

SEQ ID NO: 95586 - RNA, 64 nt, Human
uaaauaaucaggugcuuuguaaccaagcacaucggaaccagaggguggagguugguguggaaga

SEQ ID NO: 95587 - RNA, 64 nt, Human
uacgggucucuuucuguagaguuggagaggaaaugaaccagaagaguggaucccucggacauac

SEQ ID NO: 95588 - RNA, 64 nt, Human
uauauuaaauauugauauaaaaauaaaagaacuggaaccagauucagaaucaugaaaacaacau

SEQ ID NO: 95589 - RNA, 64 nt, Human
guacagguugaguaucccuuauccaaaaugcuuggaaccagaaguguuucaaauuuuagauuau

SEQ ID NO: 95590 - RNA, 64 nt, Human
auuuccuuacaguuuuccuagcugaugagggacagaaccagaacuagagccugagcccaaccca

SEQ ID NO: 95591 - RNA, 64 nt, Human
ucuucauuagccagagaugacuaauuuaaauuuagaaccagauuuuaauuuaaauuaauauuuc

SEQ ID NO: 95592 - RNA, 64 nt, Human
cacaggcuucugagcagcgagccugcuaguggccgaaccagaaccaauuauuuucauccuuguc

SEQ ID NO: 95593 - RNA, 64 nt, Human
cccccacccgucaccacgccccaacacuccccccgaaccagagccgugcacuugugccugguag

SEQ ID NO: 95594 - RNA, 64 nt, Human
aggagggggcggggcaggagcuggugccaaccgggaaccagagccccacagccauacagcccau

SEQ ID NO: 95595 - RNA, 64 nt, Human
aggccccgauaccgggaagagccgacacagccacgaaccagacaagcagacaaucagcggacaa

SEQ ID NO: 95596 - RNA, 64 nt, Human
aacagagccagacauagacaguuccagcaucacagaaccagaagaagagaccugcaacugugag

SEQ ID NO: 95597 - RNA, 51 nt, Human
acgaagggaauuucugcugaagaaccagaaaaaagaaagcacaacaccuuu

SEQ ID NO: 95598 - RNA, 64 nt, Human
acagaacccucuuacuauuuaguuuaucugggcagaaccagauuguuauguccuuuguuccaaa

SEQ ID NO: 95599 - RNA, 64 nt, Human
aaugauagaauaguauacagcacuuaaaagcagugaaccagauccauauuguguaacauggaua

SEQ ID NO: 95600 - RNA, 64 nt, Human
cagaaucagaagaaaacauucugaaauuuauuuggaaccagaaaagcccaaccuaaauagcaaa

SEQ ID NO: 95601 - RNA, 64 nt, Human
uggggggauggugagcaaauaggagugcuccccagaaccagaggaggguggggcacagaccaua

SEQ ID NO: 95602 - RNA, 64 nt, Human
agcuacuugggaagcugaggcaggagaaucgcuugaaccagagagucggagguugcaguaagcc

SEQ ID NO: 95603 - RNA, 64 nt, Human
ggcccccagcccccagcaagccugagcccgggaagaaccagaggcccucccgagagacccaguc

SEQ ID NO: 95604 - RNA, 64 nt, Human
uacgccacuggaaacacacccaccgcaaccucaagaaccagacugugcagagggcauugcgucc

SEQ ID NO: 95605 - RNA, 64 nt, Human
aaaauaaucacaacagaaaccagcugccccaaaggaaccagaggugaaaaacaaacaaaaaaaa

SEQ ID NO: 95606 - RNA, 64 nt, Human
aagaagcucagcacugcauuccugaccgaggucagaaccagaucaaucucagaaucucaccugu

SEQ ID NO: 95607 - RNA, 64 nt, Human
uuuuuuuuaaaccacagaacuugaauacaugagggaaccagaguucaaaguccuaugcaaccuu

SEQ ID NO: 95608 - RNA, 64 nt, Human
gccucaguuucccgacuugcaaaauaagcagaaagaaccagaugcucuccagggucuuuuucua

SEQ ID NO: 95609 - RNA, 64 nt, Human
cauccguggucaaaagucagcugccagcccugcggaaccagagccucaggcugggauggggagg

SEQ ID NO: 95610 - RNA, 64 nt, Human
uuccaaccuguucacgugacuccucaauuccagggaaccagagcgauguguucuuuguaccugu

SEQ ID NO: 95611 - RNA, 64 nt, Human
gagugacucgguguaaaaccauguaguuuuaacagaaccagaggguuguacuauuguuuaaaaa

SEQ ID NO: 95612 - RNA, 64 nt, Human
ggcacaucugugcucuuggugaggagagcaagaggaaccagaagaagucucuuuggucagggac

SEQ ID NO: 95613 - RNA, 64 nt, Human
cugucuguaccccagaaucaaacacagaaccucagaaccagauuuaggaccucagaauccugca

SEQ ID NO: 95614 - RNA, 64 nt, Human
ccccucucugcugcuuuagauguugcuuuacauagaaccagaaaauggaauuucucagcuaaag

SEQ ID NO: 95615 - RNA, 64 nt, Human
cccugacuucgaccccuagcuuaugucacagcccgaaccagaucgacuggucugguagcagccu

SEQ ID NO: 95616 - RNA, 64 nt, Human
uggggauguaaccaagcuguacccuugagaccuggaaccagagccacaggccccuuuugugggu

SEQ ID NO: 95617 - RNA, 64 nt, Human
cagugguaggaaagauauucucauuuuuuuuauugaaccagacauuuuuauaaaauacugauug

SEQ ID NO: 95618 - RNA, 64 nt, Human
aauguuaccauccccagcugcccuuauuuccagagaaccagacguuuguuucccaguuggaaag

SEQ ID NO: 95619 - RNA, 64 nt, Human
uucuugguggcuauuagcagaagugcagaguagggaaccagagcugguuaagggccuagugaag

SEQ ID NO: 95620 - RNA, 64 nt, Human
auuuuacaaggaagaaccucuuaagaaguccucagaaccagaagcaaugugaacucucagcgcu

SEQ ID NO: 95621 - RNA, 64 nt, Human
agggcgagacuccgucucaauuuaaaacaagagagaaccagacugagucucugaagaccacagg

SEQ ID NO: 95622 - RNA, 64 nt, Human
caggaaugccguuuccuuuuuauggaucuguugggaaccagagagaaucaacagaucaaugaca

SEQ ID NO: 95623 - RNA, 64 nt, Human
uuuaaaacuugcucagagccacuuagccacuugagaaccagacaguaagguguuacucccaggu

SEQ ID NO: 95624 - RNA, 64 nt, Human
ugcaguuuagagaaggcagagccacugguuuugagaaccagauuugagagagggaccuggccag

SEQ ID NO: 95625 - RNA, 64 nt, Human
gcugguccagccagcggcugcaggcgaguuucuagaaccagagucuauauaaagagagaacuaa

SEQ ID NO: 95626 - RNA, 64 nt, Human
gaaucaauggggugggccacaggaaaugucagaggaaccagaacucagaacucuuccuccugga

SEQ ID NO: 95627 - RNA, 64 nt, Human
cauccaacgugaagauaccauaagcuuuuucucugaaccagagaaaugaaagucaguuuaagag

SEQ ID NO: 95628 - RNA, 64 nt, Human
cucucccaaguggcugaggcaggcuuaggggaaagaaccagaggggcaggggaggacuggggag

SEQ ID NO: 95629 - RNA, 64 nt, Human
ggcaagucauuccaaacugcuugaaggaguagaugaaccagaaucugagaauuuggaaauaggu

SEQ ID NO: 95630 - RNA, 64 nt, Human
gguuuuauauccauuuuuaucaggauuuccucuugaaccagaaccagucuuucaacucauugca

SEQ ID NO: 95631 - RNA, 64 nt, Human
acuucaaaacuccagcuugcccaauaaggauuuagaaccagagugacugauauauauauauauu

SEQ ID NO: 95632 - RNA, 64 nt, Human
cagggaaucugauaauacauacuucugucaaccagaaccagagggguaguuuucuuuucccucc

SEQ ID NO: 95633 - RNA, 64 nt, Human
ggguggggggaaagcagcaagaaaagguagagaggaaccagauuggaagagggucguaaaugca

SEQ ID NO: 95634 - RNA, 64 nt, Human
auuguuggaccuggggaggggggaguuaaaaaaagaaccagaaagaaauugucaaaaaccaaua

SEQ ID NO: 95635 - RNA, 61 nt, Human
cuuguugcaagagugggaccuacccaagggggaagacaagaugucauccuuggaaacccug

SEQ ID NO: 95636 - RNA, 61 nt, Human
cucugaauaugggacccagugccaggagcuggaagacaagguguuucugccaaacggggac

SEQ ID NO: 95637 - RNA, 61 nt, Human
ggccauguuaaaagcuuuuucacaguuuuaagaagacaaguggagggugaggauaguggug

SEQ ID NO: 95638 - RNA, 61 nt, Human
augucauuaaauauugaaugcucuauugggggaagacaaaugaagagaaugcauuuugagc

SEQ ID NO: 95639 - RNA, 61 nt, Human
aaccagaacuuucuguccuaaucauacaccagaagacaaacaauaugauuugcuguuacca

SEQ ID NO: 95640 - RNA, 61 nt, Human
auuaauccucuuuuaaaaaaggaaauauacagaagacaaacauuguauaaaaacuaagagu

SEQ ID NO: 95641 - RNA, 61 nt, Human
caccaaggacggcaagaaggacaagaaggaggaagacaagaagugagacuggagggaaagg

SEQ ID NO: 95642 - RNA, 61 nt, Human
aaccuggguaacuagggaagauaauauuaaggaagacaaugugaaaagaaaaaugagccug

SEQ ID NO: 95643 - RNA, 61 nt, Human
uccuucucugaagagaucuugauuccuuugggaagacaagaauuuuucuuaauaacaaagg

SEQ ID NO: 95644 - RNA, 61 nt, Human
cuucccucauucuuugccucuauccuuagcugaagacaaacuagaggagcagcaucccagg

SEQ ID NO: 95645 - RNA, 61 nt, Human
ucugcccucauagaguugauugucuagugaggaagacaagcauuuuuaaaaaauaaauuua

SEQ ID NO: 95646 - RNA, 61 nt, Human
ucuaaccauugggaagguagaggcuggcagggaagacaaaucugcuacaaguccaugggaa

SEQ ID NO: 95647 - RNA, 53 nt, Human
cauacaacccagccagcugaucagaagacaaacuggugguauguaaugaaaug

SEQ ID NO: 95648 - RNA, 61 nt, Human
uuuauguuaaaauaauuuuuauuaauuuagagaagacaaucaaugucugugagaaaacgga

SEQ ID NO: 95649 - RNA, 61 nt, Human
caagucuggcugucaacugacaaagagaagagaagacaagucuguggcccagacaggaugc

SEQ ID NO: 95650 - RNA, 61 nt, Human
ccugcugcuggcgcccuagguggcugggggggaagacaacggagaccggugucgcgccgcc

SEQ ID NO: 95651 - RNA, 61 nt, Human
ucacuuuaccaauguuaucaaaauuacuuuugaagacaaucagaaggauuuuagcuggaua

SEQ ID NO: 95652 - RNA, 61 nt, Human
auacaugaggaauuuaaccacauacaucauugaagacaagggauagcaguuuguuuuuauu

SEQ ID NO: 95653 - RNA, 61 nt, Human
ucaaagaacuuggucauaaauaugauaaugagaagacaaaguauuuauauuaaaacaguuu

SEQ ID NO: 95654 - RNA, 61 nt, Human
auaucaaggacaaccacccuagcuucuuagugaagacaauguacaguuauccguuagauca

SEQ ID NO: 95655 - RNA, 61 nt, Human
gcuucggacacaaauaggcuccucuacaccugaagacaaaggcaaagucaaauggggacca

SEQ ID NO: 95656 - RNA, 61 nt, Human
guauauguauguauucucuguuacaaaggaugaagacaaauagggauacauuucaauguaa

SEQ ID NO: 95657 - RNA, 61 nt, Human
uuguagcuccaauugauugguaacagaagaugaagacaacagcauaacuaaauuauuuuaa

SEQ ID NO: 95658 - RNA, 61 nt, Human
gagcaugccaguggcaaccugugcucagucugaagacaauggacccacguuaggugugaca

SEQ ID NO: 95659 - RNA, 61 nt, Human
uaccauacacggaaagcaaaacagaaaaacagaagacaaaaaauagagaucagcaagaaaa

SEQ ID NO: 95660 - RNA, 61 nt, Human
caccaccccccuuccuaucuaagggagggcugaagacaaggggccggcauucagugggcag

SEQ ID NO: 95661 - RNA, 61 nt, Human
gaauuaugguugacagagaguuuaugauccagaagacaaccacuucucuccuuuuagaaag

SEQ ID NO: 95662 - RNA, 61 nt, Human
aucaugucaguuccaaugagguggggauggagaagacaauuguugcuuaugaaagaaagcu

SEQ ID NO: 95663 - RNA, 61 nt, Human
gaaaacaggguuggaaggauuuccugaauuagaagacaaacguuagcauacccaguaagga

SEQ ID NO: 95664 - RNA, 61 nt, Human
augaaaauacuugauuugcucuuauuuuguagaagacaaagaaguauguaauugucacuug

SEQ ID NO: 95665 - RNA, 61 nt, Human
acggggcgucuccuaauaaaccugauaccaagaagacaacuugagccacuuggaucccgaa

SEQ ID NO: 95666 - RNA, 61 nt, Human
gacaagucaucaaauguuugucacaugugaugaagacaaauauguauaccuggcauagaga

SEQ ID NO: 95667 - RNA, 61 nt, Human
uacagaaacagcauggaauugcaaguccucugaagacaaugagaggauuuaggaugagccc

SEQ ID NO: 95668 - RNA, 61 nt, Human
auucauauuuguuuccuuuugugguuuuaaugaagacaauuuguaaaguaauacuguuaug

SEQ ID NO: 95669 - RNA, 61 nt, Human
ucauucaugaaacagaagaggcuguacaagugaagacaagggcuuuuuaugcaaguuuuga

SEQ ID NO: 95670 - RNA, 61 nt, Human
gucagguuagggagcagugaaagugaggagggaagacaauucugugaacucuguaacucuu

SEQ ID NO: 95671 - RNA, 61 nt, Human
ugguaagccuuugcacucuguagaguacuuagaagacaagggcaacuuacuuggaguuaga

SEQ ID NO: 95672 - RNA, 61 nt, Human
cagguugaucugccacagaaaaagcaucuuugaagacaaagagggugaggucuucaugagu

SEQ ID NO: 95673 - RNA, 61 nt, Human
aaauuugagaaucaaacauucuauguguuuggaagacaacucugcuugcucauccaaggau

SEQ ID NO: 95674 - RNA, 61 nt, Human
gccauaauauaaaugugugaaucagggcugugaagacaacagcagaaaugcuaacaagcgu

SEQ ID NO: 95675 - RNA, 61 nt, Human
uaucugaguugacuugacagaacacugucuugaagacaauggcuuacuccaggagacccac

SEQ ID NO: 95676 - RNA, 61 nt, Human
caugcccucuuaccaguauuuaacuucugaggaagacaagugaugcuaaaaccugaaauuc

SEQ ID NO: 95677 - RNA, 61 nt, Human
uuguuaagucuuuuacauuuuaauaguuuuugaagacaaucuagguuaagcaagagcaaag

SEQ ID NO: 95678 - RNA, 61 nt, Human
acaucguuuuuuuccauuaaacuuuucuagagaagacaaaagcuuacacuggugacaugga

SEQ ID NO: 95679 - RNA, 61 nt, Human
agaguggugucuagauuuaucagaguaacgagaagacaaacuccggcacuggguuugcucc

SEQ ID NO: 95680 - RNA, 61 nt, Human
uuccuuacccuuuuggagcuugaagcauaaggaagacaaguuauucuguaaggaagauaaa

SEQ ID NO: 95681 - RNA, 61 nt, Human
acagaccugugauuugucaagaugggauuuggaagacaagugaaugcaauggaagauuuug

SEQ ID NO: 95682 - RNA, 61 nt, Human
cuacuacccugguauaggaaagaauccauuugaagacaauguugcaauguugaaugacaaa

SEQ ID NO: 95683 - RNA, 61 nt, Human
uugcauuucuggacccuccacuucaaucugagaagacaauauguuucuaaaaauugguacu

SEQ ID NO: 95684 - RNA, 61 nt, Human
ucuguuauuccagucuuaaauuuuucuaaaagaagacaauauuuuagaacugaagcauuga

SEQ ID NO: 95685 - RNA, 61 nt, Human
ccauggcgaagcaggcguucaagaccauggagaagacaacuccucaucuagaaaaugagga

SEQ ID NO: 95686 - RNA, 61 nt, Human
acugugaugugaaucuuucauuaucuuuaaugaagacaaaggaaucuaguguaaaaaacaa

SEQ ID NO: 95687 - RNA, 61 nt, Human
cacauuuuugcaccucuugugcauucugcaagaagacaaugaauccauguauuucuauaua

SEQ ID NO: 95688 - RNA, 61 nt, Human
gguccccacccuuuuugggaccaguuucauggaagacaauuuuuccguggaugggggaaug

SEQ ID NO: 95689 - RNA, 61 nt, Human
gauuuuacaauugaaaugacuaaaaaacaaagaagacaacauuaaaacaauauuguuucua

SEQ ID NO: 95690 - RNA, 61 nt, Human
gagagagaaagacgaauagaguuaggaaaaggaagacaagcaggugggcaggaaggacaug

SEQ ID NO: 95691 - RNA, 61 nt, Human
uucugaaacucaggccuuaaccaauagguuggaagacaagaccaauugaagaguuaggaaa

SEQ ID NO: 95692 - RNA, 61 nt, Human
aaauuaagaaaguuaaagugcaauaauguuugaagacaauaaguggugguguaucuuguuu

SEQ ID NO: 95693 - RNA, 61 nt, Human
agguuagaaaucucuaccugggugugcccacgaagacaaccaucacacuuaucaauggcac

SEQ ID NO: 95694 - RNA, 61 nt, Human
cauccgccuggauugggagaccuauguuccagaagacaaggaagaccggcugguggagcug

SEQ ID NO: 95695 - RNA, 61 nt, Human
aaaagaugauacagguaagauuggaacucaugaagacaaaagauaagacaguggcauagag

SEQ ID NO: 95696 - RNA, 61 nt, Human
uccaagcuauucaauucuuuuaacuguuguagaagacaaaauguucacaauauauuuaguu

SEQ ID NO: 95697 - RNA, 61 nt, Human
uacgggcaccuaaaagaagcaucucugaccagaagacaaaggcccaaauagcaccuggggg

SEQ ID NO: 95698 - RNA, 61 nt, Human
gaaacuccuccaccugcuucuaaaaugcccagaagacaacuggaccaguuugguauuagaa

SEQ ID NO: 95699 - RNA, 61 nt, Human
uuugaugugaaagauguuauaauaauuucuagaagacaauuugguguaucacaacaugcau

SEQ ID NO: 95700 - RNA, 61 nt, Human
aaacauuuagguuucuguagcauuaaauugugaagacaacuggagugguacuuacugaaga

SEQ ID NO: 95701 - RNA, 61 nt, Human
uuuugucuaaccugaaaaaguuccacauuuggaagacaauuuaaugauggugaagaaauaa

SEQ ID NO: 95702 - RNA, 61 nt, Human
ucagcagcagguuaaagacugaacgguuagugaagacaaaugucuuaagaggcugcgaugu

SEQ ID NO: 95703 - RNA, 61 nt, Human
cgcgcccagcccuggagugauacuuuuuauggaagacaaaagccccccaaaucuguguaaa

SEQ ID NO: 95704 - RNA, 61 nt, Human
aaaauauaaaaaggugauguucaacagaagugaagacaaaacaauaugcaucaggagaaca

SEQ ID NO: 95705 - RNA, 61 nt, Human
ccucuacucugagucacuaucuucccugacagaagacaaggaccaggucuggccugauccc

SEQ ID NO: 95706 - RNA, 61 nt, Human
aaagucuguguucugaguugucagaucucuugaagacaauauuuuucaucacuuauuguuu

SEQ ID NO: 95707 - RNA, 61 nt, Human
caucuuucauuuaauaucaauaucaaaagaagaagacaaacaucuaucuuucucaucuaua

SEQ ID NO: 95708 - RNA, 61 nt, Human
aagaaugaaagcuguuccuugguccuaguaagaagacaaacugcuucccuuacuuugcuga

SEQ ID NO: 95709 - RNA, 61 nt, Human
gaguacuaagauuugguacagaguaugucaggaagacaacucagauugccauuuuaaauaa

SEQ ID NO: 95710 - RNA, 61 nt, Human
ccugaaugaaagaagcaaaugacuauucucugaagacaaccaagagaaaauugcaaaaaga

SEQ ID NO: 95711 - RNA, 61 nt, Human
augaguaauuuugaguuugaaaucucucccagaagacaaacuacuucagugaguaaaagcu

SEQ ID NO: 95712 - RNA, 59 nt, Human
acuuuuauccacauauuacuaauugaaaaaugaagacaaguucuuuguaacuagggacc

SEQ ID NO: 95713 - RNA, 61 nt, Human
aaccacacaccucaccagaauugugcaaauggaagacaaaauguuuucuucaucugugacu

SEQ ID NO: 95714 - RNA, 61 nt, Human
uuagaaacaaacucugagaaguaggcuaagagaagacaagagggccgggcgcggugacuca

SEQ ID NO: 95715 - RNA, 61 nt, Human
gaauacagacaacucagaggacagucgagcugaagacaauuuuaacuuggaaaagguaugc

SEQ ID NO: 95716 - RNA, 61 nt, Human
ucagcaauaggacacgaaaggcauagaaggagaagacaaagugucacgcaguugacugguu

SEQ ID NO: 95717 - RNA, 61 nt, Human
ucaucugaaaaucuggaguugaacagcaaaagaagacaacauuucucaaaugcacaucuca

SEQ ID NO: 95718 - RNA, 61 nt, Human
aaaugcacuucuuccgguuaauuuuuauggggaagacaagugagucacaaacauucuguug

SEQ ID NO: 95719 - RNA, 61 nt, Human
cauguugcuuccaaauuuuguuuuuacuguagaagacaauuaauuuauuguagagaagugg

SEQ ID NO: 95720 - RNA, 61 nt, Human
ccuuuccucuccgucaacauguccucauacugaagacaaacuuguuucaaugauagucuuc

SEQ ID NO: 95721 - RNA, 61 nt, Human
uagagggaaaaaagcauguauugggccaccggaagacaagcuaauaaauaggcuggaagua

SEQ ID NO: 95722 - RNA, 61 nt, Human
gauaaaaguuugaagggcuagauugggauuugaagacaaaauuguaggaaaucuuacauuu

SEQ ID NO: 95723 - RNA, 61 nt, Human
ugugccucaaauuagaauagaacuugaaccugaagacaaugauuauuucuggaggagcaag

SEQ ID NO: 95724 - RNA, 61 nt, Human
cuuugggaguuuaaauuacuucaggggaagagaagacaaaacgagucuuucauucggugug

SEQ ID NO: 95725 - RNA, 61 nt, Human
uugauggacuaauuauuauuuuaaaauauaugaagacaauaauucuacauguugucuuaag

SEQ ID NO: 95726 - RNA, 61 nt, Human
auaugcuucccccccgcuuuuugaugaggaagaagacaauuggauaagaugggacagcacu

SEQ ID NO: 95727 - RNA, 61 nt, Human
gaagccaaagcugcucuugaagaagaaaaacgaagacaacagguaaccaaacaaaauaccc

SEQ ID NO: 95728 - RNA, 61 nt, Human
cuugaagugaaauguuuuacuuuucacuggagaagacaaaacagggugaucuucauguuau

SEQ ID NO: 95729 - RNA, 61 nt, Human
ccuaaccuaagcaaaaccacugagcuucugggaagacaacuaggauacuuucuacuuuuuc

SEQ ID NO: 95730 - RNA, 61 nt, Human
caaguaauaaaagaaauucugcauuugucacgaagacaauuuaugguagacagauaaauac

SEQ ID NO: 95731 - RNA, 61 nt, Human
gagaaguuuucuggaggucucugaacccagggaagacaagaaggaaagauuuuguuguugu

SEQ ID NO: 95732 - RNA, 61 nt, Human
uggcuuuaccaucuuggcuuuaguagguauagaagacaauggauuaccaucuuuauugcug

SEQ ID NO: 95733 - RNA, 61 nt, Human
auaauggccaguuguuuaggaaggccuuuaggaagacaaauaaauaacaaacaaacagcca

SEQ ID NO: 95734 - RNA, 61 nt, Human
ucuuucucuuucuuucuuuuuaaaauauauugaagacaaccagauauguauuugcuacuca

SEQ ID NO: 95735 - RNA, 61 nt, Human
uuacaauuuaugggcuagagccaaauagguugaagacaaucauccaaacagaucaauggaa

SEQ ID NO: 95736 - RNA, 61 nt, Human
ucauggaaauauuaugcaaauucccagauuugaagacaaaaauacucuaauucuaaccaga

SEQ ID NO: 95737 - RNA, 61 nt, Human
uuuaauuuuuuaacaaguggacaguccagcugaagacaaaucagaagauaaauuugcuauc

SEQ ID NO: 95738 - RNA, 61 nt, Human
uuauuuaaaaaucugccuuagauucuauagugaagacaagcauuucaagaaagaguuaccu

SEQ ID NO: 95739 - RNA, 61 nt, Human
ccaaaaacaaagggauuaaagaccuaaauaugaagacaaaacuuuuaaaugagaaucuaua

SEQ ID NO: 95740 - RNA, 61 nt, Human
cuagaguuccuagucucccucacagcacagagaagacaaaauuagcaaaaccccacuacac

SEQ ID NO: 95741 - RNA, 61 nt, Human
uaaugacaaggugauaugguagcaacacugugaagacaaucaugggauuuuacuagaauua

SEQ ID NO: 95742 - RNA, 61 nt, Human
uuuaaaugauugccguacaauuaguagacuugaagacaaguuuuaaauauuuuucuucaaa

SEQ ID NO: 95743 - RNA, 61 nt, Human
gcuaaaggagcaaagccuuguauuaccucuggaagacaacaaaaacaauuggcaacaacaa

SEQ ID NO: 95744 - RNA, 61 nt, Human
guacaaaguuagcucugaagaauaugguaacgaagacaauaaagcaugcacuguaagaacu

SEQ ID NO: 95745 - RNA, 61 nt, Human
cuucaugaaagugggaaucacugaacauguagaagacaaggaacauauuguuaacuccuga

SEQ ID NO: 95746 - RNA, 61 nt, Human
uuaaaaaauggaaauauuugaacuuucuauugaagacaauaaaguacacaagucguuaagg

SEQ ID NO: 95747 - RNA, 61 nt, Human
gcucguguggucuccagcaagggauucgggcgaagacaaacggaugcacccgucuuuagaa

SEQ ID NO: 95748 - RNA, 61 nt, Human
gagucaguuggagagugcauagccagucugugaagacaacugccagauacuggcaauacuc

SEQ ID NO: 95749 - RNA, 61 nt, Human
cugcauugagcagaaagacuuuuguuuuacugaagacaaaagauguuuuuauuuuagaccc

SEQ ID NO: 95750 - RNA, 61 nt, Human
gaagcucuauuuuuguacauuguguuuaaaagaagacaaaaacugaaccaaaacucuuggg

SEQ ID NO: 95751 - RNA, 61 nt, Human
uuguguuacaguacacuuguagccaaaacuggaagacaaaaccaauauauaauuuggcugc

SEQ ID NO: 95752 - RNA, 61 nt, Human
auuccaggaguccuugaagcagagggcacuggaagacaauauagcagauuaaaauagcaca

SEQ ID NO: 95753 - RNA, 61 nt, Human
uaguguuuauguuauuaaucugaaugcaacagaagacaaaagcacaggcaugcacacacac

SEQ ID NO: 95754 - RNA, 61 nt, Human
cuuuuccauaaguggccuuuaagaaaacauggaagacaauucauguuugacaaaugcugac

SEQ ID NO: 95755 - RNA, 61 nt, Human
uuucuucuaucaaauugcuacuuuuguuguggaagacaaaagcauuuccauuucaacgagu

SEQ ID NO: 95756 - RNA, 61 nt, Human
ugaauucaguuaaagguauuuaggguucaaagaagacaaacuguacaagcccauuucauuc

SEQ ID NO: 95757 - RNA, 61 nt, Human
aaccuuuuuugcaucagggaccauuuuuguggaagacaauuuuuccaugggggaagaaggu

SEQ ID NO: 95758 - RNA, 61 nt, Human
aauuugagguguuccagcagcuguuuuuggagaagacaaagaaaauuaaaguuuucccuga

SEQ ID NO: 95759 - RNA, 61 nt, Human
uuguugcucucuauacccgaccuaagguuuggaagacaacugcuuguucccagaggauucu

SEQ ID NO: 95760 - RNA, 58 nt, Human
guaaccgaaaacauggauaagaucccaggaagacaagugcuucuaaaccuucaaagau

SEQ ID NO: 95761 - RNA, 61 nt, Human
uuuucucggugggggguggggaggggggugagaagacaagaugaagaaaagccuuacauuu

SEQ ID NO: 95762 - RNA, 61 nt, Human
agagucagacacuugaaaaaaacuaauguuugaagacaaaaauauuuuggcagucacaaua

SEQ ID NO: 95763 - RNA, 61 nt, Human
gccaucuuuggcauaagaaguauuuugaguugaagacaauugagaaaaaaaauagauuaaa

SEQ ID NO: 95764 - RNA, 61 nt, Human
aggggcuucuaaugacccagauauggaaacagaagacaaaauuguaagccagagucaacaa

SEQ ID NO: 95765 - RNA, 61 nt, Human
gauccgauuuguggaggaugagaaagaugaagaagacaaugagacgguauggaaaugcaga

SEQ ID NO: 95766 - RNA, 61 nt, Human
auugguuugcuuaaaauuaacuuauuuuguagaagacaaaaugaauugcacuucacuuaau

SEQ ID NO: 95767 - RNA, 61 nt, Human
aguuguuguagagaaaacaugcagaacaaaugaagacaaaacauacauuuuguaccaacca

SEQ ID NO: 95768 - RNA, 61 nt, Human
gcugguggccauguucucugaauugggugcagaagacaagggcagaguggcugcggccccu

SEQ ID NO: 95769 - RNA, 61 nt, Human
uacucuugaaucccuguggaaaucuacauuugaagacaacaucacucugaaguguuaucag

SEQ ID NO: 95770 - RNA, 61 nt, Human
ucaauacuuuuuaaagagugucaagggguaugaagacaaaaaauauugauagucacuagag

SEQ ID NO: 95771 - RNA, 61 nt, Human
gaagauuuaugguuaugggucuggcugggaagaagacaacuauaaauacauauucuugggu

SEQ ID NO: 95772 - RNA, 61 nt, Human
caucagaagcuuuaaucaaagaagaugagcagaagacaaucacuggcucccuguuaccaga

SEQ ID NO: 95773 - RNA, 61 nt, Human
aagacaagacaagcacuuauuuuuauuuucagaagacaaaagaaccaagaugccaacuggc

SEQ ID NO: 95774 - RNA, 61 nt, Human
aacucauugucuguuuggaagaccagaaugugaagacaaguaguagaagaaaaugaaugcu

SEQ ID NO: 95775 - RNA, 61 nt, Human
aaauaagacggacagaggagaauuugcacuggaagacaauugccacuuguaaaggaugaaa

SEQ ID NO: 95776 - RNA, 61 nt, Human
ugucuuccaacugcagucuccacagucuucagaagacaaaugcucagguagucacuguuuc

SEQ ID NO: 95777 - RNA, 61 nt, Human
guggaugggagugggaggaggagagaugggugaagacaaaagaguucuuuaugagccucga

SEQ ID NO: 95778 - RNA, 61 nt, Human
uugagaugauuuaaauguaaaccaaaagauggaagacaaaaagacaaacacacccacacgc

SEQ ID NO: 95779 - RNA, 61 nt, Human
uggccuucaguauaugcauagaaugcugcuagaagacaagugauguccuggguccuuccaa

SEQ ID NO: 95780 - RNA, 61 nt, Human
cuugcucucaaggagguuaccuuuaauaaaagaagacaaacccagauagauauguaaacca

SEQ ID NO: 95781 - RNA, 61 nt, Human
gcaguuucauaugguuccaccuaauauuauugaagacaauuauuuucuuagcuaucaauag

SEQ ID NO: 95782 - RNA, 61 nt, Human
aaauuuguugauuuuguaccaaaguguuucugaagacaauaaauugugagucaacuuuaga

SEQ ID NO: 95783 - RNA, 61 nt, Human
ggcacugguuaggcacagcgggaagguuaucgaagacaaaacacauuucuacccaaguuua

SEQ ID NO: 95784 - RNA, 61 nt, Human
uuugaaguaauguuuuaguaaggagagauuagaagacaacaggcauagcaaaugacauaag

SEQ ID NO: 95785 - RNA, 61 nt, Human
cuuggggcggggggagggcaccucagccccugaagacaagcagcacugcaguggcaaaaau

SEQ ID NO: 95786 - RNA, 61 nt, Human
gauacaguuauacauuuuccacuuacaaaaagaagacaauucuguuaaaugaaacguguau

SEQ ID NO: 95787 - RNA, 61 nt, Human
caggugcugccuguuuacucguaccaaaaaugaagacaagccccacacccaccucagcccu

SEQ ID NO: 95788 - RNA, 61 nt, Human
gugagacacacagcuauccuaggagccguaggaagacaaaacuucccuuuuguuuuacucc

SEQ ID NO: 95789 - RNA, 61 nt, Human
uaauuucaggcaauaugcuuaaaaauugggggaagacaaaagaaauccauaucguguaaau

SEQ ID NO: 95790 - RNA, 56 nt, Human
ucacaagccccacccagugagcagcagaagacaagcacucugagaccacacuuuag

SEQ ID NO: 95791 - RNA, 61 nt, Human
gcggaaagccucuguccgccuuuacaagggagaagacaacagaaagagggacaagaggguu

SEQ ID NO: 95792 - RNA, 61 nt, Human
cuuuucugugaaaauuauuauuuuacuuuuggaagacaagauuauuagaauauugaagaaa

SEQ ID NO: 95793 - RNA, 61 nt, Human
acagcuuuucuacuaaaaaauggugagcaaugaagacaauaaauuuuucauuuuuccauag

SEQ ID NO: 95794 - RNA, 61 nt, Human
uacaaaacugccaaaaauauaauucuuaguggaagacaauacucccuuuaaagagaguuug

SEQ ID NO: 95795 - RNA, 61 nt, Human
ucccauauaacuaagacauaugcauuuaugggaagacaaaacaagaaugaaacacuuauac

SEQ ID NO: 95796 - RNA, 61 nt, Human
uuauaacuuauuauggugauuauacaggcaagaagacaaaaaggagagaaaauguaccucu

SEQ ID NO: 95797 - RNA, 61 nt, Human
aaaagaaaauaaaaauuaaauuaaaaaaaaagaagacaaagaaaaccuaaaguuguaucua

SEQ ID NO: 95798 - RNA, 61 nt, Human
uuggccacacuggaagaaaggcaagaaagaggaagacaagucuuggaguacccuggcuguu

SEQ ID NO: 95799 - RNA, 61 nt, Human
uaauguaaaacccaaaacaguaaaaauccuggaagacaacccaggcaguaccauucaggac

SEQ ID NO: 95800 - RNA, 61 nt, Human
gcuaaauuaggcuauaccuagguaaucucuagaagacaacucugacagacucuuuaauauu

SEQ ID NO: 95801 - RNA, 61 nt, Human
gaugggggagaagccuggggaggagggggaggaagacaagaaggaagaggaggaggagaag

SEQ ID NO: 95802 - RNA, 61 nt, Human
ugguuggggacccagauggaacacaaagggagaagacaagcaaauucucuuuucuggaggg

SEQ ID NO: 95803 - RNA, 61 nt, Human
cuuuagguauauuuuguaccaaauuaaauuagaagacaaaaauugugcuuucauaguugcu

SEQ ID NO: 95804 - RNA, 61 nt, Human
gggccucugugagcaccacguaugccugugugaagacaagcgaccaaccugcauucaugcc

SEQ ID NO: 95805 - RNA, 61 nt, Human
gaacuugagcccuguuugggcucaggagauagaagacaaaaucugucucccacgucugcca

SEQ ID NO: 95806 - RNA, 61 nt, Human
aaagggggaggaagggagggcaaagggaugagaagacaaguuucccagaagugccugguuc

SEQ ID NO: 95807 - RNA, 61 nt, Human
uccugucuggggcaucuacuggagcaccucagaagacaaggaggaaaacacuggcucaugu

SEQ ID NO: 95808 - RNA, 61 nt, Human
ugcgguaaggugagcugcacggaaggaauaagaagacaaauggcgcccacuaguggggaau

SEQ ID NO: 95809 - RNA, 61 nt, Human
ggacaggaacaagucugucuucaugagggaggaagacaaugguccuauaaugcccuuggau

SEQ ID NO: 95810 - RNA, 57 nt, Human
gagauauuaccaggcucuagcaacccagaagacaacccuggguagccugugaucagu

SEQ ID NO: 95811 - RNA, 61 nt, Human
gacugaauucuucaaaaaugucaaugucauagaagacaaagaaagguuguggaaauguuuc

SEQ ID NO: 95812 - RNA, 61 nt, Human
cuuugguggcagaacuguagcaauagggggagaagacaagcagcggaugaagcguuuucuc

SEQ ID NO: 95813 - RNA, 61 nt, Human
agagauuuguagauuuaaagggaucacauuugaagacaauaguguuuaagaaagcaagcaa

SEQ ID NO: 95814 - RNA, 61 nt, Human
acucauguaucccaacccuccacagauuucugaagacaaaguuuugcuuggauuaaaacaa

SEQ ID NO: 95815 - RNA, 61 nt, Human
cuggcccgucugggccaacccuuccaugggugaagacaagcaagucccccuggaggcgggu

SEQ ID NO: 95816 - RNA, 61 nt, Human
ugccucuaauuucaccagggauauugacuaagaagacaauaaaaucuuuuucuuuguguaa

SEQ ID NO: 95817 - RNA, 61 nt, Human
aucuauuuauaauucuaauuauuuuguaaaagaagacaaaauuaugaaucuuaaguauuug

SEQ ID NO: 95818 - RNA, 61 nt, Human
ugauuauuugaauaguuuuauauuaauaaaagaagacaaaauuuuuuaaauguuagaaaaa

SEQ ID NO: 95819 - RNA, 61 nt, Human
gaacacuaaaacaguguugauucuugucucugaagacaaauaauuaaaccuuuuuuuuccc

SEQ ID NO: 95820 - RNA, 61 nt, Human
uggugacaaagcuguacagauagagauaauagaagacaaagagauuaaaaggaaauaaaaa

SEQ ID NO: 95821 - RNA, 61 nt, Human
cuuuuauaaccuuuugggcaucuggucgagagaagacaagauuuucucuauuuacagugag

SEQ ID NO: 95822 - RNA, 61 nt, Human
gaaagccuggaguccccaaaccaaggauguggaagacaaauccuguccagccggguggcac

SEQ ID NO: 95823 - RNA, 61 nt, Human
aaugacaucuuccccuuaccuuagccacuaagaagacaagggcuguuacucauauaacuug

SEQ ID NO: 95824 - RNA, 61 nt, Human
ggaggcugcccucugcugccuguuggggucggaagacaaggggcuucugaaaugggaguuc

SEQ ID NO: 95825 - RNA, 61 nt, Human
acacucacagaagccaacuuuccacaggacugaagacaaaguguuucauuuagcuguuacu

SEQ ID NO: 95826 - RNA, 61 nt, Human
uaauguuucaugauuucuaccuccaaagugugaagacaaguaaaacaauguuucuaaauug

SEQ ID NO: 95827 - RNA, 61 nt, Human
acugaaaacaucagccauggccaggcccccagaagacaaaagaagggaccagggaacuggu

SEQ ID NO: 95828 - RNA, 61 nt, Human
aggguugaugcuuacugaccuggugauguuagaagacaaguaguuuauggauuuaaacauu

SEQ ID NO: 95829 - RNA, 61 nt, Human
agaaauaaacaggaguucagcggagcuagcagaagacaaggcauguagggggagccauucu

SEQ ID NO: 95830 - RNA, 61 nt, Human
acaaacaagcucuaagcugcuguagccugaagaagacaagauuucuggacaagcucagccc

SEQ ID NO: 95831 - RNA, 61 nt, Human
uugaguucugcuggacaggagcacuuuaucugaagacaaacucauuuaaucaucuuugaga

SEQ ID NO: 95832 - RNA, 61 nt, Human
gauaaaccucuagcuagcuuaagaacaaacagaagacaaauauugcuaauaccaaaaauga

SEQ ID NO: 95833 - RNA, 61 nt, Human
uucacuaauaaauucugaguaaauuaguggugaagacaaaauauaacuuguuuuagugagc

SEQ ID NO: 95834 - RNA, 61 nt, Human
cucuuucaugaagagcuuagcuaugaccuuagaagacaaagccuguuugucauggcugccg

SEQ ID NO: 95835 - RNA, 61 nt, Human
uugguuuuuugauuucuauucccuaacuugugaagacaaugaaaaaucaggcagaaauauu

SEQ ID NO: 95836 - RNA, 61 nt, Human
uggcagauacgugacugccacaauaugcaucgaagacaaacuuacuauaaagauguugugg

SEQ ID NO: 95837 - RNA, 61 nt, Human
gaccuuuuuuguccaguuucuuugggggaaggaagacaaagaagguaggaacggaauuuug

SEQ ID NO: 95838 - RNA, 61 nt, Human
aucuucugccacagucucucagauagcucaugaagacaaucaccugccucaccuucuaggu

SEQ ID NO: 95839 - RNA, 61 nt, Human
cacucccuuccuuguguucuccuugggagcagaagacaagcuguugggaccugacgcuuuu

SEQ ID NO: 95840 - RNA, 61 nt, Human
agcaagugcuucauugcauggaaaacacuuugaagacaaaaaagaaaucuuauuucuuuuu

SEQ ID NO: 95841 - RNA, 61 nt, Human
aaaggcuucuauuuggaggaagaaaaauuaagaagacaacuuacaaaaucaagaugacaac

SEQ ID NO: 95842 - RNA, 58 nt, Human
guuccaucuucggacguugauucuuacugaagacaaccuguggaauagaagcuggauu

SEQ ID NO: 95843 - RNA, 61 nt, Human
gauaaaccucuagcuagauuaagaaaaaacagaagacaaauacugcuaauaccaaaaguga

SEQ ID NO: 95844 - RNA, 61 nt, Human
gugcugagagccaguugcugcccugagaagagaagacaaccuccaucuauuuauugcuucc

SEQ ID NO: 95845 - RNA, 61 nt, Human
cauaaaaccuuaaaguucuguugguaucacagaagacaaggcagaguuuaaagugaggaau

SEQ ID NO: 95846 - RNA, 61 nt, Human
ccuucaccacaggguuucguuuugcuggcuugaagacaaauggucuuagaauucauugaga

SEQ ID NO: 95847 - RNA, 61 nt, Human
aacauuugcuggcgagaguccugucugcugagaagacaauauuguggcucguccugauauu

SEQ ID NO: 95848 - RNA, 61 nt, Human
ucuucaguuggagucucccaaauuuaauguggaagacaaaguguuggaaaaucaaaagagg

SEQ ID NO: 95849 - RNA, 61 nt, Human
caggccugcccugucccgaagugaucuccuggaagacaagugccuucucccuccauggauc

SEQ ID NO: 95850 - RNA, 61 nt, Human
gccucugucuucuggacugguuuucacauuagaagacaauugacaacaguuacauaauuca

SEQ ID NO: 95851 - RNA, 61 nt, Human
gcauaggguuuuuuaaugcagaauuuugucagaagacaauggcgcugcauguuuuucuuug

SEQ ID NO: 95852 - RNA, 61 nt, Human
gaggccaaaucuguaaaaucaaaaugagguugaagacaauuagugaaaguaauguuauagu

SEQ ID NO: 95853 - RNA, 61 nt, Human
gaauagagcuauuuuuuuaacaaaacaaaaugaagacaaaaauauggacugauguauccuc

SEQ ID NO: 95854 - RNA, 61 nt, Human
agaaaccuuuaaccacaaaguuuuuaucauugaagacaauauugaacaacccccuauuuug

SEQ ID NO: 95855 - RNA, 61 nt, Human
gcaccaacauguaaccggcauguuuccagcagaagacaaaaagacaaacaugaaagucuag

SEQ ID NO: 95856 - RNA, 61 nt, Human
uaugggagagagggacugccacacagaagcugaagacaacaccugcuucaggggaacacag

SEQ ID NO: 95857 - RNA, 61 nt, Human
ugcaguggaaagagcacugaacuaggaguuggaagacaaggaugugguccuggcucugcca

SEQ ID NO: 95858 - RNA, 61 nt, Human
cacucacauuucuggaacuagcuauuuuucagaagacaauaaucagggcuuaauuagaaca

SEQ ID NO: 95859 - RNA, 61 nt, Human
agauauugccuguagucuaaagaucucuuuggaagacaaagcauuggcuauauaucuuuug

SEQ ID NO: 95860 - RNA, 61 nt, Human
ggacucaacaggacauauguggccuugaagggaagacaaaacuggauguucuuucuuguug

SEQ ID NO: 95861 - RNA, 61 nt, Human
augaaauuugcaaaaucacuuagcagcaacugaagacaauuaucaaccacguggagaaaau

SEQ ID NO: 95862 - RNA, 61 nt, Human
ucucacaguguggggcagccguccuucuaaugaagacaaugauauugacacugucccucuu

SEQ ID NO: 95863 - RNA, 61 nt, Human
ccuuacuugccgagccguuuguuuagguagagaagacaaguccaaagagugugugggcuuu

SEQ ID NO: 95864 - RNA, 61 nt, Human
ggacuagugaaccacagcucaaaaggcaaaagaagacaaaagccccccaggauguagaaau

SEQ ID NO: 95865 - RNA, 61 nt, Human
ggagacuuccuuaaggagaugugacauaugggaagacaacagauucagaaauuuacgugga

SEQ ID NO: 95866 - RNA, 61 nt, Human
cggccacugggcuaccucuccuucagucccagaagacaagucucaccaacccagggaguca

SEQ ID NO: 95867 - RNA, 60 nt, Human
ucuuggggaacaauuccuaaagaagaaagggaagacaauuuacaaacuccaagcacuaaa

SEQ ID NO: 95868 - RNA, 61 nt, Human
cauauuuaacauuuuguauuucaauaaaagugaagacaaacgaacugugucuuuuucuaau

SEQ ID NO: 95869 - RNA, 61 nt, Human
gugaacauuugguccauaugaaaaugaccaggaagacaauuaggugaagguuuuuuaauga

SEQ ID NO: 95870 - RNA, 61 nt, Human
gauccugaugggucucuaagguucccuccaagaagacaaggacaggagacuugggaaggac

SEQ ID NO: 95871 - RNA, 61 nt, Human
ucaugauugccaugggccacuuuauuuacaugaagacaacuggagaacgacuaagaccaaa

SEQ ID NO: 95872 - RNA, 61 nt, Human
cacacauggcuuaagugacaaagccagaggagaagacaacccugacagcaucacgcugcau

SEQ ID NO: 95873 - RNA, 61 nt, Human
uaucaacuuuaaucaaguuguaacuuauauugaagacaauuugauacauaauaaaaaauua

SEQ ID NO: 95874 - RNA, 61 nt, Human
auugcaagaguaaaacuuauuuagagcuacagaagacaaaacccugaagaguuaagaacaa

SEQ ID NO: 95875 - RNA, 61 nt, Human
cuauugguuuggacaucuguagaauauauaugaagacaauuucuguaaugguuuuaagaga

SEQ ID NO: 95876 - RNA, 61 nt, Human
ucacaguaaggagugacaaguuuauaauaaggaagacaaaguuuaacaccuucacucaagc

SEQ ID NO: 95877 - RNA, 61 nt, Human
gcuauuuuuugaagaugaugaacuaaauguugaagacaaguuugagaucuguaaaauguga

SEQ ID NO: 95878 - RNA, 61 nt, Human
gaaaggacagaaaaaaaugaagaaaggaaaggaagacaaauguaaagaaauaaggaaaaaa

SEQ ID NO: 95879 - RNA, 61 nt, Human
uaaaaauaaaauaaagugauaccuuuacaaugaagacaaaaguuuaaaacuuucuaauaca

SEQ ID NO: 95880 - RNA, 61 nt, Human
agacagccugaguuuggaguggaauaagguggaagacaaaugucucuguucuuuggcccuu

SEQ ID NO: 95881 - RNA, 61 nt, Human
gugucguuuuugccacuagaugagauuaaaagaagacaauuauucaaagccaucacaaaac

SEQ ID NO: 95882 - RNA, 61 nt, Human
ugagcgcucacagcuucauuuggcccagguugaagacaaggaaagcucugcuguggcugcc

SEQ ID NO: 95883 - RNA, 61 nt, Human
auggaugugauaguggaaggaauuguggauggaagacaagcagaaaagcugaagacaauag

SEQ ID NO: 95884 - RNA, 61 nt, Human
gaauuguggauggaagacaagcagaaaagcugaagacaauaguuccucagacagaccucaa

SEQ ID NO: 95885 - RNA, 61 nt, Human
ucaguaaauaccuugaaaugcuuagacucuugaagacaacucugaaaagugggcugugacu

SEQ ID NO: 95886 - RNA, 61 nt, Human
agcaagcugagaaccugggaauuccugcacggaagacaagagaguagccucuccaguuuca

SEQ ID NO: 95887 - RNA, 61 nt, Human
agcaauuuuuuuucaauuuuaaaagcugaaugaagacaacuuagguugcuaaccuaguuca

SEQ ID NO: 95888 - RNA, 61 nt, Human
guggcucaugccugaaauccuagcacuuugggaagacaaugugggagaauggcuugagccc

SEQ ID NO: 95889 - RNA, 61 nt, Human
uggcccuggaugucacacucccaccagggcugaagacaaggauguuccaaaaccccaccuc

SEQ ID NO: 95890 - RNA, 61 nt, Human
uagccccuuuucaguuucuuaucguguacaagaagacaaacagaaauucaauugaugaaau

SEQ ID NO: 95891 - RNA, 61 nt, Human
gggugaguccuauugcaauaugaccgacaaagaagacaaaauagcauugaaacuaacccau

SEQ ID NO: 95892 - RNA, 61 nt, Human
auuguaaacuuguauaaaauuaucuuggugagaagacaaauuguaaaguagauauuuguaa

SEQ ID NO: 95893 - RNA, 61 nt, Human
agcuuagaauugggaggauacuuaacaucuggaagacaaguucauuucaucuugagaucau

SEQ ID NO: 95894 - RNA, 61 nt, Human
uuugguugcucuauagucaaacagcucuuuugaagacaacugucuuauuuuauuacaaauu

SEQ ID NO: 95895 - RNA, 61 nt, Human
accuaaccuuuuuguuuggggcaccaaaucugaagacaaaauuaauuugcaccaguaaacu

SEQ ID NO: 95896 - RNA, 61 nt, Human
ucauuuggucagcacuagaacaguaucuucugaagacaaaacugaaugcuauagcuuugaa

SEQ ID NO: 95897 - RNA, 61 nt, Human
uuauuuugugguaauauaguaaguuuuuuuagaagacaauuuucauaacuugauaaauuau

SEQ ID NO: 95898 - RNA, 61 nt, Human
aaaaucuuuuacuaaccccaugauaaaaggagaagacaacagugagcuuagaauaucuaua

SEQ ID NO: 95899 - RNA, 61 nt, Human
cuacaacuuuaauagaagacuacuaauaacagaagacaaauuagugaagaaaagacggagu

SEQ ID NO: 95900 - RNA, 61 nt, Human
guaucagucaccauuuuaauauggggacaaugaagacaagcacacaggagguagaauauca

SEQ ID NO: 95901 - RNA, 61 nt, Human
aaaacuaacaugcuagauaauccagugucgggaagacaaagauguuuugcuucucugaaga

SEQ ID NO: 95902 - RNA, 61 nt, Human
cccuuuauaaauccaaguagauaggaagaaagaagacaaacuuugcaucucaguaugaauu

SEQ ID NO: 95903 - RNA, 61 nt, Human
cuuuuuugaaucugucauucacauacccugugaagacaauacuaucuacaauuuuuucagg

SEQ ID NO: 95904 - RNA, 61 nt, Human
agggaaauggcuucagaaaugguuugaguuggaagacaacauucuucaucucucaggacuu

SEQ ID NO: 95905 - RNA, 61 nt, Human
uuuugucuagguuuucuuucugcucuuuauugaagacaaacacucaccaaaaagaaaaaua

SEQ ID NO: 95906 - RNA, 61 nt, Human
ugcacugauuuuucuauaccuuagguggucagaagacaaccuugaaugcacucauagagaa

SEQ ID NO: 95907 - RNA, 61 nt, Human
cuucucuacaggaaucucuggaaaacuaucagaagacaaaguuugacaccuugauacccac

SEQ ID NO: 95908 - RNA, 61 nt, Human
cuuaacagacuacgguggacaaacugaucaagaagacaaaccuggccuugguuguggggac

SEQ ID NO: 95909 - RNA, 61 nt, Human
uuucucuguugaggaugcguguuccucaguagaagacaagcagguggaggcauccagugau

SEQ ID NO: 95910 - RNA, 61 nt, Human
uuccucgggcucuucaggagacugagacagagaagacaagugaaagcgcagccuguacaug

SEQ ID NO: 95911 - RNA, 61 nt, Human
cauuuuuuuuuuuuuuuuaaagacagguuacgaagacaaagucccagaauuguaucucaua

SEQ ID NO: 95912 - RNA, 61 nt, Human
cuuagcuacagugaaguuuugcauugcuuuugaagacaagaagauaagugcuagaauaaau

SEQ ID NO: 95913 - RNA, 61 nt, Human
ucagcuguuuuacaaaagcuuuucauuaucugaagacaaaaccgaaaaagccaaaauuacc

SEQ ID NO: 95914 - RNA, 61 nt, Human
uguagaaucacuuuguagauauggagaugaagaagacaaaucuuuauuauaauauugauca

SEQ ID NO: 95915 - RNA, 61 nt, Human
uauuuaugucuauuuauauguaaaugucauugaagacaaaggucaaauauuugucuguuug

SEQ ID NO: 95916 - RNA, 61 nt, Human
cccaccagccacagugcccauguccccucuggaagacaaacuaccaauuucucguuccuga

SEQ ID NO: 95917 - RNA, 61 nt, Human
aacuaaggguugccucuagugaaaaggauuggaagacaauuuaucugaugcuacacuauuc

SEQ ID NO: 95918 - RNA, 61 nt, Human
cucugcuuccagacuucagaaacaaaucucagaagacaagcugaccugacaaguacuaugu

SEQ ID NO: 95919 - RNA, 61 nt, Human
gaaacaaaaaacaaacaaacaaacaaaaauagaagacaaaagaaagacauaugaaaggaau

SEQ ID NO: 95920 - RNA, 61 nt, Human
uuauaaagagagauauuuauguacucucuaagaagacaaaugaggucauaaacacugcaua

SEQ ID NO: 95921 - RNA, 61 nt, Human
ccuucuagagacaaccggcagugaccucacugaagacaaaaacugcccuagccagguacug

SEQ ID NO: 95922 - RNA, 61 nt, Human
cauuuaauuucacuggugggagguagaccuugaagacaaugaagagaaugccgauacucag

SEQ ID NO: 95923 - RNA, 61 nt, Human
cuuuucaccauaauuuaauuuaguggaaaaagaagacaaugcuuuccauauugugauaagg

SEQ ID NO: 95924 - RNA, 61 nt, Human
auacacacaggagucagugcccauguguauggaagacaaauacacauacauauauacauuu

SEQ ID NO: 95925 - RNA, 61 nt, Human
aaggagauuuacaacugggggagggugaagugaagacaaugacuuacuguacaugaaaaca

SEQ ID NO: 95926 - RNA, 61 nt, Human
gaaugagaugugacucuacagauaccucauagaagacaauccaagaucauacuucauuaac

SEQ ID NO: 95927 - RNA, 61 nt, Human
gguaaauggcauaaauauggucgcacuaauggaagacaaauggcaaaucuugaaauagaau

SEQ ID NO: 95928 - RNA, 61 nt, Human
uucuuaugccuuuuaaaauacuguuuacuaugaagacaauguuuuuaauuacaaauccaga

SEQ ID NO: 95929 - RNA, 61 nt, Human
ugcuguuaccaucaacaucuguuuuauuaccgaagacaauuaguacacagacaugaacugu

SEQ ID NO: 95930 - RNA, 61 nt, Human
ccccuugaacauccagcaguguuauuuuacagaagacaaauuaacugaaggcuuuucuuuu

SEQ ID NO: 95931 - RNA, 61 nt, Human
ccaggcggcagagagagacaaucaaaaccuggaagacaaagugcguuccuuaaagacagac

SEQ ID NO: 95932 - RNA, 61 nt, Human
acaaacaaaaaauauguuuuucuguuauuuugaagacaaaauuauuuuugcuugguugcau

SEQ ID NO: 95933 - RNA, 61 nt, Human
uguguguuuucuaucucggaucccagucucugaagacaacuugcuuugauucaaccuagaa

SEQ ID NO: 95934 - RNA, 61 nt, Human
gcuuccaaaauuagcaucucauugagccagagaagacaaggagaucucccucugggcaucu

SEQ ID NO: 95935 - RNA, 61 nt, Human
cccagcuauguacaacgaagcugucgaaggagaagacaauaaagucgcuccgcagcugcuc

SEQ ID NO: 95936 - RNA, 61 nt, Human
cccuauuuuccucuuaauaauacguuugggugaagacaaauuaguguuuaguaauugcauc

SEQ ID NO: 95937 - RNA, 61 nt, Human
gaccuuuucuucauccaaaacaaggugaugggaagacaaaaacaauagcuacuacaaacaa

SEQ ID NO: 95938 - RNA, 61 nt, Human
cgaagacacuccuucuguccccaccugcuccgaagacaaaccaaccuccguuucuuuuaua

SEQ ID NO: 95939 - RNA, 61 nt, Human
uaguaauaaaaccuuaucucaauagccacaagaagacaaacgugaucaccacacacuugca

SEQ ID NO: 95940 - RNA, 61 nt, Human
ucagcuggaccgugugccccuuugggaggaagaagacaagccccacuagggccaagggcag

SEQ ID NO: 95941 - RNA, 61 nt, Human
gagaugagagagaagguccgaguaggugauagaagacaagggggagaccgagccggaggcu

SEQ ID NO: 95942 - RNA, 61 nt, Human
ccagcuuggacucacaucauucuaugggguugaagacaacucauucccucugaggagccuu

SEQ ID NO: 95943 - RNA, 61 nt, Human
aaugaguauuccugcuaugcucagggccaaggaagacaaaucuaggucauggcaguugaaa

SEQ ID NO: 95944 - RNA, 61 nt, Human
gcaacaaacccuugaauuucuauuuguauucgaagacaagucauuccuauuauuauagaau

SEQ ID NO: 95945 - RNA, 61 nt, Human
aaaugugguuugguuccugaccuaggcuugggaagacaagccagcgaauaaaggaugguug

SEQ ID NO: 95946 - RNA, 61 nt, Human
cuaacugcacuuuggaaaccaagcaaggggagaagacaaaugaagaaaaacuagacagaga

SEQ ID NO: 95947 - RNA, 61 nt, Human
cgucuugcuuuugguuuccagcuggagaaaagaagacaagaaagucuugggcaugaaggag

SEQ ID NO: 95948 - RNA, 61 nt, Human
aaacguagacucugugcagcuuugaagccuggaagacaauaccuaccaacaugucaaagcc

SEQ ID NO: 95949 - RNA, 61 nt, Human
cuaucagccccuguaccccacacugcccucugaagacaacacaggcuccugcuuccaccuc

SEQ ID NO: 95950 - RNA, 61 nt, Human
cucacugggaauguguuuugaaaaugaauuugaagacaagccaacaaacccugcacuccaa

SEQ ID NO: 95951 - RNA, 61 nt, Human
uccugaggcugccuggccuugaucaacuugggaagacaaaauugagccauuaucuccucuu

SEQ ID NO: 95952 - RNA, 61 nt, Human
acauguauauaauguauuucuuuuguacagugaagacaaaaaaaaugaaaacucuuccuau

SEQ ID NO: 95953 - RNA, 61 nt, Human
uacaguuaacuauuuucggaguguggugauugaagacaauuucaucaucccacuguacuuu

SEQ ID NO: 95954 - RNA, 61 nt, Human
ggagggacagggauaaauaaaggcaaagacugaagacaaacaugggaggagaagugacugg

SEQ ID NO: 95955 - RNA, 61 nt, Human
ggggcgugguuggggcaaggggcauuacugggaagacaauggccauuguguugggaccugu

SEQ ID NO: 95956 - RNA, 61 nt, Human
aacagagccaggaacccuacugcaguaaacugaagacaagaucucuucccccaagaaaaag

SEQ ID NO: 95957 - RNA, 61 nt, Human
aguucacuccaaaucaguagagaguaauauugaagacaaaauauuugggaaaaccuaucgg

SEQ ID NO: 95958 - RNA, 61 nt, Human
guggggggcgugccucucagaaacgcggccagaagacaagcagggaagugaaaggucccag

SEQ ID NO: 95959 - RNA, 61 nt, Human
auugcugauaguggcugagaaauucagaugagaagacaaauugguuaugaauuuugaaaua

SEQ ID NO: 95960 - RNA, 61 nt, Human
aaacauuuugaaggaaaauuaaaccaaugaagaagacaaagucuaaggaagaaucggccag

SEQ ID NO: 95961 - RNA, 61 nt, Human
uacuuugcaggaaucaaaauuguuuuauucagaagacaaagucccugaccccucugguuuc

SEQ ID NO: 95962 - RNA, 61 nt, Human
acuucguggcuaagguaagaacgugcuuguggaagacaagucuguggcuuggugagucugu

SEQ ID NO: 95963 - RNA, 51 nt, Human
guaugaacugcauguuuuaaagaagacaaaugcaaaccaaagcaacuuagu

SEQ ID NO: 95964 - RNA, 61 nt, Human
gcaccgcgagacaggccaggcucguggcucggaagacaaaccccacacacacucaaggggu

SEQ ID NO: 95965 - RNA, 61 nt, Human
uugggaguauauuggucaggaucauagaaaagaagacaaagcuugcucagccaugagaugg

SEQ ID NO: 95966 - RNA, 61 nt, Human
agaaauuuuugaggaugcaaagcuuuucugugaagacaagucuucacaucuuguuuucaua

SEQ ID NO: 95967 - RNA, 61 nt, Human
gcacuuguuuauuuauaggagccagcccucagaagacaaacacaaugcaaaacauuuccuu

SEQ ID NO: 95968 - RNA, 61 nt, Human
aaauggugugcuauaaagauaaaggugaggggaagacaaagcacaccauauguccacuguu

SEQ ID NO: 95969 - RNA, 61 nt, Human
aaucagcacucaggucuuuuucuucagaaaugaagacaaaauuuaaaauaugaaaugaugc

SEQ ID NO: 95970 - RNA, 61 nt, Human
gugugugaauugcauucaucacaaagauauugaagacaauaaauaaucuuuauaacaaacu

SEQ ID NO: 95971 - RNA, 61 nt, Human
aagaagaagaaauaaaaacccacccaagcaagaagacaaaagguaaagacgcaacguuucc

SEQ ID NO: 95972 - RNA, 61 nt, Human
agaaauugcauugacauugugagcuggcucagaagacaaaccaauuaagauguagauagaa

SEQ ID NO: 95973 - RNA, 61 nt, Human
ccaacaugaugcaguuaucuugcauacaacugaagacaacuaacccuuuccccaacagagc

SEQ ID NO: 95974 - RNA, 61 nt, Human
cauccccacauaacacaaaaagcagccuggggaagacaaucaagcuacaggcacugauaag

SEQ ID NO: 95975 - RNA, 61 nt, Human
cugauggguccugggccaggccagccagggagaagacaaggccccagcccuccucugggag

SEQ ID NO: 95976 - RNA, 61 nt, Human
aguccagugugggaugaaaauauaaacagaggaagacaacauaugucacuggggaggcugg

SEQ ID NO: 95977 - RNA, 61 nt, Human
cgcugggccugcgccagagugaggggugcaggaagacaaagacgcgugcucacuuuagaaa

SEQ ID NO: 95978 - RNA, 61 nt, Human
agaaaauauaagcuuuuaaaguauuuauuuugaagacaaacauuacaaauaaaagaggauu

SEQ ID NO: 95979 - RNA, 61 nt, Human
ccaaucgcuuuccuggaggagcgccaaccucgaagacaacucagcacugggcggguucccc

SEQ ID NO: 95980 - RNA, 61 nt, Human
caauggauuuaucccacugaacaauuugaaugaagacaauguggaauggcuuugagauaca

SEQ ID NO: 95981 - RNA, 61 nt, Human
ucuacaagcagauuucuuuucuuuuaguuuagaagacaaaaaauuucaauacagauacuuc

SEQ ID NO: 95982 - RNA, 61 nt, Human
cuccaucaccccuucugccaugugaaagggagaagacaaacauccacgaaccaggaagugg

SEQ ID NO: 95983 - RNA, 61 nt, Human
gggguugggggggcacaagguuuuggaggaagaagacaacuucccucauuccaucaucacc

SEQ ID NO: 95984 - RNA, 61 nt, Human
cucacucccucccuuguccuuacacauacaggaagacaagaccugaguggugcugucuuug

SEQ ID NO: 95985 - RNA, 61 nt, Human
ggcuucugcaagcugcacagaacugggguaagaagacaaagaguagccaccgggagaggcu

SEQ ID NO: 95986 - RNA, 61 nt, Human
ugucccuggggcagacacuaaggcagguguugaagacaagcugcuugucaagaagcauuuc

SEQ ID NO: 95987 - RNA, 61 nt, Human
ugaggcuucuggugacaucauucaagggagugaagacaaucagaacuuugagaguucagag

SEQ ID NO: 95988 - RNA, 61 nt, Human
acgguggguaaaggaugugggcagcagcagggaagacaacagaaacacaaggaggcggcug

SEQ ID NO: 95989 - RNA, 61 nt, Human
uuugggguucuucuauuuacuuuguuuucucgaagacaaacuuuccucuaugucuggaaaa

SEQ ID NO: 95990 - RNA, 61 nt, Human
guuucaaggcaauauuuuuuuugaggcugccgaagacaaaugacaggauuaugaguauaca

SEQ ID NO: 95991 - RNA, 61 nt, Human
uucuuggggagguaauuucagauacgaaugagaagacaaguuuggacauagcccagaaaau

SEQ ID NO: 95992 - RNA, 61 nt, Human
ggguguggcaguuacagggcccaggugagcugaagacaaaccacuguacauauauaugccu

SEQ ID NO: 95993 - RNA, 61 nt, Human
ccagcuuguggcauucccaugugacuggggagaagacaaaauugguguuuagauucuggag

SEQ ID NO: 95994 - RNA, 61 nt, Human
ccaaguuugcugagaguuaggagcacuuggugaagacaaggccgucaggacccaccauguc

SEQ ID NO: 95995 - RNA, 61 nt, Human
gcagccucgaccuggucacuuuauuuccauagaagacaauaagguucugggaacacauaaa

SEQ ID NO: 95996 - RNA, 61 nt, Human
gcaucaugcacugaugcugcuugcaaaaaaugaagacaaaauacucagaaguugcauuugc

SEQ ID NO: 95997 - RNA, 61 nt, Human
uuugaccagugguccccaguaccaggccagcgaagacaacuuuauaaugucauuuguguug

SEQ ID NO: 95998 - RNA, 61 nt, Human
uauacaaacuuacgaaacaugcauagcauuagaagacaagaauguaucaagacacacaggu

SEQ ID NO: 95999 - RNA, 61 nt, Human
cagccugcgggaaggugguauggccggcugugaagacaacagcagcugaggccgaugcuaa

SEQ ID NO: 96000 - RNA, 61 nt, Human
aaacuggcaacaucuuacagacuacugacuugaagacaaccucuuuuauauuucucuauuu

SEQ ID NO: 96001 - RNA, 61 nt, Human
acaggucuucuuuccugccagagggagcucugaagacaacuagagaauucugggccugaaa

SEQ ID NO: 96002 - RNA, 61 nt, Human
caagcccugaggagggaucugcaacaacccugaagacaacaaggaaagaaaccaugaaagu

SEQ ID NO: 96003 - RNA, 61 nt, Human
cagguggccuuggagaggaaagaggaacggugaagacaagcugcgagagcugggagcugga

SEQ ID NO: 96004 - RNA, 58 nt, Human
uaggagaugggcagccauaaguuaaaaagaagacaagcugaagcuacacacauggcug

SEQ ID NO: 96005 - RNA, 52 nt, Human
aagggaaaccacagcuuuaaacgaagacaaccaaaagaaugcaaacuggauu

SEQ ID NO: 96006 - RNA, 61 nt, Human
ggaggaugagguuguccugaggggcuccaaagaagacaauaguucccacucaugauuuucc

SEQ ID NO: 96007 - RNA, 61 nt, Human
ugauccaguucuaagugucaucuuuuauuaugaagacaauaaaaucuugaguuuauguuca

SEQ ID NO: 96008 - RNA, 61 nt, Human
ucagcugcugcaaugaggaaaugggcaucuggaagacaaacagcaacucucagcuugcuuc

SEQ ID NO: 96009 - RNA, 61 nt, Human
ucccaaaacagggaacugacugucugguagugaagacaagcaaguggagaaguuauacgau

SEQ ID NO: 96010 - RNA, 61 nt, Human
ucuuauaaaauacaacacaugcauaaaaauagaagacaaucugcuuguuucugaauguaug

SEQ ID NO: 96011 - RNA, 61 nt, Human
guuuggggaaagaguugcaguaaaguuccaugaagacaaauaguguggagugaggcgggga

SEQ ID NO: 96012 - RNA, 61 nt, Human
uuauaggugaagagcaaccacaaguuuaaaugaagacaagcugaaacaacgcaagcugguu

SEQ ID NO: 96013 - RNA, 52 nt, Human
acaggcaaccacagguuuaaaugaagacaagcugaaacaacacaaaacuguu

SEQ ID NO: 96014 - RNA, 61 nt, Human
ccauucccuuacaccuaccccaccuacaacugaagacaaugcacuuuacagauaucaccca

SEQ ID NO: 96015 - RNA, 61 nt, Human
gcuugagcaggguucccaggagggagaaagagaagacaagagccugaugcccaacuuugug

SEQ ID NO: 96016 - RNA, 61 nt, Human
auucuacgugcagcggguucucugccuccgugaagacaagcugggcuggggagaacggugu

SEQ ID NO: 96017 - RNA, 61 nt, Human
uucuuuucuccccuugggucuuauuauaaaagaagacaauguacguuguaauuaccaaaaa

SEQ ID NO: 96018 - RNA, 64 nt, Human
gccaccucagcugcagggaggcagaaggcaaggcaggccccacggacacacuugggcugcucug

SEQ ID NO: 96019 - RNA, 64 nt, Human
uucccaggggccgcagggacgacacucuccagggaggccccagcaaccacaccaucuucuugcu

SEQ ID NO: 96020 - RNA, 64 nt, Human
gcaagcccaguuucuccugagcauucagacccccaggccccagcacuuggcguuuucaggaggc

SEQ ID NO: 96021 - RNA, 64 nt, Human
cccaaaacacggccccgacacuuaguguggccccaggccccagcgagccucgcccucccaguuu

SEQ ID NO: 96022 - RNA, 64 nt, Human
aaggcaagguccggcccauccccaggcaccucacaggccccaggaaaggcccagccaccgaagc

SEQ ID NO: 96023 - RNA, 64 nt, Human
auccaggccgcccagcagcugcugugugaugagcaggccccacagaggcagaggcugcuggcug

SEQ ID NO: 96024 - RNA, 64 nt, Human
gcccuggcucuccagaaccuucuaucccacagucaggccccagagagggcaggacaagccuugu

SEQ ID NO: 96025 - RNA, 64 nt, Human
ucccuccccuaaacugacuggacggcugccaaggaggccccaaacccaggccccaugcaaaggc

SEQ ID NO: 96026 - RNA, 64 nt, Human
cugacuggacggcugccaaggaggccccaaacccaggccccaugcaaaggcacgugguuuccuu

SEQ ID NO: 96027 - RNA, 64 nt, Human
ccggcagagccuuccugcguuugcagcagagaggaggccccacagcuugcccuuugcccuccau

SEQ ID NO: 96028 - RNA, 64 nt, Human
gauuugagacuguucucaaagggauugggaacgaaggccccaucucgggcagacccccagcaga

SEQ ID NO: 96029 - RNA, 64 nt, Human
gcaguccaguguuugccgcgguucccgcacggucaggccccaggacuggcuugcgagccccggg

SEQ ID NO: 96030 - RNA, 64 nt, Human
ccccacccugccgagaggacuaguauggggugggaggccccacccuucuccccuaggcgcuguu

SEQ ID NO: 96031 - RNA, 64 nt, Human
ccggccugggauccaggcuaagggccggcggaagaggccccaauggggcggugaccccagccuc

SEQ ID NO: 96032 - RNA, 64 nt, Human
cggcccacuggcagacacagacccaggcagcaccaggccccagcucccuccgggggcccuccag

SEQ ID NO: 96033 - RNA, 64 nt, Human
aaucuccuacccccagaaaaggggugcuggaaggaggccccaguggacucuuuguacccuuccu

SEQ ID NO: 96034 - RNA, 51 nt, Human
agaaagccaagaagccgugagaggccccacggggugugggcgacgcuguua

SEQ ID NO: 96035 - RNA, 64 nt, Human
ggaacaagccccagaggcaguauuugauuuccucaggccccacucuaggacaggaggcaccauc

SEQ ID NO: 96036 - RNA, 64 nt, Human
auauauuuuuaauuuuguagcguguggcugggccaggccccagcgggaggggcugagcuggggc

SEQ ID NO: 96037 - RNA, 64 nt, Human
aguucuuggugcccucuucggcagccaagggugaaggccccauagaggagaggauccaaaggag

SEQ ID NO: 96038 - RNA, 64 nt, Human
gugacccuugccucuuccugauacucccaagagcaggccccaggggucugugucacauaucucu

SEQ ID NO: 96039 - RNA, 64 nt, Human
cccucaugauuaggauuagugcccuuauuuaaaaaggccccagagagcuaacucacccuuccac

SEQ ID NO: 96040 - RNA, 64 nt, Human
cuguaccuacaauagccccucccucuuccuuugaaggccccagcaccucugcccuguggucacc

SEQ ID NO: 96041 - RNA, 64 nt, Human
uuggggucagggaggggcugggaagggcuacugaaggccccauucucccacaggauggugaggc

SEQ ID NO: 96042 - RNA, 64 nt, Human
cugccuguacuggaucuguuauuuucagggaaacaggccccagggccccccugagccucacccu

SEQ ID NO: 96043 - RNA, 64 nt, Human
uuaugaugaaaguccaaaaguggcauccaauuuaaggccccaucuuucguugccauucuucauu

SEQ ID NO: 96044 - RNA, 64 nt, Human
ucaagaccaagcggucagaaggccugaggacccaaggccccacuggagcagucuguccuuaugc

SEQ ID NO: 96045 - RNA, 64 nt, Human
ccuuggugagaaagggauugcugaggcaccguccaggccccaccggccaggccgcgcccagcag

SEQ ID NO: 96046 - RNA, 64 nt, Human
cuagcuccuugcuggcccccacaugccccaugcuaggccccaauguucagagcugggacuugag

SEQ ID NO: 96047 - RNA, 64 nt, Human
auugucaaggccuccuuggcucuggagcuaugaaaggccccacuuucaagucacccuugccacu

SEQ ID NO: 96048 - RNA, 64 nt, Human
uaacuguuggcuuucccccagccgcacgggucccaggccccagagaagaugagucuauggcauc

SEQ ID NO: 96049 - RNA, 58 nt, Human
ccccauacucagaggugugacccucgccaggccccagccccagugcugggaggggugg

SEQ ID NO: 96050 - RNA, 64 nt, Human; identical to SEQ ID NO: 84708

SEQ ID NO: 96051 - RNA, 64 nt, Human
ggccuucaaagccuauuauuucuaaccuaaguaaaggccccagugaaaaacauacuggggaaau

SEQ ID NO: 96052 - RNA, 64 nt, Human
acaguccaaauaagcugaaagugcagcucgcugcaggccccagagcgagcuuccccuccucccu

SEQ ID NO: 96053 - RNA, 64 nt, Human
cuaggaguuugagaccagccugggcgauauagugaggccccaucucaaaaaaaaaaaaaggggg

SEQ ID NO: 96054 - RNA, 64 nt, Human
guccccagggucagggagccccugguguggaaagaggccccaagguaguaaacccugccccugu

SEQ ID NO: 96055 - RNA, 64 nt, Human
gaggacagggcagccugcagcuguguccaggcccaggccccaccccauaacagguggccucagc

SEQ ID NO: 96056 - RNA, 64 nt, Human
ccugggaucucaggagggcagccacggaguggggaggccccagaugcgcugugccaaagccagg

SEQ ID NO: 96057 - RNA, 64 nt, Human
gccaguccaaacaccacggagcauuuggcaaucaaggccccagagucuccguggucagauccuc

SEQ ID NO: 96058 - RNA, 64 nt, Human
gccucccccaacagugggccuguucuacccgugcaggccccaggagagccgcaggggccugcca

SEQ ID NO: 96059 - RNA, 64 nt, Human
cacccauccccugagcacacuaaccaccucaugcaggccccaccugccaauaguaauaaagcaa

SEQ ID NO: 96060 - RNA, 53 nt, Human
ggccucauuucaagcacugaaggaggccccacucccuuugagacugcccuccc

SEQ ID NO: 96061 - RNA, 64 nt, Human
augggggcagagagggaaaggaggugguuacuuaaggccccaaucuaccaagucuuccccacca

SEQ ID NO: 96062 - RNA, 64 nt, Human
caucccugacccuguccuggagggggcagaggccaggccccagugcugacgaggagcccagauu

SEQ ID NO: 96063 - RNA, 64 nt, Human
ugucucccucugucuagcuuccagggcagggagcaggccccaccuagggcugcaggcagucugg

SEQ ID NO: 96064 - RNA, 64 nt, Human
gccaauauguuccuuugaaaagaguccaguacccaggccccauggaaaggucugaaaauaauau

SEQ ID NO: 96065 - RNA, 64 nt, Human
gaguagggguauagcuugggucccuuuuccugcaaggccccauggggcagaauauaauaaauau

SEQ ID NO: 96066 - RNA, 64 nt, Human
accaacuaccauuagcacuauguuaggagcugcaaggccccaaaguagaagaugugcauaaugu

SEQ ID NO: 96067 - RNA, 64 nt, Human
uggaaaaaccaaaaugaacacugaacuuggccacaggccccaaguuuccucuggcagacaugcu

SEQ ID NO: 96068 - RNA, 64 nt, Human; identical to SEQ ID NO: 84756

SEQ ID NO: 96069 - RNA, 64 nt, Human
uccauacccgaaaggugaaaccagcuuucauuauaggccccagugggccacuuggguuuugaga

SEQ ID NO: 96070 - RNA, 64 nt, Human
agaggugaggccagaaaguuguuaggccugccgcaggccccacccucaagcauuccucaggaag

SEQ ID NO: 96071 - RNA, 64 nt, Human
augcucagcuagaugggcuggugugguugggucaaggccccaacaccauggcugccagcuucca

SEQ ID NO: 96072 - RNA, 64 nt, Human
agggacccuuagaucacaucacuccaccccugccaggccccagguuaggaauaguggugggagg

SEQ ID NO: 96073 - RNA, 64 nt, Human
aggcugguguccagaacucaggaaugggccugguaggccccaggccagacuaacugggcucaag

SEQ ID NO: 96074 - RNA, 64 nt, Human
ggagucucagauggaaggacaagugauggggaucaggccccagagcuugcuguccccugagacc

SEQ ID NO: 96075 - RNA, 64 nt, Human
gugauuucagggaccuaugucacaauguucgcugaggccccaggugugguggggaggggaggca

SEQ ID NO: 96076 - RNA, 64 nt, Human
aaguucucgggauuagaaggacaagagcacucccaggccccagagucuaagccuaagucucuau

SEQ ID NO: 96077 - RNA, 64 nt, Human
guuaggaggagacacaccucuugucugagaaccuaggccccagguaucacugcacuuuaagaaa

SEQ ID NO: 96078 - RNA, 64 nt, Human
uccaggcaccggcugaccccucaggagggauugcaggccccagguggcagccucagagaggagg

SEQ ID NO: 96079 - RNA, 64 nt, Human
gaaggaauggccugacuccugcagugcagauuggaggccccagaacuccuaugaacuacugaga

SEQ ID NO: 96080 - RNA, 64 nt, Human
cuuuccucccagagcucagcccaugucacccuccaggccccagaauccagaguggccucauuuc

SEQ ID NO: 96081 - RNA, 64 nt, Human
gucuugcucugggaauuaggugaccuuccuggggaggccccaggagagugaaucagggacucuu

SEQ ID NO: 96082 - RNA, 64 nt, Human
aaugauuacccccccacccacagcugagucugugaggccccauccuuucccuacguuuucuccc

SEQ ID NO: 96083 - RNA, 64 nt, Human
guggguguugagguuuuuaaaguguggucaggaaaggccccacugauaagguaacauuugagca

SEQ ID NO: 96084 - RNA, 64 nt, Human
uaccacuggggaaggcagcaggagucuguccuucaggccccacagugcagcuucuccagggccg

SEQ ID NO: 96085 - RNA, 64 nt, Human
aacacuuucuauuucacaaaagaccaaaagccagaggccccaggcucugugcugaugaacagcc

SEQ ID NO: 96086 - RNA, 64 nt, Human; identical to SEQ ID NO: 84712

SEQ ID NO: 96087 - RNA, 64 nt, Human
ugccucugacuacucagccuuguuuucgguguguaggccccagcugcccacuggaacugccggc

SEQ ID NO: 96088 - RNA, 64 nt, Human
uucaguaaacggguacagcucauucuuucugagaaggccccagguccugcucccuccucggauu

SEQ ID NO: 96089 - RNA, 58 nt, Human
ccaggccccgguggcgguaacugccccaaggccccagggacagaggccaaggacugac

SEQ ID NO: 96090 - RNA, 64 nt, Human
ggcccugccucuccaggguauagacggcccugcuaggccccaguucuuccuccuucccccuuuc

SEQ ID NO: 96091 - RNA, 64 nt, Human
guagagagcacugugcaccugggaaugaggaaucaggccccaagacagaaguacuuggaggagc

SEQ ID NO: 96092 - RNA, 64 nt, Human
augcaccugcagcugggugcugccagcagcuugcaggccccagcccuguuccaaucaaugcagu

SEQ ID NO: 96093 - RNA, 64 nt, Human
cugcacuuggccucuucgggaagauccuccuuccaggccccaggcuggaugcuggguucugggg

SEQ ID NO: 96094 - RNA, 64 nt, Human
agggugucucaugcuacaagaagaggcaagagacaggccccagggcuucuggcuagaacccgaa

SEQ ID NO: 96095 - RNA, 64 nt, Human
guccugucccuuuucccacccuccacccucagguaggccccaguauguuauuccuuugugucca

SEQ ID NO: 96096 - RNA, 64 nt, Human
ucuggucaucugagguggcuacucaacagguuugaggccccacagcaacagaaguccaggaccc

SEQ ID NO: 96097 - RNA, 64 nt, Human
agcgacugagcaacaggaggacucagccugggacaggccccagagagucacacaaaggaaucuu

SEQ ID NO: 96098 - RNA, 64 nt, Human
cugauguugauuuggaaacaugggcugaaaaugaaggccccauagugcauaggaacaguaaagc

SEQ ID NO: 96099 - RNA, 64 nt, Human
guuuauagacuguauuuaucuaguggauuccugcaggccccauacugagccuggacugaaagua

SEQ ID NO: 96100 - RNA, 64 nt, Human
caugcuuugggucaggaggccaaagcugauguucaggccccacccacucccuacaguccucaga

SEQ ID NO: 96101 - RNA, 64 nt, Human
caaaauaugaauauuuacaguuaccuguucucaaaggccccaguauucucucuucuuuccucag

SEQ ID NO: 96102 - RNA, 64 nt, Human
ugcaccaaaucaaguagcuucaccuuguguaugcaggccccaaguuauuuuuuagcaaucuuac

SEQ ID NO: 96103 - RNA, 64 nt, Human
gcuugcagggcagccccugguaaccagcccagucaggccccagccccguuucuuaagaaacuuu

SEQ ID NO: 96104 - RNA, 64 nt, Human; identical to SEQ ID NO: 84807

SEQ ID NO: 96105 - RNA, 64 nt, Human
cuggcaccuggcgggcuggugaccuuuuuaauccaggccccaucagcaucccacgaucggccuu

SEQ ID NO: 96106 - RNA, 64 nt, Human
ggagugguggggaggugaguggaccaaaggauauaggccccaggcaugcagaugggcccggugu

SEQ ID NO: 96107 - RNA, 64 nt, Human
caccaguaccaaucagucagugucaucacauuucaggccccaagcaaucucugugcaaagcauc

SEQ ID NO: 96108 - RNA, 64 nt, Human
uuuggaagaaaaaaaucuucuccagauuuuucggaggccccacugaugcuguucucuucuucau

SEQ ID NO: 96109 - RNA, 64 nt, Human
ccagcccugaggcuccgccccagcccucagccccaggccccagcuggagaaaaaacauugccca

SEQ ID NO: 96110 - RNA, 64 nt, Human
ugaggccccgacgaggagggguaugcaggcuggcaggccccagagcugguggagggcaucucac

SEQ ID NO: 96111 - RNA, 64 nt, Human
ugucaaugaguguaccuuggagagcuauccacucaggccccagugccucuauuugcuaagggac

SEQ ID NO: 96112 - RNA, 64 nt, Human
agcagaggggccaggcccaggcagagcugacgggaggccccagcucugaggggaggggguccgu

SEQ ID NO: 96113 - RNA, 64 nt, Human
gagaaagacgcgauuaacacuguggcauucagccaggccccauguccucucuguggaagguuuu

SEQ ID NO: 96114 - RNA, 64 nt, Human
ccuccugcccagucccccaaccccagccgcucggaggccccaaaggaaaaagcacaagaagcgu

SEQ ID NO: 96115 - RNA, 64 nt, Human
acaacugugggaaaagcccugggggccccucccaaggccccaucagugcucugaguaggcuguc

SEQ ID NO: 96116 - RNA, 64 nt, Human
aaacccucuuccgcugagcagcugucugaacuauaggccccagugcugaagaccaguugugcua

SEQ ID NO: 96117 - RNA, 64 nt, Human
gggauccaccuuugugcuccaaacaccucccaccaggccccaccuccaguauuggggauuacau

SEQ ID NO: 96118 - RNA, 64 nt, Human
uuccaggacugguuuuccaguacaucuuuaaacaaggccccagagacucuaugucugcccgucc

SEQ ID NO: 96119 - RNA, 64 nt, Human
ggcacagcuaagcacagcugccacugcaggagacaggccccaugucaggaugccauagugcugu

SEQ ID NO: 96120 - RNA, 64 nt, Human
uacuccguaccucccucugccaggucguggaguuaggccccagucccuacuugucacugguucc

SEQ ID NO: 96121 - RNA, 64 nt, Human
aaagucagccccuuguauguaagagaggacacugaggccccacaaggccucaucuccuuaaggc

SEQ ID NO: 96122 - RNA, 64 nt, Human
gcuuugucggccagcguuucugcagucuuuguaaaggccccacgagagcgggccaggccgugug

SEQ ID NO: 96123 - RNA, 64 nt, Human
ugacugaggccacuuccaggugggcagcagaggcaggccccagugugaccaccacugcgacccc

SEQ ID NO: 96124 - RNA, 64 nt, Human
gaggggcacccaccaguugcugcugccccacuacaggccccacaccugcccugggcaugcccag

SEQ ID NO: 96125 - RNA, 64 nt, Human
gccugaggaacccuggcucuuuucuuuaaagcccaggccccacuuacguaaaacauuucagggu

SEQ ID NO: 96126 - RNA, 64 nt, Human
ucccuaggugauccgaugugcagccaaaucugagaggccccauuuaaaaaagaaagaacauggg

SEQ ID NO: 96127 - RNA, 64 nt, Human
cgucccuuguucauggaaccagcugccugcagucaggccccagguucuuccaugggugaacaga

SEQ ID NO: 96128 - RNA, 64 nt, Human
uggggcgggggguggguaaacccucacugccagcaggccccaaguggcuuguaaaucauucucc

SEQ ID NO: 96129 - RNA, 64 nt, Human
gacagcccaucccugcuccaugcugucugugagcaggccccaugcccagcacgccagccaccgc

SEQ ID NO: 96130 - RNA, 64 nt, Human
ccugccuucugcucugccccugcacaggacccaaaggccccaggcccugcaaggugugcuaguu

SEQ ID NO: 96131 - RNA, 64 nt, Human
agggguaaugggcccagcagugccucuggagcccaggccccaacacagccccauggccucugcc

SEQ ID NO: 96132 - RNA, 64 nt, Human
cguuccacuugagauagguuggucaucgugcagaaggccccaggaccucagcacacacagccuc

SEQ ID NO: 96133 - RNA, 64 nt, Human
gcccuguguggcccuguucccaccaugagucuggaggccccaccucccuggggcucccaauccc

SEQ ID NO: 96134 - RNA, 64 nt, Human
ugccagaccauucucuggcggggaccagggcccaaggccccagggcuggaaggagaccaagggg

SEQ ID NO: 96135 - RNA, 64 nt, Human
uggcccugggcggggcgugggggggcguggagggaggccccagggggucucacccaugcaagca

SEQ ID NO: 96136 - RNA, 64 nt, Human
cuucuuccccccugacaaacgcccaccugaccugaggccccagcuucccucugcccuaggacuu

SEQ ID NO: 96137 - RNA, 64 nt, Human
ugcccauaucaaaauuauaaaugaggaggacagcaggccccaagaaaguagggacuaaguaugu

SEQ ID NO: 96138 - RNA, 64 nt, Human
uggccaagugcacgagggucucuguguuuccagaaggccccacacacccaagugccccucacac

SEQ ID NO: 96139 - RNA, 64 nt, Human; identical to SEQ ID NO: 84716

SEQ ID NO: 96140 - RNA, 57 nt, Human
aauuguuugguaaccccuaaucaagagaggccccaagauccacaacucgagugguua

SEQ ID NO: 96141 - RNA, 64 nt, Human
auccccugugaacuuaucaaaaaugcaaauucucaggccccaaccugaaggaggacccugaauu

SEQ ID NO: 96142 - RNA, 64 nt, Human
ucaggcccccaaggccgcccuuucccucgcacacaggccccacccccacaguuccacgcccccc

SEQ ID NO: 96143 - RNA, 64 nt, Human
cuuaggaaaggcuggugagccagagggacugaucaggccccauucacucucuacucauuaaaag

SEQ ID NO: 96144 - RNA, 64 nt, Human
caaaugguugggggaggggccuagacaaggcuccaggccccaccuccuccuccauacguucaga

SEQ ID NO: 96145 - RNA, 64 nt, Human
gagccagggugcuggggcugcggguggggaaaggaggccccagcacuucagacaaagaccaccc

SEQ ID NO: 96146 - RNA, 64 nt, Human
aucuacccaucacagaccccuuuccuaucacucaaggccccagccuggcacaaauggaugcaua

SEQ ID NO: 96147 - RNA, 64 nt, Human
uuguggggguagggugaagagcauaucccacaagaggccccacagggagcagagacugcuuuaa

SEQ ID NO: 96148 - RNA, 64 nt, Human
gcgccgagaggggaaggggccgccuagcccgaguaggccccagggcgcggccacagacuggcgg

SEQ ID NO: 96149 - RNA, 64 nt, Human
ugcagguuucuacagugaggaacaggcguuucccaggccccacacccagauuucucuaucuuug

SEQ ID NO: 96150 - RNA, 64 nt, Human
cuuuggcuacccuggccgugccuggcagccccucaggccccacagguggguccugguugugaag

SEQ ID NO: 96151 - RNA, 64 nt, Human
ccuggccuggagcacccugggauccuggagggagaggccccacgcccccacucucccuccacac

SEQ ID NO: 96152 - RNA, 64 nt, Human
gguuguccauaaagagguugcuucuauauacuagaggccccagauggccaggccuugggcuacg

SEQ ID NO: 96153 - RNA, 64 nt, Human
uuccacuggucaauauauagauuuugggugucugaggccccaagauuagaugccacuaaucucc

SEQ ID NO: 96154 - RNA, 59 nt, Human
agauuggagcucugcaguaaccacagaacaggccccaugcugacgucccuccucaagag

SEQ ID NO: 96155 - RNA, 64 nt, Human
uauucuagagccccaugcuccuaacaagccagagaggccccaaacaggauuguuucuuuccucc

SEQ ID NO: 96156 - RNA, 64 nt, Human
caggcacccugaaugggcaugcagagccugugucaggccccaucccagcaggccuggguggcca

SEQ ID NO: 96157 - RNA, 64 nt, Human; identical to SEQ ID NO: 84760

SEQ ID NO: 96158 - RNA, 64 nt, Human
cggaaaccggggguggggggagacacucauuucuaggccccaucaccagucacuugauuucgug

SEQ ID NO: 96159 - RNA, 64 nt, Human
aagccucuucccucaugaccuaaucacugcccaaaggccccauguucuaaugccaucaucuugg

SEQ ID NO: 96160 - RNA, 63 nt, Human
agaacugcauuagccgcugaggagagccaccgaaggccccaacaggggaugcucaucacugga

SEQ ID NO: 96161 - RNA, 64 nt, Human
cauggggucccugcugcaaaggacagugggcaggaggccccaggcugagagccagaugccuccc

SEQ ID NO: 96162 - RNA, 64 nt, Human
ggccagggacugggcuuucuccccacuaagggcaaggccccaguuuugaccaaucgcaugguuc

SEQ ID NO: 96163 - RNA, 64 nt, Human
ucagggucucaccucacauugucccuacaaggacaggccccaacugauaaccguugcuuuuuuu

SEQ ID NO: 96164 - RNA, 64 nt, Human
ugguggguaacacccucaagucucuuugccagugaggccccaccacaucggugugaguuagguu

SEQ ID NO: 96165 - RNA, 64 nt, Human
agggcuggggugagaccccucccuuccagaauccaggccccaucucccccaacuccacagcccc

SEQ ID NO: 96166 - RNA, 64 nt, Human
aguaaaauuaauccuuggcagaaagcagucugauaggccccacucauuucaaguguuaugaaag

SEQ ID NO: 96167 - RNA, 64 nt, Human
ugcacccugugguccucuagaguagcuagcucugaggccccaagguggguacaaagcagguaug

SEQ ID NO: 96168 - RNA, 64 nt, Human
cauuugguauuacauauuuaauucuuaaauauugaggccccauugugaguaauaaaaaauacga

SEQ ID NO: 96169 - RNA, 64 nt, Human
cugaagugccagcgucgguuaaaacauaagccacaggccccaguuauugugaaaacagaagaag

SEQ ID NO: 96170 - RNA, 64 nt, Human
agcauuaccugagaacuugauaaugcauauuugcaggccccacgcaaaaccugcugaaucagaa

SEQ ID NO: 96171 - RNA, 64 nt, Human
aguuuuugugaugggggagagggugaaggaggucaggccccacuccuuccugauuguuuacagu

SEQ ID NO: 96172 - RNA, 64 nt, Human
ugagaaaaccuuugguagaagcuccugucuuaucaggccccaaaaaaccuguucugcagugaga

SEQ ID NO: 96173 - RNA, 64 nt, Human
auaaugucaucaaacauaaaguuuaaugugauggaggccccaaauaaccaaacgcguaaguaca

SEQ ID NO: 96174 - RNA, 64 nt, Human
ggucugcaaguucaacggucauagcugucccuccaggccccaaccuugccucaccacucccggc

SEQ ID NO: 96175 - RNA, 64 nt, Human
gccucugccugugcacugcaagcugugucuacucaggccccaaggggcaucucuguuuccauuc

SEQ ID NO: 96176 - RNA, 64 nt, Human
cucaucucaucuaccuucccauuuccaugccuagaggccccacuacuaccacuagcaccguugg

SEQ ID NO: 96177 - RNA, 64 nt, Human
cagucccuaucucccccauccccucccggcuuauaggccccacaggugcuauuuguugugcugg

SEQ ID NO: 96178 - RNA, 64 nt, Human
ucucuucuuauacagauaaaacaugacuccuacaaggccccaagguuuacauagucugaaguga

SEQ ID NO: 96179 - RNA, 64 nt, Human
uucagucuucacagggauagacuacaacaccucuaggccccaaccacggauuuuuuuucucagu

SEQ ID NO: 96180 - RNA, 64 nt, Human
cuucucaguccagcuggaggcuggagggagacacaggccccacccagcagacugaggggcagag

SEQ ID NO: 96181 - RNA, 64 nt, Human
gcuucacucucucccucagcaccugcccugcuggaggccccagcccuccguggacagcaggggc

SEQ ID NO: 96182 - RNA, 64 nt, Human
uagcccuuaaacucuuucaaaauauaaaagcagcaggccccaggugaguccugaaggaagaggc

SEQ ID NO: 96183 - RNA, 64 nt, Human
uccccaccuugaggccuugcagaggcgccucucaaggccccaucagcucgccgggaccucugug

SEQ ID NO: 96184 - RNA, 64 nt, Human
acauguuccuccacgcggcucacucgaugccugcaggccccagugugugccucaacugauucug

SEQ ID NO: 96185 - RNA, 64 nt, Human
ccuggcaaagucccacucagccauggccugaugcaggccccaggcccuccuuucuuggguguca

SEQ ID NO: 96186 - RNA, 64 nt, Human
agauuaugcagcuauacuugugaaaucgugcaugaggccccagggcaccguucuagaacaacgu

SEQ ID NO: 96187 - RNA, 64 nt, Human
cggguugaggauuggggcuagcucgaugacacuaaggccccaacaucgcgggaccugcuguggc

SEQ ID NO: 96188 - RNA, 64 nt, Human
aaacugcccuuauccgcuguccagcagcugccagaggccccaggucaccucggguccccuugaa

SEQ ID NO: 96189 - RNA, 64 nt, Human
uucaaccaaagcaauauacucuuacaugauuucuaggccccaugacccagugucuagagacauu

SEQ ID NO: 96190 - RNA, 64 nt, Human
uucccaccuuccauagccuccaaacauguucccaaggccccacuuucaagaaucagacagcagg

SEQ ID NO: 96191 - RNA, 64 nt, Human
ucccccaaggaacagagcaaaggaugguggccgcaggccccacgcgagcccacaggacaccggc

SEQ ID NO: 96192 - RNA, 64 nt, Human
ccuucaggaauggcagccugcagcaacuggaacaaggccccaccguaaagcucuguguguccca

SEQ ID NO: 96193 - RNA, 64 nt, Human
caguguagcaggagagccagucacuucccuccccaggccccaaagcaccccaaggcugguauuc

SEQ ID NO: 96194 - RNA, 64 nt, Human
ccagacaugagacgcaacuaguuggugcauaagaaggccccacuuggcuauuucauaucuaccu

SEQ ID NO: 96195 - RNA, 64 nt, Human
gauauagaagcauuucucugcaggauaccaguucaggccccaccauuccugccaaggccauuac

SEQ ID NO: 96196 - RNA, 64 nt, Human
uguaaaccgccuccacguggcggcagacuuccuaaggccccagcucgcuggccucgcgcugggc

SEQ ID NO: 96197 - RNA, 64 nt, Human
uccagaaaaggaggccuuucgaugucugagaaagaggccccacgcuguagagucccgaaagccc

SEQ ID NO: 96198 - RNA, 64 nt, Human
ucgagaacugaagcggccuccgggaugaggucagaggccccaccugauuuuccuggugguggua

SEQ ID NO: 96199 - RNA, 64 nt, Human
acuagugcacccccuucacagacacugaccucagaggccccacucuggugcccccagacccugg

SEQ ID NO: 96200 - RNA, 64 nt, Human
aacaaaaaccaaacacccagaggucucaucucccaggccccaggggagaaagaggaguagcaug

SEQ ID NO: 96201 - RNA, 64 nt, Human
gaaagcugguuuuuauacaggagauacguaaaguaggccccacaaauaauauuuuuaaaauaca

SEQ ID NO: 96202 - RNA, 64 nt, Human
ugcagccuccugcuccucugacucuagugggaacaggccccagcucagccuccggcagggaggu

SEQ ID NO: 96203 - RNA, 64 nt, Human
cacacagaaugccggaggggcgcagagcagauccaggccccagaaagccucaccuacagacagc

SEQ ID NO: 96204 - RNA, 64 nt, Human
agauacuaauucucaugacugaaucacccuccaaaggccccaccuccuaauaccaucacucugg

SEQ ID NO: 96205 - RNA, 64 nt, Human
uauagcagaguggcugagcaugugcucugaggccaggccccagcucugcugcugacgagcugug

SEQ ID NO: 96206 - RNA, 64 nt, Human
acacucaaaaucacugccaugguucaauguucccaggccccaggccauccacuugccggccccc

SEQ ID NO: 96207 - RNA, 64 nt, Human
cuaggguauccuugggcccaaugaauuaggggugaggccccagaacccguuaucuaugaguugu

SEQ ID NO: 96208 - RNA, 64 nt, Human
aaaaaaaagcacugucaugcagggcagggucccaaggccccagccaaccucucguugacaugua

SEQ ID NO: 96209 - RNA, 64 nt, Human
guccacucugcuuaagccuuucaucugccgcugaaggccccagucuggacucucugcccucugg

SEQ ID NO: 96210 - RNA, 64 nt, Human
gccuucuaggacaccugugcagggucccagacccaggccccagagcagcccaggccaugacccu

SEQ ID NO: 96211 - RNA, 63 nt, Human
ucccagugaucuguauuugaugaggaggagccgaggccccagcuucauccagcuucaaccaau

SEQ ID NO: 96212 - RNA, 64 nt, Human
ccugcacacuccagcccaaagggucuguggccggaggccccacgagcaggccccagcagucacc

SEQ ID NO: 96213 - RNA, 64 nt, Human
gcccaaagggucuguggccggaggccccacgagcaggccccagcagucaccggcucuggucuug

SEQ ID NO: 96214 - RNA, 64 nt, Human
aaaagagagacuuccgggacagucauuaucagauaggccccaaaccugugauuuuucuugggca

SEQ ID NO: 96215 - RNA, 64 nt, Human
acagcagaagccuccaagcacagagccuggccccaggccccagacagggugggcuuccugcccu

SEQ ID NO: 96216 - RNA, 64 nt, Human
cuagccugggaggaucagucuguccaggucagcgaggccccagauaccagagcaucaagaguac

SEQ ID NO: 96217 - RNA, 64 nt, Human
ccccagagagagcucugcacgucaccaaguaaccaggccccagccuccaggcccccaacuccgc

SEQ ID NO: 96218 - RNA, 64 nt, Human
ccacccgccuuaggacucccgaugcgcuccuggaaggccccaggaguggcaccuuagugugggu

SEQ ID NO: 96219 - RNA, 64 nt, Human
ugagauuuuaauaucuuuucccacuaguggccccaggccccagcaagccucccuccauccucca

SEQ ID NO: 96220 - RNA, 64 nt, Human
gcacagcugcucugugaccagggacagauccagcaggccccagucucgcaucagcgccggccuc

SEQ ID NO: 96221 - RNA, 64 nt, Human
uccaggugggcauggaaugcugaugacuuggagcaggccccacagaccccacagaggaugaagc

SEQ ID NO: 96222 - RNA, 64 nt, Human
aaaccuacagcccagaaaccagaagccccuauagaggccccagucccaacuccaguaaagacac

SEQ ID NO: 96223 - RNA, 64 nt, Human
caaggcucccaggauaguugcacugagcacugugaggccccagguggaaacgugcaagagaagg

SEQ ID NO: 96224 - RNA, 64 nt, Human
agcaagacccucaagugauaaccaucacaagauaaggccccaaugccuacagacaaagcagaag

SEQ ID NO: 96225 - RNA, 64 nt, Human
auuggaccugugcuguccugggaggugguguuggaggccccaugaagagcgcccuggacugcug

SEQ ID NO: 96226 - RNA, 64 nt, Human; identical to SEQ ID NO: 84720

SEQ ID NO: 96227 - RNA, 64 nt, Human
accccucugccccugcagcuggaaugugccacagaggccccaccugaaggguggaugugcugga

SEQ ID NO: 96228 - RNA, 64 nt, Human
uaccucaugccccugcaccagccccuccgucuccaggccccaggccucuuuguggacccaucuu

SEQ ID NO: 96229 - RNA, 64 nt, Human
ggacccucguccuccagacuggcuggcaggagucaggccccagcagcccuccugcccccaaagc

SEQ ID NO: 96230 - RNA, 64 nt, Human
uguucuccccggcuggcagcguaguggggcugccaggccccagcuuuguucccuggucccccug

SEQ ID NO: 96231 - RNA, 64 nt, Human
cacgggugugcagacucacccuaaagggcggcccaggccccacgcuagaaggcuggcgagaccg

SEQ ID NO: 96232 - RNA, 64 nt, Human
guaaguaggaggauccacaggauuugagaugcuaaggccccagagaucguuugauccaacccuc

SEQ ID NO: 96233 - RNA, 64 nt, Human
aguggccugugaggugacagauuggcagggcccaaggccccagguuuucauuuuucaugagaaa

SEQ ID NO: 96234 - RNA, 64 nt, Human; identical to SEQ ID NO: 96172

SEQ ID NO: 96235 - RNA, 64 nt, Human
auagcuaccugguucguguaaauaagaauaaucaaggccccagaguguguaugcuuccaggugg

SEQ ID NO: 96236 - RNA, 64 nt, Human
auuuauuucccuccccaugccccuggggaccccaaggccccagcuucccucugcacccccagcc

SEQ ID NO: 96237 - RNA, 64 nt, Human
gaagaggggcauaaacuuuccucuuccugccuagaggccccaccuuuggugcuuuccagaaucc

SEQ ID NO: 96238 - RNA, 64 nt, Human
aaaucuuuccuuugauuuuugcuccugaucaucaaggccccaguggcaaccaugugguaagugg

SEQ ID NO: 96239 - RNA, 64 nt, Human
auagauuccaguuucgcacccugggcagacccccaggccccauccgggauagggcagaggaggu

SEQ ID NO: 96240 - RNA, 64 nt, Human
ucuccagccauugaacuggucccacacgcaccccaggccccacuccucggcaguuucaggugua

SEQ ID NO: 96241 - RNA, 64 nt, Human
cugagccacggaccgcauccuccagggggccugcaggccccagccaagugccuuccguggguca

SEQ ID NO: 96242 - RNA, 64 nt, Human
ggaagccuggggcacguccugugcggugccaccaaggccccaccccugccccuuuuccuuccag

SEQ ID NO: 96243 - RNA, 64 nt, Human
ccuuauccacggagcuggagccaaccuacgugccaggccccaugcugggucccagggaugcaga

SEQ ID NO: 96244 - RNA, 64 nt, Human
agcuaugugaugcuagccgguggcuuucugggcuaggccccaguuugaggcuccccugggaacu

SEQ ID NO: 96245 - RNA, 64 nt, Human
gauggggaggagagcagucugcccuugggagcguaggccccagggagacuucuaaagccccccc

SEQ ID NO: 96246 - RNA, 64 nt, Human
cugguagagguaccagcuuccuuuccagcuggagaggccccaacacuggaugguucuguaggga

SEQ ID NO: 96247 - RNA, 54 nt, Human
ugaacagcacaaaauucuagcagaaggccccauggguuagaaaaggacuauaag

SEQ ID NO: 96248 - RNA, 64 nt, Human
cucugccagaggggcagcagcugcagauccacuuaggccccaggguccacggauggccccaaag

SEQ ID NO: 96249 - RNA, 64 nt, Human
cggggaggucauuacagccucauggccucuaccaaggccccagaucacaggaucuccugggccu

SEQ ID NO: 96250 - RNA, 64 nt, Human
ucucacucaccggggcagccugccgcagaugcacaggccccaggugcaggccaccaccuccggg

SEQ ID NO: 96251 - RNA, 64 nt, Human
uaucccauccuucagagaccagcaagguucugccaggccccaagcaucugagcaugaugauuuu

SEQ ID NO: 96252 - RNA, 64 nt, Human
gcuugccgcuuuagagguggauggugcucauaaaaggccccagucggggguauuuaaaaaggac

SEQ ID NO: 96253 - RNA, 64 nt, Human
cagaagugguugaugaguucaucugaagaaauucaggccccaccuccccacccugccccucccu

SEQ ID NO: 96254 - RNA, 64 nt, Human
ucugcaucuuuguuugcaucuccagagacaccugaggccccagagcuugaggcaaagccaggcc

SEQ ID NO: 96255 - RNA, 64 nt, Human
aggcaggugccaggucaguauugagucacaguagaggccccacaaggaccugcuugggugagac

SEQ ID NO: 96256 - RNA, 64 nt, Human
caccuagaccacccuccaugucagguacugagcaaggccccagauccuucucucuggaggaaga

SEQ ID NO: 96257 - RNA, 64 nt, Human
augggcaaguacacguacccugcacuccgggaggaggccccaagggaacacguggagagcuucu

SEQ ID NO: 96258 - RNA, 64 nt, Human
ucuugcuggagguggaggaagggcguccaugccaaggccccauaccugggccgggggcagcacg

SEQ ID NO: 96259 - RNA, 64 nt, Human
gccccacccucacccccacccccagggugcccugaggccccaggcagcugcugccuccacuauc

SEQ ID NO: 96260 - RNA, 64 nt, Human
ugcaccuggcgaggcugaaggcgagggguggaggaggccccagcacagccucaucuccaugugu

SEQ ID NO: 96261 - RNA, 64 nt, Human; identical to SEQ ID NO: 84810

SEQ ID NO: 96262 - RNA, 64 nt, Human
cuaaaaggcccagagagaagagccccacucucagaggccccaauaccccauggaccaugcuguc

SEQ ID NO: 96263 - RNA, 64 nt, Human
ggcgugggguccucaaacaucaccuuuaccugagaggccccaagaagcugagcuggcagagagc

SEQ ID NO: 96264 - RNA, 64 nt, Human
cuaguuaccauucaaaggaugcuaacugugugucaggccccacacuaagugcucugcucugaua

SEQ ID NO: 96265 - RNA, 64 nt, Human
gaggguuccgcccccaugacccaaucagcuccaaaggccccaccuccuaauacugucaccuugg

SEQ ID NO: 96266 - RNA, 64 nt, Human
gccacauuccagugggacggccacggggggaccuaggccccagggaaagagccccaugccgccc

SEQ ID NO: 96267 - RNA, 64 nt, Human
ucucccuggcccuaucagccugugaacuucacuuaggccccaagcugacagacugugcugaggc

SEQ ID NO: 96268 - RNA, 64 nt, Human
cccagggccacccacacuucaucugcucccucauaggccccaccuccacgucccggcugggccc

SEQ ID NO: 96269 - RNA, 64 nt, Human
cagggccagggcaaugccaucagccccugggaacaggccccacgcccucuccucccccuccuag

SEQ ID NO: 96270 - RNA, 64 nt, Human
gagugcagccuucucggcacuggagugucagcggaggccccaggcagcccaagagcucagggag

SEQ ID NO: 96271 - RNA, 64 nt, Human
ccguguuccauauagaggaaccccaaauaauaaaaggccccacaucugucugugauguguuucu

SEQ ID NO: 96272 - RNA, 64 nt, Human
uuccccucucccucccucuccacgugggcagggcaggccccaucgcuuuccucugauaaccaca

SEQ ID NO: 96273 - RNA, 64 nt, Human
ucugccuuucccugcucuguucuucccccuccuuaggccccagccugggcccagacccauccuc

SEQ ID NO: 96274 - RNA, 64 nt, Human
ucccaugacccucugcccacuuccauuggucuccaggccccaauaaucugggguugaaacuuug

SEQ ID NO: 96275 - RNA, 64 nt, Human
caaccaguggcccccaaaggcaggcaggauccucaggccccagccgcgggaggcuggaagggcu

SEQ ID NO: 96276 - RNA, 64 nt, Human
cuugcuggagcugagcuguuucacugccucucgcaggccccagcuggcugucacuguaaagcug

SEQ ID NO: 96277 - RNA, 64 nt, Human
aacguacucaggcuugugccacgggugagcacugaggccccagguguccucccucccccacugu

SEQ ID NO: 96278 - RNA, 64 nt, Human
ggugagaacagguucugagagggggcuucuaggaaggccccagcccuaguccuaggcgacuuga

SEQ ID NO: 96279 - RNA, 64 nt, Human
ucaggaguagucucauaucagggauccucucuccaggccccaggucaucccccacuguaaagcc

SEQ ID NO: 96280 - RNA, 64 nt, Human
uggagauuugccaaaugaauaaacgacaccuuugaggccccaggugaagcggggcccuacuccg

SEQ ID NO: 96281 - RNA, 64 nt, Human
gaggguugguuagauuccugacaguuugccagccaggccccaccuacagcgucugucgaacaaa

SEQ ID NO: 96282 - RNA, 64 nt, Human
aguguaagaaacacacugaggcagggaaguccccaggccccaggaagccgugcccugcccccgu

SEQ ID NO: 96283 - RNA, 64 nt, Human
gucccacucaagccaagcagccaagcuccuugggaggccccacuggggaaauaacagcuguggc

SEQ ID NO: 96284 - RNA, 64 nt, Human
gggcaccauccagcuccccagcccaccugcucccaggccccaggccuguggcucccuuggugcc

SEQ ID NO: 96285 - RNA, 64 nt, Human
gauacaugacaauaaaugagucagaugagcaagaaggccccagaacccaugccccaaggcacaa

SEQ ID NO: 96286 - RNA, 64 nt, Human
agaggucugcucucaugaccuaaucaccucccaaaggccccaccucccaauaccaucacauuag

SEQ ID NO: 96287 - RNA, 64 nt, Human
cccucuccucuucaugcagguauaaagaaauaugaggccccaauuggaacagcagcauggaggg

SEQ ID NO: 96288 - RNA, 64 nt, Human
ucggacuaugacuggcuacggggaggccaccaccaggccccagcucuccacccugaacucccca

SEQ ID NO: 96289 - RNA, 64 nt, Human
ccccgaccugggaugcgcacaguguccccaacgcaggccccacucugagccugcccugggcagc

SEQ ID NO: 96290 - RNA, 64 nt, Human
uuugcgucuguggcuccaagaagugccuguggucaggccccagcucuacuuggucccugaaaaa

SEQ ID NO: 96291 - RNA, 64 nt, Human
ugguggcauggaccacccucauccaugcaacuccaggccccaugggaacggauguggaaggaag

SEQ ID NO: 96292 - RNA, 64 nt, Human
acugauccuagccaggcaccuuaggaguauagggaggccccauauagguccauccuccuaggau

SEQ ID NO: 96293 - RNA, 64 nt, Human
gaggggacaaacauucaaaccauagcagggucauaggccccaagaaggcuuccagacagaaccc

SEQ ID NO: 96294 - RNA, 64 nt, Human
ccccacaaccugucuuuuccaaguggauaagcccaggccccauggagagaggcucagcccuagg

SEQ ID NO: 96295 - RNA, 64 nt, Human
auuaccugugaacuugcuggaaauacaaauccucaggccccaccucagaccuacugaaucagaa

SEQ ID NO: 96296 - RNA, 64 nt, Human
aaauugaccuuuugaaagcaaagcucuggcucacaggccccaaacuaccagccguaucuagcau

SEQ ID NO: 96297 - RNA, 64 nt, Human
cucugauucgccaucaacccauggagcaauuccaaggccccaguuacccaucaccuccacacca

SEQ ID NO: 96298 - RNA, 64 nt, Human
aacagaagaaaagguaagguguugugucacaaagaggccccagucucuuucuucuuacauccau

SEQ ID NO: 96299 - RNA, 64 nt, Human
ccagcccuuugcaggcccagcagacuugagucugaggccccaggcccuaggauuccucccccag

SEQ ID NO: 96300 - RNA, 64 nt, Human
cccaccucucccugacccuguauauagcccagccaggccccaggcagggccaacccuucuccuc

SEQ ID NO: 96301 - RNA, 64 nt, Human
ggaagauucgauggacauggacaugagcccccugaggccccagaacuaucuuuucaguugugaa

SEQ ID NO: 96302 - RNA, 64 nt, Human
ucacucccaccacggaccaaugccuuucccccauaggccccaagaagagcggcugucacacuca

SEQ ID NO: 96303 - RNA, 64 nt, Human
gaaagaggcgggggcgggugaggagacuggccccaggccccagccacggcugcagagccugggc

SEQ ID NO: 96304 - RNA, 64 nt, Human
ugucagggaggggucugggcuucugagcugaugcaggccccaaggaccccuuugcugaccucug

SEQ ID NO: 96305 - RNA, 64 nt, Human
cccucugcugcuggggacccuccaacaccugugcaggccccauggcaccaucuaucuggccucc

SEQ ID NO: 96306 - RNA, 64 nt, Human
gccagcgagcgcccagcuccugacacugcuggagaggccccagccgcuuggcgaugccagccaa

SEQ ID NO: 96307 - RNA, 64 nt, Human
ugcucccugggguggagaagggaccagggauugcaggccccaucuccaggcuaaggggaggaga

SEQ ID NO: 96308 - RNA, 64 nt, Human
agcacaucccaccacucuccuuccaguccugaccaggccccagccggcaacuucuaccgagagc

SEQ ID NO: 96309 - RNA, 64 nt, Human
uaggggguuagcuuggggaccugaacuguccuggaggccccaagccauguuccccaguucagug

SEQ ID NO: 96310 - RNA, 64 nt, Human
ugcugaacauuccccagugccauggccaguugccaggccccagcgccagccagucuggccuuac

SEQ ID NO: 96311 - RNA, 64 nt, Human
uccuggcuucccauccccagcgauucccucucccaggccccaugaccuccagcuuuccuguauu

SEQ ID NO: 96312 - RNA, 64 nt, Human
uagcuugccccucagcuuugcaaagagccacccuaggccccagcugaccgcaugggugugagcc

SEQ ID NO: 96313 - RNA, 64 nt, Human; identical to SEQ ID NO: 84674

SEQ ID NO: 96314 - RNA, 64 nt, Human
ugggggcuugaacagggacugaccagcacaguggaggccccaggcaacagagggccuggaguga

SEQ ID NO: 96315 - RNA, 64 nt, Human
cgaaugacccaaggccaaggaagggaggacagagaggccccaggaguggguggagaguggagug

SEQ ID NO: 96316 - RNA, 64 nt, Human
gaccuugaacgaggagagcacugcugaucagacuaggccccacucagccuggccuggacaccgc

SEQ ID NO: 96317 - RNA, 64 nt, Human
gaggaggggcccuggcuauuugggaccuaagccuaggccccagagaucagcccgaacacccgca

SEQ ID NO: 96318 - RNA, 64 nt, Human
ugccggaaauguuaggcaccccaacucaagucccaggccccaggcaucuuuccugcccugccuu

SEQ ID NO: 96319 - RNA, 64 nt, Human
guuggauccuccuuuucuguccccugcugucucaaggccccaaguuaaaggguuaaagccgcug

SEQ ID NO: 96320 - RNA, 64 nt, Human
cuucauggaugggggaacucagauccagggacagaggccccagccucccugaagccuuugcauu

SEQ ID NO: 96321 - RNA, 64 nt, Human
agccagcccauccacuucuuccacuccuccccgcaggccccaaggcaucacuccggccacccug

SEQ ID NO: 96322 - RNA, 64 nt, Human
uccugucucccucagagaaggagacaccuccuggaggccccaguccccagacaguuucagccag

SEQ ID NO: 96323 - RNA, 64 nt, Human
aaaauucauuuucuuuggguuagagcuagagagaaggccccaagcuucuaugguuucuucuaau

SEQ ID NO: 96324 - RNA, 64 nt, Human
agacucccuggaucucugaauauaugcaaaaagaaggccccauuuaguggagccagcaauccug

SEQ ID NO: 96325 - RNA, 64 nt, Human
gucacauaagccaacgccagagccccuccaccucaggccccagccccugccucuccauuauuua

SEQ ID NO: 96326 - RNA, 64 nt, Human
ccccagaggcgagggaccaguggaggugccagggaggccccaggacccugugguccccuggcuc

SEQ ID NO: 96327 - RNA, 64 nt, Human
gcuucaucugcugccaugccgucucugggcaaccaggccccaacugugcuuaagccauaaugcc

SEQ ID NO: 96328 - RNA, 64 nt, Human
cagugauaguuggggaauugugagaugaauggagaggccccaucgugaauuaaagaugcugacc

SEQ ID NO: 96329 - RNA, 64 nt, Human
cagagccuaagagaagcaagucggcccugacgccaggccccagugggcgccucacacucagaac

SEQ ID NO: 96330 - RNA, 64 nt, Human
uauucuugugaggcacaaauauaggcuagaauccaggccccacaaauauaggcuagaauccgga

SEQ ID NO: 96331 - RNA, 64 nt, Human
gguguguuaggauaauuguccaguuaauuugaaaaggccccagaugaaucaauaaauauaauuu

SEQ ID NO: 96332 - RNA, 64 nt, Human
aaugcccacagcccagcauuggguuucccucccaaggccccagcaccaaccucugagcccaaga

SEQ ID NO: 96333 - RNA, 64 nt, Human
uggcucccuuccaccugucauucccaccacccugaggccccaaccgccacacacacaggagcau

SEQ ID NO: 96334 - RNA, 64 nt, Human
cgugcaagcgccucaaaccaagucacgcuuggcgaggccccagugacacugaugugcugagcca

SEQ ID NO: 96335 - RNA, 64 nt, Human
cgucucagguggaggaagauuuacggcucaagacaggccccagauccccucccaguggcaccca

SEQ ID NO: 96336 - RNA, 64 nt, Human
aagaaccagccucucaccccaggguccaugucccaggccccacuccagugcugcccacacuccc

SEQ ID NO: 96337 - RNA, 64 nt, Human
agcagaggggaauguagcaacagcagggccuccuaggccccaucuuccauuucuuagguaagaa

SEQ ID NO: 96338 - RNA, 64 nt, Human
cuagaguaccuuugccuaaacucuuuuagaauugaggccccaacuuugauggcacauuuaauac

SEQ ID NO: 96339 - RNA, 64 nt, Human
uucccagcauccuaggcucagcuuaccgggugauaggccccauaagacacacacaugagcaggg

SEQ ID NO: 96340 - RNA, 64 nt, Human
ccucauccacccucccaagcugugcgagcaugcaaggccccauggccucacacugcagacaccc

SEQ ID NO: 96341 - RNA, 64 nt, Human
gaagcaagacacguggccucgugaggggcaagcuaggccccagaggcccuggaggucuccaggg

SEQ ID NO: 96342 - RNA, 64 nt, Human
aggcccgagagccuccccaggccucuucgugggaaggccccaguaccacucguaggaggucuca

SEQ ID NO: 96343 - RNA, 64 nt, Human
cagcaucagacgggcuuccaggaccgcagcaggcaggccccagcgccgagacuccuggugacag

SEQ ID NO: 96344 - RNA, 64 nt, Human
agaucgccucacuccuaacccugacuuuauucccaggccccacaccgaggcaggugcaggauuc

SEQ ID NO: 96345 - RNA, 64 nt, Human
cuaggaagaggagugggguggugucagacccuggaggccccaacccuguccucccgagcuccuc

SEQ ID NO: 96346 - RNA, 64 nt, Human
ucuggugggcagagagggauggggucccugagccaggccccacccaucacagcauucccagguc

SEQ ID NO: 96347 - RNA, 64 nt, Human
gccgcccagccccuugacuccagccucgaccgccaggccccaggccagagccacccaaugaaca

SEQ ID NO: 96348 - RNA, 64 nt, Human; identical to SEQ ID NO: 84724

SEQ ID NO: 96349 - RNA, 64 nt, Human
ccgggcaaaggagcacaaggaaaccaagcagcagaggccccaucagcacagagggccucguucc

SEQ ID NO: 96350 - RNA, 64 nt, Human
aauucucuauucugacauuacagaccaccggauaaggccccauucuuccuuuacacccuccccu

SEQ ID NO: 96351 - RNA, 64 nt, Human
ggcuaggccucaaaacugacuuggucccacuuggaggccccaggauugguccugagguacagag

SEQ ID NO: 96352 - RNA, 64 nt, Human
acucuagccccgaacccuccugccccaggcuuccaggccccaucaggccugcccugaguuggcc

SEQ ID NO: 96353 - RNA, 64 nt, Human
auccauucugcagucuccagcagagcaggcagucaggccccagcgugccuccaucccagugccc

SEQ ID NO: 96354 - RNA, 64 nt, Human
ccauuucaccugagaccaauaggugcacccucugaggccccaagggaagggcuucucucuacug

SEQ ID NO: 96355 - RNA, 64 nt, Human
acugccaggaguucuugcuccuggcugcaggcccaggccccaaggucuccuucuuggggucaca

SEQ ID NO: 96356 - RNA, 64 nt, Human
ccacaauccccaaacucagagugcaucccagaagaggccccaggcagagcucagguuggcccug

SEQ ID NO: 96357 - RNA, 64 nt, Human
agagcagagcccccauggccuaaucaccuuuccaaggccccaccuucuaucuaagacaaucacg

SEQ ID NO: 96358 - RNA, 64 nt, Human
ugcacuaggagcugugaucucccucucugcagggaggccccagccccugcugcuugcuuucugc

SEQ ID NO: 96359 - RNA, 64 nt, Human
gaguacugggaggccagacggcacgaggucuccaaggccccagcaaagccauggcuucuacccc

SEQ ID NO: 96360 - RNA, 64 nt, Human
acagaccagggcuccaaggccaccccaccaacgcaggccccagggucuccgggaccucccuugg

SEQ ID NO: 96361 - RNA, 64 nt, Human
guggccccuucaggguggcagccacccuucagugaggccccaaggcagagucggcugggcgugg

SEQ ID NO: 96362 - RNA, 64 nt, Human
gggccaggcugacuuggggggcagacuugacacuaggccccacucacucagauguccugaaauu

SEQ ID NO: 96363 - RNA, 64 nt, Human
acaaaagacugguugugaguugcagcugucccgaaggccccaguugggaagccaugggcagucc

SEQ ID NO: 96364 - RNA, 64 nt, Human
gacagguugucuucacugggagcguggggcccccaggccccaccagcaccguccuccccuaaug

SEQ ID NO: 96365 - RNA, 64 nt, Human
agcccccugcaccgcccgccccccgcccccaccaaggccccagccucuggccaucaguccuggu

SEQ ID NO: 96366 - RNA, 64 nt, Human
ccauguccuuguuccuuguuugagacugggcugcaggccccaggaagacuuuccuucacccacc

SEQ ID NO: 96367 - RNA, 64 nt, Human
ccuccagaccccgaggccuugcucucagagcgggaggccccacccacuggagagccccgccccu

SEQ ID NO: 96368 - RNA, 64 nt, Human
aaaucgauggagaugcuucuagccucccaguaggaggccccagccaugccuucaaccuggcagg

SEQ ID NO: 96369 - RNA, 64 nt, Human
gaagcccuugaucccgcugacgacgcccacgucgaggccccaccgccauccuugcgccggcuca

SEQ ID NO: 96370 - RNA, 64 nt, Human
cccuccgaccucccagaagccuccaguccccaccaggccccacucccaguccuccugggauccu

SEQ ID NO: 96371 - RNA, 64 nt, Human
caccgccaaagccauggcccgccgccgagagcccaggccccacccgcaccuccucacccaucca

SEQ ID NO: 96372 - RNA, 64 nt, Human
ugucugccugcgguccuuccuccggccagaguggaggccccaggcugcuagcacagguggaagg

SEQ ID NO: 96373 - RNA, 64 nt, Human
gcggcucccuuuucagccuugugagucaccuggcaggccccagcugggcuggcuguccgugucc

SEQ ID NO: 96374 - RNA, 64 nt, Human
cuaggaguucaagaccagccaaggcaacauagugaggccccaucuuuacaaaaauacaaaaauu

SEQ ID NO: 96375 - RNA, 64 nt, Human
uggggccaccuuugugcagcuucgaggacaggaaaggccccaaucuugcccacuggccgcugag

SEQ ID NO: 96376 - RNA, 64 nt, Human
ccggacauccucuuccagggacuggggcaaacucaggccccacaccucuggacagcucaaaucc

SEQ ID NO: 96377 - RNA, 64 nt, Human
caggcuuuacuaccaggaacgcacucggugguggaggccccauguucccaggagccaagauucg

SEQ ID NO: 96378 - RNA, 64 nt, Human
caguggcuucuucaggccuaggauaacccuggccaggccccaugguccugcucugggucagcug

SEQ ID NO: 96379 - RNA, 64 nt, Human
acauucucggggggcccuagcugagcgcaggcccaggccccacuugcuuccugcgggugggaaa

SEQ ID NO: 96380 - RNA, 64 nt, Human
gcccacagcuggggcaucucacuggagcuguuccaggccccacuggagagcagaggaccugauc

SEQ ID NO: 96381 - RNA, 64 nt, Human
cucagguccacccauuucccucauggggaucccgaggccccaagaggggcagauuccccucaca

SEQ ID NO: 96382 - RNA, 64 nt, Human
ucuuuuguaacgagucuuucaugaugugacuuugaggccccaacaugacagccacugggccacc

SEQ ID NO: 96383 - RNA, 64 nt, Human
gacagacaucacaggauaacccaggccugggaggaggccccacggccugcugguggggucugac

SEQ ID NO: 96384 - RNA, 64 nt, Human
ucccuuuucccauuguuccugcgcugcaaauugcaggccccagcaaucgugacugacguuugcu

SEQ ID NO: 96385 - RNA, 64 nt, Human
uucgguugacccaggucauggaauggaaacggugaggccccaguggcuguucuggaagaaacag

SEQ ID NO: 96386 - RNA, 64 nt, Human
guggcuguucuggaagaaacagaucuccuggcaaaggccccagcaucucccucacugaaaccag

SEQ ID NO: 96387 - RNA, 64 nt, Human
gacagcgcaugucccgcucuuauccaacucuuccaggccccaccucccugcaccccuccccucu

SEQ ID NO: 96388 - RNA, 64 nt, Human
acuuuuaaacguggauuguuuaaagaagcucuccaggccccaccaagaggguggaucacaccuc

SEQ ID NO: 96389 - RNA, 64 nt, Human
gaacugagcuccucugggcaggaccucagaguccaggccccaaaaccacagcccugucagugca

SEQ ID NO: 96390 - RNA, 64 nt, Human
ccaacaccagggaugguacuagggggaagugacaaggccccagagacucagagggaggaaucga

SEQ ID NO: 96391 - RNA, 64 nt, Human
cacuucucacucaccacuaccagccagccucagaaggccccagagagacccugcaagaccacgg

SEQ ID NO: 96392 - RNA, 64 nt, Human
ggaggggguggaacacagggggcccauccugaucaggccccaucucaagguuggcacuccugcc

SEQ ID NO: 96393 - RNA, 64 nt, Human
ggccucucuauaccccuggaugaacagcuugcucaggccccaggguggcugccucggcccuccc

SEQ ID NO: 96394 - RNA, 56 nt, Human
acuggaguugccucaguugacacagcaggccccauccagacagaccagcaggugcu

SEQ ID NO: 96395 - RNA, 64 nt, Human
cggcuucggccaagcguuuuagccucauucacucaggccccacucagcacucugccagccaaga

SEQ ID NO: 96396 - RNA, 64 nt, Human
cuugcuuugggagcugccugcaccaccccagagaaggccccaccuucuucaucccucagacccg

SEQ ID NO: 96397 - RNA, 64 nt, Human
gugcauagaagggauaguggccacacugcagcugaggccccagguggcagccauggaucaugua

SEQ ID NO: 96398 - RNA, 58 nt, Human
ccucaggccuucacugguaggccagcugaggccccaagugcccaggcuuggucaccgg

SEQ ID NO: 96399 - RNA, 64 nt, Human
gcccagagacacuguccuuccccucauccacccaaggccccagccagcgcucauacccuguccu

SEQ ID NO: 96400 - RNA, 64 nt, Human; identical to SEQ ID NO: 84678

SEQ ID NO: 96401 - RNA, 64 nt, Human
cccuuuaaugccauauggccccugccuagggcacaggccccaaccugugugcugggguccccag

SEQ ID NO: 96402 - RNA, 64 nt, Human
cucagugccucaggcucugagguacucugcucacaggccccagacagaugcuguuggguaaacu

SEQ ID NO: 96403 - RNA, 64 nt, Human
ucaguucuugaaaaacggugucauauuuagucagaggccccacccccaggaagcauggaugggg

SEQ ID NO: 96404 - RNA, 64 nt, Human
agcucuuccuugccugguuuaucaagcagagcugaggccccacguuuccaacucugauugucac

SEQ ID NO: 96405 - RNA, 64 nt, Human
uaaaccaaaaaacugcuccuucacccucacccugaggccccaggggagaggacccgugggaugg

SEQ ID NO: 96406 - RNA, 64 nt, Human
ucugcagaaugugagaugagguucucaaggucacaggccccagucccagccugggggcuggcag

SEQ ID NO: 96407 - RNA, 64 nt, Human
acagacaaucacauucauuaaaauauguuaugccaggccccaaugcaguuauuuuuagaugagc

SEQ ID NO: 96408 - RNA, 64 nt, Human
cuuccaggcuuugcuguuccccagcagccugcagaggccccacagacagcuugaggccccuccu

SEQ ID NO: 96409 - RNA, 64 nt, Human
uccugacagaaagcuccucccacccaaaugggccaggccccagcaugauccugaaaucugcauc

SEQ ID NO: 96410 - RNA, 57 nt, Human
gggagaccgacguccuuuagcccucccaggccccacggcagcacuuaugguagcggc

SEQ ID NO: 96411 - RNA, 64 nt, Human
cauggacuccaggauccuccuggagcagcagcugaggccccagggcuguggguggggaaggaag

SEQ ID NO: 96412 - RNA, 64 nt, Human
cuggaggaaaacugagacucagacaggaaagggaaggccccacagacaagguagcccuggccag

SEQ ID NO: 96413 - RNA, 64 nt, Human
aagauagugagauuuaaguuccugcugccuggguaggccccacaaggccuggucugggaguaua

SEQ ID NO: 96414 - RNA, 64 nt, Human
cgcagagcacagaucuuuaaagaagcgagagaggaggccccacccuccuggcagcagaugccug

SEQ ID NO: 96415 - RNA, 64 nt, Human
agaccauaaacaguccacaggcaccguuccugccaggccccaacccacagggagucucuccgca

SEQ ID NO: 96416 - RNA, 64 nt, Human
aaauuuugguuuucuacuguuaugugagaacauuaggccccagcaacacgucauuguguaagga

SEQ ID NO: 96417 - RNA, 64 nt, Human
agcaggacuccagggcgugcacggugagcagaugaggccccaagcucaucacaccagggggcca

SEQ ID NO: 96418 - RNA, 64 nt, Human; identical to SEQ ID NO: 84764

SEQ ID NO: 96419 - RNA, 64 nt, Human
acucugggggccuggaaaugcugcaguggggagcaggccccaggcuggaccugcccuguccuca

SEQ ID NO: 96420 - RNA, 64 nt, Human
ugcccagcuccaagcagacacacaggcaguggccaggccccacggugcuucucaguggacaaug

SEQ ID NO: 96421 - RNA, 64 nt, Human
auguaauggaagcacggggcuagaguuuccacauaggccccaacauaaaggccuucccucgcug

SEQ ID NO: 96422 - RNA, 64 nt, Human
caaagaaagguggugagggcggaggggccgcuccaggccccacagagcaggagacccccagaga

SEQ ID NO: 96423 - RNA, 64 nt, Human
ggguccugggucuucccaaccauaccccgagaucaggccccaccugccagcucuacugggcuug

SEQ ID NO: 96424 - RNA, 64 nt, Human
cagacaccgucucacacguuggcuuuggacaaccaggccccaacuuggucccugcccuagggac

SEQ ID NO: 96425 - RNA, 53 nt, Human
acgagaucaaccugcugugacccaggccccaccuggggcaggcggcaccggcg

SEQ ID NO: 96426 - RNA, 64 nt, Human
ugcaggggaggcuguggggguccuggcagccaggaggccccaggugguuuugaggcucgcucuu

SEQ ID NO: 96427 - RNA, 64 nt, Human
gcggugccugagaagagggugaaggagcuggggcaggccccauccugggcauuggagaugauga

SEQ ID NO: 96428 - RNA, 64 nt, Human
uucccuaugggggugucuguacguaggagaguggaggccccacucccaguugggcgucccggag

SEQ ID NO: 96429 - RNA, 64 nt, Human
gcuugcggaaccaacuuuucucuguguguccagcaggccccacaacccccucuccuuucuuuca

SEQ ID NO: 96430 - RNA, 64 nt, Human
aaauacugaaacuugcugccuauuggguaugcugaggccccacagacuuacagaagaaguggcc

SEQ ID NO: 96431 - RNA, 64 nt, Human
cucuggggcccaggcggggcugguccacauucccaggccccaacagccuucaaagauggguaaa

SEQ ID NO: 96432 - RNA, 64 nt, Human
cucagcuucccucuuaagcuaagacugaugucagaggccccauggcgaggccccuuggggccac

SEQ ID NO: 96433 - RNA, 64 nt, Human
aaccaaccgcguugauggacacccacugugugccaggccccagcggggcccaugggggagguga

SEQ ID NO: 96434 - RNA, 64 nt, Human
ggacuccuggccaaucaaggcuugcccagcugggaggccccacacgaaagacucuuaccauuuu

SEQ ID NO: 96435 - RNA, 64 nt, Human
cucuggggcacagugugaaacccgcacccuagccaggccccagggagccuccgcugggcccaga

SEQ ID NO: 96436 - RNA, 64 nt, Human; identical to SEQ ID NO: 84682

SEQ ID NO: 96437 - RNA, 64 nt, Human
guagcauaggauagaugaagaugaagagcauaccaggccccacccuggcucucccugaggggaa

SEQ ID NO: 96438 - RNA, 64 nt, Human
ucccaguauuuuuagccccaaaggagaagugaaaaggccccagccggggugaaucaucaguccu

SEQ ID NO: 96439 - RNA, 64 nt, Human
uggguccugggccaggccagccagggagaagacaaggccccagcccuccucugggagccucaca

SEQ ID NO: 96440 - RNA, 64 nt, Human
gaagaaggcaggauggaacucggccucauccccgaggccccaguuccuauaucgggccccccau

SEQ ID NO: 96441 - RNA, 64 nt, Human
gagaaaagugugaauucagguggagaguaggcccaggccccaugaggcaccaguggaagcacag

SEQ ID NO: 96442 - RNA, 64 nt, Human
cuggagcgcaucgcccaugagaacaccugcccccaggccccacaggaugggcccccagguaagc

SEQ ID NO: 96443 - RNA, 64 nt, Human
cccaucuuuagcaugaagggucuggcauggcccaaggccccaaguauaucaaggcacuugggca

SEQ ID NO: 96444 - RNA, 64 nt, Human
ccaggugagggcccugcccuggaagacuggagggaggccccaagccacggggcaucccccucuc

SEQ ID NO: 96445 - RNA, 64 nt, Human
caccuccuugccugcccuggaggcuugugccucuaggccccacccccuguggaguccugcuggc

SEQ ID NO: 96446 - RNA, 64 nt, Human
cugaccccuaaguuauugcccgcucaccucucccaggccccaggccgcggagcuggcagggugg

SEQ ID NO: 96447 - RNA, 64 nt, Human
agugcgggcugcgcuaggcgcaguggggugggccaggccccaggacagccggagcucggccugc

SEQ ID NO: 96448 - RNA, 64 nt, Human
ucugaaucuuccaggcgccgggucccaaauguucaggccccaagucuagauccuggcagcccag

SEQ ID NO: 96449 - RNA, 64 nt, Human
cuaccucugaccccagcuucucucugauucccacaggccccaugcauccucccugccucacucc

SEQ ID NO: 96450 - RNA, 64 nt, Human
caccuggggugcacacaggucacacagugccaagaggccccagggcccagggacuccccccaca

SEQ ID NO: 96451 - RNA, 64 nt, Human
ucaugucaaaauuuaccagaagccaagaugauguaggccccagagguggauuguuaaaaagaug

SEQ ID NO: 96452 - RNA, 64 nt, Human
uggcucucaggguggcuucugcguccccgccgccaggccccagacuauggucacagggccgucc

SEQ ID NO: 96453 - RNA, 64 nt, Human
ccuucggagcccccgaucccuccgggucuagcgcaggccccacggggccccuucaggggcugaa

SEQ ID NO: 96454 - RNA, 64 nt, Human
ggcacagaaaaggaaggcaucagucacauauuagaggccccacacagggagagagguguguggc

SEQ ID NO: 96455 - RNA, 64 nt, Human
ucucugugcuucugaaacccccuucucacguuucaggccccaguuuuaacucaaggccuggggc

SEQ ID NO: 96456 - RNA, 64 nt, Human
gccgggcggccaccagcggcccucggagguacccaggccccacggccgagccucuggccggaga

SEQ ID NO: 96457 - RNA, 64 nt, Human
gcauccagcucggccccuuggccgccccccucccaggccccagcgucuucuccccagccccguc

SEQ ID NO: 96458 - RNA, 64 nt, Human
agcccccacccacacccccaucccacccaaccacaggccccacuugcuaagggcaaaugaacga

SEQ ID NO: 96459 - RNA, 64 nt, Human
ucugaagaauggguacaggaaaggauuguccuugaggccccaggaagcucugccgcccccuccc

SEQ ID NO: 96460 - RNA, 64 nt, Human
ggcugauggagggcugggcgccauggggucagggaggccccagggacccaugggcagagcuggg

SEQ ID NO: 96461 - RNA, 64 nt, Human
auuaaaaccccagaauggcugcagaggggugaacaggccccaauauuuggggugcugugauacc

SEQ ID NO: 96462 - RNA, 64 nt, Human
ccaaauccuaaagccuccaucucuaauaaauggaaggccccaaggcccugaggggaucucaaau

SEQ ID NO: 96463 - RNA, 64 nt, Human
acgacuucccccuuugggggaccccaaaauuuggaggccccauucuaggacucuggggauccca

SEQ ID NO: 96464 - RNA, 64 nt, Human
guagagaccccuguuagccagcccucgaucauugaggccccauuauuaacagauacucccauaa

SEQ ID NO: 96465 - RNA, 64 nt, Human
cagggcaguccgugcuccuccagcugcccuagugaggccccagccuaccugcaccuccgugagg

SEQ ID NO: 96466 - RNA, 64 nt, Human
caccuucuccaagcucugagagcccucgcgucccaggccccagccagggggccggccuuguccc

SEQ ID NO: 96467 - RNA, 64 nt, Human
cuugggcucggagccccggcuccgccugcuguggaggccccagccgugggaauccagguccccc

SEQ ID NO: 96468 - RNA, 64 nt, Human
cgcccggacugaccgaagggacggggcccgccccaggccccagcagucuccgcucccgcagcgg

SEQ ID NO: 96469 - RNA, 64 nt, Human
cgcuggcuaaaguggguaggccuuggcccaccugaggccccaggugggaacauggucaccccca

SEQ ID NO: 96470 - RNA, 64 nt, Human
ggcccuccucucucuacucaggacccaggaguccaggccccagccccuccucccucagacccag

SEQ ID NO: 96471 - RNA, 64 nt, Human
ggcccccagccccuccuuccugauccagcaguccaggccccagccccuucuuccuggacccagg

SEQ ID NO: 96472 - RNA, 64 nt, Human
gucaucaaaggguucuuuccaggccugaggaccuaggccccaguuugucccaaagcaggagugu

SEQ ID NO: 96473 - RNA, 64 nt, Human
cccaucugguugucccacccacucuucagaggcuaggccccaccucuggggguuggagggaccc

SEQ ID NO: 96474 - RNA, 64 nt, Human
caggaguuuauuuuaagacugcugggaaggaaacaggccccauuuuguauauaguugcaacuua

SEQ ID NO: 96475 - RNA, 64 nt, Human
agcauuucuuucgagacaaaacacccgucugggaaggccccaaggucagcuuaugaaggacccc

SEQ ID NO: 96476 - RNA, 64 nt, Human
uuguagggagaaaugagaaaucgcauuuggauccaggccccaggugggcaccaucagcagucuu

SEQ ID NO: 96477 - RNA, 58 nt, Human
acuacuuugcaugugaauaguuccagccaggccccaagcccacugggguguguggcag

SEQ ID NO: 96478 - RNA, 64 nt, Human
gggcuggagggcaggaccuagaggcaccaagggaaggccccauuccggggcuguuccccgagga

SEQ ID NO: 96479 - RNA, 64 nt, Human
accaucccagccccgaagccagggccaugccagcaggccccaccauggaaaucaaaacaccgca

SEQ ID NO: 96480 - RNA, 64 nt, Human
guccuugcugcaccugugccguccccagagcuacaggccccaucugguccuaagucccugcugc

SEQ ID NO: 96481 - RNA, 64 nt, Human
ggccgauucugguuuaggggccggacccacugagaggccccagagccgcccgugauguuccucc

SEQ ID NO: 96482 - RNA, 64 nt, Human
gcuuuggcagaccaucuccagcauccugcuuccuaggccccagagcacaaguuccagcuggucu

SEQ ID NO: 96483 - RNA, 64 nt, Human
aggagcagggccacagcaccccugaggucuggccaggccccaggcacagagcugccugcucccu

SEQ ID NO: 96484 - RNA, 64 nt, Human
aaguaaccaagggcgcuuccuugugggcagcugcaggccccaugccucuccucccucucuggca

SEQ ID NO: 96485 - RNA, 64 nt, Human
gcgccgccccaacgagacucgcggccccaggcccaggccccaccccggcggcgguggcggcgag

SEQ ID NO: 96486 - RNA, 64 nt, Human
aggagaacagacagaggaaaugugucucccuccaaggccccaaagccucagagaaaggguguuu

SEQ ID NO: 96487 - RNA, 64 nt, Human
ucugcguuucacccuccagcugcuguccuugcccaggccccaccucuccucccuaagagcuaau

SEQ ID NO: 96488 - RNA, 64 nt, Human; identical to SEQ ID NO: 84728

SEQ ID NO: 96489 - RNA, 64 nt, Human
uguugagccccauucuacauccccaccauuaaccaggccccacccacaagguagaaacaacccc

SEQ ID NO: 96490 - RNA, 64 nt, Human
uggguaggggggggggaaugggggagggcugaugaggccccagcuggggccuguugucugggac

SEQ ID NO: 96491 - RNA, 64 nt, Human
cccaccuuaagugguaagcauguuuaauuaucaaaggccccauuugucaggggugagagaaaag

SEQ ID NO: 96492 - RNA, 64 nt, Human
guggggugggggguaucaaggagccugggacgugaggccccacucucgccccauucccagcucc

SEQ ID NO: 96493 - RNA, 53 nt, Human
gccucacccagcaguucuagcagaggccccacagaaggcucagggcaccgagg

SEQ ID NO: 96494 - RNA, 64 nt, Human
uucgaacuucgaaggccacacacuccugcuucauaggccccacgguaagugaguucacaccuag

SEQ ID NO: 96495 - RNA, 64 nt, Human
cccuccugggauggguggcucagccucgaaucccaggccccagcccaggcaggugcugcugccu

SEQ ID NO: 96496 - RNA, 64 nt, Human
uggagacacacggugcagcaucagggaccuucccaggccccagcaaauucaagucggucugcag

SEQ ID NO: 96497 - RNA, 64 nt, Human
cugacggucaugucccccagggccagccgggcucaggccccaccucccugccaguccuuggacc

SEQ ID NO: 96498 - RNA, 64 nt, Human
caggcagugaggaugagagggggugaugggcgcaaggccccagggguccucccucuuaacccau

SEQ ID NO: 96499 - RNA, 64 nt, Human
cugauggccaugucccccagggccagccgggcucaggccccaccucccugccaguccuuggacc

SEQ ID NO: 96500 - RNA, 64 nt, Human
aggaccgucccucgcagggucccaggcccagaagaggccccacgccucuagagcugggcuccgu

SEQ ID NO: 96501 - RNA, 64 nt, Human
aagggcggggcccugccuggggaucucaaggaugaggccccagcauggaggauuggggguagaa

SEQ ID NO: 96502 - RNA, 64 nt, Human
uggcgcugcaggggugucggcgcgccaccucuccaggccccagaagcccuucuugcccaaaggc

SEQ ID NO: 96503 - RNA, 64 nt, Human
cacacaaaccucugugguauaggugaggggugugaggccccagccuggagccaggcacugggug

SEQ ID NO: 96504 - RNA, 64 nt, Human
gggcccauccugggaccccagaugggguaaggagaggccccagaaccccaaagcagacagcgag

SEQ ID NO: 96505 - RNA, 64 nt, Human
ugcccugugaaguuuguuuucucccacugccuccaggccccacugauacccccaaauagaugcu

SEQ ID NO: 96506 - RNA, 64 nt, Human; identical to SEQ ID NO: 84686

SEQ ID NO: 96507 - RNA, 64 nt, Human
ucccaagagggacucgucacccagagaccucaaaaggccccaggccuacugugguuuuuucuga

SEQ ID NO: 96508 - RNA, 64 nt, Human
augguaucugagcugcccacacccccaccugccaaggccccacagagcccaaaacagaaggggg

SEQ ID NO: 96509 - RNA, 64 nt, Human
gcagggccugcaggugcuccccgcccugagacccaggccccaaaucagcaauaaugaacaaacc

SEQ ID NO: 96510 - RNA, 64 nt, Human
ccccagcugaccaugagacuuugcugagaaguggaggccccaggacaggcuggcuggcuggcug

SEQ ID NO: 96511 - RNA, 64 nt, Human
accaccgagacucggaggggacacgaugagcaccaggccccaccuuuguccccuagcaaauuca

SEQ ID NO: 96512 - RNA, 64 nt, Human
ccgacugccacucuggaccuaauagcuguuccuuaggccccacuccaugccacccccaccagcu

SEQ ID NO: 96513 - RNA, 64 nt, Human
cugggagauggccuggcccgucccaggcuccuggaggccccaccugccgaucccaggcacuuga

SEQ ID NO: 96514 - RNA, 64 nt, Human
ccccuguggaaaggucuauaugacgggccgccugaggccccagaacucgucugugaaccaccuu

SEQ ID NO: 96515 - RNA, 64 nt, Human
cccugggggcaaaucaggacacaacagagggcagaggccccauuagcuuuaaaauguagcccca

SEQ ID NO: 96516 - RNA, 64 nt, Human
aggccuucccuaggggaaggagcugggagugccaaggccccaggugcacaggaggcguggcugc

SEQ ID NO: 96517 - RNA, 64 nt, Human
ggcucccucaggaagaagcucuggaguggggccgaggccccagaugcucugcuggggucugggg

SEQ ID NO: 96518 - RNA, 64 nt, Human
ggagacgaggagggcgggcagggaggugggcaucaggccccagccuuggccugaaaccucaagg

SEQ ID NO: 96519 - RNA, 64 nt, Human
cagcuguuacaaaggcaggguccagccugcagggaggccccaggaggggaucuggccagucaag

SEQ ID NO: 96520 - RNA, 64 nt, Human
gacugggcccuccgcaggggacuucagagcagcaaggccccagcuggcaguagccugaccaucu

SEQ ID NO: 96521 - RNA, 64 nt, Human
agggaagggggaggaggggacuuuuagagccagcaggccccacuguauuauguauauauuuuuc

SEQ ID NO: 96522 - RNA, 64 nt, Human
guuuguccguggguucauacaugcauugggugcuaggccccaggcugccggguggcacccuuua

SEQ ID NO: 96523 - RNA, 64 nt, Human
cugcuccaccaaggggcucuugaaccccuuauuaaggccccagaugaucccagucacuccucuc

SEQ ID NO: 96524 - RNA, 64 nt, Human; identical to SEQ ID NO: 84813

SEQ ID NO: 96525 - RNA, 64 nt, Human
agguuccacucugcacaugaauaugcagucugggaggccccacugcucucacugggaaggacca

SEQ ID NO: 96526 - RNA, 64 nt, Human
ccuagcaaguacuuugucuugauccucacugagaaggccccagggcagcggucuucuccaucuc

SEQ ID NO: 96527 - RNA, 64 nt, Human
augauuuacccccccacccacagcugagucugugaggccccauccuuucccuacguuuucuccc

SEQ ID NO: 96528 - RNA, 64 nt, Human
uccuucccagcgcugcugggcaggccccgucuccaggccccagcuguugaaacuuugaagggca

SEQ ID NO: 96529 - RNA, 61 nt, Human
ugguggacaccgaguucuaagccacagaccgaggccccagcaggcagcggcuggagggaug

SEQ ID NO: 96530 - RNA, 64 nt, Human
auccuccuucuccaagaccuauggagaaggucccaggccccaggaacacagggcuucuuggccc

SEQ ID NO: 96531 - RNA, 64 nt, Human
gucuccacauccccagcuguaugaggagagcuucaggccccaggacugugggggccccucaggu

SEQ ID NO: 96532 - RNA, 64 nt, Human
gaacucuguccccaucauucagucaccuccccccaggccccaccgccgauucugaggaugacaa

SEQ ID NO: 96533 - RNA, 64 nt, Human
cacccaagguugucagcuuuggauugcuggggccaggccccauggaggguauacugaggggucu

SEQ ID NO: 96534 - RNA, 64 nt, Human
ggaacucuccuggccuucuaggaauggaggagccaggccccaccccuucccuauaggaacagcc

SEQ ID NO: 96535 - RNA, 64 nt, Human
gcccagguauccugggggaagaggagaugugaucaggccccaccccuguaaucaggcaaggagg

SEQ ID NO: 96536 - RNA, 64 nt, Human
ccucucucgagccagucuaugcccuuucuccaguaggccccagcccagaccucuucggcuucag

SEQ ID NO: 96537 - RNA, 64 nt, Human
uuuuacuuuccucagccaguuucuaggcccugcaaggccccaugagcuacagucguuugaaguu

SEQ ID NO: 96538 - RNA, 64 nt, Human
cagugggagggggucugggccagugcaccuuccaaggccccauccauuaguuuccacugccucg

SEQ ID NO: 96539 - RNA, 64 nt, Human
cuuaggacaccuuaacacucuuaaaaguuauugaaggccccaaggaguucuuggguguggguuc

SEQ ID NO: 96540 - RNA, 64 nt, Human
uaaauuauucuauggauguuugcuuauuaguuucaggccccaaaauaacacgagccccuccacc

SEQ ID NO: 96541 - RNA, 64 nt, Human
gucacgcaaugcucaccucgccucuuccccacuaacaucccagacuuuaaaauucaguaaauca

SEQ ID NO: 96542 - RNA, 64 nt, Human
uguuccaauaaaacuuuauuuacaaaaacagaugacaucccagaugcagaccaugggcaaccaa

SEQ ID NO: 96543 - RNA, 64 nt, Human
ugugugcacuucugcuucuuuagggaugcccuguacaucccacaccccacccucccuucccuuc

SEQ ID NO: 96544 - RNA, 64 nt, Human
acaucuccccaaagagaugagcuuuuggggcacaacaucccaccgcagucccccucacccgaca

SEQ ID NO: 96545 - RNA, 64 nt, Human
cuuauacaaccagagaaguggguguuggccaggcacaucccaucucaggcagcaagacaaucuu

SEQ ID NO: 96546 - RNA, 64 nt, Human
uucuuuacugaggaauucagcuugugacacagauacaucccacuagcuugugagguggaacuag

SEQ ID NO: 96547 - RNA, 64 nt, Human
ccaucaggaauaggagaguagacagagaucuuccacaucccaggcuucugcugcugcuuuaaaa

SEQ ID NO: 96548 - RNA, 64 nt, Human
uuguaggcaaccuucccucucuccuuggugaagaacaucccaagccagaaagaaguuaacuaca

SEQ ID NO: 96549 - RNA, 64 nt, Human
aaaaacaaaaaccuagauuccggauuaggggaugacaucccaaacagcccggaguauuugcaga

SEQ ID NO: 96550 - RNA, 64 nt, Human
guugcuguggauuaucaaguuuugaaggaacuguacaucccaacagacugaaacauucuaagug

SEQ ID NO: 96551 - RNA, 64 nt, Human
uaaggcucuggaguguuguguaugguuucuuuucacaucccagccucccaugggcacuucuaag

SEQ ID NO: 96552 - RNA, 64 nt, Human
acuuuuuaaauuauucaucuucucuauaauaaugacaucccaguucauggaggcaaaaaacaag

SEQ ID NO: 96553 - RNA, 64 nt, Human
caguuacuuaugauuuaaaaacaaccaacagaaaacaucccacugacuguauggcacucuguag

SEQ ID NO: 96554 - RNA, 64 nt, Human
ccauuaguuagacucuucuuagugaauaucaggaacaucccaucugugcuuaaccagaauccag

SEQ ID NO: 96555 - RNA, 64 nt, Human
gcuugcugccuuguuuccugccaggagcgcccugacaucccaaaaccaucuucccacauguggg

SEQ ID NO: 96556 - RNA, 64 nt, Human
gggccgagugaggucgggccuggggagcugagugacaucccaagcuugggcuuggguagugagu

SEQ ID NO: 96557 - RNA, 64 nt, Human
ccuauccugcuaacucuaagauuugauaagggccacaucccaguguuuaucuuagcuugcauca

SEQ ID NO: 96558 - RNA, 64 nt, Human
auuaguccgauuuuguggugguaaugggagaaggacaucccaggagcagggucuggugggagga

SEQ ID NO: 96559 - RNA, 64 nt, Human
uggggcauuacauggccaggugagcugucccccgacaucccaccgaaucugaugcugcugcugc

SEQ ID NO: 96560 - RNA, 64 nt, Human
ggacauggugacucggugacuguaacaguaggacacaucccaucaugcggucagagugcagaaa

SEQ ID NO: 96561 - RNA, 64 nt, Human; identical to SEQ ID NO: 84640

SEQ ID NO: 96562 - RNA, 64 nt, Human
gauugggaaguugcacuagaugauuacgaagaucacaucccacucucugaacuacaaucacugu

SEQ ID NO: 96563 - RNA, 64 nt, Human
aaauccucaccuuucagacguauuuucuuuauucacaucccaggagcauccauuuuaaggaacu

SEQ ID NO: 96564 - RNA, 64 nt, Human
aggcuugccaugugccccaucucauucuauacucacaucccauggaggugaggauuuucacuuc

SEQ ID NO: 96565 - RNA, 64 nt, Human
guuauuuuuauaucagccugagucuccugugcccacaucccaggcuucacccugaaugguucca

SEQ ID NO: 96566 - RNA, 64 nt, Human
guugcuaaaagauuaaagaucaagaagcuuggaaacaucccauggguacaaugucuuagaaagu

SEQ ID NO: 96567 - RNA, 64 nt, Human
ucauucagcacugucccuuuucuauacugcugauacaucccaugguucugagaagccuuaucuc

SEQ ID NO: 96568 - RNA, 64 nt, Human
uaggcugagccuugggaauaguuuggcagguuuaacaucccaaggcuaaccuaacguaguuggg

SEQ ID NO: 96569 - RNA, 64 nt, Human
augcuggucuugacucaucuuuauuuuuauucgcacaucccaccccauccccugaacuacuugg

SEQ ID NO: 96570 - RNA, 64 nt, Human
guucgugugcuccuccuccugcugcaggggcugcacaucccauugccccacuucugcuuugugu

SEQ ID NO: 96571 - RNA, 64 nt, Human
gcacuuuggacuuuuugcuuuagauaaaagaaagacaucccaggagaaggacaaaccagaggag

SEQ ID NO: 96572 - RNA, 64 nt, Human
aacgccguuuuuggaggaacucaaacccaguccaacaucccaucauuucacuugacugcagaaa

SEQ ID NO: 96573 - RNA, 64 nt, Human
uccuagcucuuacacauagcaggggcaccuuccgacaucccagaccagccaaggguccucaccc

SEQ ID NO: 96574 - RNA, 64 nt, Human
ucagaaauauauaggucccagguaauacucccaaacaucccacuuuuuacuguuucaggccauc

SEQ ID NO: 96575 - RNA, 64 nt, Human
accauauuuucccuuugugucuugugacucugccacaucccaucucauccuggccucugaguca

SEQ ID NO: 96576 - RNA, 64 nt, Human
augguauauuugugaguuguguuaucuguaauauacaucccagaauaaaggagugaauuaaaua

SEQ ID NO: 96577 - RNA, 64 nt, Human
aaaaagcuuugauucaacacaauuguucaucuucacaucccaaacagaaucacuguuucuugaa

SEQ ID NO: 96578 - RNA, 52 nt, Human
cuccaccaccuccucuuugaugacaucccaauucgcagacaauguccucugu

SEQ ID NO: 96579 - RNA, 64 nt, Human; identical to SEQ ID NO: 84692

SEQ ID NO: 96580 - RNA, 64 nt, Human
cauauuacuuguaucuagugcagaauaagcuauaacaucccauugaggaaucuuaaauuucaua

SEQ ID NO: 96581 - RNA, 64 nt, Human
ccagacaggcagacaucagccacauggaauccugacaucccagccagccggccagacucucauc

SEQ ID NO: 96582 - RNA, 64 nt, Human
aucacacucgagucaaggccuggaaugaccccugacaucccagaagaacaucucagauaucagu

SEQ ID NO: 96583 - RNA, 64 nt, Human
gagcuccuugagggacuuugucauaaucacuguuacaucccagugccucacaccaugccuggcc

SEQ ID NO: 96584 - RNA, 64 nt, Human
acuaaaagauguauaacauagcaaaacugcuuaaacaucccauuuugacacuugucuugcaguu

SEQ ID NO: 96585 - RNA, 64 nt, Human
auauuagcuagcaucuaauuugcacaacuagaacacaucccagaacaauuacugaaaagcugaa

SEQ ID NO: 96586 - RNA, 64 nt, Human
acaacacaguaaagugugaugagaggucaggggaacaucccaguaaaagagaagagucacagga

SEQ ID NO: 96587 - RNA, 64 nt, Human
agacaagaaaacuagacucagaggggcugaguccacaucccagacagcucacugcagacacagg

SEQ ID NO: 96588 - RNA, 64 nt, Human
cuuggugggaaagugcagaagaauugcaaaacugacaucccauuucacagcaauagugaccuuu

SEQ ID NO: 96589 - RNA, 64 nt, Human
guaaacaugaaauggggaauaagugauuuuaaguacaucccauacauuuaaauaucuuugauaa

SEQ ID NO: 96590 - RNA, 64 nt, Human
uuaaggcaaugguuucacaugguuacauaucaaaacaucccaauucuuuagugcugaucaucga

SEQ ID NO: 96591 - RNA, 64 nt, Human
cagcuuucuuuggaaaucucccaggugaggauucacaucccaaaauaaaauucagaagccaggu

SEQ ID NO: 96592 - RNA, 64 nt, Human
agcauaaaugaagccucuuuggggugaagccuggacaucccaucgaaugaaaggacacuaguac

SEQ ID NO: 96593 - RNA, 64 nt, Human
aacaagcuauuuccaggaauguguucuguauuuuacaucccaguguacccuuuauuuuauuauu

SEQ ID NO: 96594 - RNA, 64 nt, Human
ccugagccccucccucccagccccauauucacacacaucccagccccuggccuugcccucuucc

SEQ ID NO: 96595 - RNA, 64 nt, Human
agaaaccaagaacugaauuacugucugcccauucacaucccauuccugccuuuugcaaucauga

SEQ ID NO: 96596 - RNA, 64 nt, Human
caccaccagugcuaccaccguugccacugagcccacaucccaagagacaggcccagagccuaaa

SEQ ID NO: 96597 - RNA, 64 nt, Human
ccuuccaaauacuuguagccaaacauuggcuagaacaucccaagauaugcugacacuguccugu

SEQ ID NO: 96598 - RNA, 64 nt, Human
gacaucugauggacuuggcuuaggcccugcugggacaucccacgugugaucccuuucacuccau

SEQ ID NO: 96599 - RNA, 64 nt, Human
gaagaaccagccauuuuuaaaaagguuauuauugacaucccaauauuuugucuuggugggcuua

SEQ ID NO: 96600 - RNA, 64 nt, Human
cacuggcaugaugcccucgcucccccaugcccccacaucccaguggggcauaacuaggggucac

SEQ ID NO: 96601 - RNA, 64 nt, Human
uaacuuaauuguuuuagagcguguugcuguuguaacaucccagagaagaaugaaaaggcacaug

SEQ ID NO: 96602 - RNA, 64 nt, Human
agaguuucuauuucuaaagaaaaaacaauuguucacaucccaucugaugauuagcaugugugua

SEQ ID NO: 96603 - RNA, 64 nt, Human
uggaauucugccugcuagugauagcucacacaucacaucccagaaucccacucccaaugcauua

SEQ ID NO: 96604 - RNA, 64 nt, Human
uaacauagcugugcuauugcacaucuguuggaggacaucccagauuugcuuauacucagugccu

SEQ ID NO: 96605 - RNA, 64 nt, Human
cugccucccggguucaagcaguucucaugucucaacaucccagguagcuaggauuacaggcgug

SEQ ID NO: 96606 - RNA, 64 nt, Human
cugacagccaagauauaaggaggguggcacugccacaucccacuggcagaaacucuccuuuaua

SEQ ID NO: 96607 - RNA, 64 nt, Human
uuucuuggcacuaaagauuagcuuuuuuaaaaaaacaucccauaaaacaguagaaacucaguuc

SEQ ID NO: 96608 - RNA, 64 nt, Human
cuucccauuucaagcacugccugggcacaccccaacaucccaggcugugguggcuccuguggga

SEQ ID NO: 96609 - RNA, 64 nt, Human
ccgggcuccuggcucuugauuuugucugccacagacaucccacaaagccgcugccauuuuauua

SEQ ID NO: 96610 - RNA, 64 nt, Human
aauauauuuuagucuguuauuuaagaaaaacauaacaucccaaaaucuuugacaauucucgaaa

SEQ ID NO: 96611 - RNA, 64 nt, Human
gaugggccaaucuucucauuucuuagugccucagacaucccauauguaaaaugagaguaauaaa

SEQ ID NO: 96612 - RNA, 64 nt, Human
aguaacucuguuaaauauuuggaggauuuaaagaacaucccaguuugaauucauuucaaacuuu

SEQ ID NO: 96613 - RNA, 64 nt, Human
uuuguauggcuugaaaaagaaaugacaauauggaacaucccaaggcugucccauaggguuggaa

SEQ ID NO: 96614 - RNA, 64 nt, Human; identical to SEQ ID NO: 84644

SEQ ID NO: 96615 - RNA, 64 nt, Human
aagcuccucuccuaggucuucugaaugucuugaaacaucccaggucccaggucuggugcgguuu

SEQ ID NO: 96616 - RNA, 64 nt, Human
uugugcucugcugagaauguacaguuugcauuaaacaucccaggucucauccuucaggaauuuu

SEQ ID NO: 96617 - RNA, 64 nt, Human
auuugcacacucuuauuuuucuguaaaauauuucacaucccaaaugugaagaagugaaaaagac

SEQ ID NO: 96618 - RNA, 64 nt, Human
ucagucuccucauuugcuuuuuaaauggaguaguacaucccauauuuuagaacaaguaggggug

SEQ ID NO: 96619 - RNA, 64 nt, Human
caauacccaugucuacacagauguucacccaaccacaucccacucacaacagcugccuggaaga

SEQ ID NO: 96620 - RNA, 64 nt, Human
uuguuucuaacugucuaucaaauaucuucauuagacaucccacaguaauuuuaagcucaguguu

SEQ ID NO: 96621 - RNA, 64 nt, Human
cuuuaucucuucaucuaucccaccucuugucugaacaucccaccuuuauccuguguucugccuu

SEQ ID NO: 96622 - RNA, 64 nt, Human
accacagccagacugaacguuugugaaagcugggacaucccaccacacgcugagccagaccugc

SEQ ID NO: 96623 - RNA, 64 nt, Human
ugcagcacugccucccagcgccagggucgcgggcacaucccacugagagcggggguccugcccc

SEQ ID NO: 96624 - RNA, 64 nt, Human
auugguaaauguuaggaacacaccaggucaccugacaucccaagaaugcucacaaaccugcagg

SEQ ID NO: 96625 - RNA, 64 nt, Human
auacacugcaaacuacaguggggauuuuaucuggacaucccaccaucaaagaucuugaaauagu

SEQ ID NO: 96626 - RNA, 64 nt, Human
ccuuaggccgagucucggggguggucacaaccccacaucccacagccagaaagaacaaugguca

SEQ ID NO: 96627 - RNA, 64 nt, Human
uacaaacagaaaagcucgaggcucccaccccgccacaucccaacuucauuucccccucacugua

SEQ ID NO: 96628 - RNA, 64 nt, Human
uagaaacccaauuaauuugauaagcuuggggacaacaucccaauagauaaaaauuuuuaaggga

SEQ ID NO: 96629 - RNA, 64 nt, Human
gacucuccucuaugccucaaaacuucagagaggaacaucccauaauguaugccuucucauauga

SEQ ID NO: 96630 - RNA, 64 nt, Human
agcugcugaaaggccacgggaggugaggcucuucacaucccauugggacuccaugcuccuugag

SEQ ID NO: 96631 - RNA, 64 nt, Human
ucccagccaggcccagccacccaggacuccugggacaucccaugugugaccccucugcggccau

SEQ ID NO: 96632 - RNA, 64 nt, Human; identical to SEQ ID NO: 84732

SEQ ID NO: 96633 - RNA, 64 nt, Human
caacagcagggaugcuacaugggaagagaaguggacaucccacauguucugcgugcuccuguag

SEQ ID NO: 96634 - RNA, 64 nt, Human
uauuccuugucuccaguaccacaggccacucuugacaucccauguuugccuggauaaaguuccu

SEQ ID NO: 96635 - RNA, 64 nt, Human
cacgcauacacacaugcccuccuggacaaggcuaacaucccacuuagccgcacccugcaccugc

SEQ ID NO: 96636 - RNA, 64 nt, Human
gaccccaccuugacgguggggcguagacuugacaacaucccacaguggcacggagagaaggccc

SEQ ID NO: 96637 - RNA, 64 nt, Human
caccuguaaagcaaguccuuucaaguuucacugcacaucccaaaccauguuacaaaaagagcaa

SEQ ID NO: 96638 - RNA, 64 nt, Human
gcacaauauguucaaguggugauuaaacuacauuacaucccauguuuauuugcucaggugucuu

SEQ ID NO: 96639 - RNA, 64 nt, Human
cagaacaucaacagugcuguuucugacacuucagacaucccacgcaaagccacauugaauuuuu

SEQ ID NO: 96640 - RNA, 64 nt, Human
agccaguggaggugagugacccugagacuaaugaacaucccaccuaaauccaguccuccccuug

SEQ ID NO: 96641 - RNA, 64 nt, Human
agguccuuguucucuucuccucuuccccuuuuccacaucccagccccaccucuguaaaggcuuu

SEQ ID NO: 96642 - RNA, 64 nt, Human
cuucuguuuauuguuuuccauauuuaaggaaacaacaucccauaauagaaaugagcaugcaggg

SEQ ID NO: 96643 - RNA, 64 nt, Human
agcaugaacgcaucaauagaaagaacucggggaaacaucccaucaacaggacuacacacuugua

SEQ ID NO: 96644 - RNA, 64 nt, Human
cagcccuuccaaacucuucccucucucacuccccacaucccaucgucucggccuucacaaucug

SEQ ID NO: 96645 - RNA, 64 nt, Human
cgaggaauaagcaggcuggggcuggugggcgucaacaucccaguuuuguucuaucuuucugucc

SEQ ID NO: 96646 - RNA, 64 nt, Human
aguuguaggaaaucuuaguauauuuuaaaagcugacaucccaccuaauuuuaaucuuuggucuc

SEQ ID NO: 96647 - RNA, 64 nt, Human
ccaugugcuuuagcauaaaagaauauuuagaaaaacaucccaagaaaaucacaucacuaccuag

SEQ ID NO: 96648 - RNA, 64 nt, Human
cacucucuuaucuugccuuauugcuauacuauuuacaucccacugcagaacagcagauuugagg

SEQ ID NO: 96649 - RNA, 64 nt, Human
caguucaggccccaccauuccugccaaggccauuacaucccacaaacccaaauacaaagcagcu

SEQ ID NO: 96650 - RNA, 64 nt, Human; identical to SEQ ID NO: 84648

SEQ ID NO: 96651 - RNA, 64 nt, Human
gccaauuaaaucaugauaugccaucaauuaugagacaucccaauuugagagauguuagauuaua

SEQ ID NO: 96652 - RNA, 64 nt, Human
aaugauuuugagccuuuuuuuuuaagcuuggcaaacaucccagcuaaucaaaauagucauauuc

SEQ ID NO: 96653 - RNA, 64 nt, Human
agaauaggaaaaccuuuaaaccccggucauccggacaucccaacgcaugcuccuggagcucaca

SEQ ID NO: 96654 - RNA, 64 nt, Human
gaggcgacugugcuugaguccucucuugcucuuuacaucccaaaucccaucaauugucacgccu

SEQ ID NO: 96655 - RNA, 64 nt, Human
gaaggauuccaaagcccugggaauggggaaccccacaucccaucccuaccuaauuuguuaauuu

SEQ ID NO: 96656 - RNA, 64 nt, Human
uagauaucuuaucagagcucagauuccagauuucacaucccagcagccgguucuggguagcaga

SEQ ID NO: 96657 - RNA, 64 nt, Human
cguucauguccuuaaauaucaccuauacucugccacaucccaaagggaucucaagccuucagcu

SEQ ID NO: 96658 - RNA, 64 nt, Human
uuccaauagacaacaaaguugaggaaccacuggcacaucccaagcuaagauacaagguuaaaug

SEQ ID NO: 96659 - RNA, 64 nt, Human
aaggugugaauuugagcacaguccagaaauggagacaucccacccccaguugaauaauggccca

SEQ ID NO: 96660 - RNA, 64 nt, Human
cauggaaauuguagcaugccaguaauuuuuaccaacaucccauacaucugaguucugcagucca

SEQ ID NO: 96661 - RNA, 64 nt, Human
uccagagcugcggugucucccugccucauuccccacaucccacugagcaugggaccauugggag

SEQ ID NO: 96662 - RNA, 64 nt, Human
uuagcaauaguuaauauuaggugacauaaauaaaacaucccagacuagugaguuaaguacaaga

SEQ ID NO: 96663 - RNA, 64 nt, Human
ggggaaggccuccgucugugugaaagggcacagcacaucccaggugcacccuccccaaguacuc

SEQ ID NO: 96664 - RNA, 64 nt, Human
aaauguaauugagagucuauucauggugaggaguacaucccagugccuuuaaccuggauuucua

SEQ ID NO: 96665 - RNA, 50 nt, Human
uccgaccagcagauuucuaaacaucccaguccaccugaggaacugucucg

SEQ ID NO: 96666 - RNA, 64 nt, Human
cagaccugucuuccaaggagaccaaguccuggcuacaucccagccugugguuacagugcagaca

SEQ ID NO: 96667 - RNA, 64 nt, Human
uuauagacagguaaaugugaguuaaauauaacucacaucccacucaagacacaaaacauuuucu

SEQ ID NO: 96668 - RNA, 64 nt, Human; identical to SEQ ID NO: 84696

SEQ ID NO: 96669 - RNA, 64 nt, Human
cugcccagcagcccugagcucagcugcaggaaggacaucccagaagccauggcuccuggggcgc

SEQ ID NO: 96670 - RNA, 64 nt, Human
gguuaaccacugcuuuggcaaugcugcuuauaacacaucccaagugcaggccgcagugguccac

SEQ ID NO: 96671 - RNA, 64 nt, Human
ugcuuacaugauuacaccuguaaaguaagcccaaacaucccaaauguccgucaacugaugagug

SEQ ID NO: 96672 - RNA, 64 nt, Human
uucacaggcagagaagccuguggcuaaaguuuccacaucccauuaacucagugcuuuugucuuu

SEQ ID NO: 96673 - RNA, 64 nt, Human
aguguuguauauaguguagcaaaagaguauuuauacaucccaccaaucaaaacacagcuuuauu

SEQ ID NO: 96674 - RNA, 64 nt, Human
agccaguggcccugggguggacccugcccuuuggacaucccauggacuugucacccagucgccu

SEQ ID NO: 96675 - RNA, 64 nt, Human
cugcugagguaaggugggaggagggcuacagcccacaucccacccccucguccaaucccauaau

SEQ ID NO: 96676 - RNA, 64 nt, Human
uuguggcccaacuaccagagaacgcugucccccgacaucccacuccaaagugugccaccuccag

SEQ ID NO: 96677 - RNA, 64 nt, Human
gaggcccugggugggggacacucagagugggagcacaucccagcagugcccauguagcaggagc

SEQ ID NO: 96678 - RNA, 64 nt, Human
uguucgcagugucaccccagagucagaacuguacacaucccaaaauuugguggccguggaacac

SEQ ID NO: 96679 - RNA, 64 nt, Human
cagcaccaccuccugcacugcacuucugccguccacaucccagcacacuggcgaccugacuagc

SEQ ID NO: 96680 - RNA, 64 nt, Human
uacaacuacuacuucuugggaccucaagcccccaacaucccaguccucaguccucagucaucuu

SEQ ID NO: 96681 - RNA, 64 nt, Human
aguuccucuaagcacauacucugcuuuucugucaacaucccauuuuggggaaaggaaaagucau

SEQ ID NO: 96682 - RNA, 64 nt, Human
auccuccuccuggacuccccucccugccgaacacacaucccaggagucugggaaggagggacug

SEQ ID NO: 96683 - RNA, 64 nt, Human
uauuugaguuuaccaacauacuuuaaaaguccuuacaucccaaauuguguuuauaauuauuuuc

SEQ ID NO: 96684 - RNA, 64 nt, Human
ggcuacuaagauguggauguccaugauguauaucacaucccagucugaaacauaagagacuucc

SEQ ID NO: 96685 - RNA, 64 nt, Human
guacuauauuuccguaagacccaauaguuacuguacaucccauaaauaaaaaauacuuuaguuu

SEQ ID NO: 96686 - RNA, 64 nt, Human; identical to SEQ ID NO: 84652

SEQ ID NO: 96687 - RNA, 64 nt, Human
gagacggacgguagacuuccaccauguaccgaucacaucccagcucugcauggccccugcuaag

SEQ ID NO: 96688 - RNA, 64 nt, Human
guggauaaaacuguguaaaccacauaauuuuuguacaucccaaaggaugagaaugugaccuuua

SEQ ID NO: 96689 - RNA, 64 nt, Human
uuagcgaacaaccacaggaauuuuaaaaacaaaaacaucccaagauuuuuucauuucaaaaugc

SEQ ID NO: 96690 - RNA, 64 nt, Human
gucaucaacuugcaauaccucacagagccaguucacaucccacucugagcucccacgagaaaca

SEQ ID NO: 96691 - RNA, 64 nt, Human
aacagccucacuuggucugccaggcccccaccacacaucccagcccaauccagguacgcacaga

SEQ ID NO: 96692 - RNA, 64 nt, Human
ugcuuccugguggcaaguaacugugcacccuccaacaucccaaccccagaggaaccagugggau

SEQ ID NO: 96693 - RNA, 64 nt, Human
aacauagacgauuguaccauugcacucagaagaaacaucccaggcccugagcagcgugucuuuc

SEQ ID NO: 96694 - RNA, 64 nt, Human
aaacuugauuugaguuucagugucucugaauugaacaucccacguuggaagaagauacauuugg

SEQ ID NO: 96695 - RNA, 64 nt, Human
cugugaacuccugaguucagcuugauuucugacuacaucccagcaagcucuggcaucuguggau

SEQ ID NO: 96696 - RNA, 64 nt, Human
uucccucccuccugcucugggcucagauacugugacaucccagaagcccagccccucaaccccu

SEQ ID NO: 96697 - RNA, 64 nt, Human
agagacuuccuugggguugcaaccuggggaagccacaucccacuggauccacacccgcccccac

SEQ ID NO: 96698 - RNA, 64 nt, Human
gugccccaucuggggccaacaccacuugucuguaacaucccacaucugccagggaagggucugg

SEQ ID NO: 96699 - RNA, 64 nt, Human
gcacgucccuuccccuuacuccccgccaaaacccacaucccagccucuggauccuggggaaggu

SEQ ID NO: 96700 - RNA, 64 nt, Human
aagcucagaccugcccccaguucaguacuugaccacaucccaggauuuauggugucugucuaug

SEQ ID NO: 96701 - RNA, 64 nt, Human
gcugugugacaguuugaugaaacugguuacauuuacaucccaaaacuuugguugaguuugcagg

SEQ ID NO: 96702 - RNA, 64 nt, Human
uuuuuuaauuguaauaaauauucuuaaaguuaccacaucccacaaaauggcccuugguggcagc

SEQ ID NO: 96703 - RNA, 64 nt, Human
ccccacacaauaaaugguaacauaggagacauccacaucccaauucugacaagaccucaugccu

SEQ ID NO: 96704 - RNA, 64 nt, Human; identical to SEQ ID NO: 84768

SEQ ID NO: 96705 - RNA, 64 nt, Human
cccucccagggaggcugugcacagacugucuugaacaucccaaaugccaccggaaccccagccc

SEQ ID NO: 96706 - RNA, 64 nt, Human
ugcaguggcgcgaucucggcucacugcaaccuccacaucccauguugaaguaauucuucugccu

SEQ ID NO: 96707 - RNA, 64 nt, Human
ggcaguuggccaaaacuuaaaagcaagaucuacuacaucccacauuaguguucuuuauauaccu

SEQ ID NO: 96708 - RNA, 64 nt, Human
cugcaccagcacugccucccccagggauccucucacaucccacacuggucucugcaccaccccu

SEQ ID NO: 96709 - RNA, 64 nt, Human
cuuugguagguggccugaacaccugagggacuggacaucccauguucagcaaugucaauggcau

SEQ ID NO: 96710 - RNA, 64 nt, Human
uauauauaaauaucuauaugacgcucuuaaaaaaacaucccaaccaaaaccaaccaaacaaaaa

SEQ ID NO: 96711 - RNA, 57 nt, Human
gcaccccccgugaggacuaauccagauacaucccaccagccucuccaagggugguga

SEQ ID NO: 96712 - RNA, 64 nt, Human
caucuugucuuacacauaaaagccacugcuuuuaacaucccauuguacauuuaacacauaaaug

SEQ ID NO: 96713 - RNA, 64 nt, Human
aucccauuguacauuuaacacauaaaugguguuaacaucccauuguacauuuaacacauaaaug

SEQ ID NO: 96714 - RNA, 64 nt, Human
uaucuaaugaggaacaaacacuaaccuaagguacacaucccaucugggcgguggcuucacuccu

SEQ ID NO: 96715 - RNA, 64 nt, Human
ccacuggcugcagcuagcccaccauaggcacagcacaucccaccacucuccuuccaguccugac

SEQ ID NO: 96716 - RNA, 64 nt, Human
accucagcgauuugugcuuguuugugcuagaagaacaucccaaauaggagaaccucucacaagc

SEQ ID NO: 96717 - RNA, 64 nt, Human
ucuguugcccaagcuagagugcagugaagccgcgacaucccaggcucaagugauccucccaccu

SEQ ID NO: 96718 - RNA, 64 nt, Human
acagcucccaccccacccccuucagugcccaccaacaucccauugcccugguuauauucucacg

SEQ ID NO: 96719 - RNA, 64 nt, Human
cugagccuccagacccugcuaaccacaaaagggaacaucccagcaggcugugcuuggaucaugc

SEQ ID NO: 96720 - RNA, 64 nt, Human
gccuuacaaggguucuaccagagaggaaaauuccacaucccaccagaagacagggguguuggca

SEQ ID NO: 96721 - RNA, 64 nt, Human
uguguccagacguguucuauugguaucucacuccacaucccagccacucuaucaagggauccuu

SEQ ID NO: 96722 - RNA, 64 nt, Human; identical to SEQ ID NO: 84602

SEQ ID NO: 96723 - RNA, 64 nt, Human
ugggaaagucccacacuguccuccuauuaccuuaacaucccaagcuuccuuuccuuuuuugguc

SEQ ID NO: 96724 - RNA, 64 nt, Human
agguaugauuuauguugauguguaaguucaccgcacaucccacuuuuuaacaaaacucaugaau

SEQ ID NO: 96725 - RNA, 64 nt, Human
uuuugucuuuuuuuuuuuuuuuuuuuaagccaugacaucccagaagaggacagugaauuacucc

SEQ ID NO: 96726 - RNA, 64 nt, Human
uuuuagaaccagcaagcacuguugauacugugaaacaucccauuuuuuccguauuagagaccag

SEQ ID NO: 96727 - RNA, 64 nt, Human
aacagcuucaccugggggggcccagcacgaagucacaucccagccccagagucacuguccagcc

SEQ ID NO: 96728 - RNA, 64 nt, Human
aaaaauugcaaccucaggcauaaauggguuaaggacaucccaagcccaagugguacgugccuca

SEQ ID NO: 96729 - RNA, 64 nt, Human
cuggcucugugccagggccccucuucugauucacacaucccauuuuuacacagacccuuccuuc

SEQ ID NO: 96730 - RNA, 64 nt, Human
gcacauguaucccagugagcaguaaaucaauggaacaucccaagaagaggauaaggaugcuuaa

SEQ ID NO: 96731 - RNA, 64 nt, Human
agccagcaagcuucggaaaaccacagcaucaaagacaucccaaauaacaugcccagcuagcucu

SEQ ID NO: 96732 - RNA, 64 nt, Human
gucucagcaccuccucccccaauucccaggucucacaucccaccccuccugcccuccaacccuu

SEQ ID NO: 96733 - RNA, 64 nt, Human
ucuaaucgcaugcaagcauugaccuaccacaccuacaucccacugugccugcauuauugaaauu

SEQ ID NO: 96734 - RNA, 64 nt, Human
aguagaaacacauuuacguugcaguuagcuauagacaucccauuguguuaucuuuuaaaaggcc

SEQ ID NO: 96735 - RNA, 64 nt, Human
caaaaaauuggaaagcaucuuacccauuuucuucacaucccaaauuuuuauuuguuccauguca

SEQ ID NO: 96736 - RNA, 64 nt, Human
uagaauguauuguaccuuuuaacaccugauguguacaucccauguaacagaaagggcaacaaua

SEQ ID NO: 96737 - RNA, 64 nt, Human
ugcagaggguuagaggcacuugagcaaggcccccacaucccaacucugggaguuguggugggag

SEQ ID NO: 96738 - RNA, 64 nt, Human
ccccucgugacagaaccuuucagcauaacgccucacaucccaagucuauacccuuaccugaaga

SEQ ID NO: 96739 - RNA, 64 nt, Human
accuccugccuacuccagccccuacccugcacccacaucccauacccucuucucccuacccauc

SEQ ID NO: 96740 - RNA, 64 nt, Human
gcaaccuccaagucgucugugccugagaugugaaacaucccauuuuaugauguaacccaacaac

SEQ ID NO: 96741 - RNA, 64 nt, Human
gccacguucccaagguuguaacagaagauucaaaacaucccauucuagccacacacaaauaaau

SEQ ID NO: 96742 - RNA, 64 nt, Human
gagcuuaucccccagacccugcuuuauaccauucacaucccagggcuguguccagacagcacaa

SEQ ID NO: 96743 - RNA, 64 nt, Human
gguguuuaauggguuaaaaauaagccacugccugacaucccaacauuugacaccccagcaaugu

SEQ ID NO: 96744 - RNA, 64 nt, Human
uacaguguggauaagcaggacaaaggggugauucacaucccaggcaggacagagcaggagauca

SEQ ID NO: 96745 - RNA, 64 nt, Human
uggguaguguaaauacacaagaaaaggaugauucacaucccaugugggauggagcagaacugca

SEQ ID NO: 96746 - RNA, 64 nt, Human
ugccggagcuuaagccccgcccccagcagcgagaacaucccaccccucccccccccccccccgc

SEQ ID NO: 96747 - RNA, 64 nt, Human
ugucuguagaagguuaaagcugacaacaugugaaacaucccagaauuaugacucuucccaaguu

SEQ ID NO: 96748 - RNA, 64 nt, Human
guacaauguuaacccuaaauuaauaaaagaguuaacaucccauggcacaggagccuguauuucu

SEQ ID NO: 96749 - RNA, 64 nt, Human
uuggguguggccugggcucaugccugguggugucacaucccaaggcagcaagagcauggauacc

SEQ ID NO: 96750 - RNA, 64 nt, Human
acuggaccccgcccagcauugggcugggcucgccacaucccaugagaguagagggcacuggguc

SEQ ID NO: 96751 - RNA, 64 nt, Human
aaaagacucaaguggacccuacaaugaagccuacacaucccaauagaagccccuucuuaugcug

SEQ ID NO: 96752 - RNA, 64 nt, Human
gguucuagcucccuguucuccaaacccauacuacacaucccacuucugggucuuugccugggau

SEQ ID NO: 96753 - RNA, 64 nt, Human
uagaaaacagacuggggaaccuuaugugagcagcacaucccaccagugaaacaggguauugcuc

SEQ ID NO: 96754 - RNA, 64 nt, Human
cccccaugggggcuguggccccuccgcaggcaggacaucccaaccccuggcugggacugaacca

SEQ ID NO: 96755 - RNA, 64 nt, Human
acccaucugcuccuccagccaacuccugucccucacaucccaccaugguggcuccucccaccuc

SEQ ID NO: 96756 - RNA, 64 nt, Human
uuacaaauagaaaacgauuccagucauacaggacacaucccacuccaaaugauauuuccaaaaa

SEQ ID NO: 96757 - RNA, 64 nt, Human; identical to SEQ ID NO: 84658

SEQ ID NO: 96758 - RNA, 64 nt, Human
uuggcaccccacagcccuucaccuucgcuaucaaacaucccaggaaaggguaagaauuuagggc

SEQ ID NO: 96759 - RNA, 64 nt, Human
gauggcucuaagggcuauaaauuacaaacaaaacacaucccagacauuaggaguucauaaguau

SEQ ID NO: 96760 - RNA, 64 nt, Human
agauuuucggaacacauuucccuacccuaaagcgacaucccaguaguguuuggaauuuucuguu

SEQ ID NO: 96761 - RNA, 64 nt, Human
gcuuccagggugugcggcccuggccgugugucugacaucccauaaauguguguguggugugacu

SEQ ID NO: 96762 - RNA, 64 nt, Human
augguugccgaucugcccuugucacagauaggcuacaucccaggguuucuggcugcaagugaga

SEQ ID NO: 96763 - RNA, 64 nt, Human
uacuuguggaagucggggacauaagaugauuuucacaucccagagcaucauagauaguuccauu

SEQ ID NO: 96764 - RNA, 64 nt, Human
gcccuggugaugacuuagggcuucccaucuguguacaucccacuuugaaucuugaucgugacaa

SEQ ID NO: 96765 - RNA, 64 nt, Human
ucauccucccuucucuguccacaccacgaguggcacaucccaccugcugauuccagcuccuggc

SEQ ID NO: 96766 - RNA, 64 nt, Human
ucaaauagauuuuugauucagcucauuaugaaaaacaucccaaacuuuaaaaugcgaaauuauu

SEQ ID NO: 96767 - RNA, 64 nt, Human
gcucaauugcugugcagguuaaaacuacagaaccacaucccaaagguaccugguaagaauguuu

SEQ ID NO: 96768 - RNA, 64 nt, Human
gauggcuccaagggcuauaaauuacaaacaaaacacaucccagacauuaggaguucauaaguau

SEQ ID NO: 96769 - RNA, 64 nt, Human
uggcauccacuugugguaaccccuuacgaugaugacaucccacacacuaagagguacaagcagg

SEQ ID NO: 96770 - RNA, 64 nt, Human
ggagggcugguggcacugccccucccugacccagacaucccaccaaagcuaacuuucccccacc

SEQ ID NO: 96771 - RNA, 64 nt, Human
uuuucuccuccggccuaguaggggaccuuggguaacaucccauuuuucggccaaggugaguugu

SEQ ID NO: 96772 - RNA, 64 nt, Human
gauggcucuaagggcuauaaauuacaaacaaaacacaucccagacauuaggaguucauaagugu

SEQ ID NO: 96773 - RNA, 64 nt, Human
ggggcaagagggaaggugaccgcccagcucucccacaucccacuggaucuggcuuacagggggg

SEQ ID NO: 96774 - RNA, 64 nt, Human
cccugccuccagcccuggcugcaaugucucuaccacaucccagcaccagggggagcaaacccug

SEQ ID NO: 96775 - RNA, 64 nt, Human; identical to SEQ ID NO: 84606

SEQ ID NO: 96776 - RNA, 64 nt, Human
auccauagaagggcuucccaaaccuuguuuugcaacaucccaaauugucuccaguugaaggaag

SEQ ID NO: 96777 - RNA, 64 nt, Human
aggccugugcacacaucccaggcaugucccagacacaucccacacguguccguguggccggcca

SEQ ID NO: 96778 - RNA, 64 nt, Human
aaugagcugugaccaucccaggaggccugugcacacaucccaggcaugucccagacacauccca

SEQ ID NO: 96779 - RNA, 64 nt, Human
gacaaggguaaacauuuuacuuuauguaauugccacaucccaagauguaaaacggcaguaauuu

SEQ ID NO: 96780 - RNA, 64 nt, Human
uuaacuuagacauucuuaugcuucuuuuacaacuacaucccauuuuauauuuccaauuguuaaa

SEQ ID NO: 96781 - RNA, 64 nt, Human
cacuggugccucauacucaguauugaaaaccacuacaucccagcuaccuauaaugcugucagcu

SEQ ID NO: 96782 - RNA, 64 nt, Human
aauuuauuucauucaguuuauucuuggcaaucaaacaucccauaaacuuugcuuuuauuaucaa

SEQ ID NO: 96783 - RNA, 51 nt, Human
ccagagacuucuacccauagcacaucccaacaccgucacgccaaaggaaga

SEQ ID NO: 96784 - RNA, 64 nt, Human
ugcugugcuugggaacccccacuccccacuccccacaucccaacauccuggugucuguccccag

SEQ ID NO: 96785 - RNA, 64 nt, Human
gaaggagguguugggcagcaucaaaggugcugggacaucccaggguggugagauccauccacga

SEQ ID NO: 96786 - RNA, 64 nt, Human
cagcucaauuagugccacauaugggggaaacgacacaucccagugggauuuccaacacuccccc

SEQ ID NO: 96787 - RNA, 50 nt, Human
ccgggacggcaacuuucugaacaucccacagcagucucagguaggagacc

SEQ ID NO: 96788 - RNA, 64 nt, Human
cuccaccuugaaggagccccccacauccuccccuacaucccagagaugccaccacuugugucuc

SEQ ID NO: 96789 - RNA, 64 nt, Human
cagcugacuuuucugacccauguucacguuguucacaucccauguagaaaaauaaagaugccac

SEQ ID NO: 96790 - RNA, 64 nt, Human
ucccuggaauucacccucucauguuucccuacuaacaucccaauaaaguccucuucccuaccag

SEQ ID NO: 96791 - RNA, 64 nt, Human
accaagacuugggccaccacuuguccaauaaaguacaucccagacgccacaccugcuguguccc

SEQ ID NO: 96792 - RNA, 64 nt, Human
cucugcugaccuccugcagacccaaaccacagccacaucccagcuucugugccagcacugugac

SEQ ID NO: 96793 - RNA, 64 nt, Human; identical to SEQ ID NO: 84700

SEQ ID NO: 96794 - RNA, 64 nt, Human
ugaccaguaucuauaaacguguuugcaugaguuuacaucccaggauuccaugauucuguaaaug

SEQ ID NO: 96795 - RNA, 64 nt, Human
cccauaaccucaaccacaucuuauccuccaccccacaucccaccacauccaccuccauccccaa

SEQ ID NO: 96796 - RNA, 64 nt, Human
aacucaagauugacucaugaggaccugaagggugacaucccaggaggggccucugaaauuuccc

SEQ ID NO: 96797 - RNA, 64 nt, Human
acucacagaaggggacugacagugggcaacacucacaucccacuggcugcuguucugaaaccau

SEQ ID NO: 96798 - RNA, 64 nt, Human
cgcucucgagcuguucuguaaauaccuggugcuaacaucccaugccgcucccuccucacgaugc

SEQ ID NO: 96799 - RNA, 64 nt, Human
ggugggggacaugagucccccugcugccccugccacaucccagugggcucugacccccugaucu

SEQ ID NO: 96800 - RNA, 64 nt, Human
ugcccagcauguuccugucucuccuuuuccuuccacaucccaccagucaccagcgcuauuguuu

SEQ ID NO: 96801 - RNA, 64 nt, Human
gugagagugccauccgaaagaagcuaaaccuugcacaucccaacacccaccccagggagaguuc

SEQ ID NO: 96802 - RNA, 64 nt, Human
uagcagccgccucccagcccugccuaggaaccguacaucccaucugcucucuggccaacggcuu

SEQ ID NO: 96803 - RNA, 64 nt, Human
ucagcauucuaucguccuguugugcucagccccaacaucccagacccguuacccacuacccuuc

SEQ ID NO: 96804 - RNA, 64 nt, Human
gaugacauguaccugugaaggccucaagaauguaacaucccaggcuucccuccauucuccugga

SEQ ID NO: 96805 - RNA, 64 nt, Human
cacaagacucccuccagugaggagcugggaggagacaucccaggaaaagaauuugauacuccuc

SEQ ID NO: 96806 - RNA, 64 nt, Human
ccugcccccucuccuuucccaccaggcguguguaacaucccaugugccucaccuaauaaaaugg

SEQ ID NO: 96807 - RNA, 64 nt, Human
aggaugaagggcccgagaacauggccuaagggccacaucccacugccacccuugacgcccugcu

SEQ ID NO: 96808 - RNA, 64 nt, Human
ugccgccaggacugcccccuucccagagcccuguacaucccagacugggcccagggucucccau

SEQ ID NO: 96809 - RNA, 64 nt, Human
guuggcaagagcaaaguuuccguugaugaaacagacaucccacaacaaaaacccaaguuuucug

SEQ ID NO: 96810 - RNA, 64 nt, Human
uuucucugcucugaaaaauggggaaaacugcuaaacaucccagagauuugcaaucuucuagcuc

SEQ ID NO: 96811 - RNA, 64 nt, Human; identical to SEQ ID NO: 84612

SEQ ID NO: 96812 - RNA, 64 nt, Human
uuucaggggagcguuucuuccaugacacacagcaacaucccaaagaaauaaacaagugugacaa

SEQ ID NO: 96813 - RNA, 64 nt, Human
guagcagcacuggcccucugucuuccuggguggcacaucccaagagccccuuccugcacuccug

SEQ ID NO: 96814 - RNA, 64 nt, Human
ggguggggacagugauaggcccaagguccccuccacaucccagcagcccaagcuuaauagcccu

SEQ ID NO: 96815 - RNA, 64 nt, Human
guauccucuuuuugcucccccauuuuaacuugccacaucccagucacagugggguuuuuuuguc

SEQ ID NO: 96816 - RNA, 64 nt, Human
ugguggcuuaauggcugcauuagauaggauccucacaucccauucagaaccaaaacugauacag

SEQ ID NO: 96817 - RNA, 64 nt, Human
gucuguagguugccagaacucaaaagucugaaaaacaucccaaaagaccauucuuagguuguac

SEQ ID NO: 96818 - RNA, 64 nt, Human
uuauuuacauuuaaacuugucaggguauaaaaugacaucccauuaauuauauuguuaaucaauc

SEQ ID NO: 96819 - RNA, 64 nt, Human
ugagcucgccugcauaugcagggucugucauggaacaucccaagucugugcagcagggagcccc

SEQ ID NO: 96820 - RNA, 64 nt, Human
aggcuggggguucucacaccuuacuccaccgggcacaucccaaccugcacuggggcccacucga

SEQ ID NO: 96821 - RNA, 64 nt, Human
gguauuuugaaaaaucccuccaagugauucuuuuacaucccagauagaaaacccuaaauuaaag

SEQ ID NO: 96822 - RNA, 64 nt, Human
ugaagcucccagcuggacaccacuccugagcgccacaucccaugaucacuucaaccacaggccu

SEQ ID NO: 96823 - RNA, 64 nt, Human
ggagcaggugggacccucaagaaaaugacggagaacaucccagacagaugggacucaagcagga

SEQ ID NO: 96824 - RNA, 64 nt, Human
caauaucaggcugccccacuccacguuccccagcacaucccagguggugggagcagaggguacc

SEQ ID NO: 96825 - RNA, 64 nt, Human
ucugugucaucacacauacccacuucacacacacacaucccaaauaccaccaccaaccaccuuc

SEQ ID NO: 96826 - RNA, 64 nt, Human
uaacucuucauguuccaguucaucccagaaguagacaucccaggacccauucugugucaaggug

SEQ ID NO: 96827 - RNA, 64 nt, Human
aggcuggggguucucacaccuuacuccaccgggcacaucccaaccugcacuggggcccacccga

SEQ ID NO: 96828 - RNA, 64 nt, Human
cugaauggaaaccuucccaccuaagcgcucuugaacaucccacuagcaggaaggcccugugugg

SEQ ID NO: 96829 - RNA, 64 nt, Human
ucuucccaucuuguggcauguggugcccccaccaacaucccaaggggaccaauccccuugccac

SEQ ID NO: 96830 - RNA, 64 nt, Human
aagcccuagaaacuaggguuccucugccccuuccacaucccaccugucucucuagcuugcuucc

SEQ ID NO: 96831 - RNA, 64 nt, Human
gaguccaucaccugcaacuuaaaugaacaagcuuacaucccauuuugagugaagauuuugaggu

SEQ ID NO: 96832 - RNA, 64 nt, Human
ggcaguggcagcuugucacccuugcccgauucccacaucccaguccugagggacucagcacaac

SEQ ID NO: 96833 - RNA, 64 nt, Human
agaacaccgccaacacgcacaccuccaaccugggacaucccacgcugggccucgcacggaggaa

SEQ ID NO: 96834 - RNA, 64 nt, Human
uacggagucuucccagagggccggcuggaacaguacaucccaagucggccauugaaaacucaag

SEQ ID NO: 96835 - RNA, 64 nt, Human
uuuuuaaauuucuuggugcuuugucuaauuaauuacaucccauaacuugucaggauaguugcuc

SEQ ID NO: 96836 - RNA, 64 nt, Human
uuuaccugggacuccauccccaaacccacuaaucacaucccacugacugacccucugugaucaa

SEQ ID NO: 96837 - RNA, 64 nt, Human
gcagaagacccggcuugcuccaguguagcuuucuacaucccacaucagguauauuagagcuuau

SEQ ID NO: 96838 - RNA, 64 nt, Human
uguugccuucacccuucagccucccgcuccaggcacaucccaccuuaccucucacuuggcugau

SEQ ID NO: 96839 - RNA, 64 nt, Human
guggagaucacagccccacccuugucccucagcaacaucccaucuaagcauuccacacugcagg

SEQ ID NO: 96840 - RNA, 64 nt, Human
guugugaggaaauaggggagagguauccugggccacaucccagccuaacaccugugagguucau

SEQ ID NO: 96841 - RNA, 64 nt, Human
cgucugggguguguuaucaaacagagcauggucuacaucccacugugucaaccagaagagccaa

SEQ ID NO: 96842 - RNA, 64 nt, Human
ugcuuuugacuccaggaacaaaaagguaaaucccacaucccaguuucucagaagucccuguuua

SEQ ID NO: 96843 - RNA, 64 nt, Human
agagaacuaugcugccacuucacauccacucaccacaucccaccuacagacuaccaccuuucga

SEQ ID NO: 96844 - RNA, 64 nt, Human
gugucuucugccucccucugcguugguaucugcuacaucccaggccaccaccuccgaggaugaa

SEQ ID NO: 96845 - RNA, 60 nt, Human
uggcguuuguaguugugucuuuuaagaagugagugugauuguuuacuugauaaaucagcu

SEQ ID NO: 96846 - RNA, 60 nt, Human
uaaaauuaagucauugaugcugcuguuacagagugugacagaggauccaugucugugaca

SEQ ID NO: 96847 - RNA, 60 nt, Human
aaagacaaaaaucccaccuugggcagagcugagugugagaagauggaaaaccaguaucug

SEQ ID NO: 96848 - RNA, 60 nt, Human
agagacuucuucccuucaggcuuauuguuugagugugaaguuccagagcaaggagccaug

SEQ ID NO: 96849 - RNA, 60 nt, Human
agaugauccauuggaguguggauggcuaaugagugugagguaucacuuaagggaguuggu

SEQ ID NO: 96850 - RNA, 60 nt, Human
agggcuauuccgcagcuugcagcaagcacagagugugaccucccaggauuugcugacagc

SEQ ID NO: 96851 - RNA, 60 nt, Human
gggcugcagggacaaacaucguuggggggugagugugaaaggugcugauggcccucaucu

SEQ ID NO: 96852 - RNA, 60 nt, Human
ugagugcucuguggacccacagccuaagcugagugugaccccagaagccacgaugugcuc

SEQ ID NO: 96853 - RNA, 60 nt, Human
gccgaggagaaugccagccagggcccgggagagugugagguuucaggaaaguauugagau

SEQ ID NO: 96854 - RNA, 60 nt, Human
uaaaaauacuaguuaaaaugccacaagcaugagugugauuguaugugcacuguguguaua

SEQ ID NO: 96855 - RNA, 60 nt, Human
ugccuuggacuugaauccaugcaauguuuagagugugaagucaguuacuuguugauguuu

SEQ ID NO: 96856 - RNA, 60 nt, Human
caucuguggacuugagcguccaaaaacccugagugugauucugggcagccggccuggcuu

SEQ ID NO: 96857 - RNA, 60 nt, Human
ugccugggacccucagggucuuagguuggggagugugaauaggaguuugcagauggagaa

SEQ ID NO: 96858 - RNA, 60 nt, Human
auuugaccugaauguguuccugccccccaggagugugaccagguacauguggaagaugug

SEQ ID NO: 96859 - RNA, 60 nt, Human
augugagugugagagugauaaugcaggggugagugugagagggacugcguuugcauuuuu

SEQ ID NO: 96860 - RNA, 60 nt, Human
ugagggugggcaugagucuugccagaaugugagugugagagugauaaugcaggggugagu

SEQ ID NO: 96861 - RNA, 60 nt, Human
uccccaguggggaggugacuguguuucccagagugugagccgcucuccucccccuaaaaa

SEQ ID NO: 96862 - RNA, 60 nt, Human
ucaucugcaaagagccauguauucaacaucgagugugaaaagaucuauuggaaaacaaca

SEQ ID NO: 96863 - RNA, 60 nt, Human
cucuuuuugauacuggaggaacacuugauggagugugagccaccuaagaucucgguuugc

SEQ ID NO: 96864 - RNA, 60 nt, Human
ucuccuggggcugucacauuuuauaggucagagugugacuucuuaauauggugcugaugu

SEQ ID NO: 96865 - RNA, 60 nt, Human
ggagagcaggguugggggagaggcugaggagagugugacauguggggagaggaccagcug

SEQ ID NO: 96866 - RNA, 60 nt, Human
gaagaggaggggugucuagggggacuggcagagugugagagggaccgugagggggcucuu

SEQ ID NO: 96867 - RNA, 60 nt, Human
aaauacacucccccuauaaaggggaagggggagugugacacuuucuuuccauguucaagu

SEQ ID NO: 96868 - RNA, 60 nt, Human
aguaauugccaaagcugcucuagccuugaggagugugagaaucaaaacucuccuacacuu

SEQ ID NO: 96869 - RNA, 60 nt, Human
auuuaagaacugaggaaccugagacucagagagugugagcuacuggcccaagauuauuca

SEQ ID NO: 96870 - RNA, 60 nt, Human
cccccuccccccaccccacaacaguccccagagugugauguuccccuuccuguguccaug

SEQ ID NO: 96871 - RNA, 60 nt, Human
acuauauuuaugggaaccccuucauccucugagugugaccaggcauccuccacaauagca

SEQ ID NO: 96872 - RNA, 60 nt, Human
gagcaucagccuucuagaaucggagcuccggagugugaagauucaguauugauaugauau

SEQ ID NO: 96873 - RNA, 60 nt, Human
cacacugugccuuguguuuggggcuugauagagugugaaagguguguugcuugaaaggug

SEQ ID NO: 96874 - RNA, 60 nt, Human
gccgcgguagaucauuuuuaucccgccagggagugugaugcaggaagaccacaugcgcuc

SEQ ID NO: 96875 - RNA, 60 nt, Human
guaaauucugaggccacagagaaaugcauugagugugaauguugucaucuguaaucccuc

SEQ ID NO: 96876 - RNA, 60 nt, Human
acugagcaaagcugggaauccugcagaaaagagugugaggagccagggaaaggcagaacc

SEQ ID NO: 96877 - RNA, 60 nt, Human
cacagagcuccuggcccuggccagaagcaggagugugaggaggagacagccucagcggac

SEQ ID NO: 96878 - RNA, 60 nt, Human
uuguacaggaauuugagcaaaaaauguauagagugugauguccaauugguauucagcacu

SEQ ID NO: 96879 - RNA, 60 nt, Human
uucugugcuguuacaguuuucuucaucaaugagugugauccaguuuuucauaagauauuu

SEQ ID NO: 96880 - RNA, 60 nt, Human
gcucacccagcaucucuuuuaccaaccagagagugugaaacuaguuucauauauuaccua

SEQ ID NO: 96881 - RNA, 60 nt, Human
uucuuauucccuuuaagaauguuuauguaugagugugaagaugcuagcgaaccuaugcuc

SEQ ID NO: 96882 - RNA, 60 nt, Human
uguggggaugggcuccugcagccuggggaggagugugacgacgguaacagcgaugugggu

SEQ ID NO: 96883 - RNA, 60 nt, Human
acagcaggcagcgccaagugcgugccgugugagugugacagggccaguggggccugugga

SEQ ID NO: 96884 - RNA, 60 nt, Human
ccccaucccccgaccccaccacaguccccagagugugauauuccccuuccuguguccacg

SEQ ID NO: 96885 - RNA, 60 nt, Human
agcaggcuuuaaaugucaccugcuaccuuagagugugaaggugaugguaacugccacagc

SEQ ID NO: 96886 - RNA, 60 nt, Human
cguaugugaaggaggcagugcugacuccgugagugugagacacgugcuuugaacugcuuu

SEQ ID NO: 96887 - RNA, 60 nt, Human
uacagauuucuaggcccucaggguuuuguagagugugagcccuggugggcaggguugggg

SEQ ID NO: 96888 - RNA, 60 nt, Human
gcauuucucaaaggaagcaggggauucagugagugugaaggugaacaggauggccuggca

SEQ ID NO: 96889 - RNA, 60 nt, Human
acaaaaaucaguauuguuauuuuuuuccaagagugugaaggaaaauggggcauuccuuuc

SEQ ID NO: 96890 - RNA, 60 nt, Human
gugaauauacacacacacacacacacaggugagugugaauacuuccuuguuggcugaucc

SEQ ID NO: 96891 - RNA, 60 nt, Human
uauauuccucuaaaacucucaagcagacgugagugugacuuuuugaaaaaaguauaggau

SEQ ID NO: 96892 - RNA, 60 nt, Human
ccuguccuucaguuuguauaaaccuaaggagagugugaaauccagcaacugaauuguggu

SEQ ID NO: 96893 - RNA, 60 nt, Human
uagcuuucuuccuggauuccucacuuugaagagugugaggaaaaccuauguuugccgcuu

SEQ ID NO: 96894 - RNA, 60 nt, Human
auaaaaauaugcuaaagauaggauaaaagugagugugagaucacccagggaagcaguaaa

SEQ ID NO: 96895 - RNA, 60 nt, Human
uaaagcaagaggaggcgaguuaauuuggaugagugugauuuugcugauugaaugugaguu

SEQ ID NO: 96896 - RNA, 60 nt, Human
aagaacugacacuagcuagauuuguauucagagugugagagcaagcucuacagauagacc

SEQ ID NO: 96897 - RNA, 60 nt, Human
ugcccucaagagcaaaguagaucaugcauagagugugauguauguguaauaaauauguuu

SEQ ID NO: 96898 - RNA, 60 nt, Human
cuguuuuacuccaaaagagagagagagagugagugugagugugugugugugugugugugu

SEQ ID NO: 96899 - RNA, 60 nt, Human
guauguauguauuuauuuauuuauugccuggagugugaacuguauuuauuuuagcagagg

SEQ ID NO: 96900 - RNA, 60 nt, Human
cccagagcagacccuuccuauggcggcccugagugugaguaucccugccaccaagagagc

SEQ ID NO: 96901 - RNA, 60 nt, Human
aucacagagcaacggagcaaaggcuuucgggagugugaggcugcaucugcuggagcaaag

SEQ ID NO: 96902 - RNA, 60 nt, Human
cuccuccuaaaugcaggcacuugcuaggaagagugugagcuggcgucuucuguucacccu

SEQ ID NO: 96903 - RNA, 60 nt, Human
cuaauucggagaugccuuucccagccaugggagugugaagugcuaggaugaaccuggcca

SEQ ID NO: 96904 - RNA, 60 nt, Human
gauaaaaucuacuccaaauuauuuucaagagagugugacucaucaggcagcccaaaaguu

SEQ ID NO: 96905 - RNA, 60 nt, Human
cucuagaucaaccugggaacagucacaagggagugugacuucuuggccauaauaaacuca

SEQ ID NO: 96906 - RNA, 60 nt, Human
ccagcaggauugcagaucauuugaggaucagagugugaaaacgaguuucucuuuuacaga

SEQ ID NO: 96907 - RNA, 60 nt, Human
ucaguguuguagguugagcgaaugcuaccagagugugagagaccauugucucguuggcug

SEQ ID NO: 96908 - RNA, 60 nt, Human
ugagugguuuguggcugugugugugacugugagugugagugacagauacauaguuucauu

SEQ ID NO: 96909 - RNA, 60 nt, Human
ggccacuggauuucccucacuggcucucaggagugugaccagaguagacuuggggcaugg

SEQ ID NO: 96910 - RNA, 60 nt, Human
ugaggucucgggcagcacgugagguagaacgagugugagcgucuccacgcaguggcuggc

SEQ ID NO: 96911 - RNA, 60 nt, Human
uguacguauguggcauuuccagguaugacugagugugagagacaugucagaggcucuuca

SEQ ID NO: 96912 - RNA, 60 nt, Human
accuggcaaccauucaggcacaugaagguggagugugaccuugaugugaccgggauccca

SEQ ID NO: 96913 - RNA, 60 nt, Human
uggauuuuuuugacuucuacuuuacuggcugagugugagccgccaugccuggccauaauc

SEQ ID NO: 96914 - RNA, 60 nt, Human
uauuggucuuaagugcaagagcacaaaugagagugugagagaaaguaccuucuauuuuaa

SEQ ID NO: 96915 - RNA, 60 nt, Human
aaaagguguguguauagguguguguuuggagagugugagcgagaacuaacaugguaaaau

SEQ ID NO: 96916 - RNA, 60 nt, Human
auguuuauuuuauggggacuaagggauuaggagugugaacuaaaagguaacauuuuccac

SEQ ID NO: 96917 - RNA, 60 nt, Human
ucccugaggcccuguguguuaucugugauggagugugaauguguaacgggcacuguguua

SEQ ID NO: 96918 - RNA, 60 nt, Human
cauacaagugggaaaccuuagaaaugcacugagugugagagagcuuucuacuaaugcuca

SEQ ID NO: 96919 - RNA, 60 nt, Human
guauugguucaaaguaugcauauaagcauugagugugaggaauuugcuauuucacuuuaa

SEQ ID NO: 96920 - RNA, 60 nt, Human
ugucuggaucaguaaaauuauacugugugugagugugaauauaaauguguguaugugugu

SEQ ID NO: 96921 - RNA, 60 nt, Human
ugacuguuuuucggacaguuuauuuguugagagugugaccaaaaguuacauguuugcacc

SEQ ID NO: 96922 - RNA, 60 nt, Human
auuaauacuucccuaggauauccuguguuugagugugaaguuaauaucacacaaagcaug

SEQ ID NO: 96923 - RNA, 60 nt, Human
uauuauuaagucuaacaaguccaaaagcuggagugugaggcaggaggcuggaaacccagg

SEQ ID NO: 96924 - RNA, 60 nt, Human
ugcgagugugugugagaauggcuguguggugagugugaacuuuguucugugaucauagaa

SEQ ID NO: 96925 - RNA, 60 nt, Human
gacgcuuccucaagcccagccuucuacagagagugugaacgguacagccccggccugacc

SEQ ID NO: 96926 - RNA, 60 nt, Human
gguuuaaacuaccucaaaacacuuucccaugagugugauccacauuguuaggugcugacc

SEQ ID NO: 96927 - RNA, 60 nt, Human
ugucgggagcagggagccaccuucaccugcgagugugaaguugguuacgggggaggccug

SEQ ID NO: 96928 - RNA, 60 nt, Human
cacaaaaccuggcacaauggcuaauucccagagugugaaacuuccuaaguauaaaugguu

SEQ ID NO: 96929 - RNA, 60 nt, Human
aaugccaccaacucuggcuuaguuaagugagagugugaacuguguggcaagagagccuca

SEQ ID NO: 96930 - RNA, 60 nt, Human
guguguguauacuuauguguguguaugugugagugugaauauauguauauguguacauau

SEQ ID NO: 96931 - RNA, 60 nt, Human
gacagaguuuugcucuuguugcccaggcuggagugugauggcucgaucuuggcucaccac

SEQ ID NO: 96932 - RNA, 60 nt, Human
ccgucgccccuccuguuggguaaggguguugagugugacuugugcugaaaaccugguuca

SEQ ID NO: 96933 - RNA, 60 nt, Human
guaggugcucaaguguuucuguucgggacugagugugaaucuguaaaaggggaaaauccu

SEQ ID NO: 96934 - RNA, 60 nt, Human
ucuguuuuugauaagaauaagaaagggagugagugugaagauggugguuagcaguuucac

SEQ ID NO: 96935 - RNA, 60 nt, Human
cuugaugggugcguucccgcagaccaaagagagugugacucccuugccagcuccagagug

SEQ ID NO: 96936 - RNA, 60 nt, Human
cauuucagacucaaugcucugaucucuagggagugugauuauucaaacuaaugagaggac

SEQ ID NO: 96937 - RNA, 60 nt, Human
cucucucuuuuguaauuuauguucccaauugagugugaauguccaaguaaugguguaugu

SEQ ID NO: 96938 - RNA, 60 nt, Human
ccuccagccccuugcugguuaucuuacucugagugugaugcagucagaggcaccugcggg

SEQ ID NO: 96939 - RNA, 60 nt, Human
auugugcuguucuaggaacaucauccuagagagugugauguucacuauaaccccauaccu

SEQ ID NO: 96940 - RNA, 60 nt, Human
acuugcauacauauauauuuuuggcugggggagugugaguuuugccuuucuaagggaggg

SEQ ID NO: 96941 - RNA, 60 nt, Human
aaacccuagaggguugcauagucuagaaaggagugugaccugacagugcuggagccuccu

SEQ ID NO: 96942 - RNA, 60 nt, Human
agacuucacuaacacagaaaaacagaaacugagugugagaguugugaaauacaaggaaau

SEQ ID NO: 96943 - RNA, 60 nt, Human
guuuccaaggaaaggaaauguuaugagcaagagugugaggcaagagaagcuggaaccaca

SEQ ID NO: 96944 - RNA, 60 nt, Human
cccccuccccccaccccacaacaguccccagagugugaugauccccuuccuguguccaug

SEQ ID NO: 96945 - RNA, 60 nt, Human
aagaauaugcacagucugaauguauaccaggagugugagagacacaugcccacuucaugc

SEQ ID NO: 96946 - RNA, 60 nt, Human
caagaugagcaaagaaagguuugcacagaggagugugaauguguguuuguugcuggcuga

SEQ ID NO: 96947 - RNA, 60 nt, Human
uagucaacccauccccagggccauaguguagagugugaaaagcuacccugaaacccagua

SEQ ID NO: 96948 - RNA, 60 nt, Human
accuucugcccuccugccaaaagaucuggggagugugaggagaggguggcaucaggagcu

SEQ ID NO: 96949 - RNA, 60 nt, Human
uccaagcccuuugggagccaaagugucugagagugugacccucuccuguaaaguauuuau

SEQ ID NO: 96950 - RNA, 60 nt, Human
gccaucccacgccgccugcguguggagcuggagugugaggagggcgagcugucuuucuau

SEQ ID NO: 96951 - RNA, 60 nt, Human
agagcguguagaacuguggccagacuuuaggagugugagggaugcugaaucucccagaga

SEQ ID NO: 96952 - RNA, 60 nt, Human
uuggcauuggcuacuccaucuguccuagcagagugugacuaaacuggaaauguauggagc

SEQ ID NO: 96953 - RNA, 60 nt, Human
cucuuguguuugacacuaagaaaauagcaagagugugaaaucucagauacuuaugaaauc

SEQ ID NO: 96954 - RNA, 60 nt, Human
ucccuagcuuaguuucuaggacuuaucugagagugugauuucaugcagugguaauaagaa

SEQ ID NO: 96955 - RNA, 60 nt, Human
cauuuauauaauuuuccuguuuaacaacaagagugugaccuaaaugcuuuugucuuguca

SEQ ID NO: 96956 - RNA, 60 nt, Human
ggucucacugccuuuccuucccacagaccugagugugaaagacugagaguugaggaguua

SEQ ID NO: 96957 - RNA, 60 nt, Human
ucggauacacacucgaaucauugaagauccgagugugauuugaauucugugauauuuuca

SEQ ID NO: 96958 - RNA, 60 nt, Human
aagaggucuucugaccuuuccuuuccccgugagugugaagcuggcagaaaucacuaguaa

SEQ ID NO: 96959 - RNA, 60 nt, Human
gaauacuagaaaagauuuaaaaaauaguaugagugugaguacuaggaaggauuagugggc

SEQ ID NO: 96960 - RNA, 60 nt, Human
ggaaacgaugaaauaagauauauacaaggugagugugacuucccuucuaacccccucugc

SEQ ID NO: 96961 - RNA, 60 nt, Human
uggaguuugauggacagggcugccuuuaaugagugugaaggucacuaagucacuuagaca

SEQ ID NO: 96962 - RNA, 60 nt, Human
cgugcuguacgugugugugugugugugagcgagugugaacucuucaagaaacaugcauuu

SEQ ID NO: 96963 - RNA, 60 nt, Human
uuuuccuguguaauuuggguagauuuucaagagugugaacacaaauuuaaaauaagcuau

SEQ ID NO: 96964 - RNA, 60 nt, Human
gcucugaaauucaggacacauacauuuauagagugugaggcugugcauacguacauucau

SEQ ID NO: 96965 - RNA, 60 nt, Human
caggacagggccuggggugugugugagugugagugugagcgagagggugaguguggucag

SEQ ID NO: 96966 - RNA, 60 nt, Human
accagccaggacagggccuggggugugugugagugugagugugagcgagagggugagugu

SEQ ID NO: 96967 - RNA, 60 nt, Human; identical to SEQ ID NO: 96918

SEQ ID NO: 96968 - RNA, 60 nt, Human
ccuucccugucugccagggccagucuugacgagugugaagcuuccuuggcuuuuacugaa

SEQ ID NO: 96969 - RNA, 60 nt, Human
ggaaaauuuuaacugcaugguaugaauucagagugugacuuaagggucaauucaaagcag

SEQ ID NO: 96970 - RNA, 60 nt, Human
gacugaguuucgcucuugucauccuggcuggagugugauggugcgaucuugacucacugc

SEQ ID NO: 96971 - RNA, 60 nt, Human
uacugcucuuuauugcagaauguggguauugagugugauuugaaugauuuuucauuggcu

SEQ ID NO: 96972 - RNA, 60 nt, Human
uuucccggggagaccuuuccagugucgguagagugugaggauggagaccgguucccggcg

SEQ ID NO: 96973 - RNA, 60 nt, Human
uaacagaagccagugaagcaauggaagcuggagugugacuggaaaaauacucagcaaaca

SEQ ID NO: 96974 - RNA, 60 nt, Human
ccagagucugcauggcacuccugaagaagggagugugaccugcagucaccaggagaugag

SEQ ID NO: 96975 - RNA, 60 nt, Human
gaaggacccugcuccaccuggggggacugggagugugagugugcauggcauguguguggc

SEQ ID NO: 96976 - RNA, 60 nt, Human
aaauuaagguuagcggaucauguacaagcugagugugaaaguagaaaucaccuacaccag

SEQ ID NO: 96977 - RNA, 60 nt, Human
uuugucaagacauuaaaccaucuuagaucggagugugaaguaaauuaugguauauuuuau

SEQ ID NO: 96978 - RNA, 60 nt, Human
uaauauccgugagagugagugacggagugagagugugagcgaguggauguggcugucagu

SEQ ID NO: 96979 - RNA, 60 nt, Human
aucuaauucuccugacuguucuucccaggggagugugaaggucuuggcccuguucccugu

SEQ ID NO: 96980 - RNA, 60 nt, Human
uuaacuuaugaaaaaauuauuuggggacaggagugugauaccuuccuugguuuuuuuuug

SEQ ID NO: 96981 - RNA, 60 nt, Human
augagauuccuuggccugaacucugugauagagugugacugagcugcugggggacaugug

SEQ ID NO: 96982 - RNA, 60 nt, Human
cccagaaagcaagcccaggagaggaaggcagagugugacagagcagagccagggccaggc

SEQ ID NO: 96983 - RNA, 60 nt, Human
gacuguguuuuauuauuucauggcuuguaugagugugacuggguguguuucuuuaggguu

SEQ ID NO: 96984 - RNA, 60 nt, Human
uuaccuuuucacaugacuuaccccucauccgagugugagguuacaagcaggugucauggc

SEQ ID NO: 96985 - RNA, 60 nt, Human
gucaccugugccaaccauggggugucccgugagugugaguguggcagugagaagaagcau

SEQ ID NO: 96986 - RNA, 60 nt, Human
ggaaaagcuuccuugaugugagcucugggggagugugaaggaugcaucucuagcccccga

SEQ ID NO: 96987 - RNA, 60 nt, Human
gucugagaaccaugucuauuuuuauaacuggagugugaguucuguaucuucucacauucu

SEQ ID NO: 96988 - RNA, 60 nt, Human
cacauccuggcuccaguguggaugcagagagagugugacagaggaucugccugugaacca

SEQ ID NO: 96989 - RNA, 60 nt, Human
uccuguuucuacaggaagucaugcucgagggagugugaagugguucagguuggugcagag

SEQ ID NO: 96990 - RNA, 60 nt, Human
cucugauuagggaaccuguauaaggguauugagugugagguugaggugggacauuugcug

SEQ ID NO: 96991 - RNA, 60 nt, Human
uccucuuuguuuuuguccaucaaggcacaugagugugaccucugccauggggaaacacac

SEQ ID NO: 96992 - RNA, 60 nt, Human
aagugaacauuuauauccgauaaggggugggagugugauuuuaaaugcucuuuugggaga

SEQ ID NO: 96993 - RNA, 60 nt, Human
cugcauguaaaguaaaucauuuuguauuuggagugugacaagcuuuaccuuugaacucaa

SEQ ID NO: 96994 - RNA, 60 nt, Human
uaaguaaauuccauguuguaauguuacagagagugugauuugguuugugauauauauaua

SEQ ID NO: 96995 - RNA, 60 nt, Human
guccucacaugcagaguugugcaugccccugagugugaacagguuugccuacguuggugc

SEQ ID NO: 96996 - RNA, 60 nt, Human
cuuaauaaauguaugacacugaaaagauuugagugugaaucuacugaaaucacuauaaug

SEQ ID NO: 96997 - RNA, 60 nt, Human
augucaucgcugcauuuuauuucacaagaggagugugagggucaaggggaugaaaugagg

SEQ ID NO: 96998 - RNA, 60 nt, Human
aaggucaucaucgauucuacuuuagaaugagagugugaaauagacauuuguaaauguaaa

SEQ ID NO: 96999 - RNA, 60 nt, Human
ccccauaaaaugauccugccaaucuaaugugagugugaagcuuugcacacuaguuuaugc

SEQ ID NO: 97000 - RNA, 60 nt, Human
aaucucccaaaugacugucucuaucuucaugagugugacuugagguguugggauggguga

SEQ ID NO: 97001 - RNA, 60 nt, Human
uuuucuuggcaguuaugucgaugaaaucaagagugugauguucuaguuauuuuuuuuuau

SEQ ID NO: 97002 - RNA, 60 nt, Human
auauguguaauuggaagagggcauuuguuugagugugaguuuggaggccuuuuuaacaug

SEQ ID NO: 97003 - RNA, 60 nt, Human
uuucucgguucucagaggaaaaguaugaaugagugugaaguguaugugagaacuuuuguu

SEQ ID NO: 97004 - RNA, 60 nt, Human
gugaggcugaguguguuuaaguacgugagagagugugaguguguuuguaagugagugucc

SEQ ID NO: 97005 - RNA, 60 nt, Human
gugugacuccuuccagagccacagguaggggagugugaaguugagggggaggaaagcugg

SEQ ID NO: 97006 - RNA, 60 nt, Human
uacuguuaaauauauguguguaaucagccugagugugaaaguuaauggaggccugggaac

SEQ ID NO: 97007 - RNA, 60 nt, Human
gcucugcauucaguguucauugugaauugggagugugagucuuucuguaggguagaaaga

SEQ ID NO: 97008 - RNA, 60 nt, Human
agggcaucccagaaacguguaaaugaccccgagugugacugggaaggagaacuuauuccu

SEQ ID NO: 97009 - RNA, 60 nt, Human
uagaguauuuuaauccuauuacuugacuaagagugugaagguaguacuuuuuagagugca

SEQ ID NO: 97010 - RNA, 60 nt, Human
gguggcugcacuggcacagaauacuaaacugagugugacuauuuucacugcaacaaauga

SEQ ID NO: 97011 - RNA, 60 nt, Human
cuggcuaaugagugaagaaggucacuguaggagugugaggaccaucaggagcuucauauu

SEQ ID NO: 97012 - RNA, 60 nt, Human
uugaacucaagggagaagguauaguggaaugagugugagcaucgggcuuugcagucccau

SEQ ID NO: 97013 - RNA, 60 nt, Human
agaauggcugacuugaagagcaacaucauagagugugaauuucuauuugggaaggagaaa

SEQ ID NO: 97014 - RNA, 60 nt, Human
gugccacugggggcacacugaacuuguagggagugugauuuuguuggaggugcacauggu

SEQ ID NO: 97015 - RNA, 60 nt, Human
uuggaagguggcccaguaugagcccuagaagagugugaaaaggaauggcaaugguguuca

SEQ ID NO: 97016 - RNA, 60 nt, Human
aaaguggggagaaaagucuguuugccucaggagugugaggacuacacuagugaaagcgcc

SEQ ID NO: 97017 - RNA, 60 nt, Human
acgagggcgugugucaguggcugugugcaggagugugagugagcaagagcaagagcgcau

SEQ ID NO: 97018 - RNA, 60 nt, Human
uccuuucugugcaaccaauuaaagaacaaugagugugaugcuccaugucugaauuucguc

SEQ ID NO: 97019 - RNA, 60 nt, Human
uacgauuuuucacuuccaccaucaaguuaugagugugauuguuucccugcaguuuugcca

SEQ ID NO: 97020 - RNA, 60 nt, Human
gacugcggagccugcuccacugccaccacggagugugagaccaucugaggccgcuagcug

SEQ ID NO: 97021 - RNA, 60 nt, Human
gagacagauuuguccuuuacagaaauuacugagugugaauaaaaacuucagauccaagaa

SEQ ID NO: 97022 - RNA, 60 nt, Human
guggaaaauaaaaggcucugcccccagugugagugugaccgguuguacccuggaguagug

SEQ ID NO: 97023 - RNA, 60 nt, Human
uugccuuuuugggugccucacagagccccagagugugagaccugaaagaauguucagcau

SEQ ID NO: 97024 - RNA, 60 nt, Human
agagccuuccaugguagagauuucucuuaagagugugauuucucauagggcuaguaaggg

SEQ ID NO: 97025 - RNA, 60 nt, Human
ggcccugcaucccuugccucaggccgggcugagugugacugcagcuccugaggaugggcc

SEQ ID NO: 97026 - RNA, 60 nt, Human
gguagauuucacagcccuucuacuaauagugagugugaaggcaagcuugaugcaaaaccu

SEQ ID NO: 97027 - RNA, 60 nt, Human
gccacuauuuugaugauggcugaugugugugagugugauggcccugaagggcuguaggac

SEQ ID NO: 97028 - RNA, 60 nt, Human
uuccccaaggauuuauugacauugcuacuugagugugaacaguuaccuggaaauacugau

SEQ ID NO: 97029 - RNA, 60 nt, Human
cuuccucuucucucuggaacggcucacaaugagugugacauuagaaaacuccuugcagag

SEQ ID NO: 97030 - RNA, 60 nt, Human
ugcugugcagacaccucuguggccccccaggagugugaguggccuggggagggggccgug

SEQ ID NO: 97031 - RNA, 60 nt, Human
gggcacgggcgcgggccgggccucaagggugagugugaaauaaacaaauccugcaguguu

SEQ ID NO: 97032 - RNA, 60 nt, Human
acuaggauacuuuuauaugaugggugcuuugagugugaaugcagcaggcucucuuguuuc

SEQ ID NO: 97033 - RNA, 60 nt, Human
ccuuaacuacaugucuguggguaucacacugagugugaguuguguccacacgugcucaag

SEQ ID NO: 97034 - RNA, 60 nt, Human
aguauauguuaggagguuauaaaucuuguggagugugaauuaaguauguggagugucuag

SEQ ID NO: 97035 - RNA, 60 nt, Human
aaaaaaaaaaaaaacuucauuggcuuguccgagugugaaaugcacauuuaggaagguuac

SEQ ID NO: 97036 - RNA, 60 nt, Human
gggcccggguugggucaccagacggggcuggagugugaggguccugcagccugcaggacc

SEQ ID NO: 97037 - RNA, 60 nt, Human
guccagccaccccccagcacuuuauguagagagugugacauagaccugcauauuugucag

SEQ ID NO: 97038 - RNA, 60 nt, Human
cacacaggggagaagccuuaugucugcagagagugugagcggggcuuuagccggaaguca

SEQ ID NO: 97039 - RNA, 60 nt, Human
caugaaggcagccacagacaacauggaaaugagugugacuauguuccaauaaaacuuuau

SEQ ID NO: 97040 - RNA, 60 nt, Human
ugucugcaggugucugacacgcaagugugugagugugagugugagagauggggcgggggu

SEQ ID NO: 97041 - RNA, 60 nt, Human
caggugucugacacgcaagugugugagugugagugugagagauggggcgggggugugucu

SEQ ID NO: 97042 - RNA, 60 nt, Human
guccugaccgugggccccucaggggucugggagugugacguuguaaucuucauccgucuc

SEQ ID NO: 97043 - RNA, 60 nt, Human
agccacaggcagacgaugucaaccuugugugagugugacggggguugggguggggcggga

SEQ ID NO: 97044 - RNA, 60 nt, Human
ccaggagaaggucagcgagaaggaguguaugagugugagugugugugcauggaaguuggg

SEQ ID NO: 97045 - RNA, 50 nt, Human
gcaugugugugugugugugagagugugaaugcacagguggguauuuaauc

SEQ ID NO: 97046 - RNA, 60 nt, Human
caucuuccaaucccuggaaaagucuggucugagugugacuugggaagcuuucagugcugc

SEQ ID NO: 97047 - RNA, 60 nt, Human
accaaauggaaauaagaggauauugaucacgagugugaugcugaguaccuuucugcauau

SEQ ID NO: 97048 - RNA, 60 nt, Human
uucauccuguguccccugaccuguccaggugagugugagggcagcacugggaagcuggag

SEQ ID NO: 97049 - RNA, 60 nt, Human
ucagggaacugcuugcccagggugcagugugagugugaugggccaccggggcaagaggga

SEQ ID NO: 97050 - RNA, 60 nt, Human
cagggccuucuccagaucuguuccaacuuggagugugaagggcuugagcauacgggggaa

SEQ ID NO: 97051 - RNA, 60 nt, Human
acuuggcaguuaauggaucugcuguugcuggagugugagcguggacuugaugcagugaug

SEQ ID NO: 97052 - RNA, 60 nt, Human
gagaaggagggccgggcgcaccagugccuggagugugaccgcgccuucucaucggcggcg

SEQ ID NO: 97053 - RNA, 60 nt, Human
uuuuuagcuuuuaaaauuuaaaguguuuuugagugugaaaaguugaguaaaacuauuugc

SEQ ID NO: 97054 - RNA, 60 nt, Human
uucuauuucuugguggagcagcacauuguggagugugauucuuaauucuucauugaguuu

SEQ ID NO: 97055 - RNA, 60 nt, Human
gucaucauuucacuugucaggagugugugugagugugagugugcggcugugugugcacgc

SEQ ID NO: 97056 - RNA, 60 nt, Human
gacugugugccgggcacuagugauacaaaagagugugacaguuguucagucugcauuuuc

SEQ ID NO: 97057 - RNA, 60 nt, Human
aagaacauucauacugaagaggaacccuaugagugugaagaauauggcaaagccuucaac

SEQ ID NO: 97058 - RNA, 60 nt, Human
aaacacgaccagguccgaaaugcaggucaugagugugaaauucucaaauuuacauaaaaa

SEQ ID NO: 97059 - RNA, 60 nt, Human
uaaaugacauauaaguuauacauauuuauggagugugaaauuugauacauguauauaaug

SEQ ID NO: 97060 - RNA, 60 nt, Human
caugauggugaugaaucuauuaaucaugaugagugugauaggggugcucuucaagacuua

SEQ ID NO: 97061 - RNA, 60 nt, Human
acaaucuguaucuuugacaauucugggugcgagugugagagugugagcagggcuugcucc

SEQ ID NO: 97062 - RNA, 60 nt, Human
uaucuuugacaauucugggugcgagugugagagugugagcagggcuugcuccugccaacc

SEQ ID NO: 97063 - RNA, 60 nt, Human
uccaguagggaaacaaaauugauaaauauugagugugaguaauugggauuggggagauug

SEQ ID NO: 97064 - RNA, 60 nt, Human
cagagaguucacaccagaucaagguguuaugagugugacaaauggggaauauucuuuagc

SEQ ID NO: 97065 - RNA, 60 nt, Human
auucuuuagcagcagagacugaggggugcagagugugagcugggaaagguuuguggcucc

SEQ ID NO: 97066 - RNA, 60 nt, Human
aaagugggaaaaucuuccaacuguccucuagagugugaauauaugaaaggagucagagug

SEQ ID NO: 97067 - RNA, 60 nt, Human
guccacacucaagagaacgggaugauacaagagugugaauaaguccuggagacaggacca

SEQ ID NO: 97068 - RNA, 60 nt, Human
guuggcauuagagguuuuauaccauuaaaagagugugacaauguauuguaguccaucauc

SEQ ID NO: 97069 - RNA, 60 nt, Human
ugugcccaugugauugaguucuagccaauggagugugagcaaaagugauauaagccacuu

SEQ ID NO: 97070 - RNA, 60 nt, Human
aaacucccaggagacagcagccuaguuuucgagugugagcuugugcuugugaaagcuaac

SEQ ID NO: 97071 - RNA, 60 nt, Human
ugugcauacauccaccuggugucccgugaggagugugagcaugccuacccuggccagauc

SEQ ID NO: 97072 - RNA, 60 nt, Human
cucccuaaguguucuagcaauaugauuauggagugugauucaguguacaugcugauuguc

SEQ ID NO: 97073 - RNA, 60 nt, Human
aacauuauuggcuuccuccuagaguguugugagugugagaaggccuuucacuagccccac

SEQ ID NO: 97074 - RNA, 60 nt, Human
cagaggguucuuacuggaucaggaccuuaugagugugacaaacgugggauauucuuuaug

SEQ ID NO: 97075 - RNA, 60 nt, Human
augacuaacgguagaaaaguuauugccuaggagugugagacugauguugcuggacagaaa

SEQ ID NO: 97076 - RNA, 60 nt, Human
uccuccauaucucccucuucccuaggagaggagugugaagcaaggagcuuagauaagaca

SEQ ID NO: 97077 - RNA, 60 nt, Human
aacuucugagucgcccaucuguugcugugggagugugaacggaucgcugaaggagaggga

SEQ ID NO: 97078 - RNA, 60 nt, Human
cgagaaccaguucagaguggacuacauccugagugugaugaacgugccugacuuugacuu

SEQ ID NO: 97079 - RNA, 60 nt, Human
acacacuuccuuccuucuuuggugucugaggagugugaacuguuggggucaguuaagacc

SEQ ID NO: 97080 - RNA, 60 nt, Human
ccccucagcaccaggguaccaggagcugaggagugugagcgugccgucaucgacuuugug

SEQ ID NO: 97081 - RNA, 60 nt, Human
uggugacaggguguguguguaucugugcgugagugugagugugugugagagagaauuggu

SEQ ID NO: 97082 - RNA, 60 nt, Human
ggagagcccagugaacugacccuucaggcugagugugaagcgucucagaggcauuucaga

SEQ ID NO: 97083 - RNA, 60 nt, Human
agaagaggagagggcuuggauagaguugaggagugugaggcuguuagacuguuagauuua

SEQ ID NO: 97084 - RNA, 60 nt, Human
aggggauuccaauaagcuugcucgcucucugagugugacuugggcuaaaggcccccuuuu

SEQ ID NO: 97085 - RNA, 60 nt, Human
ucacagcgccuccuggaccugaaggcaucugagugugagacccuguucuaacucuuagaa

SEQ ID NO: 97086 - RNA, 60 nt, Human
guccuccuuaaccacuuaucucccauaugagagugugaaaaauaggaacacgugcucuac

SEQ ID NO: 97087 - RNA, 60 nt, Human
aggugccacaaugcaaaugcuuaaggcacggagugugaaugugaagacacaagcucuuuc

SEQ ID NO: 97088 - RNA, 60 nt, Human
ugcaaagacucuccugcuuuuuuucugucugagugugagcuccauccgccugggcaucug

SEQ ID NO: 97089 - RNA, 60 nt, Human
acucuuuuuuugccccccgcccucauccuggagugugagggugcucgcccguacucucag

SEQ ID NO: 97090 - RNA, 60 nt, Human
cucacacaaggaggaacuugggugaaggcugagugugaggcaccugaaguuucccugcgg

SEQ ID NO: 97091 - RNA, 60 nt, Human
cacaggguaaggaagagagagugggaggcagagugugauggggaggagggacaggaagac

SEQ ID NO: 97092 - RNA, 60 nt, Human
gguguggugccagcuugagugggagugugugagugugagcaggcgggcgagugcgugagu

SEQ ID NO: 97093 - RNA, 60 nt, Human
guggggaaggggcucacaugggcccaggcugagugugagugagcaugucaaguugucuga

SEQ ID NO: 97094 - RNA, 60 nt, Human
ucuucccuuaacuccaagaacuugggauaagagugugagagagacugauggggucgcucu

SEQ ID NO: 97095 - RNA, 60 nt, Human
gcuaugaucuugccauugcacuccagcugagagugugacccugucucuaaagaaaaacua

SEQ ID NO: 97096 - RNA, 60 nt, Human
gggggaagggaagagcggcgugagcggagggagugugaugauucccaaccgaaagcagcu

SEQ ID NO: 97097 - RNA, 60 nt, Human
ugaaccaacaucaggggcaccugccaugaugagugugaagaaaucauuucucuaugcaag

SEQ ID NO: 97098 - RNA, 60 nt, Human
gagucagagagaguguguaugggugugugugagugugaguguguguguacgcacacacac

SEQ ID NO: 97099 - RNA, 60 nt, Human
uugaggaccucauccaaacaauuuaaaaaugagugugaagggggaacaagucaaaauauu

SEQ ID NO: 97100 - RNA, 60 nt, Human
acagucaacaggggugugauggugaaggcagagugugaaaaacgugagagaggaagagaa

SEQ ID NO: 97101 - RNA, 60 nt, Human
guuaaggagaaagaaauuaauauacaagcugagugugaaaguagaaaucaccuacaccag

SEQ ID NO: 97102 - RNA, 60 nt, Human
cccuaccuuaccccucugccccuagccaaggagugugaauuuauagaucuaacuuucaua

SEQ ID NO: 97103 - RNA, 60 nt, Human
guuugucagugaacuagacuuuuuguuuuagagugugaggacuuggaagaguauaaugaa

SEQ ID NO: 97104 - RNA, 60 nt, Human
cccccucccccgaccccaccacaguccccagagugugauauuccccuuccuguguccaug

SEQ ID NO: 97105 - RNA, 60 nt, Human
uuuuuuauucagcagacuuucucuguguaugagugugaaugaucaaguccuuugugaaua

SEQ ID NO: 97106 - RNA, 60 nt, Human
cgucccugaggagaaaaucugggaggagcugagugugaugaagguguauguugggaggga

SEQ ID NO: 97107 - RNA, 60 nt, Human
uacuuucacagaacaaagaguaaagaggcugagugugacuuuauaaagauacucauaaaa

SEQ ID NO: 97108 - RNA, 60 nt, Human
agaggggcaggugugugguaaacggguaaugcaugggaaauaaugagaagcagcucacag

SEQ ID NO: 97109 - RNA, 60 nt, Human
cagguccugcucagcccgaggagcagucuggcaugggagugaggccccguccuucucacu

SEQ ID NO: 97110 - RNA, 60 nt, Human
gccagcacgugccugaagguuucacaugaagcaugggaagcgcacccugucguucaguga

SEQ ID NO: 97111 - RNA, 60 nt, Human
uccggccccaguguggugggcgaggguggcgcaugggaggccgagccugaauccuugccu

SEQ ID NO: 97112 - RNA, 60 nt, Human
uauacaaauaucugauuugcaagaaaaagugcaugggagggguuuuagugguuuaaugaa

SEQ ID NO: 97113 - RNA, 60 nt, Human
ggagagcccuugucucuggucagcccuggagcaugggaucgugggaaagaggagggggac

SEQ ID NO: 97114 - RNA, 60 nt, Human
gggacuugugggccucagggcuuggggcaggcaugggacuggcccaggcacacagguccc

SEQ ID NO: 97115 - RNA, 60 nt, Human
cagcagcgcagugccaaugcugaucacacugcaugggagauuuuguuaacgucugccacc

SEQ ID NO: 97116 - RNA, 60 nt, Human
ucgcugccugggaucuugggguuggccuuugcaugggaggcagguggggcuuggaucagu

SEQ ID NO: 97117 - RNA, 60 nt, Human
ccccuaaagucuuuugggaauccucaaaaagcaugggaaguuaaguauuuagcuacauaa

SEQ ID NO: 97118 - RNA, 60 nt, Human
uccaaguuuaucucuaccaagaguauaauggcaugggauggcuuauuuaggacaauuccc

SEQ ID NO: 97119 - RNA, 60 nt, Human
gacaaucggguacaagagacuuaagguugggcaugggaagggugggguuuccaugaucca

SEQ ID NO: 97120 - RNA, 60 nt, Human
gaaaggguagcugagucugcuuaggggacugcaugggaagcacggaauauaggguuagau

SEQ ID NO: 97121 - RNA, 60 nt, Human
augguuccugaaaugaagucaguagaaauggcaugggauaagagcagagcucacacuuuu

SEQ ID NO: 97122 - RNA, 60 nt, Human
gcuugcuuggugggaccugacgaguugguggcaugggaaggaugugggucucuagugccu

SEQ ID NO: 97123 - RNA, 60 nt, Human
uucccacggagccauuuuuagcucugaucagcaugggaaugugccucggccuccaagggg

SEQ ID NO: 97124 - RNA, 60 nt, Human
ugcaagcugcucauuuuugaacagcuuuuugcaugggauaggagcaugucuauucuaaca

SEQ ID NO: 97125 - RNA, 60 nt, Human
cggggugcgucuugugacugcgggcgcuuugcaugggacucuguaccuuacagcucacgu

SEQ ID NO: 97126 - RNA, 60 nt, Human
gaaaguguugggucuuccuccaggaugccugcaugggaccccacccggagcugguguggc

SEQ ID NO: 97127 - RNA, 60 nt, Human
ccccuuagagucuaggugcagcagcuccaagcaugggaccaaggaggccagaaccugucg

SEQ ID NO: 97128 - RNA, 60 nt, Human
agaggaauuugucuucucugccuucacucagcaugggaaccaguguucauccugaccuug

SEQ ID NO: 97129 - RNA, 60 nt, Human
accucacugucuccagcuaugcccagugcugcaugggacccaugucuccugggacagagg

SEQ ID NO: 97130 - RNA, 60 nt, Human
ggacugacgaguuacggcugccagaugccugcaugggaagagguggacaucugcaucuuc

SEQ ID NO: 97131 - RNA, 60 nt, Human
auuuacaauguguaucaaaacuaccugugagcaugggaauacaaaagguuugagauuccu

SEQ ID NO: 97132 - RNA, 60 nt, Human
guuggcaaaugacccccauuuuaaccuucagcaugggagaugcaugcccugaagagcagg

SEQ ID NO: 97133 - RNA, 60 nt, Human
gugccccuuuccuucacugccccacuucuggcaugggacagggggaaguucagaaggugu

SEQ ID NO: 97134 - RNA, 60 nt, Human
uaggccaggugcaaccagggagcugcaggggcaugggaaggugggcgggcaggggagggu

SEQ ID NO: 97135 - RNA, 60 nt, Human
agauguggcuguggcuuuuugggagguggggcaugggaggaccagagacgaagggcuugg

SEQ ID NO: 97136 - RNA, 60 nt, Human
ccucgaauugaaaugugugaggcaaacuaugcaugggaauagcuuaaugugaagauaauc

SEQ ID NO: 97137 - RNA, 60 nt, Human
auugcuuuacucucaggaaaguguaauaacgcaugggaauucuguacguuaucacuguaa

SEQ ID NO: 97138 - RNA, 60 nt, Human
uaaccugcagcuucguuuaauguagcucuugcaugggaguuucuaggaugaaacacuccu

SEQ ID NO: 97139 - RNA, 60 nt, Human
uaaccucauucucugccugaugauucaaaggcaugggaagaccaaaaccauguggcaguu

SEQ ID NO: 97140 - RNA, 60 nt, Human
cagauaauaauucuccuauauuugaggggggcaugggauaaaaagauuuaauaauaccug

SEQ ID NO: 97141 - RNA, 60 nt, Human
uucaccacaaaucaacaaugugccugaggugcaugggaaauauaguuagcuauacucuga

SEQ ID NO: 97142 - RNA, 60 nt, Human
ccuguagaaggggccgugggguccccuccagcaugggacuggccugccuccuccgcccag

SEQ ID NO: 97143 - RNA, 60 nt, Human
uuagcugugggaagccaaguacccucaccggcaugggacaugaggggcagcuagacuuca

SEQ ID NO: 97144 - RNA, 60 nt, Human
cggaccaaaagaaauuuccugccccaagaagcaugggauccaggaaggggcgcguagaug

SEQ ID NO: 97145 - RNA, 60 nt, Human
uucagguugguuuaaucaaucagaauuagagcaugggaggucaucacuuugaccuaaauu

SEQ ID NO: 97146 - RNA, 60 nt, Human
aagcugugccucgacacauccucauccccagcaugggacaccucaagaugaauaauaauu

SEQ ID NO: 97147 - RNA, 60 nt, Human
cagugauuaccagggacugaggggaggggagcaugggaagugacgguuuaaugggcacag

SEQ ID NO: 97148 - RNA, 60 nt, Human
aaaucuugaagggaguagggagugggggaagcaugggaguggggcaaaguugaauuuaga

SEQ ID NO: 97149 - RNA, 60 nt, Human
cagugcgcgucuuacaacuaauuccacuaggcaugggaaugucaccuccuuugccacugu

SEQ ID NO: 97150 - RNA, 60 nt, Human
ccccgauggaugguacuucuucugcucucagcaugggaccuuuuguucccuucauuauga

SEQ ID NO: 97151 - RNA, 60 nt, Human
uugugaaacuuauucacuaucacaagaauagcaugggaaagacuggcccccaugauucaa

SEQ ID NO: 97152 - RNA, 60 nt, Human
uucugcauuuccuaucuuccugugucuugugcaugggaagcagccuucagugccuucaug

SEQ ID NO: 97153 - RNA, 60 nt, Human
cagaggccagcugucaguaucuguagccaagcaugggaaucuuugcucccaggcccagca

SEQ ID NO: 97154 - RNA, 60 nt, Human
acugcugcaaggccuuucugugugugaugugcaugggagcaacuuguucgugggucaucg

SEQ ID NO: 97155 - RNA, 60 nt, Human
uguucaagaauauuugauuuccuauugugugcaugggagguuuacaaaagacagacuguc

SEQ ID NO: 97156 - RNA, 60 nt, Human
acuauuuagauuguccuucuuauuuuaaaugcaugggaacagaaugacaggugggaugcu

SEQ ID NO: 97157 - RNA, 60 nt, Human
ucucuauauuuacauauauauauuaaaauugcaugggacagagacuuugcaauccgaaag

SEQ ID NO: 97158 - RNA, 60 nt, Human
gaauuucucccugucaagcaguggaaaacugcaugggaggcaaaaugcucuguucuccaa

SEQ ID NO: 97159 - RNA, 60 nt, Human
ggacccagugcccucaggcguccaucugaugcaugggaccaacauaaggcaggcagggau

SEQ ID NO: 97160 - RNA, 60 nt, Human
gaucucaugaggcuuacuaucacgagaacagcaugggaaagaccugcccccgugauuaaa

SEQ ID NO: 97161 - RNA, 60 nt, Human
agagauacuugcaggggcaagcuguaaagggcaugggaacagugagggacauaugugggg

SEQ ID NO: 97162 - RNA, 60 nt, Human
ccucuccccucucuacuuuaauucauuggagcaugggauuuggaguuaggugguuuuggg

SEQ ID NO: 97163 - RNA, 60 nt, Human
ggaggccaaaggccaacuguacucccaaaggcaugggagaagguuggcgagaagaccccu

SEQ ID NO: 97164 - RNA, 60 nt, Human
auuucuuuggugucugcucagaaagaaacagcaugggaccgugugauuggguccaggcug

SEQ ID NO: 97165 - RNA, 60 nt, Human
uuuaagccuaaagacacucaccccugcagugcaugggacagccuggcacaaugaagaauu

SEQ ID NO: 97166 - RNA, 60 nt, Human
caguugccuuuuuuuucaucucaaauggcagcaugggacugaaacaugagaaugccaccu

SEQ ID NO: 97167 - RNA, 60 nt, Human
auggaauagucuggacaccuggugggggaugcaugggaaagccaggagggcccugaccuc

SEQ ID NO: 97168 - RNA, 60 nt, Human
uuuuuuaauuuauuuaaaauuggggggagggcaugggaaggauuuaacaccgauauauug

SEQ ID NO: 97169 - RNA, 60 nt, Human
ugggccaagcaggguggggaauggaggauagcaugggauguauggagaggauggaagauu

SEQ ID NO: 97170 - RNA, 60 nt, Human
gcuggcccaggaagagccagcaagagcaaggcaugggagaggggaggugucacacaacuu

SEQ ID NO: 97171 - RNA, 60 nt, Human
ugcagcucucuguccacaaccaugccacuugcaugggagcccugaaggcugucaaagucc

SEQ ID NO: 97172 - RNA, 60 nt, Human
uaaucuuguggguuuuuuuuuuuuuuugaugcaugggagguuggcaauauagacaaagug

SEQ ID NO: 97173 - RNA, 60 nt, Human
agacuaauaauauuuucuuauuuaaaaaaagcaugggaagauuuuuauuuaucaaaauau

SEQ ID NO: 97174 - RNA, 60 nt, Human
uuaggcccaccugaucaaauguaaaaacaugcaugggauauuugauuacguaacaaccag

SEQ ID NO: 97175 - RNA, 60 nt, Human
uucaaaucccagcucuaccacuuacuaacugcaugggacuuuggguaagacaccugcuua

SEQ ID NO: 97176 - RNA, 60 nt, Human
acauaucugggccuuuggaggccacguguggcaugggaggggcuaccuggucccuuucac

SEQ ID NO: 97177 - RNA, 60 nt, Human
gguuuaccauaccaaagcuugcuuucucuggcaugggaaaaauaaauuuaagcaccaaac

SEQ ID NO: 97178 - RNA, 60 nt, Human
aggaaaugagcucuacgaggauuucacccugcaugggagagagcaggguuuucucagauu

SEQ ID NO: 97179 - RNA, 60 nt, Human
accccuuccauuacugcugaauaggacauugcaugggaagaguacagagguggcagaaug

SEQ ID NO: 97180 - RNA, 60 nt, Human
cagugcaugcugucccuuacgugaguccuggcaugggaaugaaugucagugugacugauc

SEQ ID NO: 97181 - RNA, 60 nt, Human
aggccagggugcuacucaacauccuacaaugcaugggacaacucccacaacaaagaauua

SEQ ID NO: 97182 - RNA, 60 nt, Human
aauuaacuaagaacagcucugaauguauuugcaugggauugguccuugaauaaaauuguc

SEQ ID NO: 97183 - RNA, 60 nt, Human
aguggaccuucagugugcaagaauggagaagcaugggauuugcauuaugacuugaacugg

SEQ ID NO: 97184 - RNA, 60 nt, Human
gugaaaauaggggauggaugagugggaagggcaugggauauuccuggcaagaucucugau

SEQ ID NO: 97185 - RNA, 60 nt, Human
ccaggggaugcacagucuaaaugaauaucugcaugggauuugcuaucauaauauuuacua

SEQ ID NO: 97186 - RNA, 60 nt, Human
ggcuagugucugcgcgucacugugguuuuagcaugggaggacuuauuugagaaauacuac

SEQ ID NO: 97187 - RNA, 60 nt, Human
acccagcagaaauacaauccgagcuacaaagcaugggaaaaagagacucuuuuaggauca

SEQ ID NO: 97188 - RNA, 60 nt, Human
cucagagaaacugcgugagagugugugcgugcaugggaguguacuuguggaaaggugugu

SEQ ID NO: 97189 - RNA, 60 nt, Human
cggaccugugagcugcugcugacuagggcugcaugggagagccagggaggggaguuucug

SEQ ID NO: 97190 - RNA, 60 nt, Human
acuaaaauaacauuacaguuuccgaauuuagcaugggacauagucaguguuugaagugcc

SEQ ID NO: 97191 - RNA, 60 nt, Human
gauggccauccuggucccaguguuaggguagcaugggauuacagggcccuguuuuuucca

SEQ ID NO: 97192 - RNA, 60 nt, Human
uugacugcguaugccaaaaagggacaggaggcaugggauagcaggucuggugacacagcu

SEQ ID NO: 97193 - RNA, 60 nt, Human
auauccucuggaaaaggcuuucaugauuuggcaugggacagacggaaaugaaauugucaa

SEQ ID NO: 97194 - RNA, 60 nt, Human
agggagagacccugggugagaccccugugagcaugggaagggccugcagugggcgcggga

SEQ ID NO: 97195 - RNA, 60 nt, Human
gcucaguaggaucaagccgacccagagugggcaugggaugcuccaggaggucugggguac

SEQ ID NO: 97196 - RNA, 60 nt, Human
aauugcuuccauuuuauaauuugagguguugcaugggaauucuaagcugauccaucauga

SEQ ID NO: 97197 - RNA, 59 nt, Human
ccacggagaagagugacugaggcccuagggcaugggagaggagggacgcccaggguggg

SEQ ID NO: 97198 - RNA, 60 nt, Human
uuauauguaauugcagcguggggugggugggcaugggagguaggggugggcccuggagau

SEQ ID NO: 97199 - RNA, 60 nt, Human
acuggucucaugcccaaagaagaguugaaggcaugggagccaacauuuuauugaagaagc

SEQ ID NO: 97200 - RNA, 60 nt, Human
auggucccugggcuuaauauucuuuaaagggcaugggaauuuagccucucuuuuauugua

SEQ ID NO: 97201 - RNA, 60 nt, Human
gauacaaaugugcugccugcaguuaguccugcaugggaauaaggacuaguuauuuuuuua

SEQ ID NO: 97202 - RNA, 60 nt, Human
ggcuggacuuaagguaggagccgaaagugggcaugggagcccauccccgugggugugagg

SEQ ID NO: 97203 - RNA, 60 nt, Human
caccugugccuugaggagaugcugccaggagcaugggacucugacaguccuuuguauaaa

SEQ ID NO: 97204 - RNA, 60 nt, Human
uuuauuaaaauuaaaauccaguuccuuguugcaugggacacagugcaaaugcuugauaag

SEQ ID NO: 97205 - RNA, 60 nt, Human
uuaauguuguggauugcuuuucuaugugaagcaugggauuuacuguugcguaacuagaac

SEQ ID NO: 97206 - RNA, 60 nt, Human
aaugacaguuguagauugauacgcaguugugcaugggaaggggaaacgcacagcuuuauu

SEQ ID NO: 97207 - RNA, 60 nt, Human
uaguaaacaaaaucugugcagagggccuuagcaugggauguguccaguauugaaaaggcu

SEQ ID NO: 97208 - RNA, 60 nt, Human
aacagauuaaccugccucgcugcagugagagcaugggacaaguccgccacagcccucccc

SEQ ID NO: 97209 - RNA, 60 nt, Human
gauuaagagacagagaaucuuggauuaaccgcaugggagauguucuuccuuuugaaguuu

SEQ ID NO: 97210 - RNA, 60 nt, Human
uuaccuuagaugcauccugguuaucuggaagcaugggaaagaaggcuacuuaucucuuug

SEQ ID NO: 97211 - RNA, 60 nt, Human
gugugaguuacuaaaaaguuagaauaaugugcaugggaacagugcagcaacaugcuagaa

SEQ ID NO: 97212 - RNA, 60 nt, Human; identical to SEQ ID NO: 97207

SEQ ID NO: 97213 - RNA, 60 nt, Human
gccuggugcccugcgucgucguuggccacagcaugggaggaaagacagccaugcugcugg

SEQ ID NO: 97214 - RNA, 60 nt, Human
ugugcuauaucucugaggaauggugagguggcaugggagaugucugugcuuggagguacc

SEQ ID NO: 97215 - RNA, 60 nt, Human
cucccugccucauuccccacaucccacugagcaugggaccauugggagcagagcugauau

SEQ ID NO: 97216 - RNA, 60 nt, Human
cuccggccaccagcagaagccagcagagaggcaugggacagguuccccacaagccuuaga

SEQ ID NO: 97217 - RNA, 60 nt, Human
uuagaggguggaauggauguguuuggcgcugcaugggaucuggugccccucuucuccugg

SEQ ID NO: 97218 - RNA, 60 nt, Human
ggaguaugcccagccccugaggggagagaugcaugggauaugcacccagguuucuuuuac

SEQ ID NO: 97219 - RNA, 60 nt, Human
gcugauuuacuacuuaugcguaagugguaugcaugggaugucugaaaucagugccuaugg

SEQ ID NO: 97220 - RNA, 60 nt, Human
cugcuccuugccccaaagaacccucuuccugcaugggagagcugucccuccuucuccacc

SEQ ID NO: 97221 - RNA, 60 nt, Human
agagaacgcccucaugcucagcacauauuugcaugggagggggagaugggugggaggaga

SEQ ID NO: 97222 - RNA, 60 nt, Human
gaagaauauuuguaguuaucuuagaagauagcaugggaggugaggauuccaaaaacauuu

SEQ ID NO: 97223 - RNA, 60 nt, Human
cuagcguauuagccuugugggcaacaugaugcaugggaaaugaaagauuuuuguaaaaag

SEQ ID NO: 97224 - RNA, 60 nt, Human
ggauaucuuuuaugugcaacaguauccuuugcaugggaggagaguuacucuugaaaggca

SEQ ID NO: 97225 - RNA, 60 nt, Human
uugcuuucccacccugggcaaugcagugcagcaugggaaaggaauaagggggcaacaagg

SEQ ID NO: 97226 - RNA, 60 nt, Human
uacuacugcuuuggcuagugacaguuuuuugcaugggacuggugugcaaugaacuuguau

SEQ ID NO: 97227 - RNA, 60 nt, Human
aucuguauacccucuguuucccuuucacuggcaugggagacccuugacaccugcugagaa

SEQ ID NO: 97228 - RNA, 60 nt, Human
gccaggggauagaggaguaauuguuagugggcaugggauuuguuuuugggagguuuugaa

SEQ ID NO: 97229 - RNA, 60 nt, Human
uugguggauugcuguguuuuugcaugauuagcaugggagucuguuggagcaagaggaaca

SEQ ID NO: 97230 - RNA, 60 nt, Human
ugaggaaggacuugacuggggauggcgcaugcaugggaggaauucaucuucagucuacca

SEQ ID NO: 97231 - RNA, 60 nt, Human
caggggccuuuuaaguugagcgugcgcacugcaugggaaauagcggcccuggaggauguu

SEQ ID NO: 97232 - RNA, 60 nt, Human
guguuaagcauuuuccuccaugggaaggaagcaugggauauagaaaagcgaagggcuguc

SEQ ID NO: 97233 - RNA, 60 nt, Human
uucagguggaugaaguaugugugugcgugugcaugggagugugcguggacugggauauca

SEQ ID NO: 97234 - RNA, 60 nt, Human
ccccuuccucgggaggcuccccagacccuggcaugggaugggcugggaucuucucuguga

SEQ ID NO: 97235 - RNA, 60 nt, Human
cugcuggggcugcaagcugcugaagccagggcaugggauuaaagagauugugcguucaaa

SEQ ID NO: 97236 - RNA, 60 nt, Human
agggacuacauaacaggcaccuuugagagagcaugggagaagguggauaagaggaugcug

SEQ ID NO: 97237 - RNA, 60 nt, Human
caguagcacacaggaucucacaguaacgcggcaugggaacagugagacagggggagggga

SEQ ID NO: 97238 - RNA, 60 nt, Human
agaggcgagcguggauugucacagcugcgggcaugggaagggcuagcugagcucuucacc

SEQ ID NO: 97239 - RNA, 60 nt, Human
gguaaccuggaguuuagaaguuaaaaaaaagcaugggauguuggauuugcaccauuugga

SEQ ID NO: 97240 - RNA, 60 nt, Human
gcgucuaugacacuuuuguggugauggaaagcaugggaccugucgucucagccuguuggu

SEQ ID NO: 97241 - RNA, 60 nt, Human
cacuagguaaagcccagugaaugucucuuggcaugggaggaguuaaagagguuggaaggg

SEQ ID NO: 97242 - RNA, 60 nt, Human
ucaccuaugaccacauugggcccaacgucugcaugggagaccacaaggugacauagacug

SEQ ID NO: 97243 - RNA, 60 nt, Human
gugugugugugcuaugcaugcucuaagucugcaugggauaugggaauggaaaagggcaau

SEQ ID NO: 97244 - RNA, 60 nt, Human
augccagcccugguggcugugggcuggggugcaugggagagcugggugcgagaacauggc

SEQ ID NO: 97245 - RNA, 60 nt, Human
ucugauaccccuccagcugaacaauuuucugcaugggacucugaguuccuuuccuuccca

SEQ ID NO: 97246 - RNA, 60 nt, Human
uucuauaccuggcuaugggagagaccccuugcaugggagggaccccuugcuauggccccu

SEQ ID NO: 97247 - RNA, 60 nt, Human
cauggcugcaaaacucugaagauuccccaugcaugggaaagugcaaguggaugcauuccu

SEQ ID NO: 97248 - RNA, 60 nt, Human
uagaaugauacaaagaaaggucagagaaaugcaugggaauauuuuuuccuuaaaacagaa

SEQ ID NO: 97249 - RNA, 60 nt, Human
gaauguaguagucuuuccaagagccuacuugcaugggagucccacccucgcuaccacuca

SEQ ID NO: 97250 - RNA, 60 nt, Human
ccucacccugcuccccacccaggcagggcagcaugggacccagugucucagugccuucaa

SEQ ID NO: 97251 - RNA, 60 nt, Human
auaagagcuggcaagugcccuuaggaugccgcaugggaaaaaucgguuaucauaauuuca

SEQ ID NO: 97252 - RNA, 60 nt, Human
uccuucaagauaacuggccccaagaguggggcaugggaagggcugguccaggggucuggg

SEQ ID NO: 97253 - RNA, 60 nt, Human
ggagcacagcaguucuggcuguuguccaaagcaugggauucuggaggcagccagagcccu

SEQ ID NO: 97254 - RNA, 58 nt, Human
uccccacagaggacccugccugagcaaggggcaugggagggaagaggggcucucauuu

SEQ ID NO: 97255 - RNA, 60 nt, Human
gccggaccuuaguggacaggaagacuuggggcaugggacagcucagacuuuguauuuaaa

SEQ ID NO: 97256 - RNA, 60 nt, Human
cgcucccaaccaugagagccgaggugggaggcaugggaaacagugcagugacucaccccc

SEQ ID NO: 97257 - RNA, 60 nt, Human
cuccagagaggggcugcuaccucccagcaggcaugggaagagcacugguguggggguucc

SEQ ID NO: 97258 - RNA, 60 nt, Human
uuugggcccauucacucguucagcagacacgcaugggacugaugcuuugaguuuucuucu

SEQ ID NO: 97259 - RNA, 60 nt, Human
uccaaggccugaugugagccagcggggggugcaugggaaacugcaccccacaacccacau

SEQ ID NO: 97260 - RNA, 60 nt, Human
ggagcucugcuugugaauuccagaugccaggcaugggaggcggcuugugcuuugccuuca

SEQ ID NO: 97261 - RNA, 60 nt, Human
gaaaccaagcccuuggaagcaagugggguggcaugggagagaagggaggaggugggcaca

SEQ ID NO: 97262 - RNA, 60 nt, Human
gaaauggaccuuucucugacauaguucuuggcaugggagccagccacaaaugagauucug

SEQ ID NO: 97263 - RNA, 60 nt, Human
gcagccggagucacgcacgugcagagcugggcaugggagagaaacgggcuggggagugag

SEQ ID NO: 97264 - RNA, 60 nt, Human
agggugaggcugggugucuggaagcauggagcaugggacuguucuuuuacaagacaggac

SEQ ID NO: 97265 - RNA, 60 nt, Human
cuaagcuuucuccuuugagggcaguggggagcaugggacugugccuuugggaggcagcau

SEQ ID NO: 97266 - RNA, 60 nt, Human
cacucagccagagucuucaggacagacuccgcaugggacuuguccaaaaaaacucuaauc

SEQ ID NO: 97267 - RNA, 60 nt, Human
ggagccacaggugccuaauugggaaccagggcaugggaaaggagugggucaaaauucuuc

SEQ ID NO: 97268 - RNA, 60 nt, Human
gucuaugugugguaugggcagcccaagguugcaugggaaaacacgccccuacagaagugc

SEQ ID NO: 97269 - RNA, 60 nt, Human
caucuaucuggccuccaagaugagaaaggagcaugggacagagagcuucuuucagcaccu

SEQ ID NO: 97270 - RNA, 60 nt, Human
uuuaaaauauuuuguguuugaaguaucugugcaugggaucguugauguuuaucagaacug

SEQ ID NO: 97271 - RNA, 60 nt, Human
ugacuugugacaauuuagacuuggcauccagcaugggauaguuggggcaaggcaaaacua

SEQ ID NO: 97272 - RNA, 60 nt, Human
uaagucaugccuccuuccaccucccucccggcaugggaaagccaccucucccucaacaag

SEQ ID NO: 97273 - RNA, 60 nt, Human
uaagucgugccuccuuccaccucccucccggcaugggaaagccaccucucccucaacaag

SEQ ID NO: 97274 - RNA, 60 nt, Human
gcucuuuacucaaugguacccagggagggagcaugggaagagggugagcugagggcugga

SEQ ID NO: 97275 - RNA, 60 nt, Human
gaccccuuuccucacagggaccaagacaaagcaugggacaugaaauuaagagugaacuuc

SEQ ID NO: 97276 - RNA, 60 nt, Human
ugcuguugaaaugagugcccuuggggccuugcaugggacacauucaagaccucgaaguca

SEQ ID NO: 97277 - RNA, 60 nt, Human
caguggcccagacgcugcuuugugcuaaaagcaugggaaauguaaaggcagucuuucucu

SEQ ID NO: 97278 - RNA, 60 nt, Human
uuuagcauccaccaauuuucacugcauuuugcaugggaugaacaguguuuuaugcuggga

SEQ ID NO: 97279 - RNA, 60 nt, Human
gaauucuugcacaugcucgugcuggugugggcaugggacuggcuggaaacgucuguaugc

SEQ ID NO: 97280 - RNA, 60 nt, Human
cuuuugucgcauuuugcuucacugugaguagcaugggaaaaggguccacgucuccaaaag

SEQ ID NO: 97281 - RNA, 60 nt, Human
gaacugccauaaacacuacacagauggagggcaugggauaggacaggagaggaggugaug

SEQ ID NO: 97282 - RNA, 60 nt, Human
gaggggccccugugagaggccucuggaugggcaugggaagaugggcucccuggcccccag

SEQ ID NO: 97283 - RNA, 60 nt, Human
auucuucugcaguuaaugggguagaggagggcaugggagggagggagagguggggaggga

SEQ ID NO: 97284 - RNA, 60 nt, Human
acaaacugaagaguaaucaaucuacucaaagcaugggauuauuagaaucaaacauuuuga

SEQ ID NO: 97285 - RNA, 60 nt, Human
gacaguaaaggcucuuggcuucuguuggaggcaugggaaauugucucaauuuguacaguu

SEQ ID NO: 97286 - RNA, 60 nt, Human
aaacaccgucagaugcauuagcagcccacugcaugggacaaucgcaggcagauacgagga

SEQ ID NO: 97287 - RNA, 60 nt, Human
caguuuugcucaugacuuaccauuccagcugcaugggaaagcaaagcagaaaacagugcc

SEQ ID NO: 97288 - RNA, 60 nt, Human
uaucagcagcaacaacugucaguucauccugcaugggaaaaauguuggaaugggagucug

SEQ ID NO: 97289 - RNA, 60 nt, Human
gugggugggcccccauaauaaguuccuaaagcaugggaucucaucgaauaagacucauca

SEQ ID NO: 97290 - RNA, 60 nt, Human
gacaccggguuggcuuggggcgcgcgguuugcaugggauggggugggggcgggcuccccu

SEQ ID NO: 97291 - RNA, 60 nt, Human
cccacaaaacucuaaccaaacuggaggcuggcaugggagaagugcuucugguucacucuu

SEQ ID NO: 97292 - RNA, 60 nt, Human
agauauuugcuuuccuagaggggagugugggcaugggaggggucugaaaaucaggaccca

SEQ ID NO: 97293 - RNA, 60 nt, Human
caugaaucugcaggagacagagauccccuugcaugggaaacauaaagcagaauugggagg

SEQ ID NO: 97294 - RNA, 60 nt, Human
agagcaugccuucaugcccuucucugcagagcaugggauggggcccuuccagcccacuuu

SEQ ID NO: 97295 - RNA, 60 nt, Human
accuggcaugggugucuguugcaaaggggugcaugggaaagggcuguugauauuaaaaac

SEQ ID NO: 97296 - RNA, 60 nt, Human
cccuccaguagagacagaggggcaguguuugcaugggagguguuucugccugucccugcc

SEQ ID NO: 97297 - RNA, 60 nt, Human
auguaauacuuacaugaauguugcaugugugcaugggagcaacugaguagcaauaguaaa

SEQ ID NO: 97298 - RNA, 60 nt, Human
cccagugauuacaucuaaggaccuccagaagcaugggaacaucugggugugcccuguguc

SEQ ID NO: 97299 - RNA, 60 nt, Human
ugcaguccaggcccgugcuggcgggauugggcaugggaaggagcagggccugcugcuucc

SEQ ID NO: 97300 - RNA, 60 nt, Human
acagccucuagagaagggagaggggcgugugcaugggaguguggcucaucucgggggcca

SEQ ID NO: 97301 - RNA, 60 nt, Human
ugguuuggggacccuggugcaugcuagugggcaugggaucagccaagcuucguuccaucu

SEQ ID NO: 97302 - RNA, 60 nt, Human
gaggggcaacguggaggaagggccagggaugcaugggauuuuaauuguuucaucacaccu

SEQ ID NO: 97303 - RNA, 60 nt, Human
cugugucagccucacccuucgugugcacccgcaugggagggucggagggugcugcccgcc

SEQ ID NO: 97304 - RNA, 60 nt, Human
uguggaagaccacacauggguggucccacagcaugggaccaggcuggccugagggaugcc

SEQ ID NO: 97305 - RNA, 60 nt, Human
caacggaguucugggaugggaggggugggagcaugggaagggaggcaucccacccccaag

SEQ ID NO: 97306 - RNA, 60 nt, Human
auuguacaguuugcagaugcagauguaaaugcaugggacaugcaugauaacucagaguug

SEQ ID NO: 97307 - RNA, 60 nt, Human
cucgacgcuuucugggaacagcuuccaauggcaugggaguucuguauuuaaaagcaugaa

SEQ ID NO: 97308 - RNA, 60 nt, Human
agcaucauggaugcuguggacauggccaucgcaugggaggagcucaaaccagcacuaaug

SEQ ID NO: 97309 - RNA, 60 nt, Human
acccuguagacagaugcccucagaauuggggcaugggaggggggcugggggaccccauga

SEQ ID NO: 97310 - RNA, 60 nt, Human
ucugguuugauuguuguggguguagcccaggcaugggauuuuuuaaagagcugcucaggu

SEQ ID NO: 97311 - RNA, 60 nt, Human
aauguggaguguuagcccuugguggggcgugcaugggacuaguucaucugccacagggau

SEQ ID NO: 97312 - RNA, 60 nt, Human
ccuuaacccauacuccucugaggcaaacaggcaugggaaaauggaaggguugaggaugga

SEQ ID NO: 97313 - RNA, 60 nt, Human
caccggucucccccacccgacugcugaucugcaugggaaacacccugaccuucuucuguc

SEQ ID NO: 97314 - RNA, 60 nt, Human
gcaccugagugguugggacacaggcagcuggcaugggagggacuuuuuuugagacagggu

SEQ ID NO: 97315 - RNA, 60 nt, Human
uaauuccccaagaggucccaaggauugggagcaugggaggggagcuggcgggaggguggg

SEQ ID NO: 97316 - RNA, 55 nt, Human
aggaagaggugcucagcugaagaaggcaugggauggagcccuggcauagcugcca

SEQ ID NO: 97317 - RNA, 60 nt, Human
acuaaggagccagagugugcgcauuucagagcaugggauugaucggcagcaagaguaaag

SEQ ID NO: 97318 - RNA, 60 nt, Human
ggccauggcugacaccuccagguccgccuggcaugggacaccaaguggaaggcccaagca

SEQ ID NO: 97319 - RNA, 60 nt, Human
uguguccuugccugucuguggcauauuugugcaugggacagggccugugguggggucacu

SEQ ID NO: 97320 - RNA, 60 nt, Human
auauaggcugaauucaaacaugcaauuaaagcaugggaagagcuucuaagggcaucuuaa

SEQ ID NO: 97321 - RNA, 60 nt, Human
auggaggaggggaggaaggugaaaucuacugcaugggauucaggaaacaguugugguugg

SEQ ID NO: 97322 - RNA, 60 nt, Human
gcuucccugaaagacugaagaaaguguagugcaugggacccacgaaacugcccuggcucc

SEQ ID NO: 97323 - RNA, 60 nt, Human
gcccuccagguaggcccguuuucacguggagcaugggagccacgacccuucuuaagacau

SEQ ID NO: 97324 - RNA, 60 nt, Human
ucagccagauccuuacacguggagcccccagcaugggaaugaggggcucugcaacugagc

SEQ ID NO: 97325 - RNA, 60 nt, Human
agacauaggaccccagcccagaucugaauggcaugggaggugcugcccuuaaccaugaca

SEQ ID NO: 97326 - RNA, 60 nt, Human
gaaggucaagugucaugagcaggagaaaaggcaugggagcuggacagauuauagugguug

SEQ ID NO: 97327 - RNA, 60 nt, Human
cagggaagcgugcagcccaaaugggcacuugcaugggagccacagaggagcgucccuggg

SEQ ID NO: 97328 - RNA, 60 nt, Human
gcuuccccuucuccucuggcuccgggguuugcaugggagaauccucuuuccacgaugccg

SEQ ID NO: 97329 - RNA, 60 nt, Human
gcagaccccacacuccauggagucuggaaugcaugggagcugcccccccaguggacacca

SEQ ID NO: 97330 - RNA, 60 nt, Human
cuuggucuugcugcccccugugacccaaaggcaugggauggacagagaugccugcccccg

SEQ ID NO: 97331 - RNA, 60 nt, Human
gcccucaccccguuugcauaugcaaugcuagcaugggaccccgaaaauagacgcucugcu

SEQ ID NO: 97332 - RNA, 60 nt, Human
uaucugccuuuuauuacauacaugaugggugcaugggauucugcgugcccuuugcuugau

SEQ ID NO: 97333 - RNA, 60 nt, Human
uacaugggugaacucuugaaucgcucauaggcaugggacuccuggaucccacacaagcgc

SEQ ID NO: 97334 - RNA, 60 nt, Human
ggcacggucguauccaagggagggaucauggcaugggaggcgacucaaagacuggcgugu

SEQ ID NO: 97335 - RNA, 60 nt, Human
gaccagagaagccgcucaacauccugcaaugcaugggacaggcccugccuagaaacacca

SEQ ID NO: 97336 - RNA, 60 nt, Human
cucucaugguugaagaagugguggaggauggcaugggaaagagugccugaggauccuugc

SEQ ID NO: 97337 - RNA, 60 nt, Human
cccugcagggagccgcucaagucugggagggcaugggagcagugagcaggcccaugggga

SEQ ID NO: 97338 - RNA, 60 nt, Human
aaguuccagagaugugucagcccuuaucaggcaugggagggacacguucaggagaggagc

SEQ ID NO: 97339 - RNA, 60 nt, Human
cuagucguuucugcauuuccuuuaaaaauagcaugggaucauauuuaaacaauuguugga

SEQ ID NO: 97340 - RNA, 60 nt, Human
gcucugcuucuccuccugccgcugaccagagcaugggaaauagcccuggauuggguagug

SEQ ID NO: 97341 - RNA, 60 nt, Human
aaugaguuggggcaggguggugggguaggugcaugggagggugggcccucuggggaggcc

SEQ ID NO: 97342 - RNA, 60 nt, Human
cccagcacugugcuugcgggaggcgguggggcaugggaggaaggaggcacagaccgggga

SEQ ID NO: 97343 - RNA, 60 nt, Human
cuaagguggugauguaugcgaugggacucugcaugggauaguacaguuguguagacgucu

SEQ ID NO: 97344 - RNA, 60 nt, Human
cauggccaucuuuguggcugugggcaccaggcaugggacugagcccaugucuccucaggg

SEQ ID NO: 97345 - RNA, 60 nt, Human
cccaggaugacacaggcaagagccccugaggcaugggaggcccagggaagaccaugggcu

SEQ ID NO: 97346 - RNA, 60 nt, Human
uaaaacugcggaauacaauguccuuccauagcaugggaagaagaaaauaaacaucuccuu

SEQ ID NO: 97347 - RNA, 60 nt, Human
gaccuuggaccagcaggggaagaucuaugggcaugggaggugggcguuggaaaggcugag

SEQ ID NO: 97348 - RNA, 60 nt, Human
cagcagaugaagcauagccuccuuggaauggcaugggaggccuggccugaucuggccucu

SEQ ID NO: 97349 - RNA, 60 nt, Human
cacgguguccuccaugccugcagggcccaugcaugggaaguugcguuggcggccugggug

SEQ ID NO: 97350 - RNA, 60 nt, Human
uaucugcguucgucucggugggcuucuccugcaugggaguuguguuccugugcaaggggg

SEQ ID NO: 97351 - RNA, 60 nt, Human
gcagccucugacccuagcccugcccuggcagcaugggaccugccaacagcugaggguggc

SEQ ID NO: 97352 - RNA, 60 nt, Human
aauuuuugugauacagagcaaaauaacacggcaugggaguaagguuauccuuagaaauuu

SEQ ID NO: 97353 - RNA, 60 nt, Human
aacaaauccauguaaacaauuuugaaggaggcaugggagcuaaaaauccugugauacuaa

SEQ ID NO: 97354 - RNA, 60 nt, Human
ucuugagacucguucacuaucaugagaauagcaugggaaagaccugccuccaugauucag

SEQ ID NO: 97355 - RNA, 60 nt, Human
uauuuuucaauuggaaacuuucacacauuugcaugggaauauguucauuccauguuguaa

SEQ ID NO: 97356 - RNA, 60 nt, Human
ccaggaauggacauuccuaacggguggugggcaugggagaugccuguguaauuucguccg

SEQ ID NO: 97357 - RNA, 64 nt, Human
aaucacaggcugcgucugcaccugaaaagugacccgcggaaacucuauggcggauuuuuuuuuu

SEQ ID NO: 97358 - RNA, 64 nt, Human
cacccuuaccuuccugagaaauacccccugggagcgcggaaagcagagcggacaggucagugac

SEQ ID NO: 97359 - RNA, 64 nt, Human
gacuagucucauuucucugagaagaaaacuaaggcgcggaaauuugucuaagaucacauaacua

SEQ ID NO: 97360 - RNA, 64 nt, Human
uuccggagccccagcgucuccugcccaaauucaccgcggaaagggcccggggcggaggugcgac

SEQ ID NO: 97361 - RNA, 64 nt, Human
guggaggcuggcagggucccuccagcaaagcucccgcggaaaacugcuccugugucggggcuga

SEQ ID NO: 97362 - RNA, 64 nt, Human
agugacaccagggcacauggcuggagcacagugccgcggaaaccugauuuuguacucucuuuua

SEQ ID NO: 97363 - RNA, 64 nt, Human
acccagaucccgccccuccuguccucuguguucccgcggaaaccaaccaaaccgugcgcuguga

SEQ ID NO: 97364 - RNA, 64 nt, Human
uggcgagugacaccacugaugacgaugaugcacucgcggaaauucuccaggcaaaugaccuccu

SEQ ID NO: 97365 - RNA, 64 nt, Human
gaggggacaggagacggcccugcugcggacggagcgcggaaacugcguaggaauucaguggugg

SEQ ID NO: 97366 - RNA, 64 nt, Human
cggaggagacgcugcaauaaagguugggagaaggcgcggaaaggagaggagcuggggccuuggg

SEQ ID NO: 97367 - RNA, 64 nt, Human
uucaccuucucuuccccuuuccaucuccuuuccccgcggaaacaacgcuucccuucuggugugu

SEQ ID NO: 97368 - RNA, 58 nt, Human
uggugcaaauggcccagugacccccagacgcggaaaccggguggcagcgcccagccug

SEQ ID NO: 97369 - RNA, 64 nt, Human
agcagccuccucuagccucugaugccuucccuccacggcccaggucuccucacucaaagucccu

SEQ ID NO: 97370 - RNA, 64 nt, Human
aagccccuccccucucacacugaccuccccccuuacggcccaccaggguauguaaauaucucuu

SEQ ID NO: 97371 - RNA, 64 nt, Human
ggucagcgugcagaaaccagcugucugcugaugaacggcccaucugcacagcggcagcaaggau

SEQ ID NO: 97372 - RNA, 52 nt, Human
uccuugaagcaaaagaguaaacacggcccagcgguggaaccagccauuccuu

SEQ ID NO: 97373 - RNA, 64 nt, Human
ccagcucccgccccuccccagggcccccaccuccacggcccacuucauuuucuguucucauuuu

SEQ ID NO: 97374 - RNA, 64 nt, Human
ccagggccuaacaguguuucuuccccucggccccacggcccauacucaccccuucaccugaggc

SEQ ID NO: 97375 - RNA, 64 nt, Human
cuguguauucucuuggagccuugggugggcagggacggcccagguaccugcucucuugggaaga

SEQ ID NO: 97376 - RNA, 64 nt, Human
ggagcacacgguguagggaagccagaaagaaaagacggcccagccacagaagcacaauggcccu

SEQ ID NO: 97377 - RNA, 64 nt, Human
uuuuguggcucuuaucuuguggaccauaaauaacacggcccaauaacucuuuguguuuauggag

SEQ ID NO: 97378 - RNA, 64 nt, Human
aauauagacugcaaacaagugcuuguugccccacacggcccagauucacuugaagcagaaguua

SEQ ID NO: 97379 - RNA, 64 nt, Human
auugaagagcaugguccuucagaaaaggcaauaaacggcccaacuagugcuucuggcgaugaca

SEQ ID NO: 97380 - RNA, 64 nt, Human
cucggggaaggagagucgaugcuguucccgcugcacggcccaccggcggcguaagugagggagu

SEQ ID NO: 97381 - RNA, 64 nt, Human
ugggccgcgccgccguggcccgcuguggcucaccacggcccaggguggccuugguggcuuccac

SEQ ID NO: 97382 - RNA, 64 nt, Human
gguggaauacccuucuaauaaaaggguaaccagaacggcccacucucuuuuacggaaaaauccc

SEQ ID NO: 97383 - RNA, 64 nt, Human
cuccaggcugggcugagccaaagccagaguggccacggcccagggagggugagcuggugccugc

SEQ ID NO: 97384 - RNA, 64 nt, Human
agcauggggucacggcccacagcuagguggggucacggcccacagcuagguggggacugucugc

SEQ ID NO: 97385 - RNA, 64 nt, Human
uagcuucucauuuucaucagcacagcauggggucacggcccacagcuagguggggucacggccc

SEQ ID NO: 97386 - RNA, 64 nt, Human
cacacuggaagaagagaguuucuaaucagaugcaacggcccaaauucuugaucugcagcuucuc

SEQ ID NO: 97387 - RNA, 64 nt, Human
caggaacgcacagaucauggcaggaugcgcugggacggcccaucuuggcaagguucagucugaa

SEQ ID NO: 97388 - RNA, 64 nt, Human
uauuccuaaaggaaucugaccauuuuacgucucuacggcccaaaaaaagacaaaaauaaaaauu

SEQ ID NO: 97389 - RNA, 64 nt, Human
aguaaauauugggauuggggggaaagagggagcaacggcccauagccuugggguuggacaucuc

SEQ ID NO: 97390 - RNA, 64 nt, Human
ggccaggacgguguggcgccagccuugaagcaccacggcccaaggaugcgguguacauacugua

SEQ ID NO: 97391 - RNA, 64 nt, Human
uaauggaggcaguuuugaggagguccucagcuccacggcccaugccagugcccagagcuuggca

SEQ ID NO: 97392 - RNA, 64 nt, Human
cguaacgcacaggacacgugugcaauucauaggaacggcccagaucgcccucaugagugccacc

SEQ ID NO: 97393 - RNA, 64 nt, Human
agaggauccaucacagacggauacuggggaguaaacggcccaggccaggugcccaggaaaggac

SEQ ID NO: 97394 - RNA, 64 nt, Human
ggggccgcacagcgcggcugggaccgauucggugacggcccaaggaagcugggcucagggcucg

SEQ ID NO: 97395 - RNA, 58 nt, Human
gggcauccacggcccuguaaacaggucaacggcccaagggccuccugcccuguccugc

SEQ ID NO: 97396 - RNA, 64 nt, Human
gcuggaaacccuaagcacugcugcccauggggacacggcccaggacagcccgggggcccugcag

SEQ ID NO: 97397 - RNA, 64 nt, Human
gccggcgaggccccuucagucuuguucuggggggacggcccacuccggggagggggugugcugu

SEQ ID NO: 97398 - RNA, 64 nt, Human
gcuucugguuuccuggacaauuucucugucagauacggcccauuguaaacccagagggcugcau

SEQ ID NO: 97399 - RNA, 64 nt, Human
gggggaggggaggaguccagggagaggcgggaucacggcccaggcugcugacacccgcgcgugg

SEQ ID NO: 97400 - RNA, 64 nt, Human
agacggacacgggcguggggcggccgagaccugcacggcccagcgggcaccggcacugcggggu

SEQ ID NO: 97401 - RNA, 64 nt, Human
gaggcuuauccaacccacggccugugggccgcauacggcccaggauggcuuugaaugcagccca

SEQ ID NO: 97402 - RNA, 64 nt, Human
acacacacacaauggcaagcauagucgccugguuacggcccagggggaagaugccaagggcacc

SEQ ID NO: 97403 - RNA, 64 nt, Human
uggugacugggucccuuggccauaucaaggcagcacggcccacccaggccucccauugccgcaa

SEQ ID NO: 97404 - RNA, 64 nt, Human
gccccaaaacuuugacagccucgugggcuuugugacggcccaguggcucugcgugguacaugac

SEQ ID NO: 97405 - RNA, 64 nt, Human
aaugcuaagaacagaauacagacauaaauaagucacggcccaugaccuugaagagcuuacggcc

SEQ ID NO: 97406 - RNA, 64 nt, Human
gcacagaggcggagaggaaucccuuaccacacccacggcccagcuugcucacgagugucaccuc

SEQ ID NO: 97407 - RNA, 64 nt, Human
ugucugcuguuuccaacacuggugauuucuaacuacggcccacagcagaugcuguugaauaaca

SEQ ID NO: 97408 - RNA, 64 nt, Human
caugggaaacguaugugugcaggagccucccugcacggcccaaggggcuucguuuucagucuuc

SEQ ID NO: 97409 - RNA, 64 nt, Human
agggcagcagcauguggcccauggcaccacccccacggcccagcacaaccccuagagcaggaaa

SEQ ID NO: 97410 - RNA, 64 nt, Human
aagagauaucaaagcacgauuuuagauaaccuaaacggcccagccuauacgaaguugauuauau

SEQ ID NO: 97411 - RNA, 64 nt, Human
gcaguguggccaccacaccgcccugagcccucccacggcccaucgucccgggugggccgggaug

SEQ ID NO: 97412 - RNA, 64 nt, Human
agcucuggggccuccaggccauguggcuguucccacggcccaguccucgcugcaguaaccccug

SEQ ID NO: 97413 - RNA, 64 nt, Human
gucccgucgugagcagaaaggcccggggaggaugacggcccaggcccugguucucugcccagcg

SEQ ID NO: 97414 - RNA, 64 nt, Human
gcgcccucuuggguggccagcguuccuacugcagacggcccaacauccagucuuuccccaggac

SEQ ID NO: 97415 - RNA, 64 nt, Human
ugaggucuggggcugacaccccacucccuguuugacggcccagccuggacuuggggagaaugac

SEQ ID NO: 97416 - RNA, 64 nt, Human
agguacuaugaguccucaggggucaaguucagaaacggcccagccagaccuaaacccacacgcc

SEQ ID NO: 97417 - RNA, 64 nt, Human
caccugcuuuuccagcccacaaagggggacgaucacggcccagcaaaagcgaugcugagagggg

SEQ ID NO: 97418 - RNA, 64 nt, Human
ggagggccucacugugcgggaccuggccuucugcacggcccaaggagaaccuggaggccaccac

SEQ ID NO: 97419 - RNA, 64 nt, Human
cccuccuucccccuuccacccugcgcaaaaggggacggcccagugugcacgccguccggccaug

SEQ ID NO: 97420 - RNA, 64 nt, Human
ccaaagugauggacaggaaggggcagagugagucacggcccagacugggcaccuucgcgucuca

SEQ ID NO: 97421 - RNA, 64 nt, Human
aacaagauuuuaaucaccuggucaccagacccucacggcccauauccaauucgaauuucagaaa

SEQ ID NO: 97422 - RNA, 64 nt, Human
ccacaagagccacauccucacaccugacagaugcacggcccaaggggcugcagcccuguugcaa

SEQ ID NO: 97423 - RNA, 64 nt, Human
cgggagacccaccgugcaggggccuuucaugggaacggcccacacgcaguuugaccccacgccc

SEQ ID NO: 97424 - RNA, 64 nt, Human
guacuuaauacuaggauacagaaaugcaaaagauacggcccaugcaauuuuauuaaaugcauca

SEQ ID NO: 97425 - RNA, 64 nt, Human
gugaaggcugggaacgugaggagaggcaauggccacggcccauuuuggcuguagcacauggcac

SEQ ID NO: 97426 - RNA, 64 nt, Human
uaccgacgcuagcccgcggcgccgcgacgucugcacggcccagacccaggauuccaaacuugug

SEQ ID NO: 97427 - RNA, 64 nt, Human
gagccccgggugcgcccuggucuuuggagcagccacggcccacaaucaccccccuuuucuaaga

SEQ ID NO: 97428 - RNA, 64 nt, Human
ucagaguccggcauaugaaggcgcaugguucuggacggcccagcagcuccuguggccacagcag

SEQ ID NO: 97429 - RNA, 64 nt, Human
uaguacacacccaccuggccgagcuguaccuggcacggcccauccuggacugagaaacuggaac

SEQ ID NO: 97430 - RNA, 64 nt, Human
uguugguggcgaugucccagacaaucccaccaggacggcccagacaucccuacuggcuucgcug

SEQ ID NO: 97431 - RNA, 64 nt, Human
uggaccugagcuauucucacucggaccuggggaaacggcccaccaaggacagcuacacgcugac

SEQ ID NO: 97432 - RNA, 64 nt, Human
uacacgccugcaguuguuuuccggagucugucccacggcccacacgcucacuugacucaugcug

SEQ ID NO: 97433 - RNA, 64 nt, Human
acuuggaagaacccugcaccggcuggcgugugcgacggcccagucccauccagagcauggagcc

SEQ ID NO: 97434 - RNA, 64 nt, Human
cacccggccuuuuagcucagguccaccaugggggacggcccagcgugggugggggugccagagg

SEQ ID NO: 97435 - RNA, 64 nt, Human
cgcccaggagggugccuuccucggggguagggggacggcccacucugccccagggagucccuuu

SEQ ID NO: 97436 - RNA, 59 nt, Human
agcuggccaaccagaagugagggccacggacggcccagacccgggcuggggcgcggcac

SEQ ID NO: 97437 - RNA, 64 nt, Human
aagccaaggugggaggcagcugacaacaccacccacggcccaugcagaggugguagaaaggcug

SEQ ID NO: 97438 - RNA, 64 nt, Human
ggcccagacucugagcuccaccggcccagucugcacggcccaucugcuucaccuucccucccag

SEQ ID NO: 97439 - RNA, 64 nt, Human
gguggugggcaggcaccuuggcaucugugcagagacggcccagucuggccaaauccucuuccuc

SEQ ID NO: 97440 - RNA, 64 nt, Human
cugcugagguguggucagcuccccuaaaaugggcacggcccagccugucccaugaggaauaaag

SEQ ID NO: 97441 - RNA, 64 nt, Human
aaauggcccagugugaugcugcugccgcccggccacggcccacccuggucaggcugccuccuua

SEQ ID NO: 97442 - RNA, 64 nt, Human
ugcauugguaaagcuggcaguugaaaccaguuggacggcccagcuugcgucucuucugccugag

SEQ ID NO: 97443 - RNA, 64 nt, Human
agcacagccuggacauuauggaggguguggcgggacggcccacaccuggguccuccaucgggaa

SEQ ID NO: 97444 - RNA, 64 nt, Human
cagucaccaccgugugagcugcccgggcggguacacggcccaggcccagggaacccccuggggc

SEQ ID NO: 97445 - RNA, 64 nt, Human
ccucuuuugucuucugugaagacaggaccuaugcaacgcacagacacuuuuggagaccguaaaa

SEQ ID NO: 97446 - RNA, 64 nt, Human
uggacucccagccugccagagaaugaagaaauacaacgcacaguacuuuugaagcuucguauuu

SEQ ID NO: 97447 - RNA, 64 nt, Human
cacugugaaacccccacccuucugccucgugcuaaacgcacacaguaucuagucaggggaaaag

SEQ ID NO: 97448 - RNA, 64 nt, Human
uuauuuccuuccauuaagaauuacucagaguucuaacgcacagaauccugacuuccauguagcu

SEQ ID NO: 97449 - RNA, 64 nt, Human
uuguagaaugagguuguaucaauagcagugacaaaacgcacacaucaacccacagaccuuagga

SEQ ID NO: 97450 - RNA, 64 nt, Human
gcuuugcacuaucguuugcuugguguuuguuuuuaacgcacaacuugcuuguacaguaaacugu

SEQ ID NO: 97451 - RNA, 64 nt, Human
ccagauggggccuuuggggcugguagaaauacccaacgcacaaaugaccgcacguucucugccc

SEQ ID NO: 97452 - RNA, 64 nt, Human
guguauuuuuccaagcacaguauaaaauuuuaacaacgcacaaaaaaauacagaacugcagggg

SEQ ID NO: 97453 - RNA, 64 nt, Human
ugggcuccuuauaacauaaucguguguccaggcaaacgcacacuagugucugacuggaaagcuc

SEQ ID NO: 97454 - RNA, 64 nt, Human
ccgcccgcccgcauagcacuugcagaccugccugaacgcacaugacauagcacuugccgaucug

SEQ ID NO: 97455 - RNA, 64 nt, Human
gcucgaccacagaauaaugccagucaccacccugaacgcacaaucuccagugcaggaucuaaug

SEQ ID NO: 97456 - RNA, 64 nt, Human
gagacuuagcaccaagugcugaggcuggaagaaaaacgcacaccagacgggcaacaaacagucu

SEQ ID NO: 97457 - RNA, 64 nt, Human
ccucaguucaagugccccuauuuauuucaauaagaacgcacauaucccagcuguuuuuuguuug

SEQ ID NO: 97458 - RNA, 64 nt, Human
uuauuuaaagacugaaaauucauugcaauuagggaacgcacagccucacaaaaagugguuguga

SEQ ID NO: 97459 - RNA, 64 nt, Human
ggaggguggugugaguuccucuggugggagggagaacgcacaucucuucugggcggccaccuga

SEQ ID NO: 97460 - RNA, 64 nt, Human
auuguagagaaaaaaaaauauguguacacauaugaacgcacaacaugcacauucauccucacau

SEQ ID NO: 97461 - RNA, 64 nt, Human
aaaaccauuuugaucucccugugguuaucaauauaacgcacaaucacaaguguaugaggacuua

SEQ ID NO: 97462 - RNA, 64 nt, Human
gugacacuguuguacaagaugucagcuuugcugaaacgcacauuaccuggaauaagugcuuuaa

SEQ ID NO: 97463 - RNA, 64 nt, Human
cugguuuuaauuacccucagauuucacccauaaaaacgcacaauuguauuauuuuacagagaug

SEQ ID NO: 97464 - RNA, 64 nt, Human
aggaaggugugcaggaagaaaacucccuugggagaacgcacacccucccgugguggcuguuccu

SEQ ID NO: 97465 - RNA, 64 nt, Human
auuugaaaugaaggcauuuguuaauacaagaugcaacgcacagcacucugucugaggcuuuggu

SEQ ID NO: 97466 - RNA, 64 nt, Human
aaagagguucugcacuccuggaaccggucacaggaacgcacagaucauggcaggaugcgcuggg

SEQ ID NO: 97467 - RNA, 64 nt, Human
ucuuacagcugugccuaauaauaauuaauuaauaaacgcacagcccuaugugaacagacaggaa

SEQ ID NO: 97468 - RNA, 64 nt, Human
agagaagagcugauuuuggcauuacuaagcccagaacgcacauaacccauagugaaaugugcug

SEQ ID NO: 97469 - RNA, 64 nt, Human
gaauuuuuuaaaaaauuaauaaacaaauugucuaaacgcacaguugcaggcucccuugggaaag

SEQ ID NO: 97470 - RNA, 64 nt, Human
ucuaaugagaguuuuuacagcucaucauucaaauaacgcacaaaaaacaaaagccgcuaugacc

SEQ ID NO: 97471 - RNA, 64 nt, Human
cucccuuguggcagcuuucucuucaaauaggaagaacgcacagagggcaggagccuccuguuug

SEQ ID NO: 97472 - RNA, 64 nt, Human
uucugaccaugagacgcggcuugcagugggggugaacgcacauaaaaagggaccacugacgucc

SEQ ID NO: 97473 - RNA, 64 nt, Human
ugagguauguuuuagauauaguuuacaaaaauaaaacgcacagaucuuaccuuuuuggccuccu

SEQ ID NO: 97474 - RNA, 64 nt, Human
guagauugauacgcaguugugcaugggaaggggaaacgcacagcuuuauuuacuguaaagugga

SEQ ID NO: 97475 - RNA, 64 nt, Human
ggagaagcccgaugccccaucccggcuuucccguaacgcacaggacacgugugcaauucauagg

SEQ ID NO: 97476 - RNA, 64 nt, Human
agcucagccucacaggccaaagcaucagcaccagaacgcacacccagcccagccccaaagagaa

SEQ ID NO: 97477 - RNA, 64 nt, Human; identical to SEQ ID NO: 97476

SEQ ID NO: 97478 - RNA, 64 nt, Human
gaucccaggaaggcagagguggcagugagcugagaacgcacaacugcacuccagccugggugac

SEQ ID NO: 97479 - RNA, 64 nt, Human
cucuuguuuuuuuaccaccuggugaaucagccauaacgcacacacacgccacccagccucuugu

SEQ ID NO: 97480 - RNA, 64 nt, Human
aaauaaucucuaaguuuucugaaauggaauauuuaacgcacauagacaguggauauuuacuuua

SEQ ID NO: 97481 - RNA, 64 nt, Human
uuaacauuguuuuuguguuauuuuugcuugaaacaacgcacacauuuucaacaaccaaaaaaug

SEQ ID NO: 97482 - RNA, 64 nt, Human
aguagcaauuucacaaaauuuguauguagauguuaacgcacauuuccuuugcuucuuuuauuag

SEQ ID NO: 97483 - RNA, 64 nt, Human
accaaaacuuaugcuaaauauacuuuccaguaugaacgcacaggagagucccaucagcaggcgg

SEQ ID NO: 97484 - RNA, 64 nt, Human
ugagucauuuuuuucaaaagaugaaaacuccagaaacgcacaggaacgaaauaccucccagaaa

SEQ ID NO: 97485 - RNA, 64 nt, Human
uugguuuuuuucuacuugugugucugggggaaugaacgcacagaucuguuugacuuuguuauaa

SEQ ID NO: 97486 - RNA, 64 nt, Human
gcagugccauugacugcccugauguucagagagaaacgcacacaagguuugcccaugagaauug

SEQ ID NO: 97487 - RNA, 64 nt, Human
caggaaaccaacacccaaagcauggacuaaccccaacgcacaggaaaagguagcuuaccugaca

SEQ ID NO: 97488 - RNA, 64 nt, Human
uccguuuauggaggcaauuccauauccuuucuugaacgcacauucagcuuaccccagagagcaa

SEQ ID NO: 97489 - RNA, 64 nt, Human
uuuuuaaugucucuacuauccuuuuuuauugaauaacgcacaguauuuuccuaagguugcuggg

SEQ ID NO: 97490 - RNA, 64 nt, Human
auuggacugcccugaauuuagcaccaauugcauuaacgcacaucucuuccacaacuaacagacu

SEQ ID NO: 97491 - RNA, 64 nt, Human
aaagaaaucccuaaaaaaaaaaauuauccaauugaacgcacauagcucaaucacacuggaaaug

SEQ ID NO: 97492 - RNA, 64 nt, Human
ugcauuuguacacggggagaggagcuauaauuggaacgcacacugccguccaauguggagagcc

SEQ ID NO: 97493 - RNA, 64 nt, Human
ggaucuugggaccuccaaacuuauagcgcugaccaacgcacaacagguagcagagagguguuua

SEQ ID NO: 97494 - RNA, 64 nt, Human
aucaaacacagcauuucauguaaucagaauucuaaacgcacaacucgggagcugugcacggcuu

SEQ ID NO: 97495 - RNA, 64 nt, Human
caccaugcugagucgcccuucucagcgcuccaucaacgcacaccugcuaucguggaacagccua

SEQ ID NO: 97496 - RNA, 64 nt, Human
aacacuguugcucuugaaaaucugggucugaaaaaacgcacaagagccccugcccugcccuagc

SEQ ID NO: 97497 - RNA, 64 nt, Human
agcaugcacuuuggaaauccggccuuuugaccagaacgcacaccucgucggggggcccagucca

SEQ ID NO: 97498 - RNA, 64 nt, Human
agagcugugaaucuagaggcucugagccacuguuaacgcacaauguucacagacaucuguugcu

SEQ ID NO: 97499 - RNA, 64 nt, Human
cugcagggcugccagauggagaucuuggaacugaaacgcacagccagugcucuggaaauugagc

SEQ ID NO: 97500 - RNA, 64 nt, Human
gaaauaccaaccugaagacaccguucauucaggcaacgcacaaaacagaaaaugaagguggaac

SEQ ID NO: 97501 - RNA, 64 nt, Human
gcaggaauacauucguccucucuuagagaaguuuaacgcacauaguauuauuuuacuaagagaa

SEQ ID NO: 97502 - RNA, 64 nt, Human
uucccaccacuaaaaaaccaacaaugugauuuauaacgcacaacuucgugcucaggucaucuag

SEQ ID NO: 97503 - RNA, 64 nt, Human
uacccuaaaauugaaagguggucccuacacugaaaacgcacauaguuugucaaaaguguacaaa

SEQ ID NO: 97504 - RNA, 64 nt, Human
aaaaauugguuucuagagguaaccuguacacacaaacgcacagggaugcacaugguuuccucug

SEQ ID NO: 97505 - RNA, 64 nt, Human
ugcccacaggaggcaugcacaaucugguaggagaaacgcacaaguacagauagcuugcucucug

SEQ ID NO: 97506 - RNA, 64 nt, Human
gaaaggaccucaaccacacuccacgccggcagccaacgcacaggaugggggcgccaggagaggg

SEQ ID NO: 97507 - RNA, 64 nt, Human
aaggaugucuaagcuaaucccgucacagaaaggaaacgcacaggcgccuaggcagaaacuugga

SEQ ID NO: 97508 - RNA, 64 nt, Human
acugaugcagucguggugaacaggaggucuaccuaacgcacagaaagucaugcuucagugacau

SEQ ID NO: 97509 - RNA, 64 nt, Human
acaccgcagcucacuuaacucucgcaauaccauaaacgcacacuguuucaucuugacccuuucu

SEQ ID NO: 97510 - RNA, 64 nt, Human
cccugcagacaugguggagcugcugcugcugcagaacgcacaggugcaccaguugguccugcag

SEQ ID NO: 97511 - RNA, 64 nt, Human
ggguggcagcgcccagccuggccccaagcauggaaacgcacaaccccuaaucgcccugagcuac

SEQ ID NO: 97512 - RNA, 64 nt, Human
accagcugaccagaaugagauccaaucugcugaaaacgcacaaguuuauuguuggacaagauga

SEQ ID NO: 97513 - RNA, 64 nt, Human; identical to SEQ ID NO: 11476

SEQ ID NO: 97514 - RNA, 64 nt, Human; identical to SEQ ID NO: 11477

SEQ ID NO: 97515 - RNA, 64 nt, Human; identical to SEQ ID NO: 11478

SEQ ID NO: 97516 - RNA, 64 nt, Human; identical to SEQ ID NO: 11479

SEQ ID NO: 97517 - RNA, 64 nt, Human; identical to SEQ ID NO: 11480

SEQ ID NO: 97518 - RNA, 64 nt, Human; identical to SEQ ID NO: 11481

SEQ ID NO: 97519 - RNA, 64 nt, Human; identical to SEQ ID NO: 11482

SEQ ID NO: 97520 - RNA, 64 nt, Human; identical to SEQ ID NO: 11483

SEQ ID NO: 97521 - RNA, 64 nt, Human; identical to SEQ ID NO: 11484

SEQ ID NO: 97522 - RNA, 64 nt, Human; identical to SEQ ID NO: 11485

SEQ ID NO: 97523 - RNA, 64 nt, Human; identical to SEQ ID NO: 11486

SEQ ID NO: 97524 - RNA, 64 nt, Human; identical to SEQ ID NO: 11487

SEQ ID NO: 97525 - RNA, 64 nt, Human; identical to SEQ ID NO: 11488

SEQ ID NO: 97526 - RNA, 64 nt, Human; identical to SEQ ID NO: 11489

SEQ ID NO: 97527 - RNA, 64 nt, Human; identical to SEQ ID NO: 11490

SEQ ID NO: 97528 - RNA, 64 nt, Human; identical to SEQ ID NO: 11491

SEQ ID NO: 97529 - RNA, 64 nt, Human; identical to SEQ ID NO: 11492

SEQ ID NO: 97530 - RNA, 64 nt, Human; identical to SEQ ID NO: 11493

SEQ ID NO: 97531 - RNA, 64 nt, Human; identical to SEQ ID NO: 84662

SEQ ID NO: 97532 - RNA, 64 nt, Human; identical to SEQ ID NO: 11494

SEQ ID NO: 97533 - RNA, 64 nt, Human; identical to SEQ ID NO: 11495

SEQ ID NO: 97534 - RNA, 64 nt, Human; identical to SEQ ID NO: 11496

SEQ ID NO: 97535 - RNA, 64 nt, Human; identical to SEQ ID NO: 11497

SEQ ID NO: 97536 - RNA, 64 nt, Human; identical to SEQ ID NO: 11498

SEQ ID NO: 97537 - RNA, 64 nt, Human; identical to SEQ ID NO: 11499

SEQ ID NO: 97538 - RNA, 64 nt, Human; identical to SEQ ID NO: 11500

SEQ ID NO: 97539 - RNA, 64 nt, Human; identical to SEQ ID NO: 11502

SEQ ID NO: 97540 - RNA, 64 nt, Human; identical to SEQ ID NO: 11503

SEQ ID NO: 97541 - RNA, 64 nt, Human; identical to SEQ ID NO: 11504

SEQ ID NO: 97542 - RNA, 64 nt, Human; identical to SEQ ID NO: 11505

SEQ ID NO: 97543 - RNA, 64 nt, Human; identical to SEQ ID NO: 11506

SEQ ID NO: 97544 - RNA, 64 nt, Human; identical to SEQ ID NO: 11507

SEQ ID NO: 97545 - RNA, 64 nt, Human; identical to SEQ ID NO: 11508

SEQ ID NO: 97546 - RNA, 64 nt, Human; identical to SEQ ID NO: 11509

SEQ ID NO: 97547 - RNA, 64 nt, Human; identical to SEQ ID NO: 11510

SEQ ID NO: 97548 - RNA, 64 nt, Human; identical to SEQ ID NO: 11511

SEQ ID NO: 97549 - RNA, 64 nt, Human; identical to SEQ ID NO: 84618

SEQ ID NO: 97550 - RNA, 64 nt, Human; identical to SEQ ID NO: 11512

SEQ ID NO: 97551 - RNA, 64 nt, Human; identical to SEQ ID NO: 11513

SEQ ID NO: 97552 - RNA, 64 nt, Human; identical to SEQ ID NO: 11514

SEQ ID NO: 97553 - RNA, 64 nt, Human; identical to SEQ ID NO: 11515

SEQ ID NO: 97554 - RNA, 64 nt, Human; identical to SEQ ID NO: 11516

SEQ ID NO: 97555 - RNA, 64 nt, Human; identical to SEQ ID NO: 11517

SEQ ID NO: 97556 - RNA, 64 nt, Human; identical to SEQ ID NO: 11518

SEQ ID NO: 97557 - RNA, 64 nt, Human; identical to SEQ ID NO: 11519

SEQ ID NO: 97558 - RNA, 64 nt, Human; identical to SEQ ID NO: 11521

SEQ ID NO: 97559 - RNA, 64 nt, Human; identical to SEQ ID NO: 11522

SEQ ID NO: 97560 - RNA, 64 nt, Human; identical to SEQ ID NO: 11523

SEQ ID NO: 97561 - RNA, 64 nt, Human; identical to SEQ ID NO: 11524

SEQ ID NO: 97562 - RNA, 64 nt, Human; identical to SEQ ID NO: 11525

SEQ ID NO: 97563 - RNA, 64 nt, Human; identical to SEQ ID NO: 11526

SEQ ID NO: 97564 - RNA, 64 nt, Human; identical to SEQ ID NO: 11527

SEQ ID NO: 97565 - RNA, 64 nt, Human; identical to SEQ ID NO: 11528

SEQ ID NO: 97566 - RNA, 53 nt, Human; identical to SEQ ID NO: 11529

SEQ ID NO: 97567 - RNA, 64 nt, Human; identical to SEQ ID NO: 84736

SEQ ID NO: 97568 - RNA, 64 nt, Human; identical to SEQ ID NO: 11530

SEQ ID NO: 97569 - RNA, 64 nt, Human; identical to SEQ ID NO: 11531

SEQ ID NO: 97570 - RNA, 64 nt, Human; identical to SEQ ID NO: 11532

SEQ ID NO: 97571 - RNA, 64 nt, Human; identical to SEQ ID NO: 11533

SEQ ID NO: 97572 - RNA, 64 nt, Human; identical to SEQ ID NO: 11534

SEQ ID NO: 97573 - RNA, 64 nt, Human; identical to SEQ ID NO: 11535

SEQ ID NO: 97574 - RNA, 64 nt, Human; identical to SEQ ID NO: 11536

SEQ ID NO: 97575 - RNA, 64 nt, Human; identical to SEQ ID NO: 11537

SEQ ID NO: 97576 - RNA, 64 nt, Human; identical to SEQ ID NO: 11538

SEQ ID NO: 97577 - RNA, 64 nt, Human; identical to SEQ ID NO: 11539

SEQ ID NO: 97578 - RNA, 64 nt, Human; identical to SEQ ID NO: 11540

SEQ ID NO: 97579 - RNA, 64 nt, Human; identical to SEQ ID NO: 11541

SEQ ID NO: 97580 - RNA, 64 nt, Human; identical to SEQ ID NO: 11542

SEQ ID NO: 97581 - RNA, 64 nt, Human; identical to SEQ ID NO: 11543

SEQ ID NO: 97582 - RNA, 64 nt, Human; identical to SEQ ID NO: 11544

SEQ ID NO: 97583 - RNA, 64 nt, Human; identical to SEQ ID NO: 11545

SEQ ID NO: 97584 - RNA, 64 nt, Human; identical to SEQ ID NO: 11546

SEQ ID NO: 97585 - RNA, 64 nt, Human; identical to SEQ ID NO: 84562

SEQ ID NO: 97586 - RNA, 64 nt, Human; identical to SEQ ID NO: 11547

SEQ ID NO: 97587 - RNA, 64 nt, Human; identical to SEQ ID NO: 11548

SEQ ID NO: 97588 - RNA, 64 nt, Human; identical to SEQ ID NO: 11549

SEQ ID NO: 97589 - RNA, 64 nt, Human; identical to SEQ ID NO: 11550

SEQ ID NO: 97590 - RNA, 64 nt, Human; identical to SEQ ID NO: 11551

SEQ ID NO: 97591 - RNA, 64 nt, Human; identical to SEQ ID NO: 11552

SEQ ID NO: 97592 - RNA, 64 nt, Human; identical to SEQ ID NO: 11553

SEQ ID NO: 97593 - RNA, 64 nt, Human; identical to SEQ ID NO: 11554

SEQ ID NO: 97594 - RNA, 64 nt, Human; identical to SEQ ID NO: 11555

SEQ ID NO: 97595 - RNA, 64 nt, Human; identical to SEQ ID NO: 11556

SEQ ID NO: 97596 - RNA, 64 nt, Human; identical to SEQ ID NO: 11557

SEQ ID NO: 97597 - RNA, 64 nt, Human; identical to SEQ ID NO: 11559

SEQ ID NO: 97598 - RNA, 64 nt, Human; identical to SEQ ID NO: 11560

SEQ ID NO: 97599 - RNA, 64 nt, Human; identical to SEQ ID NO: 11561

SEQ ID NO: 97600 - RNA, 64 nt, Human; identical to SEQ ID NO: 11562

SEQ ID NO: 97601 - RNA, 64 nt, Human; identical to SEQ ID NO: 11563

SEQ ID NO: 97602 - RNA, 62 nt, Human; identical to SEQ ID NO: 11564

SEQ ID NO: 97603 - RNA, 64 nt, Human; identical to SEQ ID NO: 84624

SEQ ID NO: 97604 - RNA, 64 nt, Human; identical to SEQ ID NO: 11565

SEQ ID NO: 97605 - RNA, 64 nt, Human; identical to SEQ ID NO: 11566

SEQ ID NO: 97606 - RNA, 64 nt, Human; identical to SEQ ID NO: 11567

SEQ ID NO: 97607 - RNA, 64 nt, Human; identical to SEQ ID NO: 11568

SEQ ID NO: 97608 - RNA, 64 nt, Human; identical to SEQ ID NO: 11569

SEQ ID NO: 97609 - RNA, 64 nt, Human; identical to SEQ ID NO: 11570

SEQ ID NO: 97610 - RNA, 64 nt, Human; identical to SEQ ID NO: 11571

SEQ ID NO: 97611 - RNA, 64 nt, Human; identical to SEQ ID NO: 11572

SEQ ID NO: 97612 - RNA, 64 nt, Human; identical to SEQ ID NO: 11573

SEQ ID NO: 97613 - RNA, 64 nt, Human; identical to SEQ ID NO: 11574

SEQ ID NO: 97614 - RNA, 64 nt, Human; identical to SEQ ID NO: 11575

SEQ ID NO: 97615 - RNA, 64 nt, Human; identical to SEQ ID NO: 11576

SEQ ID NO: 97616 - RNA, 64 nt, Human; identical to SEQ ID NO: 11577

SEQ ID NO: 97617 - RNA, 64 nt, Human; identical to SEQ ID NO: 11578

SEQ ID NO: 97618 - RNA, 64 nt, Human; identical to SEQ ID NO: 11579

SEQ ID NO: 97619 - RNA, 64 nt, Human; identical to SEQ ID NO: 11580

SEQ ID NO: 97620 - RNA, 64 nt, Human; identical to SEQ ID NO: 11581

SEQ ID NO: 97621 - RNA, 64 nt, Human; identical to SEQ ID NO: 84568

SEQ ID NO: 97622 - RNA, 64 nt, Human; identical to SEQ ID NO: 11582

SEQ ID NO: 97623 - RNA, 64 nt, Human; identical to SEQ ID NO: 11583

SEQ ID NO: 97624 - RNA, 64 nt, Human; identical to SEQ ID NO: 11584

SEQ ID NO: 97625 - RNA, 64 nt, Human; identical to SEQ ID NO: 11585

SEQ ID NO: 97626 - RNA, 64 nt, Human; identical to SEQ ID NO: 11586

SEQ ID NO: 97627 - RNA, 64 nt, Human; identical to SEQ ID NO: 11587

SEQ ID NO: 97628 - RNA, 64 nt, Human; identical to SEQ ID NO: 11588

SEQ ID NO: 97629 - RNA, 64 nt, Human; identical to SEQ ID NO: 11589

SEQ ID NO: 97630 - RNA, 64 nt, Human; identical to SEQ ID NO: 11590

SEQ ID NO: 97631 - RNA, 64 nt, Human; identical to SEQ ID NO: 11591

SEQ ID NO: 97632 - RNA, 64 nt, Human; identical to SEQ ID NO: 11592

SEQ ID NO: 97633 - RNA, 64 nt, Human; identical to SEQ ID NO: 11593

SEQ ID NO: 97634 - RNA, 64 nt, Human; identical to SEQ ID NO: 11594

SEQ ID NO: 97635 - RNA, 64 nt, Human; identical to SEQ ID NO: 11595

SEQ ID NO: 97636 - RNA, 64 nt, Human; identical to SEQ ID NO: 11597

SEQ ID NO: 97637 - RNA, 64 nt, Human; identical to SEQ ID NO: 11598

SEQ ID NO: 97638 - RNA, 64 nt, Human; identical to SEQ ID NO: 11599

SEQ ID NO: 97639 - RNA, 64 nt, Human; identical to SEQ ID NO: 84666

SEQ ID NO: 97640 - RNA, 64 nt, Human; identical to SEQ ID NO: 11600

SEQ ID NO: 97641 - RNA, 64 nt, Human; identical to SEQ ID NO: 11601

SEQ ID NO: 97642 - RNA, 64 nt, Human; identical to SEQ ID NO: 11602

SEQ ID NO: 97643 - RNA, 64 nt, Human; identical to SEQ ID NO: 11603

SEQ ID NO: 97644 - RNA, 64 nt, Human; identical to SEQ ID NO: 11604

SEQ ID NO: 97645 - RNA, 64 nt, Human; identical to SEQ ID NO: 11605

SEQ ID NO: 97646 - RNA, 64 nt, Human; identical to SEQ ID NO: 11606

SEQ ID NO: 97647 - RNA, 64 nt, Human; identical to SEQ ID NO: 11607

SEQ ID NO: 97648 - RNA, 64 nt, Human; identical to SEQ ID NO: 11608

SEQ ID NO: 97649 - RNA, 64 nt, Human; identical to SEQ ID NO: 11609

SEQ ID NO: 97650 - RNA, 64 nt, Human; identical to SEQ ID NO: 11610

SEQ ID NO: 97651 - RNA, 64 nt, Human; identical to SEQ ID NO: 11611

SEQ ID NO: 97652 - RNA, 64 nt, Human; identical to SEQ ID NO: 11612

SEQ ID NO: 97653 - RNA, 64 nt, Human; identical to SEQ ID NO: 11613

SEQ ID NO: 97654 - RNA, 64 nt, Human; identical to SEQ ID NO: 11614

SEQ ID NO: 97655 - RNA, 64 nt, Human; identical to SEQ ID NO: 11615

SEQ ID NO: 97656 - RNA, 64 nt, Human; identical to SEQ ID NO: 11616

SEQ ID NO: 97657 - RNA, 64 nt, Human; identical to SEQ ID NO: 84574

SEQ ID NO: 97658 - RNA, 64 nt, Human; identical to SEQ ID NO: 11617

SEQ ID NO: 97659 - RNA, 64 nt, Human; identical to SEQ ID NO: 11618

SEQ ID NO: 97660 - RNA, 64 nt, Human; identical to SEQ ID NO: 11619

SEQ ID NO: 97661 - RNA, 64 nt, Human; identical to SEQ ID NO: 11620

SEQ ID NO: 97662 - RNA, 64 nt, Human; identical to SEQ ID NO: 11621

SEQ ID NO: 97663 - RNA, 64 nt, Human; identical to SEQ ID NO: 11622

SEQ ID NO: 97664 - RNA, 64 nt, Human; identical to SEQ ID NO: 11623

SEQ ID NO: 97665 - RNA, 64 nt, Human; identical to SEQ ID NO: 11624

SEQ ID NO: 97666 - RNA, 64 nt, Human; identical to SEQ ID NO: 11625

SEQ ID NO: 97667 - RNA, 64 nt, Human; identical to SEQ ID NO: 11626

SEQ ID NO: 97668 - RNA, 64 nt, Human; identical to SEQ ID NO: 11627

SEQ ID NO: 97669 - RNA, 64 nt, Human; identical to SEQ ID NO: 11628

SEQ ID NO: 97670 - RNA, 64 nt, Human; identical to SEQ ID NO: 11629

SEQ ID NO: 97671 - RNA, 64 nt, Human; identical to SEQ ID NO: 11630

SEQ ID NO: 97672 - RNA, 64 nt, Human; identical to SEQ ID NO: 11631

SEQ ID NO: 97673 - RNA, 64 nt, Human; identical to SEQ ID NO: 11632

SEQ ID NO: 97674 - RNA, 64 nt, Human; identical to SEQ ID NO: 11633

SEQ ID NO: 97675 - RNA, 64 nt, Human; identical to SEQ ID NO: 84628

SEQ ID NO: 97676 - RNA, 64 nt, Human; identical to SEQ ID NO: 11635

SEQ ID NO: 97677 - RNA, 64 nt, Human; identical to SEQ ID NO: 11636

SEQ ID NO: 97678 - RNA, 64 nt, Human; identical to SEQ ID NO: 11637

SEQ ID NO: 97679 - RNA, 64 nt, Human; identical to SEQ ID NO: 11638

SEQ ID NO: 97680 - RNA, 64 nt, Human; identical to SEQ ID NO: 11639

SEQ ID NO: 97681 - RNA, 64 nt, Human; identical to SEQ ID NO: 11640

SEQ ID NO: 97682 - RNA, 64 nt, Human; identical to SEQ ID NO: 11641

SEQ ID NO: 97683 - RNA, 64 nt, Human; identical to SEQ ID NO: 11642

SEQ ID NO: 97684 - RNA, 64 nt, Human; identical to SEQ ID NO: 11643

SEQ ID NO: 97685 - RNA, 64 nt, Human; identical to SEQ ID NO: 11644

SEQ ID NO: 97686 - RNA, 64 nt, Human; identical to SEQ ID NO: 11645

SEQ ID NO: 97687 - RNA, 64 nt, Human; identical to SEQ ID NO: 11646

SEQ ID NO: 97688 - RNA, 64 nt, Human; identical to SEQ ID NO: 11647

SEQ ID NO: 97689 - RNA, 64 nt, Human; identical to SEQ ID NO: 11648

SEQ ID NO: 97690 - RNA, 64 nt, Human; identical to SEQ ID NO: 11649

SEQ ID NO: 97691 - RNA, 64 nt, Human; identical to SEQ ID NO: 11650

SEQ ID NO: 97692 - RNA, 64 nt, Human; identical to SEQ ID NO: 11651

SEQ ID NO: 97693 - RNA, 64 nt, Human; identical to SEQ ID NO: 84580

SEQ ID NO: 97694 - RNA, 64 nt, Human; identical to SEQ ID NO: 11652

SEQ ID NO: 97695 - RNA, 64 nt, Human; identical to SEQ ID NO: 11654

SEQ ID NO: 97696 - RNA, 64 nt, Human; identical to SEQ ID NO: 11655

SEQ ID NO: 97697 - RNA, 64 nt, Human; identical to SEQ ID NO: 11656

SEQ ID NO: 97698 - RNA, 64 nt, Human; identical to SEQ ID NO: 11657

SEQ ID NO: 97699 - RNA, 64 nt, Human; identical to SEQ ID NO: 11658

SEQ ID NO: 97700 - RNA, 64 nt, Human; identical to SEQ ID NO: 11659

SEQ ID NO: 97701 - RNA, 64 nt, Human; identical to SEQ ID NO: 11660

SEQ ID NO: 97702 - RNA, 64 nt, Human; identical to SEQ ID NO: 11661

SEQ ID NO: 97703 - RNA, 64 nt, Human; identical to SEQ ID NO: 11662

SEQ ID NO: 97704 - RNA, 64 nt, Human; identical to SEQ ID NO: 11663

SEQ ID NO: 97705 - RNA, 64 nt, Human; identical to SEQ ID NO: 11664

SEQ ID NO: 97706 - RNA, 64 nt, Human; identical to SEQ ID NO: 11665

SEQ ID NO: 97707 - RNA, 64 nt, Human; identical to SEQ ID NO: 11666

SEQ ID NO: 97708 - RNA, 64 nt, Human; identical to SEQ ID NO: 11667

SEQ ID NO: 97709 - RNA, 64 nt, Human; identical to SEQ ID NO: 11668

SEQ ID NO: 97710 - RNA, 64 nt, Human; identical to SEQ ID NO: 11669

SEQ ID NO: 97711 - RNA, 64 nt, Human; identical to SEQ ID NO: 84704

SEQ ID NO: 97712 - RNA, 64 nt, Human; identical to SEQ ID NO: 11670

SEQ ID NO: 97713 - RNA, 64 nt, Human; identical to SEQ ID NO: 11671

SEQ ID NO: 97714 - RNA, 64 nt, Human; identical to SEQ ID NO: 11673

SEQ ID NO: 97715 - RNA, 64 nt, Human; identical to SEQ ID NO: 11674

SEQ ID NO: 97716 - RNA, 64 nt, Human; identical to SEQ ID NO: 11675

SEQ ID NO: 97717 - RNA, 64 nt, Human; identical to SEQ ID NO: 11676

SEQ ID NO: 97718 - RNA, 64 nt, Human; identical to SEQ ID NO: 11677

SEQ ID NO: 97719 - RNA, 64 nt, Human; identical to SEQ ID NO: 11678

SEQ ID NO: 97720 - RNA, 64 nt, Human; identical to SEQ ID NO: 11679

SEQ ID NO: 97721 - RNA, 64 nt, Human; identical to SEQ ID NO: 11680

SEQ ID NO: 97722 - RNA, 64 nt, Human; identical to SEQ ID NO: 11681

SEQ ID NO: 97723 - RNA, 64 nt, Human; identical to SEQ ID NO: 11682

SEQ ID NO: 97724 - RNA, 64 nt, Human; identical to SEQ ID NO: 11683

SEQ ID NO: 97725 - RNA, 64 nt, Human; identical to SEQ ID NO: 11684

SEQ ID NO: 97726 - RNA, 64 nt, Human; identical to SEQ ID NO: 11685

SEQ ID NO: 97727 - RNA, 64 nt, Human; identical to SEQ ID NO: 11686

SEQ ID NO: 97728 - RNA, 64 nt, Human; identical to SEQ ID NO: 11687

SEQ ID NO: 97729 - RNA, 50 nt, Human; identical to SEQ ID NO: 11688

SEQ ID NO: 97730 - RNA, 64 nt, Human; identical to SEQ ID NO: 11689

SEQ ID NO: 97731 - RNA, 64 nt, Human; identical to SEQ ID NO: 11690

SEQ ID NO: 97732 - RNA, 64 nt, Human; identical to SEQ ID NO: 11691

SEQ ID NO: 97733 - RNA, 64 nt, Human; identical to SEQ ID NO: 11692

SEQ ID NO: 97734 - RNA, 64 nt, Human; identical to SEQ ID NO: 11693

SEQ ID NO: 97735 - RNA, 64 nt, Human; identical to SEQ ID NO: 11694

SEQ ID NO: 97736 - RNA, 64 nt, Human; identical to SEQ ID NO: 11695

SEQ ID NO: 97737 - RNA, 64 nt, Human; identical to SEQ ID NO: 11696

SEQ ID NO: 97738 - RNA, 64 nt, Human; identical to SEQ ID NO: 11697

SEQ ID NO: 97739 - RNA, 64 nt, Human; identical to SEQ ID NO: 11698

SEQ ID NO: 97740 - RNA, 64 nt, Human; identical to SEQ ID NO: 11699

SEQ ID NO: 97741 - RNA, 64 nt, Human; identical to SEQ ID NO: 11700

SEQ ID NO: 97742 - RNA, 64 nt, Human; identical to SEQ ID NO: 11701

SEQ ID NO: 97743 - RNA, 64 nt, Human; identical to SEQ ID NO: 11702

SEQ ID NO: 97744 - RNA, 64 nt, Human; identical to SEQ ID NO: 11703

SEQ ID NO: 97745 - RNA, 64 nt, Human; identical to SEQ ID NO: 11704

SEQ ID NO: 97746 - RNA, 64 nt, Human; identical to SEQ ID NO: 11705

SEQ ID NO: 97747 - RNA, 64 nt, Human; identical to SEQ ID NO: 84520

SEQ ID NO: 97748 - RNA, 64 nt, Human; identical to SEQ ID NO: 11706

SEQ ID NO: 97749 - RNA, 64 nt, Human; identical to SEQ ID NO: 11707

SEQ ID NO: 97750 - RNA, 64 nt, Human; identical to SEQ ID NO: 11708

SEQ ID NO: 97751 - RNA, 64 nt, Human; identical to SEQ ID NO: 11709

SEQ ID NO: 97752 - RNA, 64 nt, Human; identical to SEQ ID NO: 11711

SEQ ID NO: 97753 - RNA, 64 nt, Human; identical to SEQ ID NO: 11712

SEQ ID NO: 97754 - RNA, 64 nt, Human; identical to SEQ ID NO: 11713

SEQ ID NO: 97755 - RNA, 64 nt, Human; identical to SEQ ID NO: 11714

SEQ ID NO: 97756 - RNA, 64 nt, Human; identical to SEQ ID NO: 11715

SEQ ID NO: 97757 - RNA, 64 nt, Human; identical to SEQ ID NO: 11716

SEQ ID NO: 97758 - RNA, 64 nt, Human; identical to SEQ ID NO: 11717

SEQ ID NO: 97759 - RNA, 64 nt, Human; identical to SEQ ID NO: 11718

SEQ ID NO: 97760 - RNA, 64 nt, Human; identical to SEQ ID NO: 11719

SEQ ID NO: 97761 - RNA, 64 nt, Human; identical to SEQ ID NO: 11720

SEQ ID NO: 97762 - RNA, 64 nt, Human; identical to SEQ ID NO: 11721

SEQ ID NO: 97763 - RNA, 64 nt, Human; identical to SEQ ID NO: 11722

SEQ ID NO: 97764 - RNA, 64 nt, Human; identical to SEQ ID NO: 11723

SEQ ID NO: 97765 - RNA, 64 nt, Human; identical to SEQ ID NO: 84586

SEQ ID NO: 97766 - RNA, 64 nt, Human; identical to SEQ ID NO: 11724

SEQ ID NO: 97767 - RNA, 64 nt, Human; identical to SEQ ID NO: 11725

SEQ ID NO: 97768 - RNA, 64 nt, Human; identical to SEQ ID NO: 11726

SEQ ID NO: 97769 - RNA, 64 nt, Human; identical to SEQ ID NO: 11727

SEQ ID NO: 97770 - RNA, 64 nt, Human; identical to SEQ ID NO: 11728

SEQ ID NO: 97771 - RNA, 64 nt, Human; identical to SEQ ID NO: 11730

SEQ ID NO: 97772 - RNA, 64 nt, Human; identical to SEQ ID NO: 11731

SEQ ID NO: 97773 - RNA, 64 nt, Human; identical to SEQ ID NO: 11732

SEQ ID NO: 97774 - RNA, 64 nt, Human; identical to SEQ ID NO: 11733

SEQ ID NO: 97775 - RNA, 64 nt, Human; identical to SEQ ID NO: 11734

SEQ ID NO: 97776 - RNA, 64 nt, Human; identical to SEQ ID NO: 11735

SEQ ID NO: 97777 - RNA, 64 nt, Human; identical to SEQ ID NO: 11736

SEQ ID NO: 97778 - RNA, 64 nt, Human; identical to SEQ ID NO: 11737

SEQ ID NO: 97779 - RNA, 64 nt, Human; identical to SEQ ID NO: 11738

SEQ ID NO: 97780 - RNA, 64 nt, Human; identical to SEQ ID NO: 11739

SEQ ID NO: 97781 - RNA, 64 nt, Human; identical to SEQ ID NO: 11740

SEQ ID NO: 97782 - RNA, 64 nt, Human; identical to SEQ ID NO: 11741

SEQ ID NO: 97783 - RNA, 64 nt, Human; identical to SEQ ID NO: 84526

SEQ ID NO: 97784 - RNA, 64 nt, Human; identical to SEQ ID NO: 11742

SEQ ID NO: 97785 - RNA, 64 nt, Human; identical to SEQ ID NO: 11743

SEQ ID NO: 97786 - RNA, 64 nt, Human; identical to SEQ ID NO: 11744

SEQ ID NO: 97787 - RNA, 64 nt, Human; identical to SEQ ID NO: 11745

SEQ ID NO: 97788 - RNA, 64 nt, Human; identical to SEQ ID NO: 11746

SEQ ID NO: 97789 - RNA, 64 nt, Human; identical to SEQ ID NO: 11747

SEQ ID NO: 97790 - RNA, 64 nt, Human; identical to SEQ ID NO: 11749

SEQ ID NO: 97791 - RNA, 64 nt, Human; identical to SEQ ID NO: 11750

SEQ ID NO: 97792 - RNA, 64 nt, Human; identical to SEQ ID NO: 11751

SEQ ID NO: 97793 - RNA, 64 nt, Human; identical to SEQ ID NO: 11752

SEQ ID NO: 97794 - RNA, 64 nt, Human; identical to SEQ ID NO: 11753

SEQ ID NO: 97795 - RNA, 64 nt, Human; identical to SEQ ID NO: 11754

SEQ ID NO: 97796 - RNA, 64 nt, Human; identical to SEQ ID NO: 11755

SEQ ID NO: 97797 - RNA, 64 nt, Human; identical to SEQ ID NO: 11756

SEQ ID NO: 97798 - RNA, 64 nt, Human; identical to SEQ ID NO: 11757

SEQ ID NO: 97799 - RNA, 64 nt, Human; identical to SEQ ID NO: 11758

SEQ ID NO: 97800 - RNA, 64 nt, Human; identical to SEQ ID NO: 11759

SEQ ID NO: 97801 - RNA, 64 nt, Human; identical to SEQ ID NO: 84632

SEQ ID NO: 97802 - RNA, 64 nt, Human; identical to SEQ ID NO: 11760

SEQ ID NO: 97803 - RNA, 64 nt, Human; identical to SEQ ID NO: 11761

SEQ ID NO: 97804 - RNA, 51 nt, Human; identical to SEQ ID NO: 11762

SEQ ID NO: 97805 - RNA, 64 nt, Human; identical to SEQ ID NO: 11763

SEQ ID NO: 97806 - RNA, 64 nt, Human; identical to SEQ ID NO: 11764

SEQ ID NO: 97807 - RNA, 64 nt, Human; identical to SEQ ID NO: 11765

SEQ ID NO: 97808 - RNA, 64 nt, Human; identical to SEQ ID NO: 11766

SEQ ID NO: 97809 - RNA, 64 nt, Human; identical to SEQ ID NO: 11767

SEQ ID NO: 97810 - RNA, 64 nt, Human; identical to SEQ ID NO: 11768

SEQ ID NO: 97811 - RNA, 64 nt, Human; identical to SEQ ID NO: 11769

SEQ ID NO: 97812 - RNA, 64 nt, Human; identical to SEQ ID NO: 11770

SEQ ID NO: 97813 - RNA, 64 nt, Human; identical to SEQ ID NO: 11771

SEQ ID NO: 97814 - RNA, 64 nt, Human; identical to SEQ ID NO: 11772

SEQ ID NO: 97815 - RNA, 64 nt, Human; identical to SEQ ID NO: 11773

SEQ ID NO: 97816 - RNA, 64 nt, Human; identical to SEQ ID NO: 11774

SEQ ID NO: 97817 - RNA, 64 nt, Human; identical to SEQ ID NO: 11775

SEQ ID NO: 97818 - RNA, 64 nt, Human; identical to SEQ ID NO: 11776

SEQ ID NO: 97819 - RNA, 64 nt, Human; identical to SEQ ID NO: 11777

SEQ ID NO: 97820 - RNA, 64 nt, Human; identical to SEQ ID NO: 11778

SEQ ID NO: 97821 - RNA, 64 nt, Human; identical to SEQ ID NO: 11779

SEQ ID NO: 97822 - RNA, 64 nt, Human; identical to SEQ ID NO: 11780

SEQ ID NO: 97823 - RNA, 64 nt, Human; identical to SEQ ID NO: 11781

SEQ ID NO: 97824 - RNA, 64 nt, Human; identical to SEQ ID NO: 11782

SEQ ID NO: 97825 - RNA, 64 nt, Human; identical to SEQ ID NO: 11783

SEQ ID NO: 97826 - RNA, 64 nt, Human; identical to SEQ ID NO: 11784

SEQ ID NO: 97827 - RNA, 64 nt, Human; identical to SEQ ID NO: 11785

SEQ ID NO: 97828 - RNA, 64 nt, Human; identical to SEQ ID NO: 11786

SEQ ID NO: 97829 - RNA, 64 nt, Human; identical to SEQ ID NO: 11787

SEQ ID NO: 97830 - RNA, 64 nt, Human; identical to SEQ ID NO: 11788

SEQ ID NO: 97831 - RNA, 64 nt, Human; identical to SEQ ID NO: 11789

SEQ ID NO: 97832 - RNA, 64 nt, Human; identical to SEQ ID NO: 11790

SEQ ID NO: 97833 - RNA, 64 nt, Human; identical to SEQ ID NO: 11791

SEQ ID NO: 97834 - RNA, 64 nt, Human; identical to SEQ ID NO: 11792

SEQ ID NO: 97835 - RNA, 64 nt, Human; identical to SEQ ID NO: 11793

SEQ ID NO: 97836 - RNA, 64 nt, Human; identical to SEQ ID NO: 11794

SEQ ID NO: 97837 - RNA, 62 nt, Human; identical to SEQ ID NO: 84532

SEQ ID NO: 97838 - RNA, 64 nt, Human; identical to SEQ ID NO: 11795

SEQ ID NO: 97839 - RNA, 64 nt, Human; identical to SEQ ID NO: 11796

SEQ ID NO: 97840 - RNA, 64 nt, Human; identical to SEQ ID NO: 11797

SEQ ID NO: 97841 - RNA, 64 nt, Human; identical to SEQ ID NO: 11798

SEQ ID NO: 97842 - RNA, 64 nt, Human; identical to SEQ ID NO: 11799

SEQ ID NO: 97843 - RNA, 64 nt, Human; identical to SEQ ID NO: 11800

SEQ ID NO: 97844 - RNA, 64 nt, Human; identical to SEQ ID NO: 11801

SEQ ID NO: 97845 - RNA, 64 nt, Human; identical to SEQ ID NO: 11802

SEQ ID NO: 97846 - RNA, 64 nt, Human; identical to SEQ ID NO: 11803

SEQ ID NO: 97847 - RNA, 64 nt, Human; identical to SEQ ID NO: 11804

SEQ ID NO: 97848 - RNA, 64 nt, Human; identical to SEQ ID NO: 11806

SEQ ID NO: 97849 - RNA, 64 nt, Human; identical to SEQ ID NO: 11807

SEQ ID NO: 97850 - RNA, 64 nt, Human; identical to SEQ ID NO: 11808

SEQ ID NO: 97851 - RNA, 64 nt, Human; identical to SEQ ID NO: 11809

SEQ ID NO: 97852 - RNA, 64 nt, Human; identical to SEQ ID NO: 11810

SEQ ID NO: 97853 - RNA, 64 nt, Human; identical to SEQ ID NO: 11811

SEQ ID NO: 97854 - RNA, 64 nt, Human; identical to SEQ ID NO: 11812

SEQ ID NO: 97855 - RNA, 64 nt, Human; identical to SEQ ID NO: 84590

SEQ ID NO: 97856 - RNA, 64 nt, Human; identical to SEQ ID NO: 11813

SEQ ID NO: 97857 - RNA, 64 nt, Human; identical to SEQ ID NO: 11814

SEQ ID NO: 97858 - RNA, 64 nt, Human; identical to SEQ ID NO: 11815

SEQ ID NO: 97859 - RNA, 64 nt, Human; identical to SEQ ID NO: 11816

SEQ ID NO: 97860 - RNA, 64 nt, Human; identical to SEQ ID NO: 11817

SEQ ID NO: 97861 - RNA, 64 nt, Human; identical to SEQ ID NO: 11818

SEQ ID NO: 97862 - RNA, 64 nt, Human; identical to SEQ ID NO: 11819

SEQ ID NO: 97863 - RNA, 64 nt, Human; identical to SEQ ID NO: 11820

SEQ ID NO: 97864 - RNA, 64 nt, Human; identical to SEQ ID NO: 11821

SEQ ID NO: 97865 - RNA, 64 nt, Human; identical to SEQ ID NO: 11822

SEQ ID NO: 97866 - RNA, 64 nt, Human; identical to SEQ ID NO: 11823

SEQ ID NO: 97867 - RNA, 64 nt, Human; identical to SEQ ID NO: 11824

SEQ ID NO: 97868 - RNA, 64 nt, Human; identical to SEQ ID NO: 11825

SEQ ID NO: 97869 - RNA, 64 nt, Human; identical to SEQ ID NO: 11826

SEQ ID NO: 97870 - RNA, 64 nt, Human; identical to SEQ ID NO: 11827

SEQ ID NO: 97871 - RNA, 64 nt, Human; identical to SEQ ID NO: 11828

SEQ ID NO: 97872 - RNA, 64 nt, Human; identical to SEQ ID NO: 11829

SEQ ID NO: 97873 - RNA, 64 nt, Human; identical to SEQ ID NO: 84538

SEQ ID NO: 97874 - RNA, 64 nt, Human; identical to SEQ ID NO: 11830

SEQ ID NO: 97875 - RNA, 64 nt, Human; identical to SEQ ID NO: 11831

SEQ ID NO: 97876 - RNA, 64 nt, Human; identical to SEQ ID NO: 11832

SEQ ID NO: 97877 - RNA, 64 nt, Human; identical to SEQ ID NO: 11833

SEQ ID NO: 97878 - RNA, 64 nt, Human; identical to SEQ ID NO: 11834

SEQ ID NO: 97879 - RNA, 64 nt, Human; identical to SEQ ID NO: 11835

SEQ ID NO: 97880 - RNA, 64 nt, Human; identical to SEQ ID NO: 11836

SEQ ID NO: 97881 - RNA, 64 nt, Human; identical to SEQ ID NO: 11837

SEQ ID NO: 97882 - RNA, 64 nt, Human; identical to SEQ ID NO: 11838

SEQ ID NO: 97883 - RNA, 64 nt, Human; identical to SEQ ID NO: 11839

SEQ ID NO: 97884 - RNA, 64 nt, Human; identical to SEQ ID NO: 11840

SEQ ID NO: 97885 - RNA, 64 nt, Human; identical to SEQ ID NO: 11841

SEQ ID NO: 97886 - RNA, 64 nt, Human; identical to SEQ ID NO: 11842

SEQ ID NO: 97887 - RNA, 64 nt, Human; identical to SEQ ID NO: 11844

SEQ ID NO: 97888 - RNA, 64 nt, Human; identical to SEQ ID NO: 11845

SEQ ID NO: 97889 - RNA, 59 nt, Human; identical to SEQ ID NO: 11846

SEQ ID NO: 97890 - RNA, 64 nt, Human; identical to SEQ ID NO: 11847

SEQ ID NO: 97891 - RNA, 64 nt, Human
acagaggauguggccugguucaaaguaaagcagaggaugcaacaaauguggccaagccuaucaa

SEQ ID NO: 97892 - RNA, 64 nt, Human; identical to SEQ ID NO: 11848

SEQ ID NO: 97893 - RNA, 64 nt, Human; identical to SEQ ID NO: 11849

SEQ ID NO: 97894 - RNA, 64 nt, Human; identical to SEQ ID NO: 11850

SEQ ID NO: 97895 - RNA, 64 nt, Human; identical to SEQ ID NO: 11851

SEQ ID NO: 97896 - RNA, 64 nt, Human; identical to SEQ ID NO: 11852

SEQ ID NO: 97897 - RNA, 64 nt, Human; identical to SEQ ID NO: 11853

SEQ ID NO: 97898 - RNA, 64 nt, Human; identical to SEQ ID NO: 11854

SEQ ID NO: 97899 - RNA, 64 nt, Human; identical to SEQ ID NO: 11855

SEQ ID NO: 97900 - RNA, 64 nt, Human; identical to SEQ ID NO: 11856

SEQ ID NO: 97901 - RNA, 64 nt, Human; identical to SEQ ID NO: 11857

SEQ ID NO: 97902 - RNA, 64 nt, Human; identical to SEQ ID NO: 11858

SEQ ID NO: 97903 - RNA, 64 nt, Human; identical to SEQ ID NO: 11859

SEQ ID NO: 97904 - RNA, 64 nt, Human; identical to SEQ ID NO: 11860

SEQ ID NO: 97905 - RNA, 64 nt, Human; identical to SEQ ID NO: 11861

SEQ ID NO: 97906 - RNA, 64 nt, Human; identical to SEQ ID NO: 11863

SEQ ID NO: 97907 - RNA, 64 nt, Human; identical to SEQ ID NO: 11864

SEQ ID NO: 97908 - RNA, 64 nt, Human; identical to SEQ ID NO: 11865

SEQ ID NO: 97909 - RNA, 64 nt, Human; identical to SEQ ID NO: 84670

SEQ ID NO: 97910 - RNA, 64 nt, Human; identical to SEQ ID NO: 11866

SEQ ID NO: 97911 - RNA, 64 nt, Human; identical to SEQ ID NO: 11867

SEQ ID NO: 97912 - RNA, 62 nt, Human; identical to SEQ ID NO: 11868

SEQ ID NO: 97913 - RNA, 64 nt, Human; identical to SEQ ID NO: 11869

SEQ ID NO: 97914 - RNA, 64 nt, Human; identical to SEQ ID NO: 11870

SEQ ID NO: 97915 - RNA, 64 nt, Human; identical to SEQ ID NO: 11871

SEQ ID NO: 97916 - RNA, 64 nt, Human; identical to SEQ ID NO: 11872

SEQ ID NO: 97917 - RNA, 64 nt, Human; identical to SEQ ID NO: 11873

SEQ ID NO: 97918 - RNA, 64 nt, Human; identical to SEQ ID NO: 11874

SEQ ID NO: 97919 - RNA, 64 nt, Human; identical to SEQ ID NO: 11875

SEQ ID NO: 97920 - RNA, 64 nt, Human; identical to SEQ ID NO: 11876

SEQ ID NO: 97921 - RNA, 64 nt, Human; identical to SEQ ID NO: 11877

SEQ ID NO: 97922 - RNA, 64 nt, Human; identical to SEQ ID NO: 11878

SEQ ID NO: 97923 - RNA, 64 nt, Human; identical to SEQ ID NO: 11879

SEQ ID NO: 97924 - RNA, 64 nt, Human; identical to SEQ ID NO: 11880

SEQ ID NO: 97925 - RNA, 64 nt, Human; identical to SEQ ID NO: 11882

SEQ ID NO: 97926 - RNA, 64 nt, Human; identical to SEQ ID NO: 11883

SEQ ID NO: 97927 - RNA, 64 nt, Human; identical to SEQ ID NO: 84544

SEQ ID NO: 97928 - RNA, 64 nt, Human; identical to SEQ ID NO: 11884

SEQ ID NO: 97929 - RNA, 64 nt, Human; identical to SEQ ID NO: 11885

SEQ ID NO: 97930 - RNA, 64 nt, Human; identical to SEQ ID NO: 11886

SEQ ID NO: 97931 - RNA, 64 nt, Human; identical to SEQ ID NO: 11887

SEQ ID NO: 97932 - RNA, 64 nt, Human; identical to SEQ ID NO: 11888

SEQ ID NO: 97933 - RNA, 64 nt, Human; identical to SEQ ID NO: 11889

SEQ ID NO: 97934 - RNA, 64 nt, Human; identical to SEQ ID NO: 11890

SEQ ID NO: 97935 - RNA, 64 nt, Human; identical to SEQ ID NO: 11891

SEQ ID NO: 97936 - RNA, 64 nt, Human; identical to SEQ ID NO: 11892

SEQ ID NO: 97937 - RNA, 64 nt, Human; identical to SEQ ID NO: 11893

SEQ ID NO: 97938 - RNA, 64 nt, Human; identical to SEQ ID NO: 11894

SEQ ID NO: 97939 - RNA, 64 nt, Human; identical to SEQ ID NO: 11895

SEQ ID NO: 97940 - RNA, 64 nt, Human; identical to SEQ ID NO: 11896

SEQ ID NO: 97941 - RNA, 64 nt, Human; identical to SEQ ID NO: 11897

SEQ ID NO: 97942 - RNA, 64 nt, Human; identical to SEQ ID NO: 11898

SEQ ID NO: 97943 - RNA, 64 nt, Human; identical to SEQ ID NO: 11899

SEQ ID NO: 97944 - RNA, 64 nt, Human; identical to SEQ ID NO: 11901

SEQ ID NO: 97945 - RNA, 64 nt, Human; identical to SEQ ID NO: 84478

SEQ ID NO: 97946 - RNA, 64 nt, Human; identical to SEQ ID NO: 11902

SEQ ID NO: 97947 - RNA, 64 nt, Human; identical to SEQ ID NO: 11903

SEQ ID NO: 97948 - RNA, 64 nt, Human; identical to SEQ ID NO: 11904

SEQ ID NO: 97949 - RNA, 64 nt, Human; identical to SEQ ID NO: 11905

SEQ ID NO: 97950 - RNA, 64 nt, Human; identical to SEQ ID NO: 11906

SEQ ID NO: 97951 - RNA, 64 nt, Human; identical to SEQ ID NO: 11907

SEQ ID NO: 97952 - RNA, 64 nt, Human; identical to SEQ ID NO: 11908

SEQ ID NO: 97953 - RNA, 64 nt, Human; identical to SEQ ID NO: 11909

SEQ ID NO: 97954 - RNA, 64 nt, Human; identical to SEQ ID NO: 11910

SEQ ID NO: 97955 - RNA, 64 nt, Human; identical to SEQ ID NO: 11911

SEQ ID NO: 97956 - RNA, 64 nt, Human; identical to SEQ ID NO: 11912

SEQ ID NO: 97957 - RNA, 64 nt, Human; identical to SEQ ID NO: 11913

SEQ ID NO: 97958 - RNA, 64 nt, Human; identical to SEQ ID NO: 11914

SEQ ID NO: 97959 - RNA, 64 nt, Human; identical to SEQ ID NO: 11915

SEQ ID NO: 97960 - RNA, 64 nt, Human; identical to SEQ ID NO: 11916

SEQ ID NO: 97961 - RNA, 64 nt, Human; identical to SEQ ID NO: 11917

SEQ ID NO: 97962 - RNA, 64 nt, Human; identical to SEQ ID NO: 11918

SEQ ID NO: 97963 - RNA, 64 nt, Human; identical to SEQ ID NO: 84594

SEQ ID NO: 97964 - RNA, 64 nt, Human; identical to SEQ ID NO: 11920

SEQ ID NO: 97965 - RNA, 64 nt, Human; identical to SEQ ID NO: 11921

SEQ ID NO: 97966 - RNA, 64 nt, Human; identical to SEQ ID NO: 11922

SEQ ID NO: 97967 - RNA, 64 nt, Human; identical to SEQ ID NO: 11923

SEQ ID NO: 97968 - RNA, 64 nt, Human; identical to SEQ ID NO: 11924

SEQ ID NO: 97969 - RNA, 64 nt, Human; identical to SEQ ID NO: 11925

SEQ ID NO: 97970 - RNA, 64 nt, Human; identical to SEQ ID NO: 11926

SEQ ID NO: 97971 - RNA, 64 nt, Human; identical to SEQ ID NO: 11927

SEQ ID NO: 97972 - RNA, 64 nt, Human; identical to SEQ ID NO: 11928

SEQ ID NO: 97973 - RNA, 64 nt, Human; identical to SEQ ID NO: 11929

SEQ ID NO: 97974 - RNA, 64 nt, Human; identical to SEQ ID NO: 11930

SEQ ID NO: 97975 - RNA, 64 nt, Human; identical to SEQ ID NO: 11931

SEQ ID NO: 97976 - RNA, 64 nt, Human; identical to SEQ ID NO: 11932

SEQ ID NO: 97977 - RNA, 64 nt, Human; identical to SEQ ID NO: 11933

SEQ ID NO: 97978 - RNA, 64 nt, Human; identical to SEQ ID NO: 11934

SEQ ID NO: 97979 - RNA, 64 nt, Human; identical to SEQ ID NO: 11935

SEQ ID NO: 97980 - RNA, 64 nt, Human; identical to SEQ ID NO: 11936

SEQ ID NO: 97981 - RNA, 64 nt, Human; identical to SEQ ID NO: 84484

SEQ ID NO: 97982 - RNA, 64 nt, Human; identical to SEQ ID NO: 11937

SEQ ID NO: 97983 - RNA, 64 nt, Human; identical to SEQ ID NO: 11939

SEQ ID NO: 97984 - RNA, 64 nt, Human; identical to SEQ ID NO: 11940

SEQ ID NO: 97985 - RNA, 64 nt, Human; identical to SEQ ID NO: 11941

SEQ ID NO: 97986 - RNA, 64 nt, Human; identical to SEQ ID NO: 11942

SEQ ID NO: 97987 - RNA, 64 nt, Human; identical to SEQ ID NO: 11943

SEQ ID NO: 97988 - RNA, 64 nt, Human; identical to SEQ ID NO: 11944

SEQ ID NO: 97989 - RNA, 64 nt, Human; identical to SEQ ID NO: 11945

SEQ ID NO: 97990 - RNA, 64 nt, Human; identical to SEQ ID NO: 11946

SEQ ID NO: 97991 - RNA, 64 nt, Human; identical to SEQ ID NO: 11947

SEQ ID NO: 97992 - RNA, 64 nt, Human; identical to SEQ ID NO: 11948

SEQ ID NO: 97993 - RNA, 64 nt, Human; identical to SEQ ID NO: 11949

SEQ ID NO: 97994 - RNA, 64 nt, Human; identical to SEQ ID NO: 11950

SEQ ID NO: 97995 - RNA, 64 nt, Human; identical to SEQ ID NO: 11951

SEQ ID NO: 97996 - RNA, 64 nt, Human; identical to SEQ ID NO: 11952

SEQ ID NO: 97997 - RNA, 64 nt, Human; identical to SEQ ID NO: 11953

SEQ ID NO: 97998 - RNA, 64 nt, Human; identical to SEQ ID NO: 11954

SEQ ID NO: 97999 - RNA, 64 nt, Human; identical to SEQ ID NO: 84548

SEQ ID NO: 98000 - RNA, 64 nt, Human; identical to SEQ ID NO: 11955

SEQ ID NO: 98001 - RNA, 64 nt, Human; identical to SEQ ID NO: 11956

SEQ ID NO: 98002 - RNA, 64 nt, Human; identical to SEQ ID NO: 11957

SEQ ID NO: 98003 - RNA, 64 nt, Human; identical to SEQ ID NO: 11958

SEQ ID NO: 98004 - RNA, 64 nt, Human; identical to SEQ ID NO: 11959

SEQ ID NO: 98005 - RNA, 64 nt, Human; identical to SEQ ID NO: 11960

SEQ ID NO: 98006 - RNA, 64 nt, Human; identical to SEQ ID NO: 11961

SEQ ID NO: 98007 - RNA, 64 nt, Human; identical to SEQ ID NO: 11962

SEQ ID NO: 98008 - RNA, 64 nt, Human; identical to SEQ ID NO: 11963

SEQ ID NO: 98009 - RNA, 64 nt, Human; identical to SEQ ID NO: 11964

SEQ ID NO: 98010 - RNA, 64 nt, Human; identical to SEQ ID NO: 11965

SEQ ID NO: 98011 - RNA, 64 nt, Human; identical to SEQ ID NO: 11966

SEQ ID NO: 98012 - RNA, 64 nt, Human; identical to SEQ ID NO: 11967

SEQ ID NO: 98013 - RNA, 64 nt, Human; identical to SEQ ID NO: 11968

SEQ ID NO: 98014 - RNA, 64 nt, Human; identical to SEQ ID NO: 11969

SEQ ID NO: 98015 - RNA, 64 nt, Human; identical to SEQ ID NO: 11970

SEQ ID NO: 98016 - RNA, 64 nt, Human; identical to SEQ ID NO: 11971

SEQ ID NO: 98017 - RNA, 64 nt, Human; identical to SEQ ID NO: 84490

SEQ ID NO: 98018 - RNA, 64 nt, Human; identical to SEQ ID NO: 11972

SEQ ID NO: 98019 - RNA, 64 nt, Human; identical to SEQ ID NO: 11973

SEQ ID NO: 98020 - RNA, 64 nt, Human; identical to SEQ ID NO: 11974

SEQ ID NO: 98021 - RNA, 64 nt, Human; identical to SEQ ID NO: 11975

SEQ ID NO: 98022 - RNA, 64 nt, Human; identical to SEQ ID NO: 11977

SEQ ID NO: 98023 - RNA, 64 nt, Human; identical to SEQ ID NO: 11978

SEQ ID NO: 98024 - RNA, 64 nt, Human; identical to SEQ ID NO: 11979

SEQ ID NO: 98025 - RNA, 64 nt, Human; identical to SEQ ID NO: 11980

SEQ ID NO: 98026 - RNA, 64 nt, Human; identical to SEQ ID NO: 11981

SEQ ID NO: 98027 - RNA, 64 nt, Human; identical to SEQ ID NO: 11982

SEQ ID NO: 98028 - RNA, 64 nt, Human; identical to SEQ ID NO: 11983

SEQ ID NO: 98029 - RNA, 64 nt, Human; identical to SEQ ID NO: 11984

SEQ ID NO: 98030 - RNA, 64 nt, Human; identical to SEQ ID NO: 11985

SEQ ID NO: 98031 - RNA, 64 nt, Human; identical to SEQ ID NO: 11986

SEQ ID NO: 98032 - RNA, 64 nt, Human; identical to SEQ ID NO: 11987

SEQ ID NO: 98033 - RNA, 64 nt, Human; identical to SEQ ID NO: 11988

SEQ ID NO: 98034 - RNA, 64 nt, Human; identical to SEQ ID NO: 11989

SEQ ID NO: 98035 - RNA, 64 nt, Human
guucuaacgaagcaugcgugucucuucaucuacaggaugcaauaggcugauuguauuuaaaaau

SEQ ID NO: 98036 - RNA, 64 nt, Human; identical to SEQ ID NO: 11990

SEQ ID NO: 98037 - RNA, 64 nt, Human; identical to SEQ ID NO: 11991

SEQ ID NO: 98038 - RNA, 64 nt, Human; identical to SEQ ID NO: 11992

SEQ ID NO: 98039 - RNA, 64 nt, Human; identical to SEQ ID NO: 11993

SEQ ID NO: 98040 - RNA, 64 nt, Human; identical to SEQ ID NO: 11994

SEQ ID NO: 98041 - RNA, 64 nt, Human; identical to SEQ ID NO: 11995

SEQ ID NO: 98042 - RNA, 64 nt, Human; identical to SEQ ID NO: 11996

SEQ ID NO: 98043 - RNA, 64 nt, Human; identical to SEQ ID NO: 11997

SEQ ID NO: 98044 - RNA, 64 nt, Human; identical to SEQ ID NO: 11998

SEQ ID NO: 98045 - RNA, 64 nt, Human; identical to SEQ ID NO: 11999

SEQ ID NO: 98046 - RNA, 64 nt, Human; identical to SEQ ID NO: 12000

SEQ ID NO: 98047 - RNA, 64 nt, Human; identical to SEQ ID NO: 12001

SEQ ID NO: 98048 - RNA, 64 nt, Human; identical to SEQ ID NO: 12002

SEQ ID NO: 98049 - RNA, 64 nt, Human; identical to SEQ ID NO: 12003

SEQ ID NO: 98050 - RNA, 64 nt, Human; identical to SEQ ID NO: 12004

SEQ ID NO: 98051 - RNA, 64 nt, Human; identical to SEQ ID NO: 12005

SEQ ID NO: 98052 - RNA, 64 nt, Human; identical to SEQ ID NO: 12006

SEQ ID NO: 98053 - RNA, 64 nt, Human; identical to SEQ ID NO: 84636

SEQ ID NO: 98054 - RNA, 64 nt, Human; identical to SEQ ID NO: 12007

SEQ ID NO: 98055 - RNA, 54 nt, Human; identical to SEQ ID NO: 12008

SEQ ID NO: 98056 - RNA, 64 nt, Human; identical to SEQ ID NO: 12009

SEQ ID NO: 98057 - RNA, 64 nt, Human; identical to SEQ ID NO: 12010

SEQ ID NO: 98058 - RNA, 64 nt, Human; identical to SEQ ID NO: 12011

SEQ ID NO: 98059 - RNA, 64 nt, Human; identical to SEQ ID NO: 12012

SEQ ID NO: 98060 - RNA, 64 nt, Human; identical to SEQ ID NO: 12013

SEQ ID NO: 98061 - RNA, 64 nt, Human; identical to SEQ ID NO: 12014

SEQ ID NO: 98062 - RNA, 64 nt, Human; identical to SEQ ID NO: 12015

SEQ ID NO: 98063 - RNA, 64 nt, Human; identical to SEQ ID NO: 12016

SEQ ID NO: 98064 - RNA, 62 nt, Human
gcauccuucggaccucaccacgcgaaacuacgcccgccgacagaaacaucugcaaagauaca

SEQ ID NO: 98065 - RNA, 62 nt, Human
gccaguagccaggcaagucauagaauugauuacccgccgaauucauuaauuuacuguagugu

SEQ ID NO: 98066 - RNA, 62 nt, Human
cccaagcagcaagauaaacccgcuccacccgacccgccgaccuucagcuuugugggacuauc

SEQ ID NO: 98067 - RNA, 62 nt, Human
cgacaggcggcagcacagcaccugcacgaacacccgccgaaacugcugcgaggacaccgugu

SEQ ID NO: 98068 - RNA, 62 nt, Human
uuuuuaacuuauugacaaccgagaagguuuaucccgccgauagagggacggccaagaaugua

SEQ ID NO: 98069 - RNA, 62 nt, Human
cugcgcugucccggccgcaagagcggggccgccccgccgagguuuguagcagccgggaugug

SEQ ID NO: 98070 - RNA, 62 nt, Human
cagacggugucugaccggaggauguggccgugcccgccgagcacucuugaucugagcugacc

SEQ ID NO: 98071 - RNA, 62 nt, Human
ggcaccagggcccgggguucggggauagaagccccgccgagaccccacagggaccucaguca

SEQ ID NO: 98072 - RNA, 62 nt, Human
agugcugagauuacaggugugagcuaccgcaccccgccgagguuagcacuuucaucaccaaa

SEQ ID NO: 98073 - RNA, 62 nt, Human
cgcaagacagcccaacagcuguuccuccccuccccgccgacuccaacucuucggaaucugcc

SEQ ID NO: 98074 - RNA, 62 nt, Human
cugccaccgccacacuagugcugaacguggugcccgccgaccugcggcccccgugguuccug

SEQ ID NO: 98075 - RNA, 62 nt, Human
guggugggacccagguaacccccucucccacccccgccgacuucuccccuuuccccagccuc

SEQ ID NO: 98076 - RNA, 62 nt, Human
agcugcacuacagcccuggccuccacccccaccccgccgaccauccaagggagagugagacc

SEQ ID NO: 98077 - RNA, 62 nt, Human
agacuaacuccugcaacuggaaagcgggggcgcccgccgacgaggaggccaccgugccaagc

SEQ ID NO: 98078 - RNA, 62 nt, Human
ggccaaggcgccuggaccuggcgaggacgcugcccgccgagcggacugauucgcagagucug

SEQ ID NO: 98079 - RNA, 62 nt, Human
agagacgaagccuuucuguaacaugcggccgucccgccgagaggggcaguuuugcucuuuug

SEQ ID NO: 98080 - RNA, 62 nt, Human
cgcgcgucaggcgaaccagcguccggcagcgucccgccgaaugacguugcgguggcacuggc

SEQ ID NO: 98081 - RNA, 62 nt, Human
cgaauccccgugugacccugucccagcauuuucccgccgacccugcguguccccguggcgcu

SEQ ID NO: 98082 - RNA, 62 nt, Human
uuccaaagcaggcccugcuccccgggcagccucccgccgaggggcccagcccccaacccaca

SEQ ID NO: 98083 - RNA, 62 nt, Human
uaaauccaccagagggccgguuagaugcuggccccgccgagagaacugcugucacuuucagg

SEQ ID NO: 98084 - RNA, 62 nt, Human
agccggugcgcaaguucacgggcaaggcgguccccgccgacguccuggaggcgcuaugcaag

SEQ ID NO: 98085 - RNA, 62 nt, Human
gggucuuggaggcagggcugucccacagggcgcccgccgaccugcaccugucugugaaguau

SEQ ID NO: 98086 - RNA, 62 nt, Human
uuuuuuuuuucaguuuuuguuuuuacuuuugucccgccgaguacuauguauuaccagccccc

SEQ ID NO: 98087 - RNA, 62 nt, Human
gguggggagggggcccacaagcacgcccagcccccgccgaauucuuuuagcuucguaauugg

SEQ ID NO: 98088 - RNA, 62 nt, Human
guccugcggccgcccaggugucaggagagguccccgccgagugcuucagcugcccuaagcug

SEQ ID NO: 98089 - RNA, 62 nt, Human
ugaccagagaucuugcagccccuguggaugcccccgccgaggucccccgauccccgcacccg

SEQ ID NO: 98090 - RNA, 62 nt, Human
cuagacucagaggcgccgcggggagggguggccccgccgaggcuucaggggcccccucccca

SEQ ID NO: 98091 - RNA, 62 nt, Human
gagccaccugggccccgggugcagccggagaccccgccgagccccuccucccaguauuccca

SEQ ID NO: 98092 - RNA, 62 nt, Human
uucugcggggcaucaggcugcugggguagccgcccgccgagccuggaagcugcucguucucc

SEQ ID NO: 98093 - RNA, 62 nt, Human
acaaccugucaggcugcaccaccucauccuggcccgccgaaccuugaccucaccccugcccc

SEQ ID NO: 98094 - RNA, 62 nt, Human
aaaauguauuuauuaaaaaaaaauuuuuuuaacccgccgaauaauucccauaagaguaacaa

SEQ ID NO: 98095 - RNA, 62 nt, Human
cgcagucugugggagcccggccgcgcccagcccccgccgaccguggcguuggcccugcuguc

SEQ ID NO: 98096 - RNA, 62 nt, Human
cgaggccugaccccauccccauccucgcugggcccgccgaccccgguguuagcaagaauccu

SEQ ID NO: 98097 - RNA, 62 nt, Human
cccacgccgggcgggaccggccagggaucacccccgccgacggccccgggccccgacggccc

SEQ ID NO: 98098 - RNA, 62 nt, Human
ugccagaucuaugugucugucuguguguccaucccgccgaccccccagacuaaccuccaggc

SEQ ID NO: 98099 - RNA, 62 nt, Human
aauacugugugaauauuuucauuagauuaauucacuaagauuuuauuagagauuguuugaau

SEQ ID NO: 98100 - RNA, 62 nt, Human
aucucugccuucuuaccuuaaauuaaaaagagcacuaagauaacaccuucaagagacuugaa

SEQ ID NO: 98101 - RNA, 62 nt, Human
ugagaaaaccuguguggacaucccuugguguacacuaagacagagcagagcccagcgcuccc

SEQ ID NO: 98102 - RNA, 62 nt, Human
guaaacaggguaccucaagccccauuuccucacacuaagagggcagacugugaacuugacug

SEQ ID NO: 98103 - RNA, 62 nt, Human
cauccugcauugucuuuacccaccaucaucuucacuaagagaaacaugccuacccaugaagg

SEQ ID NO: 98104 - RNA, 62 nt, Human
agccucagcuuucacacuucagcccuuaaguucacuaagaaggucugaguuucugcugcaga

SEQ ID NO: 98105 - RNA, 62 nt, Human
aauucauuaauuuacuguaguguuaagagaagcacuaagaaugccagugaccuguguaaaag

SEQ ID NO: 98106 - RNA, 62 nt, Human
ccuauuaucaaauucaaucugaugucaaauagcacuaagaaguuauugugccuuaugaaaaa

SEQ ID NO: 98107 - RNA, 62 nt, Human
uugacaauacaacauagcauaugucuucaucucacuaagaaaagagcaguuguaacucaaug

SEQ ID NO: 98108 - RNA, 62 nt, Human
uuuauuuuguuggguuuuaaaauugcacagaacacuaagaccgaaaggcuggacucuuguuu

SEQ ID NO: 98109 - RNA, 62 nt, Human
uugggguuuacggaaauuaacuauuauguuugcacuaagauuugcugggagugguaggugga

SEQ ID NO: 98110 - RNA, 62 nt, Human
acugcaagccccagaagcauauggcauguguucacuaagaggccuuuaauccuggggaguaa

SEQ ID NO: 98111 - RNA, 62 nt, Human
auuucuguuguccuacauauuuuaguauaaaucacuaagacauauuuccuuucacuuggcag

SEQ ID NO: 98112 - RNA, 62 nt, Human
uggagcacccgcacacuacuccaaaucaaaaccacuaagaguuccucccgcgcagacugcug

SEQ ID NO: 98113 - RNA, 62 nt, Human
agugagagaaguugaucaccccaggaauuagucacuaagaauuccuaagaacuuucuaucaa

SEQ ID NO: 98114 - RNA, 62 nt, Human
aauauuuaaggucugugacuauaguuaaacuucacuaagaauuugcagaauuguuuugagau

SEQ ID NO: 98115 - RNA, 62 nt, Human
aucuagucuaugaugguugcgccaucugugcacacuaagaaaugggacucugaacuggagcu

SEQ ID NO: 98116 - RNA, 62 nt, Human
uuuacaaaucaggauuauauacauaagaauuccacuaagaaaugccaagauucuuaaauuug

SEQ ID NO: 98117 - RNA, 62 nt, Human
cauggggaaacagaugccucagccuacuuucacacuaagaaaaaaacuugucuucccuucug

SEQ ID NO: 98118 - RNA, 62 nt, Human
agaauuuagaauguauuugaugauagcauucucacuaagacacaugagaauuuaacuuuaua

SEQ ID NO: 98119 - RNA, 62 nt, Human
auauguucuuuauauuuuaaugugaguauauacacuaagaacaaacuaaauugugauuuaug

SEQ ID NO: 98120 - RNA, 62 nt, Human
uuucugugaaacuucauauugcugaagacauacacuaagaauuuauguagauaauguacuuu

SEQ ID NO: 98121 - RNA, 62 nt, Human
gcgauaauaauaaacaucugcguuugucucuucacuaagaguaaacugggaaauuguaggcc

SEQ ID NO: 98122 - RNA, 62 nt, Human
uguucaauuugacuaaguuuuugguaaucuugcacuaagacaucaacaaaaugcccuggcag

SEQ ID NO: 98123 - RNA, 62 nt, Human
cucuuguccugugaucuguguacaauuuuagucacuaagacuuuccuccaagaacuaagcca

SEQ ID NO: 98124 - RNA, 62 nt, Human
ucacacauuuacaaauuuuucaagagguuagccacuaagacuuuaauaauuuuacaagggaa

SEQ ID NO: 98125 - RNA, 62 nt, Human
acagucagcccaggagguuacagugagcucuccacuaagaaucuggaagaaaugcaucacua

SEQ ID NO: 98126 - RNA, 62 nt, Human
ccacugggcuaaguuucauaucuaaagcuugucacuaagaauuuucauuuuuaggggucaaa

SEQ ID NO: 98127 - RNA, 62 nt, Human
gcacaaagaagaaggcagugcuguuacuuggccacuaagauguguaaaauggacugaaaugc

SEQ ID NO: 98128 - RNA, 62 nt, Human
uguuuguuuccaauugagucauuacugccugccacuaagaaacgugcuugaaucuaauaagu

SEQ ID NO: 98129 - RNA, 62 nt, Human
ggcaggcagacagaaauaaugauguuuucuugcacuaagaagguacuacuuguacacauaua

SEQ ID NO: 98130 - RNA, 62 nt, Human
agcaaagguagucauuagggagcaggcacuaccacuaagauaucccagaagaagaggcaagg

SEQ ID NO: 98131 - RNA, 62 nt, Human
gggucugcaacauaaagccuuaaaaagacacacacuaagaaaacuguaaaaccuugaacauu

SEQ ID NO: 98132 - RNA, 62 nt, Human
uuaagagaaagauucccugaugcugauauuuccacuaagaacaccugcauucuucccuuauc

SEQ ID NO: 98133 - RNA, 62 nt, Human
cuaaagacaguggcugcagcaguccaggugcacacuaagaacagccuggucuucaucaccca

SEQ ID NO: 98134 - RNA, 62 nt, Human
gccagauaauccacaugcucccuccccagcuccacuaagauuuucacuuuagccauauucug

SEQ ID NO: 98135 - RNA, 62 nt, Human
gaaguauuacuguagaucaaguuugucuuccgcacuaagaugugaggaaauugugauuuguu

SEQ ID NO: 98136 - RNA, 62 nt, Human
gggaccaagcagcucacuacgauaucaaguuacacuaagacuuggaacacuaacauucugua

SEQ ID NO: 98137 - RNA, 62 nt, Human
ugggaaaaugcaauuaauauggaggugauagucacuaagaacuguugaauggcagaaaagua

SEQ ID NO: 98138 - RNA, 62 nt, Human
ggagagugcauuugccauaccugugugcaugacacuaagauuuuauguuggagauacuucuu

SEQ ID NO: 98139 - RNA, 62 nt, Human
uauauuuuaauuaaaugaaucuguauuuguagcacuaagagaauuauuauuaaggauugacu

SEQ ID NO: 98140 - RNA, 62 nt, Human
ugacuuccuaagcuacuuaagacaacuugcaccacuaagaaaaaaauguagaaccauuugga

SEQ ID NO: 98141 - RNA, 62 nt, Human
gacuugcacuucuuaaagagauugcuuuauaacacuaagacauccuuucuaaagauucaagu

SEQ ID NO: 98142 - RNA, 62 nt, Human
aacaaccauacuuuuauccucauuuuuauucucacuaagaaaaaagucaacuccccuccccu

SEQ ID NO: 98143 - RNA, 62 nt, Human
uggaguugcucugugaggauguucaugguagacacuaagagggcugggugggagaugcuugg

SEQ ID NO: 98144 - RNA, 62 nt, Human
acuggugacauuuaaagaauuacaaggauaaacacuaagaauguugcaguuaccaucuuaua

SEQ ID NO: 98145 - RNA, 62 nt, Human
uugacuuuaaggguccuaguaagugccacuuccacuaagaauacaguuugaauguauaauca

SEQ ID NO: 98146 - RNA, 62 nt, Human
aaagcauaacaccaaucccagggcuggcucugcacuaagagaaaauugcacuaaaugaaucu

SEQ ID NO: 98147 - RNA, 62 nt, Human
aggaaaacugccauaacauaccaccuagucgacacuaagaaugaggaauaguuuucuccucg

SEQ ID NO: 98148 - RNA, 62 nt, Human
guauaacaagcauagacaaaugagugucccugcacuaagaagaaucacuuuaaaaagcaaag

SEQ ID NO: 98149 - RNA, 62 nt, Human
agaugaugccccccaaaacccugauuuccacacacuaagacuaaauuauguaucaaggccau

SEQ ID NO: 98150 - RNA, 62 nt, Human
auguguggccugcacagugaagugcuggcaaccacuaagaauucaaacuggggccuccagaa

SEQ ID NO: 98151 - RNA, 62 nt, Human
uucaugccucccuguggcuaguacaggcugagcacuaagaugcuuagugcucagacaaccug

SEQ ID NO: 98152 - RNA, 62 nt, Human
ucaaugcccaacagggcaaccaauaaaagugucacuaagaauauaaauauuuggaaucagca

SEQ ID NO: 98153 - RNA, 62 nt, Human
ucuuuuuaaaaacugcugugguuuugcugcuacacuaagaauugugauuugcauuguacggu

SEQ ID NO: 98154 - RNA, 62 nt, Human
ugaauggagauacuugcagagcuugucaugcacacuaagaguuuaaaaugugagcucauuau

SEQ ID NO: 98155 - RNA, 62 nt, Human
ucuuuuggagugaccagcaacuuugauguuugcacuaagauuuuauuuggaaugcaagagag

SEQ ID NO: 98156 - RNA, 62 nt, Human
aaagauuugaaaaucuuuaaugaacuggagaacacuaagauuuaaacucgaaaauucguugu

SEQ ID NO: 98157 - RNA, 62 nt, Human
gaguauugaauugacuggauccacuaaaccaacacuaagaugggaaaacacacaugguuugg

SEQ ID NO: 98158 - RNA, 62 nt, Human
ucccacucuggggguuucuaucacugugacaacacuaagauaauaaaccaaaacacuaccug

SEQ ID NO: 98159 - RNA, 62 nt, Human
aguuucacuggcucuauaacagucuaccucuacacuaagagaacuauaacaugaacaacaua

SEQ ID NO: 98160 - RNA, 62 nt, Human
ggagcuagggauugagggguuaagggaccucacacuaagaaggggcugugcuuugauccccu

SEQ ID NO: 98161 - RNA, 62 nt, Human
ugcuucugugaguucucagccuaggcuguggccacuaagacguggguggggggauagacagg

SEQ ID NO: 98162 - RNA, 62 nt, Human
aguaaaaaacucuugauguagucauauaaccacacuaagaacucuuccaggugacuucaaaa

SEQ ID NO: 98163 - RNA, 62 nt, Human
gaggcuacuacaaaaagcaaccuuuucauuuucacuaagaguuuaaaagcuauuguauuauu

SEQ ID NO: 98164 - RNA, 62 nt, Human
acaugggaauaaggaauuucauucacuucagccacuaagaaaaguuuagaaucacgaaagcu

SEQ ID NO: 98165 - RNA, 62 nt, Human
uucuuuuuucuauuaagccauugaaagagaagcacuaagacugcuucuaggcuuuauuuaua

SEQ ID NO: 98166 - RNA, 62 nt, Human
ucaggcuagauguauguacuucaugcugucuacacuaagagagaaugagagacacacugaag

SEQ ID NO: 98167 - RNA, 62 nt, Human
uccuuaauagcccauuucuguuaaccucuuaucacuaagaaagaaaggaaagaaggagauga

SEQ ID NO: 98168 - RNA, 62 nt, Human
uuuaaaucuuaccuuugauuguugaaaaaagucacuaagaugugaauacagaauagacauug

SEQ ID NO: 98169 - RNA, 62 nt, Human
ggagugagugugaagauggugguuagcaguuucacuaagacugauauuuuaggccucuuguu

SEQ ID NO: 98170 - RNA, 62 nt, Human
gcaucaaacuuggaacaucaaggcauccaaaacacuaagaauucuaucaucacaaaaauaau

SEQ ID NO: 98171 - RNA, 62 nt, Human
ugcaaaugaauaccuucaacuaggauuuagaccacuaagaacuugcacagaaaaacacgcau

SEQ ID NO: 98172 - RNA, 62 nt, Human
caagcuuuugcuugauccagaagagcccauaucacuaagauggcauauaugugaucugggca

SEQ ID NO: 98173 - RNA, 62 nt, Human
aaugauaauuauuacuuuuauauuucaaaguacacuaagaucguugaagagcaauagaaccu

SEQ ID NO: 98174 - RNA, 53 nt, Human
uccuaccuccaauugauugacgucacuaagaggccuuguguagaaguacacca

SEQ ID NO: 98175 - RNA, 62 nt, Human
cagaaacaguuccugguuccucuuguguuugacacuaagaaaauagcaagagugugaaaucu

SEQ ID NO: 98176 - RNA, 62 nt, Human
aaagugccuaagacaguaccuggcuucagagucacuaagaaauugcuaaaagcucugcuucg

SEQ ID NO: 98177 - RNA, 62 nt, Human
caaauucucaagguuguugauggggaacuugccacuaagagaaggcagagaggucccuagug

SEQ ID NO: 98178 - RNA, 62 nt, Human
auuuauuacuaugucuuauuuaucagacccugcacuaagauuaaaaguugugcaugggcuua

SEQ ID NO: 98179 - RNA, 62 nt, Human
ucaaauuaaauccuugcaggaagagaaauuaacacuaagaaaaagucaucaauauuuuucaa

SEQ ID NO: 98180 - RNA, 62 nt, Human
gaagacaucuauuggccaucucuggccaauuacacuaagaaacauaucaaggugcuuuuggc

SEQ ID NO: 98181 - RNA, 62 nt, Human
gcaaggaagugggguguucuucuugggacccccacuaagacccuggucugaggauguagaga

SEQ ID NO: 98182 - RNA, 62 nt, Human
guuuccgaugagguguacggaugagugaccugcacuaagaagugaguugccacagugaaaau

SEQ ID NO: 98183 - RNA, 62 nt, Human
uauugugagacacaaauucacugcugccuuuacacuaagaaauguauauguuaaccauauau

SEQ ID NO: 98184 - RNA, 62 nt, Human
caaugacaaugacaucuuccccuuaccuuagccacuaagaagacaagggcuguuacucauau

SEQ ID NO: 98185 - RNA, 62 nt, Human
caaagugaggaacagagauagcuuaaauaauacacuaagauugauuuuaugcucccagaaua

SEQ ID NO: 98186 - RNA, 62 nt, Human
gcguaaugagacucaccuuuucucgcugaaagcacuaagaggugggaggaggccugcacagg

SEQ ID NO: 98187 - RNA, 62 nt, Human
gauaugauauuacuguauuuauuuuaagaaagcacuaagauguaauaaagugaugaacuaau

SEQ ID NO: 98188 - RNA, 62 nt, Human
cauuuuuguaaacgagaccaccaggccuucuucacuaagacuuuguauucaacuuaguuuaa

SEQ ID NO: 98189 - RNA, 62 nt, Human
auuuaguugauauaauccuaccagaaggaaagcacuaagaaacacucguuuguuguuuuuaa

SEQ ID NO: 98190 - RNA, 62 nt, Human
agaaaaccaaagagcucaucuuagcuuacaaacacuaagaauauauacaggauauagagaua

SEQ ID NO: 98191 - RNA, 62 nt, Human
agaagaaaacauuugaauuuaccuucauaugccacuaagaacaaaagcucugaaguucuucc

SEQ ID NO: 98192 - RNA, 62 nt, Human
guaagcaucuuacaacuggcucuuccuccccucacuaagaagacccaaaccucugcauaaug

SEQ ID NO: 98193 - RNA, 62 nt, Human
cucuucacugccccucucccucaagccuaagacacuaagaccccagacccaaagccaagucc

SEQ ID NO: 98194 - RNA, 62 nt, Human
uaaguuuauauaauguaauauuauguaccuaccacuaagaaauacaugaaccgugccaugag

SEQ ID NO: 98195 - RNA, 62 nt, Human
cccacaaggccaggccaauguugcucagugaucacuaagaaccagcuucucaaccaccauug

SEQ ID NO: 98196 - RNA, 62 nt, Human
aguuuucucuucaucacuacuaacaaacaaaacacuaagaaggcuuaguaucgcucuuuuuc

SEQ ID NO: 98197 - RNA, 62 nt, Human
uucacucaggaaagggaacuaaaaccagaauacacuaagaaguuucuaguuugugugccaaa

SEQ ID NO: 98198 - RNA, 62 nt, Human
gcacagaccaguuucagagaaauacuuucaggcacuaagacuaaucgaaugaacaaagucca

SEQ ID NO: 98199 - RNA, 62 nt, Human
cccacaaggccaggccgacguuucugagugaucacuaagaaccagcuucucaaccaccauca

SEQ ID NO: 98200 - RNA, 62 nt, Human
cccacaaggccaggccgacauuccugagugaucacuaagaaccaguuucucaaccaccacug

SEQ ID NO: 98201 - RNA, 62 nt, Human
gcuaucuguuuuaccaucaguuuguacaaggacacuaagacaguguagccugcugacuugag

SEQ ID NO: 98202 - RNA, 62 nt, Human
agcucuuuuuuagcucucuuaaaugaagugcccacuaagaaguuccacuuaacacaugaauu

SEQ ID NO: 98203 - RNA, 62 nt, Human
ccuauuuauuugguguuuuggaggagaucacacacuaagagaacguugauugccucggcuau

SEQ ID NO: 98204 - RNA, 62 nt, Human
gggagaauugagugaauuaaugugugugaggacacuaagauucccauauagaaauaggcuca

SEQ ID NO: 98205 - RNA, 62 nt, Human
agauguuauuuuugaggaguuccugguccuuucacuaagaauuuccacaucuuuuauggugg

SEQ ID NO: 98206 - RNA, 62 nt, Human
gcgguuuuguugucguuuguugcugcuuauuucacuaagaaaacccaacaacugagacugcc

SEQ ID NO: 98207 - RNA, 62 nt, Human
ucuccacgucccagaacuggcccagcugcaggcacuaagaagcuccuccccugagacaagug

SEQ ID NO: 98208 - RNA, 62 nt, Human
cuggaauuaccggguuaaaaggaaaugcuuaccacuaagaugucaguauucuccucauggau

SEQ ID NO: 98209 - RNA, 62 nt, Human
uacuggcaaugcauuggaaaacagacagcucccacuaagaucacguucugguauuucugagg

SEQ ID NO: 98210 - RNA, 62 nt, Human
aaacaaaaaacaacugaccaguuguugauaaccacuaagagucucuauuaaaauuacugaug

SEQ ID NO: 98211 - RNA, 62 nt, Human
aauucugaugacaucuuuacggacacuauuaucacuaagaccuuguuauggcgaagucuuua

SEQ ID NO: 98212 - RNA, 62 nt, Human
acuuuaaauuaugccguuacuuuucauauuugcacuaagauauuuccaggcugcauuuguau

SEQ ID NO: 98213 - RNA, 62 nt, Human
aaggguauucuaggucaaagcuguuuuuauaacacuaagacaucauuucacuauuuauagcu

SEQ ID NO: 98214 - RNA, 62 nt, Human
cugacacugcugguauacacagggccaaaacccacuaagauuguccguuuauguuuauuuaa

SEQ ID NO: 98215 - RNA, 62 nt, Human
uuguccuugucuagguugagaacuuuuacacacacuaagauaaagauagaaaucugacaugc

SEQ ID NO: 98216 - RNA, 62 nt, Human
cagcaggguucuuuguaaauaguauuuugagacacuaagauguuucuacugcuacggaaugu

SEQ ID NO: 98217 - RNA, 62 nt, Human
ccaaaugucaucagguuuuguuuuuuuucagccacuaagaaccccucugcuuuuaacucuag

SEQ ID NO: 98218 - RNA, 62 nt, Human
auuacccagcugaauaguuacugcugcacuuucacuaagauguauuugaacacuuggugagu

SEQ ID NO: 98219 - RNA, 62 nt, Human
aauaauuucguaagcauauacaauccacuucccacuaagaauuagggucaaagacauucuau

SEQ ID NO: 98220 - RNA, 62 nt, Human
ggaaucaaguuugccuuugagauaauacguuacacuaagaaaaggaaaauguggauaguaaa

SEQ ID NO: 98221 - RNA, 62 nt, Human
cagugauucagagaacagugugaccaaaaacccacuaagaaaaacagauucuugugacagug

SEQ ID NO: 98222 - RNA, 62 nt, Human
uucaucuaccaauccaugugcauuggauugcacacuaagauguauuuucuuacgaaauaguu

SEQ ID NO: 98223 - RNA, 62 nt, Human
aucaaccacagacaauuuaaauuuuauagaugcacuaagaauucacugcagcagcagguuac

SEQ ID NO: 98224 - RNA, 62 nt, Human
aaauaaugcaacgcaggaggagaaaagaaaugcacuaagacaagaacauucucucauagaac

SEQ ID NO: 98225 - RNA, 62 nt, Human
uuuagauaugccaaaagaauuaaaaucaaaagcacuaagaaauacauaguugugugauggcu

SEQ ID NO: 98226 - RNA, 62 nt, Human
aaagugcauuugggagagugaaugugugagaacacuaagaccacucugaacgaugauaauga

SEQ ID NO: 98227 - RNA, 62 nt, Human
gagggggagcccagguaugagaaagaaaaaaccacuaagaaaauaccucccugggaggauga

SEQ ID NO: 98228 - RNA, 62 nt, Human
ugggggcaggcucagcaucugcccacuggucucacuaagagcuuucagauuucccuccauag

SEQ ID NO: 98229 - RNA, 62 nt, Human
gaaaaaaaucaaaaugcagaaaauguguggugcacuaagaugaucacacagcauuaaaacua

SEQ ID NO: 98230 - RNA, 62 nt, Human
uuucuguauucuaugccuuuuauuuauaaagacacuaagaaaacccauguuuguaauuuuaa

SEQ ID NO: 98231 - RNA, 62 nt, Human
ugggacaggcagcugccuucuggucugcaugacacuaagacgcuuguccacagcggcgaccc

SEQ ID NO: 98232 - RNA, 62 nt, Human
gucugagggucuuccuuuaugcuugcccuccacacuaagagaaguuggcgucucccuccugg

SEQ ID NO: 98233 - RNA, 62 nt, Human
uuuuaaacuuaaauuuugggucaacuugacaccacuaagaugauuuuuuaaggagcuggggg

SEQ ID NO: 98234 - RNA, 62 nt, Human
gcaaggauggguccagaagaccccacuucaggcacuaagaggggcuggaccuggcggcagga

SEQ ID NO: 98235 - RNA, 62 nt, Human
ugaccccuguaaggggccagagccuuggaggacacuaagaggaggcaggaggagcaacucaa

SEQ ID NO: 98236 - RNA, 62 nt, Human
uauguuagucacagucuugaauguauaaacagcacuaagacucucaggucagguaccuuggu

SEQ ID NO: 98237 - RNA, 62 nt, Human
cacggguguacccaggguuuuucagcucauuacacuaagauguggauuuccauaacccaaga

SEQ ID NO: 98238 - RNA, 62 nt, Human
gugguaaccccuuacgaugaugacaucccacacacuaagagguacaagcaggaccaaaguuu

SEQ ID NO: 98239 - RNA, 62 nt, Human
guauggaauuugaaaccccaauggggccuuggcacuaagacuggaauguauauaaagucaaa

SEQ ID NO: 98240 - RNA, 62 nt, Human
cacgucagcuacauaguuuccacaggguaauucacuaagagcuuguggagcuugguuuuaaa

SEQ ID NO: 98241 - RNA, 62 nt, Human
uguuguauuccuucugcagcccuccuucugggcacuaagaaggucuaugaauuaaaugccua

SEQ ID NO: 98242 - RNA, 62 nt, Human
cugauuguaaaacaugccauuauuuuauguugcacuaagaagguggggucgaggaguugcca

SEQ ID NO: 98243 - RNA, 62 nt, Human
ugagggagugaaugauugauuuaccugcuucucacuaagaguccauuggggugguuugcauu

SEQ ID NO: 98244 - RNA, 62 nt, Human
ccugaaucccugaaugacugcauggauagaaccacuaagaaaaauaaacuuuuauauuuuua

SEQ ID NO: 98245 - RNA, 62 nt, Human
aaaauuccaccccaugaucaagaauccugcuccacuaagaauggugcuaaaguaaaacuagu

SEQ ID NO: 98246 - RNA, 62 nt, Human
caaaucucauuuaagagaugcagcaaaguguucacuaagaguguuuaucuugccagacauaa

SEQ ID NO: 98247 - RNA, 62 nt, Human
ucugcagugggggucgcuggggguggagagaacacuaagaggugaacauguaugagugugug

SEQ ID NO: 98248 - RNA, 62 nt, Human
aagcuacuugaaggacacaagagagaaaagcucacuaagaagcuugaaucuacuuuuuuuuu

SEQ ID NO: 98249 - RNA, 62 nt, Human
uggagguucauugagaauugagucuuuggaaacacuaagaaaaucaaauuuuuaaaaguuau

SEQ ID NO: 98250 - RNA, 62 nt, Human
guucuggguaaggggacgaggagcgaacacugcacuaagauuugguuugccaaaucagauuc

SEQ ID NO: 98251 - RNA, 62 nt, Human
gugaggacuuggguccucggucuuacccccaccacuaagagaauacaggaaaaucccuucua

SEQ ID NO: 98252 - RNA, 62 nt, Human
uggaccuccagcugcccugacuccccucuggacacuaagacuccgccccugaggcuccgccc

SEQ ID NO: 98253 - RNA, 62 nt, Human
uuccguuuauuaauugccauugcuccugacaucacuaagauggguccccuucuggcugcaug

SEQ ID NO: 98254 - RNA, 62 nt, Human
acuucuugcucuaagaccugaaagacuuuugucacuaagagagaaacugucuucugggacug

SEQ ID NO: 98255 - RNA, 62 nt, Human
cgugacuaucccuaauaacaaagggguucugacacuaagacauuaggggagaauguugggua

SEQ ID NO: 98256 - RNA, 62 nt, Human
gaacaaaaacacaugccuagugggggaaggcucacuaagagggcaccaaguggggcaaauac

SEQ ID NO: 98257 - RNA, 62 nt, Human
cgcgcccggcccugugccuugcuuuuucuacucacuaagauauaaaacagcucuuuuuccaa

SEQ ID NO: 98258 - RNA, 62 nt, Human
ggacuggcuauuuaucaccacuucuuuuuccccacuaagauuccugugccuuuuaaggcaga

SEQ ID NO: 98259 - RNA, 62 nt, Human
ccaguuguguuuuaaaaacaauuccucaugaacacuaagauuaauugugucuguaucucugg

SEQ ID NO: 98260 - RNA, 62 nt, Human
ccacgccuagccucacgcuccuuucugaucuucacuaagaacaaaagaagcagcaacuugca

SEQ ID NO: 98261 - RNA, 62 nt, Human
cggucuucguccaucugcuuuuuucugaaauacacuaagagcagccacaaaacuguaaccuc

SEQ ID NO: 98262 - RNA, 62 nt, Human
ccauuuuuauucaaagggaaaagaaucccgcccacuaagacgcgaccccucagacagggguc

SEQ ID NO: 98263 - RNA, 62 nt, Human
guuaauuuacauuagauaguaaagaauggcuacacuaagacugaauuaucuuauuagucugg

SEQ ID NO: 98264 - RNA, 62 nt, Human
aggaauaguuccucauucauuuuuauauugaccacuaagaaaauaauucaucagcauuaucu

SEQ ID NO: 98265 - RNA, 62 nt, Human
cuaguuuccuuaccaaggauaauuaaauauaucacuaagagcuuuauauauugauuauauau

SEQ ID NO: 98266 - RNA, 62 nt, Human
ucauuuuauaagaagguugguuuuaaacaauacacuaagaaugacuccuauaaagaaaacaa

SEQ ID NO: 98267 - RNA, 63 nt, Human
uaauacugugugaauauuuucauuagauuaauucacuaagauuuuauuagagauuguuugaau

SEQ ID NO: 98268 - RNA, 63 nt, Human
uaucucugccuucuuaccuuaaauuaaaaagagcacuaagauaacaccuucaagagacuugaa

SEQ ID NO: 98269 - RNA, 63 nt, Human
augagaaaaccuguguggacaucccuugguguacacuaagacagagcagagcccagcgcuccc

SEQ ID NO: 98270 - RNA, 63 nt, Human
aguaaacaggguaccucaagccccauuuccucacacuaagagggcagacugugaacuugacug

SEQ ID NO: 98271 - RNA, 63 nt, Human
gcauccugcauugucuuuacccaccaucaucuucacuaagagaaacaugccuacccaugaagg

SEQ ID NO: 98272 - RNA, 63 nt, Human
cagccucagcuuucacacuucagcccuuaaguucacuaagaaggucugaguuucugcugcaga

SEQ ID NO: 98273 - RNA, 63 nt, Human
gaauucauuaauuuacuguaguguuaagagaagcacuaagaaugccagugaccuguguaaaag

SEQ ID NO: 98274 - RNA, 63 nt, Human
uccuauuaucaaauucaaucugaugucaaauagcacuaagaaguuauugugccuuaugaaaaa

SEQ ID NO: 98275 - RNA, 63 nt, Human
guugacaauacaacauagcauaugucuucaucucacuaagaaaagagcaguuguaacucaaug

SEQ ID NO: 98276 - RNA, 63 nt, Human
auuuauuuuguuggguuuuaaaauugcacagaacacuaagaccgaaaggcuggacucuuguuu

SEQ ID NO: 98277 - RNA, 63 nt, Human
cuugggguuuacggaaauuaacuauuauguuugcacuaagauuugcugggagugguaggugga

SEQ ID NO: 98278 - RNA, 63 nt, Human
cacugcaagccccagaagcauauggcauguguucacuaagaggccuuuaauccuggggaguaa

SEQ ID NO: 98279 - RNA, 63 nt, Human
uauuucuguuguccuacauauuuuaguauaaaucacuaagacauauuuccuuucacuuggcag

SEQ ID NO: 98280 - RNA, 63 nt, Human
uuggagcacccgcacacuacuccaaaucaaaaccacuaagaguuccucccgcgcagacugcug

SEQ ID NO: 98281 - RNA, 63 nt, Human
gagugagagaaguugaucaccccaggaauuagucacuaagaauuccuaagaacuuucuaucaa

SEQ ID NO: 98282 - RNA, 63 nt, Human
gaauauuuaaggucugugacuauaguuaaacuucacuaagaauuugcagaauuguuuugagau

SEQ ID NO: 98283 - RNA, 63 nt, Human
aaucuagucuaugaugguugcgccaucugugcacacuaagaaaugggacucugaacuggagcu

SEQ ID NO: 98284 - RNA, 63 nt, Human
auuuacaaaucaggauuauauacauaagaauuccacuaagaaaugccaagauucuuaaauuug

SEQ ID NO: 98285 - RNA, 63 nt, Human
acauggggaaacagaugccucagccuacuuucacacuaagaaaaaaacuugucuucccuucug

SEQ ID NO: 98286 - RNA, 63 nt, Human
aagaauuuagaauguauuugaugauagcauucucacuaagacacaugagaauuuaacuuuaua

SEQ ID NO: 98287 - RNA, 63 nt, Human
uauauguucuuuauauuuuaaugugaguauauacacuaagaacaaacuaaauugugauuuaug

SEQ ID NO: 98288 - RNA, 63 nt, Human
uuuucugugaaacuucauauugcugaagacauacacuaagaauuuauguagauaauguacuuu

SEQ ID NO: 98289 - RNA, 63 nt, Human
ugcgauaauaauaaacaucugcguuugucucuucacuaagaguaaacugggaaauuguaggcc

SEQ ID NO: 98290 - RNA, 63 nt, Human
cuguucaauuugacuaaguuuuugguaaucuugcacuaagacaucaacaaaaugcccuggcag

SEQ ID NO: 98291 - RNA, 63 nt, Human
ucucuuguccugugaucuguguacaauuuuagucacuaagacuuuccuccaagaacuaagcca

SEQ ID NO: 98292 - RNA, 63 nt, Human
gucacacauuuacaaauuuuucaagagguuagccacuaagacuuuaauaauuuuacaagggaa

SEQ ID NO: 98293 - RNA, 63 nt, Human
uacagucagcccaggagguuacagugagcucuccacuaagaaucuggaagaaaugcaucacua

SEQ ID NO: 98294 - RNA, 63 nt, Human
cccacugggcuaaguuucauaucuaaagcuugucacuaagaauuuucauuuuuaggggucaaa

SEQ ID NO: 98295 - RNA, 63 nt, Human
ugcacaaagaagaaggcagugcuguuacuuggccacuaagauguguaaaauggacugaaaugc

SEQ ID NO: 98296 - RNA, 63 nt, Human
uuguuuguuuccaauugagucauuacugccugccacuaagaaacgugcuugaaucuaauaagu

SEQ ID NO: 98297 - RNA, 63 nt, Human
aggcaggcagacagaaauaaugauguuuucuugcacuaagaagguacuacuuguacacauaua

SEQ ID NO: 98298 - RNA, 63 nt, Human
cagcaaagguagucauuagggagcaggcacuaccacuaagauaucccagaagaagaggcaagg

SEQ ID NO: 98299 - RNA, 63 nt, Human
agggucugcaacauaaagccuuaaaaagacacacacuaagaaaacuguaaaaccuugaacauu

SEQ ID NO: 98300 - RNA, 62 nt, Human; identical to SEQ ID NO: 98132

SEQ ID NO: 98301 - RNA, 63 nt, Human
gcuaaagacaguggcugcagcaguccaggugcacacuaagaacagccuggucuucaucaccca

SEQ ID NO: 98302 - RNA, 63 nt, Human
ugccagauaauccacaugcucccuccccagcuccacuaagauuuucacuuuagccauauucug

SEQ ID NO: 98303 - RNA, 63 nt, Human
ugaaguauuacuguagaucaaguuugucuuccgcacuaagaugugaggaaauugugauuuguu

SEQ ID NO: 98304 - RNA, 63 nt, Human
agggaccaagcagcucacuacgauaucaaguuacacuaagacuuggaacacuaacauucugua

SEQ ID NO: 98305 - RNA, 63 nt, Human
augggaaaaugcaauuaauauggaggugauagucacuaagaacuguugaauggcagaaaagua

SEQ ID NO: 98306 - RNA, 63 nt, Human
uggagagugcauuugccauaccugugugcaugacacuaagauuuuauguuggagauacuucuu

SEQ ID NO: 98307 - RNA, 63 nt, Human
cuauauuuuaauuaaaugaaucuguauuuguagcacuaagagaauuauuauuaaggauugacu

SEQ ID NO: 98308 - RNA, 63 nt, Human
uugacuuccuaagcuacuuaagacaacuugcaccacuaagaaaaaaauguagaaccauuugga

SEQ ID NO: 98309 - RNA, 63 nt, Human
ugacuugcacuucuuaaagagauugcuuuauaacacuaagacauccuuucuaaagauucaagu

SEQ ID NO: 98310 - RNA, 63 nt, Human
aaacaaccauacuuuuauccucauuuuuauucucacuaagaaaaaagucaacuccccuccccu

SEQ ID NO: 98311 - RNA, 63 nt, Human
guggaguugcucugugaggauguucaugguagacacuaagagggcugggugggagaugcuugg

SEQ ID NO: 98312 - RNA, 63 nt, Human
gacuggugacauuuaaagaauuacaaggauaaacacuaagaauguugcaguuaccaucuuaua

SEQ ID NO: 98313 - RNA, 63 nt, Human
uuugacuuuaaggguccuaguaagugccacuuccacuaagaauacaguuugaauguauaauca

SEQ ID NO: 98314 - RNA, 63 nt, Human
aaaagcauaacaccaaucccagggcuggcucugcacuaagagaaaauugcacuaaaugaaucu

SEQ ID NO: 98315 - RNA, 63 nt, Human
aaggaaaacugccauaacauaccaccuagucgacacuaagaaugaggaauaguuuucuccucg

SEQ ID NO: 98316 - RNA, 63 nt, Human
uguauaacaagcauagacaaaugagugucccugcacuaagaagaaucacuuuaaaaagcaaag

SEQ ID NO: 98317 - RNA, 63 nt, Human
cagaugaugccccccaaaacccugauuuccacacacuaagacuaaauuauguaucaaggccau

SEQ ID NO: 98318 - RNA, 63 nt, Human
aauguguggccugcacagugaagugcuggcaaccacuaagaauucaaacuggggccuccagaa

SEQ ID NO: 98319 - RNA, 63 nt, Human
guucaugccucccuguggcuaguacaggcugagcacuaagaugcuuagugcucagacaaccug

SEQ ID NO: 98320 - RNA, 63 nt, Human
aucaaugcccaacagggcaaccaauaaaagugucacuaagaauauaaauauuuggaaucagca

SEQ ID NO: 98321 - RNA, 63 nt, Human
aucuuuuuaaaaacugcugugguuuugcugcuacacuaagaauugugauuugcauuguacggu

SEQ ID NO: 98322 - RNA, 63 nt, Human
gugaauggagauacuugcagagcuugucaugcacacuaagaguuuaaaaugugagcucauuau

SEQ ID NO: 98323 - RNA, 63 nt, Human
gucuuuuggagugaccagcaacuuugauguuugcacuaagauuuuauuuggaaugcaagagag

SEQ ID NO: 98324 - RNA, 63 nt, Human
uaaagauuugaaaaucuuuaaugaacuggagaacacuaagauuuaaacucgaaaauucguugu

SEQ ID NO: 98325 - RNA, 63 nt, Human
cgaguauugaauugacuggauccacuaaaccaacacuaagaugggaaaacacacaugguuugg

SEQ ID NO: 98326 - RNA, 63 nt, Human
uucccacucuggggguuucuaucacugugacaacacuaagauaauaaaccaaaacacuaccug

SEQ ID NO: 98327 - RNA, 63 nt, Human
aaguuucacuggcucuauaacagucuaccucuacacuaagagaacuauaacaugaacaacaua

SEQ ID NO: 98328 - RNA, 63 nt, Human
gggagcuagggauugagggguuaagggaccucacacuaagaaggggcugugcuuugauccccu

SEQ ID NO: 98329 - RNA, 63 nt, Human
cugcuucugugaguucucagccuaggcuguggccacuaagacguggguggggggauagacagg

SEQ ID NO: 98330 - RNA, 63 nt, Human
aaguaaaaaacucuugauguagucauauaaccacacuaagaacucuuccaggugacuucaaaa

SEQ ID NO: 98331 - RNA, 63 nt, Human
agaggcuacuacaaaaagcaaccuuuucauuuucacuaagaguuuaaaagcuauuguauuauu

SEQ ID NO: 98332 - RNA, 63 nt, Human
uacaugggaauaaggaauuucauucacuucagccacuaagaaaaguuuagaaucacgaaagcu

SEQ ID NO: 98333 - RNA, 63 nt, Human
auucuuuuuucuauuaagccauugaaagagaagcacuaagacugcuucuaggcuuuauuuaua

SEQ ID NO: 98334 - RNA, 63 nt, Human
uucaggcuagauguauguacuucaugcugucuacacuaagagagaaugagagacacacugaag

SEQ ID NO: 98335 - RNA, 63 nt, Human
uuccuuaauagcccauuucuguuaaccucuuaucacuaagaaagaaaggaaagaaggagauga

SEQ ID NO: 98336 - RNA, 63 nt, Human
auuuaaaucuuaccuuugauuguugaaaaaagucacuaagaugugaauacagaauagacauug

SEQ ID NO: 98337 - RNA, 63 nt, Human
gggagugagugugaagauggugguuagcaguuucacuaagacugauauuuuaggccucuuguu

SEQ ID NO: 98338 - RNA, 63 nt, Human
ugcaucaaacuuggaacaucaaggcauccaaaacacuaagaauucuaucaucacaaaaauaau

SEQ ID NO: 98339 - RNA, 63 nt, Human
cugcaaaugaauaccuucaacuaggauuuagaccacuaagaacuugcacagaaaaacacgcau

SEQ ID NO: 98340 - RNA, 63 nt, Human
ucaagcuuuugcuugauccagaagagcccauaucacuaagauggcauauaugugaucugggca

SEQ ID NO: 98341 - RNA, 63 nt, Human
caaugauaauuauuacuuuuauauuucaaaguacacuaagaucguugaagagcaauagaaccu

SEQ ID NO: 98342 - RNA, 53 nt, Human; identical to SEQ ID NO: 98174

SEQ ID NO: 98343 - RNA, 63 nt, Human
ccagaaacaguuccugguuccucuuguguuugacacuaagaaaauagcaagagugugaaaucu

SEQ ID NO: 98344 - RNA, 63 nt, Human
aaaagugccuaagacaguaccuggcuucagagucacuaagaaauugcuaaaagcucugcuucg

SEQ ID NO: 98345 - RNA, 63 nt, Human
ccaaauucucaagguuguugauggggaacuugccacuaagagaaggcagagaggucccuagug

SEQ ID NO: 98346 - RNA, 63 nt, Human
gauuuauuacuaugucuuauuuaucagacccugcacuaagauuaaaaguugugcaugggcuua

SEQ ID NO: 98347 - RNA, 63 nt, Human
cucaaauuaaauccuugcaggaagagaaauuaacacuaagaaaaagucaucaauauuuuucaa

SEQ ID NO: 98348 - RNA, 63 nt, Human
agaagacaucuauuggccaucucuggccaauuacacuaagaaacauaucaaggugcuuuuggc

SEQ ID NO: 98349 - RNA, 63 nt, Human
ggcaaggaagugggguguucuucuugggacccccacuaagacccuggucugaggauguagaga

SEQ ID NO: 98350 - RNA, 63 nt, Human
uguuuccgaugagguguacggaugagugaccugcacuaagaagugaguugccacagugaaaau

SEQ ID NO: 98351 - RNA, 63 nt, Human
uuauugugagacacaaauucacugcugccuuuacacuaagaaauguauauguuaaccauauau

SEQ ID NO: 98352 - RNA, 63 nt, Human
acaaugacaaugacaucuuccccuuaccuuagccacuaagaagacaagggcuguuacucauau

SEQ ID NO: 98353 - RNA, 63 nt, Human
ucaaagugaggaacagagauagcuuaaauaauacacuaagauugauuuuaugcucccagaaua

SEQ ID NO: 98354 - RNA, 63 nt, Human
ugcguaaugagacucaccuuuucucgcugaaagcacuaagaggugggaggaggccugcacagg

SEQ ID NO: 98355 - RNA, 63 nt, Human
ugauaugauauuacuguauuuauuuuaagaaagcacuaagauguaauaaagugaugaacuaau

SEQ ID NO: 98356 - RNA, 63 nt, Human
ccauuuuuguaaacgagaccaccaggccuucuucacuaagacuuuguauucaacuuaguuuaa

SEQ ID NO: 98357 - RNA, 63 nt, Human
cauuuaguugauauaauccuaccagaaggaaagcacuaagaaacacucguuuguuguuuuuaa

SEQ ID NO: 98358 - RNA, 63 nt, Human
cagaaaaccaaagagcucaucuuagcuuacaaacacuaagaauauauacaggauauagagaua

SEQ ID NO: 98359 - RNA, 63 nt, Human
aagaagaaaacauuugaauuuaccuucauaugccacuaagaacaaaagcucugaaguucuucc

SEQ ID NO: 98360 - RNA, 63 nt, Human
aguaagcaucuuacaacuggcucuuccuccccucacuaagaagacccaaaccucugcauaaug

SEQ ID NO: 98361 - RNA, 63 nt, Human
ccucuucacugccccucucccucaagccuaagacacuaagaccccagacccaaagccaagucc

SEQ ID NO: 98362 - RNA, 63 nt, Human
guaaguuuauauaauguaauauuauguaccuaccacuaagaaauacaugaaccgugccaugag

SEQ ID NO: 98363 - RNA, 63 nt, Human
ccccacaaggccaggccaauguugcucagugaucacuaagaaccagcuucucaaccaccauug

SEQ ID NO: 98364 - RNA, 63 nt, Human
caguuuucucuucaucacuacuaacaaacaaaacacuaagaaggcuuaguaucgcucuuuuuc

SEQ ID NO: 98365 - RNA, 63 nt, Human
cuucacucaggaaagggaacuaaaaccagaauacacuaagaaguuucuaguuugugugccaaa

SEQ ID NO: 98366 - RNA, 63 nt, Human
ggcacagaccaguuucagagaaauacuuucaggcacuaagacuaaucgaaugaacaaagucca

SEQ ID NO: 98367 - RNA, 63 nt, Human
ccccacaaggccaggccgacguuucugagugaucacuaagaaccagcuucucaaccaccauca

SEQ ID NO: 98368 - RNA, 63 nt, Human
ccccacaaggccaggccgacauuccugagugaucacuaagaaccaguuucucaaccaccacug

SEQ ID NO: 98369 - RNA, 63 nt, Human
ugcuaucuguuuuaccaucaguuuguacaaggacacuaagacaguguagccugcugacuugag

SEQ ID NO: 98370 - RNA, 63 nt, Human
gagcucuuuuuuagcucucuuaaaugaagugcccacuaagaaguuccacuuaacacaugaauu

SEQ ID NO: 98371 - RNA, 63 nt, Human
accuauuuauuugguguuuuggaggagaucacacacuaagagaacguugauugccucggcuau

SEQ ID NO: 98372 - RNA, 63 nt, Human
ggggagaauugagugaauuaaugugugugaggacacuaagauucccauauagaaauaggcuca

SEQ ID NO: 98373 - RNA, 63 nt, Human
aagauguuauuuuugaggaguuccugguccuuucacuaagaauuuccacaucuuuuauggugg

SEQ ID NO: 98374 - RNA, 63 nt, Human
ugcgguuuuguugucguuuguugcugcuuauuucacuaagaaaacccaacaacugagacugcc

SEQ ID NO: 98375 - RNA, 63 nt, Human
cucuccacgucccagaacuggcccagcugcaggcacuaagaagcuccuccccugagacaagug

SEQ ID NO: 98376 - RNA, 63 nt, Human
acuggaauuaccggguuaaaaggaaaugcuuaccacuaagaugucaguauucuccucauggau

SEQ ID NO: 98377 - RNA, 63 nt, Human
auacuggcaaugcauuggaaaacagacagcucccacuaagaucacguucugguauuucugagg

SEQ ID NO: 98378 - RNA, 63 nt, Human
aaaacaaaaaacaacugaccaguuguugauaaccacuaagagucucuauuaaaauuacugaug

SEQ ID NO: 98379 - RNA, 63 nt, Human
caauucugaugacaucuuuacggacacuauuaucacuaagaccuuguuauggcgaagucuuua

SEQ ID NO: 98380 - RNA, 63 nt, Human
aacuuuaaauuaugccguuacuuuucauauuugcacuaagauauuuccaggcugcauuuguau

SEQ ID NO: 98381 - RNA, 63 nt, Human
caaggguauucuaggucaaagcuguuuuuauaacacuaagacaucauuucacuauuuauagcu

SEQ ID NO: 98382 - RNA, 63 nt, Human
gcugacacugcugguauacacagggccaaaacccacuaagauuguccguuuauguuuauuuaa

SEQ ID NO: 98383 - RNA, 63 nt, Human
uuuguccuugucuagguugagaacuuuuacacacacuaagauaaagauagaaaucugacaugc

SEQ ID NO: 98384 - RNA, 63 nt, Human
ucagcaggguucuuuguaaauaguauuuugagacacuaagauguuucuacugcuacggaaugu

SEQ ID NO: 98385 - RNA, 63 nt, Human
cccaaaugucaucagguuuuguuuuuuuucagccacuaagaaccccucugcuuuuaacucuag

SEQ ID NO: 98386 - RNA, 63 nt, Human
uauuacccagcugaauaguuacugcugcacuuucacuaagauguauuugaacacuuggugagu

SEQ ID NO: 98387 - RNA, 63 nt, Human
aaauaauuucguaagcauauacaauccacuucccacuaagaauuagggucaaagacauucuau

SEQ ID NO: 98388 - RNA, 63 nt, Human
gggaaucaaguuugccuuugagauaauacguuacacuaagaaaaggaaaauguggauaguaaa

SEQ ID NO: 98389 - RNA, 63 nt, Human
gcagugauucagagaacagugugaccaaaaacccacuaagaaaaacagauucuugugacagug

SEQ ID NO: 98390 - RNA, 63 nt, Human
uuucaucuaccaauccaugugcauuggauugcacacuaagauguauuuucuuacgaaauaguu

SEQ ID NO: 98391 - RNA, 63 nt, Human
caucaaccacagacaauuuaaauuuuauagaugcacuaagaauucacugcagcagcagguuac

SEQ ID NO: 98392 - RNA, 63 nt, Human
aaaauaaugcaacgcaggaggagaaaagaaaugcacuaagacaagaacauucucucauagaac

SEQ ID NO: 98393 - RNA, 63 nt, Human
auuuagauaugccaaaagaauuaaaaucaaaagcacuaagaaauacauaguugugugauggcu

SEQ ID NO: 98394 - RNA, 63 nt, Human
uaaagugcauuugggagagugaaugugugagaacacuaagaccacucugaacgaugauaauga

SEQ ID NO: 98395 - RNA, 63 nt, Human
ggagggggagcccagguaugagaaagaaaaaaccacuaagaaaauaccucccugggaggauga

SEQ ID NO: 98396 - RNA, 63 nt, Human
cugggggcaggcucagcaucugcccacuggucucacuaagagcuuucagauuucccuccauag

SEQ ID NO: 98397 - RNA, 63 nt, Human
agaaaaaaaucaaaaugcagaaaauguguggugcacuaagaugaucacacagcauuaaaacua

SEQ ID NO: 98398 - RNA, 63 nt, Human
cuuucuguauucuaugccuuuuauuuauaaagacacuaagaaaacccauguuuguaauuuuaa

SEQ ID NO: 98399 - RNA, 63 nt, Human
cugggacaggcagcugccuucuggucugcaugacacuaagacgcuuguccacagcggcgaccc

SEQ ID NO: 98400 - RNA, 63 nt, Human
agucugagggucuuccuuuaugcuugcccuccacacuaagagaaguuggcgucucccuccugg

SEQ ID NO: 98401 - RNA, 63 nt, Human
uuuuuaaacuuaaauuuugggucaacuugacaccacuaagaugauuuuuuaaggagcuggggg

SEQ ID NO: 98402 - RNA, 63 nt, Human
ggcaaggauggguccagaagaccccacuucaggcacuaagaggggcuggaccuggcggcagga

SEQ ID NO: 98403 - RNA, 63 nt, Human
augaccccuguaaggggccagagccuuggaggacacuaagaggaggcaggaggagcaacucaa

SEQ ID NO: 98404 - RNA, 63 nt, Human
uuauguuagucacagucuugaauguauaaacagcacuaagacucucaggucagguaccuuggu

SEQ ID NO: 98405 - RNA, 63 nt, Human
ucacggguguacccaggguuuuucagcucauuacacuaagauguggauuuccauaacccaaga

SEQ ID NO: 98406 - RNA, 63 nt, Human
ugugguaaccccuuacgaugaugacaucccacacacuaagagguacaagcaggaccaaaguuu

SEQ ID NO: 98407 - RNA, 63 nt, Human
gguauggaauuugaaaccccaauggggccuuggcacuaagacuggaauguauauaaagucaaa

SEQ ID NO: 98408 - RNA, 63 nt, Human
ucacgucagcuacauaguuuccacaggguaauucacuaagagcuuguggagcuugguuuuaaa

SEQ ID NO: 98409 - RNA, 63 nt, Human
uuguuguauuccuucugcagcccuccuucugggcacuaagaaggucuaugaauuaaaugccua

SEQ ID NO: 98410 - RNA, 63 nt, Human
acugauuguaaaacaugccauuauuuuauguugcacuaagaagguggggucgaggaguugcca

SEQ ID NO: 98411 - RNA, 63 nt, Human
augagggagugaaugauugauuuaccugcuucucacuaagaguccauuggggugguuugcauu

SEQ ID NO: 98412 - RNA, 63 nt, Human
accugaaucccugaaugacugcauggauagaaccacuaagaaaaauaaacuuuuauauuuuua

SEQ ID NO: 98413 - RNA, 63 nt, Human
caaaauuccaccccaugaucaagaauccugcuccacuaagaauggugcuaaaguaaaacuagu

SEQ ID NO: 98414 - RNA, 63 nt, Human
acaaaucucauuuaagagaugcagcaaaguguucacuaagaguguuuaucuugccagacauaa

SEQ ID NO: 98415 - RNA, 63 nt, Human
gucugcagugggggucgcuggggguggagagaacacuaagaggugaacauguaugagugugug

SEQ ID NO: 98416 - RNA, 63 nt, Human
aaagcuacuugaaggacacaagagagaaaagcucacuaagaagcuugaaucuacuuuuuuuuu

SEQ ID NO: 98417 - RNA, 63 nt, Human
uuggagguucauugagaauugagucuuuggaaacacuaagaaaaucaaauuuuuaaaaguuau

SEQ ID NO: 98418 - RNA, 63 nt, Human
uguucuggguaaggggacgaggagcgaacacugcacuaagauuugguuugccaaaucagauuc

SEQ ID NO: 98419 - RNA, 63 nt, Human
agugaggacuuggguccucggucuuacccccaccacuaagagaauacaggaaaaucccuucua

SEQ ID NO: 98420 - RNA, 63 nt, Human
cuggaccuccagcugcccugacuccccucuggacacuaagacuccgccccugaggcuccgccc

SEQ ID NO: 98421 - RNA, 63 nt, Human
cuuccguuuauuaauugccauugcuccugacaucacuaagauggguccccuucuggcugcaug

SEQ ID NO: 98422 - RNA, 63 nt, Human
cacuucuugcucuaagaccugaaagacuuuugucacuaagagagaaacugucuucugggacug

SEQ ID NO: 98423 - RNA, 63 nt, Human
acgugacuaucccuaauaacaaagggguucugacacuaagacauuaggggagaauguugggua

SEQ ID NO: 98424 - RNA, 63 nt, Human
agaacaaaaacacaugccuagugggggaaggcucacuaagagggcaccaaguggggcaaauac

SEQ ID NO: 98425 - RNA, 63 nt, Human
ccgcgcccggcccugugccuugcuuuuucuacucacuaagauauaaaacagcucuuuuuccaa

SEQ ID NO: 98426 - RNA, 63 nt, Human
cggacuggcuauuuaucaccacuucuuuuuccccacuaagauuccugugccuuuuaaggcaga

SEQ ID NO: 98427 - RNA, 63 nt, Human
cccaguuguguuuuaaaaacaauuccucaugaacacuaagauuaauugugucuguaucucugg

SEQ ID NO: 98428 - RNA, 63 nt, Human
accacgccuagccucacgcuccuuucugaucuucacuaagaacaaaagaagcagcaacuugca

SEQ ID NO: 98429 - RNA, 63 nt, Human
ucggucuucguccaucugcuuuuuucugaaauacacuaagagcagccacaaaacuguaaccuc

SEQ ID NO: 98430 - RNA, 63 nt, Human
uccauuuuuauucaaagggaaaagaaucccgcccacuaagacgcgaccccucagacagggguc

SEQ ID NO: 98431 - RNA, 63 nt, Human
uguuaauuuacauuagauaguaaagaauggcuacacuaagacugaauuaucuuauuagucugg

SEQ ID NO: 98432 - RNA, 63 nt, Human
uaggaauaguuccucauucauuuuuauauugaccacuaagaaaauaauucaucagcauuaucu

SEQ ID NO: 98433 - RNA, 63 nt, Human
ccuaguuuccuuaccaaggauaauuaaauauaucacuaagagcuuuauauauugauuauauau

SEQ ID NO: 98434 - RNA, 63 nt, Human
uucauuuuauaagaagguugguuuuaaacaauacacuaagaaugacuccuauaaagaaaacaa

SEQ ID NO: 98435 - RNA, 65 nt, Human
cauaauacugugugaauauuuucauuagauuaauucacuaagauuuuauuagagauuguuugaau

SEQ ID NO: 98436 - RNA, 65 nt, Human
aauaucucugccuucuuaccuuaaauuaaaaagagcacuaagauaacaccuucaagagacuugaa

SEQ ID NO: 98437 - RNA, 65 nt, Human
uuaugagaaaaccuguguggacaucccuugguguacacuaagacagagcagagcccagcgcuccc

SEQ ID NO: 98438 - RNA, 65 nt, Human
caaguaaacaggguaccucaagccccauuuccucacacuaagagggcagacugugaacuugacug

SEQ ID NO: 98439 - RNA, 65 nt, Human
aagcauccugcauugucuuuacccaccaucaucuucacuaagagaaacaugccuacccaugaagg

SEQ ID NO: 98440 - RNA, 65 nt, Human
ugcagccucagcuuucacacuucagcccuuaaguucacuaagaaggucugaguuucugcugcaga

SEQ ID NO: 98441 - RNA, 65 nt, Human
ccgaauucauuaauuuacuguaguguuaagagaagcacuaagaaugccagugaccuguguaaaag

SEQ ID NO: 98442 - RNA, 65 nt, Human
gauccuauuaucaaauucaaucugaugucaaauagcacuaagaaguuauugugccuuaugaaaaa

SEQ ID NO: 98443 - RNA, 65 nt, Human
auguugacaauacaacauagcauaugucuucaucucacuaagaaaagagcaguuguaacucaaug

SEQ ID NO: 98444 - RNA, 65 nt, Human
auauuuauuuuguuggguuuuaaaauugcacagaacacuaagaccgaaaggcuggacucuuguuu

SEQ ID NO: 98445 - RNA, 65 nt, Human
gucuugggguuuacggaaauuaacuauuauguuugcacuaagauuugcugggagugguaggugga

SEQ ID NO: 98446 - RNA, 65 nt, Human
uucacugcaagccccagaagcauauggcauguguucacuaagaggccuuuaauccuggggaguaa

SEQ ID NO: 98447 - RNA, 65 nt, Human
gcuauuucuguuguccuacauauuuuaguauaaaucacuaagacauauuuccuuucacuuggcag

SEQ ID NO: 98448 - RNA, 65 nt, Human
cauuggagcacccgcacacuacuccaaaucaaaaccacuaagaguuccucccgcgcagacugcug

SEQ ID NO: 98449 - RNA, 65 nt, Human
gugagugagagaaguugaucaccccaggaauuagucacuaagaauuccuaagaacuuucuaucaa

SEQ ID NO: 98450 - RNA, 65 nt, Human
gugaauauuuaaggucugugacuauaguuaaacuucacuaagaauuugcagaauuguuuugagau

SEQ ID NO: 98451 - RNA, 65 nt, Human
agaaucuagucuaugaugguugcgccaucugugcacacuaagaaaugggacucugaacuggagcu

SEQ ID NO: 98452 - RNA, 65 nt, Human
aaauuuacaaaucaggauuauauacauaagaauuccacuaagaaaugccaagauucuuaaauuug

SEQ ID NO: 98453 - RNA, 65 nt, Human
aaacauggggaaacagaugccucagccuacuuucacacuaagaaaaaaacuugucuucccuucug

SEQ ID NO: 98454 - RNA, 65 nt, Human
gaaagaauuuagaauguauuugaugauagcauucucacuaagacacaugagaauuuaacuuuaua

SEQ ID NO: 98455 - RNA, 65 nt, Human
gguauauguucuuuauauuuuaaugugaguauauacacuaagaacaaacuaaauugugauuuaug

SEQ ID NO: 98456 - RNA, 65 nt, Human
uuuuuucugugaaacuucauauugcugaagacauacacuaagaauuuauguagauaauguacuuu

SEQ ID NO: 98457 - RNA, 65 nt, Human
gaugcgauaauaauaaacaucugcguuugucucuucacuaagaguaaacugggaaauuguaggcc

SEQ ID NO: 98458 - RNA, 65 nt, Human
uccuguucaauuugacuaaguuuuugguaaucuugcacuaagacaucaacaaaaugcccuggcag

SEQ ID NO: 98459 - RNA, 65 nt, Human
guucucuuguccugugaucuguguacaauuuuagucacuaagacuuuccuccaagaacuaagcca

SEQ ID NO: 98460 - RNA, 65 nt, Human
uagucacacauuuacaaauuuuucaagagguuagccacuaagacuuuaauaauuuuacaagggaa

SEQ ID NO: 98461 - RNA, 65 nt, Human
guuacagucagcccaggagguuacagugagcucuccacuaagaaucuggaagaaaugcaucacua

SEQ ID NO: 98462 - RNA, 65 nt, Human
uacccacugggcuaaguuucauaucuaaagcuugucacuaagaauuuucauuuuuaggggucaaa

SEQ ID NO: 98463 - RNA, 65 nt, Human
aaugcacaaagaagaaggcagugcuguuacuuggccacuaagauguguaaaauggacugaaaugc

SEQ ID NO: 98464 - RNA, 65 nt, Human
uuuuguuuguuuccaauugagucauuacugccugccacuaagaaacgugcuugaaucuaauaagu

SEQ ID NO: 98465 - RNA, 65 nt, Human
aaaggcaggcagacagaaauaaugauguuuucuugcacuaagaagguacuacuuguacacauaua

SEQ ID NO: 98466 - RNA, 65 nt, Human
uucagcaaagguagucauuagggagcaggcacuaccacuaagauaucccagaagaagaggcaagg

SEQ ID NO: 98467 - RNA, 65 nt, Human
gaagggucugcaacauaaagccuuaaaaagacacacacuaagaaaacuguaaaaccuugaacauu

SEQ ID NO: 98468 - RNA, 62 nt, Human; identical to SEQ ID NO: 98132

SEQ ID NO: 98469 - RNA, 65 nt, Human
augcuaaagacaguggcugcagcaguccaggugcacacuaagaacagccuggucuucaucaccca

SEQ ID NO: 98470 - RNA, 65 nt, Human
ccugccagauaauccacaugcucccuccccagcuccacuaagauuuucacuuuagccauauucug

SEQ ID NO: 98471 - RNA, 65 nt, Human
guugaaguauuacuguagaucaaguuugucuuccgcacuaagaugugaggaaauugugauuuguu

SEQ ID NO: 98472 - RNA, 65 nt, Human
aaagggaccaagcagcucacuacgauaucaaguuacacuaagacuuggaacacuaacauucugua

SEQ ID NO: 98473 - RNA, 65 nt, Human
uaaugggaaaaugcaauuaauauggaggugauagucacuaagaacuguugaauggcagaaaagua

SEQ ID NO: 98474 - RNA, 65 nt, Human
aguggagagugcauuugccauaccugugugcaugacacuaagauuuuauguuggagauacuucuu

SEQ ID NO: 98475 - RNA, 65 nt, Human
uacuauauuuuaauuaaaugaaucuguauuuguagcacuaagagaauuauuauuaaggauugacu

SEQ ID NO: 98476 - RNA, 65 nt, Human
gauugacuuccuaagcuacuuaagacaacuugcaccacuaagaaaaaaauguagaaccauuugga

SEQ ID NO: 98477 - RNA, 65 nt, Human
gaugacuugcacuucuuaaagagauugcuuuauaacacuaagacauccuuucuaaagauucaagu

SEQ ID NO: 98478 - RNA, 65 nt, Human
guaaacaaccauacuuuuauccucauuuuuauucucacuaagaaaaaagucaacuccccuccccu

SEQ ID NO: 98479 - RNA, 65 nt, Human
cgguggaguugcucugugaggauguucaugguagacacuaagagggcugggugggagaugcuugg

SEQ ID NO: 98480 - RNA, 65 nt, Human
augacuggugacauuuaaagaauuacaaggauaaacacuaagaauguugcaguuaccaucuuaua

SEQ ID NO: 98481 - RNA, 65 nt, Human
auuuugacuuuaaggguccuaguaagugccacuuccacuaagaauacaguuugaauguauaauca

SEQ ID NO: 98482 - RNA, 65 nt, Human
agaaaagcauaacaccaaucccagggcuggcucugcacuaagagaaaauugcacuaaaugaaucu

SEQ ID NO: 98483 - RNA, 65 nt, Human
cgaaggaaaacugccauaacauaccaccuagucgacacuaagaaugaggaauaguuuucuccucg

SEQ ID NO: 98484 - RNA, 65 nt, Human
gcuguauaacaagcauagacaaaugagugucccugcacuaagaagaaucacuuuaaaaagcaaag

SEQ ID NO: 98485 - RNA, 65 nt, Human
gucagaugaugccccccaaaacccugauuuccacacacuaagacuaaauuauguaucaaggccau

SEQ ID NO: 98486 - RNA, 65 nt, Human
ggaauguguggccugcacagugaagugcuggcaaccacuaagaauucaaacuggggccuccagaa

SEQ ID NO: 98487 - RNA, 65 nt, Human
guguucaugccucccuguggcuaguacaggcugagcacuaagaugcuuagugcucagacaaccug

SEQ ID NO: 98488 - RNA, 65 nt, Human
auaucaaugcccaacagggcaaccaauaaaagugucacuaagaauauaaauauuuggaaucagca

SEQ ID NO: 98489 - RNA, 65 nt, Human
uaaucuuuuuaaaaacugcugugguuuugcugcuacacuaagaauugugauuugcauuguacggu

SEQ ID NO: 98490 - RNA, 65 nt, Human
uagugaauggagauacuugcagagcuugucaugcacacuaagaguuuaaaaugugagcucauuau

SEQ ID NO: 98491 - RNA, 65 nt, Human
cagucuuuuggagugaccagcaacuuugauguuugcacuaagauuuuauuuggaaugcaagagag

SEQ ID NO: 98492 - RNA, 65 nt, Human
uauaaagauuugaaaaucuuuaaugaacuggagaacacuaagauuuaaacucgaaaauucguugu

SEQ ID NO: 98493 - RNA, 65 nt, Human
uucgaguauugaauugacuggauccacuaaaccaacacuaagaugggaaaacacacaugguuugg

SEQ ID NO: 98494 - RNA, 65 nt, Human
ucuucccacucuggggguuucuaucacugugacaacacuaagauaauaaaccaaaacacuaccug

SEQ ID NO: 98495 - RNA, 65 nt, Human
ucaaguuucacuggcucuauaacagucuaccucuacacuaagagaacuauaacaugaacaacaua

SEQ ID NO: 98496 - RNA, 65 nt, Human
aggggagcuagggauugagggguuaagggaccucacacuaagaaggggcugugcuuugauccccu

SEQ ID NO: 98497 - RNA, 65 nt, Human
ggcugcuucugugaguucucagccuaggcuguggccacuaagacguggguggggggauagacagg

SEQ ID NO: 98498 - RNA, 65 nt, Human
aaaaguaaaaaacucuugauguagucauauaaccacacuaagaacucuuccaggugacuucaaaa

SEQ ID NO: 98499 - RNA, 65 nt, Human
gcagaggcuacuacaaaaagcaaccuuuucauuuucacuaagaguuuaaaagcuauuguauuauu

SEQ ID NO: 98500 - RNA, 65 nt, Human
guuacaugggaauaaggaauuucauucacuucagccacuaagaaaaguuuagaaucacgaaagcu

SEQ ID NO: 98501 - RNA, 65 nt, Human
ucauucuuuuuucuauuaagccauugaaagagaagcacuaagacugcuucuaggcuuuauuuaua

SEQ ID NO: 98502 - RNA, 65 nt, Human
uuuucaggcuagauguauguacuucaugcugucuacacuaagagagaaugagagacacacugaag

SEQ ID NO: 98503 - RNA, 65 nt, Human
auuuccuuaauagcccauuucuguuaaccucuuaucacuaagaaagaaaggaaagaaggagauga

SEQ ID NO: 98504 - RNA, 65 nt, Human
caauuuaaaucuuaccuuugauuguugaaaaaagucacuaagaugugaauacagaauagacauug

SEQ ID NO: 98505 - RNA, 65 nt, Human
aagggagugagugugaagauggugguuagcaguuucacuaagacugauauuuuaggccucuuguu

SEQ ID NO: 98506 - RNA, 65 nt, Human
auugcaucaaacuuggaacaucaaggcauccaaaacacuaagaauucuaucaucacaaaaauaau

SEQ ID NO: 98507 - RNA, 65 nt, Human
uucugcaaaugaauaccuucaacuaggauuuagaccacuaagaacuugcacagaaaaacacgcau

SEQ ID NO: 98508 - RNA, 65 nt, Human
aaucaagcuuuugcuugauccagaagagcccauaucacuaagauggcauauaugugaucugggca

SEQ ID NO: 98509 - RNA, 65 nt, Human
uccaaugauaauuauuacuuuuauauuucaaaguacacuaagaucguugaagagcaauagaaccu

SEQ ID NO: 98510 - RNA, 53 nt, Human; identical to SEQ ID NO: 98174

SEQ ID NO: 98511 - RNA, 65 nt, Human
ugccagaaacaguuccugguuccucuuguguuugacacuaagaaaauagcaagagugugaaaucu

SEQ ID NO: 98512 - RNA, 65 nt, Human
acaaaagugccuaagacaguaccuggcuucagagucacuaagaaauugcuaaaagcucugcuucg

SEQ ID NO: 98513 - RNA, 65 nt, Human
gcccaaauucucaagguuguugauggggaacuugccacuaagagaaggcagagaggucccuagug

SEQ ID NO: 98514 - RNA, 65 nt, Human
cugauuuauuacuaugucuuauuuaucagacccugcacuaagauuaaaaguugugcaugggcuua

SEQ ID NO: 98515 - RNA, 65 nt, Human
uccucaaauuaaauccuugcaggaagagaaauuaacacuaagaaaaagucaucaauauuuuucaa

SEQ ID NO: 98516 - RNA, 65 nt, Human
ugagaagacaucuauuggccaucucuggccaauuacacuaagaaacauaucaaggugcuuuuggc

SEQ ID NO: 98517 - RNA, 65 nt, Human
agggcaaggaagugggguguucuucuugggacccccacuaagacccuggucugaggauguagaga

SEQ ID NO: 98518 - RNA, 65 nt, Human
ucuguuuccgaugagguguacggaugagugaccugcacuaagaagugaguugccacagugaaaau

SEQ ID NO: 98519 - RNA, 65 nt, Human
auuuauugugagacacaaauucacugcugccuuuacacuaagaaauguauauguuaaccauauau

SEQ ID NO: 98520 - RNA, 65 nt, Human
acacaaugacaaugacaucuuccccuuaccuuagccacuaagaagacaagggcuguuacucauau

SEQ ID NO: 98521 - RNA, 65 nt, Human
agucaaagugaggaacagagauagcuuaaauaauacacuaagauugauuuuaugcucccagaaua

SEQ ID NO: 98522 - RNA, 65 nt, Human
ucugcguaaugagacucaccuuuucucgcugaaagcacuaagaggugggaggaggccugcacagg

SEQ ID NO: 98523 - RNA, 65 nt, Human
uuugauaugauauuacuguauuuauuuuaagaaagcacuaagauguaauaaagugaugaacuaau

SEQ ID NO: 98524 - RNA, 65 nt, Human
ggccauuuuuguaaacgagaccaccaggccuucuucacuaagacuuuguauucaacuuaguuuaa

SEQ ID NO: 98525 - RNA, 65 nt, Human
uucauuuaguugauauaauccuaccagaaggaaagcacuaagaaacacucguuuguuguuuuuaa

SEQ ID NO: 98526 - RNA, 65 nt, Human
uccagaaaaccaaagagcucaucuuagcuuacaaacacuaagaauauauacaggauauagagaua

SEQ ID NO: 98527 - RNA, 65 nt, Human
cgaagaagaaaacauuugaauuuaccuucauaugccacuaagaacaaaagcucugaaguucuucc

SEQ ID NO: 98528 - RNA, 65 nt, Human
caaguaagcaucuuacaacuggcucuuccuccccucacuaagaagacccaaaccucugcauaaug

SEQ ID NO: 98529 - RNA, 65 nt, Human
caccucuucacugccccucucccucaagccuaagacacuaagaccccagacccaaagccaagucc

SEQ ID NO: 98530 - RNA, 65 nt, Human
auguaaguuuauauaauguaauauuauguaccuaccacuaagaaauacaugaaccgugccaugag

SEQ ID NO: 98531 - RNA, 65 nt, Human
gaccccacaaggccaggccaauguugcucagugaucacuaagaaccagcuucucaaccaccauug

SEQ ID NO: 98532 - RNA, 65 nt, Human
agcaguuuucucuucaucacuacuaacaaacaaaacacuaagaaggcuuaguaucgcucuuuuuc

SEQ ID NO: 98533 - RNA, 65 nt, Human
ugcuucacucaggaaagggaacuaaaaccagaauacacuaagaaguuucuaguuugugugccaaa

SEQ ID NO: 98534 - RNA, 65 nt, Human
uuggcacagaccaguuucagagaaauacuuucaggcacuaagacuaaucgaaugaacaaagucca

SEQ ID NO: 98535 - RNA, 65 nt, Human
gaccccacaaggccaggccgacguuucugagugaucacuaagaaccagcuucucaaccaccauca

SEQ ID NO: 98536 - RNA, 65 nt, Human
gaccccacaaggccaggccgacauuccugagugaucacuaagaaccaguuucucaaccaccacug

SEQ ID NO: 98537 - RNA, 65 nt, Human
ggugcuaucuguuuuaccaucaguuuguacaaggacacuaagacaguguagccugcugacuugag

SEQ ID NO: 98538 - RNA, 65 nt, Human
aagagcucuuuuuuagcucucuuaaaugaagugcccacuaagaaguuccacuuaacacaugaauu

SEQ ID NO: 98539 - RNA, 65 nt, Human
aaaccuauuuauuugguguuuuggaggagaucacacacuaagagaacguugauugccucggcuau

SEQ ID NO: 98540 - RNA, 65 nt, Human
uuggggagaauugagugaauuaaugugugugaggacacuaagauucccauauagaaauaggcuca

SEQ ID NO: 98541 - RNA, 65 nt, Human
guaagauguuauuuuugaggaguuccugguccuuucacuaagaauuuccacaucuuuuauggugg

SEQ ID NO: 98542 - RNA, 65 nt, Human
aaugcgguuuuguugucguuuguugcugcuuauuucacuaagaaaacccaacaacugagacugcc

SEQ ID NO: 98543 - RNA, 65 nt, Human
uccucuccacgucccagaacuggcccagcugcaggcacuaagaagcuccuccccugagacaagug

SEQ ID NO: 98544 - RNA, 65 nt, Human
cuacuggaauuaccggguuaaaaggaaaugcuuaccacuaagaugucaguauucuccucauggau

SEQ ID NO: 98545 - RNA, 65 nt, Human
gcauacuggcaaugcauuggaaaacagacagcucccacuaagaucacguucugguauuucugagg

SEQ ID NO: 98546 - RNA, 65 nt, Human
aaaaaacaaaaaacaacugaccaguuguugauaaccacuaagagucucuauuaaaauuacugaug

SEQ ID NO: 98547 - RNA, 65 nt, Human
accaauucugaugacaucuuuacggacacuauuaucacuaagaccuuguuauggcgaagucuuua

SEQ ID NO: 98548 - RNA, 65 nt, Human
guaacuuuaaauuaugccguuacuuuucauauuugcacuaagauauuuccaggcugcauuuguau

SEQ ID NO: 98549 - RNA, 65 nt, Human
uucaaggguauucuaggucaaagcuguuuuuauaacacuaagacaucauuucacuauuuauagcu

SEQ ID NO: 98550 - RNA, 65 nt, Human
cugcugacacugcugguauacacagggccaaaacccacuaagauuguccguuuauguuuauuuaa

SEQ ID NO: 98551 - RNA, 65 nt, Human
aauuuguccuugucuagguugagaacuuuuacacacacuaagauaaagauagaaaucugacaugc

SEQ ID NO: 98552 - RNA, 64 nt, Human
aucagcaggguucuuuguaaauaguauuuugagacacuaagauguuucuacugcuacggaaugu

SEQ ID NO: 98553 - RNA, 65 nt, Human
gucccaaaugucaucagguuuuguuuuuuuucagccacuaagaaccccucugcuuuuaacucuag

SEQ ID NO: 98554 - RNA, 65 nt, Human
aauauuacccagcugaauaguuacugcugcacuuucacuaagauguauuugaacacuuggugagu

SEQ ID NO: 98555 - RNA, 65 nt, Human
auaaauaauuucguaagcauauacaauccacuucccacuaagaauuagggucaaagacauucuau

SEQ ID NO: 98556 - RNA, 65 nt, Human
aagggaaucaaguuugccuuugagauaauacguuacacuaagaaaaggaaaauguggauaguaaa

SEQ ID NO: 98557 - RNA, 65 nt, Human
gagcagugauucagagaacagugugaccaaaaacccacuaagaaaaacagauucuugugacagug

SEQ ID NO: 98558 - RNA, 65 nt, Human
ccuuucaucuaccaauccaugugcauuggauugcacacuaagauguauuuucuuacgaaauaguu

SEQ ID NO: 98559 - RNA, 65 nt, Human
gacaucaaccacagacaauuuaaauuuuauagaugcacuaagaauucacugcagcagcagguuac

SEQ ID NO: 98560 - RNA, 65 nt, Human
gcaaaauaaugcaacgcaggaggagaaaagaaaugcacuaagacaagaacauucucucauagaac

SEQ ID NO: 98561 - RNA, 65 nt, Human
acauuuagauaugccaaaagaauuaaaaucaaaagcacuaagaaauacauaguugugugauggcu

SEQ ID NO: 98562 - RNA, 65 nt, Human
ucuaaagugcauuugggagagugaaugugugagaacacuaagaccacucugaacgaugauaauga

SEQ ID NO: 98563 - RNA, 65 nt, Human
aaggagggggagcccagguaugagaaagaaaaaaccacuaagaaaauaccucccugggaggauga

SEQ ID NO: 98564 - RNA, 65 nt, Human
gucugggggcaggcucagcaucugcccacuggucucacuaagagcuuucagauuucccuccauag

SEQ ID NO: 98565 - RNA, 65 nt, Human
aaagaaaaaaaucaaaaugcagaaaauguguggugcacuaagaugaucacacagcauuaaaacua

SEQ ID NO: 98566 - RNA, 65 nt, Human
ggcuuucuguauucuaugccuuuuauuuauaaagacacuaagaaaacccauguuuguaauuuuaa

SEQ ID NO: 98567 - RNA, 65 nt, Human
cccugggacaggcagcugccuucuggucugcaugacacuaagacgcuuguccacagcggcgaccc

SEQ ID NO: 98568 - RNA, 65 nt, Human
aaagucugagggucuuccuuuaugcuugcccuccacacuaagagaaguuggcgucucccuccugg

SEQ ID NO: 98569 - RNA, 65 nt, Human
uuuuuuuaaacuuaaauuuugggucaacuugacaccacuaagaugauuuuuuaaggagcuggggg

SEQ ID NO: 98570 - RNA, 65 nt, Human
ugggcaaggauggguccagaagaccccacuucaggcacuaagaggggcuggaccuggcggcagga

SEQ ID NO: 98571 - RNA, 65 nt, Human
caaugaccccuguaaggggccagagccuuggaggacacuaagaggaggcaggaggagcaacucaa

SEQ ID NO: 98572 - RNA, 65 nt, Human
uuuuauguuagucacagucuugaauguauaaacagcacuaagacucucaggucagguaccuuggu

SEQ ID NO: 98573 - RNA, 65 nt, Human
gaucacggguguacccaggguuuuucagcucauuacacuaagauguggauuuccauaacccaaga

SEQ ID NO: 98574 - RNA, 65 nt, Human
cuugugguaaccccuuacgaugaugacaucccacacacuaagagguacaagcaggaccaaaguuu

SEQ ID NO: 98575 - RNA, 65 nt, Human
cugguauggaauuugaaaccccaauggggccuuggcacuaagacuggaauguauauaaagucaaa

SEQ ID NO: 98576 - RNA, 65 nt, Human
cuucacgucagcuacauaguuuccacaggguaauucacuaagagcuuguggagcuugguuuuaaa

SEQ ID NO: 98577 - RNA, 65 nt, Human
aauuguuguauuccuucugcagcccuccuucugggcacuaagaaggucuaugaauuaaaugccua

SEQ ID NO: 98578 - RNA, 65 nt, Human
ccacugauuguaaaacaugccauuauuuuauguugcacuaagaagguggggucgaggaguugcca

SEQ ID NO: 98579 - RNA, 65 nt, Human
acaugagggagugaaugauugauuuaccugcuucucacuaagaguccauuggggugguuugcauu

SEQ ID NO: 98580 - RNA, 65 nt, Human
gaaccugaaucccugaaugacugcauggauagaaccacuaagaaaaauaaacuuuuauauuuuua

SEQ ID NO: 98581 - RNA, 65 nt, Human
cacaaaauuccaccccaugaucaagaauccugcuccacuaagaauggugcuaaaguaaaacuagu

SEQ ID NO: 98582 - RNA, 65 nt, Human
agacaaaucucauuuaagagaugcagcaaaguguucacuaagaguguuuaucuugccagacauaa

SEQ ID NO: 98583 - RNA, 65 nt, Human
aagucugcagugggggucgcuggggguggagagaacacuaagaggugaacauguaugagugugug

SEQ ID NO: 98584 - RNA, 65 nt, Human
acaaagcuacuugaaggacacaagagagaaaagcucacuaagaagcuugaaucuacuuuuuuuuu

SEQ ID NO: 98585 - RNA, 65 nt, Human
aauuggagguucauugagaauugagucuuuggaaacacuaagaaaaucaaauuuuuaaaaguuau

SEQ ID NO: 98586 - RNA, 65 nt, Human
cauguucuggguaaggggacgaggagcgaacacugcacuaagauuugguuugccaaaucagauuc

SEQ ID NO: 98587 - RNA, 65 nt, Human
ugagugaggacuuggguccucggucuuacccccaccacuaagagaauacaggaaaaucccuucua

SEQ ID NO: 98588 - RNA, 65 nt, Human
cccuggaccuccagcugcccugacuccccucuggacacuaagacuccgccccugaggcuccgccc

SEQ ID NO: 98589 - RNA, 65 nt, Human
accuuccguuuauuaauugccauugcuccugacaucacuaagauggguccccuucuggcugcaug

SEQ ID NO: 98590 - RNA, 65 nt, Human
ggcacuucuugcucuaagaccugaaagacuuuugucacuaagagagaaacugucuucugggacug

SEQ ID NO: 98591 - RNA, 65 nt, Human
guacgugacuaucccuaauaacaaagggguucugacacuaagacauuaggggagaauguugggua

SEQ ID NO: 98592 - RNA, 65 nt, Human
ccagaacaaaaacacaugccuagugggggaaggcucacuaagagggcaccaaguggggcaaauac

SEQ ID NO: 98593 - RNA, 65 nt, Human
caccgcgcccggcccugugccuugcuuuuucuacucacuaagauauaaaacagcucuuuuuccaa

SEQ ID NO: 98594 - RNA, 65 nt, Human
cacggacuggcuauuuaucaccacuucuuuuuccccacuaagauuccugugccuuuuaaggcaga

SEQ ID NO: 98595 - RNA, 65 nt, Human
ugcccaguuguguuuuaaaaacaauuccucaugaacacuaagauuaauugugucuguaucucugg

SEQ ID NO: 98596 - RNA, 65 nt, Human
ccaccacgccuagccucacgcuccuuucugaucuucacuaagaacaaaagaagcagcaacuugca

SEQ ID NO: 98597 - RNA, 65 nt, Human
ggucggucuucguccaucugcuuuuuucugaaauacacuaagagcagccacaaaacuguaaccuc

SEQ ID NO: 98598 - RNA, 65 nt, Human
aauccauuuuuauucaaagggaaaagaaucccgcccacuaagacgcgaccccucagacagggguc

SEQ ID NO: 98599 - RNA, 65 nt, Human
uguguuaauuuacauuagauaguaaagaauggcuacacuaagacugaauuaucuuauuagucugg

SEQ ID NO: 98600 - RNA, 65 nt, Human
ucuaggaauaguuccucauucauuuuuauauugaccacuaagaaaauaauucaucagcauuaucu

SEQ ID NO: 98601 - RNA, 65 nt, Human
guccuaguuuccuuaccaaggauaauuaaauauaucacuaagagcuuuauauauugauuauauau

SEQ ID NO: 98602 - RNA, 65 nt, Human
cuuucauuuuauaagaagguugguuuuaaacaauacacuaagaaugacuccuauaaagaaaacaa

SEQ ID NO: 98603 - RNA, 62 nt, Human; identical to SEQ ID NO: 98099

SEQ ID NO: 98604 - RNA, 62 nt, Human; identical to SEQ ID NO: 98100

SEQ ID NO: 98605 - RNA, 62 nt, Human; identical to SEQ ID NO: 98101

SEQ ID NO: 98606 - RNA, 62 nt, Human; identical to SEQ ID NO: 98102

SEQ ID NO: 98607 - RNA, 62 nt, Human; identical to SEQ ID NO: 98103

SEQ ID NO: 98608 - RNA, 62 nt, Human; identical to SEQ ID NO: 98104

SEQ ID NO: 98609 - RNA, 62 nt, Human; identical to SEQ ID NO: 98105

SEQ ID NO: 98610 - RNA, 62 nt, Human; identical to SEQ ID NO: 98106

SEQ ID NO: 98611 - RNA, 62 nt, Human; identical to SEQ ID NO: 98107

SEQ ID NO: 98612 - RNA, 62 nt, Human; identical to SEQ ID NO: 98108

SEQ ID NO: 98613 - RNA, 62 nt, Human; identical to SEQ ID NO: 98109

SEQ ID NO: 98614 - RNA, 62 nt, Human; identical to SEQ ID NO: 98110

SEQ ID NO: 98615 - RNA, 62 nt, Human; identical to SEQ ID NO: 98111

SEQ ID NO: 98616 - RNA, 62 nt, Human; identical to SEQ ID NO: 98112

SEQ ID NO: 98617 - RNA, 62 nt, Human; identical to SEQ ID NO: 98113

SEQ ID NO: 98618 - RNA, 62 nt, Human; identical to SEQ ID NO: 98114

SEQ ID NO: 98619 - RNA, 62 nt, Human; identical to SEQ ID NO: 98115

SEQ ID NO: 98620 - RNA, 62 nt, Human; identical to SEQ ID NO: 98116

SEQ ID NO: 98621 - RNA, 62 nt, Human; identical to SEQ ID NO: 98117

SEQ ID NO: 98622 - RNA, 62 nt, Human; identical to SEQ ID NO: 98118

SEQ ID NO: 98623 - RNA, 62 nt, Human; identical to SEQ ID NO: 98119

SEQ ID NO: 98624 - RNA, 62 nt, Human; identical to SEQ ID NO: 98120

SEQ ID NO: 98625 - RNA, 62 nt, Human; identical to SEQ ID NO: 98121

SEQ ID NO: 98626 - RNA, 62 nt, Human; identical to SEQ ID NO: 98122

SEQ ID NO: 98627 - RNA, 62 nt, Human; identical to SEQ ID NO: 98123

SEQ ID NO: 98628 - RNA, 62 nt, Human; identical to SEQ ID NO: 98124

SEQ ID NO: 98629 - RNA, 62 nt, Human; identical to SEQ ID NO: 98125

SEQ ID NO: 98630 - RNA, 62 nt, Human; identical to SEQ ID NO: 98126

SEQ ID NO: 98631 - RNA, 62 nt, Human; identical to SEQ ID NO: 98127

SEQ ID NO: 98632 - RNA, 62 nt, Human; identical to SEQ ID NO: 98128

SEQ ID NO: 98633 - RNA, 62 nt, Human; identical to SEQ ID NO: 98129

SEQ ID NO: 98634 - RNA, 62 nt, Human; identical to SEQ ID NO: 98130

SEQ ID NO: 98635 - RNA, 62 nt, Human; identical to SEQ ID NO: 98131

SEQ ID NO: 98636 - RNA, 62 nt, Human; identical to SEQ ID NO: 98132

SEQ ID NO: 98637 - RNA, 62 nt, Human; identical to SEQ ID NO: 98133

SEQ ID NO: 98638 - RNA, 62 nt, Human; identical to SEQ ID NO: 98134

SEQ ID NO: 98639 - RNA, 62 nt, Human; identical to SEQ ID NO: 98135

SEQ ID NO: 98640 - RNA, 62 nt, Human; identical to SEQ ID NO: 98136

SEQ ID NO: 98641 - RNA, 62 nt, Human; identical to SEQ ID NO: 98137

SEQ ID NO: 98642 - RNA, 62 nt, Human; identical to SEQ ID NO: 98138

SEQ ID NO: 98643 - RNA, 62 nt, Human; identical to SEQ ID NO: 98139

SEQ ID NO: 98644 - RNA, 62 nt, Human; identical to SEQ ID NO: 98140

SEQ ID NO: 98645 - RNA, 62 nt, Human; identical to SEQ ID NO: 98141

SEQ ID NO: 98646 - RNA, 62 nt, Human; identical to SEQ ID NO: 98142

SEQ ID NO: 98647 - RNA, 62 nt, Human; identical to SEQ ID NO: 98143

SEQ ID NO: 98648 - RNA, 62 nt, Human; identical to SEQ ID NO: 98144

SEQ ID NO: 98649 - RNA, 62 nt, Human; identical to SEQ ID NO: 98145

SEQ ID NO: 98650 - RNA, 62 nt, Human; identical to SEQ ID NO: 98146

SEQ ID NO: 98651 - RNA, 62 nt, Human; identical to SEQ ID NO: 98147

SEQ ID NO: 98652 - RNA, 62 nt, Human; identical to SEQ ID NO: 98148

SEQ ID NO: 98653 - RNA, 62 nt, Human; identical to SEQ ID NO: 98149

SEQ ID NO: 98654 - RNA, 62 nt, Human; identical to SEQ ID NO: 98150

SEQ ID NO: 98655 - RNA, 62 nt, Human; identical to SEQ ID NO: 98151

SEQ ID NO: 98656 - RNA, 62 nt, Human; identical to SEQ ID NO: 98152

SEQ ID NO: 98657 - RNA, 62 nt, Human; identical to SEQ ID NO: 98153

SEQ ID NO: 98658 - RNA, 62 nt, Human; identical to SEQ ID NO: 98154

SEQ ID NO: 98659 - RNA, 62 nt, Human; identical to SEQ ID NO: 98155

SEQ ID NO: 98660 - RNA, 62 nt, Human; identical to SEQ ID NO: 98156

SEQ ID NO: 98661 - RNA, 62 nt, Human; identical to SEQ ID NO: 98157

SEQ ID NO: 98662 - RNA, 62 nt, Human; identical to SEQ ID NO: 98158

SEQ ID NO: 98663 - RNA, 62 nt, Human; identical to SEQ ID NO: 98159

SEQ ID NO: 98664 - RNA, 62 nt, Human; identical to SEQ ID NO: 98160

SEQ ID NO: 98665 - RNA, 62 nt, Human; identical to SEQ ID NO: 98161

SEQ ID NO: 98666 - RNA, 62 nt, Human; identical to SEQ ID NO: 98162

SEQ ID NO: 98667 - RNA, 62 nt, Human; identical to SEQ ID NO: 98163

SEQ ID NO: 98668 - RNA, 62 nt, Human; identical to SEQ ID NO: 98164

SEQ ID NO: 98669 - RNA, 62 nt, Human; identical to SEQ ID NO: 98165

SEQ ID NO: 98670 - RNA, 62 nt, Human; identical to SEQ ID NO: 98166

SEQ ID NO: 98671 - RNA, 62 nt, Human; identical to SEQ ID NO: 98167

SEQ ID NO: 98672 - RNA, 62 nt, Human; identical to SEQ ID NO: 98168

SEQ ID NO: 98673 - RNA, 62 nt, Human; identical to SEQ ID NO: 98169

SEQ ID NO: 98674 - RNA, 62 nt, Human; identical to SEQ ID NO: 98170

SEQ ID NO: 98675 - RNA, 62 nt, Human; identical to SEQ ID NO: 98171

SEQ ID NO: 98676 - RNA, 62 nt, Human; identical to SEQ ID NO: 98172

SEQ ID NO: 98677 - RNA, 62 nt, Human; identical to SEQ ID NO: 98173

SEQ ID NO: 98678 - RNA, 53 nt, Human; identical to SEQ ID NO: 98174

SEQ ID NO: 98679 - RNA, 62 nt, Human; identical to SEQ ID NO: 98175

SEQ ID NO: 98680 - RNA, 62 nt, Human; identical to SEQ ID NO: 98176

SEQ ID NO: 98681 - RNA, 62 nt, Human; identical to SEQ ID NO: 98177

SEQ ID NO: 98682 - RNA, 62 nt, Human; identical to SEQ ID NO: 98178

SEQ ID NO: 98683 - RNA, 62 nt, Human; identical to SEQ ID NO: 98179

SEQ ID NO: 98684 - RNA, 62 nt, Human; identical to SEQ ID NO: 98180

SEQ ID NO: 98685 - RNA, 62 nt, Human; identical to SEQ ID NO: 98181

SEQ ID NO: 98686 - RNA, 62 nt, Human; identical to SEQ ID NO: 98182

SEQ ID NO: 98687 - RNA, 62 nt, Human; identical to SEQ ID NO: 98183

SEQ ID NO: 98688 - RNA, 62 nt, Human; identical to SEQ ID NO: 98184

SEQ ID NO: 98689 - RNA, 62 nt, Human; identical to SEQ ID NO: 98185

SEQ ID NO: 98690 - RNA, 62 nt, Human; identical to SEQ ID NO: 98186

SEQ ID NO: 98691 - RNA, 62 nt, Human; identical to SEQ ID NO: 98187

SEQ ID NO: 98692 - RNA, 62 nt, Human; identical to SEQ ID NO: 98188

SEQ ID NO: 98693 - RNA, 62 nt, Human; identical to SEQ ID NO: 98189

SEQ ID NO: 98694 - RNA, 62 nt, Human; identical to SEQ ID NO: 98190

SEQ ID NO: 98695 - RNA, 62 nt, Human; identical to SEQ ID NO: 98191

SEQ ID NO: 98696 - RNA, 62 nt, Human; identical to SEQ ID NO: 98192

SEQ ID NO: 98697 - RNA, 62 nt, Human; identical to SEQ ID NO: 98193

SEQ ID NO: 98698 - RNA, 62 nt, Human; identical to SEQ ID NO: 98194

SEQ ID NO: 98699 - RNA, 62 nt, Human; identical to SEQ ID NO: 98195

SEQ ID NO: 98700 - RNA, 62 nt, Human; identical to SEQ ID NO: 98196

SEQ ID NO: 98701 - RNA, 62 nt, Human; identical to SEQ ID NO: 98197

SEQ ID NO: 98702 - RNA, 62 nt, Human; identical to SEQ ID NO: 98198

SEQ ID NO: 98703 - RNA, 62 nt, Human; identical to SEQ ID NO: 98199

SEQ ID NO: 98704 - RNA, 62 nt, Human; identical to SEQ ID NO: 98200

SEQ ID NO: 98705 - RNA, 62 nt, Human; identical to SEQ ID NO: 98201

SEQ ID NO: 98706 - RNA, 62 nt, Human; identical to SEQ ID NO: 98202

SEQ ID NO: 98707 - RNA, 62 nt, Human; identical to SEQ ID NO: 98203

SEQ ID NO: 98708 - RNA, 62 nt, Human; identical to SEQ ID NO: 98204

SEQ ID NO: 98709 - RNA, 62 nt, Human; identical to SEQ ID NO: 98205

SEQ ID NO: 98710 - RNA, 62 nt, Human; identical to SEQ ID NO: 98206

SEQ ID NO: 98711 - RNA, 62 nt, Human; identical to SEQ ID NO: 98207

SEQ ID NO: 98712 - RNA, 62 nt, Human; identical to SEQ ID NO: 98208

SEQ ID NO: 98713 - RNA, 62 nt, Human; identical to SEQ ID NO: 98209

SEQ ID NO: 98714 - RNA, 62 nt, Human; identical to SEQ ID NO: 98210

SEQ ID NO: 98715 - RNA, 62 nt, Human; identical to SEQ ID NO: 98211

SEQ ID NO: 98716 - RNA, 62 nt, Human; identical to SEQ ID NO: 98212

SEQ ID NO: 98717 - RNA, 62 nt, Human; identical to SEQ ID NO: 98213

SEQ ID NO: 98718 - RNA, 62 nt, Human; identical to SEQ ID NO: 98214

SEQ ID NO: 98719 - RNA, 62 nt, Human; identical to SEQ ID NO: 98215

SEQ ID NO: 98720 - RNA, 62 nt, Human; identical to SEQ ID NO: 98216

SEQ ID NO: 98721 - RNA, 62 nt, Human; identical to SEQ ID NO: 98217

SEQ ID NO: 98722 - RNA, 62 nt, Human; identical to SEQ ID NO: 98218

SEQ ID NO: 98723 - RNA, 62 nt, Human; identical to SEQ ID NO: 98219

SEQ ID NO: 98724 - RNA, 62 nt, Human; identical to SEQ ID NO: 98220

SEQ ID NO: 98725 - RNA, 62 nt, Human; identical to SEQ ID NO: 98221

SEQ ID NO: 98726 - RNA, 62 nt, Human; identical to SEQ ID NO: 98222

SEQ ID NO: 98727 - RNA, 62 nt, Human; identical to SEQ ID NO: 98223

SEQ ID NO: 98728 - RNA, 62 nt, Human; identical to SEQ ID NO: 98224

SEQ ID NO: 98729 - RNA, 62 nt, Human; identical to SEQ ID NO: 98225

SEQ ID NO: 98730 - RNA, 62 nt, Human; identical to SEQ ID NO: 98226

SEQ ID NO: 98731 - RNA, 62 nt, Human; identical to SEQ ID NO: 98227

SEQ ID NO: 98732 - RNA, 62 nt, Human; identical to SEQ ID NO: 98228

SEQ ID NO: 98733 - RNA, 62 nt, Human; identical to SEQ ID NO: 98229

SEQ ID NO: 98734 - RNA, 62 nt, Human; identical to SEQ ID NO: 98230

SEQ ID NO: 98735 - RNA, 62 nt, Human; identical to SEQ ID NO: 98231

SEQ ID NO: 98736 - RNA, 62 nt, Human; identical to SEQ ID NO: 98232

SEQ ID NO: 98737 - RNA, 62 nt, Human; identical to SEQ ID NO: 98233

SEQ ID NO: 98738 - RNA, 62 nt, Human; identical to SEQ ID NO: 98234

SEQ ID NO: 98739 - RNA, 62 nt, Human; identical to SEQ ID NO: 98235

SEQ ID NO: 98740 - RNA, 62 nt, Human; identical to SEQ ID NO: 98236

SEQ ID NO: 98741 - RNA, 62 nt, Human; identical to SEQ ID NO: 98237

SEQ ID NO: 98742 - RNA, 62 nt, Human; identical to SEQ ID NO: 98238

SEQ ID NO: 98743 - RNA, 62 nt, Human; identical to SEQ ID NO: 98239

SEQ ID NO: 98744 - RNA, 62 nt, Human; identical to SEQ ID NO: 98240

SEQ ID NO: 98745 - RNA, 62 nt, Human; identical to SEQ ID NO: 98241

SEQ ID NO: 98746 - RNA, 62 nt, Human; identical to SEQ ID NO: 98242

SEQ ID NO: 98747 - RNA, 62 nt, Human; identical to SEQ ID NO: 98243

SEQ ID NO: 98748 - RNA, 62 nt, Human; identical to SEQ ID NO: 98244

SEQ ID NO: 98749 - RNA, 62 nt, Human; identical to SEQ ID NO: 98245

SEQ ID NO: 98750 - RNA, 62 nt, Human; identical to SEQ ID NO: 98246

SEQ ID NO: 98751 - RNA, 62 nt, Human; identical to SEQ ID NO: 98247

SEQ ID NO: 98752 - RNA, 62 nt, Human; identical to SEQ ID NO: 98248

SEQ ID NO: 98753 - RNA, 62 nt, Human; identical to SEQ ID NO: 98249

SEQ ID NO: 98754 - RNA, 62 nt, Human; identical to SEQ ID NO: 98250

SEQ ID NO: 98755 - RNA, 62 nt, Human; identical to SEQ ID NO: 98251

SEQ ID NO: 98756 - RNA, 62 nt, Human; identical to SEQ ID NO: 98252

SEQ ID NO: 98757 - RNA, 62 nt, Human; identical to SEQ ID NO: 98253

SEQ ID NO: 98758 - RNA, 62 nt, Human; identical to SEQ ID NO: 98254

SEQ ID NO: 98759 - RNA, 62 nt, Human; identical to SEQ ID NO: 98255

SEQ ID NO: 98760 - RNA, 62 nt, Human; identical to SEQ ID NO: 98256

SEQ ID NO: 98761 - RNA, 62 nt, Human; identical to SEQ ID NO: 98257

SEQ ID NO: 98762 - RNA, 62 nt, Human; identical to SEQ ID NO: 98258

SEQ ID NO: 98763 - RNA, 62 nt, Human; identical to SEQ ID NO: 98259

SEQ ID NO: 98764 - RNA, 62 nt, Human; identical to SEQ ID NO: 98260

SEQ ID NO: 98765 - RNA, 62 nt, Human; identical to SEQ ID NO: 98261

SEQ ID NO: 98766 - RNA, 62 nt, Human; identical to SEQ ID NO: 98262

SEQ ID NO: 98767 - RNA, 62 nt, Human; identical to SEQ ID NO: 98263

SEQ ID NO: 98768 - RNA, 62 nt, Human; identical to SEQ ID NO: 98264

SEQ ID NO: 98769 - RNA, 62 nt, Human; identical to SEQ ID NO: 98265

SEQ ID NO: 98770 - RNA, 62 nt, Human; identical to SEQ ID NO: 98266

SEQ ID NO: 98771 - RNA, 63 nt, Human; identical to SEQ ID NO: 98267

SEQ ID NO: 98772 - RNA, 63 nt, Human; identical to SEQ ID NO: 98268

SEQ ID NO: 98773 - RNA, 63 nt, Human; identical to SEQ ID NO: 98269

SEQ ID NO: 98774 - RNA, 63 nt, Human; identical to SEQ ID NO: 98270

SEQ ID NO: 98775 - RNA, 63 nt, Human; identical to SEQ ID NO: 98271

SEQ ID NO: 98776 - RNA, 63 nt, Human; identical to SEQ ID NO: 98272

SEQ ID NO: 98777 - RNA, 63 nt, Human; identical to SEQ ID NO: 98273

SEQ ID NO: 98778 - RNA, 63 nt, Human; identical to SEQ ID NO: 98274

SEQ ID NO: 98779 - RNA, 63 nt, Human; identical to SEQ ID NO: 98275

SEQ ID NO: 98780 - RNA, 63 nt, Human; identical to SEQ ID NO: 98276

SEQ ID NO: 98781 - RNA, 63 nt, Human; identical to SEQ ID NO: 98277

SEQ ID NO: 98782 - RNA, 63 nt, Human; identical to SEQ ID NO: 98278

SEQ ID NO: 98783 - RNA, 63 nt, Human; identical to SEQ ID NO: 98279

SEQ ID NO: 98784 - RNA, 63 nt, Human; identical to SEQ ID NO: 98280

SEQ ID NO: 98785 - RNA, 63 nt, Human; identical to SEQ ID NO: 98281

SEQ ID NO: 98786 - RNA, 63 nt, Human; identical to SEQ ID NO: 98282

SEQ ID NO: 98787 - RNA, 63 nt, Human; identical to SEQ ID NO: 98283

SEQ ID NO: 98788 - RNA, 63 nt, Human; identical to SEQ ID NO: 98284

SEQ ID NO: 98789 - RNA, 63 nt, Human; identical to SEQ ID NO: 98285

SEQ ID NO: 98790 - RNA, 63 nt, Human; identical to SEQ ID NO: 98286

SEQ ID NO: 98791 - RNA, 63 nt, Human; identical to SEQ ID NO: 98287

SEQ ID NO: 98792 - RNA, 63 nt, Human; identical to SEQ ID NO: 98288

SEQ ID NO: 98793 - RNA, 63 nt, Human; identical to SEQ ID NO: 98289

SEQ ID NO: 98794 - RNA, 63 nt, Human; identical to SEQ ID NO: 98290

SEQ ID NO: 98795 - RNA, 63 nt, Human; identical to SEQ ID NO: 98291

SEQ ID NO: 98796 - RNA, 63 nt, Human; identical to SEQ ID NO: 98292

SEQ ID NO: 98797 - RNA, 63 nt, Human; identical to SEQ ID NO: 98293

SEQ ID NO: 98798 - RNA, 63 nt, Human; identical to SEQ ID NO: 98294

SEQ ID NO: 98799 - RNA, 63 nt, Human; identical to SEQ ID NO: 98295

SEQ ID NO: 98800 - RNA, 63 nt, Human; identical to SEQ ID NO: 98296

SEQ ID NO: 98801 - RNA, 63 nt, Human; identical to SEQ ID NO: 98297

SEQ ID NO: 98802 - RNA, 63 nt, Human; identical to SEQ ID NO: 98298

SEQ ID NO: 98803 - RNA, 63 nt, Human; identical to SEQ ID NO: 98299

SEQ ID NO: 98804 - RNA, 62 nt, Human; identical to SEQ ID NO: 98132

SEQ ID NO: 98805 - RNA, 63 nt, Human; identical to SEQ ID NO: 98301

SEQ ID NO: 98806 - RNA, 63 nt, Human; identical to SEQ ID NO: 98302

SEQ ID NO: 98807 - RNA, 63 nt, Human; identical to SEQ ID NO: 98303

SEQ ID NO: 98808 - RNA, 63 nt, Human; identical to SEQ ID NO: 98304

SEQ ID NO: 98809 - RNA, 63 nt, Human; identical to SEQ ID NO: 98305

SEQ ID NO: 98810 - RNA, 63 nt, Human; identical to SEQ ID NO: 98306

SEQ ID NO: 98811 - RNA, 63 nt, Human; identical to SEQ ID NO: 98307

SEQ ID NO: 98812 - RNA, 63 nt, Human; identical to SEQ ID NO: 98308

SEQ ID NO: 98813 - RNA, 63 nt, Human; identical to SEQ ID NO: 98309

SEQ ID NO: 98814 - RNA, 63 nt, Human; identical to SEQ ID NO: 98310

SEQ ID NO: 98815 - RNA, 63 nt, Human; identical to SEQ ID NO: 98311

SEQ ID NO: 98816 - RNA, 63 nt, Human; identical to SEQ ID NO: 98312

SEQ ID NO: 98817 - RNA, 63 nt, Human; identical to SEQ ID NO: 98313

SEQ ID NO: 98818 - RNA, 63 nt, Human; identical to SEQ ID NO: 98314

SEQ ID NO: 98819 - RNA, 63 nt, Human; identical to SEQ ID NO: 98315

SEQ ID NO: 98820 - RNA, 63 nt, Human; identical to SEQ ID NO: 98316

SEQ ID NO: 98821 - RNA, 63 nt, Human; identical to SEQ ID NO: 98317

SEQ ID NO: 98822 - RNA, 63 nt, Human; identical to SEQ ID NO: 98318

SEQ ID NO: 98823 - RNA, 63 nt, Human; identical to SEQ ID NO: 98319

SEQ ID NO: 98824 - RNA, 63 nt, Human; identical to SEQ ID NO: 98320

SEQ ID NO: 98825 - RNA, 63 nt, Human; identical to SEQ ID NO: 98321

SEQ ID NO: 98826 - RNA, 63 nt, Human; identical to SEQ ID NO: 98322

SEQ ID NO: 98827 - RNA, 63 nt, Human; identical to SEQ ID NO: 98323

SEQ ID NO: 98828 - RNA, 63 nt, Human; identical to SEQ ID NO: 98324

SEQ ID NO: 98829 - RNA, 63 nt, Human; identical to SEQ ID NO: 98325

SEQ ID NO: 98830 - RNA, 63 nt, Human; identical to SEQ ID NO: 98326

SEQ ID NO: 98831 - RNA, 63 nt, Human; identical to SEQ ID NO: 98327

SEQ ID NO: 98832 - RNA, 63 nt, Human; identical to SEQ ID NO: 98328

SEQ ID NO: 98833 - RNA, 63 nt, Human; identical to SEQ ID NO: 98329

SEQ ID NO: 98834 - RNA, 63 nt, Human; identical to SEQ ID NO: 98330

SEQ ID NO: 98835 - RNA, 63 nt, Human; identical to SEQ ID NO: 98331

SEQ ID NO: 98836 - RNA, 63 nt, Human; identical to SEQ ID NO: 98332

SEQ ID NO: 98837 - RNA, 63 nt, Human; identical to SEQ ID NO: 98333

SEQ ID NO: 98838 - RNA, 63 nt, Human; identical to SEQ ID NO: 98334

SEQ ID NO: 98839 - RNA, 63 nt, Human; identical to SEQ ID NO: 98335

SEQ ID NO: 98840 - RNA, 63 nt, Human; identical to SEQ ID NO: 98336

SEQ ID NO: 98841 - RNA, 63 nt, Human; identical to SEQ ID NO: 98337

SEQ ID NO: 98842 - RNA, 63 nt, Human; identical to SEQ ID NO: 98338

SEQ ID NO: 98843 - RNA, 63 nt, Human; identical to SEQ ID NO: 98339

SEQ ID NO: 98844 - RNA, 63 nt, Human; identical to SEQ ID NO: 98340

SEQ ID NO: 98845 - RNA, 63 nt, Human; identical to SEQ ID NO: 98341

SEQ ID NO: 98846 - RNA, 53 nt, Human; identical to SEQ ID NO: 98174

SEQ ID NO: 98847 - RNA, 63 nt, Human; identical to SEQ ID NO: 98343

SEQ ID NO: 98848 - RNA, 63 nt, Human; identical to SEQ ID NO: 98344

SEQ ID NO: 98849 - RNA, 63 nt, Human; identical to SEQ ID NO: 98345

SEQ ID NO: 98850 - RNA, 63 nt, Human; identical to SEQ ID NO: 98346

SEQ ID NO: 98851 - RNA, 63 nt, Human; identical to SEQ ID NO: 98347

SEQ ID NO: 98852 - RNA, 63 nt, Human; identical to SEQ ID NO: 98348

SEQ ID NO: 98853 - RNA, 63 nt, Human; identical to SEQ ID NO: 98349

SEQ ID NO: 98854 - RNA, 63 nt, Human; identical to SEQ ID NO: 98350

SEQ ID NO: 98855 - RNA, 63 nt, Human; identical to SEQ ID NO: 98351

SEQ ID NO: 98856 - RNA, 63 nt, Human; identical to SEQ ID NO: 98352

SEQ ID NO: 98857 - RNA, 63 nt, Human; identical to SEQ ID NO: 98353

SEQ ID NO: 98858 - RNA, 63 nt, Human; identical to SEQ ID NO: 98354

SEQ ID NO: 98859 - RNA, 63 nt, Human; identical to SEQ ID NO: 98355

SEQ ID NO: 98860 - RNA, 63 nt, Human; identical to SEQ ID NO: 98356

SEQ ID NO: 98861 - RNA, 63 nt, Human; identical to SEQ ID NO: 98357

SEQ ID NO: 98862 - RNA, 63 nt, Human; identical to SEQ ID NO: 98358

SEQ ID NO: 98863 - RNA, 63 nt, Human; identical to SEQ ID NO: 98359

SEQ ID NO: 98864 - RNA, 63 nt, Human; identical to SEQ ID NO: 98360

SEQ ID NO: 98865 - RNA, 63 nt, Human; identical to SEQ ID NO: 98361

SEQ ID NO: 98866 - RNA, 63 nt, Human; identical to SEQ ID NO: 98362

SEQ ID NO: 98867 - RNA, 63 nt, Human; identical to SEQ ID NO: 98363

SEQ ID NO: 98868 - RNA, 63 nt, Human; identical to SEQ ID NO: 98364

SEQ ID NO: 98869 - RNA, 63 nt, Human; identical to SEQ ID NO: 98365

SEQ ID NO: 98870 - RNA, 63 nt, Human; identical to SEQ ID NO: 98366

SEQ ID NO: 98871 - RNA, 63 nt, Human; identical to SEQ ID NO: 98367

SEQ ID NO: 98872 - RNA, 63 nt, Human; identical to SEQ ID NO: 98368

SEQ ID NO: 98873 - RNA, 63 nt, Human; identical to SEQ ID NO: 98369

SEQ ID NO: 98874 - RNA, 63 nt, Human; identical to SEQ ID NO: 98370

SEQ ID NO: 98875 - RNA, 63 nt, Human; identical to SEQ ID NO: 98371

SEQ ID NO: 98876 - RNA, 63 nt, Human; identical to SEQ ID NO: 98372

SEQ ID NO: 98877 - RNA, 63 nt, Human; identical to SEQ ID NO: 98373

SEQ ID NO: 98878 - RNA, 63 nt, Human; identical to SEQ ID NO: 98374

SEQ ID NO: 98879 - RNA, 63 nt, Human; identical to SEQ ID NO: 98375

SEQ ID NO: 98880 - RNA, 63 nt, Human; identical to SEQ ID NO: 98376

SEQ ID NO: 98881 - RNA, 63 nt, Human; identical to SEQ ID NO: 98377

SEQ ID NO: 98882 - RNA, 63 nt, Human; identical to SEQ ID NO: 98378

SEQ ID NO: 98883 - RNA, 63 nt, Human; identical to SEQ ID NO: 98379

SEQ ID NO: 98884 - RNA, 63 nt, Human; identical to SEQ ID NO: 98380

SEQ ID NO: 98885 - RNA, 63 nt, Human; identical to SEQ ID NO: 98381

SEQ ID NO: 98886 - RNA, 63 nt, Human; identical to SEQ ID NO: 98382

SEQ ID NO: 98887 - RNA, 63 nt, Human; identical to SEQ ID NO: 98383

SEQ ID NO: 98888 - RNA, 63 nt, Human; identical to SEQ ID NO: 98384

SEQ ID NO: 98889 - RNA, 63 nt, Human; identical to SEQ ID NO: 98385

SEQ ID NO: 98890 - RNA, 63 nt, Human; identical to SEQ ID NO: 98386

SEQ ID NO: 98891 - RNA, 63 nt, Human; identical to SEQ ID NO: 98387

SEQ ID NO: 98892 - RNA, 63 nt, Human; identical to SEQ ID NO: 98388

SEQ ID NO: 98893 - RNA, 63 nt, Human; identical to SEQ ID NO: 98389

SEQ ID NO: 98894 - RNA, 63 nt, Human; identical to SEQ ID NO: 98390

SEQ ID NO: 98895 - RNA, 63 nt, Human; identical to SEQ ID NO: 98391

SEQ ID NO: 98896 - RNA, 63 nt, Human; identical to SEQ ID NO: 98392

SEQ ID NO: 98897 - RNA, 63 nt, Human; identical to SEQ ID NO: 98393

SEQ ID NO: 98898 - RNA, 63 nt, Human; identical to SEQ ID NO: 98394

SEQ ID NO: 98899 - RNA, 63 nt, Human; identical to SEQ ID NO: 98395

SEQ ID NO: 98900 - RNA, 63 nt, Human; identical to SEQ ID NO: 98396

SEQ ID NO: 98901 - RNA, 63 nt, Human; identical to SEQ ID NO: 98397

SEQ ID NO: 98902 - RNA, 63 nt, Human; identical to SEQ ID NO: 98398

SEQ ID NO: 98903 - RNA, 63 nt, Human; identical to SEQ ID NO: 98399

SEQ ID NO: 98904 - RNA, 63 nt, Human; identical to SEQ ID NO: 98400

SEQ ID NO: 98905 - RNA, 63 nt, Human; identical to SEQ ID NO: 98401

SEQ ID NO: 98906 - RNA, 63 nt, Human; identical to SEQ ID NO: 98402

SEQ ID NO: 98907 - RNA, 63 nt, Human; identical to SEQ ID NO: 98403

SEQ ID NO: 98908 - RNA, 63 nt, Human; identical to SEQ ID NO: 98404

SEQ ID NO: 98909 - RNA, 63 nt, Human; identical to SEQ ID NO: 98405

SEQ ID NO: 98910 - RNA, 63 nt, Human; identical to SEQ ID NO: 98406

SEQ ID NO: 98911 - RNA, 63 nt, Human; identical to SEQ ID NO: 98407

SEQ ID NO: 98912 - RNA, 63 nt, Human; identical to SEQ ID NO: 98408

SEQ ID NO: 98913 - RNA, 63 nt, Human; identical to SEQ ID NO: 98409

SEQ ID NO: 98914 - RNA, 63 nt, Human; identical to SEQ ID NO: 98410

SEQ ID NO: 98915 - RNA, 63 nt, Human; identical to SEQ ID NO: 98411

SEQ ID NO: 98916 - RNA, 63 nt, Human; identical to SEQ ID NO: 98412

SEQ ID NO: 98917 - RNA, 63 nt, Human; identical to SEQ ID NO: 98413

SEQ ID NO: 98918 - RNA, 63 nt, Human; identical to SEQ ID NO: 98414

SEQ ID NO: 98919 - RNA, 63 nt, Human; identical to SEQ ID NO: 98415

SEQ ID NO: 98920 - RNA, 63 nt, Human; identical to SEQ ID NO: 98416

SEQ ID NO: 98921 - RNA, 63 nt, Human; identical to SEQ ID NO: 98417

SEQ ID NO: 98922 - RNA, 63 nt, Human; identical to SEQ ID NO: 98418

SEQ ID NO: 98923 - RNA, 63 nt, Human; identical to SEQ ID NO: 98419

SEQ ID NO: 98924 - RNA, 63 nt, Human; identical to SEQ ID NO: 98420

SEQ ID NO: 98925 - RNA, 63 nt, Human; identical to SEQ ID NO: 98421

SEQ ID NO: 98926 - RNA, 63 nt, Human; identical to SEQ ID NO: 98422

SEQ ID NO: 98927 - RNA, 63 nt, Human; identical to SEQ ID NO: 98423

SEQ ID NO: 98928 - RNA, 63 nt, Human; identical to SEQ ID NO: 98424

SEQ ID NO: 98929 - RNA, 63 nt, Human; identical to SEQ ID NO: 98425

SEQ ID NO: 98930 - RNA, 63 nt, Human; identical to SEQ ID NO: 98426

SEQ ID NO: 98931 - RNA, 63 nt, Human; identical to SEQ ID NO: 98427

SEQ ID NO: 98932 - RNA, 63 nt, Human; identical to SEQ ID NO: 98428

SEQ ID NO: 98933 - RNA, 63 nt, Human; identical to SEQ ID NO: 98429

SEQ ID NO: 98934 - RNA, 63 nt, Human; identical to SEQ ID NO: 98430

SEQ ID NO: 98935 - RNA, 63 nt, Human; identical to SEQ ID NO: 98431

SEQ ID NO: 98936 - RNA, 63 nt, Human; identical to SEQ ID NO: 98432

SEQ ID NO: 98937 - RNA, 63 nt, Human; identical to SEQ ID NO: 98433

SEQ ID NO: 98938 - RNA, 63 nt, Human; identical to SEQ ID NO: 98434

SEQ ID NO: 98939 - RNA, 65 nt, Human; identical to SEQ ID NO: 98435

SEQ ID NO: 98940 - RNA, 65 nt, Human; identical to SEQ ID NO: 98436

SEQ ID NO: 98941 - RNA, 65 nt, Human; identical to SEQ ID NO: 98437

SEQ ID NO: 98942 - RNA, 65 nt, Human; identical to SEQ ID NO: 98438

SEQ ID NO: 98943 - RNA, 65 nt, Human; identical to SEQ ID NO: 98439

SEQ ID NO: 98944 - RNA, 65 nt, Human; identical to SEQ ID NO: 98440

SEQ ID NO: 98945 - RNA, 65 nt, Human; identical to SEQ ID NO: 98441

SEQ ID NO: 98946 - RNA, 65 nt, Human; identical to SEQ ID NO: 98442

SEQ ID NO: 98947 - RNA, 65 nt, Human; identical to SEQ ID NO: 98443

SEQ ID NO: 98948 - RNA, 65 nt, Human; identical to SEQ ID NO: 98444

SEQ ID NO: 98949 - RNA, 65 nt, Human; identical to SEQ ID NO: 98445

SEQ ID NO: 98950 - RNA, 65 nt, Human; identical to SEQ ID NO: 98446

SEQ ID NO: 98951 - RNA, 65 nt, Human; identical to SEQ ID NO: 98447

SEQ ID NO: 98952 - RNA, 65 nt, Human; identical to SEQ ID NO: 98448

SEQ ID NO: 98953 - RNA, 65 nt, Human; identical to SEQ ID NO: 98449

SEQ ID NO: 98954 - RNA, 65 nt, Human; identical to SEQ ID NO: 98450

SEQ ID NO: 98955 - RNA, 65 nt, Human; identical to SEQ ID NO: 98451

SEQ ID NO: 98956 - RNA, 65 nt, Human; identical to SEQ ID NO: 98452

SEQ ID NO: 98957 - RNA, 65 nt, Human; identical to SEQ ID NO: 98453

SEQ ID NO: 98958 - RNA, 65 nt, Human; identical to SEQ ID NO: 98454

SEQ ID NO: 98959 - RNA, 65 nt, Human; identical to SEQ ID NO: 98455

SEQ ID NO: 98960 - RNA, 65 nt, Human; identical to SEQ ID NO: 98456

SEQ ID NO: 98961 - RNA, 65 nt, Human; identical to SEQ ID NO: 98457

SEQ ID NO: 98962 - RNA, 65 nt, Human; identical to SEQ ID NO: 98458

SEQ ID NO: 98963 - RNA, 65 nt, Human; identical to SEQ ID NO: 98459

SEQ ID NO: 98964 - RNA, 65 nt, Human; identical to SEQ ID NO: 98460

SEQ ID NO: 98965 - RNA, 65 nt, Human; identical to SEQ ID NO: 98461

SEQ ID NO: 98966 - RNA, 65 nt, Human; identical to SEQ ID NO: 98462

SEQ ID NO: 98967 - RNA, 65 nt, Human; identical to SEQ ID NO: 98463

SEQ ID NO: 98968 - RNA, 65 nt, Human; identical to SEQ ID NO: 98464

SEQ ID NO: 98969 - RNA, 65 nt, Human; identical to SEQ ID NO: 98465

SEQ ID NO: 98970 - RNA, 65 nt, Human; identical to SEQ ID NO: 98466

SEQ ID NO: 98971 - RNA, 65 nt, Human; identical to SEQ ID NO: 98467

SEQ ID NO: 98972 - RNA, 62 nt, Human; identical to SEQ ID NO: 98132

SEQ ID NO: 98973 - RNA, 65 nt, Human; identical to SEQ ID NO: 98469

SEQ ID NO: 98974 - RNA, 65 nt, Human; identical to SEQ ID NO: 98470

SEQ ID NO: 98975 - RNA, 65 nt, Human; identical to SEQ ID NO: 98471

SEQ ID NO: 98976 - RNA, 65 nt, Human; identical to SEQ ID NO: 98472

SEQ ID NO: 98977 - RNA, 65 nt, Human; identical to SEQ ID NO: 98473

SEQ ID NO: 98978 - RNA, 65 nt, Human; identical to SEQ ID NO: 98474

SEQ ID NO: 98979 - RNA, 65 nt, Human; identical to SEQ ID NO: 98475

SEQ ID NO: 98980 - RNA, 65 nt, Human; identical to SEQ ID NO: 98476

SEQ ID NO: 98981 - RNA, 65 nt, Human; identical to SEQ ID NO: 98477

SEQ ID NO: 98982 - RNA, 65 nt, Human; identical to SEQ ID NO: 98478

SEQ ID NO: 98983 - RNA, 65 nt, Human; identical to SEQ ID NO: 98479

SEQ ID NO: 98984 - RNA, 65 nt, Human; identical to SEQ ID NO: 98480

SEQ ID NO: 98985 - RNA, 65 nt, Human; identical to SEQ ID NO: 98481

SEQ ID NO: 98986 - RNA, 65 nt, Human; identical to SEQ ID NO: 98482

SEQ ID NO: 98987 - RNA, 65 nt, Human; identical to SEQ ID NO: 98483

SEQ ID NO: 98988 - RNA, 65 nt, Human; identical to SEQ ID NO: 98484

SEQ ID NO: 98989 - RNA, 65 nt, Human; identical to SEQ ID NO: 98485

SEQ ID NO: 98990 - RNA, 65 nt, Human; identical to SEQ ID NO: 98486

SEQ ID NO: 98991 - RNA, 65 nt, Human; identical to SEQ ID NO: 98487

SEQ ID NO: 98992 - RNA, 65 nt, Human; identical to SEQ ID NO: 98488

SEQ ID NO: 98993 - RNA, 65 nt, Human; identical to SEQ ID NO: 98489

SEQ ID NO: 98994 - RNA, 65 nt, Human; identical to SEQ ID NO: 98490

SEQ ID NO: 98995 - RNA, 65 nt, Human; identical to SEQ ID NO: 98491

SEQ ID NO: 98996 - RNA, 65 nt, Human; identical to SEQ ID NO: 98492

SEQ ID NO: 98997 - RNA, 65 nt, Human; identical to SEQ ID NO: 98493

SEQ ID NO: 98998 - RNA, 65 nt, Human; identical to SEQ ID NO: 98494

SEQ ID NO: 98999 - RNA, 65 nt, Human; identical to SEQ ID NO: 98495

SEQ ID NO: 99000 - RNA, 65 nt, Human; identical to SEQ ID NO: 98496

SEQ ID NO: 99001 - RNA, 65 nt, Human; identical to SEQ ID NO: 98497

SEQ ID NO: 99002 - RNA, 65 nt, Human; identical to SEQ ID NO: 98498

SEQ ID NO: 99003 - RNA, 65 nt, Human; identical to SEQ ID NO: 98499

SEQ ID NO: 99004 - RNA, 65 nt, Human; identical to SEQ ID NO: 98500

SEQ ID NO: 99005 - RNA, 65 nt, Human; identical to SEQ ID NO: 98501

SEQ ID NO: 99006 - RNA, 65 nt, Human; identical to SEQ ID NO: 98502

SEQ ID NO: 99007 - RNA, 65 nt, Human; identical to SEQ ID NO: 98503

SEQ ID NO: 99008 - RNA, 65 nt, Human; identical to SEQ ID NO: 98504

SEQ ID NO: 99009 - RNA, 65 nt, Human; identical to SEQ ID NO: 98505

SEQ ID NO: 99010 - RNA, 65 nt, Human; identical to SEQ ID NO: 98506

SEQ ID NO: 99011 - RNA, 65 nt, Human; identical to SEQ ID NO: 98507

SEQ ID NO: 99012 - RNA, 65 nt, Human; identical to SEQ ID NO: 98508

SEQ ID NO: 99013 - RNA, 65 nt, Human; identical to SEQ ID NO: 98509

SEQ ID NO: 99014 - RNA, 53 nt, Human; identical to SEQ ID NO: 98174

SEQ ID NO: 99015 - RNA, 65 nt, Human; identical to SEQ ID NO: 98511

SEQ ID NO: 99016 - RNA, 65 nt, Human; identical to SEQ ID NO: 98512

SEQ ID NO: 99017 - RNA, 65 nt, Human; identical to SEQ ID NO: 98513

SEQ ID NO: 99018 - RNA, 65 nt, Human; identical to SEQ ID NO: 98514

SEQ ID NO: 99019 - RNA, 65 nt, Human; identical to SEQ ID NO: 98515

SEQ ID NO: 99020 - RNA, 65 nt, Human; identical to SEQ ID NO: 98516

SEQ ID NO: 99021 - RNA, 65 nt, Human; identical to SEQ ID NO: 98517

SEQ ID NO: 99022 - RNA, 65 nt, Human; identical to SEQ ID NO: 98518

SEQ ID NO: 99023 - RNA, 65 nt, Human; identical to SEQ ID NO: 98519

SEQ ID NO: 99024 - RNA, 65 nt, Human; identical to SEQ ID NO: 98520

SEQ ID NO: 99025 - RNA, 65 nt, Human; identical to SEQ ID NO: 98521

SEQ ID NO: 99026 - RNA, 65 nt, Human; identical to SEQ ID NO: 98522

SEQ ID NO: 99027 - RNA, 65 nt, Human; identical to SEQ ID NO: 98523

SEQ ID NO: 99028 - RNA, 65 nt, Human; identical to SEQ ID NO: 98524

SEQ ID NO: 99029 - RNA, 65 nt, Human; identical to SEQ ID NO: 98525

SEQ ID NO: 99030 - RNA, 65 nt, Human; identical to SEQ ID NO: 98526

SEQ ID NO: 99031 - RNA, 65 nt, Human; identical to SEQ ID NO: 98527

SEQ ID NO: 99032 - RNA, 65 nt, Human; identical to SEQ ID NO: 98528

SEQ ID NO: 99033 - RNA, 65 nt, Human; identical to SEQ ID NO: 98529

SEQ ID NO: 99034 - RNA, 65 nt, Human; identical to SEQ ID NO: 98530

SEQ ID NO: 99035 - RNA, 65 nt, Human; identical to SEQ ID NO: 98531

SEQ ID NO: 99036 - RNA, 65 nt, Human; identical to SEQ ID NO: 98532

SEQ ID NO: 99037 - RNA, 65 nt, Human; identical to SEQ ID NO: 98533

SEQ ID NO: 99038 - RNA, 65 nt, Human; identical to SEQ ID NO: 98534

SEQ ID NO: 99039 - RNA, 65 nt, Human; identical to SEQ ID NO: 98535

SEQ ID NO: 99040 - RNA, 65 nt, Human; identical to SEQ ID NO: 98536

SEQ ID NO: 99041 - RNA, 65 nt, Human; identical to SEQ ID NO: 98537

SEQ ID NO: 99042 - RNA, 65 nt, Human; identical to SEQ ID NO: 98538

SEQ ID NO: 99043 - RNA, 65 nt, Human; identical to SEQ ID NO: 98539

SEQ ID NO: 99044 - RNA, 65 nt, Human; identical to SEQ ID NO: 98540

SEQ ID NO: 99045 - RNA, 65 nt, Human; identical to SEQ ID NO: 98541

SEQ ID NO: 99046 - RNA, 65 nt, Human; identical to SEQ ID NO: 98542

SEQ ID NO: 99047 - RNA, 65 nt, Human; identical to SEQ ID NO: 98543

SEQ ID NO: 99048 - RNA, 65 nt, Human; identical to SEQ ID NO: 98544

SEQ ID NO: 99049 - RNA, 65 nt, Human; identical to SEQ ID NO: 98545

SEQ ID NO: 99050 - RNA, 65 nt, Human; identical to SEQ ID NO: 98546

SEQ ID NO: 99051 - RNA, 65 nt, Human; identical to SEQ ID NO: 98547

SEQ ID NO: 99052 - RNA, 65 nt, Human; identical to SEQ ID NO: 98548

SEQ ID NO: 99053 - RNA, 65 nt, Human; identical to SEQ ID NO: 98549

SEQ ID NO: 99054 - RNA, 65 nt, Human; identical to SEQ ID NO: 98550

SEQ ID NO: 99055 - RNA, 65 nt, Human; identical to SEQ ID NO: 98551

SEQ ID NO: 99056 - RNA, 64 nt, Human; identical to SEQ ID NO: 98552

SEQ ID NO: 99057 - RNA, 65 nt, Human; identical to SEQ ID NO: 98553

SEQ ID NO: 99058 - RNA, 65 nt, Human; identical to SEQ ID NO: 98554

SEQ ID NO: 99059 - RNA, 65 nt, Human; identical to SEQ ID NO: 98555

SEQ ID NO: 99060 - RNA, 65 nt, Human; identical to SEQ ID NO: 98556

SEQ ID NO: 99061 - RNA, 65 nt, Human; identical to SEQ ID NO: 98557

SEQ ID NO: 99062 - RNA, 65 nt, Human; identical to SEQ ID NO: 98558

SEQ ID NO: 99063 - RNA, 65 nt, Human; identical to SEQ ID NO: 98559

SEQ ID NO: 99064 - RNA, 65 nt, Human; identical to SEQ ID NO: 98560

SEQ ID NO: 99065 - RNA, 65 nt, Human; identical to SEQ ID NO: 98561

SEQ ID NO: 99066 - RNA, 65 nt, Human; identical to SEQ ID NO: 98562

SEQ ID NO: 99067 - RNA, 65 nt, Human; identical to SEQ ID NO: 98563

SEQ ID NO: 99068 - RNA, 65 nt, Human; identical to SEQ ID NO: 98564

SEQ ID NO: 99069 - RNA, 65 nt, Human; identical to SEQ ID NO: 98565

SEQ ID NO: 99070 - RNA, 65 nt, Human; identical to SEQ ID NO: 98566

SEQ ID NO: 99071 - RNA, 65 nt, Human; identical to SEQ ID NO: 98567

SEQ ID NO: 99072 - RNA, 65 nt, Human; identical to SEQ ID NO: 98568

SEQ ID NO: 99073 - RNA, 65 nt, Human; identical to SEQ ID NO: 98569

SEQ ID NO: 99074 - RNA, 65 nt, Human; identical to SEQ ID NO: 98570

SEQ ID NO: 99075 - RNA, 65 nt, Human; identical to SEQ ID NO: 98571

SEQ ID NO: 99076 - RNA, 65 nt, Human; identical to SEQ ID NO: 98572

SEQ ID NO: 99077 - RNA, 65 nt, Human; identical to SEQ ID NO: 98573

SEQ ID NO: 99078 - RNA, 65 nt, Human; identical to SEQ ID NO: 98574

SEQ ID NO: 99079 - RNA, 65 nt, Human; identical to SEQ ID NO: 98575

SEQ ID NO: 99080 - RNA, 65 nt, Human; identical to SEQ ID NO: 98576

SEQ ID NO: 99081 - RNA, 65 nt, Human; identical to SEQ ID NO: 98577

SEQ ID NO: 99082 - RNA, 65 nt, Human; identical to SEQ ID NO: 98578

SEQ ID NO: 99083 - RNA, 65 nt, Human; identical to SEQ ID NO: 98579

SEQ ID NO: 99084 - RNA, 65 nt, Human; identical to SEQ ID NO: 98580

SEQ ID NO: 99085 - RNA, 65 nt, Human; identical to SEQ ID NO: 98581

SEQ ID NO: 99086 - RNA, 65 nt, Human; identical to SEQ ID NO: 98582

SEQ ID NO: 99087 - RNA, 65 nt, Human; identical to SEQ ID NO: 98583

SEQ ID NO: 99088 - RNA, 65 nt, Human; identical to SEQ ID NO: 98584

SEQ ID NO: 99089 - RNA, 65 nt, Human; identical to SEQ ID NO: 98585

SEQ ID NO: 99090 - RNA, 65 nt, Human; identical to SEQ ID NO: 98586

SEQ ID NO: 99091 - RNA, 65 nt, Human; identical to SEQ ID NO: 98587

SEQ ID NO: 99092 - RNA, 65 nt, Human; identical to SEQ ID NO: 98588

SEQ ID NO: 99093 - RNA, 65 nt, Human; identical to SEQ ID NO: 98589

SEQ ID NO: 99094 - RNA, 65 nt, Human; identical to SEQ ID NO: 98590

SEQ ID NO: 99095 - RNA, 65 nt, Human; identical to SEQ ID NO: 98591

SEQ ID NO: 99096 - RNA, 65 nt, Human; identical to SEQ ID NO: 98592

SEQ ID NO: 99097 - RNA, 65 nt, Human; identical to SEQ ID NO: 98593

SEQ ID NO: 99098 - RNA, 65 nt, Human; identical to SEQ ID NO: 98594

SEQ ID NO: 99099 - RNA, 65 nt, Human; identical to SEQ ID NO: 98595

SEQ ID NO: 99100 - RNA, 65 nt, Human; identical to SEQ ID NO: 98596

SEQ ID NO: 99101 - RNA, 65 nt, Human; identical to SEQ ID NO: 98597

SEQ ID NO: 99102 - RNA, 65 nt, Human; identical to SEQ ID NO: 98598

SEQ ID NO: 99103 - RNA, 65 nt, Human; identical to SEQ ID NO: 98599

SEQ ID NO: 99104 - RNA, 65 nt, Human; identical to SEQ ID NO: 98600

SEQ ID NO: 99105 - RNA, 65 nt, Human; identical to SEQ ID NO: 98601

SEQ ID NO: 99106 - RNA, 65 nt, Human; identical to SEQ ID NO: 98602

SEQ ID NO: 99107 - RNA, 61 nt, Human
ugucggggacaugagcuccaugcucaccagccucgccgaggagagcaaguuccugaacaug

SEQ ID NO: 99108 - RNA, 61 nt, Human
gccggcucugggcuggcugcuccuaaccuaccucgccgagcugucggagggcuggacauuu

SEQ ID NO: 99109 - RNA, 61 nt, Human
accacacguggccucugcgcccagcacggugcucgccgacaguggugucugaacccuuggg

SEQ ID NO: 99110 - RNA, 61 nt, Human
ggagcugcuccuggcugaggggcuucaaccacucgccgaggaggagcagagggccuaggag

SEQ ID NO: 99111 - RNA, 61 nt, Human
gcaaugcacugaaaggcccggccgacugcugcucgccgauccguggggcccccugugcccg

SEQ ID NO: 99112 - RNA, 52 nt, Human
gccucucguccaacuugugacccucgccgaccgccccgcgggcccaggcggg

SEQ ID NO: 99113 - RNA, 61 nt, Human
agccaccaccugcgcuuagguaggcguccugcucgccgacuuucaguuccuugggagggug

SEQ ID NO: 99114 - RNA, 61 nt, Human
ggcuugguggggucuuccacugugugcccuucucgccgaggccggucccccgggugugggg

SEQ ID NO: 99115 - RNA, 61 nt, Human
aaggccgcgcuugccgucuccgccgccccuucucgccgagccguggggcgcgggcggccga

SEQ ID NO: 99116 - RNA, 61 nt, Human
cugugccccaagcaccuuggccuccucucagcucgccgaggaggcacgcuagagccgccuu

SEQ ID NO: 99117 - RNA, 64 nt, Human
cccaggaugucuuguggugcgggucggccguucugccccccagggcacccccuguuguaggcac

SEQ ID NO: 99118 - RNA, 64 nt, Human
cuucuuccaucgcaaugaccuguauuaaacacaagccccccaagcaaaagaagagguugaguuu

SEQ ID NO: 99119 - RNA, 64 nt, Human
caacccaugugguucucagacuugaaucuucucggccccccaaaaagaaggaccucauuucuua

SEQ ID NO: 99120 - RNA, 64 nt, Human
auguuagugccccgcacugugccccaaguucuaggccccccagaaagcugccagagccggccgc

SEQ ID NO: 99121 - RNA, 64 nt, Human
gucugauccuggguucuugucuccccuaaaugcugccccccaaguuacuguauuugucugggcu

SEQ ID NO: 99122 - RNA, 64 nt, Human
auaaugaaugguguucccuuugcuuggcuggggagccccccaggccagguuugcuggccauaga

SEQ ID NO: 99123 - RNA, 64 nt, Human
gcgugggcuccccucggcuguggugccuccucuggccccccagguccacguccuuuaaauuggc

SEQ ID NO: 99124 - RNA, 64 nt, Human
aggacugccuuucucucucucaguucuggccucugccccccaaagucagcucucuaaaagcaag

SEQ ID NO: 99125 - RNA, 64 nt, Human
ucuuucucuggagcucuagauacucacuuuuugugccccccaaaugaaugcauuuucuucccac

SEQ ID NO: 99126 - RNA, 64 nt, Human
cuuugugcuauuagccuguccucugggugcucuagccccccagcuuucugguagcuucuuccag

SEQ ID NO: 99127 - RNA, 64 nt, Human
ucccuccacuugugagcgcccccagcuuugcggcgccccccaccccagcgcugucugugggucc

SEQ ID NO: 99128 - RNA, 64 nt, Human
acuugcuagcgucccuucauuuucccacaaguuugccccccaccuccacuuaccugucugcccu

SEQ ID NO: 99129 - RNA, 64 nt, Human
acucuuuucugcagcacacgccugugugcugugagccccccacucugccgugcucacacagaca

SEQ ID NO: 99130 - RNA, 64 nt, Human
gcagagcauauuguggauuggaaaggcugcgacagccccccaaacaggaaagacaaaaaacaaa

SEQ ID NO: 99131 - RNA, 64 nt, Human
gcugccugaacugaagaaauaaaauccagaaucugccccccaacuugcuaccagccugcuugau

SEQ ID NO: 99132 - RNA, 64 nt, Human
caucaaagagaaaggaaugugggggguuuccgcugccccccacccccagcggcccaccccaugc

SEQ ID NO: 99133 - RNA, 64 nt, Human
ccuucagcuucagaccccuuccccaccaggcuaggccccccacaccugggggacccccuggccc

SEQ ID NO: 99134 - RNA, 64 nt, Human
cauggagagagccccuucuccaucccuguccugugccccccaggcugauugggagggagggcac

SEQ ID NO: 99135 - RNA, 64 nt, Human
auauuucaucuagaggcgccugcccacuuccugcgccccccaggggcccuguggggacugcugg

SEQ ID NO: 99136 - RNA, 64 nt, Human
auugaauacagcagucucaacugggggcaauuuugccccccagaggacauugggcaauguuugg

SEQ ID NO: 99137 - RNA, 64 nt, Human
cagagaaacagaacugguggugcugggggguauagccccccauccuugaggccugucacccaca

SEQ ID NO: 99138 - RNA, 64 nt, Human
aauacuggaauuugugcuauuaucuuccucuccagccccccaacuccaucccucaccacaguug

SEQ ID NO: 99139 - RNA, 64 nt, Human
cucucaggcugcuguucugugggugcugagagcugccccccaucaccacgccaucacaccccuc

SEQ ID NO: 99140 - RNA, 64 nt, Human
ugaggagcagcugggguaggcugucugugccauggccccccacucccccuucccuuggagggag

SEQ ID NO: 99141 - RNA, 64 nt, Human
uugggggacaaugugcccuugcaauauuuccauugccccccaaggagccugucacuagcuaaga

SEQ ID NO: 99142 - RNA, 64 nt, Human
agccccuuaagggaaagguaggaagagagguccagccccccaggcugcccagagcugcuggucu

SEQ ID NO: 99143 - RNA, 64 nt, Human
gaggaguuuugagcgcccggccgcgccccgcgccgccccccacgcaccaccggggcggccucgc

SEQ ID NO: 99144 - RNA, 64 nt, Human
auuaaaacaaaaaacugccaaaagcauccccucugccccccauguggcacuggcaucauucucu

SEQ ID NO: 99145 - RNA, 64 nt, Human
ugauggaucucaguacugagcugggcauuucucugccccccaacuuuuuucuuuuuaaaaauaa

SEQ ID NO: 99146 - RNA, 64 nt, Human
aguucugugaagaauuugaccugaauguguuccugccccccaggagugugaccagguacaugug

SEQ ID NO: 99147 - RNA, 64 nt, Human
ccccucucagaccacccagcggaugccuauucccgccccccaccccuccccugcgucuccuugu

SEQ ID NO: 99148 - RNA, 64 nt, Human
ugguaaauaucuacucccccaagugacuccaggugccccccaccgccuggcacuucccccagga

SEQ ID NO: 99149 - RNA, 64 nt, Human
auucccaucagguuaaagacuucaucuagaugaugccccccagagaugccuuuaguguaaguag

SEQ ID NO: 99150 - RNA, 64 nt, Human
ggggaaaauuuuuuuaaauggaagcuucuagcaagccccccaccccaaucaaccucuaugcuuu

SEQ ID NO: 99151 - RNA, 64 nt, Human
uguguuagugcccauguggcauuguggcacuguugccccccauggcggcaugggcaagaugacc

SEQ ID NO: 99152 - RNA, 64 nt, Human
acccuggggccccucaacugcagucagagagcaagccccccaaaaaaaagaaaaagaaaaggag

SEQ ID NO: 99153 - RNA, 64 nt, Human
gguuugaacuccuguuuuuauuguaaaauaaauugccccccauucugguccccuaacuucucac

SEQ ID NO: 99154 - RNA, 64 nt, Human
cugagauugucuuccaagccgggcauccuugcgagccccccaagcuggccacagaugccacuac

SEQ ID NO: 99155 - RNA, 64 nt, Human
cccaagccuggcaagggaauuucuucaacucccugccccccagcccuccuuaucaaaggacacc

SEQ ID NO: 99156 - RNA, 64 nt, Human
uagagggagccaagaggauggggugggggccagggccccccagggccuaucgugggagagccug

SEQ ID NO: 99157 - RNA, 64 nt, Human
gaucauugccagaaucuucuucuccuggggucuggccccccaaaaugccuaacccaggaccuug

SEQ ID NO: 99158 - RNA, 64 nt, Human
gcccugguggccucuccagggcugcucaggcaaggccccccacccaucugguauggaaaccugc

SEQ ID NO: 99159 - RNA, 64 nt, Human
gggcccucauuccgggcaggucccccuucacucagccccccagugucgaaggccaagguugggg

SEQ ID NO: 99160 - RNA, 64 nt, Human
caucccaguguccuaggaccuuuucccaauacuagccccccaguggugaacagaaccucccaaa

SEQ ID NO: 99161 - RNA, 64 nt, Human
cggccccccgacugagaacucgggccucucacccgccccccagccucccgcucugggcgagccu

SEQ ID NO: 99162 - RNA, 64 nt, Human
ccuggcugaccuggcugaaagccgcugucucggagccccccacagcauuuuguuccccucccgc

SEQ ID NO: 99163 - RNA, 64 nt, Human
agaugcccccccauccugcucagcugcgucaugggccccccaugcauacguacauuccuggaca

SEQ ID NO: 99164 - RNA, 64 nt, Human
aggaggggcugcagccacacacucuuccccaccugccccccagcucagagacucgugaccaaau

SEQ ID NO: 99165 - RNA, 64 nt, Human
augcugcugacccagcaccacuucccagccaggagccccccaggaacagcacagaacagcaggg

SEQ ID NO: 99166 - RNA, 58 nt, Human
acuuccagcagugugacuagggcaacgugccccccagaacucccugggcagagccagc

SEQ ID NO: 99167 - RNA, 64 nt, Human
guauaaagggacuugaaguauuuuuuaauaauccgccccccaaugaacuucagaagugccauuc

SEQ ID NO: 99168 - RNA, 64 nt, Human
ggaaucaggcuccucagccaggacacagggugaggccccccagccaggauaugccuccccugga

SEQ ID NO: 99169 - RNA, 64 nt, Human
aacuccaagcucccuccacaaguuucccucccaggccccccacaccccaguguggacuugggau

SEQ ID NO: 99170 - RNA, 64 nt, Human
accaaagaagcaaggagcuaggacccccaguccugccccccaggagcacaagcaggguccccuc

SEQ ID NO: 99171 - RNA, 64 nt, Human
gaucaccagggggauuuugacacagccuucggcugccccccacuaagcuaauuccacaccccug

SEQ ID NO: 99172 - RNA, 64 nt, Human
cuugccccaagucacagccacucagaugcuuccugccccccagugcccauuccaggucaccaga

SEQ ID NO: 99173 - RNA, 64 nt, Human
ggugggcagccaucaccagccacaguuaagccaagccccccaacauguauuccaucgugcuggu

SEQ ID NO: 99174 - RNA, 64 nt, Human
ugaccggcccaccugguagcagaggacacccccagccccccaagcauugaagacauaguguauu

SEQ ID NO: 99175 - RNA, 64 nt, Human
ccucagacauccuggacugggagguggaggcagagccccccaggacaggagcaacugucucagg

SEQ ID NO: 99176 - RNA, 64 nt, Human
ugagggugggcgucuuccugccccaugcuccccugccccccaccaccugccugcuugcuucucu

SEQ ID NO: 99177 - RNA, 64 nt, Human
agagauagccgugugagcagucucagcucaagcugccccccauuucuguaacccuccuagcccc

SEQ ID NO: 99178 - RNA, 64 nt, Human
ccgaggggguggaagggggugggcacacuccagggccccccaugccccuggcccccagggacug

SEQ ID NO: 99179 - RNA, 64 nt, Human
aaucaccuuggaguggucaccagggggacagggagccccccaccaauguaucaaugggugauuu

SEQ ID NO: 99180 - RNA, 64 nt, Human
ugcgaagucugauuuaccggccuacucucgaccugccccccacccccagcucaggggaccuuuu

SEQ ID NO: 99181 - RNA, 64 nt, Human
cagcggcacucugagaucccggggcugggcagucgccccccacuucccagcagcucugugguag

SEQ ID NO: 99182 - RNA, 64 nt, Human
ucucugccagcuuccugaguucugccuaaagauggccccccagcacugguuggggacaagggcc

SEQ ID NO: 99183 - RNA, 64 nt, Human
uucggccucucccuguacuggaaucagguccagggccccccaaaaccccgguggcacaaaaacc

SEQ ID NO: 99184 - RNA, 64 nt, Human
gucagugcuggaaaugcagccacuggcagaucuggccccccagacgucaccgcagggccucuga

SEQ ID NO: 99185 - RNA, 64 nt, Human
ugcgucaacccaaaggagcugccgcacugacccagccccccaggaaacagugagacaagaauca

SEQ ID NO: 99186 - RNA, 64 nt, Human
caaacaccugaccucaagugauccgccugccuuggccccccaaagugcugggauuacaggagug

SEQ ID NO: 99187 - RNA, 64 nt, Human
aagagcaagcucaccacagaggaguggaacugaggccccccagauguugccuccgguguccaag

SEQ ID NO: 99188 - RNA, 64 nt, Human
aggggcaggaaccagacaaucucguagguguccugccccccagccuaggcuuggcuccuuucac

SEQ ID NO: 99189 - RNA, 64 nt, Human
cuagagcccacagcagaaugggguugggccuguggccccccaaacuaggggguguggguucauc

SEQ ID NO: 99190 - RNA, 64 nt, Human
ucaagaagacuuccuuuucuaccaccacacuacugccccccauuaagguucuugugguuuaccc

SEQ ID NO: 99191 - RNA, 64 nt, Human
cagcuggcuagcauuccucaggaaggacaugggugccccccacccccaguucagucuguaggga

SEQ ID NO: 99192 - RNA, 64 nt, Human
agcccuggagugauacuuuuuauggaagacaaaagccccccaaaucuguguaaaaucugcugca

SEQ ID NO: 99193 - RNA, 64 nt, Human
ugaaucuuuaaguuagguaucuaccuucccaccagccccccaaaaaaccucucaguaguuucuu

SEQ ID NO: 99194 - RNA, 64 nt, Human
ccagagaccuucagugccauccugacucuagaaggccccccacagcagggcguagggggcauca

SEQ ID NO: 99195 - RNA, 64 nt, Human
ggguuccacagggcccagcccuggcaggggucuggccccccagguaggcggagagcagucccuc

SEQ ID NO: 99196 - RNA, 64 nt, Human
gggcaggcaggggcaggcugaggaguugcccuuugccccccagagacugacucucagagccaga

SEQ ID NO: 99197 - RNA, 64 nt, Human
ccuucuggucaaccuggccguccggggcccccaggccccccaccugcagguaagagcuacacug

SEQ ID NO: 99198 - RNA, 64 nt, Human
ucccagccuaagggagacaggccuuucccugccggccccccaaggaugggguucuuguccacgg

SEQ ID NO: 99199 - RNA, 64 nt, Human
cuggggggagggggcuuccccuuucagcugcccggccccccacacccacagcuugcucuucuau

SEQ ID NO: 99200 - RNA, 64 nt, Human
augugugaauuugcacaccacugccugaauuggagccccccagagugucccucuacccagaguu

SEQ ID NO: 99201 - RNA, 64 nt, Human
uuggauuuggcuuuccugucccuuccccaugccagccccccagaguguucugccuugugcugcc

SEQ ID NO: 99202 - RNA, 64 nt, Human
aacuggcagauacuggugggaagcacugugccuggccccccagcuuccuguaugggccucgaaa

SEQ ID NO: 99203 - RNA, 64 nt, Human
ggcugggcugaucccccuacugcaacuaacuguugccccccaaccccgaacccccaguugagga

SEQ ID NO: 99204 - RNA, 64 nt, Human
ugucaccuuggacugugagccacuuccacuucucgccccccaggcaggagcacccucacuccaa

SEQ ID NO: 99205 - RNA, 64 nt, Human
guuccaggggaaaaaaauagcugguuggugucuagccccccaacacuuuugucuguuguguaua

SEQ ID NO: 99206 - RNA, 64 nt, Human
ccagguuugccagaaccaccgagccccgccucccgccccccagggcuucugcaggcuucagcca

SEQ ID NO: 99207 - RNA, 64 nt, Human
ugggggcuucugaagauggacuuaccugggaccugccccccaugagccaggacgguccccccac

SEQ ID NO: 99208 - RNA, 64 nt, Human
ucccagacucugggcugucagcccaugugcaccugccccccagccuucacugacagccgcugcu

SEQ ID NO: 99209 - RNA, 60 nt, Human
accaccccauuuauauaugaaguauucagagccccccaggagagacggauggacagacag

SEQ ID NO: 99210 - RNA, 64 nt, Human
ggcagagguagcccccuaaaugggcaagcaaggagccccccaaagacacuaccacuccccaucc

SEQ ID NO: 99211 - RNA, 64 nt, Human
cuaugggacaccaggccugacucaggcagguucugccccccagaccccacacacggccgcccca

SEQ ID NO: 99212 - RNA, 64 nt, Human
uccuuccauccugaggaccgccccaacccucggagccccccacucaguaggucugaaggccucc

SEQ ID NO: 99213 - RNA, 64 nt, Human
agagguauuuaaagugcuuugagaccugauucaugccccccaaagggugguauuaaaagaggaa

SEQ ID NO: 99214 - RNA, 64 nt, Human
gugcugggauuacaggugugagccacugugccuggccccccacaacauguuuaaacuuagcuag

SEQ ID NO: 99215 - RNA, 64 nt, Human
ugauucucuuaaauuuggguugcaaagcuaucccgccccccacccugccccaugaaacuugagc

SEQ ID NO: 99216 - RNA, 55 nt, Human
cccauuuuucaguagcuuaaaggaagccccccacuuuuuuuuuuucugccugaga

SEQ ID NO: 99217 - RNA, 64 nt, Human
caauaggaacugagcccucauguccccuuggcaggccccccagggucuggcacucacugcagac

SEQ ID NO: 99218 - RNA, 64 nt, Human
cuuuauauacuacaguuguuccuaucucucccccgccccccaccgccccaccacacacauauuu

SEQ ID NO: 99219 - RNA, 64 nt, Human
cgcaccccgcccccaccuugugccccuguguccagccccccagggggccugugucugugucugu

SEQ ID NO: 99220 - RNA, 64 nt, Human
gcuuccucuccggagccugcgcacagagagucacgccccccacucuccuuuagggagcugaggu

SEQ ID NO: 99221 - RNA, 64 nt, Human
cagaaacguacucccccaccaaccccaccucaccgccccccaucccgguucugggagagcauug

SEQ ID NO: 99222 - RNA, 64 nt, Human
ucccucuauuuaugcaaagccgaccuaugcuacagccccccaacccccgaccugggguagggag

SEQ ID NO: 99223 - RNA, 64 nt, Human
acauauacccuuaagaacgcccccuccacacacugccccccaguauaugccgcauuguacugcu

SEQ ID NO: 99224 - RNA, 64 nt, Human
caacaaugagagaccaggaguagguccuaucagugccccccagaguagagagcaauaagagccc

SEQ ID NO: 99225 - RNA, 64 nt, Human
gaccugcccugugcccccuccucccugccgcagugccccccaacccaggccucuauuguuccau

SEQ ID NO: 99226 - RNA, 64 nt, Human
caaagcuguccuuugccaucucaucccuuggccugccccccaacccugaggaugccccugccau

SEQ ID NO: 99227 - RNA, 64 nt, Human
ccaaaaccaggagccaggcugugccaugucccccgccccccaucccagccggcccgguccgaac

SEQ ID NO: 99228 - RNA, 64 nt, Human
accagcagcacaauucugucccugucccugccccgccccccagagccagggcuguccuuagacu

SEQ ID NO: 99229 - RNA, 51 nt, Human
aaagaaauggggucagaugaugccccccaaaacccugauuuccacacacua

SEQ ID NO: 99230 - RNA, 64 nt, Human
gccucugauuuacccuacagcuucaggcccagcugccccccagucuuuggguggugcuguucuu

SEQ ID NO: 99231 - RNA, 64 nt, Human
gaggaaaaagcgagagaaaaggaaaagccaacaggccccccagccaagaaagcuaucucugagu

SEQ ID NO: 99232 - RNA, 64 nt, Human
cugcccgcucccaaccccccuccugcuccucccugccccccaagguucugguuccauuuuuccu

SEQ ID NO: 99233 - RNA, 64 nt, Human
cauuugcuggggaggagaucaucuuguuccccuggccccccacucucccuccauguccauccaa

SEQ ID NO: 99234 - RNA, 64 nt, Human
agaaaaggugcccagcccccaccacuccucagcugccccccaaccucucuauggcagagaggca

SEQ ID NO: 99235 - RNA, 64 nt, Human
acaccuccucauguacauacccuggccgcccccugccccccagccucuggcauuagaauuauuu

SEQ ID NO: 99236 - RNA, 64 nt, Human
gucucagaguccuccucgccccuuucuucaccccgccccccaacccccagacuuuccuggagca

SEQ ID NO: 99237 - RNA, 64 nt, Human
cuuggccaccauacgggccauccucagugaggcagccccccauaggcuuccgccaagcucuggu

SEQ ID NO: 99238 - RNA, 64 nt, Human
ugaagggaagccaaccccccugcagcacaaauaggccccccagucccagccgugugcuggcaga

SEQ ID NO: 99239 - RNA, 64 nt, Human
ccgcugcucuccgcggucccccacccucaccccggccccccacccgcagccggccacacuggag

SEQ ID NO: 99240 - RNA, 64 nt, Human
guuucacugcucucccccaugauggagggagggagccccccaaccucagugaggagagccccga

SEQ ID NO: 99241 - RNA, 55 nt, Human
agaucauggugacaguguaggcagggccccccaagggaguggcagggagauggcg

SEQ ID NO: 99242 - RNA, 64 nt, Human
ugcugcagcaucacgaucagggcaaaucagcacagccccccagccaucaguggugucuagaaaa

SEQ ID NO: 99243 - RNA, 64 nt, Human
ggagaugggacacggcuccuggcagcacccaggagccccccaggcugccugccugcgugcagag

SEQ ID NO: 99244 - RNA, 64 nt, Human
accccaccuugccaagcuuucuucuacaaccagagccccccacaaugaugauuaaacaccugac

SEQ ID NO: 99245 - RNA, 64 nt, Human
cugucacccugaagccugggcuuggccuccuccagccccccaucuccgucccauccucccaugg

SEQ ID NO: 99246 - RNA, 64 nt, Human
aguccccuccccaacccccugacucucacacauagccccccaucagcuguuuuacuccgugccu

SEQ ID NO: 99247 - RNA, 52 nt, Human
gcaaguuugcugccugcuaggagccccccagggucugggaccccgcucagca

SEQ ID NO: 99248 - RNA, 64 nt, Human
aaacagcccugacagagucuauaauugaguucaggccccccaccuugccuaauaacugcaaauc

SEQ ID NO: 99249 - RNA, 64 nt, Human
cucccagcggcucucugcccauuuccuccucuccgccccccaccucgcuucaccuguuaccuug

SEQ ID NO: 99250 - RNA, 64 nt, Human
gcuggccacccuauaggguccuccuucccuggcagccccccaugugggagaaauaccugauucu

SEQ ID NO: 99251 - RNA, 64 nt, Human
aagcugcacucccacccaccuagcuccccccagggccccccagcaccuacagcuggggcugcag

SEQ ID NO: 99252 - RNA, 64 nt, Human
agcacagcgcagaagccccugcccacgggauccggccccccagacaccgaccccacaggccguc

SEQ ID NO: 99253 - RNA, 64 nt, Human
agagugcuccccagcaggcauccacuaccccagggccccccacaugucauggcaagguugguag

SEQ ID NO: 99254 - RNA, 64 nt, Human
ucaugaacucuggagcccugagaggagaggggcagccccccaccuugucacccucagggcuucc

SEQ ID NO: 99255 - RNA, 64 nt, Human
ggaaucuuuugccucucccagccaccuccucccagccccccaggagagcugggcacauguccca

SEQ ID NO: 99256 - RNA, 64 nt, Human
aguccgccacagcccucccccgcccccuucccccgccccccaacgcgcaguguguauuugcacc

SEQ ID NO: 99257 - RNA, 64 nt, Human
gagagacagcaaggggccggcaggugcucgaugggccccccagggcuucuccagggcagcacag

SEQ ID NO: 99258 - RNA, 64 nt, Human
ucagcugcccacaaguuuccugcacccuggaaaagccccccacccuuccucugggaaacugaca

SEQ ID NO: 99259 - RNA, 64 nt, Human
ggccucaacgugcgaggauuccuggaccgcuacugccccccaaacugccccccgagcuucuucc

SEQ ID NO: 99260 - RNA, 64 nt, Human
cucacuccugggaacugucuggcagguaggcugggccccccagugcuguuagaauaaaaagccu

SEQ ID NO: 99261 - RNA, 58 nt, Human
ccauguccgcgucccacuagcaggcggagccccccacccccucagcagggccggagac

SEQ ID NO: 99262 - RNA, 64 nt, Human
aaaacaaugcugagaaugagagcggcggagacaagccccccaucgaucccaguaagugucuccu

SEQ ID NO: 99263 - RNA, 64 nt, Human
auaucuggagaagguguacaacuuucaaacacaagccccccacccccugacccuuggccuuccc

SEQ ID NO: 99264 - RNA, 64 nt, Human
gggugcggcaggagcaggaacagagacucuggaagccccccaccuuucucgcuggaaucaauuu

SEQ ID NO: 99265 - RNA, 64 nt, Human
ccaaagggcacaccccuggggcugagucuccagggccccccaacugugguagcuccagcgaugg

SEQ ID NO: 99266 - RNA, 64 nt, Human
cuggcgccgcugcaacagccccucauggccaggagccccccauggccuggggccuccucuucau

SEQ ID NO: 99267 - RNA, 64 nt, Human
cagggggagccuaggcccagcuccuccgcgguuggccccccagaccauaccucugacccaccca

SEQ ID NO: 99268 - RNA, 64 nt, Human
cucagaugaugggcucccugaaacugcugccgccgccccccaucaugucugccagggugcuccc

SEQ ID NO: 99269 - RNA, 64 nt, Human
ccgggggcagcguguuccccuguaccuguccaaggccccccagcaggugagagcucuuuccccu

SEQ ID NO: 99270 - RNA, 64 nt, Human
accuggcucagccaaccuccuuccucccccgguugccccccacucuaaagccuccucccuccca

SEQ ID NO: 99271 - RNA, 64 nt, Human
aaagagcaguggcugcaggagaggccuucccggggccccccaucagcgaugugucuucagagac

SEQ ID NO: 99272 - RNA, 64 nt, Human
gagugaccacgggauucccugagaaacagggccggccccccaacuucagggacccaccgcccau

SEQ ID NO: 99273 - RNA, 64 nt, Human
uacuuuagauaccuuguugccaugguuugaaugugccccccagauuucaugugugugaaacuua

SEQ ID NO: 99274 - RNA, 64 nt, Human
gaacucugguugcaaucccuccccgucccacacugccccccauuugaguacaccgcacaaguca

SEQ ID NO: 99275 - RNA, 64 nt, Human
agggccugcucguacacuugcucaaccuggaccagccccccagccuccaggugugccccuuguc

SEQ ID NO: 99276 - RNA, 64 nt, Human
caucugaguccagcuccccccaagaugagcugcagccccccagagagagcucugcacgucacca

SEQ ID NO: 99277 - RNA, 64 nt, Human
ccacccacccaggauguccuggcucacuccgcaagccccccagccucccacccuggucccaguu

SEQ ID NO: 99278 - RNA, 64 nt, Human
gccucccccagccaggucggcucucagcaauacggccccccagggaagucuucgcuggcguccg

SEQ ID NO: 99279 - RNA, 64 nt, Human
ccagggcacagcagcggcggggagggcgccucuggccccccaccucacggccaguucccgcggg

SEQ ID NO: 99280 - RNA, 64 nt, Human
aggauggguaacaguauuggggccagaucccuaagccccccagcuguaaauaggcuguggccag

SEQ ID NO: 99281 - RNA, 64 nt, Human
ugugauuauugaccucuguugcauuuauucuaaagccccccaaaaauuaucuagccguuucgaa

SEQ ID NO: 99282 - RNA, 64 nt, Human
cuaucucuaccccccuaauaaauuaauuuaaaaagccccccaaucugugguauuuuauuauggc

SEQ ID NO: 99283 - RNA, 64 nt, Human
cagccucucucuuuucuacacacucagccacaaagccccccagcucccacaccgcgucccagcu

SEQ ID NO: 99284 - RNA, 64 nt, Human
gcguggauccuguguuuguggcucccacuccccagccccccagcagcccccagccgaggggccc

SEQ ID NO: 99285 - RNA, 64 nt, Human
acccacgcgccccgggagcggggccaugccuccagccccccagcucgcccgacccauccuguuc

SEQ ID NO: 99286 - RNA, 64 nt, Human
uauaagaaagggauaaagguaauagagcccuucugccccccacccaccaaauuuacacaacaaa

SEQ ID NO: 99287 - RNA, 64 nt, Human
aauuuguggagaccccggcgggcccgggccugccgccccccagcccugccgcaccaagcuggcc

SEQ ID NO: 99288 - RNA, 64 nt, Human
cccuccccaaccccaagugccuucaugcccuagggccccccaagugccugccccuccccagagu

SEQ ID NO: 99289 - RNA, 64 nt, Human
ccaggcuggagugcaguggcucaaugcaaccucugccccccaaguucaagugauucuccugccu

SEQ ID NO: 99290 - RNA, 64 nt, Human
cugugacagagccugagacuuggaggugccagaggccccccaccaaccagcccagccacuguug

SEQ ID NO: 99291 - RNA, 64 nt, Human
acccagccaagcaccccuaucucuagaggaucuggccccccagcccaguuacugcagggcagcu

SEQ ID NO: 99292 - RNA, 64 nt, Human
uggucccucuaaugauccuccagccucaucuaaugccccccaaagacugauacaaguaaccucc

SEQ ID NO: 99293 - RNA, 64 nt, Human
uguaucuguuuacauccagaguucugugacacaugccccccagauugcugcaaagaucccaagg

SEQ ID NO: 99294 - RNA, 64 nt, Human
ugagcagcuccugugcccugggggcagucacagagccccccaacacccccgugcucugcaccag

SEQ ID NO: 99295 - RNA, 64 nt, Human
ugaguagauaauccugaauugaggucaugaggaggccccccaggccagacaguccugaaccccu

SEQ ID NO: 99296 - RNA, 64 nt, Human
gcucagguccauccuucucaagaucuccuucuuagccccccagccccuggugcugucugugguc

SEQ ID NO: 99297 - RNA, 64 nt, Human
uucugugugggagggagcgggggcuggcuagcgggccccccagccagggaucccagaggcugag

SEQ ID NO: 99298 - RNA, 64 nt, Human
uuuguuuaugguuuuguuucacuuuucuuaauuugccccccacccccaccuugaaagguuuugu

SEQ ID NO: 99299 - RNA, 64 nt, Human
accuugggcugggccugcucccccagggcccagggccccccagcuuagaacagcccuuggugag

SEQ ID NO: 99300 - RNA, 64 nt, Human
accaguaaaggcuccuggccucucaucaggaucugccccccagagaccccccccagacacugca

SEQ ID NO: 99301 - RNA, 64 nt, Human
uggugguaggggugugaggguagugggggugucagccccccagguguuucagaacaaggccucg

SEQ ID NO: 99302 - RNA, 64 nt, Human
ggaaccccaccuggacacauggcccugcuucuaagccccccaguuaggcccaaaggaauggucc

SEQ ID NO: 99303 - RNA, 64 nt, Human
ccuggaggcagccggccaaggccucuagggaagagccccccacugcagacaugacccgaguaac

SEQ ID NO: 99304 - RNA, 64 nt, Human
ccugccuuuccugcccuuccccaccaccugcacugccccccacauucucccagccccccccaag

SEQ ID NO: 99305 - RNA, 64 nt, Human
ucaguccucugggagggagguucgccuaggaggugccccccacauugguguccccaugggcagc

SEQ ID NO: 99306 - RNA, 64 nt, Human
cagcgcccagcaggacacccaugcaagaggcugagccccccaacauccaaggacaggagagaca

SEQ ID NO: 99307 - RNA, 64 nt, Human
aggaugcuugaugcugcgucccccgcugcuugccgccccccaccccgccauuuuguauaauaaa

SEQ ID NO: 99308 - RNA, 64 nt, Human
caucuaagcaucuggguugccauggcaauggcaugccccccagcuacuguaugcccccgacccc

SEQ ID NO: 99309 - RNA, 62 nt, Human
gcauuuucacagcugacugaaccacuccagaugccccccaccuagcaguccaggucccucaa

SEQ ID NO: 99310 - RNA, 58 nt, Human
aagaagauuacgacuccuagcgccuucugccccccagaccauagccccuuuuaguugg

SEQ ID NO: 99311 - RNA, 64 nt, Human
cacagcaaggaggcuggcuggggccuaucagugugccccccauccuggcccaucaguguacccc

SEQ ID NO: 99312 - RNA, 64 nt, Human
cuucacuucccuaggcugggcugagggcaaccuugccccccacccaagaagcccugcccuccag

SEQ ID NO: 99313 - RNA, 64 nt, Human
gggguggcaaugacacccugcaggggaaaggacugccccccaugcaccauugcagggaggaugc

SEQ ID NO: 99314 - RNA, 64 nt, Human
ggaaugguguaguuacagaucgacauaaacuccugccccccaacaaugccaugagcugcuuagc

SEQ ID NO: 99315 - RNA, 64 nt, Human
gccugugucuucagcccugaugcacaggcugccagccccccaguccagcccucucccuuccacu

SEQ ID NO: 99316 - RNA, 64 nt, Human
cagggccucccugagccaguggcauccugccugggccccccauggcagugcugccucuuguagg

SEQ ID NO: 99317 - RNA, 64 nt, Human
guggugggacacccgagcugcacguuccuauacggccccccagacccagcuguccgggccacag

SEQ ID NO: 99318 - RNA, 64 nt, Human
cacagaccccagagccaggaaccucucagccgaugccccccaguaugggaaccagcaccuccca

SEQ ID NO: 99319 - RNA, 64 nt, Human
agcucaggcccuggugaggggcugggucccgggugccccccaugcccucccugcugccaggcuc

SEQ ID NO: 99320 - RNA, 64 nt, Human
gccgaccuccagcggaaccccccagggggcaccagccccccagcagacaauggcccuccuggug

SEQ ID NO: 99321 - RNA, 64 nt, Human
uccagauucccuguccugagccauggucucucgggccccccacacgcguguguacacacggacc

SEQ ID NO: 99322 - RNA, 64 nt, Human
cugucccccacuccugccugcuucccggugagcugccccccacacgugcagcccgggcugccuc

SEQ ID NO: 99323 - RNA, 64 nt, Human
ugaaccacagcucaaaaggcaaaagaagacaaaagccccccaggauguagaaaugaaggaccuu

SEQ ID NO: 99324 - RNA, 64 nt, Human
ccaggagaacgguggcucccacaggacaaucgcugccccccaaccucguagcaacagcaauacc

SEQ ID NO: 99325 - RNA, 64 nt, Human
uccacccuggcuggaucuggaggcaagaugccaggccccccagguguucucagggcaguucuug

SEQ ID NO: 99326 - RNA, 64 nt, Human
uuugggguguaggguggcagcuccccaaggcccugccccccagccccacccacucaugacucua

SEQ ID NO: 99327 - RNA, 64 nt, Human
ugccucagccucccuaguagcugggauuauaggcgccccccaccacgcccaaguaacuuuugua

SEQ ID NO: 99328 - RNA, 64 nt, Human
cucacaugccuccccauggauuggggccucccaggccccccaccuuaugucaaccugcacuucu

SEQ ID NO: 99329 - RNA, 64 nt, Human
agugagcugggcaugguaccagcccuggggcugggccccccagcucaggggcagcucauagagu

SEQ ID NO: 99330 - RNA, 64 nt, Human
ccccucuccaccagcccuacuccugcggcugccugccccccagucuccccacuccacccuguua

SEQ ID NO: 99331 - RNA, 64 nt, Human
accccgucccuccucucccgcaggucugaaguuggccccccagcgcagaguagcugcuuccugg

SEQ ID NO: 99332 - RNA, 64 nt, Human
aguuucuaagcaauacauuuuggggguucccucagccccccaccccagaucuuagcuggcaggu

SEQ ID NO: 99333 - RNA, 64 nt, Human
acacauuucccccuuccuuucccagaagccacuggccccccauagcacccagugcauccuuuuu

SEQ ID NO: 99334 - RNA, 64 nt, Human
cccagcagaagccucuuucuccucucugcccccugccccccacaccacaccuguaggggaccug

SEQ ID NO: 99335 - RNA, 64 nt, Human
agaaccgucuuuaccucagcuccuagggccuccagccccccagcuccaccacggugacuuggug

SEQ ID NO: 99336 - RNA, 64 nt, Human
uuuucuucauuuuccuuuucucugcauaccccccgccccccaacguguagcucuccaucuaagu

SEQ ID NO: 99337 - RNA, 64 nt, Human
uuggagacaccauguggggccauugguguuaugagccccccaggccacacugcuucucagaaau

SEQ ID NO: 99338 - RNA, 64 nt, Human
uuccuucccuggcgcagucgcuccucgagccgcugccccccacccacccugcaccccucgcccu

SEQ ID NO: 99339 - RNA, 50 nt, Human
cucaacucgugaacuacuaggccccccagggguccagcaggguggcuggu

SEQ ID NO: 99340 - RNA, 64 nt, Human
ccucaggccuggcccucgggccuccgugaugggagccccccaggaggggucagaugcuggaagg

SEQ ID NO: 99341 - RNA, 64 nt, Human
agguccccaguggggcagcccuccccacagacgagccccccacauggugccgcggcacgucccc

SEQ ID NO: 99342 - RNA, 64 nt, Human
guuuguacauacacauaugcagacacaugccagggccccccaagcccgagcaccggaccacguu

SEQ ID NO: 99343 - RNA, 64 nt, Human
agcugcccauaaccugcuaaggucagggcccagggccccccacagcauggcugagggaccccuu

SEQ ID NO: 99344 - RNA, 64 nt, Human
auccaguggaaacacagccucacacugcccuuccgccccccacacuuugccugcaggugcaccg

SEQ ID NO: 99345 - RNA, 64 nt, Human
caugcaagguccacacccaaaagugucaauguuugccccccaaauaaaauugucuggcuucuga

SEQ ID NO: 99346 - RNA, 64 nt, Human
ucaacucuuucugcuugacaauguagcaacccaggccccccacccacgguccuccccuuuuucc

SEQ ID NO: 99347 - RNA, 64 nt, Human
uacuuaagcacuucugaacuuggguuucaugccugccccccacaaauuauguuuagaagcagca

SEQ ID NO: 99348 - RNA, 64 nt, Human
gaagccccaggccgcagggggcaaggggccaggugccccccaccagcugagaacaaagugucua

SEQ ID NO: 99349 - RNA, 64 nt, Human
acaccccgcuucucccggacucucccagcggacagccccccagccccacagccugagccuccca

SEQ ID NO: 99350 - RNA, 64 nt, Human
ugagccagccaggccuggccgcugggccugaccggccccccagccccuacaccccgcuucuccc

SEQ ID NO: 99351 - RNA, 64 nt, Human
ugcugggacagccgccgccucugcauguaccacagccccccacgccccauagggaggccaagcc

SEQ ID NO: 99352 - RNA, 64 nt, Human
aagugucuuuuauacuuuuaugaaaucauugguagccccccaaguguuuaauaacuggcauuaa

SEQ ID NO: 99353 - RNA, 64 nt, Human
uguggcaaagagcuugacccaggaaauagauggugccccccaaauugucuccacaugaagaugu

SEQ ID NO: 99354 - RNA, 64 nt, Human
guuuuuguuucucauucuucuuccucgccccucagccccccaacccccaacccccucccggucc

SEQ ID NO: 99355 - RNA, 64 nt, Human
uccaggggaagaauugguggccugagccgauggggccccccaggcccaggcgaaagggcagcag

SEQ ID NO: 99356 - RNA, 64 nt, Human
ccggaagcagaggugagaugggagcagcuugggagccccccauuggcgccgcccuacuggggaa

SEQ ID NO: 99357 - RNA, 64 nt, Human
cugcgcgccugcggggaacguaggcgggagucgugccccccagaccgguguucgcaucgcuggc

SEQ ID NO: 99358 - RNA, 64 nt, Human
augagaucuuguuguuucaaaguauguggcacucgccccccacacucucuugcuccugccuucg

SEQ ID NO: 99359 - RNA, 64 nt, Human
ugacugucuucuggaaggugcuguuugccugugugccccccacagaguacugccacggcugggc

SEQ ID NO: 99360 - RNA, 64 nt, Human
cuggccaggaaagggaacagaguccauccaagcugccccccacucaucugccaugguuguccac

SEQ ID NO: 99361 - RNA, 64 nt, Human
gccgccccgagcuggagggccuggcucccaccaugccccccaguggcugcagguagcuggacuu

SEQ ID NO: 99362 - RNA, 64 nt, Human
aagcacugagccagcaggugccagggagccacccgccccccaucgcuucugcacaccucagacu

SEQ ID NO: 99363 - RNA, 64 nt, Human
uaaagggaaggaaaggaagcugggcguccucugggccccccaacacacgucccauuuagcccug

SEQ ID NO: 99364 - RNA, 64 nt, Human
cucgaacuccugaccucgugauccgcccgccucggccccccaaagugcugggauuaacgggugu

SEQ ID NO: 99365 - RNA, 64 nt, Human
agcacccucuccuggggguggcaggcacacagcagccccccagcacuaaggccgugucucugag

SEQ ID NO: 99366 - RNA, 64 nt, Human
agggcaguggcgcucccugucagagcuggaucaggccccccaucgaggagggagggcagacgga

SEQ ID NO: 99367 - RNA, 64 nt, Human
gaacccugcugaugagcccacuccaggggccccagccccccaggaacuuggggcugccggugag

SEQ ID NO: 99368 - RNA, 64 nt, Human
gaggcccacccucgcccugcuugcccugccgcaggccccccaccagaagccaucucccccgcug

SEQ ID NO: 99369 - RNA, 64 nt, Human
ccacucuaugggaaacucuucagcaccuaccugcgccccccacacaccucucgaggcaccuccc

SEQ ID NO: 99370 - RNA, 64 nt, Human
uugggaagucauuaguugaacuauuuucacauuggccccccacacaggccacucucuucccuuu

SEQ ID NO: 99371 - RNA, 64 nt, Human
gaacccugcugaugagccugcuccaugggacccagccccccaggagauuggggcugccaacaag

SEQ ID NO: 99372 - RNA, 64 nt, Human
agucauaucugcuaaagcgaauccugggcucacugccccccacaggcacuguggccacugccag

SEQ ID NO: 99373 - RNA, 64 nt, Human
uaagcauguaccgcucccucaguccugugcugcagccccccaaauauauuuuucugauauagac

SEQ ID NO: 99374 - RNA, 64 nt, Human
agugugaaugugugaaacauccccucaggcugaagccccccacccccaccagagacacacuggg

SEQ ID NO: 99375 - RNA, 64 nt, Human
cggugccugucucagaagaaggggcccuuggccagccccccagcgacacuaugcaaauccugga

SEQ ID NO: 99376 - RNA, 64 nt, Human
aaggaggaagcccugcugugcagacaccucuguggccccccaggagugugaguggccuggggag

SEQ ID NO: 99377 - RNA, 64 nt, Human
caaaacaccacugcuuccuacccagguggcgacugccccccacaccuucccugccccguccuga

SEQ ID NO: 99378 - RNA, 64 nt, Human
auugccuucccacuaugcagccagggaugccccugccccccauggcucugugcugcucacuuua

SEQ ID NO: 99379 - RNA, 64 nt, Human
gccggcacggcugccggguagcgggcagcgggaagccccccaucuuugagguggacccccgagg

SEQ ID NO: 99380 - RNA, 64 nt, Human
ugugccuuucagugggcguggaggacuggccuuggccccccagggggcugcuggacuuugggag

SEQ ID NO: 99381 - RNA, 64 nt, Human
caguuucuugccgcuugggucuucagcacgccaagccccccaccaacccuccaccccgagugaa

SEQ ID NO: 99382 - RNA, 64 nt, Human
cugguuggcucccgcggugccaugucugcagugugccccccagccccgguggcugggcagagcu

SEQ ID NO: 99383 - RNA, 64 nt, Human
augucucuucccccagcagcucggaccacucccagccccccauccccccguuccccaggggagc

SEQ ID NO: 99384 - RNA, 56 nt, Human
ugcuucucaaggacagcuaguugggcgccccccacccucccccggacucgacagga

SEQ ID NO: 99385 - RNA, 64 nt, Human
caauuuauuuaaguuuaaaaaaaggaaaacugcugccccccaaaaaaagaaauuuucaaaacaa

SEQ ID NO: 99386 - RNA, 64 nt, Human
uuacuuuugucccgccgaguacuauguauuaccagccccccaccccacagaucaguuuuccuag

SEQ ID NO: 99387 - RNA, 64 nt, Human
ccuaccucugagcccaggcccccucccucccucagccccccaguccucccuccaucuucccugg

SEQ ID NO: 99388 - RNA, 64 nt, Human
ccaccagauaaccagcuaaucccaggaauuugcugccccccaccaguggcuucuagggaaagca

SEQ ID NO: 99389 - RNA, 64 nt, Human
uaaacuccuggccucaagcaauccuucugccuuggccccccaaagugcugggauugugggcaug

SEQ ID NO: 99390 - RNA, 64 nt, Human
uuuggacaggaguaaccgaggccgccccucccacgccccccagcgcacauguaguccugagucc

SEQ ID NO: 99391 - RNA, 64 nt, Human
accgcaaggaccuggagauugugcucugcagcgagccccccauguaaaguggggacgggggcug

SEQ ID NO: 99392 - RNA, 64 nt, Human
uuucaucugaggacuuucaucugugcauaucacggccccccagggcaguuccugcuggaccaga

SEQ ID NO: 99393 - RNA, 64 nt, Human
guguuauacaaucaagaaaugggggcaagggccugccccccacucccucaccuaccuccuuagc

SEQ ID NO: 99394 - RNA, 64 nt, Human
uuggggucugggcauuccccgugucuggaggacagccccccacuguucuccucaucuccagccu

SEQ ID NO: 99395 - RNA, 64 nt, Human
ggagaggaugaggcugcagagauggggaccagaagccccccaccccagcuuuccugggucugca

SEQ ID NO: 99396 - RNA, 64 nt, Human; identical to SEQ ID NO: 99377

SEQ ID NO: 99397 - RNA, 64 nt, Human
gagauuccaguuuuaggccuuucuccuucuaagugccccccacccccauagccugcauguccac

SEQ ID NO: 99398 - RNA, 64 nt, Human
ggggcugggcuucccuagaugucacuggacagcugccccccauccuacucaggucucuggagcu

SEQ ID NO: 99399 - RNA, 64 nt, Human
cuguuccaguucuggucaagggccuugggggcuggccccccaccaggccuucuagagcagcacc

SEQ ID NO: 99400 - RNA, 64 nt, Human
gcagaauagggaucggugugccccgcugcgaggggccccccaugggggcuguggccccuccgca

SEQ ID NO: 99401 - RNA, 64 nt, Human
ucagaaugcgaccuaugguggccuccuacuccuugccccccaccccgccccgccccuuccuucu

SEQ ID NO: 99402 - RNA, 64 nt, Human
gcaggaagaucuggcucagucuacuaugggcagggccccccaccaagcugagccgaauggagac

SEQ ID NO: 99403 - RNA, 64 nt, Human
ugggcuggcugcaccaugggcaggguugaggacugccccccaccccgcccaagccaaugcagac

SEQ ID NO: 99404 - RNA, 64 nt, Human
agcucaagagaaggcagagccccagcaccucugugccccccagagcucugugcagggaguuggc

SEQ ID NO: 99405 - RNA, 64 nt, Human
ucuuuuuuuuuuuuggacagaguguggaaagggagccccccaaaggauagcuucuuuuucauga

SEQ ID NO: 99406 - RNA, 64 nt, Human
acccauucagagacugucccugaaaccuaguacugccccccaugaggaaggaacagcaauggug

SEQ ID NO: 99407 - RNA, 64 nt, Human
ggaaggggcccccacucuccuuucaugucccugugccccccaguucuccuccucagccuuuucc

SEQ ID NO: 99408 - RNA, 64 nt, Human
acacuuggcccgaguuccuccauuucccuggccugccccccacccccaaccugucccacccccg

SEQ ID NO: 99409 - RNA, 64 nt, Human
acaggccgccgcagugcccgucggcgucccccgggccccccacugcaggucaccuccgaccucu

SEQ ID NO: 99410 - RNA, 64 nt, Human
ucccaguggccucaacccucccucagccccucuugccccccaccccagccuaagaugaagagga

SEQ ID NO: 99411 - RNA, 64 nt, Human
uacacaguggcaccuucaccugggcccaggaccugccccccacucugcacagguaccagcuucu

SEQ ID NO: 99412 - RNA, 51 nt, Human
aguuucuuggcuugcacugaagccccccaccccucccugcccccucccugg

SEQ ID NO: 99413 - RNA, 64 nt, Human
aggagcuggggagcuggggcccugggucagucuggccccccaccagcugccuguccaguuggcc

SEQ ID NO: 99414 - RNA, 64 nt, Human
agaauggagcagcagcaggacagacccccacgaggccccccagagaggaggaagaucccacgga

SEQ ID NO: 99415 - RNA, 64 nt, Human
aguuuccaguugcccuguccacuuacccuagguagccccccaccccaucagugccgaguccuug

SEQ ID NO: 99416 - RNA, 64 nt, Human
ugggggagggcagcucugggcacgccgcacccacgccccccaccugggggaaacaggcgguucc

SEQ ID NO: 99417 - RNA, 64 nt, Human
cuuuugccuggcugcaggguucggcucugccccugccccccagcccucguguguccacaccgca

SEQ ID NO: 99418 - RNA, 64 nt, Human
accucagacugauggugcccauguguucgccuccgccccccacccuugccaccacacucgccca

SEQ ID NO: 99419 - RNA, 64 nt, Human
ugggcucccaccauggggcccaugccgaguggaugccccccacccucucuccugggccacugag

SEQ ID NO: 99420 - RNA, 64 nt, Human
aucuuggcugcuguccugccucugaccaguggccgccccccacguuguugaauguccagaaauu

SEQ ID NO: 99421 - RNA, 64 nt, Human
cugccauuaguagagggggccccucugcaucugagccccccaucccugugccaccugggugugg

SEQ ID NO: 99422 - RNA, 64 nt, Human
cauuuucccuugcugggaguagccacaugcucuugccccccaacccuuguauauggggacagug

SEQ ID NO: 99423 - RNA, 64 nt, Human
ggaggaauucagcucagcuucuuccuagguccaagccccccacaccuuuuccccaaccacagag

SEQ ID NO: 99424 - RNA, 64 nt, Human
ucuccuccucuggagucagguggugggaguaccagccccccagcccacccacuuggcccacuca

SEQ ID NO: 99425 - RNA, 64 nt, Human
uauugaaaugaaggcuguggauucaaggcucccugccccccagaucauuuccccaauccuggca

SEQ ID NO: 99426 - RNA, 64 nt, Human
gcccugugagggcgagcggcaaaggcccggcugagccccccaugccccuccccuccccguguaa

SEQ ID NO: 99427 - RNA, 64 nt, Human
ucugccccuguugaggugggugggccugacuguugccccccaggguccuaaaacuuggauggac

SEQ ID NO: 99428 - RNA, 64 nt, Human
agaguaaauugacguacuugcaguuuaugaagcugccccccaccccucaguuaauugcagucua

SEQ ID NO: 99429 - RNA, 64 nt, Human
gaggaggagcuggccugcgguggagggaucaguugccccccaucaccagagucuuaagggucac

SEQ ID NO: 99430 - RNA, 64 nt, Human
aggggaagagaacaggauggagaauggaaggaaagccccccaggcuucgugaauugcaagaagg

SEQ ID NO: 99431 - RNA, 64 nt, Human
caugcagaggugcucuccuccuuucucagccauggccccccaucccugaccucagcuugggaag

SEQ ID NO: 99432 - RNA, 64 nt, Human
ccuccaaccucccccuuuuucguugugcagccuggccccccagggaccccagagggccagggcg

SEQ ID NO: 99433 - RNA, 64 nt, Human
ccugacccugugugcuggccgggaccugccaccagccccccagccugcuucuuccccuuaagcu

SEQ ID NO: 99434 - RNA, 64 nt, Human
ccucuggacagugcccaagucaggguccagaacugccccccaacacagguccacagacacccca

SEQ ID NO: 99435 - RNA, 64 nt, Human
acgugggcccagaggcccacagggacgcccaccugccccccacagaggcuggugguugagaugc

SEQ ID NO: 99436 - RNA, 64 nt, Human
gaggccgcagccaggccucugcugcccuuucugugccccccagguucuaucuccccgucacacc

SEQ ID NO: 99437 - RNA, 64 nt, Human
cuccaagagcugccaccgcuggggcugcacugcggccccccacgugaacucgguuguaacgggg

SEQ ID NO: 99438 - RNA, 64 nt, Human
ugugguccccccagcaccuucccugccccaccaugccccccacccugccacaccccucacccug

SEQ ID NO: 99439 - RNA, 64 nt, Human
ucagagacauucugcugugggcgcagggagcccggccccccaugcagccaugacuggaugcgcc

SEQ ID NO: 99440 - RNA, 52 nt, Human
aaggcggggccaaggcuugagcgccccccauggcugggagcccgaagcucgg

SEQ ID NO: 99441 - RNA, 64 nt, Human
caccucgcaggagccgccccccgggccccccucagccccccacuucccguacccguuugcccau

SEQ ID NO: 99442 - RNA, 64 nt, Human
guggcugagaggagccggcuguggagccccgcccgccccccacccucuagguggcccccguccg

SEQ ID NO: 99443 - RNA, 64 nt, Human
acugacgagccgaggcagcagugcccccaccguggccccccacgccccauuaacccccacaccc

SEQ ID NO: 99444 - RNA, 64 nt, Human
agccugcaggacaggccugggccuggugcccgaggccccccaucauccccuguuauuuauugcc

SEQ ID NO: 99445 - RNA, 64 nt, Human
ugaggcucuaugggguucccuggccaaggcgcuggccccccaaucucaggcaguuggggugagg

SEQ ID NO: 99446 - RNA, 64 nt, Human
cucucugcaccagggugacaagggguccucgucugccccccaaugcuccagggccaguccuaag

SEQ ID NO: 99447 - RNA, 64 nt, Human
uccagucucccagcagcagcaacauccccacgcagccccccagcaaguccucuggcaagccgga

SEQ ID NO: 99448 - RNA, 64 nt, Human
gccgcucucuucucugccucucaccaggacagccgccccccaggguacuccugcccuugcuuga

SEQ ID NO: 99449 - RNA, 64 nt, Human
acgucccggggccaggcuacggacuugcggacgagccccccaguccugggagccggccgcccuc

SEQ ID NO: 99450 - RNA, 64 nt, Human
agagaugcugcuaagucggcuccagcacacaggagccccccacaacgaagaguuagugccccca

SEQ ID NO: 99451 - RNA, 64 nt, Human
gagcccgcuccccucuccccgcgggccgggggacgccccccagacucacacgggggcuuauuua

SEQ ID NO: 99452 - RNA, 64 nt, Human
cacuuccaaaucccuccccucaccuucccccacugccccccaaguuccaggcucagucuuccag

SEQ ID NO: 99453 - RNA, 64 nt, Human
gugugcgugugccacgugagugccaaaguccccugccccccaagccagccagacccagacauua

SEQ ID NO: 99454 - RNA, 64 nt, Human
cuuuuucuuggaaccugccccuguucuucacacugccccccaugccucagccucauacagaugu

SEQ ID NO: 99455 - RNA, 64 nt, Human
uucaaagauggguaaaggagcuugcccucccugggccccccaccuuggugacucgccccaccac

SEQ ID NO: 99456 - RNA, 64 nt, Human
cuuucugugccccccgacuuucccccgccuccccgccccccacguggccacuuuucucuggauu

SEQ ID NO: 99457 - RNA, 64 nt, Human
cugcaagguggaguucuagccccaucgccgacacgccccccacucagcccagcccgccuguccc

SEQ ID NO: 99458 - RNA, 64 nt, Human
gagccauggccucugcuagcuccaccuugaaggagccccccacauccuccccuacaucccagag

SEQ ID NO: 99459 - RNA, 64 nt, Human
ccguuuaaggcuuuccuugguauuuggcacccaagccccccaucuccuauuccugaguccccaa

SEQ ID NO: 99460 - RNA, 64 nt, Human
cccuuucuguggcuggauggggagacaggucagggccccccacccucuccagccccugcagcaa

SEQ ID NO: 99461 - RNA, 64 nt, Human
auucaucccaggcuccucgugugaccccuucugugccccccaacccugccuggaucucccugcu

SEQ ID NO: 99462 - RNA, 64 nt, Human
ggccucauccccgaggccccaguuccuauaucgggccccccauucauccacucacacucccagc

SEQ ID NO: 99463 - RNA, 64 nt, Human
cacauccacaccccuugcagccguccaugccacagccccccaaggggccccauugccaaagcau

SEQ ID NO: 99464 - RNA, 64 nt, Human
ugggggagcugcuuagagacugugcccguccucggccccccacccugaagugccagcaccacca

SEQ ID NO: 99465 - RNA, 64 nt, Human
ggagggaggggaccccccuccaccccccuuccgugccccccaacugugaaucuguaaauaaggc

SEQ ID NO: 99466 - RNA, 64 nt, Human
cuugaacucuugaccucaugauccacccgccucggccccccaaagugcugggguuacaggugug

SEQ ID NO: 99467 - RNA, 64 nt, Human
cagcccgcugggcccugcugggggccucccccacgccccccaggacaguguccccccgagugac

SEQ ID NO: 99468 - RNA, 64 nt, Human
aucacuuccgccacagccuguuuaucaaaagcaagccccccaggcccagcccacgugcagaggg

SEQ ID NO: 99469 - RNA, 64 nt, Human
uccugccgcaccccuccgccgguccccacccucugccccccagcccucuggcgucucuagaaac

SEQ ID NO: 99470 - RNA, 64 nt, Human
uguccuucuguccuggauguuucaugggcccggggccccccagggaagcuuaccccuccugugc

SEQ ID NO: 99471 - RNA, 64 nt, Human
gaucguguggcuuccaaagccuuuuacagcccccgccccccaucccguggucugucugcaggaa

SEQ ID NO: 99472 - RNA, 64 nt, Human
ggaugcgccuacccugcugaggugggugacaggggccccccaccuccagggccuuagaaccacc

SEQ ID NO: 99473 - RNA, 64 nt, Human
ucaaggagugaggcuugguccaauacauggcucugccccccagaacuuaaggcucucacugccc

SEQ ID NO: 99474 - RNA, 64 nt, Human
uucaccccugacuucugcuucaccuuugaccucugccccccaugaaucccauuuuaccucuaga

SEQ ID NO: 99475 - RNA, 64 nt, Human
guccccucgaggcuucugaccuuugauccgcuaggccccccaucucugaacccuagagccccgc

SEQ ID NO: 99476 - RNA, 64 nt, Human
caggucagcgcgcccugccccggugcccaccgcugccccccauccgcccuccugccacuugccc

SEQ ID NO: 99477 - RNA, 64 nt, Human
gggggcccagacuccacagugacuugccacauuugccccccauuuggagaaugcuuuuauauca

SEQ ID NO: 99478 - RNA, 64 nt, Human
ggccucugccugggccucugugccagccccgggggccccccaguuacucagucuuuccuggaga

SEQ ID NO: 99479 - RNA, 64 nt, Human
gaguagggguggggagguggucugccggugcccugccccccagcacugcccuaccccuccacuc

SEQ ID NO: 99480 - RNA, 64 nt, Human
cugggauaugaugagagauuccagcccaagccuggccccccaccgccaggccauagggcauaau

SEQ ID NO: 99481 - RNA, 64 nt, Human
ugccucagcccagcucugcaaauccccucccccugccccccaccuccccaggcucaccuugcca

SEQ ID NO: 99482 - RNA, 64 nt, Human
cucugcuuugagucaaggggcuucacugccugcagccccccaucagcauuaugccaaaggcccg

SEQ ID NO: 99483 - RNA, 64 nt, Human
cccucucccacuuuucccuuccucuuuccccacagccccccagccccucagcccucccagccca

SEQ ID NO: 99484 - RNA, 64 nt, Human
uguguagcugaauucccaagcccugcauuguacagccccccacuccccucaccaccuaauaaag

SEQ ID NO: 99485 - RNA, 64 nt, Human
ccagaccuguucugaccucaugagugucaaacgugccccccaguuccuuaggagaugucaugac

SEQ ID NO: 99486 - RNA, 64 nt, Human
cggucacacaguuucucggcucuuccuccccgcugccccccacgacccuaccuugaaggccccc

SEQ ID NO: 99487 - RNA, 64 nt, Human
gcccuuccccugccuaguccccgccugagugccagccccccaccccgccugccgcccccugucc

SEQ ID NO: 99488 - RNA, 64 nt, Human
ccgcccccucauccugccuccaguucccggccacgccccccaggaccccugccccuccggggac

SEQ ID NO: 99489 - RNA, 64 nt, Human
aucugaccuucuugaaggaguuaacagacagguggccccccaggaagcagagagcgccagauuu

SEQ ID NO: 99490 - RNA, 64 nt, Human
cucuuggcccccagccugagcccugguggcccuggccccccacucccaaugagcagcccaggcc

SEQ ID NO: 99491 - RNA, 64 nt, Human
ugugugacaaaccaggcuguucacagcuuccucagccccccagaaggggagugucaggaagaga

SEQ ID NO: 99492 - RNA, 64 nt, Human
cugggacugcucaggcuccccaagacuugacgcagccccccacgcuucuggagguggggagggc

SEQ ID NO: 99493 - RNA, 64 nt, Human
cgaaguccgaggccuggcucuggagcccgccugcgccccccaguggacucgcgagagggugccg

SEQ ID NO: 99494 - RNA, 60 nt, Human
augaggaggaccugcgcuaagccccacccagccccccagugcccgucuuccugucccauc

SEQ ID NO: 99495 - RNA, 64 nt, Human
ccugcauccaggaugguaccagcucccgccccucgccccccaccuccacaggugccuuaaaggg

SEQ ID NO: 99496 - RNA, 64 nt, Human
aaagaugucccucuccccagcccuccgccucaccgccccccacccccgaccccguccuuagaau

SEQ ID NO: 99497 - RNA, 64 nt, Human
gaggcgaggggccaugcaugucugggggaccccugccccccaaaacccucugucugucucuguc

SEQ ID NO: 99498 - RNA, 64 nt, Human
cccugugucaucccaucauuuuccauauccuggugccccccaccccuggaagagcccagucugu

SEQ ID NO: 99499 - RNA, 64 nt, Human
aguccccucagccuccaugacaggucccucccuggccccccaacccucuuccucccuugcccca

SEQ ID NO: 99500 - RNA, 64 nt, Human
uguuccccgaggaggaagggaaggggcucugugugccccccaggaggaagaggcccugaguccu

SEQ ID NO: 99501 - RNA, 51 nt, Human
gccaagaagccaaccaauaaggccccccaccccaagcaggaaccccaggag

SEQ ID NO: 99502 - RNA, 64 nt, Human
cuggacaugauuuagggaagcagggacaccccccgccccccaccuuugggaucagccuccgcca

SEQ ID NO: 99503 - RNA, 64 nt, Human
cugaaacuuuaaaaaauaauugguauuauuuugugccccccacuuaauauggauagauuuuaau

SEQ ID NO: 99504 - RNA, 64 nt, Human
cucccugcggcuguguccuuagugcuguuaggaggccccccaauccccacguugagcugucuag

SEQ ID NO: 99505 - RNA, 64 nt, Human
ggcacccccagccagaacacgcagugccagccgugccccccaggcaccuucucagccagcagcu

SEQ ID NO: 99506 - RNA, 64 nt, Human
agcagaccaggguuggcaaggcuggcaccaacaagccccccaggugccggggaagaggggccag

SEQ ID NO: 99507 - RNA, 64 nt, Human
acccggaggaggagcagcagcugugucauccugugccccccaugugcugugugcuguuugcaug

SEQ ID NO: 99508 - RNA, 64 nt, Human
cccuccuugacccagaaguccagaagggucaucugccccccaacuccccuccgucugugacaug

SEQ ID NO: 99509 - RNA, 64 nt, Human
uugguuuucuuuccagauuggagguuuccaagaggccccccaccguggaaguaaccaagggcgc

SEQ ID NO: 99510 - RNA, 64 nt, Human
cuggcucccuucgggggcugucugcgccuuccacgccccccaggacgggcccagaggcuggggg

SEQ ID NO: 99511 - RNA, 64 nt, Human
gcccucuccagggggccaguucagggccccagcugccccccaggauggauaugagaugggagag

SEQ ID NO: 99512 - RNA, 64 nt, Human
aacuuuccugggcucaagcgacccuccugccucagccccccaaguagcugggacuaaagucaug

SEQ ID NO: 99513 - RNA, 64 nt, Human
auucucuauuggaggugagaucacagccuccagggccccccaaaucccagggaaggacuuggag

SEQ ID NO: 99514 - RNA, 64 nt, Human
gugaccuuacgauguucccuaggccacaagagaggccccccauccucacaccuaaccugcaugg

SEQ ID NO: 99515 - RNA, 64 nt, Human
accuccuccucccuucuuucuuugaagccuaauggccccccaaaagaugggcaggacaagcugu

SEQ ID NO: 99516 - RNA, 64 nt, Human
gcaaggauccggagccagcucccaggggcccagagccccccacuugaagaggagcuugagcuuc

SEQ ID NO: 99517 - RNA, 64 nt, Human
cacuggcuggacuggaggcuggguggccggcccugccccccacauucuggcuccaccgggaggg

SEQ ID NO: 99518 - RNA, 64 nt, Human
gccugcuuugcuccagcacagcagagaccagcaggccccccaacccagagacugggucugcugg

SEQ ID NO: 99519 - RNA, 64 nt, Human
ggcagugcacccccuaaagauggcgcacccggcagccccccaguguccccaggggcacacuucc

SEQ ID NO: 99520 - RNA, 64 nt, Human
ggggcuccuuccaggaggggacccucagcccugugccccccaccacuucaggccacaccagguu

SEQ ID NO: 99521 - RNA, 64 nt, Human
ggccuggaagugaaagccgccuccuucccguuaugccccccauacaggagccucgguuuuucag

SEQ ID NO: 99522 - RNA, 64 nt, Human
cgcucaggucagaagcccagcugcugauggacacgccccccagugccagccaggcucagguccc

SEQ ID NO: 99523 - RNA, 64 nt, Human
ccgucccaaggguauuacugguggaauaauauccgccccccaccccaguuucuaauuugcugua

SEQ ID NO: 99524 - RNA, 64 nt, Human
augccccuuggggggcuugagacaaauccuuucugccccccagggcuagugaaguggccucuug

SEQ ID NO: 99525 - RNA, 64 nt, Human
gaggagcccucgggucagcccugcccccagagcugccccccacgggcauccuacccacugccuc

SEQ ID NO: 99526 - RNA, 64 nt, Human
cucuuuuguuggcagauguccccgcuucccuccagccccccauccuuggcauguauauuaguag

SEQ ID NO: 99527 - RNA, 64 nt, Human
ccggcacacauuccauuuguugagccccaguccugccccccaccccacccucccuaccccuccc

SEQ ID NO: 99528 - RNA, 64 nt, Human
cucguggaggaugggcaucugagguggcccugcagccccccaccuucuggcccucccaccagag

SEQ ID NO: 99529 - RNA, 64 nt, Human
guucaggugccggucggcguagccaggccuggaggccccccaggcaggaggccgcccaaaggcg

SEQ ID NO: 99530 - RNA, 64 nt, Human
ucccuccccaccuggcccucccaggacagcucucgccccccacaaaggggcaugggccuccagc

SEQ ID NO: 99531 - RNA, 64 nt, Human
acauucccuucgugggcccugucuuccucuugcagccccccaaacugggaccgaaugacccugg

SEQ ID NO: 99532 - RNA, 64 nt, Human
auucuccacgcccuccccaucucccagucucccugccccccaugccccagaccggcccaccagg

SEQ ID NO: 99533 - RNA, 64 nt, Human
guaggcuaauggaaaauacccaagggagggcaaagccccccaucagaugcaugaauguuugcga

SEQ ID NO: 99534 - RNA, 64 nt, Human
acaaaauaaucuagugugcagggcauucaccucagccccccaggcaggagccaagcacagcagg

SEQ ID NO: 99535 - RNA, 64 nt, Human
ccgccuccuggguucaagcgauccuccugccucagccccccacuagcugggacuacaggcacau

SEQ ID NO: 99536 - RNA, 64 nt, Human
ucuguagcugagagauuuuuauucauuuuuaacugccccccaaccccacuccaacuccuucucc

SEQ ID NO: 99537 - RNA, 64 nt, Human
cuucagcuccgaaccccaccccacucaguacauggccccccaacaggcuuucaaaugucugccu

SEQ ID NO: 99538 - RNA, 64 nt, Human
acugaagugacgugagaccccugcaaaugggacagccccccaguucaugaggccuggcuauugc

SEQ ID NO: 99539 - RNA, 64 nt, Human
guagcuauaucugccccuauuuuccuguucugcagccccccaaauccacauguaacucauuacu

SEQ ID NO: 99540 - RNA, 64 nt, Human
uccccuccuggcccaggugugcugggggcaccgugccccccaccccccugcccuccucagggug

SEQ ID NO: 99541 - RNA, 64 nt, Human
cggugcuaaccuggcagcuguggggcccuuaggagccccccaccgaggguggacacagucccuu

SEQ ID NO: 99542 - RNA, 64 nt, Human
aggggcaggcugaggcuguggaggggacaagcacgccccccagaacgcagucuccacugagggc

SEQ ID NO: 99543 - RNA, 64 nt, Human
cuggcgcugcuccgcccugugccccccgcccaucgccccccacccaucucuggagagcccucug

SEQ ID NO: 99544 - RNA, 64 nt, Human
ucaggucgugaguccaggggucuacaagucccgggccccccaguucacgauucuggcgcggacu

SEQ ID NO: 99545 - RNA, 64 nt, Human
cgaggagaaaugagaaaaucccagaucucugagcgccccccaacuccauuccccuguguucuuc

SEQ ID NO: 99546 - RNA, 64 nt, Human
gaagcuaagccagggcccagcugcguccaacccagccccccaccucgggucccugaccccagcu

SEQ ID NO: 99547 - RNA, 64 nt, Human
gagacacaauagcaaggaaauccccauugagccugccccccaccuccggcgcgugggcauccug

SEQ ID NO: 99548 - RNA, 64 nt, Human
uaccaaacaugaauuuucaguucccucccucccagccccccaauuuccugcgggcggguacaaa

SEQ ID NO: 99549 - RNA, 64 nt, Human
augacuaagcucucucaugacccaccucagcucagccccccagccccugccagcuccacacuau

SEQ ID NO: 99550 - RNA, 64 nt, Human
ccagcccacauccccacugccccuguacaguccugccccccagcacccuccagcccacaaacag

SEQ ID NO: 99551 - RNA, 64 nt, Human
gaaagaucucaaaaagcaacuucugcccugcaacgccccccacuccauagucugguauucugag

SEQ ID NO: 99552 - RNA, 64 nt, Human
gaucacugcuccaucgugaggagcccucugaauagccccccacugaaugcuugccuugcccaaa

SEQ ID NO: 99553 - RNA, 64 nt, Human
aggugacacagaauaugauucccucacugccccugccccccagaaaggagagugaaacucuuau

SEQ ID NO: 99554 - RNA, 64 nt, Human
cugacagcuuuccuuuggggugccaggcagcgaggccccccaccccuauccugccauguacuuc

SEQ ID NO: 99555 - RNA, 64 nt, Human
ccaacuuuguguguguggggacgggggagucagggccccccaagucccacaauagccccaaugu

SEQ ID NO: 99556 - RNA, 64 nt, Human
cccgccacagccacucaggccuccgugcuggccagccccccaaguggugaugcccagguguguu

SEQ ID NO: 99557 - RNA, 64 nt, Human
gcuccgaggcugggggaucugcuuggaguuuucugccccccaccccaaacuucugucgaggagc

SEQ ID NO: 99558 - RNA, 64 nt, Human
ggugaaggcuuugaagagcacacagaagccccuggccccccacgagagcuggagagccauguau

SEQ ID NO: 99559 - RNA, 64 nt, Human
uaucugaugccucugcaguucaugucccccaccaggccucgaggcucagggugggagagggccc

SEQ ID NO: 99560 - RNA, 64 nt, Human
cggacccacuucucacagacucuggcacuggccaggccucgaaccugggaccccuccucugaug

SEQ ID NO: 99561 - RNA, 64 nt, Human
ccgccguacucuuuggggcagcuggucccggagaggccucgacccaccccagugcuuguuccuc

SEQ ID NO: 99562 - RNA, 64 nt, Human
aguagagaugggguuucaccauguuggccaggcuggccucgaacuccugaccucaggugaucug

SEQ ID NO: 99563 - RNA, 52 nt, Human
aggugguggacaacuccugaauggccucgagccugcaacaguccaaaccgga

SEQ ID NO: 99564 - RNA, 64 nt, Human
gguggcacccagcauccugaagccaagaaaggugggccucgaccugugacucacacccagugga

SEQ ID NO: 99565 - RNA, 64 nt, Human
ugggaacuccaacauaugaugaaaaccccaugaaggccucgaaaaagcccaagacagcagaagc

SEQ ID NO: 99566 - RNA, 64 nt, Human
aagcacugugccuggccccccagcuuccuguaugggccucgaaacacaaugggccuucucgcuc

SEQ ID NO: 99567 - RNA, 64 nt, Human
agguuuggaaggaaugccaggucucgcacagcuuggccucgagaaggugagaggaaggcaaagg

SEQ ID NO: 99568 - RNA, 64 nt, Human
aagccuguuucccauaucacagauguggggccauggccucgaugauggucuccacaggucuuuc

SEQ ID NO: 99569 - RNA, 64 nt, Human
aguagagacagaguuuugucacuuuggccagguuggccucgaacucaggugaucugccagccuc

SEQ ID NO: 99570 - RNA, 64 nt, Human
agcgcugacugugcgcuagacacugccaggcccgggccucgaggaggaaaagacaguagggaag

SEQ ID NO: 99571 - RNA, 64 nt, Human
ugcuuuuggagcagggguccaaggaagagaggguggccucgacaucaaacugccuggauuuuuc

SEQ ID NO: 99572 - RNA, 64 nt, Human
aaguccccuggucugucccuucuuuggggagcagggccucgacagcuccagcucccuugaccua

SEQ ID NO: 99573 - RNA, 64 nt, Human
uugguccaucccuucaggcuucugacacacuaguggccucgagucacugauaguggugccuccu

SEQ ID NO: 99574 - RNA, 64 nt, Human
gccuccuggucccugguuggccucagacaagcacggccucgagaaaagagccaagcgcaucggg

SEQ ID NO: 99575 - RNA, 64 nt, Human
cugaguuccaaagaaggaaauagagcaacacaaaggccucgaaaagaggucuccagcaaaaggc

SEQ ID NO: 99576 - RNA, 64 nt, Human
uggggucaggguccaagaggaauggguguucuguggccucgaguccucuccuguuugcgaaaau

SEQ ID NO: 99577 - RNA, 64 nt, Human
cuggaaggggaucccaccccauuuucugugggcaggccucgaaaaccaucacaugaccacauag

SEQ ID NO: 99578 - RNA, 64 nt, Human
cggaaacaggugggucaccuccugcaagaaguggggccucgagcugucagucaucauggugcua

SEQ ID NO: 99579 - RNA, 64 nt, Human
aguagagacgggguuucacuguguuagccaggacggccucgaucuccugaccucgugauccacc

SEQ ID NO: 99580 - RNA, 64 nt, Human
uuucauaaauucgcagucucagcuuaugguuuauggccucgauucugcaaaccuaacaggguca

SEQ ID NO: 99581 - RNA, 64 nt, Human
uuguccuauugcaaaaugaaacaaaauuaaaaguggccucgaguacuugguaaguuacuuaaaa

SEQ ID NO: 99582 - RNA, 64 nt, Human
ucacacccgcugccagagcccaccucuccuccuaggccucgagugcuggggaugggccuggcug

SEQ ID NO: 99583 - RNA, 64 nt, Human
gcacgggccuccagggcccuguaagguggacucuggccucgaaggggggcccaggucugagggg

SEQ ID NO: 99584 - RNA, 64 nt, Human
accacugcaggcuccucuuccagacucaccagggggccucgaggccccggcaucucccuuggcc

SEQ ID NO: 99585 - RNA, 64 nt, Human
aaggugcaggugcuccacaaacgggugguaaaaaggccucgagcucuuggauguuguauuucag

SEQ ID NO: 99586 - RNA, 64 nt, Human
cagguccggggaggagguucgggauucccuggugggccucgacgucccuuggaucagaggucau

SEQ ID NO: 99587 - RNA, 64 nt, Human
aacugucacgguacgaaaucuuagugcccacggaggccucgagcagagagaaugaaagucuuuu

SEQ ID NO: 99588 - RNA, 64 nt, Human
aucccacccuacagagaccagcaagguucugccaggccucgagcauccaagcaugauuuugcug

SEQ ID NO: 99589 - RNA, 64 nt, Human
aggcucuuccugcugcugcucucccuggacgaccggccucgaggcaacccuggggcccaccagc

SEQ ID NO: 99590 - RNA, 64 nt, Human
gggcuccugagcuuacaaagcauggcaggccaagggccucgaccacaggccagcauuagcagaa

SEQ ID NO: 99591 - RNA, 64 nt, Human
uccccuccccuccccucgcccgccuucgccgcccggccucgaguccccgcccgcccccgcuccc

SEQ ID NO: 99592 - RNA, 64 nt, Human
ccaggggcaucaggugcugguccuccucccuccuggccucgaccccuaagggcuucgccccucc

SEQ ID NO: 99593 - RNA, 64 nt, Human
ucuguccccaccggggagugggccuugauggccgggccucgaaggccacaaacaaggcgucgag

SEQ ID NO: 99594 - RNA, 64 nt, Human
agagcccagaccagccccucugcccuccuacccgggccucgaaggguguggcacaggcuacgug

SEQ ID NO: 99595 - RNA, 64 nt, Human
aauuugguguaagcaaccuguggccugcacuuguggccucgaaggaagcacaaacccuccaucc

SEQ ID NO: 99596 - RNA, 64 nt, Human
gguggacuugggguccuaaguggggagggacuggggccucgaagggauuccuggagcagcaacc

SEQ ID NO: 99597 - RNA, 64 nt, Human
ggcgggugggaggccgcggccaccgccaccugccggccucgagaggggccgaugcccagagaca

SEQ ID NO: 99598 - RNA, 64 nt, Human
uaguggagacagguuucaccauguuggccaggauggccucgaucucuugaccucgugauccgcc

SEQ ID NO: 99599 - RNA, 64 nt, Human
ucucccuacccuggcucugccaucagccuugaagggccucgaugaagccuucucuggaaccacu

SEQ ID NO: 99600 - RNA, 64 nt, Human
ccucagccugggucccgccuagccuaagagugguggccucgagggagcugcaucuugcagccgu

SEQ ID NO: 99601 - RNA, 64 nt, Human
uaagcccaaggaagaagggcggaaccagaaguagggccucgacuugcuucagacgacacagagc

SEQ ID NO: 99602 - RNA, 64 nt, Human
gaugggcgagcgagcgucugcucacuggcucuggggccucgaggugccaggcagcaucaggccc

SEQ ID NO: 99603 - RNA, 64 nt, Human
gaaggcaggucuuccccuagcacauggggaccccggccucgagggugaccucccuaccccgccc

SEQ ID NO: 99604 - RNA, 64 nt, Human
gugguggagaacaagugccuucagggcuggccucggccucgagucucgggacagaggccgccag

SEQ ID NO: 99605 - RNA, 64 nt, Human
accaggcucugugcugggggacgauacuggcccuggccucgaccagcuuagagguuucucacac

SEQ ID NO: 99606 - RNA, 64 nt, Human
cucccggccguggggcgccccuccuggacuuccgggccucgauuucuuccgcacaagccugacc

SEQ ID NO: 99607 - RNA, 64 nt, Human
gugggcugugggugcugacguuguagaagcgaguggccucgaaggcuacgggacgaggguggcg

SEQ ID NO: 99608 - RNA, 64 nt, Human
ccccggcucugacugagaguaaggggacugucagggccucgacuugccauugguuggggucgua

SEQ ID NO: 99609 - RNA, 64 nt, Human
cugcagacagaccucaagggacagggaaugcugaggccucgaggggccucccggggcccaggac

SEQ ID NO: 99610 - RNA, 64 nt, Human
cauuucacgcccuccaucucacagucaagauaaaggccucgagaauaaagagccagcccccuuc

SEQ ID NO: 99611 - RNA, 64 nt, Human
aaccccguguaucucucaauaaagguggccgaagggccucgauguggacuugaguguugagggc

SEQ ID NO: 99612 - RNA, 64 nt, Human
gcuccagugcaugucugcugggacaaggauuccuggccucgaagcccugggcugcacagcccua

SEQ ID NO: 99613 - RNA, 64 nt, Human
cucuggaugugcacugucagucauguguccaccaggccucgaauaucauaugggaaaugucaua

SEQ ID NO: 99614 - RNA, 64 nt, Human
acgauuauagcaauuuaagggcccaccagaagcaggccucgaggagucaauuugccucugugug

SEQ ID NO: 99615 - RNA, 64 nt, Human
ucucgcagacuaggggcugggggcggccacagacggccucgaaaccacagcccuuaccccaauc

SEQ ID NO: 99616 - RNA, 64 nt, Human
auuuauuguagaugaaaugcacucuucucgaugaggccucgauuugaaucaauggggugggcca

SEQ ID NO: 99617 - RNA, 64 nt, Human
uagaccauuuggggucugaggagaaacaggcuggggccucgagaaggagucacucagacaagcc

SEQ ID NO: 99618 - RNA, 64 nt, Human
uccuccaaggacagaaggcuccugcccccauaguggccucgaacuccuggcacuaccaaaggac

SEQ ID NO: 99619 - RNA, 64 nt, Human
ccagacaccacccacugcuucgccggacaaugucgaaguccagucugugccggggaaggcacug

SEQ ID NO: 99620 - RNA, 64 nt, Human
ugugaauggcuagaagaaggagcucaguaaacuagaaguccaggguugcuugguuuacugguuu

SEQ ID NO: 99621 - RNA, 64 nt, Human
aauuucucuucuggauauuuuguuuauuuuuucugaaguccaaaaaauuaucauuacaguguac

SEQ ID NO: 99622 - RNA, 64 nt, Human
ccucucagggcuuggagaagaucucugccuacaugaaguccagccgcuuccucccaaaaccucu

SEQ ID NO: 99623 - RNA, 64 nt, Human
aauaguuuauuuguuucauaaaucuaaaagcugagaaguccaagaugguggggcugccucuggu

SEQ ID NO: 99624 - RNA, 64 nt, Human
accaagucaucuggaauggucuacaugccaugcggaaguccaccgaaggguuagaacagggugu

SEQ ID NO: 99625 - RNA, 51 nt, Human
caaaugagcuuaagcuguaaagaaguccaaauuuacagguucagggaagau

SEQ ID NO: 99626 - RNA, 64 nt, Human
uccccugggcggcggaggggcauugcacuuccgggaaguccaccuagcggcuguuugccugucg

SEQ ID NO: 99627 - RNA, 64 nt, Human
aauucucucuaccacacugccuuugacacucuuggaaguccauguaguucucuacagauagacu

SEQ ID NO: 99628 - RNA, 64 nt, Human
ucagcagugcggucagagaagggcuuuuggucuugaaguccagguaccauccccccuuagcaua

SEQ ID NO: 99629 - RNA, 64 nt, Human
uaaacaucauuuguucuucaguauuuuucauuuggaaguccaauagggcaaauugaaugaagua

SEQ ID NO: 99630 - RNA, 64 nt, Human
cacuugcuucucauuuggcuauucuuuuccuaaggaaguccauucuccucuguacagacagcug

SEQ ID NO: 99631 - RNA, 64 nt, Human
ggaaaagaaggcucuuuggggacccugacaugaagaaguccacuaagugggagaucuucucuca

SEQ ID NO: 99632 - RNA, 64 nt, Human
uuuugcuggaagguccaggauggaccaugugacagaaguccacgggcacccucuguagucuucu

SEQ ID NO: 99633 - RNA, 64 nt, Human
acauacauuuugcuuuuuuaauaaauguuuaaaagaaguccacauaagaaaugguguugucagg

SEQ ID NO: 99634 - RNA, 64 nt, Human
uauuauuuuaggcggccagugaacugcugcuucagaaguccauagcccagcucugaacuuucuc

SEQ ID NO: 99635 - RNA, 64 nt, Human
aauaggagacuuuagcacacuucacuuguuucuagaaguccagaauuuuggaccuccacgugaa

SEQ ID NO: 99636 - RNA, 64 nt, Human
cgugauguuuguaguuacuauaaaucaagcuuuggaaguccaaaaagaauaaaagacugccuuc

SEQ ID NO: 99637 - RNA, 64 nt, Human
ggagaaaggauaacaauagaauguucuaaaaccagaaguccaagugcgugucuacuuaugggac

SEQ ID NO: 99638 - RNA, 64 nt, Human
ccugggguuucgggaagguguugaggaaucuauagaaguccaaauuauagguuguauucuucca

SEQ ID NO: 99639 - RNA, 64 nt, Human
cugcagagcuucauaacugggaauuugauuugaagaaguccaugucauauguguaacuaguacu

SEQ ID NO: 99640 - RNA, 64 nt, Human
ccauuccagagcugcagaaccagucccucugagugaaguccagugacccuggagcuaggguccc

SEQ ID NO: 99641 - RNA, 64 nt, Human
ggcuacucaacagguuugaggccccacagcaacagaaguccaggacccacuagguugccucaga

SEQ ID NO: 99642 - RNA, 64 nt, Human
uuaauagaauggaggggacuccaaagcuggaacugaaguccaaauuguuuguacaguaauaugu

SEQ ID NO: 99643 - RNA, 64 nt, Human
cugugaaugcagcuugcuucucucuacagauugagaaguccagcuucaaaaguuacuugccacu

SEQ ID NO: 99644 - RNA, 64 nt, Human
uuccaaaaaaguggcaaaucccguuggagguuuugaaguccaacaaauuuuaaacgaauccaaa

SEQ ID NO: 99645 - RNA, 64 nt, Human
ggagagccugcuugggaaugaaauuaacacaaaggaaguccaaccugagaaauggccaaauaua

SEQ ID NO: 99646 - RNA, 64 nt, Human
uuuugagacaggaucucacucugucauccaggcugaaguccaaucccacaaucauggcucacug

SEQ ID NO: 99647 - RNA, 64 nt, Human
cuuuaaggggaggaaccagagugcugaaggaauggaaguccaucugcgugugugcagggagacu

SEQ ID NO: 99648 - RNA, 64 nt, Human
caauuuuaacccaaagucauuggauuauuuauaugaaguccauaauguucgaguaccucaggga

SEQ ID NO: 99649 - RNA, 64 nt, Human
agcuaccaccuaacuccucacucccugaucaauggaaguccaggucaguggagucucuccuuga

SEQ ID NO: 99650 - RNA, 64 nt, Human
cgguaaauauaggauuggugaccaauugggucaggaaguccaguguucuggacuugggguaagc

SEQ ID NO: 99651 - RNA, 64 nt, Human
aaaagggcugguaaugcaguuacauucuaacagagaaguccaaacuacagguaaaaacuacggc

SEQ ID NO: 99652 - RNA, 64 nt, Human
ucuugcucugugccucauagggaauaaacacaaugaaguccaggguuguacaacauucccuuuc

SEQ ID NO: 99653 - RNA, 64 nt, Human
guauauaaaacuugcuuuauugcauggggcaggggaaguccaggccuaauacuccuaaaguaag

SEQ ID NO: 99654 - RNA, 64 nt, Human
ucagaguggguucugccgaacccuccucucacaggaaguccagaggaagggggaguaucugugg

SEQ ID NO: 99655 - RNA, 64 nt, Human
caugugcacgugagucuggugaaaauggccuugugaaguccagugucugucaugccccugaguu

SEQ ID NO: 99656 - RNA, 64 nt, Human
auguagccuucagucuccucauuuguccuuugaggaaguccacauuuguucacaguugcagccu

SEQ ID NO: 99657 - RNA, 64 nt, Human
guggccccuaugguagggacuccagcaccagguggaaguccauauggacaacaggugagccucc

SEQ ID NO: 99658 - RNA, 64 nt, Human
agagagucaugcuggaggagaaggaaguaggccagaaguccagggcugcacuguggugugaggg

SEQ ID NO: 99659 - RNA, 64 nt, Human
ccaaggggauguggggaagauggcaggaaaguuagaaguccauguucccuuaauugucuuguug

SEQ ID NO: 99660 - RNA, 64 nt, Human
augugcugaaagaaaaaaaaaacgcccaacucuugaaguccauugcugaaaacugcagccaggg

SEQ ID NO: 99661 - RNA, 64 nt, Human
uuagaagcacauguacauacauggaccucauucagaaguccauguuguagcaguuagaauuuga

SEQ ID NO: 99662 - RNA, 64 nt, Human
gcuguacucugauguuucagugaagcucauccacgaaguccagaauucugccuggaaaccagcu

SEQ ID NO: 99663 - RNA, 64 nt, Human
gugcaagccgggggucuccacaucuuccuucucugaaguccagguaccugcacaagcaggaagc

SEQ ID NO: 99664 - RNA, 64 nt, Human
ugucacacauuguacauggaaacaagaacauuaagaaguccacugacaguaucaguacuguuuu

SEQ ID NO: 99665 - RNA, 64 nt, Human
aguaugaaauuucccaccaggcuaagcaaauaaagaaguccauugccuuauagcuaugucagau

SEQ ID NO: 99666 - RNA, 64 nt, Human
cuuuauuacuugauucugucuucuguauaacucugaaguccaccaaaaguggacccucuauauu

SEQ ID NO: 99667 - RNA, 64 nt, Human
ggucuugcuaaacacuacagguagguuggucuuugaaguccacuaguggagaaugucaagacaa

SEQ ID NO: 99668 - RNA, 64 nt, Human
gggaggcugaggugggaggaucacuugagcccaggaaguccagaacguagugagccuugauuau

SEQ ID NO: 99669 - RNA, 64 nt, Human
uuugaaagaagucaaaugaaugagcucucuaauagaaguccaugaguugaguggguauuucuua

SEQ ID NO: 99670 - RNA, 64 nt, Human
gaagaccagcucucuccaggacaucgggcugcgugaaguccagugacccugaggggauuuuggc

SEQ ID NO: 99671 - RNA, 64 nt, Human
uaugaaccacauggaacuuaaaacauaugggugugaaguccacuuauguagacaaaacuuauaa

SEQ ID NO: 99672 - RNA, 64 nt, Human
ccugcuugagcccagcgcugcaugucccucccaagaaguccagaaugccugcaaauugcuguaa

SEQ ID NO: 99673 - RNA, 64 nt, Human
auuccaggaagcuccuugccaugcuguuggccuggaaguccaccugucugguccauagugacgu

SEQ ID NO: 99674 - RNA, 64 nt, Human
uuguuuguaacagugaaaaauugaaaacaaccuggaaguccagugaugggaaaaugaguauguu

SEQ ID NO: 99675 - RNA, 64 nt, Human
augaaguaccuagcacacugccuaguacauaguagaaguccaggaaauggaagccauuauuaug

SEQ ID NO: 99676 - RNA, 64 nt, Human
aggugccccuacuugcuuucugcuuccuucuggugaaguccaccuccaacauuaaccugcccac

SEQ ID NO: 99677 - RNA, 64 nt, Human
gguauggaaacccuucauuccucauagguacugggaaguccauuugcaagcugagcgccaggcc

SEQ ID NO: 99678 - RNA, 64 nt, Human
gcucuagaaagggacuaaacuuauucucucauccgaaguccaaagaggaugaugaagcccuggg

SEQ ID NO: 99679 - RNA, 64 nt, Human
aguggggggaacgccucuguucaguucauucccagaaguccacaggacgcacagcccaggccac

SEQ ID NO: 99680 - RNA, 64 nt, Human
guggggagcugguucccagaggauugucuacccugaaguccaucagguuuucuguugcacaagg

SEQ ID NO: 99681 - RNA, 64 nt, Human
gcaagaagggagacacagcugcccugggagggaagaaguccaagaagaagagcagcagggccaa

SEQ ID NO: 99682 - RNA, 64 nt, Human
uuaugauguaggacuuccuuugauaucccuguuggaaguccauuagcaguccuuugcauuugcc

SEQ ID NO: 99683 - RNA, 64 nt, Human
uuaaugaagcuuugcaucgagaaacgaugggucugaaguccaaagugaaacagauaaaggaacu

SEQ ID NO: 99684 - RNA, 64 nt, Human
aacagaaauuuguuucucacaguucuggaggcuggaaguccaaggucggggugcccucaugguc

SEQ ID NO: 99685 - RNA, 64 nt, Human
ccaugaugaaaacauaaauaucugccacauaaaagaaguccaggaaaauaacacguaauaagac

SEQ ID NO: 99686 - RNA, 64 nt, Human
uuucuuacagaucaaaaagcuuagaaaaucauccgaaguccaugaccaugguaggucaccuuga

SEQ ID NO: 99687 - RNA, 64 nt, Human
aggaaauuacagcacagugugguggguguuacgggaaguccaaccccagcauuaugggaguuca

SEQ ID NO: 99688 - RNA, 64 nt, Human
acaaacaagcacauacacuauaucccauaugggagaaguccagugcccaggcauaggguuagcu

SEQ ID NO: 99689 - RNA, 64 nt, Human
guaucaaauucaauaaucuuaaacaauuuguguagaaguccacagacaucuuucaaccaccuuu

SEQ ID NO: 99690 - RNA, 64 nt, Human
ucugaguucccacaggggacccagcagccuccaggaaguccauacccugggguggcugagaccu

SEQ ID NO: 99691 - RNA, 64 nt, Human
caaaagaaaugaugcaacauguaggcuuacuuaggaaguccagcauuaauggcauagggcauaa

SEQ ID NO: 99692 - RNA, 64 nt, Human
aaaguuaaauuuauaagcuagcauuaaguaaagugaaguccagcucccuugcuaaaaauaacua

SEQ ID NO: 99693 - RNA, 64 nt, Human
gugagggugaacaggaaaugccuuguggaaacaggaaguccaagugauucauguacugaggaau

SEQ ID NO: 99694 - RNA, 64 nt, Human
auaaugucauuuuaaaaucugaaggaaagaauuugaaguccacaaaaaguguuugagguucuuu

SEQ ID NO: 99695 - RNA, 64 nt, Human
guguuucuuuguggucugugucaccguaucucaggaaguccagccacuugacuggcacacaccc

SEQ ID NO: 99696 - RNA, 64 nt, Human
agauaggccaugggcacuguggguagacacacaugaaguccaagcauuuagauguauagguuga

SEQ ID NO: 99697 - RNA, 64 nt, Human
acauaguauuuaguuuauaauuaaaugcauucuugaaguccagugugaauuuuauuaaugcuau

SEQ ID NO: 99698 - RNA, 64 nt, Human
auuccaaaagaagaaaaaauuaaaacaacuugcugaaguccaaagauuuuuuauugcugcauuu

SEQ ID NO: 99699 - RNA, 64 nt, Human
uugguaacuuccuuuacugagccagucuugaucagaaguccacauuaguaugugacagcuagag

SEQ ID NO: 99700 - RNA, 64 nt, Human
uuuuuuugaaaauuuuauauacuuuauaaugauagaaguccaaccguuuuuuaaaaaauaaauu

SEQ ID NO: 99701 - RNA, 64 nt, Human
caggaaacgacgagaaggccgaggaauccucagagaaguccagcucuucgcccugcguuccuuc

SEQ ID NO: 99702 - RNA, 64 nt, Human
gaggaaaauagcuuuucuaugacacaagucauaagaaguccauauacugaagagcguuugauua

SEQ ID NO: 99703 - RNA, 64 nt, Human
uauguaucuaguucuacaaggucacauuuauguggaaguccaaagucaaguccuuaggggauaa

SEQ ID NO: 99704 - RNA, 64 nt, Human
caggaaggggguggcgugacaggcaggaaccugcgaaguccagaguccaggguggagcgcgcca

SEQ ID NO: 99705 - RNA, 64 nt, Human
ucuguauauauguauauauguauguauauuuaaggaaguccagaaaucauacugcauacaugcu

SEQ ID NO: 99706 - RNA, 64 nt, Human
cuggagaacacugaucccaaauuuguccauagcugaaguccaccauaaaguggauuuacuuuuu

SEQ ID NO: 99707 - RNA, 64 nt, Human
gucauuuaauuucagauccuagcucaucaucagugaaguccagccuacuuacuuguaacuauua

SEQ ID NO: 99708 - RNA, 64 nt, Human
acagaaauuuauuucucgcuguucucaauggugggaaguccaagauuaagggaucaacaaauua

SEQ ID NO: 99709 - RNA, 64 nt, Human
aacuacuuagcucgcgugugccuggagggugcgggaaguccagcgacucucagacgcaccuccc

SEQ ID NO: 99710 - RNA, 64 nt, Human
uaacccucaaggguucuuuaacucacauucagaggaaguccagaucuccugaguagugauuuug

SEQ ID NO: 99711 - RNA, 64 nt, Human
acagaaauuuauguuuuacaguucuggaggcugggaaguccaagaugagggugucaacauuugg

SEQ ID NO: 99712 - RNA, 64 nt, Human
uugauguuuucguuaugaaaacauuuggugcccagaaguccaaauuaucaguuuuauuuguaag

SEQ ID NO: 99713 - RNA, 64 nt, Human
cuuaacaugagcagggugaaugacagguacugacgaaguccaacacaaagguauaauacagccu

SEQ ID NO: 99714 - RNA, 64 nt, Human
uccaaaaaugguagccacucacccuucacaaacugaaguccauggaccacggaagucgagaauu

SEQ ID NO: 99715 - RNA, 64 nt, Human
uauuuauucaaggugacucuuguacuuggcaagggaaguccacugugugauugucuguauucuu

SEQ ID NO: 99716 - RNA, 64 nt, Human
cacuccucccacggcuuguggcugcccuuggcuggaaguccagggucauacgacgccauugcca

SEQ ID NO: 99717 - RNA, 64 nt, Human
aucauaaauuugcuucaauucaggagcuuugaaggaaguccaaggaaagcucuagaaaacagua

SEQ ID NO: 99718 - RNA, 64 nt, Human
uucuagaagaaaaaucuccgaagagcucucucuagaaguccaaaauggcuagccauuaugcuuc

SEQ ID NO: 99719 - RNA, 64 nt, Human
uguaaaaugucuggagagccgaguugcagugcuggaaguccagaacaagaagcuuauagaggaa

SEQ ID NO: 99720 - RNA, 64 nt, Human
uuauauaaagcagccaaauccuucauguaauauugaaguccauuuuugcaauguuguuccauac

SEQ ID NO: 99721 - RNA, 64 nt, Human
uuguauaucgauuagcugugucacuuuuaaauaagaaguccacacaagcaagccaaauuuuuag

SEQ ID NO: 99722 - RNA, 64 nt, Human
aaguccacacaagcaagccaaauuuuuagaugacgaaguccauaaauaacuagagaauuuuugu

SEQ ID NO: 99723 - RNA, 64 nt, Human
auccauuuaagcuugcagaagagucugacaguaugaaguccagaugugucccugaugcugcugg

SEQ ID NO: 99724 - RNA, 64 nt, Human
cccugccugggcccugacuucagcucccuguagugaaguccaggagggugggacaggccuguca

SEQ ID NO: 99725 - RNA, 64 nt, Human
augacucuuacuccagugucaucuuuguccaccugaaguccaccucuggagagcccaacauccc

SEQ ID NO: 99726 - RNA, 64 nt, Human
uuuuuaauacaccugcuucacgucccuauguugggaaguccauauuugucugcuuuucuugcag

SEQ ID NO: 99727 - RNA, 64 nt, Human
uggaauguggcagaugagacgggcuuucaggaaggaaguccacuucuucugcaggaucuucuuc

SEQ ID NO: 99728 - RNA, 64 nt, Human
cucucuuggccuaacaggaaaugcuugacaucaugaaguccaucuaugacaugaugggcaagua

SEQ ID NO: 99729 - RNA, 64 nt, Human
aauuuguacacugaaagaaaauuuaaauaaaggggaaguccacauuaaaaagaaaacaaaacaa

SEQ ID NO: 99730 - RNA, 64 nt, Human
augggguuuucuguguuauuucauaaaauucuuugaaguccaauaaagcauguaggagauuuua

SEQ ID NO: 99731 - RNA, 64 nt, Human
gugacaccccauauucaucacaaaauuaaagcaagaaguccauaguaauuuauuugcuaauagu

SEQ ID NO: 99732 - RNA, 55 nt, Human
uuuuuccaacagacauuuaaagucugaaguccaccagaacuuggaagaaagcugu

SEQ ID NO: 99733 - RNA, 64 nt, Human
gaaagaagcccuaaagcagaaagcucuauaccaagaaguccaaacccagcacgcaacagcccaa

SEQ ID NO: 99734 - RNA, 64 nt, Human
uuucuggggcuccagagaagugccacgggaggcagaaguccagaacugcccauauagaugcccu

SEQ ID NO: 99735 - RNA, 64 nt, Human
ccccucuccccauccguccccccucagggaccaagaaguccaagaggggccgugggcguccagg

SEQ ID NO: 99736 - RNA, 64 nt, Human
ugugugcaauuucaugaauauuaaauuauguuucgaaguccaguugucauucccgcauucagau

SEQ ID NO: 99737 - RNA, 64 nt, Human
uacuauguucccuauuugggugauggguucguuagaaguccaaaccucagcagcacacaauaua

SEQ ID NO: 99738 - RNA, 64 nt, Human
ccuccucaguaugugggggcuucaucucuuuagagaaguccaagcaacagccuuugaauguaac

SEQ ID NO: 99739 - RNA, 64 nt, Human
guuuauuugauuuugaguuaggagggauaauagagaaguccauuuaaaaauuauuuuuagaagc

SEQ ID NO: 99740 - RNA, 64 nt, Human
acaugaauuuauuucucacaguucuggaugcugggaaguccaaguucaaggagcgcagauucaa

SEQ ID NO: 99741 - RNA, 64 nt, Human
cccucgcaaaaugaugugaaaggaccaguuucuugaaguccaguguuuccacggcuggauaccu

SEQ ID NO: 99742 - RNA, 64 nt, Human
gggagcacucauugucuacacacccuaacuaaaggaaguccagagccugccacuccccuaauuc

SEQ ID NO: 99743 - RNA, 64 nt, Human
aaaugcuauuaaacuugggaucaauguguucuaugaaguccaguggaguucuuagggccuaaau

SEQ ID NO: 99744 - RNA, 64 nt, Human
ccgacaugaucaaggagcaccuuccuccuccagcgaaguccacgcucauccugguguguggccc

SEQ ID NO: 99745 - RNA, 64 nt, Human
cagaaauguauuggcucagagcucuggaggcugggaaguccauaguggagggcccagagcccag

SEQ ID NO: 99746 - RNA, 64 nt, Human
cugguggcugggcccagcaggggcccucacucuugaaguccaggacugggucugaccugguggg

SEQ ID NO: 99747 - RNA, 64 nt, Human
ucaaagccucauguaucucccagacccuucucuugaaguccaauaacaagaccaaguaagaaug

SEQ ID NO: 99748 - RNA, 64 nt, Human
cuuaaauguguuauauagaaauaaaaaaaugggggaaguccaugaaucagcacucuuucucaaa

SEQ ID NO: 99749 - RNA, 64 nt, Human
agcuuggagcguggagguccugccuagauuccaggaaguccagggcgauacuguuuuccccugc

SEQ ID NO: 99750 - RNA, 64 nt, Human
uuugguuuucaaggcacugauaauggauauguaugaaguccaugcugucuguuaaauaaaaugc

SEQ ID NO: 99751 - RNA, 64 nt, Human
ccaaucacccuacaagaugccaaggaggucccaggaaguccagcuccuuaaacugacgcuaguc

SEQ ID NO: 99752 - RNA, 64 nt, Human
gcaguuuacaggaacggcuccuucccuaaaaugagaaguccaaggucaucucuggcccagugac

SEQ ID NO: 99753 - RNA, 64 nt, Human
aagagcguauucuguuuuucuaucaguucgacaugaaguccacaucacaugcuguucuuuucua

SEQ ID NO: 99754 - RNA, 64 nt, Human
uuuggaaggggguuauauaugagaguucauugaagaaguccagugaggcugaaguaaaggggca

SEQ ID NO: 99755 - RNA, 64 nt, Human
acuuuccaucauggccugaacccuggaggaagaggaaguccauucagauaguuguggggggccu

SEQ ID NO: 99756 - RNA, 64 nt, Human
cuuaauugggccuagugaaaaugggggcaggugagaaguccauuuugagaaucagcauaguaaa

SEQ ID NO: 99757 - RNA, 64 nt, Human
aauagaucugugguugaauuugcuguguuguuaugaaguccacccugugggcacaauaacauaa

SEQ ID NO: 99758 - RNA, 64 nt, Human
gcugaugcaagaggaucgcuugagcccaggaguugaaguccagccuaagcaacauagugaaacc

SEQ ID NO: 99759 - RNA, 64 nt, Human
ucaccuagcuugucccaagcuucccugccagccugaaguccauuuuccccuuuuuauuuuaaaa

SEQ ID NO: 99760 - RNA, 64 nt, Human
cacugcucuucccuugcugucagauuaauccacugaaguccaacuuugguucaagcagaguauu

SEQ ID NO: 99761 - RNA, 64 nt, Human
cacuuugcauuuuuaaaaauuaagaaucauuugugaaguccacuacgagguacuucaaaagccc

SEQ ID NO: 99762 - RNA, 64 nt, Human
acaagcauucacagagugcuuaccugccccgagggaaguccagcagcuccaccagauagagauc

SEQ ID NO: 99763 - RNA, 51 nt, Human
guguggugaagguugacugaagaaguccaguguguccaguuaaaacagaaa

SEQ ID NO: 99764 - RNA, 64 nt, Human
ugucaugaauccuugguagcucucugagaacagugaaguccagggaaaggcaucuggucugucu

SEQ ID NO: 99765 - RNA, 64 nt, Human
gaccucccuuacugggcuaaucagcacuugaucggaaguccagguuaguaugugaagccaggag

SEQ ID NO: 99766 - RNA, 64 nt, Human
uauggaaacgugggaggggcaggggagauguggggaaguccaggacuccaggaggugaaaagga

SEQ ID NO: 99767 - RNA, 62 nt, Human
ugcugagagagugcagcuuuugugaauuaaacuugaaguccaggcagaauucuaaugcaaua

SEQ ID NO: 99768 - RNA, 64 nt, Human
ucagcucugcaaguaguuuaguaggaaugaaguggaaguccaggcuuggauugccuaacuacac

SEQ ID NO: 99769 - RNA, 64 nt, Human
acagugguccaucaucgugcacucgucauacucagaaguccaaaguucauucuucuuuaaagua

SEQ ID NO: 99770 - RNA, 64 nt, Human
ccccaaagcagccccacaguggagccuuuggcuggaaguccaugggccacccuguucuugucca

SEQ ID NO: 99771 - RNA, 64 nt, Human
auuggugcuggcuaacauugcauggucggauagagaaguccagcugugagucucuccccaaagc

SEQ ID NO: 99772 - RNA, 64 nt, Human
ccccaggcagcccugccucugacuccaagagggugaaguccacagaagugagcuccugccuuag

SEQ ID NO: 99773 - RNA, 64 nt, Human
ugacauuccauaagaugaguuggcauuagaauuggaaguccaguuuauuucugaaucaaaaaau

SEQ ID NO: 99774 - RNA, 64 nt, Human
auauguauccaucucagugauccauguccuuagugaaguccacauuauucucuguggggacaag

SEQ ID NO: 99775 - RNA, 64 nt, Human
aggguuuuggguauagccugcccuggaggggaaggaaguccaugcaagcaaagacaugcaguuu

SEQ ID NO: 99776 - RNA, 64 nt, Human
gaucugaggacacugccgaggcuguaggggccuagaaguccaccauccugcccugcagucacau

SEQ ID NO: 99777 - RNA, 64 nt, Human
caaaaacaaccuaaccaucacaagaaagccugaugaaguccagccgugcuccagccucacuuuc

SEQ ID NO: 99778 - RNA, 64 nt, Human
ccccgggacaggccgucccccaccccauccuguagaaguccauuccccuuuucccuccugugcu

SEQ ID NO: 99779 - RNA, 64 nt, Human
aacauaaacagaagauaccuacaaaauacugucagaaguccagguauacugauaacacugaaaa

SEQ ID NO: 99780 - RNA, 64 nt, Human
augagaguauuugagauuggccaagcagaacuaugaaguccaucaaguaagucaaagaucaucg

SEQ ID NO: 99781 - RNA, 64 nt, Human
ccagcccuccagcgucugccuccaggagcugcaagaaguccauauuguuccuuaucaccugcca

SEQ ID NO: 99782 - RNA, 64 nt, Human
uuuuccuuucauauugagaacacuacacagugcugaaguccagcugguacacaccggggugaca

SEQ ID NO: 99783 - RNA, 64 nt, Human
gaugcauaaggccuuuucuagcucugacagccuagaaguccaaucacccuguaauaaauaugug

SEQ ID NO: 99784 - RNA, 64 nt, Human
ugagccuggcugagauggcuaggcggagggcuuugaaguccaagcagcugaacuggcugggugg

SEQ ID NO: 99785 - RNA, 64 nt, Human
agaagaagaacuagacucuuacagaggugagaaugaaguccacacagcaaaaaugcaucugaga

SEQ ID NO: 99786 - RNA, 64 nt, Human
acagguuauugauuaaccugacuuuauagggacugaaguccaccuccagagacaaguccaaguu

SEQ ID NO: 99787 - RNA, 64 nt, Human
gcggccgcucgagggaagcacccgccgguuggccgaaguccacgaagccgcccucugcuaggga

SEQ ID NO: 99788 - RNA, 64 nt, Human
ucacauccuuuuccuugacuucucaacccagccugaaguccauugcgguuccgucacucgccuu

SEQ ID NO: 99789 - RNA, 64 nt, Human
auuguggaauuuaguauaaaggccaaucuguccugaaguccaucuaauguggugaaucacugaa

SEQ ID NO: 99790 - RNA, 64 nt, Human
ugcaccauuacucagacuucuaaagagacuauuugaaguccaguugagucacaagagaagccug

SEQ ID NO: 99791 - RNA, 64 nt, Human
auaccucagccagcagcugccuucguuuggaacugaaguccagccagcagacucucuagcucca

SEQ ID NO: 99792 - RNA, 64 nt, Human
accugaccgggaguccaaaccaccuuggugcucugaaguccacugacucaucacaccuuucuua

SEQ ID NO: 99793 - RNA, 64 nt, Human
ccugccucgccaucggagcucucaugggccccaggaaguccagggacagcucccuuauaccugg

SEQ ID NO: 99794 - RNA, 64 nt, Human
ugcuuaaagauguuccuucauucaucaacuaggggaaguccagaugcggguuaucuugaaagaa

SEQ ID NO: 99795 - RNA, 64 nt, Human
auaguacagaacccgaccaaaguaggcuggugaggaaguccaggcuccaggggaacagacgcug

SEQ ID NO: 99796 - RNA, 64 nt, Human
uuguagggccacagaucuuaaagccuccaaccuugaaguccagugaagucucucucuuaaaguc

SEQ ID NO: 99797 - RNA, 64 nt, Human
uuuuuuuuuuuucuuuuuuagaaaacagggaguugaaguccaaccuauuuaaaaaccccaccau

SEQ ID NO: 99798 - RNA, 64 nt, Human
cuaggcuguauguagugcuacaauuagagaaacagaaguccaaggcuggcgacagcuugaaaag

SEQ ID NO: 99799 - RNA, 64 nt, Human
cugagcccuccagcagugcccacugugaccugccgaaguccacugccuuugccccagcacagaa

SEQ ID NO: 99800 - RNA, 64 nt, Human
gcuuucugcaugugacgccagcuaagcauaguaagaaguccagccuaggaagggaaggauuuug

SEQ ID NO: 99801 - RNA, 64 nt, Human
cccaauauggcaucaucuagcacgaggcccugcugaaguccagacccucccccuccugcccacu

SEQ ID NO: 99802 - RNA, 64 nt, Human
cuaaagcaguguuuucaccucauaugcuauguuagaaguccaggcagagacaauaaaacauucc

SEQ ID NO: 99803 - RNA, 64 nt, Human
ucucuucccccaacacucccaaagauacccacaggaaguccagccaguuuccagguagaggauu

SEQ ID NO: 99804 - RNA, 64 nt, Human
cuuuuuaagagaaaaaaaacccagcauccuuuuugaaguccagauuugucaaaaugauagacua

SEQ ID NO: 99805 - RNA, 64 nt, Human
ugugauauuaacagagggaggguuccuguggggggaaguccaugccucccuggccugaagaaga

SEQ ID NO: 99806 - RNA, 64 nt, Human
uuacugggugcaaaagaauccacggaacuugggagaaguccaguuccuguaaaaacugggaaga

SEQ ID NO: 99807 - RNA, 64 nt, Human
gaacccuucagccaaaccuuugggaucccauuuugaaguccagagcuggagcaggcgggcagug

SEQ ID NO: 99808 - RNA, 64 nt, Human
agaauuguuuuguuucacaaaagcugggaaggaagaaguccauucugcagcuguuagaucugcc

SEQ ID NO: 99809 - RNA, 64 nt, Human
auuauuagacaaauuagaugacaaaaaucauuaagaaguccaaacuuuuuuuuuauuacuagcu

SEQ ID NO: 99810 - RNA, 64 nt, Human
agccagaugccauagacccucagaacuugaccuggaaguccagacacugaacgcaggccucaaa

SEQ ID NO: 99811 - RNA, 64 nt, Human
aacuggaaucucaaaaguucuuugggacaaaacagaaguccauggaguuaucuaagcucuugua

SEQ ID NO: 99812 - RNA, 64 nt, Human
gauuccuuacagccuccggcggcucacagggcuagaaguccagaacauguaugugggaccccag

SEQ ID NO: 99813 - RNA, 64 nt, Human
auagaaauuugucacucaugguucuggaugcugggaaguccaagaucaaggcucuggcagauuu

SEQ ID NO: 99814 - RNA, 64 nt, Human
agcucggagggucucagccuccccuggguugggagaaguccaucuuuccccuuagugccaccgg

SEQ ID NO: 99815 - RNA, 64 nt, Human
ggucuacugagacaugaccccccuuccuguacccgaaguccagacucccaggggaaucagcagc

SEQ ID NO: 99816 - RNA, 64 nt, Human
caggaugccucaguguuaaaaugacaucucaaaagaaguccaaagcgggaaucaugugccccuc

SEQ ID NO: 99817 - RNA, 64 nt, Human
aucagacaacacacuuccugacguaaugcaauaggaaguccacaccaccaucuacaaagccuua

SEQ ID NO: 99818 - RNA, 64 nt, Human
augauuaggaggacaucauaaccuaugaaugauggaaguccaaaaugaugguaacugacaguag

SEQ ID NO: 99819 - RNA, 64 nt, Human
cuucaguuagagcucacaucuuugucuccguugggaaguccaugcugaugauugugaaaaguuc

SEQ ID NO: 99820 - RNA, 64 nt, Human
uggugguccuugccaccgguucucuguucuccuggaaguccagggaagaaggagggccccagcc

SEQ ID NO: 99821 - RNA, 64 nt, Human
acacaaaaucauuaucuuacaguucuggaggacugaaguccaaaugcaucucacggggcuacau

SEQ ID NO: 99822 - RNA, 64 nt, Human
uaacccucugauauuauauacuucagcauaaucagaaguccaaauguguuaaaacucauuacau

SEQ ID NO: 99823 - RNA, 64 nt, Human
uggcacuuugggaggacgaagcgaguggaucacugaaguccaagaguucgagaccggccugcga

SEQ ID NO: 99824 - RNA, 64 nt, Human
acagcaacgugaucuuggcugucugucauguguugaaguccaugguugggucuugugaagucug

SEQ ID NO: 99825 - RNA, 64 nt, Human
aagugcaggcuggaaacaugcaggagcugucccugaaguccacaaguggaauuucuucuucauc

SEQ ID NO: 99826 - RNA, 64 nt, Human
cccugggcuuccugagccagcccuccuugacccagaaguccagaagggucaucugccccccaac

SEQ ID NO: 99827 - RNA, 64 nt, Human
guguguguguugcgggaggggaggacuggggcuggaaguccagcacccagggaagaucuguccu

SEQ ID NO: 99828 - RNA, 64 nt, Human
uugcuuccauuggcaugggcucuggagcuguccagaaguccagggacaccagacuugaucaagg

SEQ ID NO: 99829 - RNA, 64 nt, Human
ggaggauaaccagcaggagcagagauaacuucaggaaguccauuuuugccccugcuuuugcuuu

SEQ ID NO: 99830 - RNA, 64 nt, Human
auauuuuccuaaguaaaauugccaaguggacuuggaaguccagaaaggaaaauaauuuaaauua

SEQ ID NO: 99831 - RNA, 64 nt, Human
cccgccuggccugcugaggccucugcucaggccagaaguccagcugcugccaggcauguccccc

SEQ ID NO: 99832 - RNA, 64 nt, Human
cuccauccgccugggcaucugauuuuuugggaaagaaguccaguuuuaugaucuucacaggcua

SEQ ID NO: 99833 - RNA, 64 nt, Human
auuuucucucauaggcaagucacacugcauugccgaaguccagcuuucugcagacuggcagucg

SEQ ID NO: 99834 - RNA, 64 nt, Human
gguauuucugugaagguauuuuguagaugugacagaaguccauucccaauugacuaaguaagug

SEQ ID NO: 99835 - RNA, 64 nt, Human
uacagccaucuguaccuacuggagcugcagaagggaaguccacucagucacauccagaaaaagg

SEQ ID NO: 99836 - RNA, 64 nt, Human
gaagaguuggccuuugaccacgguuccuggaguagaaguccauccuccccccaaccuccugacc

SEQ ID NO: 99837 - RNA, 64 nt, Human
agaccccaagccuugacuccagcugcgcccacaggaaguccagucccgacagugcccuuguugc

SEQ ID NO: 99838 - RNA, 64 nt, Human
uaaaugaacaaguaaccacaucucaggcggcagugaaguccagauaguuuugcagauuguuuug

SEQ ID NO: 99839 - RNA, 64 nt, Human
ucagggaacccuguuacacuauuaaaggcuuagggaaguccaguaaagaaaccuauuuuccgaa

SEQ ID NO: 99840 - RNA, 64 nt, Human
uguuaaaucuacaaacuuuuauaaauguuuuaaagaaguccaugugauaauuguaaaggugaug

SEQ ID NO: 99841 - RNA, 64 nt, Human
ggggcuccaugccagccgaccuugaccucacucagaaguccagagucuagcguagugcagcagg

SEQ ID NO: 99842 - RNA, 64 nt, Human
ccccaucuucuaaacccaauccaaauggcgucuggaaguccaauguggcaaggaaaaacagguc

SEQ ID NO: 99843 - RNA, 64 nt, Human
gagccgggcccggccgcacgcugacccccgugcuguccccgaccggcucacggggcugggcucc

SEQ ID NO: 99844 - RNA, 64 nt, Human
uuagccaguuugccagcaagcgcauccuagcaggguccccgagcagcagguuguguggaugaag

SEQ ID NO: 99845 - RNA, 64 nt, Human
ggccccccugcggggaggagguggagcagcgggcguccccgaagugagggccaggcccuucccg

SEQ ID NO: 99846 - RNA, 64 nt, Human
uucucccucgagcagcagcaaggacccugacgcuguccccgauaacucccuaggggcuccugcc

SEQ ID NO: 99847 - RNA, 64 nt, Human
ggcuuuuguuuacaagaugcaagaggggaaaccuguccccgacucaucgagacaacaugcccag

SEQ ID NO: 99848 - RNA, 64 nt, Human
ugucuuauuuuccaaaacacuaagcuguauucagguccccgaugggcauauacaucuuagccgg

SEQ ID NO: 99849 - RNA, 64 nt, Human
cucuuucucccuauuagggaguuaugcaaaauuuguccccgauuuuaccuuugucuuucugugu

SEQ ID NO: 99850 - RNA, 64 nt, Human
ccucgcuccccaccauuuuuccugaccggccuguguccccgagcccucgcggcaggcccgagca

SEQ ID NO: 99851 - RNA, 64 nt, Human
cucauaccccaccaaccccugcuuccccuucucgguccccgagggcccuggcccccgcugcguc

SEQ ID NO: 99852 - RNA, 64 nt, Human
aaaucgaaaacacagaagaaugaaggacaugccaguccccgaucgcugcugugagcaccucagu

SEQ ID NO: 99853 - RNA, 64 nt, Human
ugucuccuugguccuuaggcagauacuccccugaguccccgaucuagggccagcugcagagggc

SEQ ID NO: 99854 - RNA, 64 nt, Human
cccuuccccuccugccagggggaggcucagguugguccccgagugccgccuguacucacaaagg

SEQ ID NO: 99855 - RNA, 64 nt, Human
auuuccauuuuaagguggugucugugcagcugguguccccgauucuggcuguccuauguccagg

SEQ ID NO: 99856 - RNA, 64 nt, Human
accagacauccccagacuccacagauguaaugaaguccccgaauguaucuguuucuaaggagcc

SEQ ID NO: 99857 - RNA, 64 nt, Human
ugcgugcgagcacacacacacauacgugcacaggguccccgagugccuagguuuuggagaguuu

SEQ ID NO: 99858 - RNA, 64 nt, Human
ucccaagccugucaguggcccucccuggugcacuguccccgaaaccccugcuugggaagggaag

SEQ ID NO: 99859 - RNA, 64 nt, Human
gcgcggcgagagcggacugccugcccacccugagguccccgacugagccagggccacucagcug

SEQ ID NO: 99860 - RNA, 64 nt, Human
cugaaggccccagucuggacucucugcccucuggguccccgagcucugcagcgagcccugggac

SEQ ID NO: 99861 - RNA, 64 nt, Human
uccagggugccaggcagggcuggccuccaggccuguccccgacugccauuggcaacaguggccc

SEQ ID NO: 99862 - RNA, 64 nt, Human
uucaugguuuugagaaugacauccuggcccugugguccccgagggucaugguccuugugaccug

SEQ ID NO: 99863 - RNA, 64 nt, Human
auagcagcagugcaugggcgcuggucuagcugggguccccgaaguccuugcucccgcuccugcg

SEQ ID NO: 99864 - RNA, 64 nt, Human
ccggggcaacccgucggcucggccuggaggccggguccccgaugucgcuggggccccuaccccc

SEQ ID NO: 99865 - RNA, 64 nt, Human
ugcggggggcagggcagaaauggacuccuuuuggguccccgaggugggguccccucccagcccu

SEQ ID NO: 99866 - RNA, 64 nt, Human
gaccccgagcuuccucgguagcagaggcccugugguccccgagacacaggcacgggucccugcc

SEQ ID NO: 99867 - RNA, 64 nt, Human
ugaaugacagcagcauuaaacauauaugugaagaguccccgauguuuguagaccuuaugugagu

SEQ ID NO: 99868 - RNA, 64 nt, Human
gguuacucgucuguucugaugccaccgcgagaugguccccgagcuccccgagaguccucaguga

SEQ ID NO: 99869 - RNA, 53 nt, Human
acaacugugugcagaugugauaaguccccgagggcgaaggccauuggguuugg

SEQ ID NO: 99870 - RNA, 64 nt, Human
accaagggguacugcaggggaagggcuggcugggguccccgagaucucaggaauuuuuguaggg

SEQ ID NO: 99871 - RNA, 52 nt, Human
gcacaccccagaagaagugacgguccccgacccaggagaacgguggcuccca

SEQ ID NO: 99872 - RNA, 64 nt, Human
uaaagggccaguaccagugaguggccccaccuguguccccgaugcugaccucaccugguccucc

SEQ ID NO: 99873 - RNA, 64 nt, Human
uauauccccaucuccguuucauaucagaacuaccguccccgauauucccuucagagagauuaaa

SEQ ID NO: 99874 - RNA, 64 nt, Human
gaacaggguguucccagaaggcaggucccucauuguccccgaagccucuccuggaccuguggcg

SEQ ID NO: 99875 - RNA, 64 nt, Human
acuacaagguguaggcaugcccacugcuggacacguccccgacucguggccacauggagaaaca

SEQ ID NO: 99876 - RNA, 64 nt, Human
cguagaccuagggaagggaugggaagauugcccaguccccgauggcugcgcacacaggaggcgg

SEQ ID NO: 99877 - RNA, 64 nt, Human
gucugcaggacaccgaggaaucguaugugggaacguccccgagaaccacacgagcgugcugcuc

SEQ ID NO: 99878 - RNA, 64 nt, Human
uugcuucaagggcaugggucaggauuccugccagguccccgauguguauccaggggaagaauug

SEQ ID NO: 99879 - RNA, 64 nt, Human
acauuuccuuccugugcucuggacugcugcccuuguccccgaggagugucccgcgcagccacac

SEQ ID NO: 99880 - RNA, 64 nt, Human
ccucaggcucucagcacauuccacaggcuccugaguccccgaggccugggccagcuugggcaag

SEQ ID NO: 99881 - RNA, 64 nt, Human
caggagacccaggaaagggaguugcugagggcagguccccgagggggaugagaccuggcaacau

SEQ ID NO: 99882 - RNA, 64 nt, Human
uaaaaccaaauuguggcuauugauuuuugcuaggguccccgagguaaguggggaaggaaccucc

SEQ ID NO: 99883 - RNA, 64 nt, Human
caguuugggguuugggaagcaggacuccgucccuguccccgacugugccacgugguaggacaca

SEQ ID NO: 99884 - RNA, 64 nt, Human
acaccacaacacgagcguguuucuugagaggaauguccccgaguuggacaaggaggcuguuucu

SEQ ID NO: 99885 - RNA, 64 nt, Human
ggucccugguggcagcucaccucucccuuggauuguccccgacccuugccgucuaccugagggg

SEQ ID NO: 99886 - RNA, 64 nt, Human
cagggccuccuugcuccuucguucacagcuggggguccccgauuccaaugcuguuuuuugggga

SEQ ID NO: 99887 - RNA, 64 nt, Human
gguuggggccccaaagcuuugcugcuauugauuuguccccgacagcaggcaaagccucacauug

SEQ ID NO: 99888 - RNA, 64 nt, Human
aguucagcauggcagagcuggccaacagcuugugguccccgaucugccuccagccccaagaugc

SEQ ID NO: 99889 - RNA, 64 nt, Human
aucaugaugcauggagcuacaacagccaucuuagguccccgaggugcccagcaucacguaaaac

SEQ ID NO: 99890 - RNA, 64 nt, Human
acuggaucccaggccugcccuucacccaggccccguccccgaggccgacccccagcucaagcgc

SEQ ID NO: 99891 - RNA, 64 nt, Human
agggcuuugccacggagccacagagagaugcuggguccccgaggccugugggcaggccgaucag

SEQ ID NO: 99892 - RNA, 64 nt, Human
auccguguaugccucugggcauggacaggcgggaguccccgagccccacguaugccccaucugc

SEQ ID NO: 99893 - RNA, 64 nt, Human
cugcccggcugcccagagggcuggaugccugccgguccccgagcaagccugggaacucaggaaa

SEQ ID NO: 99894 - RNA, 64 nt, Human
caaaaccaguuauguuucggaaagagggaaaagaguccccgagcccggaucuugugcugcuuuu

SEQ ID NO: 99895 - RNA, 64 nt, Human
cccccugucccccuguccacauaccaaucccccuguccccgaccccccauccccgucccccauc

SEQ ID NO: 99896 - RNA, 64 nt, Human
acugagcaccugagccuggggcuggcuccccgggguccccgacucagcugguggcuguggagcu

SEQ ID NO: 99897 - RNA, 64 nt, Human
cauugugggcucuggaaaccacauggcuucaccuguccccgaaacuaccagcccuacaccauuc

SEQ ID NO: 99898 - RNA, 64 nt, Human
cugaaauucacguuucucucugaguccuguaacuguccccgaggggauugagcagaagcucggg

SEQ ID NO: 99899 - RNA, 64 nt, Human
accaugggugucccuugagucugagcuagaguguguccccgauaaacugugagaccucccuguu

SEQ ID NO: 99900 - RNA, 64 nt, Human
gagagagaaggagcaggcacgcugggccucgcguguccccgagcagugagggucccaguguucc

SEQ ID NO: 99901 - RNA, 64 nt, Human
uggcucagcccgcugaguggggggucgugggccaguccccgaggagcugggccccugcacaggc

SEQ ID NO: 99902 - RNA, 64 nt, Human
cugggaagaagagaccugggcuuggaaggaaccgguccccgacgguuucugcuugccucgccuc

SEQ ID NO: 99903 - RNA, 64 nt, Human
cgggcguucgcuugcugugaauuccuguccucguguccccgacccccgagaggccaccuccaag

SEQ ID NO: 99904 - RNA, 64 nt, Human
uccguccucggccccugccucuugcugcuguccuguccccgagccccugcagguccccccccgc

SEQ ID NO: 99905 - RNA, 64 nt, Human
agcagaggcacugggggcagcgggggccagggaaguccccgaguuuccccagacaccgccacau

SEQ ID NO: 99906 - RNA, 64 nt, Human
uuuccccagcugcugagguuccccaugcgcagcuguccccgauaccacgagcugcugcgggagg

SEQ ID NO: 99907 - RNA, 64 nt, Human
cccuggccuaccacucacuggccucgcucccccuguccccgaaucucagccaccgugucacucu

SEQ ID NO: 99908 - RNA, 64 nt, Human
uuuguggcuccuugcagccuccagggacuggccuguccccgauagaauugaagcaguccacggg

SEQ ID NO: 99909 - RNA, 64 nt, Human
caccagcguuucugauggaaaauggcgguuucaaguccccgauuccgugcccacuucacaucuc

SEQ ID NO: 99910 - RNA, 64 nt, Human
caggagcaggggugggaggcagguggacuccuggguccccgaggaggaggggacuggggucccg

SEQ ID NO: 99911 - RNA, 64 nt, Human
guggggucucgcagggaaaagggcuggcuucuagguccccgagauaagugugcagggggauggg

SEQ ID NO: 99912 - RNA, 64 nt, Human
uugggcucugcgucccacugagucucauuccucuguccccgagccgagcucuccugggccaggg

SEQ ID NO: 99913 - RNA, 58 nt, Human
uccuccccaaacggcgguaaugccgggcguccccgagacgcggcugccuguccgugcc

SEQ ID NO: 99914 - RNA, 64 nt, Human
cucgugugaucguucuuguggggcugccgugagcguccccgaggccgggagcgugggcccucgu

SEQ ID NO: 99915 - RNA, 64 nt, Human
guccuuguugcuguguuguugagcauccgugagcguccccgaggccgggagcgugggcccucgu

SEQ ID NO: 99916 - RNA, 64 nt, Human
cgggcgagggcuugcucuggacucagucugucaaguccccgaagcuuccugcagcuccaccuug

SEQ ID NO: 99917 - RNA, 64 nt, Human
accuggcaacaggcucagugggggucagguccagguccccgaagaggugcuggagaggaaagca

SEQ ID NO: 99918 - RNA, 64 nt, Human
acucagggccagagaaagucagaacaaagaaaauguccccgaaacgaauuuucuuacaaaagcc

SEQ ID NO: 99919 - RNA, 64 nt, Human
ucuaaagagguauguguaucuuuauuucagaugucacccagaguaaauuauaauuagaaguaua

SEQ ID NO: 99920 - RNA, 64 nt, Human
uuggaggccaaauguggcaaaccaaccccaggcccacccagagcgagcaaacgcugagaccuga

SEQ ID NO: 99921 - RNA, 64 nt, Human
gacaggggaggacccuucuuuuggacagcccccccacccagagcccggucccuugggggccuca

SEQ ID NO: 99922 - RNA, 64 nt, Human
cauccugggcaagcugauccugcugcaccacaagcacccagaacggaagcaggcaccacuaacu

SEQ ID NO: 99923 - RNA, 64 nt, Human
ccugguaacggguaacgggggcagcgcccaggaucacccagagcugggccuuccaccauuuccu

SEQ ID NO: 99924 - RNA, 64 nt, Human
auggccuccuugcugucuuuauugaagagcugcccacccagagucuugacucuagggcaggcua

SEQ ID NO: 99925 - RNA, 64 nt, Human
cacacacacaggcccauagacagaugggcagaugcacccagagccccaugcacaguguccugcg

SEQ ID NO: 99926 - RNA, 64 nt, Human
gaaggcaggacguuccaugccgaggcugcccccucacccagaagucugagcccagccucaggag

SEQ ID NO: 99927 - RNA, 64 nt, Human
gaagcccagagagagcacuggguuuguucaggaccacccagaaggugucacacgggguuucccc

SEQ ID NO: 99928 - RNA, 64 nt, Human
uguguagccucaauuaacacaugcauggucaugacacccagaauucaugaugguuuguuauaac

SEQ ID NO: 99929 - RNA, 64 nt, Human
ucauucagcaggaaaaacuaaugauauggaucaucacccagauucucucacuugguaccagcau

SEQ ID NO: 99930 - RNA, 64 nt, Human
agcaggguggacgcugaggagugaaagaacccugcacccagagggccugccuggugccaaggua

SEQ ID NO: 99931 - RNA, 64 nt, Human
cuuuguuaggcugugucucccuaagcccuugccccacccagaguuucccguccccuucacugau

SEQ ID NO: 99932 - RNA, 64 nt, Human
acaucagcauuuucauuuuguguccagggaaaagcacccagaggucaucugugugucccgagac

SEQ ID NO: 99933 - RNA, 64 nt, Human
ccuagccccacucccugccuccugaaaugguucccacccagaacuaauuuauuuuuuauuaaag

SEQ ID NO: 99934 - RNA, 64 nt, Human
cuggcuguuucuuuggaucccucugucccagagccacccagaacccugacucuugagaaucaag

SEQ ID NO: 99935 - RNA, 64 nt, Human
cacccagaacccugacucuugagaaucaagaaaacacccagaaaggccuuaaugaccucauagg

SEQ ID NO: 99936 - RNA, 64 nt, Human
cucguuguugguacagccggacacggggugcugccacccagaauaaagccacucacacugacug

SEQ ID NO: 99937 - RNA, 64 nt, Human
cugggcaaugggaaggagccagaaaugccaucuucacccagaaacaaagaauacugaagccacu

SEQ ID NO: 99938 - RNA, 64 nt, Human
auguuaacuuaacuuuaauuuccuguguaguuuacacccagagcagauacucauaaaguauaaa

SEQ ID NO: 99939 - RNA, 64 nt, Human
gauuagccaggccuggucaggguccuggggacggcacccagauaugcagagucacccugacacu

SEQ ID NO: 99940 - RNA, 64 nt, Human
cccauacugagccugccaaagugccugggaagcccacccagauucugaaacaggcccucugugg

SEQ ID NO: 99941 - RNA, 64 nt, Human
aacuaagguaucauccuuacccuucucuuugucucacccagaaauaugauggggggaauuaccu

SEQ ID NO: 99942 - RNA, 64 nt, Human
cuccugcaaaacuggcugccuggaggcccugagccacccagaucugaauaaaacagaugcuuac

SEQ ID NO: 99943 - RNA, 61 nt, Human
aguacugcuguuucguaugaugcuggcaagacacccagaaaggcuauuuucagaugaaauc

SEQ ID NO: 99944 - RNA, 64 nt, Human
gggugacuucuggugaugauaaaaaugguuuuaucacccagaugugaaagaagcugccuguuua

SEQ ID NO: 99945 - RNA, 64 nt, Human
gaggggcaggugggccucucuaggaucagugucccacccagaggccaguggccccuucacaugc

SEQ ID NO: 99946 - RNA, 64 nt, Human
uuuuuguugucguuuuagggcuuaaggguuaauucacccagaguauauuaauauaauaaaaaga

SEQ ID NO: 99947 - RNA, 64 nt, Human
agcucucgcuuaacuuccuaggggcugcugagcccacccagagguuguuggaguucagcggggc

SEQ ID NO: 99948 - RNA, 64 nt, Human
caaaacaccucagagggcugcccuccagaggcugcacccagaacagugggacaugagcaggggu

SEQ ID NO: 99949 - RNA, 64 nt, Human
guuugccaugagauaacacaguguaaacaguagacacccagaaaucgugacuucuguguucucu

SEQ ID NO: 99950 - RNA, 64 nt, Human
cauccuagaggccaggcaggagcccuucuauacccacccagaaugagacauccagcagauuucc

SEQ ID NO: 99951 - RNA, 64 nt, Human
uacacagagguugcagcagaugguguggguaccucacccagauaucauccaggcccaaggcccc

SEQ ID NO: 99952 - RNA, 64 nt, Human
guaccaucacuauaaucaacgaacuucucuucuccacccagagauggcuuuuccaacacauuuu

SEQ ID NO: 99953 - RNA, 64 nt, Human
aggacagcgaugcgggcagcuggggggcugagagcacccagaggaccgaggacaggggccggac

SEQ ID NO: 99954 - RNA, 64 nt, Human
cugaagaaggcuguucgugaggaggagaugcgagcacccagaacgucuuuugaggcugggcggg

SEQ ID NO: 99955 - RNA, 64 nt, Human
cuagaagaaaaggcucaccuggccacuguuuaggcacccagacauaauuuauggacgaaaugcc

SEQ ID NO: 99956 - RNA, 64 nt, Human
aacuuagcaagaauggccauggaggcaaagccuucacccagacccaucccacucuccugugauc

SEQ ID NO: 99957 - RNA, 64 nt, Human
ccagggcucugggauaguaagagaggugacaacccacccagacugcaguucccuccccacccuc

SEQ ID NO: 99958 - RNA, 64 nt, Human
ucauaagacugucauguaagaggugcucuccuggcacccagagaaaaggagcauccuuaccucc

SEQ ID NO: 99959 - RNA, 64 nt, Human
cggaagccuuaaagcagcagcgggugugcccaggcacccagaugauuccuauggcaccagccag

SEQ ID NO: 99960 - RNA, 64 nt, Human
ccugcuuggucaaauccccggcugcuuccuucugcacccagaaauuccuucccacucauguugu

SEQ ID NO: 99961 - RNA, 64 nt, Human
uacagcaucugaaaggaaugaugcagaugagaagcacccagaacaugcugagcagaacaucaga

SEQ ID NO: 99962 - RNA, 64 nt, Human
acagugcucaaggccagcuuauagucauauauaucacccagacauaaaggaaaagacacauuuu

SEQ ID NO: 99963 - RNA, 64 nt, Human
auaauuucuuaccucacauagaugagaaaacuaacacccagaaaggagaaaugauguuauaaaa

SEQ ID NO: 99964 - RNA, 64 nt, Human
gggaaccccaguccugagcuugguuucuucccagcacccagagaauccuuccucagcucucuuc

SEQ ID NO: 99965 - RNA, 64 nt, Human
ggggcagauaucuuggccugguuaugggguaggacacccagauuuucagacuuacaaucagugg

SEQ ID NO: 99966 - RNA, 64 nt, Human
ggugcaaagcaagcccaucucuaaguagaaaaaucacccagagcacaugcugaccugauaacug

SEQ ID NO: 99967 - RNA, 64 nt, Human
cuccauacucuguccccccagcuaauacccagagcacccagaucagacucuccuucaggguuua

SEQ ID NO: 99968 - RNA, 64 nt, Human
auacccagucuaggagcuccuucuggcucccaagcacccagagcuuuccuccgccuuuuaguuu

SEQ ID NO: 99969 - RNA, 64 nt, Human
ugcgucaggcugcucgggaaaugugggaacuggacacccagaacacugcugugcuggggcuauu

SEQ ID NO: 99970 - RNA, 64 nt, Human
ucagcugaccaagacaccugaggacacaucuuggcacccagaggagcagcagcaacaggcugga

SEQ ID NO: 99971 - RNA, 64 nt, Human
uuccccagucacgaaagggcugguccccagagcucacccagaaagcaucuugccgggggcaggg

SEQ ID NO: 99972 - RNA, 64 nt, Human
uauucugcacaaaacuuuugggaauuccucuuugcacccagagacucagaggggaagagggugc

SEQ ID NO: 99973 - RNA, 64 nt, Human
cuuuucuuuuuuuugagacaaagucucacugugucacccagacuggaaugcagugacacaaucu

SEQ ID NO: 99974 - RNA, 64 nt, Human
agguuucuucuuugaaugcaggugauuccuucaacacccagaaugagccagaagacaugaugaa

SEQ ID NO: 99975 - RNA, 64 nt, Human
auggucuuucaagagaguuccagacuggcacuuucacccagaaccaaugcgguguuucuuaaug

SEQ ID NO: 99976 - RNA, 64 nt, Human
gccaagacucugaacucugcagaaacauuuguuucacccagacuucaaacucuagcccugacua

SEQ ID NO: 99977 - RNA, 60 nt, Human
caccagaaaaaaagaauugaaaauaaucgucacccagaaaauccagaaaacugaagauuu

SEQ ID NO: 99978 - RNA, 64 nt, Human
agagcugcuaggcuugaggccuugacuguugugucacccagagcccccucaagccuucugcucc

SEQ ID NO: 99979 - RNA, 64 nt, Human
ggagagagaugcugcucccgccugauuggggccucacccagaaggaacccggucccaggccgca

SEQ ID NO: 99980 - RNA, 64 nt, Human
aacuuucuuuuuuuuggagauagucucauucugucacccagacuggagugcaggggggcaauca

SEQ ID NO: 99981 - RNA, 64 nt, Human
guaccaggcaggcucccuuccuggggaaaagaagcacccagaccccgcgccccgcugaucuuug

SEQ ID NO: 99982 - RNA, 64 nt, Human
gacccagagacgucccccaucgugggacacgacacacccagaccgcgugccccaccgucuuagc

SEQ ID NO: 99983 - RNA, 64 nt, Human
gagguaaggauguguuccuguaucgaucugcagacacccagaaggugggugcacacugcaugcu

SEQ ID NO: 99984 - RNA, 64 nt, Human
uacuuguagauuuccauguaaucauugagguuaucacccagauuagaaagacauauuuguuauc

SEQ ID NO: 99985 - RNA, 64 nt, Human
ggaguggacugaauggaucguugcagagaagacucacccagaccuggccagggaaugauguauc

SEQ ID NO: 99986 - RNA, 64 nt, Human
ugaggagcagccaggacccgccugcucccauccucacccagaucaggaaccagggccucccugu

SEQ ID NO: 99987 - RNA, 64 nt, Human
ccagauccucugcugacuccauauggaggccucacacccagaggguagggcagcagaucuucuu

SEQ ID NO: 99988 - RNA, 64 nt, Human
ugccgcugccccucggggcuggaauaaaacuccccacccagagucaguccuaguggggcccucu

SEQ ID NO: 99989 - RNA, 64 nt, Human
cccaggggaggccaggcagaagccugggucacagcacccagaacugcaugguuccauuuucucc

SEQ ID NO: 99990 - RNA, 64 nt, Human
acaccaagaacaugaggauggagagaaguaucagcacccagaagagaaaaaggaauuuaaaaca

SEQ ID NO: 99991 - RNA, 61 nt, Human
ucaacaccaucgacguuugagugaagaaacacacccagaagagagaugcacuaacaacugg

SEQ ID NO: 99992 - RNA, 64 nt, Human
agagaaguucuuauuguuggccaugaaggaaaaucacccagaaugcuucugcaagguaaagucu

SEQ ID NO: 99993 - RNA, 64 nt, Human
ggguccuaagacccagggacccagcgacuaugcccacccagaccccagagcguucccauaaccc

SEQ ID NO: 99994 - RNA, 64 nt, Human
ucacauuagauuaucccucagggugacaccaaagcacccagacagauuuagaagcccaaaguuu

SEQ ID NO: 99995 - RNA, 64 nt, Human
caggaggcugacugagcucaaaggaacaggauggcacccagagccgcaggacggagacuggggg

SEQ ID NO: 99996 - RNA, 64 nt, Human
ucuguaccagcuccuuuccauccaccuucguaugcacccagauuuuucuguucccaucuguccu

SEQ ID NO: 99997 - RNA, 64 nt, Human
uaagccaucauauccccugugcccugcacguauacacccagauggccugaagcaacugaagauc

SEQ ID NO: 99998 - RNA, 64 nt, Human
agagcuucugucccuuccuucccauugcaaguugcacccagaugagacagcuguaguacuaggu

SEQ ID NO: 99999 - RNA, 64 nt, Human
gcuuccugguucucagucccaccccaaaaccuggcacccagaacaguuggaaguguggaaagga

SEQ ID NO: 100000 - RNA, 64 nt, Human
gagcagcuccugcccuguggcgacagccagcgugcacccagacgcuggugccauggcgaagcag

SEQ ID NO: 100001 - RNA, 64 nt, Human
ucaaauuagcuuauuucacaaauaucucuagacucacccagaucccagcuuggugggaaagugc

SEQ ID NO: 100002 - RNA, 64 nt, Human
ugacuccaggcuggccuuuggccgacugucugcucacccagagaccuuggacuccggacuaucc

SEQ ID NO: 100003 - RNA, 64 nt, Human
uugcucagcuuugggaugugggugggaacuggagcacccagagaaaacccauacagacaguggc

SEQ ID NO: 100004 - RNA, 64 nt, Human
gacccaguccuguuugguuuucuuccguuggaaccacccagacaucugcuuccacccagccaag

SEQ ID NO: 100005 - RNA, 64 nt, Human
gggggggauuguagcagacgucugggcuuuuccccacccagagaauagcccccuucgauacaca

SEQ ID NO: 100006 - RNA, 64 nt, Human
caggacuccagcuaaaucaaaauacgcauguucucacccagagugacaaaauccugcagauagg

SEQ ID NO: 100007 - RNA, 64 nt, Human
ggagccggugugugcacucugccuccucaccuugcacccagagcaagaggacugggugcugggc

SEQ ID NO: 100008 - RNA, 64 nt, Human
gaugggucugguuugcagagcuugaacacagucucacccagacuccaggcugucuuucacugaa

SEQ ID NO: 100009 - RNA, 64 nt, Human
ugccaccgucccucugcagauacacugcucuccccacccagaccugccugucucccacccuuuc

SEQ ID NO: 100010 - RNA, 64 nt, Human
auggcugaagugcaugggucagggugugaggccacacccagaguagccaugaggaggcagagag

SEQ ID NO: 100011 - RNA, 64 nt, Human
uaaaguguuuuacacaaaugcauaucuugaacgucacccagagacuguaauuuguguaguuuuu

SEQ ID NO: 100012 - RNA, 64 nt, Human
ucaagccaaauaccugguuuuccuuaucaugcugcacccagagcaacucuugagaaagauuuaa

SEQ ID NO: 100013 - RNA, 64 nt, Human
gucccagguccccacucuccagggcccaucaagucacccagacccaugaaaugcccugccuccc

SEQ ID NO: 100014 - RNA, 64 nt, Human
uuuaggcaacacucaauuuaccugcgaagcaauacacccagacacaccagucuuguaucucuua

SEQ ID NO: 100015 - RNA, 64 nt, Human
uacuauagggaaaagaugccaaaacauguccccucacccagacuaaacuugauacuguauuauu

SEQ ID NO: 100016 - RNA, 64 nt, Human
agcgguuuucccaaaacaagcccuuccuggcucccacccagacauggaccagccaugcacccgc

SEQ ID NO: 100017 - RNA, 64 nt, Human
aguguggccugaauaccccaccccggcuccucugcacccagagcugggggccaccucagaagug

SEQ ID NO: 100018 - RNA, 64 nt, Human
uugcuccuagccaagauguuggccuuucugugcccacccagacuugguuugggccaccagaggc

SEQ ID NO: 100019 - RNA, 64 nt, Human
guaagggcagacaaacaggugagggugaguguggcacccagagacugcucuuccugcccucacc

SEQ ID NO: 100020 - RNA, 64 nt, Human
uugcugagggccgaccacccaugccaagggaauccacccagaaugcaccccugaaccucaagau

SEQ ID NO: 100021 - RNA, 61 nt, Human
ucaugaaggguguggaguagaugcugaccuucacccagagcugccuaugcccagccuccaa

SEQ ID NO: 100022 - RNA, 64 nt, Human
cagcagugagaugagggcugugauuaaggcccaacacccagacuacucuuucggggagcucagc

SEQ ID NO: 100023 - RNA, 64 nt, Human
uggagcugcauauuuuuauggccccaucuucauucacccagaagaaacagagcaugagcccaca

SEQ ID NO: 100024 - RNA, 64 nt, Human
cuguuugcaaaaagagaguguuuaaacacuccaacacccagacuuagaauuaaaucaguaaagc

SEQ ID NO: 100025 - RNA, 64 nt, Human
uacaccugcuagcucuguugcccccucaaaacugcacccagagcagggccacaagggugcuuuu

SEQ ID NO: 100026 - RNA, 64 nt, Human
uuuuuuccugauuugaagaagcaggaaaagcugacacccagacaaucacuuaagaaaccccuua

SEQ ID NO: 100027 - RNA, 64 nt, Human
uagagaggagcuuugaggccacccgcacaaaauucacccagagggaaaucucgucggaaggaca

SEQ ID NO: 100028 - RNA, 64 nt, Human
caaggggaaaaugugaagcugaacccccuccagacacccagaauguagcaucugagaaggcccu

SEQ ID NO: 100029 - RNA, 64 nt, Human
ccagcagggcugugaugggcgagucccggagccccacccagaccugaaugcuucugagagcaaa

SEQ ID NO: 100030 - RNA, 64 nt, Human
ugcucaacaggacugcacucgucucugcccugcccacccagagccccucuuugugcccugaugg

SEQ ID NO: 100031 - RNA, 64 nt, Human
gcauccagaaacuuccagaccagcccucucaccacacccagaagaggccuuucccaucuggaga

SEQ ID NO: 100032 - RNA, 64 nt, Human
uucgccuuugcugaagucuccccgcagcccucuccacccagaggucucccuauaccgagaccca

SEQ ID NO: 100033 - RNA, 64 nt, Human
cugacagccuccuaggcucccugagguaccuuuccacccagacccuccuuccccaccccauaag

SEQ ID NO: 100034 - RNA, 64 nt, Human
cugguguggccgccacagagaguguuaccaccagcacccagaccgaacccccaccggccaaaug

SEQ ID NO: 100035 - RNA, 64 nt, Human
cugaguccccagacagcagaguaugaacugcugacacccagauuccauuaaaaauucugcuaau

SEQ ID NO: 100036 - RNA, 64 nt, Human
auucagggcagaacuccuguaucagccucauggacacccagaauugguaucucauggcuggaga

SEQ ID NO: 100037 - RNA, 64 nt, Human
acaauucugcaaaaaaaggaugaauuuccuccaucacccagauuuauacuuagagucagacgaa

SEQ ID NO: 100038 - RNA, 64 nt, Human
aggaccauucuuaguggcacuggggaaaucuuggcacccagaagaauucaacugcgcucacugc

SEQ ID NO: 100039 - RNA, 64 nt, Human
gucugccccucggcccucaggguggggcacuuagcacccagaagggaccaaaagcagggcaugg

SEQ ID NO: 100040 - RNA, 64 nt, Human
cucccagcccacaccagugcucucggccacugagcacccagacucaggcuuggguuccccagcc

SEQ ID NO: 100041 - RNA, 64 nt, Human
gcgucucaugaggccgcugccgcugcugcaggggcacccagaccuccagagcauccagagccuc

SEQ ID NO: 100042 - RNA, 64 nt, Human
gcuuuguuaaaacaucaugagaguggaggccugccacccagaaaggcacauacuagugccuuuu

SEQ ID NO: 100043 - RNA, 64 nt, Human
cuauggguaauuaauuaauuuauuucauagaggccacccagaugccuuauagguuuuauuaauu

SEQ ID NO: 100044 - RNA, 64 nt, Human
agaaugaaacucaccguccagauaaccaugcaugcacccagauuuuuuccaccuuggauaccug

SEQ ID NO: 100045 - RNA, 64 nt, Human
agaacuuugccuuaaguuucccuguguuguuccacacccagaaggacccaagaaaaccuguuuu

SEQ ID NO: 100046 - RNA, 64 nt, Human
cagugguaugaucucagcucacugcaaccucugccacccagauucaacagauucuccugccuca

SEQ ID NO: 100047 - RNA, 64 nt, Human
aacggcagggcucuuugcuggagcagaggcccuucacccagagccaguguggucaguauuccaa

SEQ ID NO: 100048 - RNA, 64 nt, Human
uuuucuuuucuuuuuuuugauacagagucuuagucacccagacuagaggucaguggcaggaucu

SEQ ID NO: 100049 - RNA, 64 nt, Human
aagcaccuguggcauaccuucaugugcuccacugcacccagagcuuaagccacaguccugcuca

SEQ ID NO: 100050 - RNA, 64 nt, Human
gacagggcugccaucgcucaccuguaccuauuuacacccagaacuuuccagcucccccucauca

SEQ ID NO: 100051 - RNA, 64 nt, Human
ucuacagugaggaacaggcguuucccaggccccacacccagauuucucuaucuuugcuguguuu

SEQ ID NO: 100052 - RNA, 64 nt, Human
cugcuucucggugucauugcagugugcugcuugucacccagaauacuacuaucaugugaauucu

SEQ ID NO: 100053 - RNA, 64 nt, Human
guauaacacagaugaucuucuccacacaccccaucacccagauaauuuacaguucuguuaacag

SEQ ID NO: 100054 - RNA, 64 nt, Human
cuagggaaagcuuuguacugcugcuaaugauaugcacccagaaaccuuguuagacaaaaggcag

SEQ ID NO: 100055 - RNA, 64 nt, Human
auuucaucauggaaaugcauccaucaaagagagccacccagaggaagaggauugauguccuugc

SEQ ID NO: 100056 - RNA, 64 nt, Human
guuuguuuguuuuugagacugagucucacuuuaucacccagacuggcgugcaguggcacuaucu

SEQ ID NO: 100057 - RNA, 64 nt, Human
cucauggauguugcaauaagcauucggguacuaucacccagaaauaugaauugccagaauagaa

SEQ ID NO: 100058 - RNA, 64 nt, Human
gugaaggucaguuugaggcaucacaaauuuaaggcacccagacauaagggucaacaggguuagc

SEQ ID NO: 100059 - RNA, 64 nt, Human
agaugggaaggcacagggagaagggauaacccuacacccagaccccaggcuggacaugcugacu

SEQ ID NO: 100060 - RNA, 64 nt, Human
cugaacugagcuguuuacaggacuggggaggcuccacccagaaggcuuucauuuguacucugcu

SEQ ID NO: 100061 - RNA, 64 nt, Human
cucagagucugggucucacuggccccaagucucccacccagaacucuggccaaaaauggcucuc

SEQ ID NO: 100062 - RNA, 64 nt, Human
acugacugcuacuuccugucucuguuuccauuaucacccagagagggacaagauaggacauggc

SEQ ID NO: 100063 - RNA, 64 nt, Human
gcuucuucaauuccuuaacaaaugcaaccaccaacacccagaucucucucucucuuuauuuuca

SEQ ID NO: 100064 - RNA, 64 nt, Human
ucuccuucuaccacucuuaaauuuacucccuccccacccagaacccagaugggguggagggggc

SEQ ID NO: 100065 - RNA, 64 nt, Human
ccaguacaacaaaggugacggguguguagguacacacccagagauggagcacugcagaucagca

SEQ ID NO: 100066 - RNA, 64 nt, Human
gaaggccagaauacuggagaccagcgugaacccucacccagagucaggggaagauuuagaaaca

SEQ ID NO: 100067 - RNA, 64 nt, Human
uugagagcuuucuuguuuguuuucccuccuuuaccacccagaaauccauuugagucugcuccuu

SEQ ID NO: 100068 - RNA, 64 nt, Human
auacaaacucguauaaagaauguaggaagaccuucacccagaagccaggacugacugugcacca

SEQ ID NO: 100069 - RNA, 64 nt, Human
aaaaauuaggaccacaugugagauguuuacaagacacccagaacagugguaaagugugcauacu

SEQ ID NO: 100070 - RNA, 64 nt, Human
ugaguuacgugaaaagagcaucucacuuuuaauacacccagauauuuucuucaagucuuugugc

SEQ ID NO: 100071 - RNA, 64 nt, Human
guaaaaccaacuaaauaaaaaauucaaaccaauucacccagaaaaaagaccaauaggugcaaaa

SEQ ID NO: 100072 - RNA, 64 nt, Human
uaugcaagugacggugcugcucuuguuccacccccacccagauggucucugagugcgccguccu

SEQ ID NO: 100073 - RNA, 64 nt, Human
gggcucacagaccccggccucggagcccgucuggcacccagagugaccacaaguccagcaggga

SEQ ID NO: 100074 - RNA, 64 nt, Human
ugacuugaaggggccugguuuggaucuaagcaaacacccagaugggguucucuggucucagcaa

SEQ ID NO: 100075 - RNA, 64 nt, Human
cuggccgccuucuuggugccaaacccccuucccccacccagagacugggcagcugugucugguu

SEQ ID NO: 100076 - RNA, 64 nt, Human
gucuaugcuucccuugcccucuccagcuccaccucacccagagcaccucccagccaccgucccc

SEQ ID NO: 100077 - RNA, 64 nt, Human
cucacugguacaguggggagaccuguaaccagggcacccagaagagucugguguacggccucgu

SEQ ID NO: 100078 - RNA, 58 nt, Human
guaagaagaggaugucuuaggaggagggcacccagaaguaucgagccauagcuaucca

SEQ ID NO: 100079 - RNA, 64 nt, Human
uuacacacacacacacacacacacaaaugugccacacccagacacgcacagaaucagacacuac

SEQ ID NO: 100080 - RNA, 64 nt, Human
caacuaugucuggucaccagcucccuccugcuggcacccagagacccggacccgcagggccugc

SEQ ID NO: 100081 - RNA, 64 nt, Human
ucucccuuccccucccaccugcccccugcguaggcacccagacuuggagagacccgucugcugu

SEQ ID NO: 100082 - RNA, 64 nt, Human
gugauuguuuuuuugagacagagucuugcucugucacccagaguggagugcaguguccuguaau

SEQ ID NO: 100083 - RNA, 64 nt, Human
gggaaaacgggccgguauuuacacacgcgcaaaacacccagagacggcacaaggagguugaacu

SEQ ID NO: 100084 - RNA, 64 nt, Human
gcaugcacuggcauuugaacagggugagacaguccacccagagcucucccaagucucucccaaa

SEQ ID NO: 100085 - RNA, 64 nt, Human
agucuuccaugaaaauaaaugcugccuggacccccacccagaccacacacugacggccggcucc

SEQ ID NO: 100086 - RNA, 64 nt, Human
cuuccuaucaaaauauucagagacucgagcacagcacccagacuucaugcgcccguggaaugcu

SEQ ID NO: 100087 - RNA, 64 nt, Human
uuguuuuguuuuguuugagacggucucauucugucacccagacuggagugcagugccacaauca

SEQ ID NO: 100088 - RNA, 64 nt, Human
cugaccaacuaagcuuuuaaaaaucaacuauuaccacccagaaaacaguccuacgugaucaugu

SEQ ID NO: 100089 - RNA, 64 nt, Human
ggguccuucccuucagaaccacaugugugcgggacacccagacagaaaacacaaaugcaaaguc

SEQ ID NO: 100090 - RNA, 64 nt, Human
aauaaauugauuuguuaugguuacauauuuagcgcacccagagaaaauuaauuauauuucuaca

SEQ ID NO: 100091 - RNA, 64 nt, Human
uggaggcagccagacaccaaacugggaacucagacacccagauucccuccauggccucaccccu

SEQ ID NO: 100092 - RNA, 64 nt, Human
agaucucuaggcaggaaauccacagcuccuccugcacccagaaugggaaggaaagaaggccaag

SEQ ID NO: 100093 - RNA, 64 nt, Human
cacuucugacuucacugaaauuauggaagaaagacacccagaggaggccucuuugguugguucu

SEQ ID NO: 100094 - RNA, 64 nt, Human
ggaggaagaccaugaaagcugaauuggucugugccacccagaguaaaccucuucucuucuucug

SEQ ID NO: 100095 - RNA, 64 nt, Human
uuuccugggugcaucaaacaaaacaaaaaccaaacacccagaggucucaucucccaggccccag

SEQ ID NO: 100096 - RNA, 64 nt, Human
cuucuuggaggagcuugggugacagccaggugagcacccagaccccagacccucaugugcugug

SEQ ID NO: 100097 - RNA, 64 nt, Human
cgaauaaagaacucagaguugugugugcaaugcacacccagacacacgcacgcacacacacgcg

SEQ ID NO: 100098 - RNA, 64 nt, Human
agcccuaacacaugggaugaacguuuuacugcuacacccagauuuguguugaacgaaaacauug

SEQ ID NO: 100099 - RNA, 64 nt, Human
augauugcuguaauauuuaagacuguacaccccucacccagacagaccuuaaguucuucaagug

SEQ ID NO: 100100 - RNA, 64 nt, Human
ggcauaaaauguucaccuuuuugccagaugaguacacccagaaugcuaauuuuucuguccaucg

SEQ ID NO: 100101 - RNA, 64 nt, Human
aguuuaaccuggaauaucugacuaccccugaauccacccagaaagggggcccaacacccuuguc

SEQ ID NO: 100102 - RNA, 64 nt, Human
aggaauucgggcuccuucccuagccccagcauuucacccagaugacaccuccccaaaguccaca

SEQ ID NO: 100103 - RNA, 64 nt, Human
ugacaggugaauuggaugguucucagaaccauuucacccagacagccuguuucuauccuguuua

SEQ ID NO: 100104 - RNA, 64 nt, Human
cuaauuauccuuucuuuuucaaucccauugcuaacacccagaacauauuuucuguucaaugcaa

SEQ ID NO: 100105 - RNA, 61 nt, Human
augaccucucuguacucuaggaacccagggucacccagaugucccuuugauggccguuguu

SEQ ID NO: 100106 - RNA, 64 nt, Human
cagugcacucaaguuuggccaagggacuccacagcacccagaagacugcaugccucaagguuua

SEQ ID NO: 100107 - RNA, 64 nt, Human
uuuguguuuaaagucuuguaaaguucaugucuuucacccagauauaucaaauguuagaagacca

SEQ ID NO: 100108 - RNA, 64 nt, Human
cguugugacgaaugugauuggaacauuuggggagcacccagagggauuucucagugggaagcau

SEQ ID NO: 100109 - RNA, 64 nt, Human
auggcaggggccagcggccaccaagcucaugggacacccagagcagaagcuagggcagagccaa

SEQ ID NO: 100110 - RNA, 64 nt, Human
ucugugaucuccacagggccaggguugcuacuugcacccagaaucuagugauuuuagucagauc

SEQ ID NO: 100111 - RNA, 64 nt, Human
ucaaaccacaauauccagcaaaaugucuccugagcacccagaacuccauaccaucggccgggug

SEQ ID NO: 100112 - RNA, 64 nt, Human
gccaggguggggagcugagcugaggcucccucuccacccagaagcacuggcguuguucacauag

SEQ ID NO: 100113 - RNA, 64 nt, Human
gagcauggucaggaguggccugcccguacuccuccacccagaugagggcccuccagagccugca

SEQ ID NO: 100114 - RNA, 64 nt, Human
gcuguucagaccgacguugccaucaaaacacauacacccagaaagaaacaacagaaaccaaaac

SEQ ID NO: 100115 - RNA, 64 nt, Human
acccagccugguauuguccacggacagcguuguucacccagagccuuacuugggagccucacug

SEQ ID NO: 100116 - RNA, 64 nt, Human
aguacaauugguuauuugguacguguagauuuaacacccagacggcugacuuguaacccucccc

SEQ ID NO: 100117 - RNA, 64 nt, Human
gcccauacuggcccccaucugaacccaccucucccacccagaucaacauccccccaaccccugu

SEQ ID NO: 100118 - RNA, 64 nt, Human
accggcgcugggaggaacacgagacuuucuuugacacccagaagacccggcaacgaggaggaag

SEQ ID NO: 100119 - RNA, 64 nt, Human
guagacaauaauuaacacagaggacuuucccccacacccagaucacaaacagccuacagccaga

SEQ ID NO: 100120 - RNA, 64 nt, Human
ugugauguccuuagucacuaagguuaaacuuucccacccagaaaaggcaacuuagauaaaaucu

SEQ ID NO: 100121 - RNA, 64 nt, Human
cagcguggacagcaggugaggcaggugcuccucacacccagaccugggcaucuucauugaggga

SEQ ID NO: 100122 - RNA, 64 nt, Human
aggagaacguuugguacaaucgacauccuagccccacccagagguggcccucccaggcugguau

SEQ ID NO: 100123 - RNA, 64 nt, Human
ccucaucccaccccaaauacuuaaaaugacacuacacccagacggcgcccagcuggcugcagca

SEQ ID NO: 100124 - RNA, 64 nt, Human
gacuuugggugagccuuacagccccugaguccuacacccagaaggcggcugagggaacugaggc

SEQ ID NO: 100125 - RNA, 64 nt, Human
cggagagcagcagcaccaaccacagcaucgggagcacccagagcacccccugcuccaccagcag

SEQ ID NO: 100126 - RNA, 64 nt, Human
ugcuauuguacauagaggaaaccugggcuagccccacccagagcgcagaggagggggcaccgac

SEQ ID NO: 100127 - RNA, 64 nt, Human
aaaugugcaguuguguccuuaaauaugcagucuucacccagaguaaaguguugaucgcaagagu

SEQ ID NO: 100128 - RNA, 64 nt, Human
cagagcugggccagggaggacacgcuccacugaccacccagagcugggccagggacucaacaau

SEQ ID NO: 100129 - RNA, 51 nt, Human
acacggacacgcucugcugaccacccagagcugggccagggaggacacgcu

SEQ ID NO: 100130 - RNA, 64 nt, Human
cuuuaucauaacaaaauucuaguguuuauacgaacacccagaggcaaaagaauuuggcuuaauu

SEQ ID NO: 100131 - RNA, 64 nt, Human
accaucucacgguggggauggccgcagggcugugcacccagaagaagauggcuguuagcguuuc

SEQ ID NO: 100132 - RNA, 64 nt, Human
uucuaugcuuuuuugaauaucagaguaggaugaacacccagauucaaauaugucaccaaaguug

SEQ ID NO: 100133 - RNA, 64 nt, Human
acaggacagugcccgguccccuugagggccaucacacccagacccaacggguugcagccuccug

SEQ ID NO: 100134 - RNA, 64 nt, Human
guuucaucuuucuaggguugaaaacuaaacuguccacccagaaagacacucaccccauuucccu

SEQ ID NO: 100135 - RNA, 64 nt, Human
cacuguauaugauucgguauuggggguuuggaggcacccagacccuggcaauauuauguguccc

SEQ ID NO: 100136 - RNA, 64 nt, Human
cacugucuucuggucuuggugcuacugaaauugucacccagaauuugaauccugacccucccca

SEQ ID NO: 100137 - RNA, 64 nt, Human
gacuuugagaacucugugagacaagguccuuaggcacccagauaucagccacuuucacauuuca

SEQ ID NO: 100138 - RNA, 64 nt, Human
ccacuuaagaguauacauugcuauuaugggagaccacccagacaucugacuaauggcucugugc

SEQ ID NO: 100139 - RNA, 64 nt, Human
uuaaauuuauuuaaauuagcaagcuauuagugcucacccagaggggaaggugguggaaaaugug

SEQ ID NO: 100140 - RNA, 64 nt, Human
aaccaagccuccuuagugcccuggggcugauggucacccagagccauagagcacccuuccuccu

SEQ ID NO: 100141 - RNA, 64 nt, Human
agagaccucugagaucugcacacaugguucccuccacccagaaaacugcccuuuucuuucucuc

SEQ ID NO: 100142 - RNA, 64 nt, Human
caguggugugggccagaaacaagggacagugaaacacccagagacuuguaucagcaggaagcca

SEQ ID NO: 100143 - RNA, 64 nt, Human
uaucucuuugagacucugccuuuaauuccuuuaccacccagaguuuuaucuuuagcaaaauaac

SEQ ID NO: 100144 - RNA, 64 nt, Human
caccggcuccacuuuccccuuuuauuaauacauucacccagauaaucauuaaaauuaacaugug

SEQ ID NO: 100145 - RNA, 64 nt, Human
gggucccuacguuuuacauugauuaaugaauuaucacccagacaugugcagaugaaaugucaau

SEQ ID NO: 100146 - RNA, 64 nt, Human
auucaugggugugugugcacauguugguuucacucacccagaguaauuuugugagcaugcaugu

SEQ ID NO: 100147 - RNA, 64 nt, Human
ugcccggcucccagcagaacauacuagggagaugcacccagagccugccagggagggcuggccu

SEQ ID NO: 100148 - RNA, 64 nt, Human
gaaauccccaagaucaucugggucucccucuccacacccagaacugaggcuuggauaucuucuu

SEQ ID NO: 100149 - RNA, 64 nt, Human
caggggcaguuggcaaaaguccaaguagagauuacacccagaacaccauuccuuccaggagcag

SEQ ID NO: 100150 - RNA, 64 nt, Human
gggccuggaguacgaggggcacccugggggcucccacccagaagcagaggggcugggcuguugc

SEQ ID NO: 100151 - RNA, 64 nt, Human
acugggccugauggaaguuaacccggagcuaagucacccagagcacaggagcugccaugucaga

SEQ ID NO: 100152 - RNA, 64 nt, Human
cacagggaggacggagcuggccucaggagugggacacccagacuuggcagggccuucaagaggc

SEQ ID NO: 100153 - RNA, 64 nt, Human
ccauuugcagguggguagggccuccagcccacaccacccagaccuaggcuucccucuucucagg

SEQ ID NO: 100154 - RNA, 64 nt, Human
uugcugugggcucuccuccagccugcccagggcccacccagaugccucugggguuaccccuguc

SEQ ID NO: 100155 - RNA, 64 nt, Human
ccugagaugacuaggacagucuguacccagaggccacccagaagcccucagauguacauacaca

SEQ ID NO: 100156 - RNA, 64 nt, Human
uggaucccacuguuccucuuugccacagagaaagcacccagacgccacaggcucugucgcauuu

SEQ ID NO: 100157 - RNA, 64 nt, Human
ccucccaggaaacgugaaugguacauucaucauccacccagacucgggcaaccucaccguggcc

SEQ ID NO: 100158 - RNA, 64 nt, Human
acuuuuuuuuuuuugagauggagucucgcucugucacccagacuggagugcaguggugugauca

SEQ ID NO: 100159 - RNA, 64 nt, Human
uucugaucugauuuuuuauucaacaaaccuuaaacacccagaagcaguaauaaucaucgaggua

SEQ ID NO: 100160 - RNA, 64 nt, Human
ucaccccuguccacccugugccuggcugucccugcacccagauacagcaacauggccuguaccc

SEQ ID NO: 100161 - RNA, 64 nt, Human
caaccuccuuucugugccccuuuccucauucugacacccagaagacagugacagauguguuugc

SEQ ID NO: 100162 - RNA, 64 nt, Human
aguggcguuggugcucccuguggacuugcgucggcacccagaggccuuggagggacaaggcacu

SEQ ID NO: 100163 - RNA, 64 nt, Human
ucuuuuauuuuuuugagacagagucucacucugucacccagacuggagugcaguggcgcgaucu

SEQ ID NO: 100164 - RNA, 64 nt, Human
gaacccggcacuguagagcuacagaguuccuucucacccagacacacuagugcucuccagaauc

SEQ ID NO: 100165 - RNA, 64 nt, Human
uuuuuucccucuuacaaaaacagguaaaaagccucacccagaugacccccaucccucauaccau

SEQ ID NO: 100166 - RNA, 64 nt, Human
caccuucugucugguccugagugacucacugugucacccagaaaagagaccugucaggcagaau

SEQ ID NO: 100167 - RNA, 64 nt, Human
gcugcucccguuggcuuuaugagcaucaaguccucacccagacccccugcuggugccguggaug

SEQ ID NO: 100168 - RNA, 64 nt, Human
cccccacccuccccccaccgugcccuuggccugccacccagagccaagagggugcugcucaguu

SEQ ID NO: 100169 - RNA, 64 nt, Human
gugacgguugaagaaucaagcucauaauaugauacacccagacagacccagaaaucuuuugauu

SEQ ID NO: 100170 - RNA, 64 nt, Human
gaaaguucggcuaguguucguguguuugucguagcacccagagccuccaccaaacccucuccau

SEQ ID NO: 100171 - RNA, 64 nt, Human
gcccagccacucccgggaccacggcaaaaggaaccacccagacccaccacccguacacccucag

SEQ ID NO: 100172 - RNA, 64 nt, Human
uuuuguaaugauguuucuuuggauacugucuagucacccagaaaaauguauggaugaauuuuuu

SEQ ID NO: 100173 - RNA, 64 nt, Human
uggccucugagaggagcccacgacacugcagccccacccagaugccccuuucuggauuauucug

SEQ ID NO: 100174 - RNA, 64 nt, Human
gcucccuggggaccccagaugggcucagugcugccacccagaucagaucacaugggaaugaggc

SEQ ID NO: 100175 - RNA, 64 nt, Human
gauaacacagagagaggaauguccaggucaucuucacccagaggagaagccucaucauugaaug

SEQ ID NO: 100176 - RNA, 64 nt, Human
ggcucccagggaagugggagcuggggagccaauccacccagacccgcguccaccugggaggcau

SEQ ID NO: 100177 - RNA, 64 nt, Human
agugcaauucagggccuuuuucuccacucaccugcacccagaagcagagaaaagcaggcacugu

SEQ ID NO: 100178 - RNA, 64 nt, Human
auauauauauauauauauaugagggagaacgccucacccagauuuuaucaugcuggaaagagug

SEQ ID NO: 100179 - RNA, 64 nt, Human
aacaaaacaaaaaacuagauauguaauuucuaaacacccagaucacaaugacaagaugccacuc

SEQ ID NO: 100180 - RNA, 64 nt, Human
ccuccucucaccgcccccacucccugccgugcuacacccagauccugugcaggcugccgggccc

SEQ ID NO: 100181 - RNA, 64 nt, Human
cuugcccuucugggguccugguuccugaagagcucacccagagaggcucaaagcagccuuuugu

SEQ ID NO: 100182 - RNA, 64 nt, Human
uccacauaagaauuuguuguaaugaguucauguccacccagauguuguguuggcagugaacaag

SEQ ID NO: 100183 - RNA, 64 nt, Human
uuuuuuuuuccuuugagacggagucuugcucugucacccagacuagagugcaguggcacggucu

SEQ ID NO: 100184 - RNA, 64 nt, Human
uuuagaaaaauugggauuuccccccaccccgccccacccagauaaacuauaucuacacugucuc

SEQ ID NO: 100185 - RNA, 64 nt, Human
guggggggcacguggacaugccccauaggggccccacccagacuuaacaggcaagguccugggc

SEQ ID NO: 100186 - RNA, 64 nt, Human
ggcucugcuguccuugccuuccauuuccccucugcacccagaacagugguggcaacauucauug

SEQ ID NO: 100187 - RNA, 64 nt, Human
aauucccucuccaggacuccgcaccacuccccuacacccagagcauucucuuccccucaucucu

SEQ ID NO: 100188 - RNA, 64 nt, Human
ucucgccgcccgcccgccaccaccacucucacuccacccagaguagagccaggugcuuaguaaa

SEQ ID NO: 100189 - RNA, 64 nt, Human
ugucauuuucauucggugacauucucucccaugacacccagaaggggcagaagaaccacauuuu

SEQ ID NO: 100190 - RNA, 64 nt, Human
ggacaggcccugggggugccaccgugggcccugccacccagaagucuggcugaggucugggcag

SEQ ID NO: 100191 - RNA, 64 nt, Human
ugggucugggcuccauccugcgcccaaagacauccacccagaccucauuauuucuugcucuauc

SEQ ID NO: 100192 - RNA, 64 nt, Human
ugaucauguuauuguguauugccguggacuucagcacccagacaagccaaaaacagagacaggg

SEQ ID NO: 100193 - RNA, 59 nt, Human
ggguuaugaacccaguguaagagaccacccacccagagccucagcacugucugacuuug

SEQ ID NO: 100194 - RNA, 64 nt, Human
cucagggguuuggucacaaaggauggacucuucccacccagaggaugcagggaaagcacacugu

SEQ ID NO: 100195 - RNA, 64 nt, Human
acccucacugcccucaaggacaacagcagggugucacccagagcccgaugaggggugccagcag

SEQ ID NO: 100196 - RNA, 64 nt, Human
uaaccgcugauucucagggucucugcugccgccccacccagaugggggaaagcacaggugggcu

SEQ ID NO: 100197 - RNA, 60 nt, Human
uccgaccaccuccugaauagugggagacaccacccagagcccugaagcuuuguuccuucg

SEQ ID NO: 100198 - RNA, 64 nt, Human
ugagcccaggagccugccaggcugacgugcaucccacccagacgguguccucuucuugucgcuu

SEQ ID NO: 100199 - RNA, 64 nt, Human
cugcugcucuccagucaaguagcgaagcuccuaccacccagacacccaaacagccguggcccca

SEQ ID NO: 100200 - RNA, 64 nt, Human
agcgaccccuccuagacgcucccuggccccucggcacccagaaugccacauucuuguguuuuuu

SEQ ID NO: 100201 - RNA, 64 nt, Human
cguugugcauuuggugguuucagaaauguguuaucacccagaagaaaauaguggugugauuugg

SEQ ID NO: 100202 - RNA, 64 nt, Human
agcccugcccugggcuguugagaagagaucaguccacccagaguuagacauuguuuuuguagaa

SEQ ID NO: 100203 - RNA, 64 nt, Human
aagucccaggaaccacaggaagugagcuaaggcucacccagagcagcugggucuccaggcugcc

SEQ ID NO: 100204 - RNA, 64 nt, Human
ucccuaacaggaagguguccaguucaagagaacccacccagagacugggagugguggcucacgc

SEQ ID NO: 100205 - RNA, 64 nt, Human
aggacauucucaguggaaagaguuugaucugcagcacccagaagagaagccaaacucgguguca

SEQ ID NO: 100206 - RNA, 64 nt, Human
ccugggcuuuaauguguaggaaaagccuucuggccacccagagagccggagcccugcuugcugu

SEQ ID NO: 100207 - RNA, 64 nt, Human
guggggacaucaggguagcugaaggaaauccacacacccagagcaucucggaguucagacucuc

SEQ ID NO: 100208 - RNA, 64 nt, Human
ucagugacauccaugaggccuuauuagcaaaggacacccagaccuccaagguuugugggccccu

SEQ ID NO: 100209 - RNA, 64 nt, Human
ccagagucacccgcuggcucuacugagauuguuacacccagaauccuuuuguguuuuuuugugg

SEQ ID NO: 100210 - RNA, 64 nt, Human
gggggcuccugagugcagccccacacgacugagccacccagacccucacagggcuggggccugc

SEQ ID NO: 100211 - RNA, 64 nt, Human
ggaagccucagaggccuugggagcucaucccucucacccagaaucccucuaaccccuugggugc

SEQ ID NO: 100212 - RNA, 64 nt, Human
gagcugcucuccuaucugcacucacccaggccuucacccagacuuuaccacggaggcggcugag

SEQ ID NO: 100213 - RNA, 64 nt, Human
gacugugagcaauaaauguuugauguuuauaagccacccagacugugguauuuuguuauagcag

SEQ ID NO: 100214 - RNA, 64 nt, Human
ucccaggccaggcuccuuccugucuuccugcauucacccagacagcucccucugccugaaccuu

SEQ ID NO: 100215 - RNA, 64 nt, Human
ucuuuuucuuuuuugagacagggucuugcucugucacccagacuggagugcaguggugugauca

SEQ ID NO: 100216 - RNA, 64 nt, Human
agcccagcacugucucuucagugcccugauuucucacccagagguuucacccuccuucaucuca

SEQ ID NO: 100217 - RNA, 64 nt, Human
ugcugggcugugccucagacagugcaucaccgggcacccagaggcuugccuggcuauuccuguu

SEQ ID NO: 100218 - RNA, 64 nt, Human
cccacuucugggucuuugccugggauguugcugacacccagaaagucccaccaccugcacaugu

SEQ ID NO: 100219 - RNA, 64 nt, Human
acaagacaacagaauccaucagggccaugagugucacccagaccugacccucaccaauuccagc

SEQ ID NO: 100220 - RNA, 64 nt, Human
caaggaauuggaucacaaucauguagcagaauggcacccagaccacugcccaccagugacggac

SEQ ID NO: 100221 - RNA, 64 nt, Human
ggguggcgggggagaagcagccgugcugccaggucacccagaccuccagacagccggcuagccc

SEQ ID NO: 100222 - RNA, 64 nt, Human
agaaccuugucccagccagugaggaugacagugacacccagagggaguagaauacgcagaacua

SEQ ID NO: 100223 - RNA, 64 nt, Human
ucaccccacccgaugaccugcaugaagccagcagcacccagagccacuccugcugcccuagaac

SEQ ID NO: 100224 - RNA, 64 nt, Human
gcaaaguggagucugguucagccccgugcagacucacccagagcuuaacguugucuuucaaaca

SEQ ID NO: 100225 - RNA, 64 nt, Human
ggcaggacaucccaaccccuggcugggacugaaccacccagagcggagcggcucccuuuucagc

SEQ ID NO: 100226 - RNA, 64 nt, Human
gaguccguagccccgccccggcgcuggucccgcccacccagacaccgcccacuucccggcccgg

SEQ ID NO: 100227 - RNA, 64 nt, Human
ucagccucgcucucaacgugacccggggaaugaccacccagagggaugagcuagccuguagagg

SEQ ID NO: 100228 - RNA, 64 nt, Human
caagagauccugguccccucccugcuggaccugccacccagagcuuccugccuagucccacugg

SEQ ID NO: 100229 - RNA, 64 nt, Human
ggcagcggagcccuacuagacugccagucucaugcacccagaccuguggccagauuguggccuc

SEQ ID NO: 100230 - RNA, 64 nt, Human
cuaccuucuacuggccaaagggagucccagggcucacccagauucagagguggggaaacugagu

SEQ ID NO: 100231 - RNA, 64 nt, Human
gcagaggcggggccggcagagaaggggccuccuccacccagaguccuggccuuggcccgcuguc

SEQ ID NO: 100232 - RNA, 64 nt, Human
gagucaaugccuucaugggaagggcucccagccacacccagaguggcccaaagcuguugaaguc

SEQ ID NO: 100233 - RNA, 64 nt, Human
ugaccaugacccaggcauccuugucccccucacccacccagagcuaggggcgggaacagcccac

SEQ ID NO: 100234 - RNA, 64 nt, Human
caucccuuugaccacaucgcucuaggauaacuggcacccagagaaaaggacuccucagaaaaaa

SEQ ID NO: 100235 - RNA, 64 nt, Human
acccuuuccuucucuagugccugggccugggacccacccagagcaccugugcuggaggaugccg

SEQ ID NO: 100236 - RNA, 64 nt, Human
ccccaugcugcugcugccugggucucugcucuagcacccagaggcaugacaggcccugcucaga

SEQ ID NO: 100237 - RNA, 64 nt, Human
cagcuggcaucauacaaagagcaggagaagcaaacacccagaacucuuuugcuggucagagauu

SEQ ID NO: 100238 - RNA, 64 nt, Human
cuggugccaagaucuacauuucaacccugccuuacacccagagcguccagaucugccacauaga

SEQ ID NO: 100239 - RNA, 64 nt, Human
cacuguuuuuauuuguuuauguuauuuaaauacacacccagacacacacacacacaguuuuugc

SEQ ID NO: 100240 - RNA, 64 nt, Human
uacacuugaggaccacaguuggggguguagggaccacccagacccugguugaauuguuucucuc

SEQ ID NO: 100241 - RNA, 64 nt, Human
gauaccucagagcuggcugucagguggcagcucacacccagacucacuggccacaccucagcag

SEQ ID NO: 100242 - RNA, 64 nt, Human
cacggaagaugcccacgugccugagccaccaauccacccagacaauaaaccauccucuuccaac

SEQ ID NO: 100243 - RNA, 64 nt, Human
cugccugcacuugccuucagagggaggcacaguccacccagauccaccuuuccagcaagacccc

SEQ ID NO: 100244 - RNA, 64 nt, Human
uccccagcagcugcucugcucaccagccugaccccacccagagcaggagcuggcgggugucuuc

SEQ ID NO: 100245 - RNA, 64 nt, Human
ccauccuggagugauuccaacucaacucagaggacacccagagcugccaucuggugaguggcug

SEQ ID NO: 100246 - RNA, 64 nt, Human
uucuccaccuguugguggggggugcuccucgacccacccagauuugaccguucagggggccucc

SEQ ID NO: 100247 - RNA, 64 nt, Human
ucauggguagaaggugccauucagcucacagccgcacccagaauccuuugcagcccuccuucuu

SEQ ID NO: 100248 - RNA, 64 nt, Human
gaaagggaggcucucuuaagagcuaugugccuuccacccagagggagacccaguagaaagaaaa

SEQ ID NO: 100249 - RNA, 64 nt, Human
cuuuccuuccugggggucuguuccuuccuaugcucacccagagaacucucugaugugccagugg

SEQ ID NO: 100250 - RNA, 64 nt, Human
aaaucugccuggcguccccucccucugucuucagcacccagaggaggagagagccggcaguucc

SEQ ID NO: 100251 - RNA, 61 nt, Human
ucuuuuuucaauuuggcuaaugaagggcaaccacccagaacccagaaaaugcagauucacu

SEQ ID NO: 100252 - RNA, 64 nt, Human
cgagugcucagcuggcagaacaccuuuccuuucucacccagaacuuaagagacugauuuuuugu

SEQ ID NO: 100253 - RNA, 64 nt, Human
aaacaaauguguauaaacugcugucaauaaaugacacccagaccuuccggcucagccauggguu

SEQ ID NO: 100254 - RNA, 64 nt, Human
uguguaccugccacaucccucacuugguggaaaacacccagaaggucuugagucccccaccccu

SEQ ID NO: 100255 - RNA, 64 nt, Human
gaaagggaggcucucuuaagagcugugugccuuccacccagagccuugugggagacccaguaga

SEQ ID NO: 100256 - RNA, 64 nt, Human
acugugcgcauucuccagccagggaugcagaggccacccagaggcccuuccugagggccggcca

SEQ ID NO: 100257 - RNA, 64 nt, Human
agagucuggaagugacagaagucagaucuacagccacccagaggaaagucagcuccugaaacgc

SEQ ID NO: 100258 - RNA, 64 nt, Human
uuuuccggcuagugcuucugugauauggaaagggcacccagagcagcaggaccuauagccacgu

SEQ ID NO: 100259 - RNA, 64 nt, Human
gugauuccagcaaguacagagauucuaugaagcccacccagaaaaaacuugcugguccuggcua

SEQ ID NO: 100260 - RNA, 64 nt, Human
gaguugcuuuacguggccuguuucaacacagacccacccagagcccuccugcccuccuuccgcg

SEQ ID NO: 100261 - RNA, 64 nt, Human
gccucuuggguuggagcaggagacccucauuugccacccagaccaaugugagccugcccccagc

SEQ ID NO: 100262 - RNA, 64 nt, Human
cagccgugaccaccugcugugaggcccgaccacccacccagaaucugcccaguccccacuucuu

SEQ ID NO: 100263 - RNA, 64 nt, Human
agacacucccaguugcagggaggguagauggccccacccagaccgagagacacagugaugaccu

SEQ ID NO: 100264 - RNA, 64 nt, Human
uuugaauguggggaacaacugaagacucaggggucacccagaggucugguggaaagcaacuuca

SEQ ID NO: 100265 - RNA, 64 nt, Human
uccagcuccgcagggccugcgcgucuccggcuuccacccagacggcacucaagccugcccccga

SEQ ID NO: 100266 - RNA, 64 nt, Human
acuauccuaaauauauaugcacccaauacaggagcacccagauucauaaagcaaguccugagug

SEQ ID NO: 100267 - RNA, 64 nt, Human
ccagaguauuuucaacaaagcgugcuucauuugacacccagagucugacuuuggauucgaacua

SEQ ID NO: 100268 - RNA, 64 nt, Human
cuccccggagccggcacugcauguuccuggacaccacccagagcacccucugguugugggcuug

SEQ ID NO: 100269 - RNA, 64 nt, Human
cuuuuuagcuagugggcaugugaagauauuuagucacccagaggagccaguaaauguuauaaug

SEQ ID NO: 100270 - RNA, 64 nt, Human
cacagggaacagcaugcccccuccggggucaugccacccagagacugucgcugucuauggcccc

SEQ ID NO: 100271 - RNA, 64 nt, Human
gacccccaccauaaaucacaucauuagcaugaaccacccagaguggcccaagacucccagauca

SEQ ID NO: 100272 - RNA, 64 nt, Human
uuugguggcacguaagcuccuugucugucuccagcacccagaaucucauuaaagcuuauuuauu

SEQ ID NO: 100273 - RNA, 59 nt, Human
aggacccugccccggccugaaggccagggcacccagaugugcugcucaagggagcccca

SEQ ID NO: 100274 - RNA, 64 nt, Human
acucgguuuaaccagggcucuguaagaccacucccacccagagacuuguguggccugguguggc

SEQ ID NO: 100275 - RNA, 64 nt, Human
uacucaucaaaccagguguccuuggcauuguguccacccagagagcucacuguuuucuuuucuu

SEQ ID NO: 100276 - RNA, 64 nt, Human
uaugugccuugaauguagccaaaaugacgaacaacacccagaaaucugugauuuagcacugaga

SEQ ID NO: 100277 - RNA, 64 nt, Human
caccuugccuuccagauaugugguuuuugugauucacccagaucuguugugccaguuaggaauu

SEQ ID NO: 100278 - RNA, 64 nt, Human
accucagccuccagaguagcuggaaauacagugccacccagauagccucacaaaacuuugaccc

SEQ ID NO: 100279 - RNA, 64 nt, Human
ggaggucaccugggggcagcuggugccgggucuucacccagaccacgcuggguccccucuguug

SEQ ID NO: 100280 - RNA, 64 nt, Human
ccaaccacaggagcacggauucccuguaccucaacacccagacccugccucccucaggcaccag

SEQ ID NO: 100281 - RNA, 64 nt, Human
caccagggaauuaauucccccagucaaccaauggcacccagagagggcauggaggcuccacgca

SEQ ID NO: 100282 - RNA, 64 nt, Human
ggagcgacccuucccccagccccgccccucaggacacccagaaccccaccccucguccucucgg

SEQ ID NO: 100283 - RNA, 64 nt, Human
ugcuccucuccgcagccagaaaugcugccggcugcacccagagggagcagugaggcaggacaga

SEQ ID NO: 100284 - RNA, 64 nt, Human
cuggugcucugcccugcacgucaggguuggcauccacccagauccagauggaagggaaacuucu

SEQ ID NO: 100285 - RNA, 64 nt, Human
ccucucacacccgcacccgcgccucacgaucccucacccagagcacacggccgcggagaugacg

SEQ ID NO: 100286 - RNA, 55 nt, Human
gacaggcgggcaaacagugagcgcccacccagaccggcugcugcgcccccuccug

SEQ ID NO: 100287 - RNA, 64 nt, Human
uccccgggcacugagccuaagauguccuaaccuccacccagaaccccuucagucccugcugggu

SEQ ID NO: 100288 - RNA, 64 nt, Human
gccugcuggucagcacuccaguagcgagagacggcacccagaaucagaucccagcuucggcauu

SEQ ID NO: 100289 - RNA, 64 nt, Human
cucccauaauaacccccaaauacagaccccaugucacccagaaagagauucccugaguagcacc

SEQ ID NO: 100290 - RNA, 64 nt, Human
cacugguggcucgcuuugaugcuggagaacuaaucacccagagggagcuggucuccagccaggu

SEQ ID NO: 100291 - RNA, 64 nt, Human
ugccaccucuaucuguguacauacucccuucuuccacccagauggguccccugggguagaugca

SEQ ID NO: 100292 - RNA, 64 nt, Human
agggagggacagagacccagagggcagcgucagacacccagaguuggagacagaacaacagagu

SEQ ID NO: 100293 - RNA, 64 nt, Human
gugaggagugugagcaugccuacccuggccagaucacccagaacauguugugugcuggggauga

SEQ ID NO: 100294 - RNA, 64 nt, Human
acuuuccagcacacucccccgacccucgcggacacacccagaugccccagggaccccgggaagg

SEQ ID NO: 100295 - RNA, 64 nt, Human
agugggcggggcagcgacugggagaugggucggucacccagacagcucuguggaggcagggucu

SEQ ID NO: 100296 - RNA, 64 nt, Human
gucucuucugcaaagaaugcauucucccccaguccacccagaacacacagccuccauccaggua

SEQ ID NO: 100297 - RNA, 64 nt, Human
gggagauaaggucaugggagaguggguggggacacacccagagacuggcuuugggauugggcac

SEQ ID NO: 100298 - RNA, 64 nt, Human
gcucagugugauccugagauggcuuccccgccgccacccagagugugguccuuggccgccuccu

SEQ ID NO: 100299 - RNA, 64 nt, Human
guuugccucuuccuuggguaugaaugugugaguucacccagaggccugcucuccucacacauug

SEQ ID NO: 100300 - RNA, 64 nt, Human
gucguggccagcccugcagcuucagcaccugccccacccagagugggagucagguggagccacc

SEQ ID NO: 100301 - RNA, 64 nt, Human
gaggcaaauugcauuugcuugcucccuauggaaucacccagaggggugccuugcccuggcugag

SEQ ID NO: 100302 - RNA, 64 nt, Human
uucccuacacccugaccggccacugccgcacacccacccagagcacgccacccgccaugggagu

SEQ ID NO: 100303 - RNA, 64 nt, Human
ccgcaugccuccugccuccugggcuauuccucuccacccagaaggcugggaaucccagcugauu

SEQ ID NO: 100304 - RNA, 64 nt, Human
uccuuugagcccaaggcagagcuggagcuggcgccacccagacagcgucagguguggcuggggu

SEQ ID NO: 100305 - RNA, 64 nt, Human
ggcgucuguaccucaggggaugccccgcuguggucacccagagaaucacccuuccuggucuaca

SEQ ID NO: 100306 - RNA, 64 nt, Human
cuggacuaacagacaacauacauucaccgcuggucacccagauccucauucaaacccacugcug

SEQ ID NO: 100307 - RNA, 64 nt, Human
gagcaggagaacaucaucuuaauagccuuuggcucacccagagucagggagagaugaaaauaau

SEQ ID NO: 100308 - RNA, 64 nt, Human
cccaccuuuccuucagaacccuggggcccagggccacccagagguaagaggacauuuagcauua

SEQ ID NO: 100309 - RNA, 64 nt, Human
cacaaagacuugcaugcagagaucccuggcagaacacccagagugcccguggcucccaccccag

SEQ ID NO: 100310 - RNA, 64 nt, Human
ucgguucuccaacagcccagagcucacucuuuuacacccagagguggagcagguggcuuagggg

SEQ ID NO: 100311 - RNA, 64 nt, Human
auagaagcacauuucugccaccuccccugggaggcacccagaagccugccacucuuuaccuagu

SEQ ID NO: 100312 - RNA, 64 nt, Human
uaaaugccagccauuucucaaacccaccucggaccacccagaguuuccucuuggucccugucua

SEQ ID NO: 100313 - RNA, 64 nt, Human
aggcagcuuuccucugaaaagcaaccucuccugccacccagaucccaucucaagagcucgccca

SEQ ID NO: 100314 - RNA, 64 nt, Human
ucaagccaaggaucauccccuggaacccaguaugcacccagaggggacucagcuucaaagcugc

SEQ ID NO: 100315 - RNA, 64 nt, Human
uucccaagccagccccaacacccuucccacuuggcacccagagggggcuguggguggaggccug

SEQ ID NO: 100316 - RNA, 64 nt, Human
augcuaaucucuuccagaaacagccucacagacacacccagacaucugguagaugguaaaacau

SEQ ID NO: 100317 - RNA, 64 nt, Human
gauacuauagugagcccaugcagcaccucucacccacccagagauggagcugcucugccuucca

SEQ ID NO: 100318 - RNA, 64 nt, Human
acugugaagugacuccaggacggaccugcgggggcacccagagguccuaagccccaggacugag

SEQ ID NO: 100319 - RNA, 64 nt, Human
gcacgggggugaugcugccacagggggcuggugacacccagagcccccuccccagcccucaggc

SEQ ID NO: 100320 - RNA, 64 nt, Human
caggacccguguccucagagcaccacacacugagcacccagagacagcgggccuggcagcgggc

SEQ ID NO: 100321 - RNA, 64 nt, Human
auguguugaccggcugccguuugaggacuuuggucacccagacuagacaccuucugugcucaug

SEQ ID NO: 100322 - RNA, 64 nt, Human
uggaugcgaggccacggcucagugaugggcucaccacccagaaguggggagagacuuugggccu

SEQ ID NO: 100323 - RNA, 64 nt, Human
ggcuccggguggccccucuggcccccacugcccacacccagagcuuuaauggacaguccguacc

SEQ ID NO: 100324 - RNA, 54 nt, Human
gccgcuuccccagcagcugaaaggcacccagacuucaaggacccagacccaccc

SEQ ID NO: 100325 - RNA, 50 nt, Human
gaaacagcaacggccucuagcacccagaaacagggaggguccucgaggag

SEQ ID NO: 100326 - RNA, 64 nt, Human
cagucaccauggucuaaucccaagagggacucgucacccagagaccucaaaaggccccaggccu

SEQ ID NO: 100327 - RNA, 64 nt, Human
caggaagcguguucaacacauggaaucagggcuccacccagaccugccgaggccacacuccugg

SEQ ID NO: 100328 - RNA, 64 nt, Human
guuuaguguggauuucagcaaaaccugaucaucccacccagaagaccuucucaucaauagaucg

SEQ ID NO: 100329 - RNA, 64 nt, Human
uuuuuuuuuuuuuugagacggaauuucgcucugucacccagacuggagugcaauggcuugaucu

SEQ ID NO: 100330 - RNA, 64 nt, Human
gugcucauuuggaauuccucccaagaccccuggccacccagaccccccauucuuccuaacacug

SEQ ID NO: 100331 - RNA, 64 nt, Human
aucuggauccauuccggcgccuuccucucccagucacccagagggccccaaccccggcggcccu

SEQ ID NO: 100332 - RNA, 64 nt, Human
ucggcggcagcguuuguuccagaacgccgccucccacccagaucgcgguauauagagauaugca

SEQ ID NO: 100333 - RNA, 64 nt, Human
cagcacauccuguccuccugagcucgcgugcagccacccagagcgcaggggucacugcacgcug

SEQ ID NO: 100334 - RNA, 64 nt, Human
ccagcucucuagucaccacccugccucucccucucacccagagucaguaccaguuuuauggcuu

SEQ ID NO: 100335 - RNA, 64 nt, Human
aaugaaucugcuacaauuccaccucauucuuucacacccagagccagagccuuaagcaucaugg

SEQ ID NO: 100336 - RNA, 64 nt, Human
augccaccuaugccacagugccuaagggcuaggccacccagagacugugcccggagcuggccgu

SEQ ID NO: 100337 - RNA, 64 nt, Human
uguacuggcagcuugccacccccuccucucccuucacccagacacgugguagggauggaaaagg

SEQ ID NO: 100338 - RNA, 64 nt, Human
ccccuccucuggcccaggacgccugcugcaagcccacccagauggggccagagucuguguggac

SEQ ID NO: 100339 - RNA, 64 nt, Human
ucuaagcucuuggcuuggagucccgugucgucuccacccagaggaaguucuccagaguucaccu

SEQ ID NO: 100340 - RNA, 64 nt, Human
caucaccuccugcggcagaacagcacccgugacccacccagagagcaaggccaggggucuuggu

SEQ ID NO: 100341 - RNA, 64 nt, Human
cauacaggaaacuucucguuuccucguuuagccccacccagaucaggugaaagggcagcuuuaa

SEQ ID NO: 100342 - RNA, 64 nt, Human
uuguuuuguuuuuagagacagggucuugcucugucacccagacuggaguacaaugacacaauca

SEQ ID NO: 100343 - RNA, 64 nt, Human
ggccucagagcugccccugcucucccaccacagccacccagaggcaccccaugaagcuuuuuuc

SEQ ID NO: 100344 - RNA, 64 nt, Human
gacggcugagugaccccaagaaaggcuuccccgacacccagacagaggcugcagggcuggggcu

SEQ ID NO: 100345 - RNA, 64 nt, Human
ccccaacacuauaccuugggccggccaggcagggcacccagacggggggcuggaggacacccuc

SEQ ID NO: 100346 - RNA, 64 nt, Human
ucugucaaaaguucacaaugccauacaggcucuucacccagaggaucuggaaagaagaaagaua

SEQ ID NO: 100347 - RNA, 64 nt, Human
gaugcuguauucccauaucaaaagacacaggggacacccagaaacgccacaucccccaauccau

SEQ ID NO: 100348 - RNA, 64 nt, Human
uuucucaugcccugccuucaucugucuccuucugcacccagaguagggguggaguauacccuug

SEQ ID NO: 100349 - RNA, 64 nt, Human
gcggccaagugaggaaaagacacccugucugcagcacccagaacugaggaggggcacugcccug

SEQ ID NO: 100350 - RNA, 64 nt, Human
caaagggaaauuuuacauaugucacugggaccaucacccagaugaugugaguuaucugccugaa

SEQ ID NO: 100351 - RNA, 64 nt, Human
cuaacuauucucccaucaaaucauauauguugaccugucugaauuauaaaccagccugaccuuu

SEQ ID NO: 100352 - RNA, 64 nt, Human
uaugaacgcaaggcugugauauggaaccagaaggcugucugaacuuuugaaaccuuguguggga

SEQ ID NO: 100353 - RNA, 64 nt, Human
ccugaccacggcucaguacuugccaccugcuggccugucugacccuccgcacucaccugccggg

SEQ ID NO: 100354 - RNA, 64 nt, Human
agugugcacuucacacaggggaaugggguuacuucugucugauccugggccuuucuuucauccc

SEQ ID NO: 100355 - RNA, 64 nt, Human
acagugaguuggcagaagugacuugagcauuucucugucugauuugaggcucagaccccucccu

SEQ ID NO: 100356 - RNA, 64 nt, Human
cggaauaguugcacugaaucuauacuuugcagcacugucugaugcgucaacaaaauugagccau

SEQ ID NO: 100357 - RNA, 64 nt, Human
ggggcuuggaucaguaagucugguucccgccucccugucugagagaggaggcaggagccccagg

SEQ ID NO: 100358 - RNA, 64 nt, Human
uaaagcuucuguggucuuguuuuuaauggcucaacugucugauguaauugagugaagguuugca

SEQ ID NO: 100359 - RNA, 64 nt, Human
acccuggugaaaccuuugaagacauaaaaaaaaccugucugagauguucuuucuaccaaucuau

SEQ ID NO: 100360 - RNA, 64 nt, Human
uaagauuuaagauauacauuuuuugagagguagucugucugauacaauguaaaugacaaaacau

SEQ ID NO: 100361 - RNA, 64 nt, Human
aaaaaauaguugugcacaacaucugcucacuggacugucugauccaauguaauuggcugcgucu

SEQ ID NO: 100362 - RNA, 64 nt, Human
cagcuuugaaccaugcauuccaucuauauuccuccugucugaacucaugcucuuuugauuaugu

SEQ ID NO: 100363 - RNA, 64 nt, Human
ccagcagcuccugcccccuucucuguacuugcuucugucugacaccuucucccuguuggccuga

SEQ ID NO: 100364 - RNA, 64 nt, Human
guccccuaaggaggggccuugugucugugccugccugucugacagaccuugaauauguuaggcu

SEQ ID NO: 100365 - RNA, 64 nt, Human
uucucuauuugauauuugaaauucuucuguaagccugucugaguguauguggaaacgauuguca

SEQ ID NO: 100366 - RNA, 64 nt, Human
aaugauguaaauucagucccugguuuuuaauuuucugucugaugucacagaucauuguugcaca

SEQ ID NO: 100367 - RNA, 64 nt, Human
gaagcucaauaucagcugggaaggaacugugccucugucugacuggccccacuuccuaagcacu

SEQ ID NO: 100368 - RNA, 64 nt, Human
caauaaaaauuaaagugaaggaaaauacugaacucugucugagugggaugguaugaguuagagg

SEQ ID NO: 100369 - RNA, 64 nt, Human
aaaacccaaaguccuuaucauggccuacaaggcccugucugauuuggcuccccuuucucucccu

SEQ ID NO: 100370 - RNA, 64 nt, Human
auaggcuacagccaccucagaugcuuucagugcucugucugaggauguguauaugcauaugcaa

SEQ ID NO: 100371 - RNA, 64 nt, Human
ucugacaccacauuuuccuucuaugcaaucaugccugucugauaaucuugcauugcuuuccucu

SEQ ID NO: 100372 - RNA, 64 nt, Human
uccuggcugguucuuugggguuggcacagaaguccugucugagguccuauccaugccccuuacu

SEQ ID NO: 100373 - RNA, 64 nt, Human
gagaaguucucagaauaacuaccuccucacuuggcugucugaccagagaaugcaccucuuguua

SEQ ID NO: 100374 - RNA, 64 nt, Human
caacaacaacaaaaaauaaaucaagaaggcauagcugucugaauccccaauuauugaggcacac

SEQ ID NO: 100375 - RNA, 64 nt, Human
acuugccugucucauuuuaucuuccuucuagcagcugucugaaauugguucgucuguuuucuug

SEQ ID NO: 100376 - RNA, 64 nt, Human
augggaagagugcuccccauugauugaagagucacugucugaaagaagcaaaguucaguuucag

SEQ ID NO: 100377 - RNA, 64 nt, Human
ccgaucuucucaaauucuguacuuuuuuucuuuucugucugagcugccuucucuaucauucagc

SEQ ID NO: 100378 - RNA, 64 nt, Human
gaagaaauggaaugaaucuccaaggcuuuuaggacugucugaaaauuugaggcugggugaaguu

SEQ ID NO: 100379 - RNA, 64 nt, Human
guggaaggucugagcucuccccagaaggcacuuccugucugauguccaggaugucacauguucc

SEQ ID NO: 100380 - RNA, 64 nt, Human
aauuccaggguaaggaggaagaugccuguucucccugucugaagagggagaugagacagcucuc

SEQ ID NO: 100381 - RNA, 64 nt, Human
ugacuuuagaggcaugggcuccaaccccuuagcucugucugagaauuaugguuuuacugcuacg

SEQ ID NO: 100382 - RNA, 64 nt, Human
uucuagccccugcagagccugggagcugcaggaacugucugagaaaaucucccuaauaggggag

SEQ ID NO: 100383 - RNA, 64 nt, Human
caagagaaguggcuauugaagugucuuuggauagcugucugagugaccacggacaaagucuuaa

SEQ ID NO: 100384 - RNA, 64 nt, Human
ugucuguugaaagauuuuaaguuggaaacaguuccugucugaaaacucuucugagaaccacaaa

SEQ ID NO: 100385 - RNA, 64 nt, Human
caguuuggggcugugaaaccuaggcagaaggcggcugucugagggcuguccccgccuaggacag

SEQ ID NO: 100386 - RNA, 64 nt, Human
auucccagacagcagggauuuauuuaaauguuagcugucugaguuuuuaaauagcuaauacgac

SEQ ID NO: 100387 - RNA, 64 nt, Human
accuguuaguccagaaaggauacggauagauagccugucugacugaacagccagauggccccca

SEQ ID NO: 100388 - RNA, 64 nt, Human
uaaaaugugcuucucuucuucgggauguuguuugcugucugaucuuuguagacuguuccuguuu

SEQ ID NO: 100389 - RNA, 64 nt, Human
ccccucccucuccacuaguggugaaugcaugugucugucugaucagcaucacugcacacggagg

SEQ ID NO: 100390 - RNA, 64 nt, Human
gcucugaggucugugaucgccggacaguccaggccugucugaaccccaccacucacuucugugg

SEQ ID NO: 100391 - RNA, 64 nt, Human
aggguuguagggauggcacacuuauuaguucugccugucugaaagguuccugcaggacaguuug

SEQ ID NO: 100392 - RNA, 64 nt, Human
guuuuagaaaauauagcccuuguuuggauuacugcugucugagcacuagaaauuucuaauggaa

SEQ ID NO: 100393 - RNA, 64 nt, Human
uggagaacugaaaaggguaucugcaugaaggcuccugucugacuauuccaggauccaauauuac

SEQ ID NO: 100394 - RNA, 64 nt, Human
ugcuaguugugauuuuauacauaaaggccagaagcugucugaggcaaucaugauugauuguaug

SEQ ID NO: 100395 - RNA, 64 nt, Human
gacaaauucauucccuucucucagccuccacucccugucugaaaccagaagacuggaucaaggg

SEQ ID NO: 100396 - RNA, 64 nt, Human
gcacuuaaguguuagaucuaacguguuccagugucugucugaggugacuuaaaaaaucagaaca

SEQ ID NO: 100397 - RNA, 64 nt, Human
acaaaguauguuaaaggucacaaaagcaaaauaacugucugaggcuaaggcccacgugggacag

SEQ ID NO: 100398 - RNA, 64 nt, Human
ccaugucuauuuugcuaucucagcauagacuaugcugucugauaaaucuaauucuuaacucuau

SEQ ID NO: 100399 - RNA, 64 nt, Human
guuuucacagaccauaaacaggacugaagaaugucugucugaaucuuugccuugaaugaagaaa

SEQ ID NO: 100400 - RNA, 64 nt, Human
ucuucucucccacacccugcccuccuuguuucagcugucugaggugccucgcagggccucucuu

SEQ ID NO: 100401 - RNA, 64 nt, Human
cacccugcuacacauacaggauuugaacucagaucugucugauaggaaugugaaagcacggacu

SEQ ID NO: 100402 - RNA, 64 nt, Human
aucaccuuugguggggugggcuucggaggacagucugucugaaccugccagugcugacccugca

SEQ ID NO: 100403 - RNA, 64 nt, Human
gggccugcagugcaaacccucuuccgcugagcagcugucugaacuauaggccccagugcugaag

SEQ ID NO: 100404 - RNA, 64 nt, Human
ucucagaacccagaaucuuugaggguaagguuaucugucugauacugagcagaaacagaaugau

SEQ ID NO: 100405 - RNA, 64 nt, Human
gcugccacguguuuaggaaacaaaguaugcgcuacugucugaaaacaaauaaagcagaugccuu

SEQ ID NO: 100406 - RNA, 64 nt, Human
uuaugcucuuuuuuacucauugaaaugucacguacugucugauuggcuuguagaauuguuauag

SEQ ID NO: 100407 - RNA, 64 nt, Human
ggugggcagccucaggucuugagaggauaagacucugucugaggacuccaucugcuccgggaag

SEQ ID NO: 100408 - RNA, 64 nt, Human
cugggguagaaauguauggugauuuuuauuuucucugucugaagaaccagccauuuuuaaaaag

SEQ ID NO: 100409 - RNA, 64 nt, Human
uuuccauuuguguuaugccacagagagaaauuuccugucugaacucuucugcugccugccuagg

SEQ ID NO: 100410 - RNA, 64 nt, Human
aagaaacaacaacaaacgagauacauuauaauuacugucugauuuucuuacaguucuagaauga

SEQ ID NO: 100411 - RNA, 64 nt, Human
aaauuccuucagaacuagauuagcauugcccugccugucugaaaggacaguuuaccuaauggug

SEQ ID NO: 100412 - RNA, 64 nt, Human
gcgcugagcucccagacccccugaucaggccgcacugucugaagcaaucgguuccccagauuac

SEQ ID NO: 100413 - RNA, 64 nt, Human
gcuguccccgccccccugcucccgucugucuguccugucugauucucuuaggugucauguucuu

SEQ ID NO: 100414 - RNA, 64 nt, Human
guaaagccacggauuccccucgcuggagaggcuccugucugauagcgguagaugaaaaauaagg

SEQ ID NO: 100415 - RNA, 64 nt, Human
ccauuccuccucccugcagucagaauucuuugcccugucugaccugaacuugcuuagggaguca

SEQ ID NO: 100416 - RNA, 64 nt, Human
ucagaaauagaaucacaauaggaggagaauuugacugucugauauuaugauuugauuacaauac

SEQ ID NO: 100417 - RNA, 64 nt, Human
guugccuagagucccacugugagucauggucagccugucugacauccagguugugcuauuaacc

SEQ ID NO: 100418 - RNA, 64 nt, Human
gcauuuguuaauacaagaugcaacgcacagcacucugucugaggcuuugguaaaaaguaaaggg

SEQ ID NO: 100419 - RNA, 64 nt, Human
ugggugggauuccugguggacaggggugucagaucugucugaggagccccagucaugcucagca

SEQ ID NO: 100420 - RNA, 64 nt, Human
guaauggaugucuuaaucguguagaccugauucacugucugaaguauuguuuacuucguuacau

SEQ ID NO: 100421 - RNA, 64 nt, Human
ugcaaacuuuaguuauuacaggcagcaaaaaccacugucugaaacuaaaucuguguucaaagau

SEQ ID NO: 100422 - RNA, 64 nt, Human
agcacauaaauacaacagaauagccacccaauuucugucugaaaucuaaauuggauggauuuga

SEQ ID NO: 100423 - RNA, 64 nt, Human
augauuacuucuuuguuuccuuguggcuucuugucugucugagucaacgaauacacagacuuac

SEQ ID NO: 100424 - RNA, 64 nt, Human
acaaugguauauauuuuuguuaucaggugcaugucugucugauuucuuuuuuuuuccuguugga

SEQ ID NO: 100425 - RNA, 64 nt, Human
gcacaguucauuucacugggauuuugaagcauuucugucugaauguaaagccuguucuaguccu

SEQ ID NO: 100426 - RNA, 64 nt, Human
gacuugagauuguacauuucuuacuacucuucuacugucugagaucagaauaugacauugcagu

SEQ ID NO: 100427 - RNA, 64 nt, Human
gguuggaaaguaggggaaauugaaguuguagucacugucugagaauggcuaugaagcgucauuu

SEQ ID NO: 100428 - RNA, 64 nt, Human
agucuggauucggauguauaaggugugccuuguacugucugauuuacuacacagagaaacuuuu

SEQ ID NO: 100429 - RNA, 64 nt, Human
ggaauagcacuuuaauagucaaaaauguguuuaccugucugauugagugagccuuuuggugagc

SEQ ID NO: 100430 - RNA, 64 nt, Human
ucugcuguucucccuggaucuucugacauuacugcugucugagauuuguauauguguaaauaca

SEQ ID NO: 100431 - RNA, 64 nt, Human
uaauaagugacaaaacugagcauccaucccagaucugucugacucugggucagugacccugcuc

SEQ ID NO: 100432 - RNA, 64 nt, Human
gcccaaagcccuugugggcggaccuccccugagccugucugaggggccagcccuuagugcauuc

SEQ ID NO: 100433 - RNA, 64 nt, Human
cuagaaagucuagagcugguauucuagcccaaaucugucugaccgcaauacacagauucuuuau

SEQ ID NO: 100434 - RNA, 64 nt, Human
uuugcaaccuugcccugagugaaucauguuaaagcugucugagucuaaagcaccguaucuuggu

SEQ ID NO: 100435 - RNA, 64 nt, Human
auguauuugugcacauguacauauggaaauguuacugucugacuacaacaugcaucaugcucau

SEQ ID NO: 100436 - RNA, 64 nt, Human
gucaucggggcucacugccuccugcccuucucuccugucugacccccacuuagcccuucucucc

SEQ ID NO: 100437 - RNA, 64 nt, Human
cguaucucccgaaguccucuguggccagcugcaucugucugaauggugcgugaaggcucucaga

SEQ ID NO: 100438 - RNA, 64 nt, Human
acaaccgagcacauuggugacagaccuucggggccugucugaagccauagccuccacggagagc

SEQ ID NO: 100439 - RNA, 64 nt, Human
gccacugaacuccagccugggagacagcaagacccugucugaaaaaaaaaaagaaaagaaaaag

SEQ ID NO: 100440 - RNA, 64 nt, Human
ugaaugaaccuugcugaauuaaucugaauagcaacugucugacuugauaacuccagugccagua

SEQ ID NO: 100441 - RNA, 64 nt, Human
gaaugagaggccagagggaccauaguguugggcacugucugaccauguugcauuuggaaggcua

SEQ ID NO: 100442 - RNA, 64 nt, Human
ucccuuuuguuuuacuguauauaaaauuguuaaucugucugauuuugucugaauuauaaacacu

SEQ ID NO: 100443 - RNA, 64 nt, Human
aauacaaaaguuaauuuuaccuacuauaauaugacugucugaaacuuauuuucucucugagaaa

SEQ ID NO: 100444 - RNA, 64 nt, Human
cucuuccucaagcaacacuccuagggccuggcuucugucugaucaaggcaccacacaacccaga

SEQ ID NO: 100445 - RNA, 64 nt, Human
ucaacaggaaagacaaaguguacgugaaugcucgcugucugauaggguuccagcuccauauaua

SEQ ID NO: 100446 - RNA, 64 nt, Human
cuauuuuaaaaauagaaaguaaguuuguagcaugcugucugaauucugggguaaguuccaccuc

SEQ ID NO: 100447 - RNA, 64 nt, Human
guaggaaucuuagaaacaagaccacuuauacugucugucugaggcagaagauaacagcagcauc

SEQ ID NO: 100448 - RNA, 64 nt, Human
cccugcccacccucccuccccacugcugcugagucugucugauguuuugguugugugaauaaau

SEQ ID NO: 100449 - RNA, 58 nt, Human
cugucugcuucaugggauaggaccgucucugucugauccuguccauucggaaccaggc

SEQ ID NO: 100450 - RNA, 64 nt, Human
cagcacggcugccuuccugacccagucaaggccucugucugaaaugagucgcuccagguucuca

SEQ ID NO: 100451 - RNA, 64 nt, Human
ccucccagcaaccuaagaccagucugaacucacacugucugaaaggccacccaggauccaaauc

SEQ ID NO: 100452 - RNA, 64 nt, Human
augccacuccuuacccagugcucugcaacaaguccugucugacccccaauucccuccacuucac

SEQ ID NO: 100453 - RNA, 64 nt, Human
uuacuuccuauuuucaccuuaucuugcaauuuuucugucugauuuuuacaaugggaggggagcu

SEQ ID NO: 100454 - RNA, 64 nt, Human
uugcuucacuuugccuucugguuauuuaugguuucugucugaauuauucugccuacguucucuu

SEQ ID NO: 100455 - RNA, 64 nt, Human
uuuggguauauucuuauauauauuauguacaucgcugucugaaauuuuaguuauuuuuuguuuu

SEQ ID NO: 100456 - RNA, 64 nt, Human
ggagggcaggcuccggggcccgcagccucccacgcugucugagagaucucagacuccacuugac

SEQ ID NO: 100457 - RNA, 64 nt, Human
ggggaauuuguccuuacagucccacucuggagcacugucugaagaugaggaaucaucuguguac

SEQ ID NO: 100458 - RNA, 64 nt, Human
acuccacauaagggguuuaguaagagaagucugucugucugaugauggauagggggcaaaucuu

SEQ ID NO: 100459 - RNA, 64 nt, Human
guucguaucuuuauuuauucccuaguuugcagaacugucugaauaaaggauacaaggauuauuu

SEQ ID NO: 100460 - RNA, 64 nt, Human
uaugcugguguauguuuaucaaagagcacuugagcugucugaagcccaaagccugaggacagaa

SEQ ID NO: 100461 - RNA, 64 nt, Human
uuuggccuuccuagaacacugcuucauaaccucucugucugacuucugcaucuccuuccagguc

SEQ ID NO: 100462 - RNA, 64 nt, Human
auggauuuugugccugaaaauaauagagcuugagcugucugaacuauuuuacauuuuauggugu

SEQ ID NO: 100463 - RNA, 64 nt, Human
aaaaucugaagguuaucuuuaucauguuucaucccugucugaagauuuccuagucuucuuaugu

SEQ ID NO: 100464 - RNA, 64 nt, Human
uuacauauugucuuauuuguuuguuuuacugaaucugucugaguauuaaaagccuuguaucuug

SEQ ID NO: 100465 - RNA, 64 nt, Human
acauaccacaaaaauacauccccagucuuuuguucugucugagguuagaauuaauucaaauuca

SEQ ID NO: 100466 - RNA, 64 nt, Human
guccucgagggucauggcuugucccuggucaguccugucugacugaccucagggccucaccucu

SEQ ID NO: 100467 - RNA, 64 nt, Human
acaaaggccaacucuacauauuugguagcccuaacugucugagcaguaguggcugcugugaugu

SEQ ID NO: 100468 - RNA, 64 nt, Human
uucuuguugucccucccauuagccagggcggagacugucugagcugugcaggaggaggguugcu

SEQ ID NO: 100469 - RNA, 64 nt, Human
ugauuucuucccaagcuucucaaacuguuagcugcugucugacuucaucaauaaaguauuuuua

SEQ ID NO: 100470 - RNA, 64 nt, Human
auuuguaacuccucuuuggggucuucuccaccaccugucugauuuuuuugugaucuguuuaauc

SEQ ID NO: 100471 - RNA, 64 nt, Human
aacauuguuuuaauggcugccgacaaugaacugucugucugagucuaaaaccaagcucagguuu

SEQ ID NO: 100472 - RNA, 64 nt, Human
uugacuugacaaagcaugaagauauucccagugucugucugauaauauuuugcaucuaagaaug

SEQ ID NO: 100473 - RNA, 64 nt, Human
guucuggcuuugaggcuuguuuuguugucugugucugucugaauaaccugcgugucuaaaacca

SEQ ID NO: 100474 - RNA, 55 nt, Human
agccauauggcagauacugauuguacugucugauguugugaaauagccaaucucc

SEQ ID NO: 100475 - RNA, 64 nt, Human
guuugaggcauugacaguugugauucagcaccugcugucugagcgggaggaagcacugaaacaa

SEQ ID NO: 100476 - RNA, 64 nt, Human
gaagacaccaucuccaugugaccgaacacugcagcugucugaccuuccaaagacuaagacucgc

SEQ ID NO: 100477 - RNA, 64 nt, Human
ggguuugcccuucucggaggguaccuccuguucccugucugagcauccugcauggaagucaaag

SEQ ID NO: 100478 - RNA, 64 nt, Human
cuuaccaaguggguuuucaccauccucuugcucucugucugagagauguuuucuaaaccccagc

SEQ ID NO: 100479 - RNA, 64 nt, Human
agauugaugaggucaaugugauucaguuguguugcugucugagccacagccaauugugugugcu

SEQ ID NO: 100480 - RNA, 64 nt, Human
gacaagggaagggagcaccagaugacacauaaaucugucugauucuaugccuguauuuccaaca

SEQ ID NO: 100481 - RNA, 64 nt, Human
cuuaguucuucauuacugcauugaaaaggaaaaccugucugagaaaaugccugacaguuuaauu

SEQ ID NO: 100482 - RNA, 64 nt, Human
cagcugggcuggaacgugaacucaguagcugaaccugucugacccggucacguucuuggauccu

SEQ ID NO: 100483 - RNA, 63 nt, Human
uaaggaggugaggugguuggaauaaaaacaguuccugucugaaugcuuugguucuucaggcgg

SEQ ID NO: 100484 - RNA, 64 nt, Human
uuuccauauccuagauggaaacccucaugcuaaacugucugauuaugcaugguucuaaaugguu

SEQ ID NO: 100485 - RNA, 64 nt, Human
gaagacgaggcccucgggcccagcccccacagugcugucugaucugugcuuuccagcucacccc

SEQ ID NO: 100486 - RNA, 64 nt, Human
gcuuuuugugauaugcacaauguagauaaguguucugucugacuuucuuuuuugauauagaagu

SEQ ID NO: 100487 - RNA, 64 nt, Human
ugccuguggcauuuguguguuggcuuugcagcugcugucugaguaguggccacuggggugccuu

SEQ ID NO: 100488 - RNA, 64 nt, Human
ccccuuucuguucgaaguucauuuuuaucccuuccugucugaacaaaaacuguauggaaucaac

SEQ ID NO: 100489 - RNA, 64 nt, Human
cggcugguggagggggaaggagggugcgaggugucugucugaugcuuuaggaaaugucuacuga

SEQ ID NO: 100490 - RNA, 64 nt, Human
gguuaaguuugcuugaccccagcagcccgagggacugucugagucacagcacagccccuauugc

SEQ ID NO: 100491 - RNA, 64 nt, Human
uucacucuccucccaaagcaaaccacagccaagccugucugagcugggaguccccuuccccagc

SEQ ID NO: 100492 - RNA, 64 nt, Human
uguugcuaauuugccacaggagcugaaguuaacccugucugagaugcagccagcauuaccacag

SEQ ID NO: 100493 - RNA, 64 nt, Human
agagaggaaugcucuugaaagguggucuguggaucugucugaauagaaagagcacaguaaguau

SEQ ID NO: 100494 - RNA, 64 nt, Human
cggggagcggcggaaagccuguaagccugcaagccugucugagacucacaggaaggaggagccg

SEQ ID NO: 100495 - RNA, 64 nt, Human
accgcagccccagcccagccugccuguccuccagcugucugacuauccauccaucauaaccacc

SEQ ID NO: 100496 - RNA, 64 nt, Human
ucacucucaauucacuggcaaaugccugaauggucugucugaaggaagcaacagagaagugggg

SEQ ID NO: 100497 - RNA, 64 nt, Human
auacacuugugacugaaccaugcccaguuuaugccugucugacugucacucuggcacuaggagg

SEQ ID NO: 100498 - RNA, 64 nt, Human
ggccagaccaccuccggaauccugccaccugugacugucugacugcuuagugcuucagcugucc

SEQ ID NO: 100499 - RNA, 64 nt, Human
ccgcccuucuucaucuuagagaaccaagugccuccugucugaaaggugaggguggccugaccug

SEQ ID NO: 100500 - RNA, 64 nt, Human
aggguuacauuguaauauauaugccccagcuaaccugucugaugguggcaucuuccugcagaca

SEQ ID NO: 100501 - RNA, 64 nt, Human
acagacuacuuccaaaaacaguuugagaaaaaaacugucugauuuuaagucucuagaggucugu

SEQ ID NO: 100502 - RNA, 64 nt, Human
uuguccccuaagaguguuuaauggcaaggcagcccugucugaaggacacuuccugccuaaggga

SEQ ID NO: 100503 - RNA, 64 nt, Human
cagcacuggaguuggccaccaccucuucuacuugcugucugaaaaaacaccugacuaguacagc

SEQ ID NO: 100504 - RNA, 64 nt, Human
uguuuccccaauuccucugugcucuccuagagcucugucugaauccucgcagccacaccuaggu

SEQ ID NO: 100505 - RNA, 64 nt, Human
ggacacgcgccccccucccagaggcgucccgcaccugucugaacuguuaagaaaucuguuuuug

SEQ ID NO: 100506 - RNA, 64 nt, Human
uuuuaaagugucuuuugcagaguuuuaaguuguucugucugaacucugcugugaucccaugaug

SEQ ID NO: 100507 - RNA, 64 nt, Human
ugucaggucagacaguauuauaaacuguacuuugcugucugagacagcacauuugugaaugaug

SEQ ID NO: 100508 - RNA, 64 nt, Human
ugaaguauuauuauaauucaccauaaacagcuaucugucugaauuacuucaggccuucuccaua

SEQ ID NO: 100509 - RNA, 64 nt, Human
ugaaauuuucaccucuugggguauuuuaauuguacugucugaacccagggaucacaaauucugu

SEQ ID NO: 100510 - RNA, 64 nt, Human
aaacaauuuagucugaaacacaauugugcugaaucugucugacuauaacucugaccacacagaa

SEQ ID NO: 100511 - RNA, 64 nt, Human
gaaaaaggaaaaauccaaaauaucucaguaucaucugucugaagcauuguguguucucauucgg

SEQ ID NO: 100512 - RNA, 64 nt, Human
uuaguauuuuugcagaauugugcagccaucaccacugucugauuuuaaaacacuuucauacccc

SEQ ID NO: 100513 - RNA, 64 nt, Human
acccucaauaacuguuuuuuauuuggucuuagggcugucugauacuuagagcugaaggcauucc

SEQ ID NO: 100514 - RNA, 64 nt, Human
agcugagaggccagggacagggugccucgccaagcugucugaggucugucccagguggcccagg

SEQ ID NO: 100515 - RNA, 64 nt, Human
ucucugccacccucauaccagaucugcuucaucccugucugaagaaugcuagcccaucuggcug

SEQ ID NO: 100516 - RNA, 64 nt, Human
ccugggugcuccacugauuggaggauagagccagcugucugacacacaaauggucuuuucagcc

SEQ ID NO: 100517 - RNA, 64 nt, Human
gggggcgugaguggccgugcccugggugugcugccugucugagcaagcuucccuagcuguggaa

SEQ ID NO: 100518 - RNA, 64 nt, Human
caguacaggauggagccaggauuuuuaucugggucugucugacuuuaaaacacauacucuucuc

SEQ ID NO: 100519 - RNA, 64 nt, Human
cggucgacauugaauuuggguggggguugggauccugucugaaguacagacuguucuugcucua

SEQ ID NO: 100520 - RNA, 64 nt, Human
cugcuguguggacggcgcugccucaggcacucuccugucugaaccugcccuuacuguguuuaac

SEQ ID NO: 100521 - RNA, 53 nt, Human
ggggccaugaggccuucugagggcugucugauugccccugcccugcucaccac

SEQ ID NO: 100522 - RNA, 64 nt, Human
aauggagcugcuggagcccgguacccacucagcucugucugaugcccucuccauagcccagcug

SEQ ID NO: 100523 - RNA, 64 nt, Human
cucacgcuuaccucaaccauccuggcugcggcgucugucugaaccacgcgggggccuugaggga

SEQ ID NO: 100524 - RNA, 64 nt, Human
ugguucuguuggucagucagguguuugcucagcccugucugaucaccugugcugcucugucccu

SEQ ID NO: 100525 - RNA, 64 nt, Human
uuagauaugugccaaaguccauuuaucccaaauccugucugaaaaggagggguacauugguaaa

SEQ ID NO: 100526 - RNA, 64 nt, Human
uagguuaucuuaguuguaugacgaacugauaaaucugucugacugggcuacaauccauuguucu

SEQ ID NO: 100527 - RNA, 64 nt, Human
ucaguagccccauugcggggccccaccauucauccugucugaagguccuggguuuggugugacc

SEQ ID NO: 100528 - RNA, 64 nt, Human
uguauagaucccagauccaucccaugauuuguuccugucugaggcauagaggcaggcaagccgu

SEQ ID NO: 100529 - RNA, 64 nt, Human
gaaacugagcugagcccaguauccaaggauuccucugucugauccuuuggucuuugcuaccagg

SEQ ID NO: 100530 - RNA, 64 nt, Human
cucaucaguauccagugguaaaaaggccuccuggcugucugaggcuagguggguugaaagccaa

SEQ ID NO: 100531 - RNA, 64 nt, Human
uauauguggcuuugagaggcaacuuugccccugucugucugauuugcugaacuuucucaguccu

SEQ ID NO: 100532 - RNA, 64 nt, Human
guuucuguuuccagucuguggugaugcugucugucugucugagucucguggccgccccuggacc

SEQ ID NO: 100533 - RNA, 64 nt, Human
gagguccuccucgcucuggccgcucuugcugcuccugucugaagaaaucagacugauuuccucu

SEQ ID NO: 100534 - RNA, 64 nt, Human
ccccgguugggagcaggcuccugggggugagggucugucugagucuguuuuugcugcucuagca

SEQ ID NO: 100535 - RNA, 64 nt, Human
gguugugguucugauugcaaacaaacagugaacacugucugaauuaaacaaaaagcugcccgac

SEQ ID NO: 100536 - RNA, 64 nt, Human
ugagggaauuauuuuauucuagccugucaugagucugucugagcaugauacuuaacaugaacuu

SEQ ID NO: 100537 - RNA, 64 nt, Human
gccuuuccaccacucccacuuaaucccugauucacugucugauuugggcuuucugcuuuacuuc

SEQ ID NO: 100538 - RNA, 64 nt, Human
gagcccuccaccccuggcccaagacccccccaaacugucugacucuguguuuccugcccugagg

SEQ ID NO: 100539 - RNA, 64 nt, Human
cacacauucacaggauaacugcauagaucccucgcugucugauucacuucuuaccaugcacuuu

SEQ ID NO: 100540 - RNA, 64 nt, Human
cuggggccaggucucuucuccagccuccaccugccugucugauccaagagcugagacacggcca

SEQ ID NO: 100541 - RNA, 64 nt, Human
aagagugucaaguuggacucuuugaacucuguugcugucugagcaaucguggugccuagacuuu

SEQ ID NO: 100542 - RNA, 64 nt, Human
agcuuuaaaucuuuaaauguauugaagcauugugcugucugaaaauaaggaauugcuuauaaac

SEQ ID NO: 100543 - RNA, 64 nt, Human
agggaggcaucugcaugggucuucuuuuacuggacugucugaucaggguggagggaaggugaga

SEQ ID NO: 100544 - RNA, 64 nt, Human
gcccccugccccccacaccacaccuguaggggaccugucugacugggaagggaguuccgagagg

SEQ ID NO: 100545 - RNA, 64 nt, Human
uuuccucgucaaacaucugauugacgcuugcaaacugucugaauuugccaugcaagguuuucaa

SEQ ID NO: 100546 - RNA, 64 nt, Human
cuccauuuugccuuguuuguuaguuugccugggucugucugaggaaggagggggucccgccuuc

SEQ ID NO: 100547 - RNA, 64 nt, Human
uccuguaguauauuccccuuugaaccacccuuuccugucugaauucuacuuugccuccuuucuc

SEQ ID NO: 100548 - RNA, 64 nt, Human
auaacaaaugacaaauuauauaucaugaauccuucugucugacuaacucaauaacuuucuauaa

SEQ ID NO: 100549 - RNA, 64 nt, Human
cuaaacuuuaggcuaauaaucuuuacuauugaaucugucugauauagaucuuaggguugaagaa

SEQ ID NO: 100550 - RNA, 64 nt, Human
agcacuuugaaaaauauauaaggaauuguugagccugucugaauuugggcccccuuucugacua

SEQ ID NO: 100551 - RNA, 64 nt, Human
ugccaaggugaggggcuggggcauggcauuaacacugucugacacagccagccagucugacauc

SEQ ID NO: 100552 - RNA, 64 nt, Human
gcugguuuguucugugcuuaggccaaguuagcuacugucugagagguuuuacauccccugccag

SEQ ID NO: 100553 - RNA, 64 nt, Human
gggaguuggagauuugaagccagucaucucagcacugucugaggagggcagagccauggguucu

SEQ ID NO: 100554 - RNA, 64 nt, Human
ucaacuuguaaauuguuaaaagaauuugaagucacugucugaggagcuggugaagaguuguuuu

SEQ ID NO: 100555 - RNA, 64 nt, Human
cgaaugaccaaggcuuguuccagggaauaaugcucugucugaaagcguuuuuccaaaaaaagaa

SEQ ID NO: 100556 - RNA, 64 nt, Human
gguguuaaagcuguacaccccaggacaguuuauccugucugaggaguaaguguacaauugaucu

SEQ ID NO: 100557 - RNA, 64 nt, Human
gaaacccuguuucuaacccuuguguuguguguuucugucugaggacaguggguguguacuggcc

SEQ ID NO: 100558 - RNA, 64 nt, Human
ggagaaggggaaguauguuuuggggggcugcuuccugucugaguaagcccucaggagccucugc

SEQ ID NO: 100559 - RNA, 64 nt, Human
cccagagccagccuuaguuugucccugccaucuacugucugaggccaucgcugcuacacuuugu

SEQ ID NO: 100560 - RNA, 64 nt, Human
auggcccuagagugggaguccugauaacccaggccugucugacuacuuugccuucuuuuguagc

SEQ ID NO: 100561 - RNA, 64 nt, Human
cuucuguauuaaugaagccugguaaaauuaacaccugucugaaaaucaaaaacauggcuuccca

SEQ ID NO: 100562 - RNA, 64 nt, Human
gaauguuccuuuuagaaguguguuaugucuguaccugucugaagagugacauuaaacuuugaaa

SEQ ID NO: 100563 - RNA, 64 nt, Human
ucaggaccgucccacaccuuuuacuugcucagugcugucugaagaugcaguugcuguuugcaaa

SEQ ID NO: 100564 - RNA, 64 nt, Human
ggucagaguguuuuuucugucuuugggccaaguccugucugagaccuguauuuucacucuuguu

SEQ ID NO: 100565 - RNA, 64 nt, Human
uucuaguggcuacuuaauuagacauuauuugaagcugucugaagaaugcacuuuaugaauuaaa

SEQ ID NO: 100566 - RNA, 64 nt, Human
gguuguacagauugaaauuuaguuguuucauuggcugucugaggagguguggacuuuuauauau

SEQ ID NO: 100567 - RNA, 64 nt, Human
uuuucuuuuccuuuucaacaaucuccuaauaaaacugucugaaaucucccugugacuuuauuua

SEQ ID NO: 100568 - RNA, 64 nt, Human
aucacuuccccagcccagagaagacauuccaacccugucugauacccaggcccguuucucaccu

SEQ ID NO: 100569 - RNA, 64 nt, Human
ccucccugccagccagaagcauccguacugcacgcugucugagaaugcugggccuggauugcag

SEQ ID NO: 100570 - RNA, 64 nt, Human
ucuauguuaaaaauacguacugcuugaguauccccugucugaaaugcuugggaccagaaguguu

SEQ ID NO: 100571 - RNA, 64 nt, Human
aaauggauuaaagaaucuaaaaccagugggaaaacugucugauuucuggauggcaaaggcuuuc

SEQ ID NO: 100572 - RNA, 64 nt, Human
acauggaggugggcaggcucaccuguuccugggacugucugagauggcagggcacuugcccugg

SEQ ID NO: 100573 - RNA, 64 nt, Human
uggccuucuucuaaggacuaggagagcuccuuaucugucugagaauggggaccagcucugagug

SEQ ID NO: 100574 - RNA, 64 nt, Human
gucagagacaaaauuccacugucuguuccuuuugcugucugaacuuuauguguuacucccuucc

SEQ ID NO: 100575 - RNA, 64 nt, Human
ccugacaccugugcugucccugcagucucuaggccugucugagcugcucccgugaccguguccu

SEQ ID NO: 100576 - RNA, 64 nt, Human
caguguaagagaccacccacccagagccucagcacugucugacuuugggaaccagggaucccac

SEQ ID NO: 100577 - RNA, 64 nt, Human
gucaguaaaacucucaagcagguuuuuaaguugucugucugaaugaucuuguguaagguuuugg

SEQ ID NO: 100578 - RNA, 64 nt, Human
ugaauaaaacaacaauauuguaucuuaaucaaggcugucugaugcagaugauugcauuuuuugg

SEQ ID NO: 100579 - RNA, 64 nt, Human
ugacuggugagaauuuggucaaggugacagccuccugucugaugacaggacagacuggugguga

SEQ ID NO: 100580 - RNA, 64 nt, Human
ugccaucuccaaauagagaugguuuuacuucuuccugucugaucugaaugccuuuuauuuauuu

SEQ ID NO: 100581 - RNA, 64 nt, Human
cuuuuauuacacacucugagagugucuccaaugccugucugacaaagacagucccagcccauuc

SEQ ID NO: 100582 - RNA, 64 nt, Human
caugucccgggccccauugcuuccaugccuggugcugucugaguauccccagagcaagagagac

SEQ ID NO: 100583 - RNA, 64 nt, Human
ucccuccaaaccucccagccacucgggcuuguaacugucugagccccggauccgguggggugaa

SEQ ID NO: 100584 - RNA, 64 nt, Human
gcgcugggaggggcaaaaccauacggaugcgcugcugucugagaggaagggcugacacuugcug

SEQ ID NO: 100585 - RNA, 64 nt, Human
cuuggggucaggaugccugggucucuucccguaacugucugacguccugugccgucuuguccuu

SEQ ID NO: 100586 - RNA, 64 nt, Human
gacagggacaugcccuguguggcugggacccagacugucugaccuggggguugccuggggaccu

SEQ ID NO: 100587 - RNA, 64 nt, Human
auguuagaaaaaaaugugauuuaacuagaacuugcugucugauguuagcaaaucauggaauguu

SEQ ID NO: 100588 - RNA, 64 nt, Human
aggcugacuugccugaacgcuaagaacaugacuucugucugagcuaagcuggcacccaucccag

SEQ ID NO: 100589 - RNA, 64 nt, Human
aaauacauagggaucagaaacuuuuucauauaaccugucugaaagcacacaaagucuuguuuac

SEQ ID NO: 100590 - RNA, 64 nt, Human
cccccgcaccaagcagacaaagucaauaaaagagcugucugacugcaaucugugccucuauguc

SEQ ID NO: 100591 - RNA, 64 nt, Human
gggggagcuccguccgggcaguuggcugcugguccugucugauuauguuuugccauauugaguc

SEQ ID NO: 100592 - RNA, 64 nt, Human
gcacaguucauuucacugggauuuugaagcauuucugucugaacacaaagccuguucuaguccu

SEQ ID NO: 100593 - RNA, 64 nt, Human
aggucugggacgugugugugacucuuaacaauugcugucugaaaaugagagagaagacuucgga

SEQ ID NO: 100594 - RNA, 64 nt, Human
cccauuuggaauauagaauuaggaugggaaaacacugucugauucugcacacaaaaguggguuu

SEQ ID NO: 100595 - RNA, 64 nt, Human
ugguucugucugcuuccacagucugcuuaaaaaacugucugacuucgugaauauagagaccaag

SEQ ID NO: 100596 - RNA, 64 nt, Human
ccguaagaaggcugaccagccacgcccaccuccucugucugacugaguuccuuccuguggccac

SEQ ID NO: 100597 - RNA, 64 nt, Human
cuggcgcuaggacgugcguccuugugacacuggccugucugaacucaccuggccugggaagcac

SEQ ID NO: 100598 - RNA, 64 nt, Human
accuggaaucagauuugcaaaauuuccugcacugcugucugacacuguccuguugaugcccuuu

SEQ ID NO: 100599 - RNA, 64 nt, Human
guagaaacaauuguauuuugaagucucauacaagcugucugauagagaacuuucaggcagaucc

SEQ ID NO: 100600 - RNA, 64 nt, Human
acuaagguuaaaagcuauauuguggcccaagacacugucugaaagaugacaugaguaguaauuc

SEQ ID NO: 100601 - RNA, 64 nt, Human
ugagaagugaggagaccuccgcccggcagccgcccugucugagaagugaggagccccuccgccc

SEQ ID NO: 100602 - RNA, 64 nt, Human
ggggggcccagaggccgccuuuugaaauguuugccugucugaacugugaagacacuugggagug

SEQ ID NO: 100603 - RNA, 64 nt, Human
ucaaagcaauagccagcuuucgacacauaccuggcugucugaggaggaaggccuccuggaaacu

SEQ ID NO: 100604 - RNA, 64 nt, Human
accccuccgcuggacucacaacugucuggaguuucugucugauggauggugugcuuucauaugc

SEQ ID NO: 100605 - RNA, 64 nt, Human
aggcuggcuuuggaauagauggacaguuuguuuccugucugauagcaccacacgcaaaccaacc

SEQ ID NO: 100606 - RNA, 64 nt, Human
ggccccuagaauugagucacccccuagauaccaacugucugaccccgaggagcucuguaagucc

SEQ ID NO: 100607 - RNA, 64 nt, Human
uuaccauuaggaggagguagauuguuucgucuuccugucugauuuuuguuuuguaguauuuaau

SEQ ID NO: 100608 - RNA, 64 nt, Human
uggcucagccccagcucccaaggccugccuggcucugucugaacagaaggucugggggaagcga

SEQ ID NO: 100609 - RNA, 64 nt, Human
ggaguugucaagucucugcuggcccagccaaacccugucugacaaccucuuggugaaccuuagu

SEQ ID NO: 100610 - RNA, 64 nt, Human
ugcguaaucaggacuugcaacacccugauugcuccugucugauucuuucugacgaucacuuaca

SEQ ID NO: 100611 - RNA, 64 nt, Human
ucuugcggaaacgcgaaugaggcgcccagacggucugucugaggcucugagcguacauagggaa

SEQ ID NO: 100612 - RNA, 64 nt, Human
cgaaagcccaguccacucuucgccucgguaauaccugucugaugccacagauuuuauuuauucu

SEQ ID NO: 100613 - RNA, 64 nt, Human
aguuuaugacaaaggaagugaagaacagacuucacugucugagauuucccacauuucuuggguu

SEQ ID NO: 100614 - RNA, 64 nt, Human
gcguguuugcacguuaugguguuucucccucucacugucugagaguuuaguuguagcagagggg

SEQ ID NO: 100615 - RNA, 64 nt, Human
uugauuaccggccuagccccugcucacaucacagcugucugaagaacagugagguggagugccu

SEQ ID NO: 100616 - RNA, 64 nt, Human
gccuuuccaagucaguggcuguuguucugucuugcugucugauacgagaguggggcuuuucagu

SEQ ID NO: 100617 - RNA, 64 nt, Human
uugugaguccuguuugcugaaaaaagcucuggggcugucugaggcucuggaaugcucucuggag

SEQ ID NO: 100618 - RNA, 64 nt, Human
uguuugcaaaacccaguggacugggcugggucugcugucugagcagcuccuggcuccgguggga

SEQ ID NO: 100619 - RNA, 64 nt, Human
uuggauacgcaccccccaacucccaauacuggcucugucugaguaagaaacagaauccucugga

SEQ ID NO: 100620 - RNA, 64 nt, Human
agucacaggucacacgaggggccccguguccugccugucugaagccaaugcugucugguugcgc

SEQ ID NO: 100621 - RNA, 64 nt, Human
ugccccgguccagcccugauggcgcgcgccuggucugucugauuccccuagccgccaccccacg

SEQ ID NO: 100622 - RNA, 64 nt, Human
gauacagagaaccucucaauaaaugauuugucgccugucugacugauuuacccuaggauaaaga

SEQ ID NO: 100623 - RNA, 64 nt, Human
uaauggaaaguugagccagaacuaaaccagggagcugucugaaaucauagcaccccauccgggu

SEQ ID NO: 100624 - RNA, 64 nt, Human
cagaaugcaauugagaaaucguuuauuuuaguaacugucugaucuuuuucaacuuuggagaugg

SEQ ID NO: 100625 - RNA, 64 nt, Human
guauuuauuuaaaacucuggugauaaaaauaaagcugucugaacuguucccugugguguccagg

SEQ ID NO: 100626 - RNA, 64 nt, Human
agggggcaaagggcacgucccaucacucacugcccugucugaaauguggcagccacugugggcc

SEQ ID NO: 100627 - RNA, 64 nt, Human
ccuuacccgugguauuugaaaaaaaucaagguaacugucugaauacuuuaauaucagcuuguuu

SEQ ID NO: 100628 - RNA, 64 nt, Human
ugcugcacuccagccugcgggacagagugagacccugucugaaagaaagagagaaagaaagaaa

SEQ ID NO: 100629 - RNA, 64 nt, Human
cccuuaagcgguggacuccagcauuuucccagcacugucugagccccaugagggcggagccacu

SEQ ID NO: 100630 - RNA, 64 nt, Human
guacucuugaauacaaguuucugauaccacugcacugucugagaauuuccaaaacuuuaaugaa

SEQ ID NO: 100631 - RNA, 64 nt, Human
aacacacacucaacugcccacuucauucugugaccugucugaggcccacccugcagcugcccug

SEQ ID NO: 100632 - RNA, 64 nt, Human
gcaaucaaagccacaaugagauaccaucucagaccugucugaauggguauuaucagaaugggua

SEQ ID NO: 100633 - RNA, 64 nt, Human
cugggguacccgauucaaagaaggacucugcucccugucugagaccacccccggcucugacuga

SEQ ID NO: 100634 - RNA, 64 nt, Human
ggagaccauguggccugcagagcccaaauaucuacugucugauccuacacagaaaaugugugug

SEQ ID NO: 100635 - RNA, 64 nt, Human
uuuugcuuuuccacccccgugcaacccaggacggcugucugaggccgggagaugccuuagacgc

SEQ ID NO: 100636 - RNA, 64 nt, Human
cucugcugggucuugggguguguggauggauuggcugucugaugggauugguaaccccucgcua

SEQ ID NO: 100637 - RNA, 64 nt, Human
aaacaaaacaaaaccaaguucccacuggugaugccugucugacacguuuugguauuuaguagga

SEQ ID NO: 100638 - RNA, 64 nt, Human
agacaaaauuuuccuaaaaacaugagaguccaggcugucugagucagcacaguaagaaaguccu

SEQ ID NO: 100639 - RNA, 64 nt, Human
gggagaguuggagagaagggggacguuucuggaacugucugaauauucuagaacuagcaaaaca

SEQ ID NO: 100640 - RNA, 64 nt, Human
aggaauugcauaugagauggcacacauauucaugcugucugaagauucagucacguuaccauau

SEQ ID NO: 100641 - RNA, 64 nt, Human
cguucggccagugucugucugucugucugccucucugucugagggcacccuccauuugggaugg

SEQ ID NO: 100642 - RNA, 64 nt, Human
gccauccaagggucuccagugagguggcugcuugcugucugagaugaggguuccuaaaccuuaa

SEQ ID NO: 100643 - RNA, 64 nt, Human
gaugcucacaguuuuauuuuacuuuaaaauaaaccugucugacuguagcuuugugaaauaucuu

SEQ ID NO: 100644 - RNA, 64 nt, Human
ucgaaugcugcauuuuuauaaacaaaauuacagacugucugaaauugaagaagaaugaacuaau

SEQ ID NO: 100645 - RNA, 64 nt, Human
cugcaacuggggcgugggccgcucucugcuuuuccugucugacucugacaaguccucccucacu

SEQ ID NO: 100646 - RNA, 64 nt, Human
cacaaggccugucguggccuccugguucacucugcugucugaucuugggagggugggcuugaga

SEQ ID NO: 100647 - RNA, 64 nt, Human
cauaagaacaucaacaggaaugccgcccucucuacugucugaaccccuugucccugucaaauaa

SEQ ID NO: 100648 - RNA, 64 nt, Human
cauaagaaaauuuaacaguugugucauguuguuucugucugauuuuaauugcugucuaaugacg

SEQ ID NO: 100649 - RNA, 64 nt, Human
guagccacgccagagcggggucgccucugggccucugucugagcaaaccugggugugaauucgg

SEQ ID NO: 100650 - RNA, 64 nt, Human
gggguguggggugggguggagucgcagaccagagcugucugaacucaugugucagaagccucca

SEQ ID NO: 100651 - RNA, 64 nt, Human
guguuuccauaaguaagauuacguaccugauuuccugucugagaacuaugguaacagauguuaa

SEQ ID NO: 100652 - RNA, 64 nt, Human
cucauggguggauauggauucuaaggauucuagccugucugaaccaauacaaaauuucacagau

SEQ ID NO: 100653 - RNA, 64 nt, Human
ggccagcagggccccaucucuaguuuuuccacgucugucugaaguucuugcaacaaauucugca

SEQ ID NO: 100654 - RNA, 64 nt, Human
aacauggagccuugccuggccugggcuaggggcacugucugaacuccugacugucaggauaaac

SEQ ID NO: 100655 - RNA, 64 nt, Human
ugaucagcagcaaagcugacguuuugaucuccaucugucugauucuugugucuacuucucaguu

SEQ ID NO: 100656 - RNA, 64 nt, Human
ccacagacagugcaaagacucuccugcuuuuuuucugucugagugugagcuccauccgccuggg

SEQ ID NO: 100657 - RNA, 64 nt, Human
cacaugcccgcuccaucaucgaucuaggcaccugcugucugaagggaccgugggucagaaucau

SEQ ID NO: 100658 - RNA, 64 nt, Human
aauugguggaugguggaaggcaggacacguaucucugucugacggaaaacagaccucggggcug

SEQ ID NO: 100659 - RNA, 64 nt, Human
ggagggauagagguacaaggcuucgucucaucugcugucugagcauccaggcccaaaggcacug

SEQ ID NO: 100660 - RNA, 64 nt, Human
uaacugcugagcagucccccuuugccacuccuggcugucugagugggcacuugucuggcugcug

SEQ ID NO: 100661 - RNA, 64 nt, Human
uguaaaagugaaaaaaugaugaagacgggugcaccugucugaguuuggcccucaugugagcugu

SEQ ID NO: 100662 - RNA, 64 nt, Human
gagacuggcugagaacuuacggacaacauccuuucugucugaaacaaacagucacaagcaaagg

SEQ ID NO: 100663 - RNA, 64 nt, Human
uuuccaugcaaagacgcugggcaaaccacauguucugucugagccucaguuuuccuauccauaa

SEQ ID NO: 100664 - RNA, 64 nt, Human
auuggcuguggaggagagacuccuaggauggcugcugucugagccaugagugccagggcugaga

SEQ ID NO: 100665 - RNA, 64 nt, Human
uggcagagacauccagucaggaccugacccgucucugucugaggccggcucagcagugcagccu

SEQ ID NO: 100666 - RNA, 64 nt, Human
ucuuuccagaccagcggggcagcaccugggaggccugucugaagcaugcaguucuguggugcug

SEQ ID NO: 100667 - RNA, 64 nt, Human
aacaauagcuagguaagauuuuuaucagcuuucucugucugaauccaguuuuuccucugucagu

SEQ ID NO: 100668 - RNA, 64 nt, Human
uuucaacuugauugaugggaugucaucccuuauccugucugacauuugccucuggccugguugc

SEQ ID NO: 100669 - RNA, 64 nt, Human
cucccuuuggaucaacccagccuggcacccuugccugucugagagugucucaaagggcugaugg

SEQ ID NO: 100670 - RNA, 64 nt, Human
cuuucuuguggccccaugggaugcagcgugggggcugucugaaggacccugcuuuuuccagggg

SEQ ID NO: 100671 - RNA, 64 nt, Human
accauagggcuuccuauccugggcucagcugccccugucugaagggucuuggcuugauugcaga

SEQ ID NO: 100672 - RNA, 64 nt, Human
gugaugcaaaugcucaaaaccucuuaaaucauagcugucugaccucuacggaccucacauccau

SEQ ID NO: 100673 - RNA, 64 nt, Human
ugcagucgagccugggcgacacaaagagaccacccugucugauagauaacuaacaaaauaguuu

SEQ ID NO: 100674 - RNA, 64 nt, Human
acagugaaagagcuaucccgucuucccuuuacaacugucugaacuuuauuuacucauuagucaa

SEQ ID NO: 100675 - RNA, 64 nt, Human
guacccauauauaucucuuucuggaguauuuuaucugucugauguugcaguauucuacaaguuu

SEQ ID NO: 100676 - RNA, 64 nt, Human
cucuaacauauuaaucauaguuauuuuuaacucccugucugauaguuccaacuacuaggucaac

SEQ ID NO: 100677 - RNA, 64 nt, Human
aacaaaaggcugcaggcacaugguuagacugccgcugucugaaggaccauaucuuacagaaggu

SEQ ID NO: 100678 - RNA, 64 nt, Human
gaacuccugucuucuuucuccauggagccuaccucugucugagacaggugccuaaccugggacc

SEQ ID NO: 100679 - RNA, 64 nt, Human
aaaaagaauucuuuuuacaggaggcagcagaaaacugucugaaaggucaauuguuuuaucuccc

SEQ ID NO: 100680 - RNA, 64 nt, Human
cauaaccagcagugaguagaucuucuuaauauagcugucugaccacauguggaaggcagcuaga

SEQ ID NO: 100681 - RNA, 64 nt, Human
auuuuucuguuggucuuaacuaauguaaauauugcugucugaaaaaguguuuuuacauauagcu

SEQ ID NO: 100682 - RNA, 64 nt, Human
uuaacuuuggauuuuuagugguuuugucauauaacugucugaguuugguagguaggauuacuuu

SEQ ID NO: 100683 - RNA, 64 nt, Human
ucugugucuucugccuccucugaggaaucuggcccugucugacagucccagaccccccguucuc

SEQ ID NO: 100684 - RNA, 64 nt, Human
agacaucuccccuuaugacaacaacuccccagugcugucugagcgcucccugcuggcuaugcaa

SEQ ID NO: 100685 - RNA, 64 nt, Human
uauauauauauauuauauauaaauaucuauuuaucugucugagcccugcccucacuccacuccc

SEQ ID NO: 100686 - RNA, 64 nt, Human
uccuuagagguuguauucuuuauucuccaagaaucugucugaaacuuguacagcuaguuccugu

SEQ ID NO: 100687 - RNA, 64 nt, Human
aggaauugcacaugagauggcacacauauuuaugcugucugaaggucacgaucauguuaccaua

SEQ ID NO: 100688 - RNA, 64 nt, Human
ggucgagauuucaaacccaauuauguacagggagcugucugagagcuagccagaacugggguac

SEQ ID NO: 100689 - RNA, 63 nt, Human
cgagaauuaggcgcccaccguguccccuccagcgcgcgcgaagaagcuugggagucguggcgg

SEQ ID NO: 100690 - RNA, 63 nt, Human
ccaauggcaauaaaggcacugacgauagcuggcgcgcgcgacgucacacaccauuuucagaug

SEQ ID NO: 100691 - RNA, 63 nt, Human
agagcugggucccgggagauggaagccucccaggcgcgcgaggcuucccgggcgcucugaggc

SEQ ID NO: 100692 - RNA, 56 nt, Human
gccuuacgcugaaaggcugaaguggggcgcgcgaagggcggcgaagcggagacggc

SEQ ID NO: 100693 - RNA, 63 nt, Human
cggccccagcuuuccgccugcacccgcgaggacgcgcgcgagcacacgcggcgccccgccagg

SEQ ID NO: 100694 - RNA, 63 nt, Human
ccgccgcacgcacgcgcgccugcgugcggggaugcgcgcgagugugugcgugcucgcgugugu

SEQ ID NO: 100695 - RNA, 63 nt, Human
acugacagccuuugauggaggaacccaagaaaggcgcgcgacaaugguagaagugagagcuuu

SEQ ID NO: 100696 - RNA, 63 nt, Human
ggccacgucuccuugagaaccaauaccaaacgagcgcgcgaaccuugaaaugucacgggcuuc

SEQ ID NO: 100697 - RNA, 64 nt, Human
caacacauuuuuaaaugacuaacuucuaaaagccccaacacaugacgccaucugaagacccgca

SEQ ID NO: 100698 - RNA, 64 nt, Human
cuccguggcugccuccaugggacaaggaccgauuccaacacaggcuccucuuucccccuucccg

SEQ ID NO: 100699 - RNA, 64 nt, Human
uugaaagugaacugcuguuugccugauugguaaaccaacacacuacaauugauaucaaaagguu

SEQ ID NO: 100700 - RNA, 64 nt, Human
guccugaguggugagcaucuuagcuuagcaccaaccaacacagucucaccuagaaaacagaugg

SEQ ID NO: 100701 - RNA, 64 nt, Human
ucuagggaucuggccacagacucccuccugugaaccaacacagacacccaagcagagcaaucag

SEQ ID NO: 100702 - RNA, 64 nt, Human
gacugagggccugagcuggcaaggccaaggacacccaacacaauuuuugccauacagccccagg

SEQ ID NO: 100703 - RNA, 64 nt, Human
gccccacagguguguuucccaucccacugcucccccaacacaaacccccacuccagcuccuucg

SEQ ID NO: 100704 - RNA, 64 nt, Human
aucagaaaugcacacaacagaaccauaggcaacaccaacacaggaagaaauagaagucaccuau

SEQ ID NO: 100705 - RNA, 64 nt, Human
aggauuucuggauuuauacguaaucacuccugccccaacacacacacacacacacacacacaca

SEQ ID NO: 100706 - RNA, 64 nt, Human
auccuugguuuuguugcuacauuauuuuuccagaccaacacaucuaccaaguaaauuuuauuca

SEQ ID NO: 100707 - RNA, 64 nt, Human
ccucaccuugagaguaaagugcugcccucugcccccaacacacacacauaucaauuccuggauu

SEQ ID NO: 100708 - RNA, 64 nt, Human
agcuuuucuugacucacagcccagguucuucugcccaacacaaaaggagugaguuggggucuuu

SEQ ID NO: 100709 - RNA, 64 nt, Human
gaucuccauuacuuuauuuuccuggagguauuagccaacacaguuagaucagagaaagcaauug

SEQ ID NO: 100710 - RNA, 64 nt, Human
cagccuccugaguagcugggauuacaggugugcaccaacacacccggcuaauuuuuguauuugu

SEQ ID NO: 100711 - RNA, 64 nt, Human
aguaauuuaaaaaauauauuugaaaugaaaaucuccaacacauuagaagaugaugauguuagau

SEQ ID NO: 100712 - RNA, 64 nt, Human
ucuucgcccacgggaggcuggacagaggcuguagccaacacaaucaccuuuacuuuguacucug

SEQ ID NO: 100713 - RNA, 64 nt, Human
aagaacaccauccuacauaauacccaggauucccccaacacacguucuuuucuaaaugccaaug

SEQ ID NO: 100714 - RNA, 64 nt, Human
aagccaagcaggggagacuagagagcaccaauggccaacacagcugccuggcuggggaggcugu

SEQ ID NO: 100715 - RNA, 64 nt, Human
acgaacuucucuucuccacccagagauggcuuuuccaacacauuuuaauuaaaggaacugagua

SEQ ID NO: 100716 - RNA, 64 nt, Human
uugagccauucagggguacuugugcauuuaaaaaccaacacaaaaagauguaaauacuuaacac

SEQ ID NO: 100717 - RNA, 64 nt, Human
acagguuuccucuuuccuuauuuccucagcugugccaacacaaaaaacaacuuuggcacaggug

SEQ ID NO: 100718 - RNA, 64 nt, Human
aucaccugaagucaggaguucaagaccauccuggccaacacagugaaaccccaucuguacuaaa

SEQ ID NO: 100719 - RNA, 64 nt, Human
gggagguagagcacugaugggugaaaaagugaggccaacacacagggcaaguggugucgaugga

SEQ ID NO: 100720 - RNA, 64 nt, Human
auacacuaauuuucaguauauuacuguuaaauuaccaacacaaggcaauuuauuugaaagauuc

SEQ ID NO: 100721 - RNA, 64 nt, Human
caaaaucaucuuugugaaggccucgcaggaagacccaacacaugggaccuauaacugcccagcg

SEQ ID NO: 100722 - RNA, 64 nt, Human
ucuuagaguuaaaggagggggugcuggccaagagccaacacauucuuggcccaggagcauugcu

SEQ ID NO: 100723 - RNA, 64 nt, Human
acccagagacucagaggggaagagggugcuaguaccaacacagggaaaacggaugggaccuggg

SEQ ID NO: 100724 - RNA, 64 nt, Human
ucauaauuucgcaacuguccuuuuggguugcccuccaacacauuacuuccauuucagaaaccau

SEQ ID NO: 100725 - RNA, 64 nt, Human
guggccucuucuaguacaaggcgaguggauaauuccaacacaagacuggcaguccaaauugaaa

SEQ ID NO: 100726 - RNA, 64 nt, Human
gugaaaaaauuaaaaacucaaauuagagagaaacccaacacauguaaggaagauuagaauguau

SEQ ID NO: 100727 - RNA, 56 nt, Human
agugccucaagcuggccuagcugccuccaacacacuacgucagaaggacccggguc

SEQ ID NO: 100728 - RNA, 64 nt, Human
aaauauuaacaguaaaacauaaacacaaaauuugccaacacacuaauuuucuuauagaguaaau

SEQ ID NO: 100729 - RNA, 64 nt, Human
ucaaugauucuguucgacuaaauagcuguccuuuccaacacauugcuacuuuuuuaaauacugu

SEQ ID NO: 100730 - RNA, 64 nt, Human
agccuuuacaccaccaaucaaaacucuagguacaccaacacaaccuggaaguacuccuaggauu

SEQ ID NO: 100731 - RNA, 64 nt, Human
ucaaaacuaucucaucugucagauuuuuaaaacuccaacacagguuuuggcaucuuuugugcug

SEQ ID NO: 100732 - RNA, 64 nt, Human
aaccugacuuuagauguuuugggaucaggagcccccaacacaggcaaguccaccccauaauaac

SEQ ID NO: 100733 - RNA, 64 nt, Human
ugcugggaugacaggcaugagccaccgcacccggccaacacagauguuuauugaucguggagga

SEQ ID NO: 100734 - RNA, 64 nt, Human
aggaguacuacagcaucaaggcacaacacaaaaaccaacacaaaacauaacacaaaaaagaagc

SEQ ID NO: 100735 - RNA, 64 nt, Human
uuuaaugggccaccuccccacaacagaauucugcccaacacaggagauuucuauaguuauuguu

SEQ ID NO: 100736 - RNA, 64 nt, Human
cuacauggugcacccggaccuguacccccuccccccaacacaaaaccagugucugggagguuca

SEQ ID NO: 100737 - RNA, 62 nt, Human
uuaaaaaagccaccaacugaucaucugagaaaccaacacauuuuuuccugugaauuuguuaa

SEQ ID NO: 100738 - RNA, 64 nt, Human
gguccuaugugucacauucaucacagguuucauaccaacacaggcuucagcacuuccuuuggug

SEQ ID NO: 100739 - RNA, 64 nt, Human
uuauggugacuucccuuugcaaaccaggcugugaccaacacaugugagacccaguccuguuugg

SEQ ID NO: 100740 - RNA, 64 nt, Human
uucucaagcuccagauuggcuagauuucagaucgccaacacauucgccacugggcaacuacccu

SEQ ID NO: 100741 - RNA, 64 nt, Human
gagggcagauucaagagccagcaggucaaaaaggccaacacaaccauaagcagccagacccaca

SEQ ID NO: 100742 - RNA, 64 nt, Human
cccaggcggugcaaacaauccacuucuucaagcuccaacacaaaugcugccuccuuuaggaugc

SEQ ID NO: 100743 - RNA, 64 nt, Human
cugcuguucuucaugugcuucuaugagauuuacuccaacacaaauaggacugaauuuauuguga

SEQ ID NO: 100744 - RNA, 64 nt, Human
ucauaauaaaaaaguuuuaaaaguccuccaguuuccaacacacucaagagagagccccaacccc

SEQ ID NO: 100745 - RNA, 64 nt, Human
gccaaaccuggugguccugggcggccccgagaccccaacacaugcuucuucgaggggcagcagc

SEQ ID NO: 100746 - RNA, 64 nt, Human
caucuuaaaaauauugucauguuuauucuaauauccaacacaacuaucaaaauugccuuuuucu

SEQ ID NO: 100747 - RNA, 64 nt, Human
cagugugaauucugacugcaauaggcaccagugcccaacacauacagccccaccaucauccccu

SEQ ID NO: 100748 - RNA, 64 nt, Human
uaaugggcccagcagugccucuggagcccaggccccaacacagccccauggccucugccagaug

SEQ ID NO: 100749 - RNA, 64 nt, Human
gccuucucuggugacagaggcucagcuguggccaccaacacacaaccacacacacacaaccaca

SEQ ID NO: 100750 - RNA, 64 nt, Human
auccgcccaccaugucccccugcugggucaggagccaacacaggacccugcgugugagcgugcc

SEQ ID NO: 100751 - RNA, 64 nt, Human
uacucuacagaagaggaccucaaggaucaauaauccaacacauuauuuucuuuucagaguauua

SEQ ID NO: 100752 - RNA, 64 nt, Human
acacauugccuuauucauacuagcaugcucaugaccaacacauacacgucauagaagaaaauag

SEQ ID NO: 100753 - RNA, 64 nt, Human
gacagaaggccuugaagaauuuguucuuguaaauccaacacaaguuguuugguacuuuuaacau

SEQ ID NO: 100754 - RNA, 64 nt, Human
guuccaguuucucuuccauucugugucacagacaccaacacaccacucauuggaaaauggaaaa

SEQ ID NO: 100755 - RNA, 64 nt, Human
cagccucccaaagugcugggauuacaggcaaaagccaacacacccggccuggauaugaauuuau

SEQ ID NO: 100756 - RNA, 64 nt, Human
agcucugcaggauugcaugggguaaaacuuguuaccaacacaugugaaccauugcuacauugua

SEQ ID NO: 100757 - RNA, 64 nt, Human
uuuguucuuccuuccugccuuaguggaacaaaaaccaacacauaguuuuaagcuacaccuuucu

SEQ ID NO: 100758 - RNA, 64 nt, Human
uccucaggcugguagcaaguucuggaucuuauacccaacacacagcaacauccagaaauaaaga

SEQ ID NO: 100759 - RNA, 64 nt, Human
aaccagagaaugacaugaauccagcaaauaggauccaacacaggcaauauuccagcuauggagc

SEQ ID NO: 100760 - RNA, 64 nt, Human
uuucuggacuuuucuuuuagccauauaucauaaaccaacacaguaauugccuuacaugacuuga

SEQ ID NO: 100761 - RNA, 64 nt, Human
aucacuugaggcaaggaguuugagaccagacuggccaacacagcgagacccccaucucuaaaaa

SEQ ID NO: 100762 - RNA, 64 nt, Human
agacagauccccguuccugacaucacagcagccuccaacacaaggcuccaagaccuaggcucau

SEQ ID NO: 100763 - RNA, 64 nt, Human
acucugaggugucaggagagcccucugcugcuuuccaacacacaauuaacuccguuuccaaaua

SEQ ID NO: 100764 - RNA, 64 nt, Human
cuaaaaguguccacaagaagggguguuuauucuuccaacacauuucacuuuucuguaaauauac

SEQ ID NO: 100765 - RNA, 64 nt, Human
aguagaaaguuccuuuggccaacugcuuagaagcccaacacaacccaaaggcucuuuucagagc

SEQ ID NO: 100766 - RNA, 64 nt, Human
aaaaaacugugaauggggaaugcugacugacaaaccaacacaacuuucagaggcuucagugucu

SEQ ID NO: 100767 - RNA, 64 nt, Human
uaugucacugacucagaugcagggucugcucaccccaacacaugccuucccuccccagccacac

SEQ ID NO: 100768 - RNA, 64 nt, Human
uugggguaaaagcggguaaugaacauuccuauccccaacacaucaauuguauuuuuucuguaaa

SEQ ID NO: 100769 - RNA, 64 nt, Human
ggaacaugacaacgugaccacaccacacaugccuccaacacacacccacagucuaaacaucucu

SEQ ID NO: 100770 - RNA, 64 nt, Human
guuugaaaaacuaaaacagaaaaaaaaauggaagccaacacaucacucauuuuaggcaaauguu

SEQ ID NO: 100771 - RNA, 64 nt, Human
gugagguaucuucuuuguguguguguuuuccaagccaacacacucuacagauucuuuauuaagu

SEQ ID NO: 100772 - RNA, 64 nt, Human
ucaccgguugaauggacaacuaacccgagcuggaccaacacaauucucuccagagacuuuugau

SEQ ID NO: 100773 - RNA, 64 nt, Human
aauuucuguaaauuugagacuaccuuuauauucuccaacacaagaccguguaggugucccuuca

SEQ ID NO: 100774 - RNA, 64 nt, Human
uaauaauguagaaaaacauuauuuuaaaaaaguuccaacacacagccaugaggagccucaguuu

SEQ ID NO: 100775 - RNA, 64 nt, Human
uuauuuacgugugaaagcaacauggaugugauucccaacacagaauuuucaugacccuuuuauu

SEQ ID NO: 100776 - RNA, 64 nt, Human
acuuuuggagggcagauaauuucaucuguuaaauccaacacacauuucuuucagggaaaaacaa

SEQ ID NO: 100777 - RNA, 64 nt, Human
gggaacgggauccuucucccgcugcccaccaacaccaacacacacacaccucuaagcugcuggc

SEQ ID NO: 100778 - RNA, 64 nt, Human
ggccuuacugggcccagagcagagaaggaccuguccaacacacacagcuauuuauaguagcaga

SEQ ID NO: 100779 - RNA, 64 nt, Human
acuaaacugcugcaaaaguucucaauguucuuuuccaacacaucuauauauauauggacacaca

SEQ ID NO: 100780 - RNA, 64 nt, Human
cacuccccucuugaugccuagagagcuggcccagccaacacagcucuuagcugggagcuccuuc

SEQ ID NO: 100781 - RNA, 64 nt, Human
gucccaccauuuucucaguuucucccucucucucccaacacacacacacacacaccccucacau

SEQ ID NO: 100782 - RNA, 64 nt, Human
uuauguccagauucgccauuucugaaauccagauccaacacaagcagucuugccguuagggcau

SEQ ID NO: 100783 - RNA, 64 nt, Human
uauauuguuccccauccaccacauaacacucuccccaacacacacacacacacacacacacaca

SEQ ID NO: 100784 - RNA, 64 nt, Human
aucuguaugucuauuuauaauauguucugcaaauccaacacacguuugccaaucaagaaaaaga

SEQ ID NO: 100785 - RNA, 64 nt, Human
cugcuugugggagugggaaauggguauuuuagacccaacacagguucuaaauuuaaaacaaaua

SEQ ID NO: 100786 - RNA, 64 nt, Human
gggaagcuggcucugcuuuugcccuuugucaucaccaacacaacagauagaauuuaaauauaag

SEQ ID NO: 100787 - RNA, 64 nt, Human
gagcaccauuuaguuauaugugcuaggcaaaucuccaacacaguugauguguagucuuguggua

SEQ ID NO: 100788 - RNA, 64 nt, Human
acugugaugaauagccccacccuucuugcuguccccaacacaccugaugucacuuugagccaua

SEQ ID NO: 100789 - RNA, 64 nt, Human
auaccuuauuuuaauugaaacguuuaugcuuuugccaacacaucuuguaacuuaauauacuaga

SEQ ID NO: 100790 - RNA, 64 nt, Human
aauauguuuugcuuaauguggacaauuuacacacccaacacauacuguuuccaaaauuauuucu

SEQ ID NO: 100791 - RNA, 64 nt, Human
uuuagcuuuaagguucuauagauuuuuaacuaguccaacacagucagaaacauuguuuugaauc

SEQ ID NO: 100792 - RNA, 64 nt, Human
caugagcagggugaaugacagguacugacgaaguccaacacaaagguauaauacagccuguugu

SEQ ID NO: 100793 - RNA, 64 nt, Human
ugccugggaaggcgaaauauacccccagccccuuccaacacacacacuccagcgagaggagggc

SEQ ID NO: 100794 - RNA, 64 nt, Human
uuuaaaaugucaacaauauggagaauaaccccccccaacacaccuauaaaaacccaaauuuuug

SEQ ID NO: 100795 - RNA, 64 nt, Human
gacaagccaugggcaugcauacaaugcagcaagaccaacacaagagcaauauugaauuguucau

SEQ ID NO: 100796 - RNA, 64 nt, Human
agucacagaaucugccaggcgguucaagugaaaaccaacacacucagcaucccugggaacugag

SEQ ID NO: 100797 - RNA, 64 nt, Human
cuaaaaagcaugcagcauggugccccucuucugaccaacacacacacgaccccucccccaacac

SEQ ID NO: 100798 - RNA, 64 nt, Human
aacacuuacauuagccuacagugggcaaaacuauccaacacaaaaucuauauuguaauaaaguu

SEQ ID NO: 100799 - RNA, 64 nt, Human
gguaaguggccaaccaagcccuacccagggucacccaacacacucugccuugagccucuccuca

SEQ ID NO: 100800 - RNA, 64 nt, Human
ugucuugacaaauccuaaugucacgccuacagccccaacacaagcuccagucuuccucuucggc

SEQ ID NO: 100801 - RNA, 64 nt, Human
caauaucacccugugagccucgcacagcucagccccaacacagaggugagaccaggaauaaggc

SEQ ID NO: 100802 - RNA, 64 nt, Human
caucccuccacacucugcauccuaccccaccuacccaacacacuuuuccaccugggagccugug

SEQ ID NO: 100803 - RNA, 64 nt, Human
gccucaacuuuucucccaacacuaagcuuuccucccaacacacauccaucucguguguucaugu

SEQ ID NO: 100804 - RNA, 64 nt, Human
uuuguugaaugaaugcaugucuucuaaaaguuuuccaacacaaauuagcagugguuucuuguaa

SEQ ID NO: 100805 - RNA, 64 nt, Human
guaaucugauaugccaguuugcuuaaaacauuugccaacacauuaugaaguuauuaaauuuaag

SEQ ID NO: 100806 - RNA, 64 nt, Human
gguaaauacagccauuccaaaugggagaaauuggccaacacaaaaggguaacagggcccaugca

SEQ ID NO: 100807 - RNA, 64 nt, Human
auggcuugagcccaggaguucgacaccagccuggccaacacagugaaaugugucucuacuuaca

SEQ ID NO: 100808 - RNA, 64 nt, Human
guaacacgugccuucuugcuacucuaaacugucuccaacacauuguuucugagcuccacaaaug

SEQ ID NO: 100809 - RNA, 64 nt, Human
uccuaccuacucuucuuguaaacucugcugcuucccaacacaacuagagugcaauuuuggcauc

SEQ ID NO: 100810 - RNA, 64 nt, Human
augcaagucauccucucuaucauaaccccuccccccaacacacaguaggucacuccccaacccc

SEQ ID NO: 100811 - RNA, 64 nt, Human
gcuaucguuagugcuaguggauuuuacauguggcccaacacaauucuucuuccaacguggccca

SEQ ID NO: 100812 - RNA, 64 nt, Human
ucuuggccuuuucuguuagaauacuuggugcuuuccaacacacuuucacauguguuguaacuug

SEQ ID NO: 100813 - RNA, 64 nt, Human
uaucuggcugugcagccuugcucuguggcuuuucccaacacaaucagugcuagugcuggggagg

SEQ ID NO: 100814 - RNA, 64 nt, Human
uauguuaaagaugaacuauuuggucucauugaagccaacacagaacuugcugcuguguuuuuuc

SEQ ID NO: 100815 - RNA, 64 nt, Human
guuguaggacugcaagacacuggaccgaaagccuccaacacaaacccuagcugccaaccugcuc

SEQ ID NO: 100816 - RNA, 64 nt, Human
uacccuccuuaggacccauuuugggggggaaaaaccaacacauuccagagcuuuccaaguccuu

SEQ ID NO: 100817 - RNA, 64 nt, Human
acgccuaggcagcucugggcccugggaucuggaaccaacacaccccuguuccccucagcuuucc

SEQ ID NO: 100818 - RNA, 64 nt, Human
cacagagagggacagcaugugcaaaggcugagcaccaacacauaguggucaccugggccuuaug

SEQ ID NO: 100819 - RNA, 64 nt, Human
uggcacagggcacuagaucccuggaguucaggaaccaacacaagcacaaccacgggcauaaguu

SEQ ID NO: 100820 - RNA, 64 nt, Human
ccccacccgggaaaggcugccgccaccaccaccaccaacacaacagcaauggcaacaccgacag

SEQ ID NO: 100821 - RNA, 64 nt, Human
cacacgcacauucauuacacaccuacauacgcccccaacacacgcgcacggugaagaggacgcc

SEQ ID NO: 100822 - RNA, 64 nt, Human
gccgcauacggcccaggauggcuuugaaugcagcccaacacaaauucguaaacuuucuuaaaac

SEQ ID NO: 100823 - RNA, 64 nt, Human
auagcagucaagccgagcaaccuguauaagcagcccaacacaaaacgaguguggauuuaucuaa

SEQ ID NO: 100824 - RNA, 64 nt, Human
ugcauuaccuaaaaccaguccaaaaugaaacagaccaacacacacacaaaagcaaauugucaau

SEQ ID NO: 100825 - RNA, 64 nt, Human
ucuucccagagucacaaguagccucugggaucugccaacacacguccacucccaagccacuagc

SEQ ID NO: 100826 - RNA, 64 nt, Human
agccaagggaaaaacaaaaaccccacaaaauaccccaacacaggcgggggagagacgaaaaaga

SEQ ID NO: 100827 - RNA, 64 nt, Human
gcaggauuguaaguagaccgaauucuaauuuuucccaacacauagugguaauuggagguuacug

SEQ ID NO: 100828 - RNA, 64 nt, Human
ccgugggggaacacaccacuuuuuacuguugaaaccaacacaacguugaaauccaggcuuauac

SEQ ID NO: 100829 - RNA, 64 nt, Human
cuagacaaccagaggcuggcauugaggcuaaccuccaacacagugcaucucagaugccucagua

SEQ ID NO: 100830 - RNA, 64 nt, Human
gaacggaagaagaaauagauaagggccuuggauuccaacacaguuucuuccacauccccugacu

SEQ ID NO: 100831 - RNA, 64 nt, Human
uccuuuccgugaaagcagggguuugcaugugcuaccaacacaugauacggggaagacccaccca

SEQ ID NO: 100832 - RNA, 64 nt, Human
gcacuccggcuuccuagacucuggcccugccacaccaacacacuuucuauuugggcucccaaca

SEQ ID NO: 100833 - RNA, 64 nt, Human
uugccugguguggggaaggauugggucuugucccccaacacagcuucuguggcugacuguaaua

SEQ ID NO: 100834 - RNA, 64 nt, Human
ucucaucuugggaccgaggggguggggaaguuccccaacacauaaucccaagacugugccccuc

SEQ ID NO: 100835 - RNA, 64 nt, Human
gagagcugcgaaaaaucaaacgcauucacgucauccaacacaacauggcuuucaucagaaguua

SEQ ID NO: 100836 - RNA, 64 nt, Human
agaugcacugccauauuaucuuucuuaacuuuuuccaacacauaauccucuccaacuggauuau

SEQ ID NO: 100837 - RNA, 64 nt, Human
auaucucgccaaagaaaccacgcccacaccaaugccaacacaaaacuguguuuacugaaagccg

SEQ ID NO: 100838 - RNA, 64 nt, Human
ucuggagggccaggugggaaaugcuuucacuggaccaacacacaaaugaucauccugaggaucu

SEQ ID NO: 100839 - RNA, 64 nt, Human
cagccucccgaguagcugggauuagaggcgccagccaacacacccggcuaauuuuuguauuuuu

SEQ ID NO: 100840 - RNA, 64 nt, Human
ucagagucccauuccacaagcccaugcuagugagccaacacaaacaaaaaacaacucaaauuca

SEQ ID NO: 100841 - RNA, 64 nt, Human
uaccaccaacuacuaccuguaaugacaggccuguccaacacaucucccuuuuccaugacugugg

SEQ ID NO: 100842 - RNA, 64 nt, Human
ugcucagcugucaaggcucagucgcuagcauuucccaacacaaagauucugaccuuaaaugcaa

SEQ ID NO: 100843 - RNA, 64 nt, Human
uuuguaucuguugcagaaauuccaguggaucuauccaacacagaaacugaacaaaaugagauga

SEQ ID NO: 100844 - RNA, 64 nt, Human
aaaaccccgucucuauaccaaccaaaccaauucaccaacacaguugggacccaaaacacaggaa

SEQ ID NO: 100845 - RNA, 64 nt, Human
augaugcaagaaaaucaaaugggaaucuggggacccaacacaacauccugaagauuauuaaaag

SEQ ID NO: 100846 - RNA, 64 nt, Human
cacggaggcuugccccaucacccucugagcccucccaacacagcacacuagucagcccacugcc

SEQ ID NO: 100847 - RNA, 64 nt, Human
uuuaaaaauauuugccaccacccuggagucuagaccaacacacaaagauccuggcuaacccugg

SEQ ID NO: 100848 - RNA, 64 nt, Human
cagggaccaaagcucugaaaggugacuuuuauuaccaacacacuggcuggaaaagggacaaacc

SEQ ID NO: 100849 - RNA, 64 nt, Human
uaggcaggagccccacugcuuccagccucuggugccaacacaguugccaaacccauugagcuug

SEQ ID NO: 100850 - RNA, 64 nt, Human
cccccuuuuauccuaccucccugccuugguccugccaacacaugcgaguacacacacaccccuc

SEQ ID NO: 100851 - RNA, 64 nt, Human
uuuuguuguauuucccccuuuccacugggcccuuccaacacaaugaaugaaggaaauaucauuu

SEQ ID NO: 100852 - RNA, 64 nt, Human
auauagaauuguagacugauguuuuagcauuuuuccaacacacacaacguaaaaauaaaagcag

SEQ ID NO: 100853 - RNA, 64 nt, Human
ggaaggaaaggaagcugggcguccucugggccccccaacacacgucccauuuagcccugcacag

SEQ ID NO: 100854 - RNA, 64 nt, Human
gugauuaguagcccguaugaucacguagacccacccaacacacuccugcacacuggccccggcc

SEQ ID NO: 100855 - RNA, 64 nt, Human
ugcuguugcugcgacugccaguauugcuggagccccaacacaguacccaccaggacggggcacu

SEQ ID NO: 100856 - RNA, 64 nt, Human
gaaacgcagaggccagcguuccuggccucugcagccaacacaguagaaaaggcugcugugguuu

SEQ ID NO: 100857 - RNA, 64 nt, Human
uucagugcagaaugguucguggguacagugaacaccaacacauccuacaaagccuucagcgcag

SEQ ID NO: 100858 - RNA, 64 nt, Human
gcuugagggaccuaguucuuaccuuuucuugcaaccaacacacuugcaauugugucugguaugc

SEQ ID NO: 100859 - RNA, 64 nt, Human
aucgcuugagcccaggaguuugagaccagccuggccaacacaguaaacccugucuccacaaaau

SEQ ID NO: 100860 - RNA, 64 nt, Human
gccagcacaguccuaaaagggcuggaguaccacaccaacacagguaggggugcagggcuucaag

SEQ ID NO: 100861 - RNA, 64 nt, Human
uuguuuagcucuaaggcaaaaguuugcuugcuugccaacacaaugaagauaauaccuacccaca

SEQ ID NO: 100862 - RNA, 64 nt, Human
ggccuaauuuuucugacugauauggaaacgauugccaacacauacuucuacuuuuaaauaaaca

SEQ ID NO: 100863 - RNA, 64 nt, Human
uuugguugucuaauauucuuggauuugauaugaaccaacacauaguccuuguugucauugacag

SEQ ID NO: 100864 - RNA, 64 nt, Human
aggacacaauccaaaucauaaaccuggcucaugcccaacacauuucugcuaauagggagaggga

SEQ ID NO: 100865 - RNA, 64 nt, Human
acacccaagcugcuggccuccagucccaucucccccaacacaugugcccccaaaaagugagcca

SEQ ID NO: 100866 - RNA, 64 nt, Human
uagcguuccucuuccccucuaguuuccuggagccccaacacauuccuggcagggacagcagggu

SEQ ID NO: 100867 - RNA, 64 nt, Human
ggacccauccugccacaggacccagaaaaaaagcccaacacacacucggguuaagaaauaccuu

SEQ ID NO: 100868 - RNA, 64 nt, Human
ugaugaauaguuuaaguguucagaaauugguaaaccaacacacgggauacaauaacucucuguu

SEQ ID NO: 100869 - RNA, 64 nt, Human
aagugccagggcugggccccuuccaaaugucccuccaacacagauccgcaagaguaaaggaaau

SEQ ID NO: 100870 - RNA, 64 nt, Human
uauaaggggauagcagcaaaccaccuaucuggccccaacacaccugagagaauucagcagccca

SEQ ID NO: 100871 - RNA, 64 nt, Human
gacaccccaccucccuccuccauggggcacagacccaacacaaggcggggaugcucccacgcca

SEQ ID NO: 100872 - RNA, 64 nt, Human
ccaguuccaccugcugguagggguagguuggcucccaacacauccccagcaggccucucuuggg

SEQ ID NO: 100873 - RNA, 64 nt, Human
aaauaaucuauuuguagcuucucuucuaucaaaaccaacacauccucuucuuucugccaauccu

SEQ ID NO: 100874 - RNA, 64 nt, Human
ugcuugcucggccauccccacuuccuccucuaccccaacacaugcaggcuaggccuugcccugg

SEQ ID NO: 100875 - RNA, 64 nt, Human
cuguccgcccucuuccccucuaaugcucacgcucccaacacaaggugggcagggaggcaccauu

SEQ ID NO: 100876 - RNA, 64 nt, Human
gagagauguuagucacugcccaguucuuagagccccaacacagauacccucaucccagggcccc

SEQ ID NO: 100877 - RNA, 64 nt, Human
gucguuugcuccagcaugcacaaacuucgugagaccaacacagccgugcccugcaggcaccagc

SEQ ID NO: 100878 - RNA, 64 nt, Human
gugccugacuacuuguggcccaggcaggcuucccccaacacaggaacgcucauggacaccugca

SEQ ID NO: 100879 - RNA, 64 nt, Human
gcuggauguggcagaauccacaccagcuuaucaaccaacacagcuaauuuuagaauagauccuu

SEQ ID NO: 100880 - RNA, 64 nt, Human
auaacuugagaucaggaguucgagaccagccuggccaacacaaugaaaccguguaucuacuaaa

SEQ ID NO: 100881 - RNA, 64 nt, Human
uccugucuugcugagcccucccccaacccacgcuccaacacacacacacacacacacacacaca

SEQ ID NO: 100882 - RNA, 64 nt, Human
ucuucaaguaaaauuaaagucucuuguguaagagccaacacaugcccagcugcggaugggagcu

SEQ ID NO: 100883 - RNA, 64 nt, Human
ccagcaucacaaggcacuugucuacaagugugucccaacacaguccugggccacuuuccccacc

SEQ ID NO: 100884 - RNA, 64 nt, Human
ggacagugcccaagucaggguccagaacugccccccaacacagguccacagacaccccaccacc

SEQ ID NO: 100885 - RNA, 64 nt, Human
aggagcucucccgguaccaguguccacagaccgcccaacacagaggcuuugaggcuucucuaga

SEQ ID NO: 100886 - RNA, 64 nt, Human
guuacuuuuuuaggcugugguuuggugaaaggaaccaacacauuaacgauuuuucccccagaag

SEQ ID NO: 100887 - RNA, 64 nt, Human
ucuguuuuauaccuuauacccaaaacacuuacuaccaacacagcuguuaaacauucuauacaaa

SEQ ID NO: 100888 - RNA, 64 nt, Human
aaagucuccaaaaaaauugaagucacccacaauuccaacacacagcaaucacugcuguuaauag

SEQ ID NO: 100889 - RNA, 64 nt, Human
ggagggguuuuuacaucuccuaaaggaccugaugccaacacaaguaggauugacuuaaacucuu

SEQ ID NO: 100890 - RNA, 64 nt, Human
acaaucuuucauuucuggauauauuguagcuaacccaacacauuuuuaaacuauuuuuguuacu

SEQ ID NO: 100891 - RNA, 64 nt, Human
uuuucuacuaauuauuuuuugaagcauuauuuucccaacacaaaagagcuuuuuucucgguaua

SEQ ID NO: 100892 - RNA, 64 nt, Human
uaaucaagauuaaauguaaauaaucagggcaaucccaacacaugucuagcuuucaccuccagga

SEQ ID NO: 100893 - RNA, 64 nt, Human
aaguuucaacuugcaaacugacuuuugggacaaaccaacacacacacagaagagaaagcaaaga

SEQ ID NO: 100894 - RNA, 64 nt, Human
ggaucacuaggucaggaaauggagaccauccuggccaacacagugaaacccagucucuacuaaa

SEQ ID NO: 100895 - RNA, 64 nt, Human
uuuaaaaaaaacaccucgacauuuaaaaaaucaaccaacacaagaucaaaaaggaaaaggacga

SEQ ID NO: 100896 - RNA, 64 nt, Human
gcccagccucccgcggggccacacacuuccccucccaacacacacacacaccugccaucuuggu

SEQ ID NO: 100897 - RNA, 64 nt, Human
uauuuuguuagagugcgauaggacauauggaaaaccaacacaaagugcuuuagcauuaaaacuc

SEQ ID NO: 100898 - RNA, 64 nt, Human
aggaaauaacccacaaaagaagcaaaugcaauuuccaacacaagggggaagggaugcaggggga

SEQ ID NO: 100899 - RNA, 64 nt, Human
caguggcugcaccaaauuggagguguggguuccuccaacacaauuugcuucugcccguugucuu

SEQ ID NO: 100900 - RNA, 64 nt, Human
cuguuuauugugggauaucaauauuuuuaaagugccaacacagucaugauaggacaauauuuua

SEQ ID NO: 100901 - RNA, 64 nt, Human
guguacaccuaugaaaccaccacagucaagauauccaacacaacaaaagauugucccuuuauaa

SEQ ID NO: 100902 - RNA, 64 nt, Human
uuguagacgcugacaggugggguccuaaugagagccaacacaugcucacugccagcuccugucc

SEQ ID NO: 100903 - RNA, 64 nt, Human
cuuucauguaacagauuaauaacuuauaugaaaaccaacacaaccauauguuuagggcuggaaa

SEQ ID NO: 100904 - RNA, 64 nt, Human
aucugggacucagagcuuucuauccaucugagagccaacacaggagaaaaaccauaggaaagug

SEQ ID NO: 100905 - RNA, 64 nt, Human
caaucagccauccucgucugcucuccucucucuuccaacacagcccaucccugcacugcuccug

SEQ ID NO: 100906 - RNA, 64 nt, Human
acugggguagggaucaaagccagccacccccaccccaacacacucggugucccuuucauccugg

SEQ ID NO: 100907 - RNA, 64 nt, Human
ccaggcuggcccccacccaccuuccuugcgaccaccaacacacaggaacucugugugagagaga

SEQ ID NO: 100908 - RNA, 64 nt, Human
gcugcuaacccuugcaccagcccuugugggacucccaacacaagacaaagcucaggaugcuggu

SEQ ID NO: 100909 - RNA, 64 nt, Human
uuguaguuauacuuuugcuuguuuuucaguuuccccaacacacagcagauaccuggugagcuca

SEQ ID NO: 100910 - RNA, 64 nt, Human
auggugccugucagcccgcagagcccaucuacgcccaacacagagcucacacaggucacugcuc

SEQ ID NO: 100911 - RNA, 64 nt, Human
aaaagucaaaucauaucacuucucugcuucuuccccaacacagcugcauggcucccgcucuccc

SEQ ID NO: 100912 - RNA, 64 nt, Human
ucugaaaaacagcaggauuaaguacugaaagagcccaacacaauuacccuguaaacucucuguu

SEQ ID NO: 100913 - RNA, 61 nt, Human
ucacccuggccgaugacugagccccgagggcccaacacagaucauggauuugcggccagcu

SEQ ID NO: 100914 - RNA, 64 nt, Human
gcucagucagcccauggccuucgugaacuuugcuccaacacacugaugugugggcuucccacag

SEQ ID NO: 100915 - RNA, 64 nt, Human
gcggcccugacggugguauccaguuaacucaaaaccaacacacagagugcaggaaaagacaauu

SEQ ID NO: 100916 - RNA, 64 nt, Human
agagaaauguuucacgcaagcagucccccaacucccaacacacacucccuuucauuccgagcac

SEQ ID NO: 100917 - RNA, 64 nt, Human
acguacaaaacacacagcaaguuuucuaucauguccaacacauucaacacugguauaccuccua

SEQ ID NO: 100918 - RNA, 64 nt, Human
gugcccuagcugggcaaacccuucucuucuccccccaacacaaucuuuccuugucucucauucu

SEQ ID NO: 100919 - RNA, 64 nt, Human
ugccuucauuuuuacagagguagcacaacugauuccaacacaaaaccccuuccccuuuuuaaaa

SEQ ID NO: 100920 - RNA, 64 nt, Human
acugaccuaagaccuauguaaaaggaaagcuguuccaacacacggacuauuuuuguacuagaau

SEQ ID NO: 100921 - RNA, 64 nt, Human
gagucuggcugguccaacacagauucugccugguccaacacagauucugccugagccuccuuau

SEQ ID NO: 100922 - RNA, 64 nt, Human
ccuggccacugggcugggcuggagucuggcugguccaacacagauucugccugguccaacacag

SEQ ID NO: 100923 - RNA, 64 nt, Human
ccguggggaggagccccuuguaccugcuccgugcccaacacaugcccucucuguacaucuuuug

SEQ ID NO: 100924 - RNA, 64 nt, Human
aauaagaauaacacucaagacuauguucuccaucccaacacaucacuuaccacuugcacuauuc

SEQ ID NO: 100925 - RNA, 64 nt, Human
ggccccaccagaucuccauucuuugccaugagggccaacacaugagaccccaccucccucccug

SEQ ID NO: 100926 - RNA, 64 nt, Human
aagccuggucaauucuauaguuaucuuuuuuguaccaacacaugcuuuucuguuacuguuauau

SEQ ID NO: 100927 - RNA, 64 nt, Human
uggcuggacuuuaccaggcaugcagaagccuguaccaacacagacuacagcacccaggaggugc

SEQ ID NO: 100928 - RNA, 64 nt, Human
uauuuguaauugcugcuuuuuucagggguaauuuccaacacacauacaugcacacaaacaaaau

SEQ ID NO: 100929 - RNA, 64 nt, Human
cccaggccuugccugaggggucaggcugccucucccaacacacacucagauagcacaaauucua

SEQ ID NO: 100930 - RNA, 64 nt, Human
ccuuucuauauauauucucguaugucuuauucuaccaacacaacaauaagcguguugcagucaa

SEQ ID NO: 100931 - RNA, 64 nt, Human
acaccccacacccgggcaggagcgcucccuggccccaacacaucggggcuccgaggcagugacc

SEQ ID NO: 100932 - RNA, 64 nt, Human
uuucucuuuguacugcuuugucuugcauuguguuccaacacaugagacuuacugcucacugaau

SEQ ID NO: 100933 - RNA, 64 nt, Human
aaaggaggcuccgugagaugggguccagcccaucccaacacaagggugcagcuugauucgggag

SEQ ID NO: 100934 - RNA, 63 nt, Human
guuuuacaagugacgguuuccccggcucccuccugccgccaugugaagaaggucguugcuucc

SEQ ID NO: 100935 - RNA, 63 nt, Human
cggcaaccuccugggcuuccuagaggacagccuugccgccacacaguuccagcagagccaggc

SEQ ID NO: 100936 - RNA, 63 nt, Human
augauaaagauuauaaagcagguccaaggaaagugccgccagugguccaaggagggagacaga

SEQ ID NO: 100937 - RNA, 63 nt, Human
ugucugcuacugcugggacucaggcccucgcccugccgccaucuaugccaguuacccuggaga

SEQ ID NO: 100938 - RNA, 63 nt, Human
gagaguauggggaaaagaaucaagagaccugacugccgccaacucacuagugacuuagauaca

SEQ ID NO: 100939 - RNA, 63 nt, Human
ucauuaacuugaucccuuucuccagacuggccaugccgccauauaccuuuccuuuuguauucc

SEQ ID NO: 100940 - RNA, 63 nt, Human
acucagagaacuagaguuuaagcugaggcagagugccgccacccuggcaugccccacaaacag

SEQ ID NO: 100941 - RNA, 63 nt, Human
acacauggguguccagggagaaggcucugucccugccgccagaccccagugguugccacugaa

SEQ ID NO: 100942 - RNA, 63 nt, Human
ucgcugaguccagccucguggucuucuccaagaugccgccagaugcccagccuacagccucuc

SEQ ID NO: 100943 - RNA, 63 nt, Human
aagguggaggccuugcagugccaggaggagggcugccgccauggggcagagccccaggcgucc

SEQ ID NO: 100944 - RNA, 63 nt, Human
aaaacugcugccgccgcgccgaggagacucgcaugccgccaccaccucacugggagggcgccg

SEQ ID NO: 100945 - RNA, 63 nt, Human
accccgagccgggguucccuccucccggcccgcugccgccacccaccucuccugcaggcugcg

SEQ ID NO: 100946 - RNA, 63 nt, Human
uggugccugcaccugcacucuagugacccugggugccgccagacccuucucuucuacaaagac

SEQ ID NO: 100947 - RNA, 63 nt, Human
cauagcauggcugcccuguggaugccuugucagugccgccagccugaccagaggggaggugga

SEQ ID NO: 100948 - RNA, 63 nt, Human
ugcugugaaacuggcacccaccuggcgugcugcugccgccacuugcuuccugcagcaccuccu

SEQ ID NO: 100949 - RNA, 63 nt, Human
gggggucgagggggaggaggccaccugaccaaaugccgccaaccccgagggccaguuucuugu

SEQ ID NO: 100950 - RNA, 63 nt, Human
auggcuuggggcugccugggccccccuccaggaugccgccaggugucccucuccucccccugg

SEQ ID NO: 100951 - RNA, 63 nt, Human
agaaaacagacaugacagaacuguuccugccguugccgccacugcugccauugcugugguuau

SEQ ID NO: 100952 - RNA, 63 nt, Human
caccuccgccagauccugcagaaguacuccuauugccgccagaagauccaagaggcccugcac

SEQ ID NO: 100953 - RNA, 63 nt, Human
cuucagagauuuguuuucauuaaaaaauaagccugccgccaaaauaaaucacuuaucaaaaug

SEQ ID NO: 100954 - RNA, 63 nt, Human
cugaaagugcaguacaucguuuguaccugaaacugccgccacaugcacuccuccaccgcugag

SEQ ID NO: 100955 - RNA, 63 nt, Human
gggcgccccacacggacugaaggccgcccgggcugccgccagccaagugcaacuugaauuguc

SEQ ID NO: 100956 - RNA, 63 nt, Human
uggggcggggagccuucaggagccccgugcgucugccgccacguugcagaaagagccagccaa

SEQ ID NO: 100957 - RNA, 63 nt, Human
cucccccaaaacacaccuggagccagagccuucugccgccagcccugccccugaauuggaagc

SEQ ID NO: 100958 - RNA, 63 nt, Human
ugugggucugcaggugagcagacaggacaggugugccgccacccaagugccaagacacagcag

SEQ ID NO: 100959 - RNA, 63 nt, Human
aaguaaagccuuagcccggaugcccaccccugcugccgccacuggcugugccucccccgccac

SEQ ID NO: 100960 - RNA, 63 nt, Human
ucaccugacaguaacuuucaugacauaggauucugccgccaaauuuauaucauuaacaaugug

SEQ ID NO: 100961 - RNA, 63 nt, Human
caugauaugcggcuaugccugccucaaagggacugccgccaugcggaacaccaaacgagguuc

SEQ ID NO: 100962 - RNA, 63 nt, Human
ugcaaggagaugucugaauacugcagcacucugugccgccaccucuaccuguucccaggacac

SEQ ID NO: 100963 - RNA, 63 nt, Human
aaugaaaacaacucaaguucauagcagccagccugccgccauuggaccucccuuuuaaaaacu

SEQ ID NO: 100964 - RNA, 63 nt, Human
agcaguugaauguaaugcuggggacaggcaugcugccgccaguagggcggggacccggacagc

SEQ ID NO: 100965 - RNA, 63 nt, Human
ccagcagcugcgggaugagauugaggagcucaaugccgccauuaaguaggcaggguccaggcg

SEQ ID NO: 100966 - RNA, 63 nt, Human
accucugccccagagcugccuccugccuggcacugccgccacacuccccuccugggauggggc

SEQ ID NO: 100967 - RNA, 63 nt, Human
gugcagcaggccauggaguguagcgggcaucgcugccgccauuccugcagcaucaccauaagc

SEQ ID NO: 100968 - RNA, 63 nt, Human
uuaaagaggggcaguuucucaaaagcagaaacaugccgccaguucucaaguuuuccuccuaac

SEQ ID NO: 100969 - RNA, 63 nt, Human
accauuuucccccucacccuaacucucuuauucugccgccacaaugcaagcauaguuugaugu

SEQ ID NO: 100970 - RNA, 59 nt, Human
accaguguaucgacggcugagugcacaggugccgccagcugccgcaccagcccgaacac

SEQ ID NO: 100971 - RNA, 63 nt, Human
gcccacuggggacacacugugccgugcuccuucugccgccacgcccagcuccccaccugcccu

SEQ ID NO: 100972 - RNA, 63 nt, Human
gccucaggagguggccgacugcugcuagcggccugccgccacgucagcagcccagggcacagc

SEQ ID NO: 100973 - RNA, 63 nt, Human
gaaauuggaccugaacuguuggauuuuucuaguugccgccaaacaaggcaaaaaaauuuaaac

SEQ ID NO: 100974 - RNA, 63 nt, Human
gccaagcauccacccggcccacaggcauguuucugccgccacuccgcaagauggacagggagc

SEQ ID NO: 100975 - RNA, 63 nt, Human
cauugaaaugaggauuuugcuuaaaacagcacuugccgccagugggaggagggagguuuuauu

SEQ ID NO: 100976 - RNA, 63 nt, Human
ccacuccuugaaaaacacaggauuauaaaauggugccgccauuucucauuuuuuaacuuuuua

SEQ ID NO: 100977 - RNA, 63 nt, Human
uuguuauauaaaggguacuuuugggagggugagugccgccauuuaguggcugcuagaaacauu

SEQ ID NO: 100978 - RNA, 63 nt, Human
aggacugccccccaugcaccauugcagggaggaugccgccaccaugagcuagguggaguaacu

SEQ ID NO: 100979 - RNA, 63 nt, Human
gaugugagugccacuuccccacccgggaaaggcugccgccaccaccaccaccaacacaacagc

SEQ ID NO: 100980 - RNA, 63 nt, Human
gagggagagcaacccuuugccgaugaccacgcuugccgccaucucuuaguuuucuuuuucaca

SEQ ID NO: 100981 - RNA, 63 nt, Human
uuucuguguuuuguaagggaacuguuuccuucaugccgccauguuccugauauuaguucugau

SEQ ID NO: 100982 - RNA, 55 nt, Human
ggaagagcuacaagcacugaagugcugccgccagcucucagucccacagcucuca

SEQ ID NO: 100983 - RNA, 63 nt, Human
acuccuccccugcccaagccuacugccucccgcugccgccaguacccccuccagccccacacc

SEQ ID NO: 100984 - RNA, 63 nt, Human
gcgaaugccagaccaaugauacccagagcuaccugccgccaacuuguugagauguguguuuga

SEQ ID NO: 100985 - RNA, 63 nt, Human
ugccucggccuccugaguagcugggauuacaguugccgccacacccggcuuauuuuuuuguau

SEQ ID NO: 100986 - RNA, 63 nt, Human
cgaggaggcugcaugcacuuucacuguacccagugccgccaccaguucugcagcggcugcuac

SEQ ID NO: 100987 - RNA, 63 nt, Human
agguguuuccugcaccugcugucagccuggcuaugccgccaccggccccgcccaugaggacua

SEQ ID NO: 100988 - RNA, 63 nt, Human
caggggagccccuguggccuggacucuaggggaugccgccaccagaaaccccucugccaaucc

SEQ ID NO: 100989 - RNA, 63 nt, Human
auggaauuugggauugaaguuaaacuacaacagugccgccaacaccaagucuugcaggaaaaa

SEQ ID NO: 100990 - RNA, 63 nt, Human
aaacaugucgugugucugcacgccccggcaaacugccgccacucguucugcugccugacuggu

SEQ ID NO: 100991 - RNA, 63 nt, Human
cacgugagcacuggcucccacggagggugcgccugccgccagcggcccagccuugcugcccug

SEQ ID NO: 100992 - RNA, 63 nt, Human
ccuuugcccgcgugucagacuccaucccuccucugccgccaccgcagcagccacaggcagagg

SEQ ID NO: 100993 - RNA, 63 nt, Human
aaagcaggugagggugggcugggcugaggccauugccgccacuaucuguguaauaaaauccgu

SEQ ID NO: 100994 - RNA, 63 nt, Human
gcugcuacagagguguugggcaggccaugccugugccgccaucucucccuuccugccucauuu

SEQ ID NO: 100995 - RNA, 63 nt, Human
cgucggucgucgcccccgucguucccucccggcugccgccagggggcggucggaccccgccuc

SEQ ID NO: 100996 - RNA, 63 nt, Human
gacccuccccugcccccuccacuccggggccugugccgccagaaccgggcucugcccccauac

SEQ ID NO: 100997 - RNA, 63 nt, Human
cugugggucuguggcacagcaggaagagcccggugccgccagcaccuuguggaagaccacaca

SEQ ID NO: 100998 - RNA, 63 nt, Human
ucauccuccugaguagcugggguuacaggugugugccgccaugcccagucucuuuuuugguag

SEQ ID NO: 100999 - RNA, 63 nt, Human
ugccacaggccccuggaaaugcuaccuacguguugccgccacaggcuccugcucucuggccaa

SEQ ID NO: 101000 - RNA, 63 nt, Human
cuguggaucccgucaggagggacuuaguggcucugccgccagugagacuucccgccggcagcu

SEQ ID NO: 101001 - RNA, 63 nt, Human
uucagucccucaccuccugaccggccacauccuugccgccacaucccggguggcucuggggcu

SEQ ID NO: 101002 - RNA, 63 nt, Human
caagacgacguggcacacauuccacgugggugcugccgccaccccagucggucguggcgugca

SEQ ID NO: 101003 - RNA, 59 nt, Human
ccucaccacccacagugugaauccugaggugccgccauuggcgguucugcugcuucgcu

SEQ ID NO: 101004 - RNA, 63 nt, Human
ugaagacgaugaccaguuuucaccggaagcagaugccgccaugagcgagaugacggggaauac

SEQ ID NO: 101005 - RNA, 63 nt, Human
gccguuuccuucauuccucuuagauuccauaguugccgccaugaaaagacugcucuugagccc

SEQ ID NO: 101006 - RNA, 63 nt, Human
cuccaguaggaaauugauuuugaaaaaguaggcugccgccaccacggcauuaugaucccuucc

SEQ ID NO: 101007 - RNA, 62 nt, Human
ugagaaccgccagaaacugagccgccccaggaugccgccagaaucacuggucccugggagcu

SEQ ID NO: 101008 - RNA, 63 nt, Human
cuaguacuuuuugucauaaacaaacaggccaucugccgccaaauacauccacuccccaugcca

SEQ ID NO: 101009 - RNA, 56 nt, Human
agcaguaugagcucuugugaggaugcugccgccacccugcgacggagcggcgcccc

SEQ ID NO: 101010 - RNA, 63 nt, Human
gcagccuauaacaccuuucaccacugugaacagugccgccaguacauggacuucaccucugcc

SEQ ID NO: 101011 - RNA, 63 nt, Human
gucauauaaagccauugcaaggacucuggaaacugccgccaaugaccaauuucugacuaacca

SEQ ID NO: 101012 - RNA, 63 nt, Human
uauuuauuuaucucucauucuguauagaauucuugccgccaucccaggucuagccuuaggagc

SEQ ID NO: 101013 - RNA, 63 nt, Human
agcccugaccagccucccccaacagaacgccugugccgccacugucccaaggacuggacauuc

SEQ ID NO: 101014 - RNA, 63 nt, Human
ccaacggccgagcuugugauucugagcuugcaaugccgccaagcgccccccgccagcccgccc

SEQ ID NO: 101015 - RNA, 63 nt, Human
cccuuccccagcccugcccccgcagacucccccugccgccaagacuuccaauaaaacgugcgu

SEQ ID NO: 101016 - RNA, 63 nt, Human
gacugagcccucccuuggcucacuguccccuucugccgccagcccuagccaguaagagguggg

SEQ ID NO: 101017 - RNA, 63 nt, Human
cugcgccaggccacagcagccgcccgcugccgcugccgccagccacagccguuccugcuggcc

SEQ ID NO: 101018 - RNA, 63 nt, Human
ucaaggaaaggagaaauaucuucagaggaagacugccgccauacugaggcugagcacagauuu

SEQ ID NO: 101019 - RNA, 63 nt, Human
aagcaggauguuggcgaacugacaaacucugucugccgccagaaggaaugcugggggcaguca

SEQ ID NO: 101020 - RNA, 63 nt, Human
cacgggguucagcggcucccccagugcugcaggugccgccaggacgggccacgugggccccca

SEQ ID NO: 101021 - RNA, 63 nt, Human
cuaacuggccuggcaccuggugccacgugcugcugccgccaggauaugcgccuucccacaggu

SEQ ID NO: 101022 - RNA, 63 nt, Human
uguuguccgggcugugauccacccugacuaugaugccgccagccaugaccaggacaucaugcu

SEQ ID NO: 101023 - RNA, 63 nt, Human
cuucuaagcaaagugccccugcaggccggguucugccgccaggacugcccccuucccagagcc

SEQ ID NO: 101024 - RNA, 63 nt, Human
uucagaaguucagucuauuuuuucagcggauacugccgccaccaagaauccaaaaccuauuuu

SEQ ID NO: 101025 - RNA, 63 nt, Human
cgaagguggcagcugacagacgugggcucugcaugccgccagccuaguagaaaguucucguuc

SEQ ID NO: 101026 - RNA, 63 nt, Human
gggcuuuccaccugcauggaacaagggccugucugccgccagcgcuguggccacagccugcau

SEQ ID NO: 101027 - RNA, 63 nt, Human
gccgccugagcagguguggugccgucccgccauugccgccaccuauuuauuguguuuuaucug

SEQ ID NO: 101028 - RNA, 63 nt, Human
gagcccggcauauacccagggcaccccuacggcugccgccagucucaugcccaggugggugcu

SEQ ID NO: 101029 - RNA, 63 nt, Human
uacauuguguuuaagagaaaaaugaaacccacaugccgccauuuuccugaaucaaauucugca

SEQ ID NO: 101030 - RNA, 63 nt, Human
ccacaaucauggagcccugcgaccucccugcccugccgccacaugcaguggaggagaggccug

SEQ ID NO: 101031 - RNA, 63 nt, Human
ccacaaucauggagcccugcgaccuacccgcccugccgccacaugcaguggaggagaggccug

SEQ ID NO: 101032 - RNA, 63 nt, Human
aaaggacaggcgaggagcugugggcgcagggccugccgccacugccuacaucuucucucuucc

SEQ ID NO: 101033 - RNA, 63 nt, Human
cgaaaucagccacaacuaaaucgcucuggacggugccgccaggugacccuacauguccggagc

SEQ ID NO: 101034 - RNA, 63 nt, Human
aucguucccgcuucugcguuuuguuauuccuacugccgccauaggaauuauuucguuggcuga

SEQ ID NO: 101035 - RNA, 64 nt, Human
uaauuuucuaggcuaaauggcaaucucugaaagaugaauaaagcuauauuuauuuagcuuuucu

SEQ ID NO: 101036 - RNA, 64 nt, Human
cccaugaaugcucacgcaaguguaaugacagaccugaauaaaauguauuaagcagcagugaucu

SEQ ID NO: 101037 - RNA, 64 nt, Human
ggaggugggggaaugugguaacauugaauacaguugaauaaaaucgcuuacaaaacucacacuc

SEQ ID NO: 101038 - RNA, 64 nt, Human
ugugugcaaucaguaccuugaaggcagaacauucugaauaaaguuggaaaaagaacagcuuugc

SEQ ID NO: 101039 - RNA, 64 nt, Human
ggacagucucccugauggacccucagucuucucaugaauaaauuccuucaacgccuguguucuc

SEQ ID NO: 101040 - RNA, 64 nt, Human
agcauagaaauauuuuaggauauuuuaggauaugugaauaaagcuagacucaaaccaucauaau

SEQ ID NO: 101041 - RNA, 64 nt, Human
ggcccagcuggcagugcugaucgaucccacauccugaauaaagaauaaagaucucucagaaaau

SEQ ID NO: 101042 - RNA, 64 nt, Human; identical to SEQ ID NO: 101041

SEQ ID NO: 101043 - RNA, 64 nt, Human
ucccuucccuucuccuuucccugggaaaauacaaugaauaaauaaagacuuauugguacgcaaa

SEQ ID NO: 101044 - RNA, 64 nt, Human
uauuuuggagggagaacaaaaucuuuuaacauuuugaauaaauuuagaguuuuauaaaauaggc

SEQ ID NO: 101045 - RNA, 64 nt, Human
gaaaaagagugaugagaagagaauggagagaauuugaauaaaaggugggaaaggagagcacugu

SEQ ID NO: 101046 - RNA, 64 nt, Human
aacuuugauucuugaaagagaaaacaaaagcaugugaauaaacuuugaaguguucaccucaguu

SEQ ID NO: 101047 - RNA, 64 nt, Human
uuggagggggaggccccugaggcagcccagcuccugaauaaagauucuacaacacacgagucca

SEQ ID NO: 101048 - RNA, 64 nt, Human
aucugucugccgccuauuucccauuggugucgauugaauaaauguaugugaacuucagcaguca

SEQ ID NO: 101049 - RNA, 64 nt, Human
ugaaauuuauuuugccaauguuuucugaaugaacugaauaaagcuucuguuguagcaugccaug

SEQ ID NO: 101050 - RNA, 64 nt, Human
agcucauacuucauagaagcuguuauuuugcuuuugaauaaauuuuauauuucaauauuuuaaa

SEQ ID NO: 101051 - RNA, 64 nt, Human
uguuaggcugugcuuuacugauaaaaccaaguauugaauaaagagaguuaauuaucuuuuuaaa

SEQ ID NO: 101052 - RNA, 64 nt, Human
aaucuguuuaguuuuaguaugguuuugucucuaaugaauaaauaauuccuucuuauuaagaaga

SEQ ID NO: 101053 - RNA, 64 nt, Human
uuuguuguuguuguuuuuucaugccccauacuacugaauaaacuaguucugugcggguacagca

SEQ ID NO: 101054 - RNA, 64 nt, Human
gcauguuguuuucuggugcuuguuauuauauauuugaauaaacagugcugcaaguacuugccau

SEQ ID NO: 101055 - RNA, 64 nt, Human
agaagauucuaauugcuaacuguuuauacuuuucugaauaaaauaguuguuucuaauuaaaaag

SEQ ID NO: 101056 - RNA, 64 nt, Human
ggcauguaauaguaagugcucaauuaacauugguugaauaaaugagagaaugaauagauucauu

SEQ ID NO: 101057 - RNA, 64 nt, Human
guccugauugaaggggaggcuuguacugcuuuguugaauaaaugaguuuuacgaaccagggcac

SEQ ID NO: 101058 - RNA, 64 nt, Human
acagcccccagacccucugcaauaucacuuuuugugaauaaauuuauuaagaaaaaaugaugug

SEQ ID NO: 101059 - RNA, 64 nt, Human
cauuguuuuuucacugcuuucucaacaguuccugugaauaaaugaaacauuucggagcucccug

SEQ ID NO: 101060 - RNA, 64 nt, Human
ugaguuuauacucaccuuuuaugaaagcacugcaugaauaaaauuauuccuuuguauuuuuacu

SEQ ID NO: 101061 - RNA, 64 nt, Human
guguuuugcuucaugcuagaagcauaugcaacagugaauaaaagcuucuuuuuuuguuaaucag

SEQ ID NO: 101062 - RNA, 64 nt, Human
uugucuuuaaaaaauaauuggcagcaacuguauuugaauaaaaugauuucuuaguaugauugua

SEQ ID NO: 101063 - RNA, 64 nt, Human
gaaucagaggagauaacauauauggaagauaaagugaauaaaaguacuuugaaaaacuauaaag

SEQ ID NO: 101064 - RNA, 64 nt, Human
cuccuugaacucauacacacagguauuugaguccugaauaaaguguuggaaagcacugcagaug

SEQ ID NO: 101065 - RNA, 64 nt, Human
gugcauuuuuuucucagggaauuuuagaugaacuugaauaaacucuccuagcaaaugaaaucuc

SEQ ID NO: 101066 - RNA, 64 nt, Human
auguuagacuagauauuauaaaacaacuagauccugaauaaaaucugcuuuuaauagguucacu

SEQ ID NO: 101067 - RNA, 64 nt, Human
aacuugcuacuaaacuauuaggccaucaauggcuugaauaaaaaccagagaagguuuuucccag

SEQ ID NO: 101068 - RNA, 64 nt, Human
uuuccugguacaguguaguuuuuccccuuucauuugaauaaaagcauggcaccaaaugacuccu

SEQ ID NO: 101069 - RNA, 64 nt, Human
uuggagacucaugagcaccccaggcagcucaagcugaauaaauagcugcagacauggccaacaa

SEQ ID NO: 101070 - RNA, 64 nt, Human
ucuacaugccugugaaggagacuuuucaugaaacugaauaaaagaaauccuuuccgagauagag

SEQ ID NO: 101071 - RNA, 64 nt, Human
auccuguaguacacauuguacugagugguuuuucugaauaaauuccauauuuuaccuaugaaug

SEQ ID NO: 101072 - RNA, 64 nt, Human
cuacagcugagcagauguaauagaaauaaaccuaugaauaaauuuucuucuugguucugaaauu

SEQ ID NO: 101073 - RNA, 64 nt, Human
acuggcugccuggaggcccugagccacccagaucugaauaaaacagaugcuuacccuggaagag

SEQ ID NO: 101074 - RNA, 64 nt, Human
guauaaaaccuaagguuuugguaaguaccuuaguugaauaaaagcacaagguuaucaccuuuuu

SEQ ID NO: 101075 - RNA, 64 nt, Human
cugaguuauauacuuugcaaggguaaauuacaucugaauaaagcuguaauuaaaaacaacaccu

SEQ ID NO: 101076 - RNA, 64 nt, Human
agaugugaaagaagcugccuguuuacugauccauugaauaaacccauuuuaauagaaaaaguca

SEQ ID NO: 101077 - RNA, 64 nt, Human
cuuucccacugucuuuaaguugaaacuguuaagcugaauaaaaacuuaagcugcaaauugauaa

SEQ ID NO: 101078 - RNA, 64 nt, Human
auuucauuuaucuggaaaauuuuguaugaguucuugaauaaaacuugggaaccaaaaugguggu

SEQ ID NO: 101079 - RNA, 64 nt, Human
agaaccucaccuguuacugaaagugguuugaaagugaauaaacuucagcaccauggacagaaga

SEQ ID NO: 101080 - RNA, 64 nt, Human
gccaauaaguaaaaacaacccaaauguccaagaaugaauaaauggauaaacaaaauaugguaua

SEQ ID NO: 101081 - RNA, 64 nt, Human
gguggggggugagucccacuugagcgcuuccuguugaauaaagcaggcacuugaccuggcugua

SEQ ID NO: 101082 - RNA, 64 nt, Human
uaaccaaagaagcuguacuccggggggucucuucugaauaaagcaauuagcaaaucauguauau

SEQ ID NO: 101083 - RNA, 64 nt, Human
caaaagcaaacaaaaaagaaaucucucuauaaaaugaauaaaauguuuaagaaaagagaaagag

SEQ ID NO: 101084 - RNA, 64 nt, Human
ggugaccacuggcaucuaugcuuagcuaugaaagugaauaaagcagaauaaaaauaaaauacuu

SEQ ID NO: 101085 - RNA, 64 nt, Human
guugagucagcagaaguggaccaaaggauuccucugaauaaaguuauuuaaauugauguucacu

SEQ ID NO: 101086 - RNA, 64 nt, Human
cuccaugaaaagaaguucuugcauaccggaaaguugaauaaauggaugaauucauuccuucaga

SEQ ID NO: 101087 - RNA, 64 nt, Human
caugcaaugcacacuuucuucugaauuagcaaacugaauaaacuacagaaauuuuuuagaauca

SEQ ID NO: 101088 - RNA, 64 nt, Human
uagaagaauaggggcaagacgacaaaaguaccuuugaauaaaacaauuuaagaaauugguuuaa

SEQ ID NO: 101089 - RNA, 64 nt, Human
uauguauuuuuaguaacagaagcaucugguucugugaauaaaggaauguauagauguuuggaug

SEQ ID NO: 101090 - RNA, 64 nt, Human
ugccauaugcagauauccaauuaugugcauccugugaauaaaccacgucuuggucacugucaua

SEQ ID NO: 101091 - RNA, 64 nt, Human
guauuuuggaagauauuugaaauuauguaauucuugaauaaaacauuuuucaaaacucaaguuu

SEQ ID NO: 101092 - RNA, 64 nt, Human
guugacaagcugagaguagaggauacaagugaugugaauaaaauggaaauugcauugaguuaau

SEQ ID NO: 101093 - RNA, 64 nt, Human
uuauaaaucaccugagaauuaccuaaugauggauugaauaaaucuuuagacuacaaaagcccaa

SEQ ID NO: 101094 - RNA, 64 nt, Human
cccuuucccggaauuuuaagugucucuacaacuuugaauaaagggaaaugcccaagauguccug

SEQ ID NO: 101095 - RNA, 64 nt, Human
accauuaaacugaaucagaaauccauuuucuggcugaauaaaaaguuuggcuugccuguguaau

SEQ ID NO: 101096 - RNA, 64 nt, Human
gccuugucucucacugcauuuggucaggggggcaugaauaaaggcuacaggcuccaacgugugu

SEQ ID NO: 101097 - RNA, 64 nt, Human
ucugaacacuuuagguagaugaacuagauguaugugaauaaaaauuauuugguccucacaaaaa

SEQ ID NO: 101098 - RNA, 64 nt, Human
agugggcaggauauuccugauaggaggaacuacaugaauaaagggguaagagcacagaaauuua

SEQ ID NO: 101099 - RNA, 64 nt, Human
acuuugaaguuaauacuuuugugcaacuguguuuugaauaaagccaugacaguguuaaaaacaa

SEQ ID NO: 101100 - RNA, 64 nt, Human
guccuuaaucuugagauaaauccaauagaacuuuugaauaaaagcaaaaguacaaaugucauaa

SEQ ID NO: 101101 - RNA, 64 nt, Human
uaauauuugauaucuauaaagaguauaucuaacgugaauaaauuaugaagcauacuaaugagua

SEQ ID NO: 101102 - RNA, 64 nt, Human
ccaccuuugcaauugucauuuaucuuucacucccugaauaaaguaucuaugcauauauauuugu

SEQ ID NO: 101103 - RNA, 64 nt, Human
ccaccuuugcaauugucacuuaucuuucacucccugaauaaaguaucuaugcauauauauuugu

SEQ ID NO: 101104 - RNA, 64 nt, Human
aauggguucuacugauguuuauuagagaaauggaugaauaaaugaaugaagagauccaaauuca

SEQ ID NO: 101105 - RNA, 64 nt, Human
ccacaguugccaguuucuagcgcuaccaaaugaaugaauaaacaugagcuugcgcuccuagccu

SEQ ID NO: 101106 - RNA, 64 nt, Human
gccacgcuguggcccugccuggcuagucccugccugaauaaaguaaugccuccgcuucaaaguc

SEQ ID NO: 101107 - RNA, 64 nt, Human
ugugugugugugugugugugaaguuuuuuacaggugaauaaacaaaguuugaaagauguuucug

SEQ ID NO: 101108 - RNA, 64 nt, Human
cauuuccuguccuggaauuaguuuuucuaaaaugugaauaaacuuguuuuauaaaaagcaggcu

SEQ ID NO: 101109 - RNA, 64 nt, Human
auuuuaucauccuagaaagccuugacuagaaaaaugaauaaauauugaggguuuccuguccaua

SEQ ID NO: 101110 - RNA, 64 nt, Human
caaaguggcauaaaaaacaugugguuacacagugugaauaaagugcugcggagcaagaggaggc

SEQ ID NO: 101111 - RNA, 64 nt, Human
ggugcaaaaggauuggcccccauuauggugcuucugaauaaaucuugccaagauagacaaacaa

SEQ ID NO: 101112 - RNA, 64 nt, Human
ugagauuauacucaccuuuuaugaaagcacugcaugaauaaaauuauuccuuuguauuuuuacu

SEQ ID NO: 101113 - RNA, 64 nt, Human
caguuuuccacuauuucucuuucuuuucuauuagugaauaaaauuuuauacaagaagcuuuuau

SEQ ID NO: 101114 - RNA, 64 nt, Human
ugaaagguuacccuguaacaugcaauuuugcauuugaauaaagccugcuuuuuaaguguuaacu

SEQ ID NO: 101115 - RNA, 64 nt, Human
uaucuaauuuuugugauagggaaacaaauucuuuugaauaaaaauaaauaacaaaacaauaaaa

SEQ ID NO: 101116 - RNA, 64 nt, Human
aacugggcaucuaacuguuacaccaaaucuuaagugaauaaaacuuuaccaaggcuucucaguu

SEQ ID NO: 101117 - RNA, 64 nt, Human
cucuaguuuugccaauagaaaaugcuucuuccauugaauaaaaguuauuucaaauugaauuugu

SEQ ID NO: 101118 - RNA, 64 nt, Human
agaagggcacaaaaugaaugaauaaauaaauaaaugaauaaagacaaaagccaagguguaugcu

SEQ ID NO: 101119 - RNA, 64 nt, Human
guccugguucauucccagaagggcacaaaaugaaugaauaaauaaauaaaugaauaaagacaaa

SEQ ID NO: 101120 - RNA, 64 nt, Human
agugauguaauuaugguuaguagagguacacuugugaauaaagaggguggguggguauagaugu

SEQ ID NO: 101121 - RNA, 64 nt, Human
aaacaauccaaagaaaugauuguauuaagauuugugaauaaauuuuuagaaaucugauuggcau

SEQ ID NO: 101122 - RNA, 64 nt, Human
aaaaaaaaucacaaauaaaacagugaaguuuuaaugaauaaaguuuaaucaauuaguaauggcg

SEQ ID NO: 101123 - RNA, 64 nt, Human
uugcuaacuuauuuggauuuccuuuuuuaaaaaaugaauaaagacugguugccagaagaguguc

SEQ ID NO: 101124 - RNA, 64 nt, Human
guugagacacaccuagagaaggguuuuugggagcugaauaaacucagucaccugguuucccauc

SEQ ID NO: 101125 - RNA, 64 nt, Human
auuguuugucugucuucauagcagauuuuaauuuugaauaaauaaauguaucuuauucacauca

SEQ ID NO: 101126 - RNA, 64 nt, Human
ucuaagcauuucauuauguguucuacagugucggugaauaaaugaaaccaaucucaauuuagag

SEQ ID NO: 101127 - RNA, 64 nt, Human
acugaagaaauaucuuuuuucuuugauucauuuuugaauaaauauaaaaugaauaacuauuaag

SEQ ID NO: 101128 - RNA, 64 nt, Human
uuuucuuaacuaaaauuacuuuuuacuuuaagcuugaauaaaaaucuucauugguaacuguaug

SEQ ID NO: 101129 - RNA, 64 nt, Human
gauuucugcacuaucuuuuucucaguuaccugcaugaauaaauaaugagaaauauuuugugacu

SEQ ID NO: 101130 - RNA, 64 nt, Human
uccccaauccagauaauaaagacuuuguaaaacaugaauaaaacacauuuuauucuauaauuuu

SEQ ID NO: 101131 - RNA, 64 nt, Human
ugcacagugccugucaaacagaugcaaaccuuccugaauaaagccuuggagaccagcgcugucu

SEQ ID NO: 101132 - RNA, 64 nt, Human
gcauggaauauuauauuuuauuguucauaauuaaugaauaaaauugauaugaaugaauauagug

SEQ ID NO: 101133 - RNA, 64 nt, Human
uggaugaaacagugucugcuauuuuauucacaauugaauaaaaugaaaacuucaauuaauugug

SEQ ID NO: 101134 - RNA, 64 nt, Human
cuaguaccaugucguaguuacucucaggcauggaugaauaaauguuauagcugcauuugucugg

SEQ ID NO: 101135 - RNA, 64 nt, Human
cggaauuagcuaaaccuaaaaauguuugcauuaaugaauaaauucuuccugcauuccuuggccc

SEQ ID NO: 101136 - RNA, 64 nt, Human
uuaccuuuauuuaaaugaugguaagguggaauauugaauaaaauuagguuuuguguuuuguucu

SEQ ID NO: 101137 - RNA, 64 nt, Human
auggcuaaaccaaguuaacuuuuauuauagacagugaauaaaacaccaaaaacccaaaaaugcu

SEQ ID NO: 101138 - RNA, 64 nt, Human
cugaacaguuuacagcacaauauuuauuuuaaagugaauaaaauguccacaagcaguguuguca

SEQ ID NO: 101139 - RNA, 64 nt, Human
ccauguguuagauggaagcauuuccuauccagugugaauaaaaagaacaguuguaguaaauuau

SEQ ID NO: 101140 - RNA, 64 nt, Human
agagaagcagaauccuuacuuuugugagucugguugaauaaagcuuauucuuuguccaugugua

SEQ ID NO: 101141 - RNA, 64 nt, Human
uaaugaagcugcuguguguauuuaugaauauuaaugaauaaaaacugcuuggaugguuuaccuu

SEQ ID NO: 101142 - RNA, 64 nt, Human
ccuggaaugugguaggugcucaguaaauguguguugaauaaaugaaugaaugaaugaacaaaug

SEQ ID NO: 101143 - RNA, 64 nt, Human
cagcuagccagugcucagcuaaauauuuguugacugaauaaaugaaugcacaaccaaauuauug

SEQ ID NO: 101144 - RNA, 64 nt, Human
uaauaauugcaccuaccucccagggguaacuaaaugaauaaauauaauaaaguacuuacagugg

SEQ ID NO: 101145 - RNA, 64 nt, Human
uauuuggacuuccugcauggauauacuuaccauuugaauaaagggaccacaacuuggauaauuu

SEQ ID NO: 101146 - RNA, 64 nt, Human
guugaaaugcaaaaauacuaauuagagaauaaugugaauaaaaugggaaucuucuugguauuuu

SEQ ID NO: 101147 - RNA, 64 nt, Human
acagccuuccauguucauuugucuaccucuuaacugaauaaaaaagccuacaguuuuuagaaaa

SEQ ID NO: 101148 - RNA, 64 nt, Human
gcauuuuuuggagcaaaaacuauggguuguaauuugaauaaagugucacuaagcaguuauaacg

SEQ ID NO: 101149 - RNA, 64 nt, Human
uuggacauagacuucauuuccuuucaguauaagcugaauaaauuuagagcuuucaaacuggaaa

SEQ ID NO: 101150 - RNA, 64 nt, Human
guauccccucccaaagaaucaugggcuuuuuuuuugaauaaaaaagcagacaaauagacuuucu

SEQ ID NO: 101151 - RNA, 64 nt, Human
uuauaccuggaugauucaggagaguguauaugaaugaauaaagcauccaaguauauaugaauga

SEQ ID NO: 101152 - RNA, 64 nt, Human
auaugaaugaauaaagcauccaaguauauaugaaugaauaaaguauguaaguaucaccagaaaa

SEQ ID NO: 101153 - RNA, 64 nt, Human
acugggauguggaacuguggcggguggagaggucugaauaaaccgucugugucauggccccgcc

SEQ ID NO: 101154 - RNA, 64 nt, Human
cuuaccuaagaauuucaaauuucuaccauaacacugaauaaaguuugacuuuuugaaacuucca

SEQ ID NO: 101155 - RNA, 64 nt, Human
ucacuaagaauuugcagaauuguuuugagaugugugaauaaagguaauuuuauugaaucuucau

SEQ ID NO: 101156 - RNA, 64 nt, Human
caagcaaaaucuuguaguuuuuaaucuuaaacacugaauaaaaaaacuuuccccuaaauuggaa

SEQ ID NO: 101157 - RNA, 64 nt, Human
uuaaugaugauuuuguguuuaaguuccaaacauuugaauaaaauaauugacaauauuugccucu

SEQ ID NO: 101158 - RNA, 64 nt, Human
aggucaaaucaaauuaaagaugauuuuuuuaaugugaauaaaguuauguucugauaguuuguac

SEQ ID NO: 101159 - RNA, 64 nt, Human
auuuaauuauuuaugcuauaggugauauucucuuugaauaaaccuauaauagaaaauagcagac

SEQ ID NO: 101160 - RNA, 64 nt, Human
gcuauuuuugucuuguacuacuuugacccaccccugaauaaaccucaauugcuggaguggggug

SEQ ID NO: 101161 - RNA, 64 nt, Human
gaauguagagcuagccaacauaucacauucugaaugaauaaauaacuaugcacaauuauguuuc

SEQ ID NO: 101162 - RNA, 64 nt, Human
ggggggaguguggaaaagggaaaacuguuuuagcugaauaaaggugaauuauauaauuuauaau

SEQ ID NO: 101163 - RNA, 64 nt, Human
auaacaaauguucauuauaaacucuaggaaagauugaauaaaaucuguuuacuuaacauucuuu

SEQ ID NO: 101164 - RNA, 64 nt, Human
acaaaguuuuauauguagaaaagugggguccuuuugaauaaaagaucauucaacuaaaaauauu

SEQ ID NO: 101165 - RNA, 64 nt, Human
guaauuuugugauuugucuauauuguugcauuuaugaauaaaucauuuaucugcugcugaguag

SEQ ID NO: 101166 - RNA, 64 nt, Human
uuugaugauggacauuaauaguucuaggcuauuaugaauaaaguuuccaugaacaucuauguac

SEQ ID NO: 101167 - RNA, 64 nt, Human
cagagacccugccucuguuugaccccgcacugacugaauaaagcuccucuggccguuuaugauu

SEQ ID NO: 101168 - RNA, 64 nt, Human
cagcgggugacguguguucuuuugaguccuuguaugaauaaaaggcuggaaaccuacagcaggg

SEQ ID NO: 101169 - RNA, 64 nt, Human
cggccugauacugaaauagcgucuacucgugcacugaauaaaaacagaaacuugaucauuuuau

SEQ ID NO: 101170 - RNA, 64 nt, Human
aauggaaagugucuguuuugugguguauauacuaugaauaaaaucacagcauuuucuaagcauu

SEQ ID NO: 101171 - RNA, 64 nt, Human
uaauguguucuggucaucccugauugaugcuaucugaauaaaguuauaagcuccuauaagccau

SEQ ID NO: 101172 - RNA, 64 nt, Human
aggacuuacuauaccuuguacuguuaagaucuacugaauaaaggacguucucucacuaaggacc

SEQ ID NO: 101173 - RNA, 64 nt, Human
aacaaguuccaguugagaaacacuaagguuauggugaauaaaaccauagggagcuucuuccccc

SEQ ID NO: 101174 - RNA, 64 nt, Human
aacggugauuucuguccaagugcagauuuccguuugaauaaagcuucgcuucuagguggcacug

SEQ ID NO: 101175 - RNA, 64 nt, Human
ucaccucaauugauuuuuccauuucuuagguccuugaauaaaugauacuuagguauaccucaga

SEQ ID NO: 101176 - RNA, 64 nt, Human
cucuacuacuguugauuuugcccucggagcaaacugaauaaagcaacaagaugaaaacugagua

SEQ ID NO: 101177 - RNA, 64 nt, Human
ucugcuguuuuguuauaaugccugauacacaucuugaauaaagucuuaacauuuuucuuuuaaa

SEQ ID NO: 101178 - RNA, 64 nt, Human
gcagguuuuucuaugggcauguuuuuaauucauuugaauaaauaccaagagcuucagugcugga

SEQ ID NO: 101179 - RNA, 64 nt, Human
agacuucuuggugguuuccaaguuuuggcaauuaugaauaaagcuguuguaaacaucuuugugc

SEQ ID NO: 101180 - RNA, 64 nt, Human
uaggguuguacuaugcuguuaugaguggcuuuaaugaauaaacauuuguagcauccucuuuaau

SEQ ID NO: 101181 - RNA, 64 nt, Human
uucacuccuaacugugacauuuuuaucaaaugugugaauaaauacauaaagauugguacaaaaa

SEQ ID NO: 101182 - RNA, 64 nt, Human
ucccacggaaucagauggauccuccacgauuacgugaauaaaaugauggaaccaaaaaucacug

SEQ ID NO: 101183 - RNA, 64 nt, Human
uguuaauauuuaagguguauuuauguuaccguucugaauaaacagaauggaccauugaaccagu

SEQ ID NO: 101184 - RNA, 64 nt, Human
agaaaagaaaaacacagcaugagaacacaguaaaugaauaaaaccauaaaauauuuagccccuc

SEQ ID NO: 101185 - RNA, 64 nt, Human
ugugcaaauaaugaaagagcucgguaaagcauucugaauaaauucagccugacugaauuuucag

SEQ ID NO: 101186 - RNA, 64 nt, Human
uaaaacuuuuuucccucucaacucaaaaggaccaugaauaaauaaagcacaaaaaccucucuua

SEQ ID NO: 101187 - RNA, 64 nt, Human
aguuuggcuuuuuaaauuauuuugugccuauuuaugaauaaauauuacaaauucuaaaagauaa

SEQ ID NO: 101188 - RNA, 64 nt, Human
cugugaauaauugagaacuuuuuggagucaaguaugaauaaagguguggcagaauauaauaauc

SEQ ID NO: 101189 - RNA, 64 nt, Human
uugacuaacugagcuccuucacuuaaaaaucagcugaauaaauuccuuaaguauacuucaagac

SEQ ID NO: 101190 - RNA, 64 nt, Human
uagugucauuuguaugagagaggaucauggacaaugaauaaaugcacacuucugacuauaauuu

SEQ ID NO: 101191 - RNA, 64 nt, Human
caagggucuagcacaaugcuugaugcauauugugugaauaaauacuuuguugccaaauccagug

SEQ ID NO: 101192 - RNA, 64 nt, Human
accagaaagggauguaagucucgcuuauauuuugugaauaaaaugaucaaaagcucauugauuc

SEQ ID NO: 101193 - RNA, 64 nt, Human
ugacaaugaccaccuuugcagaaaguaaacugauugaauaaauaaaucuccguuuucuucaauu

SEQ ID NO: 101194 - RNA, 64 nt, Human
uguccaugccuacagauaauuuauuuuguauuuuugaauaaaaaacauuuguacauuccugaua

SEQ ID NO: 101195 - RNA, 64 nt, Human
gggaaaaaagccuucauuuuugaccuccccuuacugaauaaauugaaauaugaaguuugucuuu

SEQ ID NO: 101196 - RNA, 64 nt, Human
auggugcauauaugauacaguuaccuaaucauguugaauaaaugggcaugccaaaaauucuuac

SEQ ID NO: 101197 - RNA, 64 nt, Human
ugcgacguauucauggcacaaagcuuucccaagcugaauaaaaacaaacauuaacaaauuuuua

SEQ ID NO: 101198 - RNA, 64 nt, Human
acaaacaaaacuggcaagaucacuaaaaaauaagugaauaaacaaauaaguaguaaaauaaggu

SEQ ID NO: 101199 - RNA, 64 nt, Human
aauucuucccuucuucccuccaccuuuccuucauugaauaaaccucuguucaaagagauugccu

SEQ ID NO: 101200 - RNA, 64 nt, Human
aacauuucuagaaaaaacuacuuuuguaccagugugaauaaaguuaguguguugucugugcagc

SEQ ID NO: 101201 - RNA, 58 nt, Human
gcagaaugguucccgucugagccaguacugaauaaacucaaaacucuugaaauuaguu

SEQ ID NO: 101202 - RNA, 64 nt, Human
uguaaaaagugcaguaaauauuuacuauuuauaaugaauaaacaguuaugaaaacuugcccacu

SEQ ID NO: 101203 - RNA, 64 nt, Human
gcuucuucugauucuugcuaauuuccaaccauauugaauaaaugugaucaagucaaggaugcag

SEQ ID NO: 101204 - RNA, 64 nt, Human
cuugaacccuuuguggaaagaaccugggugugagugaauaaaaaguaaagagcgacgcgcuaua

SEQ ID NO: 101205 - RNA, 50 nt, Human
cuauucagccacuuaucugaugaauaaaaccauaaaucuuugagaguuuu

SEQ ID NO: 101206 - RNA, 64 nt, Human
gggugcuggcgguggggaccaagauccggaaagaugaauaaagacaaacaugacaaacuaagaa

SEQ ID NO: 101207 - RNA, 64 nt, Human
uguguauauuuuucuuuuuaaucuucccaauagcugaauaaaguauagauacuauuauuuguac

SEQ ID NO: 101208 - RNA, 64 nt, Human
uauagauuugcauuuugucuuguaaaauuuuauuugaauaaauucuuccuguagguaaugggaa

SEQ ID NO: 101209 - RNA, 64 nt, Human
auuuacuggccauuuuaguuguaucacagcagaaugaauaaaagauggugaaggcuguuaauuu

SEQ ID NO: 101210 - RNA, 64 nt, Human
caguaaguguugguaccuuuuagacucauaaaauugaauaaaccauugcaaugcuuuaaaaaaa

SEQ ID NO: 101211 - RNA, 64 nt, Human
cacuaauucauaaucacucuaauuaauuguaaucugaauaaaguguaacaauuguguagccuuu

SEQ ID NO: 101212 - RNA, 64 nt, Human
uuuccauuaaacggaaagccucccugacauuaacugaauaaaaccucauguugugggacuucug

SEQ ID NO: 101213 - RNA, 64 nt, Human
uccuaagagcuaguauguuguaaaaccugccaccugaauaaaaugaaaaaaaaaguguuuuuuu

SEQ ID NO: 101214 - RNA, 64 nt, Human
cagacgugcucuguauucagcaauaguuugugaaugaauaaauuacuaauccuccuugucgcuu

SEQ ID NO: 101215 - RNA, 64 nt, Human
caauucacuuaacuucuccauggcugcuuccugcugaauaaauagggacaggcauaauggauag

SEQ ID NO: 101216 - RNA, 64 nt, Human
caugguuuucuuuuucuuaguaugggaguguccaugaauaaauucaugggcauccucauaacuc

SEQ ID NO: 101217 - RNA, 64 nt, Human
cuugccccacccaacaagccauaguggagagaacugaauaaacaggaaaaugccagagcuugug

SEQ ID NO: 101218 - RNA, 64 nt, Human
guuugguuucuguaguuuuaauuuuuaauaaaguugaauaaaauauaaacgcugguaucuguug

SEQ ID NO: 101219 - RNA, 64 nt, Human
gcuguccacccuuccaggaaagggacauuguaaaugaauaaaacauucucaacuccucuugaau

SEQ ID NO: 101220 - RNA, 64 nt, Human
aauaaaaauaaguucuuaaaauuuauuuuuuuccugaauaaauuguauuugguaaacuucugcc

SEQ ID NO: 101221 - RNA, 64 nt, Human
acugucuucuagcagugagccaaauguaaaauagugaauaaagucauuauuaggaaguucaaaa

SEQ ID NO: 101222 - RNA, 64 nt, Human
uuuugauuuuuuuugcuacugugcaaguuuaaugugaauaaaaucuuuguggaaugaugauuuu

SEQ ID NO: 101223 - RNA, 64 nt, Human
uugaucagagagccuguuuccuuauucaagagaaugaauaaaacauuuaggcaggagacuuucu

SEQ ID NO: 101224 - RNA, 64 nt, Human
auaucaaacuuuuuuauauaugagaacuaauucuugaauaaaccccaaaguucacucucuuguu

SEQ ID NO: 101225 - RNA, 64 nt, Human
uuugaaugacagcauauuguaagaaaaaaaaaggugaauaaaauuugacauuagauuauaaaug

SEQ ID NO: 101226 - RNA, 64 nt, Human
agagagaaaccuguauaauaguaagaucuuauuuugaauaaaaacgucuauaauuacaaggagu

SEQ ID NO: 101227 - RNA, 64 nt, Human
auuuuaugccuuugcaaagauucguucuuguauuugaauaaauucaguugcuaaaguagaucca

SEQ ID NO: 101228 - RNA, 64 nt, Human
uugagaccaaucuuuauuuguacuggccaaauacugaauaaacaguugaaggaaagacauugga

SEQ ID NO: 101229 - RNA, 64 nt, Human
ccagauuucaagaggagaaauuuaguuuuaaaccugaauaaacauguuuguuuucagugcucac

SEQ ID NO: 101230 - RNA, 64 nt, Human
uuaccauguaccagaauuuuacuaggcacaaccaugaauaaaaauacaauucucuugcaccauu

SEQ ID NO: 101231 - RNA, 64 nt, Human
acccuuuagugaaaucagaaaaauaaaguaggcaugaauaaauguucaggacacacacauacac

SEQ ID NO: 101232 - RNA, 64 nt, Human
auguuugagucaggaagguaaggcggggagugacugaauaaacucugccuuuuaaauugagcau

SEQ ID NO: 101233 - RNA, 53 nt, Human
auggacugcaaggauauugagagugaauaaaauuggacuuuguuuaaaauaag

SEQ ID NO: 101234 - RNA, 64 nt, Human
aagacaaacugcuucccuuacuuugcugaggguuugaauaaaccuaggacuuccgagcuauguc

SEQ ID NO: 101235 - RNA, 64 nt, Human
caauuaaaguaauguugaccaucccccucucagcugaauaaagaaaaauuuaguucaauuuauu

SEQ ID NO: 101236 - RNA, 64 nt, Human
cccccugcuugccauccugcaguaguauaaaucaugaauaaaaaauaauuuugcuguuguagua

SEQ ID NO: 101237 - RNA, 64 nt, Human
uggaauauccgaugcuuugaaucaugcacuguguugaauaaacguaucugcuaaaucaggcuuc

SEQ ID NO: 101238 - RNA, 64 nt, Human
cuucugccuauugcugauacugucuuugcauacaugaauaaaaauaaaguuuuuuucuucaaaa

SEQ ID NO: 101239 - RNA, 64 nt, Human
agguugaaagcucucuguauuuuaguuaacaccuugaauaaaauggaaaaagcaguuauagcaa

SEQ ID NO: 101240 - RNA, 64 nt, Human
gcuuuuuuguauuuauuaauaucaaauucacuuaugaauaaacuugauaauggaaacggacaaa

SEQ ID NO: 101241 - RNA, 64 nt, Human
cuaaauauacaaggcaucuacccagccccaauagugaauaaaagucacaaauuuaaguucaaca

SEQ ID NO: 101242 - RNA, 64 nt, Human
cccacucugcaccccaaaugggaagcauacggucugaauaaauccaaguuuuauucucuacucu

SEQ ID NO: 101243 - RNA, 64 nt, Human
uuaauuagcagcaaguugugaucacuuucccaggugaauaaaucauuucaaagcauuguuuuug

SEQ ID NO: 101244 - RNA, 64 nt, Human
ugacagcagcucuguccccaccccaugggccucaugaauaaauggcuucuugccggccuuccuu

SEQ ID NO: 101245 - RNA, 64 nt, Human
ugaaugaagaaggccuaaucucucucuuuuucagugaauaaauggaacaccauuucuggauucu

SEQ ID NO: 101246 - RNA, 64 nt, Human
ggagguggcucuggcucagagccgucaguguggcugaauaaaggcucucuuggguauggcugug

SEQ ID NO: 101247 - RNA, 64 nt, Human
uuccauugaggagcccaggcuggggccacaacccugaauaaacucuguuggcccauaaccuuca

SEQ ID NO: 101248 - RNA, 64 nt, Human
agacacucuguacaguuuuuucaaucccuguuuuugaauaaauauucucagcgaccaggaaguu

SEQ ID NO: 101249 - RNA, 64 nt, Human
ccccucuagccccuguaaauacuggaucaaugaaugaauaaaacucuccuaagaaucuccugag

SEQ ID NO: 101250 - RNA, 64 nt, Human
guuccaguuuuguuuugagggcuauuagaagggcugaauaaagggaacaugcagcucugcagca

SEQ ID NO: 101251 - RNA, 64 nt, Human
guuuuucugaugcccuacgauccuaaagaacagaugaauaaaacuaaugaauuaaauaugaaau

SEQ ID NO: 101252 - RNA, 64 nt, Human
uucuccauuauuaauguguucugaaaauauauuaugaauaaauacaucaccacacccaaaccau

SEQ ID NO: 101253 - RNA, 64 nt, Human
uuuagucaccuccagguuauaugcaucgagaaccugaauaaaucaugccacuauauuaauuuau

SEQ ID NO: 101254 - RNA, 64 nt, Human
accagauuaugauguugccagaauucacucaauuugaauaaagaugaacaguauuuguuuucuu

SEQ ID NO: 101255 - RNA, 64 nt, Human
ccuccucucuuccuauagaacacugugcauaccuugaauaaagagcuuauuauacuauauuguu

SEQ ID NO: 101256 - RNA, 64 nt, Human
cacauguacugguggaguuuccagaccaccaguaugaauaaaagcuuguucugugugacccagc

SEQ ID NO: 101257 - RNA, 64 nt, Human
aauguauauauuuaauaaugucauguauaaaauaugaauaaaauguccacauaggaaauuaaca

SEQ ID NO: 101258 - RNA, 64 nt, Human
aaccaccuauucauugacuucuuuuguguuagagugaauaaaauuuuguucaugccaguguuau

SEQ ID NO: 101259 - RNA, 64 nt, Human
gguauaggacaugaggaaauguuguguucagaaaugaauaaauggaaugcccucauacaagggg

SEQ ID NO: 101260 - RNA, 64 nt, Human
uaggauuuaaaauaugaaaugguggucugcugugugaauaaauaauuccugaagaaugaagaag

SEQ ID NO: 101261 - RNA, 64 nt, Human
uaacuccugauucuuccuuuucggauacuauugaugaauaaagaaauuaaagugaugguuuuau

SEQ ID NO: 101262 - RNA, 64 nt, Human
auauggauaugaauucccagauuuuauauacucuugaauaaaagguuuauuuuuauuuauaagu

SEQ ID NO: 101263 - RNA, 64 nt, Human
uaaggaugugcuggucccccuacucugugugugcugaauaaauggcuuguaaagaaguuuuucc

SEQ ID NO: 101264 - RNA, 64 nt, Human
caguggagucuucuuuagugccaguccuugugguugaauaaaaaggaugguccgcuuucuauug

SEQ ID NO: 101265 - RNA, 64 nt, Human
cuacgaugacugggcaagaagaaagaugggaaacugaauaaagcaguugaucagcaucauugga

SEQ ID NO: 101266 - RNA, 64 nt, Human
guccauaccacagugccuugcaaaaaacaccacaugaauaaagcaauaaaauuugauuguuaag

SEQ ID NO: 101267 - RNA, 64 nt, Human
acuucuaaaauggaauuuggugcauauguacugcugaauaaagaccgaugaagagguuugagua

SEQ ID NO: 101268 - RNA, 64 nt, Human
uauccuauccuuguuuacgauguauaaaaagaugugaauaaauuauauggacccccuaagucuu

SEQ ID NO: 101269 - RNA, 64 nt, Human
augauacuaugcaaugcuuguuuuccaacuauguugaauaaauaguaauauuuaucaguaaaua

SEQ ID NO: 101270 - RNA, 64 nt, Human
cugaacaccuuguggaagcaaaaaucugaaaaugugaauaaaauuauuuuggauuuuguaaaac

SEQ ID NO: 101271 - RNA, 64 nt, Human
uggaauggggcuaaggugggagugaacacuggggugaauaaauuuuaaaucaauucaaguaucu

SEQ ID NO: 101272 - RNA, 64 nt, Human
ggguuuuagaaaacagccgucagccaaauguaauugaauaaaguugaagcuaagauuuagagau

SEQ ID NO: 101273 - RNA, 64 nt, Human
gaguguaacaaaaccuuuaaacagcccucaccggugaauaaacauaagaaaaaucaugcuggag

SEQ ID NO: 101274 - RNA, 64 nt, Human
cgcccagccuguuuuuauaaacugaagccaacugugaauaaacuguagccuacauuacucaucc

SEQ ID NO: 101275 - RNA, 64 nt, Human
agucacuguauaagggucuaugaguagcuguguaugaauaaauauuaccugucuaccucaaaau

SEQ ID NO: 101276 - RNA, 64 nt, Human
gucuuaaauuggacaguugaacuuaaaagguuuuugaauaaauggaugaaaaucuuuuaacgga

SEQ ID NO: 101277 - RNA, 64 nt, Human
uuacuguacacaguagcuuuagauggcguggacgugaauaaaugcaacuuauguuuucuuguug

SEQ ID NO: 101278 - RNA, 64 nt, Human
caauucugcccaaaaauaugguugauaguuuaccugaauaaaugguaguaaucacaguuggccu

SEQ ID NO: 101279 - RNA, 64 nt, Human
gaauacuaugaauguauucauauuuuuucuauauugaauaaacaauguaacauagauaacaaua

SEQ ID NO: 101280 - RNA, 64 nt, Human
uuuuaaauuagagaacacaaauaaaauguauuagugaauaaaugcuucucuagauccauauuaa

SEQ ID NO: 101281 - RNA, 64 nt, Human
cagaauuacuuacagacacucuuucuugguaucuugaauaaauuguguaaauuauuuugaaaag

SEQ ID NO: 101282 - RNA, 64 nt, Human
uuagaaaaauugguauaaguuccuaauuaaaagcugaauaaacuuugagaaauuauuucugagu

SEQ ID NO: 101283 - RNA, 64 nt, Human
cacaagagaauguuuuaagcauugguagcauaauugaauaaaagaauaguuuccugaugucacu

SEQ ID NO: 101284 - RNA, 64 nt, Human
uaaaaauacguagagugacuuagacauguuugcaugaauaaauauauuucuagagaacaguuua

SEQ ID NO: 101285 - RNA, 64 nt, Human
acaauguggaagaggcugagguuguggaacacacugaauaaaauaaaggcagugugacuccaaa

SEQ ID NO: 101286 - RNA, 64 nt, Human
augacaguuuguguuccuacaaaaauaaacaaaaugaauaaaaagggaucaccauucaauuuga

SEQ ID NO: 101287 - RNA, 64 nt, Human
acugaaaaaacagggcgggagugguauguggcccugaauaaaagaggaaaagccaaacgagggu

SEQ ID NO: 101288 - RNA, 64 nt, Human
uaaaauguuaacacucaucacauuuuaucuauguugaauaaaagugguucugugugauugucau

SEQ ID NO: 101289 - RNA, 64 nt, Human
guguauauuuuguugugauuaucuuuuuguggugugaauaaaucuuuuaucuugaauguaauaa

SEQ ID NO: 101290 - RNA, 64 nt, Human
gaaaaaguauuguuuuccagugucacuugacucuugaauaaaaauaacugcaguguuccccaaa

SEQ ID NO: 101291 - RNA, 64 nt, Human
guguacuguggguauucuccagcauacuugaaaaugaauaaaguuagauugcucacauugaagc

SEQ ID NO: 101292 - RNA, 64 nt, Human
uuucuguuuccaggguuauguacuuguguccagaugaauaaagcagaaaaagaggggauugagu

SEQ ID NO: 101293 - RNA, 64 nt, Human
guauuguauuccaacccaauuuuacuggaacuauugaauaaaucuuuuauuuucuuucagguuu

SEQ ID NO: 101294 - RNA, 64 nt, Human
aaaauuccguaaugguguauuaguauuagaauagugaauaaaaugggaaaguuauacauguaua

SEQ ID NO: 101295 - RNA, 64 nt, Human
acagaagcuuuacccaggacauuuuauuucucuuugaauaaaucuauuauuucacuuaaauacu

SEQ ID NO: 101296 - RNA, 64 nt, Human
aaauuguacauauuuguggaauaauguaaaauguugaauaaaaauauguacaaguguuguuuuu

SEQ ID NO: 101297 - RNA, 64 nt, Human
agguuaaauuugugaaugaucauuucaaauauauugaauaaaauaagcaaaagcuauuguuauu

SEQ ID NO: 101298 - RNA, 64 nt, Human
gaaugugugaaaauaauuggauuuuuaaacaaugugaauaaagaggcuuguguuuugauuacua

SEQ ID NO: 101299 - RNA, 64 nt, Human
uagaugcuacaguauuuuuuauuuaauuauauuaugaauaaaauuguuauuucaauaguaccca

SEQ ID NO: 101300 - RNA, 64 nt, Human
aaaugaccaaaacaugucuuucuugaauuaacuuugaauaaaaguuuguauauuauuuguuuca

SEQ ID NO: 101301 - RNA, 64 nt, Human
ucuacuuuaccuacaaguucuauauauguagaaaugaauaaauauauauuuaaguacaguuuuc

SEQ ID NO: 101302 - RNA, 64 nt, Human
uugguuguagaguggcccagaauugcauucugaaugaauaaagguuaaaaaaaaauccccagug

SEQ ID NO: 101303 - RNA, 64 nt, Human
aggcuaauuuaaauauaaauaauauaaagugcucugaauaaagcagaaauauauuacaguucau

SEQ ID NO: 101304 - RNA, 64 nt, Human
guauuaaguugucuaccauguuuucuuuucuagcugaauaaaccacaucaaaggaaagggacca

SEQ ID NO: 101305 - RNA, 64 nt, Human
uuuuguuucugccuuaucuuucuguguuuuuuucugaauaaaauauucagaggaaaugcuuuua

SEQ ID NO: 101306 - RNA, 64 nt, Human
gacccugcgacccacucuuuggaccagcagcggaugaauaaagcuuccuguguugugugauacu

SEQ ID NO: 101307 - RNA, 64 nt, Human
gucaguguuuccauguuauggaucucucugcguuugaauaaagacuaucucuguugcucacaaa

SEQ ID NO: 101308 - RNA, 64 nt, Human
cgagggcgcauccaagcgggggccacuugagaagugaauaaauggggcgguuucggaagcguca

SEQ ID NO: 101309 - RNA, 64 nt, Human
uuuuucuuuggugucucacaaauuacccaauuguugaauaaaacuauaaauauguuaauaccag

SEQ ID NO: 101310 - RNA, 64 nt, Human
ucuuuucaugugcagauugcaguucugauucauuugaauaaaaaggaacuuggaaaacaugguc

SEQ ID NO: 101311 - RNA, 64 nt, Human
uaaauaaccaguauuuaaguaaauguauaacgaaugaauaaauacaugcauaauauuuucaaag

SEQ ID NO: 101312 - RNA, 64 nt, Human
aacccuguggcagugacacgggcaaauuggcauuugaauaaagcccugggaccaccucaacaug

SEQ ID NO: 101313 - RNA, 64 nt, Human
acagcucugaauguauuugcaugggauugguccuugaauaaaauugucuuacuucauuaauacu

SEQ ID NO: 101314 - RNA, 64 nt, Human
ugggcuucucuaauuacuauacauugugcucauaugaauaaaagaaauuuuaaaagaaaaaaaa

SEQ ID NO: 101315 - RNA, 64 nt, Human
ugucucauugguucauagucuuuauuuuguccuuugaauaaacauuaaaagauuucuaaacuuc

SEQ ID NO: 101316 - RNA, 64 nt, Human
caaagagccauucagcuucagucuuuacauaccaugaauaaaacauuaaaacaucauauggaga

SEQ ID NO: 101317 - RNA, 64 nt, Human
ucuaaaucuagauauggcuucaccaaggaagugaugaauaaauacaaggugcgcugccuuuaaa

SEQ ID NO: 101318 - RNA, 64 nt, Human
gacauugagauuguccuuuucccugaucaaaaaaugaauaaagccuuuuuaaacaaaauccaaa

SEQ ID NO: 101319 - RNA, 64 nt, Human
acguguuugaaguguuaaaauucaaagggaucauugaauaaaacggguguagaguacaggaaug

SEQ ID NO: 101320 - RNA, 64 nt, Human
uccauauuuuuuuuaaauuuguuggcucuuaagaugaauaaaguuuauaggugcaucugccucc

SEQ ID NO: 101321 - RNA, 64 nt, Human
gcaacagauaucauuucaggugacuuaacaugaaugaauaaaagucaaugcuauuggauuguuu

SEQ ID NO: 101322 - RNA, 64 nt, Human
aaucuaucuuccaauacacuguuuaauauagcacugaauaaaugaugcaaguugucaauggaug

SEQ ID NO: 101323 - RNA, 64 nt, Human
ccagucuuuuuaaacuuguaaagacacaucuuauugaauaaagagaugagagcuuaaguuugua

SEQ ID NO: 101324 - RNA, 64 nt, Human
ccaacugauugucacuuaaaugaaaauuuaaaaaugaauaaaaagacauacuucucagcugcaa

SEQ ID NO: 101325 - RNA, 64 nt, Human
uagauauuugucugacaaaguguaauuacucaacugaauaaaugacugagaacaaguuacaaaa

SEQ ID NO: 101326 - RNA, 64 nt, Human
aaaccccaaacuguugauuauuagccagguaaugugaauaaauucuauaggaacauaugaaaau

SEQ ID NO: 101327 - RNA, 64 nt, Human
cucgcugguucugugcgaaggguauuccuggugcugaauaaaggguguugcugucaaggcugac

SEQ ID NO: 101328 - RNA, 64 nt, Human
guacauacucaacaaagguuugugggacaaagggugaauaaaaugaaugaauuacaaugaacaa

SEQ ID NO: 101329 - RNA, 64 nt, Human
uuuuaagaguuggggggaguaucuauaguaaacuugaauaaaggggacaaagcuagaacuuauu

SEQ ID NO: 101330 - RNA, 64 nt, Human
cacaguuuuaagcacauaauguaauucuaaaagaugaauaaacuagagagguucacuuugugcc

SEQ ID NO: 101331 - RNA, 64 nt, Human
auagguuggcacugacuauaucucugcuugacugugaauaaagucagcugugcaguauuuauag

SEQ ID NO: 101332 - RNA, 64 nt, Human
aauuagaauuuugcuguaauaaaguuucaaaauuugaauaaaauaauuaaauuuuuugaggaag

SEQ ID NO: 101333 - RNA, 64 nt, Human
gaaaucauguaaaauaagauauuagacuguuuuuugaauaaaauauuuuuauugauugaaccuu

SEQ ID NO: 101334 - RNA, 64 nt, Human
cauggaaaaaauuuuccauccacaaauacaaacaugaauaaauacauucagaauguuggcacca

SEQ ID NO: 101335 - RNA, 64 nt, Human
aaaccaguuuugaggucuuagacuuauaauucuuugaauaaaacugauaacuuauuuguauaau

SEQ ID NO: 101336 - RNA, 64 nt, Human
gagggugacugaugauacaugcauacauauuuguugaauaaaugaaaauuuauuuuuagugaua

SEQ ID NO: 101337 - RNA, 64 nt, Human
gugauuauagagaaugauuauaugauguuuguaaugaauaaaauaguaguuucauuauuuggca

SEQ ID NO: 101338 - RNA, 64 nt, Human
uucuuuuucugugauuaugaaaugcaauaaaaucugaauaaagggcaaaguuucuuccugauca

SEQ ID NO: 101339 - RNA, 64 nt, Human
uaccuuaguagaauacagagcuuugguaauuacaugaauaaaauuaagaaaauagccauauaca

SEQ ID NO: 101340 - RNA, 64 nt, Human
uucacuuuauaguuugggagacagaaucaggucuugaauaaaauaauuguaaugagugcuaaau

SEQ ID NO: 101341 - RNA, 64 nt, Human
aaauguacuuucuaauaaguaaaauuucuaauuuugaauaaaagauuaaauuuuacugaaauau

SEQ ID NO: 101342 - RNA, 64 nt, Human
uguuuguauuguuuuaggaaaccaggcuguuuugugaauaaaacgaaugcauguuugugucacg

SEQ ID NO: 101343 - RNA, 64 nt, Human
guaaaguugagcuucuuucuagauauuaggccuuugaauaaaauucuaugugagucagauuuaa

SEQ ID NO: 101344 - RNA, 64 nt, Human
uaaaauaaaauauaaaauaacuuaaaaagaacuuugaauaaaauucuaugaaaaaagacacuag

SEQ ID NO: 101345 - RNA, 64 nt, Human
uauaauugaaauaaaauuauaaucugccugaaaaugaauaaaaauaaaacauuuugaaaugugu

SEQ ID NO: 101346 - RNA, 64 nt, Human
uauaaauauuuuauaucaggaaaguucauauuucugaauaaauuaauaguauucauuccugaag

SEQ ID NO: 101347 - RNA, 64 nt, Human
gacaauuuugauucucacugguauguuuaaaaacugaauaaaaggaauagaauuuuuuuuugau

SEQ ID NO: 101348 - RNA, 64 nt, Human
uguguaacauaaauaagccuucugagaagcagggugaauaaaguuuagggagcugggacaccug

SEQ ID NO: 101349 - RNA, 64 nt, Human
aaaucuacuuuugcaauuuuaaguaauaauuuuaugaauaaaaaugggaaaugcuuccuaauuc

SEQ ID NO: 101350 - RNA, 62 nt, Human
ggaagaaaggugaugaaaacuccuggucauuccuugaauaaacuugauuuuauuuaauagaa

SEQ ID NO: 101351 - RNA, 64 nt, Human
ugggguuuuguuauugguuuuuuuuuguaaagugugaauaaaagguauguuuacucauuuuucc

SEQ ID NO: 101352 - RNA, 64 nt, Human
gcccagacagcucuuugaugagggugaugggaacugaauaaaccauacggacuggcaguaacaa

SEQ ID NO: 101353 - RNA, 64 nt, Human
aggaugaauaaugacaggagagauuauaacacacugaauaaaaacauaauccaugaguucaugc

SEQ ID NO: 101354 - RNA, 64 nt, Human
caaacaauugaucaugugcuguaaaggaauucaaugaauaaauguuauuuuuaaguauuuuguc

SEQ ID NO: 101355 - RNA, 64 nt, Human
cuggcucuucuacuaaugaaccaucgagugauauugaauaaauuauuuaucuucucaguuuccu

SEQ ID NO: 101356 - RNA, 64 nt, Human
ugcagccaccacaucccuucauaucauacuguuuugaauaaauuuucaaauccuuauuguucag

SEQ ID NO: 101357 - RNA, 64 nt, Human
uugaguaauggauguuuguuuuuuguguaauuugugaauaaauaguuuuuuucugcauuuugaa

SEQ ID NO: 101358 - RNA, 64 nt, Human
aaauaaaaaaguagggcuguuauuagagugccaaugaauaaauaacuuaagcacaaaauacaua

SEQ ID NO: 101359 - RNA, 64 nt, Human
aaauauaauggaaaacagauuuuucaucauaucaugaauaaaauauagagguaacuauguugua

SEQ ID NO: 101360 - RNA, 64 nt, Human
aucuaagacucauccugauuuuuacuaucacacaugaauaaagccuuuguaucuuucuuucucu

SEQ ID NO: 101361 - RNA, 64 nt, Human
uauuucccccacagagugccuagaaucuuaauaaugaauaaaauaaaaagcagcaauaugucau

SEQ ID NO: 101362 - RNA, 64 nt, Human
uacauuguauguguuaaaaagaaauuugcaacugugaauaaaaggacuucuuuagaagaagcuu

SEQ ID NO: 101363 - RNA, 64 nt, Human
cuauaaaucccuagaaaaaaauuguucuuauuguugaauaaaaaagugcacagugugauuguuu

SEQ ID NO: 101364 - RNA, 64 nt, Human
agucaccaugccuggccucauuuuuuaaaacaaaugaauaaauggacaaaugaguaaaugagaa

SEQ ID NO: 101365 - RNA, 64 nt, Human
auggauuuacuucuuugagaaaucuuuccuuagaugaauaaaugaaaguuuuaauuuuucauga

SEQ ID NO: 101366 - RNA, 64 nt, Human
acuuuaauuuucuaaacauaguauucaacuuaguugaauaaauauaugauagaaguuaaauaga

SEQ ID NO: 101367 - RNA, 64 nt, Human
cauagaacugugauauuuugcuauuacuucaaugugaauaaauaagguaaaguauaucauuuau

SEQ ID NO: 101368 - RNA, 64 nt, Human
caugguccuagaacucugcuuggaccagaagaugugaauaaacuuaagcuuauuuauuuaaaau

SEQ ID NO: 101369 - RNA, 64 nt, Human
uccugaaaagaaaucagaauuaacauuuuuauguugaauaaauuuuaaaauuuaggaaauguuc

SEQ ID NO: 101370 - RNA, 64 nt, Human
auguuuuguuucuuagggaaaacagucugagaaaugaauaaaaagcaugaaguacgugugugug

SEQ ID NO: 101371 - RNA, 64 nt, Human
gcuggguuucagcauccaccaaugaacugaaaggugaauaaaggacguucaugagaaaucgacu

SEQ ID NO: 101372 - RNA, 64 nt, Human
uuuuggagaagacaaagaaaauuaaaguuuucccugaauaaaugcauuauuaugacugugacag

SEQ ID NO: 101373 - RNA, 64 nt, Human
uucaaaugcuguaauuaacaacacuuaaaaaacuugaauaaaauauugaaaccucauccuucuu

SEQ ID NO: 101374 - RNA, 64 nt, Human
cuaguaugauggaaaguuucuuuuuucuuugcucugaauaaaacugaacuguggguucucuaua

SEQ ID NO: 101375 - RNA, 64 nt, Human
uuucaaauuggaaguaacuuuauucaacuagaguugaauaaaagaagggcaaaaauaaucucac

SEQ ID NO: 101376 - RNA, 64 nt, Human
gcagcuguaauggucugagcggauuuauugacaaugaauaaagggcacgaaggccaggccaggg

SEQ ID NO: 101377 - RNA, 64 nt, Human
uuugaaaguaggaacucuuaagcaaugguaauugugaauaaaaauugaugagaguguuagcucc

SEQ ID NO: 101378 - RNA, 64 nt, Human
ucaggucaccgcgaggccugacuggccuuauuguugaauaaauguaucugaauauccccuguug

SEQ ID NO: 101379 - RNA, 64 nt, Human
auuaaggacucugucaacucugauauucugaaagugaauaaaagaaauuaacuuauccaccaac

SEQ ID NO: 101380 - RNA, 64 nt, Human
aacagcauaauuugugggaagacuggaauagggcugaauaaauguguuugaaucucuaauuuua

SEQ ID NO: 101381 - RNA, 64 nt, Human
cgggcgggugggcccggccgcccccgagaguccaugaauaaagcuaaucugucuguagccagag

SEQ ID NO: 101382 - RNA, 64 nt, Human
uugaauucuuugagguccaauuuauuuggaccccugaauaaaguuuuguggguuuucuucuaug

SEQ ID NO: 101383 - RNA, 64 nt, Human
accuacuagauugaauuuauuuagugaaugcuccugaauaaaugugcauuccucuuuuagagua

SEQ ID NO: 101384 - RNA, 64 nt, Human
gcagugcauguuucuaauugacuuacugggaaacugaauaaaauaugccucuuauuaucauauu

SEQ ID NO: 101385 - RNA, 64 nt, Human
guagcuaaugcaccuugagaaaaaucuggcauacugaauaaauaacauuaacuugggagccaag

SEQ ID NO: 101386 - RNA, 64 nt, Human
agcugugaucuuaccacuucaaauggguguaauuugaauaaauuuuguaugguaaaggaucaau

SEQ ID NO: 101387 - RNA, 64 nt, Human
uuucuuguauuugcccccuuuuuuuuauaaaaggugaauaaaaagaaauaauuuaauaucacca

SEQ ID NO: 101388 - RNA, 64 nt, Human
gggcucccucucugguuuccuauuugcaguuacuugaauaaaaaaaauauccuuuucuggacug

SEQ ID NO: 101389 - RNA, 64 nt, Human
uuuguuucugacuugaauaauuuaucaaugguguugaauaaaagcaaguucaauaaugucuuuu

SEQ ID NO: 101390 - RNA, 58 nt, Human
agccccagcgccuauauuaaggcacauuugaauaaauucuauuaccaguucccucugu

SEQ ID NO: 101391 - RNA, 64 nt, Human
agaucuuauuuuuuuuuuuauacuuggcguuuuuugaauaaaaaccuuuugucuuaacucgugg

SEQ ID NO: 101392 - RNA, 64 nt, Human
gggcccagauggaccaaguggggccggggagggaugaauaaacacccuaccccgugcccugucu

SEQ ID NO: 101393 - RNA, 64 nt, Human
ugggcuuggaccgauguccccauauguacagaacugaauaaagugggucucugagaagucugau

SEQ ID NO: 101394 - RNA, 64 nt, Human
gggauucccagcgucuguagugcuuccuguuugcugaauaaaggucucuuucucacacacaucu

SEQ ID NO: 101395 - RNA, 64 nt, Human
gccuaauuuuaaagugcugccugugaguaacucuugaauaaaaacaaaauauaaaaaauugaga

SEQ ID NO: 101396 - RNA, 64 nt, Human
uacuguaaauuaaagggaggugaauggaaauuaaugaauaaacauuuugaguuucccuaguguu

SEQ ID NO: 101397 - RNA, 64 nt, Human
cuguuugaauuuggaaguauucuaauacaagauuugaauaaaguuuauccuuaaauaaaguuua

SEQ ID NO: 101398 - RNA, 64 nt, Human
gcuggcacauuguuggcacucaacaaugguugaaugaauaaaacaauaaaugaaugaauaacua

SEQ ID NO: 101399 - RNA, 64 nt, Human
gauuaguaauuuuagauauguccuuuccuaaaaaugaauaaaauuuaugaauaugacuuaaaag

SEQ ID NO: 101400 - RNA, 64 nt, Human
gcacacaguaagaucucaaugcacauuuguuggaugaauaaauaaaugcaauugaauucccaga

SEQ ID NO: 101401 - RNA, 64 nt, Human
gagcuuuacuaaaagaacauaagucaagggaggaugaauaaaaacagcaaaaccaaauaaagug

SEQ ID NO: 101402 - RNA, 64 nt, Human
cauaaagcagaauacauuauaaauaaguagaauaugaauaaauagaauaauaaaauuccaaaau

SEQ ID NO: 101403 - RNA, 64 nt, Human
uuucugugagcacacuaaaagcgaaaaauaaaugugaauaaaauguacaaauuuguuguguuuu

SEQ ID NO: 101404 - RNA, 64 nt, Human
auuuuauaauuucuuuuggaauguaaaucaaauuugaauaaaaaucuuacacgugaaauuuugu

SEQ ID NO: 101405 - RNA, 64 nt, Human
acuuccacuucaugaauaguaaaucuauuuuuacugaauaaaguaauuauggaaaauauuuuaa

SEQ ID NO: 101406 - RNA, 64 nt, Human
uguauguuuuccagcuaaggucacaaaccaaaacugaauaaagucuuugaggaaacauuuugga

SEQ ID NO: 101407 - RNA, 64 nt, Human
ucuauuucaaccgaaaaguaagcauuuaacccggugaauaaauguagauccugccauucauugg

SEQ ID NO: 101408 - RNA, 64 nt, Human
gaaugccuacuauuauccugauuauggggucuccugaauaaauagaguauuaguccuuauguca

SEQ ID NO: 101409 - RNA, 64 nt, Human
auguaccuuguauuauauagguugaaauuaaagaugaauaaauaaaauaaaaugacacaaggcc

SEQ ID NO: 101410 - RNA, 64 nt, Human
caauuacaaugaugauauuucacuacagcucugaugaauaaaaaguuuuguaaaacaagcuuaa

SEQ ID NO: 101411 - RNA, 64 nt, Human
aguguugauauauggguaggauguuacaaaguauugaauaaacuauuugccaaaguaugaagua

SEQ ID NO: 101412 - RNA, 64 nt, Human
ggaauguggggaucagggagguggagggacagugugaauaaauggcaucuaggaagguaaacuc

SEQ ID NO: 101413 - RNA, 64 nt, Human
uuuauucagacuuuuuuuugagagaaauguaagaugaauaaaaauucaaauaaaaugauaacua

SEQ ID NO: 101414 - RNA, 64 nt, Human
aggaaaaaagaugaaaacagauucuucaaaagcaugaauaaaaaugacaugaagagcuguaagu

SEQ ID NO: 101415 - RNA, 64 nt, Human
accuggggguaucuccccucugccaccccaauugugaauaaagauuguuugcuuuguagccccu

SEQ ID NO: 101416 - RNA, 64 nt, Human
uguccuggaacaugggugggaccagaaaucuuuaugaauaaaugaaaagauaagggauuuggaa

SEQ ID NO: 101417 - RNA, 64 nt, Human
uuaaaagcaaaaaaaaaaaaaaguaugaugguggugaauaaagaccaaaggguccucucuaccu

SEQ ID NO: 101418 - RNA, 64 nt, Human
acugcugcugagucugucugauguuuugguugugugaauaaauauaauuccccucuggacugca

SEQ ID NO: 101419 - RNA, 64 nt, Human
aacaggcuucaguaucagggcugaaacugcuggaugaauaaacuauuuauuaaaaacggauguu

SEQ ID NO: 101420 - RNA, 64 nt, Human
caccucaguaaaauuggagaggauucuuuugcauugaauaaacuuacagccaaaaaaccuuaau

SEQ ID NO: 101421 - RNA, 64 nt, Human
ggggaaaaugcccacauuuuaacuuuuaaacuucugaauaaacuguguaaaaacaguaguggaa

SEQ ID NO: 101422 - RNA, 64 nt, Human
acaaacccaauauccagaugaauauccgagauguugaauaaacuuagccauuucguacacaugg

SEQ ID NO: 101423 - RNA, 64 nt, Human
aucacuuggucaccuugccccaagcuuuccccucugaauaaauacccauugaacucugauggcu

SEQ ID NO: 101424 - RNA, 64 nt, Human
gugauggaagcuggugacuuuauuugcaaagcugugaauaaaaccacaaacucuaaaguagcac

SEQ ID NO: 101425 - RNA, 64 nt, Human
uuaaaaaaaaaaaaagaaaaccaaacaccucccuugaauaaauuuauacuccuguucccaggau

SEQ ID NO: 101426 - RNA, 64 nt, Human
gcuugauguuacaagguguuguuaaaacacaaaaugaauaaaagugagaguagucagaacuaua

SEQ ID NO: 101427 - RNA, 64 nt, Human
ggagaauaagaacucuuuuugucauuuuuggcuaugaauaaacuuucuggucuuuugagaccac

SEQ ID NO: 101428 - RNA, 64 nt, Human
gccaacuguuuuauuccuuucaacaacugcauugugaauaaacuuuacaaauuuuucuuguauu

SEQ ID NO: 101429 - RNA, 64 nt, Human
ucuuucuuugucccacauauacauucuaccccuuugaauaaaaaaguucaaugacgccgggcgu

SEQ ID NO: 101430 - RNA, 64 nt, Human
aagacuugaaaacuaaugaguaaagucugcugaaugaauaaaccgugugauuguuucccgacuc

SEQ ID NO: 101431 - RNA, 64 nt, Human
uccuccaacuucgugugaaauugugauguugaagugaauaaaugucuauuguguaacucucaug

SEQ ID NO: 101432 - RNA, 64 nt, Human
ugaagaaaacacuguaauugcuacucagcaaaugugaauaaaagguguuugcguuauuaggaug

SEQ ID NO: 101433 - RNA, 64 nt, Human
gugccugacacauagaaaacaaucaaauauuugcugaauaaaugauuaaaaaaucagagaacuu

SEQ ID NO: 101434 - RNA, 64 nt, Human
agaaggguuaacucaacugucuauugucacaugaugaauaaauagaugaagugagauacaaagc

SEQ ID NO: 101435 - RNA, 64 nt, Human
ucagugcuuaaaauuucuuuuucaacugugagauugaauaaacagucucuauuucuguggaaaa

SEQ ID NO: 101436 - RNA, 64 nt, Human
ucucaaauuuguaaguuuuuauacauccuuucauugaauaaacguuuaauuaaaugaguauaug

SEQ ID NO: 101437 - RNA, 64 nt, Human
auuacgcuuuccagacuuucugaauagauuuuuuugaauaaacaugguuuuaugaaguguaauc

SEQ ID NO: 101438 - RNA, 64 nt, Human
ugagaaugaaaagaauguaacaguguuaguauuuugaauaaacauguuauuacuagacuguugc

SEQ ID NO: 101439 - RNA, 64 nt, Human
gaaguguuguugcuauggugacguccuuuugcugugaauaaaggugcucuuugcagcaauccug

SEQ ID NO: 101440 - RNA, 64 nt, Human
uguuuacaggaaagaucucagaggcuaugagcucugaauaaaucuucauuguauaaaaugaagu

SEQ ID NO: 101441 - RNA, 64 nt, Human
uagcaugaaauuuuuacuucagauuuuaagcucaugaauaaagauauaucuguguugaucucua

SEQ ID NO: 101442 - RNA, 64 nt, Human
acaguuggugguugaauagacaagaacagcuagaugaauaaaugauucguguuucacucuuuca

SEQ ID NO: 101443 - RNA, 64 nt, Human
uaucuuuauuuauucccuaguuugcagaacugucugaauaaaggauacaaggauuauuucaaug

SEQ ID NO: 101444 - RNA, 64 nt, Human
agagcuaguguaagcuguugaugagagcuguugcugaauaaaaccauauucaccugccuauggg

SEQ ID NO: 101445 - RNA, 64 nt, Human
uuugacuggaaaaucccuaguuguuugaauuaacugaauaaagugcagggcguaauagugacug

SEQ ID NO: 101446 - RNA, 64 nt, Human
caauuugugaaacaugaauguguuuaaacugcagugaauaaaugagaugugcuuuaauuuaacc

SEQ ID NO: 101447 - RNA, 64 nt, Human
ucugccccacaaucaagaauguauguguaaagugugaauaaaucucauaucaaaugucaaacuu

SEQ ID NO: 101448 - RNA, 64 nt, Human
uauuuuuauggucauaauaaaaauuacaaaaguaugaauaaaauacauacauuucugaguccug

SEQ ID NO: 101449 - RNA, 64 nt, Human
auugugaagcuguguaugaaauucaacuauaauaugaauaaauuugaaucaugagaauuauggg

SEQ ID NO: 101450 - RNA, 64 nt, Human
aaauucucaaaauuauauagcuuuuuguuuuguuugaauaaaugauucauuccuguuugcuuuu

SEQ ID NO: 101451 - RNA, 64 nt, Human
gguuuuuauuugaauuguaaaauauuuaaaaguaugaauaaaauauauuuauagguauuuauca

SEQ ID NO: 101452 - RNA, 64 nt, Human
guagccauaauuuuuuuuuuuuuuugccgaaaucugaauaaacuacauauauuuagcaucagga

SEQ ID NO: 101453 - RNA, 64 nt, Human
acuauuaggaaguuaguauuuugcuauugaucacugaauaaacaucagaguauuuuaaaaaaca

SEQ ID NO: 101454 - RNA, 64 nt, Human
uaucccagaacacuagacacuucaaauuguuuugugaauaaaacucagaaaugaagaugagcuu

SEQ ID NO: 101455 - RNA, 64 nt, Human
aaaacacccagggauuuguacucauuuuccaaguugaauaaaauacauuuuuaaaaugauaauc

SEQ ID NO: 101456 - RNA, 64 nt, Human
ucguucuguuuuauuuuucuaacucugcugaccaugaauaaaagaccaaaacacuacaggcugg

SEQ ID NO: 101457 - RNA, 64 nt, Human
aaaccaaaaacauuugauuaauaaaauaucuauuugaauaaauuaugagcuauccuuucaaaca

SEQ ID NO: 101458 - RNA, 64 nt, Human
guagugaaacacaaagcuuccaaucuuaaggaugugaauaaaaccaccaaauggcauuucuaga

SEQ ID NO: 101459 - RNA, 64 nt, Human
agaguagugaagcuaauuaaacacauuugguuucugaauaaauugaacuaaauccaaacuauuu

SEQ ID NO: 101460 - RNA, 64 nt, Human
cuuggcacauagugggccuucauuaaauguuuguugaauaaaagagggaagaaggcaagccaac

SEQ ID NO: 101461 - RNA, 64 nt, Human
gaagguauagaugcuauuguucugauggcccggcugaauaaaauggaaauucuaguuuguuaga

SEQ ID NO: 101462 - RNA, 64 nt, Human
ccagggcuuaccuguacacugacuugagaccaguugaauaaaagugcacaccuuaaaaaugagg

SEQ ID NO: 101463 - RNA, 64 nt, Human
ugaaaaaaaaaaaagaaauagaagauuccugcugugaauaaacauacuucuuguguaaauagaa

SEQ ID NO: 101464 - RNA, 64 nt, Human
acagaggguaguuagaaaaaucauaacuuauaugugaauaaaauacauauaagcagcauuuacg

SEQ ID NO: 101465 - RNA, 64 nt, Human
cauagugcuggucucacagcuuaauauuugguaaugaauaaauucugcuagugguauauguuga

SEQ ID NO: 101466 - RNA, 64 nt, Human
ucaguuuuuaaaagaucgaucuacauacaauagaugaauaaauguuuucagugauaugaaaagg

SEQ ID NO: 101467 - RNA, 64 nt, Human
auauuuguuacguaaaguuaaaaugauuuuugucugaauaaaaaaaaagcauugcaaaugcuuu

SEQ ID NO: 101468 - RNA, 64 nt, Human
gugguaaauauuuucaaagagaugggccuuuucuugaauaaaaguuaauaacagcuccuuuauu

SEQ ID NO: 101469 - RNA, 64 nt, Human
ccauuaaggcagcucauccaagcuuguauuuaacugaauaaaugaguagacauuguggaccuca

SEQ ID NO: 101470 - RNA, 64 nt, Human
ugaggauguggcacaaaguuggugccaagcuucuugaauaaaacguguuugauggauuaguauu

SEQ ID NO: 101471 - RNA, 64 nt, Human
auuuguuugaacaaggugucuaagaauauacuguugaauaaagacaugcacacagcauaauuca

SEQ ID NO: 101472 - RNA, 64 nt, Human
uuggauacuuaggugguuucuucacugacaauacugaauaaacaucucaauagucaaacaucug

SEQ ID NO: 101473 - RNA, 64 nt, Human
cacuagcuuucguuccuuagaaugucuuuucuuuugaauaaacaguauugggugauuuauuaaa

SEQ ID NO: 101474 - RNA, 64 nt, Human
aucuggccauggcggacacucagcauuuguugauugaauaaauguuagcucuucucauugugaa

SEQ ID NO: 101475 - RNA, 64 nt, Human
ucagaggacugaggcauagucucucaucugcuauugaauaaagaccuucuaucuugucuugccu

SEQ ID NO: 101476 - RNA, 64 nt, Human
gguuuuacagggguggucagaccucaggcuuuaaugaauaaagacacuacucccaaaguccugg

SEQ ID NO: 101477 - RNA, 64 nt, Human
uggucucuaaguguaaaaguaguaaauuuugugaugaauaaaauaauuaucuccuaauuguaug

SEQ ID NO: 101478 - RNA, 64 nt, Human
caaacuguuuggaaagcuaaaucuucccucuuaaugaauaaagguuuuugccuugucuuaaagu

SEQ ID NO: 101479 - RNA, 64 nt, Human
uucuuccucuauaaagaauagguauaggaaagacugaauaaaaauggagggauauccccuugga

SEQ ID NO: 101480 - RNA, 64 nt, Human
uguauuucaaaauauacugaacgucaacaugauuugaauaaagaaaauguauuuucuacuugaa

SEQ ID NO: 101481 - RNA, 64 nt, Human
ugaaacauaggcuaauauagauuaaauugaauauugaauaaaaaauauauuuauuuauccacau

SEQ ID NO: 101482 - RNA, 64 nt, Human
ucuuuacuucccaguauaagauuuuugaaaauccugaauaaaccaguaucguuacuggcaccug

SEQ ID NO: 101483 - RNA, 64 nt, Human
agacuguucauuucucucugacauguuuguugaaugaauaaauaauuugaaacuucuacuugau

SEQ ID NO: 101484 - RNA, 64 nt, Human
cgugauaaauuauuaauguuccgcagucucacucugaauaaaggacaguuuguaagucuugagu

SEQ ID NO: 101485 - RNA, 64 nt, Human
gcauugaaaccauauggugugugauuaaaaaaaaugaauaaauugugaagaacugguuuugguu

SEQ ID NO: 101486 - RNA, 64 nt, Human
uuaggaaaaguuaacuuguuaaauucuuuugaauugaauaaaaaaaugcauugaaaccauaugg

SEQ ID NO: 101487 - RNA, 64 nt, Human
uggauuugcuuuuauuuguaaaauuauucuuuucugaauaaacugcauacaauucaaaaugcaa

SEQ ID NO: 101488 - RNA, 64 nt, Human
uuacuuacacaauucaguuaagaugcuuugacacugaauaaaauauugauuucaugaaaucauu

SEQ ID NO: 101489 - RNA, 64 nt, Human
uuuguaccuaaguggauauagauaacugcauaaaugaauaaauucagaauuaacuccuucaaua

SEQ ID NO: 101490 - RNA, 64 nt, Human
uguuucuuccuucaaacugaauguaauuaauucaugaauaaaugcaccuuauauguuuaaacaa

SEQ ID NO: 101491 - RNA, 64 nt, Human
ugcuuuguacacugauauauuggguaaauuuuguugaauaaauuaagcucaacuauuuguauuu

SEQ ID NO: 101492 - RNA, 64 nt, Human
aauaaaugaacauauguuugcuuauauguuaaauugaauaaaauacucucuuuuuuuuuaaggu

SEQ ID NO: 101493 - RNA, 64 nt, Human
uugcaauaaugcaguaugguacauuuuucaacuuugaauaaagaauacuugaacuuguccuugu

SEQ ID NO: 101494 - RNA, 64 nt, Human
uucuguucaugucuucuacuuuucuacuccuguaugaauaaaauauugauuugauuacaguggc

SEQ ID NO: 101495 - RNA, 64 nt, Human
aauuauugggaugguuucuuggcuuuaaguccacugaauaaaaacuaugaaauugcacucugug

SEQ ID NO: 101496 - RNA, 64 nt, Human
aucaagcacgugcuugagaaaaaaauuauaauuuugaauaaagacuuucuacuuaaaauaugug

SEQ ID NO: 101497 - RNA, 64 nt, Human
aacauuuguaaggcugcaacauaauauuaaaaugugaauaaauaaauguucugauaaaauagaa

SEQ ID NO: 101498 - RNA, 64 nt, Human
aaauaagagacuauuuguuuucuuuuaauuucuaugaauaaaagaaauuuuuaaaaacuuuaaa

SEQ ID NO: 101499 - RNA, 64 nt, Human
cuggcacugaaaauaaggaaaaaaaaccuacuacugaauaaaagugacaaagaauggagaaucu

SEQ ID NO: 101500 - RNA, 64 nt, Human
aaacuagcaaucuauaaagugcaccaggucaacuugaauaaaaacacuaugacagacagguuug

SEQ ID NO: 101501 - RNA, 64 nt, Human
guaaaucugauggcucacugauuuuugaaaagccugaauaaaauuggaaagacuggaaaguuag

SEQ ID NO: 101502 - RNA, 64 nt, Human
cugucauguauuuauauucuagcauagacuaaacugaauaaaaaugcugauaacaggaccuuua

SEQ ID NO: 101503 - RNA, 64 nt, Human
cugcccaagauuaaagagcuaagaugaaauaguuugaauaaacugguaaaauaacaauucauac

SEQ ID NO: 101504 - RNA, 64 nt, Human
uucauucuaagacaaaacauuucuccuaaaucucugaauaaaaucagugcuguaggaagaugga

SEQ ID NO: 101505 - RNA, 64 nt, Human
uagcuugguguaaaauguauauugacuguauuggugaauaaauugaauagacauaaccucaaag

SEQ ID NO: 101506 - RNA, 64 nt, Human
ccacaugaccuugauuguuaaauguaguuauauuugaauaaaaaaugaaucauuuccaaaauuc

SEQ ID NO: 101507 - RNA, 64 nt, Human
gaagacuuuaauccgucaaauucuuguauaacuuugaauaaaugguuaauguucacuuaaaaga

SEQ ID NO: 101508 - RNA, 64 nt, Human
cuuguaaugcacugguaaaaacaaaauaaauagaugaauaaauaaagagugagagaagagagaa

SEQ ID NO: 101509 - RNA, 64 nt, Human
aaacacauauuuagaaacacagcaagggagauuuugaauaaagagagagaugaauuuauaaagu

SEQ ID NO: 101510 - RNA, 64 nt, Human
gcaaacuaggguaauuggugccuuuuuacaguuuugaauaaaagcauuuacaauuucuaaauua

SEQ ID NO: 101511 - RNA, 64 nt, Human
aaauaacuaaguuuggagguauuuucacucuauaugaauaaauauuuuuccauaaaauaguugu

SEQ ID NO: 101512 - RNA, 64 nt, Human
gacauaaauuguaauuugggaacauaaaaacuacugaauaaaucauguggccuaauauugaaaa

SEQ ID NO: 101513 - RNA, 64 nt, Human
aggucucucaaauaauuaagaauagagccaguuuugaauaaagucuagcagaacuaugcagcuu

SEQ ID NO: 101514 - RNA, 64 nt, Human
ugaguacaccgcacaagucaaacgcuaggaaguuugaauaaaaccaauuuuucuaacuuguugc

SEQ ID NO: 101515 - RNA, 64 nt, Human
ggauagaccacuuacauauaaauguguauauaugugaauaaaccuauagccuuaacuuacuuau

SEQ ID NO: 101516 - RNA, 64 nt, Human
uuucuuaaaauuuuugcuuuugcuuauuuaauuuugaauaaaagcuaaauuccuaauacuuuuu

SEQ ID NO: 101517 - RNA, 64 nt, Human
uaaacuauuuguggcaauuuuauguuuuuauuuaugaauaaagaaugccauuucucacgcccuc

SEQ ID NO: 101518 - RNA, 64 nt, Human
cauaguguauagaaaacugaauuugacaaguuaaugaauaaaugaacaaaugauuucacauguu

SEQ ID NO: 101519 - RNA, 64 nt, Human
gugaauacuuuauuauuuaguuuuuacaguaacaugaauaaagccaaaccugcuuuucauuuag

SEQ ID NO: 101520 - RNA, 64 nt, Human
aguacaguaauaguuuggguucucccuugauaaaugaauaaaaggcucaauucugauaagugau

SEQ ID NO: 101521 - RNA, 64 nt, Human
caguuauucaucaagaaugcaauuagacuaauugugaauaaaugauugaaugaagauauaauaa

SEQ ID NO: 101522 - RNA, 64 nt, Human
agacaauugagcuauuucuaauuuucggcugcuaugaauaaagcugcuacaaauauuuuuguac

SEQ ID NO: 101523 - RNA, 64 nt, Human
uuuugcaauuaaauuuauuuuaauaagacgaucaugaauaaaacuuuaaauugauauuuuuauu

SEQ ID NO: 101524 - RNA, 64 nt, Human
uaacuuccguaaguuacauccuuauggaagcuacugaauaaaagaaggggguaugcacccccua

SEQ ID NO: 101525 - RNA, 64 nt, Human
accauuguuuaaauaccgccuauguacucccaaaugaauaaaacauaauucuuguccucugaga

SEQ ID NO: 101526 - RNA, 64 nt, Human
uucacuuguuuaguuuuuaaacguuaguauaaucugaauaaauaaaauguugccaaauucaaug

SEQ ID NO: 101527 - RNA, 64 nt, Human
cccgacgcauggacccgagaggcgacgacacgagugaauaaagugcacauggacccugcgcguc

SEQ ID NO: 101528 - RNA, 64 nt, Human
caggagauggggcccugcugccagucaucuccacugaauaaagaauaaugcuccucuuucaggg

SEQ ID NO: 101529 - RNA, 64 nt, Human
uaaucaaauauaucuacuacauuguuuauauuauugaauaaaguauauuuuccaaauguaugug

SEQ ID NO: 101530 - RNA, 64 nt, Human
aaaugcauuuauaaauucuucuuggcuucauucaugaauaaacguguuagcaauuuaaaacaug

SEQ ID NO: 101531 - RNA, 64 nt, Human
gaauguuugaauuuuuuccauuugaggaauuuuaugaauaaagcugcuauaagcaugaaauuac

SEQ ID NO: 101532 - RNA, 64 nt, Human
gugaaagaaguaaaucugaacauuauaugugccuugaauaaagcuauuucaggaaauauuuaau

SEQ ID NO: 101533 - RNA, 64 nt, Human
acuguaggcacacuuugcacugauauaucaugagugaauaaaugucuugccuacucacgucuca

SEQ ID NO: 101534 - RNA, 64 nt, Human
cuuggccuuuccccuugcagggguugugcaggugugaauaaagagaauaaggaaguucuuggag

SEQ ID NO: 101535 - RNA, 64 nt, Human
ugacugggguaggagaaacccaugacauuagaauugaauaaaaccuagaaguuggauauuggca

SEQ ID NO: 101536 - RNA, 64 nt, Human
uuuuguuaaauucuguuuauaaguauggcucaacugaauaaaaggagauucacuaaaacgaaaa

SEQ ID NO: 101537 - RNA, 64 nt, Human
aaauguggaaagaaagaagacauuguuauuccguugaauaaagaaacagaaaaaauagaacaua

SEQ ID NO: 101538 - RNA, 64 nt, Human
uuugagaauuuuaaaugugaccauuuuucugguaugaauaaacuuacagcaacaaauaaucaaa

SEQ ID NO: 101539 - RNA, 64 nt, Human
cccuaaaguauuuuagguucagugagcauuugccugaauaaaaccuaaaagaguagucuuaaca

SEQ ID NO: 101540 - RNA, 64 nt, Human
auuaaucaggcuauacauaaguauuguauuuauuugaauaaaaauaaaaagagcaacccauaau

SEQ ID NO: 101541 - RNA, 64 nt, Human
acaagauagcuucagaccaaauucaaauugaauuugaauaaauuagaaauacugugcauacaua

SEQ ID NO: 101542 - RNA, 64 nt, Human
uuuaacauaaauaaacaaaucguaucaguguuugugaauaaaauacaaaaaugauuguuaauga

SEQ ID NO: 101543 - RNA, 64 nt, Human
aaagaaagucauuucaacucuuaccucaucaaguugaauaaagacagagaaaacagaaagagac

SEQ ID NO: 101544 - RNA, 64 nt, Human
ccuggagcauaguaggcagucauauguuguaucgugaauaaauugcacauaguagcuacccagc

SEQ ID NO: 101545 - RNA, 64 nt, Human
ugguagauuucauugagguuuuagauugaaacuuugaauaaaucaaaaauacucauucuuauuu

SEQ ID NO: 101546 - RNA, 64 nt, Human
accccacagaaacugcuggacacacugaagaaacugaauaaaacagaugaagaaauaagcaguu

SEQ ID NO: 101547 - RNA, 64 nt, Human
ugagaagagagaaguggagggggaggcgagugugugaauaaaggcucccaucaggucaaguguc

SEQ ID NO: 101548 - RNA, 64 nt, Human
uccuugagucagugcuguugaugacgaguugucuugaauaaaucauguguucuuugcaaugggc

SEQ ID NO: 101549 - RNA, 64 nt, Human
aucugcggaauaaacccaaugguuaauuuuugaaugaauaaaaggcuuuuguugaauaaacagc

SEQ ID NO: 101550 - RNA, 64 nt, Human
ccccaggggcuccccucccaucuugagcucuuccugaauaaagccucauaccccugucgguguc

SEQ ID NO: 101551 - RNA, 64 nt, Human
gcguucccugcccugugcugacucuguugcucugugaauaaacacccuggcccaugagggcagc

SEQ ID NO: 101552 - RNA, 64 nt, Human
cugugcgagcucugcccuccucagcucucaaaccugaauaaaugcaccaagcccagagccccag

SEQ ID NO: 101553 - RNA, 64 nt, Human
aaaccucaggucucaccccuguggccugugauuaugaauaaagauuaucuuuguaaagauccgu

SEQ ID NO: 101554 - RNA, 64 nt, Human
accuucuguugauuuuuuaagccacaugcuaugaugaauaaacugauuuauuuucuaccauuac

SEQ ID NO: 101555 - RNA, 64 nt, Human
gaaaaacuuuuuuaaagauguuagucuuguagcgugaauaaauuugccaucaccuuuugugugg

SEQ ID NO: 101556 - RNA, 64 nt, Human
ggaagaaaaaaucaugaugcuuauacaauaaauaugaauaaauguuauauaaggaaacucaccu

SEQ ID NO: 101557 - RNA, 64 nt, Human
auggccauuguguugccucuguuacuguuuguauugaauaaaaacaucuucaugugggcugggg

SEQ ID NO: 101558 - RNA, 64 nt, Human
uuguuauauaucuuuucuccuaaauggagaauuuugaauaaaauauauuugaaauuuugccucu

SEQ ID NO: 101559 - RNA, 64 nt, Human
uguauuuuugccuuuaaaauuaaauaauauaacgugaauaaaugacccuaucuuuguaacugca

SEQ ID NO: 101560 - RNA, 64 nt, Human
caccucuuccuuguaaauaugauuuauaccuaacugaauaaaaagcuguucugucuucccaccc

SEQ ID NO: 101561 - RNA, 64 nt, Human
uuaaaucauuaggauaucccucaccuguuccugaugaauaaaaaguguguuaaagaccaaaauu

SEQ ID NO: 101562 - RNA, 64 nt, Human
cauuaaacaucaauuauaauaaaauuucauauuuugaauaaaugacauuuuuccuagguauuuu

SEQ ID NO: 101563 - RNA, 64 nt, Human
ugguuucuaagcagaaaauagcaaauguuuauauugaauaaaauugcauguuccuccacgcagc

SEQ ID NO: 101564 - RNA, 64 nt, Human
cgauuuuuaauaaauuguugcaaauuuguuuuuaugaauaaaaggaaaaaaccugucgucuuua

SEQ ID NO: 101565 - RNA, 64 nt, Human
uuggugcuguaguauaugaugaaagauguaaagcugaauaaagcauuauuucugcccuagaguu

SEQ ID NO: 101566 - RNA, 64 nt, Human
cuauauuuucauaauucuauguguauuuuuauuuugaauaaacagaaagaaauuuuggguuuuu

SEQ ID NO: 101567 - RNA, 64 nt, Human
auacugcauaacaagcuaaccaaacuggacauggugaauaaaucauaaaacaaaucauuuuacu

SEQ ID NO: 101568 - RNA, 64 nt, Human
ugccaucaacauugcuugaaaugccucuauguucugaauaaagaaaaaccauaauugcuugugg

SEQ ID NO: 101569 - RNA, 64 nt, Human
uggaagaaaaugcaaagaaaccaaaugugccgagugaauaaaggauugucauaucaauuagugu

SEQ ID NO: 101570 - RNA, 64 nt, Human
aaaaucuauauuguaauaaaguuguaaagaauuuugaauaaaaauucaauauuugaaguacagu

SEQ ID NO: 101571 - RNA, 64 nt, Human
ucaggagaaaccaggcagcaggggaugaaauacaugaauaaagagaggcaucagcuccaagucu

SEQ ID NO: 101572 - RNA, 64 nt, Human
guauggucuacacauucugauuuuuuuuuuagauugaauaaaauuuguaaaucauuauuuucau

SEQ ID NO: 101573 - RNA, 64 nt, Human
gggcaacacagcaagacucugucucaaaaauaaaugaauaaaauaaaaaccugccaccaaauua

SEQ ID NO: 101574 - RNA, 64 nt, Human
acgcagagcaaaugagcuccggagucccugcaggugaauaaacacacagaucugcaucugauag

SEQ ID NO: 101575 - RNA, 64 nt, Human
uguugcauguccacgcaccacccguucagggcccugaauaaacaguuggcaacagcacauuguu

SEQ ID NO: 101576 - RNA, 64 nt, Human
gaauaacauuuuaucuuuugugguauuauuuuauugaauaaaauugaguuuuaugauaaaagug

SEQ ID NO: 101577 - RNA, 64 nt, Human
guuucaauauuuuccuucucucucaauuuuugguugaauaaacuagauuacauucaguuggccu

SEQ ID NO: 101578 - RNA, 64 nt, Human
uauuugaaagcccaacuuugauguuaaauauucuugaauaaaucuguuauuuuaagaauaucac

SEQ ID NO: 101579 - RNA, 64 nt, Human
agucuucugaaaggaaguagacaguauuacacccugaauaaauaagguguuguuuuccacaaag

SEQ ID NO: 101580 - RNA, 64 nt, Human
ugauagauuuauauuguaaccuuuuucuaguucuugaauaaauauagccugcuuucccuagaug

SEQ ID NO: 101581 - RNA, 64 nt, Human
aauacuuuuguccaaugugguuggucaaaucaacugaauaaauucaguauuuugccuuaguugu

SEQ ID NO: 101582 - RNA, 64 nt, Human
cucugacaaacugagccagccuuuuagaucuacaugaauaaacaaacuauuuuaccaagaaaaa

SEQ ID NO: 101583 - RNA, 64 nt, Human
cagguguuucugugccuguacauacuauucuucuugaauaaaaacaggauuacacaguguauac

SEQ ID NO: 101584 - RNA, 64 nt, Human
gaauggaacaaaucuacuuauccaguuauaccuuugaauaaaaaaaccuccuuuuauugucucu

SEQ ID NO: 101585 - RNA, 64 nt, Human
uauuacuuuugguaucccagaacaugacaaauuaugaauaaaacaaguauacauaauuaauggc

SEQ ID NO: 101586 - RNA, 64 nt, Human
uaucaagagggauaaaacaccaugaaaauaaacuugaauaaacugaaaauggaccuuuuuuuuu

SEQ ID NO: 101587 - RNA, 64 nt, Human
cuuuguguaagugauaaacaacagcaaauauacuugaauaaaauguuucagguauuuuuguuuc

SEQ ID NO: 101588 - RNA, 64 nt, Human
gacagucuaguuucagcacauagaaaaccagcagugaauaaaccaaggugaggccuugagcucu

SEQ ID NO: 101589 - RNA, 64 nt, Human
uuauaggauuuuaacuuaacugaaaugccugcuuugaauaaauguguuggguuuuuuguuuggu

SEQ ID NO: 101590 - RNA, 64 nt, Human
uugcugacucuguccaacagauaucacugugaauugaauaaauuuguugaaagagcacacaggc

SEQ ID NO: 101591 - RNA, 64 nt, Human
gccuggcucucacacaguauuuuaucuuugauucugaauaaauauuuuuugugggguuuuuuuu

SEQ ID NO: 101592 - RNA, 64 nt, Human
cugcuucccuugugcacuugggucgcugugauugugaauaaaagugauuucguaccagccugag

SEQ ID NO: 101593 - RNA, 64 nt, Human
cccagugaacuuuuccaguaaaugaagcaagcacugaauaaaaaccuccugaacugggaacaaa

SEQ ID NO: 101594 - RNA, 64 nt, Human
auacacauuuuuuguguauguauucuaauuagugugaauaaagcaguaacauuaaugcauuuuu

SEQ ID NO: 101595 - RNA, 64 nt, Human
acuugaaacugugaauaagguaagaaaacuauuuugaauaaauaaacuauuuauuuaaaauguc

SEQ ID NO: 101596 - RNA, 64 nt, Human
ccgcauggcucccucccguccuggcaccaauuucugaauaaaguccuuucuaccagcugcugcu

SEQ ID NO: 101597 - RNA, 64 nt, Human
gccauauuguuaaaauuagauaacuuacuuacauugaauaaacgaaugcguuuuauugguaaca

SEQ ID NO: 101598 - RNA, 64 nt, Human
gcugguauagagaagguacucaaaaaauccuuaaugaauaaaguaauggaucguacccaaacau

SEQ ID NO: 101599 - RNA, 64 nt, Human
cuuaagaugcaguaauuauguuccagauugaccaugaauaaaauauuuuuuaaucuaaauguag

SEQ ID NO: 101600 - RNA, 64 nt, Human
uaggaaaaaaaaauaugcauuugcuuaguuuauuugaauaaaagcucuaaaccuagguuauaua

SEQ ID NO: 101601 - RNA, 64 nt, Human
ucaugugggcugaugcagggaagcucugaagcagugaauaaagguguuucgggcccuguaagug

SEQ ID NO: 101602 - RNA, 64 nt, Human
agaaaaauucagaagaugaauuucuuccaauauuugaauaaauuaaagcucuuagauacagagu

SEQ ID NO: 101603 - RNA, 64 nt, Human
cucucuucauccugggggcucuguuacacuaauuugaauaaacucuccccuuucuuugcaacuu

SEQ ID NO: 101604 - RNA, 64 nt, Human
ucuuacuaguuucauucuaaucaagaugucaaauugaauaaaaaucacagcaaucucugauucu

SEQ ID NO: 101605 - RNA, 62 nt, Human
gaaguucaugcucccagccaccccaccccugagcugaauaaagaugauuuaagcauaauaaa

SEQ ID NO: 101606 - RNA, 64 nt, Human
agccuuuauuuguuaauaguuccugcuaaaacaaugaauaaaaacucaaggagcaacuacccua

SEQ ID NO: 101607 - RNA, 64 nt, Human
acuguaugaaugacuuuguaaauuuuguucuauaugaauaaaaaggcaaauuacuugugaucau

SEQ ID NO: 101608 - RNA, 64 nt, Human
cugauuuauaggauuucauaauuaaaaugucugcugaauaaauuuggcuuuuguuuuggagcac

SEQ ID NO: 101609 - RNA, 64 nt, Human
agucucaaccaagugucugaagugaacuuugcauugaauaaauuuuugccauggaaagaacauc

SEQ ID NO: 101610 - RNA, 64 nt, Human
uuccaagugggaugguuguggcauuaguuuaagcugaauaaauaauuucaauuuggggcaguua

SEQ ID NO: 101611 - RNA, 64 nt, Human
cagaaccuuacuaaaguagagggcacaaucagugugaauaaauucacuucagaaucucaaguca

SEQ ID NO: 101612 - RNA, 64 nt, Human
uuagccuuaauuguauacaaauuuuuguccugcaugaauaaauguguaaaauaccaugaauugc

SEQ ID NO: 101613 - RNA, 64 nt, Human
accuuaaugcucaugagacuauauuuaugaucagugaauaaaaaugucagaacugugcuuuguc

SEQ ID NO: 101614 - RNA, 64 nt, Human
ucauuaucaguaccacgguucccucaaaguuuguugaauaaagcaacuuuuguagaugcuguuu

SEQ ID NO: 101615 - RNA, 64 nt, Human
caaaggaaaugcuaccucguggcuacacauauuaugaauaaaugaggaagggccugaaagugac

SEQ ID NO: 101616 - RNA, 64 nt, Human
gacagaacccuacuuuuuguagaggaacuuaaucugaauaaagucugaguuuuucaguaaaucu

SEQ ID NO: 101617 - RNA, 64 nt, Human
cuguguccuugcugccuucauccccuggggccugugaauaaagcugcagaacccccuucacagu

SEQ ID NO: 101618 - RNA, 64 nt, Human
cugaaccuuacccagggcuguaggagugagacucugaauaaaggguugggccggcgguguggca

SEQ ID NO: 101619 - RNA, 64 nt, Human
accauguagguucuugggagggaaugggacagggugaauaaagcagggaauauuuuagaaccac

SEQ ID NO: 101620 - RNA, 64 nt, Human
uguguuuagaguucuguugucaaaagaaaacuaaugaauaaauuaguuugucauucuagaauuu

SEQ ID NO: 101621 - RNA, 64 nt, Human
aagaaauauagugagcccuaaaggacacauacauugaauaaauaauuggaacaugugguuaucu

SEQ ID NO: 101622 - RNA, 64 nt, Human
aacaauguacaugaaauuauauguguguggugugugaauaaauauguaugaauauauggucugu

SEQ ID NO: 101623 - RNA, 64 nt, Human
aauguaaucucagaauaaagguugucauuuaaguugaauaaauauauagcuuuaugaaaaacac

SEQ ID NO: 101624 - RNA, 64 nt, Human
agaaauuccacacaugaguauugugaugaguaaaugaauaaaacauuugcaaagaccuuuagag

SEQ ID NO: 101625 - RNA, 64 nt, Human
uauauagucuuugaauucauuuauuuuaaauaaaugaauaaaauaaaauaaaaaagaauauuca

SEQ ID NO: 101626 - RNA, 64 nt, Human
agcgcugggccagagaggcauuggugcgagggauugaauaaagaaacaaaugaauggcugcccc

SEQ ID NO: 101627 - RNA, 64 nt, Human
gguuuuugcccauccucccaaucucaauacagccugaauaaaccaagacaagaccucuggcuug

SEQ ID NO: 101628 - RNA, 64 nt, Human
cggcacccccuccccggccauuugugacaaaauaugaauaaacuacugcaaauaugugggcccc

SEQ ID NO: 101629 - RNA, 64 nt, Human
caagggccuaagagaaaagccagccaagugcuucugaauaaagaucccucucugggucucuccc

SEQ ID NO: 101630 - RNA, 64 nt, Human
aguuucgucuccugucucucuggcugaugucaccugaauaaagccuucuucccuggcaauacuu

SEQ ID NO: 101631 - RNA, 64 nt, Human
ucuaggaaggccccagcccuaguccuaggcgacuugaauaaagugggaggucaaacaugggccu

SEQ ID NO: 101632 - RNA, 64 nt, Human
agcaagaacgaagcaggauguugucacucccgucugaauaaagcuccaugagcuggguuggaaa

SEQ ID NO: 101633 - RNA, 64 nt, Human
uccugcuccauggucgggccucugacagccacuuugaauaaaccagacaccgcacaugugucuu

SEQ ID NO: 101634 - RNA, 64 nt, Human
cauccauuuccucacucaguggagauuugccaaaugaauaaacgacaccuuugaggccccaggu

SEQ ID NO: 101635 - RNA, 64 nt, Human
ccuggcaacagagcaagacuccgucucacaaaaaugaauaaauaaaauaaaaauaaaaauguua

SEQ ID NO: 101636 - RNA, 64 nt, Human
augaauuuugaguacugccuaauugucaguuauaugaauaaauuacaugucauucuacuguaac

SEQ ID NO: 101637 - RNA, 64 nt, Human
caugucauagccuugguuuaguuuuggguggagcugaauaaacccaaaucucagggccuuguuu

SEQ ID NO: 101638 - RNA, 64 nt, Human
ggaauaauggacaaagggaaauacucuuaauucaugaauaaaaacuuugcagaaaauuagacag

SEQ ID NO: 101639 - RNA, 64 nt, Human
guguuguuggaccaugugugaucagacugcuaucugaauaaaauaagauuugucaaaacucagu

SEQ ID NO: 101640 - RNA, 64 nt, Human
acuguguucuucacgguaauuagacaucauucagugaauaaauuacuguagucaaagacaguau

SEQ ID NO: 101641 - RNA, 64 nt, Human
cagcuucgugaggggucucuggcccaguuuccaaugaauaaaguucucuugacagcucugacag

SEQ ID NO: 101642 - RNA, 64 nt, Human
aacguugguaugauaaugauaacuuguuuugacuugaauaaaguacuacaucaguguggaaaaa

SEQ ID NO: 101643 - RNA, 64 nt, Human
gcauuuauguggagcauuucucauuguuggaaucugaauaaaccaauuacaaaauaacauaugu

SEQ ID NO: 101644 - RNA, 64 nt, Human
aucucagagguuauguguucuaacuauuaucaaaugaauaaauccucucuaucacaucccccaa

SEQ ID NO: 101645 - RNA, 64 nt, Human
ugaagccaaauugaugugaagcuugugauccuuuugaauaaaaaaaaggcaagauuauuucuua

SEQ ID NO: 101646 - RNA, 64 nt, Human
aaaaauguauuuuauaccggcuuauuccuaguauugaauaaacuagcgggcucacucagugugg

SEQ ID NO: 101647 - RNA, 64 nt, Human
gcuggugugaaaggcgcugggaaccggcuuugaaugaauaaaugaaucgugucaucugcugggc

SEQ ID NO: 101648 - RNA, 64 nt, Human
ccagggacugcguuaggcccuggggaaacaucagugaauaaaacacggucccugcccacagugc

SEQ ID NO: 101649 - RNA, 64 nt, Human
uaaacuuuauauacuauaaaugugauuaagucaaugaauaaaaacauuaaugcauuggugauau

SEQ ID NO: 101650 - RNA, 64 nt, Human
agcuuaauaaaucuuuguugaauggcuuaaugaaugaauaaacugguuaauguuuaaguuaaac

SEQ ID NO: 101651 - RNA, 64 nt, Human
caguguccagcauaugguagauacuuguaguguuugaauaaaugaaaccagcauuagagcuuua

SEQ ID NO: 101652 - RNA, 64 nt, Human
uaccuggguguuccacagcugauagugauugccuugaauaaauucaagggcaauuuauucauuu

SEQ ID NO: 101653 - RNA, 64 nt, Human
uugaaauaucaaggauucuaguaauuguauuuccugaauaaauguauguuuaugaauuuucuaa

SEQ ID NO: 101654 - RNA, 64 nt, Human
gaugggaauuuuuaucuuagaaauggaugauucgugaauaaaacuagguacauaguaaguguau

SEQ ID NO: 101655 - RNA, 64 nt, Human
agauguuugcaauaucgaucagaugacuagaaagugaauaaaaauuaaggcaacugaacaaaaa

SEQ ID NO: 101656 - RNA, 64 nt, Human
guguuuuccagguggauauaguuuguaaacaaugugaauaaaguauuuaacauguucaacuguc

SEQ ID NO: 101657 - RNA, 64 nt, Human
gugagaaauaaggauaugagucucagcaaauucuugaauaaacuccccagcguauccuauggua

SEQ ID NO: 101658 - RNA, 64 nt, Human
accagcaaucuccaaaguccuguggugggagggcugaauaaauaaaaauacaaagaggugggua

SEQ ID NO: 101659 - RNA, 64 nt, Human
uuccaaugguucagucuagcuuucacaguuuuuaugaauaaaaggcauuaaaggcugaaguagu

SEQ ID NO: 101660 - RNA, 64 nt, Human
ucuuuccuuucauccucagcaagugcugagucugugaauaaagccacauaaccagcgggcacua

SEQ ID NO: 101661 - RNA, 64 nt, Human
gauucaacacugcgcuaaagcggggauguuccauugaauaaaagagcagugugguuuucugggu

SEQ ID NO: 101662 - RNA, 64 nt, Human
uuuuguacaucuagcuguaucgaggcaucaggccugaauaaacauccuuucuuacccacuguca

SEQ ID NO: 101663 - RNA, 64 nt, Human
gcagccggauccuggggcaacccaucuggucucuugaauaaaggucaaagcuggauucucgcca

SEQ ID NO: 101664 - RNA, 64 nt, Human
gcuucacccugucaggccagcuccacuccaggacugaauaaaggucuuugacagcucuagagcu

SEQ ID NO: 101665 - RNA, 64 nt, Human
aguugacgcuuuugguucuguuguaaagcaaagaugaauaaaaauuuccaaugucuucaauugu

SEQ ID NO: 101666 - RNA, 64 nt, Human
gauugacucugcuauuggcaagacaaagaaacaaugaauaaaggaacugcuuagauaugugcca

SEQ ID NO: 101667 - RNA, 64 nt, Human
aaauauguugaaucaaagugaaauauuuauuuuuugaauaaaggagauaauagccuuaaacugg

SEQ ID NO: 101668 - RNA, 64 nt, Human
aggaaauacaauaaauacagaaaagucauaugguugaauaaauaauuauaaauugagcacugau

SEQ ID NO: 101669 - RNA, 64 nt, Human
uuuacaagggcauaaaguaaauacaugcauauaaugaauaaaucauucuuacuaaaaaguauaa

SEQ ID NO: 101670 - RNA, 64 nt, Human
ccugcuuuuaguuauuauguauguacaccauauaugaauaaacaguuuccaaaaacuuaaaaua

SEQ ID NO: 101671 - RNA, 64 nt, Human
gaggaagucuuugucagcccuuauagcuaucaugugaauaaaguuaagucaacuucaaaaacaa

SEQ ID NO: 101672 - RNA, 64 nt, Human
uuaacucagcuugagacuguacuacaguuagguuugaauaaauauuuucauuaacuucaaaagu

SEQ ID NO: 101673 - RNA, 64 nt, Human
augccaugccaagcacucuuucugucucuguucaugaauaaaagagauggaugggcuuauucuu

SEQ ID NO: 101674 - RNA, 64 nt, Human
caugcuacugaugauaaauuuguuacuuuggaguugaauaaaugugaaggcugugaagagugga

SEQ ID NO: 101675 - RNA, 64 nt, Human
uguccuucucuggaaaaugccaaaauacacgaugugaauaaaaguacaacggcuaaauuguguc

SEQ ID NO: 101676 - RNA, 64 nt, Human
aagguacuuucccucuucucucaggccaugcauuugaauaaagugccucccuuagccugagcuc

SEQ ID NO: 101677 - RNA, 64 nt, Human
uguuggcuucaggccuuugguauucugucucuacugaauaaauacaaaugguuccagccuauca

SEQ ID NO: 101678 - RNA, 64 nt, Human
gaugguugaagaaaauuagugcauaauuucucagugaauaaaguuguagcucucauauacuaaa

SEQ ID NO: 101679 - RNA, 64 nt, Human
cuaaaaauguagaauaaagacuauuuugaagauuugaauaaagugaugaaguugcauuacaccu

SEQ ID NO: 101680 - RNA, 64 nt, Human
cuauuguggcauauaugaauucucaaacauuaucugaauaaauuuuccacucuuggaaagguag

SEQ ID NO: 101681 - RNA, 64 nt, Human
uugauugcuaaauguaacagucugaucgugacgcugaauaaaugucuuuuuuuuaaugugcugu

SEQ ID NO: 101682 - RNA, 64 nt, Human
acccgcagggggaaggagggaggcugacaagccuugaauaaaacacaagccuccguuucucugu

SEQ ID NO: 101683 - RNA, 64 nt, Human
caccccaaaacacauacauugaaagugccucaucugaauaaaaugacuuguguuuccccuuugg

SEQ ID NO: 101684 - RNA, 64 nt, Human
aaggauucauggauaaaaugaacaggaauagaucugaauaaagcaaaucugcauaaaugguaac

SEQ ID NO: 101685 - RNA, 64 nt, Human
gaguauaagaaagguuaggcauauuuucauuaacugaauaaacgacuugauuuauauaaccugg

SEQ ID NO: 101686 - RNA, 64 nt, Human
aaagauggagcaugaucuaaguacauagcacaugugaauaaaagaaaagcugacaguauauucu

SEQ ID NO: 101687 - RNA, 64 nt, Human
ugugauuuuuuuuuuuuuuuuuuggugggguaguugaauaaaauugggcagcuaaauuuuucag

SEQ ID NO: 101688 - RNA, 64 nt, Human
uuuuaggaaaauaagagaaagguaagggcucuuuugaauaaacugcuguuuuauuuguggcaca

SEQ ID NO: 101689 - RNA, 64 nt, Human
uuuuuguuuauaccagucuuaaagauccagguucugaauaaaaaaauuaauugauacaauugau

SEQ ID NO: 101690 - RNA, 64 nt, Human
guuucucacccugcugauucugugguaucuguguugaauaaagaaaaagguagcagugcuucuc

SEQ ID NO: 101691 - RNA, 64 nt, Human
uccuaaugaacaugaggaugggaucaaugugggaugaauaaacuuuaguucagaaacaggacuu

SEQ ID NO: 101692 - RNA, 64 nt, Human
gaauguugcauuaauugugcuguuugcuuguaguugaauaaaaauagaaaccugaaugaaggaa

SEQ ID NO: 101693 - RNA, 64 nt, Human
uuuaagcauugcagauaucaaaguucuauugugcugaauaaaugccccuuuguuaacaggucuc

SEQ ID NO: 101694 - RNA, 64 nt, Human
ggauugucuuucaacgcagcgugagucuaaugguugaauaaaacuuacugaugaucaugggguu

SEQ ID NO: 101695 - RNA, 64 nt, Human
cgggaaagagaauuauaguuuuuaugccuccuguugaauaaaugguguccugauugccuggguc

SEQ ID NO: 101696 - RNA, 64 nt, Human
uuauuugaaucaacaguuaacuucaguagucaugugaauaaaauucuuauugucuaaauugaga

SEQ ID NO: 101697 - RNA, 64 nt, Human
uucagagaauuuacacuaggaacaccuuauaaguugaauaaauuaaggaagcauuuucccauug

SEQ ID NO: 101698 - RNA, 64 nt, Human
uguucacuuugaagugugaaguuuuaaaaauacgugaauaaauugguuauugaaacaucuaaga

SEQ ID NO: 101699 - RNA, 64 nt, Human
cuaaauaucuuugaaggagacaacaacuuuuaaaugaauaaagaggaagucaaguugcccuaug

SEQ ID NO: 101700 - RNA, 64 nt, Human
uaguucucacuguucccucugcuccuggagccuuugaauaaaaaugcacguagcugaggccgga

SEQ ID NO: 101701 - RNA, 64 nt, Human
cuuuguaaauagguguguugaauuuguuuugaagugaauaaaauucucaaaaagaugacauauu

SEQ ID NO: 101702 - RNA, 64 nt, Human
gaagacacguguuuuuguaucuuuaaagacuugaugaauaaacacuuuuucuggucaaugucuu

SEQ ID NO: 101703 - RNA, 64 nt, Human
uugucucuauaaaauagacacuaaaaauauuugcugaauaaauauguacuucuggucaaacuau

SEQ ID NO: 101704 - RNA, 64 nt, Human
ucacagguucacaguuaagaaggaauuuugccucugaauaaauagaaucuugagucucaugcau

SEQ ID NO: 101705 - RNA, 64 nt, Human
cagaaaagaaugggugauuaaaguucauuacagcugaauaaaugugucuaaaacagacucuugu

SEQ ID NO: 101706 - RNA, 64 nt, Human
ucagagauguguuccaugcucucuagcacaggaaugaauaaauuuauaacaccugcuuuagccu

SEQ ID NO: 101707 - RNA, 64 nt, Human
ugacuagccuuucaucaguguccugccugaucacugaauaaagaacugagauggaggggaguga

SEQ ID NO: 101708 - RNA, 64 nt, Human
uggauacuuauaaucaaaacuuuuacuaggguauugaauaaaucuagucuuacuagaaaauaaa

SEQ ID NO: 101709 - RNA, 64 nt, Human
aaaguuccuaauguguauuuuuaaagcacauaucugaauaaauugccuagauagaaaaaaaauu

SEQ ID NO: 101710 - RNA, 64 nt, Human
cacuuucacuacagcacagauuucaccucugucuugaauaaaggucccacuuugaagucacugg

SEQ ID NO: 101711 - RNA, 64 nt, Human
acagacccaagcuguccauuucugugauggguuuugaauaaaguauucccugucuuaaaugaau

SEQ ID NO: 101712 - RNA, 64 nt, Human
cuuggggccauguccccuucuugcugccacaggaugaauaaaguguugagauuugucuauggag

SEQ ID NO: 101713 - RNA, 62 nt, Human
cuuucucugcucucuuugccuucuuuuguucuguugaauaaagcauauugagaaugugaaca

SEQ ID NO: 101714 - RNA, 64 nt, Human
caagugcagcuguagaaaagugcuugucaguuguugaauaaaaaaaaccacauuugauagagau

SEQ ID NO: 101715 - RNA, 64 nt, Human
ccaguagauuaauguugugacuauucagaaaaggugaauaaaauugggauauaaaauggacucu

SEQ ID NO: 101716 - RNA, 64 nt, Human
ccauugguaauaauguuggcaaguaauaguuaucugaauaaaucaaucauauaagaauguauag

SEQ ID NO: 101717 - RNA, 64 nt, Human
cucauuuguuaaaauuaucaauaucuaauauauaugaauaaaguguaaguucacaacuacuuau

SEQ ID NO: 101718 - RNA, 64 nt, Human
cugacucaguauaguuacugguaccacagugaggugaauaaaacgggauuuucagaaguuagcc

SEQ ID NO: 101719 - RNA, 64 nt, Human
aaugaaaauauuaauuuaagagacucugggagucugaauaaaguagcuuuauauuaacuacagg

SEQ ID NO: 101720 - RNA, 64 nt, Human
acugucuccuuaaccacugaacaguucagccauuugaauaaauuguacauuguaaagcuuauag

SEQ ID NO: 101721 - RNA, 64 nt, Human
accauuuacacaagagauggcuuuuuccuuugcuugaauaaacauuuuggaucaccuccaaaga

SEQ ID NO: 101722 - RNA, 64 nt, Human
uuacauggauugccaauuuuuaaaacacuaaaguugaauaaaaugcaugaacaauagaaaaaug

SEQ ID NO: 101723 - RNA, 64 nt, Human
aggcuugguugguagauauucaggaaauguucacugaauaaauaaguaaauacauuauugaaaa

SEQ ID NO: 101724 - RNA, 64 nt, Human
uuauuuucagccaguaaucaaaacagacugggaaugaauaaagcacuuacagaagaguauccua

SEQ ID NO: 101725 - RNA, 64 nt, Human
cauauauauauauaaacacacacauagauauauaugaauaaacaaaaaugaaauccugcuaaga

SEQ ID NO: 101726 - RNA, 64 nt, Human
gagaggagaaaaugaagaggcaugaagaaguauuugaauaaauaauggcuaaagauuuuccaaa

SEQ ID NO: 101727 - RNA, 64 nt, Human
cauuuucuuaguuuuguaauaccuuuuuuauuugugaauaaaauuaucaccugguauucuuauu

SEQ ID NO: 101728 - RNA, 64 nt, Human
uaugaauucccuguuaguugauuuaaauccuuucugaauaaagaucagauaaacaguaacugaa

SEQ ID NO: 101729 - RNA, 64 nt, Human
ugcauauaaaagguagacagcugauauguuuucaugaauaaauauugucagccagaaaagguug

SEQ ID NO: 101730 - RNA, 64 nt, Human
aaucuuuuuuuuuuuuuuuggucaagcuugaggcugaauaaagccuuugaugcacaaaauggga

SEQ ID NO: 101731 - RNA, 64 nt, Human
aauuuucagacacauuuuuggauuucugugaaguugaauaaacauaaaagcuaauacaguugua

SEQ ID NO: 101732 - RNA, 64 nt, Human
uggaucuuugguuuguuuccagguuugguuauuaugaauaaaguugcugugaauacuuacgugu

SEQ ID NO: 101733 - RNA, 64 nt, Human
gugggaaauuagaggguuggugagauuuuggugaugaauaaaugccauagaguuagagucacua

SEQ ID NO: 101734 - RNA, 64 nt, Human
ccuuguaaacuuccaggaagauugguugaaagucugaauaaaagcuguccuuuccuaccaauuu

SEQ ID NO: 101735 - RNA, 64 nt, Human
uugauugcuaaauguaauagucugauugugacgcugaauaaaugucucuaaaaaaaaaaaagau

SEQ ID NO: 101736 - RNA, 64 nt, Human
cuucuguccuuaaagguuucagacauggugaaacugaauaaagcaugucauuugcuccuagaua

SEQ ID NO: 101737 - RNA, 64 nt, Human
uuguauggugagagugaugaauuguuggaucauuugaauaaaaucuuuuacuaaccccaugaua

SEQ ID NO: 101738 - RNA, 64 nt, Human
guguaugcagaggcagcccucaauaugcagugguugaauaaaugaaugaagaaaccacuaucaa

SEQ ID NO: 101739 - RNA, 64 nt, Human
guaucccagcacauguaauuuuuuaaauaguuucugaauaaacacuugauaacuaugucaaaua

SEQ ID NO: 101740 - RNA, 64 nt, Human
agcauguauacaaaauauauuugagguuacuaaaugaauaaaaacucggaauuaggccaggaga

SEQ ID NO: 101741 - RNA, 64 nt, Human
aaaaguuuguuuauauucagaagucugacuaugaugaauaaaucuuaaaugcuuuguuuaauua

SEQ ID NO: 101742 - RNA, 64 nt, Human
acauuuucacugaaugaaugaaucagugaguuaaugaauaaauaaacaaaugggagguguucuc

SEQ ID NO: 101743 - RNA, 64 nt, Human
uauguuuauuaaaauugaaauaauguaaaacacaugaauaaauuugcaaaaccaagaucacagu

SEQ ID NO: 101744 - RNA, 64 nt, Human
auuguuaauauuguaauuuaauguagacuuacuuugaauaaaauuaguuuaauuggccuuaaaa

SEQ ID NO: 101745 - RNA, 64 nt, Human
gaggcaccuaccuucauuuugcuaacgcuuauucugaauaaaaguuuuugauuccuuaaagaca

SEQ ID NO: 101746 - RNA, 64 nt, Human
cugucuuugaugaggaauuauuguuauugguuccugaauaaaacauuaaccuuuuaagucagaa

SEQ ID NO: 101747 - RNA, 64 nt, Human
ggugcauauuaaaauaagcagagaaaaaaaaaugugaauaaacuacugaaaacacuugguguuu

SEQ ID NO: 101748 - RNA, 64 nt, Human
cagcacaucacuguagaauuugagugaucuaugcugaauaaacaguggaaugugaccagucaag

SEQ ID NO: 101749 - RNA, 64 nt, Human
cacaauccagaauguucuaacaauaaguuuucagugaauaaaccacuggcaagacaauuccaug

SEQ ID NO: 101750 - RNA, 64 nt, Human
aaagugcuauuuuguuuguauuugaaaaucucugugaauaaauucucucuuugaucaauagcua

SEQ ID NO: 101751 - RNA, 64 nt, Human
auggugguuguauuagagaacugauguauuaucuugaauaaagacuuugucuuguuuacugcca

SEQ ID NO: 101752 - RNA, 64 nt, Human
cuaaaagggcuuuauucuauaguugaaucaccucugaauaaagauauaaaaccuacuucugauu

SEQ ID NO: 101753 - RNA, 64 nt, Human
aaaaaaguaacuuaaaaacaagaaacuugguuauugaauaaacagauaaguuuaaaaaaaaaaa

SEQ ID NO: 101754 - RNA, 64 nt, Human
guacuugauuuauuauacuuaccaaagcugcaacugaauaaaucuggugaggugaggccuucaa

SEQ ID NO: 101755 - RNA, 64 nt, Human
gaaauaaugcgccucuugaggagaaaagcaauaaugaauaaaaggacuuuccuacaauaacuuc

SEQ ID NO: 101756 - RNA, 64 nt, Human
uuuaaguuagguaacauuuuauauuacuuucauaugaauaaaaguaauccaugcauuguagagu

SEQ ID NO: 101757 - RNA, 64 nt, Human
uuuauauagcauauucuuuaucuuggauauuuuaugaauaaaguauaguuauuuuaagugccaa

SEQ ID NO: 101758 - RNA, 64 nt, Human
cuaacauuuuguucuaaaacuguccuucacaaauugaauaaaaaacucucacacucaguguguc

SEQ ID NO: 101759 - RNA, 64 nt, Human
auuuggacgugauuuuuccaugcagcaucuggugugaauaaaacagcaguugacugauguuuac

SEQ ID NO: 101760 - RNA, 64 nt, Human
uccaggggugggaauuuuuuuuuaauaugugucaugaauaaaguuguuuuugaaaauaaaaauu

SEQ ID NO: 101761 - RNA, 64 nt, Human
uuucaaugccaaaagauagaagauuaaauauucuugaauaaagcagugauauauauuggaacac

SEQ ID NO: 101762 - RNA, 64 nt, Human
uauuuuugauauuuguccaaacaggacauacaauugaauaaaagaguuuaggaacugguuucug

SEQ ID NO: 101763 - RNA, 64 nt, Human
auugaguauguggucacaugaaaacacggaugaaugaauaaaacacucuuugguggugacugag

SEQ ID NO: 101764 - RNA, 64 nt, Human
uguauguauugguaaugaugucauuaaaaguauaugaauaaaaauaugaguaacaucauaaaaa

SEQ ID NO: 101765 - RNA, 64 nt, Human
auuuuguaucauuuguuuuccucaucuaaaaaguugaauaaaaucuguuugauucaguucuccu

SEQ ID NO: 101766 - RNA, 64 nt, Human
accuaaguaguuuuucauuauuuuaaguugaauuugaauaaagauuccagaaauaaacauggag

SEQ ID NO: 101767 - RNA, 64 nt, Human
ccauaacauuuucuguaaugauacugaaacuuaaugaauaaaaaaauuccuugaucauuauuua

SEQ ID NO: 101768 - RNA, 64 nt, Human
uauuuuagucuugauguggaacuguaggagcaggugaauaaaggaucucuauaacagauccuuu

SEQ ID NO: 101769 - RNA, 64 nt, Human
cucucuucacccaucuuuuuuaaaaacaaauaaaugaauaaagcugcugugacacacacacaaa

SEQ ID NO: 101770 - RNA, 64 nt, Human
acagacuccuuguucucuagaagggcuuuuuacuugaauaaaacaaugcaacuuagcaaaccaa

SEQ ID NO: 101771 - RNA, 64 nt, Human
uuuguuuuaucaaaagauuaagagcuccuuucuuugaauaaaauaauuucucauaauuaagcag

SEQ ID NO: 101772 - RNA, 64 nt, Human
gaauggcacggagcagagacucaggaacacuugaugaauaaaugagugaucagcuuucuaagcu

SEQ ID NO: 101773 - RNA, 64 nt, Human
cagcaaagcuuuccagaaggcauaaaaggaaacuugaauaaaggaagauauguuccacauuccu

SEQ ID NO: 101774 - RNA, 64 nt, Human
uuuacauguucuauuuuguauccuaaugacagaaugaauaaaccucuuuauauuugcacaagag

SEQ ID NO: 101775 - RNA, 64 nt, Human
acuugauauuuucaauuuuggaagaacuaaaagaugaauaaacuggguuuuuuuuguuguuugu

SEQ ID NO: 101776 - RNA, 64 nt, Human
aagagggcaggacccagcauaaugauuauauggcugaauaaaguugcacugugacuggguguug

SEQ ID NO: 101777 - RNA, 64 nt, Human
ugcccccuacccuugcccuuuaacuuauugggacugaauaaagaauggagaggcccucucaggc

SEQ ID NO: 101778 - RNA, 64 nt, Human
aguccagauuuacacugggagaggugccagcaacugaauaaauaccucuuagcugaguggaaaa

SEQ ID NO: 101779 - RNA, 64 nt, Human
ccgggaacauaguaagggcucaguaaauacuuguugaauaaacucagucuccuacauuagcauu

SEQ ID NO: 101780 - RNA, 64 nt, Human
ccucagccccauuuugcugaaaauaaugacuuucugaauaaagauggcaacacaauuuuuucuc

SEQ ID NO: 101781 - RNA, 64 nt, Human
augguuuauguuaaauguauauucuuuuaaucaaugaauaaagcauuaaaaaugaucauuguaa

SEQ ID NO: 101782 - RNA, 64 nt, Human
uuaauaaugugguacaaauuuuaaaguuuaauauugaauaaaaggaggauuaucaaauucauau

SEQ ID NO: 101783 - RNA, 64 nt, Human
aucaguuuuguauaacuuaaaauaauuaaauaaaugaauaaauccaaaacaaacaugcaguacu

SEQ ID NO: 101784 - RNA, 64 nt, Human
uaacaaaauauaucuaauuuuuauuggauaaauaugaauaaauauuuucucucagggaaaauaa

SEQ ID NO: 101785 - RNA, 64 nt, Human
cagaaucuuuaaaauauaagacagugcuaucuagugaauaaaaaaauuaguuugaaagauaucu

SEQ ID NO: 101786 - RNA, 64 nt, Human
uguuggaacaauuacacuggccaugccauaauguugaauaaaacucucuucuuaugagguucuc

SEQ ID NO: 101787 - RNA, 64 nt, Human
uuguggccucuuucuacaccuggaaauuuacucuugaauaaauaaaaacucguuugucuugucu

SEQ ID NO: 101788 - RNA, 64 nt, Human
ugcagggccaucugacugccaagccagauucucuugaauaaaguauucuaguguggaaacgcug

SEQ ID NO: 101789 - RNA, 64 nt, Human
aagucccaaggguguuuuguuacuguuuucuccaugaauaaacucacuugauuuuaaauuaaag

SEQ ID NO: 101790 - RNA, 64 nt, Human
aaucaaaggaucuuuuguccauuccauuaauaacugaauaaaaaauaaauaaaauggauagaaa

SEQ ID NO: 101791 - RNA, 64 nt, Human
ugcucaauacuuaccuaaucaaauggcauccauuugaauaaaaugacaauaacuaaagcuaguu

SEQ ID NO: 101792 - RNA, 64 nt, Human
uguuuuaaguaauauugcacuuuauaaaaaaguaugaauaaagcaaacuauuuuauaaagugca

SEQ ID NO: 101793 - RNA, 64 nt, Human
uacuucaaaugucauuucauacaaauuuucccagugaauaaauauuuuaggaaacucuccauga

SEQ ID NO: 101794 - RNA, 64 nt, Human
aauuaccuuuggaaggagcuauauagaaaaaaaaugaauaaaguguuuuguuggaaaaugcucu

SEQ ID NO: 101795 - RNA, 64 nt, Human
cacuuuuagaauuuguguuuauauuuccuguaagugaauaaauaaaacaaaacaaaacaaaaaa

SEQ ID NO: 101796 - RNA, 64 nt, Human
gggaauaauaaaaugaaauaauacuuuuauuuucugaauaaaaguuugucacugauuguguucu

SEQ ID NO: 101797 - RNA, 64 nt, Human
uaguaagagagaagcuuuuaaaacaguacauuccugaauaaaacaacaauauuguaucuuaauc

SEQ ID NO: 101798 - RNA, 64 nt, Human
acugaaugaucuauuccccaucccaaggcaagcaugaauaaaauuagguuaaacguagcaugug

SEQ ID NO: 101799 - RNA, 64 nt, Human
gagaucauagauacaggauuauauaacgaaauuuugaauaaacuugaauuccuaaaagauggaa

SEQ ID NO: 101800 - RNA, 64 nt, Human
guagaauacuuucuguguuuuuaucuuauacacaugaauaaaugcuauggcuuaucacaguuac

SEQ ID NO: 101801 - RNA, 64 nt, Human
ccauaccacagagcuagauugcccaggucugggcugaauaaaacaagguuuuucuacucugugg

SEQ ID NO: 101802 - RNA, 64 nt, Human
agacagauuuguccuuuacagaaauuacugagugugaauaaaaacuucagauccaagaaauaua

SEQ ID NO: 101803 - RNA, 64 nt, Human
aguuuguuuaaagaaauauauucaaaaucauuugugaauaaacuugaucauccaucucaauauu

SEQ ID NO: 101804 - RNA, 64 nt, Human
ccaaggaauguguccaagacacaugcugagguuuugaauaaaaagugaacuuuuguaauuugaa

SEQ ID NO: 101805 - RNA, 64 nt, Human
uuuauauaaauaccaaauugcagcauccccaaaaugaauaaagccuuuuuacuugugggugcaa

SEQ ID NO: 101806 - RNA, 64 nt, Human
aggagauuguggggagagaaaucuuaagucauaaugaauaaagugcaaacagaagugcauccug

SEQ ID NO: 101807 - RNA, 64 nt, Human
auuuaggugaaaagucuuauuuauuaaagugguuugaauaaaguagaucaaaacuuccagagau

SEQ ID NO: 101808 - RNA, 64 nt, Human
cuucauuuuuuaccuuugaaauacuuaaucuuucugaauaaauauaaugugucuauaaaauaau

SEQ ID NO: 101809 - RNA, 64 nt, Human
uagguacaguaaugaaaacuauacuaucaaaaugugaauaaaauuauagucagccauaaauauu

SEQ ID NO: 101810 - RNA, 64 nt, Human
cacuuugccuccuguguacugugucauaaacagaugaauaaacugaauuuguacuuuagaaaca

SEQ ID NO: 101811 - RNA, 64 nt, Human
ccauaaaggucaaaucauuuuggacagcuucuuuugaauaaagaccugauuauacaggcaguga

SEQ ID NO: 101812 - RNA, 64 nt, Human
ccagcgcuguugagggguccccucuggaaugcacugaauaaagcacgugcaaggacucccggag

SEQ ID NO: 101813 - RNA, 64 nt, Human
gugaaaauuacuaauuugaguauuaacaaauaacugaauaaauggaucauuacaguuagguuuu

SEQ ID NO: 101814 - RNA, 64 nt, Human
cuuccagaguuauggaaauuuuguccccauguaaugaauaaauuguauguauuuuucucuauau

SEQ ID NO: 101815 - RNA, 64 nt, Human
uccugcuguauuuccugcuucccuguugaauuggugaauaaaaccuugcucuuuacauacaaug

SEQ ID NO: 101816 - RNA, 64 nt, Human
uuaugugcauagugggagcuuaguauuugcugaaugaauaaaaauugaaaggaaaaaauuuaaa

SEQ ID NO: 101817 - RNA, 64 nt, Human
aggaggcucugccuaaugugaauuuauuuauuugugaauaaacuguacuggugucaguuggcaa

SEQ ID NO: 101818 - RNA, 64 nt, Human
uugaaaaagcccuggacccaaacugcggcacuguugaauaaagggcaguccuacuccuguccuu

SEQ ID NO: 101819 - RNA, 64 nt, Human
uccuccccuccuugcaccggcccuuccuggucuuugaauaaagucugagugggcagcagccugu

SEQ ID NO: 101820 - RNA, 64 nt, Human
ccuccccuuccugcacccguacccccguggucuuugaauaaagucugagugggcggcagccugu

SEQ ID NO: 101821 - RNA, 64 nt, Human
cacccccuuggguaccagagggagcugugcauugugaauaaagagugagcuugguucuggacuc

SEQ ID NO: 101822 - RNA, 64 nt, Human
agcccccgcaggggccugcgccaccccguccuggugaauaaacgcacucccugugccucagacc

SEQ ID NO: 101823 - RNA, 64 nt, Human
ucugggaaguggggcacacggggccuccgaacuaugaauaaagcuuugaaaggccguugucagu

SEQ ID NO: 101824 - RNA, 64 nt, Human
cccuuuuucccugucuuccuuaaaguuucacuccugaauaaaacuucacuuugccuuagaaucu

SEQ ID NO: 101825 - RNA, 64 nt, Human
uuuugauugcacaagccuuuguuuucaguccuagugaauaaaguuguguuuucuggagcgucug

SEQ ID NO: 101826 - RNA, 64 nt, Human
ucagcaaaaacagucaaaaaacccccacagauuuugaauaaaggaucuacuuugguacgggccu

SEQ ID NO: 101827 - RNA, 64 nt, Human
guuuuugugguugaucuagacagaugcuagauaaugaauaaaaacugguuuagggccauaucca

SEQ ID NO: 101828 - RNA, 64 nt, Human
auucaagcaggcgccaagugcuaugacagaggugugaauaaaagcaucaggaaaucggauggag

SEQ ID NO: 101829 - RNA, 64 nt, Human
aacuggaguagugauaaacaccuuaaucauaaaaugaauaaaaacaaaaaaaccauggggcuug

SEQ ID NO: 101830 - RNA, 64 nt, Human
uuuagaaacuguugcuaagaaaagugguccauccugaauaaacauguaauacuccagcagggau

SEQ ID NO: 101831 - RNA, 64 nt, Human
aaccaccguacccagccuaucuuuuugauacuuuugaauaaagaaagggucauaugcaugacag

SEQ ID NO: 101832 - RNA, 64 nt, Human
gagaaagugccagcccugaagcuggagccguuugugaauaaacuguucuucaucauugacacug

SEQ ID NO: 101833 - RNA, 64 nt, Human
ccaggagauggauuuaguuauucaauuuuguggaugaauaaauugaggcacagaaagauuaagu

SEQ ID NO: 101834 - RNA, 64 nt, Human
cagggcuggcaccucucaacgucuguggacugaaugaauaaacccuccucauccaccccuauuu

SEQ ID NO: 101835 - RNA, 64 nt, Human
acugccuagcacacaguaggcauucaauacuuguugaauaaauaaacuggcuuucaccuaagga

SEQ ID NO: 101836 - RNA, 64 nt, Human
ccccacaucacuacauucccucggcccguguuagugaauaaaguauuauauccucaccccaccc

SEQ ID NO: 101837 - RNA, 64 nt, Human
uucuagagaugcuuguauaggcuguuaauugugaugaauaaacguucaacccucggccugcagc

SEQ ID NO: 101838 - RNA, 64 nt, Human
acaugaaaauuuuuaaaaauaugcucuuuguguuugaauaaaguaguaaugcauguaaacauau

SEQ ID NO: 101839 - RNA, 64 nt, Human
uucaaccauuccccaugggaaaugucaacaaguaugaauaaagacaccuacugaguggccgugu

SEQ ID NO: 101840 - RNA, 64 nt, Human
aggccaagcacagggucuggcucguggcaaaccuugaauaaauauuuguuggcugaaugagugg

SEQ ID NO: 101841 - RNA, 64 nt, Human
cccccauacauuuauuucuguaaauaaugugcacugaauaaauuguacagccggcaaauguguc

SEQ ID NO: 101842 - RNA, 64 nt, Human
accaaggcucgguccagcccaguaccgcuggaagugaauaaacuccggagggucggacgggacc

SEQ ID NO: 101843 - RNA, 64 nt, Human
aaaaggaaauuguaauauuuguacaguguucaagugaauaaaaaccaugccuaaggcuagcucu

SEQ ID NO: 101844 - RNA, 64 nt, Human
agguauuggguauacuuauacucuauagggucguugaauaaauggcuuagaauguggcugaugg

SEQ ID NO: 101845 - RNA, 64 nt, Human
caaacaaaaaaaagaccaucaguaagggaauggaugaauaaauugugguaaaaacauaccaugg

SEQ ID NO: 101846 - RNA, 64 nt, Human
ccucauuuuuggccucucauguuccaaaccucauugaauaaaagcaaugaaaaccuugaucaau

SEQ ID NO: 101847 - RNA, 64 nt, Human
aaaggcaggcugcccugaccaaaaauaucugccaugaauaaaggugccugaaauccugcuauga

SEQ ID NO: 101848 - RNA, 64 nt, Human
auaggaucuuuaaaacauuuuuaaugaacuaaguugaauaaaggcacaauuaaaaacugucauc

SEQ ID NO: 101849 - RNA, 64 nt, Human
gccugguccagcccuggacagauugauuuccagcugaauaaauuggccuagauacccucuuacu

SEQ ID NO: 101850 - RNA, 64 nt, Human
gaaguggcuuuacgcuucaggaagccacgccuguugaauaaagcuuugguguguuugcagaugg

SEQ ID NO: 101851 - RNA, 64 nt, Human
uuguacuuuguuguguagaguggaagaauuguguugaauaaacccaagaucggaaugcaaaucu

SEQ ID NO: 101852 - RNA, 64 nt, Human
augggaagggaggcaucccacccccaagaagaacugaauaaagauugcugagcaaaggaaggcu

SEQ ID NO: 101853 - RNA, 64 nt, Human
ggccaugauucuuaagagaauugacugggccucaugaauaaaaaaauuagaaaaucuggucauu

SEQ ID NO: 101854 - RNA, 64 nt, Human
ugucauccugcugccaagaaguuuuuuaaucacuugaauaaauugauauaauaaaaggagccac

SEQ ID NO: 101855 - RNA, 64 nt, Human
cagugauugagguggugacuaaauauacagucauugaauaaauaccauguagcaaguguacuuu

SEQ ID NO: 101856 - RNA, 64 nt, Human
cacuuggggaguuucuuccuggcaucaugccuucugaauaaaugccgauuuuauccauggacuu

SEQ ID NO: 101857 - RNA, 64 nt, Human
auguauaugcugugucauacucauaaucuggaaaugaauaaagugauauauuccugguuuguaa

SEQ ID NO: 101858 - RNA, 64 nt, Human
aguuacauauuauuauuuuaaaaguauauauuauugaauaaaagguuuuaaaagaaacguaugg

SEQ ID NO: 101859 - RNA, 64 nt, Human
gacuuugaggagaggcugugauguuuaugaucccugaauaaagcuacuccuuggagagaugcca

SEQ ID NO: 101860 - RNA, 64 nt, Human
agucuucacugagggccacuuuacaaaggaaauuugaauaaauggagagagagagaagccuugu

SEQ ID NO: 101861 - RNA, 64 nt, Human
ucauucacuuuacuuuuaaaaauuuguccuuaaaugaauaaauaaaauaaaaguugguccugug

SEQ ID NO: 101862 - RNA, 64 nt, Human
ccucacagacaguaggaucccaguaaauauggguugaauaaaaugugucuuguccaaccuacaa

SEQ ID NO: 101863 - RNA, 64 nt, Human
aaaggucaagagaucaaagaaagguccaaacucuugaauaaaaggacauggcagagggagauuu

SEQ ID NO: 101864 - RNA, 64 nt, Human
uuuguaagguuuuuguagugauuuuuaugccaccugaauaaagaaugaaugggccuggcugguu

SEQ ID NO: 101865 - RNA, 64 nt, Human
gcucucuccccgacacauuuguuaaaaucaaaccugaauaaaacuacaaguuuaauaugaagcc

SEQ ID NO: 101866 - RNA, 64 nt, Human
gccaagggauggacaucuugucauuuuuuuucuuugaauaaaugucacuuuuugaggcaaaaga

SEQ ID NO: 101867 - RNA, 64 nt, Human
ccccugcugcugccaccgcuuccugccugucauuugaauaaacaguguuucuauugagcucuug

SEQ ID NO: 101868 - RNA, 64 nt, Human
gaauugauuuuuaaacacauauaacaguaggaaaugaauaaaugggcuucugcauuuggcuuuc

SEQ ID NO: 101869 - RNA, 64 nt, Human
agacugcuuuucuuuuagcugccagauuggauugugaauaaaaauaauucuucccucucccucu

SEQ ID NO: 101870 - RNA, 64 nt, Human
uuaauaaaacaauugguaauucugaauaaggaucugaauaaauccagaucacagacuguuccuu

SEQ ID NO: 101871 - RNA, 64 nt, Human
uugcuauaagggaaacagaguggccuggcugauuugaauaaauguuucuuuccucuccaccauc

SEQ ID NO: 101872 - RNA, 64 nt, Human
ucccugguagcagaaauccuuaccuauauguuucugaauaaauucugaaccauccucaucucau

SEQ ID NO: 101873 - RNA, 64 nt, Human
ucucugguagcagagauucuuaccuauauguuucugaauaaacucugaaccaucuucaucucau

SEQ ID NO: 101874 - RNA, 64 nt, Human
cugcuaccagcagagauucuuagcuauauguuucugaauaaacucugaaccauccucaucucau

SEQ ID NO: 101875 - RNA, 64 nt, Human
ugcccaagguccuccuguucagacauuccuauguugaauaaaguauguuugacuuccccggaga

SEQ ID NO: 101876 - RNA, 64 nt, Human
ggauuuacacccauuguuuuggaagcacaucagcugaauaaaguugagguuuauuuuauuuaga

SEQ ID NO: 101877 - RNA, 64 nt, Human
gcaggacagggucuccugcugcaagucccaacuuugaauaaaacagaugauguccugugacugc

SEQ ID NO: 101878 - RNA, 64 nt, Human
uauuuuauuuaaaaaaaaucaaguacuuuggaagugaauaaaguaagagauagccugucucacu

SEQ ID NO: 101879 - RNA, 64 nt, Human
guuuucuuucugggaagaaaaguguguucuauaaugaauaaauauagagugguuuuuacuuguc

SEQ ID NO: 101880 - RNA, 64 nt, Human
ucuauauuuacauuuuaauauaauauacaaauuuugaauaaaagaucaugggcaaugcaugcac

SEQ ID NO: 101881 - RNA, 64 nt, Human
guccucaucuguucugacugaaggauggaggugcugaauaaauuaggccucaggccucuaccac

SEQ ID NO: 101882 - RNA, 64 nt, Human
uugaauagucugaaaugcugugacuuuuuuugugugaauaaagauaugaaacuucugaaucuca

SEQ ID NO: 101883 - RNA, 64 nt, Human
aucugaauugugcccuguacugcaguuacuuguuugaauaaaaguuuuauuuauugcacgaguu

SEQ ID NO: 101884 - RNA, 64 nt, Human
guggucucgguguguuuugauaugaaaacucucaugaauaaacaucuccgugaaacgccaaggc

SEQ ID NO: 101885 - RNA, 64 nt, Human
cuuguguuguugaccuccugauggcuugucauccugaauaaaauauaauaauaaauuuuguaua

SEQ ID NO: 101886 - RNA, 64 nt, Human
uggaaaacuuuuguuuuuugggguuuuuuuuuucugaauaaaaaagauucuacuaacaaggugc

SEQ ID NO: 101887 - RNA, 64 nt, Human
aaaaaaaacaaucccaaggguacagaagagcuuaugaauaaaaguaguuuucuccucuaccccu

SEQ ID NO: 101888 - RNA, 64 nt, Human
caguuuuaggggacaauugagauggcugaacuacugaauaaaaaaaaaacaacgcuguuuucua

SEQ ID NO: 101889 - RNA, 64 nt, Human
acuugcuuuaugacguuuauuuuccuguuaaagcugaauaaauaaaaacuacaguaaauguaua

SEQ ID NO: 101890 - RNA, 64 nt, Human
uacuugguuucuuuuacuuaccugcuugaauacuugaauaaaccauucaccaauuuuaauccuu

SEQ ID NO: 101891 - RNA, 64 nt, Human
gagcaagaguguuuggcucccaguuuggacuuggugaauaaauguaccuuagaacuaggauaau

SEQ ID NO: 101892 - RNA, 64 nt, Human
ucuuucugauaacuagauggugcugagaagcuuuugaauaaaaacuuugcuaaaugagaauaag

SEQ ID NO: 101893 - RNA, 64 nt, Human
uuuuuccccugaaaagcuguguauaaaauuauggugaauaaacuuuuauguuuccauuucaaag

SEQ ID NO: 101894 - RNA, 64 nt, Human
gcaucuccauaucccagaaaagaagauccuaucaugaauaaaagcuguauggcccagagaggag

SEQ ID NO: 101895 - RNA, 64 nt, Human
gugagccaccacguccaacugccuuauuuuguucugaauaaauuuacaguauugggcagcaauu

SEQ ID NO: 101896 - RNA, 64 nt, Human
gccacuuaagcccuccccacccccauccuauuccugaauaaaaccaggauaauggaagaguugu

SEQ ID NO: 101897 - RNA, 64 nt, Human
caaucauuuuuaaaauuccuaauuuucagaaauaugaauaaauaguuuuuguuaaacccuuugu

SEQ ID NO: 101898 - RNA, 64 nt, Human
cuuccuauggucuugucugaauaaacuacucuccugaauaaaacaacauccaacccaggucauu

SEQ ID NO: 101899 - RNA, 64 nt, Human
cuuuuuuucuuuucuuucuuccuauggucuugucugaauaaacuacucuccugaauaaaacaac

SEQ ID NO: 101900 - RNA, 64 nt, Human
caggccauacugguuccauuguucuguauaauacugaauaaauaaauuuacuuuuacaugaucg

SEQ ID NO: 101901 - RNA, 64 nt, Human
ucuuccuugcaaagggcacauuuaauuuuguucuugaauaaaauauuuuauuggguauuuguuu

SEQ ID NO: 101902 - RNA, 64 nt, Human
gaugacgcugacgugauugcuucagacuuagaggugaauaaauugagguccagagaggucacag

SEQ ID NO: 101903 - RNA, 64 nt, Human
ugaaagugacucucagguggugggguggggaaugugaauaaacaugauuucuugccgggcuugg

SEQ ID NO: 101904 - RNA, 64 nt, Human
gguccagcucugacaucccuuccuggaaacagcaugaauaaaacacucaucccauggguccaaa

SEQ ID NO: 101905 - RNA, 64 nt, Human
acauuucaugguacauuaguaguucuuuguauauugaauaaauacuaaaucaccuaggugucua

SEQ ID NO: 101906 - RNA, 64 nt, Human
agauaaaauguugaucauguauauauauccauagugaauaaaauugucucaguaaaguguauuu

SEQ ID NO: 101907 - RNA, 64 nt, Human
auuuucuagcuuuaaagggaaauuaaaccauucaugaauaaacuuuaaaaaugugaaguguccu

SEQ ID NO: 101908 - RNA, 64 nt, Human
aaaugaugaacuuuuauaauuuuaauuugaagauugaauaaauauuuuuuauaaagauuguuuu

SEQ ID NO: 101909 - RNA, 64 nt, Human
aaaugaggccagaauggcauguuuuauaauuaacugaauaaagaaggaagcauuauuauauauu

SEQ ID NO: 101910 - RNA, 64 nt, Human
guucugcaaagguggcaaugcuuaaacuaaauaaugaauaaacugaauauuuuggaaacugcua

SEQ ID NO: 101911 - RNA, 64 nt, Human
auauacuauguacacccaauaagcuguacuagaaugaauaaauuacugauaagguuacaaauag

SEQ ID NO: 101912 - RNA, 64 nt, Human
ucuuuuuaaaugguccauuuucaaaagacaguguugaauaaacauaccugugugauaaaacaca

SEQ ID NO: 101913 - RNA, 64 nt, Human
aauuucuguguauauaauguaaaaccacaauuuuugaauaaaauuuaguuccugcagcuugauu

SEQ ID NO: 101914 - RNA, 64 nt, Human
cagggguaugcugacuucagcagacaaagacuuuugaauaaauaaacugaacucacaccuggua

SEQ ID NO: 101915 - RNA, 64 nt, Human
uagugguuugagugucuagcaaaggaaaaauugaugaauaaaaugaaggucugguguauauguu

SEQ ID NO: 101916 - RNA, 64 nt, Human
gacgggcgccucguggcuuggaaccuccucuguaugaauaaacaguuuucacgucuguccucuu

SEQ ID NO: 101917 - RNA, 64 nt, Human
gaauauaaaugauacaccucugaccccagcguucugaauaaaaugcuaauuuuggaucugguga

SEQ ID NO: 101918 - RNA, 64 nt, Human
cagaacuuguuuccuagggccauuguaagucacuugaauaaaaaauaguuuugaagcaugagag

SEQ ID NO: 101919 - RNA, 64 nt, Human
uucagagagacauaaguuacuagaaagugaaaagugaauaaauaagucacagagaauguaaauu

SEQ ID NO: 101920 - RNA, 64 nt, Human
uguaugauguuuguaagaccauguuuguaagacaugaauaaauugcugcuuuugcccaacccgu

SEQ ID NO: 101921 - RNA, 64 nt, Human
cuauguaccuuugugaaauuguugaauuaguuagugaauaaagaaauaaacuucaacuagaaau

SEQ ID NO: 101922 - RNA, 64 nt, Human
acaccccaagaucaggggcccuggggacggcaagugaauaaagcacauuuccacccaauuuugu

SEQ ID NO: 101923 - RNA, 64 nt, Human
uuuguguaauuaauugaacauaauuuucuuccuuugaauaaaccugugccuauuuuggaguuca

SEQ ID NO: 101924 - RNA, 64 nt, Human
uuuuuuuuuuuuuuuggugacucuguucauacagugaauaaagaucuaucaaaggaaaaggaaa

SEQ ID NO: 101925 - RNA, 64 nt, Human
uguaauuuacaagauuuuucaaauugguggggagugaauaaauacaauuuaaaagucagaaauc

SEQ ID NO: 101926 - RNA, 64 nt, Human
cgagauagcgccauugcacuccagccugggcgacugaauaaaacucugucucaaaaaaaaacaa

SEQ ID NO: 101927 - RNA, 64 nt, Human
aauaaggcuuucuggggaucacagaacuuuuguaugaauaaaagccuuauaaaaccagcucugg

SEQ ID NO: 101928 - RNA, 64 nt, Human
gauguaggcuaacaaugaaaaguauuugccaaacugaauaaaacugucaugguuaccuugaaag

SEQ ID NO: 101929 - RNA, 64 nt, Human
ugauacaauuaaauuuuauauaauguguuuugcuugaauaaaauguuacauuuauacuuugaga

SEQ ID NO: 101930 - RNA, 64 nt, Human
agggcguuucccauugaccaguuugacccugguuugaauaaagagaagugcguuuggauuagaa

SEQ ID NO: 101931 - RNA, 64 nt, Human
gcugacccccagcuuucuacagacaccagauuugugaauaaaguuggggaauggacagccuaac

SEQ ID NO: 101932 - RNA, 62 nt, Human
ccuugggggcggggagacuggguggggaggguguugaauaaaagggaaaauaaaugugucgu

SEQ ID NO: 101933 - RNA, 64 nt, Human
gguccuuccccuucccggggguauucugugaccaugaauaaaguuaucauucucuuucucuuuc

SEQ ID NO: 101934 - RNA, 64 nt, Human
aaguugcacugcguuucaaaaacccaccccugaaugaauaaaaggagcccuggcuggacaaaau

SEQ ID NO: 101935 - RNA, 64 nt, Human
gaacagaaccgugucucugauaaagguuuugaagugaauaaaguuuuaaaaacuagcccuaugg

SEQ ID NO: 101936 - RNA, 64 nt, Human
cugacccauccaccuguuuuuuugcagauugucaugaauaaaacggugcugucaccucugccug

SEQ ID NO: 101937 - RNA, 64 nt, Human
aaccccacacaggucccggccuuuuaauguucuuugaauaaacacuuuauuuucuaauaaaaua

SEQ ID NO: 101938 - RNA, 64 nt, Human
auggagcagcccggggagggguccgugcugguucugaauaaagcaggacccgccuaguggcugc

SEQ ID NO: 101939 - RNA, 64 nt, Human
agagcccacauugccaagucaauccuaagccaaaugaauaaagccggaggcaucacgcuaccug

SEQ ID NO: 101940 - RNA, 64 nt, Human
uacaaacguguaaaaucuauacauuucugaguucugaauaaauauuuuuaaaaauuuuaauaua

SEQ ID NO: 101941 - RNA, 64 nt, Human
gaugcauuuauucuaaugugauuguaugaacaagugaauaaaaaaccuuggaccuccuaaacca

SEQ ID NO: 101942 - RNA, 64 nt, Human
ccacaugccccacuaaaccaucugacaacauuaaugaauaaaauggugaaaauguggcugcuga

SEQ ID NO: 101943 - RNA, 64 nt, Human
aaacaaccuaaauauucaucagugggguaauggaugaauaaaauaugauauauucaaaugauag

SEQ ID NO: 101944 - RNA, 64 nt, Human
ugcccuguuuuguuugguuucguuuuguuuucuuugaauaaaugacauggcaccuccuagcagg

SEQ ID NO: 101945 - RNA, 64 nt, Human
ccuauggcccacccggggucaccuggaaaggaucugaauaaaggggaaacuuccucucauuggc

SEQ ID NO: 101946 - RNA, 64 nt, Human
ccuguggcccaccuggggucacuuggaaaggaucugaauaaaggggacccuuccucucauuagc

SEQ ID NO: 101947 - RNA, 64 nt, Human
auuauuuucauaaaagcuguaaagcuaugaaaaaugaauaaaauuacuaaaaauuuucuguagc

SEQ ID NO: 101948 - RNA, 64 nt, Human
cugucccagugcagagggccuggagcacggauugugaauaaagccgcacaugcugauacacacu

SEQ ID NO: 101949 - RNA, 64 nt, Human
cguagugauacccugacucuuauaaauaaauaaaugaauaaacacaauuaugacuuugcggaug

SEQ ID NO: 101950 - RNA, 64 nt, Human
uugguaaaccuauuuucauuuuggaaaauauuuaugaauaaauaguuuuauaugacggcuggca

SEQ ID NO: 101951 - RNA, 64 nt, Human
uuuuguucacuuuauuguaaauacuagugaacagugaauaaaugguuguauauuccuaauaaga

SEQ ID NO: 101952 - RNA, 64 nt, Human
caaaggacaacugaggagacugcccagcacauaaugaauaaauaagaaaaugagugaggaguua

SEQ ID NO: 101953 - RNA, 64 nt, Human
cugguggagggagccgugggcguggggacgugacugaauaaagccaccauggguggaugugcuu

SEQ ID NO: 101954 - RNA, 64 nt, Human
aagccuucuauauuuccaguucccuuugauaucaugaauaaacuuacacuggacagaaacccua

SEQ ID NO: 101955 - RNA, 64 nt, Human
augacccaacucucucacuuuucccucuccccuuugaauaaagucgccagcuagagcacgugac

SEQ ID NO: 101956 - RNA, 64 nt, Human
caacugugccguuuguccccucucuuauggagacugaauaaaccaccucuggcccauguaggcc

SEQ ID NO: 101957 - RNA, 64 nt, Human
uucgugggaggcacucauggcucucugggucuaaugaauaaaguccuccacagccuagaucuug

SEQ ID NO: 101958 - RNA, 64 nt, Human
auuagcaucauauugucauuuguuuugagcagucugaauaaacgagaccgggaaagacaucccu

SEQ ID NO: 101959 - RNA, 64 nt, Human
cugaaaucccugaaggggguuguacugggauuugugaauaaacuugauacacuaugcugucuca

SEQ ID NO: 101960 - RNA, 64 nt, Human
ugaugaacauauuguaaugaugcuucugugaauuugaauaaaaucaacacuaaccagcccuagu

SEQ ID NO: 101961 - RNA, 64 nt, Human
guugggaaacaaaugcugucucuugugaaauagaugaauaaaaugugauaguaacauaguagag

SEQ ID NO: 101962 - RNA, 64 nt, Human
aaagcugcugucauuuaaacaauguauuaccaagugaauaaaucaagcaguaguaagauaguga

SEQ ID NO: 101963 - RNA, 64 nt, Human
gaauguguaaagaccuuuacuuggcuuucaaacuugaauaaacaucagacaauucacacuggug

SEQ ID NO: 101964 - RNA, 64 nt, Human
uuuucugggucacagaggccaaaugugagagcauugaauaaauaucuuaagcuaagcugcaugu

SEQ ID NO: 101965 - RNA, 64 nt, Human
ccuguggcccacccggggucaccaggaaaggaucugaauaaagaggacccuuccucucauuggc

SEQ ID NO: 101966 - RNA, 64 nt, Human
acaaaccuaaguccugugccuguccccaggguccugaauaaauaaaagccuccuugcagagccu

SEQ ID NO: 101967 - RNA, 64 nt, Human
uccuggaauggagcuggaggagcaaugcuguuggugaauaaaucagucuacuggaacuccaagg

SEQ ID NO: 101968 - RNA, 64 nt, Human
gccgcggggugggggcugccuguaaaugacacugugaauaaacccguuaccuuaccuggccuuc

SEQ ID NO: 101969 - RNA, 64 nt, Human
uuuaaaccagagcaacuccaucuggaauaggagcugaauaaaaugaggcugagaccuacugggc

SEQ ID NO: 101970 - RNA, 64 nt, Human
gaagauaaacccccucagaagugaucauagaucaugaauaaacuacuaauucguggaaauguaa

SEQ ID NO: 101971 - RNA, 64 nt, Human
uuuuaccucauauuuucugucaaugaaaauacguugaauaaacuauauuaauguggagauguuu

SEQ ID NO: 101972 - RNA, 64 nt, Human
cuacaaccauugcaaaucauuggagaaucuauaaugaauaaagaucuaacaaguguaauaaaug

SEQ ID NO: 101973 - RNA, 64 nt, Human
agcaaaggucuguccuugucccuuugucugucugugaauaaaugugaguucgugaaauccaaga

SEQ ID NO: 101974 - RNA, 64 nt, Human
augcugaggacucguugcaggagggcaaacuaggugaauaaauuaccugugaaugaacaaugaa

SEQ ID NO: 101975 - RNA, 64 nt, Human
uagaauguaaaauugauuguuaaaaguuuuguucugaauaaauauuuaucuuuuguauugcuaa

SEQ ID NO: 101976 - RNA, 64 nt, Human
ccacagcaggacuccgccagucugaugccaggacugaauaaaguguauuugccccgaccuugcc

SEQ ID NO: 101977 - RNA, 64 nt, Human
gccugaaaugaucaaauaacuacaaaugaucuguugaauaaaaauaguugagcugauauauguu

SEQ ID NO: 101978 - RNA, 64 nt, Human
accggauggccaucuguccuggaaacuguagaauugaauaaaucacugaaaauagaacacuucu

SEQ ID NO: 101979 - RNA, 64 nt, Human
ucgcccccugcugccuucagccuucccugggcccugaauaaacaccacagccaguuuccuucuc

SEQ ID NO: 101980 - RNA, 64 nt, Human
uaagaguuuccauuguagaauguuuucacauacuugaauaaaucaaaucuuuaauugagaaccu

SEQ ID NO: 101981 - RNA, 64 nt, Human
cugaccagugagaggguuccugggggaaguauggugaauaaacugacaugcaugcuucagaacc

SEQ ID NO: 101982 - RNA, 64 nt, Human
gacugugaguuucuggcaaguagcuuggggaagcugaauaaacucuaggcccagggcuacuaaa

SEQ ID NO: 101983 - RNA, 64 nt, Human
auuaauucauuuguuacauuaguaaaauucaguaugaauaaauauuuggauugauguagucuuc

SEQ ID NO: 101984 - RNA, 64 nt, Human
cuuuucuuagucugauaccaagcaaggccuuuucugaauaaauucauuugacuuugagucuuug

SEQ ID NO: 101985 - RNA, 64 nt, Human
cagacugcauaaguugucagccuugacuaucuuuugaauaaagauuugauuuuaaacaaaaccc

SEQ ID NO: 101986 - RNA, 64 nt, Human
cccuuguuauucaacagcaagugugaauacugcuugaauaaacaccacuggauuaauggccugu

SEQ ID NO: 101987 - RNA, 64 nt, Human
acuccuuaaauaugaaaaauuauggucuuauugcugaauaaaacuuuuaaaaaguacagaauaa

SEQ ID NO: 101988 - RNA, 64 nt, Human
gauauauuagcuucaacuuuaguuuaaaauuaugugaauaaauauuuugauuucuacaaaucuu

SEQ ID NO: 101989 - RNA, 64 nt, Human
gaguucgagccaaccaccucuguugguuagaugaugaauaaaaagguucugaagaaaaggucug

SEQ ID NO: 101990 - RNA, 64 nt, Human
uguuuuggauguauuuguuguagaaauggaccagugaauaaagagaaucuaaggauuuguacaa

SEQ ID NO: 101991 - RNA, 64 nt, Human
agcuuugucuaaaguccucauuuucuuuuaaaauugaauaaaauuucuguauacagauucauug

SEQ ID NO: 101992 - RNA, 64 nt, Human
uguuaagccagagaucuaagguuuagauucaauuugaauaaacuagcuggccugcccucuauug

SEQ ID NO: 101993 - RNA, 64 nt, Human
cacagcaggcuuucaagaagugccaguugaucaaugaauaaauaaacgagccuauuucucuuug

SEQ ID NO: 101994 - RNA, 64 nt, Human
cacucaaccacuauuuguugaaugaacaaaugagugaauaaauggguggugugauuuuugacgu

SEQ ID NO: 101995 - RNA, 64 nt, Human
ggagggaguuggcaguuucaaaucgcccaagugaugaauaaaguaucuggcucugcacgagacu

SEQ ID NO: 101996 - RNA, 64 nt, Human
uuuuaaugaaguugaaauaaaugcuuaugucacuugaauaaauauaaaucauuauauuccuauu

SEQ ID NO: 101997 - RNA, 64 nt, Human
aaacgaaaagaagaaacaaaagaaagcaucaugaugaauaaaaugucuuugcuuguaauuuuua

SEQ ID NO: 101998 - RNA, 64 nt, Human
gacacuuagaggggagagaugaaagccaaacaaaugaauaaacauaaaugauaccaucagugcu

SEQ ID NO: 101999 - RNA, 64 nt, Human
aauaaggaaaaggagagaaaaaagaaauugguuaugaauaaaagugacaauaaaacaugagaua

SEQ ID NO: 102000 - RNA, 64 nt, Human
aaaaaugaaaacaaauuuuaaaaacguugcaacaugaauaaaaguuucaccaaaucgggagucu

SEQ ID NO: 102001 - RNA, 64 nt, Human
aaacuugucagaauuucuuugucauucaagccugugaauaaaaacccuguauggcacuuauuau

SEQ ID NO: 102002 - RNA, 64 nt, Human
cagccuagaugacagaacgagaccccaucucuaaugaauaaauaaauauggcugggcacaaugg

SEQ ID NO: 102003 - RNA, 64 nt, Human
aucgcacagaguaaagaagaugaugauguaauagugaauaaaccucauguuucggaugaagagg

SEQ ID NO: 102004 - RNA, 64 nt, Human
uaauugaugaaaauaaugaaugaaaaucaacagaugaauaaaugguucuuuauaaguguccauu

SEQ ID NO: 102005 - RNA, 64 nt, Human
uuuuuugaacuugguaguucauaaagguuuacagugaauaaaaggauaucaucuugaguauagc

SEQ ID NO: 102006 - RNA, 64 nt, Human
auugacgauugcccugcauuucuaccaaguccugugaauaaagagaugggagauuugauuccgu

SEQ ID NO: 102007 - RNA, 64 nt, Human
uuaggaaaauagaaauuacuuugugugaaauucuugaauaaauaauuuauucagagcuaggaau

SEQ ID NO: 102008 - RNA, 64 nt, Human
uuaaucuuuuaguguuuacuuccugcagugaauuugaauaaaugagaaaaaaugcauugucucu

SEQ ID NO: 102009 - RNA, 64 nt, Human
guuuuauuuaaaaugaaaugccaguccauuacacugaauaaauagaacucaacuauugcuuuuc

SEQ ID NO: 102010 - RNA, 64 nt, Human
ggaaacugugaaugcuucugauuuagcaaugcugugaauaaaaagaaagauuuuauacccuuga

SEQ ID NO: 102011 - RNA, 64 nt, Human
aagacucucaaaacuccgcuucuauagaauuagcugaauaaaggcauuuuacugauagcuguuc

SEQ ID NO: 102012 - RNA, 64 nt, Human
uuaaaaagguauacuuacaaugugaaguaacuuaugaauaaaaggaaaaguuuaucccauauuc

SEQ ID NO: 102013 - RNA, 64 nt, Human
acaacaaaaaaaaaaacauacaaagauggguuucugaauaaaauuuguagugauaacaguauuc

SEQ ID NO: 102014 - RNA, 64 nt, Human
uuuaguucuauauuuuuugugccucuuuuauuuuugaauaaagaaaaucagaagaguuguauua

SEQ ID NO: 102015 - RNA, 64 nt, Human
ucuucuccauaagauagugugauaaacacagucaugaauaaaguuauuuuccacaaaaggacuu

SEQ ID NO: 102016 - RNA, 64 nt, Human
gacccugcugcgucucccuuccaaacucuggugcugaauaaacccuucugaucuggucuucucu

SEQ ID NO: 102017 - RNA, 64 nt, Human
gacccuugucacugaacccugaucuagacuuauaugaauaaaugaaauuacaugccaagggccc

SEQ ID NO: 102018 - RNA, 64 nt, Human
gggaacgugacuggauucccucacuguuguaucuugaauaaacgcugcugcuucauccuguggg

SEQ ID NO: 102019 - RNA, 64 nt, Human
ugcugcccaggaacccuccagaccucccagagagugaauaaagugugacuugcaacuugucugc

SEQ ID NO: 102020 - RNA, 64 nt, Human
uaugauacggguuucuugggucugauguacagugugaauaaaugcuugcagcucuuagcucuuu

SEQ ID NO: 102021 - RNA, 64 nt, Human
cuggguuuacaacgcuguuaggaaaauuaaccaaugaauaaagcaacguucagugcgcagggag

SEQ ID NO: 102022 - RNA, 64 nt, Human
agaaaccaagcggcagccaccaccaguguuguuuugaauaaaagcccagaagccuauuuaagaa

SEQ ID NO: 102023 - RNA, 64 nt, Human
gcccucccacuuugcuguuccuuacuuuacugccugaauaaagagcccuaaguuuguacuauau

SEQ ID NO: 102024 - RNA, 64 nt, Human
agagcauguucuuggaacauggaauuuuauaagcugaauaaaguuuuugacuuccuuuaccaug

SEQ ID NO: 102025 - RNA, 64 nt, Human
auguuuggcuugaagaaggagcucaguaaacaucugaauaaacaugcagguugauggauggaug

SEQ ID NO: 102026 - RNA, 64 nt, Human
ugaacucggaggugagcuccucucaccacucucuugaauaaagcuuuucucaccauuuuaacaa

SEQ ID NO: 102027 - RNA, 64 nt, Human
uucaaacccugagcccuucauucaccucugugagugaauaaaugugcuaagucucuuuaucucg

SEQ ID NO: 102028 - RNA, 64 nt, Human
agaagcucagcauggccauuaugccuaguuuugaugaauaaacaugggaaagccauaacuguua

SEQ ID NO: 102029 - RNA, 64 nt, Human
cauccuaaaggcugggcccaugcaagggcccaccugaauaaacagaaugagcugcagucucuug

SEQ ID NO: 102030 - RNA, 64 nt, Human
ucuaccuaguuucacagaggaaaaaaauacucuuugaauaaagugaacagaggcucauuuguuu

SEQ ID NO: 102031 - RNA, 64 nt, Human
uuguauguuuacucuuauuuucagaaagagaaaaugaauaaaaaugaugacaucaagugugucc

SEQ ID NO: 102032 - RNA, 64 nt, Human
ugaauacuuuuuuuuuuaagaaaaaaaagagaaaugaauaaagaaucuacucuuggcuggcucu

SEQ ID NO: 102033 - RNA, 64 nt, Human
ccuugccucuuaccccuugccucccagugguauuugaauaaaguauguagcuauaucugccccu

SEQ ID NO: 102034 - RNA, 64 nt, Human
gaugaagggugauuauguauuacuuauccauuucugaauaaacauuuguuauuccuaccuuuga

SEQ ID NO: 102035 - RNA, 64 nt, Human
guaacuacucaaggccaacugucacaugaaggaaugaauaaagaguuuuuacugacuugugcac

SEQ ID NO: 102036 - RNA, 64 nt, Human
ucaagagagaaucaacagaucauauucagugucuugaauaaauugcucuauuuugauauuagag

SEQ ID NO: 102037 - RNA, 64 nt, Human
uguuaauugccauugcuguaaaucuuaaaaugaaugaauaaaaauguuucauuuuacaagagga

SEQ ID NO: 102038 - RNA, 64 nt, Human
acuaaaggaaaucuugaggucauauacugaaauaugaauaaauuaaaauaaugaauucagaucu

SEQ ID NO: 102039 - RNA, 64 nt, Human
acacuuuuucuuaaaagaaaaauauuuugggguuugaauaaaauggaccaccauuucucauugg

SEQ ID NO: 102040 - RNA, 64 nt, Human
gaaaaccagcaugguuugacaccacaugggaacaugaauaaaucugucucaugauuugaaaagu

SEQ ID NO: 102041 - RNA, 64 nt, Human
accuugauuuccauuacaaaguaucugauuugucugaauaaaggugucccacucacuguuccag

SEQ ID NO: 102042 - RNA, 64 nt, Human
uauuacauaaaacacccuugaaaauauaugacuuugaauaaaauaaagcuaccauguuaauaca

SEQ ID NO: 102043 - RNA, 64 nt, Human
auuuaaagacuacuucguaaguaguaugauuauuugaauaaauuacacauuguuuaguuuuuua

SEQ ID NO: 102044 - RNA, 64 nt, Human
aguagacagaugucagacaaaaaagacgagaaaaugaauaaauaaaaaaccaggccaggcgugg

SEQ ID NO: 102045 - RNA, 64 nt, Human
uguuuguguguguguuaaaaugauaacuaacaugugaauaaaauacuccauuugaaacucuucg

SEQ ID NO: 102046 - RNA, 64 nt, Human
aaauuuuggcucugugguguuggauaaguggccuugaauaaauuaguuauuaagcuucaguuuu

SEQ ID NO: 102047 - RNA, 64 nt, Human
agauuggaguggggaagugugucaaaucaauaaaugaauaaauucaauaaaugccuauaaccag

SEQ ID NO: 102048 - RNA, 64 nt, Human
aauagguggagacuaacuuauuuugauuguuugaugaauaaaauguuuauuuuugcucucccuc

SEQ ID NO: 102049 - RNA, 61 nt, Human
ggggaaugaagagaguguaaaauaaccaaucugaauaaaacagccaugcucccaggugcau

SEQ ID NO: 102050 - RNA, 64 nt, Human
uuuaaucuuuuuaaaggaucagugcugcccuaagugaauaaacucaauuguccaucuuuauuuu

SEQ ID NO: 102051 - RNA, 64 nt, Human
ugugacagcaugaagauaaugccugugguuaugcugaauaaauucaccagaugcuaaaauucug

SEQ ID NO: 102052 - RNA, 64 nt, Human
agaucaagugcauugaggggcaguuuuguuugccugaauaaacguaaaggacaaguaaacaauu

SEQ ID NO: 102053 - RNA, 64 nt, Human
ugauuuguauuuaugucuugagacaguaacuuuuugaauaaaaauaaaccuacaguauguugua

SEQ ID NO: 102054 - RNA, 64 nt, Human
ucuuuuuuauuauaauuuauugcaaauuuuuuucugaauaaauauauguugugugaaaaagcaa

SEQ ID NO: 102055 - RNA, 64 nt, Human
gaugugcccaacugcucuguauuuaugcaauauuugaauaaagcggaaauguaugugcucuucc

SEQ ID NO: 102056 - RNA, 64 nt, Human
cuuggcuucuuugagaaugaaauugaauuaaauaugaauaaauaagucccccugcucacuggcu

SEQ ID NO: 102057 - RNA, 64 nt, Human
uccuuggcuucgugaauguaagagaaauuaaaucugaauaaauaauucuuucuguuaacuggcu

SEQ ID NO: 102058 - RNA, 64 nt, Human
uugacuucuuugagaaugcaagcgaaauuaaaucugaauaaauaauucuuccucuucacuggcu

SEQ ID NO: 102059 - RNA, 64 nt, Human
ccauaucauaguugcuuucuuuaauuguuccuucugaauaaacaguuuauuuaagauacugagu

SEQ ID NO: 102060 - RNA, 64 nt, Human
cacacaaaugaaugcauguaaaaucuggugauacugaauaaagucuguggucuagauagcagua

SEQ ID NO: 102061 - RNA, 64 nt, Human
gaaaacaaucuucauuugaaaacaucccuaagcuugaauaaauggauaccauagauagcuucuc

SEQ ID NO: 102062 - RNA, 64 nt, Human
gugguguuucuuaagguucuaucuugugccaugaugaauaaaaaguuaagcaaaggcuuuguuu

SEQ ID NO: 102063 - RNA, 64 nt, Human
uagcaugugucagaauuucauuccuuucuauggcugaauaaaauuccauuguaugaauauacca

SEQ ID NO: 102064 - RNA, 64 nt, Human
auaaugaacauaugaauaccaccuaaaaauacacugaauaaaguacaccauauagcauuauuuu

SEQ ID NO: 102065 - RNA, 64 nt, Human
auauucauacagccuacuccuggguagacaacaaugaauaaauaaggagaacuuggaaaccauu

SEQ ID NO: 102066 - RNA, 64 nt, Human
cuuguuucagggcuguggccucccugcucuauccugaauaaagcagacaggugugcagauuuug

SEQ ID NO: 102067 - RNA, 64 nt, Human
guuucuguuugcucagacccuguuuucauguuguugaauaaacuuucuaaaauaaaagcaugcu

SEQ ID NO: 102068 - RNA, 64 nt, Human
augcuaguuuaaugacuuuuuuaacugaauuuuuugaauaaaucagaaauguuuguauugguca

SEQ ID NO: 102069 - RNA, 64 nt, Human
aaaaaauguauaaaaagaauuaguguaugcuuccugaauaaaaaggagccaaaguugaucagaa

SEQ ID NO: 102070 - RNA, 64 nt, Human
aagcgggaagggcuuggucuggauguagagagggugaauaaaauugccaagagagauauugaac

SEQ ID NO: 102071 - RNA, 64 nt, Human
agacuugauauaaguauuaauaguaaugaaucaaugaauaaauaaugagcuaggguuugugagg

SEQ ID NO: 102072 - RNA, 64 nt, Human
uucccucuuuuuaaaacaguuacggcuuauuuacugaauaaauacaaagcaaacaaacucaagu

SEQ ID NO: 102073 - RNA, 64 nt, Human
uuugcuucuuugagaaugcaaaagaaauuaaaucugaauaaauaauucuuccuguucacuggcu

SEQ ID NO: 102074 - RNA, 64 nt, Human; identical to SEQ ID NO: 102058

SEQ ID NO: 102075 - RNA, 64 nt, Human
uuggcuucuuugagaauguaagagaaauuaaaucugaauaaagaauucuuccuguucacuggcu

SEQ ID NO: 102076 - RNA, 64 nt, Human
cuagcucuuuucacugcaucauacugcugucagaugaauaaaugauuaugaauuuguuuacuug

SEQ ID NO: 102077 - RNA, 64 nt, Human
ucacaggcaaagaauaacuuaaaagcugacgauuugaauaaauuauguuacaguaugaaauaug

SEQ ID NO: 102078 - RNA, 64 nt, Human
cuacuaccuauugcugauacugucuuugcauaaaugaauaaaaauaaacuuuuuuucuucaaau

SEQ ID NO: 102079 - RNA, 64 nt, Human; identical to SEQ ID NO: 102078

SEQ ID NO: 102080 - RNA, 64 nt, Human
gguuuaaagcuuauuucccuuucuuauacacaccugaauaaaauugaugugcauguuuuaggga

SEQ ID NO: 102081 - RNA, 64 nt, Human
aguucucacaccguaucuagggacagaggcaucuggaugcaaacgcgggguuuguuaggggcgg

SEQ ID NO: 102082 - RNA, 64 nt, Human
gcuucaguuuuucucuuauaguaccaucacuauaaucaacgaacuucucuucuccacccagaga

SEQ ID NO: 102083 - RNA, 64 nt, Human
ugcuuaaagguuuauuucaaauuaaaacaaaaaaaucaacgacagcaguagacacaggcaccac

SEQ ID NO: 102084 - RNA, 64 nt, Human
gcaugaaaaaggaagcucaguuccagccccuuggaucaacgaaaaucagaggauucuggaaagg

SEQ ID NO: 102085 - RNA, 64 nt, Human
cuguauaggcugaccagaagcaugcugcugaauuaucaacgaggauuuucaaguuaacuuuuaa

SEQ ID NO: 102086 - RNA, 64 nt, Human
aucuauuuuauaugaacuuuuuugguuguacuuaaucaacgaggagaaucucugcacuuuucca

SEQ ID NO: 102087 - RNA, 64 nt, Human
ggauuggugucuuaguacacuuguggucacagggaucaacgaauaguaaauaaugaacucgugc

SEQ ID NO: 102088 - RNA, 64 nt, Human
ccucaaaaaacaaaacaaaacaaaacacucacccaucaacgaauauagacucuucucucauuua

SEQ ID NO: 102089 - RNA, 64 nt, Human
gaaaagcuuaugcaacaugcucagcaggagcuucaucaacgauauaugucagaucuaaagguau

SEQ ID NO: 102090 - RNA, 64 nt, Human
acauuuaaagcuuggucggugaccuuugcauaccaucaacgagcacagcuaagaacagagugag

SEQ ID NO: 102091 - RNA, 64 nt, Human
ccaggccgacagcuacauccuccaacugacccugaucaacgaagagggauucaugugucugucu

SEQ ID NO: 102092 - RNA, 64 nt, Human
ugaagacgugaaaagccuagguucugugcagcuuaucaacgaccgcuguguggacaugcagaga

SEQ ID NO: 102093 - RNA, 64 nt, Human
cauguguuuguucucagggacggagcugaagaccaucaacgacuuucucuuccagagccagauc

SEQ ID NO: 102094 - RNA, 64 nt, Human
cgauggggaugaggaggagagcacagcccucagcaucaacgaggagaugcagcgcaugcucaac

SEQ ID NO: 102095 - RNA, 64 nt, Human
ugcaaaaagccuuuacagaagggacagacagcuuaucaacgaaaaggaucagcucaccucuuuu

SEQ ID NO: 102096 - RNA, 64 nt, Human
uugcccacuugagaacagacauuugacaaguuauaucaacgacugugcuuguccauuauuuuac

SEQ ID NO: 102097 - RNA, 64 nt, Human
gauauggaagaaaauauuugcagcacauaaaaaaaucaacgaguacaauuacuuuaggagaaaa

SEQ ID NO: 102098 - RNA, 64 nt, Human
auuaaguccaugccaguugcuuggcuagaauaugaucaacgacuuguaguagacucaaguuuuu

SEQ ID NO: 102099 - RNA, 64 nt, Human; identical to SEQ ID NO: 84496

SEQ ID NO: 102100 - RNA, 64 nt, Human
ggccaggccaaccuuggcuaaauggagcagcgaaaucaacgagaaacuggacuuuuuaaacccu

SEQ ID NO: 102101 - RNA, 64 nt, Human
acaggauuugcgaccagguuuauggggagauugaaucaacgauuggucucaaagacaguccauu

SEQ ID NO: 102102 - RNA, 64 nt, Human
cuccuagccaauguauuaaguaaggaaaacaaguaucaacgaagaacuauaaaaauaacuuuua

SEQ ID NO: 102103 - RNA, 64 nt, Human
aaaaucaguagacaacaccacugaggucguuacgaucaacgauauccacagucucuuuuuaguc

SEQ ID NO: 102104 - RNA, 64 nt, Human
cuuguugaugaacuuguuuucaaaauaucaucucaucaacgaggccuggacaaacaagcccuga

SEQ ID NO: 102105 - RNA, 61 nt, Human; identical to SEQ ID NO: 23229

SEQ ID NO: 102106 - RNA, 61 nt, Human; identical to SEQ ID NO: 23230

SEQ ID NO: 102107 - RNA, 61 nt, Human; identical to SEQ ID NO: 23231

SEQ ID NO: 102108 - RNA, 61 nt, Human; identical to SEQ ID NO: 23232

SEQ ID NO: 102109 - RNA, 61 nt, Human; identical to SEQ ID NO: 23233

SEQ ID NO: 102110 - RNA, 61 nt, Human; identical to SEQ ID NO: 23234

SEQ ID NO: 102111 - RNA, 61 nt, Human; identical to SEQ ID NO: 23235

SEQ ID NO: 102112 - RNA, 61 nt, Human; identical to SEQ ID NO: 23236

SEQ ID NO: 102113 - RNA, 61 nt, Human; identical to SEQ ID NO: 23237

SEQ ID NO: 102114 - RNA, 61 nt, Human; identical to SEQ ID NO: 23238

SEQ ID NO: 102115 - RNA, 61 nt, Human; identical to SEQ ID NO: 23239

SEQ ID NO: 102116 - RNA, 61 nt, Human; identical to SEQ ID NO: 23240

SEQ ID NO: 102117 - RNA, 61 nt, Human; identical to SEQ ID NO: 23241

SEQ ID NO: 102118 - RNA, 61 nt, Human; identical to SEQ ID NO: 23242

SEQ ID NO: 102119 - RNA, 61 nt, Human; identical to SEQ ID NO: 23243

SEQ ID NO: 102120 - RNA, 61 nt, Human; identical to SEQ ID NO: 23244

SEQ ID NO: 102121 - RNA, 61 nt, Human; identical to SEQ ID NO: 23245

SEQ ID NO: 102122 - RNA, 61 nt, Human; identical to SEQ ID NO: 23246

SEQ ID NO: 102123 - RNA, 61 nt, Human; identical to SEQ ID NO: 23247

SEQ ID NO: 102124 - RNA, 61 nt, Human; identical to SEQ ID NO: 23248

SEQ ID NO: 102125 - RNA, 61 nt, Human; identical to SEQ ID NO: 23249

SEQ ID NO: 102126 - RNA, 61 nt, Human; identical to SEQ ID NO: 23250

SEQ ID NO: 102127 - RNA, 61 nt, Human; identical to SEQ ID NO: 23251

SEQ ID NO: 102128 - RNA, 61 nt, Human; identical to SEQ ID NO: 23252

SEQ ID NO: 102129 - RNA, 61 nt, Human; identical to SEQ ID NO: 23253

SEQ ID NO: 102130 - RNA, 61 nt, Human; identical to SEQ ID NO: 23254

SEQ ID NO: 102131 - RNA, 61 nt, Human; identical to SEQ ID NO: 23255

SEQ ID NO: 102132 - RNA, 64 nt, Human
augguccugacuuugggcgcuggguauuggaaauggaugcaaaguacaauguguuuuucuccag

SEQ ID NO: 102133 - RNA, 61 nt, Human; identical to SEQ ID NO: 23256

SEQ ID NO: 102134 - RNA, 61 nt, Human; identical to SEQ ID NO: 23257

SEQ ID NO: 102135 - RNA, 61 nt, Human; identical to SEQ ID NO: 23258

SEQ ID NO: 102136 - RNA, 61 nt, Human; identical to SEQ ID NO: 23259

SEQ ID NO: 102137 - RNA, 61 nt, Human; identical to SEQ ID NO: 23260

SEQ ID NO: 102138 - RNA, 61 nt, Human; identical to SEQ ID NO: 23261

SEQ ID NO: 102139 - RNA, 61 nt, Human; identical to SEQ ID NO: 23262

SEQ ID NO: 102140 - RNA, 61 nt, Human; identical to SEQ ID NO: 23263

SEQ ID NO: 102141 - RNA, 61 nt, Human; identical to SEQ ID NO: 23264

SEQ ID NO: 102142 - RNA, 61 nt, Human; identical to SEQ ID NO: 23265

SEQ ID NO: 102143 - RNA, 61 nt, Human; identical to SEQ ID NO: 23266

SEQ ID NO: 102144 - RNA, 61 nt, Human; identical to SEQ ID NO: 23267

SEQ ID NO: 102145 - RNA, 61 nt, Human; identical to SEQ ID NO: 23268

SEQ ID NO: 102146 - RNA, 61 nt, Human; identical to SEQ ID NO: 23269

SEQ ID NO: 102147 - RNA, 61 nt, Human; identical to SEQ ID NO: 23270

SEQ ID NO: 102148 - RNA, 61 nt, Human; identical to SEQ ID NO: 23271

SEQ ID NO: 102149 - RNA, 61 nt, Human; identical to SEQ ID NO: 23272

SEQ ID NO: 102150 - RNA, 64 nt, Human; identical to SEQ ID NO: 84552

SEQ ID NO: 102151 - RNA, 61 nt, Human; identical to SEQ ID NO: 23273

SEQ ID NO: 102152 - RNA, 61 nt, Human; identical to SEQ ID NO: 23274

SEQ ID NO: 102153 - RNA, 61 nt, Human; identical to SEQ ID NO: 23275

SEQ ID NO: 102154 - RNA, 61 nt, Human; identical to SEQ ID NO: 23276

SEQ ID NO: 102155 - RNA, 61 nt, Human; identical to SEQ ID NO: 23277

SEQ ID NO: 102156 - RNA, 61 nt, Human; identical to SEQ ID NO: 23278

SEQ ID NO: 102157 - RNA, 61 nt, Human; identical to SEQ ID NO: 23279

SEQ ID NO: 102158 - RNA, 61 nt, Human; identical to SEQ ID NO: 23280

SEQ ID NO: 102159 - RNA, 61 nt, Human; identical to SEQ ID NO: 23281

SEQ ID NO: 102160 - RNA, 61 nt, Human; identical to SEQ ID NO: 23282

SEQ ID NO: 102161 - RNA, 61 nt, Human; identical to SEQ ID NO: 23283

SEQ ID NO: 102162 - RNA, 61 nt, Human; identical to SEQ ID NO: 23284

SEQ ID NO: 102163 - RNA, 61 nt, Human; identical to SEQ ID NO: 23285

SEQ ID NO: 102164 - RNA, 61 nt, Human; identical to SEQ ID NO: 23286

SEQ ID NO: 102165 - RNA, 61 nt, Human; identical to SEQ ID NO: 23287

SEQ ID NO: 102166 - RNA, 61 nt, Human; identical to SEQ ID NO: 23288

SEQ ID NO: 102167 - RNA, 61 nt, Human; identical to SEQ ID NO: 23289

SEQ ID NO: 102168 - RNA, 64 nt, Human
agaacuacaaaccacugcuuaacgaaauaaaagaggaugcaaagaaauggaagagcauuccaug

SEQ ID NO: 102169 - RNA, 61 nt, Human; identical to SEQ ID NO: 23290

SEQ ID NO: 102170 - RNA, 61 nt, Human; identical to SEQ ID NO: 23291

SEQ ID NO: 102171 - RNA, 61 nt, Human; identical to SEQ ID NO: 23292

SEQ ID NO: 102172 - RNA, 61 nt, Human; identical to SEQ ID NO: 23293

SEQ ID NO: 102173 - RNA, 61 nt, Human; identical to SEQ ID NO: 23294

SEQ ID NO: 102174 - RNA, 61 nt, Human; identical to SEQ ID NO: 23295

SEQ ID NO: 102175 - RNA, 61 nt, Human; identical to SEQ ID NO: 23296

SEQ ID NO: 102176 - RNA, 61 nt, Human; identical to SEQ ID NO: 23297

SEQ ID NO: 102177 - RNA, 61 nt, Human; identical to SEQ ID NO: 23298

SEQ ID NO: 102178 - RNA, 61 nt, Human; identical to SEQ ID NO: 23299

SEQ ID NO: 102179 - RNA, 61 nt, Human; identical to SEQ ID NO: 23300

SEQ ID NO: 102180 - RNA, 61 nt, Human; identical to SEQ ID NO: 23301

SEQ ID NO: 102181 - RNA, 61 nt, Human; identical to SEQ ID NO: 23302

SEQ ID NO: 102182 - RNA, 61 nt, Human; identical to SEQ ID NO: 23303

SEQ ID NO: 102183 - RNA, 61 nt, Human; identical to SEQ ID NO: 23304

SEQ ID NO: 102184 - RNA, 61 nt, Human; identical to SEQ ID NO: 23305

SEQ ID NO: 102185 - RNA, 61 nt, Human; identical to SEQ ID NO: 23306

SEQ ID NO: 102186 - RNA, 61 nt, Human; identical to SEQ ID NO: 23307

SEQ ID NO: 102187 - RNA, 61 nt, Human; identical to SEQ ID NO: 23308

SEQ ID NO: 102188 - RNA, 61 nt, Human; identical to SEQ ID NO: 23309

SEQ ID NO: 102189 - RNA, 61 nt, Human; identical to SEQ ID NO: 23310

SEQ ID NO: 102190 - RNA, 61 nt, Human; identical to SEQ ID NO: 23311

SEQ ID NO: 102191 - RNA, 61 nt, Human; identical to SEQ ID NO: 23312

SEQ ID NO: 102192 - RNA, 61 nt, Human; identical to SEQ ID NO: 23313

SEQ ID NO: 102193 - RNA, 61 nt, Human; identical to SEQ ID NO: 23314

SEQ ID NO: 102194 - RNA, 61 nt, Human; identical to SEQ ID NO: 23315

SEQ ID NO: 102195 - RNA, 61 nt, Human; identical to SEQ ID NO: 23316

SEQ ID NO: 102196 - RNA, 61 nt, Human; identical to SEQ ID NO: 23317

SEQ ID NO: 102197 - RNA, 61 nt, Human; identical to SEQ ID NO: 23318

SEQ ID NO: 102198 - RNA, 61 nt, Human; identical to SEQ ID NO: 23319

SEQ ID NO: 102199 - RNA, 61 nt, Human; identical to SEQ ID NO: 23320

SEQ ID NO: 102200 - RNA, 61 nt, Human; identical to SEQ ID NO: 23321

SEQ ID NO: 102201 - RNA, 61 nt, Human; identical to SEQ ID NO: 23322

SEQ ID NO: 102202 - RNA, 61 nt, Human; identical to SEQ ID NO: 23323

SEQ ID NO: 102203 - RNA, 64 nt, Human; identical to SEQ ID NO: 84502

SEQ ID NO: 102204 - RNA, 61 nt, Human; identical to SEQ ID NO: 23324

SEQ ID NO: 102205 - RNA, 61 nt, Human; identical to SEQ ID NO: 23325

SEQ ID NO: 102206 - RNA, 61 nt, Human; identical to SEQ ID NO: 23326

SEQ ID NO: 102207 - RNA, 61 nt, Human; identical to SEQ ID NO: 23327

SEQ ID NO: 102208 - RNA, 61 nt, Human; identical to SEQ ID NO: 23328

SEQ ID NO: 102209 - RNA, 61 nt, Human; identical to SEQ ID NO: 23329

SEQ ID NO: 102210 - RNA, 61 nt, Human; identical to SEQ ID NO: 23330

SEQ ID NO: 102211 - RNA, 61 nt, Human; identical to SEQ ID NO: 23331

SEQ ID NO: 102212 - RNA, 61 nt, Human; identical to SEQ ID NO: 23332

SEQ ID NO: 102213 - RNA, 61 nt, Human; identical to SEQ ID NO: 23333

SEQ ID NO: 102214 - RNA, 61 nt, Human; identical to SEQ ID NO: 23334

SEQ ID NO: 102215 - RNA, 61 nt, Human; identical to SEQ ID NO: 23335

SEQ ID NO: 102216 - RNA, 61 nt, Human; identical to SEQ ID NO: 23336

SEQ ID NO: 102217 - RNA, 61 nt, Human; identical to SEQ ID NO: 23337

SEQ ID NO: 102218 - RNA, 61 nt, Human; identical to SEQ ID NO: 23338

SEQ ID NO: 102219 - RNA, 61 nt, Human; identical to SEQ ID NO: 23339

SEQ ID NO: 102220 - RNA, 61 nt, Human; identical to SEQ ID NO: 23340

SEQ ID NO: 102221 - RNA, 61 nt, Human; identical to SEQ ID NO: 23341

SEQ ID NO: 102222 - RNA, 61 nt, Human; identical to SEQ ID NO: 23342

SEQ ID NO: 102223 - RNA, 61 nt, Human; identical to SEQ ID NO: 23343

SEQ ID NO: 102224 - RNA, 61 nt, Human; identical to SEQ ID NO: 23344

SEQ ID NO: 102225 - RNA, 61 nt, Human; identical to SEQ ID NO: 23345

SEQ ID NO: 102226 - RNA, 61 nt, Human; identical to SEQ ID NO: 23346

SEQ ID NO: 102227 - RNA, 61 nt, Human; identical to SEQ ID NO: 23347

SEQ ID NO: 102228 - RNA, 61 nt, Human; identical to SEQ ID NO: 23348

SEQ ID NO: 102229 - RNA, 61 nt, Human; identical to SEQ ID NO: 23349

SEQ ID NO: 102230 - RNA, 61 nt, Human; identical to SEQ ID NO: 23350

SEQ ID NO: 102231 - RNA, 61 nt, Human; identical to SEQ ID NO: 23351

SEQ ID NO: 102232 - RNA, 61 nt, Human; identical to SEQ ID NO: 23352

SEQ ID NO: 102233 - RNA, 61 nt, Human; identical to SEQ ID NO: 23353

SEQ ID NO: 102234 - RNA, 61 nt, Human; identical to SEQ ID NO: 23354

SEQ ID NO: 102235 - RNA, 61 nt, Human; identical to SEQ ID NO: 23355

SEQ ID NO: 102236 - RNA, 61 nt, Human; identical to SEQ ID NO: 23356

SEQ ID NO: 102237 - RNA, 61 nt, Human; identical to SEQ ID NO: 23357

SEQ ID NO: 102238 - RNA, 64 nt, Human
gcagucagguccacaccuauguccagggcaccagggaugcaauuccauguggaugucaccaaac

SEQ ID NO: 102239 - RNA, 61 nt, Human; identical to SEQ ID NO: 23358

SEQ ID NO: 102240 - RNA, 61 nt, Human; identical to SEQ ID NO: 23359

SEQ ID NO: 102241 - RNA, 61 nt, Human; identical to SEQ ID NO: 23360

SEQ ID NO: 102242 - RNA, 61 nt, Human; identical to SEQ ID NO: 23361

SEQ ID NO: 102243 - RNA, 61 nt, Human; identical to SEQ ID NO: 23362

SEQ ID NO: 102244 - RNA, 61 nt, Human; identical to SEQ ID NO: 23363

SEQ ID NO: 102245 - RNA, 61 nt, Human; identical to SEQ ID NO: 23364

SEQ ID NO: 102246 - RNA, 61 nt, Human; identical to SEQ ID NO: 23365

SEQ ID NO: 102247 - RNA, 61 nt, Human; identical to SEQ ID NO: 23366

SEQ ID NO: 102248 - RNA, 61 nt, Human; identical to SEQ ID NO: 23367

SEQ ID NO: 102249 - RNA, 61 nt, Human; identical to SEQ ID NO: 23368

SEQ ID NO: 102250 - RNA, 61 nt, Human; identical to SEQ ID NO: 23369

SEQ ID NO: 102251 - RNA, 61 nt, Human; identical to SEQ ID NO: 23370

SEQ ID NO: 102252 - RNA, 61 nt, Human; identical to SEQ ID NO: 23371

SEQ ID NO: 102253 - RNA, 61 nt, Human; identical to SEQ ID NO: 23372

SEQ ID NO: 102254 - RNA, 61 nt, Human; identical to SEQ ID NO: 23373

SEQ ID NO: 102255 - RNA, 61 nt, Human; identical to SEQ ID NO: 23374

SEQ ID NO: 102256 - RNA, 64 nt, Human
augaggaguuguugaacccacugcuaggaagcaaggaugcaacaagaugaugcugagcgugaac

SEQ ID NO: 102257 - RNA, 61 nt, Human; identical to SEQ ID NO: 23375

SEQ ID NO: 102258 - RNA, 61 nt, Human; identical to SEQ ID NO: 23376

SEQ ID NO: 102259 - RNA, 61 nt, Human; identical to SEQ ID NO: 23377

SEQ ID NO: 102260 - RNA, 61 nt, Human; identical to SEQ ID NO: 23378

SEQ ID NO: 102261 - RNA, 61 nt, Human; identical to SEQ ID NO: 23379

SEQ ID NO: 102262 - RNA, 61 nt, Human; identical to SEQ ID NO: 23380

SEQ ID NO: 102263 - RNA, 61 nt, Human; identical to SEQ ID NO: 23381

SEQ ID NO: 102264 - RNA, 61 nt, Human; identical to SEQ ID NO: 23382

SEQ ID NO: 102265 - RNA, 61 nt, Human; identical to SEQ ID NO: 23383

SEQ ID NO: 102266 - RNA, 61 nt, Human; identical to SEQ ID NO: 23384

SEQ ID NO: 102267 - RNA, 61 nt, Human; identical to SEQ ID NO: 23385

SEQ ID NO: 102268 - RNA, 61 nt, Human; identical to SEQ ID NO: 23386

SEQ ID NO: 102269 - RNA, 61 nt, Human; identical to SEQ ID NO: 23387

SEQ ID NO: 102270 - RNA, 61 nt, Human; identical to SEQ ID NO: 23388

SEQ ID NO: 102271 - RNA, 61 nt, Human; identical to SEQ ID NO: 23389

SEQ ID NO: 102272 - RNA, 61 nt, Human; identical to SEQ ID NO: 23390

SEQ ID NO: 102273 - RNA, 61 nt, Human; identical to SEQ ID NO: 23391

SEQ ID NO: 102274 - RNA, 64 nt, Human
gcccagagagccagcagccuugggauacuaaugaggaugcaacuggcuuauugguaugaaauag

SEQ ID NO: 102275 - RNA, 61 nt, Human; identical to SEQ ID NO: 23392

SEQ ID NO: 102276 - RNA, 61 nt, Human; identical to SEQ ID NO: 23393

SEQ ID NO: 102277 - RNA, 61 nt, Human; identical to SEQ ID NO: 23394

SEQ ID NO: 102278 - RNA, 61 nt, Human; identical to SEQ ID NO: 23395

SEQ ID NO: 102279 - RNA, 61 nt, Human; identical to SEQ ID NO: 23396

SEQ ID NO: 102280 - RNA, 61 nt, Human; identical to SEQ ID NO: 23397

SEQ ID NO: 102281 - RNA, 61 nt, Human; identical to SEQ ID NO: 23398

SEQ ID NO: 102282 - RNA, 61 nt, Human; identical to SEQ ID NO: 23399

SEQ ID NO: 102283 - RNA, 61 nt, Human; identical to SEQ ID NO: 23400

SEQ ID NO: 102284 - RNA, 61 nt, Human; identical to SEQ ID NO: 23401

SEQ ID NO: 102285 - RNA, 61 nt, Human; identical to SEQ ID NO: 23402

SEQ ID NO: 102286 - RNA, 61 nt, Human; identical to SEQ ID NO: 23403

SEQ ID NO: 102287 - RNA, 61 nt, Human; identical to SEQ ID NO: 23404

SEQ ID NO: 102288 - RNA, 61 nt, Human; identical to SEQ ID NO: 23405

SEQ ID NO: 102289 - RNA, 61 nt, Human; identical to SEQ ID NO: 23406

SEQ ID NO: 102290 - RNA, 61 nt, Human; identical to SEQ ID NO: 23407

SEQ ID NO: 102291 - RNA, 61 nt, Human; identical to SEQ ID NO: 23408

SEQ ID NO: 102292 - RNA, 62 nt, Human; identical to SEQ ID NO: 84598

SEQ ID NO: 102293 - RNA, 61 nt, Human; identical to SEQ ID NO: 23409

SEQ ID NO: 102294 - RNA, 61 nt, Human; identical to SEQ ID NO: 23410

SEQ ID NO: 102295 - RNA, 61 nt, Human; identical to SEQ ID NO: 23411

SEQ ID NO: 102296 - RNA, 61 nt, Human; identical to SEQ ID NO: 23412

SEQ ID NO: 102297 - RNA, 61 nt, Human; identical to SEQ ID NO: 23413

SEQ ID NO: 102298 - RNA, 61 nt, Human; identical to SEQ ID NO: 23414

SEQ ID NO: 102299 - RNA, 61 nt, Human; identical to SEQ ID NO: 23415

SEQ ID NO: 102300 - RNA, 61 nt, Human; identical to SEQ ID NO: 23416

SEQ ID NO: 102301 - RNA, 61 nt, Human; identical to SEQ ID NO: 23417

SEQ ID NO: 102302 - RNA, 61 nt, Human; identical to SEQ ID NO: 23418

SEQ ID NO: 102303 - RNA, 61 nt, Human; identical to SEQ ID NO: 23419

SEQ ID NO: 102304 - RNA, 61 nt, Human; identical to SEQ ID NO: 23420

SEQ ID NO: 102305 - RNA, 61 nt, Human; identical to SEQ ID NO: 23421

SEQ ID NO: 102306 - RNA, 61 nt, Human; identical to SEQ ID NO: 23422

SEQ ID NO: 102307 - RNA, 61 nt, Human; identical to SEQ ID NO: 23423

SEQ ID NO: 102308 - RNA, 61 nt, Human; identical to SEQ ID NO: 23424

SEQ ID NO: 102309 - RNA, 61 nt, Human; identical to SEQ ID NO: 23425

SEQ ID NO: 102310 - RNA, 64 nt, Human
gccagagacauaugggccauaccccuuaaccccgggaugcaagguagcauggguccaagagaca

SEQ ID NO: 102311 - RNA, 61 nt, Human; identical to SEQ ID NO: 23426

SEQ ID NO: 102312 - RNA, 61 nt, Human; identical to SEQ ID NO: 23427

SEQ ID NO: 102313 - RNA, 61 nt, Human; identical to SEQ ID NO: 23428

SEQ ID NO: 102314 - RNA, 61 nt, Human; identical to SEQ ID NO: 23429

SEQ ID NO: 102315 - RNA, 61 nt, Human; identical to SEQ ID NO: 23430

SEQ ID NO: 102316 - RNA, 61 nt, Human; identical to SEQ ID NO: 23431

SEQ ID NO: 102317 - RNA, 61 nt, Human; identical to SEQ ID NO: 23432

SEQ ID NO: 102318 - RNA, 61 nt, Human; identical to SEQ ID NO: 23433

SEQ ID NO: 102319 - RNA, 61 nt, Human; identical to SEQ ID NO: 23434

SEQ ID NO: 102320 - RNA, 61 nt, Human; identical to SEQ ID NO: 23435

SEQ ID NO: 102321 - RNA, 61 nt, Human; identical to SEQ ID NO: 23436

SEQ ID NO: 102322 - RNA, 61 nt, Human; identical to SEQ ID NO: 23437

SEQ ID NO: 102323 - RNA, 61 nt, Human; identical to SEQ ID NO: 23438

SEQ ID NO: 102324 - RNA, 61 nt, Human; identical to SEQ ID NO: 23439

SEQ ID NO: 102325 - RNA, 61 nt, Human; identical to SEQ ID NO: 23440

SEQ ID NO: 102326 - RNA, 61 nt, Human; identical to SEQ ID NO: 23441

SEQ ID NO: 102327 - RNA, 61 nt, Human; identical to SEQ ID NO: 23442

SEQ ID NO: 102328 - RNA, 64 nt, Human
aaacaguauuuauuauaaauuacuaccgugacugggaugcaagagaauuaggacuauaauuuuc

SEQ ID NO: 102329 - RNA, 61 nt, Human; identical to SEQ ID NO: 23443

SEQ ID NO: 102330 - RNA, 61 nt, Human; identical to SEQ ID NO: 23444

SEQ ID NO: 102331 - RNA, 61 nt, Human; identical to SEQ ID NO: 23445

SEQ ID NO: 102332 - RNA, 61 nt, Human; identical to SEQ ID NO: 23446

SEQ ID NO: 102333 - RNA, 61 nt, Human; identical to SEQ ID NO: 23447

SEQ ID NO: 102334 - RNA, 61 nt, Human; identical to SEQ ID NO: 23448

SEQ ID NO: 102335 - RNA, 61 nt, Human; identical to SEQ ID NO: 23449

SEQ ID NO: 102336 - RNA, 61 nt, Human; identical to SEQ ID NO: 23450

SEQ ID NO: 102337 - RNA, 61 nt, Human; identical to SEQ ID NO: 23451

SEQ ID NO: 102338 - RNA, 61 nt, Human; identical to SEQ ID NO: 23452

SEQ ID NO: 102339 - RNA, 61 nt, Human; identical to SEQ ID NO: 23453

SEQ ID NO: 102340 - RNA, 61 nt, Human; identical to SEQ ID NO: 23454

SEQ ID NO: 102341 - RNA, 61 nt, Human; identical to SEQ ID NO: 23455

SEQ ID NO: 102342 - RNA, 61 nt, Human; identical to SEQ ID NO: 23456

SEQ ID NO: 102343 - RNA, 61 nt, Human; identical to SEQ ID NO: 23457

SEQ ID NO: 102344 - RNA, 61 nt, Human; identical to SEQ ID NO: 23458

SEQ ID NO: 102345 - RNA, 61 nt, Human; identical to SEQ ID NO: 23459

SEQ ID NO: 102346 - RNA, 61 nt, Human; identical to SEQ ID NO: 23460

SEQ ID NO: 102347 - RNA, 61 nt, Human; identical to SEQ ID NO: 23461

SEQ ID NO: 102348 - RNA, 61 nt, Human; identical to SEQ ID NO: 23462

SEQ ID NO: 102349 - RNA, 58 nt, Human; identical to SEQ ID NO: 23463

SEQ ID NO: 102350 - RNA, 61 nt, Human; identical to SEQ ID NO: 23464

SEQ ID NO: 102351 - RNA, 61 nt, Human; identical to SEQ ID NO: 23465

SEQ ID NO: 102352 - RNA, 61 nt, Human; identical to SEQ ID NO: 23466

SEQ ID NO: 102353 - RNA, 61 nt, Human; identical to SEQ ID NO: 23467

SEQ ID NO: 102354 - RNA, 61 nt, Human; identical to SEQ ID NO: 23468

SEQ ID NO: 102355 - RNA, 61 nt, Human; identical to SEQ ID NO: 23469

SEQ ID NO: 102356 - RNA, 61 nt, Human; identical to SEQ ID NO: 23470

SEQ ID NO: 102357 - RNA, 56 nt, Human; identical to SEQ ID NO: 23471

SEQ ID NO: 102358 - RNA, 61 nt, Human; identical to SEQ ID NO: 23472

SEQ ID NO: 102359 - RNA, 61 nt, Human; identical to SEQ ID NO: 23473

SEQ ID NO: 102360 - RNA, 61 nt, Human; identical to SEQ ID NO: 23474

SEQ ID NO: 102361 - RNA, 61 nt, Human; identical to SEQ ID NO: 23475

SEQ ID NO: 102362 - RNA, 61 nt, Human; identical to SEQ ID NO: 23476

SEQ ID NO: 102363 - RNA, 64 nt, Human
cggcgggcuggguguucacgugugucugugucauggaugcaaugcaggcccuggaggacugugc

SEQ ID NO: 102364 - RNA, 61 nt, Human; identical to SEQ ID NO: 23477

SEQ ID NO: 102365 - RNA, 61 nt, Human; identical to SEQ ID NO: 23478

SEQ ID NO: 102366 - RNA, 61 nt, Human; identical to SEQ ID NO: 23479

SEQ ID NO: 102367 - RNA, 61 nt, Human; identical to SEQ ID NO: 23480

SEQ ID NO: 102368 - RNA, 61 nt, Human; identical to SEQ ID NO: 23481

SEQ ID NO: 102369 - RNA, 61 nt, Human; identical to SEQ ID NO: 23482

SEQ ID NO: 102370 - RNA, 61 nt, Human; identical to SEQ ID NO: 23483

SEQ ID NO: 102371 - RNA, 61 nt, Human; identical to SEQ ID NO: 23484

SEQ ID NO: 102372 - RNA, 61 nt, Human; identical to SEQ ID NO: 23485

SEQ ID NO: 102373 - RNA, 61 nt, Human; identical to SEQ ID NO: 23486

SEQ ID NO: 102374 - RNA, 61 nt, Human; identical to SEQ ID NO: 23487

SEQ ID NO: 102375 - RNA, 61 nt, Human; identical to SEQ ID NO: 23488

SEQ ID NO: 102376 - RNA, 61 nt, Human; identical to SEQ ID NO: 23489

SEQ ID NO: 102377 - RNA, 61 nt, Human; identical to SEQ ID NO: 23490

SEQ ID NO: 102378 - RNA, 61 nt, Human; identical to SEQ ID NO: 23491

SEQ ID NO: 102379 - RNA, 61 nt, Human; identical to SEQ ID NO: 23492

SEQ ID NO: 102380 - RNA, 61 nt, Human; identical to SEQ ID NO: 23493

SEQ ID NO: 102381 - RNA, 64 nt, Human; identical to SEQ ID NO: 84508

SEQ ID NO: 102382 - RNA, 61 nt, Human; identical to SEQ ID NO: 23494

SEQ ID NO: 102383 - RNA, 61 nt, Human; identical to SEQ ID NO: 23495

SEQ ID NO: 102384 - RNA, 61 nt, Human; identical to SEQ ID NO: 23496

SEQ ID NO: 102385 - RNA, 61 nt, Human; identical to SEQ ID NO: 23497

SEQ ID NO: 102386 - RNA, 61 nt, Human; identical to SEQ ID NO: 23498

SEQ ID NO: 102387 - RNA, 61 nt, Human; identical to SEQ ID NO: 23499

SEQ ID NO: 102388 - RNA, 61 nt, Human; identical to SEQ ID NO: 23500

SEQ ID NO: 102389 - RNA, 61 nt, Human; identical to SEQ ID NO: 23501

SEQ ID NO: 102390 - RNA, 61 nt, Human; identical to SEQ ID NO: 23502

SEQ ID NO: 102391 - RNA, 61 nt, Human; identical to SEQ ID NO: 23503

SEQ ID NO: 102392 - RNA, 61 nt, Human; identical to SEQ ID NO: 23504

SEQ ID NO: 102393 - RNA, 61 nt, Human; identical to SEQ ID NO: 23505

SEQ ID NO: 102394 - RNA, 61 nt, Human; identical to SEQ ID NO: 23506

SEQ ID NO: 102395 - RNA, 61 nt, Human; identical to SEQ ID NO: 23507

SEQ ID NO: 102396 - RNA, 61 nt, Human; identical to SEQ ID NO: 23508

SEQ ID NO: 102397 - RNA, 61 nt, Human; identical to SEQ ID NO: 23509

SEQ ID NO: 102398 - RNA, 61 nt, Human; identical to SEQ ID NO: 23510

SEQ ID NO: 102399 - RNA, 64 nt, Human
aguucaaagcauaagguccauggugguggaaaauggaugcaagugauucuaaguuuguggauuu

SEQ ID NO: 102400 - RNA, 61 nt, Human; identical to SEQ ID NO: 23511

SEQ ID NO: 102401 - RNA, 61 nt, Human; identical to SEQ ID NO: 23512

SEQ ID NO: 102402 - RNA, 61 nt, Human; identical to SEQ ID NO: 23513

SEQ ID NO: 102403 - RNA, 61 nt, Human; identical to SEQ ID NO: 23514

SEQ ID NO: 102404 - RNA, 61 nt, Human; identical to SEQ ID NO: 23515

SEQ ID NO: 102405 - RNA, 61 nt, Human; identical to SEQ ID NO: 23516

SEQ ID NO: 102406 - RNA, 61 nt, Human; identical to SEQ ID NO: 23517

SEQ ID NO: 102407 - RNA, 61 nt, Human; identical to SEQ ID NO: 23518

SEQ ID NO: 102408 - RNA, 61 nt, Human; identical to SEQ ID NO: 23519

SEQ ID NO: 102409 - RNA, 61 nt, Human; identical to SEQ ID NO: 23520

SEQ ID NO: 102410 - RNA, 61 nt, Human; identical to SEQ ID NO: 23521

SEQ ID NO: 102411 - RNA, 61 nt, Human; identical to SEQ ID NO: 23522

SEQ ID NO: 102412 - RNA, 61 nt, Human; identical to SEQ ID NO: 23523

SEQ ID NO: 102413 - RNA, 61 nt, Human; identical to SEQ ID NO: 23524

SEQ ID NO: 102414 - RNA, 61 nt, Human; identical to SEQ ID NO: 23525

SEQ ID NO: 102415 - RNA, 61 nt, Human; identical to SEQ ID NO: 23526

SEQ ID NO: 102416 - RNA, 61 nt, Human; identical to SEQ ID NO: 23527

SEQ ID NO: 102417 - RNA, 64 nt, Human
uucugaauuguaaaugaacuuaaaaauagaauguggaugcaaaauaucacauaagacaucauga

SEQ ID NO: 102418 - RNA, 61 nt, Human; identical to SEQ ID NO: 23528

SEQ ID NO: 102419 - RNA, 61 nt, Human; identical to SEQ ID NO: 23529

SEQ ID NO: 102420 - RNA, 61 nt, Human; identical to SEQ ID NO: 23530

SEQ ID NO: 102421 - RNA, 61 nt, Human; identical to SEQ ID NO: 23531

SEQ ID NO: 102422 - RNA, 61 nt, Human; identical to SEQ ID NO: 23532

SEQ ID NO: 102423 - RNA, 61 nt, Human; identical to SEQ ID NO: 23533

SEQ ID NO: 102424 - RNA, 61 nt, Human; identical to SEQ ID NO: 23534

SEQ ID NO: 102425 - RNA, 61 nt, Human; identical to SEQ ID NO: 23535

SEQ ID NO: 102426 - RNA, 61 nt, Human; identical to SEQ ID NO: 23536

SEQ ID NO: 102427 - RNA, 61 nt, Human; identical to SEQ ID NO: 23537

SEQ ID NO: 102428 - RNA, 61 nt, Human; identical to SEQ ID NO: 23538

SEQ ID NO: 102429 - RNA, 61 nt, Human; identical to SEQ ID NO: 23539

SEQ ID NO: 102430 - RNA, 61 nt, Human; identical to SEQ ID NO: 23540

SEQ ID NO: 102431 - RNA, 61 nt, Human; identical to SEQ ID NO: 23541

SEQ ID NO: 102432 - RNA, 61 nt, Human; identical to SEQ ID NO: 23542

SEQ ID NO: 102433 - RNA, 61 nt, Human; identical to SEQ ID NO: 23543

SEQ ID NO: 102434 - RNA, 61 nt, Human; identical to SEQ ID NO: 23544

SEQ ID NO: 102435 - RNA, 64 nt, Human
ccucuuuaacguaugaggaagguuguccugcuacggaugcaauucaauucuuccuuuuuuauua

SEQ ID NO: 102436 - RNA, 61 nt, Human; identical to SEQ ID NO: 23545

SEQ ID NO: 102437 - RNA, 61 nt, Human; identical to SEQ ID NO: 23546

SEQ ID NO: 102438 - RNA, 61 nt, Human; identical to SEQ ID NO: 23547

SEQ ID NO: 102439 - RNA, 61 nt, Human; identical to SEQ ID NO: 23548

SEQ ID NO: 102440 - RNA, 61 nt, Human; identical to SEQ ID NO: 23549

SEQ ID NO: 102441 - RNA, 61 nt, Human; identical to SEQ ID NO: 23550

SEQ ID NO: 102442 - RNA, 61 nt, Human; identical to SEQ ID NO: 23551

SEQ ID NO: 102443 - RNA, 61 nt, Human; identical to SEQ ID NO: 23552

SEQ ID NO: 102444 - RNA, 61 nt, Human; identical to SEQ ID NO: 23553

SEQ ID NO: 102445 - RNA, 61 nt, Human; identical to SEQ ID NO: 23554

SEQ ID NO: 102446 - RNA, 61 nt, Human; identical to SEQ ID NO: 23555

SEQ ID NO: 102447 - RNA, 61 nt, Human; identical to SEQ ID NO: 23556

SEQ ID NO: 102448 - RNA, 61 nt, Human; identical to SEQ ID NO: 23557

SEQ ID NO: 102449 - RNA, 61 nt, Human; identical to SEQ ID NO: 23558

SEQ ID NO: 102450 - RNA, 61 nt, Human; identical to SEQ ID NO: 23559

SEQ ID NO: 102451 - RNA, 61 nt, Human; identical to SEQ ID NO: 23560

SEQ ID NO: 102452 - RNA, 61 nt, Human; identical to SEQ ID NO: 23561

SEQ ID NO: 102453 - RNA, 64 nt, Human
guguggaauuuugguugggguggggggagaggagggaugcaacucgcccuguuuggcaucuaau

SEQ ID NO: 102454 - RNA, 61 nt, Human; identical to SEQ ID NO: 23562

SEQ ID NO: 102455 - RNA, 61 nt, Human; identical to SEQ ID NO: 23563

SEQ ID NO: 102456 - RNA, 61 nt, Human; identical to SEQ ID NO: 23564

SEQ ID NO: 102457 - RNA, 61 nt, Human; identical to SEQ ID NO: 23565

SEQ ID NO: 102458 - RNA, 61 nt, Human; identical to SEQ ID NO: 23566

SEQ ID NO: 102459 - RNA, 61 nt, Human; identical to SEQ ID NO: 23567

SEQ ID NO: 102460 - RNA, 61 nt, Human; identical to SEQ ID NO: 23568

SEQ ID NO: 102461 - RNA, 61 nt, Human; identical to SEQ ID NO: 23569

SEQ ID NO: 102462 - RNA, 61 nt, Human; identical to SEQ ID NO: 23570

SEQ ID NO: 102463 - RNA, 61 nt, Human; identical to SEQ ID NO: 23571

SEQ ID NO: 102464 - RNA, 61 nt, Human; identical to SEQ ID NO: 23572

SEQ ID NO: 102465 - RNA, 61 nt, Human; identical to SEQ ID NO: 23573

SEQ ID NO: 102466 - RNA, 61 nt, Human; identical to SEQ ID NO: 23574

SEQ ID NO: 102467 - RNA, 61 nt, Human; identical to SEQ ID NO: 23575

SEQ ID NO: 102468 - RNA, 61 nt, Human; identical to SEQ ID NO: 23576

SEQ ID NO: 102469 - RNA, 61 nt, Human; identical to SEQ ID NO: 23577

SEQ ID NO: 102470 - RNA, 61 nt, Human; identical to SEQ ID NO: 23578

SEQ ID NO: 102471 - RNA, 64 nt, Human
gcucaccaggcagugugcuuccuuccuugcaugaggaugcaagaugcaacaguuugucuuucac

SEQ ID NO: 102472 - RNA, 61 nt, Human; identical to SEQ ID NO: 23579

SEQ ID NO: 102473 - RNA, 61 nt, Human; identical to SEQ ID NO: 23580

SEQ ID NO: 102474 - RNA, 61 nt, Human; identical to SEQ ID NO: 23581

SEQ ID NO: 102475 - RNA, 61 nt, Human; identical to SEQ ID NO: 23582

SEQ ID NO: 102476 - RNA, 61 nt, Human; identical to SEQ ID NO: 23583

SEQ ID NO: 102477 - RNA, 61 nt, Human; identical to SEQ ID NO: 23584

SEQ ID NO: 102478 - RNA, 61 nt, Human; identical to SEQ ID NO: 23585

SEQ ID NO: 102479 - RNA, 61 nt, Human; identical to SEQ ID NO: 23586

SEQ ID NO: 102480 - RNA, 61 nt, Human; identical to SEQ ID NO: 23587

SEQ ID NO: 102481 - RNA, 61 nt, Human; identical to SEQ ID NO: 23588

SEQ ID NO: 102482 - RNA, 61 nt, Human; identical to SEQ ID NO: 23589

SEQ ID NO: 102483 - RNA, 61 nt, Human; identical to SEQ ID NO: 23590

SEQ ID NO: 102484 - RNA, 61 nt, Human; identical to SEQ ID NO: 23591

SEQ ID NO: 102485 - RNA, 61 nt, Human; identical to SEQ ID NO: 23592

SEQ ID NO: 102486 - RNA, 61 nt, Human; identical to SEQ ID NO: 23593

SEQ ID NO: 102487 - RNA, 61 nt, Human; identical to SEQ ID NO: 23594

SEQ ID NO: 102488 - RNA, 61 nt, Human; identical to SEQ ID NO: 23595

SEQ ID NO: 102489 - RNA, 64 nt, Human
aaauaucgaccaucacccucccccgcgugaacugggaugcaaguugcuaaccgaugugaacgca

SEQ ID NO: 102490 - RNA, 61 nt, Human; identical to SEQ ID NO: 23596

SEQ ID NO: 102491 - RNA, 61 nt, Human; identical to SEQ ID NO: 23597

SEQ ID NO: 102492 - RNA, 61 nt, Human; identical to SEQ ID NO: 23598

SEQ ID NO: 102493 - RNA, 61 nt, Human; identical to SEQ ID NO: 23599

SEQ ID NO: 102494 - RNA, 61 nt, Human; identical to SEQ ID NO: 23600

SEQ ID NO: 102495 - RNA, 61 nt, Human; identical to SEQ ID NO: 23601

SEQ ID NO: 102496 - RNA, 61 nt, Human; identical to SEQ ID NO: 23602

SEQ ID NO: 102497 - RNA, 61 nt, Human; identical to SEQ ID NO: 23603

SEQ ID NO: 102498 - RNA, 61 nt, Human; identical to SEQ ID NO: 23604

SEQ ID NO: 102499 - RNA, 61 nt, Human; identical to SEQ ID NO: 23605

SEQ ID NO: 102500 - RNA, 61 nt, Human; identical to SEQ ID NO: 23606

SEQ ID NO: 102501 - RNA, 61 nt, Human; identical to SEQ ID NO: 23607

SEQ ID NO: 102502 - RNA, 61 nt, Human; identical to SEQ ID NO: 23608

SEQ ID NO: 102503 - RNA, 61 nt, Human; identical to SEQ ID NO: 23609

SEQ ID NO: 102504 - RNA, 61 nt, Human; identical to SEQ ID NO: 23610

SEQ ID NO: 102505 - RNA, 61 nt, Human; identical to SEQ ID NO: 23611

SEQ ID NO: 102506 - RNA, 61 nt, Human; identical to SEQ ID NO: 23612

SEQ ID NO: 102507 - RNA, 64 nt, Human
aauuacuugcaugggguaacccaguaauacugugggaugcaacuucuagggcauggcugccucc

SEQ ID NO: 102508 - RNA, 61 nt, Human; identical to SEQ ID NO: 23613

SEQ ID NO: 102509 - RNA, 61 nt, Human; identical to SEQ ID NO: 23614

SEQ ID NO: 102510 - RNA, 61 nt, Human; identical to SEQ ID NO: 23615

SEQ ID NO: 102511 - RNA, 61 nt, Human; identical to SEQ ID NO: 23616

SEQ ID NO: 102512 - RNA, 61 nt, Human; identical to SEQ ID NO: 23617

SEQ ID NO: 102513 - RNA, 61 nt, Human; identical to SEQ ID NO: 23618

SEQ ID NO: 102514 - RNA, 61 nt, Human; identical to SEQ ID NO: 23619

SEQ ID NO: 102515 - RNA, 61 nt, Human; identical to SEQ ID NO: 23620

SEQ ID NO: 102516 - RNA, 61 nt, Human; identical to SEQ ID NO: 23621

SEQ ID NO: 102517 - RNA, 61 nt, Human; identical to SEQ ID NO: 23622

SEQ ID NO: 102518 - RNA, 61 nt, Human; identical to SEQ ID NO: 23623

SEQ ID NO: 102519 - RNA, 61 nt, Human; identical to SEQ ID NO: 23624

SEQ ID NO: 102520 - RNA, 61 nt, Human; identical to SEQ ID NO: 23625

SEQ ID NO: 102521 - RNA, 61 nt, Human; identical to SEQ ID NO: 23626

SEQ ID NO: 102522 - RNA, 61 nt, Human; identical to SEQ ID NO: 23627

SEQ ID NO: 102523 - RNA, 61 nt, Human; identical to SEQ ID NO: 23628

SEQ ID NO: 102524 - RNA, 61 nt, Human; identical to SEQ ID NO: 23629

SEQ ID NO: 102525 - RNA, 64 nt, Human; identical to SEQ ID NO: 84556

SEQ ID NO: 102526 - RNA, 61 nt, Human; identical to SEQ ID NO: 23630

SEQ ID NO: 102527 - RNA, 61 nt, Human; identical to SEQ ID NO: 23631

SEQ ID NO: 102528 - RNA, 61 nt, Human; identical to SEQ ID NO: 23632

SEQ ID NO: 102529 - RNA, 61 nt, Human; identical to SEQ ID NO: 23633

SEQ ID NO: 102530 - RNA, 61 nt, Human; identical to SEQ ID NO: 23634

SEQ ID NO: 102531 - RNA, 61 nt, Human; identical to SEQ ID NO: 23635

SEQ ID NO: 102532 - RNA, 61 nt, Human; identical to SEQ ID NO: 23636

SEQ ID NO: 102533 - RNA, 61 nt, Human; identical to SEQ ID NO: 23637

SEQ ID NO: 102534 - RNA, 61 nt, Human; identical to SEQ ID NO: 23638

SEQ ID NO: 102535 - RNA, 61 nt, Human; identical to SEQ ID NO: 23639

SEQ ID NO: 102536 - RNA, 61 nt, Human; identical to SEQ ID NO: 23640

SEQ ID NO: 102537 - RNA, 61 nt, Human; identical to SEQ ID NO: 23641

SEQ ID NO: 102538 - RNA, 61 nt, Human; identical to SEQ ID NO: 23642

SEQ ID NO: 102539 - RNA, 61 nt, Human; identical to SEQ ID NO: 23643

SEQ ID NO: 102540 - RNA, 61 nt, Human; identical to SEQ ID NO: 23644

SEQ ID NO: 102541 - RNA, 61 nt, Human; identical to SEQ ID NO: 23645

SEQ ID NO: 102542 - RNA, 61 nt, Human; identical to SEQ ID NO: 23646

SEQ ID NO: 102543 - RNA, 64 nt, Human
ccccccaucauaccagcccccaggaccacuaccccacggccagccagggguccagagcuagccc

SEQ ID NO: 102544 - RNA, 61 nt, Human; identical to SEQ ID NO: 23647

SEQ ID NO: 102545 - RNA, 61 nt, Human; identical to SEQ ID NO: 23648

SEQ ID NO: 102546 - RNA, 61 nt, Human; identical to SEQ ID NO: 23649

SEQ ID NO: 102547 - RNA, 61 nt, Human; identical to SEQ ID NO: 23650

SEQ ID NO: 102548 - RNA, 61 nt, Human; identical to SEQ ID NO: 23651

SEQ ID NO: 102549 - RNA, 61 nt, Human; identical to SEQ ID NO: 23652

SEQ ID NO: 102550 - RNA, 61 nt, Human; identical to SEQ ID NO: 23653

SEQ ID NO: 102551 - RNA, 61 nt, Human; identical to SEQ ID NO: 23654

SEQ ID NO: 102552 - RNA, 61 nt, Human; identical to SEQ ID NO: 23655

SEQ ID NO: 102553 - RNA, 61 nt, Human; identical to SEQ ID NO: 23656

SEQ ID NO: 102554 - RNA, 61 nt, Human; identical to SEQ ID NO: 23657

SEQ ID NO: 102555 - RNA, 61 nt, Human; identical to SEQ ID NO: 23658

SEQ ID NO: 102556 - RNA, 61 nt, Human; identical to SEQ ID NO: 23659

SEQ ID NO: 102557 - RNA, 61 nt, Human; identical to SEQ ID NO: 23660

SEQ ID NO: 102558 - RNA, 61 nt, Human; identical to SEQ ID NO: 23661

SEQ ID NO: 102559 - RNA, 61 nt, Human; identical to SEQ ID NO: 23662

SEQ ID NO: 102560 - RNA, 61 nt, Human; identical to SEQ ID NO: 23663

SEQ ID NO: 102561 - RNA, 64 nt, Human
uuugucagccucagcaacaaacauuuccuaaaugggaugcaaaaagaaacugaaugauguugaa

SEQ ID NO: 102562 - RNA, 61 nt, Human; identical to SEQ ID NO: 23664

SEQ ID NO: 102563 - RNA, 61 nt, Human; identical to SEQ ID NO: 23665

SEQ ID NO: 102564 - RNA, 61 nt, Human; identical to SEQ ID NO: 23666

SEQ ID NO: 102565 - RNA, 61 nt, Human; identical to SEQ ID NO: 23667

SEQ ID NO: 102566 - RNA, 61 nt, Human; identical to SEQ ID NO: 23668

SEQ ID NO: 102567 - RNA, 61 nt, Human; identical to SEQ ID NO: 23669

SEQ ID NO: 102568 - RNA, 61 nt, Human; identical to SEQ ID NO: 23670

SEQ ID NO: 102569 - RNA, 61 nt, Human; identical to SEQ ID NO: 23671

SEQ ID NO: 102570 - RNA, 61 nt, Human; identical to SEQ ID NO: 23672

SEQ ID NO: 102571 - RNA, 61 nt, Human; identical to SEQ ID NO: 23673

SEQ ID NO: 102572 - RNA, 61 nt, Human; identical to SEQ ID NO: 23674

SEQ ID NO: 102573 - RNA, 61 nt, Human; identical to SEQ ID NO: 23675

SEQ ID NO: 102574 - RNA, 61 nt, Human; identical to SEQ ID NO: 23676

SEQ ID NO: 102575 - RNA, 61 nt, Human; identical to SEQ ID NO: 23677

SEQ ID NO: 102576 - RNA, 61 nt, Human; identical to SEQ ID NO: 23678

SEQ ID NO: 102577 - RNA, 61 nt, Human; identical to SEQ ID NO: 23679

SEQ ID NO: 102578 - RNA, 61 nt, Human; identical to SEQ ID NO: 23680

SEQ ID NO: 102579 - RNA, 61 nt, Human; identical to SEQ ID NO: 23681

SEQ ID NO: 102580 - RNA, 61 nt, Human; identical to SEQ ID NO: 23682

SEQ ID NO: 102581 - RNA, 61 nt, Human; identical to SEQ ID NO: 23683

SEQ ID NO: 102582 - RNA, 61 nt, Human; identical to SEQ ID NO: 23684

SEQ ID NO: 102583 - RNA, 61 nt, Human; identical to SEQ ID NO: 23685

SEQ ID NO: 102584 - RNA, 61 nt, Human; identical to SEQ ID NO: 23686

SEQ ID NO: 102585 - RNA, 61 nt, Human; identical to SEQ ID NO: 23687

SEQ ID NO: 102586 - RNA, 61 nt, Human; identical to SEQ ID NO: 23688

SEQ ID NO: 102587 - RNA, 61 nt, Human; identical to SEQ ID NO: 23689

SEQ ID NO: 102588 - RNA, 61 nt, Human; identical to SEQ ID NO: 23690

SEQ ID NO: 102589 - RNA, 61 nt, Human; identical to SEQ ID NO: 23691

SEQ ID NO: 102590 - RNA, 61 nt, Human; identical to SEQ ID NO: 23692

SEQ ID NO: 102591 - RNA, 61 nt, Human; identical to SEQ ID NO: 23693

SEQ ID NO: 102592 - RNA, 61 nt, Human; identical to SEQ ID NO: 23694

SEQ ID NO: 102593 - RNA, 61 nt, Human; identical to SEQ ID NO: 23695

SEQ ID NO: 102594 - RNA, 61 nt, Human; identical to SEQ ID NO: 23696

SEQ ID NO: 102595 - RNA, 61 nt, Human; identical to SEQ ID NO: 23697

SEQ ID NO: 102596 - RNA, 64 nt, Human
uauuucaugguguuuucagggaacacagaaaugcggaugcaaaacaacuuuugacagaggccca

SEQ ID NO: 102597 - RNA, 61 nt, Human; identical to SEQ ID NO: 23698

SEQ ID NO: 102598 - RNA, 61 nt, Human; identical to SEQ ID NO: 23699

SEQ ID NO: 102599 - RNA, 61 nt, Human; identical to SEQ ID NO: 23700

SEQ ID NO: 102600 - RNA, 61 nt, Human; identical to SEQ ID NO: 23701

SEQ ID NO: 102601 - RNA, 61 nt, Human; identical to SEQ ID NO: 23702

SEQ ID NO: 102602 - RNA, 61 nt, Human; identical to SEQ ID NO: 23703

SEQ ID NO: 102603 - RNA, 61 nt, Human; identical to SEQ ID NO: 23704

SEQ ID NO: 102604 - RNA, 61 nt, Human; identical to SEQ ID NO: 23705

SEQ ID NO: 102605 - RNA, 61 nt, Human; identical to SEQ ID NO: 23706

SEQ ID NO: 102606 - RNA, 61 nt, Human; identical to SEQ ID NO: 23707

SEQ ID NO: 102607 - RNA, 61 nt, Human; identical to SEQ ID NO: 23708

SEQ ID NO: 102608 - RNA, 61 nt, Human; identical to SEQ ID NO: 23709

SEQ ID NO: 102609 - RNA, 61 nt, Human; identical to SEQ ID NO: 23710

SEQ ID NO: 102610 - RNA, 61 nt, Human; identical to SEQ ID NO: 23711

SEQ ID NO: 102611 - RNA, 61 nt, Human; identical to SEQ ID NO: 23712

SEQ ID NO: 102612 - RNA, 61 nt, Human; identical to SEQ ID NO: 23713

SEQ ID NO: 102613 - RNA, 61 nt, Human; identical to SEQ ID NO: 23714

SEQ ID NO: 102614 - RNA, 64 nt, Human
uaaaaaucacuguaauacuucauuguguuguacuggaugcaaagcuagaaaauauugcaauaaa

SEQ ID NO: 102615 - RNA, 61 nt, Human; identical to SEQ ID NO: 23715

SEQ ID NO: 102616 - RNA, 61 nt, Human; identical to SEQ ID NO: 23716

SEQ ID NO: 102617 - RNA, 61 nt, Human; identical to SEQ ID NO: 23717

SEQ ID NO: 102618 - RNA, 61 nt, Human; identical to SEQ ID NO: 23718

SEQ ID NO: 102619 - RNA, 61 nt, Human; identical to SEQ ID NO: 23719

SEQ ID NO: 102620 - RNA, 61 nt, Human; identical to SEQ ID NO: 23720

SEQ ID NO: 102621 - RNA, 61 nt, Human; identical to SEQ ID NO: 23721

SEQ ID NO: 102622 - RNA, 61 nt, Human; identical to SEQ ID NO: 23722

SEQ ID NO: 102623 - RNA, 61 nt, Human; identical to SEQ ID NO: 23723

SEQ ID NO: 102624 - RNA, 61 nt, Human; identical to SEQ ID NO: 23724

SEQ ID NO: 102625 - RNA, 61 nt, Human; identical to SEQ ID NO: 23725

SEQ ID NO: 102626 - RNA, 61 nt, Human; identical to SEQ ID NO: 23726

SEQ ID NO: 102627 - RNA, 61 nt, Human; identical to SEQ ID NO: 23727

SEQ ID NO: 102628 - RNA, 61 nt, Human; identical to SEQ ID NO: 23728

SEQ ID NO: 102629 - RNA, 61 nt, Human; identical to SEQ ID NO: 23729

SEQ ID NO: 102630 - RNA, 61 nt, Human; identical to SEQ ID NO: 23730

SEQ ID NO: 102631 - RNA, 61 nt, Human; identical to SEQ ID NO: 23731

SEQ ID NO: 102632 - RNA, 61 nt, Human; identical to SEQ ID NO: 23732

SEQ ID NO: 102633 - RNA, 61 nt, Human; identical to SEQ ID NO: 23733

SEQ ID NO: 102634 - RNA, 61 nt, Human; identical to SEQ ID NO: 23734

SEQ ID NO: 102635 - RNA, 61 nt, Human; identical to SEQ ID NO: 23735

SEQ ID NO: 102636 - RNA, 61 nt, Human; identical to SEQ ID NO: 23736

SEQ ID NO: 102637 - RNA, 61 nt, Human; identical to SEQ ID NO: 23737

SEQ ID NO: 102638 - RNA, 61 nt, Human; identical to SEQ ID NO: 23738

SEQ ID NO: 102639 - RNA, 61 nt, Human; identical to SEQ ID NO: 23739

SEQ ID NO: 102640 - RNA, 61 nt, Human; identical to SEQ ID NO: 23740

SEQ ID NO: 102641 - RNA, 61 nt, Human; identical to SEQ ID NO: 23741

SEQ ID NO: 102642 - RNA, 61 nt, Human; identical to SEQ ID NO: 23742

SEQ ID NO: 102643 - RNA, 61 nt, Human; identical to SEQ ID NO: 23743

SEQ ID NO: 102644 - RNA, 61 nt, Human; identical to SEQ ID NO: 23744

SEQ ID NO: 102645 - RNA, 61 nt, Human; identical to SEQ ID NO: 23745

SEQ ID NO: 102646 - RNA, 61 nt, Human; identical to SEQ ID NO: 23746

SEQ ID NO: 102647 - RNA, 61 nt, Human; identical to SEQ ID NO: 23747

SEQ ID NO: 102648 - RNA, 61 nt, Human; identical to SEQ ID NO: 23748

SEQ ID NO: 102649 - RNA, 61 nt, Human; identical to SEQ ID NO: 23749

SEQ ID NO: 102650 - RNA, 61 nt, Human; identical to SEQ ID NO: 23750

SEQ ID NO: 102651 - RNA, 61 nt, Human; identical to SEQ ID NO: 23751

SEQ ID NO: 102652 - RNA, 61 nt, Human; identical to SEQ ID NO: 23752

SEQ ID NO: 102653 - RNA, 61 nt, Human; identical to SEQ ID NO: 23753

SEQ ID NO: 102654 - RNA, 61 nt, Human; identical to SEQ ID NO: 23754

SEQ ID NO: 102655 - RNA, 61 nt, Human; identical to SEQ ID NO: 23755

SEQ ID NO: 102656 - RNA, 61 nt, Human; identical to SEQ ID NO: 23756

SEQ ID NO: 102657 - RNA, 61 nt, Human; identical to SEQ ID NO: 23757

SEQ ID NO: 102658 - RNA, 61 nt, Human; identical to SEQ ID NO: 23758

SEQ ID NO: 102659 - RNA, 61 nt, Human; identical to SEQ ID NO: 23759

SEQ ID NO: 102660 - RNA, 61 nt, Human; identical to SEQ ID NO: 23760

SEQ ID NO: 102661 - RNA, 61 nt, Human; identical to SEQ ID NO: 23761

SEQ ID NO: 102662 - RNA, 61 nt, Human; identical to SEQ ID NO: 23762

SEQ ID NO: 102663 - RNA, 61 nt, Human; identical to SEQ ID NO: 23763

SEQ ID NO: 102664 - RNA, 61 nt, Human; identical to SEQ ID NO: 23764

SEQ ID NO: 102665 - RNA, 61 nt, Human; identical to SEQ ID NO: 23765

SEQ ID NO: 102666 - RNA, 61 nt, Human; identical to SEQ ID NO: 23766

SEQ ID NO: 102667 - RNA, 61 nt, Human; identical to SEQ ID NO: 23767

SEQ ID NO: 102668 - RNA, 61 nt, Human; identical to SEQ ID NO: 23768

SEQ ID NO: 102669 - RNA, 61 nt, Human; identical to SEQ ID NO: 23769

SEQ ID NO: 102670 - RNA, 61 nt, Human; identical to SEQ ID NO: 23770

SEQ ID NO: 102671 - RNA, 61 nt, Human; identical to SEQ ID NO: 23771

SEQ ID NO: 102672 - RNA, 61 nt, Human; identical to SEQ ID NO: 23772

SEQ ID NO: 102673 - RNA, 61 nt, Human; identical to SEQ ID NO: 23773

SEQ ID NO: 102674 - RNA, 61 nt, Human; identical to SEQ ID NO: 23774

SEQ ID NO: 102675 - RNA, 61 nt, Human; identical to SEQ ID NO: 23775

SEQ ID NO: 102676 - RNA, 61 nt, Human; identical to SEQ ID NO: 23776

SEQ ID NO: 102677 - RNA, 61 nt, Human; identical to SEQ ID NO: 23777

SEQ ID NO: 102678 - RNA, 61 nt, Human; identical to SEQ ID NO: 23778

SEQ ID NO: 102679 - RNA, 61 nt, Human; identical to SEQ ID NO: 23779

SEQ ID NO: 102680 - RNA, 61 nt, Human; identical to SEQ ID NO: 23780

SEQ ID NO: 102681 - RNA, 61 nt, Human; identical to SEQ ID NO: 23781

SEQ ID NO: 102682 - RNA, 61 nt, Human; identical to SEQ ID NO: 23782

SEQ ID NO: 102683 - RNA, 61 nt, Human; identical to SEQ ID NO: 23783

SEQ ID NO: 102684 - RNA, 61 nt, Human; identical to SEQ ID NO: 23784

SEQ ID NO: 102685 - RNA, 61 nt, Human; identical to SEQ ID NO: 23785

SEQ ID NO: 102686 - RNA, 61 nt, Human; identical to SEQ ID NO: 23786

SEQ ID NO: 102687 - RNA, 61 nt, Human; identical to SEQ ID NO: 23787

SEQ ID NO: 102688 - RNA, 61 nt, Human; identical to SEQ ID NO: 23788

SEQ ID NO: 102689 - RNA, 61 nt, Human; identical to SEQ ID NO: 23789

SEQ ID NO: 102690 - RNA, 61 nt, Human; identical to SEQ ID NO: 23790

SEQ ID NO: 102691 - RNA, 61 nt, Human; identical to SEQ ID NO: 23791

SEQ ID NO: 102692 - RNA, 61 nt, Human; identical to SEQ ID NO: 23792

SEQ ID NO: 102693 - RNA, 61 nt, Human; identical to SEQ ID NO: 23793

SEQ ID NO: 102694 - RNA, 61 nt, Human; identical to SEQ ID NO: 23794

SEQ ID NO: 102695 - RNA, 61 nt, Human; identical to SEQ ID NO: 23795

SEQ ID NO: 102696 - RNA, 61 nt, Human; identical to SEQ ID NO: 23796

SEQ ID NO: 102697 - RNA, 61 nt, Human; identical to SEQ ID NO: 23797

SEQ ID NO: 102698 - RNA, 61 nt, Human; identical to SEQ ID NO: 23798

SEQ ID NO: 102699 - RNA, 61 nt, Human; identical to SEQ ID NO: 23799

SEQ ID NO: 102700 - RNA, 64 nt, Human
caaaauggccgugcaagcuuaggcuggggauucuggaugcaacgucuuuacaaccuuaccuaga

SEQ ID NO: 102701 - RNA, 61 nt, Human; identical to SEQ ID NO: 23800

SEQ ID NO: 102702 - RNA, 61 nt, Human; identical to SEQ ID NO: 23801

SEQ ID NO: 102703 - RNA, 61 nt, Human; identical to SEQ ID NO: 23802

SEQ ID NO: 102704 - RNA, 61 nt, Human; identical to SEQ ID NO: 23803

SEQ ID NO: 102705 - RNA, 61 nt, Human; identical to SEQ ID NO: 23804

SEQ ID NO: 102706 - RNA, 61 nt, Human; identical to SEQ ID NO: 23805

SEQ ID NO: 102707 - RNA, 50 nt, Human; identical to SEQ ID NO: 23806

SEQ ID NO: 102708 - RNA, 61 nt, Human; identical to SEQ ID NO: 23807

SEQ ID NO: 102709 - RNA, 61 nt, Human; identical to SEQ ID NO: 23808

SEQ ID NO: 102710 - RNA, 61 nt, Human; identical to SEQ ID NO: 23809

SEQ ID NO: 102711 - RNA, 61 nt, Human; identical to SEQ ID NO: 23810

SEQ ID NO: 102712 - RNA, 61 nt, Human; identical to SEQ ID NO: 23811

SEQ ID NO: 102713 - RNA, 61 nt, Human; identical to SEQ ID NO: 23812

SEQ ID NO: 102714 - RNA, 61 nt, Human; identical to SEQ ID NO: 23813

SEQ ID NO: 102715 - RNA, 61 nt, Human; identical to SEQ ID NO: 23814

SEQ ID NO: 102716 - RNA, 61 nt, Human; identical to SEQ ID NO: 23815

SEQ ID NO: 102717 - RNA, 61 nt, Human; identical to SEQ ID NO: 23816

SEQ ID NO: 102718 - RNA, 64 nt, Human
uugucuauaaccaggcccuggcaaagugcaaacaggaugcaacugcaguggcacaaaggucacu

SEQ ID NO: 102719 - RNA, 61 nt, Human; identical to SEQ ID NO: 23817

SEQ ID NO: 102720 - RNA, 61 nt, Human; identical to SEQ ID NO: 23818

SEQ ID NO: 102721 - RNA, 61 nt, Human; identical to SEQ ID NO: 23819

SEQ ID NO: 102722 - RNA, 61 nt, Human; identical to SEQ ID NO: 23820

SEQ ID NO: 102723 - RNA, 61 nt, Human; identical to SEQ ID NO: 23821

SEQ ID NO: 102724 - RNA, 61 nt, Human; identical to SEQ ID NO: 23822

SEQ ID NO: 102725 - RNA, 61 nt, Human; identical to SEQ ID NO: 23823

SEQ ID NO: 102726 - RNA, 61 nt, Human; identical to SEQ ID NO: 23824

SEQ ID NO: 102727 - RNA, 61 nt, Human; identical to SEQ ID NO: 23825

SEQ ID NO: 102728 - RNA, 61 nt, Human; identical to SEQ ID NO: 23826

SEQ ID NO: 102729 - RNA, 61 nt, Human; identical to SEQ ID NO: 23827

SEQ ID NO: 102730 - RNA, 61 nt, Human; identical to SEQ ID NO: 23828

SEQ ID NO: 102731 - RNA, 61 nt, Human; identical to SEQ ID NO: 23829

SEQ ID NO: 102732 - RNA, 61 nt, Human; identical to SEQ ID NO: 23830

SEQ ID NO: 102733 - RNA, 61 nt, Human; identical to SEQ ID NO: 23831

SEQ ID NO: 102734 - RNA, 61 nt, Human; identical to SEQ ID NO: 23832

SEQ ID NO: 102735 - RNA, 61 nt, Human; identical to SEQ ID NO: 23833

SEQ ID NO: 102736 - RNA, 64 nt, Human
uugauucuaaaucuguuccauuaucuucucuguaggaugcaaaacauccaguuguaauguauaa

SEQ ID NO: 102737 - RNA, 61 nt, Human; identical to SEQ ID NO: 23834

SEQ ID NO: 102738 - RNA, 61 nt, Human; identical to SEQ ID NO: 23835

SEQ ID NO: 102739 - RNA, 61 nt, Human; identical to SEQ ID NO: 23836

SEQ ID NO: 102740 - RNA, 61 nt, Human; identical to SEQ ID NO: 23837

SEQ ID NO: 102741 - RNA, 61 nt, Human; identical to SEQ ID NO: 23838

SEQ ID NO: 102742 - RNA, 61 nt, Human; identical to SEQ ID NO: 23839

SEQ ID NO: 102743 - RNA, 61 nt, Human; identical to SEQ ID NO: 23840

SEQ ID NO: 102744 - RNA, 61 nt, Human; identical to SEQ ID NO: 23841

SEQ ID NO: 102745 - RNA, 61 nt, Human; identical to SEQ ID NO: 23842

SEQ ID NO: 102746 - RNA, 61 nt, Human; identical to SEQ ID NO: 23843

SEQ ID NO: 102747 - RNA, 61 nt, Human; identical to SEQ ID NO: 23844

SEQ ID NO: 102748 - RNA, 61 nt, Human; identical to SEQ ID NO: 23845

SEQ ID NO: 102749 - RNA, 61 nt, Human; identical to SEQ ID NO: 23846

SEQ ID NO: 102750 - RNA, 61 nt, Human; identical to SEQ ID NO: 23847

SEQ ID NO: 102751 - RNA, 61 nt, Human; identical to SEQ ID NO: 23848

SEQ ID NO: 102752 - RNA, 61 nt, Human; identical to SEQ ID NO: 23849

SEQ ID NO: 102753 - RNA, 61 nt, Human; identical to SEQ ID NO: 23850

SEQ ID NO: 102754 - RNA, 61 nt, Human; identical to SEQ ID NO: 23851

SEQ ID NO: 102755 - RNA, 61 nt, Human; identical to SEQ ID NO: 23852

SEQ ID NO: 102756 - RNA, 61 nt, Human; identical to SEQ ID NO: 23853

SEQ ID NO: 102757 - RNA, 61 nt, Human; identical to SEQ ID NO: 23854

SEQ ID NO: 102758 - RNA, 61 nt, Human; identical to SEQ ID NO: 23855

SEQ ID NO: 102759 - RNA, 61 nt, Human; identical to SEQ ID NO: 23856

SEQ ID NO: 102760 - RNA, 61 nt, Human; identical to SEQ ID NO: 23857

SEQ ID NO: 102761 - RNA, 61 nt, Human; identical to SEQ ID NO: 23858

SEQ ID NO: 102762 - RNA, 61 nt, Human; identical to SEQ ID NO: 23859

SEQ ID NO: 102763 - RNA, 61 nt, Human; identical to SEQ ID NO: 23860

SEQ ID NO: 102764 - RNA, 61 nt, Human; identical to SEQ ID NO: 23861

SEQ ID NO: 102765 - RNA, 61 nt, Human; identical to SEQ ID NO: 23862

SEQ ID NO: 102766 - RNA, 61 nt, Human; identical to SEQ ID NO: 23863

SEQ ID NO: 102767 - RNA, 61 nt, Human; identical to SEQ ID NO: 23864

SEQ ID NO: 102768 - RNA, 61 nt, Human; identical to SEQ ID NO: 23829

SEQ ID NO: 102769 - RNA, 61 nt, Human; identical to SEQ ID NO: 23866

SEQ ID NO: 102770 - RNA, 61 nt, Human; identical to SEQ ID NO: 23867

SEQ ID NO: 102771 - RNA, 64 nt, Human
uuuuagaugaguucucuaugugaccaauuuuacuggaugcaauugacaggacccgucaucauaa

SEQ ID NO: 102772 - RNA, 61 nt, Human; identical to SEQ ID NO: 23868

SEQ ID NO: 102773 - RNA, 58 nt, Human; identical to SEQ ID NO: 23869

SEQ ID NO: 102774 - RNA, 61 nt, Human; identical to SEQ ID NO: 23870

SEQ ID NO: 102775 - RNA, 61 nt, Human; identical to SEQ ID NO: 23871

SEQ ID NO: 102776 - RNA, 61 nt, Human; identical to SEQ ID NO: 23872

SEQ ID NO: 102777 - RNA, 61 nt, Human; identical to SEQ ID NO: 23873

SEQ ID NO: 102778 - RNA, 61 nt, Human; identical to SEQ ID NO: 23874

SEQ ID NO: 102779 - RNA, 61 nt, Human; identical to SEQ ID NO: 23875

SEQ ID NO: 102780 - RNA, 61 nt, Human; identical to SEQ ID NO: 23876

SEQ ID NO: 102781 - RNA, 61 nt, Human; identical to SEQ ID NO: 23877

SEQ ID NO: 102782 - RNA, 61 nt, Human; identical to SEQ ID NO: 23878

SEQ ID NO: 102783 - RNA, 61 nt, Human; identical to SEQ ID NO: 23879

SEQ ID NO: 102784 - RNA, 61 nt, Human; identical to SEQ ID NO: 23880

SEQ ID NO: 102785 - RNA, 61 nt, Human; identical to SEQ ID NO: 23881

SEQ ID NO: 102786 - RNA, 55 nt, Human; identical to SEQ ID NO: 23882

SEQ ID NO: 102787 - RNA, 61 nt, Human; identical to SEQ ID NO: 23883

SEQ ID NO: 102788 - RNA, 61 nt, Human; identical to SEQ ID NO: 23884

SEQ ID NO: 102789 - RNA, 64 nt, Human
uccgguguggaggcuauguagcuggugcgcugcucacggccauucacugcccaugcugagcgcc

SEQ ID NO: 102790 - RNA, 61 nt, Human; identical to SEQ ID NO: 23885

SEQ ID NO: 102791 - RNA, 61 nt, Human; identical to SEQ ID NO: 23886

SEQ ID NO: 102792 - RNA, 61 nt, Human; identical to SEQ ID NO: 23887

SEQ ID NO: 102793 - RNA, 61 nt, Human; identical to SEQ ID NO: 23888

SEQ ID NO: 102794 - RNA, 61 nt, Human; identical to SEQ ID NO: 23889

SEQ ID NO: 102795 - RNA, 61 nt, Human; identical to SEQ ID NO: 23890

SEQ ID NO: 102796 - RNA, 61 nt, Human; identical to SEQ ID NO: 23891

SEQ ID NO: 102797 - RNA, 61 nt, Human; identical to SEQ ID NO: 23892

SEQ ID NO: 102798 - RNA, 61 nt, Human; identical to SEQ ID NO: 23893

SEQ ID NO: 102799 - RNA, 61 nt, Human; identical to SEQ ID NO: 23894

SEQ ID NO: 102800 - RNA, 61 nt, Human; identical to SEQ ID NO: 23895

SEQ ID NO: 102801 - RNA, 61 nt, Human; identical to SEQ ID NO: 23896

SEQ ID NO: 102802 - RNA, 61 nt, Human; identical to SEQ ID NO: 23897

SEQ ID NO: 102803 - RNA, 61 nt, Human; identical to SEQ ID NO: 23898

SEQ ID NO: 102804 - RNA, 61 nt, Human; identical to SEQ ID NO: 23899

SEQ ID NO: 102805 - RNA, 61 nt, Human; identical to SEQ ID NO: 23900

SEQ ID NO: 102806 - RNA, 61 nt, Human; identical to SEQ ID NO: 23901

SEQ ID NO: 102807 - RNA, 64 nt, Human
uugcagcuaacauggguuagguuuaaaccaugggggaugcaaccccuuugcguuucauauguag

SEQ ID NO: 102808 - RNA, 61 nt, Human; identical to SEQ ID NO: 23902

SEQ ID NO: 102809 - RNA, 61 nt, Human; identical to SEQ ID NO: 23903

SEQ ID NO: 102810 - RNA, 61 nt, Human; identical to SEQ ID NO: 23904

SEQ ID NO: 102811 - RNA, 61 nt, Human; identical to SEQ ID NO: 23905

SEQ ID NO: 102812 - RNA, 61 nt, Human; identical to SEQ ID NO: 23906

SEQ ID NO: 102813 - RNA, 61 nt, Human; identical to SEQ ID NO: 23907

SEQ ID NO: 102814 - RNA, 61 nt, Human; identical to SEQ ID NO: 23908

SEQ ID NO: 102815 - RNA, 61 nt, Human; identical to SEQ ID NO: 23909

SEQ ID NO: 102816 - RNA, 61 nt, Human; identical to SEQ ID NO: 23910

SEQ ID NO: 102817 - RNA, 61 nt, Human; identical to SEQ ID NO: 23911

SEQ ID NO: 102818 - RNA, 61 nt, Human; identical to SEQ ID NO: 23912

SEQ ID NO: 102819 - RNA, 61 nt, Human; identical to SEQ ID NO: 23913

SEQ ID NO: 102820 - RNA, 61 nt, Human; identical to SEQ ID NO: 23914

SEQ ID NO: 102821 - RNA, 61 nt, Human; identical to SEQ ID NO: 23915

SEQ ID NO: 102822 - RNA, 61 nt, Human; identical to SEQ ID NO: 23916

SEQ ID NO: 102823 - RNA, 61 nt, Human; identical to SEQ ID NO: 23917

SEQ ID NO: 102824 - RNA, 61 nt, Human; identical to SEQ ID NO: 23918

SEQ ID NO: 102825 - RNA, 64 nt, Human
ugugccaggcgaggcccuuggcgggcacgggugucacggccaggcagaugaccucguacucagg

SEQ ID NO: 102826 - RNA, 61 nt, Human; identical to SEQ ID NO: 23919

SEQ ID NO: 102827 - RNA, 61 nt, Human; identical to SEQ ID NO: 23920

SEQ ID NO: 102828 - RNA, 61 nt, Human; identical to SEQ ID NO: 23921

SEQ ID NO: 102829 - RNA, 61 nt, Human; identical to SEQ ID NO: 23922

SEQ ID NO: 102830 - RNA, 61 nt, Human; identical to SEQ ID NO: 23923

SEQ ID NO: 102831 - RNA, 61 nt, Human; identical to SEQ ID NO: 23924

SEQ ID NO: 102832 - RNA, 61 nt, Human; identical to SEQ ID NO: 23925

SEQ ID NO: 102833 - RNA, 61 nt, Human; identical to SEQ ID NO: 23926

SEQ ID NO: 102834 - RNA, 61 nt, Human; identical to SEQ ID NO: 23927

SEQ ID NO: 102835 - RNA, 61 nt, Human; identical to SEQ ID NO: 23928

SEQ ID NO: 102836 - RNA, 61 nt, Human; identical to SEQ ID NO: 23929

SEQ ID NO: 102837 - RNA, 61 nt, Human; identical to SEQ ID NO: 23930

SEQ ID NO: 102838 - RNA, 61 nt, Human; identical to SEQ ID NO: 23931

SEQ ID NO: 102839 - RNA, 61 nt, Human; identical to SEQ ID NO: 23932

SEQ ID NO: 102840 - RNA, 61 nt, Human; identical to SEQ ID NO: 23933

SEQ ID NO: 102841 - RNA, 61 nt, Human; identical to SEQ ID NO: 23934

SEQ ID NO: 102842 - RNA, 61 nt, Human; identical to SEQ ID NO: 23935

SEQ ID NO: 102843 - RNA, 61 nt, Human; identical to SEQ ID NO: 23936

SEQ ID NO: 102844 - RNA, 61 nt, Human; identical to SEQ ID NO: 23937

SEQ ID NO: 102845 - RNA, 61 nt, Human; identical to SEQ ID NO: 23938

SEQ ID NO: 102846 - RNA, 61 nt, Human; identical to SEQ ID NO: 23939

SEQ ID NO: 102847 - RNA, 61 nt, Human; identical to SEQ ID NO: 23940

SEQ ID NO: 102848 - RNA, 61 nt, Human; identical to SEQ ID NO: 23941

SEQ ID NO: 102849 - RNA, 61 nt, Human; identical to SEQ ID NO: 23942

SEQ ID NO: 102850 - RNA, 61 nt, Human; identical to SEQ ID NO: 23943

SEQ ID NO: 102851 - RNA, 61 nt, Human; identical to SEQ ID NO: 23944

SEQ ID NO: 102852 - RNA, 61 nt, Human; identical to SEQ ID NO: 23945

SEQ ID NO: 102853 - RNA, 61 nt, Human; identical to SEQ ID NO: 23946

SEQ ID NO: 102854 - RNA, 61 nt, Human; identical to SEQ ID NO: 23947

SEQ ID NO: 102855 - RNA, 61 nt, Human; identical to SEQ ID NO: 23948

SEQ ID NO: 102856 - RNA, 61 nt, Human; identical to SEQ ID NO: 23949

SEQ ID NO: 102857 - RNA, 61 nt, Human; identical to SEQ ID NO: 23950

SEQ ID NO: 102858 - RNA, 61 nt, Human; identical to SEQ ID NO: 23951

SEQ ID NO: 102859 - RNA, 61 nt, Human; identical to SEQ ID NO: 23952

SEQ ID NO: 102860 - RNA, 64 nt, Human
cccaacaugccuccugcccugcuaaagacagugcggaugcaagagcaccuggccaagcgagagc

SEQ ID NO: 102861 - RNA, 61 nt, Human; identical to SEQ ID NO: 23953

SEQ ID NO: 102862 - RNA, 61 nt, Human; identical to SEQ ID NO: 23954

SEQ ID NO: 102863 - RNA, 61 nt, Human; identical to SEQ ID NO: 23955

SEQ ID NO: 102864 - RNA, 61 nt, Human; identical to SEQ ID NO: 23956

SEQ ID NO: 102865 - RNA, 61 nt, Human; identical to SEQ ID NO: 23957

SEQ ID NO: 102866 - RNA, 61 nt, Human; identical to SEQ ID NO: 23958

SEQ ID NO: 102867 - RNA, 61 nt, Human; identical to SEQ ID NO: 23959

SEQ ID NO: 102868 - RNA, 61 nt, Human; identical to SEQ ID NO: 23960

SEQ ID NO: 102869 - RNA, 61 nt, Human; identical to SEQ ID NO: 23961

SEQ ID NO: 102870 - RNA, 61 nt, Human; identical to SEQ ID NO: 23962

SEQ ID NO: 102871 - RNA, 60 nt, Human; identical to SEQ ID NO: 23963

SEQ ID NO: 102872 - RNA, 61 nt, Human; identical to SEQ ID NO: 23964

SEQ ID NO: 102873 - RNA, 61 nt, Human; identical to SEQ ID NO: 23965

SEQ ID NO: 102874 - RNA, 61 nt, Human; identical to SEQ ID NO: 23966

SEQ ID NO: 102875 - RNA, 61 nt, Human; identical to SEQ ID NO: 23967

SEQ ID NO: 102876 - RNA, 61 nt, Human; identical to SEQ ID NO: 23968

SEQ ID NO: 102877 - RNA, 61 nt, Human; identical to SEQ ID NO: 23969

SEQ ID NO: 102878 - RNA, 61 nt, Human; identical to SEQ ID NO: 23970

SEQ ID NO: 102879 - RNA, 61 nt, Human; identical to SEQ ID NO: 23971

SEQ ID NO: 102880 - RNA, 61 nt, Human; identical to SEQ ID NO: 23972

SEQ ID NO: 102881 - RNA, 61 nt, Human; identical to SEQ ID NO: 23973

SEQ ID NO: 102882 - RNA, 61 nt, Human; identical to SEQ ID NO: 23974

SEQ ID NO: 102883 - RNA, 61 nt, Human; identical to SEQ ID NO: 23975

SEQ ID NO: 102884 - RNA, 61 nt, Human; identical to SEQ ID NO: 23976

SEQ ID NO: 102885 - RNA, 61 nt, Human; identical to SEQ ID NO: 23977

SEQ ID NO: 102886 - RNA, 61 nt, Human; identical to SEQ ID NO: 23978

SEQ ID NO: 102887 - RNA, 61 nt, Human; identical to SEQ ID NO: 23979

SEQ ID NO: 102888 - RNA, 61 nt, Human; identical to SEQ ID NO: 23980

SEQ ID NO: 102889 - RNA, 61 nt, Human; identical to SEQ ID NO: 23981

SEQ ID NO: 102890 - RNA, 61 nt, Human; identical to SEQ ID NO: 23982

SEQ ID NO: 102891 - RNA, 61 nt, Human; identical to SEQ ID NO: 23983

SEQ ID NO: 102892 - RNA, 61 nt, Human; identical to SEQ ID NO: 23984

SEQ ID NO: 102893 - RNA, 61 nt, Human; identical to SEQ ID NO: 23985

SEQ ID NO: 102894 - RNA, 61 nt, Human; identical to SEQ ID NO: 23986

SEQ ID NO: 102895 - RNA, 55 nt, Human
uugcacagcucauguacugagcucucacggccacacagcugccggucgcccuuug

SEQ ID NO: 102896 - RNA, 61 nt, Human; identical to SEQ ID NO: 23987

SEQ ID NO: 102897 - RNA, 61 nt, Human; identical to SEQ ID NO: 23988

SEQ ID NO: 102898 - RNA, 61 nt, Human; identical to SEQ ID NO: 23989

SEQ ID NO: 102899 - RNA, 61 nt, Human; identical to SEQ ID NO: 23990

SEQ ID NO: 102900 - RNA, 61 nt, Human; identical to SEQ ID NO: 23991

SEQ ID NO: 102901 - RNA, 61 nt, Human; identical to SEQ ID NO: 23992

SEQ ID NO: 102902 - RNA, 61 nt, Human; identical to SEQ ID NO: 23993

SEQ ID NO: 102903 - RNA, 61 nt, Human; identical to SEQ ID NO: 23994

SEQ ID NO: 102904 - RNA, 61 nt, Human; identical to SEQ ID NO: 23995

SEQ ID NO: 102905 - RNA, 61 nt, Human; identical to SEQ ID NO: 23996

SEQ ID NO: 102906 - RNA, 61 nt, Human; identical to SEQ ID NO: 23997

SEQ ID NO: 102907 - RNA, 61 nt, Human; identical to SEQ ID NO: 23998

SEQ ID NO: 102908 - RNA, 61 nt, Human; identical to SEQ ID NO: 23999

SEQ ID NO: 102909 - RNA, 61 nt, Human; identical to SEQ ID NO: 24000

SEQ ID NO: 102910 - RNA, 61 nt, Human; identical to SEQ ID NO: 24001

SEQ ID NO: 102911 - RNA, 61 nt, Human; identical to SEQ ID NO: 24002

SEQ ID NO: 102912 - RNA, 61 nt, Human; identical to SEQ ID NO: 24003

SEQ ID NO: 102913 - RNA, 64 nt, Human
uggguggaugguccagagccuccacccacagaggggaugcaaagggcaggugagucaagaaccg

SEQ ID NO: 102914 - RNA, 61 nt, Human; identical to SEQ ID NO: 24004

SEQ ID NO: 102915 - RNA, 61 nt, Human; identical to SEQ ID NO: 24005

SEQ ID NO: 102916 - RNA, 61 nt, Human; identical to SEQ ID NO: 24006

SEQ ID NO: 102917 - RNA, 61 nt, Human; identical to SEQ ID NO: 24007

SEQ ID NO: 102918 - RNA, 61 nt, Human; identical to SEQ ID NO: 24008

SEQ ID NO: 102919 - RNA, 61 nt, Human; identical to SEQ ID NO: 24009

SEQ ID NO: 102920 - RNA, 61 nt, Human; identical to SEQ ID NO: 24010

SEQ ID NO: 102921 - RNA, 61 nt, Human; identical to SEQ ID NO: 24011

SEQ ID NO: 102922 - RNA, 61 nt, Human; identical to SEQ ID NO: 24012

SEQ ID NO: 102923 - RNA, 61 nt, Human; identical to SEQ ID NO: 24013

SEQ ID NO: 102924 - RNA, 61 nt, Human; identical to SEQ ID NO: 24014

SEQ ID NO: 102925 - RNA, 61 nt, Human; identical to SEQ ID NO: 24015

SEQ ID NO: 102926 - RNA, 61 nt, Human; identical to SEQ ID NO: 24016

SEQ ID NO: 102927 - RNA, 61 nt, Human; identical to SEQ ID NO: 24017

SEQ ID NO: 102928 - RNA, 61 nt, Human; identical to SEQ ID NO: 24018

SEQ ID NO: 102929 - RNA, 61 nt, Human; identical to SEQ ID NO: 24019

SEQ ID NO: 102930 - RNA, 61 nt, Human; identical to SEQ ID NO: 24020

SEQ ID NO: 102931 - RNA, 64 nt, Human
caguggacaccccauuuccuucaccagguccccccacggccauagcccuugcagccaaacuuug

SEQ ID NO: 102932 - RNA, 61 nt, Human; identical to SEQ ID NO: 24021

SEQ ID NO: 102933 - RNA, 61 nt, Human; identical to SEQ ID NO: 24022

SEQ ID NO: 102934 - RNA, 61 nt, Human; identical to SEQ ID NO: 24023

SEQ ID NO: 102935 - RNA, 61 nt, Human; identical to SEQ ID NO: 24024

SEQ ID NO: 102936 - RNA, 61 nt, Human; identical to SEQ ID NO: 24025

SEQ ID NO: 102937 - RNA, 61 nt, Human; identical to SEQ ID NO: 24026

SEQ ID NO: 102938 - RNA, 61 nt, Human; identical to SEQ ID NO: 24027

SEQ ID NO: 102939 - RNA, 61 nt, Human; identical to SEQ ID NO: 24028

SEQ ID NO: 102940 - RNA, 61 nt, Human; identical to SEQ ID NO: 24029

SEQ ID NO: 102941 - RNA, 61 nt, Human; identical to SEQ ID NO: 24030

SEQ ID NO: 102942 - RNA, 61 nt, Human; identical to SEQ ID NO: 24031

SEQ ID NO: 102943 - RNA, 61 nt, Human; identical to SEQ ID NO: 24032

SEQ ID NO: 102944 - RNA, 61 nt, Human; identical to SEQ ID NO: 24033

SEQ ID NO: 102945 - RNA, 61 nt, Human; identical to SEQ ID NO: 24034

SEQ ID NO: 102946 - RNA, 51 nt, Human; identical to SEQ ID NO: 24035

SEQ ID NO: 102947 - RNA, 61 nt, Human; identical to SEQ ID NO: 24036

SEQ ID NO: 102948 - RNA, 61 nt, Human; identical to SEQ ID NO: 24037

SEQ ID NO: 102949 - RNA, 64 nt, Human
uauggagaugaaugaucaaagugaaacaauguuuggaugcaacgcagaauaaaagaauauaaga

SEQ ID NO: 102950 - RNA, 61 nt, Human; identical to SEQ ID NO: 24038

SEQ ID NO: 102951 - RNA, 61 nt, Human; identical to SEQ ID NO: 24039

SEQ ID NO: 102952 - RNA, 61 nt, Human; identical to SEQ ID NO: 24040

SEQ ID NO: 102953 - RNA, 61 nt, Human; identical to SEQ ID NO: 24041

SEQ ID NO: 102954 - RNA, 61 nt, Human; identical to SEQ ID NO: 24042

SEQ ID NO: 102955 - RNA, 61 nt, Human; identical to SEQ ID NO: 24043

SEQ ID NO: 102956 - RNA, 61 nt, Human; identical to SEQ ID NO: 24044

SEQ ID NO: 102957 - RNA, 61 nt, Human; identical to SEQ ID NO: 24045

SEQ ID NO: 102958 - RNA, 61 nt, Human; identical to SEQ ID NO: 24046

SEQ ID NO: 102959 - RNA, 61 nt, Human; identical to SEQ ID NO: 24047

SEQ ID NO: 102960 - RNA, 61 nt, Human; identical to SEQ ID NO: 24048

SEQ ID NO: 102961 - RNA, 61 nt, Human; identical to SEQ ID NO: 24049

SEQ ID NO: 102962 - RNA, 61 nt, Human; identical to SEQ ID NO: 24050

SEQ ID NO: 102963 - RNA, 61 nt, Human; identical to SEQ ID NO: 24051

SEQ ID NO: 102964 - RNA, 61 nt, Human; identical to SEQ ID NO: 24052

SEQ ID NO: 102965 - RNA, 61 nt, Human; identical to SEQ ID NO: 24053

SEQ ID NO: 102966 - RNA, 61 nt, Human; identical to SEQ ID NO: 24054

SEQ ID NO: 102967 - RNA, 64 nt, Human
cuccucccgucccucuccaggggccccgcauacacacggccaugcacgcacacacugggccugg

SEQ ID NO: 102968 - RNA, 61 nt, Human; identical to SEQ ID NO: 24055

SEQ ID NO: 102969 - RNA, 61 nt, Human; identical to SEQ ID NO: 24056

SEQ ID NO: 102970 - RNA, 61 nt, Human; identical to SEQ ID NO: 24057

SEQ ID NO: 102971 - RNA, 61 nt, Human; identical to SEQ ID NO: 24058

SEQ ID NO: 102972 - RNA, 61 nt, Human; identical to SEQ ID NO: 24059

SEQ ID NO: 102973 - RNA, 61 nt, Human; identical to SEQ ID NO: 24060

SEQ ID NO: 102974 - RNA, 61 nt, Human; identical to SEQ ID NO: 24061

SEQ ID NO: 102975 - RNA, 61 nt, Human; identical to SEQ ID NO: 24062

SEQ ID NO: 102976 - RNA, 61 nt, Human; identical to SEQ ID NO: 24063

SEQ ID NO: 102977 - RNA, 61 nt, Human; identical to SEQ ID NO: 24064

SEQ ID NO: 102978 - RNA, 61 nt, Human; identical to SEQ ID NO: 24065

SEQ ID NO: 102979 - RNA, 61 nt, Human; identical to SEQ ID NO: 24066

SEQ ID NO: 102980 - RNA, 61 nt, Human; identical to SEQ ID NO: 24067

SEQ ID NO: 102981 - RNA, 61 nt, Human; identical to SEQ ID NO: 24068

SEQ ID NO: 102982 - RNA, 61 nt, Human; identical to SEQ ID NO: 24069

SEQ ID NO: 102983 - RNA, 61 nt, Human; identical to SEQ ID NO: 24070

SEQ ID NO: 102984 - RNA, 61 nt, Human; identical to SEQ ID NO: 24071

SEQ ID NO: 102985 - RNA, 57 nt, Human; identical to SEQ ID NO: 24072

SEQ ID NO: 102986 - RNA, 61 nt, Human; identical to SEQ ID NO: 24073

SEQ ID NO: 102987 - RNA, 61 nt, Human; identical to SEQ ID NO: 24074

SEQ ID NO: 102988 - RNA, 61 nt, Human; identical to SEQ ID NO: 24075

SEQ ID NO: 102989 - RNA, 61 nt, Human; identical to SEQ ID NO: 24076

SEQ ID NO: 102990 - RNA, 61 nt, Human; identical to SEQ ID NO: 24077

SEQ ID NO: 102991 - RNA, 61 nt, Human; identical to SEQ ID NO: 24078

SEQ ID NO: 102992 - RNA, 61 nt, Human; identical to SEQ ID NO: 24079

SEQ ID NO: 102993 - RNA, 61 nt, Human; identical to SEQ ID NO: 24080

SEQ ID NO: 102994 - RNA, 61 nt, Human; identical to SEQ ID NO: 24081

SEQ ID NO: 102995 - RNA, 61 nt, Human; identical to SEQ ID NO: 24082

SEQ ID NO: 102996 - RNA, 61 nt, Human; identical to SEQ ID NO: 24083

SEQ ID NO: 102997 - RNA, 61 nt, Human; identical to SEQ ID NO: 24084

SEQ ID NO: 102998 - RNA, 61 nt, Human; identical to SEQ ID NO: 24085

SEQ ID NO: 102999 - RNA, 61 nt, Human; identical to SEQ ID NO: 24086

SEQ ID NO: 103000 - RNA, 61 nt, Human; identical to SEQ ID NO: 24087

SEQ ID NO: 103001 - RNA, 61 nt, Human; identical to SEQ ID NO: 24088

SEQ ID NO: 103002 - RNA, 64 nt, Human
aaggaacguggaaggucaugaaugggccgcaaaccacggccagcugcuugucuuuguauggcuu

SEQ ID NO: 103003 - RNA, 61 nt, Human; identical to SEQ ID NO: 24089

SEQ ID NO: 103004 - RNA, 61 nt, Human; identical to SEQ ID NO: 24090

SEQ ID NO: 103005 - RNA, 61 nt, Human; identical to SEQ ID NO: 24091

SEQ ID NO: 103006 - RNA, 61 nt, Human; identical to SEQ ID NO: 24092

SEQ ID NO: 103007 - RNA, 61 nt, Human; identical to SEQ ID NO: 24093

SEQ ID NO: 103008 - RNA, 61 nt, Human; identical to SEQ ID NO: 24094

SEQ ID NO: 103009 - RNA, 61 nt, Human; identical to SEQ ID NO: 24095

SEQ ID NO: 103010 - RNA, 61 nt, Human; identical to SEQ ID NO: 24096

SEQ ID NO: 103011 - RNA, 61 nt, Human; identical to SEQ ID NO: 24097

SEQ ID NO: 103012 - RNA, 61 nt, Human; identical to SEQ ID NO: 24098

SEQ ID NO: 103013 - RNA, 61 nt, Human; identical to SEQ ID NO: 24099

SEQ ID NO: 103014 - RNA, 61 nt, Human; identical to SEQ ID NO: 24100

SEQ ID NO: 103015 - RNA, 61 nt, Human; identical to SEQ ID NO: 24101

SEQ ID NO: 103016 - RNA, 61 nt, Human; identical to SEQ ID NO: 24102

SEQ ID NO: 103017 - RNA, 61 nt, Human; identical to SEQ ID NO: 24103

SEQ ID NO: 103018 - RNA, 61 nt, Human; identical to SEQ ID NO: 24104

SEQ ID NO: 103019 - RNA, 61 nt, Human; identical to SEQ ID NO: 24105

SEQ ID NO: 103020 - RNA, 60 nt, Human
ccuggcaccccuggcugugacuguggccgccacggccacccggaaugugaagggcgcucc

SEQ ID NO: 103021 - RNA, 61 nt, Human; identical to SEQ ID NO: 24106

SEQ ID NO: 103022 - RNA, 61 nt, Human; identical to SEQ ID NO: 24107

SEQ ID NO: 103023 - RNA, 61 nt, Human; identical to SEQ ID NO: 24108

SEQ ID NO: 103024 - RNA, 61 nt, Human; identical to SEQ ID NO: 24109

SEQ ID NO: 103025 - RNA, 61 nt, Human; identical to SEQ ID NO: 24110

SEQ ID NO: 103026 - RNA, 61 nt, Human; identical to SEQ ID NO: 24111

SEQ ID NO: 103027 - RNA, 61 nt, Human; identical to SEQ ID NO: 24112

SEQ ID NO: 103028 - RNA, 61 nt, Human; identical to SEQ ID NO: 24113

SEQ ID NO: 103029 - RNA, 61 nt, Human; identical to SEQ ID NO: 24114

SEQ ID NO: 103030 - RNA, 61 nt, Human; identical to SEQ ID NO: 24115

SEQ ID NO: 103031 - RNA, 61 nt, Human; identical to SEQ ID NO: 24116

SEQ ID NO: 103032 - RNA, 61 nt, Human; identical to SEQ ID NO: 24117

SEQ ID NO: 103033 - RNA, 61 nt, Human; identical to SEQ ID NO: 24118

SEQ ID NO: 103034 - RNA, 61 nt, Human; identical to SEQ ID NO: 24119

SEQ ID NO: 103035 - RNA, 61 nt, Human; identical to SEQ ID NO: 24120

SEQ ID NO: 103036 - RNA, 61 nt, Human; identical to SEQ ID NO: 24121

SEQ ID NO: 103037 - RNA, 61 nt, Human; identical to SEQ ID NO: 24122

SEQ ID NO: 103038 - RNA, 64 nt, Human
ucauagcuguuccucauggccaugacuggaacagggaugcaaccucuuucuacacaagcacagu

SEQ ID NO: 103039 - RNA, 61 nt, Human; identical to SEQ ID NO: 24123

SEQ ID NO: 103040 - RNA, 61 nt, Human; identical to SEQ ID NO: 24124

SEQ ID NO: 103041 - RNA, 61 nt, Human; identical to SEQ ID NO: 24125

SEQ ID NO: 103042 - RNA, 61 nt, Human; identical to SEQ ID NO: 24126

SEQ ID NO: 103043 - RNA, 61 nt, Human; identical to SEQ ID NO: 24127

SEQ ID NO: 103044 - RNA, 61 nt, Human; identical to SEQ ID NO: 24128

SEQ ID NO: 103045 - RNA, 61 nt, Human; identical to SEQ ID NO: 24129

SEQ ID NO: 103046 - RNA, 61 nt, Human; identical to SEQ ID NO: 24130

SEQ ID NO: 103047 - RNA, 61 nt, Human; identical to SEQ ID NO: 24131

SEQ ID NO: 103048 - RNA, 61 nt, Human; identical to SEQ ID NO: 24132

SEQ ID NO: 103049 - RNA, 61 nt, Human; identical to SEQ ID NO: 24133

SEQ ID NO: 103050 - RNA, 61 nt, Human; identical to SEQ ID NO: 24134

SEQ ID NO: 103051 - RNA, 61 nt, Human; identical to SEQ ID NO: 24135

SEQ ID NO: 103052 - RNA, 61 nt, Human; identical to SEQ ID NO: 24136

SEQ ID NO: 103053 - RNA, 61 nt, Human; identical to SEQ ID NO: 24137

SEQ ID NO: 103054 - RNA, 61 nt, Human; identical to SEQ ID NO: 24138

SEQ ID NO: 103055 - RNA, 61 nt, Human; identical to SEQ ID NO: 24139

SEQ ID NO: 103056 - RNA, 61 nt, Human; identical to SEQ ID NO: 24140

SEQ ID NO: 103057 - RNA, 61 nt, Human; identical to SEQ ID NO: 24141

SEQ ID NO: 103058 - RNA, 61 nt, Human; identical to SEQ ID NO: 24142

SEQ ID NO: 103059 - RNA, 61 nt, Human; identical to SEQ ID NO: 24143

SEQ ID NO: 103060 - RNA, 61 nt, Human; identical to SEQ ID NO: 24143

SEQ ID NO: 103061 - RNA, 61 nt, Human; identical to SEQ ID NO: 24145

SEQ ID NO: 103062 - RNA, 61 nt, Human; identical to SEQ ID NO: 24146

SEQ ID NO: 103063 - RNA, 61 nt, Human; identical to SEQ ID NO: 24147

SEQ ID NO: 103064 - RNA, 61 nt, Human; identical to SEQ ID NO: 24148

SEQ ID NO: 103065 - RNA, 61 nt, Human; identical to SEQ ID NO: 24149

SEQ ID NO: 103066 - RNA, 61 nt, Human; identical to SEQ ID NO: 24150

SEQ ID NO: 103067 - RNA, 61 nt, Human; identical to SEQ ID NO: 24151

SEQ ID NO: 103068 - RNA, 61 nt, Human; identical to SEQ ID NO: 24152

SEQ ID NO: 103069 - RNA, 61 nt, Human; identical to SEQ ID NO: 24153

SEQ ID NO: 103070 - RNA, 61 nt, Human; identical to SEQ ID NO: 24154

SEQ ID NO: 103071 - RNA, 61 nt, Human; identical to SEQ ID NO: 24155

SEQ ID NO: 103072 - RNA, 61 nt, Human; identical to SEQ ID NO: 24156

SEQ ID NO: 103073 - RNA, 64 nt, Human
gagguccaggcucgcucagccccacagcccugugcacggccauuaaagcuucccacagacacug

SEQ ID NO: 103074 - RNA, 61 nt, Human; identical to SEQ ID NO: 24157

SEQ ID NO: 103075 - RNA, 61 nt, Human; identical to SEQ ID NO: 24158

SEQ ID NO: 103076 - RNA, 61 nt, Human; identical to SEQ ID NO: 24159

SEQ ID NO: 103077 - RNA, 61 nt, Human; identical to SEQ ID NO: 24160

SEQ ID NO: 103078 - RNA, 61 nt, Human; identical to SEQ ID NO: 24161

SEQ ID NO: 103079 - RNA, 61 nt, Human; identical to SEQ ID NO: 24162

SEQ ID NO: 103080 - RNA, 61 nt, Human; identical to SEQ ID NO: 24163

SEQ ID NO: 103081 - RNA, 61 nt, Human; identical to SEQ ID NO: 24164

SEQ ID NO: 103082 - RNA, 61 nt, Human; identical to SEQ ID NO: 24165

SEQ ID NO: 103083 - RNA, 61 nt, Human; identical to SEQ ID NO: 24166

SEQ ID NO: 103084 - RNA, 61 nt, Human; identical to SEQ ID NO: 24167

SEQ ID NO: 103085 - RNA, 61 nt, Human; identical to SEQ ID NO: 24168

SEQ ID NO: 103086 - RNA, 61 nt, Human; identical to SEQ ID NO: 24169

SEQ ID NO: 103087 - RNA, 61 nt, Human; identical to SEQ ID NO: 24170

SEQ ID NO: 103088 - RNA, 61 nt, Human; identical to SEQ ID NO: 24171

SEQ ID NO: 103089 - RNA, 61 nt, Human; identical to SEQ ID NO: 24172

SEQ ID NO: 103090 - RNA, 61 nt, Human; identical to SEQ ID NO: 24173

SEQ ID NO: 103091 - RNA, 61 nt, Human; identical to SEQ ID NO: 24174

SEQ ID NO: 103092 - RNA, 61 nt, Human; identical to SEQ ID NO: 24175

SEQ ID NO: 103093 - RNA, 61 nt, Human; identical to SEQ ID NO: 24176

SEQ ID NO: 103094 - RNA, 61 nt, Human; identical to SEQ ID NO: 24177

SEQ ID NO: 103095 - RNA, 61 nt, Human; identical to SEQ ID NO: 24178

SEQ ID NO: 103096 - RNA, 60 nt, Human; identical to SEQ ID NO: 24179

SEQ ID NO: 103097 - RNA, 61 nt, Human; identical to SEQ ID NO: 24180

SEQ ID NO: 103098 - RNA, 61 nt, Human; identical to SEQ ID NO: 24181

SEQ ID NO: 103099 - RNA, 61 nt, Human; identical to SEQ ID NO: 24182

SEQ ID NO: 103100 - RNA, 61 nt, Human; identical to SEQ ID NO: 24183

SEQ ID NO: 103101 - RNA, 61 nt, Human; identical to SEQ ID NO: 24184

SEQ ID NO: 103102 - RNA, 61 nt, Human; identical to SEQ ID NO: 24185

SEQ ID NO: 103103 - RNA, 61 nt, Human; identical to SEQ ID NO: 24186

SEQ ID NO: 103104 - RNA, 61 nt, Human; identical to SEQ ID NO: 24187

SEQ ID NO: 103105 - RNA, 61 nt, Human; identical to SEQ ID NO: 24188

SEQ ID NO: 103106 - RNA, 61 nt, Human; identical to SEQ ID NO: 24189

SEQ ID NO: 103107 - RNA, 61 nt, Human; identical to SEQ ID NO: 24190

SEQ ID NO: 103108 - RNA, 64 nt, Human
cugcccugacaugcacaccucccccugcccccaccacggccacuggccaucuccacccccagcu

SEQ ID NO: 103109 - RNA, 61 nt, Human; identical to SEQ ID NO: 24191

SEQ ID NO: 103110 - RNA, 61 nt, Human; identical to SEQ ID NO: 24192

SEQ ID NO: 103111 - RNA, 61 nt, Human; identical to SEQ ID NO: 24193

SEQ ID NO: 103112 - RNA, 61 nt, Human; identical to SEQ ID NO: 24194

SEQ ID NO: 103113 - RNA, 61 nt, Human; identical to SEQ ID NO: 24195

SEQ ID NO: 103114 - RNA, 61 nt, Human; identical to SEQ ID NO: 24196

SEQ ID NO: 103115 - RNA, 61 nt, Human; identical to SEQ ID NO: 24197

SEQ ID NO: 103116 - RNA, 61 nt, Human; identical to SEQ ID NO: 24198

SEQ ID NO: 103117 - RNA, 61 nt, Human; identical to SEQ ID NO: 24199

SEQ ID NO: 103118 - RNA, 61 nt, Human; identical to SEQ ID NO: 24200

SEQ ID NO: 103119 - RNA, 61 nt, Human; identical to SEQ ID NO: 24201

SEQ ID NO: 103120 - RNA, 61 nt, Human; identical to SEQ ID NO: 24202

SEQ ID NO: 103121 - RNA, 61 nt, Human; identical to SEQ ID NO: 24203

SEQ ID NO: 103122 - RNA, 61 nt, Human; identical to SEQ ID NO: 24204

SEQ ID NO: 103123 - RNA, 61 nt, Human; identical to SEQ ID NO: 24205

SEQ ID NO: 103124 - RNA, 61 nt, Human; identical to SEQ ID NO: 24206

SEQ ID NO: 103125 - RNA, 61 nt, Human; identical to SEQ ID NO: 24207

SEQ ID NO: 103126 - RNA, 64 nt, Human
uguacuuucagcucuaggcaugcagacaaccccacacggccacaccaccacaugcccaagugua

SEQ ID NO: 103127 - RNA, 61 nt, Human; identical to SEQ ID NO: 24208

SEQ ID NO: 103128 - RNA, 61 nt, Human; identical to SEQ ID NO: 24209

SEQ ID NO: 103129 - RNA, 61 nt, Human; identical to SEQ ID NO: 24210

SEQ ID NO: 103130 - RNA, 61 nt, Human; identical to SEQ ID NO: 24211

SEQ ID NO: 103131 - RNA, 61 nt, Human; identical to SEQ ID NO: 24212

SEQ ID NO: 103132 - RNA, 61 nt, Human; identical to SEQ ID NO: 24213

SEQ ID NO: 103133 - RNA, 61 nt, Human; identical to SEQ ID NO: 24214

SEQ ID NO: 103134 - RNA, 61 nt, Human; identical to SEQ ID NO: 24215

SEQ ID NO: 103135 - RNA, 61 nt, Human; identical to SEQ ID NO: 24216

SEQ ID NO: 103136 - RNA, 61 nt, Human; identical to SEQ ID NO: 24217

SEQ ID NO: 103137 - RNA, 61 nt, Human; identical to SEQ ID NO: 24218

SEQ ID NO: 103138 - RNA, 61 nt, Human; identical to SEQ ID NO: 24219

SEQ ID NO: 103139 - RNA, 61 nt, Human; identical to SEQ ID NO: 24220

SEQ ID NO: 103140 - RNA, 61 nt, Human; identical to SEQ ID NO: 24221

SEQ ID NO: 103141 - RNA, 61 nt, Human; identical to SEQ ID NO: 24222

SEQ ID NO: 103142 - RNA, 61 nt, Human; identical to SEQ ID NO: 24223

SEQ ID NO: 103143 - RNA, 61 nt, Human; identical to SEQ ID NO: 24224

SEQ ID NO: 103144 - RNA, 64 nt, Human
cuuggaucauuuuuauguagcaugauuuuccuugggaugcaaaucuuaaaacaguccuuuaaua

SEQ ID NO: 103145 - RNA, 61 nt, Human; identical to SEQ ID NO: 24225

SEQ ID NO: 103146 - RNA, 61 nt, Human; identical to SEQ ID NO: 24226

SEQ ID NO: 103147 - RNA, 61 nt, Human; identical to SEQ ID NO: 24227

SEQ ID NO: 103148 - RNA, 61 nt, Human; identical to SEQ ID NO: 24228

SEQ ID NO: 103149 - RNA, 61 nt, Human; identical to SEQ ID NO: 24229

SEQ ID NO: 103150 - RNA, 61 nt, Human; identical to SEQ ID NO: 24230

SEQ ID NO: 103151 - RNA, 61 nt, Human; identical to SEQ ID NO: 24231

SEQ ID NO: 103152 - RNA, 61 nt, Human; identical to SEQ ID NO: 24232

SEQ ID NO: 103153 - RNA, 61 nt, Human; identical to SEQ ID NO: 24233

SEQ ID NO: 103154 - RNA, 61 nt, Human; identical to SEQ ID NO: 24234

SEQ ID NO: 103155 - RNA, 61 nt, Human; identical to SEQ ID NO: 24235

SEQ ID NO: 103156 - RNA, 61 nt, Human; identical to SEQ ID NO: 24236

SEQ ID NO: 103157 - RNA, 61 nt, Human; identical to SEQ ID NO: 24237

SEQ ID NO: 103158 - RNA, 61 nt, Human; identical to SEQ ID NO: 24238

SEQ ID NO: 103159 - RNA, 61 nt, Human; identical to SEQ ID NO: 24239

SEQ ID NO: 103160 - RNA, 61 nt, Human; identical to SEQ ID NO: 24240

SEQ ID NO: 103161 - RNA, 61 nt, Human; identical to SEQ ID NO: 24241

SEQ ID NO: 103162 - RNA, 61 nt, Human; identical to SEQ ID NO: 24242

SEQ ID NO: 103163 - RNA, 61 nt, Human; identical to SEQ ID NO: 24243

SEQ ID NO: 103164 - RNA, 61 nt, Human; identical to SEQ ID NO: 24244

SEQ ID NO: 103165 - RNA, 61 nt, Human; identical to SEQ ID NO: 24245

SEQ ID NO: 103166 - RNA, 61 nt, Human; identical to SEQ ID NO: 24246

SEQ ID NO: 103167 - RNA, 61 nt, Human; identical to SEQ ID NO: 24247

SEQ ID NO: 103168 - RNA, 61 nt, Human; identical to SEQ ID NO: 24248

SEQ ID NO: 103169 - RNA, 61 nt, Human; identical to SEQ ID NO: 24249

SEQ ID NO: 103170 - RNA, 61 nt, Human; identical to SEQ ID NO: 24250

SEQ ID NO: 103171 - RNA, 61 nt, Human; identical to SEQ ID NO: 24251

SEQ ID NO: 103172 - RNA, 61 nt, Human; identical to SEQ ID NO: 24252

SEQ ID NO: 103173 - RNA, 61 nt, Human; identical to SEQ ID NO: 24253

SEQ ID NO: 103174 - RNA, 61 nt, Human; identical to SEQ ID NO: 24254

SEQ ID NO: 103175 - RNA, 61 nt, Human; identical to SEQ ID NO: 24255

SEQ ID NO: 103176 - RNA, 61 nt, Human; identical to SEQ ID NO: 24256

SEQ ID NO: 103177 - RNA, 61 nt, Human; identical to SEQ ID NO: 24257

SEQ ID NO: 103178 - RNA, 61 nt, Human; identical to SEQ ID NO: 24258

SEQ ID NO: 103179 - RNA, 61 nt, Human; identical to SEQ ID NO: 24259

SEQ ID NO: 103180 - RNA, 61 nt, Human; identical to SEQ ID NO: 24260

SEQ ID NO: 103181 - RNA, 61 nt, Human; identical to SEQ ID NO: 24261

SEQ ID NO: 103182 - RNA, 61 nt, Human; identical to SEQ ID NO: 24262

SEQ ID NO: 103183 - RNA, 61 nt, Human; identical to SEQ ID NO: 24263

SEQ ID NO: 103184 - RNA, 61 nt, Human; identical to SEQ ID NO: 24264

SEQ ID NO: 103185 - RNA, 61 nt, Human; identical to SEQ ID NO: 24265

SEQ ID NO: 103186 - RNA, 61 nt, Human; identical to SEQ ID NO: 24266

SEQ ID NO: 103187 - RNA, 61 nt, Human; identical to SEQ ID NO: 24267

SEQ ID NO: 103188 - RNA, 61 nt, Human; identical to SEQ ID NO: 24268

SEQ ID NO: 103189 - RNA, 61 nt, Human; identical to SEQ ID NO: 24269

SEQ ID NO: 103190 - RNA, 61 nt, Human; identical to SEQ ID NO: 24270

SEQ ID NO: 103191 - RNA, 61 nt, Human; identical to SEQ ID NO: 24271

SEQ ID NO: 103192 - RNA, 61 nt, Human; identical to SEQ ID NO: 24272

SEQ ID NO: 103193 - RNA, 61 nt, Human; identical to SEQ ID NO: 24273

SEQ ID NO: 103194 - RNA, 61 nt, Human; identical to SEQ ID NO: 24274

SEQ ID NO: 103195 - RNA, 61 nt, Human; identical to SEQ ID NO: 24275

SEQ ID NO: 103196 - RNA, 64 nt, Human
cuugacuguaagccagauagcuugacucaugagggaccuucagccagaggcaucuuuugagcca

SEQ ID NO: 103197 - RNA, 61 nt, Human; identical to SEQ ID NO: 24276

SEQ ID NO: 103198 - RNA, 61 nt, Human; identical to SEQ ID NO: 24277

SEQ ID NO: 103199 - RNA, 61 nt, Human; identical to SEQ ID NO: 24278

SEQ ID NO: 103200 - RNA, 61 nt, Human; identical to SEQ ID NO: 24279

SEQ ID NO: 103201 - RNA, 61 nt, Human; identical to SEQ ID NO: 24280

SEQ ID NO: 103202 - RNA, 61 nt, Human; identical to SEQ ID NO: 24281

SEQ ID NO: 103203 - RNA, 61 nt, Human; identical to SEQ ID NO: 24282

SEQ ID NO: 103204 - RNA, 61 nt, Human; identical to SEQ ID NO: 24283

SEQ ID NO: 103205 - RNA, 61 nt, Human; identical to SEQ ID NO: 24284

SEQ ID NO: 103206 - RNA, 61 nt, Human; identical to SEQ ID NO: 24285

SEQ ID NO: 103207 - RNA, 61 nt, Human; identical to SEQ ID NO: 24286

SEQ ID NO: 103208 - RNA, 61 nt, Human; identical to SEQ ID NO: 24287

SEQ ID NO: 103209 - RNA, 61 nt, Human; identical to SEQ ID NO: 24288

SEQ ID NO: 103210 - RNA, 61 nt, Human; identical to SEQ ID NO: 24289

SEQ ID NO: 103211 - RNA, 61 nt, Human; identical to SEQ ID NO: 24290

SEQ ID NO: 103212 - RNA, 61 nt, Human; identical to SEQ ID NO: 24291

SEQ ID NO: 103213 - RNA, 61 nt, Human; identical to SEQ ID NO: 24292

SEQ ID NO: 103214 - RNA, 61 nt, Human; identical to SEQ ID NO: 24293

SEQ ID NO: 103215 - RNA, 61 nt, Human; identical to SEQ ID NO: 24294

SEQ ID NO: 103216 - RNA, 61 nt, Human; identical to SEQ ID NO: 24295

SEQ ID NO: 103217 - RNA, 61 nt, Human; identical to SEQ ID NO: 24296

SEQ ID NO: 103218 - RNA, 61 nt, Human; identical to SEQ ID NO: 24297

SEQ ID NO: 103219 - RNA, 61 nt, Human; identical to SEQ ID NO: 24298

SEQ ID NO: 103220 - RNA, 61 nt, Human; identical to SEQ ID NO: 24299

SEQ ID NO: 103221 - RNA, 61 nt, Human; identical to SEQ ID NO: 24300

SEQ ID NO: 103222 - RNA, 61 nt, Human; identical to SEQ ID NO: 24301

SEQ ID NO: 103223 - RNA, 61 nt, Human; identical to SEQ ID NO: 24302

SEQ ID NO: 103224 - RNA, 61 nt, Human; identical to SEQ ID NO: 24303

SEQ ID NO: 103225 - RNA, 61 nt, Human; identical to SEQ ID NO: 24304

SEQ ID NO: 103226 - RNA, 61 nt, Human; identical to SEQ ID NO: 24305

SEQ ID NO: 103227 - RNA, 61 nt, Human; identical to SEQ ID NO: 24306

SEQ ID NO: 103228 - RNA, 61 nt, Human; identical to SEQ ID NO: 24307

SEQ ID NO: 103229 - RNA, 61 nt, Human; identical to SEQ ID NO: 24308

SEQ ID NO: 103230 - RNA, 61 nt, Human; identical to SEQ ID NO: 24309

SEQ ID NO: 103231 - RNA, 64 nt, Human
uggaagggcuccaggacccgucccaauaaccacccacggccaggagggccaaggccccgugcug

SEQ ID NO: 103232 - RNA, 61 nt, Human; identical to SEQ ID NO: 24310

SEQ ID NO: 103233 - RNA, 61 nt, Human; identical to SEQ ID NO: 24311

SEQ ID NO: 103234 - RNA, 61 nt, Human; identical to SEQ ID NO: 24312

SEQ ID NO: 103235 - RNA, 61 nt, Human; identical to SEQ ID NO: 24313

SEQ ID NO: 103236 - RNA, 61 nt, Human; identical to SEQ ID NO: 24314

SEQ ID NO: 103237 - RNA, 61 nt, Human; identical to SEQ ID NO: 24315

SEQ ID NO: 103238 - RNA, 61 nt, Human; identical to SEQ ID NO: 24316

SEQ ID NO: 103239 - RNA, 61 nt, Human; identical to SEQ ID NO: 24317

SEQ ID NO: 103240 - RNA, 61 nt, Human; identical to SEQ ID NO: 24318

SEQ ID NO: 103241 - RNA, 61 nt, Human; identical to SEQ ID NO: 24319

SEQ ID NO: 103242 - RNA, 61 nt, Human; identical to SEQ ID NO: 24320

SEQ ID NO: 103243 - RNA, 61 nt, Human; identical to SEQ ID NO: 24321

SEQ ID NO: 103244 - RNA, 61 nt, Human; identical to SEQ ID NO: 24322

SEQ ID NO: 103245 - RNA, 61 nt, Human; identical to SEQ ID NO: 24323

SEQ ID NO: 103246 - RNA, 61 nt, Human; identical to SEQ ID NO: 24324

SEQ ID NO: 103247 - RNA, 61 nt, Human; identical to SEQ ID NO: 24325

SEQ ID NO: 103248 - RNA, 61 nt, Human; identical to SEQ ID NO: 24326

SEQ ID NO: 103249 - RNA, 64 nt, Human
agggggcaggccaaugaggucugcauggccaggggaccuucaaggugcguaaagucccuugggg

SEQ ID NO: 103250 - RNA, 61 nt, Human; identical to SEQ ID NO: 24327

SEQ ID NO: 103251 - RNA, 61 nt, Human; identical to SEQ ID NO: 24328

SEQ ID NO: 103252 - RNA, 61 nt, Human; identical to SEQ ID NO: 24329

SEQ ID NO: 103253 - RNA, 61 nt, Human; identical to SEQ ID NO: 24330

SEQ ID NO: 103254 - RNA, 61 nt, Human; identical to SEQ ID NO: 24331

SEQ ID NO: 103255 - RNA, 61 nt, Human; identical to SEQ ID NO: 24332

SEQ ID NO: 103256 - RNA, 61 nt, Human; identical to SEQ ID NO: 24333

SEQ ID NO: 103257 - RNA, 61 nt, Human; identical to SEQ ID NO: 24334

SEQ ID NO: 103258 - RNA, 61 nt, Human; identical to SEQ ID NO: 24335

SEQ ID NO: 103259 - RNA, 61 nt, Human; identical to SEQ ID NO: 24336

SEQ ID NO: 103260 - RNA, 61 nt, Human; identical to SEQ ID NO: 24337

SEQ ID NO: 103261 - RNA, 61 nt, Human; identical to SEQ ID NO: 24338

SEQ ID NO: 103262 - RNA, 61 nt, Human; identical to SEQ ID NO: 24339

SEQ ID NO: 103263 - RNA, 61 nt, Human; identical to SEQ ID NO: 24340

SEQ ID NO: 103264 - RNA, 61 nt, Human; identical to SEQ ID NO: 24341

SEQ ID NO: 103265 - RNA, 61 nt, Human; identical to SEQ ID NO: 24342

SEQ ID NO: 103266 - RNA, 61 nt, Human; identical to SEQ ID NO: 24343

SEQ ID NO: 103267 - RNA, 61 nt, Human
cugcugugaagauagacugauuggaguggaccacggccaagcuugcuccguccucggacag

SEQ ID NO: 103268 - RNA, 61 nt, Human; identical to SEQ ID NO: 24344

SEQ ID NO: 103269 - RNA, 61 nt, Human; identical to SEQ ID NO: 24345

SEQ ID NO: 103270 - RNA, 61 nt, Human; identical to SEQ ID NO: 24346

SEQ ID NO: 103271 - RNA, 61 nt, Human; identical to SEQ ID NO: 24347

SEQ ID NO: 103272 - RNA, 61 nt, Human; identical to SEQ ID NO: 24348

SEQ ID NO: 103273 - RNA, 61 nt, Human; identical to SEQ ID NO: 24349

SEQ ID NO: 103274 - RNA, 61 nt, Human; identical to SEQ ID NO: 24350

SEQ ID NO: 103275 - RNA, 61 nt, Human; identical to SEQ ID NO: 24351

SEQ ID NO: 103276 - RNA, 61 nt, Human; identical to SEQ ID NO: 24352

SEQ ID NO: 103277 - RNA, 61 nt, Human; identical to SEQ ID NO: 24353

SEQ ID NO: 103278 - RNA, 61 nt, Human; identical to SEQ ID NO: 24354

SEQ ID NO: 103279 - RNA, 61 nt, Human; identical to SEQ ID NO: 24355

SEQ ID NO: 103280 - RNA, 61 nt, Human; identical to SEQ ID NO: 24356

SEQ ID NO: 103281 - RNA, 61 nt, Human; identical to SEQ ID NO: 24357

SEQ ID NO: 103282 - RNA, 61 nt, Human; identical to SEQ ID NO: 24358

SEQ ID NO: 103283 - RNA, 61 nt, Human; identical to SEQ ID NO: 24359

SEQ ID NO: 103284 - RNA, 61 nt, Human; identical to SEQ ID NO: 24360

SEQ ID NO: 103285 - RNA, 61 nt, Human; identical to SEQ ID NO: 24361

SEQ ID NO: 103286 - RNA, 61 nt, Human; identical to SEQ ID NO: 24362

SEQ ID NO: 103287 - RNA, 61 nt, Human; identical to SEQ ID NO: 24363

SEQ ID NO: 103288 - RNA, 61 nt, Human; identical to SEQ ID NO: 24364

SEQ ID NO: 103289 - RNA, 61 nt, Human; identical to SEQ ID NO: 24365

SEQ ID NO: 103290 - RNA, 61 nt, Human; identical to SEQ ID NO: 24366

SEQ ID NO: 103291 - RNA, 61 nt, Human; identical to SEQ ID NO: 24367

SEQ ID NO: 103292 - RNA, 61 nt, Human; identical to SEQ ID NO: 24325

SEQ ID NO: 103293 - RNA, 61 nt, Human; identical to SEQ ID NO: 24369

SEQ ID NO: 103294 - RNA, 64 nt, Human; identical to SEQ ID NO: 24370

SEQ ID NO: 103295 - RNA, 64 nt, Human; identical to SEQ ID NO: 24371

SEQ ID NO: 103296 - RNA, 64 nt, Human; identical to SEQ ID NO: 24372

SEQ ID NO: 103297 - RNA, 64 nt, Human; identical to SEQ ID NO: 24373

SEQ ID NO: 103298 - RNA, 64 nt, Human; identical to SEQ ID NO: 24374

SEQ ID NO: 103299 - RNA, 64 nt, Human; identical to SEQ ID NO: 24375

SEQ ID NO: 103300 - RNA, 64 nt, Human; identical to SEQ ID NO: 24376

SEQ ID NO: 103301 - RNA, 64 nt, Human; identical to SEQ ID NO: 24377

SEQ ID NO: 103302 - RNA, 64 nt, Human; identical to SEQ ID NO: 24378

SEQ ID NO: 103303 - RNA, 64 nt, Human; identical to SEQ ID NO: 24379

SEQ ID NO: 103304 - RNA, 64 nt, Human; identical to SEQ ID NO: 24380

SEQ ID NO: 103305 - RNA, 64 nt, Human; identical to SEQ ID NO: 24381

SEQ ID NO: 103306 - RNA, 64 nt, Human; identical to SEQ ID NO: 24382

SEQ ID NO: 103307 - RNA, 64 nt, Human; identical to SEQ ID NO: 24383

SEQ ID NO: 103308 - RNA, 64 nt, Human; identical to SEQ ID NO: 24384

SEQ ID NO: 103309 - RNA, 64 nt, Human; identical to SEQ ID NO: 24385

SEQ ID NO: 103310 - RNA, 64 nt, Human; identical to SEQ ID NO: 24386

SEQ ID NO: 103311 - RNA, 64 nt, Human; identical to SEQ ID NO: 24387

SEQ ID NO: 103312 - RNA, 64 nt, Human; identical to SEQ ID NO: 24388

SEQ ID NO: 103313 - RNA, 64 nt, Human; identical to SEQ ID NO: 24389

SEQ ID NO: 103314 - RNA, 64 nt, Human; identical to SEQ ID NO: 24390

SEQ ID NO: 103315 - RNA, 64 nt, Human; identical to SEQ ID NO: 24391

SEQ ID NO: 103316 - RNA, 64 nt, Human; identical to SEQ ID NO: 24392

SEQ ID NO: 103317 - RNA, 64 nt, Human; identical to SEQ ID NO: 24393

SEQ ID NO: 103318 - RNA, 64 nt, Human; identical to SEQ ID NO: 24394

SEQ ID NO: 103319 - RNA, 64 nt, Human; identical to SEQ ID NO: 24395

SEQ ID NO: 103320 - RNA, 64 nt, Human; identical to SEQ ID NO: 24396

SEQ ID NO: 103321 - RNA, 64 nt, Human; identical to SEQ ID NO: 24397

SEQ ID NO: 103322 - RNA, 64 nt, Human; identical to SEQ ID NO: 24398

SEQ ID NO: 103323 - RNA, 64 nt, Human; identical to SEQ ID NO: 24399

SEQ ID NO: 103324 - RNA, 64 nt, Human; identical to SEQ ID NO: 24400

SEQ ID NO: 103325 - RNA, 64 nt, Human; identical to SEQ ID NO: 24401

SEQ ID NO: 103326 - RNA, 64 nt, Human; identical to SEQ ID NO: 24402

SEQ ID NO: 103327 - RNA, 64 nt, Human; identical to SEQ ID NO: 24403

SEQ ID NO: 103328 - RNA, 64 nt, Human; identical to SEQ ID NO: 24404

SEQ ID NO: 103329 - RNA, 64 nt, Human; identical to SEQ ID NO: 24405

SEQ ID NO: 103330 - RNA, 64 nt, Human; identical to SEQ ID NO: 24406

SEQ ID NO: 103331 - RNA, 64 nt, Human; identical to SEQ ID NO: 24407

SEQ ID NO: 103332 - RNA, 64 nt, Human; identical to SEQ ID NO: 24408

SEQ ID NO: 103333 - RNA, 64 nt, Human; identical to SEQ ID NO: 24409

SEQ ID NO: 103334 - RNA, 64 nt, Human; identical to SEQ ID NO: 24410

SEQ ID NO: 103335 - RNA, 64 nt, Human; identical to SEQ ID NO: 24411

SEQ ID NO: 103336 - RNA, 64 nt, Human; identical to SEQ ID NO: 24412

SEQ ID NO: 103337 - RNA, 64 nt, Human; identical to SEQ ID NO: 24413

SEQ ID NO: 103338 - RNA, 64 nt, Human; identical to SEQ ID NO: 24414

SEQ ID NO: 103339 - RNA, 64 nt, Human; identical to SEQ ID NO: 24415

SEQ ID NO: 103340 - RNA, 64 nt, Human; identical to SEQ ID NO: 24416

SEQ ID NO: 103341 - RNA, 64 nt, Human; identical to SEQ ID NO: 24417

SEQ ID NO: 103342 - RNA, 64 nt, Human; identical to SEQ ID NO: 24418

SEQ ID NO: 103343 - RNA, 64 nt, Human; identical to SEQ ID NO: 24419

SEQ ID NO: 103344 - RNA, 64 nt, Human; identical to SEQ ID NO: 24420

SEQ ID NO: 103345 - RNA, 64 nt, Human; identical to SEQ ID NO: 24421

SEQ ID NO: 103346 - RNA, 64 nt, Human; identical to SEQ ID NO: 24422

SEQ ID NO: 103347 - RNA, 64 nt, Human; identical to SEQ ID NO: 24423

SEQ ID NO: 103348 - RNA, 64 nt, Human; identical to SEQ ID NO: 24424

SEQ ID NO: 103349 - RNA, 64 nt, Human; identical to SEQ ID NO: 24425

SEQ ID NO: 103350 - RNA, 64 nt, Human; identical to SEQ ID NO: 24426

SEQ ID NO: 103351 - RNA, 64 nt, Human; identical to SEQ ID NO: 24427

SEQ ID NO: 103352 - RNA, 64 nt, Human; identical to SEQ ID NO: 24428

SEQ ID NO: 103353 - RNA, 64 nt, Human; identical to SEQ ID NO: 24429

SEQ ID NO: 103354 - RNA, 64 nt, Human; identical to SEQ ID NO: 24430

SEQ ID NO: 103355 - RNA, 64 nt, Human; identical to SEQ ID NO: 24431

SEQ ID NO: 103356 - RNA, 64 nt, Human; identical to SEQ ID NO: 24432

SEQ ID NO: 103357 - RNA, 64 nt, Human; identical to SEQ ID NO: 24433

SEQ ID NO: 103358 - RNA, 64 nt, Human; identical to SEQ ID NO: 24434

SEQ ID NO: 103359 - RNA, 64 nt, Human; identical to SEQ ID NO: 24435

SEQ ID NO: 103360 - RNA, 64 nt, Human; identical to SEQ ID NO: 24436

SEQ ID NO: 103361 - RNA, 64 nt, Human; identical to SEQ ID NO: 24437

SEQ ID NO: 103362 - RNA, 64 nt, Human; identical to SEQ ID NO: 24438

SEQ ID NO: 103363 - RNA, 64 nt, Human; identical to SEQ ID NO: 24439

SEQ ID NO: 103364 - RNA, 64 nt, Human; identical to SEQ ID NO: 24440

SEQ ID NO: 103365 - RNA, 64 nt, Human; identical to SEQ ID NO: 24441

SEQ ID NO: 103366 - RNA, 64 nt, Human; identical to SEQ ID NO: 24442

SEQ ID NO: 103367 - RNA, 64 nt, Human; identical to SEQ ID NO: 24443

SEQ ID NO: 103368 - RNA, 64 nt, Human; identical to SEQ ID NO: 24444

SEQ ID NO: 103369 - RNA, 64 nt, Human; identical to SEQ ID NO: 24445

SEQ ID NO: 103370 - RNA, 64 nt, Human; identical to SEQ ID NO: 24446

SEQ ID NO: 103371 - RNA, 64 nt, Human; identical to SEQ ID NO: 24447

SEQ ID NO: 103372 - RNA, 64 nt, Human; identical to SEQ ID NO: 24448

SEQ ID NO: 103373 - RNA, 64 nt, Human; identical to SEQ ID NO: 24449

SEQ ID NO: 103374 - RNA, 64 nt, Human; identical to SEQ ID NO: 24450

SEQ ID NO: 103375 - RNA, 64 nt, Human; identical to SEQ ID NO: 24451

SEQ ID NO: 103376 - RNA, 64 nt, Human; identical to SEQ ID NO: 24452

SEQ ID NO: 103377 - RNA, 64 nt, Human; identical to SEQ ID NO: 24453

SEQ ID NO: 103378 - RNA, 64 nt, Human; identical to SEQ ID NO: 24454

SEQ ID NO: 103379 - RNA, 64 nt, Human; identical to SEQ ID NO: 24455

SEQ ID NO: 103380 - RNA, 64 nt, Human; identical to SEQ ID NO: 24456

SEQ ID NO: 103381 - RNA, 64 nt, Human; identical to SEQ ID NO: 24457

SEQ ID NO: 103382 - RNA, 64 nt, Human; identical to SEQ ID NO: 24458

SEQ ID NO: 103383 - RNA, 64 nt, Human; identical to SEQ ID NO: 24459

SEQ ID NO: 103384 - RNA, 64 nt, Human; identical to SEQ ID NO: 24460

SEQ ID NO: 103385 - RNA, 64 nt, Human; identical to SEQ ID NO: 24461

SEQ ID NO: 103386 - RNA, 64 nt, Human; identical to SEQ ID NO: 24462

SEQ ID NO: 103387 - RNA, 64 nt, Human; identical to SEQ ID NO: 24463

SEQ ID NO: 103388 - RNA, 64 nt, Human; identical to SEQ ID NO: 24464

SEQ ID NO: 103389 - RNA, 64 nt, Human; identical to SEQ ID NO: 24465

SEQ ID NO: 103390 - RNA, 64 nt, Human; identical to SEQ ID NO: 24466

SEQ ID NO: 103391 - RNA, 64 nt, Human; identical to SEQ ID NO: 24467

SEQ ID NO: 103392 - RNA, 64 nt, Human; identical to SEQ ID NO: 24468

SEQ ID NO: 103393 - RNA, 64 nt, Human; identical to SEQ ID NO: 24469

SEQ ID NO: 103394 - RNA, 64 nt, Human; identical to SEQ ID NO: 24470

SEQ ID NO: 103395 - RNA, 64 nt, Human; identical to SEQ ID NO: 24471

SEQ ID NO: 103396 - RNA, 64 nt, Human; identical to SEQ ID NO: 24472

SEQ ID NO: 103397 - RNA, 64 nt, Human; identical to SEQ ID NO: 24473

SEQ ID NO: 103398 - RNA, 64 nt, Human; identical to SEQ ID NO: 24474

SEQ ID NO: 103399 - RNA, 64 nt, Human; identical to SEQ ID NO: 24475

SEQ ID NO: 103400 - RNA, 64 nt, Human; identical to SEQ ID NO: 24476

SEQ ID NO: 103401 - RNA, 64 nt, Human; identical to SEQ ID NO: 24477

SEQ ID NO: 103402 - RNA, 64 nt, Human; identical to SEQ ID NO: 24478

SEQ ID NO: 103403 - RNA, 64 nt, Human; identical to SEQ ID NO: 24479

SEQ ID NO: 103404 - RNA, 64 nt, Human; identical to SEQ ID NO: 24480

SEQ ID NO: 103405 - RNA, 64 nt, Human; identical to SEQ ID NO: 24481

SEQ ID NO: 103406 - RNA, 64 nt, Human; identical to SEQ ID NO: 24482

SEQ ID NO: 103407 - RNA, 64 nt, Human; identical to SEQ ID NO: 24483

SEQ ID NO: 103408 - RNA, 64 nt, Human; identical to SEQ ID NO: 24484

SEQ ID NO: 103409 - RNA, 64 nt, Human; identical to SEQ ID NO: 24485

SEQ ID NO: 103410 - RNA, 64 nt, Human; identical to SEQ ID NO: 24486

SEQ ID NO: 103411 - RNA, 64 nt, Human; identical to SEQ ID NO: 24487

SEQ ID NO: 103412 - RNA, 64 nt, Human; identical to SEQ ID NO: 24488

SEQ ID NO: 103413 - RNA, 64 nt, Human; identical to SEQ ID NO: 24489

SEQ ID NO: 103414 - RNA, 64 nt, Human; identical to SEQ ID NO: 24490

SEQ ID NO: 103415 - RNA, 64 nt, Human; identical to SEQ ID NO: 24491

SEQ ID NO: 103416 - RNA, 64 nt, Human; identical to SEQ ID NO: 24492

SEQ ID NO: 103417 - RNA, 64 nt, Human; identical to SEQ ID NO: 24493

SEQ ID NO: 103418 - RNA, 64 nt, Human; identical to SEQ ID NO: 24494

SEQ ID NO: 103419 - RNA, 64 nt, Human; identical to SEQ ID NO: 24495

SEQ ID NO: 103420 - RNA, 64 nt, Human; identical to SEQ ID NO: 24496

SEQ ID NO: 103421 - RNA, 64 nt, Human; identical to SEQ ID NO: 24497

SEQ ID NO: 103422 - RNA, 64 nt, Human; identical to SEQ ID NO: 24498

SEQ ID NO: 103423 - RNA, 64 nt, Human; identical to SEQ ID NO: 24499

SEQ ID NO: 103424 - RNA, 64 nt, Human; identical to SEQ ID NO: 24500

SEQ ID NO: 103425 - RNA, 64 nt, Human; identical to SEQ ID NO: 24501

SEQ ID NO: 103426 - RNA, 64 nt, Human; identical to SEQ ID NO: 24502

SEQ ID NO: 103427 - RNA, 64 nt, Human; identical to SEQ ID NO: 24503

SEQ ID NO: 103428 - RNA, 64 nt, Human; identical to SEQ ID NO: 24504

SEQ ID NO: 103429 - RNA, 64 nt, Human; identical to SEQ ID NO: 24505

SEQ ID NO: 103430 - RNA, 64 nt, Human; identical to SEQ ID NO: 24506

SEQ ID NO: 103431 - RNA, 64 nt, Human; identical to SEQ ID NO: 24507

SEQ ID NO: 103432 - RNA, 64 nt, Human; identical to SEQ ID NO: 24508

SEQ ID NO: 103433 - RNA, 64 nt, Human; identical to SEQ ID NO: 24509

SEQ ID NO: 103434 - RNA, 64 nt, Human; identical to SEQ ID NO: 24510

SEQ ID NO: 103435 - RNA, 64 nt, Human; identical to SEQ ID NO: 24511

SEQ ID NO: 103436 - RNA, 64 nt, Human; identical to SEQ ID NO: 24512

SEQ ID NO: 103437 - RNA, 64 nt, Human; identical to SEQ ID NO: 24513

SEQ ID NO: 103438 - RNA, 64 nt, Human; identical to SEQ ID NO: 24514

SEQ ID NO: 103439 - RNA, 64 nt, Human; identical to SEQ ID NO: 24515

SEQ ID NO: 103440 - RNA, 64 nt, Human; identical to SEQ ID NO: 24516

SEQ ID NO: 103441 - RNA, 64 nt, Human; identical to SEQ ID NO: 24517

SEQ ID NO: 103442 - RNA, 64 nt, Human; identical to SEQ ID NO: 24518

SEQ ID NO: 103443 - RNA, 64 nt, Human; identical to SEQ ID NO: 24519

SEQ ID NO: 103444 - RNA, 64 nt, Human; identical to SEQ ID NO: 24520

SEQ ID NO: 103445 - RNA, 64 nt, Human; identical to SEQ ID NO: 24521

SEQ ID NO: 103446 - RNA, 64 nt, Human; identical to SEQ ID NO: 24522

SEQ ID NO: 103447 - RNA, 64 nt, Human; identical to SEQ ID NO: 24523

SEQ ID NO: 103448 - RNA, 64 nt, Human; identical to SEQ ID NO: 24524

SEQ ID NO: 103449 - RNA, 64 nt, Human; identical to SEQ ID NO: 24525

SEQ ID NO: 103450 - RNA, 64 nt, Human; identical to SEQ ID NO: 24526

SEQ ID NO: 103451 - RNA, 64 nt, Human; identical to SEQ ID NO: 24527

SEQ ID NO: 103452 - RNA, 64 nt, Human; identical to SEQ ID NO: 24528

SEQ ID NO: 103453 - RNA, 64 nt, Human; identical to SEQ ID NO: 24529

SEQ ID NO: 103454 - RNA, 64 nt, Human; identical to SEQ ID NO: 24530

SEQ ID NO: 103455 - RNA, 64 nt, Human; identical to SEQ ID NO: 24531

SEQ ID NO: 103456 - RNA, 64 nt, Human; identical to SEQ ID NO: 24532

SEQ ID NO: 103457 - RNA, 64 nt, Human; identical to SEQ ID NO: 24533

SEQ ID NO: 103458 - RNA, 64 nt, Human; identical to SEQ ID NO: 24534

SEQ ID NO: 103459 - RNA, 64 nt, Human; identical to SEQ ID NO: 24535

SEQ ID NO: 103460 - RNA, 64 nt, Human; identical to SEQ ID NO: 24536

SEQ ID NO: 103461 - RNA, 64 nt, Human; identical to SEQ ID NO: 24537

SEQ ID NO: 103462 - RNA, 64 nt, Human; identical to SEQ ID NO: 24538

SEQ ID NO: 103463 - RNA, 64 nt, Human; identical to SEQ ID NO: 24539

SEQ ID NO: 103464 - RNA, 64 nt, Human; identical to SEQ ID NO: 24540

SEQ ID NO: 103465 - RNA, 64 nt, Human; identical to SEQ ID NO: 24541

SEQ ID NO: 103466 - RNA, 64 nt, Human; identical to SEQ ID NO: 24542

SEQ ID NO: 103467 - RNA, 64 nt, Human; identical to SEQ ID NO: 24543

SEQ ID NO: 103468 - RNA, 64 nt, Human; identical to SEQ ID NO: 24544

SEQ ID NO: 103469 - RNA, 64 nt, Human; identical to SEQ ID NO: 24545

SEQ ID NO: 103470 - RNA, 64 nt, Human; identical to SEQ ID NO: 24546

SEQ ID NO: 103471 - RNA, 64 nt, Human; identical to SEQ ID NO: 24547

SEQ ID NO: 103472 - RNA, 64 nt, Human; identical to SEQ ID NO: 24548

SEQ ID NO: 103473 - RNA, 64 nt, Human; identical to SEQ ID NO: 24549

SEQ ID NO: 103474 - RNA, 64 nt, Human; identical to SEQ ID NO: 24550

SEQ ID NO: 103475 - RNA, 64 nt, Human; identical to SEQ ID NO: 24551

SEQ ID NO: 103476 - RNA, 64 nt, Human; identical to SEQ ID NO: 24552

SEQ ID NO: 103477 - RNA, 64 nt, Human; identical to SEQ ID NO: 24553

SEQ ID NO: 103478 - RNA, 64 nt, Human; identical to SEQ ID NO: 24554

SEQ ID NO: 103479 - RNA, 64 nt, Human; identical to SEQ ID NO: 24555

SEQ ID NO: 103480 - RNA, 64 nt, Human; identical to SEQ ID NO: 24556

SEQ ID NO: 103481 - RNA, 64 nt, Human; identical to SEQ ID NO: 24557

SEQ ID NO: 103482 - RNA, 64 nt, Human; identical to SEQ ID NO: 24558

SEQ ID NO: 103483 - RNA, 64 nt, Human; identical to SEQ ID NO: 24559

SEQ ID NO: 103484 - RNA, 64 nt, Human; identical to SEQ ID NO: 24560

SEQ ID NO: 103485 - RNA, 64 nt, Human; identical to SEQ ID NO: 24561

SEQ ID NO: 103486 - RNA, 64 nt, Human; identical to SEQ ID NO: 24562

SEQ ID NO: 103487 - RNA, 64 nt, Human; identical to SEQ ID NO: 24563

SEQ ID NO: 103488 - RNA, 64 nt, Human; identical to SEQ ID NO: 24564

SEQ ID NO: 103489 - RNA, 64 nt, Human; identical to SEQ ID NO: 24565

SEQ ID NO: 103490 - RNA, 64 nt, Human; identical to SEQ ID NO: 24566

SEQ ID NO: 103491 - RNA, 64 nt, Human; identical to SEQ ID NO: 24567

SEQ ID NO: 103492 - RNA, 64 nt, Human; identical to SEQ ID NO: 24568

SEQ ID NO: 103493 - RNA, 64 nt, Human; identical to SEQ ID NO: 24569

SEQ ID NO: 103494 - RNA, 64 nt, Human; identical to SEQ ID NO: 24570

SEQ ID NO: 103495 - RNA, 64 nt, Human; identical to SEQ ID NO: 24571

SEQ ID NO: 103496 - RNA, 64 nt, Human; identical to SEQ ID NO: 24572

SEQ ID NO: 103497 - RNA, 64 nt, Human; identical to SEQ ID NO: 24573

SEQ ID NO: 103498 - RNA, 64 nt, Human; identical to SEQ ID NO: 24574

SEQ ID NO: 103499 - RNA, 64 nt, Human; identical to SEQ ID NO: 24575

SEQ ID NO: 103500 - RNA, 64 nt, Human; identical to SEQ ID NO: 24576

SEQ ID NO: 103501 - RNA, 64 nt, Human; identical to SEQ ID NO: 24577

SEQ ID NO: 103502 - RNA, 64 nt, Human; identical to SEQ ID NO: 24578

SEQ ID NO: 103503 - RNA, 64 nt, Human; identical to SEQ ID NO: 24579

SEQ ID NO: 103504 - RNA, 64 nt, Human; identical to SEQ ID NO: 24580

SEQ ID NO: 103505 - RNA, 64 nt, Human; identical to SEQ ID NO: 24581

SEQ ID NO: 103506 - RNA, 64 nt, Human; identical to SEQ ID NO: 24582

SEQ ID NO: 103507 - RNA, 64 nt, Human; identical to SEQ ID NO: 24583

SEQ ID NO: 103508 - RNA, 64 nt, Human; identical to SEQ ID NO: 24584

SEQ ID NO: 103509 - RNA, 64 nt, Human; identical to SEQ ID NO: 24585

SEQ ID NO: 103510 - RNA, 64 nt, Human; identical to SEQ ID NO: 24586

SEQ ID NO: 103511 - RNA, 64 nt, Human; identical to SEQ ID NO: 24587

SEQ ID NO: 103512 - RNA, 64 nt, Human; identical to SEQ ID NO: 24588

SEQ ID NO: 103513 - RNA, 64 nt, Human; identical to SEQ ID NO: 24589

SEQ ID NO: 103514 - RNA, 64 nt, Human; identical to SEQ ID NO: 24590

SEQ ID NO: 103515 - RNA, 64 nt, Human; identical to SEQ ID NO: 24591

SEQ ID NO: 103516 - RNA, 64 nt, Human; identical to SEQ ID NO: 24592

SEQ ID NO: 103517 - RNA, 64 nt, Human; identical to SEQ ID NO: 24593

SEQ ID NO: 103518 - RNA, 64 nt, Human; identical to SEQ ID NO: 24594

SEQ ID NO: 103519 - RNA, 64 nt, Human; identical to SEQ ID NO: 24595

SEQ ID NO: 103520 - RNA, 64 nt, Human; identical to SEQ ID NO: 24596

SEQ ID NO: 103521 - RNA, 64 nt, Human; identical to SEQ ID NO: 24597

SEQ ID NO: 103522 - RNA, 64 nt, Human; identical to SEQ ID NO: 24598

SEQ ID NO: 103523 - RNA, 64 nt, Human; identical to SEQ ID NO: 24599

SEQ ID NO: 103524 - RNA, 64 nt, Human; identical to SEQ ID NO: 24600

SEQ ID NO: 103525 - RNA, 64 nt, Human; identical to SEQ ID NO: 24601

SEQ ID NO: 103526 - RNA, 64 nt, Human; identical to SEQ ID NO: 24602

SEQ ID NO: 103527 - RNA, 64 nt, Human; identical to SEQ ID NO: 24603

SEQ ID NO: 103528 - RNA, 58 nt, Human; identical to SEQ ID NO: 23463

SEQ ID NO: 103529 - RNA, 64 nt, Human; identical to SEQ ID NO: 24605

SEQ ID NO: 103530 - RNA, 64 nt, Human; identical to SEQ ID NO: 24606

SEQ ID NO: 103531 - RNA, 64 nt, Human; identical to SEQ ID NO: 24607

SEQ ID NO: 103532 - RNA, 64 nt, Human; identical to SEQ ID NO: 24608

SEQ ID NO: 103533 - RNA, 64 nt, Human; identical to SEQ ID NO: 24609

SEQ ID NO: 103534 - RNA, 64 nt, Human; identical to SEQ ID NO: 24610

SEQ ID NO: 103535 - RNA, 64 nt, Human; identical to SEQ ID NO: 24611

SEQ ID NO: 103536 - RNA, 56 nt, Human; identical to SEQ ID NO: 23471

SEQ ID NO: 103537 - RNA, 64 nt, Human; identical to SEQ ID NO: 24613

SEQ ID NO: 103538 - RNA, 64 nt, Human; identical to SEQ ID NO: 24614

SEQ ID NO: 103539 - RNA, 64 nt, Human; identical to SEQ ID NO: 24615

SEQ ID NO: 103540 - RNA, 64 nt, Human; identical to SEQ ID NO: 24616

SEQ ID NO: 103541 - RNA, 64 nt, Human; identical to SEQ ID NO: 24617

SEQ ID NO: 103542 - RNA, 64 nt, Human; identical to SEQ ID NO: 24618

SEQ ID NO: 103543 - RNA, 64 nt, Human; identical to SEQ ID NO: 24619

SEQ ID NO: 103544 - RNA, 64 nt, Human; identical to SEQ ID NO: 24620

SEQ ID NO: 103545 - RNA, 64 nt, Human; identical to SEQ ID NO: 24621

SEQ ID NO: 103546 - RNA, 64 nt, Human; identical to SEQ ID NO: 24622

SEQ ID NO: 103547 - RNA, 64 nt, Human; identical to SEQ ID NO: 24623

SEQ ID NO: 103548 - RNA, 64 nt, Human; identical to SEQ ID NO: 24624

SEQ ID NO: 103549 - RNA, 64 nt, Human; identical to SEQ ID NO: 24625

SEQ ID NO: 103550 - RNA, 64 nt, Human; identical to SEQ ID NO: 24626

SEQ ID NO: 103551 - RNA, 64 nt, Human; identical to SEQ ID NO: 24627

SEQ ID NO: 103552 - RNA, 64 nt, Human; identical to SEQ ID NO: 24628

SEQ ID NO: 103553 - RNA, 64 nt, Human; identical to SEQ ID NO: 24629

SEQ ID NO: 103554 - RNA, 64 nt, Human; identical to SEQ ID NO: 24630

SEQ ID NO: 103555 - RNA, 64 nt, Human; identical to SEQ ID NO: 24631

SEQ ID NO: 103556 - RNA, 64 nt, Human; identical to SEQ ID NO: 24632

SEQ ID NO: 103557 - RNA, 64 nt, Human; identical to SEQ ID NO: 24633

SEQ ID NO: 103558 - RNA, 64 nt, Human; identical to SEQ ID NO: 24634

SEQ ID NO: 103559 - RNA, 64 nt, Human; identical to SEQ ID NO: 24635

SEQ ID NO: 103560 - RNA, 64 nt, Human; identical to SEQ ID NO: 24636

SEQ ID NO: 103561 - RNA, 64 nt, Human; identical to SEQ ID NO: 24637

SEQ ID NO: 103562 - RNA, 64 nt, Human; identical to SEQ ID NO: 24638

SEQ ID NO: 103563 - RNA, 64 nt, Human; identical to SEQ ID NO: 24639

SEQ ID NO: 103564 - RNA, 64 nt, Human; identical to SEQ ID NO: 24640

SEQ ID NO: 103565 - RNA, 64 nt, Human; identical to SEQ ID NO: 24641

SEQ ID NO: 103566 - RNA, 64 nt, Human; identical to SEQ ID NO: 24642

SEQ ID NO: 103567 - RNA, 64 nt, Human; identical to SEQ ID NO: 24643

SEQ ID NO: 103568 - RNA, 64 nt, Human; identical to SEQ ID NO: 24644

SEQ ID NO: 103569 - RNA, 64 nt, Human; identical to SEQ ID NO: 24645

SEQ ID NO: 103570 - RNA, 64 nt, Human; identical to SEQ ID NO: 24646

SEQ ID NO: 103571 - RNA, 64 nt, Human; identical to SEQ ID NO: 24647

SEQ ID NO: 103572 - RNA, 64 nt, Human; identical to SEQ ID NO: 24648

SEQ ID NO: 103573 - RNA, 64 nt, Human; identical to SEQ ID NO: 24649

SEQ ID NO: 103574 - RNA, 64 nt, Human; identical to SEQ ID NO: 24650

SEQ ID NO: 103575 - RNA, 64 nt, Human; identical to SEQ ID NO: 24651

SEQ ID NO: 103576 - RNA, 64 nt, Human; identical to SEQ ID NO: 24652

SEQ ID NO: 103577 - RNA, 64 nt, Human; identical to SEQ ID NO: 24653

SEQ ID NO: 103578 - RNA, 64 nt, Human; identical to SEQ ID NO: 24654

SEQ ID NO: 103579 - RNA, 64 nt, Human; identical to SEQ ID NO: 24655

SEQ ID NO: 103580 - RNA, 64 nt, Human; identical to SEQ ID NO: 24656

SEQ ID NO: 103581 - RNA, 64 nt, Human; identical to SEQ ID NO: 24657

SEQ ID NO: 103582 - RNA, 64 nt, Human; identical to SEQ ID NO: 24658

SEQ ID NO: 103583 - RNA, 64 nt, Human; identical to SEQ ID NO: 24659

SEQ ID NO: 103584 - RNA, 64 nt, Human; identical to SEQ ID NO: 24660

SEQ ID NO: 103585 - RNA, 64 nt, Human; identical to SEQ ID NO: 24661

SEQ ID NO: 103586 - RNA, 64 nt, Human; identical to SEQ ID NO: 24662

SEQ ID NO: 103587 - RNA, 64 nt, Human; identical to SEQ ID NO: 24663

SEQ ID NO: 103588 - RNA, 64 nt, Human; identical to SEQ ID NO: 24664

SEQ ID NO: 103589 - RNA, 64 nt, Human; identical to SEQ ID NO: 24665

SEQ ID NO: 103590 - RNA, 64 nt, Human; identical to SEQ ID NO: 24666

SEQ ID NO: 103591 - RNA, 64 nt, Human; identical to SEQ ID NO: 24667

SEQ ID NO: 103592 - RNA, 64 nt, Human; identical to SEQ ID NO: 24668

SEQ ID NO: 103593 - RNA, 64 nt, Human; identical to SEQ ID NO: 24669

SEQ ID NO: 103594 - RNA, 64 nt, Human; identical to SEQ ID NO: 24670

SEQ ID NO: 103595 - RNA, 64 nt, Human; identical to SEQ ID NO: 24671

SEQ ID NO: 103596 - RNA, 64 nt, Human; identical to SEQ ID NO: 24672

SEQ ID NO: 103597 - RNA, 63 nt, Human; identical to SEQ ID NO: 24673

SEQ ID NO: 103598 - RNA, 64 nt, Human; identical to SEQ ID NO: 24674

SEQ ID NO: 103599 - RNA, 64 nt, Human; identical to SEQ ID NO: 24675

SEQ ID NO: 103600 - RNA, 64 nt, Human; identical to SEQ ID NO: 24676

SEQ ID NO: 103601 - RNA, 64 nt, Human; identical to SEQ ID NO: 24677

SEQ ID NO: 103602 - RNA, 64 nt, Human; identical to SEQ ID NO: 24678

SEQ ID NO: 103603 - RNA, 64 nt, Human; identical to SEQ ID NO: 24679

SEQ ID NO: 103604 - RNA, 64 nt, Human; identical to SEQ ID NO: 24680

SEQ ID NO: 103605 - RNA, 64 nt, Human; identical to SEQ ID NO: 24681

SEQ ID NO: 103606 - RNA, 64 nt, Human; identical to SEQ ID NO: 24682

SEQ ID NO: 103607 - RNA, 64 nt, Human; identical to SEQ ID NO: 24683

SEQ ID NO: 103608 - RNA, 64 nt, Human; identical to SEQ ID NO: 24684

SEQ ID NO: 103609 - RNA, 64 nt, Human; identical to SEQ ID NO: 24685

SEQ ID NO: 103610 - RNA, 64 nt, Human; identical to SEQ ID NO: 24686

SEQ ID NO: 103611 - RNA, 64 nt, Human; identical to SEQ ID NO: 24687

SEQ ID NO: 103612 - RNA, 64 nt, Human; identical to SEQ ID NO: 24688

SEQ ID NO: 103613 - RNA, 64 nt, Human; identical to SEQ ID NO: 24689

SEQ ID NO: 103614 - RNA, 64 nt, Human; identical to SEQ ID NO: 24690

SEQ ID NO: 103615 - RNA, 64 nt, Human; identical to SEQ ID NO: 24691

SEQ ID NO: 103616 - RNA, 64 nt, Human; identical to SEQ ID NO: 24692

SEQ ID NO: 103617 - RNA, 64 nt, Human; identical to SEQ ID NO: 24693

SEQ ID NO: 103618 - RNA, 64 nt, Human; identical to SEQ ID NO: 24694

SEQ ID NO: 103619 - RNA, 64 nt, Human; identical to SEQ ID NO: 24695

SEQ ID NO: 103620 - RNA, 64 nt, Human; identical to SEQ ID NO: 24696

SEQ ID NO: 103621 - RNA, 64 nt, Human; identical to SEQ ID NO: 24697

SEQ ID NO: 103622 - RNA, 64 nt, Human; identical to SEQ ID NO: 24698

SEQ ID NO: 103623 - RNA, 64 nt, Human; identical to SEQ ID NO: 24699

SEQ ID NO: 103624 - RNA, 64 nt, Human; identical to SEQ ID NO: 24700

SEQ ID NO: 103625 - RNA, 64 nt, Human; identical to SEQ ID NO: 24701

SEQ ID NO: 103626 - RNA, 64 nt, Human; identical to SEQ ID NO: 24702

SEQ ID NO: 103627 - RNA, 64 nt, Human; identical to SEQ ID NO: 24703

SEQ ID NO: 103628 - RNA, 64 nt, Human; identical to SEQ ID NO: 24704

SEQ ID NO: 103629 - RNA, 64 nt, Human; identical to SEQ ID NO: 24705

SEQ ID NO: 103630 - RNA, 64 nt, Human; identical to SEQ ID NO: 24706

SEQ ID NO: 103631 - RNA, 64 nt, Human; identical to SEQ ID NO: 24707

SEQ ID NO: 103632 - RNA, 64 nt, Human; identical to SEQ ID NO: 24708

SEQ ID NO: 103633 - RNA, 64 nt, Human; identical to SEQ ID NO: 24709

SEQ ID NO: 103634 - RNA, 64 nt, Human; identical to SEQ ID NO: 24710

SEQ ID NO: 103635 - RNA, 64 nt, Human; identical to SEQ ID NO: 24711

SEQ ID NO: 103636 - RNA, 64 nt, Human; identical to SEQ ID NO: 24712

SEQ ID NO: 103637 - RNA, 64 nt, Human; identical to SEQ ID NO: 24713

SEQ ID NO: 103638 - RNA, 64 nt, Human; identical to SEQ ID NO: 24714

SEQ ID NO: 103639 - RNA, 64 nt, Human; identical to SEQ ID NO: 24715

SEQ ID NO: 103640 - RNA, 64 nt, Human; identical to SEQ ID NO: 24716

SEQ ID NO: 103641 - RNA, 64 nt, Human; identical to SEQ ID NO: 24717

SEQ ID NO: 103642 - RNA, 64 nt, Human; identical to SEQ ID NO: 24718

SEQ ID NO: 103643 - RNA, 64 nt, Human; identical to SEQ ID NO: 24719

SEQ ID NO: 103644 - RNA, 64 nt, Human; identical to SEQ ID NO: 24720

SEQ ID NO: 103645 - RNA, 64 nt, Human; identical to SEQ ID NO: 24721

SEQ ID NO: 103646 - RNA, 64 nt, Human; identical to SEQ ID NO: 24722

SEQ ID NO: 103647 - RNA, 64 nt, Human; identical to SEQ ID NO: 24723

SEQ ID NO: 103648 - RNA, 64 nt, Human; identical to SEQ ID NO: 24724

SEQ ID NO: 103649 - RNA, 64 nt, Human; identical to SEQ ID NO: 24725

SEQ ID NO: 103650 - RNA, 64 nt, Human; identical to SEQ ID NO: 24726

SEQ ID NO: 103651 - RNA, 64 nt, Human; identical to SEQ ID NO: 24727

SEQ ID NO: 103652 - RNA, 64 nt, Human; identical to SEQ ID NO: 24728

SEQ ID NO: 103653 - RNA, 64 nt, Human; identical to SEQ ID NO: 24729

SEQ ID NO: 103654 - RNA, 64 nt, Human; identical to SEQ ID NO: 24730

SEQ ID NO: 103655 - RNA, 64 nt, Human; identical to SEQ ID NO: 24731

SEQ ID NO: 103656 - RNA, 64 nt, Human; identical to SEQ ID NO: 24732

SEQ ID NO: 103657 - RNA, 64 nt, Human; identical to SEQ ID NO: 24733

SEQ ID NO: 103658 - RNA, 64 nt, Human; identical to SEQ ID NO: 24734

SEQ ID NO: 103659 - RNA, 64 nt, Human; identical to SEQ ID NO: 24735

SEQ ID NO: 103660 - RNA, 64 nt, Human; identical to SEQ ID NO: 24736

SEQ ID NO: 103661 - RNA, 64 nt, Human; identical to SEQ ID NO: 24737

SEQ ID NO: 103662 - RNA, 64 nt, Human; identical to SEQ ID NO: 24738

SEQ ID NO: 103663 - RNA, 64 nt, Human; identical to SEQ ID NO: 24739

SEQ ID NO: 103664 - RNA, 64 nt, Human; identical to SEQ ID NO: 24740

SEQ ID NO: 103665 - RNA, 64 nt, Human; identical to SEQ ID NO: 24741

SEQ ID NO: 103666 - RNA, 64 nt, Human; identical to SEQ ID NO: 24742

SEQ ID NO: 103667 - RNA, 64 nt, Human; identical to SEQ ID NO: 24743

SEQ ID NO: 103668 - RNA, 64 nt, Human; identical to SEQ ID NO: 24744

SEQ ID NO: 103669 - RNA, 64 nt, Human; identical to SEQ ID NO: 24745

SEQ ID NO: 103670 - RNA, 64 nt, Human; identical to SEQ ID NO: 24746

SEQ ID NO: 103671 - RNA, 64 nt, Human; identical to SEQ ID NO: 24747

SEQ ID NO: 103672 - RNA, 64 nt, Human; identical to SEQ ID NO: 24748

SEQ ID NO: 103673 - RNA, 64 nt, Human; identical to SEQ ID NO: 24749

SEQ ID NO: 103674 - RNA, 64 nt, Human; identical to SEQ ID NO: 24750

SEQ ID NO: 103675 - RNA, 64 nt, Human; identical to SEQ ID NO: 24751

SEQ ID NO: 103676 - RNA, 64 nt, Human; identical to SEQ ID NO: 24752

SEQ ID NO: 103677 - RNA, 64 nt, Human; identical to SEQ ID NO: 24753

SEQ ID NO: 103678 - RNA, 64 nt, Human; identical to SEQ ID NO: 24754

SEQ ID NO: 103679 - RNA, 64 nt, Human; identical to SEQ ID NO: 24755

SEQ ID NO: 103680 - RNA, 64 nt, Human; identical to SEQ ID NO: 24756

SEQ ID NO: 103681 - RNA, 64 nt, Human; identical to SEQ ID NO: 24757

SEQ ID NO: 103682 - RNA, 64 nt, Human; identical to SEQ ID NO: 24758

SEQ ID NO: 103683 - RNA, 64 nt, Human; identical to SEQ ID NO: 24759

SEQ ID NO: 103684 - RNA, 64 nt, Human; identical to SEQ ID NO: 24760

SEQ ID NO: 103685 - RNA, 64 nt, Human; identical to SEQ ID NO: 24761

SEQ ID NO: 103686 - RNA, 64 nt, Human; identical to SEQ ID NO: 24762

SEQ ID NO: 103687 - RNA, 64 nt, Human; identical to SEQ ID NO: 24763

SEQ ID NO: 103688 - RNA, 64 nt, Human; identical to SEQ ID NO: 24764

SEQ ID NO: 103689 - RNA, 64 nt, Human; identical to SEQ ID NO: 24765

SEQ ID NO: 103690 - RNA, 64 nt, Human; identical to SEQ ID NO: 24766

SEQ ID NO: 103691 - RNA, 64 nt, Human; identical to SEQ ID NO: 24767

SEQ ID NO: 103692 - RNA, 64 nt, Human; identical to SEQ ID NO: 24768

SEQ ID NO: 103693 - RNA, 64 nt, Human; identical to SEQ ID NO: 24769

SEQ ID NO: 103694 - RNA, 64 nt, Human; identical to SEQ ID NO: 24770

SEQ ID NO: 103695 - RNA, 64 nt, Human; identical to SEQ ID NO: 24771

SEQ ID NO: 103696 - RNA, 64 nt, Human; identical to SEQ ID NO: 24772

SEQ ID NO: 103697 - RNA, 64 nt, Human; identical to SEQ ID NO: 24773

SEQ ID NO: 103698 - RNA, 64 nt, Human; identical to SEQ ID NO: 24774

SEQ ID NO: 103699 - RNA, 64 nt, Human; identical to SEQ ID NO: 24775

SEQ ID NO: 103700 - RNA, 64 nt, Human; identical to SEQ ID NO: 24776

SEQ ID NO: 103701 - RNA, 64 nt, Human; identical to SEQ ID NO: 24777

SEQ ID NO: 103702 - RNA, 64 nt, Human; identical to SEQ ID NO: 24778

SEQ ID NO: 103703 - RNA, 64 nt, Human; identical to SEQ ID NO: 24779

SEQ ID NO: 103704 - RNA, 64 nt, Human; identical to SEQ ID NO: 24780

SEQ ID NO: 103705 - RNA, 64 nt, Human; identical to SEQ ID NO: 24781

SEQ ID NO: 103706 - RNA, 64 nt, Human; identical to SEQ ID NO: 24782

SEQ ID NO: 103707 - RNA, 64 nt, Human; identical to SEQ ID NO: 24783

SEQ ID NO: 103708 - RNA, 64 nt, Human; identical to SEQ ID NO: 24784

SEQ ID NO: 103709 - RNA, 64 nt, Human; identical to SEQ ID NO: 24785

SEQ ID NO: 103710 - RNA, 64 nt, Human; identical to SEQ ID NO: 24786

SEQ ID NO: 103711 - RNA, 64 nt, Human; identical to SEQ ID NO: 24787

SEQ ID NO: 103712 - RNA, 64 nt, Human; identical to SEQ ID NO: 24788

SEQ ID NO: 103713 - RNA, 64 nt, Human; identical to SEQ ID NO: 24789

SEQ ID NO: 103714 - RNA, 64 nt, Human; identical to SEQ ID NO: 24790

SEQ ID NO: 103715 - RNA, 64 nt, Human; identical to SEQ ID NO: 24791

SEQ ID NO: 103716 - RNA, 64 nt, Human; identical to SEQ ID NO: 24792

SEQ ID NO: 103717 - RNA, 64 nt, Human; identical to SEQ ID NO: 24793

SEQ ID NO: 103718 - RNA, 64 nt, Human; identical to SEQ ID NO: 24794

SEQ ID NO: 103719 - RNA, 64 nt, Human; identical to SEQ ID NO: 24795

SEQ ID NO: 103720 - RNA, 64 nt, Human; identical to SEQ ID NO: 24796

SEQ ID NO: 103721 - RNA, 64 nt, Human; identical to SEQ ID NO: 24797

SEQ ID NO: 103722 - RNA, 64 nt, Human; identical to SEQ ID NO: 24798

SEQ ID NO: 103723 - RNA, 64 nt, Human; identical to SEQ ID NO: 24799

SEQ ID NO: 103724 - RNA, 64 nt, Human; identical to SEQ ID NO: 24800

SEQ ID NO: 103725 - RNA, 64 nt, Human; identical to SEQ ID NO: 24801

SEQ ID NO: 103726 - RNA, 64 nt, Human; identical to SEQ ID NO: 24802

SEQ ID NO: 103727 - RNA, 64 nt, Human; identical to SEQ ID NO: 24803

SEQ ID NO: 103728 - RNA, 64 nt, Human; identical to SEQ ID NO: 24804

SEQ ID NO: 103729 - RNA, 64 nt, Human; identical to SEQ ID NO: 24805

SEQ ID NO: 103730 - RNA, 64 nt, Human; identical to SEQ ID NO: 24806

SEQ ID NO: 103731 - RNA, 64 nt, Human; identical to SEQ ID NO: 24807

SEQ ID NO: 103732 - RNA, 64 nt, Human; identical to SEQ ID NO: 24808

SEQ ID NO: 103733 - RNA, 64 nt, Human; identical to SEQ ID NO: 24809

SEQ ID NO: 103734 - RNA, 64 nt, Human; identical to SEQ ID NO: 24810

SEQ ID NO: 103735 - RNA, 64 nt, Human; identical to SEQ ID NO: 24811

SEQ ID NO: 103736 - RNA, 64 nt, Human; identical to SEQ ID NO: 24812

SEQ ID NO: 103737 - RNA, 64 nt, Human; identical to SEQ ID NO: 24813

SEQ ID NO: 103738 - RNA, 64 nt, Human; identical to SEQ ID NO: 24814

SEQ ID NO: 103739 - RNA, 64 nt, Human; identical to SEQ ID NO: 24815

SEQ ID NO: 103740 - RNA, 64 nt, Human; identical to SEQ ID NO: 24816

SEQ ID NO: 103741 - RNA, 64 nt, Human; identical to SEQ ID NO: 24817

SEQ ID NO: 103742 - RNA, 64 nt, Human; identical to SEQ ID NO: 24818

SEQ ID NO: 103743 - RNA, 64 nt, Human; identical to SEQ ID NO: 24819

SEQ ID NO: 103744 - RNA, 64 nt, Human; identical to SEQ ID NO: 24820

SEQ ID NO: 103745 - RNA, 64 nt, Human; identical to SEQ ID NO: 24821

SEQ ID NO: 103746 - RNA, 64 nt, Human; identical to SEQ ID NO: 24822

SEQ ID NO: 103747 - RNA, 64 nt, Human; identical to SEQ ID NO: 24823

SEQ ID NO: 103748 - RNA, 64 nt, Human; identical to SEQ ID NO: 24824

SEQ ID NO: 103749 - RNA, 64 nt, Human; identical to SEQ ID NO: 24825

SEQ ID NO: 103750 - RNA, 64 nt, Human; identical to SEQ ID NO: 24826

SEQ ID NO: 103751 - RNA, 64 nt, Human; identical to SEQ ID NO: 24827

SEQ ID NO: 103752 - RNA, 64 nt, Human; identical to SEQ ID NO: 24828

SEQ ID NO: 103753 - RNA, 64 nt, Human; identical to SEQ ID NO: 24829

SEQ ID NO: 103754 - RNA, 64 nt, Human; identical to SEQ ID NO: 24830

SEQ ID NO: 103755 - RNA, 64 nt, Human; identical to SEQ ID NO: 24831

SEQ ID NO: 103756 - RNA, 64 nt, Human; identical to SEQ ID NO: 24832

SEQ ID NO: 103757 - RNA, 64 nt, Human; identical to SEQ ID NO: 24833

SEQ ID NO: 103758 - RNA, 64 nt, Human; identical to SEQ ID NO: 24834

SEQ ID NO: 103759 - RNA, 64 nt, Human; identical to SEQ ID NO: 24835

SEQ ID NO: 103760 - RNA, 64 nt, Human; identical to SEQ ID NO: 24836

SEQ ID NO: 103761 - RNA, 64 nt, Human; identical to SEQ ID NO: 24837

SEQ ID NO: 103762 - RNA, 64 nt, Human; identical to SEQ ID NO: 24838

SEQ ID NO: 103763 - RNA, 64 nt, Human; identical to SEQ ID NO: 24839

SEQ ID NO: 103764 - RNA, 64 nt, Human; identical to SEQ ID NO: 24840

SEQ ID NO: 103765 - RNA, 64 nt, Human; identical to SEQ ID NO: 24841

SEQ ID NO: 103766 - RNA, 64 nt, Human; identical to SEQ ID NO: 24842

SEQ ID NO: 103767 - RNA, 64 nt, Human; identical to SEQ ID NO: 24843

SEQ ID NO: 103768 - RNA, 64 nt, Human; identical to SEQ ID NO: 24844

SEQ ID NO: 103769 - RNA, 64 nt, Human; identical to SEQ ID NO: 24845

SEQ ID NO: 103770 - RNA, 64 nt, Human; identical to SEQ ID NO: 24846

SEQ ID NO: 103771 - RNA, 64 nt, Human; identical to SEQ ID NO: 24847

SEQ ID NO: 103772 - RNA, 64 nt, Human; identical to SEQ ID NO: 24848

SEQ ID NO: 103773 - RNA, 64 nt, Human; identical to SEQ ID NO: 24849

SEQ ID NO: 103774 - RNA, 64 nt, Human; identical to SEQ ID NO: 24850

SEQ ID NO: 103775 - RNA, 64 nt, Human; identical to SEQ ID NO: 24851

SEQ ID NO: 103776 - RNA, 64 nt, Human; identical to SEQ ID NO: 24852

SEQ ID NO: 103777 - RNA, 64 nt, Human; identical to SEQ ID NO: 24853

SEQ ID NO: 103778 - RNA, 64 nt, Human; identical to SEQ ID NO: 24854

SEQ ID NO: 103779 - RNA, 64 nt, Human; identical to SEQ ID NO: 24855

SEQ ID NO: 103780 - RNA, 64 nt, Human; identical to SEQ ID NO: 24856

SEQ ID NO: 103781 - RNA, 64 nt, Human; identical to SEQ ID NO: 24857

SEQ ID NO: 103782 - RNA, 64 nt, Human; identical to SEQ ID NO: 24858

SEQ ID NO: 103783 - RNA, 64 nt, Human; identical to SEQ ID NO: 24859

SEQ ID NO: 103784 - RNA, 64 nt, Human; identical to SEQ ID NO: 24860

SEQ ID NO: 103785 - RNA, 64 nt, Human; identical to SEQ ID NO: 24861

SEQ ID NO: 103786 - RNA, 64 nt, Human; identical to SEQ ID NO: 24862

SEQ ID NO: 103787 - RNA, 64 nt, Human; identical to SEQ ID NO: 24863

SEQ ID NO: 103788 - RNA, 64 nt, Human; identical to SEQ ID NO: 24864

SEQ ID NO: 103789 - RNA, 64 nt, Human; identical to SEQ ID NO: 24865

SEQ ID NO: 103790 - RNA, 64 nt, Human; identical to SEQ ID NO: 24866

SEQ ID NO: 103791 - RNA, 64 nt, Human; identical to SEQ ID NO: 24867

SEQ ID NO: 103792 - RNA, 64 nt, Human; identical to SEQ ID NO: 24868

SEQ ID NO: 103793 - RNA, 64 nt, Human; identical to SEQ ID NO: 24869

SEQ ID NO: 103794 - RNA, 64 nt, Human; identical to SEQ ID NO: 24870

SEQ ID NO: 103795 - RNA, 64 nt, Human; identical to SEQ ID NO: 24871

SEQ ID NO: 103796 - RNA, 64 nt, Human; identical to SEQ ID NO: 24872

SEQ ID NO: 103797 - RNA, 64 nt, Human; identical to SEQ ID NO: 24873

SEQ ID NO: 103798 - RNA, 64 nt, Human; identical to SEQ ID NO: 24874

SEQ ID NO: 103799 - RNA, 64 nt, Human; identical to SEQ ID NO: 24875

SEQ ID NO: 103800 - RNA, 64 nt, Human; identical to SEQ ID NO: 24876

SEQ ID NO: 103801 - RNA, 64 nt, Human; identical to SEQ ID NO: 24877

SEQ ID NO: 103802 - RNA, 64 nt, Human; identical to SEQ ID NO: 24878

SEQ ID NO: 103803 - RNA, 64 nt, Human; identical to SEQ ID NO: 24879

SEQ ID NO: 103804 - RNA, 64 nt, Human; identical to SEQ ID NO: 24880

SEQ ID NO: 103805 - RNA, 64 nt, Human; identical to SEQ ID NO: 24881

SEQ ID NO: 103806 - RNA, 64 nt, Human; identical to SEQ ID NO: 24882

SEQ ID NO: 103807 - RNA, 64 nt, Human; identical to SEQ ID NO: 24883

SEQ ID NO: 103808 - RNA, 64 nt, Human; identical to SEQ ID NO: 24884

SEQ ID NO: 103809 - RNA, 64 nt, Human; identical to SEQ ID NO: 24885

SEQ ID NO: 103810 - RNA, 64 nt, Human; identical to SEQ ID NO: 24886

SEQ ID NO: 103811 - RNA, 64 nt, Human; identical to SEQ ID NO: 24887

SEQ ID NO: 103812 - RNA, 64 nt, Human; identical to SEQ ID NO: 24888

SEQ ID NO: 103813 - RNA, 64 nt, Human; identical to SEQ ID NO: 24889

SEQ ID NO: 103814 - RNA, 64 nt, Human; identical to SEQ ID NO: 24890

SEQ ID NO: 103815 - RNA, 64 nt, Human; identical to SEQ ID NO: 24891

SEQ ID NO: 103816 - RNA, 64 nt, Human; identical to SEQ ID NO: 24892

SEQ ID NO: 103817 - RNA, 64 nt, Human; identical to SEQ ID NO: 24893

SEQ ID NO: 103818 - RNA, 64 nt, Human; identical to SEQ ID NO: 24894

SEQ ID NO: 103819 - RNA, 64 nt, Human; identical to SEQ ID NO: 24895

SEQ ID NO: 103820 - RNA, 64 nt, Human; identical to SEQ ID NO: 24896

SEQ ID NO: 103821 - RNA, 64 nt, Human; identical to SEQ ID NO: 24897

SEQ ID NO: 103822 - RNA, 64 nt, Human; identical to SEQ ID NO: 24898

SEQ ID NO: 103823 - RNA, 64 nt, Human; identical to SEQ ID NO: 24899

SEQ ID NO: 103824 - RNA, 64 nt, Human; identical to SEQ ID NO: 24900

SEQ ID NO: 103825 - RNA, 64 nt, Human; identical to SEQ ID NO: 24901

SEQ ID NO: 103826 - RNA, 64 nt, Human; identical to SEQ ID NO: 24902

SEQ ID NO: 103827 - RNA, 64 nt, Human; identical to SEQ ID NO: 24903

SEQ ID NO: 103828 - RNA, 64 nt, Human; identical to SEQ ID NO: 24904

SEQ ID NO: 103829 - RNA, 64 nt, Human; identical to SEQ ID NO: 24905

SEQ ID NO: 103830 - RNA, 64 nt, Human; identical to SEQ ID NO: 24906

SEQ ID NO: 103831 - RNA, 64 nt, Human; identical to SEQ ID NO: 24907

SEQ ID NO: 103832 - RNA, 64 nt, Human; identical to SEQ ID NO: 24908

SEQ ID NO: 103833 - RNA, 64 nt, Human; identical to SEQ ID NO: 24909

SEQ ID NO: 103834 - RNA, 64 nt, Human; identical to SEQ ID NO: 24910

SEQ ID NO: 103835 - RNA, 64 nt, Human; identical to SEQ ID NO: 24911

SEQ ID NO: 103836 - RNA, 64 nt, Human; identical to SEQ ID NO: 24912

SEQ ID NO: 103837 - RNA, 64 nt, Human; identical to SEQ ID NO: 24913

SEQ ID NO: 103838 - RNA, 64 nt, Human; identical to SEQ ID NO: 24914

SEQ ID NO: 103839 - RNA, 64 nt, Human; identical to SEQ ID NO: 24915

SEQ ID NO: 103840 - RNA, 64 nt, Human; identical to SEQ ID NO: 24916

SEQ ID NO: 103841 - RNA, 64 nt, Human; identical to SEQ ID NO: 24917

SEQ ID NO: 103842 - RNA, 64 nt, Human; identical to SEQ ID NO: 24918

SEQ ID NO: 103843 - RNA, 64 nt, Human; identical to SEQ ID NO: 24919

SEQ ID NO: 103844 - RNA, 64 nt, Human; identical to SEQ ID NO: 24920

SEQ ID NO: 103845 - RNA, 64 nt, Human; identical to SEQ ID NO: 24921

SEQ ID NO: 103846 - RNA, 64 nt, Human; identical to SEQ ID NO: 24922

SEQ ID NO: 103847 - RNA, 64 nt, Human; identical to SEQ ID NO: 24923

SEQ ID NO: 103848 - RNA, 64 nt, Human; identical to SEQ ID NO: 24924

SEQ ID NO: 103849 - RNA, 64 nt, Human; identical to SEQ ID NO: 24925

SEQ ID NO: 103850 - RNA, 64 nt, Human; identical to SEQ ID NO: 24926

SEQ ID NO: 103851 - RNA, 64 nt, Human; identical to SEQ ID NO: 24927

SEQ ID NO: 103852 - RNA, 64 nt, Human; identical to SEQ ID NO: 24928

SEQ ID NO: 103853 - RNA, 64 nt, Human; identical to SEQ ID NO: 24929

SEQ ID NO: 103854 - RNA, 64 nt, Human; identical to SEQ ID NO: 24930

SEQ ID NO: 103855 - RNA, 64 nt, Human; identical to SEQ ID NO: 24931

SEQ ID NO: 103856 - RNA, 64 nt, Human; identical to SEQ ID NO: 24932

SEQ ID NO: 103857 - RNA, 64 nt, Human; identical to SEQ ID NO: 24933

SEQ ID NO: 103858 - RNA, 64 nt, Human; identical to SEQ ID NO: 24934

SEQ ID NO: 103859 - RNA, 64 nt, Human; identical to SEQ ID NO: 24935

SEQ ID NO: 103860 - RNA, 64 nt, Human; identical to SEQ ID NO: 24936

SEQ ID NO: 103861 - RNA, 64 nt, Human; identical to SEQ ID NO: 24937

SEQ ID NO: 103862 - RNA, 64 nt, Human; identical to SEQ ID NO: 24938

SEQ ID NO: 103863 - RNA, 64 nt, Human; identical to SEQ ID NO: 24939

SEQ ID NO: 103864 - RNA, 64 nt, Human; identical to SEQ ID NO: 24940

SEQ ID NO: 103865 - RNA, 64 nt, Human; identical to SEQ ID NO: 24941

SEQ ID NO: 103866 - RNA, 64 nt, Human; identical to SEQ ID NO: 24942

SEQ ID NO: 103867 - RNA, 64 nt, Human; identical to SEQ ID NO: 24943

SEQ ID NO: 103868 - RNA, 64 nt, Human; identical to SEQ ID NO: 24944

SEQ ID NO: 103869 - RNA, 64 nt, Human; identical to SEQ ID NO: 24945

SEQ ID NO: 103870 - RNA, 64 nt, Human; identical to SEQ ID NO: 24946

SEQ ID NO: 103871 - RNA, 50 nt, Human; identical to SEQ ID NO: 23806

SEQ ID NO: 103872 - RNA, 64 nt, Human; identical to SEQ ID NO: 24948

SEQ ID NO: 103873 - RNA, 64 nt, Human; identical to SEQ ID NO: 24949

SEQ ID NO: 103874 - RNA, 64 nt, Human; identical to SEQ ID NO: 24950

SEQ ID NO: 103875 - RNA, 64 nt, Human; identical to SEQ ID NO: 24951

SEQ ID NO: 103876 - RNA, 64 nt, Human; identical to SEQ ID NO: 24952

SEQ ID NO: 103877 - RNA, 64 nt, Human; identical to SEQ ID NO: 24953

SEQ ID NO: 103878 - RNA, 64 nt, Human; identical to SEQ ID NO: 24954

SEQ ID NO: 103879 - RNA, 64 nt, Human; identical to SEQ ID NO: 24955

SEQ ID NO: 103880 - RNA, 64 nt, Human; identical to SEQ ID NO: 24956

SEQ ID NO: 103881 - RNA, 64 nt, Human; identical to SEQ ID NO: 24957

SEQ ID NO: 103882 - RNA, 64 nt, Human; identical to SEQ ID NO: 24958

SEQ ID NO: 103883 - RNA, 64 nt, Human; identical to SEQ ID NO: 24959

SEQ ID NO: 103884 - RNA, 64 nt, Human; identical to SEQ ID NO: 24960

SEQ ID NO: 103885 - RNA, 64 nt, Human; identical to SEQ ID NO: 24961

SEQ ID NO: 103886 - RNA, 64 nt, Human; identical to SEQ ID NO: 24962

SEQ ID NO: 103887 - RNA, 64 nt, Human; identical to SEQ ID NO: 24963

SEQ ID NO: 103888 - RNA, 64 nt, Human; identical to SEQ ID NO: 24964

SEQ ID NO: 103889 - RNA, 64 nt, Human; identical to SEQ ID NO: 24965

SEQ ID NO: 103890 - RNA, 64 nt, Human; identical to SEQ ID NO: 24966

SEQ ID NO: 103891 - RNA, 64 nt, Human; identical to SEQ ID NO: 24967

SEQ ID NO: 103892 - RNA, 64 nt, Human; identical to SEQ ID NO: 24968

SEQ ID NO: 103893 - RNA, 64 nt, Human; identical to SEQ ID NO: 24969

SEQ ID NO: 103894 - RNA, 64 nt, Human; identical to SEQ ID NO: 24970

SEQ ID NO: 103895 - RNA, 64 nt, Human; identical to SEQ ID NO: 24971

SEQ ID NO: 103896 - RNA, 64 nt, Human; identical to SEQ ID NO: 24972

SEQ ID NO: 103897 - RNA, 64 nt, Human; identical to SEQ ID NO: 24973

SEQ ID NO: 103898 - RNA, 64 nt, Human; identical to SEQ ID NO: 24974

SEQ ID NO: 103899 - RNA, 64 nt, Human; identical to SEQ ID NO: 24975

SEQ ID NO: 103900 - RNA, 64 nt, Human; identical to SEQ ID NO: 24976

SEQ ID NO: 103901 - RNA, 64 nt, Human; identical to SEQ ID NO: 24977

SEQ ID NO: 103902 - RNA, 64 nt, Human; identical to SEQ ID NO: 24978

SEQ ID NO: 103903 - RNA, 64 nt, Human; identical to SEQ ID NO: 24979

SEQ ID NO: 103904 - RNA, 64 nt, Human; identical to SEQ ID NO: 24980

SEQ ID NO: 103905 - RNA, 64 nt, Human; identical to SEQ ID NO: 24981

SEQ ID NO: 103906 - RNA, 64 nt, Human; identical to SEQ ID NO: 24982

SEQ ID NO: 103907 - RNA, 64 nt, Human; identical to SEQ ID NO: 24983

SEQ ID NO: 103908 - RNA, 64 nt, Human; identical to SEQ ID NO: 24984

SEQ ID NO: 103909 - RNA, 64 nt, Human; identical to SEQ ID NO: 24985

SEQ ID NO: 103910 - RNA, 64 nt, Human; identical to SEQ ID NO: 24986

SEQ ID NO: 103911 - RNA, 64 nt, Human; identical to SEQ ID NO: 24987

SEQ ID NO: 103912 - RNA, 64 nt, Human; identical to SEQ ID NO: 24988

SEQ ID NO: 103913 - RNA, 64 nt, Human; identical to SEQ ID NO: 24989

SEQ ID NO: 103914 - RNA, 64 nt, Human; identical to SEQ ID NO: 24990

SEQ ID NO: 103915 - RNA, 64 nt, Human; identical to SEQ ID NO: 24991

SEQ ID NO: 103916 - RNA, 64 nt, Human; identical to SEQ ID NO: 24992

SEQ ID NO: 103917 - RNA, 64 nt, Human; identical to SEQ ID NO: 24993

SEQ ID NO: 103918 - RNA, 64 nt, Human; identical to SEQ ID NO: 24994

SEQ ID NO: 103919 - RNA, 64 nt, Human; identical to SEQ ID NO: 24995

SEQ ID NO: 103920 - RNA, 64 nt, Human; identical to SEQ ID NO: 24996

SEQ ID NO: 103921 - RNA, 64 nt, Human; identical to SEQ ID NO: 24997

SEQ ID NO: 103922 - RNA, 64 nt, Human; identical to SEQ ID NO: 24998

SEQ ID NO: 103923 - RNA, 64 nt, Human; identical to SEQ ID NO: 24999

SEQ ID NO: 103924 - RNA, 64 nt, Human; identical to SEQ ID NO: 25000

SEQ ID NO: 103925 - RNA, 64 nt, Human; identical to SEQ ID NO: 25001

SEQ ID NO: 103926 - RNA, 64 nt, Human; identical to SEQ ID NO: 25002

SEQ ID NO: 103927 - RNA, 64 nt, Human; identical to SEQ ID NO: 25003

SEQ ID NO: 103928 - RNA, 64 nt, Human; identical to SEQ ID NO: 25004

SEQ ID NO: 103929 - RNA, 64 nt, Human; identical to SEQ ID NO: 25005

SEQ ID NO: 103930 - RNA, 64 nt, Human; identical to SEQ ID NO: 24970

SEQ ID NO: 103931 - RNA, 64 nt, Human; identical to SEQ ID NO: 25007

SEQ ID NO: 103932 - RNA, 64 nt, Human; identical to SEQ ID NO: 25008

SEQ ID NO: 103933 - RNA, 64 nt, Human; identical to SEQ ID NO: 25009

SEQ ID NO: 103934 - RNA, 58 nt, Human; identical to SEQ ID NO: 23869

SEQ ID NO: 103935 - RNA, 64 nt, Human; identical to SEQ ID NO: 25011

SEQ ID NO: 103936 - RNA, 64 nt, Human; identical to SEQ ID NO: 25012

SEQ ID NO: 103937 - RNA, 64 nt, Human; identical to SEQ ID NO: 25013

SEQ ID NO: 103938 - RNA, 64 nt, Human; identical to SEQ ID NO: 25014

SEQ ID NO: 103939 - RNA, 64 nt, Human; identical to SEQ ID NO: 25015

SEQ ID NO: 103940 - RNA, 64 nt, Human; identical to SEQ ID NO: 25016

SEQ ID NO: 103941 - RNA, 64 nt, Human; identical to SEQ ID NO: 25017

SEQ ID NO: 103942 - RNA, 64 nt, Human; identical to SEQ ID NO: 25018

SEQ ID NO: 103943 - RNA, 64 nt, Human; identical to SEQ ID NO: 25019

SEQ ID NO: 103944 - RNA, 64 nt, Human; identical to SEQ ID NO: 25020

SEQ ID NO: 103945 - RNA, 64 nt, Human; identical to SEQ ID NO: 25021

SEQ ID NO: 103946 - RNA, 64 nt, Human; identical to SEQ ID NO: 25022

SEQ ID NO: 103947 - RNA, 55 nt, Human; identical to SEQ ID NO: 23882

SEQ ID NO: 103948 - RNA, 64 nt, Human; identical to SEQ ID NO: 25024

SEQ ID NO: 103949 - RNA, 64 nt, Human; identical to SEQ ID NO: 25025

SEQ ID NO: 103950 - RNA, 64 nt, Human; identical to SEQ ID NO: 25026

SEQ ID NO: 103951 - RNA, 64 nt, Human; identical to SEQ ID NO: 25027

SEQ ID NO: 103952 - RNA, 64 nt, Human; identical to SEQ ID NO: 25028

SEQ ID NO: 103953 - RNA, 64 nt, Human; identical to SEQ ID NO: 25029

SEQ ID NO: 103954 - RNA, 64 nt, Human; identical to SEQ ID NO: 25030

SEQ ID NO: 103955 - RNA, 64 nt, Human; identical to SEQ ID NO: 25031

SEQ ID NO: 103956 - RNA, 64 nt, Human; identical to SEQ ID NO: 25032

SEQ ID NO: 103957 - RNA, 64 nt, Human; identical to SEQ ID NO: 25033

SEQ ID NO: 103958 - RNA, 64 nt, Human; identical to SEQ ID NO: 25034

SEQ ID NO: 103959 - RNA, 64 nt, Human; identical to SEQ ID NO: 25035

SEQ ID NO: 103960 - RNA, 64 nt, Human; identical to SEQ ID NO: 25036

SEQ ID NO: 103961 - RNA, 64 nt, Human; identical to SEQ ID NO: 25037

SEQ ID NO: 103962 - RNA, 64 nt, Human; identical to SEQ ID NO: 25038

SEQ ID NO: 103963 - RNA, 64 nt, Human; identical to SEQ ID NO: 25039

SEQ ID NO: 103964 - RNA, 64 nt, Human; identical to SEQ ID NO: 25040

SEQ ID NO: 103965 - RNA, 64 nt, Human; identical to SEQ ID NO: 25041

SEQ ID NO: 103966 - RNA, 64 nt, Human; identical to SEQ ID NO: 25042

SEQ ID NO: 103967 - RNA, 64 nt, Human; identical to SEQ ID NO: 25043

SEQ ID NO: 103968 - RNA, 64 nt, Human; identical to SEQ ID NO: 25044

SEQ ID NO: 103969 - RNA, 64 nt, Human; identical to SEQ ID NO: 25045

SEQ ID NO: 103970 - RNA, 64 nt, Human; identical to SEQ ID NO: 25046

SEQ ID NO: 103971 - RNA, 64 nt, Human; identical to SEQ ID NO: 25047

SEQ ID NO: 103972 - RNA, 64 nt, Human; identical to SEQ ID NO: 25048

SEQ ID NO: 103973 - RNA, 64 nt, Human; identical to SEQ ID NO: 25049

SEQ ID NO: 103974 - RNA, 64 nt, Human; identical to SEQ ID NO: 25050

SEQ ID NO: 103975 - RNA, 64 nt, Human; identical to SEQ ID NO: 25051

SEQ ID NO: 103976 - RNA, 64 nt, Human; identical to SEQ ID NO: 25052

SEQ ID NO: 103977 - RNA, 64 nt, Human; identical to SEQ ID NO: 25053

SEQ ID NO: 103978 - RNA, 64 nt, Human; identical to SEQ ID NO: 25054

SEQ ID NO: 103979 - RNA, 64 nt, Human; identical to SEQ ID NO: 25055

SEQ ID NO: 103980 - RNA, 64 nt, Human; identical to SEQ ID NO: 25056

SEQ ID NO: 103981 - RNA, 64 nt, Human; identical to SEQ ID NO: 25057

SEQ ID NO: 103982 - RNA, 64 nt, Human; identical to SEQ ID NO: 25058

SEQ ID NO: 103983 - RNA, 64 nt, Human; identical to SEQ ID NO: 25059

SEQ ID NO: 103984 - RNA, 64 nt, Human; identical to SEQ ID NO: 25060

SEQ ID NO: 103985 - RNA, 64 nt, Human; identical to SEQ ID NO: 25061

SEQ ID NO: 103986 - RNA, 64 nt, Human; identical to SEQ ID NO: 25062

SEQ ID NO: 103987 - RNA, 64 nt, Human; identical to SEQ ID NO: 25063

SEQ ID NO: 103988 - RNA, 64 nt, Human; identical to SEQ ID NO: 25064

SEQ ID NO: 103989 - RNA, 64 nt, Human; identical to SEQ ID NO: 25065

SEQ ID NO: 103990 - RNA, 64 nt, Human; identical to SEQ ID NO: 25066

SEQ ID NO: 103991 - RNA, 64 nt, Human; identical to SEQ ID NO: 25067

SEQ ID NO: 103992 - RNA, 64 nt, Human; identical to SEQ ID NO: 25068

SEQ ID NO: 103993 - RNA, 64 nt, Human; identical to SEQ ID NO: 25069

SEQ ID NO: 103994 - RNA, 64 nt, Human; identical to SEQ ID NO: 25070

SEQ ID NO: 103995 - RNA, 64 nt, Human; identical to SEQ ID NO: 25071

SEQ ID NO: 103996 - RNA, 64 nt, Human; identical to SEQ ID NO: 25072

SEQ ID NO: 103997 - RNA, 64 nt, Human; identical to SEQ ID NO: 25073

SEQ ID NO: 103998 - RNA, 64 nt, Human; identical to SEQ ID NO: 25074

SEQ ID NO: 103999 - RNA, 64 nt, Human; identical to SEQ ID NO: 25075

SEQ ID NO: 104000 - RNA, 64 nt, Human; identical to SEQ ID NO: 25076

SEQ ID NO: 104001 - RNA, 62 nt, Human; identical to SEQ ID NO: 25077

SEQ ID NO: 104002 - RNA, 64 nt, Human; identical to SEQ ID NO: 25078

SEQ ID NO: 104003 - RNA, 64 nt, Human; identical to SEQ ID NO: 25079

SEQ ID NO: 104004 - RNA, 64 nt, Human; identical to SEQ ID NO: 25080

SEQ ID NO: 104005 - RNA, 64 nt, Human; identical to SEQ ID NO: 25081

SEQ ID NO: 104006 - RNA, 64 nt, Human; identical to SEQ ID NO: 25082

SEQ ID NO: 104007 - RNA, 64 nt, Human; identical to SEQ ID NO: 25083

SEQ ID NO: 104008 - RNA, 64 nt, Human; identical to SEQ ID NO: 25084

SEQ ID NO: 104009 - RNA, 64 nt, Human; identical to SEQ ID NO: 25085

SEQ ID NO: 104010 - RNA, 64 nt, Human; identical to SEQ ID NO: 25086

SEQ ID NO: 104011 - RNA, 64 nt, Human; identical to SEQ ID NO: 25087

SEQ ID NO: 104012 - RNA, 64 nt, Human; identical to SEQ ID NO: 25088

SEQ ID NO: 104013 - RNA, 64 nt, Human; identical to SEQ ID NO: 25089

SEQ ID NO: 104014 - RNA, 64 nt, Human; identical to SEQ ID NO: 25090

SEQ ID NO: 104015 - RNA, 64 nt, Human; identical to SEQ ID NO: 25091

SEQ ID NO: 104016 - RNA, 64 nt, Human; identical to SEQ ID NO: 25092

SEQ ID NO: 104017 - RNA, 64 nt, Human; identical to SEQ ID NO: 25093

SEQ ID NO: 104018 - RNA, 64 nt, Human; identical to SEQ ID NO: 25094

SEQ ID NO: 104019 - RNA, 64 nt, Human; identical to SEQ ID NO: 25095

SEQ ID NO: 104020 - RNA, 64 nt, Human; identical to SEQ ID NO: 25096

SEQ ID NO: 104021 - RNA, 64 nt, Human; identical to SEQ ID NO: 25097

SEQ ID NO: 104022 - RNA, 64 nt, Human; identical to SEQ ID NO: 25098

SEQ ID NO: 104023 - RNA, 64 nt, Human; identical to SEQ ID NO: 25099

SEQ ID NO: 104024 - RNA, 64 nt, Human; identical to SEQ ID NO: 25100

SEQ ID NO: 104025 - RNA, 64 nt, Human; identical to SEQ ID NO: 25101

SEQ ID NO: 104026 - RNA, 64 nt, Human; identical to SEQ ID NO: 25102

SEQ ID NO: 104027 - RNA, 64 nt, Human; identical to SEQ ID NO: 25103

SEQ ID NO: 104028 - RNA, 60 nt, Human; identical to SEQ ID NO: 23963

SEQ ID NO: 104029 - RNA, 64 nt, Human; identical to SEQ ID NO: 25105

SEQ ID NO: 104030 - RNA, 64 nt, Human; identical to SEQ ID NO: 25106

SEQ ID NO: 104031 - RNA, 64 nt, Human; identical to SEQ ID NO: 25107

SEQ ID NO: 104032 - RNA, 64 nt, Human; identical to SEQ ID NO: 25108

SEQ ID NO: 104033 - RNA, 64 nt, Human; identical to SEQ ID NO: 25109

SEQ ID NO: 104034 - RNA, 64 nt, Human; identical to SEQ ID NO: 25110

SEQ ID NO: 104035 - RNA, 64 nt, Human; identical to SEQ ID NO: 25111

SEQ ID NO: 104036 - RNA, 64 nt, Human; identical to SEQ ID NO: 25112

SEQ ID NO: 104037 - RNA, 64 nt, Human; identical to SEQ ID NO: 25113

SEQ ID NO: 104038 - RNA, 64 nt, Human; identical to SEQ ID NO: 25114

SEQ ID NO: 104039 - RNA, 64 nt, Human; identical to SEQ ID NO: 25115

SEQ ID NO: 104040 - RNA, 64 nt, Human; identical to SEQ ID NO: 25116

SEQ ID NO: 104041 - RNA, 64 nt, Human; identical to SEQ ID NO: 25117

SEQ ID NO: 104042 - RNA, 64 nt, Human; identical to SEQ ID NO: 25118

SEQ ID NO: 104043 - RNA, 64 nt, Human; identical to SEQ ID NO: 25119

SEQ ID NO: 104044 - RNA, 64 nt, Human; identical to SEQ ID NO: 25120

SEQ ID NO: 104045 - RNA, 64 nt, Human; identical to SEQ ID NO: 25121

SEQ ID NO: 104046 - RNA, 64 nt, Human; identical to SEQ ID NO: 25122

SEQ ID NO: 104047 - RNA, 64 nt, Human; identical to SEQ ID NO: 25123

SEQ ID NO: 104048 - RNA, 64 nt, Human; identical to SEQ ID NO: 25124

SEQ ID NO: 104049 - RNA, 64 nt, Human; identical to SEQ ID NO: 25125

SEQ ID NO: 104050 - RNA, 64 nt, Human; identical to SEQ ID NO: 25126

SEQ ID NO: 104051 - RNA, 64 nt, Human; identical to SEQ ID NO: 25127

SEQ ID NO: 104052 - RNA, 64 nt, Human; identical to SEQ ID NO: 25128

SEQ ID NO: 104053 - RNA, 64 nt, Human; identical to SEQ ID NO: 25129

SEQ ID NO: 104054 - RNA, 64 nt, Human; identical to SEQ ID NO: 25130

SEQ ID NO: 104055 - RNA, 64 nt, Human; identical to SEQ ID NO: 25131

SEQ ID NO: 104056 - RNA, 64 nt, Human; identical to SEQ ID NO: 25132

SEQ ID NO: 104057 - RNA, 64 nt, Human; identical to SEQ ID NO: 25133

SEQ ID NO: 104058 - RNA, 64 nt, Human; identical to SEQ ID NO: 25134

SEQ ID NO: 104059 - RNA, 64 nt, Human; identical to SEQ ID NO: 25135

SEQ ID NO: 104060 - RNA, 64 nt, Human; identical to SEQ ID NO: 25136

SEQ ID NO: 104061 - RNA, 64 nt, Human; identical to SEQ ID NO: 25137

SEQ ID NO: 104062 - RNA, 64 nt, Human; identical to SEQ ID NO: 25138

SEQ ID NO: 104063 - RNA, 64 nt, Human; identical to SEQ ID NO: 25139

SEQ ID NO: 104064 - RNA, 64 nt, Human; identical to SEQ ID NO: 25140

SEQ ID NO: 104065 - RNA, 64 nt, Human; identical to SEQ ID NO: 25141

SEQ ID NO: 104066 - RNA, 64 nt, Human; identical to SEQ ID NO: 25142

SEQ ID NO: 104067 - RNA, 64 nt, Human; identical to SEQ ID NO: 25143

SEQ ID NO: 104068 - RNA, 64 nt, Human; identical to SEQ ID NO: 25144

SEQ ID NO: 104069 - RNA, 64 nt, Human; identical to SEQ ID NO: 25145

SEQ ID NO: 104070 - RNA, 64 nt, Human; identical to SEQ ID NO: 25146

SEQ ID NO: 104071 - RNA, 64 nt, Human; identical to SEQ ID NO: 25147

SEQ ID NO: 104072 - RNA, 64 nt, Human; identical to SEQ ID NO: 25148

SEQ ID NO: 104073 - RNA, 64 nt, Human; identical to SEQ ID NO: 25149

SEQ ID NO: 104074 - RNA, 64 nt, Human; identical to SEQ ID NO: 25150

SEQ ID NO: 104075 - RNA, 64 nt, Human; identical to SEQ ID NO: 25151

SEQ ID NO: 104076 - RNA, 64 nt, Human; identical to SEQ ID NO: 25152

SEQ ID NO: 104077 - RNA, 64 nt, Human; identical to SEQ ID NO: 25153

SEQ ID NO: 104078 - RNA, 64 nt, Human; identical to SEQ ID NO: 25154

SEQ ID NO: 104079 - RNA, 64 nt, Human; identical to SEQ ID NO: 25155

SEQ ID NO: 104080 - RNA, 64 nt, Human; identical to SEQ ID NO: 25156

SEQ ID NO: 104081 - RNA, 64 nt, Human; identical to SEQ ID NO: 25157

SEQ ID NO: 104082 - RNA, 64 nt, Human; identical to SEQ ID NO: 25158

SEQ ID NO: 104083 - RNA, 64 nt, Human; identical to SEQ ID NO: 25159

SEQ ID NO: 104084 - RNA, 64 nt, Human; identical to SEQ ID NO: 25160

SEQ ID NO: 104085 - RNA, 64 nt, Human; identical to SEQ ID NO: 25161

SEQ ID NO: 104086 - RNA, 64 nt, Human; identical to SEQ ID NO: 25162

SEQ ID NO: 104087 - RNA, 64 nt, Human; identical to SEQ ID NO: 25163

SEQ ID NO: 104088 - RNA, 64 nt, Human; identical to SEQ ID NO: 25164

SEQ ID NO: 104089 - RNA, 64 nt, Human; identical to SEQ ID NO: 25165

SEQ ID NO: 104090 - RNA, 64 nt, Human; identical to SEQ ID NO: 25166

SEQ ID NO: 104091 - RNA, 64 nt, Human; identical to SEQ ID NO: 25167

SEQ ID NO: 104092 - RNA, 64 nt, Human; identical to SEQ ID NO: 25168

SEQ ID NO: 104093 - RNA, 64 nt, Human; identical to SEQ ID NO: 25169

SEQ ID NO: 104094 - RNA, 64 nt, Human; identical to SEQ ID NO: 25170

SEQ ID NO: 104095 - RNA, 64 nt, Human; identical to SEQ ID NO: 25171

SEQ ID NO: 104096 - RNA, 64 nt, Human; identical to SEQ ID NO: 25172

SEQ ID NO: 104097 - RNA, 64 nt, Human; identical to SEQ ID NO: 25173

SEQ ID NO: 104098 - RNA, 64 nt, Human; identical to SEQ ID NO: 25174

SEQ ID NO: 104099 - RNA, 64 nt, Human; identical to SEQ ID NO: 25175

SEQ ID NO: 104100 - RNA, 51 nt, Human; identical to SEQ ID NO: 24035

SEQ ID NO: 104101 - RNA, 64 nt, Human; identical to SEQ ID NO: 25177

SEQ ID NO: 104102 - RNA, 64 nt, Human; identical to SEQ ID NO: 25178

SEQ ID NO: 104103 - RNA, 64 nt, Human; identical to SEQ ID NO: 25179

SEQ ID NO: 104104 - RNA, 64 nt, Human; identical to SEQ ID NO: 25180

SEQ ID NO: 104105 - RNA, 64 nt, Human; identical to SEQ ID NO: 25181

SEQ ID NO: 104106 - RNA, 64 nt, Human; identical to SEQ ID NO: 25182

SEQ ID NO: 104107 - RNA, 64 nt, Human; identical to SEQ ID NO: 25183

SEQ ID NO: 104108 - RNA, 64 nt, Human; identical to SEQ ID NO: 25184

SEQ ID NO: 104109 - RNA, 64 nt, Human; identical to SEQ ID NO: 25185

SEQ ID NO: 104110 - RNA, 64 nt, Human; identical to SEQ ID NO: 25186

SEQ ID NO: 104111 - RNA, 64 nt, Human; identical to SEQ ID NO: 25187

SEQ ID NO: 104112 - RNA, 64 nt, Human; identical to SEQ ID NO: 25188

SEQ ID NO: 104113 - RNA, 64 nt, Human; identical to SEQ ID NO: 25189

SEQ ID NO: 104114 - RNA, 64 nt, Human; identical to SEQ ID NO: 25190

SEQ ID NO: 104115 - RNA, 64 nt, Human; identical to SEQ ID NO: 25191

SEQ ID NO: 104116 - RNA, 64 nt, Human; identical to SEQ ID NO: 25192

SEQ ID NO: 104117 - RNA, 64 nt, Human; identical to SEQ ID NO: 25193

SEQ ID NO: 104118 - RNA, 64 nt, Human; identical to SEQ ID NO: 25194

SEQ ID NO: 104119 - RNA, 64 nt, Human; identical to SEQ ID NO: 25195

SEQ ID NO: 104120 - RNA, 64 nt, Human; identical to SEQ ID NO: 25196

SEQ ID NO: 104121 - RNA, 64 nt, Human; identical to SEQ ID NO: 25197

SEQ ID NO: 104122 - RNA, 64 nt, Human; identical to SEQ ID NO: 25198

SEQ ID NO: 104123 - RNA, 64 nt, Human; identical to SEQ ID NO: 25199

SEQ ID NO: 104124 - RNA, 64 nt, Human; identical to SEQ ID NO: 25200

SEQ ID NO: 104125 - RNA, 64 nt, Human; identical to SEQ ID NO: 25201

SEQ ID NO: 104126 - RNA, 64 nt, Human; identical to SEQ ID NO: 25202

SEQ ID NO: 104127 - RNA, 64 nt, Human; identical to SEQ ID NO: 25203

SEQ ID NO: 104128 - RNA, 64 nt, Human; identical to SEQ ID NO: 25204

SEQ ID NO: 104129 - RNA, 64 nt, Human; identical to SEQ ID NO: 25205

SEQ ID NO: 104130 - RNA, 64 nt, Human; identical to SEQ ID NO: 25206

SEQ ID NO: 104131 - RNA, 64 nt, Human; identical to SEQ ID NO: 25207

SEQ ID NO: 104132 - RNA, 64 nt, Human; identical to SEQ ID NO: 25208

SEQ ID NO: 104133 - RNA, 64 nt, Human; identical to SEQ ID NO: 25209

SEQ ID NO: 104134 - RNA, 64 nt, Human; identical to SEQ ID NO: 25210

SEQ ID NO: 104135 - RNA, 64 nt, Human; identical to SEQ ID NO: 25211

SEQ ID NO: 104136 - RNA, 64 nt, Human; identical to SEQ ID NO: 25212

SEQ ID NO: 104137 - RNA, 57 nt, Human; identical to SEQ ID NO: 24072

SEQ ID NO: 104138 - RNA, 64 nt, Human; identical to SEQ ID NO: 25214

SEQ ID NO: 104139 - RNA, 64 nt, Human; identical to SEQ ID NO: 25215

SEQ ID NO: 104140 - RNA, 64 nt, Human; identical to SEQ ID NO: 25216

SEQ ID NO: 104141 - RNA, 64 nt, Human; identical to SEQ ID NO: 25217

SEQ ID NO: 104142 - RNA, 64 nt, Human; identical to SEQ ID NO: 25218

SEQ ID NO: 104143 - RNA, 64 nt, Human; identical to SEQ ID NO: 25219

SEQ ID NO: 104144 - RNA, 64 nt, Human; identical to SEQ ID NO: 25220

SEQ ID NO: 104145 - RNA, 64 nt, Human; identical to SEQ ID NO: 25221

SEQ ID NO: 104146 - RNA, 64 nt, Human; identical to SEQ ID NO: 25222

SEQ ID NO: 104147 - RNA, 64 nt, Human; identical to SEQ ID NO: 25223

SEQ ID NO: 104148 - RNA, 64 nt, Human; identical to SEQ ID NO: 25224

SEQ ID NO: 104149 - RNA, 64 nt, Human; identical to SEQ ID NO: 25225

SEQ ID NO: 104150 - RNA, 64 nt, Human; identical to SEQ ID NO: 25226

SEQ ID NO: 104151 - RNA, 64 nt, Human; identical to SEQ ID NO: 25227

SEQ ID NO: 104152 - RNA, 64 nt, Human; identical to SEQ ID NO: 25228

SEQ ID NO: 104153 - RNA, 64 nt, Human; identical to SEQ ID NO: 25229

SEQ ID NO: 104154 - RNA, 64 nt, Human; identical to SEQ ID NO: 25230

SEQ ID NO: 104155 - RNA, 64 nt, Human; identical to SEQ ID NO: 25231

SEQ ID NO: 104156 - RNA, 64 nt, Human; identical to SEQ ID NO: 25232

SEQ ID NO: 104157 - RNA, 64 nt, Human; identical to SEQ ID NO: 25233

SEQ ID NO: 104158 - RNA, 64 nt, Human; identical to SEQ ID NO: 25234

SEQ ID NO: 104159 - RNA, 64 nt, Human; identical to SEQ ID NO: 25235

SEQ ID NO: 104160 - RNA, 64 nt, Human; identical to SEQ ID NO: 25236

SEQ ID NO: 104161 - RNA, 64 nt, Human; identical to SEQ ID NO: 25237

SEQ ID NO: 104162 - RNA, 64 nt, Human; identical to SEQ ID NO: 25238

SEQ ID NO: 104163 - RNA, 64 nt, Human; identical to SEQ ID NO: 25239

SEQ ID NO: 104164 - RNA, 64 nt, Human; identical to SEQ ID NO: 25240

SEQ ID NO: 104165 - RNA, 64 nt, Human; identical to SEQ ID NO: 25241

SEQ ID NO: 104166 - RNA, 64 nt, Human; identical to SEQ ID NO: 25242

SEQ ID NO: 104167 - RNA, 64 nt, Human; identical to SEQ ID NO: 25243

SEQ ID NO: 104168 - RNA, 64 nt, Human; identical to SEQ ID NO: 25244

SEQ ID NO: 104169 - RNA, 64 nt, Human; identical to SEQ ID NO: 25245

SEQ ID NO: 104170 - RNA, 64 nt, Human; identical to SEQ ID NO: 25246

SEQ ID NO: 104171 - RNA, 64 nt, Human; identical to SEQ ID NO: 25247

SEQ ID NO: 104172 - RNA, 64 nt, Human; identical to SEQ ID NO: 25248

SEQ ID NO: 104173 - RNA, 64 nt, Human; identical to SEQ ID NO: 25249

SEQ ID NO: 104174 - RNA, 64 nt, Human; identical to SEQ ID NO: 25250

SEQ ID NO: 104175 - RNA, 64 nt, Human; identical to SEQ ID NO: 25251

SEQ ID NO: 104176 - RNA, 64 nt, Human; identical to SEQ ID NO: 25252

SEQ ID NO: 104177 - RNA, 64 nt, Human; identical to SEQ ID NO: 25253

SEQ ID NO: 104178 - RNA, 64 nt, Human; identical to SEQ ID NO: 25254

SEQ ID NO: 104179 - RNA, 64 nt, Human; identical to SEQ ID NO: 25255

SEQ ID NO: 104180 - RNA, 64 nt, Human; identical to SEQ ID NO: 25256

SEQ ID NO: 104181 - RNA, 64 nt, Human; identical to SEQ ID NO: 25257

SEQ ID NO: 104182 - RNA, 64 nt, Human; identical to SEQ ID NO: 25258

SEQ ID NO: 104183 - RNA, 64 nt, Human; identical to SEQ ID NO: 25259

SEQ ID NO: 104184 - RNA, 64 nt, Human; identical to SEQ ID NO: 25260

SEQ ID NO: 104185 - RNA, 64 nt, Human; identical to SEQ ID NO: 25261

SEQ ID NO: 104186 - RNA, 64 nt, Human; identical to SEQ ID NO: 25262

SEQ ID NO: 104187 - RNA, 64 nt, Human; identical to SEQ ID NO: 25263

SEQ ID NO: 104188 - RNA, 64 nt, Human; identical to SEQ ID NO: 25264

SEQ ID NO: 104189 - RNA, 64 nt, Human; identical to SEQ ID NO: 25265

SEQ ID NO: 104190 - RNA, 64 nt, Human; identical to SEQ ID NO: 25266

SEQ ID NO: 104191 - RNA, 64 nt, Human; identical to SEQ ID NO: 25267

SEQ ID NO: 104192 - RNA, 64 nt, Human; identical to SEQ ID NO: 25268

SEQ ID NO: 104193 - RNA, 64 nt, Human; identical to SEQ ID NO: 25269

SEQ ID NO: 104194 - RNA, 64 nt, Human; identical to SEQ ID NO: 25270

SEQ ID NO: 104195 - RNA, 64 nt, Human; identical to SEQ ID NO: 25271

SEQ ID NO: 104196 - RNA, 64 nt, Human; identical to SEQ ID NO: 25272

SEQ ID NO: 104197 - RNA, 64 nt, Human; identical to SEQ ID NO: 25273

SEQ ID NO: 104198 - RNA, 64 nt, Human; identical to SEQ ID NO: 25274

SEQ ID NO: 104199 - RNA, 64 nt, Human; identical to SEQ ID NO: 25275

SEQ ID NO: 104200 - RNA, 64 nt, Human; identical to SEQ ID NO: 25276

SEQ ID NO: 104201 - RNA, 64 nt, Human; identical to SEQ ID NO: 25277

SEQ ID NO: 104202 - RNA, 64 nt, Human; identical to SEQ ID NO: 25278

SEQ ID NO: 104203 - RNA, 64 nt, Human; identical to SEQ ID NO: 25279

SEQ ID NO: 104204 - RNA, 64 nt, Human; identical to SEQ ID NO: 25280

SEQ ID NO: 104205 - RNA, 64 nt, Human; identical to SEQ ID NO: 25281

SEQ ID NO: 104206 - RNA, 64 nt, Human; identical to SEQ ID NO: 25282

SEQ ID NO: 104207 - RNA, 64 nt, Human; identical to SEQ ID NO: 25283

SEQ ID NO: 104208 - RNA, 64 nt, Human; identical to SEQ ID NO: 25284

SEQ ID NO: 104209 - RNA, 64 nt, Human; identical to SEQ ID NO: 25284

SEQ ID NO: 104210 - RNA, 64 nt, Human; identical to SEQ ID NO: 25286

SEQ ID NO: 104211 - RNA, 64 nt, Human; identical to SEQ ID NO: 25287

SEQ ID NO: 104212 - RNA, 64 nt, Human; identical to SEQ ID NO: 25288

SEQ ID NO: 104213 - RNA, 64 nt, Human; identical to SEQ ID NO: 25289

SEQ ID NO: 104214 - RNA, 64 nt, Human; identical to SEQ ID NO: 25290

SEQ ID NO: 104215 - RNA, 64 nt, Human; identical to SEQ ID NO: 25291

SEQ ID NO: 104216 - RNA, 64 nt, Human; identical to SEQ ID NO: 25292

SEQ ID NO: 104217 - RNA, 64 nt, Human; identical to SEQ ID NO: 25293

SEQ ID NO: 104218 - RNA, 64 nt, Human; identical to SEQ ID NO: 25294

SEQ ID NO: 104219 - RNA, 64 nt, Human; identical to SEQ ID NO: 25295

SEQ ID NO: 104220 - RNA, 64 nt, Human; identical to SEQ ID NO: 25296

SEQ ID NO: 104221 - RNA, 64 nt, Human; identical to SEQ ID NO: 25297

SEQ ID NO: 104222 - RNA, 64 nt, Human; identical to SEQ ID NO: 25298

SEQ ID NO: 104223 - RNA, 64 nt, Human; identical to SEQ ID NO: 25299

SEQ ID NO: 104224 - RNA, 64 nt, Human; identical to SEQ ID NO: 25300

SEQ ID NO: 104225 - RNA, 64 nt, Human; identical to SEQ ID NO: 25301

SEQ ID NO: 104226 - RNA, 64 nt, Human; identical to SEQ ID NO: 25302

SEQ ID NO: 104227 - RNA, 64 nt, Human; identical to SEQ ID NO: 25303

SEQ ID NO: 104228 - RNA, 64 nt, Human; identical to SEQ ID NO: 25304

SEQ ID NO: 104229 - RNA, 64 nt, Human; identical to SEQ ID NO: 25305

SEQ ID NO: 104230 - RNA, 64 nt, Human; identical to SEQ ID NO: 25306

SEQ ID NO: 104231 - RNA, 64 nt, Human; identical to SEQ ID NO: 25307

SEQ ID NO: 104232 - RNA, 64 nt, Human; identical to SEQ ID NO: 25308

SEQ ID NO: 104233 - RNA, 64 nt, Human; identical to SEQ ID NO: 25309

SEQ ID NO: 104234 - RNA, 64 nt, Human; identical to SEQ ID NO: 25310

SEQ ID NO: 104235 - RNA, 64 nt, Human; identical to SEQ ID NO: 25311

SEQ ID NO: 104236 - RNA, 64 nt, Human; identical to SEQ ID NO: 25312

SEQ ID NO: 104237 - RNA, 64 nt, Human; identical to SEQ ID NO: 25313

SEQ ID NO: 104238 - RNA, 64 nt, Human; identical to SEQ ID NO: 25314

SEQ ID NO: 104239 - RNA, 64 nt, Human; identical to SEQ ID NO: 25315

SEQ ID NO: 104240 - RNA, 64 nt, Human; identical to SEQ ID NO: 25316

SEQ ID NO: 104241 - RNA, 64 nt, Human; identical to SEQ ID NO: 25317

SEQ ID NO: 104242 - RNA, 64 nt, Human; identical to SEQ ID NO: 25318

SEQ ID NO: 104243 - RNA, 64 nt, Human; identical to SEQ ID NO: 25319

SEQ ID NO: 104244 - RNA, 63 nt, Human; identical to SEQ ID NO: 25320

SEQ ID NO: 104245 - RNA, 64 nt, Human; identical to SEQ ID NO: 25321

SEQ ID NO: 104246 - RNA, 64 nt, Human; identical to SEQ ID NO: 25322

SEQ ID NO: 104247 - RNA, 64 nt, Human; identical to SEQ ID NO: 25323

SEQ ID NO: 104248 - RNA, 64 nt, Human; identical to SEQ ID NO: 25324

SEQ ID NO: 104249 - RNA, 64 nt, Human; identical to SEQ ID NO: 25325

SEQ ID NO: 104250 - RNA, 64 nt, Human; identical to SEQ ID NO: 25326

SEQ ID NO: 104251 - RNA, 64 nt, Human; identical to SEQ ID NO: 25327

SEQ ID NO: 104252 - RNA, 64 nt, Human; identical to SEQ ID NO: 25328

SEQ ID NO: 104253 - RNA, 64 nt, Human; identical to SEQ ID NO: 25329

SEQ ID NO: 104254 - RNA, 64 nt, Human; identical to SEQ ID NO: 25330

SEQ ID NO: 104255 - RNA, 64 nt, Human; identical to SEQ ID NO: 25331

SEQ ID NO: 104256 - RNA, 64 nt, Human; identical to SEQ ID NO: 25332

SEQ ID NO: 104257 - RNA, 64 nt, Human; identical to SEQ ID NO: 25333

SEQ ID NO: 104258 - RNA, 64 nt, Human; identical to SEQ ID NO: 25334

SEQ ID NO: 104259 - RNA, 64 nt, Human; identical to SEQ ID NO: 25335

SEQ ID NO: 104260 - RNA, 64 nt, Human; identical to SEQ ID NO: 25336

SEQ ID NO: 104261 - RNA, 64 nt, Human; identical to SEQ ID NO: 25337

SEQ ID NO: 104262 - RNA, 64 nt, Human; identical to SEQ ID NO: 25338

SEQ ID NO: 104263 - RNA, 64 nt, Human; identical to SEQ ID NO: 25339

SEQ ID NO: 104264 - RNA, 64 nt, Human; identical to SEQ ID NO: 25340

SEQ ID NO: 104265 - RNA, 64 nt, Human; identical to SEQ ID NO: 25341

SEQ ID NO: 104266 - RNA, 64 nt, Human; identical to SEQ ID NO: 25342

SEQ ID NO: 104267 - RNA, 64 nt, Human; identical to SEQ ID NO: 25343

SEQ ID NO: 104268 - RNA, 64 nt, Human; identical to SEQ ID NO: 25344

SEQ ID NO: 104269 - RNA, 64 nt, Human; identical to SEQ ID NO: 25345

SEQ ID NO: 104270 - RNA, 64 nt, Human; identical to SEQ ID NO: 25346

SEQ ID NO: 104271 - RNA, 64 nt, Human; identical to SEQ ID NO: 25347

SEQ ID NO: 104272 - RNA, 64 nt, Human; identical to SEQ ID NO: 25348

SEQ ID NO: 104273 - RNA, 64 nt, Human; identical to SEQ ID NO: 25349

SEQ ID NO: 104274 - RNA, 64 nt, Human; identical to SEQ ID NO: 25350

SEQ ID NO: 104275 - RNA, 64 nt, Human; identical to SEQ ID NO: 25351

SEQ ID NO: 104276 - RNA, 64 nt, Human; identical to SEQ ID NO: 25352

SEQ ID NO: 104277 - RNA, 64 nt, Human; identical to SEQ ID NO: 25353

SEQ ID NO: 104278 - RNA, 64 nt, Human; identical to SEQ ID NO: 25354

SEQ ID NO: 104279 - RNA, 64 nt, Human; identical to SEQ ID NO: 25355

SEQ ID NO: 104280 - RNA, 64 nt, Human; identical to SEQ ID NO: 25356

SEQ ID NO: 104281 - RNA, 64 nt, Human; identical to SEQ ID NO: 25357

SEQ ID NO: 104282 - RNA, 64 nt, Human; identical to SEQ ID NO: 25358

SEQ ID NO: 104283 - RNA, 64 nt, Human; identical to SEQ ID NO: 25359

SEQ ID NO: 104284 - RNA, 64 nt, Human; identical to SEQ ID NO: 25360

SEQ ID NO: 104285 - RNA, 64 nt, Human; identical to SEQ ID NO: 25361

SEQ ID NO: 104286 - RNA, 64 nt, Human; identical to SEQ ID NO: 25362

SEQ ID NO: 104287 - RNA, 64 nt, Human; identical to SEQ ID NO: 25363

SEQ ID NO: 104288 - RNA, 64 nt, Human; identical to SEQ ID NO: 25364

SEQ ID NO: 104289 - RNA, 64 nt, Human; identical to SEQ ID NO: 25365

SEQ ID NO: 104290 - RNA, 64 nt, Human; identical to SEQ ID NO: 25366

SEQ ID NO: 104291 - RNA, 64 nt, Human; identical to SEQ ID NO: 25367

SEQ ID NO: 104292 - RNA, 64 nt, Human; identical to SEQ ID NO: 25368

SEQ ID NO: 104293 - RNA, 64 nt, Human; identical to SEQ ID NO: 25369

SEQ ID NO: 104294 - RNA, 64 nt, Human; identical to SEQ ID NO: 25370

SEQ ID NO: 104295 - RNA, 64 nt, Human; identical to SEQ ID NO: 25371

SEQ ID NO: 104296 - RNA, 64 nt, Human; identical to SEQ ID NO: 25372

SEQ ID NO: 104297 - RNA, 64 nt, Human; identical to SEQ ID NO: 25373

SEQ ID NO: 104298 - RNA, 64 nt, Human; identical to SEQ ID NO: 25374

SEQ ID NO: 104299 - RNA, 64 nt, Human; identical to SEQ ID NO: 25375

SEQ ID NO: 104300 - RNA, 64 nt, Human; identical to SEQ ID NO: 25376

SEQ ID NO: 104301 - RNA, 64 nt, Human; identical to SEQ ID NO: 25377

SEQ ID NO: 104302 - RNA, 64 nt, Human; identical to SEQ ID NO: 25378

SEQ ID NO: 104303 - RNA, 64 nt, Human; identical to SEQ ID NO: 25379

SEQ ID NO: 104304 - RNA, 64 nt, Human; identical to SEQ ID NO: 25380

SEQ ID NO: 104305 - RNA, 64 nt, Human; identical to SEQ ID NO: 25381

SEQ ID NO: 104306 - RNA, 64 nt, Human; identical to SEQ ID NO: 25382

SEQ ID NO: 104307 - RNA, 64 nt, Human; identical to SEQ ID NO: 25383

SEQ ID NO: 104308 - RNA, 64 nt, Human; identical to SEQ ID NO: 25384

SEQ ID NO: 104309 - RNA, 64 nt, Human; identical to SEQ ID NO: 25385

SEQ ID NO: 104310 - RNA, 64 nt, Human; identical to SEQ ID NO: 25386

SEQ ID NO: 104311 - RNA, 64 nt, Human; identical to SEQ ID NO: 25387

SEQ ID NO: 104312 - RNA, 64 nt, Human; identical to SEQ ID NO: 25388

SEQ ID NO: 104313 - RNA, 64 nt, Human; identical to SEQ ID NO: 25389

SEQ ID NO: 104314 - RNA, 64 nt, Human; identical to SEQ ID NO: 25390

SEQ ID NO: 104315 - RNA, 64 nt, Human; identical to SEQ ID NO: 25391

SEQ ID NO: 104316 - RNA, 64 nt, Human; identical to SEQ ID NO: 25392

SEQ ID NO: 104317 - RNA, 64 nt, Human; identical to SEQ ID NO: 25393

SEQ ID NO: 104318 - RNA, 64 nt, Human; identical to SEQ ID NO: 25394

SEQ ID NO: 104319 - RNA, 64 nt, Human; identical to SEQ ID NO: 25395

SEQ ID NO: 104320 - RNA, 64 nt, Human; identical to SEQ ID NO: 25396

SEQ ID NO: 104321 - RNA, 64 nt, Human; identical to SEQ ID NO: 25397

SEQ ID NO: 104322 - RNA, 64 nt, Human; identical to SEQ ID NO: 25398

SEQ ID NO: 104323 - RNA, 64 nt, Human; identical to SEQ ID NO: 25399

SEQ ID NO: 104324 - RNA, 64 nt, Human; identical to SEQ ID NO: 25400

SEQ ID NO: 104325 - RNA, 64 nt, Human; identical to SEQ ID NO: 25401

SEQ ID NO: 104326 - RNA, 64 nt, Human; identical to SEQ ID NO: 25402

SEQ ID NO: 104327 - RNA, 64 nt, Human; identical to SEQ ID NO: 25403

SEQ ID NO: 104328 - RNA, 64 nt, Human; identical to SEQ ID NO: 25404

SEQ ID NO: 104329 - RNA, 64 nt, Human; identical to SEQ ID NO: 25405

SEQ ID NO: 104330 - RNA, 64 nt, Human; identical to SEQ ID NO: 25406

SEQ ID NO: 104331 - RNA, 64 nt, Human; identical to SEQ ID NO: 25407

SEQ ID NO: 104332 - RNA, 64 nt, Human; identical to SEQ ID NO: 25408

SEQ ID NO: 104333 - RNA, 64 nt, Human; identical to SEQ ID NO: 25409

SEQ ID NO: 104334 - RNA, 64 nt, Human; identical to SEQ ID NO: 25410

SEQ ID NO: 104335 - RNA, 64 nt, Human; identical to SEQ ID NO: 25411

SEQ ID NO: 104336 - RNA, 64 nt, Human; identical to SEQ ID NO: 25412

SEQ ID NO: 104337 - RNA, 64 nt, Human; identical to SEQ ID NO: 25413

SEQ ID NO: 104338 - RNA, 64 nt, Human; identical to SEQ ID NO: 25414

SEQ ID NO: 104339 - RNA, 64 nt, Human; identical to SEQ ID NO: 25415

SEQ ID NO: 104340 - RNA, 64 nt, Human; identical to SEQ ID NO: 25416

SEQ ID NO: 104341 - RNA, 64 nt, Human; identical to SEQ ID NO: 25417

SEQ ID NO: 104342 - RNA, 64 nt, Human; identical to SEQ ID NO: 25418

SEQ ID NO: 104343 - RNA, 64 nt, Human; identical to SEQ ID NO: 25419

SEQ ID NO: 104344 - RNA, 64 nt, Human; identical to SEQ ID NO: 25420

SEQ ID NO: 104345 - RNA, 64 nt, Human; identical to SEQ ID NO: 25421

SEQ ID NO: 104346 - RNA, 64 nt, Human; identical to SEQ ID NO: 25422

SEQ ID NO: 104347 - RNA, 64 nt, Human; identical to SEQ ID NO: 25423

SEQ ID NO: 104348 - RNA, 64 nt, Human; identical to SEQ ID NO: 25424

SEQ ID NO: 104349 - RNA, 64 nt, Human; identical to SEQ ID NO: 25425

SEQ ID NO: 104350 - RNA, 64 nt, Human; identical to SEQ ID NO: 25426

SEQ ID NO: 104351 - RNA, 64 nt, Human; identical to SEQ ID NO: 25427

SEQ ID NO: 104352 - RNA, 64 nt, Human; identical to SEQ ID NO: 25428

SEQ ID NO: 104353 - RNA, 64 nt, Human; identical to SEQ ID NO: 25429

SEQ ID NO: 104354 - RNA, 64 nt, Human; identical to SEQ ID NO: 25430

SEQ ID NO: 104355 - RNA, 64 nt, Human; identical to SEQ ID NO: 25431

SEQ ID NO: 104356 - RNA, 64 nt, Human; identical to SEQ ID NO: 25432

SEQ ID NO: 104357 - RNA, 64 nt, Human; identical to SEQ ID NO: 25433

SEQ ID NO: 104358 - RNA, 64 nt, Human; identical to SEQ ID NO: 25434

SEQ ID NO: 104359 - RNA, 64 nt, Human; identical to SEQ ID NO: 25435

SEQ ID NO: 104360 - RNA, 64 nt, Human; identical to SEQ ID NO: 25436

SEQ ID NO: 104361 - RNA, 64 nt, Human; identical to SEQ ID NO: 25437

SEQ ID NO: 104362 - RNA, 64 nt, Human; identical to SEQ ID NO: 25438

SEQ ID NO: 104363 - RNA, 64 nt, Human; identical to SEQ ID NO: 25439

SEQ ID NO: 104364 - RNA, 64 nt, Human; identical to SEQ ID NO: 25440

SEQ ID NO: 104365 - RNA, 64 nt, Human; identical to SEQ ID NO: 25441

SEQ ID NO: 104366 - RNA, 64 nt, Human; identical to SEQ ID NO: 25442

SEQ ID NO: 104367 - RNA, 64 nt, Human; identical to SEQ ID NO: 25443

SEQ ID NO: 104368 - RNA, 64 nt, Human; identical to SEQ ID NO: 25444

SEQ ID NO: 104369 - RNA, 64 nt, Human; identical to SEQ ID NO: 25445

SEQ ID NO: 104370 - RNA, 64 nt, Human; identical to SEQ ID NO: 25446

SEQ ID NO: 104371 - RNA, 64 nt, Human; identical to SEQ ID NO: 25447

SEQ ID NO: 104372 - RNA, 64 nt, Human; identical to SEQ ID NO: 25448

SEQ ID NO: 104373 - RNA, 64 nt, Human; identical to SEQ ID NO: 25449

SEQ ID NO: 104374 - RNA, 64 nt, Human; identical to SEQ ID NO: 25450

SEQ ID NO: 104375 - RNA, 64 nt, Human; identical to SEQ ID NO: 25451

SEQ ID NO: 104376 - RNA, 64 nt, Human; identical to SEQ ID NO: 25452

SEQ ID NO: 104377 - RNA, 64 nt, Human; identical to SEQ ID NO: 25453

SEQ ID NO: 104378 - RNA, 64 nt, Human; identical to SEQ ID NO: 25454

SEQ ID NO: 104379 - RNA, 64 nt, Human; identical to SEQ ID NO: 25455

SEQ ID NO: 104380 - RNA, 64 nt, Human; identical to SEQ ID NO: 25456

SEQ ID NO: 104381 - RNA, 64 nt, Human; identical to SEQ ID NO: 25457

SEQ ID NO: 104382 - RNA, 64 nt, Human; identical to SEQ ID NO: 25458

SEQ ID NO: 104383 - RNA, 64 nt, Human; identical to SEQ ID NO: 25459

SEQ ID NO: 104384 - RNA, 64 nt, Human; identical to SEQ ID NO: 25460

SEQ ID NO: 104385 - RNA, 64 nt, Human; identical to SEQ ID NO: 25461

SEQ ID NO: 104386 - RNA, 64 nt, Human; identical to SEQ ID NO: 25462

SEQ ID NO: 104387 - RNA, 64 nt, Human; identical to SEQ ID NO: 25463

SEQ ID NO: 104388 - RNA, 64 nt, Human; identical to SEQ ID NO: 25464

SEQ ID NO: 104389 - RNA, 64 nt, Human; identical to SEQ ID NO: 25465

SEQ ID NO: 104390 - RNA, 64 nt, Human; identical to SEQ ID NO: 25466

SEQ ID NO: 104391 - RNA, 64 nt, Human; identical to SEQ ID NO: 25467

SEQ ID NO: 104392 - RNA, 64 nt, Human; identical to SEQ ID NO: 25468

SEQ ID NO: 104393 - RNA, 64 nt, Human; identical to SEQ ID NO: 25469

SEQ ID NO: 104394 - RNA, 64 nt, Human; identical to SEQ ID NO: 25470

SEQ ID NO: 104395 - RNA, 64 nt, Human; identical to SEQ ID NO: 25471

SEQ ID NO: 104396 - RNA, 64 nt, Human; identical to SEQ ID NO: 25472

SEQ ID NO: 104397 - RNA, 64 nt, Human; identical to SEQ ID NO: 25473

SEQ ID NO: 104398 - RNA, 64 nt, Human; identical to SEQ ID NO: 25474

SEQ ID NO: 104399 - RNA, 64 nt, Human; identical to SEQ ID NO: 25475

SEQ ID NO: 104400 - RNA, 64 nt, Human; identical to SEQ ID NO: 25476

SEQ ID NO: 104401 - RNA, 64 nt, Human; identical to SEQ ID NO: 25477

SEQ ID NO: 104402 - RNA, 64 nt, Human; identical to SEQ ID NO: 25478

SEQ ID NO: 104403 - RNA, 64 nt, Human; identical to SEQ ID NO: 25479

SEQ ID NO: 104404 - RNA, 64 nt, Human; identical to SEQ ID NO: 25480

SEQ ID NO: 104405 - RNA, 64 nt, Human; identical to SEQ ID NO: 25481

SEQ ID NO: 104406 - RNA, 64 nt, Human; identical to SEQ ID NO: 25482

SEQ ID NO: 104407 - RNA, 64 nt, Human; identical to SEQ ID NO: 25483

SEQ ID NO: 104408 - RNA, 64 nt, Human; identical to SEQ ID NO: 25484

SEQ ID NO: 104409 - RNA, 64 nt, Human; identical to SEQ ID NO: 25485

SEQ ID NO: 104410 - RNA, 64 nt, Human; identical to SEQ ID NO: 25486

SEQ ID NO: 104411 - RNA, 64 nt, Human; identical to SEQ ID NO: 25487

SEQ ID NO: 104412 - RNA, 64 nt, Human; identical to SEQ ID NO: 25488

SEQ ID NO: 104413 - RNA, 64 nt, Human; identical to SEQ ID NO: 25489

SEQ ID NO: 104414 - RNA, 64 nt, Human; identical to SEQ ID NO: 25490

SEQ ID NO: 104415 - RNA, 64 nt, Human; identical to SEQ ID NO: 25491

SEQ ID NO: 104416 - RNA, 64 nt, Human; identical to SEQ ID NO: 25492

SEQ ID NO: 104417 - RNA, 64 nt, Human; identical to SEQ ID NO: 25493

SEQ ID NO: 104418 - RNA, 64 nt, Human; identical to SEQ ID NO: 25494

SEQ ID NO: 104419 - RNA, 64 nt, Human; identical to SEQ ID NO: 25495

SEQ ID NO: 104420 - RNA, 64 nt, Human; identical to SEQ ID NO: 25496

SEQ ID NO: 104421 - RNA, 64 nt, Human; identical to SEQ ID NO: 25497

SEQ ID NO: 104422 - RNA, 64 nt, Human; identical to SEQ ID NO: 25498

SEQ ID NO: 104423 - RNA, 64 nt, Human; identical to SEQ ID NO: 25499

SEQ ID NO: 104424 - RNA, 64 nt, Human; identical to SEQ ID NO: 25500

SEQ ID NO: 104425 - RNA, 64 nt, Human; identical to SEQ ID NO: 25501

SEQ ID NO: 104426 - RNA, 64 nt, Human; identical to SEQ ID NO: 25502

SEQ ID NO: 104427 - RNA, 64 nt, Human; identical to SEQ ID NO: 25503

SEQ ID NO: 104428 - RNA, 64 nt, Human; identical to SEQ ID NO: 25504

SEQ ID NO: 104429 - RNA, 64 nt, Human; identical to SEQ ID NO: 25505

SEQ ID NO: 104430 - RNA, 64 nt, Human; identical to SEQ ID NO: 25506

SEQ ID NO: 104431 - RNA, 64 nt, Human; identical to SEQ ID NO: 25507

SEQ ID NO: 104432 - RNA, 64 nt, Human; identical to SEQ ID NO: 25508

SEQ ID NO: 104433 - RNA, 64 nt, Human; identical to SEQ ID NO: 25466

SEQ ID NO: 104434 - RNA, 64 nt, Human; identical to SEQ ID NO: 25510

SEQ ID NO: 104435 - RNA, 64 nt, Human; identical to SEQ ID NO: 92707

SEQ ID NO: 104436 - RNA, 64 nt, Human; identical to SEQ ID NO: 92708

SEQ ID NO: 104437 - RNA, 64 nt, Human; identical to SEQ ID NO: 92709

SEQ ID NO: 104438 - RNA, 64 nt, Human; identical to SEQ ID NO: 92710

SEQ ID NO: 104439 - RNA, 64 nt, Human; identical to SEQ ID NO: 92711

SEQ ID NO: 104440 - RNA, 64 nt, Human; identical to SEQ ID NO: 92712

SEQ ID NO: 104441 - RNA, 64 nt, Human; identical to SEQ ID NO: 92713

SEQ ID NO: 104442 - RNA, 64 nt, Human; identical to SEQ ID NO: 92714

SEQ ID NO: 104443 - RNA, 64 nt, Human; identical to SEQ ID NO: 92715

SEQ ID NO: 104444 - RNA, 64 nt, Human; identical to SEQ ID NO: 92716

SEQ ID NO: 104445 - RNA, 64 nt, Human; identical to SEQ ID NO: 92717

SEQ ID NO: 104446 - RNA, 64 nt, Human; identical to SEQ ID NO: 92718

SEQ ID NO: 104447 - RNA, 64 nt, Human; identical to SEQ ID NO: 92719

SEQ ID NO: 104448 - RNA, 64 nt, Human; identical to SEQ ID NO: 92720

SEQ ID NO: 104449 - RNA, 64 nt, Human; identical to SEQ ID NO: 92721

SEQ ID NO: 104450 - RNA, 64 nt, Human; identical to SEQ ID NO: 92722

SEQ ID NO: 104451 - RNA, 64 nt, Human; identical to SEQ ID NO: 92723

SEQ ID NO: 104452 - RNA, 64 nt, Human; identical to SEQ ID NO: 92724

SEQ ID NO: 104453 - RNA, 64 nt, Human; identical to SEQ ID NO: 92725

SEQ ID NO: 104454 - RNA, 64 nt, Human; identical to SEQ ID NO: 92726

SEQ ID NO: 104455 - RNA, 64 nt, Human; identical to SEQ ID NO: 92727

SEQ ID NO: 104456 - RNA, 64 nt, Human; identical to SEQ ID NO: 92728

SEQ ID NO: 104457 - RNA, 64 nt, Human; identical to SEQ ID NO: 92729

SEQ ID NO: 104458 - RNA, 51 nt, Human; identical to SEQ ID NO: 92730

SEQ ID NO: 104459 - RNA, 64 nt, Human; identical to SEQ ID NO: 92731

SEQ ID NO: 104460 - RNA, 64 nt, Human; identical to SEQ ID NO: 92732

SEQ ID NO: 104461 - RNA, 64 nt, Human; identical to SEQ ID NO: 92733

SEQ ID NO: 104462 - RNA, 64 nt, Human; identical to SEQ ID NO: 92734

SEQ ID NO: 104463 - RNA, 64 nt, Human; identical to SEQ ID NO: 92735

SEQ ID NO: 104464 - RNA, 64 nt, Human; identical to SEQ ID NO: 92736

SEQ ID NO: 104465 - RNA, 64 nt, Human; identical to SEQ ID NO: 92737

SEQ ID NO: 104466 - RNA, 64 nt, Human; identical to SEQ ID NO: 92738

SEQ ID NO: 104467 - RNA, 53 nt, Human; identical to SEQ ID NO: 92739

SEQ ID NO: 104468 - RNA, 64 nt, Human; identical to SEQ ID NO: 92740

SEQ ID NO: 104469 - RNA, 64 nt, Human; identical to SEQ ID NO: 92741

SEQ ID NO: 104470 - RNA, 64 nt, Human; identical to SEQ ID NO: 92742

SEQ ID NO: 104471 - RNA, 64 nt, Human; identical to SEQ ID NO: 92743

SEQ ID NO: 104472 - RNA, 64 nt, Human; identical to SEQ ID NO: 92744

SEQ ID NO: 104473 - RNA, 64 nt, Human; identical to SEQ ID NO: 92745

SEQ ID NO: 104474 - RNA, 56 nt, Human; identical to SEQ ID NO: 92746

SEQ ID NO: 104475 - RNA, 64 nt, Human; identical to SEQ ID NO: 92747

SEQ ID NO: 104476 - RNA, 64 nt, Human; identical to SEQ ID NO: 92748

SEQ ID NO: 104477 - RNA, 64 nt, Human; identical to SEQ ID NO: 92749

SEQ ID NO: 104478 - RNA, 64 nt, Human; identical to SEQ ID NO: 92750

SEQ ID NO: 104479 - RNA, 64 nt, Human; identical to SEQ ID NO: 92751

SEQ ID NO: 104480 - RNA, 64 nt, Human; identical to SEQ ID NO: 92752

SEQ ID NO: 104481 - RNA, 64 nt, Human; identical to SEQ ID NO: 92753

SEQ ID NO: 104482 - RNA, 57 nt, Human; identical to SEQ ID NO: 92754

SEQ ID NO: 104483 - RNA, 64 nt, Human; identical to SEQ ID NO: 92755

SEQ ID NO: 104484 - RNA, 64 nt, Human; identical to SEQ ID NO: 92756

SEQ ID NO: 104485 - RNA, 64 nt, Human; identical to SEQ ID NO: 92757

SEQ ID NO: 104486 - RNA, 64 nt, Human; identical to SEQ ID NO: 92758

SEQ ID NO: 104487 - RNA, 64 nt, Human; identical to SEQ ID NO: 92759

SEQ ID NO: 104488 - RNA, 64 nt, Human; identical to SEQ ID NO: 92760

SEQ ID NO: 104489 - RNA, 64 nt, Human; identical to SEQ ID NO: 92761

SEQ ID NO: 104490 - RNA, 64 nt, Human; identical to SEQ ID NO: 92762

SEQ ID NO: 104491 - RNA, 64 nt, Human; identical to SEQ ID NO: 92763

SEQ ID NO: 104492 - RNA, 64 nt, Human; identical to SEQ ID NO: 92764

SEQ ID NO: 104493 - RNA, 64 nt, Human; identical to SEQ ID NO: 92765

SEQ ID NO: 104494 - RNA, 64 nt, Human; identical to SEQ ID NO: 92766

SEQ ID NO: 104495 - RNA, 64 nt, Human; identical to SEQ ID NO: 92767

SEQ ID NO: 104496 - RNA, 64 nt, Human; identical to SEQ ID NO: 92768

SEQ ID NO: 104497 - RNA, 64 nt, Human; identical to SEQ ID NO: 92769

SEQ ID NO: 104498 - RNA, 64 nt, Human; identical to SEQ ID NO: 92770

SEQ ID NO: 104499 - RNA, 64 nt, Human; identical to SEQ ID NO: 92771

SEQ ID NO: 104500 - RNA, 64 nt, Human; identical to SEQ ID NO: 92772

SEQ ID NO: 104501 - RNA, 64 nt, Human; identical to SEQ ID NO: 92773

SEQ ID NO: 104502 - RNA, 64 nt, Human; identical to SEQ ID NO: 92774

SEQ ID NO: 104503 - RNA, 64 nt, Human; identical to SEQ ID NO: 92775

SEQ ID NO: 104504 - RNA, 64 nt, Human; identical to SEQ ID NO: 92776

SEQ ID NO: 104505 - RNA, 64 nt, Human; identical to SEQ ID NO: 92777

SEQ ID NO: 104506 - RNA, 64 nt, Human; identical to SEQ ID NO: 92778

SEQ ID NO: 104507 - RNA, 64 nt, Human; identical to SEQ ID NO: 92779

SEQ ID NO: 104508 - RNA, 64 nt, Human; identical to SEQ ID NO: 92780

SEQ ID NO: 104509 - RNA, 64 nt, Human; identical to SEQ ID NO: 92781

SEQ ID NO: 104510 - RNA, 64 nt, Human; identical to SEQ ID NO: 92782

SEQ ID NO: 104511 - RNA, 64 nt, Human; identical to SEQ ID NO: 92783

SEQ ID NO: 104512 - RNA, 64 nt, Human; identical to SEQ ID NO: 92784

SEQ ID NO: 104513 - RNA, 64 nt, Human; identical to SEQ ID NO: 92785

SEQ ID NO: 104514 - RNA, 64 nt, Human; identical to SEQ ID NO: 92786

SEQ ID NO: 104515 - RNA, 64 nt, Human; identical to SEQ ID NO: 92787

SEQ ID NO: 104516 - RNA, 64 nt, Human; identical to SEQ ID NO: 92788

SEQ ID NO: 104517 - RNA, 64 nt, Human; identical to SEQ ID NO: 92789

SEQ ID NO: 104518 - RNA, 53 nt, Human; identical to SEQ ID NO: 92790

SEQ ID NO: 104519 - RNA, 64 nt, Human; identical to SEQ ID NO: 92791

SEQ ID NO: 104520 - RNA, 64 nt, Human; identical to SEQ ID NO: 92792

SEQ ID NO: 104521 - RNA, 64 nt, Human; identical to SEQ ID NO: 92793

SEQ ID NO: 104522 - RNA, 64 nt, Human; identical to SEQ ID NO: 92794

SEQ ID NO: 104523 - RNA, 64 nt, Human; identical to SEQ ID NO: 92795

SEQ ID NO: 104524 - RNA, 64 nt, Human; identical to SEQ ID NO: 92796

SEQ ID NO: 104525 - RNA, 64 nt, Human; identical to SEQ ID NO: 92797

SEQ ID NO: 104526 - RNA, 64 nt, Human; identical to SEQ ID NO: 92798

SEQ ID NO: 104527 - RNA, 64 nt, Human; identical to SEQ ID NO: 92799

SEQ ID NO: 104528 - RNA, 64 nt, Human; identical to SEQ ID NO: 92800

SEQ ID NO: 104529 - RNA, 64 nt, Human; identical to SEQ ID NO: 92801

SEQ ID NO: 104530 - RNA, 64 nt, Human; identical to SEQ ID NO: 92802

SEQ ID NO: 104531 - RNA, 64 nt, Human; identical to SEQ ID NO: 92803

SEQ ID NO: 104532 - RNA, 64 nt, Human; identical to SEQ ID NO: 92804

SEQ ID NO: 104533 - RNA, 64 nt, Human; identical to SEQ ID NO: 92805

SEQ ID NO: 104534 - RNA, 64 nt, Human; identical to SEQ ID NO: 92806

SEQ ID NO: 104535 - RNA, 63 nt, Human; identical to SEQ ID NO: 92807

SEQ ID NO: 104536 - RNA, 64 nt, Human; identical to SEQ ID NO: 92808

SEQ ID NO: 104537 - RNA, 64 nt, Human; identical to SEQ ID NO: 92809

SEQ ID NO: 104538 - RNA, 64 nt, Human; identical to SEQ ID NO: 92810

SEQ ID NO: 104539 - RNA, 64 nt, Human; identical to SEQ ID NO: 92811

SEQ ID NO: 104540 - RNA, 64 nt, Human; identical to SEQ ID NO: 92812

SEQ ID NO: 104541 - RNA, 64 nt, Human; identical to SEQ ID NO: 92813

SEQ ID NO: 104542 - RNA, 63 nt, Human; identical to SEQ ID NO: 92814

SEQ ID NO: 104543 - RNA, 64 nt, Human; identical to SEQ ID NO: 92815

SEQ ID NO: 104544 - RNA, 64 nt, Human; identical to SEQ ID NO: 92816

SEQ ID NO: 104545 - RNA, 64 nt, Human; identical to SEQ ID NO: 92817

SEQ ID NO: 104546 - RNA, 64 nt, Human; identical to SEQ ID NO: 92818

SEQ ID NO: 104547 - RNA, 64 nt, Human; identical to SEQ ID NO: 92819

SEQ ID NO: 104548 - RNA, 64 nt, Human; identical to SEQ ID NO: 92820

SEQ ID NO: 104549 - RNA, 64 nt, Human; identical to SEQ ID NO: 92821

SEQ ID NO: 104550 - RNA, 64 nt, Human; identical to SEQ ID NO: 92822

SEQ ID NO: 104551 - RNA, 51 nt, Human; identical to SEQ ID NO: 92823

SEQ ID NO: 104552 - RNA, 64 nt, Human; identical to SEQ ID NO: 92824

SEQ ID NO: 104553 - RNA, 64 nt, Human
ccuauuuccuaugcuggaguuuugauuuuuaacuaaacgcaaaucuguagauucucuccucucc

SEQ ID NO: 104554 - RNA, 64 nt, Human
ugaccgagaacuuuuaagaggauagaauacauggaaacgcaaaugaguauuucggagcaugaag

SEQ ID NO: 104555 - RNA, 64 nt, Human
gucagcccgaaugccugucaguuucauggaggggaaacgcaaaaccugcaguuccugaguaccu

SEQ ID NO: 104556 - RNA, 64 nt, Human
uguauagaucgucagggaauagcccaaauguuuuaaacgcaaaaaaaaagacaaaaaaaaacca

SEQ ID NO: 104557 - RNA, 64 nt, Human
aggucuugugagcccaggaaugaaagaggagaagaaacgcaacuaccugcgcccuccguggucc

SEQ ID NO: 104558 - RNA, 64 nt, Human
cacaaaaugaaauaaaggaaguggaaauuggaaaaaacgcaaaccuaacuugcucugcuuguuu

SEQ ID NO: 104559 - RNA, 64 nt, Human
agguuuguaaaaaguguccugugacuuaacacagaaacgcaauaaacacacacaaaauaguuuc

SEQ ID NO: 104560 - RNA, 64 nt, Human
ggcgugguauauuuaaccacgggagcgugucuggaaacgcaaacuaucauuaauuucauacuag

SEQ ID NO: 104561 - RNA, 64 nt, Human
gaagagaucuuuuuuuacuagagaucugcagaagaaacgcaaucuucugagcacaauauggaau

SEQ ID NO: 104562 - RNA, 62 nt, Human
ucaugucaacaaaacucuaaccucaucgcaacaaacgcaacaguggcuuucaaaguuaugca

SEQ ID NO: 104563 - RNA, 64 nt, Human
ugagcauuugcaccucuguucauuucacacagugaaacgcaauuuuaccuaguuugcacuauau

SEQ ID NO: 104564 - RNA, 64 nt, Human
acagaaauaaaauacuauauaauuuaaauaauguaaacgcaaacaggguuugauagcacuuaaa

SEQ ID NO: 104565 - RNA, 64 nt, Human
cagucgcucacaggacuuggaucugaagcacaguaaacgcaagaggggauuuguguacaaaagg

SEQ ID NO: 104566 - RNA, 64 nt, Human
uacagugugauguauggacucaaucaaaaacauuaaacgcaaacugauuaggauuugauuucuu

SEQ ID NO: 104567 - RNA, 64 nt, Human
uuucacucaaauguuuugagaacuguguuuaaauaaacgcaaaugaaaagaaaaauguuggugc

SEQ ID NO: 104568 - RNA, 64 nt, Human
acccuuuagcuggaugcugucagaggcgauggagaaacgcaaaggugcguuaauuuuacucuag

SEQ ID NO: 104569 - RNA, 64 nt, Human
aucaugggauuuuacuagaauuaaacaacaaacaaaacgcaaaacccaguauaugcuauucaau

SEQ ID NO: 104570 - RNA, 64 nt, Human
caaacccuucagugccaaaaacaacaacaaaaugaaacgcaaccaccaccaaccacugcgacca

SEQ ID NO: 104571 - RNA, 64 nt, Human
ugaauacacuaagguccuugugguuuuccaguuaaaacgcaagugauuuuuacacaugguggcu

SEQ ID NO: 104572 - RNA, 64 nt, Human
aaucaaggaaacacaaucaggauuuuaugugugaaaacgcaaaagugauggcucggcgguccga

SEQ ID NO: 104573 - RNA, 64 nt, Human
agcuuuuuuucauucuuaacucuuuaaaggauucaaacgcaacucaaaucugugcuggacuuua

SEQ ID NO: 104574 - RNA, 64 nt, Human
acaacagcagaguugauuaagaaaaaugaagaaaaaacgcaaaaagagaacacauguagaaggu

SEQ ID NO: 104575 - RNA, 61 nt, Human
aaaagccuaaauuggaaugagauccaagucuaaacgcaagagcuagauugagccgccauug

SEQ ID NO: 104576 - RNA, 64 nt, Human
aaagacaaucagcagaaagcauuuucugcaaaauaaacgcaauaugcaaaaugugauucgucca

SEQ ID NO: 104577 - RNA, 64 nt, Human
cauuucuacuguaaaaugcaauuugaaaaaaauaaaacgcaaaaaaagaaacuguaaaggaaac

SEQ ID NO: 104578 - RNA, 64 nt, Human
aagcugaugcuuugcuucaaauccauccagaauaaaacgcaaagggcugaaagccauuuguugg

SEQ ID NO: 104579 - RNA, 64 nt, Human
agcucacccuuggcuuguuuuccgcaaacccgguaaacgcaagcccuuggggcagaugcagaag

SEQ ID NO: 104580 - RNA, 64 nt, Human
caaugggacagucauagauggugugacaguguuuaaacgcaacaaaaggcuacauuuccauggg

SEQ ID NO: 104581 - RNA, 64 nt, Human
ugcguuagaugguaauaaucuggaaguugguuacaaacgcaagaggccauuguaaacaucugcu

SEQ ID NO: 104582 - RNA, 64 nt, Human
auuuaagugguaaugaaaaauaguaaucauaguaaaacgcaacaagaagaaaaccaacccaaac

SEQ ID NO: 104583 - RNA, 64 nt, Human
acaaaacaggguaccagcacggaagacuuucuuaaaacgcaaccugaauugaaugaugaaaugu

SEQ ID NO: 104584 - RNA, 64 nt, Human
cuauaguaguguuuuaaaaaguuaaaugaagaauaaacgcaaauauaaaagcucugauuuugcc

SEQ ID NO: 104585 - RNA, 64 nt, Human
uggcagccuaacagggagaggccacggggcccaaaaacgcaacacgucucaaggcaaacccgag

SEQ ID NO: 104586 - RNA, 64 nt, Human
cugccuuugcaguccuuuuacuacagcuaugaagaaacgcaacaagaaacucaaugcacaacaa

SEQ ID NO: 104587 - RNA, 64 nt, Human
accacaagggaaaagaaaaacccaguuucuuaggaaacgcaaacgauuuauuauccagauuauu

SEQ ID NO: 104588 - RNA, 64 nt, Human
auucagauacuuggucauuuacuuaccaaauuacaaacgcaauacuacagcauuuguauauuaa

SEQ ID NO: 104589 - RNA, 64 nt, Human
ucauagggguggaacuugcacagcaaaaacaaacaaacgcaagaagagauuugggcuuuaacac

SEQ ID NO: 104590 - RNA, 64 nt, Human
ucccuggcugccucaggcuucucuuacgaagaggaaacgcaaaaaaagaaaaggaaaaaccccg

SEQ ID NO: 104591 - RNA, 64 nt, Human
gcuacagaagacaaaacccugaagaguuaagaacaaacgcaaggaaauaauuuuuauuguuuaa

SEQ ID NO: 104592 - RNA, 64 nt, Human
uucugaucucagagcauuucaauuagggaugcucaaacgcaacuguuucuacuuccccauuuca

SEQ ID NO: 104593 - RNA, 64 nt, Human
acagggguguugcggagaagggagaguucaaggcaaacgcaaggacuggacuuagcucccuagg

SEQ ID NO: 104594 - RNA, 64 nt, Human
aauggguugaugucugaaguagcaaaucuucuggaaacgcaaacucuuuuaaggaagucccuaa

SEQ ID NO: 104595 - RNA, 64 nt, Human
uuccuggggaaguucuuucugcaccagugauggaaaacgcaagacuuuccagucgcaaccccug

SEQ ID NO: 104596 - RNA, 64 nt, Human
caaaauacaaaaguucaaccucuuacaauaagcuaaacgcaaugucauuuuuaaaaagaaggac

SEQ ID NO: 104597 - RNA, 64 nt, Human
acugcacuccagccugggcgcaagaccaagacuuaaacgcaaaaaaaaaaaaaaaaaaaaaaaa

SEQ ID NO: 104598 - RNA, 64 nt, Human
caaaucagagcaagagcucuuucucaagggcaagaaacgcaaacaagaaauauuugugagauga

SEQ ID NO: 104599 - RNA, 64 nt, Human
aaaauaaagaacucuguagcucaccaagguggagaaacgcaauucagaaaaguaauuucuccaa

SEQ ID NO: 104600 - RNA, 64 nt, Human
gcuuacauauauugucuuugugcugcugugugacaaacgcaaugcaaaaacaauccucuuucuc

SEQ ID NO: 104601 - RNA, 64 nt, Human
uagccuauacagacgaacugaucuguccuucgugaaacgcaacaaagcuaguucugucuuuuca

SEQ ID NO: 104602 - RNA, 64 nt, Human
gauagguguuuccaaagugugucuucucaagugaaaacgcaacucuagguuucaaguacuccuu

SEQ ID NO: 104603 - RNA, 64 nt, Human
cagguacagaauaggaacuucagaggcuuuguuuaaacgcaaagcuuuguaaaagccacaaggu

SEQ ID NO: 104604 - RNA, 64 nt, Human
cugcuucugucuugaggauaugggaagccuagagaaacgcaagcagacuggauugggauagaag

SEQ ID NO: 104605 - RNA, 64 nt, Human
ggagcacaaggccuuaauggacauugacuugugaaaacgcaaacaugaauaugguuggagagcc

SEQ ID NO: 104606 - RNA, 64 nt, Human
cacuuuucgcuccggagcgagaacgaaacgacaaaaacgcaagaaaacaauaaaacgcuagaaa

SEQ ID NO: 104607 - RNA, 64 nt, Human
uccuuuguggagugcuggguaagcaguuuccaauaaacgcaagcugagcugggcacguggcugc

SEQ ID NO: 104608 - RNA, 64 nt, Human
accuaggcuaggauaacuuuagagcacugacauaaaacgcaaaaacaggaaucaugccguuugc

SEQ ID NO: 104609 - RNA, 64 nt, Human
uaggauuuuuacucccuuuguacaguauucugagaaacgcaaauaaaagggcaacauguuucug

SEQ ID NO: 104610 - RNA, 64 nt, Human
uacauucuguguguaucuaaaggauggaaaaauaaaacgcaauuaaaaauaaacagaugcccua

SEQ ID NO: 104611 - RNA, 64 nt, Human
agacacacugacaccucccgaaguggaccacaagaaacgcaaaauccgggaggagauugagcau

SEQ ID NO: 104612 - RNA, 64 nt, Human
cagauuuagcaaaaccaaaacagagugcugaguuaaacgcaaauuucagguaaacaaaagauaa

SEQ ID NO: 104613 - RNA, 64 nt, Human
ucucccaagauacaccagcagccugcuuacuacuaaacgcaauccaaaaggccuuuaaaaauac

SEQ ID NO: 104614 - RNA, 64 nt, Human
cuccgugagauaaugugaaauacgacuguggaccaaacgcaauaaaaccucuguuuguacgaag

SEQ ID NO: 104615 - RNA, 64 nt, Human
caccaaaaaagaaaaaaaaaaaaacccaaaccaaaaacgcaaaccaaagcaggcaggcagacag

SEQ ID NO: 104616 - RNA, 64 nt, Human
ggccccacacgaaagacucuuaccauuuuauuaaaaacgcaaggaccucagagacguucuuuuc

SEQ ID NO: 104617 - RNA, 64 nt, Human
aaccugucugacuguagcuuugugaaauaucuuaaaacgcaaaaaccaauuguguccugaaaau

SEQ ID NO: 104618 - RNA, 64 nt, Human
auaauaaaagucugaguuuaagcagcuuuaccgaaaacgcaagggaaguuucauuccauuuaua

SEQ ID NO: 104619 - RNA, 64 nt, Human
aucccuugcucaccccuuucccccgccaaauaagaaacgcaagccagaccacgaugauuguaga

SEQ ID NO: 104620 - RNA, 64 nt, Human
uuguguaauugguuugaaaaacagugaaauggguaaacgcaaaacuuuuguacuuuauuacgag

SEQ ID NO: 104621 - RNA, 64 nt, Human
ggcuccuuucagcuacuacguuaccacguuccuaaaacgcaagcucuccggaccagacggacac

SEQ ID NO: 104622 - RNA, 64 nt, Human
uggacugacaggccgagagcggauggacuacaugaaacgcaagagccgcgaguaugagcagcuc

SEQ ID NO: 104623 - RNA, 64 nt, Human
aauggugucauggcugaaguuggccaccuugcuugagggacaaguuguuuauguaucagcucuc

SEQ ID NO: 104624 - RNA, 64 nt, Human
cacugcacucuggagguggguggugcaggcgguggagggacacaggccagcucaagcccgcugg

SEQ ID NO: 104625 - RNA, 64 nt, Human
cacugggucacccuguccuggaugccucugaagagagggacagaccgucagaaacuggagaguu

SEQ ID NO: 104626 - RNA, 64 nt, Human
ugcacuuuaacccuagaagguggggaccuggggggagggacagggcaggcgggcccaugaagaa

SEQ ID NO: 104627 - RNA, 64 nt, Human
gacagaguucacaggaggccagugggcgggccaugagggacagggucuuuuuucauuucuuccu

SEQ ID NO: 104628 - RNA, 64 nt, Human
aacagcaauauugaaaggaggugggggauugagggagggacagaguguuggagggccagagacu

SEQ ID NO: 104629 - RNA, 64 nt, Human
uggugccaucuggccuggcuggagccaggaacaggagggacacuuccccagaauccgcauguuu

SEQ ID NO: 104630 - RNA, 64 nt, Human
gggaaucaauguaacagccauuauagaaaaugaagagggacaucaaguaacauuggagcucugg

SEQ ID NO: 104631 - RNA, 64 nt, Human
ggggguaguucuuuacucucccuuuacuacccuggagggacagcucugcccuugaggcccuuca

SEQ ID NO: 104632 - RNA, 64 nt, Human
ucacucuuguggcucagauugcucuuaggaccuggagggacagaccagaaucaggguccccucc

SEQ ID NO: 104633 - RNA, 64 nt, Human
ccccgugaagguguaugccacaccuggccuuaaagagggacaggcugaagagagggacaggcac

SEQ ID NO: 104634 - RNA, 64 nt, Human
ccacaccuggccuuaaagagggacaggcugaagagagggacaggcacuccaaaccugucuuggg

SEQ ID NO: 104635 - RNA, 64 nt, Human
aaagguuuuacugagaaggggaaaaccuuagauagagggacaugugaaacaaaaucauuugaaa

SEQ ID NO: 104636 - RNA, 64 nt, Human
ggaggagaacaggagggaggaggagaugaaagaggagggacagguucuuggugcuguaccuuug

SEQ ID NO: 104637 - RNA, 64 nt, Human
ccagauugacgacaagugcugaacaguggaggaagagggacagaugaaugccguggauugcacg

SEQ ID NO: 104638 - RNA, 64 nt, Human
agggaccuggaacccucuuggccaaggggagugggagggacagagggaaggucacaggcaaggg

SEQ ID NO: 104639 - RNA, 64 nt, Human
gucucaggcucugcuucuaaggaaagagacugaagagggacaacuuuuuccuaugaggacuccc

SEQ ID NO: 104640 - RNA, 64 nt, Human
caacaucugcugcuacucaaaauguccuguugaagagggacagcugugaugcccuuuugcuggg

SEQ ID NO: 104641 - RNA, 64 nt, Human
guuaaauaaaaauauucugaaugucacuccuuuugagggacagcacagccuucccuaggcauuc

SEQ ID NO: 104642 - RNA, 64 nt, Human
ucucagcugguccccaggcccacgggcacagggagagggacaacugcagcaguggggaggaggc

SEQ ID NO: 104643 - RNA, 64 nt, Human
uagucaugugccaccaccuuccugcccacaggccgagggacagggugaggguauacccaaagcu

SEQ ID NO: 104644 - RNA, 64 nt, Human
auauugaaauagcaaauagaaaugugcaggagcggagggacagcgacaccugguucuuaagcaa

SEQ ID NO: 104645 - RNA, 64 nt, Human
aaccugaugaccucucuggcuggccucccaggaggagggacacuccagccccccucucuggccc

SEQ ID NO: 104646 - RNA, 64 nt, Human
uucaggaggcuggaggaagggggguugcaguggagagggacagcccacugagaagucaaacauu

SEQ ID NO: 104647 - RNA, 64 nt, Human
cagcgccuggcccaguguaauauuuuugaaagaggagggacaauugugaaaucaguagguuauc

SEQ ID NO: 104648 - RNA, 64 nt, Human
gaagagaggagaggggcuaagacauugcugaucugagggacagaccucuaucaaauagaagagg

SEQ ID NO: 104649 - RNA, 64 nt, Human
ucuggcacacugagcauggucagggcauuggucagagggacagagcaaggaaugcauccugagc

SEQ ID NO: 104650 - RNA, 64 nt, Human
ucacugcccuccagaaaacagaggugacaaaugugagggacacuggggccuuucuucuccuugu

SEQ ID NO: 104651 - RNA, 64 nt, Human
gaguauggugcuugcucuuucacuuaacugauaagagggacaugccuacuaggaguuuuuaaug

SEQ ID NO: 104652 - RNA, 64 nt, Human
aagauggaauaaaagaaauugggaucuuggguuggagggacagugaagcuuagagcacaugaac

SEQ ID NO: 104653 - RNA, 64 nt, Human
guagguuccccaccaaaagcaggcuuucugcccugagggacaucuucccacuccccugcuccac

SEQ ID NO: 104654 - RNA, 64 nt, Human
ucuguuuuguuuuauuuuugguuuugguugaacagagggacagaagaauaaguaacacucccaa

SEQ ID NO: 104655 - RNA, 64 nt, Human
gcuugcugccugggagggaugcacagggccucuggagggacaggauggaccuggucagaggacg

SEQ ID NO: 104656 - RNA, 64 nt, Human
ccccagggcuagagcucagaugaccuuauuucuagagggacaggcuguucuguuggaagagucu

SEQ ID NO: 104657 - RNA, 64 nt, Human
gcaacuuuccaacuuuucauccaggcucccaaaagagggacaacgaacauggcaugugaaaagu

SEQ ID NO: 104658 - RNA, 64 nt, Human
aaagcugguccccagaaagcaggacagaaagaaggagggacaggcaggcagcaggaggggcgag

SEQ ID NO: 104659 - RNA, 64 nt, Human
ccacagggcuugaagcccggggccgccauugacagagggacaagcaaugggcuggcugaggccu

SEQ ID NO: 104660 - RNA, 64 nt, Human
uauggaguauggaaaaggccucugccuuccucaggagggacacauagugggucaucacccuuuc

SEQ ID NO: 104661 - RNA, 64 nt, Human
uuauggcaauaugaauggagcuuauuacuggggugagggacagcuuacuccauuugaccagauu

SEQ ID NO: 104662 - RNA, 64 nt, Human
ucucuuggaaugucaggucuuaaggcauuuaauugagggacaaaaaaaaaaaaagccgauauag

SEQ ID NO: 104663 - RNA, 64 nt, Human
agaauuacaaguagaauggcagcuggaauuuaaggagggacaagaaucaauggauaagcguggg

SEQ ID NO: 104664 - RNA, 64 nt, Human
uuuuuaugcccccaagcacuuucugcaguagcuagagggacagguuuccuuccaggaaggauuc

SEQ ID NO: 104665 - RNA, 64 nt, Human
uguauuggugaagagacugcaccuacuuucuguggagggacagguuauugaaacaaaguaugaa

SEQ ID NO: 104666 - RNA, 64 nt, Human
aggugggaggaaaagaaaacuucuuaccuuggaggagggacaucccgcuuccuuauccuuagcu

SEQ ID NO: 104667 - RNA, 64 nt, Human
ugcgccuuuuuuagcuucagucauggcagcaccugagggacacaaggacuugggugcaucagga

SEQ ID NO: 104668 - RNA, 64 nt, Human
ggacggcccagguaccugcucucuugggaagagagagggacagggacaagggcaagaggacuga

SEQ ID NO: 104669 - RNA, 64 nt, Human
gcuguggggguaagggcugccgcgcucuggccuggagggacaaggccagcacacggugccucaa

SEQ ID NO: 104670 - RNA, 64 nt, Human
caaaggauccagauagccuagggugagggugacagagggacagugggcuaugccacuaggcccu

SEQ ID NO: 104671 - RNA, 64 nt, Human
gucuuucuggucucccuaagaaaacuaagcucuugagggacagcccuuggcaaugcuuuccuau

SEQ ID NO: 104672 - RNA, 64 nt, Human
accagggaagcuguccuggaggucccuggucggagagggacauagaaucugugaccucugacaa

SEQ ID NO: 104673 - RNA, 64 nt, Human
gguggguugcaggaacagcacccaggacucugaggagggacagagaagcaagggggcugcugaa

SEQ ID NO: 104674 - RNA, 64 nt, Human
gcaaguccugcuguccacacccacaagcuaccuggagggacaggacccaccuccauccuucgga

SEQ ID NO: 104675 - RNA, 64 nt, Human
augcacgugccugacgcuuccaggaagcuguagagagggacagaaggggcgguucagccaagac

SEQ ID NO: 104676 - RNA, 64 nt, Human
gaauucaaaggaagcccuuuagaauuagagucuugagggacagcacuaacaggccuuuauuaag

SEQ ID NO: 104677 - RNA, 64 nt, Human
aaggaggcuccguuuugcaaaguggaggagggacgagggacagggguuucaccagccagcaacc

SEQ ID NO: 104678 - RNA, 64 nt, Human
aaagauuaggguuggugguggcagugcagcaggggagggacaaacaaccaagcuaugggugaca

SEQ ID NO: 104679 - RNA, 64 nt, Human
gcuauaguacuuugaaauuaucacccauauaaaagagggacauggacuauaacguugauuucuu

SEQ ID NO: 104680 - RNA, 64 nt, Human
guggaggguucugccgaacucaaugcagugagaagagggacagggacaaguaguccuugaaacu

SEQ ID NO: 104681 - RNA, 64 nt, Human
auccuccuccgauuucuaagguuccaguuuucuggagggacagucaucauguuuugauuuaucu

SEQ ID NO: 104682 - RNA, 64 nt, Human
uaaauacuugucaucauggacuccaacaggguuagagggacaggccuaaucaacugaaacuccu

SEQ ID NO: 104683 - RNA, 64 nt, Human
augccuucagaaauaaguccuagacuggacucuugagggacauauuggagaaucuuaagaaaug

SEQ ID NO: 104684 - RNA, 64 nt, Human
aaaaauacaguauuuucauuuaaauucucugauggagggacaacaaugguuucaacuguaugcc

SEQ ID NO: 104685 - RNA, 64 nt, Human
ugcaggggcaagcuguaaagggcaugggaacagugagggacauaugugggguccuaacaauauc

SEQ ID NO: 104686 - RNA, 64 nt, Human
uagaggucugcaacaugagugaagagguuaauuagagggacacacuuaucucugaaguuuuucu

SEQ ID NO: 104687 - RNA, 64 nt, Human
cucaaauaauuaaaaaggacuguauuguugaacagagggacaauuguuuuacuuuucuuugguu

SEQ ID NO: 104688 - RNA, 64 nt, Human
ccucaaguagaaauugcccaauuuuuaccagcuggagggacacccuuggguuuuuguacgaagc

SEQ ID NO: 104689 - RNA, 64 nt, Human
gcaggaauucuaacaggagugggugaggauggcagagggacacagugccugucucgccuccauc

SEQ ID NO: 104690 - RNA, 64 nt, Human
uggcgccucuguuugccaccacuuccccaggaaggagggacagcauuucucuggcugguuccac

SEQ ID NO: 104691 - RNA, 64 nt, Human
gacuggaugcauuacgaggacuggggacaggguagagggacauccagggaucagggcaugagug

SEQ ID NO: 104692 - RNA, 64 nt, Human
cacuggugggcagguucccauucuuuggggcugggagggacagcuugccuguuucuggucacaa

SEQ ID NO: 104693 - RNA, 64 nt, Human
uccucaaagcaaaugaacuuaagcauuugggauugagggacagaaggauucugagggggcucug

SEQ ID NO: 104694 - RNA, 64 nt, Human
augaaaacuuccuggcagcaaguuuucauauauagagggacaaugggagacagcaugcuguuuu

SEQ ID NO: 104695 - RNA, 64 nt, Human
auuuuuuuaagcaauaauuuauuugccuccuccagagggacauggcaauguuaccagcccaccu

SEQ ID NO: 104696 - RNA, 64 nt, Human
gaggugggggcagccgaugccugguccaggcugugagggacacguauggagcagauaaagaauu

SEQ ID NO: 104697 - RNA, 64 nt, Human
uaagaauggaaagguggcuugagcucagcuccuggagggacagugagaauuuauuuguauaugc

SEQ ID NO: 104698 - RNA, 64 nt, Human
agggcuggaaggagaccaaggggcagccgcccuggagggacaucagugcuuccucuuccaccca

SEQ ID NO: 104699 - RNA, 64 nt, Human
ccuggccuggccggggaagguggcagcggcaccggagggacacuuauggcuucauucgagagcu

SEQ ID NO: 104700 - RNA, 64 nt, Human
ggcaggggcaagugaacucagcacucugcagugagagggacagucccauguguggcagcauugu

SEQ ID NO: 104701 - RNA, 64 nt, Human
accuuugcugcccacugaaugaggacucccuggagagggacacgcgagaggcaggccaggcugc

SEQ ID NO: 104702 - RNA, 64 nt, Human
acaaugugucacuugcaaauaacaaagggacuuugagggacauuucauuaaauauaauuacuga

SEQ ID NO: 104703 - RNA, 64 nt, Human
cggagaggacagcggcaucucuaggcucuucugagagggacagagaaagaauagaaaugugccc

SEQ ID NO: 104704 - RNA, 64 nt, Human
caacaccaucccacacuguccaggccuuaacugagagggacagaagacgcuggaaggagagaag

SEQ ID NO: 104705 - RNA, 64 nt, Human
gccaaucuguacaaaaugguccuauuuuugugaagagggacauaagauaaaaugauguuauaca

SEQ ID NO: 104706 - RNA, 64 nt, Human
agaucaaauguguguuaagaaaaggugucgaggggagggacaaaaccagaaacgguggaaggac

SEQ ID NO: 104707 - RNA, 64 nt, Human
cacaccuauaaucccaacacuuucggaggccaaggagggacaaacgaacccuugaggccaggag

SEQ ID NO: 104708 - RNA, 64 nt, Human
uagggcaguucagaacccacuuguuucccuaucagagggacacagugaaguggagguuaaagua

SEQ ID NO: 104709 - RNA, 64 nt, Human
gcuugauaaaaaugcguuguucuuuuuucuuuuggagggacaagaugaaaauauauaauuugaa

SEQ ID NO: 104710 - RNA, 64 nt, Human
cuggccgggacaagauaaacggagcugguggcgggagggacagccccagagcagacccuuccua

SEQ ID NO: 104711 - RNA, 64 nt, Human
ugcgccuugcugauggcuugacaugugcaauugugagggacaugcucaccucuagccuuaaggg

SEQ ID NO: 104712 - RNA, 64 nt, Human
cccuggagaaggcauguucccagaaaggucucuggagggacaaacucacucaguaaaacauaau

SEQ ID NO: 104713 - RNA, 64 nt, Human
ggcagaucucaaggccaucaauuauugggggagggagggacaaacacucccaaucauccaccag

SEQ ID NO: 104714 - RNA, 64 nt, Human
gcugcuuagaaggcccuggaagggaagugaggaggagggacaaggaagaugacuaguuacggag

SEQ ID NO: 104715 - RNA, 64 nt, Human
cuuucagcuguagucuucuugaacacuucaugaggagggacauucccugauauaagagaggaug

SEQ ID NO: 104716 - RNA, 64 nt, Human
ggcacugccacucacacucggccccagggcccaggagggacagugccuggagccugggccaggc

SEQ ID NO: 104717 - RNA, 64 nt, Human
agggacagguucugucaggggugacaccaggagagagggacagguucuguugggggugacacca

SEQ ID NO: 104718 - RNA, 64 nt, Human
agggacagguucugucgggggugacaccaggagagagggacagguucugucaggggugacacca

SEQ ID NO: 104719 - RNA, 64 nt, Human
agggacagguucuaucaugggugacaccaggagagagggacagguucuguugggggugacaaga

SEQ ID NO: 104720 - RNA, 64 nt, Human
gaauaacaaacugcacaaccugcaaaccaggagagagggacagguucugucaggggugacacca

SEQ ID NO: 104721 - RNA, 64 nt, Human
aggcucgccaggcccugauccggucuguggggacgagggacacugaggagaggugcugggcacc

SEQ ID NO: 104722 - RNA, 64 nt, Human
agcacagagagcggcuuccccauugccuucuggggagggacacagaggacagcuuccccaucgc

SEQ ID NO: 104723 - RNA, 64 nt, Human
agcacagaggauggcuuccccauugccuucuggggagggacacagaggacggcuuccccaucgc

SEQ ID NO: 104724 - RNA, 64 nt, Human
ugaggaaauguguuggcucacuacguagaguccagagggacagucaguuuuaggguugccugua

SEQ ID NO: 104725 - RNA, 64 nt, Human
ucaaugaaauaaaagcacacugcuuaguauucuugagggacaaugccaauagguauauccucug

SEQ ID NO: 104726 - RNA, 64 nt, Human
aguuucugcagcagaugcuuuugguccagguacugagggacaaguagaaagauuugaaacaguu

SEQ ID NO: 104727 - RNA, 64 nt, Human
uuuaauaaaaaaaaagagagagagagagaggugugagggacaaaaugcaaaccuauuucccuug

SEQ ID NO: 104728 - RNA, 64 nt, Human
cuacuuccugucucuguuuccauuaucacccagagagggacaagauaggacauggccuggacca

SEQ ID NO: 104729 - RNA, 64 nt, Human
acuggcagguuauuaaucgagauacacuuguuaggagggacaggguuccccuaaggcacuuuua

SEQ ID NO: 104730 - RNA, 64 nt, Human
acuaugaagcuggagaugucuccuucuacaacaugagggacagaucgcacaucuacacaugucc

SEQ ID NO: 104731 - RNA, 64 nt, Human
gcuauguuaucuaugagagggagaaugagaaagagagggacagagagauaaaagaaauugggug

SEQ ID NO: 104732 - RNA, 64 nt, Human
cagugggggagggaugcagggacauuuacugaaggagggacauggacaaaacaacauugaauuc

SEQ ID NO: 104733 - RNA, 64 nt, Human
auuucucaaucagugcagugauacauguacuccagagggacaggguggacccccugagucaacu

SEQ ID NO: 104734 - RNA, 64 nt, Human
auuuacaaguaaucuguuaagauauacuauuugagagggacagauuagccuuuuaguaacuaua

SEQ ID NO: 104735 - RNA, 64 nt, Human
ucuuuccucucuggccacucugcucugcacauuagagggacagccaaaaguaaguggagcauuu

SEQ ID NO: 104736 - RNA, 64 nt, Human
ggugaccauggggaauguggggaucagggagguggagggacagugugaauaaauggcaucuagg

SEQ ID NO: 104737 - RNA, 64 nt, Human
gcuuuguaccucuuuugcaggaucuggggguggggagggacaagcuaguuccccaaccuccuau

SEQ ID NO: 104738 - RNA, 64 nt, Human
ccagugucugcuauuuugaagaagcuagggucuggagggacagagaacaguucccugauuaaca

SEQ ID NO: 104739 - RNA, 64 nt, Human
uggggccgcucugugcuggcgccugcuggccacugagggacagggacacgugccaccugcucau

SEQ ID NO: 104740 - RNA, 64 nt, Human
ccaagagacacaauuacgcagguauuuagaagcagagggacaaccagaaggcccuuaacuauca

SEQ ID NO: 104741 - RNA, 64 nt, Human
cagguccucuacugugaaggagcagggagcugccgagggacacgagccucagugcgggguggaa

SEQ ID NO: 104742 - RNA, 64 nt, Human
acuuuggccaacauccugcuuauuucucaaaaaagagggacagugaaaacaaaaacgacauugg

SEQ ID NO: 104743 - RNA, 64 nt, Human
ggccauugguagauguuugauugacuuaacaagagagggacaaauuuucaauuugugaaacucc

SEQ ID NO: 104744 - RNA, 58 nt, Human
agaugcccaugccuguguagccgccaccgagggacagccgagggaccgauggacgagg

SEQ ID NO: 104745 - RNA, 64 nt, Human
cuuggccagaguggggaggguggccagccacucugagggacagaacguccucuuguguauaaua

SEQ ID NO: 104746 - RNA, 64 nt, Human
ccaggauggcuuuugcugcggccccgugggguaggagggacagagagacagggagagucagccu

SEQ ID NO: 104747 - RNA, 64 nt, Human
gugcugcuuuucagguuaggggagagguggcccugagggacagcccagcucugagucucagucg

SEQ ID NO: 104748 - RNA, 64 nt, Human
cuguccgccuuuacaagggagaagacaacagaaagagggacaagaggguucacacagcccaguu

SEQ ID NO: 104749 - RNA, 64 nt, Human
auagccaaucaucuauugccugagagcacagcaggagggacaaugaucgggauauaaacccaag

SEQ ID NO: 104750 - RNA, 51 nt, Human
caaaagaaguggccaugugaagagggacacucaggacacuuuacgggauca

SEQ ID NO: 104751 - RNA, 64 nt, Human
ccccugaccaaaacuccuucccuguaguccagcugagggacacacaucccugggcccucuucug

SEQ ID NO: 104752 - RNA, 64 nt, Human
uuguucacggguggccuggcucacacuuggcucugagggacagguguggcgagaccugauuucu

SEQ ID NO: 104753 - RNA, 64 nt, Human
ggagugagauagaacuugggagcccggggguugggagggacagggauaaauaaagacaaagacu

SEQ ID NO: 104754 - RNA, 64 nt, Human
uaagggcaaagugaguuaauguguagacaaaggcgagggacaagagagaguuaacaucuagaca

SEQ ID NO: 104755 - RNA, 64 nt, Human
uguuaaaauggacauacauggaaccacuacugaugagggacaguuguauguuugcaucauauau

SEQ ID NO: 104756 - RNA, 64 nt, Human
ucccaaaaauuacuugggggugauugucacagaggagggacagaaaggguaucugcugaccacc

SEQ ID NO: 104757 - RNA, 64 nt, Human
agugguguuucuuuugcccuuucugguacaaacagagggacacuaagcauuaacuuaauaauca

SEQ ID NO: 104758 - RNA, 64 nt, Human
aagcagcagcgggccggcaaggccauaccucggugagggacagguggacaacggucaccuaucu

SEQ ID NO: 104759 - RNA, 64 nt, Human
gcgaggacagguugucuuucucuccccaguuggcgagggacacgaaggcugcggccgggcuggc

SEQ ID NO: 104760 - RNA, 64 nt, Human
cuaggaccuggggugugugacucaguccauaugagagggacaucuggguggaggaguaaauucc

SEQ ID NO: 104761 - RNA, 64 nt, Human
cacaagcaccucuccugugaguggcuaaugagaagagggacagaccgaccaccagcacaguagg

SEQ ID NO: 104762 - RNA, 64 nt, Human
cagcucauggcuuaggauggaauuagagacaggugagggacacucaggagcucauuuuccagcu

SEQ ID NO: 104763 - RNA, 64 nt, Human
gagauuaaaccuagguucagagcaugggugcucugagggacaaaguuggauuaguauaagggag

SEQ ID NO: 104764 - RNA, 64 nt, Human
gaaaaagugggagggcuggcuugggcugagaagggagggacagaaaagagaagacagaacaaag

SEQ ID NO: 104765 - RNA, 64 nt, Human
uuagcuggugaggaacgugcaggcacugaggcuggagggacauggagcccccucuuccagacac

SEQ ID NO: 104766 - RNA, 64 nt, Human
ucgcccauuggacuuccugaccucuucugucuuugagggacagagaccaagcuagauccuuuuu

SEQ ID NO: 104767 - RNA, 64 nt, Human
ccuguaagugggccucucacccuggaaaggaguugagggacaucagaugcuggaacccucacug

SEQ ID NO: 104768 - RNA, 64 nt, Human
aguaugaucccuaacuccugauuuggaugcaucugagggacaaggggggcggucuccgaagugg

SEQ ID NO: 104769 - RNA, 64 nt, Human
uacagaaaguagggaggaaggggaccaagccagagagggacagguauauguacagggcugagcu

SEQ ID NO: 104770 - RNA, 64 nt, Human
ucuuccugccauggaccccuggaggagaccuauggagggacaguuuugaccugaccccuagagg

SEQ ID NO: 104771 - RNA, 64 nt, Human
gccuuccuggaaguucagugagggaaagucaguugagggacacaaaaguguuuuguaaacuaua

SEQ ID NO: 104772 - RNA, 64 nt, Human
gaucaagucacuuagaucgcuccuugguauuccugagggacaaacuagagaucaguugacaaag

SEQ ID NO: 104773 - RNA, 64 nt, Human
uccucuccacugcuggacaugagauggagaggcugagggacaggaucuauaggcagcuucuaag

SEQ ID NO: 104774 - RNA, 64 nt, Human
uuuuucuuuuuuuuuuguuuuucgagggggcaaggagggacagaaaaguaaccucuucuuaagu

SEQ ID NO: 104775 - RNA, 64 nt, Human
agcuuuauucaauggcugggccauuuuguucuuggagggacaaaauugaccucuccaugaaauu

SEQ ID NO: 104776 - RNA, 64 nt, Human
cacauacauaccuaggucauccuaucacccaaaagagggacaaacaucugacuuggacagcuga

SEQ ID NO: 104777 - RNA, 64 nt, Human
aggcugugguggccacauaaaggaucuuccauuagagggacacaggacacaaagcuccauuccc

SEQ ID NO: 104778 - RNA, 64 nt, Human
ccugaucuuggggccuguuucccaugggauucaagagggacagccccagcuuuguguguguuua

SEQ ID NO: 104779 - RNA, 64 nt, Human
cucggugcucugccccaugcugggaggagggagggagggacaggugccuggagcccccggaacc

SEQ ID NO: 104780 - RNA, 64 nt, Human
uggagacugcuccugagcccccagcuuccagcaggagggacagucucaccauuuccccagggca

SEQ ID NO: 104781 - RNA, 64 nt, Human
cuauggagggcagagugggcugccuggggauugggagggacagggcuuggggagcaggucucug

SEQ ID NO: 104782 - RNA, 64 nt, Human
gacggcuguguagcgggccgcccacgggcagcaggagggacaaugcggccaggggacgagcgcc

SEQ ID NO: 104783 - RNA, 64 nt, Human
cuccccagccccaccccuaagugcccaaaguggggagggacaagggauucugggaagcuugagc

SEQ ID NO: 104784 - RNA, 64 nt, Human
uuagacuauaucaaccuacaacuuuagucgggaagagggacagggguggaccugaguuucgucu

SEQ ID NO: 104785 - RNA, 64 nt, Human
uacuguuggccugggagcugagagaaggcacugagagggacaguaggcggaggaccaggugagg

SEQ ID NO: 104786 - RNA, 64 nt, Human
gaagaugugcgggccagggaauguguuccacagagagggacagcaugugcaaaggcugagcacc

SEQ ID NO: 104787 - RNA, 64 nt, Human
ccagcagcagguuaccaagggcugucuggaaagggagggacaaaaggacccagaaguagaagaa

SEQ ID NO: 104788 - RNA, 64 nt, Human
uuuuguaaacuugaagugugugguggccgugggggagggacaugcuggcagcaggcgccuucuu

SEQ ID NO: 104789 - RNA, 64 nt, Human
gaauccauuuucuacacauuaacuugagcugcuggagggacacugcuggcaaacggagaccuau

SEQ ID NO: 104790 - RNA, 64 nt, Human
ucuacaaaggccaagaucacagaguacagucuuggagggacagaauuguuugugcuggguauug

SEQ ID NO: 104791 - RNA, 64 nt, Human
ccaguagcuguacagaggcccugccuggcuuguggagggacagacauuggggugauuggacaag

SEQ ID NO: 104792 - RNA, 64 nt, Human
ucugcuguaugucaacuuuaugcagcuuccuuuugagggacaaauuuaaaacaaacaacccccc

SEQ ID NO: 104793 - RNA, 64 nt, Human
uuccuccagccugaagucuucggcaaauagcucagagggacacggucuugccucucagugcuua

SEQ ID NO: 104794 - RNA, 64 nt, Human
ugggcucaguugagacuaaguaaauuaggagagagagggacaugcuuuuguaggcucaucccag

SEQ ID NO: 104795 - RNA, 64 nt, Human
cccuguggacuugcgucggcacccagaggccuuggagggacaaggcacugggcggugugacugg

SEQ ID NO: 104796 - RNA, 64 nt, Human
aggaagacucuggagccaaggcagaggggagcuugagggacaaugccacuauaguuuaauacuc

SEQ ID NO: 104797 - RNA, 64 nt, Human
uugcucuugcccuagaucccuguguuccagcguggagggacaaucgugccucgauggaugcgag

SEQ ID NO: 104798 - RNA, 64 nt, Human
uccuugggggugcaggguggagcagaaagugaaggagggacacgugcaagaguggugugcaugg

SEQ ID NO: 104799 - RNA, 64 nt, Human
aucaggguggguggggacaggccagugacgaagagagggacagaggagggaugggaacaggcug

SEQ ID NO: 104800 - RNA, 64 nt, Human
ccccugugauuuggagguguggagaaggggaagggagggacagcucacugguuccuucugcagu

SEQ ID NO: 104801 - RNA, 64 nt, Human
caaagcaaugaacucaagaaggaauugaaauaaggagggacaugauggggaaggaguacaaaac

SEQ ID NO: 104802 - RNA, 64 nt, Human
agggccuccgcagcuggacagagagugggggagggagggacagacagaaggccaaggcccgaug

SEQ ID NO: 104803 - RNA, 64 nt, Human
gccuauaagaggaaauaagagagaaaguggaggagagggacaaaaggaguaauuauuugguaua

SEQ ID NO: 104804 - RNA, 64 nt, Human
aucuuggaucccuuuaccucauauggaagaacuugagggacauuaguauacuuuuuuuuaagau

SEQ ID NO: 104805 - RNA, 64 nt, Human
ccagcccucuguggccaggagcccuggcccgcaagagggacagagcccgggagagacucgcuca

SEQ ID NO: 104806 - RNA, 64 nt, Human
acgcggacccuggauagugguucuaugacucugcgagggacaggcccacgcguguggggagaac

SEQ ID NO: 104807 - RNA, 64 nt, Human
gcuaaggccugagaguuuuugcagaaauggggcagagggacacccuuugggcguggcuuccugg

SEQ ID NO: 104808 - RNA, 64 nt, Human
cugcaucuuuggcucugcugugaucugauuggaggagggacaguuucugguacccauccucuga

SEQ ID NO: 104809 - RNA, 64 nt, Human
cugucuacuucauaggguuggaauaaggauaaaugagggacagguuggaugccguugcagagaa

SEQ ID NO: 104810 - RNA, 64 nt, Human
acccugaggagucugagguccugagcacugccaggagggacaaaggagccugugaacccaggac

SEQ ID NO: 104811 - RNA, 64 nt, Human
cagaugcagggacucugccacguugaauucuggugagggacauuguaguucgcaugguucucug

SEQ ID NO: 104812 - RNA, 64 nt, Human
agcugauucacaaacccacgcucaccugacagccgagggacacgagcaucacucugcuggacgg

SEQ ID NO: 104813 - RNA, 64 nt, Human
uucuaagguaucagugacacuugaguuuuccuaggagggacaucaauaacagcccccuaaagaa

SEQ ID NO: 104814 - RNA, 64 nt, Human
uuuugcaaagaaacuuuggugcugugaaaggggugagggacaucccuaagcugaagagagagac

SEQ ID NO: 104815 - RNA, 64 nt, Human
uuauucagggcugagugccaaaagcuugggggaggagggacagguccucggcaauaaacagugu

SEQ ID NO: 104816 - RNA, 56 nt, Human
cagacagucccacucucugaaggagggagggacacuuacccaaggcucuucuccuu

SEQ ID NO: 104817 - RNA, 64 nt, Human
aaggucauaagggagcaugauaggauuuggggcagagggacaggcuccucuggggaaacccccc

SEQ ID NO: 104818 - RNA, 64 nt, Human
cuuccugcggauguagagguggggccccuuccaagagggacaggccucuccccagcgcgccuuc

SEQ ID NO: 104819 - RNA, 64 nt, Human
agggggagggugggguaggucccccagcaagaaagagggacaggagcaccccaggcaggaccaa

SEQ ID NO: 104820 - RNA, 64 nt, Human
caccaguggccucugggcauucggcucaacgcaggagggacauucugcuggcccacccugcgcg

SEQ ID NO: 104821 - RNA, 64 nt, Human
acugcugcuccauauuagcuuccagagggugagugagggacagaauauuuccuucauaaugguc

SEQ ID NO: 104822 - RNA, 64 nt, Human
gugcugguuacuagucagugacagagaacacagagagggacaaacacagccaugaacccccugg

SEQ ID NO: 104823 - RNA, 64 nt, Human
cuucuaaagguaagugguuuaaguugccucaagagagggacaauguagcuuuauuuuacaagaa

SEQ ID NO: 104824 - RNA, 64 nt, Human
gcuggagaauugacugaagcacagcaccgggggagagggacacuccuccucggaagagcccguc

SEQ ID NO: 104825 - RNA, 64 nt, Human
gcugcgcacucccgaccgcgacguccacgcagcagagggacaugggccauuccaugacgugccc

SEQ ID NO: 104826 - RNA, 64 nt, Human
uaacuugguaggauuuuuaguauuuauuuuaauggagggacaaaugcuuucuaacugggccccc

SEQ ID NO: 104827 - RNA, 64 nt, Human
gccagcagggcugcugugaauuuguguaaggauugagggacaguugcuuuucagcaugggccca

SEQ ID NO: 104828 - RNA, 64 nt, Human
auaggaauaaugccuaggggaaagggagaagugagagggacaauuggguucauuuaugcccuau

SEQ ID NO: 104829 - RNA, 64 nt, Human
ggugugagucugcaggcccuggacccgcuggccagagggacaccuugguggcacugguggacau

SEQ ID NO: 104830 - RNA, 57 nt, Human
uuuccuuccucagauccugaucuccgggagggacagauggccaaucucuccccuucc

SEQ ID NO: 104831 - RNA, 64 nt, Human
ucuccugagcucuaggcugggauuacacccgcuggagggacacucaccccaucugcucccacgg

SEQ ID NO: 104832 - RNA, 64 nt, Human
cgacagaccgcauuccacccccaacaucggcacugagggacaucgggggcaaguuugcaguggg

SEQ ID NO: 104833 - RNA, 64 nt, Human
gcuccuugggacacaaacaagaaauguggacaaggagggacauuugcauacuccuacugucugu

SEQ ID NO: 104834 - RNA, 64 nt, Human
cuucuugguggggaugagaagggagagagagcuagagggacaaagagaaugagaagacauggau

SEQ ID NO: 104835 - RNA, 64 nt, Human
cuccucccucagcgaccagcucucccuggaacgggagggacagggaauuuuuucccccucuaug

SEQ ID NO: 104836 - RNA, 64 nt, Human
auuugaggaacaaggagcaagugaucuggcaaaagagggacaggaggaaaaugaaaccuguucu

SEQ ID NO: 104837 - RNA, 64 nt, Human
ggacaggaggcagacacugcccagaugcucgguggagggacagugauggccuuugacucaugag

SEQ ID NO: 104838 - RNA, 64 nt, Human
ggguuuaaacauuaaguaggagcuugggguggaagagggacagccggcugggccaccugagcag

SEQ ID NO: 104839 - RNA, 64 nt, Human
cauugcuggcuggaagggaggagcgcccucuagggagggacauggccccggugcggcugcagcu

SEQ ID NO: 104840 - RNA, 64 nt, Human
ccagagccguggcugcaaauccagcaggaauaaggagggacaaccacagccuccucauccaugu

SEQ ID NO: 104841 - RNA, 64 nt, Human
ugguugcuuuagccguuucucaccaugcaaugcagagggacaaagggcugugcuacacuuccca

SEQ ID NO: 104842 - RNA, 64 nt, Human
caggugggccuggcaggacuccagaugaggacaagagggacaagguauggggugggagccacaa

SEQ ID NO: 104843 - RNA, 64 nt, Human
ugagggucugggauggggugaaccuuccgcaccagagggacacuccacagaagccacagcccag

SEQ ID NO: 104844 - RNA, 64 nt, Human
uuugaggcugggugacgagaaaaucuagagacaugagggacauaaaugggccuggcagccucgg

SEQ ID NO: 104845 - RNA, 64 nt, Human
uccucaggacgcaggucacauucaccugugggcagagggacaggucagacacccaggcccaccc

SEQ ID NO: 104846 - RNA, 64 nt, Human
uccagcuggagugucuuaucaauccagaugaacugagggacaucuguuggucuauguauaacuu

SEQ ID NO: 104847 - RNA, 64 nt, Human
agcaaaguugugguucucuugcuaacuucaaggugagggacauugggcacccuaaguuugggaa

SEQ ID NO: 104848 - RNA, 64 nt, Human
agaaggugguaccugauggucuguucugacgggugagggacagaggcaucuggaugaaaaucuc

SEQ ID NO: 104849 - RNA, 64 nt, Human
gugcgccguugggggaagagcugcgucacagccagagggacaaagugugggugauccuggagac

SEQ ID NO: 104850 - RNA, 64 nt, Human
agacugggcuucagaccuggugcggagccaggcggagggacacagagccaggacucccagccgu

SEQ ID NO: 104851 - RNA, 64 nt, Human
caguuuaauauuccaauacccuagaagaaaacccgagggacagcagauuccacaggacacgaag

SEQ ID NO: 104852 - RNA, 64 nt, Human
cuucccaaaacugugccuguccccagcuucuggggagggacacagcuuccccuucccaggaauu

SEQ ID NO: 104853 - RNA, 64 nt, Human
ucuuggggugcuccuccaguuuaauuccugguuugagggacaccucuaacaucucggcccccug

SEQ ID NO: 104854 - RNA, 64 nt, Human
augagccagugccucgcaugauaccagaggaggcgagggacagagacagcaaggcagacagugg

SEQ ID NO: 104855 - RNA, 64 nt, Human
agaaaauaaaaaagcugggcuuggaggcugccuagagggacaggugggugaagggucaccacag

SEQ ID NO: 104856 - RNA, 64 nt, Human
gaauggcaugagggauugaugggggacuuggagggagggacaaguggugcccuguccccugcuc

SEQ ID NO: 104857 - RNA, 64 nt, Human
uccugccacccuuauaccuguucagccuccuaaagagggacaaacucugucucugcgugcacug

SEQ ID NO: 104858 - RNA, 64 nt, Human
ccacagacagcugagugcccuguccucagauggggagggacagggucggccuguaccccggagg

SEQ ID NO: 104859 - RNA, 64 nt, Human
uuccauugugcaauuuuacggggaugggugggcggagggacacaacaaaauuuaagaaugacua

SEQ ID NO: 104860 - RNA, 64 nt, Human
guuuccuuuguucacuuucuagauguguacuuuugagggacaugagguuaggcaacauuacagc

SEQ ID NO: 104861 - RNA, 64 nt, Human
aaaugccccgacaggggugcccagcacacugccugagggacaacagacaucagaacaaaccccc

SEQ ID NO: 104862 - RNA, 64 nt, Human
gaugggggcuggggccccaggcgucagccucccagagggacagcugagcccccugccuuggcuc

SEQ ID NO: 104863 - RNA, 64 nt, Human
ccuccggaucccauccaggcgcaaagaggaauaggagggacauggaaccauuugccucuggcug

SEQ ID NO: 104864 - RNA, 64 nt, Human
gagagggagagaggcagagagacagagagggagagagggacagagagagauagagcaggagguc

SEQ ID NO: 104865 - RNA, 64 nt, Human
ggagugagauagaacuugggagcccggggguugggagggacagggauaaauaaaggcaaagacu

SEQ ID NO: 104866 - RNA, 64 nt, Human
gugugcugacaggagacccagagagcuagggcuggagggacagggagcagggcagaaaacacag

SEQ ID NO: 104867 - RNA, 64 nt, Human
aggguuauugccccaaccauugcaaugggagguggagggacaggcucagccuccucauugucua

SEQ ID NO: 104868 - RNA, 64 nt, Human
caguauagaaaaguuaacacaaguacuaauaaaagagggacaucccgacuuacguuuuucuacc

SEQ ID NO: 104869 - RNA, 64 nt, Human
uugauucagaccauggacccuggaccuuguagaugagggacacuggccuggcccucgggucuuc

SEQ ID NO: 104870 - RNA, 64 nt, Human
caccagcgaucccuuggggcgggcaccuggcagugagggacagagcuaguggggugggcucagc

SEQ ID NO: 104871 - RNA, 64 nt, Human
gccugggaucuggcacacucccucuccuuggggugagggacagagccccacgcuguugacauca

SEQ ID NO: 104872 - RNA, 64 nt, Human
guguagcaggccuaccaggucccuuucaucuugagagggacauggcccuuguuuucugcagcuu

SEQ ID NO: 104873 - RNA, 64 nt, Human
uccuguuuuucgccuuauaguuuugugaguguuugagggacaacgaccaaaggucuuuucccca

SEQ ID NO: 104874 - RNA, 64 nt, Human
gaaaagaccuauuuuauuucuagguucaccaguugagggacauuuggauuguucccacuucuug

SEQ ID NO: 104875 - RNA, 64 nt, Human
uaaaaugaaagcugcucaaagucacagaacaaccgagggacaaaggagauuggaugacugggaa

SEQ ID NO: 104876 - RNA, 64 nt, Human
aaacaguuuuaaggagaagacuugaaugaaguuggagggacauugaaugauggucagagggcag

SEQ ID NO: 104877 - RNA, 64 nt, Human
gagauuuaauugccaguuagauguggcaugaaaugagggacaaagaaagcaucucguaggugug

SEQ ID NO: 104878 - RNA, 64 nt, Human
ugaaauuaauuuccuuacaguuuuccuagcugaugagggacagaaccagaacuagagccugagc

SEQ ID NO: 104879 - RNA, 64 nt, Human
cugcuauuaggccagcaagcggggaugucccugggagggacaugcuuagcaguccccuucccuc

SEQ ID NO: 104880 - RNA, 64 nt, Human
ccaggggugcaguggggugggugaggacgggugggagggacagggagggaccaauaaaucauaa

SEQ ID NO: 104881 - RNA, 64 nt, Human
uacauguuccuuccgaguuuucuuucgcuggaaagagggacaggggcccccacccgucaccacg

SEQ ID NO: 104882 - RNA, 64 nt, Human
cuacugggcuuggagcacguccgggcaguggagggagggacacagccugggacaggaagccucu

SEQ ID NO: 104883 - RNA, 64 nt, Human
ugccccugcccuaggggugucugucuccagaggggagggacaaauccccuacuggggccauuuc

SEQ ID NO: 104884 - RNA, 64 nt, Human
gaguucacccccagggcuggccagauggggccaggagggacagagcaaggggggugaaggccgu

SEQ ID NO: 104885 - RNA, 64 nt, Human
uaaggagagaaugccugccugcaacacucauggagagggacacuuccuggccccaccugcuaaa

SEQ ID NO: 104886 - RNA, 64 nt, Human
agaagcccucucucccucugggcuggagcucagugagggacaacucucuagggacaccuguacc

SEQ ID NO: 104887 - RNA, 64 nt, Human
cucugcugcccccuuccccagcccuuagcacagagagggacacaugccccucccccagcugcgu

SEQ ID NO: 104888 - RNA, 64 nt, Human
gauaaguaaggucagaauuuagcaaaaguauaaugagggacaugacaaaaucuguguccacuag

SEQ ID NO: 104889 - RNA, 64 nt, Human
ggguggcugccagcccugucccgggaccugcugggagggacaagaggcccucccccaggcagaa

SEQ ID NO: 104890 - RNA, 64 nt, Human
acaccccgguggaagcauuuagaggggaccacgggagggacaaggcuucucuguccgcccuuca

SEQ ID NO: 104891 - RNA, 64 nt, Human
ggggcgagggcugcccccuccuccccuccccagugagggacauuuuuugguaaaccuauuuuca

SEQ ID NO: 104892 - RNA, 64 nt, Human
uggacccacggaggagggagucacugcagggaaagagggacacuggcauuccauuugucagagc

SEQ ID NO: 104893 - RNA, 64 nt, Human
agagcauuuaucuguaaauauguuuguccugauugagggacacgaucuguguuccacucuauag

SEQ ID NO: 104894 - RNA, 64 nt, Human
cggagcagacgagggcagggcugggaaggauggggagggacauagaggauucgguuccuccccc

SEQ ID NO: 104895 - RNA, 64 nt, Human
caggguuagggggagcaggaagcccagauaaucagagggacagaaacaccagcugcucccccuc

SEQ ID NO: 104896 - RNA, 64 nt, Human
cuggggaagcggggguuggguguuuuagagacaggagggacaucuccgggugucuuuagucuug

SEQ ID NO: 104897 - RNA, 64 nt, Human
uuuugcgccucuugcgcgugcgccggggcacagggagggacagcgggaggugucgcggggagcc

SEQ ID NO: 104898 - RNA, 64 nt, Human
uccccagugcauaaggaucaagacagacaaugucgagggacaaaagauagaagauggaggagga

SEQ ID NO: 104899 - RNA, 64 nt, Human
uuucucauaccccacaaggucacagcaggggagggagggacaauuuuauaaugaaccaaaaauu

SEQ ID NO: 104900 - RNA, 64 nt, Human
gcagggcagucgcugcuggcucugggaagagagugagggacagaggaaacguuuauccuggagu

SEQ ID NO: 104901 - RNA, 64 nt, Human
ucaacaaacaaacaaaaagagccagugggggagggagggacagagacccagagggcagcgucag

SEQ ID NO: 104902 - RNA, 64 nt, Human
gggggagaaaacuguacucuguccagacaugauagagggacagagccaaaaggauagagaaaga

SEQ ID NO: 104903 - RNA, 64 nt, Human
uguaucgaaaaaugaaucugguaaaguuuggguagagggacaaugaaaucauugaugcuuuaug

SEQ ID NO: 104904 - RNA, 64 nt, Human
caaccauggggcuucugaccugagcaccaagguugagggacaggauuaggcagggucuguccug

SEQ ID NO: 104905 - RNA, 64 nt, Human
ugugccguaggaaagugacuggaaguggacuccagagggacaggugugguggcacaguccuggu

SEQ ID NO: 104906 - RNA, 64 nt, Human
cggugcaggcuguccuggcugcucuggggaagccgagggacagccauaacacccccgggacagu

SEQ ID NO: 104907 - RNA, 64 nt, Human
auggaaucacccagaggggugccuugcccuggcugagggacauguacugccucucaucuagaau

SEQ ID NO: 104908 - RNA, 64 nt, Human
augugcaggcucaccacucccaggccucugacaugagggacaugugacagugucauucaguauu

SEQ ID NO: 104909 - RNA, 64 nt, Human
agcuggacugggaggucaggaagccaggcaaggagagggacagcacaggccacagagggcugcc

SEQ ID NO: 104910 - RNA, 64 nt, Human
guuccagagaugugucagcccuuaucaggcaugggagggacacguucaggagaggagccuuaug

SEQ ID NO: 104911 - RNA, 64 nt, Human
accugucaagacgggaaggggaagaguagagagggagggacaaagugaggaaaaggugcucauu

SEQ ID NO: 104912 - RNA, 64 nt, Human
uggcacauggguguugggggaguagccuguguuggagggacaccagugcacuaggcagcugggg

SEQ ID NO: 104913 - RNA, 64 nt, Human
gccggcccugccccccacauucuggcuccaccgggagggacagucuggaggucccagacaugcu

SEQ ID NO: 104914 - RNA, 64 nt, Human
cugccauggagggugcccagcagacguggugugagagggacagcucacgaggcuuggaccugcu

SEQ ID NO: 104915 - RNA, 64 nt, Human
agccccuugggcaggucacacaaccugucccagcgagggacaccgaguggcccuucauguacau

SEQ ID NO: 104916 - RNA, 64 nt, Human
uccggcaacaucaacccgagucauucguucuguggagggacaaguggacucagggcagcgccag

SEQ ID NO: 104917 - RNA, 64 nt, Human
ccgagagccaggggaaggaguggcucugggcagagagggacacauagcacugggguggcagguc

SEQ ID NO: 104918 - RNA, 64 nt, Human
ccucauugugccuuuacuguuguguggacugcgugagggacaagaaguuccauuugaugucaau

SEQ ID NO: 104919 - RNA, 64 nt, Human
acauggacaccugugacagagagaggacaguuaggagggacagacagcucuuccuuucggagcc

SEQ ID NO: 104920 - RNA, 64 nt, Human
gcaggcuucuccugcaccuuuugucugcugggcugagggacacgagggcaacccugugacaaug

SEQ ID NO: 104921 - RNA, 64 nt, Human
aggggaggcucagcauggaaugaaacaggggagugagggacacaaggaggugggaagugggagg

SEQ ID NO: 104922 - RNA, 64 nt, Human
ggagagcugcagaguguccugccugccuuggcuggagggacaccucuccuggguguggagacag

SEQ ID NO: 104923 - RNA, 64 nt, Human
cagacuugacuuuuugcaaguccgcguguugcuggagggacacguguauuggagcccagaagag

SEQ ID NO: 104924 - RNA, 64 nt, Human
gaagagagagugggaggcagagugugauggggaggagggacaggaagacccuuuuaaugaugag

SEQ ID NO: 104925 - RNA, 64 nt, Human
agggggucucagaaacugcgaggccaguuccuuggagggacaugacuaauuuaucgauuuuuau

SEQ ID NO: 104926 - RNA, 64 nt, Human
aggaaggagauucuggcauguuggggugagggcagagggacagaugaggggaggagggugcugg

SEQ ID NO: 104927 - RNA, 64 nt, Human
agcacagggggauucugagcagugccucuugucugagggacauaucagugaccucgacguugcc

SEQ ID NO: 104928 - RNA, 64 nt, Human
uuacuucauuuugcuucaaauggccaauugugcagagggacaaagccacagccacacucuucaa

SEQ ID NO: 104929 - RNA, 64 nt, Human
ugaaaagucaauccugugagagagcuccauguaugagggacacucuccaaguugauaacaaugg

SEQ ID NO: 104930 - RNA, 64 nt, Human
auagaugcuuuucauuauacacacaaaaaucccugagggacauuuugaggcaugaauauaaaac

SEQ ID NO: 104931 - RNA, 64 nt, Human
ugccagaagagucuaguccugcucccacaguuuggagggacaaagcuaauugaucugucacacu

SEQ ID NO: 104932 - RNA, 64 nt, Human
cauuugacaugagaccccugaggcaacuagcuuugagggacacaucagguauacuagggaaaga

SEQ ID NO: 104933 - RNA, 64 nt, Human
aaggucugagugcccggcacggccucaggcccccgagggacagucggccuggaccggaccucuc

SEQ ID NO: 104934 - RNA, 64 nt, Human
aaaaacaguggacagcaccccgagggccacaggugagggacacuaccacuggaucgugucagaa

SEQ ID NO: 104935 - RNA, 64 nt, Human
uuuacucaauugguuacucucauuugaaaugagggagggacauacagaauaggaacagguguuu

SEQ ID NO: 104936 - RNA, 63 nt, Human
cccagacaaacagcagaugaguugaguggggcagagggacagggcagccagaccaaggccaag

SEQ ID NO: 104937 - RNA, 64 nt, Human
cuugggcucagccacugggagacaguugggaccugagggacagaggaucggaauggaaaccacc

SEQ ID NO: 104938 - RNA, 64 nt, Human
uuguuuuuuaaaagguuggggguguucagccacugagggacaaaacuuagcaucuaauuucaau

SEQ ID NO: 104939 - RNA, 64 nt, Human
gggucucacuccugaguggggccagggugggagggagggacaagggggaggaaaggggcgagca

SEQ ID NO: 104940 - RNA, 64 nt, Human
gcuccauccccauuauauuacaaauaaagaugcccuaaaugaguguggaaauucuaaugagaga

SEQ ID NO: 104941 - RNA, 64 nt, Human
ugcccauuuuaugcugcugugugguuuguuaaaucuaaaugauuuuuaaacuuuucucauagaa

SEQ ID NO: 104942 - RNA, 64 nt, Human
uggugcaugauaguaggccuucaauaaauuuuuucuaaaugaaugaaaucuuucuggacaaggu

SEQ ID NO: 104943 - RNA, 64 nt, Human
aucccagaagaguaaauguagcaugaugcccuuucuaaaugaaagguuuuuucuuuucuaugga

SEQ ID NO: 104944 - RNA, 64 nt, Human
uguuuagaauauaacagacauaagaaaaaauuaccuaaaugaagacuguacaaaauaauaaaua

SEQ ID NO: 104945 - RNA, 64 nt, Human
uugaagauuaggaaaaagauaguaguuauuuuuccuaaaugaaauaacuuucuucucuuccccu

SEQ ID NO: 104946 - RNA, 64 nt, Human
ugacuccaggaaaagccauuuugguuuuccuuaacuaaaugauaaauguaccccucucagucug

SEQ ID NO: 104947 - RNA, 64 nt, Human
uuaucagagauuuuuauauuuauacaaaagauuacuaaaugaaggauugcuaaauguuuuuggu

SEQ ID NO: 104948 - RNA, 64 nt, Human
gaagccgaaaucugcauaaggaagcccacuuuaucuaaaugauauuagccaggauccuuggugu

SEQ ID NO: 104949 - RNA, 64 nt, Human
uguaauaucuuuuacuacuugaacauuuaaauuucuaaaugagaaagguauauauauuacugua

SEQ ID NO: 104950 - RNA, 64 nt, Human
aagugagaaggagucacugugaugcuuagcuguccuaaaugaugguuugcucaaugccaggacu

SEQ ID NO: 104951 - RNA, 64 nt, Human
agagacuggaggcauuucuuuuuaggcucugagacuaaaugagaggaaaagaaaagaaaaaaaa

SEQ ID NO: 104952 - RNA, 64 nt, Human
ggguucagaaaacaucaaaacacugcagcaguuccuaaaugauucucacaagcaacccugagag

SEQ ID NO: 104953 - RNA, 64 nt, Human
uaggagggaaugagccucagggaggagugagcaccuaaaugaacgcaguaaaccuucauggacc

SEQ ID NO: 104954 - RNA, 64 nt, Human
ucauaauaucacacaauggaaggaaccuagauuccuaaaugacugcauaggacagaucccaucu

SEQ ID NO: 104955 - RNA, 64 nt, Human
ucgcuguugcucaaaauguauuuuaugaaucauccuaaaugagaaaauuauguuuuucuuacug

SEQ ID NO: 104956 - RNA, 64 nt, Human
gagcuauuuaaagcuuauuauauuuuaguaugaacuaaaugaagguuaaaacaugcuuaagaaa

SEQ ID NO: 104957 - RNA, 64 nt, Human
cgucucgggggcuuaaaaaaaaaaaaugcuguaucuaaaugaaucuguguaauugggcccagau

SEQ ID NO: 104958 - RNA, 64 nt, Human
uuggaaacuaagguuacucgugugcauaaaaauucuaaaugaaagggugugguuuccaucaauc

SEQ ID NO: 104959 - RNA, 64 nt, Human
cuccccucgaggugguaccuaagcuguggauuugcuaaaugaauuaagcaaccuagaagauaca

SEQ ID NO: 104960 - RNA, 64 nt, Human
auucucuugcucccucauucacuagggcaaaugucuaaaugaagaaaagucucucucaacaccu

SEQ ID NO: 104961 - RNA, 64 nt, Human
cuccacacauuucccuuggaugggacuugcaggccuaaaugagaggcauucugacugguuggcu

SEQ ID NO: 104962 - RNA, 64 nt, Human
uuuaguuagaaaauaaggcaaguuuugaagccugcuaaaugaagagacuuaagaaagcuuaagg

SEQ ID NO: 104963 - RNA, 64 nt, Human
uucaauucagugcuguacuugaugacagacacuucuaaaugaagugcaaauuugauacauaugu

SEQ ID NO: 104964 - RNA, 64 nt, Human
agugguuuccagauuggagcgagguuauucugaucuaaaugaacagcauuuuuuuccuuagccu

SEQ ID NO: 104965 - RNA, 64 nt, Human
agauagaaauacuuuauuuuuguaacuuuaaggucuaaaugacuaaacuucaaaguaagauuuu

SEQ ID NO: 104966 - RNA, 64 nt, Human
ccugcaagaauaguuauucuaaugaucacagcugcuaaaugaaucccaaacuuugcaccagguc

SEQ ID NO: 104967 - RNA, 64 nt, Human
ucuuuugaucuuuuaguuuuucccucagugaaggcuaaaugagauacacugauucuagguacau

SEQ ID NO: 104968 - RNA, 64 nt, Human
uuggaugaaugcaguauaaaauguaaaaacccugcuaaaugacuuauugauuaaguauaucuau

SEQ ID NO: 104969 - RNA, 64 nt, Human
cacucacacuaggcaaugccauuucaaugcauuacuaaaugacauuuguaguuccuagcuccuc

SEQ ID NO: 104970 - RNA, 64 nt, Human
ggugguuguuuuuggucucuguugucacuaaagacuaaaugaggguuugcaguugggaaagagg

SEQ ID NO: 104971 - RNA, 64 nt, Human
ucugucuagauguauugauggaauuucuggcuuucuaaaugauuuuacuuucugccuugaauuu

SEQ ID NO: 104972 - RNA, 64 nt, Human
auuuauaauaauugcaccuaccucccagggguaacuaaaugaauaaauauaauaaaguacuuac

SEQ ID NO: 104973 - RNA, 64 nt, Human
ugcauucaaaaucuucacugaauaucauauguaucuaaaugaaaagagaauuacuuauauucau

SEQ ID NO: 104974 - RNA, 64 nt, Human
ugugacacauucucuuuuuguuuauucccuuauucuaaaugaguucuaaaaacauaauauuuug

SEQ ID NO: 104975 - RNA, 64 nt, Human
agcaugugacauauugcuacaaagauuuuuuuuccuaaaugauucaguaauugaaugauuauuu

SEQ ID NO: 104976 - RNA, 64 nt, Human
uaaguagauccugagacuauuugcaugcuucugucuaaaugauaauuaaaaggaaauuucaugg

SEQ ID NO: 104977 - RNA, 64 nt, Human
aaauacuuucauuuauguuugcuagaaacauuuucuaaaugauagugauuagcugguuagccau

SEQ ID NO: 104978 - RNA, 64 nt, Human
guuuuagaauccuuugaaucuaaguauuuguuuccuaaaugaaacauuuguacaacauuugaug

SEQ ID NO: 104979 - RNA, 64 nt, Human
aaggaaugcugaugaacaauuuugcuaucgacuacuaaaugagagauuuucagaccccugggua

SEQ ID NO: 104980 - RNA, 64 nt, Human
uacaaaaucauggugacacuuccaauuaagugcacuaaaugaaaaguuaagucacuuauuaacu

SEQ ID NO: 104981 - RNA, 64 nt, Human
aucaguggugaagcaaguaggaccacugaugugucuaaaugagcaugacaggaacuaaacgaaa

SEQ ID NO: 104982 - RNA, 64 nt, Human
aaacauggucaguauucuguaaaguuccccuggccuaaaugauuacuugcucugggcaagugga

SEQ ID NO: 104983 - RNA, 64 nt, Human
aaucuggaauuacaauggggaguaauaauguauacuaaaugacuuuuguauuuuaaguuacuuu

SEQ ID NO: 104984 - RNA, 64 nt, Human
acuuaaguguguuaacuugugacuucuuucaagucuaaaugauuuaauaaaacuuuuuuuaaau

SEQ ID NO: 104985 - RNA, 64 nt, Human
uggaacucugaguccuccuaugaaccucuguagccuaaaugaaauucuuaaaaucaccgaugga

SEQ ID NO: 104986 - RNA, 64 nt, Human
gucauuugcugagcauguacugagccuuguaauucuaaaugaauguuuacacucuuuguaagag

SEQ ID NO: 104987 - RNA, 64 nt, Human
guguaaaaaacaacagcaaacaaaaaggugaagucuaaaugaagugcacagccaaagucaugua

SEQ ID NO: 104988 - RNA, 64 nt, Human
aaauucaaacugucacauuaagaaacaugauaaccuaaaugaccuaaauaagaacacuguaccu

SEQ ID NO: 104989 - RNA, 64 nt, Human
uuuuuaagucuucuugaaggcacucuaauugcugcuaaaugauguugcuucuuugcuaaaaaau

SEQ ID NO: 104990 - RNA, 64 nt, Human
auauuuaaagaaaaaaaaguaguuuuguaucaaccuaaaugagucaaaguucaaaaauauucau

SEQ ID NO: 104991 - RNA, 64 nt, Human
ugggauuuuguuaaucaaauuuauuguacuaugacuaaaugaaauuauuucuuacaucuaauuu

SEQ ID NO: 104992 - RNA, 64 nt, Human
gaguauaauuuguauacuuuuuuauaauuaaugacuaaaugaucacuuuggaggcaggguggug

SEQ ID NO: 104993 - RNA, 64 nt, Human
aaccaccuuugaaaagccacagagucuugaguuccuaaaugaauuugaaggcaaaaccguggaa

SEQ ID NO: 104994 - RNA, 64 nt, Human
guagcucaacuggacaucacagcagaaugaagaccuaaaugaccucagcaaauccucuucuaac

SEQ ID NO: 104995 - RNA, 64 nt, Human
uaaugucucccuaauaagucuucuuuccuuccaacuaaaugaccuacacggacuuuuauuuucu

SEQ ID NO: 104996 - RNA, 64 nt, Human
aacuguccuccauaauaaucaaacggugauucaucuaaaugacuucuagcaaccuaaguaaaaa

SEQ ID NO: 104997 - RNA, 64 nt, Human
ggucuucgauagguucuagggaaccagcuuuaagcuaaaugagguauaacaaugccaguuuucc

SEQ ID NO: 104998 - RNA, 64 nt, Human
cugugccauuugaacagucacuuccaagcucagucuaaaugaaaccgaaacgugaccacgcaca

SEQ ID NO: 104999 - RNA, 64 nt, Human
auaucagauacccauuauaggcauugaagguuaccuaaaugacagaaggaugcacuauauucau

SEQ ID NO: 105000 - RNA, 64 nt, Human
cuaauagucucaugucuuuuaaucuuaaccccagcuaaaugacucugaggaccaacaguacauu

SEQ ID NO: 105001 - RNA, 64 nt, Human
gaaaccguuuguuuucccucuccauuuucccuaacuaaaugaaaaggacacauucugaaauccc

SEQ ID NO: 105002 - RNA, 64 nt, Human
ugucggcugaaaagaagagcaauggcgucaaguacuaaaugauuaucaagggucaacuucugua

SEQ ID NO: 105003 - RNA, 64 nt, Human
acauguagugucacaugaauauucguauuguuaacuaaaugauuuauauuuuacugauuuaaua

SEQ ID NO: 105004 - RNA, 64 nt, Human
uuccuaacaaaagaugaaagcagggaauuucuaucuaaaugaugaguauuaguucccugucucu

SEQ ID NO: 105005 - RNA, 64 nt, Human
aggaugugggagaggagggucugaagcugagcugcuaaaugaauaucccugcucugcuggucaa

SEQ ID NO: 105006 - RNA, 64 nt, Human
auggagauguccucuccacuuuaucccacgauaucuaaaugaaaaagaaagaaaacccacacac

SEQ ID NO: 105007 - RNA, 64 nt, Human
guaugugguuuaucacauguagcucuuuugcaugcuaaaugaaaauucaaaacuugccaauaaa

SEQ ID NO: 105008 - RNA, 64 nt, Human
uuuuuccugcuucuaaaagugagaguaucacacccuaaaugaacacugucuacuaagagacauc

SEQ ID NO: 105009 - RNA, 64 nt, Human
cucaggcuggggagcacagaggggaggaggaggacuaaaugaaaaguuguucccagccugcaca

SEQ ID NO: 105010 - RNA, 64 nt, Human
cacuuuuuggaaaaaaaguuugcagacaccugcccuaaaugauuauaguuugagagaaacuuaa

SEQ ID NO: 105011 - RNA, 64 nt, Human
uaugucuccauauuacuguuucaugacugacugacuaaaugacacccaaaaugguuaagaugua

SEQ ID NO: 105012 - RNA, 64 nt, Human
aaaagcagaacauacauguaccaguuuuuggauacuaaaugacagccuuguuucuccccuuuga

SEQ ID NO: 105013 - RNA, 64 nt, Human
acuuuuccuguuggauucucuuuuacaaauaagucuaaaugacugauaauagaagauuguuagu

SEQ ID NO: 105014 - RNA, 64 nt, Human
agcuuuucugggggucucauaaagagcaguuuuacuaaaugauuguaugcuuaugcugaacacc

SEQ ID NO: 105015 - RNA, 64 nt, Human
guaggacccaaguuucuggacuacuucagaauaccuaaaugaaucauggaaacacucuuuauga

SEQ ID NO: 105016 - RNA, 64 nt, Human
gcugaggagaagcgggaguggcugauggaagcaccuaaaugaugccuuugucugugggaaggca

SEQ ID NO: 105017 - RNA, 64 nt, Human
auaagagaacucuccucuuuuuuuaaaaauaaaucuaaaugauuaucuugaaaaaguauuguuu

SEQ ID NO: 105018 - RNA, 64 nt, Human
uuuuuuaaacaaaugaguauuauaggacuuucuucuaaaugagcuaaauaagucaccauugacu

SEQ ID NO: 105019 - RNA, 64 nt, Human
aaucaguaauuaacauaucaaggagcucuucuagcuaaaugaccauccaguagagauuucccac

SEQ ID NO: 105020 - RNA, 64 nt, Human
uccacuuuugucuauguugaaaauuuucugggagcuaaaugaugagaacacauggacacaugau

SEQ ID NO: 105021 - RNA, 64 nt, Human
guuuucagaggauuuuuuaaaucacagaaucauacuaaaugauauuuagccuaucaaaacuucc

SEQ ID NO: 105022 - RNA, 64 nt, Human
ggcuguucaucuuugaaaccaggggaugcacagucuaaaugaauaucugcaugggauuugcuau

SEQ ID NO: 105023 - RNA, 64 nt, Human
gacuuggcacaacuauggugcugagaaugaaaaucuaaaugauugaaguuuuaaguccaaguag

SEQ ID NO: 105024 - RNA, 64 nt, Human
acuguacucccaguggccaaacuuauuuaugcugcuaaaugaaagaaagaaaaaagcaaauuau

SEQ ID NO: 105025 - RNA, 64 nt, Human
aacuugucuaaaucauauauuuuugucuaauaaacuaaaugaaaugacacccccuccccgcucc

SEQ ID NO: 105026 - RNA, 64 nt, Human
uuagcaaccauaauauggucacuacccuaauagacuaaaugaaaucuugcaauuucaaauuacu

SEQ ID NO: 105027 - RNA, 64 nt, Human
ucucauuugcaggaaaugcuggcauagagcagcacuaaaugacaccacuaaagaaacgaucaga

SEQ ID NO: 105028 - RNA, 64 nt, Human; identical to SEQ ID NO: 105027

SEQ ID NO: 105029 - RNA, 64 nt, Human
uauaaaaguauauauuuuaugugauuuauuccuacuaaaugaaagugcacuacugccucaugua

SEQ ID NO: 105030 - RNA, 64 nt, Human
uauuaaugagacaugaauugugucucaacagaaacuaaaugaacauuucagaauaaauuauugc

SEQ ID NO: 105031 - RNA, 64 nt, Human
gcuuuuauguauaacuuuaaugauuuauaagaugcuaaaugaauuguuuuuguaccuaaccauu

SEQ ID NO: 105032 - RNA, 64 nt, Human
guugggccccaaggauaaggcuacugauuugauacuaaaugaaucagcaguggauguagggaua

SEQ ID NO: 105033 - RNA, 64 nt, Human
caaaauccauuucuuauugaucuuuaaagaugugcuaaaugacuuuuuuggccaaaggcuuagu

SEQ ID NO: 105034 - RNA, 64 nt, Human
auuaaacauuaacaucacuaucauuuauuuauugcuaaaugaugcauaguauuuuagucuacuu

SEQ ID NO: 105035 - RNA, 64 nt, Human
uaacaacuggguuuaauuuaaugaguauuuuuuucuaaaugauaguguuaagguuuuaauucuu

SEQ ID NO: 105036 - RNA, 64 nt, Human
aaaaaucaaacauucauauccacaaaauuuucugcuaaaugacuccacacucagccuucucuac

SEQ ID NO: 105037 - RNA, 64 nt, Human
guaacugaagcuccagaguuaagguuucagauuucuaaaugaaacuaucuuuuucaauuacauc

SEQ ID NO: 105038 - RNA, 64 nt, Human
acaaaaauaucuugcuuacucuaaacuuuagagucuaaaugaagcuuuuucucaguacaagauu

SEQ ID NO: 105039 - RNA, 64 nt, Human
uggaugccauuuggaaaguaguggcccugcaagccuaaaugaaguaguauuuguaggccugggu

SEQ ID NO: 105040 - RNA, 64 nt, Human
aagugauaucuucugauuuuuuaaaugauagcaccuaaaugaaacuuucaaaaaguauggcagg

SEQ ID NO: 105041 - RNA, 63 nt, Human
gugagcuuuagaucauuaaauccaaaauguuugccuaaaugaguuuaucaguuguuaacuuca

SEQ ID NO: 105042 - RNA, 64 nt, Human
ccaguaaggaaauauuaagagcuauuuuagaaagcuaaaugaaucgcaaguuaacuuggaaauc

SEQ ID NO: 105043 - RNA, 64 nt, Human
ugacuaugccuggucaccuucuuggaucugcugucuaaaugauauauauaugauauauauguga

SEQ ID NO: 105044 - RNA, 64 nt, Human
ggcgaauaguaccaaucucuacaaauggcuuagacuaaaugagcagggauguagguaauggaaa

SEQ ID NO: 105045 - RNA, 64 nt, Human
ccuuaagugagaauuucuaaaugauuuucacauucuaaaugacuuuggguuuugaacucuccau

SEQ ID NO: 105046 - RNA, 64 nt, Human
ccccuaauucugugggugccuuaagugagaauuucuaaaugauuuucacauucuaaaugacuuu

SEQ ID NO: 105047 - RNA, 64 nt, Human
uuuugaaauuguagugcaaaauggucaguauuaucuaaaugaaugagccaaaaugacuuugaac

SEQ ID NO: 105048 - RNA, 64 nt, Human
cccagggcuggcucugcacuaagagaaaauugcacuaaaugaaucucguucccaaagaacuacc

SEQ ID NO: 105049 - RNA, 64 nt, Human
uaauaaaacagcauguuuucagguagagcuuaaacuaaaugauguguuuacuuagugcaguuuc

SEQ ID NO: 105050 - RNA, 64 nt, Human
cuugcaggcugagucccuccaugcaaaaguggggcuaaaugaaguguguuaaggggucggcuaa

SEQ ID NO: 105051 - RNA, 57 nt, Human
agaugaaaacuaagaaguaaaucaaugcuaaaugaagaaucuguacuuuguauguau

SEQ ID NO: 105052 - RNA, 64 nt, Human
uggaggaucauaagauagcaaaaccauuucaacacuaaaugaauauuaauguacacacaccuug

SEQ ID NO: 105053 - RNA, 64 nt, Human
caucgccaucuacaggagcagaagaauggacuugcuaaaugaccuagcacuauucucuggcccg

SEQ ID NO: 105054 - RNA, 64 nt, Human
caucaccaucuacaggagaagaagaauggacuugcuaaaugaccuagcacuauucucuggccug

SEQ ID NO: 105055 - RNA, 64 nt, Human
aaauggcccacaacacugaguuaguggacaccggcuaaaugaggaagagcagcaggcauuguca

SEQ ID NO: 105056 - RNA, 64 nt, Human
ccccucaccuuccucccgucccaccccagauauccuaaaugagagagaaaugacuuaaaaauaa

SEQ ID NO: 105057 - RNA, 64 nt, Human
auuugggccccaaaguagggugggaaguuuuccucuaaaugacuugaugguugccaaaucccuu

SEQ ID NO: 105058 - RNA, 64 nt, Human
cauuucuguuacuugucauuucuacuuucagaaacuaaaugacuuucaaauuuggguauagaca

SEQ ID NO: 105059 - RNA, 64 nt, Human
auauuacaaugagcauaaauaaucaagcuuaggacuaaaugaaagauacuaucucauguaugcu

SEQ ID NO: 105060 - RNA, 64 nt, Human
agaaaaaaugcuuagaguggacuauuaaaugugccuaaaugaauuuugcaguaacugguauucu

SEQ ID NO: 105061 - RNA, 64 nt, Human
ccuucugggagccaaacuggauaaguaccacagucuaaaugaggagcuugauuucuugguaaga

SEQ ID NO: 105062 - RNA, 64 nt, Human
gggaaagguaaauacaagugaacaaaauaagcaacuaaaugagaccuaauaauuggccuucgau

SEQ ID NO: 105063 - RNA, 64 nt, Human
ccaaacacuccauauucucacuuguaagugggagcuaaaugagaacacguggacacauagaggg

SEQ ID NO: 105064 - RNA, 64 nt, Human
ggagugucaucuuuugggcagggcaauccuggggcuaaaugagguacaggggaauggacucucc

SEQ ID NO: 105065 - RNA, 64 nt, Human
aacauaugcauuuuuccuuccuuuuaucacauugcuaaaugaguucugcuuucuuuuuggaacu

SEQ ID NO: 105066 - RNA, 64 nt, Human
uggcauucuuaaagauuuucuucaaaaagcaauccuaaaugaaaguguguaaauuauaagaagc

SEQ ID NO: 105067 - RNA, 64 nt, Human
acgcaguguaggucaaaagaaugcaugcacgcuucuaaaugaaucuugucugaauaugucgugc

SEQ ID NO: 105068 - RNA, 64 nt, Human
aauguaauuucuuuccuuuuuuggacacuuggaucuaaaugauguaaagcaaaacagcaucaau

SEQ ID NO: 105069 - RNA, 64 nt, Human
aucuuauguccaguagguucuugguaaacauuugcuaaaugaaauuacugauugaaauuugggg

SEQ ID NO: 105070 - RNA, 64 nt, Human
aaaacagacaaaaacuaauaacauauuagcugcccuaaaugaucuuggagagccaccaaaacuu

SEQ ID NO: 105071 - RNA, 64 nt, Human
auuuucuaaugcaguggaaaagaaacagaucauccuaaaugaggagguaacagggaaagcacug

SEQ ID NO: 105072 - RNA, 64 nt, Human
cauuaguuuacaaaguuagcacuuugaaguaaaacuaaaugaggaaggaaguaauguuaccuau

SEQ ID NO: 105073 - RNA, 64 nt, Human
aauucugauguacauucaggacaaaugauuagcccuaaaugaaacuguaauaauuucaguggaa

SEQ ID NO: 105074 - RNA, 64 nt, Human
uguguuuaaagugaauuuuuaaagacaaagcauucuaaaugaacucaauauaaaaacauucauu

SEQ ID NO: 105075 - RNA, 64 nt, Human
gagaagagagggcccucaaaucccauuccagccccuaaaugaaaguggcaucacaaggagaaaa

SEQ ID NO: 105076 - RNA, 64 nt, Human
guugacuuuguaucucugccugugauuuucuuuucuaaaugaaacuccauguagcaaccaggac

SEQ ID NO: 105077 - RNA, 64 nt, Human
acaucuuaaagcuaaaaaugaaccugcaagccuucuaaaugagucacugagcaucacuagugac

SEQ ID NO: 105078 - RNA, 64 nt, Human
ccagguugguuuugcuguugaucggucuccuaggcuaaaugagaaugaaagcgacuucagguca

SEQ ID NO: 105079 - RNA, 64 nt, Human
caguaaucagaguuaccauuauuuaauuuguaugcuaaaugaggagguacauugaaacccucca

SEQ ID NO: 105080 - RNA, 64 nt, Human
ugcaaagacuagguguauauuuuuuucuguuuuucuaaaugacccgugguacuuaauaggugua

SEQ ID NO: 105081 - RNA, 64 nt, Human
gacuguuaggaacaguuuguacaguauauacuugcuaaaugaguucauuaugacagucacauug

SEQ ID NO: 105082 - RNA, 64 nt, Human
augucauauguuaaaaauaaagagauguagaaaucuaaaugaauuaucacuguguauacagaca

SEQ ID NO: 105083 - RNA, 64 nt, Human
cauggucaucuggugaugaagagaaaaguuuaaucuaaaugauaugugcauuuccucauuuaaa

SEQ ID NO: 105084 - RNA, 64 nt, Human
auuuuuaagauguauauuuuguuaagcauauucucuaaaugagauauuguguggcuuuuuagua

SEQ ID NO: 105085 - RNA, 64 nt, Human
uggccggaauuuugaaucagcauuaauugaauugcuaaaugacugacauucauuccauuuaauu

SEQ ID NO: 105086 - RNA, 64 nt, Human
aggcucccagacguagaguaggaaacgugcucuucuaaaugaggagggagaagauaaaggaaac

SEQ ID NO: 105087 - RNA, 64 nt, Human
uugucuuuccaccuauuggaggaaugucaucuuccuaaaugaaguuuauuuggaggaacacagu

SEQ ID NO: 105088 - RNA, 64 nt, Human
aaagccuuuauuuauauuuaccacuuugcucaaccuaaaugaauucaagguagagagaauccag

SEQ ID NO: 105089 - RNA, 64 nt, Human
cuauuuccccagaguguucaaggcauuuuucuaccuaaaugaauaccuaaaucuugaguagugu

SEQ ID NO: 105090 - RNA, 64 nt, Human
uucacuugcuuugaaaguugauuuaauugacugacuaaaugaaaaugccuacccacucauauaa

SEQ ID NO: 105091 - RNA, 64 nt, Human
ggugauugauuugaguauuugaaaauuguuguagcuaaaugaagcaugauuagucuuaguauga

SEQ ID NO: 105092 - RNA, 64 nt, Human
uugccucuugggaaauuagcagauagucuuugcucuaaaugauaucugaguaaauagacuugag

SEQ ID NO: 105093 - RNA, 64 nt, Human
auacauuuuaaguauuuuuaaauagaugaaaauucuaaaugauuuucccucaaaucuaucuaga

SEQ ID NO: 105094 - RNA, 64 nt, Human
ucgccauaucuucuccuuuuccugguugaacucccuaaaugaaugauauucauuccaacugcug

SEQ ID NO: 105095 - RNA, 64 nt, Human
uauauaguaagaaaagaucaaaagacuuuaaaaccuaaaugacuuuugacauacaaacucuucu

SEQ ID NO: 105096 - RNA, 64 nt, Human
ucuuucauaaaaauuuaauuuccauaaucauaaccuaaaugaguucuuaaagaauucuauaagc

SEQ ID NO: 105097 - RNA, 64 nt, Human
uugacauuauguuuuauuuaaaugcuuuuuaucgcuaaaugacuugcagaugaaaaaaacuaag

SEQ ID NO: 105098 - RNA, 64 nt, Human
ugacuauuuauuuagaaaauuucuaggugaaaaacuaaaugauguuuuguauuuuucuugccua

SEQ ID NO: 105099 - RNA, 64 nt, Human
gcagggauaagcaggacaucgacuggaacguaugcuaaaugaaagcagacaaauuucuauuuuc

SEQ ID NO: 105100 - RNA, 64 nt, Human
aagaauucauucaagugaagccauuugugugccucuaaaugagucaucuaauuagauguuacuu

SEQ ID NO: 105101 - RNA, 64 nt, Human
auagccuucucuagcaacaucauuuucagacuaacuaaaugaaugcaguauacucuuuucuuug

SEQ ID NO: 105102 - RNA, 64 nt, Human
aacauuuucugaauucccauuuucuuguucgcggcuaaaugacaguuucugucauuacuuagau

SEQ ID NO: 105103 - RNA, 64 nt, Human
aaagguucuggcacuucaaugccaggcaggucuccuaaaugaacagaaugaucugugugagccg

SEQ ID NO: 105104 - RNA, 64 nt, Human
agcugguacuggcuucuuguuucaagagaugaaccuaaaugagauaggaagccugucccauagc

SEQ ID NO: 105105 - RNA, 64 nt, Human
uguucuguucccuauagagggccuauuccaggaucuaaaugaaugggaauuuauaauuccuuuc

SEQ ID NO: 105106 - RNA, 64 nt, Human
aaaaauuuguucuuuugucaugaauuuauaauuccuaaaugaagaccagaaaguacaaauugcu

SEQ ID NO: 105107 - RNA, 64 nt, Human
aaaauuauaaaaaaugaauuaguacuggcgaggacuaaaugaaacaauaauuuuucauuuugau

SEQ ID NO: 105108 - RNA, 64 nt, Human
cacaucggcagccucagcuaccacaacauacugacuaaaugaugauauuuacucaaguucaguc

SEQ ID NO: 105109 - RNA, 64 nt, Human
aguguauuuuaaaguaauaaugauuaaagaauaacuaaaugacucugauuuuguuuuaucaauc

SEQ ID NO: 105110 - RNA, 64 nt, Human
aaugcauucuguacuacauccugccuuuugaaaccuaaaugaguuuucguugaugaaauguugc

SEQ ID NO: 105111 - RNA, 64 nt, Human
cucuucuguuugucuugcaccuugucuaaggacccuaaaugaacgauaaacagagaugguagcu

SEQ ID NO: 105112 - RNA, 64 nt, Human
gggccuccggcacacucuuuccacucuguauuugcuaaaugaugcuaacugcuaccaaaaggcc

SEQ ID NO: 105113 - RNA, 64 nt, Human
cuuacauguuuucuccaaguguaaaaagucacagcuaaaugaucucacuccuguaugaauaagc

SEQ ID NO: 105114 - RNA, 64 nt, Human
agaaauucagguacagaaaacauguuuaaauagccuaaaugauggugcuuggugagucuugguu

SEQ ID NO: 105115 - RNA, 64 nt, Human
auuggcgaguuucuaaauauuaagacacugaucacuaaaugaauggaugaucuacucgggucag

SEQ ID NO: 105116 - RNA, 64 nt, Human
cugccccucuaccugggaggccaaauggcaacaacuaaaugacuccucugucaucaucagcgcc

SEQ ID NO: 105117 - RNA, 64 nt, Human
uuguguaaacaccucuggggauaagcugaggugacuaaaugauauauuuauauuauaagauuaa

SEQ ID NO: 105118 - RNA, 64 nt, Human
ugagcuggccugccuaauuaauuccuugugaaaacuaaaugauuuuuucaguuuggggaucauu

SEQ ID NO: 105119 - RNA, 64 nt, Human
uaugauucacccuaauagauaccuccauuauucucuaaaugaaauagaagacuuuggaguauau

SEQ ID NO: 105120 - RNA, 64 nt, Human
cguuuuguaaacuucuguucaaaaggaaagggaucuaaaugacaucagaacucuucagguacca

SEQ ID NO: 105121 - RNA, 64 nt, Human
cucugagagaagcuauaauuuaaucugugaggaacuaaaugacaggagauuggugcuaauacgg

SEQ ID NO: 105122 - RNA, 64 nt, Human
uguuaguacaugauuuuaaagguuagaaccccuucuaaaugaauggucuguggaagauuuuagu

SEQ ID NO: 105123 - RNA, 64 nt, Human
augcuuuuccauaacuuuuuaaaaauauauauaucuaaaugaaugcaaugugcauaaauauuuu

SEQ ID NO: 105124 - RNA, 64 nt, Human
aauuuuuaauugccuaagaaucauuggaucagaccuaaaugauccaucugcauuuuuauaagaa

SEQ ID NO: 105125 - RNA, 64 nt, Human
uugauaccuucugaugucaaagugauugugcaagcuaaaugaaguaggcucagcgauagugguc

SEQ ID NO: 105126 - RNA, 64 nt, Human
uucauaacuggaauugccaaauaagcauggagaucuaaaugauguacuuguuaguguauucauu

SEQ ID NO: 105127 - RNA, 64 nt, Human
uuagacaggcaucuauuuggaccuguuucuaucucuaaaugaauuuuuggaaacauuaaugagg

SEQ ID NO: 105128 - RNA, 64 nt, Human
ugggaaacaguuguuagcaaacccuuucaaccaucuaaaugaaaacacacaaauugaaaaugca

SEQ ID NO: 105129 - RNA, 64 nt, Human
ugauagugacaacaucuuaggauugcuuugaggucuaaaugaguuaacauuuucaaagcacuua

SEQ ID NO: 105130 - RNA, 64 nt, Human
caaauaucuucccuauaucuaaacaaugcaaaaucuaaaugaauaaguggucagacuccuuaau

SEQ ID NO: 105131 - RNA, 64 nt, Human
ccaccugauuucuucgucaugcauucggcauuugcuaaaugacaguuacuacaucaaucugcaa

SEQ ID NO: 105132 - RNA, 64 nt, Human
agcucucuagucuaacggucuuguaguuagagaucuaaaugacauuuuaucauguuuuccugca

SEQ ID NO: 105133 - RNA, 64 nt, Human
cuauuacagaaggggaaacugaggcugggaaaggcuaaaugacuuauccuccaucaguuauaac

SEQ ID NO: 105134 - RNA, 64 nt, Human
cuguaucuagccuggaaccaagguuaucuuggaacuaaaugacuuuucuccucucagugggugg

SEQ ID NO: 105135 - RNA, 64 nt, Human
ccucacuaugacacugagcaagaucuugucuccacuaaaugagcuccugcgggaguaguuggaa

SEQ ID NO: 105136 - RNA, 64 nt, Human
ccucuguugucucuucauauucuucuuccuuuuccuaaaugaaauuauauuauuucaacuacua

SEQ ID NO: 105137 - RNA, 64 nt, Human
ugccaaaaagaaaaaaaaagaguggaucaguuugcuaaaugaacauugaaauugaaaugcuuua

SEQ ID NO: 105138 - RNA, 64 nt, Human
aauguaagggcuauaaguagaaacuuucuauaaccuaaaugauguuauagaauuauuuuugagc

SEQ ID NO: 105139 - RNA, 64 nt, Human
cuauguauguuuuuuuccaaugcuucuuauaagacuaaaugauuagaaguaccuaauaguuuga

SEQ ID NO: 105140 - RNA, 64 nt, Human
uucuuuaaaaguguguuccuaaguagaaauacaccuaaaugaagauucucuuauuuuaucauau

SEQ ID NO: 105141 - RNA, 64 nt, Human
uuugaaaauucagggcuggugaaaaaaaucaacucuaaaugaugauaauuuuguacaguuuuau

SEQ ID NO: 105142 - RNA, 64 nt, Human
agcugaagucaggucuuuuaaucagguuagaauucuaaaugaugccagagaaggcuugggaaau

SEQ ID NO: 105143 - RNA, 64 nt, Human
uagcuugucucauugaauaguauuauugaagauacuaaaugaugcaaaccaaauggauuuuuuc

SEQ ID NO: 105144 - RNA, 64 nt, Human
cucucaauaauugaaagguggugguaguuguauucuaaaugauguagaagguuuaaaaauaauu

SEQ ID NO: 105145 - RNA, 64 nt, Human
aaaagcuaauugaggacaauuuuuuuuuaauuuccuaaaugagaccaccuuggauuuuuauuuu

SEQ ID NO: 105146 - RNA, 64 nt, Human
agacacuuacuugaugauuuuuaacuuuuuauuucuaaaugagacgaaaugcugauguauccuu

SEQ ID NO: 105147 - RNA, 64 nt, Human
uaaauuucaacuuuccauaauauuaagaauguagcuaaaugaugucccaaacuacuuacaaacu

SEQ ID NO: 105148 - RNA, 64 nt, Human
gagucuaguuuucucucaaaaugagaacauuaggcuaaaugauuuccgaguuuccagcuagucc

SEQ ID NO: 105149 - RNA, 64 nt, Human
uguuagguguuuguacuccaugaggaugagaacucuaaaugaggugguguauggaaagccgauc

SEQ ID NO: 105150 - RNA, 64 nt, Human
guuuucuguggacugaaaaaucguguccuuuucucuaaaugaaguggcaucaaggacucagggg

SEQ ID NO: 105151 - RNA, 64 nt, Human
uaccaggaacccagcggcucuagccacugagcggcuaaaugaaauaaaguggaaaaaaaaaaaa

SEQ ID NO: 105152 - RNA, 64 nt, Human
uuaugaacugagggugaaauauauuucugaauagcuaaaugaagaaaugggaaaaaaucuucac

SEQ ID NO: 105153 - RNA, 64 nt, Human
acaauguauuugguguguaggggaggggggagaacuaaaugaguuuucagcuuuauaaauuguu

SEQ ID NO: 105154 - RNA, 52 nt, Human
aggagagcaccuauuuuuaaaccuaaaugagguauaaggacucacacaaauu

SEQ ID NO: 105155 - RNA, 64 nt, Human
aacacaauaauguguccuucuacauuuuauuacacuaaaugauauucauauucaagcaacagca

SEQ ID NO: 105156 - RNA, 64 nt, Human
auaauuguaccaaccucauagaguuuggugucaacuaaaugagauuauauguggacuaaauauc

SEQ ID NO: 105157 - RNA, 64 nt, Human
accugcugcaagagccauaacuuugaggcauuuucuaaaugaacuguggggauccaggauuugu

SEQ ID NO: 105158 - RNA, 64 nt, Human
cgggcucccagcccgccccuccucccggcacucccuaaaugaucucuccuuccccccccccacc

SEQ ID NO: 105159 - RNA, 64 nt, Human
auuagguuaagaccaguacugcaggauuguugcacuaaaugaaauacuguaugugaagugccug

SEQ ID NO: 105160 - RNA, 64 nt, Human
cuccaggggcuaauaaagaguauuuaccacuucacuaaaugaccccaauuugccauuuucaaac

SEQ ID NO: 105161 - RNA, 64 nt, Human
auuugaaagggacagcacuguguauguuuauaaacuaaaugaagauaagauauuauuuuguaua

SEQ ID NO: 105162 - RNA, 64 nt, Human
uguugaccugagcuaguauugcuguguaucuacucuaaaugagaugaucuauuuuuuugcuagc

SEQ ID NO: 105163 - RNA, 64 nt, Human
gugcugaguagguaauagugacccaacuuguuugcuaaaugauuauuuguuuaaaucuguacag

SEQ ID NO: 105164 - RNA, 64 nt, Human
uagcuagcauguauacaaaauauauuugagguuacuaaaugaauaaaaacucggaauuaggcca

SEQ ID NO: 105165 - RNA, 64 nt, Human
caucaauuccagacaucuucauguuccuaauaggcuaaaugaaguuaaaaacuuauuucagauu

SEQ ID NO: 105166 - RNA, 64 nt, Human
cuuggaaaguucugcuuugacaaacugacaaagucuaaaugagcacauguaucccagugagcag

SEQ ID NO: 105167 - RNA, 64 nt, Human
ucuaauaucaaagugcucagugguuugcccuuggcuaaaugaagcagagccaggaaaaacagac

SEQ ID NO: 105168 - RNA, 64 nt, Human
agaaucuaauaaaccaauguagcauuauuuuuuucuaaaugaagccccaaaaaagaaaagugcc

SEQ ID NO: 105169 - RNA, 64 nt, Human
cccuccucuuccucagcagaacccauuugagauucuaaaugaauacucuuagucucuaaaguug

SEQ ID NO: 105170 - RNA, 64 nt, Human
auugccucagcuacugaagguggccaccuccacucuaaaugacauuuuguaaauaguaaaaaac

SEQ ID NO: 105171 - RNA, 64 nt, Human
uuuaauuuuuaaccugauucucugaugucaugaucuaaaugagggguagugggggauggaagag

SEQ ID NO: 105172 - RNA, 64 nt, Human
uugcuucagccucaaagaggguguuuauguaaaacuaaaugagugcaggcagcgagcuacacuu

SEQ ID NO: 105173 - RNA, 64 nt, Human
ggcaguagaaggaccccuggagccagaggguuuucuaaaugagauaacugggggcaaagguugg

SEQ ID NO: 105174 - RNA, 64 nt, Human
aguucacaucaaaaagagugaaugugguauauuucuaaaugauauggaaaauagagacagauuu

SEQ ID NO: 105175 - RNA, 64 nt, Human
aauaggcagacuguuuauguuaaaaaaauucuugcuaaaugauuucaucuuuaggaaaaaauua

SEQ ID NO: 105176 - RNA, 64 nt, Human
guagaagaggugguguuuguuuaucucuuggauacuaaaugaaaugaggugugugggcuuguca

SEQ ID NO: 105177 - RNA, 64 nt, Human
uuuuccucuucuauagacuugagaauguuuuucucuaaaugagagaaagacuuagaauguacac

SEQ ID NO: 105178 - RNA, 64 nt, Human
ugcagucacagacuugagagcaauaaaugcaaaccuaaaugagaaaauggaaucccugacagcu

SEQ ID NO: 105179 - RNA, 64 nt, Human
uuuaacccgcuucuaccugcccaacugugaccaacuaaaugacagaugugugagaacaagaacu

SEQ ID NO: 105180 - RNA, 64 nt, Human
cacaaagcaguauuucuaaauaugccuugaagaacuaaaugaaguguauagcacuugccuuuac

SEQ ID NO: 105181 - RNA, 64 nt, Human
aaaaacacuuccaaaaagauacacagaagaggaacuaaaugacugcgaagcuggaauacugcua

SEQ ID NO: 105182 - RNA, 64 nt, Human
cacugcuuaaaguacauuaugcuuuuuaauggaacuaaaugaucaaaaaaagaauggacuguaa

SEQ ID NO: 105183 - RNA, 64 nt, Human
acaguaacagugagcacagccaagccugacacuacuaaaugauuugguagugaagccaggacau

SEQ ID NO: 105184 - RNA, 64 nt, Human
uugcagaaaaacaauggauacauuuucuucuggccuaaaugaauauuuaugugcaaacauaggc

SEQ ID NO: 105185 - RNA, 64 nt, Human
uucacccuguccccacuccccacaguuuuaggaucuaaaugauugccucuggaacuauucuucu

SEQ ID NO: 105186 - RNA, 64 nt, Human
uauaccgagggggauacaaccguuuugcuccauacuaaaugacaaaaccauaaaaaccuuccaa

SEQ ID NO: 105187 - RNA, 64 nt, Human
cuccugugucuugcaauggcagccuuggcaaacgcuaaaugaaaaucgugacaacacuuguguu

SEQ ID NO: 105188 - RNA, 64 nt, Human
cuguucagcuguuauuaaacugucauuucucccgcuaaaugaaaaccguguuguuauaaagcuu

SEQ ID NO: 105189 - RNA, 64 nt, Human
uagaaaguauguuuguguugguuuuuuaagaagucuaaaugaaguuauuaauaccugaagcuuu

SEQ ID NO: 105190 - RNA, 64 nt, Human
aaaaaauugacuaccuggaggaaugauuaggaaucuaaaugaagccagcccucgguaucugcag

SEQ ID NO: 105191 - RNA, 64 nt, Human
ucgccagcaacaagcacguaguguaguguuccugcuaaaugagcguagguuauccaaaccuugg

SEQ ID NO: 105192 - RNA, 64 nt, Human
accucccugguccccguuugucaaagaggauggacuaaaugaucucugaaaguguugaagcgcg

SEQ ID NO: 105193 - RNA, 64 nt, Human
accugccaccgcccaggaccagucugcccacugccuaaaugaugcccggccagcaggaccuggc

SEQ ID NO: 105194 - RNA, 64 nt, Human
uauccaaguauagugcagauucuauguaaaacuacuaaaugacacuggaauauguuuaguagau

SEQ ID NO: 105195 - RNA, 64 nt, Human
cuauauuuaucugagugaguccaaggugcaacuccuaaaugaauuguguugcagagaacuccca

SEQ ID NO: 105196 - RNA, 64 nt, Human
ccauuucugguauuuaaaaaauaucuaggaggagcuaaaugacaaaacacagcaguguuuugag

SEQ ID NO: 105197 - RNA, 64 nt, Human
ugcagcaacguggauggagcuggaagccauuauccuaaaugaacucacucagaaacagaaaacc

SEQ ID NO: 105198 - RNA, 64 nt, Human
cugcagaucaaauguaaagcuuccaguuaaggagcuaaaugagguccucagcugaaugaggaac

SEQ ID NO: 105199 - RNA, 64 nt, Human
uaugaauuuuuucucacucuagcaauucccuuuucuaaaugacacagcauuuaaacucaaaucu

SEQ ID NO: 105200 - RNA, 64 nt, Human
cggggaggccaagugcaggcuggcaccgccuucucuaaaugaggggccucagguuugccugagg

SEQ ID NO: 105201 - RNA, 64 nt, Human
ugauauguuagaggcaguauccuuaauauucauucuaaaugaguuaacgacuuaacuugaaauu

SEQ ID NO: 105202 - RNA, 64 nt, Human
uggggcuaucuccguugcuauauuaauggcaagacuaaaugaaaccuagggcacggccuccgaa

SEQ ID NO: 105203 - RNA, 64 nt, Human
uugcccuuacagguggaguaucuucgucacacaucuaaaugagaaaucagugacaacaagucuu

SEQ ID NO: 105204 - RNA, 64 nt, Human
ucugucuguccaaagguuuuugagagucucacuucuaaaugaaacaaugcaacauuucacuuug

SEQ ID NO: 105205 - RNA, 63 nt, Human
gauggugcugagaagcuuuugaauaaaaacuuugcuaaaugagaauaagcugauuuaugugau

SEQ ID NO: 105206 - RNA, 64 nt, Human
uccuagaauccccaugacucaaucaaggacugugcuaaaugagauuguccagcccccgcccuug

SEQ ID NO: 105207 - RNA, 64 nt, Human
acaggcugaaggguuaagaucuaaucucccuaaucuaaaugacagucuaagaguaaguaaaaga

SEQ ID NO: 105208 - RNA, 64 nt, Human
ggagguggagggacaggcucagccuccucauugucuaaaugaggccuaaaugugugaagugcga

SEQ ID NO: 105209 - RNA, 64 nt, Human
aucaaaugccaaaguagcugauguauuggacguucuaaaugagguagaugaauauucugguucu

SEQ ID NO: 105210 - RNA, 64 nt, Human
uuuuccauagagccuaaacuuuauagaucacuaucuaaaugaaaauuuacaucaaacuaguguu

SEQ ID NO: 105211 - RNA, 64 nt, Human
caccuccugccucugcuuauuucuuguucuggaacuaaaugaacagaacuucaaauacuuccua

SEQ ID NO: 105212 - RNA, 64 nt, Human
gggagugacagguuaugacauuuccaugucaacucuaaaugaagucuuuaugaaacuggaagga

SEQ ID NO: 105213 - RNA, 64 nt, Human
uucucaccucuguaaauuuuagucucaaucucaccuaaaugaaucaggucugcccuuuaucuug

SEQ ID NO: 105214 - RNA, 64 nt, Human
uuguuuguuuggaaggcagggcaggcugccguugcuaaaugauuuaauaauauuguaauucugu

SEQ ID NO: 105215 - RNA, 64 nt, Human
uggaucugaggaggcuuugguaaaacaguuucaucuaaaugaaagugguaauccucuucuaaaa

SEQ ID NO: 105216 - RNA, 64 nt, Human
uuaaaauuuuuuuuucucuuaaugaacacauuuucuaaaugaauuuuuuuuguaguuacuguau

SEQ ID NO: 105217 - RNA, 64 nt, Human
uuaccagcuauuuauugagugucuuuuauguaggcuaaaugaacauaggucucuggccucacgg

SEQ ID NO: 105218 - RNA, 64 nt, Human
aaauauaugaggaagcgacacuucgaauauucuacuaaaugagaguucugaguauagaaaauaa

SEQ ID NO: 105219 - RNA, 64 nt, Human
uuucuccauaguacguagaccuucuaauacucugcuaaaugaaaccacacuuguuaucugaaag

SEQ ID NO: 105220 - RNA, 64 nt, Human
agaucaagcagagaaaauaauuaauuucaugggacuaaaugaacuaaugaggauaauauuuuca

SEQ ID NO: 105221 - RNA, 64 nt, Human
aaauuuaauuugaauucaacuuaauuuaagccaccuaaaugaccucuaucagggauuucugaau

SEQ ID NO: 105222 - RNA, 64 nt, Human
ccuggccauauaucaagguuucaauaaauauuugcuaaaugagugaaucuacugagugcuuacu

SEQ ID NO: 105223 - RNA, 64 nt, Human
ucucaaaaaugauuucaguugaauaacuugccuucuaaaugaucaauuuacuucucccccaauu

SEQ ID NO: 105224 - RNA, 64 nt, Human
gaaacuugacucaacuauacacaaaguucucauccuaaaugaacuauuucagucaagcccacuc

SEQ ID NO: 105225 - RNA, 64 nt, Human
aggaaaaugucccugcuuaauaauguaagccaagcuaaaugaugguuaaaguuaucaggccucc

SEQ ID NO: 105226 - RNA, 64 nt, Human
uuaaaaauguucauaacauuggauagucuagucucuaaaugaugacuaaguagugggguuggcu

SEQ ID NO: 105227 - RNA, 64 nt, Human
gagaggacaaaaaagcccaacuugccaccagaugcuaaaugagacuugacagcugcagagcuug

SEQ ID NO: 105228 - RNA, 64 nt, Human
ucagggaagucagcugccggggagaaacuugcuccuaaaugaacacauaaguuuagaucgcaau

SEQ ID NO: 105229 - RNA, 64 nt, Human
gggcuuguauguucuuuuggccuuuuguuccuaccuaaaugaagaaaccaugccuggaggggcc

SEQ ID NO: 105230 - RNA, 64 nt, Human
auucucugggcuggaaugugaagccucagucacucuaaaugaagaauuuucuuuugaauguuuu

SEQ ID NO: 105231 - RNA, 64 nt, Human
cuuugcacagaaugagcuucgagcuuuguucagacuaaaugaauguaucugggaggggucgggg

SEQ ID NO: 105232 - RNA, 64 nt, Human
uggaccaugaauugcacugucucccuccucauuucuaaaugaaagguauuagauauaaauuuuu

SEQ ID NO: 105233 - RNA, 64 nt, Human
gauuauaagacaaugcugcuuugguuaaucucuucuaaaugaauuuagagagauugacuuuuau

SEQ ID NO: 105234 - RNA, 64 nt, Human
ccuguccacacugcuggagauacuaagucccaaccuaaaugauggaaggagcaucuccccucuu

SEQ ID NO: 105235 - RNA, 64 nt, Human
uacuuucccguacauuuuuuagaaagcauaauuccuaaaugauuuugaagggaaaguacuauuu

SEQ ID NO: 105236 - RNA, 64 nt, Human
acacaccacaguguaaauuaugccuuaucagaaucuaaaugaaaauagcgaacauuuaaaagcu

SEQ ID NO: 105237 - RNA, 64 nt, Human
auuacugcauagaaaucaaauguaaguuuagcuucuaaaugaaauaauauauaggagggauauc

SEQ ID NO: 105238 - RNA, 64 nt, Human
cauacauugagccuaaacagcaguuaaguugucucuaaaugaacuagcaaaaaaaaaaaaugua

SEQ ID NO: 105239 - RNA, 64 nt, Human
uugcuauuucuugucuauuuuaacccgucugcuucuaaaugaugucuagcugcuuaccaacuuu

SEQ ID NO: 105240 - RNA, 64 nt, Human
guuucucacauaucucacauauaauguaauuucccuaaaugaaguugucucuacuucugcucau

SEQ ID NO: 105241 - RNA, 64 nt, Human
uaccuauuucuugugggucuccuauuaccagcuucuaaaugaauguuguuuuugacccaguuug

SEQ ID NO: 105242 - RNA, 64 nt, Human
ugacaauaaauugugcuguacauguccuuaccaacuaaaugauguaaaacuuucuuaaaguaau

SEQ ID NO: 105243 - RNA, 64 nt, Human
aaauagacuauuuggaucacauuucucauuccuccuaaaugaucaucuuaauuuuuuuucccaa

SEQ ID NO: 105244 - RNA, 64 nt, Human
uguuucaggguuuucaagcuuuuacucuuaauuccuaaaugagaucaauaaauuuuauaaccaa

SEQ ID NO: 105245 - RNA, 64 nt, Human
ugacccaagugccaaaggcagacgugcuuuauagcuaaaugaacaaagcaaaggauacagaggu

SEQ ID NO: 105246 - RNA, 62 nt, Human
ccaagcgccugguccuguccucuugagcugcccuugcccagcacugcacucuggaggugggu

SEQ ID NO: 105247 - RNA, 62 nt, Human
ccccuccccagcccccucucccggacagacgccuugcccaggguguguuugcugagugucuu

SEQ ID NO: 105248 - RNA, 62 nt, Human
accgugaggcacgcuggaguuauuugacucgacuugcccagggucccaggucagugcuccuc

SEQ ID NO: 105249 - RNA, 62 nt, Human
gaugggagaacagucucagcacaauugagcagcuugcccagcuaggagcagcagcaacacga

SEQ ID NO: 105250 - RNA, 62 nt, Human
cagcaacgcucacucuacccccaacaccaccccuugcccaaccaaugcacacaguagggcuu

SEQ ID NO: 105251 - RNA, 62 nt, Human
aagugggcucugaggcugcagggcuggaaguccuugcccacuucccacucuccugccccaau

SEQ ID NO: 105252 - RNA, 62 nt, Human
aguuaugcuucugaccuuguauggucuguaagcuugcccagaaauaagaccacuguuuugaa

SEQ ID NO: 105253 - RNA, 62 nt, Human
gaugaaacuugagucucagggaagugaagugacuugcccagggucacucagguagaguugag

SEQ ID NO: 105254 - RNA, 62 nt, Human
gaaaaaugaaagcaaaacuucguacacagugccuugcccauaauagguacucaauaagcaau

SEQ ID NO: 105255 - RNA, 62 nt, Human
auacagcccauuuuuucauaguuucauuuguucuugcccacaagcuugaaauccagguuaag

SEQ ID NO: 105256 - RNA, 62 nt, Human
acucuggaguuucuuaugugcccugguggacacuugcccaccauccugugaguaaaagugaa

SEQ ID NO: 105257 - RNA, 62 nt, Human
uuaggcuaaagaagccaccacuauuccucucucuugcccauuguggggggcaaaggcauugg

SEQ ID NO: 105258 - RNA, 62 nt, Human
uuaaaucaugugaaaggguugcugcugucagccuugcccacugugacuucaaacccaaggag

SEQ ID NO: 105259 - RNA, 62 nt, Human
uuauaaaucugcgagguaguuucuuugguauucuugcccaggaaauggguugauucaucaca

SEQ ID NO: 105260 - RNA, 62 nt, Human
ucaccccacuuaucccucuccauaaccccacccuugcccaccccacccccacccccaccaag

SEQ ID NO: 105261 - RNA, 62 nt, Human
ggcagggccucuccaugccagccucugugguccuugcccaaacccaucagcgcaauacuuga

SEQ ID NO: 105262 - RNA, 62 nt, Human
ucccuaucuaacacuuuugcucugcaggcagccuugcccauucucuaagccuggcuuagaag

SEQ ID NO: 105263 - RNA, 62 nt, Human
uugcauucucacgugaaauauaaaaagcaagucuugcccaauaaaaacgcuacauugugugu

SEQ ID NO: 105264 - RNA, 62 nt, Human
ucugagacuccauuuucuccagggaaacgaggcuugcccagauagacuaacaacccuuuagu

SEQ ID NO: 105265 - RNA, 62 nt, Human
gcccgcgugacgucgauggguccugcggcccccuugcccaaccucggguuuagggaggaggg

SEQ ID NO: 105266 - RNA, 62 nt, Human
guaugugguucuuaagugccagggagaucagccuugcccaugaagguugcauauguguggua

SEQ ID NO: 105267 - RNA, 62 nt, Human
ucuuugcaccaaagauguccugacuuugcccccuugcccaucagccauuugccaucacccca

SEQ ID NO: 105268 - RNA, 62 nt, Human
acauuuguaggggccgcugcuaguuagcuacccuugcccaccgccguggaguucgcaccucu

SEQ ID NO: 105269 - RNA, 62 nt, Human
acugcacuuucuuccugccuuagguaguugggcuugcccacccuaguuugcuuuuguagugg

SEQ ID NO: 105270 - RNA, 62 nt, Human
ggauggucucugaggcucuuuguggcaucagccuugcccagugccacacaguaucuccuggc

SEQ ID NO: 105271 - RNA, 54 nt, Human
aggcuaccuguaaacucugagccccuugcccaccugaagcccuggggaugaugu

SEQ ID NO: 105272 - RNA, 62 nt, Human
uguugggacugacuccuggaagacagccuggccuugcccaccugcacacagucuguuggaua

SEQ ID NO: 105273 - RNA, 62 nt, Human
ccccugaauuuugcaaaaugggaaagugggcgcuugcccaagggccaggcugcauggauucu

SEQ ID NO: 105274 - RNA, 62 nt, Human
gcugggguccacuccugggccugccccagcuccuugcccagggagagggaaagaguuaacgg

SEQ ID NO: 105275 - RNA, 62 nt, Human
uaggaaauggggagcuaggauuugaauucaggcuugcccaacucacauucuaugacaucaug

SEQ ID NO: 105276 - RNA, 62 nt, Human
gccauguucagugucccggcuccaaaugcccccuugcccagaugaaacccugcagugguuac

SEQ ID NO: 105277 - RNA, 55 nt, Human
cugccuguaccggaugcuaggggggcuugcccacugccugccuccccuccgcagc

SEQ ID NO: 105278 - RNA, 62 nt, Human
ggaccagcaagacugcacgugucccucuuggccuugcccagggcgaagacaccuucccugcc

SEQ ID NO: 105279 - RNA, 62 nt, Human
uuuuuuuuuuucuuuugagacagggucuugcucuugcccaggcaggaguacaguagugcaau

SEQ ID NO: 105280 - RNA, 62 nt, Human
gcagggccugggccuguuuccccagcugugaucuugcccagaaccucucuuggcuucauaaa

SEQ ID NO: 105281 - RNA, 62 nt, Human
uacccucucuccuguaccccuuucaaucuggacuugcccaggucuucugcgaucaguuaacc

SEQ ID NO: 105282 - RNA, 62 nt, Human
gauaccugacuagggaaguuugucucuccuuucuugcccaaccaggucaaaguaaaauguga

SEQ ID NO: 105283 - RNA, 62 nt, Human
gacaguguaucuucuaauuggcuaaagugggccuugcccagaguccagcuguguggcuuuua

SEQ ID NO: 105284 - RNA, 62 nt, Human
ccauggcuuuucaugcuuccaagugucagggccuugcccagauagacagggcuggcucugcu

SEQ ID NO: 105285 - RNA, 62 nt, Human
ugaaacacacaauguggacgugcacugacagccuugcccacccccaccaugcagccccuggg

SEQ ID NO: 105286 - RNA, 62 nt, Human
gcacgccagagcugaagggggaaacuugguaacuugcccauuauucucugcuuuuagccaga

SEQ ID NO: 105287 - RNA, 62 nt, Human
uuucacccuuuuuugugauuugcaaugaugugcuugcccagcuaacuuuugaauugcacuuu

SEQ ID NO: 105288 - RNA, 62 nt, Human
agcugcuccuuccuuacagccuuggggauggacuugcccacaccuccaccuccccugagccc

SEQ ID NO: 105289 - RNA, 62 nt, Human
ugaguugagaaagcagccccaguaguuccauucuugcccagcacuuucugcauuccaaacag

SEQ ID NO: 105290 - RNA, 62 nt, Human
ggcucccauuuguugcuucucaaaauauaccucuugcccagcugccucuucugaaauccacu

SEQ ID NO: 105291 - RNA, 62 nt, Human
ggcaagaggaggaggagagccugccguuccaacuugcccaucagagacccggacacggccug

SEQ ID NO: 105292 - RNA, 62 nt, Human
cuauuccucgucaaguccucuuguuuuuuuaucuugcccaaagagcucccucucaaggccaa

SEQ ID NO: 105293 - RNA, 62 nt, Human
gaaggggccuuagaggcucuccagcucugcuucuugcccauugccaaauacugaaauggaag

SEQ ID NO: 105294 - RNA, 62 nt, Human
acacuauuuacaagauggacuuaccuggcagacuugcccaggucaccaagcaguggccuuuu

SEQ ID NO: 105295 - RNA, 62 nt, Human
ccauaaguaguuuugagaggguggauggguuacuugcccaccagaaacagcccuagucccaa

SEQ ID NO: 105296 - RNA, 62 nt, Human
uggugcauaugucgaaagagcuggcugggggccuugcccaaaccaacugaggucuuaaaguc

SEQ ID NO: 105297 - RNA, 62 nt, Human
ugagcacccugagguuuagagagauuaaaucacuugcccaaggugaaccagcugguaaaagg

SEQ ID NO: 105298 - RNA, 62 nt, Human
cugcuuggugugauguaagggaaauugaaagacuugcccauucaaaaugaucuuuaccgugg

SEQ ID NO: 105299 - RNA, 62 nt, Human
ugacaauaaucuguccuguugauuuuguuuuccuugcccaugacuugaacaacuguguuuua

SEQ ID NO: 105300 - RNA, 62 nt, Human
ggggggucucuacgccagcucaucagugccuccuugcccauccuucaccggugccuuugggg

SEQ ID NO: 105301 - RNA, 62 nt, Human
augccuuuuuacuuaaacaccaagacagaaaacuugcccaauacugagaagcaacuugcauu

SEQ ID NO: 105302 - RNA, 62 nt, Human
gggccgccuguccucacugccccaggcugcggcuugcccagucccgccccucugaccccugc

SEQ ID NO: 105303 - RNA, 62 nt, Human
uaaaggcauuagagucaacuacacaaagcaggcuugcccaguacauuuaaauuuuuuggcac

SEQ ID NO: 105304 - RNA, 62 nt, Human
cguuuuacaguugcccaagagaaaucaggugacuugcccaaggucacacagcuaguuagcgg

SEQ ID NO: 105305 - RNA, 62 nt, Human
guuccuuucaggcuuccgugcaggcuucuccacuugcccaugcacaguagggucuuucaggg

SEQ ID NO: 105306 - RNA, 62 nt, Human
ucaauuaaaugucuuaucaaguucugucaauacuugcccaaaucaauggguuugcaaaauuu

SEQ ID NO: 105307 - RNA, 62 nt, Human
cauucuauaaacauucuuguauuuaugugagacuugcccaucuacugucuuggcugugucuu

SEQ ID NO: 105308 - RNA, 62 nt, Human
gaugaagacugaagccuagguauauuaaauagcuugcccaaggccacacagcaaaagucacc

SEQ ID NO: 105309 - RNA, 59 nt, Human
augccggccaaaagagaugaacccugccccuugcccagggccagugccauggggaaggg

SEQ ID NO: 105310 - RNA, 62 nt, Human
cauacuuccuuccccacucccauccuaggauacuugcccagugcucauuaggcauuucuuau

SEQ ID NO: 105311 - RNA, 62 nt, Human
agcacccagagaaaacccauacagacaguggccuugcccaggaaucagucuuguuucuuuuu

SEQ ID NO: 105312 - RNA, 62 nt, Human
caccgccagauccuuucuguaggcuaauuccucuugcccaacggcauauggaguguccuuau

SEQ ID NO: 105313 - RNA, 62 nt, Human
gggaaccaagccucugcucucaccuguggguucuugcccaucaggguaauuguauugagaac

SEQ ID NO: 105314 - RNA, 62 nt, Human
cucaccuuuuuuuugagauggagucucgcucucuugcccaggcuggagugcaauggcacguu

SEQ ID NO: 105315 - RNA, 62 nt, Human
cagaaagccgucucagacuucagcacugcggucuugcccacucucugccuuaggcucccagg

SEQ ID NO: 105316 - RNA, 62 nt, Human
cugggcuuggaggguacagugccagcagcuuccuugcccaauugauguuggagcuguagacg

SEQ ID NO: 105317 - RNA, 62 nt, Human
agcaggaaacagcaggucuggccagauucucacuugcccaucaaucucguucuuggaugauu

SEQ ID NO: 105318 - RNA, 62 nt, Human
uuuuauuuuuuguacaggcaggaucuugccaccuugcccaggcuggucuugaacuccugagc

SEQ ID NO: 105319 - RNA, 62 nt, Human
ccuugucuaaaauuucuuuguguucccagugucuugcccaguagauacaagauaaauauugc

SEQ ID NO: 105320 - RNA, 62 nt, Human
ucauuggggaagagagccugaggcuggcaauccuugcccagaacuuuggucaccugcuuguu

SEQ ID NO: 105321 - RNA, 62 nt, Human
ccugaguguccggugaccucccccagggccuccuugcccagcccaguccaggcugcugugcc

SEQ ID NO: 105322 - RNA, 62 nt, Human
uuuauuuuauuuuuuauuuccuucccucauaccuugcccauucccucugaauauuaggugug

SEQ ID NO: 105323 - RNA, 62 nt, Human
agucagccuuucuggggcuuucauggaggagacuugcccaaggggcuucccugccagggcug

SEQ ID NO: 105324 - RNA, 62 nt, Human
ucucuuguuuuccccuccagcuccacucugcucuugcccacaaagcugacccgaauggacca

SEQ ID NO: 105325 - RNA, 62 nt, Human
gggauuauaggcaugagccauuaugccugacucuugcccaaauuucugaugucaaauuguuc

SEQ ID NO: 105326 - RNA, 62 nt, Human
gcauagcagacuauaccucuucuguccgcugacuugcccaauaaauaauucugcagagauuu

SEQ ID NO: 105327 - RNA, 62 nt, Human
ugugccaagaaacgcaggcucugggccugccccuugcccaggaggccuugccagccugugug

SEQ ID NO: 105328 - RNA, 62 nt, Human
ccccaguagcugggauuacaggcaccuaccaccuugcccagcuaauuuaguuuccugguaaa

SEQ ID NO: 105329 - RNA, 62 nt, Human
cauauuuuuauaugaaucaucuccucuguggucuugcccaguaccauccaguggagcuuucu

SEQ ID NO: 105330 - RNA, 62 nt, Human
ugcuggagaagcuggacugagcgcagggccuccuugcccaggcaggaggcuggggugcugug

SEQ ID NO: 105331 - RNA, 62 nt, Human
ccauaggagccuccagaugggggcuggccucucuugcccagccagcgggcagggacuguggg

SEQ ID NO: 105332 - RNA, 62 nt, Human
uuuauucauauggaucucuaccauccccaugccuugcccagguccaguuccauuucucucau

SEQ ID NO: 105333 - RNA, 62 nt, Human
ccuuauggagaaugaggauucagccuugacuucuugcccaaggccugcuacugggguagcaa

SEQ ID NO: 105334 - RNA, 62 nt, Human
acuuaaaauaauuuuggaauaaugcucccagacuugcccagauuuguguauuguacuuauug

SEQ ID NO: 105335 - RNA, 62 nt, Human
uuccuuuggguaccccucaggcuccuaauauucuugcccaggauccuuggaacuuaagaaug

SEQ ID NO: 105336 - RNA, 62 nt, Human
ucuccaguauauacuuccuuucuagaacccgacuugcccacguuuagggguucacucugcac

SEQ ID NO: 105337 - RNA, 62 nt, Human
uaaaugcuguaugcuuuuuugccaccgugcaacuugcccaacaucaaucuucacccucaucc

SEQ ID NO: 105338 - RNA, 62 nt, Human
uccacacgaggacuaagcucugauuuuuuuaucuugcccaaauuccuaccuaaggggucuag

SEQ ID NO: 105339 - RNA, 62 nt, Human
ggugguggcauugauuuuuuuccuccaugcaucuugcccaggaucacucagucaagcauguc

SEQ ID NO: 105340 - RNA, 62 nt, Human
gcugcuccugugcugcccuggcccuggccuugcuugcccaugguguguguguccagaggugu

SEQ ID NO: 105341 - RNA, 62 nt, Human
guuuucacuaacuacacucuacaagugaacuccuugcccaggccaguuagaaaaucccuugg

SEQ ID NO: 105342 - RNA, 62 nt, Human
cuggaacaacucagucucgcucuuuccgaauccuugcccagaucacugggacugaacauugu

SEQ ID NO: 105343 - RNA, 62 nt, Human
aaucuucacauuggagauaauauugguuggaccuugcccaucuucacucuagccuucguauu

SEQ ID NO: 105344 - RNA, 62 nt, Human
ugaugggcugugucucccugaagauugucuggcuugcccacuucuccgugcaugacucuggg

SEQ ID NO: 105345 - RNA, 62 nt, Human
caggcaaggaggccccggagccuuagcagggacuugcccaacggcacagcugauuggugcuc

SEQ ID NO: 105346 - RNA, 62 nt, Human
gaaccggcccuccuguggacuagcacaacuuccuugcccacuguuucuuccuuucugugccu

SEQ ID NO: 105347 - RNA, 62 nt, Human
cauaguaugauaaacagguguauuccccucuacuugcccaugugcucauuuuucugagucug

SEQ ID NO: 105348 - RNA, 62 nt, Human
ugguugcagcccacuggagagaaguuugcuggcuugcccaggccagagcaggaccacagaua

SEQ ID NO: 105349 - RNA, 62 nt, Human
uuaauuugguugaacauuugcugcuaaugggacuugcccagcugagugcuggcucugaggaa

SEQ ID NO: 105350 - RNA, 62 nt, Human
agaagcugucauugugagauguuugggauccccuugcccaagggacaacaacaaacagugca

SEQ ID NO: 105351 - RNA, 62 nt, Human
acaggaggauagccgcaucaccaccagcagcucuugcccagagcugugcagugcaguggcug

SEQ ID NO: 105352 - RNA, 62 nt, Human
uuuauuugugucacaaagaauuuaaaauaacacuugcccaugcuauuuguucuucaagaacu

SEQ ID NO: 105353 - RNA, 62 nt, Human
ugcaugcauaccucaucagugauuguacauaccuugcccacuccuagagacagcugugcuca

SEQ ID NO: 105354 - RNA, 62 nt, Human
uucugcccaaugccuuuuugauuacaguguagcuugcccaccgcauuugucguuuuagauac

SEQ ID NO: 105355 - RNA, 62 nt, Human
guuauuuguauuuauauauaaguacaucagaacuugcccacaugauaacucauguuugcuuu

SEQ ID NO: 105356 - RNA, 62 nt, Human
gaccagaaggaagguuuagaaagaaaagaacacuugcccagggcagcuuugcccuccaagag

SEQ ID NO: 105357 - RNA, 62 nt, Human
ccgucuucagccuagccgaccucagccuuccccuugcccagggcucagccuggugggccucc

SEQ ID NO: 105358 - RNA, 62 nt, Human
ccccucuccucugccccugggguccauccccucuugcccaggguccccauccuguaccaagc

SEQ ID NO: 105359 - RNA, 62 nt, Human
auuauuuuuccagguuuggggaugagucaguccuugcccauccacaauuuuguuugugaacu

SEQ ID NO: 105360 - RNA, 62 nt, Human
uagcccucucuucccccuugugcagcggaccacuugcccaguuugcuguggugcuagccuuc

SEQ ID NO: 105361 - RNA, 62 nt, Human
ugggggaggugaguccagccccuuggaacaggcuugcccaacauggagggauggcguuggca

SEQ ID NO: 105362 - RNA, 62 nt, Human
uucucacuaagaaaaaagucaacuccccuccccuugcccaaguaugaaauauagggacagua

SEQ ID NO: 105363 - RNA, 62 nt, Human
ccugucuuucuuuccucucccaccacgcuacccuugcccaguccacccagucacauccgugc

SEQ ID NO: 105364 - RNA, 62 nt, Human
gcaucuuggaauucaguaagugcauauccuaacuugcccauauucuaaaucaucugguuggu

SEQ ID NO: 105365 - RNA, 62 nt, Human
agccaaguacaggacacccccagccugcagcccuugcccagggcacuuggagcacacgcagc

SEQ ID NO: 105366 - RNA, 62 nt, Human
gagacagaagucaaaaggaagagcaguggagccuugcccacagggcugcugcuucaugcgag

SEQ ID NO: 105367 - RNA, 62 nt, Human
aaaugauuaaaguauuuucauacauuuugcuucuugcccagcagggacagguggcagagccg

SEQ ID NO: 105368 - RNA, 62 nt, Human
cggggacaggccagucgcguuccuuccgcauccuugcccaccucacaggcaccgaguucagu

SEQ ID NO: 105369 - RNA, 62 nt, Human
uaugugcaugugaccacaaaugcuugcuuggacuugcccaucuagcacuuuggaaaucagua

SEQ ID NO: 105370 - RNA, 62 nt, Human
uuuaagcccuggcagcauuuuggucccugcuccuugcccauaguaaaacagcuugaaauauc

SEQ ID NO: 105371 - RNA, 62 nt, Human
ugcuaugaauaauuacuauagcugcuguccaucuugcccauccauuaagguaccuucucaca

SEQ ID NO: 105372 - RNA, 62 nt, Human
gcuuugccaagaugggaggaggccagugcccacuugcccaccgaccugagccugaguaagug

SEQ ID NO: 105373 - RNA, 62 nt, Human
gguuuauaggccauucauacuuaaguugaucacuugcccaugguggacauuuuugugguggu

SEQ ID NO: 105374 - RNA, 59 nt, Human
gaauggacacugacaucuaggagacaguccuugcccaccuaaaauccauuuugccuucg

SEQ ID NO: 105375 - RNA, 62 nt, Human
auggugauuuaaaaacuuguuacuccaagcaacuugcccaauuuuaaucugaaaauuuauca

SEQ ID NO: 105376 - RNA, 62 nt, Human
uuuugacauuuaguuuuuccaagagcuauaaucuugcccauaguauuuaccucauuuuugug

SEQ ID NO: 105377 - RNA, 62 nt, Human
cucucuggaauaagggcccgaugcagcauuuucuugcccaguguggcaagaccucagaaaaa

SEQ ID NO: 105378 - RNA, 62 nt, Human
gacccuucuaauucagaggucucaugccugcccuugcccagaugcccagggucgugcacucu

SEQ ID NO: 105379 - RNA, 62 nt, Human
caacaccuuugugccuuugcauaugguguuuucuugcccauuuucugcucgacucgccccug

SEQ ID NO: 105380 - RNA, 62 nt, Human
ugacauggcuuaccugccuucacucccagcaccuugcccaacaggauaagcuggauccccuu

SEQ ID NO: 105381 - RNA, 62 nt, Human
gagugauaguuaccuucacaauggugcuaccccuugcccaggcaaggaaagacagcagugau

SEQ ID NO: 105382 - RNA, 62 nt, Human
agcucuuaccaucaaaaucaguuauucaagugcuugcccagugcuucuugaaacucaccucu

SEQ ID NO: 105383 - RNA, 62 nt, Human
agcugaagagcuguuuugugaagcaucccaggcuugcccaggagagacauuugccacuaugu

SEQ ID NO: 105384 - RNA, 62 nt, Human
ccgaaacccgcgcccaggaguauggcugaggccuugcccacccaccugccugggaagugcag

SEQ ID NO: 105385 - RNA, 62 nt, Human
ccuucccucugcucuccucccucccuauccuacuugcccauaugagcacggcuccccauggc

SEQ ID NO: 105386 - RNA, 62 nt, Human
augaccguggccacagcccugcuccagcagcacuugcccauuccuuacaccccuuccccauc

SEQ ID NO: 105387 - RNA, 62 nt, Human
augaagcaaaagaaacgugagaaggagggucucuugcccaucucuccggccaccccgccagg

SEQ ID NO: 105388 - RNA, 62 nt, Human
aggaaagccagcagccccagacugcccaaaaacuugcccaccagaccaagggcagugcccca

SEQ ID NO: 105389 - RNA, 62 nt, Human
gcuggugacacuaacgauugcuacucgguucacuugcccagaugucuucauaugaugagcaa

SEQ ID NO: 105390 - RNA, 62 nt, Human
agguauuaaccaaggcagaaagaggugaguaacuugcccauuucuccacagagaccccauuu

SEQ ID NO: 105391 - RNA, 62 nt, Human
uuguuaggcuugagugagguguuugcuuccuucuugcccagcgcuggguucucuccacccag

SEQ ID NO: 105392 - RNA, 62 nt, Human
ugagauugccgagaccugaagaggguaagugacuugcccaaggucagagccacuuggugaca

SEQ ID NO: 105393 - RNA, 62 nt, Human
uuuacuuaccuaucugucuaccaguagcgguccuugcccauuugggaaacugagcuucuuuc

SEQ ID NO: 105394 - RNA, 62 nt, Human
ucuucugagccuaguucucacgaggacccuuucuugcccacaguuucgagaggcccgugcca

SEQ ID NO: 105395 - RNA, 62 nt, Human
uucuuauacucuguuuucuuuuauauugauaucuugcccacauuuuaaauaaauguacuuuu

SEQ ID NO: 105396 - RNA, 62 nt, Human
cccuguaggguuuggacagacccacccccagccuugcccagcuuucaaaggacaaaagggag

SEQ ID NO: 105397 - RNA, 62 nt, Human
ggagcaggccagagccucuuuugcuuccuuuucuugcccaugccgcuucuagaagccaggca

SEQ ID NO: 105398 - RNA, 62 nt, Human
ccaaaguguugggauuacaagcgugagcuaaccuugcccagccucugggaacacuuggaagg

SEQ ID NO: 105399 - RNA, 62 nt, Human
acaaaaugcagauuuuccugauuuccucuucucuugcccaguuuuuuuuuuuuuuuuuuuuu

SEQ ID NO: 105400 - RNA, 62 nt, Human
gggggaaacuugcugguggucucucccacaaccuugcccagaguccuuuccacuaaggaggu

SEQ ID NO: 105401 - RNA, 62 nt, Human
ccuccuguagugaguugauugucugcacuugccuugcccaauagccaguaggcuacagcuuu

SEQ ID NO: 105402 - RNA, 62 nt, Human
auguuuucuuucuguuucaggcuugaaaaacccuugcccaguuuugaucccuucaagacuuu

SEQ ID NO: 105403 - RNA, 62 nt, Human
cuggaguuaauauacgccuuuauaugugaaaucuugcccagucacagagguagaauugagca

SEQ ID NO: 105404 - RNA, 62 nt, Human
uaucauuaacuaacacuccaaacaaaggugagcuugcccaggacuuggcauuuccaaaucaa

SEQ ID NO: 105405 - RNA, 62 nt, Human
uugaauauuguguaaacccuucuuuggcuuuccuugcccauugcaauuugauuuaagccuac

SEQ ID NO: 105406 - RNA, 62 nt, Human
aggcagccacagaccugggacaccucagccagcuugcccacccuccaccuuugcccaauuuc

SEQ ID NO: 105407 - RNA, 62 nt, Human
ucccuguggcuccugcgcgcccuggccugggccuugcccagccgccccggucucuccuuccc

SEQ ID NO: 105408 - RNA, 62 nt, Human
cauugugccaucccaaaccucguuccagccgccuugcccauacuagauucuaaauguuucua

SEQ ID NO: 105409 - RNA, 62 nt, Human
ucagccaggauugauggcagcugagggaaauucuugcccaacuaaacccagaacucaaacuu

SEQ ID NO: 105410 - RNA, 62 nt, Human
aagaggaaaaauaaaaaccuccugaggcauuucuugcccagcuggguccaacacuuguucag

SEQ ID NO: 105411 - RNA, 62 nt, Human
gaggagacuggugccccacagggauuaagugccuugcccaaggucaggcuuaucuccagagg

SEQ ID NO: 105412 - RNA, 62 nt, Human
cucccaggcggggcaggaaggggccaagggggcuugcccacccaccccgaccccagccccca

SEQ ID NO: 105413 - RNA, 62 nt, Human
ucccgccgcacuuucuaccccgggcagaggcgcuugcccacgggacguuuggggauggaccu

SEQ ID NO: 105414 - RNA, 62 nt, Human
ugcuuccugcuccuuggagcuggcucccggaccuugcccaccauccaugcaguggcucccag

SEQ ID NO: 105415 - RNA, 62 nt, Human
cagcccaguuugcagguguggccuuguuucuccuugcccagcagugcugccuucagcggccg

SEQ ID NO: 105416 - RNA, 62 nt, Human
uccacacggggcagccggcccucgggggaggccuugcccaccuuggugaggcuccuguggcc

SEQ ID NO: 105417 - RNA, 62 nt, Human
acgagacagccccuucaggauuuccacuggaccuugcccaaauagcaccuuaggccacugcc

SEQ ID NO: 105418 - RNA, 62 nt, Human
aaccacgugggcaacuguuucagggguuuucucuugcccaauccccaccuaauaaaguucug

SEQ ID NO: 105419 - RNA, 62 nt, Human
ugccuggaccuuguucccugggggugggggcgcuugcccaggagagggaccaggggugcgcc

SEQ ID NO: 105420 - RNA, 62 nt, Human
cugcacucaacuauggaaagaggcagaguuugcuugcccaauugccaaacuaaagacaucag

SEQ ID NO: 105421 - RNA, 62 nt, Human
uucuuucuuucugggugaucuggggaucacgccuugcccaagugugagauuaccuuucuguu

SEQ ID NO: 105422 - RNA, 62 nt, Human
ucuacacauggcaaaauggagacccagagucacuugcccaaggucgcacagcuaguggugga

SEQ ID NO: 105423 - RNA, 62 nt, Human
auacaacaguugcuuguauucaguagaguuuucuugcccaccuauuuugugcuggguucuac

SEQ ID NO: 105424 - RNA, 62 nt, Human
acacucacgaaccgccagcguggcgccuggaucuugcccagcugccagcuccccccaccagg

SEQ ID NO: 105425 - RNA, 62 nt, Human
ucauuucaauccuugacucucucuccccuucccuugcccagcucuguugaaugcugcugugc

SEQ ID NO: 105426 - RNA, 62 nt, Human
ccaggcaggaggaucguuugagaauauaucuccuugcccaagaguuugagaccagccuggac

SEQ ID NO: 105427 - RNA, 62 nt, Human
ugcccagcugucgucuaagcccucuugauugacuugcccaaguggcaauagaguucuaauau

SEQ ID NO: 105428 - RNA, 62 nt, Human
cccaaauugcugggauuacaggcgugagccaccuugcccagccaauuuuuuuuuaaagagac

SEQ ID NO: 105429 - RNA, 62 nt, Human
gacaagccaacgccagguagcauguggccacccuugcccagugucuguggccuggcaagugg

SEQ ID NO: 105430 - RNA, 62 nt, Human
agcugggaggcaggaauggcacacugggcaggcuugcccauuccuggcccugagaauggagc

SEQ ID NO: 105431 - RNA, 62 nt, Human
uacguuuuacuccuuugcugaaaaaaaaucaucuugcccacaggccuguggcaaaaggauaa

SEQ ID NO: 105432 - RNA, 62 nt, Human
ccagacuaggggucaggcagcuagcuaccuaccuugcccagugcugacccggaccuccucca

SEQ ID NO: 105433 - RNA, 62 nt, Human
guuuugaacaagaacuaccaucaugcaggcuucuugcccagcugaccacuggccccggggug

SEQ ID NO: 105434 - RNA, 62 nt, Human
cuccagauaaauaaccauacacugaccucauacuugcccaggacccauuaaaguugcgguau

SEQ ID NO: 105435 - RNA, 62 nt, Human
uuuugguucagugauucucaagaaaaagaucucuugcccauuaagaaguguaucaaaaucuc

SEQ ID NO: 105436 - RNA, 62 nt, Human
cugagugugucuggcucugagagagucugagucuugcccaaacauucuuucuuuuugugcca

SEQ ID NO: 105437 - RNA, 62 nt, Human
gguuccggucccacuguguguccccuggcgcucuugcccauagagagccagacaccaauccu

SEQ ID NO: 105438 - RNA, 62 nt, Human
accuggcagccuggaagccacaggcauccggccuugcccaggcaucucgccugcggucugag

SEQ ID NO: 105439 - RNA, 62 nt, Human
acauuuuauuuaacuucuucaucuuggugguccuugcccaguuauuuugccucauuagacau

SEQ ID NO: 105440 - RNA, 62 nt, Human
gugccuccagccacacccccugccuuccccagcuugcccauuucccugccccaaggcccaga

SEQ ID NO: 105441 - RNA, 62 nt, Human
aacguauuuaauuuggccuuuucagcuuucuucuugcccagcucugucgaauucaugggugu

SEQ ID NO: 105442 - RNA, 62 nt, Human
ggcaguggcaggagccuuacuuuugucacagccuugcccacaaacccugccucugaggggag

SEQ ID NO: 105443 - RNA, 62 nt, Human
aggauccuccggccugggcucccccuuccucccuugcccacggucuuggagccccacugggu

SEQ ID NO: 105444 - RNA, 62 nt, Human
acaugccucugucuccccgcugagcccaggcacuugcccaggccgcccugcaggaccacugc

SEQ ID NO: 105445 - RNA, 62 nt, Human
ugcucauuugucauuuacccugguggaggcuucuugcccagauagagaucugaaauuggugg

SEQ ID NO: 105446 - RNA, 62 nt, Human
aggccugccucccacuucacugcgaagacccucuugcccauccugacugaaaguagggggcu

SEQ ID NO: 105447 - RNA, 62 nt, Human
uguuuuucuguggcucuguccauggcaucccacuugcccacucuccuuccuggaguguugag

SEQ ID NO: 105448 - RNA, 62 nt, Human
agggacaaugcggccaggggacgagcgccuuccuugcccaccucacugccacauuccagugg

SEQ ID NO: 105449 - RNA, 62 nt, Human
uaguccuaacaacacuaugagauggacuauaacuugcccaaauuuuuuuuuuuuuuuugaga

SEQ ID NO: 105450 - RNA, 62 nt, Human
ccagcacucagacagagccaaggcaauauccucuugcccauggcuaugaugucagacagugg

SEQ ID NO: 105451 - RNA, 62 nt, Human
gcuucuaugggauccuggaaguuccuuagggacuugcccagggucccagggccacccacacu

SEQ ID NO: 105452 - RNA, 62 nt, Human
cagucauccagcucgaccuuaugagaagguaccuugcccaggucuggcacauaguagagucu

SEQ ID NO: 105453 - RNA, 62 nt, Human
auuuuuuaucccugggaucaugagcguccggucuugcccacagggccugugcugcgacgcac

SEQ ID NO: 105454 - RNA, 62 nt, Human
agggaucucagaggcucagagacugcaagcugcuugcccaagucacacagcuagugaagacc

SEQ ID NO: 105455 - RNA, 62 nt, Human
uccaagaacaagcagagcccgggccacuggcccuugcccaaggcagggaagaaggaugugug

SEQ ID NO: 105456 - RNA, 62 nt, Human
ucacagccagcaugacugcuucucugagagaacuugcccaucaggggcugggacaugggggu

SEQ ID NO: 105457 - RNA, 62 nt, Human
ugagcacauucuggcucagggagguuaagugacuugcccaguuucagggcuaacgaccacag

SEQ ID NO: 105458 - RNA, 62 nt, Human
aucuccuuucugcuucccagagagggucuggccuugcccaaggccacucagugauuuaggaa

SEQ ID NO: 105459 - RNA, 62 nt, Human
gcagaggggaugccaggaccauggacaugaggcuugcccaucccugccaacuuacacagccu

SEQ ID NO: 105460 - RNA, 62 nt, Human
acuugucugaucauaacauuguaagccuguagcuugcccagcugcugccugggcccccauuc

SEQ ID NO: 105461 - RNA, 57 nt, Human
uggaaaucacacuggugugaugaugggcuugcccauccauuacugcuacaaucaagg

SEQ ID NO: 105462 - RNA, 62 nt, Human
ggcgaaggcugggagugucuuucccaccagcccuugcccaugguggggaggacaucuggucu

SEQ ID NO: 105463 - RNA, 62 nt, Human
gcugaccucucucucuggucccagacugccuccuugcccaggccucucucacucuucauacu

SEQ ID NO: 105464 - RNA, 62 nt, Human
auggugggguaccagccacuggaggggucauccuugcccaucgggaccagaaaccugggaga

SEQ ID NO: 105465 - RNA, 57 nt, Human
cugcccucaugaaggcuuaacguggcucuugcccaauaccaaaucgccgcuuucccc

SEQ ID NO: 105466 - RNA, 62 nt, Human
gaggugaggccuggggggcuuccugcccccuccuugcccaccugccugcccccgggcagcac

SEQ ID NO: 105467 - RNA, 62 nt, Human
aaaggagacacucaguuucacaagugagcccucuugcccagcacacaccuauggcuggcugg

SEQ ID NO: 105468 - RNA, 62 nt, Human
gagccgaacaauccucgaacuaaaagccuucccuugcccaugugaaaagauccgcuaagaca

SEQ ID NO: 105469 - RNA, 62 nt, Human
caaccaaggcaucuaaagcaacaagaaaugaacuugcccaaggucaucugccagggucagug

SEQ ID NO: 105470 - RNA, 62 nt, Human
gauuggcccccagccugcgcaugcacccuccucuugcccaaguggggagcacagaggcggag

SEQ ID NO: 105471 - RNA, 62 nt, Human
gacugcaaccuggacagagccgccucccucugcuugcccagguacuccuuccgccgccucga

SEQ ID NO: 105472 - RNA, 62 nt, Human
uuuuauaaagucucagacuauaauaaacacagcuugcccaguuuauccuuucuuuuuuauuu

SEQ ID NO: 105473 - RNA, 62 nt, Human
cugaugacagcccugucccucccugccucugccuugcccaaggccacggagggcaucugcag

SEQ ID NO: 105474 - RNA, 62 nt, Human
ccuucagcccucucccuucggagggacguggucuugcccacuguccuuuugccuccaugcug

SEQ ID NO: 105475 - RNA, 62 nt, Human
augaggaaacugaggcucaggggauaaagggacuugcccaagucccacagcuggugugugac

SEQ ID NO: 105476 - RNA, 62 nt, Human
cugucccuucugcuggcucagggaagugucuucuugcccacauuucuguggggaaagguuuu

SEQ ID NO: 105477 - RNA, 62 nt, Human
ucacacauucgcaaugcaucaggaagaaaaggcuugcccaaaaggcuggagagggcagggag

SEQ ID NO: 105478 - RNA, 62 nt, Human
uguuaaugaguuacauuaucagccagcccagccuugcccaccauuuaagaaauaucacagag

SEQ ID NO: 105479 - RNA, 62 nt, Human
ugggggcagagggcagaggcuggaggcagggccuugcccagagaugccuccaccgcugccua

SEQ ID NO: 105480 - RNA, 62 nt, Human
uucuuauuuauaaauuguaauauaaugauucccuugcccagcuugccaaggugaggggcugg

SEQ ID NO: 105481 - RNA, 62 nt, Human
cagcaucaggcucugccaaggccccucugacucuugcccaauccuugaccuugacuccuauc

SEQ ID NO: 105482 - RNA, 62 nt, Human
gccucaggagcaggaagggccaggaccagaaccuugcccacggcaacugccuuccugccucu

SEQ ID NO: 105483 - RNA, 62 nt, Human
ccaccuggggaguuuacuaccuggggaccccccuugcccaugccuccagcuacaaaacaauu

SEQ ID NO: 105484 - RNA, 62 nt, Human
augagcccucggggccuccuccugggccucagcuugcccagauacauaccuaaauauauaua

SEQ ID NO: 105485 - RNA, 62 nt, Human
cgaaagggauucuccuaaacccacccacuucucuugcccaggcugcuuuuuaaaaauauuuu

SEQ ID NO: 105486 - RNA, 62 nt, Human
auggacgugaacccaggguucuaauagguuggcuugcccaaggucaccugcuagcuuguaag

SEQ ID NO: 105487 - RNA, 62 nt, Human
ugcugaguguuccuucuugcccuuuucagcagcuugcccagcucuugaguacaguggugggg

SEQ ID NO: 105488 - RNA, 59 nt, Human
acaggguuuucagcuccuaacuggacccucuugcccagccggcugcaaguuuuguaagc

SEQ ID NO: 105489 - RNA, 62 nt, Human
aaaacuggggguuucuucucaccgacucuccacuugcccaaacugccaaaagcuggugauuc

SEQ ID NO: 105490 - RNA, 62 nt, Human
gugugggggcaaagggcgugggaagagcagggcuugcccagcgacacugcuggacaggaauu

SEQ ID NO: 105491 - RNA, 62 nt, Human
acgccuucaguaacuccgagcagaaaucacaucuugcccacaugcuguaaccuaagaaacug

SEQ ID NO: 105492 - RNA, 62 nt, Human
ccaggagcccuggcugaagcaagcagucaguacuugcccacugacagucaauaucugucacc

SEQ ID NO: 105493 - RNA, 62 nt, Human
aaaaaaaugauaguuucacaucucuuaguucccuugcccaaacaagaauauucuuaguucca

SEQ ID NO: 105494 - RNA, 62 nt, Human
gggggugagccugaaggccacagagaaagaaccuugcccaaacucaggcagcuggggcugag

SEQ ID NO: 105495 - RNA, 62 nt, Human
acagccaggaccgggccuuccugcgccgcuugcuugcccaggagugugccguguguggcugg

SEQ ID NO: 105496 - RNA, 62 nt, Human
uuagaauggcuugugauaucugauggcuugaacuugcccacaguugaacacaagugcuguca

SEQ ID NO: 105497 - RNA, 62 nt, Human
uuauuuuuuuuuugagacagaguuucgcacuucuugcccaggcuggaguacaauggugcgau

SEQ ID NO: 105498 - RNA, 62 nt, Human
ugaugaggcagaggaagauauuucuaaucggucuugcccagaggaucacagugcugagaccc

SEQ ID NO: 105499 - RNA, 62 nt, Human
cugcggacuccauggcccuuccuggacuggcccuugcccaacucccagccaccaccacuguc

SEQ ID NO: 105500 - RNA, 62 nt, Human
cuaagaauucuuguagaaggcaguuuccucuacuugcccaagagcacugaguacuucucuac

SEQ ID NO: 105501 - RNA, 62 nt, Human
aaggugcaguacaucuaugggcugugauuccccuugcccaucagagaggagcauuucaaucu

SEQ ID NO: 105502 - RNA, 62 nt, Human
ccuggauggugucucccagcuuccccgcccagcuugcccaccccauaguuggugagaugcca

SEQ ID NO: 105503 - RNA, 62 nt, Human
auccuccuccucagcuccuugcagauguagcccuugcccaucuucacagacacauacaccca

SEQ ID NO: 105504 - RNA, 62 nt, Human
cugccugccaacccccucccucaaggaauggccuugcccaggaaugcccaccacacauaccc

SEQ ID NO: 105505 - RNA, 62 nt, Human
caugaauaacaaagacuggcucaggagcagggcuugcccaggcaugguggaucaccggaggu

SEQ ID NO: 105506 - RNA, 62 nt, Human
gagcccuguggaugagcccucagaacccuuggcuugcccacguggaaaagggauagagguug

SEQ ID NO: 105507 - RNA, 62 nt, Human
gacagagugagacccugacucagaaagaaccacuugcccacaguccagacagauggauugua

SEQ ID NO: 105508 - RNA, 62 nt, Human
uuucauuuucuuuaugguggaaagugaagugacuugcccaagaucuuuguuggcccuaaaca

SEQ ID NO: 105509 - RNA, 62 nt, Human
gugagagguauggagccaagucuucuagguugcuugcccacaucacucuaucucuggccucu

SEQ ID NO: 105510 - RNA, 62 nt, Human
ccgagccagcaagaggaaggggugcugugaggcuugcccaggagcaagugaggccggagagg

SEQ ID NO: 105511 - RNA, 62 nt, Human
ucaaugggcugaacaaagaugcuucacuuugccuugcccaucacccuauacaguuucgcaga

SEQ ID NO: 105512 - RNA, 62 nt, Human
ccugucaugcaggacaccuaggagcacccaggcuugcccagcaaacccugcgugccauucuu

SEQ ID NO: 105513 - RNA, 62 nt, Human
ucccugaugucacauucccugugcaaucuucccuugcccauggucugucuaucucuuuccua

SEQ ID NO: 105514 - RNA, 62 nt, Human
auucuuuuuuuuuuuugagauggagucucacucuugcccaggcuggagugcaguggugcgau

SEQ ID NO: 105515 - RNA, 62 nt, Human
gagcaggucccagagcugcuguuccuccacugcuugcccauagggcugccugguugacucuc

SEQ ID NO: 105516 - RNA, 62 nt, Human
agagcaugucagcuggagaaaagcaguucuuccuugcccacuugagaagugcacgcccacuc

SEQ ID NO: 105517 - RNA, 62 nt, Human
ugggcccagaugcugaucgggccagggacaggcuugcccaugucccgggccccauugcuucc

SEQ ID NO: 105518 - RNA, 60 nt, Human
agaaccgagauuccagcuagaggagcuggccuugcccaguggccuguggcgcccaaagcu

SEQ ID NO: 105519 - RNA, 62 nt, Human
augggguuuaaaaacaugaggcuuuccaaguucuugcccaguaucuggggcagccuccagag

SEQ ID NO: 105520 - RNA, 62 nt, Human
uaggacacauaggacacaggaauuccuggguccuugcccaugacugugccaugugguaggac

SEQ ID NO: 105521 - RNA, 62 nt, Human
uccugcuguuuauugacagccgacggcagcgccuugcccagaccuccccugcccaccugcug

SEQ ID NO: 105522 - RNA, 62 nt, Human
gacccccagccucccuuagcugcuaagccugccuugcccaggggugggauggcacugaaggc

SEQ ID NO: 105523 - RNA, 62 nt, Human
cuucuggacuguguggccaugcuggucaucggcuugcccaggcuccagccucuccagauucu

SEQ ID NO: 105524 - RNA, 62 nt, Human
ggggaccugaagcccuggggcuuacguucucucuugcccagggugggccugguccugagggc

SEQ ID NO: 105525 - RNA, 62 nt, Human
uggaauugauccauaaaccucccuguccacaucuugcccaauggggaauggaucuuucacca

SEQ ID NO: 105526 - RNA, 62 nt, Human
uucacugggccuuccuagcaggauagaaaguccuugcccagagcaggaccuggcugucuuuu

SEQ ID NO: 105527 - RNA, 62 nt, Human
ggaaaccccacuucugcccggcccuugagcuucuugcccacugucuccccauccuuccaccu

SEQ ID NO: 105528 - RNA, 62 nt, Human
cccucccaaagcucagcccucugggcgguccccuugcccaggguaucuccuacgguaccucu

SEQ ID NO: 105529 - RNA, 62 nt, Human
caguguagugugaagucccagcuuggcagagacuugcccaaggcuggauaggaggcuucuuu

SEQ ID NO: 105530 - RNA, 62 nt, Human
ugugcagcuucgaggacaggaaaggccccaaucuugcccacuggccgcugagcgcccccgag

SEQ ID NO: 105531 - RNA, 62 nt, Human
aaaaugccuuaggauggaguuugcaagguuuccuugcccauuaucagaaggaaaaagagcag

SEQ ID NO: 105532 - RNA, 62 nt, Human
aauguagguuaccgggcaugacccggcagaugcuugcccaguaguucuggaggaaggcccgg

SEQ ID NO: 105533 - RNA, 62 nt, Human
ucucugacccacgccucccgccuccuggccgacuugcccaggaggugucucuggcucaccuc

SEQ ID NO: 105534 - RNA, 62 nt, Human
uugcccgugcguugcugcagaccaucuggggucuugcccaagcacccuggagacuuugcucc

SEQ ID NO: 105535 - RNA, 62 nt, Human
gucaagugaggguccaggaaagcucuugcccucuugcccagcagccgcaggcauaucucaac

SEQ ID NO: 105536 - RNA, 62 nt, Human
ucugccccaggaggccagaguaaaaagugcugcuugcccacaccuucguccccuuugcaggg

SEQ ID NO: 105537 - RNA, 62 nt, Human
acgaggccuccccuucagcucaggcacagcaacuugcccaggacugacacugucacccugac

SEQ ID NO: 105538 - RNA, 62 nt, Human
ccugcucccggaaccggacggcacagggcguucuugcccaccccaggggccaggcuugcgga

SEQ ID NO: 105539 - RNA, 62 nt, Human
uggggaggugcaaugggaugggaggcaggaugcuugcccagaaaggugcuuuccuucagacg

SEQ ID NO: 105540 - RNA, 62 nt, Human
ggcugccagugccuggguggaugggccaccgccuugcccagccuggaugccauccaaguugu

SEQ ID NO: 105541 - RNA, 62 nt, Human
auguccaaccggucugucugcuucccucaccccuugcccaauaaaggacaaggacuucagag

SEQ ID NO: 105542 - RNA, 62 nt, Human
cuaaacaguugaguuucuucuaaagaggaagccuugcccagcaaggaccagugagacagccg

SEQ ID NO: 105543 - RNA, 62 nt, Human
gugguucaugggggagcaguccccuccccacucuugcccaugggugacucuuacccacagcu

SEQ ID NO: 105544 - RNA, 62 nt, Human
ugaacucuuuacacaccugaaccugugggggccuugcccauuugaccauguggcccaggcca

SEQ ID NO: 105545 - RNA, 62 nt, Human
uaccucuguuacucucagccuggaauccccaccuugcccaccccaguggaaaguaagcagug

SEQ ID NO: 105546 - RNA, 62 nt, Human
uguugauaaaccggucccugguggagcgaggccuugcccaguggguagacagcuacuacaca

SEQ ID NO: 105547 - RNA, 62 nt, Human
uaguuaguaucacacucaggccacacucagcacuugcccacucuuguuuacugccuuguauu

SEQ ID NO: 105548 - RNA, 62 nt, Human
agacaacacaggcuccugcuuccaccucggcccuugcccaggguggggccuggcccucaucu

SEQ ID NO: 105549 - RNA, 62 nt, Human
uggagaaagcuguguuccaaugaauccuaccucuugcccagucccaggcagaguaagcaggg

SEQ ID NO: 105550 - RNA, 62 nt, Human
agaaauuguccaugccaccaauuccacugcuacuugcccagguagugaucagugagaguuag

SEQ ID NO: 105551 - RNA, 62 nt, Human
gagggauagguggacccugacaucccuguggccuugcccaagggcucugcuggucuuucuga

SEQ ID NO: 105552 - RNA, 62 nt, Human
ccgccccccacccuugccaccacacucgcccacuugcccaccgggucccgccggauaaauga

SEQ ID NO: 105553 - RNA, 62 nt, Human
gacagguugcugaggggucggcaagcaucugacuugcccaauccccuggauauggugagccc

SEQ ID NO: 105554 - RNA, 62 nt, Human
acuggcaaagaugaauaggaaaaacuuugacucuugcccagugccugccugccucucucucu

SEQ ID NO: 105555 - RNA, 62 nt, Human
ccccacucugcgggagccccauagccaccucucuugcccaaggugagccagcccuggggacc

SEQ ID NO: 105556 - RNA, 62 nt, Human
acccaacccauccccaccccauaugggagaugcuugcccauguguuucaucaaucagaaguc

SEQ ID NO: 105557 - RNA, 62 nt, Human
gcacauggcuggcacugagcaguaccagugugcuugcccaccacagcgauccacggagcuga

SEQ ID NO: 105558 - RNA, 62 nt, Human
cugagaggagccaagggaacccagaugacacccuugcccaugccuggaccuugcuucuggcc

SEQ ID NO: 105559 - RNA, 62 nt, Human
gcugguugcacuggggucaggagugcccucaccuugcccagucuuccuucaagacuagacuc

SEQ ID NO: 105560 - RNA, 62 nt, Human
cccucuagaguagcugguggccagggaugaaccuugcccagccgugguggcccccaggccug

SEQ ID NO: 105561 - RNA, 62 nt, Human
ucaaaaggaaggaaaugacagagacacacgcccuugcccaccuuccucuguaggcugcacau

SEQ ID NO: 105562 - RNA, 62 nt, Human
acaaagccaugaauucccaaagcaucacugaacuugcccagccgggacacuggagacugaag

SEQ ID NO: 105563 - RNA, 62 nt, Human
ugagcccuccucgguuuauggagggucgccgucuugcccacccccgauccccgugcgcuccu

SEQ ID NO: 105564 - RNA, 62 nt, Human
aaagagggacaucccgacuuacguuuuucuaccuugcccagauaaguggauacaaccacucu

SEQ ID NO: 105565 - RNA, 62 nt, Human
gguugugagccccuuggggguucagggaacugcuugcccagggugcagugugagugugaugg

SEQ ID NO: 105566 - RNA, 62 nt, Human
uugaagcggacugcugcggaugcaacucccagcuugcccaccgcgggcugucugcucucccu

SEQ ID NO: 105567 - RNA, 62 nt, Human
ugaugaggaaacugagucauagaggauacagacuugcccaaaggagagccaggauuuucaca

SEQ ID NO: 105568 - RNA, 62 nt, Human
aggaauccugcccucaccucacccuuuuccaacuugcccagggaaguggagguucccucuuu

SEQ ID NO: 105569 - RNA, 62 nt, Human
acgacucugaccucuuggccacagaggacucacuugcccacaccgagggcgaccccgucaca

SEQ ID NO: 105570 - RNA, 62 nt, Human
acuugggucuggcuggcuccugcccgugacgccuugcccagcagcaaggugcgcaacauggc

SEQ ID NO: 105571 - RNA, 62 nt, Human
aggcccggccuggaggggugcuguggagcugucuugcccaggcccuccugggagggggacag

SEQ ID NO: 105572 - RNA, 62 nt, Human
cugcccugcggguugcccgccuccuccagagacuugcccaagggcccaucaccacuggccuc

SEQ ID NO: 105573 - RNA, 62 nt, Human
gcagugaccacgcucccggacccaaccuucagcuugcccaaagcaauaaucuuuccuaaaga

SEQ ID NO: 105574 - RNA, 62 nt, Human
ggccacgccccugcagauccaggucuccaggccuugcccacugagccuucagaggaccuaag

SEQ ID NO: 105575 - RNA, 62 nt, Human
acucagacccuuguaagccccuuccuuccucccuugcccaaagauccuuugcugaguguucu

SEQ ID NO: 105576 - RNA, 62 nt, Human
ccucgggcaccuggacuccuggccaaucaaggcuugcccagcugggaggccccacacgaaag

SEQ ID NO: 105577 - RNA, 62 nt, Human
caaggaaaguggggcacugagaaaggcagggacuugcccaagggcauauagugagacagugg

SEQ ID NO: 105578 - RNA, 62 nt, Human
cagccugggccuccccagauguccugcggacucuugcccagaucucggcuuuggauauugga

SEQ ID NO: 105579 - RNA, 62 nt, Human
uuguuuuuguuuuuuugagacagagucucacucuugcccaggcuggagugcaguggcacggu

SEQ ID NO: 105580 - RNA, 62 nt, Human
gcccuuccgaccucaguccugucugcuccagucuugcccagcucgaaggagagcagaucuga

SEQ ID NO: 105581 - RNA, 62 nt, Human
uuuggguguauucuauuuggcgcucccuggugcuugcccagcuuuuugaucuguaggauuau

SEQ ID NO: 105582 - RNA, 62 nt, Human
gccuuauaagugaagcaaauuuuggaaauucucuugcccaggcuuuuugcuccuucaaggcc

SEQ ID NO: 105583 - RNA, 62 nt, Human
acgcugcgccucccaucgcccgggugccuguccuugcccagcgccaccaggcuggaggcgga

SEQ ID NO: 105584 - RNA, 62 nt, Human
agcuguuuagcugguuguguuuuaagcaaguucuugcccaaucaugcauccugcuagaaaag

SEQ ID NO: 105585 - RNA, 62 nt, Human
ggggggcuccagggggugcccucccagacccccuugcccaggccuccccagcaccuaggugg

SEQ ID NO: 105586 - RNA, 62 nt, Human
caguucuuuuuuuuuuuuuuugagacggaguccuugcccaggcuggagugcaguggcgcgau

SEQ ID NO: 105587 - RNA, 62 nt, Human
cucacggcuugucucaugcagucguguggcuucuugcccagguuucaaagcugaaguacauu

SEQ ID NO: 105588 - RNA, 62 nt, Human
ggcccggccccaccccgccccgcccccgcugccuugcccaugggggcuguauuuaaggacac

SEQ ID NO: 105589 - RNA, 62 nt, Human
cuggagcuggggugcacauggggccugcucaccuugcccacacaucuccagccagccagggc

SEQ ID NO: 105590 - RNA, 62 nt, Human
ccaaacacuagaauagacuggccugaaauccccuugcccaguagaauggacugaucuaugug

SEQ ID NO: 105591 - RNA, 62 nt, Human
ugcacuggcuguucccucugccuggaaugcuccuugcccaguuaucccacugucuucuuugc

SEQ ID NO: 105592 - RNA, 62 nt, Human
ugcuucuuaccccuccccugcuuucucaaacacuugcccaccucaggcacucagcgggcucc

SEQ ID NO: 105593 - RNA, 62 nt, Human
cuauuugaaaaaaaaaaucacuugauuguauccuugcccagugaagccauccuaagacuuag

SEQ ID NO: 105594 - RNA, 62 nt, Human
uuuucaaaguaguaaacuuuucuauuuuucuacuugcccaguagagacucugauucuggaaa

SEQ ID NO: 105595 - RNA, 62 nt, Human
uaugugucuguaagagagacagagaccaagaacuugcccaauuuuagaaauacacuaaugug

SEQ ID NO: 105596 - RNA, 62 nt, Human
caguuuuuuaaucuaacaacuacuuuuggggacuugcccacaucucugggauuugaaugggg

SEQ ID NO: 105597 - RNA, 62 nt, Human
uuacauuuaccacguuucucuucucugcuccccuugcccacuggggacuccucuuuggcucc

SEQ ID NO: 105598 - RNA, 62 nt, Human
uuaagaaauacaguggggcccucucgcugucccuugcccagggcacuugcauuccagccucg

SEQ ID NO: 105599 - RNA, 62 nt, Human
ucaggagagccaugguagggcuagaguugggucuugcccagcccugcaguuucauaguccca

SEQ ID NO: 105600 - RNA, 62 nt, Human
cagagggccugaccccucaccuccccuucccucuugcccagggaacucuuccacaggacaaa

SEQ ID NO: 105601 - RNA, 62 nt, Human
uuuuuuaaaaauuuucauuuauuuaauggaaacuugcccauuuucacaugucugcuuauuua

SEQ ID NO: 105602 - RNA, 62 nt, Human
acgggagaggccacagauggccacuuccagagcuugcccauugccugucucucgccaauucc

SEQ ID NO: 105603 - RNA, 62 nt, Human
gacagagcugcggggucccaucuggacacuuacuugcccaccugccagugucuugggcauuu

SEQ ID NO: 105604 - RNA, 62 nt, Human
ucgccaccacuuguucccacgagaauaugucacuugcccagauaaaacugggcggcagccag

SEQ ID NO: 105605 - RNA, 62 nt, Human
ggccuugggugaguggccugcuaaggccccuccuugcccagacuacagggcuuaggacuugg

SEQ ID NO: 105606 - RNA, 62 nt, Human
ccaggucugcguuucacccuccagcugcuguccuugcccaggccccaccucuccucccuaag

SEQ ID NO: 105607 - RNA, 62 nt, Human
ugaggaaacuaaggcuccuaggggagaaaucacuugcccacaguuccacagcuagugaguga

SEQ ID NO: 105608 - RNA, 62 nt, Human
ggaugcaaaaguaccaggagcuagcuuuuaaccuugcccagccucaguuucuuuucuuagaa

SEQ ID NO: 105609 - RNA, 62 nt, Human
gauggagaaacaggcucugagauuucacaggucuugcccaaagucauugauuuugaugauua

SEQ ID NO: 105610 - RNA, 62 nt, Human
uauguuuucucuuaaaauaagguaaugaauggcuugcccacaaauuuaccuugacuacgaua

SEQ ID NO: 105611 - RNA, 62 nt, Human
cagccaaucagugacaucauugcuuucuuuagcuugcccauggugaugugaagaugagaaga

SEQ ID NO: 105612 - RNA, 62 nt, Human
ucugaggguucugaaaucaauguggucccucucuugcccacuaaacaaagaugguuguucgg

SEQ ID NO: 105613 - RNA, 62 nt, Human
ucagccauuucauuucuuaucuauuaaaauggcuugcccauaaaggaacugcauaggauuau

SEQ ID NO: 105614 - RNA, 62 nt, Human
auggagagagaccugggaaaaguccaggguagcuugcccaggggaagacagcagccacauac

SEQ ID NO: 105615 - RNA, 62 nt, Human
agcgcugggcggugcggagcgggcccgccacccuugcccacuucuccuucgcuuuccugagc

SEQ ID NO: 105616 - RNA, 62 nt, Human
augugacagaaugaucuggagcccuugcugaccuugcccauccccccagggaagucuggggu

SEQ ID NO: 105617 - RNA, 62 nt, Human
cagcggccucagggucuaaggagcgcuagugccuugcccacaggugcgggaccaucugaugu

SEQ ID NO: 105618 - RNA, 62 nt, Human
ggagucacugagagcuucguuaccccugcugccuugcccagggcacacccuauaccuccuua

SEQ ID NO: 105619 - RNA, 62 nt, Human
ucuuucuacucccgcucucuauuccccaguuucuugcccagaggcaacccuugccagucugu

SEQ ID NO: 105620 - RNA, 62 nt, Human
gcgcgccaccucuccaggccccagaagcccuucuugcccaaaggcuucccuggucccugagc

SEQ ID NO: 105621 - RNA, 62 nt, Human
ugccuucuguuuuccaaaggaguggucaagcccuugcccagagcucucuauucuggaagagc

SEQ ID NO: 105622 - RNA, 62 nt, Human
gaggaaacugaggucuagagaggucaagauuacuugcccagaaucacucaggcagcuaguga

SEQ ID NO: 105623 - RNA, 62 nt, Human
cugccuggaagauuccuucuuuccccuuuugucuugcccacuccuguuuacccuucaaguuu

SEQ ID NO: 105624 - RNA, 62 nt, Human
aggcccagaaagcaggaauggcuugccuaagacuugcccaagucccagagcaccucaccucc

SEQ ID NO: 105625 - RNA, 62 nt, Human
caguuucagcuuuccugggcaccagccuggaccuugcccauggcuaugccaagccuugggaa

SEQ ID NO: 105626 - RNA, 62 nt, Human
uuggacacaggaccccagagaggaaaaagugacuugcccaaggucguaagcaagcuacuggc

SEQ ID NO: 105627 - RNA, 62 nt, Human
cagccccugcccccagccugugugcccuguuccuugcccaccucaggccuggugguggcagu

SEQ ID NO: 105628 - RNA, 62 nt, Human
ucagcgggucuccucccagcggccuccggcgucuugcccagcagcucaagaagaaaaagaag

SEQ ID NO: 105629 - RNA, 62 nt, Human
cucagucuucaagggcuuuccuggaugccacccuugcccagagcccugcucacugccucaug

SEQ ID NO: 105630 - RNA, 62 nt, Human
ccugcuucuacccccugucacugauggcgagccuugcccagcuugagaccuguucccaucuc

SEQ ID NO: 105631 - RNA, 62 nt, Human
cacaaagugcugggauuacaggcgugagccaccuugcccagcccacaucauacaguuugaaa

SEQ ID NO: 105632 - RNA, 62 nt, Human
ggagccaaucucagcccuccacgccaaggagccuugcccaccagccaaucaauguucgucuc

SEQ ID NO: 105633 - RNA, 62 nt, Human
gcagaggcuugagaagugccugcacaaugaggcuugcccacuuuugcagcucuuuggaaucc

SEQ ID NO: 105634 - RNA, 62 nt, Human
caggagaccccuggcucagaccagcccaaggccuugcccaguggcaggggaaaggggcaccu

SEQ ID NO: 105635 - RNA, 62 nt, Human
ugacuaaauguugggaguggucguauuaacuucuugcccaaagaaguaagcauauugguguu

SEQ ID NO: 105636 - RNA, 62 nt, Human
cacuuaauuauaaaaccaguaauucauuuacucuugcccaaaacuauacacuguauuucugu

SEQ ID NO: 105637 - RNA, 62 nt, Human
ugucgagugagcugccccagccccucccagcccuugcccagccugggggaguggggaaggcu

SEQ ID NO: 105638 - RNA, 62 nt, Human
caguuauuuccucugucacuucaaaacuccagcuugcccaauaaggauuuagaaccagagug

SEQ ID NO: 105639 - RNA, 62 nt, Human
acuuccaaguggccagugauuuguuaaaauaccuugcccaagaauauaacugauugaugaaa

SEQ ID NO: 105640 - RNA, 62 nt, Human
uuguuuaagguucuugcugccccacaacacaccuugcccaugcacaaggaaugaauuuuuuc

SEQ ID NO: 105641 - RNA, 62 nt, Human
acagccucaccccugccccugugggacucauccuugcccaggugagggaaggagacaggaug

SEQ ID NO: 105642 - RNA, 62 nt, Human
ucaucacccauaaucgugggccccuugggccucuugcccacuguguguguggguauguaugu

SEQ ID NO: 105643 - RNA, 62 nt, Human
caccuguaccacccacuccaaccucaccccagcuugcccaaugcuucuggggaauuuaauag

SEQ ID NO: 105644 - RNA, 62 nt, Human
cagagucauugauguccugaugugaaacaacccuugcccaaccccacgaagucuccuauuua

SEQ ID NO: 105645 - RNA, 62 nt, Human
ucucuccuuaggucucuugggccccuggcagccuugcccaguuguucucucuggacucuguu

SEQ ID NO: 105646 - RNA, 62 nt, Human
gcccucugaauagccccccacugaaugcuugccuugcccaaauggaauggaggaagauugau

SEQ ID NO: 105647 - RNA, 64 nt, Human
uucccucauccuccguggcugccuccaugggacaaggaccgauuccaacacaggcuccucuuuc

SEQ ID NO: 105648 - RNA, 64 nt, Human
gcuuaaguggguugcuuccaggcagaagcagccaaggaccgauuccaggcacuuucuguagcaa

SEQ ID NO: 105649 - RNA, 64 nt, Human
agaagcaauauaagugugauugcaagaaugguagaggaccgagcacagaaaucuuagagauuuc

SEQ ID NO: 105650 - RNA, 64 nt, Human
ucaaggccuucgaccgggcuuuugcugacaacccaggaccgauggugaggcccgcggcagggcc

SEQ ID NO: 105651 - RNA, 64 nt, Human
aauauuccacagcgcccuccagaguuaccuggggaggaccgaggccacacgccacugcccccga

SEQ ID NO: 105652 - RNA, 64 nt, Human
gaaaggccccacuuucaagucacccuugccacugaggaccgaggacuaugcuaugaugaggauu

SEQ ID NO: 105653 - RNA, 64 nt, Human
gaauauagaugagcguagcugaguuuucacccguaggaccgaaguguuuugugguggaguaucu

SEQ ID NO: 105654 - RNA, 64 nt, Human
cgaugcgggcagcuggggggcugagagcacccagaggaccgaggacaggggccggacauugggg

SEQ ID NO: 105655 - RNA, 64 nt, Human
ggaaugggccugcagcccaacaaacaagggaacuaggaccgacagugacuucaccagcuugcua

SEQ ID NO: 105656 - RNA, 64 nt, Human
agagucgugaagugguuuuucagaaugcuauguaaggaccgauuugagcacuaacuauagguac

SEQ ID NO: 105657 - RNA, 64 nt, Human
ccucuucccucuccuacuuggcccagcugcuuggaggaccgaccccauggcugagaauaugacg

SEQ ID NO: 105658 - RNA, 64 nt, Human
acaguggugaggaauugagcucaugaagcaggcaaggaccgaacaccuccaccccaacguagac

SEQ ID NO: 105659 - RNA, 64 nt, Human
ucaaucuuacuguacuggaaacgucaccggaaucaggaccgagagcccuaaauaagucacacag

SEQ ID NO: 105660 - RNA, 64 nt, Human
ggcuucuuuccccacugcaggacccacuuugagaaggaccgaggaggaggauuuggguuguuuu

SEQ ID NO: 105661 - RNA, 64 nt, Human
uuuacaucuucacuuucugaagacacuugaauuuaggaccgauguaucugugacaagcaugcca

SEQ ID NO: 105662 - RNA, 64 nt, Human
ggggcacgucugaggggcccugcuccaagccugcaggaccgagggccacagccggacagggggu

SEQ ID NO: 105663 - RNA, 64 nt, Human
agccaggucugcuuauucucccauugggcagcugaggaccgaggcacagaggugcggugacuug

SEQ ID NO: 105664 - RNA, 64 nt, Human
guggccaccgcaaaggacggcgucgugcaacccuaggaccgacccccaccaccccuccccagcc

SEQ ID NO: 105665 - RNA, 56 nt, Human
gcccgggccagagccagugauggggcaggaccgaugccagccggguaccucaguuu

SEQ ID NO: 105666 - RNA, 64 nt, Human
augcuguucuuugguaauggaauaaauugacccaaggaccgaauuucauuuggauuucaaauug

SEQ ID NO: 105667 - RNA, 64 nt, Human
cagacggacagaccccucccuuucuuccggcaaaaggaccgagcccugggguaguaaggccccc

SEQ ID NO: 105668 - RNA, 64 nt, Human
ccuuugugugggugggguuuguggguaguggugaaggaccgauaucagaaaaaugccuucaagu

SEQ ID NO: 105669 - RNA, 64 nt, Human
aggccgccgcgucuguguuggggagcgccuggccaggaccgagcucuuccugcuguuugccggc

SEQ ID NO: 105670 - RNA, 64 nt, Human
cgagcugggcgagcugggcuggggagagccugugaggaccgagaggagaaaugagaagaaggaa

SEQ ID NO: 105671 - RNA, 64 nt, Human
ccggucagcaaucagcugcauccggacgguguggaggaccgagggguugggggccuucuaccgg

SEQ ID NO: 105672 - RNA, 64 nt, Human
uucaguacuguuuuuaaucacuuuuuaaaauauaaggaccgaaugcaaggaaaccaaaguuuau

SEQ ID NO: 105673 - RNA, 64 nt, Human
ggacucuuuccgacugcccagaaaguggggguggaggaccgaggcuacagcuccacacgccccg

SEQ ID NO: 105674 - RNA, 64 nt, Human
gacccagcuggaguucaugucgcaacagugcgccaggaccgacggccagccgcugcgcuccucc

SEQ ID NO: 105675 - RNA, 64 nt, Human
gcccuccccacucgggagaagcagagcugaccuuaggaccgagcaccagggcagguugcgcuga

SEQ ID NO: 105676 - RNA, 64 nt, Human
aucguccccgucugaccccaccccggagggagggaggaccgacgcgacgcgaugccucccggcc

SEQ ID NO: 105677 - RNA, 64 nt, Human
uccuggaggagguggagcugcagcugggacugugaggaccgagaagcaauggcccagcagacga

SEQ ID NO: 105678 - RNA, 64 nt, Human
gcuuggaauugggccuggcccccauggggcuuggaggaccgagccacugacagguauccccuga

SEQ ID NO: 105679 - RNA, 64 nt, Human
uaaagcggggcucccugcccgugaggcccggugcaggaccgauguacaaaacagcagcaagugc

SEQ ID NO: 105680 - RNA, 64 nt, Human
aaauauacaaaaaucacuugccagcaguagaaaaaggaccgacuauaccgaccuuucugauuag

SEQ ID NO: 105681 - RNA, 64 nt, Human
ggugacaggccugggccucugcaacugcccugacaggaccgagaggccuugccccuccaccugg

SEQ ID NO: 105682 - RNA, 64 nt, Human
gacccgcguccaccugggaggcauuugggguugcaggaccgagacccacauccucucacucacu

SEQ ID NO: 105683 - RNA, 64 nt, Human
caggcaagacaacaaagccgcuucugaagaagaaaggaccgaagcugcugcguaagcccaugca

SEQ ID NO: 105684 - RNA, 64 nt, Human
gcccugacgcaccugcugcucucugggagcccugaggaccgaguggccugcgcgcugacccugc

SEQ ID NO: 105685 - RNA, 64 nt, Human
uuuuuuuuuuaaacaauguaauugcuacuugauaaggaccgaacauuauucuaguuucauguuu

SEQ ID NO: 105686 - RNA, 64 nt, Human
ggagaaaguaugagagccucaggaaaccccaucaaggaccgaguaugugucugguuccuugggu

SEQ ID NO: 105687 - RNA, 64 nt, Human
uuccugacagccucccagccagggcuggcgauaaaggaccgagauagauggagggggcgaguag

SEQ ID NO: 105688 - RNA, 64 nt, Human
accagaaugggagccaggagucccagccaggcacaggaccgagccuggcucucggucagcaggu

SEQ ID NO: 105689 - RNA, 64 nt, Human
ggaggccuuggaagaguccggccuggccucccccaggaccgagaucaccgcccaguaugggcua

SEQ ID NO: 105690 - RNA, 64 nt, Human
cccugaccccacccgguggggcccuuggccccagaggaccgagagaguggagagugcggcgugg

SEQ ID NO: 105691 - RNA, 64 nt, Human
uaccuccuccgcugcgcuuuugcaugcccgggcgaggaccgaagcacacaccuccacgcgcacg

SEQ ID NO: 105692 - RNA, 64 nt, Human
ccauuaauuugccucucuguguuuaaagagcaccaggaccgaauggauuuucacuucaggcuuu

SEQ ID NO: 105693 - RNA, 64 nt, Human
ggaacucacagccaccacuaccaccacuuuagacaggaccgaggccacauacuccccauucucu

SEQ ID NO: 105694 - RNA, 64 nt, Human
acagccggucagaacugugugacucacuugaggcaggaccgagagugacauccaguugcaccuu

SEQ ID NO: 105695 - RNA, 64 nt, Human
cagccaucagccugucaacucaguuaacaaguuaaggaccgaaguguuucaaguggaucucagu

SEQ ID NO: 105696 - RNA, 64 nt, Human
auuugcaugcaguggguggagagucggccaccaaaggaccgaguugcgcucggaauuugagcug

SEQ ID NO: 105697 - RNA, 64 nt, Human
uaccugcucuacguucagggcuguggccguggugaggaccgacuccaggaguccccuuucccug

SEQ ID NO: 105698 - RNA, 64 nt, Human
acguugggacucccacguuccggggaccugaaugaggaccgacuuuauaacuuuuccaguguuu

SEQ ID NO: 105699 - RNA, 64 nt, Human
auaagaaaaccacccacaagcucaacugugacccaagcagaaucuacaaaccccagacaagguu

SEQ ID NO: 105700 - RNA, 64 nt, Human
caacugcagagaaugcuguugaugggaaugcuggaagcagaaacuuugucaucggaaaaacuuu

SEQ ID NO: 105701 - RNA, 64 nt, Human
acccucugcuagacacagccaaggccaacgaggcaagcagaagcagcggccgcagcgaagcugc

SEQ ID NO: 105702 - RNA, 64 nt, Human
caccugccgggacccucccuauuccauccaagggaagcagaacugccaaagacucaagucuuuu

SEQ ID NO: 105703 - RNA, 64 nt, Human
gauugagcgucugcagaaagaaauugagcgccauaagcagaagaucaaaaugcuaaaacaugau

SEQ ID NO: 105704 - RNA, 64 nt, Human
caugugccuauaaucccagcuacuugggagguugaagcagaauugcuugaacccaggaggugga

SEQ ID NO: 105705 - RNA, 64 nt, Human
guuuggaaaacuaacucagguguauuuauuguuuaagcagaaauaaaguuuaauuuuugcuuga

SEQ ID NO: 105706 - RNA, 64 nt, Human
ugauguuuauaguuccugugguuuuucacccaagaagcagaaucucauucaguacauuuaguuu

SEQ ID NO: 105707 - RNA, 64 nt, Human
aauguuugauaugauuuauuuaugaaaccuaaugaagcagaauuaaauacuguauuaaaauaag

SEQ ID NO: 105708 - RNA, 64 nt, Human
uaauaagcagcuucuacuuuugagccucaacuuaaagcagaacuguuuucuacuggauuuuuca

SEQ ID NO: 105709 - RNA, 64 nt, Human
acaacaccuccuaccuggccccuugccaaaucccaagcagaauuagcaacaggaaaagcagagc

SEQ ID NO: 105710 - RNA, 64 nt, Human
cuuagccagcaacuuguucugcaggggcccacugaagcagaagguuuuucucugggggaaccug

SEQ ID NO: 105711 - RNA, 64 nt, Human
gauaagcuaaauaaauuacuuuuauaacuuacuaaagcagaacaaacagugaaacuuucuaaaa

SEQ ID NO: 105712 - RNA, 64 nt, Human
aaggaaaacuguaggggggaguaaugugcuaaguaagcagaauugccucaaaaagaaguuguuc

SEQ ID NO: 105713 - RNA, 64 nt, Human
uuaaggguugagauuuuuaagaggcaagagcugaaagcagaagacaugaucauuagccauaaga

SEQ ID NO: 105714 - RNA, 64 nt, Human
acacacucugaagaauccuguaagccccugaauuaagcagaaagucuucauggcuuuucugguc

SEQ ID NO: 105715 - RNA, 64 nt, Human
gaagaaaagagggcaaagggaacaaugugaaaagaagcagaaaaucauaaaagaccauguguuu

SEQ ID NO: 105716 - RNA, 64 nt, Human
ucauauccuggcucuucucugggcaagaugagccaagcagaacauuccauccaggacacuggaa

SEQ ID NO: 105717 - RNA, 64 nt, Human
uuuccuccacuccccccauaucuuuaaaguguggaagcagaaaggaccugcauuuuccuacauu

SEQ ID NO: 105718 - RNA, 64 nt, Human
uggggggaaaaaguaaauuacaaacaaacaaacaaagcagaacuaaaauauugggaccauggca

SEQ ID NO: 105719 - RNA, 64 nt, Human
aagauguauuuuaaaucuaaauaaagagcaaauuaagcagaauaauuauaauaugauacucuca

SEQ ID NO: 105720 - RNA, 64 nt, Human
uucagacuaaagggugauggaaagaagcagaggaaagcagaaacagcaagagugacugagaccu

SEQ ID NO: 105721 - RNA, 64 nt, Human
ugcuuuucuccuccaccugugugguauauuuuuuaagcagaauuuuauuuuuuaaaauaaaagg

SEQ ID NO: 105722 - RNA, 64 nt, Human
auaaccccuugggacacucauccagacuucucugaagcagaaaaccugagcuccccacucacug

SEQ ID NO: 105723 - RNA, 64 nt, Human
ccucuaccuuacaguuaaucguuucuuaauaaagaagcagaauuuagaaaccacaggauagugu

SEQ ID NO: 105724 - RNA, 64 nt, Human
ugggguaagcauuuucauucuuccugcugaaguaaagcagaaaguacugcauaguauaugagau

SEQ ID NO: 105725 - RNA, 64 nt, Human
cuguugcaaacucaguuccaaagucacaggaagaaagcagaaaguucaacuuccaaaggguuag

SEQ ID NO: 105726 - RNA, 64 nt, Human
uagauauguauucagcuugucuucaaauacggccaagcagaaaauguuuuauauuuuauaaauc

SEQ ID NO: 105727 - RNA, 64 nt, Human
acuuuguuuucuucuuuuuccugaugugaauguuaagcagaagggagagaguccuuacucccuu

SEQ ID NO: 105728 - RNA, 58 nt, Human
agauaagcaugaaaacuugaacaaugaaaagcagaaugaaaaugagucauugcaacga

SEQ ID NO: 105729 - RNA, 64 nt, Human
acagcuuauaaguugcuaucaauuuucacuaccuaagcagaauuuuucucuaauuuacuuuuug

SEQ ID NO: 105730 - RNA, 64 nt, Human
ggugcauggcgaggccaagaagauggaguuccugaagcagaagaucgagcaggagcuccguagg

SEQ ID NO: 105731 - RNA, 64 nt, Human
cuggcauuuuuccauuucuaugcaaauuucuuugaagcagaauugcuugcauauuucuucucug

SEQ ID NO: 105732 - RNA, 64 nt, Human
uucuuuccccuuggaguucuuuucuucagacuuaaagcagaaaggggucugugcugccucuaaa

SEQ ID NO: 105733 - RNA, 64 nt, Human
caggcgccuauaaucccagcuacucaggaggcugaagcagaagaaucacuugaaccuaggaggc

SEQ ID NO: 105734 - RNA, 64 nt, Human
ugaaaacccucugcccuggccucaucuaccacugaagcagaaaggagucugggagcagcagucu

SEQ ID NO: 105735 - RNA, 64 nt, Human
cacuggcaucuaugcuuagcuaugaaagugaauaaagcagaauaaaaauaaaauacuuucucuc

SEQ ID NO: 105736 - RNA, 64 nt, Human
gugaggcaaacuuccagccgucagggucucagcuaagcagaaggugcuggaaggcugguuaguc

SEQ ID NO: 105737 - RNA, 64 nt, Human
augugaaaaaauaagauuuuucuuuagagagcagaagcagaagaguaaaauuuauuguauagcu

SEQ ID NO: 105738 - RNA, 64 nt, Human
ggcaguaagagaaaucaaaugcuaagaguuguugaagcagaaggcggcugauuguugguaaguc

SEQ ID NO: 105739 - RNA, 64 nt, Human
cauauaggacuuaauaugucaaaagcacauuaugaagcagaaauuaaaaauagccaagguuggu

SEQ ID NO: 105740 - RNA, 64 nt, Human
caugagaugcaccaucgaggcuacccccaagaagaagcagaagagaaguugguaaugagagggg

SEQ ID NO: 105741 - RNA, 64 nt, Human
uaaacaacuuugagauauggucuuaauuauuuuaaagcagaauaauauaauugaaaguuuauag

SEQ ID NO: 105742 - RNA, 64 nt, Human
gccgaacuuuguuauggagggagcagccucacacaagcagaaacacuccuguggaugguauugu

SEQ ID NO: 105743 - RNA, 64 nt, Human
caugccauucaccagauuauuugaugguacaaagaagcagaaguguaauuuuccuuuucccagc

SEQ ID NO: 105744 - RNA, 64 nt, Human
uuuaauagcaugcuuuaaagacugaugaguauaaaagcagaaguuuugcguuuuuuacugcuuu

SEQ ID NO: 105745 - RNA, 64 nt, Human
gagcaaacaagagcaagaaacaaaaagaagccaaaagcagaaggcuccaauaugaacaagauaa

SEQ ID NO: 105746 - RNA, 64 nt, Human
guugcuuuuuugucacaaguaacuuggaaaauagaagcagaauaguaaagguucuauucagcaa

SEQ ID NO: 105747 - RNA, 64 nt, Human
uggugguuuaguuucacccagugugcuuuuggauaagcagaaauaucuaaaugggauuuugagu

SEQ ID NO: 105748 - RNA, 64 nt, Human
cauucucaucauccaaacugaacauuuguaucccaagcagaaauaaagagaauauguucuuuuu

SEQ ID NO: 105749 - RNA, 64 nt, Human
ccagaucuaaaucuacucucccuccaaggcagcaaagcagaaucgggagcaguggagcagaaau

SEQ ID NO: 105750 - RNA, 64 nt, Human
uccagcugucuucuaccacuagaagacccaagagaagcagaagucgcucgcacuggucagucgg

SEQ ID NO: 105751 - RNA, 64 nt, Human
uaaagagaaugaggagaaaaaggagaaaagggaaaagcagaaaggaaaaaaaggaagagagagg

SEQ ID NO: 105752 - RNA, 64 nt, Human
uccuaucccuucccggaugauccgaaagacaagaaagcagaaauauuuuuaccggggucgccug

SEQ ID NO: 105753 - RNA, 64 nt, Human
ugucaucuuugccuacugacacccuuguccccacaagcagaagcacagaggggucacuagcacc

SEQ ID NO: 105754 - RNA, 64 nt, Human
cacaagccacaauaaaaagcauaacuucuaaaggaagcagaauagcuccucuggccagcaucga

SEQ ID NO: 105755 - RNA, 64 nt, Human
gguucuuacugcuugguccuugauuuaucacacaaagcagaauaguauuuuuauauuuaaaugu

SEQ ID NO: 105756 - RNA, 64 nt, Human
cagaaagugcagcauggaggaaaaucugaacucuaagcagaagacucuccacugaccugguugu

SEQ ID NO: 105757 - RNA, 64 nt, Human
ccaaccauaagugucaaaagcacaggccaguauuaagcagaaguucuaccaccuuauuagaacu

SEQ ID NO: 105758 - RNA, 64 nt, Human
caugcgccugucaucccagcuacuugagaggcugaagcagaagaaucucuugagcccggaaggc

SEQ ID NO: 105759 - RNA, 64 nt, Human
auuuacuaucacucaggauuauaaggcugguguuaagcagaacagccauuaaaucagcaucaaa

SEQ ID NO: 105760 - RNA, 64 nt, Human
aacuaaacaaacauauuuuagagcauggaucucgaagcagaauuuggcuaaauuuuaacaaaau

SEQ ID NO: 105761 - RNA, 64 nt, Human
ugaaguccuaggggcugggggccacucuugcggcaagcagaaggccauccuacuccgcggagug

SEQ ID NO: 105762 - RNA, 64 nt, Human
ugccaugauucuaaguuuccugaggccuccccagaagcagaagcauguaaagcccacagaaccg

SEQ ID NO: 105763 - RNA, 64 nt, Human
ucaugaccugaggcacucugcgaugugugccccaaagcagaacuuacagggccugcaggaagcu

SEQ ID NO: 105764 - RNA, 64 nt, Human
guaaaguuauauacgaaauaucugcuuuuggaauaagcagaaugaggcuaaacauggguuauac

SEQ ID NO: 105765 - RNA, 64 nt, Human
uuacaauacugagucauauauaaauuuucaauaaaagcagaaacuuucuuaccuuaaacacggc

SEQ ID NO: 105766 - RNA, 64 nt, Human
aaaaaagaucucagagaaaacaaaaguaaaagaaaagcagaaaaucaccuguuaucuacuccca

SEQ ID NO: 105767 - RNA, 64 nt, Human
cagagccuuggaauucuauuuuaugaaccuagagaagcagaauccuuacuuuugugagucuggu

SEQ ID NO: 105768 - RNA, 64 nt, Human
uuguuuacaugcuuauuccaugacugcuugcccuaagcagaaagugccuuucaggaucuauuuu

SEQ ID NO: 105769 - RNA, 64 nt, Human
ccuuccaaacaucaagccuugggauucuuggagcaagcagaaagccaguaacuucgcucuguua

SEQ ID NO: 105770 - RNA, 64 nt, Human
gacuuugaucaccugaacuuucucuagcaaguguaagcagaauggagugugguuccaagagauc

SEQ ID NO: 105771 - RNA, 64 nt, Human
uggccuuuugggaacccaaguuacguccuggugaaagcagaaaggaggagacaggauggcuguc

SEQ ID NO: 105772 - RNA, 64 nt, Human
gacugguggaagaauuccccaccagaucuccuugaagcagaauuagggaucagcaucauuaaca

SEQ ID NO: 105773 - RNA, 64 nt, Human
uauaagugcgacuguaaacgcagccaauuuuuuuaagcagaauaugagaacaccuaaguauucu

SEQ ID NO: 105774 - RNA, 64 nt, Human
cauuacuguagaagcuaaauugaucuuuauaauuaagcagaaauuacaaaacuaggaauaauca

SEQ ID NO: 105775 - RNA, 64 nt, Human
gucuucauguuuaucagugacuugacuacaaguaaagcagaaaacaguuggccuguaaucacag

SEQ ID NO: 105776 - RNA, 64 nt, Human
aucccacaccuggugcaauuagaagcauaauuagaagcagaagaacaaaaugccacguaaccaa

SEQ ID NO: 105777 - RNA, 50 nt, Human
acauggauaauagugaaugaaagcagaaagcaaaguaauaaaaucacaaa

SEQ ID NO: 105778 - RNA, 64 nt, Human
aaaaaaaaaaaaaaaaauccacaccguccuuggaaagcagaauaaaaggagcagaauauaaaau

SEQ ID NO: 105779 - RNA, 64 nt, Human
aagagcacaugucguggcuggcuacaagguuguaaagcagaaaaucgaaguuuaccaugucugu

SEQ ID NO: 105780 - RNA, 64 nt, Human
ugugacgaaaguggaaauggagaugguccugcagaagcagaagugcaauccagcccaugccgac

SEQ ID NO: 105781 - RNA, 64 nt, Human
aagaugauggcucauuuacacucagcugcucugcaagcagaaacuuuacaaccugaugucauau

SEQ ID NO: 105782 - RNA, 64 nt, Human
agguacugagagugaacaaauuuacagagacagaaagcagaacagugauuaccagggacugagg

SEQ ID NO: 105783 - RNA, 64 nt, Human
agaagccacgcuuguuccccauguaccucuagagaagcagaaaccaaagucccccugugcccug

SEQ ID NO: 105784 - RNA, 64 nt, Human
ccuguguuuaauguuucacuagggagaggaaauaaagcagaaggaacgugugaagcucuguguc

SEQ ID NO: 105785 - RNA, 64 nt, Human
cugcagggccggggcauggagaagaccagggaagaagcagaacuugaggccaacaguguguuuc

SEQ ID NO: 105786 - RNA, 64 nt, Human
accacacauuugagggaagacguggcguuaggugaagcagaagcaaacccugcucuuaggggcu

SEQ ID NO: 105787 - RNA, 64 nt, Human
ucccacagaggacugugguggccacaggagcugaaagcagaagagugggauuugaugccaggca

SEQ ID NO: 105788 - RNA, 64 nt, Human
uaguuuuuaaaauaucuuuugaccuguggugcaaaagcagaaaauacagcuggauuggguuaug

SEQ ID NO: 105789 - RNA, 64 nt, Human
cagugagccagccuugcaguaggcaguagacuauaagcagaagcacauaugaacuggaccugca

SEQ ID NO: 105790 - RNA, 64 nt, Human
uauaugauuuuauccucacaauaauucuguagccaagcagaauugguuccauuugacagaugaa

SEQ ID NO: 105791 - RNA, 64 nt, Human
accacauguuguaguaacuggucuuuuuauauuuaagcagaauccuguaagauugcuugucuuu

SEQ ID NO: 105792 - RNA, 64 nt, Human
cugauuuagguggaagaagacuaccuguuugaaaaagcagaagucaacuuuugggccgagaccc

SEQ ID NO: 105793 - RNA, 64 nt, Human
uacauuguggcaagaaaaaaugaggaagaagcaaaagcagaaaccccugauaaacugaucagau

SEQ ID NO: 105794 - RNA, 64 nt, Human
acagaacaugcuggguuaagugcauuagugcuucaagcagaaaaugcugaaaacaacguguaaa

SEQ ID NO: 105795 - RNA, 64 nt, Human
auucagaaacaaaacaauagaguacaaaagugccaagcagaacauaaaacauccuuacuuuuau

SEQ ID NO: 105796 - RNA, 64 nt, Human
ucaucagaccaugcacuauggauguggaacugucaagcagaaguuuucacccuccuucagaggc

SEQ ID NO: 105797 - RNA, 64 nt, Human
uauuguaaaaagaaaauaaguuauaacuguuauaaagcagaacuuuuguugcauuuuuuaaacu

SEQ ID NO: 105798 - RNA, 64 nt, Human
uagaaugaauucaaccugcucuguccauuaugucaagcagaauaauuugaagcuauuuacaaac

SEQ ID NO: 105799 - RNA, 64 nt, Human
gagguacacauacuaaagugacacaaagagaaugaagcagaaguagagaagaaagacuguaugu

SEQ ID NO: 105800 - RNA, 64 nt, Human
ggaaacgggcacagcgaaauccuggugaagagcaaagcagaagaaaugacagcagaagccaugg

SEQ ID NO: 105801 - RNA, 64 nt, Human
cugcaucuuuguaaguuagccagacaauaaagaaaagcagaaugauauggugucaacugguggu

SEQ ID NO: 105802 - RNA, 64 nt, Human
aucccaguuaccuacaucgcaauuaccuuauguaaagcagaacuaaugcugacuggauguuuaa

SEQ ID NO: 105803 - RNA, 64 nt, Human
uaaaaagaccuuuguaauuacuaacgaaaaugcaaagcagaaagcagucuguaauaaagauuaa

SEQ ID NO: 105804 - RNA, 64 nt, Human
ggucagcaaaauuagaagucauuucuaguccucaaagcagaaauaauuagaaauguuaacauuu

SEQ ID NO: 105805 - RNA, 64 nt, Human
ucacuucucccaaauaguauguggacucccagcuaagcagaaaacuauugucauucaacugaag

SEQ ID NO: 105806 - RNA, 64 nt, Human
uuuuuuugcguucgugggguuguaaaagaaaagaaagcagaauguuuuaucaugguuuuugcuu

SEQ ID NO: 105807 - RNA, 64 nt, Human
gcuugaaacccaauucuuauaugaaauuuuuuaaaagcagaaaccuagcagcccaucugcuuuu

SEQ ID NO: 105808 - RNA, 64 nt, Human
uuuguuagucagagcaggggaucagaggagacugaagcagaaacccugcacacgggcccaggau

SEQ ID NO: 105809 - RNA, 64 nt, Human
cggugaucagcagagagauugaacuuugaggaggaagcagaaucuuugcaagaaagucagaccu

SEQ ID NO: 105810 - RNA, 64 nt, Human
aagcuucuuaaaaugauuggugguuaauuuuucaaagcagaaauuuuaagccaaaaacaaacga

SEQ ID NO: 105811 - RNA, 64 nt, Human
uucuucaaauaaggacgcaaaucuucaggacaguaagcagaacaaucagaauggaauuaaaucu

SEQ ID NO: 105812 - RNA, 64 nt, Human
acccaguuccacuggggcaagcuccucggacaccaagcagaauucugcauggugacagucuccc

SEQ ID NO: 105813 - RNA, 64 nt, Human
gacaccuuuggguugcaaucuggggauacuggcaaagcagaaaauuguacaaccugugaucaag

SEQ ID NO: 105814 - RNA, 64 nt, Human
acaacacacaauauuauauugcauauugcccaauaagcagaagccauaaggucucacacuuuuc

SEQ ID NO: 105815 - RNA, 64 nt, Human
aaucaucuucagaaagugaacuugaacaugagagaagcagaaggaggaaacauaagaggaggcc

SEQ ID NO: 105816 - RNA, 64 nt, Human
agaaaaaaagguuaagcauaaaaagaaagggaaaaagcagaaacacugcagaagacacaaacaa

SEQ ID NO: 105817 - RNA, 64 nt, Human
acacagaagcacuggcugcugcuacagaccgcaaaagcagaaaguuucgugaaaauguccaucu

SEQ ID NO: 105818 - RNA, 64 nt, Human
gauccucacagucaagugacgaggcuggggcugaaagcagaagcaugcacagggaggagaccac

SEQ ID NO: 105819 - RNA, 64 nt, Human
cauguaagcagcuuuucgagagaaauaauucuuuaagcagaauaaaguuaggcuggcauugcuc

SEQ ID NO: 105820 - RNA, 64 nt, Human
uacauagaccucuacaaguagggaauguuuucugaagcagaaguuaaaauggacagcauuucua

SEQ ID NO: 105821 - RNA, 64 nt, Human
gugcuuguugccccacacggcccagauucacuugaagcagaaguuagcauccugggccaguuug

SEQ ID NO: 105822 - RNA, 64 nt, Human
acccugcuccuaccaaucuuuuuuaaagcaguugaagcagaauguauaggugucagagaagaaa

SEQ ID NO: 105823 - RNA, 64 nt, Human
cacucacucaaacuugcucuucaacucuguauacaagcagaagcaauaaaccaaucugauuuuc

SEQ ID NO: 105824 - RNA, 64 nt, Human
acauucucaauaauugauaauaacaguccaaagaaagcagaaagaaggaaagccuagaacagaa

SEQ ID NO: 105825 - RNA, 64 nt, Human
ugacuuuaguaaauuugucaauauagaugguaggaagcagaaugccauuuuauuaaaacacagg

SEQ ID NO: 105826 - RNA, 64 nt, Human
auuauuucuucaauuauuucucauuuauuguauuaagcagaaauuaccuuuucuuucucaaaau

SEQ ID NO: 105827 - RNA, 64 nt, Human
ucuccagaaccaucucuaggcaacuaucaaaaagaagcagaaguucaaguggacaaauuuaugu

SEQ ID NO: 105828 - RNA, 64 nt, Human
ucccaccucucaaagagacaaggaagccaccuguaagcagaagcagcauccaagugccccuggc

SEQ ID NO: 105829 - RNA, 64 nt, Human
ucgugccuuacaugcugggcccacauucugccccaagcagaagcugcagggaccucagugucca

SEQ ID NO: 105830 - RNA, 64 nt, Human
aguaucuucacucaaaagucuugcuuggaagaauaagcagaaauaauuuuauauauuuuuuuuc

SEQ ID NO: 105831 - RNA, 64 nt, Human
aagcagggaauagaggcaauuagcuagauaauucaagcagaaauccauuuucaucgaaauugcc

SEQ ID NO: 105832 - RNA, 64 nt, Human
gagugucuauggagcagccggaagucuguucucaaagcagaaguggaauccaguguggcuccca

SEQ ID NO: 105833 - RNA, 64 nt, Human
auaagauggaagcuuccaguccaaucucauggagaagcagaaauacauauuuccaagaaguugg

SEQ ID NO: 105834 - RNA, 64 nt, Human
uugucuguggaccaagauguucuauguaauucagaagcagaacucuuggcuaaagggcuagugu

SEQ ID NO: 105835 - RNA, 64 nt, Human
augcuggaagcugucguugaggagaaggaguaguaagcagaacuaagcagucuuggagggcaag

SEQ ID NO: 105836 - RNA, 64 nt, Human
gggacagaauggagaaaucuugagacagccaagaaagcagaauaugaagguaaauagagccuag

SEQ ID NO: 105837 - RNA, 64 nt, Human
ugguaugaaucaucuguuuaugaaguggcugaacaagcagaaacagcccuucauuuggaaauuc

SEQ ID NO: 105838 - RNA, 64 nt, Human
gugacucaggugaaauuuagagucauauuucccgaagcagaaguuaaagaaaauuuuuuaaaca

SEQ ID NO: 105839 - RNA, 64 nt, Human
uauauguuagaguuuugaaugagggauaaauagaaagcagaaugaauuaauggaaaagaacucg

SEQ ID NO: 105840 - RNA, 64 nt, Human
uaugcccuuucuccacuauagccaacacucagucaagcagaaaauacaaauccccccaaaacuu

SEQ ID NO: 105841 - RNA, 64 nt, Human
ucagguuggauccuguguggaugaucuuggugcuaagcagaaaagaaauuuggaccuugaaacc

SEQ ID NO: 105842 - RNA, 64 nt, Human
uugggacaugaggaaaagaaugcagagagggugcaagcagaauacauacccuaaguccauaauu

SEQ ID NO: 105843 - RNA, 64 nt, Human
uuacguacuaaggauacaggcuggaaaguaagggaagcagaaggaaggcuuugaaaaguuguuu

SEQ ID NO: 105844 - RNA, 64 nt, Human
aaauguguguuuuuaaaaaugcgcuaagaaggcaaagcagaaagaagagguauacuuauuuaaa

SEQ ID NO: 105845 - RNA, 64 nt, Human
ugaaaaacagaagagagaaaaauauacauuauaaaagcagaacauacauguaccaguuuuugga

SEQ ID NO: 105846 - RNA, 64 nt, Human
ucguuucacucagauuagcucaguuuucucaucaaagcagaaugcuaucuuguauguauuuuuu

SEQ ID NO: 105847 - RNA, 64 nt, Human
uaaggaaaaggcuuacuugcccuucagcucauaaaagcagaaggugugcuauucacaguaccau

SEQ ID NO: 105848 - RNA, 64 nt, Human
uuuaaauucaauugaugaagaugugauuuuacagaagcagaaguuucauuuucuugaggcuuaa

SEQ ID NO: 105849 - RNA, 64 nt, Human
aaaugaaugucgaagcuaucugcucuguuaaauuaagcagaagaaccaaaauuucaaggguagg

SEQ ID NO: 105850 - RNA, 64 nt, Human
guuggauaaauauuuggggucaccuagccauugaaagcagaaagcaguagugacacagcuuucc

SEQ ID NO: 105851 - RNA, 64 nt, Human
aggugcucaauaacuguuuguugcauuucaguaaaagcagaauaaccuuucaaaauaauaacag

SEQ ID NO: 105852 - RNA, 64 nt, Human
gaaagaaauggggugcugccuuucuguuuaguaaaagcagaauuugcaguggcaucuaaagaga

SEQ ID NO: 105853 - RNA, 64 nt, Human
ccuaacuauaaccaguuguugagggguauacuagaagcagaaugaaaccacauuuuuugguuug

SEQ ID NO: 105854 - RNA, 64 nt, Human
accuauaauguaaaggauguauucugagagaacaaagcagaaugaaacuugagucacuuacuaa

SEQ ID NO: 105855 - RNA, 64 nt, Human
uuuccaggguuauguacuuguguccagaugaauaaagcagaaaaagaggggauugaguagcauu

SEQ ID NO: 105856 - RNA, 64 nt, Human
cuucuuuaccccgcugagacagugggagagccugaagcagaauccugguauucaccacgcugcg

SEQ ID NO: 105857 - RNA, 64 nt, Human
ugucaugguuaaucuauuuuuuaaaauugaaaugaagcagaaguaggccuugugagaacugaaa

SEQ ID NO: 105858 - RNA, 64 nt, Human
auuuaaauauaaauaauauaaagugcucugaauaaagcagaaauauauuacaguucauuccaca

SEQ ID NO: 105859 - RNA, 64 nt, Human
ggcgcucugcccuguguccuucgcguuccucguuaagcagaagaagucaguaguuauucuccca

SEQ ID NO: 105860 - RNA, 64 nt, Human
agaggccaucaccgugucuauagagagcagacagaagcagaacagagcccggggcuccugagcc

SEQ ID NO: 105861 - RNA, 64 nt, Human
ugggcugaauuuuuaaauuuuuuuuaaaaacuugaagcagaaccuuguaauuuguguaaaugac

SEQ ID NO: 105862 - RNA, 64 nt, Human
aaggaaaugaagcggaaagcaucugagauaaaagaagcagaagccaaagcugcucuugaagaag

SEQ ID NO: 105863 - RNA, 64 nt, Human
uucccugaaacauaagcuuggaaaaucuauuagaaagcagaacagggcaaacucuccauuuuac

SEQ ID NO: 105864 - RNA, 64 nt, Human
aauauguugcuaagauuguguuggucgcucucugaagcagaaaagggacuggaaccaauugugc

SEQ ID NO: 105865 - RNA, 64 nt, Human
uaaauguacaauuguuuacauaacagaaaaggcuaagcagaaaguaaauuucaauaugucagua

SEQ ID NO: 105866 - RNA, 64 nt, Human
auaguaauucacaguccucagaagccuauuuuuaaagcagaagcaaaaaagaaaaacaaaauaa

SEQ ID NO: 105867 - RNA, 64 nt, Human
aaaggaguuauguuugggcaaagccuuugucuucaagcagaaugucacagaaggcagcuacuuu

SEQ ID NO: 105868 - RNA, 64 nt, Human
uugggaaagcugccucguuucccuuuuccucuagaagcagaaccagcucuacgagagugagacu

SEQ ID NO: 105869 - RNA, 64 nt, Human
agucuuugcuugacuuuuuugggggggauuagcaaagcagaaaacuggcugcuggguucuguag

SEQ ID NO: 105870 - RNA, 64 nt, Human
ucuaagcuguacaugguacacuagaauuuucugaaagcagaaaacguucagauuuuguaguuaa

SEQ ID NO: 105871 - RNA, 64 nt, Human
acuguuacaguuuuauugcucugaguaacugacaaagcagaaacuauucaguuuuuguaguaaa

SEQ ID NO: 105872 - RNA, 64 nt, Human
auauccuuuacccaggccauuccuaucauauaguaagcagaagaguugccaugaaaguaaaaga

SEQ ID NO: 105873 - RNA, 64 nt, Human
cuaaagugauaaaaccaaagaaaagcauguggaaaagcagaagcuuagaaaguuguggucacug

SEQ ID NO: 105874 - RNA, 64 nt, Human
gcugugaacugaucauguuuaugagaaacuggcaaagcagaaugugauauccuaggagguaaug

SEQ ID NO: 105875 - RNA, 64 nt, Human
cuauguuuucuugcucaaacaccuuucucucugaaagcagaaaaaggcacugauauaaagggaa

SEQ ID NO: 105876 - RNA, 64 nt, Human
uacagcccagguagaaauccuacauggcuaaaagaagcagaagcaaguuucgaagucacaguca

SEQ ID NO: 105877 - RNA, 64 nt, Human
cgaaacuuacugcugaaugauuacauucucccuuaagcagaaaacuuuggaugugccaugcaau

SEQ ID NO: 105878 - RNA, 64 nt, Human
aaaucagcuacccauuauagcacaaaaucagccaaagcagaauuuuuaaaaauuggcuuuuuua

SEQ ID NO: 105879 - RNA, 64 nt, Human
aaaacagccugucaaguucaaaacagagaggugaaagcagaagagacacuuuccuauuuugccu

SEQ ID NO: 105880 - RNA, 64 nt, Human
gggauggaugggggugguguaucuuacucuguuuaagcagaacaccuuguuugcgguguuggaa

SEQ ID NO: 105881 - RNA, 64 nt, Human
cuuacgugacaguucagggcucccuuaagugcuaaagcagaagcugcaaggcuuucuuaagguu

SEQ ID NO: 105882 - RNA, 64 nt, Human
ugaccucagaacugcauuuuauuuauuaauuuauaagcagaacaggccagaguucuaggcucug

SEQ ID NO: 105883 - RNA, 64 nt, Human
uacucuucaaccucuacugaaaacacaaacaacaaagcagaagacuccucucuucugacuguuu

SEQ ID NO: 105884 - RNA, 64 nt, Human
uuuccuggccaugacagugugauucccccagaggaagcagaaggaaguuaaagguugucuuugg

SEQ ID NO: 105885 - RNA, 64 nt, Human
uaagcgaugucuggagugauugugguucuuggaaaagcagaaggaaaaacuaaaaaguguaucu

SEQ ID NO: 105886 - RNA, 64 nt, Human
uggguuuguaacacgguuaaaggcaaugagaaacaagcagaauuccaggaguccuugaagcaga

SEQ ID NO: 105887 - RNA, 64 nt, Human
uuugcuucaaauuuaugaucccugcugauugucaaagcagaaagaaauacucucauaaacugag

SEQ ID NO: 105888 - RNA, 64 nt, Human
aaauuaugucuuuauaacucugaucuuuuacauaaagcagaagaggaaucaacuaguuaauugc

SEQ ID NO: 105889 - RNA, 64 nt, Human
auuaagguaugaccaaauccugccucauuaauucaagcagaaaauauccuggcagggaaucugg

SEQ ID NO: 105890 - RNA, 64 nt, Human
auucucaccaaauugcuccuaagcuucaaaucagaagcagaaacuggcaggccauggaccuuaa

SEQ ID NO: 105891 - RNA, 64 nt, Human
cccaaguguacauauguaccuauuuuuuuuuaaaaagcagaaauagaaauacaagacugguaaa

SEQ ID NO: 105892 - RNA, 64 nt, Human
auuaaaaaaaaauuuuauaaucucaaaugcuaguaagcagaaagaugcucuccgagguccaacu

SEQ ID NO: 105893 - RNA, 64 nt, Human
ugauggauuugaaaaugaaagauuuaauaaggcaaagcagaaucuguuguccuuaauuauauuu

SEQ ID NO: 105894 - RNA, 64 nt, Human
ccuucuaguccuugagacuuuguagcucuaacucaagcagaacccugggguuuugggauucugu

SEQ ID NO: 105895 - RNA, 64 nt, Human
uccucuuaugcuuuaccuguauuuuaucauuuguaagcagaacucuagcuauaugggguagaaa

SEQ ID NO: 105896 - RNA, 64 nt, Human
uucaacuacugcugaaagucuggauuucagaauaaagcagaauguaaguuucaguugaggccau

SEQ ID NO: 105897 - RNA, 64 nt, Human
gcagugaaucaagugcccacagauuugcaggcuuaagcagaacaagggaagauugauauuuuug

SEQ ID NO: 105898 - RNA, 64 nt, Human
ucuaagcuuuuuucucucauugcuggaaugauuuaagcagaaguccuuuuguguacuuuuaaaa

SEQ ID NO: 105899 - RNA, 64 nt, Human
ugagacaagaccuccuacuguacucuuucuggggaagcagaacugcagugacccacuucaaaga

SEQ ID NO: 105900 - RNA, 64 nt, Human
uggaagcuguucaagauacauuugaucuucagaaaagcagaauuugguucaacuguugacagag

SEQ ID NO: 105901 - RNA, 64 nt, Human
ggaugaaaaauugaagucacagccccucagcaccaagcagaagguggcccuaugcacccaggua

SEQ ID NO: 105902 - RNA, 64 nt, Human
cuucuauucugggaacaccagccgaugucaucaaaagcagaauaaugaaucaaccacgagauaa

SEQ ID NO: 105903 - RNA, 64 nt, Human
cggccccuauuaccuuuguagcagccacaucagaaagcagaagaaaacaguauuucugaaggca

SEQ ID NO: 105904 - RNA, 64 nt, Human
ugaaauuauucauggagugaauaagaaagauaugaagcagaacuguucuauucgggaagcuauu

SEQ ID NO: 105905 - RNA, 64 nt, Human
acacucugaaaaacaugcagauaauuugcugaugaagcagaagaggggaugcgcauggcaagaa

SEQ ID NO: 105906 - RNA, 64 nt, Human
uuccauuaaguaguguucuauaaacuuugauccaaagcagaaucaaugucuuuuccaucucgug

SEQ ID NO: 105907 - RNA, 64 nt, Human
agaauuuguccagauuauucagauaaacaucauaaagcagaauacauuauaaauaaguagaaua

SEQ ID NO: 105908 - RNA, 64 nt, Human
cuuuuuaaagagaaguugccuugguccacacacuaagcagaaaaccaaguuaucaggacagaga

SEQ ID NO: 105909 - RNA, 64 nt, Human
uguuacuguauuacaauuaguauucuaaaggcagaagcagaaguagcugcuuuuuagcaauaga

SEQ ID NO: 105910 - RNA, 64 nt, Human
gaggccacuggguucccagugguggcuguucagaaagcagaacauacuaagcgugagguaucuu

SEQ ID NO: 105911 - RNA, 64 nt, Human
ucuuccuaagcggaguuuuaggugacacaggaugaagcagaagagaucuacccaucucaucugc

SEQ ID NO: 105912 - RNA, 64 nt, Human
cucugacccccucucaucccggaagaagaggaagaagcagaacagacuaguuuugaguaaacuc

SEQ ID NO: 105913 - RNA, 64 nt, Human
uguauaauaaucaagaaauuaguuuauuaaaaggaagcagaagcauugaccauuuuuucccaga

SEQ ID NO: 105914 - RNA, 64 nt, Human
auuucagcaaacaugagcaaaccacuuugacugaaagcagaaagagugaaaauucuauuuuguu

SEQ ID NO: 105915 - RNA, 64 nt, Human
ugcugcugggguauguucugggcuuaauucccccaagcagaagaccagauccaagauguuugga

SEQ ID NO: 105916 - RNA, 64 nt, Human
ggcagggucagauugagaagaagcaaagcuggggaagcagaaguugggagucuuguguugcucc

SEQ ID NO: 105917 - RNA, 64 nt, Human
acucuccugagugagaagagacugaaauaggagcaagcagaacccugagaggugucccaucuua

SEQ ID NO: 105918 - RNA, 64 nt, Human
caucugaagaauguuggugaaggcaagucucugaaagcagaacuauccaguguuaucuaaaaau

SEQ ID NO: 105919 - RNA, 64 nt, Human
auauaugugacagaaaucuaacuucaagugacugaagcagaaagaaaaauuuuugaaugacaua

SEQ ID NO: 105920 - RNA, 64 nt, Human
ucauauagacaggcuucugauaguuugcaacuguaagcagaaaccuacauauaguuaaaauccu

SEQ ID NO: 105921 - RNA, 64 nt, Human
auauaagggauauguuguuaacuggaaggguguaaagcagaaguucuucggcccgggccugucg

SEQ ID NO: 105922 - RNA, 64 nt, Human
uccugucucuuuccuuucacccuagccugacuggaagcagaaaaugaccaaaucaguauuuuuu

SEQ ID NO: 105923 - RNA, 64 nt, Human
acacuugcucuccuauguaguucucagaugcguaaagcagaacagccucccgaaugaagcguug

SEQ ID NO: 105924 - RNA, 64 nt, Human
uggcgugccaggcgcguaccccaccaggugggcaaagcagaaaccugcggggagcggagacgcc

SEQ ID NO: 105925 - RNA, 64 nt, Human
ugaugccaauuccuacgagaaugugcucauuugcaagcagaaaaccacagagacaggugaggcu

SEQ ID NO: 105926 - RNA, 64 nt, Human
aagcaauuucagaacauuaacugaacuauuuucaaagcagaaaaauugacauugcugccuuuaa

SEQ ID NO: 105927 - RNA, 64 nt, Human
uuccaugguuccacagaagcuuuguuucuugggcaagcagaaaaauuaaauuguaccuauuuug

SEQ ID NO: 105928 - RNA, 64 nt, Human
agagaccagagaagagaacaagcuguugauuccuaagcagaaaauuucggaagaagugcauuca

SEQ ID NO: 105929 - RNA, 64 nt, Human
gcuuauuaaucuguauuguacacaugaugaaaugaagcagaagcugggagucggccuuuccucu

SEQ ID NO: 105930 - RNA, 64 nt, Human
gccaguucuuuccucuuuaggcgugguugagaaaaagcagaaacuuuacauaaagcuguauuuc

SEQ ID NO: 105931 - RNA, 64 nt, Human
gcccagcauguccaucuuuucaaagauacaacaaaagcagaaguuacaagaauauugcggagag

SEQ ID NO: 105932 - RNA, 64 nt, Human
agagagggacaaauuuucaauuugugaaacuccaaagcagaaaguauuggugcuugcuaccuug

SEQ ID NO: 105933 - RNA, 64 nt, Human
cacucacuaaguauggaaaacugauucugggaggaagcagaaaugucccuagauaacagcaugu

SEQ ID NO: 105934 - RNA, 64 nt, Human
cacuccagccugggaacaagagugaaacucucaaaagcagaaacaaaaacccaacauauauggg

SEQ ID NO: 105935 - RNA, 64 nt, Human
acccgguaaacgcaagcccuuggggcagaugcagaagcagaagagggaggggaaaccugccucu

SEQ ID NO: 105936 - RNA, 64 nt, Human
ugucucaguuuuuauaggcaucuuugcaugaagaaagcagaaguuuaccugaagugauacugca

SEQ ID NO: 105937 - RNA, 64 nt, Human
aagaaaaaauacaggcuuuagggaacaaagggacaagcagaacagguguggaagagagauuuuc

SEQ ID NO: 105938 - RNA, 64 nt, Human
gcugaguggggacauacacuugcaucuuuguugaaagcagaagaagacagacccuuuccccacc

SEQ ID NO: 105939 - RNA, 64 nt, Human
caaggacagaagcucuggcaggaguaaauuagcaaagcagaaauaguacccuuucauucuugga

SEQ ID NO: 105940 - RNA, 64 nt, Human
uggcccuuuauugagauaaguuuuccugucaagaaagcagaaaccaucucauuucuaacagcug

SEQ ID NO: 105941 - RNA, 64 nt, Human
uuuaucacaguugauuucugaagacuacauugccaagcagaaugaugaaaugacuuuuucguug

SEQ ID NO: 105942 - RNA, 64 nt, Human
gagaguggccauuuccuuaccuuugaucccuguaaagcagaaaggacuccuuugacaggcgaca

SEQ ID NO: 105943 - RNA, 64 nt, Human
uggauuuccaccugacaaaucuucgggauccaagaagcagaaacaauaucagcggauucggaag

SEQ ID NO: 105944 - RNA, 64 nt, Human
cagguggggcacagaccucuguuccugagcagagaagcagaaaaggagguucccucucucugcu

SEQ ID NO: 105945 - RNA, 64 nt, Human
caggcggagcugcugagugacagcuuuccucaaaaagcagaaggagagugagugccuuucccuc

SEQ ID NO: 105946 - RNA, 64 nt, Human
cucugaauaugcaugguguguuuccugucuguuuaagcagaacucaccuuuccuucuuguaaca

SEQ ID NO: 105947 - RNA, 64 nt, Human
gcaggaaggaaagaaaggauauaggaagagagggaagcagaaggcaggcauuuuucuauuuucc

SEQ ID NO: 105948 - RNA, 64 nt, Human
auuccauacuucucucagaugggaacaguaaagaaagcagaaucaacugccccugacuuaacuu

SEQ ID NO: 105949 - RNA, 64 nt, Human
accuugacguuucuucuuucuagagcaguuggccaagcagaaaaaaaagugucucaaaggagcu

SEQ ID NO: 105950 - RNA, 64 nt, Human
uaccuucagauguucacuaaauaacucaguuuuuaagcagaaguuuucagggcauuaaauauau

SEQ ID NO: 105951 - RNA, 64 nt, Human
gauuagaacacucgcacaagaugaccacauauagaagcagaaagccccaaauucccugggaacu

SEQ ID NO: 105952 - RNA, 64 nt, Human
uaagugaaaagcaucaccaucuacccauuggcucaagcagaaaucuggaagucaucuuugacuc

SEQ ID NO: 105953 - RNA, 64 nt, Human
uuuuuauuuugauuuuauuaaaugggaagaaagcaagcagaaauaguaaaauucaguagguuua

SEQ ID NO: 105954 - RNA, 64 nt, Human
agcuaaaacuguuaugcccacugugcucaauuugaagcagaauucagugaaaaauuauuuuucc

SEQ ID NO: 105955 - RNA, 64 nt, Human
cugcucuggccagggaggcagccccacucccagcaagcagaagugauccucgaggguccugccc

SEQ ID NO: 105956 - RNA, 64 nt, Human
cagauauuucuaugcuacuuagauauuuguggcaaagcagaaagcuuuuugacugugaaggcag

SEQ ID NO: 105957 - RNA, 64 nt, Human
ugaucaccugccaaaugaauaagacaacaaagagaagcagaagggcagaagauuauuuacugac

SEQ ID NO: 105958 - RNA, 64 nt, Human
ggaaagaauggaugacacuuagggacaggucacuaagcagaauagguauuaguugguuuuuuau

SEQ ID NO: 105959 - RNA, 64 nt, Human
guaccuguuauggaggacugcaaagggaagagaaaagcagaacacuguauuauuuuuuccuuua

SEQ ID NO: 105960 - RNA, 64 nt, Human
gacagguugaguagaggaaaagggaaagaagggaaagcagaaaacaaauuuuuagcaucugcug

SEQ ID NO: 105961 - RNA, 64 nt, Human
ugauccauucaugagcugguaugaaaucagugggaagcagaacaacagaaggaacuuuaaaagc

SEQ ID NO: 105962 - RNA, 64 nt, Human
aacucacauucccaucaaacacucuuccaaggaaaagcagaaguaauaauuggagguaaaguuu

SEQ ID NO: 105963 - RNA, 64 nt, Human
ugaaagcucaucaaaugagagcccuuuuauuuccaagcagaauuuagucagauaauuuugcuuc

SEQ ID NO: 105964 - RNA, 60 nt, Human
caaagaacugugucaacuagcagagaguccaagcagaagggcagauggacuucuucagug

SEQ ID NO: 105965 - RNA, 64 nt, Human
uuggaagcugcugaggcccccaaguuuuuuaauuaagcagaaacagcauauuagcagggauucu

SEQ ID NO: 105966 - RNA, 64 nt, Human
cguaccuggauucugugccuaccugcuccaucuaaagcagaaaacuccacaacuaagaucucuu

SEQ ID NO: 105967 - RNA, 64 nt, Human
caagaaugccaugcgcuggcaguacaugugcacaaagcagaaucucagagggucuccugcagcc

SEQ ID NO: 105968 - RNA, 64 nt, Human
uacauggaaaaagaggacuuucuugcacauuaggaagcagaauauccuccaguguagcacaggg

SEQ ID NO: 105969 - RNA, 64 nt, Human
aauuugauauguuuuucuuucccuuaagaaucaaaagcagaaaacaaaaacaacaguccuacuc

SEQ ID NO: 105970 - RNA, 64 nt, Human
gguucuaacuuucaauuuaaaaagagugaggaagaagcagaaugauucauuuugcugcguguga

SEQ ID NO: 105971 - RNA, 64 nt, Human
uggagacaucugagagaauauuuuuaucugaagaaagcagaauuuguuugauaccuaacaagau

SEQ ID NO: 105972 - RNA, 64 nt, Human
uugcuuuuguuuauggacaauguucagcugacauaagcagaaguuggccaaaauacugccugua

SEQ ID NO: 105973 - RNA, 64 nt, Human
cacugcaagucuguggccccacaacgugggcuuaaagcagaagccccacagccuggcacgaagg

SEQ ID NO: 105974 - RNA, 64 nt, Human
auugugcauaugaugcuugagaugguuuuugcaaaagcagaaaucgcugcaagguaaucacaau

SEQ ID NO: 105975 - RNA, 64 nt, Human
ggaauuguacauuuuuuaaacuugauugccauuaaagcagaaauuauaagguugcaacaauauu

SEQ ID NO: 105976 - RNA, 64 nt, Human
auacaaacaccaccacuguccagagagaguaaagaagcagaaagagaaagaauuugcaaccaug

SEQ ID NO: 105977 - RNA, 64 nt, Human
ugccaguuuuuuguagcaauguuauuucucuuggaagcagaaaugcuuuguaccagagcaccuc

SEQ ID NO: 105978 - RNA, 64 nt, Human
ccaucacaagauaaggccccaaugccuacagacaaagcagaagcugccacggacaccaauggga

SEQ ID NO: 105979 - RNA, 64 nt, Human
cugucaauaauuguuaccaaagagauaaaaauaaaagcagaauguauaucaucccaucugaaaa

SEQ ID NO: 105980 - RNA, 64 nt, Human
ugcccuucuuuuuaggaaacccuaaaggagaaggaagcagaauauaacccucuggagagcucaa

SEQ ID NO: 105981 - RNA, 64 nt, Human
agccuacuaucagcauccuacuacugcuucccuaaagcagaauuguuauucauuuaagaagucu

SEQ ID NO: 105982 - RNA, 64 nt, Human
gauccaguucuugaaaacacuguuucugguaaugaagcagaauuuaaguugguaauauuaaggu

SEQ ID NO: 105983 - RNA, 64 nt, Human
uuucuccuuucaacauacuuaggcuguggagugcaagcagaauuaugcauagaaauuguggcag

SEQ ID NO: 105984 - RNA, 64 nt, Human
gguuagaggagucuguggcuuuuuguucagaauuaagcagaacacugcagucagauccuguuac

SEQ ID NO: 105985 - RNA, 64 nt, Human
cauacccaugccuuaaagaggggcaguuucucaaaagcagaaacaugccgccaguucucaaguu

SEQ ID NO: 105986 - RNA, 64 nt, Human
ccugguuucauaacuuccuguacuugaagucuaaaagcagaaaauaaaggaagcaaguuuucuu

SEQ ID NO: 105987 - RNA, 64 nt, Human
cccagaugggccaaagaaagagccuaugaaggagaagcagaagcagacggcuggccuggcucac

SEQ ID NO: 105988 - RNA, 64 nt, Human
gaauuuauaauuccuuucauagacucaaaccugaaagcagaaauuuuuaguaguugaguugcuu

SEQ ID NO: 105989 - RNA, 64 nt, Human
ggucauuuuauucucuguauaaaacuuagcucuaaagcagaaacuaaagcagcaaaugcaggaa

SEQ ID NO: 105990 - RNA, 64 nt, Human
aaagcacugaagccccccggccgccaaccccugaaagcagaaccuggccucccuggccacagca

SEQ ID NO: 105991 - RNA, 64 nt, Human
uacgguuugaacauaauuggagaaccuuuccuucaagcagaaacaagcaacugagggaaaaaga

SEQ ID NO: 105992 - RNA, 64 nt, Human
aaugauacacaugaagauaacuuuuuuuaaaaaaaagcagaaauacacaaugaucucccuugua

SEQ ID NO: 105993 - RNA, 64 nt, Human
aaacugucugggagauuccucagcuacuuuuccgaagcagaaugucauccgagguauugauuac

SEQ ID NO: 105994 - RNA, 64 nt, Human
ugcauagacagcacgucuucagggugugguuucuaagcagaaaauagcaaauguuuauauugaa

SEQ ID NO: 105995 - RNA, 64 nt, Human
uguaucacugcagggcuuucugcacugaaaguggaagcagaaggcuaaugggucacauugugua

SEQ ID NO: 105996 - RNA, 64 nt, Human
uccagccagaaaagugguaagcggagcaagugccaagcagaacagaccuuaucaucuggguaac

SEQ ID NO: 105997 - RNA, 64 nt, Human
aauuuguacaaugguuuauucccaaguaugccuuaagcagaacaaauguguuuuucuauauagu

SEQ ID NO: 105998 - RNA, 64 nt, Human
aaucacuuaaauagcuucuugucaccuuaaacuaaagcagaauaaaaaguauccuuugaaauua

SEQ ID NO: 105999 - RNA, 64 nt, Human
caaaccagauuuagagaauugagugcuugcagucaagcagaauguaccuccugcagagacaaau

SEQ ID NO: 106000 - RNA, 64 nt, Human
auaucuguguauuuucaaauguuacuauauauuaaagcagaaauauaaccaaagguuaagcugu

SEQ ID NO: 106001 - RNA, 64 nt, Human
aagggagcagcacagggagagaaacaggauaggaaagcagaauggcgagcagccuauggcccag

SEQ ID NO: 106002 - RNA, 64 nt, Human
uuggaccacuccugucccuguagcucagucaucaaagcagaagucuggcuuugcucuauuaaga

SEQ ID NO: 106003 - RNA, 64 nt, Human
aguguuuugccagaaucucucuugcuuugccauuaagcagaagaacuaguuucccuguauagcc

SEQ ID NO: 106004 - RNA, 64 nt, Human
gugagaaugagauucauuucaauguaaugcacuaaagcagaacacgaacuuagcuuggccuauu

SEQ ID NO: 106005 - RNA, 64 nt, Human
augagaugauguaaccuuuucuaucacuuguuaaaagcagaaaacauguaucagguacuuaauu

SEQ ID NO: 106006 - RNA, 64 nt, Human
ggacaggagccaggguggggguaguuuugugggaaagcagaacugaaguuagcuuaagcauaaa

SEQ ID NO: 106007 - RNA, 64 nt, Human
guuuuuuuuuucuuugaagacuuucuaaauuaggaagcagaaaaacaaaucucuaggagauucu

SEQ ID NO: 106008 - RNA, 64 nt, Human
uauaauugggaaaaaauucaguguccuccaugccaagcagaaaacucauagucaauacaaguau

SEQ ID NO: 106009 - RNA, 64 nt, Human
augucacagcuccugugauucaauguuauaaaacaagcagaauuuuaaaagcagcacuauauag

SEQ ID NO: 106010 - RNA, 64 nt, Human
cuuuccagccugaauuuuucagauugacuagaccaagcagaaucucucaaccugaucuuaguau

SEQ ID NO: 106011 - RNA, 64 nt, Human
uugggugcugugggucaccaacaggcuguuuacaaagcagaaaauaucaucaccaucauaaccu

SEQ ID NO: 106012 - RNA, 64 nt, Human
ucuucccugugucuccccuaacaaggcaaucuggaagcagaaaugcaaacuccagccccaccac

SEQ ID NO: 106013 - RNA, 64 nt, Human
uacuguagaaaaaaaggucaugauucaugauugaaagcagaacaauggagaugaaauaaacaag

SEQ ID NO: 106014 - RNA, 64 nt, Human
ucuggauccaucagcccucaggcacaguugggccaagcagaaagagagaaacacuucugcuguc

SEQ ID NO: 106015 - RNA, 64 nt, Human
auagggccuuccuacagagcagcaagaguaggccaagcagaaagacugcugagguaacacggac

SEQ ID NO: 106016 - RNA, 64 nt, Human
ugaauuaauuaacauuugaguuuguuuaagguauaagcagaagauaagcuaauauagcuuguuu

SEQ ID NO: 106017 - RNA, 64 nt, Human
acgugaguuguuccucaggaauagauuuuucauaaagcagaauugauccuguggcugguuucuc

SEQ ID NO: 106018 - RNA, 64 nt, Human
cuccuucagugacaaguagggcacaaaauucuagaagcagaagguuguuuuuuuuuuuuuuucu

SEQ ID NO: 106019 - RNA, 64 nt, Human
uuggaugauuaauccucagaacaauggagcaauaaagcagaaggagucuuucaucuucuggcag

SEQ ID NO: 106020 - RNA, 64 nt, Human
aacuacaauagaagacauuuucacuggaauuacaaagcagaauuaaaauuauauuguagaagga

SEQ ID NO: 106021 - RNA, 64 nt, Human
uaugugcuuaacaggcaaugcuucucagaccacaaagcagaaagaagaagaaaagcuccugacu

SEQ ID NO: 106022 - RNA, 64 nt, Human
auuagagagugaguagaagugagccagacaaaaaaagcagaaaaugcagaugauggaaaggaca

SEQ ID NO: 106023 - RNA, 64 nt, Human
ugcaauguauuuuuuuaggggaguaucuuuaacaaagcagaaugauucuucuaaguuuggcaac

SEQ ID NO: 106024 - RNA, 64 nt, Human
auauaaaggcauuacauuggcaaauaagguuuggaagcagaagagcaaaaaaaagauauuguua

SEQ ID NO: 106025 - RNA, 64 nt, Human
gcaaacacaggaucuauuagagaaagaagcccuaaagcagaaagcucuauaccaagaaguccaa

SEQ ID NO: 106026 - RNA, 64 nt, Human
ugccagggaccagcuuaaugcccugcgccgcgagaagcagaagcucguggagaagaucauggac

SEQ ID NO: 106027 - RNA, 64 nt, Human
agcugggcagccccuuaaagccaaaccccaccugaagcagaaccacuuuggccuccccugccca

SEQ ID NO: 106028 - RNA, 64 nt, Human
cugcucauccuccugggccccauccacucagccaaagcagaaugcaggguuuccugccugacaa

SEQ ID NO: 106029 - RNA, 64 nt, Human
gagccagauguugagggcugagugggaacuuggcaagcagaaguggggagcacuuuaaugcaac

SEQ ID NO: 106030 - RNA, 64 nt, Human
cugcuggccggggauggagacaugucauuuguaaaagcagaaaaagguugcauuuguucacuuu

SEQ ID NO: 106031 - RNA, 64 nt, Human
cuuugaagaccuuuuuuucuguugggagaauggaaagcagaaagggaagccaggcucuuuaaug

SEQ ID NO: 106032 - RNA, 64 nt, Human
gcaaguaacuauguguaaguccucaucaaaugaaaagcagaaagacaagaacaauuagucaaga

SEQ ID NO: 106033 - RNA, 64 nt, Human
uuuaaaucauauuaaaauuacagaugugaaaauaaagcagaagcaaccuuuuucccucuuccca

SEQ ID NO: 106034 - RNA, 64 nt, Human
ugggcgaaauccaggccaggagccucagagacugaagcagaacagaguaagacucaugagaauc

SEQ ID NO: 106035 - RNA, 64 nt, Human
auaagucauauguuuguauccuguuuuaugaagaaagcagaaauaauuacugaaagugccagac

SEQ ID NO: 106036 - RNA, 64 nt, Human
gaggaaaaaugauuggauguguuuauucuuuucuaagcagaaugguuuaacuuuguacucuuug

SEQ ID NO: 106037 - RNA, 64 nt, Human
uacauccguuuauuaucaagggcaaccuuggugaaagcagaaagggugugugcuauugcauaua

SEQ ID NO: 106038 - RNA, 64 nt, Human
uuguaagcuccuauuugcuuaucuuguuuauuucaagcagaaaucaauaaauuccauaacccuc

SEQ ID NO: 106039 - RNA, 64 nt, Human
uaguucuuuuuguagguguucagcaauggugauaaagcagaauauucuccuaccucacgucauu

SEQ ID NO: 106040 - RNA, 64 nt, Human
acaaucuaacucagaaugggauuaaaaauuuuagaagcagaagcuaauauauaaaugaaguuug

SEQ ID NO: 106041 - RNA, 64 nt, Human
ccuaauggauggcuuuuuaaaauguuuuaauaaaaagcagaauagauguuuguuuuucuagugg

SEQ ID NO: 106042 - RNA, 64 nt, Human
aacuugaguucuaagcagugcucgugaaaaaaaaaagcagaaagaauuagaaauaaauaaaaac

SEQ ID NO: 106043 - RNA, 64 nt, Human
aauucauuccgcuguaauguuuucacaauauuuaaagcagaagcacgucaguuaggauuuccuu

SEQ ID NO: 106044 - RNA, 64 nt, Human
aucuuaaagcuaaguuuacccaaguacuuucagcaagcagaaaaaugaaacucuuuguuuucuu

SEQ ID NO: 106045 - RNA, 64 nt, Human
guucuaaggaaugagaaacaauuuugaugaauuuaagcagaaaaugaauuucugggaacuuuuu

SEQ ID NO: 106046 - RNA, 64 nt, Human
caaacguugcacuggugccuccccucgaaccgccaagcagaaaccggaccucacagcugacugg

SEQ ID NO: 106047 - RNA, 64 nt, Human
agguccagaguccaagcccugguggguagaggccaagcagaagcccugaaguggacucuugcuu

SEQ ID NO: 106048 - RNA, 64 nt, Human
uacgauuucacuaggacucagaaacgagaucgggaagcagaaauauagugcaauagugcaacau

SEQ ID NO: 106049 - RNA, 64 nt, Human
aucacauagacuaauagaaaggaggcuguggcuaaagcagaaauggaacuuccggaucugaaau

SEQ ID NO: 106050 - RNA, 64 nt, Human
uuguaaguccccaucccuacccuacacaaaguaaaagcagaagauagauaaaaaaugauguaau

SEQ ID NO: 106051 - RNA, 53 nt, Human
uaacaucugguuugaaauaguaaaagcagaaucaugagucuucuauuuuuguc

SEQ ID NO: 106052 - RNA, 64 nt, Human
gaacuugaaaucuaauauuucuaguauuugaacaaagcagaagguuaagucagggaagagcagu

SEQ ID NO: 106053 - RNA, 64 nt, Human
uggacuacaugaagauaacaugcuuaaaaauggaaagcagaaaguaacugcagugaugaacauu

SEQ ID NO: 106054 - RNA, 64 nt, Human
cuacaagcagccucuaacuggaucuuaaggacuaaagcagaauguaggagagggauucuuccaa

SEQ ID NO: 106055 - RNA, 64 nt, Human
caaacuuauuggauuauuaguuauucagacagucaagcagaacccacagccuuauuacaccugu

SEQ ID NO: 106056 - RNA, 64 nt, Human
auuuuuucaguuguuuguuuuugcuuguuauauuaagcagaaauccugcaaugaaagguacuau

SEQ ID NO: 106057 - RNA, 64 nt, Human
agaaaacuauauuggcugauuuuuucugaucuuaaagcagaaugccuuuucuuuuuuugcuuca

SEQ ID NO: 106058 - RNA, 64 nt, Human
ugguaucaagaacuuuaucaguaugcuuuguugaaagcagaaauuaagauaauaauugaguuca

SEQ ID NO: 106059 - RNA, 64 nt, Human
uuaucacacacaaaaguuacaccaacagaauaccaagcagaaugaugaggaccuguaaaauacc

SEQ ID NO: 106060 - RNA, 64 nt, Human
uuuguagaaauaguuuuugaggaagccaaaagcaaagcagaaaccuuuacaguauuguuucuuu

SEQ ID NO: 106061 - RNA, 64 nt, Human
aaaguacucaaaagugagaagaguuaacuugucaaagcagaaugguucucuuugacccacucug

SEQ ID NO: 106062 - RNA, 64 nt, Human
auggauuuuauuuuuucauuuuauugauucucagaagcagaaagcaucacuuuaaaaguucguu

SEQ ID NO: 106063 - RNA, 64 nt, Human
uaggugguaagguuggggauuaguccagguacagaagcagaacuuuuuucuaaggauaaacauc

SEQ ID NO: 106064 - RNA, 64 nt, Human
uccccuuuuccuccaaacccuauuaggguaccggaagcagaaccccugggcugaggcccuggcc

SEQ ID NO: 106065 - RNA, 64 nt, Human
acaugcacacacgcaugcacacacacaaagccuuaagcagaagaaugucuuagcaucaugagac

SEQ ID NO: 106066 - RNA, 64 nt, Human
gguaggagggcuuuucuauacauuuucugagggaaagcagaacaccgggguuauagcuauaccu

SEQ ID NO: 106067 - RNA, 64 nt, Human
uguucacaaauuaaugcugucaaaggaaugaguaaagcagaaaaacuuuuaaccagcaacauuu

SEQ ID NO: 106068 - RNA, 64 nt, Human
uaaagagaacaagugauacauccaaugcaacggaaagcagaagggauuuaggacuacgucuccu

SEQ ID NO: 106069 - RNA, 64 nt, Human
cagagcugcaguuagacgggguuacgggggcuaaaagcagaaaaaaaauuccauuucaucggga

SEQ ID NO: 106070 - RNA, 64 nt, Human
uucugaaucucuccagcagccagaggcacgugagaagcagaaagagcugguaaauaaagccuug

SEQ ID NO: 106071 - RNA, 64 nt, Human
ucucacaugcagcucagagcucccaagagcucaaaagcagaaauggccaggccuucugaaaacu

SEQ ID NO: 106072 - RNA, 64 nt, Human
aaccagugccauggaaaaccaaggauauuagcaaaagcagaaguugcuagugaccuugggaagc

SEQ ID NO: 106073 - RNA, 64 nt, Human
gaugugauaguggaaggaauuguggauggaagacaagcagaaaagcugaagacaauaguuccuc

SEQ ID NO: 106074 - RNA, 64 nt, Human
caggcgucuaaggagucaaaagagaaacagcuucaagcagaacguaaaaggaaagcggcguuau

SEQ ID NO: 106075 - RNA, 64 nt, Human
uuauuuuuacagacccucaaaaauccucugccggaagcagaagcugggaaaauugaggagaguc

SEQ ID NO: 106076 - RNA, 64 nt, Human
aguuagccagacuguuuuuaaagcaccuggcgggaagcagaagguuggauccaagcccuuguuc

SEQ ID NO: 106077 - RNA, 64 nt, Human
ugaccuuuuuuucaaucuucuagaaagggaacggaagcagaagugggacaucgagggcucugcu

SEQ ID NO: 106078 - RNA, 64 nt, Human
uccugaaagcuuacauuuuccugagaccucaaugaagcagaaauguacuuaggcuuggcugccc

SEQ ID NO: 106079 - RNA, 64 nt, Human
ugugcaauauauucaaagaaaagaaaacacaaauaagcagaaaacauacuuauuuuaaaaaaga

SEQ ID NO: 106080 - RNA, 64 nt, Human
uuugauaaagauuuuaauuuauguaaaacuucuaaagcagaaucaaagcuccucuuggggaaau

SEQ ID NO: 106081 - RNA, 64 nt, Human
gggagaagaggcauagguccagcaacaaccaacaaagcagaaggagggcucaccuuggugucac

SEQ ID NO: 106082 - RNA, 64 nt, Human
guuuugccaacccuugacauacaaggaguuugaaaagcagaagggaaggacaauucaguaucua

SEQ ID NO: 106083 - RNA, 64 nt, Human
uggcgaguccagagaggaaacuguggaauggaaaaagcagaaggcuaggaauuuuagcaguccu

SEQ ID NO: 106084 - RNA, 64 nt, Human
aaugacaugucagccauuguuucauguuuccuaaaagcagaauauuugcaacauuuguuuugua

SEQ ID NO: 106085 - RNA, 64 nt, Human
ugaguauugagacugaggagaaugauagagagugaagcagaaacaggagcacagaccucugcug

SEQ ID NO: 106086 - RNA, 64 nt, Human
ugcaggggcuuuucuucccuagaaacccaauucuaagcagaaaaagaaaaaaaacacaaaaaau

SEQ ID NO: 106087 - RNA, 64 nt, Human
cccuuguccuucaccuccacacaggaccagcuggaagcagaaagaagaaaggccaauuucacag

SEQ ID NO: 106088 - RNA, 64 nt, Human
uugcucuuuuguacauuuuccgaaacuacaguuaaagcagaagucuguuuuuaggaaaaguuuc

SEQ ID NO: 106089 - RNA, 64 nt, Human
ugaaaaagcuugaauugaggagucaagagucacuaagcagaauuuagaaagagaaguuuuuaaa

SEQ ID NO: 106090 - RNA, 64 nt, Human
aaaauguuuauacguggaaacacaccuacaugaaaagcagaaaucgguugcuguuuugcuucuu

SEQ ID NO: 106091 - RNA, 64 nt, Human
guuagaugcagacuggcagcauccuccuugauaaaagcagaaaagcaaagagguaauuggaguu

SEQ ID NO: 106092 - RNA, 64 nt, Human
gguggauucuuuaucaccaguggccuuacuucguaagcagaauuuccagccuacagcccaacaa

SEQ ID NO: 106093 - RNA, 64 nt, Human
uuacugcuuucugaauguagacggaacaguguggaagcagaaggcuuuuuuaacucauccguuu

SEQ ID NO: 106094 - RNA, 64 nt, Human
uaaaauaacauguaaacuucaauguucuaucuggaagcagaauaaaauauuuacauagauacaa

SEQ ID NO: 106095 - RNA, 64 nt, Human
uacuguuuuucuaaucauauguggucauaacgggaagcagaauuaugcuuuauucaaacaaacc

SEQ ID NO: 106096 - RNA, 64 nt, Human
ucauauacaaagccuguaauuuuaggcgaaauggaagcagaaaucuaggaaguugugcuugcuu

SEQ ID NO: 106097 - RNA, 64 nt, Human
uuggagagaagggcauagucuuugagcuacuaaaaagcagaauuccggagcuucgagauaucuu

SEQ ID NO: 106098 - RNA, 64 nt, Human
guacuauuugaacuuugcagaucucuguucucucaagcagaacucccaaccagauccauucuug

SEQ ID NO: 106099 - RNA, 64 nt, Human
uuuuaaaaaguugccuucuccaguggcaguccaaaagcagaaaugagaggaaauuauuacaaaa

SEQ ID NO: 106100 - RNA, 64 nt, Human
acagacuagagaagccaccugguuguaacagaauaagcagaaguuuacagcaugauaguccaag

SEQ ID NO: 106101 - RNA, 64 nt, Human
auuuccagccuucuugcucucagagcuauuguucaagcagaaaacaagcugcuuuuauuacagu

SEQ ID NO: 106102 - RNA, 64 nt, Human
ucucaauuccaaggcauuggaaaaagagaggaacaagcagaagaugccugcagguaucacuuug

SEQ ID NO: 106103 - RNA, 64 nt, Human
cuuauauguuuuaaucucccuugucccucagaauaagcagaaaauauaacugcagcuguauguc

SEQ ID NO: 106104 - RNA, 64 nt, Human
ucaugacuuaccauuccagcugcaugggaaagcaaagcagaaaacagugccccaaauggaaaaa

SEQ ID NO: 106105 - RNA, 64 nt, Human
agcacuucgagucgaguguaagggcccuucacaaaagcagaaggaacacuggcccaaaccccca

SEQ ID NO: 106106 - RNA, 64 nt, Human
acaauggugaugauggauuaauuccaccaaggaaaagcagaacaccugaaagccagcaauuucc

SEQ ID NO: 106107 - RNA, 64 nt, Human
caugcuggagccuguguaacagcuccuugggaggaagcagaauaaagcaauuuuccuugaagcc

SEQ ID NO: 106108 - RNA, 64 nt, Human
auaggaccagacaagauaacaggagcucacauggaagcagaagcugugacaaguuuaguagucc

SEQ ID NO: 106109 - RNA, 64 nt, Human
aaagaacaacacuuguuugucuguggggaaagaaaagcagaauacuugagaugaaaguuggcau

SEQ ID NO: 106110 - RNA, 64 nt, Human
auuguacuugcaugaacacaaucauaugaugguaaagcagaaacuuaagaaaaaauuguuuaug

SEQ ID NO: 106111 - RNA, 64 nt, Human
uagaaaaauuagaaaauuuaaaauggaaauaacaaagcagaauuucuucacaaaaugaaaauga

SEQ ID NO: 106112 - RNA, 64 nt, Human
gucucuggccuaugugaaaaccagugaaucccuuaagcagaacaaccgugaugccauggaacuc

SEQ ID NO: 106113 - RNA, 64 nt, Human
guagauaucaccgcaaugcccuagaacagcuaugaagcagaauaccauauggccaccuggacau

SEQ ID NO: 106114 - RNA, 64 nt, Human
gugagaacauuuuugaacaauuuaccugucaauaaagcagaagacggcaguuuuaaaguuccca

SEQ ID NO: 106115 - RNA, 64 nt, Human
ucuugccugguaucauugagcccacacauggaggaagcagaacucaucaguucuuggcguuuca

SEQ ID NO: 106116 - RNA, 64 nt, Human
accacuagacccuuggaccaccauuggaacaaccaagcagaauguacuugauauuauuucaggg

SEQ ID NO: 106117 - RNA, 64 nt, Human
aucuugaaauuuuuuuaauguuugagaacaccauaagcagaauauucuaacaccuuuggccccu

SEQ ID NO: 106118 - RNA, 64 nt, Human
agaaccugaaaacagcaauguauggaaacccucaaagcagaaaagggaggaagauccugaagau

SEQ ID NO: 106119 - RNA, 64 nt, Human
aaggagcaucagccgcuucucaaguggguagggaaagcagaaaaacguacgcaagaggacaugg

SEQ ID NO: 106120 - RNA, 64 nt, Human
caggagacagagauccccuugcaugggaaacauaaagcagaauugggagggacuuuguggagac

SEQ ID NO: 106121 - RNA, 64 nt, Human
ccauggaguucugaucuuugggcauggccaggggaagcagaagggagacucuaggaguugaaau

SEQ ID NO: 106122 - RNA, 64 nt, Human
gcccaucccaucacacaugauccaccguaccaggaagcagaaauauuucuacaaagggggccua

SEQ ID NO: 106123 - RNA, 64 nt, Human
acagggcgguucugggcacuugaacucagggcccaagcagaagcacaggcccaguccuggcugc

SEQ ID NO: 106124 - RNA, 51 nt, Human
augaugggcauugguuuuaauaagcagaaacauuuuguuuuaauggcagcc

SEQ ID NO: 106125 - RNA, 64 nt, Human
uuuauuuuaagaggggaaaacaaaaauaucuugcaagcagaaccuuggaaaaaaaaagccauga

SEQ ID NO: 106126 - RNA, 64 nt, Human
uuuccaucugaagcuaugucuuugacuucacuuuaagcagaaaauuuuguacccugguggucga

SEQ ID NO: 106127 - RNA, 64 nt, Human
auaucacggucuaccuuaaccaaggcacuuucuuaagcagaaaauauuguugagguuaccuuug

SEQ ID NO: 106128 - RNA, 64 nt, Human
ucgcaagucacagaaaaugcaccucauuccagucaagcagaaaaacaggcacaggcucagugua

SEQ ID NO: 106129 - RNA, 64 nt, Human
cacugcucuggccaaugggacugugcaagcacccaagcagaagggagacugagugccucagccu

SEQ ID NO: 106130 - RNA, 64 nt, Human
gccaugguaaacugauacauaaccuaaauuauaaaagcagaaaccuaacucacucgucaaggga

SEQ ID NO: 106131 - RNA, 64 nt, Human
ucuaugaauuuguaaaacaaucaaaaguaggcguaagcagaauaaggcaaaagggaaaguguuc

SEQ ID NO: 106132 - RNA, 64 nt, Human
ucauucucuuuccugaccccuuaggagcgccuggaagcagaaccaguagcuacaggcccaguug

SEQ ID NO: 106133 - RNA, 64 nt, Human
uugugcugggauuuaagaauuagaaaauaaaaauaagcagaaauuaaaaaaaaaaacacuugua

SEQ ID NO: 106134 - RNA, 64 nt, Human
gacuguaugugcugaauuccugggccuccugcagaagcagaaagccugcuggggauggugccag

SEQ ID NO: 106135 - RNA, 64 nt, Human
aaauuauccaaagcaucacugacacccuguguguaagcagaaccuccacucccuccgcugccau

SEQ ID NO: 106136 - RNA, 64 nt, Human
uauugcacugugucaccucuggaucucugcucagaagcagaacaagugaugaccuaaaugucaa

SEQ ID NO: 106137 - RNA, 64 nt, Human
gacaaggggcauuguugcuuguuggguaaaaaugaagcagaagccccaaaguucacauuaacuc

SEQ ID NO: 106138 - RNA, 64 nt, Human
cugggaccauaaguuuacugaaucuucaagaccaaagcagaaaagaaaggcgcuuggcaucaca

SEQ ID NO: 106139 - RNA, 64 nt, Human
caaagcagccugaugacccacccaccaaggaagaaagcagaauaaacauuuuugcacugccuga

SEQ ID NO: 106140 - RNA, 64 nt, Human
gaggggcaccccagccauaucuuacacuuugguaaagcagaaaaccaggaaaauuuucuuaaaa

SEQ ID NO: 106141 - RNA, 64 nt, Human
uagauuauaaauaugcauauacaguguauguauaaagcagaaugccugccuuuccugguuauuu

SEQ ID NO: 106142 - RNA, 64 nt, Human
ccuguccacugcugcugugggauggaggaggcguaagcagaaacacuaacaguauauugaccuc

SEQ ID NO: 106143 - RNA, 64 nt, Human
auaauuggaaacaugagaguauuugagauuggccaagcagaacuaugaaguccaucaaguaagu

SEQ ID NO: 106144 - RNA, 64 nt, Human
cugggcuaggaccucaaccccagggauucccaggaagcagaacucuccagaagaaggguuuuga

SEQ ID NO: 106145 - RNA, 64 nt, Human
agccaaggccagguucuggguguagggcccagagaagcagaacagcccagagccccaggugccu

SEQ ID NO: 106146 - RNA, 64 nt, Human
augucccaaaaugggauuggagaagcuggagagaaagcagaagaggccgaggagugaggcagca

SEQ ID NO: 106147 - RNA, 64 nt, Human
guguggaugaugauaugcuuuugugagcaagcaaaagcagaaacgugaagccgugauacaaauu

SEQ ID NO: 106148 - RNA, 64 nt, Human
agucaguaauuucacaaccguuaucagaguuuggaagcagaaauagcuguuaacuaaaaucucc

SEQ ID NO: 106149 - RNA, 64 nt, Human
ucacacugagugugaguuguguccacacgugcucaagcagaaggacuuuuguguccaugcuugu

SEQ ID NO: 106150 - RNA, 64 nt, Human
ggucccauacuucacagcacucuggugcgggaagaagcagaagcaaaaaaaauaaaaauaaaaa

SEQ ID NO: 106151 - RNA, 64 nt, Human
accuaggaguguuaggaaguuguguuuguguuucaagcagaaaaacugagcuccaagugagcac

SEQ ID NO: 106152 - RNA, 64 nt, Human
agggaacaggguggguuuucucacugaagagagaaagcagaagguucuagauccuggcacagac

SEQ ID NO: 106153 - RNA, 64 nt, Human
cgucaaaacagcgauagacagcauaggagguuugaagcagaaaugaaauguguuauucagagcc

SEQ ID NO: 106154 - RNA, 64 nt, Human
ccccaggucuguugcgguucucccacuuuuccauaagcagaacaagaaccaaaucaaacgucuu

SEQ ID NO: 106155 - RNA, 64 nt, Human
ggacugcauugaaggcgaggcugccccuuggaucaagcagaaaacaagagaaagaaagaacguu

SEQ ID NO: 106156 - RNA, 64 nt, Human
uguuuucagccauguuucucugugcaucuccaguaagcagaaggcuacccauuccauuccucaa

SEQ ID NO: 106157 - RNA, 64 nt, Human
ugagugagcaugcuggagaaugagagaccacaugaagcagaaacaugcuuuccuagcugaaguc

SEQ ID NO: 106158 - RNA, 64 nt, Human
auuugaagagcaguuccuaacuucauagaaacuaaagcagaaaguuguuacauuuuuuuuauga

SEQ ID NO: 106159 - RNA, 64 nt, Human
ucacaacacaggcacacaauuucagucccagccaaagcagaagggguaaugacauggacuuggc

SEQ ID NO: 106160 - RNA, 64 nt, Human
gucuuagaguccagcagaagaccuuagacaaaaaaagcagaacccacuggaguagaaaaggaag

SEQ ID NO: 106161 - RNA, 64 nt, Human
acacacaaaaacagaaacaaaaucaaaacagagaaagcagaaaaucuaccaagaacagagucuc

SEQ ID NO: 106162 - RNA, 64 nt, Human
cugacuucucagccucauuuggacuaaaaaaagaaagcagaaauccaugaacacauugcuucuc

SEQ ID NO: 106163 - RNA, 64 nt, Human
aguuugguauuuuguaauugagagcucauuucaaaagcagaaaaagacaacaaauauuaaagca

SEQ ID NO: 106164 - RNA, 64 nt, Human
cauaacuagguaacaguuugauaacuagggaagaaagcagaacaguuaagcagccgccacaucc

SEQ ID NO: 106165 - RNA, 64 nt, Human
cacgcaccuguaguccccgcuacgcagguggcugaagcagaagaaucacuugaaccugagaggu

SEQ ID NO: 106166 - RNA, 64 nt, Human
uagcccccagaauugucuggcccaaauugaauagaagcagaaaaacauuuagggauaacaucag

SEQ ID NO: 106167 - RNA, 64 nt, Human
ugccuuuggccuugcacaacccauuugugagcaaaagcagaaguggaccaccaucagcucccac

SEQ ID NO: 106168 - RNA, 64 nt, Human
gcuccucccugccucaguggcucuggguaccugcaagcagaacuuccaaagagaguuaaaagca

SEQ ID NO: 106169 - RNA, 64 nt, Human
cugguguucaggguccuugucccuccuuuccccuaagcagaaaacuggcccugcccugccccug

SEQ ID NO: 106170 - RNA, 64 nt, Human
gugagccgccgugcccggcccccuuuucuuuucaaagcagaacuacaaagaugagaaauuacca

SEQ ID NO: 106171 - RNA, 64 nt, Human
ggccgggaagccgaagaguccacaggcccagaggaagcagaagcccccgaguccuuuccggcgg

SEQ ID NO: 106172 - RNA, 64 nt, Human
uucucuucccaggccuuuggaggggaaauggggaaagcagaacugaagccacuuggcccagaaa

SEQ ID NO: 106173 - RNA, 64 nt, Human
cccagaccucuacaaacguuguauguccuuuuuuaagcagaaauaaaaugguugaggauguagu

SEQ ID NO: 106174 - RNA, 64 nt, Human
uaucggguugaauaugaagcuuuguguaaaguagaagcagaacaaaaugaauuuauugaccaau

SEQ ID NO: 106175 - RNA, 64 nt, Human
uuauuaggcugaaacuagccagucacauugagagaagcagaacaaugaucaaaauaaaggagaa

SEQ ID NO: 106176 - RNA, 64 nt, Human
uauugcuucucauaccugcccugcuugacugcugaagcagaaacaaucaggcacgcugacaccc

SEQ ID NO: 106177 - RNA, 64 nt, Human
uccuugucucucaacguauuggcuaugacgcagcaagcagaaugaauuuggacucaguuacagg

SEQ ID NO: 106178 - RNA, 64 nt, Human
auuaaugaaauagguuccagugaugaaaacauucaagcagaacuagguagaaacagagggccaa

SEQ ID NO: 106179 - RNA, 64 nt, Human
ugcugauccccugugugagagaaaagaauggaauaagcagaaacugccaugcucagagaauccu

SEQ ID NO: 106180 - RNA, 64 nt, Human
cccccaccauuccacauccccaccuuccaaggaaaagcagaaguucaugggcaccucauggacu

SEQ ID NO: 106181 - RNA, 64 nt, Human
ugggaccagggccucgcagcagcaaggugggggcaagcagaaugccucccaggauuucacaccu

SEQ ID NO: 106182 - RNA, 64 nt, Human
ucagcccacccccaaccccaccguuuggggugagaagcagaaucugugcuuccccagucuccuu

SEQ ID NO: 106183 - RNA, 64 nt, Human
ccccaccccccauggaacagaaagccauguuuuuaagcagaaccagcgaaacccaagccccucc

SEQ ID NO: 106184 - RNA, 64 nt, Human
uggguucggaggagagucaggaagggccacgacaaagcagaaacaucggauuuggggaacgcgu

SEQ ID NO: 106185 - RNA, 64 nt, Human
uuucuuuucccucauuuguuaugagucaauaaagaagcagaagguuuggacgugcuagccagug

SEQ ID NO: 106186 - RNA, 64 nt, Human
gaucugugauacgaaccauagauauugccugacaaagcagaaaucaccaaguuucccccuuuug

SEQ ID NO: 106187 - RNA, 64 nt, Human
auuuucaucauuuguuugacaucagaagaggaaaaagcagaaagagaaauggcaccaaacuccu

SEQ ID NO: 106188 - RNA, 64 nt, Human
ucgguaaggguaaaggagcagaggcaaaggagaaaagcagaaguugcagcugaugcagguaucc

SEQ ID NO: 106189 - RNA, 64 nt, Human
gcuggcaggcggcagggcuggcacagacagacggaagcagaaaggacaguuuggcugcuguguc

SEQ ID NO: 106190 - RNA, 64 nt, Human
gagguaaccgugacuacugcucacaaacgucgcaaagcagaaacugaaaacugguagguacacu

SEQ ID NO: 106191 - RNA, 64 nt, Human
acauaguuuuugacuugaauuaaaauacuagacaaagcagaaauguacaauuucuggucugugu

SEQ ID NO: 106192 - RNA, 64 nt, Human
aggcucuggccuuggauacagagaugccaauugaaagcagaaaguucuacucucguaucuguuu

SEQ ID NO: 106193 - RNA, 64 nt, Human
ucuccugaaucuuuuuaaguuugugucguuccuuaagcagaacuaagcucaguaugugaccuua

SEQ ID NO: 106194 - RNA, 64 nt, Human
ccauuaggccauuuacauacccagaguuauacucaagcagaaugcacaaauggacaugucauaa

SEQ ID NO: 106195 - RNA, 64 nt, Human
aacuugaauagcacaucaauagguuacuggacaaaagcagaaaaaccuguuacaggauagccug

SEQ ID NO: 106196 - RNA, 55 nt, Human
guccugggaccgaguccugaacuucaagcagaauccucaguuggaaucauugcua

SEQ ID NO: 106197 - RNA, 64 nt, Human
gaaacaaaacagaaggggcgucauaaauuugaauaagcagaacauacuguucucaacauacugu

SEQ ID NO: 106198 - RNA, 64 nt, Human
ugucaauuucacuaaacaaaagcuauuagaaguaaagcagaaaccuaucacugcaaggagugac

SEQ ID NO: 106199 - RNA, 64 nt, Human
cuuuuaaaaaaaauuacaaaccaagaauuuuuuaaagcagaagaugcuauuuguggggguuuuu

SEQ ID NO: 106200 - RNA, 64 nt, Human
uaugaucggcaggacacccugauaggaagaggggaagcagaaauccaagcaccaccaaacacag

SEQ ID NO: 106201 - RNA, 64 nt, Human
aggaauuacaauugcaugcagguagcaagcaagaaagcagaaacuacuguucccuuuauuuuaa

SEQ ID NO: 106202 - RNA, 64 nt, Human
gaaggggucucgguggagcugugcaccagcagccaagcagaaagaaacacgcgacauggacucu

SEQ ID NO: 106203 - RNA, 64 nt, Human
uucgguuggcuaaacagggucagagcugagagcgaagcagaaggggcucccuguccggcccacg

SEQ ID NO: 106204 - RNA, 64 nt, Human
aaaagugcaguaauucucuuucuccauaguauuuaagcagaaauauugcuaguuuaauauugug

SEQ ID NO: 106205 - RNA, 64 nt, Human
cacccugggacugcggccuuucccagcuuuauugaagcagaaugguggaacuugugccggaggu

SEQ ID NO: 106206 - RNA, 64 nt, Human
cgugcgccuguagucccagcuacucgggaggcugaagcagaagaaucgcuugaacccgggaggc

SEQ ID NO: 106207 - RNA, 64 nt, Human
caugagcuugcuguuguacacaggguauuucuagaagcagaaauagacugggaagaugcacaac

SEQ ID NO: 106208 - RNA, 64 nt, Human
uuauuuuagugagggcaauuacagagaaaagaguaagcagaaauguccuucugaguacuggccu

SEQ ID NO: 106209 - RNA, 64 nt, Human
acaaaggacuguagcaagggcuaugggaguucugaagcagaaaccaugggcuaaaaccaacaua

SEQ ID NO: 106210 - RNA, 64 nt, Human
uuggguguucuauucauugcauagaaugacuuguaagcagaauagugaugucagcaugaagggg

SEQ ID NO: 106211 - RNA, 64 nt, Human
cagccccaggccgggaaggagccagcggccgacaaagcagaaacacccgcugcuccacguagcc

SEQ ID NO: 106212 - RNA, 64 nt, Human
aaaaaaaacuuaaaaauuaaaaacacaaagagcaaagcagaacuuauaaaauuauauauauaua

SEQ ID NO: 106213 - RNA, 64 nt, Human
acacagccagagcccacggagggcccuucccgcaaagcagaagccgccagggcaggggccgggg

SEQ ID NO: 106214 - RNA, 64 nt, Human
ugcucugagugaggugggagccauagaagcuucuaagcagaagagggacuugcccuaauucagg

SEQ ID NO: 106215 - RNA, 64 nt, Human
ugguggaaugcgggggagcaggcaguggggcuggaagcagaaacaaaaugaaaaaaaaaggggg

SEQ ID NO: 106216 - RNA, 64 nt, Human
ggcagcggcgacagccuucccugagaggacuuaaaagcagaaggaaaccgagaugcuucccgca

SEQ ID NO: 106217 - RNA, 64 nt, Human
gauggggaauaucagagucagcugcugcuugaggaagcagaacacacagcuggaggcuuggaac

SEQ ID NO: 106218 - RNA, 64 nt, Human
aagaugccuuccuuugggcuggcucgagggaaggaagcagaaguucaaggugaucgugccagcc

SEQ ID NO: 106219 - RNA, 64 nt, Human
cacuccguuugaaguaucaccuucucauaacuaaaagcagaaaagcuaacaaaagcuucucagc

SEQ ID NO: 106220 - RNA, 64 nt, Human
ccucuugggaagcuguguggaaauaagcacagagaagcagaacucuaauugcuuaauccacuaa

SEQ ID NO: 106221 - RNA, 64 nt, Human
cucaugaaaauuaugacuuuuuuguuugguuggaaagcagaauuaugcauaaauuuccucuuac

SEQ ID NO: 106222 - RNA, 64 nt, Human
aggaacauuugaucuagcagcagggaugagaggaaagcagaaaugaaugaacugugaaagcucc

SEQ ID NO: 106223 - RNA, 64 nt, Human
gcaggcaacuuuauucuauaaacacaacuuuauuaagcagaauacacuguagaugcuuuucccc

SEQ ID NO: 106224 - RNA, 64 nt, Human
auuuugguccaaauucuuuauucuuccuugagcuaagcagaauaauggaauauaauaugucuuc

SEQ ID NO: 106225 - RNA, 64 nt, Human
uuuuuaagggcccaggaucguuuuuucccagggcaagcagaagagaaaauguuguauaugucuu

SEQ ID NO: 106226 - RNA, 64 nt, Human
aagguagucaauuucaugucuuguucaacgauguaagcagaaacugaauugcccuaauuuugcc

SEQ ID NO: 106227 - RNA, 64 nt, Human
cccucuugggccucaguuucccgacuugcaaaauaagcagaaagaaccagaugcucuccagggu

SEQ ID NO: 106228 - RNA, 64 nt, Human
uuguaauuguguaaaaaauggaaaaaaacauaaaaagcagaauuuuaaugugaagacauuuuuu

SEQ ID NO: 106229 - RNA, 64 nt, Human
agcucugagaacagucuccuucaacaguucggccaagcagaacugcuguaccucugaccacuug

SEQ ID NO: 106230 - RNA, 64 nt, Human
auggugaacuaauuuagagcauccuccagagcugaagcagaacauuccagaacccguuguggaa

SEQ ID NO: 106231 - RNA, 64 nt, Human
gcaccuaacggccugcccuguuagcuuuccaaggaagcagaagacgggaggggaggcauugaca

SEQ ID NO: 106232 - RNA, 64 nt, Human
uaacuaacauuuuguucaguuuugccuccaguggaagcagaaaggguuuuuucagcuguuaaau

SEQ ID NO: 106233 - RNA, 64 nt, Human
ccuuuucaaccuaaccagccacagccaagggcccaagcagaaguacacccacaagcaaggccuu

SEQ ID NO: 106234 - RNA, 64 nt, Human
gaacaggaggacggggcucucccccacaguggggaagcagaacggggagaccugcccccccuug

SEQ ID NO: 106235 - RNA, 64 nt, Human
ugucugccuucaaggguuaaucccucuuuguuccaagcagaagcauucuggcaucccagugaag

SEQ ID NO: 106236 - RNA, 64 nt, Human
guccacaucuggcuuuugugggacucagaaagggaagcagaacugagggcugggauauuccuca

SEQ ID NO: 106237 - RNA, 64 nt, Human
auaaugguagaagauggcauacugauuauaaaagaagcagaaaaacauugauuuuuuuauaucu

SEQ ID NO: 106238 - RNA, 64 nt, Human
ugugcaccuauagucccagcuacucgggaggcugaagcagaaggaucacuugagucugagaauu

SEQ ID NO: 106239 - RNA, 64 nt, Human
uugcaccaacagguccagaguaugagugcaagcaaagcagaacucucaugcgugaccugagcag

SEQ ID NO: 106240 - RNA, 64 nt, Human
aaaggcacucgauuaaugugacaaccuuuucaauaagcagaaauaacguagguacacaucacuc

SEQ ID NO: 106241 - RNA, 64 nt, Human
ugcaguagagaaagaguuuaacacagagcuagccaagcagaaaggcuggaguuauuauucaacu

SEQ ID NO: 106242 - RNA, 64 nt, Human
guauugguacaucuuggcuucuggcccaaaccccaagcagaaaagaaaauggaauaauggagca

SEQ ID NO: 106243 - RNA, 64 nt, Human
cugaauuucugcuguggauaucaaggaaauaauaaagcagaaaccccaagaaauuugcaacuua

SEQ ID NO: 106244 - RNA, 64 nt, Human
ucuguugacggaugcugacuuuggagaggcagcuaagcagaagucccugacggucacucacacg

SEQ ID NO: 106245 - RNA, 64 nt, Human
uauuguaucgagccuuuucuguguuuuaaugagaaagcagaacacuaguuuccuauuuaagacu

SEQ ID NO: 106246 - RNA, 64 nt, Human
ccugcaggaagcacgcgaggcggagcgaagagccaagcagaagcuccuggagauugccaccaag

SEQ ID NO: 106247 - RNA, 64 nt, Human
guccgggcuuccuguggauuggcggaauguuuagaagcagaacaagccauuccuauuaccuccc

SEQ ID NO: 106248 - RNA, 64 nt, Human
cguuugucaaaagguggugcuggcccaccucugaaagcagaacacuugcucaacaaccuugcug

SEQ ID NO: 106249 - RNA, 64 nt, Human
guggugggggcagccucugccucaaaaauucaccaagcagaaugccucucagccucauguguug

SEQ ID NO: 106250 - RNA, 64 nt, Human
guaaguauaauauuagcuuauuugacuagaacucaagcagaauaggaauuuaugcuuguuuuau

SEQ ID NO: 106251 - RNA, 64 nt, Human
aaggacaccuccauccauuccacgcaguugcucaaagcagaaauuuucagugcaagucuugaug

SEQ ID NO: 106252 - RNA, 64 nt, Human
ucaggauggcgccuucagccucuccggcaaagcaaagcagaagcugcugaagcacggggugaac

SEQ ID NO: 106253 - RNA, 64 nt, Human
ccaaaguguaucuggugcugaaugacugggggacaagcagaaguggaagagaucuuucugcaac

SEQ ID NO: 106254 - RNA, 64 nt, Human
cuauugcaaauagaaaacccaacucaaccugcuuaagcagaaaauaaauuuauugauucaaguu

SEQ ID NO: 106255 - RNA, 64 nt, Human
aauuaagccaaauuuuaaaucauuugacuuugacaagcagaaauuacuuuuaaaaaauguauuu

SEQ ID NO: 106256 - RNA, 64 nt, Human
gacugguggaagaauuccccaccagaucuccuugaagcagaaguagggaucagcaucauuaaca

SEQ ID NO: 106257 - RNA, 64 nt, Human
cuucuacagaacguuuguagagauauuggccuugaagcagaaaauucauuuuaaagccaaucag

SEQ ID NO: 106258 - RNA, 64 nt, Human
cagccucagggauacgacacaugcccaugaugagaagcagaacguggugaccuuucacgaacgu

SEQ ID NO: 106259 - RNA, 64 nt, Human
cagccugggggauacgacacaugcccuugaugagaagcagaacguggugaccuuucacgaacau

SEQ ID NO: 106260 - RNA, 64 nt, Human
cagccugggggauaugacacaugcccaugaugagaagcagaacauggugaccuuucacgaacau

SEQ ID NO: 106261 - RNA, 64 nt, Human
cagccucagggauacgacacaugcccaugaugagaagcagaacguggugaccuuucacgaacau

SEQ ID NO: 106262 - RNA, 64 nt, Human
uaaccccacacucaaaggggcaugggugguggagaagcagaaggagcaaucaagcuuaucugga

SEQ ID NO: 106263 - RNA, 64 nt, Human
acaggacaguugauggagccccaggguuuacaugaagcagaaccuucuuugguuccauguugac

SEQ ID NO: 106264 - RNA, 64 nt, Human
aaaauccaucagagccauuguuuucauaaaaaccaagcagaagugaagagaaaagaggaggacu

SEQ ID NO: 106265 - RNA, 64 nt, Human
cuugaaagaggcacgcauuuuugacagguugcugaagcagaagauuguuauaauacagcucucc

SEQ ID NO: 106266 - RNA, 64 nt, Human
agaagggauaaucauuaagauaguaaaacaggcaaagcagaaucacaugugcacacacacauac

SEQ ID NO: 106267 - RNA, 64 nt, Human
ggucuguugaagugcauguuaaaauaauuauaugaagcagaaugagaugauuuaauucuuaccg

SEQ ID NO: 106268 - RNA, 64 nt, Human
uaaauauuguaauuguggagaaaaguaaacuuauaagcagaacuuuuacaauuuuuucaucuaa

SEQ ID NO: 106269 - RNA, 64 nt, Human
uaaggaaauuaagauuuuaagcuugaaauuauacaagcagaaucuaauuuaauuuugauugacu

SEQ ID NO: 106270 - RNA, 64 nt, Human
ggaugaagaccuagacuuaccugaaggaucuucaaagcagaaugaagaccuaggcuuaccugaa

SEQ ID NO: 106271 - RNA, 64 nt, Human
ugccauuuagaggaaacuugugaauucuuucauaaagcagaaaaccauuuuauaauacaaauaa

SEQ ID NO: 106272 - RNA, 64 nt, Human
uuuuguaaacuuugaaauauauggucuaauguuuaagcagaauuggaaaagacuaagaucgguu

SEQ ID NO: 106273 - RNA, 64 nt, Human
uggggugccugggccucagauggggaccccaaagaagcagaagcugaagaagguacggcugggg

SEQ ID NO: 106274 - RNA, 64 nt, Human
ugugguacuugcugagagaaaagaaaagugagccaagcagaaggaggugggaaaacggacccaa

SEQ ID NO: 106275 - RNA, 64 nt, Human
caaauuauauuugcugucagcaugauagaauaagaagcagaaaccccccagcagugggguaaga

SEQ ID NO: 106276 - RNA, 64 nt, Human
aacccuuccuucgauaccaaacacuaacaagaggaagcagaauaugagaagccauauuuuuaca

SEQ ID NO: 106277 - RNA, 64 nt, Human
aggaggauguauucagccuuuaggaugaucagaaaagcagaaagagagaguggccggauggggc

SEQ ID NO: 106278 - RNA, 64 nt, Human
caucucagucauaacccaaaagcuacgggagaaaaagcagaaguguaaucucuguaucugacaa

SEQ ID NO: 106279 - RNA, 64 nt, Human
cagccucggggauaugacacaugcccaugaugagaagcagaacguggugaccuuucacgaacau

SEQ ID NO: 106280 - RNA, 64 nt, Human
cagccucggggauacgacacaugcccaugaugagaagcagaauguggugaccuuucacgaacgu

SEQ ID NO: 106281 - RNA, 64 nt, Human
cagccuuggggauaugacacaugcccaugaugagaagcagaacguggugaccuuucacgaacau

SEQ ID NO: 106282 - RNA, 64 nt, Human; identical to SEQ ID NO: 106279

SEQ ID NO: 106283 - RNA, 64 nt, Human
cagccucggggauacgacauaugcccaugaugagaagcagaacguggugaccuuucacgaacau

SEQ ID NO: 106284 - RNA, 64 nt, Human
ggccuuugcacuuccagacgacaggucaucguucaagcagaaugcagacaggccauucacgagc

SEQ ID NO: 106285 - RNA, 64 nt, Human
aagagacuggugacauccacaaaugcaguuuuagaagcagaaaaggucuuggugccucugcagu

SEQ ID NO: 106286 - RNA, 64 nt, Human
agcagcuugaccugguauucuaccugaguagaugaagcagaagaucagcaaguuuggcagaguu

SEQ ID NO: 106287 - RNA, 64 nt, Human
uuuuuuuguuguuuuggacuacauauuugcacugaagcagaauuguuuuauuaaaaaaaucaua

SEQ ID NO: 106288 - RNA, 64 nt, Human
acacaugaagaaaauuuaccaaaaaaaaaaaaaaaagcagaagaauaauguaguuuagaaauua

SEQ ID NO: 106289 - RNA, 64 nt, Human
acuaguaacuaccauccauccuauuugaauuaucaagcagaacaugaccauaaaauuugguaac

SEQ ID NO: 106290 - RNA, 64 nt, Human
gugugucuacaagcuuguaaagauguuggccuugaagcagaaaauucauuuuuuaaagccaguc

SEQ ID NO: 106291 - RNA, 64 nt, Human
cucacuuuuauaauccuaggauuuggggaagcugaagcagaaagauugcuugagccugggaguu

SEQ ID NO: 106292 - RNA, 64 nt, Human
uugcauuuaugauuuaucuagaaauuuaccucaaaagcagaauuuuuaaaacugcauuuuuaau

SEQ ID NO: 106293 - RNA, 64 nt, Human; identical to SEQ ID NO: 106292

SEQ ID NO: 106294 - RNA, 64 nt, Human
agggaguaccgaccuaucccaguugugugaggcugcgagagaaagggagugcaugugcgcgcgu

SEQ ID NO: 106295 - RNA, 64 nt, Human
acaagagcugccaaccucacagaguguuugcuaggcgagagaggugcagggaagaggcagaggu

SEQ ID NO: 106296 - RNA, 64 nt, Human
aucucuccuuucaguccuggacgcacaauauccagcgagagaaagaguuucugcggaagcuggu

SEQ ID NO: 106297 - RNA, 64 nt, Human
aguagaugggaccucgaggcucgagcugaagcaggcgagagagaaacagcuacugcgugcgugc

SEQ ID NO: 106298 - RNA, 64 nt, Human
ggaaaggccucaagcucacauuuguagagagagagcgagagaaaucagaguucccuuuauugcc

SEQ ID NO: 106299 - RNA, 64 nt, Human
gcaaaggcaggcacuucacacaguaaaagcaggagcgagagagaggugccacacugaaacagcc

SEQ ID NO: 106300 - RNA, 64 nt, Human
ccucccggagguggacccccuucccagcaccucugcgagagauccggggaccugugggcagcug

SEQ ID NO: 106301 - RNA, 64 nt, Human
cccgauaccaugcuguaaggauccggaaagaagagcgagagaucaaagaugaaaaguauauuga

SEQ ID NO: 106302 - RNA, 64 nt, Human
ugaggucccaaaugacccagggcuuaagggagaggcgagagaaugaucuggccucaggggacag

SEQ ID NO: 106303 - RNA, 64 nt, Human
cugcuccaaggagggagggagcgcagggaaaagagcgagagagacagaaagagagccucagaau

SEQ ID NO: 106304 - RNA, 64 nt, Human
ucaugcucagcugaugguuauguuucugccuucggcgagagaacagcaagcuccagaaaguggc

SEQ ID NO: 106305 - RNA, 64 nt, Human
guaugguuaauaaguuucacugacuuagaaccaggcgagagacuuguggccugggagagcuggg

SEQ ID NO: 106306 - RNA, 64 nt, Human
guccccacgccgggaaccaagcaggagacgacaggcgagagaggagccagacagacccugaaaa

SEQ ID NO: 106307 - RNA, 64 nt, Human
gcaaucgagaugagacgccaugcagaucccggcugcgagagagggagacacccggaggagcagg

SEQ ID NO: 106308 - RNA, 64 nt, Human
gaaguuggaauagauuugacuguauuaaauguuggcgagagacucucuuugauacauuaaaaaa

SEQ ID NO: 106309 - RNA, 64 nt, Human
acugcaacagacucuaccagagaugcaaagagaagcgagagaggcaccuuguucuccaagaacu

SEQ ID NO: 106310 - RNA, 64 nt, Human
cacaucucuagucccaauuacucaggaggcugaggcgagagaaucgcuugagccugggacauug

SEQ ID NO: 106311 - RNA, 64 nt, Human
cuggaaaaccaggaacaauugacucccggggugggcgagagacaggagggcucccugaucugcc

SEQ ID NO: 106312 - RNA, 64 nt, Human
ugugcggcccgggggcucccugugcccgcgugaggcgagagaacaggggacuugagucucgaac

SEQ ID NO: 106313 - RNA, 64 nt, Human
caucucaaccaggauccugauguaugaggaaaaagcgagagaaaaggaaaagccaacaggcccc

SEQ ID NO: 106314 - RNA, 64 nt, Human
gcgaccccucagugcucggcagucauacuggggugcgagagaggugggcagcagcucagccucc

SEQ ID NO: 106315 - RNA, 64 nt, Human
acaaaaguuguguaagagaugagauaacaaaggagcgagagaaaucucaugugaauuuccaagu

SEQ ID NO: 106316 - RNA, 64 nt, Human
caaggccaaaaacaaauggguuuaacugaccagagcgagagaacucugcacuaugaacccaaac

SEQ ID NO: 106317 - RNA, 64 nt, Human
agcaaacaaaaagucaauuuugcuuuccaccagugcgagagaggauguauacuuuucaagagag

SEQ ID NO: 106318 - RNA, 64 nt, Human
cuagagacaauggagagagaaagagagagagagcgcgagagagaucaagacccaaguuuugaau

SEQ ID NO: 106319 - RNA, 64 nt, Human
ccauugagcccaggaguccagccugggcaaaauagcgagagacccugaaucugaaaguaaugau

SEQ ID NO: 106320 - RNA, 64 nt, Human
aagacgcggggagugagcugggugggcccugcuagcgagagaggucaaccccgguggccaggga

SEQ ID NO: 106321 - RNA, 64 nt, Human
gcauguaugugucugccucuaggaugagcucagagcgagagaugacacaaugccucacucaggc

SEQ ID NO: 106322 - RNA, 64 nt, Human
ugagggggaaauaaaacccagagagagagagagagcgagagagagagacauguuacuaugaaag

SEQ ID NO: 106323 - RNA, 64 nt, Human
uggaaaguugacaugggugggguguccccauccagcgagagaguuucaaaagcaaaacaucucu

SEQ ID NO: 106324 - RNA, 64 nt, Human
agaagcuacagccuggacuuaccaccacuaaacugcgagagaagcuaaacguguuuauuuuccc

SEQ ID NO: 106325 - RNA, 64 nt, Human
cacagggaaggaggcuuggaauuaggaugggaucgcgagagagaugaaacuuggaaaauucagc

SEQ ID NO: 106326 - RNA, 64 nt, Human
gagcugaagacagaaaaccaguuucacgccaggugcgagagagagcauaauggagggaagcccg

SEQ ID NO: 106327 - RNA, 64 nt, Human
cagcccacggaagggcucuuucacagcuggcagagcgagagaauaugucacauuucugacaguu

SEQ ID NO: 106328 - RNA, 64 nt, Human
gaagagugacugcuaagucccuuugcuccugcccgcgagagacugucgggaaguugacccggau

SEQ ID NO: 106329 - RNA, 64 nt, Human
ucuagcaagaaucuuagucaggaguaagcucugugcgagagaucugugaauaaccagauaaccc

SEQ ID NO: 106330 - RNA, 64 nt, Human
cuucccgagggucagugccccagugaagacagaagcgagagaauaaaguucccuguagguccuc

SEQ ID NO: 106331 - RNA, 64 nt, Human
cacagaggcugaccugugucagggagaggaggcggcgagagaggacugccuucagggcauccgg

SEQ ID NO: 106332 - RNA, 64 nt, Human
ccgcauaugugagaggcagagagggcgaguggcugcgagagagaaugagccucccgccagacag

SEQ ID NO: 106333 - RNA, 64 nt, Human
ucgcguggagggcugucguuugaacucucccagcgcgagagacccugccccgcccccuuccugg

SEQ ID NO: 106334 - RNA, 64 nt, Human
uggaauguaagaagaugaaggugacugggauucagcgagagagaggucccucagaccugggacc

SEQ ID NO: 106335 - RNA, 64 nt, Human
gguguacagguggguuugggagagaggagcaugcgcgagagagucuccgagugugugcgacgcg

SEQ ID NO: 106336 - RNA, 64 nt, Human
cccagcaaaagaucuaacauucuugcucaaaguugcgagagaaaguagcacauggaguagcuga

SEQ ID NO: 106337 - RNA, 64 nt, Human
gagagaggcugggaaaaguguggacguggccagagcgagagaguagcggaggaaaggagcaauc

SEQ ID NO: 106338 - RNA, 64 nt, Human
ugacgaguguggcagagagugugcaugugagaaagcgagagaaagaggaacugaaggacgcggu

SEQ ID NO: 106339 - RNA, 64 nt, Human
ggacaucagaagaggaaaaaaacucaaaacaaaagcgagagagacuauugccauaugaacucaa

SEQ ID NO: 106340 - RNA, 64 nt, Human
aaaaaaaaacugaaacacaaccaaaaaagcaagagcgagagagaguacgugcacacgcgcacaa

SEQ ID NO: 106341 - RNA, 64 nt, Human
ugcgccuguaaucccagcuacucaggaagcugaggcgagagaaucgcuugaacccgggaggcaa

SEQ ID NO: 106342 - RNA, 64 nt, Human
ccaucucuaagaugucagauguagaggagagagagcgagagaacaucuuccuucucuaccauca

SEQ ID NO: 106343 - RNA, 64 nt, Human
ccccagagugucaucauuggagagagcagugacugcgagagaugguggaggccgcuaagcaugg

SEQ ID NO: 106344 - RNA, 64 nt, Human
uugugguuaugaaaccgucuguggccucaugacagcgagagaugggaauacacuagaaggaucu

SEQ ID NO: 106345 - RNA, 58 nt, Human
ugaagagcaagguagagugaagccaauggcgagagaucagguccgaaaugcugcauug

SEQ ID NO: 106346 - RNA, 64 nt, Human
cugggccccccgaucagaccucaaggacaggccagcgagagauggagcuaccguguccaggaug

SEQ ID NO: 106347 - RNA, 64 nt, Human
aauaaggggaaggaagagagagggagcaggcggagcgagagagggagaaacaggcgcggggucu

SEQ ID NO: 106348 - RNA, 64 nt, Human
cgguccuggucgcagagcacagaucuuuaaagaagcgagagaggaggccccacccuccuggcag

SEQ ID NO: 106349 - RNA, 64 nt, Human
cggggcgggcuccccucucgccaacccgccaaccgcgagagacccaggcuggcccccaggguga

SEQ ID NO: 106350 - RNA, 64 nt, Human
caaaaaaaaaaaaaaaaagcgagcgagagagagagcgagagagagagcgagagcagaagaaauu

SEQ ID NO: 106351 - RNA, 64 nt, Human
aaguugaaaagacaaaaaaaaaaaaaaaaagcgagcgagagagagagcgagagagagagcgaga

SEQ ID NO: 106352 - RNA, 64 nt, Human
gaugccuuggcagugccagccacgggaaccaggagcgagagacggugccagaacgccggggccc

SEQ ID NO: 106353 - RNA, 64 nt, Human
auuuuguucuguuugggggcuucuguuuuguuuggcgagagagcgauggcugccguggggagua

SEQ ID NO: 106354 - RNA, 64 nt, Human
cgugaugggcagccugcuggucagcacuccaguagcgagagacggcacccagaaucagauccca

SEQ ID NO: 106355 - RNA, 64 nt, Human
aggugaagaacugaaguucagcgcugucaggauugcgagagauguguguugauacuguugcacg

SEQ ID NO: 106356 - RNA, 64 nt, Human
auauauuauauauuauauagagagagggaggagagcgagagagagugaggacaccgaacugggc

SEQ ID NO: 106357 - RNA, 64 nt, Human
agagaccagugcagggcuguuaacaggguugcaggcgagagacuggggugcugggcuccccuag

SEQ ID NO: 106358 - RNA, 64 nt, Human
caaggccacggcucuacuaaaagagagagaggaagcgagagagagagagaaaaaacaaaaaaca

SEQ ID NO: 106359 - RNA, 64 nt, Human
guguuugugaagucacauaaucuacggggcuagggcgagagaggccagggauuuguucacagau

SEQ ID NO: 106360 - RNA, 64 nt, Human
cccagaagcucacaaaggaaaacggagagagcgagcgagagagauuuccuuggaaauuucuccc

SEQ ID NO: 106361 - RNA, 64 nt, Human
uaaaguccuguuuauugagacccuuuaaaugccugcgagagacccuacagacaguaugucuacu

SEQ ID NO: 106362 - RNA, 64 nt, Human
gugugaacauccccuauugagacccacugcuuuagcgagagaggguuuacuuaggaagaauugg

SEQ ID NO: 106363 - RNA, 64 nt, Human
gugugugugugugugugugugugacagagagagagcgagagagccugugugugugcaugcaggg

SEQ ID NO: 106364 - RNA, 64 nt, Human
aucaggaauaucugaagacauuggcuucuccacugcgagagauugauccagaccaacccaaaag

SEQ ID NO: 106365 - RNA, 59 nt, Human
ugaauggcucuuuucacagagaguagccaaccagagaccuuugcuuugauaucaucaac

SEQ ID NO: 106366 - RNA, 59 nt, Human
auccuggauauguacuaacgaauauuaccaccagagaagagagcuuucuacaaaaguca

SEQ ID NO: 106367 - RNA, 59 nt, Human
cuugaacccaggaggugaagguugcagugaccagagaugacgccauugcacuccagccu

SEQ ID NO: 106368 - RNA, 59 nt, Human
uguuaaguacugaaucaugugugacugagaccagagauggcaaaugaauggcacaccau

SEQ ID NO: 106369 - RNA, 59 nt, Human
caggguauugcuugccacuaagccaugaaaccagagacaaaaucucuauacugcccuga

SEQ ID NO: 106370 - RNA, 59 nt, Human
cucacccugcggaucccagccuaaaagacaccagagaccucagcuauggagcccuucgg

SEQ ID NO: 106371 - RNA, 59 nt, Human
guguuuuagaggaauccuaaagucaaaacaccagagacuugaagaacuugcaaacuggc

SEQ ID NO: 106372 - RNA, 59 nt, Human
uuucccuuuuuaggucccugucuuauacaaccagagaaguggguguuggccaggcacau

SEQ ID NO: 106373 - RNA, 59 nt, Human
gagcugcagagaggaaaggucucccauguaccagagaaggaaaagucugaucccgaaac

SEQ ID NO: 106374 - RNA, 59 nt, Human
caaguucugagaauuguucacacuuucuaaccagagacagaauucagagcucuuuuuga

SEQ ID NO: 106375 - RNA, 59 nt, Human
uuauaugugauguuuuuccccauuaaaauaccagagauaauggagauauuuugcacuuu

SEQ ID NO: 106376 - RNA, 59 nt, Human
cuauuaggccaucaauggcuugaauaaaaaccagagaagguuuuucccaggacgucuca

SEQ ID NO: 106377 - RNA, 59 nt, Human
ccucuuccuugucaugucugaagcuguggaccagagaccuggacuuuugucugcuuaag

SEQ ID NO: 106378 - RNA, 59 nt, Human
gcugaaucccaaauuugaguuugggaagaaccagagagaaauggaucccugagcucuga

SEQ ID NO: 106379 - RNA, 59 nt, Human
aaucacuaaugagaaggcuaaccugcagcaccagagaaaccuuuccaagugcuaggcag

SEQ ID NO: 106380 - RNA, 59 nt, Human
uauuccuuuguguucaacaguuaaucaaaaccagagagucuagggcagccucucugaug

SEQ ID NO: 106381 - RNA, 59 nt, Human
cccucugucaguccugggggugacugggaaccagagagguugagcagaauuccuggacc

SEQ ID NO: 106382 - RNA, 59 nt, Human
cgucagccagcacugcacagacagcugcgaccagagacuggaggugacccuugcccuuu

SEQ ID NO: 106383 - RNA, 59 nt, Human
ugcugcuuuuuuugccacucugauacuaaaccagagaaagcugcagguggauaaagaag

SEQ ID NO: 106384 - RNA, 59 nt, Human
ccaaccugucacaacggccagaaccauacaccagagacacacuggcagguuaggcaguc

SEQ ID NO: 106385 - RNA, 59 nt, Human
cauucugcucuuuuccccucucccuccauaccagagauguggugagcucuguucuucua

SEQ ID NO: 106386 - RNA, 59 nt, Human
aucucaucagagaugaauaauaucuuuuuaccagagagagaacgaauguuagccacaug

SEQ ID NO: 106387 - RNA, 59 nt, Human
gcuggaauucuugaugagcaauaaugauaaccagagagugauuucauuuacacucauag

SEQ ID NO: 106388 - RNA, 59 nt, Human
gaauaacuaccuccucacuuggcugucugaccagagaaugcaccucuuguuacucccug

SEQ ID NO: 106389 - RNA, 59 nt, Human
ugugagguaacugggaucgcaccuuuuauaccagagaccugaggcagaugaaauuuauu

SEQ ID NO: 106390 - RNA, 59 nt, Human
ugguuucugguucagagugcucucccaccaccagagacaaguggguaaaaaggucaguc

SEQ ID NO: 106391 - RNA, 51 nt, Human
ugacacuuccagagagcugacaccagagaccaacaaagggacuuucugaag

SEQ ID NO: 106392 - RNA, 59 nt, Human
uggcuuuuugggagguggggcaugggaggaccagagacgaagggcuuggaaggagaccc

SEQ ID NO: 106393 - RNA, 59 nt, Human
uggaaaacaguuuuuauucuguuuuauaaaccagagagaaaugaguuuugacgucuuuu

SEQ ID NO: 106394 - RNA, 59 nt, Human
agugggcgucguccauccucagugagaacaccagagaacccggggccgggagaaggugg

SEQ ID NO: 106395 - RNA, 59 nt, Human
auagucacaauacuuuuugugaaucuacaaccagagacaggcaaaaacuuguaaaguaa

SEQ ID NO: 106396 - RNA, 59 nt, Human
uuguuuuguuagaugcaguaaugauguuuaccagagauuauuguuuccuaugcaaaaua

SEQ ID NO: 106397 - RNA, 59 nt, Human
agaauacugaggccuggacaggugaagugaccagagagcaaaaggcaaagggguggggg

SEQ ID NO: 106398 - RNA, 59 nt, Human
ccuugaggcaugcccucugagggagggagaccagagaugcagggauuggccagcugggu

SEQ ID NO: 106399 - RNA, 59 nt, Human
auaacauguuuuaagauaauuaaguuuaaaccagagaauuugauuguuacucauuuugc

SEQ ID NO: 106400 - RNA, 59 nt, Human
gcuuuuaaaaauacugagacccccccauaaccagagauucagauucaaagacugaggau

SEQ ID NO: 106401 - RNA, 59 nt, Human
gugaugagaaggauucuuuuucgaauauaaccagagaaaaaaaggauggagaaauaucu

SEQ ID NO: 106402 - RNA, 59 nt, Human
gaggagucagcagucuuguucuguaaaggaccagagaugguaaauacugucccacucag

SEQ ID NO: 106403 - RNA, 59 nt, Human
aaauucuuugguuucuauggaguacaccuaccagagacuaccaguguaaagugauaaau

SEQ ID NO: 106404 - RNA, 59 nt, Human
acauagaaacgacaaaucaccauguaacaaccagagaugacugaaaccacucugaaaua

SEQ ID NO: 106405 - RNA, 59 nt, Human
agcagaaaugcuaacaagcgugcagaaacaccagagagugcguauccugcucagaacca

SEQ ID NO: 106406 - RNA, 59 nt, Human
uacugcaaaaagaaaaucuuuauaaauguaccagagagaguuguuuuaauaacuuaucu

SEQ ID NO: 106407 - RNA, 59 nt, Human
uaguggucuguuuucuacuucaguauucuaccagagaacauauuuuuuaggggagaagg

SEQ ID NO: 106408 - RNA, 59 nt, Human
gaacuuugccauuugucuacagaagacgaaccagagacaaaauuacuaaguauaaauua

SEQ ID NO: 106409 - RNA, 59 nt, Human
aacuggugaaacuagccuggaauaaugccaccagagacugaguggaaaucgccccuuuu

SEQ ID NO: 106410 - RNA, 58 nt, Human
uuuaagauuacuauuuaaauaaacauuauaccagagauauuuuucugcaucgugguuu

SEQ ID NO: 106411 - RNA, 59 nt, Human
aagugcucuaaagacagagacccucugccaccagagaccguccucaccccuguccucac

SEQ ID NO: 106412 - RNA, 59 nt, Human
ccugcuuggccagccucuguccagaaaggaccagagaaagccaggcuggaucgucacau

SEQ ID NO: 106413 - RNA, 59 nt, Human
uucggcgccagcagcuccaaaacuggaccaccagagaauggacaccauccaggaagacc

SEQ ID NO: 106414 - RNA, 59 nt, Human
aggagagagaggcaauggcuccuucacaaaccagagaccaaaugucacguuuuguuuug

SEQ ID NO: 106415 - RNA, 55 nt, Human
gcacauuaaaaguuacauaaauauuaccagagagccugaugcucucugauagcug

SEQ ID NO: 106416 - RNA, 59 nt, Human
acguagccccaucaugaagugacgugacuaccagagauuucuggaaaagcacucccaaa

SEQ ID NO: 106417 - RNA, 59 nt, Human
aaagcaguaacugacaacuugaauaauacaccagagauaauaugagaaucagaucauuu

SEQ ID NO: 106418 - RNA, 59 nt, Human
cuugagggguggcauuaggaacuuacgaaaccagagaccuuucccuaugacuuggcagu

SEQ ID NO: 106419 - RNA, 59 nt, Human
ggcaggaagagcaaagcuguccuaggccaaccagagauucaucuuucaugcagugacau

SEQ ID NO: 106420 - RNA, 59 nt, Human
cuggguagagaauggcugaggaggagauuaccagagaaguugcuuugcucagugcuuug

SEQ ID NO: 106421 - RNA, 59 nt, Human
ugugggugaggcugggugaugaccugaggaccagagacacgcgaccauguuggggcucu

SEQ ID NO: 106422 - RNA, 59 nt, Human
uagcugaauaaggggucagaacuucugaaaccagagaucuguaaucaucucuauuggcc

SEQ ID NO: 106423 - RNA, 59 nt, Human
cuuucuuuccucaccccaaccuuuacuccaccagagaaacuuccuuuugaacucagugg

SEQ ID NO: 106424 - RNA, 59 nt, Human
uauuuuuuaaaaaaauccuauauuaucacaccagagauuuuagauucuuuucugguuag

SEQ ID NO: 106425 - RNA, 59 nt, Human
aaaauaaauaauuguggauauaaaagaacaccagagaucagaaauucaaaaacucagaa

SEQ ID NO: 106426 - RNA, 59 nt, Human
aauacagaaacaguuuccccacugaugggaccagagagagugaaagagaaaagaaaacu

SEQ ID NO: 106427 - RNA, 59 nt, Human
cuguagcucacccagcaucucuuuuaccaaccagagagugugaaacuaguuucauauau

SEQ ID NO: 106428 - RNA, 59 nt, Human
cauguggcaagugugaugggcaguaaaauaccagagaagauguuuaguagcaauuaaag

SEQ ID NO: 106429 - RNA, 59 nt, Human
acaggauucugaaauguaguggguguaaaaccagagauuauuuguaugcucaaaauagu

SEQ ID NO: 106430 - RNA, 59 nt, Human
uuuguguauguguguaugugcgugugauuaccagagaacuacuaaaaaaaccaacugcu

SEQ ID NO: 106431 - RNA, 59 nt, Human
gucucuuaacuccugcccucaagugauccaccagagaggagauccucggccuccccaag

SEQ ID NO: 106432 - RNA, 59 nt, Human
cuaucagcaguacuaaaauguaucagccaaccagagaacaucagugacuuuaacuucug

SEQ ID NO: 106433 - RNA, 59 nt, Human
augccugcaaagugaaaagaagccauucaaccagagaacaagcuagaauuuauuuugcu

SEQ ID NO: 106434 - RNA, 59 nt, Human
aagaauacaaaugcugcagaggaauccuuaccagagauccagaaagaacaucgcaaucu

SEQ ID NO: 106435 - RNA, 59 nt, Human
uuugauguuugaccauuuaugacuuaauuaccagagagccaguaaauuaggacaguguu

SEQ ID NO: 106436 - RNA, 59 nt, Human
gaugacuccauggagccuggcccaggagaaccagagaugaucccgaggcagcuggggag

SEQ ID NO: 106437 - RNA, 59 nt, Human
cacccaaaacgccauugccuuccgcagagaccagagaucucuguacuucaaggacagcc

SEQ ID NO: 106438 - RNA, 59 nt, Human
ccccagacuuuacaugacacagcuuuaucaccagagagggacugacacccauguuucuc

SEQ ID NO: 106439 - RNA, 59 nt, Human
caaauauuccagagacugggacuaaguguaccagagaagggcuuggacucaagcaagau

SEQ ID NO: 106440 - RNA, 59 nt, Human
gagacuuuuauacguuuuguaccuuuguaaccagagagaugcuuauguuauuuuucagc

SEQ ID NO: 106441 - RNA, 59 nt, Human
uugaggcauucacugcccuagacaaugccaccagagauagugggggaaaugccagauga

SEQ ID NO: 106442 - RNA, 59 nt, Human
cugcccagguaugccuuccagugaugcccaccagagaauacauucucuauuaguuuuua

SEQ ID NO: 106443 - RNA, 59 nt, Human
caaacuuuguuaaacauaagagaauuuauaccagagagaaacccuacacauguaaagaa

SEQ ID NO: 106444 - RNA, 59 nt, Human
agauuggcugacacccuggagaagccgaaaccagagagccuuuuguuuucucuuuuuuc

SEQ ID NO: 106445 - RNA, 59 nt, Human
caauaaacucagucaaauguacccagccuaccagagauggaccaacgauccuaugagag

SEQ ID NO: 106446 - RNA, 59 nt, Human
gccagaucgucagcgcuaagggaacugagaccagagaaagaacccaagagaacuacagu

SEQ ID NO: 106447 - RNA, 59 nt, Human
cuuucaauuuacagaucaagaaacugaagaccagagaagagaaaugauuugguuaaagu

SEQ ID NO: 106448 - RNA, 59 nt, Human
uacuuguaagauccuaucauaugaaaauaaccagagauacaaagacauucugcaaagau

SEQ ID NO: 106449 - RNA, 59 nt, Human
aggcccuagcauuucuccuuggauaggggaccagagagagcuuggaauguuaaaaacaa

SEQ ID NO: 106450 - RNA, 59 nt, Human
cuguccuggcuggagaaucucacaagcggaccagagaucuuuuuaaaucccugcuacug

SEQ ID NO: 106451 - RNA, 59 nt, Human
gucaggauggucugagcaucugggugagaaccagagaaacaggacuucuuccuucugua

SEQ ID NO: 106452 - RNA, 59 nt, Human
aaugugugccuuuuaaaacaauaacaaaaaccagagaugugccuauacaauuuguguuc

SEQ ID NO: 106453 - RNA, 59 nt, Human
ugcugugguuaagcacugcaacagacucuaccagagaugcaaagagaagcgagagaggc

SEQ ID NO: 106454 - RNA, 59 nt, Human
uuaugcugaauccugagaagcuuucaagaaccagagaaccugauugcugaugauggccu

SEQ ID NO: 106455 - RNA, 59 nt, Human
ggcacuggugggauguggagucaggagcaaccagagaccccccaauacuagaauggguu

SEQ ID NO: 106456 - RNA, 59 nt, Human
ucuuaucuuaguagacaaaaagagucaauaccagagaaccagaggcauccucuguauuu

SEQ ID NO: 106457 - RNA, 59 nt, Human
auacuccagcaaaaugaaggaguacacaaaccagagaaugacaugaauccagcaaauag

SEQ ID NO: 106458 - RNA, 59 nt, Human
cauaucaaaaaguauuaaaacuaaaaaggaccagagaauucuuagauuggcccggaaag

SEQ ID NO: 106459 - RNA, 59 nt, Human
ugucacagaaaacaucagggucuuggaacaccagagauccaccuaacugcucauccuaa

SEQ ID NO: 106460 - RNA, 59 nt, Human
aaggaccauuuacuguuuuuuucuguagcaccagagaauccauccaaaguucccuauga

SEQ ID NO: 106461 - RNA, 59 nt, Human
ugaauggcaaauaacccaauagccugcguaccagagacaucugugauuguucuauuacu

SEQ ID NO: 106462 - RNA, 59 nt, Human
uguaaaugggucugaugugauaugacaagaccagagaaauuggauguaaauuuacauuu

SEQ ID NO: 106463 - RNA, 59 nt, Human
gccccgcccgccccacuaucuuuaaggagaccagagaccgccuacuggagagaaaggag

SEQ ID NO: 106464 - RNA, 59 nt, Human
cucugacugcagguuugaauaaguugaagaccagagaaaaguacacacugggcuacaaa

SEQ ID NO: 106465 - RNA, 59 nt, Human
ggaaaauugguuuugcuuucuuuguacacaccagagacccaucugaggucaucugauua

SEQ ID NO: 106466 - RNA, 59 nt, Human
agaaggugaaauaaagccauauuuaguauaccagagaagguagauuuuaagaauggucu

SEQ ID NO: 106467 - RNA, 59 nt, Human
auaugcagaucagagauagaggaaguggaaccagagagcugggagggaccaagguugua

SEQ ID NO: 106468 - RNA, 59 nt, Human
uguaagaggagagaggaauccacaggaccaccagagaggagagggaaccagauaugcag

SEQ ID NO: 106469 - RNA, 59 nt, Human; identical to SEQ ID NO: 106467

SEQ ID NO: 106470 - RNA, 59 nt, Human
aguauaaaaucauuuuuauuuaguuaauuaccagagagauuuagcauaauuuuguucug

SEQ ID NO: 106471 - RNA, 59 nt, Human
uuccauggugaagucuucuguaccaaugcaccagagaaugccuaccauccaaaaaagca

SEQ ID NO: 106472 - RNA, 59 nt, Human
cuguuaaagucugagcucuguugcagauaaccagagacccaacaaccaaaggcaaagcg

SEQ ID NO: 106473 - RNA, 59 nt, Human
cuuugcucagagcucagaauucaguggggaccagagagccugcaauuggaaauaugaga

SEQ ID NO: 106474 - RNA, 59 nt, Human
cuucacccagaagccaggacugacugugcaccagagaaucugcacaauaaacaugauga

SEQ ID NO: 106475 - RNA, 59 nt, Human
ucuccccaccacccuuucacacauuccugaccagagaucccagccaggcccuggagguc

SEQ ID NO: 106476 - RNA, 59 nt, Human
caugcccucaacucuugcuuggcagggguaccagagacugaaagacacggcacaaaucu

SEQ ID NO: 106477 - RNA, 59 nt, Human
uucacucauagacuuaagaugaucccaucaccagagagguuucucuaccauuagcuucc

SEQ ID NO: 106478 - RNA, 59 nt, Human
ugugcccucgcugggguaggcauuggagcaccagagaugaauagccccaagugcucccu

SEQ ID NO: 106479 - RNA, 59 nt, Human
gcgcccugccccacggacccgggcagugaaccagagaucacgcgccgcgccgcgaggcu

SEQ ID NO: 106480 - RNA, 59 nt, Human
aauuucauguuaaucugguuugucuguccaccagagacagaucuucugugacagccucc

SEQ ID NO: 106481 - RNA, 59 nt, Human
acaagaaaguuauaccauuuaaagcuggcaccagagacccgauagggacuuauuaacua

SEQ ID NO: 106482 - RNA, 59 nt, Human
agaucauugaauuccucuggaauuagaaaaccagagagucccauuuuaagaaauuagau

SEQ ID NO: 106483 - RNA, 59 nt, Human
uaucauagaucuuauuguacacauuuuguaccagagaaaaacccugaagcaguuguuca

SEQ ID NO: 106484 - RNA, 59 nt, Human
uucuuaaucauugauccaggaauauuucaaccagagacacaacuuucuggcagacagac

SEQ ID NO: 106485 - RNA, 59 nt, Human
ucuuaagagaugacugcucagauggagagaccagagaagagaacaagcuguugauuccu

SEQ ID NO: 106486 - RNA, 59 nt, Human
cagccauugcucagcaucagauaauucacaccagagagaaacccucugaaugugacgaa

SEQ ID NO: 106487 - RNA, 59 nt, Human
ugccugugguggucguacuacuggccgugaccagagagugcauuuacagaacgaggagg

SEQ ID NO: 106488 - RNA, 59 nt, Human
augccucagcaauauacaauggcauugcaaccagagaggugcccaucccugugcagcgc

SEQ ID NO: 106489 - RNA, 59 nt, Human
uccuagcagacaagcugagcaccguuguaaccagagaacuauuacuaggccuugaagaa

SEQ ID NO: 106490 - RNA, 59 nt, Human
augaaggaaaggagugaaagggaaguaggaccagagaaguggaaggaagcaaaauggag

SEQ ID NO: 106491 - RNA, 59 nt, Human
caggauaauauauuugcagauaauucuggaccagagacuuggugcgggguuaacaccuu

SEQ ID NO: 106492 - RNA, 59 nt, Human
auuccuuuaaacgguaacgauacaauaaaaccagagaagauccagcuuuugaaaacagu

SEQ ID NO: 106493 - RNA, 59 nt, Human
ugggccccugacucaaaaaagugguuuugaccagagaggcccagauggaggcuguucau

SEQ ID NO: 106494 - RNA, 59 nt, Human
cacuaccauauauggcaucagcuuugguuaccagagaaauuuucuuagucauuagacca

SEQ ID NO: 106495 - RNA, 59 nt, Human
guguucugaaucugucaagcuucaagaauaccagagaacugagggaaaauaccaaaugu

SEQ ID NO: 106496 - RNA, 59 nt, Human
uggucuucaagaaagcugugccccagaacaccagagauuucaacuuagucaauaaaacc

SEQ ID NO: 106497 - RNA, 59 nt, Human
ugcucuucaagaaagcugugccccagaacaccagagaccucaaauuacuuuacaaauag

SEQ ID NO: 106498 - RNA, 59 nt, Human
ugcucuucaagaaaucugugccugagaacaccagagaccucaaauuacuuugugaauag

SEQ ID NO: 106499 - RNA, 59 nt, Human
auaaucaagcuacaaauagguuuucuuaaaccagagaugcacugcccuugucuaaaguu

SEQ ID NO: 106500 - RNA, 59 nt, Human
ugauuuuaugaaguauauacccuuuacccaccagagacaguacagaaucccugcccuaa

SEQ ID NO: 106501 - RNA, 59 nt, Human
gaaacgacgggacuuucacugugauuuccaccagagaaauuauagcagaguggcugagc

SEQ ID NO: 106502 - RNA, 59 nt, Human
caaguucccgauggcgaacggggcucagcaccagagaccagggaguauucacugccauc

SEQ ID NO: 106503 - RNA, 59 nt, Human
ucaaauacagaugaagaaggaaaagagaaaccagagauggauggcagaucugggaucua

SEQ ID NO: 106504 - RNA, 59 nt, Human
caucugugagugaaaauccaguuucaagaaccagagaauuggguugucaugucuguuua

SEQ ID NO: 106505 - RNA, 59 nt, Human
uuaaaaguaucuuuaacaauugucuuaaaaccagagaaucuuaaggucuaacuguggaa

SEQ ID NO: 106506 - RNA, 59 nt, Human
uccuggguggggcagcggcugcagggcgcaccagagaacccagccagagggguugugag

SEQ ID NO: 106507 - RNA, 59 nt, Human
uuuaacaagguuguaaauauuuuaugcccaccagagauguggucauaagaucugauccu

SEQ ID NO: 106508 - RNA, 59 nt, Human
uauuuacaugucuuuuuaaaagggucguuaccagagauuuacccaucggguaagaugcu

SEQ ID NO: 106509 - RNA, 59 nt, Human
auaaauaaaggaaccuuuuauacugacaaaccagagaaaaauggaccuuuuuccaguua

SEQ ID NO: 106510 - RNA, 59 nt, Human
ccugggucuuccaagaggauucuuaagguaccagagauuugcuagggaaccaaaagugc

SEQ ID NO: 106511 - RNA, 59 nt, Human
gccuuugagaaaagaagggcugcaaugccaccagagaacgugaugucagacaccaucug

SEQ ID NO: 106512 - RNA, 59 nt, Human
cgguaaccagagggcagcguagugucaacaccagagaccaggauccaaauuguggggaa

SEQ ID NO: 106513 - RNA, 59 nt, Human
uucuggagcuuggcagauuuuccucugacaccagagaacaauaguagucucaagaaugg

SEQ ID NO: 106514 - RNA, 59 nt, Human
cgcuaauucggguacccauuccccaaguaaccagagagcacagagaaaugcuggugaaa

SEQ ID NO: 106515 - RNA, 59 nt, Human
gcucuguccuccccuauugcgcucucaagaccagagacccaacagcagugaucucaggg

SEQ ID NO: 106516 - RNA, 59 nt, Human
ccacucugagcacauguccggggguugccaccagagacggcuuuguucucccagcuaag

SEQ ID NO: 106517 - RNA, 59 nt, Human
cuauccuuguggagucuuguggcccaacuaccagagaacgcugucccccgacaucccac

SEQ ID NO: 106518 - RNA, 59 nt, Human
agccgggcccagcucuucuguccuuggccaccagagacugcagcccacaacccuuggag

SEQ ID NO: 106519 - RNA, 59 nt, Human
agccguuucuauucaaauggaaauucaguaccagagaauaaaugucuauguagucauac

SEQ ID NO: 106520 - RNA, 59 nt, Human
gcccucugcagacauccccgauugaaagaaccagagaggcucugagaaaccucgggaaa

SEQ ID NO: 106521 - RNA, 59 nt, Human
cucugaggugugggcucccucaucucguaaccagagaccagcacaugucagggaagcac

SEQ ID NO: 106522 - RNA, 59 nt, Human; identical to SEQ ID NO: 106473

SEQ ID NO: 106523 - RNA, 59 nt, Human
agaucaucagagcccccagauggcuacagaccagagauuccacgcucucaggcugacua

SEQ ID NO: 106524 - RNA, 59 nt, Human
uuucaauucuugaccagcacucccucccaaccagagaauuacugguuugauagaguagu

SEQ ID NO: 106525 - RNA, 59 nt, Human
cauaagugauuuggagcuuugguaaagggaccagagagaaggagucaccugcagucuuu

SEQ ID NO: 106526 - RNA, 59 nt, Human
ccuagggcuguaucucucccugggcugccaccagagaaggugcuugguguucgccugcc

SEQ ID NO: 106527 - RNA, 59 nt, Human
gguccugccggagaggaagagacacucagaccagagaaggggugugcaugcgccuacuc

SEQ ID NO: 106528 - RNA, 59 nt, Human
uaauccaacgcugcuagucuuaaccccagaccagagagaacugcagaucugacugggcc

SEQ ID NO: 106529 - RNA, 59 nt, Human
uaugagauuaacuuccuacaggggccaaaaccagagaaaggcuuccagcaacuucgaug

SEQ ID NO: 106530 - RNA, 59 nt, Human
uucacacuuacaggcacacacagacacagaccagagacucccagcagcagagcccaagc

SEQ ID NO: 106531 - RNA, 59 nt, Human
guacgacauuaccgaacaccuaaaauagaaccagagaaacgaaagccauucccacaaag

SEQ ID NO: 106532 - RNA, 59 nt, Human
ggcaaaaagcauacgcaugcuucccauggaccagagaaaccuggccuggguugucucaa

SEQ ID NO: 106533 - RNA, 59 nt, Human
cgagcgaauagcaucuccucccaccucccaccagagacguccuguuugagcugucaggu

SEQ ID NO: 106534 - RNA, 59 nt, Human
agcaucucagcagaaaccuugcucugaagaccagagacagaagggacagaaacaggagu

SEQ ID NO: 106535 - RNA, 59 nt, Human
agcugagugugaaaguagaaaucaccuacaccagagagccauuuugguauuuugccuuu

SEQ ID NO: 106536 - RNA, 59 nt, Human
ucagaaucugaacuuuggaaggguccacuaccagagacagaugaaaaaucacaguaagu

SEQ ID NO: 106537 - RNA, 59 nt, Human
uuggcuaaauagaaccucaccugcucaugaccagagagcauuuaggauaauagaggacc

SEQ ID NO: 106538 - RNA, 59 nt, Human
ugcggggaggcgcguggggagagaucucaaccagagaaguuaccagccgcggcgaggcc

SEQ ID NO: 106539 - RNA, 59 nt, Human
ggcuucugacuccugggacuuuggagcuuaccagagaugcagucccucccaggaaccug

SEQ ID NO: 106540 - RNA, 59 nt, Human
uccugagaggccagagaggaaguuuguucaccagagacaggcuucagauggcuuugauu

SEQ ID NO: 106541 - RNA, 59 nt, Human
gggcccucagucaccccgccccauuccucaccagagaaaagaauccauuucuauggaag

SEQ ID NO: 106542 - RNA, 59 nt, Human
gagugaaaccaauucucagagaacaacccaccagagacuuuuaaagagaggccaggcuu

SEQ ID NO: 106543 - RNA, 59 nt, Human
guaacucagaacaggaguaacugcaggggaccagagaugagcaaagaucuguguguguu

SEQ ID NO: 106544 - RNA, 59 nt, Human
gugaggcccacucuguuccuacuggagauaccagagacucugaaacuauagaauaaagc

SEQ ID NO: 106545 - RNA, 59 nt, Human
ugucuuuacaccuucacucagccacgccaaccagagacuggguuccaaucucaccccac

SEQ ID NO: 106546 - RNA, 59 nt, Human
gucugugugcuuacugaagagucccaaaaaccagagaccauuuucauuuacugccauca

SEQ ID NO: 106547 - RNA, 59 nt, Human
uggggaggacuaagaaagcuaccacccuaaccagagaggcuuggaauugggccuggccc

SEQ ID NO: 106548 - RNA, 59 nt, Human
gaguuaggcauggggagcuccagaaggucaccagagagcuuucagcugagggagaguuc

SEQ ID NO: 106549 - RNA, 59 nt, Human
gcugcgcuaauguacuacguagggcuucuaccagagauuuuccucuccaauuggguugu

SEQ ID NO: 106550 - RNA, 59 nt, Human
aauggggcuucuguaaguagagguggaaaaccagagagauguuuccacagcagccauuu

SEQ ID NO: 106551 - RNA, 59 nt, Human
gucucaucuaguaccuuuggaguagguuuaccagagagagcaaggaagcuucaaaacau

SEQ ID NO: 106552 - RNA, 59 nt, Human
acaggacacccagccagggaauucugaagaccagagagcagcccacgggcaucacgagc

SEQ ID NO: 106553 - RNA, 59 nt, Human
ucaacaggcugagaggaugccuccaauggaccagagagcugaguguucuaauaucacaa

SEQ ID NO: 106554 - RNA, 59 nt, Human
acuagugcaguccuugcccucagccccagaccagagaugggugguauaugccauguggg

SEQ ID NO: 106555 - RNA, 59 nt, Human
gacucauugcuggagguagagaggugucaaccagagaacagcuccccuagacauggccu

SEQ ID NO: 106556 - RNA, 59 nt, Human
uguggauagagcagccugcugcucucaggaccagagaagggaaaugacuucuccaggca

SEQ ID NO: 106557 - RNA, 59 nt, Human
gaucucuggggucuggaauuuggccccaaaccagagaauguaccuuaagggggagggcu

SEQ ID NO: 106558 - RNA, 59 nt, Human
cuuguaggggaaaaaaaggaaaaaaauuaaccagagagggucuguaaucucgcagagca

SEQ ID NO: 106559 - RNA, 59 nt, Human
cuuaagugcuaaacuuaguggaguuugugaccagagaauuggcauuuucuacaaauguu

SEQ ID NO: 106560 - RNA, 59 nt, Human
aaacaaggacugcagccuaaauuccaaauaccagagacugaaauuuucagccuugcuaa

SEQ ID NO: 106561 - RNA, 59 nt, Human
gaaugauagaugaaguauugcugaagccaaccagagaucuugaucucucucugaggaaa

SEQ ID NO: 106562 - RNA, 59 nt, Human
cuaaguucucauucuuucaauuguuaugcaccagagauuaaaaagcuuuaacuauaaaa

SEQ ID NO: 106563 - RNA, 59 nt, Human
acacucuaauggcauuugaacauguaaucaccagagauucugaaaugacugguuuaugu

SEQ ID NO: 106564 - RNA, 59 nt, Human
agcagccauaauuugaauaacucuacgagaccagagagacuguaguucccuauuuuaac

SEQ ID NO: 106565 - RNA, 59 nt, Human
uuuagagauccugugggcaaguaguuggaaccagagaacagccugccugcuuugacagu

SEQ ID NO: 106566 - RNA, 59 nt, Human
ggcccaaaugacagccuuacaaggguucuaccagagaggaaaauuccacaucccaccag

SEQ ID NO: 106567 - RNA, 59 nt, Human
aucacaugguacacuugauuaguaauaaaaccagagaucaauuuaaauugcugauaggu

SEQ ID NO: 106568 - RNA, 59 nt, Human
cuugaaauuauuguggguauuaucuguuuaccagagauacuaaauauuaguuuuaauua

SEQ ID NO: 106569 - RNA, 59 nt, Human
aacaaaaaacaaaacgcucaagccuuacgaccagagaaggauuucagcaaaccaccacc

SEQ ID NO: 106570 - RNA, 59 nt, Human
agucaugucaaauugcaaucaggcucaaaaccagagaccaggcugugaaauccacacau

SEQ ID NO: 106571 - RNA, 59 nt, Human
gaagugcucaucacgaaugaaacaccaaaaccagagacuaucaucauaccagagcaauc

SEQ ID NO: 106572 - RNA, 59 nt, Human
cuucuuaagguuuguuuguguuuucuaaaaccagagaauaaggaacugauuuggcuaug

SEQ ID NO: 106573 - RNA, 59 nt, Human
guuugcugggcucugggauccacgagacaaccagagagggauaucucaugaaauuugca

SEQ ID NO: 106574 - RNA, 59 nt, Human
uucuccauugauuuucaccugugguucauaccagagaccugagaauguuuguaaaugua

SEQ ID NO: 106575 - RNA, 59 nt, Human
gggaaggguaggaaaauggacuguuucugaccagagacacuuaccuaaauauccugggg

SEQ ID NO: 106576 - RNA, 59 nt, Human
cagcuguggugaauguugauauuaaauaaaccagagaucugaucuucaagcaagaaaau

SEQ ID NO: 106577 - RNA, 59 nt, Human
gaggggcucaguucugccuuaucuaaaucaccagagaccaaacaaggacuaauccaaua

SEQ ID NO: 106578 - RNA, 59 nt, Human
auuaguugcauauaucauugaacacacauaccagagauguuuuagaaaugugagaaaaa

SEQ ID NO: 106579 - RNA, 59 nt, Human
accugggauugcuucuuccagguaugggcaccagagagggaagccacugcaacauuuua

SEQ ID NO: 106580 - RNA, 53 nt, Human
cugaugaaugggaguacugaaauaccagagaucucacuuuugauacuguuuug

SEQ ID NO: 106581 - RNA, 59 nt, Human
uggaugggugccuguggguguuuuuagacaccagagaaaacacagucucugcuagagag

SEQ ID NO: 106582 - RNA, 59 nt, Human
caaccaggaaacugcuacuuguggaccucaccagagaccaggaggguuugguuagcuca

SEQ ID NO: 106583 - RNA, 59 nt, Human
cuugaaauguuaaugguuaauguucccaaaccagagaaugcuuugaaaauguaucauuc

SEQ ID NO: 106584 - RNA, 59 nt, Human
ccuccuccaaaucaucauucaccaaccauaccagagaaacauuuccaguuuuccacaaa

SEQ ID NO: 106585 - RNA, 59 nt, Human
gagaaucagcugacccauacagacuugaaaccagagaacauccuguuugugaauucuga

SEQ ID NO: 106586 - RNA, 59 nt, Human
cuuuugugcuaccuuucuuggauuuuuguaccagagaugugcuaaacugaugaaauaca

SEQ ID NO: 106587 - RNA, 59 nt, Human
ucagaaauguauuuauucucagaaacagaaccagagagaaguuaaacaaaagguuaugu

SEQ ID NO: 106588 - RNA, 59 nt, Human
caucauaguaauuugucaugggcaacaugaccagagagaagauuuuugucaugauuuua

SEQ ID NO: 106589 - RNA, 59 nt, Human
ggugcuauuugucaucugcuccuguucacaccagagaaccaggcuacaagagaaaaagc

SEQ ID NO: 106590 - RNA, 59 nt, Human
gaauugcagaaaugacuacacugugcuauaccagagaauuccaguagaaagaaacuugu

SEQ ID NO: 106591 - RNA, 59 nt, Human
ccacugucagcaaagccuggagaaaugggaccagagagucugccccuaccacgucccug

SEQ ID NO: 106592 - RNA, 59 nt, Human
gcagauccagcucguggaccagcugcagcaccagagaaaagaguagcagagauggccug

SEQ ID NO: 106593 - RNA, 59 nt, Human
gguucagaaccagccuggccaaaaauuacaccagagagacagaguccuccccauuggga

SEQ ID NO: 106594 - RNA, 59 nt, Human
uacaggaguaggggggguguggguguguaaccagagaccgagagcaugaguggggugug

SEQ ID NO: 106595 - RNA, 59 nt, Human
auccccucaggcugaagccccccacccccaccagagacacacugggaaccgucagaguc

SEQ ID NO: 106596 - RNA, 59 nt, Human
gcuagcuuucucauacucccacaggcuagaccagagaugccaagucccaacagcacuga

SEQ ID NO: 106597 - RNA, 59 nt, Human
cuggcagggacuucuggguuaugggagaaaccagagaugggaaugaggaaaauaugaac

SEQ ID NO: 106598 - RNA, 59 nt, Human
gggcagcccagcccccgcacccacccccaaccagagaagcacagaucuuggggagcugc

SEQ ID NO: 106599 - RNA, 59 nt, Human
uauauaucacucucucccucuccugaaagaccagagauuguguauuuucagugucccau

SEQ ID NO: 106600 - RNA, 59 nt, Human
cuccagcuccacacauguuuccacuuaauaccagagacccccccccuuccccucccccu

SEQ ID NO: 106601 - RNA, 59 nt, Human
ucuuuacccucugugaccugugggguuagaccagagagggacucuggggucacgucuug

SEQ ID NO: 106602 - RNA, 59 nt, Human
gaaccaggaagcccagcuaaagccaagagaccagagagucccugccacuaguuuucauc

SEQ ID NO: 106603 - RNA, 59 nt, Human
uguccccuagggucccuagaagggcaaagaccagagaguugacaagucuguuauuagga

SEQ ID NO: 106604 - RNA, 59 nt, Human
aaagcaguuaauuaggcagccuggagaaaaccagagauccaguacagaaaggaaaggau

SEQ ID NO: 106605 - RNA, 59 nt, Human
ugagcucccuggggcgggcagcugacacuaccagagagacucaagcaauaauuagaggu

SEQ ID NO: 106606 - RNA, 59 nt, Human
cgucagcugggacaccccgacuuuuguuuaccagagaaaaagggagggggagagggcug

SEQ ID NO: 106607 - RNA, 59 nt, Human
augacaggaaggaaggaacacugggcagaaccagagagaugggacaugguagacugugg

SEQ ID NO: 106608 - RNA, 59 nt, Human
gaucagccuuuuccagcauccugugagagaccagagagagaguuuggauuucauguggg

SEQ ID NO: 106609 - RNA, 59 nt, Human
gaaggcggcaggguccucugccuaggaaaaccagagaccuuuguucacuuguugaucug

SEQ ID NO: 106610 - RNA, 59 nt, Human
aggaagaaaaaaaugucacccauagucucaccagagacuaucauuauuucguuuuguug

SEQ ID NO: 106611 - RNA, 59 nt, Human
uccuuugagagugaagguggguggaguugaccagagaaaggggagagaauucgggaaag

SEQ ID NO: 106612 - RNA, 59 nt, Human
gaucaucagugauacuaagguggaugccaaccagagaagcugcuaccccuacaucaucu

SEQ ID NO: 106613 - RNA, 59 nt, Human
cugaauaaauuaggccucaggccucuaccaccagagagcuggagaauggguccacguca

SEQ ID NO: 106614 - RNA, 59 nt, Human
uguggauuuuucagcauuggaaucccccaaccagagauguuaaagugagccugucccag

SEQ ID NO: 106615 - RNA, 59 nt, Human
uuuguuaaaaucguggaguaugaaccgugaccagagaaguaaauauggagccguuuuau

SEQ ID NO: 106616 - RNA, 59 nt, Human
uuugugcuuugcacaaaccugaaucccccaccagagaggaugugugugaggagccagaa

SEQ ID NO: 106617 - RNA, 59 nt, Human
cucuaauccagcaaagugauucccugcacaccagagacaagcagaguaacaggaucagu

SEQ ID NO: 106618 - RNA, 59 nt, Human
ccauccugucuggaauacaccaggucaacaccagagaucucagaucagaaucagagauc

SEQ ID NO: 106619 - RNA, 59 nt, Human
ucuuccgaaaaccaggccuuaucuccaagaccagagauaguggggagacuucuuggcuu

SEQ ID NO: 106620 - RNA, 59 nt, Human
aauuauagccaagugacauuccucaagucaccagagagaauggaagcucaucacccaac

SEQ ID NO: 106621 - RNA, 59 nt, Human
uggguuccaaauuacucauagaggagaaaaccagagaaagaugaagaggaggaguuagg

SEQ ID NO: 106622 - RNA, 59 nt, Human
uucucuuuucccuaccuccugcuaacccaaccagagauccccuuccuugcugagagggu

SEQ ID NO: 106623 - RNA, 59 nt, Human
uuccuucuagaaggagcuuccugacuggaaccagagaaugcaugucuguccacuuggug

SEQ ID NO: 106624 - RNA, 59 nt, Human
aucucuccuggcagggcccuguuacauaaaccagagaugauaaaacagauacuuccaga

SEQ ID NO: 106625 - RNA, 59 nt, Human
uggucuguauuugcauguaaaagugggccaccagagaacccuuauugauuacuuaagug

SEQ ID NO: 106626 - RNA, 59 nt, Human
ccccaauucaucauauuuuguuuguuaucaccagagaugccugaacucaguuaagcgag

SEQ ID NO: 106627 - RNA, 59 nt, Human
cuacuagagugaaaugauauuaaguggaaaccagagauaaaugcuguuaauuuaacaag

SEQ ID NO: 106628 - RNA, 59 nt, Human
uuuaaaaacagcugaagugaccuuagcagaccagagauuuuauuuuuuuaaagagaaau

SEQ ID NO: 106629 - RNA, 59 nt, Human
ccuggggacccaaggggugggggggucacaccagagagaggcagggggccuggccggcu

SEQ ID NO: 106630 - RNA, 59 nt, Human
gaaacgcucuccccacccacgccaugcugaccagagaucuugcagccccuguggaugcc

SEQ ID NO: 106631 - RNA, 59 nt, Human
gguuuuucuuuaaguauuguaauguacauaccagagagauaaugcagacugucaugggu

SEQ ID NO: 106632 - RNA, 59 nt, Human
gaaggaaucugaauggagaaucaccaaccaccagagaaaaaagacuguggggcccuccc

SEQ ID NO: 106633 - RNA, 59 nt, Human
ucucagacaacucagaagguuggggggauaccagagaggugguggaauaggaccgcccc

SEQ ID NO: 106634 - RNA, 59 nt, Human
cgucaauaucugcucacaucuuacuaaacaccagagaguucaugcuuaauaaaagcaug

SEQ ID NO: 106635 - RNA, 59 nt, Human
uaaauuuuaucaauauggugcugguucaaaccagagaauucaugcugcagggaaacuca

SEQ ID NO: 106636 - RNA, 59 nt, Human
uuuuauucagaugucaaaccucauucgacaccagagaauucauacgggugagaaacccu

SEQ ID NO: 106637 - RNA, 59 nt, Human
guguuaugggccuagugggccucugguggaccagagauuaccccucucaacaggccagc

SEQ ID NO: 106638 - RNA, 59 nt, Human
uaccaaggauauuuacagaaaagacucugaccagagaucgagaccauccuagccaacau

SEQ ID NO: 106639 - RNA, 59 nt, Human
auagcagaccacacagaagggugugggccaccagagaauuuugguaaaaauuuggccuc

SEQ ID NO: 106640 - RNA, 59 nt, Human
aucaguuucugucggauuguaggagccucaccagagagggccccugucgccauguugua

SEQ ID NO: 106641 - RNA, 59 nt, Human
auguguaauugucuuauucacuguaggacaccagagagcugauuuuucaagggauccaa

SEQ ID NO: 106642 - RNA, 59 nt, Human
cuuuuguccaaggauucaccguauuccaaaccagagauguucaaauuggugagaaaccc

SEQ ID NO: 106643 - RNA, 59 nt, Human
ccucgagucgcccugcccagagcccuggcaccagagacgccaagagccuguggggugac

SEQ ID NO: 106644 - RNA, 59 nt, Human
ugggaagcugaggcaggagaaucgcuugaaccagagagucggagguugcaguaagccga

SEQ ID NO: 106645 - RNA, 59 nt, Human
ccccaaauucauuccagaucuauuuuucuaccagagagaggagcaaaguccuccucccc

SEQ ID NO: 106646 - RNA, 59 nt, Human
uguauuccucaccccaccugugaacuccuaccagagagaaaccuuuuguauguaaagaa

SEQ ID NO: 106647 - RNA, 59 nt, Human
agcggaagaggauuuucuaaguggcuggcaccagagauaacucaagggccugcaccaaa

SEQ ID NO: 106648 - RNA, 59 nt, Human
ugucuuguggccuccaugggagguugaaaaccagagaaggugaaggggggcugcacuga

SEQ ID NO: 106649 - RNA, 59 nt, Human
ugccacggugugcccagacucugcuaggcaccagagagacaagauacgagugacauggu

SEQ ID NO: 106650 - RNA, 59 nt, Human
gcuguuucuucagaaauguuaaaauguuuaccagagaacuaauaaauguuguuauggcu

SEQ ID NO: 106651 - RNA, 59 nt, Human
acuuuuucaaaaacuacagcuuagaaaacaccagagaguucauacuaaaacauauuuuu

SEQ ID NO: 106652 - RNA, 59 nt, Human
cucuucuugucuuucauaggugaaaaagcaccagagaauacauacaugaagggacaaau

SEQ ID NO: 106653 - RNA, 59 nt, Human
aauccuuuauugauuguucaacucuuaacaccagagaauucacacuggugagaaacccu

SEQ ID NO: 106654 - RNA, 59 nt, Human
acuccaccccuuguggccccgccuccuucaccagagaucucgccccucgugaugucagg

SEQ ID NO: 106655 - RNA, 59 nt, Human
ggcaugcuccuggcaucgaguggguggagaccagagaagccgcucaacauccugcaaug

SEQ ID NO: 106656 - RNA, 59 nt, Human
cuuuauguguaaacaagaugauaucugaaaccagagagacuuggaaugucugacugacu

SEQ ID NO: 106657 - RNA, 59 nt, Human
gggcgcuccucucugcacaccuacuagucaccagagacuuuagggggugggauuccacu

SEQ ID NO: 106658 - RNA, 59 nt, Human
ggucggccaagugaggaaugauugcagggaccagagaagaccaaagaugccagaugucc

SEQ ID NO: 106659 - RNA, 59 nt, Human
uggauggaacccuuucccguauuaaacaaaccagagacagaaucagugcugacucagga

SEQ ID NO: 106660 - RNA, 59 nt, Human
ggagugugcugggcuuggggguaagggggaccagagaggcgggcugguguucuaagagc

SEQ ID NO: 106661 - RNA, 59 nt, Human
cuucugagcccugggcaggggugguggguaccagagaaugcugccuucccccaagccug

SEQ ID NO: 106662 - RNA, 59 nt, Human
aacacuuccaguugugagccaagauuguaaccagagagcagccaggagcuuccugucag

SEQ ID NO: 106663 - RNA, 59 nt, Human
ggccuuugaccggccccagagcuaaaagcaccagagaaaaucaaaugcuuccuacucag

SEQ ID NO: 106664 - RNA, 59 nt, Human
gucuucaacuuuugaccggugcaggugugaccagagaccaccucuguggccaccucaga

SEQ ID NO: 106665 - RNA, 59 nt, Human
ucuagaacucccagacccuggacuuagccaccagagagcuacauuuuaaaggcugucuu

SEQ ID NO: 106666 - RNA, 59 nt, Human
uuguacaugggacugauucuguuguguucaccagagaaagcuugaggccauggcgagau

SEQ ID NO: 106667 - RNA, 59 nt, Human
uuggcccagccugggcuggugaccugggcaccagagaccuugcaucccuccucauccua

SEQ ID NO: 106668 - RNA, 59 nt, Human
agaugccacuuacuguaaguggccagaauaccagagagguggguuccauggucaaaugc

SEQ ID NO: 106669 - RNA, 59 nt, Human
acaugaugcccugcugaccaugcagccgcaccagagagagauucuuccccaauuggcuc

SEQ ID NO: 106670 - RNA, 59 nt, Human
gccguuuccuuuuuauggaucuguugggaaccagagagaaucaacagaucaaugacaua

SEQ ID NO: 106671 - RNA, 59 nt, Human
uugaagcuuuacugguuaaguauagggucaccagagaaaguuccuuuccccaguugaug

SEQ ID NO: 106672 - RNA, 59 nt, Human
auuugcuugaggcuagcccagugaaaaaaaccagagacucauguuuccaggggucaguc

SEQ ID NO: 106673 - RNA, 59 nt, Human
uacguccugccuggcacuuacugguccuuaccagagacgcccagccccaucccuguccu

SEQ ID NO: 106674 - RNA, 59 nt, Human
ggggcgggcugaugucuucuugggggcagaccagagagcucaaguuucagagucagaau

SEQ ID NO: 106675 - RNA, 59 nt, Human
gugucucagaggcugcaauguagguguucaccagagacauaggcaucacuggggucaca

SEQ ID NO: 106676 - RNA, 59 nt, Human
cgugaagauaccauaagcuuuuucucugaaccagagaaaugaaagucaguuuaagaggc

SEQ ID NO: 106677 - RNA, 59 nt, Human
auccccaguugcagggggaucuggggacuaccagagacucugggaaauggacaaggugg

SEQ ID NO: 106678 - RNA, 59 nt, Human
aguguaaacuaaggggcuuugcuuuucaaaccagagaaaggaaagccagaaggaaaaga

SEQ ID NO: 106679 - RNA, 59 nt, Human
accagcuguucugucccuuggagcuguaaaccagagagcugcuggggauucuggccuag

SEQ ID NO: 106680 - RNA, 59 nt, Human
agcaggaucccucaaaucaauaaagcauuaccagagaugcacuuuaacuguguggcugu

SEQ ID NO: 106681 - RNA, 59 nt, Human
aaugacugggcacccucuucuugguuuuuaccagagaggcuuugaauggaagcaggcug

SEQ ID NO: 106682 - RNA, 59 nt, Human
agcugagugugaaaguagaaaucaccuacaccagagagcuauuuugguauuuugccuuu

SEQ ID NO: 106683 - RNA, 59 nt, Human
uaguguggacuggaugaugccuucgacaaaccagagaagccaaguuggggggagcuggu

SEQ ID NO: 106684 - RNA, 59 nt, Human
gacuagauucuauuagcuacugucaacucaccagagacuguuucccagaaaaaccagua

SEQ ID NO: 106685 - RNA, 59 nt, Human
cuauuuugaacuuuccagaacccucucacaccagagacaguucuucucuguucaguuuc

SEQ ID NO: 106686 - RNA, 59 nt, Human; identical to SEQ ID NO: 106681

SEQ ID NO: 106687 - RNA, 59 nt, Human
uucaauauuaacuagcuugaagccugaccuagccagaagugccuguccgcugcagccgc

SEQ ID NO: 106688 - RNA, 59 nt, Human
aauggaggcuuagcuuucuggauggcaucuagccagaggcuggagacaggugcgccccu

SEQ ID NO: 106689 - RNA, 59 nt, Human
auauuuuuuauaaauagugaagauacgucuagccagaccuaauguucaaaaauaaauuu

SEQ ID NO: 106690 - RNA, 59 nt, Human
agcaauccaguugcuccugugcuagaugguagccagagaauuuuauaguaauggagguu

SEQ ID NO: 106691 - RNA, 59 nt, Human
gauaguuuuucuucuggguucaaccacuuuagccagaauuugaucaaauuaaaagucug

SEQ ID NO: 106692 - RNA, 59 nt, Human
acccauacaccuccagggcugcaggucauuagccagaauaaaggauguccacauucaca

SEQ ID NO: 106693 - RNA, 59 nt, Human
auaaugauuuccucugaauuauaauaacauagccagauguagucucacacuguuuuuca

SEQ ID NO: 106694 - RNA, 59 nt, Human
gccagcugcaguccguaccguucuuagguuagccagagacagguuuucauuaucagguc

SEQ ID NO: 106695 - RNA, 59 nt, Human
uguguccagcagcugcgggucugaaggaauagccagagaggagcaccugaaccccaugg

SEQ ID NO: 106696 - RNA, 59 nt, Human
cuuaagcugagaccuggauaagugggagcuagccagauaaagcugcaggaaauagcauu

SEQ ID NO: 106697 - RNA, 59 nt, Human
guggccacagaaaauucuucuccacuuucuagccagaggagagaggacccccugaauuu

SEQ ID NO: 106698 - RNA, 59 nt, Human
gucuguuucauugggguuuuuguuuuguuuagccagacacccucaacagaauauuaggc

SEQ ID NO: 106699 - RNA, 59 nt, Human
uuuuaaugcuauuugaacaagugggccauuagccagauuugucuuuuuguuguaaaaca

SEQ ID NO: 106700 - RNA, 59 nt, Human
ccagacucaaggaguugguaaaggguuaauagccagauaguagaaccagugaggagaug

SEQ ID NO: 106701 - RNA, 59 nt, Human
aagcauggcaaaagcuggccuggaagggauagccagagggauagaaugacucucucucu

SEQ ID NO: 106702 - RNA, 59 nt, Human
uaacuuccuagaguugcacccuagcaaccuagccagaaaagcaaguggcaagaggauua

SEQ ID NO: 106703 - RNA, 59 nt, Human
gggcaccuagucagaucuucucagcuugcuagccagaaaugacugugauucugcugggg

SEQ ID NO: 106704 - RNA, 59 nt, Human
gcagcaggacugaucaagugacuacugguuagccagaggagcucagcugaagcccugga

SEQ ID NO: 106705 - RNA, 59 nt, Human
uuuauaggucacauaugucuguaucuacuuagccagaugcuuggccuggugggaccagg

SEQ ID NO: 106706 - RNA, 59 nt, Human
uugguaacuugcccauuauucucugcuuuuagccagaguuaaacagacugaugggucug

SEQ ID NO: 106707 - RNA, 59 nt, Human
ccugaaccaguccugcugccuggagucaguagccagaguuguucucaggggugcugggg

SEQ ID NO: 106708 - RNA, 59 nt, Human
ccucagcuccacccaccuggagacgaauguagccagagaggaggaaggagggaaacuga

SEQ ID NO: 106709 - RNA, 59 nt, Human
ccuuuugcaccugcucucuuguaaugauauagccagaaaaacguguugccuugaaccac

SEQ ID NO: 106710 - RNA, 59 nt, Human
ugcagauuauuacagacaccucuuuccuuuagccagagaaugguucaaaugucuuacag

SEQ ID NO: 106711 - RNA, 59 nt, Human
ugcuuuccucagaggaugguccuuuaacauagccagaaacaagcccugugguuugaagg

SEQ ID NO: 106712 - RNA, 59 nt, Human
aagugacgaggaagguucuguuuugaguauagccagagaaaacaaggauggagaaaaau

SEQ ID NO: 106713 - RNA, 59 nt, Human
aagugacgaggaagauucuguuuuggguauagccagagaaaacaaggauggagaaaaau

SEQ ID NO: 106714 - RNA, 59 nt, Human
aagugaugagaaagauucuguuuugaauauagccagaggaaaaaaggauggagaaaaaa

SEQ ID NO: 106715 - RNA, 59 nt, Human
gcuguuucuaauauaauuauuuucuaagauagccagauaguuagaaaaagauuuucauu

SEQ ID NO: 106716 - RNA, 59 nt, Human
cuccugccucugcuccucugcccuucuuauagccagaacuuguaucuucucagcaaccu

SEQ ID NO: 106717 - RNA, 59 nt, Human
uaagaaggugcaauccuagauaacacagcuagccagauagaagacacuuuuuucuccaa

SEQ ID NO: 106718 - RNA, 59 nt, Human
auagauaaggcagcuaaauuucugaaagauagccagaguaaguaagcagccacugcaag

SEQ ID NO: 106719 - RNA, 59 nt, Human
cccgccucuguccucacugugccaggccauagccagaggccacccuguaguacagggau

SEQ ID NO: 106720 - RNA, 59 nt, Human
aaccccuucucuacuaaaaauacaaaaauuagccagacgugguggugggugccuguaau

SEQ ID NO: 106721 - RNA, 59 nt, Human
cuacccuagacaucugcaucuuuguaaguuagccagacaauaaagaaaagcagaaugau

SEQ ID NO: 106722 - RNA, 59 nt, Human
uaacucaaggacuuggacccaugacucuguagccagaagacuucaauauuaaaugacuu

SEQ ID NO: 106723 - RNA, 59 nt, Human
uauauacgucuauucuuuaugccuugcccuagccagauggaagaagaugaagaaggaaa

SEQ ID NO: 106724 - RNA, 59 nt, Human
cugccagccucgcugggcagggcuggccguagccagaccccaagcuggcccacuggucc

SEQ ID NO: 106725 - RNA, 59 nt, Human
uuccuuugugugccuuuccuaugucaaauuagccagaaggaagaagagacguuaagaau

SEQ ID NO: 106726 - RNA, 59 nt, Human
augccuuuguuuuuuuguuauuauuuucuuagccagaacaucucucuuugaacucacac

SEQ ID NO: 106727 - RNA, 59 nt, Human
agccuguagcuaagguuuacaguggacauuagccagaucauuuucuucuuagauuaugc

SEQ ID NO: 106728 - RNA, 59 nt, Human
aaauaucaaaaagaguuuaggaauucuacuagccagagauagucacuuggagaaacuuu

SEQ ID NO: 106729 - RNA, 59 nt, Human
uucacagaggaauagaagguacuuuaucauagccagacuucgcuuagaaugccagaaua

SEQ ID NO: 106730 - RNA, 59 nt, Human
ggucaggaaaucagguccagccuucccuguagccagacaguuuaugagcccagagccuc

SEQ ID NO: 106731 - RNA, 59 nt, Human
caaaaaauaaaauaaaauaaaaaccaaauuagccagacaugguggcaugcgcuuguuua

SEQ ID NO: 106732 - RNA, 59 nt, Human
uuaaauacauguuuguauauacuguauucuagccagaauaauuuuagaucugaucaggu

SEQ ID NO: 106733 - RNA, 59 nt, Human
aauugcuaucuguguaaaaugucuaccaguagccagaugcuuccagaguucuuaaugcc

SEQ ID NO: 106734 - RNA, 59 nt, Human
aauuauauuucaccuuuuagaaucuuucauagccagaaaacaagauuacuguaagccag

SEQ ID NO: 106735 - RNA, 59 nt, Human
uucaucacgcucuaaggccguuuuuuccuuagccagaccccuguugauagaccagauac

SEQ ID NO: 106736 - RNA, 59 nt, Human
guuuguguuuuugguuaugcccaucuccauagccagaccaagcacucuggaagccaggg

SEQ ID NO: 106737 - RNA, 59 nt, Human
uucauuaacucugauuaauuagaaucagcuagccagauuaguaaccucuuuguccagcc

SEQ ID NO: 106738 - RNA, 59 nt, Human
uuccaggcagcuucaugaugugcaggcaguagccagacagggucaugggaagggggccc

SEQ ID NO: 106739 - RNA, 59 nt, Human
aguuuuaucacguuugaaucuaccauucauagccagauguguaucagauguuucacuga

SEQ ID NO: 106740 - RNA, 59 nt, Human
uggcucagugacuggaagaggcggacuaauagccagaguuaaauauaaauacaaauuaa

SEQ ID NO: 106741 - RNA, 59 nt, Human
gaacccuuggauuaccugguggcuuuuucuagccagauuugcauuaauccuuacugaga

SEQ ID NO: 106742 - RNA, 59 nt, Human
cuccauguacuuuggaaucuccuccaagauagccagaguuuaauacaucuucauucuca

SEQ ID NO: 106743 - RNA, 59 nt, Human
aaggaagaaggaaguggcugaguuauuaauagccagagccacugggagacuggggagac

SEQ ID NO: 106744 - RNA, 59 nt, Human
uuaagagucucaugcucuaccguuggaacuagccagauggccauuauuuuguauuuuaa

SEQ ID NO: 106745 - RNA, 59 nt, Human
ccaguuuccccaugacagugccuucuaacuagccagagaauagguagcuucccuccuga

SEQ ID NO: 106746 - RNA, 59 nt, Human
aaaggacuuaucgcucacagcaaaagcuguagccagagcuucauguugguuuuauucag

SEQ ID NO: 106747 - RNA, 59 nt, Human
uuuuuaacacacuugaaaaaagguuggaguagccagacuuucauauauaacuuggugau

SEQ ID NO: 106748 - RNA, 59 nt, Human
caccguguccaaguuuuuagaacccuuguuagccagaccgagguguccuggucaccguu

SEQ ID NO: 106749 - RNA, 59 nt, Human
uuggguuuguucacucucugaaugauuauuagccagacuucaaaauuauuuuauagccc

SEQ ID NO: 106750 - RNA, 59 nt, Human
uaauagagcguuauuccacagaaggccucuagccagagaucuugaguguagugcaaggg

SEQ ID NO: 106751 - RNA, 59 nt, Human
agaguaacauaccauuuaauuacaauuuuuagccagaaaaguccccacuauuuuacuaa

SEQ ID NO: 106752 - RNA, 59 nt, Human
uugguaaauuuuucuaaacacaauuguuauagccagaggaacaaagaugauauaaaaua

SEQ ID NO: 106753 - RNA, 59 nt, Human
uauucuagccucauuugcaugaagucagauagccagaagaaauuccauugcugguuuuc

SEQ ID NO: 106754 - RNA, 59 nt, Human
aaaccccgucucuacuaaaaauacaaaauuagccagaugugguggcgcacaccuguaau

SEQ ID NO: 106755 - RNA, 59 nt, Human
uuggccuuaguagucaaaaacaaagcugauagccagacacguucugauuucugcccuug

SEQ ID NO: 106756 - RNA, 59 nt, Human
aacaaaauacucccucucuguuccugucuuagccagaggcgucgcuccugucuugcuua

SEQ ID NO: 106757 - RNA, 59 nt, Human
gggccagagucguguccaccaagggacaguagccagagcuccucuuccuuuaccaggca

SEQ ID NO: 106758 - RNA, 59 nt, Human
ggauagcaguaagccacacaccugccacuuagccagaaugcccaggaucgcguugguca

SEQ ID NO: 106759 - RNA, 59 nt, Human
cuuuaugugucaguauuaagaguaauauguagccagauuacuuaaaucucagaauuacu

SEQ ID NO: 106760 - RNA, 59 nt, Human
cuggagauggggagaaaccuacagaauacuagccagagcuccuccuugucuuggcagcc

SEQ ID NO: 106761 - RNA, 59 nt, Human
gccauggugacacacagcagcacugcagauagccagacacauggcuauccuagagaggc

SEQ ID NO: 106762 - RNA, 59 nt, Human
gccaguggcucuggugcuagaugccacuguagccagaucuccaacagugccuuggacca

SEQ ID NO: 106763 - RNA, 59 nt, Human
cacaaacugucgucuuuuuccaaacaauuuagccagaauguuuccuguggaaauaugca

SEQ ID NO: 106764 - RNA, 59 nt, Human
cuuugcguuugcagugcguuuuacucaaguagccagaaacaccccacguuucugaauuu

SEQ ID NO: 106765 - RNA, 59 nt, Human
gcucagaugucauaaguggcagcuaucuuuagccagacuguugcaguuauugcucgaug

SEQ ID NO: 106766 - RNA, 59 nt, Human
ugaggaaaaaacgcuguugcccauuuuuguagccagagaaauugaaaaacgacuguggc

SEQ ID NO: 106767 - RNA, 59 nt, Human
gcucccaguauacaauauccuccaggacauagccagaaaucuccauuccacacaugacu

SEQ ID NO: 106768 - RNA, 59 nt, Human
aucaaucacuucaggcuacuuuuaugaguuagccagaugcuuguguauccucagaccaa

SEQ ID NO: 106769 - RNA, 59 nt, Human
uauauauuauucucauuuagugcccucuuuagccagaaucucauuacugcuucauuuuu

SEQ ID NO: 106770 - RNA, 59 nt, Human
auucaccagccggaugucccaaaucccuuuagccagauugcuuuuugcaaccaaagcug

SEQ ID NO: 106771 - RNA, 59 nt, Human
gggaaaaccuacaggacuuucacuaaagcuagccagagacagccaugaaaauggacguu

SEQ ID NO: 106772 - RNA, 59 nt, Human
acccuagcauauugggauuaagagcuuucuagccagaaucuggaccuauaccaugggaa

SEQ ID NO: 106773 - RNA, 59 nt, Human
gcugagcaugcuugugcagaaagaagccauagccagaaaggacagaaucucucccccac

SEQ ID NO: 106774 - RNA, 59 nt, Human
aaaucgucauguauuuagacuugguguaguagccagaauucguaaagcuguugccuggg

SEQ ID NO: 106775 - RNA, 59 nt, Human
uagagcaaaaaucaaauagcaaaggacacuagccagaaaauacagugugugugugugca

SEQ ID NO: 106776 - RNA, 59 nt, Human
aguccuuagugcaaaccaccauuggaaucuagccagaaaugucugucagauaguuagaa

SEQ ID NO: 106777 - RNA, 59 nt, Human
acuuucaguucuaaagcugauaaaguguguagccagaagaguacuuuuuuuuuuguaac

SEQ ID NO: 106778 - RNA, 59 nt, Human
aacccuaucucuacaaaaaauacaaaaauuagccagacaugguggcacaugccuuuagu

SEQ ID NO: 106779 - RNA, 59 nt, Human
cuuugggauaauuuauuuccuguggcaucuagccagaagaaauugaggauguuuccuuu

SEQ ID NO: 106780 - RNA, 59 nt, Human
uacuacuggaccuuauuuuggaacuaugguagccagaugauaaauaugguuaauuucau

SEQ ID NO: 106781 - RNA, 59 nt, Human
gaauuuugauggaugcaucucaaaauguauagccagacuugagaggugacaauuaaaga

SEQ ID NO: 106782 - RNA, 59 nt, Human
gaauagaauggcacuguccagcucugggcuagccagaucaacucccccacccgucuucu

SEQ ID NO: 106783 - RNA, 59 nt, Human
uuaagagacaagggagaaaacacaauguauagccagagaaggagaagcucccauccaaa

SEQ ID NO: 106784 - RNA, 59 nt, Human
aaggaggaucgucuuuaccugaggauuucuagccagaggucccagaugccugggcugag

SEQ ID NO: 106785 - RNA, 59 nt, Human
augaauguucauaguaacauuauacuucauagccagaaaguauaagcuaauacccauca

SEQ ID NO: 106786 - RNA, 59 nt, Human
uugagaguuagagaacuuuuaaauuucuuuagccagacaggucucuauuuuuuuaaguu

SEQ ID NO: 106787 - RNA, 59 nt, Human
gaaaagaaugauaggcuugucagagccuauagccagaacucagaaaaaauucaaaugca

SEQ ID NO: 106788 - RNA, 59 nt, Human
ugggcaagugaggauuuguaugcucccuguagccagaggugaaauauucaacgcuuuua

SEQ ID NO: 106789 - RNA, 59 nt, Human
gggugacagccacccagcccuccugaagauagccagagagcccaugagaccguccccca

SEQ ID NO: 106790 - RNA, 59 nt, Human
ugucacaccauuucuaaucugagcauccuuagccagagaauauucauuauacuuccuaa

SEQ ID NO: 106791 - RNA, 59 nt, Human
ucacaaacuagcugugucaaggcccgugauagccagaaagcggcaguuucaguccauau

SEQ ID NO: 106792 - RNA, 59 nt, Human
ccugagggagcuccaacucagaagggagcuagccagaggacugugaugcccugcccuug

SEQ ID NO: 106793 - RNA, 59 nt, Human
auuucuggaugaugaugauuguuauuuaauagccagaggcucauauaauuggccucuuu

SEQ ID NO: 106794 - RNA, 59 nt, Human
aacuccuggccuucgacuucuggcuggguuagccagacccugguuucucuacccugaug

SEQ ID NO: 106795 - RNA, 59 nt, Human
gacaacacaaauucaaaucauuauacguguagccagaaacucaagcauuuucacuaaag

SEQ ID NO: 106796 - RNA, 59 nt, Human
ugacaugguccuaaauaaaccuaacugaguagccagaagaaucacuucuaagguaaaca

SEQ ID NO: 106797 - RNA, 59 nt, Human
ucacauaagcucagaauccaagugaacacuagccagacacucugcucugcccuuguucc

SEQ ID NO: 106798 - RNA, 59 nt, Human
uuuuuuuaauuuaucuaauggcuacgauauagccagauucaaauaacauauguacucaa

SEQ ID NO: 106799 - RNA, 59 nt, Human
accccagugaggaaguagauugcugccucuagccagagaccugaacuggggaauuugaa

SEQ ID NO: 106800 - RNA, 59 nt, Human
augaauccauuggagaagcgguggauaacuagccagacaaaauuugagaauacauaaac

SEQ ID NO: 106801 - RNA, 59 nt, Human
cauugccuaacagaugcagcagcagucuuuagccagagaacucucuggaaccauuaaag

SEQ ID NO: 106802 - RNA, 59 nt, Human
ugaccugaagcauaguccaggagcagaguuagccagaaaugccuccugcugccccagcc

SEQ ID NO: 106803 - RNA, 59 nt, Human
auuacgucccuuuucuuuuuggggagggguagccagaggagugaguuuuucauuuagau

SEQ ID NO: 106804 - RNA, 59 nt, Human
ccccgucucuacaaaaauacaaaagaaauuagccagacaugauggcgggugccucuaau

SEQ ID NO: 106805 - RNA, 59 nt, Human
gggagaaagggguagugauacaagucucauagccagagaugguuuuccacuccuucuag

SEQ ID NO: 106806 - RNA, 59 nt, Human
ucagcuacccuccagacaagggcaagaguuagccagaugcuccaggcagugggaagcca

SEQ ID NO: 106807 - RNA, 59 nt, Human
ccaauagaaaugcuaacaucccugccugguagccagacuagcccacuaaagcuccccug

SEQ ID NO: 106808 - RNA, 59 nt, Human
cccccacugacuuggacauaagugaaaacuagccagaagucucuuuuucaaauuacuua

SEQ ID NO: 106809 - RNA, 59 nt, Human
augcccgggcauccgcugcugcuacaucuuagccagaacuugaagucuuuugucccagu

SEQ ID NO: 106810 - RNA, 59 nt, Human
gagggaaguggagcagccagcaaguaagcuagccagaguuuucucaagagccagcuuug

SEQ ID NO: 106811 - RNA, 59 nt, Human
ccugcccuugguuucccagaccccugcuauagccagagaacaauaaagaagggagacca

SEQ ID NO: 106812 - RNA, 59 nt, Human
ucaccaucucuucauucaaacugcacuuuuagccagagaugcaauauauccccacuacu

SEQ ID NO: 106813 - RNA, 59 nt, Human
auucucagaagauguuaauaguuuguuacuagccagagaguaugacuauguuagauuau

SEQ ID NO: 106814 - RNA, 59 nt, Human
uggcuugauauuacuauauuuuaacugaauagccagagcaucuaaguacagguguucuu

SEQ ID NO: 106815 - RNA, 59 nt, Human
aagacguuuauucugaugauaaaaacaguuagccagacuguuuuuaaagcaccuggcgg

SEQ ID NO: 106816 - RNA, 59 nt, Human
ugacagaagauacuuuagguggaacuauguagccagauucccauccaugaaaggcaagu

SEQ ID NO: 106817 - RNA, 59 nt, Human
acguuuuacucugauaucauugugcacuuuagccagauccagaaaacacucaaauuuau

SEQ ID NO: 106818 - RNA, 59 nt, Human
guaccuaaagggagaaggaccccaugugcuagccagaaauauacugucucuugaaggaa

SEQ ID NO: 106819 - RNA, 59 nt, Human
ccauagauccuaagcucuugacuguaguuuagccagacuuguuuugcuaucuuauaagc

SEQ ID NO: 106820 - RNA, 59 nt, Human
aaccccuucucuacugaaaauacaaaaauuagccagacgugauggcacauaccuguaau

SEQ ID NO: 106821 - RNA, 59 nt, Human
auuuaaaaggaaaaaaaagaauuuuaucuuagccagaaugucccuggauucaggggugu

SEQ ID NO: 106822 - RNA, 59 nt, Human
aacagaucaugaacuaacugaaacucagcuagccagaaugaacaacacaaccggaagcg

SEQ ID NO: 106823 - RNA, 59 nt, Human
ggcuccucuaguaagaugcacugaaaacuuagccagaguuagguugucuccaggccaug

SEQ ID NO: 106824 - RNA, 59 nt, Human
gaaauuguguuugcuaacaaggugcccuuuagccagaugcuaggcugucugcgaagaag

SEQ ID NO: 106825 - RNA, 59 nt, Human
agagcaaaacucugucucaaaaaaaaaauuagccagauguggugacgcaugccuguagu

SEQ ID NO: 106826 - RNA, 59 nt, Human
auagguaguaauuuguucaaaagcgguuuuagccagacaucuaguugcaguguucaaga

SEQ ID NO: 106827 - RNA, 59 nt, Human
uagaauaauauauugaaugccuuuugauuuagccagagucucugaugauuagcuuucac

SEQ ID NO: 106828 - RNA, 59 nt, Human
ucugcuaaaguucaaaguucacaucaguguagccagagugaagcaucuuuguuagcagu

SEQ ID NO: 106829 - RNA, 59 nt, Human
aguuccauggcaauuuuguaaauugacccuagccagagaauagaucaguauuucacuga

SEQ ID NO: 106830 - RNA, 59 nt, Human
acuuuccacaguuggacaugguguuaguauagccagacggguuucauuauuauuucucu

SEQ ID NO: 106831 - RNA, 59 nt, Human
ucaccuuuuaaaaacuuguuccuuaauuuuagccagaaagcaaaaaaacaauaguaaug

SEQ ID NO: 106832 - RNA, 59 nt, Human
acccugucucuacuaaaaaaaagaaaaauuagccagacgugguggcaugcgccuguaau

SEQ ID NO: 106833 - RNA, 59 nt, Human
auucugccaugucuuucccucucucugcauagccagauuugaagugacugauacccacc

SEQ ID NO: 106834 - RNA, 59 nt, Human
aaacgcauggaacaacuauccauggcucuuagccagaaaugucuugccucuggucucug

SEQ ID NO: 106835 - RNA, 59 nt, Human
uucuugagcagaugauuccccuaguugaguagccagaugaaauucaagccuaaagacaa

SEQ ID NO: 106836 - RNA, 59 nt, Human
ggaaaaaggcagugaauaauuaugcaaauuagccagaagaaggggaaccgugcuaaugg

SEQ ID NO: 106837 - RNA, 59 nt, Human
auauaugugaauauguguauauauguacauagccagagagucaugccacguggucauua

SEQ ID NO: 106838 - RNA, 59 nt, Human
uuucaaguaauaccaguacuguuuaacuauagccagaacuggcuaaaauuuuuauauuu

SEQ ID NO: 106839 - RNA, 59 nt, Human
uacaaucugggauaguuugggggaacuuguagccagaaugcccuguucaugcugagcaa

SEQ ID NO: 106840 - RNA, 59 nt, Human
gcugacaaucuuugccaaaucuuccuugcuagccagaaguggaauuggcagcuucuaga

SEQ ID NO: 106841 - RNA, 59 nt, Human
uguagaacucagcaguugacauccaaaucuagccagagcccuucacugccaugauagcu

SEQ ID NO: 106842 - RNA, 59 nt, Human
agcuggugugaggguugugucagcagcuguagccagagagagguguugacucugagaga

SEQ ID NO: 106843 - RNA, 59 nt, Human
ugccuuguuuuguuuuguuguuuuguauuuagccagaggaugccaaaauuagucuucuc

SEQ ID NO: 106844 - RNA, 59 nt, Human
uuaugcaaaaagaauuuucccagauaggcuagccagaaaaaacuucaaguccucuguaa

SEQ ID NO: 106845 - RNA, 59 nt, Human
acccugucucuaccaaaaauacaaaaaauuagccagauauuguggcaggcacuuuuaau

SEQ ID NO: 106846 - RNA, 59 nt, Human
guugagugugguacauuaacucuccauuuuagccagaagauaccugauaagagaaggug

SEQ ID NO: 106847 - RNA, 59 nt, Human
uagaacuucuagaacaucuuguuuacaguuagccagaaacuauacaagugguuuaacau

SEQ ID NO: 106848 - RNA, 59 nt, Human
guuggcaccaguucccccuggaugggcuauagccagaacauuuacuucaacucuaccuu

SEQ ID NO: 106849 - RNA, 59 nt, Human
uaccuugaccaucguccuuccucucaagcuagccagagggugggagccuaaggaagcgu

SEQ ID NO: 106850 - RNA, 59 nt, Human
aaagacucacaggugaccugcuaucgagauagccagagggucaggagagaaugggggag

SEQ ID NO: 106851 - RNA, 59 nt, Human
ccugaugguuucucccagacuagaccaaauagccagaaaaaugauaggggucggauggg

SEQ ID NO: 106852 - RNA, 59 nt, Human
accccgucucugcuaaaaauacaaaaaauuagccagaugugguggugcacaccuguagu

SEQ ID NO: 106853 - RNA, 59 nt, Human
ccccgacccacuaccuggagauagccagauagccagaugcccugcuccuggccaccuuu

SEQ ID NO: 106854 - RNA, 59 nt, Human
cagagccuccccgacccacuaccuggagauagccagauagccagaugcccugcuccugg

SEQ ID NO: 106855 - RNA, 59 nt, Human
gggggaaggaaagcuacgccauccuuccuuagccagagagggagaaccagccagaugau

SEQ ID NO: 106856 - RNA, 59 nt, Human
ucagccuugcagauauguguggcauuuacuagccagagcucugaaaggcagugcugucu

SEQ ID NO: 106857 - RNA, 59 nt, Human
acugccuuuuauuuuuuaaccuuaaaaaguagccagauaguaacaagacuggcuggcug

SEQ ID NO: 106858 - RNA, 59 nt, Human
ucaagcuaauggggaugaugauccugguuuagccagaguucaaaacucuccagucauug

SEQ ID NO: 106859 - RNA, 59 nt, Human
uuuuuuaaaucaaugcaaguuacacauuauagccagaaucuguaucacagaggugcaag

SEQ ID NO: 106860 - RNA, 59 nt, Human
cagcacgggugacuucuuuuucucuucauuagccagagaugacuaauuuaaauuuagaa

SEQ ID NO: 106861 - RNA, 59 nt, Human
gaagggucucuguuaauccuacucugcuuuagccagaauagccuaguauuuuauuucua

SEQ ID NO: 106862 - RNA, 59 nt, Human
aaccccaucucuaccaaaaauacaaaaauuagccagacgugguggugcacgccuuuaau

SEQ ID NO: 106863 - RNA, 59 nt, Human
gcuguuucauacuaggacuugggaugauguagccagaauaaaacucaaguugcacccuc

SEQ ID NO: 106864 - RNA, 59 nt, Human
aauauauauauaauauauguauguauguauagccagaugcaguggcacaugccuguaau

SEQ ID NO: 106865 - RNA, 59 nt, Human
gagcccuccacagcucagcaaagccucuguagccagacugccucucuagauuccuccuc

SEQ ID NO: 106866 - RNA, 59 nt, Human
ccaggaguuagagaucagccugggcaacauagccagaccuccucucuacaaaaagaaaa

SEQ ID NO: 106867 - RNA, 59 nt, Human
aaagacaguagucauuguggagaaacaucuagccagauuggagauacuguugugaacaa

SEQ ID NO: 106868 - RNA, 59 nt, Human
gggaccuuuuuccugaagagagcuggguguagccagagcuacuggcaccuaccccgagc

SEQ ID NO: 106869 - RNA, 59 nt, Human
ccccauauccauuaaaaauauuuaaaaauuagccagacaugguggcacgcgucuguggu

SEQ ID NO: 106870 - RNA, 59 nt, Human
uguauaguucauugcaccaugaguuauaguagccagaaguugggaaacaaaugcugucu

SEQ ID NO: 106871 - RNA, 59 nt, Human
cuuaacgacauguuccugcugcagauaacuagccagacccaucccuuuauuucagccca

SEQ ID NO: 106872 - RNA, 59 nt, Human
uuuuuaguagagacuggguuucaccguguuagccagaauggucucuaucuucugacuuu

SEQ ID NO: 106873 - RNA, 59 nt, Human
ggugccaagcucagagggggaaaaaaagauagccagagagagaccuggcccucaaaaag

SEQ ID NO: 106874 - RNA, 59 nt, Human
ugaagccccaggucucagagagcaagcuguagccagagguaccagcuucgccuggggcu

SEQ ID NO: 106875 - RNA, 59 nt, Human
aagguggaacuagaagguguuuucagcaauagccagagcacuggaggaaaaauaauuga

SEQ ID NO: 106876 - RNA, 59 nt, Human
aauaggcauuaaaugcaaaaauauauauguagccagacaguuuaugagaaugacccugu

SEQ ID NO: 106877 - RNA, 59 nt, Human
gaccucgucucuacaaaaaaugcaaaaauuagccagauguggcggcaugucccuguggu

SEQ ID NO: 106878 - RNA, 59 nt, Human
uuuuuaguagagaugggguuucgccauguuagccagacuggucucgaacuccugaccuc

SEQ ID NO: 106879 - RNA, 59 nt, Human
ggggguuguaauuuauaagcugacgaagguagccagacuuccggaggacugaccaucuc

SEQ ID NO: 106880 - RNA, 59 nt, Human
guucucuguugagucugcccuccguguuguagccagaccuuguggagauggcuuugcgg

SEQ ID NO: 106881 - RNA, 59 nt, Human
augggguaccuaguccccagccugcucccuagccagaggcucuaauguacaauaaagca

SEQ ID NO: 106882 - RNA, 59 nt, Human; identical to SEQ ID NO: 106881

SEQ ID NO: 106883 - RNA, 59 nt, Human
acaagcuaauauggaaaccacauguaacuuagccagacuauaccuuguguagcuucaag

SEQ ID NO: 106884 - RNA, 59 nt, Human
agaggaggggugguguccuucuccucuuguagccagaauucuggacaacccaagucucu

SEQ ID NO: 106885 - RNA, 59 nt, Human
ggggcaggggaggacuggggagggcuggcuagccagaggaguuggcuguaucaccccug

SEQ ID NO: 106886 - RNA, 59 nt, Human
aacccuuaaaagaaggacccuuuuuggacuagccagaauucuacccuggaaaaguguua

SEQ ID NO: 106887 - RNA, 59 nt, Human
agcccaaaccuaucaccaccuguugggcauagccagagcuguucccacccagccagggc

SEQ ID NO: 106888 - RNA, 59 nt, Human
uguaaaccucaaauuaccucuggaucucuuagccagaggaauaaacuggcaauuauuac

SEQ ID NO: 106889 - RNA, 59 nt, Human
caauuauguacagggagcugucugagagcuagccagaacugggguacagccugggcuca

SEQ ID NO: 106890 - RNA, 59 nt, Human
accgaaucugaaacuuugggaauuugcuuuagccagaauaaagaaaccaaaucaugaaa

SEQ ID NO: 106891 - RNA, 59 nt, Human
acccuugucucuauuaaaaacacaaaaauuagccagaugugguggcacaugccuguaau

SEQ ID NO: 106892 - RNA, 59 nt, Human
agaagcuaauauggaaaccacauguaacuuagccagacuauauuguguagcuucaagaa

SEQ ID NO: 106893 - RNA, 59 nt, Human
accucgugucuacuaaaaauacaagaaacuagccagaugcgguggcacccgccuguaau

SEQ ID NO: 106894 - RNA, 64 nt, Human
acaggggcauugacagacuggaguugaaagccgacgaaccgacacgcggcagagucaauaauuc

SEQ ID NO: 106895 - RNA, 64 nt, Human
ccucagccucagcaacccagggagaggacagaaacgaaccgaugguugagggauugucacggga

SEQ ID NO: 106896 - RNA, 64 nt, Human
guccuuuccacacaggccagaagaggucuucaggcgaaccgaccuucccccuucuggcauuuca

SEQ ID NO: 106897 - RNA, 64 nt, Human
cagccagccgcguggaucccacgcagcgcugaaccgaaccgaguaggaagccuuucuccccagg

SEQ ID NO: 106898 - RNA, 64 nt, Human
ccaagagcacuuauugacccuuccucaggccucccgaaccgacuuccuccaggcgcugugcccc

SEQ ID NO: 106899 - RNA, 64 nt, Human
ugcaacacgacgcucaccgcggcucgggccguggggccgucagagaaaccuuuuuaaaaaaugg

SEQ ID NO: 106900 - RNA, 64 nt, Human
gcucugcuuuauacagacccaagcauacacaccaggccgucacuuuggguucuggcauaaguuc

SEQ ID NO: 106901 - RNA, 64 nt, Human
cugcgccccccaggggcccuguggggacugcuggggccgucaccaacccggacuuguacagagc

SEQ ID NO: 106902 - RNA, 64 nt, Human
gccugacaagaacauauuguuucccugaccccuaggccgucacaccacacccuccauuuccuca

SEQ ID NO: 106903 - RNA, 64 nt, Human
gcugaggauggagaggcaggggagggaggcgggaggccgucacuggaguggcgucugcagcagc

SEQ ID NO: 106904 - RNA, 64 nt, Human
aggcaaggugguaggcaccaucuggguccccuguggccgucacagugucugcugugauugagau

SEQ ID NO: 106905 - RNA, 64 nt, Human
uggggcaaggguuuccuucugccccagcagggcuggccgucaguccccugcuugguaguggugu

SEQ ID NO: 106906 - RNA, 64 nt, Human
gcccuguccugucauguguccucaccgggguaucggccgucacucagcucuccugugccccugc

SEQ ID NO: 106907 - RNA, 64 nt, Human
accaauguguccuagaaccaccugccucacagcuggccgucacuuguggggguccacgggacga

SEQ ID NO: 106908 - RNA, 64 nt, Human
gucugucauuagguguguguuagggugcagcaccggccgucacaggaugcugauaagcgcgcug

SEQ ID NO: 106909 - RNA, 64 nt, Human
gcaaaggugagcugggggcgagaaaggccucuguggccgucaucggcacuagcggguugggggu

SEQ ID NO: 106910 - RNA, 64 nt, Human
cgacccacacaccuuuggccucaucgcugaccugggccgucagagcuuccagugcgcagccuuc

SEQ ID NO: 106911 - RNA, 64 nt, Human
agcaggcacagcacaaggcaggcccagccccaugggccgucacaaaggcuugaucacugccugg

SEQ ID NO: 106912 - RNA, 64 nt, Human
uugagcacacaccaugaagaucaccagcuuggauggccgucaccucagacaucacuccagggag

SEQ ID NO: 106913 - RNA, 64 nt, Human
ggacccaaugggcgcccugcacacccguuucuggggccgucagacuuggauacaucguaaacuc

SEQ ID NO: 106914 - RNA, 64 nt, Human
cgcgcacaaucaaggagcuggaacacacucuccaggccgucaaauuauucucuuguucauuuuc

SEQ ID NO: 106915 - RNA, 64 nt, Human
ccaaacauaaccucccaaucuuuuuuguuaguccggccgucaauuguauaguaccaauuucgua

SEQ ID NO: 106916 - RNA, 64 nt, Human
aggggcccggcuuuucaggcuugcccucaccagcggccgucagccgacacucagggauguagcu

SEQ ID NO: 106917 - RNA, 64 nt, Human
gaucugugaacgcguguugucucaaaccagucagggccgucaugacuacgcagcagcagcaguu

SEQ ID NO: 106918 - RNA, 64 nt, Human
ucugcuuuaaucaggacaccgugaggacaagugaggccgucagucuuggugugaugcggggugg

SEQ ID NO: 106919 - RNA, 64 nt, Human
gucacagaucccuaccugccuggcuaagacccguggccgucaaggacugguucgggguggauuc

SEQ ID NO: 106920 - RNA, 64 nt, Human
accucgguaugacugaaaagggaguuuucuguauggccgucacuagguuuuuuuguggguuagu

SEQ ID NO: 106921 - RNA, 64 nt, Human
aacguuaacuguuaauacauucauaaugcuguguggccgucaccgccguccaucuccauaggcu

SEQ ID NO: 106922 - RNA, 64 nt, Human
ucgugacaguauguagacugccauucucaucagcggccgucaggcuacugucugugauucuuuu

SEQ ID NO: 106923 - RNA, 64 nt, Human
cauuucuguaucccuggguugacugccaauccgaggccgucaugaagcucuguguugucuguuu

SEQ ID NO: 106924 - RNA, 64 nt, Human
cagggaaggcucugguggagaaccugugcaugaaggccgucaaccaguccauaggugagccugg

SEQ ID NO: 106925 - RNA, 64 nt, Human
aaccagcucuucaggagaagcacgccaugaaacaggccgucauggaaaugaugagucagaagau

SEQ ID NO: 106926 - RNA, 64 nt, Human
gaaguaugauggaucacguggaaagugaccagauggccgucauaguccuuuucucucaacucau

SEQ ID NO: 106927 - RNA, 64 nt, Human
guggagggcgcugaaacuucaucacacacugagaggccgucacagccccagaccacccgcuugg

SEQ ID NO: 106928 - RNA, 64 nt, Human
acucagauuuaagccuuacaaagggaaagccucuggccgucacacguaggacgcaugaagguca

SEQ ID NO: 106929 - RNA, 64 nt, Human
ugaaugacuugacuucaaaagcaacaaccuuaaaggccgucauuucauuaguauuccucauucu

SEQ ID NO: 106930 - RNA, 64 nt, Human
ccaguuuccauucacuugccuuacagccugcccuggccgucacuccccagcuuuguucagcaau

SEQ ID NO: 106931 - RNA, 64 nt, Human
agucuuaugugagccuggcugcucagcgucuccuggccgucaugacagcugcuuggagacccgu

SEQ ID NO: 106932 - RNA, 64 nt, Human
uccucucuaugggccauauuccgcacugggcacaggccgucacccugggagcagucggcacagu

SEQ ID NO: 106933 - RNA, 64 nt, Human
gucuguguuguguccugacaccuccaaguucuagggccgucaggacacgggaggguuuggggac

SEQ ID NO: 106934 - RNA, 64 nt, Human
gaggccaugugccauucucccgggcccagcgcccggccgucaccccacccgaugaccugcauga

SEQ ID NO: 106935 - RNA, 64 nt, Human
ggccgggcgcuccuggugugugacuggguguccuggccgucaugugcuugcucuuacagugccu

SEQ ID NO: 106936 - RNA, 64 nt, Human
gucucaugugcacgccccggccagcuaagccucgggccgucagcaauaccucugagugcccgga

SEQ ID NO: 106937 - RNA, 64 nt, Human
gaccgccccgcgggcccaggcgggccgggggcggggccgucauccagaccaaagccaugccauu

SEQ ID NO: 106938 - RNA, 64 nt, Human
cccugugccucugcggccccagcccagcucccagggccgucaccugcuuggcccuggcccagcu

SEQ ID NO: 106939 - RNA, 64 nt, Human
cucuugcuggcccgggaggaguuaacuuugcgccggccgucagggcauuaccgcuaacgucugc

SEQ ID NO: 106940 - RNA, 64 nt, Human
ccguccugcccaaguucuggggcagguaggagagggccgucacacaccuguccgcccgugagug

SEQ ID NO: 106941 - RNA, 64 nt, Human
cucugagccggagggcaccagggacucggcccagggccgucaaggaaagggcaguggacgugcu

SEQ ID NO: 106942 - RNA, 64 nt, Human
gcgcccaggaggaagggagggcagagggggcuguggccgucaguggaaugcagcugucaggccu

SEQ ID NO: 106943 - RNA, 64 nt, Human
agcaaaaucuaggacucccgaguggcuuccagggggccgucaguccucagccgcgccugugucc

SEQ ID NO: 106944 - RNA, 64 nt, Human
gcgcugggcucccacgaccccucaggacagaucuggccgucagccgcgggccgcugggaacucc

SEQ ID NO: 106945 - RNA, 64 nt, Human
cacacugcccgcccucaggcucucaggugaacguggccgucagcggggaaacgugugugucagu

SEQ ID NO: 106946 - RNA, 64 nt, Human
cgaggaacacggacaaugccuggaucgagacgguggccgucagcguccacuuccaggaccagaa

SEQ ID NO: 106947 - RNA, 64 nt, Human
uuugcugagaguuaggagcacuuggugaagacaaggccgucaggacccaccaugucugccccau

SEQ ID NO: 106948 - RNA, 64 nt, Human
augcugguccugaccagcuagccuacgcggggauggccgucaguucuggccacaggacccgagu

SEQ ID NO: 106949 - RNA, 64 nt, Human
gcaccagcaggugccaucacgcuugugaugugguggccgucacgcuuucaugaccacugggccu

SEQ ID NO: 106950 - RNA, 64 nt, Human
agaugcccauucaccagaaucucaaggagcugcuggccgucagggcggagcugcagaagcgugu

SEQ ID NO: 106951 - RNA, 64 nt, Human
cccggcucccaccggugccaaacccagccccugcggccgucaccccgccagccuacacugccag

SEQ ID NO: 106952 - RNA, 64 nt, Human
uccugaaucacccucgcuccgucaggcgggacucgugucccagagaggaaggggcugcugaggu

SEQ ID NO: 106953 - RNA, 64 nt, Human
guggacucgagcccaggggcugcccgucacagcggugucccaggucccugccauccgauuuuac

SEQ ID NO: 106954 - RNA, 64 nt, Human
aggcacccccaggcaagcucgagggggccacaccgugucccagggagcccagccuauucccguu

SEQ ID NO: 106955 - RNA, 64 nt, Human
gcaggugcggggugccaccuacaggcccaggccugugucccaagcaguacccaggcuuugcaga

SEQ ID NO: 106956 - RNA, 64 nt, Human
caucacgcaucacaggccgcgucuuugacggugggugucccauuuuuauccgcuacucuuuauu

SEQ ID NO: 106957 - RNA, 64 nt, Human
ugcagggcuggaggccagaggugucagcaacacugugucccaccacaaccuccagccucccuuu

SEQ ID NO: 106958 - RNA, 64 nt, Human
aacauagccgugaucaagaugagcacggaggcucgugucccagcaccuggcacacaguaagugc

SEQ ID NO: 106959 - RNA, 64 nt, Human
ucaaggccaagggacaguggucuaauucaacucugugucccagcaccuggcacaccagaagugc

SEQ ID NO: 106960 - RNA, 64 nt, Human
acuucucugucuggagacagccccagacccuuuugugucccaugcccacccuccccacgcugca

SEQ ID NO: 106961 - RNA, 64 nt, Human
gcuguagcaguggugccugggugccuggccuccagugucccaccuccuucaccaccccacuugg

SEQ ID NO: 106962 - RNA, 64 nt, Human
gaagcagcagagaaacugaaguguuagacacuaugugucccaccaccccauuacagagacauau

SEQ ID NO: 106963 - RNA, 64 nt, Human
gacacagucucauauccccaccccuucccacggcgugucccacggccagacacaugcacacaca

SEQ ID NO: 106964 - RNA, 64 nt, Human
guucuggcauaaguucagaacaauucaaguccaugugucccauggcuggucagagcccuggguc

SEQ ID NO: 106965 - RNA, 64 nt, Human
uggcagaauuuauuuaggaacagcccuuuugaaagugucccaguaacaacgcacccagcugcag

SEQ ID NO: 106966 - RNA, 64 nt, Human
cccagacagcagagcaaguauucacugaguaggggugucccaugacacuauuucauauucuaca

SEQ ID NO: 106967 - RNA, 64 nt, Human
gccaugcggaaguccaccgaaggguuagaacagggugucccagacucucucuucugagggaagg

SEQ ID NO: 106968 - RNA, 64 nt, Human
ccacaugugugccaaagccuaccccaccuggcaggugucccacagcaacagaaggaauaguagu

SEQ ID NO: 106969 - RNA, 64 nt, Human
ccugccauauucauaggguguccaugcacacauggugucccagaucuaggcaggccuaggaugg

SEQ ID NO: 106970 - RNA, 64 nt, Human
cccaucuuccucucgcagcuugaugagccccggugugucccaggagucggagaagcuggaaagu

SEQ ID NO: 106971 - RNA, 64 nt, Human
ggaagacgagagagggcuggacauccugcccaccgugucccagccagggcagggagggaccaug

SEQ ID NO: 106972 - RNA, 64 nt, Human
guccaagaggggcaggugggccucucuaggaucagugucccacccagaggccaguggccccuuc

SEQ ID NO: 106973 - RNA, 64 nt, Human
acuauuugugcaagucaguguuuuugaaaauucagugucccaauaaaaaguggacugcacacua

SEQ ID NO: 106974 - RNA, 64 nt, Human
auggauggggagaauggucaauacacauaagaccgugucccaaggagcugauuuccaggccccu

SEQ ID NO: 106975 - RNA, 64 nt, Human
ucuugagcaguggcugguccagggcuagugacuugugucccaugaucccuguguugucucuaga

SEQ ID NO: 106976 - RNA, 64 nt, Human
acagugagccccagaucuccuagcucuggcuucugugucccacacggccuguucccagcuucuc

SEQ ID NO: 106977 - RNA, 64 nt, Human
cuccaagcccccuggcacuucuguugcccugagagugucccaggggauucagagucuccagaaa

SEQ ID NO: 106978 - RNA, 64 nt, Human
agguggcccaggacaugcuccugcauacuccugggugucccagggacugugugcucaggagcac

SEQ ID NO: 106979 - RNA, 64 nt, Human
ucuauaaacuguaucauuuucugcugaggguggagugucccauccuuuuaaucaaggugauugu

SEQ ID NO: 106980 - RNA, 64 nt, Human
uguacccuaauuuuuagugugccccaaguuuggugugucccaauuuuugguauuguggcagaag

SEQ ID NO: 106981 - RNA, 64 nt, Human
acagaggaacggcuguuccaaggcuguuugcugggugucccacaaguuggguggacauaaauga

SEQ ID NO: 106982 - RNA, 64 nt, Human
ugcuguacccuaggaauauggggacauggacauggugucccaugcccagaugauaaacacugag

SEQ ID NO: 106983 - RNA, 64 nt, Human
gcaugcucacagucccuugccuauguguggcagagugucccagccagaugugugcccucacccc

SEQ ID NO: 106984 - RNA, 64 nt, Human
ggucugggcaucuguggauuuuuggcuacuagaagugucccagaagucacuguauuuuugaaac

SEQ ID NO: 106985 - RNA, 64 nt, Human
caacugugcuggccugcuguacaagcuucaaaaagugucccagagcccacacggcucgguguca

SEQ ID NO: 106986 - RNA, 64 nt, Human
gaaucaaaggaggauuuaccaugcccuuucgguugugucccacuuaacaaauugugaaguaaca

SEQ ID NO: 106987 - RNA, 64 nt, Human
ccagucccccgcgagcccggagaaggggagacccgugucccacaaggaccccaccggccugccu

SEQ ID NO: 106988 - RNA, 64 nt, Human
gucuuccccccucauuugcucucuucccuaaaaugugucccagaugccuucauuugcuguuuua

SEQ ID NO: 106989 - RNA, 64 nt, Human
gaccugcccacaacucccuugcacguaaacuucagugucccaccuugaccaaaaucagcuuugu

SEQ ID NO: 106990 - RNA, 64 nt, Human
aaaaaauaaaaagccagacuggugguauguaucugugucccagcuaauugggagggugaguugg

SEQ ID NO: 106991 - RNA, 64 nt, Human
uuggagcauuuuggggcacuaaucuuguucucuugugucccagcuuuuagaccucuuacuucca

SEQ ID NO: 106992 - RNA, 64 nt, Human
ccuaaaaucuaaaucauauaaucagaauucuauagugucccacucuaucuguaaagaucauuug

SEQ ID NO: 106993 - RNA, 64 nt, Human
auacugcggaccaagggacuccaaucugguaauggugucccaaagguaagucugagacccauca

SEQ ID NO: 106994 - RNA, 64 nt, Human
gcggagggagaggcgaugcugcaaaguguuuucugugucccacugucuugaagcugggccugcc

SEQ ID NO: 106995 - RNA, 64 nt, Human
ccaccagagcacaagagaagguggcuaccugggggugucccagggacucugucagugccuucag

SEQ ID NO: 106996 - RNA, 64 nt, Human
uuugcauuucuuccagugcaaugaaauucauauggugucccaccuuauuuaaugaugguacaau

SEQ ID NO: 106997 - RNA, 64 nt, Human
uggagcugcuuaguggaagauguaagugaggugggugucccaugugcuuggucuccccuucugc

SEQ ID NO: 106998 - RNA, 64 nt, Human
uuucauuucagaagcauuauucuguuuauuaacagugucccaucuacugaauagaaaacuuuga

SEQ ID NO: 106999 - RNA, 64 nt, Human
ugggaaaucgaggaggugggacgggcugggcccugugucccagguuucacagggcucaggguua

SEQ ID NO: 107000 - RNA, 64 nt, Human
uuuaaggguggucauuuuuuucaaguucucucaagugucccaaaucaggguagcaaucuuguug

SEQ ID NO: 107001 - RNA, 64 nt, Human
aggccucuaugggugggggcagaaggcagagccugugucccagggggacccacacgaagucacc

SEQ ID NO: 107002 - RNA, 64 nt, Human
uaagcuacaaacucggacagggucagaaacagaggugucccaucccauugcagccuccaccacc

SEQ ID NO: 107003 - RNA, 64 nt, Human
accuuugccuuauccaaccccucuucagagaaaggugucccauggccccaaaaagaacugccaa

SEQ ID NO: 107004 - RNA, 64 nt, Human
uucaggaacacgaggauucuugcuuucuggaaaagugucccagcuuagggauaagugucuagca

SEQ ID NO: 107005 - RNA, 64 nt, Human
aaauaaauaaauaaucgacucaaaaauaagucaugugucccagcauaaggcaucagguuguuag

SEQ ID NO: 107006 - RNA, 64 nt, Human
ugagcguuucuauccccucccccuggggugugcugugucccaccuggcccaccagaggcucacg

SEQ ID NO: 107007 - RNA, 64 nt, Human
gaccuggcagggcagaguacaagcccagcacccagugucccagccuuacuggguccuuacccug

SEQ ID NO: 107008 - RNA, 64 nt, Human
cagggacccagcacugggcuggguugggaguagggugucccagugggguuggggugagcaggcu

SEQ ID NO: 107009 - RNA, 64 nt, Human
acacaauguugcacugaaaacccaggccacaaaugugucccagugaacaguuuggauguccuca

SEQ ID NO: 107010 - RNA, 64 nt, Human
agcuuggggcuccccuauccagaaaauguugucagugucccaguggugacaucucaguuuggga

SEQ ID NO: 107011 - RNA, 64 nt, Human
gcucaaugcagaaaaacuagaaucugaagaagaugugucccaagcuuuccuugaggcuguugcu

SEQ ID NO: 107012 - RNA, 64 nt, Human
gucugcaugaaaucccuucuaggccucugccucagugucccaccucugccacaggagcugugau

SEQ ID NO: 107013 - RNA, 64 nt, Human
gacccacaauuacccguguuuuguuugaacagcagugucccaucuggcuucgacccaacaaagu

SEQ ID NO: 107014 - RNA, 64 nt, Human
cugguauuuucauacaaauucuucuaauugcugugugucccaggcagggagacgguuuccaggg

SEQ ID NO: 107015 - RNA, 64 nt, Human
gagcaaccauguuuuagcauaaugggaugaccuggugucccauuauaaauaaagggugguaugg

SEQ ID NO: 107016 - RNA, 64 nt, Human
uuauauaaaaaaaaggcuugucaauuaugaaggugugucccagauauuacaugaagaucaugca

SEQ ID NO: 107017 - RNA, 64 nt, Human
gauccugcgccucuggacgugcuagccauuuccagugucccaacuacugucaucgugagguuuu

SEQ ID NO: 107018 - RNA, 64 nt, Human
ccaugcaagagaggcccaaucucaacuguagacugugucccaguaagagagucacagcuucagg

SEQ ID NO: 107019 - RNA, 64 nt, Human
cccagucacaacugccauuuccagucucugcugagugucccagacccucgaggcugccacuccg

SEQ ID NO: 107020 - RNA, 64 nt, Human
ccuugguaguagugaccagucagugucagcaucagugucccaaccccagucucuguuuacugcc

SEQ ID NO: 107021 - RNA, 64 nt, Human
ugcugccucaaaaguucugugaguuucggggucagugucccacccuucacuucccgagggcggg

SEQ ID NO: 107022 - RNA, 64 nt, Human
cuaauuauuuuuuuaaaaagcugugcagugugaugugucccaaacggacuggcucauggguggc

SEQ ID NO: 107023 - RNA, 64 nt, Human
cugucuuggcacuggccaggcuuggguggagccugugucccagacagauccccuaggccuaucu

SEQ ID NO: 107024 - RNA, 64 nt, Human
gcauugcuguagagugacggcugcugcccagagcgugucccagacaucacagcggggcucagca

SEQ ID NO: 107025 - RNA, 64 nt, Human
uggauacauuucaagugcauuucaagccaccagagugucccauugcugccaaaaauacacgucu

SEQ ID NO: 107026 - RNA, 64 nt, Human
uauucuauguggaauagauccuguuuuuccaucugugucccagauugugacccuagacuuucaa

SEQ ID NO: 107027 - RNA, 64 nt, Human
gaguauuauagcuuucauuuuaguuugacauuuagugucccaaugaauugaauuucaaauauga

SEQ ID NO: 107028 - RNA, 64 nt, Human
agaccacaacaaaccaaaacauaaacucaugucugugucccauggucauagucaaagauuuugu

SEQ ID NO: 107029 - RNA, 64 nt, Human
gcgauguggagauuuaagaguggcuugggaugcugugucccaaggaauuucuuuucaccucuug

SEQ ID NO: 107030 - RNA, 64 nt, Human
gaaggagcacuggacuaaaggcuucaguggcugcgugucccaggacaggucauggccccucucu

SEQ ID NO: 107031 - RNA, 64 nt, Human
gggggacuggucaaaggacucuuaugucacugcagugucccauucuaggauugucugaaggcca

SEQ ID NO: 107032 - RNA, 64 nt, Human
gugagagaguggcuggggcauggaaggcaagauugugucccauucccccagugcggccagcucc

SEQ ID NO: 107033 - RNA, 64 nt, Human
uuacugucauaauucaguuuaagcuaugaacugugugucccaguaggaggucaagaaaaccucc

SEQ ID NO: 107034 - RNA, 64 nt, Human
gccagggugucucccgcuuuacucuucaggaauggugucccaaguuggaggcuuugugucagcu

SEQ ID NO: 107035 - RNA, 64 nt, Human
uucguaggggcacuuggaaucacaugguuguuuugugucccauggucaagcauucuaucuuauc

SEQ ID NO: 107036 - RNA, 64 nt, Human
ccagcuauaugaagcacuuugcagugaauggcaggugucccauaucugguuauguuaaccuaga

SEQ ID NO: 107037 - RNA, 64 nt, Human
cacagcaacagaagaccuauaccccggugccccugugucccacuacacacagaaaacccuguga

SEQ ID NO: 107038 - RNA, 64 nt, Human
aauucaagguaaaacagggucagugacaucugcagugucccagucauuuauuugcaugaaucug

SEQ ID NO: 107039 - RNA, 64 nt, Human
guugcccacugccuaacuguguacaguguuaccagugucccauuauggauaauucucaauaugu

SEQ ID NO: 107040 - RNA, 64 nt, Human
ugacagaacaacaagguuaagcuucaucugcuuggugucccacagaacuugcacaagcaguugu

SEQ ID NO: 107041 - RNA, 64 nt, Human
cuccuccaugggcagcaggagugagcggaggggugugucccacagcgacuuucccagccaaugc

SEQ ID NO: 107042 - RNA, 64 nt, Human
gaggacagaggggcccacacuuccuugccccuuugugucccaggccuggugcccagacuccuug

SEQ ID NO: 107043 - RNA, 64 nt, Human
uguccugacuucaucucuccuucugcccaagucugugucccaucagacuugcagccuuucagcu

SEQ ID NO: 107044 - RNA, 64 nt, Human
gugaaccacggguugaggaagucaggcuguuggcgugucccagcaccacaccaccccuaaagug

SEQ ID NO: 107045 - RNA, 64 nt, Human
cccccaccaaaaacacagugaaaggccugcuuuugugucccauucacaugcccucggucacuga

SEQ ID NO: 107046 - RNA, 64 nt, Human
gagacugaaauaggagcaagcagaacccugagaggugucccaucuuauugcuguugaggacccu

SEQ ID NO: 107047 - RNA, 64 nt, Human
uucucugcuuuuaaaaaaaccauugcaggugccagugucccauauguuccuccugacaguuuga

SEQ ID NO: 107048 - RNA, 64 nt, Human
aaccacucaccuuguucuaaaauagguuauuucagugucccagucaaauuccuauucuaacaug

SEQ ID NO: 107049 - RNA, 64 nt, Human
ugcggcgggacggugccuacggguacuugcagcugugucccauguggcaucccagagcugcgcc

SEQ ID NO: 107050 - RNA, 64 nt, Human
gccccggcugugacugcccuguuucaccccugcugugucccaucccccgucuguccacuaacug

SEQ ID NO: 107051 - RNA, 64 nt, Human
uugguauaauuuucauaaaaugucuuuuuuuuuagugucccaaagauaucuuagauaaacuauu

SEQ ID NO: 107052 - RNA, 64 nt, Human
ugcagugaaugcuugcaugcauucacacgugugugugucccagcuaguucacuccuuucgccgu

SEQ ID NO: 107053 - RNA, 64 nt, Human
auauugugccagcuuugcuccaaguauucuaaaugugucccaucaugcuuuccacugacccaaa

SEQ ID NO: 107054 - RNA, 64 nt, Human
cacccccuuacuuuaauucuugggccuccaauaagugucccauaggugucuggccaggcccacc

SEQ ID NO: 107055 - RNA, 64 nt, Human
ggcuaccagaacauggggcagguggcugguguuggugucccagccuaagagccaccugcugcag

SEQ ID NO: 107056 - RNA, 64 nt, Human
cuacaauaagcuaaaucagaauuuacaaauacaagugucccagguagcauugacucccgucauu

SEQ ID NO: 107057 - RNA, 64 nt, Human
gcaacuggaacaaggccccaccguaaagcucugugugucccagggucuuccugucacccaggcu

SEQ ID NO: 107058 - RNA, 64 nt, Human
cuugagacgggcuucaacaaugguuccugcuugggugucccagcgggcgccuauggcaaaaaca

SEQ ID NO: 107059 - RNA, 64 nt, Human
ccagggagcaaugggagggggcuccauggaggaggugucccaagcuuugaauacccccagagac

SEQ ID NO: 107060 - RNA, 64 nt, Human
ccauccucccaucgaugugccacgugggugucacgugucccagaugcaguauucggcagccagc

SEQ ID NO: 107061 - RNA, 64 nt, Human
aguaacuuuuuguauaaauaaaagaaaaugggacgugucccagcuccaggggugauggggguga

SEQ ID NO: 107062 - RNA, 64 nt, Human
aauuagaagacaggaagaaaacaaaaaccagacugugucccacaaucagaaaccuccguugugg

SEQ ID NO: 107063 - RNA, 64 nt, Human
uguaaguggacagaguccuggucagggggcaggagugucccaagggcuggcccaccugcugucu

SEQ ID NO: 107064 - RNA, 64 nt, Human
ugcacuaaccuagauuuucauuucgauauucccugugucccagcgcaguccugcucuccuguga

SEQ ID NO: 107065 - RNA, 64 nt, Human
ccuauuuccaaguucaaguuaacuagcuuugaaugugucccaaaacagcuuccuccauuuccug

SEQ ID NO: 107066 - RNA, 64 nt, Human
aagacacuauguuugggaauauaggaaacuaugugugucccaaggaaaucccuguaaauuuaac

SEQ ID NO: 107067 - RNA, 64 nt, Human
gccuuucagaaagucaacaagcaaaaugccuugagugucccaaaacacugaugccaugaugugg

SEQ ID NO: 107068 - RNA, 64 nt, Human
accagacugcuccaaacucaccucacuggcuucugugucccaagacuagguuguguacaguuua

SEQ ID NO: 107069 - RNA, 64 nt, Human
ucuuaggcauuucaggcuuccuuugggauuucaggugucccaugaucuugaugugcugcuaggc

SEQ ID NO: 107070 - RNA, 64 nt, Human
ccagaggggccacuguccccagccgcagccaacugugucccacaggaaugggagccuagguuuc

SEQ ID NO: 107071 - RNA, 64 nt, Human
ccacugagaugccagcuccuugagagcagugggggugucccaggccagagcagccucuuccucu

SEQ ID NO: 107072 - RNA, 64 nt, Human
agucauuuaaaaaauauauaaauacuaccuuguagugucccauacuguguuuuuuacaugguag

SEQ ID NO: 107073 - RNA, 64 nt, Human
acuuccuggacaaggaauguaggaagugagugcugugucccaggaagcugcucacacucuuaaa

SEQ ID NO: 107074 - RNA, 64 nt, Human
ucauugccaguagugccuucaucaguuaagggaggugucccagcacagaucauucucaaaagcg

SEQ ID NO: 107075 - RNA, 64 nt, Human
ggaggucaggcacggaccaguggcccagcccugggugucccaucaccaugugaccuuggacaug

SEQ ID NO: 107076 - RNA, 64 nt, Human
cugccuguaccccaaauguuaccagcucccugaggugucccacauacuauugugaguucucaga

SEQ ID NO: 107077 - RNA, 64 nt, Human
aauuuauccucauucaacacaggcccagaaaauugugucccagaaggaugucaguaauugugac

SEQ ID NO: 107078 - RNA, 64 nt, Human
cuccagaccgaguccuacccaccuucccccggaagugucccaagaggcuccgaaggccuccccu

SEQ ID NO: 107079 - RNA, 64 nt, Human
agcacucgaugucauccgugucgaugucauccgugugucccagacugucugcuguagaaaacac

SEQ ID NO: 107080 - RNA, 64 nt, Human
ucuucgagaguauagaaccguucauucuugcuuugugucccauuccaucucuugaaaaaaugua

SEQ ID NO: 107081 - RNA, 64 nt, Human
gcucucguccucccgugccagcccccgcccgcccgugucccagaaugcacugcugaggagcaug

SEQ ID NO: 107082 - RNA, 64 nt, Human
auaggaauguccaccaugaacuugauacguccgugugucccagaugcugucauuagucuauaug

SEQ ID NO: 107083 - RNA, 62 nt, Human
gcagcaaugccguucagugacugcacagagccgugucccagacacgcugucagugccuucaa

SEQ ID NO: 107084 - RNA, 64 nt, Human
cgugguuuuagauuuacgaauccugucuucuguugugucccacagaaaaacccaugagguuuuu

SEQ ID NO: 107085 - RNA, 64 nt, Human
gggucggccgguucccugcauucguuuuacuuuggugucccagaaacacgcgagugugcaaugu

SEQ ID NO: 107086 - RNA, 64 nt, Human
agacagaaccacagggcuauuuuguuugcuucaugugucccagaagaugacugagggugaguug

SEQ ID NO: 107087 - RNA, 64 nt, Human
uaugguugacuaauuaaacaauaauucaaguagagugucccagaaaaaaaccacuugggcuccc

SEQ ID NO: 107088 - RNA, 64 nt, Human
aaaacugaauacaagauaccaaaaaugaaaaaaagugucccauuuuuaauaacuauauucuauu

SEQ ID NO: 107089 - RNA, 64 nt, Human
aaguuccucacccagcaagggacuauagauacucgugucccaauuccaaaacacaaugcacaag

SEQ ID NO: 107090 - RNA, 64 nt, Human
ccauguucuuccucuuugaaaagaaaaggggaaugugucccacuagugaaaggaaaacuuuuca

SEQ ID NO: 107091 - RNA, 64 nt, Human
acccagucuuucucuguccccagucucaagcagggugucccacuggagagaucucuuggcuucc

SEQ ID NO: 107092 - RNA, 64 nt, Human
uccugucuuuuccagcuggagcagcugggcaugagugucccaccugcaacaaggugggcguuua

SEQ ID NO: 107093 - RNA, 64 nt, Human
uccagaggaugucauaugggaguuuuagagagcugugucccaaggaugaagguguggcuguggg

SEQ ID NO: 107094 - RNA, 64 nt, Human
ugaaacacauacauuggauaugggagguaaaggagugucccaguugcuccuggucacucccuuu

SEQ ID NO: 107095 - RNA, 64 nt, Human
gaggcccugccauccuugggcccuggcaguggcugugucccagugagcuuuacucacguggccc

SEQ ID NO: 107096 - RNA, 64 nt, Human
ggcgcuuugaggggucucccucggggaccguucagugucccaggcagcacagugugugaacugc

SEQ ID NO: 107097 - RNA, 64 nt, Human
guuuuguucaucuuccaccaccuuugaggaccucgugucccaaaagacuuugccuaucccagca

SEQ ID NO: 107098 - RNA, 62 nt, Human
uccaugucaccgcacuguagaggccggucuuggugucccaucccugucacagccgcucacuc

SEQ ID NO: 107099 - RNA, 64 nt, Human
ccaccucugccucuugggucagcccuccuugacugugucccagccagcaccaggccagcagccu

SEQ ID NO: 107100 - RNA, 64 nt, Human
gcaaauguaacaccauaacaguagggaauaaacugugucccaccuguuuacuuguguuuauuug

SEQ ID NO: 107101 - RNA, 64 nt, Human
gagauagaauagagggugaugacgguaagagcaagugucccaugaaugugauuuccuggguucu

SEQ ID NO: 107102 - RNA, 64 nt, Human
acuuggguccaguauuuacggaggcguugugaaugugucccaugcauaacacacuacuggauag

SEQ ID NO: 107103 - RNA, 64 nt, Human
gggauaguuccaagucuguccugucuucaucucugugucccaucucuacaacccacauacagac

SEQ ID NO: 107104 - RNA, 64 nt, Human
ucagagcuuggcccucuuuccucuguggcaaagcgugucccauagaaaauuggguguguauacu

SEQ ID NO: 107105 - RNA, 64 nt, Human
auuuccccugucaguuuccccucucggccagguugugucccaaaauccccucagccucuucucu

SEQ ID NO: 107106 - RNA, 64 nt, Human
aaaaaaaccugguucaaguuuuuuuuaaaauguggugucccauuccaagggagaccaauuccua

SEQ ID NO: 107107 - RNA, 64 nt, Human
cauuucacauaucgacuaccugagaaauugcuuugugucccacuguuauuaaagcaaaaaguau

SEQ ID NO: 107108 - RNA, 64 nt, Human
uguagguauaggcauucuacccuuugaaauagcugugucccaaccuguugccauugauuuuuug

SEQ ID NO: 107109 - RNA, 64 nt, Human
cuccacaguccuucagaguuucagcugcauccuggugucccacccaggucgagcccccaggcuu

SEQ ID NO: 107110 - RNA, 64 nt, Human
ucacuuguaccuuccacaagacucagaauccacagugucccauuuuccgacuaggagacaucuu

SEQ ID NO: 107111 - RNA, 64 nt, Human
acccccuaauugucuguuaaagccaauucucugggugucccagugagugguggcuuuuuuucuu

SEQ ID NO: 107112 - RNA, 64 nt, Human
ucaccgcuggagaagaaccaccacuguccucgaugugucccaagccuggagcgaauccguccuc

SEQ ID NO: 107113 - RNA, 64 nt, Human
gauucuugaacaaacuggaaaguacguuaugauagugucccacggugccuuggggacaagagca

SEQ ID NO: 107114 - RNA, 64 nt, Human
cuuaagaaaaucacaauuucagcuaacagcaauugugucccaaagaugaagauacuauaaccuc

SEQ ID NO: 107115 - RNA, 64 nt, Human
cuccagcucacccucacucagcucacuuucugacgugucccagccugucuguuggagcaaaggc

SEQ ID NO: 107116 - RNA, 64 nt, Human
cuuggcccugcaagcuuaggaugagaaccacuuagugucccauucuacuccucucauucccucu

SEQ ID NO: 107117 - RNA, 64 nt, Human
uguuuguuuuuguuuugagacagagucucacucugugucccaggcuggagugcaguggcacagu

SEQ ID NO: 107118 - RNA, 64 nt, Human
aggcaaggcaugcauaagagucauuugagaccaugugucccaucucaagccacagagcaacuca

SEQ ID NO: 107119 - RNA, 64 nt, Human
aaaauuuuaaucuaacccuuauguguauaaauuggugucccauaccagcuuuuaaugguggacc

SEQ ID NO: 107120 - RNA, 64 nt, Human
accaauucuaugcgccaaaauacaacagggggaugugucccaguacacuuacaaauaaaacaua

SEQ ID NO: 107121 - RNA, 64 nt, Human
aaaugaguauuaaacaguauuugaaacagagaacgugucccagggcccaaaagucagaagggcc

SEQ ID NO: 107122 - RNA, 64 nt, Human
auguaaauuugacugucaccucugaauuuguucagugucccaccauggucuaugagaaguacac

SEQ ID NO: 107123 - RNA, 64 nt, Human
gaugggugcaaauggaaccuggaugugugcacgugugucccagguagggacggcacaggagggu

SEQ ID NO: 107124 - RNA, 64 nt, Human
ccguuggccgugguugguggggguggacgugggggugucccaccuggaccagacuggcgugggu

SEQ ID NO: 107125 - RNA, 64 nt, Human
gagccuauuggacacaccuggcgacguauaccaggugucccaccccugccaccauggggccucc

SEQ ID NO: 107126 - RNA, 64 nt, Human
guaacugucuccacucacagccugaaauucuccugugucccaaaccccagggggccccagcagc

SEQ ID NO: 107127 - RNA, 64 nt, Human
gacagaauguaucugugaaguaguucuguuuggugugucccauugguguugucauuguaaacaa

SEQ ID NO: 107128 - RNA, 64 nt, Human
agaaagggcugcugucauagugaacaauuuauaagugucccauggggcagacacuccuuuuuuc

SEQ ID NO: 107129 - RNA, 64 nt, Human
cgguuaguuuccuccacaggcuuccaugagcucagugucccaagacagcaaaaaucugguauac

SEQ ID NO: 107130 - RNA, 64 nt, Human
gggcuucagcuguagcacuuggcagaaacgugaugugucccacaaacugcugguggaggaagaa

SEQ ID NO: 107131 - RNA, 64 nt, Human
uugggcagcuucugugguguaaauucucccagcagugucccaugucaugcugccagcaucacug

SEQ ID NO: 107132 - RNA, 64 nt, Human
gccggggucacaccugccaggacuccgcuucuccgugucccagcagaaggcaugcaggacccug

SEQ ID NO: 107133 - RNA, 64 nt, Human
cucagaagaagccuucucuuccuccugccuguaggugucccagaagugagaaggcagccuucga

SEQ ID NO: 107134 - RNA, 64 nt, Human
ggccaggagcaaaaccuacaucaacaugcgggaggugucccagcgcuuccgccugccucccagc

SEQ ID NO: 107135 - RNA, 64 nt, Human
gucucaguucaacagcauacagccaacaucuauggugucccaggcacagugccaggccccggga

SEQ ID NO: 107136 - RNA, 64 nt, Human
agggaccccucgccccagccucauuccccauucugugucccaugucccgugucuccucggucgc

SEQ ID NO: 107137 - RNA, 64 nt, Human
cuauguggcuuuucuuugucuuccccaaggcugagugucccaguuuuaucugcuccugagacug

SEQ ID NO: 107138 - RNA, 64 nt, Human
uccaggugugcacguggcauguggccuguggccugugucccaugacccaccccugugcuccgug

SEQ ID NO: 107139 - RNA, 64 nt, Human
cuuaccugcaaacuccuuguaggucugcagaugugugucccauggcagacaaagcacccuguag

SEQ ID NO: 107140 - RNA, 64 nt, Human
aaauauaacgagggauaaauuuuugguggugauagugucccaguacaaaaaggcuguaagauag

SEQ ID NO: 107141 - RNA, 64 nt, Human
uauauuuucuugccucuuccggacauucaugcuugugucccaagcauucccuuggugaauuguc

SEQ ID NO: 107142 - RNA, 64 nt, Human
cgccauggagcagaggcggggacagcuggccaccgugucccaggaccguaccguccgcaucugg

SEQ ID NO: 107143 - RNA, 64 nt, Human
ccucuccugaaagaccagagauuguguauuuucagugucccauguuccgacugcaccuucuuua

SEQ ID NO: 107144 - RNA, 64 nt, Human
accacgagggcagcugugacuacaggccugugcggugucccaacaaccccagcugccccccgcu

SEQ ID NO: 107145 - RNA, 64 nt, Human
aagcggagggaggcuguggucgcugccggccuaggugucccaggugccccgccuuucucuggga

SEQ ID NO: 107146 - RNA, 64 nt, Human
ccaucagcacuaacgcccugcuccaucggcacuggugucccacuccauugucacuaacguccgg

SEQ ID NO: 107147 - RNA, 64 nt, Human
aggcagcacaguagggcgccgggccuuugggacagugucccagcuuccccugggguucaccccu

SEQ ID NO: 107148 - RNA, 64 nt, Human
gggcuuccucauaguaugguggcuggguuggagggugucccaaaaagaaaggaggggauagaga

SEQ ID NO: 107149 - RNA, 64 nt, Human
ggggccuggagaaaaucauuuucuccccuuggcagugucccagggcccuggaugguccucuuac

SEQ ID NO: 107150 - RNA, 64 nt, Human
ccugaauuucagugacacauagugcagcccggcagugucccacuuccguggagagagccgcugg

SEQ ID NO: 107151 - RNA, 64 nt, Human
aaagucugcaagggcauaaauuuagggggaaaaagugucccaguucucuccuacagaaaaaaua

SEQ ID NO: 107152 - RNA, 64 nt, Human
aauauucuuuucauacagcaaguaugggacagcagugucccagguaaaggacauaaauguuaca

SEQ ID NO: 107153 - RNA, 64 nt, Human
gcugcagcggauuucggccuggcccgggccuauggugucccaguaaagccaaugacccccaagg

SEQ ID NO: 107154 - RNA, 64 nt, Human
ggguaguggggaggucagggaggcggggccaagggugucccacauucccaacaccgcccucuga

SEQ ID NO: 107155 - RNA, 64 nt, Human
uagaaagauucuucccacagggaagaacuagcaagugucccaauuuuuuccaaacguuggggag

SEQ ID NO: 107156 - RNA, 64 nt, Human
ugagggcauagcuccaugucuucugacauuccuggugucccaaagaauagcaaaaagccaguuu

SEQ ID NO: 107157 - RNA, 64 nt, Human
ugauaaauaggccugcauccauucuccugaggaugugucccaucuagggaaggcuggacuaggc

SEQ ID NO: 107158 - RNA, 64 nt, Human
gcugugcuguguuucuggaguccuuuggaaacaugugucccagaggagaagagguuugacuugc

SEQ ID NO: 107159 - RNA, 64 nt, Human
ugcguggcgcaggugccaugccugcucccugucugugucccagccacgcagggccauccacugu

SEQ ID NO: 107160 - RNA, 64 nt, Human
uggcuggaggagcuggccuguggcacagcccugagugucccaagccgggagccaacgaagccgg

SEQ ID NO: 107161 - RNA, 64 nt, Human
ggcccggcuuaacgcacuaacccagccucucccugugucccacagggaguagcaagacccaccc

SEQ ID NO: 107162 - RNA, 64 nt, Human
uggccacgugcccacagaugugcuguugguccaggugucccagucuggccacagcccugccucc

SEQ ID NO: 107163 - RNA, 64 nt, Human
aagcugccucggggccaccccuugcaaagggggugugucccacaaacgcugcuauggguggggu

SEQ ID NO: 107164 - RNA, 64 nt, Human
ucuuugaauccagggacuugaagaaagacuaggugugucccauccaaguugagcacgcgccuuc

SEQ ID NO: 107165 - RNA, 64 nt, Human
cucaaaagcuagcuugagggggcagaugccccaggugucccagcuccacagccccuggcagauc

SEQ ID NO: 107166 - RNA, 64 nt, Human
gcagcaaaaauccucuauggacauaggaggugcugugucccaugcccucuugcccugacagugu

SEQ ID NO: 107167 - RNA, 64 nt, Human
gaggugcugugucccaugcccucuugcccugacagugucccaugggcccccuucugcucccugc

SEQ ID NO: 107168 - RNA, 64 nt, Human
agggggcagaguggccugugagcaagagccaggggugucccagucccagccucuggggcagagc

SEQ ID NO: 107169 - RNA, 64 nt, Human
gccugaggguuagggaugucuccacccugauggggugucccagagacauuuucccauggcaguc

SEQ ID NO: 107170 - RNA, 64 nt, Human
gcccugccccacccccaccaccuguccccacccagugucccaggccacaggagcuuauuggcca

SEQ ID NO: 107171 - RNA, 64 nt, Human
uuucagccgcgcuucagcgaugacuccagucugggugucccagcgagccccugcagggacagua

SEQ ID NO: 107172 - RNA, 64 nt, Human
aggcaggcuauggcugccacccucccuccugccugugucccagugagaacugaccugagucccc

SEQ ID NO: 107173 - RNA, 64 nt, Human
gcauguuccauuucuaaaaagcccagaguucagugugucccaaggaaaacccaaaguggaggug

SEQ ID NO: 107174 - RNA, 64 nt, Human
ugugccccguggccccugugccuguucggugggggugucccagagaagccuggcaccaguaccc

SEQ ID NO: 107175 - RNA, 64 nt, Human
ccccccuccccuguguuuacgcgccccauccugugugucccagccuuuugagcagaaacugcca

SEQ ID NO: 107176 - RNA, 64 nt, Human
cccccaccccaucgugggugaggguauccccugugugucccaggccaauaaaaucuaccugcca

SEQ ID NO: 107177 - RNA, 64 nt, Human
uucggcaaauuagccccaaauugagcgcugaaucgugucccaugagaucaggcgccaucuguaa

SEQ ID NO: 107178 - RNA, 64 nt, Human
ugucccuugaguuucucaacugcuggaaggagcugugucccagcaaggaagggaaaccaucagg

SEQ ID NO: 107179 - RNA, 64 nt, Human
gaggagggguugcuccgccuggccuggccauacugugucccaucggagugcggaccacccucac

SEQ ID NO: 107180 - RNA, 64 nt, Human
accugccuacggcugaacggagccaggaggccacgugucccagcccagcguccaguggugccuc

SEQ ID NO: 107181 - RNA, 64 nt, Human
cuguguacuccucugacuggagucuaggaagggcgugucccaugggaaguggauacucuggggu

SEQ ID NO: 107182 - RNA, 64 nt, Human
ugcucccagcaucacaaggcacuugucuacaagugugucccaacacaguccugggccacuuucc

SEQ ID NO: 107183 - RNA, 64 nt, Human
aagacucaacaacaauaucacagaaucagaccaugugucccauggcaaugugaauccaauaguc

SEQ ID NO: 107184 - RNA, 64 nt, Human
cccucgcguccugguccacccaccucgucuacuagugucccacagugcugcgcuagucccuucu

SEQ ID NO: 107185 - RNA, 64 nt, Human
cuguguacucuuuaauagggauaucauguaccaggugucccaguagagcacugacaugugugug

SEQ ID NO: 107186 - RNA, 64 nt, Human
cuuuguguauuaugauucagugcuauuuguaacugugucccagugaccaaauugcacucgacuc

SEQ ID NO: 107187 - RNA, 64 nt, Human
auucugcguggaucggggguaagagagcucaccugugucccagcccucugaugguggugagacc

SEQ ID NO: 107188 - RNA, 64 nt, Human
cuuucaaccuguuuaguucaacucaagccucccugugucccagacccuccugcugccaccacca

SEQ ID NO: 107189 - RNA, 64 nt, Human
agggugggagagaaucaagcuccuguggccaccugugucccagcagcagugaguggagcugcuc

SEQ ID NO: 107190 - RNA, 64 nt, Human
ugugugggauguggguuguguguauaucuggcaugugucccagucacuugcagaagggugacuu

SEQ ID NO: 107191 - RNA, 64 nt, Human
accccaguugggcuuuggccccuccagcaaccuugugucccagcccugcccuucuucccacccc

SEQ ID NO: 107192 - RNA, 64 nt, Human
agucaguggggaggccaggauagaacuagagcuggugucccagguuccagucugggcucuucac

SEQ ID NO: 107193 - RNA, 64 nt, Human
agacuuaaugaugucuuauugggcauaaaacugagugucccaaagguuuauuaauaacaguagu

SEQ ID NO: 107194 - RNA, 64 nt, Human
gcuuuuaggagaccgaaguccgcagaaccugccugugucccagcuuggaggccugguccuggaa

SEQ ID NO: 107195 - RNA, 64 nt, Human
cacgcaugugugacauccggaguccuggagccgggugucccaguggcaccacuaggugccugcu

SEQ ID NO: 107196 - RNA, 64 nt, Human
gcugguuccugguccccugggcuguguagacccggugucccaccaggcuccaggcucccaccau

SEQ ID NO: 107197 - RNA, 64 nt, Human
aggcgggcagggggugaccccuggagcuaguugcgugucccagaauggaggguguucugacacc

SEQ ID NO: 107198 - RNA, 64 nt, Human
uguucaccuuccccaacagggcuauaguuuaagggugucccaggccuuggcugguuggcugggc

SEQ ID NO: 107199 - RNA, 64 nt, Human
aaaguucauucucgucuggcugaacucugggagugugucccagcugagggaagcacaaguagca

SEQ ID NO: 107200 - RNA, 64 nt, Human
uucucccuuucucuaaucauccagaauauggcgggugucccaguguucaacaguaucaugcuaa

SEQ ID NO: 107201 - RNA, 64 nt, Human
accacugcuucuguuuauucauuuauaugcuuuugugucccauaaauuauuucagaaaaugcug

SEQ ID NO: 107202 - RNA, 64 nt, Human
ccccacacuggaaaacugggaaauggccagcugugugucccaggaaauuccuccccuuauucuu

SEQ ID NO: 107203 - RNA, 64 nt, Human
ucuccaggccaggccuccuuggacuccccugggggugucccacucuucuucccucuaaacugcc

SEQ ID NO: 107204 - RNA, 64 nt, Human
agaguagaaaagauuguggccaagaagagugaaugugucccauccaaaggugcauccagauaug

SEQ ID NO: 107205 - RNA, 64 nt, Human
aaacagcauggauugggugucuuguuugcagcaugugucccauguuccccaacacuguugaggg

SEQ ID NO: 107206 - RNA, 64 nt, Human
gcagaaccagcaggguguccccucgggcccaucugugucccaugucccagcacccaggccucuc

SEQ ID NO: 107207 - RNA, 64 nt, Human
gggcacagggaaggcagcugggccguuucugucugugucccauccugcuguccuucuguccugg

SEQ ID NO: 107208 - RNA, 64 nt, Human
ucuggccacaccuucuuuguggcucagugccaaugugucccacagaacuucccacuguggaucu

SEQ ID NO: 107209 - RNA, 64 nt, Human
cagaugcccacguaugugaaacacacauggacaugugucccagccacaguguuaugcucugugg

SEQ ID NO: 107210 - RNA, 64 nt, Human
cuccauggacugcaucuaacugcaggaacccagagugucccagcacgccgggaggggcaaccag

SEQ ID NO: 107211 - RNA, 64 nt, Human
ccucucuuccaguggagccagaugccgagaccgagugucccaccuccucccuuccuggggccuc

SEQ ID NO: 107212 - RNA, 64 nt, Human
agaagagucaggaaaacaauuguauucccagccugugucccaugggcacaagcaaaucccaaau

SEQ ID NO: 107213 - RNA, 64 nt, Human
cccauaagauggacaaaaguguuucuguaucacugugucccagacaauauuuagaauuacccag

SEQ ID NO: 107214 - RNA, 64 nt, Human
agauucaaguccgugugauuugggcccgagcugggugucccagggcaagccaccuugccugucu

SEQ ID NO: 107215 - RNA, 64 nt, Human
ccuaacugccuccuggauugucaucuucccagaugugucccauaguguccaggugucacagaga

SEQ ID NO: 107216 - RNA, 64 nt, Human
aaaaauaaaaaaaguaccuccccugucucgcacagugucccaggacccugcggugcaguagagg

SEQ ID NO: 107217 - RNA, 64 nt, Human
gggcauccaggucuaggccgugugguacccagaagugucccagcccaccacaccguuuaccucc

SEQ ID NO: 107218 - RNA, 64 nt, Human
aaaaacuuguggcacacaaugcuuauucacuagugugucccacccgccagccccacagaugacu

SEQ ID NO: 107219 - RNA, 64 nt, Human
agauagcuaaguccuaaucuauggguacauuguugugucccaaaccaaaauuuuccuuauccac

SEQ ID NO: 107220 - RNA, 64 nt, Human
ggaccugagccugguccuggccgucccuaagcaugugucccaggagcaggaccuacuaggagag

SEQ ID NO: 107221 - RNA, 64 nt, Human
guucccuuggaggcuguggcaaguccucaauccugugucccagaggucccucugggccacaacc

SEQ ID NO: 107222 - RNA, 64 nt, Human
ucagggcaccgaggugcacuugccggccugggaggugucccacugaagccccgcgccuccuccu

SEQ ID NO: 107223 - RNA, 64 nt, Human
aggcccgucugaggccccgcaaugcgaggguccugugucccacuucacugcuccgaagggaacu

SEQ ID NO: 107224 - RNA, 64 nt, Human
agcuacaggggcauuuucuucccuaaaaccaacagugucccacugaccuccccaaguguuugcu

SEQ ID NO: 107225 - RNA, 64 nt, Human
ugagagagcagccaggagagcuuagggucucagggugucccagaccccgacaccggccaguggc

SEQ ID NO: 107226 - RNA, 64 nt, Human
caauucguucucugccacagggacuugccucacugugucccaaaaacaaaucgcagccagcuuu

SEQ ID NO: 107227 - RNA, 64 nt, Human
ugccuuccuucugucgauuuucaaugucuugauggugucccaccugaguggccuuuagagaugu

SEQ ID NO: 107228 - RNA, 64 nt, Human
guggccaucuagccucguaacuucacugucaccugugucccauagggugccuucugaauacugu

SEQ ID NO: 107229 - RNA, 64 nt, Human
gagggcucaccccgggugcugcucugugcucugcgugucccacagacgcuuguuccagggggcu

SEQ ID NO: 107230 - RNA, 64 nt, Human
cuccaugccuguccauuaucugucuccuuuccuugugucccaaaacaaagcuguuugccucacu

SEQ ID NO: 107231 - RNA, 64 nt, Human
uggagugacgggggagcuguggaugguggcaggagugucccagcaagaaaggcggcauccgucu

SEQ ID NO: 107232 - RNA, 64 nt, Human
cccuccucucccaccuccuggcacuuccagcugggugucccacauguuggauuccguccccacc

SEQ ID NO: 107233 - RNA, 64 nt, Human
ggguggaggccaagucccaggcuuucaggugugugugucccaccacacuggccgugguaaacau

SEQ ID NO: 107234 - RNA, 64 nt, Human
guccccccuguggucugugugugacaccaccacugugucccagugucuggcccagccauggcug

SEQ ID NO: 107235 - RNA, 64 nt, Human
agauaugcccagccaguccuggucggccacaccagugucccaaagaggagagcgcagcagagcc

SEQ ID NO: 107236 - RNA, 64 nt, Human
ucacguggggcuuguuuaaacaguaccauugcuugugucccaccuggaccaguucagucagccc

SEQ ID NO: 107237 - RNA, 64 nt, Human
cuugcagccugggcuguguaugccugcggaugcagugucccacacaaggacacuuccucuagga

SEQ ID NO: 107238 - RNA, 64 nt, Human
ugaccucacuuuaggcagcuguaacagcggcagggugucccaggagcccugauccgggggucca

SEQ ID NO: 107239 - RNA, 64 nt, Human
gccaggcacaugccccuugaacacccgaugcuacgugucccaaaggaaacuggucuccacccac

SEQ ID NO: 107240 - RNA, 64 nt, Human
gccucuccccagcacugaguccccccuccuuugugugucccagcacccuuggccugaguaaacu

SEQ ID NO: 107241 - RNA, 64 nt, Human
ccaacccaggugugggcagucagggagggagggagugucccaccacguucucagggcagcccuu

SEQ ID NO: 107242 - RNA, 64 nt, Human
uggacaggacucuggccacaggcagggcgggucugugucccauguguccugucaguccccugag

SEQ ID NO: 107243 - RNA, 64 nt, Human
gcaguuccccuggagccccuucgggagcagggcugugucccagaugggccacggcugagccuuc

SEQ ID NO: 107244 - RNA, 64 nt, Human
agggacgguuuacggacgugcagcugagcuguccgugucccaugcucccucagccaguggaacg

SEQ ID NO: 107245 - RNA, 64 nt, Human
gcgcaaggccugggguggagccacggcuggggccgugucccaacuccgaacccagcggggcggg

SEQ ID NO: 107246 - RNA, 64 nt, Human
uccauuacaaaguaucugauuugucugaauaaaggugucccacucacuguuccaggaauucuug

SEQ ID NO: 107247 - RNA, 64 nt, Human
cccaugagggaagaggaaagugccacugggcaaggugucccacccuccccuccugacccuccua

SEQ ID NO: 107248 - RNA, 64 nt, Human
aagcagaagauuguuauaauacagcucuccgucugugucccacccaugcagacucucugaauaa

SEQ ID NO: 107249 - RNA, 64 nt, Human
uuaaagaugauuauauucauucaaagcuuuagaugugucccauguggcaagaaaggagacagug

SEQ ID NO: 107250 - RNA, 64 nt, Human
uuaggagauccaaauagggaaccaagauugcagagugucccaucuugggagggaaugcugaaua

SEQ ID NO: 107251 - RNA, 64 nt, Human
aaaccaauaaaugaaauccaccaacucaccgugugugucccagcugccccaucuuccccagcgc

SEQ ID NO: 107252 - RNA, 58 nt, Human
auggcaaacuacuucugugagcccuccugugucccaccccucaccccuuuacccccau

SEQ ID NO: 107253 - RNA, 64 nt, Human
ugaugaggagagaguggaagaagcaaaacugcuggugucccaaggagcaaguauuuacauugag

SEQ ID NO: 107254 - RNA, 64 nt, Human
cuguuuagccuagucaugugccuugaacauauaugugucccauaaucuggcucaugguaccugu

SEQ ID NO: 107255 - RNA, 64 nt, Human
gcccugggcccaagaggaggcggcugcgggucguggggaccaagcacauugguccuaaaggggc

SEQ ID NO: 107256 - RNA, 64 nt, Human
cagcccuggagcaugggaucgugggaaagaggagggggaccaggcccagggcaggggucagagg

SEQ ID NO: 107257 - RNA, 64 nt, Human
guaggguggggguggggagaacacuuaacaacauggggaccagucaggggaauccccuuauuuc

SEQ ID NO: 107258 - RNA, 64 nt, Human
auacgacaccacugggaggguuguguaggugccaggggaccaucgugguucucuagggcgcugu

SEQ ID NO: 107259 - RNA, 64 nt, Human
gccaggagagaccagagccucuggaggcuacccaggggaccacaccaaguccuugccugugccg

SEQ ID NO: 107260 - RNA, 64 nt, Human
guguugguuucuuagauugcuagcuuuuccuccaggggaccacagcaggugaagcucaagagcg

SEQ ID NO: 107261 - RNA, 64 nt, Human
gcuccagcagggacuaccuuucuuauaaacccagggggaccacacacacacacacacacacaca

SEQ ID NO: 107262 - RNA, 64 nt, Human
uuggugcgcccccugcugaggagcagccccaggaggggaccagaggggaugcugugucgcugcc

SEQ ID NO: 107263 - RNA, 64 nt, Human
caaugucaucaccuauuugacuguucagaaaaguggggaccagaguuugauuuuuuuuguuuuu

SEQ ID NO: 107264 - RNA, 64 nt, Human
uggaagcagauucccauugaguuuuccccaccaaggggaccaugcacaugguagaaacauuaga

SEQ ID NO: 107265 - RNA, 50 nt, Human
uguggcuuugcauucaguaaggggaccaucagucccauuacuaguuugga

SEQ ID NO: 107266 - RNA, 64 nt, Human
uauagaacagaagcagauggauaugaagaggagaggggaccagaccaucuccgcaaccacagcc

SEQ ID NO: 107267 - RNA, 64 nt, Human
gcagaggcugaggcacggggagccagccccacucggggaccagaaguggaaccaaaaacaagaa

SEQ ID NO: 107268 - RNA, 64 nt, Human
gggcuccacuccaaggguuucugacccaagagguggggaccaaaaccaugcauuccuaagaagu

SEQ ID NO: 107269 - RNA, 64 nt, Human
aauccagucauuggccaccagccaccucugcaguggggaccacacuagcagcccugacuccaca

SEQ ID NO: 107270 - RNA, 64 nt, Human
cugcagaggccagaaaccuugagcuuaggugccuggggaccagcuucgacauucucuccaguuu

SEQ ID NO: 107271 - RNA, 64 nt, Human
auguucugcaagacgcuguccucagggaccauuaggggaccauucuguucagugcgauccugau

SEQ ID NO: 107272 - RNA, 64 nt, Human
aaacccucugaucuaugaagucucugcagggcaaggggaccagggaccuggaacccucuuggcc

SEQ ID NO: 107273 - RNA, 64 nt, Human
cuucaaggccaaggauaguuucuuccucugacauggggaccauaacaggugaucacugauaccu

SEQ ID NO: 107274 - RNA, 64 nt, Human
auacgguuggaaaggaaaaaugagacacagguuuggggaccaaggacccaucaaugauggugac

SEQ ID NO: 107275 - RNA, 64 nt, Human
acgugacucagagcuuuucgaacugugcucccacggggaccacugggccccucaggggaagcug

SEQ ID NO: 107276 - RNA, 64 nt, Human
agccaaccacauagccuugggaccagccucucugggggaccagaaguagugagagaaggaaggg

SEQ ID NO: 107277 - RNA, 64 nt, Human
cugugggguuuuccuccaaggggaagggagaagaggggaccaucgagguggcgaguguggacac

SEQ ID NO: 107278 - RNA, 64 nt, Human
uggaaggaacguccccuguccccgcacugggcuuggggaccagagcugccaccugccuguuggg

SEQ ID NO: 107279 - RNA, 64 nt, Human
uccucuacaccugaagacaaaggcaaagucaaauggggaccagaauaaaucuuagaccccacag

SEQ ID NO: 107280 - RNA, 64 nt, Human
aaggcaugggguggcugggauuuaaggacuucugggggaccaagacauccucaagaaaacaggg

SEQ ID NO: 107281 - RNA, 64 nt, Human
aaggaucacccauccuccuuucagcccccuuuauggggaccaggcagcucuggagccagccaca

SEQ ID NO: 107282 - RNA, 64 nt, Human
ggagagggcauccccuuuccagggagguaaagcaggggaccagagcgcccccucguguaugccc

SEQ ID NO: 107283 - RNA, 64 nt, Human
gaauuuguaauagaucaguaccauuuauugguuuggggaccaucuuaauuaaaaauaaaugccc

SEQ ID NO: 107284 - RNA, 64 nt, Human
accugagaaggacggcaaggcugagguggcuaagggggaccauggggagguggcacuagggauc

SEQ ID NO: 107285 - RNA, 64 nt, Human
cagagggugggaggggccaugcugugugagaccaggggaccagagggaugggagagucaaggga

SEQ ID NO: 107286 - RNA, 64 nt, Human
cucagcaccugagccucccucacuuggacacucaggggaccacacagagaaguggauggacacu

SEQ ID NO: 107287 - RNA, 64 nt, Human
accguucccaccgucagggagaccuacaguuucgggggaccacccuggucuggccuuguauaua

SEQ ID NO: 107288 - RNA, 64 nt, Human
uuaagagucugcaucaagagauuuguccuccuugggggaccacuggaucauuccagauuucuug

SEQ ID NO: 107289 - RNA, 64 nt, Human
ugggacuacaggcaugaaauacugugccuggccuggggaccaggugcauuuuaagguuccuugg

SEQ ID NO: 107290 - RNA, 64 nt, Human
uaacugcaaguuuagcuugaauuaagggauuuggggggaccauguaacuuaauuacugcuaguu

SEQ ID NO: 107291 - RNA, 64 nt, Human
gagccauaggcauuucaggccaaauccaugaaagggggaccagucauuuauuuuccauuuuguu

SEQ ID NO: 107292 - RNA, 64 nt, Human
aggagagucaggccccugggccucuaugccagguggggaccagaagucgggaaggcaccuacca

SEQ ID NO: 107293 - RNA, 64 nt, Human
accgagggaguuuucuggguguagagagaauggaggggaccaaaaagaguccuuccuggggugu

SEQ ID NO: 107294 - RNA, 64 nt, Human
uuaggaauguguacauuguaggaauccugguuguggggaccaggucugugggccucaggucugg

SEQ ID NO: 107295 - RNA, 64 nt, Human
uucccucaacagcagaaccuaccugcagccaccaggggaccagcucuguguagguaaccagaug

SEQ ID NO: 107296 - RNA, 64 nt, Human
ggcguacccaccuuggggggcauguugguucuggggggaccaccucuccuugcauucaggggcu

SEQ ID NO: 107297 - RNA, 64 nt, Human
ugcugcacugguccuaugccagccucacccauguggggaccacggaaggcacacucccuuaccc

SEQ ID NO: 107298 - RNA, 64 nt, Human
gcagacggcacccaggcugugaucuguccugggcggggaccaggagggagcggggucgggauca

SEQ ID NO: 107299 - RNA, 64 nt, Human
gggguuggggguggggugggugggugcuggcgguggggaccaagauccggaaagaugaauaaag

SEQ ID NO: 107300 - RNA, 64 nt, Human
cgggguccaggcauguuggacucugagcucauuuggggaccacagaggcuguggucagagaggg

SEQ ID NO: 107301 - RNA, 64 nt, Human
aaguggccacauacagcaacccacuccaggccauggggaccaccacucaggguucggggcuggc

SEQ ID NO: 107302 - RNA, 64 nt, Human
cuuaucccugguauccacgguuccccagagcuuuggggaccacgcgaaaaccuccaagauauuu

SEQ ID NO: 107303 - RNA, 64 nt, Human
gggaaggagaggagggaaaaggaccagggucaagggggaccagagguugaccacuguggaaugu

SEQ ID NO: 107304 - RNA, 64 nt, Human
ugggaggcauuauaauggagggucuucagaguucggggaccaagucuagcagauucucagcagu

SEQ ID NO: 107305 - RNA, 64 nt, Human
auuugccuuuaagcgaacaaaugcugggguccuuggggaccagcuugucagaggguagcccuaa

SEQ ID NO: 107306 - RNA, 64 nt, Human
ucagcccuaacauagugucugcugcugccucccuggggaccaggagcuagcccagucccuggag

SEQ ID NO: 107307 - RNA, 64 nt, Human
aguagaacuuaagagaggggccaaguguaggauuggggaccauggucugggagcuguucugggg

SEQ ID NO: 107308 - RNA, 64 nt, Human
gguggggugggacggguggugcuuaaaagaggaaggggaccaguguagcaacuugccagggacc

SEQ ID NO: 107309 - RNA, 64 nt, Human
ccauagaccugguuguacuguagcuuguuguuugggggaccaaauuuucuagagagaacuagag

SEQ ID NO: 107310 - RNA, 64 nt, Human
gaagcggagaaagggugccagaccauucucuggcggggaccagggcccaaggccccagggcugg

SEQ ID NO: 107311 - RNA, 64 nt, Human
uaauauguuaaccucagugucauuuaugaaaagaggggaccagaagccaaagacuuaguauauu

SEQ ID NO: 107312 - RNA, 64 nt, Human
uggucuugucagaccuguagccuggaccucgccgggggaccagggagugcacgucuguagaucu

SEQ ID NO: 107313 - RNA, 64 nt, Human
cgcuggggcagugcccuccuacccccaggguugaggggaccaagguggcacggugguacugggg

SEQ ID NO: 107314 - RNA, 64 nt, Human
auugucuauaaaaucccacaguccuugggaaguuggggaccacauacacuguugggauguacau

SEQ ID NO: 107315 - RNA, 64 nt, Human
acauccucgaggcccuagcauuucuccuuggauaggggaccagagagagcuuggaauguuaaaa

SEQ ID NO: 107316 - RNA, 64 nt, Human
ucacuccaccuuugacacauuacuaguaacaagaggggaccacauagucucuguuggcauuucu

SEQ ID NO: 107317 - RNA, 64 nt, Human
cccagaaguaacccuaggcucaauggaggggucuggggaccaugguauaaagaggaaaccaaga

SEQ ID NO: 107318 - RNA, 64 nt, Human
ggcauuuugcuaccaagccucuucccaacgcccuggggaccagucuucuguuuuguuuuucauu

SEQ ID NO: 107319 - RNA, 64 nt, Human
ccauacguucagaggugcagcuggaggcugcuguggggaccacacugauccuggagaaaaggga

SEQ ID NO: 107320 - RNA, 64 nt, Human
gcugggaggccagaccgggccagacugagggucaggggaccaggcuggguuggggguugggugg

SEQ ID NO: 107321 - RNA, 64 nt, Human
caugugcacuccauccucauguauccuuuuucacggggaccagaacacugguacgucaucacca

SEQ ID NO: 107322 - RNA, 64 nt, Human
acacauguguagaguguauguagccaggagugguggggaccagaagccucuguggccuuuggug

SEQ ID NO: 107323 - RNA, 64 nt, Human
acagaggguauggaagacuugcaauuugaaaacuggggaccaguuccaaagucaguaauugugu

SEQ ID NO: 107324 - RNA, 64 nt, Human
gggcgaaucuccuccaaggaagucccaggaggauggggaccaggaaggcuguggacccccaucu

SEQ ID NO: 107325 - RNA, 64 nt, Human
aggaugaggcagaaggaaggguaagggaaaggauggggaccacaaggaagagccaggugcugcu

SEQ ID NO: 107326 - RNA, 64 nt, Human
cggagcuuucaaagaaggaauucuaggcaucccaggggaccacaccucccugaaccaucccuga

SEQ ID NO: 107327 - RNA, 64 nt, Human
ccaaagugaccccaccaggggacagccagaggaaggggaccaugggguaucccuguguccuggu

SEQ ID NO: 107328 - RNA, 64 nt, Human
ucucuugagaauuuggauacacucucuagcuuuaggggaccaugaagagacucucuuagggaaa

SEQ ID NO: 107329 - RNA, 64 nt, Human
cugcccaggcacugcuaggcucugucuggaagauggggaccagcagccccacaccagggccagc

SEQ ID NO: 107330 - RNA, 64 nt, Human
gcaugagaccuccuucuccccgucuuggggagguggggaccagcagauaaaucccacccuuccu

SEQ ID NO: 107331 - RNA, 64 nt, Human
agcuucuccgaaugacaaucagcucgugccagguggggaccaggauaugacuccuggugcccag

SEQ ID NO: 107332 - RNA, 64 nt, Human
acuguaagagacccuaaaaccuuggugcagugguggggaccacaaaacaaccagggaggaagag

SEQ ID NO: 107333 - RNA, 64 nt, Human
agaaggcugcagcccacaggaguccagggaaggcggggaccacagaggcacagaguccagcacu

SEQ ID NO: 107334 - RNA, 56 nt, Human
gagacaugcccaggaccuagcaagccggggaccagccaccaguggcggccagggac

SEQ ID NO: 107335 - RNA, 64 nt, Human
gugcguucugagcguguuggccaguggcuguggaggggaccaccugccacccacggucaccacu

SEQ ID NO: 107336 - RNA, 64 nt, Human
aaucucagacuuugcucagagcucagaauucaguggggaccagagagccugcaauuggaaauau

SEQ ID NO: 107337 - RNA, 64 nt, Human
uguucauguugcuguuuauaguuuguggaaagugggggaccaucccccuucucaccacuguucc

SEQ ID NO: 107338 - RNA, 64 nt, Human
uuauuucuggguugauucaaagggaggacuugcuggggaccagaauccaaacggccucaagugg

SEQ ID NO: 107339 - RNA, 64 nt, Human
caggcucagagccucucaucaccgccugugaaauggggaccacccuccuaaucuacuauccaga

SEQ ID NO: 107340 - RNA, 64 nt, Human
cuggaccccagaaccccagacaagggggcaggcgggggaccagggccucuccugugggaucuuu

SEQ ID NO: 107341 - RNA, 64 nt, Human
uuucucuuucuguuuccuggccucagagcuuccuggggaccaagauuuaccaauucacccacuc

SEQ ID NO: 107342 - RNA, 64 nt, Human
ggccacuuguagggcagugagaggaagccgucgcggggaccaugcugccuucucugggcucacg

SEQ ID NO: 107343 - RNA, 64 nt, Human
cagccuuggcccugcagccuccaccucgccgcugggggaccaacagguugcuuacagcuuugca

SEQ ID NO: 107344 - RNA, 64 nt, Human
ugguccauguugcccacucacuccagugggaaguggggaccacgccauagagggucugcuccca

SEQ ID NO: 107345 - RNA, 64 nt, Human
ugaauauaaaugaugauugaacuggaauaauauuggggaccaaaucaaaugaaugauuaaauua

SEQ ID NO: 107346 - RNA, 64 nt, Human
cuggacucugggaaccuuucaucauuaaaaaaagggggaccauuggggccugagccaaggaacu

SEQ ID NO: 107347 - RNA, 64 nt, Human
cugauuccugaggauccuccccgagccaggcacgggggaccacagggcugccgugagcacccac

SEQ ID NO: 107348 - RNA, 64 nt, Human
aguuuuauuuuuauuaaaacuugacugaacaaaaggggaccaucaacauuguagacacuggaca

SEQ ID NO: 107349 - RNA, 64 nt, Human
uugugcugcuccuugccaccuugggguuccugcuggggaccaugugugguuguggcauguguga

SEQ ID NO: 107350 - RNA, 64 nt, Human
uccagcuguccccacaagcagagcccugagggguggggaccagcuggccacauggugcugcuuu

SEQ ID NO: 107351 - RNA, 64 nt, Human
uacugccacucugcagguggagcgggugacucugggggaccauuaagaccuccagaccgggugc

SEQ ID NO: 107352 - RNA, 64 nt, Human
ggaccuggcaaccacaagacccuccccauaagcaggggaccagcauacccgggagcugucccug

SEQ ID NO: 107353 - RNA, 64 nt, Human
cucaagcacaaccaacugaaugucucuuaacuguggggaccaaaagggagagagccuggggucu

SEQ ID NO: 107354 - RNA, 64 nt, Human
aucacagaagguggacagggccuacccagguggaggggaccacccugcgaucagguguuugcga

SEQ ID NO: 107355 - RNA, 64 nt, Human
cuucugguaugucugccgcacgcagggcguggagggggaccacugcgugaccucggacccagcc

SEQ ID NO: 107356 - RNA, 64 nt, Human
cauuagguccaguaauuguugacaggcaggaacgggggaccauugcauugugcccaaguaauaa

SEQ ID NO: 107357 - RNA, 64 nt, Human
caauuggagcacaggaauguuaacauguaugacaggggaccaguagggugguuucccucucagg

SEQ ID NO: 107358 - RNA, 64 nt, Human
uggcucaggguucaucguucugccuuguccacugggggaccagcccugcagaccacucugacaa

SEQ ID NO: 107359 - RNA, 64 nt, Human
ugggacccaggccugacccggagccccagccccaggggaccaugccggggugcugccugggcag

SEQ ID NO: 107360 - RNA, 64 nt, Human
auucaaucaaggcuguucuauuuaaaucagagauggggaccaggcucagaguucuaccuaucua

SEQ ID NO: 107361 - RNA, 64 nt, Human
aggccagagcagguagcaaggcauuguggaaagaggggaccaggguggcuggggaagaggccga

SEQ ID NO: 107362 - RNA, 64 nt, Human
aaaccguuaagccucuacgauuuuuaaguaaguuggggaccaucaguuuaaaauaaaugcaaua

SEQ ID NO: 107363 - RNA, 64 nt, Human
agcaagauucuuucauucgucuccuccuagccugggggaccaggcucgaacugacccuggacau

SEQ ID NO: 107364 - RNA, 64 nt, Human
aagguacuucaaacaagggagggccuggacugagggggaccaggucuucuugcugaccucgucu

SEQ ID NO: 107365 - RNA, 64 nt, Human
uagcuccaggugccucagccccgugcccugacccggggaccacagggacacccucugagacgug

SEQ ID NO: 107366 - RNA, 64 nt, Human
ccgcagggagcaagcaguacaguggcauucccagggggaccagcagcuacccaaggagaaccau

SEQ ID NO: 107367 - RNA, 64 nt, Human
ucagugcuguuccaccuuuuagggagguuacugaggggaccaggaugggagaaugaggaguaaa

SEQ ID NO: 107368 - RNA, 64 nt, Human
uuuuuccaguuccaggacacagauuaucaacuggggggaccaaauagccaccuugauuuucuuc

SEQ ID NO: 107369 - RNA, 64 nt, Human
uuagauacagauauuuacagaaaguagggaggaaggggaccaagccagagagggacagguauau

SEQ ID NO: 107370 - RNA, 64 nt, Human; identical to SEQ ID NO: 107336

SEQ ID NO: 107371 - RNA, 64 nt, Human
ccuuguguuccuaucggaugcucccaguaaccagggggaccacccgagcuaaucauggaauguc

SEQ ID NO: 107372 - RNA, 64 nt, Human
gccagcuaccucuucgaguuuuucaaauugugagggggaccauaaaaggauggaaacuuuuaga

SEQ ID NO: 107373 - RNA, 64 nt, Human
aaaagugccuugacguggagggugggcaccagauggggaccagccuugccaacugcugcugugg

SEQ ID NO: 107374 - RNA, 64 nt, Human
uagagaugagcgcuagccuuccaagcaugaagucggggaccaaauuagccuuuaacucauaaag

SEQ ID NO: 107375 - RNA, 64 nt, Human
caaaacuucaguugauucugaccugggaggaucuggggaccagggggucuugggcugccuugug

SEQ ID NO: 107376 - RNA, 64 nt, Human
ggguggccaggcugacagcuuuuugcaagaggagggggaccagcaccagcugggaggcauaggc

SEQ ID NO: 107377 - RNA, 64 nt, Human
cgcguggcugcugcuguccuccuccgggacccacggggaccaaggucacacguuccgugcugug

SEQ ID NO: 107378 - RNA, 64 nt, Human
gccuuugccccuggagucaagacccacagcccucggggaccaccuggagucucuccauccucca

SEQ ID NO: 107379 - RNA, 64 nt, Human
cugauuccuccaacucuccaccccacaaaauaacggggaccaauauuuuuaacuuugccuauuu

SEQ ID NO: 107380 - RNA, 64 nt, Human
ggaccauaaccugggggucaggggaaggcaugggggggaccagaaaccagaagaacaaucaaga

SEQ ID NO: 107381 - RNA, 64 nt, Human
caagguaaggagggucacuggggcccaagagucuggggaccagcuuggcucaggcugagcugaa

SEQ ID NO: 107382 - RNA, 64 nt, Human
cucucuccacuggccgccagccucccuagcacaaggggaccauucagcaaugaguguuuacuca

SEQ ID NO: 107383 - RNA, 64 nt, Human
acaucuguagacaucuugaguuguagcugcagacggggaccaguggcucccauuuucauuuuag

SEQ ID NO: 107384 - RNA, 64 nt, Human
aggaacuaaaugacaggagauuggugcuaauacgggggaccaagcuuuguccaagugaagcagg

SEQ ID NO: 107385 - RNA, 64 nt, Human
gcugccgcugccuaugaccgccacuaguuaccgcggggaccacaucaagcuucaggccgacagc

SEQ ID NO: 107386 - RNA, 64 nt, Human
cacaaagaaaagcugcuaaaucuauagccaaccaggggaccacaguagugggcaagagugaucu

SEQ ID NO: 107387 - RNA, 64 nt, Human
ucauggccaacaauggacaccuccagagccuccaggggaccacacaguagacuaucccuacucu

SEQ ID NO: 107388 - RNA, 64 nt, Human
gcaaaaccuguguaggucucgcuguggguuugcuggggaccaagggggugaugaaaaggggagg

SEQ ID NO: 107389 - RNA, 64 nt, Human
gugagcuuggccucucugguccccauggacuuagggggaccaggcaagaacucugacagagcuu

SEQ ID NO: 107390 - RNA, 62 nt, Human
acaucccccuugucacauaguccaaagaaagaggggaccaugccugaccuugacuccuuguc

SEQ ID NO: 107391 - RNA, 64 nt, Human
cuagcccccaggagagggggucaguguuuccuggggggaccaugcucuaacccuaguccaggcg

SEQ ID NO: 107392 - RNA, 64 nt, Human
gaguuugcuuugauuucccuuuccuuuccuucucggggaccaguucuuacuuccuuuuauuuuu

SEQ ID NO: 107393 - RNA, 64 nt, Human
ucaggucucagggaaggucuuuuauaaacucaauggggaccaccuuccuggagaggcugcuccc

SEQ ID NO: 107394 - RNA, 64 nt, Human
uggggcugcugcggcccuaggccuggcugggcucggggaccacaucuggcccccggcccgcgcc

SEQ ID NO: 107395 - RNA, 64 nt, Human
cucucugugccagggaggcugggagagcagcaagggggaccaggugcgccaucaggaggagaga

SEQ ID NO: 107396 - RNA, 64 nt, Human
uugucuucacgggcaaucaggaagggagagagcuggggaccauauucugcaaugcagccaaauc

SEQ ID NO: 107397 - RNA, 64 nt, Human
gaucuggagcugcaucucuaaggggccaggcuuuggggaccauugccaaagguggacucaggag

SEQ ID NO: 107398 - RNA, 64 nt, Human
aacucagugggcugacccaucccucccaggcgcuggggaccaaccuagcaaugaagguugggaa

SEQ ID NO: 107399 - RNA, 64 nt, Human
gaaagcucaguaacucagaacaggaguaacugcaggggaccagagaugagcaaagaucugugug

SEQ ID NO: 107400 - RNA, 64 nt, Human
auuccccccuggguuucagaaaggaaggauauauggggaccaccucccccuucuuugaucccag

SEQ ID NO: 107401 - RNA, 64 nt, Human
cccauuuauuuaacuuuuuuuuucuccuaccuauggggaccaaagugcuuuuuccuucaggaag

SEQ ID NO: 107402 - RNA, 64 nt, Human
ccugugccagccccuccuuguugcgccucaccguggggaccaggugagccggcucucccacgug

SEQ ID NO: 107403 - RNA, 64 nt, Human
agcuuccguggugccuuugcugccggcagcccuuggggaccacaggccugaccagggccugcac

SEQ ID NO: 107404 - RNA, 64 nt, Human
cucucagcuggagagacucgggaugggguaaccuggggaccagucuagccccugcacccucuuc

SEQ ID NO: 107405 - RNA, 64 nt, Human
aaugacaugaggaaaagaaaccuauuccugcccuggggaccacccugggacucuaaccaagccu

SEQ ID NO: 107406 - RNA, 64 nt, Human
uagugggccaggggccaggcagcugggggccuuuggggaccagaaggggagaugugcucccaga

SEQ ID NO: 107407 - RNA, 64 nt, Human
cgugguucuggcuaggcucucauguccagacagcggggaccaggggaaaacccagccccuucug

SEQ ID NO: 107408 - RNA, 64 nt, Human
ugucuagaggugagaccaaaggauccagagacuuggggaccagaggugacaguggaugacguga

SEQ ID NO: 107409 - RNA, 64 nt, Human
guggguacccaggcugguucuugggcuagguaguggggaccaaguucauuaccucccuaucagu

SEQ ID NO: 107410 - RNA, 64 nt, Human
agggaaaggggacuugugguaguggaccauaccuggggaccaaaagagacccacuguaauugau

SEQ ID NO: 107411 - RNA, 64 nt, Human
gaauggauugggccucaggccagguggucuucaaggggaccagcuaacugauccugcccuucag

SEQ ID NO: 107412 - RNA, 64 nt, Human
uugccagugcuaagcugcccugaggguuuccuucggggaccagcccacagcacaccaagguggc

SEQ ID NO: 107413 - RNA, 64 nt, Human
ugauucccagcccaggagcugaggggugagggcuggggaccaugccgcgggcuaggucgggccc

SEQ ID NO: 107414 - RNA, 64 nt, Human
agccccccagcuccaccacggugacuuggugaagggggaccaaugccagaagaaaggggcugua

SEQ ID NO: 107415 - RNA, 64 nt, Human
aucaauggacacuaguuagauguuuguucaccauggggaccauuacauaugaccauacaaugca

SEQ ID NO: 107416 - RNA, 64 nt, Human
aaagcaccccuaggaccauugaacacccacugccggggaccacuguccagugaauggauugagg

SEQ ID NO: 107417 - RNA, 64 nt, Human
ucacguucggacugccuucaucaagacaacucuaggggaccauuuugccuggggcuccuagcaa

SEQ ID NO: 107418 - RNA, 64 nt, Human
cuucuaaaggauaagguacuguagccuugguccuggggaccaccugccuggggcaguggacauc

SEQ ID NO: 107419 - RNA, 64 nt, Human
aaguugaaaaauccuaaguggaaccaucaaagccggggaccaucuguauugcuuuguuuuuagg

SEQ ID NO: 107420 - RNA, 64 nt, Human
uuccacaaaacuggucccuggugccaaaaauguuggggaccacugcucuagagagaggucauga

SEQ ID NO: 107421 - RNA, 64 nt, Human
aagacugucucacuuagcagaccuugaccaugugggggaccagcucuuuguugucuacagccag

SEQ ID NO: 107422 - RNA, 64 nt, Human
cugugaacaagaauccacgccccccugcccugcuggggaccacauaaugaucccuuugggggaa

SEQ ID NO: 107423 - RNA, 64 nt, Human
ccaaaaauacuauggagagcuacacugcuucaguggggaccaagcagucauuuggugacuuagg

SEQ ID NO: 107424 - RNA, 64 nt, Human
cacccccauuggacaagcuggggaacagccauagggggaccagcuucugccaggugagaugcuu

SEQ ID NO: 107425 - RNA, 64 nt, Human
augguccccgugugauccacccugcuucucuccaggggaccauaggucccgucauguacucagu

SEQ ID NO: 107426 - RNA, 64 nt, Human
ugccuuuauggcccuagagaaagucaaggaacauggggaccaacaaagcauuuccaguuguaag

SEQ ID NO: 107427 - RNA, 64 nt, Human
cacuguggggagugcaugccuggggccucuggguggggaccauggacaggcccuggucacuguc

SEQ ID NO: 107428 - RNA, 64 nt, Human
gcugaaagagccagguauuuaccugaugagcagaggggaccacugauuggcagaaaacuucccu

SEQ ID NO: 107429 - RNA, 64 nt, Human
uguuucugaccagagacacuuaccuaaauauccuggggaccaaggaacuauguacaaaaacaaa

SEQ ID NO: 107430 - RNA, 64 nt, Human
aggcccaaaggcagaacagccagagggggcaggaggggaccaaaaaggaaaaugaggacgugca

SEQ ID NO: 107431 - RNA, 64 nt, Human
cuaccggacugagauggcacccggggccagccagggggaccagcagugacucuggggcuaccug

SEQ ID NO: 107432 - RNA, 64 nt, Human
uucccuagugcugguauacuauagagaaaccccuggggaccaugugauuaaguuccuaucuuuu

SEQ ID NO: 107433 - RNA, 64 nt, Human
agcaaggcacaagucauaccuacauucaaggagaggggaccaugcaaaggauaaacugcaggug

SEQ ID NO: 107434 - RNA, 64 nt, Human
gggccucccgauacggcaaccaccacggaccuguggggaccaaugaggaaagagagaggcaggu

SEQ ID NO: 107435 - RNA, 64 nt, Human
aaggacuaggagagcuccuuaucugucugagaauggggaccagcucugagugggguugcugccu

SEQ ID NO: 107436 - RNA, 64 nt, Human
gcccggcaggcugggguuggccccuggagggucaggggaccaucuucuuauucccucuuuucuc

SEQ ID NO: 107437 - RNA, 64 nt, Human
gcagguggcgcucuggcuuugcacugcaaaaacuggggaccagcccccuucucccacaaauaaa

SEQ ID NO: 107438 - RNA, 64 nt, Human
ccugcuggauuggcaggcccuguccgaggaguugggggaccaucccagcaggugaggaaccagc

SEQ ID NO: 107439 - RNA, 64 nt, Human
gucugguucugacuuuguguuuuugugcccuccuggggaccagaaucuccuuucggaaugaaug

SEQ ID NO: 107440 - RNA, 64 nt, Human
uggugucccaggcacagugccaggccccgggaguggggaccaagauguacauaagacaaagcua

SEQ ID NO: 107441 - RNA, 64 nt, Human
uucucuccuaucugugccucuucaguggggguuuggggaccauaucaggagaccuggguugugc

SEQ ID NO: 107442 - RNA, 64 nt, Human
caucuuuaacugggcaccugagaugggaaccaauggggaccaucccagacacauggguuugucu

SEQ ID NO: 107443 - RNA, 64 nt, Human
cuuugcaggggagucaaagggccagaacuccuugggggaccagaacaugguuuuccuucugccu

SEQ ID NO: 107444 - RNA, 64 nt, Human
agaagacggguuccugcuuugcagagaaggagccggggaccagcuugaagacuggcucugggac

SEQ ID NO: 107445 - RNA, 64 nt, Human
cgauucuguguggggaaacccaccggaccuugcaggggaccauggggaagcugcaggugaguga

SEQ ID NO: 107446 - RNA, 64 nt, Human
cauguccagccagguugagccuaggggccaguugggggaccacaggacaauuuucauauggccu

SEQ ID NO: 107447 - RNA, 64 nt, Human
cauucaagucagcuuucaccauuuuauauacaaaggggaccagugccacagaaggguacccgaa

SEQ ID NO: 107448 - RNA, 64 nt, Human
agcuacaaggacagcguccaggguagggugagagggggaccaugaguggccccugucccuggcc

SEQ ID NO: 107449 - RNA, 64 nt, Human
cccgcauuauggcugggggcgccagcccaagaauggggaccaugggacuccuccagccuggcuc

SEQ ID NO: 107450 - RNA, 64 nt, Human
caguguaaggccccuaaaccagauggcccaggagggggaccagguggcucucacauggguaaga

SEQ ID NO: 107451 - RNA, 64 nt, Human
cagacauuggguguuuccaugcuguaggcuggugggggaccaugugccucuaggcagugacuag

SEQ ID NO: 107452 - RNA, 64 nt, Human
ggggaggacgacuaggcggccugccugcagggcuggggaccaaacgucaggccacagagcaucu

SEQ ID NO: 107453 - RNA, 64 nt, Human
uguguagcuggggagaggaugaggcugcagagauggggaccagaagccccccaccccagcuuuc

SEQ ID NO: 107454 - RNA, 64 nt, Human
cccggccagccgcucgggcgcagcacaagggacaggggaccaaggucagggccccccugcccca

SEQ ID NO: 107455 - RNA, 64 nt, Human
cagggagauccuccauagcuggcuuugaggacacggggaccacagccaugagcggccucuaaga

SEQ ID NO: 107456 - RNA, 64 nt, Human
gaguggcugccaugagaccugaggaccacacuugggggaccaaucauguccuucaccacugugc

SEQ ID NO: 107457 - RNA, 64 nt, Human
cagucgcguaagacaacagcagugucuccaccucggggaccaaggacgccuccgugccuccaga

SEQ ID NO: 107458 - RNA, 64 nt, Human
agggcccagccauugggcaccucugggaaggggaggggaccaugaggcagccagccccuggcag

SEQ ID NO: 107459 - RNA, 64 nt, Human
gcucagcugaaggaccccgucugcaggagagucgggggaccagguuugggaauacacuugcaug

SEQ ID NO: 107460 - RNA, 64 nt, Human
uagcccuuuacccugagcaccaccccaacagacuggggaccagcccccucgccugccugugucu

SEQ ID NO: 107461 - RNA, 64 nt, Human
gaucccuuguggccaggaguugggagaccagccuggggaccauagcgagaccgcugucuccacc

SEQ ID NO: 107462 - RNA, 64 nt, Human
auaaccaaguugcugcugaacuuauacuaaaucaggggaccaaaaaacuugcucuuaucuucuc

SEQ ID NO: 107463 - RNA, 64 nt, Human
guuuccucuugaucucaaagcacaauguggauuuggggaccaaaggucagggacacauccccuu

SEQ ID NO: 107464 - RNA, 64 nt, Human
gcuuuaauuauauaguaaugcacucucaguaaugggggaccagcuuaaguauaauuaauagaug

SEQ ID NO: 107465 - RNA, 64 nt, Human
ugagaucucuuuauuacauggacauuuacuucagggggaccacuguaagaaaagccaaacucca

SEQ ID NO: 107466 - RNA, 64 nt, Human
ugcuggggcacggcgggauccuccacagagaggaggggaccaauucuggacagacagauguugg

SEQ ID NO: 107467 - RNA, 64 nt, Human
auaaacuagacauggggugcccucaaguuuccaaggggaccaaugugccacuguucuuccuugg

SEQ ID NO: 107468 - RNA, 64 nt, Human
gguacccacgugggcauggaaauggggcagauuaggggaccacuggacucagaggggagggaag

SEQ ID NO: 107469 - RNA, 64 nt, Human
ccugucccccuucccccgaccccucccagauccuggggaccaauaaagcccgcagcgggucucg

SEQ ID NO: 107470 - RNA, 64 nt, Human
ccaaggaaacacccagcagggucuccugugagccggggaccaugcagcccgaaaccuccaguca

SEQ ID NO: 107471 - RNA, 64 nt, Human
ggugaggaagggggaggcagcaagagucacuuugggggaccaauauucuuagauauuuagagca

SEQ ID NO: 107472 - RNA, 64 nt, Human
ugauccccaaguguuucuugagcaucuggucuggggggaccacuuugaucggacccacccuugg

SEQ ID NO: 107473 - RNA, 64 nt, Human
uguaugaaggggggugacaaggucccccuggggaggggaccaaccuugucugguggaugagaag

SEQ ID NO: 107474 - RNA, 64 nt, Human
gguuuuucccuuggagggcaaacaaaguggcaguggggaccaggguguccccugcugagaaaug

SEQ ID NO: 107475 - RNA, 64 nt, Human
ggaggccugguccaucuggaguuuugaggggugaggggaccagagcagugggaccagcaugggg

SEQ ID NO: 107476 - RNA, 64 nt, Human
aggccugagggcugggggcugacccaaguguugaggggaccaaagccaccaagacaggcucgga

SEQ ID NO: 107477 - RNA, 64 nt, Human
uguucugucagucucccccaggggugggggguauggggaccauucauucccuggcauuaauccc

SEQ ID NO: 107478 - RNA, 64 nt, Human
cuuccuguggggucacucuugccauugccuggagggggaccagagcaugugaccagagcaugug

SEQ ID NO: 107479 - RNA, 64 nt, Human
ccaaagaggggccaccuguucucaaaagcauguuggggaccaggagguaaaacuggccauuuau

SEQ ID NO: 107480 - RNA, 64 nt, Human
aggaggcugcccguuccugccaguuccucacugcggggaccagcaaaggccuucucacuggguu

SEQ ID NO: 107481 - RNA, 64 nt, Human
uucucugccccaggcuaauauuagggacuggggaggggaccaccagaggggagagggaagcugc

SEQ ID NO: 107482 - RNA, 64 nt, Human
cuuauuuuaagcuuucaggcuuucuuaaaaacuuggggaccagaauuucaauguauguuuccau

SEQ ID NO: 107483 - RNA, 64 nt, Human
ggcggagccaaguccacucugggggagcucuggcggggaccacgggccacugcucacccacugg

SEQ ID NO: 107484 - RNA, 64 nt, Human
ggaguuggccugauuuuaagccuuuugccgcuccggggaccagcagcaauccugggcagccagu

SEQ ID NO: 107485 - RNA, 64 nt, Human
ggccucaauggcggacucagucacauugacugacggggaccagggcuugugugggucgagagcg

SEQ ID NO: 107486 - RNA, 64 nt, Human
cacuuugggggauggagucucaggguggcagaggggggaccagaacccuugacaccauccugaa

SEQ ID NO: 107487 - RNA, 64 nt, Human
cuuuccucgugaaggauaagagaaacaggcccggggggaccaggaugacaccuccauuucucuc

SEQ ID NO: 107488 - RNA, 64 nt, Human
aguaagucucugcccuaggcacaucagaucaccuggggaccacuccagagugaguagacaagac

SEQ ID NO: 107489 - RNA, 64 nt, Human
cuuucugugccaagaaucccaagugacuggggcuggggaccacuucuccaggccucucuccccg

SEQ ID NO: 107490 - RNA, 64 nt, Human
cagugaggagagaaaucacccugcuguggggguuggggaccacucccugcauccccucuccacu

SEQ ID NO: 107491 - RNA, 64 nt, Human
acuaccgccagacaccccgguggaagcauuuagaggggaccacgggagggacaaggcuucucug

SEQ ID NO: 107492 - RNA, 64 nt, Human
ggcucagcuagaagauccacauccucuacaggucggggaccaaaggcugauucuuggagauuua

SEQ ID NO: 107493 - RNA, 64 nt, Human
accuuuugugggcaccaccuuuaugugccucagaggggaccaaaggauggcagaaaacuguucu

SEQ ID NO: 107494 - RNA, 64 nt, Human
ucaagggccagggcagccgagggaagcuccagguggggaccacgucuuccugagguuggugccc

SEQ ID NO: 107495 - RNA, 64 nt, Human
ggggcauuuuguugggaccagugaccccuggcauggggaccacacccuggagcccggugcuggg

SEQ ID NO: 107496 - RNA, 64 nt, Human
ugcccccagaggagcagucauugcccucugcggaggggaccaggguucagcagugacguagcau

SEQ ID NO: 107497 - RNA, 64 nt, Human
cuccccaggcucaccuugccaugccaggugguuuggggaccaagauguugggggggugaaucag

SEQ ID NO: 107498 - RNA, 63 nt, Human
cauccucggcagaagaguagccgugagggaggcggggaccagccagaccgggagcaaaccguc

SEQ ID NO: 107499 - RNA, 64 nt, Human
ccugccggaggcugggcuuccuccucuguucuugggggaccauccccaauguuggugcugccuc

SEQ ID NO: 107500 - RNA, 64 nt, Human
accacaugcaguugugggaccgcaguuugguccuggggaccauucauacccacacacccagcuu

SEQ ID NO: 107501 - RNA, 64 nt, Human
uuuccuuuugguuuugggauuacuuuugauccugggggaccaaugaggugagggggguucuccu

SEQ ID NO: 107502 - RNA, 54 nt, Human
cagaauccagaaagguuugaucugggggaccacccauacugaggaguugaaaga

SEQ ID NO: 107503 - RNA, 64 nt, Human
gggaggccgagccaagcagggggacguugccagaggggaccagggccagagacgggaccaggaa

SEQ ID NO: 107504 - RNA, 64 nt, Human
gggccaccaaaaacccacaaaggccccggagcugggggaccacaaacaaacaggguccuuagcu

SEQ ID NO: 107505 - RNA, 64 nt, Human
ggauuguuuuggaagaaaggaauauuuuuaucuuggggaccagcuaagucucugcaguagugug

SEQ ID NO: 107506 - RNA, 64 nt, Human
ucaggagaacuguuccuugugguuuccgucccuuggggaccacaggcaucagcagucccauuca

SEQ ID NO: 107507 - RNA, 64 nt, Human
accacccucgccgcaggcagcugcagcccccagaggggaccacaagcccaaaaaggacaaaaau

SEQ ID NO: 107508 - RNA, 64 nt, Human
gagccaagcccaccccuucuuuguguagggaccgggggaccauggccuguuccgggacacucug

SEQ ID NO: 107509 - RNA, 64 nt, Human
caccccucccugucccagccagcaucaucucuuuggggaccacuccucuggcuuucauuuuuca

SEQ ID NO: 107510 - RNA, 64 nt, Human
aauccucuuuccuccccauuuggcccugggcucaggggaccagguggggcggguggggagcugu

SEQ ID NO: 107511 - RNA, 64 nt, Human
cuaggccgcggagugugcugggcuuggggguaagggggaccagagaggcgggcugguguucuaa

SEQ ID NO: 107512 - RNA, 64 nt, Human
guuugcgcagcuucgcuucuuugccucuccccggggggaccaaaccgucccagcguuaaugucg

SEQ ID NO: 107513 - RNA, 64 nt, Human
caucuugaaaggaugagacucaagaaccaagaugggggaccagcaaccccccagggucauggag

SEQ ID NO: 107514 - RNA, 64 nt, Human
ucugauuuaggaucuguggcucugcaccuaagcuggggaccaacggaaagaguucacgauggga

SEQ ID NO: 107515 - RNA, 64 nt, Human
cugucugucacacgacggaauggauacugggcccggggaccacuuucauacucacguccucauc

SEQ ID NO: 107516 - RNA, 64 nt, Human
uuuuacauuucaaagaaagguauguugucuaacaggggaccaacagaagguaguauugacaacu

SEQ ID NO: 107517 - RNA, 64 nt, Human
ucuaacucuuagaagugacauuguaagaggugguggggaccagcuaauugguccaacccagccu

SEQ ID NO: 107518 - RNA, 64 nt, Human
gguugugggcaacgguggaggaggagagacgggaggggaccauuugggauggaggggccucuuc

SEQ ID NO: 107519 - RNA, 64 nt, Human
cugaagcaaguuggccuugcccuugagaguauauggggaccagucuucaugucuuggaguaauu

SEQ ID NO: 107520 - RNA, 64 nt, Human
uccaggugacaucaccuaugcacauucccaguauggggaccauaguaucauucagugcauuguu

SEQ ID NO: 107521 - RNA, 64 nt, Human
ucaucaccccaacugucccuuguuuuugaucaauggggaccagccacugccccaggagcacuuu

SEQ ID NO: 107522 - RNA, 64 nt, Human
acacccucagaagguggggcaggcucuuugucuuggggaccaggaugcucccccaguccuuccc

SEQ ID NO: 107523 - RNA, 64 nt, Human
ggugcauaccuuggggagggaguagggggacacgggggaccaccagguguccacgguugucccc

SEQ ID NO: 107524 - RNA, 64 nt, Human
aggacugacugccacacauccgccauggugccacggggaccaggaccccacagcgcaccccccc

SEQ ID NO: 107525 - RNA, 64 nt, Human
ugaggggccacugcagccccaccgccacgccccaggggaccagccaggccuggaaugcccccug

SEQ ID NO: 107526 - RNA, 64 nt, Human
ucucccugccuccugccggcuccuugguucuugaggggaccaggaguggguggggagugggggu

SEQ ID NO: 107527 - RNA, 64 nt, Human
ggcacgagaugugugggacugggacgcuuccuuuggggaccagaggaacauuaggggccgguca

SEQ ID NO: 107528 - RNA, 64 nt, Human
gcaggggaguccagcugagaguggaagagguggcggggaccagcugggcagaugagaggcugag

SEQ ID NO: 107529 - RNA, 64 nt, Human
accaugaguccuguguccaggccggacauggcugggggaccaacuacucuggcaggaucuggac

SEQ ID NO: 107530 - RNA, 64 nt, Human
ugacaccgacagcugcccagccuguucacaugcuggggaccagcacagcaccugaagccaugug

SEQ ID NO: 107531 - RNA, 64 nt, Human
gcuccuguggcugugaugugggguuaagugagguggggaccaaaggaaacagagccagagcagc

SEQ ID NO: 107532 - RNA, 64 nt, Human
ugcucuggaaagccaaagcagcucaucccuuccuggggaccacacugcucugcuccaccagacc

SEQ ID NO: 107533 - RNA, 64 nt, Human
cagcagccuuccaguggcuucucccaacacucuuggggaccaaauauauuuaaugguuaaggga

SEQ ID NO: 107534 - RNA, 64 nt, Human
ccccaggccccugggaggugaguuagacagcccaggggaccagguggaccaggugguggccaga

SEQ ID NO: 107535 - RNA, 64 nt, Human
guggaagcugccuauauuucuucccaguuuaacuggggaccaucugugaaauuaauuuuccauc

SEQ ID NO: 107536 - RNA, 64 nt, Human
ugggccagcagcccccccagcccccagccuugguggggaccaagcagccuuucccguccccucc

SEQ ID NO: 107537 - RNA, 64 nt, Human
cuuguggcauguggugcccccaccaacaucccaaggggaccaauccccuugccaccacuuugca

SEQ ID NO: 107538 - RNA, 64 nt, Human
gaaggccuggacugccucucgccucaguaggccuggggaccaggcuugggucuggagguuugcu

SEQ ID NO: 107539 - RNA, 64 nt, Human
agaaagggcgguggcucgggagguuccggccuucggggaccagacuugcugccaagggcuucug

SEQ ID NO: 107540 - RNA, 64 nt, Human
ugccccugcagagcugaggcagccugggguugauggggaccacgcggugccugcagguccuaga

SEQ ID NO: 107541 - RNA, 51 nt, Human
ggcucccccggccguccugagggggaccaggcagcccucagcagccacagg

SEQ ID NO: 107542 - RNA, 58 nt, Human
auaagagacugagccgcuagcagcgccuggggaccagacagacgcauguggcaaagcu

SEQ ID NO: 107543 - RNA, 64 nt, Human
cagcacacaccugggaaagggaugcugccccaagggggaccaaaagggccggacguuacagggu

SEQ ID NO: 107544 - RNA, 64 nt, Human
guggggaucuguccuaagcugaguacagcagccaggggaccagaacuguguggggagguccacu

SEQ ID NO: 107545 - RNA, 64 nt, Human
ugggacacagaucaagggccuaucuuggagagcuggggaccagcagucugccuggaggccaggg

SEQ ID NO: 107546 - RNA, 64 nt, Human
cugaaagguaagaaauaaacaaugaaagcgaugaggggaccauuuacauaaaacacagagcuua

SEQ ID NO: 107547 - RNA, 64 nt, Human
agugaccugcucagagucauugcagagccgggauggggaccaggucucccaucuccuacuuuau

SEQ ID NO: 107548 - RNA, 64 nt, Human
cagccagugaagaaguagauuccuaaauuuuauuggggaccauggaaugguaguugagaagaaa

SEQ ID NO: 107549 - RNA, 64 nt, Human; identical to SEQ ID NO: 81980

SEQ ID NO: 107550 - RNA, 64 nt, Human; identical to SEQ ID NO: 81981

SEQ ID NO: 107551 - RNA, 64 nt, Human; identical to SEQ ID NO: 81982

SEQ ID NO: 107552 - RNA, 64 nt, Human; identical to SEQ ID NO: 81983

SEQ ID NO: 107553 - RNA, 64 nt, Human; identical to SEQ ID NO: 81984

SEQ ID NO: 107554 - RNA, 64 nt, Human; identical to SEQ ID NO: 81985

SEQ ID NO: 107555 - RNA, 50 nt, Human; identical to SEQ ID NO: 81986

SEQ ID NO: 107556 - RNA, 64 nt, Human; identical to SEQ ID NO: 81987

SEQ ID NO: 107557 - RNA, 64 nt, Human; identical to SEQ ID NO: 81988

SEQ ID NO: 107558 - RNA, 64 nt, Human; identical to SEQ ID NO: 81989

SEQ ID NO: 107559 - RNA, 64 nt, Human; identical to SEQ ID NO: 81990

SEQ ID NO: 107560 - RNA, 64 nt, Human; identical to SEQ ID NO: 81991

SEQ ID NO: 107561 - RNA, 64 nt, Human; identical to SEQ ID NO: 81992

SEQ ID NO: 107562 - RNA, 64 nt, Human; identical to SEQ ID NO: 81993

SEQ ID NO: 107563 - RNA, 64 nt, Human; identical to SEQ ID NO: 81994

SEQ ID NO: 107564 - RNA, 64 nt, Human; identical to SEQ ID NO: 81995

SEQ ID NO: 107565 - RNA, 64 nt, Human; identical to SEQ ID NO: 81996

SEQ ID NO: 107566 - RNA, 64 nt, Human; identical to SEQ ID NO: 81997

SEQ ID NO: 107567 - RNA, 64 nt, Human; identical to SEQ ID NO: 81998

SEQ ID NO: 107568 - RNA, 64 nt, Human; identical to SEQ ID NO: 81999

SEQ ID NO: 107569 - RNA, 64 nt, Human; identical to SEQ ID NO: 82000

SEQ ID NO: 107570 - RNA, 64 nt, Human; identical to SEQ ID NO: 82001

SEQ ID NO: 107571 - RNA, 64 nt, Human; identical to SEQ ID NO: 82002

SEQ ID NO: 107572 - RNA, 64 nt, Human; identical to SEQ ID NO: 82003

SEQ ID NO: 107573 - RNA, 64 nt, Human; identical to SEQ ID NO: 82004

SEQ ID NO: 107574 - RNA, 64 nt, Human; identical to SEQ ID NO: 82005

SEQ ID NO: 107575 - RNA, 64 nt, Human; identical to SEQ ID NO: 82006

SEQ ID NO: 107576 - RNA, 64 nt, Human; identical to SEQ ID NO: 82007

SEQ ID NO: 107577 - RNA, 64 nt, Human; identical to SEQ ID NO: 82008

SEQ ID NO: 107578 - RNA, 64 nt, Human; identical to SEQ ID NO: 82009

SEQ ID NO: 107579 - RNA, 64 nt, Human; identical to SEQ ID NO: 82010

SEQ ID NO: 107580 - RNA, 64 nt, Human; identical to SEQ ID NO: 82011

SEQ ID NO: 107581 - RNA, 64 nt, Human; identical to SEQ ID NO: 82012

SEQ ID NO: 107582 - RNA, 64 nt, Human; identical to SEQ ID NO: 82013

SEQ ID NO: 107583 - RNA, 64 nt, Human; identical to SEQ ID NO: 82014

SEQ ID NO: 107584 - RNA, 50 nt, Human; identical to SEQ ID NO: 82015

SEQ ID NO: 107585 - RNA, 64 nt, Human; identical to SEQ ID NO: 82016

SEQ ID NO: 107586 - RNA, 64 nt, Human; identical to SEQ ID NO: 82017

SEQ ID NO: 107587 - RNA, 64 nt, Human; identical to SEQ ID NO: 82018

SEQ ID NO: 107588 - RNA, 64 nt, Human; identical to SEQ ID NO: 82019

SEQ ID NO: 107589 - RNA, 64 nt, Human; identical to SEQ ID NO: 82020

SEQ ID NO: 107590 - RNA, 64 nt, Human; identical to SEQ ID NO: 82021

SEQ ID NO: 107591 - RNA, 64 nt, Human; identical to SEQ ID NO: 82022

SEQ ID NO: 107592 - RNA, 61 nt, Human; identical to SEQ ID NO: 82023

SEQ ID NO: 107593 - RNA, 64 nt, Human; identical to SEQ ID NO: 82024

SEQ ID NO: 107594 - RNA, 62 nt, Human; identical to SEQ ID NO: 82025

SEQ ID NO: 107595 - RNA, 64 nt, Human; identical to SEQ ID NO: 82026

SEQ ID NO: 107596 - RNA, 64 nt, Human; identical to SEQ ID NO: 82027

SEQ ID NO: 107597 - RNA, 64 nt, Human; identical to SEQ ID NO: 82028

SEQ ID NO: 107598 - RNA, 64 nt, Human; identical to SEQ ID NO: 82029

SEQ ID NO: 107599 - RNA, 64 nt, Human; identical to SEQ ID NO: 82030

SEQ ID NO: 107600 - RNA, 64 nt, Human; identical to SEQ ID NO: 82031

SEQ ID NO: 107601 - RNA, 64 nt, Human; identical to SEQ ID NO: 82032

SEQ ID NO: 107602 - RNA, 64 nt, Human; identical to SEQ ID NO: 82033

SEQ ID NO: 107603 - RNA, 64 nt, Human; identical to SEQ ID NO: 82034

SEQ ID NO: 107604 - RNA, 64 nt, Human; identical to SEQ ID NO: 82035

SEQ ID NO: 107605 - RNA, 64 nt, Human; identical to SEQ ID NO: 82036

SEQ ID NO: 107606 - RNA, 64 nt, Human; identical to SEQ ID NO: 82037

SEQ ID NO: 107607 - RNA, 64 nt, Human; identical to SEQ ID NO: 82038

SEQ ID NO: 107608 - RNA, 64 nt, Human; identical to SEQ ID NO: 82039

SEQ ID NO: 107609 - RNA, 64 nt, Human; identical to SEQ ID NO: 82040

SEQ ID NO: 107610 - RNA, 64 nt, Human; identical to SEQ ID NO: 82041

SEQ ID NO: 107611 - RNA, 64 nt, Human; identical to SEQ ID NO: 82042

SEQ ID NO: 107612 - RNA, 64 nt, Human; identical to SEQ ID NO: 82043

SEQ ID NO: 107613 - RNA, 64 nt, Human; identical to SEQ ID NO: 82044

SEQ ID NO: 107614 - RNA, 64 nt, Human; identical to SEQ ID NO: 82045

SEQ ID NO: 107615 - RNA, 64 nt, Human; identical to SEQ ID NO: 82046

SEQ ID NO: 107616 - RNA, 64 nt, Human; identical to SEQ ID NO: 82047

SEQ ID NO: 107617 - RNA, 64 nt, Human; identical to SEQ ID NO: 82048

SEQ ID NO: 107618 - RNA, 64 nt, Human; identical to SEQ ID NO: 82049

SEQ ID NO: 107619 - RNA, 62 nt, Human; identical to SEQ ID NO: 82050

SEQ ID NO: 107620 - RNA, 64 nt, Human; identical to SEQ ID NO: 82051

SEQ ID NO: 107621 - RNA, 64 nt, Human; identical to SEQ ID NO: 82052

SEQ ID NO: 107622 - RNA, 64 nt, Human; identical to SEQ ID NO: 82053

SEQ ID NO: 107623 - RNA, 64 nt, Human; identical to SEQ ID NO: 82054

SEQ ID NO: 107624 - RNA, 64 nt, Human; identical to SEQ ID NO: 82055

SEQ ID NO: 107625 - RNA, 64 nt, Human; identical to SEQ ID NO: 82056

SEQ ID NO: 107626 - RNA, 64 nt, Human; identical to SEQ ID NO: 82057

SEQ ID NO: 107627 - RNA, 64 nt, Human; identical to SEQ ID NO: 82058

SEQ ID NO: 107628 - RNA, 64 nt, Human; identical to SEQ ID NO: 82059

SEQ ID NO: 107629 - RNA, 64 nt, Human; identical to SEQ ID NO: 82060

SEQ ID NO: 107630 - RNA, 64 nt, Human; identical to SEQ ID NO: 82061

SEQ ID NO: 107631 - RNA, 64 nt, Human; identical to SEQ ID NO: 82062

SEQ ID NO: 107632 - RNA, 64 nt, Human; identical to SEQ ID NO: 82063

SEQ ID NO: 107633 - RNA, 64 nt, Human; identical to SEQ ID NO: 82064

SEQ ID NO: 107634 - RNA, 64 nt, Human; identical to SEQ ID NO: 82065

SEQ ID NO: 107635 - RNA, 64 nt, Human; identical to SEQ ID NO: 82066

SEQ ID NO: 107636 - RNA, 64 nt, Human; identical to SEQ ID NO: 82067

SEQ ID NO: 107637 - RNA, 62 nt, Human; identical to SEQ ID NO: 82068

SEQ ID NO: 107638 - RNA, 64 nt, Human; identical to SEQ ID NO: 82069

SEQ ID NO: 107639 - RNA, 64 nt, Human; identical to SEQ ID NO: 82070

SEQ ID NO: 107640 - RNA, 64 nt, Human; identical to SEQ ID NO: 82071

SEQ ID NO: 107641 - RNA, 64 nt, Human; identical to SEQ ID NO: 82072

SEQ ID NO: 107642 - RNA, 64 nt, Human; identical to SEQ ID NO: 82073

SEQ ID NO: 107643 - RNA, 64 nt, Human; identical to SEQ ID NO: 82074

SEQ ID NO: 107644 - RNA, 64 nt, Human; identical to SEQ ID NO: 82075

SEQ ID NO: 107645 - RNA, 64 nt, Human; identical to SEQ ID NO: 82076

SEQ ID NO: 107646 - RNA, 57 nt, Human; identical to SEQ ID NO: 82077

SEQ ID NO: 107647 - RNA, 64 nt, Human; identical to SEQ ID NO: 82078

SEQ ID NO: 107648 - RNA, 64 nt, Human; identical to SEQ ID NO: 82079

SEQ ID NO: 107649 - RNA, 64 nt, Human; identical to SEQ ID NO: 82080

SEQ ID NO: 107650 - RNA, 64 nt, Human; identical to SEQ ID NO: 82081

SEQ ID NO: 107651 - RNA, 64 nt, Human; identical to SEQ ID NO: 82082

SEQ ID NO: 107652 - RNA, 64 nt, Human; identical to SEQ ID NO: 82083

SEQ ID NO: 107653 - RNA, 64 nt, Human; identical to SEQ ID NO: 82084

SEQ ID NO: 107654 - RNA, 64 nt, Human; identical to SEQ ID NO: 82085

SEQ ID NO: 107655 - RNA, 64 nt, Human; identical to SEQ ID NO: 82086

SEQ ID NO: 107656 - RNA, 64 nt, Human; identical to SEQ ID NO: 82087

SEQ ID NO: 107657 - RNA, 64 nt, Human; identical to SEQ ID NO: 82088

SEQ ID NO: 107658 - RNA, 64 nt, Human; identical to SEQ ID NO: 82089

SEQ ID NO: 107659 - RNA, 64 nt, Human; identical to SEQ ID NO: 82090

SEQ ID NO: 107660 - RNA, 64 nt, Human; identical to SEQ ID NO: 82091

SEQ ID NO: 107661 - RNA, 64 nt, Human; identical to SEQ ID NO: 82092

SEQ ID NO: 107662 - RNA, 64 nt, Human; identical to SEQ ID NO: 82093

SEQ ID NO: 107663 - RNA, 64 nt, Human; identical to SEQ ID NO: 82094

SEQ ID NO: 107664 - RNA, 64 nt, Human; identical to SEQ ID NO: 82095

SEQ ID NO: 107665 - RNA, 64 nt, Human; identical to SEQ ID NO: 82096

SEQ ID NO: 107666 - RNA, 64 nt, Human; identical to SEQ ID NO: 82097

SEQ ID NO: 107667 - RNA, 64 nt, Human; identical to SEQ ID NO: 82098

SEQ ID NO: 107668 - RNA, 64 nt, Human; identical to SEQ ID NO: 82099

SEQ ID NO: 107669 - RNA, 64 nt, Human; identical to SEQ ID NO: 82100

SEQ ID NO: 107670 - RNA, 64 nt, Human; identical to SEQ ID NO: 82101

SEQ ID NO: 107671 - RNA, 64 nt, Human; identical to SEQ ID NO: 82102

SEQ ID NO: 107672 - RNA, 64 nt, Human; identical to SEQ ID NO: 82103

SEQ ID NO: 107673 - RNA, 64 nt, Human; identical to SEQ ID NO: 82104

SEQ ID NO: 107674 - RNA, 64 nt, Human; identical to SEQ ID NO: 82105

SEQ ID NO: 107675 - RNA, 64 nt, Human; identical to SEQ ID NO: 82106

SEQ ID NO: 107676 - RNA, 64 nt, Human; identical to SEQ ID NO: 82107

SEQ ID NO: 107677 - RNA, 64 nt, Human; identical to SEQ ID NO: 82108

SEQ ID NO: 107678 - RNA, 64 nt, Human; identical to SEQ ID NO: 82109

SEQ ID NO: 107679 - RNA, 64 nt, Human; identical to SEQ ID NO: 82110

SEQ ID NO: 107680 - RNA, 64 nt, Human; identical to SEQ ID NO: 82111

SEQ ID NO: 107681 - RNA, 64 nt, Human; identical to SEQ ID NO: 82112

SEQ ID NO: 107682 - RNA, 64 nt, Human; identical to SEQ ID NO: 82113

SEQ ID NO: 107683 - RNA, 64 nt, Human; identical to SEQ ID NO: 82114

SEQ ID NO: 107684 - RNA, 61 nt, Human; identical to SEQ ID NO: 82115

SEQ ID NO: 107685 - RNA, 64 nt, Human; identical to SEQ ID NO: 82116

SEQ ID NO: 107686 - RNA, 64 nt, Human; identical to SEQ ID NO: 82117

SEQ ID NO: 107687 - RNA, 64 nt, Human; identical to SEQ ID NO: 82118

SEQ ID NO: 107688 - RNA, 64 nt, Human; identical to SEQ ID NO: 82119

SEQ ID NO: 107689 - RNA, 64 nt, Human; identical to SEQ ID NO: 82120

SEQ ID NO: 107690 - RNA, 64 nt, Human; identical to SEQ ID NO: 82121

SEQ ID NO: 107691 - RNA, 64 nt, Human; identical to SEQ ID NO: 82122

SEQ ID NO: 107692 - RNA, 64 nt, Human; identical to SEQ ID NO: 82123

SEQ ID NO: 107693 - RNA, 64 nt, Human; identical to SEQ ID NO: 82124

SEQ ID NO: 107694 - RNA, 57 nt, Human; identical to SEQ ID NO: 82125

SEQ ID NO: 107695 - RNA, 64 nt, Human; identical to SEQ ID NO: 82126

SEQ ID NO: 107696 - RNA, 64 nt, Human; identical to SEQ ID NO: 82127

SEQ ID NO: 107697 - RNA, 64 nt, Human; identical to SEQ ID NO: 82128

SEQ ID NO: 107698 - RNA, 61 nt, Human; identical to SEQ ID NO: 82129

SEQ ID NO: 107699 - RNA, 64 nt, Human; identical to SEQ ID NO: 82130

SEQ ID NO: 107700 - RNA, 64 nt, Human; identical to SEQ ID NO: 82131

SEQ ID NO: 107701 - RNA, 64 nt, Human; identical to SEQ ID NO: 82132

SEQ ID NO: 107702 - RNA, 64 nt, Human; identical to SEQ ID NO: 82133

SEQ ID NO: 107703 - RNA, 64 nt, Human; identical to SEQ ID NO: 82134

SEQ ID NO: 107704 - RNA, 64 nt, Human; identical to SEQ ID NO: 82135

SEQ ID NO: 107705 - RNA, 64 nt, Human; identical to SEQ ID NO: 82136

SEQ ID NO: 107706 - RNA, 64 nt, Human; identical to SEQ ID NO: 82137

SEQ ID NO: 107707 - RNA, 64 nt, Human; identical to SEQ ID NO: 82138

SEQ ID NO: 107708 - RNA, 64 nt, Human; identical to SEQ ID NO: 82139

SEQ ID NO: 107709 - RNA, 55 nt, Human; identical to SEQ ID NO: 82140

SEQ ID NO: 107710 - RNA, 64 nt, Human; identical to SEQ ID NO: 82141

SEQ ID NO: 107711 - RNA, 64 nt, Human; identical to SEQ ID NO: 82142

SEQ ID NO: 107712 - RNA, 64 nt, Human; identical to SEQ ID NO: 82143

SEQ ID NO: 107713 - RNA, 61 nt, Human; identical to SEQ ID NO: 82144

SEQ ID NO: 107714 - RNA, 64 nt, Human; identical to SEQ ID NO: 82145

SEQ ID NO: 107715 - RNA, 64 nt, Human; identical to SEQ ID NO: 82146

SEQ ID NO: 107716 - RNA, 64 nt, Human; identical to SEQ ID NO: 82147

SEQ ID NO: 107717 - RNA, 64 nt, Human; identical to SEQ ID NO: 82148

SEQ ID NO: 107718 - RNA, 64 nt, Human; identical to SEQ ID NO: 82149

SEQ ID NO: 107719 - RNA, 64 nt, Human; identical to SEQ ID NO: 82150

SEQ ID NO: 107720 - RNA, 64 nt, Human; identical to SEQ ID NO: 82151

SEQ ID NO: 107721 - RNA, 64 nt, Human; identical to SEQ ID NO: 82152

SEQ ID NO: 107722 - RNA, 64 nt, Human; identical to SEQ ID NO: 82153

SEQ ID NO: 107723 - RNA, 64 nt, Human; identical to SEQ ID NO: 82154

SEQ ID NO: 107724 - RNA, 64 nt, Human; identical to SEQ ID NO: 82155

SEQ ID NO: 107725 - RNA, 64 nt, Human; identical to SEQ ID NO: 82156

SEQ ID NO: 107726 - RNA, 64 nt, Human; identical to SEQ ID NO: 82157

SEQ ID NO: 107727 - RNA, 64 nt, Human; identical to SEQ ID NO: 82158

SEQ ID NO: 107728 - RNA, 64 nt, Human; identical to SEQ ID NO: 82159

SEQ ID NO: 107729 - RNA, 64 nt, Human; identical to SEQ ID NO: 82160

SEQ ID NO: 107730 - RNA, 64 nt, Human; identical to SEQ ID NO: 82161

SEQ ID NO: 107731 - RNA, 64 nt, Human; identical to SEQ ID NO: 82162

SEQ ID NO: 107732 - RNA, 64 nt, Human; identical to SEQ ID NO: 82163

SEQ ID NO: 107733 - RNA, 64 nt, Human; identical to SEQ ID NO: 82164

SEQ ID NO: 107734 - RNA, 64 nt, Human; identical to SEQ ID NO: 82165

SEQ ID NO: 107735 - RNA, 64 nt, Human; identical to SEQ ID NO: 82166

SEQ ID NO: 107736 - RNA, 64 nt, Human; identical to SEQ ID NO: 82167

SEQ ID NO: 107737 - RNA, 64 nt, Human; identical to SEQ ID NO: 82168

SEQ ID NO: 107738 - RNA, 64 nt, Human; identical to SEQ ID NO: 82169

SEQ ID NO: 107739 - RNA, 64 nt, Human; identical to SEQ ID NO: 82170

SEQ ID NO: 107740 - RNA, 64 nt, Human; identical to SEQ ID NO: 82171

SEQ ID NO: 107741 - RNA, 64 nt, Human; identical to SEQ ID NO: 82172

SEQ ID NO: 107742 - RNA, 64 nt, Human; identical to SEQ ID NO: 82173

SEQ ID NO: 107743 - RNA, 64 nt, Human
ggguugaccucugccgccugccuggguaucugggccuggccauggcuguguucuucauguguug

SEQ ID NO: 107744 - RNA, 64 nt, Human
ccgucaguagucauugccacccgcggggcaccucccuggccacacgccuguucccagcaagugc

SEQ ID NO: 107745 - RNA, 64 nt, Human
gguggaucacgugaggucaagaguucaagaccagccuggccaauauggugaaaccccaucucua

SEQ ID NO: 107746 - RNA, 64 nt, Human
cgggcagaucacgagaucaggaguucaagaccagccuggccaauaugaugaaaccccgucucua

SEQ ID NO: 107747 - RNA, 64 nt, Human
gguggaucaccugaggucagaaguuugagaccagccuggccaacauggugaaaccccgucucua

SEQ ID NO: 107748 - RNA, 64 nt, Human
cagguggaucacgaggucaggagauagagaccauccuggccaacacggugaaacccugucucua

SEQ ID NO: 107749 - RNA, 64 nt, Human
caggcgggccccgggcugcacuccgagcaguguuccuggccaucuuugcuacuuuccuagagaa

SEQ ID NO: 107750 - RNA, 64 nt, Human
ugggcucccccaggggcacguguggcuccugcccccuggccacugccaagagaaugaagcaccc

SEQ ID NO: 107751 - RNA, 64 nt, Human
gguggaucaccugagguuaggaguucgagaccagccuggccaacaugguaaaaccccaucucua

SEQ ID NO: 107752 - RNA, 64 nt, Human
gguggaucaccugaggucaggaguucaagaccagccuggccaacauggugaaacccugucucua

SEQ ID NO: 107753 - RNA, 64 nt, Human
uucucuugggggagucuuggcacuuugcaaacauccuggccaccaugggcaccaggacacaggg

SEQ ID NO: 107754 - RNA, 64 nt, Human
gcccugagcccaucuucccuggcguccucucccuccuggccagaugucgcuggguccucugcag

SEQ ID NO: 107755 - RNA, 64 nt, Human
cacgagacccuccagcuuugggagccaccccacaccuggccaacgcuggcggcccguguccccu

SEQ ID NO: 107756 - RNA, 64 nt, Human
gagcacaugagauguccucagcugggcuuggcugccuggccagggccgggggcucagcagccuc

SEQ ID NO: 107757 - RNA, 64 nt, Human
agcaguuucucuccaacucccucugggaaggugaccuggccagagccaagaaacacuuucagaa

SEQ ID NO: 107758 - RNA, 64 nt, Human
auauucuccuguuuuuauuaaaccagugauuacaccuggccaucccucuaaauguucuaggaag

SEQ ID NO: 107759 - RNA, 64 nt, Human
aaggcggcuccccuguuuaucuagagccuucguuccuggccauaccccggacugcccuccugug

SEQ ID NO: 107760 - RNA, 51 nt, Human
uccgaccuccugaccucugacccuggccagcacucuagcuccugaccuuug

SEQ ID NO: 107761 - RNA, 64 nt, Human
cuggacuccaucaccacacuccccccagccuucaccuggccaugaaggaccuuuugaccaacuc

SEQ ID NO: 107762 - RNA, 64 nt, Human
ggccgugcugcugcugggcggggcaggagaggagccuggccagugugccacauuaaauacccgu

SEQ ID NO: 107763 - RNA, 64 nt, Human
caaagugcugggauuacaggcaugagccaccacgccuggccaaaaaaauauguuuuaaaugucc

SEQ ID NO: 107764 - RNA, 64 nt, Human
gguggaucacccaaggucaggaguuugagaccagccuggccaaauggugaaaccccaucucuac

SEQ ID NO: 107765 - RNA, 64 nt, Human
accucccugaccagcucuggcuucugcuccugccccuggccauuggugacuaguggggccaaga

SEQ ID NO: 107766 - RNA, 64 nt, Human
aggcuuccauccccguccaugcucaagaugggucccuggccaccauggucaucaccacccuucc

SEQ ID NO: 107767 - RNA, 64 nt, Human
gcaccaugugagcuggaagcugccugcaacccugccuggccaccuccaggccuggcuccccacc

SEQ ID NO: 107768 - RNA, 64 nt, Human
cagaggcugaguuagggggcuagaggacagugcuccuggccacccagccucugcugagaaccau

SEQ ID NO: 107769 - RNA, 64 nt, Human
ggaucaccugaggucaggaggaguucaagaccagccuggccaacguggugaaaccccaucucua

SEQ ID NO: 107770 - RNA, 64 nt, Human
ugcgccucucggggaacacauuccgggagagaugccuggccaggcuccacggaucccgccagaa

SEQ ID NO: 107771 - RNA, 64 nt, Human
gauuauuugaaucuuacagcaacaaauaggaacuccuggccaaugagagcucuugaccagugaa

SEQ ID NO: 107772 - RNA, 64 nt, Human
gguggaucacuugaggucaggaguuugagaccaaccuggccaacauggugaaaccuugucucua

SEQ ID NO: 107773 - RNA, 64 nt, Human
caggagcaguccgacuaggccccaggcccgcccuccuggccagcagaguggggcacuggggggc

SEQ ID NO: 107774 - RNA, 64 nt, Human
gcauccugccuugcugcucugucccccacaucuuccuggccacagccccuugccccuccucuaa

SEQ ID NO: 107775 - RNA, 64 nt, Human
ugugcaucuacgcagcccagguccaggaccacauccuggccagcugcuggcagaacuccuggcu

SEQ ID NO: 107776 - RNA, 64 nt, Human
gguggaucaccugaggucaggaguucgaguccagccuggccaauaugcugaaacccugucucua

SEQ ID NO: 107777 - RNA, 64 nt, Human
uggcagaauucuugcuguauugccaugaugucacccuggccauguguacugacuugaggagauc

SEQ ID NO: 107778 - RNA, 64 nt, Human
aaggaucauuugcuuccuacccagcucaaucugcccuggccauagggcuucccagggaaggaag

SEQ ID NO: 107779 - RNA, 64 nt, Human
ucucugaggaggagguggccaagaagcggaaaaaccuggccacuuauugccggccagugaaggc

SEQ ID NO: 107780 - RNA, 64 nt, Human
aggagacauuauggggcguccaccaccaccccucccuggccauccuccuggaauguggucugcc

SEQ ID NO: 107781 - RNA, 64 nt, Human
aaggguaccuguagagagcuucuuuuuguuucuaccuggccaaaguuagaugggacaaagauga

SEQ ID NO: 107782 - RNA, 64 nt, Human
uugauaguuucugccucacucaucccuccuguacccuggccagaacaucucacugauacucgaa

SEQ ID NO: 107783 - RNA, 64 nt, Human
caggcggaucacaaggucaagagauuaagaucauccuggccaacauggugacaccccgucucua

SEQ ID NO: 107784 - RNA, 64 nt, Human
acuucgggcuccugugucucaccauucccaagccccuggccacucuaagcugggcagacggagc

SEQ ID NO: 107785 - RNA, 64 nt, Human
acucuaggcacaggccggggcugcggugcaggcaccuggccaugcuggcugggcggcccaagca

SEQ ID NO: 107786 - RNA, 64 nt, Human
uggcuguggcacagacagguggaaaacgggauagccuggccagucccucuguugucugcauucg

SEQ ID NO: 107787 - RNA, 64 nt, Human
cagguggaucaugaggucaggaguucgaggcgagccuggccaacauggugaaacccugucucua

SEQ ID NO: 107788 - RNA, 64 nt, Human
ggugggucaucugaggucaggaguucaagaccagccuggccaacauggugaaaccccaucucua

SEQ ID NO: 107789 - RNA, 61 nt, Human
uucaacaaggcgacgagugaugcugucagugccuggccauguuccuacggcucagguccuc

SEQ ID NO: 107790 - RNA, 64 nt, Human
gguggaucaccugaggucagaaguucaagaccagccuggccaacauggugaaaccccgucucua

SEQ ID NO: 107791 - RNA, 64 nt, Human
cccugggaggaaggaccaccccgggcccucuaugccuggccagccuccagcuccucagaccucc

SEQ ID NO: 107792 - RNA, 64 nt, Human
ggcagaucaccugaggucaggaguucaagaccagccuggccaacauagugaaaccccuuguuua

SEQ ID NO: 107793 - RNA, 64 nt, Human
ggcagaucacuuggugccaggaguucuagaccagccuggccaacaugacccaucuuuacuaaaa

SEQ ID NO: 107794 - RNA, 64 nt, Human
uggcccugccugcucccagguauaccuaggaccaccuggccagauccgcucccagacggccuug

SEQ ID NO: 107795 - RNA, 64 nt, Human
aaguucaugaguaagggcugcaaggaauucuuauccuggccacauguccuccgugcacacaccc

SEQ ID NO: 107796 - RNA, 64 nt, Human
gguggaucaccugaggucaggaguucgagaccagccuggccaacacggugaaaccccaucucua

SEQ ID NO: 107797 - RNA, 64 nt, Human
cagcccugggagccuccugagggcccucccugucccuggccacgggcccuucuuaccucacuca

SEQ ID NO: 107798 - RNA, 64 nt, Human
uccugccccgcccgcagcucccucccacaccccgccuggccaagaugacugcuucagggggcuu

SEQ ID NO: 107799 - RNA, 64 nt, Human
cggguggaucacaagcucaggaguucaagaccagccuggccaacauggugaaacccugucucua

SEQ ID NO: 107800 - RNA, 64 nt, Human
ugggcuuuggaggagacuggagccucagcccuguccuggccacgggccgcuggggcuggugugg

SEQ ID NO: 107801 - RNA, 64 nt, Human
ccucugccugguuagacucgggcacccaggaaagccuggccagggcuccuuugggccugggccc

SEQ ID NO: 107802 - RNA, 64 nt, Human
ggccccacagugccucagauggcuccacggagacccuggccaugguugugguagagccugggga

SEQ ID NO: 107803 - RNA, 64 nt, Human
caaagugcugggauuacaggcaugagccacugugccuggccaacauaauguuuucacaguuccu

SEQ ID NO: 107804 - RNA, 64 nt, Human
cacgaggauccucagugaccaugguggccacacgccuggccagccugcuggcuccugggugagc

SEQ ID NO: 107805 - RNA, 64 nt, Human
cucugucccccucuacugucccuuucacaccuugccuggccaaggggcuagaccucccaggcua

SEQ ID NO: 107806 - RNA, 64 nt, Human
gucuccucucuggauggaauccgcgagcuggccaccuggccacccucuacacggcuccacccug

SEQ ID NO: 107807 - RNA, 64 nt, Human
ggcagaucaccugaggucaggaguuuuagaccagccuggccaacaugacgaaacccggucucua

SEQ ID NO: 107808 - RNA, 64 nt, Human
agugcucagggaauuugccucuccuugccccauuccuggccaguuucacaaucuagcucgacag

SEQ ID NO: 107809 - RNA, 64 nt, Human
aggcagaucacuuaaggccaggaguucaagaccaccuggccaacauggugaaaccccgucucua

SEQ ID NO: 107810 - RNA, 64 nt, Human
aucaggugggcagaggcuggcagugcugauucagccuggccauccccagaggugacccaaugcu

SEQ ID NO: 107811 - RNA, 64 nt, Human
caaggucucacacuccuccugccagcucugucacccuggccaccacccaaccuguccuuacuca

SEQ ID NO: 107812 - RNA, 64 nt, Human
agggcagugguucucccaaauaggagaccuggggccuggccaggccaggguuugggccuaaugg

SEQ ID NO: 107813 - RNA, 64 nt, Human
auguucugaucacuaccacccagcugguuccagcccuggccaagguucuccuauauggacuagg

SEQ ID NO: 107814 - RNA, 64 nt, Human
gugggcagaucaugggucaagagaucgagaccauccuggccaacauuguaaaaccccaucucua

SEQ ID NO: 107815 - RNA, 64 nt, Human
acacaauggaggcugacagaggcaggagccuaccccuggccacaccaccucugggacacggcac

SEQ ID NO: 107816 - RNA, 64 nt, Human
cacagaaucagaaagagcuagaagaaaaggcucaccuggccacuguuuaggcacccagacauaa

SEQ ID NO: 107817 - RNA, 64 nt, Human
caugcagaaguagaagcuggugaggggcagggucccuggccagaaggggcauggccaccuccca

SEQ ID NO: 107818 - RNA, 64 nt, Human
ggcagaucaccugaagucaggaguucaagaccauccuggccaacacagugaaaccccaucugua

SEQ ID NO: 107819 - RNA, 64 nt, Human
cugucacgaagcagaguuggcacauaacauggaaccuggccaggcaugguggcucacaccuaua

SEQ ID NO: 107820 - RNA, 64 nt, Human
uuccagugaagcacgaggucuugguuccaggguuccuggccaggugcccccuuagcauuuguuc

SEQ ID NO: 107821 - RNA, 64 nt, Human
gcguucugcagcauguagcaugcccaccuagcucccuggccagggcccuggggaggcagagggu

SEQ ID NO: 107822 - RNA, 64 nt, Human
ccuggcuuauacugcccccaccacagcuccuugcccuggccagaacugcugucgaagaaaauca

SEQ ID NO: 107823 - RNA, 64 nt, Human
guccaggagcccaggacaggccuuuucugugggcccuggccagacaggguuaccuggugaggug

SEQ ID NO: 107824 - RNA, 64 nt, Human
ggguagauaccugaagucaggaguucgagacuagccuggccaauaugguaaaaccccgugucua

SEQ ID NO: 107825 - RNA, 64 nt, Human
ucccaccccaaacccucucccgggacucagucucccuggccacugcguaucaggcuucugggga

SEQ ID NO: 107826 - RNA, 64 nt, Human
ugaaaugcuccagucacaccuuauaggcccuaggccuggccaggcauuguccccuggaaaccug

SEQ ID NO: 107827 - RNA, 64 nt, Human
gguggaucaccugaggucaggaauucaagaccagccuggccaacauggugaaaccccgucucca

SEQ ID NO: 107828 - RNA, 64 nt, Human
gaguucauggcuuuuuuuuguagccaguccugucccuggccauccaugugaugguuuuggaugg

SEQ ID NO: 107829 - RNA, 64 nt, Human
gccagaucaccugaggucaggaguucgagaccacccuggccaacauggugaaaccccaucucua

SEQ ID NO: 107830 - RNA, 64 nt, Human
ggcggaucaccugagguuagaaguuugagaccagccuggccaacauggugaaaccuggccucua

SEQ ID NO: 107831 - RNA, 64 nt, Human
ugggcagaucacgaggucaagagaucgagaccauccuggccaacaugaugaaaccccguuucua

SEQ ID NO: 107832 - RNA, 64 nt, Human
ggcggauuaccuggggucaggaguucaugaccagccuggccaacauggugaaaccccgucucua

SEQ ID NO: 107833 - RNA, 64 nt, Human
uggcccucuucuugaauuggccauauacagggucccuggccaguggacugaaggcuuugucuaa

SEQ ID NO: 107834 - RNA, 64 nt, Human
uuuucuuacucugaauuuagaucuccagacccugccuggccacaauucaaauuaaggcaacaaa

SEQ ID NO: 107835 - RNA, 64 nt, Human
auuauuuugaaacuuugcuuuggguuuguggcacccuggccaccccaucuggcugugacagccu

SEQ ID NO: 107836 - RNA, 64 nt, Human
ggaaagugcuuggauuaggagagucuugugggccccuggccagccuuccugccucagcuccccu

SEQ ID NO: 107837 - RNA, 64 nt, Human
cucaccccuuccccagcugggaggagcuugccugccuggccacagacaguguaucuucuaauug

SEQ ID NO: 107838 - RNA, 64 nt, Human
gggcccaacucgguucacacggaucgugcugcucccuggccagccuuuggccacagcaccacca

SEQ ID NO: 107839 - RNA, 64 nt, Human
ggcagaucaucugaggccaggaguucgagaccugccuggccaacauggcaacaccccgucucua

SEQ ID NO: 107840 - RNA, 64 nt, Human
gggagaucacuugaggucaggaguucaagaccagccuggccaacuuggugaaaccccgucuuua

SEQ ID NO: 107841 - RNA, 64 nt, Human
caaagugcugggauuacaggcgugagccaccgugccuggccacgcccaacuaauuuuuguauuu

SEQ ID NO: 107842 - RNA, 64 nt, Human
gaggccucacagaagagauacuugcaguuccaggccuggccaccaggugacgccuuccuucucu

SEQ ID NO: 107843 - RNA, 64 nt, Human
ugaaaucaagggcuugggaaucuagagcagagcuccuggccagcguuugaagccuggccuccca

SEQ ID NO: 107844 - RNA, 64 nt, Human
gguugaucacccgaggucaggaguucaagaccagccuggccaacguggugaaagccuguaucua

SEQ ID NO: 107845 - RNA, 64 nt, Human
auuagggcagcuuaccccaacaugaaaaugaugaccuggccauuuuuaauggccagagcuugaa

SEQ ID NO: 107846 - RNA, 64 nt, Human
cgggcggaucacaagguccagaguucaagagcagccuggccaacauggugaaaccccgucucua

SEQ ID NO: 107847 - RNA, 64 nt, Human
gguggaucgccugaggucaggaguucaagaucaaccuggccaacauacugaaaccccgucucua

SEQ ID NO: 107848 - RNA, 64 nt, Human
ucauacacgcacauccaaaagccugugccucauuccuggccaugggugaggacuuggucuguca

SEQ ID NO: 107849 - RNA, 64 nt, Human
acaaggaugugaagcauaugaacucugcaggaguccuggccacacugaggaauuaugacuacua

SEQ ID NO: 107850 - RNA, 64 nt, Human
gaaggucuacaccugcaagggacgaguccccgggccuggccaacccugcugugcagggugaggg

SEQ ID NO: 107851 - RNA, 64 nt, Human
gcccacacuaugcacagagcccaaugcauagagcccuggccagcccuuccucucacuccugccu

SEQ ID NO: 107852 - RNA, 64 nt, Human
cagcagggccuugacaggaauccagggaguagcuccuggccagaaccagccucugcggggcuug

SEQ ID NO: 107853 - RNA, 64 nt, Human
gguggaucacuugagaccaggaauucgagaccagccuggccaacauggugaaaccccgucucua

SEQ ID NO: 107854 - RNA, 64 nt, Human
caaacggaucacgaggucaggagaucaagaccauccuggccaacauggugaaaccccaucucua

SEQ ID NO: 107855 - RNA, 64 nt, Human
gguggaucucuugaggucgggaguuugagaccagccuggccaacauggugaaacccugucuuua

SEQ ID NO: 107856 - RNA, 64 nt, Human
cccugcgugggcccaagcuggacucuggccacucccuggccaggcuuuggggaggccuggaguc

SEQ ID NO: 107857 - RNA, 64 nt, Human
agaguacguguaaauacauaguguucauaagagaccuggccacaugugcaugaaugacugggcc

SEQ ID NO: 107858 - RNA, 64 nt, Human
agcugcaggggcuuucagggggucaugucaggagccuggccaggccgcaccccuugcugucuca

SEQ ID NO: 107859 - RNA, 64 nt, Human
uggguggaucacaaggucaggaguucaagaccagccuggccaauauggugaaaguccgucucua

SEQ ID NO: 107860 - RNA, 64 nt, Human
gcccccuggucaucccggccuucccggcccacuuccuggccaccgcaggccccucgcccauggc

SEQ ID NO: 107861 - RNA, 64 nt, Human
gaccagggauugucuugcaccaaguaugccuaccccuggccagucugaggucuccuagccauag

SEQ ID NO: 107862 - RNA, 64 nt, Human
ucccauuuuguuucuuuggauuugggguggggguccuggccaagaacucagucauuuuucugug

SEQ ID NO: 107863 - RNA, 64 nt, Human
gcagggccucagccucaggaugcauuuaauguauccuggccacaguugcagccaacgguucuug

SEQ ID NO: 107864 - RNA, 64 nt, Human
uaucuauauuaaaaacaaaauuucugucaucuguccuggccauucaggcaacuccagccugggc

SEQ ID NO: 107865 - RNA, 64 nt, Human
gguggaucacuugaggccaggaguuugaaaccagccuggccaacauggugaaaaccugucucua

SEQ ID NO: 107866 - RNA, 64 nt, Human
ccacccccauggcagucccuccgcagccccagucccuggccacgcccaagggaagagggaggug

SEQ ID NO: 107867 - RNA, 64 nt, Human
caccaguuuuuuuaguaucgcccacgcccaguucccuggccaaguccgcagggcccuccuagag

SEQ ID NO: 107868 - RNA, 64 nt, Human
agauuuuuucuguugcucuuugaaaacuaugagcccuggccagcuuaaccuggucugaggugag

SEQ ID NO: 107869 - RNA, 64 nt, Human
ggcggaucaccugaugucagggguucgagaccagccuggccaacauggugaaacccuguugcua

SEQ ID NO: 107870 - RNA, 64 nt, Human
ggcagaucacuucaggucaggaguucgagaccagccuggccaacaugguaaacgcugucccuag

SEQ ID NO: 107871 - RNA, 64 nt, Human
ggcagaucacuugaggucaggaguucgagaccagccuggccaauacggcaaaaccucaucauua

SEQ ID NO: 107872 - RNA, 64 nt, Human
cggguggaucaugaggucagacguucaacaccagccuggccaagauggugaaaccccgucucua

SEQ ID NO: 107873 - RNA, 64 nt, Human
gguggaucaccuguggucaagaguucaagaccagccuggccaucauggugaaaccccaucucua

SEQ ID NO: 107874 - RNA, 64 nt, Human
ggcagaucaccugaggucaggaguucaagaccagccuggccaacaugacgaaaccccaucucua

SEQ ID NO: 107875 - RNA, 64 nt, Human
aagugcugggacgugacaggagugagccaccacaccuggccacucgcaagaccuuuuaucugaa

SEQ ID NO: 107876 - RNA, 64 nt, Human
ggcagaaaugguuccuuccggcuuggcguucucuccuggccacucuuccugcugccucugacua

SEQ ID NO: 107877 - RNA, 64 nt, Human
ggcagaucacuugaggucaggaguucgagaccagccuggccaacauggcaaaaccacaucucua

SEQ ID NO: 107878 - RNA, 64 nt, Human
gguggaucaccugaggucaagaguucgaggccagccuggccaacauggugaaacccugucucua

SEQ ID NO: 107879 - RNA, 64 nt, Human
cugaauggaucguugcagagaagacucacccagaccuggccagggaaugauguaucuggggaga

SEQ ID NO: 107880 - RNA, 64 nt, Human
gggccucacacuugccacccccagaaccagcucaccuggccagaguggguuccugcuggccagg

SEQ ID NO: 107881 - RNA, 64 nt, Human
ggccaugagccucccgggaauguuuaauaaagggccuggccaacucuccucacuguguggggug

SEQ ID NO: 107882 - RNA, 64 nt, Human
ccucaggcaggugggcuuugugguccucgccgccccuggccacaucgcccucuccucuuacacc

SEQ ID NO: 107883 - RNA, 64 nt, Human
cagagugcugggauuacaggcgugagccaccgcgccuggccacccagcuaaguuuguauuuuug

SEQ ID NO: 107884 - RNA, 64 nt, Human
ggcggaucacuugaggucaggaguuggagaccagccuggccaacguggugaauccccgucucua

SEQ ID NO: 107885 - RNA, 64 nt, Human
aucccacauguucucaaggccguuaaguuccaguccuggccagucauucccugauugguaucug

SEQ ID NO: 107886 - RNA, 64 nt, Human
cggggggaucacgaggucaagagaucgagaccauccuggccaacauggugaaaccccgucucua

SEQ ID NO: 107887 - RNA, 64 nt, Human
gacacccuccugccuguuuuucucugcaucccaaccuggccaaggccccuccuguggggugccc

SEQ ID NO: 107888 - RNA, 64 nt, Human
ggcagaucacuugaggccaggaguucgagaccagccuggccaacauggcaaaaccccuucucua

SEQ ID NO: 107889 - RNA, 64 nt, Human
guuucccaggcuggucuugaacuccugggccaugccuggccagggacaugaauuuguacaaaga

SEQ ID NO: 107890 - RNA, 64 nt, Human
gguggaucaccugaggucaggaguuugagaccagccuggccaacacuaucuguacuaaaaacac

SEQ ID NO: 107891 - RNA, 64 nt, Human
gguggaucaccugaggucaggaguucaagaccagccuggccaacauggcgaaaccccgucucua

SEQ ID NO: 107892 - RNA, 64 nt, Human
aggagugccugaauagcuuggaaaaguaacaucuccuggccaucccuucauuuaaccaagcuau

SEQ ID NO: 107893 - RNA, 64 nt, Human
gguggaacauuugagggcaugaguucgagaccagccuggccaacauggugaaacccugucucua

SEQ ID NO: 107894 - RNA, 64 nt, Human
uugaggcacagaaacuccuguucaugcccauaccccuggccaaggaagaucccuuuguccacaa

SEQ ID NO: 107895 - RNA, 64 nt, Human
cuggccccacgugugugguguuugugugucugugccuggccaagggaggugccaacacugggcu

SEQ ID NO: 107896 - RNA, 64 nt, Human
gguggauuaccugaggucaggacuucaagaccagccuggccaacauggugaaaccccgucucca

SEQ ID NO: 107897 - RNA, 64 nt, Human
gguggaucacuugaggucaggaguucgagagcagccuggccaauaugaugaaaccccaucucua

SEQ ID NO: 107898 - RNA, 64 nt, Human
caaagagcugagauuacaggcgugagccaccaugccuggccaaaacaccugauuuuuaaauggu

SEQ ID NO: 107899 - RNA, 64 nt, Human
gaagugugcagaucaccugagguccggagaccagccuggccaacauggugaaacccugucucua

SEQ ID NO: 107900 - RNA, 64 nt, Human
uccccuggcuccagagauggucacaugacccaggccuggccagucaaaguagucucuccccugg

SEQ ID NO: 107901 - RNA, 64 nt, Human
ugacccaggccuggccagucaaaguagucucuccccuggccacaguaauuggucaugugaugca

SEQ ID NO: 107902 - RNA, 64 nt, Human
ugggcagaucacaaggucaggaguucaagaccagccuggccaacauagugaaaccccaucucua

SEQ ID NO: 107903 - RNA, 64 nt, Human
cugcccugcuaaagacagugcggaugcaagagcaccuggccaagcgagagcagcuggguaagcg

SEQ ID NO: 107904 - RNA, 64 nt, Human
agauggggcgagccaggaccacagagcuccuggcccuggccagaagcaggagugugaggaggag

SEQ ID NO: 107905 - RNA, 64 nt, Human
agagagagaagggaccaauuaugaggacugacauccuggccacucuccuuaaaauaaacacuga

SEQ ID NO: 107906 - RNA, 64 nt, Human
caaagugcugggauuacaggccucagcuaccacgccuggccaauccaggucuuaagagaccuca

SEQ ID NO: 107907 - RNA, 64 nt, Human
agauguuucuucucuuuuacaaguaagaccuacuccuggccacuuaggagagcugaauuuaugg

SEQ ID NO: 107908 - RNA, 64 nt, Human
gggacagccucuucagccccuucuccccuccccgccuggccagggcagggccaccccacucuac

SEQ ID NO: 107909 - RNA, 64 nt, Human
ccuccacugcccugggugcaugcguacacaauucccuggccaagccuggcucgagcacaggaag

SEQ ID NO: 107910 - RNA, 64 nt, Human
ucagccugcauaacagacugaaaugugcucaggcccuggccaggagggcccagggucauucuuu

SEQ ID NO: 107911 - RNA, 64 nt, Human
ggcggaucacuugaggucaggaguccaagaccagccuggccaacauggugaaaccccaucucua

SEQ ID NO: 107912 - RNA, 64 nt, Human
ccuuucuaaaaacguugguugaaggaccuaaauaccuggccauaccauagauuugggaugaugu

SEQ ID NO: 107913 - RNA, 64 nt, Human
caaacugcugggauuacaggcgugagccaccgcgccuggccagggacuauacucuuuuuaaaau

SEQ ID NO: 107914 - RNA, 64 nt, Human
ggcagaucaccugaggucaggaguucaagaccagccuggccaacauggugaaaccccgucucua

SEQ ID NO: 107915 - RNA, 64 nt, Human
caaagugcugggauuacagacaugagccaccgagccuggccaauuuuuguguuuuuuguagaga

SEQ ID NO: 107916 - RNA, 64 nt, Human
cgggcagaucacgaggucaagagaucaagaccauccuggccaacauggugaaauccugccucua

SEQ ID NO: 107917 - RNA, 64 nt, Human
caaagggcugagauuacaggugugagcuaccucaccuggccaaaacaguuuuuuuagaaaugaa

SEQ ID NO: 107918 - RNA, 64 nt, Human
uuccuucugccaugggaggaugaaacaugaaggcccuggccagguguggccccuccaucuuccg

SEQ ID NO: 107919 - RNA, 64 nt, Human
caccuggccgccgggccagcgggcgcagggcacaccuggccaggcuugggggcagcccaucuca

SEQ ID NO: 107920 - RNA, 64 nt, Human
ccaaaagagagggauggcuuucccagaagacacuccuggccaucuguggauuugucugugcacc

SEQ ID NO: 107921 - RNA, 64 nt, Human
aguccacuugggucaucagcucugccaagcugagccuggccaagcuagguggacagacccuugc

SEQ ID NO: 107922 - RNA, 64 nt, Human
gacaggccugaggcccugggcacagugacgguggccuggccagcccucgggaccccuccccacc

SEQ ID NO: 107923 - RNA, 64 nt, Human
ucacuaugcaaacuagaauauccucagcagguggccuggccacucuggagaaagaaacccaagg

SEQ ID NO: 107924 - RNA, 64 nt, Human
uccuggcuucugaguggguuuggccaaggaguguccuggccagagaucagaggaugguagggug

SEQ ID NO: 107925 - RNA, 64 nt, Human
aucuaaauuuguaguuccuauuucuguggguuugccuggccaugguuggagagggaaugguguu

SEQ ID NO: 107926 - RNA, 64 nt, Human
gguggaucacuugaggucgggaguucgagaccagccuggccaacauagcaaaacccugucucua

SEQ ID NO: 107927 - RNA, 64 nt, Human
uaagugccgaacucaucccuguuccucaaggccaccuggccaggagcuucucugaugugauauc

SEQ ID NO: 107928 - RNA, 64 nt, Human
guuggcugaaguuccuagucucaggccguaggugccuggccaguuuccuguuuguggggcagcu

SEQ ID NO: 107929 - RNA, 64 nt, Human
ccagcugcagagggcucucucuaggcagagcguuccuggccagagcucuaccucuuugccuccu

SEQ ID NO: 107930 - RNA, 64 nt, Human
cagggcucugggacagacuggaaaggaccacagaccuggccaucccugggcagcagggccagug

SEQ ID NO: 107931 - RNA, 64 nt, Human
gauuuccagaauggagcuuagugcuacugaauacccuggccacagagccaccucaggauauucu

SEQ ID NO: 107932 - RNA, 64 nt, Human
cagguggaucacgaggucaagagaucgagaccauccuggccaacaugaugaaacuccgucucua

SEQ ID NO: 107933 - RNA, 64 nt, Human
ccuacagagugagcuuggccaagccagcugcaaaccuggccagaggaguucuauugcaucucuc

SEQ ID NO: 107934 - RNA, 64 nt, Human
gguggaucacuugaggucaggaguuugaggccagccuggccaacauggcgaaaccccauuucua

SEQ ID NO: 107935 - RNA, 64 nt, Human
uggcagaaagccaucaggugcucaaucaucuucuccuggccaaggcucugaccaugcuuaguac

SEQ ID NO: 107936 - RNA, 64 nt, Human
cauccagaaagaagacaugaggcugcaccgcuuaccuggccacuggcacuccagggagcucugg

SEQ ID NO: 107937 - RNA, 64 nt, Human
gaagccaucagaggugcaagggcuuagaaaagacccuggccagaccugacuccacucuuaaacc

SEQ ID NO: 107938 - RNA, 64 nt, Human
caaagugcugggauuacaggugugagacacugugccuggccagauauacauuguuuuagauccc

SEQ ID NO: 107939 - RNA, 64 nt, Human
uugucccccaaaccugcaugaagcaagaacaacuccuggccaggcccuguccuccccacguacc

SEQ ID NO: 107940 - RNA, 64 nt, Human
agggacuuggaggacccaccugugaggacccugaccuggccaucuugagggguuuucuaacccc

SEQ ID NO: 107941 - RNA, 64 nt, Human
ugggcugggcccagaccuccacucgcuugccugcccuggccaccugaacuguaugggcacucuc

SEQ ID NO: 107942 - RNA, 64 nt, Human
gguuggggagggggucggggucccaggaccugagccuggccauguccucaaccccaaauccccc

SEQ ID NO: 107943 - RNA, 64 nt, Human
uugaaccuccuucucuaccucagcuucagaccccccuggccagugagcuggaccucaugcccua

SEQ ID NO: 107944 - RNA, 64 nt, Human
caaagugcugggauuacaggcuugagccacugcuccuggccaacauccaguauuuuaucuugac

SEQ ID NO: 107945 - RNA, 64 nt, Human
ggaggaucuccagaggucaggaguucgagaccagccuggccaacauggugaaaccccgucucua

SEQ ID NO: 107946 - RNA, 64 nt, Human
ccugagucuuucaguagacuacacugcccagaacccuggccauucucaaaaugagaacuuggga

SEQ ID NO: 107947 - RNA, 64 nt, Human
uuuuauuuuagaaaaagguuguuacauaaaacacccuggccaguucauuucagcaugcucuuuc

SEQ ID NO: 107948 - RNA, 64 nt, Human
cugucucucccuuccaggaaugcugggcccccagccuggccagacaagaagacugucaggaagg

SEQ ID NO: 107949 - RNA, 64 nt, Human
ggccaggagcccacagugccuguacaggaaggugccuggccaugucaccuggcugcuaggccag

SEQ ID NO: 107950 - RNA, 64 nt, Human
caaaguacugggauuacaggcgugagccaccaugccuggccagaaaucuauguuuucuuagaac

SEQ ID NO: 107951 - RNA, 64 nt, Human
cucucuccggcugggaugaucacacccucugcuuccuggccaccugccagccuccaugcaacuc

SEQ ID NO: 107952 - RNA, 64 nt, Human
gguggaugauuccuggucuccccagcccucuugaccuggccacagagagcugccuuuccagcga

SEQ ID NO: 107953 - RNA, 64 nt, Human
cccugcccucugcacuaagcacuuuccaggcaggccuggccauagggcaagagcaggccuuaca

SEQ ID NO: 107954 - RNA, 64 nt, Human
uguuaucuccacuucccccucacccguagaggauccuggccacagacaguuucaaguaguguca

SEQ ID NO: 107955 - RNA, 64 nt, Human
ggaggaucacuugaggccaggaguuggagaccagccuggccaacauggugaaacccugucucua

SEQ ID NO: 107956 - RNA, 64 nt, Human
ggcggaucacuugagguccggaguuccagacaagccuggccaacaugaugaagcccugucucua

SEQ ID NO: 107957 - RNA, 64 nt, Human
ccuauguugucaucacuugguccaugaaauauuaccuggccaauaucccaccaucaccucaaac

SEQ ID NO: 107958 - RNA, 64 nt, Human
agguuuauuauuuuuaaaaaacuuuucuugaacuccuggccaacauggugaaaccccgucucua

SEQ ID NO: 107959 - RNA, 64 nt, Human
ccggugauucacaaggucaggaguucaagaccagccuggccaagauggugaaauccugucucua

SEQ ID NO: 107960 - RNA, 64 nt, Human
uggguggaucacaaggucaggaguuugagaccagccuggccaagaugguaaaaccccgucucua

SEQ ID NO: 107961 - RNA, 64 nt, Human
ggccuggcugaucucaaacuccuggucuugaacuccuggccacaagugaucugcccgccuuggc

SEQ ID NO: 107962 - RNA, 64 nt, Human
caaagugcugggauuacgggugugagccaucguaccuggccacuuuaauuauuuuuaaaugugc

SEQ ID NO: 107963 - RNA, 64 nt, Human
uaaguaauguaacgcauguaagaugcuuagggugccuggccaggacuccgugguuuccuguugu

SEQ ID NO: 107964 - RNA, 64 nt, Human
cuucccaacccagugccguuuauuucagaagcuuccuggccacugggcuuggaugcuucgggcu

SEQ ID NO: 107965 - RNA, 64 nt, Human
ucuuguccugcuggccaccccacccacaccugucccuggccagcaggccgccugcaagcgucag

SEQ ID NO: 107966 - RNA, 64 nt, Human
gguggaucaccugaggucaggaguucgagaccagccuggccaacauggugaaauccugucucca

SEQ ID NO: 107967 - RNA, 64 nt, Human
gguggaucgccugaggucagaaguucaagaccagccuggccaacauggugaauccccgucucua

SEQ ID NO: 107968 - RNA, 64 nt, Human
agcagaucacuugaggucaggaguuugagaccagccuggccaacauggugaaacccugucucua

SEQ ID NO: 107969 - RNA, 64 nt, Human
ccaggccauccccuacugcuuacauuccccucccccuggccaguuuuauauuuuaaucacacau

SEQ ID NO: 107970 - RNA, 64 nt, Human
gguuugaaacugcaucugaaugccugccuucaauccuggccaaguuggaguagacugguaugag

SEQ ID NO: 107971 - RNA, 64 nt, Human
aaaauaaagcagcacauacuuucucuacuguuuuccuggccauucauugucacaaggcuuagcc

SEQ ID NO: 107972 - RNA, 64 nt, Human
gguggaccacaugaggucaggaguuugagaucagccuggccaacauggugaaaccccaucucua

SEQ ID NO: 107973 - RNA, 64 nt, Human
cgggcggaucaugaggucaagagaucaagaucauccuggccaacauggugaaacccugucucua

SEQ ID NO: 107974 - RNA, 64 nt, Human
agcagaucacuugaggucaggaguucaacaucagccuggccaacaugaugaaaccuugucuuua

SEQ ID NO: 107975 - RNA, 64 nt, Human
caaagugcuggaauuacaggcgugagccacugcgccuggccaagaauggacauuuuuuaaaaaa

SEQ ID NO: 107976 - RNA, 64 nt, Human
gguggaucaccugaggucaggaguucaugaccagccuggccagcaugguaaaacccugucucca

SEQ ID NO: 107977 - RNA, 64 nt, Human
ugggcagaucuugaggucgguagauggagaccauccuggccaacauggugaaacccugucucua

SEQ ID NO: 107978 - RNA, 64 nt, Human
caaagugcugggauuauagucgugagccaccacgccuggccagaguuuuuuauuuuuaucacca

SEQ ID NO: 107979 - RNA, 64 nt, Human
gucugaucucacuuugugccccucgggccgucccccuggccaguccuuaagagcagcaggcucc

SEQ ID NO: 107980 - RNA, 64 nt, Human
cagcucagcccucaggugcaguggcccuacccagccuggccagcagacacacacagggaugcuc

SEQ ID NO: 107981 - RNA, 64 nt, Human
aaugacgauuauuuuucuacucaaugugaauaucccuggccagccuuuccacggcgcccaccgc

SEQ ID NO: 107982 - RNA, 64 nt, Human
cacaugagaacauggcuccuuucuuuuuggauagccuggccaugugugaaugggauuuuagcuu

SEQ ID NO: 107983 - RNA, 64 nt, Human
cuaaugagaguuccuuccagaccguuacgugucuccuggccaagccccaggaaggaaaugaugc

SEQ ID NO: 107984 - RNA, 64 nt, Human
gguggaucacuugagguugggauuucgagaccagccuggccaacauggugaaacccugccucua

SEQ ID NO: 107985 - RNA, 64 nt, Human
uucuuauguucuuucccuucaucuguuuccuuggccuggccagagcagcagugcugaucuucau

SEQ ID NO: 107986 - RNA, 64 nt, Human
gguggaucacuugaggucaggaguucaagaccagccuggccaacauggugaaaccucgucucua

SEQ ID NO: 107987 - RNA, 64 nt, Human
gguagaucaucugaggucaggaauucaagaccagccuggccaacauggugaaacccugucucua

SEQ ID NO: 107988 - RNA, 64 nt, Human
auuccuaaaauagauuaaauuaaagcaauuagauccuggccagcucgauucaaauuugacuuuc

SEQ ID NO: 107989 - RNA, 64 nt, Human
uacuaaaguguacuuaauguuacuaaguuuaaugccuggccauuuuccauuuauauauauuuuu

SEQ ID NO: 107990 - RNA, 64 nt, Human
cuaggugaaucaggaauugauugcauaugcaagcccuggccacagcugcacuuacaggaugccu

SEQ ID NO: 107991 - RNA, 64 nt, Human
ggcggaucacuugaggucaggaguuugaaacuagccuggccaacguggcaaaacuccaucucua

SEQ ID NO: 107992 - RNA, 64 nt, Human
aggcaaucacuugaggucaggaguucgagaccagccuggccaucauggcgaaaccucaucucua

SEQ ID NO: 107993 - RNA, 64 nt, Human
ggcagaucaccugaggucaggaguucaagaccagccuggccaacauggcaaaaccccaucuuua

SEQ ID NO: 107994 - RNA, 64 nt, Human
uaggaauugcggcacgaagaaugccaagaguuuaccuggccagcccuggcuuuaauaggacuga

SEQ ID NO: 107995 - RNA, 64 nt, Human
aguggauaacuugaggucaugaguucgaaaccagccuggccaaaacagugaaaccccgucucua

SEQ ID NO: 107996 - RNA, 64 nt, Human
cggguggaucacaaggucaagagaucgagaccauccuggccaacauggugaaacccugucucua

SEQ ID NO: 107997 - RNA, 64 nt, Human
gguggaucaccugacgucaguaguuugagaccagccuggccaacauggugaaacccuguaucua

SEQ ID NO: 107998 - RNA, 64 nt, Human
caggcagaucaugaugucaggaguuugagaccagccuggccaauauggugaaacccugucucua

SEQ ID NO: 107999 - RNA, 64 nt, Human
caaagugcugggauuacaggcacgagccaccacaccuggccaaaaaaauuuauauuuuuugaga

SEQ ID NO: 108000 - RNA, 64 nt, Human
uuugugugaguguuuauauagaaaugaacauagaccuggccaguaaaaggcucugaggaggcuu

SEQ ID NO: 108001 - RNA, 64 nt, Human
acauccuggauaucuggguuauuguccucaucauccuggccaccauugucaucaugaccucguu

SEQ ID NO: 108002 - RNA, 64 nt, Human
uuucuucucuuuccuuugugccacugagucguucccuggccagaggacauaaauggugcuggua

SEQ ID NO: 108003 - RNA, 64 nt, Human
ucaccccaccuucaucaucaugcuccagggucacccuggccagcucuugugcugggacagggga

SEQ ID NO: 108004 - RNA, 64 nt, Human
aguagauggugggggacagcggcguggguccuagccuggccagugaugcugcuggcguccagac

SEQ ID NO: 108005 - RNA, 64 nt, Human
gccuaggccaccccgccgcggccccucaggucgcccuggccacacucacacucccagaaaacug

SEQ ID NO: 108006 - RNA, 64 nt, Human
aggggaaaaccucaguuggccucugccccucuucccuggccaggggcuucucccccucagcucu

SEQ ID NO: 108007 - RNA, 64 nt, Human
cuuccagggccccacgguccccaggaggacgcuuccuggccaaagccccaagccuuuggugaga

SEQ ID NO: 108008 - RNA, 64 nt, Human
ucccagccaugggagugugaagugcuaggaugaaccuggccauccuagcaaggagcuuucugaa

SEQ ID NO: 108009 - RNA, 64 nt, Human
uagaacaccaucucuaggaaaauuuaauucugucccuggccagcuauuguucuuccacuucguu

SEQ ID NO: 108010 - RNA, 64 nt, Human
uucaacucucccaaaauggcucagccuaaccucuccuggccaaucccccccgccggagagcagg

SEQ ID NO: 108011 - RNA, 64 nt, Human
aagcugucccugaugaugaaggugaaacgucagcccuggccauggcuccgcucagggccccggu

SEQ ID NO: 108012 - RNA, 64 nt, Human
gguggaucacuuaaggucaggaguuugagaccagccuggccaacauggcaaaacccugucucua

SEQ ID NO: 108013 - RNA, 64 nt, Human
augguauccuucuuggccaacagaugguaucuuuccuggccaugacagugugauucccccagag

SEQ ID NO: 108014 - RNA, 64 nt, Human
aguggccguagcaucaccccaucagaaaggggaaccuggccagccagcuuccugcuaugcuggg

SEQ ID NO: 108015 - RNA, 64 nt, Human; identical to SEQ ID NO: 107991

SEQ ID NO: 108016 - RNA, 64 nt, Human
ggcgaaucauuugaggugaggaauucgagaccagccuggccagcauggugaaaccccaucucua

SEQ ID NO: 108017 - RNA, 64 nt, Human
ggcagaucaccugaggucaggaguucgagaccagccuggccaacauggugaaaccccgucacua

SEQ ID NO: 108018 - RNA, 64 nt, Human
gcaggacgacuugagcccaagaguuccagaccagccuggccaccuuagugagaucccuucucuu

SEQ ID NO: 108019 - RNA, 64 nt, Human
aaauuuguuauauagaggcaacagucugaacucuccuggccagcucacgaaaguuaauuauaca

SEQ ID NO: 108020 - RNA, 64 nt, Human
agggccucacucuccaccccuucagcguggacuuccuggccagggccccaaguggggguaucac

SEQ ID NO: 108021 - RNA, 64 nt, Human
cggguggaucacaaggucaggaguucgagaccagccuggccaauauggugaaaccccgucucua

SEQ ID NO: 108022 - RNA, 64 nt, Human
caaaaugcugggaucacaggcgugagccaccucgccuggccagaucucuuuuauaugcauuauc

SEQ ID NO: 108023 - RNA, 64 nt, Human
aguuaaaccagugagccgaggcccgcgccgaggaccuggccaggccagccacuccugaagcccc

SEQ ID NO: 108024 - RNA, 59 nt, Human
auucugauauccggaggugaaaugaaaggccuggccacgaaaucuuuccuccacgccgu

SEQ ID NO: 108025 - RNA, 64 nt, Human
gguggaucaccugagguccggaguucgagaccagccuggccaauguggugaaacccugucucua

SEQ ID NO: 108026 - RNA, 64 nt, Human
aggccuucucagcccaugcccuggagggcauuccccuggccagccucagccccuugucuacuug

SEQ ID NO: 108027 - RNA, 64 nt, Human
gguggaucacuugaggucaggaguucaacaccagccuggccaacauggugaaacccugucucua

SEQ ID NO: 108028 - RNA, 64 nt, Human
ucaauuccuuggacucacagccaugcagauaagcccuggccaucucagcagccaccgcacaacc

SEQ ID NO: 108029 - RNA, 64 nt, Human
cgggcgaaucacgaggucaggaguucaagaccagccuggccaacauggugaaaccccaucucua

SEQ ID NO: 108030 - RNA, 64 nt, Human
cggagacggcggcucuccgggauccagcuccgccccuggccagugugcggcccgggggcucccu

SEQ ID NO: 108031 - RNA, 64 nt, Human
cuuaguagcuacucccaaauugucagccuucuuaccuggccaagguguccaagccagaaaggaa

SEQ ID NO: 108032 - RNA, 64 nt, Human
aacuccaggucaggggugcguagagguugggggcccuggccagggacaucugccaaaggaagga

SEQ ID NO: 108033 - RNA, 64 nt, Human
ccccuuguucuucccaaugucauauccaccaggaccuggccacagcuggccugugggugauccc

SEQ ID NO: 108034 - RNA, 64 nt, Human
ugucuugagcccuagccugaggauaaaggcugagccuggccaucccagauugcaacugccuccc

SEQ ID NO: 108035 - RNA, 64 nt, Human
caaagugcugagauuacaggcaugagccauugcaccuggccaagaagagacaucuugacuugag

SEQ ID NO: 108036 - RNA, 64 nt, Human
uuugggcaucucccauguccccaucuccuggacaccuggccauuguugugaagccagacaguga

SEQ ID NO: 108037 - RNA, 64 nt, Human
ccaucaccguggagugaggaaaacagucagcuguccuggccaaagggguuuggaaggacaccaa

SEQ ID NO: 108038 - RNA, 64 nt, Human
gaggugcccaggaacccugcuucuccucacagggccuggccauauagccagcuccaacccaaag

SEQ ID NO: 108039 - RNA, 64 nt, Human
cgggcagaccaugaggucaggagauugagaccauccuggccaacauggugaaacccugucucua

SEQ ID NO: 108040 - RNA, 64 nt, Human
gacagaucaccugaggucaggaguuugagaccagccuggccaacauggcaaaaccaucucuacu

SEQ ID NO: 108041 - RNA, 64 nt, Human
cuucuacuuuacuggcugagugugagccgccaugccuggccauaaucuacauuuucuuaccagg

SEQ ID NO: 108042 - RNA, 64 nt, Human
ggugaaucaccugaggucaggaguucaagaccagccuggccaacauagugaaaccccgucucua

SEQ ID NO: 108043 - RNA, 64 nt, Human
accccacaggccgcuucgcggguggagcccucugccuggccauggaggaaggaucccgcuaggc

SEQ ID NO: 108044 - RNA, 64 nt, Human
caaagugcugggauuacaggcgugagucacugugccuggccaaguuucaguucuauaugaagua

SEQ ID NO: 108045 - RNA, 64 nt, Human
gaccacagaugguguguaaucuaucaaacacaccccuggccaaguuggguccuauaggaccugg

SEQ ID NO: 108046 - RNA, 64 nt, Human
ggcagauugccugagcucaagaguucgagaccagccuggccaacauggugaaaccccaucucua

SEQ ID NO: 108047 - RNA, 64 nt, Human
aaccguucgugagucaucaaaaagucaaagucagccuggccaacauggcaaaacuccgucucug

SEQ ID NO: 108048 - RNA, 64 nt, Human
ggggaccccacagccuggcagaugagcagauaccccuggccacccauguccucagcgacauuuc

SEQ ID NO: 108049 - RNA, 64 nt, Human
auccguucucagccgugcaggccuuugcaguugcccuggccaacgugacucagcgccucaaaug

SEQ ID NO: 108050 - RNA, 64 nt, Human
cuccuucccugucggaaaagucaccacuuuagucccuggccaccagcacaccccaggaggguga

SEQ ID NO: 108051 - RNA, 64 nt, Human
gguggaucacuugaggucaggaguuugagaccagccuggccaacauggcgaaaccccucucuac

SEQ ID NO: 108052 - RNA, 64 nt, Human
ggcggaucauuugaagucaggaguucaagccuagccuggccaacauggugaaaccccgucucua

SEQ ID NO: 108053 - RNA, 64 nt, Human
gggcggaucaccugagucaggaguucgagaccagccuggccaacauggugaaaccuccgucucu

SEQ ID NO: 108054 - RNA, 64 nt, Human
gauucugaaguguuccuguuugucuuauccuggcccuggccagacguuuucuuugauuuuuaau

SEQ ID NO: 108055 - RNA, 64 nt, Human
aguaaccugaaucaucuaaaaaacacggucucaaccuggccaccgugggugaggccugaccacc

SEQ ID NO: 108056 - RNA, 64 nt, Human
gguggaucaccugaggucaggaguucgagaccagccuggccaacaugguuaaaccccgucucua

SEQ ID NO: 108057 - RNA, 64 nt, Human
cuuugagcacaacuuuaagaggacauaaugggguccuggccaucccacaaguggugguaacccu

SEQ ID NO: 108058 - RNA, 64 nt, Human
gucggcacuucugaaaggcacaaggccaagaacuccuggccaggacugcaaggcucugcagcca

SEQ ID NO: 108059 - RNA, 64 nt, Human
cagucccaguccugaugugugugcguuguucucuccuggccacuuaaauaggaccauauguaaa

SEQ ID NO: 108060 - RNA, 64 nt, Human
ccaacauuuaagaaaccccaauagacaccucugcccuggccacguucacagauccuucucuuga

SEQ ID NO: 108061 - RNA, 64 nt, Human
ggcagaucaccugagguuaggaguucaagaccagccuggccaacauggugaaaccccaucucua

SEQ ID NO: 108062 - RNA, 64 nt, Human
ugggcgaaucaugagaucaggaguucgagaccagccuggccagcauggugaaaccccaucucua

SEQ ID NO: 108063 - RNA, 64 nt, Human
cuguuccuagaagagggcauagacaucgagggggccuggccagucauugacagacggacuuguu

SEQ ID NO: 108064 - RNA, 64 nt, Human
guuuuccuggaacaaugcuaauuaggauugcauuccuggccaaagacaugacaucaaauaagua

SEQ ID NO: 108065 - RNA, 64 nt, Human
uacaacugaagccaaaccugccugacuuccugcuccuggccacccaaaacuccauauggcuucu

SEQ ID NO: 108066 - RNA, 64 nt, Human
ucggcaacacaccagugcaacaaagacucagcugccuggccaaggacaacucuaucuaugucgu

SEQ ID NO: 108067 - RNA, 64 nt, Human
ggugaagcaccugaggucaagaguucgagaucagccuggccaacauggcgaaaccccgucucca

SEQ ID NO: 108068 - RNA, 64 nt, Human
auagaaugugaagacacgcgcuagaaaucgcaguccuggccagagacguuauggucauugugag

SEQ ID NO: 108069 - RNA, 64 nt, Human
cccccgcaggccgccgcgucuguguuggggagcgccuggccaggaccgagcucuuccugcuguu

SEQ ID NO: 108070 - RNA, 64 nt, Human
gacagaaggaucgcuugaggucaggaauuugagaccuggccaacauggugaaacccugucucua

SEQ ID NO: 108071 - RNA, 64 nt, Human
aggcggaucacuggggucaggauuucgagaccagccuggccaacauggcgaaaccucgccucua

SEQ ID NO: 108072 - RNA, 64 nt, Human
agcugaauaaccugcacaggcuugcuguaugaccccuggccacagccuucccucugcauugacc

SEQ ID NO: 108073 - RNA, 64 nt, Human
uugagugaggacauggaaccucgccugacauuuuccuggccagugacaucacccuuccugggau

SEQ ID NO: 108074 - RNA, 64 nt, Human
caaggagaaaagccuucuagggucacugucauucccuggccauguugcaaacagcgcaauucca

SEQ ID NO: 108075 - RNA, 64 nt, Human
gguggaucaccugagggcaggagucugagaccagccuggccaacauagcaaaaccccaucucua

SEQ ID NO: 108076 - RNA, 64 nt, Human
uccucgagaacaacagagauaagaaaagaaccggccuggccaauccuucaacagcucuagagcc

SEQ ID NO: 108077 - RNA, 64 nt, Human
cucccaguccccaucucuuuuuccccacacugucccuggccaagcccugcccagagcugaaccc

SEQ ID NO: 108078 - RNA, 64 nt, Human
cuccuggaaggagaaccagccacccugaggaccaccuggccaugcgugcacagccugggaaaag

SEQ ID NO: 108079 - RNA, 64 nt, Human
gguggaucaccucaagucaggaguucgagaccagccuggccaacauggugaaaccccaucucua

SEQ ID NO: 108080 - RNA, 64 nt, Human
caggcugaucacgaggucagaagaucaagaccauccuggccaacauggugaaaccuugucuacu

SEQ ID NO: 108081 - RNA, 64 nt, Human
ggcagaucacuugaggucaggaguucaagaccagccuggccaacauggcgaaaccccgucucua

SEQ ID NO: 108082 - RNA, 64 nt, Human
gauggaucacuugaggucaggaguucaggaccagccuggccaacaugaugaaacccugucucua

SEQ ID NO: 108083 - RNA, 64 nt, Human
cggauggaucacgaggucaggcagucgagaccauccuggccaacauggugaaaccccgucucua

SEQ ID NO: 108084 - RNA, 64 nt, Human
gcggaucaccugaggucaggaguuuugagaccagccuggccaacaugguaaaaucccgucucua

SEQ ID NO: 108085 - RNA, 64 nt, Human
gaaugucccccaucauguggcccaacucuccuggccuggccaucucccuccccagaaacagugu

SEQ ID NO: 108086 - RNA, 64 nt, Human
cggguggaucaugaggucaggagaucaagaccauccuggccaacauggugauaccccgucucua

SEQ ID NO: 108087 - RNA, 64 nt, Human
cucuccugccugcugggaccuauggaaggggcuuccuggccaaggcccccucuuccagaggagg

SEQ ID NO: 108088 - RNA, 64 nt, Human
ucaugaaaauagcucuuucagggggguugugaggccuggccaggcacccccuggagagaaguuu

SEQ ID NO: 108089 - RNA, 64 nt, Human
uggggggaucacaaggucacuagauggcgagcauccuggccaacauggugaaaccccgucucua

SEQ ID NO: 108090 - RNA, 64 nt, Human
guauuccacuuaggaagaaaugcccaaaagagguccuggccaucaaacauaauucucucacaaa

SEQ ID NO: 108091 - RNA, 64 nt, Human
caaauagcugggcuuacaggcaugagccaccacaccuggccaggauuugguuguuuaaauauaa

SEQ ID NO: 108092 - RNA, 64 nt, Human
acaccccgccuccccucaucugcucuaguggugaccuggccaaggggauacagacccugcaguc

SEQ ID NO: 108093 - RNA, 64 nt, Human
gguggaucacuugaggucaggaguucgagaccagccuggccaacauggcaaaaccccgucucua

SEQ ID NO: 108094 - RNA, 64 nt, Human
cuggcccauugacagaugagaggucugaagccuuccuggccacaggcaucacuuucuccuccuc

SEQ ID NO: 108095 - RNA, 64 nt, Human
caaagugcugggauuacaggcgugagccaccacgccuggccaauuauguaauuuuuuaaaaagg

SEQ ID NO: 108096 - RNA, 64 nt, Human
cucuuucuuccuuucuaauccuaucuggggagcuccuggccaggauaauauauuugcagauaau

SEQ ID NO: 108097 - RNA, 64 nt, Human
ccggacgcagcagcccucuggcuccagcauggggccuggccaggcuauucgccuggaagcucgg

SEQ ID NO: 108098 - RNA, 64 nt, Human
ggauuugcucagugucuggcugcagagcagugggccuggccagcagguccccagcuuuggcuau

SEQ ID NO: 108099 - RNA, 64 nt, Human
gguggaucacuugagaucaggaguucaagaccagccuggccaacauggugaaaccuugucucua

SEQ ID NO: 108100 - RNA, 64 nt, Human
auauccccaggcacacucuggccucagguuuugcccuggccaugucaucuaccuggagugggcc

SEQ ID NO: 108101 - RNA, 64 nt, Human
cccacuuccacucaggaaauugggcugcccccaaccuggccacugaaugucuccaggcagauau

SEQ ID NO: 108102 - RNA, 64 nt, Human
caaaagggcagccaggggcugcucaucacccaguccuggccauuuucuugccugaggcucaaga

SEQ ID NO: 108103 - RNA, 64 nt, Human
gaggcuugucccuauguaggaugcaccgcaggccccuggccacugaaagagugugcaguggacu

SEQ ID NO: 108104 - RNA, 64 nt, Human
augcgugcaggccucugcagaaggagcacuuggcccuggccaggaaccccuggaacugaggcca

SEQ ID NO: 108105 - RNA, 64 nt, Human
uggggaccgggcggugcggcuguuucacaacacuccuggccaccgagccaugguggaggagaug

SEQ ID NO: 108106 - RNA, 64 nt, Human
gucacagagggcacccuuggcaaaccuuuauaguccuggccagacccugcugcucacucagcug

SEQ ID NO: 108107 - RNA, 64 nt, Human
ggaggaugacuugaggccaggaguuggagaccagccuggccaacauggugaaacccugucucua

SEQ ID NO: 108108 - RNA, 64 nt, Human
gguggaucaccugaggucagaaguucaagaccagccuggccaacauggggaaacccugucuuua

SEQ ID NO: 108109 - RNA, 64 nt, Human
gguggaucaccugaggucaggaguucaagacuagccuggccaacauggugaaaccccgucucua

SEQ ID NO: 108110 - RNA, 64 nt, Human
aggcggaucaccugaagucagaguucaagaccagccuggccaacauggugaaacccugucucua

SEQ ID NO: 108111 - RNA, 64 nt, Human
gguggaucaucugaggucaggaguucaagaccagccuggccaacauggagaaacuccgucucua

SEQ ID NO: 108112 - RNA, 64 nt, Human
ggcagaucauuugagaucaggaguuugaaaccagccuggccaacaugguaaaauccugucucua

SEQ ID NO: 108113 - RNA, 64 nt, Human
ccgaggugggcagaucacuugaguucaagaccagccuggccaacauggugaaaccccaucucua

SEQ ID NO: 108114 - RNA, 64 nt, Human
gagaccacucugggagguuugcuaggcccugggaccuggccagcucuguuagugggagagaucg

SEQ ID NO: 108115 - RNA, 64 nt, Human
gguggauuacuugaggucaggaguucaaaaccagccuggccaacauggugaaacccugucucua

SEQ ID NO: 108116 - RNA, 64 nt, Human
caggcggaucacaagguccagagaucgagaccauccuggccaacauggugaaaccccgucucua

SEQ ID NO: 108117 - RNA, 64 nt, Human
ggcggaucacuugaggccaggaguucaagaccagccuggccaacauggcaaaaucccaucucua

SEQ ID NO: 108118 - RNA, 64 nt, Human
ccuuggguccugcuccucaggccgcuccccugucccuggccauggguaggagacugcccugguc

SEQ ID NO: 108119 - RNA, 64 nt, Human
ucacaccggggaggagggccucucaugggaaagcccuggccaccacaccggccugugccccuug

SEQ ID NO: 108120 - RNA, 64 nt, Human
gaugaugacuggcaaggacuagagagcaggagugccuggccaggucgguccugacucuccugac

SEQ ID NO: 108121 - RNA, 64 nt, Human
agaugacacaaugccucacucaggccccgggcucccuggccacaagcuuuuucuauccuguuuu

SEQ ID NO: 108122 - RNA, 64 nt, Human
ggcggaugaccugaggucaggaguucaagaccagccuggccaacauggagaaaccccaucuuua

SEQ ID NO: 108123 - RNA, 64 nt, Human
gguggaucauuugaggucaggaguuugaaaccagccuggccaacauggugaaaccccaucucua

SEQ ID NO: 108124 - RNA, 64 nt, Human
cuugccaugcaaacucucaagaggccaauauauuccuggccauguuugaaugagccucuuaaaa

SEQ ID NO: 108125 - RNA, 64 nt, Human
cggguggaucaugaggucaggagaucaagaccauccuggccaacauggugaaaccccgucucua

SEQ ID NO: 108126 - RNA, 64 nt, Human
ugccaucaugaggaugugugcuagagugugggacccuggccaagugcaggaaugggccaugccg

SEQ ID NO: 108127 - RNA, 64 nt, Human
gugacaaagauggcucagagggggacugcugcugccuggccacugcucccuaagccagccuggu

SEQ ID NO: 108128 - RNA, 64 nt, Human
gaccccgggucuccuuggcugucugugggccgccccuggccaccuuguccuggcucgcagggug

SEQ ID NO: 108129 - RNA, 64 nt, Human
ggcggaucaccugagguuaggaguucgagaccacccuggccaacaugcgaaaccccaucucuac

SEQ ID NO: 108130 - RNA, 64 nt, Human
caaguagcugggccuacaggugcgugcuaccacgccuggccaauuuuuuaaauuuuagcacaga

SEQ ID NO: 108131 - RNA, 64 nt, Human
aaggaccagugaccgccaccuucacaccgucugcccuggccaccauccugggccugggggcugc

SEQ ID NO: 108132 - RNA, 64 nt, Human
ugcccaggccacaagcguuccacgagcgaaggcgccuggccacagcugcccucuggccucucca

SEQ ID NO: 108133 - RNA, 64 nt, Human
gugucuuuugaauauuuuuuauuaagccaccacuccuggccaacuguaguugaacucagguauu

SEQ ID NO: 108134 - RNA, 64 nt, Human
ggcggaucacuugaggucaggaguucaaaaccagccuggccaagauggugaaaccccaucucua

SEQ ID NO: 108135 - RNA, 64 nt, Human
gguggaucaccugaggucaggaguucaagaccagccuggccaacauggugagacccccgucucu

SEQ ID NO: 108136 - RNA, 64 nt, Human
uuucugcaauaagcucucagaccaucagcauccuccuggccagccacauaagccaaucggggau

SEQ ID NO: 108137 - RNA, 64 nt, Human
uuucugcaauucacucucagaccaucagcauccuccuggccagcugcauaaauguauuuuucug

SEQ ID NO: 108138 - RNA, 64 nt, Human
ggcagcucaccugaggucaggcguucaagaccagccuggccaacauggugaaaccucgucugua

SEQ ID NO: 108139 - RNA, 64 nt, Human
caaagugcugagauugcagaugugagccaccgugccuggccagauuuuucuuuuauucuucuuu

SEQ ID NO: 108140 - RNA, 64 nt, Human
cgaaaaagaggcauacacacagcagugugaauagccuggccaccagccauccucccuccaccuc

SEQ ID NO: 108141 - RNA, 64 nt, Human
guccaccgccccuuggcuucugcuggugacuccuccuggccacugcaucagaagaaccuccucu

SEQ ID NO: 108142 - RNA, 64 nt, Human
gcgugaccucggacccagccacgucgccccugguccuggccaucccacgccgccugcgugugga

SEQ ID NO: 108143 - RNA, 64 nt, Human
aaucacuugauugaggucaggaguucgagaccagccuggccaacauggcaaaaccccgucucua

SEQ ID NO: 108144 - RNA, 64 nt, Human
uaggcggaucacaaggucaggagaucgagaccauccuggccaacauggugaaaccccgucucua

SEQ ID NO: 108145 - RNA, 64 nt, Human
aagaguaggggcugucacugagugaaagugacauccuggccaccucacgcauuugaucacagac

SEQ ID NO: 108146 - RNA, 64 nt, Human
ggcugaucgcuugaggucaggaguucgagaccagccuggccaaaauagugaaacucacguuucu

SEQ ID NO: 108147 - RNA, 64 nt, Human
aauuaagauaucaaucugaaaugcaucuguaauuccuggccacagguccuuauugccauuauuu

SEQ ID NO: 108148 - RNA, 64 nt, Human
cagcccagagggaaauauggauuuucacaccuugccuggccacccuggaaaaacaagccaagga

SEQ ID NO: 108149 - RNA, 64 nt, Human
caaagugcugggauuacaggcgugagccacugcgccuggccagaccauuuuagaauugggaaau

SEQ ID NO: 108150 - RNA, 64 nt, Human
gguagaucaccugaaguuaggaguucgagaccagccuggccaacauggcgaaacccugucucua

SEQ ID NO: 108151 - RNA, 64 nt, Human
cagcaggugacaacugauggcuucucugcccugcccuggccacuggcccuguuucuccccacac

SEQ ID NO: 108152 - RNA, 64 nt, Human
ccugccuagucucacaugucccuguuccucuuccccuggccagggccccugcgcagacugucag

SEQ ID NO: 108153 - RNA, 64 nt, Human
ucaacuaaucacgucucugcacccagggucccagccuggccaccagccucccuuucugccugac

SEQ ID NO: 108154 - RNA, 64 nt, Human
ccugccuagucucacaugucccugucccucucgcccuggccagggccucugugcagacaguguc

SEQ ID NO: 108155 - RNA, 64 nt, Human
uuaacuagucuugcaucugcacccagggucccagccuggccaccagcuucccucugccugaccc

SEQ ID NO: 108156 - RNA, 64 nt, Human
guaggugggguggcuugaggucugggaggguggcccuggccagccaggacacaugcagaccccu

SEQ ID NO: 108157 - RNA, 64 nt, Human
ucagcugccuccuggcugcugcugccaacuugcaccuggccaccuccccugcuucucccugggc

SEQ ID NO: 108158 - RNA, 64 nt, Human
uuuaaucugaaaccugcaacaagacuagccaacaccuggccaugaaacuugccccuucacugau

SEQ ID NO: 108159 - RNA, 64 nt, Human
caucucaggccaaagggaggggagcaaguggggaccuggccauggccccucagcaaaaaccuau

SEQ ID NO: 108160 - RNA, 64 nt, Human
ggcagaucaccugaggucaggaguucacgaccagccuggccaacauggugaaacccuucucuac

SEQ ID NO: 108161 - RNA, 64 nt, Human
caccaguuuuuuuaguaucgcccacgcccaguucccuggccaacuccgcagggcccuccuagag

SEQ ID NO: 108162 - RNA, 64 nt, Human
gguggaucaccugaggucaggaguucaagaccagccuggccaacaugaugaaaccccgucucua

SEQ ID NO: 108163 - RNA, 64 nt, Human
gguggaucaccugaggucaggaguucgagaccagccuggccaacauggcggaaccccaucucca

SEQ ID NO: 108164 - RNA, 64 nt, Human
gguggaucaccugaggucaggaguuugugaccagccuggccaacauagugaaauccuguuucua

SEQ ID NO: 108165 - RNA, 64 nt, Human
gaauuuggcugcuucuacggccaugagacugaucccuggccacugaaaagcuuuccugacaaua

SEQ ID NO: 108166 - RNA, 64 nt, Human
ugaagaaacuccagauaucaaggaauugggaaauccuggccaaaccaccccaagaugauuacac

SEQ ID NO: 108167 - RNA, 64 nt, Human
gguggaucaccugaggucaggaguucgagaccaaccuggccaacaugacgaaacuccgucucua

SEQ ID NO: 108168 - RNA, 64 nt, Human
ugcagaucaccugaggucaggaguuugagaccagccuggccaauguggugaaaccccaucucua

SEQ ID NO: 108169 - RNA, 64 nt, Human
uuucuagcacacaagagcaaccugaaaggcugcuccuggccagaggacucugucccgggggacc

SEQ ID NO: 108170 - RNA, 64 nt, Human
acgagggggcccaagacccuggcaggucaggggcccuggccaagccagaucuggagcugcugcu

SEQ ID NO: 108171 - RNA, 64 nt, Human
acugccuagacgguucucuuggucuuauucccauccuggccaaugcuuaaauacuauuuguuga

SEQ ID NO: 108172 - RNA, 64 nt, Human
guuuucucugccuggcucucucuuccccuccuuaccuggccaguccuguuuaucaucaggccuu

SEQ ID NO: 108173 - RNA, 64 nt, Human
uuauaacuuggugagugacgaugagagcccugcaccuggccagagugucacaggcaaaaggcau

SEQ ID NO: 108174 - RNA, 64 nt, Human
caaaguguugggauuacaggcaugagccacugcgccuggccagcaaaugcuuuuugugcagaau

SEQ ID NO: 108175 - RNA, 64 nt, Human
aggggcaagcagcauugcauucugggggaacgauccuggccacagccgccaaacaaacauucac

SEQ ID NO: 108176 - RNA, 64 nt, Human
cagacuguugggauuacaggcaugagccaccacgccuggccaguuucuucauuuuacauauggu

SEQ ID NO: 108177 - RNA, 64 nt, Human
gacaagagggacucccauguucuaagcaccuguuccuggccaggcucuaggccaggcucucuaa

SEQ ID NO: 108178 - RNA, 64 nt, Human
cuccuggcucaggcccagcuuauugugugcgcugccuggccaggcccugggucuugccaugugc

SEQ ID NO: 108179 - RNA, 64 nt, Human
gagguuguuggcagggacugcagauccugucagaccuggccaccaccuugggcauggccacucu

SEQ ID NO: 108180 - RNA, 64 nt, Human
gagcugcucagggccggugagcgcagccagaagcccuggccagugaggagcucacagguccucc

SEQ ID NO: 108181 - RNA, 64 nt, Human
ggcagaucaccugaggucaauaguucgagaccagccuggccaacaaggugaaaccccaucucua

SEQ ID NO: 108182 - RNA, 64 nt, Human
cacugggcaccugcgcacaggugggaggaaagggccuggccaguccugguccuggcugcacucu

SEQ ID NO: 108183 - RNA, 64 nt, Human
acaaucucaagugaggcugcgccggcucccagcuccuggccagccugcccugcgguccugucac

SEQ ID NO: 108184 - RNA, 64 nt, Human
cggccgccaaccccugaaagcagaaccuggccucccuggccacagcagccuuacccaccgcucu

SEQ ID NO: 108185 - RNA, 64 nt, Human
acgugcuguccaccaggccuuggagacaggcuagccuggccacagaauuaaacguguugccaca

SEQ ID NO: 108186 - RNA, 64 nt, Human
ccugggagcccaggaaggcauccacgagggagcuccuggccagcagccgucauccucucggacc

SEQ ID NO: 108187 - RNA, 64 nt, Human
caaagugcugggauuacaggcauggagcaccgugccuggccaagauucuuuacaauaggauuua

SEQ ID NO: 108188 - RNA, 64 nt, Human
ugggaucagcaggccaggcaggucuuguccugguccuggccacaugucuuugcugugggaccuc

SEQ ID NO: 108189 - RNA, 50 nt, Human
caguggagaggaagcagugaccuggccagcacugcucccagcacugcgca

SEQ ID NO: 108190 - RNA, 64 nt, Human
guuuucauuuuucaugagaaaagcuuuccaagugccuggccagaccuugguccuuagugcagag

SEQ ID NO: 108191 - RNA, 64 nt, Human
cgugcgugcgugugugugugucucugcuggggacccuggccaccccccugcugcugucuuggug

SEQ ID NO: 108192 - RNA, 64 nt, Human
aaugcacgcuccucaaacaucuuuggaggaacuaccuggccaaaacacuggccaggaugcagca

SEQ ID NO: 108193 - RNA, 64 nt, Human
aauuaguugauauacuaaugagaaaauauacuagccuggccaugccaauaaguuuccugcugug

SEQ ID NO: 108194 - RNA, 64 nt, Human
ggcaaaucacuugagucuaggaguucaagaccagccuggccaauauggcaaaacccugucucua

SEQ ID NO: 108195 - RNA, 64 nt, Human
acaccauucauuaagugccuucugugugucagucccuggccacucacugcaguucaaggccccc

SEQ ID NO: 108196 - RNA, 64 nt, Human
ggagcccagugaagccucugagggauugaggggcccuggccaggacccugaccuccgccccugc

SEQ ID NO: 108197 - RNA, 64 nt, Human
ggaggauccccugaggucaggaguucgagagcagccuggccaacauggcaaaaccccuuauuua

SEQ ID NO: 108198 - RNA, 64 nt, Human
cuggggacugggcgcugccccugggaggggagagccuggccagggcugguguugggcccggagc

SEQ ID NO: 108199 - RNA, 64 nt, Human
ccagaaauucuggcccagccaaucuagaggcaagccuggccaucuguauuuuuuuuuuuccaag

SEQ ID NO: 108200 - RNA, 64 nt, Human
gcccccacugugacuccggugcuguuugccguccccuggccaggaugguggagucugccccagg

SEQ ID NO: 108201 - RNA, 64 nt, Human
ccgaauggucccucagggugcagggaggcagaagccuggccacagaggagccuccuaaggcagc

SEQ ID NO: 108202 - RNA, 64 nt, Human
aucauuccgagucaucaucucuguuugcugccuuccuggccagccagguggaagaaaguuucca

SEQ ID NO: 108203 - RNA, 64 nt, Human
caguggagccaugccuggguuucagagcagagcuccuggccagagcguuugaccgacagacaau

SEQ ID NO: 108204 - RNA, 64 nt, Human
cuccccaugcagagcgggagccugccuaccugggccuggccagcaggcagggcugccuucugcu

SEQ ID NO: 108205 - RNA, 64 nt, Human
gggguagccccagcagcagcacccugcaagccagccuggccagcugcucagaccagcuugcaga

SEQ ID NO: 108206 - RNA, 64 nt, Human
gucaggguggggagcagggacggccaugggcacgccuggccacgcuuuaccgacugcugacccc

SEQ ID NO: 108207 - RNA, 64 nt, Human
gguggauuacccaaggccaggaguucaagaccagccuggccaacauggugaaaccccgucucua

SEQ ID NO: 108208 - RNA, 64 nt, Human
gguggaucaccugaggucaggaguucgagaccagccuggccaacacggugaaaccccgccucua

SEQ ID NO: 108209 - RNA, 64 nt, Human
cgggcggaucacaaggucaggagaucaaggccauccuggccaacauggugaaaccccacgucua

SEQ ID NO: 108210 - RNA, 64 nt, Human
ggguggaucacuuggggucaggguuugagaccagccuggccaacauggcggaacccugucucua

SEQ ID NO: 108211 - RNA, 64 nt, Human
ggaggaucacgugaggucgggaguucaagaccagccuggccaucauggugaaacccugucucua

SEQ ID NO: 108212 - RNA, 64 nt, Human
ggcaaaucaccugaggucaggaguuccagaccagccuggccaacaugaugaaacccugucucua

SEQ ID NO: 108213 - RNA, 64 nt, Human
auuacuuauuugaggucagagaacaaaacaagaaccuggccagguguugauuaccuuuuaguga

SEQ ID NO: 108214 - RNA, 64 nt, Human
uuguuuugagggaacugaagaaccugauguagccccuggccagauaacugccugauuucucaga

SEQ ID NO: 108215 - RNA, 64 nt, Human
ggcggauugccugagaucgggaguucgagaccagccuggccaacauggugaaaccuugucucua

SEQ ID NO: 108216 - RNA, 64 nt, Human
gaucucaucaucauccuuagucaagcagcagggcccuggccacguggagcaacacugacuagaa

SEQ ID NO: 108217 - RNA, 64 nt, Human
uucuguucuucccucacuccauccccgcuaccguccuggccagcuaccgucagagagaaccaga

SEQ ID NO: 108218 - RNA, 64 nt, Human
gacaugcggcugcccacgcuccugcccucgucucccuggccacccuuggccuguccaccugugc

SEQ ID NO: 108219 - RNA, 64 nt, Human
gguggauugcuugagcccaggaguuugagaccagccuggccaacguggcaaaaccucgucucug

SEQ ID NO: 108220 - RNA, 64 nt, Human
gccugggggucuaacagggagcccggcugccucaccuggccacagccuccacaccagaucucca

SEQ ID NO: 108221 - RNA, 64 nt, Human
gguggaucacuugaagucaggaguuugagaccagccuggccaacauggugaaaccccaucucuc

SEQ ID NO: 108222 - RNA, 64 nt, Human
cggugggguacaaaggggcccaugcaggagaugcccuggccaguaggaccuccaacagguuguu

SEQ ID NO: 108223 - RNA, 64 nt, Human
agugucucccuguuaacugcaggaaugccaagcaccuggccagagcagcccagccccaauaugc

SEQ ID NO: 108224 - RNA, 64 nt, Human
accucuguguggcaggcagggcauggguuuuaguccuggccacugaccagcuguguggcccugg

SEQ ID NO: 108225 - RNA, 64 nt, Human
gaggcggggguggaucacaaggucaggagaccagccuggccaacauggcgaagccccgucucua

SEQ ID NO: 108226 - RNA, 64 nt, Human
uuugacugccauuuuguuuguucaguggagacucccuggccaacagaauccuucuugauaguuu

SEQ ID NO: 108227 - RNA, 64 nt, Human
cccgcuucgauguaacaugagaggaagucggcguccuggccacgaaaugcaguucacuuuuuuu

SEQ ID NO: 108228 - RNA, 64 nt, Human
ucacuagggugcugugcucucuggcgccccacagccuggccagcuccagggaccccaguugcag

SEQ ID NO: 108229 - RNA, 64 nt, Human
ucuggggcaucugaggucaggaguuugaaaccagccuggccaacuugaugaaaccccaucucua

SEQ ID NO: 108230 - RNA, 64 nt, Human
aggguggaucaugaggucaggagauggagaccauccuggccaacauggugaaaccucgucucua

SEQ ID NO: 108231 - RNA, 64 nt, Human
gggcaauggcuugagcccaggaguucgacaccagccuggccaacacagugaaaugugucucuac

SEQ ID NO: 108232 - RNA, 64 nt, Human
gguugaucaccugaggucaggaguuugagacuagccuggccagcauggugaaaccucaucucuc

SEQ ID NO: 108233 - RNA, 64 nt, Human
ggcaaaucaccugaggucaagaguuugagaccagccuggccaacauggugaaaccccaucucua

SEQ ID NO: 108234 - RNA, 64 nt, Human
gguggauugcuugaggccaggaguucgagaccagccuggccaacguggugaaacgcugucucua

SEQ ID NO: 108235 - RNA, 64 nt, Human
uuuugccaagguggauuuguuagucucaggcccuccuggccacauugcccaagucacacaggcu

SEQ ID NO: 108236 - RNA, 64 nt, Human
aaggggaggcucagaaggaggugguguggggaccccuggccaagagggcugaggucugacccug

SEQ ID NO: 108237 - RNA, 64 nt, Human
cuugagggacuuugugguuuugugcuucugguuuccuggccaaccccagggucacuugucugga

SEQ ID NO: 108238 - RNA, 64 nt, Human
caccaccagccaccucucaggagaagccagaggcccuggccaaagauaggaggaagaaagagaa

SEQ ID NO: 108239 - RNA, 64 nt, Human
cggguggaucacgaggucaggagauugagaccauccuggccaacauggugaaaccccgucucua

SEQ ID NO: 108240 - RNA, 64 nt, Human
cuuggucucuauuagucaguaaugaagacgacagccuggccaaccaagggaaaggaaauuagua

SEQ ID NO: 108241 - RNA, 64 nt, Human
ugacaaagaauuuccuaauccaaauaucuuugacccuggccacuuucuagauaagaauggcaac

SEQ ID NO: 108242 - RNA, 64 nt, Human
ccacagccugugcuaaagagccauggagcccuccccuggccaugucuggggacagauagaaccu

SEQ ID NO: 108243 - RNA, 64 nt, Human
cucaguaugccaaccuccuggcagcccagggcagccuggccacugccaugagcuuucuacccag

SEQ ID NO: 108244 - RNA, 64 nt, Human
ccaaagugcuaggauuacagcgugaucuaccacaccuggccaaucccaacuacucuggaagcug

SEQ ID NO: 108245 - RNA, 64 nt, Human
ugcugaggagagccgaguuggacuggcuaccccuccuggccacccaguacucccuccagccuca

SEQ ID NO: 108246 - RNA, 64 nt, Human
ugcgaaagaguugauauaugcaaaguaauucaaaccuggccauguacuuuggaaaagaaagcau

SEQ ID NO: 108247 - RNA, 64 nt, Human
ucacgugucuuuggugagugagaagaccuaaacuccuggccaucaucucuuauccaauacuuag

SEQ ID NO: 108248 - RNA, 64 nt, Human
ugcugccuucccaguggggcuggucagggggcagccuggccacugccuagcuggaaugggagga

SEQ ID NO: 108249 - RNA, 64 nt, Human
aucaauacuccuagggcucaggacaaguggcuccccuggccaggagagccacagccaugauaca

SEQ ID NO: 108250 - RNA, 64 nt, Human
gguggaucaccugaggucaggaguucaagagcagccuggccaaccuggugaaacccugucucua

SEQ ID NO: 108251 - RNA, 64 nt, Human
uacuaagcugaaacaugucccucuggagcuuccaccuggccagggaggacggagacuuugaccu

SEQ ID NO: 108252 - RNA, 64 nt, Human
gcaaaucgcuugaggcugaggaguucaagaccagccuggccaacauggcgaaaacccaucucua

SEQ ID NO: 108253 - RNA, 64 nt, Human
ccagcacuuugggaggccaggaguucgagaccagccuggccaacauggugaaacccggucucua

SEQ ID NO: 108254 - RNA, 64 nt, Human
ggcggaucaccugaggucaggaguuugagaccagccuggccaacauggcaaaaccccgucucua

SEQ ID NO: 108255 - RNA, 64 nt, Human
gacccuuuccucagggcugcccugggagcucauuccuggccaacacgcccuggcagcaccagca

SEQ ID NO: 108256 - RNA, 64 nt, Human
ccucuccugcccugugauaugucugcugaguuggccuggccauuuccaagaggcuguagaaagg

SEQ ID NO: 108257 - RNA, 64 nt, Human
ugggcagaucacgaagucaguaguuugagaccagccuggccaacauagugaaaccccgucucua

SEQ ID NO: 108258 - RNA, 64 nt, Human
gacggaucacccgaggucaggaguuugagaccagccuggccaacaaggugaaacccugucucua

SEQ ID NO: 108259 - RNA, 64 nt, Human
auguauucucaucugugguccaggccggcaucguccuggccaccccccagaucuggugccugcu

SEQ ID NO: 108260 - RNA, 64 nt, Human
ggcucuguuaucagcugggcagugccagccaaucccuggccauuuggccccaggggacgugggc

SEQ ID NO: 108261 - RNA, 64 nt, Human
cgggcagaucaugaggucagaagauaaagaccacccuggccaacauggugaaacccugucucua

SEQ ID NO: 108262 - RNA, 64 nt, Human
agccccaagagcauccaggauugccucccagcugccuggccagcccacccuccugcaaccucuc

SEQ ID NO: 108263 - RNA, 64 nt, Human
guguggcacagagucuggcuccugcuaggugagaccuggccaucaaaugacacaaacaacuaaa

SEQ ID NO: 108264 - RNA, 64 nt, Human
uccugcugcaggccaaggccaaaauugggcuaguccuggccagggaaaucagaagcucuucuug

SEQ ID NO: 108265 - RNA, 64 nt, Human
aggauucccgagugugagcugucuuggggccccaccuggccaagaguagcagccacagcaguac

SEQ ID NO: 108266 - RNA, 64 nt, Human
aggucggaucaugaggucaagaguucgagaccagccuggccaauauggugaaaccccgucucua

SEQ ID NO: 108267 - RNA, 64 nt, Human
cgagcagcugagacuacaggcgccugccaccacgccuggccaauuuuuuguauuuuuaguagag

SEQ ID NO: 108268 - RNA, 64 nt, Human
caggcagaucaugaggucaagagaucaagaccauccuggccaacauggugaaacccugucucua

SEQ ID NO: 108269 - RNA, 64 nt, Human
cgggcggaucacgaggucaagagaucgagaccauccuggccaacauggugaaaccccgucucua

SEQ ID NO: 108270 - RNA, 64 nt, Human
ggcagaucaccugauaucaagaguuugaggccagccuggccaacauggcaaaacccugucucug

SEQ ID NO: 108271 - RNA, 64 nt, Human
ggaguuuacaaagaauugccccagcucugggcacccuggccacccugguccuuggauccccuuc

SEQ ID NO: 108272 - RNA, 64 nt, Human
ccugccucacccacacccgugugguaccuucagcccuggccaagcuuugaggcucugucacuga

SEQ ID NO: 108273 - RNA, 64 nt, Human
ggcagaucacuugaggucaggaguuggagaccagccuggccaacauagugaaaccccgucucua

SEQ ID NO: 108274 - RNA, 64 nt, Human
ggaggaucacuugaggccacgaguucaagaccagccuggccaacauggugaaacccaucuauac

SEQ ID NO: 108275 - RNA, 64 nt, Human
uggacucacccccucuuggggagggaguucugggccuggccaggucugagaugaggccaugccc

SEQ ID NO: 108276 - RNA, 64 nt, Human
accgaggcuucucacccuggagauggcaguuacuccuggccaugguugcugagcaugggcagac

SEQ ID NO: 108277 - RNA, 64 nt, Human
ucccugcugugagccgaagcucucccugccccgcccuggccaugugaucguguuggugacagac

SEQ ID NO: 108278 - RNA, 64 nt, Human
cucuugucgccuuggcaggacuugacucugccucccuggccagccuugcaagaggacugggguc

SEQ ID NO: 108279 - RNA, 64 nt, Human
uggaugguguggggccggccucuggccuggcucaccuggccacuguccagccagccuugugaca

SEQ ID NO: 108280 - RNA, 64 nt, Human
aaagccaaaugcagcuucugcugugcgacgcacuccuggccaucuugccgugucacccccuguc

SEQ ID NO: 108281 - RNA, 64 nt, Human
gguggaaauggggaugucaguuugaaagcugagaccuggccaggugcgguggcucacuccugua

SEQ ID NO: 108282 - RNA, 64 nt, Human
cacuucacagccaacggcuaugacaaaaccacucccuggccaauggcaucacucuucaggcugg

SEQ ID NO: 108283 - RNA, 64 nt, Human
cuggaggcccagaaguugcugcccugucuaucuuccuggccacagggcuucauucccagaucuu

SEQ ID NO: 108284 - RNA, 64 nt, Human
gguggaucauuugagguuaggaguuugagaccagccuggccaacauggcgaaauccucucucua

SEQ ID NO: 108285 - RNA, 64 nt, Human
uggucccugaaaaagcaccuggcuaagggcugggccuggccagcagggagggcaguugaugaga

SEQ ID NO: 108286 - RNA, 64 nt, Human
ggcggaucacuugagaccaggaguucgagaccagccuggccaacauggugugagaccccgucuc

SEQ ID NO: 108287 - RNA, 64 nt, Human
caaagugcugggauuacaggcgugagccaccgcgccuggccaaaacaacauuuuaaguagaaga

SEQ ID NO: 108288 - RNA, 64 nt, Human
caaagcauuaggauuauaggcgugagccacugcaccuggccaaguaauuucuuuuaggaauaaa

SEQ ID NO: 108289 - RNA, 64 nt, Human
guguguguuguguauggacucacucccagguucaccuggccacaggugcacccuucccacaccc

SEQ ID NO: 108290 - RNA, 64 nt, Human
cccggggaggggaggcugaggcguuuggccccggccuggccaggagaggcccauccccagggca

SEQ ID NO: 108291 - RNA, 64 nt, Human
uauguuuaucuuuguuacuuucacuuuuuuacaaccuggccagaggcauuuuuuaaaucaggcc

SEQ ID NO: 108292 - RNA, 64 nt, Human
agacucuggagcccaugguguccaggucuaucugccuggccaaggggaggugaguuaaggaagg

SEQ ID NO: 108293 - RNA, 64 nt, Human
ucuccaucaccaccaccagagccuccugcccagcccuggccaguucaaagguucagccaucccu

SEQ ID NO: 108294 - RNA, 64 nt, Human
ugagaggucgccaaagccugcagccuggccugggccuggccaccccuucuuucccuccgcgccc

SEQ ID NO: 108295 - RNA, 64 nt, Human
aaggcugcccugcccccgacucuccugccgcaccccuggccauuguaccuuuugauguuuagaa

SEQ ID NO: 108296 - RNA, 64 nt, Human
ucuccugguugaaugagaugcaguggggggugcaccuggccagacucucccuccuguccuguac

SEQ ID NO: 108297 - RNA, 64 nt, Human
gguggaucaccugaggccagguguuugagaucagccuggccagcauggcgaaacccugugucua

SEQ ID NO: 108298 - RNA, 64 nt, Human
cuggagaucgagugaucuugccccagaccggcagccuggccauccccaagccuucaacagaagc

SEQ ID NO: 108299 - RNA, 64 nt, Human
cuucuagauggagaguggucacuggggaaaaggaccuggccaucaccuuccaauaccugcugcc

SEQ ID NO: 108300 - RNA, 64 nt, Human
ccagcccccacccgaaaguggacacuggcuccgcccuggccaccuggggacuggcacuguggug

SEQ ID NO: 108301 - RNA, 64 nt, Human
agcacaaagucacgauuccacaauggaggggagaccuggccaagggagccagccagcgugcaac

SEQ ID NO: 108302 - RNA, 64 nt, Human
auuugaggcugguuuugauggcuggguccuugggccuggccagucuuccucuuagccucuggau

SEQ ID NO: 108303 - RNA, 64 nt, Human
cccugccccuccaggaccugacagccccucccauccuggccacccgccuggaaguccccauccg

SEQ ID NO: 108304 - RNA, 64 nt, Human
cagguggaucacaaugucaggaguuugagacuagccuggccaauauggugaaacccugucucua

SEQ ID NO: 108305 - RNA, 64 nt, Human
uuugugguuuugguucucccacuaugguaggaccccuggccagcauuguggcuugucaugucag

SEQ ID NO: 108306 - RNA, 64 nt, Human
ggcggaucuuuugaggucaggaguuugagaccagccuggccaacauggugaaaccccgucucua

SEQ ID NO: 108307 - RNA, 64 nt, Human
agagagagccacuuacaaagucgaucuugagagaccuggccacaugcagcugggcugagugaug

SEQ ID NO: 108308 - RNA, 64 nt, Human
ucaaccagggcuggccacccuggucuugaggguuccuggccaccuagccugcuccucugcucuc

SEQ ID NO: 108309 - RNA, 64 nt, Human
ggcggaucaccugagaucaggaguucgaggccagccuggccaagauggcaaaaaccccgacucu

SEQ ID NO: 108310 - RNA, 64 nt, Human
uagagucuuuguugguuagaggacugccugugauccuggccacuaggccaagaggcccuaugaa

SEQ ID NO: 108311 - RNA, 64 nt, Human
gccucuuaggaguccucagagagccuucugugccccuggccagcugauaauccuagguucauga

SEQ ID NO: 108312 - RNA, 64 nt, Human
uucuuaacauguugagagaugauucuuucuuggcccuggccaucucgggaagcuugauggcaau

SEQ ID NO: 108313 - RNA, 64 nt, Human
ugcuccuggaccagcgauaugcccggcccccuguccuggccaagcugccggccuggauccgagc

SEQ ID NO: 108314 - RNA, 64 nt, Human
ggcagaucaccugaggucaagaguucaagaccggccuggccaacauggugaaaccccgucucua

SEQ ID NO: 108315 - RNA, 64 nt, Human
gcagaucacgaggucaggaguucgagaccagcagccuggccaauauagugaaacuucgucucua

SEQ ID NO: 108316 - RNA, 64 nt, Human
cggguggaucacuaggucaggaguucaagaccagccuggccaacauggugaaacccugucugua

SEQ ID NO: 108317 - RNA, 64 nt, Human
guggcuaggggaaaugggaagaggauugccauggccuggccaucuuguugcugcuugguuagau

SEQ ID NO: 108318 - RNA, 64 nt, Human
uccucccaacuccucagggccuucuguaucugugccuggccaguggcagcacuagcagugguau

SEQ ID NO: 108319 - RNA, 64 nt, Human
uugauauuuuuucuucuuuugcuuaaacagaagcccuggccauccauguauuuugcaauugacu

SEQ ID NO: 108320 - RNA, 64 nt, Human
cccggcuaauuuuuguauuuucagucgagaccagccuggccaacauggugaaacaccgucucua

SEQ ID NO: 108321 - RNA, 64 nt, Human
ggcggaucacuugaggucagcaguuugagacgagccuggccaacauggugaaacccuguagcua

SEQ ID NO: 108322 - RNA, 64 nt, Human
caaagugcugagauuacaggcgugagccaccgugccuggccaggccccuucucuuuuaauggag

SEQ ID NO: 108323 - RNA, 64 nt, Human
uuccaguugaacauucuuggaggcuuaucucuucccuggccagaugccugaucagaugagaagc

SEQ ID NO: 108324 - RNA, 64 nt, Human
gaggaauaugauuaauacauuccgccccuuggaaccuggccaugcaaagcaagggcacagggau

SEQ ID NO: 108325 - RNA, 64 nt, Human
aagugccagggggcggaguccccagcagaugcauccuggccaucuguugcguggaugagggagu

SEQ ID NO: 108326 - RNA, 64 nt, Human
gagaagcaaugggucugugacucaaaaauugagcccuggccaggaaaauguggagacaguucuu

SEQ ID NO: 108327 - RNA, 64 nt, Human
ggggaagccagacgccauuuaaaagucugccuauccuggccaggugugguggcucacaccugua

SEQ ID NO: 108328 - RNA, 64 nt, Human
cuaagugcugggauuacaggcgugagccaccaugccuggccaaaauaugcaaauauuuuuuauc

SEQ ID NO: 108329 - RNA, 64 nt, Human
gcgagcccaugagaggacagaggcggugggacagccuggccacagagggcaaggacugugccgg

SEQ ID NO: 108330 - RNA, 64 nt, Human
ugcccagcgacggcuuaagccagcccccgacuggccuggccacacugcucuccaguagcacaga

SEQ ID NO: 108331 - RNA, 64 nt, Human
aagaguaucggugcccauggugacuucuagaaaaccuggccacugguaggagcuagggaggggc

SEQ ID NO: 108332 - RNA, 64 nt, Human
uggguggaucacgaggucaggagauccagcccauccuggccaacauggugaaaccccaucucua

SEQ ID NO: 108333 - RNA, 64 nt, Human
ggcggaucaccuguggucaggaguuugagaccagccuggccaacauggcaaaaccccgucugua

SEQ ID NO: 108334 - RNA, 64 nt, Human
gguggaucacuugaggucagaaauuugagacgagccuggccaacauggugaaaccccaucucua

SEQ ID NO: 108335 - RNA, 64 nt, Human
ucugcaagaggaacuaaggccuucucucagacugccuggccagccuggggcacugaaaauacgg

SEQ ID NO: 108336 - RNA, 64 nt, Human
gcugucccaagccccacuccauggggccagguuuccuggccacuuuuguugauagcagauggau

SEQ ID NO: 108337 - RNA, 64 nt, Human
gguggaucacuugaggucaggaguucgagaccagccuggccaauaaggugaaacccugucucua

SEQ ID NO: 108338 - RNA, 64 nt, Human
guggccucuucaucagggguauugggguuagugaccuggccagagggugccaagaggggggcag

SEQ ID NO: 108339 - RNA, 64 nt, Human
gccauccuucggggcucucucccucugucucccuccuggccauucugggcuuggguaucuccuu

SEQ ID NO: 108340 - RNA, 64 nt, Human
aggggccaugauggcaacagaucuggaaccucagccuggccagacacaggcccucccuguuccc

SEQ ID NO: 108341 - RNA, 64 nt, Human
caguagggcaccaaucccaccuccuucauuaccuccuggccaugauucuccugggagauaauuc

SEQ ID NO: 108342 - RNA, 64 nt, Human
ugccugggagccagggugagagucuggguccaggccuggccauguggcccuccaguguaugaga

SEQ ID NO: 108343 - RNA, 64 nt, Human
ggcggaucacuugaggucaggagcucgagaccagccuggccaacacggugaaaccccaucucua

SEQ ID NO: 108344 - RNA, 64 nt, Human
ggcggaucacuugaggucaggagcucaagaccagccuggccaacauggugaaaccccaucucua

SEQ ID NO: 108345 - RNA, 64 nt, Human
gcagaucacuuugaggucaggaguuugagaccagccuggccaacauggagaaccccccgucucu

SEQ ID NO: 108346 - RNA, 64 nt, Human
uaguaaguuuaaagcaggaccugccuuaacugcuccuggccacuuggaaguuuaggguagaucu

SEQ ID NO: 108347 - RNA, 64 nt, Human
gguggaucaccugaggucgggaguuugagaccagccuggccaacauggugaaaccccaucgcua

SEQ ID NO: 108348 - RNA, 64 nt, Human
uccaccccagcccauguacguccccacgaacuggccuggccagcaccccacacuggagccaucu

SEQ ID NO: 108349 - RNA, 64 nt, Human
ugucugugcaccgagaagaggcggcagauccugcccuggccaaucaggcgagacgccuuuguga

SEQ ID NO: 108350 - RNA, 64 nt, Human
guccauagaggcucuccaaagagguccagaaugcccuggccagagcgagcaacacggcggagga

SEQ ID NO: 108351 - RNA, 64 nt, Human
ugugccaaauucaguggggacucagugcccaggcccuggccacgagcuuuggccuuggucuacc

SEQ ID NO: 108352 - RNA, 64 nt, Human
gccaacucaaacacgugccuucuccacgguaucuccuggccaggcugcugggacagccgccgcc

SEQ ID NO: 108353 - RNA, 64 nt, Human
ggagcagcugugugacagggucugcggcaccgcgccuggccaggccggcugcaguuucucacuu

SEQ ID NO: 108354 - RNA, 64 nt, Human
gaaggaucaccugagaucaggaguuccagaccagccuggccaacauggcgaaaccccaucucua

SEQ ID NO: 108355 - RNA, 64 nt, Human
ugggcggaucacaaggucaggaguucgagaccagccuggccaauauggugaaaccccaucucua

SEQ ID NO: 108356 - RNA, 64 nt, Human
agccuauggccccgaaccaaggacugccgcgccuccuggccaggcagggcgccugggagaaccc

SEQ ID NO: 108357 - RNA, 64 nt, Human
ggcggaucaccugaggucaggagaucgagaucagccuggccaacauggugaaaccccuucucua

SEQ ID NO: 108358 - RNA, 64 nt, Human
ggcagauuacuugaggcuaggaguucaagaccagccuggccaacauggugaaaccccaucucua

SEQ ID NO: 108359 - RNA, 64 nt, Human
ugaauuugcagauuacccaugugcacaguggggaccuggccagugagcacucgcaaggggacuc

SEQ ID NO: 108360 - RNA, 64 nt, Human
gcagguggaucaccugaggucaguucaagaccagccuggccaacauggugaaaccccgucucua

SEQ ID NO: 108361 - RNA, 64 nt, Human
gguggaucacucgaugucaggaguuugagaccagccuggccaacaugguaaaacgccgucucua

SEQ ID NO: 108362 - RNA, 64 nt, Human
uguggaucaccugaggucaggaguucaagaccagccuggccaacacggugaaaccccgucucua

SEQ ID NO: 108363 - RNA, 64 nt, Human
gguggaucaccugaggucaggaguuugagaccagccuggccaacauggugaaacccugucucua

SEQ ID NO: 108364 - RNA, 64 nt, Human
cgggcagaucacaagaucaggaguucgagaccagccuggccaacccagccuggucaacauggug

SEQ ID NO: 108365 - RNA, 64 nt, Human
gguggaucaccugaagucagguguuugagaccagccuggccaacaugguggaacccaaucucua

SEQ ID NO: 108366 - RNA, 64 nt, Human
gaaguggaaguaggggcaagcucuugccccacucccuggccaucucaacgccucuccucaaugc

SEQ ID NO: 108367 - RNA, 64 nt, Human
agcucagagaugcagcaugaggcgcuuagaaaaaccuggccauuugcugccucuaauucccuuu

SEQ ID NO: 108368 - RNA, 64 nt, Human
ggcagaucacuugaggucaggaguucaagaccagccuggccaacacggugaaaccccaucucuc

SEQ ID NO: 108369 - RNA, 64 nt, Human
ccaugcucacuggccaauaaagagcuugaugcugccuggccaaaugaggugacucagauagaau

SEQ ID NO: 108370 - RNA, 64 nt, Human
cuguggcccuggcucugcuguccccuuggcagguccuggccagauggcccggaugcugcuuccg

SEQ ID NO: 108371 - RNA, 64 nt, Human
gggaauuccggccagcagcuuccuccuucagccaccuggccauaccccuuaaauaagccccuca

SEQ ID NO: 108372 - RNA, 64 nt, Human
gauguuaccuugcuuguccacagcagccagucacccuggccagucccacuuccuggauaauucu

SEQ ID NO: 108373 - RNA, 58 nt, Human
ccgagagguuccugaucuaggccccagaccuggccaggccagccucccugugcgugug

SEQ ID NO: 108374 - RNA, 64 nt, Human
cugccucgcccccuacaggccucugggcccagcuccuggccaggcugcugccaaggucaagccc

SEQ ID NO: 108375 - RNA, 64 nt, Human
ggaguccucaguccuuaagauacauccagaaaguccuggccaugaauuggaggugcagaguccu

SEQ ID NO: 108376 - RNA, 64 nt, Human
uuuuuaagcacugaauucacuacugaucccaucgccuggccaguagaacagucauuacuccauu

SEQ ID NO: 108377 - RNA, 64 nt, Human
uuaggauggcucuauaauuaggauaggccagaacccuggccacuguauaaaauuggaaagucuc

SEQ ID NO: 108378 - RNA, 64 nt, Human
caaagugcugggauuauaggcaugagccacugugccuggccacaucuugcuuuuuuuuuuauga

SEQ ID NO: 108379 - RNA, 64 nt, Human
cguucccccaugauuguaaguuucuugaggccucccuggccaugcugaacucuucagucaauua

SEQ ID NO: 108380 - RNA, 64 nt, Human
gguggaucaccggaggucaguaguucaagaccagccuggccaacauggugaaaccccaccucua

SEQ ID NO: 108381 - RNA, 64 nt, Human
agucuaaauauuagagaugaggcugugccuacucccuggccagcucugcugauagccuaugaug

SEQ ID NO: 108382 - RNA, 64 nt, Human
ucugccggggccucccucugcugccugcugggacccuggccacucauuuuucuccuccuuggga

SEQ ID NO: 108383 - RNA, 64 nt, Human
gguggcucacuugaggucaggaauucaagaccagccuggccaacauggugaaaccccgucucua

SEQ ID NO: 108384 - RNA, 64 nt, Human
gcagcaccugucuccuuucaccccagggccugagccuggccagccuacaauggggauguugugu

SEQ ID NO: 108385 - RNA, 64 nt, Human
aacugaggcagacacuccagccccuuucugggauccuggccacgucauugugcuccugcccugc

SEQ ID NO: 108386 - RNA, 64 nt, Human
guggggguggccaucccugggccccuccacgccuccuggccagacgcugccgcugccgcugcac

SEQ ID NO: 108387 - RNA, 60 nt, Human
agaccccgcuguacaucuaggccaccccagccuggccacgcagccaggacaccgggcagg

SEQ ID NO: 108388 - RNA, 64 nt, Human
guagggcaccaggagagaaauccuccuggguacuccuggccagacccuccugaaucaucugcgg

SEQ ID NO: 108389 - RNA, 64 nt, Human
ugggcgaaucacaaggucaggaguuugagacuagccuggccaacauggugaaacccugucucua

SEQ ID NO: 108390 - RNA, 64 nt, Human
uggccuggcuuccaccucuccacuccugugucuaccuggccaguggagugguccaugcuaaguc

SEQ ID NO: 108391 - RNA, 64 nt, Human
cccagcauuguauuucccugugaccccuuacucuccuggccagaacuugagccagcugugggau

SEQ ID NO: 108392 - RNA, 64 nt, Human
gguggaucaccugagguuaggaguucgagaucagccuggccaacauggugaaacccugucuacu

SEQ ID NO: 108393 - RNA, 64 nt, Human
cagguagaucacgaggucaggaauucaagaccagccuggccaacaugugaaaccccgucuccac

SEQ ID NO: 108394 - RNA, 64 nt, Human
cggguggaucaugaggucaaaagauugagaccauccuggccaacauggugaaaccccgucucua

SEQ ID NO: 108395 - RNA, 64 nt, Human
ucauuggauccucucccuuuccccaggcagcucgccuggccacaccguuggagugaacccucac

SEQ ID NO: 108396 - RNA, 64 nt, Human
ggaggaucauuugagcccaggaauuggaaagcagccuggccaacauagugggacccugucucua

SEQ ID NO: 108397 - RNA, 64 nt, Human
uuaagugcacaacauuacagggaaugccugagugccuggccaaagggauauuugguuuggccau

SEQ ID NO: 108398 - RNA, 64 nt, Human
cucuuccucucugcugaggcagcugccuccugauccuggccagcccaccucuccugcugucccc

SEQ ID NO: 108399 - RNA, 64 nt, Human
ccccacagacccgcuggaccagccugcugcggguccuggccaggggucuggcuaacggugaggg

SEQ ID NO: 108400 - RNA, 64 nt, Human
acccagacacccaaacagccguggccccagagguccuggccaaauaugggggccugccuagguu

SEQ ID NO: 108401 - RNA, 64 nt, Human
guggagacugcuucccauccuacccucgggcccaccuggccaccugaggugggcccaggaccag

SEQ ID NO: 108402 - RNA, 64 nt, Human
gguggaucacuugaggucaggaguucgagaccagccuggccaagauggcgaaacccugugucua

SEQ ID NO: 108403 - RNA, 64 nt, Human
gguggaucacuugaggucaggaguucaagaccagccuggccaacaaggcgaaacccugucucua

SEQ ID NO: 108404 - RNA, 64 nt, Human
ccuccucggcuugaguccugcacuaccaaaauggccuggccauuugauggcggagcuccagggg

SEQ ID NO: 108405 - RNA, 64 nt, Human
aauagguguagcagagaucucgcuccuguguuucccuggccagaggccacugacaggguggggg

SEQ ID NO: 108406 - RNA, 64 nt, Human
ugugugaaggugaggacucuuggaagcaggccauccuggccagacacccuagcaggaaggggcu

SEQ ID NO: 108407 - RNA, 64 nt, Human
cucagccaguaccugccccaugggcucaaggauuccuggccagcuccugccaccuccagcagac

SEQ ID NO: 108408 - RNA, 64 nt, Human
ggcacccgggccuuugcggcagcuacuggcagggccuggccaccucauaggacucaguucccuu

SEQ ID NO: 108409 - RNA, 64 nt, Human
gcaggaacuugaccugccaugugugcccugccuuccuggccagcugugcuuguuaucuuccauu

SEQ ID NO: 108410 - RNA, 64 nt, Human
gguggaucacucaaggucaggcauuugagaccagccuggccaacauagugaaaccccgucucua

SEQ ID NO: 108411 - RNA, 64 nt, Human
ggcagaucaccugaggcuaggaguugcagaccagccuggccaacauggcaaaaccccgucucua

SEQ ID NO: 108412 - RNA, 64 nt, Human
cuagcugggaaagaagaguggagcagagacucugccuggccacugagaacagccaaauucacaa

SEQ ID NO: 108413 - RNA, 64 nt, Human
ggcggacugccugaggucaggaauucaagaccagccuggccaacauggcaaaaccccaucucua

SEQ ID NO: 108414 - RNA, 64 nt, Human
uuccucuccucuucacuagccucucugaagguguccuggccagcccuggagaagcacugguguc

SEQ ID NO: 108415 - RNA, 64 nt, Human
gccuucuucacaggcugaggggguucagaaccagccuggccaaaaauuacaccagagagacaga

SEQ ID NO: 108416 - RNA, 64 nt, Human
aguggaucaugugaggucaagaguucgagaccagccuggccaacauggugaaaccccgucucua

SEQ ID NO: 108417 - RNA, 64 nt, Human
ggaggaucgcuugagcccaggaguuugagaccagccuggccaacacaguaaacccugucuccac

SEQ ID NO: 108418 - RNA, 64 nt, Human
ggugaaugguaguggagccaggcuuccacugcauccuggccaggggacggagccccuugccuuc

SEQ ID NO: 108419 - RNA, 64 nt, Human
guuuugcugaugaaaucaggaagaggacaaguggccuggccagcccacaacuaguauucagcca

SEQ ID NO: 108420 - RNA, 64 nt, Human
gauguggugcucuggaauccagucccauuuccuuccuggccacgccuguccagcggccucuuug

SEQ ID NO: 108421 - RNA, 64 nt, Human
cccgcucacaccaggcagccuucauaguggucucccuggccaccuugggcagagcugggucaug

SEQ ID NO: 108422 - RNA, 64 nt, Human
cccccuccuuccccucccugaaccccacaguccgccuggccaggccuccuggccgccacgcaga

SEQ ID NO: 108423 - RNA, 64 nt, Human
ccgugucccaggaccguaccguccgcaucugggaccuggccacccugcagcaggugggguuugg

SEQ ID NO: 108424 - RNA, 64 nt, Human
cccagcugcugcgaguugacaucggcacucuggaccuggccagcagccgccuggacucagccau

SEQ ID NO: 108425 - RNA, 64 nt, Human
cagaagcccccggccccuauacauaguuuauguuccuggccaccccgaccgcuucccccaaguu

SEQ ID NO: 108426 - RNA, 64 nt, Human
acaugagggccaccucuggaaccuucuucgaggcccuggccagccaucugcccagccucggagg

SEQ ID NO: 108427 - RNA, 64 nt, Human
cccuugcuggccccagcccugcuggggauccccgccuggccaggagcaggcacggguggucccc

SEQ ID NO: 108428 - RNA, 64 nt, Human
gggagaugccucuguggggaugaaauggggcaccccuggccaucacucauguguaguccagguu

SEQ ID NO: 108429 - RNA, 64 nt, Human
ggaagaugcucucgggacaguuucccgggcagcuccuggccagcuuccagcccagaguccucaa

SEQ ID NO: 108430 - RNA, 64 nt, Human
ggaaagacaccacccucgccccaagacuggggauccuggccacuguucccaucccaugucccug

SEQ ID NO: 108431 - RNA, 64 nt, Human
cagaaaacaccagaaacaacaacugccagcccggccuggccacaggugaggucugugauuuccg

SEQ ID NO: 108432 - RNA, 64 nt, Human
cccugccagcagcuguccucccuggugcagguggccuggccagcccacuggauuggggacgggc

SEQ ID NO: 108433 - RNA, 64 nt, Human
ugaguagcugggaccacaggcaugcgccaccacuccuggccaauuuuuaaaauuuuuuuguaga

SEQ ID NO: 108434 - RNA, 64 nt, Human
gcgcaguccugggacucuccgcagccccgccccgccuggccacugcgucuggcauuccuggguc

SEQ ID NO: 108435 - RNA, 64 nt, Human
cucccguuuccaggccaugaccacucugcccuguccuggccauacggacucggccugccuuugc

SEQ ID NO: 108436 - RNA, 64 nt, Human
cgaagugcugggauuauaggcguaagccaccaugccuggccaaaaauuaaaagauuuuaugaaa

SEQ ID NO: 108437 - RNA, 64 nt, Human
ugcugauuuccuaaaugcuacccuuugaucauuuccuggccaccaucacaauacuaaggggcuc

SEQ ID NO: 108438 - RNA, 64 nt, Human
ugcacugacauuguuggccaaagccaaagcuaggccuggccagaugcaccagcccuuagcaggg

SEQ ID NO: 108439 - RNA, 64 nt, Human
caccccauuucuugcuugauugcuuuguugggggccuggccacuuccuugcuucucaagcugac

SEQ ID NO: 108440 - RNA, 64 nt, Human
cgggcagaucaugagggcaggagauugagacccuccuggccaacauggugaaaccccgucucua

SEQ ID NO: 108441 - RNA, 64 nt, Human
ggaagaucacuugaguucaggaguuugagaccagccuggccaacauggugaaaccccaucucua

SEQ ID NO: 108442 - RNA, 64 nt, Human
agcagaucacuugagguuaggaguucgauaccagccuggccaacauggugaaacccggucucua

SEQ ID NO: 108443 - RNA, 64 nt, Human
uccuuguccccaucuggcugucucucugugcuucccuggccaggggcgugccugcugguccuau

SEQ ID NO: 108444 - RNA, 64 nt, Human
gguggaucaccugaggucaggagcucgagaccagccuggccaacauggugaaaccccaucucua

SEQ ID NO: 108445 - RNA, 64 nt, Human
aggcagaucaccgagcccaagaguucaagacaauccuggccaacggcgaaacucugucucuaca

SEQ ID NO: 108446 - RNA, 64 nt, Human
uccuguggccguccuggaggaggugaugcuggucccuggccaccucuacagcccugaacucuug

SEQ ID NO: 108447 - RNA, 64 nt, Human
gccuggggagacuugagcagauguuucauuuuggccuggccaguggcugaaagccaggccucca

SEQ ID NO: 108448 - RNA, 64 nt, Human
aagccauacucaggcccccaccgacauuguccacccuggccagaagggugcaugccaauggcag

SEQ ID NO: 108449 - RNA, 64 nt, Human
ggccucuguaccacccuguggguuuucuuggacaccuggccagugcugaagggcuguugugaug

SEQ ID NO: 108450 - RNA, 64 nt, Human
gugacugacuggugucuucccauuuggacuguggccuggccagagccccuugcauauccccacu

SEQ ID NO: 108451 - RNA, 64 nt, Human
ccgccuggcugugcacacaugcagcacgacccagccuggccacacacuguggugccaucugggu

SEQ ID NO: 108452 - RNA, 64 nt, Human
ucagcacagggcugaggauggggcuccuauccacccuggccagcacccagcuuagugcugggac

SEQ ID NO: 108453 - RNA, 64 nt, Human
gacggaucacuugagguuaggaguuugagaccagccuggccaacauggugaaaccccaucucua

SEQ ID NO: 108454 - RNA, 64 nt, Human
aaaccccgguuucacucuggccccaggaguggagccuggccacuccuguuugguucucacuggg

SEQ ID NO: 108455 - RNA, 64 nt, Human
ggcggaucgguugagcucaggcguucgggaccagccuggccaacaugaugaaaccccgucucua

SEQ ID NO: 108456 - RNA, 64 nt, Human
gagcaagaccccagagaugcuuagagacaggacaccuggccaucaaacccaguuuggcccagcc

SEQ ID NO: 108457 - RNA, 64 nt, Human
agcacuuugagguuggcugggaguucaagaccagccuggccaacaugucagaacuacuaaaaau

SEQ ID NO: 108458 - RNA, 64 nt, Human
ggaggaucaccugaggucaggaguuugagaccagccuggccaacaugaugaaauguugucucua

SEQ ID NO: 108459 - RNA, 64 nt, Human
ggcauccgggcccuagaaauuccacagcucccguccuggccacccuggaagcucaucaggccaa

SEQ ID NO: 108460 - RNA, 64 nt, Human
uggauuccuggcuggggacaaugaugaccuggacccuggccagaagagcccuggcccuccagca

SEQ ID NO: 108461 - RNA, 64 nt, Human
ccuggggguugaccaggagccggucagagauggaccuggccagaugucugaccacaccccaauc

SEQ ID NO: 108462 - RNA, 64 nt, Human
aguccccuguccgccccaaaacccggccuuggucccuggccaggcugagagaauugggcaggga

SEQ ID NO: 108463 - RNA, 64 nt, Human
guggugacugugccuuacuguacaugcucggaggccuggccauauaggagggugggugaugcug

SEQ ID NO: 108464 - RNA, 64 nt, Human
ccagggcuggggaggagcggggagggcggaucucccuggccagcagggaugggagggggccauu

SEQ ID NO: 108465 - RNA, 64 nt, Human
acucccuuccuggcuuguauuuacuuuucuuggcccuggccagggcugggcgcaaggcacgcag

SEQ ID NO: 108466 - RNA, 64 nt, Human
gacucagugaccacgucaugacagaacagcacauccuggccagcaccccuggcuggaguggguu

SEQ ID NO: 108467 - RNA, 64 nt, Human
aaguuccugauagcacuugugccucagccccucaccuggccaccugccagggcaccugcaaccc

SEQ ID NO: 108468 - RNA, 64 nt, Human
ccacaguagguaggaaaaugggcuguuucacaggccuggccacgcucucacggaaccacuggca

SEQ ID NO: 108469 - RNA, 64 nt, Human
aggcggaucacaaggucaacgagaucgagaccauccuggccaacauggugaaacccugucugua

SEQ ID NO: 108470 - RNA, 64 nt, Human
cacccugggggaggcccucugugaaugggucucuccuggccauagaaugauggaaagggaaggu

SEQ ID NO: 108471 - RNA, 64 nt, Human
gguggaucaccugaggucagcaguucaaaaucagccuggccaaaaugcugaaacuccgucucua

SEQ ID NO: 108472 - RNA, 64 nt, Human
gaacucagaacgcacugcacaccuaaggcaaaucccuggccacuuuagucuccccacuauggug

SEQ ID NO: 108473 - RNA, 64 nt, Human
agaggaucacuugagcucaggaguucgagaccagccuggccaacauggcaacaccccauuucua

SEQ ID NO: 108474 - RNA, 64 nt, Human
gaccuuggcagcccaggccgggguggagcaugggccuggccaccucucuccuuugcugaggccu

SEQ ID NO: 108475 - RNA, 64 nt, Human
ucccugucuucagcccucccugucucccccacuuccuggccagggcucucauucuggaccugug

SEQ ID NO: 108476 - RNA, 64 nt, Human
ucucaaaccaaucaaucaaucaaucaaucacuguccuggccaguugcaguggcucacgccuaua

SEQ ID NO: 108477 - RNA, 64 nt, Human
agucucgcuauguugcccaggcuggucucgaacuccuggccacaagugugccucccgccuuggc

SEQ ID NO: 108478 - RNA, 64 nt, Human
cauuaccccaggccagugguagcuuccucaggagccuggccacuuccaacgguagcacugaagu

SEQ ID NO: 108479 - RNA, 64 nt, Human
caaaauggacaccacgagacagaaguggggacugccuggccaccuagcgccuucccacuccuua

SEQ ID NO: 108480 - RNA, 64 nt, Human
gggacuuuacuaucuagcaccccaguaggccuguccuggccagagaagacugguaggggccgag

SEQ ID NO: 108481 - RNA, 64 nt, Human
aaagucuggacccacuccaugcucugcccucagaccuggccaggugaugcucugggggcagcau

SEQ ID NO: 108482 - RNA, 64 nt, Human
gaggcuucuccaccaguggcagccccaccccgucccuggccauucuuggccuccaccccgcuca

SEQ ID NO: 108483 - RNA, 64 nt, Human
gguggaucaccugaggucaggaguucgaaaccagccuggccaacauagugaaacccccucucua

SEQ ID NO: 108484 - RNA, 64 nt, Human
ggcagaucacuugaggucaggaguucaagaccagccuggccaaccuggugaaacccugucucua

SEQ ID NO: 108485 - RNA, 64 nt, Human
cagcauacuuggccucccccaccucccugcccuuccuggccagagagcuguccaaggcuguauc

SEQ ID NO: 108486 - RNA, 64 nt, Human
gcagcaaguggaaccuucuggagcuggccaucauccuggccagcuggagcgcccuggcgguguu

SEQ ID NO: 108487 - RNA, 64 nt, Human
cgugaauuuuuuucgcuaugggaggcagccgaggccuggccaaugcggcccacuuuccugagcu

SEQ ID NO: 108488 - RNA, 64 nt, Human
ucaggcgagccauggggucugcuguggggucugcccuggccacccacugugugucuggguccuu

SEQ ID NO: 108489 - RNA, 64 nt, Human
cccugagcuacguggagcugcugccccggggaggccuggccaaguaguacagcuagagcccagg

SEQ ID NO: 108490 - RNA, 64 nt, Human
gccacagaaggcugcggagugaggcggcagcuagccuggccaguggcugucccguggaccgaca

SEQ ID NO: 108491 - RNA, 64 nt, Human
acuuaagcagggagcugggcuagcagaggccggcccuggccaucgggagagcucugaccugcac

SEQ ID NO: 108492 - RNA, 64 nt, Human
cuuccuccuacuucugcuguagccugggaccagaccuggccaaggucagccagcggggagggcc

SEQ ID NO: 108493 - RNA, 64 nt, Human
gcccagcccuaugcucugugcuuggcccugggccccuggccauccacaaacagcagaggccuuc

SEQ ID NO: 108494 - RNA, 64 nt, Human
ugggucugggguuuaaguggccacccauccaggcccuggccagugugggaccgggacgggaagg

SEQ ID NO: 108495 - RNA, 64 nt, Human
cacaucacaaggcgaacacaaauggacacacauaccuggccacgaacccacaccuccucagaca

SEQ ID NO: 108496 - RNA, 64 nt, Human
agcccuucaguggcuucuucaggccuaggauaacccuggccaggccccaugguccugcucuggg

SEQ ID NO: 108497 - RNA, 64 nt, Human
ggugguucaccugaggucaggaguuugagaccagccuggccaacauggagaaacuccgucuccg

SEQ ID NO: 108498 - RNA, 64 nt, Human
agacaccagcaugaaaagccuaggccccugagggccuggccacaugggaccaagcggaaccaga

SEQ ID NO: 108499 - RNA, 64 nt, Human
gacccuuugaggcccccagugaucucgacuccccccuggccacagacccccagggcauuguguu

SEQ ID NO: 108500 - RNA, 64 nt, Human
gguggaucacuggaggucaggaguuugagaccagccuggccaacauggugaaacccugucucua

SEQ ID NO: 108501 - RNA, 64 nt, Human
aaaaacauccgacagagcagcucuggcuuugcagccuggccagcagcucagagugcaccgagga

SEQ ID NO: 108502 - RNA, 62 nt, Human
ccaccacaccaagccccuaggcuggggcacagccuggccaugcccaggaagacccaccccau

SEQ ID NO: 108503 - RNA, 64 nt, Human
ggcggaucaccugaggccaggaauucaagaccagccuggccaacauggugaaacccuaucucca

SEQ ID NO: 108504 - RNA, 64 nt, Human
ggccgccccuacugggaagugaggagccccucugccuggccaccaccccaucugggaggugugc

SEQ ID NO: 108505 - RNA, 64 nt, Human
caaggugcugggauuacaggugugagccaccacaccuggccaagaauaccacuuuugaaguuaa

SEQ ID NO: 108506 - RNA, 64 nt, Human
caaagcacugggauuacaggcaugagccaccaugccuggccaggacauauuugaaauggggaga

SEQ ID NO: 108507 - RNA, 64 nt, Human
agggagggacaaguggugcccuguccccugcuccccuggccaaagaaagcuguccuugaggcug

SEQ ID NO: 108508 - RNA, 64 nt, Human
aggagggugggcaggcaaccuccccgggcaggguccuggccagcagugugggagcaggagggga

SEQ ID NO: 108509 - RNA, 64 nt, Human
cuauuacugcaguacauacgucugccagggguaaccuggccacugucccuguccuucuacagaa

SEQ ID NO: 108510 - RNA, 61 nt, Human
ggguccacgaggagcucugaggggcagggagccuggccaggccugagacacagaggcccac

SEQ ID NO: 108511 - RNA, 64 nt, Human
aauccuaaguuaccuuucuaggucaaggccugucccuggccaucucugaacuucagcuagagcu

SEQ ID NO: 108512 - RNA, 64 nt, Human
ggucgauuacuugaggucaggaguucacgaccagccuggccaacauugugaaaccccaucucug

SEQ ID NO: 108513 - RNA, 64 nt, Human
ggcggaucaccugaggucaggaguucaagaccagccuggccaacauggugaaaccccaucucua

SEQ ID NO: 108514 - RNA, 64 nt, Human
ggugguucaucuaaggucuggaguucgagaccagccuggccaacauagcgagagcagcuccggu

SEQ ID NO: 108515 - RNA, 63 nt, Human
cgaaguuugucucagcguagggcaggaggcccuccuggccaggccagcagugaagcaguaugg

SEQ ID NO: 108516 - RNA, 64 nt, Human
ccggcagagagugguugccuuuccauuugcccucccuggccaugccuucuugccuuuggaaaaa

SEQ ID NO: 108517 - RNA, 64 nt, Human
uauuaaauaguaggucgauucacauccucgugcuccuggccacccuccccugugccucagugac

SEQ ID NO: 108518 - RNA, 64 nt, Human
caaagcuuaguccuagcauaugcaccugagccaaccuggccaaucagauuguuuugucaauaau

SEQ ID NO: 108519 - RNA, 64 nt, Human
uaguguuacccuccccuagucaacagcagaccagccuggccaaugccuauggguggccccucug

SEQ ID NO: 108520 - RNA, 64 nt, Human
ggcggaucaucugaagucaggaguuaaagaccagccuggccaacauggcaaaaccccaucucua

SEQ ID NO: 108521 - RNA, 64 nt, Human
ugggggccugaguggggacagaguugaucguccaccuggccauuuugacccugaguggacaguc

SEQ ID NO: 108522 - RNA, 64 nt, Human
caggcggaucacgaggucaggagaucgagaccauccuggccaacacggugaaaccucgucucca

SEQ ID NO: 108523 - RNA, 64 nt, Human
ccuagggaugcucuaaagcugggcucaagcaagcccuggccagagguccuaaagaugcugacug

SEQ ID NO: 108524 - RNA, 64 nt, Human
gccucugccuuguccugaugcugugcucaaucagccuggccaucuggauuuucacacaguaaag

SEQ ID NO: 108525 - RNA, 64 nt, Human
uucgccucugcuggaacaagcaggacccuaacuaccuggccaccauggccauggauggaaugga

SEQ ID NO: 108526 - RNA, 64 nt, Human
gcacccacuguuaccagaagcugcucuaggaguuccuggccagucaccccaucgcccucugugg

SEQ ID NO: 108527 - RNA, 64 nt, Human
aaggggagauggacgacacggucggggcaucuggccuggccagugcccugaucccagagagccc

SEQ ID NO: 108528 - RNA, 64 nt, Human
cuccccugggaauagagcaagacgugaguccuaaccuggccacaguugggggaggcagagccag

SEQ ID NO: 108529 - RNA, 64 nt, Human
gguggaucacccgaggucaggaguucgagaccagccuggccaacauggugaaaccccaucacua

SEQ ID NO: 108530 - RNA, 64 nt, Human
gacagaccaccugaggucaggaguucgaaaccagccuggccaacauggagaaaccccaucucua

SEQ ID NO: 108531 - RNA, 64 nt, Human
ccugaccugugcagagaguggggaggcgucagcgccuggccagggcugccccaguccuuuggug

SEQ ID NO: 108532 - RNA, 64 nt, Human
gcggcucagugcugccugcggcccagcuaaggggccuggccacugggugccacccagccugugu

SEQ ID NO: 108533 - RNA, 64 nt, Human
cggguggaucaugaggucaggaguucgagaccagccuggccaacauagugaaaccccaucucug

SEQ ID NO: 108534 - RNA, 64 nt, Human
gagguugugugggcugggcucuggugcccucuucccuggccaggacaccucuccuccugauucc

SEQ ID NO: 108535 - RNA, 64 nt, Human
ggcggaucaccugaugucaggaguucaagaccagccuggccaacauggugaaaccccaucuuua

SEQ ID NO: 108536 - RNA, 64 nt, Human
gguggaucagcugaggucaggaguucaagaccagccuggccaaccuggugaaaugcagugucaa

SEQ ID NO: 108537 - RNA, 64 nt, Human
ugcccugccccaugaagggccaccagccaagggcccuggccacgugugcgccaccuuacuuugg

SEQ ID NO: 108538 - RNA, 50 nt, Human
agccgggacuggccacaugaccuggccaccgccuuucucaccacccuggg

SEQ ID NO: 108539 - RNA, 64 nt, Human
gguggaucaccugaggucaggaguuccagaccagccuggccaacauggugaaaccucaucucua

SEQ ID NO: 108540 - RNA, 64 nt, Human
ggagcugauugagcugcaacagcuuugcugaaggccuggccagccuccuggccugccccaagug

SEQ ID NO: 108541 - RNA, 64 nt, Human
gaggucagccugauuucaacccaggugccccuggccuggccagcagugaauguaggagaugaau

SEQ ID NO: 108542 - RNA, 64 nt, Human
agguuucacccacuggaggcucaaccuaaggaacccuggccaugguggguggguucaccuuggg

SEQ ID NO: 108543 - RNA, 64 nt, Human
ugacccagcacugaggagggguugcuccgccuggccuggccauacugugucccaucggagugcg

SEQ ID NO: 108544 - RNA, 64 nt, Human
ggccagaccccagagcccuugugccaucuuucuuccuggccagagugaugggguuccagccaug

SEQ ID NO: 108545 - RNA, 64 nt, Human
cugugccaacccuguacagaaucgagugcuguagccuggccagaccccagagcccuugugccau

SEQ ID NO: 108546 - RNA, 64 nt, Human
aguucucugugcaucuguccauccucccuauggcccuggccagagcucagcaugggcagggguu

SEQ ID NO: 108547 - RNA, 64 nt, Human
gguggaucacuugaggucaggaguucgagaccagccuggccaacaugaugaaaccccaucucua

SEQ ID NO: 108548 - RNA, 64 nt, Human
ggcagauaacuugagaucaggaguucgagaccagccuggccaacacaaugaaaccguguaucua

SEQ ID NO: 108549 - RNA, 64 nt, Human
augaauagauugguuuccuguggcucccuccaaaccuggccaagcccagcuuccgaagcaggaa

SEQ ID NO: 108550 - RNA, 64 nt, Human
ggcggaucaccugaagucagaaguuugagaccagccuggccaacauaauuaaaaugucucuacu

SEQ ID NO: 108551 - RNA, 64 nt, Human
accuggagauagccagauagccagaugcccugcuccuggccaccuuuaaagccccugcauauga

SEQ ID NO: 108552 - RNA, 64 nt, Human; identical to SEQ ID NO: 107914

SEQ ID NO: 108553 - RNA, 64 nt, Human
ccccacagacagcuugaggccccuccuucugcugccuggccaagccccacacccgcagacccuc

SEQ ID NO: 108554 - RNA, 64 nt, Human
ccagggccugacacccccuccccgccccuguggcccuggccacuaaagcuucagacucaaguac

SEQ ID NO: 108555 - RNA, 64 nt, Human
ggccgaucacuugaggucaggaguucaagaccagccuggccaacauggugaaaccccaucucua

SEQ ID NO: 108556 - RNA, 64 nt, Human
gguggaucacuugaggccaggaguucaagaccagccuggccaacaugaugagaccuccgucucu

SEQ ID NO: 108557 - RNA, 64 nt, Human
uuaccuaccuauaaggugguuuauaagcugcuguccuggccacugcauucaaauuccaaugugu

SEQ ID NO: 108558 - RNA, 64 nt, Human
gacaggaaagggaaggccccacagacaagguagcccuggccagaggcuuguuuugucuuuuggu

SEQ ID NO: 108559 - RNA, 64 nt, Human
cucagcaucacacugacacucacccugcccugccccuggccagaggguacugccgacggcacuu

SEQ ID NO: 108560 - RNA, 64 nt, Human
uaagggggcccucuaaaccccuugccuggccucaccuggccagcucaccccuuuuggguguagg

SEQ ID NO: 108561 - RNA, 64 nt, Human
cugcagggccuucuccagcucccuuugguuagucccuggccaucccuccuguccuggaucccuu

SEQ ID NO: 108562 - RNA, 64 nt, Human
gggcaggaggagauuuggcagugccugcagguugccuggccagguggagagggggaaagaggaa

SEQ ID NO: 108563 - RNA, 64 nt, Human
gagccauggggagcaagugugcucuccuggggcgccuggccagagccgggguuccaggacaggg

SEQ ID NO: 108564 - RNA, 64 nt, Human
aacuuuuuacauauggugaggugcguaaggaagcccuggccaacuuaaagauuuuucuggaggu

SEQ ID NO: 108565 - RNA, 64 nt, Human
caggauugggcuuuucuggcuucugccaugaaauccuggccaugggaccccagugacagaugau

SEQ ID NO: 108566 - RNA, 64 nt, Human
cggguggaucgcgagaucaggagcucgagaccacccuggccaacauggugaaaccccgucucua

SEQ ID NO: 108567 - RNA, 64 nt, Human
caggcggaucacaaggucaggaguucgagaccagccuggccaacaaggcaaaaccccgucucua

SEQ ID NO: 108568 - RNA, 64 nt, Human
ucacagggcagagcucuugucggcagggcagccuccuggccaguuucucugcucaguguucugg

SEQ ID NO: 108569 - RNA, 64 nt, Human
gggguacuccagagaccucacguguggagccaggccuggccagggcaggggccugaaacccacu

SEQ ID NO: 108570 - RNA, 64 nt, Human
ccuuuuaaggaaagaagccguguuucgaugaagaccuggccacauggggccacugggacuucaa

SEQ ID NO: 108571 - RNA, 64 nt, Human
cacccaccccaccugggcccagccaggagccccgccuggccaucaguauuuauugccuccgucc

SEQ ID NO: 108572 - RNA, 64 nt, Human
gggugugcugcugcugcuccccagcccaccagugccuggccagccugcccccuucccuggacag

SEQ ID NO: 108573 - RNA, 64 nt, Human
gugggggccgggccguccuccagccccgcugcucccuggccagcccccuugucgcugucggucc

SEQ ID NO: 108574 - RNA, 64 nt, Human
ccccuugcacugcugcgguuguacccugauacggccuggccaucgaggacaccugcccauccgg

SEQ ID NO: 108575 - RNA, 64 nt, Human
cacccgggguccuacaggcaggugcugggaaaggccuggccagcagguagccuguguguuugac

SEQ ID NO: 108576 - RNA, 64 nt, Human
caggugguucacuggagguugaguucgagaccagccuggccacauggugaaacccugucucuac

SEQ ID NO: 108577 - RNA, 64 nt, Human
ugggcggaucaugaggucaggagaucgagaccauccuggccaacauggugaaaccccaucugua

SEQ ID NO: 108578 - RNA, 64 nt, Human
caggcggaucacaaggucaggaguucgagaccagccuggccaacacuggucucugugaaacucc

SEQ ID NO: 108579 - RNA, 64 nt, Human
ugcaagcagagggugagcaggggcugccccuccaccuggccaggacccccuucggcacccaguu

SEQ ID NO: 108580 - RNA, 64 nt, Human
gguggaucacuugaggucaggaguucaagaccagccuggccaacauggugaaaccucgucuccg

SEQ ID NO: 108581 - RNA, 64 nt, Human
caaagugcugggauuacaggcgugagccaccgugccuggccagaauagguuuuuucuuucaacu

SEQ ID NO: 108582 - RNA, 64 nt, Human
aggccugugagcggagcccucgaccccgugacacccuggccagacacccugcuuggacuggggu

SEQ ID NO: 108583 - RNA, 64 nt, Human
gcucaggcccuggaagugaggcucuaugggguucccuggccaaggcgcuggccccccaaucuca

SEQ ID NO: 108584 - RNA, 64 nt, Human
ccacugcaaggccucccucccaccgcggccccugccuggccaccuggccucucugcaccagggu

SEQ ID NO: 108585 - RNA, 64 nt, Human
ggcuaaggcccugcccugcccucagccagaggugccuggccaugccugcacacuccuccccauu

SEQ ID NO: 108586 - RNA, 64 nt, Human
aguggugucgcgggggugcguggcgcuugcgagcccuggccaggggaggaagugaggcccaggc

SEQ ID NO: 108587 - RNA, 64 nt, Human
cggcggucagugggcuucagaugggccugugcauccuggccaagcgucacccucacacuggagg

SEQ ID NO: 108588 - RNA, 64 nt, Human
ggcggaucaccugaggugaggaguuugagaacagccuggccaacauggugaaaccucaucucua

SEQ ID NO: 108589 - RNA, 64 nt, Human
acuuguaaaugaauugaagcgucaggaccacccgccuggccacgugcgcgggccccuggaccua

SEQ ID NO: 108590 - RNA, 64 nt, Human
aguugaggacugucugccuucccucgucccuuuaccuggccagauaacuccagccgcugaauac

SEQ ID NO: 108591 - RNA, 64 nt, Human
gaggcccaggcucucugguggccgccccugugcaccuggccaggggaagcccgggggucugggg

SEQ ID NO: 108592 - RNA, 64 nt, Human
cccuccgacgaccucaacucugcccagcccggucccuggccaucagcgacgcuguccgcccccc

SEQ ID NO: 108593 - RNA, 64 nt, Human
uuucuugcagcugguaccauccaugucucacagcccuggccacugacagaucagcagaugucac

SEQ ID NO: 108594 - RNA, 64 nt, Human
ccugucccccugccugucuccagugggaagguagccuggccaggcggggccuccccuucgacga

SEQ ID NO: 108595 - RNA, 64 nt, Human
cgggcggaucacuaggucaggaaauggagaccauccuggccaacacagugaaacccagucucua

SEQ ID NO: 108596 - RNA, 64 nt, Human
gggggaucaccugaggucaggaguucgagaucagccuggccaacauggugaaauccccucucua

SEQ ID NO: 108597 - RNA, 64 nt, Human
ugggcagaucaugaggucaggaguuugagaccagccuggccaauauggugaaaccacgucucua

SEQ ID NO: 108598 - RNA, 64 nt, Human
ggcagaucgcuugaggucaggaguucgagaccagccuggccaacauggugaaaccccgucuaua

SEQ ID NO: 108599 - RNA, 64 nt, Human
ugcagugagcugagaucuucccacugcacuccagccuggccaauaagaccugucuccagcaaga

SEQ ID NO: 108600 - RNA, 64 nt, Human
ugccucucugacacaugucuccggggggcagccaccuggccaaugugcauuuuugcacaugcug

SEQ ID NO: 108601 - RNA, 64 nt, Human
uggcgcugagaucccucagacagcauggcccagcccuggccagaagcaucgcuccccuucaacc

SEQ ID NO: 108602 - RNA, 64 nt, Human
ggcggaucuuuugaggucgggaguuggaggccagccuggccaaaauggcaaaaccccgcaucua

SEQ ID NO: 108603 - RNA, 64 nt, Human
gaggggcugaggucacaccucgggcaccuggacuccuggccaaucaaggcuugcccagcuggga

SEQ ID NO: 108604 - RNA, 64 nt, Human
gccccgaaaccacuggcuggucccuucccugagcccuggccaagauucaggcugcaggggaaga

SEQ ID NO: 108605 - RNA, 64 nt, Human
cugggucccacuccugccccaccccacccuugucccuggccauugccugguggucuagaaacac

SEQ ID NO: 108606 - RNA, 64 nt, Human
uggguggaucacaaggucaagagaucgagaccauccuggccaacauggugaaacccugucucua

SEQ ID NO: 108607 - RNA, 64 nt, Human
caggacugcccacccaccacgcuggugcccaccgccuggccagccaagcccugccgaucagaca

SEQ ID NO: 108608 - RNA, 64 nt, Human
gguggaucaccugaggccaggaguucgagaccagccuggccaacauagcgaaacccgaucucua

SEQ ID NO: 108609 - RNA, 64 nt, Human
ccaacuagguuugcuaaccugaggggucacugggccuggccacuucugucccucugguggugga

SEQ ID NO: 108610 - RNA, 64 nt, Human
gguggaucaccuaaggucaggaguucgagaccagccuggccaauauggugaaaccccaucucua

SEQ ID NO: 108611 - RNA, 64 nt, Human
caccgugcccagccuccugcauccccucgaagagccuggccagagagggaagacacagaugaug

SEQ ID NO: 108612 - RNA, 64 nt, Human
aaagugcugggguuuacaggcuugagccacugcaccuggccaaaaaauuaacauucuaaaggau

SEQ ID NO: 108613 - RNA, 64 nt, Human
caggcagaucacgaggucaggaguucgagaccagccuggccaacauggcaagacccugucucua

SEQ ID NO: 108614 - RNA, 64 nt, Human
cgggcggaucacaaggucaggaguucgagaccagccuggccaacacggugaaaccccgacucua

SEQ ID NO: 108615 - RNA, 64 nt, Human
agcagaucaccugaggucaggaguucaagaccagccuggccaacauggugaaaccccuucucua

SEQ ID NO: 108616 - RNA, 64 nt, Human
ugggcugaucacaaggucaagaguucgugaccagccuggccaauauggugaaaccccaugucua

SEQ ID NO: 108617 - RNA, 64 nt, Human
cuucaaaccauccucaacuaagcuccucuccagcccuggccacauccccauccucccccaaccu

SEQ ID NO: 108618 - RNA, 64 nt, Human
gguggaucacuugaggucaggaguucaagacuagccuggccaacauggugaaaccccaucucga

SEQ ID NO: 108619 - RNA, 50 nt, Human
ugcugcuuguggagcacugaccuggccaaggccucauccuggugaguccu

SEQ ID NO: 108620 - RNA, 54 nt, Human
ugccccugcccccucucugagagcccuggccagcucuucgccccucaccucuuu

SEQ ID NO: 108621 - RNA, 64 nt, Human
gcuuccccccugcccauggaguagagcccgagauccuggccacuaugccaguucugaccucgca

SEQ ID NO: 108622 - RNA, 64 nt, Human
cgugcccacccuccuccggaaucucccuucccuuccuggccacgaauggcagcguccuccccga

SEQ ID NO: 108623 - RNA, 64 nt, Human
gaaagugcuaggauuacaggcgugagccaccacaccuggccagcucagcauauucuuaaguagg

SEQ ID NO: 108624 - RNA, 64 nt, Human
uccuccuuauuucuccucucccuugauucggccuccuggccagggcugggacauccucccugcu

SEQ ID NO: 108625 - RNA, 64 nt, Human
caaagugcugagauuauaggcaugagccaccacgccuggccagaugcauguucaaaccaaucaa

SEQ ID NO: 108626 - RNA, 64 nt, Human
ggcagauuaccugaggucaggaguuccagaccagccuggccaacauggugaaaccccgccucua

SEQ ID NO: 108627 - RNA, 64 nt, Human
gguggaucaccugaggccaggaguucgagaccagccuggccaacauggcaaaacccugucuacu

SEQ ID NO: 108628 - RNA, 64 nt, Human
caaagugcugggauuacgggcgugagccaccgcgccuggccaggauuucuauuuuuaauauuuu

SEQ ID NO: 108629 - RNA, 64 nt, Human
agaagaugggggacaucccccagccccaccaaccccuggccaccuugggacuccucuugaagga

SEQ ID NO: 108630 - RNA, 64 nt, Human
gagggccaucgugacguagacaggaugccaggggccuggccagccucccccaaugcuggggagc

SEQ ID NO: 108631 - RNA, 64 nt, Human
uguggguccccugucaggccacagugugaccagcccuggccaugcuugcugggugacccugggu

SEQ ID NO: 108632 - RNA, 64 nt, Human
ugucagugucuguuggcuggggcagcccucagagccuggccacguggaccuccccagcaugauc

SEQ ID NO: 108633 - RNA, 64 nt, Human
ccugcggccuccccccgucgcccaccccacgucuccuggccacugagacacaaaccuauuuauu

SEQ ID NO: 108634 - RNA, 64 nt, Human
ucucccagccccuuguccuuccuuccagcugagcccuggccacacuggggcugccuuucucuga

SEQ ID NO: 108635 - RNA, 64 nt, Human
ggcggaucaccugagguugggaguucaagaccagccuggccaacauggggaaaccccgucucua

SEQ ID NO: 108636 - RNA, 64 nt, Human
caggcggaucacaaggucaggagaucgagaccauccuggccaauauggugaaacccgucucuac

SEQ ID NO: 108637 - RNA, 64 nt, Human
guuccgccaccuucuccuggaaggugagccuuuuccuggccaagggcagcugccuuaaccucug

SEQ ID NO: 108638 - RNA, 64 nt, Human
gcgcgggaaagucacagagcugccugggcuuguaccuggccacauaaagccccaguuuaaagca

SEQ ID NO: 108639 - RNA, 64 nt, Human
gguggaucacuugaggucaggaguuugagaccacccuggccaacauggugaaaccuugucucua

SEQ ID NO: 108640 - RNA, 64 nt, Human
ucuacagagacgugaugugggaaaccuucaggaaccuggccacuauagguaaaaaugaaaucau

SEQ ID NO: 108641 - RNA, 64 nt, Human
ugggcggaucacgaggucaggagaucaagaccauccuggccaacauggugaaacccugucucua

SEQ ID NO: 108642 - RNA, 64 nt, Human
ggcagaucacuugaggucaggaguucgagaccagccuggccaacauggugaaaccccauaucca

SEQ ID NO: 108643 - RNA, 64 nt, Human
uccccgagucccugcugcugcgcuccuuugcaucccuggccagugaccuuguauuuaugaggcc

SEQ ID NO: 108644 - RNA, 64 nt, Human
ccuaggaaagaacaggccuugggucuccccuaguccuggccagaaggaugaucucgcuuuuccu

SEQ ID NO: 108645 - RNA, 64 nt, Human
cccucccgggaugggcccacauccaccuccagucccuggccaggggugagaggcagaccagcag

SEQ ID NO: 108646 - RNA, 64 nt, Human
ccuuucucuuucuuuugccuauuaaaccucugcuccuggccaggcacaguggcucacgccuaua

SEQ ID NO: 108647 - RNA, 64 nt, Human
cugagguggguggaucacuggaguuugagaccacccuggccaacauggugaaaccccaucucua

SEQ ID NO: 108648 - RNA, 64 nt, Human
ugggcggaucacgaggucaggaguucgagaccagccuggccaacauagugaaaccccaucucua

SEQ ID NO: 108649 - RNA, 64 nt, Human
gguggaucaccugagguuaggaguucgagaccagccuggccaacauggugaaaccccaucucua

SEQ ID NO: 108650 - RNA, 64 nt, Human
gcuggcaccgcugggucaucgcgccgcgcggcuuccuggccaacuacugccagggucagugcgc

SEQ ID NO: 108651 - RNA, 64 nt, Human
uccuggcagaacaguacuuuggaguucccuggagccuggccagcccucaccucuucuggauaga

SEQ ID NO: 108652 - RNA, 64 nt, Human
gaccacuggucuagagcccugugguccccuggagccuggccacgcccuugaagcccuggacacu

SEQ ID NO: 108653 - RNA, 64 nt, Human
ggcggaucacuggaggucaggaguuuaagaccagccuggccaacauggugaaauccugucucua

SEQ ID NO: 108654 - RNA, 64 nt, Human
gguggaucaccugaggucaggaguucgagaccagccuggccaacaugguaaaacuccauuucua

SEQ ID NO: 108655 - RNA, 64 nt, Human
cagggggaucacgaggucaagagauaaagaccauccuggccaacauggugaaaccucaucucua

SEQ ID NO: 108656 - RNA, 64 nt, Human
cuagcuggcuguuggcugaacgcugacugcagcuccuggccacaauagccucaucaacauggcu

SEQ ID NO: 108657 - RNA, 64 nt, Human
aaccauauguuuagggcuggaaagggccaugacgccuggccauuuuuccuguuuuaccuuacuc

SEQ ID NO: 108658 - RNA, 64 nt, Human
ggcggaucaccugaggucaggaguucaagaccagccuggccaacauggugaaaccccgucucua

SEQ ID NO: 108659 - RNA, 64 nt, Human
ggcggaucacuugaggucaggaguuccagaccagccuggccaacauggugaaacuccgucucua

SEQ ID NO: 108660 - RNA, 64 nt, Human
ggggugcacugacggagaugcggacuccugggucccuggccaagaagccaggagagggacggcu

SEQ ID NO: 108661 - RNA, 64 nt, Human
acucggggggcaggccccucccaccuccugacacccuggccagcgcgggggacuuucucugcac

SEQ ID NO: 108662 - RNA, 64 nt, Human
ggggaggaucacggggucaggagaucgagaccauccuggccaacaugaugaaacccuaucucua

SEQ ID NO: 108663 - RNA, 64 nt, Human
ggcagaugacuugaggucaggaguucgagaccagccuggccaacauggugaaaccccgucucua

SEQ ID NO: 108664 - RNA, 64 nt, Human
ccuggugucccgugaggagugugagcaugccuacccuggccagaucacccagaacauguugugu

SEQ ID NO: 108665 - RNA, 64 nt, Human
guucucuguuguauccccagccccaaagacagcuccuggccauauaucaagguuucaauaaaua

SEQ ID NO: 108666 - RNA, 64 nt, Human
ggcagaucgccugaggucgggaguucgagaccagccuggccaacuuggugaaaccccgucucua

SEQ ID NO: 108667 - RNA, 64 nt, Human
uuguaucuauucugaaauuauauaaauuaaccuaccuggccaggcacaguggcucacaccugua

SEQ ID NO: 108668 - RNA, 64 nt, Human
gguaggucacuggagguuaagaguuugagaacagccuggccaacagacgggagccacuuuuccc

SEQ ID NO: 108669 - RNA, 64 nt, Human
gguaggucacuugaggucaugaauuugagaccagccuggccaacagacgggagccacuuuuccc

SEQ ID NO: 108670 - RNA, 64 nt, Human
ggcaagcagaucaccugaagucaggagagaccagccuggccagcauagugaaaccccaucucua

SEQ ID NO: 108671 - RNA, 64 nt, Human
cagguggaucacgaggucaggaguuugagauuagccuggccaagauggugaaacccugucucua

SEQ ID NO: 108672 - RNA, 64 nt, Human
cggccagaucacaagguuaggaguucaagaccagccuggccagcauggugaaaccccaucucua

SEQ ID NO: 108673 - RNA, 64 nt, Human
caaaguguugggauuacaggugugagccacagcaccuggccaaccaacacuucucagggccucu

SEQ ID NO: 108674 - RNA, 64 nt, Human
ugaguagcugggacuacaggcaugagccaccaugccuggccaacucacauuuuucuuucuauua

SEQ ID NO: 108675 - RNA, 64 nt, Human
aguucugugcacacccugagcucugcuccucuggccuggccaccaguccuugucugagugcccc

SEQ ID NO: 108676 - RNA, 64 nt, Human
caaagcguugggauuauaggcgugagccaccgcaccuggccagggaaccuucuuuauaccaagu

SEQ ID NO: 108677 - RNA, 64 nt, Human
ugucccuuucauccugggccugugugaaucccagccuggccauacccucaaccucagugggcug

SEQ ID NO: 108678 - RNA, 53 nt, Human
agggaaccuggaggcucugaucaccuggccaacccacugggguagggaucaaa

SEQ ID NO: 108679 - RNA, 64 nt, Human
ccaccucugccugaccccagccuuaaacauagccccuggccagaggccuugcuggguggagccu

SEQ ID NO: 108680 - RNA, 64 nt, Human
caaugcucuuguguugucccucugucuggacgcgccuggccacuccgaaggcuuuucaccccau

SEQ ID NO: 108681 - RNA, 64 nt, Human
ggacagaucguagugccuuauuccauuguccuccccuggccaggccuccuggcucagcuggaag

SEQ ID NO: 108682 - RNA, 64 nt, Human
gcaaggagaagcgagaggcugucaguaaagaggaccuggccagagcgacuuugaucaccaucac

SEQ ID NO: 108683 - RNA, 64 nt, Human
uuuuguccuguuccuagacugcuagaaucuggccccuggccaucuuaaagugccaacauaugcc

SEQ ID NO: 108684 - RNA, 64 nt, Human
ggcugauugcuugaggucaggaguuugagaccagccuggccaaaaucuauacuaaaaaaaauac

SEQ ID NO: 108685 - RNA, 64 nt, Human
cauguagccccagucauccugcccagcccugccuccuggccaugccgggaggggucggauccuc

SEQ ID NO: 108686 - RNA, 64 nt, Human
caggcggaucacaaggucaggagauugagaccauccuggccaacauggugaaaccccgucucua

SEQ ID NO: 108687 - RNA, 64 nt, Human
cccccaauguggcccucaagagccauccccacugccuggccagagccauuguuguccccuacuu

SEQ ID NO: 108688 - RNA, 64 nt, Human
ggcagaucacuugaggugaggaguucaagaccagccuggccaacauggugaauuaucucuacua

SEQ ID NO: 108689 - RNA, 64 nt, Human
gguggaccaccugagguuaggacuucaagaccagccuggccaacauggugaaaccccaucugua

SEQ ID NO: 108690 - RNA, 64 nt, Human
gguggaucaccugaggucaggaguucgagaccagccuggccaacagggugaaaccccgucucua

SEQ ID NO: 108691 - RNA, 64 nt, Human
caaagugcugggauuacaggcgugagccaccuugccuggccaaaaaucucagaauucuuuaaga

SEQ ID NO: 108692 - RNA, 64 nt, Human
cugucgggaccagugccagguggacagccaguguccuggccagaugaaaugcugccgcaauggc

SEQ ID NO: 108693 - RNA, 60 nt, Human
aagcaccuccacagaccugaggccggguccccuggccacacuuggcagcccuccuccaaa

SEQ ID NO: 108694 - RNA, 64 nt, Human
uaggcugugcgccccggaacguguccaggaggagccuggccauggguccuugcccccgacagac

SEQ ID NO: 108695 - RNA, 64 nt, Human
ccaggaggagcuguggucagaggaggagccggcgccuggccacgccaaccuuagaaucaugaac

SEQ ID NO: 108696 - RNA, 64 nt, Human
gguggaucacuugaggucaagaguucgagaccagccuggccaacauggcaaaaccccaucucua

SEQ ID NO: 108697 - RNA, 64 nt, Human
uuuucaguucuccuaggaugcaccccucagggagccuggccagaguuccgaggcccgugagcgu

SEQ ID NO: 108698 - RNA, 64 nt, Human
agaggggcucuccugaguggaagccacucacaugccuggccacaugcugcccccucccccgugg

SEQ ID NO: 108699 - RNA, 64 nt, Human
ugaggcauuaagcccagggguucacuuucaggccccuggccaaucugaguuuccugauucugcc

SEQ ID NO: 108700 - RNA, 64 nt, Human
agccugggcagccaggcugccaaggccagaguggccuggccaggagcucuucaggccucccucu

SEQ ID NO: 108701 - RNA, 64 nt, Human
ggugggguagggcugacuagaagggccaguccugccuggccaggcagaucugugccccaugccu

SEQ ID NO: 108702 - RNA, 64 nt, Human
cauucucagggcaguaugggaagccccaaggugaccuggccaaguagcaauaauuuggguccag

SEQ ID NO: 108703 - RNA, 64 nt, Human
uuaauauugaaggaagggguugguucccauaguaccuggccagaggguuauauaccauccuguc

SEQ ID NO: 108704 - RNA, 64 nt, Human
ucggcauggccgcgucacuucucugauuaugugcccuggccagggaccagcgcccuugcacaug

SEQ ID NO: 108705 - RNA, 64 nt, Human
gaaagugcugggaucacaggugggagccacugugccuggccaguuauuuccuuuuuaagccuau

SEQ ID NO: 108706 - RNA, 64 nt, Human
ccccagagaaguggcugugacccguccaagggcaccuggccagugaauggcagagccucuggca

SEQ ID NO: 108707 - RNA, 64 nt, Human
agcgcucagucucaucccagcaagucaaagaccuccuggccaaguccugcccucuuaagucucc

SEQ ID NO: 108708 - RNA, 64 nt, Human
gcccagcguccucccugccuccuuccgggacaagccuggccacccucgcugugaugacgagcug

SEQ ID NO: 108709 - RNA, 64 nt, Human
ggcggaucacuugaggucgggaguucaagaccagccuggccaacauggcgaaaccccgucucua

SEQ ID NO: 108710 - RNA, 64 nt, Human
gguggaucaccugaggucaggaguucaagacuagccuggccaacaucaugaaaccccgucucua

SEQ ID NO: 108711 - RNA, 64 nt, Human
ggcagaucaccugaggucaggaguucgagaccauccuggccaacauggugaaaccccgucucca

SEQ ID NO: 108712 - RNA, 64 nt, Human
gugcaggucagggcagguccucugagccggcgccccuggccagcaggcgaggcuacaguaccug

SEQ ID NO: 108713 - RNA, 64 nt, Human
ggcggaucacuugaggucaggaguucaagaccagccuggccaauauggugaaacccagucucua

SEQ ID NO: 108714 - RNA, 64 nt, Human
caggcagaucaugaggucaagagaucgagaccagccuggccaacguggugaaaccccaucucua

SEQ ID NO: 108715 - RNA, 64 nt, Human
ucagauugaugccugggcucagcugaacucuauuccuggccaguucacaggaaguacaggagua

SEQ ID NO: 108716 - RNA, 64 nt, Human
ugcgucccugcucagcccauccccugccucuaucccuggccaccugccaggccucccucgggcu

SEQ ID NO: 108717 - RNA, 64 nt, Human
uuccccccagaaaccagggcuucucucuccugagccuggccaggacucaggcuguuccugggcc

SEQ ID NO: 108718 - RNA, 64 nt, Human
cucccuugcagcuagcaagguugugugacuaagcccuggccaguaggcauggaagugaagacug

SEQ ID NO: 108719 - RNA, 64 nt, Human
uaaccaugagcacuacucuaccaugguucugccuccuggccaagcaggcugguuugcaagaaug

SEQ ID NO: 108720 - RNA, 64 nt, Human
ggccacagcgugcuggcgacacucagggcagcugccuggccaugcugucccugcacugugcccc

SEQ ID NO: 108721 - RNA, 64 nt, Human
gguggaucacucugaggucaggaguuugagccagccuggccaacauggugaaaccccaucucca

SEQ ID NO: 108722 - RNA, 64 nt, Human
aaggagauuuugcuucugauugacuggcuaguggccuggccauugguauuuugaaaaaucccuc

SEQ ID NO: 108723 - RNA, 64 nt, Human
agcacagcuauugaugagauuuuaagcugcuguuccuggccaguugcagguuaagccccagaaa

SEQ ID NO: 108724 - RNA, 64 nt, Human
gguggaucacuugaggccaggaauucgagaccagccuggccaacauggcgaaaacccaucucua

SEQ ID NO: 108725 - RNA, 64 nt, Human
agcagcagcuguuccggcgccuggaagaggaguuccuggccaaugcccgggcccuugaggcugu

SEQ ID NO: 108726 - RNA, 64 nt, Human
gcuccuccagcuguaucugcaccugccucucuguccuggccagggguggacaacuggggucccc

SEQ ID NO: 108727 - RNA, 64 nt, Human
cccaggcugcccgacugcagaccacgugcucuucccuggccacccaccuccuaccauccccacg

SEQ ID NO: 108728 - RNA, 64 nt, Human
gguggaucacuugaggucaggaguucgagaccagccuggccaacauggugaaaccccgucucca

SEQ ID NO: 108729 - RNA, 64 nt, Human
gguggaucucuugagaccaggaggucaagaccagccuggccaacguggugaaacacugucucua

SEQ ID NO: 108730 - RNA, 64 nt, Human
uguccagggacccuugggaucuggggcuuccuggccuggccagagcuggagcccccacagggua

SEQ ID NO: 108731 - RNA, 64 nt, Human
ccugcagugcucauuuggaauuccucccaagaccccuggccacccagaccccccauucuuccua

SEQ ID NO: 108732 - RNA, 64 nt, Human
cggguggaucacaaggucagcagaucgagaccauccuggccaacauggugaaacccugucucua

SEQ ID NO: 108733 - RNA, 64 nt, Human
gcaguggcugacagcagggaggccaugugcucagccuggccacguugccguuacagucugcucc

SEQ ID NO: 108734 - RNA, 64 nt, Human
ggccgccgagagccccucugccugugucguguggccuggccagccucccgguggacaccagccc

SEQ ID NO: 108735 - RNA, 64 nt, Human
ggcacaucaccugaguucaggaguucaagaccagccuggccaacauggugaaaucccgucucua

SEQ ID NO: 108736 - RNA, 64 nt, Human
cuccugccccagccgacugcuguucccagacuucccuggccacgcuccaagacgccagcucugc

SEQ ID NO: 108737 - RNA, 64 nt, Human
cccuuggagaagggcugcuacuuaacaaggaaguccuggccacaggaguccccuacuggcugca

SEQ ID NO: 108738 - RNA, 64 nt, Human
gguggaucaccugaggucaggaguucuagaucagccuggccaacauggugaaaccccaucucua

SEQ ID NO: 108739 - RNA, 64 nt, Human
ucucuuggcccacagcacuggcuuccccaucucaccuggccacauccuucuaugccugccccgu

SEQ ID NO: 108740 - RNA, 64 nt, Human
ccagcauggagcccaagagcagcucgaagaccauccuggccauagcagccaagcccccauuccc

SEQ ID NO: 108741 - RNA, 64 nt, Human
cccaaaugggggcugcuggcagaccccgagggugccuggccaguccacuccacucugggcuggg

SEQ ID NO: 108742 - RNA, 64 nt, Human
uccacauccugcccacccucugagggccaagcugccuggccacugggcugggcuggagucuggc

SEQ ID NO: 108743 - RNA, 64 nt, Human
caaagugcugggauuacaggcgugagccaccgcgccuggccaaaaugcagacauuuuauuaggg

SEQ ID NO: 108744 - RNA, 64 nt, Human
caaaaugcugggauuacaggugugagccaccgugccuggccaauuccaacauucuuaaauucuc

SEQ ID NO: 108745 - RNA, 64 nt, Human
gguggaucacuugaggucaggaguucaagaccagccuggccaacauggagaaaccccaucucua

SEQ ID NO: 108746 - RNA, 64 nt, Human
ggcagaucacuugaggucaggaguucgaagucagccuggccaacguggugaaaccccaucuuca

SEQ ID NO: 108747 - RNA, 64 nt, Human
cccucaacggugggaggaacuggcagagggugcgccuggccacagccuccccgcaucuaaaggc

SEQ ID NO: 108748 - RNA, 64 nt, Human
guccacaugggccuugcgaaccuggguuagaaacccuggccaggcgaacguggggugauucaca

SEQ ID NO: 108749 - RNA, 64 nt, Human
gaccucucagcauagccugccugaucccugaaccccuggccagcucugaggggaggcaccucca

SEQ ID NO: 108750 - RNA, 64 nt, Human
cugucuggcuacaauuuggcuaagguaggugaagccuggccaggcgggaggcuucucuucugac

SEQ ID NO: 108751 - RNA, 64 nt, Human
accauucccucuaggcccagaccaucaucauggcccuggccauugauguguaugggcuuucuuu

SEQ ID NO: 108752 - RNA, 64 nt, Human
gcccucuugggggcacugcucccuaccccagggcccuggccagccgggagcuuggcucuccucu

SEQ ID NO: 108753 - RNA, 64 nt, Human
caagguacaaaugggaacaccuccccucgggaagccuggccaagcuggaagauccggcagguuu

SEQ ID NO: 108754 - RNA, 64 nt, Human
gguggaucaccugaggucaggaguucgagaccagccuggccaacguggugaaacccugucucua

SEQ ID NO: 108755 - RNA, 64 nt, Human
ccacugguuuugagaaccagauuugagagagggaccuggccaggguggagcauugucugggugu

SEQ ID NO: 108756 - RNA, 64 nt, Human
agaaggcugcuaagaagcaccagaauauguaccgccuggccaugaccggggcagggaucgacag

SEQ ID NO: 108757 - RNA, 50 nt, Human
uuggccugcagauggacugaccuggccagaggggggaaaguuugcuuaac

SEQ ID NO: 108758 - RNA, 64 nt, Human
caaagagcugggauuacaggugugagcuaccgcgccuggccaugaugauauuauuaaacaccau

SEQ ID NO: 108759 - RNA, 64 nt, Human
cuuuaugcugagccccugccacaugcaucaucauccuggccauguggcauugucacagaccguc

SEQ ID NO: 108760 - RNA, 64 nt, Human
gaggagguaguaccuuugaagaugcuguugaccaccuggccacagccagucaggggccuggugg

SEQ ID NO: 108761 - RNA, 64 nt, Human
uuggccgggggaacccauucaugcuguuccucugccuggccauccugcuggagcaccgcgacca

SEQ ID NO: 108762 - RNA, 64 nt, Human
cugguggaucacgaggucaagaguucaagagcagccuggccaagauggugaaaccccgucucua

SEQ ID NO: 108763 - RNA, 64 nt, Human
cagugccccuagcuuagagccucccucaauucccccuggccaccaccccccacucugugccuga

SEQ ID NO: 108764 - RNA, 64 nt, Human
gcuggcccucacaccauccaccuccacacugccuccuggccagcugcccaccccagugccaggu

SEQ ID NO: 108765 - RNA, 64 nt, Human
cuccaggcuggaaguacuuggcccccuucaggagccuggccaggcagggagagaguagcugcag

SEQ ID NO: 108766 - RNA, 64 nt, Human
cgggcggaucacgaggucaggaguucgagaccagccuggccaacauggugaaaccccaccucua

SEQ ID NO: 108767 - RNA, 64 nt, Human
ggugaccugcuuccccaaaggccaacagcauuggccuggccagaccaggugaccuuagauuugg

SEQ ID NO: 108768 - RNA, 64 nt, Human
auguggaaggcagcuagacuuauuguauuuacagccuggccacucuagacauaugaauccaggc

SEQ ID NO: 108769 - RNA, 64 nt, Human
gauuuggcuuuaccuucaucuaucuugauccuuuccuggccaaauauccucuugggcccaaaug

SEQ ID NO: 108770 - RNA, 64 nt, Human
gguggaucaccugaggucaggaguucgagaccagccuggccaacauggcgaaaccccuucucua

SEQ ID NO: 108771 - RNA, 64 nt, Human
ucuuugguuccuacuccaauuccacauccuucauccuggccaugcccccaccuucaagagcaug

SEQ ID NO: 108772 - RNA, 64 nt, Human
ugagcccuggauuggguaucguggggcaggucacccuggccacgaugcccccggcacacccagg

SEQ ID NO: 108773 - RNA, 64 nt, Human
gguggaucaccugaggucaggaguucgagaccagccuggccaacauggcaaaacccccaucucu

SEQ ID NO: 108774 - RNA, 64 nt, Human
uggagcaaucacuguauaauuuuaaaauaguuuaccuggccaggcaugguggcucacgccugua

SEQ ID NO: 108775 - RNA, 64 nt, Human
uguuguuuuauuguuuccugaauucaugcagaugccuggccauuccugggaagaguggauaacu

SEQ ID NO: 108776 - RNA, 64 nt, Human
gguggaucaccugaggucaggaguuugagaccagccuggccaacauggugaaaccccgucucua

SEQ ID NO: 108777 - RNA, 64 nt, Human
gaguagaagaguuaguuuguuuuguuuuauuauuccuggccauacucagggguccaggaagaau

SEQ ID NO: 108778 - RNA, 64 nt, Human
ggcagaucacuugaggucaggaguucaagaccagccuggccaacauggugaaaccccaucucua

SEQ ID NO: 108779 - RNA, 64 nt, Human
gcagaucacuugagguuaggaguuugagaacuggccuggccaacauagcaaaaccucaucucua

SEQ ID NO: 108780 - RNA, 64 nt, Human
ggggacucuccucccuucucuccccaguucugguccuggccaggccaugcuacacuaaccccug

SEQ ID NO: 108781 - RNA, 64 nt, Human
uucagcuggcuuggcccucucucugaccucagggccuggccacacacuuccaugugucuuuuug

SEQ ID NO: 108782 - RNA, 64 nt, Human
caaaaagaaucuuggggauuuuccaucugacuucccuggccaucuuaucccauccuugcacuac

SEQ ID NO: 108783 - RNA, 64 nt, Human
caggcagaucacgaggucaggaguucgagaccauccuggccaacauggugaaaccccgucucua

SEQ ID NO: 108784 - RNA, 64 nt, Human
uaagagaaaaauaggcucaguuagaaaaggacucccuggccaggcgcagugacuuacgccugua

SEQ ID NO: 108785 - RNA, 64 nt, Human
gguggauugcuugaggccaggaguuagagaccagccuggccaacaaggcaaaaccccgucucua

SEQ ID NO: 108786 - RNA, 64 nt, Human
gguggaucacuugaggccaggaguuugagaccagccuggccaacauggugaaaccccaucucua

SEQ ID NO: 108787 - RNA, 64 nt, Human
cugaagaggagggagaguggggucagaagauucuccuggccaccaagugccagcauugcccaca

SEQ ID NO: 108788 - RNA, 64 nt, Human
cacucacucggaagugcuuggaagugucaucuacccuggccauccccgggaucccuccccugcu

SEQ ID NO: 108789 - RNA, 64 nt, Human
acguucagaaugcguuugcugucauccugcuuggccuggccaggccuggcacagccuuggcuuc

SEQ ID NO: 108790 - RNA, 64 nt, Human
gaaaaggcguuaccucuucucccagcgcuggccgccuggccacugagggcccuuugcaaaaauc

SEQ ID NO: 108791 - RNA, 64 nt, Human
ggcagaucaccugaggucaggaguuugagaccagccuggccaacaugaugaaacccuugucucu

SEQ ID NO: 108792 - RNA, 64 nt, Human
agugccuguggggagcagccucuacccucagcauccuggccacaaguucuuccuuccauugucc

SEQ ID NO: 108793 - RNA, 64 nt, Human
guggcucacgcugaggucaggaguucgagaccagccuggccaaccaacauggugaaaccucgug

SEQ ID NO: 108794 - RNA, 64 nt, Human
ggcagaucagcugaggucaggagaucgagaccagccuggccaacauggcgaaaccccgucucua

SEQ ID NO: 108795 - RNA, 64 nt, Human; identical to SEQ ID NO: 60185

SEQ ID NO: 108796 - RNA, 64 nt, Human; identical to SEQ ID NO: 60186

SEQ ID NO: 108797 - RNA, 64 nt, Human; identical to SEQ ID NO: 60187

SEQ ID NO: 108798 - RNA, 64 nt, Human; identical to SEQ ID NO: 60188

SEQ ID NO: 108799 - RNA, 64 nt, Human; identical to SEQ ID NO: 60189

SEQ ID NO: 108800 - RNA, 64 nt, Human; identical to SEQ ID NO: 60190

SEQ ID NO: 108801 - RNA, 64 nt, Human; identical to SEQ ID NO: 60191

SEQ ID NO: 108802 - RNA, 64 nt, Human; identical to SEQ ID NO: 60192

SEQ ID NO: 108803 - RNA, 64 nt, Human; identical to SEQ ID NO: 60193

SEQ ID NO: 108804 - RNA, 64 nt, Human; identical to SEQ ID NO: 60194

SEQ ID NO: 108805 - RNA, 64 nt, Human; identical to SEQ ID NO: 60195

SEQ ID NO: 108806 - RNA, 64 nt, Human; identical to SEQ ID NO: 60196

SEQ ID NO: 108807 - RNA, 64 nt, Human; identical to SEQ ID NO: 60197

SEQ ID NO: 108808 - RNA, 64 nt, Human; identical to SEQ ID NO: 60198

SEQ ID NO: 108809 - RNA, 64 nt, Human; identical to SEQ ID NO: 60199

SEQ ID NO: 108810 - RNA, 64 nt, Human; identical to SEQ ID NO: 60200

SEQ ID NO: 108811 - RNA, 64 nt, Human; identical to SEQ ID NO: 60201

SEQ ID NO: 108812 - RNA, 64 nt, Human; identical to SEQ ID NO: 60202

SEQ ID NO: 108813 - RNA, 64 nt, Human; identical to SEQ ID NO: 60203

SEQ ID NO: 108814 - RNA, 64 nt, Human; identical to SEQ ID NO: 60204

SEQ ID NO: 108815 - RNA, 64 nt, Human; identical to SEQ ID NO: 60205

SEQ ID NO: 108816 - RNA, 64 nt, Human; identical to SEQ ID NO: 60206

SEQ ID NO: 108817 - RNA, 64 nt, Human; identical to SEQ ID NO: 60207

SEQ ID NO: 108818 - RNA, 64 nt, Human; identical to SEQ ID NO: 60208

SEQ ID NO: 108819 - RNA, 64 nt, Human; identical to SEQ ID NO: 60209

SEQ ID NO: 108820 - RNA, 64 nt, Human; identical to SEQ ID NO: 60210

SEQ ID NO: 108821 - RNA, 64 nt, Human; identical to SEQ ID NO: 60211

SEQ ID NO: 108822 - RNA, 64 nt, Human; identical to SEQ ID NO: 60212

SEQ ID NO: 108823 - RNA, 64 nt, Human; identical to SEQ ID NO: 60213

SEQ ID NO: 108824 - RNA, 64 nt, Human; identical to SEQ ID NO: 60214

SEQ ID NO: 108825 - RNA, 64 nt, Human; identical to SEQ ID NO: 60215

SEQ ID NO: 108826 - RNA, 64 nt, Human; identical to SEQ ID NO: 60216

SEQ ID NO: 108827 - RNA, 64 nt, Human; identical to SEQ ID NO: 60217

SEQ ID NO: 108828 - RNA, 64 nt, Human; identical to SEQ ID NO: 60218

SEQ ID NO: 108829 - RNA, 64 nt, Human; identical to SEQ ID NO: 60219

SEQ ID NO: 108830 - RNA, 64 nt, Human; identical to SEQ ID NO: 60220

SEQ ID NO: 108831 - RNA, 64 nt, Human; identical to SEQ ID NO: 60221

SEQ ID NO: 108832 - RNA, 64 nt, Human; identical to SEQ ID NO: 60222

SEQ ID NO: 108833 - RNA, 64 nt, Human; identical to SEQ ID NO: 60223

SEQ ID NO: 108834 - RNA, 64 nt, Human; identical to SEQ ID NO: 60224

SEQ ID NO: 108835 - RNA, 64 nt, Human; identical to SEQ ID NO: 60225

SEQ ID NO: 108836 - RNA, 64 nt, Human; identical to SEQ ID NO: 60226

SEQ ID NO: 108837 - RNA, 64 nt, Human; identical to SEQ ID NO: 60227

SEQ ID NO: 108838 - RNA, 64 nt, Human; identical to SEQ ID NO: 60228

SEQ ID NO: 108839 - RNA, 64 nt, Human; identical to SEQ ID NO: 60229

SEQ ID NO: 108840 - RNA, 64 nt, Human; identical to SEQ ID NO: 60230

SEQ ID NO: 108841 - RNA, 64 nt, Human; identical to SEQ ID NO: 60231

SEQ ID NO: 108842 - RNA, 64 nt, Human; identical to SEQ ID NO: 60232

SEQ ID NO: 108843 - RNA, 64 nt, Human; identical to SEQ ID NO: 60233

SEQ ID NO: 108844 - RNA, 64 nt, Human; identical to SEQ ID NO: 60234

SEQ ID NO: 108845 - RNA, 64 nt, Human; identical to SEQ ID NO: 60235

SEQ ID NO: 108846 - RNA, 64 nt, Human; identical to SEQ ID NO: 60236

SEQ ID NO: 108847 - RNA, 64 nt, Human; identical to SEQ ID NO: 60237

SEQ ID NO: 108848 - RNA, 64 nt, Human; identical to SEQ ID NO: 60238

SEQ ID NO: 108849 - RNA, 64 nt, Human; identical to SEQ ID NO: 60239

SEQ ID NO: 108850 - RNA, 64 nt, Human; identical to SEQ ID NO: 60240

SEQ ID NO: 108851 - RNA, 64 nt, Human; identical to SEQ ID NO: 60241

SEQ ID NO: 108852 - RNA, 64 nt, Human; identical to SEQ ID NO: 60242

SEQ ID NO: 108853 - RNA, 64 nt, Human; identical to SEQ ID NO: 60243

SEQ ID NO: 108854 - RNA, 64 nt, Human; identical to SEQ ID NO: 60244

SEQ ID NO: 108855 - RNA, 64 nt, Human; identical to SEQ ID NO: 60245

SEQ ID NO: 108856 - RNA, 64 nt, Human; identical to SEQ ID NO: 60246

SEQ ID NO: 108857 - RNA, 64 nt, Human; identical to SEQ ID NO: 60247

SEQ ID NO: 108858 - RNA, 64 nt, Human; identical to SEQ ID NO: 60248

SEQ ID NO: 108859 - RNA, 64 nt, Human; identical to SEQ ID NO: 60249

SEQ ID NO: 108860 - RNA, 64 nt, Human; identical to SEQ ID NO: 60250

SEQ ID NO: 108861 - RNA, 59 nt, Human; identical to SEQ ID NO: 60251

SEQ ID NO: 108862 - RNA, 64 nt, Human; identical to SEQ ID NO: 60252

SEQ ID NO: 108863 - RNA, 64 nt, Human; identical to SEQ ID NO: 60253

SEQ ID NO: 108864 - RNA, 64 nt, Human; identical to SEQ ID NO: 60254

SEQ ID NO: 108865 - RNA, 64 nt, Human; identical to SEQ ID NO: 60255

SEQ ID NO: 108866 - RNA, 64 nt, Human; identical to SEQ ID NO: 60256

SEQ ID NO: 108867 - RNA, 64 nt, Human; identical to SEQ ID NO: 60257

SEQ ID NO: 108868 - RNA, 61 nt, Human; identical to SEQ ID NO: 60258

SEQ ID NO: 108869 - RNA, 64 nt, Human; identical to SEQ ID NO: 60259

SEQ ID NO: 108870 - RNA, 64 nt, Human; identical to SEQ ID NO: 60260

SEQ ID NO: 108871 - RNA, 64 nt, Human; identical to SEQ ID NO: 60261

SEQ ID NO: 108872 - RNA, 64 nt, Human; identical to SEQ ID NO: 60262

SEQ ID NO: 108873 - RNA, 64 nt, Human; identical to SEQ ID NO: 60263

SEQ ID NO: 108874 - RNA, 64 nt, Human; identical to SEQ ID NO: 60264

SEQ ID NO: 108875 - RNA, 64 nt, Human; identical to SEQ ID NO: 60265

SEQ ID NO: 108876 - RNA, 64 nt, Human; identical to SEQ ID NO: 60266

SEQ ID NO: 108877 - RNA, 64 nt, Human; identical to SEQ ID NO: 60267

SEQ ID NO: 108878 - RNA, 64 nt, Human; identical to SEQ ID NO: 60268

SEQ ID NO: 108879 - RNA, 64 nt, Human; identical to SEQ ID NO: 60269

SEQ ID NO: 108880 - RNA, 64 nt, Human; identical to SEQ ID NO: 60270

SEQ ID NO: 108881 - RNA, 64 nt, Human; identical to SEQ ID NO: 60271

SEQ ID NO: 108882 - RNA, 64 nt, Human; identical to SEQ ID NO: 60272

SEQ ID NO: 108883 - RNA, 64 nt, Human; identical to SEQ ID NO: 60273

SEQ ID NO: 108884 - RNA, 64 nt, Human; identical to SEQ ID NO: 60274

SEQ ID NO: 108885 - RNA, 64 nt, Human; identical to SEQ ID NO: 60275

SEQ ID NO: 108886 - RNA, 64 nt, Human; identical to SEQ ID NO: 60276

SEQ ID NO: 108887 - RNA, 64 nt, Human; identical to SEQ ID NO: 60277

SEQ ID NO: 108888 - RNA, 64 nt, Human; identical to SEQ ID NO: 60278

SEQ ID NO: 108889 - RNA, 64 nt, Human; identical to SEQ ID NO: 60279

SEQ ID NO: 108890 - RNA, 64 nt, Human; identical to SEQ ID NO: 60280

SEQ ID NO: 108891 - RNA, 64 nt, Human; identical to SEQ ID NO: 60281

SEQ ID NO: 108892 - RNA, 64 nt, Human; identical to SEQ ID NO: 60282

SEQ ID NO: 108893 - RNA, 64 nt, Human; identical to SEQ ID NO: 60283

SEQ ID NO: 108894 - RNA, 64 nt, Human; identical to SEQ ID NO: 60284

SEQ ID NO: 108895 - RNA, 64 nt, Human; identical to SEQ ID NO: 60285

SEQ ID NO: 108896 - RNA, 64 nt, Human; identical to SEQ ID NO: 60286

SEQ ID NO: 108897 - RNA, 64 nt, Human; identical to SEQ ID NO: 60287

SEQ ID NO: 108898 - RNA, 64 nt, Human; identical to SEQ ID NO: 60288

SEQ ID NO: 108899 - RNA, 64 nt, Human; identical to SEQ ID NO: 60289

SEQ ID NO: 108900 - RNA, 64 nt, Human; identical to SEQ ID NO: 60290

SEQ ID NO: 108901 - RNA, 59 nt, Human; identical to SEQ ID NO: 60291

SEQ ID NO: 108902 - RNA, 64 nt, Human; identical to SEQ ID NO: 60292

SEQ ID NO: 108903 - RNA, 64 nt, Human; identical to SEQ ID NO: 60293

SEQ ID NO: 108904 - RNA, 64 nt, Human; identical to SEQ ID NO: 60294

SEQ ID NO: 108905 - RNA, 64 nt, Human; identical to SEQ ID NO: 60295

SEQ ID NO: 108906 - RNA, 64 nt, Human; identical to SEQ ID NO: 60296

SEQ ID NO: 108907 - RNA, 64 nt, Human; identical to SEQ ID NO: 60297

SEQ ID NO: 108908 - RNA, 64 nt, Human; identical to SEQ ID NO: 60298

SEQ ID NO: 108909 - RNA, 64 nt, Human; identical to SEQ ID NO: 60299

SEQ ID NO: 108910 - RNA, 64 nt, Human; identical to SEQ ID NO: 60300

SEQ ID NO: 108911 - RNA, 64 nt, Human; identical to SEQ ID NO: 60301

SEQ ID NO: 108912 - RNA, 64 nt, Human; identical to SEQ ID NO: 60302

SEQ ID NO: 108913 - RNA, 64 nt, Human; identical to SEQ ID NO: 60303

SEQ ID NO: 108914 - RNA, 64 nt, Human; identical to SEQ ID NO: 60304

SEQ ID NO: 108915 - RNA, 64 nt, Human; identical to SEQ ID NO: 60305

SEQ ID NO: 108916 - RNA, 64 nt, Human; identical to SEQ ID NO: 60306

SEQ ID NO: 108917 - RNA, 64 nt, Human; identical to SEQ ID NO: 60307

SEQ ID NO: 108918 - RNA, 64 nt, Human; identical to SEQ ID NO: 60308

SEQ ID NO: 108919 - RNA, 64 nt, Human; identical to SEQ ID NO: 60309

SEQ ID NO: 108920 - RNA, 64 nt, Human; identical to SEQ ID NO: 60310

SEQ ID NO: 108921 - RNA, 64 nt, Human; identical to SEQ ID NO: 60311

SEQ ID NO: 108922 - RNA, 64 nt, Human; identical to SEQ ID NO: 60312

SEQ ID NO: 108923 - RNA, 64 nt, Human; identical to SEQ ID NO: 60313

SEQ ID NO: 108924 - RNA, 64 nt, Human; identical to SEQ ID NO: 60314

SEQ ID NO: 108925 - RNA, 64 nt, Human; identical to SEQ ID NO: 60315

SEQ ID NO: 108926 - RNA, 64 nt, Human; identical to SEQ ID NO: 60316

SEQ ID NO: 108927 - RNA, 64 nt, Human; identical to SEQ ID NO: 60317

SEQ ID NO: 108928 - RNA, 64 nt, Human; identical to SEQ ID NO: 60318

SEQ ID NO: 108929 - RNA, 64 nt, Human; identical to SEQ ID NO: 60319

SEQ ID NO: 108930 - RNA, 64 nt, Human; identical to SEQ ID NO: 60320

SEQ ID NO: 108931 - RNA, 64 nt, Human; identical to SEQ ID NO: 60321

SEQ ID NO: 108932 - RNA, 64 nt, Human; identical to SEQ ID NO: 60322

SEQ ID NO: 108933 - RNA, 64 nt, Human; identical to SEQ ID NO: 60323

SEQ ID NO: 108934 - RNA, 64 nt, Human; identical to SEQ ID NO: 60324

SEQ ID NO: 108935 - RNA, 64 nt, Human; identical to SEQ ID NO: 60325

SEQ ID NO: 108936 - RNA, 57 nt, Human; identical to SEQ ID NO: 60326

SEQ ID NO: 108937 - RNA, 64 nt, Human; identical to SEQ ID NO: 60327

SEQ ID NO: 108938 - RNA, 64 nt, Human; identical to SEQ ID NO: 60328

SEQ ID NO: 108939 - RNA, 64 nt, Human; identical to SEQ ID NO: 60329

SEQ ID NO: 108940 - RNA, 64 nt, Human; identical to SEQ ID NO: 60330

SEQ ID NO: 108941 - RNA, 64 nt, Human; identical to SEQ ID NO: 60331

SEQ ID NO: 108942 - RNA, 53 nt, Human; identical to SEQ ID NO: 60332

SEQ ID NO: 108943 - RNA, 64 nt, Human; identical to SEQ ID NO: 60333

SEQ ID NO: 108944 - RNA, 64 nt, Human; identical to SEQ ID NO: 60334

SEQ ID NO: 108945 - RNA, 64 nt, Human; identical to SEQ ID NO: 60335

SEQ ID NO: 108946 - RNA, 64 nt, Human; identical to SEQ ID NO: 60336

SEQ ID NO: 108947 - RNA, 64 nt, Human; identical to SEQ ID NO: 60337

SEQ ID NO: 108948 - RNA, 64 nt, Human; identical to SEQ ID NO: 60338

SEQ ID NO: 108949 - RNA, 64 nt, Human; identical to SEQ ID NO: 60339

SEQ ID NO: 108950 - RNA, 64 nt, Human; identical to SEQ ID NO: 60340

SEQ ID NO: 108951 - RNA, 64 nt, Human; identical to SEQ ID NO: 60341

SEQ ID NO: 108952 - RNA, 64 nt, Human; identical to SEQ ID NO: 60342

SEQ ID NO: 108953 - RNA, 64 nt, Human; identical to SEQ ID NO: 60343

SEQ ID NO: 108954 - RNA, 64 nt, Human; identical to SEQ ID NO: 60344

SEQ ID NO: 108955 - RNA, 64 nt, Human; identical to SEQ ID NO: 60345

SEQ ID NO: 108956 - RNA, 64 nt, Human; identical to SEQ ID NO: 60346

SEQ ID NO: 108957 - RNA, 64 nt, Human; identical to SEQ ID NO: 60347

SEQ ID NO: 108958 - RNA, 64 nt, Human; identical to SEQ ID NO: 60348

SEQ ID NO: 108959 - RNA, 64 nt, Human; identical to SEQ ID NO: 60349

SEQ ID NO: 108960 - RNA, 64 nt, Human; identical to SEQ ID NO: 60350

SEQ ID NO: 108961 - RNA, 64 nt, Human; identical to SEQ ID NO: 60351

SEQ ID NO: 108962 - RNA, 64 nt, Human; identical to SEQ ID NO: 60352

SEQ ID NO: 108963 - RNA, 64 nt, Human; identical to SEQ ID NO: 60353

SEQ ID NO: 108964 - RNA, 64 nt, Human; identical to SEQ ID NO: 60354

SEQ ID NO: 108965 - RNA, 64 nt, Human; identical to SEQ ID NO: 60355

SEQ ID NO: 108966 - RNA, 64 nt, Human; identical to SEQ ID NO: 60356

SEQ ID NO: 108967 - RNA, 64 nt, Human; identical to SEQ ID NO: 60357

SEQ ID NO: 108968 - RNA, 64 nt, Human; identical to SEQ ID NO: 60358

SEQ ID NO: 108969 - RNA, 64 nt, Human; identical to SEQ ID NO: 60359

SEQ ID NO: 108970 - RNA, 64 nt, Human; identical to SEQ ID NO: 60360

SEQ ID NO: 108971 - RNA, 64 nt, Human; identical to SEQ ID NO: 60361

SEQ ID NO: 108972 - RNA, 64 nt, Human; identical to SEQ ID NO: 60362

SEQ ID NO: 108973 - RNA, 64 nt, Human; identical to SEQ ID NO: 60363

SEQ ID NO: 108974 - RNA, 64 nt, Human; identical to SEQ ID NO: 60364

SEQ ID NO: 108975 - RNA, 64 nt, Human; identical to SEQ ID NO: 60365

SEQ ID NO: 108976 - RNA, 64 nt, Human; identical to SEQ ID NO: 60366

SEQ ID NO: 108977 - RNA, 64 nt, Human; identical to SEQ ID NO: 60367

SEQ ID NO: 108978 - RNA, 64 nt, Human; identical to SEQ ID NO: 60368

SEQ ID NO: 108979 - RNA, 60 nt, Human; identical to SEQ ID NO: 60369

SEQ ID NO: 108980 - RNA, 64 nt, Human; identical to SEQ ID NO: 60370

SEQ ID NO: 108981 - RNA, 64 nt, Human; identical to SEQ ID NO: 60371

SEQ ID NO: 108982 - RNA, 64 nt, Human; identical to SEQ ID NO: 60372

SEQ ID NO: 108983 - RNA, 64 nt, Human; identical to SEQ ID NO: 60373

SEQ ID NO: 108984 - RNA, 64 nt, Human; identical to SEQ ID NO: 60374

SEQ ID NO: 108985 - RNA, 64 nt, Human; identical to SEQ ID NO: 60375

SEQ ID NO: 108986 - RNA, 64 nt, Human; identical to SEQ ID NO: 60376

SEQ ID NO: 108987 - RNA, 64 nt, Human; identical to SEQ ID NO: 60377

SEQ ID NO: 108988 - RNA, 64 nt, Human; identical to SEQ ID NO: 60378

SEQ ID NO: 108989 - RNA, 64 nt, Human; identical to SEQ ID NO: 60379

SEQ ID NO: 108990 - RNA, 64 nt, Human; identical to SEQ ID NO: 60380

SEQ ID NO: 108991 - RNA, 64 nt, Human; identical to SEQ ID NO: 60381

SEQ ID NO: 108992 - RNA, 64 nt, Human; identical to SEQ ID NO: 60382

SEQ ID NO: 108993 - RNA, 64 nt, Human; identical to SEQ ID NO: 60383

SEQ ID NO: 108994 - RNA, 64 nt, Human; identical to SEQ ID NO: 60384

SEQ ID NO: 108995 - RNA, 64 nt, Human; identical to SEQ ID NO: 60385

SEQ ID NO: 108996 - RNA, 64 nt, Human; identical to SEQ ID NO: 60386

SEQ ID NO: 108997 - RNA, 64 nt, Human; identical to SEQ ID NO: 60387

SEQ ID NO: 108998 - RNA, 64 nt, Human; identical to SEQ ID NO: 60388

SEQ ID NO: 108999 - RNA, 64 nt, Human; identical to SEQ ID NO: 60389

SEQ ID NO: 109000 - RNA, 64 nt, Human; identical to SEQ ID NO: 60390

SEQ ID NO: 109001 - RNA, 64 nt, Human; identical to SEQ ID NO: 60391

SEQ ID NO: 109002 - RNA, 64 nt, Human; identical to SEQ ID NO: 60392

SEQ ID NO: 109003 - RNA, 64 nt, Human; identical to SEQ ID NO: 60393

SEQ ID NO: 109004 - RNA, 64 nt, Human; identical to SEQ ID NO: 60394

SEQ ID NO: 109005 - RNA, 64 nt, Human; identical to SEQ ID NO: 60395

SEQ ID NO: 109006 - RNA, 64 nt, Human; identical to SEQ ID NO: 60396

SEQ ID NO: 109007 - RNA, 64 nt, Human; identical to SEQ ID NO: 60397

SEQ ID NO: 109008 - RNA, 64 nt, Human; identical to SEQ ID NO: 60398

SEQ ID NO: 109009 - RNA, 64 nt, Human; identical to SEQ ID NO: 60399

SEQ ID NO: 109010 - RNA, 64 nt, Human; identical to SEQ ID NO: 60400

SEQ ID NO: 109011 - RNA, 64 nt, Human; identical to SEQ ID NO: 60401

SEQ ID NO: 109012 - RNA, 64 nt, Human; identical to SEQ ID NO: 60402

SEQ ID NO: 109013 - RNA, 64 nt, Human; identical to SEQ ID NO: 60402

SEQ ID NO: 109014 - RNA, 64 nt, Human; identical to SEQ ID NO: 60404

SEQ ID NO: 109015 - RNA, 64 nt, Human; identical to SEQ ID NO: 60405

SEQ ID NO: 109016 - RNA, 64 nt, Human; identical to SEQ ID NO: 60406

SEQ ID NO: 109017 - RNA, 64 nt, Human; identical to SEQ ID NO: 60407

SEQ ID NO: 109018 - RNA, 64 nt, Human; identical to SEQ ID NO: 60408

SEQ ID NO: 109019 - RNA, 64 nt, Human; identical to SEQ ID NO: 60409

SEQ ID NO: 109020 - RNA, 64 nt, Human; identical to SEQ ID NO: 60410

SEQ ID NO: 109021 - RNA, 64 nt, Human; identical to SEQ ID NO: 60411

SEQ ID NO: 109022 - RNA, 64 nt, Human; identical to SEQ ID NO: 60412

SEQ ID NO: 109023 - RNA, 64 nt, Human; identical to SEQ ID NO: 60413

SEQ ID NO: 109024 - RNA, 64 nt, Human; identical to SEQ ID NO: 60414

SEQ ID NO: 109025 - RNA, 64 nt, Human; identical to SEQ ID NO: 60415

SEQ ID NO: 109026 - RNA, 64 nt, Human; identical to SEQ ID NO: 60416

SEQ ID NO: 109027 - RNA, 64 nt, Human; identical to SEQ ID NO: 60417

SEQ ID NO: 109028 - RNA, 64 nt, Human; identical to SEQ ID NO: 60418

SEQ ID NO: 109029 - RNA, 64 nt, Human; identical to SEQ ID NO: 60419

SEQ ID NO: 109030 - RNA, 64 nt, Human; identical to SEQ ID NO: 60420

SEQ ID NO: 109031 - RNA, 64 nt, Human; identical to SEQ ID NO: 60421

SEQ ID NO: 109032 - RNA, 64 nt, Human; identical to SEQ ID NO: 60422

SEQ ID NO: 109033 - RNA, 64 nt, Human; identical to SEQ ID NO: 60423

SEQ ID NO: 109034 - RNA, 64 nt, Human; identical to SEQ ID NO: 60424

SEQ ID NO: 109035 - RNA, 64 nt, Human; identical to SEQ ID NO: 60425

SEQ ID NO: 109036 - RNA, 64 nt, Human; identical to SEQ ID NO: 60426

SEQ ID NO: 109037 - RNA, 64 nt, Human; identical to SEQ ID NO: 60427

SEQ ID NO: 109038 - RNA, 64 nt, Human; identical to SEQ ID NO: 60428

SEQ ID NO: 109039 - RNA, 64 nt, Human; identical to SEQ ID NO: 60429

SEQ ID NO: 109040 - RNA, 64 nt, Human; identical to SEQ ID NO: 60430

SEQ ID NO: 109041 - RNA, 64 nt, Human; identical to SEQ ID NO: 60431

SEQ ID NO: 109042 - RNA, 64 nt, Human; identical to SEQ ID NO: 60432

SEQ ID NO: 109043 - RNA, 64 nt, Human; identical to SEQ ID NO: 60433

SEQ ID NO: 109044 - RNA, 64 nt, Human; identical to SEQ ID NO: 60434

SEQ ID NO: 109045 - RNA, 64 nt, Human; identical to SEQ ID NO: 60435

SEQ ID NO: 109046 - RNA, 64 nt, Human; identical to SEQ ID NO: 60436

SEQ ID NO: 109047 - RNA, 64 nt, Human; identical to SEQ ID NO: 60437

SEQ ID NO: 109048 - RNA, 64 nt, Human; identical to SEQ ID NO: 60438

SEQ ID NO: 109049 - RNA, 64 nt, Human; identical to SEQ ID NO: 60439

SEQ ID NO: 109050 - RNA, 64 nt, Human; identical to SEQ ID NO: 60440

SEQ ID NO: 109051 - RNA, 64 nt, Human; identical to SEQ ID NO: 60441

SEQ ID NO: 109052 - RNA, 64 nt, Human; identical to SEQ ID NO: 60442

SEQ ID NO: 109053 - RNA, 64 nt, Human; identical to SEQ ID NO: 60443

SEQ ID NO: 109054 - RNA, 64 nt, Human; identical to SEQ ID NO: 60444

SEQ ID NO: 109055 - RNA, 64 nt, Human; identical to SEQ ID NO: 60445

SEQ ID NO: 109056 - RNA, 64 nt, Human; identical to SEQ ID NO: 60446

SEQ ID NO: 109057 - RNA, 64 nt, Human; identical to SEQ ID NO: 60447

SEQ ID NO: 109058 - RNA, 64 nt, Human; identical to SEQ ID NO: 60448

SEQ ID NO: 109059 - RNA, 64 nt, Human; identical to SEQ ID NO: 60449

SEQ ID NO: 109060 - RNA, 51 nt, Human; identical to SEQ ID NO: 60450

SEQ ID NO: 109061 - RNA, 64 nt, Human; identical to SEQ ID NO: 60451

SEQ ID NO: 109062 - RNA, 64 nt, Human; identical to SEQ ID NO: 60452

SEQ ID NO: 109063 - RNA, 64 nt, Human; identical to SEQ ID NO: 60453

SEQ ID NO: 109064 - RNA, 64 nt, Human; identical to SEQ ID NO: 60454

SEQ ID NO: 109065 - RNA, 64 nt, Human; identical to SEQ ID NO: 60455

SEQ ID NO: 109066 - RNA, 64 nt, Human; identical to SEQ ID NO: 60456

SEQ ID NO: 109067 - RNA, 64 nt, Human; identical to SEQ ID NO: 60457

SEQ ID NO: 109068 - RNA, 64 nt, Human; identical to SEQ ID NO: 60458

SEQ ID NO: 109069 - RNA, 64 nt, Human; identical to SEQ ID NO: 60459

SEQ ID NO: 109070 - RNA, 64 nt, Human; identical to SEQ ID NO: 60460

SEQ ID NO: 109071 - RNA, 64 nt, Human; identical to SEQ ID NO: 60461

SEQ ID NO: 109072 - RNA, 64 nt, Human; identical to SEQ ID NO: 60462

SEQ ID NO: 109073 - RNA, 64 nt, Human; identical to SEQ ID NO: 60463

SEQ ID NO: 109074 - RNA, 51 nt, Human; identical to SEQ ID NO: 60464

SEQ ID NO: 109075 - RNA, 64 nt, Human; identical to SEQ ID NO: 60465

SEQ ID NO: 109076 - RNA, 64 nt, Human; identical to SEQ ID NO: 60466

SEQ ID NO: 109077 - RNA, 64 nt, Human; identical to SEQ ID NO: 60467

SEQ ID NO: 109078 - RNA, 64 nt, Human; identical to SEQ ID NO: 60468

SEQ ID NO: 109079 - RNA, 50 nt, Human; identical to SEQ ID NO: 60469

SEQ ID NO: 109080 - RNA, 64 nt, Human; identical to SEQ ID NO: 60470

SEQ ID NO: 109081 - RNA, 64 nt, Human; identical to SEQ ID NO: 60471

SEQ ID NO: 109082 - RNA, 64 nt, Human; identical to SEQ ID NO: 60472

SEQ ID NO: 109083 - RNA, 64 nt, Human; identical to SEQ ID NO: 60473

SEQ ID NO: 109084 - RNA, 64 nt, Human; identical to SEQ ID NO: 60474

SEQ ID NO: 109085 - RNA, 64 nt, Human; identical to SEQ ID NO: 60475

SEQ ID NO: 109086 - RNA, 64 nt, Human; identical to SEQ ID NO: 60476

SEQ ID NO: 109087 - RNA, 64 nt, Human; identical to SEQ ID NO: 60477

SEQ ID NO: 109088 - RNA, 64 nt, Human; identical to SEQ ID NO: 60478

SEQ ID NO: 109089 - RNA, 64 nt, Human; identical to SEQ ID NO: 60479

SEQ ID NO: 109090 - RNA, 64 nt, Human; identical to SEQ ID NO: 60480

SEQ ID NO: 109091 - RNA, 64 nt, Human; identical to SEQ ID NO: 60481

SEQ ID NO: 109092 - RNA, 64 nt, Human; identical to SEQ ID NO: 60482

SEQ ID NO: 109093 - RNA, 64 nt, Human; identical to SEQ ID NO: 60483

SEQ ID NO: 109094 - RNA, 64 nt, Human; identical to SEQ ID NO: 60484

SEQ ID NO: 109095 - RNA, 64 nt, Human; identical to SEQ ID NO: 60485

SEQ ID NO: 109096 - RNA, 64 nt, Human; identical to SEQ ID NO: 60486

SEQ ID NO: 109097 - RNA, 64 nt, Human; identical to SEQ ID NO: 60487

SEQ ID NO: 109098 - RNA, 64 nt, Human; identical to SEQ ID NO: 60488

SEQ ID NO: 109099 - RNA, 64 nt, Human; identical to SEQ ID NO: 60489

SEQ ID NO: 109100 - RNA, 64 nt, Human; identical to SEQ ID NO: 60490

SEQ ID NO: 109101 - RNA, 64 nt, Human; identical to SEQ ID NO: 60491

SEQ ID NO: 109102 - RNA, 64 nt, Human; identical to SEQ ID NO: 60492

SEQ ID NO: 109103 - RNA, 64 nt, Human; identical to SEQ ID NO: 60493

SEQ ID NO: 109104 - RNA, 64 nt, Human; identical to SEQ ID NO: 60494

SEQ ID NO: 109105 - RNA, 64 nt, Human; identical to SEQ ID NO: 60495

SEQ ID NO: 109106 - RNA, 64 nt, Human; identical to SEQ ID NO: 60496

SEQ ID NO: 109107 - RNA, 64 nt, Human; identical to SEQ ID NO: 60497

SEQ ID NO: 109108 - RNA, 64 nt, Human; identical to SEQ ID NO: 60498

SEQ ID NO: 109109 - RNA, 64 nt, Human; identical to SEQ ID NO: 60499

SEQ ID NO: 109110 - RNA, 64 nt, Human; identical to SEQ ID NO: 60500

SEQ ID NO: 109111 - RNA, 64 nt, Human; identical to SEQ ID NO: 60501

SEQ ID NO: 109112 - RNA, 64 nt, Human; identical to SEQ ID NO: 60502

SEQ ID NO: 109113 - RNA, 64 nt, Human; identical to SEQ ID NO: 60503

SEQ ID NO: 109114 - RNA, 64 nt, Human; identical to SEQ ID NO: 60504

SEQ ID NO: 109115 - RNA, 64 nt, Human; identical to SEQ ID NO: 60505

SEQ ID NO: 109116 - RNA, 64 nt, Human; identical to SEQ ID NO: 60506

SEQ ID NO: 109117 - RNA, 64 nt, Human; identical to SEQ ID NO: 60507

SEQ ID NO: 109118 - RNA, 64 nt, Human; identical to SEQ ID NO: 60508

SEQ ID NO: 109119 - RNA, 64 nt, Human; identical to SEQ ID NO: 60509

SEQ ID NO: 109120 - RNA, 60 nt, Human; identical to SEQ ID NO: 60510

SEQ ID NO: 109121 - RNA, 64 nt, Human; identical to SEQ ID NO: 60511

SEQ ID NO: 109122 - RNA, 64 nt, Human; identical to SEQ ID NO: 60512

SEQ ID NO: 109123 - RNA, 51 nt, Human; identical to SEQ ID NO: 60513

SEQ ID NO: 109124 - RNA, 64 nt, Human; identical to SEQ ID NO: 60514

SEQ ID NO: 109125 - RNA, 64 nt, Human; identical to SEQ ID NO: 60515

SEQ ID NO: 109126 - RNA, 59 nt, Human; identical to SEQ ID NO: 60516

SEQ ID NO: 109127 - RNA, 64 nt, Human; identical to SEQ ID NO: 60517

SEQ ID NO: 109128 - RNA, 64 nt, Human; identical to SEQ ID NO: 60518

SEQ ID NO: 109129 - RNA, 64 nt, Human; identical to SEQ ID NO: 60519

SEQ ID NO: 109130 - RNA, 64 nt, Human; identical to SEQ ID NO: 60520

SEQ ID NO: 109131 - RNA, 64 nt, Human; identical to SEQ ID NO: 60521

SEQ ID NO: 109132 - RNA, 64 nt, Human; identical to SEQ ID NO: 60522

SEQ ID NO: 109133 - RNA, 64 nt, Human; identical to SEQ ID NO: 60523

SEQ ID NO: 109134 - RNA, 64 nt, Human; identical to SEQ ID NO: 60524

SEQ ID NO: 109135 - RNA, 64 nt, Human; identical to SEQ ID NO: 60525

SEQ ID NO: 109136 - RNA, 64 nt, Human; identical to SEQ ID NO: 60526

SEQ ID NO: 109137 - RNA, 64 nt, Human; identical to SEQ ID NO: 60527

SEQ ID NO: 109138 - RNA, 64 nt, Human; identical to SEQ ID NO: 60528

SEQ ID NO: 109139 - RNA, 64 nt, Human; identical to SEQ ID NO: 60529

SEQ ID NO: 109140 - RNA, 64 nt, Human; identical to SEQ ID NO: 60530

SEQ ID NO: 109141 - RNA, 64 nt, Human; identical to SEQ ID NO: 60531

SEQ ID NO: 109142 - RNA, 64 nt, Human; identical to SEQ ID NO: 60532

SEQ ID NO: 109143 - RNA, 64 nt, Human; identical to SEQ ID NO: 60533

SEQ ID NO: 109144 - RNA, 64 nt, Human; identical to SEQ ID NO: 60534

SEQ ID NO: 109145 - RNA, 64 nt, Human; identical to SEQ ID NO: 60535

SEQ ID NO: 109146 - RNA, 64 nt, Human; identical to SEQ ID NO: 60536

SEQ ID NO: 109147 - RNA, 64 nt, Human; identical to SEQ ID NO: 60537

SEQ ID NO: 109148 - RNA, 64 nt, Human; identical to SEQ ID NO: 60538

SEQ ID NO: 109149 - RNA, 64 nt, Human; identical to SEQ ID NO: 60539

SEQ ID NO: 109150 - RNA, 64 nt, Human; identical to SEQ ID NO: 60540

SEQ ID NO: 109151 - RNA, 64 nt, Human; identical to SEQ ID NO: 60541

SEQ ID NO: 109152 - RNA, 64 nt, Human; identical to SEQ ID NO: 60542

SEQ ID NO: 109153 - RNA, 64 nt, Human; identical to SEQ ID NO: 60543

SEQ ID NO: 109154 - RNA, 64 nt, Human; identical to SEQ ID NO: 60544

SEQ ID NO: 109155 - RNA, 64 nt, Human; identical to SEQ ID NO: 60545

SEQ ID NO: 109156 - RNA, 64 nt, Human; identical to SEQ ID NO: 60546

SEQ ID NO: 109157 - RNA, 64 nt, Human; identical to SEQ ID NO: 60547

SEQ ID NO: 109158 - RNA, 64 nt, Human; identical to SEQ ID NO: 60548

SEQ ID NO: 109159 - RNA, 64 nt, Human; identical to SEQ ID NO: 60549

SEQ ID NO: 109160 - RNA, 64 nt, Human; identical to SEQ ID NO: 60550

SEQ ID NO: 109161 - RNA, 64 nt, Human; identical to SEQ ID NO: 60551

SEQ ID NO: 109162 - RNA, 64 nt, Human; identical to SEQ ID NO: 60552

SEQ ID NO: 109163 - RNA, 64 nt, Human; identical to SEQ ID NO: 60553

SEQ ID NO: 109164 - RNA, 64 nt, Human; identical to SEQ ID NO: 60554

SEQ ID NO: 109165 - RNA, 64 nt, Human; identical to SEQ ID NO: 60555

SEQ ID NO: 109166 - RNA, 64 nt, Human; identical to SEQ ID NO: 60556

SEQ ID NO: 109167 - RNA, 64 nt, Human; identical to SEQ ID NO: 60557

SEQ ID NO: 109168 - RNA, 64 nt, Human; identical to SEQ ID NO: 60558

SEQ ID NO: 109169 - RNA, 64 nt, Human; identical to SEQ ID NO: 60559

SEQ ID NO: 109170 - RNA, 64 nt, Human; identical to SEQ ID NO: 60560

SEQ ID NO: 109171 - RNA, 64 nt, Human; identical to SEQ ID NO: 60561

SEQ ID NO: 109172 - RNA, 52 nt, Human; identical to SEQ ID NO: 60562

SEQ ID NO: 109173 - RNA, 64 nt, Human; identical to SEQ ID NO: 60563

SEQ ID NO: 109174 - RNA, 64 nt, Human; identical to SEQ ID NO: 60564

SEQ ID NO: 109175 - RNA, 64 nt, Human; identical to SEQ ID NO: 60565

SEQ ID NO: 109176 - RNA, 64 nt, Human; identical to SEQ ID NO: 60566

SEQ ID NO: 109177 - RNA, 64 nt, Human; identical to SEQ ID NO: 60567

SEQ ID NO: 109178 - RNA, 64 nt, Human; identical to SEQ ID NO: 60568

SEQ ID NO: 109179 - RNA, 64 nt, Human; identical to SEQ ID NO: 60569

SEQ ID NO: 109180 - RNA, 61 nt, Human; identical to SEQ ID NO: 60570

SEQ ID NO: 109181 - RNA, 64 nt, Human; identical to SEQ ID NO: 60571

SEQ ID NO: 109182 - RNA, 64 nt, Human; identical to SEQ ID NO: 60572

SEQ ID NO: 109183 - RNA, 64 nt, Human; identical to SEQ ID NO: 60573

SEQ ID NO: 109184 - RNA, 64 nt, Human; identical to SEQ ID NO: 60574

SEQ ID NO: 109185 - RNA, 64 nt, Human; identical to SEQ ID NO: 60575

SEQ ID NO: 109186 - RNA, 64 nt, Human; identical to SEQ ID NO: 60576

SEQ ID NO: 109187 - RNA, 64 nt, Human; identical to SEQ ID NO: 60577

SEQ ID NO: 109188 - RNA, 64 nt, Human; identical to SEQ ID NO: 60578

SEQ ID NO: 109189 - RNA, 50 nt, Human; identical to SEQ ID NO: 60579

SEQ ID NO: 109190 - RNA, 64 nt, Human; identical to SEQ ID NO: 60580

SEQ ID NO: 109191 - RNA, 64 nt, Human; identical to SEQ ID NO: 60581

SEQ ID NO: 109192 - RNA, 64 nt, Human; identical to SEQ ID NO: 60582

SEQ ID NO: 109193 - RNA, 64 nt, Human; identical to SEQ ID NO: 60583

SEQ ID NO: 109194 - RNA, 64 nt, Human; identical to SEQ ID NO: 60584

SEQ ID NO: 109195 - RNA, 57 nt, Human; identical to SEQ ID NO: 60585

SEQ ID NO: 109196 - RNA, 64 nt, Human; identical to SEQ ID NO: 60586

SEQ ID NO: 109197 - RNA, 64 nt, Human; identical to SEQ ID NO: 60587

SEQ ID NO: 109198 - RNA, 64 nt, Human; identical to SEQ ID NO: 60588

SEQ ID NO: 109199 - RNA, 64 nt, Human; identical to SEQ ID NO: 60589

SEQ ID NO: 109200 - RNA, 64 nt, Human; identical to SEQ ID NO: 60590

SEQ ID NO: 109201 - RNA, 64 nt, Human; identical to SEQ ID NO: 60591

SEQ ID NO: 109202 - RNA, 64 nt, Human; identical to SEQ ID NO: 60592

SEQ ID NO: 109203 - RNA, 56 nt, Human; identical to SEQ ID NO: 60593

SEQ ID NO: 109204 - RNA, 64 nt, Human; identical to SEQ ID NO: 60594

SEQ ID NO: 109205 - RNA, 64 nt, Human; identical to SEQ ID NO: 60595

SEQ ID NO: 109206 - RNA, 64 nt, Human; identical to SEQ ID NO: 60596

SEQ ID NO: 109207 - RNA, 64 nt, Human; identical to SEQ ID NO: 60597

SEQ ID NO: 109208 - RNA, 64 nt, Human; identical to SEQ ID NO: 60598

SEQ ID NO: 109209 - RNA, 64 nt, Human; identical to SEQ ID NO: 60599

SEQ ID NO: 109210 - RNA, 64 nt, Human; identical to SEQ ID NO: 60600

SEQ ID NO: 109211 - RNA, 64 nt, Human; identical to SEQ ID NO: 60601

SEQ ID NO: 109212 - RNA, 64 nt, Human; identical to SEQ ID NO: 60602

SEQ ID NO: 109213 - RNA, 64 nt, Human; identical to SEQ ID NO: 60603

SEQ ID NO: 109214 - RNA, 64 nt, Human; identical to SEQ ID NO: 60604

SEQ ID NO: 109215 - RNA, 64 nt, Human; identical to SEQ ID NO: 60605

SEQ ID NO: 109216 - RNA, 64 nt, Human; identical to SEQ ID NO: 60606

SEQ ID NO: 109217 - RNA, 64 nt, Human; identical to SEQ ID NO: 60607

SEQ ID NO: 109218 - RNA, 64 nt, Human; identical to SEQ ID NO: 60608

SEQ ID NO: 109219 - RNA, 64 nt, Human; identical to SEQ ID NO: 60609

SEQ ID NO: 109220 - RNA, 64 nt, Human; identical to SEQ ID NO: 60610

SEQ ID NO: 109221 - RNA, 64 nt, Human; identical to SEQ ID NO: 60611

SEQ ID NO: 109222 - RNA, 64 nt, Human; identical to SEQ ID NO: 60612

SEQ ID NO: 109223 - RNA, 64 nt, Human; identical to SEQ ID NO: 60613

SEQ ID NO: 109224 - RNA, 64 nt, Human; identical to SEQ ID NO: 60614

SEQ ID NO: 109225 - RNA, 64 nt, Human; identical to SEQ ID NO: 60615

SEQ ID NO: 109226 - RNA, 64 nt, Human; identical to SEQ ID NO: 60616

SEQ ID NO: 109227 - RNA, 64 nt, Human; identical to SEQ ID NO: 60617

SEQ ID NO: 109228 - RNA, 64 nt, Human; identical to SEQ ID NO: 60618

SEQ ID NO: 109229 - RNA, 64 nt, Human; identical to SEQ ID NO: 60619

SEQ ID NO: 109230 - RNA, 64 nt, Human; identical to SEQ ID NO: 60620

SEQ ID NO: 109231 - RNA, 64 nt, Human; identical to SEQ ID NO: 60621

SEQ ID NO: 109232 - RNA, 64 nt, Human; identical to SEQ ID NO: 60622

SEQ ID NO: 109233 - RNA, 64 nt, Human; identical to SEQ ID NO: 60623

SEQ ID NO: 109234 - RNA, 64 nt, Human; identical to SEQ ID NO: 60624

SEQ ID NO: 109235 - RNA, 64 nt, Human; identical to SEQ ID NO: 60625

SEQ ID NO: 109236 - RNA, 64 nt, Human; identical to SEQ ID NO: 60626

SEQ ID NO: 109237 - RNA, 64 nt, Human; identical to SEQ ID NO: 60627

SEQ ID NO: 109238 - RNA, 64 nt, Human; identical to SEQ ID NO: 60628

SEQ ID NO: 109239 - RNA, 64 nt, Human; identical to SEQ ID NO: 60629

SEQ ID NO: 109240 - RNA, 58 nt, Human; identical to SEQ ID NO: 60630

SEQ ID NO: 109241 - RNA, 64 nt, Human; identical to SEQ ID NO: 60631

SEQ ID NO: 109242 - RNA, 64 nt, Human; identical to SEQ ID NO: 60632

SEQ ID NO: 109243 - RNA, 64 nt, Human; identical to SEQ ID NO: 60633

SEQ ID NO: 109244 - RNA, 64 nt, Human; identical to SEQ ID NO: 60634

SEQ ID NO: 109245 - RNA, 64 nt, Human; identical to SEQ ID NO: 60635

SEQ ID NO: 109246 - RNA, 64 nt, Human; identical to SEQ ID NO: 60636

SEQ ID NO: 109247 - RNA, 64 nt, Human; identical to SEQ ID NO: 60637

SEQ ID NO: 109248 - RNA, 64 nt, Human; identical to SEQ ID NO: 60638

SEQ ID NO: 109249 - RNA, 64 nt, Human; identical to SEQ ID NO: 60639

SEQ ID NO: 109250 - RNA, 64 nt, Human; identical to SEQ ID NO: 60640

SEQ ID NO: 109251 - RNA, 64 nt, Human; identical to SEQ ID NO: 60641

SEQ ID NO: 109252 - RNA, 64 nt, Human; identical to SEQ ID NO: 60642

SEQ ID NO: 109253 - RNA, 64 nt, Human; identical to SEQ ID NO: 60643

SEQ ID NO: 109254 - RNA, 64 nt, Human; identical to SEQ ID NO: 60644

SEQ ID NO: 109255 - RNA, 62 nt, Human; identical to SEQ ID NO: 60645

SEQ ID NO: 109256 - RNA, 64 nt, Human; identical to SEQ ID NO: 60646

SEQ ID NO: 109257 - RNA, 64 nt, Human; identical to SEQ ID NO: 60647

SEQ ID NO: 109258 - RNA, 64 nt, Human; identical to SEQ ID NO: 60648

SEQ ID NO: 109259 - RNA, 64 nt, Human; identical to SEQ ID NO: 60649

SEQ ID NO: 109260 - RNA, 64 nt, Human; identical to SEQ ID NO: 60650

SEQ ID NO: 109261 - RNA, 58 nt, Human; identical to SEQ ID NO: 60651

SEQ ID NO: 109262 - RNA, 64 nt, Human; identical to SEQ ID NO: 60652

SEQ ID NO: 109263 - RNA, 60 nt, Human; identical to SEQ ID NO: 60653

SEQ ID NO: 109264 - RNA, 64 nt, Human; identical to SEQ ID NO: 60654

SEQ ID NO: 109265 - RNA, 64 nt, Human; identical to SEQ ID NO: 60655

SEQ ID NO: 109266 - RNA, 64 nt, Human; identical to SEQ ID NO: 60656

SEQ ID NO: 109267 - RNA, 64 nt, Human; identical to SEQ ID NO: 60657

SEQ ID NO: 109268 - RNA, 64 nt, Human; identical to SEQ ID NO: 60658

SEQ ID NO: 109269 - RNA, 53 nt, Human; identical to SEQ ID NO: 60659

SEQ ID NO: 109270 - RNA, 64 nt, Human; identical to SEQ ID NO: 60660

SEQ ID NO: 109271 - RNA, 64 nt, Human; identical to SEQ ID NO: 60661

SEQ ID NO: 109272 - RNA, 64 nt, Human; identical to SEQ ID NO: 60662

SEQ ID NO: 109273 - RNA, 64 nt, Human; identical to SEQ ID NO: 60663

SEQ ID NO: 109274 - RNA, 64 nt, Human; identical to SEQ ID NO: 60664

SEQ ID NO: 109275 - RNA, 64 nt, Human; identical to SEQ ID NO: 60665

SEQ ID NO: 109276 - RNA, 64 nt, Human; identical to SEQ ID NO: 60666

SEQ ID NO: 109277 - RNA, 64 nt, Human; identical to SEQ ID NO: 60667

SEQ ID NO: 109278 - RNA, 64 nt, Human; identical to SEQ ID NO: 60668

SEQ ID NO: 109279 - RNA, 64 nt, Human; identical to SEQ ID NO: 60669

SEQ ID NO: 109280 - RNA, 64 nt, Human; identical to SEQ ID NO: 60670

SEQ ID NO: 109281 - RNA, 64 nt, Human; identical to SEQ ID NO: 60671

SEQ ID NO: 109282 - RNA, 64 nt, Human; identical to SEQ ID NO: 60672

SEQ ID NO: 109283 - RNA, 64 nt, Human; identical to SEQ ID NO: 60673

SEQ ID NO: 109284 - RNA, 64 nt, Human; identical to SEQ ID NO: 60674

SEQ ID NO: 109285 - RNA, 64 nt, Human; identical to SEQ ID NO: 60675

SEQ ID NO: 109286 - RNA, 64 nt, Human; identical to SEQ ID NO: 60676

SEQ ID NO: 109287 - RNA, 64 nt, Human; identical to SEQ ID NO: 60677

SEQ ID NO: 109288 - RNA, 64 nt, Human; identical to SEQ ID NO: 60678

SEQ ID NO: 109289 - RNA, 64 nt, Human; identical to SEQ ID NO: 60679

SEQ ID NO: 109290 - RNA, 64 nt, Human; identical to SEQ ID NO: 60680

SEQ ID NO: 109291 - RNA, 64 nt, Human; identical to SEQ ID NO: 60681

SEQ ID NO: 109292 - RNA, 64 nt, Human; identical to SEQ ID NO: 60682

SEQ ID NO: 109293 - RNA, 64 nt, Human; identical to SEQ ID NO: 60683

SEQ ID NO: 109294 - RNA, 64 nt, Human; identical to SEQ ID NO: 60684

SEQ ID NO: 109295 - RNA, 64 nt, Human; identical to SEQ ID NO: 60685

SEQ ID NO: 109296 - RNA, 64 nt, Human; identical to SEQ ID NO: 60686

SEQ ID NO: 109297 - RNA, 64 nt, Human; identical to SEQ ID NO: 60687

SEQ ID NO: 109298 - RNA, 64 nt, Human; identical to SEQ ID NO: 60688

SEQ ID NO: 109299 - RNA, 64 nt, Human; identical to SEQ ID NO: 60689

SEQ ID NO: 109300 - RNA, 64 nt, Human; identical to SEQ ID NO: 60690

SEQ ID NO: 109301 - RNA, 64 nt, Human; identical to SEQ ID NO: 60691

SEQ ID NO: 109302 - RNA, 64 nt, Human; identical to SEQ ID NO: 60692

SEQ ID NO: 109303 - RNA, 64 nt, Human; identical to SEQ ID NO: 60693

SEQ ID NO: 109304 - RNA, 64 nt, Human; identical to SEQ ID NO: 60694

SEQ ID NO: 109305 - RNA, 64 nt, Human; identical to SEQ ID NO: 60695

SEQ ID NO: 109306 - RNA, 64 nt, Human; identical to SEQ ID NO: 60696

SEQ ID NO: 109307 - RNA, 64 nt, Human; identical to SEQ ID NO: 60697

SEQ ID NO: 109308 - RNA, 64 nt, Human; identical to SEQ ID NO: 60698

SEQ ID NO: 109309 - RNA, 64 nt, Human; identical to SEQ ID NO: 60699

SEQ ID NO: 109310 - RNA, 64 nt, Human; identical to SEQ ID NO: 60700

SEQ ID NO: 109311 - RNA, 64 nt, Human; identical to SEQ ID NO: 60701

SEQ ID NO: 109312 - RNA, 64 nt, Human; identical to SEQ ID NO: 60702

SEQ ID NO: 109313 - RNA, 64 nt, Human; identical to SEQ ID NO: 60703

SEQ ID NO: 109314 - RNA, 64 nt, Human; identical to SEQ ID NO: 60704

SEQ ID NO: 109315 - RNA, 64 nt, Human; identical to SEQ ID NO: 60705

SEQ ID NO: 109316 - RNA, 64 nt, Human; identical to SEQ ID NO: 60706

SEQ ID NO: 109317 - RNA, 64 nt, Human; identical to SEQ ID NO: 60707

SEQ ID NO: 109318 - RNA, 64 nt, Human; identical to SEQ ID NO: 60708

SEQ ID NO: 109319 - RNA, 64 nt, Human; identical to SEQ ID NO: 60709

SEQ ID NO: 109320 - RNA, 64 nt, Human; identical to SEQ ID NO: 60710

SEQ ID NO: 109321 - RNA, 64 nt, Human; identical to SEQ ID NO: 60711

SEQ ID NO: 109322 - RNA, 64 nt, Human; identical to SEQ ID NO: 60712

SEQ ID NO: 109323 - RNA, 64 nt, Human; identical to SEQ ID NO: 60713

SEQ ID NO: 109324 - RNA, 64 nt, Human; identical to SEQ ID NO: 60714

SEQ ID NO: 109325 - RNA, 64 nt, Human; identical to SEQ ID NO: 60715

SEQ ID NO: 109326 - RNA, 64 nt, Human; identical to SEQ ID NO: 60716

SEQ ID NO: 109327 - RNA, 64 nt, Human; identical to SEQ ID NO: 60717

SEQ ID NO: 109328 - RNA, 64 nt, Human; identical to SEQ ID NO: 60718

SEQ ID NO: 109329 - RNA, 64 nt, Human; identical to SEQ ID NO: 60719

SEQ ID NO: 109330 - RNA, 64 nt, Human; identical to SEQ ID NO: 60720

SEQ ID NO: 109331 - RNA, 64 nt, Human; identical to SEQ ID NO: 60721

SEQ ID NO: 109332 - RNA, 64 nt, Human; identical to SEQ ID NO: 60722

SEQ ID NO: 109333 - RNA, 64 nt, Human; identical to SEQ ID NO: 60723

SEQ ID NO: 109334 - RNA, 64 nt, Human; identical to SEQ ID NO: 60724

SEQ ID NO: 109335 - RNA, 64 nt, Human; identical to SEQ ID NO: 60725

SEQ ID NO: 109336 - RNA, 64 nt, Human; identical to SEQ ID NO: 60726

SEQ ID NO: 109337 - RNA, 64 nt, Human; identical to SEQ ID NO: 60727

SEQ ID NO: 109338 - RNA, 64 nt, Human; identical to SEQ ID NO: 60728

SEQ ID NO: 109339 - RNA, 64 nt, Human; identical to SEQ ID NO: 60729

SEQ ID NO: 109340 - RNA, 64 nt, Human; identical to SEQ ID NO: 60730

SEQ ID NO: 109341 - RNA, 64 nt, Human; identical to SEQ ID NO: 60731

SEQ ID NO: 109342 - RNA, 64 nt, Human; identical to SEQ ID NO: 60732

SEQ ID NO: 109343 - RNA, 64 nt, Human; identical to SEQ ID NO: 60733

SEQ ID NO: 109344 - RNA, 64 nt, Human; identical to SEQ ID NO: 60734

SEQ ID NO: 109345 - RNA, 64 nt, Human; identical to SEQ ID NO: 60735

SEQ ID NO: 109346 - RNA, 64 nt, Human; identical to SEQ ID NO: 60736

SEQ ID NO: 109347 - RNA, 64 nt, Human; identical to SEQ ID NO: 60737

SEQ ID NO: 109348 - RNA, 64 nt, Human; identical to SEQ ID NO: 60738

SEQ ID NO: 109349 - RNA, 64 nt, Human
cuccacugaagccacccccaccccucgccagcuagcuccauagggaagccugugucuccugccc

SEQ ID NO: 109350 - RNA, 64 nt, Human
aagcacccccaagccacuauccacuuugaauccugcuccauacauuggguguauauuuauucug

SEQ ID NO: 109351 - RNA, 64 nt, Human
uuuccgguaggaauaacuccuuuucuacauccacgcuccauagagucucuccuuuucagacauc

SEQ ID NO: 109352 - RNA, 64 nt, Human
agaugaguucuucacuagcccuucugaaccccuugcuccauaauuggucuuuuauccuggcucu

SEQ ID NO: 109353 - RNA, 64 nt, Human
acacugaggccaaaguggcaaccugggaaugaaggcuccauaaaccauggcauguuggguuugc

SEQ ID NO: 109354 - RNA, 64 nt, Human
uuaagggaaaugacuacaaacuuucaaagcaaaugcuccauagcuaaagcaacuuagaccuuau

SEQ ID NO: 109355 - RNA, 64 nt, Human
ucuucugaagaggaaaagucaaaguguugcuguggcuccauauuucaacuaaaaauauaucugu

SEQ ID NO: 109356 - RNA, 64 nt, Human
cuggugcccaaagcaacaccagaaccaagaaggagcuccauaaauccuucuugggugaagccua

SEQ ID NO: 109357 - RNA, 64 nt, Human
uaauuuuaaugcuguuucuaagaaaauguaguuagcuccauaaaguacaaaugaagaaagucaa

SEQ ID NO: 109358 - RNA, 64 nt, Human
uuagugugacaguuuccaaauugcccuaugcugugcuccauauuugauuucuaauuguaaguga

SEQ ID NO: 109359 - RNA, 64 nt, Human
uuuuuuuuaaaacugucauuuuuuacugucuuuugcuccauaucaggaaauauuuugguaggaa

SEQ ID NO: 109360 - RNA, 64 nt, Human
gagauguaaguuucauuccagaauucauuccccagcuccauacucuguccccccagcuaauacc

SEQ ID NO: 109361 - RNA, 64 nt, Human
cuuuucguuaaugugcucuguaccacuggugagugcuccauaguuuccuuaccugcugcuacag

SEQ ID NO: 109362 - RNA, 64 nt, Human
auaguagcuagcuacuuaagcauccauggguauugcuccauaucaaagcagauuugcaggacag

SEQ ID NO: 109363 - RNA, 64 nt, Human
ugagcauaaaucaacuguccaucaggugaggugugcuccauacccagcgguucuucaugaguag

SEQ ID NO: 109364 - RNA, 64 nt, Human
auaggggacggaaggucguuuguuuuuguucugagcuccauaagaacugugcugacuuggaagg

SEQ ID NO: 109365 - RNA, 64 nt, Human
ggggcugcuggcgagcucuuucucuuuagggacugcuccauaccccaugauggagcacacggug

SEQ ID NO: 109366 - RNA, 64 nt, Human
aucagcaguagacugaagaaucuaccuuagauuugcuccauacuauuaauuagcuuacaaaaug

SEQ ID NO: 109367 - RNA, 64 nt, Human
uuauaucgcauugcucauuuagaguuugcaggaggcuccauacuagguucagucugaaagaaau

SEQ ID NO: 109368 - RNA, 64 nt, Human
uuugucacuccaccucauugagccugacuguucugcuccauaaaauaggguaauaaaggucaaa

SEQ ID NO: 109369 - RNA, 64 nt, Human
uaguugguuuucuaguaugaaagagcacccucuagcuccauauucuaagaaucugaaauaugcu

SEQ ID NO: 109370 - RNA, 64 nt, Human
uggcucugcugcaggucucugcacuccugauuuugcuccauacuuuuaaauaacaauaauaaau

SEQ ID NO: 109371 - RNA, 64 nt, Human
aaaguucuguccuagaguucuuuccugaccucuagcuccauacuucugauugccuaauaaauau

SEQ ID NO: 109372 - RNA, 64 nt, Human
ggucaaaacugagaagagauuaagauaggagagagcuccauaauggcuggauaguggucaggca

SEQ ID NO: 109373 - RNA, 64 nt, Human
ggccacugggcuuggaugcuucgggcuucugacugcuccauagguuuugacuggugaaacaggg

SEQ ID NO: 109374 - RNA, 64 nt, Human
acaagcuaacucccugcaucugggcaucaggacugcuccauacauuugcugaaaacuucuugua

SEQ ID NO: 109375 - RNA, 64 nt, Human
ugcgauggucuugacuauuagaccagauuuaguagcuccauaucuaagauuuuucuaccugccc

SEQ ID NO: 109376 - RNA, 64 nt, Human
aaguaacuucugacuuacugucaguuguacuucugcuccauagacaucaguauucugccaucau

SEQ ID NO: 109377 - RNA, 64 nt, Human
auuuacuacuuugagguuucccucacaacuucuggcuccauaccuagccccucuuuuauaaucu

SEQ ID NO: 109378 - RNA, 64 nt, Human
cuauauagauauauguaacuuagcuuuauuguuagcuccauaagcugccaguguugcuuuucug

SEQ ID NO: 109379 - RNA, 64 nt, Human
uuaaagucagcgagcagguucucauugauaacaagcuccauacugcugagauacagggaaaugg

SEQ ID NO: 109380 - RNA, 64 nt, Human
agacacgggcuccccucgagggagacuugcaaaugcuccauaaacagccacaguguggggcucu

SEQ ID NO: 109381 - RNA, 64 nt, Human
accucagcucuucuuguuucuacagauggcaacagcuccauagggacagcuuguauaauuaccu

SEQ ID NO: 109382 - RNA, 64 nt, Human
cuuuucuugaugccuuccggcugaaacccucucugcuccauaugcccuaaacuuaucugggaag

SEQ ID NO: 109383 - RNA, 64 nt, Human
uucacuaccugcuagagccuacugugaaaucacugcuccauauuugccaguggaggaaaugggc

SEQ ID NO: 109384 - RNA, 64 nt, Human
uuccucagcacacgaggcuuccacaacccagucugcuccauagcacucuggcccacccugucug

SEQ ID NO: 109385 - RNA, 64 nt, Human
gagauaaaagaaauugggugagaggagauagguagcuccauaaggcacacaaauucaaauauua

SEQ ID NO: 109386 - RNA, 64 nt, Human
uuaacagcuuuuguuaagugucaggcugcacuuugcuccauauaauuauuguuuucagauuuca

SEQ ID NO: 109387 - RNA, 64 nt, Human
gagaguuaaguccuuccucaaaaaauuuucuuaugcuccauaaaauugagguagaauauuuuca

SEQ ID NO: 109388 - RNA, 64 nt, Human
uguacgugaaugcucgcugucugauaggguuccagcuccauauauauagaaagaucgggggugg

SEQ ID NO: 109389 - RNA, 64 nt, Human
cuucuacuacuugagacuuuauucucuggguccagcuccauacccuaaauucugaguuucagcc

SEQ ID NO: 109390 - RNA, 64 nt, Human
accuuuagaggaauuucgucagaaaaauguggaggcuccauauuaaugcauuauuuuuuaaaaa

SEQ ID NO: 109391 - RNA, 64 nt, Human
uuuucuuacccauaagaucaaagcagacucaucagcuccauaucugcauuccacuggggaaaga

SEQ ID NO: 109392 - RNA, 64 nt, Human
cgcccaaaggauuccccuucacguuggugcaccugcuccauagcuccgggcgcugcgucccgag

SEQ ID NO: 109393 - RNA, 64 nt, Human
auuagcaaucaaacauuuucuuugagcuaucaaagcuccauauucucuuguccucaaucauuag

SEQ ID NO: 109394 - RNA, 64 nt, Human
gauggggcaaacagcccccaggcacuugcucccugcuccauacuuaagguuugugaugccaaca

SEQ ID NO: 109395 - RNA, 64 nt, Human
guacuuucucaccaagcgccagcuggaaaaucgagcuccauacuaaaggaagggaucauagaau

SEQ ID NO: 109396 - RNA, 64 nt, Human
uuuucuauaauauccuacuacuuugguuuuccuagcuccauaccacacaccuaaaccuguauua

SEQ ID NO: 109397 - RNA, 64 nt, Human
uacacuauuacuacauuaugggaagauuccaguugcuccauaucuuugcuaacacuuggcauug

SEQ ID NO: 109398 - RNA, 64 nt, Human
ggucuggcagagcugagagccauggccugcaggggcuccauaugucccuacgcgugcagcaggc

SEQ ID NO: 109399 - RNA, 64 nt, Human
agcagcaagaaaaaaaaaugccauaauacaaaaggcuccauauauauauauauauauauauaua

SEQ ID NO: 109400 - RNA, 64 nt, Human
uggagcucucuguagcuauuguucauaacacuuugcuccauaacccugauguccgcaguaucua

SEQ ID NO: 109401 - RNA, 64 nt, Human
aaugagagaguagggucaaacugucacaguaucugcuccauagguuucuguuuuuaauuucaau

SEQ ID NO: 109402 - RNA, 64 nt, Human
ugucaccuauuuauucacaggaucugugaauauugcuccauagaaaacaaauuguuaugauuga

SEQ ID NO: 109403 - RNA, 64 nt, Human
guuugucuggugucagcacgaggcagagcugugugcuccauagcguguagcuuuagacucggag

SEQ ID NO: 109404 - RNA, 64 nt, Human
aucagaaauaauugagaugggaaagaauagugcagcuccauagaggagacggacuguagacaau

SEQ ID NO: 109405 - RNA, 64 nt, Human
cuagcaucuucuggggccaggggcuugcuuccucgcuccauagcccucaacugcccaggcgcuc

SEQ ID NO: 109406 - RNA, 64 nt, Human
ccaggguuuuaaggaauuucacauguauaagguggcuccauagcuuuauuuguaaguaggcugg

SEQ ID NO: 109407 - RNA, 64 nt, Human
gaacaggccgugcacaacuuugacaucuggucuugcuccauagagcacaacucaagauagacca

SEQ ID NO: 109408 - RNA, 64 nt, Human
cugggcgccugcccucaggagccugggcugcgaggcuccauaggagggcugguggcugggaggu

SEQ ID NO: 109409 - RNA, 64 nt, Human
ccuuccucaccaacucagagcuccccuucuacuugcuccauauggaaccugcucguuuauggaa

SEQ ID NO: 109410 - RNA, 64 nt, Human
cccccuaacuccugucccccuucucuacuccuuugcuccauaguguuaaccuacucucggagcu

SEQ ID NO: 109411 - RNA, 64 nt, Human
ugggacccaugcaaauuaaaccaaccugguaguagcuccauaguggacucacucacuguuguuu

SEQ ID NO: 109412 - RNA, 64 nt, Human
ugggcaccugacagcuuugccuuuugcugacacagcuccauaaagacucgugcuuucucacugc

SEQ ID NO: 109413 - RNA, 64 nt, Human
uucccaccgaacacuacuaaggggcuuguguucugcuccauaccuuuucucuuuucuuucuguc

SEQ ID NO: 109414 - RNA, 64 nt, Human
aaacuaucucagccguuucccugcuuucccuucugcuccauaugccucauuguccuuccaggga

SEQ ID NO: 109415 - RNA, 64 nt, Human
gaaugaacaccuuuucauccagccuuaauuucuugcuccauaacuacucuaucccacgaugcag

SEQ ID NO: 109416 - RNA, 64 nt, Human
aauauaaaaucacuuggugauuaaaaaaauaacugcuccauaaauaaaacuccuaaagucacuu

SEQ ID NO: 109417 - RNA, 64 nt, Human
uacacaucuugauuggaacucaaauauuucaagggcuccauagccacguggccagcagcuacca

SEQ ID NO: 109418 - RNA, 64 nt, Human
uucuaagugccugggauaaagcugucucaugggugcuccauauauauucauauauauuuguuga

SEQ ID NO: 109419 - RNA, 64 nt, Human
ggaacagaacacuucuaggacugggggucuuuuagcuccauaagcaagugagcagaugggacaa

SEQ ID NO: 109420 - RNA, 64 nt, Human
gaguuauuuuuguggacggaaucggaacacgcuggcuccauaucgugaaauuuuuauuaauuuu

SEQ ID NO: 109421 - RNA, 64 nt, Human
acaguaacaaucauuguuuuaauaauauauacaagcuccauaacuccuuuuggugcuaaugauu

SEQ ID NO: 109422 - RNA, 64 nt, Human
cagucccaggucauacucuccaacaguuuucagagcuccauauauauguagaugccauccuuuc

SEQ ID NO: 109423 - RNA, 64 nt, Human
accugagcauagguaugaccuugggaagacauuggcuccauaagcaaugccaagagaaugauca

SEQ ID NO: 109424 - RNA, 64 nt, Human
agaucagaacucaccaaauggaagccuagcagcugcuccauaaaccuagccccauucuucauau

SEQ ID NO: 109425 - RNA, 64 nt, Human
gagaggagcaucaccagcuccucagagccacuccgcuccauaucaguaucucacagucccaucc

SEQ ID NO: 109426 - RNA, 64 nt, Human
cauagucuccuuguucuccuacuaauauucccaagcuccauaugccaauuaaagaagaaacaaa

SEQ ID NO: 109427 - RNA, 64 nt, Human
ugucucugaggggugggggugccgcucuaaauuggcuccauaucauuugaguuuaggguucugg

SEQ ID NO: 109428 - RNA, 64 nt, Human
cugugaacauguggcucuggauagagugacugcugcuccauauuagcuuccagagggugaguga

SEQ ID NO: 109429 - RNA, 64 nt, Human
aguuuaucuaucggaagaacaugaaucucuaacagcuccauacuucuuucacuacucaaauggc

SEQ ID NO: 109430 - RNA, 64 nt, Human
ccccccaggccuuggugccucuuguaucccuagugcuccauaguuuggcauuugcacgguuucg

SEQ ID NO: 109431 - RNA, 64 nt, Human
uucaagagggacgguauuuaugaaucaggguuaggcuccauauuuaaagauagagccaguuuuu

SEQ ID NO: 109432 - RNA, 64 nt, Human
gucaugagcugaaggaucaugcuuuccuguccuggcuccauagguuauaggcuggcuggugaaa

SEQ ID NO: 109433 - RNA, 64 nt, Human
aacuuguuuacaacauuuuugcaaaucuaaaguugcuccauacaaugacuagucaccugggggg

SEQ ID NO: 109434 - RNA, 64 nt, Human
ggcuaguauauaccgagggggauacaaccguuuugcuccauacuaaaugacaaaaccauaaaaa

SEQ ID NO: 109435 - RNA, 64 nt, Human
ccauagcucuggcauccucagggguugugauccagcuccauauauuguuuaccuucaaagauac

SEQ ID NO: 109436 - RNA, 64 nt, Human
gcuugccucacuucugcuuaggaaagcggcuguugcuccauaacucuaaccagcacagggcuga

SEQ ID NO: 109437 - RNA, 64 nt, Human
auguucacgucuaagcguccagugugcacccagcgcuccauagacgccuuugugaacugaaaag

SEQ ID NO: 109438 - RNA, 64 nt, Human
agucccugccugaaucugggcuuugcaagcuccugcuccauauugguggacaugggaaugguug

SEQ ID NO: 109439 - RNA, 64 nt, Human
aggcaguccuggguguggacacgaugaagcaccggcuccauaagacaccuuuuggggaaguggu

SEQ ID NO: 109440 - RNA, 64 nt, Human
auuucaagcaaguucaaugaccuggucccuuagagcuccauaucccagucccagcccuucuuug

SEQ ID NO: 109441 - RNA, 64 nt, Human
ucugaaugaaaacauucuccagcugcucucuuuugcuccauauggugcuguucucuauguguuu

SEQ ID NO: 109442 - RNA, 64 nt, Human
gaaugauuaagggccuggcccccaggguuguccagcuccauaagguggagcugggcaagauuuu

SEQ ID NO: 109443 - RNA, 64 nt, Human
agagccuuucuaagaacaugauaggcuuacuucugcuccauaauaaagugggagaaaaaagcca

SEQ ID NO: 109444 - RNA, 64 nt, Human
ucaguggcuccgccgcauccucacacugacgggggcuccauacggaccuggggacugggcugag

SEQ ID NO: 109445 - RNA, 54 nt, Human
aaggucccagaaagagcuaacuuagcuccauauuugacagaaagauagaaagcu

SEQ ID NO: 109446 - RNA, 64 nt, Human
cagucaaccaauggcauccagagagggcauggaggcuccauacaaccucuuccacccccacauc

SEQ ID NO: 109447 - RNA, 64 nt, Human
aaacauacaugacaguucuugcuguguaacagaugcuccauaguaagccauaaguauuccugcu

SEQ ID NO: 109448 - RNA, 64 nt, Human
ucucauuacagccugggccgagcugguuaggugagcuccauaaaacccaaagggacuugguguc

SEQ ID NO: 109449 - RNA, 64 nt, Human
gaacauucuaugaauguaguaauuaaucuauuuugcuccauacaugcaacugcguuggcauuag

SEQ ID NO: 109450 - RNA, 64 nt, Human
agguuuuccaugagauucucuacacaggcaagaagcuccauagaaguggcauuugaagggugug

SEQ ID NO: 109451 - RNA, 64 nt, Human
gacacuuuuuuuuaaagcucauaaacugccaagagcuccauauauugggugugaguucagguug

SEQ ID NO: 109452 - RNA, 64 nt, Human
agaagagugccagggaccccucaaggagggagacgcuccauaucccagggcauaggacuugcag

SEQ ID NO: 109453 - RNA, 64 nt, Human
uugcuagcuugugagaagaaugaguugaugacaugcuccauaccaguggcuagauggaguauua

SEQ ID NO: 109454 - RNA, 64 nt, Human
uggucuuuucccuguucaucucccaacaugcugugcuccauagcugguaggagagggaaggcaa

SEQ ID NO: 109455 - RNA, 64 nt, Human
agaaaaugagcccaaccaguacaccaggaguggggcuccauaucagccccuaaggucaagccug

SEQ ID NO: 109456 - RNA, 64 nt, Human
ccuggguuccccacuggucugggaagacuguugugcuccauagagcagugcacaucugacccag

SEQ ID NO: 109457 - RNA, 64 nt, Human
uucugucuagucacugcugauuuucuaugucuuugcuccauacugcugggggaugggagagcca

SEQ ID NO: 109458 - RNA, 64 nt, Human
auaguuuucaauguauuaaugaagugauuaauuggcuccauauuuagacuaauaaaacauuaag

SEQ ID NO: 109459 - RNA, 64 nt, Human
gggcagcccccagaguccugugcauucugccaaggcuccauagcuuugccaaaugcacggagcu

SEQ ID NO: 109460 - RNA, 64 nt, Human
gaauuacaggucacaugaaaccaaaacgggcccugcuccauaagagcuuauauaucugaagcag

SEQ ID NO: 109461 - RNA, 64 nt, Human
uuauauuaucuuaauauuucggcuaaaauguuaagcuccauaacaugaauugauacaauuccaa

SEQ ID NO: 109462 - RNA, 64 nt, Human
uauuucagcaucucgggggguaauuuccggaagggcuccauacugucccaauaaggugaggcca

SEQ ID NO: 109463 - RNA, 64 nt, Human
gccgcccagcccaccccauggccggcuuucaggagcuccauacacacgcugccuucgguaccca

SEQ ID NO: 109464 - RNA, 59 nt, Human
ccgccagccgugagccguaagccggcguccccgcccagccgagagggccggcgccuacc

SEQ ID NO: 109465 - RNA, 64 nt, Human
ccuggcgggaccccgcagcagccccggccccauccccgcccagagccgggcgucgugugggucc

SEQ ID NO: 109466 - RNA, 64 nt, Human
ugggcauucaggaccuugaggacacgugaccccacccgcccaccgccacuaucaggccccggga

SEQ ID NO: 109467 - RNA, 64 nt, Human
ucuggcaggcgcacccaggagauggaauccccugcccgcccagcucaggcccagcuguccuagg

SEQ ID NO: 109468 - RNA, 64 nt, Human
ugcuggggcaagucccugacucucugugaccugccccgcccagcugcaccugccagccuggcuu

SEQ ID NO: 109469 - RNA, 64 nt, Human
gccuccuuuucuccuuauuccuccuaccucccgccccgcccaggucuggaguuacuuucauagc

SEQ ID NO: 109470 - RNA, 55 nt, Human
aggccugcggcugccacugagucagcccgcccagcccuacugcagccacccuucu

SEQ ID NO: 109471 - RNA, 64 nt, Human
uguucuauucaggccuucaacugauucagcaaggcccgcccacauuugggaggacagucugcau

SEQ ID NO: 109472 - RNA, 64 nt, Human
ucugaugaacacuacaguggcugaggcaucagcccccgcccaggcccuguagggacagcauuug

SEQ ID NO: 109473 - RNA, 59 nt, Human
uuuuggcccugccugcuuaagcccuccagcccgcccacugcccguugccuucgugcuuc

SEQ ID NO: 109474 - RNA, 64 nt, Human
uauaaccaccgcgucuccuccuccaccaccucaucccgcccaccuguguggggcugaccaaugc

SEQ ID NO: 109475 - RNA, 64 nt, Human
aucgcagcacuuuuaccacguuuuguccucagaccccgcccaugcuguguggucucugcauguc

SEQ ID NO: 109476 - RNA, 64 nt, Human
aaaagagaaaugugagcauccgcucccccaccaccccgcccagccccuagccccacucccugcc

SEQ ID NO: 109477 - RNA, 64 nt, Human
gaggcccgcaacccccagcgcugcgcuagagaaacccgcccagcccagagcgggcccgccccgc

SEQ ID NO: 109478 - RNA, 64 nt, Human
accgccaguugcacgccugccaccucagccagcccccgcccagcucaucagucugaauggaguu

SEQ ID NO: 109479 - RNA, 64 nt, Human
ccucccuccccagaccccagagggagaggcccaccccgcccagccccgccccagccccugcuca

SEQ ID NO: 109480 - RNA, 64 nt, Human
cgucgcugugcuugguguguaggacccuaggcuccccgcccacccucugccuggucgcgcucuu

SEQ ID NO: 109481 - RNA, 64 nt, Human
auagcccaaagggcugagccuccuggccugccugcccgcccacccugggagucccaguggugag

SEQ ID NO: 109482 - RNA, 64 nt, Human
gggagguacggucagcuuucaaaacaauaugccccccgcccaucccaugugugaggacauggug

SEQ ID NO: 109483 - RNA, 64 nt, Human
gggaccgucaucaucuaaaccugaagccgagcuccccgcccaccccugucgucccccuaagccc

SEQ ID NO: 109484 - RNA, 64 nt, Human
ugggugagcgcucuggcccaggcugggccagacucccgcccaagcaugaacaggacuugaccau

SEQ ID NO: 109485 - RNA, 64 nt, Human
gacuccuggugccccucgccagcuucuccugcgccccgcccacacccucggggggucacaggcc

SEQ ID NO: 109486 - RNA, 64 nt, Human
cugcccaaccccgcagccugggcuucgaaggcgacccgcccaccauccugcccuucccagaacc

SEQ ID NO: 109487 - RNA, 64 nt, Human
uucuaguugggggcuagucgcugaucugccggcucccgcccagccuguguggaaaggaggccca

SEQ ID NO: 109488 - RNA, 64 nt, Human
ugaaaggggcccaacccugcccacuucagcccagcccgcccaaggggacuugugccagcagaac

SEQ ID NO: 109489 - RNA, 64 nt, Human
ccauggccaaggucccagccgagagccccacgcucccgcccaccuuccccaguagcccaggccu

SEQ ID NO: 109490 - RNA, 64 nt, Human
ccgagaguacaccgguugcucuagccaccugcggcccgcccaucugcgcuagcuggccuucacg

SEQ ID NO: 109491 - RNA, 64 nt, Human
ugaauucacuccccacuucucuggaaccucaggacccgcccauuucucggcaguacugugaauu

SEQ ID NO: 109492 - RNA, 64 nt, Human
ggacaucaagugccuugcauagagcccccucuuccccgcccagcuuucccaggggcacagcucu

SEQ ID NO: 109493 - RNA, 64 nt, Human
ucuaaacguggucaccuucgaguagagaggcccgcccgcccaccgugggcagugccacccgcag

SEQ ID NO: 109494 - RNA, 64 nt, Human
uuucaggaaaagaggaggcucagaccauccagcccccgcccauauccugagguggaucaggcag

SEQ ID NO: 109495 - RNA, 64 nt, Human
gcauccccucccucuuccugguggccaccucccucccgcccacccacucucaccccaaacaaaa

SEQ ID NO: 109496 - RNA, 64 nt, Human; identical to SEQ ID NO: 109491

SEQ ID NO: 109497 - RNA, 64 nt, Human
auuauuuuauccccucccccaccgccucgcugcccccgcccaguuucguuuucguugccuuuuu

SEQ ID NO: 109498 - RNA, 64 nt, Human
acuaggauuaccccagggccaucugugcuccaugcccgcccauccccuugccgccugacugggu

SEQ ID NO: 109499 - RNA, 64 nt, Human
cuaucaggaggacugaaugguguccagccuggugcccgcccaccccgccaggcugcacucgguc

SEQ ID NO: 109500 - RNA, 64 nt, Human
cggguggaucaugaggucaggaguucgagaccagcccgcccaauauggugaaaccccgucucuc

SEQ ID NO: 109501 - RNA, 64 nt, Human
gaacugggagcaggguagggcugucgccuuagaucccgcccaagccccucauucccuccuugca

SEQ ID NO: 109502 - RNA, 64 nt, Human
gaagaccaccuaaauaucacuugcucugccacugcccgcccagcccccauggucuucuggaagg

SEQ ID NO: 109503 - RNA, 64 nt, Human
aucuagagcauggagccucuagaagccaugcucacccgcccacauuuaauuaacagcugagucc

SEQ ID NO: 109504 - RNA, 64 nt, Human
ccuggcucccacccagacauggaccagccaugcacccgcccagccaccacgucccccgcaugaa

SEQ ID NO: 109505 - RNA, 64 nt, Human
cuagaguuuagccuuuuuaaaaaugugacuuuaacccgcccaccuguguccucccauuggcgug

SEQ ID NO: 109506 - RNA, 64 nt, Human
aggaccaccagcagggggcugccucugcacccuacccgcccaaggagacuccacccuggggucc

SEQ ID NO: 109507 - RNA, 64 nt, Human
ggcgacaggcaccacccccucugauaaauccaagcccgcccaggcccacggggggcccacggga

SEQ ID NO: 109508 - RNA, 64 nt, Human
uggccaggguggggcuccgagccccgggucaccgcccgcccagcguuccaggcacaugaagaga

SEQ ID NO: 109509 - RNA, 64 nt, Human
acacgccaagucccguuucgcacucggcuucucacccgcccagcucggcuagggagggggaguu

SEQ ID NO: 109510 - RNA, 64 nt, Human
cugugggggggcuuggccugauggugggcggggccccgcccacagggccgaccccaauacacca

SEQ ID NO: 109511 - RNA, 64 nt, Human
uugaucuaucguggccugcucgucgcaguccaaacccgcccaagacugcagcccaaucaacgcc

SEQ ID NO: 109512 - RNA, 64 nt, Human
ucgcaggaccaucccggccggcgcgcucaucccacccgcccaccgcagggugaacugcagcgag

SEQ ID NO: 109513 - RNA, 64 nt, Human
cucagacuucaagaccauccuggacugauggccacccgcccacagccaggccgagagcagacac

SEQ ID NO: 109514 - RNA, 64 nt, Human
gccgggcgcccgggccuuugcuaucucgccgucgcccgcccacgcacccacccguauuuauguu

SEQ ID NO: 109515 - RNA, 64 nt, Human
ucgucacugccguccccggagggccagauacggccccgcccaaaggguucugccuggcgucggg

SEQ ID NO: 109516 - RNA, 64 nt, Human
ccccccucuacccgccaccccaccccaccccacccccgcccacucguugccugauuccguuucc

SEQ ID NO: 109517 - RNA, 51 nt, Human
aguacaccaguuccaagugagcccgcccaccgcggaacguucggucagucu

SEQ ID NO: 109518 - RNA, 64 nt, Human
cucagggcuuuaaggcugcccuuguaauagacgucacggccaagcucacagcuauugacaacca

SEQ ID NO: 109519 - RNA, 64 nt, Human
aggcucuugcaaagacccgagauucucauaaauccccgcccagaagagcugcacguaucccuuu

SEQ ID NO: 109520 - RNA, 64 nt, Human
agcaguuuuccccuggccucaguucccagcuccccccgcccacccacgcauacacacaugcccu

SEQ ID NO: 109521 - RNA, 64 nt, Human
ugggaacaggcgagauggaacagggauuuaacuccccgcccacagguccaugggagcuugaggc

SEQ ID NO: 109522 - RNA, 64 nt, Human
gggcuauuccuuuccuccaaugaaccaaacgccucccgcccaccuccaggucccaguccucugu

SEQ ID NO: 109523 - RNA, 64 nt, Human
auauucuggaaggggaaccacaguuucaccaucgcccgcccauucuacuacucaaccccucccc

SEQ ID NO: 109524 - RNA, 64 nt, Human
gugugucccuguggcccgcagccugcccgccugccccgcccaucugccgugugucuugcccgcc

SEQ ID NO: 109525 - RNA, 64 nt, Human
agucccugccagcccccaggagcgccuccagggccccgcccacucucccaccccugaagcugca

SEQ ID NO: 109526 - RNA, 64 nt, Human
gaaugcuggaguaaaauauccccucuccccuccgcccgcccacccgcccgcccgcucgcccgcu

SEQ ID NO: 109527 - RNA, 64 nt, Human
ccaucucucugcagugcccuccucgccugugcagcccgcccacccacaggcucaccccuccugc

SEQ ID NO: 109528 - RNA, 56 nt, Human
ccauccucgcaggccucugagccagccccgcccacugccagggacgccgagggccu

SEQ ID NO: 109529 - RNA, 64 nt, Human
gcgagagugugcccucugagacagcccuguccgccccgcccaggugggaccugacauacaggcg

SEQ ID NO: 109530 - RNA, 64 nt, Human
gaaagaggaggcaaauggcacugcaggugagaaccccgcccauccgugcuaugacauggaggca

SEQ ID NO: 109531 - RNA, 64 nt, Human
ccuagcacagugcagccuccauaaccaugacauucccgcccaagcucucagugccuaauccugc

SEQ ID NO: 109532 - RNA, 64 nt, Human
cccuagauuccagccaccaagcggaagcaugagacccgcccacacuagccucuguguucccguu

SEQ ID NO: 109533 - RNA, 64 nt, Human
uccgaaggaacuguacucccccugcccuccccgacccgcccagcuuagccgaugaccugcacau

SEQ ID NO: 109534 - RNA, 64 nt, Human
ccgccgccccccaucaugucugccagggugcucccccgcccaucacccucccggggccccucca

SEQ ID NO: 109535 - RNA, 64 nt, Human
gugcguccucccugcacucauacccccccuucaacccgcccaaauguccgauccccgaccuucc

SEQ ID NO: 109536 - RNA, 64 nt, Human
ggggagcgguggcacucgugggagggagaggacccccgcccacauccuccuuccccaggaccug

SEQ ID NO: 109537 - RNA, 64 nt, Human
ugaaagucaguguugcugugcaugcgcugauggaguagacgagugagcuuuuccgugccucucc

SEQ ID NO: 109538 - RNA, 64 nt, Human
agggccagcgucuugagcccucgaucagacgccucccgcccaccgcggccgcuucuccacgcuu

SEQ ID NO: 109539 - RNA, 62 nt, Human
aacacacagguaacuuauaaaauaauuacuuucccgcccagugagugauguuuggaaaugcg

SEQ ID NO: 109540 - RNA, 64 nt, Human
ugagaccuguaagcugucccgcgggccccggcaccccgcccagcugugcacuuugcucacucgc

SEQ ID NO: 109541 - RNA, 64 nt, Human
ccugaccagcagacucaccucccaagaacgccugcccgcccacccgccuuaggacucccgaugc

SEQ ID NO: 109542 - RNA, 54 nt, Human
ucuugagccuccgacuguagaguccccgcccacccccauggcccuaugcggccc

SEQ ID NO: 109543 - RNA, 56 nt, Human
gcaucuaccacagcagcugagugcugcccgcccaccugggccugguccuagcccug

SEQ ID NO: 109544 - RNA, 64 nt, Human
uauuuauguucaugguugauuguaccuucccaagcccgcccagugggaugggaggaggaggaga

SEQ ID NO: 109545 - RNA, 64 nt, Human
uuggucagacccuagccagggaccggacaccugccccgcccaggcugggacaggcugcaggucu

SEQ ID NO: 109546 - RNA, 50 nt, Human
cgcagcugcaggaguccugacccgcccagacuguccccagacucccccga

SEQ ID NO: 109547 - RNA, 64 nt, Human
agagacugcccacccugggccucccguccguccgcccgcccaccccgcugccuggcgggcagcc

SEQ ID NO: 109548 - RNA, 64 nt, Human
uccccaaagugccugccaaaccccagggccuggccccgcccagucccgcaguacauccccuguc

SEQ ID NO: 109549 - RNA, 64 nt, Human
agggaggugaaagcuggugugagcccaguggguucccgcccacucacccaggagcuggcugggc

SEQ ID NO: 109550 - RNA, 64 nt, Human
ucaggcccaagcagaccccgggcuccaccccagccccgcccaggcugcugccagugcacacuuu

SEQ ID NO: 109551 - RNA, 64 nt, Human
ucucucuccagcaugcucccugcggcccugcccucccgcccagcccgggccaccucguggggga

SEQ ID NO: 109552 - RNA, 64 nt, Human
gcagguccauacagcauggguggcaggguuuggacccgcccagcagcaccacggaccccagcca

SEQ ID NO: 109553 - RNA, 64 nt, Human
cagcgacaacgaggaggugguggcuggcccggcccccgcccacgccaaggagggcuugcggcac

SEQ ID NO: 109554 - RNA, 64 nt, Human
cugccaucgcucucccacccagcuuggcccccugcccgcccaccucccugggagccgggccugu

SEQ ID NO: 109555 - RNA, 64 nt, Human
caacgaaggcgccaucuaggccgcgcuggcugcacccgcccaggcccgcacccgcccagucccg

SEQ ID NO: 109556 - RNA, 64 nt, Human
uaggccgcgcuggcugcacccgcccaggcccgcacccgcccagucccgagggcccggcccuguc

SEQ ID NO: 109557 - RNA, 64 nt, Human
ccccugccuccccuccaccccugccucuccuccacccgcccaggagagccccaccuccuccacc

SEQ ID NO: 109558 - RNA, 64 nt, Human
accgaauacgcacucuugaaagcugcaucgagaacccgcccaagcgccaccugcuagacggcca

SEQ ID NO: 109559 - RNA, 64 nt, Human
ccuaggagucuuugccuucauaaauuuuaagaaccccgcccacaacagggaguuaaacuggagg

SEQ ID NO: 109560 - RNA, 64 nt, Human
cuuggcucaggauguguucugggcuugcaagccccccgcccaaucauguguucaguagccgucc

SEQ ID NO: 109561 - RNA, 52 nt, Human
uagacuacuccuacacaugaugcccgcccacccgggcugccccgccucagcc

SEQ ID NO: 109562 - RNA, 64 nt, Human
augcuccguguccagaaguaagccagcuguggaucccgcccacucagaaaaggcgagaaggcuu

SEQ ID NO: 109563 - RNA, 64 nt, Human
aucccggccuuaugcacugccccucccacccggccccgcccaggcacggccgaccccgccccgg

SEQ ID NO: 109564 - RNA, 50 nt, Human
gcagugccaacggccucugacccgcccacccgccuuuuauaaaccucuaa

SEQ ID NO: 109565 - RNA, 64 nt, Human
cagugugccccccauccuggcccaucaguguacccccgcccaggcuggccagccccacagccca

SEQ ID NO: 109566 - RNA, 64 nt, Human
gggugugacccugucugccguggcccaggacucgcccgcccaccugccuucagccugcuugccu

SEQ ID NO: 109567 - RNA, 64 nt, Human
agaggccacugugaugccacugucuccucuccaucccgcccagccaugugacacuggcucccgg

SEQ ID NO: 109568 - RNA, 64 nt, Human
uacucuccauuuaggccuguugauaacuccauuacccgcccaucacugcuguuccuccagggcc

SEQ ID NO: 109569 - RNA, 64 nt, Human
ccagcggccccucccacacacacccacacacucgcccgcccacuguccugggcgcccuggaagc

SEQ ID NO: 109570 - RNA, 64 nt, Human
cccaacccaauucaggacuggcucaccccucucccccgcccaaggcugcagaggcugugggagg

SEQ ID NO: 109571 - RNA, 64 nt, Human
ugggcggggcaacggcuccccauuuuucccgagccccgcccacagagcucuuagccaauccuau

SEQ ID NO: 109572 - RNA, 64 nt, Human
ggagcuggggaauccccucgcuucauaggcagagcccgcccaccugggcccuaggcauacucuc

SEQ ID NO: 109573 - RNA, 64 nt, Human
gcuggagcuccaccucccucuugguuucuccgcacccgcccauuuuccuucugucuuuaccugc

SEQ ID NO: 109574 - RNA, 64 nt, Human
gcagugaguacccgcaugguaucagccugccucucccgcccacgcccugcugucuccaggccua

SEQ ID NO: 109575 - RNA, 64 nt, Human
ccggaauccacagugcucugcuucucugugucgccccgcccagcccccugguguggagggaggg

SEQ ID NO: 109576 - RNA, 64 nt, Human
accucccccaaugucuucaagacuuuucucuccccccgcccaaccccgucucucccucccuugc

SEQ ID NO: 109577 - RNA, 56 nt, Human
acagcccggccuccaccugaccguggcccgcccagccacucccgggaccacggcaa

SEQ ID NO: 109578 - RNA, 64 nt, Human
caggugcacuguggacgugggucugggggucucacccgcccagcgagagcagaaccaauccagu

SEQ ID NO: 109579 - RNA, 64 nt, Human
aaccuaugaaucucuaaggcucuggaaccaucugcccgcccaccaugcccuugggaccugguuc

SEQ ID NO: 109580 - RNA, 64 nt, Human
cuccucugguggagagguccucagccagagcucgcccgcccaagagccaagagagaugucaucu

SEQ ID NO: 109581 - RNA, 64 nt, Human
cgcccaacuucccuacuggcugcuccccuugggucccgcccaccagcggacucggcccccaagg

SEQ ID NO: 109582 - RNA, 52 nt, Human
ggguggugcccggcauguaagccccgcccaccccacggaggccacagccaca

SEQ ID NO: 109583 - RNA, 64 nt, Human
aaagugcuuggauuacagguguaagccaccgcaccccgcccagccuggcagauuuuauuuaauc

SEQ ID NO: 109584 - RNA, 64 nt, Human
cgccucuuccgcucccugccaucagucaaggccgcccgcccacguuucuacgccuuucuacuuc

SEQ ID NO: 109585 - RNA, 64 nt, Human
gcuagcacugaagacuauuuuucuauugguauaacccgcccaccugaaggggaaagggaaauca

SEQ ID NO: 109586 - RNA, 63 nt, Human
cccugcuggacaaggucugacgcccaccgccggcccgcccacuccuaccacaaggacuuugcc

SEQ ID NO: 109587 - RNA, 64 nt, Human
uccacaucuuuuccuuuggcuuccaaagucaggucccgcccacccugccuaaggaacugcagag

SEQ ID NO: 109588 - RNA, 64 nt, Human
caggcaggacgagacuccucgggcaagggccgugcccgcccaccucugcugcccacggccaccc

SEQ ID NO: 109589 - RNA, 64 nt, Human
gcuguggccccuucagacaaugggcagugcccaccccgcccacuggcaucugcgugugagggcu

SEQ ID NO: 109590 - RNA, 64 nt, Human
caccugcugucagccuggcuaugccgccaccggccccgcccaugaggacuaggagcccagccuu

SEQ ID NO: 109591 - RNA, 64 nt, Human
gccgcccccaccugcggccgccccccgccccucgcccgcccacacggccccuucccagccagcc

SEQ ID NO: 109592 - RNA, 64 nt, Human
gcccuuccuggccuggauggugucucccagcuuccccgcccagcuugcccaccccauaguuggu

SEQ ID NO: 109593 - RNA, 64 nt, Human
gugggagcucaaaucccucaccccacccccuggccccgcccaccucacaggaacuguucaguuc

SEQ ID NO: 109594 - RNA, 64 nt, Human
caacuuggcccgcagcaggccagaccccccuacccccgcccagagcucaguagccagccugggu

SEQ ID NO: 109595 - RNA, 64 nt, Human
uccugaaggugcagucccaccuguacagccccuccccgcccagaacugugaauggccugcucca

SEQ ID NO: 109596 - RNA, 64 nt, Human
cccacccccaagguucuccaacaucacagcccagcccgcccacuggguaauaaaagugguuugu

SEQ ID NO: 109597 - RNA, 64 nt, Human
cugucaggggcuuggauuucgugugccgcugccacccgcccacccgccuugugagauggaauug

SEQ ID NO: 109598 - RNA, 64 nt, Human
gagcuugacaucaauguuagagggucucuuacuccccgcccagcugugauguuucaucugcuuu

SEQ ID NO: 109599 - RNA, 64 nt, Human
ccugcaugggugaggggacacccugggccucucucccgcccagcauccucccugaguccccaca

SEQ ID NO: 109600 - RNA, 64 nt, Human
ccgacagaggacgcuugagccagaaucucaggaccccgcccagggagcugccagcccagggcuc

SEQ ID NO: 109601 - RNA, 64 nt, Human
gcugugggggcgggagcagccucagugucaagggcccgcccacugacccagccguaccuauucg

SEQ ID NO: 109602 - RNA, 64 nt, Human
gcuugggggaggcugcucauuaagugccugccugcccgcccaccccucggcgccaugcucccgc

SEQ ID NO: 109603 - RNA, 64 nt, Human
cguggggacccagcuccaugcacgucaacccagucccgcccagacuaguggacagaccuggugu

SEQ ID NO: 109604 - RNA, 64 nt, Human
acguuggccuaacacugggcugcagagacuggaccccgcccagcauugggcugggcucgccaca

SEQ ID NO: 109605 - RNA, 64 nt, Human
ggaaaugggcagagcagagaccaucccugaaggccccgcccaggcuuagucacugagacagccc

SEQ ID NO: 109606 - RNA, 64 nt, Human
gauuccugaaggccagagcucugacaggcggugccccgcccaugcuggauaggaccugggaugc

SEQ ID NO: 109607 - RNA, 64 nt, Human
aguccccuuuaggguucccggagcuccgggaagacccgcccaucccaggacuccagaugccagg

SEQ ID NO: 109608 - RNA, 64 nt, Human
ggagccccuugagcagagcucugcacccagccugcccgcccacaccauccugcugguccuccca

SEQ ID NO: 109609 - RNA, 64 nt, Human
gacggccucaggccccgccuccaaggcaucaggccccgcccaacggccucauguccccgccccc

SEQ ID NO: 109610 - RNA, 63 nt, Human
ggcagaugccccauacgugacugcucggcuccccccgcccaccccgccgccucuaauuuauag

SEQ ID NO: 109611 - RNA, 64 nt, Human
uuauacauacccucgcugccaggcugcucagagucccgcccacauaugagacaggcacuggcug

SEQ ID NO: 109612 - RNA, 64 nt, Human
cagccugaguccguagccccgccccggcgcuggucccgcccacccagacaccgcccacuucccg

SEQ ID NO: 109613 - RNA, 64 nt, Human
ccagcaccacuucccccuucuccacccucuacuucccgcccaguggggcuggaauguggcccag

SEQ ID NO: 109614 - RNA, 64 nt, Human
gauugcaagagcuaauaggaacaaauacucuccccccgcccacccccauugguuuuaaugcuga

SEQ ID NO: 109615 - RNA, 64 nt, Human
gccccaccccagaggccacaccccaggccgggcccccgcccaucgcugcagcugccaugugagu

SEQ ID NO: 109616 - RNA, 64 nt, Human
ggcccaggcuccagccacaggcaccucuccugcccccgcccacccuccugaccgcagcucccag

SEQ ID NO: 109617 - RNA, 64 nt, Human
aaguauccucagaaauguauucugcacccccggccccgcccaugcugagggaaggggagcaguu

SEQ ID NO: 109618 - RNA, 64 nt, Human
ugcaccaugggcaggguugaggacugccccccaccccgcccaagccaaugcagacacugaccuc

SEQ ID NO: 109619 - RNA, 64 nt, Human
ggaacaaaccgugcggaacgcguccaggggccuucccgcccagccuuugccagaucucucgugc

SEQ ID NO: 109620 - RNA, 64 nt, Human
agaucgugaagaaguaacggcgccugccgggccucccgcccaccugccucgucucccuggggag

SEQ ID NO: 109621 - RNA, 64 nt, Human
gaagguugagcucuccggcuuccagggagaccuccccgcccagcagcccccagagacacaacaa

SEQ ID NO: 109622 - RNA, 64 nt, Human
ccgaaccugugccuaauacacgcaagggcgcugucccgcccaaccccgccuuuaaacgccacaa

SEQ ID NO: 109623 - RNA, 64 nt, Human
gggacggccgccccuccucggacagccagcugcacccgcccacccagcggcgacauuguacaga

SEQ ID NO: 109624 - RNA, 64 nt, Human
ggccuguggugcagacaggagcuguguggacagucccgcccaggaggggccgcagggcguguau

SEQ ID NO: 109625 - RNA, 64 nt, Human
augacgggggaggcccguccgccuggcccaccaacccgcccaccuugacugcccccagaagugu

SEQ ID NO: 109626 - RNA, 64 nt, Human
ccagggccuggaccagaccauugugauaccugaccccgcccaccugggaguguggcuuuggguu

SEQ ID NO: 109627 - RNA, 64 nt, Human
gaucccuccacgcagcggccggagccagacuagccccgcccaccaacgagucccggcuucgagu

SEQ ID NO: 109628 - RNA, 64 nt, Human
gguauccucagaaauguauucugcaccccccggccccgcccaugcugagggaaggggagcaguu

SEQ ID NO: 109629 - RNA, 64 nt, Human
cugugugacaccacagggcggagucuguggaggccccgcccaccuccucuugucaauggcccca

SEQ ID NO: 109630 - RNA, 64 nt, Human
cggucccuguucaauaagccaaagacccuggugccccgcccagaccccugggcugacguccaga

SEQ ID NO: 109631 - RNA, 64 nt, Human
cuguccccgugccagggaaccgggguugaccgcccccgcccagcccgcgcuauauauuuguaca

SEQ ID NO: 109632 - RNA, 51 nt, Human
gcagcgccuuccagcccugagcccgcccagaggagcccagcggcccaagag

SEQ ID NO: 109633 - RNA, 64 nt, Human
cccugacuaaagauugucuuaaguagcagcccagcccgcccagccccagguggguaguggggag

SEQ ID NO: 109634 - RNA, 64 nt, Human
cacccaaguggcccccacccucagcccgcuccugcccgcccagcacccccaggcccugggggac

SEQ ID NO: 109635 - RNA, 64 nt, Human
cgggacugacccccucucuuaaaacacauucccgcccgcccacaggccugaggucugggaccuu

SEQ ID NO: 109636 - RNA, 64 nt, Human
ggaugccuagggggacggcgaugggccucacgggcccgcccagcacccugagaccacacuguug

SEQ ID NO: 109637 - RNA, 64 nt, Human
gggcugcgggcuggcgaaggaaauggucacaccccccgcccaccccaggcgaggauccugguga

SEQ ID NO: 109638 - RNA, 64 nt, Human
uuuuggucugcacccacccccccacccccccccccccgcccacaugcuccccagcuugcaggag

SEQ ID NO: 109639 - RNA, 64 nt, Human
ggaauaguggaggccuucaacugauuagacaaggcccgcccacaucuuggagggcaucugccuu

SEQ ID NO: 109640 - RNA, 64 nt, Human
ucucccugcaggugacccgcgccgcccccgcccgcccgcccacgcuguccuccacuuaggcucc

SEQ ID NO: 109641 - RNA, 64 nt, Human
caaugugaauuaucaaauucuccucaaugccccccccgcccaguccuuugcugcuauccacugu

SEQ ID NO: 109642 - RNA, 64 nt, Human
cucugcccacccgagccccaccacucucagaacccccgcccagcgcacggcgaccucgcgccuc

SEQ ID NO: 109643 - RNA, 64 nt, Human
cggguggggguguggccgagccccggcaggaagccccgcccagacgguguucagggaacccgga

SEQ ID NO: 109644 - RNA, 64 nt, Human
cagacgcacacacacaacagaugcgcagcaacuccccgcccagggaccccucccggccucccuc

SEQ ID NO: 109645 - RNA, 64 nt, Human
ggugguggcggggggucuugggggccucucagcucccgcccaugccucccugaugggugggccc

SEQ ID NO: 109646 - RNA, 50 nt, Human
cggcugaagcccugcaguaacccgcccagccucccgcggggccacacacu

SEQ ID NO: 109647 - RNA, 64 nt, Human
ccucacucagccggggcccucccaccuccaacgccccgcccacgccgcggccaccgggcccacg

SEQ ID NO: 109648 - RNA, 60 nt, Human
acaugaaacggcacauguagccgggacgcccccgcccaccugcgcgcggccguggcgggu

SEQ ID NO: 109649 - RNA, 64 nt, Human
ccuccagccccgccucccccguacaggcagagcgcccgcccaccucuaugcugcguucuccuga

SEQ ID NO: 109650 - RNA, 64 nt, Human
aacgcugagucaggcugaguggacugaggccugccccgcccagacugcccaggcagagggcagg

SEQ ID NO: 109651 - RNA, 64 nt, Human
cgcgaggccgcgagccgggccguccacccacccgcccgcccagggcugggcugggaucggaggc

SEQ ID NO: 109652 - RNA, 64 nt, Human
cccaggccagccagccugccugccugccugccugcccgcccagagcuguggggaugaguguccc

SEQ ID NO: 109653 - RNA, 64 nt, Human
gaaccagguuccugcccggucagcgcagccccagcccgcccaccccugccucgaguuaguuuua

SEQ ID NO: 109654 - RNA, 64 nt, Human
ccggcccuuccagauucgccugugagcgaugaggcccgcccaugcggguugcuacguccccuuc

SEQ ID NO: 109655 - RNA, 54 nt, Human
cccagccuggcugcacuugagguucccgcccaggaaggugaguggggcaccugg

SEQ ID NO: 109656 - RNA, 64 nt, Human
ccgcuucuaccagcugacugccccggcccggccucccgcccauggggucuccugccauggcccc

SEQ ID NO: 109657 - RNA, 64 nt, Human
cccgugcccgccugcggcgggggcacccagcaagcccgcccaccgcccgcugccucaccugcuu

SEQ ID NO: 109658 - RNA, 58 nt, Human
acccgcacuccuccuccugaggccggaccccgcccaggcagggagcugcugugagucc

SEQ ID NO: 109659 - RNA, 64 nt, Human
ugaguggcccgcgggccccagugaggcacuuugucccgcccagcgcuggccagccccgaggagc

SEQ ID NO: 109660 - RNA, 64 nt, Human
cugcccagggcuccccaacuauaggccugggacccccgcccagcuuggggggcugcucguacga

SEQ ID NO: 109661 - RNA, 64 nt, Human
ugcacaccaggcugcugcuuuguccgucuauccacccgcccacccgcccccaccccaccggcag

SEQ ID NO: 109662 - RNA, 51 nt, Human
agaaaaggcacaacugcugaccccgcccagugcccuggagccgcgcccauu

SEQ ID NO: 109663 - RNA, 64 nt, Human
cagaaaccagcacuccaugaagauaaacucugggcccgcccaccagcaggaccugucgaccuga

SEQ ID NO: 109664 - RNA, 64 nt, Human
ccucuacuugcgcugcucggcccagccuggggggcccgcccagcccucccuggccucuccacug

SEQ ID NO: 109665 - RNA, 64 nt, Human
uguggguauucaccacccugggaccccccccccccccgcccaccagaccuguucugaccucaug

SEQ ID NO: 109666 - RNA, 52 nt, Human
gccaguucuccgagggcugagccccgcccagcuccccuccacaauaaacgcu

SEQ ID NO: 109667 - RNA, 64 nt, Human
gggagggacgucuucuauuuuuugcugcccccuccccgcccacugucuggggcagggggagaag

SEQ ID NO: 109668 - RNA, 64 nt, Human
acggagcagggagagcucaccauggaaugaaccccccgcccaugcuguccggccugggaaaccc

SEQ ID NO: 109669 - RNA, 64 nt, Human
accuugacuuggcagcauggagccaaggucuguccccgcccaggagggugccuuccucgggggu

SEQ ID NO: 109670 - RNA, 64 nt, Human
ugcucuuucaccugggugucugggcucaagcuuucccgcccagccucacuuccuuugcccuucc

SEQ ID NO: 109671 - RNA, 64 nt, Human
gccccucgcccugccgucggggcgcggcugcucacccgcccagcacacgccggggccccaggac

SEQ ID NO: 109672 - RNA, 64 nt, Human
ugugcuucccuccaucugaaaucucaucccuccacccgcccacucgggcagcugugccgugggc

SEQ ID NO: 109673 - RNA, 63 nt, Human
ccugcgugucccuccucugacgccccgugugcucccgcccagccugcugaggccuccgcucag

SEQ ID NO: 109674 - RNA, 64 nt, Human
gagaccgcgcuggcccucugcuaaagcccgggcacccgcccagccgggcugggcccucccugcc

SEQ ID NO: 109675 - RNA, 64 nt, Human
uugugucuguuuccgaggggccuggaccguagcccccgcccagcuggcccucucugaccuuggg

SEQ ID NO: 109676 - RNA, 64 nt, Human
acccaaagccgaaggacagguggccuggaaagaucccgcccaggucugggagccccaggcuggc

SEQ ID NO: 109677 - RNA, 64 nt, Human
ccacccgggaacccgccgcacgcuguguucuaggcccgcccaccccaaccuucugguggggaga

SEQ ID NO: 109678 - RNA, 64 nt, Human
agaagcuccuggagauugccaccaagcccacguacccgcccaugaacccaauuccagcaccguu

SEQ ID NO: 109679 - RNA, 64 nt, Human
ugaagcccugagaagccagugccaucauccccaccccgcccaggguuccggaacauucauuccc

SEQ ID NO: 109680 - RNA, 64 nt, Human
ccagcacgccugccggcuucucaucgucagggagcccgcccagagcucgugacgagcaagugcu

SEQ ID NO: 109681 - RNA, 54 nt, Human
gcaacagccuggcugaguagaggucccgcccagcugcagacccuccaggcugga

SEQ ID NO: 109682 - RNA, 64 nt, Human
ccucugccaccccgguccagggaagaggcucgcucccgcccauggucaucacuggucugucugc

SEQ ID NO: 109683 - RNA, 64 nt, Human
aaaagaaacaguuugggaagaaaaggaaaagaaucccgcccacuaagacgcgaccccucagaca

SEQ ID NO: 109684 - RNA, 64 nt, Human
uccacucgccucggacuucacccguucucugccgcccgcccacuccguuucccugugguccgug

SEQ ID NO: 109685 - RNA, 64 nt, Human
gccagcacacccuuagccuccagcaccccccgcccccgcccaggccaucaccacagcugcagcc

SEQ ID NO: 109686 - RNA, 64 nt, Human
aaugcccaaggcauggcaugguggcagcugugcccccgcccauugcuuuggagcacagaugacu

SEQ ID NO: 109687 - RNA, 64 nt, Human
uuccccaccucaaucccggcauccagccuucagucccgcccacgugcuagcuccgugggcccac

SEQ ID NO: 109688 - RNA, 64 nt, Human
cccggcccuaaagggggcccugucgccaccaccccccgcccagccccugcccccagccugugug

SEQ ID NO: 109689 - RNA, 64 nt, Human
ggaagacgcagaacaacagaaauagccgccccuccccgcccacugugccuguuggccuaucaua

SEQ ID NO: 109690 - RNA, 64 nt, Human
cccuccccugcuggcgcugcuccgcccugugccccccgcccaucgccccccacccaucucugga

SEQ ID NO: 109691 - RNA, 64 nt, Human
aacgccgggcacagaccaaagaccgcgguccagccccgcccaggcgggcaucucauggcagugc

SEQ ID NO: 109692 - RNA, 64 nt, Human
ugaccgccgguggguguguccccgcucccgucgucccgcccaccucaaaccccgcaggugugcc

SEQ ID NO: 109693 - RNA, 64 nt, Human
agcccacggcucccucgacucuggggcacggaaccccgcccacucccaauccccgcgccccgcc

SEQ ID NO: 109694 - RNA, 52 nt, Human
cagcccgccuugugccuuaggccccgcccaagccaccagggagccaaucuca

SEQ ID NO: 109695 - RNA, 64 nt, Human
agccagccacagcuggaucugaugucuugucugccccgcccagcuuugcauauccauguucuac

SEQ ID NO: 109696 - RNA, 64 nt, Human
gguaucgccugcaugaggucugccuccuacccaucccgcccaccggggcuuuggccaccucucc

SEQ ID NO: 109697 - RNA, 64 nt, Human
augcuguaugcuugaacuucggaaaaugcuuuuccccgcccaaucuucucucaaauauaaacac

SEQ ID NO: 109698 - RNA, 64 nt, Human
gggugggcggguagggggguggccaucccugcuacccgcccaccccugagucccuugacuuuug

SEQ ID NO: 109699 - RNA, 64 nt, Human
ugaccagacaagcuguugaccaggcaccuccccucccgcccaaaccuuucccccauguggucgu

SEQ ID NO: 109700 - RNA, 64 nt, Human
ucaugaagaagacuaagccuacuucaucucaggacccgcccaagaguggccgcggcuuugggac

SEQ ID NO: 109701 - RNA, 64 nt, Human
cacguugggcucacaggaggagcacaggcucuuggguggcgaagccagcccaggauccauuacc

SEQ ID NO: 109702 - RNA, 64 nt, Human
ccuccaaggggaagggagaagaggggaccaucgagguggcgaguguggacacccugccaggacu

SEQ ID NO: 109703 - RNA, 64 nt, Human
agauacuuugcugauucccagcugaggggagcaugguggcgauugcucagccauuuucugacag

SEQ ID NO: 109704 - RNA, 58 nt, Human
caaugaagauacgaaacugagacaucaggguggcgacucuauagacucuaggacauaa

SEQ ID NO: 109705 - RNA, 64 nt, Human
aaaaggcuggaggcaagguggugacaggcagcaggguggcgacauggagagagggaagcucaau

SEQ ID NO: 109706 - RNA, 64 nt, Human
uguucagaccacuggagaggauagagagguaaaagguggcgacaguuucccuuaggggucugcc

SEQ ID NO: 109707 - RNA, 64 nt, Human
cgccuuguccgucagugccagugccugugccagagguggcgaggugaguccuccagagcuuccu

SEQ ID NO: 109708 - RNA, 64 nt, Human
ugagacuggaccugggugagcgugggggguggaggguggcgaggugcggagacugcagaccagu

SEQ ID NO: 109709 - RNA, 64 nt, Human
ggccacccucuguucucaccugugaguucuugcagguggcgacuucaucugcaaggucacuuac

SEQ ID NO: 109710 - RNA, 64 nt, Human
agggcugcccagggccaggcucacaguacaggaggguggcgaggccccucccucacuggcacgc

SEQ ID NO: 109711 - RNA, 64 nt, Human
gguggaaaaucagucaugauuacaaaccuacagagguggcgaguauguaacacaagagcuuaau

SEQ ID NO: 109712 - RNA, 64 nt, Human
ccgccccacaaggccgcggagccucagcaggagggguggcgaguugcgggugggcagggccagg

SEQ ID NO: 109713 - RNA, 64 nt, Human
cucucugucagcaauagugaccucauuaccaagggguggcgaccacauuaccaagcgcaauucc

SEQ ID NO: 109714 - RNA, 64 nt, Human
guggagagggcgaugaauuaagaguagugggguggguggcgaguaaguaaaauuucaaauagca

SEQ ID NO: 109715 - RNA, 64 nt, Human
uuuugaaguuccugcgagaaauggaugguggaaggguggcgaauguucaaauucauaugugugg

SEQ ID NO: 109716 - RNA, 64 nt, Human
gucccguuugaugagaggcuguuuacuggggugggguggcgagaugggcuugagggggcucaga

SEQ ID NO: 109717 - RNA, 64 nt, Human
gcccagaauucucagugacgugggggugaggguggguggcgauugccuuagagggaaccccuaa

SEQ ID NO: 109718 - RNA, 64 nt, Human
cccugggaacugagaggugccagcaauugcugaagguggcgaugaacacccgaaggugggaggg

SEQ ID NO: 109719 - RNA, 64 nt, Human
uuuccacuaaaaauacaaaaaauuagcugggcgugguggcgagcgccuguagucccagcuacuc

SEQ ID NO: 109720 - RNA, 64 nt, Human
gagcccacacaugggaucaaguccugcaagcagagguggcgauuuguuaaagggccaaaaguau

SEQ ID NO: 109721 - RNA, 64 nt, Human
cuucccuggggccacggacaucagcaguggguuggguggcgauuauaucaucugugaucccaag

SEQ ID NO: 109722 - RNA, 64 nt, Human
ggccaaggcccgauguggugugcagagguggggagguggcgaggauggggacagaaagcgcaca

SEQ ID NO: 109723 - RNA, 64 nt, Human
ucacuucagacaauucagaagcaucaccaugcaugguggcgaaugcccccaaacucucccccaa

SEQ ID NO: 109724 - RNA, 64 nt, Human
aggcuuccaucgauuggguaguguccuucaaguggguggcgaagagccagucgggcauauguca

SEQ ID NO: 109725 - RNA, 64 nt, Human
uugggacccgcuucccaccugcugcggucaccaugguggcgagcacagcaaccccaggugucca

SEQ ID NO: 109726 - RNA, 64 nt, Human
ggugguggccuggggcaccggccaggugggccucgguggcgagguggucguucuggcaaaggcg

SEQ ID NO: 109727 - RNA, 64 nt, Human
accacggcugggcgucugugccaggccucccgaagguggcgauggugagcagcagggguccugg

SEQ ID NO: 109728 - RNA, 64 nt, Human
cccugcuguccaaaacaccacugcuuccuacccagguggcgacugccccccacaccuucccugc

SEQ ID NO: 109729 - RNA, 64 nt, Human
ugccgagcagccaaggcccuguccuuucuugaaugguggcgagcugaaucuggucgguuuccua

SEQ ID NO: 109730 - RNA, 64 nt, Human
cccuccuguucaaaacaccacugcuuccuacccagguggcgacugccccccacaccuucccugc

SEQ ID NO: 109731 - RNA, 64 nt, Human
caguaaagcuaccacucuggcugcuagacagcuugguggcgagggagaugacuccuuguagcug

SEQ ID NO: 109732 - RNA, 64 nt, Human
gucuccgcuaaaaauacgaaaauuagccaggcgugguggcgagcaccugucaucccagcuacuu

SEQ ID NO: 109733 - RNA, 64 nt, Human
uugggaugggggugagcgugcaauggaggcuggggguggcgaggugccgccuuggccgggcccc

SEQ ID NO: 109734 - RNA, 64 nt, Human
ccuggugcugagagaccugagucugcaugugcacgguggcgagaagguacgcgugggguaggcg

SEQ ID NO: 109735 - RNA, 64 nt, Human
gucaucugugccgccccuggugcggacggggccugguggcgagcccaagugguugccuccuacg

SEQ ID NO: 109736 - RNA, 64 nt, Human
cuggccccuucguggguauugugugaaaugagaugguggcgaggggugcgcuguggaacugccg

SEQ ID NO: 109737 - RNA, 56 nt, Human
accccuacgugugggacugagucagcgguggcgaggagaggcgggcggauuugggg

SEQ ID NO: 109738 - RNA, 64 nt, Human
caccugcuuuccgggcggcacugugaugggagcugguggcgacugaguccuucuguacgugcaa

SEQ ID NO: 109739 - RNA, 64 nt, Human
gccccuggcuuugugcaaggccggaucugggccagguggcgaaaggggcccagucguucuuggg

SEQ ID NO: 109740 - RNA, 64 nt, Human
ugggguuauuggagccugagcuugaccucaaacggguggcgauuugauggguacccccaggcug

SEQ ID NO: 109741 - RNA, 63 nt, Human
aggacaugaaggagaacugagugacccagaagggguggcgaaggcacagcucagagacauaaa

SEQ ID NO: 109742 - RNA, 64 nt, Human
aaggacaugaaggagaacugagugacccagaagggguggcgaaggcacagcucagagacauaaa

SEQ ID NO: 109743 - RNA, 64 nt, Human
ucuuguuuccucugccgaggagaagacgggccucgguggcgaccauuaccucgacacccgcuaa

SEQ ID NO: 109744 - RNA, 64 nt, Human
acaggagauggugauaccagaagucaaggguugggguggcgacacggccucccgaggaagaggu

SEQ ID NO: 109745 - RNA, 64 nt, Human
aaaauucacaguggcgauuagcggacuggagucugguggcgauuagcggacuggagucugggga

SEQ ID NO: 109746 - RNA, 64 nt, Human
uuggguuaauucuucggugacacuggcguugcuggguggcgaugcccguccucuggcuuggguu

SEQ ID NO: 109747 - RNA, 64 nt, Human
cugcaugagcauguggccuccccgucccuuccccgguggcgaacccagugacccagggacacgu

SEQ ID NO: 109748 - RNA, 64 nt, Human
acucuacuaaaaauauaagaaauuagccggacaugguggcgaaugacuguaaucccagcuacuc

SEQ ID NO: 109749 - RNA, 64 nt, Human
ccgauguccccacugauggcucugacaccguguugguggcgaugucccagacaaucccaccagg

SEQ ID NO: 109750 - RNA, 64 nt, Human
ggagcgggagcgcaaggaggagcugcguggcggcgguggcgacauggcggagcccuccgaggcg

SEQ ID NO: 109751 - RNA, 64 nt, Human
cacccagaccggcugcugcgcccccuccugccaggguggcgauuccgcuccacagucucggacg

SEQ ID NO: 109752 - RNA, 64 nt, Human
cguuuugaccaaaauauagaaauuagccuggugugguggcgagugccuguaaucccagcuauuc

SEQ ID NO: 109753 - RNA, 64 nt, Human
acuggugcaccuugcuggcacggugccucaggaagguggcgacucaggugggccuugaguuaua

SEQ ID NO: 109754 - RNA, 64 nt, Human
cugaaugcuggagagauguuauguaauaugcugagguggcgaccucaguggagaaauguaaaga

SEQ ID NO: 109755 - RNA, 64 nt, Human
agaaauucauuguuuggcccauccugaaaggugagguggcgagacaguggggugccuccgugcc

SEQ ID NO: 109756 - RNA, 64 nt, Human
cugaaccgcccgcugcucggcggaucccagcugcgguggcgacggcgggaaggcgcuuuccgcu

SEQ ID NO: 109757 - RNA, 64 nt, Human
aucucuacuaaaaauacgaaaauuagccgggcaugguggcgagugccuguaaucuuagcuacuc

SEQ ID NO: 109758 - RNA, 64 nt, Human
ucggcuaccaccuguuccagaggugcagacaagagguggcgagagcccccaucaugccccucaa

SEQ ID NO: 109759 - RNA, 64 nt, Human
ggucagccaaaccccuggcacccccagggugacggguggcgagcuguuugaccgcaucauggag

SEQ ID NO: 109760 - RNA, 64 nt, Human
gaagaccucgggccaugcggccuggggaggacuugguggcgauccgcaaccuggaccccaguga

SEQ ID NO: 109761 - RNA, 64 nt, Human
gcggguacccuugcucagaugccuggcagggcuggguggcgauucauaaagaccucguguugau

SEQ ID NO: 109762 - RNA, 64 nt, Human
gccuuugaguguuagagaaaggagugaaggaggcaggugggaaaugguauuucuauuuuuaaau

SEQ ID NO: 109763 - RNA, 64 nt, Human
ugcacaccuguagucccagcuauucuccaggcugaggugggaggaucgcuugagcccaagaggu

SEQ ID NO: 109764 - RNA, 64 nt, Human
gagacaugaacaacaggagggagggaaagagcccaggugggacgugggacaggcuuaggggaaa

SEQ ID NO: 109765 - RNA, 64 nt, Human
uaucuuggguacuugagcagacgguauauuccagaggugggaggugggaggggaagggagaaau

SEQ ID NO: 109766 - RNA, 64 nt, Human
gguacuugagcagacgguauauuccagaggugggaggugggaggggaagggagaaauccaaaac

SEQ ID NO: 109767 - RNA, 64 nt, Human
gggccuagguuucuggacugcaaaggggacccccaggugggaggggcaggaagcagccggagug

SEQ ID NO: 109768 - RNA, 64 nt, Human
cuuagcucuugggggugggccuggaaggacugaaaggugggauuagagucaggccagaaagaga

SEQ ID NO: 109769 - RNA, 64 nt, Human
gugaugagaagagaauggagagaauuugaauaaaaggugggaaaggagagcacuguucuuugau

SEQ ID NO: 109770 - RNA, 64 nt, Human
gaugaaaaaacuggggccauuggaggcccacuguaggugggagggagcugauuuuggggugggg

SEQ ID NO: 109771 - RNA, 64 nt, Human
ugccagaagcugugucucucauugggcuccaaagaggugggauuuuuuaaaacuaaaacauuuc

SEQ ID NO: 109772 - RNA, 64 nt, Human
cucacgccuguaaucucaacacuuugggaggccaaggugggaagaucacuugaucccaggaauu

SEQ ID NO: 109773 - RNA, 64 nt, Human
uuaauuuuguggcaguuuucuaaaacugacaaccaggugggaccaaaguuuaugugccuuuagu

SEQ ID NO: 109774 - RNA, 64 nt, Human
aauggaaaugugaguuccugcgaacgcugaaucuaggugggacgcuugccuugaacaucauggu

SEQ ID NO: 109775 - RNA, 64 nt, Human
gucuggggcaacaaguaaugccuugaaggccaggaggugggagugaggagcccauacucagccu

SEQ ID NO: 109776 - RNA, 64 nt, Human
gucuggggcaacaaguagggccuugaaggccaggaggugggagugaggagcccauacucagccu

SEQ ID NO: 109777 - RNA, 64 nt, Human; identical to SEQ ID NO: 109776

SEQ ID NO: 109778 - RNA, 64 nt, Human
uguguuacacuaaaaaccaguccucucuaaucucaggugggacuuggcgcucucucuuuucugc

SEQ ID NO: 109779 - RNA, 64 nt, Human
caggcaccuaugguuccagcuacucaggaggcugaggugggaggaucgcuugugccuuggaggu

SEQ ID NO: 109780 - RNA, 64 nt, Human
cuguucacccuggugguguacggaugaggcggggaggugggacccccaaacauauaucagccca

SEQ ID NO: 109781 - RNA, 64 nt, Human
ccucaacaccucugcacaagcugcacccucaggcaggugggauggauuuccagccaaagccucc

SEQ ID NO: 109782 - RNA, 64 nt, Human
agugugccugaagucccagauacuuggggggcugaggugggaggaucucuugagccugggaggu

SEQ ID NO: 109783 - RNA, 64 nt, Human
cucacgccuguaauccuagcacuuugggaggccaaggugggaggauugcuugagcucaggaguu

SEQ ID NO: 109784 - RNA, 64 nt, Human
ugcacgccuguggucccagcuauucaggaggcugaggugggaggaucauuugagcccagaggua

SEQ ID NO: 109785 - RNA, 64 nt, Human
uuucuguauuuuauuuagacaagagaugggaaugaggugggagguggaagaagggagaagaaag

SEQ ID NO: 109786 - RNA, 64 nt, Human
cugguaagggaccuucagggagagcugggcagacaggugggagauggagguagggcuggcugga

SEQ ID NO: 109787 - RNA, 64 nt, Human
caugcgcauguagucccagcuacucagaaggaugaggugggaggaucucuugaggcugggaggc

SEQ ID NO: 109788 - RNA, 64 nt, Human
uuuuaagacuucugaucuccugcccugcaggaauaggugggaagucauugaauuuuuacacuau

SEQ ID NO: 109789 - RNA, 64 nt, Human
ugcacaccuguggucccagcuacuugggaggcugaggugggaaaaucacuugaaccugggaggg

SEQ ID NO: 109790 - RNA, 64 nt, Human
cugggacaaaaguaauuuggaagcccaguuccuuaggugggauaggaaugaaagccuaaaccuc

SEQ ID NO: 109791 - RNA, 64 nt, Human
ggaaagaagaauucagaugucagugggagccuccaggugggaggagagcaugccuaaacccugg

SEQ ID NO: 109792 - RNA, 64 nt, Human
agaagaucaaguuacagucuguuuuuaaaaccauaggugggacagcuauggccaauaggcuaua

SEQ ID NO: 109793 - RNA, 64 nt, Human
aaaaguauaguaucgaguacccguucccucccagaggugggaguaacugcugguagugccuucu

SEQ ID NO: 109794 - RNA, 64 nt, Human
uguuccaaaaaccuaggcaaagaguauauguaggaggugggauaucacuuccaugacauaagug

SEQ ID NO: 109795 - RNA, 64 nt, Human
aauuuagguguaauauagaaaacugucccuuuccaggugggagcuuaacaccuguauaaaaccu

SEQ ID NO: 109796 - RNA, 64 nt, Human
cacaugccuguaaucccagcuacaugggaggcugaggugggagaauugcuugaacccaggaggc

SEQ ID NO: 109797 - RNA, 64 nt, Human
ucccggcggccucuccggcuucccuaaagagagcaggugggacuuucuacaacgcugcugugca

SEQ ID NO: 109798 - RNA, 64 nt, Human
aggaggagugacugggaagccucccaugccaaggaggugggaggugcccuggaaauagcugccu

SEQ ID NO: 109799 - RNA, 64 nt, Human
auuguggaaccauggggacuuggggguggggcagaggugggaacauuuguaucaguugagucag

SEQ ID NO: 109800 - RNA, 64 nt, Human
accccugagcaucccucuggacucagagggaacaaggugggagagagaguuugagacagcuccg

SEQ ID NO: 109801 - RNA, 64 nt, Human
uuuauggcuguaaucugcaaacucugggaggcugaggugggagaaucgcuuaaccccagaaguu

SEQ ID NO: 109802 - RNA, 64 nt, Human
caggugccuguaaucccggcuauucagaaggccgaggugggagaauccguugaaccugggaggc

SEQ ID NO: 109803 - RNA, 64 nt, Human
gcaugaggccccugccucuucugucauuguucaaaggugggaagagagccuggaaaagaaccag

SEQ ID NO: 109804 - RNA, 64 nt, Human
uuaacuguuuacaaagcccuuucacgugcacagcaggugggaacugcgcggugugggcugggcc

SEQ ID NO: 109805 - RNA, 64 nt, Human
gagagauagcacagauggaccaaagguuaugcacaggugggagucuuuuguauauaguuguaaa

SEQ ID NO: 109806 - RNA, 64 nt, Human
uauaguugggggacaggggucuggguuuggcuccaggugggaacaaggccugguaaaguuguuu

SEQ ID NO: 109807 - RNA, 64 nt, Human
cauauaccuguaauccuagcuauucaaggggcugaggugggaggaucgccugagcccaggaguu

SEQ ID NO: 109808 - RNA, 64 nt, Human
ugcccucacuaguguugaagccuguuccagagagaggugggacugcaaggagaggauggucagc

SEQ ID NO: 109809 - RNA, 64 nt, Human
gguuguccugccccuuggcucuaucccugcccagaggugggaacuggaggagugggcugcaaga

SEQ ID NO: 109810 - RNA, 64 nt, Human
cucacgccuguaaucucggcacuuugggagacugaggugggagcaucacuugagaccaggaguu

SEQ ID NO: 109811 - RNA, 64 nt, Human
ugaauucauuuuaucuucauuaucccugugaaguaggugggacaaguauaaggggaagaggggu

SEQ ID NO: 109812 - RNA, 64 nt, Human
gcucugcagcaggggcuggggaguggacagcaucaggugggaaaguggaguccacccucauguu

SEQ ID NO: 109813 - RNA, 64 nt, Human
ugcucaugcauagucccagcuacccaggaggcugaggugggaggaucacuugagcccaggaauu

SEQ ID NO: 109814 - RNA, 64 nt, Human
caagggauuuuuacauccuugauuacuuccacugaggugggagcaucuccagugcuccccaauu

SEQ ID NO: 109815 - RNA, 64 nt, Human
cagugugacccuccuuuaugggaggaucaggaccaggugggaacaaaggaggcucagagaagaa

SEQ ID NO: 109816 - RNA, 64 nt, Human
uaccaugggugcugugacacuaacagucauugagaggugggaggaagucccuuuuccuuggacu

SEQ ID NO: 109817 - RNA, 64 nt, Human
cccuugccuguagucucagcacuuugggaggcugaggugggagggucgcuugaguucaggaguu

SEQ ID NO: 109818 - RNA, 64 nt, Human
ccccuaaauaggucaggugagggaggcugggaagaggugggaggaggggcagaagugaaggaag

SEQ ID NO: 109819 - RNA, 64 nt, Human
gacagcuuuacaaguauuagugcaugcucagaacaggugggacuaaaacaaacucaaggaacug

SEQ ID NO: 109820 - RNA, 64 nt, Human
caaaaucuaguaccagcuacggccagaaagggccaggugggaccugaaagcaaagacaauguuc

SEQ ID NO: 109821 - RNA, 64 nt, Human
aggcagcuccuguuuggaaauggggagcuggccuaggugggagccaccacuccugccugccccc

SEQ ID NO: 109822 - RNA, 64 nt, Human
uguauaccuguagucccugcuacuugggaggcucaggugggaggaucacuugagccccaaagau

SEQ ID NO: 109823 - RNA, 64 nt, Human
ccccaaaccugcccuuucuccccugcagacuggcaggugggauuggcucccaggucauuuccuc

SEQ ID NO: 109824 - RNA, 64 nt, Human
aauuuaaaacaaaggccugugccucccacccaggaggugggagggugaauuuuauguuuaaaug

SEQ ID NO: 109825 - RNA, 64 nt, Human
cccugugugcuagugucugggaaguuucccugaaaggugggaggcggguggguggucuuuugga

SEQ ID NO: 109826 - RNA, 64 nt, Human
caacccaaugcgaaguauuugggugagaacugagaggugggagaugauuggaggccauggccua

SEQ ID NO: 109827 - RNA, 64 nt, Human
cacgugucuguaaucccagcuacucuggagacugaggugggagaaucgcuugagacugggaggc

SEQ ID NO: 109828 - RNA, 64 nt, Human
cuccaccuccuuccaaguccagcucaggcccaggaggugggagaaggucacagagccucaggaa

SEQ ID NO: 109829 - RNA, 64 nt, Human
aaguaaagugagacuuggguggugggaagaaggaaggugggaagaaggaauuagacacucugcc

SEQ ID NO: 109830 - RNA, 64 nt, Human
uggcgccgcaggggucacgcaugguccagcccucaggugggagggaaguccuuguuggcagagg

SEQ ID NO: 109831 - RNA, 64 nt, Human
aaccuugugacugaaaacuugaaaagaguggagcaggugggaccucuuauucucaaauagugac

SEQ ID NO: 109832 - RNA, 64 nt, Human
uuccucagggaagaaucucacuugacuagagaggaggugggaacagaagagagaaggaggcagg

SEQ ID NO: 109833 - RNA, 64 nt, Human
acgugccugggagucccagcgacuugggaggcugaggugggaggauuguuugagccugggaggu

SEQ ID NO: 109834 - RNA, 64 nt, Human
ugccaccagggagcuuccuggcucugggggacccaggugggacuuagcagugaguauuggaaga

SEQ ID NO: 109835 - RNA, 64 nt, Human
ugcgcgccuguggucccagcugcucgggaggcugaggugggaggaucacuugagccuuggaggu

SEQ ID NO: 109836 - RNA, 64 nt, Human
aauuauaccuagcaacauauuauaguaaaaaaugaggugggagggcuggaucuuuucccccacc

SEQ ID NO: 109837 - RNA, 64 nt, Human
ucuuuaaugagcauggaaccugagcaaagggaauaggugggaugaauuuuuuuuuuaauuguga

SEQ ID NO: 109838 - RNA, 53 nt, Human
ucugcaaguucaaggacuagggcaggugggaagucagcagccugagcuuggcg

SEQ ID NO: 109839 - RNA, 64 nt, Human
uccaguguaucccacugggagugaauggaucaugaggugggauggccccaucuggauguucugc

SEQ ID NO: 109840 - RNA, 64 nt, Human
cucacaccuguaaccucagcacuuugggaggcagaggugggaggaucacuuagguccaggaguu

SEQ ID NO: 109841 - RNA, 64 nt, Human
gagcucucccuuccuccuccuccuccuccuccggaggugggaucccagagccugccaguggagg

SEQ ID NO: 109842 - RNA, 64 nt, Human
ugugcaucuauagucccugcuauuugagaggcugaggugggaggaucauuugagugcaggaguu

SEQ ID NO: 109843 - RNA, 64 nt, Human
cacaccccuguagucccagcuacuugggaggcugaggugggaggauugcuugaacccaagaggu

SEQ ID NO: 109844 - RNA, 64 nt, Human
cacaugccuguaguuccagcuacucaggaggcugaggugggagaaucuccugagccuggaaggu

SEQ ID NO: 109845 - RNA, 64 nt, Human
ucccuggccaaguccgcagggcccuccuagagccaggugggaguggggagcgauccgcagcugc

SEQ ID NO: 109846 - RNA, 64 nt, Human
auggccaccccagaggccaccuuuugcuccacggaggugggagaaaaucugggcacauggggcc

SEQ ID NO: 109847 - RNA, 64 nt, Human
caaaauguugaauaucagggcauuuuuuuuucugaggugggaguaugucacucacagcaaacuu

SEQ ID NO: 109848 - RNA, 64 nt, Human
cccuaucuagacuuaggagcucaguuugggauggaggugggagaacaaaaaugaauagggauuu

SEQ ID NO: 109849 - RNA, 64 nt, Human
guccacguuuuugugacucuucaagcuguuggugaggugggacgaaugcacuugcuuccugugg

SEQ ID NO: 109850 - RNA, 64 nt, Human
uggguaccuguauucccaguuacuugggaggcugaggugggaggaucuuuugaacccaggaguu

SEQ ID NO: 109851 - RNA, 64 nt, Human
cucaugucuauaaucccagcacuuugggagguugaggugggaggauugcuugaacccaagaggu

SEQ ID NO: 109852 - RNA, 64 nt, Human
cauccuucaccggugccuuugggggaucuguaggaggugggaccuucugugggguuuggggauc

SEQ ID NO: 109853 - RNA, 64 nt, Human
ugaggagggagagaaggaggccgccagacucgagaggugggaggaacuccuugcacacacccug

SEQ ID NO: 109854 - RNA, 64 nt, Human
gggagaccaccccggccgcggcgccucaguggacaggugggaggaaaagaaaacuucuuaccuu

SEQ ID NO: 109855 - RNA, 64 nt, Human
gacuaggcagaggugaggcuggcucacccugaagaggugggauaggaccgggggaccccagagg

SEQ ID NO: 109856 - RNA, 64 nt, Human
aggggcuacaagagggaauccccgaaggugcuggaggugggagcaggagauugagaaggagaga

SEQ ID NO: 109857 - RNA, 64 nt, Human
gugagagccugugaguccuagcuaccuggaggugaggugggaacaucacuugagcccaggaguu

SEQ ID NO: 109858 - RNA, 64 nt, Human
uuaaaaaaugguuuuuuguuuuuuuguuuuuuugaggugggagaggaugugugaaaaucuuuuc

SEQ ID NO: 109859 - RNA, 64 nt, Human
uaacaaaaaauaguaacaauaccuugcagaggaaaggugggagagaggaaaaaaggaaauucua

SEQ ID NO: 109860 - RNA, 64 nt, Human
gucccagggaaagagaaaacucgcccuaggcccuaggugggaagaugguuugaaauuuuuguaa

SEQ ID NO: 109861 - RNA, 64 nt, Human
agcaggggagcuccuuuuucuaguuugccuguagaggugggaagacuguugguguuucuguccu

SEQ ID NO: 109862 - RNA, 64 nt, Human
accaauccucccgagugcaaugcuaaacacuuccaggugggaauucaucuauuucacuuaacac

SEQ ID NO: 109863 - RNA, 64 nt, Human
gcucagcuucuaaucccagcacuuugguaggcaaaggugggaggaucauuugagcucaggaguu

SEQ ID NO: 109864 - RNA, 64 nt, Human
cucacaccuauaaucccaacacuuugggaggccgaggugggaggaucacuugagcacaggaguu

SEQ ID NO: 109865 - RNA, 64 nt, Human
ugcaugccuguagucccagcuacuuuggagacugaggugggaguaccccuugagccugggaggc

SEQ ID NO: 109866 - RNA, 64 nt, Human
ucuucccuugugccucauguaugggcaggaggaaaggugggagggggagugggaauaugcgugu

SEQ ID NO: 109867 - RNA, 64 nt, Human
ccuucuuauuuuaaaugcaugggaacagaaugacaggugggaugcugaggagcugguugaagca

SEQ ID NO: 109868 - RNA, 64 nt, Human
cagggcugccacggcaaccgccaagccccccucaaggugggacaguaccccggacccauccacu

SEQ ID NO: 109869 - RNA, 64 nt, Human
cucacuccuguaauccgagcaauuugggaggccaaggugggaguuuugcuugaggccagagguu

SEQ ID NO: 109870 - RNA, 64 nt, Human
ccacuggagacgccucucccugcagucccccgagaggugggagacucgcggaaggccccguccc

SEQ ID NO: 109871 - RNA, 64 nt, Human
acgagcauacuuguaccuuugucucugggcaaacaggugggacuguuagugacccauuugggaa

SEQ ID NO: 109872 - RNA, 64 nt, Human
cccugcagggcagggaccccuugggaaaucgaggaggugggacgggcugggcccugugucccag

SEQ ID NO: 109873 - RNA, 64 nt, Human
gcgaguccagacaccaucaccacgcagagaggggaggugggaggacaguuagaccccugggugg

SEQ ID NO: 109874 - RNA, 64 nt, Human
cuaggucuccaggugggccugguucccaggcagcaggugggaacccugggccuggaugugaggg

SEQ ID NO: 109875 - RNA, 64 nt, Human
cucaugccuguaaucccagcacuuugggaggcugaggugggaggauugcuugaguccaggaguu

SEQ ID NO: 109876 - RNA, 64 nt, Human
cacguuuuucuagguacagcucccaggaacagcuaggugggaaagucccaucacugagggagcc

SEQ ID NO: 109877 - RNA, 64 nt, Human
aaaggaaaacugcuggagggagguggagggaggaaggugggaauuauuauuuaauacaucauua

SEQ ID NO: 109878 - RNA, 64 nt, Human
gaccauucccuacuugcuuuuccuuggaucacuaaggugggagaguaggaguaacuuauuccag

SEQ ID NO: 109879 - RNA, 64 nt, Human
cucacuccuguagucccaggacuuugggaggccgaggugggaagaucccuugagcccaggaguu

SEQ ID NO: 109880 - RNA, 64 nt, Human
uacuguacucugagaggaauguuuccagaaauggaggugggagcuuagggaaugcagagccuac

SEQ ID NO: 109881 - RNA, 64 nt, Human
acaaucuggcaaacccuuggcccaaagacucaccaggugggacguggcaggcaggccucaguug

SEQ ID NO: 109882 - RNA, 64 nt, Human
cccgacccaaagggugacuuuucaucugaacuuaaggugggagauauuuuuaacuuuuuuccac

SEQ ID NO: 109883 - RNA, 64 nt, Human
gggccauucuccaaaggaccugaaagagcaaaagaggugggagcgaaagccuuaaggaucccac

SEQ ID NO: 109884 - RNA, 64 nt, Human
ugacaagugaguuagguugggcugaugggauagaaggugggaggggaaugcuauacagcuggga

SEQ ID NO: 109885 - RNA, 64 nt, Human
uccucaaaauugagauggaucaauauguaaggggaggugggagcguguguggaagggggagaga

SEQ ID NO: 109886 - RNA, 64 nt, Human
uacugggagaaaugacuuugaaaaccuggcucuaaggugggaucacuaagggauggggcagucu

SEQ ID NO: 109887 - RNA, 64 nt, Human
uggcuggccucacgauggggccgucccgggagccaggugggagcugccuuccacugccaucggg

SEQ ID NO: 109888 - RNA, 64 nt, Human
ucuugaguggugaccaaagcaguuggcucuuaaaaggugggagagcagcccaaccaauccccaa

SEQ ID NO: 109889 - RNA, 64 nt, Human
ccuacaccuguagucccagcauuccgggaggcugaggugggaggaucacuugagcccagggagg

SEQ ID NO: 109890 - RNA, 64 nt, Human
gcucuuucuuccucuucagagaucaucagaaaagaggugggaauacacaagcaggugcauguaa

SEQ ID NO: 109891 - RNA, 64 nt, Human
acacacgcagcagagguuucccuugaagugcaagaggugggagaucaggcuguuccuuugcugc

SEQ ID NO: 109892 - RNA, 64 nt, Human
caaccaagcuucaauauuuuucuaaagaaauuacaggugggauaugcuagaaaaggcauuuugg

SEQ ID NO: 109893 - RNA, 64 nt, Human
uucgcgucuguagucccagcuauuugggaagcugaggugggaggaucucgagccugcgagauca

SEQ ID NO: 109894 - RNA, 64 nt, Human
uccaagcaggacuaggugcccugcauuccacccaaggugggauuggccuuccuuaggcuggcua

SEQ ID NO: 109895 - RNA, 64 nt, Human
caugugccuguggucccagcuacucaggaggcugaggugggaaaaucacuugagcccaggaggu

SEQ ID NO: 109896 - RNA, 64 nt, Human
cagagggagcccaugggcuguuugaauuugggagaggugggauucauuacaagacuuugggcuc

SEQ ID NO: 109897 - RNA, 64 nt, Human
aaagagauucuguugguugacugccuaaagagaaaggugggauggccuucagauuauaccagcu

SEQ ID NO: 109898 - RNA, 64 nt, Human
acuccagcaccagguggaaguccauauggacaacaggugggaguuuuggggccuccagggcagc

SEQ ID NO: 109899 - RNA, 64 nt, Human
ggguauguugagaaacauccugaggcaaggugggaggugggauggggcaggacuuucccuucca

SEQ ID NO: 109900 - RNA, 64 nt, Human
caugaagggguauguugagaaacauccugaggcaaggugggaggugggauggggcaggacuuuc

SEQ ID NO: 109901 - RNA, 64 nt, Human
gaaagcacauauauuaaugcagucaucccuuuucaggugggaagagagcaaaccaguugauuuu

SEQ ID NO: 109902 - RNA, 64 nt, Human
cuggacuagcauuuguuuagcaccaacaaauaaaaggugggaugggggaucugccugaagcagg

SEQ ID NO: 109903 - RNA, 64 nt, Human
uguauauuuuaaagcagagacuauuuugguggauaggugggagggagcaaggggaguuugaggg

SEQ ID NO: 109904 - RNA, 64 nt, Human
guucaagcaauucuccugccucagccucccaaguaggugggacuacaggugcccgccaccacac

SEQ ID NO: 109905 - RNA, 64 nt, Human
uggcagugugagugcaacucauuuaucuucugugaggugggauuuuuguguuccucacacccau

SEQ ID NO: 109906 - RNA, 64 nt, Human
cucacaccuguaauuccagcacuucaggaggccaaggugggaagaucauuugaguucaggaguu

SEQ ID NO: 109907 - RNA, 64 nt, Human
ugugcauaggcacaagugggccagggcuggagggaggugggaaaccucaucauccggugggccc

SEQ ID NO: 109908 - RNA, 64 nt, Human
aacagaaaaccaaacaccgcauguucucacucauaggugggaauugaacaaugagaacacuugg

SEQ ID NO: 109909 - RNA, 64 nt, Human
augaguaaggguaagggcgcauggaauggggcuaaggugggagugaacacuggggugaauaaau

SEQ ID NO: 109910 - RNA, 64 nt, Human
gugaagaaaauaguuugaguagcagcagugcuauaggugggaaauacaguuuagcugcugaauu

SEQ ID NO: 109911 - RNA, 64 nt, Human
aaguucucuuuuguguuuucugcugguauucuggaggugggaaggacuuggagagaguuaagaa

SEQ ID NO: 109912 - RNA, 64 nt, Human
gggguaaguuagcugaagucauuuaaagauggaaaggugggaaaauucuuugauauuugauguc

SEQ ID NO: 109913 - RNA, 64 nt, Human
cguguacauguggucucagauacuugggaggcugaggugggaggguugaucacuugaggcugag

SEQ ID NO: 109914 - RNA, 64 nt, Human
ugcuggcuaccgauuaaauucauuagugugaaagaggugggagugagguuuucuggccugaagc

SEQ ID NO: 109915 - RNA, 64 nt, Human
gccagagguugggagaaggauugcagguugggagaggugggaaauagcagugaauuuuagucau

SEQ ID NO: 109916 - RNA, 64 nt, Human
cgugcaccuauagucccagcuauucaggaggcugaggugggaggauugcuugagcccagcaggu

SEQ ID NO: 109917 - RNA, 64 nt, Human
cccggcugcgagagagggagacacccggaggagcaggugggaagaugaagccggccagagcccc

SEQ ID NO: 109918 - RNA, 64 nt, Human
auuauuuauuuguuuguuuauugugagauauuucaggugggaucaaagaggucauaagaauuua

SEQ ID NO: 109919 - RNA, 64 nt, Human
cacgugccuguagucccagcuacaugggaggcugaggugggaggaucacuugagcccaggaagu

SEQ ID NO: 109920 - RNA, 64 nt, Human
caaaccuguaguuacagaaaaaguuuuaugcuagaggugggaugccaaguuuucacuauccaug

SEQ ID NO: 109921 - RNA, 64 nt, Human
cucacaccuguaauccaagcacuuugggaggccaaggugggagcaucacuugauccugggaguu

SEQ ID NO: 109922 - RNA, 64 nt, Human
uguguuccuguagucccagcuccccaggaggcugaggugggagguuggcuuuaacccaggaggc

SEQ ID NO: 109923 - RNA, 64 nt, Human
caccuggguuuacucaagggugugcauucauuuuaggugggaucgccacaggauuucauguuau

SEQ ID NO: 109924 - RNA, 64 nt, Human
cugacaccugcaaucccaacauuuugggaggccaaggugggagggucccuuccuugagcccagc

SEQ ID NO: 109925 - RNA, 64 nt, Human
cccugggggcuccuguaugcaggacuccugaaggaggugggagcugagggcccuggaggauggg

SEQ ID NO: 109926 - RNA, 64 nt, Human
gaguucaggagaggguucuggaccacagauguugaggugggagucauuagugaauagaugaugu

SEQ ID NO: 109927 - RNA, 64 nt, Human
ccuaugcuuguagucacagcuacucgggaggccgaggugggagggucuucugagcccagggagg

SEQ ID NO: 109928 - RNA, 64 nt, Human
ugggcugauuuuuauuaccaggucccccagaagcaggugggaggcucugcuuccugcugccgcu

SEQ ID NO: 109929 - RNA, 64 nt, Human
ugggacugcgagugcugacgccaccuuccugcugaggugggacugggcccuggacacaccccuc

SEQ ID NO: 109930 - RNA, 64 nt, Human
ugcaugccuguagucccagcuacucgggaggcugaggugggaggaucccgugagccugggaggu

SEQ ID NO: 109931 - RNA, 64 nt, Human
ggcuuuccucauccccuggcaaacauugucaccaaggugggauguugcugcuaaugggagaguc

SEQ ID NO: 109932 - RNA, 64 nt, Human
uguacaugguacgaauggcagcauacacagaugaaggugggaaggaugguccagaauucacuuu

SEQ ID NO: 109933 - RNA, 64 nt, Human
uucaagcaauucuccugccucggccuccuuuaguaggugggauuacaggugcauaccaccacac

SEQ ID NO: 109934 - RNA, 64 nt, Human
aaagaaaaaaaaaauccccuucacuccuacugggaggugggaccccuuucauuuucaguuuugc

SEQ ID NO: 109935 - RNA, 64 nt, Human
aggcccacccccagaguuugauacaguagaccucaggugggacccaaaaauuugcauuucuaac

SEQ ID NO: 109936 - RNA, 56 nt, Human
augcagaggcccacaaguagcagggcaggugggaacgggacugcuugcugccucuc

SEQ ID NO: 109937 - RNA, 64 nt, Human
cuuccugggccccuccuugccacaucaugagcugaggugggaccacaguccccaggcugcaucg

SEQ ID NO: 109938 - RNA, 64 nt, Human
cugcaggcucccacaugagggagagggcagacucaggugggaagaugugccaugcguaaggcau

SEQ ID NO: 109939 - RNA, 64 nt, Human
cucacagcuauaaucucagcacuuugggaggcugaggugggagaauugccugagcccaggaguu

SEQ ID NO: 109940 - RNA, 64 nt, Human
cacacaucuguggucccaggugcucaggaagcugaggugggaggaucacuugagcccaauucaa

SEQ ID NO: 109941 - RNA, 64 nt, Human
caucugccuuaaaaaaacacggaagcacaguuggaggugggacgaugagacuuugaaacuaucu

SEQ ID NO: 109942 - RNA, 64 nt, Human
aauggugcuguuauuacucugucuugaaauaggaaggugggauuucuggggaggcuggugaagg

SEQ ID NO: 109943 - RNA, 64 nt, Human
ugggggccucugucccucaucgcuuaccuuggaaaggugggaagcuggcaaucugcaccuuggg

SEQ ID NO: 109944 - RNA, 64 nt, Human
cugggguccuugcugcaggccggguggccaauccaggugggagagacacucccagggacaaggg

SEQ ID NO: 109945 - RNA, 64 nt, Human
cagcacgcgugacaguuaccggcuggagagccggaggugggaccgggagcaggggaccguagaa

SEQ ID NO: 109946 - RNA, 64 nt, Human
cauuccccauugcuccuggcucuuccccaccccuaggugggacagugaaggggagcaguuuaac

SEQ ID NO: 109947 - RNA, 64 nt, Human
ccccaugguuguccauugaauggagugaggaucaaggugggaaugacugggugguggcugccac

SEQ ID NO: 109948 - RNA, 64 nt, Human
aggugccauggcuugagccuauaauccgaggcugaggugggaggaucacuugagcccaggaguu

SEQ ID NO: 109949 - RNA, 64 nt, Human
cuauccaguagccaggccaguaggcaguuggggaaggugggaaggauccagcgaggccccugag

SEQ ID NO: 109950 - RNA, 64 nt, Human
aaacaacacacacuggggccuaugagagggcggaaggugggaggagggagagaucaggaaaaau

SEQ ID NO: 109951 - RNA, 64 nt, Human
gaaaccagggcugagcauauuuccauagccaaggaggugggacucccuggagcuaucugugguc

SEQ ID NO: 109952 - RNA, 64 nt, Human
guguuauggcaguggaggugggaauuuaguccccaggugggacaagggaaguuuuuucauuuug

SEQ ID NO: 109953 - RNA, 64 nt, Human
uuuuuauuuuguuucucuaguguuauggcaguggaggugggaauuuaguccccaggugggacaa

SEQ ID NO: 109954 - RNA, 64 nt, Human
gacuuagaacggggggaggggguaccagguggccaggugggacuguuucaaauuucccugaucc

SEQ ID NO: 109955 - RNA, 64 nt, Human
gccuccagaauguucugggauaacauuuggaggaaggugggaagcagaugacugaggaagggau

SEQ ID NO: 109956 - RNA, 64 nt, Human
cugagaugggagaggcagggaucagaggacgaacaggugggacuuugcgagcucugugacuguc

SEQ ID NO: 109957 - RNA, 64 nt, Human
cuacuacaaaccguagugggguggaggcugcuggaggugggagugaggagaugagggcaggguc

SEQ ID NO: 109958 - RNA, 64 nt, Human
cccaggguucaggguugcuuugcagaaggcauggaggugggaccagaugcuucccugugcuggc

SEQ ID NO: 109959 - RNA, 64 nt, Human
ugugcaccugugauccuagcuacuugggaggcugaggugggagaauugcucaagcccaggaguu

SEQ ID NO: 109960 - RNA, 64 nt, Human
uacauaccuguagucccagcuacucagaaggcugaggugggagguucacuugaaccugggaggu

SEQ ID NO: 109961 - RNA, 64 nt, Human
gcaucuguguggauuuucacggacaaguuccaguaggugggacagugaugccgucaaggcuuag

SEQ ID NO: 109962 - RNA, 64 nt, Human
cauaugccuguggucccagcuacugaggaggcugaggugggaggauugcuugagcccaggaggc

SEQ ID NO: 109963 - RNA, 64 nt, Human
ccucugccuauagccccagcuacuugggaggcugaggugggaggaucgcuugagcccaggcggu

SEQ ID NO: 109964 - RNA, 64 nt, Human
uguaauacucacaauggcuuuugguuaguguugaaggugggaagagcauuuguagguccagaag

SEQ ID NO: 109965 - RNA, 64 nt, Human
aaugaauauaucaguauuuagaaauaaauugcaaaggugggaauauauacuuaaauaauuuguc

SEQ ID NO: 109966 - RNA, 64 nt, Human
aggcccuugguguuuuaccacagaccccagcgucaggugggaguacugcaaccugacgcgaugc

SEQ ID NO: 109967 - RNA, 64 nt, Human
acaacccugguguuacacaacugauccgugugugaggugggaguacugcaaccugacacaaugc

SEQ ID NO: 109968 - RNA, 64 nt, Human
aggcccuugguguuauacaacggaucccaaagucaggugggaguacugcaaccugacaggaugc

SEQ ID NO: 109969 - RNA, 64 nt, Human
aggccccacccagcagacugaggggcagaggcacaggugggagggcagcggagaucagcgugga

SEQ ID NO: 109970 - RNA, 64 nt, Human
ugugcccucugagacagcccuguccgccccgcccaggugggaccugacauacaggcggcuccag

SEQ ID NO: 109971 - RNA, 64 nt, Human
cucacaccuguaaucccagcaccuugggaggcugaggugggaggaucauuugaggccaggaguu

SEQ ID NO: 109972 - RNA, 64 nt, Human
aaucccaacaggcccgugggaccaugacuuagggaggugggacccacccacccccauccaggaa

SEQ ID NO: 109973 - RNA, 64 nt, Human
auuugauuaagcuucaggacuguuuuguaaagcgaggugggaccgauguggcacacgccagcug

SEQ ID NO: 109974 - RNA, 64 nt, Human
cauaugccuuucaacguagcuacucaggaggcugaggugggaggaucccuugagccgaggaguu

SEQ ID NO: 109975 - RNA, 64 nt, Human
gcugaacagccaaaugcauggugcaguugacagcaggugggaaaugguaugagcugaggggggc

SEQ ID NO: 109976 - RNA, 64 nt, Human
aguggccaaggauguggagugggcaugugcuggcaggugggauauguccucagccuuugggggc

SEQ ID NO: 109977 - RNA, 64 nt, Human
uucuuuuuaaacggaugauaccgauggaaauaaaaggugggaaauauauucaaaaauugucacc

SEQ ID NO: 109978 - RNA, 64 nt, Human
uccaccggccuuuguucuuuuaaaacuugaauauaggugggagacauaagaaaggaaagaaaag

SEQ ID NO: 109979 - RNA, 64 nt, Human
cccaaagccucgacacagaguggacuguucccugaggugggagauguggaaaagccaagaggcu

SEQ ID NO: 109980 - RNA, 64 nt, Human
uugagccccugcuggugugcugcagggugugaugaggugggagcccucagugccagccucauca

SEQ ID NO: 109981 - RNA, 64 nt, Human
ugcacacuuguagucccagcuacucaggaggcugaggugggagaauugcuugggcccaggaauu

SEQ ID NO: 109982 - RNA, 64 nt, Human
cucacaccuguaaucccagcacuuugggaggucgaggugggaggaucgcuugaggccaggaguu

SEQ ID NO: 109983 - RNA, 64 nt, Human
ugcaugccuguagucucagcuaguuggggagcuaaggugggagaauugcuugagcuugggaagu

SEQ ID NO: 109984 - RNA, 64 nt, Human
cgggcgccuauaauccuagcuacuagggaggccaaggugggagaucgcuuaaacccaggaggug

SEQ ID NO: 109985 - RNA, 64 nt, Human
cucaugccuguaaucccagcacuuugggaggccaaggugggaggaucguuugagcccaggaguu

SEQ ID NO: 109986 - RNA, 64 nt, Human
cacaugccuguaaucccagcuacuuggcaggcugaggugggagaaucgcuugagcucaggaguu

SEQ ID NO: 109987 - RNA, 64 nt, Human
uguguaccuguagucacagguacuugggaggcugaggugggaggaucacuugagcccaggagau

SEQ ID NO: 109988 - RNA, 64 nt, Human
ucuuacugccauaggaaauuauuuuagggguuggaggugggacaagcaggcuuguuuccaccaa

SEQ ID NO: 109989 - RNA, 64 nt, Human
caaggaagagcuuugaaggccugaggucugcggaaggugggaggaggcagacgcccugcguggc

SEQ ID NO: 109990 - RNA, 64 nt, Human
cucccgccuguaaucccauuacuuugggaggcccaggugggaggaucgcuugagcccagaaguu

SEQ ID NO: 109991 - RNA, 64 nt, Human
caugcacauguagucagagcuacugggggugcugaggugggaggaucgcuugagcccaggagag

SEQ ID NO: 109992 - RNA, 64 nt, Human
cacgugccuguggucccagcuacuugggaggcugaggugggagccugggaggucaaggcugcag

SEQ ID NO: 109993 - RNA, 64 nt, Human
ucaucuuugcgcauaacuuaccuguuaccaguauaggugggauauacauuuaucuugcaggaaa

SEQ ID NO: 109994 - RNA, 64 nt, Human
ccaaggcagaaauccccucuucagcuucuuuuguaggugggaauccagccucuguuagauaugu

SEQ ID NO: 109995 - RNA, 64 nt, Human
gugaguaccagugguguugcuuccacccugcagcaggugggaugaggucuguguguguguguga

SEQ ID NO: 109996 - RNA, 64 nt, Human
augagcccaaagugccagggagaacagccaggugaggugggagguuggagagccaggugagguc

SEQ ID NO: 109997 - RNA, 64 nt, Human
uuugccugugauuuccuaauuaucgcuagggccaaggugggauuuguaaagcuuuacaauaauc

SEQ ID NO: 109998 - RNA, 64 nt, Human
cugcuuuggauagucuccuacgcaccauuuugucaggugggagauuuggaauacacaugcagga

SEQ ID NO: 109999 - RNA, 64 nt, Human
ugaacugaucucuguaucccauuauuacuauaagaggugggaaucccaaaacugcuuagauugc

SEQ ID NO: 110000 - RNA, 64 nt, Human
acaugacaacaugggaaauuacguaagucauacaaggugggaggaaaggucauguguaaaauug

SEQ ID NO: 110001 - RNA, 64 nt, Human
ccucuuuuaaacaggcaaaacaggaagggggaaaaggugggauucaugucgaggcuagaggcau

SEQ ID NO: 110002 - RNA, 64 nt, Human
cuaauggaguacagccgccaggagcuacucaggaaggugggagagagccaagcccugugucccc

SEQ ID NO: 110003 - RNA, 64 nt, Human
cacccgccucagccucccaaagugcugggauuacaggugggagccacaacacccggccaugaau

SEQ ID NO: 110004 - RNA, 64 nt, Human
ucccuggccaacuccgcagggcccuccuagagccaggugggaguggggagcgacccgcagcugc

SEQ ID NO: 110005 - RNA, 64 nt, Human
ccagaagcuggaaaggaaagugggguugggaggaaggugggaaugguuaauagguacaaaaaaa

SEQ ID NO: 110006 - RNA, 64 nt, Human
ggcggggagagcucgaggggaggcccagcccugcaggugggacuggcucucccuccccagccac

SEQ ID NO: 110007 - RNA, 64 nt, Human
cucaugccuguaaucccaacacuuugggaggccaaggugggaggauggcuuguguccagaaguu

SEQ ID NO: 110008 - RNA, 64 nt, Human
cuucugccugugauuccggcuacuugggaggcugaggugggagggauugcuuaagccugggagg

SEQ ID NO: 110009 - RNA, 64 nt, Human
ccgcacugucccaguagccaaggcccgggguuggaggugggagcuucccacaccugccugcguu

SEQ ID NO: 110010 - RNA, 64 nt, Human
gugcccucuugcugccugccugucugcugagguaaggugggaggagggcuacagcccacauccc

SEQ ID NO: 110011 - RNA, 64 nt, Human
ugugcaccuguagucccagcuauuugggaggcugaggugggagaaucacuugaaccugggaggc

SEQ ID NO: 110012 - RNA, 64 nt, Human
cccaccuagugccccagacugagcucuccaggccaggugggaacggcugauguggacugucuuu

SEQ ID NO: 110013 - RNA, 64 nt, Human
ggugcuaaagccaaccagccuuuggguccugggcaggugggagcugaaaaggaucgaggcaugg

SEQ ID NO: 110014 - RNA, 64 nt, Human
gagagaauagagcugccacugggcaccugcgcacaggugggaggaaagggccuggccaguccug

SEQ ID NO: 110015 - RNA, 64 nt, Human
cauuccacaccucuucucauccucagugaugugaaggugggaaggaaaggagcuuggcauuggg

SEQ ID NO: 110016 - RNA, 64 nt, Human
ccagccucacaugcccaaaucuccagucuccuggaggugggacuggacaggagucuaccagcuu

SEQ ID NO: 110017 - RNA, 64 nt, Human
aucuggggaccccuccaggaagaugcugacauccaggugggaggugucagagcccagcucaugc

SEQ ID NO: 110018 - RNA, 64 nt, Human
gugcccaggagcugaaggugggggugacacugggaggugggagggccaggccaacuggcugcgg

SEQ ID NO: 110019 - RNA, 64 nt, Human
acccacagcccacucucuggacaccaauccugggaggugggagcuggaauggggagcaaugaga

SEQ ID NO: 110020 - RNA, 64 nt, Human
cuugcaccuauaaucccagcacuuugggaggcagaggugggaggauugcuuggucccaggaguu

SEQ ID NO: 110021 - RNA, 64 nt, Human
cucacaccgguaaucccagcacuuugggaggccgaggugggaggauugcuugagcucaugaguu

SEQ ID NO: 110022 - RNA, 64 nt, Human
ccagcaauugcugaagguggcgaugaacacccgaaggugggagggaggacugguacccacaaag

SEQ ID NO: 110023 - RNA, 64 nt, Human
ugguugugaauguuuuugcuuuuaaccccuuuugaggugggauugccucuuggagacauggaau

SEQ ID NO: 110024 - RNA, 64 nt, Human
agaggcugaggcaugaggaucucuugaacccgggaggugggaguuguagugagccgagaucaug

SEQ ID NO: 110025 - RNA, 64 nt, Human
cccucaggcuagcccuucuccacucugggggaggaggugggaagggccaccaggcccccagcug

SEQ ID NO: 110026 - RNA, 64 nt, Human
aucuuacauguuuacauaagaaauaauaaacuggaggugggaauggagaacaauguguuuuguc

SEQ ID NO: 110027 - RNA, 64 nt, Human
uguggagguugugggggcgguggggaggucccagaggugggaggccggcauccaggucuuggcu

SEQ ID NO: 110028 - RNA, 64 nt, Human
aguccucugaaugggucagccccuuagauggaggaggugggacguuugggcuugggggcucggc

SEQ ID NO: 110029 - RNA, 64 nt, Human
augagacucaccuuuucucgcugaaagcacuaagaggugggaggaggccugcacaggcuggagg

SEQ ID NO: 110030 - RNA, 64 nt, Human
cgugugacagcugcugcccacgcauguggaagcuaggugggacucauuccuaauucugccguug

SEQ ID NO: 110031 - RNA, 64 nt, Human
guugguuucuccucauugccucaaacccugggguaggugggacggggggucucgugcccagaug

SEQ ID NO: 110032 - RNA, 64 nt, Human
ugcacaucgguaguccuggcuacuagagagguugaggugggaggaucacuugaaccugggaggu

SEQ ID NO: 110033 - RNA, 64 nt, Human
aaaacuuuuguuacaucucauuauuuucaggccaaggugggaguauagugcauaauaauuguac

SEQ ID NO: 110034 - RNA, 64 nt, Human
cucauaccuguaaucccagcaguuggggaggccaaggugggaggauugcuugagcccaagaguu

SEQ ID NO: 110035 - RNA, 64 nt, Human
uccuuacuuagcacuugauuguguggggaaacaaaggugggagggguggggaauacuggaaaua

SEQ ID NO: 110036 - RNA, 64 nt, Human
guucaagcaauuauccugccucagccucccgaguaggugggauuauaggagcgugccaccaugc

SEQ ID NO: 110037 - RNA, 64 nt, Human
ugcaguggcucacgcccagcacuuugggaggcugaggugggaggaucccuugaggccaggaguu

SEQ ID NO: 110038 - RNA, 64 nt, Human
ucugucacugucaaggaugcagagagcuggugguaggugggaagcaugguguccaccugccugc

SEQ ID NO: 110039 - RNA, 64 nt, Human
cagauccgaauccgacuguggggggcgggcugggaggugggagccgcgucucaggcccggccgu

SEQ ID NO: 110040 - RNA, 64 nt, Human
ccagcuccagggaccccaguugcagggcccaagcaggugggaguggacaccaggcuucccagug

SEQ ID NO: 110041 - RNA, 64 nt, Human
agcuuagaguccuuugaacugcugagucacuucuaggugggauuuuuuuguuuuaccaagagac

SEQ ID NO: 110042 - RNA, 64 nt, Human
agcugcucugcacacauggacagggaccugggaaaggugggagagaugcugagcccagcgaauc

SEQ ID NO: 110043 - RNA, 64 nt, Human
cucaugccuguaauccuaacacuuugggaggccaaggugggaagauugccugagcucaggaguu

SEQ ID NO: 110044 - RNA, 64 nt, Human
augcuucccaccuuaccuuuuagauucuuuugcuaggugggagauuguuauaaggucuuuaaac

SEQ ID NO: 110045 - RNA, 64 nt, Human
cuagauugugguuguuuugguuaaggugauauggaggugggagagcuuuuaguuaaguaagaag

SEQ ID NO: 110046 - RNA, 64 nt, Human
cugaagggcaguagccugaagauaacagugcacaaggugggaaaagccagcucagaggugacgu

SEQ ID NO: 110047 - RNA, 64 nt, Human
cuuucuuuuauucuucuccuucuuuuuuuuucagaggugggauggguggagauuuuuuaaaaau

SEQ ID NO: 110048 - RNA, 64 nt, Human
ggacuguggggacuuuugggaccccacacacuccaggugggaucagaugcugcuccaaccaugc

SEQ ID NO: 110049 - RNA, 64 nt, Human
aggccuuuguaaaaucaguagccguccugcaggcaggugggagcaacaggggcuucaguagcuu

SEQ ID NO: 110050 - RNA, 64 nt, Human
caggcccuggugcuaucugaccugggguccagcgaggugggaaucccagugugugagcgacagg

SEQ ID NO: 110051 - RNA, 64 nt, Human
ugugaaaguugagacauaugugcauguauuuuggaggugggaugaagucaccuauagcuuucau

SEQ ID NO: 110052 - RNA, 64 nt, Human
gcauuauuuaguuugagcucuguagguaaaaaggaggugggaaaaauuuuaaaacuugagggua

SEQ ID NO: 110053 - RNA, 64 nt, Human
uacaugccuguaaucccagcuacuugggaggcugaggugggaggaucacuugaacucaggaguu

SEQ ID NO: 110054 - RNA, 64 nt, Human
aauuaagggacuggagagaggugaagaauuuugcaggugggagauuuggauuugaauguggacu

SEQ ID NO: 110055 - RNA, 64 nt, Human
ugccccuuuuucccaccgauucgguggcuggugaaggugggagaugugaacuccaauuaaggga

SEQ ID NO: 110056 - RNA, 64 nt, Human
ugccacuguagcugaccaggggacuagguuguagaggugggaaggcccccucugggcugaucuu

SEQ ID NO: 110057 - RNA, 64 nt, Human
cuuuugacuguaaugacaucuggaauguaaggagaggugggagguuuaauuccagaaaaauuac

SEQ ID NO: 110058 - RNA, 64 nt, Human
gaaggaucagacugggaaccacagaggaaggaugaggugggauguggaggucagagcaucucac

SEQ ID NO: 110059 - RNA, 64 nt, Human
gaagagaacgcuugagcauccuuggcaacagcccaggugggaccuggaugaagcuuugcacuca

SEQ ID NO: 110060 - RNA, 64 nt, Human
ggccuuaguacggcugcugcacacuucucggucuaggugggagagagugcauaaagguucuggg

SEQ ID NO: 110061 - RNA, 64 nt, Human
cgggugccucuaaucccagcuacuggggaggcugaggugggagaaucgcuugaacucgggaggu

SEQ ID NO: 110062 - RNA, 64 nt, Human
uuacacccagaacaccauuccuuccaggagcaguaggugggagguuugacccagagaagccaau

SEQ ID NO: 110063 - RNA, 64 nt, Human
gcaggaguuggcaagagaacccccugcccuguccaggugggaagcugagucccagugcuggggg

SEQ ID NO: 110064 - RNA, 64 nt, Human
agaguguguccuccuggggcuuuagggggcaggaaggugggacgaaugacgaugcccauccacu

SEQ ID NO: 110065 - RNA, 64 nt, Human
ugagcgccuguagucccagcuacuugggaugcugaggugggaggaucacuugaaccugggagac

SEQ ID NO: 110066 - RNA, 64 nt, Human
auuccccaggcccugcaggauuuuggggggggggaggugggagggcaagggaggggagcuucuu

SEQ ID NO: 110067 - RNA, 64 nt, Human
cuccucccucagccgcucccaaccaugagagccgaggugggaggcaugggaaacagugcaguga

SEQ ID NO: 110068 - RNA, 64 nt, Human
cccagcagacgagacagcaaagaccaaggccuggaggugggagcgucugccccagugaggaggc

SEQ ID NO: 110069 - RNA, 64 nt, Human
ugucuccacccccuuccauguguugaauaauaaaaggugggaaagugcugucacgaggagcucc

SEQ ID NO: 110070 - RNA, 64 nt, Human
uugaauacucugaaaccgaagggacuggaucugcaggugggaugagggagacagaccacuuuuc

SEQ ID NO: 110071 - RNA, 64 nt, Human
ccuuguugguggagaguggaaggacuguggcugcaggugggacuuuguuguuuggauuccucac

SEQ ID NO: 110072 - RNA, 64 nt, Human
uaugugccuguggucccagcuacuggggaggcugaggugggaggaucguuugagccugggaggc

SEQ ID NO: 110073 - RNA, 64 nt, Human
caugcaccuguagucucaccuacuccagaggcugaggugggaggauggcuugcgcucaggaggc

SEQ ID NO: 110074 - RNA, 64 nt, Human
cacacaccuguagucccagcuacucaggagguugaggugggaagauugcuugagcccaggaguu

SEQ ID NO: 110075 - RNA, 64 nt, Human
cucaugccuguacucucagcuacuugggagguugaggugggaggauugcuugagcccaggauuu

SEQ ID NO: 110076 - RNA, 64 nt, Human
cucaugccuguaaucccagcacuuugggaggucgaggugggaggaucacuugaggccacgaguu

SEQ ID NO: 110077 - RNA, 64 nt, Human
gucauguucugguuugagauuuagugacaaauagaggugggaagcuuauaaucuaauuuuagga

SEQ ID NO: 110078 - RNA, 64 nt, Human
ugugcaccuauagcccccacugccuggaaagcugaggugggagaaucgcuugaguccaggaguu

SEQ ID NO: 110079 - RNA, 64 nt, Human
auuauccuuggggagaccaucccuaacaaaguacaggugggaucuccugugagucauuggcugg

SEQ ID NO: 110080 - RNA, 64 nt, Human
acagcaugaaaggaaugaguguaugaaaaggugaaggugggagcaccuugacccagggauguga

SEQ ID NO: 110081 - RNA, 64 nt, Human
uugucucugcaaacugccuucuucggaaagaagaaggugggaggaugugaauuguuaguuucug

SEQ ID NO: 110082 - RNA, 64 nt, Human
cacguuccugcaaucccagcuacucauaaggcugaggugggaggaucuauugagcccuggaauu

SEQ ID NO: 110083 - RNA, 64 nt, Human
agugaacauugaaacaucgacguaacuggaaauuaggugggauauuugauaggauccauaucua

SEQ ID NO: 110084 - RNA, 64 nt, Human
gagaugggguguaggaagaaguggcuuccuuuggaggugggagugggcuggaggccucuggaga

SEQ ID NO: 110085 - RNA, 64 nt, Human
cauucucacuguaccacuaggcgcaguuggauauaggugggaagaaaaggugacuuguuauaga

SEQ ID NO: 110086 - RNA, 64 nt, Human
aagugacugcccuaaggaaugaaaagcaagggccaggugggaguagcccagcgaaggcacuugg

SEQ ID NO: 110087 - RNA, 64 nt, Human
gggaaccuguauaaggguauugagugugagguugaggugggacauuugcugagcaaggagaacc

SEQ ID NO: 110088 - RNA, 64 nt, Human
uaacuucucacuuggaacagacugcguaagagccaggugggauaagguaaagcaacucagcugc

SEQ ID NO: 110089 - RNA, 64 nt, Human
ggugggcagugggcaaggcgguggguggugggcaaggugggaccuccugcagccuggaaagagg

SEQ ID NO: 110090 - RNA, 64 nt, Human
auuuuccucccuugcccuugcaaucuccagcaaaaggugggaucuaggaagaaagaauccagug

SEQ ID NO: 110091 - RNA, 64 nt, Human
uguguaccuguaguccuagcuauuugggaagcugaggugggagggucgcuugagcccaggaguu

SEQ ID NO: 110092 - RNA, 64 nt, Human
cucacgccuguaaucucagcacuuugggaggccgaggugggagaaucacaaggucaggagacug

SEQ ID NO: 110093 - RNA, 64 nt, Human
uccugggucaagccauucugcuucagccccaaguaggugggacuccaggcaugcaccaccaugc

SEQ ID NO: 110094 - RNA, 64 nt, Human
acacagagaagaacauuuucucaggcucguagagaggugggauagaggaagggagguuugagcc

SEQ ID NO: 110095 - RNA, 64 nt, Human
ucaguucauguccuaggaagucagcuuuugccccaggugggaauccuuauuuggcuuaggacug

SEQ ID NO: 110096 - RNA, 64 nt, Human
ccggcacccaucuguaucaucagugccucuuugaaggugggaaacauuagugaaaauucuguug

SEQ ID NO: 110097 - RNA, 64 nt, Human
ccaucccaaccaagaaacugcauuuccuggggccaggugggagcugccuuugccccacugccuc

SEQ ID NO: 110098 - RNA, 64 nt, Human
cgaccaagccgugugcaauacaacagagggaggcaggugggaauugagggugagggguuugggg

SEQ ID NO: 110099 - RNA, 64 nt, Human
ccaacagugaaggaaaaggcacaggugagaguauaggugggagauuuggggggauguagagggg

SEQ ID NO: 110100 - RNA, 64 nt, Human
aguccugagccucccgccaaaucccagccucacuaggugggacccccuucccaguguucugccg

SEQ ID NO: 110101 - RNA, 64 nt, Human
guagagagugggucagcagccuggcaccucacagaggugggaccuaagaggacucaugauuaug

SEQ ID NO: 110102 - RNA, 64 nt, Human
acagaauaaugcaugaugaacucaccuaauuaugaggugggaggagcgaaaucuaaauuucuuu

SEQ ID NO: 110103 - RNA, 64 nt, Human
aaacucuugcacuuccccaaccagggcagaaaugaggugggagaaguuugacuaaaaugaggga

SEQ ID NO: 110104 - RNA, 64 nt, Human
cuccaguguuaucuggaccaguuccuucauuuucaggugggacucuugauccagagaggacaaa

SEQ ID NO: 110105 - RNA, 64 nt, Human
guucaagugauucuccugccucagccucccaaguaggugggauuacaggcgcccgccaccacgc

SEQ ID NO: 110106 - RNA, 64 nt, Human
aagcugcuuugaugcauggcuauaaucccagccgaggugggaggaucacuugaguccagguuca

SEQ ID NO: 110107 - RNA, 64 nt, Human
gcuggggaggauggcgcgccugaagacgcagccgaggugggagcacgggcaggcucaggcggga

SEQ ID NO: 110108 - RNA, 64 nt, Human
aguaaguaucgcugaaguugcugguggggugaagaggugggaagguccuggagucuucucccug

SEQ ID NO: 110109 - RNA, 64 nt, Human
uuagugcccgggaugggcacaguguuuugaagggaggugggagcucuugcucuccuggucacug

SEQ ID NO: 110110 - RNA, 64 nt, Human
ggcaggaggcgggagcccggaucugugcgacugaaggugggaagaggaguacacggugcggauc

SEQ ID NO: 110111 - RNA, 64 nt, Human
gauagaaaaccaaacacugcauauucucacucacaggugggaauugaacaauaaaaacacuugg

SEQ ID NO: 110112 - RNA, 64 nt, Human
ggcucacaccuguaaucccaauacugggaagccaaggugggaguaucgcuugagcccaggaguu

SEQ ID NO: 110113 - RNA, 64 nt, Human
uuuaccugaauggagcauacucauauuucuacauaggugggaagauacucaucuuucuacauag

SEQ ID NO: 110114 - RNA, 64 nt, Human
ucccuuuccucacccaguugguagaggagucaggaggugggaggccgugggcuuugguuuuaua

SEQ ID NO: 110115 - RNA, 64 nt, Human
cucagccuuggguggcuugucucugcuucuugccaggugggagggccuguccacacccuggauc

SEQ ID NO: 110116 - RNA, 64 nt, Human
cugccccuuccguguuggugagauuaagggaagaaggugggagggcauuagucaagccggacug

SEQ ID NO: 110117 - RNA, 64 nt, Human
cuuaugccuguagucgcagcuacucagaaggcugaggugggaggauugcuuguuccccggaggu

SEQ ID NO: 110118 - RNA, 64 nt, Human
uuacuugcugugggaagagagaugagggucagauaggugggaggacuaacuuccagggugccaa

SEQ ID NO: 110119 - RNA, 64 nt, Human
acugucguccccggacuauagacacuaccccaucaggugggaauaccacucccucagguacggg

SEQ ID NO: 110120 - RNA, 64 nt, Human
gggagagauaauaggugugauuauuuuaauauggaggugggagugugguuggagauagaaaggc

SEQ ID NO: 110121 - RNA, 64 nt, Human
cugaagggccuugggguaguuugcucagccuuucaggugggaaacccagauuuccucccuuugc

SEQ ID NO: 110122 - RNA, 64 nt, Human
cacauacuuguagucccaguuauuagggaagcugaggugggaggauagcuuaagcccaggauuu

SEQ ID NO: 110123 - RNA, 64 nt, Human
cacaugccuguaaucccagcacuuugggaggcugaggugggaggacugcuugagcccaggaguu

SEQ ID NO: 110124 - RNA, 64 nt, Human
uaucccuuccccagaucugcuccuccccuuucacaggugggaucggcacucagggggucuggaa

SEQ ID NO: 110125 - RNA, 64 nt, Human
cucacaccuguaaucccagaacuuugggaggccgaggugggaggagcgcuugagccgaggaguu

SEQ ID NO: 110126 - RNA, 64 nt, Human
uguggucaaugaaauacccaguuucuggagggccaggugggaaaugcuuucacuggaccaacac

SEQ ID NO: 110127 - RNA, 64 nt, Human
cccucaguuugucucccuuguuccucuguggcugaggugggagggggagggugggguagguccc

SEQ ID NO: 110128 - RNA, 64 nt, Human
cagucugcucucauuguccaagcucugauuugggaggugggaggggacgucuuauuaacaaacg

SEQ ID NO: 110129 - RNA, 64 nt, Human
uuucuucauagguuugaacagugggagauaccagaggugggaggagaaaaaguuauuuauuacc

SEQ ID NO: 110130 - RNA, 64 nt, Human
ugcaggcuugcaaucccagcuacuugggacgcugaggugggaggaucgccugaaccucagaggc

SEQ ID NO: 110131 - RNA, 64 nt, Human
cucaugccuguaaucccaacacuuugagaagcugaggugggaggagugcuugaggccaggaguu

SEQ ID NO: 110132 - RNA, 64 nt, Human
aauuaugagaggcugucauauaucaaagcagcucaggugggaucaacauacauugguuuugaaa

SEQ ID NO: 110133 - RNA, 64 nt, Human
aacacugagcuuucgaauaugaaucaugugcuuuaggugggaauugugaauucugaagauacag

SEQ ID NO: 110134 - RNA, 64 nt, Human
ugggauacuuuuuagagugaaaggggcuauuauuaggugggacaaaaggaauaaaugaagacug

SEQ ID NO: 110135 - RNA, 64 nt, Human
uuguuuaaucguguucucaaagcauacagucaagaggugggacugacugaugcuuuauaggugu

SEQ ID NO: 110136 - RNA, 64 nt, Human
aaccuauuaccacauuuagcaguuaaauggcuauaggugggaaguaggauuuagauguauagaa

SEQ ID NO: 110137 - RNA, 64 nt, Human
uuuuuugcuggugcuucuuacauuuaauauggaaaggugggaagaauauuacugcauuagaugu

SEQ ID NO: 110138 - RNA, 64 nt, Human
cuuggagaggucaaaacauccaccuaccuucaaaaggugggauaguaguucuaauccaauacaa

SEQ ID NO: 110139 - RNA, 64 nt, Human
ggcucaugccuguaauccuagcaacucggggcugaggugggaggauugcuucagcccaggaguu

SEQ ID NO: 110140 - RNA, 64 nt, Human
cuaaacaguuauaaucuuggcacuguuaauagaaaggugggauagucuuugcuguuugcgguga

SEQ ID NO: 110141 - RNA, 64 nt, Human
uguucaccuuuaaucccagcuacuugggaggcugaggugggaggauaacuugagcacaggaguu

SEQ ID NO: 110142 - RNA, 64 nt, Human
cuacuuuugaaaaucaacuguauuggguagugggaggugggagggaagggcuuugggaagggga

SEQ ID NO: 110143 - RNA, 64 nt, Human
uguggucuccucagucucugucagagggguggggaggugggaaacaggaauccucugcaaagcc

SEQ ID NO: 110144 - RNA, 64 nt, Human
ggcacaggagauguagucguuccagggcugggggaggugggagggaucacgccuauaggugugg

SEQ ID NO: 110145 - RNA, 64 nt, Human
uauuuggagggaaugggaggaagugggaacagggaggugggagguggauuuuguuuauuuuuuu

SEQ ID NO: 110146 - RNA, 64 nt, Human
cgcaugccuguaguccuagcuacucaggaggcugaggugggaggaucaccuaaggccaggaggu

SEQ ID NO: 110147 - RNA, 64 nt, Human
ugugugccuauagucccaacuacuagggaggcugaggugggaggaucacuugagccugggggac

SEQ ID NO: 110148 - RNA, 64 nt, Human
gcugaaaccuaaucaccagugugaugguaauaggaggugggacugagcucugaugaaugagauu

SEQ ID NO: 110149 - RNA, 64 nt, Human
cauagccugaauuaugauguuccucagagaagugaggugggaaauaugaccaggucaggcaguu

SEQ ID NO: 110150 - RNA, 64 nt, Human
auccagccugccauuccaucaaauggagcaggagaggugggaggagcuucuaaagaggugacug

SEQ ID NO: 110151 - RNA, 64 nt, Human
aggggccauugggauucuccccucuggcagccccaggugggagcugggaggguccccagcccag

SEQ ID NO: 110152 - RNA, 64 nt, Human
caugugccuauagucccagcuacuugggagguggaggugggaggauuauaaauagagacuuucc

SEQ ID NO: 110153 - RNA, 64 nt, Human
cgcuucugcucucuuuauggacuggucagaggguaggugggaaagaacagacaagccaugggaa

SEQ ID NO: 110154 - RNA, 64 nt, Human
uuugggugauagucagagagugguguuuuuguucaggugggaaggauuggaaacucuagucuuu

SEQ ID NO: 110155 - RNA, 64 nt, Human
auagcugaucucacaugcuucccaggcagggcagaggugggagucaaacccgggugacaggugg

SEQ ID NO: 110156 - RNA, 64 nt, Human
cauauaaucaugcaccaaacuuuuuauuucuuuaaggugggaguauauuuuuauuuccuaaaug

SEQ ID NO: 110157 - RNA, 64 nt, Human
cauauccacccauugacucugccuucaucaaggaaggugggaaguaaaacaucacuuuuuacau

SEQ ID NO: 110158 - RNA, 64 nt, Human
gguggcagaggugggaugagcuggaaagguauggaggugggagaggauggggcucuucugucug

SEQ ID NO: 110159 - RNA, 64 nt, Human
cccucugaccccgcgaugaguguuuugguggcagaggugggaugagcuggaaagguauggaggu

SEQ ID NO: 110160 - RNA, 64 nt, Human
agcugaauacuuccagcauauuuauucaggguguaggugggaauaaaguaucuucgcagugcuc

SEQ ID NO: 110161 - RNA, 64 nt, Human
cacgugccuguagucccagcuacucgauagccugaggugggagaaucacuuaagccuggaaggu

SEQ ID NO: 110162 - RNA, 64 nt, Human
ugccccgacuucccacaccagccgcgcccaccgcaggugggacucagguucgcccucugggcca

SEQ ID NO: 110163 - RNA, 64 nt, Human
cuaacucucauucauucccuggcugcugaguugcaggugggaacugucaucacgcagugcuuca

SEQ ID NO: 110164 - RNA, 64 nt, Human
cucuaaggcuccaugguuccuacgaagcucugaaaggugggaacaccacagaggccauggagga

SEQ ID NO: 110165 - RNA, 64 nt, Human
cucacaccuguaaucccagugcuuugggaggcugaggugggaagauucuuugagcccaggaguu

SEQ ID NO: 110166 - RNA, 64 nt, Human
gggggaaagguucauagacuuaggugugagaaugaggugggaggugucugguaaggucaugggg

SEQ ID NO: 110167 - RNA, 64 nt, Human
caguggcccaugccuguaaucccagcacuuugggaggugggacaauugcuuuagaccuugcaac

SEQ ID NO: 110168 - RNA, 64 nt, Human
cacccaugagacucgguccaagaguccauuccccaggugggagccaacugucagggaggucuuu

SEQ ID NO: 110169 - RNA, 64 nt, Human
cuuacagagcaagccacgccucuuuccgaggugaaggugggaccauuccuugggaaaggauuca

SEQ ID NO: 110170 - RNA, 64 nt, Human
aggccuugaucugcuggcuccugccaggguccuuaggugggaaggcugggguggugcaggggcc

SEQ ID NO: 110171 - RNA, 64 nt, Human
ugugugccuguagucccagcuacuauggagguugaggugggaggaucgcuugagcccaugaggc

SEQ ID NO: 110172 - RNA, 64 nt, Human
cucacucuuguaaucccaaaacuuuaggaggccaaggugggaggaucgcuugagcccaggaguu

SEQ ID NO: 110173 - RNA, 64 nt, Human
uauuacguucaccuggaacuaaagaagagcguccaggugggacugggauaauuguucaaggaau

SEQ ID NO: 110174 - RNA, 64 nt, Human
ccagugcuccuugucaagcuccccccgucacuccaggugggagccaccccggugagggggugug

SEQ ID NO: 110175 - RNA, 64 nt, Human
ggaagugucaugcaagugcuggacagaaggcggcaggugggacgagccccacagcccccuccuc

SEQ ID NO: 110176 - RNA, 64 nt, Human
ccuagaucaccacuggauugcugacagauagaggaggugggacccugacuaucaccccuaaucu

SEQ ID NO: 110177 - RNA, 64 nt, Human
cgccacuaucuguguaauaaaauccgugagcacgaggugggacgugcuggugugugaccggcag

SEQ ID NO: 110178 - RNA, 64 nt, Human
caagcgcccuuggguccagcuacucaggaggccaaggugggaggaucacuugagcccaggaguu

SEQ ID NO: 110179 - RNA, 64 nt, Human
cucacgccugucaccccagagcuuugggaggccaaggugggaggaucgcuugagaccaggaguu

SEQ ID NO: 110180 - RNA, 64 nt, Human
cugugcaguggcccccacagaaagacugagcucaaggugggaaccacgucugcuaacuuggagc

SEQ ID NO: 110181 - RNA, 64 nt, Human
gggccuggccugagcugggaugauuggaggggggaggugggauccuccaggugcacaagcucca

SEQ ID NO: 110182 - RNA, 64 nt, Human
accacugaacuugaaacuuacccucuagggaugcaggugggauguccagggacuauagguuugg

SEQ ID NO: 110183 - RNA, 64 nt, Human
agaguuaaaagcugcuucacuugggcaauggugaaggugggagguugauuggggcaaauccagg

SEQ ID NO: 110184 - RNA, 64 nt, Human
cucaggccuguaauccuggcacuuugggaggccaaggugggaagaucgcuugaggccaagaguu

SEQ ID NO: 110185 - RNA, 64 nt, Human
uagccaccggaugugcugaggccuaaauguuagcaggugggaggaggccacagaacaauaaaaa

SEQ ID NO: 110186 - RNA, 64 nt, Human
ugugcuuaauucuauaacaguaaaccccauacgcaggugggagggaggaacaccggugccucgg

SEQ ID NO: 110187 - RNA, 64 nt, Human
agaaggagccuccggcuggggggagcuccccuggaggugggacuggcccuugcaccugccugac

SEQ ID NO: 110188 - RNA, 64 nt, Human
acuucuggaggcuucccuugaagcucugugcaaaaggugggagacagagcuggaccugcagggg

SEQ ID NO: 110189 - RNA, 64 nt, Human
ugcaugccuguauucccagcuacucaggagguugaggugggaggaucacuugagcccagaaguu

SEQ ID NO: 110190 - RNA, 64 nt, Human
cgcacgccuguagucccagcugcuugggaggcugaggugggagaaucacuugagcccaggaguu

SEQ ID NO: 110191 - RNA, 64 nt, Human
ggucaugucuguaaucccagcaauuuggaggcugaggugggaggaucauuugagcccaggaguu

SEQ ID NO: 110192 - RNA, 64 nt, Human
accaacuuuggggagcugcaggguucuuuuugggaggugggaggaagggagaugaguuuuguua

SEQ ID NO: 110193 - RNA, 64 nt, Human
ggugagauguuauuuguggcaugugaacuguggcaggugggaauaauccugcccuugagagaaa

SEQ ID NO: 110194 - RNA, 64 nt, Human
gcaucuccccaccgagagaagcgggcuccuaaugaggugggaaagccacggcaggcagcgagca

SEQ ID NO: 110195 - RNA, 64 nt, Human
cgcuuccucaagaagaggauuagcucugauuuugaggugggagacuccauggccucagaggaag

SEQ ID NO: 110196 - RNA, 64 nt, Human
cacacuccuguaaucccagcuacuuaggaggcugaggugggagaaucacuuggacuccagaggu

SEQ ID NO: 110197 - RNA, 64 nt, Human
uccgguugcacacuggccucuguggaggucagggaggugggaaggugggugggccugaacucag

SEQ ID NO: 110198 - RNA, 64 nt, Human
cucaggccaguaaucccagugacuuaggaggcugaggugggaggauuacuugaaacccacaguu

SEQ ID NO: 110199 - RNA, 64 nt, Human
uggaacuccaaguggcuuagucugggggaucaggaggugggagguggaugguucuuauucugug

SEQ ID NO: 110200 - RNA, 64 nt, Human
cgccugccucggccucccaaagugcugggauuacaggugggagccacuacagcuggcccagcag

SEQ ID NO: 110201 - RNA, 64 nt, Human
cucaugccuguaaucccagcacuuugggaggccgaggugggaggauugcuugaguccaggaauu

SEQ ID NO: 110202 - RNA, 64 nt, Human
ccugucuucagauccugcugccgcgugcgaccagaggugggaggccccugguggcauggaagag

SEQ ID NO: 110203 - RNA, 64 nt, Human
ccccugccagucauuccuccauucacccagcgggaggugggaugugagacagcccacauuggaa

SEQ ID NO: 110204 - RNA, 64 nt, Human
gagcagggaaggccugacuucugcuggcaucaagaggugggagggcccuccgaccacuuccagg

SEQ ID NO: 110205 - RNA, 64 nt, Human
agccaagcugcuuuuuggggcagggaguagcagcaggugggagggguuacccaucagcccuugc

SEQ ID NO: 110206 - RNA, 64 nt, Human
gccagaaauacucagcugccauguugauccacaaaggugggaggauguggggaagggggaaagc

SEQ ID NO: 110207 - RNA, 64 nt, Human
ugcuguucuuagcaagaugcgcacugcauuccacaggugggaggagucggagaggcaggggcuu

SEQ ID NO: 110208 - RNA, 64 nt, Human
uggucagagaagaugcgggccaggagacuuacucaggugggacugggcacagggcagguaugug

SEQ ID NO: 110209 - RNA, 64 nt, Human
uccaaguuccaggcuuccgguccuuagccuucccaggugggacuuuaggcaugauuaaaauaug

SEQ ID NO: 110210 - RNA, 64 nt, Human
gguggcauccgaaggugucucuggucuuccagcgaggugggagaggccucauccagggcccagc

SEQ ID NO: 110211 - RNA, 64 nt, Human
ugaguucuuuuucacucugugucuaauaauguuaaggugggaaaaaaaaaaguguggcauagcu

SEQ ID NO: 110212 - RNA, 64 nt, Human
cuggcccaggccuugcugacucucugagcuggggaggugggaggccaggcgagccugacucugu

SEQ ID NO: 110213 - RNA, 64 nt, Human
gcucaagcgauucucucaccucagccuccugaguaggugggauuacagaugcccgccaccacac

SEQ ID NO: 110214 - RNA, 64 nt, Human
cucacaccuguaaucccaguacuuugagacgcugaggugggaggaucacuugagcccaggaguu

SEQ ID NO: 110215 - RNA, 64 nt, Human
cgcagagcgcccacggacaguguccacucuggcaaggugggaaaaggcacuccaagugcauccu

SEQ ID NO: 110216 - RNA, 64 nt, Human
cggacccacccuuggaaagcucagggguaggcccaggugggaugcucacccugucacugagggu

SEQ ID NO: 110217 - RNA, 64 nt, Human
uugguggaccauggagucccuggugcugccccucaggugggacccaggcguucucagcuguacc

SEQ ID NO: 110218 - RNA, 64 nt, Human
gagugcagaaugucggcuguuugucuguaucgucaggugggauaauccuuaccuguuccuccuc

SEQ ID NO: 110219 - RNA, 64 nt, Human
cagagccugggcaccuuugggagagggaaaagugaggugggacuuggaaaggcuuugaacgcca

SEQ ID NO: 110220 - RNA, 64 nt, Human
aggcccaagacccaggacaaggaacagcaagcucaggugggauggccccagugcuggaaagaag

SEQ ID NO: 110221 - RNA, 64 nt, Human
cucgugccuguacucccagcacuuugggaggcugaggugggaggguugcuugagcccagggguu

SEQ ID NO: 110222 - RNA, 64 nt, Human
cugcgcuagcuucuuuugauacugaaaacuuuuaaggugggaggguggcaagggaugugcuuaa

SEQ ID NO: 110223 - RNA, 64 nt, Human
ggaccucaauuuccacuuuguaaaaugaggguggaggugggaauaggaucucgaggagacuauu

SEQ ID NO: 110224 - RNA, 64 nt, Human
ucccucauaggcuagaaugugcagcucuuucuccaggugggauguagcaccccgaaguagagcu

SEQ ID NO: 110225 - RNA, 64 nt, Human
auccagggaugccaucugugggcacgcugugggcaggugggagcuugauucucagcacuugggg

SEQ ID NO: 110226 - RNA, 64 nt, Human
ggccagaggcuuguuuugucuuuugguuuuuaugaggugggauaucccuaugcugccuaggcug

SEQ ID NO: 110227 - RNA, 64 nt, Human
gagacacaccugaccagccccuccccccaggcucaggugggaguucaaacugcuccuccccucc

SEQ ID NO: 110228 - RNA, 64 nt, Human
ucaccauuacaaguccaugaauguuaaaauguacaggugggauugugaagauuuacugacauca

SEQ ID NO: 110229 - RNA, 64 nt, Human
gggagcaugggaggggagcuggcgggagggugggaggugggauuuagccaggaaaggggugaga

SEQ ID NO: 110230 - RNA, 64 nt, Human
cuggaccgcagaccaccuucugcccccgugggccaggugggagcuguccguucaggaccaugag

SEQ ID NO: 110231 - RNA, 64 nt, Human
uugcugccugcccuccuccucucacccgauguccaggugggauuuuaaagucugcauugguuau

SEQ ID NO: 110232 - RNA, 64 nt, Human
aaggucaaggacccccucugugaaggcucagcagaggugggaucccacgcccccucccggcccc

SEQ ID NO: 110233 - RNA, 64 nt, Human
ugcacaccugugaucccagcuacuugggaggcugaggugggagaauugcuugaaccuggaaggc

SEQ ID NO: 110234 - RNA, 64 nt, Human
cacccccgacggcuccugcugacagggcccccacaggugggaaagacgggcuccuauuuacagu

SEQ ID NO: 110235 - RNA, 64 nt, Human
ugggugccuguaguuccagcuacuugggaggcugaggugggaaaaugacuugagcccaggagga

SEQ ID NO: 110236 - RNA, 64 nt, Human
ggcgggaaggaggggcccaggcugcggagaacccaggugggauccugaaggcacuagcugacag

SEQ ID NO: 110237 - RNA, 64 nt, Human
cuccugccucagucuugcaaagugcugggauuccaggugggagccacugcaccuggcucuugca

SEQ ID NO: 110238 - RNA, 64 nt, Human
aagagacuaucugaacucuauacuccagacaguuaggugggaguauaaaucuaccccuuuugau

SEQ ID NO: 110239 - RNA, 64 nt, Human
auugagcaccuacuauaugcagaaggggaggccgaggugggaggaucauuggaucucaggaguu

SEQ ID NO: 110240 - RNA, 64 nt, Human
ugggugcuuguaguuccagcuacucaggaggcugaggugggaggaugacuugaacgcaggaggc

SEQ ID NO: 110241 - RNA, 64 nt, Human
cucccggaggcugcgccccggcgccuggaacccgaggugggaggaccgguuggugucacccugc

SEQ ID NO: 110242 - RNA, 64 nt, Human
caccuggggcaggcggcaccggcgggcgggugggaggugggaguggcugcagggaccccuagug

SEQ ID NO: 110243 - RNA, 64 nt, Human
uuauuaauuuacaagacagguuuuaacucagccgaggugggaaauggugucccugucccuccca

SEQ ID NO: 110244 - RNA, 64 nt, Human
ggcuagaccaggucccugccgguccaccaggcggaggugggacaaagguccuaacaggagucac

SEQ ID NO: 110245 - RNA, 64 nt, Human
cccuugcgggucccccaggaagccaggugaccccaggugggaggcuguguguggaggccauccu

SEQ ID NO: 110246 - RNA, 64 nt, Human
agcccauggccucuggccaggcauggcgaggcugaggugggaggaugguuugagcucaggcauu

SEQ ID NO: 110247 - RNA, 64 nt, Human
cacacguaggggauguacuuuugggacagaagcaaggugggagugugcucugcagccgggucca

SEQ ID NO: 110248 - RNA, 64 nt, Human
cacacaccuguaguccgagccacuugggaggcugaggugggaggaucgguugagcccaggaguu

SEQ ID NO: 110249 - RNA, 64 nt, Human
uauaguggauugguggcuuucagcagcuguggggaggugggacugaggagcgacugcuaaucag

SEQ ID NO: 110250 - RNA, 64 nt, Human
uucuuuucacuuucugucaaugucaccagggauaaggugggacaaugggggguggggguggaca

SEQ ID NO: 110251 - RNA, 64 nt, Human
cacgugccuguagcaccagcuacuugggagguuaaggugggaggaucacuugagccugggagau

SEQ ID NO: 110252 - RNA, 64 nt, Human
ucuaugcacuuuuuuauuuaagagguggggucccaggugggaacccccccacaauaaagucugu

SEQ ID NO: 110253 - RNA, 64 nt, Human
ugaagaguggagaagggaaaauaaugagugugggaggugggauggguauugguuaaaggggacu

SEQ ID NO: 110254 - RNA, 64 nt, Human
gcgugcccagguucccagguacucggaggcugagaggugggaggaugccuugagcuugagaggu

SEQ ID NO: 110255 - RNA, 64 nt, Human
gcuuugauggacgguuuggaggaggcaagacuggaggugggaaaauuagcaaggaggucuguga

SEQ ID NO: 110256 - RNA, 64 nt, Human
cuguccccuucugccgccagcccuagccaguaagaggugggauuucuaagaccgacuguaugag

SEQ ID NO: 110257 - RNA, 64 nt, Human
cucacgccuguaaucccagcacuuugggaggccgaggugggaggaucgcuugagcccaggaguc

SEQ ID NO: 110258 - RNA, 64 nt, Human
ugggugccuguaaucccagcuacuugggaggcugaggugggagaauugcucgaacuuggaggug

SEQ ID NO: 110259 - RNA, 64 nt, Human
uggaguuggguauucccagcuaccagggaggcugaggugggaggauugcuugaugccaggaguu

SEQ ID NO: 110260 - RNA, 64 nt, Human
aaugcagcugacccagcugauagaggaaguagccaggugggagccuuucccaguggguguggga

SEQ ID NO: 110261 - RNA, 64 nt, Human
uacauuaaaguguuuauguuaagaagauugggccaggugggauuacaggcgcgagccaccgcgc

SEQ ID NO: 110262 - RNA, 64 nt, Human
cacccaucuguaguccuaacugcucaggaggcugaggugggaggauugcuugaguccaggaguu

SEQ ID NO: 110263 - RNA, 64 nt, Human
ugaguuugacaaauugacagaaguaggcuucagaaggugggaaauaacaaacuccucugagcua

SEQ ID NO: 110264 - RNA, 64 nt, Human
cgcauaccuguaguccuagcuacucaggaggcugaggugggaggaucacuugagcuugggaggc

SEQ ID NO: 110265 - RNA, 64 nt, Human
gcguuuguuuguuuguuuuuuuuuuuuuuucugaaggugggacagucacuuccuccucccuccc

SEQ ID NO: 110266 - RNA, 64 nt, Human
gcccggccacgcagcuucccaggugggcucggggaggugggagcagggaccaucucuguccccu

SEQ ID NO: 110267 - RNA, 64 nt, Human
gauugcacacaugugucucuguagucauguggccaggugggacuauguagguaacagauugcuc

SEQ ID NO: 110268 - RNA, 64 nt, Human
aaguucaagcccaggaccaccacuuauaggguacaggugggaucgacuguaaaugaggacuucu

SEQ ID NO: 110269 - RNA, 64 nt, Human
gauggaaggugggagccaacacccuucugauggaaggugggagccaacacccuucugauggaag

SEQ ID NO: 110270 - RNA, 64 nt, Human; identical to SEQ ID NO: 110269

SEQ ID NO: 110271 - RNA, 64 nt, Human; identical to SEQ ID NO: 110269

SEQ ID NO: 110272 - RNA, 64 nt, Human; identical to SEQ ID NO: 110269

SEQ ID NO: 110273 - RNA, 64 nt, Human
uucagguuucccugggccagcaucuucugauggaaggugggagccaacacccuucugauggaag

SEQ ID NO: 110274 - RNA, 64 nt, Human
guuuugagaucaacuggucugacuaaaauuuauuaggugggaauuuccucuuccuaauaagccu

SEQ ID NO: 110275 - RNA, 64 nt, Human
ggugauauagaggacuucgcuuuugcucugagugaggugggagccauagaagcuucuaagcaga

SEQ ID NO: 110276 - RNA, 64 nt, Human
ucugagccugcccccacgaacuuucuggauuccaaggugggauggugaucccuuugaccccugc

SEQ ID NO: 110277 - RNA, 64 nt, Human
uaugccccuguagucccagcuacuugggaggcugaggugggaagaucucuugagcccaaggggu

SEQ ID NO: 110278 - RNA, 64 nt, Human
cauugacuuuccauaguguuaggggcggugguggaggugggaucagcggccaggggaugccuca

SEQ ID NO: 110279 - RNA, 64 nt, Human
cauagcggauugguggcuuucagcagcuguggggaggugggacugaggagcgacugcuaaucag

SEQ ID NO: 110280 - RNA, 64 nt, Human
cuuaugccuguaaucccgguacuuugggaggcugaggugggaggacugcuuaagcucaggaguu

SEQ ID NO: 110281 - RNA, 64 nt, Human
gugucgcccgcaggcagcccugcagacaccggugaggugggaugauuucaggaggucccagccc

SEQ ID NO: 110282 - RNA, 64 nt, Human
aggcaugguggcacacaccuguagucccaggcugaggugggaggaucacuugaacccaagaggc

SEQ ID NO: 110283 - RNA, 64 nt, Human
cacaccuguggaaucccagcacuucaggaggccgaggugggaggaucacuggagcucgggaguu

SEQ ID NO: 110284 - RNA, 64 nt, Human
cucacaccuguaaucccugcacuuugggaggccaaggugggaggaucaguugagccccagaguu

SEQ ID NO: 110285 - RNA, 64 nt, Human
ucugucagaugcucccauccacuauuaaugcacuaggugggaggagagggcggcaaugacacug

SEQ ID NO: 110286 - RNA, 64 nt, Human
uaaaguggguaggccuuggcccaccugaggccccaggugggaacauggucacccccacucugca

SEQ ID NO: 110287 - RNA, 64 nt, Human
auauuguaucagaauaaaucuucugauaccagaaaggugggaaaaucuuuaguaggaauccucc

SEQ ID NO: 110288 - RNA, 64 nt, Human
ugcaucccuauacucccagcaacucagggggcugaggugggagaauggcuugagccugggaggc

SEQ ID NO: 110289 - RNA, 64 nt, Human
caggagccgagggggccacccgaggccaggauggaggugggaggccgagccaagcagggggacg

SEQ ID NO: 110290 - RNA, 64 nt, Human
uguugacaaugacugucuccaggucaaaggagagaggugggauugugggugacuuuuaaugugu

SEQ ID NO: 110291 - RNA, 64 nt, Human
gcagggucuguccuguggccaccuggaaagucccaggugggacucuucuggggacacuuggggu

SEQ ID NO: 110292 - RNA, 64 nt, Human
gaauuguggaaagggcaguagaucucuaauguggaggugggaacauuauugugguggaggcaau

SEQ ID NO: 110293 - RNA, 64 nt, Human
gccguggaugcgcagugccuugcauacccaaaccaggugggagcguuuuguugagcaugacagc

SEQ ID NO: 110294 - RNA, 64 nt, Human
gcuuaagcgauucucaugccucauccucccaaguaggugggauuacaggugcccaccaccaagc

SEQ ID NO: 110295 - RNA, 64 nt, Human
ucaggagcugucuccucucuaccuggcuaguaagaggugggacaguaaugguccuccugcuggc

SEQ ID NO: 110296 - RNA, 64 nt, Human
gugacuacuuuauccaugaaaaugaagcaauggcaggugggaggcucuucccaaugugcuuucu

SEQ ID NO: 110297 - RNA, 64 nt, Human
cucucccaagagacaaaggccauugcauugaaggaggugggaaaugauuagauucugaacauau

SEQ ID NO: 110298 - RNA, 64 nt, Human
uauuuaaaauucagguauuguacucgggaggcugaggugggaggaucccaggaguucaaauccu

SEQ ID NO: 110299 - RNA, 64 nt, Human
cugcuugugccagggacuauucucaggcugaagaaggugggaggggagggcggaaccugaggag

SEQ ID NO: 110300 - RNA, 64 nt, Human
cuguaguagggaacucuggaaguguauugggcugaggugggauuuucccuccccacagugcacu

SEQ ID NO: 110301 - RNA, 64 nt, Human
auccucuuccuaccuugaguuuuucuacccugugaggugggacuuucaguaaaagccauguuga

SEQ ID NO: 110302 - RNA, 64 nt, Human
cucacaccuauaaucccaguauuuugggaggcugaggugggagaaucacuugaguccuggaguu

SEQ ID NO: 110303 - RNA, 64 nt, Human
aaaaaaaaaaauuguuuuagcgcuggguuucccaaggugggagagacagacccagccuggagcu

SEQ ID NO: 110304 - RNA, 64 nt, Human
ccacgugcagaagucuugaguggaccuaggagguaggugggauauuuuuuuucacuaggauaca

SEQ ID NO: 110305 - RNA, 64 nt, Human
gccugaauugucauuuuccauuuugguuuguuagaggugggagggguggguuuugagaagguca

SEQ ID NO: 110306 - RNA, 64 nt, Human
aacuguuuacuguugaaacaguguaaguauuaggaggugggaccuuugggaagugauuaaguca

SEQ ID NO: 110307 - RNA, 64 nt, Human
aggugucagcucaaaggaucucugcaucaucuugaggugggaggcagggaaaggagcgccaaug

SEQ ID NO: 110308 - RNA, 64 nt, Human
ggagaaggacuaucaacaccacuaggaaucccagaggugggauccucccucauggcucuggcac

SEQ ID NO: 110309 - RNA, 64 nt, Human
auuagccggguuccaucaccugugguuccagcugaggugggaggaucacuugagccuaugaggu

SEQ ID NO: 110310 - RNA, 64 nt, Human
ccuggcuguagagaagggcuacaucccugaacccaggugggacccguucccgcugcucacugcg

SEQ ID NO: 110311 - RNA, 64 nt, Human
aucccaccugcgaccucuagugcgagugcagagaaggugggaccagggccaggguuccaaaaag

SEQ ID NO: 110312 - RNA, 64 nt, Human
uaaagagcccagugauuguggcugcuccuccuagaggugggagggggcaagaggccuccuuggu

SEQ ID NO: 110313 - RNA, 64 nt, Human
cacccaccucagccuccgaaagugcugggaucacaggugggagccacugugccuggccaguuau

SEQ ID NO: 110314 - RNA, 64 nt, Human
uccccauuuuauagauggagaaacuggccccaaaaggugggaacuuguccaagacgucacaggu

SEQ ID NO: 110315 - RNA, 64 nt, Human
uacgugccuguagucccagcuacuucggggacugaggugggaggaucacuugaaccuaggaggu

SEQ ID NO: 110316 - RNA, 64 nt, Human
guucaagugauucucccaccucagccucccaaguaggugggauuacagguacucaccaccaggu

SEQ ID NO: 110317 - RNA, 64 nt, Human
guaucuugccaguaaccagugagguguaucaguaaggugggauuauggggguagauagaaaagg

SEQ ID NO: 110318 - RNA, 64 nt, Human
gaaaaaaaaaauuagccaggcaugcgaaacgcugaggugggaggaucagaugagcuugggaggu

SEQ ID NO: 110319 - RNA, 64 nt, Human
aguagaaaauuuaguuuagggaaagcccucccacaggugggaaauugcucuccccucuguggcu

SEQ ID NO: 110320 - RNA, 64 nt, Human
cuccuuuacaguauuaccgggacuaugaacuaaaaggugggacugaggauguguauagagugag

SEQ ID NO: 110321 - RNA, 64 nt, Human
gggaaggauguuuuuggacauuaucaacugagauaggugggaaaccuccucucauuuguggcuu

SEQ ID NO: 110322 - RNA, 64 nt, Human
uaugcgccuguuaucucagcagcucugggggcugaggugggaggauugcuugagcccaggaguu

SEQ ID NO: 110323 - RNA, 64 nt, Human
caugucccuguggucccagcuacucaggaggcugaggugggaggaucauuugagccuaggaggu

SEQ ID NO: 110324 - RNA, 64 nt, Human
ccauguccauggggaggugggcucugaagggcgaaggugggagagcagggccccugaggccugg

SEQ ID NO: 110325 - RNA, 64 nt, Human
cucaugacuguaaucccagcacuuugggaggccaaggugggaggaucaauugaggccagaguuu

SEQ ID NO: 110326 - RNA, 64 nt, Human
gcuccccuguaagcugggugagcuacugaagccaaggugggaggcagcugacaacaccacccac

SEQ ID NO: 110327 - RNA, 64 nt, Human
cauggaaugaaacaggggagugagggacacaaggaggugggaagugggagggucccagccccac

SEQ ID NO: 110328 - RNA, 64 nt, Human
ccucugaccagucuguuccggggcccccucagccaggugggaaugacggacacguacuauccaa

SEQ ID NO: 110329 - RNA, 64 nt, Human
uuuuuuuccgagauggagucucucucugucacccaggugggagugugguggcacaaucucggcu

SEQ ID NO: 110330 - RNA, 64 nt, Human
ugaaaauucaaagccuuucaauuugaagugaccuaggugggaggugauaaaauuuguucccuuu

SEQ ID NO: 110331 - RNA, 64 nt, Human
caccuuccaggauguccauuucggggagaggagcaggugggacccucaagaaaaugacggagaa

SEQ ID NO: 110332 - RNA, 64 nt, Human
cacgccuguaaucccccagcaauuugggaggcaaaggugggagaaucgcgugagcccaggaguu

SEQ ID NO: 110333 - RNA, 64 nt, Human
agcuucaggauggaaggacccaggagaggccccgaggugggaggguucuguaaauacagacuac

SEQ ID NO: 110334 - RNA, 64 nt, Human
uuacugagagcuuaugacuuccagaaagugcuaaaggugggaggugggccagggccuggacggg

SEQ ID NO: 110335 - RNA, 64 nt, Human
acaccaugagcucaggaucugugugaggugugggaggugggaagggugagggucugggggaaug

SEQ ID NO: 110336 - RNA, 64 nt, Human
cagcucaccaccacagccccucucagcccucaguaggugggaggggccagcugccucuuuaggc

SEQ ID NO: 110337 - RNA, 64 nt, Human
cucacacauggaaucccagcacuuugggaggccgaggugggaggaucacuugagcccaggaguu

SEQ ID NO: 110338 - RNA, 64 nt, Human
cacacaucaguagucccagcuacucugcaggcugaggugggaggauugcuugaacccaggaggu

SEQ ID NO: 110339 - RNA, 64 nt, Human
ucagagcccaggugcccucugaccugccaugcggaggugggauuugauacuguacauugucuug

SEQ ID NO: 110340 - RNA, 64 nt, Human
ugccaucucuuugcccaagccuggaagccuuggcaggugggaaaugccgcugcccuggugggca

SEQ ID NO: 110341 - RNA, 64 nt, Human
uuccuggcaagguggcuuugcagucuggaagggcaggugggagcugugacacagugugaaaaag

SEQ ID NO: 110342 - RNA, 64 nt, Human
cucugcuacuagccacugagaagugcacuuuaagaggugggagcugggcagaccccucuaccuc

SEQ ID NO: 110343 - RNA, 64 nt, Human
gcccuagugccugggugcuguggccugagguagcaggugggaaguuagggaugucacagaaaug

SEQ ID NO: 110344 - RNA, 64 nt, Human
aaguaggggguuucaaugcuguugggaaccaggaaggugggacagccggcagguagggacauug

SEQ ID NO: 110345 - RNA, 64 nt, Human
agacgugggguggggcggugugacaggguagaggaggugggagaugagaucuuccgcacaggaa

SEQ ID NO: 110346 - RNA, 64 nt, Human
uacgugccuguaggccuagcuacuuaggaggcugaggugggaggauugcuugagcccaggaguu

SEQ ID NO: 110347 - RNA, 64 nt, Human
ucauagugcuguucaggcaaaauggaauagucucaggugggaacaccuucucuugcuagcucca

SEQ ID NO: 110348 - RNA, 64 nt, Human
uggcagauguuugaggaaaggaauuaugccaggaaggugggaccggguuauggucggguuucua

SEQ ID NO: 110349 - RNA, 64 nt, Human
augugcugagggaagucugccuggugaggcuggcaggugggagucuaaugcagucaggagcauu

SEQ ID NO: 110350 - RNA, 64 nt, Human
uucccaaugucaaguuauuaggguagacuccaggaggugggauucuucaacuaaagaauaugaa

SEQ ID NO: 110351 - RNA, 64 nt, Human
uuuagguuccccuggacuccagccaaggcuguucaggugggaccauggugcucuuuaagcguga

SEQ ID NO: 110352 - RNA, 64 nt, Human
gguuucacugacguuuuccucaauuuuugaauuuaggugggauuugcuuucauguccuguuuca

SEQ ID NO: 110353 - RNA, 64 nt, Human
ugggguggggcuggcauccucccaggaagguucuaggugggaccccgucuucugggggcggggg

SEQ ID NO: 110354 - RNA, 64 nt, Human
auguguugacgaaacuggugccccagcagaucaaaggugggaaauacgucagcaguggggcuaa

SEQ ID NO: 110355 - RNA, 59 nt, Human
auccucaccugguggcuugaaaucggccaaggugggagcauuuacaccgcagaaaugac

SEQ ID NO: 110356 - RNA, 64 nt, Human
cacacaccuguggucccagcuacucgggaggcugaggugggaggaucgcuggagccugggaagu

SEQ ID NO: 110357 - RNA, 64 nt, Human
cacugccuccuggccagcugcccaccccagugccaggugggagagggagcagaacagccagccc

SEQ ID NO: 110358 - RNA, 64 nt, Human
gugauagcugcacugcugccugggauugcagcugaggugggaguggagaaugguucccaggaag

SEQ ID NO: 110359 - RNA, 64 nt, Human
acagacaugauaaaauucaccugcaugaguuggcaggugggagaaccaaacuggaucacugggu

SEQ ID NO: 110360 - RNA, 64 nt, Human
gcugagagaaaagaaaagugagccaagcagaaggaggugggaaaacggacccaaaccccagugu

SEQ ID NO: 110361 - RNA, 64 nt, Human
ugugcaccuguggucccagcuacuccagaggcugaggugggaagaucauuugagcccaggaggc

SEQ ID NO: 110362 - RNA, 64 nt, Human
caguucuguaccauaugagaaaguugccuucagaaggugggaagaucauuguuccauccucuac

SEQ ID NO: 110363 - RNA, 64 nt, Human
cccacaccuguggucccagcuacucaggaggcugaggugggaggaucauuugagcccaggaggu

SEQ ID NO: 110364 - RNA, 64 nt, Human
gggcuggggauggaugggagggaaggggagggaaaggugggaggaaugggaagcagcuguucug

SEQ ID NO: 110365 - RNA, 64 nt, Human
agugcagggugccugcacuucacccugugcagagaggugggauggggccgugcacacagggaug

SEQ ID NO: 110366 - RNA, 64 nt, Human
guaagaauugcuugguagcauaagcucagggauaaggugggaauugaguucaaauauaguguuu

SEQ ID NO: 110367 - RNA, 64 nt, Human
gcagcugucaaaugaggaauugauaagagacacgaggugggacauacaauccuacacuacagau

SEQ ID NO: 110368 - RNA, 64 nt, Human
cccaggcucucuugggcgagaaagaccauucuggaggugggagugggagagcugccugucugcc

SEQ ID NO: 110369 - RNA, 64 nt, Human; identical to SEQ ID NO: 109762

SEQ ID NO: 110370 - RNA, 64 nt, Human; identical to SEQ ID NO: 109763

SEQ ID NO: 110371 - RNA, 64 nt, Human; identical to SEQ ID NO: 109764

SEQ ID NO: 110372 - RNA, 64 nt, Human; identical to SEQ ID NO: 109765

SEQ ID NO: 110373 - RNA, 64 nt, Human; identical to SEQ ID NO: 109766

SEQ ID NO: 110374 - RNA, 64 nt, Human; identical to SEQ ID NO: 109767

SEQ ID NO: 110375 - RNA, 64 nt, Human; identical to SEQ ID NO: 109768

SEQ ID NO: 110376 - RNA, 64 nt, Human; identical to SEQ ID NO: 109769

SEQ ID NO: 110377 - RNA, 64 nt, Human; identical to SEQ ID NO: 109770

SEQ ID NO: 110378 - RNA, 64 nt, Human; identical to SEQ ID NO: 109771

SEQ ID NO: 110379 - RNA, 64 nt, Human; identical to SEQ ID NO: 109772

SEQ ID NO: 110380 - RNA, 64 nt, Human; identical to SEQ ID NO: 109773

SEQ ID NO: 110381 - RNA, 64 nt, Human; identical to SEQ ID NO: 109774

SEQ ID NO: 110382 - RNA, 64 nt, Human; identical to SEQ ID NO: 109775

SEQ ID NO: 110383 - RNA, 64 nt, Human; identical to SEQ ID NO: 109776

SEQ ID NO: 110384 - RNA, 64 nt, Human; identical to SEQ ID NO: 109776

SEQ ID NO: 110385 - RNA, 64 nt, Human; identical to SEQ ID NO: 109778

SEQ ID NO: 110386 - RNA, 64 nt, Human; identical to SEQ ID NO: 109779

SEQ ID NO: 110387 - RNA, 64 nt, Human; identical to SEQ ID NO: 109780

SEQ ID NO: 110388 - RNA, 64 nt, Human; identical to SEQ ID NO: 109781

SEQ ID NO: 110389 - RNA, 64 nt, Human; identical to SEQ ID NO: 109782

SEQ ID NO: 110390 - RNA, 64 nt, Human; identical to SEQ ID NO: 109783

SEQ ID NO: 110391 - RNA, 64 nt, Human; identical to SEQ ID NO: 109784

SEQ ID NO: 110392 - RNA, 64 nt, Human; identical to SEQ ID NO: 109785

SEQ ID NO: 110393 - RNA, 64 nt, Human; identical to SEQ ID NO: 109786

SEQ ID NO: 110394 - RNA, 64 nt, Human; identical to SEQ ID NO: 109787

SEQ ID NO: 110395 - RNA, 64 nt, Human; identical to SEQ ID NO: 109788

SEQ ID NO: 110396 - RNA, 64 nt, Human; identical to SEQ ID NO: 109789

SEQ ID NO: 110397 - RNA, 64 nt, Human; identical to SEQ ID NO: 109790

SEQ ID NO: 110398 - RNA, 64 nt, Human; identical to SEQ ID NO: 109791

SEQ ID NO: 110399 - RNA, 64 nt, Human; identical to SEQ ID NO: 109792

SEQ ID NO: 110400 - RNA, 64 nt, Human; identical to SEQ ID NO: 109793

SEQ ID NO: 110401 - RNA, 64 nt, Human; identical to SEQ ID NO: 109794

SEQ ID NO: 110402 - RNA, 64 nt, Human; identical to SEQ ID NO: 109795

SEQ ID NO: 110403 - RNA, 64 nt, Human; identical to SEQ ID NO: 109796

SEQ ID NO: 110404 - RNA, 64 nt, Human; identical to SEQ ID NO: 109797

SEQ ID NO: 110405 - RNA, 64 nt, Human; identical to SEQ ID NO: 109798

SEQ ID NO: 110406 - RNA, 64 nt, Human; identical to SEQ ID NO: 109799

SEQ ID NO: 110407 - RNA, 64 nt, Human; identical to SEQ ID NO: 109800

SEQ ID NO: 110408 - RNA, 64 nt, Human; identical to SEQ ID NO: 109801

SEQ ID NO: 110409 - RNA, 64 nt, Human; identical to SEQ ID NO: 109802

SEQ ID NO: 110410 - RNA, 64 nt, Human; identical to SEQ ID NO: 109803

SEQ ID NO: 110411 - RNA, 64 nt, Human; identical to SEQ ID NO: 109804

SEQ ID NO: 110412 - RNA, 64 nt, Human; identical to SEQ ID NO: 109805

SEQ ID NO: 110413 - RNA, 64 nt, Human; identical to SEQ ID NO: 109806

SEQ ID NO: 110414 - RNA, 64 nt, Human; identical to SEQ ID NO: 109807

SEQ ID NO: 110415 - RNA, 64 nt, Human; identical to SEQ ID NO: 109808

SEQ ID NO: 110416 - RNA, 64 nt, Human; identical to SEQ ID NO: 109809

SEQ ID NO: 110417 - RNA, 64 nt, Human; identical to SEQ ID NO: 109810

SEQ ID NO: 110418 - RNA, 64 nt, Human; identical to SEQ ID NO: 109811

SEQ ID NO: 110419 - RNA, 64 nt, Human; identical to SEQ ID NO: 109812

SEQ ID NO: 110420 - RNA, 64 nt, Human; identical to SEQ ID NO: 109813

SEQ ID NO: 110421 - RNA, 64 nt, Human; identical to SEQ ID NO: 109814

SEQ ID NO: 110422 - RNA, 64 nt, Human; identical to SEQ ID NO: 109815

SEQ ID NO: 110423 - RNA, 64 nt, Human; identical to SEQ ID NO: 109816

SEQ ID NO: 110424 - RNA, 64 nt, Human; identical to SEQ ID NO: 109817

SEQ ID NO: 110425 - RNA, 64 nt, Human; identical to SEQ ID NO: 109818

SEQ ID NO: 110426 - RNA, 64 nt, Human; identical to SEQ ID NO: 109819

SEQ ID NO: 110427 - RNA, 64 nt, Human; identical to SEQ ID NO: 109820

SEQ ID NO: 110428 - RNA, 64 nt, Human; identical to SEQ ID NO: 109821

SEQ ID NO: 110429 - RNA, 64 nt, Human; identical to SEQ ID NO: 109822

SEQ ID NO: 110430 - RNA, 64 nt, Human; identical to SEQ ID NO: 109823

SEQ ID NO: 110431 - RNA, 64 nt, Human; identical to SEQ ID NO: 109824

SEQ ID NO: 110432 - RNA, 64 nt, Human; identical to SEQ ID NO: 109825

SEQ ID NO: 110433 - RNA, 64 nt, Human; identical to SEQ ID NO: 109826

SEQ ID NO: 110434 - RNA, 64 nt, Human; identical to SEQ ID NO: 109827

SEQ ID NO: 110435 - RNA, 64 nt, Human; identical to SEQ ID NO: 109828

SEQ ID NO: 110436 - RNA, 64 nt, Human; identical to SEQ ID NO: 109829

SEQ ID NO: 110437 - RNA, 64 nt, Human; identical to SEQ ID NO: 109830

SEQ ID NO: 110438 - RNA, 64 nt, Human; identical to SEQ ID NO: 109831

SEQ ID NO: 110439 - RNA, 64 nt, Human; identical to SEQ ID NO: 109832

SEQ ID NO: 110440 - RNA, 64 nt, Human; identical to SEQ ID NO: 109833

SEQ ID NO: 110441 - RNA, 64 nt, Human; identical to SEQ ID NO: 109834

SEQ ID NO: 110442 - RNA, 64 nt, Human; identical to SEQ ID NO: 109835

SEQ ID NO: 110443 - RNA, 64 nt, Human; identical to SEQ ID NO: 109836

SEQ ID NO: 110444 - RNA, 64 nt, Human; identical to SEQ ID NO: 109837

SEQ ID NO: 110445 - RNA, 53 nt, Human; identical to SEQ ID NO: 109838

SEQ ID NO: 110446 - RNA, 64 nt, Human; identical to SEQ ID NO: 109839

SEQ ID NO: 110447 - RNA, 64 nt, Human; identical to SEQ ID NO: 109840

SEQ ID NO: 110448 - RNA, 64 nt, Human; identical to SEQ ID NO: 109841

SEQ ID NO: 110449 - RNA, 64 nt, Human; identical to SEQ ID NO: 109842

SEQ ID NO: 110450 - RNA, 64 nt, Human; identical to SEQ ID NO: 109843

SEQ ID NO: 110451 - RNA, 64 nt, Human; identical to SEQ ID NO: 109844

SEQ ID NO: 110452 - RNA, 64 nt, Human; identical to SEQ ID NO: 109845

SEQ ID NO: 110453 - RNA, 64 nt, Human; identical to SEQ ID NO: 109846

SEQ ID NO: 110454 - RNA, 64 nt, Human; identical to SEQ ID NO: 109847

SEQ ID NO: 110455 - RNA, 64 nt, Human; identical to SEQ ID NO: 109848

SEQ ID NO: 110456 - RNA, 64 nt, Human; identical to SEQ ID NO: 109849

SEQ ID NO: 110457 - RNA, 64 nt, Human; identical to SEQ ID NO: 109850

SEQ ID NO: 110458 - RNA, 64 nt, Human; identical to SEQ ID NO: 109851

SEQ ID NO: 110459 - RNA, 64 nt, Human; identical to SEQ ID NO: 109852

SEQ ID NO: 110460 - RNA, 64 nt, Human; identical to SEQ ID NO: 109853

SEQ ID NO: 110461 - RNA, 64 nt, Human; identical to SEQ ID NO: 109854

SEQ ID NO: 110462 - RNA, 64 nt, Human; identical to SEQ ID NO: 109855

SEQ ID NO: 110463 - RNA, 64 nt, Human; identical to SEQ ID NO: 109856

SEQ ID NO: 110464 - RNA, 64 nt, Human; identical to SEQ ID NO: 109857

SEQ ID NO: 110465 - RNA, 64 nt, Human; identical to SEQ ID NO: 109858

SEQ ID NO: 110466 - RNA, 64 nt, Human; identical to SEQ ID NO: 109859

SEQ ID NO: 110467 - RNA, 64 nt, Human; identical to SEQ ID NO: 109860

SEQ ID NO: 110468 - RNA, 64 nt, Human; identical to SEQ ID NO: 109861

SEQ ID NO: 110469 - RNA, 64 nt, Human; identical to SEQ ID NO: 109862

SEQ ID NO: 110470 - RNA, 64 nt, Human; identical to SEQ ID NO: 109863

SEQ ID NO: 110471 - RNA, 64 nt, Human; identical to SEQ ID NO: 109864

SEQ ID NO: 110472 - RNA, 64 nt, Human; identical to SEQ ID NO: 109865

SEQ ID NO: 110473 - RNA, 64 nt, Human; identical to SEQ ID NO: 109866

SEQ ID NO: 110474 - RNA, 64 nt, Human; identical to SEQ ID NO: 109867

SEQ ID NO: 110475 - RNA, 64 nt, Human; identical to SEQ ID NO: 109868

SEQ ID NO: 110476 - RNA, 64 nt, Human; identical to SEQ ID NO: 109869

SEQ ID NO: 110477 - RNA, 64 nt, Human; identical to SEQ ID NO: 109870

SEQ ID NO: 110478 - RNA, 64 nt, Human; identical to SEQ ID NO: 109871

SEQ ID NO: 110479 - RNA, 64 nt, Human; identical to SEQ ID NO: 109872

SEQ ID NO: 110480 - RNA, 64 nt, Human; identical to SEQ ID NO: 109873

SEQ ID NO: 110481 - RNA, 64 nt, Human; identical to SEQ ID NO: 109874

SEQ ID NO: 110482 - RNA, 64 nt, Human; identical to SEQ ID NO: 109875

SEQ ID NO: 110483 - RNA, 64 nt, Human; identical to SEQ ID NO: 109876

SEQ ID NO: 110484 - RNA, 64 nt, Human; identical to SEQ ID NO: 109877

SEQ ID NO: 110485 - RNA, 64 nt, Human; identical to SEQ ID NO: 109878

SEQ ID NO: 110486 - RNA, 64 nt, Human; identical to SEQ ID NO: 109879

SEQ ID NO: 110487 - RNA, 64 nt, Human; identical to SEQ ID NO: 109880

SEQ ID NO: 110488 - RNA, 64 nt, Human; identical to SEQ ID NO: 109881

SEQ ID NO: 110489 - RNA, 64 nt, Human; identical to SEQ ID NO: 109882

SEQ ID NO: 110490 - RNA, 64 nt, Human; identical to SEQ ID NO: 109883

SEQ ID NO: 110491 - RNA, 64 nt, Human; identical to SEQ ID NO: 109884

SEQ ID NO: 110492 - RNA, 64 nt, Human; identical to SEQ ID NO: 109885

SEQ ID NO: 110493 - RNA, 64 nt, Human; identical to SEQ ID NO: 109886

SEQ ID NO: 110494 - RNA, 64 nt, Human; identical to SEQ ID NO: 109887

SEQ ID NO: 110495 - RNA, 64 nt, Human; identical to SEQ ID NO: 109888

SEQ ID NO: 110496 - RNA, 64 nt, Human; identical to SEQ ID NO: 109889

SEQ ID NO: 110497 - RNA, 64 nt, Human; identical to SEQ ID NO: 109890

SEQ ID NO: 110498 - RNA, 64 nt, Human; identical to SEQ ID NO: 109891

SEQ ID NO: 110499 - RNA, 64 nt, Human; identical to SEQ ID NO: 109892

SEQ ID NO: 110500 - RNA, 64 nt, Human; identical to SEQ ID NO: 109893

SEQ ID NO: 110501 - RNA, 64 nt, Human; identical to SEQ ID NO: 109894

SEQ ID NO: 110502 - RNA, 64 nt, Human; identical to SEQ ID NO: 109895

SEQ ID NO: 110503 - RNA, 64 nt, Human; identical to SEQ ID NO: 109896

SEQ ID NO: 110504 - RNA, 64 nt, Human; identical to SEQ ID NO: 109897

SEQ ID NO: 110505 - RNA, 64 nt, Human; identical to SEQ ID NO: 109898

SEQ ID NO: 110506 - RNA, 64 nt, Human; identical to SEQ ID NO: 109899

SEQ ID NO: 110507 - RNA, 64 nt, Human; identical to SEQ ID NO: 109900

SEQ ID NO: 110508 - RNA, 64 nt, Human; identical to SEQ ID NO: 109901

SEQ ID NO: 110509 - RNA, 64 nt, Human; identical to SEQ ID NO: 109902

SEQ ID NO: 110510 - RNA, 64 nt, Human; identical to SEQ ID NO: 109903

SEQ ID NO: 110511 - RNA, 64 nt, Human; identical to SEQ ID NO: 109904

SEQ ID NO: 110512 - RNA, 64 nt, Human; identical to SEQ ID NO: 109905

SEQ ID NO: 110513 - RNA, 64 nt, Human; identical to SEQ ID NO: 109906

SEQ ID NO: 110514 - RNA, 64 nt, Human; identical to SEQ ID NO: 109907

SEQ ID NO: 110515 - RNA, 64 nt, Human; identical to SEQ ID NO: 109908

SEQ ID NO: 110516 - RNA, 64 nt, Human; identical to SEQ ID NO: 109909

SEQ ID NO: 110517 - RNA, 64 nt, Human; identical to SEQ ID NO: 109910

SEQ ID NO: 110518 - RNA, 64 nt, Human; identical to SEQ ID NO: 109911

SEQ ID NO: 110519 - RNA, 64 nt, Human; identical to SEQ ID NO: 109912

SEQ ID NO: 110520 - RNA, 64 nt, Human; identical to SEQ ID NO: 109913

SEQ ID NO: 110521 - RNA, 64 nt, Human; identical to SEQ ID NO: 109914

SEQ ID NO: 110522 - RNA, 64 nt, Human; identical to SEQ ID NO: 109915

SEQ ID NO: 110523 - RNA, 64 nt, Human; identical to SEQ ID NO: 109916

SEQ ID NO: 110524 - RNA, 64 nt, Human; identical to SEQ ID NO: 109917

SEQ ID NO: 110525 - RNA, 64 nt, Human; identical to SEQ ID NO: 109918

SEQ ID NO: 110526 - RNA, 64 nt, Human; identical to SEQ ID NO: 109919

SEQ ID NO: 110527 - RNA, 64 nt, Human; identical to SEQ ID NO: 109920

SEQ ID NO: 110528 - RNA, 64 nt, Human; identical to SEQ ID NO: 109921

SEQ ID NO: 110529 - RNA, 64 nt, Human; identical to SEQ ID NO: 109922

SEQ ID NO: 110530 - RNA, 64 nt, Human; identical to SEQ ID NO: 109923

SEQ ID NO: 110531 - RNA, 64 nt, Human; identical to SEQ ID NO: 109924

SEQ ID NO: 110532 - RNA, 64 nt, Human; identical to SEQ ID NO: 109925

SEQ ID NO: 110533 - RNA, 64 nt, Human; identical to SEQ ID NO: 109926

SEQ ID NO: 110534 - RNA, 64 nt, Human; identical to SEQ ID NO: 109927

SEQ ID NO: 110535 - RNA, 64 nt, Human; identical to SEQ ID NO: 109928

SEQ ID NO: 110536 - RNA, 64 nt, Human; identical to SEQ ID NO: 109929

SEQ ID NO: 110537 - RNA, 64 nt, Human; identical to SEQ ID NO: 109930

SEQ ID NO: 110538 - RNA, 64 nt, Human; identical to SEQ ID NO: 109931

SEQ ID NO: 110539 - RNA, 64 nt, Human; identical to SEQ ID NO: 109932

SEQ ID NO: 110540 - RNA, 64 nt, Human; identical to SEQ ID NO: 109933

SEQ ID NO: 110541 - RNA, 64 nt, Human; identical to SEQ ID NO: 109934

SEQ ID NO: 110542 - RNA, 64 nt, Human; identical to SEQ ID NO: 109935

SEQ ID NO: 110543 - RNA, 56 nt, Human; identical to SEQ ID NO: 109936

SEQ ID NO: 110544 - RNA, 64 nt, Human; identical to SEQ ID NO: 109937

SEQ ID NO: 110545 - RNA, 64 nt, Human; identical to SEQ ID NO: 109938

SEQ ID NO: 110546 - RNA, 64 nt, Human; identical to SEQ ID NO: 109939

SEQ ID NO: 110547 - RNA, 64 nt, Human; identical to SEQ ID NO: 109940

SEQ ID NO: 110548 - RNA, 64 nt, Human; identical to SEQ ID NO: 109941

SEQ ID NO: 110549 - RNA, 64 nt, Human; identical to SEQ ID NO: 109942

SEQ ID NO: 110550 - RNA, 64 nt, Human; identical to SEQ ID NO: 109943

SEQ ID NO: 110551 - RNA, 64 nt, Human; identical to SEQ ID NO: 109944

SEQ ID NO: 110552 - RNA, 64 nt, Human; identical to SEQ ID NO: 109945

SEQ ID NO: 110553 - RNA, 64 nt, Human; identical to SEQ ID NO: 109946

SEQ ID NO: 110554 - RNA, 64 nt, Human; identical to SEQ ID NO: 109947

SEQ ID NO: 110555 - RNA, 64 nt, Human; identical to SEQ ID NO: 109948

SEQ ID NO: 110556 - RNA, 64 nt, Human; identical to SEQ ID NO: 109949

SEQ ID NO: 110557 - RNA, 64 nt, Human; identical to SEQ ID NO: 109950

SEQ ID NO: 110558 - RNA, 64 nt, Human; identical to SEQ ID NO: 109951

SEQ ID NO: 110559 - RNA, 64 nt, Human; identical to SEQ ID NO: 109952

SEQ ID NO: 110560 - RNA, 64 nt, Human; identical to SEQ ID NO: 109953

SEQ ID NO: 110561 - RNA, 64 nt, Human; identical to SEQ ID NO: 109954

SEQ ID NO: 110562 - RNA, 64 nt, Human; identical to SEQ ID NO: 109955

SEQ ID NO: 110563 - RNA, 64 nt, Human; identical to SEQ ID NO: 109956

SEQ ID NO: 110564 - RNA, 64 nt, Human; identical to SEQ ID NO: 109957

SEQ ID NO: 110565 - RNA, 64 nt, Human; identical to SEQ ID NO: 109958

SEQ ID NO: 110566 - RNA, 64 nt, Human; identical to SEQ ID NO: 109959

SEQ ID NO: 110567 - RNA, 64 nt, Human; identical to SEQ ID NO: 109960

SEQ ID NO: 110568 - RNA, 64 nt, Human; identical to SEQ ID NO: 109961

SEQ ID NO: 110569 - RNA, 64 nt, Human; identical to SEQ ID NO: 109962

SEQ ID NO: 110570 - RNA, 64 nt, Human; identical to SEQ ID NO: 109963

SEQ ID NO: 110571 - RNA, 64 nt, Human; identical to SEQ ID NO: 109964

SEQ ID NO: 110572 - RNA, 64 nt, Human; identical to SEQ ID NO: 109965

SEQ ID NO: 110573 - RNA, 64 nt, Human; identical to SEQ ID NO: 109966

SEQ ID NO: 110574 - RNA, 64 nt, Human; identical to SEQ ID NO: 109967

SEQ ID NO: 110575 - RNA, 64 nt, Human; identical to SEQ ID NO: 109968

SEQ ID NO: 110576 - RNA, 64 nt, Human; identical to SEQ ID NO: 109969

SEQ ID NO: 110577 - RNA, 64 nt, Human; identical to SEQ ID NO: 109970

SEQ ID NO: 110578 - RNA, 64 nt, Human; identical to SEQ ID NO: 109971

SEQ ID NO: 110579 - RNA, 64 nt, Human; identical to SEQ ID NO: 109972

SEQ ID NO: 110580 - RNA, 64 nt, Human; identical to SEQ ID NO: 109973

SEQ ID NO: 110581 - RNA, 64 nt, Human; identical to SEQ ID NO: 109974

SEQ ID NO: 110582 - RNA, 64 nt, Human; identical to SEQ ID NO: 109975

SEQ ID NO: 110583 - RNA, 64 nt, Human; identical to SEQ ID NO: 109976

SEQ ID NO: 110584 - RNA, 64 nt, Human; identical to SEQ ID NO: 109977

SEQ ID NO: 110585 - RNA, 64 nt, Human; identical to SEQ ID NO: 109978

SEQ ID NO: 110586 - RNA, 64 nt, Human; identical to SEQ ID NO: 109979

SEQ ID NO: 110587 - RNA, 64 nt, Human; identical to SEQ ID NO: 109980

SEQ ID NO: 110588 - RNA, 64 nt, Human; identical to SEQ ID NO: 109981

SEQ ID NO: 110589 - RNA, 64 nt, Human; identical to SEQ ID NO: 109982

SEQ ID NO: 110590 - RNA, 64 nt, Human; identical to SEQ ID NO: 109983

SEQ ID NO: 110591 - RNA, 64 nt, Human; identical to SEQ ID NO: 109984

SEQ ID NO: 110592 - RNA, 64 nt, Human; identical to SEQ ID NO: 109985

SEQ ID NO: 110593 - RNA, 64 nt, Human; identical to SEQ ID NO: 109986

SEQ ID NO: 110594 - RNA, 64 nt, Human; identical to SEQ ID NO: 109987

SEQ ID NO: 110595 - RNA, 64 nt, Human; identical to SEQ ID NO: 109988

SEQ ID NO: 110596 - RNA, 64 nt, Human; identical to SEQ ID NO: 109989

SEQ ID NO: 110597 - RNA, 64 nt, Human; identical to SEQ ID NO: 109990

SEQ ID NO: 110598 - RNA, 64 nt, Human; identical to SEQ ID NO: 109991

SEQ ID NO: 110599 - RNA, 64 nt, Human; identical to SEQ ID NO: 109992

SEQ ID NO: 110600 - RNA, 64 nt, Human; identical to SEQ ID NO: 109993

SEQ ID NO: 110601 - RNA, 64 nt, Human; identical to SEQ ID NO: 109994

SEQ ID NO: 110602 - RNA, 64 nt, Human; identical to SEQ ID NO: 109995

SEQ ID NO: 110603 - RNA, 64 nt, Human; identical to SEQ ID NO: 109996

SEQ ID NO: 110604 - RNA, 64 nt, Human; identical to SEQ ID NO: 109997

SEQ ID NO: 110605 - RNA, 64 nt, Human; identical to SEQ ID NO: 109998

SEQ ID NO: 110606 - RNA, 64 nt, Human; identical to SEQ ID NO: 109999

SEQ ID NO: 110607 - RNA, 64 nt, Human; identical to SEQ ID NO: 110000

SEQ ID NO: 110608 - RNA, 64 nt, Human; identical to SEQ ID NO: 110001

SEQ ID NO: 110609 - RNA, 64 nt, Human; identical to SEQ ID NO: 110002

SEQ ID NO: 110610 - RNA, 64 nt, Human; identical to SEQ ID NO: 110003

SEQ ID NO: 110611 - RNA, 64 nt, Human; identical to SEQ ID NO: 110004

SEQ ID NO: 110612 - RNA, 64 nt, Human; identical to SEQ ID NO: 110005

SEQ ID NO: 110613 - RNA, 64 nt, Human; identical to SEQ ID NO: 110006

SEQ ID NO: 110614 - RNA, 64 nt, Human; identical to SEQ ID NO: 110007

SEQ ID NO: 110615 - RNA, 64 nt, Human; identical to SEQ ID NO: 110008

SEQ ID NO: 110616 - RNA, 64 nt, Human; identical to SEQ ID NO: 110009

SEQ ID NO: 110617 - RNA, 64 nt, Human; identical to SEQ ID NO: 110010

SEQ ID NO: 110618 - RNA, 64 nt, Human; identical to SEQ ID NO: 110011

SEQ ID NO: 110619 - RNA, 64 nt, Human; identical to SEQ ID NO: 110012

SEQ ID NO: 110620 - RNA, 64 nt, Human; identical to SEQ ID NO: 110013

SEQ ID NO: 110621 - RNA, 64 nt, Human; identical to SEQ ID NO: 110014

SEQ ID NO: 110622 - RNA, 64 nt, Human; identical to SEQ ID NO: 110015

SEQ ID NO: 110623 - RNA, 64 nt, Human; identical to SEQ ID NO: 110016

SEQ ID NO: 110624 - RNA, 64 nt, Human; identical to SEQ ID NO: 110017

SEQ ID NO: 110625 - RNA, 64 nt, Human; identical to SEQ ID NO: 110018

SEQ ID NO: 110626 - RNA, 64 nt, Human; identical to SEQ ID NO: 110019

SEQ ID NO: 110627 - RNA, 64 nt, Human; identical to SEQ ID NO: 110020

SEQ ID NO: 110628 - RNA, 64 nt, Human; identical to SEQ ID NO: 110021

SEQ ID NO: 110629 - RNA, 64 nt, Human; identical to SEQ ID NO: 110022

SEQ ID NO: 110630 - RNA, 64 nt, Human; identical to SEQ ID NO: 110023

SEQ ID NO: 110631 - RNA, 64 nt, Human; identical to SEQ ID NO: 110024

SEQ ID NO: 110632 - RNA, 64 nt, Human; identical to SEQ ID NO: 110025

SEQ ID NO: 110633 - RNA, 64 nt, Human; identical to SEQ ID NO: 110026

SEQ ID NO: 110634 - RNA, 64 nt, Human; identical to SEQ ID NO: 110027

SEQ ID NO: 110635 - RNA, 64 nt, Human; identical to SEQ ID NO: 110028

SEQ ID NO: 110636 - RNA, 64 nt, Human; identical to SEQ ID NO: 110029

SEQ ID NO: 110637 - RNA, 64 nt, Human; identical to SEQ ID NO: 110030

SEQ ID NO: 110638 - RNA, 64 nt, Human; identical to SEQ ID NO: 110031

SEQ ID NO: 110639 - RNA, 64 nt, Human; identical to SEQ ID NO: 110032

SEQ ID NO: 110640 - RNA, 64 nt, Human; identical to SEQ ID NO: 110033

SEQ ID NO: 110641 - RNA, 64 nt, Human; identical to SEQ ID NO: 110034

SEQ ID NO: 110642 - RNA, 64 nt, Human; identical to SEQ ID NO: 110035

SEQ ID NO: 110643 - RNA, 64 nt, Human; identical to SEQ ID NO: 110036

SEQ ID NO: 110644 - RNA, 64 nt, Human; identical to SEQ ID NO: 110037

SEQ ID NO: 110645 - RNA, 64 nt, Human; identical to SEQ ID NO: 110038

SEQ ID NO: 110646 - RNA, 64 nt, Human; identical to SEQ ID NO: 110039

SEQ ID NO: 110647 - RNA, 64 nt, Human; identical to SEQ ID NO: 110040

SEQ ID NO: 110648 - RNA, 64 nt, Human; identical to SEQ ID NO: 110041

SEQ ID NO: 110649 - RNA, 64 nt, Human; identical to SEQ ID NO: 110042

SEQ ID NO: 110650 - RNA, 64 nt, Human; identical to SEQ ID NO: 110043

SEQ ID NO: 110651 - RNA, 64 nt, Human; identical to SEQ ID NO: 110044

SEQ ID NO: 110652 - RNA, 64 nt, Human; identical to SEQ ID NO: 110045

SEQ ID NO: 110653 - RNA, 64 nt, Human; identical to SEQ ID NO: 110046

SEQ ID NO: 110654 - RNA, 64 nt, Human; identical to SEQ ID NO: 110047

SEQ ID NO: 110655 - RNA, 64 nt, Human; identical to SEQ ID NO: 110048

SEQ ID NO: 110656 - RNA, 64 nt, Human; identical to SEQ ID NO: 110049

SEQ ID NO: 110657 - RNA, 64 nt, Human; identical to SEQ ID NO: 110050

SEQ ID NO: 110658 - RNA, 64 nt, Human; identical to SEQ ID NO: 110051

SEQ ID NO: 110659 - RNA, 64 nt, Human; identical to SEQ ID NO: 110052

SEQ ID NO: 110660 - RNA, 64 nt, Human; identical to SEQ ID NO: 110053

SEQ ID NO: 110661 - RNA, 64 nt, Human; identical to SEQ ID NO: 110054

SEQ ID NO: 110662 - RNA, 64 nt, Human; identical to SEQ ID NO: 110055

SEQ ID NO: 110663 - RNA, 64 nt, Human; identical to SEQ ID NO: 110056

SEQ ID NO: 110664 - RNA, 64 nt, Human; identical to SEQ ID NO: 110057

SEQ ID NO: 110665 - RNA, 64 nt, Human; identical to SEQ ID NO: 110058

SEQ ID NO: 110666 - RNA, 64 nt, Human; identical to SEQ ID NO: 110059

SEQ ID NO: 110667 - RNA, 64 nt, Human; identical to SEQ ID NO: 110060

SEQ ID NO: 110668 - RNA, 64 nt, Human; identical to SEQ ID NO: 110061

SEQ ID NO: 110669 - RNA, 64 nt, Human; identical to SEQ ID NO: 110062

SEQ ID NO: 110670 - RNA, 64 nt, Human; identical to SEQ ID NO: 110063

SEQ ID NO: 110671 - RNA, 64 nt, Human; identical to SEQ ID NO: 110064

SEQ ID NO: 110672 - RNA, 64 nt, Human; identical to SEQ ID NO: 110065

SEQ ID NO: 110673 - RNA, 64 nt, Human; identical to SEQ ID NO: 110066

SEQ ID NO: 110674 - RNA, 64 nt, Human; identical to SEQ ID NO: 110067

SEQ ID NO: 110675 - RNA, 64 nt, Human; identical to SEQ ID NO: 110068

SEQ ID NO: 110676 - RNA, 64 nt, Human; identical to SEQ ID NO: 110069

SEQ ID NO: 110677 - RNA, 64 nt, Human; identical to SEQ ID NO: 110070

SEQ ID NO: 110678 - RNA, 64 nt, Human; identical to SEQ ID NO: 110071

SEQ ID NO: 110679 - RNA, 64 nt, Human; identical to SEQ ID NO: 110072

SEQ ID NO: 110680 - RNA, 64 nt, Human; identical to SEQ ID NO: 110073

SEQ ID NO: 110681 - RNA, 64 nt, Human; identical to SEQ ID NO: 110074

SEQ ID NO: 110682 - RNA, 64 nt, Human; identical to SEQ ID NO: 110075

SEQ ID NO: 110683 - RNA, 64 nt, Human; identical to SEQ ID NO: 110076

SEQ ID NO: 110684 - RNA, 64 nt, Human; identical to SEQ ID NO: 110077

SEQ ID NO: 110685 - RNA, 64 nt, Human; identical to SEQ ID NO: 110078

SEQ ID NO: 110686 - RNA, 64 nt, Human; identical to SEQ ID NO: 110079

SEQ ID NO: 110687 - RNA, 64 nt, Human; identical to SEQ ID NO: 110080

SEQ ID NO: 110688 - RNA, 64 nt, Human; identical to SEQ ID NO: 110081

SEQ ID NO: 110689 - RNA, 64 nt, Human; identical to SEQ ID NO: 110082

SEQ ID NO: 110690 - RNA, 64 nt, Human; identical to SEQ ID NO: 110083

SEQ ID NO: 110691 - RNA, 64 nt, Human; identical to SEQ ID NO: 110084

SEQ ID NO: 110692 - RNA, 64 nt, Human; identical to SEQ ID NO: 110085

SEQ ID NO: 110693 - RNA, 64 nt, Human; identical to SEQ ID NO: 110086

SEQ ID NO: 110694 - RNA, 64 nt, Human; identical to SEQ ID NO: 110087

SEQ ID NO: 110695 - RNA, 64 nt, Human; identical to SEQ ID NO: 110088

SEQ ID NO: 110696 - RNA, 64 nt, Human; identical to SEQ ID NO: 110089

SEQ ID NO: 110697 - RNA, 64 nt, Human; identical to SEQ ID NO: 110090

SEQ ID NO: 110698 - RNA, 64 nt, Human; identical to SEQ ID NO: 110091

SEQ ID NO: 110699 - RNA, 64 nt, Human; identical to SEQ ID NO: 110092

SEQ ID NO: 110700 - RNA, 64 nt, Human; identical to SEQ ID NO: 110093

SEQ ID NO: 110701 - RNA, 64 nt, Human; identical to SEQ ID NO: 110094

SEQ ID NO: 110702 - RNA, 64 nt, Human; identical to SEQ ID NO: 110095

SEQ ID NO: 110703 - RNA, 64 nt, Human; identical to SEQ ID NO: 110096

SEQ ID NO: 110704 - RNA, 64 nt, Human; identical to SEQ ID NO: 110097

SEQ ID NO: 110705 - RNA, 64 nt, Human; identical to SEQ ID NO: 110098

SEQ ID NO: 110706 - RNA, 64 nt, Human; identical to SEQ ID NO: 110099

SEQ ID NO: 110707 - RNA, 64 nt, Human; identical to SEQ ID NO: 110100

SEQ ID NO: 110708 - RNA, 64 nt, Human; identical to SEQ ID NO: 110101

SEQ ID NO: 110709 - RNA, 64 nt, Human; identical to SEQ ID NO: 110102

SEQ ID NO: 110710 - RNA, 64 nt, Human; identical to SEQ ID NO: 110103

SEQ ID NO: 110711 - RNA, 64 nt, Human; identical to SEQ ID NO: 110104

SEQ ID NO: 110712 - RNA, 64 nt, Human; identical to SEQ ID NO: 110105

SEQ ID NO: 110713 - RNA, 64 nt, Human; identical to SEQ ID NO: 110106

SEQ ID NO: 110714 - RNA, 64 nt, Human; identical to SEQ ID NO: 110107

SEQ ID NO: 110715 - RNA, 64 nt, Human; identical to SEQ ID NO: 110108

SEQ ID NO: 110716 - RNA, 64 nt, Human; identical to SEQ ID NO: 110109

SEQ ID NO: 110717 - RNA, 64 nt, Human; identical to SEQ ID NO: 110110

SEQ ID NO: 110718 - RNA, 64 nt, Human; identical to SEQ ID NO: 110111

SEQ ID NO: 110719 - RNA, 64 nt, Human; identical to SEQ ID NO: 110112

SEQ ID NO: 110720 - RNA, 64 nt, Human; identical to SEQ ID NO: 110113

SEQ ID NO: 110721 - RNA, 64 nt, Human; identical to SEQ ID NO: 110114

SEQ ID NO: 110722 - RNA, 64 nt, Human; identical to SEQ ID NO: 110115

SEQ ID NO: 110723 - RNA, 64 nt, Human; identical to SEQ ID NO: 110116

SEQ ID NO: 110724 - RNA, 64 nt, Human; identical to SEQ ID NO: 110117

SEQ ID NO: 110725 - RNA, 64 nt, Human; identical to SEQ ID NO: 110118

SEQ ID NO: 110726 - RNA, 64 nt, Human; identical to SEQ ID NO: 110119

SEQ ID NO: 110727 - RNA, 64 nt, Human; identical to SEQ ID NO: 110120

SEQ ID NO: 110728 - RNA, 64 nt, Human; identical to SEQ ID NO: 110121

SEQ ID NO: 110729 - RNA, 64 nt, Human; identical to SEQ ID NO: 110122

SEQ ID NO: 110730 - RNA, 64 nt, Human; identical to SEQ ID NO: 110123

SEQ ID NO: 110731 - RNA, 64 nt, Human; identical to SEQ ID NO: 110124

SEQ ID NO: 110732 - RNA, 64 nt, Human; identical to SEQ ID NO: 110125

SEQ ID NO: 110733 - RNA, 64 nt, Human; identical to SEQ ID NO: 110126

SEQ ID NO: 110734 - RNA, 64 nt, Human; identical to SEQ ID NO: 110127

SEQ ID NO: 110735 - RNA, 64 nt, Human; identical to SEQ ID NO: 110128

SEQ ID NO: 110736 - RNA, 64 nt, Human; identical to SEQ ID NO: 110129

SEQ ID NO: 110737 - RNA, 64 nt, Human; identical to SEQ ID NO: 110130

SEQ ID NO: 110738 - RNA, 64 nt, Human; identical to SEQ ID NO: 110131

SEQ ID NO: 110739 - RNA, 64 nt, Human; identical to SEQ ID NO: 110132

SEQ ID NO: 110740 - RNA, 64 nt, Human; identical to SEQ ID NO: 110133

SEQ ID NO: 110741 - RNA, 64 nt, Human; identical to SEQ ID NO: 110134

SEQ ID NO: 110742 - RNA, 64 nt, Human; identical to SEQ ID NO: 110135

SEQ ID NO: 110743 - RNA, 64 nt, Human; identical to SEQ ID NO: 110136

SEQ ID NO: 110744 - RNA, 64 nt, Human; identical to SEQ ID NO: 110137

SEQ ID NO: 110745 - RNA, 64 nt, Human; identical to SEQ ID NO: 110138

SEQ ID NO: 110746 - RNA, 64 nt, Human; identical to SEQ ID NO: 110139

SEQ ID NO: 110747 - RNA, 64 nt, Human; identical to SEQ ID NO: 110140

SEQ ID NO: 110748 - RNA, 64 nt, Human; identical to SEQ ID NO: 110141

SEQ ID NO: 110749 - RNA, 64 nt, Human; identical to SEQ ID NO: 110142

SEQ ID NO: 110750 - RNA, 64 nt, Human; identical to SEQ ID NO: 110143

SEQ ID NO: 110751 - RNA, 64 nt, Human; identical to SEQ ID NO: 110144

SEQ ID NO: 110752 - RNA, 64 nt, Human; identical to SEQ ID NO: 110145

SEQ ID NO: 110753 - RNA, 64 nt, Human; identical to SEQ ID NO: 110146

SEQ ID NO: 110754 - RNA, 64 nt, Human; identical to SEQ ID NO: 110147

SEQ ID NO: 110755 - RNA, 64 nt, Human; identical to SEQ ID NO: 110148

SEQ ID NO: 110756 - RNA, 64 nt, Human; identical to SEQ ID NO: 110149

SEQ ID NO: 110757 - RNA, 64 nt, Human; identical to SEQ ID NO: 110150

SEQ ID NO: 110758 - RNA, 64 nt, Human; identical to SEQ ID NO: 110151

SEQ ID NO: 110759 - RNA, 64 nt, Human; identical to SEQ ID NO: 110152

SEQ ID NO: 110760 - RNA, 64 nt, Human; identical to SEQ ID NO: 110153

SEQ ID NO: 110761 - RNA, 64 nt, Human; identical to SEQ ID NO: 110154

SEQ ID NO: 110762 - RNA, 64 nt, Human; identical to SEQ ID NO: 110155

SEQ ID NO: 110763 - RNA, 64 nt, Human; identical to SEQ ID NO: 110156

SEQ ID NO: 110764 - RNA, 64 nt, Human; identical to SEQ ID NO: 110157

SEQ ID NO: 110765 - RNA, 64 nt, Human; identical to SEQ ID NO: 110158

SEQ ID NO: 110766 - RNA, 64 nt, Human; identical to SEQ ID NO: 110159

SEQ ID NO: 110767 - RNA, 64 nt, Human; identical to SEQ ID NO: 110160

SEQ ID NO: 110768 - RNA, 64 nt, Human; identical to SEQ ID NO: 110161

SEQ ID NO: 110769 - RNA, 64 nt, Human; identical to SEQ ID NO: 110162

SEQ ID NO: 110770 - RNA, 64 nt, Human; identical to SEQ ID NO: 110163

SEQ ID NO: 110771 - RNA, 64 nt, Human; identical to SEQ ID NO: 110164

SEQ ID NO: 110772 - RNA, 64 nt, Human; identical to SEQ ID NO: 110165

SEQ ID NO: 110773 - RNA, 64 nt, Human; identical to SEQ ID NO: 110166

SEQ ID NO: 110774 - RNA, 64 nt, Human; identical to SEQ ID NO: 110167

SEQ ID NO: 110775 - RNA, 64 nt, Human; identical to SEQ ID NO: 110168

SEQ ID NO: 110776 - RNA, 64 nt, Human; identical to SEQ ID NO: 110169

SEQ ID NO: 110777 - RNA, 64 nt, Human; identical to SEQ ID NO: 110170

SEQ ID NO: 110778 - RNA, 64 nt, Human; identical to SEQ ID NO: 110171

SEQ ID NO: 110779 - RNA, 64 nt, Human; identical to SEQ ID NO: 110172

SEQ ID NO: 110780 - RNA, 64 nt, Human; identical to SEQ ID NO: 110173

SEQ ID NO: 110781 - RNA, 64 nt, Human; identical to SEQ ID NO: 110174

SEQ ID NO: 110782 - RNA, 64 nt, Human; identical to SEQ ID NO: 110175

SEQ ID NO: 110783 - RNA, 64 nt, Human; identical to SEQ ID NO: 110176

SEQ ID NO: 110784 - RNA, 64 nt, Human; identical to SEQ ID NO: 110177

SEQ ID NO: 110785 - RNA, 64 nt, Human; identical to SEQ ID NO: 110178

SEQ ID NO: 110786 - RNA, 64 nt, Human; identical to SEQ ID NO: 110179

SEQ ID NO: 110787 - RNA, 64 nt, Human; identical to SEQ ID NO: 110180

SEQ ID NO: 110788 - RNA, 64 nt, Human; identical to SEQ ID NO: 110181

SEQ ID NO: 110789 - RNA, 64 nt, Human; identical to SEQ ID NO: 110182

SEQ ID NO: 110790 - RNA, 64 nt, Human; identical to SEQ ID NO: 110183

SEQ ID NO: 110791 - RNA, 64 nt, Human; identical to SEQ ID NO: 110184

SEQ ID NO: 110792 - RNA, 64 nt, Human; identical to SEQ ID NO: 110185

SEQ ID NO: 110793 - RNA, 64 nt, Human; identical to SEQ ID NO: 110186

SEQ ID NO: 110794 - RNA, 64 nt, Human; identical to SEQ ID NO: 110187

SEQ ID NO: 110795 - RNA, 64 nt, Human; identical to SEQ ID NO: 110188

SEQ ID NO: 110796 - RNA, 64 nt, Human; identical to SEQ ID NO: 110189

SEQ ID NO: 110797 - RNA, 64 nt, Human; identical to SEQ ID NO: 110190

SEQ ID NO: 110798 - RNA, 64 nt, Human; identical to SEQ ID NO: 110191

SEQ ID NO: 110799 - RNA, 64 nt, Human; identical to SEQ ID NO: 110192

SEQ ID NO: 110800 - RNA, 64 nt, Human; identical to SEQ ID NO: 110193

SEQ ID NO: 110801 - RNA, 64 nt, Human; identical to SEQ ID NO: 110194

SEQ ID NO: 110802 - RNA, 64 nt, Human; identical to SEQ ID NO: 110195

SEQ ID NO: 110803 - RNA, 64 nt, Human; identical to SEQ ID NO: 110196

SEQ ID NO: 110804 - RNA, 64 nt, Human; identical to SEQ ID NO: 110197

SEQ ID NO: 110805 - RNA, 64 nt, Human; identical to SEQ ID NO: 110198

SEQ ID NO: 110806 - RNA, 64 nt, Human; identical to SEQ ID NO: 110199

SEQ ID NO: 110807 - RNA, 64 nt, Human; identical to SEQ ID NO: 110200

SEQ ID NO: 110808 - RNA, 64 nt, Human; identical to SEQ ID NO: 110201

SEQ ID NO: 110809 - RNA, 64 nt, Human; identical to SEQ ID NO: 110202

SEQ ID NO: 110810 - RNA, 64 nt, Human; identical to SEQ ID NO: 110203

SEQ ID NO: 110811 - RNA, 64 nt, Human; identical to SEQ ID NO: 110204

SEQ ID NO: 110812 - RNA, 64 nt, Human; identical to SEQ ID NO: 110205

SEQ ID NO: 110813 - RNA, 64 nt, Human; identical to SEQ ID NO: 110206

SEQ ID NO: 110814 - RNA, 64 nt, Human; identical to SEQ ID NO: 110207

SEQ ID NO: 110815 - RNA, 64 nt, Human; identical to SEQ ID NO: 110208

SEQ ID NO: 110816 - RNA, 64 nt, Human; identical to SEQ ID NO: 110209

SEQ ID NO: 110817 - RNA, 64 nt, Human; identical to SEQ ID NO: 110210

SEQ ID NO: 110818 - RNA, 64 nt, Human; identical to SEQ ID NO: 110211

SEQ ID NO: 110819 - RNA, 64 nt, Human; identical to SEQ ID NO: 110212

SEQ ID NO: 110820 - RNA, 64 nt, Human; identical to SEQ ID NO: 110213

SEQ ID NO: 110821 - RNA, 64 nt, Human; identical to SEQ ID NO: 110214

SEQ ID NO: 110822 - RNA, 64 nt, Human; identical to SEQ ID NO: 110215

SEQ ID NO: 110823 - RNA, 64 nt, Human; identical to SEQ ID NO: 110216

SEQ ID NO: 110824 - RNA, 64 nt, Human; identical to SEQ ID NO: 110217

SEQ ID NO: 110825 - RNA, 64 nt, Human; identical to SEQ ID NO: 110218

SEQ ID NO: 110826 - RNA, 64 nt, Human; identical to SEQ ID NO: 110219

SEQ ID NO: 110827 - RNA, 64 nt, Human; identical to SEQ ID NO: 110220

SEQ ID NO: 110828 - RNA, 64 nt, Human; identical to SEQ ID NO: 110221

SEQ ID NO: 110829 - RNA, 64 nt, Human; identical to SEQ ID NO: 110222

SEQ ID NO: 110830 - RNA, 64 nt, Human; identical to SEQ ID NO: 110223

SEQ ID NO: 110831 - RNA, 64 nt, Human; identical to SEQ ID NO: 110224

SEQ ID NO: 110832 - RNA, 64 nt, Human; identical to SEQ ID NO: 110225

SEQ ID NO: 110833 - RNA, 64 nt, Human; identical to SEQ ID NO: 110226

SEQ ID NO: 110834 - RNA, 64 nt, Human; identical to SEQ ID NO: 110227

SEQ ID NO: 110835 - RNA, 64 nt, Human; identical to SEQ ID NO: 110228

SEQ ID NO: 110836 - RNA, 64 nt, Human; identical to SEQ ID NO: 110229

SEQ ID NO: 110837 - RNA, 64 nt, Human; identical to SEQ ID NO: 110230

SEQ ID NO: 110838 - RNA, 64 nt, Human; identical to SEQ ID NO: 110231

SEQ ID NO: 110839 - RNA, 64 nt, Human; identical to SEQ ID NO: 110232

SEQ ID NO: 110840 - RNA, 64 nt, Human; identical to SEQ ID NO: 110233

SEQ ID NO: 110841 - RNA, 64 nt, Human; identical to SEQ ID NO: 110234

SEQ ID NO: 110842 - RNA, 64 nt, Human; identical to SEQ ID NO: 110235

SEQ ID NO: 110843 - RNA, 64 nt, Human; identical to SEQ ID NO: 110236

SEQ ID NO: 110844 - RNA, 64 nt, Human; identical to SEQ ID NO: 110237

SEQ ID NO: 110845 - RNA, 64 nt, Human; identical to SEQ ID NO: 110238

SEQ ID NO: 110846 - RNA, 64 nt, Human; identical to SEQ ID NO: 110239

SEQ ID NO: 110847 - RNA, 64 nt, Human; identical to SEQ ID NO: 110240

SEQ ID NO: 110848 - RNA, 64 nt, Human; identical to SEQ ID NO: 110241

SEQ ID NO: 110849 - RNA, 64 nt, Human; identical to SEQ ID NO: 110242

SEQ ID NO: 110850 - RNA, 64 nt, Human; identical to SEQ ID NO: 110243

SEQ ID NO: 110851 - RNA, 64 nt, Human; identical to SEQ ID NO: 110244

SEQ ID NO: 110852 - RNA, 64 nt, Human; identical to SEQ ID NO: 110245

SEQ ID NO: 110853 - RNA, 64 nt, Human; identical to SEQ ID NO: 110246

SEQ ID NO: 110854 - RNA, 64 nt, Human; identical to SEQ ID NO: 110247

SEQ ID NO: 110855 - RNA, 64 nt, Human; identical to SEQ ID NO: 110248

SEQ ID NO: 110856 - RNA, 64 nt, Human; identical to SEQ ID NO: 110249

SEQ ID NO: 110857 - RNA, 64 nt, Human; identical to SEQ ID NO: 110250

SEQ ID NO: 110858 - RNA, 64 nt, Human; identical to SEQ ID NO: 110251

SEQ ID NO: 110859 - RNA, 64 nt, Human; identical to SEQ ID NO: 110252

SEQ ID NO: 110860 - RNA, 64 nt, Human; identical to SEQ ID NO: 110253

SEQ ID NO: 110861 - RNA, 64 nt, Human; identical to SEQ ID NO: 110254

SEQ ID NO: 110862 - RNA, 64 nt, Human; identical to SEQ ID NO: 110255

SEQ ID NO: 110863 - RNA, 64 nt, Human; identical to SEQ ID NO: 110256

SEQ ID NO: 110864 - RNA, 64 nt, Human; identical to SEQ ID NO: 110257

SEQ ID NO: 110865 - RNA, 64 nt, Human; identical to SEQ ID NO: 110258

SEQ ID NO: 110866 - RNA, 64 nt, Human; identical to SEQ ID NO: 110259

SEQ ID NO: 110867 - RNA, 64 nt, Human; identical to SEQ ID NO: 110260

SEQ ID NO: 110868 - RNA, 64 nt, Human; identical to SEQ ID NO: 110261

SEQ ID NO: 110869 - RNA, 64 nt, Human; identical to SEQ ID NO: 110262

SEQ ID NO: 110870 - RNA, 64 nt, Human; identical to SEQ ID NO: 110263

SEQ ID NO: 110871 - RNA, 64 nt, Human; identical to SEQ ID NO: 110264

SEQ ID NO: 110872 - RNA, 64 nt, Human; identical to SEQ ID NO: 110265

SEQ ID NO: 110873 - RNA, 64 nt, Human; identical to SEQ ID NO: 110266

SEQ ID NO: 110874 - RNA, 64 nt, Human; identical to SEQ ID NO: 110267

SEQ ID NO: 110875 - RNA, 64 nt, Human; identical to SEQ ID NO: 110268

SEQ ID NO: 110876 - RNA, 64 nt, Human; identical to SEQ ID NO: 110269

SEQ ID NO: 110877 - RNA, 64 nt, Human; identical to SEQ ID NO: 110269

SEQ ID NO: 110878 - RNA, 64 nt, Human; identical to SEQ ID NO: 110269

SEQ ID NO: 110879 - RNA, 64 nt, Human; identical to SEQ ID NO: 110269

SEQ ID NO: 110880 - RNA, 64 nt, Human; identical to SEQ ID NO: 110273

SEQ ID NO: 110881 - RNA, 64 nt, Human; identical to SEQ ID NO: 110274

SEQ ID NO: 110882 - RNA, 64 nt, Human; identical to SEQ ID NO: 110275

SEQ ID NO: 110883 - RNA, 64 nt, Human; identical to SEQ ID NO: 110276

SEQ ID NO: 110884 - RNA, 64 nt, Human; identical to SEQ ID NO: 110277

SEQ ID NO: 110885 - RNA, 64 nt, Human; identical to SEQ ID NO: 110278

SEQ ID NO: 110886 - RNA, 64 nt, Human; identical to SEQ ID NO: 110279

SEQ ID NO: 110887 - RNA, 64 nt, Human; identical to SEQ ID NO: 110280

SEQ ID NO: 110888 - RNA, 64 nt, Human; identical to SEQ ID NO: 110281

SEQ ID NO: 110889 - RNA, 64 nt, Human; identical to SEQ ID NO: 110282

SEQ ID NO: 110890 - RNA, 64 nt, Human; identical to SEQ ID NO: 110283

SEQ ID NO: 110891 - RNA, 64 nt, Human; identical to SEQ ID NO: 110284

SEQ ID NO: 110892 - RNA, 64 nt, Human; identical to SEQ ID NO: 110285

SEQ ID NO: 110893 - RNA, 64 nt, Human; identical to SEQ ID NO: 110286

SEQ ID NO: 110894 - RNA, 64 nt, Human; identical to SEQ ID NO: 110287

SEQ ID NO: 110895 - RNA, 64 nt, Human; identical to SEQ ID NO: 110288

SEQ ID NO: 110896 - RNA, 64 nt, Human; identical to SEQ ID NO: 110289

SEQ ID NO: 110897 - RNA, 64 nt, Human; identical to SEQ ID NO: 110290

SEQ ID NO: 110898 - RNA, 64 nt, Human; identical to SEQ ID NO: 110291

SEQ ID NO: 110899 - RNA, 64 nt, Human; identical to SEQ ID NO: 110292

SEQ ID NO: 110900 - RNA, 64 nt, Human; identical to SEQ ID NO: 110293

SEQ ID NO: 110901 - RNA, 64 nt, Human; identical to SEQ ID NO: 110294

SEQ ID NO: 110902 - RNA, 64 nt, Human; identical to SEQ ID NO: 110295

SEQ ID NO: 110903 - RNA, 64 nt, Human; identical to SEQ ID NO: 110296

SEQ ID NO: 110904 - RNA, 64 nt, Human; identical to SEQ ID NO: 110297

SEQ ID NO: 110905 - RNA, 64 nt, Human; identical to SEQ ID NO: 110298

SEQ ID NO: 110906 - RNA, 64 nt, Human; identical to SEQ ID NO: 110299

SEQ ID NO: 110907 - RNA, 64 nt, Human; identical to SEQ ID NO: 110300

SEQ ID NO: 110908 - RNA, 64 nt, Human; identical to SEQ ID NO: 110301

SEQ ID NO: 110909 - RNA, 64 nt, Human; identical to SEQ ID NO: 110302

SEQ ID NO: 110910 - RNA, 64 nt, Human; identical to SEQ ID NO: 110303

SEQ ID NO: 110911 - RNA, 64 nt, Human; identical to SEQ ID NO: 110304

SEQ ID NO: 110912 - RNA, 64 nt, Human; identical to SEQ ID NO: 110305

SEQ ID NO: 110913 - RNA, 64 nt, Human; identical to SEQ ID NO: 110306

SEQ ID NO: 110914 - RNA, 64 nt, Human; identical to SEQ ID NO: 110307

SEQ ID NO: 110915 - RNA, 64 nt, Human; identical to SEQ ID NO: 110308

SEQ ID NO: 110916 - RNA, 64 nt, Human; identical to SEQ ID NO: 110309

SEQ ID NO: 110917 - RNA, 64 nt, Human; identical to SEQ ID NO: 110310

SEQ ID NO: 110918 - RNA, 64 nt, Human; identical to SEQ ID NO: 110311

SEQ ID NO: 110919 - RNA, 64 nt, Human; identical to SEQ ID NO: 110312

SEQ ID NO: 110920 - RNA, 64 nt, Human; identical to SEQ ID NO: 110313

SEQ ID NO: 110921 - RNA, 64 nt, Human; identical to SEQ ID NO: 110314

SEQ ID NO: 110922 - RNA, 64 nt, Human; identical to SEQ ID NO: 110315

SEQ ID NO: 110923 - RNA, 64 nt, Human; identical to SEQ ID NO: 110316

SEQ ID NO: 110924 - RNA, 64 nt, Human; identical to SEQ ID NO: 110317

SEQ ID NO: 110925 - RNA, 64 nt, Human; identical to SEQ ID NO: 110318

SEQ ID NO: 110926 - RNA, 64 nt, Human; identical to SEQ ID NO: 110319

SEQ ID NO: 110927 - RNA, 64 nt, Human; identical to SEQ ID NO: 110320

SEQ ID NO: 110928 - RNA, 64 nt, Human; identical to SEQ ID NO: 110321

SEQ ID NO: 110929 - RNA, 64 nt, Human; identical to SEQ ID NO: 110322

SEQ ID NO: 110930 - RNA, 64 nt, Human; identical to SEQ ID NO: 110323

SEQ ID NO: 110931 - RNA, 64 nt, Human; identical to SEQ ID NO: 110324

SEQ ID NO: 110932 - RNA, 64 nt, Human; identical to SEQ ID NO: 110325

SEQ ID NO: 110933 - RNA, 64 nt, Human; identical to SEQ ID NO: 110326

SEQ ID NO: 110934 - RNA, 64 nt, Human; identical to SEQ ID NO: 110327

SEQ ID NO: 110935 - RNA, 64 nt, Human; identical to SEQ ID NO: 110328

SEQ ID NO: 110936 - RNA, 64 nt, Human; identical to SEQ ID NO: 110329

SEQ ID NO: 110937 - RNA, 64 nt, Human; identical to SEQ ID NO: 110330

SEQ ID NO: 110938 - RNA, 64 nt, Human; identical to SEQ ID NO: 110331

SEQ ID NO: 110939 - RNA, 64 nt, Human; identical to SEQ ID NO: 110332

SEQ ID NO: 110940 - RNA, 64 nt, Human; identical to SEQ ID NO: 110333

SEQ ID NO: 110941 - RNA, 64 nt, Human; identical to SEQ ID NO: 110334

SEQ ID NO: 110942 - RNA, 64 nt, Human; identical to SEQ ID NO: 110335

SEQ ID NO: 110943 - RNA, 64 nt, Human; identical to SEQ ID NO: 110336

SEQ ID NO: 110944 - RNA, 64 nt, Human; identical to SEQ ID NO: 110337

SEQ ID NO: 110945 - RNA, 64 nt, Human; identical to SEQ ID NO: 110338

SEQ ID NO: 110946 - RNA, 64 nt, Human; identical to SEQ ID NO: 110339

SEQ ID NO: 110947 - RNA, 64 nt, Human; identical to SEQ ID NO: 110340

SEQ ID NO: 110948 - RNA, 64 nt, Human; identical to SEQ ID NO: 110341

SEQ ID NO: 110949 - RNA, 64 nt, Human; identical to SEQ ID NO: 110342

SEQ ID NO: 110950 - RNA, 64 nt, Human; identical to SEQ ID NO: 110343

SEQ ID NO: 110951 - RNA, 64 nt, Human; identical to SEQ ID NO: 110344

SEQ ID NO: 110952 - RNA, 64 nt, Human; identical to SEQ ID NO: 110345

SEQ ID NO: 110953 - RNA, 64 nt, Human; identical to SEQ ID NO: 110346

SEQ ID NO: 110954 - RNA, 64 nt, Human; identical to SEQ ID NO: 110347

SEQ ID NO: 110955 - RNA, 64 nt, Human; identical to SEQ ID NO: 110348

SEQ ID NO: 110956 - RNA, 64 nt, Human; identical to SEQ ID NO: 110349

SEQ ID NO: 110957 - RNA, 64 nt, Human; identical to SEQ ID NO: 110350

SEQ ID NO: 110958 - RNA, 64 nt, Human; identical to SEQ ID NO: 110351

SEQ ID NO: 110959 - RNA, 64 nt, Human; identical to SEQ ID NO: 110352

SEQ ID NO: 110960 - RNA, 64 nt, Human; identical to SEQ ID NO: 110353

SEQ ID NO: 110961 - RNA, 64 nt, Human; identical to SEQ ID NO: 110354

SEQ ID NO: 110962 - RNA, 59 nt, Human; identical to SEQ ID NO: 110355

SEQ ID NO: 110963 - RNA, 64 nt, Human; identical to SEQ ID NO: 110356

SEQ ID NO: 110964 - RNA, 64 nt, Human; identical to SEQ ID NO: 110357

SEQ ID NO: 110965 - RNA, 64 nt, Human; identical to SEQ ID NO: 110358

SEQ ID NO: 110966 - RNA, 64 nt, Human; identical to SEQ ID NO: 110359

SEQ ID NO: 110967 - RNA, 64 nt, Human; identical to SEQ ID NO: 110360

SEQ ID NO: 110968 - RNA, 64 nt, Human; identical to SEQ ID NO: 110361

SEQ ID NO: 110969 - RNA, 64 nt, Human; identical to SEQ ID NO: 110362

SEQ ID NO: 110970 - RNA, 64 nt, Human; identical to SEQ ID NO: 110363

SEQ ID NO: 110971 - RNA, 64 nt, Human; identical to SEQ ID NO: 110364

SEQ ID NO: 110972 - RNA, 64 nt, Human; identical to SEQ ID NO: 110365

SEQ ID NO: 110973 - RNA, 64 nt, Human; identical to SEQ ID NO: 110366

SEQ ID NO: 110974 - RNA, 64 nt, Human; identical to SEQ ID NO: 110367

SEQ ID NO: 110975 - RNA, 64 nt, Human; identical to SEQ ID NO: 110368

SEQ ID NO: 110976 - RNA, 64 nt, Human
gcguccccgaagugagggccaggcccuucccggcugcgaggacgcccagagaccgcgggcgcug

SEQ ID NO: 110977 - RNA, 64 nt, Human
uagaugaguacuugccuaggacugggaggaggauugcgaggaaauggagauucacugcuaauga

SEQ ID NO: 110978 - RNA, 64 nt, Human
agaacaugcagcauaagaaacugcugcagaguggugcgaggaguacauuuucagagcaggugca

SEQ ID NO: 110979 - RNA, 64 nt, Human
gcacagcaccugcacgaacacccgccgaaacugcugcgaggacaccguguacaggagcggguug

SEQ ID NO: 110980 - RNA, 63 nt, Human
aaaaaucugcuagucgcuagcccugagaaguacugcgaggaaauguggagcaguuuucucugg

SEQ ID NO: 110981 - RNA, 64 nt, Human
cacgggcagcugcuugcgcuacuggcagagcugcugcgaggacccuguggcagcuuugaugugc

SEQ ID NO: 110982 - RNA, 64 nt, Human
guguugucagccugugcuguggcauagacauggaugcgaggaccacuuuggagacugggguggc

SEQ ID NO: 110983 - RNA, 64 nt, Human
accaaucucuacgggaaagagagguaggagaggcugcgaggaagcuuggguucaagcgucacuc

SEQ ID NO: 110984 - RNA, 64 nt, Human
cucugagagcccaccgcaugccggugcagacggaugcgaggaugcagggacgcgcgacgccggc

SEQ ID NO: 110985 - RNA, 64 nt, Human
gcaugaaaagugguccucuugacugcauuaugcaugcgaggaugaaauaaaccuagaaguggca

SEQ ID NO: 110986 - RNA, 64 nt, Human
ugcggagguggaaaguucgagaggaggagcuauuugcgaggaagcccuguggcaauagagauag

SEQ ID NO: 110987 - RNA, 64 nt, Human
gggcuagccaccuguacuacggugccgaccgcaaugcgaggaaugugguggccacgcgauggag

SEQ ID NO: 110988 - RNA, 64 nt, Human
caaagucagugggacaaacuccagcacagaagccugcgaggaagccuauggaauaguuuccugu

SEQ ID NO: 110989 - RNA, 64 nt, Human
uaaaaccaaaaaaauaauggaaugauugcaucacugcgaggaaguauacuuaauuaagaaaguu

SEQ ID NO: 110990 - RNA, 64 nt, Human
aacccaaacucuccagacaucaccaacuguccccugcgaggagaaaucacuccugggggagaac

SEQ ID NO: 110991 - RNA, 64 nt, Human
uaccugccccgcaccauggacuuuggccucaacgugcgaggauuccuggaccgcuacugccccc

SEQ ID NO: 110992 - RNA, 64 nt, Human
agcaccccaggaccccggggggauggcccaggccugcgaggaguaccucagccagauccacagu

SEQ ID NO: 110993 - RNA, 64 nt, Human
acaagauggaaagaaccacgcaggauccccugggugcgaggagagugaugccgguaaagaaaag

SEQ ID NO: 110994 - RNA, 61 nt, Human
gaccagccucugaaaccuaacuaugcagcagugcgaggacaaaagaucauggaguggucaa

SEQ ID NO: 110995 - RNA, 64 nt, Human
guagucuccauggugggccugucccagcccuggcugcgaggacagguugucuuucucuccccag

SEQ ID NO: 110996 - RNA, 64 nt, Human
cacuuuaaaacucgcuuucuugagucggaguguuugcgaggaacugccugugugugagugcgug

SEQ ID NO: 110997 - RNA, 64 nt, Human
ucaacagcuuuggaaaugggucccgagugggccgugcgaggaaggcugucgaccucuacuccuc

SEQ ID NO: 110998 - RNA, 64 nt, Human
uauauuuuaaauguggaaugauguauauaaaaugugcgaggauccugguauuguaauauuaaaa

SEQ ID NO: 110999 - RNA, 64 nt, Human
ugcgccgugggcucaagagccugagugggugguuugcgaggaugagggacgcuaugccucaugc

SEQ ID NO: 111000 - RNA, 64 nt, Human
cgccaagcucugcgauguggcucagcagcgcaacugcgaggacaugauccagauguuccaggug

SEQ ID NO: 111001 - RNA, 64 nt, Human
aggaauaaaaaagcuuucuaugaguuugguauggugcgaggaaaaucuuacaguuugaauuaug

SEQ ID NO: 111002 - RNA, 64 nt, Human
uugcuuacuuaaaagcuacauagcccuaucgaaaugcgaggauuaaugcuuuaaugcuuuuaga

SEQ ID NO: 111003 - RNA, 64 nt, Human
cagggagaggauucuccagugagugcacacacuaugcgaggagcaagcauuucucuaagucaag

SEQ ID NO: 111004 - RNA, 64 nt, Human
agaagcgccgggcuuuccucacaccugagccgggugcgaggaggagcaugcacggaccaagcgc

SEQ ID NO: 111005 - RNA, 64 nt, Human
cuuccaugguaagggggccugcgucccugcacacugcgaggacugccuuggccacaggcccacu

SEQ ID NO: 111006 - RNA, 64 nt, Human
agcaucaggcccacuggguugccccggccaggccugcgaggaagggcugagguggggccggcag

SEQ ID NO: 111007 - RNA, 64 nt, Human
gcggcugcccugagccccaggucuugugggaggcugcgaggacgagagccuggcuggagcccgc

SEQ ID NO: 111008 - RNA, 59 nt, Human
uucaccaggucaccaaguaaugucccuggugcgaggaaacagagacaaccuuucugucu

SEQ ID NO: 111009 - RNA, 64 nt, Human
caaaguuuuacagagaggauacauuuaauaaaacugcgaggacaucaaagugguaaauacugug

SEQ ID NO: 111010 - RNA, 64 nt, Human
ggaucccuuagguucaggaagcuucuguguaagcugcgaggauggcuugggccgaaggguugcu

SEQ ID NO: 111011 - RNA, 64 nt, Human
ggucgcgcgccucuccaaaacguucuucccagacugcgaggaccgccucggcagguggcgguaa

SEQ ID NO: 111012 - RNA, 64 nt, Human
uacucuucucuuuuccuacuuuacauguaaugguugcgaggaccaacuuucaaaugagcuaacu

SEQ ID NO: 111013 - RNA, 64 nt, Human
ugguuuggagagagccuucuagaaugacagacugugcgaggaagcaggggcagggguuuccagc

SEQ ID NO: 111014 - RNA, 64 nt, Human
agucaagugauccucccaccuuggccucugaaggugcgaggauuauaggcgucaccuaccacau

SEQ ID NO: 111015 - RNA, 64 nt, Human
gcauauaaaccacaggcgaaagaggaugcugcauugcgaggacccagaaauucauacuggugcc

SEQ ID NO: 111016 - RNA, 64 nt, Human
acaaaccucucccccuuugaaacucaagcacagcugcgaggagggcagcgaggagggaccccuc

SEQ ID NO: 111017 - RNA, 64 nt, Human
uauuguuucauuuacuccaaaggauccugaagccugcgaggaaagguaauauaaaaauguuaua

SEQ ID NO: 111018 - RNA, 64 nt, Human
cuggauacagcuggauacuggggaggacgugggcugcgaggagaagcuguacuuuggcuugagu

SEQ ID NO: 111019 - RNA, 57 nt, Human
guggcaagaaggccaagugaccggaggugcgaggagagccagccggccugugugacu

SEQ ID NO: 111020 - RNA, 51 nt, Human
ucacaaggguagagaucugauugcgaggaaccugggcucugacucgaacac

SEQ ID NO: 111021 - RNA, 64 nt, Human
ucguuacgcggugugugaagacugacaucugcacugcgaggauggagaucuuggucaucucuga

SEQ ID NO: 111022 - RNA, 64 nt, Human
ucuaagaugagggggccaggcgguggcuucucccugcgaggaggggagaauucuuggggcugag

SEQ ID NO: 111023 - RNA, 64 nt, Human
ucgaagcgggcuccgaugcagggcagcucccccaugcgaggauccgggucugccuccuccugcu

SEQ ID NO: 111024 - RNA, 64 nt, Human
ugggcaauuuuuguauccaaggaaauaaugugaaugcgaggaaaugucuuuagagcacagggac

SEQ ID NO: 111025 - RNA, 64 nt, Human
ucuccggcgggugaggcugcagcccaguuucacaugcgaggaggccuaaucaggaguuucaauu

SEQ ID NO: 111026 - RNA, 64 nt, Human
cccaagagcacugcccugggcaucaucucccuccugcgaggagcugagccaguccccucacaga

SEQ ID NO: 111027 - RNA, 64 nt, Human
uuggagguucgugccguccccagccugccacgggugcgaggacagccaaguccugagugacuca

SEQ ID NO: 111028 - RNA, 64 nt, Human
gucagagcauaaucauugucugcaaaguguuuggugcgaggaagauuauugcuaauuuugugaa

SEQ ID NO: 111029 - RNA, 64 nt, Human
acugcccugacccaaccccacuggaccuugaugcugcgaggagugguguccugacggacucagc

SEQ ID NO: 111030 - RNA, 64 nt, Human
cauaccuccugccaauucucuaacucucugagacugcgaggaucuccaggcaggguucuccccu

SEQ ID NO: 111031 - RNA, 64 nt, Human
gcucaagugauccgcccgccucagucucccaaagugcgaggaugacaugugugagcuaccacac

SEQ ID NO: 111032 - RNA, 64 nt, Human
aaacacuucccagagaggauucuagucugguaaauaaccacaguguaggaacuaucuaacuggc

SEQ ID NO: 111033 - RNA, 64 nt, Human
agccugauagaucuguauaugguaaacagggguuuaaccacaugugguuaacauggauuaaugu

SEQ ID NO: 111034 - RNA, 64 nt, Human
guauucaacagaaggacuguggucauguaacagguaaccacaauuuucagguuucuuaaaaaca

SEQ ID NO: 111035 - RNA, 64 nt, Human
uuacuuuugcaaacagacagaaaggauacacuucuaaccacauuuuacuuccuuccccuguugu

SEQ ID NO: 111036 - RNA, 64 nt, Human
ccuuucucuucccuuaacccuuucugcuuuucauuaaccacauuccugcacaacucauuucuga

SEQ ID NO: 111037 - RNA, 64 nt, Human
cgugcaugugugugugugugagugucuuaaagcauaaccacaaacugcaaaaagcuagguaagc

SEQ ID NO: 111038 - RNA, 64 nt, Human
aauuuugaaguauuugggcaggugagucauguuuuaaccacaagccauaacucaucuguugucu

SEQ ID NO: 111039 - RNA, 64 nt, Human
aacugcacuuuucauuacgugaauggaacuuaccuaaccacagggcucagacuuacuagauaaa

SEQ ID NO: 111040 - RNA, 64 nt, Human
gacggcuuuuugcauauuugugucaguuugauguuaaccacaagugccagacugauuuuucaga

SEQ ID NO: 111041 - RNA, 64 nt, Human
gugauuuuuuuuuuaaauuuauguugcggaaagguaaccacaaaguuaugaugaacugcaaaca

SEQ ID NO: 111042 - RNA, 64 nt, Human
uuaauauuccaguacacugaauacaugaggaauuuaaccacauacaucauugaagacaagggau

SEQ ID NO: 111043 - RNA, 64 nt, Human
gagcugcuuaaucauauugauaucuaauuucuuuuaaccacaaugaauuguccuuaauuaccaa

SEQ ID NO: 111044 - RNA, 64 nt, Human
aggaggaaaauaugguguuuggaauguuagauauuaaccacaauaaggcaugaucuggauuaaa

SEQ ID NO: 111045 - RNA, 64 nt, Human
caucugguacaugggcaaguaaguuauuuaguucuaaccacaaauaacaaguaguuuccaagga

SEQ ID NO: 111046 - RNA, 64 nt, Human
cagccccugggguaccccauguaugucuccccacuaaccacauccuaccuagggacacacaggc

SEQ ID NO: 111047 - RNA, 64 nt, Human
cagugaauaaaacaccaaaaacccaaaaaugcuuuaaccacaguauaaauaauagauuauacac

SEQ ID NO: 111048 - RNA, 64 nt, Human
cucauuccucagguguuuugagaaacaugacuaauaaccacacaauuaaguagagucauuccaa

SEQ ID NO: 111049 - RNA, 64 nt, Human
cgccuaagaaacagaacuucgagaaguccuaacguaaccacaguaaagcagacuccccuuucag

SEQ ID NO: 111050 - RNA, 64 nt, Human
acacuucgccauccaggcagaacuaagccaggcauaaccacagccaagcagauuaaccccaggc

SEQ ID NO: 111051 - RNA, 56 nt, Human
cuaaucccaaggcagugugacucagcuaaccacaaaugucuccuccaggcuaugaa

SEQ ID NO: 111052 - RNA, 64 nt, Human
ccaaggcuuuacugcugauagugcuaauuggcauuaaccacaaaaugagaauuauauuugucaa

SEQ ID NO: 111053 - RNA, 64 nt, Human
cuugcacuacuuacaaguuucauagauuugagccuaaccacaagaggcuggugcuuaguacugu

SEQ ID NO: 111054 - RNA, 64 nt, Human
gauuacugaaaccugauuuauugcuuugucacuuuaaccacaucucucaacucucugcaauguu

SEQ ID NO: 111055 - RNA, 64 nt, Human
ugcaaggcuuuuaucccugaaaaucauuuacagauaaccacaauuugcugugguauauaaacua

SEQ ID NO: 111056 - RNA, 64 nt, Human
acagaccagaccggcacaggcuuugagcucauuauaaccacacuccuugucucgugucugccuc

SEQ ID NO: 111057 - RNA, 64 nt, Human
acugguauggcuauucuugaaggccagguuuuaauaaccacaaacaaaaaggcaugaaccuggg

SEQ ID NO: 111058 - RNA, 64 nt, Human
uuuuuccuuugggguaaaagguacaaaaacaaacuaaccacaguugaagagaagggcuuccgga

SEQ ID NO: 111059 - RNA, 64 nt, Human
gauuguuuucuaugugaagcaaaccaauuauaauuaaccacauguuguaguaacuggucuuuuu

SEQ ID NO: 111060 - RNA, 64 nt, Human
uuucauaccauuucaagaaacgacuagacaguaguaaccacaugaauauuuuacuuucuccagu

SEQ ID NO: 111061 - RNA, 64 nt, Human
cacacaaaggaaucuuuauuuauuacaugaaaaauaaccacaaguccagcauugcggcacacuc

SEQ ID NO: 111062 - RNA, 64 nt, Human
auuauauuuuuggguuuuguagaauauugcaaauuaaccacacaaaaaauguuuaauuuaugca

SEQ ID NO: 111063 - RNA, 64 nt, Human
cgugccucugcgaagugugagaugaggggucacauaaccacacuguugacuaccucauuccugg

SEQ ID NO: 111064 - RNA, 64 nt, Human
uucaucaauuucccauuuuuuuuuucagcuuaaguaaccacacaauuuuaggccucaauuuuuu

SEQ ID NO: 111065 - RNA, 64 nt, Human
acaaaaauaacacaaauaauaauauccuucguuauaaccacaaugagauaaguauuggcauuag

SEQ ID NO: 111066 - RNA, 64 nt, Human
aaaugaaaaaguuuaaagacuguucuuugcccaauaaccacauuuuauuucuucagcuuuguaa

SEQ ID NO: 111067 - RNA, 64 nt, Human
uuucuacaacauguuuuauccauuccauaaauaauaaccacauugggaauagugaggugucuuu

SEQ ID NO: 111068 - RNA, 64 nt, Human
cuugaaaguuuugugacaauuauuuugcuguguuuaaccacaaucauucaccuuauggcaugcu

SEQ ID NO: 111069 - RNA, 64 nt, Human
guauuuaaaauguacauuccacauuuuaauaaauuaaccacaagaaaauaaucccacauauaca

SEQ ID NO: 111070 - RNA, 64 nt, Human
uuccuaacccuccagucccaaauccaagauucuuuaaccacacucuaaaaguucuucagacuca

SEQ ID NO: 111071 - RNA, 64 nt, Human
gugauuuguaauuuaaacuaauuguauucugagguaaccacaaaauaaauucaaccaaacuggg

SEQ ID NO: 111072 - RNA, 64 nt, Human
accccuccccaccuaacugcacugaaaccauuucuaaccacaacccuuggcccaaggacuuggu

SEQ ID NO: 111073 - RNA, 64 nt, Human
ggauacagugaguuugcacagcucaguuuuuaccuaaccacacacuugcagaccuccugaggua

SEQ ID NO: 111074 - RNA, 64 nt, Human
ucaacauagagaaaagcugaaaaaaugcaaagaauaaccacauacuuuccaucuaccuuccuuu

SEQ ID NO: 111075 - RNA, 64 nt, Human
augaacuuuuuuccucauucggcuguauaauacauaaccacagcaagacugacauccacuuagg

SEQ ID NO: 111076 - RNA, 64 nt, Human
auuguaauaaugcuaaagaaaaagucauccaaucuaaccacaucaauauugucauuccuguauu

SEQ ID NO: 111077 - RNA, 64 nt, Human
ugugguuugaaucugaauuauauuuuauaaggguuaaccacagauccaaggacucaguaaaagg

SEQ ID NO: 111078 - RNA, 64 nt, Human
auccccuccgcacagccuccccguccaggccuucuaaccacaccuacccagggcugccgcauuc

SEQ ID NO: 111079 - RNA, 64 nt, Human
ccucucugcuucgugauuuuauuucauugaauuauaaccacaagccaccacccauuugacaucc

SEQ ID NO: 111080 - RNA, 64 nt, Human
ccugcaacuaacccuggucuuucccauggcaauuuaaccacauuuggaaggcacugccuucagc

SEQ ID NO: 111081 - RNA, 64 nt, Human
auauaaaauggagaagagcuugauauucagguacuaaccacaacuagucugacauuguuggcag

SEQ ID NO: 111082 - RNA, 64 nt, Human
uggauacuuggaaccuuguauuuaaaagugaauuuaaccacaacugagaccuaagaaauugacc

SEQ ID NO: 111083 - RNA, 64 nt, Human
accucacuugguaccauauagaucaaaagcuuuguaaccacaggaaaaaauaaacucuuccauc

SEQ ID NO: 111084 - RNA, 64 nt, Human
auaccagaaaaguacaguugagauaguuaagauauaaccacaagucagaguacauugguuguau

SEQ ID NO: 111085 - RNA, 64 nt, Human
aaaugaguugcaguaauuuguuugcuuguuuguuuaaccacaaccacuauuuuaaugauauacu

SEQ ID NO: 111086 - RNA, 64 nt, Human
gaaacaguuaauaccauuuuuuaaggaaacaauauaaccacaaagcacaguuugaacaaaaucu

SEQ ID NO: 111087 - RNA, 64 nt, Human
agagcuuuauguucgcuguccaugaaaccuucuguaaccacagugacuacaaguaguucuuucu

SEQ ID NO: 111088 - RNA, 64 nt, Human
uuuuaaauguuaaaauuauaauuucagauucauauaaccacaacugugauauauccuaacuaua

SEQ ID NO: 111089 - RNA, 64 nt, Human
aguaauucuaaucucuucuguguuuuccuugccuuaaccacaaauuguggugcuuuuuguauau

SEQ ID NO: 111090 - RNA, 64 nt, Human
uuccucaucugcauuucaucuggagcagggcagguaaccacaggaggaggcaugcccgaggcag

SEQ ID NO: 111091 - RNA, 64 nt, Human
uuucauugauaguaacgcuguuucuaauuugucuuaaccacauucaugcuuacccugcugcuca

SEQ ID NO: 111092 - RNA, 64 nt, Human
aagaucacaagccuguauguggaauguagaaaaauaaccacagcugauguaaaugaaaagaacc

SEQ ID NO: 111093 - RNA, 64 nt, Human
gaaguuuguuuugcuuuuaauuuaaaggaagcaguaaccacaaagcuuccgcucaggguuuuuu

SEQ ID NO: 111094 - RNA, 64 nt, Human
uaauuuaccauuauuuuacagucucuguuguaaauaaccacacugaaaccucuucgguugucuu

SEQ ID NO: 111095 - RNA, 64 nt, Human
ugagcuguguuaaaaggcauucuuagauucauuuuaaccacauuuuuaaaaacucacaguuggu

SEQ ID NO: 111096 - RNA, 64 nt, Human
uauugaguguggauuuugcauacauucaaaacauuaaccacaaaauacagcaagugcaccuaua

SEQ ID NO: 111097 - RNA, 62 nt, Human
cuucaucagagaguagcuagaagagaauaaguuaaccacaaaauaagacuuuuugccaucau

SEQ ID NO: 111098 - RNA, 64 nt, Human
uugauuaaaauuggucguuacuaaaauaguauaguaaccacaagugauuggcuuauaaaugaag

SEQ ID NO: 111099 - RNA, 64 nt, Human
caccucagagcaccagcuccccugucccagggccuaaccacagauccuggaguucugcaaccuc

SEQ ID NO: 111100 - RNA, 64 nt, Human
uuuauuuauuuauuacccuaagaaugcuuugccauaaccacauuuaaugggaaaaacggcagua

SEQ ID NO: 111101 - RNA, 64 nt, Human
uuaacauacuaaguuauaccagggagagagugacuaaccacauucuuuaaauaucaauagcuua

SEQ ID NO: 111102 - RNA, 64 nt, Human
gcccucucaagggagcguaagugauguuccauauuaaccacagacuguccucuccaccuuuagc

SEQ ID NO: 111103 - RNA, 64 nt, Human
uggguauuggggacaggacagagagcucauucuauaaccacaguugucuuuuaaaggccacccu

SEQ ID NO: 111104 - RNA, 64 nt, Human
uguugggcagcgaaccuacuguuuaaaaucaggauaaccacauuaagcccaauaugccaguugg

SEQ ID NO: 111105 - RNA, 64 nt, Human
aaauguggaaaaaaugcuuuaaaaguacuuacuauaaccacaucauaagaauucuggaaaaaua

SEQ ID NO: 111106 - RNA, 64 nt, Human
gaccaacagaguauuugagaaaauugaaaacauguaaccacaagaaguugucauuuucaaaaac

SEQ ID NO: 111107 - RNA, 64 nt, Human
aaaaauacacauguucuuucauauaggcaaaauuuaaccacauaaauuugcacugcaagaaaau

SEQ ID NO: 111108 - RNA, 64 nt, Human
acuguggaauaaaagcaccuuuugcuuuucucacuaaccacacacucuugcagagcuuucaggu

SEQ ID NO: 111109 - RNA, 64 nt, Human
augcuuaaucaucuuuaaacacuuuuuaaauuucuaaccacaagaccucucuauaaugguaaau

SEQ ID NO: 111110 - RNA, 64 nt, Human
ggggcaaaaucagaauggaaugcucuggucuauauaaccacauuucuaagccuuugagacuguu

SEQ ID NO: 111111 - RNA, 64 nt, Human
uuauuaugaaagguuagauuucucaguucuucuuuaaccacauuuuguuauaucagacaguccu

SEQ ID NO: 111112 - RNA, 64 nt, Human
gaaagaauuuccuuaggaaauaauuuuuaaaacauaaccacagauaaaugagaaucaugauaag

SEQ ID NO: 111113 - RNA, 64 nt, Human
auggaaaaaugccaucaaaugaauaaugccuuuguaaccacaacuuucacuauaaugugaaaug

SEQ ID NO: 111114 - RNA, 64 nt, Human
aguggcugcaguauugacuccagugacauaaaguuaaccacaguggccuuuuaacaaauguugc

SEQ ID NO: 111115 - RNA, 64 nt, Human
agaaucuguauauuuuuaaaggcuuaaaauauuauaaccacaggguauccagccaaauucaaca

SEQ ID NO: 111116 - RNA, 64 nt, Human
uacuaaucaccaugaauauuucucaccauaggaauaaccacaacccaccaaguacccauguugg

SEQ ID NO: 111117 - RNA, 64 nt, Human
ucaucaaaaguaaaaaacucuugauguagucauauaaccacacuaagaacucuuccaggugacu

SEQ ID NO: 111118 - RNA, 64 nt, Human
gacugggcagcugugucugguucguucuuugcacuaaccacauuugucaucucuagggcaggcu

SEQ ID NO: 111119 - RNA, 64 nt, Human
guccaccugccgaccugauuccugcaucauggaauaaccacauggcuaccuucuauccucuguu

SEQ ID NO: 111120 - RNA, 64 nt, Human
uaaaauauaaggaaaucuuuauacuauuuuacaguaaccacaaucuaaauauuuacauauaccc

SEQ ID NO: 111121 - RNA, 64 nt, Human
uuccuuucugcaugagaaucuaggagagaauucauaaccacaccaauaacgaaauagaaguuuu

SEQ ID NO: 111122 - RNA, 64 nt, Human
uuuguagacuuuugcuguccagugugguagccacuaaccacauguggcuguuaagcccuugaaa

SEQ ID NO: 111123 - RNA, 64 nt, Human
ucagcaguuuuguaaacucuguauauaaaaucauuaaccacacauugugggugaugggaagacg

SEQ ID NO: 111124 - RNA, 64 nt, Human
guccaccugccggccugauuccugcaucauggaauaaccacauggcuaccuucuauccucuguu

SEQ ID NO: 111125 - RNA, 64 nt, Human
ggcuuggcaggcccugccaagcagaugcauacauuaaccacagcccagggccugcgacaggugu

SEQ ID NO: 111126 - RNA, 64 nt, Human
uuuguuuuuaguuuuuuccuccuuuccauccuguuaaccacagugaaacgcugcaguauuuuga

SEQ ID NO: 111127 - RNA, 64 nt, Human
aaacagaugcccccgugaaugcuuaccugugagauaaccacaaccaggaagaacaaaucugggc

SEQ ID NO: 111128 - RNA, 64 nt, Human
uguaugauuucagaugaacucugcuguuuagaaguaaccacagaaaagcaaagucaguguacac

SEQ ID NO: 111129 - RNA, 64 nt, Human
aucauauauaauuaaacagcuuuuuaaagaaacauaaccacaaaccuuuucaaauaauaauaau

SEQ ID NO: 111130 - RNA, 64 nt, Human
gcauguaauaagauaaacaucauacauuauaagguaaccacaauuacaaaauggcaaaacauuu

SEQ ID NO: 111131 - RNA, 64 nt, Human
aaaugcuaguggcugauaugggugugggggaugcuaaccacagggccugagaagucuugcuuua

SEQ ID NO: 111132 - RNA, 64 nt, Human
gguuuguaucuuccauauaauaaccacacacagauaaccacacaaaaaauccuuuguaaaauuu

SEQ ID NO: 111133 - RNA, 64 nt, Human
uuaaauagaauuucgguuuguaucuuccauauaauaaccacacacagauaaccacacaaaaaau

SEQ ID NO: 111134 - RNA, 64 nt, Human
accaucugguugaaaaaucuuucucauauaaguuuaaccacacuuugauuuggguucauuuuuu

SEQ ID NO: 111135 - RNA, 64 nt, Human
guguauuuuaaaauagaggcuuugagcaacuaacuaaccacauuuuaggaucucgccuggaaac

SEQ ID NO: 111136 - RNA, 64 nt, Human
gagcagugggacuuccuccugcccuuucaaagaauaaccacagcucagaagacgaugacguggu

SEQ ID NO: 111137 - RNA, 64 nt, Human
uucugauucccgccucugguccuuuacaugugcauaaccacaugcacacacacucacgcaugag

SEQ ID NO: 111138 - RNA, 64 nt, Human
guuuccgauguuuacacauguugccugagcugguuaaccacaucggcagccucagcuaccacaa

SEQ ID NO: 111139 - RNA, 64 nt, Human
uuccagaaaagaaaauacaauuagucacucaacauaaccacaggccaauuuguuggccaccaga

SEQ ID NO: 111140 - RNA, 64 nt, Human
acuugaacaacuuugcaggaauaaagcaacccccuaaccacaaaauaucccucuaaauuaguuc

SEQ ID NO: 111141 - RNA, 64 nt, Human
uuccuuuucagaaguaccuguguguaucuguuaauaaccacagggguuaauaugauguaggauc

SEQ ID NO: 111142 - RNA, 64 nt, Human
uaccgaguuaaauguuuuuccgcuuugagggauguaaccacauccacucagaggacacuacuuu

SEQ ID NO: 111143 - RNA, 64 nt, Human
gauuuagccucaaguaguucccuuuuuguauuaauaaccacacgcuuucugcaacccuaucccu

SEQ ID NO: 111144 - RNA, 64 nt, Human
ccccuccuugcuguccauauggguucaaugugaguaaccacaauuguagaguguggccaucuuc

SEQ ID NO: 111145 - RNA, 64 nt, Human
agcauggacaaaacaucacuggaaacaaaggcuguaaccacagcaacagacuuugugauacagu

SEQ ID NO: 111146 - RNA, 64 nt, Human
cacacaguguuaacucuacacagcuucuggugcuuaaccacauccacacaguuaaaaauaagcu

SEQ ID NO: 111147 - RNA, 64 nt, Human
gcacauguuaucuaucuaucuaucuauauaacuauaaccacacgccguguagacacccgcugcc

SEQ ID NO: 111148 - RNA, 64 nt, Human
cacacaguuguucaccaacagaccagaccuccuuuaaccacagugucaacauaguaucggaaag

SEQ ID NO: 111149 - RNA, 64 nt, Human
acuaacugugaguaaaaaugauauauauaggcauuaaccacacacuuuaauggguauaauuucc

SEQ ID NO: 111150 - RNA, 64 nt, Human
ccuuccucaugauuuccaaccuuaauacuauuaguaaccacaaguucaagggucaaagggaccc

SEQ ID NO: 111151 - RNA, 64 nt, Human
gauuuagccucaaguaguucccuuguuguauuaauaaccacacccuuucugcaucccugucccu

SEQ ID NO: 111152 - RNA, 63 nt, Human
aaagaagauaaaauaaauuauauacccgagccauuaaccacaauuuagugaucacuagugguu

SEQ ID NO: 111153 - RNA, 64 nt, Human
ucuacauauagugccuauaugacaaaauccugccuaaccacacugcuuuauuuuacacuuaaga

SEQ ID NO: 111154 - RNA, 64 nt, Human
cugcaaagauggugugguguacguggcuucccuguaaccacauggggcuuggccauuucuccau

SEQ ID NO: 111155 - RNA, 64 nt, Human
uguaacuucugcagaccuaucacaaguuuacauguaaccacagaaaucccuuucucuccugacu

SEQ ID NO: 111156 - RNA, 64 nt, Human
gaaggacuugcccgcauggagcuauuuuuauuucuaaccacaauuuuacagaacuuuaaccuga

SEQ ID NO: 111157 - RNA, 64 nt, Human
agacaacuccccaugauccugucacacagcauuauaaccacaaauccaaaccuuagccugcugc

SEQ ID NO: 111158 - RNA, 64 nt, Human
ccuuucagcucuggccaagagugggacaggguuuuaaccacaaauaggagcagcaugcaauucc

SEQ ID NO: 111159 - RNA, 64 nt, Human
auccagacgauuucagugaccaaaugcucagcuguaaccacagcacuaacuggccuucuuucca

SEQ ID NO: 111160 - RNA, 64 nt, Human
agcaaaccacauaaucucucuagguccauuuuccuaaccacaagauaaagauguuacauuguca

SEQ ID NO: 111161 - RNA, 64 nt, Human
cgguaguuugguuuuuuuguuuguuuuguuuuuuuaaccacagauaauugccaaaguuuccacc

SEQ ID NO: 111162 - RNA, 64 nt, Human
cuuccaaaacccaagguuggcuauaaucucugcauaaccacaugacuuggaaugcuuaaaucag

SEQ ID NO: 111163 - RNA, 64 nt, Human
ugcuuccucuccugucaauuccaggcucuuuccauaaccacaagccugaggcugcagccuuuua

SEQ ID NO: 111164 - RNA, 64 nt, Human
ccuaacuuugucgcuaguccuaaggagaaaccuuuaaccacaaaguuuuuaucauugaagacaa

SEQ ID NO: 111165 - RNA, 64 nt, Human
cgugggcagggcaggccccaucgcuuuccucugauaaccacauggacacauccugaagucagcc

SEQ ID NO: 111166 - RNA, 64 nt, Human
ggggucuggugggggacacccaagaauaaaagaauaaccacaaagugugcaagggaccaacagc

SEQ ID NO: 111167 - RNA, 64 nt, Human
gguguuuuuuuuuucuuuuuauacaauaccauguuaaccacaugaguuaaauaaauuugagaag

SEQ ID NO: 111168 - RNA, 64 nt, Human
agaagaauuuuccucaagauggacccgguaaauauaaccacaaggaagcgaaacugggugcguu

SEQ ID NO: 111169 - RNA, 64 nt, Human
cacagacauccuucuggacuuaaacacuuaacauuaaccacauuauuaauuguugcugaguuua

SEQ ID NO: 111170 - RNA, 64 nt, Human
cccuuucuuaaagauacuccaagccacaugccacuaaccacaagcaagcuggcugcaagacuaa

SEQ ID NO: 111171 - RNA, 64 nt, Human
gccuuugugaaaugaacuuguuuacuauuggagauaaccacacuuaauaaagaagagacaguga

SEQ ID NO: 111172 - RNA, 64 nt, Human
gaaggggaggaaaauggcaaguguauuuauauuguaaccacaugcaaauaaaaagaaugggacc

SEQ ID NO: 111173 - RNA, 64 nt, Human
cauauauuuauagauuguguucacagcaaucauuuaaccacaaauaaaauaucccuugaugaua

SEQ ID NO: 111174 - RNA, 64 nt, Human
gucagcuuagaagaguacuccaagcuucagaugauaaccacagccugggcugacaccuggauuu

SEQ ID NO: 111175 - RNA, 64 nt, Human
augagagccacaucuguaauuuaaauguuucuaguaaccacauuuuuuuaaaaguaaaaagaaa

SEQ ID NO: 111176 - RNA, 64 nt, Human
ggugguuguauuuuugccccaagaaguguuuggauaaccacacaaaagcaugaugaaaaggcuu

SEQ ID NO: 111177 - RNA, 64 nt, Human
cuaguuuggucuguggcuaguuuaaauauguuucuaaccacagagaauuucauauauauauaca

SEQ ID NO: 111178 - RNA, 64 nt, Human
cuguggcagggggcacugagccuccagacccugcuaaccacaaaagggaacaucccagcaggcu

SEQ ID NO: 111179 - RNA, 64 nt, Human
cuuuacaccauacuuuacuucugguaugguuuauuaaccacacacacacacaaaagugaaaaac

SEQ ID NO: 111180 - RNA, 64 nt, Human
ucuauagacacagacacuugccuauacagagacauaaccacacacacucagaggauagugaaca

SEQ ID NO: 111181 - RNA, 60 nt, Human
cugggagucuugagauauaaaagaaugugguaaccacagaauuaauaacuguacuacccu

SEQ ID NO: 111182 - RNA, 64 nt, Human
ugcaaacguucuaggagaugugagagaaaauauguaaccacaucuuaguggcccaagaaaauac

SEQ ID NO: 111183 - RNA, 64 nt, Human
ucaacaggccacucacucuuaagggugagaagaauaaccacaauuguaugugccuguuuuuuac

SEQ ID NO: 111184 - RNA, 64 nt, Human
agccauuccuucuuuccuuccugccuuuuagcucuaaccacauuaagcuaagacaaggccagag

SEQ ID NO: 111185 - RNA, 64 nt, Human
accccagaucccagggacucauccugugacuuuguaaccacacucauuccuuucaaacacagag

SEQ ID NO: 111186 - RNA, 64 nt, Human
uuaauuauauuuacuuuuuggaaugguguaagccuaaccacaaguaaaagaucuuugccuaagu

SEQ ID NO: 111187 - RNA, 64 nt, Human
guuuauuucaacagauauuuuaugaaaugcaguuuaaccacagugaaugaauuuuagcuuugcu

SEQ ID NO: 111188 - RNA, 64 nt, Human
auuuuucuauaucauacucuugugagguuggauuuaaccacagaggcagaaaguuggucuacuu

SEQ ID NO: 111189 - RNA, 64 nt, Human
caaauugaaauuuuccauaauuaucauuaauuuguaaccacauccagugucaugcuuacuccuu

SEQ ID NO: 111190 - RNA, 64 nt, Human
ccuaaaaauauuaaugucuaguuguucuauauuauaaccacauuugcgcucuaugcaagcccuu

SEQ ID NO: 111191 - RNA, 64 nt, Human
caaggacuggcuaggaccuagaacuaagaucuuauaaccacacuccaugcaacuaugagucucu

SEQ ID NO: 111192 - RNA, 64 nt, Human
aaaagaagaguuuuagagaaaauaaauuuaacuuuaaccacagugaaaguugacccuuagcggg

SEQ ID NO: 111193 - RNA, 64 nt, Human
ucuguagccuucagcaguguuugcaucucugacauaaccacaggcugcuguuuucaagaagagc

SEQ ID NO: 111194 - RNA, 64 nt, Human
cugagcacuaguugauaacuuuggaguuaguggauaaccacagggcugggcuacuaagcuuuuu

SEQ ID NO: 111195 - RNA, 64 nt, Human
ugugaaaucacgcugacccuagccugucucuggcuaaccacacaggccauuccccucucccagc

SEQ ID NO: 111196 - RNA, 64 nt, Human
caaaauaguuguacagguuauauguggcauagcauaaccacaguaagaacagaacagauauuca

SEQ ID NO: 111197 - RNA, 64 nt, Human
caggaccauuuuaucaaaguucguucauuuccguuaaccacauaacuaauaauuuaauuguuau

SEQ ID NO: 111198 - RNA, 64 nt, Human
gugcuugaaaaguuuaauauuugaauauuguguuuaaccacaugguauuaaaauuuugcaauau

SEQ ID NO: 111199 - RNA, 64 nt, Human
ugcuuauguucugcuaugacguuugaucgaauccuaaccacagugagcucuucauuagcucaau

SEQ ID NO: 111200 - RNA, 64 nt, Human
aaauauugauguuguauuuuacacucuuaagucuuaaccacagucagaauuaucuuaauguaga

SEQ ID NO: 111201 - RNA, 64 nt, Human
ucuugacuucuguccuuggggaaagccauuuuguuaaccacacuagugagauuuacaugaugcu

SEQ ID NO: 111202 - RNA, 64 nt, Human
caucccuguaauagauggaaggucagccccggcuuaaccacagagcacuggcccuucauggcug

SEQ ID NO: 111203 - RNA, 64 nt, Human
uacacaugcuuuaaaauauguauucaaauguuauuaaccacaaugacgaccugcuuugauuuaa

SEQ ID NO: 111204 - RNA, 64 nt, Human
aauagauugcaucugcccugugcaugcgcauguuuaaccacaggccagagaacucaauucugau

SEQ ID NO: 111205 - RNA, 64 nt, Human
cccugccgagaugucggugauggccuggaugcuguaaccacaaccuguggcuaaaaauuuuauu

SEQ ID NO: 111206 - RNA, 64 nt, Human
uaaagcuuggaugccaaugagaguuauuuuaugguaaccacagugcaaggcaacugucagcgca

SEQ ID NO: 111207 - RNA, 64 nt, Human
uugguauaguaucuacagaguguauaauuuaaacuaaccacaaagcuuuacaucuucauuuuga

SEQ ID NO: 111208 - RNA, 64 nt, Human
ugaaugugucuauuuuuuucuagugaauguauuuuaaccacaguguccuaaacugagaaaacua

SEQ ID NO: 111209 - RNA, 64 nt, Human
gagagggaagauggucccugggcacuguggcagcuaaccacaggaagacugucggcagcccucu

SEQ ID NO: 111210 - RNA, 64 nt, Human
ugcaaccaguagaaagcauugaaaugacugucauuaaccacacaguccuggaggcagagaugca

SEQ ID NO: 111211 - RNA, 64 nt, Human
uucccuccccacuacuccuucuccuucuagaugguaaccacagccucgaccaugccugcucccu

SEQ ID NO: 111212 - RNA, 64 nt, Human
uaggaauaucugaaaacagcauuucuaagggugguaaccacaggucgauuuuaauacgaguccu

SEQ ID NO: 111213 - RNA, 64 nt, Human
uuggugaaauaauaaaaugcaaaugaaucauuguuaaccacagcuguggcucguuugagggauu

SEQ ID NO: 111214 - RNA, 64 nt, Human
uguaagacuugcaaaggacagaaggaaucuucuguaaccacauagcuguaugccagagaggaag

SEQ ID NO: 111215 - RNA, 64 nt, Human
aaaaggggagguuuuagacaggcucccugaauguuaaccacagaggagucacuccuucauuccu

SEQ ID NO: 111216 - RNA, 64 nt, Human
ccaguucccagugcagcuguaggucgucaucaccuaaccacacgugcaauaaaguccucgugcc

SEQ ID NO: 111217 - RNA, 64 nt, Human
agaugaccauuuuuaauaagcacaaucaaauuuuuaaccacagaaugucuacaagaauuauagc

SEQ ID NO: 111218 - RNA, 64 nt, Human
caugaacuagcggaaaauuuauuaaauuaacuauuaaccacauucaccuuguaaaugacuguau

SEQ ID NO: 111219 - RNA, 64 nt, Human
ucauccuuucuucucagucccuaccuacuguuuguaaccacaagugucucuguguguggguggg

SEQ ID NO: 111220 - RNA, 64 nt, Human
cagaaggcuuuaaguauccauugggacaugaaguuaaccacagucgggaaacaagcauagaaau

SEQ ID NO: 111221 - RNA, 64 nt, Human
augugggcuuuuucaagggugaagauacaagucuuaaccacaguguaacuuacaguuuccuuua

SEQ ID NO: 111222 - RNA, 64 nt, Human
cuuuuuacccuccugugacagcuguuacaaccuguaaccacaaucccucaccucucagagggaa

SEQ ID NO: 111223 - RNA, 64 nt, Human
cuggugaauuuuagucaucccagcuuuuuagucuuaaccacaguucucacucucuuaaauggua

SEQ ID NO: 111224 - RNA, 64 nt, Human
uuaaugaauguuuuugcaugaccuguucuuauguuaaccacauauuuuuuuucccaauuccaca

SEQ ID NO: 111225 - RNA, 64 nt, Human
acucccccuucaccccacacccggcccccccaccuaaccacagcgccucuccagaccuaccucg

SEQ ID NO: 111226 - RNA, 64 nt, Human
acuaugacccagccgagcuguuuaacaaauaaacuaaccacaaaagacugaguugcaagagucu

SEQ ID NO: 111227 - RNA, 64 nt, Human
cuuagcuccauauuugacagaaagauagaaagcuuaaccacauuguccaaaaagaaauugcauu

SEQ ID NO: 111228 - RNA, 62 nt, Human
uguauguauauuuuuuccauuaaauauauauuuauaaccacaaguuguaguuacauuuacua

SEQ ID NO: 111229 - RNA, 64 nt, Human
ggccugagguguacauaguccuucccggccauauuaaccacacagccugagccuggcccagccu

SEQ ID NO: 111230 - RNA, 64 nt, Human
gaccacacccaccgcaaccucauccccucagcacuaaccacauccacucucaaccccguccccu

SEQ ID NO: 111231 - RNA, 64 nt, Human
uuuuuguuaaaaaaaacuuggcuccaaguucuauuaaccacagguuguguucauucuuuuccug

SEQ ID NO: 111232 - RNA, 64 nt, Human
uaaaagguaauaauacucugaaagaaaaaugacguaaccacagcguguacuaugaaagcuguua

SEQ ID NO: 111233 - RNA, 64 nt, Human
guccuugucaucugggcacccucacacaucuccuuaaccacacuuaaucuccaaauaaguacga

SEQ ID NO: 111234 - RNA, 64 nt, Human
auccacauaggagagaaacuuugcugaugacuuuuaaccacaaguaaaaaaugugguaagucca

SEQ ID NO: 111235 - RNA, 64 nt, Human
gggcccgugggaugggccucaggccaccaggcaauaaccacagggccugcagcagugccccugc

SEQ ID NO: 111236 - RNA, 64 nt, Human
gaucccuuacuucagcaacucaagucugcuacccuaaccacaagauucaagauuauccacaccc

SEQ ID NO: 111237 - RNA, 64 nt, Human
ucugacccaugggcuccuugagccugcagcucuguaaccacagggcuccuguggggaggccuug

SEQ ID NO: 111238 - RNA, 64 nt, Human
uuuuauuucuaacacauuccagaaccacauuuucuaaccacaguguaguaauuuuaucaagagc

SEQ ID NO: 111239 - RNA, 64 nt, Human
guacuggcuaaaaagaaaggaagauaacauccaguaaccacaggaauauauucucugugaauua

SEQ ID NO: 111240 - RNA, 64 nt, Human
ucgcaccgugcccagguacacuuucaagacacuguaaccacaagauguuauuuauugagcuggc

SEQ ID NO: 111241 - RNA, 64 nt, Human
auucuacaucauuaaccaguaaggacuuuuuaauuaaccacaauaccacuaucacaccuaauaa

SEQ ID NO: 111242 - RNA, 64 nt, Human
uguccggugcuaccacaccgugcccucaguggacuaaccacagcagcagccagggaugggcccu

SEQ ID NO: 111243 - RNA, 64 nt, Human
auuguugaacuuugcugccaaauauaguaaccaguaaccacagcuagcuguaaaauugaaaauu

SEQ ID NO: 111244 - RNA, 64 nt, Human
uuugcaaugcuuuuauauggcccagccuuguaaauaaccacaagguccacucccugcuccacga

SEQ ID NO: 111245 - RNA, 64 nt, Human
ucuucaggcucuagggcugugcuauccaauacaguaaccacaugcggcuguuuaaaguuaagcc

SEQ ID NO: 111246 - RNA, 64 nt, Human
gcuggaauuuuuugggcuuucagauuucucuuuuuaaccacauuucugaauguauaaaaauacc

SEQ ID NO: 111247 - RNA, 64 nt, Human
cucuaaaaaccauguacacacuuucacucuauuguaaccacacagggcaggcgcauccagcaug

SEQ ID NO: 111248 - RNA, 64 nt, Human
gugagcccucccgguucucaccucgccuggcacuuaaccacacccugguuuuguguagccgcca

SEQ ID NO: 111249 - RNA, 64 nt, Human
auuuccuggagaaauuccucuuuaaaugaacaaguaaccacaucucaggcggcagugaagucca

SEQ ID NO: 111250 - RNA, 64 nt, Human
ucuuagaaaaaaaugagaacuaaaaaaaaaaaauuaaccacauggagaaauggguguaaaaugg

SEQ ID NO: 111251 - RNA, 64 nt, Human
cguagaaaucccccuuucucuaauagcgaggcucuaaccacacagccuacaaugcugcgucucc

SEQ ID NO: 111252 - RNA, 64 nt, Human
uguaacuucugcagaccuaccacaaguuuacauguaaccacagaaaucccuuucucuccugacu

SEQ ID NO: 111253 - RNA, 64 nt, Human
aaguuuauaaguuugaacuggacuuguucgauuauaaccacaaauugugugugugugugugugu

SEQ ID NO: 111254 - RNA, 64 nt, Human
gucugaccagaacauuagcaaggccaaggaacuuuaaccacaguauaacuaagaaauggcauag

SEQ ID NO: 111255 - RNA, 64 nt, Human
uuucuuuuucuuuucuaauuugguggcacugguauaaccacacauuaaagucaguaguacauuu

SEQ ID NO: 111256 - RNA, 64 nt, Human
ucacccuaaggccucggcccaccucuggcuaugguaaccacacugggggcuuccuccaagcccc

SEQ ID NO: 111257 - RNA, 64 nt, Human
caugggagucauuuuauuccuuacagcuuccuuguaaccacagcccuaaauccaugauaaagcu

SEQ ID NO: 111258 - RNA, 64 nt, Human
gacuuuauaaguuugaacuggacuuauuugauuauaaccacaaauugugugugugugugugugu

SEQ ID NO: 111259 - RNA, 64 nt, Human
gguuuauucuugucuuaugucuugaccuguuucugagugcgaacacaaaccagguguuucuguc

SEQ ID NO: 111260 - RNA, 64 nt, Human
uuugguuuguuuaucuucaaauuugaguugaaacgagugcgauuuauuuaaguuguauauaaaa

SEQ ID NO: 111261 - RNA, 64 nt, Human
caccgacccgacacucucaccccccgaccuggcugagugcgaccaccacuugaugucugaggau

SEQ ID NO: 111262 - RNA, 64 nt, Human
cugaccagacacugccugggguggacauucagcagagugcgaguggagagagagagaugguguu

SEQ ID NO: 111263 - RNA, 64 nt, Human
ccuucucucaucaacgggaaaguacuuccucugagagugcgagugcaccaugcucacuguugcu

SEQ ID NO: 111264 - RNA, 64 nt, Human
ccucagggguuguuaaaaaugcacagaaacaauugagugcgauuauuggcuucugagcgcugag

SEQ ID NO: 111265 - RNA, 64 nt, Human
aguaccugaccaacagaacuucaagucucuuccagagugcgagacucagcuuaucugaucaagg

SEQ ID NO: 111266 - RNA, 64 nt, Human
aguuuguaucacucaacaucaggggaugccugaggagugcgagcuccacagcaacauggcaggc

SEQ ID NO: 111267 - RNA, 64 nt, Human
uuuuuaauggaguuucacuauuuugcccaggcuggagugcgauggugcgaucuuggcucacugc

SEQ ID NO: 111268 - RNA, 64 nt, Human
augagaauggagucugaauggccuuccugagagcgagugcgacccguuccuuuguuuccuugca

SEQ ID NO: 111269 - RNA, 64 nt, Human
ugaguaucuucaugguaugauaguguguguuugugagugcgaaguaccaauuaaggugucuuaa

SEQ ID NO: 111270 - RNA, 64 nt, Human
aaaacaaagugaaaucauaccucagcucaugucagagugcgaauaugucucugagaagcuagag

SEQ ID NO: 111271 - RNA, 64 nt, Human
gcugcucaggaugaaccuggaggcccaccucaaggagugcgagcacaucaaaugcccccacucc

SEQ ID NO: 111272 - RNA, 64 nt, Human
uguuauaugcuacaagggauuucaguggacugcagagugcgaacgucuugcuguuguguuuuua

SEQ ID NO: 111273 - RNA, 64 nt, Human
ucguguucauuccccuugaggaggaagcagagcagagugcgagauccugacccaagagcaccau

SEQ ID NO: 111274 - RNA, 64 nt, Human
ggaaugccuggucuugagcaaccucccacugcuggagugcgagugggaaucagagccuccugaa

SEQ ID NO: 111275 - RNA, 64 nt, Human
uuaguguuucugugcaugguggcaccagcgaagggagugcgaguauguguuugugugugugugu

SEQ ID NO: 111276 - RNA, 64 nt, Human
gagacuaggagggaaucuggagggggcgcuggaggagugcgaaacgggggaagggagccggcag

SEQ ID NO: 111277 - RNA, 64 nt, Human
aggauucuuccuaucuggaaauucuauuuuguuagagugcgauaggacauauggaaaaccaaca

SEQ ID NO: 111278 - RNA, 64 nt, Human
gccauccaccggggcauggcccaggaggagcggugagugcgagccgcccgccaaggcugcaggg

SEQ ID NO: 111279 - RNA, 64 nt, Human
auacagaagagcucccacugcagaagggccucuugagugcgaugaaugugagaaagccuucugc

SEQ ID NO: 111280 - RNA, 64 nt, Human
cgucaguauucacuggaccucaggcccugugcaggagugcgauccgggcugggccgcugggcag

SEQ ID NO: 111281 - RNA, 64 nt, Human
aagcugccuucagacaaggcuagucuaggggcaagagugcgagcuggcugacaauaagaacgug

SEQ ID NO: 111282 - RNA, 64 nt, Human
gugaggcuuucuacaaauaggucagcuccaccuggagugcgaauugccagagacaccuugguag

SEQ ID NO: 111283 - RNA, 64 nt, Human
gcaguuuggaaagcauuugugaaacuuucuguuuggcacagaaacagucaaaauuuugacauuc

SEQ ID NO: 111284 - RNA, 64 nt, Human
gucgccuuucugaccagcaggccuggagggcaggggcacagagcagagaggagggcacuggugg

SEQ ID NO: 111285 - RNA, 64 nt, Human
gauaccacggcuaugagggaguaggcucugagagggcacagacuuguggagcugggcgucugga

SEQ ID NO: 111286 - RNA, 64 nt, Human
cauagaugguaccuggcauggacugauguuuuuaggcacagaaguuggagaagagauuucauga

SEQ ID NO: 111287 - RNA, 64 nt, Human
aucugguaauaguccucuucugagaaugaaaggaggcacagaaguugcgagaaagacccagucc

SEQ ID NO: 111288 - RNA, 64 nt, Human
aacucaucuccagguagcccacggauacgugguuggcacagacacaagacucccagaguugucc

SEQ ID NO: 111289 - RNA, 64 nt, Human
ggcguggugggggcggagggaaggagggcggcggggcacagagacagagagcaaggcugugaaa

SEQ ID NO: 111290 - RNA, 64 nt, Human
gcagcugugucuccaacguugagacuuugcagauggcacagacuccauggauaauagguaaacu

SEQ ID NO: 111291 - RNA, 64 nt, Human
ccuagggacaugaaguaugggaguggguggcuguggcacagacagguggaaaacgggauagccu

SEQ ID NO: 111292 - RNA, 64 nt, Human
ugaaauucaaggcagcacggacaugugcccaucaggcacagaagaaaacacgacgucguccauu

SEQ ID NO: 111293 - RNA, 64 nt, Human
cugagccuuaagaggacuaauucccuuuuucuaaggcacagagcugguaaaaugugaaguaaua

SEQ ID NO: 111294 - RNA, 64 nt, Human
ucuuuagcaggccucuggcaccucagcagucggaggcacagaagcugcaaaagggaucuucgaa

SEQ ID NO: 111295 - RNA, 64 nt, Human
ggcaagcagggaaagcuccacggugcguggcuguggcacagacuucuggaaggcuggcugagug

SEQ ID NO: 111296 - RNA, 64 nt, Human
aauggagcaacgugagugaccgcccaaggucacaggcacagaaccuuuccccugcuaucucccu

SEQ ID NO: 111297 - RNA, 64 nt, Human
gagagaagcugggcccagccgggccgugccugcuggcacagacgccuuaacgcuguguguauga

SEQ ID NO: 111298 - RNA, 64 nt, Human
cuuucauuucugugggaggggcagagagguagguggcacagaagauggggcuuuaugcuuguaa

SEQ ID NO: 111299 - RNA, 64 nt, Human
gcagccauggggaaggcaguuugugagggcuuggggcacagaccuggggcaggaggcagcucuu

SEQ ID NO: 111300 - RNA, 64 nt, Human
cagagucagaaguuucugccgcagcccugcagagggcacagaaaauggaagacagcucuuauau

SEQ ID NO: 111301 - RNA, 64 nt, Human
auauauuaucagagaaguagccuaguggucguggggcacagaaaaaauagauaggggcagcucu

SEQ ID NO: 111302 - RNA, 64 nt, Human
cccggaggcauguccuggcugguucuuugggguuggcacagaaguccugucugagguccuaucc

SEQ ID NO: 111303 - RNA, 64 nt, Human
ugucugcugcuguguccccaggucuuguguggguggcacagaucugggcaguuagauagugcuc

SEQ ID NO: 111304 - RNA, 64 nt, Human
ggagagaggagggaucucucccauagagauggaaggcacagaaaggugcgacuggaaacuuucc

SEQ ID NO: 111305 - RNA, 64 nt, Human
cugacuauggcuuaguaucuuucucauuacaauaggcacagagaagaaugcaacagggcacagg

SEQ ID NO: 111306 - RNA, 64 nt, Human
agggcacugccccugccugccccuuuggugcccaggcacagacccugauaguggguuuggguca

SEQ ID NO: 111307 - RNA, 64 nt, Human
uaacacggaugcucaaguaaaacuagauucacagggcacagauuccccagaaaguuaacacaau

SEQ ID NO: 111308 - RNA, 64 nt, Human
uuuucuaacucucccuugcucgcuguaaaaucuuggcacagaaacacaauauuuuguggcuuuc

SEQ ID NO: 111309 - RNA, 64 nt, Human
gcuacuauucucaugguacaguggggaaaacugaggcacagagagguuagggacuuuucaugau

SEQ ID NO: 111310 - RNA, 64 nt, Human
guccuauaauaaaggggcuucugggaggugccugggcacagaugucuguucagcaggugugugg

SEQ ID NO: 111311 - RNA, 64 nt, Human
augcucagcuacauccggcccagggugcugcaguggcacagaccagccacaggauggcaguaga

SEQ ID NO: 111312 - RNA, 64 nt, Human
cugggaaggagacaggacauuccuguacuaagguggcacagagcuguccuuugcaacauucuca

SEQ ID NO: 111313 - RNA, 64 nt, Human
cagagcuguccuuugcaacauucucauaaaauugggcacagaguucgcauuggcgcaauauuua

SEQ ID NO: 111314 - RNA, 64 nt, Human
ccugucacccugagcaucugucucaaccugcugaggcacagacuuccaccaugugcaucaggaa

SEQ ID NO: 111315 - RNA, 64 nt, Human; identical to SEQ ID NO: 84514

SEQ ID NO: 111316 - RNA, 64 nt, Human
ggccagcccaguccauggccuucuugggccucugggcacagagccaauguucgucauugcagcu

SEQ ID NO: 111317 - RNA, 64 nt, Human
gguuagcagaggagccggacacagaggaagcucaggcacagaggacgaggagcaagcuggcgcc

SEQ ID NO: 111318 - RNA, 64 nt, Human
gagacucgugugacuauuuuuuuuccuuguucuaggcacagaaaaaaauaggucagcuuaaaaa

SEQ ID NO: 111319 - RNA, 64 nt, Human
auaucugccuucuaagaaggcaggccaggucuugggcacagaccugcauuuguugaccuugcac

SEQ ID NO: 111320 - RNA, 64 nt, Human
uacugugcuagccugacuucaagcucaggugagaggcacagaauccacacacuuauugccaucc

SEQ ID NO: 111321 - RNA, 64 nt, Human
auaaaaucuaccuuucauauaaugcuacauugaaggcacagaauuugcuaccaucucucucucc

SEQ ID NO: 111322 - RNA, 64 nt, Human
agagcaaagcagaagaaaugacagcagaagccauggcacagacuuguauagaggagaaaaaaug

SEQ ID NO: 111323 - RNA, 64 nt, Human
uggggcuuuaacuccugcuagaacagucucuugaggcacagaaacuccuguucaugcccauacc

SEQ ID NO: 111324 - RNA, 64 nt, Human
gaccccugccccugucugccagcagaggcaguagggcacagagggaagaggaggguggggcccu

SEQ ID NO: 111325 - RNA, 64 nt, Human
ugggcaaaaauuauuuucucaauuuuacugaguaggcacagaagaaaaguacagauaggcugau

SEQ ID NO: 111326 - RNA, 64 nt, Human
ccuccucuaccuuggaagcaguuagaaucuaccaggcacagaugaggccgcccuugccugacgg

SEQ ID NO: 111327 - RNA, 64 nt, Human
auuggcaagaggagcugguccauuccccauucauggcacagagcaguggcagggcccagcuagc

SEQ ID NO: 111328 - RNA, 64 nt, Human
caggcggccgagcugccgaauucaguugacacgaggcacagaaaacaaauaucaaagaucuaau

SEQ ID NO: 111329 - RNA, 64 nt, Human
ugaauuguaccuuuguccuguccuuucccuaggaggcacagacuucggguuggauuugucagca

SEQ ID NO: 111330 - RNA, 64 nt, Human
aagaaagaauugaaauacugugccggcuuucacuggcacagaaguuuaagacuaugaguuuuua

SEQ ID NO: 111331 - RNA, 64 nt, Human
cauccuuugguuucuuuuuaaucaccugugucugggcacagacaaucacaauaaaugcagcccu

SEQ ID NO: 111332 - RNA, 64 nt, Human
agguugagggcagcuccagugccagcaauaggguggcacagaagcucaucucagucauccugca

SEQ ID NO: 111333 - RNA, 64 nt, Human
gggguauuaauacaguugaaguuauguugcccuuggcacagaucuuugagaaucucauacaucu

SEQ ID NO: 111334 - RNA, 64 nt, Human
gccugaaggcagacgugugcccagaugugaaagagaccuucaguaucagcccuaacucuucucu

SEQ ID NO: 111335 - RNA, 64 nt, Human
uggauggcccggauuuuauggcaucuggaacaugggcacagagaggggccugugggaggggcug

SEQ ID NO: 111336 - RNA, 64 nt, Human
uccuccucaagcucacaccaauugguuuggcacaggcacagagcuggucccuaguuaaguggca

SEQ ID NO: 111337 - RNA, 64 nt, Human
agaaagcauuauuuugaaaggugauauacaguggggcacagaaaacaaaugaaaaccuucaguu

SEQ ID NO: 111338 - RNA, 64 nt, Human
caaugacagacugagcaaaauugcuugcaaaaguggcacagaguuagcacuccauaccccuuca

SEQ ID NO: 111339 - RNA, 64 nt, Human
aggaugccgccaggugucccucuccucccccuggggcacagagauauauuauauauaaagucuu

SEQ ID NO: 111340 - RNA, 64 nt, Human
gucuaggcuagacauggcagagaugaggagguuuggcacagaaaacauagccaccauuuugucc

SEQ ID NO: 111341 - RNA, 64 nt, Human
cucuggggcaggguuauuccuuuguggaaccagaggcacagagagagucaacugaggccaaaag

SEQ ID NO: 111342 - RNA, 64 nt, Human
cuuuagguuguuccagaaaagauucaggccguuuggcacagaauugcucuuucugaaggguagc

SEQ ID NO: 111343 - RNA, 64 nt, Human
cccuugucagucagcaccuuaggaaaccaugaugggcacagagcaucacaugagcuguuucucu

SEQ ID NO: 111344 - RNA, 64 nt, Human
caccaccuccuccccucaaggcaugcugagcaugggcacagacagcccaucccugcuccaugcu

SEQ ID NO: 111345 - RNA, 64 nt, Human
augguuuuagucauuuuggcugccagcccuuaauggcacagaucugcugcuucuaacagauggc

SEQ ID NO: 111346 - RNA, 64 nt, Human
ugagccugcggggugcccucucacuugaagaucaggcacagauggcuguggaguucaaaugucg

SEQ ID NO: 111347 - RNA, 64 nt, Human
uugcuuugcaggaagugucuagaggaauauggugggcacagaaguagcucuggugaccuugauc

SEQ ID NO: 111348 - RNA, 64 nt, Human
accuuccuucaggagcaggcauugguagugcagaggcacagauuccguccuuuaccagcugcag

SEQ ID NO: 111349 - RNA, 56 nt, Human
ugagcaccaaagagaucuaaugaggaggcacagaccagugucuggaucccagcauc

SEQ ID NO: 111350 - RNA, 64 nt, Human
ccguccuggggacuugggcuucuugccuucauaaggcacagagcagauggagaugggacagugg

SEQ ID NO: 111351 - RNA, 54 nt, Human
ucuuuucauccccuagaugaugcuggcacagaaggcauuguucccuacccucug

SEQ ID NO: 111352 - RNA, 64 nt, Human
caccaucccuguccccuugcuugcagguagaauuggcacagaguuaagguuccauaauaaacug

SEQ ID NO: 111353 - RNA, 64 nt, Human
gugagggauacugagggcaguccuguggcugaggggcacagauugaacugcugaacuaguugga

SEQ ID NO: 111354 - RNA, 64 nt, Human
auuugucauuuguggcuuucuuucuuaucaucauggcacagauucuguacauguauuaacaaug

SEQ ID NO: 111355 - RNA, 64 nt, Human
ugucauauuuuugaguuuuguaauggaagaaccaggcacagaaacagacagaaaugauacugua

SEQ ID NO: 111356 - RNA, 64 nt, Human
uaggggugcgcucaccugcagccccuccuccucgggcacagacgacugucguucuccacccacc

SEQ ID NO: 111357 - RNA, 64 nt, Human
uuuggaagacacugcauuuuagccaguguaccugggcacagacucggggcugcccugaagcuga

SEQ ID NO: 111358 - RNA, 64 nt, Human
uucugaguccccggccagggucccuuaacaccucggcacagaggcuguuggcaaguguagaggc

SEQ ID NO: 111359 - RNA, 64 nt, Human
ugccaccccagcaucugucuuuucacccacggagggcacagaaccaccagcaaagccggcggcu

SEQ ID NO: 111360 - RNA, 64 nt, Human
aauauaagaagaaaaaaauccccuacauuuuauuggcacagaaaaguauuagguguuuuucuua

SEQ ID NO: 111361 - RNA, 64 nt, Human
agcgauucaaggacauaaaucuucauucuuuucuggcacagacuacuuaaaugggucuguuuuc

SEQ ID NO: 111362 - RNA, 64 nt, Human
auuucaacaaugggaauuauuuaauguaacagugggcacagauuacuuaucuuccuucucugcu

SEQ ID NO: 111363 - RNA, 64 nt, Human
auugguaucucauggcuggagagcugaucagccaggcacagaaucuccagaacaaccuagagag

SEQ ID NO: 111364 - RNA, 64 nt, Human
uaugaaagaguucuugauccuaaagaaauuuaguggcacagaaaacaaagugaauuuguuagca

SEQ ID NO: 111365 - RNA, 64 nt, Human
ccaaauauuuucacuccagauuuguguuuucucuggcacagaguagaucuuuugggaaauauau

SEQ ID NO: 111366 - RNA, 64 nt, Human
uuucuauuucccccaguucuuuaagcagucaauuggcacagaguuucccacgggggcugcagug

SEQ ID NO: 111367 - RNA, 64 nt, Human
acuguggcggaagggggucccuggaaacaacucuggcacagaaccugcccugcaggcuguaggg

SEQ ID NO: 111368 - RNA, 64 nt, Human
gcacaacucgcaaauauaaauugcacaugcagaaggcacagaccccguagcgcaugccaacuug

SEQ ID NO: 111369 - RNA, 64 nt, Human
gugcuuguuuguugcagugguugaaaguguguggggcacagaggacgugcaccucccugcccuc

SEQ ID NO: 111370 - RNA, 64 nt, Human
agaguacuagacaguucaacaagccacaucuaauggcacagauagaggauguagcuauuuuaua

SEQ ID NO: 111371 - RNA, 64 nt, Human
ugggggcucaugguuucccucuacuuugggagagggcacagauugcagagguaaugcuguggca

SEQ ID NO: 111372 - RNA, 64 nt, Human
aaaagcaaaaacucuugugguaccuagucagaugguagacgagcugucugcugccgcaggagca

SEQ ID NO: 111373 - RNA, 64 nt, Human
gcaauagggugcucacugccucucacuuuccaauggcacagauuacaaaaguaaagaacaacca

SEQ ID NO: 111374 - RNA, 64 nt, Human
aucaggaucgucuaaaaauguaccucggugaggaggcacagauuuugccuccuguugaccagcc

SEQ ID NO: 111375 - RNA, 64 nt, Human
ucaguauagaaccacuagcgaauaguguugcucuggcacagaccacugugguugauggcauggc

SEQ ID NO: 111376 - RNA, 64 nt, Human
cugcuuauucucccauugggcagcugaggaccgaggcacagaggugcggugacuugcccggggc

SEQ ID NO: 111377 - RNA, 64 nt, Human
gguugggguccgcggguccucacaccgcacggcaggcacagaggcucgccaggcccugauccgg

SEQ ID NO: 111378 - RNA, 64 nt, Human
gaagacgaaggcagaguggugucaaaucuuugacggcacagaugccugugugacuccgguucug

SEQ ID NO: 111379 - RNA, 64 nt, Human
uccauugccggcaaugggcaggccugcaaauacuggcacagagcauuaaucauacaccuuauua

SEQ ID NO: 111380 - RNA, 64 nt, Human
auuguaacacuugauggagugaaauuccacgccaggcacagaauuuuuuugacauagauaauuu

SEQ ID NO: 111381 - RNA, 64 nt, Human
gacucaguccagagggucagaugcugcugugagaggcacagagcccuuuccgcauguggaagag

SEQ ID NO: 111382 - RNA, 64 nt, Human
aaacugggugcugaggugaaagcauaacuuuuuuggcacagaaagucuaaaggggccacugauu

SEQ ID NO: 111383 - RNA, 64 nt, Human
aaagagacuagaggccacacuugauaaaucauggggcacagauauguucccacccaacaaaugu

SEQ ID NO: 111384 - RNA, 64 nt, Human
accccagccucaaggcucugaccuucuucaugugggcacagaggguccugacacucuggcaggg

SEQ ID NO: 111385 - RNA, 64 nt, Human
gccugcauccgcuugcccugccuccaucccgcagggcacagagaagccucuucugccccugcca

SEQ ID NO: 111386 - RNA, 64 nt, Human
gcuccccauccccuaccaugggcacccaugugcuggcacagaacaguuccagaucuagacugga

SEQ ID NO: 111387 - RNA, 64 nt, Human
aaacaaaaacaagaacaaaaacaaacauaaaguuggcacagaaaagggaccaaguuuaaaaaag

SEQ ID NO: 111388 - RNA, 64 nt, Human
cccacaggaguccagggaaggcggggaccacagaggcacagaguccagcacuuggccgcucaug

SEQ ID NO: 111389 - RNA, 64 nt, Human
guguguuuuuuuaggguuucugauucuucaaagaggcacagagccaaauugguagaggaaggau

SEQ ID NO: 111390 - RNA, 64 nt, Human
aaauuuguuuuagcucuaaccucaucaaaccaaaggcacagauuuguguacaauauacccauug

SEQ ID NO: 111391 - RNA, 64 nt, Human
acuuguaagccagcgcuucuucucuccauccuuggaccuucacaaaugcccugagacgguucuc

SEQ ID NO: 111392 - RNA, 64 nt, Human
ggaacggggcuucacagugccugccuucucuagcggcacagaagcagccgggggcgcugacucc

SEQ ID NO: 111393 - RNA, 64 nt, Human
cucuuguauucucauggcaccuagugcagugcugggcacagaguaggugcucaauaaagacuug

SEQ ID NO: 111394 - RNA, 64 nt, Human
uauuuuuuauucucagggucgcuggucauccucuggcacagaacgaacguugucuucacauguu

SEQ ID NO: 111395 - RNA, 64 nt, Human
aucaucaugauucauauuuugagugaauacaucaggcacagaccuucaugauaucacacacucu

SEQ ID NO: 111396 - RNA, 64 nt, Human
ucaagcgcuguaaagcaccaacccggaaguggcaggcacagaaggaagggcuggauugggcccc

SEQ ID NO: 111397 - RNA, 64 nt, Human
gcauuccuucuucuggucagaaaccuguccacugggcacagaacuuauguuguucucuauggag

SEQ ID NO: 111398 - RNA, 64 nt, Human
gagcauuugaaggcacaaugcaggggcucagauuggcacagaauucuuuugugaaauaucagug

SEQ ID NO: 111399 - RNA, 64 nt, Human
gggcagcuggcaggagagagccuuggccugaccuggcacagaaagggcagcuucagucucugca

SEQ ID NO: 111400 - RNA, 64 nt, Human
aggaaaaugugauaaggccagagcuugugugcugggcacagaaaucaccugcugcauccugugc

SEQ ID NO: 111401 - RNA, 64 nt, Human
ucucuguuguuggagccuggagccuugcucucugggcacagagggguccacucuccugccugcu

SEQ ID NO: 111402 - RNA, 64 nt, Human
cgcacuuaucaaggaucgggaagguuaugcuccuggcacagaauuccaccggugcaaggagaug

SEQ ID NO: 111403 - RNA, 64 nt, Human
agggcugggcucuugccuuccuggaguaaauauuggcacagauuucauuugagagaacucagcc

SEQ ID NO: 111404 - RNA, 64 nt, Human
aagauuauuaguuguaacuaauuuagggguucugggcacagacaucuaaccugguauuguaagg

SEQ ID NO: 111405 - RNA, 64 nt, Human
uccucauucugcgacucccaaccaggguggagugggcacagacaggaugccuuaugcuuaucuc

SEQ ID NO: 111406 - RNA, 64 nt, Human
ucauuucuaugccuccuauauuaaggucuguguuggcacagaugaguaacugccauguucuagg

SEQ ID NO: 111407 - RNA, 64 nt, Human
ucucugucaccuccacuugcuccccgacagguggggcacagaccucuguuccugagcagagaag

SEQ ID NO: 111408 - RNA, 64 nt, Human
aggcuucaagucucugcagccugcuccacauuugggcacagaaggacucagacaggcacugugu

SEQ ID NO: 111409 - RNA, 64 nt, Human
agccccccauggccuggggccuccucuucaucuuggcacagaaauuguuugggggauggggggg

SEQ ID NO: 111410 - RNA, 64 nt, Human
aaccaagcauaagagaagaaacugucucagaucucacggccaggccucucuccugcugcuguuu

SEQ ID NO: 111411 - RNA, 64 nt, Human
ugcccauccuucuuucccagagucauuacaccaaggcacagacugguuccucugcucugagggu

SEQ ID NO: 111412 - RNA, 64 nt, Human
ggccccucaugauauuugccuucugcuccuagaaggcacagacuacuuucaaccugccucgccc

SEQ ID NO: 111413 - RNA, 64 nt, Human
ucacuucauugaccaagaugaucacauggaaggcggcacagaggcagcugugugggcugcagau

SEQ ID NO: 111414 - RNA, 64 nt, Human
ucugcugucuuuuguaauuaugcauccuagcuaaggcacagaagacugaaugaaugcaaggauu

SEQ ID NO: 111415 - RNA, 64 nt, Human
gcccaggauagauguaauauuucuuacagaugcuggcacagaggaaauaauauaccagcuaauc

SEQ ID NO: 111416 - RNA, 64 nt, Human
auggccauggcuauacuuggaaguucuccuuguuggcacagacauagaaaugcuuuaaccccaa

SEQ ID NO: 111417 - RNA, 64 nt, Human
agggaugcugcuccgcccgcuccugccgcagacgggcacagacacgcucgcgggcagcgggcca

SEQ ID NO: 111418 - RNA, 64 nt, Human
ugugaaggagcacaggugagggggugccugcuguggcacagagcugggaaggccuuacagaaga

SEQ ID NO: 111419 - RNA, 64 nt, Human
gccuuaagaagugcccuccccacaaugcaggagaggcacagagugcacugucauugacauguua

SEQ ID NO: 111420 - RNA, 64 nt, Human
agcaauuucagaaccaaaagggaggcucucuguaggcacagagcugcacuaucacgagccuuug

SEQ ID NO: 111421 - RNA, 64 nt, Human
uugggaaaucuuccccagcagaaucuggaugaauggcacagaauugaaaucucuuuguuuccca

SEQ ID NO: 111422 - RNA, 64 nt, Human
uuauuugugaauuacauguuucaugaauccauuuggcacagagacacaaggaagaaaacacuag

SEQ ID NO: 111423 - RNA, 64 nt, Human
gaaaagacauugugucaccuaugaaauuuuauuaggcacagagucauauuuuaagguagauagu

SEQ ID NO: 111424 - RNA, 64 nt, Human
aaaaggaggcccuuaugugaagugaaauaagccaggcacagaaagacaaacaucacauguucuc

SEQ ID NO: 111425 - RNA, 64 nt, Human
uuauucacgaaggugaccacugucuuucugaccuggcacagaggaaauguuggcugugaaugug

SEQ ID NO: 111426 - RNA, 64 nt, Human
acaaaaauaaacuaugguaauuaaugcaaaucugggcacagaugaugcgugcuacuugcuauua

SEQ ID NO: 111427 - RNA, 64 nt, Human
acuauccuagaggcugcuuggcccagaagagccaggcacagagcugcaguugggcacgccaagg

SEQ ID NO: 111428 - RNA, 64 nt, Human
acaauaagcauccgagguuuaugcagaaagcuaaggcacagaaagguuaaaugauuacucagcu

SEQ ID NO: 111429 - RNA, 64 nt, Human
cacucuacguugguuacuggauuugaaggcuagagaccuucaagucauaggacucaguaucugu

SEQ ID NO: 111430 - RNA, 64 nt, Human
acuuugccaaucaugucuaaacagauggauggugggcacagauggguccuccaugcuggcaaug

SEQ ID NO: 111431 - RNA, 64 nt, Human
aauacacaguuaccagaugggaaugcagcacaguggcacagagagguaacuacggagcccaugc

SEQ ID NO: 111432 - RNA, 64 nt, Human; identical to SEQ ID NO: 111423

SEQ ID NO: 111433 - RNA, 64 nt, Human
cugagccccuguauucugcuggccagacacacauggcacagacacagcugaccauaacccagga

SEQ ID NO: 111434 - RNA, 64 nt, Human
aguuuuuccuuuguaggaugggaaaguauaaaaaggcacagaagguugucaugggcuguuccuu

SEQ ID NO: 111435 - RNA, 64 nt, Human
augauggucaaucaguguuaacuugcauauuguuggcacagaacaggaggugugaaugcacguu

SEQ ID NO: 111436 - RNA, 64 nt, Human
uauguauccucuucccuuccccucccuugguaaaggcacagauguuuugagaacuuuauuugca

SEQ ID NO: 111437 - RNA, 64 nt, Human
ccuuaccggcaagcagcgggcuaacgggaggcugggcacagaggucaggaagcagggguggggg

SEQ ID NO: 111438 - RNA, 50 nt, Human
uggugggcagcgaccccugaggcacagaagaacaagagcaaagaccauga

SEQ ID NO: 111439 - RNA, 64 nt, Human
ugggcuuugcaaauccaggguagaggcccuaacaggcacagagagcaggggcaacuccuggcac

SEQ ID NO: 111440 - RNA, 64 nt, Human
uggagcuauuacugaugggccagacucugugcuaggcacagacuuucuagggauuauuucauuu

SEQ ID NO: 111441 - RNA, 64 nt, Human
caucuaaugugguuuuccuuaggaagagauagaaggcacagaagaucacagcuagagaauugag

SEQ ID NO: 111442 - RNA, 64 nt, Human
uucuccccucucucagauuggccuggcagccccuggcacagagcagacccggccacugguagcu

SEQ ID NO: 111443 - RNA, 64 nt, Human
ggccugcuccacuugucugggaaccugggcaggaggcacagaggaagccaaggccuggagcugc

SEQ ID NO: 111444 - RNA, 64 nt, Human
gucacuucuauugcaacucauuuucuuuuuccagggcacagaucgaccaagcugccguucccua

SEQ ID NO: 111445 - RNA, 64 nt, Human
ccugguaccaguaggcaccuggcugagccuggcuggcacagaaaccucuacuaaaaagaaggaa

SEQ ID NO: 111446 - RNA, 64 nt, Human
guccuuaauuggauuauuuuucuuuuggccuuugggcacagagucugaccucuggaccacucua

SEQ ID NO: 111447 - RNA, 64 nt, Human
accaaccagauacaucugcuggagagcccaggugggcacagagaaggguggagagagaaucugg

SEQ ID NO: 111448 - RNA, 64 nt, Human
uuuuucuuaaaauaaagacuuuuucacaaugacuggcacagauuacucagcaaaagauagcaaa

SEQ ID NO: 111449 - RNA, 64 nt, Human
ggacugggagugugagugugcauggcauguguguggcacagauggcugggacgggugacagugu

SEQ ID NO: 111450 - RNA, 64 nt, Human
gagagaggcacuggcuuugcuacugacauacucaggcacagagaaauuucccgagcucuguggu

SEQ ID NO: 111451 - RNA, 64 nt, Human
aaagauccugauguccaugacuucauguaguucaggcacagaaagaauagcaaagcugcuguca

SEQ ID NO: 111452 - RNA, 64 nt, Human
gacccaagaagaacagcuagaggacaacucuguuggcacagagacggggacagcccagucugcu

SEQ ID NO: 111453 - RNA, 64 nt, Human
gagggaacccuggggcucacccucucagaggaagggcacagagaggaagggaagaauugggggg

SEQ ID NO: 111454 - RNA, 64 nt, Human
aguccugccccagagacacuccaaguccgccaggggcacagaccaguucugcagugacuguccc

SEQ ID NO: 111455 - RNA, 64 nt, Human
agaucuucuguucaaaguacagugcuggcacuggggcacagagugcccacguuagccccgggcu

SEQ ID NO: 111456 - RNA, 64 nt, Human
uacagauuccaggguuggaucuuugguuggguguggcacagagucuggcuccugcuaggugaga

SEQ ID NO: 111457 - RNA, 64 nt, Human
gguucaggaagaccacacuugguguuacccgauuggcacagaccaguuucagagaaauacuuuc

SEQ ID NO: 111458 - RNA, 61 nt, Human
agcuuaacgaugcccauuaacugguuuguggggcacagaugccuggguugcugcuguccag

SEQ ID NO: 111459 - RNA, 64 nt, Human
agcuccccucccaggccucugugggcccuugucgggcacagaugggaucacaguaaauuauugg

SEQ ID NO: 111460 - RNA, 64 nt, Human
gagggccccgggcugcacuggugugggcugcacaggcacagacgcagacggccccggccguguc

SEQ ID NO: 111461 - RNA, 64 nt, Human
ggagauuuuuccggaggggagaggauuuucuaagggcacagagaauccauuuucuacacauuaa

SEQ ID NO: 111462 - RNA, 64 nt, Human
uggucaugggggaagaauguaggguuguggcacuggcacagacacaggaaaauccauuuucccc

SEQ ID NO: 111463 - RNA, 64 nt, Human
uggguugaaugacaaaucacuccaaacaaagcugggcacagagaaucagcuaggagaccaguua

SEQ ID NO: 111464 - RNA, 64 nt, Human
auggcggccccaccccaacuaccaccucuuuucaggcacagaccuugugggacugggccccagg

SEQ ID NO: 111465 - RNA, 64 nt, Human
aggggcgcucugaaaggggccugggggcaucucgggcacagacagccccaccuggggcgcucag

SEQ ID NO: 111466 - RNA, 64 nt, Human
uccuuacgaggcgucauacagaggcaguggggugggcacagaugagcagaguggaugguucggu

SEQ ID NO: 111467 - RNA, 64 nt, Human
ugggagaugcccugggguccgugguuguggucaucacggccaucauauucuaugugcuuccccu

SEQ ID NO: 111468 - RNA, 64 nt, Human
cccucacgugucuccucucuucccuagcccgucuggcacagaggguggaccuguuagaggagug

SEQ ID NO: 111469 - RNA, 64 nt, Human
cagcagaggcuauggaauguuucugcaacccuaaggcacagagagcccaacccugagugucuca

SEQ ID NO: 111470 - RNA, 64 nt, Human
aguuucuuugcagugagcagugcaguggaagucgggcacagagguagcagacagaugugaagca

SEQ ID NO: 111471 - RNA, 64 nt, Human
ccaucugcccugcucccacaugcucaggucccagggcacagaaaaagggcagacucccuaauca

SEQ ID NO: 111472 - RNA, 64 nt, Human
ggacuuucuucucggcucccucaacccuggcucaggcacagaagguguuuugcuacguuuuuuu

SEQ ID NO: 111473 - RNA, 64 nt, Human
aagccuguaaacuaaaaucuguuaccauucugauggcacagaaggaucuuaauucccaucucua

SEQ ID NO: 111474 - RNA, 64 nt, Human
gcuuguuagguuaggguuagauggggagagacagggcacagaggaccugucuccccggcuacuc

SEQ ID NO: 111475 - RNA, 64 nt, Human
augcauauuuuagccacuuuagagaaaccucauaggcacagaguuuccaagauuaauuuuaaga

SEQ ID NO: 111476 - RNA, 64 nt, Human
auauauguauauuuaaaaagugaauauaauuugaggcacagaagaauauucuuaaaaccuuuug

SEQ ID NO: 111477 - RNA, 64 nt, Human
aacagaaaccuggccgccggaugggaccuccuuuggcacagacuugacuguguaacugcauaaa

SEQ ID NO: 111478 - RNA, 64 nt, Human
cgcaucaagauuuggcaggaucggcuuccucaggggcacagaccucucccacccacaagaacuc

SEQ ID NO: 111479 - RNA, 64 nt, Human
aaacaucacacacugagaaucucuucauaaucuaggcacagauaaucuuuaacacuaaacuacu

SEQ ID NO: 111480 - RNA, 64 nt, Human
guguccugagauaguuuuguaucuuaaagacugaggcacagaagcgaaacgagaacacacuguu

SEQ ID NO: 111481 - RNA, 64 nt, Human
ggcgcuaccaaccuuuuuccuauaucccgaguggggcacagacgguggaucucugcccagugug

SEQ ID NO: 111482 - RNA, 64 nt, Human
cgggaggccccugccuucuguccuccauggugagggcacagaugucuccccagagcccagcgcu

SEQ ID NO: 111483 - RNA, 64 nt, Human
aggcucagagaaggugugaccucuuguugcuugaggcacagaguuauaaaguaacauaucugga

SEQ ID NO: 111484 - RNA, 64 nt, Human
uaacuucuaauauauuaaaucugaagaugugaagggcacagaagugacuuugaauaagaagaau

SEQ ID NO: 111485 - RNA, 64 nt, Human
uggcucaagauuaggaugugggccccacuuuagaggcacagacuaugaaaagcugaguuagugc

SEQ ID NO: 111486 - RNA, 64 nt, Human
gaauucuaccaaagucagccgugguggcugcacuggcacagaauacuaaacugagugugacuau

SEQ ID NO: 111487 - RNA, 64 nt, Human
uugaguuguuuuugggggggagguggggguagggggcacagaacaccagaaagaguguuggugu

SEQ ID NO: 111488 - RNA, 64 nt, Human
gggugggaggcggugcacucacuccugacugcccggcacagaugcuccagggaugauucaagcc

SEQ ID NO: 111489 - RNA, 64 nt, Human
aagucucguccuggucucugcccuggcauggacuggcacagagguguucuguaguugaauagga

SEQ ID NO: 111490 - RNA, 64 nt, Human
uugcuguaguucugauauaauucuacuauuuuguggcacagaaauuugauaucuucagucagua

SEQ ID NO: 111491 - RNA, 64 nt, Human
gcaacugugaaaaacaaguugugccauacuacauggcacagacacaaaauauuauacuaauaug

SEQ ID NO: 111492 - RNA, 64 nt, Human
acaaagcucagcuucuccacaaggcuagaaauggggcacagagccacuggaggccucugacuga

SEQ ID NO: 111493 - RNA, 64 nt, Human
aggauuuaguuuugggauaaaauuuugguccuugggcacagagacauucacuauuaaugaagua

SEQ ID NO: 111494 - RNA, 64 nt, Human
cagaagaguauuaagaaagaugcucaagucccauggcacagagcaaggcgggcagggaacgguu

SEQ ID NO: 111495 - RNA, 64 nt, Human
ccaugaugugaaaccaaugacccugugaccacauggcacagaacacuaaauuuuggucccaugg

SEQ ID NO: 111496 - RNA, 64 nt, Human
uuuguguagcuucagaguuagauugaaauuaccaggcacagauuuagucuugucauuuuguuua

SEQ ID NO: 111497 - RNA, 64 nt, Human
uugucucugagcccccugugcccacccagggcccggcacagagucgaugcucaauaaaugugug

SEQ ID NO: 111498 - RNA, 64 nt, Human
uggugauucaaauggguuuuccacgcuagggcggggcacagauuggagagggcucugugcugac

SEQ ID NO: 111499 - RNA, 64 nt, Human
aagccuaaagacaauucauucauuugcauccaugggcacagaagguugcuauauaguaucuacc

SEQ ID NO: 111500 - RNA, 64 nt, Human
uccaccccccacucagugccuccacaugcugccuggcacagaccaggccuuugacaaauaaaug

SEQ ID NO: 111501 - RNA, 64 nt, Human
cuucagcccgacuggaggaacagcagcucugggaggcacagagugcaggucucaggggcagaag

SEQ ID NO: 111502 - RNA, 64 nt, Human
gaggagaggccucagguuguuauuugguuggggaggcacagagcagagguucaggucucagcag

SEQ ID NO: 111503 - RNA, 64 nt, Human
uccaaaaaaaaccaaaacucaguacacacacacaggcacagaugcacacacacgcagacagaca

SEQ ID NO: 111504 - RNA, 64 nt, Human
gaugugugucccauggcagacaaagcacccuguaggcacagacaagucuggcacuuccuuggac

SEQ ID NO: 111505 - RNA, 64 nt, Human
augccuggaaaguugauguugguuguugucaggggaccuucagucauuaccauguaggccucuu

SEQ ID NO: 111506 - RNA, 64 nt, Human
ccaagaaaagucaaggcccuucaugaccuugcugggcacagaaaacacccucguggaguacacu

SEQ ID NO: 111507 - RNA, 64 nt, Human
ugaagcaccggacucuagaggcgaggccuccaagggcacagaccugagguugcucagaggcugc

SEQ ID NO: 111508 - RNA, 64 nt, Human
ccgugacucugacacauggggcagaggagcuccaggcacagaccaggggaggggauauuuaggg

SEQ ID NO: 111509 - RNA, 64 nt, Human
ccaagagugaagggaagagacagcccaggauacuggcacagagguagucucacugcuugaacua

SEQ ID NO: 111510 - RNA, 64 nt, Human
guauuugaauguccaccagacaccagccccggggggcacagagagaacaacauuccucucuguc

SEQ ID NO: 111511 - RNA, 59 nt, Human
accaggugcccgccuacuagcggcuggcaggcacagaccagggcuccaaggccacccca

SEQ ID NO: 111512 - RNA, 64 nt, Human
aaauaaaguccugaccccagugcacagacauagaggcacagauugcagucagacagcucuuuua

SEQ ID NO: 111513 - RNA, 64 nt, Human
uuuaguuauucaauuuuguggaugaauaaauugaggcacagaaagauuaaguuaccggcccaag

SEQ ID NO: 111514 - RNA, 64 nt, Human
uauauacaggaagggcucuuagaaucaguuugugggcacagagccucaggaguaaaugaaguua

SEQ ID NO: 111515 - RNA, 64 nt, Human
accccgauagugacacaucuucaggcagagcuguggcacagacccccguccugucccccacacc

SEQ ID NO: 111516 - RNA, 64 nt, Human
ggcagucgugggagccccucucagcuguggggcuggcacagagccccaggcaagcuuuuaauaa

SEQ ID NO: 111517 - RNA, 64 nt, Human
aagacuaaguaaaagaauucaaauaaagagacuuggcacagaguaagugcucaguaaaugguua

SEQ ID NO: 111518 - RNA, 64 nt, Human
acuugaccccucucaucccacucccggcggcccaggcacagaagggcagggccauagggaggga

SEQ ID NO: 111519 - RNA, 64 nt, Human
gccuucgccagcccaggcucggcugccacccaguggcacagaaccgaggagcugccauuacccc

SEQ ID NO: 111520 - RNA, 64 nt, Human
gaugccaagggauacugcucaucuguggagcagaggcacagacaacccuucccaucuggcggga

SEQ ID NO: 111521 - RNA, 64 nt, Human
cacugaagagagaaagcagaagguucuagauccuggcacagacugcaucccauguucccaugcu

SEQ ID NO: 111522 - RNA, 64 nt, Human
gcagggagcuggggggacaucucaccucccccauggcacagagcccuccacaccccuggaccag

SEQ ID NO: 111523 - RNA, 64 nt, Human
cuugggggagacaccccaccucccuccuccauggggcacagacccaacacaaggcggggaugcu

SEQ ID NO: 111524 - RNA, 64 nt, Human
gaaugugagagggguguuugcugagcgcuccgggcacggccagagggcaagugagcaugcacgg

SEQ ID NO: 111525 - RNA, 64 nt, Human
gccugaaacucccuuuccaggacucucaucccugggcacagaauucaggaaacugcuagacagc

SEQ ID NO: 111526 - RNA, 64 nt, Human
uuuucuacccucacuagaauguaaacuccaugaaggcacagacuuuucuuguucucuucucuau

SEQ ID NO: 111527 - RNA, 64 nt, Human
gcuguugaggguccgacucccuacuuggacuucuggcacagaaggggcugagugacuccuugag

SEQ ID NO: 111528 - RNA, 64 nt, Human
ccacagcuggcccucuagguuguuugguguugugggcacagaggugacagugucucugcaggca

SEQ ID NO: 111529 - RNA, 64 nt, Human
auguccuggccaggcccugagcucagcuucugcgggcacagacaccagcaugaaaagccuaggc

SEQ ID NO: 111530 - RNA, 64 nt, Human
aucggugcagcgguggaaggagccugcggcugcuggcacagacuucacacagcaccuccucucu

SEQ ID NO: 111531 - RNA, 64 nt, Human
caccuucaaagaguccccgccugcccaggccuuuggcacagaggcugaguggacagucaggaga

SEQ ID NO: 111532 - RNA, 64 nt, Human
aggggcuccuggcagcuacugggugagguuuccuggcacagacucacccuucuuucuggcacca

SEQ ID NO: 111533 - RNA, 64 nt, Human
uaaaaucuuccugacaagguaguccucuuuucauggcacagacaaugggcuuucuguuuaugag

SEQ ID NO: 111534 - RNA, 64 nt, Human
caggcccaugcccuccuggugccccuggcacugaggcacagaucgucaaggcagguacccccuc

SEQ ID NO: 111535 - RNA, 64 nt, Human
aguagcaacugugagaaaucagcaacuugcaggaggcacagaaaacuccugcugauggucucag

SEQ ID NO: 111536 - RNA, 64 nt, Human
ggauggggcuggagaugagcugguuuggccuuggggcacagagcugagcugaggccgcugaagc

SEQ ID NO: 111537 - RNA, 64 nt, Human
uuuuuuaacuuucacauuccuaagcuggcuucccggcacagaagccauggauuuccccucucuc

SEQ ID NO: 111538 - RNA, 64 nt, Human
aggcagcccugccagccaugccuacauccccaugggcacagaacaagccaaagccuucguugua

SEQ ID NO: 111539 - RNA, 64 nt, Human
ucugccccgaauaacuuucaguaguauggcagauggcacagagaaagggaaggggcucugggga

SEQ ID NO: 111540 - RNA, 64 nt, Human
cccacgaggggacccaugggggcugucuuugcagggcacagaugaccaaagucccuuccugcuu

SEQ ID NO: 111541 - RNA, 64 nt, Human
aaggucccugccuggcauccgagugucgguguguggcacagaaggcuccugcuugcuuccaaag

SEQ ID NO: 111542 - RNA, 64 nt, Human
ggacagagcugaggauuuccuggagugcccugcaggcacagaggaggucagcaaaggucuugaa

SEQ ID NO: 111543 - RNA, 64 nt, Human
ugaugcccaacuaauguguuucugguuacuaacagaccuucaucccccacccucccuaaauucu

SEQ ID NO: 111544 - RNA, 64 nt, Human
cccagcuuccuucucuggaaaagccuggaaacugggcacagaaggacugugugccugggucuaa

SEQ ID NO: 111545 - RNA, 64 nt, Human
gcucugagggccuacaggagggguuaaagcugccggcacagaacuuaaggauggagccagcucu

SEQ ID NO: 111546 - RNA, 64 nt, Human
cgcucauacccuguccuuucucccugaccccaagggcacagaggcaaggccuccugucuacagc

SEQ ID NO: 111547 - RNA, 64 nt, Human
gggucacacucucugccugacugaccccugccagggcacagauaggcaggaccccagagagggc

SEQ ID NO: 111548 - RNA, 64 nt, Human
ugugugaccagcggaaacaggugugugugaacugggcacagauugaagaaucugccccuguuga

SEQ ID NO: 111549 - RNA, 64 nt, Human
auccugugcaggggccaccugggagauagcagggggcacagagagagcagggucagcucccucg

SEQ ID NO: 111550 - RNA, 64 nt, Human
cucagcaaucggacaucucuggggaaaggaagguggcacagaccauguucccugguuccucccu

SEQ ID NO: 111551 - RNA, 64 nt, Human
ucugagggagcaagagcuggcaggcggcagggcuggcacagacagacggaagcagaaaggacag

SEQ ID NO: 111552 - RNA, 64 nt, Human
ggugggggccagguucacugggaccagggcuacaggcacagagucuccuggaaaagggagaggg

SEQ ID NO: 111553 - RNA, 64 nt, Human
cuuuggucaguaaugcguucaggaguccacaccaggcacagauggggccuugaaacgcuuuguc

SEQ ID NO: 111554 - RNA, 56 nt, Human
agugcacagaggacaaguagcugccaggcacagaggaaagagcaucaccgugggag

SEQ ID NO: 111555 - RNA, 64 nt, Human
gcuagucccugaagccuuuaaccaaacgggagugggcacagaaagccuucuccuggcaacagga

SEQ ID NO: 111556 - RNA, 64 nt, Human
guggcggggccugggucucucgucccacccggagggcacagacaccggcuugcuuggcaggcug

SEQ ID NO: 111557 - RNA, 64 nt, Human
ugggauaucuggaucaguaauaaaauauuucaaaggcacagauguuggaaaugguuuaaggucc

SEQ ID NO: 111558 - RNA, 64 nt, Human
cacaagaaagggaggguacgccaggcgagcccagggcacagaugcugagacagccucuccuucu

SEQ ID NO: 111559 - RNA, 64 nt, Human
gugcagggacgucaccccugccaggcaagcccagggcacagaugccaggauggcuucucccucu

SEQ ID NO: 111560 - RNA, 64 nt, Human
gugcagggacgucaccccugccaggcaagcccagggcacagaggccgggacggccucucccucu

SEQ ID NO: 111561 - RNA, 64 nt, Human
agugugaggcuucacccaugcuaggcaagcccagggcacagaugccgggauggccccucccucu

SEQ ID NO: 111562 - RNA, 64 nt, Human
gugcgggaacgucaccccugccaggcaagcccagggcacagaugcugcgauggccucuuccucu

SEQ ID NO: 111563 - RNA, 64 nt, Human
ugccuuuguggcaacugaagauggaagucuggggggcacagacaaccuuaucaaacaauauaaa

SEQ ID NO: 111564 - RNA, 64 nt, Human
cauuuucgaucaugggcuacaugccgagugcuggggcacagagaugaacaagaucgguuccuuc

SEQ ID NO: 111565 - RNA, 64 nt, Human
cucuuuuuuuuuuuuuuuaaauagugcuaguuugggcacagaguaauuuauauucccuuugguu

SEQ ID NO: 111566 - RNA, 64 nt, Human
acuccuuguaaauucagugcccgacagaugcucuggcacagaugcuuuguagaucucuguugag

SEQ ID NO: 111567 - RNA, 64 nt, Human
guaauuuuuaucaaguaagggcuccuuuccugguggcacagaugacuucagcaguuagaaguuu

SEQ ID NO: 111568 - RNA, 64 nt, Human
augagggacugugccaugaggaauggugcacuccggcacagauacuacgcuuuucccauggucu

SEQ ID NO: 111569 - RNA, 64 nt, Human
ccaaugaguuaggccaugaaccugacucauuuuuggcacagaggacucuucugauaacuugaaa

SEQ ID NO: 111570 - RNA, 64 nt, Human
cgggcccauucccucuaugucaagaguaaauagaggcacagagacugaugagaaacguucauaa

SEQ ID NO: 111571 - RNA, 64 nt, Human
ucccgagcggccaaucgcauuugaguccuuauuuggcacagagacggaagcacgugugugccgu

SEQ ID NO: 111572 - RNA, 64 nt, Human
aauaggagugcuccccagaaccagaggaggguggggcacagaccauagacggaccccucguccu

SEQ ID NO: 111573 - RNA, 64 nt, Human
cggccucuccccuccuaccugccaccgcuggggaggcacagagcucgccagcgucccuggaguc

SEQ ID NO: 111574 - RNA, 64 nt, Human
ugccggagccagguagccccggccugggucaucaggcacagaggcaccgcaacaccaccugcgg

SEQ ID NO: 111575 - RNA, 64 nt, Human
cagcugaugaacuguggugccacaugacccuuguggcacagaugcccacguaugugaaacacac

SEQ ID NO: 111576 - RNA, 64 nt, Human
uucaccuauagccaaucuugcaugagauuucaaaggcacagaaaaggaaggcaucagucacaua

SEQ ID NO: 111577 - RNA, 64 nt, Human
aacgcuaugaauugaauugucuguucuaggacugggcacagauuuucccauuaaaauuuuugac

SEQ ID NO: 111578 - RNA, 64 nt, Human
auggugaacucugccuuauguaauguggaugcugggcacagagcugccaucuuugaccaauucc

SEQ ID NO: 111579 - RNA, 64 nt, Human
gaggccuuggccugugacagcccccaggccugggggcacagauccccccagcaaggauaacauu

SEQ ID NO: 111580 - RNA, 64 nt, Human
agugcggccacaagccggugccagcaugagagcaggcacagaaggaccagugaggaagucaggg

SEQ ID NO: 111581 - RNA, 64 nt, Human
gagagaggcuucaaucggcuugugggugauguuugaccuucagagccagccggcuaugaaaggg

SEQ ID NO: 111582 - RNA, 64 nt, Human
guuacacuggaacaccuucuucuuuuugucaaucggcacagaccacuguaaggaaaugcagugu

SEQ ID NO: 111583 - RNA, 59 nt, Human
ugcugccgccagcacaaugaaccccgaguggcacagaauccccaguuuuccccucucau

SEQ ID NO: 111584 - RNA, 64 nt, Human
ggggccccguuggaagacugagugcccggggcacggcacagaagccgcgcccaccgccugccag

SEQ ID NO: 111585 - RNA, 64 nt, Human
ccuugcugugucaccaucacuacucaagaccggaggcacagagggcaggagcacagaccccuua

SEQ ID NO: 111586 - RNA, 64 nt, Human
ggugagugaggagaugcuugccgugaugacgcugggcacagagggucagguccugucaagagga

SEQ ID NO: 111587 - RNA, 64 nt, Human
uaaugccaaauaaauacugguuaaauaaauguauggcacagaauauaauuugacuaucaagacu

SEQ ID NO: 111588 - RNA, 64 nt, Human
acaaccguaugagcgcauuggcuugucugccgcaggcacagaaggguagaaagccacagcaggg

SEQ ID NO: 111589 - RNA, 64 nt, Human
gguaacaguucccauuuuagagaugaagaacugaggcacagauuaaaggacuugccuguguuga

SEQ ID NO: 111590 - RNA, 64 nt, Human
guccaggcaccgcuggccggcagcccugggcugaggcacagacucauuugucaccuucuggcgg

SEQ ID NO: 111591 - RNA, 64 nt, Human
ggacaguugaugggcacauggccuuguagcucugggcacagauguguuuggauucauugcagcg

SEQ ID NO: 111592 - RNA, 64 nt, Human
gucagaggugggcccuccccuggaccuagagagaggcacagauguucugggggcugcccugagc

SEQ ID NO: 111593 - RNA, 64 nt, Human
uguuggggagcaucaguaaaagaauggacacucaggcacagaguggcccucaggaaggaggucu

SEQ ID NO: 111594 - RNA, 64 nt, Human
ggccacagcaccccugaggucuggccaggccccaggcacagagcugccugcucccucccggggc

SEQ ID NO: 111595 - RNA, 64 nt, Human
ugagugcuggugauuaccauucucaagcucucugggcacagagaccugcugucaaccccccuca

SEQ ID NO: 111596 - RNA, 64 nt, Human
ccagagugccaagccacaaguaccaggcuucgugggcacagacaccuccugggcugggcagagu

SEQ ID NO: 111597 - RNA, 64 nt, Human
uucauuagauaaguguugucuaccuagucuaggaggcacagaauucucauucuguuauccaguu

SEQ ID NO: 111598 - RNA, 64 nt, Human
gaaggagcagggcucuggagggauucgcauucaaggcacagaauuggccccuugccuguuuguu

SEQ ID NO: 111599 - RNA, 64 nt, Human
gggaccaaaggaaaggaggaggugccgggggccuggcacagaccccuaggugccucgcuccaug

SEQ ID NO: 111600 - RNA, 64 nt, Human
ugucuguacgcagcauguugggaucgggaguuucggcacagacuaucccaucaagccguuggcu

SEQ ID NO: 111601 - RNA, 64 nt, Human
ugauucuuauuuucuuggacacagacuauucugaggcacagagcggggacuuaagaugggaaag

SEQ ID NO: 111602 - RNA, 64 nt, Human
gcuugcgggaggcgguggggcaugggaggaaggaggcacagaccggggaaauaugacagccguc

SEQ ID NO: 111603 - RNA, 64 nt, Human
uucggagucgcagggagcucugucuggcaucgguggcacagauggugaacuuguuucaggaagu

SEQ ID NO: 111604 - RNA, 64 nt, Human
aacugccuggccuggcaccguuaucccugcacacggcacagagcauccgucuccccucguuaac

SEQ ID NO: 111605 - RNA, 64 nt, Human
uugacugaagccuucaacaucaucuugggagagaggcacagaccugucuccugggugcauccuu

SEQ ID NO: 111606 - RNA, 64 nt, Human
uuuaauaacuagggacaccuguguccacagcuguggcacagacucccacuaaagaaguaggggu

SEQ ID NO: 111607 - RNA, 64 nt, Human
cggugugaacuacuuugcaauccggaauaaaaagggcacagagcugcugcuuggaguggaugcc

SEQ ID NO: 111608 - RNA, 64 nt, Human
ugauuucugaagacgcuuccauggugggcacugaggcacagaggaggccaaggagagguuguuu

SEQ ID NO: 111609 - RNA, 64 nt, Human
acuaagcccuuaccuagggcuggguggacaacaaggcacagaugagggugugacuggcccgagg

SEQ ID NO: 111610 - RNA, 64 nt, Human
ccugagacacgacgccugccccaggggacugucaggcacagaagcggccuccucccgugcccca

SEQ ID NO: 111611 - RNA, 64 nt, Human
ggaaccaacaaucuuccuguuuaaaaaaccacauggcacagagauucugaacuaaagugcugca

SEQ ID NO: 111612 - RNA, 64 nt, Human
gcuggccaggauauucagagguaggcagccaaagggcacagaacccugugccccaccaggauug

SEQ ID NO: 111613 - RNA, 64 nt, Human
gagggagcccucguccaccccugcacagcagcugggcacagaggagcgcucuuccaucuugacc

SEQ ID NO: 111614 - RNA, 64 nt, Human
gugaguauuccuguuuaacacuugaguaaacugaggcacagagaacauaaguugcaugccauag

SEQ ID NO: 111615 - RNA, 64 nt, Human
aacgcuccugcugcacagggugaggugccuccuuggcacagacuguggaugccucucccccagc

SEQ ID NO: 111616 - RNA, 64 nt, Human
aaggagcaggcccugggccuccaccucugugcagggcacagaaggcugggguggggggaggagu

SEQ ID NO: 111617 - RNA, 64 nt, Human
gcugcuguaucuuuaaugcuggggcccaaguaagggcacagauccccccacaaaguggaugccu

SEQ ID NO: 111618 - RNA, 64 nt, Human
augcccccucccuuucugaaggcaggaaggaguuggcacagaggcccccugauccaauucugug

SEQ ID NO: 111619 - RNA, 64 nt, Human
aucuuacagaaguugaggccaagggagaaugguaggcacagaagaaacauggcaaacugcucug

SEQ ID NO: 111620 - RNA, 64 nt, Human
guucuuggcuccguuagacaggugaggaaacuggggcacagagaggugaugucaucugccuggu

SEQ ID NO: 111621 - RNA, 64 nt, Human
cuauagccccuaugauuagacacuucagugucagggcacagauuaucuaaaauuagccagcucu

SEQ ID NO: 111622 - RNA, 64 nt, Human
ccugcagggaagggaaagcuggugguagaggcugggcacagacugacguccagaagaagucccu

SEQ ID NO: 111623 - RNA, 64 nt, Human
uuuuuauacaccuguucauuucuacuuaaauuauggcacagauugaugcgcaccagucuugagg

SEQ ID NO: 111624 - RNA, 64 nt, Human
gggcccagaggcuggccagaguucaggaacgccgggcacagaccaaagaccgcgguccagcccc

SEQ ID NO: 111625 - RNA, 64 nt, Human
ucccaucauugggcaccucugggaguuuguccugggcacagacagcuuccaccugggcuacacg

SEQ ID NO: 111626 - RNA, 64 nt, Human
agggauuauaaucaaaauuuuuaacaugugguaaggcacagacacugaccagaacucaggccuu

SEQ ID NO: 111627 - RNA, 51 nt, Human
uggcuccgcucagcucaugagggcacagagcauggccuccagaggaggggu

SEQ ID NO: 111628 - RNA, 64 nt, Human
ucacccagccuuggcccugcagggaauguuggggggcacagaggggagaagcucuuucccccac

SEQ ID NO: 111629 - RNA, 64 nt, Human
uuagauccaaaacagccucucucaugucuaaaaaggcacagaauuuugcagaucugaggaagag

SEQ ID NO: 111630 - RNA, 64 nt, Human
ccugccucagcucggcgccugccagggggugacuggcacagagcgggccguaggggacccccuc

SEQ ID NO: 111631 - RNA, 64 nt, Human
ccuuugucuuggaaccaccagucuaguccguccuggcacagaagaggagucaaguaauggaggu

SEQ ID NO: 111632 - RNA, 64 nt, Human
ugcagaggcccugaaugcacaaaugggaaaccaaggcacagagaggcucuccucuccucuccuc

SEQ ID NO: 111633 - RNA, 64 nt, Human
uaaauuuacuaaacuuggccuaaaaucaaaccuuggcacagagguaugauacaacuuuaacagg

SEQ ID NO: 111634 - RNA, 64 nt, Human; identical to SEQ ID NO: 111259

SEQ ID NO: 111635 - RNA, 64 nt, Human; identical to SEQ ID NO: 111260

SEQ ID NO: 111636 - RNA, 64 nt, Human; identical to SEQ ID NO: 111261

SEQ ID NO: 111637 - RNA, 64 nt, Human
acauaaaagauaaucuugaccugaguagagaagagaccuucaggugcuuuuguggcuaaaaaga

SEQ ID NO: 111638 - RNA, 64 nt, Human; identical to SEQ ID NO: 111262

SEQ ID NO: 111639 - RNA, 64 nt, Human; identical to SEQ ID NO: 111263

SEQ ID NO: 111640 - RNA, 64 nt, Human; identical to SEQ ID NO: 111264

SEQ ID NO: 111641 - RNA, 64 nt, Human; identical to SEQ ID NO: 111265

SEQ ID NO: 111642 - RNA, 64 nt, Human; identical to SEQ ID NO: 111266

SEQ ID NO: 111643 - RNA, 64 nt, Human; identical to SEQ ID NO: 111267

SEQ ID NO: 111644 - RNA, 64 nt, Human; identical to SEQ ID NO: 111268

SEQ ID NO: 111645 - RNA, 64 nt, Human; identical to SEQ ID NO: 111269

SEQ ID NO: 111646 - RNA, 64 nt, Human; identical to SEQ ID NO: 111270

SEQ ID NO: 111647 - RNA, 64 nt, Human; identical to SEQ ID NO: 111271

SEQ ID NO: 111648 - RNA, 64 nt, Human; identical to SEQ ID NO: 111272

SEQ ID NO: 111649 - RNA, 64 nt, Human; identical to SEQ ID NO: 111273

SEQ ID NO: 111650 - RNA, 64 nt, Human; identical to SEQ ID NO: 111274

SEQ ID NO: 111651 - RNA, 64 nt, Human; identical to SEQ ID NO: 111275

SEQ ID NO: 111652 - RNA, 64 nt, Human; identical to SEQ ID NO: 111276

SEQ ID NO: 111653 - RNA, 64 nt, Human; identical to SEQ ID NO: 111277

SEQ ID NO: 111654 - RNA, 64 nt, Human; identical to SEQ ID NO: 111278

SEQ ID NO: 111655 - RNA, 64 nt, Human; identical to SEQ ID NO: 111279

SEQ ID NO: 111656 - RNA, 64 nt, Human; identical to SEQ ID NO: 111280

SEQ ID NO: 111657 - RNA, 64 nt, Human; identical to SEQ ID NO: 111281

SEQ ID NO: 111658 - RNA, 64 nt, Human; identical to SEQ ID NO: 111282

SEQ ID NO: 111659 - RNA, 64 nt, Human; identical to SEQ ID NO: 111283

SEQ ID NO: 111660 - RNA, 64 nt, Human; identical to SEQ ID NO: 111284

SEQ ID NO: 111661 - RNA, 64 nt, Human; identical to SEQ ID NO: 111285

SEQ ID NO: 111662 - RNA, 64 nt, Human; identical to SEQ ID NO: 111286

SEQ ID NO: 111663 - RNA, 64 nt, Human; identical to SEQ ID NO: 111287

SEQ ID NO: 111664 - RNA, 64 nt, Human; identical to SEQ ID NO: 111288

SEQ ID NO: 111665 - RNA, 64 nt, Human; identical to SEQ ID NO: 111289

SEQ ID NO: 111666 - RNA, 64 nt, Human; identical to SEQ ID NO: 111290

SEQ ID NO: 111667 - RNA, 64 nt, Human; identical to SEQ ID NO: 111291

SEQ ID NO: 111668 - RNA, 64 nt, Human; identical to SEQ ID NO: 111292

SEQ ID NO: 111669 - RNA, 64 nt, Human; identical to SEQ ID NO: 111293

SEQ ID NO: 111670 - RNA, 64 nt, Human; identical to SEQ ID NO: 111294

SEQ ID NO: 111671 - RNA, 64 nt, Human; identical to SEQ ID NO: 111295

SEQ ID NO: 111672 - RNA, 64 nt, Human; identical to SEQ ID NO: 111296

SEQ ID NO: 111673 - RNA, 64 nt, Human; identical to SEQ ID NO: 111297

SEQ ID NO: 111674 - RNA, 64 nt, Human; identical to SEQ ID NO: 111298

SEQ ID NO: 111675 - RNA, 64 nt, Human; identical to SEQ ID NO: 111299

SEQ ID NO: 111676 - RNA, 64 nt, Human; identical to SEQ ID NO: 111300

SEQ ID NO: 111677 - RNA, 64 nt, Human; identical to SEQ ID NO: 111301

SEQ ID NO: 111678 - RNA, 64 nt, Human; identical to SEQ ID NO: 111302

SEQ ID NO: 111679 - RNA, 64 nt, Human; identical to SEQ ID NO: 111303

SEQ ID NO: 111680 - RNA, 64 nt, Human; identical to SEQ ID NO: 111304

SEQ ID NO: 111681 - RNA, 64 nt, Human; identical to SEQ ID NO: 111305

SEQ ID NO: 111682 - RNA, 64 nt, Human; identical to SEQ ID NO: 111306

SEQ ID NO: 111683 - RNA, 64 nt, Human; identical to SEQ ID NO: 111307

SEQ ID NO: 111684 - RNA, 64 nt, Human; identical to SEQ ID NO: 111308

SEQ ID NO: 111685 - RNA, 64 nt, Human; identical to SEQ ID NO: 111309

SEQ ID NO: 111686 - RNA, 64 nt, Human; identical to SEQ ID NO: 111310

SEQ ID NO: 111687 - RNA, 64 nt, Human; identical to SEQ ID NO: 111311

SEQ ID NO: 111688 - RNA, 64 nt, Human; identical to SEQ ID NO: 111312

SEQ ID NO: 111689 - RNA, 64 nt, Human; identical to SEQ ID NO: 111313

SEQ ID NO: 111690 - RNA, 64 nt, Human
ccaaauuaaaaguuuucuuucuccaaccugagggcacggccaaaaagaucugguuauuuuuuag

SEQ ID NO: 111691 - RNA, 64 nt, Human; identical to SEQ ID NO: 111314

SEQ ID NO: 111692 - RNA, 64 nt, Human; identical to SEQ ID NO: 111316

SEQ ID NO: 111693 - RNA, 64 nt, Human; identical to SEQ ID NO: 111317

SEQ ID NO: 111694 - RNA, 64 nt, Human; identical to SEQ ID NO: 111318

SEQ ID NO: 111695 - RNA, 64 nt, Human; identical to SEQ ID NO: 111319

SEQ ID NO: 111696 - RNA, 64 nt, Human; identical to SEQ ID NO: 111320

SEQ ID NO: 111697 - RNA, 64 nt, Human; identical to SEQ ID NO: 111321

SEQ ID NO: 111698 - RNA, 64 nt, Human; identical to SEQ ID NO: 111322

SEQ ID NO: 111699 - RNA, 64 nt, Human; identical to SEQ ID NO: 111323

SEQ ID NO: 111700 - RNA, 64 nt, Human; identical to SEQ ID NO: 111324

SEQ ID NO: 111701 - RNA, 64 nt, Human; identical to SEQ ID NO: 111325

SEQ ID NO: 111702 - RNA, 64 nt, Human; identical to SEQ ID NO: 111326

SEQ ID NO: 111703 - RNA, 64 nt, Human; identical to SEQ ID NO: 111327

SEQ ID NO: 111704 - RNA, 64 nt, Human; identical to SEQ ID NO: 111328

SEQ ID NO: 111705 - RNA, 64 nt, Human; identical to SEQ ID NO: 111329

SEQ ID NO: 111706 - RNA, 64 nt, Human; identical to SEQ ID NO: 111330

SEQ ID NO: 111707 - RNA, 64 nt, Human; identical to SEQ ID NO: 111331

SEQ ID NO: 111708 - RNA, 64 nt, Human; identical to SEQ ID NO: 111332

SEQ ID NO: 111709 - RNA, 64 nt, Human
uacagaaaagcauuacgcugagucuuaccagugugaccuucagcaaguugcugaaucuguuugg

SEQ ID NO: 111710 - RNA, 64 nt, Human; identical to SEQ ID NO: 111333

SEQ ID NO: 111711 - RNA, 64 nt, Human; identical to SEQ ID NO: 111335

SEQ ID NO: 111712 - RNA, 64 nt, Human; identical to SEQ ID NO: 111336

SEQ ID NO: 111713 - RNA, 64 nt, Human; identical to SEQ ID NO: 111337

SEQ ID NO: 111714 - RNA, 64 nt, Human; identical to SEQ ID NO: 111338

SEQ ID NO: 111715 - RNA, 64 nt, Human; identical to SEQ ID NO: 111339

SEQ ID NO: 111716 - RNA, 64 nt, Human; identical to SEQ ID NO: 111340

SEQ ID NO: 111717 - RNA, 64 nt, Human; identical to SEQ ID NO: 111341

SEQ ID NO: 111718 - RNA, 64 nt, Human; identical to SEQ ID NO: 111342

SEQ ID NO: 111719 - RNA, 64 nt, Human; identical to SEQ ID NO: 111343

SEQ ID NO: 111720 - RNA, 64 nt, Human; identical to SEQ ID NO: 111344

SEQ ID NO: 111721 - RNA, 64 nt, Human; identical to SEQ ID NO: 111345

SEQ ID NO: 111722 - RNA, 64 nt, Human; identical to SEQ ID NO: 111346

SEQ ID NO: 111723 - RNA, 64 nt, Human; identical to SEQ ID NO: 111347

SEQ ID NO: 111724 - RNA, 64 nt, Human; identical to SEQ ID NO: 111348

SEQ ID NO: 111725 - RNA, 56 nt, Human; identical to SEQ ID NO: 111349

SEQ ID NO: 111726 - RNA, 64 nt, Human; identical to SEQ ID NO: 111350

SEQ ID NO: 111727 - RNA, 54 nt, Human; identical to SEQ ID NO: 111351

SEQ ID NO: 111728 - RNA, 64 nt, Human; identical to SEQ ID NO: 111352

SEQ ID NO: 111729 - RNA, 64 nt, Human; identical to SEQ ID NO: 111353

SEQ ID NO: 111730 - RNA, 64 nt, Human; identical to SEQ ID NO: 111354

SEQ ID NO: 111731 - RNA, 64 nt, Human; identical to SEQ ID NO: 111355

SEQ ID NO: 111732 - RNA, 64 nt, Human; identical to SEQ ID NO: 111356

SEQ ID NO: 111733 - RNA, 64 nt, Human; identical to SEQ ID NO: 111357

SEQ ID NO: 111734 - RNA, 64 nt, Human; identical to SEQ ID NO: 111358

SEQ ID NO: 111735 - RNA, 64 nt, Human; identical to SEQ ID NO: 111359

SEQ ID NO: 111736 - RNA, 64 nt, Human; identical to SEQ ID NO: 111360

SEQ ID NO: 111737 - RNA, 64 nt, Human; identical to SEQ ID NO: 111361

SEQ ID NO: 111738 - RNA, 64 nt, Human; identical to SEQ ID NO: 111362

SEQ ID NO: 111739 - RNA, 64 nt, Human; identical to SEQ ID NO: 111363

SEQ ID NO: 111740 - RNA, 64 nt, Human; identical to SEQ ID NO: 111364

SEQ ID NO: 111741 - RNA, 64 nt, Human; identical to SEQ ID NO: 111365

SEQ ID NO: 111742 - RNA, 64 nt, Human; identical to SEQ ID NO: 111366

SEQ ID NO: 111743 - RNA, 64 nt, Human; identical to SEQ ID NO: 111367

SEQ ID NO: 111744 - RNA, 64 nt, Human; identical to SEQ ID NO: 111368

SEQ ID NO: 111745 - RNA, 64 nt, Human; identical to SEQ ID NO: 111369

SEQ ID NO: 111746 - RNA, 64 nt, Human; identical to SEQ ID NO: 111370

SEQ ID NO: 111747 - RNA, 64 nt, Human
cccgcccuacugucucuuccuguuuguucccucggaccuucagcugcuucuucacuguugaaac

SEQ ID NO: 111748 - RNA, 64 nt, Human; identical to SEQ ID NO: 111371

SEQ ID NO: 111749 - RNA, 64 nt, Human; identical to SEQ ID NO: 111373

SEQ ID NO: 111750 - RNA, 64 nt, Human; identical to SEQ ID NO: 111374

SEQ ID NO: 111751 - RNA, 64 nt, Human; identical to SEQ ID NO: 111375

SEQ ID NO: 111752 - RNA, 64 nt, Human; identical to SEQ ID NO: 111376

SEQ ID NO: 111753 - RNA, 64 nt, Human; identical to SEQ ID NO: 111377

SEQ ID NO: 111754 - RNA, 64 nt, Human; identical to SEQ ID NO: 111378

SEQ ID NO: 111755 - RNA, 64 nt, Human; identical to SEQ ID NO: 111379

SEQ ID NO: 111756 - RNA, 64 nt, Human; identical to SEQ ID NO: 111380

SEQ ID NO: 111757 - RNA, 64 nt, Human; identical to SEQ ID NO: 111381

SEQ ID NO: 111758 - RNA, 64 nt, Human; identical to SEQ ID NO: 111382

SEQ ID NO: 111759 - RNA, 64 nt, Human; identical to SEQ ID NO: 111383

SEQ ID NO: 111760 - RNA, 64 nt, Human; identical to SEQ ID NO: 111384

SEQ ID NO: 111761 - RNA, 64 nt, Human; identical to SEQ ID NO: 111385

SEQ ID NO: 111762 - RNA, 64 nt, Human; identical to SEQ ID NO: 111386

SEQ ID NO: 111763 - RNA, 64 nt, Human; identical to SEQ ID NO: 111387

SEQ ID NO: 111764 - RNA, 64 nt, Human; identical to SEQ ID NO: 111388

SEQ ID NO: 111765 - RNA, 64 nt, Human; identical to SEQ ID NO: 111389

SEQ ID NO: 111766 - RNA, 64 nt, Human
caggccauaguuucagagaaucacccuuaccccagaccuucaugagacagugcucaugaagcca

SEQ ID NO: 111767 - RNA, 64 nt, Human; identical to SEQ ID NO: 111390

SEQ ID NO: 111768 - RNA, 64 nt, Human; identical to SEQ ID NO: 111392

SEQ ID NO: 111769 - RNA, 64 nt, Human; identical to SEQ ID NO: 111393

SEQ ID NO: 111770 - RNA, 64 nt, Human; identical to SEQ ID NO: 111394

SEQ ID NO: 111771 - RNA, 64 nt, Human; identical to SEQ ID NO: 111395

SEQ ID NO: 111772 - RNA, 64 nt, Human; identical to SEQ ID NO: 111396

SEQ ID NO: 111773 - RNA, 64 nt, Human; identical to SEQ ID NO: 111397

SEQ ID NO: 111774 - RNA, 64 nt, Human; identical to SEQ ID NO: 111398

SEQ ID NO: 111775 - RNA, 64 nt, Human; identical to SEQ ID NO: 111399

SEQ ID NO: 111776 - RNA, 64 nt, Human; identical to SEQ ID NO: 111400

SEQ ID NO: 111777 - RNA, 64 nt, Human; identical to SEQ ID NO: 111401

SEQ ID NO: 111778 - RNA, 64 nt, Human; identical to SEQ ID NO: 111402

SEQ ID NO: 111779 - RNA, 64 nt, Human; identical to SEQ ID NO: 111403

SEQ ID NO: 111780 - RNA, 64 nt, Human; identical to SEQ ID NO: 111404

SEQ ID NO: 111781 - RNA, 64 nt, Human; identical to SEQ ID NO: 111405

SEQ ID NO: 111782 - RNA, 64 nt, Human; identical to SEQ ID NO: 111406

SEQ ID NO: 111783 - RNA, 64 nt, Human; identical to SEQ ID NO: 111407

SEQ ID NO: 111784 - RNA, 64 nt, Human; identical to SEQ ID NO: 111408

SEQ ID NO: 111785 - RNA, 64 nt, Human
ugggugugaauaggaauacuguuuaaugaaacuccacggccauaacaauauuuaacuuuaaaag

SEQ ID NO: 111786 - RNA, 64 nt, Human; identical to SEQ ID NO: 111409

SEQ ID NO: 111787 - RNA, 64 nt, Human; identical to SEQ ID NO: 111411

SEQ ID NO: 111788 - RNA, 64 nt, Human; identical to SEQ ID NO: 111412

SEQ ID NO: 111789 - RNA, 64 nt, Human; identical to SEQ ID NO: 111413

SEQ ID NO: 111790 - RNA, 64 nt, Human; identical to SEQ ID NO: 111414

SEQ ID NO: 111791 - RNA, 64 nt, Human; identical to SEQ ID NO: 111415

SEQ ID NO: 111792 - RNA, 64 nt, Human; identical to SEQ ID NO: 111416

SEQ ID NO: 111793 - RNA, 64 nt, Human; identical to SEQ ID NO: 111417

SEQ ID NO: 111794 - RNA, 64 nt, Human; identical to SEQ ID NO: 111418

SEQ ID NO: 111795 - RNA, 64 nt, Human; identical to SEQ ID NO: 111419

SEQ ID NO: 111796 - RNA, 64 nt, Human; identical to SEQ ID NO: 111420

SEQ ID NO: 111797 - RNA, 64 nt, Human; identical to SEQ ID NO: 111421

SEQ ID NO: 111798 - RNA, 64 nt, Human; identical to SEQ ID NO: 111422

SEQ ID NO: 111799 - RNA, 64 nt, Human; identical to SEQ ID NO: 111423

SEQ ID NO: 111800 - RNA, 64 nt, Human; identical to SEQ ID NO: 111424

SEQ ID NO: 111801 - RNA, 64 nt, Human; identical to SEQ ID NO: 111425

SEQ ID NO: 111802 - RNA, 64 nt, Human; identical to SEQ ID NO: 111426

SEQ ID NO: 111803 - RNA, 64 nt, Human; identical to SEQ ID NO: 111427

SEQ ID NO: 111804 - RNA, 64 nt, Human
uuguauaaaaaaauaaugcuguuaaacaggaguugaccuucauuuaguugauguaauacauagc

SEQ ID NO: 111805 - RNA, 64 nt, Human; identical to SEQ ID NO: 111428

SEQ ID NO: 111806 - RNA, 64 nt, Human; identical to SEQ ID NO: 111430

SEQ ID NO: 111807 - RNA, 64 nt, Human; identical to SEQ ID NO: 111431

SEQ ID NO: 111808 - RNA, 64 nt, Human; identical to SEQ ID NO: 111423

SEQ ID NO: 111809 - RNA, 64 nt, Human; identical to SEQ ID NO: 111433

SEQ ID NO: 111810 - RNA, 64 nt, Human; identical to SEQ ID NO: 111434

SEQ ID NO: 111811 - RNA, 64 nt, Human; identical to SEQ ID NO: 111435

SEQ ID NO: 111812 - RNA, 64 nt, Human; identical to SEQ ID NO: 111436

SEQ ID NO: 111813 - RNA, 64 nt, Human; identical to SEQ ID NO: 111437

SEQ ID NO: 111814 - RNA, 50 nt, Human; identical to SEQ ID NO: 111438

SEQ ID NO: 111815 - RNA, 64 nt, Human; identical to SEQ ID NO: 111439

SEQ ID NO: 111816 - RNA, 64 nt, Human; identical to SEQ ID NO: 111440

SEQ ID NO: 111817 - RNA, 64 nt, Human; identical to SEQ ID NO: 111441

SEQ ID NO: 111818 - RNA, 64 nt, Human; identical to SEQ ID NO: 111442

SEQ ID NO: 111819 - RNA, 64 nt, Human; identical to SEQ ID NO: 111443

SEQ ID NO: 111820 - RNA, 64 nt, Human; identical to SEQ ID NO: 111444

SEQ ID NO: 111821 - RNA, 64 nt, Human; identical to SEQ ID NO: 111445

SEQ ID NO: 111822 - RNA, 64 nt, Human; identical to SEQ ID NO: 111446

SEQ ID NO: 111823 - RNA, 64 nt, Human; identical to SEQ ID NO: 111447

SEQ ID NO: 111824 - RNA, 64 nt, Human; identical to SEQ ID NO: 111448

SEQ ID NO: 111825 - RNA, 64 nt, Human; identical to SEQ ID NO: 111449

SEQ ID NO: 111826 - RNA, 64 nt, Human; identical to SEQ ID NO: 111450

SEQ ID NO: 111827 - RNA, 64 nt, Human; identical to SEQ ID NO: 111451

SEQ ID NO: 111828 - RNA, 64 nt, Human; identical to SEQ ID NO: 111452

SEQ ID NO: 111829 - RNA, 64 nt, Human; identical to SEQ ID NO: 111453

SEQ ID NO: 111830 - RNA, 64 nt, Human; identical to SEQ ID NO: 111454

SEQ ID NO: 111831 - RNA, 64 nt, Human; identical to SEQ ID NO: 111455

SEQ ID NO: 111832 - RNA, 64 nt, Human; identical to SEQ ID NO: 111456

SEQ ID NO: 111833 - RNA, 64 nt, Human; identical to SEQ ID NO: 111457

SEQ ID NO: 111834 - RNA, 61 nt, Human; identical to SEQ ID NO: 111458

SEQ ID NO: 111835 - RNA, 64 nt, Human; identical to SEQ ID NO: 111459

SEQ ID NO: 111836 - RNA, 64 nt, Human; identical to SEQ ID NO: 111460

SEQ ID NO: 111837 - RNA, 64 nt, Human; identical to SEQ ID NO: 111461

SEQ ID NO: 111838 - RNA, 64 nt, Human; identical to SEQ ID NO: 111462

SEQ ID NO: 111839 - RNA, 64 nt, Human; identical to SEQ ID NO: 111463

SEQ ID NO: 111840 - RNA, 64 nt, Human; identical to SEQ ID NO: 111464

SEQ ID NO: 111841 - RNA, 64 nt, Human; identical to SEQ ID NO: 111465

SEQ ID NO: 111842 - RNA, 64 nt, Human
ucugacaaggcuucuaaagagcaaccaccccgaggaccuucaggcugcaaaccgguuaaucaag

SEQ ID NO: 111843 - RNA, 64 nt, Human; identical to SEQ ID NO: 111466

SEQ ID NO: 111844 - RNA, 64 nt, Human; identical to SEQ ID NO: 111468

SEQ ID NO: 111845 - RNA, 64 nt, Human; identical to SEQ ID NO: 111469

SEQ ID NO: 111846 - RNA, 64 nt, Human; identical to SEQ ID NO: 111470

SEQ ID NO: 111847 - RNA, 64 nt, Human; identical to SEQ ID NO: 111471

SEQ ID NO: 111848 - RNA, 64 nt, Human; identical to SEQ ID NO: 111472

SEQ ID NO: 111849 - RNA, 64 nt, Human; identical to SEQ ID NO: 111473

SEQ ID NO: 111850 - RNA, 64 nt, Human; identical to SEQ ID NO: 111474

SEQ ID NO: 111851 - RNA, 64 nt, Human; identical to SEQ ID NO: 111475

SEQ ID NO: 111852 - RNA, 64 nt, Human; identical to SEQ ID NO: 111476

SEQ ID NO: 111853 - RNA, 64 nt, Human; identical to SEQ ID NO: 111477

SEQ ID NO: 111854 - RNA, 64 nt, Human; identical to SEQ ID NO: 111478

SEQ ID NO: 111855 - RNA, 64 nt, Human; identical to SEQ ID NO: 111479

SEQ ID NO: 111856 - RNA, 64 nt, Human; identical to SEQ ID NO: 111480

SEQ ID NO: 111857 - RNA, 64 nt, Human; identical to SEQ ID NO: 111481

SEQ ID NO: 111858 - RNA, 64 nt, Human; identical to SEQ ID NO: 111482

SEQ ID NO: 111859 - RNA, 64 nt, Human; identical to SEQ ID NO: 111483

SEQ ID NO: 111860 - RNA, 64 nt, Human; identical to SEQ ID NO: 111484

SEQ ID NO: 111861 - RNA, 64 nt, Human
cucucuggguuuccuaggaauguccagccucggagaccuucacaaagccuugggagggugauga

SEQ ID NO: 111862 - RNA, 64 nt, Human; identical to SEQ ID NO: 111485

SEQ ID NO: 111863 - RNA, 64 nt, Human; identical to SEQ ID NO: 111486

SEQ ID NO: 111864 - RNA, 64 nt, Human; identical to SEQ ID NO: 111487

SEQ ID NO: 111865 - RNA, 64 nt, Human; identical to SEQ ID NO: 111488

SEQ ID NO: 111866 - RNA, 64 nt, Human; identical to SEQ ID NO: 111489

SEQ ID NO: 111867 - RNA, 64 nt, Human; identical to SEQ ID NO: 111490

SEQ ID NO: 111868 - RNA, 64 nt, Human; identical to SEQ ID NO: 111491

SEQ ID NO: 111869 - RNA, 64 nt, Human; identical to SEQ ID NO: 111492

SEQ ID NO: 111870 - RNA, 64 nt, Human; identical to SEQ ID NO: 111493

SEQ ID NO: 111871 - RNA, 64 nt, Human; identical to SEQ ID NO: 111494

SEQ ID NO: 111872 - RNA, 64 nt, Human; identical to SEQ ID NO: 111495

SEQ ID NO: 111873 - RNA, 64 nt, Human; identical to SEQ ID NO: 111496

SEQ ID NO: 111874 - RNA, 64 nt, Human; identical to SEQ ID NO: 111497

SEQ ID NO: 111875 - RNA, 64 nt, Human; identical to SEQ ID NO: 111498

SEQ ID NO: 111876 - RNA, 64 nt, Human; identical to SEQ ID NO: 111499

SEQ ID NO: 111877 - RNA, 64 nt, Human; identical to SEQ ID NO: 111500

SEQ ID NO: 111878 - RNA, 64 nt, Human; identical to SEQ ID NO: 111501

SEQ ID NO: 111879 - RNA, 64 nt, Human; identical to SEQ ID NO: 111502

SEQ ID NO: 111880 - RNA, 64 nt, Human
aggcucagcucucuccaccacccagcucuucccugaccuucacgaagggauggcucuccagucc

SEQ ID NO: 111881 - RNA, 64 nt, Human; identical to SEQ ID NO: 111503

SEQ ID NO: 111882 - RNA, 64 nt, Human; identical to SEQ ID NO: 111504

SEQ ID NO: 111883 - RNA, 64 nt, Human; identical to SEQ ID NO: 111506

SEQ ID NO: 111884 - RNA, 64 nt, Human; identical to SEQ ID NO: 111507

SEQ ID NO: 111885 - RNA, 64 nt, Human; identical to SEQ ID NO: 111508

SEQ ID NO: 111886 - RNA, 64 nt, Human; identical to SEQ ID NO: 111509

SEQ ID NO: 111887 - RNA, 64 nt, Human; identical to SEQ ID NO: 111510

SEQ ID NO: 111888 - RNA, 59 nt, Human; identical to SEQ ID NO: 111511

SEQ ID NO: 111889 - RNA, 64 nt, Human; identical to SEQ ID NO: 111512

SEQ ID NO: 111890 - RNA, 64 nt, Human; identical to SEQ ID NO: 111513

SEQ ID NO: 111891 - RNA, 64 nt, Human; identical to SEQ ID NO: 111514

SEQ ID NO: 111892 - RNA, 64 nt, Human; identical to SEQ ID NO: 111515

SEQ ID NO: 111893 - RNA, 64 nt, Human; identical to SEQ ID NO: 111516

SEQ ID NO: 111894 - RNA, 64 nt, Human; identical to SEQ ID NO: 111517

SEQ ID NO: 111895 - RNA, 64 nt, Human; identical to SEQ ID NO: 111518

SEQ ID NO: 111896 - RNA, 64 nt, Human; identical to SEQ ID NO: 111519

SEQ ID NO: 111897 - RNA, 64 nt, Human; identical to SEQ ID NO: 111520

SEQ ID NO: 111898 - RNA, 64 nt, Human; identical to SEQ ID NO: 111521

SEQ ID NO: 111899 - RNA, 64 nt, Human
guuuauuuauuuacugccacgcuacugauauucagaccuucaugaucauccaucuggugagcag

SEQ ID NO: 111900 - RNA, 64 nt, Human; identical to SEQ ID NO: 111522

SEQ ID NO: 111901 - RNA, 64 nt, Human; identical to SEQ ID NO: 111523

SEQ ID NO: 111902 - RNA, 64 nt, Human; identical to SEQ ID NO: 111525

SEQ ID NO: 111903 - RNA, 64 nt, Human; identical to SEQ ID NO: 111526

SEQ ID NO: 111904 - RNA, 64 nt, Human; identical to SEQ ID NO: 111527

SEQ ID NO: 111905 - RNA, 64 nt, Human; identical to SEQ ID NO: 111528

SEQ ID NO: 111906 - RNA, 64 nt, Human; identical to SEQ ID NO: 111529

SEQ ID NO: 111907 - RNA, 64 nt, Human; identical to SEQ ID NO: 111530

SEQ ID NO: 111908 - RNA, 64 nt, Human; identical to SEQ ID NO: 111531

SEQ ID NO: 111909 - RNA, 64 nt, Human; identical to SEQ ID NO: 111532

SEQ ID NO: 111910 - RNA, 64 nt, Human; identical to SEQ ID NO: 111533

SEQ ID NO: 111911 - RNA, 64 nt, Human; identical to SEQ ID NO: 111534

SEQ ID NO: 111912 - RNA, 64 nt, Human; identical to SEQ ID NO: 111535

SEQ ID NO: 111913 - RNA, 64 nt, Human; identical to SEQ ID NO: 111536

SEQ ID NO: 111914 - RNA, 64 nt, Human; identical to SEQ ID NO: 111537

SEQ ID NO: 111915 - RNA, 64 nt, Human; identical to SEQ ID NO: 111538

SEQ ID NO: 111916 - RNA, 64 nt, Human; identical to SEQ ID NO: 111539

SEQ ID NO: 111917 - RNA, 64 nt, Human; identical to SEQ ID NO: 111540

SEQ ID NO: 111918 - RNA, 64 nt, Human
uuuucaccuaaguggguccugcccccucccccaugaccuucaggagcaccccauauuauuucca

SEQ ID NO: 111919 - RNA, 64 nt, Human; identical to SEQ ID NO: 111541

SEQ ID NO: 111920 - RNA, 64 nt, Human; identical to SEQ ID NO: 111542

SEQ ID NO: 111921 - RNA, 64 nt, Human; identical to SEQ ID NO: 111544

SEQ ID NO: 111922 - RNA, 64 nt, Human; identical to SEQ ID NO: 111545

SEQ ID NO: 111923 - RNA, 64 nt, Human; identical to SEQ ID NO: 111546

SEQ ID NO: 111924 - RNA, 64 nt, Human; identical to SEQ ID NO: 111547

SEQ ID NO: 111925 - RNA, 64 nt, Human; identical to SEQ ID NO: 111548

SEQ ID NO: 111926 - RNA, 64 nt, Human; identical to SEQ ID NO: 111549

SEQ ID NO: 111927 - RNA, 64 nt, Human; identical to SEQ ID NO: 111550

SEQ ID NO: 111928 - RNA, 64 nt, Human; identical to SEQ ID NO: 111551

SEQ ID NO: 111929 - RNA, 64 nt, Human; identical to SEQ ID NO: 111552

SEQ ID NO: 111930 - RNA, 64 nt, Human; identical to SEQ ID NO: 111553

SEQ ID NO: 111931 - RNA, 56 nt, Human; identical to SEQ ID NO: 111554

SEQ ID NO: 111932 - RNA, 64 nt, Human; identical to SEQ ID NO: 111555

SEQ ID NO: 111933 - RNA, 64 nt, Human; identical to SEQ ID NO: 111556

SEQ ID NO: 111934 - RNA, 64 nt, Human; identical to SEQ ID NO: 111557

SEQ ID NO: 111935 - RNA, 64 nt, Human; identical to SEQ ID NO: 111558

SEQ ID NO: 111936 - RNA, 64 nt, Human; identical to SEQ ID NO: 111559

SEQ ID NO: 111937 - RNA, 64 nt, Human; identical to SEQ ID NO: 111560

SEQ ID NO: 111938 - RNA, 64 nt, Human; identical to SEQ ID NO: 111561

SEQ ID NO: 111939 - RNA, 64 nt, Human; identical to SEQ ID NO: 111562

SEQ ID NO: 111940 - RNA, 64 nt, Human; identical to SEQ ID NO: 111563

SEQ ID NO: 111941 - RNA, 64 nt, Human; identical to SEQ ID NO: 111564

SEQ ID NO: 111942 - RNA, 64 nt, Human; identical to SEQ ID NO: 111565

SEQ ID NO: 111943 - RNA, 64 nt, Human; identical to SEQ ID NO: 111566

SEQ ID NO: 111944 - RNA, 64 nt, Human; identical to SEQ ID NO: 111567

SEQ ID NO: 111945 - RNA, 64 nt, Human; identical to SEQ ID NO: 111568

SEQ ID NO: 111946 - RNA, 64 nt, Human; identical to SEQ ID NO: 111569

SEQ ID NO: 111947 - RNA, 64 nt, Human; identical to SEQ ID NO: 111570

SEQ ID NO: 111948 - RNA, 64 nt, Human; identical to SEQ ID NO: 111571

SEQ ID NO: 111949 - RNA, 64 nt, Human; identical to SEQ ID NO: 111572

SEQ ID NO: 111950 - RNA, 64 nt, Human; identical to SEQ ID NO: 111573

SEQ ID NO: 111951 - RNA, 64 nt, Human; identical to SEQ ID NO: 111574

SEQ ID NO: 111952 - RNA, 64 nt, Human; identical to SEQ ID NO: 111575

SEQ ID NO: 111953 - RNA, 64 nt, Human; identical to SEQ ID NO: 111576

SEQ ID NO: 111954 - RNA, 64 nt, Human; identical to SEQ ID NO: 111577

SEQ ID NO: 111955 - RNA, 64 nt, Human; identical to SEQ ID NO: 111578

SEQ ID NO: 111956 - RNA, 63 nt, Human
gcugccaguguaagaucugaggcucugaacccagaccuucagguuucaccuguuuggugaaag

SEQ ID NO: 111957 - RNA, 64 nt, Human; identical to SEQ ID NO: 111579

SEQ ID NO: 111958 - RNA, 64 nt, Human; identical to SEQ ID NO: 111580

SEQ ID NO: 111959 - RNA, 64 nt, Human; identical to SEQ ID NO: 111582

SEQ ID NO: 111960 - RNA, 59 nt, Human; identical to SEQ ID NO: 111583

SEQ ID NO: 111961 - RNA, 64 nt, Human; identical to SEQ ID NO: 111584

SEQ ID NO: 111962 - RNA, 64 nt, Human; identical to SEQ ID NO: 111585

SEQ ID NO: 111963 - RNA, 64 nt, Human; identical to SEQ ID NO: 111586

SEQ ID NO: 111964 - RNA, 64 nt, Human; identical to SEQ ID NO: 111587

SEQ ID NO: 111965 - RNA, 64 nt, Human; identical to SEQ ID NO: 111588

SEQ ID NO: 111966 - RNA, 64 nt, Human; identical to SEQ ID NO: 111589

SEQ ID NO: 111967 - RNA, 64 nt, Human; identical to SEQ ID NO: 111590

SEQ ID NO: 111968 - RNA, 64 nt, Human; identical to SEQ ID NO: 111591

SEQ ID NO: 111969 - RNA, 64 nt, Human; identical to SEQ ID NO: 111592

SEQ ID NO: 111970 - RNA, 64 nt, Human; identical to SEQ ID NO: 111593

SEQ ID NO: 111971 - RNA, 64 nt, Human; identical to SEQ ID NO: 111594

SEQ ID NO: 111972 - RNA, 64 nt, Human; identical to SEQ ID NO: 111595

SEQ ID NO: 111973 - RNA, 64 nt, Human; identical to SEQ ID NO: 111596

SEQ ID NO: 111974 - RNA, 64 nt, Human; identical to SEQ ID NO: 111597

SEQ ID NO: 111975 - RNA, 64 nt, Human; identical to SEQ ID NO: 111598

SEQ ID NO: 111976 - RNA, 64 nt, Human; identical to SEQ ID NO: 111599

SEQ ID NO: 111977 - RNA, 64 nt, Human; identical to SEQ ID NO: 111600

SEQ ID NO: 111978 - RNA, 64 nt, Human; identical to SEQ ID NO: 111601

SEQ ID NO: 111979 - RNA, 64 nt, Human; identical to SEQ ID NO: 111602

SEQ ID NO: 111980 - RNA, 64 nt, Human; identical to SEQ ID NO: 111603

SEQ ID NO: 111981 - RNA, 64 nt, Human; identical to SEQ ID NO: 111604

SEQ ID NO: 111982 - RNA, 64 nt, Human; identical to SEQ ID NO: 111605

SEQ ID NO: 111983 - RNA, 64 nt, Human; identical to SEQ ID NO: 111606

SEQ ID NO: 111984 - RNA, 64 nt, Human; identical to SEQ ID NO: 111607

SEQ ID NO: 111985 - RNA, 64 nt, Human; identical to SEQ ID NO: 111608

SEQ ID NO: 111986 - RNA, 64 nt, Human; identical to SEQ ID NO: 111609

SEQ ID NO: 111987 - RNA, 64 nt, Human; identical to SEQ ID NO: 111610

SEQ ID NO: 111988 - RNA, 64 nt, Human; identical to SEQ ID NO: 111611

SEQ ID NO: 111989 - RNA, 64 nt, Human; identical to SEQ ID NO: 111612

SEQ ID NO: 111990 - RNA, 64 nt, Human; identical to SEQ ID NO: 111613

SEQ ID NO: 111991 - RNA, 64 nt, Human; identical to SEQ ID NO: 111614

SEQ ID NO: 111992 - RNA, 64 nt, Human; identical to SEQ ID NO: 111615

SEQ ID NO: 111993 - RNA, 64 nt, Human; identical to SEQ ID NO: 111616

SEQ ID NO: 111994 - RNA, 64 nt, Human; identical to SEQ ID NO: 111617

SEQ ID NO: 111995 - RNA, 64 nt, Human; identical to SEQ ID NO: 111618

SEQ ID NO: 111996 - RNA, 64 nt, Human; identical to SEQ ID NO: 111619

SEQ ID NO: 111997 - RNA, 64 nt, Human; identical to SEQ ID NO: 111620

SEQ ID NO: 111998 - RNA, 64 nt, Human; identical to SEQ ID NO: 111621

SEQ ID NO: 111999 - RNA, 64 nt, Human; identical to SEQ ID NO: 111622

SEQ ID NO: 112000 - RNA, 64 nt, Human; identical to SEQ ID NO: 111623

SEQ ID NO: 112001 - RNA, 64 nt, Human; identical to SEQ ID NO: 111624

SEQ ID NO: 112002 - RNA, 64 nt, Human; identical to SEQ ID NO: 111625

SEQ ID NO: 112003 - RNA, 64 nt, Human; identical to SEQ ID NO: 111626

SEQ ID NO: 112004 - RNA, 51 nt, Human; identical to SEQ ID NO: 111627

SEQ ID NO: 112005 - RNA, 64 nt, Human; identical to SEQ ID NO: 111628

SEQ ID NO: 112006 - RNA, 64 nt, Human; identical to SEQ ID NO: 111629

SEQ ID NO: 112007 - RNA, 64 nt, Human; identical to SEQ ID NO: 111630

SEQ ID NO: 112008 - RNA, 64 nt, Human; identical to SEQ ID NO: 111631

SEQ ID NO: 112009 - RNA, 64 nt, Human; identical to SEQ ID NO: 111632

SEQ ID NO: 112010 - RNA, 64 nt, Human; identical to SEQ ID NO: 111633

SEQ ID NO: 112011 - RNA, 64 nt, Human
agcaagauaagcagggccagucucagggcccggagacgaacacggggacaauugucaaaggagc

SEQ ID NO: 112012 - RNA, 64 nt, Human
caugcuuccuuuucaaagaauagacuucaaaagggacgaacaaacauuaggucaccuuuugugu

SEQ ID NO: 112013 - RNA, 64 nt, Human
uuuuacaacgugacaggaagaggagggagagggugacgaacaccaggcauuuccaggggcuaua

SEQ ID NO: 112014 - RNA, 64 nt, Human
auuuccugacacugagaaugaagaguaucacagugacgaacaaaaugauacucagaagcaauuu

SEQ ID NO: 112015 - RNA, 64 nt, Human
ugcagaugcucuuaaaagcauugauaaccuuugugacgaacauaaagagauccuuaaauuauga

SEQ ID NO: 112016 - RNA, 64 nt, Human
uccagguguggccucuggaaccugacuccguuaggacgaacaucugccccuucagggaggguga

SEQ ID NO: 112017 - RNA, 64 nt, Human
gagugguggcagcucaaaaugauauguuugaguagacgaacagcugacauggaguucccgugca

SEQ ID NO: 112018 - RNA, 64 nt, Human
gcaccucacgcacagcucucagaagcugcaggcggacgaacaucugaccaaagagguguggucg

SEQ ID NO: 112019 - RNA, 64 nt, Human
uaggggaaaguuucaugaugguaucuauagucaagacgaacauguagcauggugccuauguaga

SEQ ID NO: 112020 - RNA, 64 nt, Human
cccccucccugguggucuuaggucuauaaucagugacgaacagagggugcccuuggccaaugua

SEQ ID NO: 112021 - RNA, 64 nt, Human
cuucuaaaaucuaaaauccauuucaagaaauaaagacgaacacauuugcaggaagguaacuguu

SEQ ID NO: 112022 - RNA, 64 nt, Human
cucuucugccugauagagggaagaggaagaggaggacgaacagagauccugaaauucugacuug

SEQ ID NO: 112023 - RNA, 54 nt, Human
uugggaucauugcccugugaggaggacgaacauccaaccuucccaaacgccucc

SEQ ID NO: 112024 - RNA, 64 nt, Human
gcgugggcaaagcugaaggugaugaggaagaagagacgaacauuaaagaugucuauuuacuaug

SEQ ID NO: 112025 - RNA, 64 nt, Human
gggacuccugagaugggagaggcagggaucagaggacgaacaggugggacuuugcgagcucugu

SEQ ID NO: 112026 - RNA, 64 nt, Human
uaaucagacaagcuugaauauuguuuuugcaccagacgaacagugaggaaauucggagcuauac

SEQ ID NO: 112027 - RNA, 64 nt, Human
uucucacagacccuucagcaauggcuacuagaaggacgaacaauugcccuccuuuggaaguacg

SEQ ID NO: 112028 - RNA, 64 nt, Human
uuacaaacucagaaauacgaacagaaauacagcagacgaacauauuuauugguacugaaaagag

SEQ ID NO: 112029 - RNA, 57 nt, Human
aucuuuacagauucauuuaagccaucagacgaacacaagagaggcucaaacaagaaa

SEQ ID NO: 112030 - RNA, 64 nt, Human
aaauuacgaaagaaaagaaaucucuaugcaaaaugacgaacaugguccuguggacuccucuggc

SEQ ID NO: 112031 - RNA, 64 nt, Human
gugccucucuggccgcccacuggaugagcggugagacgaacaaaagggaaaggaaaaaaugggg

SEQ ID NO: 112032 - RNA, 64 nt, Human
gagcuggccaucccaaauucaaucaguccauagagacgaacagaaugagaccuuccggcccaag

SEQ ID NO: 112033 - RNA, 64 nt, Human
caaacaguuuuuccaauuauaaauaaaugcuaaagacgaacaccacuuucuugaucuuauuucc

SEQ ID NO: 112034 - RNA, 64 nt, Human
caagccuccucaccccuagucuucaucuccuguggacgaacaucugggguggaaguuuuguagc

SEQ ID NO: 112035 - RNA, 64 nt, Human
uucuuuaaaaagaaagaggguugaaaauccucuggacgaacagaagucacuuuggcuguucagu

SEQ ID NO: 112036 - RNA, 64 nt, Human
cuccguaaacagcccagcuguaacgccagaccgagacgaacacucugccuaacuaucaaaggau

SEQ ID NO: 112037 - RNA, 64 nt, Human
gucacgcuggcgcugaauacuuuuuguauaaaccgacgaacagcugaugaccgcaugaaugcuc

SEQ ID NO: 112038 - RNA, 64 nt, Human
uguuugcugcccagccauaacccacucagugacagacgaacacagcuaaggccucgcugccagc

SEQ ID NO: 112039 - RNA, 64 nt, Human
uuugucacacaggauggcaugugauccucaagacgacgaacaaugaacuaaagccaaaugcagc

SEQ ID NO: 112040 - RNA, 64 nt, Human
ugauuccgaccagggcacccccuucagagcuagggacgaacagcagugugcucccaccucaggg

SEQ ID NO: 112041 - RNA, 64 nt, Human
ggacaucagaucacucuguauucaaagcuuacuagacgaacaaucuuucauuucuggauauauu

SEQ ID NO: 112042 - RNA, 64 nt, Human
aaggccacguaugugccuugaauguagccaaaaugacgaacaacacccagaaaucugugauuua

SEQ ID NO: 112043 - RNA, 64 nt, Human
aggcacugagagcuggagaguuggugauaagcgagacgaacacauuuccugcccucauacacac

SEQ ID NO: 112044 - RNA, 64 nt, Human
ggccccugaccucaagaucaaggaaaggaggauggacgaacaggggccaaacuggugggaggca

SEQ ID NO: 112045 - RNA, 64 nt, Human
aguggaauuaauugcaguagggauaaaguagaagaaaccacaaauuaucuugugccugaaaucc

SEQ ID NO: 112046 - RNA, 64 nt, Human
ugucaauguaaguauuugucauaucugagguccaaaaccacaaugaaagugcucugaagauuua

SEQ ID NO: 112047 - RNA, 64 nt, Human
cacaacagccagggacuugauuuugauguauuuuaaaccacauuaaauaaagagucuguugccu

SEQ ID NO: 112048 - RNA, 64 nt, Human
aguuuuuaaccacuuuuagguuuuccccuuacagaaaccacagaaauauucccuuagaauaaaa

SEQ ID NO: 112049 - RNA, 64 nt, Human
ccaucguguuugcaaagguuaaaacaaaaacaaaaaaccacaaaaauaaaaaacaaaaaaaaca

SEQ ID NO: 112050 - RNA, 64 nt, Human
ugcuggccagaaagggaaaugaggaggagaguagaaaccacagcucuuaguaguaauggcauac

SEQ ID NO: 112051 - RNA, 64 nt, Human
gagggcaaaggagagaagggagaaaaaaaaaaaaaaaccacacacacccauacacacauaccag

SEQ ID NO: 112052 - RNA, 64 nt, Human
agcugagacuccuggugagccuuugccaccaugaaaaccacauagcugaccagggcugugcuug

SEQ ID NO: 112053 - RNA, 64 nt, Human
uuuccauuugaaaaaaaucucaaaacacagauuaaaaccacaauaggcuguaguauuuuuuauu

SEQ ID NO: 112054 - RNA, 64 nt, Human
uuaaguuuccacguaaacuuucggggacacauucaaaccacaggagaaacucaaauuguuccug

SEQ ID NO: 112055 - RNA, 64 nt, Human
cauuaagcucuguugucaugaacaacuggaauguaaaccacaguauuuuggagugcagaacauu

SEQ ID NO: 112056 - RNA, 64 nt, Human
agguguuguaaagagcugcuaguagguucgcuuuaaaccacaugagcuuaaccaagaauauguu

SEQ ID NO: 112057 - RNA, 64 nt, Human
aucaacaagacggcugccaaccugagaagucaccaaaccacaaaaauaaccuuacagccuucag

SEQ ID NO: 112058 - RNA, 64 nt, Human
aggcaacacaagcucgcaacucuaagauuuuuuuaaaccacaaaaacccugguuagccaucuca

SEQ ID NO: 112059 - RNA, 64 nt, Human
guuaaucguuucuuaauaaagaagcagaauuuagaaaccacaggauaguguacccacagauggg

SEQ ID NO: 112060 - RNA, 64 nt, Human
aaagcaauuuaaucaauugcaaagcaauuauauaaaaccacaaagaauguacugaaccuacuaa

SEQ ID NO: 112061 - RNA, 64 nt, Human
caaagugguuuuuuaaaauuacauaacuaaaaauaaaccacacuguggauacaucuuauaaaac

SEQ ID NO: 112062 - RNA, 64 nt, Human
aaagaauauuccauuuuccuuuccuugugguugaaaaccacagucaguggagagauguuuggaa

SEQ ID NO: 112063 - RNA, 64 nt, Human
gguugaaaaccacagucaguggagagauguuuggaaaccacagucaguggagccugggugguac

SEQ ID NO: 112064 - RNA, 64 nt, Human
auguaaaguuguuuuauaaacgauccuguuaauuaaaccacagacaccauauauccuucugcau

SEQ ID NO: 112065 - RNA, 64 nt, Human
ucagggcgggagacaggagccuugggguccuguuaaaccacagacaguuaugaacugaaaguca

SEQ ID NO: 112066 - RNA, 64 nt, Human
auguaaaucuucauagugucagacauacugaccaaaaccacaaucuagacuacaaaguauauug

SEQ ID NO: 112067 - RNA, 64 nt, Human
gucccaguccaaacucugauuuacaucacuuuagaaaccacacucacacuuuugcagaguguug

SEQ ID NO: 112068 - RNA, 64 nt, Human
uacaaaauacccaagauuuaagaccggggggaaaaaaccacaaauugguaaauaaagguuugcu

SEQ ID NO: 112069 - RNA, 64 nt, Human
ucacaauagagcucagggagccccuaacucuuccaaaccacaugggagacaguuuccuucaugc

SEQ ID NO: 112070 - RNA, 64 nt, Human
aacuucuuuucuaaaagguauagcugagcgguugaaaccacagugaucucuauuuucucccuuu

SEQ ID NO: 112071 - RNA, 64 nt, Human
guucauccauuauaaauauaucuuuagccacagcaaaccacacuuaaccuaucuauaauaaaaa

SEQ ID NO: 112072 - RNA, 64 nt, Human
aaaaaaaaaaaaacucuuguaucucaauauuuuuaaaccacaggccuaaauaaaacuaauuuug

SEQ ID NO: 112073 - RNA, 64 nt, Human
uuuuuuuauauacaugcucuccccagaauacaguaaaccacaguuuuagaacuaaacacaucug

SEQ ID NO: 112074 - RNA, 64 nt, Human
aaaacaaggaguguauuuuagagacaagggaaaaaaaccacaucugcuauccaaagauuuuagu

SEQ ID NO: 112075 - RNA, 64 nt, Human
cuuccccaucauucccucugccuaggcccuggugaaaccacagguaugcaauuaugcuaggggc

SEQ ID NO: 112076 - RNA, 64 nt, Human
gcaguauauguucuaagaccccuaguagauucgcaaaccacagauaguaccaaacuccauucau

SEQ ID NO: 112077 - RNA, 64 nt, Human
uaccaagcucucccuuaucaagugaauaucaucaaaaccacagcauccuugaucagagaagggg

SEQ ID NO: 112078 - RNA, 64 nt, Human
uaaguacaguugauacugacauuguucacucaucaaaccacaucuugaugcuaaguaacauuuc

SEQ ID NO: 112079 - RNA, 64 nt, Human
augagaaacuuuuuuccuacaaagaccuugcuugaaaccacaaaaguuuugcuggcacgaaaga

SEQ ID NO: 112080 - RNA, 64 nt, Human
uuuguugcagcuuuuaaauguacucugaacuuccaaaccacauucauuccagccugguagaaca

SEQ ID NO: 112081 - RNA, 64 nt, Human
gggggaaagcuaguguugaugaaacuuuugaucaaaaccacauuguaaaacauugcccaucugu

SEQ ID NO: 112082 - RNA, 64 nt, Human
auuucccacacugucuuagagaacuugucaccagaaaccacauguauuugcauguuuuuuguua

SEQ ID NO: 112083 - RNA, 64 nt, Human
uuuguguagguaaauaaaggcagacaugguuugcaaaccacaagaaucauuaguuguagagaag

SEQ ID NO: 112084 - RNA, 64 nt, Human
cuuuuaguaaacuggacauguuauuccacuacaaaaaccacaaguuaucuggccuuuuagaucu

SEQ ID NO: 112085 - RNA, 64 nt, Human
uguucgcacaaucuacacugccuuaccuucacuuaaaccacacacacaaggugcucagacauga

SEQ ID NO: 112086 - RNA, 64 nt, Human
caaaauugguuucagaacacugauaacacucagaaaaccacaguguguuuucauauuuggaacu

SEQ ID NO: 112087 - RNA, 64 nt, Human
gggaaaaagggcaauguugauuaaucucaguauuaaaccacauuaaucuguaucccauugucug

SEQ ID NO: 112088 - RNA, 64 nt, Human
ucucaaauguuugagauucaagugaauggaaggaaaaccacaugccuuuaaaacuaaacuguaa

SEQ ID NO: 112089 - RNA, 64 nt, Human
acaucaaaugaaaugagaaguguguaugcugaccaaaccacaagaaacuuucuuuaaguugugu

SEQ ID NO: 112090 - RNA, 64 nt, Human
augacagcccacuugucaaauauguaauucaccgaaaccacaccaaguccugcuacuguagagu

SEQ ID NO: 112091 - RNA, 64 nt, Human
ccucugaaauguggcuagguguagaaugauguugaaaccacaggcuaaaauguagaucuggaag

SEQ ID NO: 112092 - RNA, 64 nt, Human
acagucugcacuugcagaagaaagaaaaaaauucaaaccacauguuuauuuuuuuuuugccuac

SEQ ID NO: 112093 - RNA, 64 nt, Human
aaaaagagaaaggggcaagaaauucauuaaagaaaaaccacagauacugaaacauuugacacau

SEQ ID NO: 112094 - RNA, 64 nt, Human
gggacuccaaauguccucuggcagaggacccagaaaaccacacuggcuccaacuuccuccucau

SEQ ID NO: 112095 - RNA, 64 nt, Human
cagucacucuugcacuauuccuucuccaagccagaaaccacauuuaauuucauaaauaaauuua

SEQ ID NO: 112096 - RNA, 64 nt, Human
gaaaagcuacagcuucuuugcguuuaacuuuuucaaaccacagaccagaacugguugcauguua

SEQ ID NO: 112097 - RNA, 64 nt, Human
uggcguggcacaacacacuuuggucauuucucaaaaaccacaguccucaccacaguuuauugau

SEQ ID NO: 112098 - RNA, 64 nt, Human
uuaaagcugaucaagaaaguuaacaacaacauagaaaccacacgauuguuccacugucuggaag

SEQ ID NO: 112099 - RNA, 64 nt, Human
uauagaauguuguaaaacagacaaacaagaaaacaaaccacauacuuuugaaguguauuuuauc

SEQ ID NO: 112100 - RNA, 64 nt, Human
uugcuaaugcuguuccuucuuugugccuccuuccaaaccacaguuauuugcccaaacuaccucu

SEQ ID NO: 112101 - RNA, 64 nt, Human
auacucuggcacaauuuucauuuguauaugagccaaaccacauaccuuaaugauuugggaaguu

SEQ ID NO: 112102 - RNA, 64 nt, Human
cucaaacaacaacaacaacaacaacaacaacaacaaaccacaaaauuauuugaguacugugaag

SEQ ID NO: 112103 - RNA, 64 nt, Human
cacauaugugucagggcacaauucccucucauaaaaaccacacagccuggaaauuggcccuggc

SEQ ID NO: 112104 - RNA, 64 nt, Human
ucaggaguucgagaccagccuggccaacauggcaaaaccacaucucuacuaaaaauaaaaaaau

SEQ ID NO: 112105 - RNA, 64 nt, Human
acugcagaaguggcuccuuuucauaaacuccccuaaaccacacacaggagagagcgacgggccu

SEQ ID NO: 112106 - RNA, 64 nt, Human
aaaauaaauaagaauaacucagaaacucaaaaggaaaccacaaauucagcuaauaauagcauuu

SEQ ID NO: 112107 - RNA, 64 nt, Human
cagcacccagaagagaaaaaggaauuuaaaacaaaaaccacagaggcggaaauaccggagggcu

SEQ ID NO: 112108 - RNA, 64 nt, Human
gauuugagcuacaucuuguugagcaaggggagugaaaccacagaaacuguuaaauugaacguaa

SEQ ID NO: 112109 - RNA, 64 nt, Human
uaggacuuauuuguuuuaauguacagaugugggaaaaccacacaaauuccgcaguuuauucugg

SEQ ID NO: 112110 - RNA, 64 nt, Human
cacuccccagcugcacugaccaguguuuccggcaaaaccacauucaugggacacuucuccaggu

SEQ ID NO: 112111 - RNA, 64 nt, Human
cuauggggaggauaugagaaaauaaauuccuucuaaaccacauuggaacugaccugaagaagca

SEQ ID NO: 112112 - RNA, 64 nt, Human
uugguuuuaaaauaugagugccuuggaucuauuaaaaccacaucgaugguucuuucuacuuguu

SEQ ID NO: 112113 - RNA, 64 nt, Human
ugaacuucauccuaauaaggauaaaacuuaaggaaaaccacaauaaaccaugaagguguacaca

SEQ ID NO: 112114 - RNA, 64 nt, Human
agaaaugguagacugggaauggaaagaaugggguaaaccacagucuacauagggaaggacucuu

SEQ ID NO: 112115 - RNA, 64 nt, Human
ccucugacaacugugaagccacccugggcuacagaaaccacagucuucccagcaauuauuacaa

SEQ ID NO: 112116 - RNA, 64 nt, Human
aguauuaaucuccaaacaucacugcugcucggagaaaccacauccccaggcauaacaccaccuu

SEQ ID NO: 112117 - RNA, 64 nt, Human
ugaauguauuuaauuuuaugaauuauuuaugauuaaaccacauccagaaucuucguuuucugug

SEQ ID NO: 112118 - RNA, 64 nt, Human
gaaaucaaauaugcaaagcacugacuucuaaguaaaaccacagcaguugaaaagacuccaaaga

SEQ ID NO: 112119 - RNA, 64 nt, Human
acuuguuuauaaaauaaucauuugcccagggaaaaaaccacaacgcuguuucaagcuuuagucu

SEQ ID NO: 112120 - RNA, 64 nt, Human
ggggauuauucuuuaguucucagagguagggacaaaaccacaucagguuuucagaaggaaaaaa

SEQ ID NO: 112121 - RNA, 64 nt, Human
ugcuuugcaaaucuggauuccaauggaccuuucaaaaccacaacaaaaccucaguuuuagauga

SEQ ID NO: 112122 - RNA, 64 nt, Human
guugccaggcaggcaccugggcuuucuggaauccaaaccacagucuuaggggcuugguaguuug

SEQ ID NO: 112123 - RNA, 64 nt, Human
ucugguugugauuuauauuuuaaagcuuggugcuaaaccacaauauguauagcauauggagugc

SEQ ID NO: 112124 - RNA, 64 nt, Human
aaugggaguagggggguggacaggggagaaacgaaaaccacaaaaagaaaacccaacuccucuc

SEQ ID NO: 112125 - RNA, 53 nt, Human
ucaccggagccagucuauagcgcaaaccacacaccugccaaggagcaacagaa

SEQ ID NO: 112126 - RNA, 64 nt, Human
cagaugccaugcuuggcagcagcaguaggacuauaaaccacagcugucccccaggaucccacuc

SEQ ID NO: 112127 - RNA, 64 nt, Human
ucugugugcugaagcuaacucaagauggaaagugaaaccacaugugccgugaccuuuagguuuu

SEQ ID NO: 112128 - RNA, 64 nt, Human
aacaaaguuuagguaaaugaauuaucgcagagaaaaaccacaugagaaaauuuuuguacuccaa

SEQ ID NO: 112129 - RNA, 64 nt, Human
ggaaguuaagguguugaccacugugccugaaaugaaaccacaaggcuugagaauagaaauuaaa

SEQ ID NO: 112130 - RNA, 64 nt, Human
gcagaggacagugagugucugcacugagaaccuuaaaccacaguugaacauacccacaccuguu

SEQ ID NO: 112131 - RNA, 64 nt, Human
uuguguacugacuccaucugccccgucaaauaaaaaaccacaagguucgagccgccgggcccga

SEQ ID NO: 112132 - RNA, 64 nt, Human
aagcacaagaagcgugagacgccaccauuccuggaaaccacaguccaccugcucauucucguag

SEQ ID NO: 112133 - RNA, 64 nt, Human
gauuauaaaacucccaaaguaccaguuuuccagaaaaccacauuuuacaguuuaugaugauuaa

SEQ ID NO: 112134 - RNA, 64 nt, Human
gaaggaagagcgucccuuccuucuccuuuugagaaaaccacagaacuaugacucucaugauuuu

SEQ ID NO: 112135 - RNA, 64 nt, Human
ucuuuuguuugcauuuucugcaaaaaggaaaaagaaaccacaaauuggggaaaaaaaaagaaga

SEQ ID NO: 112136 - RNA, 64 nt, Human
uucuacacaaggcuuucaagaccaucagagagcaaaaccacauguucugucuugaggagccaua

SEQ ID NO: 112137 - RNA, 64 nt, Human
gggagggaucugacagagaugaaugugccaagcaaaaccacaacuguguauauuuuaaagcaca

SEQ ID NO: 112138 - RNA, 64 nt, Human
cccaaacccugaaagagauaaaggcaacccaaugaaaccacagagaggcagaagagaacgggca

SEQ ID NO: 112139 - RNA, 64 nt, Human
guaggguaucuuaauuaugcucauuucuuccccuaaaccacauuaucuauaugauuggacccuu

SEQ ID NO: 112140 - RNA, 64 nt, Human
aaaauuaacccacuccuccccaacaaggucuuauaaaccacagcacuuuguuccaaguucagag

SEQ ID NO: 112141 - RNA, 64 nt, Human
cuuucaaaagaguagaaagcuugaaaagauucugaaaccacaguuucauuauucucauaauccu

SEQ ID NO: 112142 - RNA, 64 nt, Human
uuuuuuuagccuuauuaauauuuuucccuauuagaaaccacaauuacucccucuauuaacccuu

SEQ ID NO: 112143 - RNA, 64 nt, Human
uguuuuuaaagguuuuguacucagcacaucauacaaaccacauuacuucugucacuucagggca

SEQ ID NO: 112144 - RNA, 64 nt, Human
agaagagucaaaguaguuaguuuugguuauuucuaaaccacaaaaguuguuuaauaaguauauc

SEQ ID NO: 112145 - RNA, 64 nt, Human
gcucuagcagcaaggcaguaacaccacaaaagcaaaaccacaugggaaaacucagcacuggugg

SEQ ID NO: 112146 - RNA, 64 nt, Human
acaaaaaauugccccaacuacaguuugcaaccccaaaccacauuagaagucugugcagacaucc

SEQ ID NO: 112147 - RNA, 64 nt, Human
uucucaacagguguaaaacaggcagagcauucuaaaaccacaugguagugcuuugguggaggac

SEQ ID NO: 112148 - RNA, 64 nt, Human
acuuuuuuccuuaauaucagaaagcaaaaaaauaaaaccacaauugagauuugccuuucaaacc

SEQ ID NO: 112149 - RNA, 64 nt, Human
gagggcaagaguacaccaauuuguuaaaagcaagaaaccacagugucucuucacuagucauuua

SEQ ID NO: 112150 - RNA, 64 nt, Human
gcugaagccacguagaagcaccuugaaaucuguaaaaccacaagaaaguacuuuauaaaaggua

SEQ ID NO: 112151 - RNA, 64 nt, Human
caacaaaauacaacuccucagcuagcuugcuguuaaaccacauugaagucuguuaaaagauauu

SEQ ID NO: 112152 - RNA, 64 nt, Human
aagaugaaauucugacauaguacaucucugccaaaaaccacacacccucuguggauauggauau

SEQ ID NO: 112153 - RNA, 64 nt, Human
aaggcacagcagccgucagaguccaugagaggugaaaccacacagcagggauguccaauaucag

SEQ ID NO: 112154 - RNA, 64 nt, Human
auuuaucaaaacaagaugaaacacagaaaaguugaaaccacaacaaaaugaauucuauuaaaga

SEQ ID NO: 112155 - RNA, 64 nt, Human
accuuuauuuugggaauuuaugagaaaauauagaaaaccacagaucagggauucauauauguag

SEQ ID NO: 112156 - RNA, 64 nt, Human
cauugaaucucuuaugccaguuuucauaaaacccaaaccacauaugaaaaaauccauuaagggu

SEQ ID NO: 112157 - RNA, 64 nt, Human
accaguuguugagggguauacuagaagcagaaugaaaccacauuuuuugguuugauaauaugca

SEQ ID NO: 112158 - RNA, 64 nt, Human
guccauuccaggaccuucauuugcauaagguaucaaaccacaucagccucugauuggccauggg

SEQ ID NO: 112159 - RNA, 64 nt, Human
guucauuccaggacauucauuugcauaaggagucaaaccacaccagucuuggauuggcugugag

SEQ ID NO: 112160 - RNA, 64 nt, Human
aaacuaguguuuguuaaaaacaaaaauaaaaacaaaaccacacaaggagaacccaauuuuguuu

SEQ ID NO: 112161 - RNA, 64 nt, Human
ggccaagugaggggcugcccaguucucacaccagaaaccacacauucacucaauaugcagcuuc

SEQ ID NO: 112162 - RNA, 64 nt, Human
guaaaucuuggcugaauggucuuaauuacucauuaaaccacagucagaaagacauauaggugcu

SEQ ID NO: 112163 - RNA, 64 nt, Human
gccuucugugcuuucaaaaaaaaaaacaaaaaaaaaaccacacacacacauaaaaaacccaaca

SEQ ID NO: 112164 - RNA, 64 nt, Human
gagcgaaacucugucucaaaaaacaaaccaacaaaaaccacaauugauuugaugaaaauuaguu

SEQ ID NO: 112165 - RNA, 64 nt, Human
aaguugucuaccauguuuucuuuucuagcugaauaaaccacaucaaaggaaagggaccacagua

SEQ ID NO: 112166 - RNA, 64 nt, Human
uaccucagaagagaugcuucauugaguguucauuaaaccacacauguauuuuguauuuauuuua

SEQ ID NO: 112167 - RNA, 64 nt, Human
gaaggcagcucccgcauaccaggauaacccccgcaaaccacauagcagacccccgccauccucg

SEQ ID NO: 112168 - RNA, 64 nt, Human
gagaguggaaaaucacucacgguuuugaaaguucaaaccacagagaaaauauuuauaacaugca

SEQ ID NO: 112169 - RNA, 64 nt, Human
agauaaaaacuuuuccaugcaaauaucuauuucuaaaccacaaugaucugauuuucuuucuucu

SEQ ID NO: 112170 - RNA, 64 nt, Human
uucccaugccagagaaagcaagcuuugguaugguaaaccacaugagaacauggcuccuuucuuu

SEQ ID NO: 112171 - RNA, 64 nt, Human
cucauaacguaaugauuauaugacaauccugaagaaaccacagguuccauagaacuaauauccu

SEQ ID NO: 112172 - RNA, 64 nt, Human
agauuucuuaauaaugggcagacagaaaaauguaaaaccacacaaaacggacugcugauaauau

SEQ ID NO: 112173 - RNA, 64 nt, Human
ucaacauuaacuauucauacagaaaugcaaaucaaaaccacaaugagauaucaucucauccuaa

SEQ ID NO: 112174 - RNA, 64 nt, Human
uaaggcacaaggaugccaaaaaaacaaaggugagaaaccacaacacaggucuaaacucagcaug

SEQ ID NO: 112175 - RNA, 64 nt, Human
aagaaaugaaagauccaguuugggauuaugaaauaaaccacaaauuaaaauuuuuguuuaaacu

SEQ ID NO: 112176 - RNA, 64 nt, Human
uggauuauugucugucuuuauagcaaguuccaguaaaccacaaguauggcaaagcuuauccaau

SEQ ID NO: 112177 - RNA, 64 nt, Human
ucuucuuucuuuagcaaaucagagugacuucuuuaaaccacagguuguugaaauggccaacacu

SEQ ID NO: 112178 - RNA, 64 nt, Human
acaguuuugucuuccaauacuuugugagucuggaaaaccacacauuuuauuuguauuucaguca

SEQ ID NO: 112179 - RNA, 64 nt, Human
uuuagcauuuccaucugcgaugaauguaggccacaaaccacaguaguauuagcagugccuggga

SEQ ID NO: 112180 - RNA, 64 nt, Human
gcuugguuuagcugugcagaaggugaaauggaggaaaccacaaauucaugcaaaguccuuuccc

SEQ ID NO: 112181 - RNA, 64 nt, Human
guuuucacuacaacuccucuaccaacggcuauggaaaccacaguuugcauuuaggauugugcua

SEQ ID NO: 112182 - RNA, 64 nt, Human
aagaagagcuaaguaacauugucagaaauaaauaaaaccacaagucucaagaauuugccacgua

SEQ ID NO: 112183 - RNA, 64 nt, Human
aaaaaaaaauucccuaaagacuaacuugaaaagaaaaccacagcaggaugcuaauggaauuacu

SEQ ID NO: 112184 - RNA, 64 nt, Human
uugauuagaauucugccaauagguggauuuuacaaaaccacagacaaccucugaaagauucuga

SEQ ID NO: 112185 - RNA, 64 nt, Human
caaccuggguucacuuggcccuucucuugcucuuaaaccacaccgaggugucuaauuucaaccc

SEQ ID NO: 112186 - RNA, 64 nt, Human
ugagcgugugauccauuaccaagucuccucaugaaaaccacagugagucagcccuucacagaac

SEQ ID NO: 112187 - RNA, 64 nt, Human
ugaaggacagcagaggaguauuuuccaucauuucaaaccacaaacaaaauuaagauuuaaacug

SEQ ID NO: 112188 - RNA, 64 nt, Human
cauuuccguguagauggagaucacuguguguaauaaaccacaagugcgugucugggugugccug

SEQ ID NO: 112189 - RNA, 64 nt, Human
augcaguuuguccauugugacaguuuguuuaauaaaaccacauacacacuuuauuuaagauuaa

SEQ ID NO: 112190 - RNA, 64 nt, Human
ggauaucuaaaaccagacccccaguggaugucuaaaaccacagauaauaacaaaccuuauacau

SEQ ID NO: 112191 - RNA, 64 nt, Human
guaauauauaucacugcucaagucaagccuccuaaaaccacagaccuguuucagcugcuacuuc

SEQ ID NO: 112192 - RNA, 64 nt, Human
gcaaguuccuucuggugucugcuuucuccauuguaaaccacaaggcuguugcaugggcuaauga

SEQ ID NO: 112193 - RNA, 64 nt, Human
aaauaucccuuaggaaaaaaaaaaaacacacaaaaaaccacaagagccccagccaguuuacucc

SEQ ID NO: 112194 - RNA, 64 nt, Human
uacagcaaaaagggauucuguagcuuuaacuuguaaaccacaucuuuuuugcacuuuuuuuaua

SEQ ID NO: 112195 - RNA, 64 nt, Human
uaagaguacaucagaguucucucuaggaaucccaaaaccacauuuugaaacuagaauaguggau

SEQ ID NO: 112196 - RNA, 64 nt, Human
ucaguuagaguuugagcauuauucagcauuagggaaaccacacacuggugagaggucuuucagu

SEQ ID NO: 112197 - RNA, 64 nt, Human
aucgcugugaaaaugaggaggauugcuucuugugaaaccacaggcccuugggguucccccagac

SEQ ID NO: 112198 - RNA, 64 nt, Human
gaagcugcagcaagagguacagcucaacaaaggaaaaccacaggacuggauaugcaacuagugc

SEQ ID NO: 112199 - RNA, 64 nt, Human
gacuucagacuucucaguguguugggaaaaccaaaaaccacaacuacagaaauucaucuaaaaa

SEQ ID NO: 112200 - RNA, 64 nt, Human
uggacagauccugucauuguuuaagcugagcaaaaaaccacacaaaaguuguguaagagaugag

SEQ ID NO: 112201 - RNA, 64 nt, Human
gaagagggaacuuucuggaguuuuugagaaugccaaaccacauuuuuaucacacuucuuuggaa

SEQ ID NO: 112202 - RNA, 64 nt, Human
acuuuacacaagcuacacauuuuauacuuuucauaaaccacaaagucucucuagaauuuuuucu

SEQ ID NO: 112203 - RNA, 64 nt, Human
cauuucugagccaaauggcccuguaucuucucuaaaaccacaucuaaaguucaagaaacuaguc

SEQ ID NO: 112204 - RNA, 64 nt, Human
gcuauuauccuaagcaaccuaaugcaagaacagaaaaccacauacugcaucuucccauuggaaa

SEQ ID NO: 112205 - RNA, 64 nt, Human
cagugcuuaaguacuuagcaaaaucuauucagcgaaaccacaccacuuaguuucucccaggggu

SEQ ID NO: 112206 - RNA, 64 nt, Human
ucauugcaguucauacuuauugacucagaguuuaaaaccacaaucuguaggcuuuaagaauugc

SEQ ID NO: 112207 - RNA, 64 nt, Human
uauggaauaccugguacuaacguaggcagcugcaaaaccacacugaguuacagcugucagcccu

SEQ ID NO: 112208 - RNA, 64 nt, Human
ugugacuccccgcacuccccaaaaagaauccgaaaaaccacaaagaaacaccaggcguaccugg

SEQ ID NO: 112209 - RNA, 64 nt, Human
accugcgucuuggaccauugccccucccggccccaaaccacaggggcucaggucgugugggccc

SEQ ID NO: 112210 - RNA, 64 nt, Human
gaagcuggugacuuuauuugcaaagcugugaauaaaaccacaaacucuaaaguagcacaagccu

SEQ ID NO: 112211 - RNA, 64 nt, Human
cauaaaguuccauguguaagcuucucuaaauaggaaaccacaauuugucaaauauguuugccau

SEQ ID NO: 112212 - RNA, 64 nt, Human
uguuuacauggauauuggcugcuuuuuuuaaggaaaaccacauugagaugugacaaguguuagg

SEQ ID NO: 112213 - RNA, 64 nt, Human
uaugugcuuggacaacgggaugaaaagacaugaaaaaccacacugaugcagaagccuuuagugc

SEQ ID NO: 112214 - RNA, 64 nt, Human
auggacccgccugcggucugcaucagccucugggaaaccacagcagugaugccagcugggcacg

SEQ ID NO: 112215 - RNA, 64 nt, Human
auaagacuggcacuuacccugaagugcauuaauaaaaccacacuuuaaaauuaucaugggccuu

SEQ ID NO: 112216 - RNA, 64 nt, Human
aguuaauauaguuuagcaguaaaaaaaaaaaaaaaaaccacaccuaaaauagaccacugaggag

SEQ ID NO: 112217 - RNA, 64 nt, Human
guccaacccuuugccugaaacauugaaucuuguuaaaccacagcuuuuagcuaaaaugagguau

SEQ ID NO: 112218 - RNA, 64 nt, Human
agcugccaaagcuaugcacccaguuggccuuagaaaaccacaauguuuacagcccugucuuagg

SEQ ID NO: 112219 - RNA, 64 nt, Human
ccucugcagcccauccuuuccuuccguccuucugaaaccacauaccccaggcccaagcgccuug

SEQ ID NO: 112220 - RNA, 64 nt, Human
aauuccuacgagaaugugcucauuugcaagcagaaaaccacagagacaggugaggcugcccagc

SEQ ID NO: 112221 - RNA, 64 nt, Human
agcugggcaauggagucagauucucuuucuuaaaaaaccacaaaaaaacuggauuuccaguucu

SEQ ID NO: 112222 - RNA, 64 nt, Human
aauaauuuuaauauauacuuuuagacccacagugaaaccacagaaggucauauuuuguaccuua

SEQ ID NO: 112223 - RNA, 64 nt, Human
uugcaguguucuuaucuugugggcugauuuccaaaaaccacaugcugcugaauuuaccagggau

SEQ ID NO: 112224 - RNA, 64 nt, Human
aaacaaagacauucuucccacuucuuggauuuuuaaaccacagucuggagugauagcuacugua

SEQ ID NO: 112225 - RNA, 64 nt, Human
agcugcuguuaaggaauuucuugcuuauagaggcaaaccacaguaucauuuuaacucuagaauu

SEQ ID NO: 112226 - RNA, 64 nt, Human
cuguucucuccaccuucaguuuagcgucauuccaaaaccacacccuugcaaagcuuuguacucc

SEQ ID NO: 112227 - RNA, 64 nt, Human
gcuuugcugagaaguuaggucugugguagaccagaaaccacaaauugacuuuuuuucuuagaaa

SEQ ID NO: 112228 - RNA, 64 nt, Human
gaaauaaggaaauaggggaaaaaaagagcacuauaaaccacauguuuucauuucuagugcuucg

SEQ ID NO: 112229 - RNA, 64 nt, Human
ugugugaucacaagacuaaagauaauuaaaaagaaaaccacagaucaugacuuuuugacugugc

SEQ ID NO: 112230 - RNA, 64 nt, Human
uuccuucguauugcuggauucuguuuucuagauuaaaccacaaggaccuuguuagugagguuua

SEQ ID NO: 112231 - RNA, 64 nt, Human
gugacagcuccucccacccccccaaaaaauaaaaaaaccacaaaaaacaaaaaaacaaaacuaa

SEQ ID NO: 112232 - RNA, 64 nt, Human
ugggggacaagggcagacggccccugccugggaaaaaccacacucacaccccaccccgaagagc

SEQ ID NO: 112233 - RNA, 64 nt, Human
guauaaagaauaaaaaucccagugagauacuuggaaaccacaguuuauuauuauuuaucugggc

SEQ ID NO: 112234 - RNA, 64 nt, Human
auguuacugagauguuuuaccauccuuacaauguaaaccacaugaacuacgugaccucugcaag

SEQ ID NO: 112235 - RNA, 64 nt, Human
aagcuuuuaugugaaacauguuucuuuguaaugaaaaccacauuggagauguuuaguaaucaua

SEQ ID NO: 112236 - RNA, 64 nt, Human
auggaggaguuauaaaaagaaaugucacagaagaaaaccacaaacuuguuuuacuggacuugug

SEQ ID NO: 112237 - RNA, 64 nt, Human
gacugagggguccgcagaagucgccacccaaauaaaaccacauuccugcugcugcgggcguggg

SEQ ID NO: 112238 - RNA, 64 nt, Human
aacugugguuuccccaagcugcacaggaggccagaaaccacaaguaugaugacuaggaagccua

SEQ ID NO: 112239 - RNA, 64 nt, Human
acaggaggaggggagguuggggggcgggagacaaaaaccacaccucuuuuuauauaagguuuca

SEQ ID NO: 112240 - RNA, 64 nt, Human
caaccucuccccuuguacagaagccauuuuuguaaaaccacacugaccuaaauucagcugccaa

SEQ ID NO: 112241 - RNA, 64 nt, Human
uagacuugaggaauccucuaccacagugucccugaaaccacaugcaucauucaggaagccuuca

SEQ ID NO: 112242 - RNA, 64 nt, Human
ugccucaaagugcuuacauuuguuaacagauuguaaaccacauuuauuuacauugaugaauggg

SEQ ID NO: 112243 - RNA, 64 nt, Human
cgaagaaaucaaaguagcauaugcacaagguuaaaaaccacauauacaaauacuauagaacagc

SEQ ID NO: 112244 - RNA, 64 nt, Human
ccagguaaaugguuauguggucuauguuccaaacaaaccacaugaucuugccugugucacaaug

SEQ ID NO: 112245 - RNA, 64 nt, Human
agaaaugggugggagaaugaaaaugcaaaucaggaaaccacauuaaagucaaggaaauaaaaua

SEQ ID NO: 112246 - RNA, 64 nt, Human
acuuuuaauaucacuaauuucuucuuuagaugccaaaccacaagacucuuuggguccauucaga

SEQ ID NO: 112247 - RNA, 64 nt, Human
gaauaggacccauuugggcagacacaggccacggaaaccacagggccagcgucuugagcccucg

SEQ ID NO: 112248 - RNA, 64 nt, Human
ccuuccuuaauauugcaucucacucccacccuuaaaaccacagauugcaaagcauagcauuuua

SEQ ID NO: 112249 - RNA, 64 nt, Human
acuugaagugcgauagugacauuauggaagagucaaaccacaaccauucuuucuugucauaguu

SEQ ID NO: 112250 - RNA, 64 nt, Human
agacuggugauaucgugauguaccuaaaagucagaaaccacauuuucuccucagaaguagggac

SEQ ID NO: 112251 - RNA, 64 nt, Human
guuucuguaacaaauugggaucugucuuggcauuaaaccacaucauggaccaaaugugccauac

SEQ ID NO: 112252 - RNA, 64 nt, Human
ggcagccugugccugccuuugugucagaaaaaggaaaccacagugagccugagagagacggcga

SEQ ID NO: 112253 - RNA, 64 nt, Human
ugccucauauuuaaaaaccauggguccacuguuaaaaccacauguguaugugcagcuuuacauu

SEQ ID NO: 112254 - RNA, 64 nt, Human
uuaguccaaauggaaccccuugaaggauaaugagaaaccacaaggccugccucugacuggggcu

SEQ ID NO: 112255 - RNA, 64 nt, Human
uuguuuaaauaguaccacagagaaaacaacugaaaaaccacauuuuucuacauacagcugggga

SEQ ID NO: 112256 - RNA, 64 nt, Human
agauaagauuucacauuauccaucacugcauaacaaaccacaccaaaacucagugguuuaaaac

SEQ ID NO: 112257 - RNA, 64 nt, Human
ugaauccaugacaagguccgggagcagcagaccaaaaccacagcagccuccuauuaaguguaac

SEQ ID NO: 112258 - RNA, 64 nt, Human
cauuugcaacucugcccaacaaaaacaagcaagcaaaccacaaugguaaagugguuaauucagg

SEQ ID NO: 112259 - RNA, 64 nt, Human
uccauucauggauauuugucaacagauuuaaagaaaaccacaguuauuaauuaaagaaaauuaa

SEQ ID NO: 112260 - RNA, 64 nt, Human
ggccuguggcauucauauuucauauucauauuucaaaccacaauauccagcaaaaugucuccug

SEQ ID NO: 112261 - RNA, 64 nt, Human
uauucaauauaaacauuugcuauuuucugcuuagaaaccacacccugaagacgugcugucuaug

SEQ ID NO: 112262 - RNA, 64 nt, Human
auuuaagaaaauuaacguauuucuuuacuauggaaaaccacauugucauuugugacaucaucua

SEQ ID NO: 112263 - RNA, 64 nt, Human
uuuuucuuucuuagaucuaguuuaaaaaaaaaaaaaaccacauaacaauucuuugaagaaagga

SEQ ID NO: 112264 - RNA, 64 nt, Human
cauguucugugggggucaucagggaggguuaggaaaaccacaaacggagccccugaaagccuca

SEQ ID NO: 112265 - RNA, 64 nt, Human
ccauucccugugauguucacucuccucccaaagcaaaccacagccaagccugucugagcuggga

SEQ ID NO: 112266 - RNA, 64 nt, Human
ucaggagccuucauuaaaacagaaauuuuagggaaaaccacaaaaaccuucguaaagugaauug

SEQ ID NO: 112267 - RNA, 64 nt, Human
gguacauuuucucagauguuaagcuuauuuuuauaaaccacauuguacgugucacuuuuauuug

SEQ ID NO: 112268 - RNA, 64 nt, Human
gacaccacucggcuccauggggagguuuagaaccaaaccacaaguccccucaaggacaaccacu

SEQ ID NO: 112269 - RNA, 64 nt, Human
uaccauauacuuuuguauuuaauagauuacuuagaaaccacaaaaauaggaauccuuaccccuu

SEQ ID NO: 112270 - RNA, 64 nt, Human
aaugagaccuugucuugaaaaaaaaaaaaacaaaaaaccacauacaggaaaaaagagagggaug

SEQ ID NO: 112271 - RNA, 64 nt, Human
uuguauaaagagaggucuacguauguagcauauaaaaccacaucacuaaguaauagacccacag

SEQ ID NO: 112272 - RNA, 64 nt, Human
uuccggagcagcucagucagcccucggggacgagaaaccacaagcgcagagacgcugaggccca

SEQ ID NO: 112273 - RNA, 64 nt, Human
ggcccugggccuuucccacagugcaaugugaugaaaaccacaggacucacgccagucggauagg

SEQ ID NO: 112274 - RNA, 64 nt, Human
uaaagggccuuaaggcauuuuguuauucuguuaaaaaccacacacacucguacaugcagacacc

SEQ ID NO: 112275 - RNA, 64 nt, Human
aaacgugauguuuugaauguggauaaaacuguguaaaccacauaauuuuuguacaucccaaagg

SEQ ID NO: 112276 - RNA, 64 nt, Human
ucaaaaauaaugcauccagcaguacaauaaaaguaaaccacaaaaaaauaccucaggaaagaau

SEQ ID NO: 112277 - RNA, 64 nt, Human
aaauauuucacagugguugguuuguuuuguuuuuaaaccacaguuugauuuaguuagccuugcu

SEQ ID NO: 112278 - RNA, 64 nt, Human; identical to SEQ ID NO: 112277

SEQ ID NO: 112279 - RNA, 64 nt, Human
aaucguuaauccagcaaaaagaaaugaaaagggaaaaccacauagaaggguaaucccggaaaug

SEQ ID NO: 112280 - RNA, 64 nt, Human
cgcuaguaaggcucaaagaagaagaaaaacaccaaaaccacaagggaaaagaaaaacccaguuu

SEQ ID NO: 112281 - RNA, 64 nt, Human
uccaaaaaagaucugaagaauccuccuuuauguaaaaccacaccaagauucugagaggaaacau

SEQ ID NO: 112282 - RNA, 64 nt, Human
uaaaugugcacgcgcuacaccacacccaggguggaaaccacaguugcagagucauuaaacaauc

SEQ ID NO: 112283 - RNA, 64 nt, Human
ucuuagucacggaguugccauggcauguaguagaaaaccacaggaagaauggucauauucacuu

SEQ ID NO: 112284 - RNA, 64 nt, Human
ugacauuuguauucucagacacugaguagcauaaaaaccacauagaacugaacuguaacuuaaa

SEQ ID NO: 112285 - RNA, 64 nt, Human
cacuguguauauaugaaaacguauuuggcaauacaaaccacauaccccuucuauuuccugacau

SEQ ID NO: 112286 - RNA, 64 nt, Human
aagucugcccauggcccacccuccccacaguccaaaaccacacagcccugguucuccagcuguu

SEQ ID NO: 112287 - RNA, 64 nt, Human
cauuauuacaaaacaaaaugaacacuugaccaaaaaaccacauuaauuuaaauggagccuuuca

SEQ ID NO: 112288 - RNA, 64 nt, Human
uuaauacuaauggaauguuucaaagguuuuauucaaaccacaaauuauagaauccacccaagaa

SEQ ID NO: 112289 - RNA, 64 nt, Human
uggaacuaggaggaggaauauuccaucuuggcagaaaccacagcauugguuuuuuucuacuugu

SEQ ID NO: 112290 - RNA, 64 nt, Human
agcagagcuuuuuaauacaagaaaacaacaacacaaaccacacacacucgcacacacacacaua

SEQ ID NO: 112291 - RNA, 64 nt, Human
uuagcccaagccugucccucgcacagccucgcacaaaccacauugccugguggggcccagugua

SEQ ID NO: 112292 - RNA, 64 nt, Human
cugacccgucccuugcauucccuccaugguuuugaaaccacagacaguguuugcuggugcuguc

SEQ ID NO: 112293 - RNA, 64 nt, Human
agccuaggguuuccccaacacgugcgugcauaugaaaccacaucaugauucccgacgugaguua

SEQ ID NO: 112294 - RNA, 64 nt, Human
gagcuuccugugcccagcaggaaggaagucaaauaaaccacacugacuaccugugcuuacugag

SEQ ID NO: 112295 - RNA, 64 nt, Human
gacaugcacugacccuuccagacauacgaaacacaaaccacaacugacacaggaaaccaacacc

SEQ ID NO: 112296 - RNA, 64 nt, Human
gaaaggaggagcuaucgaaguacaacggaucaaaaaaccacagggcuuuugggcacugccuccu

SEQ ID NO: 112297 - RNA, 64 nt, Human
ugguuuucagaugaagccauaaggcuuuggaguuaaaccacaguaucaccauacaaguauuugu

SEQ ID NO: 112298 - RNA, 64 nt, Human
cacuacugcacuuaguagcuaugugauuuugagcaaaccacauaaucucucuagguccauuuuc

SEQ ID NO: 112299 - RNA, 64 nt, Human
gcuaggugaaaucuaggaggaaggcauacuuggcaaaccacauguauaauaugcuacuuggaaa

SEQ ID NO: 112300 - RNA, 64 nt, Human
acuuuuguaacagaccaugguuguguccaagguaaaaccacagugauauuuuuggaugcuuugu

SEQ ID NO: 112301 - RNA, 64 nt, Human
aggguauggugagaaaccaacuacggauugcugcaaaccacaccuucucuuucuuaugucuuuu

SEQ ID NO: 112302 - RNA, 64 nt, Human
ugaguccacgcccaccagccuugcucucuucaauaaaccacaagcaucucacuuuugugccccc

SEQ ID NO: 112303 - RNA, 64 nt, Human
ccccugccuccaucuuuccaagcaccggggcgaaaaaccacaaaggaaaggaagaaaauuuaua

SEQ ID NO: 112304 - RNA, 64 nt, Human
uuuauaggugagaaaaaaacaaucuggaagaaaaaaaccacacaaagacauugauucagccugu

SEQ ID NO: 112305 - RNA, 64 nt, Human
uugagaggucccagucagccauggagagcuggggaaaccacauuaaggugcucacaaaaauaca

SEQ ID NO: 112306 - RNA, 64 nt, Human
uaagaguaaggggaugauuauuauauugaggcuaaaaccacaaaguggcucaggcuuuaaaaaa

SEQ ID NO: 112307 - RNA, 64 nt, Human
uuaaauggaaaccaggggaguuuuaaagcccgagaaaccacacauaaucuuuuguugagaugag

SEQ ID NO: 112308 - RNA, 64 nt, Human
ucagguuugaaucagucaccuagggguaagagaaaaaccacaacauaagaccugaaaaacagaa

SEQ ID NO: 112309 - RNA, 64 nt, Human
gagccucuacacauauauauacguacagagccuuaaaccacaucguggcggugccgucugagcu

SEQ ID NO: 112310 - RNA, 64 nt, Human
auccuuggaaccaauggaguaucugaaguuaucaaaaccacacugaaagaagauacaguuacug

SEQ ID NO: 112311 - RNA, 64 nt, Human
aaacugcauggagacgcauuucgguugagaauggaaaccacaacuuuuaaccaaacaauuauuu

SEQ ID NO: 112312 - RNA, 64 nt, Human
acuucauacuucuaaaucagaaauaggaagauuaaaaccacagaacaguuugugauuucuauug

SEQ ID NO: 112313 - RNA, 64 nt, Human
ucuaacuggagcacauucacuuacgaacaccaggaaaccacagggcccuugucgccccuucucu

SEQ ID NO: 112314 - RNA, 64 nt, Human
uggcagaacugggccgccucucugguugacaagcaaaccacaugcuaaggcuuggagcaagaga

SEQ ID NO: 112315 - RNA, 55 nt, Human
accucuuuccuggcaauugaaaaugaaaccacaggcagcccagcccuccucuguc

SEQ ID NO: 112316 - RNA, 64 nt, Human
uccaaggcaaacucuaauacccauccauugugcaaaaccacaagcacgcaaguauuaaauaaga

SEQ ID NO: 112317 - RNA, 64 nt, Human
uuuuguaagauuuauuauucacucaagaguucggaaaccacaguuuugucucucauccauacac

SEQ ID NO: 112318 - RNA, 64 nt, Human
gcugcugucacuccuccaccgagggaggccucacaaaccacaggacgcugcaacgggucaggcu

SEQ ID NO: 112319 - RNA, 64 nt, Human
uuaacccaaauauugcaagcacuuuaaagauuugaaaccacauuuuuauuguuugauguuucau

SEQ ID NO: 112320 - RNA, 64 nt, Human
uggacuaauguuacuguccaaguucuuucucaagaaaccacaucugguucagaagagugucaag

SEQ ID NO: 112321 - RNA, 64 nt, Human
guaauugugguuuuugccauugaaaguaauggcaaaaccacaauuacuuuuuuaccaaccuaau

SEQ ID NO: 112322 - RNA, 64 nt, Human
guggggggcccagccccuucucuucucccccgccaaaccacagugggagcuggggcagggggag

SEQ ID NO: 112323 - RNA, 64 nt, Human
gccaaauuacaaaagauguacucuuuguucucuaaaaccacacuaaaguuuucugacuucuuuc

SEQ ID NO: 112324 - RNA, 64 nt, Human
uauaccuucaggucuuuuguuacuuaggcaaggaaaaccacaugucugaccugguucagcaugu

SEQ ID NO: 112325 - RNA, 64 nt, Human
uccaggacuuccuuuuaauggaggaugggcuuuuaaaccacaucaucuuguacaacaaccauau

SEQ ID NO: 112326 - RNA, 64 nt, Human
ugcaaaaugucuccugaaauaagggaaaaaaaaaaaaccacaacuuugaaaaucuuaauguuga

SEQ ID NO: 112327 - RNA, 64 nt, Human
aauaauaaaaauuuaaaaaaauuaaaaauaaaaaaaaccacagaaaacaacuuuacauguauau

SEQ ID NO: 112328 - RNA, 64 nt, Human
uugcacauuagagaauugguccuggaagggaaagaaaccacagauuuuauuucaguacacaaau

SEQ ID NO: 112329 - RNA, 64 nt, Human
ccagaacaggacuccacacagcguuugccaccagaaaccacaagcaaaaucuggaucuugggac

SEQ ID NO: 112330 - RNA, 64 nt, Human
aaaaaaaaaaaaaggaaaaaaccaaaagcauaaaaaaccacagcaaauuucuugaugaaaauug

SEQ ID NO: 112331 - RNA, 64 nt, Human
uuagaagacagugugacuccuaccaaagcugucaaaaccacagggguucuuuccagcccuuguc

SEQ ID NO: 112332 - RNA, 64 nt, Human
agagacaucugauuuguuuaucaccuuagcagaaaaaccacaguccaaaagacaagcaaauuaa

SEQ ID NO: 112333 - RNA, 64 nt, Human
aggggaacaaaaaaaaaaauaucugaauuuugaaaaaccacaaagcuacaaacugacccucuuu

SEQ ID NO: 112334 - RNA, 64 nt, Human
agaguuuuauguuguauuuagaauuucaaccuagaaaccacacaguacuuaaauucuccugggg

SEQ ID NO: 112335 - RNA, 64 nt, Human
uguagaaaagugcuugucaguuguugaauaaaaaaaaccacauuugauagagauucaaaagacu

SEQ ID NO: 112336 - RNA, 64 nt, Human
uugcuucccucccaucagucugguugacaggaagaaaccacaccaucaacaccaacaaguuucu

SEQ ID NO: 112337 - RNA, 64 nt, Human
cauuguuuaaaaccaucacuuuuuugucuuugggaaaccacaggaacaauuucucuggagacaa

SEQ ID NO: 112338 - RNA, 64 nt, Human
agcugagcuaaauugaaucccuguccuuggaggaaaaccacauuuccagaagcauguuaguuua

SEQ ID NO: 112339 - RNA, 64 nt, Human
ccuccucucuucuuaguaacuucuuucuguggcaaaaccacaauucuuuaagauuccuauuguu

SEQ ID NO: 112340 - RNA, 64 nt, Human
uuuaacaauaaaauuaaaacaacuguuaaacuaaaaaccacaccguuuuccaguacuugaucuc

SEQ ID NO: 112341 - RNA, 64 nt, Human
gauaguuaaaaauacgucauuuuaaagauuucccaaaccacaccacuaaauuuguuuuaugaau

SEQ ID NO: 112342 - RNA, 64 nt, Human
aaagaauauaggauguuuacagugaauaauuuuaaaaccacaaacauagcagaaauguacuuua

SEQ ID NO: 112343 - RNA, 64 nt, Human
aaggucgcuggaugcugaucuaaucaguagcuugaaaccacaauuuuaaaaaugugacuuucuu

SEQ ID NO: 112344 - RNA, 64 nt, Human
uucuacccuguuuguugugucuugcuauacagaaaaaccacauuucuuuuauauacuguacgug

SEQ ID NO: 112345 - RNA, 64 nt, Human
aaaaaagaaaacagaaaaaaauucagacccugcaaaaccacauuccccauuuuaacgggcguug

SEQ ID NO: 112346 - RNA, 64 nt, Human
ccuacaggacguacacaauauccugcugcugggaaaaccacagcauuuuaucuauuuuuuauuu

SEQ ID NO: 112347 - RNA, 64 nt, Human
accuuuccaguuuauaagacuggaauauaauuucaaaccacacauuaguacuuauguugcacaa

SEQ ID NO: 112348 - RNA, 64 nt, Human
uguguaaaaacaacaaaaacaaacaaaagcaagaaaaccacaacuaaaacuggaaauguauauu

SEQ ID NO: 112349 - RNA, 64 nt, Human
agugaaacuccauuuacagcaaccccauaguauaaaaccacaaugccucauuguaaugggauau

SEQ ID NO: 112350 - RNA, 64 nt, Human
aaggagucucagggaugccuaugcugcuggccuaaaaccacacucagaaacgaggaccuagaag

SEQ ID NO: 112351 - RNA, 64 nt, Human
uauauagaucuacauaaaaacugcuacaugacaaaaaccacaccuaaagaaauuuuaagaauuu

SEQ ID NO: 112352 - RNA, 64 nt, Human
aaaggcaacaagcaugcagccagcaagcuucggaaaaccacagcaucaaagacaucccaaauaa

SEQ ID NO: 112353 - RNA, 64 nt, Human
uuuguuuucaaaagcaguugaguaacagcaacauaaaccacauuuuuuaaaaaaaugagcacuu

SEQ ID NO: 112354 - RNA, 64 nt, Human
uucuaaacagcaguuaagcuacaaaaagcaaacaaaaccacacauauugauggagucugcauuc

SEQ ID NO: 112355 - RNA, 64 nt, Human
uagaaauacacguaugguuaauguucaguccaacaaaccacacacaguaaauguuuauuaauag

SEQ ID NO: 112356 - RNA, 64 nt, Human
auugucauuugggcuuucuguugaaugaaucaacaaaccacaauacuuccugggaccuuuugua

SEQ ID NO: 112357 - RNA, 64 nt, Human
ccgaaggcauuuuccacuaguuuuuggacuauguaaaccacauuguacuuuuuuuuacuuuggc

SEQ ID NO: 112358 - RNA, 64 nt, Human
gccuugccucauaacaguggaauuucugauagacaaaccacaggacuuugauuuuaagccaaau

SEQ ID NO: 112359 - RNA, 64 nt, Human
uaacuugcccugggggccuuuuuuuaaaaaacaaaaaccacaaaaauucccaaaccauacuugc

SEQ ID NO: 112360 - RNA, 64 nt, Human
cuuuuauuaccaacacacuggcuggaaaagggacaaaccacaucacgggugagugauacuucuc

SEQ ID NO: 112361 - RNA, 64 nt, Human
aagaugaaccaacuuaguaacuguuuaaacaaagaaaccacauuuuuaaaauuaccuuguggca

SEQ ID NO: 112362 - RNA, 64 nt, Human
aacaaccuggccgcguuuagaccaaggaacaaaaaaaccacaaaggccaaacugcuggacgucu

SEQ ID NO: 112363 - RNA, 64 nt, Human
cugguagcaagagagaaaaaaucaacagcaaacaaaaccacacaaaccaaaccgucaacagcau

SEQ ID NO: 112364 - RNA, 64 nt, Human
aaggaauguaaaaugcaaaaauuaaaacaaucuuaaaccacauaaccaagcauugugaacugua

SEQ ID NO: 112365 - RNA, 64 nt, Human
ugccuacugugacuucaugcccuuuugggauaagaaaccacaaaacgcauggaacaacuaucca

SEQ ID NO: 112366 - RNA, 64 nt, Human
ugcuuuuugcguacacagagaaggcuauguaaacaaaccacagcaggaucgaaggguuuuuaga

SEQ ID NO: 112367 - RNA, 64 nt, Human
ggagagaagaaaagggaaagaagcugaaaauguaaaaccacaccagggaggaaaaaugacauuc

SEQ ID NO: 112368 - RNA, 64 nt, Human
cucccugccggccucagggagcgaacguggaugaaaaccacagggauuccggacgccagacccc

SEQ ID NO: 112369 - RNA, 64 nt, Human
auugucaucaggagaaaaagccuccaguccaaggaaaccacagcugcuggagacuccuaggcag

SEQ ID NO: 112370 - RNA, 64 nt, Human
gcacagaggaugccccaacaaacucauggcguugaaaccacacaguucucauuacuguuauuua

SEQ ID NO: 112371 - RNA, 64 nt, Human
uuaauccuuuugguagaaaucagguuacaaagcaaaaccacaauaucagcaacacuuccuaauc

SEQ ID NO: 112372 - RNA, 64 nt, Human
ggagauauaccaauaacaguaauaauuauuuaaaaaaccacacacaccagaaaaacaaaagaca

SEQ ID NO: 112373 - RNA, 64 nt, Human
agccaugugccuuaguguccuucuuaacagacucaaaccacauggaccacgaauauucuuucug

SEQ ID NO: 112374 - RNA, 64 nt, Human
ccuaacuaccauaaugaaugcugcauauuaagagaaaccacaagaagguuauauguuugguugu

SEQ ID NO: 112375 - RNA, 64 nt, Human
gugaucucugcuucauuagucauggguggaagaaaaaccacaccccccgcaccccuccguucuu

SEQ ID NO: 112376 - RNA, 64 nt, Human
ucuucacuucccuuugcaucugagauccugcuggaaaccacagcaaccuguauccacuauuagg

SEQ ID NO: 112377 - RNA, 64 nt, Human
cuauaaaacaaacauaguaucugucaaucucuagaaaccacaagaugauggagaggucauaaaa

SEQ ID NO: 112378 - RNA, 64 nt, Human
guuucccgccugggccauccaaccuugaaguccuaaaccacaccucagucacuaaaggucuguu

SEQ ID NO: 112379 - RNA, 64 nt, Human
aauaaucucaaaaagauguacaaguuauaccuguaaaccacaaaagugaagccugaggcuucug

SEQ ID NO: 112380 - RNA, 64 nt, Human
uuguucagauguuucaaugccucaugauacaauaaaaccacaaaaauuuucuuaacaguuuaaa

SEQ ID NO: 112381 - RNA, 64 nt, Human
auaugcaacauagacauugccauaacagaauaauaaaccacaugugggguuuuaaaaaugaaau

SEQ ID NO: 112382 - RNA, 64 nt, Human
aggguagaaaaaagggacauuaaaauuaaaagcaaaaccacaagaagggaaagaccgcaacucg

SEQ ID NO: 112383 - RNA, 64 nt, Human
cccugcccuugcccuuucccuuucccugggguccaaaccacauguguccugccucuccuggccc

SEQ ID NO: 112384 - RNA, 64 nt, Human
cagaucugggcuccaagccaggaaaggugaacagaaaccacaaguguccagcccucggugcugg

SEQ ID NO: 112385 - RNA, 64 nt, Human
cgucaauugcacaccggugcuguugggagugaccaaaccacaugaaccagacuuuucccgucca

SEQ ID NO: 112386 - RNA, 64 nt, Human
uuuaauguauaaaauguugucaaaccaagggaaaaaaccacaguucaccauguggaguuuacuu

SEQ ID NO: 112387 - RNA, 64 nt, Human
guuuaaaugaucauagccuagcaggauuggauuaaaaccacaggcuuuugcagcuggaaugggg

SEQ ID NO: 112388 - RNA, 64 nt, Human
cucuccaggugggcauaaggaguaacagauggcaaaaccacaaacuauuuugauggacugugcu

SEQ ID NO: 112389 - RNA, 64 nt, Human
cauccgaaucagggcuucuaccacugcugaugcaaaaccacaaagggaccuaccugagccaccg

SEQ ID NO: 112390 - RNA, 64 nt, Human
uccggccccacuucguucucaguuccacugguuuaaaccacagcacauccucuuagaaucaaac

SEQ ID NO: 112391 - RNA, 64 nt, Human
gcuguggcgauggcuacagcaauggucagcuuggaaaccacagugaagaagacagcacugauga

SEQ ID NO: 112392 - RNA, 64 nt, Human
acauaccucaaaauaauaagagccaucuaugacaaaaccacagccaacaucauacugaaugagc

SEQ ID NO: 112393 - RNA, 64 nt, Human
uaccucacaucacagugcugguagaaauggaacuaaaccacagucuguaaucccaggaguccag

SEQ ID NO: 112394 - RNA, 64 nt, Human
aguucauuuauugaugcauugguuggacacaauaaaaccacaauuguuaucaaaaaguuucccu

SEQ ID NO: 112395 - RNA, 64 nt, Human
aaauuuaugugauggcaaagaaggagagcauaggaaaccacacagacuugggcaggguacagac

SEQ ID NO: 112396 - RNA, 64 nt, Human
gcuguggugauuggcccuguggucuaucaggcgaaaaccacagauucuccuucuaguuaguaua

SEQ ID NO: 112397 - RNA, 64 nt, Human
cuccucugggcaggaccucagaguccaggccccaaaaccacagcccugucagugcagcccgugu

SEQ ID NO: 112398 - RNA, 64 nt, Human
ucgcaacaaugagaauuguucacauggccccugaaaaccacaccuuccuuuucaccuucuuggu

SEQ ID NO: 112399 - RNA, 64 nt, Human
auacuggagagagaaauuacccauuucuaaaaaaaaaccacacucugucguaucuguguuaaug

SEQ ID NO: 112400 - RNA, 64 nt, Human
auccaggcaagaacuaauucaaaaggcagaucagaaaccacaggagucaaaauuauugcuccgg

SEQ ID NO: 112401 - RNA, 64 nt, Human
aggaaaaguaguguaaacaguagcgagaaaauggaaaccacagaggaagauguauuuugcaugu

SEQ ID NO: 112402 - RNA, 64 nt, Human
uuuagaggacuucauacaaagcugggcauuaagaaaaccacaaugcauggccgggcgugguggc

SEQ ID NO: 112403 - RNA, 64 nt, Human
ccugggaagaggaauauuaagacaucuuaacaacaaaccacaacauugccugcaugucuaaaag

SEQ ID NO: 112404 - RNA, 64 nt, Human
uugggccauuaccccauaccccuuauugcugccaaaaccacaugggcugggggccagggcugga

SEQ ID NO: 112405 - RNA, 64 nt, Human
ucugcuaauaguagggcuaguuccaauucucauuaaaccacauuguaaacaguaguuacaguag

SEQ ID NO: 112406 - RNA, 64 nt, Human
aaaugagcagauuucuuuccauugugggcucuggaaaccacauggcuucaccuguccccgaaac

SEQ ID NO: 112407 - RNA, 64 nt, Human
uuggguuccuuggccucacucucuguaagcauauaaaccacaggcgaaagaggaugcugcauug

SEQ ID NO: 112408 - RNA, 64 nt, Human
uguccagcccccgcccuugcacuggacuacgccaaaaccacacugaccaggcacuugccuuccc

SEQ ID NO: 112409 - RNA, 64 nt, Human
ugaauuagaaaggcauauccagacccuauuaaagaaaccacaggguuugauucugguuaccagg

SEQ ID NO: 112410 - RNA, 64 nt, Human
gcagcccccuccccgcucccaccucccugcugggaaaccacagcauuaucacagcauuauugug

SEQ ID NO: 112411 - RNA, 64 nt, Human
ugcguucuaucuucucucuccuccuuguuccugcaaaccacaagauaaagguaguggugugucu

SEQ ID NO: 112412 - RNA, 64 nt, Human
aaggggggcaggaaucccgggugcuccacugcuuaaaccacaggaccugguuaacuccucacca

SEQ ID NO: 112413 - RNA, 64 nt, Human
uuucccacccccuacauuaggaggauaauuucuuaaaccacauuguuuuaauugauuuuucuua

SEQ ID NO: 112414 - RNA, 64 nt, Human
ccuggcccacucuccucucuccuucugcaguucuaaaccacagucuauaagcccgagucaccag

SEQ ID NO: 112415 - RNA, 64 nt, Human
auguuuugaaauacucguuacuaaagcuguuuauaaaccacaggugccauaagauccccaaacg

SEQ ID NO: 112416 - RNA, 64 nt, Human
guuuuaaucaguguucaacucuuaugcuacauuaaaaccacacuggauccggauacguauggug

SEQ ID NO: 112417 - RNA, 64 nt, Human
accccaccaaaauauuacuuuuaaaaacaaugacaaaccacacaauuguuguugaguaaaccac

SEQ ID NO: 112418 - RNA, 64 nt, Human
gaacaggcugaaauuucuuguucauaagauuaugaaaccacaugagaagugauaaaauguuugu

SEQ ID NO: 112419 - RNA, 64 nt, Human
ucauuuuauauuaaauuucuguguauauaauguaaaaccacaauuuuugaauaaaauuuaguuc

SEQ ID NO: 112420 - RNA, 64 nt, Human
auugcagaagcacaagccauacaucgcagguaggaaaccacagaaccgucugcaaggagcaagc

SEQ ID NO: 112421 - RNA, 64 nt, Human
uucuggggagagauguuguguuuacguuacacuaaaaccacaugugcaacaaauaccuccauua

SEQ ID NO: 112422 - RNA, 64 nt, Human
ugaauagaauacaauaaaacaaaacaaugacacaaaaccacaaucaucaucauaaucguaucca

SEQ ID NO: 112423 - RNA, 64 nt, Human
aucgacauauauuaggugcguguacuguuucuaaaaaccacaaacuaagaaugauaaauuauca

SEQ ID NO: 112424 - RNA, 64 nt, Human
auugggaggguacaggcaacaggagaaaggaaucaaaccacagaaaaauacaaagggaaacuuc

SEQ ID NO: 112425 - RNA, 64 nt, Human
acuuacauagacagaaaguagguuuuggaaagggaaaccacagagauuagggggacuuaaaauu

SEQ ID NO: 112426 - RNA, 64 nt, Human
ugaugcucagaaucgccuaccugugccugcguguaaaccacagccucagaccagcuauggggag

SEQ ID NO: 112427 - RNA, 64 nt, Human
gagggauuaacucagucauggcauucuccgaccaaaaccacaccugugucucuggcaggcuggc

SEQ ID NO: 112428 - RNA, 64 nt, Human
auuggaagauccaccuuaacgaccgugcauaugaaaaccacagucuaaggaagugacugcagaa

SEQ ID NO: 112429 - RNA, 64 nt, Human
ggugggcacccacccugggaccuaggggcgccgcaaaccacacuggacuccggcccuccuaccc

SEQ ID NO: 112430 - RNA, 64 nt, Human
auguaauccagcauauaaacagaaccaaagacagaaaccacaugauuaucucaauagaugcaga

SEQ ID NO: 112431 - RNA, 64 nt, Human
auaguacguagaccuucuaauacucugcuaaaugaaaccacacuuguuaucugaaaguguguga

SEQ ID NO: 112432 - RNA, 64 nt, Human
ccagcacccaugauacagggccuaccaaugcuuaaaaccacacccagggagcccacagaggcac

SEQ ID NO: 112433 - RNA, 64 nt, Human
uccucggcggacucugcugaccuccugcagacccaaaccacagccacaucccagcuucugugcc

SEQ ID NO: 112434 - RNA, 64 nt, Human
gaggaagagccacaaaacaaaacacaacaaaaccaaaccacagaaucaucuuuaacccaacuuu

SEQ ID NO: 112435 - RNA, 64 nt, Human
aauggaaaaacccuuccaguaauuaaaaaggaagaaaccacagaaagaaaacuacagaccucaa

SEQ ID NO: 112436 - RNA, 64 nt, Human
uuucagggcuauguugguccuuuguuuaccuccuaaaccacagcuguuuguguuucacauaugu

SEQ ID NO: 112437 - RNA, 64 nt, Human
cgcgcccgccucgcacagggccggggccuggaccaaaccacaugaacuggacugagagggggaa

SEQ ID NO: 112438 - RNA, 64 nt, Human
cugucaggaccaccuuugggagugucauccuuacaaaccacagcaugcccggcuccucccagaa

SEQ ID NO: 112439 - RNA, 64 nt, Human
ucugaauguuaaacuacucuugaauuccuggaauaaaccacacuuaguccugauguacuuuaaa

SEQ ID NO: 112440 - RNA, 64 nt, Human
augugauuuaucacauacacagaacuaaaaacaaaaaccacaugaccaugaucaucucuuuaga

SEQ ID NO: 112441 - RNA, 64 nt, Human
ucaaugucauugcuccucaaggaacuguagaguaaaaccacaaugugcugucacucuagacagu

SEQ ID NO: 112442 - RNA, 64 nt, Human
agagcgagacuccaucucaaaaaaaaaaaaaaaaaaaccacauaggcucagucuuuucaguauc

SEQ ID NO: 112443 - RNA, 64 nt, Human
aucugcugcuuguuuuuguaaauagaguuuuaucaaaccacagccaugcuuacuuguuuagcua

SEQ ID NO: 112444 - RNA, 64 nt, Human
aaacaaaggaagaggaaauauagggaagagaaagaaaccacagcuucuuuuagacuugucugac

SEQ ID NO: 112445 - RNA, 64 nt, Human
guguuuuccucuuggacauuguuguauuucaaauaaaccacaaaucaucauuuuccaccgagcc

SEQ ID NO: 112446 - RNA, 64 nt, Human
gcugauuuugucugcccaauccauccugcucaggaaaccacaaccuugcaguauuuuuaaauau

SEQ ID NO: 112447 - RNA, 64 nt, Human
ccuucauugccacaucagaguugaugcugggcacaaaccacaugaguaucaggaauauggagag

SEQ ID NO: 112448 - RNA, 64 nt, Human
gcuccauggcguggagggcacgggugccacccacaaaccacaccaggaggcgcugcagccacca

SEQ ID NO: 112449 - RNA, 64 nt, Human
aggugcuaaaccucucugaccuguguacauucacaaaccacagcuagaauuccuccaccuagga

SEQ ID NO: 112450 - RNA, 64 nt, Human
uuuucuuguuaaaaaacaaaaaacaaaaaacaaaaaaccacacacacauuuuguacgggguggg

SEQ ID NO: 112451 - RNA, 64 nt, Human
ccacuccaagagccagccccuuucugcuccacaaaaaccacaguuauuggaaaagcucccugcc

SEQ ID NO: 112452 - RNA, 64 nt, Human
ucugauuuugagcucaaucucugcaggaugggugaaaccacaugggguuuuggagguugaauag

SEQ ID NO: 112453 - RNA, 64 nt, Human
ugcagaacccugcaggcagccccaggcuuugcagaaaccacacacacuguugcuggaucuugag

SEQ ID NO: 112454 - RNA, 64 nt, Human
agaaaaagcaaaacaaaacaaacaaacaagcaaaaaaccacaauuagacugacagcugacuuuu

SEQ ID NO: 112455 - RNA, 64 nt, Human
ccuugaaacacauaagaaaaugcaugcugaagagaaaccacacagauguaagguuuaugacaag

SEQ ID NO: 112456 - RNA, 64 nt, Human
uuagaaaaccuucaccuaggacuugacccuuaccaaaccacagagaauccaaaccaauccauga

SEQ ID NO: 112457 - RNA, 64 nt, Human
guggagagguuucucuagagguguaggggacuggaaaccacauccaggaaguacagcuuucucu

SEQ ID NO: 112458 - RNA, 64 nt, Human
guaccacaccagucagagucaagucaggaaauagaaaccacacuagguauuucaaacagagggg

SEQ ID NO: 112459 - RNA, 64 nt, Human
cagugauuucaauugcaccaugacuucuucacuaaaaccacaaaguccugcuuaaaacuaugga

SEQ ID NO: 112460 - RNA, 64 nt, Human
cagggaaggagaaaacagagaacugacaccuuugaaaccacagaauguguuacaugcagacucg

SEQ ID NO: 112461 - RNA, 64 nt, Human
ucuaccacucagagaaacaauggcuaagauaccaaaaccacagugccgacagcucuccaauacu

SEQ ID NO: 112462 - RNA, 64 nt, Human
cuuucaccuugagcaugcuucaggauuuuuuuuuaaaccacagaacuugaauacaugagggaac

SEQ ID NO: 112463 - RNA, 64 nt, Human
agggaaacaaaguuuacauuguccuguagcuuuaaaaccacagcugggcagggugagaagcuag

SEQ ID NO: 112464 - RNA, 64 nt, Human
aaauagaaauuauucuuuaucuugcaaagaauugaaaccacaugaaaugacuuaugggggaugg

SEQ ID NO: 112465 - RNA, 64 nt, Human
gcagaccgugauuuggaagagaggcaccugcuggaaaccacacuucuugaaacagccuggguga

SEQ ID NO: 112466 - RNA, 64 nt, Human
gauauucucagaucagccaucuugaaccaaagcaaaaccacaaguuacacuuucuuaaaauuug

SEQ ID NO: 112467 - RNA, 64 nt, Human
gccucuaaagaaaccagcuuuuugcacuaaagccaaaccacaccgcuguccccuuagccccaag

SEQ ID NO: 112468 - RNA, 64 nt, Human
gacuucucccauccgucgccuugggacuggccauaaaccacagacucucuccaggcucucaaga

SEQ ID NO: 112469 - RNA, 64 nt, Human
caggacucccauccaucgccuugagacugaccguaaaccacagacgcucuccagguucucaaga

SEQ ID NO: 112470 - RNA, 64 nt, Human
gccaguggggcuucccuggugcugcagcacuuguaaaccacacacacagccucucucccuggac

SEQ ID NO: 112471 - RNA, 60 nt, Human
gacaguguuacagcaauuaaucaaaaagaaaaaccacaggcccuuccccuuccccccaau

SEQ ID NO: 112472 - RNA, 50 nt, Human
acaugggccaguucuacugaaaaccacaugcaucuugaugcgaucgcacu

SEQ ID NO: 112473 - RNA, 64 nt, Human
ugagacuccgucucaaaaacaaaacaaaacaaaaaaaccacauaacauaaauuuaucaucucga

SEQ ID NO: 112474 - RNA, 64 nt, Human
guuguuuguuuuuguuguuuguuuccuuuaagaaaaaccacagggaccaagaaagaaaauauaa

SEQ ID NO: 112475 - RNA, 56 nt, Human
gcgcaagcccaucaaccugaaggcauaaaccacauccagccaccuccuucugauca

SEQ ID NO: 112476 - RNA, 64 nt, Human
aaaauauauuaaaaaaaaaaaagagaaaauacugaaaccacagacagugcaaagacucuccugc

SEQ ID NO: 112477 - RNA, 64 nt, Human
gacuaggggcugggggcggccacagacggccucgaaaccacagcccuuaccccaaucccacgag

SEQ ID NO: 112478 - RNA, 64 nt, Human
uucaacucccuauuuccaugcaaagacgcugggcaaaccacauguucugucugagccucaguuu

SEQ ID NO: 112479 - RNA, 64 nt, Human
ugccccaccaggguccuuagggaugcucuaggccaaaccacaguuuguaccaaaaaccuuguga

SEQ ID NO: 112480 - RNA, 64 nt, Human
uuuuauucuguaggcuuuuuacucaauuauguacaaaccacaaaucagguacuguauuuuagug

SEQ ID NO: 112481 - RNA, 64 nt, Human
uaauacuaaggaaccaacaaucuuccuguuuaaaaaaccacauggcacagagauucugaacuaa

SEQ ID NO: 112482 - RNA, 64 nt, Human
gucucccaaggacccaccaugcagaagugucaauaaaccacaaguucugaacucugucgcccga

SEQ ID NO: 112483 - RNA, 64 nt, Human
aaacaggcugcagucuggcacuuuuagaagacagaaaccacacucacaguccaaagcaguagaa

SEQ ID NO: 112484 - RNA, 64 nt, Human
uuugaccugcagaagaagaccugaugugcuaaugaaaccacaacguguaagccugucuuccuuu

SEQ ID NO: 112485 - RNA, 64 nt, Human
ugaauugcugaguuuuguguauccuuuaaauuaaaaaccacaaguguuuauuguagugguuaaa

SEQ ID NO: 112486 - RNA, 64 nt, Human
guucagaaaacacuagacccaggauugaaaaagcaaaccacagcagaaccauccuuuugucauu

SEQ ID NO: 112487 - RNA, 64 nt, Human
caccaaaccuacuaggucuucucauuacccauguaaaccacauguuagauaaauuuuugcaagu

SEQ ID NO: 112488 - RNA, 64 nt, Human
acucuuggcucccacagaacgcccagcgcuuuggaaaccacauccgcaaagcccugcuggacau

SEQ ID NO: 112489 - RNA, 64 nt, Human
ucaucacuuuggccauauucuauuuguuagaaguaaaccacaggucccaccagcuccaugggag

SEQ ID NO: 112490 - RNA, 64 nt, Human
gcaguaggucacccugccaaacaagcuaauauggaaaccacauguaacuuagccagacuauacc

SEQ ID NO: 112491 - RNA, 64 nt, Human
auuuuuuccucugcauuuacacacacacgcacacaaaccacaccacacacacacacacacacac

SEQ ID NO: 112492 - RNA, 64 nt, Human
uuuuaaaacaaacaaacaaacaaaacaaaaaagcaaaccacauuuguuaucucaaauuuugaug

SEQ ID NO: 112493 - RNA, 64 nt, Human
cucacucuagggcaccugaccuggccucuugccuaaaccacaaggcuaagggcuauagacaaug

SEQ ID NO: 112494 - RNA, 64 nt, Human
agugagcuuauucuuauuuuggauugauuuuccaaaaccacagcuucagcagcaacaaucagaa

SEQ ID NO: 112495 - RNA, 64 nt, Human
aucaggauacauuaaaaauacaauacagcacgucaaaccacagaauauuuauugaguaauaaac

SEQ ID NO: 112496 - RNA, 64 nt, Human
uuguuguuuaacuuguaaaugaaaaaauucucuuaaaccacagcacuauugagugaaacauuga

SEQ ID NO: 112497 - RNA, 64 nt, Human
aauaauuagggaaaauugauaaauaucugucaccaaaccacaagaaauccaaaaucauuuuagg

SEQ ID NO: 112498 - RNA, 64 nt, Human
uuuaauaaagcgaaaaacucaaccaaaugguacaaaaccacaguguaccauuaaaauaugcacu

SEQ ID NO: 112499 - RNA, 64 nt, Human
ugaagcccacuggcuugacuuguaaguucaaccuaaaccacaauccuagaccaucauggauuua

SEQ ID NO: 112500 - RNA, 64 nt, Human
uuaaacuccauaagucaucagggaaugcaaauugaaaccacagcgaggcuaugacuuacuuauc

SEQ ID NO: 112501 - RNA, 64 nt, Human
aaagaaaaauguauauagcugugaguuuaaacaaaaaccacaaacagacaaacaagaaaaaaag

SEQ ID NO: 112502 - RNA, 64 nt, Human
uguuauaugauacaugcauaacuugagcuacacuaaaccacaugacaguguuuaguuaauucuu

SEQ ID NO: 112503 - RNA, 63 nt, Human
aaagaaacaagguuuauauuaaauggaaauccauaaaccacaauuaauccuauuuugucaugu

SEQ ID NO: 112504 - RNA, 64 nt, Human
ucucauucaaagaggaauuauucaaaaguaaucaaaaccacaaaugcauuugguuuuugggcca

SEQ ID NO: 112505 - RNA, 64 nt, Human
ucagauuuuuuccucugcauuuacacacacacacaaaccacaccacacacacacacacacacac

SEQ ID NO: 112506 - RNA, 64 nt, Human
aaauaguaugugcucauuguaguacauuuuuuaaaaaccacaaaugagcaaagauuuuuuuaaa

SEQ ID NO: 112507 - RNA, 64 nt, Human
guucucuaaaccagucuccaggaagaagagaaagaaaccacacuggcuagugaagaagcaggag

SEQ ID NO: 112508 - RNA, 64 nt, Human
ccucgaacuacaggcccuaaagagaaauugccucaaaccacaagugcuguaacuuccuccccuu

SEQ ID NO: 112509 - RNA, 64 nt, Human
aagcacaacauuaugauuuaauaugcuuuuguugaaaccacagcuuuugugcccauuguuuuaa

SEQ ID NO: 112510 - RNA, 64 nt, Human
cagauguuguuuucagguuaauggacacgcaaagaaaccacagcacauacuucuuuucuuucau

SEQ ID NO: 112511 - RNA, 64 nt, Human
uucuucaaggagcauccgugaugcucaguguucaaaaccacagccacuuagugaucagcucccu

SEQ ID NO: 112512 - RNA, 64 nt, Human
caguaaaaauaacaaauacauguaacuguagauaaaaccacauacuaaaucuauaagacuaagg

SEQ ID NO: 112513 - RNA, 64 nt, Human
cagcaaagucacccuuacaaagaagcuaauauggaaaccacauguaacuuagccagacuauauu

SEQ ID NO: 112514 - RNA, 64 nt, Human
cauaggggccaauuucaaauaauaauuuuuuucccugauggaauuuaccuuaaucuguauauaa

SEQ ID NO: 112515 - RNA, 64 nt, Human
ugagauuuucuaauguaguuagaaguuucauugucugauggacacaauaugcccuuccgguucu

SEQ ID NO: 112516 - RNA, 64 nt, Human
ggcuucuggagcuugucaccauuggacagucucccugauggacccucagucuucucaugaauaa

SEQ ID NO: 112517 - RNA, 64 nt, Human
gaaaauccacccuggcaucugggcuccugaucagcugauggagcuccugauuugacaaaggagc

SEQ ID NO: 112518 - RNA, 64 nt, Human
acaccagggacaacagaccaggaggggcccccaccugauggaccuccagaaaaacggaucacag

SEQ ID NO: 112519 - RNA, 64 nt, Human
gcucagcacaugcccaguaaugcguguuguuuggcugauggaauaaagggcuuagggacuuccc

SEQ ID NO: 112520 - RNA, 64 nt, Human
cucuuaauggucauuuguguuagauuacaucaaacugauggauagccauugguauucaucuauu

SEQ ID NO: 112521 - RNA, 64 nt, Human
ccucaaggcugucuucaaggggcgggaccagaagcugauggacagugcggucuauguggagaug

SEQ ID NO: 112522 - RNA, 64 nt, Human
ugcuccugcagcauggucccugccuuaggccuaccugauggaaguaaagccucaaccacauuug

SEQ ID NO: 112523 - RNA, 64 nt, Human; identical to SEQ ID NO: 112522

SEQ ID NO: 112524 - RNA, 64 nt, Human
gaaguuguggcuuauguggaguuuacaugggccucugauggaagaaagcuaaucuguuuaguau

SEQ ID NO: 112525 - RNA, 64 nt, Human
uuaaaaacagcacuggcuggggcauucucauucucugauggagccaucaaugagauuuaacuua

SEQ ID NO: 112526 - RNA, 64 nt, Human
ucuugggacugaauggccaagaaccugcuacggccugauggauacucuuuccacuuccucucau

SEQ ID NO: 112527 - RNA, 64 nt, Human
uacccaacucugaucuugcgugcagggaugcuugcugauggaugaaagaccacaauaaaacaag

SEQ ID NO: 112528 - RNA, 64 nt, Human
guccuaggugaccccaucucugcugcuucugggccugauggagaggagaacacuagacaugcca

SEQ ID NO: 112529 - RNA, 64 nt, Human
aaguuugcuacaaaggggcugcaaagggaauaggcugauggagcuguucuguaugguacugugu

SEQ ID NO: 112530 - RNA, 64 nt, Human
uguauagacauuucucggguuccuaccuuugucucugauggaccauuuuccauuuaagacauuu

SEQ ID NO: 112531 - RNA, 64 nt, Human
cacaaagucaucaacuggaaaaaaagcaaaaacccacggccaaaauaaauugguacuguuuguu

SEQ ID NO: 112532 - RNA, 64 nt, Human
cuuaacucacaagagaacucaucauaaguacuugcugauggaagaaugaccuaguugcuccucu

SEQ ID NO: 112533 - RNA, 64 nt, Human
gcagccaugccucaugccacaccuucuucgcaaacugauggaccgggugggccuggccugagcu

SEQ ID NO: 112534 - RNA, 64 nt, Human
aagccugagaccugcuucacggccuucaccagcccugauggagagggcagcagcugccacgugg

SEQ ID NO: 112535 - RNA, 64 nt, Human
cccaaaugccuuaugucaaauaaagcagauugcacugauggacaucagacuugaaggaaauguu

SEQ ID NO: 112536 - RNA, 64 nt, Human
gguauuaggaaacuaagucuguggcucuucucugcugauggaaacagaagggcgccaagccaug

SEQ ID NO: 112537 - RNA, 64 nt, Human
ugaggaccggggcugaggccacacagauaggggccugauggaggagaggauagaaguugaaugu

SEQ ID NO: 112538 - RNA, 64 nt, Human
caaugccaggccaggaacugggaccaccaucuugcugauggaaggaacaacagguggcccagga

SEQ ID NO: 112539 - RNA, 64 nt, Human
cccuaaucugauacugccucacgucaauggugagcugauggacacaagaucaaauaaggcuaug

SEQ ID NO: 112540 - RNA, 64 nt, Human
gccugaacuuaaaaaguuggugcauuaguuguaucugauggauauaaauuugccuccuaguuca

SEQ ID NO: 112541 - RNA, 64 nt, Human
gugauuucuggacauugcccauggauaauucucacugauggaucucaagcuaaagcaaaccauc

SEQ ID NO: 112542 - RNA, 64 nt, Human
ggcagucaaguuaagacacuaacuuggcccuuuccugauggaaauauuuccuccauagcagaag

SEQ ID NO: 112543 - RNA, 64 nt, Human
acugggugaggauaacacaaguaaaacugugguacugauggacuuaaccggaguucggaaaccg

SEQ ID NO: 112544 - RNA, 64 nt, Human
ucaaaacccaccaugccccaggcucagcagcgugcugauggaaguggaagugccugaagucuua

SEQ ID NO: 112545 - RNA, 64 nt, Human
ugacaaaaaccagcagccaaauauuagaggucuccugauggaaguguacaauaccaccuacaaa

SEQ ID NO: 112546 - RNA, 64 nt, Human
aaugcccugcucugaacacgaagcuuaguauaaacugauggauaucccuaccuugaaagaagaa

SEQ ID NO: 112547 - RNA, 64 nt, Human
gagaugcccaagacccccgcuuccauagcgacggcugauggaaccgccccugguaccugcuggc

SEQ ID NO: 112548 - RNA, 64 nt, Human
cuuuuaaggcugcugagaauuucuggacuguguccugauggacgcagcaccaucaaagcccaga

SEQ ID NO: 112549 - RNA, 64 nt, Human
gaggguaccaggagagcuggcgaugacugaacugcugauggacaaaugcucugugcucucuagu

SEQ ID NO: 112550 - RNA, 64 nt, Human
gggauuuuuaaaaagccucuuuccaggaauggaacugauggauuccucucccacugccucaccc

SEQ ID NO: 112551 - RNA, 64 nt, Human
ugucagaaaucuguuguagacuguuaacuucuuccugauggaauuuauuuucugcaagaauuau

SEQ ID NO: 112552 - RNA, 64 nt, Human
uuguuugcauuuaauucauguuugagucucuuaacugauggaugcccacuugccuuaaagcagc

SEQ ID NO: 112553 - RNA, 64 nt, Human
aauaacaaucauugcacacugagucuuagcguuucugauggaaacaguuuggauuguauaauaa

SEQ ID NO: 112554 - RNA, 64 nt, Human
ccaguuuccaagugagaaggggagcagguguuuacugauggaaaagguauguugcuauguugau

SEQ ID NO: 112555 - RNA, 64 nt, Human
aucagacaaaaaauggaacagacguauuuggacacugauggacuuaaguauggaaggaagaaaa

SEQ ID NO: 112556 - RNA, 64 nt, Human
gucuucaugagucuccugggcccaaagccaucuucugauggaaggaagagaguagggccaguga

SEQ ID NO: 112557 - RNA, 64 nt, Human
gcugagcggcagaaacuugucucauaaauuggcacugauggagcaucagcuguggcccacagag

SEQ ID NO: 112558 - RNA, 64 nt, Human
cucucccauggagacaagggcaucaucuauggcacugauggacaggaggcccccaucuaugagc

SEQ ID NO: 112559 - RNA, 64 nt, Human
acuggauuuucagaccugcugaggaccguaaggccugauggaacacagaacugaacugagguuc

SEQ ID NO: 112560 - RNA, 64 nt, Human
acaugcccauuacuaacggcaaaagggggauucccugauggaaccauaauacccuuggaaauac

SEQ ID NO: 112561 - RNA, 64 nt, Human
aauguuggaguuuauaucacucauuccuguguaccugauggaaguugcauguucauguuuaagc

SEQ ID NO: 112562 - RNA, 64 nt, Human
gaggaaacugacauuugucauguucacuuaccugcugauggaauccagcuucaagagcauacuc

SEQ ID NO: 112563 - RNA, 64 nt, Human
gaaaagagggcaaguccugaaccuaaccaaugaccugauggauugcucgaccaagacacagaag

SEQ ID NO: 112564 - RNA, 64 nt, Human
gccugguugugauuaguucagguuacuagguguucugauggagugggacaguccaaguccagua

SEQ ID NO: 112565 - RNA, 64 nt, Human
ccgccugacuuuuucucauugccauuaguaaugacugauggaaaacccagccaccacugugaug

SEQ ID NO: 112566 - RNA, 64 nt, Human
gcccuggaagucucccaggucuucccucccuccucugauggauggcuugcagggcagccccugg

SEQ ID NO: 112567 - RNA, 64 nt, Human
auggguuucuccagagggaauugcagaguacuggcugauggaguaaaucgcuaccuuuugcugu

SEQ ID NO: 112568 - RNA, 64 nt, Human
gcuuagaaaaugaaugggaccaaaggcaucacuucugauggagaugaagccaucuugaaaguga

SEQ ID NO: 112569 - RNA, 64 nt, Human
agccuucugaccaucagccaagggaagcaggccucugauggagcaggcucuggcucuguaagga

SEQ ID NO: 112570 - RNA, 64 nt, Human
guccucugagguucugcuguugaguccuggguggcugauggaaugauugaggaggucuggucac

SEQ ID NO: 112571 - RNA, 64 nt, Human
gcacuugcaggcagaaugggaggaggacauggagcugauggaguccaggcugugcaagccccug

SEQ ID NO: 112572 - RNA, 64 nt, Human
uuaaaaaaaaauacaguauuuucauuuaaauucucugauggagggacaacaaugguuucaacug

SEQ ID NO: 112573 - RNA, 64 nt, Human
guaauuucccuuuagggagacgugauguucacuucugauggauucuucuuuuguguauuuccuu

SEQ ID NO: 112574 - RNA, 64 nt, Human
uagaagugcauuucugaauagaaaugggaggccucugauggaccuucuagaauuauaagucaca

SEQ ID NO: 112575 - RNA, 64 nt, Human
uccucuguuuuuguuucauaagccguugagacaucugauggacuuggcuuaggcccugcuggga

SEQ ID NO: 112576 - RNA, 64 nt, Human
aauagccacauuuaacuccagccuuggguuugaccugauggaaaauucccaugagagagugcuc

SEQ ID NO: 112577 - RNA, 64 nt, Human
aacauugaggccuuaaaaccugaggcuccugugccugauggaauucuuguaacauacacuugug

SEQ ID NO: 112578 - RNA, 64 nt, Human
agggggugggauggggguacucaauggaguaugucugauggaucccgaagaauggagaggaaca

SEQ ID NO: 112579 - RNA, 64 nt, Human
agguaagccugccagcugugagaagccuugguaacugauggacucauuuccugguccuuaaaga

SEQ ID NO: 112580 - RNA, 52 nt, Human
gcuggucuguggagcuguaguucugauggaaggagcugugcccacccuguac

SEQ ID NO: 112581 - RNA, 64 nt, Human
auguacaagcuauuauuuagaguguuuagaaagacugauggagaagugagcaccaguaaagauc

SEQ ID NO: 112582 - RNA, 64 nt, Human
uucaccugugaacccaaauaaaaugauuaaaguucugauggaaaaaucuugaauggaguauaag

SEQ ID NO: 112583 - RNA, 64 nt, Human
uguugccugcuuugugcuuucugcaccagacaaccugauggaacauuugcaccugaguuguaca

SEQ ID NO: 112584 - RNA, 64 nt, Human
uucauuguucuuggcugaggagaagcgggaguggcugauggaagcaccuaaaugaugccuuugu

SEQ ID NO: 112585 - RNA, 64 nt, Human
cauuuaggugaaagucaguguugcugugcaugcgcugauggaguagacgagugagcuuuuccgu

SEQ ID NO: 112586 - RNA, 64 nt, Human
guacaaguaacacaagucguuguaccucaguugugaccuucagcagauuuuaugaacuauaaga

SEQ ID NO: 112587 - RNA, 64 nt, Human
ugcccauaaaauaagcuuuauaaaaaccaauuuccugauggacuauuaaauucaucuuagaaua

SEQ ID NO: 112588 - RNA, 64 nt, Human
agcaaaauccuuuuauuugauucaugcauaacuccugauggagugucaaggaagacucauucac

SEQ ID NO: 112589 - RNA, 64 nt, Human
acauauaucagauaauuguagucaauuguacaaacugauggagucaccugcaaucucauauccu

SEQ ID NO: 112590 - RNA, 64 nt, Human
ucaguguuuuugaaacccacaguuuuaguuggugcugauggagggagggggaagucgaaggaug

SEQ ID NO: 112591 - RNA, 64 nt, Human
acggaagaagagaucaggaagagaaggagcagagcugauggagaaggaaggcuccaucuccagu

SEQ ID NO: 112592 - RNA, 64 nt, Human
acuauuacuuccuuuucacaugaccacaaguccucugauggaaauguacagcagaaacucuuga

SEQ ID NO: 112593 - RNA, 64 nt, Human
caugaagaggaaagguagaucugagcucaucucgcugauggacauucagauucauguauauuau

SEQ ID NO: 112594 - RNA, 64 nt, Human
auuauucauacauucauuuuaauaacauugaguacugauggauguuuugaaagugagcauucau

SEQ ID NO: 112595 - RNA, 64 nt, Human
aauuucucucuugccuugaggagcagaaaagcuucugauggacaugggcuucugugagacuuau

SEQ ID NO: 112596 - RNA, 64 nt, Human
uugcucacagccuaaccuggcguguuguuuagggcugauggagacccaugugagccuuugcuuu

SEQ ID NO: 112597 - RNA, 64 nt, Human
caguaauccccaggguacuaggauuacuaguacucugauggaacuagucuuccuuccuuauucc

SEQ ID NO: 112598 - RNA, 64 nt, Human
gacuuccaucuguuuuacugguaaaggaaauccucugauggacaggucagagugaaggaagguu

SEQ ID NO: 112599 - RNA, 64 nt, Human
cuucuacaugaugcuaaaggcugcgaaugggauccugauggaacuaaggacuccaaugucgaac

SEQ ID NO: 112600 - RNA, 64 nt, Human
caccaccacaauuaauucccuucccaacacuugccugauggaaaaaaaacaaaggaauuaaaac

SEQ ID NO: 112601 - RNA, 64 nt, Human
aaaugcuauuugauaacaguuacuccaguauaugcugauggaccaggaagcccugaauccauaa

SEQ ID NO: 112602 - RNA, 64 nt, Human
gccacuugagccaaauauaaaauuguauuuacagcugauggacucaauuugagccuucaaacuu

SEQ ID NO: 112603 - RNA, 64 nt, Human
agauauauuuuaaaguuauaaguagcaggauauucugauggaguuugacuuugguuuugggccc

SEQ ID NO: 112604 - RNA, 64 nt, Human
aguuguaacauaaaggcaaauccugaggaacucacugauggagaugugaaauggcaguaaggaa

SEQ ID NO: 112605 - RNA, 64 nt, Human
uuggacuuucaacaugcuccuuggcgagguagcucugauggaguuauuuuuuauuuccauguuc

SEQ ID NO: 112606 - RNA, 64 nt, Human
uauauuuuagagaagaaaugggucuaaagauagccugauggaagaaaaaccucagacaucuaca

SEQ ID NO: 112607 - RNA, 64 nt, Human
gaaaaagaaauagaguugcuccauucauauuggacugauggacugaaaacauugaugugauucu

SEQ ID NO: 112608 - RNA, 64 nt, Human
ggcuucauaacucuaccuggcuguggguuggaagcugauggaaugagaaauguccuuucuccuu

SEQ ID NO: 112609 - RNA, 64 nt, Human
auguuauauauuuuuuguaggggucaaagaaaugcugauggauaaccuauaugauuuauaguuu

SEQ ID NO: 112610 - RNA, 64 nt, Human
gcagcuucuccuccagacuccuagccccgaggugcugauggagaugcucaaggccagcaagccc

SEQ ID NO: 112611 - RNA, 64 nt, Human
uguaaauauaucuuaagcagguuuguuuucagcacugauggaaaauaccaguguuggguuuuuu

SEQ ID NO: 112612 - RNA, 64 nt, Human
ccugcaaaggcucugucagagacucacaucuuuccugauggauagcugugaagcauucucuuac

SEQ ID NO: 112613 - RNA, 64 nt, Human
gaagguugauuagcuugacugucuuugaaaguaucugauggagcuccugaugaccuaauguauc

SEQ ID NO: 112614 - RNA, 64 nt, Human
auccguuggaacuuugaaaaguuccugguggggccugauggaaucccugucaugcgcugguccc

SEQ ID NO: 112615 - RNA, 64 nt, Human
uacacuagcuucuagaacaagauaaccacugcugcugauggauacuuuucccucacugccaugg

SEQ ID NO: 112616 - RNA, 64 nt, Human
ccagagaaugccuaccauccaaaaaagcagucagcugauggaaaagaagauuauuaaaccuuug

SEQ ID NO: 112617 - RNA, 64 nt, Human
aaucuuauuuaauguauauuuguacuuucaaguacugauggagauagacucaaaacaguuauuu

SEQ ID NO: 112618 - RNA, 64 nt, Human
aggaaggaguuaauuaaaaugauuuuauuuuggucugauggauguuuuuuaaaaggaaaauuau

SEQ ID NO: 112619 - RNA, 64 nt, Human
ccuaacauauuaugcaauuuucucuuggugcuaccugauggaauuccugcacuuaaaguucugg

SEQ ID NO: 112620 - RNA, 64 nt, Human
gcguuggguguccauaaaauuugcaacaccacaccugauggaaaaauguaauugcuuaccugca

SEQ ID NO: 112621 - RNA, 64 nt, Human
ccagagguggauacuggggggcaggccucccaagcugauggacaugagaguagggcccugacag

SEQ ID NO: 112622 - RNA, 64 nt, Human
auucaagauauuuacauaccagaagcaucuaggacugauggaucacugucccgauucaaauuau

SEQ ID NO: 112623 - RNA, 64 nt, Human
caagacuccaauagacacucuuagagaaggauugcugauggauugauagugaaaccauuagauc

SEQ ID NO: 112624 - RNA, 64 nt, Human
uaugauaugccauguuucuuuauccauucaucagcugauggacaucuagguucuguucauuuuu

SEQ ID NO: 112625 - RNA, 64 nt, Human
cugagcgugcgggcgccgggaggggaugcugaggcugauggagcugccuccagggcuagggcca

SEQ ID NO: 112626 - RNA, 64 nt, Human
acugaaucccacuucaauacacacucaugaacuccugauggaacaauaacaggcccaagccugu

SEQ ID NO: 112627 - RNA, 64 nt, Human
uuuguaaaaauguccccacgguacuuacuccccacugauggaccagugguuuccagucaugagc

SEQ ID NO: 112628 - RNA, 64 nt, Human
agcucuggacuuuucuggccccuccugagaugaccugauggagcugaugcuuucucuccuaauc

SEQ ID NO: 112629 - RNA, 64 nt, Human
gcgggcucuuuuucugaugaggguacuugaagggcugauggacaggggucaggcaacuauccca

SEQ ID NO: 112630 - RNA, 64 nt, Human
gaauguuuuuccccgauuguggaugacuucuuuucugauggagagaguccaggagggauggaaa

SEQ ID NO: 112631 - RNA, 64 nt, Human
ucaucauuugcacaaacuugugagcaucagagggcugauggauuccaaaccaggacacuacccu

SEQ ID NO: 112632 - RNA, 64 nt, Human
gugguauguuuauuccacuguccagagcuauucucugauggauuugagcaacagcaguggagau

SEQ ID NO: 112633 - RNA, 64 nt, Human
ccucccugcaauugggcagcuccccuggaagaagcugauggaauucauauaucugucucucucc

SEQ ID NO: 112634 - RNA, 64 nt, Human
aauaauuaaaccauaaggaagaccauguauaaaacugauggaaauaauagucaccaaaguacag

SEQ ID NO: 112635 - RNA, 64 nt, Human
aacagcauaguacuggcacaaaaacacacguagacugauggaacagaauagagaauuuagaaau

SEQ ID NO: 112636 - RNA, 64 nt, Human
uuggcuauggcugaucuuuuuuaaauuuaacuuucugauggacccuguaguuuccaguuaagug

SEQ ID NO: 112637 - RNA, 64 nt, Human
gauuuaaugguagaacggauaccugcugcuagaccugauggaauguuaccuguccguguuacau

SEQ ID NO: 112638 - RNA, 64 nt, Human
caaaagacugaaaaauuauaauuuuagaauuaaacugauggauuucauuauagaauuaucugug

SEQ ID NO: 112639 - RNA, 64 nt, Human
uguuuauaacagugccuuaagguaugauguauuucugauggaagccauuuucacauucauguuc

SEQ ID NO: 112640 - RNA, 64 nt, Human
gcucuagaaccuugaccuugauaguucaccaccucugauggaucccuguuuuaaauaaaaacga

SEQ ID NO: 112641 - RNA, 64 nt, Human
uaaccuucccuaggcauugaaacuucccccaaaucugauggaccuagaagucugcuuuuguacc

SEQ ID NO: 112642 - RNA, 64 nt, Human
uuuuggagcagacuguuuuaaguugcucaggagccugauggaaccaugaaccgagacucuucuc

SEQ ID NO: 112643 - RNA, 64 nt, Human
ccuggagcacgggaggggaggugacggcuggugacugauggauggguagugggcugagaagagg

SEQ ID NO: 112644 - RNA, 64 nt, Human
agugccccaacaggacugauucauagccauaccucugauggacaagcagugauuccuuuggugc

SEQ ID NO: 112645 - RNA, 64 nt, Human
agaacugcuuucuuauagcacaaaacuacuuacucugauggaccaauaaugaagaaagcacuag

SEQ ID NO: 112646 - RNA, 64 nt, Human
cucccuccuucccagcccacccgggcagcagacucugauggaaggaaggugccguaggugggcu

SEQ ID NO: 112647 - RNA, 64 nt, Human
gagggaaacugauuagauggguuguguuuguguucugauggagaaaacagcaccccaaggacuc

SEQ ID NO: 112648 - RNA, 64 nt, Human
cuguaugggcacuagucccuuacagaugaccaugcugauggaucuauucaucuauuuauuuaaa

SEQ ID NO: 112649 - RNA, 64 nt, Human
cuagcaauuuuaagaggugucccuccaaagugaccugauggaaguccugaacuuggaaauuagg

SEQ ID NO: 112650 - RNA, 64 nt, Human
ugccacccaugcagcugcuccccaggccaccccgcugauggagccccaccuugucugcuaaaua

SEQ ID NO: 112651 - RNA, 64 nt, Human
uccugccugaggccacuuaucagggccuggagcccugauggaagccauaggaacuccagaguug

SEQ ID NO: 112652 - RNA, 58 nt, Human
augaaggagaagaugacuaaauagaacacugauggauuccaaccuuccuuuuuuuaaa

SEQ ID NO: 112653 - RNA, 64 nt, Human
guggugggaggugguuuucugacugagauguugccugauggauggaaagaaauguauuuuuaag

SEQ ID NO: 112654 - RNA, 64 nt, Human
ggcagggucgugcuccgucuccugcgggcgaggucugauggagcugcguuuccugugcauggac

SEQ ID NO: 112655 - RNA, 64 nt, Human
uggggagguucuuaguugcgaaggagccaagcuccugauggacuugcguugggaugugggggac

SEQ ID NO: 112656 - RNA, 64 nt, Human
cuagagguauggauggagcaaggucaaauaugagcugauggagcugggagcuaaauaaggguau

SEQ ID NO: 112657 - RNA, 51 nt, Human
ccagcuaccccaaugugugagcugauggauggugaggaggaaggacuuaag

SEQ ID NO: 112658 - RNA, 64 nt, Human
cuuucugaggcuucugcucuucaccuccugcucgcugauggaaaccuccagggcaaagcugaag

SEQ ID NO: 112659 - RNA, 64 nt, Human
aagagcaccagauccagaggggguuggguuugcugaccuucaucaugcauucauucauacagca

SEQ ID NO: 112660 - RNA, 64 nt, Human
uaccauuacugagugcauuuuggugugccuaucucugauggaugauugauugcuuuuaaaacuu

SEQ ID NO: 112661 - RNA, 64 nt, Human
gcaugggccaugugagaagaucgccaggaucuuccugauggaagcugacuugggcguggaaguc

SEQ ID NO: 112662 - RNA, 64 nt, Human
aauuccccagauacugaacaauuuguguuugugacugauggagaauuucaggaaugaaugagaa

SEQ ID NO: 112663 - RNA, 64 nt, Human
gacgaccucacccaaagggcucccuggcucuccucugauggaggggcacugcuugcuuggcccg

SEQ ID NO: 112664 - RNA, 64 nt, Human
aacuagguccaauaacaugcuucaugugagggaacugauggacagcugucuaauucauaaccuc

SEQ ID NO: 112665 - RNA, 64 nt, Human
gggcucaaguauccugccacucugucauguccugcugauggaaggugccccuguucccucauuc

SEQ ID NO: 112666 - RNA, 64 nt, Human
ccagacauaagacccccugaaaguaucaucccuccugauggaaugguaaagcaaucuuucuugg

SEQ ID NO: 112667 - RNA, 64 nt, Human
caguuggaacuugugcagcaaaguuugggagcuacugauggacaugugaaaaguaaguauaaau

SEQ ID NO: 112668 - RNA, 64 nt, Human
guugaggauauucuccaaguuguccucucuccugcugauggaaaugggaaugaaguuaaguggu

SEQ ID NO: 112669 - RNA, 64 nt, Human
uguucgcagauaccagugacaccagguggcuggacugauggagacgucuucagacaggagccgc

SEQ ID NO: 112670 - RNA, 64 nt, Human
agagccauuacccuuucaagccccuggucagguacugauggaguuccccaaaauugaaucugua

SEQ ID NO: 112671 - RNA, 64 nt, Human
cagaggagcacaggcgggcaggucacugcagagacugauggaaguuagagagguggaggaggcc

SEQ ID NO: 112672 - RNA, 64 nt, Human
aggugacuggaucuguguuccuccuuaacaucaucugauggaauggcaaugaaaagcguggauu

SEQ ID NO: 112673 - RNA, 64 nt, Human
ccccagcgcgccccuggcccugguucugucccagcugauggauggcuucuccaugcuggagaag

SEQ ID NO: 112674 - RNA, 64 nt, Human
ggguagaccaaaucaaaugcucacuggggucaggcugauggagacaguaacacuggcgagcagg

SEQ ID NO: 112675 - RNA, 64 nt, Human
ccaccaggcuuugucccccauggcucugcaggaccugauggagaaggugaugguucuuaacagg

SEQ ID NO: 112676 - RNA, 64 nt, Human
acuucaggggacacguuuaguauauuaagacaugcugauggaaacaguaucuucaaaaaaauca

SEQ ID NO: 112677 - RNA, 64 nt, Human
ugcaccagacccucacacaccacagcacugcaagcugauggaauguuccaguuaugauggacac

SEQ ID NO: 112678 - RNA, 64 nt, Human
ggugagaaguuugccuagaaagggcuucccggugcugauggagaggccgagacccuucuguugg

SEQ ID NO: 112679 - RNA, 64 nt, Human
cuaccuccccagaagccuuccuccccagguggggcugauggagcaaggguccagacuaggagcc

SEQ ID NO: 112680 - RNA, 64 nt, Human
aagaucucagaaccccgccccggccugucucuagcugauggagaggggcuacgcagcugcccca

SEQ ID NO: 112681 - RNA, 64 nt, Human
ucauuuucuccaucaacaaccagggagacugcaccugauggaaaagauauaugacugcuucaug

SEQ ID NO: 112682 - RNA, 64 nt, Human
cugggcagagcagcagagcaggcugccacugccccugauggaacucauggagaaugaagcucug

SEQ ID NO: 112683 - RNA, 64 nt, Human
uagagucucacugcuggggaggagaggacugggccugauggaaguuaacccggagcuaagucac

SEQ ID NO: 112684 - RNA, 64 nt, Human
gcgugggcucugccuugucuucgcggaagcauuccugauggaacacccacuggccagccaggcc

SEQ ID NO: 112685 - RNA, 64 nt, Human
gagcucucuuuacauuguuaguugucaaccuuggcugauggaaaucccguaaccacuauuuguu

SEQ ID NO: 112686 - RNA, 64 nt, Human
aagccuugauguuuucucuguacagcuaaguuuucugauggaaucuucaucucaccccauuuuc

SEQ ID NO: 112687 - RNA, 64 nt, Human
aguagcaggcaaagagggagcacacagcauuauucugauggaaaaagauuauccagggaauggu

SEQ ID NO: 112688 - RNA, 64 nt, Human
acaugguuucaaaaccccaaaagaguuaaaacaacugauggagaucagagcaaauuaugccaga

SEQ ID NO: 112689 - RNA, 61 nt, Human
gcugcucacgccuuuuuuagcaagccuucugcugauggaagcacuaggaugauucuaggcu

SEQ ID NO: 112690 - RNA, 62 nt, Human
ucaaguucuacagccuguaggcccuggcccuucugauggaagcugggccucaucucaguaga

SEQ ID NO: 112691 - RNA, 64 nt, Human
uguacugcaugugacuucuccccugcccuuccuccugauggagugugcagacagccaugcgugg

SEQ ID NO: 112692 - RNA, 64 nt, Human
aguggugauggccaucagacagagacuucaaaugcugauggagggcagaggaaguacuuaggga

SEQ ID NO: 112693 - RNA, 64 nt, Human
aaauauaaaaagaaauuauauauaucuugccucccugauggaaaacuauauaaaauuguagacu

SEQ ID NO: 112694 - RNA, 64 nt, Human
ucauaugguugaauaaauaauuauaaauugagcacugauggaaucccucuacaggucaagaaau

SEQ ID NO: 112695 - RNA, 64 nt, Human
agaguucgugaagagggaagccaggauuggggaccugauggagagugagagcaugugaggggua

SEQ ID NO: 112696 - RNA, 64 nt, Human
caacagggaaauucucauuuuggucgaugauauucugauggacugguuuggucuuaauaccagu

SEQ ID NO: 112697 - RNA, 64 nt, Human
aguguuuguuuauuaagaaucuuaaugcaguuuacugauggauuaaaaacagcuaacauugucu

SEQ ID NO: 112698 - RNA, 64 nt, Human
gguuuaaucuguuugaaaacuauccaguaaaaagcugauggaggccaauuacauggcgggugua

SEQ ID NO: 112699 - RNA, 64 nt, Human
uggauuuaaucucccacaguauucaugagaccaucugauggaaucagaucccugagccaccuug

SEQ ID NO: 112700 - RNA, 64 nt, Human
ugaagaccgcuucccugagacaggggcaguggugcugauggaaugugggggaggcccacauuug

SEQ ID NO: 112701 - RNA, 64 nt, Human
gaugcaagacaaccuccuagggauugaugccuaacugauggauucucuuugagacuauuuagau

SEQ ID NO: 112702 - RNA, 64 nt, Human
ccuccuccauuuagcuucaauaaagggccuuuugcugauggagggcacucaagggcugggugag

SEQ ID NO: 112703 - RNA, 64 nt, Human
gcuuaucugcaggauguuucagaucugauaaauccugauggaaacugguaugaucagaauucag

SEQ ID NO: 112704 - RNA, 64 nt, Human
acuugccuggggcggcaugaacccucuugccauccugauggaccugccccggaccuaccucccu

SEQ ID NO: 112705 - RNA, 64 nt, Human
gcuuagaaaaacccccuugacuuucucuaggaaccugauggaaaccugaaggagaugugggucu

SEQ ID NO: 112706 - RNA, 64 nt, Human
aaagaaaucucuacguuccugcccuuuacuauugcugauggagccugggggaaccaucacuuuu

SEQ ID NO: 112707 - RNA, 64 nt, Human
uggagcccccauauaacaucuuccugucagaagacugauggaucuuuuucauuccaaccaucuc

SEQ ID NO: 112708 - RNA, 64 nt, Human
uaaagguaggucuguuaacuuucuuuguguguuccugauggaauucaccauagccuuacagcuu

SEQ ID NO: 112709 - RNA, 64 nt, Human
cuuugggcauuuggcgauuagugaaaauucuauccugauggacuucuggaaaacugugacuggg

SEQ ID NO: 112710 - RNA, 64 nt, Human
uacuuugaucugucuuuuauuugauuguaaguugcugauggacagugaucauuagaaacugaau

SEQ ID NO: 112711 - RNA, 64 nt, Human
uuccccagcaguuuagugccugcugaaaagaucccugauggacaauacuucuugguggacucca

SEQ ID NO: 112712 - RNA, 64 nt, Human
cugggucauuugggaguggcucugcuaguagagacugauggagagagccagguggaaugccaua

SEQ ID NO: 112713 - RNA, 64 nt, Human
uucccaauuugacaaucguauuuuaaaauugaaacugauggaacauucuuucuuggucuucacc

SEQ ID NO: 112714 - RNA, 64 nt, Human
cuguggaauuacaagugagagacacuuuuaggaccugauggacaaagcaggagauucacuguca

SEQ ID NO: 112715 - RNA, 64 nt, Human
ggggggugcuuuuguacugggauuuaagacaccccugauggaaugaaagccaacugaaccacgu

SEQ ID NO: 112716 - RNA, 64 nt, Human
auuuuuguauauacuuuuaaagccuauucacuugcugauggaucuuugguuuguuuccagguuu

SEQ ID NO: 112717 - RNA, 64 nt, Human
gaauugcaaaauguuuacuuuccauagaucuggucugauggaauguuccuacugugcaacugca

SEQ ID NO: 112718 - RNA, 64 nt, Human
gaagacugucucaaaaaaaaaaaaauugaucaaacugauggauacccuaaguacccugacuuga

SEQ ID NO: 112719 - RNA, 64 nt, Human
cuguagaccauuauauacuccugaaguucuuuuucugauggaaaacaaaauucagcuuaaucgu

SEQ ID NO: 112720 - RNA, 64 nt, Human
gaggagaggaguuuucuccauaucaaaacgagggcugauggaggaaaaaggucaauaaggucaa

SEQ ID NO: 112721 - RNA, 64 nt, Human
cuggcuucuacuacugaaacaagaguuuagaucacugauggagaggcauaguaaucuguuugug

SEQ ID NO: 112722 - RNA, 64 nt, Human
aucacaugagcuuauauuuugggaacacauagaacugauggaggcuuuuccuaaggccaaggau

SEQ ID NO: 112723 - RNA, 64 nt, Human
cugcaugucgcuggcccaaggcuggacccugaagcugauggaaccaccuaauacuggugcugag

SEQ ID NO: 112724 - RNA, 64 nt, Human
gugcuguccgggugccagggcugcagggucgguacugauggaggcugcagcgcccggugcucug

SEQ ID NO: 112725 - RNA, 64 nt, Human
auugccuugugggccugagagauuccuggcuuuucugauggaccuauuuaggacaaccucucua

SEQ ID NO: 112726 - RNA, 64 nt, Human
augccuguaauccuagcacuuugggaagccaaagcugauggaucgcuugagcccaggaguuuga

SEQ ID NO: 112727 - RNA, 64 nt, Human
uauuuuucagaggauuugacacgauaagccucaucugauggaagagaggaauaaauaauucacc

SEQ ID NO: 112728 - RNA, 64 nt, Human
uagaaaugguucagaaacucauaggcacccuuagcugauggaaacaaucaaucauauuuaauac

SEQ ID NO: 112729 - RNA, 64 nt, Human
uccacuucacuccagcaucaacaaguggggaauucugauggauucaauucgacuucuuuccaug

SEQ ID NO: 112730 - RNA, 64 nt, Human
caaccuggagaccaggauuuuauggcuccccucacugauggacaaggaggucugugccaaagaa

SEQ ID NO: 112731 - RNA, 64 nt, Human
aaauuaaguagcaauuaaaguguuuuccugaacacugauggaaauguauagaauaauauuuagg

SEQ ID NO: 112732 - RNA, 57 nt, Human
uccuuggccaaccacgauagagaaguccugauggaugaacuuuugaugaaagauugc

SEQ ID NO: 112733 - RNA, 64 nt, Human
aguauugugguguauuuuuaagauuaaagguacacugauggacaaaaaaaaaaaguaaaacaug

SEQ ID NO: 112734 - RNA, 64 nt, Human
auuuuacuaaaguccuccugccagguaguucccacugauggaaauguuuauggcaaauaauuuu

SEQ ID NO: 112735 - RNA, 64 nt, Human
gauguguuuuggcagaugagcuuucagcugaggccugauggaaauugagauaaccugcaaagac

SEQ ID NO: 112736 - RNA, 64 nt, Human
gaugcugaaagcagauuucuucuugauuucacuucugauggaugcauggggcucugggggaaug

SEQ ID NO: 112737 - RNA, 64 nt, Human
cgguuugaagccuggaacaucaucaaggcacugccugauggaccugucacgauugucaucagga

SEQ ID NO: 112738 - RNA, 56 nt, Human
uacaguccuacuuggacugaacaggccugauggagcuuguggcuggccucagauac

SEQ ID NO: 112739 - RNA, 64 nt, Human
uuggcaucuaguccaaacaagacugaagaaugugcugauggagcagugcuguuucugcauucau

SEQ ID NO: 112740 - RNA, 64 nt, Human
acagggacuggcuucucaccaccagccuuuccgucugauggacagcagaccccgccuccagcac

SEQ ID NO: 112741 - RNA, 64 nt, Human
cagagacaacagguaaaacagggccacauagaugcugauggagccuucccaaguugugcuugag

SEQ ID NO: 112742 - RNA, 64 nt, Human
gaagcuauuuaacauggugcugagcuagccaggacugauggagccccugggggugugggaugga

SEQ ID NO: 112743 - RNA, 64 nt, Human
cacgcagaggccuguguucacucuuuggaacaagcugauggacugcgcaucucugagaaugcca

SEQ ID NO: 112744 - RNA, 64 nt, Human
aggaggccauuuacaaggggaucuggaugaccugcugauggagauccagcuugccagggacuua

SEQ ID NO: 112745 - RNA, 64 nt, Human
uuuuggcauucuugcugacucugacagagugauucugauggacuuguauuuaaauuguaugugu

SEQ ID NO: 112746 - RNA, 64 nt, Human
acagguggauccccaauaaucuguuuuugguuuucugauggaaauaauagaauuaggggaaauc

SEQ ID NO: 112747 - RNA, 64 nt, Human
uagcaguuguuugaaguuuucagggauaacauaccugauggagaaauguuuuguguguaugaua

SEQ ID NO: 112748 - RNA, 64 nt, Human
caucauggcuuuagaagcugguacauuuacugagcugauggacaguggccuucuaaaauaugac

SEQ ID NO: 112749 - RNA, 64 nt, Human
caggauagcuucggcauccaaucugcgaaggccccugauggagcuauuucuuccuaguaucagg

SEQ ID NO: 112750 - RNA, 64 nt, Human
cuguggucuuguugagcugauggccuugguugagcugauggacaagugaaggaggccauggggc

SEQ ID NO: 112751 - RNA, 64 nt, Human
caucaccaugaugugguagcuugugacuuuucuccugauggagcauuacuggcuacugcaucuu

SEQ ID NO: 112752 - RNA, 64 nt, Human
aguauauaucugggauccacauaauggagacauucugauggaauuuggguggguacagcaugaa

SEQ ID NO: 112753 - RNA, 64 nt, Human
ggaaaauucuguuuuucauagauucuuugagaugcugauggaccagcuucagcauguuugaggu

SEQ ID NO: 112754 - RNA, 64 nt, Human
cccucaggccgagggugcagacugaugcucuucccugauggagacccugagaucuuccccaccc

SEQ ID NO: 112755 - RNA, 64 nt, Human
uuccugccccagacagacuucaucauugugcuagcugauggacaggugucugagaugggcccgu

SEQ ID NO: 112756 - RNA, 64 nt, Human
cuccgcuggacucacaacugucuggaguuucugucugauggauggugugcuuucauaugccacu

SEQ ID NO: 112757 - RNA, 64 nt, Human
accccucgggacccgggacauuagucucaggcugcugauggauugauuugacaugaaccaaaca

SEQ ID NO: 112758 - RNA, 64 nt, Human
ccuggagaagaucgccuucauccccuuuggcuaccugauggaccuccuucgcuggaaggucuuu

SEQ ID NO: 112759 - RNA, 64 nt, Human
ccaacccugaacaagaccuuacaugagagauggacugauggacugcggcaauccugggcuguca

SEQ ID NO: 112760 - RNA, 64 nt, Human
agggagugucucacaggauugcaccugugacauccugauggaugcuucccuguggcccuccugg

SEQ ID NO: 112761 - RNA, 64 nt, Human
acuugguaagaugacucugagaaaaugcgagacucugauggaaugugccaccuguccggcccag

SEQ ID NO: 112762 - RNA, 64 nt, Human
gaacacgucauaucagaugagaggaagauggccucugauggacagaauuuuucucuuaacucag

SEQ ID NO: 112763 - RNA, 64 nt, Human
agaucauggaugcucucuuucuggaagcuguggccugauggagcagccccauuccaggguccca

SEQ ID NO: 112764 - RNA, 64 nt, Human
gaaugcuaauauagucacuuauuaaaggauuaugcugauggaaauguaccaaccuccugucucg

SEQ ID NO: 112765 - RNA, 64 nt, Human
ugaggcuguggaaguccgacugggcaguggaaugcugauggaggcagacgcugccgagggggug

SEQ ID NO: 112766 - RNA, 64 nt, Human
gcuucugcccccuugauccaaaugaccaucaucucugauggagauggguuggguaccuggccuu

SEQ ID NO: 112767 - RNA, 64 nt, Human
cugccuagauccacguguggccuccguccugucacugauggaagguuugcggaugagggcaugu

SEQ ID NO: 112768 - RNA, 64 nt, Human
uguauguaguucuacauaaugcaaauugugcuuucugauggacaagaccucauaacugugauua

SEQ ID NO: 112769 - RNA, 64 nt, Human
cuuggcacagucucugccugcuugcucuccuuugcugauggauugcauuuaucaaacuauucau

SEQ ID NO: 112770 - RNA, 64 nt, Human
ggcuccggcugugaagucacugaacagaacgucgcugauggagaaagggcucccgcagaaggaa

SEQ ID NO: 112771 - RNA, 64 nt, Human
aauaaucaugccauccugccuuuccauggaauaacugauggaugguuagaaauguuaaaaacaa

SEQ ID NO: 112772 - RNA, 64 nt, Human
caacagggcaguguggucuccgaaugucuggaagcugauggagcucagaauuccacugucaaga

SEQ ID NO: 112773 - RNA, 64 nt, Human
ggaggguaauaaagaugaaagaccaacauuuuaacugauggaucccuuaagcuacagaauagaa

SEQ ID NO: 112774 - RNA, 64 nt, Human
agaggcagacguuucccagggcguucaggcagcccugauggaccgaaggcucuggugucugguu

SEQ ID NO: 112775 - RNA, 64 nt, Human
cacauugccaugguuuugugggaaucacgcgccccugauggaacuuuucugcuguugugaagua

SEQ ID NO: 112776 - RNA, 64 nt, Human
cugaggacgcagggaggguggagguguccugaggcugauggacagugaccgccacuggccccca

SEQ ID NO: 112777 - RNA, 64 nt, Human
uagcgggucauguagucucuagaaaauacauaaccugauggaaauguagaagcuauauguauau

SEQ ID NO: 112778 - RNA, 64 nt, Human
uuggggugaccuucuuggggacucgggggcuggucugauggaacuguguauuuauuuaaaacuc

SEQ ID NO: 112779 - RNA, 64 nt, Human
uaagaaauaggaucugugguguauuccagggggccugauggacaccuuucccgggcgucugcag

SEQ ID NO: 112780 - RNA, 64 nt, Human
ugaagauacggaaaccugccccacucacacccaucugauggaggaacuuuaaacgcuguuuucu

SEQ ID NO: 112781 - RNA, 64 nt, Human
uagaauaaccaguuuagagaagaacauaaaugaccugauggagcugaaaaacacagcaugagaa

SEQ ID NO: 112782 - RNA, 64 nt, Human
ccccccagcccucuggcgucucuagaaacugcugcugauggagaccaggacagagcccgccccc

SEQ ID NO: 112783 - RNA, 64 nt, Human
acccuucugauggaaggugggagccaacacccuucugauggaaggcgggauucccgcuucugaa

SEQ ID NO: 112784 - RNA, 64 nt, Human
acccuucugauggaaggugggagccaacacccuucugauggaaggugggagccaacacccuucu

SEQ ID NO: 112785 - RNA, 64 nt, Human; identical to SEQ ID NO: 112784

SEQ ID NO: 112786 - RNA, 64 nt, Human; identical to SEQ ID NO: 112784

SEQ ID NO: 112787 - RNA, 64 nt, Human
caucuucugauggaaggugggagccaacacccuucugauggaaggugggagccaacacccuucu

SEQ ID NO: 112788 - RNA, 64 nt, Human
agaagccuuucagguuucccugggccagcaucuucugauggaaggugggagccaacacccuucu

SEQ ID NO: 112789 - RNA, 64 nt, Human
ugaggguggccaugggugacacgucccacucuuucugauggaggggcauccguggugccuucua

SEQ ID NO: 112790 - RNA, 64 nt, Human
aucuugaugauacauuacuuguucaauacagccacugauggaaugcuuccuuuuuuauuuuuuu

SEQ ID NO: 112791 - RNA, 64 nt, Human
agagccaccgccaagguuugcacucagggaggggcugauggagggcugggcgccauggggucag

SEQ ID NO: 112792 - RNA, 64 nt, Human
uaggaaaaucacuugccaaaauccaaggcaauuccugauggaaaaugcaaaagcacauauaugu

SEQ ID NO: 112793 - RNA, 64 nt, Human
auaauaacaguagagcuauuuuuuauaaauuagccugauggaacaaucccuuaugauuaaagau

SEQ ID NO: 112794 - RNA, 64 nt, Human
ugggucccuggccaagaagccaggagagggacggcugauggacucagcaucggaagguggcggu

SEQ ID NO: 112795 - RNA, 64 nt, Human
ccgccauuccagggauugauucucaccagcguuucugauggaaaauggcgguuucaaguccccg

SEQ ID NO: 112796 - RNA, 64 nt, Human
gaagauguagcaauaaaccaaaugugcuaaaacccugauggaguuuuauuccagugaauaauga

SEQ ID NO: 112797 - RNA, 64 nt, Human
ggacaugcaaaagauugacugggagaacacaccucugauggacaaaggugagacagagcagcca

SEQ ID NO: 112798 - RNA, 64 nt, Human
uccccagcugguggcccugugccugggcccugggcugauggaagaugguccgugcccaggcccu

SEQ ID NO: 112799 - RNA, 64 nt, Human
aaucuauuuugaaaaggcauccccaaauggcagucugauggacugcggguuuggauaccacugc

SEQ ID NO: 112800 - RNA, 64 nt, Human
ucuacagggguugagggaccaggccuggccggggcugauggacaguggggacuuuccuucucuc

SEQ ID NO: 112801 - RNA, 64 nt, Human
uauugucugaagcuaaaauggguuauuuauaggacugauggaaaugauuucaucucugccaucu

SEQ ID NO: 112802 - RNA, 64 nt, Human
ggaaacgugugugucaguuggaccaugugggacccugauggaccugaaagaccaggaucggucc

SEQ ID NO: 112803 - RNA, 64 nt, Human
gcugucggcugaugaggaggcggccgccccagugcugauggagaugccacuuucgugugacugc

SEQ ID NO: 112804 - RNA, 64 nt, Human
agcuugguggccaagcagucugugugcuuccccgcugauggagaacguugcguuguucacaaua

SEQ ID NO: 112805 - RNA, 64 nt, Human
aacaaaauaacagccacauaaccuugcggcaagucugauggaaagaaaaagauaaaccauccgu

SEQ ID NO: 112806 - RNA, 64 nt, Human
uaaaacaauaggaugggcuucugugcccagaauacugauggaauuuuuuuguacgacgucagau

SEQ ID NO: 112807 - RNA, 64 nt, Human
ccagcaacccaaccagacagcucagguugugcaucugauggaaaccacugggcucaaacacgug

SEQ ID NO: 112808 - RNA, 64 nt, Human
guggccuuccugccaaacaagccauauauaaagacugauggaaucguuagcaaauaauuagcug

SEQ ID NO: 112809 - RNA, 64 nt, Human
gcugaggccuccgcucaggucagaagcccagcugcugauggacacgccccccagugccagccag

SEQ ID NO: 112810 - RNA, 64 nt, Human
aaaccagcugccucacuucuguuucacagggaggcugauggaaaaaggaagcaagcuggaccca

SEQ ID NO: 112811 - RNA, 64 nt, Human
agaguuuacuaugugccuagcacuguuugagguccugauggaaguuacaggacggguacucugg

SEQ ID NO: 112812 - RNA, 64 nt, Human
augagagggaugcagugccuuuccccauucauuccugauggaauuguuauacuagguuaacauu

SEQ ID NO: 112813 - RNA, 64 nt, Human
gcuugagcccaggaguuagaagcugcagugagcucugauggaaccacugcacuauagccuggac

SEQ ID NO: 112814 - RNA, 64 nt, Human
uuuuagaguucuuuuggaucauaaacuggaaauacugauggaagcacacaaguggagagaaguu

SEQ ID NO: 112815 - RNA, 64 nt, Human
cccccucauuagcagggcuuaucugggggagcugcugauggaguccucgcugcucaugcccaca

SEQ ID NO: 112816 - RNA, 64 nt, Human
gguguuuagacacagauaggaguccaggguaugacugauggaggccccggcccacgugaccagc

SEQ ID NO: 112817 - RNA, 64 nt, Human
ggccacagcgauucgcacggaggaggagaagcgccugauggagcagaaggugcuggaagccgag

SEQ ID NO: 112818 - RNA, 64 nt, Human
ggaaugaauugagaagguggcgugcuggccugagcugauggaccacuugguguuuugcguuuug

SEQ ID NO: 112819 - RNA, 64 nt, Human
cuuugcaagaauauucauauuauaaaugucucaucugauggaggaacgugugcauuuagagaga

SEQ ID NO: 112820 - RNA, 64 nt, Human
ggugacuugugggccauucaucuacaaccaaguccugauggagcaagaggcccacgccuagggg

SEQ ID NO: 112821 - RNA, 64 nt, Human
gccgacccguggggcaggccaggccagguccucccugauggacgccugccgcccgccaccccca

SEQ ID NO: 112822 - RNA, 64 nt, Human
gcuuuuucacagucacugauguacaauuaaaaaccugauggaaccugggcuuugugcuucugcu

SEQ ID NO: 112823 - RNA, 64 nt, Human
ugccuaccauccaggaaaacuugugcuggaauugcugauggaaacaauuaaauauuuacuauaa

SEQ ID NO: 112824 - RNA, 64 nt, Human
gcaucuguuacauaaaugagaaaaagcuauuaugcugauggagcaugcuuuuuaaauccuuuaa

SEQ ID NO: 112825 - RNA, 64 nt, Human
gcaccguugaaaggcagaaagagccaggagaaagcugauggagccaggacagagaucugguucc

SEQ ID NO: 112826 - RNA, 64 nt, Human
ccucuguuaaugccugacuucagcugcugguguucugauggagccagaggcuuggggaaucugg

SEQ ID NO: 112827 - RNA, 64 nt, Human
ggaggcgcacuaugaggcacugcggcacuuccugcugauggaggacggcgaguucgcccagucc

SEQ ID NO: 112828 - RNA, 64 nt, Human
gggggcgccccuucuuggaaggcagggcuggacacugauggacagcaggcagggagacaguccc

SEQ ID NO: 112829 - RNA, 64 nt, Human
aaaaccaagcagaagugaagagaaaagaggaggacugauggaaagacagacucuggacagcugc

SEQ ID NO: 112830 - RNA, 64 nt, Human
guugaguuauuuagaauuuuaucucaagugaaagcugauggauucaucugcuuuggcugaaauu

SEQ ID NO: 112831 - RNA, 64 nt, Human
aggaauguucacacaguaggauauuauaaguaugcugauggaaaucuauauugccaggaaaagc

SEQ ID NO: 112832 - RNA, 64 nt, Human
ucagaaaguaauuucuucucaaaggguacuuccacugauggaaacaaaguggaaggaaagaugc

SEQ ID NO: 112833 - RNA, 64 nt, Human
guguuuaccaagccguuggucuccuaagggccuccugauggaagaacaguggggugguucaaag

SEQ ID NO: 112834 - RNA, 64 nt, Human
uuauagaaggcuuguuggugguggugauguuaaacugauggaaauucuuuuucgccuuaguggu

SEQ ID NO: 112835 - RNA, 64 nt, Human
acuauaaagggaugacgcaaggaguuccuuugugcugauggaacaguucuauaugauuaugaug

SEQ ID NO: 112836 - RNA, 64 nt, Human
cauuggaggagucguaugcacuguuuuucuguugcugauggaggcaagcaggccuucuaauuag

SEQ ID NO: 112837 - RNA, 64 nt, Human
agaugaaacuugaauuaccaucucagaagucaagcugauggaguaugugauaaagugaauguac

SEQ ID NO: 112838 - RNA, 64 nt, Human
auuauuuuucguuugcucuuucuucuacacgcgccugauggauagugaaccuauucaucaaaaa

SEQ ID NO: 112839 - RNA, 64 nt, Human
uaggcauugauuaagauuaagugugaucauuguacugauggauauauuuuguguacauguuucu

SEQ ID NO: 112840 - RNA, 64 nt, Human
ugcccggccccucccuuucugugcacuggggacgcugauggaggcugaagcugcuguucggagg

SEQ ID NO: 112841 - RNA, 64 nt, Human; identical to SEQ ID NO: 40787

SEQ ID NO: 112842 - RNA, 64 nt, Human; identical to SEQ ID NO: 40788

SEQ ID NO: 112843 - RNA, 58 nt, Human; identical to SEQ ID NO: 40789

SEQ ID NO: 112844 - RNA, 64 nt, Human; identical to SEQ ID NO: 40790

SEQ ID NO: 112845 - RNA, 64 nt, Human; identical to SEQ ID NO: 40791

SEQ ID NO: 112846 - RNA, 64 nt, Human; identical to SEQ ID NO: 40792

SEQ ID NO: 112847 - RNA, 64 nt, Human; identical to SEQ ID NO: 40793

SEQ ID NO: 112848 - RNA, 64 nt, Human; identical to SEQ ID NO: 40794

SEQ ID NO: 112849 - RNA, 64 nt, Human; identical to SEQ ID NO: 40795

SEQ ID NO: 112850 - RNA, 64 nt, Human; identical to SEQ ID NO: 40796

SEQ ID NO: 112851 - RNA, 64 nt, Human; identical to SEQ ID NO: 40797

SEQ ID NO: 112852 - RNA, 64 nt, Human; identical to SEQ ID NO: 40798

SEQ ID NO: 112853 - RNA, 64 nt, Human; identical to SEQ ID NO: 40799

SEQ ID NO: 112854 - RNA, 64 nt, Human; identical to SEQ ID NO: 40800

SEQ ID NO: 112855 - RNA, 64 nt, Human; identical to SEQ ID NO: 40801

SEQ ID NO: 112856 - RNA, 64 nt, Human; identical to SEQ ID NO: 40802

SEQ ID NO: 112857 - RNA, 64 nt, Human; identical to SEQ ID NO: 40803

SEQ ID NO: 112858 - RNA, 64 nt, Human; identical to SEQ ID NO: 40804

SEQ ID NO: 112859 - RNA, 64 nt, Human; identical to SEQ ID NO: 40805

SEQ ID NO: 112860 - RNA, 64 nt, Human; identical to SEQ ID NO: 40806

SEQ ID NO: 112861 - RNA, 64 nt, Human; identical to SEQ ID NO: 40807

SEQ ID NO: 112862 - RNA, 64 nt, Human; identical to SEQ ID NO: 40808

SEQ ID NO: 112863 - RNA, 64 nt, Human; identical to SEQ ID NO: 40809

SEQ ID NO: 112864 - RNA, 64 nt, Human; identical to SEQ ID NO: 40810

SEQ ID NO: 112865 - RNA, 64 nt, Human; identical to SEQ ID NO: 40811

SEQ ID NO: 112866 - RNA, 64 nt, Human; identical to SEQ ID NO: 40812

SEQ ID NO: 112867 - RNA, 64 nt, Human; identical to SEQ ID NO: 40813

SEQ ID NO: 112868 - RNA, 64 nt, Human; identical to SEQ ID NO: 40814

SEQ ID NO: 112869 - RNA, 64 nt, Human; identical to SEQ ID NO: 40815

SEQ ID NO: 112870 - RNA, 64 nt, Human; identical to SEQ ID NO: 40816

SEQ ID NO: 112871 - RNA, 64 nt, Human; identical to SEQ ID NO: 40817

SEQ ID NO: 112872 - RNA, 64 nt, Human; identical to SEQ ID NO: 40818

SEQ ID NO: 112873 - RNA, 64 nt, Human; identical to SEQ ID NO: 40819

SEQ ID NO: 112874 - RNA, 64 nt, Human; identical to SEQ ID NO: 40820

SEQ ID NO: 112875 - RNA, 64 nt, Human; identical to SEQ ID NO: 40821

SEQ ID NO: 112876 - RNA, 64 nt, Human; identical to SEQ ID NO: 40822

SEQ ID NO: 112877 - RNA, 62 nt, Human; identical to SEQ ID NO: 40823

SEQ ID NO: 112878 - RNA, 62 nt, Human; identical to SEQ ID NO: 40824

SEQ ID NO: 112879 - RNA, 64 nt, Human; identical to SEQ ID NO: 40825

SEQ ID NO: 112880 - RNA, 62 nt, Human; identical to SEQ ID NO: 40826

SEQ ID NO: 112881 - RNA, 62 nt, Human; identical to SEQ ID NO: 40827

SEQ ID NO: 112882 - RNA, 64 nt, Human; identical to SEQ ID NO: 40828

SEQ ID NO: 112883 - RNA, 64 nt, Human; identical to SEQ ID NO: 40829

SEQ ID NO: 112884 - RNA, 64 nt, Human; identical to SEQ ID NO: 40830

SEQ ID NO: 112885 - RNA, 64 nt, Human; identical to SEQ ID NO: 40831

SEQ ID NO: 112886 - RNA, 64 nt, Human; identical to SEQ ID NO: 40832

SEQ ID NO: 112887 - RNA, 64 nt, Human; identical to SEQ ID NO: 40833

SEQ ID NO: 112888 - RNA, 64 nt, Human; identical to SEQ ID NO: 40834

SEQ ID NO: 112889 - RNA, 64 nt, Human; identical to SEQ ID NO: 40835

SEQ ID NO: 112890 - RNA, 64 nt, Human; identical to SEQ ID NO: 40836

SEQ ID NO: 112891 - RNA, 64 nt, Human; identical to SEQ ID NO: 40837

SEQ ID NO: 112892 - RNA, 56 nt, Human; identical to SEQ ID NO: 40838

SEQ ID NO: 112893 - RNA, 64 nt, Human; identical to SEQ ID NO: 40839

SEQ ID NO: 112894 - RNA, 64 nt, Human; identical to SEQ ID NO: 40840

SEQ ID NO: 112895 - RNA, 64 nt, Human; identical to SEQ ID NO: 40841

SEQ ID NO: 112896 - RNA, 64 nt, Human; identical to SEQ ID NO: 40842

SEQ ID NO: 112897 - RNA, 64 nt, Human; identical to SEQ ID NO: 40843

SEQ ID NO: 112898 - RNA, 64 nt, Human; identical to SEQ ID NO: 40844

SEQ ID NO: 112899 - RNA, 64 nt, Human; identical to SEQ ID NO: 40845

SEQ ID NO: 112900 - RNA, 64 nt, Human; identical to SEQ ID NO: 40846

SEQ ID NO: 112901 - RNA, 64 nt, Human; identical to SEQ ID NO: 40847

SEQ ID NO: 112902 - RNA, 64 nt, Human; identical to SEQ ID NO: 40848

SEQ ID NO: 112903 - RNA, 64 nt, Human; identical to SEQ ID NO: 40849

SEQ ID NO: 112904 - RNA, 64 nt, Human; identical to SEQ ID NO: 40850

SEQ ID NO: 112905 - RNA, 64 nt, Human; identical to SEQ ID NO: 40851

SEQ ID NO: 112906 - RNA, 64 nt, Human; identical to SEQ ID NO: 40852

SEQ ID NO: 112907 - RNA, 64 nt, Human; identical to SEQ ID NO: 40853

SEQ ID NO: 112908 - RNA, 64 nt, Human; identical to SEQ ID NO: 40854

SEQ ID NO: 112909 - RNA, 64 nt, Human; identical to SEQ ID NO: 40855

SEQ ID NO: 112910 - RNA, 64 nt, Human; identical to SEQ ID NO: 40856

SEQ ID NO: 112911 - RNA, 52 nt, Human; identical to SEQ ID NO: 40857

SEQ ID NO: 112912 - RNA, 50 nt, Human; identical to SEQ ID NO: 40858

SEQ ID NO: 112913 - RNA, 60 nt, Human; identical to SEQ ID NO: 40859

SEQ ID NO: 112914 - RNA, 53 nt, Human; identical to SEQ ID NO: 40860

SEQ ID NO: 112915 - RNA, 64 nt, Human; identical to SEQ ID NO: 40861

SEQ ID NO: 112916 - RNA, 64 nt, Human; identical to SEQ ID NO: 40862

SEQ ID NO: 112917 - RNA, 64 nt, Human; identical to SEQ ID NO: 40863

SEQ ID NO: 112918 - RNA, 64 nt, Human; identical to SEQ ID NO: 40864

SEQ ID NO: 112919 - RNA, 64 nt, Human; identical to SEQ ID NO: 40865

SEQ ID NO: 112920 - RNA, 64 nt, Human; identical to SEQ ID NO: 40866

SEQ ID NO: 112921 - RNA, 64 nt, Human; identical to SEQ ID NO: 40867

SEQ ID NO: 112922 - RNA, 64 nt, Human; identical to SEQ ID NO: 40868

SEQ ID NO: 112923 - RNA, 64 nt, Human; identical to SEQ ID NO: 40869

SEQ ID NO: 112924 - RNA, 64 nt, Human; identical to SEQ ID NO: 40870

SEQ ID NO: 112925 - RNA, 64 nt, Human; identical to SEQ ID NO: 40871

SEQ ID NO: 112926 - RNA, 64 nt, Human; identical to SEQ ID NO: 40872

SEQ ID NO: 112927 - RNA, 64 nt, Human; identical to SEQ ID NO: 40873

SEQ ID NO: 112928 - RNA, 64 nt, Human; identical to SEQ ID NO: 40874

SEQ ID NO: 112929 - RNA, 64 nt, Human; identical to SEQ ID NO: 40875

SEQ ID NO: 112930 - RNA, 64 nt, Human; identical to SEQ ID NO: 40876

SEQ ID NO: 112931 - RNA, 64 nt, Human; identical to SEQ ID NO: 40877

SEQ ID NO: 112932 - RNA, 64 nt, Human; identical to SEQ ID NO: 40878

SEQ ID NO: 112933 - RNA, 64 nt, Human; identical to SEQ ID NO: 40879

SEQ ID NO: 112934 - RNA, 64 nt, Human; identical to SEQ ID NO: 40880

SEQ ID NO: 112935 - RNA, 63 nt, Human; identical to SEQ ID NO: 40881

SEQ ID NO: 112936 - RNA, 64 nt, Human; identical to SEQ ID NO: 40882

SEQ ID NO: 112937 - RNA, 64 nt, Human; identical to SEQ ID NO: 40883

SEQ ID NO: 112938 - RNA, 64 nt, Human; identical to SEQ ID NO: 40884

SEQ ID NO: 112939 - RNA, 64 nt, Human; identical to SEQ ID NO: 40885

SEQ ID NO: 112940 - RNA, 64 nt, Human; identical to SEQ ID NO: 40886

SEQ ID NO: 112941 - RNA, 64 nt, Human; identical to SEQ ID NO: 40887

SEQ ID NO: 112942 - RNA, 64 nt, Human; identical to SEQ ID NO: 40888

SEQ ID NO: 112943 - RNA, 64 nt, Human; identical to SEQ ID NO: 40889

SEQ ID NO: 112944 - RNA, 64 nt, Human; identical to SEQ ID NO: 40890

SEQ ID NO: 112945 - RNA, 64 nt, Human; identical to SEQ ID NO: 40891

SEQ ID NO: 112946 - RNA, 64 nt, Human; identical to SEQ ID NO: 40892

SEQ ID NO: 112947 - RNA, 64 nt, Human; identical to SEQ ID NO: 40893

SEQ ID NO: 112948 - RNA, 64 nt, Human; identical to SEQ ID NO: 40894

SEQ ID NO: 112949 - RNA, 64 nt, Human; identical to SEQ ID NO: 40895

SEQ ID NO: 112950 - RNA, 64 nt, Human; identical to SEQ ID NO: 40896

SEQ ID NO: 112951 - RNA, 64 nt, Human; identical to SEQ ID NO: 40897

SEQ ID NO: 112952 - RNA, 64 nt, Human; identical to SEQ ID NO: 40898

SEQ ID NO: 112953 - RNA, 64 nt, Human; identical to SEQ ID NO: 40899

SEQ ID NO: 112954 - RNA, 64 nt, Human; identical to SEQ ID NO: 40900

SEQ ID NO: 112955 - RNA, 64 nt, Human; identical to SEQ ID NO: 40901

SEQ ID NO: 112956 - RNA, 64 nt, Human; identical to SEQ ID NO: 40902

SEQ ID NO: 112957 - RNA, 64 nt, Human; identical to SEQ ID NO: 40903

SEQ ID NO: 112958 - RNA, 64 nt, Human; identical to SEQ ID NO: 40904

SEQ ID NO: 112959 - RNA, 64 nt, Human; identical to SEQ ID NO: 40905

SEQ ID NO: 112960 - RNA, 64 nt, Human; identical to SEQ ID NO: 40906

SEQ ID NO: 112961 - RNA, 64 nt, Human; identical to SEQ ID NO: 40907

SEQ ID NO: 112962 - RNA, 64 nt, Human; identical to SEQ ID NO: 40908

SEQ ID NO: 112963 - RNA, 64 nt, Human; identical to SEQ ID NO: 40909

SEQ ID NO: 112964 - RNA, 64 nt, Human; identical to SEQ ID NO: 40910

SEQ ID NO: 112965 - RNA, 64 nt, Human; identical to SEQ ID NO: 40911

SEQ ID NO: 112966 - RNA, 64 nt, Human; identical to SEQ ID NO: 40912

SEQ ID NO: 112967 - RNA, 64 nt, Human; identical to SEQ ID NO: 40913

SEQ ID NO: 112968 - RNA, 64 nt, Human; identical to SEQ ID NO: 40914

SEQ ID NO: 112969 - RNA, 64 nt, Human; identical to SEQ ID NO: 40915

SEQ ID NO: 112970 - RNA, 64 nt, Human; identical to SEQ ID NO: 40916

SEQ ID NO: 112971 - RNA, 64 nt, Human; identical to SEQ ID NO: 40917

SEQ ID NO: 112972 - RNA, 64 nt, Human; identical to SEQ ID NO: 40918

SEQ ID NO: 112973 - RNA, 64 nt, Human; identical to SEQ ID NO: 40919

SEQ ID NO: 112974 - RNA, 64 nt, Human; identical to SEQ ID NO: 40920

SEQ ID NO: 112975 - RNA, 64 nt, Human; identical to SEQ ID NO: 40921

SEQ ID NO: 112976 - RNA, 64 nt, Human; identical to SEQ ID NO: 40922

SEQ ID NO: 112977 - RNA, 64 nt, Human; identical to SEQ ID NO: 40923

SEQ ID NO: 112978 - RNA, 64 nt, Human; identical to SEQ ID NO: 40924

SEQ ID NO: 112979 - RNA, 64 nt, Human; identical to SEQ ID NO: 40925

SEQ ID NO: 112980 - RNA, 64 nt, Human; identical to SEQ ID NO: 40926

SEQ ID NO: 112981 - RNA, 64 nt, Human; identical to SEQ ID NO: 40927

SEQ ID NO: 112982 - RNA, 64 nt, Human; identical to SEQ ID NO: 40928

SEQ ID NO: 112983 - RNA, 64 nt, Human; identical to SEQ ID NO: 40929

SEQ ID NO: 112984 - RNA, 64 nt, Human; identical to SEQ ID NO: 40930

SEQ ID NO: 112985 - RNA, 64 nt, Human; identical to SEQ ID NO: 40931

SEQ ID NO: 112986 - RNA, 64 nt, Human; identical to SEQ ID NO: 40932

SEQ ID NO: 112987 - RNA, 64 nt, Human; identical to SEQ ID NO: 40933

SEQ ID NO: 112988 - RNA, 64 nt, Human; identical to SEQ ID NO: 40934

SEQ ID NO: 112989 - RNA, 64 nt, Human; identical to SEQ ID NO: 40935

SEQ ID NO: 112990 - RNA, 64 nt, Human; identical to SEQ ID NO: 40936

SEQ ID NO: 112991 - RNA, 64 nt, Human; identical to SEQ ID NO: 40937

SEQ ID NO: 112992 - RNA, 64 nt, Human; identical to SEQ ID NO: 40938

SEQ ID NO: 112993 - RNA, 64 nt, Human; identical to SEQ ID NO: 40939

SEQ ID NO: 112994 - RNA, 64 nt, Human; identical to SEQ ID NO: 40940

SEQ ID NO: 112995 - RNA, 64 nt, Human; identical to SEQ ID NO: 40941

SEQ ID NO: 112996 - RNA, 64 nt, Human; identical to SEQ ID NO: 40942

SEQ ID NO: 112997 - RNA, 64 nt, Human; identical to SEQ ID NO: 40943

SEQ ID NO: 112998 - RNA, 64 nt, Human
cuggucucggucugcugacgucagggucagcucccccgcggagcugacuucagcagcccacagc

SEQ ID NO: 112999 - RNA, 64 nt, Human
agaaucacaggcugcgucugcaccugaaaagugacccgcggaaacucuauggcggauuuuuuuu

SEQ ID NO: 113000 - RNA, 58 nt, Human
gcagccuggagaagcccuaggggggcgacccgcggagaccccagcagaggucgcagcc

SEQ ID NO: 113001 - RNA, 64 nt, Human
gcacauguuucugggucuuggaggucacccccaccccgcggaucacagcucacccacgcggcgc

SEQ ID NO: 113002 - RNA, 64 nt, Human
gugauuauaagcaacauccccgcccccucucccccccgcggacccccagcugccuccugagggu

SEQ ID NO: 113003 - RNA, 64 nt, Human
uuccuggcuuugggaguaagaaaugggccucagccccgcggaucaaccaggcagaguucugugg

SEQ ID NO: 113004 - RNA, 64 nt, Human
cccaggcccugcaaggugugcuaguuccugcuuucccgcggacuuccuagugcccaaaugcccu

SEQ ID NO: 113005 - RNA, 64 nt, Human
augcucaagaaguagccgcgcgcgggacagcggccccgcggagcccccgccccucccccuacag

SEQ ID NO: 113006 - RNA, 64 nt, Human
caggcucugggcuccggcgacuggugcuacgcaucccgcggagcuucugcugagcgccggcagg

SEQ ID NO: 113007 - RNA, 64 nt, Human
ggggggcgacaagucagacccgaaccuuaauaaccccgcggacgaggaccaugccuaugcucug

SEQ ID NO: 113008 - RNA, 64 nt, Human
caagaccggcugcgugauccagccugugccaaaacccgcggagaaggcugccauggcaccgugc

SEQ ID NO: 113009 - RNA, 64 nt, Human
gugaucgugugagucgucguuaaaugccugucuccccgcggaucaugggcuccucgaggacagg

SEQ ID NO: 113010 - RNA, 64 nt, Human
caguggaggcuggcagggucccuccagcaaagcucccgcggaaaacugcuccugugucggggcu

SEQ ID NO: 113011 - RNA, 64 nt, Human
cccgcccugccccgcuacagaagccagacugggucccgcggacgccagcaggggcagccccagc

SEQ ID NO: 113012 - RNA, 64 nt, Human
cugcugcagccaacccaguagcccccuuagcgcccccgcggaccccgcagcuccagacuccgcu

SEQ ID NO: 113013 - RNA, 64 nt, Human
agugcccguguccccacagccccaugugccccaccccgcggaaggcguguuugugcccagaaga

SEQ ID NO: 113014 - RNA, 64 nt, Human
ccccgaccucgcgcacgcccuggcccgcucccugcccgcggauaccuuggacuacggugccuuc

SEQ ID NO: 113015 - RNA, 64 nt, Human
ugguguggcgguugcagcggccccuggcagaggccccgcggagcaagcucugaggcuguguuac

SEQ ID NO: 113016 - RNA, 64 nt, Human
acagcagcagguaugugugaaagcaacguagcgccccgcggacugcagugcgcuuaaccaacuc

SEQ ID NO: 113017 - RNA, 64 nt, Human
uaacuaggguugcucucaccugagacauucuccacccgcggaaucucagggucccaggcugugg

SEQ ID NO: 113018 - RNA, 64 nt, Human
agagggggacgugaccggccgcauccuugcacgccccgcggagcucucuccaugguagcccagg

SEQ ID NO: 113019 - RNA, 64 nt, Human
ggcgcccguccccagccccacgcacgaccccaagcccgcggaggcaccgaugcccgcagagccc

SEQ ID NO: 113020 - RNA, 64 nt, Human
gccucgguuuccuguccccccaccacccgccugccccgcggaagaccgcccagugagccagccc

SEQ ID NO: 113021 - RNA, 64 nt, Human
caacccagaucccgccccuccuguccucuguguucccgcggaaaccaaccaaaccgugcgcugu

SEQ ID NO: 113022 - RNA, 64 nt, Human
agaaugugcugccuguuccccaaagccugcuugucccgcggaggacggcugccuuugacccugc

SEQ ID NO: 113023 - RNA, 64 nt, Human
ccugaccguuccuaccgcagguccagggccugggcccgcggaccccacaggcaggcggcggcgc

SEQ ID NO: 113024 - RNA, 64 nt, Human
agacagaggccagucuuggccacucaccccacaccccgcggaccccaauaaaggcuugcauagc

SEQ ID NO: 113025 - RNA, 64 nt, Human
ccguggagacgugagggggaccccucccugccagcccgcggaccucgcaugcucccugcaugag

SEQ ID NO: 113026 - RNA, 64 nt, Human
gcagguuucuguuuauucugaacaagggccaggccccgcggagugucuuugguggaucccagau

SEQ ID NO: 113027 - RNA, 64 nt, Human
agccugaucccaggaggcccugcaguucccccgacccgcggauggcagucuggaauaaagcccc

SEQ ID NO: 113028 - RNA, 64 nt, Human
gcccaccccaggggccaggcuugcggagggggagcccgcggagcggccagacuccccggggcgc

SEQ ID NO: 113029 - RNA, 64 nt, Human
ccugugaccacgaucuacaugcuggcagggaagccccgcggauccgaaggcccuguccgcucug

SEQ ID NO: 113030 - RNA, 53 nt, Human
ucagcgugcccgggaacugacgccccgcggaggccuggcccggagcccggcca

SEQ ID NO: 113031 - RNA, 64 nt, Human
gucgcagucggcagcagcgugcaguccggcaucucccgcggaugcuuuuccaucccaagugccu

SEQ ID NO: 113032 - RNA, 58 nt, Human
ccaugcacuacgggagcuaggggcccgccccgcggacugacagcaccaggaaaccaaa

SEQ ID NO: 113033 - RNA, 64 nt, Human
gguaauaaaucuguguuggccccugugccucagucccgcggauggccaguagggggcgcuggag

SEQ ID NO: 113034 - RNA, 64 nt, Human
ccgauccagugggcaggccaaggccugcugggcccccgcggacccaggugcucugggucacggu

SEQ ID NO: 113035 - RNA, 64 nt, Human
ccggcucgggcgucuccucgguuuccuugccucacccgcggagagcgcugaaccuggacaagca

SEQ ID NO: 113036 - RNA, 64 nt, Human
cacgagcgagcagccuauggagguggagcuguggcccgcggagaagcagucaucaucauccaug

SEQ ID NO: 113037 - RNA, 64 nt, Human
aaguguugagagcugccugcgagccccgcaccaccccgcggagcacguacccagggaccgcagc

SEQ ID NO: 113038 - RNA, 64 nt, Human
ggggggugcagggcaggcccgagcagcucgguuucccgcggacuuggcugcugcucccaccgca

SEQ ID NO: 113039 - RNA, 64 nt, Human
uccgagugggugcucaagucccccccgcgacccacccgcggaguggggggcccccuccgccaca

SEQ ID NO: 113040 - RNA, 64 nt, Human
guagggacaaagccgaagcccagugccaugacugcccgcggauugaaaaacagaaacacaaaac

SEQ ID NO: 113041 - RNA, 64 nt, Human
uuuaugggccaccaggguuuggggaaaucaccaucccgcggaugcugugaccucccuucuacgg

SEQ ID NO: 113042 - RNA, 64 nt, Human
gaccuguuuccuugucauuugacccucgucugugcccgcggagaccuccucugaccaaggggca

SEQ ID NO: 113043 - RNA, 64 nt, Human
agcacacgccggggccccaggacaacgcguuucccccgcggacccccuuuccugcccuccccca

SEQ ID NO: 113044 - RNA, 64 nt, Human
ucuucaccuucucuuccccuuuccaucuccuuuccccgcggaaacaacgcuucccuucuggugu

SEQ ID NO: 113045 - RNA, 64 nt, Human
gucagggcacaugccuggccggcugggguccccacccgcggagacgguccuagacccagugggg

SEQ ID NO: 113046 - RNA, 64 nt, Human
cgcccgugggagguggguccggccggagaggccucccgcggacgccgucucuccagaacuccgc

SEQ ID NO: 113047 - RNA, 64 nt, Human
acgaagaccaaagcagccugcacagggcaaggcccccgcggaauccugcagagcaaacucaggu

SEQ ID NO: 113048 - RNA, 64 nt, Human
acucugggggugggacacggcggggagguggugccccgcggaccccggggugccaggcacggaa

SEQ ID NO: 113049 - RNA, 64 nt, Human
acugagcaguuuuuaaccgcagguucuaaagugucccgcggaguacagauaauauucuggaagg

SEQ ID NO: 113050 - RNA, 64 nt, Human
cagcgggcggcuccaaaggcccaaugcagaggagcccgcggagcaugugcugagggaagucugc

SEQ ID NO: 113051 - RNA, 64 nt, Human
cccacggcucugcaggaucagggcucgggcaggccccgcggagaugaagaauuugcagggagcc

SEQ ID NO: 113052 - RNA, 64 nt, Human
ggcacaucuguggucccagcuacuugagaggcugagccaggaggaucgcuugagcccaggaggc

SEQ ID NO: 113053 - RNA, 64 nt, Human
uaguaagcugguuuagaaacugacgagggcaaacagccaggacgcauuggagaggaauuugcca

SEQ ID NO: 113054 - RNA, 64 nt, Human
accugcaaggaaccgguuuauaaaacaacagaacagccaggaaaauggugcuaggagagacagu

SEQ ID NO: 113055 - RNA, 64 nt, Human
aucauuaaaguuccuccuugagaggcugagccguagccaggauuggggagagcccuugucucug

SEQ ID NO: 113056 - RNA, 64 nt, Human
cggaacgggaggacucgcagcucucccuuuccccagccaggaugagggaauuagacaauggaag

SEQ ID NO: 113057 - RNA, 64 nt, Human
ucagcccuucccacaggaaacaucaagaagccccagccaggaggggccaggcugccaaggcggc

SEQ ID NO: 113058 - RNA, 64 nt, Human
aauuaaaaaauggcauuuagccaaaggccuuuucagccaggaguaagaaaagaugguuagugau

SEQ ID NO: 113059 - RNA, 64 nt, Human
ccaggccucuggcgcccccacucaagacuaccaaagccaggacaccucaagucuccagccccac

SEQ ID NO: 113060 - RNA, 64 nt, Human
uaaaaggcucccaugcugagcagcccauugcugaagccaggauguucugaccuggcuggcaucu

SEQ ID NO: 113061 - RNA, 59 nt, Human
aaacagaaccaccuggcuagacccuaggaagccaggagaggaucagguuccaaagggga

SEQ ID NO: 113062 - RNA, 64 nt, Human
uuccugucccccuggugccaucuggccuggcuggagccaggaacaggagggacacuuccccaga

SEQ ID NO: 113063 - RNA, 64 nt, Human
gucuucccaagacagaggcccggugacacaguucagccaggacugaccacagggcucuagagcu

SEQ ID NO: 113064 - RNA, 64 nt, Human
agucacuggaauggaaaaguguguuccuguucauagccaggaaacccagcucagcaaacucccu

SEQ ID NO: 113065 - RNA, 64 nt, Human
aagauuccaguucauccagguggcuggagccagcagccaggaccagggucguugacagcagguu

SEQ ID NO: 113066 - RNA, 64 nt, Human
auagacuaggcaauucaucagcucaccugaaaucagccaggaggagcaaggacaagaugcgcac

SEQ ID NO: 113067 - RNA, 64 nt, Human
accagcuugcuuuguugcacgccugggcaauuucagccaggacauuaggaccacuuguuguaca

SEQ ID NO: 113068 - RNA, 64 nt, Human
ugcauaaggaagcccacuuuaucuaaaugauauuagccaggauccuugguguccuaggagaaac

SEQ ID NO: 113069 - RNA, 64 nt, Human
cucccuagaucauggcaaggccugacaacagcugagccaggaaagugcugcugaggcaagucga

SEQ ID NO: 113070 - RNA, 64 nt, Human
ugagccgugaacugaagaaugguauccagucaucagccaggaaagauggggauucacuuacaug

SEQ ID NO: 113071 - RNA, 64 nt, Human
agaugaaggcaacugaaucccaagaggcaccugcagccaggaaggaaaggugggggcuuuuuaa

SEQ ID NO: 113072 - RNA, 64 nt, Human
gagcaaagccagggccuggugccugauuuucugaagccaggagcccucagguggcuggagcugg

SEQ ID NO: 113073 - RNA, 64 nt, Human
agacagagaaacagacagaaagagacacacacacagccaggaguggguagauuucagggagaca

SEQ ID NO: 113074 - RNA, 64 nt, Human
agaggcuuaccugacagccagccugccugcugggagccaggagagucagcucauuaaaucuuga

SEQ ID NO: 113075 - RNA, 64 nt, Human
aggaauauuaguuagagacugauuaucucaugugagccaggacauucuuccagcaagguuggcc

SEQ ID NO: 113076 - RNA, 64 nt, Human
gcaaagcuugucaaagaugcccccuccaggagagagccaggaugcccagaugaacugacugaag

SEQ ID NO: 113077 - RNA, 64 nt, Human
uauuuugaaauaaaguuuagugucuagggcugggagccaggacugaucuuccauuucuuuuucu

SEQ ID NO: 113078 - RNA, 64 nt, Human
ugcugaagaggaucuuugacgccacagugggacuagccaggaaugagggagaaaugcccuuucu

SEQ ID NO: 113079 - RNA, 64 nt, Human
uucuacccucaggggccuguagauguugcuuuccagccaggaaucuaaagcuuuggguuuucug

SEQ ID NO: 113080 - RNA, 64 nt, Human
cccaagcaacuaccccaagacauaccaacagugaagccaggacagcaccaugccaucggcgcuc

SEQ ID NO: 113081 - RNA, 64 nt, Human
acucucugaggcuccagcugguccugggacaugcagccaggacugugagucugggcagguccaa

SEQ ID NO: 113082 - RNA, 64 nt, Human
ccuaaaauaaauuagucaaaaaauuccaacaaguagccaggacugcagagacacuccagugcag

SEQ ID NO: 113083 - RNA, 64 nt, Human
guagacuccccagucccauaauuguguaucuuccagccaggaauccuacacggccagcauguau

SEQ ID NO: 113084 - RNA, 64 nt, Human
uguauuuuuaguagagacgggguuucaccauguuagccaggauggucuggaucuccugaccucg

SEQ ID NO: 113085 - RNA, 64 nt, Human
guggaguggcugcucuguaccgugggcauccggcagccaggaagugagacaacauaauuauaac

SEQ ID NO: 113086 - RNA, 64 nt, Human
cuggccacgggcccuucuuaccucacucaacuucagccaggaggacuggguggugcuugcaaug

SEQ ID NO: 113087 - RNA, 64 nt, Human
auacaaaaaaguagagacaggauuucacuguguuagccaggauggucuugaucucccgaccucg

SEQ ID NO: 113088 - RNA, 64 nt, Human
auuaaaaauagauuaaacuucgcuggaaaugaguagccaggaaguucaggggagggugccgggu

SEQ ID NO: 113089 - RNA, 64 nt, Human
cuagaaagugcuuggggguuuuugcugcccuggaagccaggagccugcucacuccaaccacaag

SEQ ID NO: 113090 - RNA, 64 nt, Human
ggccgccagugccuucuucaccuacgugucgcugagccaggaaggcaggucgcugccugugccc

SEQ ID NO: 113091 - RNA, 64 nt, Human
cggccccacaugggaaccuaguacucucugcucuagccaggagucugugcucuuuuggugggga

SEQ ID NO: 113092 - RNA, 64 nt, Human
uaagauuaaugaccugaauugaaagagaauuuggagccaggaugggucuccauucuguguggca

SEQ ID NO: 113093 - RNA, 64 nt, Human
caucuccuuuaucgucauuaagucauucacaaaaagccaggagaagcauuuggaaagggcauga

SEQ ID NO: 113094 - RNA, 64 nt, Human
ccccuuguccaugucaguaaaauaugaaggucacagccaggauuucuaagggucaggaggccuu

SEQ ID NO: 113095 - RNA, 64 nt, Human
cucacacucucauuugagccucccugaggcagggagccaggaggcaccugaggccuaucugugc

SEQ ID NO: 113096 - RNA, 64 nt, Human
cugcagguggcuggacugagugucccccaggcccagccaggacuuugccuaccccagcuguguu

SEQ ID NO: 113097 - RNA, 60 nt, Human
gcaugcucaaggacuccuagggcugguggcagccaggauucuggcccagggcgccuccuc

SEQ ID NO: 113098 - RNA, 61 nt, Human
ccccuuggggacccugguaaccccagccccaagccaggaggacgacugugucuuugggcca

SEQ ID NO: 113099 - RNA, 64 nt, Human
ucuuacugucucaauguacauacggggaaacugaagccaggagaagaagagggagaaacugucc

SEQ ID NO: 113100 - RNA, 64 nt, Human
cggcccucggugaugggucugggccaccaggaucagccaggagggcguucuuaggcugcuggga

SEQ ID NO: 113101 - RNA, 64 nt, Human
agguaggcaagccaggacuccgggaaggaggugcagccaggaugcucugguggagcugccgaug

SEQ ID NO: 113102 - RNA, 64 nt, Human
cauccaggccaaccucccauggaauagguaggcaagccaggacuccgggaaggaggugcagcca

SEQ ID NO: 113103 - RNA, 64 nt, Human
agguggggcugccuaggagaaggggcuucgaagcagccaggacucuuccuaccacaaacugagu

SEQ ID NO: 113104 - RNA, 64 nt, Human
uguauuuuuaguagaggcgggguuucaccauguuagccaggauggucuccaucuccugaccucg

SEQ ID NO: 113105 - RNA, 64 nt, Human
agccuagauaugcuacauguccaggaacaacugcagccaggaggcagaacagccuaggucuaac

SEQ ID NO: 113106 - RNA, 64 nt, Human
cucauagaauggaagugagcaaaggaaaauuuuaagccaggauaguuaaccguuagggggccag

SEQ ID NO: 113107 - RNA, 64 nt, Human
agagcaugccuguuuaagggauuacugguccuacagccaggagcuaauuguucaagaaguguug

SEQ ID NO: 113108 - RNA, 64 nt, Human
ugugcccaggcacccagaugauuccuauggcaccagccaggaaaaauggcagcucuuaaaggag

SEQ ID NO: 113109 - RNA, 64 nt, Human
cgcaccaagagcagggcugugugugggaggcugcagccaggauugccucagcuccucccccuca

SEQ ID NO: 113110 - RNA, 64 nt, Human
gggcugacuccagaucucuccugcccucccuggcagccaggaccagcaccuguagucaccccac

SEQ ID NO: 113111 - RNA, 64 nt, Human
cccagcuucugccccaauacacauaccucccuuaagccaggaugggggaaagagugggauuagg

SEQ ID NO: 113112 - RNA, 64 nt, Human
uuggcuggaacuggauaauaaaaaucagacugaaagccaggacaucugaguaccuaucucacac

SEQ ID NO: 113113 - RNA, 64 nt, Human
gcacuuuuauuuagguagggaggcauguugaaugagccaggaggucuagaacuggagcuuaguc

SEQ ID NO: 113114 - RNA, 64 nt, Human
ccaccucuucucuuccuguaacacaagccacagaagccaggagcaaauguuucugcaguagucu

SEQ ID NO: 113115 - RNA, 64 nt, Human
ggccacuuggguuuugagauccuuccuuauuuuaagccaggacugggauuaaaucucccucugu

SEQ ID NO: 113116 - RNA, 64 nt, Human
gauggaacagccuuguccaggcagaacagucauaagccaggaaaugaaacaaaggaaaacaggu

SEQ ID NO: 113117 - RNA, 64 nt, Human
uguauuuuuaguagagacaggguuucaccguguuagccaggauggucucgaucuccugaccucg

SEQ ID NO: 113118 - RNA, 64 nt, Human
uguauuuuuaguagagaagguguuucaccguguuagccaggauggucuugaucuccugacaucg

SEQ ID NO: 113119 - RNA, 64 nt, Human
uuccugggccaucaguauguguugcagagcucacagccaggaacacuuauuuugaacaaugcag

SEQ ID NO: 113120 - RNA, 64 nt, Human
ggcggacacucucgggguugucugcaggagagcaagccaggaggacaugggccuggacgacacg

SEQ ID NO: 113121 - RNA, 64 nt, Human
gacgacagguggcaacaaugccccgagugguggcagccaggagagcagcgcagaacagcccaga

SEQ ID NO: 113122 - RNA, 64 nt, Human
aguacacaugggcccccgaggccgugguccugggagccaggaagacuccgcagugggugagaau

SEQ ID NO: 113123 - RNA, 64 nt, Human
guauuuuuuaguagagacgggguuucaccauguuagccaggauggucucgaucuccugaccucg

SEQ ID NO: 113124 - RNA, 64 nt, Human
cacuuugggaggcugagaugggaggaucacuugaagccaggaguuuaaaaccagaaugaucaac

SEQ ID NO: 113125 - RNA, 64 nt, Human
cuauagacaugugauagcaaaagaaacaaacaaaagccaggaaaacacucauuuucgccuugaa

SEQ ID NO: 113126 - RNA, 64 nt, Human
uuucuggcuugagaugaauccaagcagcagaaugagccaggaguagcaggagaugggcaaagaa

SEQ ID NO: 113127 - RNA, 64 nt, Human
cauguuuuuaagaaaacauugagcagagaacugcagccaggaugcgcucagcagacauucacuc

SEQ ID NO: 113128 - RNA, 64 nt, Human
uacuauauuuaaaaugaaaauguauagauuacacagccaggaaugcuaguaucuaccaccuucu

SEQ ID NO: 113129 - RNA, 64 nt, Human
gagcauuccaguaucaugcaggguccugugaucuagccaggagcagccauuaaccuagugauua

SEQ ID NO: 113130 - RNA, 64 nt, Human
aucaaggaauccugagucugggcaaugaaaccaaagccaggaguugacgcauccugcaguuggg

SEQ ID NO: 113131 - RNA, 64 nt, Human
caaagcagaugcugcugacccagcaccacuucccagccaggagccccccaggaacagcacagaa

SEQ ID NO: 113132 - RNA, 64 nt, Human
aggccacaguacagugauccaaggcaggcaaggcagccaggacaggggagcccgaccccagaua

SEQ ID NO: 113133 - RNA, 64 nt, Human
uggugccaggcagcuugccacuugggagggcagaagccaggaauuccacacccuuguguugcgc

SEQ ID NO: 113134 - RNA, 64 nt, Human
cucaucucacacccugcauggaaucaggcuccucagccaggacacagggugaggccccccagcc

SEQ ID NO: 113135 - RNA, 64 nt, Human
ggcuccucagccaggacacagggugaggccccccagccaggauaugccuccccuggaggagcac

SEQ ID NO: 113136 - RNA, 64 nt, Human
aggggaauucggagcuagaggacauggaaaauaaagccaggaaagucaaaaaaacgaaagagaa

SEQ ID NO: 113137 - RNA, 64 nt, Human
cagugggccaggaucgugccacugcacuuuauuuagccaggacaacacucugucuccaaaaaaa

SEQ ID NO: 113138 - RNA, 64 nt, Human
acccugugguccucaggcagguguaccuugagucagccaggagcccucuuuuccugugucaaag

SEQ ID NO: 113139 - RNA, 64 nt, Human
uaggucuguguaaaguaaggggaguguuaggagcagccaggacuguguaguguguguuugguug

SEQ ID NO: 113140 - RNA, 64 nt, Human
gacaagcgcuucaucuagggugggccuguuggggagccaggagacagcagggucugagagagga

SEQ ID NO: 113141 - RNA, 64 nt, Human
uucccgaggggagcuugggauuggguccugcugaagccaggagggucuucccaagauaggagag

SEQ ID NO: 113142 - RNA, 64 nt, Human
cagggcuguuggaggaccccgagggcugaggagcagccaggacccgccugcucccauccucacc

SEQ ID NO: 113143 - RNA, 64 nt, Human
ccugcgcuuuccucaggucccagaggguggaaggagccaggacgcacccccacugcugcugcag

SEQ ID NO: 113144 - RNA, 64 nt, Human
caucgcaaccaggauugacaggccauccauucacagccaggagaugcugggccaguuccuccaa

SEQ ID NO: 113145 - RNA, 64 nt, Human
uucuaagaaugagucugaaugguucuugaaaauuagccaggaucaaaugcuauugcagacaaag

SEQ ID NO: 113146 - RNA, 64 nt, Human
cagagggcaccaaggaggguggcagagccugcuuagccaggaggccgaggucccucaguccucc

SEQ ID NO: 113147 - RNA, 64 nt, Human
ggaguguuuccucuuuauuuuugcugaguccugcagccaggaggguaauacacucugauccccu

SEQ ID NO: 113148 - RNA, 64 nt, Human
ugagggcacggccaaaaagaucugguuauuuuuuagccaggaacgugcuuguuaaugaguaugu

SEQ ID NO: 113149 - RNA, 64 nt, Human
gcaagccgcagcgaccauuucagauaccguccacagccaggaccgcugagaacugggacaguuu

SEQ ID NO: 113150 - RNA, 64 nt, Human
acaugaagagcagaugaccaccaugcucugugucagccaggacgaagggagacaucugggugcc

SEQ ID NO: 113151 - RNA, 64 nt, Human
uguauuuuuaguagagaugggguuucaccguauuagccaggauggucucgaucuccugaccucg

SEQ ID NO: 113152 - RNA, 64 nt, Human
cagggcauuuugguccaaguugugcuuaucccauagccaggaaacucugcauucuaguacuugg

SEQ ID NO: 113153 - RNA, 64 nt, Human
cuuaggguagugcuaagaggaucuccuguccaucagccaggacagucagcucucuccuuucagg

SEQ ID NO: 113154 - RNA, 64 nt, Human
uuucuucacauaucugaaaaauguugaaagccuaagccaggaauaaaagaaaaguagagauaau

SEQ ID NO: 113155 - RNA, 64 nt, Human
aguauuuauuucacuaugcauuuuauuuaguaaaagccaggagaaauguuuaauccaauggugc

SEQ ID NO: 113156 - RNA, 64 nt, Human
ucuuucccacgacugccaggagauagggaagcccagccaggacugacccuccuuccuccagccu

SEQ ID NO: 113157 - RNA, 64 nt, Human
gauacuggggugccacuccccugagaaaagacugagccaggaacuacaagcuccccccacauuc

SEQ ID NO: 113158 - RNA, 64 nt, Human
ucccagagcccagggcaucccaugggggugcugcagccaggaggagaggaaaggacauggguag

SEQ ID NO: 113159 - RNA, 64 nt, Human
aguguuguccaagguugcuagcaggaaauggcagagccaggaguuggaccuagguuuaauccua

SEQ ID NO: 113160 - RNA, 64 nt, Human
aggaccugaucauguagggagggacggggaggggagccaggacccaggagcugcauggcuguaa

SEQ ID NO: 113161 - RNA, 64 nt, Human
ccauucugaaucccugcaggccaagucauugcucagccaggacucaguucauggaggaaacuug

SEQ ID NO: 113162 - RNA, 64 nt, Human
cuccuuccgggccugcucuagugaggagugccuaagccaggacccagaaacucagaguugaugg

SEQ ID NO: 113163 - RNA, 64 nt, Human
ucacuccuccuggucaccuagugagcagggacagagccaggagucaagugcagugccaaggugc

SEQ ID NO: 113164 - RNA, 64 nt, Human
guugaacuuuacugggggugucccuggccccacaagccaggaccugcugugugaaaucgaagac

SEQ ID NO: 113165 - RNA, 64 nt, Human
cuccaggcccuucuccguuucucaagauggggcgagccaggaccacagagcuccuggcccuggc

SEQ ID NO: 113166 - RNA, 64 nt, Human
ggcugugaguggcauguccacuugcuggauuaucagccaggacacuauagaacaggaccagcug

SEQ ID NO: 113167 - RNA, 64 nt, Human
cccagcagucuugguaaaaggagggagccugcugagccaggagggagaaaagaagauugaccag

SEQ ID NO: 113168 - RNA, 64 nt, Human
aagaggagcuaagcugggaugccacauaggcagaagccaggaaaaaugaccaaccacagaacca

SEQ ID NO: 113169 - RNA, 64 nt, Human
guugaagcaauucucaugccucagccucccaaguagccaggacuauaggcaccugccaccaugc

SEQ ID NO: 113170 - RNA, 64 nt, Human
gucgcuugaaccugggagggcggagguugcagugagccaggaucgcgccauugcacuccagccu

SEQ ID NO: 113171 - RNA, 51 nt, Human
acuuccuggugcaagauugacagccaggaggcugcagcuaccacgagggcc

SEQ ID NO: 113172 - RNA, 64 nt, Human
uggugggagcaggaaggagcagugccccucgagcagccaggaagccugcggaucugggaaaugg

SEQ ID NO: 113173 - RNA, 64 nt, Human
ucuccucuguggcuaggaggcucaaaggacugugagccaggagaucugggcuggagcuaggggg

SEQ ID NO: 113174 - RNA, 64 nt, Human
agcgucccgcugcucaucagcuuuuuuaccauugagccaggagugcggcaggcaguaccugccu

SEQ ID NO: 113175 - RNA, 64 nt, Human
cccauguccucucuguggaagguuuuuguucaagagccaggaccaaggcccuugggccacuacc

SEQ ID NO: 113176 - RNA, 64 nt, Human
gucugcugccuggugaggcccacggacuucugagagccaggaauccugcggucugggcccaaca

SEQ ID NO: 113177 - RNA, 64 nt, Human
cugggauuggaggccagaggccagggucagacccagccaggacuccucauuucaucucacagac

SEQ ID NO: 113178 - RNA, 64 nt, Human
uguauuuuuaguagagacgggguuucaccguguuagccaggauguucucgaucuccugaccuca

SEQ ID NO: 113179 - RNA, 64 nt, Human
uaagcaaaaauauaacaucuagaagcacaguuuuagccaggauguuuaaaaauuacaguuuugu

SEQ ID NO: 113180 - RNA, 64 nt, Human
uauauuuuuaguagagaugggguuucaccguaugagccaggauggucucgaucuccugaccuca

SEQ ID NO: 113181 - RNA, 64 nt, Human
ugaguaucugugggaguccucuagagagaugagaagccaggaggccugcaccaaaugucagaag

SEQ ID NO: 113182 - RNA, 64 nt, Human
uguauuuuuaguagaggcaggguuucaccauguuagccaggaugaucucgaucuccugaccuca

SEQ ID NO: 113183 - RNA, 64 nt, Human
uguauuuuuaguagagacaggguuucacuguguuagccaggauggucucgaucuccugaccucg

SEQ ID NO: 113184 - RNA, 64 nt, Human
aggggcacacucuggagaccuugcuggcagugcuagccaggaaacagagugaccaagggacaag

SEQ ID NO: 113185 - RNA, 64 nt, Human
cuucccaguuuccuuucaguaaucuuucugaaggagccaggacaauagggccuguuguuuagug

SEQ ID NO: 113186 - RNA, 64 nt, Human
cagcgcacuguccugugccacauggcuggacuccagccaggaggacacacggugagggcuccag

SEQ ID NO: 113187 - RNA, 64 nt, Human
aagacuugcacaggaucaccaagucaugcuguagagccaggauuccuagacccagggcucugca

SEQ ID NO: 113188 - RNA, 64 nt, Human
uuuuuaguuaguaaaaauccuauuaaugugaaccagccaggaauaacaguguuauuucuauugg

SEQ ID NO: 113189 - RNA, 64 nt, Human
gucauguguuugcaugcuggaugcuauacuguccagccaggacacaagacuucugauuucuacc

SEQ ID NO: 113190 - RNA, 64 nt, Human
uguauuuuuaguagagacgggguuucaccguguuagccaggauggucucgaucuccugaccucg

SEQ ID NO: 113191 - RNA, 64 nt, Human
cuguguuugcacaccaugcuccauguucauucggagccaggagggguucucaguggagccuggc

SEQ ID NO: 113192 - RNA, 64 nt, Human
gcaaguguuucuucuggcuuagucuguuuucuaaagccaggacuauucccuuuccuccccagga

SEQ ID NO: 113193 - RNA, 64 nt, Human
uuguuucucuagucacaucauguguauacaaggaagccaggaauacagguuuucuugaugauuu

SEQ ID NO: 113194 - RNA, 64 nt, Human
uuugauaugaucaugccagauuggagaagauccaagccaggaagaugggcuugaagcaaacugc

SEQ ID NO: 113195 - RNA, 64 nt, Human
uauauuuuuaguagagacgggguuucacuguguuagccaggauggucucgaucuccaggauggu

SEQ ID NO: 113196 - RNA, 64 nt, Human
auagucuggacaccuggugggggaugcaugggaaagccaggagggcccugaccucccacugccc

SEQ ID NO: 113197 - RNA, 64 nt, Human
gcggaaacuccucggcugcuuuuucaaaugcuuaagccaggagugcucagcccaucaacuuccu

SEQ ID NO: 113198 - RNA, 64 nt, Human
ugccccaccugcagacauguuuacuaaugaucauagccaggauuagaaccacuuucaaacauug

SEQ ID NO: 113199 - RNA, 64 nt, Human
aauucuacuucccugacuggagcuaaaucccaccagccaggacccaaacucuccuuaccgagaa

SEQ ID NO: 113200 - RNA, 64 nt, Human
aauuugggcucagcacauuuuacuguuaguagagagccaggaaacguuuucuggguuggggauu

SEQ ID NO: 113201 - RNA, 64 nt, Human
agaucaccaggagcugagaucuucuucagucccuagccaggaauacccauuugauuuccagggu

SEQ ID NO: 113202 - RNA, 64 nt, Human
acugagaugccuuggccauggcacaagagaaaccagccaggaaaaaccagacagacuuucacac

SEQ ID NO: 113203 - RNA, 64 nt, Human
uaccuccucagcucugugcuuggauacagggagcagccaggagacucccuagugcccccaccau

SEQ ID NO: 113204 - RNA, 64 nt, Human
ugcugcaggccucucaggcuuacaucgcacauacagccaggacuguagcuuuaaaaacagcaug

SEQ ID NO: 113205 - RNA, 64 nt, Human
uguauuuuuaguagagacaggguuucacuguguuagccaggauggucuugaucuccugaccuca

SEQ ID NO: 113206 - RNA, 64 nt, Human
augcagccucacagaucuuugcaacacuccaaccagccaggaccaguugaucagaacugaucuu

SEQ ID NO: 113207 - RNA, 64 nt, Human
uaggacccuuuuuucaguaaguaauuuguuuauuagccaggacccaagacuaaguuauuuacau

SEQ ID NO: 113208 - RNA, 64 nt, Human
gaucccuugagcccaggagugcaaggcugcaaugagccaggaucccaugaucacacaucuguau

SEQ ID NO: 113209 - RNA, 64 nt, Human
uguauuuuuaguagagacgggguuucaccguguuagccaggauggucuugaucuccugaccucg

SEQ ID NO: 113210 - RNA, 53 nt, Human
agcaggcccugcagcucugagggagccaggagucgcggccccugccucccuuc

SEQ ID NO: 113211 - RNA, 64 nt, Human
acccucccuccagcagcccugaucacaccaugagagccaggaacgggucacccugcugaagauc

SEQ ID NO: 113212 - RNA, 64 nt, Human
aaacucggaggcccuuuccacgaaauccuaauuuagccaggaccugccaaugauuccagacgac

SEQ ID NO: 113213 - RNA, 64 nt, Human
uggauuuuuaguagagacgggguuuccccguguuagccaggauggucucgaucuccugaccucg

SEQ ID NO: 113214 - RNA, 64 nt, Human
aauuauaaacuauguuaauaccuauaaaauauauagccaggaaccauuuaucaucaagaaaagu

SEQ ID NO: 113215 - RNA, 64 nt, Human
ugaagauggacuuaccugggaccugccccccaugagccaggacgguccccccacagucagccug

SEQ ID NO: 113216 - RNA, 64 nt, Human
gaaaaaggcugaauuucauuuuuuccagcaugaaagccaggaucgguuagugguuggauucuau

SEQ ID NO: 113217 - RNA, 64 nt, Human
cuuuucccaccagcucccaacagaggccucccccagccaggaccaccucguccucguggcgggg

SEQ ID NO: 113218 - RNA, 64 nt, Human
uguggcaugggaggggcuaccuggucccuuucacagccaggacacgccuggaugagaaagccug

SEQ ID NO: 113219 - RNA, 64 nt, Human
aaaaaaaaaagaaaagagaaaaaaaagacuagccagccaggaagaugaauccuagcuucuucca

SEQ ID NO: 113220 - RNA, 64 nt, Human
agagaagcuuccagaccagcccuucacacaccacagccaggaggggccuuucccaccuggagag

SEQ ID NO: 113221 - RNA, 64 nt, Human
ggagagaaauuuccagaccauccccucucaccacagccaggagaggccuuucccaccgguagag

SEQ ID NO: 113222 - RNA, 64 nt, Human
uggagagaaacuuccagaccagcccucucacuacagccaggagaggccuuucccgccuggaaac

SEQ ID NO: 113223 - RNA, 64 nt, Human
cuggaaacuuccggacaagccucucacacaccacagccaggagaggccuuucccaccuggacag

SEQ ID NO: 113224 - RNA, 64 nt, Human
ggacagaaacuuccagaccagccccucucaccacagccaggagaggccuuuaccaccuggagag

SEQ ID NO: 113225 - RNA, 64 nt, Human
ggagagaagcuuccagaccagccccucacaccacagccaggagaggccuuucccaccuggagag

SEQ ID NO: 113226 - RNA, 64 nt, Human
ggagagaaacuuccagaccagccccucacaccacagccaggagaggccuuucccaccgggagag

SEQ ID NO: 113227 - RNA, 64 nt, Human
ggagaggaacuuccagaccagccccucacaccacagccaggagaggccuuucccgccuggagag

SEQ ID NO: 113228 - RNA, 64 nt, Human
uggagagaagcuucaggccagcuccucacaccacagccaggagagaccuuuucugccuggagag

SEQ ID NO: 113229 - RNA, 64 nt, Human
ggagagaaacuuucagaccagccccacacaccacagccaggagaggccguuccugccuggagag

SEQ ID NO: 113230 - RNA, 64 nt, Human
ggagagaagcuuccagaccagcccuucacaccacagccaggagaggccuuucccaccuggagag

SEQ ID NO: 113231 - RNA, 64 nt, Human
ggagagaaacuuccagaccagccccucucaccacagccaggagaggccguucccaccuggaggg

SEQ ID NO: 113232 - RNA, 64 nt, Human
cuaugucaacuacugggaaguauguuacagucuuagccaggaugcaugagagauguuauuuggg

SEQ ID NO: 113233 - RNA, 64 nt, Human
ccccaaagacuaauggggagagggagggccgggaagccaggaaagcuugguguuuucucugggu

SEQ ID NO: 113234 - RNA, 64 nt, Human
uagccuggauccucaguucucaaauguguguggcagccaggaugacuagauccuggguuuccau

SEQ ID NO: 113235 - RNA, 64 nt, Human
uuuuuucuguuaaaucuggcaacccuagucugcuagccaggauccacaaguccuuguuccacug

SEQ ID NO: 113236 - RNA, 64 nt, Human
guuuucauugucaugacuugggggugcuacuagaagccaggaaugcugccaaacauucuaccau

SEQ ID NO: 113237 - RNA, 64 nt, Human
cccacacacacacacagacacacucacacacaagagccaggaugguggaguuuugauugggugg

SEQ ID NO: 113238 - RNA, 64 nt, Human
uguauuuuuaguagagacgggguuucaccguguuagccaggauggucucgaucuccugaccuug

SEQ ID NO: 113239 - RNA, 64 nt, Human
uuuuuuuucaguagagacagggucucaccauguuagccaggauggucuugaucugaccucguga

SEQ ID NO: 113240 - RNA, 64 nt, Human
ggcagguaaccacaggaggaggcaugcccgaggcagccaggacugggcgggaaggugcucccug

SEQ ID NO: 113241 - RNA, 64 nt, Human
gguugcucggggccuugggucggguuuaccaaucagccaggacgcccggggccaccagcucagc

SEQ ID NO: 113242 - RNA, 64 nt, Human
caccuggaggugaaacccagcuccagcucccguuagccaggacuuguccccuggcagcugggcu

SEQ ID NO: 113243 - RNA, 64 nt, Human
uguauuuuuaguagagacaggguuucaccaugugagccaggauggucucaaucuccugaccuug

SEQ ID NO: 113244 - RNA, 64 nt, Human
cuuuacacugacacugaaaauucauccauuuuagagccaggaauucccauguuacacaggaaaa

SEQ ID NO: 113245 - RNA, 64 nt, Human
ggauggaauuggagggcauauguuaagugaaacaagccaggaacagaaaguuaaacauugcaug

SEQ ID NO: 113246 - RNA, 64 nt, Human
ugcuauugaaguuuuggcaauugacuauagugugagccaggaaucacuggcuguuaaucuuuca

SEQ ID NO: 113247 - RNA, 64 nt, Human
auuuaauuaaaaauauuucuacauauugauuugaagccaggauauugauggaccuacagauuua

SEQ ID NO: 113248 - RNA, 64 nt, Human
gaaaugcuggacuuggcucagugcuauaaauuguagccaggaaauaagaagagcuuacacagag

SEQ ID NO: 113249 - RNA, 64 nt, Human
gcccgcuucacgaguuagaguugagcuccccuguagccaggacuaugcuguagauaucaguaug

SEQ ID NO: 113250 - RNA, 64 nt, Human
uugggcucugccgcuuuugcaaaagccaagguaaagccaggaucgcugccaaguuguuugcacu

SEQ ID NO: 113251 - RNA, 64 nt, Human
aauuaugcuuuguagaguuuugucauucagagucagccaggaccauaccgggucuugauucagu

SEQ ID NO: 113252 - RNA, 64 nt, Human
ugaauuuacuuuuuuguuucucacccgcaacuugagccaggacagcugguccaaguggccacag

SEQ ID NO: 113253 - RNA, 64 nt, Human
cuucacuucccgagggcgggugaguggagagcagagccaggagcucuggcagcuguggacagau

SEQ ID NO: 113254 - RNA, 64 nt, Human
ccucuggaauugagugauggacuucacaacaacuagccaggaagggugacaaguaccuucugcc

SEQ ID NO: 113255 - RNA, 64 nt, Human
gcucaagugauccucccaccucagccuaccaaguagccaggaccacaggcaagugcaccaccau

SEQ ID NO: 113256 - RNA, 64 nt, Human
uguggggcgcauauuggagaaggguaaugccagaagccaggaagccugcaagggaugaggccau

SEQ ID NO: 113257 - RNA, 64 nt, Human
auggccccaguuuuuucugucucuucuguuccaaagccaggagagcugacuuccaggugaaggg

SEQ ID NO: 113258 - RNA, 64 nt, Human
ugcucacauccccagcugaugcucaauaaaacucagccaggagcauauggagaugcugacagcc

SEQ ID NO: 113259 - RNA, 64 nt, Human
cagaaucuguauguaucaauacaggguuuuuccaagccaggaaacgcccuccuuggcuacuagg

SEQ ID NO: 113260 - RNA, 64 nt, Human
aacaauaggauuccaaccaggagccucaagugacagccaggaagagaccugaagguuggggcca

SEQ ID NO: 113261 - RNA, 64 nt, Human
uggggccgugggcuggguagggugccuuggcaggagccaggacaaggcccuccuggcagaggag

SEQ ID NO: 113262 - RNA, 64 nt, Human
gaaaacacccacucggcucccaucucugucaccuagccaggagggguagcaaaaauaaagucac

SEQ ID NO: 113263 - RNA, 64 nt, Human
ccagcggcccucaggcuuuucucagacaugcgggagccaggagagcacccuucuccacucagcu

SEQ ID NO: 113264 - RNA, 64 nt, Human
gagugaacagugaguucccccgacagcccacgacagccaggacugcccuccccaccccacccca

SEQ ID NO: 113265 - RNA, 64 nt, Human
gaauauuuaaauucuguacuuauaucuguaaaauagccaggaauuuccuguuugugaucuauua

SEQ ID NO: 113266 - RNA, 64 nt, Human
uguauuuuuaguggagacggauuuucaccguguuagccaggauggucucaaucuccugaccucg

SEQ ID NO: 113267 - RNA, 64 nt, Human
aauggcuguuuuugcuaauuuuuagcuaauaucuagccaggagagcaagcacauaggacagacu

SEQ ID NO: 113268 - RNA, 64 nt, Human
aguggggagaacagcgucuuuuaccugucaccgaagccaggaagccccguuuguaagcgugugu

SEQ ID NO: 113269 - RNA, 64 nt, Human
gggagaggaacaggccuugggaaucaggagcuggagccaggaugcgaagcagcuguaauggucu

SEQ ID NO: 113270 - RNA, 64 nt, Human
ugagagggagaucaaaagcuaagaacuacccuguagccaggacuacaacuguguauuuuaaagc

SEQ ID NO: 113271 - RNA, 64 nt, Human
auguuauugugacaacauuccaguacucugaaauagccaggaaacuucuuugaauggaauuuga

SEQ ID NO: 113272 - RNA, 64 nt, Human
auaguacguguguacacauguguagaguguauguagccaggagugguggggaccagaagccucu

SEQ ID NO: 113273 - RNA, 64 nt, Human
uucucaggggcucuagggacugccaggcuguuucagccaggaaggccaaaaucaagagugagau

SEQ ID NO: 113274 - RNA, 64 nt, Human
uauccagcuaaauggugcaauaggcuaggaauugagccaggagaaaagagaagauaucccagaa

SEQ ID NO: 113275 - RNA, 64 nt, Human
uccucuuccacaggugugcggccgccugagcccgagccaggagcacuagagagggagggggaag

SEQ ID NO: 113276 - RNA, 64 nt, Human
uguauuuuuaguagauacgggguuucaccguguuagccaggauggucuugauguccugaccucg

SEQ ID NO: 113277 - RNA, 64 nt, Human
uggcugagacagggucaccuugggaaggcuugggagccaggaugagugucgggcucucgugugu

SEQ ID NO: 113278 - RNA, 64 nt, Human
gccuuucaccucuucacuuauccuuagucccaguagccaggauaccugauggccacgugugccu

SEQ ID NO: 113279 - RNA, 64 nt, Human
ugguggcagcagagaggcagaagugggaguccagagccaggaacagugaaggaugguuccuggc

SEQ ID NO: 113280 - RNA, 64 nt, Human
gcucaaugggcggccagugugugaggacagcuucagccaggaggcugugagcaaaguggccgcc

SEQ ID NO: 113281 - RNA, 64 nt, Human
aaaaaauguuaaugccaguuggccuacuauaaaaagccaggaccauguuagaauuaggaaaagu

SEQ ID NO: 113282 - RNA, 64 nt, Human
uguauuuuuaguagagacgggguuucaccguguuagccaggauggugucgaucuccugaccucg

SEQ ID NO: 113283 - RNA, 64 nt, Human
gaagcuguccuuauaacgccuuauacgcauacacagccaggaaacguggagcauuguuucucac

SEQ ID NO: 113284 - RNA, 64 nt, Human
gugugaauuccuaaauagaggguaaagugagccuagccaggagguguuuggggcucuaucgcgc

SEQ ID NO: 113285 - RNA, 64 nt, Human
ccccauucuggccagagcagggcuggagggaaggagccaggagggagagagccucccaccuuuc

SEQ ID NO: 113286 - RNA, 64 nt, Human
ucguauaaagaauguaggaagaccuucacccagaagccaggacugacugugcaccagagaaucu

SEQ ID NO: 113287 - RNA, 64 nt, Human
ucuuuaagcagcuguuuaccgaaggcaccaguucagccaggagugaaauccggagaggagcaac

SEQ ID NO: 113288 - RNA, 64 nt, Human
uguguuuuuaguagagacgggguuucaccguguuagccaggauggucucgaucuccugaccuug

SEQ ID NO: 113289 - RNA, 64 nt, Human
guauuuuuuaguagagacgggguuucaccguguuagccaggauggucucgaucuccuaaccugg

SEQ ID NO: 113290 - RNA, 64 nt, Human
auuaugcucuaaugcugcucaucggagaacagacagccaggauaaaguggcaccuucuggagua

SEQ ID NO: 113291 - RNA, 64 nt, Human
ggugcagggagacaucugcaccccugaguugggcagccaggagugcccccgggaauggauaaua

SEQ ID NO: 113292 - RNA, 64 nt, Human
acuaaggaaauaaagcaauaaagacagucucagcagccaggauucuggcugaaggaaaugaucc

SEQ ID NO: 113293 - RNA, 64 nt, Human
ccuucucuucuuccccaauaccuggcucuaacccagccaggaagguguaaacaauaagggugau

SEQ ID NO: 113294 - RNA, 64 nt, Human
gucagggacguuccaauggccaagagagugacacagccaggacccugguggacagccagagggg

SEQ ID NO: 113295 - RNA, 64 nt, Human
uguauuuuuaguagagacgggguuucacuguguuagccaggacggccucgaucuccugaccucg

SEQ ID NO: 113296 - RNA, 64 nt, Human
gucuuccauagauuuuuaaggaagaaagggcccaagccaggagaucgcuugguuuucuuccaga

SEQ ID NO: 113297 - RNA, 64 nt, Human
uuaguaugccaacugccacuacuccuucaaaaggagccaggaccagcgacaagacucaugagag

SEQ ID NO: 113298 - RNA, 64 nt, Human
uaauuuggauaauaaaaauuguagcuuuuuauuaagccaggaaacaugaagcauaauuuguuua

SEQ ID NO: 113299 - RNA, 64 nt, Human
uguauuuuuaguagagaugggguuucacuguguuagccaggauggucucgaucuccugaccucg

SEQ ID NO: 113300 - RNA, 64 nt, Human
auacauuuugcacuauugaugugauacuguagccagccaggaccuuacugaucucagcauaaua

SEQ ID NO: 113301 - RNA, 64 nt, Human
aaguucuuuagagcacugaaagaaacacaaagccagccaggaggaacaguaacucuuccuucgg

SEQ ID NO: 113302 - RNA, 64 nt, Human
cgaggauuugcagugcgucuagcaccuagauuacagccaggaacauugguuaagaacuguugga

SEQ ID NO: 113303 - RNA, 64 nt, Human
ggggagaugacauuugcuuugggcagaggcagcuagccaggacacauuuccacuauaauuuuac

SEQ ID NO: 113304 - RNA, 64 nt, Human
uguauuuuuaguagagacgggguuucaccauguuagccaggauggucucgaucuccugaccucg

SEQ ID NO: 113305 - RNA, 64 nt, Human
uggaacucgaggggagaagucgcgcccccagggaagccaggaaacucugacacagaacgcccaa

SEQ ID NO: 113306 - RNA, 64 nt, Human
aauugcuugaacccaggaggcugagguugcagugagccaggauugcgccaccacacuccagccu

SEQ ID NO: 113307 - RNA, 64 nt, Human
cucaaucuugaguuugcuuuacugguucagcaaaagccaggaagaacaacuuuguaguaaucaa

SEQ ID NO: 113308 - RNA, 64 nt, Human
auuguuucuccuugacacauuucucaauccacgaagccaggagagguagagugaaaaucccagc

SEQ ID NO: 113309 - RNA, 64 nt, Human
uguauuuuuaguagagaugggguuucaccguguuagccaggauggucucgaucuccugaccugg

SEQ ID NO: 113310 - RNA, 64 nt, Human
ccaaagcuguccguuuugcagauggacaggaaggagccaggacacagcucagcuugcucacgcc

SEQ ID NO: 113311 - RNA, 64 nt, Human
cuaaccggccucuuucccaacacuuaaucauggcagccaggaugggugaaugaugaaagcucuu

SEQ ID NO: 113312 - RNA, 64 nt, Human
auuggccaacacgaacuccccaguuauucaugccagccaggaaggaaacgccuuccuuccccac

SEQ ID NO: 113313 - RNA, 64 nt, Human
ugccugccacuaggcaucugcauccccgagcccaagccaggagggauuucccuuaggcaacacc

SEQ ID NO: 113314 - RNA, 64 nt, Human
caggcagcaccuggagcccacagagucuguguguagccaggaagccccgcucagguagccacca

SEQ ID NO: 113315 - RNA, 64 nt, Human
augcuccgggggugacacaggccacgguggcuccagccaggaccagccagaccagcagagcagg

SEQ ID NO: 113316 - RNA, 64 nt, Human
aguauuuuuaguagagacgggguuucaccguguuagccaggauggucucuaucuccugaccuug

SEQ ID NO: 113317 - RNA, 64 nt, Human
cccacagacugguuuugcaacguuuacaccgacuagccaggaaguacuuccaccucgggcacau

SEQ ID NO: 113318 - RNA, 64 nt, Human
gauuuuuuuuuuuaauguguaaagaauugaugcgagccaggaacaugucuguagucccagcuac

SEQ ID NO: 113319 - RNA, 64 nt, Human
uguauuuuuaguagagacggguuuucaccguguuagccaggauggucuugaucucuugaccuug

SEQ ID NO: 113320 - RNA, 64 nt, Human
uguauuuuuaguagagacggaguuucaccguguuagccaggauggucucgaucuccugaccucg

SEQ ID NO: 113321 - RNA, 64 nt, Human
acuuauuccaagcuuucaaaauaaucuuuuaagaagccaggauucuccggucuggaauuucuga

SEQ ID NO: 113322 - RNA, 64 nt, Human
uuccugcgaccaucccggcgccccuagggggagaagccaggacagcagcuuccgcugucuccac

SEQ ID NO: 113323 - RNA, 64 nt, Human
cauuuuaggaggccaaggcaggaggaucacuuggagccaggaguuugagaccagccugggcaac

SEQ ID NO: 113324 - RNA, 64 nt, Human
uuuaagauuuuucucaaaguuuugaaaagcuauuagccaggaucaugguguaauaagacauaac

SEQ ID NO: 113325 - RNA, 64 nt, Human
auaugcccacaggcgucacucaaggagucugcauagccaggaacaucaaguuuugguguuacuu

SEQ ID NO: 113326 - RNA, 64 nt, Human
uguauuuuuaguagagacgggguuugaccguguuagccaggauggucuugaucuccugaccuug

SEQ ID NO: 113327 - RNA, 64 nt, Human
aucccuacucccagccccuucucccaggguccagagccaggaccccuuaaucuagguaaauuga

SEQ ID NO: 113328 - RNA, 64 nt, Human
gaaggaugagggcccaagucuagggucuaaacaaagccaggagugguuugguauauuacugagu

SEQ ID NO: 113329 - RNA, 64 nt, Human
cccccacagcccagacaugagcuacgagaucaugagccaggaccugcaggaccuucugccccag

SEQ ID NO: 113330 - RNA, 64 nt, Human
gcagccuugccucggaggccagcccacccccagaagccaggaagcccccgcgcuggacuggggc

SEQ ID NO: 113331 - RNA, 64 nt, Human
aaguggagggcauuuggaaggagcagugaagccaagccaggaaacaccaagauggcgagccagu

SEQ ID NO: 113332 - RNA, 64 nt, Human
cagcgaugugucuucagagacaauccauuaaagcagccaggaaggacaggcuuuccccuguaua

SEQ ID NO: 113333 - RNA, 64 nt, Human
ugacuugcccaaggucagagccacuuggugacagagccaggaugagaacaaagauuccauuugc

SEQ ID NO: 113334 - RNA, 64 nt, Human
uucagaaacuacagccugagugaagaaauguuacagccaggaacauauuccucagucagcuuuu

SEQ ID NO: 113335 - RNA, 64 nt, Human
uguauuuuuaguagagacaggguuucaccauguuagccaggauggucucgaucuccugaccucg

SEQ ID NO: 113336 - RNA, 64 nt, Human
gcaggugacccggauagaaaauggcccugcguuuagccaggauguggcucuccagcuuggcuuc

SEQ ID NO: 113337 - RNA, 64 nt, Human
ugccauuaaaaagcaaguugcgaugguuuuguauagccaggaguuuauugugauuaaacaucaa

SEQ ID NO: 113338 - RNA, 64 nt, Human
gggccccugcuaaugagaaccuuggugcagcugcagccaggaggggagcgggcccaggagccag

SEQ ID NO: 113339 - RNA, 64 nt, Human
ccaacacuggccagggaugacaaccugguaugggagccaggaguccuggcaucauuagucccag

SEQ ID NO: 113340 - RNA, 64 nt, Human
ccggugugaguggucuccauggcaacuuggagccagccaggaugggguggggagcgguggcacu

SEQ ID NO: 113341 - RNA, 64 nt, Human
cuccagcugagcuugcaggaaacccacuuccugaagccaggacuuccccaugggaagugcaggg

SEQ ID NO: 113342 - RNA, 64 nt, Human
guguaaaagauggagucccacggaggaggggcagagccaggaggcaguggggcugugggcucag

SEQ ID NO: 113343 - RNA, 64 nt, Human
cagaaagggcacuugaaaauaaauuuugauucugagccaggagaaaaacuugaaauguugacuu

SEQ ID NO: 113344 - RNA, 64 nt, Human
aaauuaguacaugcccacagcuggcucccacgguagccaggagaauuaucuauagguggaaagu

SEQ ID NO: 113345 - RNA, 64 nt, Human
acucuacgccucccuggcacugcuaucaggacugagccaggagccccacuagccugugcccggg

SEQ ID NO: 113346 - RNA, 64 nt, Human
acagcagauguggcuaaaugcggagccaggggcaagccaggaugcccugugguuguggcgcccc

SEQ ID NO: 113347 - RNA, 64 nt, Human
ucacugcuucaaccaccugugagaaauuagaaaaagccaggaaugaguuacaaacaguguauga

SEQ ID NO: 113348 - RNA, 64 nt, Human
uaucuuuaaaaacaacuuuaaagguucuuuugugagccaggaucucagacugccguagcaugau

SEQ ID NO: 113349 - RNA, 64 nt, Human
uuuguguguuguguccauuuugcaaacccaacuaagccaggaccccaaugcgacaaguaguuca

SEQ ID NO: 113350 - RNA, 64 nt, Human
ccccuuuugagcccugccagugacagcccugaggagccaggagcccgguggccccuuccccagg

SEQ ID NO: 113351 - RNA, 64 nt, Human
aggacccccaggcuuaccuguaggacucaaagggagccaggaccccaucugaaagggucuccuc

SEQ ID NO: 113352 - RNA, 64 nt, Human
cucagggaggauggggaucaagggacaggccaggagccaggaguggggaagggagggaugaaag

SEQ ID NO: 113353 - RNA, 64 nt, Human
uauauuuugaguagaaaugggguuucaccauguuagccaggauggucucaaucuccugaccuug

SEQ ID NO: 113354 - RNA, 64 nt, Human
caaauccggcugaggcagcagcuggcaccaucagagccaggagagugacaacagguaacggagc

SEQ ID NO: 113355 - RNA, 64 nt, Human
cuccaccugucccuaacggacggcaggucaggaaagccaggacucaggggagaagcaaaccccc

SEQ ID NO: 113356 - RNA, 64 nt, Human
ggguggcuugaggucugggaggguggcccuggccagccaggacacaugcagaccccuggcuuua

SEQ ID NO: 113357 - RNA, 64 nt, Human
ucuaaccagaccucagaaucagaaacgucuccaaagccaggauucugaggaaaguccugugggg

SEQ ID NO: 113358 - RNA, 64 nt, Human
ugcagaagaggguguguuugaaaucaucggagucagccaggagcugucaccaaggaaacgcuac

SEQ ID NO: 113359 - RNA, 64 nt, Human
cuuuggugaccccaacgagaacccucucggcagcagccaggagcuguucaccuuccagaagcag

SEQ ID NO: 113360 - RNA, 64 nt, Human
gucagauccccaggugcugcaccugcagggaggcagccaggacggccggcugccccgcaccauc

SEQ ID NO: 113361 - RNA, 59 nt, Human
acgggaaacuacuccuuuaagauuuggaaagccaggauccuucugcuccgcucaggacc

SEQ ID NO: 113362 - RNA, 64 nt, Human
uccccugggucagugauggaaagggguuaacuucagccaggauugauggcagcugagggaaauu

SEQ ID NO: 113363 - RNA, 64 nt, Human
ggggcaggccuagcuucucccagaacucccggacagccaggacagccucguggcugggcaggag

SEQ ID NO: 113364 - RNA, 64 nt, Human
aucaguggagucaguaucgagccugaccaccgcaagccaggaagcaggugaagugcccagcgcu

SEQ ID NO: 113365 - RNA, 64 nt, Human
uguauuuuuaguagagaugggguuugaccguguuagccaggauggucucgaucuccugaccucg

SEQ ID NO: 113366 - RNA, 64 nt, Human
gccucaagugagcuucaaccuuagccuccugaguagccaggacuauggcauguaccaccgcacc

SEQ ID NO: 113367 - RNA, 64 nt, Human
ucucugcugacugccaggggcgggggcucugcauagccaggaugacggcuuucaugucccagag

SEQ ID NO: 113368 - RNA, 64 nt, Human
ccaggcuuccagcuccucugcaccagaccugaccagccaggacagggccuggggugugugugag

SEQ ID NO: 113369 - RNA, 64 nt, Human
caccaaaagcaauaaagaggaacucuagaacuggagccaggacuaagugagaaaaacugcuuau

SEQ ID NO: 113370 - RNA, 64 nt, Human
aaccuccagggcaaagcugaagguuucuuggggaagccaggaaagccaguauuuccuauguguc

SEQ ID NO: 113371 - RNA, 64 nt, Human
ccuccucagcuucuuguuccugggacaagggucaagccaggaugggcccaggccugggaucccc

SEQ ID NO: 113372 - RNA, 64 nt, Human
uuguauuuuaaguagagacgggguuucaccuguuagccaggauggucucaaucuccugaccucg

SEQ ID NO: 113373 - RNA, 64 nt, Human
cuaggccccaguuugaggcuccccugggaacuagagccaggaacagccaguggcacugacaagg

SEQ ID NO: 113374 - RNA, 64 nt, Human
aaucgcuugaaucugggaggcggagguugcagugagccaggaucacaccauugcuguccagccu

SEQ ID NO: 113375 - RNA, 64 nt, Human
uguguauuggaacagaaaguaacaaagaggaaugagccaggagaacaaacuaauuccuuuaaau

SEQ ID NO: 113376 - RNA, 64 nt, Human
uggugguuucugcccugcagaugucuaacacauaagccaggacauucugcugugagugacuuau

SEQ ID NO: 113377 - RNA, 64 nt, Human
ggacugguggggaagagggccaggacaucuucugagccaggacgucccugaggcuccaccucca

SEQ ID NO: 113378 - RNA, 64 nt, Human
auugaucuugccaagagugagggcagaugucuccagccaggacugcccugagccgcaaaauguc

SEQ ID NO: 113379 - RNA, 64 nt, Human
cauguauuuagcagagacgggguuucaccguguuagccaggauggucucaaucuccugaccuca

SEQ ID NO: 113380 - RNA, 64 nt, Human
aacauguaccuuccucugggcagcugcagcccugagccaggacauguggccuggcuagugcagc

SEQ ID NO: 113381 - RNA, 64 nt, Human
acuuggggggcaggaggaaagcacaauguuucuuagccaggaaagacaaauaauccaacgcugc

SEQ ID NO: 113382 - RNA, 64 nt, Human
ggagucggaaccugaguagauuuccaaauuuuacagccaggacuacagaagugcaucauucuag

SEQ ID NO: 113383 - RNA, 64 nt, Human
cgauacaaugcguagauagaagaagccccacgggagccaggaugggacuggucguguuugugcu

SEQ ID NO: 113384 - RNA, 63 nt, Human
uucccccaguauuagaauaaauuaaaacauacaagccaggaugaaugaagccaauaggaaaua

SEQ ID NO: 113385 - RNA, 64 nt, Human
ucuuaguagcagcuuuguacacugaggacacuguagccaggaaccugugcaugccacccaccgc

SEQ ID NO: 113386 - RNA, 64 nt, Human
ggacaggcagagcuggucuccucccagcagacggagccaggacgggcacaagagucuuggaggu

SEQ ID NO: 113387 - RNA, 64 nt, Human
accuggggauacgaugagaagauggccaccugcaagccaggaagacggcccucaccagacacca

SEQ ID NO: 113388 - RNA, 64 nt, Human
gaaguugggauuaaaagcagucucggaaacacagagccaggaauauagccuuuuggcauggugc

SEQ ID NO: 113389 - RNA, 64 nt, Human
guauuuucaaguagagacgggguuucacuguguuagccaggauggucucgaucuccugaccuca

SEQ ID NO: 113390 - RNA, 64 nt, Human
cauccaacagcuccccgagcugccagccagcccgagccaggaggacgugagugcugauaugcag

SEQ ID NO: 113391 - RNA, 64 nt, Human
guuugacuugcuaguaaacagaagacuucaagccagccaggaaauuaaaguggcgacuaaaaca

SEQ ID NO: 113392 - RNA, 64 nt, Human
gcccugcagucacagcuacacagaucacagcuucagccaggagcugggcagaaggccaagaggc

SEQ ID NO: 113393 - RNA, 64 nt, Human
cacuggcucugcugagcugggccugggugcugaaagccaggauuuggggcuaggcgggaagaug

SEQ ID NO: 113394 - RNA, 64 nt, Human
gccgucuuccaaagccuuacuuccccaagcugccagccaggaggugauaaccacccucccagag

SEQ ID NO: 113395 - RNA, 64 nt, Human
gggcgggagacggggcgguucugaucuggcaggcagccaggaucccugacccuuggcccaaccc

SEQ ID NO: 113396 - RNA, 54 nt, Human
cucagagaaacaccaacugaaaagagccaggaaaacccgggaauuuuccaaaag

SEQ ID NO: 113397 - RNA, 61 nt, Human
uccaccagaucagacacugauccagggaaagagccaggaauggcagugucuucccucuugc

SEQ ID NO: 113398 - RNA, 64 nt, Human
aggcccuacacacagaccgcgccccugggacuaaagccaggaacagggaccagcuccccggggg

SEQ ID NO: 113399 - RNA, 64 nt, Human
aauugcuugaacccaggaggcggagguugcagugagccaggauugugccauugcacuccagccu

SEQ ID NO: 113400 - RNA, 64 nt, Human
agucacuuuuaugagguucaacaguacaggauggagccaggauuuuuaucugggucugucugac

SEQ ID NO: 113401 - RNA, 64 nt, Human
guggugggcuggcagcugacggccugcucaguggagccaggagcuaacucagaccccaaagcaa

SEQ ID NO: 113402 - RNA, 64 nt, Human
cuggggagagaccccagcaccuugagcacacaggagccaggaggagcccaacagagcagcaggg

SEQ ID NO: 113403 - RNA, 64 nt, Human
agacaggagcugucgccccaggccugugcugcccagccaggaacccuguacugcugcugcgacc

SEQ ID NO: 113404 - RNA, 64 nt, Human
agcuuuggcccucagugggcucccuggcccagccagccaggaacuggcuccuuugccucugcua

SEQ ID NO: 113405 - RNA, 64 nt, Human
aauguccagaucuauggcgaacacagguguuggaagccaggacugugauaaucagaagcuauaa

SEQ ID NO: 113406 - RNA, 64 nt, Human
ucauauucuacccaggaaugguacuuuucagugcagccaggagggcucuugggauuuccuuucc

SEQ ID NO: 113407 - RNA, 64 nt, Human
cgaccuuaaaaaggguuagauugacauugcaggaagccaggauguaauucucagaaccagucuc

SEQ ID NO: 113408 - RNA, 64 nt, Human
caucccgguucccccagacaagagagggcaagucagccaggaacugccuccucccugcucuaca

SEQ ID NO: 113409 - RNA, 64 nt, Human
uaaaaaagacuauuuuauaugauucacaugcuaaagccaggauuguguuggguugaauauauuu

SEQ ID NO: 113410 - RNA, 64 nt, Human
ucggggagggcgccuaguccccccagcucuaagcagccaggagggaccugcaucuaagcaucug

SEQ ID NO: 113411 - RNA, 64 nt, Human
uggaggagacuguguaggguccggcguggggaucagccaggaugggcugcgcgucuccagccuc

SEQ ID NO: 113412 - RNA, 64 nt, Human
ucgggauggacucccugggccccacccauugccaagccaggaaggcagcuuucgcuuguuccug

SEQ ID NO: 113413 - RNA, 64 nt, Human
gaggcugccuaggcuggggucccagguggggcccagccaggaggugggguguggacccggcccu

SEQ ID NO: 113414 - RNA, 64 nt, Human
gagcaguggagcaagggagaccugggagcgugggagccaggaucagcgcccccugccaugugcc

SEQ ID NO: 113415 - RNA, 64 nt, Human
ugcauguccccacugggccugagucuagccugggagccaggauacugggguccuuuucccacuc

SEQ ID NO: 113416 - RNA, 64 nt, Human
gaagggaggcccgcggcgguggagccgagcggggagccaggaaagaagaguuggagugagauga

SEQ ID NO: 113417 - RNA, 64 nt, Human
uaggauuuaaaucaugcaacaacgagaguaucacagccaggaugacccuugggucccauuccua

SEQ ID NO: 113418 - RNA, 64 nt, Human
gcccugaaacaggaauggggcaaagagaaaggagagccaggagcauuuaaaaaucagcaucugg

SEQ ID NO: 113419 - RNA, 64 nt, Human
accacacccggugggggcacagcacagaccccagagccaggaaccucucagccgaugccccuca

SEQ ID NO: 113420 - RNA, 64 nt, Human
gccacacccagugggggcacagcacagaccccagagccaggaaccucucagccgaugcccccca

SEQ ID NO: 113421 - RNA, 64 nt, Human
gccacucccgguggggacacagcacagaccccaaagccaggaaccucucagccgaugccccccg

SEQ ID NO: 113422 - RNA, 64 nt, Human
gcaagaggacuggggucuccugcccucucuguugagccaggaaucccaagugagggguugcccu

SEQ ID NO: 113423 - RNA, 64 nt, Human
cucauuugccuuuugcaccuuuccugaugcuuccagccaggagaaguccuggaauaagaguuau

SEQ ID NO: 113424 - RNA, 64 nt, Human
ucucugcccucuguaccggacacugugucuccucagccaggaagggguaaugagcuccagcccc

SEQ ID NO: 113425 - RNA, 64 nt, Human
uguauuuuuaguagagacgggguuucaccguguuagccaggaugaucucgaucuccugaccucg

SEQ ID NO: 113426 - RNA, 64 nt, Human
gcggggggguggggaauucagccacacuccagaaagccaggagucgacaguuuuggaagccucu

SEQ ID NO: 113427 - RNA, 64 nt, Human
uuguauuuuuaguacagauggguuucauuauguuagccaggauggucucgaucuccugaccuca

SEQ ID NO: 113428 - RNA, 64 nt, Human
uugauuuuuaguagagacaggguuucaccguguuagccaggauggucucgaucuucugacagau

SEQ ID NO: 113429 - RNA, 64 nt, Human
agcuccguaagguggcggcaccugaggaggaagcagccaggaguggcuggggaagaaucuggag

SEQ ID NO: 113430 - RNA, 64 nt, Human
gccuucugccuucugguuccucaccccucagaccagccaggaaccucucagagcugaagcaggc

SEQ ID NO: 113431 - RNA, 64 nt, Human
ugugagagccagcccuguaugccaacaccuguugagccaggagacagaagcugugagccucugg

SEQ ID NO: 113432 - RNA, 64 nt, Human
caagagagaauuugugucuauuggcaaagaacuaagccaggaagacaugggccaucccuccgcu

SEQ ID NO: 113433 - RNA, 64 nt, Human
gaaaagacaagugucuucugugugucacagggaaagccaggaguggccuucucugcaggccagc

SEQ ID NO: 113434 - RNA, 64 nt, Human
aguugacauuugacagugugggaggccucguaccagccaggaucccaagcgucccgucccuugg

SEQ ID NO: 113435 - RNA, 64 nt, Human
gagaagcugguggaguccuguggcuuuccagagaagccaggagccaaaagcugggguaggagag

SEQ ID NO: 113436 - RNA, 64 nt, Human
ccacuucuccaucgcagccccaccuuggcugcugagccaggagcuaaaaccuuagauaucuggu

SEQ ID NO: 113437 - RNA, 64 nt, Human
ugcauuuuuaguagagacgggguuucaccguguuagccaggauggucucgaucuccugaccucg

SEQ ID NO: 113438 - RNA, 64 nt, Human
cuucccacauauaaguugagaaggugccugccauagccaggagcgcaucucaauggaaacauca

SEQ ID NO: 113439 - RNA, 64 nt, Human
caaagucuccugugacauuuuuucuuuggucagaagccaggaacuggugucauuccuuaaaaga

SEQ ID NO: 113440 - RNA, 64 nt, Human
uccuuccuuuucuuugagaguucgugaagagggaagccaggauuggggaccugauggagaguga

SEQ ID NO: 113441 - RNA, 64 nt, Human
cuaacaucaaaauaaagaggcugggccgcuguguagccaggacaugcccaugccaccgccuauu

SEQ ID NO: 113442 - RNA, 64 nt, Human
agcuguaaucaauugugcgcaguugggaaaggaaagccaggacuuguggggugggugggaccag

SEQ ID NO: 113443 - RNA, 64 nt, Human
acacaggccaggccugggccaggagucugccaggagccaggagcgccuacaccucccuggaggc

SEQ ID NO: 113444 - RNA, 64 nt, Human
ccugagcagaagaacuggagaaagggaaccacagagccaggaggaaugucugagcagagucaag

SEQ ID NO: 113445 - RNA, 64 nt, Human
uguauuuuuaguagagacgggguuucacuguguuagccaggauggucucgaucuccugaccuug

SEQ ID NO: 113446 - RNA, 64 nt, Human
uguauuuuuaguagagacgggguuucaccguguuagccaggaaggucucaaucuccugaccucg

SEQ ID NO: 113447 - RNA, 64 nt, Human
ugaaacuucgucucuacuaaaaauacaaaaaauuagccaggagugguggcaggcaccuguaguc

SEQ ID NO: 113448 - RNA, 64 nt, Human
agacacacacaccagcagagacagaaacagcaauagccaggacuccuggcuaaaacgggggaag

SEQ ID NO: 113449 - RNA, 64 nt, Human
uggcuauauugaacuguuuuggaggggaggggguagccaggaaggaaacaagagaaaguacguc

SEQ ID NO: 113450 - RNA, 64 nt, Human
ugaugagacuuccugcugccuuuggacauaacuaagccaggaaacuuuaaaagccuucuagaaa

SEQ ID NO: 113451 - RNA, 64 nt, Human
uguacuuuuaguagagacaggguuucaccguguuagccaggauggucucgaucuccugaccucg

SEQ ID NO: 113452 - RNA, 64 nt, Human
uguauuuuuaguagagacaggguuucaccguguuagccaggauggucucgaucuccugaccuug

SEQ ID NO: 113453 - RNA, 64 nt, Human
uguauuuuuaguagagacgggguuucaccagguuagccaggauggucucgaucuccugaccuug

SEQ ID NO: 113454 - RNA, 64 nt, Human
acagugacucgaaccuuacccaaacaagugggagagccaggagccaaacuaucaggcuccaaag

SEQ ID NO: 113455 - RNA, 64 nt, Human
gcaccugcaccaccaagguugaugccggauucgaagccaggaaggcccagucccuccucugcuc

SEQ ID NO: 113456 - RNA, 64 nt, Human
cauucuuuaaagagccaaguugcuucggggaaacagccaggaaaauggucaagauuauuuuuag

SEQ ID NO: 113457 - RNA, 64 nt, Human
guugguaccucccucccuggaucucugagccagcagccaggaggaccugacccagcaguucuuu

SEQ ID NO: 113458 - RNA, 64 nt, Human
ugacagcucaggagugucugcacacugucucggaagccaggauuccauuuguguugcugcugua

SEQ ID NO: 113459 - RNA, 64 nt, Human
cucuuauuuaucugcagaaggaacuuuggggugcagccaggacccgguaggccugagccucaac

SEQ ID NO: 113460 - RNA, 64 nt, Human
agccagcgucuccccuguggagagucggggcuccagccaggagcgcuccagguaaccccugucc

SEQ ID NO: 113461 - RNA, 64 nt, Human
acagcugaggguacgaugaggccugggcucagugagccaggacgaaugugacagacaccccuug

SEQ ID NO: 113462 - RNA, 64 nt, Human
gucuuccauaggaaacugggaaucucauaggaagagccaggacaugaagaaaaggaaauaugau

SEQ ID NO: 113463 - RNA, 64 nt, Human
ucccccaugcacauugccuuaucucuccccaucuagccaggaaucuauuguguuuuucuucugc

SEQ ID NO: 113464 - RNA, 64 nt, Human
ggacuguguaaagaugaucaaccaucucaauaaaagccaggaacagagaagagauuacaccagc

SEQ ID NO: 113465 - RNA, 64 nt, Human
aaaaauguuggggguuggggggaagaguggugcuagccaggaagaagccaguaaacauguaaau

SEQ ID NO: 113466 - RNA, 64 nt, Human
acuggcagcuaaggaggaccucggaguggacccgagccaggaauaacgaaugacccaaggccaa

SEQ ID NO: 113467 - RNA, 64 nt, Human
gcggggaggggguggagugaagcucagggcuugcagccaggacacugcccacuggagccuguca

SEQ ID NO: 113468 - RNA, 64 nt, Human
gccuccacugccagccuaugguuguucgccaccaagccaggagugcugcaccgcccaguggucc

SEQ ID NO: 113469 - RNA, 64 nt, Human
gaaggggugggcuggauuuuguaaagcuggaggcagccaggaaucugacuguccggaaugugag

SEQ ID NO: 113470 - RNA, 64 nt, Human
auucaguuuuuccaucugccacauggaaguucauagccaggauagggcgggagaggcaccagaa

SEQ ID NO: 113471 - RNA, 64 nt, Human
aaguuguaucuuguauagccacugcauauuacauagccaggaguaccccuugaggcuaauucua

SEQ ID NO: 113472 - RNA, 64 nt, Human
auccuggaggcccaguucacccugauuuaggagaagccaggaauuucccaggacccugaagggg

SEQ ID NO: 113473 - RNA, 64 nt, Human
aggcucauacuguccuguccuuacccucagauggagccaggaagcucagugaaaggcuucccua

SEQ ID NO: 113474 - RNA, 64 nt, Human
guugacuuggugucugggaguucccgaacccuagagccaggauguucuguuuaaucaacagcuc

SEQ ID NO: 113475 - RNA, 64 nt, Human
gggcacuuucaccaagauguucuagaaacuucugagccaggagugaauggcccuuccuuaguag

SEQ ID NO: 113476 - RNA, 64 nt, Human
ccacaaguacuugcaccgugugaucucccuggugagccaggagcccgugcuguucgcccgcucc

SEQ ID NO: 113477 - RNA, 64 nt, Human
gaagugcuaagaucagucacccaugugaauaagaagccaggaaaggaaagauggggaagcccag

SEQ ID NO: 113478 - RNA, 64 nt, Human
gcuuaccuuacucaauuuaaagucaaaagccaacagccaggagcagcucagguacuucagaugu

SEQ ID NO: 113479 - RNA, 64 nt, Human
acuccagguuuauaaacuaucuuuuaaaauuuuaagccaggacuucaaaaauuguagaguacuu

SEQ ID NO: 113480 - RNA, 64 nt, Human
cggggucccuggagggcaagcccugcccacagaaagccaggagcagcccuggcccccaucagcc

SEQ ID NO: 113481 - RNA, 64 nt, Human
uguacuuuuaguagagacgggguuucaccguguuagccaggauggucucgaucuccugaccuug

SEQ ID NO: 113482 - RNA, 64 nt, Human
gaccuacagaccuggcucucagaggaaaaaugggagccaggaguaagacaagugggauuugggg

SEQ ID NO: 113483 - RNA, 64 nt, Human
uucccagcucugacccuucuacauuugagggcccagccaggagcagauggacagcgaugagggg

SEQ ID NO: 113484 - RNA, 64 nt, Human
ugcucagugguuugcccuuggcuaaaugaagcagagccaggaaaaacagacuacauauuuuuca

SEQ ID NO: 113485 - RNA, 64 nt, Human
uggaauauaucacuuaacucaaaaagcccuguuaagccaggacuguuaucuccauuuaacagau

SEQ ID NO: 113486 - RNA, 64 nt, Human
gaaauaauagguguagaagacucucccuaaggguagccaggaagaagucuccugauucggacaa

SEQ ID NO: 113487 - RNA, 64 nt, Human
uguuucaaugcuguaaguagguguagccaagggaagccaggacuaucugauauacgguagcagg

SEQ ID NO: 113488 - RNA, 64 nt, Human
ugucccagggcccaaaagucagaagggccccaccagccaggaaaguuguuucaaugcuguaagu

SEQ ID NO: 113489 - RNA, 64 nt, Human
ugaguugggggaugugguagaagcugugaggcacagccaggaccgggccuuccugcgccgcuug

SEQ ID NO: 113490 - RNA, 64 nt, Human
ccaggaggaagcagucccuccucaccagcucuccagccaggacgaucacacagagaugaauggc

SEQ ID NO: 113491 - RNA, 64 nt, Human
acugucucuucagaucugaaauacuccaguuuagagccaggaaauuucacaggucacaccgauu

SEQ ID NO: 113492 - RNA, 64 nt, Human
uucaccagggcacccauccaaggaaccuccgaacagccaggaaaagccaugaguugcaaccaaa

SEQ ID NO: 113493 - RNA, 51 nt, Human
agaccaguggggacagguagaagccaggaguggaugcugggcagaggccag

SEQ ID NO: 113494 - RNA, 64 nt, Human
gguguauggagucaccuguaaauugauucaagugagccaggaaagcagcaaaggaaagagaaac

SEQ ID NO: 113495 - RNA, 64 nt, Human
uguauuuuuaguagagacaggguuucaccguguuagccaggauggacuccaucuccugaccucg

SEQ ID NO: 113496 - RNA, 64 nt, Human
ucuggggaugggaaugacuuccucgagaccauacagccaggaaauagcggugaaucuagugauc

SEQ ID NO: 113497 - RNA, 64 nt, Human
cagcacuugaucggaaguccagguuaguaugugaagccaggaguacuauuauuauuguguuagc

SEQ ID NO: 113498 - RNA, 64 nt, Human
uuauauuuuuaguagagacggguuucaucauguuagccaggauggucuugaucuccugaccuca

SEQ ID NO: 113499 - RNA, 64 nt, Human
ugacugaccccagugguauccugugacauguaacagccaggaguguuaagcguucagugaugug

SEQ ID NO: 113500 - RNA, 64 nt, Human; identical to SEQ ID NO: 113209

SEQ ID NO: 113501 - RNA, 64 nt, Human
guuuauaagaccucuuucagcagaucacaucagaagccaggaaaugcauagcuaggagauguca

SEQ ID NO: 113502 - RNA, 64 nt, Human
uacaaauuggauuucaggaaggagacuccaucacagccaggaccuuucgugccauggagagugu

SEQ ID NO: 113503 - RNA, 64 nt, Human
ggacaacugagucuccggcccaccuaccaccgccagccaggaucccccaaagugugcagagggc

SEQ ID NO: 113504 - RNA, 64 nt, Human
gcuguacaucuaggccaccccagccuggccacgcagccaggacaccgggcagggccgcccgggc

SEQ ID NO: 113505 - RNA, 64 nt, Human
uuuguauuuuuaguagagacgguuucaccguguuagccaggauggucucgaucuccugacguug

SEQ ID NO: 113506 - RNA, 64 nt, Human
gaucagccccacccuggccuagaccagcagacagagccaggagaagcucagcugcauuccgcag

SEQ ID NO: 113507 - RNA, 64 nt, Human
ucgcacccuucuggaccaaagcgccaaggacugcagccaggagagagggggcucaccucuuauc

SEQ ID NO: 113508 - RNA, 64 nt, Human
agagaggaagcuggaaaaguuccuggggcucugcagccaggaaggggaaccagggcaaaucuua

SEQ ID NO: 113509 - RNA, 64 nt, Human
accgugcucggcccaaggcaggagaaucucuugaagccaggaggcggaaguuguggugagccga

SEQ ID NO: 113510 - RNA, 64 nt, Human
uuaacuucucccuuaccagugaccccagagacagagccaggacaggagugggggccagccugag

SEQ ID NO: 113511 - RNA, 64 nt, Human
gcauuugaggucggaaacccucuacugccccauaagccaggaaaagugaaaagagaacacaguu

SEQ ID NO: 113512 - RNA, 64 nt, Human
acaaacauuacugagcccaaaagaucaaggagucagccaggacccuguggacauaaagaaguug

SEQ ID NO: 113513 - RNA, 64 nt, Human
gcgaaacccugugucuacuaaaaauacaaaaacuagccaggaaugguggcgcgcgccuguaauc

SEQ ID NO: 113514 - RNA, 64 nt, Human
acccagacuugggccguugcucugacauggacacagccaggacaagcugcucagaccuacuucc

SEQ ID NO: 113515 - RNA, 64 nt, Human
cgcuggggcagagccaggccggagucgaaugaucagccaggaagaguuugccaggcagcuacag

SEQ ID NO: 113516 - RNA, 64 nt, Human
gguggucugacugcacugucuccaucuuaugcaaagccaggaacucacucacugucuuaaguga

SEQ ID NO: 113517 - RNA, 64 nt, Human
caguccuuuuucauaccuagugggauacagaagaagccaggacaguggcuuugccagcuaagug

SEQ ID NO: 113518 - RNA, 64 nt, Human
ucacucuuuagucuugauaucuaccugucuguucagccaggacaacaaauggcuuccaagccug

SEQ ID NO: 113519 - RNA, 64 nt, Human
agggaccaauccugugaccucccagaaccauggaagccaggacgucaggcugaccaacaccuca

SEQ ID NO: 113520 - RNA, 64 nt, Human
augggcccaaggaauucagaagagcuugcaggcaagccaggagacccugggagcuguggcuguc

SEQ ID NO: 113521 - RNA, 64 nt, Human
ccaagccugacacuacuaaaugauuugguagugaagccaggacaucuacccuugacuauuuuuu

SEQ ID NO: 113522 - RNA, 64 nt, Human
uagaugcugauggagccuucccaaguugugcuugagccaggaggccugcuaggguuaggagguc

SEQ ID NO: 113523 - RNA, 64 nt, Human
auugcaaggaagcuauuuaacauggugcugagcuagccaggacugauggagccccugggggugu

SEQ ID NO: 113524 - RNA, 64 nt, Human
cucuaaucucuucccuuaagcccuguggccacacagccaggagagacuugccgcuggcucccgc

SEQ ID NO: 113525 - RNA, 64 nt, Human
uauuuuuuucugugaaaaaauuaaaacguacuuaagccaggagaaugaauuauacagugauuga

SEQ ID NO: 113526 - RNA, 64 nt, Human
ucccugugggcucagggucuccugcgggcuaggcagccaggagcucuguccgcaaaaccaaauc

SEQ ID NO: 113527 - RNA, 64 nt, Human
uguauuuuuaguagagauaggcuuucaccuuguuagccaggauggucucacguuuuguuuuuuu

SEQ ID NO: 113528 - RNA, 64 nt, Human
uuccucaggagagagagaccacagggugagagugagccaggaacagcaaggacguugauugguu

SEQ ID NO: 113529 - RNA, 64 nt, Human
agguggcacaaauaagagaggggagauggggggcagccaggagaggaggugucccuuccucgcc

SEQ ID NO: 113530 - RNA, 64 nt, Human
cacuuugggugggugaggcaggcggaucacuugaagccaggacuucaagaccagcuuggccaac

SEQ ID NO: 113531 - RNA, 64 nt, Human
uuuaggaacugcccagaagaaaauccaaggcuuuagccaggagcggaaacugacuaccauguaa

SEQ ID NO: 113532 - RNA, 64 nt, Human
uggagugccaaguagaucuccuccuccuucaugcagccaggauugccuccagugcuguuagcuu

SEQ ID NO: 113533 - RNA, 64 nt, Human
uuuaaaucaucacgcccuggcuuaucccuggucgagccaggacacggggugcuucagugggucu

SEQ ID NO: 113534 - RNA, 64 nt, Human
ccagagccccuugcauauccccacugucaggggcagccaggacuguucccauccuccuggaaug

SEQ ID NO: 113535 - RNA, 64 nt, Human
cccucugccuaggccccugguacucagucacggcagccaggagaccccaggugaguuucugagc

SEQ ID NO: 113536 - RNA, 64 nt, Human
ggggaaagcugcuggugugaccagcugagcacccagccaggagaccugcagcccugcgccuucc

SEQ ID NO: 113537 - RNA, 64 nt, Human
gccuggggacagcugcugcucugaugaccucuucagccaggagcuguaucgagggggaggcgcc

SEQ ID NO: 113538 - RNA, 64 nt, Human
agggugugcugggacccgaguaggagcuaggacuagccaggacccgcagccgccucgucaccuc

SEQ ID NO: 113539 - RNA, 64 nt, Human
cccugggaccagcugcccuacuucccagguuuguagccaggagaagggggcaucacagagcuga

SEQ ID NO: 113540 - RNA, 64 nt, Human
aguuacucugcucaugagacagaucugggcuccaagccaggaaaggugaacagaaaccacaagu

SEQ ID NO: 113541 - RNA, 64 nt, Human
ccccugguuguuguagcagcuuaacuguaucuggagccaggaccugaacucgcaccuccuaccu

SEQ ID NO: 113542 - RNA, 64 nt, Human
uacacaccuguggucccagcuacuagggaggcugagccaggaagaacgcuccagcccaggacuu

SEQ ID NO: 113543 - RNA, 64 nt, Human
aaucgguaacaguugccgaaccaggccgccucacagccaggaaauuuggaaauccuagccaagg

SEQ ID NO: 113544 - RNA, 64 nt, Human
agcacuuugggaggccaagccagauggaucaugaagccaggaguucgagaccagccugaccaac

SEQ ID NO: 113545 - RNA, 64 nt, Human
aaucacuugagcccaggaguucgaggcugcagugagccaggaucaugccacugcacuccagccu

SEQ ID NO: 113546 - RNA, 64 nt, Human
gauggggagugagaggcugggaauggaggggcagagccaggaagaucccccagaaaagaaagcu

SEQ ID NO: 113547 - RNA, 64 nt, Human
cccagcuguggaagcagagguagaagacgaggccagccaggagggcgacuucagucacagcucc

SEQ ID NO: 113548 - RNA, 57 nt, Human
aggaauggguguguuuguaggagagaaagccaggagguaagagccagcugauauccu

SEQ ID NO: 113549 - RNA, 64 nt, Human
gcccgggcccaagcccugccccuccagaguccagagccaggaaggggcugcugagggcgagcau

SEQ ID NO: 113550 - RNA, 64 nt, Human; identical to SEQ ID NO: 113190

SEQ ID NO: 113551 - RNA, 64 nt, Human
gaguucacaguucgacuaacccugugaacacccaagccaggaguucuaugagaagccaaauggu

SEQ ID NO: 113552 - RNA, 64 nt, Human
ggaaugccaccacccucaguaauggcaguaccagagccaggaccaacgucaaggguaucccauc

SEQ ID NO: 113553 - RNA, 64 nt, Human
gacgaugaaugaggagccgccugagccuuccuggagccaggaccuggauuccucuggguagagg

SEQ ID NO: 113554 - RNA, 64 nt, Human
cagaccuggugcggagccaggcggagggacacagagccaggacucccagccguauugaaaugga

SEQ ID NO: 113555 - RNA, 64 nt, Human
cuuugagaagauauuuucccacaaaggggugggaagccaggagugagaaggaauucagggagag

SEQ ID NO: 113556 - RNA, 64 nt, Human
uugguuccccuugucuauggagccccgccuugugagccaggaagcagcgucucaucaggacaga

SEQ ID NO: 113557 - RNA, 64 nt, Human
guuuaugugcacgcauguauaugcaucaccacguagccaggaggggccuguugggguuugaguc

SEQ ID NO: 113558 - RNA, 64 nt, Human
ugacguuauuuaaaaacaacaacaaagaaggcagagccaggauauaacuagaaaaaggaugucu

SEQ ID NO: 113559 - RNA, 64 nt, Human
guuggguaacucagccauggagaugccaagcacuagccaggaggugaguuccucuuuagggcuu

SEQ ID NO: 113560 - RNA, 64 nt, Human
ggcuaacaguuaguuacuuguuaaugcuagucacagccaggaggucagaaggaauuuucuacuu

SEQ ID NO: 113561 - RNA, 64 nt, Human
uuucuuccacuacccucccucgcauccgccucugagccaggagccuccugacccugugaugccu

SEQ ID NO: 113562 - RNA, 64 nt, Human
ugagaagccaaagccccuacaacuccagccacccagccaggaggggcuguccaaucacauucag

SEQ ID NO: 113563 - RNA, 64 nt, Human
cgucaccucuccgcucauacaggaaugaagccuuagccaggaggccaggcucagcccugugcca

SEQ ID NO: 113564 - RNA, 64 nt, Human
ggauggccucuggggcaggaccacuagcuaagcaagccaggagaagaccccugcccaaguggcu

SEQ ID NO: 113565 - RNA, 64 nt, Human
ccuugggagucauuaaagccaagucauucauagcagccaggaaacaauaggaaccaaaagccuc

SEQ ID NO: 113566 - RNA, 64 nt, Human
uggugaacccuccaauucaggaagugggaaaaggagccaggaaaugugcuucuacuuugccagu

SEQ ID NO: 113567 - RNA, 64 nt, Human
uuuccuccacagccagccuguccaacagaggggcagccaggacaucucugcccucuucucaucc

SEQ ID NO: 113568 - RNA, 64 nt, Human
aggugcaucugcaggcaccgggcuggcugcuugcagccaggagaaggucagcgagaaggagugu

SEQ ID NO: 113569 - RNA, 64 nt, Human
guggccgaagcagguguccaggcagguaggcugcagccaggagcucccuggcaccgcaggaccu

SEQ ID NO: 113570 - RNA, 64 nt, Human
cggggccuggggucucuguggugccugcagcaggagccaggaacgcccggcaggcaggcgcucu

SEQ ID NO: 113571 - RNA, 64 nt, Human
uguauauuuaauagagacaggguuucaccauguuagccaggauggucucgaucuccugaccucg

SEQ ID NO: 113572 - RNA, 64 nt, Human
aagaacuuaccuucagaacauacucuaauaaugcagccaggagccgucagccagaucccaaaug

SEQ ID NO: 113573 - RNA, 64 nt, Human
accccuuugcaggacuugcacacagggaggcuguagccaggaaacccucuucuucccuggucug

SEQ ID NO: 113574 - RNA, 64 nt, Human
ucagaagaagcuucauucccucuuaaucuaguuaagccaggacauccagaauucauugcuuuaa

SEQ ID NO: 113575 - RNA, 64 nt, Human
aaugaguugccuccaaccugucccaacagcugacagccaggagccacucucccagcugcaggcc

SEQ ID NO: 113576 - RNA, 64 nt, Human
caccaggcacuagcaaagaagcuuggaaauagaaagccaggaguggcuguccccaguaugcaaa

SEQ ID NO: 113577 - RNA, 64 nt, Human
aucccagaacauuguuugccaguaucucaaccacagccaggaaguauaugugaguugcccagag

SEQ ID NO: 113578 - RNA, 64 nt, Human
gggugagcagagucacccacagggccagccccucagccaggagccaguggcaggagcggaacag

SEQ ID NO: 113579 - RNA, 64 nt, Human
uuaugugagugcugggacuguggaauaccuguacagccaggauggcagcuucuacuuucuggaa

SEQ ID NO: 113580 - RNA, 64 nt, Human
uuucacaaaacaggaccugccuacggcugaacggagccaggaggccacgugucccagcccagcg

SEQ ID NO: 113581 - RNA, 64 nt, Human
ggugcaccuguagucccagcuacuagggaggcugagccaggaggaucacuugagcccgggaggu

SEQ ID NO: 113582 - RNA, 64 nt, Human
ccuuugauuuuggcccucugauguauugugcccaagccaggagcugcuugggcagucccagcuc

SEQ ID NO: 113583 - RNA, 64 nt, Human
cgccagcucugcccaaggcgccaccugggcggacagccaggagcucuccauggccaggcugccu

SEQ ID NO: 113584 - RNA, 64 nt, Human
uucccacuuucuggguggcuuuuuggguccacccagccaggaugcugcaggccaagcugggugu

SEQ ID NO: 113585 - RNA, 53 nt, Human
cggaacacaugagcauguaacagagccaggaacccuacugcaguaaacugaag

SEQ ID NO: 113586 - RNA, 64 nt, Human
cagggcagggcagugacacuguaggagcauagcaagccaggagauggggugaagggacacaguc

SEQ ID NO: 113587 - RNA, 64 nt, Human
gcacacaccugugcccagacgccaaugccuccuaagccaggagcuggguuaugcaccgccaugg

SEQ ID NO: 113588 - RNA, 64 nt, Human
gagagacccgggaaggaaggcucucgggugggggagccaggagaccugcucuccggcgcagaca

SEQ ID NO: 113589 - RNA, 64 nt, Human
aggggagcuggcgggagggugggaggugggauuuagccaggaaaggggugagagugauuguguu

SEQ ID NO: 113590 - RNA, 64 nt, Human
ccacagugaguauguaacuugaccaaggucacugagccaggacuggacccaggacccucgcguc

SEQ ID NO: 113591 - RNA, 64 nt, Human
guggugaaggaacggaaucgcaaguaugaccagaagccaggacaaagcuggcagggggagaucc

SEQ ID NO: 113592 - RNA, 64 nt, Human
cccacuaugaccuuugacccuacggcgcaggggcagccaggacccuugauucagaccauggacc

SEQ ID NO: 113593 - RNA, 64 nt, Human
gaguggaaggugaggcguucuccugcuuguacuaagccaggaggcuuuaagcuccagcuuuaag

SEQ ID NO: 113594 - RNA, 64 nt, Human
agugccaccacccccggcaggccuucccugacccagccaggaacaaacaagggaccaagugcac

SEQ ID NO: 113595 - RNA, 64 nt, Human
ucgauggacagccucacccaccccaccugggcccagccaggagccccgccuggccaucaguauu

SEQ ID NO: 113596 - RNA, 64 nt, Human
ccgucacucagacugagacuugaguuauuacagaagccaggaaaaguguauuagaaacuguugu

SEQ ID NO: 113597 - RNA, 64 nt, Human
ugagucauagaggauacagacuugcccaaaggagagccaggauuuucacacccccuccucaagc

SEQ ID NO: 113598 - RNA, 64 nt, Human
ccgccuccggggcggacccugcuccacuuccagaagccaggacuaggaccugggccuugccugc

SEQ ID NO: 113599 - RNA, 54 nt, Human
gacccgcgccgcuguggugacggaagccaggaggcaggcgcgcguccaaaucca

SEQ ID NO: 113600 - RNA, 64 nt, Human
cauucauauuacagcucuuacuuaaauuugaccaagccaggauauaucuguuaggccacauuca

SEQ ID NO: 113601 - RNA, 64 nt, Human
ucucgucucacgcaguucgaggaggacccuagaaagccaggagcugugauugacaguagcugua

SEQ ID NO: 113602 - RNA, 64 nt, Human
uguauuuuuaguagagacgcaguuucaccguguuagccaggauagucucgaucuccugaccuug

SEQ ID NO: 113603 - RNA, 64 nt, Human
auuaaaaaaguuccaggauuuuuagaaaagaaagagccaggagaacuugcuuccaaaguaagug

SEQ ID NO: 113604 - RNA, 64 nt, Human
uguauuuuuaauagagacgggguuucacuguguuagccaggauggucucgaucuccugaccucg

SEQ ID NO: 113605 - RNA, 64 nt, Human
gcagaacacauaucugcuuaaagaccuugagaugagccaggaagaaacaaaagcaaggggcauu

SEQ ID NO: 113606 - RNA, 64 nt, Human
gcccggaggcggccauggugucucgauggacggcagccaggauggagcacccaugggucucacg

SEQ ID NO: 113607 - RNA, 64 nt, Human
agaacaggaggaauggcugggaaguggcugagggagccaggaggccggggggccgggggcugca

SEQ ID NO: 113608 - RNA, 64 nt, Human
cgggggcugcaggggaggcuguggggguccuggcagccaggaggccccaggugguuuugaggcu

SEQ ID NO: 113609 - RNA, 64 nt, Human
aaagagggccacaggacccgggaaauacacacagagccaggagcagaagcaaagagcagacaca

SEQ ID NO: 113610 - RNA, 64 nt, Human
aaagcugcuaauucucccagucuggaagagauggagccaggacuccuggguucuccuggggauc

SEQ ID NO: 113611 - RNA, 64 nt, Human
gucauuugcccugggucucccccaccagaaugggagccaggagucccagccaggcacaggaccg

SEQ ID NO: 113612 - RNA, 64 nt, Human
cagugucuuucgagguggguuuguaccuuccuuaagccaggaaagggauucauggcgucggaaa

SEQ ID NO: 113613 - RNA, 64 nt, Human
uguauuuuuaguaaagacaggguuucaccguguuagccaggauggucucuaucuccugaccucg

SEQ ID NO: 113614 - RNA, 64 nt, Human
cugcccugagcugcaugguucccccacccugggcagccaggaaggaaucugaauggagaaucac

SEQ ID NO: 113615 - RNA, 64 nt, Human
gcacucugggaggccaagauggaggauugcuugaagccaggaguuugggaccagccugggcaac

SEQ ID NO: 113616 - RNA, 64 nt, Human
gccacgaugccaagcacagccaacagccaccagcagccaggagacaggccugggacgggcucuc

SEQ ID NO: 113617 - RNA, 64 nt, Human
ggaaccuuccaugggggucugggcuauuggcuggagccaggacaugagucaggggcaccaugga

SEQ ID NO: 113618 - RNA, 64 nt, Human
uggccccagcuugucugucucuggguccugggccagccaggauaccugauaauaaaagaucauu

SEQ ID NO: 113619 - RNA, 64 nt, Human
aagcugucccaggagggcuguuaacucccuauagagccaggagacaggauagggguuucuaggg

SEQ ID NO: 113620 - RNA, 64 nt, Human
uacccaugaaggaugagagauguuuugaaaaacuagccaggacacacccacaggauccuacugg

SEQ ID NO: 113621 - RNA, 64 nt, Human
aacuugccauaauggauuguucugauuucugaggagccaggacaaguuggcgaccuuacuccuc

SEQ ID NO: 113622 - RNA, 64 nt, Human
uuuuacuuaaaauaucuuggcauaagcucaaaaaagccaggaucuuuauggaaaaauuuuaaua

SEQ ID NO: 113623 - RNA, 64 nt, Human
acuuuauguguauagggaaugugguacagccuuuagccaggagucauacuucaucagacaccag

SEQ ID NO: 113624 - RNA, 64 nt, Human
auggaguucugagagcuaggaaacugggagguugagccaggagcaggggaacuugggcuuugag

SEQ ID NO: 113625 - RNA, 64 nt, Human
ugugugucagaggcgcaggguggguggggcugccagccaggacccuggccugcagccugaucca

SEQ ID NO: 113626 - RNA, 64 nt, Human
ugaaaccccgucucuacuaaaaauacaaaaaauuagccaggagugguggcgggcgccuguggug

SEQ ID NO: 113627 - RNA, 64 nt, Human; identical to SEQ ID NO: 113190

SEQ ID NO: 113628 - RNA, 64 nt, Human
aaggcacuguaucccaggccucccaauguucccgagccaggaacucugggccccauggaguuau

SEQ ID NO: 113629 - RNA, 64 nt, Human
uuuuuuuuuaguagagaugggguuucaccacguuagccaggauggucucgaucuccugaccucc

SEQ ID NO: 113630 - RNA, 64 nt, Human
gugcacaggggauuucaaacguucuacguccuaaagccaggaagagugacaaggcaggugggga

SEQ ID NO: 113631 - RNA, 64 nt, Human
aagagugacaaggcagguggggacagaaggaagaagccaggagccucccugagaaggugucacc

SEQ ID NO: 113632 - RNA, 64 nt, Human
ccaccugcggagccgcugggggaccucacgucccagccaggaucccccuggaagaaaaagggcg

SEQ ID NO: 113633 - RNA, 64 nt, Human
guggcugaaccgagcuggagccaacagaugugucagccaggauugaccuuugcacgaacaccaa

SEQ ID NO: 113634 - RNA, 64 nt, Human
ugcaaguaaacaccuggaggugaaggcagagaggagccaggacuguggaguccgacaaagcuac

SEQ ID NO: 113635 - RNA, 64 nt, Human
gucuuuucaguaucugcuuuacugguucaguaaaagccaggaaacacaacuuugugguaaucug

SEQ ID NO: 113636 - RNA, 64 nt, Human
cagcauucccagcucagggcuaaugguucacggaagccaggaaucaaacugccuggguuccagu

SEQ ID NO: 113637 - RNA, 64 nt, Human
aacauauaaauguaagaaauguagaaaaaccuucagccaggaggcuggcaagauggccgaauag

SEQ ID NO: 113638 - RNA, 64 nt, Human
uguauuuuuaguagagacgggguuucaccguguuagccaggaugguccugaucuccugaccuug

SEQ ID NO: 113639 - RNA, 64 nt, Human
uguauuuuuaguagagauggaguuucaccauguuagccaggauggucucgaucuccugaccucg

SEQ ID NO: 113640 - RNA, 64 nt, Human
ggcccauagagagggccugucccggugcugccccagccaggaucuggucgcugccccaggggga

SEQ ID NO: 113641 - RNA, 64 nt, Human
uuguauuuuaguagagacaggguuucaccguguuagccaggauggucuugaucuccugaccuug

SEQ ID NO: 113642 - RNA, 64 nt, Human
cucucggugccaagagccauccccgccaacagccagccaggacacggggccucaguccacagcc

SEQ ID NO: 113643 - RNA, 64 nt, Human
uguacccgaaguccagacucccaggggaaucagcagccaggacagacauccuagcagccgccuc

SEQ ID NO: 113644 - RNA, 64 nt, Human
acuaucagggccuccccaggcuuccagaguugaaagccaggagaaaaucggcaaagaccacccu

SEQ ID NO: 113645 - RNA, 64 nt, Human
ucugggcuuucggccagaaguuaauuaaccucagagccaggagccuggggcuggggccucccuc

SEQ ID NO: 113646 - RNA, 64 nt, Human
uacuguggagaugcaguggaggaccugguggcugagccaggagaugcacaccuucgcuucucuc

SEQ ID NO: 113647 - RNA, 64 nt, Human
uguauuuuuaguggagacgggguuucaccguguuagccaggauagucuugaucuccugaccucg

SEQ ID NO: 113648 - RNA, 64 nt, Human
uuucuccggagcagagcagcgcugcuggccuggcagccaggacuucuccguguacgugcauccc

SEQ ID NO: 113649 - RNA, 64 nt, Human
ccuguccagcuucgcuguccugauggcccugaccagccaggaggaggaucccgugcugacuguc

SEQ ID NO: 113650 - RNA, 64 nt, Human
gggaggccccagggacccaugggcagagcuggggagccaggaggaugggucugccugcucuggg

SEQ ID NO: 113651 - RNA, 64 nt, Human
gccugaggcuggcccagagcugucaggaccaugaagccaggacagaggccaggagccagcccug

SEQ ID NO: 113652 - RNA, 64 nt, Human
gucgccggaucucgaggcuugcccgagccgugcgagccaggacuaggagauuccggugccuccu

SEQ ID NO: 113653 - RNA, 64 nt, Human
uguguguuuuacauauauauaucucuaaguccagagccaggagaguuggaccauugagggcagc

SEQ ID NO: 113654 - RNA, 64 nt, Human
uaaaacuccauuucuacuaaaaauauaaaaaauuagccaggaguaguggcgcaugccuguaguc

SEQ ID NO: 113655 - RNA, 64 nt, Human
gggauuacagacaugagccaccgugccucgccacagccaggauuugaacaaacuugguauucac

SEQ ID NO: 113656 - RNA, 64 nt, Human
guaaucuuuuccaaguuuccuuaguaagggacagagccaggauuuuuuuauuuuuauuuuuuga

SEQ ID NO: 113657 - RNA, 64 nt, Human
ccuucagucuccagcuuccauccuccaguuaucuagccaggaggucccaagaguuaguuuuagg

SEQ ID NO: 113658 - RNA, 64 nt, Human
cgccuuccucucguguaaccagcgggguaaguuaagccaggaccuucgcugcaaaccugguuuu

SEQ ID NO: 113659 - RNA, 64 nt, Human
acggagaugcggacuccugggucccuggccaagaagccaggagagggacggcugauggacucag

SEQ ID NO: 113660 - RNA, 64 nt, Human
ucaugggguaacauccccuguggaucaaaggagaagccaggagucuacaccaacgucugcagau

SEQ ID NO: 113661 - RNA, 64 nt, Human
ugcaggaagugguggcaaagguuuauuccagagaagccaggaagccggucaucacccagccucu

SEQ ID NO: 113662 - RNA, 64 nt, Human
guucaagcaauucuccugccucagccucccaaguagccaggauuacaggcacgcgccaccaagc

SEQ ID NO: 113663 - RNA, 64 nt, Human
ggacccuugugauuacacugugaaaacccagauaagccaggauaaucucccuaucuuauuauga

SEQ ID NO: 113664 - RNA, 64 nt, Human
ccccuccccagauaaccucuggagcagauuugaaagccaggauggcgccuccagaccgaggaca

SEQ ID NO: 113665 - RNA, 64 nt, Human
aaggaacugaggaccaagaagugcaaggaucaguagccaggaccagaguggccgccuggagguc

SEQ ID NO: 113666 - RNA, 64 nt, Human
cugucacgacagagccugggcacuucagaggaggagccaggaucgaauggaaggggggaauugg

SEQ ID NO: 113667 - RNA, 64 nt, Human
uguauuuuuaguagagaugggguuucacccuguuagccaggaaguucucaaucuccugaccucg

SEQ ID NO: 113668 - RNA, 64 nt, Human
ugaggccucuuggaacucuugcuaaccuguucagagccaggaaggagacugcacaguuuugaaa

SEQ ID NO: 113669 - RNA, 64 nt, Human
uuggacaggugcacacucucugccucuuaccucuagccaggaggaugccucagucuguucauuc

SEQ ID NO: 113670 - RNA, 64 nt, Human
uccuccugcccauucuuugucucuuccacaugggagccaggaggccucaguuaauccugccuca

SEQ ID NO: 113671 - RNA, 64 nt, Human
uggcaaucugcuuuuuuucuaaaaucugauuugcagccaggaaagaauuuucucacccaaggaa

SEQ ID NO: 113672 - RNA, 64 nt, Human
ugguuucugugagaauuggccauccugaggacacagccaggacggcagaggccuccuggccuca

SEQ ID NO: 113673 - RNA, 64 nt, Human
acugcacccagcaucaccagcuagaaaguggcagagccaggauucaacccuggcuugucuaacc

SEQ ID NO: 113674 - RNA, 64 nt, Human
uacacugggcacauggaggagacguccacccugcagccaggacugggguucacgucacugccag

SEQ ID NO: 113675 - RNA, 64 nt, Human
uccugcucugcaagccugaaacuggcuugucuggagccaggaguuaguccuggggugugugugu

SEQ ID NO: 113676 - RNA, 64 nt, Human
aauuugcuaggaucacaccacuaauaagcaacagagccaggauucaaacccagguguggcucca

SEQ ID NO: 113677 - RNA, 64 nt, Human
aaggccccgagacuggaguguguuccugaagagcagccaggaggccagcauggcuggagaggca

SEQ ID NO: 113678 - RNA, 64 nt, Human
agccaggccccaagcccacugggguguguggcagagccaggacccaggaggugugauuccugaa

SEQ ID NO: 113679 - RNA, 57 nt, Human
cccaagccgccuccagguagcagccacagccaggagcacacagacagaagacugugu

SEQ ID NO: 113680 - RNA, 64 nt, Human
uccuggauacugacuaacuuggguggguggaucuagccaggagaaagacaguaacauguguucu

SEQ ID NO: 113681 - RNA, 64 nt, Human
acaggggugagaaguccucgcuguguucagagggagccaggaaucuacauggguagaugagaua

SEQ ID NO: 113682 - RNA, 64 nt, Human
ugucuguccucagcccuugucccuguuuaucugcagccaggagacuugcaagggauuggugauu

SEQ ID NO: 113683 - RNA, 64 nt, Human
guaccugcaagaaaccuacucaaagcaggucaccagccaggagcccugacccaggcugcccagc

SEQ ID NO: 113684 - RNA, 64 nt, Human
ccauccaguguuugucucucggguccuucaagccagccaggaccuuuucugggucaugaauagc

SEQ ID NO: 113685 - RNA, 64 nt, Human
cuguccuucagaacacuucucugugcucagugggagccaggaagccucaggcuucacgacugaa

SEQ ID NO: 113686 - RNA, 64 nt, Human
gagaagacagucccaggagaagcuggccgggaccagccaggagcugggagccacaggaagcaaa

SEQ ID NO: 113687 - RNA, 64 nt, Human
ugucuggacaccgagagcgaccacauccuggagaagccaggagaaaagcucaggaagagccugc

SEQ ID NO: 113688 - RNA, 64 nt, Human
ccacaggucagguggaggguggggcgugggcaucagccaggauugccguuacagucuuuuucuc

SEQ ID NO: 113689 - RNA, 64 nt, Human
gaucagacuguugcuggacacgacgucuguguggagccaggaggaacacauguggugucuguau

SEQ ID NO: 113690 - RNA, 64 nt, Human
ccagcccuggugagccaaggacaaccacacagaaagccaggauugaagcggugcucagccaggc

SEQ ID NO: 113691 - RNA, 64 nt, Human
cucuggggucuggcuaccgcuaggaggcugagcaagccaggaagggaaggagucuguguggugu

SEQ ID NO: 113692 - RNA, 64 nt, Human
gggugguuauguacuucacaagccaauucccuucagccaggagcuccugggugcauuuccgugu

SEQ ID NO: 113693 - RNA, 64 nt, Human
cuguucguuuauuacuuaccauuggaauauuuugagccaggagagcgccuucucucuccagcca

SEQ ID NO: 113694 - RNA, 64 nt, Human
ugugcuguugggguuaggggcagccaugggccccagccaggacaugcugggugccccagccugc

SEQ ID NO: 113695 - RNA, 64 nt, Human
uuccaguugugagccaagauuguaaccagagagcagccaggagcuuccugucaguaaccauguu

SEQ ID NO: 113696 - RNA, 64 nt, Human
ccugcccucccauggggugacucaugaccccuccagccaggacucuccuacauguggcccccau

SEQ ID NO: 113697 - RNA, 64 nt, Human
uggauuuuuaguagagaugggauuucaccguauuagccaggauggucuugaucuccugagcucg

SEQ ID NO: 113698 - RNA, 64 nt, Human
agacacagcccagacaagauggcuggaaggagccagccaggacuccuuagacugaucaagccaa

SEQ ID NO: 113699 - RNA, 64 nt, Human
cugauacauagaaccaaggagcacucaaauagggagccaggagccagggagcuggugacacuug

SEQ ID NO: 113700 - RNA, 64 nt, Human
ugcuagaauuaaggugugggaaaaaaaaaaaaacagccaggaaggacaagaucuccaauuugug

SEQ ID NO: 113701 - RNA, 64 nt, Human
ggggaguguuuguggggguccagagcccucccccagccaggagagaaccucccggagggguucu

SEQ ID NO: 113702 - RNA, 64 nt, Human
cacuuugggaggcugagguaggaggauugugggaagccaggaguucaagaccagcccagccaac

SEQ ID NO: 113703 - RNA, 64 nt, Human
ggaccugccccucacguucucuuggggacacccgagccaggacacuacgcaucccugcugagug

SEQ ID NO: 113704 - RNA, 64 nt, Human
caccuucucacauggaaugaggguuugagagagcagccaggagagcuuagggucucaggguguc

SEQ ID NO: 113705 - RNA, 64 nt, Human
acuguguggcuggacuguacucugcugcccggguagccaggagucucucccucucuccccugcc

SEQ ID NO: 113706 - RNA, 64 nt, Human
cccacucaucacuaaacagaguaaaaucuuggaaagccaggacacaacgcugcugccugcuuug

SEQ ID NO: 113707 - RNA, 64 nt, Human
uguauuuucaguagagauggaguuucacugugucagccaggauggucucgaucuccugaccucg

SEQ ID NO: 113708 - RNA, 64 nt, Human
ggaugcgcauccccaucccaagaagucgggaagaagccaggaaggcuccucucccacagguuuc

SEQ ID NO: 113709 - RNA, 64 nt, Human
aaguuacaccguuguuguuuuacaucuuuugggaagccaggaaagcguuuggaaaacguaucac

SEQ ID NO: 113710 - RNA, 64 nt, Human
gcugaacugugaggagagaggcggacugugaggcagccaggagccagcugcguccguguguggu

SEQ ID NO: 113711 - RNA, 64 nt, Human
cgucauuuaaagggaaaacaaaaucugagucuccagccaggaggcuucucccagagaggacaaa

SEQ ID NO: 113712 - RNA, 64 nt, Human
uuacuucccagaauccccugacauucccagggucagccaggaccuguuacagcccuggucacuu

SEQ ID NO: 113713 - RNA, 64 nt, Human
aacguggaagggggaccugagggccuccaccucgagccaggaaaugaggaccggccggacgaug

SEQ ID NO: 113714 - RNA, 64 nt, Human
uuauauuuuuaguagagagagguuucaccguguuagccaggauggucucgaugaucugaccucg

SEQ ID NO: 113715 - RNA, 64 nt, Human
cgcagggcugaauggucgcugagacagagauggaagccaggacaagggagcccaccgggcccag

SEQ ID NO: 113716 - RNA, 64 nt, Human
gauguuguggcccugugucuuccuagugugacccagccaggagcggaagcuucaggcguuugua

SEQ ID NO: 113717 - RNA, 64 nt, Human
gcuuguuucuuccgggugggaggaugguggucagagccaggaguauggagaucugagaccguga

SEQ ID NO: 113718 - RNA, 64 nt, Human
ggaagcugaaggccacuuccucccagauggccucagccaggaccaucgcccuuucucagagcag

SEQ ID NO: 113719 - RNA, 64 nt, Human
accgcccgccccgucucaccuucuuuaccucaggagccaggagcagacagcaauacuucgucca

SEQ ID NO: 113720 - RNA, 64 nt, Human
aggcuugucccagcacugccgcuccccaccccugagccaggaccccagaggauggccaugcccc

SEQ ID NO: 113721 - RNA, 64 nt, Human
ugcuggcauaaaauaaccugaaaagauucugaaaagccaggauguggaauugaaagagaagcug

SEQ ID NO: 113722 - RNA, 64 nt, Human
aucaaaugcuucauucugcauacuuggacacuaaagccaggaugugcaugcaucuugaagcaac

SEQ ID NO: 113723 - RNA, 64 nt, Human
gaagaccccaauuaccugccccucccugaggaacagccaggaccccaucugccacccccgcagc

SEQ ID NO: 113724 - RNA, 64 nt, Human
cauucugcccagaggggcuggggaaagggaugggagccaggaaagauuuaggggcaggagacag

SEQ ID NO: 113725 - RNA, 64 nt, Human
aaccuccacugcugcucccggguccugcugcccgagccaggaacuguguguguugcaggggggc

SEQ ID NO: 113726 - RNA, 61 nt, Human
ugcgcaucagcuaccuguagggccuggggaaagccaggauggcccgaggaagaggcagaag

SEQ ID NO: 113727 - RNA, 64 nt, Human
cgugaccugcacaggaucacagagcauggggcagagccaggacuagagcucagggcaucugacu

SEQ ID NO: 113728 - RNA, 64 nt, Human
ugaaaggcagaaagagccaggagaaagcugauggagccaggacagagaucugguuccagcuuuc

SEQ ID NO: 113729 - RNA, 64 nt, Human
aagcagggugguggcaccguugaaaggcagaaagagccaggagaaagcugauggagccaggaca

SEQ ID NO: 113730 - RNA, 64 nt, Human
agaggagggaggaagagcugggcgagaggccuagagccaggaccaggugggggugcggcccugu

SEQ ID NO: 113731 - RNA, 64 nt, Human
aggguaguccaaaggcagaugccagacaagacacagccaggaacccggccagguccccccacau

SEQ ID NO: 113732 - RNA, 64 nt, Human
agagcucuuggguauguagaacuguaugggaagaagccaggaaaaccucugaguguugaagggg

SEQ ID NO: 113733 - RNA, 64 nt, Human
cugcugggagccauuagaacacagauacaagagaagccaggaggucuaugauggugacgauuuu

SEQ ID NO: 113734 - RNA, 64 nt, Human
uuugaugauggaaggcaguuuuguggaaauugccagccaggacuuugacaugaaacagacccag

SEQ ID NO: 113735 - RNA, 64 nt, Human
gccaguacaagagggccuggggcacgauguggucagccaggaagcauaggaugccauuucuuuu

SEQ ID NO: 113736 - RNA, 64 nt, Human
uugccucuguccgugccccuucccuggguuugggagccaggacucccagaaccucuaagugcug

SEQ ID NO: 113737 - RNA, 64 nt, Human
uuauucuuucuuaucgaauuuuggagccuaauauagccaggagcugcugaauuugugccccugg

SEQ ID NO: 113738 - RNA, 64 nt, Human
uccccaacccucaacuugaaaccccauucccuuaagccaggacucagaggaucccuuugcccuc

SEQ ID NO: 113739 - RNA, 64 nt, Human
uguauuuuuaguagagaugggguuucacguuguuagccaggauggucuccaucuccugaccuca

SEQ ID NO: 113740 - RNA, 64 nt, Human
aaugcucuguagauugaguugcuggaggagugacagccaggagcccugacuucacuuccuuugg

SEQ ID NO: 113741 - RNA, 64 nt, Human
gcuccugcucuguagauugaucugucugucugcuagccaggaugggaucucugcagucuucugu

SEQ ID NO: 113742 - RNA, 64 nt, Human
gggaacacagccagacauccugauggggaggcagagccaggaagcuaagccagggcccagcugc

SEQ ID NO: 113743 - RNA, 64 nt, Human
gcuccaguccuaggagaacagucccugggucagcagccaggaggcgguccauaagaauggggac

SEQ ID NO: 113744 - RNA, 64 nt, Human
agccgccaccggggcacacgggccucugcuugccagccaggagugcggacaccauguucccagc

SEQ ID NO: 113745 - RNA, 64 nt, Human
aaugccaccggccugcuuucauaggcauugauaaagccaggaaggaaauaaagucacaaccaaa

SEQ ID NO: 113746 - RNA, 64 nt, Human
gcuuggucuagaauggauuuuucccggagccggaagccaggaggaaacuacaccacacuaaaac

SEQ ID NO: 113747 - RNA, 64 nt, Human
gaguuucaugaaaugguccacauaguggggaaguagccaggaaaugagaaacuuccucccaccc

SEQ ID NO: 113748 - RNA, 64 nt, Human
uucccaccccuauacccuaggucuccaccccucaagccaggagacccugucuuugcuguuuaua

SEQ ID NO: 113749 - RNA, 64 nt, Human
cccugacuccuucaccaagaagacgggagucggcagccaggaguucccguggcaccucucucuc

SEQ ID NO: 113750 - RNA, 64 nt, Human
uguauuuuuaguagagacaggguuucaccauguuagccaggauggucucgaucuccugacgucg

SEQ ID NO: 113751 - RNA, 64 nt, Human
gcgaaaccccgucucuacuaaaaauacaaaaauuagccaggacugauggcaugugccuguaauc

SEQ ID NO: 113752 - RNA, 64 nt, Human
cucuaaagccgcccgccagcccaggccgcugcucugcaccgagcuggugggcuuggguuuugug

SEQ ID NO: 113753 - RNA, 64 nt, Human
uccuggccuaggacuuagcuucauaacuaucaccugcaccgacuaggcugaggugcugguacuu

SEQ ID NO: 113754 - RNA, 64 nt, Human
aagccagaaagaaguuaacuacaguguuuuccuuugcaccgauccccaccccaauucaaucccg

SEQ ID NO: 113755 - RNA, 64 nt, Human
ucugucuuguucugucucccaggcugaagugcagugcaccgagauugugccacugcacuccagc

SEQ ID NO: 113756 - RNA, 64 nt, Human
uuccauacugcaccguacaugccagcguacccauugcaccgaaagcaggcccuuagggcaggaa

SEQ ID NO: 113757 - RNA, 64 nt, Human
aggggcuguuagagaagcaaggccuggaguggccugcaccgaguagcagggucaggguucgugu

SEQ ID NO: 113758 - RNA, 64 nt, Human
caacuccucgcagaagugggagaggccggcagccugcaccgagaggggcuuuccucucucuugc

SEQ ID NO: 113759 - RNA, 64 nt, Human
gaacuuggaauuccuuguaacuggagcucggagcugcaccgagggcaaccaggacagcugugug

SEQ ID NO: 113760 - RNA, 64 nt, Human
gaaaaggaagacaagcaggugggcaggaaggacaugcaccgagaccaggcaggggcccaacuuu

SEQ ID NO: 113761 - RNA, 64 nt, Human
agugggagcccaggcccucccuccaggguagagaugcaccgaauggaaauugcacuaaggaccu

SEQ ID NO: 113762 - RNA, 64 nt, Human
acaaaguugauuucaggaaguauaaauuauauucugcaccgaacaaggaacagaaauuauugca

SEQ ID NO: 113763 - RNA, 64 nt, Human
agaggaugguaugggaagaaauuuggcugaucgaugcaccgaugaaguaaacgccuuagugcuu

SEQ ID NO: 113764 - RNA, 64 nt, Human
uauucuuggcagcacuccacucaccuucagcuccugcaccgacaucaggaacccacggccacca

SEQ ID NO: 113765 - RNA, 64 nt, Human
agccccgucuccaggaaaaggagagggguuaagaugcaccgaggcuguagcugggcuacuugau

SEQ ID NO: 113766 - RNA, 64 nt, Human
ugcugaggaugccaacuucacgcucagagacagcugcaccgacuuggagcucuuugguaggacu

SEQ ID NO: 113767 - RNA, 64 nt, Human
ucauaaacagagucccucccauucccccacggggugcaccgaacuuggguuugcgcuaaaaaga

SEQ ID NO: 113768 - RNA, 64 nt, Human
gugugguuucucuuaugucgagugagagcugaccugcaccgaagguuuugucccauuuguugcc

SEQ ID NO: 113769 - RNA, 64 nt, Human
ccaagagucuguuucaauuuaugaauucaguauuugcaccgagauuuugauucccaaaguuugg

SEQ ID NO: 113770 - RNA, 64 nt, Human
acagaggagcuccaaaccugcccaucucaucccaugcaccgacggugccuggccuggcuccaaa

SEQ ID NO: 113771 - RNA, 64 nt, Human
aauuucaaccauuugauuuuguaugauugaaacuugcaccgagcuuugacuguuuguuaaagag

SEQ ID NO: 113772 - RNA, 64 nt, Human
accuucgagugagccgggcccugagggugggggaugcaccgaggcccgaggguccguccacugc

SEQ ID NO: 113773 - RNA, 64 nt, Human
uaugcacguguguguguccguauguaagaaagugugcaccgagugacugaaugguugagaugaa

SEQ ID NO: 113774 - RNA, 64 nt, Human
gaaugggguuugauucugaaaucuuucuaccuguugcaccgauauucaaauaaaaaugauagac

SEQ ID NO: 113775 - RNA, 64 nt, Human
uccacccaggccggacacagacaugagacaaaagugcaccgaggcacgcucugccccguguuug

SEQ ID NO: 113776 - RNA, 64 nt, Human
gcagcccgcaggcagccccacacccgccgccuccugcaccgagagagauggaauaaagcccuug

SEQ ID NO: 113777 - RNA, 64 nt, Human
aauggaagcaauugcucauguuggccaaacauggugcaccgagugauuuccaucucugguaaag

SEQ ID NO: 113778 - RNA, 64 nt, Human
acugcccuuccgccccccacacuuugccugcaggugcaccgaaaggaccugggagauaaaauuc

SEQ ID NO: 113779 - RNA, 64 nt, Human
augccacccugcccaggguuggcaugacugucugugcaccgagaagaggcggcagauccugccc

SEQ ID NO: 113780 - RNA, 64 nt, Human
ccuggagggcucggucggcgaccucugaagagagugcaccgagcaaaccaagugccggagcacc

SEQ ID NO: 113781 - RNA, 64 nt, Human
aguuuucaauauacauugaauaaucauuguguacugcaccgauauguguguauauuuagauaua

SEQ ID NO: 113782 - RNA, 64 nt, Human
gaugccugggucucugggcacagccuggccccugugcaccgaguggccauggcauguguggccc

SEQ ID NO: 113783 - RNA, 64 nt, Human
uugcuguguuucguuagcaucuggcuccaggacagaccuucaacuuccaaauuggauacugcug

SEQ ID NO: 113784 - RNA, 64 nt, Human
gacaaauggaaaaaaagaggaaagauuaacuauuugcaccgaaaugucuuguuuuguugcgaca

SEQ ID NO: 113785 - RNA, 64 nt, Human
ccacgcugugcucccucccaacaacggccgagccugcaccgacaacccccuggaggaggaguac

SEQ ID NO: 113786 - RNA, 64 nt, Human
aucauccacccacagagaaaugccucugugcgagugcaccgacagaaaacugucagcucugcuu

SEQ ID NO: 113787 - RNA, 64 nt, Human
uauuucuuuuucuugcaaaacaaacauacccaucugcaccgacgccugcccccgucccaccucg

SEQ ID NO: 113788 - RNA, 64 nt, Human
caugguaguugcugcucgugguucugucuguccgugcaccgaugcacacaccgcaccccaccac

SEQ ID NO: 113789 - RNA, 64 nt, Human
aucucuguuguacgugucagucuagaggucucacugcaccgaguucauaaacugacugaagaau

SEQ ID NO: 113790 - RNA, 64 nt, Human
aagaaggaaauaaagggauaaagaaauucaugcuugcaccgaguacaaggacagacagcaggca

SEQ ID NO: 113791 - RNA, 64 nt, Human
cuguggccucugcugcuggcccuguacaggagcgugcaccgagcccgggaggcugcccugagca

SEQ ID NO: 113792 - RNA, 64 nt, Human
gcucuggcuuugcagccuggccagcagcucagagugcaccgaggagggaaggauggcuaagcug

SEQ ID NO: 113793 - RNA, 64 nt, Human
uucuugguacugggaggcugcaggcuuccuucugugcaccgagacuuccuugagcaaguggagc

SEQ ID NO: 113794 - RNA, 64 nt, Human
ggucggguggcuuccaguggucuucagucugucgugcaccgaugagaacucuccuuauugcugu

SEQ ID NO: 113795 - RNA, 64 nt, Human
caccucuggcuuguagaagggacggcucaguggcugcaccgacgguccuggaaaucucacaugg

SEQ ID NO: 113796 - RNA, 64 nt, Human
cgccugcccuccguauuuccugcaccugucagccugcaccgacugaugagccaguugcucauuu

SEQ ID NO: 113797 - RNA, 64 nt, Human
cacagcccgccuucugccaaaagaagugauggccugcaccgagcuuccuugagggcuucagaaa

SEQ ID NO: 113798 - RNA, 64 nt, Human
uccaaauggcuguauuuauaaagguuuuuggagcugcaccgaagcaucuuauuuuauaguauau

SEQ ID NO: 113799 - RNA, 64 nt, Human
gcauuccauauuuuuuuaagaaaagguuacacugugcaccgacauguggagcuagaaggaaaag

SEQ ID NO: 113800 - RNA, 64 nt, Human
cugccagguuucucagaaacugacaagaaaaucugaccuucauccauacuuuguuuacuuaccc

SEQ ID NO: 113801 - RNA, 64 nt, Human
ugcuuucggcccaguucuggccucagccucaaagugcaccgacuaguugcuugccuauaccugg

SEQ ID NO: 113802 - RNA, 64 nt, Human
gcauuccauauuuuuuuaaaaaaagguuacacugugcaccgacguggagcuagaaggaaaagca

SEQ ID NO: 113803 - RNA, 64 nt, Human
uuuaauaaugugucuguaaccaagaaaauauugauagcaucauccuaaugaaacuaaacauuua

SEQ ID NO: 113804 - RNA, 64 nt, Human
ccucagguugaauccagagcuguagagguuacaguagcaucaccagccuuggggguccagagcc

SEQ ID NO: 113805 - RNA, 64 nt, Human
acaugggauguggggagguggaaaugaugagcaguagcaucauuucucccuguuggguuuuagc

SEQ ID NO: 113806 - RNA, 64 nt, Human
agguugauuaaagcaaccauacccaagaaauagcuagcaucaagaaugagauuuauccaauguu

SEQ ID NO: 113807 - RNA, 64 nt, Human
guuuauaauugaagggauucaacaaaauuaucucuagcaucaggugcuagacaugguuagaauc

SEQ ID NO: 113808 - RNA, 64 nt, Human
cuccuucccccucaggugauacuaugaccaugaguagcaucagccagaacaugagagggagaac

SEQ ID NO: 113809 - RNA, 64 nt, Human
ucuccaaaccuggugccugugcuccuggccccccuagcaucaugcuaucccaggaguaucagga

SEQ ID NO: 113810 - RNA, 64 nt, Human
aggauuuggcaagcucaaccacaugcuauuuaguuagcaucaguugucaccaacagucuuucug

SEQ ID NO: 113811 - RNA, 64 nt, Human
agcccccaggcuggcuuagaaccccauagaguccuagcaucaccgaggacguggcugcucugac

SEQ ID NO: 113812 - RNA, 64 nt, Human
ggcugggacacucccuaaaucagcugcguguuguuagcaucaggcagaaugaauggcagagagu

SEQ ID NO: 113813 - RNA, 64 nt, Human
gagauuuuacaaaaugcugacaaaaauauuuuccuagcaucaguagauuucuggcauauguuuc

SEQ ID NO: 113814 - RNA, 64 nt, Human
gcuuuuucuguguauuuuguauugggcugggggauagcaucaaagguugaacuuuuugagcuuu

SEQ ID NO: 113815 - RNA, 64 nt, Human
uuuaaucaguaaguuaauuaguggcauaaaaaaguagcaucagggucuuuucccaagccaguga

SEQ ID NO: 113816 - RNA, 64 nt, Human
uugggacauugcaaauguuuaucauguuguaaaguagcaucaguuguauccuuucauuaaaacu

SEQ ID NO: 113817 - RNA, 64 nt, Human
uggguuacauuaaauaugugaacauaguaugaaguagcaucauuuuaggguuauucuguuacuu

SEQ ID NO: 113818 - RNA, 64 nt, Human
cucccuuguugcaacucuguguaccaagaaccccuagcaucagccucauuccuaagccaauaac

SEQ ID NO: 113819 - RNA, 64 nt, Human
gaaaacaaaaaucuacuuacauacacugucaccuuagcaucagagucggauuaaugaacugcgg

SEQ ID NO: 113820 - RNA, 64 nt, Human
gcaucuacaaaucucuuuuuuuagguuuuguccauagcaucaguugauccuuacuaaguuuuuc

SEQ ID NO: 113821 - RNA, 64 nt, Human
ucuguuagaacgaugucaauucaugcuuuuaauuuagcaucaauagaaaauugcuguagguaaa

SEQ ID NO: 113822 - RNA, 64 nt, Human
aguacauuuuguagcaguucaaagccaaaguugcuagcaucauuuugcuguugugccaguuaau

SEQ ID NO: 113823 - RNA, 64 nt, Human
auuaaucagugagaccuaauuugugacaugucaguagcaucaucuuuugacacacaggagguca

SEQ ID NO: 113824 - RNA, 64 nt, Human
aaacuugaacaaugauaccguuuuauuuacuuaguagcaucacugugugucuuagcaggcaggc

SEQ ID NO: 113825 - RNA, 64 nt, Human
gaaaguaauuuuuguugcauuauaaaaugucuaguagcaucauaaguuuuuuugagagaagcau

SEQ ID NO: 113826 - RNA, 64 nt, Human
ucugccuucaagaaggcagacauuugguaugauuuagcaucaacaacacauuuaugaguauaug

SEQ ID NO: 113827 - RNA, 64 nt, Human
agaaauuaauuauuacagggagcuauugaucuacuagcaucaaacaaaggcaagcucuaauucc

SEQ ID NO: 113828 - RNA, 64 nt, Human
aauagauuuuguccuaagagaguguuuuuuuuucuagcaucauuuucuuuacaugccacucaug

SEQ ID NO: 113829 - RNA, 64 nt, Human
uuccuucagaaaguagaggaacuaggggcccaauuagcaucaucuaggggaaucucuauuacuc

SEQ ID NO: 113830 - RNA, 64 nt, Human
ugcuucuggacggaagugguggcuguggaaggcguagcaucauccugcagacagacaauaauuc

SEQ ID NO: 113831 - RNA, 64 nt, Human
auagugagaguuucaaacuauauaucagugucuauagcaucaaaaacuucugggggcguggggg

SEQ ID NO: 113832 - RNA, 64 nt, Human
ugugauucagucuuccagauuaugccucacaugcuagcaucagguaaugcugacugaauuucag

SEQ ID NO: 113833 - RNA, 64 nt, Human
uugccuuauuugguaucuuacacauuaauguuacuagcaucaggagcuuacuguuuuauuauga

SEQ ID NO: 113834 - RNA, 64 nt, Human
uguauaaaaacuuaaauauuuuacaaguuacauauagcaucauucuaaaauaagaauuuuuuuu

SEQ ID NO: 113835 - RNA, 64 nt, Human
guguguucuauuuagagagaguuuaaaguucucuuagcaucagacaacuugauuccuaagguuu

SEQ ID NO: 113836 - RNA, 64 nt, Human
aacugauguggcuggagaauugguauugaauuuauagcaucagcagaacagaaaaugugaugua

SEQ ID NO: 113837 - RNA, 64 nt, Human
uguaauuugcagauuauucaguuauaggggugauuagcaucaagggcacacuuuggcuacugau

SEQ ID NO: 113838 - RNA, 64 nt, Human
uuauucaaauuaaauggcugugaacaauguuaaauagcaucaguuuguccaauaguuuuaaagg

SEQ ID NO: 113839 - RNA, 64 nt, Human
uaugugcuucacuacgggggggagaaggaaacguuagcaucauguuucccauuuagggcaggag

SEQ ID NO: 113840 - RNA, 64 nt, Human
uucuaaauagcucuggaaccaggcuuguaauccauagcaucaccgacucugcaaaggauuucau

SEQ ID NO: 113841 - RNA, 64 nt, Human
cagaggcagcaaugaugugaugggauaguggccguagcaucaccccaucagaaaggggaaccug

SEQ ID NO: 113842 - RNA, 64 nt, Human
auguuccaauccagucggcauugccugaauacaguagcaucauaccuauaguuggucuuagaua

SEQ ID NO: 113843 - RNA, 64 nt, Human
aagauguuucuuuuucuuuuuuuccuuuugauaauagcaucauauauuaguucauuuucuuuug

SEQ ID NO: 113844 - RNA, 64 nt, Human
acauguguguugguaguagugaggagauugguauuagcaucaagucuucauugaugacuaauuu

SEQ ID NO: 113845 - RNA, 64 nt, Human
aacucuuaaauccucagaugccaggggucugcucuagcaucaguaaguauuuagcagaaacuaa

SEQ ID NO: 113846 - RNA, 64 nt, Human
ccuauuuuacuuauuuccaagaaaugcauuuucuuagcaucauugcccacaguguugauauaug

SEQ ID NO: 113847 - RNA, 64 nt, Human
uuugacauuuguauucgucaacccuguggcuuguuagcaucagaaccucucugaagaccaaacu

SEQ ID NO: 113848 - RNA, 64 nt, Human
uauuuuuucugguugagucauugcucuuuagaccuagcaucagcaauagauuucaaagauaagu

SEQ ID NO: 113849 - RNA, 64 nt, Human
aaaaaaggcuuaaacuaaaccuugacauccacaguagcaucaggaauagaaauguguauuuugg

SEQ ID NO: 113850 - RNA, 64 nt, Human
aucuuggaaagccucauggucacuaauuuucaacuagcaucagguauuuugaaaacgugugucu

SEQ ID NO: 113851 - RNA, 64 nt, Human
uuuuuugccgaaaucugaauaaacuacauauauuuagcaucaggaacacacucuauacuaagac

SEQ ID NO: 113852 - RNA, 64 nt, Human
aauauuuauaggcaauacagucaaaguuucaaaauagcaucacacaaaacauguuuauaaauga

SEQ ID NO: 113853 - RNA, 64 nt, Human
ccgggcuggaaggcuggcguaggacuuggggcuguagcaucaucuuccugacccuggcaccugu

SEQ ID NO: 113854 - RNA, 64 nt, Human
cugcuuggaccucgauaacgggggaggggugcccuagcaucagaaggguucauggcccuuuccc

SEQ ID NO: 113855 - RNA, 64 nt, Human
uuuuaaaucucuuagugguuacauugccauuugguagcaucauguauauauuuaugcuuauaag

SEQ ID NO: 113856 - RNA, 64 nt, Human
aauaaccauuaugaaaaggaaaauuuguccuguauagcaucauuauuuuuagccuuuccuguua

SEQ ID NO: 113857 - RNA, 64 nt, Human
ucuuuuagcagacaaguuauaagucagauuuaauuagcaucagaguugauuuuauauuagucag

SEQ ID NO: 113858 - RNA, 64 nt, Human
cucuguaacuuacugcauauuguuaauguaugucuagcaucaaaugaguauuguaaaagacuaa

SEQ ID NO: 113859 - RNA, 64 nt, Human
ccaaaauggugcacuucacagauucaccagacuguagcaucauaaaguuaauuuacaguuuuua

SEQ ID NO: 113860 - RNA, 64 nt, Human
uuuuguagucuuaucaacauauaaucuaaucccuuagcaucagcuccucccucagugguacaug

SEQ ID NO: 113861 - RNA, 64 nt, Human
ccauuuaguaauacagcaacauugugucauuuauuagcaucauaauucuuuguuauguaaguua

SEQ ID NO: 113862 - RNA, 64 nt, Human
uauacagcugugcacauauugucaucacuuauucuagcaucacuguuaaggcugugauuauguu

SEQ ID NO: 113863 - RNA, 64 nt, Human
augcccaggaaagcacaugggaucaaaaguaaaauagcaucaugugugaucucgucuuccagcg

SEQ ID NO: 113864 - RNA, 64 nt, Human
cccuuaaaaccacagauugcaaagcauagcauuuuagcaucaacuacaaucaaaagagcgauuu

SEQ ID NO: 113865 - RNA, 64 nt, Human
uucugacauuuagaguaguguugaaauacucggcuagcaucagcaccacuauagcacuguccgu

SEQ ID NO: 113866 - RNA, 64 nt, Human
ucauggcaugagggggaauugacgagugcuugcuuagcaucagcucucauuguauugaaggcug

SEQ ID NO: 113867 - RNA, 64 nt, Human
ccuguguaacacuuggcucuugguaccuguggguuagcaucaaguucuccccaggguagaauuc

SEQ ID NO: 113868 - RNA, 64 nt, Human
guuucccauuccaauuugaaucuuucuauuucuuuagcaucauauugcucuucuucuuuuagac

SEQ ID NO: 113869 - RNA, 64 nt, Human
auccaaauaaagacuuuauuauuaacagaccagauagcaucagaaaucaugugacuguuaugau

SEQ ID NO: 113870 - RNA, 64 nt, Human
uuucuccccaguagccccaaauaucaacucauuuuagcaucaacuuuaaaauuguaguccaaag

SEQ ID NO: 113871 - RNA, 64 nt, Human
cuuaggacucaugugcaguaaauauaaauaaguguagcaucagaagcaguaggaauggccguau

SEQ ID NO: 113872 - RNA, 64 nt, Human
gagucugacccauggacaccuguuucauucacuuuagcaucacagugaccuuuguaugcucugu

SEQ ID NO: 113873 - RNA, 64 nt, Human
uuuuguccuauguguguggauuccagggcaacucuagcaucagagcaaaagccuuggguuucuc

SEQ ID NO: 113874 - RNA, 64 nt, Human
ucuuguaaaugcuguucaauuauuaauguaacaguagcaucaaaauuuuauucaggcuuuaguu

SEQ ID NO: 113875 - RNA, 64 nt, Human
caguguuuggggacauuaugcuggaaagagcuccuagcaucagaggauuaacacuagcagauuc

SEQ ID NO: 113876 - RNA, 64 nt, Human
ugccuccuccaugcacuccaguccacacuccccguagcaucauuccauugccccucccauccau

SEQ ID NO: 113877 - RNA, 64 nt, Human
ccagcacuaaaaauaagacaauuggaauauauuuuagcaucaguuuacaaacaacuuuauuauc

SEQ ID NO: 113878 - RNA, 64 nt, Human
ucuuuacucacaacucaugcuaggaggccaguccuagcaucaccuuauguugaaaaucuuacca

SEQ ID NO: 113879 - RNA, 64 nt, Human
uucgacagcauuuuaguuuuuuaauaguacuuauuagcaucaaccaucuugauaaucaccaagg

SEQ ID NO: 113880 - RNA, 64 nt, Human
aguuacucuaauuccaggugaagcaagccgcugguagcaucacccuuaugagaagugaagguuu

SEQ ID NO: 113881 - RNA, 64 nt, Human
uaaagacaugaauucucaccacuaaagucccagauagcaucauauuuacgccuguacuugggaa

SEQ ID NO: 113882 - RNA, 64 nt, Human
uuugauaaagaacuacuacaaaaaacccuacaucuagcaucauccuugauguuuccaacuaaau

SEQ ID NO: 113883 - RNA, 64 nt, Human
ggcggggugggaaguccugagugcuccgucccucuagcaucacuccugagcugcgggagaggug

SEQ ID NO: 113884 - RNA, 64 nt, Human
ccuugguuucaaagugagcugcuauauauuauucuagcaucaaaguuuuucucuuuccccaaaa

SEQ ID NO: 113885 - RNA, 64 nt, Human
agaaauaaauacaguacucaacuuccuuucauauuagcaucaucaacccucuaauucaccuuau

SEQ ID NO: 113886 - RNA, 64 nt, Human
aaggcagccuccugccuuuggacugcucugacuuuagcaucagcuuaauacacagaagagguuu

SEQ ID NO: 113887 - RNA, 64 nt, Human
uaauuggaauauacggaauauuuaaacaguagcuuagcaucagagguuugcuuccucaguaaca

SEQ ID NO: 113888 - RNA, 64 nt, Human
cugugaugcugggcacuucaucugaucgggggcguagcaucauaguaguuuuuacagcuguguu

SEQ ID NO: 113889 - RNA, 64 nt, Human
agccuccagauuugccauacugagccccucuuccuagcaucaggcgauacaucugaguucaaau

SEQ ID NO: 113890 - RNA, 64 nt, Human
cccauccuuagccauagcgagcgguggugguggauagcaucacaagaaacgagccugaaaauca

SEQ ID NO: 113891 - RNA, 64 nt, Human
ugcuccccuggcuugcaggaaauuauacuuauuauagcaucaccaaguuuagaaaucaucacua

SEQ ID NO: 113892 - RNA, 64 nt, Human
uuauuuuuccucuggcuccuuggauguagucaguuagcaucauuaguacaucuuuggagggugg

SEQ ID NO: 113893 - RNA, 64 nt, Human
ucacauaagauaaacauugaagcuauuugugauauagcaucaaaaauuauucaguucucuagug

SEQ ID NO: 113894 - RNA, 64 nt, Human
ccuccuggaauauuccuauugaucucauuuuauuuagcaucagcucaagaaacuaagucuuagu

SEQ ID NO: 113895 - RNA, 64 nt, Human
ucagccccauaacccaggaaggaacaggcauuguuagcaucagauuauaccucauuauuaaaag

SEQ ID NO: 113896 - RNA, 64 nt, Human
agccuggguggcagagggcagggucaucacccucuagcaucagugccugcuccugccugcccug

SEQ ID NO: 113897 - RNA, 64 nt, Human
gcacacacacaaagccuuaagcagaagaaugucuuagcaucaugagacagagaaauagacucuu

SEQ ID NO: 113898 - RNA, 64 nt, Human
agccuuaauuaaaguggugcaauuuuguauaacuuagcaucaguaguucaauaaauuuggauug

SEQ ID NO: 113899 - RNA, 64 nt, Human
aguccaacccagaauggcacacacugcucugcuguagcaucaugucagggcuuccuggacucag

SEQ ID NO: 113900 - RNA, 64 nt, Human
aaacaccauaaaagagagaagagagguaauuuguuagcaucaagagucaaguugcuauaugguc

SEQ ID NO: 113901 - RNA, 64 nt, Human
ccccauacuggaaugaaugauuucuuggugguauuagcaucaucacagaccuauacuugcuuuc

SEQ ID NO: 113902 - RNA, 64 nt, Human
cacagacuugacuguguaacugcauaaacugcaguagcaucauugcccuagaugccccaggaga

SEQ ID NO: 113903 - RNA, 64 nt, Human
acguuuuguuucuguuucuucuuagucugugucuuagcaucacuuaaagaacuauucauccuuu

SEQ ID NO: 113904 - RNA, 64 nt, Human
ucagauggcuacugaguuaucaguggccauuuauuagcaucauauuuauuuguauuuucucaac

SEQ ID NO: 113905 - RNA, 64 nt, Human
auaccguaacacgaaauugcugucaaaagcuuauuagcaucaaucaagauucuaggucuccaaa

SEQ ID NO: 113906 - RNA, 64 nt, Human
cacguuuuaacaaguauauugaguccacguuugguagcaucaguuguugaguuaaaaagaaaau

SEQ ID NO: 113907 - RNA, 64 nt, Human
guugucuaaauaagugaaacacaaauucacuuaauagcaucaagauuugaaauacuuaagcaug

SEQ ID NO: 113908 - RNA, 64 nt, Human
aaaagcacugaaugugaccuguugcauucaguuguagcaucaaauccacaccuagucauugcuu

SEQ ID NO: 113909 - RNA, 64 nt, Human
guuacuacccuugguaugcaugagcgguuccuauuagcaucagugggaacucaguacucuguau

SEQ ID NO: 113910 - RNA, 64 nt, Human
uuucaucugcuucuacugaacuaugcguacugcauagcaucaagucuucucuagagaccucugu

SEQ ID NO: 113911 - RNA, 64 nt, Human
guuuuaaagugcaaacuaacauuuaagugaacauuagcaucaaguagugcagacacuuguaugc

SEQ ID NO: 113912 - RNA, 64 nt, Human
uguuugacuccuaacaaaagacaauggauggccuuagcaucagaauuaaaauaaucuggauuaa

SEQ ID NO: 113913 - RNA, 64 nt, Human
ucaguuuuuugguauuuaaaccauugcauugcaguagcaucauuuuaaaaaaugcaccuuuuua

SEQ ID NO: 113914 - RNA, 64 nt, Human
caugauaagcccuuuugauagcauguauccuugauagcaucacaucauacagaaugugauaaga

SEQ ID NO: 113915 - RNA, 64 nt, Human
auuucccuaaugaucuugcuaauaaaugcuacaauagcaucagcuucauuuuggguuuuugccu

SEQ ID NO: 113916 - RNA, 62 nt, Human
auuuuaucauuauaaaugugcuuaguucaucauguagcaucacuugucucccgucucauuuu

SEQ ID NO: 113917 - RNA, 64 nt, Human
acugaggaucugaggggacccuguuaggagagcauagcaucaugauguauuagcuguucaucug

SEQ ID NO: 113918 - RNA, 64 nt, Human
guagcaaagaagucuauuuauuaacccacaaauguagcaucaagccagacucacagguagcaaa

SEQ ID NO: 113919 - RNA, 64 nt, Human
agcacuacuuagaaacuggaaaacauauauauguuagcaucaaagggggcagaagcaaagaaga

SEQ ID NO: 113920 - RNA, 64 nt, Human
ucaguauuguuuuaaaguuucugucuguaaaguguagcaucauauauaaaaagaguuucgcuag

SEQ ID NO: 113921 - RNA, 64 nt, Human
acugucauaaguagucauccaguagaagcauaguuagcaucagaaaaugucaccauauuuucgc

SEQ ID NO: 113922 - RNA, 64 nt, Human
acaauacuguaaauuagguuaauuuuguaagucuuagcaucaucauauugugcuguuuuggaua

SEQ ID NO: 113923 - RNA, 64 nt, Human
acuaguggacagaccuggugucaccaguuuuuccuagcaucaguccgaaccaugcgcccgcccu

SEQ ID NO: 113924 - RNA, 64 nt, Human
uuuuaaccacugacauguaaggaggacuacugucuagcaucagcuuauggggucagcuggcugu

SEQ ID NO: 113925 - RNA, 64 nt, Human
auacccaaauuuuaauauuccagaagaacaacuuuagcaucagaagguucacccagcaccuugc

SEQ ID NO: 113926 - RNA, 64 nt, Human
ggauucaaguaccuuuuccuacacagcggucagauagcaucagaccugcauugaacaguccugu

SEQ ID NO: 113927 - RNA, 64 nt, Human
aagaaagugguuccauauuuuacaaacagaagaguagcaucagagcccugaccuccugucuuug

SEQ ID NO: 113928 - RNA, 64 nt, Human
ccacacugaugcgaagcuguucuugacccucccauagcaucaacucaguucagcucaaagcuag

SEQ ID NO: 113929 - RNA, 64 nt, Human
cacuuauuuaauaacuguagaaauccaaaagaauuagcaucaaaucuugaagucgugagugaag

SEQ ID NO: 113930 - RNA, 64 nt, Human
acgauguacaguaacuuaauggaagugcugacucuagcaucagccucuaccgauugauuuuccu

SEQ ID NO: 113931 - RNA, 64 nt, Human
ggugguagggagcuuauagcuugugcuaauacuguagcaucaagcccaagcaaauuagucagag

SEQ ID NO: 113932 - RNA, 64 nt, Human
uccauaucacaccaccaaaggcuuuuggaccauuuagcaucaugagccuaauggcucagucagu

SEQ ID NO: 113933 - RNA, 64 nt, Human
agggagggauggggaggggagaaagggagauggguagcaucauuuugauuaacauuuggggccu

SEQ ID NO: 113934 - RNA, 64 nt, Human
uaaaaaacuuaacuagaucuguaaauguacagaauagcaucagauguuucugagagauuagaaa

SEQ ID NO: 113935 - RNA, 64 nt, Human
gaacccagugagccaggggccaguuuugacaggguagcaucacgcccacagacuacacccucuc

SEQ ID NO: 113936 - RNA, 64 nt, Human
auauauauauuuguaagccuugcaaugugacagguagcaucacuauauaugcaauaguuguuau

SEQ ID NO: 113937 - RNA, 64 nt, Human
agccaggggagauaagcauuccuggcaaagagaauagcaucaaaugcaaaaagguucacacuaa

SEQ ID NO: 113938 - RNA, 64 nt, Human
ucaaauaaauaaucugaggauguguuucauacuuuagcaucaacgcugaguugugccuuguaga

SEQ ID NO: 113939 - RNA, 64 nt, Human
acuuacagaagaaguggcccuccauagacauguguagcaucaaaacacaaaggcccacacuucc

SEQ ID NO: 113940 - RNA, 64 nt, Human
aaauuauuucguauguuaaagagucgaaagacuauagcaucacucagucccuguuagacuuuag

SEQ ID NO: 113941 - RNA, 64 nt, Human
aaggagcgggcagcagccaaagacaaguaucagcuagcaucaggacagaaagguguccaaguac

SEQ ID NO: 113942 - RNA, 64 nt, Human
caucccagacaggucccuccccuucucugugcaguagcaucaccuugaaagcaguagcaucacc

SEQ ID NO: 113943 - RNA, 64 nt, Human
ccuucucugugcaguagcaucaccuugaaagcaguagcaucaccaucuguaaaaggaagggguu

SEQ ID NO: 113944 - RNA, 64 nt, Human
gauagagguucauguuuaaauuauacauauuuauuagcaucauauugucauuuguuuugagcag

SEQ ID NO: 113945 - RNA, 64 nt, Human
ucaugcagcuaguaaaugauagaaucaggauucauagcaucacuauagggggucaauauuuaca

SEQ ID NO: 113946 - RNA, 64 nt, Human
aaaccaacuuuucuaacgacugaguucgcggagauagcaucaucccugaucaaggauguaauuc

SEQ ID NO: 113947 - RNA, 64 nt, Human
uuuguacgacgucagauguuuaaaacaccuucuauagcaucacuuaaaacacguuuuaaggacu

SEQ ID NO: 113948 - RNA, 64 nt, Human
uggcccacacaccuaagcgucaucgucauugccauagcaucaugaugcaacacaucuacgugua

SEQ ID NO: 113949 - RNA, 64 nt, Human
gguacacacacccccaccuccugcaauuaaacaguagcaucaccucccucugaguucuuggcug

SEQ ID NO: 113950 - RNA, 64 nt, Human
gcacuguguuuugugcuuaaacucuucagcgggguagcaucaaaguucuuggggaaggaucgua

SEQ ID NO: 113951 - RNA, 64 nt, Human
uuuguuauccgagaccuuugcaaacauuggcaaauagcaucaauuaccuacuguauuuguuucu

SEQ ID NO: 113952 - RNA, 64 nt, Human
ugaguauuuuuacuauuuguauuaagugucauaauagcaucaaugugcacauuaccaguauaga

SEQ ID NO: 113953 - RNA, 64 nt, Human
aauauuuuaaaccuuuuuggcuuaaacagaauuuuagcaucagaacuagcuuucugggauugga

SEQ ID NO: 113954 - RNA, 64 nt, Human
cagaggacuugggaaaagucucaacuugaugggguagcaucacugcuaagcaaugaaugaauuu

SEQ ID NO: 113955 - RNA, 64 nt, Human
gggucuuguacauauguuuuuuggaauuucuuuguagcaucaguguccuccuguuuuaccaugu

SEQ ID NO: 113956 - RNA, 64 nt, Human
acaaggagcaccggauucuuucucggguucugccuagcaucaacugggccacgucggccuucag

SEQ ID NO: 113957 - RNA, 64 nt, Human
ucagccucaccuugucccaguccacuccuaacacuagcaucagucccacucaucucaggcugag

SEQ ID NO: 113958 - RNA, 64 nt, Human
aauguaaaaauuguacaguacuuauguucccaaguagcaucaucaucuucuggguaguaauuac

SEQ ID NO: 113959 - RNA, 64 nt, Human
ucauuuuagaccaaacuagagucagaacgaauacuagcaucaguggggaagaaaccuccccagg

SEQ ID NO: 113960 - RNA, 64 nt, Human
ugcccacuuguuguaguggguguucucagaucucuagcaucacgacccaucacucuaccucuac

SEQ ID NO: 113961 - RNA, 64 nt, Human
uuuauuauccaggauuucauacucagaugagaauuagcaucaggaaagccugaaaugccuuaau

SEQ ID NO: 113962 - RNA, 64 nt, Human
ucugaugcagggccuuuuuauaaauagguuaggguagcaucauucagacuucucuguuguuuuu

SEQ ID NO: 113963 - RNA, 64 nt, Human
auuuccccauugguuggaguauucccucagccuauagcaucaaagcagaccaguggccaacagc

SEQ ID NO: 113964 - RNA, 64 nt, Human
ccuaaaaaucugauuuccguaccaguuaaauugguagcaucacuguuacugauaauuuaucaua

SEQ ID NO: 113965 - RNA, 64 nt, Human
ugucugcccuucauuaaggugagaaaucugcagauagcaucauuaagaucaguuuuaaggggua

SEQ ID NO: 113966 - RNA, 64 nt, Human
uuuauuauccaggauuucauacucagaugagcauuagcaucaggaaagccugaaaugccuuaau

SEQ ID NO: 113967 - RNA, 62 nt, Human
ccagggucugcaggugucacaugaucacaguucagcgggaggcuuuccguacccacacuggc

SEQ ID NO: 113968 - RNA, 62 nt, Human
ggcuaaggggcuggauccaccaaggcagcucacagcgggaaaacucugggaaugaaccacug

SEQ ID NO: 113969 - RNA, 62 nt, Human
uuaauuuuguagcguguggcugggccaggccccagcgggaggggcugagcuggggcugugug

SEQ ID NO: 113970 - RNA, 62 nt, Human
ccaugcuccgacagguggcccuucacagggggcagcgggacaggcaucuugaagggcauaug

SEQ ID NO: 113971 - RNA, 62 nt, Human
ccgcuugaggccagcacugagucugggacacucagcgggaagggggcuggcaucgccagcga

SEQ ID NO: 113972 - RNA, 62 nt, Human
cuaagcgagccagacaggaucccacauagcagcagcgggaagugugccaaggaagcucugug

SEQ ID NO: 113973 - RNA, 62 nt, Human
ggcaggggagggucagccagggccugcgagggcagcgggagccucccugccucaggccucug

SEQ ID NO: 113974 - RNA, 62 nt, Human
aagugaggggugacccuuuagugagcuuagcacagcgggauuaaacaguccuuuaaccagca

SEQ ID NO: 113975 - RNA, 62 nt, Human
uggccgcgccccaucagauguucgcccuucaccagcgggagcuugauaucccuugucuguaa

SEQ ID NO: 113976 - RNA, 62 nt, Human
auaggugugacaauccgagcaguggagucauucagcgggagcacugcgcgcuauccccucac

SEQ ID NO: 113977 - RNA, 62 nt, Human
ccccguggagcuggacugaggaggaggcugcacagcgggagagcagcugguccagaccagcc

SEQ ID NO: 113978 - RNA, 62 nt, Human
uccauagggaccagaagccugacucuggcgggcagcgggagaggcgcucgcucgggaccuuc

SEQ ID NO: 113979 - RNA, 62 nt, Human
aacucuccuguagggguucuaaaggacagcaccagcgggacagcccacaaggcuggggcugg

SEQ ID NO: 113980 - RNA, 62 nt, Human
ggagaaggguuagacaagccuggaggacaaaacagcgggagugugggggugccaugguguug

SEQ ID NO: 113981 - RNA, 62 nt, Human
ccggaaucggcaaugacccccacccagggggccagcgggagcagggccugcaugagaccccg

SEQ ID NO: 113982 - RNA, 62 nt, Human
gcugcugccgccucaccuuccuugaaauuucucagcgggagucuccucacugccacuaaaau

SEQ ID NO: 113983 - RNA, 62 nt, Human
uuccuccucccuggauaggaccuaauguagcacagcgggacucaaagaggaggacauuuucu

SEQ ID NO: 113984 - RNA, 62 nt, Human
cuacugaucuggagucccacguuccccaaggccagcgggaugugugccccuccuccucccaa

SEQ ID NO: 113985 - RNA, 62 nt, Human
ugccugaacuacauaacuuccuacguauccugcagcgggaggaggaggagcaccuccgccag

SEQ ID NO: 113986 - RNA, 62 nt, Human
ggccucaggggcucccgcccuucuuccuccagcagcgggaacugccacugcucucccaggcc

SEQ ID NO: 113987 - RNA, 62 nt, Human
ggggcccacuaggcggggcggggguugggacccagcgggagccggggcagccuggcuccacg

SEQ ID NO: 113988 - RNA, 62 nt, Human
agagcccagggucaggaguucguucaguaacgcagcgggaaucaaucugcacugacaccgcg

SEQ ID NO: 113989 - RNA, 55 nt, Human; identical to SEQ ID NO: 58138

SEQ ID NO: 113990 - RNA, 55 nt, Human; identical to SEQ ID NO: 58139

SEQ ID NO: 113991 - RNA, 62 nt, Human
ccagccauacuaaaggagaacauuggagaaaacagcgggaacuucauugcaggccguguguc

SEQ ID NO: 113992 - RNA, 62 nt, Human
gaaaugacccgagaaccccguuggaagcgcagcagcgggagcuaggggcgggggcggaggag

SEQ ID NO: 113993 - RNA, 62 nt, Human
accaaccaccaggauuggacaucaccgaggaacagcgggauugccuccccgaaugccucccu

SEQ ID NO: 113994 - RNA, 62 nt, Human
gauucauggggacagcaggcacugguuaggcacagcgggaagguuaucgaagacaaaacaca

SEQ ID NO: 113995 - RNA, 62 nt, Human
gccaagggggaaaggagagggcggaaaaggaccagcgggauccggccgcaagaauuggaaag

SEQ ID NO: 113996 - RNA, 62 nt, Human
guguggauguguacaguacacgcacuggacggcagcgggaggcugggacuuuccauuacaaa

SEQ ID NO: 113997 - RNA, 62 nt, Human
cggaagaaacaaagacaucccggcccaaggcgcagcgggagcgcacaggugccccgcggccc

SEQ ID NO: 113998 - RNA, 62 nt, Human
caccgccuccuggcugcagcucugaagagccacagcgggaacauaucuugcauggacuuuag

SEQ ID NO: 113999 - RNA, 62 nt, Human
uccucgcucccgcgcuccccgcgccccggacacagcgggacgcggccggcggccucagaguc

SEQ ID NO: 114000 - RNA, 62 nt, Human
ggaauacacgggcggcgccaggcauuaccucacagcgggacuacacaguugcuggcuuugcu

SEQ ID NO: 114001 - RNA, 62 nt, Human
ccauucacggggcaacacugggcuucugggcacagcgggaauacagaaagauacagcacucc

SEQ ID NO: 114002 - RNA, 62 nt, Human
uggaucccaggacuccggcuuucgccgagccgcagcgggaucccugugcacccggcgcagcc

SEQ ID NO: 114003 - RNA, 62 nt, Human
ccuguccggccugccaaguucauccugguggacagcgggaggccuccgcuaacuguucucuu

SEQ ID NO: 114004 - RNA, 62 nt, Human
acucugcuaaucaugugggugagccaguggaacagcgggagaccugugcuaguuuuacagau

SEQ ID NO: 114005 - RNA, 62 nt, Human
ccuccagugccucccggcugcuagccugaaagcagcgggaaagccagccacggaggcguagg

SEQ ID NO: 114006 - RNA, 62 nt, Human
ugacccugcagaggucgcgugcugugggaugacagcgggacgggagcucacaagugcuuuca

SEQ ID NO: 114007 - RNA, 62 nt, Human
ggaaagugaagagucagaacuaacuuuggucucagcgggagccaguggugauguaaaaaugc

SEQ ID NO: 114008 - RNA, 62 nt, Human
aaagaucacucaccagggccaaagagagugcucagcgggagaugcuucacugaugccuucuu

SEQ ID NO: 114009 - RNA, 62 nt, Human
cuggggguuccuguccaaccccagcaggggcgcagcgggaccagccccacauuccacuugug

SEQ ID NO: 114010 - RNA, 62 nt, Human
cuugacaugugcgggcuacugggguccaucggcagcgggaagagacccggagagaugcaucu

SEQ ID NO: 114011 - RNA, 62 nt, Human
agaaauaaaaguccuaaauaacuaagaaugaucagcgggagcguugggcaugauuacugcag

SEQ ID NO: 114012 - RNA, 64 nt, Human
gcuccguugcccuaacagggucucaugccauuccgaccuucaccaagcuuagaagccaccaugu

SEQ ID NO: 114013 - RNA, 62 nt, Human
uaacaucugcuucaccucaacuaacccagcagcagcgggacggcggugcuaggucaaucuua

SEQ ID NO: 114014 - RNA, 62 nt, Human
guuagaggcugcugggauccacuguuuccacacagcgggaaggcugcugggaacagguggca

SEQ ID NO: 114015 - RNA, 62 nt, Human
cucaagugauccucccgcuucagccucucaagcagcgggaacuacaggugugcacuaccaca

SEQ ID NO: 114016 - RNA, 62 nt, Human
ccugcaaaugcagacuccagaauccccagcaucagcgggaaccaccaucacaucuuuauucc

SEQ ID NO: 114017 - RNA, 62 nt, Human
gaagaaaaucuuuauuuuguaauauguguguccagcgggauugacacucaaaaaaagucuca

SEQ ID NO: 114018 - RNA, 62 nt, Human
cugaucaugcaaccuggcacuggaaaagaaaucagcgggauuuuggggguggggggggaugg

SEQ ID NO: 114019 - RNA, 62 nt, Human
gccuggagagucgggaccaccugcaccgcgaacagcgggaguaccugugagugggccgccug

SEQ ID NO: 114020 - RNA, 62 nt, Human
ucacuaucuuucugauaacagaauugccaaggcagcgggaucucguaucuuuaaaaagcagu

SEQ ID NO: 114021 - RNA, 62 nt, Human
ugugcauaucugccuccccugucucuaaggagcagcgggaacggagcuucggggccuccuca

SEQ ID NO: 114022 - RNA, 62 nt, Human
ugguuuuuuuuaaauguuuuauuuugcuuucccagcgggaggggaggaagaagaguguuuac

SEQ ID NO: 114023 - RNA, 62 nt, Human
ccuccagacaacauccugccccucgucaucugcagcgggaucuccaaccagccgcuggaauu

SEQ ID NO: 114024 - RNA, 62 nt, Human
ggccgagccaagaggaccccaggagcccagagcagcgggagaggguccuuccuagccucggc

SEQ ID NO: 114025 - RNA, 62 nt, Human
uccugccccagcauuuccaacuggagcuggcucagcgggaugaggaugaaaaugucaacauc

SEQ ID NO: 114026 - RNA, 62 nt, Human
uggugagagugugugucuuugcacacacagugcagcgggaacgguggggcuggcuggugcug

SEQ ID NO: 114027 - RNA, 62 nt, Human
accggaccacguugcugcccaggucuggaccucagcgggagaacuggcuccggggggagugg

SEQ ID NO: 114028 - RNA, 62 nt, Human
cuauguggagcauuaacuguggccaaaggaggcagcgggaacaggcugcuugcuaucuggaa

SEQ ID NO: 114029 - RNA, 55 nt, Human; identical to SEQ ID NO: 58177

SEQ ID NO: 114030 - RNA, 62 nt, Human
aagcuggagugccucaccacacggcccggaaacagcgggaaguaacuggaaagagcuuuagg

SEQ ID NO: 114031 - RNA, 64 nt, Human
aaagaacuuuguggcugaggggucaguuaccagugaccuucaaucaacuccaucacuucuuaaa

SEQ ID NO: 114032 - RNA, 62 nt, Human
uccccaggaagugguggugguugauggcuuuucagcgggaaacagaagagacaguguccuuu

SEQ ID NO: 114033 - RNA, 62 nt, Human
ggaggaagcugaggcaacuuugggauucuugucagcgggaggcgucacuggccccagaguga

SEQ ID NO: 114034 - RNA, 54 nt, Human; identical to SEQ ID NO: 58181

SEQ ID NO: 114035 - RNA, 62 nt, Human
uaauaaguccuaggagcugggcuucauuccuccagcgggaguccagucaggguccugaaguu

SEQ ID NO: 114036 - RNA, 54 nt, Human; identical to SEQ ID NO: 58183

SEQ ID NO: 114037 - RNA, 62 nt, Human
aggugcguguucagcagaaccugcacacaggacagcgggaaaaaucgaugagcgccaccucu

SEQ ID NO: 114038 - RNA, 62 nt, Human
cagugucacagcguggccuugcuugucugccacagcgggagcuaagccggcccugggccagc

SEQ ID NO: 114039 - RNA, 62 nt, Human
ggguggcugcgucugaaggcugucgucgguuacagcgggaaugggcgggccaacauggucug

SEQ ID NO: 114040 - RNA, 62 nt, Human
auccacugccggcacggcugccggguagcgggcagcgggaagccccccaucuuugaggugga

SEQ ID NO: 114041 - RNA, 62 nt, Human
gcgcgcgggaucgcagguagagcaggacgcugcagcgggauuggaccggcucggcugauguc

SEQ ID NO: 114042 - RNA, 62 nt, Human
cuggagaaguacgcgugaggacgccugagccccagcgggagaccuguccuuggcucuuccuc

SEQ ID NO: 114043 - RNA, 62 nt, Human
ggggcugcagaguauccgaggugcugccggggcagcgggagguggcuggacccaucgcaucu

SEQ ID NO: 114044 - RNA, 62 nt, Human
cggacccuggggcagagcugagcuugggacaccagcgggaacagggcaccccuucugcacug

SEQ ID NO: 114045 - RNA, 62 nt, Human
aagcagcaguguaccagugucacucuggaguacagcgggagaaacacaaaauaguauaacug

SEQ ID NO: 114046 - RNA, 62 nt, Human
ccguggggcuggggcagggggugucagcugcacagcgggacucuagggagaugggcgagcga

SEQ ID NO: 114047 - RNA, 54 nt, Human; identical to SEQ ID NO: 58194

SEQ ID NO: 114048 - RNA, 62 nt, Human
aaucagagcugaguggggaggugcuucagcagcagcgggaucaauacgauuuccacugggaa

SEQ ID NO: 114049 - RNA, 62 nt, Human
gugucggcucacagagccaccgcaacucugcccagcgggagugacaccacugaugccacaga

SEQ ID NO: 114050 - RNA, 62 nt, Human
ccaguggagaaagcgcccuuccagggcggcagcagcgggagccacgcagaccccgaggcgca

SEQ ID NO: 114051 - RNA, 62 nt, Human
uguguuucagccacacugaacccaauuacacacagcgggagaacgcaguaaacagcuuuccc

SEQ ID NO: 114052 - RNA, 62 nt, Human
gcccaccccugccagucauuccuccauucacccagcgggaggugggaugugagacagcccac

SEQ ID NO: 114053 - RNA, 62 nt, Human
cuggugaugcacaauaaagcagacuauuccuacagcgggacacccugaccccacggcugccc

SEQ ID NO: 114054 - RNA, 62 nt, Human
caggugaccaaccacauaacucgagacagggacagcgggaggcucaaaccugcccucggacg

SEQ ID NO: 114055 - RNA, 62 nt, Human
cccuccaucguuuucuucacuguccuccaagccagcgggaauggcagcugccacgccgcccu

SEQ ID NO: 114056 - RNA, 62 nt, Human
guuguguccgagcccgcccuccccugcuuccucagcgggaccccuucaucuguuggccuuac

SEQ ID NO: 114057 - RNA, 62 nt, Human
guauaaauucaauggaauuugagaagcaauggcagcgggauaauuuagagucacugauauua

SEQ ID NO: 114058 - RNA, 62 nt, Human
gucauccggggacccacuguugcccuggaccucagcgggaaggagcaggagagagcugcugu

SEQ ID NO: 114059 - RNA, 62 nt, Human
ugggccucgugcagggacgcucaggcugcucccagcgggaccacaguuuuggccucugaaac

SEQ ID NO: 114060 - RNA, 62 nt, Human
uauuccuggcagagcauuuagcuaacaccuugcagcgggaaccuuacuuuccuuuuaguuau

SEQ ID NO: 114061 - RNA, 62 nt, Human
acagggacagcucaggcucuuggugacuguggcagcgggaguucccggcccuccacacccgg

SEQ ID NO: 114062 - RNA, 62 nt, Human
aagccgcgggugcccccuagggcgacaggagccagcgggacgccgcacgcggccccagacuc

SEQ ID NO: 114063 - RNA, 62 nt, Human
cagcagccuccucucuuccugccugagcaccgcagcgggagccagcagggggcagcagaggc

SEQ ID NO: 114064 - RNA, 62 nt, Human
ccaccccgugccuccugccuccgcgcagccugcagcgggagacccuguccccgccccagccg

SEQ ID NO: 114065 - RNA, 62 nt, Human
gccugucuuucccagacuugucccuccuuuuccagcgggacucuucucauccuuccucauuu

SEQ ID NO: 114066 - RNA, 62 nt, Human
cucgcgccgaggacuggaccaucuguacagaccagcgggagugcgcgcgcccgccucgcaca

SEQ ID NO: 114067 - RNA, 62 nt, Human
aggucacgccugccuccacaucucuguuucuucagcgggaaaguggagcugguggaggggag

SEQ ID NO: 114068 - RNA, 62 nt, Human
ccccccgcccugggccccgucucgccuggggccagcgggagucccgggccuguggcagcggc

SEQ ID NO: 114069 - RNA, 64 nt, Human
gugggcucaccauucuuaguccuuucucaagugggaccuucaacuuucugugaacacccagucu

SEQ ID NO: 114070 - RNA, 62 nt, Human
uaacccguccaccuggccgaggcagcccagagcagcgggaugagcuggcggccagagaacgc

SEQ ID NO: 114071 - RNA, 62 nt, Human
aggcgugagcgcagggcacgguggucagcgugcagcgggacgggacuggcccugcccagcca

SEQ ID NO: 114072 - RNA, 62 nt, Human
ccaagccugcauucuggcugcccagcuucggacagcgggaacuccucaggcagccacgcagc

SEQ ID NO: 114073 - RNA, 62 nt, Human
cugguccuguugcaggaagccccuccuguuagcagcgggaugcaagaugcugucucggggcu

SEQ ID NO: 114074 - RNA, 62 nt, Human
cucuugcgcgugcgccggggcacagggagggacagcgggaggugucgcggggagccuggugc

SEQ ID NO: 114075 - RNA, 53 nt, Human; identical to SEQ ID NO: 58221

SEQ ID NO: 114076 - RNA, 62 nt, Human
gccccgguccucuccaucucucuccucggcagcagcgggaggcagaggaaggcggcagaaga

SEQ ID NO: 114077 - RNA, 62 nt, Human
ggcuccaaagcacagccuucccuguuccgucccagcgggagcugguguuaggggucccaagg

SEQ ID NO: 114078 - RNA, 62 nt, Human
agguccacccucaguacucaagcugcaguauacagcgggaaaaacugaggcacuuuggugcu

SEQ ID NO: 114079 - RNA, 62 nt, Human
gcgcuucccauuccggagacguuucaacccugcagcgggaaaggcugacugggaaauccauu

SEQ ID NO: 114080 - RNA, 62 nt, Human
ucuuccagacugaggagaagaucgagcgaacccagcgggacaucaggagcauccaggaggcu

SEQ ID NO: 114081 - RNA, 62 nt, Human
ggggugaaugggccuuugcucagcuccaggcccagcgggaagggaggcugcagggauggugg

SEQ ID NO: 114082 - RNA, 62 nt, Human
gcgcgcguggcgcccuggugcgacugcggagccagcgggaaccggcgugaggacugcgaagc

SEQ ID NO: 114083 - RNA, 62 nt, Human
cugcugcagccgucauacuguuccaaauguggcagcgggaacagaguacccucuucaagccc

SEQ ID NO: 114084 - RNA, 62 nt, Human
ucccaaguggagcuuuugguguccaguuaggccagcgggagcagucuccugauuuauuuuga

SEQ ID NO: 114085 - RNA, 62 nt, Human
guuaagcugaucacagacaccggcugcaccaucagcgggaagcagagcccauguccaggaug

SEQ ID NO: 114086 - RNA, 62 nt, Human
gcagccaccuacugccccaccucagagaagugcagcgggaaggaggcuggagguggugcggc

SEQ ID NO: 114087 - RNA, 62 nt, Human
ucaacaccagagccguguaccugaggcccaggcagcgggaaugccuuucugcagagccggac

SEQ ID NO: 114088 - RNA, 51 nt, Human
gucuuccaaugccaaucugaggaccuucagagacagucuacgccuuaacaa

SEQ ID NO: 114089 - RNA, 62 nt, Human
cguggcagccgggggccguggccacauuaccucagcgggagggagcagagcugggacaggca

SEQ ID NO: 114090 - RNA, 62 nt, Human
gcuguguucuacaagggggacgagugccugggcagcgggaagauccugcggcuggggccguc

SEQ ID NO: 114091 - RNA, 62 nt, Human
cauuccuccaguagacaccccugcugugugcccagcgggacgacagccacagggccuguuuc

SEQ ID NO: 114092 - RNA, 62 nt, Human
cuggccuuuguccugugugcccacaucugccccagcgggaagaggcccugccaaucuccgug

SEQ ID NO: 114093 - RNA, 62 nt, Human
cagcuagcacccuucauauccauccccguucucagcgggacaacaccauggacagccguuuu

SEQ ID NO: 114094 - RNA, 62 nt, Human
gaacagagcccuacagccagggcuuauauggccagcgggacuccaaccgggguagccgcgag

SEQ ID NO: 114095 - RNA, 62 nt, Human
gggcggagcugcagaagcguguggagggccuacagcgggagguggccacgcgcgccgucuca

SEQ ID NO: 114096 - RNA, 62 nt, Human
accauauguauuagucccccagugcuccagaacagcgggagcacugugcugugcuccuuuca

SEQ ID NO: 114097 - RNA, 54 nt, Human; identical to SEQ ID NO: 46544

SEQ ID NO: 114098 - RNA, 64 nt, Human; identical to SEQ ID NO: 46545

SEQ ID NO: 114099 - RNA, 64 nt, Human; identical to SEQ ID NO: 46546

SEQ ID NO: 114100 - RNA, 64 nt, Human; identical to SEQ ID NO: 46547

SEQ ID NO: 114101 - RNA, 64 nt, Human; identical to SEQ ID NO: 46548

SEQ ID NO: 114102 - RNA, 64 nt, Human; identical to SEQ ID NO: 46549

SEQ ID NO: 114103 - RNA, 64 nt, Human; identical to SEQ ID NO: 46550

SEQ ID NO: 114104 - RNA, 64 nt, Human; identical to SEQ ID NO: 46551

SEQ ID NO: 114105 - RNA, 64 nt, Human; identical to SEQ ID NO: 46552

SEQ ID NO: 114106 - RNA, 64 nt, Human; identical to SEQ ID NO: 46553

SEQ ID NO: 114107 - RNA, 64 nt, Human; identical to SEQ ID NO: 46554

SEQ ID NO: 114108 - RNA, 64 nt, Human; identical to SEQ ID NO: 46555

SEQ ID NO: 114109 - RNA, 64 nt, Human; identical to SEQ ID NO: 46556

SEQ ID NO: 114110 - RNA, 64 nt, Human; identical to SEQ ID NO: 46557

SEQ ID NO: 114111 - RNA, 64 nt, Human; identical to SEQ ID NO: 46558

SEQ ID NO: 114112 - RNA, 64 nt, Human; identical to SEQ ID NO: 46559

SEQ ID NO: 114113 - RNA, 64 nt, Human; identical to SEQ ID NO: 46560

SEQ ID NO: 114114 - RNA, 64 nt, Human; identical to SEQ ID NO: 46561

SEQ ID NO: 114115 - RNA, 64 nt, Human; identical to SEQ ID NO: 46562

SEQ ID NO: 114116 - RNA, 64 nt, Human; identical to SEQ ID NO: 46563

SEQ ID NO: 114117 - RNA, 64 nt, Human; identical to SEQ ID NO: 46564

SEQ ID NO: 114118 - RNA, 64 nt, Human; identical to SEQ ID NO: 46565

SEQ ID NO: 114119 - RNA, 64 nt, Human; identical to SEQ ID NO: 46566

SEQ ID NO: 114120 - RNA, 64 nt, Human; identical to SEQ ID NO: 46567

SEQ ID NO: 114121 - RNA, 64 nt, Human
augauucauauuuugagugaauacaucaggcacagaccuucaugauaucacacacucuuggcua

SEQ ID NO: 114122 - RNA, 64 nt, Human; identical to SEQ ID NO: 46568

SEQ ID NO: 114123 - RNA, 64 nt, Human; identical to SEQ ID NO: 46569

SEQ ID NO: 114124 - RNA, 64 nt, Human; identical to SEQ ID NO: 46570

SEQ ID NO: 114125 - RNA, 64 nt, Human; identical to SEQ ID NO: 46571

SEQ ID NO: 114126 - RNA, 64 nt, Human; identical to SEQ ID NO: 46572

SEQ ID NO: 114127 - RNA, 64 nt, Human; identical to SEQ ID NO: 46573

SEQ ID NO: 114128 - RNA, 64 nt, Human; identical to SEQ ID NO: 46574

SEQ ID NO: 114129 - RNA, 64 nt, Human; identical to SEQ ID NO: 46575

SEQ ID NO: 114130 - RNA, 64 nt, Human; identical to SEQ ID NO: 46576

SEQ ID NO: 114131 - RNA, 64 nt, Human; identical to SEQ ID NO: 46577

SEQ ID NO: 114132 - RNA, 64 nt, Human; identical to SEQ ID NO: 46578

SEQ ID NO: 114133 - RNA, 64 nt, Human; identical to SEQ ID NO: 46579

SEQ ID NO: 114134 - RNA, 64 nt, Human; identical to SEQ ID NO: 46580

SEQ ID NO: 114135 - RNA, 64 nt, Human; identical to SEQ ID NO: 46581

SEQ ID NO: 114136 - RNA, 64 nt, Human; identical to SEQ ID NO: 46582

SEQ ID NO: 114137 - RNA, 64 nt, Human; identical to SEQ ID NO: 46583

SEQ ID NO: 114138 - RNA, 64 nt, Human; identical to SEQ ID NO: 46584

SEQ ID NO: 114139 - RNA, 64 nt, Human; identical to SEQ ID NO: 46585

SEQ ID NO: 114140 - RNA, 64 nt, Human; identical to SEQ ID NO: 46586

SEQ ID NO: 114141 - RNA, 64 nt, Human; identical to SEQ ID NO: 46587

SEQ ID NO: 114142 - RNA, 64 nt, Human; identical to SEQ ID NO: 46588

SEQ ID NO: 114143 - RNA, 64 nt, Human; identical to SEQ ID NO: 46589

SEQ ID NO: 114144 - RNA, 64 nt, Human; identical to SEQ ID NO: 46590

SEQ ID NO: 114145 - RNA, 64 nt, Human; identical to SEQ ID NO: 46591

SEQ ID NO: 114146 - RNA, 64 nt, Human; identical to SEQ ID NO: 46592

SEQ ID NO: 114147 - RNA, 64 nt, Human; identical to SEQ ID NO: 46593

SEQ ID NO: 114148 - RNA, 64 nt, Human; identical to SEQ ID NO: 46594

SEQ ID NO: 114149 - RNA, 64 nt, Human; identical to SEQ ID NO: 46595

SEQ ID NO: 114150 - RNA, 64 nt, Human; identical to SEQ ID NO: 46596

SEQ ID NO: 114151 - RNA, 64 nt, Human; identical to SEQ ID NO: 46597

SEQ ID NO: 114152 - RNA, 64 nt, Human; identical to SEQ ID NO: 46598

SEQ ID NO: 114153 - RNA, 64 nt, Human; identical to SEQ ID NO: 46599

SEQ ID NO: 114154 - RNA, 64 nt, Human; identical to SEQ ID NO: 46600

SEQ ID NO: 114155 - RNA, 64 nt, Human
ugcauuucugaaacauuccuaagacccuuuaguugaccuucaaauauucaagcuauucugcagc

SEQ ID NO: 114156 - RNA, 64 nt, Human; identical to SEQ ID NO: 46601

SEQ ID NO: 114157 - RNA, 64 nt, Human; identical to SEQ ID NO: 46602

SEQ ID NO: 114158 - RNA, 64 nt, Human; identical to SEQ ID NO: 46603

SEQ ID NO: 114159 - RNA, 64 nt, Human; identical to SEQ ID NO: 46604

SEQ ID NO: 114160 - RNA, 64 nt, Human; identical to SEQ ID NO: 46605

SEQ ID NO: 114161 - RNA, 64 nt, Human; identical to SEQ ID NO: 46606

SEQ ID NO: 114162 - RNA, 64 nt, Human; identical to SEQ ID NO: 46607

SEQ ID NO: 114163 - RNA, 64 nt, Human; identical to SEQ ID NO: 46608

SEQ ID NO: 114164 - RNA, 64 nt, Human; identical to SEQ ID NO: 46609

SEQ ID NO: 114165 - RNA, 64 nt, Human; identical to SEQ ID NO: 46610

SEQ ID NO: 114166 - RNA, 64 nt, Human; identical to SEQ ID NO: 46611

SEQ ID NO: 114167 - RNA, 64 nt, Human; identical to SEQ ID NO: 46612

SEQ ID NO: 114168 - RNA, 64 nt, Human; identical to SEQ ID NO: 46613

SEQ ID NO: 114169 - RNA, 64 nt, Human; identical to SEQ ID NO: 46614

SEQ ID NO: 114170 - RNA, 64 nt, Human; identical to SEQ ID NO: 46615

SEQ ID NO: 114171 - RNA, 64 nt, Human; identical to SEQ ID NO: 46616

SEQ ID NO: 114172 - RNA, 64 nt, Human; identical to SEQ ID NO: 46617

SEQ ID NO: 114173 - RNA, 64 nt, Human; identical to SEQ ID NO: 46618

SEQ ID NO: 114174 - RNA, 64 nt, Human; identical to SEQ ID NO: 46619

SEQ ID NO: 114175 - RNA, 64 nt, Human; identical to SEQ ID NO: 46620

SEQ ID NO: 114176 - RNA, 64 nt, Human; identical to SEQ ID NO: 46621

SEQ ID NO: 114177 - RNA, 64 nt, Human; identical to SEQ ID NO: 46622

SEQ ID NO: 114178 - RNA, 64 nt, Human; identical to SEQ ID NO: 46623

SEQ ID NO: 114179 - RNA, 64 nt, Human; identical to SEQ ID NO: 46624

SEQ ID NO: 114180 - RNA, 64 nt, Human; identical to SEQ ID NO: 46625

SEQ ID NO: 114181 - RNA, 64 nt, Human; identical to SEQ ID NO: 46626

SEQ ID NO: 114182 - RNA, 64 nt, Human; identical to SEQ ID NO: 46627

SEQ ID NO: 114183 - RNA, 64 nt, Human; identical to SEQ ID NO: 46628

SEQ ID NO: 114184 - RNA, 64 nt, Human; identical to SEQ ID NO: 46629

SEQ ID NO: 114185 - RNA, 64 nt, Human; identical to SEQ ID NO: 46630

SEQ ID NO: 114186 - RNA, 64 nt, Human; identical to SEQ ID NO: 46631

SEQ ID NO: 114187 - RNA, 64 nt, Human; identical to SEQ ID NO: 46632

SEQ ID NO: 114188 - RNA, 64 nt, Human; identical to SEQ ID NO: 46633

SEQ ID NO: 114189 - RNA, 64 nt, Human
aucauuuuagcacacuagcgguuuauauuuuaaggaccuucauucucuguucugcaccucuucu

SEQ ID NO: 114190 - RNA, 64 nt, Human; identical to SEQ ID NO: 46634

SEQ ID NO: 114191 - RNA, 64 nt, Human; identical to SEQ ID NO: 46635

SEQ ID NO: 114192 - RNA, 64 nt, Human; identical to SEQ ID NO: 46636

SEQ ID NO: 114193 - RNA, 64 nt, Human; identical to SEQ ID NO: 46637

SEQ ID NO: 114194 - RNA, 64 nt, Human; identical to SEQ ID NO: 46638

SEQ ID NO: 114195 - RNA, 58 nt, Human; identical to SEQ ID NO: 46639

SEQ ID NO: 114196 - RNA, 64 nt, Human; identical to SEQ ID NO: 46640

SEQ ID NO: 114197 - RNA, 64 nt, Human; identical to SEQ ID NO: 46641

SEQ ID NO: 114198 - RNA, 64 nt, Human; identical to SEQ ID NO: 46642

SEQ ID NO: 114199 - RNA, 64 nt, Human; identical to SEQ ID NO: 46643

SEQ ID NO: 114200 - RNA, 64 nt, Human; identical to SEQ ID NO: 46644

SEQ ID NO: 114201 - RNA, 64 nt, Human; identical to SEQ ID NO: 46645

SEQ ID NO: 114202 - RNA, 64 nt, Human; identical to SEQ ID NO: 46646

SEQ ID NO: 114203 - RNA, 64 nt, Human; identical to SEQ ID NO: 46647

SEQ ID NO: 114204 - RNA, 64 nt, Human; identical to SEQ ID NO: 46648

SEQ ID NO: 114205 - RNA, 64 nt, Human; identical to SEQ ID NO: 46649

SEQ ID NO: 114206 - RNA, 64 nt, Human; identical to SEQ ID NO: 46650

SEQ ID NO: 114207 - RNA, 64 nt, Human; identical to SEQ ID NO: 46651

SEQ ID NO: 114208 - RNA, 64 nt, Human; identical to SEQ ID NO: 46652

SEQ ID NO: 114209 - RNA, 64 nt, Human; identical to SEQ ID NO: 46653

SEQ ID NO: 114210 - RNA, 64 nt, Human; identical to SEQ ID NO: 46654

SEQ ID NO: 114211 - RNA, 64 nt, Human; identical to SEQ ID NO: 46655

SEQ ID NO: 114212 - RNA, 64 nt, Human; identical to SEQ ID NO: 46656

SEQ ID NO: 114213 - RNA, 64 nt, Human; identical to SEQ ID NO: 46657

SEQ ID NO: 114214 - RNA, 64 nt, Human; identical to SEQ ID NO: 46658

SEQ ID NO: 114215 - RNA, 64 nt, Human; identical to SEQ ID NO: 46659

SEQ ID NO: 114216 - RNA, 64 nt, Human; identical to SEQ ID NO: 46660

SEQ ID NO: 114217 - RNA, 64 nt, Human; identical to SEQ ID NO: 46661

SEQ ID NO: 114218 - RNA, 64 nt, Human; identical to SEQ ID NO: 46662

SEQ ID NO: 114219 - RNA, 64 nt, Human; identical to SEQ ID NO: 46663

SEQ ID NO: 114220 - RNA, 64 nt, Human; identical to SEQ ID NO: 46664

SEQ ID NO: 114221 - RNA, 62 nt, Human; identical to SEQ ID NO: 46665

SEQ ID NO: 114222 - RNA, 64 nt, Human; identical to SEQ ID NO: 46666

SEQ ID NO: 114223 - RNA, 64 nt, Human
aagaagagagggucucccuggggugggguugcuggaccuucaauccaucgcuacaguccagaag

SEQ ID NO: 114224 - RNA, 64 nt, Human; identical to SEQ ID NO: 46667

SEQ ID NO: 114225 - RNA, 64 nt, Human; identical to SEQ ID NO: 46668

SEQ ID NO: 114226 - RNA, 64 nt, Human; identical to SEQ ID NO: 46669

SEQ ID NO: 114227 - RNA, 64 nt, Human; identical to SEQ ID NO: 46670

SEQ ID NO: 114228 - RNA, 64 nt, Human; identical to SEQ ID NO: 46671

SEQ ID NO: 114229 - RNA, 64 nt, Human; identical to SEQ ID NO: 46672

SEQ ID NO: 114230 - RNA, 64 nt, Human; identical to SEQ ID NO: 46673

SEQ ID NO: 114231 - RNA, 64 nt, Human; identical to SEQ ID NO: 46674

SEQ ID NO: 114232 - RNA, 64 nt, Human; identical to SEQ ID NO: 46675

SEQ ID NO: 114233 - RNA, 64 nt, Human; identical to SEQ ID NO: 46676

SEQ ID NO: 114234 - RNA, 64 nt, Human; identical to SEQ ID NO: 46677

SEQ ID NO: 114235 - RNA, 64 nt, Human; identical to SEQ ID NO: 46678

SEQ ID NO: 114236 - RNA, 64 nt, Human; identical to SEQ ID NO: 46679

SEQ ID NO: 114237 - RNA, 64 nt, Human; identical to SEQ ID NO: 46680

SEQ ID NO: 114238 - RNA, 64 nt, Human; identical to SEQ ID NO: 46681

SEQ ID NO: 114239 - RNA, 64 nt, Human; identical to SEQ ID NO: 46682

SEQ ID NO: 114240 - RNA, 64 nt, Human; identical to SEQ ID NO: 46683

SEQ ID NO: 114241 - RNA, 64 nt, Human; identical to SEQ ID NO: 46684

SEQ ID NO: 114242 - RNA, 64 nt, Human; identical to SEQ ID NO: 46685

SEQ ID NO: 114243 - RNA, 64 nt, Human; identical to SEQ ID NO: 46686

SEQ ID NO: 114244 - RNA, 64 nt, Human; identical to SEQ ID NO: 46687

SEQ ID NO: 114245 - RNA, 64 nt, Human; identical to SEQ ID NO: 46688

SEQ ID NO: 114246 - RNA, 64 nt, Human; identical to SEQ ID NO: 46689

SEQ ID NO: 114247 - RNA, 64 nt, Human; identical to SEQ ID NO: 46690

SEQ ID NO: 114248 - RNA, 64 nt, Human; identical to SEQ ID NO: 46691

SEQ ID NO: 114249 - RNA, 64 nt, Human; identical to SEQ ID NO: 46692

SEQ ID NO: 114250 - RNA, 64 nt, Human; identical to SEQ ID NO: 46693

SEQ ID NO: 114251 - RNA, 64 nt, Human; identical to SEQ ID NO: 46694

SEQ ID NO: 114252 - RNA, 64 nt, Human; identical to SEQ ID NO: 46695

SEQ ID NO: 114253 - RNA, 64 nt, Human; identical to SEQ ID NO: 46696

SEQ ID NO: 114254 - RNA, 64 nt, Human; identical to SEQ ID NO: 46697

SEQ ID NO: 114255 - RNA, 64 nt, Human; identical to SEQ ID NO: 46698

SEQ ID NO: 114256 - RNA, 64 nt, Human; identical to SEQ ID NO: 46699

SEQ ID NO: 114257 - RNA, 64 nt, Human
agccugcccagcugaaucuuggcuucuggaccuugaccuucagaacuucucuugguguggaacc

SEQ ID NO: 114258 - RNA, 64 nt, Human; identical to SEQ ID NO: 46700

SEQ ID NO: 114259 - RNA, 64 nt, Human; identical to SEQ ID NO: 46701

SEQ ID NO: 114260 - RNA, 64 nt, Human; identical to SEQ ID NO: 46702

SEQ ID NO: 114261 - RNA, 64 nt, Human; identical to SEQ ID NO: 46703

SEQ ID NO: 114262 - RNA, 64 nt, Human; identical to SEQ ID NO: 46704

SEQ ID NO: 114263 - RNA, 64 nt, Human; identical to SEQ ID NO: 46705

SEQ ID NO: 114264 - RNA, 64 nt, Human; identical to SEQ ID NO: 46706

SEQ ID NO: 114265 - RNA, 64 nt, Human; identical to SEQ ID NO: 46707

SEQ ID NO: 114266 - RNA, 64 nt, Human; identical to SEQ ID NO: 46708

SEQ ID NO: 114267 - RNA, 64 nt, Human; identical to SEQ ID NO: 46709

SEQ ID NO: 114268 - RNA, 64 nt, Human; identical to SEQ ID NO: 46710

SEQ ID NO: 114269 - RNA, 64 nt, Human; identical to SEQ ID NO: 46711

SEQ ID NO: 114270 - RNA, 64 nt, Human; identical to SEQ ID NO: 46712

SEQ ID NO: 114271 - RNA, 64 nt, Human; identical to SEQ ID NO: 46713

SEQ ID NO: 114272 - RNA, 64 nt, Human; identical to SEQ ID NO: 46714

SEQ ID NO: 114273 - RNA, 64 nt, Human; identical to SEQ ID NO: 46715

SEQ ID NO: 114274 - RNA, 64 nt, Human
ggcuccccuccucggcuuccuuccucucugcaaugaccuucaacaaccggccaccagaugucgc

SEQ ID NO: 114275 - RNA, 64 nt, Human; identical to SEQ ID NO: 46716

SEQ ID NO: 114276 - RNA, 64 nt, Human; identical to SEQ ID NO: 46717

SEQ ID NO: 114277 - RNA, 64 nt, Human; identical to SEQ ID NO: 46718

SEQ ID NO: 114278 - RNA, 64 nt, Human; identical to SEQ ID NO: 46719

SEQ ID NO: 114279 - RNA, 64 nt, Human; identical to SEQ ID NO: 46720

SEQ ID NO: 114280 - RNA, 64 nt, Human; identical to SEQ ID NO: 46721

SEQ ID NO: 114281 - RNA, 64 nt, Human; identical to SEQ ID NO: 46722

SEQ ID NO: 114282 - RNA, 64 nt, Human; identical to SEQ ID NO: 46723

SEQ ID NO: 114283 - RNA, 64 nt, Human; identical to SEQ ID NO: 46724

SEQ ID NO: 114284 - RNA, 64 nt, Human; identical to SEQ ID NO: 46725

SEQ ID NO: 114285 - RNA, 64 nt, Human; identical to SEQ ID NO: 46726

SEQ ID NO: 114286 - RNA, 64 nt, Human; identical to SEQ ID NO: 46727

SEQ ID NO: 114287 - RNA, 64 nt, Human; identical to SEQ ID NO: 46728

SEQ ID NO: 114288 - RNA, 64 nt, Human; identical to SEQ ID NO: 46729

SEQ ID NO: 114289 - RNA, 64 nt, Human; identical to SEQ ID NO: 46730

SEQ ID NO: 114290 - RNA, 64 nt, Human; identical to SEQ ID NO: 46731

SEQ ID NO: 114291 - RNA, 64 nt, Human
ucagggucugugccagcccugucggugcugcucagaccuucauagccucucuugucauucuuug

SEQ ID NO: 114292 - RNA, 64 nt, Human; identical to SEQ ID NO: 46732

SEQ ID NO: 114293 - RNA, 64 nt, Human; identical to SEQ ID NO: 46733

SEQ ID NO: 114294 - RNA, 64 nt, Human; identical to SEQ ID NO: 46734

SEQ ID NO: 114295 - RNA, 64 nt, Human; identical to SEQ ID NO: 46735

SEQ ID NO: 114296 - RNA, 64 nt, Human; identical to SEQ ID NO: 46736

SEQ ID NO: 114297 - RNA, 64 nt, Human; identical to SEQ ID NO: 46737

SEQ ID NO: 114298 - RNA, 64 nt, Human; identical to SEQ ID NO: 46738

SEQ ID NO: 114299 - RNA, 64 nt, Human; identical to SEQ ID NO: 46739

SEQ ID NO: 114300 - RNA, 64 nt, Human; identical to SEQ ID NO: 46740

SEQ ID NO: 114301 - RNA, 64 nt, Human; identical to SEQ ID NO: 46741

SEQ ID NO: 114302 - RNA, 64 nt, Human; identical to SEQ ID NO: 46742

SEQ ID NO: 114303 - RNA, 61 nt, Human; identical to SEQ ID NO: 46743

SEQ ID NO: 114304 - RNA, 64 nt, Human; identical to SEQ ID NO: 46744

SEQ ID NO: 114305 - RNA, 64 nt, Human; identical to SEQ ID NO: 46745

SEQ ID NO: 114306 - RNA, 64 nt, Human; identical to SEQ ID NO: 46746

SEQ ID NO: 114307 - RNA, 64 nt, Human; identical to SEQ ID NO: 46747

SEQ ID NO: 114308 - RNA, 64 nt, Human
aguaguuauccaucagagaugacucugucucauugaccuucagauuccccaucaacaaacacuu

SEQ ID NO: 114309 - RNA, 64 nt, Human; identical to SEQ ID NO: 46748

SEQ ID NO: 114310 - RNA, 64 nt, Human; identical to SEQ ID NO: 46749

SEQ ID NO: 114311 - RNA, 55 nt, Human; identical to SEQ ID NO: 46750

SEQ ID NO: 114312 - RNA, 64 nt, Human; identical to SEQ ID NO: 46751

SEQ ID NO: 114313 - RNA, 64 nt, Human; identical to SEQ ID NO: 46752

SEQ ID NO: 114314 - RNA, 64 nt, Human; identical to SEQ ID NO: 46753

SEQ ID NO: 114315 - RNA, 64 nt, Human; identical to SEQ ID NO: 46754

SEQ ID NO: 114316 - RNA, 64 nt, Human; identical to SEQ ID NO: 46755

SEQ ID NO: 114317 - RNA, 64 nt, Human; identical to SEQ ID NO: 46756

SEQ ID NO: 114318 - RNA, 64 nt, Human; identical to SEQ ID NO: 46757

SEQ ID NO: 114319 - RNA, 64 nt, Human; identical to SEQ ID NO: 46758

SEQ ID NO: 114320 - RNA, 64 nt, Human; identical to SEQ ID NO: 46759

SEQ ID NO: 114321 - RNA, 64 nt, Human; identical to SEQ ID NO: 46760

SEQ ID NO: 114322 - RNA, 64 nt, Human; identical to SEQ ID NO: 46761

SEQ ID NO: 114323 - RNA, 64 nt, Human; identical to SEQ ID NO: 46762

SEQ ID NO: 114324 - RNA, 64 nt, Human; identical to SEQ ID NO: 46763

SEQ ID NO: 114325 - RNA, 64 nt, Human; identical to SEQ ID NO: 46764

SEQ ID NO: 114326 - RNA, 64 nt, Human; identical to SEQ ID NO: 46765

SEQ ID NO: 114327 - RNA, 64 nt, Human; identical to SEQ ID NO: 46766

SEQ ID NO: 114328 - RNA, 64 nt, Human; identical to SEQ ID NO: 46767

SEQ ID NO: 114329 - RNA, 64 nt, Human; identical to SEQ ID NO: 46768

SEQ ID NO: 114330 - RNA, 64 nt, Human; identical to SEQ ID NO: 46769

SEQ ID NO: 114331 - RNA, 64 nt, Human; identical to SEQ ID NO: 46770

SEQ ID NO: 114332 - RNA, 64 nt, Human; identical to SEQ ID NO: 46771

SEQ ID NO: 114333 - RNA, 64 nt, Human; identical to SEQ ID NO: 46772

SEQ ID NO: 114334 - RNA, 64 nt, Human; identical to SEQ ID NO: 46773

SEQ ID NO: 114335 - RNA, 64 nt, Human; identical to SEQ ID NO: 46774

SEQ ID NO: 114336 - RNA, 64 nt, Human; identical to SEQ ID NO: 46775

SEQ ID NO: 114337 - RNA, 64 nt, Human; identical to SEQ ID NO: 46776

SEQ ID NO: 114338 - RNA, 64 nt, Human; identical to SEQ ID NO: 46777

SEQ ID NO: 114339 - RNA, 64 nt, Human; identical to SEQ ID NO: 46778

SEQ ID NO: 114340 - RNA, 64 nt, Human; identical to SEQ ID NO: 46779

SEQ ID NO: 114341 - RNA, 64 nt, Human; identical to SEQ ID NO: 46780

SEQ ID NO: 114342 - RNA, 64 nt, Human
uaacuccgugugugaugaaaacgccuccuuuucugaccuucaaaguccccuguagagaccaugc

SEQ ID NO: 114343 - RNA, 64 nt, Human; identical to SEQ ID NO: 46781

SEQ ID NO: 114344 - RNA, 64 nt, Human; identical to SEQ ID NO: 46782

SEQ ID NO: 114345 - RNA, 64 nt, Human; identical to SEQ ID NO: 46783

SEQ ID NO: 114346 - RNA, 64 nt, Human; identical to SEQ ID NO: 46784

SEQ ID NO: 114347 - RNA, 64 nt, Human; identical to SEQ ID NO: 46785

SEQ ID NO: 114348 - RNA, 64 nt, Human; identical to SEQ ID NO: 46786

SEQ ID NO: 114349 - RNA, 64 nt, Human; identical to SEQ ID NO: 46787

SEQ ID NO: 114350 - RNA, 64 nt, Human; identical to SEQ ID NO: 46788

SEQ ID NO: 114351 - RNA, 64 nt, Human; identical to SEQ ID NO: 46789

SEQ ID NO: 114352 - RNA, 64 nt, Human; identical to SEQ ID NO: 46790

SEQ ID NO: 114353 - RNA, 64 nt, Human; identical to SEQ ID NO: 46791

SEQ ID NO: 114354 - RNA, 64 nt, Human; identical to SEQ ID NO: 46792

SEQ ID NO: 114355 - RNA, 64 nt, Human; identical to SEQ ID NO: 46793

SEQ ID NO: 114356 - RNA, 64 nt, Human; identical to SEQ ID NO: 46794

SEQ ID NO: 114357 - RNA, 64 nt, Human; identical to SEQ ID NO: 46795

SEQ ID NO: 114358 - RNA, 64 nt, Human; identical to SEQ ID NO: 46796

SEQ ID NO: 114359 - RNA, 64 nt, Human
gguugggaaaacaccucauuugaccuugccagcugaccuucaaacccugcauuugaaccgacca

SEQ ID NO: 114360 - RNA, 64 nt, Human; identical to SEQ ID NO: 46797

SEQ ID NO: 114361 - RNA, 64 nt, Human; identical to SEQ ID NO: 46798

SEQ ID NO: 114362 - RNA, 64 nt, Human; identical to SEQ ID NO: 46799

SEQ ID NO: 114363 - RNA, 64 nt, Human; identical to SEQ ID NO: 46800

SEQ ID NO: 114364 - RNA, 64 nt, Human; identical to SEQ ID NO: 46801

SEQ ID NO: 114365 - RNA, 64 nt, Human; identical to SEQ ID NO: 46802

SEQ ID NO: 114366 - RNA, 64 nt, Human; identical to SEQ ID NO: 46803

SEQ ID NO: 114367 - RNA, 64 nt, Human; identical to SEQ ID NO: 46804

SEQ ID NO: 114368 - RNA, 64 nt, Human; identical to SEQ ID NO: 46805

SEQ ID NO: 114369 - RNA, 64 nt, Human; identical to SEQ ID NO: 46806

SEQ ID NO: 114370 - RNA, 54 nt, Human; identical to SEQ ID NO: 46807

SEQ ID NO: 114371 - RNA, 54 nt, Human; identical to SEQ ID NO: 46807

SEQ ID NO: 114372 - RNA, 64 nt, Human; identical to SEQ ID NO: 46809

SEQ ID NO: 114373 - RNA, 64 nt, Human; identical to SEQ ID NO: 46810

SEQ ID NO: 114374 - RNA, 64 nt, Human; identical to SEQ ID NO: 46811

SEQ ID NO: 114375 - RNA, 64 nt, Human; identical to SEQ ID NO: 46812

SEQ ID NO: 114376 - RNA, 64 nt, Human; identical to SEQ ID NO: 46813

SEQ ID NO: 114377 - RNA, 64 nt, Human; identical to SEQ ID NO: 46814

SEQ ID NO: 114378 - RNA, 64 nt, Human; identical to SEQ ID NO: 46815

SEQ ID NO: 114379 - RNA, 64 nt, Human; identical to SEQ ID NO: 46816

SEQ ID NO: 114380 - RNA, 64 nt, Human; identical to SEQ ID NO: 46817

SEQ ID NO: 114381 - RNA, 64 nt, Human; identical to SEQ ID NO: 46818

SEQ ID NO: 114382 - RNA, 64 nt, Human; identical to SEQ ID NO: 46819

SEQ ID NO: 114383 - RNA, 63 nt, Human; identical to SEQ ID NO: 46820

SEQ ID NO: 114384 - RNA, 64 nt, Human; identical to SEQ ID NO: 46821

SEQ ID NO: 114385 - RNA, 64 nt, Human; identical to SEQ ID NO: 46822

SEQ ID NO: 114386 - RNA, 64 nt, Human; identical to SEQ ID NO: 46823

SEQ ID NO: 114387 - RNA, 64 nt, Human; identical to SEQ ID NO: 46824

SEQ ID NO: 114388 - RNA, 64 nt, Human; identical to SEQ ID NO: 46825

SEQ ID NO: 114389 - RNA, 64 nt, Human; identical to SEQ ID NO: 46826

SEQ ID NO: 114390 - RNA, 64 nt, Human; identical to SEQ ID NO: 46827

SEQ ID NO: 114391 - RNA, 64 nt, Human; identical to SEQ ID NO: 46828

SEQ ID NO: 114392 - RNA, 64 nt, Human; identical to SEQ ID NO: 46829

SEQ ID NO: 114393 - RNA, 64 nt, Human
uuuuuugcacagcagucucugcaauuagcucaccgaccuucaacuuugcuguaaaccuuuuggu

SEQ ID NO: 114394 - RNA, 64 nt, Human; identical to SEQ ID NO: 46830

SEQ ID NO: 114395 - RNA, 64 nt, Human; identical to SEQ ID NO: 46831

SEQ ID NO: 114396 - RNA, 64 nt, Human; identical to SEQ ID NO: 46832

SEQ ID NO: 114397 - RNA, 60 nt, Human; identical to SEQ ID NO: 46833

SEQ ID NO: 114398 - RNA, 64 nt, Human; identical to SEQ ID NO: 46834

SEQ ID NO: 114399 - RNA, 64 nt, Human; identical to SEQ ID NO: 46835

SEQ ID NO: 114400 - RNA, 64 nt, Human; identical to SEQ ID NO: 46836

SEQ ID NO: 114401 - RNA, 64 nt, Human; identical to SEQ ID NO: 46837

SEQ ID NO: 114402 - RNA, 64 nt, Human; identical to SEQ ID NO: 46838

SEQ ID NO: 114403 - RNA, 64 nt, Human; identical to SEQ ID NO: 46839

SEQ ID NO: 114404 - RNA, 64 nt, Human; identical to SEQ ID NO: 46840

SEQ ID NO: 114405 - RNA, 64 nt, Human; identical to SEQ ID NO: 46841

SEQ ID NO: 114406 - RNA, 64 nt, Human; identical to SEQ ID NO: 46842

SEQ ID NO: 114407 - RNA, 64 nt, Human; identical to SEQ ID NO: 46843

SEQ ID NO: 114408 - RNA, 64 nt, Human; identical to SEQ ID NO: 46844

SEQ ID NO: 114409 - RNA, 64 nt, Human; identical to SEQ ID NO: 46845

SEQ ID NO: 114410 - RNA, 64 nt, Human; identical to SEQ ID NO: 46846

SEQ ID NO: 114411 - RNA, 64 nt, Human; identical to SEQ ID NO: 46847

SEQ ID NO: 114412 - RNA, 64 nt, Human; identical to SEQ ID NO: 46848

SEQ ID NO: 114413 - RNA, 64 nt, Human; identical to SEQ ID NO: 46849

SEQ ID NO: 114414 - RNA, 64 nt, Human; identical to SEQ ID NO: 46850

SEQ ID NO: 114415 - RNA, 64 nt, Human; identical to SEQ ID NO: 46851

SEQ ID NO: 114416 - RNA, 64 nt, Human; identical to SEQ ID NO: 46852

SEQ ID NO: 114417 - RNA, 64 nt, Human; identical to SEQ ID NO: 46853

SEQ ID NO: 114418 - RNA, 64 nt, Human; identical to SEQ ID NO: 46854

SEQ ID NO: 114419 - RNA, 64 nt, Human; identical to SEQ ID NO: 46855

SEQ ID NO: 114420 - RNA, 64 nt, Human; identical to SEQ ID NO: 46856

SEQ ID NO: 114421 - RNA, 63 nt, Human; identical to SEQ ID NO: 46857

SEQ ID NO: 114422 - RNA, 62 nt, Human; identical to SEQ ID NO: 46858

SEQ ID NO: 114423 - RNA, 64 nt, Human; identical to SEQ ID NO: 46859

SEQ ID NO: 114424 - RNA, 64 nt, Human; identical to SEQ ID NO: 46860

SEQ ID NO: 114425 - RNA, 64 nt, Human; identical to SEQ ID NO: 46861

SEQ ID NO: 114426 - RNA, 64 nt, Human; identical to SEQ ID NO: 46862

SEQ ID NO: 114427 - RNA, 64 nt, Human; identical to SEQ ID NO: 46863

SEQ ID NO: 114428 - RNA, 64 nt, Human; identical to SEQ ID NO: 46864

SEQ ID NO: 114429 - RNA, 64 nt, Human; identical to SEQ ID NO: 46865

SEQ ID NO: 114430 - RNA, 64 nt, Human; identical to SEQ ID NO: 46866

SEQ ID NO: 114431 - RNA, 64 nt, Human; identical to SEQ ID NO: 46867

SEQ ID NO: 114432 - RNA, 64 nt, Human; identical to SEQ ID NO: 46868

SEQ ID NO: 114433 - RNA, 64 nt, Human; identical to SEQ ID NO: 46869

SEQ ID NO: 114434 - RNA, 64 nt, Human; identical to SEQ ID NO: 46870

SEQ ID NO: 114435 - RNA, 64 nt, Human; identical to SEQ ID NO: 46871

SEQ ID NO: 114436 - RNA, 64 nt, Human; identical to SEQ ID NO: 46872

SEQ ID NO: 114437 - RNA, 64 nt, Human; identical to SEQ ID NO: 46873

SEQ ID NO: 114438 - RNA, 64 nt, Human; identical to SEQ ID NO: 46874

SEQ ID NO: 114439 - RNA, 64 nt, Human; identical to SEQ ID NO: 46875

SEQ ID NO: 114440 - RNA, 64 nt, Human; identical to SEQ ID NO: 46876

SEQ ID NO: 114441 - RNA, 64 nt, Human; identical to SEQ ID NO: 46877

SEQ ID NO: 114442 - RNA, 64 nt, Human; identical to SEQ ID NO: 46878

SEQ ID NO: 114443 - RNA, 64 nt, Human; identical to SEQ ID NO: 46879

SEQ ID NO: 114444 - RNA, 64 nt, Human
uuucucagauugucuuuaacuuuguuuuuaaaaugaccuucaaaauaaacugucaaaacaccau

SEQ ID NO: 114445 - RNA, 64 nt, Human; identical to SEQ ID NO: 46880

SEQ ID NO: 114446 - RNA, 64 nt, Human; identical to SEQ ID NO: 46881

SEQ ID NO: 114447 - RNA, 52 nt, Human; identical to SEQ ID NO: 46882

SEQ ID NO: 114448 - RNA, 64 nt, Human; identical to SEQ ID NO: 46664

SEQ ID NO: 114449 - RNA, 64 nt, Human; identical to SEQ ID NO: 46884

SEQ ID NO: 114450 - RNA, 64 nt, Human; identical to SEQ ID NO: 46885

SEQ ID NO: 114451 - RNA, 64 nt, Human; identical to SEQ ID NO: 46886

SEQ ID NO: 114452 - RNA, 64 nt, Human; identical to SEQ ID NO: 46887

SEQ ID NO: 114453 - RNA, 64 nt, Human; identical to SEQ ID NO: 46888

SEQ ID NO: 114454 - RNA, 64 nt, Human; identical to SEQ ID NO: 46889

SEQ ID NO: 114455 - RNA, 64 nt, Human; identical to SEQ ID NO: 46890

SEQ ID NO: 114456 - RNA, 64 nt, Human; identical to SEQ ID NO: 46891

SEQ ID NO: 114457 - RNA, 64 nt, Human; identical to SEQ ID NO: 46892

SEQ ID NO: 114458 - RNA, 64 nt, Human; identical to SEQ ID NO: 46893

SEQ ID NO: 114459 - RNA, 64 nt, Human; identical to SEQ ID NO: 46894

SEQ ID NO: 114460 - RNA, 64 nt, Human; identical to SEQ ID NO: 46895

SEQ ID NO: 114461 - RNA, 64 nt, Human; identical to SEQ ID NO: 46896

SEQ ID NO: 114462 - RNA, 64 nt, Human; identical to SEQ ID NO: 46897

SEQ ID NO: 114463 - RNA, 64 nt, Human; identical to SEQ ID NO: 46898

SEQ ID NO: 114464 - RNA, 64 nt, Human; identical to SEQ ID NO: 46899

SEQ ID NO: 114465 - RNA, 64 nt, Human; identical to SEQ ID NO: 46900

SEQ ID NO: 114466 - RNA, 64 nt, Human; identical to SEQ ID NO: 46901

SEQ ID NO: 114467 - RNA, 64 nt, Human; identical to SEQ ID NO: 46902

SEQ ID NO: 114468 - RNA, 64 nt, Human; identical to SEQ ID NO: 46903

SEQ ID NO: 114469 - RNA, 64 nt, Human; identical to SEQ ID NO: 46904

SEQ ID NO: 114470 - RNA, 64 nt, Human; identical to SEQ ID NO: 46905

SEQ ID NO: 114471 - RNA, 64 nt, Human; identical to SEQ ID NO: 46906

SEQ ID NO: 114472 - RNA, 64 nt, Human; identical to SEQ ID NO: 46907

SEQ ID NO: 114473 - RNA, 64 nt, Human; identical to SEQ ID NO: 46908

SEQ ID NO: 114474 - RNA, 64 nt, Human; identical to SEQ ID NO: 46909

SEQ ID NO: 114475 - RNA, 55 nt, Human; identical to SEQ ID NO: 46910

SEQ ID NO: 114476 - RNA, 64 nt, Human; identical to SEQ ID NO: 46911

SEQ ID NO: 114477 - RNA, 64 nt, Human; identical to SEQ ID NO: 46912

SEQ ID NO: 114478 - RNA, 64 nt, Human; identical to SEQ ID NO: 46913

SEQ ID NO: 114479 - RNA, 64 nt, Human; identical to SEQ ID NO: 46914

SEQ ID NO: 114480 - RNA, 64 nt, Human; identical to SEQ ID NO: 46915

SEQ ID NO: 114481 - RNA, 64 nt, Human; identical to SEQ ID NO: 46916

SEQ ID NO: 114482 - RNA, 64 nt, Human; identical to SEQ ID NO: 46917

SEQ ID NO: 114483 - RNA, 64 nt, Human; identical to SEQ ID NO: 46918

SEQ ID NO: 114484 - RNA, 64 nt, Human; identical to SEQ ID NO: 46919

SEQ ID NO: 114485 - RNA, 64 nt, Human; identical to SEQ ID NO: 46920

SEQ ID NO: 114486 - RNA, 64 nt, Human; identical to SEQ ID NO: 46921

SEQ ID NO: 114487 - RNA, 64 nt, Human; identical to SEQ ID NO: 46922

SEQ ID NO: 114488 - RNA, 64 nt, Human; identical to SEQ ID NO: 46923

SEQ ID NO: 114489 - RNA, 64 nt, Human; identical to SEQ ID NO: 46924

SEQ ID NO: 114490 - RNA, 64 nt, Human; identical to SEQ ID NO: 46925

SEQ ID NO: 114491 - RNA, 64 nt, Human; identical to SEQ ID NO: 46926

SEQ ID NO: 114492 - RNA, 64 nt, Human; identical to SEQ ID NO: 46927

SEQ ID NO: 114493 - RNA, 64 nt, Human; identical to SEQ ID NO: 46928

SEQ ID NO: 114494 - RNA, 64 nt, Human
gccuugauggccgggccucgaaggccacaaacaaggcgucgaggaauuggaaagauuugcacac

SEQ ID NO: 114495 - RNA, 64 nt, Human
auacuucaaaagccauaacuugaaaaauacugguggcgucgauggugagugauuuuuaucccac

SEQ ID NO: 114496 - RNA, 64 nt, Human
cauggacagaucccccacagccuggggcagaagaggcgucgagggcgccagaaguggcggcagc

SEQ ID NO: 114497 - RNA, 64 nt, Human
acguuggccauuccaccuuggaguuggaacccugggcgucgagacaggaaggcagggcgcagug

SEQ ID NO: 114498 - RNA, 64 nt, Human
acuugacuucauguuaaaaacccucaacaaaccaggcgucgaaggaacauaccucaaaauaaua

SEQ ID NO: 114499 - RNA, 64 nt, Human
acugaggcuggccgagccacacugucuccccaggggcgucgaccuggcccagcuggguccccag

SEQ ID NO: 114500 - RNA, 64 nt, Human
uuaaggcuuucuacaaaaccaaauucagaauccaggcgucgaccugguggggcccggggccaag

SEQ ID NO: 114501 - RNA, 64 nt, Human
gaggguuuagaagaaacgcaggaacauucuggguggcgucgaaggagccuuucccgaucaucau

SEQ ID NO: 114502 - RNA, 64 nt, Human
ugccccggacgacugcgcugggcaccgcaugucccgggccgagugaggucgggccuggggagcu

SEQ ID NO: 114503 - RNA, 64 nt, Human
cgucaccaccaccggccaccugaguguccgugagcgggccgaggcgcucaucagguccagccug

SEQ ID NO: 114504 - RNA, 64 nt, Human
ugggccuggggccguguccaaggugccaaugaugcgggccgacagagcgggccgcacugucugu

SEQ ID NO: 114505 - RNA, 64 nt, Human
gacauugaaggacugcagaaauguaugggugcaccgggccgagggaaggguggcugagugagag

SEQ ID NO: 114506 - RNA, 64 nt, Human
acccaacaguccaggacagcugcauggcacccggcgggccgagcaugccauggguccgcucugc

SEQ ID NO: 114507 - RNA, 64 nt, Human
gacgcugcugccgugggccugagaccaaggcccccgggccgacggagccgggaaagaagagccg

SEQ ID NO: 114508 - RNA, 64 nt, Human
cagaggccgaaggugccucagacuccgcccuccucgggccgaggcccagcgggcagaugggcgg

SEQ ID NO: 114509 - RNA, 64 nt, Human
cgguuccccuuggccgccaguuccguucuccucacgggccgaacggaacaagggguccagcuug

SEQ ID NO: 114510 - RNA, 54 nt, Human
ucccguuccgcuggagcugagccacgggccgacccagccacaaguacuggagua

SEQ ID NO: 114511 - RNA, 64 nt, Human
uuccugcccugaggagagaggggucagauugcagcgggccgagugcccucuccguccccucucc

SEQ ID NO: 114512 - RNA, 64 nt, Human
aagcccaagugguacgugccucacucagaacugacgggccgaguucuaucuaggugugucuucc

SEQ ID NO: 114513 - RNA, 64 nt, Human
ccuauagguuauuuuguagagcugaguguuaauacgggccgagaaauaaaaguaucuucugcuc

SEQ ID NO: 114514 - RNA, 64 nt, Human
gcuggagcuggggugggaagcccuguacgagcagcgggccgagccacgcagcggcuucgaggag

SEQ ID NO: 114515 - RNA, 64 nt, Human
acgccuguaaucccaacacuuugggaggccgaggcgggccgaucacgaggucaggagaucaagg

SEQ ID NO: 114516 - RNA, 64 nt, Human
agcaugcggcuucucugccauuagcagcccugggcgggccgaccacacucgaggcugcggugcu

SEQ ID NO: 114517 - RNA, 64 nt, Human
agucucaagggcuagcaucccugaggagccaggccgggccgaauccccucccugucaaagcugu

SEQ ID NO: 114518 - RNA, 64 nt, Human
uaggggcacuggggaacgucuugggauccgaccccgggccgaccgcaccguacccgcauccucu

SEQ ID NO: 114519 - RNA, 64 nt, Human
ucaauccgcagacccucugugaagccaggccggccgggccgagccagcagccccucucccuaga

SEQ ID NO: 114520 - RNA, 64 nt, Human
ccagcgagugcugagaccccauuuucugucgaggcgggccgagucuucccuuauccccagacgc

SEQ ID NO: 114521 - RNA, 64 nt, Human
caauuaacguggcagucccggccguccugagagucgggccgagccccguguguuucugaagacu

SEQ ID NO: 114522 - RNA, 64 nt, Human
aagcacggccagcuagcacggccagugccaggaccgggccgagggaggccagaccaagggaggc

SEQ ID NO: 114523 - RNA, 64 nt, Human
cugcuggcaucuggagaacaccccugugccugggacaggggaggacccuucuuuuggacagccc

SEQ ID NO: 114524 - RNA, 64 nt, Human
aaaaaagggcagagacuugacacuccagucuuagacaggggacaauuucuuuguaguuguucug

SEQ ID NO: 114525 - RNA, 64 nt, Human
uaagguuuucuaguuuugagagugugcacuucacacaggggaaugggguuacuucugucugauc

SEQ ID NO: 114526 - RNA, 64 nt, Human
ugaaacuuucuaaaauauucuaucuggaauagggacaggggaucuuuuauuuauaaucucauca

SEQ ID NO: 114527 - RNA, 64 nt, Human
uaaaucagaucacccuccauguuguuccugacccacaggggaagcuguccucaguuguagccgu

SEQ ID NO: 114528 - RNA, 64 nt, Human
cccgacccccuccacccagcaguagacacagugcacaggggagaagagggguggcgcagaaggg

SEQ ID NO: 114529 - RNA, 64 nt, Human
ucuuugggucuacugagcagugggugcugaggugacaggggaggaaccaguuguucuguagccu

SEQ ID NO: 114530 - RNA, 64 nt, Human
accccagcugucuugucuccacucugugaaacccacaggggaugugauaaacagggcuauuagg

SEQ ID NO: 114531 - RNA, 64 nt, Human
ucaagaauuuauacuuauuuuuuccuuaaaagccacaggggacaguuaaauaucuuaaaauauc

SEQ ID NO: 114532 - RNA, 64 nt, Human
auuagcggguauauguaauauauaugugggaaauacaggggaaugagcaaaucucaaagagcug

SEQ ID NO: 114533 - RNA, 64 nt, Human
cuggggcuacauuuggcuucuguacuggcugaggacaggggagggagugaaguugguuuggggu

SEQ ID NO: 114534 - RNA, 64 nt, Human
ccggccuggcuugaaguccgccaugacccugggcacaggggaagcccagccgugggcuuaggag

SEQ ID NO: 114535 - RNA, 64 nt, Human
cgugucacauggugagagagggagcaagagacagacaggggaggaaauucacacacugauggug

SEQ ID NO: 114536 - RNA, 64 nt, Human
caagucugggggcagcagcaggguccuugagagaacaggggagcaagccugccccaguacccaa

SEQ ID NO: 114537 - RNA, 64 nt, Human
gccgugauggcgccacugcacuucagccuuggagacaggggagacccuaugucaaaaaagaaau

SEQ ID NO: 114538 - RNA, 64 nt, Human
gccccuguucuggcagaguugaagacagagcuacacaggggaaaagaggaguuugggguauggg

SEQ ID NO: 114539 - RNA, 64 nt, Human
ccguggugacccuugccucuggggaaggguuagcacaggggagguucuagcuggaggagggguc

SEQ ID NO: 114540 - RNA, 64 nt, Human
uuguaauucuacaagauaugccaugggccuuuucacaggggacacaggcuucuuaaaacaaccc

SEQ ID NO: 114541 - RNA, 64 nt, Human
gaagcccuagacacuccccgcgucucccccaugcacaggggaaggauguugacauagcacuggg

SEQ ID NO: 114542 - RNA, 64 nt, Human
auuacaauaggcacagagaagaaugcaacagggcacaggggaagagaugcuaaauauaccaaga

SEQ ID NO: 114543 - RNA, 64 nt, Human
ccuauagucgagugccugcuuaggugcugaggucacaggggagaugguggaaucuucccuguuu

SEQ ID NO: 114544 - RNA, 64 nt, Human
cuguugcagcuaugaugcuaggugguuucuaagcacaggggacaccccacacccccugccugaa

SEQ ID NO: 114545 - RNA, 64 nt, Human
ggggcgggggggaggaagaggcugcacugcagccacaggggauucuuaggauuuuucuacauuc

SEQ ID NO: 114546 - RNA, 64 nt, Human
uaggaauugaaaagaaagcaugaccaacccaauuacaggggauaaauguaagcuuguuaaagua

SEQ ID NO: 114547 - RNA, 64 nt, Human
cuuguggaaugcugccuuuauuauauuugaauugacaggggaacuugguuuaggguuaagacgu

SEQ ID NO: 114548 - RNA, 64 nt, Human
auuauugccacccugcacaucaaguauccuaaggacaggggauaucaagaugccagcacaaaaa

SEQ ID NO: 114549 - RNA, 64 nt, Human
uuugcuaaagcaaaucaugauaugaacaaaaauuacaggggaccuguuuaagagaacaaaaugu

SEQ ID NO: 114550 - RNA, 64 nt, Human
ugauuucuuuuuccucuuccgcuaguugugaaagacaggggaaggguguucuuucucucugccc

SEQ ID NO: 114551 - RNA, 64 nt, Human
uggagacugcuuuuauccagaaccuguuaagagaacaggggauuuaaauacaaaggaauaugaa

SEQ ID NO: 114552 - RNA, 64 nt, Human
aguacagugauccaaggcaggcaaggcagccaggacaggggagcccgaccccagauaaugaucc

SEQ ID NO: 114553 - RNA, 64 nt, Human
auuuuaaaguuuaaagaagaguuuugccacuuaaacaggggagcuuugucuggaaaauacacug

SEQ ID NO: 114554 - RNA, 64 nt, Human
caugucucccaucagaaagauucauuggcaugccacaggggauucuccuccuucauccuguaaa

SEQ ID NO: 114555 - RNA, 64 nt, Human
aagcgagucgcaggaggaagggagaugcagccgcacaggggaugauuacccuccuaggaccgcg

SEQ ID NO: 114556 - RNA, 64 nt, Human
cuccaccacccaacccaaaccaugagaauuugcaacaggggaggaaaaaagaaccaaaacuucc

SEQ ID NO: 114557 - RNA, 64 nt, Human
augugugugcguguuugugugcguguuuaccuccacaggggacacucuacacucaguguaagau

SEQ ID NO: 114558 - RNA, 64 nt, Human
ucaguuucccucccuucucccuccauccgcagccacaggggaacucgucucuuacauacucuca

SEQ ID NO: 114559 - RNA, 64 nt, Human
uauguauuuauugucauuacugccuuuggaagaaacaggggaucaaaguuccuguucaccuuau

SEQ ID NO: 114560 - RNA, 64 nt, Human
uauaauguggggugaaaugggaguagggggguggacaggggagaaacgaaaaccacaaaaagaa

SEQ ID NO: 114561 - RNA, 64 nt, Human
cacacagacugauguggcuaccuucucagaauuaacaggggaugucaauccuuugcauuugaau

SEQ ID NO: 114562 - RNA, 64 nt, Human
uuguaauccagugcccuacaaaggcuagaacacuacaggggaugaauucuucaaauaggagccg

SEQ ID NO: 114563 - RNA, 64 nt, Human
cuuauauucuauagaaguucgcucaaaauacucaacaggggaauaggcagcggacagucagaau

SEQ ID NO: 114564 - RNA, 64 nt, Human
aaugcaggguggcucuggggggcaaguaggugguacaggggauuggaaacaugcuccgcgccuc

SEQ ID NO: 114565 - RNA, 64 nt, Human
uggaggggauuuguaaaggacacucaguccuugaacaggggaauguggccucaagugcacagac

SEQ ID NO: 114566 - RNA, 64 nt, Human
aaaaauaaugaugggcagaagggggggaauagccacaggggacaaaccuuaaggcauuauaagu

SEQ ID NO: 114567 - RNA, 64 nt, Human
ggaucuugaggccugucacaugggcagcaugugcacaggggacagaguauuccucuagcacacg

SEQ ID NO: 114568 - RNA, 64 nt, Human
ccgacuuccacugggcugacagacuuugcugaccacaggggaacgauguucuuuucuuucuuca

SEQ ID NO: 114569 - RNA, 64 nt, Human
cacugaggaauacaagccaagcugaugaggcaguacaggggagaggcuggaaaacauauuaaga

SEQ ID NO: 114570 - RNA, 64 nt, Human
ggagcggguuugggggagucuggagagagacuggacaggggagugcuggaaccgcggaguuugg

SEQ ID NO: 114571 - RNA, 64 nt, Human
cgaggaagccguggggcagccucuucacauggggacaggggauggagcaugaggcaagggaagg

SEQ ID NO: 114572 - RNA, 64 nt, Human
cucacuggcccccacuuuguuucuuggguaauucacaggggaauucccaguacugucauggagc

SEQ ID NO: 114573 - RNA, 64 nt, Human
agcuauaauagaguauauacagugcugugggaauacaggggaagaagcaauuaaaucugcuaga

SEQ ID NO: 114574 - RNA, 64 nt, Human
cucuaguuuacuugugugugcauacaucucauccacaggggaagauaaagauggucacacaaac

SEQ ID NO: 114575 - RNA, 64 nt, Human
auuaaauggacccaugauacucuucuucacaguaacaggggaaaaguucaagaauacagacuug

SEQ ID NO: 114576 - RNA, 64 nt, Human
aauucuaaccagagcaagcuuuuuuauuuuuuauacaggggaauauuuuauucaagguaaaauu

SEQ ID NO: 114577 - RNA, 64 nt, Human
uaauuguuuuguuuucaauauucuuggggauuagacaggggaagguauuuuauuacugcauaau

SEQ ID NO: 114578 - RNA, 64 nt, Human
cggggaagacagcaagauuuauuggaagauacuuacaggggaaauuaauauuuugacuauuuuu

SEQ ID NO: 114579 - RNA, 64 nt, Human
aaacuuauuuuuucuccccaaaagaaucagcagcacaggggaacuaugucacaguuuaccucuu

SEQ ID NO: 114580 - RNA, 64 nt, Human
ucacaccuggaagaaacaaaguaggaaaaagugaacaggggaugucaaaucgauucuugaauuc

SEQ ID NO: 114581 - RNA, 64 nt, Human
cuccagggucacccuggccagcucuugugcugggacaggggauuacaccaucucuguucaaaga

SEQ ID NO: 114582 - RNA, 64 nt, Human
cugcuccccuuuggcagggguccuguaggucaugacaggggaggcaaggguauugagagacucg

SEQ ID NO: 114583 - RNA, 64 nt, Human
agccauccauccaugccauaccacuugucagggcacaggggacuggcugggcccccagggcugc

SEQ ID NO: 114584 - RNA, 64 nt, Human
ucuacuaaaagauacagcaguuacccccuuauccacaggggauacaguggauaucuaaaaccag

SEQ ID NO: 114585 - RNA, 64 nt, Human
ucuguucuguguugauuugacugccaugagaaacacaggggaaaccugaugaggagaaggauaa

SEQ ID NO: 114586 - RNA, 64 nt, Human
gucccuccauccuugggcuucccgggccccugugacaggggaaagggcucucuuacaccgcacu

SEQ ID NO: 114587 - RNA, 64 nt, Human
uaacgcuaaagauuuuaccaugccuggaaauuuuacaggggaagaaaacacgcuaguuauuuaa

SEQ ID NO: 114588 - RNA, 64 nt, Human
cggggggccugauguguguggguuguugaggggaacaggggacauagcugugcuaugagguuuc

SEQ ID NO: 114589 - RNA, 64 nt, Human
ccgggggcucccugugcccgcgugaggcgagagaacaggggacuugagucucgaacagcgguug

SEQ ID NO: 114590 - RNA, 64 nt, Human
acuaggaaagauccaaaacacagagcaggaguccacaggggaaccugcccugccucaguaaaaa

SEQ ID NO: 114591 - RNA, 64 nt, Human
cauuagccgcugaggagagccaccgaaggccccaacaggggaugcucaucacuggagacugcga

SEQ ID NO: 114592 - RNA, 64 nt, Human
gccaaucuuuagacaaauggccauggggcagaggacaggggagcugagguugguucagaggcca

SEQ ID NO: 114593 - RNA, 64 nt, Human
guagccugcugguuuuaucugagugaaauacuguacaggggaauaaaagagaucuuauuuuuuu

SEQ ID NO: 114594 - RNA, 64 nt, Human
gcugaugucaaccuaacccccucaggggcagggaacaggggagggcuccacaagcgugucuggc

SEQ ID NO: 114595 - RNA, 64 nt, Human
uucucuuuagcucuauggcauuucacucaaguggacaggggaaaaaguaauugccaugggcucc

SEQ ID NO: 114596 - RNA, 64 nt, Human
ucacugguugugauuuggucacuuuaguguugggacaggggaaagggucugugcgugggcaaag

SEQ ID NO: 114597 - RNA, 64 nt, Human
gggaaggggccugggcugugaggacagggcccccacaggggaugguuucacgaguguagucccg

SEQ ID NO: 114598 - RNA, 64 nt, Human
ggaagaagauacgugggccauaagcaucuucuggacaggggaacugcuuucagagagaaaaccu

SEQ ID NO: 114599 - RNA, 64 nt, Human
uuuugggcagggcaauccuggggcuaaaugagguacaggggaauggacucuccccuacugcacc

SEQ ID NO: 114600 - RNA, 64 nt, Human
ccaauccauuugccccgcaacccuggcugcuccgacaggggagacuugucucccuuguuccccu

SEQ ID NO: 114601 - RNA, 64 nt, Human
uaucugaccugccagcaccuucuuuacugcaaagacaggggacuugccugaauggcauccgcca

SEQ ID NO: 114602 - RNA, 64 nt, Human
agcuucuacaccugggcuccaagucugaguucccacaggggacccagcagccuccaggaagucc

SEQ ID NO: 114603 - RNA, 64 nt, Human
caccacgauggccuggucccuccaacaugcauggacaggggacagugggacuaacuucaguacc

SEQ ID NO: 114604 - RNA, 64 nt, Human
gaguggaguauggaaagggaaacauaguaacuuuacaggggagaaaaaugacaaaugacgucuu

SEQ ID NO: 114605 - RNA, 64 nt, Human
cuggugugggaaacacuuuauguagggugggaggacaggggaguuaaauggcugggcaggugcc

SEQ ID NO: 114606 - RNA, 64 nt, Human
acugcagggaaaaggauauaggaauacucaucuuacaggggaauuugugaccagaagauguagu

SEQ ID NO: 114607 - RNA, 64 nt, Human
aacaguuuagguaccuaccacuucuucacaugacacaggggaauccugauuagucaaaauaaua

SEQ ID NO: 114608 - RNA, 64 nt, Human
uuuuuguaugaugcacugagauguguacuuucuaacaggggauugguaccuaagaaauguggua

SEQ ID NO: 114609 - RNA, 64 nt, Human
caugcaaggaaauaacagauacgggcagcuaggaacaggggacaaaauggaccgaggggaaccc

SEQ ID NO: 114610 - RNA, 64 nt, Human
guacaauuucaacuacagugauucauguagagagacaggggaguugucaacuugggcuacugaa

SEQ ID NO: 114611 - RNA, 64 nt, Human
ucccuuaccugggaaagggcuguuauaaucuuucacaggggacaggaugguucccuugaugaag

SEQ ID NO: 114612 - RNA, 64 nt, Human
uaguauuucuaugaaauauuauguuaaaacugggacaggggagaaccuagggugauauuaacca

SEQ ID NO: 114613 - RNA, 64 nt, Human
cuagcaguuuggcccugcuggccuuagcagggagacaggggagcaaagaacgccaagccggagg

SEQ ID NO: 114614 - RNA, 64 nt, Human
uaaggagaauggcccaguccucucccaaguccacacaggggaggugauagcauugcuuucgugu

SEQ ID NO: 114615 - RNA, 64 nt, Human
guaucgcugccuugccaugucuuguucagaagacacaggggagcaggguuagcucacgugucuu

SEQ ID NO: 114616 - RNA, 64 nt, Human
gacuuucuccuguccucuuccaguuuagaauaagacaggggagaaaaaggcuuuucgagugugg

SEQ ID NO: 114617 - RNA, 64 nt, Human
ucacucuggccucaucaccaaggugacagaggacacaggggagggggaaaacccacacacacuc

SEQ ID NO: 114618 - RNA, 64 nt, Human
ccauuuguuacuauugugcacaaaagcccuguucacaggggaaugguguaaacauuuauacugu

SEQ ID NO: 114619 - RNA, 64 nt, Human
ugucucuguuuuauauagaaacacuuucucacuuacaggggagaaggaaaugcagggcacauga

SEQ ID NO: 114620 - RNA, 64 nt, Human
cucucuuuuaguucuggaaagcuggcuugauuucacaggggaguuggagccaccagauccucuu

SEQ ID NO: 114621 - RNA, 64 nt, Human
uggugugugggugauugggcagggccugagcuggacaggggagcuccuaguaggggaggggagg

SEQ ID NO: 114622 - RNA, 64 nt, Human
aaacuaaaaagaaaaaaagaagccccuucacucuacaggggacaggagaccauggauuggaccc

SEQ ID NO: 114623 - RNA, 64 nt, Human
aucaguuaaauuaguuuuugauacuugaugugugacaggggaaacuguguaagcuguacuuguu

SEQ ID NO: 114624 - RNA, 64 nt, Human
ggacaauuggagcacaggaauguuaacauguaugacaggggaccaguagggugguuucccucuc

SEQ ID NO: 114625 - RNA, 64 nt, Human
ucaugagagaaauuuucuguaagcuugcuguuuuacaggggauuuaucaauaauugauuuugag

SEQ ID NO: 114626 - RNA, 64 nt, Human
ucccggcccccggccaaggacccaggcgcugcauacaggggaggggcgcaccccacagcugggg

SEQ ID NO: 114627 - RNA, 64 nt, Human
aguauuucucaggaagagcuauggcccagaaacaacaggggaaacuagaguucggucugacagu

SEQ ID NO: 114628 - RNA, 64 nt, Human
cuguuuuguuuaagcucuaacucaccccuggaauacaggggaaugaugacaaccagcccagcca

SEQ ID NO: 114629 - RNA, 64 nt, Human
uccccuggguccguaacauuuuuuccgaggaugaacaggggacaucuuuagguuucucaacucu

SEQ ID NO: 114630 - RNA, 64 nt, Human
cggaagggauucuggcuauugggggagcccagagacaggggaaggcagccuguccaucugugca

SEQ ID NO: 114631 - RNA, 64 nt, Human
ucaagaaagcauuugaucugacccagugccagacacaggggauuuaaggcauguucacacuugc

SEQ ID NO: 114632 - RNA, 64 nt, Human
cuuuaaaaaucuacacucuugcauucuuaggcauacaggggaaauguugaaaaggaagguggaa

SEQ ID NO: 114633 - RNA, 64 nt, Human
agcccaucaaccagcauuggucccauagggaagcacaggggacucacccucuuucauaucccuu

SEQ ID NO: 114634 - RNA, 64 nt, Human
cuccggguguucgacaccagacguggggauuucaacaggggaggagccaaggaauucuguggcu

SEQ ID NO: 114635 - RNA, 64 nt, Human
uuuccuucaguuaguuuaauggugaagaugauuaacaggggaaaugcuugaaguaaaugauugu

SEQ ID NO: 114636 - RNA, 64 nt, Human
accuggguccuuuucagaagugagcuuugcugcuacaggggaagguggccucuguggagcccca

SEQ ID NO: 114637 - RNA, 64 nt, Human
cagcugaggcaggugaagacuucauaagcucaucacaggggagggaauuaggagcagggcagca

SEQ ID NO: 114638 - RNA, 64 nt, Human
uuuaaaaguaugcuauaaacuaugcuacucucauacaggggacccguauuuuaaaaucuccaga

SEQ ID NO: 114639 - RNA, 64 nt, Human
gcugcaaaggguacagggauugcaccagggcagaacaggggaggguguucaaggaagaguggcu

SEQ ID NO: 114640 - RNA, 64 nt, Human
aacaaaaaaagcuaaccuucuauuagaaaaggggacaggggaaugaguaaacuucuuuuauugc

SEQ ID NO: 114641 - RNA, 64 nt, Human
cccaugucucuugcugagauuauggaucugugccacaggggauuuaugcugcuuuacauugacu

SEQ ID NO: 114642 - RNA, 64 nt, Human
aaaaaaaaaaaaggaagaaagagaagauagagacacaggggagaaugccacaugaagcuggagg

SEQ ID NO: 114643 - RNA, 64 nt, Human
agaacuccugaccccagauucaacuuugcaaacaacaggggaaaaaaauggggaaaagaaaaac

SEQ ID NO: 114644 - RNA, 64 nt, Human
gaaaugucccaucaucgugggaggggagcagggcacaggggauggugugcauucagagcauugg

SEQ ID NO: 114645 - RNA, 64 nt, Human
caggaggagggagguggguguuggagccccugagacaggggauacagaaacuagggcuaaagga

SEQ ID NO: 114646 - RNA, 64 nt, Human
ugcaggagcagcuuuuuaaaacaagauaaaacucacaggggaauguacuuuuuuaaaaaaaaau

SEQ ID NO: 114647 - RNA, 64 nt, Human
gguccucauuuuuacagaguauacaggcaaagugacaggggaaaaggaauuagucuaagaguaa

SEQ ID NO: 114648 - RNA, 64 nt, Human
gucugugucuacagcccuuccucugcauguggccacaggggaccuuuuuuuguuucuccugaca

SEQ ID NO: 114649 - RNA, 64 nt, Human
ccuccucacucucuaccaacccuaaacccugaggacaggggaggaacccacagcuuccuucucc

SEQ ID NO: 114650 - RNA, 64 nt, Human
cuggccuuggaauuggacuugagauggggagcagacaggggaggauggggaaugugggacacgg

SEQ ID NO: 114651 - RNA, 64 nt, Human
uuuugcagaucaaauaaaucagaguuuacaaugcacaggggaucauuuauuuagcauucccuug

SEQ ID NO: 114652 - RNA, 64 nt, Human
gaggcccccgccagccccaccuugaaagcagcauacaggggaaggcuuggaccaagcugggcga

SEQ ID NO: 114653 - RNA, 64 nt, Human
agccaaacgggagcuuuuggugagaagguguuggacaggggauuggcgccccccuuugguuugg

SEQ ID NO: 114654 - RNA, 64 nt, Human
gggcauucucaauacuugaauauggaacauaugcacaggggaaggaaauaacauugcacuuuau

SEQ ID NO: 114655 - RNA, 64 nt, Human
uuauauaagaaggacaauuaaugcugauuuggguacaggggaauuaugugugugaaugucaucu

SEQ ID NO: 114656 - RNA, 64 nt, Human
cagggcugccuguggucccaagguucugggagaaacaggggacccccucaccuccugggcagug

SEQ ID NO: 114657 - RNA, 64 nt, Human
uaagccuauggaaacauagcaagacacugucucuacaggggaaaaaaaaaaaagaaacugagcc

SEQ ID NO: 114658 - RNA, 64 nt, Human
auagacucuuccucccuccucuuucacauauagcacaggggaagguaaaauggaagggcugcua

SEQ ID NO: 114659 - RNA, 64 nt, Human
acagucccagguuuagugaaaaacugcuguaaacacaggggacacagcuuaacaaugcaacuuu

SEQ ID NO: 114660 - RNA, 64 nt, Human
uaucuccaagguuaaucaggaaaaauagcuuuugacaggggaaaaaacucaauaacuagcuauu

SEQ ID NO: 114661 - RNA, 58 nt, Human
aaaucugggacgugcagugauggggauuacaggggaggggucuagcuccuuuuucucu

SEQ ID NO: 114662 - RNA, 64 nt, Human
uggcucucuuuaucucccuugccuuuauggugaaacaggggagaugugcaccuuucaggcacag

SEQ ID NO: 114663 - RNA, 64 nt, Human
uaccaucgccauuuuugcuccaacugaggaaacuacaggggaaguggggauuggauccaguuag

SEQ ID NO: 114664 - RNA, 64 nt, Human
gauacgcagccauuccauauucaucuccaacuacacaggggaacggagcagauagagcugcgac

SEQ ID NO: 114665 - RNA, 64 nt, Human
aaauaauugugcugcuacauuauacuggaaauuaacaggggaaaagggaagagcucuuggcucc

SEQ ID NO: 114666 - RNA, 64 nt, Human
aucaucccuagaaagagggaaggagcaggagacgacaggggaggggcugguuuguucugugcuu

SEQ ID NO: 114667 - RNA, 64 nt, Human
ggguguuugcuucagauuccagucagagaaggaaacaggggaucggaauuaugccaucggcuau

SEQ ID NO: 114668 - RNA, 64 nt, Human
cacucauuugauugguuugagcccagaacagccuacaggggaaaaacaagcuggauaaccaccc

SEQ ID NO: 114669 - RNA, 64 nt, Human
ggcaaguuccgcagauagcuggguuagaagagagacaggggagugagcuagucaaaugugaaaa

SEQ ID NO: 114670 - RNA, 64 nt, Human
ggccccacccugcacugguccaaggucggaggagacaggggaugaggaaggccucaggccacug

SEQ ID NO: 114671 - RNA, 64 nt, Human
uugguaugagguauuaauuuagcuuaacuaaauuacaggggacucagaggccgugcuccugacc

SEQ ID NO: 114672 - RNA, 64 nt, Human
caucauggaacuccaggacggcuacagcacagagacaggggagaagggcgcccagcugucaggu

SEQ ID NO: 114673 - RNA, 60 nt, Human
caggagacaagcuucuuugaugagaaccgcacaggggaccucaucucccgccugaccucg

SEQ ID NO: 114674 - RNA, 64 nt, Human
uuacauauucccucgcaaaccuggagugcagaccacaggggaagcuaucuuugcccucccaacu

SEQ ID NO: 114675 - RNA, 64 nt, Human
uuuggaucacuggacuuucaguggacuaccuaaaacaggggacagcuuuuggaagaugacaucu

SEQ ID NO: 114676 - RNA, 64 nt, Human
uuccaucuuuuagggaacggggaguggauccaggacaggggagguuguaaccccugagaaauga

SEQ ID NO: 114677 - RNA, 64 nt, Human
cugauccuuguggcacacaacuguggucccagcuacaggggaggcugagacgcaaggaucacuu

SEQ ID NO: 114678 - RNA, 64 nt, Human
uuuacuuguucuuauuauucaagagucauuuauuacaggggauaaauguuggguagcaagaacu

SEQ ID NO: 114679 - RNA, 64 nt, Human
uugcaagugguaaauuggauuugcgguggaagagacaggggagggaaacgguugggguuagauc

SEQ ID NO: 114680 - RNA, 64 nt, Human
agcaaugaagcuaugcaaacaauaggagggugugacaggggaaccguagacuuuauauauguaa

SEQ ID NO: 114681 - RNA, 64 nt, Human
ccuacccucucccuccuaacccucuccuugccugacaggggagccccuguggccuggacucuag

SEQ ID NO: 114682 - RNA, 54 nt, Human
uuggcucuagugaugcauagggaaacaggggacaugggcacuccugugaacagu

SEQ ID NO: 114683 - RNA, 64 nt, Human
gacaccccucuucccucaggaggcccgugggcagacaggggagccggggcuuugcccugcugcu

SEQ ID NO: 114684 - RNA, 64 nt, Human
gagggaaagaaaggcuaaccauccaaacagggauacaggggaggcggugggggguggugggggg

SEQ ID NO: 114685 - RNA, 64 nt, Human
aauaccacugcaaagugauggaaaaggguggagaacaggggaguagccaggcuggauggcucaa

SEQ ID NO: 114686 - RNA, 64 nt, Human
caguucacauggucuggguaaacaagucacuggcacaggggaaagccagaagguugcuuguguc

SEQ ID NO: 114687 - RNA, 64 nt, Human
uuuagucuaucugcagagguauucaguuccuggcacaggggacuaggggcauguagaguauaug

SEQ ID NO: 114688 - RNA, 64 nt, Human
cguguacagcggaguacgaaaaggaacguuguccacaggggauuuauggauacaacagcaaaca

SEQ ID NO: 114689 - RNA, 64 nt, Human
cggaggcagcagaucaggaguagggacaggaaggacaggggaugccugaccugacagguggcuu

SEQ ID NO: 114690 - RNA, 64 nt, Human
gcacaugccugccagcguugugucaugccuguccacaggggauucguggggcucacuucaucag

SEQ ID NO: 114691 - RNA, 64 nt, Human
cagcugacacugacuaaggaacugcagcauuugcacaggggaggggggugcccuccuuccuaga

SEQ ID NO: 114692 - RNA, 64 nt, Human
uaaggacauggaucgggugcccccagacgugugcacaggggacccucugccccacucugggcuu

SEQ ID NO: 114693 - RNA, 64 nt, Human
uuggcaucagggacaguuuuuccacggaugggugacaggggaugguuuugggaugauucaagug

SEQ ID NO: 114694 - RNA, 64 nt, Human
cagguguccucagcucaccugucccagacugaggacaggggaguuccugcauuuccugccaggg

SEQ ID NO: 114695 - RNA, 64 nt, Human
gaccccaguucccagccugacaagcuuuccacucacaggggagaggcuacugcagaaccugacg

SEQ ID NO: 114696 - RNA, 64 nt, Human
cuggacuccugagaggcaguggccucuugagugaacaggggaggccaguagaugccccagaucc

SEQ ID NO: 114697 - RNA, 64 nt, Human
ggggcacucccuugguuggauuuucuaugacagcacaggggacagguggcacaccaugagaggu

SEQ ID NO: 114698 - RNA, 64 nt, Human
uccucagcccaugccgcccacuaggccucagaccacaggggaggggcucuggcagaaauagucg

SEQ ID NO: 114699 - RNA, 64 nt, Human
ccagguauaguggcaggaaccuguaaucccagcuacaggggaggcugaggcaggagaaucgcuu

SEQ ID NO: 114700 - RNA, 64 nt, Human
uugccugcugccuagacaaagccgauucauuaagacaggggaauugcaauagagaaagaguaau

SEQ ID NO: 114701 - RNA, 64 nt, Human
acgcccggccagccgcucgggcgcagcacaagggacaggggaccaaggucagggccccccugcc

SEQ ID NO: 114702 - RNA, 64 nt, Human
gggugcuggguccucaggguggggggucauagccacaggggagggcaguucccaggaagguaac

SEQ ID NO: 114703 - RNA, 64 nt, Human
uuugaauauuauguaacuuauuuuuuuaauguggacaggggaccuugaaaaucacuaaguuauu

SEQ ID NO: 114704 - RNA, 64 nt, Human
aauccgccacuuucaugacuagaguugaggaagaacaggggauaguucuguaaguguucggggg

SEQ ID NO: 114705 - RNA, 64 nt, Human
cggaagucaguccuccucauucaccagaggacacacaggggagacgccccagucugcaggaagg

SEQ ID NO: 114706 - RNA, 64 nt, Human
gaagucagaccuccucagucaccagaggacacacacaggggagaagccuuaugucugcagagag

SEQ ID NO: 114707 - RNA, 64 nt, Human
cggaguauuucugucccucgugaagucacgucacacaggggagaggcgaggucgauggaacugg

SEQ ID NO: 114708 - RNA, 64 nt, Human
gguuuagauaaaggaaacauauaacuauugaguuacaggggauuuuauuaauuauaaaaugcaa

SEQ ID NO: 114709 - RNA, 64 nt, Human
cguucucugaaaacagugacucugaaauguugggacaggggaaggggugggaaacaugaacaug

SEQ ID NO: 114710 - RNA, 64 nt, Human
uagacacaaggaccugaagugacaugacggcgggacaggggaaaugugacuuucuaauuaggca

SEQ ID NO: 114711 - RNA, 64 nt, Human
agaguuguuuuucagcugaauucucauggugaaaacaggggaaaggacaaaggaaaccuuaagu

SEQ ID NO: 114712 - RNA, 64 nt, Human
ccuccacccauccaguggacucuggggcgcggccacaggggacgggaugaggagcgggaggguu

SEQ ID NO: 114713 - RNA, 64 nt, Human
gagccaggagccuccugacccugugaugccugacacaggggacacugaaccuuguugaugccag

SEQ ID NO: 114714 - RNA, 64 nt, Human
acagagcugucagcaggggccgcuguggcggugcacaggggaggcagguccuuggcgagguagc

SEQ ID NO: 114715 - RNA, 64 nt, Human
ccccaccuguguucagggguccugugauacugugacaggggacugugucugcagugccggcuac

SEQ ID NO: 114716 - RNA, 64 nt, Human
ccagaguggaagcuccuaguagaggcugaaggccacaggggaggccucagccaggggcaagugc

SEQ ID NO: 114717 - RNA, 64 nt, Human
cuuguuuacagaagagagggguaaaccuaugaaaacaggggaagccuuauuaggcugaaacuag

SEQ ID NO: 114718 - RNA, 64 nt, Human
cccucacuugccgcgucgcccucccaggcucucaacaggggagagugugguguuuccugcaggc

SEQ ID NO: 114719 - RNA, 64 nt, Human
ugacccgcuuggaucagugaccauuugcuggcagacaggggagagcagcuuccagccuggguca

SEQ ID NO: 114720 - RNA, 64 nt, Human
ggaucuguucccuauuucagugccuuccuaggacacaggggacuccuugacgcuccccaggcuu

SEQ ID NO: 114721 - RNA, 64 nt, Human
guucauuaggggauuccuuccucccccucaucucacaggggaagggagaggaaagaguuguucu

SEQ ID NO: 114722 - RNA, 64 nt, Human
ggacaucuuucaccucaggcuccugguagagaagacaggggauucuacucugugccuccugacu

SEQ ID NO: 114723 - RNA, 64 nt, Human
uccuucaauuccucagcuuccccucugccuccaaacaggggacacuucgggaaugcugaacuaa

SEQ ID NO: 114724 - RNA, 64 nt, Human
ggcacgggaggggguggggcugggcgugaaggggacaggggacgguagaaaccuaaggaaaaug

SEQ ID NO: 114725 - RNA, 64 nt, Human
uauugcuuuacucuucauucuguggcaccuacccacaggggaaguaagaaguuuguuuugguau

SEQ ID NO: 114726 - RNA, 64 nt, Human
cgcccggcucugcccaccaccacugccaggcugaacaggggacuagugcccaggugacacugca

SEQ ID NO: 114727 - RNA, 64 nt, Human
accaagccagcuggagcgccacagccgcauacauacaggggagcggccguuccauugcacgcuu

SEQ ID NO: 114728 - RNA, 64 nt, Human
gagcuugcuacguguuuauggaacugaaagcucaacaggggagcaauaaaccgagaaaucauga

SEQ ID NO: 114729 - RNA, 64 nt, Human
augggaugcuacaccuugaagcugacagucaucaacaggggagcuaaaguugaagccagcugug

SEQ ID NO: 114730 - RNA, 64 nt, Human
gcaauuccaggcucaguauugugaccgcggagccacaggggaccccacgcacauuccguugccu

SEQ ID NO: 114731 - RNA, 64 nt, Human
uauacacguauauauauaaagagaauuuaauaaaacaggggaaaaccaaggaacacuugaauuu

SEQ ID NO: 114732 - RNA, 64 nt, Human
aaucucaucccucacucuucaugugagaagucacacaggggagaaacccuaugaauguaauaaa

SEQ ID NO: 114733 - RNA, 64 nt, Human
caaucaagcuacaggcacugauaagggaacuagcacaggggauugugccuggagacaugcccau

SEQ ID NO: 114734 - RNA, 64 nt, Human
cugggcuccugaguguugguucuuccagcugugcacaggggauuucaaacguucuacguccuaa

SEQ ID NO: 114735 - RNA, 64 nt, Human
gagcccugcuggcggacuucaaggagaagcccccacaggggauuuugcuccuagaguaaggcuc

SEQ ID NO: 114736 - RNA, 64 nt, Human
gcagugcagggcugcugagucaaccuuuuauuguacaggggaugagggaaagggagaggaugag

SEQ ID NO: 114737 - RNA, 64 nt, Human
gucaugaccuuccuaguuuccugacgcagggaauacaggggagaggguuguccuuccccccagc

SEQ ID NO: 114738 - RNA, 64 nt, Human
aggagugggagggggcuugggaguccagacucugacaggggaugccugggcuuaauccugggug

SEQ ID NO: 114739 - RNA, 64 nt, Human
aucuuacgagaacaaucaucaugcagauucguccacaggggaucugucaguuuggguccuccaa

SEQ ID NO: 114740 - RNA, 64 nt, Human
cccauggcugggaacaugacccagccugaaagauacaggggaucauguuaaaaauagcaguauu

SEQ ID NO: 114741 - RNA, 64 nt, Human
ucuccuuuaagugagcugggcugggaggcuuccuacaggggaagaggccccucuggggagcuga

SEQ ID NO: 114742 - RNA, 64 nt, Human
aaugagccauggcauugggacagggucacuucugacaggggaaguggguccccaggucagcccu

SEQ ID NO: 114743 - RNA, 64 nt, Human
ccuggacuccaugaacggggaggaucugcuucugacaggggaggugagcuggcgcccucuagug

SEQ ID NO: 114744 - RNA, 57 nt, Human
agcucccuccuguuuucugaagcugccacaggggaggagucucuucucagugagggu

SEQ ID NO: 114745 - RNA, 64 nt, Human
acauuuuacauuucaaagaaagguauguugucuaacaggggaccaacagaagguaguauugaca

SEQ ID NO: 114746 - RNA, 64 nt, Human
caagugagccgacuggcgccggcgcguucuggcgacaggggagccaggggccgcggggaagcga

SEQ ID NO: 114747 - RNA, 64 nt, Human
uggguggacaccguccccacuccggacucccagcacaggggaggauaccugagccuguauggcc

SEQ ID NO: 114748 - RNA, 64 nt, Human
uccuucugaagaaauggggcccuguagcugcagcacaggggaagggcccggcacccuuucuggg

SEQ ID NO: 114749 - RNA, 64 nt, Human
aaugcacaggggacacuuacggacacagaaaugcacaggggaggccgagcauaaccagggguga

SEQ ID NO: 114750 - RNA, 64 nt, Human
aggguuuauaguagucuuguggacacagaaaugcacaggggacacuuacggacacagaaaugca

SEQ ID NO: 114751 - RNA, 64 nt, Human
gaggccccagccuggagccaggcacugggugcugacaggggaaccaugaggaggguggcagguc

SEQ ID NO: 114752 - RNA, 64 nt, Human
gauaaggaccaagggcuggcgguguggccagaggacaggggaagcugaaggccccgugcuugag

SEQ ID NO: 114753 - RNA, 64 nt, Human
agcccaaggcaggggaggcucagcauggaaugaaacaggggagugagggacacaaggagguggg

SEQ ID NO: 114754 - RNA, 64 nt, Human
gaggcccaggcagcagccauggcggggugucucuacaggggagaggcgggagccugccacccuc

SEQ ID NO: 114755 - RNA, 64 nt, Human
ccgcaugccuggggccuucgcccccacgugcucgacaggggaacccgcccggacggcaucgcca

SEQ ID NO: 114756 - RNA, 64 nt, Human
cuaacuucuccaaggagcaugucacuccagcagcacaggggacgcaaugggaggcagggacacc

SEQ ID NO: 114757 - RNA, 61 nt, Human
caacccuggccaguugcugaucccaaagauaacaggggaggaaguuucagcugagaagaug

SEQ ID NO: 114758 - RNA, 64 nt, Human
ggacucagcauuuuccagucuuuuucagggguagacaggggagccuggguuaaacuuuaccacu

SEQ ID NO: 114759 - RNA, 64 nt, Human
guucucccaucuguuuauucuuugggcucugggaacaggggacuacuuuggggcuuucuccaga

SEQ ID NO: 114760 - RNA, 64 nt, Human
caauaaaaauuuuagaaaacuauugaaagaaaucacaggggaaacugcacuuagacugacagaa

SEQ ID NO: 114761 - RNA, 64 nt, Human
uauauacauucuaugaucauugcuuuuucucuuuacaggggagaauuucauauuuuaccugagc

SEQ ID NO: 114762 - RNA, 64 nt, Human
cuuacuuucaaagacauaaagcacagaucuccgcacaggggauguguguguuccugauguaauu

SEQ ID NO: 114763 - RNA, 64 nt, Human
cagaguuccuguuaagugaauaacuuuagcuuuuacaggggauuaugaucaaaagugauuuuag

SEQ ID NO: 114764 - RNA, 64 nt, Human
gaaauugaacacuagguggcacucaguuaucuuaacaggggaaguacugauacaauuguugacu

SEQ ID NO: 114765 - RNA, 64 nt, Human
gccuggaucagccacaucaacucaguuguccaccacaggggaauuuugaaugucuuuuguuuuu

SEQ ID NO: 114766 - RNA, 64 nt, Human
guuuagaccuucugguagaagaaauaauauccagacaggggaugauuuggcuucagcaggcugc

SEQ ID NO: 114767 - RNA, 64 nt, Human
aucucggcccuuguccacacucuccaagcacauuacaggggaccugauugcuacacguucagaa

SEQ ID NO: 114768 - RNA, 64 nt, Human
cuucuguugaugcuguauucccauaucaaaagacacaggggacacccagaaacgccacaucccc

SEQ ID NO: 114769 - RNA, 64 nt, Human
uccuaaucacucagagcagucugugacuuaguggacaggggagggggcaaagggggaggagaag

SEQ ID NO: 114770 - RNA, 64 nt, Human
aauuuccugcugaaaauaacacaacaaaaauguaacaggggaaauuauauaccgugacugaaaa

SEQ ID NO: 114771 - RNA, 64 nt, Human
aagaguuccuguuaaaugaauagcuuuagcuuuuacaggggauuaugauuaaaagugauuuagu

SEQ ID NO: 114772 - RNA, 64 nt, Human
uuauaauuuuuuagaaaaaccaccaucgugucacgucgacgaugccaaauuauguuagcgugag

SEQ ID NO: 114773 - RNA, 64 nt, Human
gacugaacuggccaggccacguggagacaccacggucgacgacggcuggagggacguuucagag

SEQ ID NO: 114774 - RNA, 64 nt, Human
uccagggugcccccggcuuucucccagcaauagggucgacgagaccuagaaccgaaccucaucu

SEQ ID NO: 114775 - RNA, 64 nt, Human
ggaagaggaggaggaggaggagcuggaggaggaggucgacgagcugcagacgacaaaugucagc

SEQ ID NO: 114776 - RNA, 64 nt, Human
augcacagaauuuaccucaucucacagagcccacgucgacgagcaccauuuggccagacauuga

SEQ ID NO: 114777 - RNA, 64 nt, Human
ugccaaauccacuuugaggaugagucuuacgacacagauccacccacauguugcucuuaucugg

SEQ ID NO: 114778 - RNA, 64 nt, Human
uuucuccuuaauggcauuuagagacuuucuucugcagauccauggcugcccugggaacuccaaa

SEQ ID NO: 114779 - RNA, 64 nt, Human
gagugagcuaccaggaagaggggcgcugcccccacagauccauccuuuugcuucaucuggaguc

SEQ ID NO: 114780 - RNA, 64 nt, Human
gugcuuaagcccucccccacugugccacccuugugaccuucaggcuugggucaucaagaugcac

SEQ ID NO: 114781 - RNA, 64 nt, Human
auuccauccaggacacuggaaguucuccaggauccagauccauggggacauuaauaguccaagg

SEQ ID NO: 114782 - RNA, 64 nt, Human
ucaccuuggacaaaggaucagcacagcuggccuccagauccacaucaccacucuuccacucgau

SEQ ID NO: 114783 - RNA, 64 nt, Human
gguuuguagcguggugcaccagggccuuguugaacagauccacacugcucuaauaaaguuccca

SEQ ID NO: 114784 - RNA, 64 nt, Human
caugcccuuugcuugccacaccauauccuuuccccagauccaccuguccugacacucuaguccu

SEQ ID NO: 114785 - RNA, 64 nt, Human
cucaugauauaaucacugccugcauacauaugcacagauccaguuagugaguuugucaagcuua

SEQ ID NO: 114786 - RNA, 64 nt, Human
uucuuuaaaagaacauuaaauguaaccauuuugucagauccauguauuuuggagcauaaaaugu

SEQ ID NO: 114787 - RNA, 64 nt, Human
cagagaauccuucaccuuugcugaaaagugagcucagauccagcaccauguuccuccugaccca

SEQ ID NO: 114788 - RNA, 64 nt, Human
uuuagaagcuaauguaggacuguauagguagauccagauccagacuguaagauguuguuuuagg

SEQ ID NO: 114789 - RNA, 64 nt, Human
uuuuacaagagauucuguuugggggaacuuaagucagauccagaaccuuggcugcaagggaguc

SEQ ID NO: 114790 - RNA, 64 nt, Human
gggagacaguuuccuucaugcccaagccugagcucagauccagcuugcaacuaauccuucuauc

SEQ ID NO: 114791 - RNA, 64 nt, Human
aucaguagguuaucuuuaaucuuuacacuacaugcagauccauaguauccuuuguaguguugua

SEQ ID NO: 114792 - RNA, 64 nt, Human
uaacccugcuugucucuguacauagaagccugcacagauccaacccuugcuagguaucauaguu

SEQ ID NO: 114793 - RNA, 64 nt, Human
accaauguaugcuaaccagaugcauuguuugcuucagauccaugguguuaauaccauguauauu

SEQ ID NO: 114794 - RNA, 64 nt, Human
gcuaccuguugaagugauauucauuguugcuguacagauccagagagccuuuuguccccaccuc

SEQ ID NO: 114795 - RNA, 60 nt, Human
augcccggcgucccgucuaaagguguucugcagauccauggaaagcuuccugggaaacgu

SEQ ID NO: 114796 - RNA, 64 nt, Human
aagcaaagauagguaggacagaaaggaagacagccagauccagugauugacuuggcaugaaaau

SEQ ID NO: 114797 - RNA, 64 nt, Human
uuccuguaccugagaacaaccacauaggcaggaccagauccacaucgugcagucgugucauaaa

SEQ ID NO: 114798 - RNA, 64 nt, Human
cuucaggguaguugggaucucaaaagauuugguucagauccaaacaaauacacauucuguguuu

SEQ ID NO: 114799 - RNA, 64 nt, Human
ccaccuccucugagaucccucaccuucuccaaaccagauccaaucaaaccucagcccgaggaaa

SEQ ID NO: 114800 - RNA, 64 nt, Human
auccaacaggcgccaaacucacagagcccuugugcagauccagcauggaggccacccucaggag

SEQ ID NO: 114801 - RNA, 64 nt, Human
gacagggauucaggaguucugacgacacgacucucagauccacgcccccagccuaacagcaaca

SEQ ID NO: 114802 - RNA, 64 nt, Human
uuagaaguccuaagaagcccaaucuguaucaaagcagauccauuuugcaaggaucuuucuuuua

SEQ ID NO: 114803 - RNA, 64 nt, Human
ugaggaagaggagagagaagagauggacagaccucagauccauuaaaguguucucacuucccug

SEQ ID NO: 114804 - RNA, 64 nt, Human
aacuccuagagcaacucugugggguggggaggagcagauccaaguuuugcggggucuaaagcug

SEQ ID NO: 114805 - RNA, 64 nt, Human
aguuauuuuguuuuauauuucuaaauucuuguaucagauccaaagcucuauuguacagcaaauu

SEQ ID NO: 114806 - RNA, 64 nt, Human
aaauaaacuaaacaaaucuaaugauaaaauaugucagauccauguucuaaaaaauuuuuguaau

SEQ ID NO: 114807 - RNA, 64 nt, Human
cucagagacgaaccaaaaccagcugggcugagcucagauccagggggaaaugcuggaagucaau

SEQ ID NO: 114808 - RNA, 64 nt, Human
ucaggcuugaagucccugauuucgccaucaaagucagauccaggggggacgaugcuauucaggu

SEQ ID NO: 114809 - RNA, 64 nt, Human
ugcuuccugccccccagugcccauuccaggucaccagauccaaggagcgcuugaggagcucugg

SEQ ID NO: 114810 - RNA, 64 nt, Human
uguauuacaguagaccgcugacguucccaagugacagauccagggccuuucaaacauccccaaa

SEQ ID NO: 114811 - RNA, 64 nt, Human
gcccauuuugcuucucucuuggauuuuguuuuuucagauccacauuuauuggguuuccugucca

SEQ ID NO: 114812 - RNA, 64 nt, Human
gcauuggccucuguguacaaaccaagagcuuuuacagauccagaauuuauuaguuuaaaaugca

SEQ ID NO: 114813 - RNA, 64 nt, Human
acauuagcagaacuauaaaaaaaaaucugcuacucagauccacugcauacagaauaagucagag

SEQ ID NO: 114814 - RNA, 64 nt, Human
ugcauuuuuuagcaaacauuuaucuuaaacaucacagauccacuggggggugcaaggggcuacu

SEQ ID NO: 114815 - RNA, 64 nt, Human
ugcuccaguuugcaggguagcccagugcaagguucagauccauguagcuaaguauuauccugcu

SEQ ID NO: 114816 - RNA, 64 nt, Human
uucaugugauuaauauuaggacguccagcaggagcagauccaggagcagcucauaugaucccca

SEQ ID NO: 114817 - RNA, 64 nt, Human
uccagcaggaucugcucccuguguccuuggacagcagauccacacaccacuuccccacccacac

SEQ ID NO: 114818 - RNA, 64 nt, Human
ggucugugcagacucauggccaccaggaggccugcagauccagccuuccugucaacagcgacag

SEQ ID NO: 114819 - RNA, 64 nt, Human
gaagccauauucaaccccagaugagaaaacccaacagauccaucccuugagcuguaaacacuca

SEQ ID NO: 114820 - RNA, 64 nt, Human
aucuuccaagggacaucuuuuaaaacaagugcuucagauccagaaauuuguuaacaugaaaacu

SEQ ID NO: 114821 - RNA, 64 nt, Human
cagaaguuugcccagcugcuuucuucugguuguacagauccauuguggucugccuuccaggcuc

SEQ ID NO: 114822 - RNA, 64 nt, Human
cccucccaucucuaccccaaagaauuccugaagccagauccacccuaucccuguacagaguaag

SEQ ID NO: 114823 - RNA, 64 nt, Human
uuuucuaaaucauggagcgaauaauuuucaauaacagauccaaaagacuauauugcauaacuug

SEQ ID NO: 114824 - RNA, 64 nt, Human
acauccugaagaucucgugacuauacuggcauuucagauccaccccacccccagacucauccca

SEQ ID NO: 114825 - RNA, 64 nt, Human
cuccuuuuucuuuuuaugaaacuuagauuuaccucagauccaugccaccaaacaucucccaccg

SEQ ID NO: 114826 - RNA, 64 nt, Human
uugaaucugaauuauauuuuauaaggguuaaccacagauccaaggacucaguaaaagggugaaa

SEQ ID NO: 114827 - RNA, 64 nt, Human
aggccgaaggucagccuugagucccguuuaacagcagauccagaagaccuugagaguaggcguc

SEQ ID NO: 114828 - RNA, 64 nt, Human
ggaauguuuguuuguacugugccaaacuguuccucagauccaauuguuagcacaaaaugacuau

SEQ ID NO: 114829 - RNA, 64 nt, Human
agccuucggaaacccccaaggugucgaggaggaucagauccagauaagagaagaugauuccuuc

SEQ ID NO: 114830 - RNA, 64 nt, Human
aauuaauuccuguggacaaugcccagucucuguucagauccaaaagcacaaaauguuguauaua

SEQ ID NO: 114831 - RNA, 64 nt, Human
agucagugagacgaaguauagagaacagguggcccagauccaggggacccaacuucuggccccu

SEQ ID NO: 114832 - RNA, 64 nt, Human
uuacugugacuagauuugaagcaaauaaauacuccagauccaugcagcuagaacacacuugcuu

SEQ ID NO: 114833 - RNA, 64 nt, Human
auugcugacuuuguaucuuggauacaguguaaaccagauccauauaaggugaaugugaaauggg

SEQ ID NO: 114834 - RNA, 64 nt, Human
cacagauuuacagugaacuugaucuacaaguucacagauccauugugugguuuaauagacuauu

SEQ ID NO: 114835 - RNA, 64 nt, Human
auaagccuaaaaaaagcacaauuauuaaaacaaacagauccauguuaggacauuucugaauaau

SEQ ID NO: 114836 - RNA, 64 nt, Human
uguuauguuaccauaauuugauguauauaguguccagauccauuuagaaauuuaauauuuauua

SEQ ID NO: 114837 - RNA, 64 nt, Human
uaaauaacagacacuauauguuggaguugggaaucagauccaaguuugacuccaaacccacuuu

SEQ ID NO: 114838 - RNA, 64 nt, Human
ugaaaauaaaaagcaacuuaugaaaguagacauucagauccagccauuacuaaccuauuccuuu

SEQ ID NO: 114839 - RNA, 64 nt, Human
uguuggagcauaagguuuccaguaagcgggagggcagauccaacucagaaccaugcagauaagg

SEQ ID NO: 114840 - RNA, 64 nt, Human
uggacuguguuuccaguacaccuuucagccaaaacagauccacaguaguuguugaguucaagua

SEQ ID NO: 114841 - RNA, 64 nt, Human
uccaugaagcagcgcugcaugucacuagguaacacagauccauccagaugguguuuacauuuga

SEQ ID NO: 114842 - RNA, 64 nt, Human
cagcauugcuccccagcccuccagaaaccuugagcagauccagggaucagugagaggaguggug

SEQ ID NO: 114843 - RNA, 64 nt, Human
accuuuaaaaauugguagauuucacauaaaaguccagauccacagcuucucuugaagaaugacc

SEQ ID NO: 114844 - RNA, 64 nt, Human
auguuauagggugagucccuggaucuuugcucaccagauccaagcacugcuucucggugucauu

SEQ ID NO: 114845 - RNA, 64 nt, Human
auguuuccaugaguuuuuuaguuucacaguuuuacagauccaacgacacaaucuuuuaaucuuu

SEQ ID NO: 114846 - RNA, 64 nt, Human
cuugcuacagccucugcccugguuugggcuaugucagauccaaaaacauccugaaccucugucu

SEQ ID NO: 114847 - RNA, 64 nt, Human
ugugugcgugucaguuacuuuuuuaguaacaauucagauccaguguaaacuuccguucauugcu

SEQ ID NO: 114848 - RNA, 64 nt, Human
gaguuauucagauuaguaucuauguagguucagucagauccaaccauggauucgagguauuaua

SEQ ID NO: 114849 - RNA, 64 nt, Human
uuuuuuuuuuuuuuuuuuuuuuuuuguauagaaacagauccauuucuugguaaucaaagcacau

SEQ ID NO: 114850 - RNA, 64 nt, Human
gucuccucugccuuuuguuuuucagcuucagagacagauccaauauagucccagggaccugggu

SEQ ID NO: 114851 - RNA, 64 nt, Human
ccagcuaucagcacuuucagcaucggcucuucagcagauccaaacccccucagcaacuugcaga

SEQ ID NO: 114852 - RNA, 64 nt, Human
agggugagcagucccagugguccuagugccgcaucagauccaggugggugagggcaggaggccc

SEQ ID NO: 114853 - RNA, 64 nt, Human
aacugagcuuuuccaggccucuuauggaauccugcagauccaguggcugcagcuucaaucccag

SEQ ID NO: 114854 - RNA, 64 nt, Human
aaaaggguugacuugaccauacagcuaaugcugacagauccaagaccuagaccuaggucuuuug

SEQ ID NO: 114855 - RNA, 64 nt, Human
cucugcacccugaagguagccauacagaugccgacagauccacaaaggaacaauaaagcuauuu

SEQ ID NO: 114856 - RNA, 64 nt, Human
augcaauuccuccaucaucucuggacgugcagaccagauccagaagaaaggccuggcguguggc

SEQ ID NO: 114857 - RNA, 64 nt, Human
uuccccuuugaaauaauugcaccuuaaauuuauucagauccacuuugguaacugagguucaguu

SEQ ID NO: 114858 - RNA, 64 nt, Human
uuucacuuugcaucagcuuucccccauuaucucucagauccacuuaaggaauccuuacagcaug

SEQ ID NO: 114859 - RNA, 64 nt, Human
cauuuugccucuaaugaaucuuucacaaauuggucagauccaugaggucuuuuacucuucuuug

SEQ ID NO: 114860 - RNA, 64 nt, Human
ccuuauuugaaggcaucuaaagagaaacuguuuucagauccaagugcucagaucuaaagccucu

SEQ ID NO: 114861 - RNA, 64 nt, Human
uauguucugggcuuaauucccccaagcagaagaccagauccaagauguuuggacacccugucag

SEQ ID NO: 114862 - RNA, 64 nt, Human
uucauuucccuccuuuuccuguuccuccaauccccagauccaccacuccugcacaugccauaca

SEQ ID NO: 114863 - RNA, 64 nt, Human
ugacaagucaagcucuuaagaaauacaaggacuucagauccauuuuuaaauaagaauuuucgau

SEQ ID NO: 114864 - RNA, 64 nt, Human
gcucugucacaugaauucuuuuuuauccuaauggcagauccaauuucaucucauucauuuuuuu

SEQ ID NO: 114865 - RNA, 64 nt, Human
uguaauagaaugucauuguggauguuaccuuuuucagauccaagcauauaaaaagccuguauau

SEQ ID NO: 114866 - RNA, 64 nt, Human
gcuaaaaugagguauaccuagaugucaaguaagacagauccaagguaacuggguaggaaaucuu

SEQ ID NO: 114867 - RNA, 64 nt, Human
auaguuuuggguuagauuuuauaaugcaaagauucagauccaaaauaauuucauaccccauuuu

SEQ ID NO: 114868 - RNA, 64 nt, Human
ggggauggcccaggccugcgaggaguaccucagccagauccacaguugccaaacguugcaggac

SEQ ID NO: 114869 - RNA, 64 nt, Human
uguuuaguucacagcuguucagggugacagugagcagauccagacaccagauccagcuaggcua

SEQ ID NO: 114870 - RNA, 64 nt, Human
gcuguucagggugacagugagcagauccagacaccagauccagcuaggcuagauguacaguauc

SEQ ID NO: 114871 - RNA, 64 nt, Human
guauuuuauguccagauucgccauuucugaaauccagauccaacacaagcagucuugccguuag

SEQ ID NO: 114872 - RNA, 64 nt, Human
auguaaaagagaaagcuuauuggacucaaacccacagauccacaccagaguucuauuuaccuca

SEQ ID NO: 114873 - RNA, 64 nt, Human
gccugaccuccccuuccccuuuccugccccaaggcagauccacaucaccgaagcucccuagagg

SEQ ID NO: 114874 - RNA, 64 nt, Human
cuaaauacuuucaugucucuauauucauuuuucacagauccaccugucucuugaaaauauaaaa

SEQ ID NO: 114875 - RNA, 64 nt, Human
ccacugucacacagaaugccggaggggcgcagagcagauccaggccccagaaagccucaccuac

SEQ ID NO: 114876 - RNA, 64 nt, Human
agcaggugauguuaagucacaaggugcugcuuuucagauccacuaugcaagaggggaggguggg

SEQ ID NO: 114877 - RNA, 64 nt, Human
gguguuguguuuucaugucuuuuuucagcccucucagauccaaauguuauuaugcacuuuuuaa

SEQ ID NO: 114878 - RNA, 64 nt, Human
cuuuccuugcuaaggucccauauauugauuuguacagauccacuuagucauuuucuccuuuuuu

SEQ ID NO: 114879 - RNA, 64 nt, Human
aguuccuuuucacuguguuuaauuugggaaaauccagauccacaucauuguagagucugagggu

SEQ ID NO: 114880 - RNA, 64 nt, Human
cagucuugagcagcagggagggcucagcuguccccagauccaggugccucugaccagccugguc

SEQ ID NO: 114881 - RNA, 64 nt, Human
aaguccaugaucaguucuggaccgcuauggauuccagauccaccuuacguagccgugugagcuc

SEQ ID NO: 114882 - RNA, 64 nt, Human
aaucacuugagcauguaauaacuaauaaauaaugcagauccaugugauuauuaaaaugacugua

SEQ ID NO: 114883 - RNA, 64 nt, Human
cuuugacagcgcacagcugcucugugaccagggacagauccagcaggccccagucucgcaucag

SEQ ID NO: 114884 - RNA, 64 nt, Human
gggaugggggucaagcugcucucucuucccagugcagauccacucaucagcagagccagauugu

SEQ ID NO: 114885 - RNA, 64 nt, Human
uugcuacuugcacccagaaucuagugauuuuagucagauccauggaacagagcagcuucguaau

SEQ ID NO: 114886 - RNA, 64 nt, Human
ugugacuugucccaggaccagaauguaccuaagucagauccauagacgcauguugguaggucac

SEQ ID NO: 114887 - RNA, 64 nt, Human
gugugcacugggggagggaugguuugggcaggugcagauccaagggcugugguaaacgggagag

SEQ ID NO: 114888 - RNA, 64 nt, Human
cugggacgcauagcuaauacuuuagagaggaugacagauccauaaagagaguaaagauaagaga

SEQ ID NO: 114889 - RNA, 64 nt, Human
agaguaggagaagcuuagagaaagcacagaaucccagauccagcuggugaaggagggaaggcuu

SEQ ID NO: 114890 - RNA, 64 nt, Human
ccgagaucgcuccacugcacuccagccugggugacagauccagacucugucucaaaaaaaaaaa

SEQ ID NO: 114891 - RNA, 64 nt, Human
ucuguagggagcucugccagaggggcagcagcugcagauccacuuaggccccaggguccacgga

SEQ ID NO: 114892 - RNA, 62 nt, Human
cuguucugcuuuggaguuaaaggauauaaucacagauccauuuaagcuugcagaagagucug

SEQ ID NO: 114893 - RNA, 64 nt, Human
cagugaaaaggaguuuuuucauuccugaaaguugcagauccacaaaacuaacaggauaauuggg

SEQ ID NO: 114894 - RNA, 64 nt, Human
cgugugcauuuuaaaagucauaaauuaauuaaaacagauccacuucggucaguaugugucccaa

SEQ ID NO: 114895 - RNA, 64 nt, Human
gcuaaauauuuauacacuugucuugaauuuuuuucagauccacuuaaaauauuuagaaaaacaa

SEQ ID NO: 114896 - RNA, 64 nt, Human
gcacagccugugcagagagggugggucacccccccagauccaaggagaaacugcaggucaaggg

SEQ ID NO: 114897 - RNA, 64 nt, Human
cuaacuaauaaaggaaagagaauauuugguuacucagauccauuuuuaaccucuggugcuguau

SEQ ID NO: 114898 - RNA, 64 nt, Human
aaaacuuccuuucucuucugugaacaucauuggccagauccauuuucaguggucuggauuucuu

SEQ ID NO: 114899 - RNA, 64 nt, Human
ucagcaacaaacguacuuccaccagauguguccccagauccacagcaggcacauaucucuccaa

SEQ ID NO: 114900 - RNA, 64 nt, Human
ccagccaccaggguguccucuaggaugcagcugccagauccacucacucugcugccuccagcag

SEQ ID NO: 114901 - RNA, 64 nt, Human
agggagggagggagaaaagagguggguaggguuacagauccagguuauaacuacucuggcccau

SEQ ID NO: 114902 - RNA, 64 nt, Human
ugugucagaccauggcgugguauuuauugugcagcagauccagagacagaggcagccugucuuu

SEQ ID NO: 114903 - RNA, 64 nt, Human
accaagcuggcuuguuucuuaugccagaggcuaacagauccaaugggaguccauggugucaugc

SEQ ID NO: 114904 - RNA, 64 nt, Human
ugguauuuguaaugaagugaauccacuguuuaaucagauccauaaucuuuaacagauucaccac

SEQ ID NO: 114905 - RNA, 64 nt, Human
auuguccugccucauggagcuguuguauagaucccagauccaucccaugauuuguuccugucug

SEQ ID NO: 114906 - RNA, 64 nt, Human
ccagcaccaagauagcuauggaucuuaagagcaccagauccagaggggguuggguuugcugacc

SEQ ID NO: 114907 - RNA, 64 nt, Human
aaaaucacacagccaagccagucaaggauggaugcagauccagagguuucuggcagccaguacc

SEQ ID NO: 114908 - RNA, 64 nt, Human
ugaucacuucucuuuucuaaacccuuuuccuguucagauccauacaggauuugcaaggguagga

SEQ ID NO: 114909 - RNA, 64 nt, Human
cacuugcccuguucucuucacaccaaggaagcuccagauccaguaucuuguuuggccucaaaac

SEQ ID NO: 114910 - RNA, 56 nt, Human
aacacauccuaagcgucugagugcugcagauccagugggguccggacacugggccc

SEQ ID NO: 114911 - RNA, 64 nt, Human
uguuaccaucacugaccugccccuggcccuagaacagauccagggcaacguccaggccaaugug

SEQ ID NO: 114912 - RNA, 64 nt, Human
aggucuaaagucuuuccuuauguuaaauuguugccagauccaaaggggcauacugaguguugug

SEQ ID NO: 114913 - RNA, 64 nt, Human
ccugagcuccgaggaaaaauuggcccuucucaaacagauccaggaagccuauggcaagugcaag

SEQ ID NO: 114914 - RNA, 64 nt, Human
guuauuaccuagcaacccuugcaaugaagaugagcagauccacaggaaaacuugaaugcacaac

SEQ ID NO: 114915 - RNA, 64 nt, Human
gacguuuuacucugauaucauugugcacuuuagccagauccagaaaacacucaaauuuauuuug

SEQ ID NO: 114916 - RNA, 64 nt, Human
cccaaagaugaagauacuauaaccucaaauggugcagauccagaacugggcuggaugacauccc

SEQ ID NO: 114917 - RNA, 64 nt, Human
guugaacuggucuaaugaguucaagggccugaggcagauccagaggacaagccugccucaccuc

SEQ ID NO: 114918 - RNA, 64 nt, Human
gaacccagacucagacauuggcaccuaauccaggcagauccaggacuauauuugggccugcucc

SEQ ID NO: 114919 - RNA, 64 nt, Human
ccagcuccaaggggaaucagaacucaaauggggccagauccagccuggggucuggaguugaucu

SEQ ID NO: 114920 - RNA, 64 nt, Human
guuuacacauacccucuucauggaugggggaacucagauccagggacagaggccccagccuccc

SEQ ID NO: 114921 - RNA, 64 nt, Human
auaaucccaagacugugccccucaucugcaucuucagauccaguacucuguguaccugcuccag

SEQ ID NO: 114922 - RNA, 64 nt, Human
cacaaggaccagguacaguagcugaaacccaauucagauccaccauaggauucuuugacuacau

SEQ ID NO: 114923 - RNA, 64 nt, Human
cauggaguaauucuuacaaauuuaaacuauuguacagauccacauacauguuguuaaguaccua

SEQ ID NO: 114924 - RNA, 64 nt, Human
uuauuuuugcauauuucuguaauauugcaguccccagauccagaacaugggaaguuagggaaaa

SEQ ID NO: 114925 - RNA, 64 nt, Human
cuacccuugccguaucuaaggagcugagguaauacagauccaaggagaauuguauagcaagaaa

SEQ ID NO: 114926 - RNA, 64 nt, Human
uucgauuguuuaaccaaacccaguugcauuuguacagauccacguguacuggcaccucagaaga

SEQ ID NO: 114927 - RNA, 64 nt, Human
uuccuaugacacucaucagguaaacugaugcuuucagauccaucgguuuauacuauuuauuaaa

SEQ ID NO: 114928 - RNA, 64 nt, Human
ggaaggagaaaugauucaugugugaaaaaauucucagauccaucaauaaauuuuuuucagagcc

SEQ ID NO: 114929 - RNA, 64 nt, Human
gcagaucucuguucucucaagcagaacucccaaccagauccauucuugaccagugaccggcucg

SEQ ID NO: 114930 - RNA, 64 nt, Human
guuuccucaacugcccuucauaugucaugguuuucagauccauuccaaccugacugaauguuaa

SEQ ID NO: 114931 - RNA, 64 nt, Human
gacacuuuucuccuaguaguuuugaauucaggaacagauccaaaguuagcaguauauggcugcu

SEQ ID NO: 114932 - RNA, 64 nt, Human
gagauuucaguuuccuacugcaguuuccuaccugcagauccaggggcugcuguugccuuuggau

SEQ ID NO: 114933 - RNA, 64 nt, Human
ggcagcaauaggcuggagcccgaagguauuucuccagauccacagggagaggucucacccucca

SEQ ID NO: 114934 - RNA, 64 nt, Human
cuuuacagaaauuacugagugugaauaaaaacuucagauccaagaaauauauaaugagagauau

SEQ ID NO: 114935 - RNA, 64 nt, Human
caacaaaacaacccauaguaucucauucugucaucagauccagaagaaauauccugguuuucca

SEQ ID NO: 114936 - RNA, 64 nt, Human
uuucucuaaaugagagaaagacuuagaauguacacagauccaaaauagaaucagauuaucucuu

SEQ ID NO: 114937 - RNA, 64 nt, Human
ugaggaggaggcacugcacaggcaguuauuucugcagauccagcucguggaccagcugcagcac

SEQ ID NO: 114938 - RNA, 64 nt, Human
ggccuucaagacagaggccugccccagugugccacagauccauguggauggagccuccuucaga

SEQ ID NO: 114939 - RNA, 64 nt, Human
gauuugagcagcuccuacugugauaaguguaucccagauccacaauguaaauauaugugauuug

SEQ ID NO: 114940 - RNA, 64 nt, Human
auuuuucccagauuuguuuacauguucccugggacagauccaggucugcagaucgacaccagug

SEQ ID NO: 114941 - RNA, 64 nt, Human
acaggugacucagcagugacccugugugccaggccagauccaaacugagagggaaggugucguu

SEQ ID NO: 114942 - RNA, 64 nt, Human
gugagguaguggcgagaaagcugacuccauucaucagauccaguuuaugaggguugggggugag

SEQ ID NO: 114943 - RNA, 64 nt, Human
cuguucccccuccuccaucucugagcccgugucacagauccagaagaugaaagaaggaagugag

SEQ ID NO: 114944 - RNA, 64 nt, Human
uugcucuaccucucccugacauuuugcuccggggcagauccaaccuuaccuggggcagcaaacu

SEQ ID NO: 114945 - RNA, 64 nt, Human
ccagguuggaccacguggcaucagaggucccauccagauccaacuauagguccaagaguccacg

SEQ ID NO: 114946 - RNA, 64 nt, Human
cucuugagugaacaggggaggccaguagaugccccagauccagagccguggcugcaaauccagc

SEQ ID NO: 114947 - RNA, 64 nt, Human
accucuguccuugcugcugguggggaagggaagccagauccagcacccccuggggggccaucgg

SEQ ID NO: 114948 - RNA, 64 nt, Human
cauggccaaggcccugccacgcacgcccaucccucagauccacugugagcaccaaccugcugca

SEQ ID NO: 114949 - RNA, 64 nt, Human
cagcgggacgcggggcucggaucugaaaggcggccagauccacaucuggaucuggaucugcggc

SEQ ID NO: 114950 - RNA, 64 nt, Human
agcccggggcucugcagcauuccaguccccuuugcagauccauagcugcucugcagggcggaag

SEQ ID NO: 114951 - RNA, 64 nt, Human
uuuuacggguugcuguuuuaacauggguuuuugucagauccauggucuuaggacuugacugaug

SEQ ID NO: 114952 - RNA, 64 nt, Human
aagcugcccaguccauggggacagaaccgucacucagauccacauucaagugugcccacccugc

SEQ ID NO: 114953 - RNA, 64 nt, Human
ucacugagcuuccucugaagccuugaaggguuuucagauccaaggaacaaaggggaaaauagac

SEQ ID NO: 114954 - RNA, 64 nt, Human
gauaagcccacuuuccugucauuaguggcagccccagauccagaccuaggccuccuggcaccca

SEQ ID NO: 114955 - RNA, 64 nt, Human
gcugcagccucaggacugggagcccccagccugucagauccaggagcuccaguguccugagcuc

SEQ ID NO: 114956 - RNA, 64 nt, Human
cugcacuugccuucagagggaggcacaguccacccagauccaccuuuccagcaagacccccagu

SEQ ID NO: 114957 - RNA, 64 nt, Human
cuccuuccauggaaccugacguagcugcaaaggacagauccagggacugaagccaaaguuaugc

SEQ ID NO: 114958 - RNA, 64 nt, Human
aucagggcauaacuaagggguaaagucugaggagcagauccaaagggcugaggcagggaggccg

SEQ ID NO: 114959 - RNA, 64 nt, Human
auucuacacugaggaggcugccuuaugggugggccagauccaaaccgcaggcaaacgggucgug

SEQ ID NO: 114960 - RNA, 64 nt, Human
auucuuucccaugggggcucucuuccccagaccccagauccaaggucccucacccugccugccc

SEQ ID NO: 114961 - RNA, 64 nt, Human
uuacgaguaacugaagaccccauucuccaagcaucagauccauuuccuaucacaacauuuuuaa

SEQ ID NO: 114962 - RNA, 64 nt, Human
ucuaccaagagcuucgccagugucacugaaucaacagauccaagggaaugaacaagaagacuac

SEQ ID NO: 114963 - RNA, 64 nt, Human
accgacuuccccaucccugcugucccaccagggacagauccagaaacugagaagcuuauccgag

SEQ ID NO: 114964 - RNA, 64 nt, Human
caaucuucguuguuuuuguauuuauuuguauguucagauccaaaggauccguuguaaaaauaua

SEQ ID NO: 114965 - RNA, 64 nt, Human
accuuggggaaaggcagugcccucucugggcagucagauccacccagugcuuaauagcagggaa

SEQ ID NO: 114966 - RNA, 64 nt, Human
uccuacggauugagguccucaggccacgccccugcagauccaggucuccaggccuugcccacug

SEQ ID NO: 114967 - RNA, 64 nt, Human
auagaauaguauacagcacuuaaaagcagugaaccagauccauauuguguaacauggauaguua

SEQ ID NO: 114968 - RNA, 64 nt, Human
cagcguguaacacggaacuuccaaaugcugagcgcagauccaaaguugucuucuguccacuagc

SEQ ID NO: 114969 - RNA, 64 nt, Human
ccagcauguacauagaacuuccaaaugcugagcccagauccaaaguugucuucuguccacgagc

SEQ ID NO: 114970 - RNA, 64 nt, Human
gggagacaacagcccugucucaaaaccagguugccagauccaaugaaccagcagcuggaaucug

SEQ ID NO: 114971 - RNA, 64 nt, Human
augcucguguuucccaagcaccuggaagacaugccagauccaugugcaguaaugccugguggcu

SEQ ID NO: 114972 - RNA, 64 nt, Human
aucccuuccacagcuaaagggcauauguccucugcagauccacagcagagaaaaagucccgugc

SEQ ID NO: 114973 - RNA, 64 nt, Human
accucaacacccagacccugccucccucaggcaccagauccaguguccuagugaaacgcuggau

SEQ ID NO: 114974 - RNA, 64 nt, Human
cugcgucuugcacccagcgggcaucugccguggucagauccauuucaaaugaaauguggggaca

SEQ ID NO: 114975 - RNA, 64 nt, Human
ugcucugcccugcacgucaggguuggcauccacccagauccagauggaagggaaacuucucucu

SEQ ID NO: 114976 - RNA, 64 nt, Human
uggcuauaaagggcaccacaaggaagaagccaaacagauccagaaugugugaaauucuacagag

SEQ ID NO: 114977 - RNA, 64 nt, Human
cgaucuaaagguaggcagacccuggacccagccucagauccaggcaggagcacgaggucuggcc

SEQ ID NO: 114978 - RNA, 64 nt, Human
ggauguucccggugugaagcugcaggcugugcuccagauccaccgacccguagcaucucgucac

SEQ ID NO: 114979 - RNA, 64 nt, Human
auuaauuuggcuucacauaacauaucccuuagaacagauccaauagacaacucuuaauaucagc

SEQ ID NO: 114980 - RNA, 64 nt, Human
agccugcccccuccuggacgugcccauccccccucagauccagacaugccccucccccgcagac

SEQ ID NO: 114981 - RNA, 64 nt, Human
cccucugacaccccucccccuaauucucaucugucagauccaguguauuccuaagcugggacaa

SEQ ID NO: 114982 - RNA, 64 nt, Human
gcuugccugcugcccugauggccugagcaucccccagauccaagccugggggaucccgggaaag

SEQ ID NO: 114983 - RNA, 64 nt, Human
uugugcaucucugagguucccucauggagcuccacagauccauuuuuagggaagggauuuuggc

SEQ ID NO: 114984 - RNA, 64 nt, Human
aaugcuuagcaacaacaacaaaaaauugcucucucagauccauaauccauacucagugaaagca

SEQ ID NO: 114985 - RNA, 64 nt, Human
uugacucaacggggacaacuccagaaggucauuccagauccagagauccccaucgaacugaagg

SEQ ID NO: 114986 - RNA, 64 nt, Human
gacacagggggacaggaaaacccauuucucaacccagauccaugucuccacugcuucuacucug

SEQ ID NO: 114987 - RNA, 64 nt, Human
gcugcccagccagcugguucucccgggacaccagcagauccacacccugggcaccuccguguuu

SEQ ID NO: 114988 - RNA, 64 nt, Human
agccccaagggggauuuugugggaccgcugcccacagauccagguguuggaagggcagcgggua

SEQ ID NO: 114989 - RNA, 64 nt, Human
cuuggacauuuagugacuguuagccggucccuuucagauccaguggccaugcccccugcuuccc

SEQ ID NO: 114990 - RNA, 64 nt, Human
gagcccuggcugugugcuguugugugccuaucggcagauccauccuuccugccuccaaggagga

SEQ ID NO: 114991 - RNA, 64 nt, Human
gugacucccuccuuggccaggcccucacccaguucagauccacggccuccacccgggacgccuu

SEQ ID NO: 114992 - RNA, 64 nt, Human
cuggugguaccagaggccagaauggugggaaagacagauccagauaaugcugggaaguguggcu

SEQ ID NO: 114993 - RNA, 64 nt, Human
cccuccucuccacccuaccuuccaucaaccagggcagauccaccgugcccugguuccccagaca

SEQ ID NO: 114994 - RNA, 64 nt, Human
uccagucccgacagugcccuuguugccuuugagccagauccauggcaauggucuccccacagac

SEQ ID NO: 114995 - RNA, 64 nt, Human
gucuguagcuguauauaaagcgcauguagagcuacagauccagauacacacacuuguguauaua

SEQ ID NO: 114996 - RNA, 64 nt, Human
gagcuggcaauggcagcgacagcagcaacagcagcagauccaagaagcgggucccugagacggg

SEQ ID NO: 114997 - RNA, 64 nt, Human
cuggcuguuugggaccauggagcgguaccuaaaacagauccaggaccugcccccaacuggccuc

SEQ ID NO: 114998 - RNA, 64 nt, Human
cagagcacagccaaucuccaggcucccucccucccagauccaggaacacaugcacacacacaca

SEQ ID NO: 114999 - RNA, 64 nt, Human
cauauauguauacgcacgcacccacacccuacagcagauccaccugcacaaacauagacagaug

SEQ ID NO: 115000 - RNA, 64 nt, Human
agccugggaaaauaauuuuuuccuccaagauucucagauccagguuaggaaaggauucagcacu

SEQ ID NO: 115001 - RNA, 64 nt, Human
aaaauguuugugugggaaaaaaaaaacucauuggcagauccaagaaugacaaacacaagugccc

SEQ ID NO: 115002 - RNA, 64 nt, Human
ugugccagggcaaugaugaaugagaaucuacccccagauccaagcagccugagcaacucuugau

SEQ ID NO: 115003 - RNA, 64 nt, Human
gaaagauagcaguguucuccugacuucgcccuacugcaugcagccaaauaaaaggugugcccag

SEQ ID NO: 115004 - RNA, 64 nt, Human
ugugugugugugugugugugugcgcgcgcgcgcgugcaugcagagaggaaggaagggagcuuua

SEQ ID NO: 115005 - RNA, 64 nt, Human
ccuuccucgccagcacgccuuagcuuugcaagccugcaugcauucaggcuucucagguguuucu

SEQ ID NO: 115006 - RNA, 64 nt, Human
cuguccuccccucuguccccccaaccgcccccccugcaugcagccaaauggagcaucucuguuc

SEQ ID NO: 115007 - RNA, 64 nt, Human
cccgaccuugagauuauuccuguuugaaagguggugcaugcagauggagaagugguguuggcag

SEQ ID NO: 115008 - RNA, 64 nt, Human
caucaccuaggacugacucggcagugugcaguggugcaugcacugucucagccaacccgcucca

SEQ ID NO: 115009 - RNA, 64 nt, Human
auucuggugcugcuucauaacaaaaaugaaaagcugcaugcaucuacagcaggcauggauuguu

SEQ ID NO: 115010 - RNA, 64 nt, Human
aaucagcugucauuuuauuaaucuaucccuuuugugcaugcaccauuucucucuuacuaacagu

SEQ ID NO: 115011 - RNA, 64 nt, Human
auucaagccucucaacucaaaagcacaagauccuugcaugcacaccuuccuccacccuccaccc

SEQ ID NO: 115012 - RNA, 64 nt, Human
acaaucucccuggacuccuccuccauacuguaugugcaugcauucacacacacauauguacaug

SEQ ID NO: 115013 - RNA, 64 nt, Human
aaaaaaauuaaaucacauuuagugcuguauaauuugcaugcaauaaaauucaauaaaauuaaau

SEQ ID NO: 115014 - RNA, 64 nt, Human
gguaaauauaguuuuauugucacaugcuaaauauugcaugcauauugacuaauuggaauaacca

SEQ ID NO: 115015 - RNA, 64 nt, Human
gaaaugguauauauauguguauaauguaagugugugcaugcaugugcgcgugcaugugugugug

SEQ ID NO: 115016 - RNA, 64 nt, Human
uuugggggccauguccuacauuugcauggauggaugcaugcauugccuagucaacucacuuaaa

SEQ ID NO: 115017 - RNA, 64 nt, Human
uuuuucuuggaugauugcaguuauuucaaaaauuugcaugcaaaauauacacucauccuacuuc

SEQ ID NO: 115018 - RNA, 64 nt, Human
gccuuggcccgaggagacuaacuugcuuucucccugcaugcaggcugagauuguuucuggaagg

SEQ ID NO: 115019 - RNA, 64 nt, Human
gugccugaagcuauagugcaaugguucccaacccugcaugcacauucgaaucaccugggggcac

SEQ ID NO: 115020 - RNA, 64 nt, Human
aacaacugccauuaaacuuaacucaaaaucaugaugcaugcauuuuuguugaaccauaaaguuu

SEQ ID NO: 115021 - RNA, 64 nt, Human
ucacugccuuguucuguuucucucugaccaccagugcaugcagccccugucauguaccgccugu

SEQ ID NO: 115022 - RNA, 64 nt, Human
uucauagcagugugagaauggauuaauaccuggaugcaugcauguuuguguaacaaacaggucu

SEQ ID NO: 115023 - RNA, 64 nt, Human
gugugugugugugcaugugugugucugucuggcaugcaugcacucacuuuggggcuggagguga

SEQ ID NO: 115024 - RNA, 64 nt, Human
agaccucuuccugaaucacuggacuccagaaaugugcaugcagaucagcuguugccuucaagau

SEQ ID NO: 115025 - RNA, 64 nt, Human
gccuuagcuggaccugcguugccgucuaugcaaaugcaugcaaauacuccaggcccugggaugu

SEQ ID NO: 115026 - RNA, 64 nt, Human
ggggaugcugaugcugcuggcccugggacugcacugcaugcaugugaagcccuauaggucucag

SEQ ID NO: 115027 - RNA, 64 nt, Human
cgggagggcuccaccaauugagucucucccaccaugcaugcaggucacugugugugugcaugug

SEQ ID NO: 115028 - RNA, 64 nt, Human
ggccagaucaaugcuacaaucaugaaguucucauugcaugcaauuguguaggauugacaaggaa

SEQ ID NO: 115029 - RNA, 64 nt, Human
ucauuuuuaaaaauaaaaaaaaacccaaaaauaaugcaugcauaauuuaaauggucaauuuaua

SEQ ID NO: 115030 - RNA, 64 nt, Human
aaagccaaaggguuauagggguacacuuagggguugcaugcaagcuguuaccaaaaaauuuuua

SEQ ID NO: 115031 - RNA, 64 nt, Human
ggaaguccuccagggauccgcuacauccccuaacugcaugcagauguggaaaggggcugaucca

SEQ ID NO: 115032 - RNA, 64 nt, Human
gccuggccaacccugcugugcagggugagggccaugcaugcaguaugaggggucuacaccugca

SEQ ID NO: 115033 - RNA, 64 nt, Human
cuauccauugaguuuaugaaauggaagaguuaacugcaugcacuaguguuuggaggguguugug

SEQ ID NO: 115034 - RNA, 64 nt, Human
aaaauaaacuuaacucuacaaaagcaaacucuaaugcaugcaagaaucauuagguuggcaggua

SEQ ID NO: 115035 - RNA, 64 nt, Human
cagcaggggaagguggauguuuaggcuugggcucugcaugcaugugacuugcuucuuuuugcau

SEQ ID NO: 115036 - RNA, 64 nt, Human
cuuaagucaggagcccgcuuuguauuagcagguuugcaugcagcaaaaaaacaguuaugugagc

SEQ ID NO: 115037 - RNA, 64 nt, Human
auggugucuuuccaggcucuugauagggugucacugcaugcaagccaugaaucuguuuugagaa

SEQ ID NO: 115038 - RNA, 64 nt, Human
uucuguaucuugaaauuuuuguuuccuugaaacaugcaugcauuuaaaaauaaagcuuaaacaa

SEQ ID NO: 115039 - RNA, 64 nt, Human
agcguucccauaacccugacaguucuccacacugugcaugcacccuugcuugccuuuuucagag

SEQ ID NO: 115040 - RNA, 64 nt, Human
uuugugcuucgaguugguguuucuuucaguguaaugcaugcaguggucacaacccaguuacuca

SEQ ID NO: 115041 - RNA, 64 nt, Human; identical to SEQ ID NO: 115037

SEQ ID NO: 115042 - RNA, 64 nt, Human
gcuguuuuauaagaagacuuuuuguuguacuaugugcaugcauacuaccuauuucuaaacuuug

SEQ ID NO: 115043 - RNA, 64 nt, Human
uugauuauuuuguugucuaaagcuaaacaaaacuugcaugcagcagcuuuugacuguuuccaga

SEQ ID NO: 115044 - RNA, 64 nt, Human
uuacaaaacuauuuacuguaguguauugaagaacugcaugcagggaauugcuauugcuaaaaag

SEQ ID NO: 115045 - RNA, 64 nt, Human
uuaguguuuagugggccacuucucugaugucagaugcaugcagaccuguacuccacaugcaacc

SEQ ID NO: 115046 - RNA, 64 nt, Human
uccaaggccugugaauggcagccugaggaaguuuugcaugcaggcuguguuuucgagcaggacu

SEQ ID NO: 115047 - RNA, 64 nt, Human
ucgugccugcgaacccaaaccugugagucucuucugcaugcaggaguuucuccugggcagcugg

SEQ ID NO: 115048 - RNA, 64 nt, Human
ugguugauauuuuucugucacaaugauuucuuuaugcaugcagagccuggggaagucaugggau

SEQ ID NO: 115049 - RNA, 64 nt, Human
cacugacucauugaaaauguuaauuacacacacaugcaugcaugcacacacgagcauacuugua

SEQ ID NO: 115050 - RNA, 64 nt, Human
gacucauugaaaauguuaauuacacacacaugcaugcaugcacacacgagcauacuuguaccuu

SEQ ID NO: 115051 - RNA, 64 nt, Human
ggauguaguuuccaaaggaaucccccauuuuuucugcaugcaguuugcaacaaauguauucuca

SEQ ID NO: 115052 - RNA, 64 nt, Human
ggaagugugugaucugugggcacauuagccuaugugcaugcagcaucuaaguaaugaugucguu

SEQ ID NO: 115053 - RNA, 64 nt, Human
cacuuaaaagugcaugguauuuuucaugguauuuugcaugcagccaguuaacucucguagauag

SEQ ID NO: 115054 - RNA, 64 nt, Human
cuuguauuuaaaauugccauuauagaugagagcgugcaugcacagucauuuuuguuuaagagua

SEQ ID NO: 115055 - RNA, 64 nt, Human
uuaguagggaccugcucugugcucacaccucggcugcaugcacccugcugugacggaggcuagu

SEQ ID NO: 115056 - RNA, 64 nt, Human
auuccagaucuuucagaaauauaacacauuuuuuugcaugcaugcaaaugagcucugaaaucuu

SEQ ID NO: 115057 - RNA, 64 nt, Human
cagaucuuucagaaauauaacacauuuuuuugcaugcaugcaaaugagcucugaaaucuuccca

SEQ ID NO: 115058 - RNA, 64 nt, Human
uugugaugaaaaagggcuuuagaaguuaaauacaugcaugcacaugaaaacaugcacaaccaca

SEQ ID NO: 115059 - RNA, 64 nt, Human
uccaaguucagcgcuccaggucugggacagggccugcaugcagucaggcuggcaguggcgcggu

SEQ ID NO: 115060 - RNA, 64 nt, Human
gacgccaccaagccucagacucuuaccaucccggugcaugcaggucuccaugaagaagcuggga

SEQ ID NO: 115061 - RNA, 64 nt, Human
aggaauuucuauaucguaggacucaguggggacuugcaugcacauccaccauugucucugagua

SEQ ID NO: 115062 - RNA, 64 nt, Human
uggcuuuaaggauaaagaauaaaugugauagcugugcaugcauuauauauuugcauuugcaaau

SEQ ID NO: 115063 - RNA, 64 nt, Human
aauucaucuguuguauuuagagaaccauauucauugcaugcaaauuuuauuguuaguguucuua

SEQ ID NO: 115064 - RNA, 64 nt, Human
aauaaggaguccagagacuacgcuuaacuuucuaugcaugcauuugaaagcuguuuuuaccuga

SEQ ID NO: 115065 - RNA, 64 nt, Human
gcacagaaggcauuguucccuacccucuggcgagugcaugcagcagagaguuagacagcaacuu

SEQ ID NO: 115066 - RNA, 64 nt, Human
gccauguugggaaguacagucucugcccauuaccugcaugcaggcaccagagcagggacugaga

SEQ ID NO: 115067 - RNA, 64 nt, Human
cuuccuuuuguagcgcaugguugggaggaaaaagugcaugcaucauuccuucacucuucucuuu

SEQ ID NO: 115068 - RNA, 64 nt, Human
cuuuugcaagacugaacauaguuugggccauuggugcaugcacauauauuaacuugugacuaaa

SEQ ID NO: 115069 - RNA, 64 nt, Human
gugagggggcuguaugcuucaggaacuaacuaaaugcaugcagaagguaagaggcaugauggga

SEQ ID NO: 115070 - RNA, 64 nt, Human
acauuacagaaaagguuccauaauuuggccaaacugcaugcauguaaugcuuauuuaguaaugg

SEQ ID NO: 115071 - RNA, 64 nt, Human
aaaaaugcauguuuacuuaccuguauacaccauaugcaugcacuagaauuauuaacuaacgagg

SEQ ID NO: 115072 - RNA, 64 nt, Human
aacaaauuauaaaauuuguuuaaaaaagcaaacuugcaugcauuauugugacuucaaguuuaaa

SEQ ID NO: 115073 - RNA, 64 nt, Human
uuuauuaaagaugcuauggaacauaaaguuguauugcaugcaauuugaaguaacuuauuugacu

SEQ ID NO: 115074 - RNA, 64 nt, Human
uccuuucuaguuuuccuuacaggacgugauaggcugcaugcaagaggcauacagaaaauggaaa

SEQ ID NO: 115075 - RNA, 64 nt, Human
cagugcucccuuccucuccucuccuucuaguggaugcaugcagccuuuuuuucaauuuuuauuu

SEQ ID NO: 115076 - RNA, 64 nt, Human
gcuucuuccgcuucauucucuaccauaccacuugugcaugcaugugauguucuaauaccaauug

SEQ ID NO: 115077 - RNA, 64 nt, Human
uuacauguuagcauaaaacagacuucucucucauugcaugcacuagaucaauauuaucaucugu

SEQ ID NO: 115078 - RNA, 64 nt, Human
accaacauguuuauaucuugacuugacuuuuuuaugcaugcaaaucauuguuuuuacagaguuu

SEQ ID NO: 115079 - RNA, 64 nt, Human
gccuagagaaugaaacucaccguccagauaaccaugcaugcacccagauuuuuuccaccuugga

SEQ ID NO: 115080 - RNA, 64 nt, Human
auaauaguuauauauacauacagguguauacuuaugcaugcauacauaaauccuuaguauagaa

SEQ ID NO: 115081 - RNA, 64 nt, Human
acaagguaauuuuuuuuuguaaagugcaauguccugcaugcauaaugaaccguuuacaguguau

SEQ ID NO: 115082 - RNA, 64 nt, Human
caguaagcuacgaucacaccacugcacucuggccugcaugcacucuggccugcauggcagaaca

SEQ ID NO: 115083 - RNA, 64 nt, Human
uguagugagacugagcaguuuuaaauccuuugcgugcaugcauaccucaucagugauuguacau

SEQ ID NO: 115084 - RNA, 64 nt, Human
uccacccacuuaguccacucugagucgauuaaccugcaugcagcaacacccaaguccaccccaa

SEQ ID NO: 115085 - RNA, 64 nt, Human
aaaaagucucccgcgcauuugcacuaaugauggcugcaugcauagcaaucagcaugugagcaaa

SEQ ID NO: 115086 - RNA, 64 nt, Human
ccaccaugaucuucaucacagucuuugauaugucugcaugcaaaguggaacagaguugggcggc

SEQ ID NO: 115087 - RNA, 64 nt, Human
ccaccucugccucccaaagggcugggacugcaggugcaugcacuaccaugcccagcuuucucac

SEQ ID NO: 115088 - RNA, 64 nt, Human
aucauguucccccuaaacauggcuguuaacccacugcaugcagaaacuuggaugucacugccug

SEQ ID NO: 115089 - RNA, 64 nt, Human
ucugucauaagcauuacuuuauagcuagugacagugcaugcacagccuuguucaacuauguuug

SEQ ID NO: 115090 - RNA, 64 nt, Human
uucccauccugcccuaugguucucuagccaccugugcaugcauguguauuucugccugguucua

SEQ ID NO: 115091 - RNA, 64 nt, Human
auaaucuuuuguggauucuugguuguacuguaguugcaugcaugauuauagcucuuguuuuucu

SEQ ID NO: 115092 - RNA, 64 nt, Human
gagacuuaaagugcuacaggcagcuggaucuguuugcaugcaggaugaagaggguuaaaacacu

SEQ ID NO: 115093 - RNA, 64 nt, Human
uuuguauuuauaggcacaguuaucuuacugaaaaugcaugcauggugaauuaaaauaaaagggg

SEQ ID NO: 115094 - RNA, 64 nt, Human
uggcugagugagaggcguauaaaauggggcugugugcaugcaggcccauguuucagccucagcc

SEQ ID NO: 115095 - RNA, 64 nt, Human
aauauuucaauaacuuagaaugcuucaaguuuagugcaugcaucucuuuagauccaaaauaaau

SEQ ID NO: 115096 - RNA, 64 nt, Human
aagaggggucacaugagggaggaaacuguauccaugcaugcaugauaaugcguggcagagacug

SEQ ID NO: 115097 - RNA, 64 nt, Human
gggcaaugagugugcacauacaaauggggcagugugcaugcaacacacuuaggggaggaguggc

SEQ ID NO: 115098 - RNA, 64 nt, Human
ccugccuaaauuuguucucaccaagcacugccugugcaugcagagaaaaucugugcauccucuu

SEQ ID NO: 115099 - RNA, 64 nt, Human
cagggcccccacaggagcguguacuaccccaggaugcaugcagggcccccacaggagcguguac

SEQ ID NO: 115100 - RNA, 64 nt, Human
gagcagggcacaggcgcuccgggaacagugcaugugcaugcauaccacaagacauuucuuucug

SEQ ID NO: 115101 - RNA, 64 nt, Human
uuucugagagugguuagaggaaauuuagguacaaugcaugcaucacagacuguauuugauugau

SEQ ID NO: 115102 - RNA, 64 nt, Human
aaaaugccuccccauuguacacagguguacaccaugcaugcaccaacaccuaaaacucaaaacu

SEQ ID NO: 115103 - RNA, 64 nt, Human
aaaugagccuuuuguguacacacagaggcacaugugcaugcacacacaacuugugaacacacau

SEQ ID NO: 115104 - RNA, 64 nt, Human
uguauccuuuuauggguaaaacaaaagugaacauugcaugcauguaaugugaugaauuuguaau

SEQ ID NO: 115105 - RNA, 64 nt, Human
uauaugcuauguacaugucagaaaccauuagcauugcaugcagguuucauauucuuucuaagau

SEQ ID NO: 115106 - RNA, 64 nt, Human
ggugucuggauacuucccuguacaugcauaaauaugcaugcauguacagaaagacuguaugugu

SEQ ID NO: 115107 - RNA, 64 nt, Human
ugaugacugucucacuuugacuauacccauguuuugcaugcaaugacucaugcaugguuuucuu

SEQ ID NO: 115108 - RNA, 64 nt, Human
ccuguaccuuugacuaacgcucagcuuccgggccugcaugcaguagacagaagaggaagaaaga

SEQ ID NO: 115109 - RNA, 64 nt, Human
gaaggugcagcacguccaguggguagguacuuguugcaugcaaaagcuguaguguaucuggucc

SEQ ID NO: 115110 - RNA, 64 nt, Human
cuugauuuguuugacuccccuccccccauuuacaugcaugcaaucagacaggccacuaagguaa

SEQ ID NO: 115111 - RNA, 64 nt, Human
cccagggggccgagcacggucaugcuggccggccugcaugcaugcgugugccgggcugggcugg

SEQ ID NO: 115112 - RNA, 64 nt, Human
gguugacagcucccuaaagauuuuccuguuuuuuugcaugcauggguuugaauucuuugagguc

SEQ ID NO: 115113 - RNA, 64 nt, Human
guccaggagcagcucagagaggguggagugaggaugcaugcauccagggaacaggcaucaagaa

SEQ ID NO: 115114 - RNA, 64 nt, Human
ccgacucuucugagcaccuacuuacaugcauuacugcaugcacuucuuacaauaauucuaugag

SEQ ID NO: 115115 - RNA, 64 nt, Human
gccuggccuguauaugugauuucuaaaaaauagaugcaugcauauguuaacauugaauagucaa

SEQ ID NO: 115116 - RNA, 64 nt, Human
uaccuggauugaagugcagaauuuggcauaucgaugcaugcaauggaaagaaaaaaaauuuguu

SEQ ID NO: 115117 - RNA, 64 nt, Human
gaugcuggucucugcacacauaugcuugguuacuugcaugcauucauugguuguucaauaagug

SEQ ID NO: 115118 - RNA, 64 nt, Human
uuggugaaaaugcugaguaugacacuuuucuucuugcaugcaugucagcuacauaaacaguuuu

SEQ ID NO: 115119 - RNA, 64 nt, Human
caguaauuaauuuauuuucauuuucagaaauauaugcaugcaguuauguuuuauuugauuguug

SEQ ID NO: 115120 - RNA, 64 nt, Human
acuuuuuuuccugaauuguauaugaccuuggugcugcaugcaugcuguugacuuuuaggacuuu

SEQ ID NO: 115121 - RNA, 64 nt, Human
aaagccaugaugcucuguauguuaucugugugugugcaugcacucaggugcccuuuguuucaug

SEQ ID NO: 115122 - RNA, 64 nt, Human
ugauauucauugagccuggaaaaauacaagccagugcaugcauuaauacuuaguuagaccgcag

SEQ ID NO: 115123 - RNA, 64 nt, Human
uuugaaagacaauccaggggacauaauagcagugugcaugcaggcaggaggcagggaaauguga

SEQ ID NO: 115124 - RNA, 64 nt, Human
caugcguccccucccaagugcuggcaggccacugugcaugcagacagcccgccccaaagaaaaa

SEQ ID NO: 115125 - RNA, 64 nt, Human
ugugcaauaucuguguaauguagaauguggggugugcaugcagaugucugguacuggaguaagc

SEQ ID NO: 115126 - RNA, 64 nt, Human
gguuuuccuuucgacgcaguguaggucaaaagaaugcaugcacgcuucuaaaugaaucuugucu

SEQ ID NO: 115127 - RNA, 64 nt, Human
gcaaagggggacucgaaccagaugucguguguuuugcaugcaugcuucuuuuccccaugccgcg

SEQ ID NO: 115128 - RNA, 64 nt, Human
uuuagggccagggauuauuuuaaccuuaaaauugugcaugcaucauuguagcccucaauauuug

SEQ ID NO: 115129 - RNA, 64 nt, Human
acuguuuggugaagcccgcaaaaccuccucgcuuugcaugcaugaacgugccaagccagcauag

SEQ ID NO: 115130 - RNA, 64 nt, Human
aucguguaaaacgagaauccacccauccuaccaaugcaugcagccacugugcugaauucugcaa

SEQ ID NO: 115131 - RNA, 64 nt, Human
uguuuuaaguaaacaaaaauuuuucuuucuuuacugcaugcauagcacuuaauaaaauggauuu

SEQ ID NO: 115132 - RNA, 64 nt, Human
ccugggagaugcacaagacaaauguucuaaugacugcaugcacugcuuaaguauuggccaacac

SEQ ID NO: 115133 - RNA, 64 nt, Human
ggguauuucuaaugccuguucagggcugguuuucugcaugcacggguauacacauaaugcagug

SEQ ID NO: 115134 - RNA, 64 nt, Human
cacauauaaaucagaguuaauauaugaacgcgugugcaugcacaagugugugugugccugcgug

SEQ ID NO: 115135 - RNA, 64 nt, Human
guagggaguccacggagaagaugcagugaaugcuugcaugcauucacacgugugugugucccag

SEQ ID NO: 115136 - RNA, 64 nt, Human
gcuguuuacaaccaugaccccuuggacacuggacugcaugcacuuuacauaucacaaaaugcuc

SEQ ID NO: 115137 - RNA, 64 nt, Human
gaauaauggcuaucaaguggagaugugcuuugacugcaugcauggugacaucuuuggaaauuca

SEQ ID NO: 115138 - RNA, 64 nt, Human
uuccaagauaaauauguguguuuacacauaugucugcaugcaugugaacacacacacacacaca

SEQ ID NO: 115139 - RNA, 64 nt, Human
ccauuuauguuuccugcuguaaagccaggguagcugcaugcacuggcauuugaacagggugaga

SEQ ID NO: 115140 - RNA, 64 nt, Human
ccuguaauaauacugagcucuuggaagcgaaucaugcaugcaauuagcucccuccuccucaccu

SEQ ID NO: 115141 - RNA, 64 nt, Human
gaaguuuaccugaagugauacugcauauuuuuggugcaugcauucccauagauuuuuacaucuc

SEQ ID NO: 115142 - RNA, 64 nt, Human
uugacgaagaauguuuuuauuuuuauuuuuuucaugcaugcauucucaagaggucgugccaauc

SEQ ID NO: 115143 - RNA, 64 nt, Human
cucccuuguggacaggcagggagaugcaugcgagugcaugcagcaggggauggggccguguccg

SEQ ID NO: 115144 - RNA, 64 nt, Human
gaaaguuuagccaccugugcuuucugacucagagugcaugcaacaguuagaucaugcaacaguu

SEQ ID NO: 115145 - RNA, 64 nt, Human
aaggagaaaaaauucuaguauauuuuaagagaugugcaugcauucuauuuagucuucagaaugc

SEQ ID NO: 115146 - RNA, 64 nt, Human
aaacauauucuguucacuugaguguaauacuugaugcaugcacacacacacacacauaccuucu

SEQ ID NO: 115147 - RNA, 64 nt, Human
ccuggguugugcuaaaaauaaaugcaaugauugaugcaugcaauuuuuuauacaaauaauuuau

SEQ ID NO: 115148 - RNA, 64 nt, Human
ccacauuccauuugguagcaauaugcggucugaaugcaugcauucaugaguccauguggccaag

SEQ ID NO: 115149 - RNA, 64 nt, Human
ugcccuccuacauaaauaagcaauugcaguguuuugcaugcaaaauauaaaaaauuuaaauugu

SEQ ID NO: 115150 - RNA, 64 nt, Human
acauuguauuuuacuuugugcaauaugaggggacugcaugcaagcucagggugcucccuccuca

SEQ ID NO: 115151 - RNA, 64 nt, Human
ccuccucacacauacaugugcacaugcacacacaugcaugcacacacaugcacacauacacgca

SEQ ID NO: 115152 - RNA, 64 nt, Human
caugcacacauacacgcacaugcacacauacacaugcaugcacacauacacaggcauacaugca

SEQ ID NO: 115153 - RNA, 64 nt, Human
cauacacaugcaugcacacauacacaggcauacaugcaugcacacacacaugcacgcacacaca

SEQ ID NO: 115154 - RNA, 64 nt, Human
cacacauacacgugcacacauacacaggcacacaugcaugcacacauacacaugcacacacaca

SEQ ID NO: 115155 - RNA, 64 nt, Human
ccucagucccuguagcccccugcccuggcacagcugcaugcacuucaagggcagccuuuggggg

SEQ ID NO: 115156 - RNA, 64 nt, Human
auauggugugcguguguauguauguguauguauaugcaugcauguguauaaagaugcacaugcg

SEQ ID NO: 115157 - RNA, 64 nt, Human
uuacguuugaagucugacaauccuugagaaucuuugcaugcagaggagguaagagguauuggau

SEQ ID NO: 115158 - RNA, 64 nt, Human
uggauugggcguggugaggauguuggcaaaccagugcaugcaccugguuggaagaugcucagcc

SEQ ID NO: 115159 - RNA, 64 nt, Human
acucugcugcucaugggaagaacagaauugcuccugcaugcaacuaauucaauaaaacugucuu

SEQ ID NO: 115160 - RNA, 64 nt, Human
gaugaagaaaugucuuuugcccguuuugauuacgugcaugcaaacagcgauuugcaaagaccgu

SEQ ID NO: 115161 - RNA, 64 nt, Human
ucagcaucauguuuuugugauacauccacauuguugcaugcagcuguaguuuguuucuuuuuau

SEQ ID NO: 115162 - RNA, 64 nt, Human
ucuaaaagucaguguuauuuaaacauuuucaaugugcaugcaugucauuauuacaucaaagcau

SEQ ID NO: 115163 - RNA, 64 nt, Human
uuggaauucagguacauuaagcuuuagugaagagugcaugcaguaauuccaaugugacugcaug

SEQ ID NO: 115164 - RNA, 64 nt, Human
cuguguucuuaaacaguauaaauaguuguaaguuugcaugcaugauggaaaaauaaaaaccugu

SEQ ID NO: 115165 - RNA, 64 nt, Human
cuugaguauuugucauucugcagaauauuguaauugcaugcauaccgauauuggagaaaucugg

SEQ ID NO: 115166 - RNA, 64 nt, Human
aacuuacugacccuuguuuuugccugugcuuguaugcaugcauuuucaagcaaguaauaaagca

SEQ ID NO: 115167 - RNA, 64 nt, Human
gcauuauuucuuuguuuugaagauucacucauguugcaugcaucuguagcuugugccuuuuuua

SEQ ID NO: 115168 - RNA, 64 nt, Human
ccaugugucugugaggcagggaacauguauucucugcaugcauguauguaggugccuggggagu

SEQ ID NO: 115169 - RNA, 64 nt, Human
cuauuuuccuauggacuuuugcauuauuucauugugcaugcauccagugauuauacauaagcaa

SEQ ID NO: 115170 - RNA, 64 nt, Human
ugguauugcauugguuuuuaugguaacuagguuuugcaugcaauuaaaaauccuuauuucuugu

SEQ ID NO: 115171 - RNA, 64 nt, Human
uaucuagagugugcccaucuguguuuaguacacaugcaugcauacacacccauacaaacaucug

SEQ ID NO: 115172 - RNA, 64 nt, Human
aaauguucauaacgccauugaagggauuauuucuugcaugcauaugcugaauuuuuuuaagcaa

SEQ ID NO: 115173 - RNA, 64 nt, Human
cuggugcuagcugcaccgugaccgcucagacgccugcaugcagcaggcguguguuccaguggau

SEQ ID NO: 115174 - RNA, 64 nt, Human
aagaaaugccucuauguaggugaaguguucucucugcaugcaacaguaaaaauuaauauaauau

SEQ ID NO: 115175 - RNA, 64 nt, Human
gaggaggaaaaaauacacauaauacaaacauacaugcaugcacacauacauacauauguauaca

SEQ ID NO: 115176 - RNA, 64 nt, Human
uuuucuuuucuggaacagugggaauuaaggcuacugcaugcaucacuucugcauuuauuguaau

SEQ ID NO: 115177 - RNA, 64 nt, Human
aucuguucuguuucaccauguaacacacaauacaugcaugcauuguauuaguguuagaaaacac

SEQ ID NO: 115178 - RNA, 64 nt, Human
gcuggaauucugccaguguuucuuugcuaagccuugcaugcaaaauuugaaauuuuaacauugg

SEQ ID NO: 115179 - RNA, 64 nt, Human
ccccuccccaucucccucucaaccucaacccaccugcaugcaucucccccagaggaaacacuga

SEQ ID NO: 115180 - RNA, 64 nt, Human
guagauagagacuuagucagauuuuacuaugguuugcaugcacucuguguguguguguacgugu

SEQ ID NO: 115181 - RNA, 64 nt, Human
gcuuguucaacauuugauauucaguguaauccauugcaugcauuagcagcucaaagaugaaaua

SEQ ID NO: 115182 - RNA, 64 nt, Human
ugaccaggucagcugcccuggccuugcaccccucugcaugcagcacagaagggugugaccaugc

SEQ ID NO: 115183 - RNA, 64 nt, Human
ugcccuccacagggaauacagcauccuuacagcuugcaugcaaucaaccucuuuuguaaaugga

SEQ ID NO: 115184 - RNA, 64 nt, Human
ugcugccauuugaauuagaagaaaauaauuuauaugcaugcacaggaagauauugguggccggu

SEQ ID NO: 115185 - RNA, 64 nt, Human
auucaagguuauauucuuuuaaguguuguuagucugcaugcacauuggcaguaaacuaguuacu

SEQ ID NO: 115186 - RNA, 64 nt, Human
uggcauaaguuuauuuucuuucaguuuaguucagugcaugcacuaauaaaacugguuguuuaau

SEQ ID NO: 115187 - RNA, 64 nt, Human
uuagucugucaacuucggaaugugugcgugugugugcaugcacacgcauguauguaucuguucc

SEQ ID NO: 115188 - RNA, 64 nt, Human
auacagcacugaaaagagagauaaagucccugccugcaugcauucuggcggaagagacaagcaa

SEQ ID NO: 115189 - RNA, 64 nt, Human
ucggaaccgaugugugcuuuagggaauuuuaaguugcaugcauuucagagacuuuaagucaguu

SEQ ID NO: 115190 - RNA, 64 nt, Human
ccgacaccauuguuccuuucacacuuuccuuuguugcaugcaguuggguucaaaugccaaauag

SEQ ID NO: 115191 - RNA, 64 nt, Human
uucacccaugaauggaugcaggaauuguguuccgugcaugcaguggaauaguaccagccuuccg

SEQ ID NO: 115192 - RNA, 64 nt, Human
uuuugaaaccuguguauuucuuuuucgggguuucugcaugcaguggcagucuuaagugccaaaa

SEQ ID NO: 115193 - RNA, 64 nt, Human
ccuuguucaacauuugauauucagugcaauccauugcaugcauuagcaguucaaagauuaaaua

SEQ ID NO: 115194 - RNA, 64 nt, Human
aagccagcguccuccucugugaccaaugucuugaugcaugcacuguucccccugugcagccgcu

SEQ ID NO: 115195 - RNA, 64 nt, Human
caucucucaguauuccuugaacuugccaugcuucugcaugcagauucuucacugacuugaauug

SEQ ID NO: 115196 - RNA, 64 nt, Human
aagggggauguacauauauucucugaaacuaggaugcaugcaauuguguuggaaguguccuugg

SEQ ID NO: 115197 - RNA, 64 nt, Human
augcagaggcucagugaaguauauaugugggaagugcaugcauuucguuuauuagcaaacauag

SEQ ID NO: 115198 - RNA, 64 nt, Human
auggcugggacgggugacagugugagugcaugugugcaugcauguguguaugugugugugugug

SEQ ID NO: 115199 - RNA, 64 nt, Human
uucuauucauagcuuauccuucagagcaaugaccugcaugcagcaauaucaaacaucagcuaac

SEQ ID NO: 115200 - RNA, 64 nt, Human
aauuacaaaagcggcagcagccaaugcacgccccugcaugcagcccucccgcccgcccuucgug

SEQ ID NO: 115201 - RNA, 64 nt, Human
uauuucugacugcauguuuacuuaaucagguugcugcaugcaauaaauuuuauauccaaugucu

SEQ ID NO: 115202 - RNA, 64 nt, Human
ccacugcagcacaggaucagauggccgugugcugugcaugcaggagccucgccuucugugucuu

SEQ ID NO: 115203 - RNA, 64 nt, Human
aacgguaaugaacagauagcacuggggcagaauaugcaugcauuuuguaacguccaguguggcg

SEQ ID NO: 115204 - RNA, 64 nt, Human
uugccgugggcccccucgccagccacucaccagcugcaugcacugagaggggagguuuccacac

SEQ ID NO: 115205 - RNA, 64 nt, Human
acuugucuuuucaagcaaauaacuaauauauaugugcaugcagucugccuugacaaguuguucc

SEQ ID NO: 115206 - RNA, 64 nt, Human
gcaccuggacuucuagggauuccuccuuagucgcugcaugcagaauucuaugacacucuaauua

SEQ ID NO: 115207 - RNA, 64 nt, Human
gugcagaggagggaguggugugccuguuugugugugcaugcaucuguugacacucaugauucug

SEQ ID NO: 115208 - RNA, 64 nt, Human
gguuuguagcuuccucccuacucucuccaacaccugcaugcaaagacuacugggaggcugcugc

SEQ ID NO: 115209 - RNA, 64 nt, Human
ggagccacuuccuguacagacccgaggaagccagugcaugcagaguucacccuuaccuauucgu

SEQ ID NO: 115210 - RNA, 64 nt, Human
agcauaacuacagccugcagcaugucugcacgugugcaugcauacacaccggguugacagauag

SEQ ID NO: 115211 - RNA, 64 nt, Human
gaauaaauaauauaauugguguagcacagugccuugcaugcaguaggcagccaacaaauccuua

SEQ ID NO: 115212 - RNA, 64 nt, Human
agguccugcgguacccauggggugaugcuacuucugcaugcaucuacagggcaucugacaccua

SEQ ID NO: 115213 - RNA, 64 nt, Human
agccguggggugacuucccuggucaccaaggcagugcaugcauguugggguuuccuuuaccuuu

SEQ ID NO: 115214 - RNA, 64 nt, Human
ugaggcaccugcaccugcucuagcucaucauccaugcaugcaccucuuuccauggcucggcucu

SEQ ID NO: 115215 - RNA, 64 nt, Human; identical to SEQ ID NO: 115213

SEQ ID NO: 115216 - RNA, 64 nt, Human
ugggcaaagcuaucuuccccaaguggaaccucagugcaugcaaaucucugaugguggcuuccag

SEQ ID NO: 115217 - RNA, 64 nt, Human
aucucuuguguaccagcugcugugcugggugccuugcaugcacggacuuaucugaucuuccuca

SEQ ID NO: 115218 - RNA, 64 nt, Human
caaggaacacaguuuccuucagcucccaucccuaugcaugcaucaugguccccccaaaaggagg

SEQ ID NO: 115219 - RNA, 64 nt, Human
gaaaaaccgaauuggguuuagucaaucacugcacugcaugcaaacaagaaacgugucacacuug

SEQ ID NO: 115220 - RNA, 64 nt, Human
ccagggcccuagggcuaagggccugcaccuugcgugcaugcagcaggcaacaacugccccuucu

SEQ ID NO: 115221 - RNA, 64 nt, Human
gaauguuuaaagcacaaaggacuuugggugugugugcaugcacauguguguguuuuccaugagg

SEQ ID NO: 115222 - RNA, 64 nt, Human
uuuuugcauacaagccgaacguuugugcuucccgugcaugcagucaaagacucagcacagguuu

SEQ ID NO: 115223 - RNA, 64 nt, Human
auucucauaggagcacaaauccuauugugaacucugcaugcaagggaucuaggcuaugcgcucc

SEQ ID NO: 115224 - RNA, 64 nt, Human
ugaauaccuaagauuucugucuuggggcuuuuggugcaugcaguugauuacuucuuauuuuucu

SEQ ID NO: 115225 - RNA, 64 nt, Human
caugauccaaagauauaagaaauuuugauaugucugcaugcagcacagaacuuugaaccuagga

SEQ ID NO: 115226 - RNA, 64 nt, Human
ugggaagaagugacaugucaucccuugauaugucugcaugcaagguccacacccaaaaguguca

SEQ ID NO: 115227 - RNA, 64 nt, Human
guuaggggccugucucugcaccugucuguccaucugcaugcaguauucucacccauguugaaug

SEQ ID NO: 115228 - RNA, 64 nt, Human
aaaaugaugaaaaaaaaaaaggcuuuacuucuuuugcaugcacuuuaaaaacaaaacaaaacau

SEQ ID NO: 115229 - RNA, 64 nt, Human
guuaagagagucacuagucagaauguuaaaggagugcaugcaggaugccccaaaugucgugaac

SEQ ID NO: 115230 - RNA, 64 nt, Human
ccuaaguacccugacuugaucauuacaccuucuaugcaugcaacaaaaugccacguguacccca

SEQ ID NO: 115231 - RNA, 64 nt, Human
ugaaauaaaucaaaacauacaauggcaaguaguaugcaugcauauucaagagacucuuccauuu

SEQ ID NO: 115232 - RNA, 64 nt, Human
guacccaccacaaacgugcaagcuccugcacacaugcaugcacacaaacguguacacaagugug

SEQ ID NO: 115233 - RNA, 64 nt, Human
guauuugguaacuugcugugaaaugacugcaucaugcaugcacucuuuugagcaguaaauguau

SEQ ID NO: 115234 - RNA, 64 nt, Human
gccccccaacccccaacccccucccgguccguguugcaugcacgcuguucaaaugugaggucug

SEQ ID NO: 115235 - RNA, 64 nt, Human
augcaaguucucguacgcccuggcccgaggaggcugcaugcacuuucacuguacccagugccgc

SEQ ID NO: 115236 - RNA, 64 nt, Human
aggggaggugggcuggaucugugacugauugaaaugcaugcaaauaaaaaagacaauauuaaag

SEQ ID NO: 115237 - RNA, 64 nt, Human
caucucuccugcacacuuuagucagaaggacuucugcaugcaguuugucuuucuguucugcagg

SEQ ID NO: 115238 - RNA, 64 nt, Human
gccuccuagcucaggacaguggcgacugcccggcugcaugcacuccgauuacccacgugcugcc

SEQ ID NO: 115239 - RNA, 64 nt, Human
aggggcauccauccccaagcaccuccucaugcugugcaugcagucuuaaauucaauggacaaaa

SEQ ID NO: 115240 - RNA, 64 nt, Human
uggcuaagcuagauaacuguaugcugucucuuuuugcaugcacuacuauccaggaugguaaacc

SEQ ID NO: 115241 - RNA, 64 nt, Human
uagaacaacacacagaagaauugguccaguuaagugcaugcaaaaagccaccaaaugaagggau

SEQ ID NO: 115242 - RNA, 64 nt, Human
aacauagauauugcuuguauauuaugcaguugacugcaugcacacuuuacauuuauuuauaauc

SEQ ID NO: 115243 - RNA, 64 nt, Human
gccaucagcucuggcuguguaggggaggaaggggugcaugcaugucccccacccuccacagucu

SEQ ID NO: 115244 - RNA, 64 nt, Human
cauguucauucuucaaaccaguguuuuggaaguaugcaugcaggccuauaaaugaaaaacacaa

SEQ ID NO: 115245 - RNA, 64 nt, Human
ucuucacuuaaauaccucaguucuucuuuucuuuugcaugcauuuuuccccuguuuggugcuau

SEQ ID NO: 115246 - RNA, 64 nt, Human
ucacauaaauuucuuacuauacuuuucauaauguugcaugcauauuucaccuaccaaagcugug

SEQ ID NO: 115247 - RNA, 64 nt, Human
aucgcaugacuauaacuuaagucuuucuucaaagugcaugcagucuuuugcgauaccucauuca

SEQ ID NO: 115248 - RNA, 64 nt, Human
uuuaggaugacuguauucgaggagugccguguguugcaugcagcuacccguaggaagacuucgc

SEQ ID NO: 115249 - RNA, 64 nt, Human
cuacccuccugcugagcugccccugcugcuuaagugcaugcauugagcugccuccagccuggug

SEQ ID NO: 115250 - RNA, 64 nt, Human
uuuuggagggcugugauuuuuccaguauuaaacaugcaugcauuaaucuugcaguuuauuuucu

SEQ ID NO: 115251 - RNA, 64 nt, Human
uugucuguaauggugauugggucuccacuguagaugcaugcaguguucacuccaaccucagagg

SEQ ID NO: 115252 - RNA, 64 nt, Human
gcguuguuucuugaugugggaggggagguguuagugcaugcaaggguugaacuagauagacccu

SEQ ID NO: 115253 - RNA, 64 nt, Human
ucugugauggcuuugcaguaagugccgccuggccugcaugcauuggcuaacaggcugcagaaug

SEQ ID NO: 115254 - RNA, 64 nt, Human; identical to SEQ ID NO: 115247

SEQ ID NO: 115255 - RNA, 64 nt, Human
aaaugccucaucuguuguacugaacaauugaaacugcaugcagccauaaaagggacaagaaaca

SEQ ID NO: 115256 - RNA, 64 nt, Human
uuauuacauccauuucuguaacauaauaauauguugcaugcaguuauauuuucuauuuagucug

SEQ ID NO: 115257 - RNA, 64 nt, Human
ccauucugaacgccacgccuggcccggucagugcugcaugcacugcauaugaaauaaaaucugc

SEQ ID NO: 115258 - RNA, 64 nt, Human
agcuucaaaacuagaaggaucuacuccgcaugggugcaugcagaggcuccuggaucugggaagc

SEQ ID NO: 115259 - RNA, 64 nt, Human
auaggucaguguaaagaaauaugauuugagguggugcaugcaaguaacuaggguuuauucuaua

SEQ ID NO: 115260 - RNA, 64 nt, Human
aaaccuccagcuuccacaguauauuaccugccguugcaugcauuugaaaguuagccuccucccu

SEQ ID NO: 115261 - RNA, 64 nt, Human
cccugcacugagcggguuuaggggcucgcccacaugcaugcaggccaagacagcaaaugccagc

SEQ ID NO: 115262 - RNA, 64 nt, Human
gaggacggaucuagcuccuguauauauauuuuauugcaugcacugugaccuuggggggagaaca

SEQ ID NO: 115263 - RNA, 64 nt, Human
ucuagucuguccacacagggauuaccugucaucuugcaugcaaucaggagaaucucauaggggc

SEQ ID NO: 115264 - RNA, 64 nt, Human
aauaaauuuaaaaaaaauuagcugagugugguggugcaugcauguaguuccagcuacucaggag

SEQ ID NO: 115265 - RNA, 64 nt, Human
uguaugcaugugaguguguguguaugugugugugugcaugcauaugcaugugcaugugugugag

SEQ ID NO: 115266 - RNA, 64 nt, Human
cugccuguuucccccaaagacaauggcuggacccugcaugcagggcuggggguggaauggggcu

SEQ ID NO: 115267 - RNA, 64 nt, Human
cugccuuggccucccaaagugcugggacuacaggugcaugcaaccacaccuggcuaauuuucuu

SEQ ID NO: 115268 - RNA, 64 nt, Human
uucccggucuguucuguuccacucugaccaucggugcaugcagccccugucaccuacccccugc

SEQ ID NO: 115269 - RNA, 64 nt, Human
uauauguguucacgugugcuauguguguuaagccugcaugcauggguguggggguaugugcccu

SEQ ID NO: 115270 - RNA, 64 nt, Human
ccgucugccuccgcacggcuggcagagggcaggcugcaugcaguggcggcuacugggcccugcc

SEQ ID NO: 115271 - RNA, 64 nt, Human
ccguggcugugggcagcauccacacgguuagccgugcaugcacuuuguggccccuuugcaaggg

SEQ ID NO: 115272 - RNA, 64 nt, Human
uuauucuuuaauuguugcuuuuacggugauauugugcaugcaaaccaggagcauuuugugucuu

SEQ ID NO: 115273 - RNA, 64 nt, Human
ugcaugccgcugcauccgugagcagugugucuccugcaugcagaaagggagcagagaaggccag

SEQ ID NO: 115274 - RNA, 64 nt, Human
ccggggaaagcaaucauugguguguauguguaugugcaugcacacacgugcauauacacauuug

SEQ ID NO: 115275 - RNA, 64 nt, Human
gcccagccggcccucugggcagacugucaucacaugcaugcauaaaccggcaugugugccaaug

SEQ ID NO: 115276 - RNA, 64 nt, Human
aauauacaaauuuugaauaaaagaucaugggcaaugcaugcacauuaugaaacuuaugucauua

SEQ ID NO: 115277 - RNA, 64 nt, Human
ucuuccuccacccgcucuuccuucccagccugccugcaugcaugugcacccuuggucuucgcuc

SEQ ID NO: 115278 - RNA, 55 nt, Human
aagacgaggcugcauccugagccccugcaugcacccagggccacccggcagcaca

SEQ ID NO: 115279 - RNA, 64 nt, Human
cuuuaauacaguguuucuaccucucauuuguaacugcaugcauuauucuugaaacuagguaaaa

SEQ ID NO: 115280 - RNA, 64 nt, Human
uguuuuuguuagcuuuugguuccauuuuuuauugugcaugcagaauguacauugaugccuguga

SEQ ID NO: 115281 - RNA, 64 nt, Human
uuuuauaauauuuuggucauuuuacuguuucuggugcaugcaggguuuggguguuuuucagugu

SEQ ID NO: 115282 - RNA, 64 nt, Human
cuucaggcagaagcucuccggaggauccagguggugcaugcauuugacaucuuccagaugcugg

SEQ ID NO: 115283 - RNA, 64 nt, Human
ugugugugcaugcaugugugugcaugugugugugugcaugcaugugugugugugugcaugugug

SEQ ID NO: 115284 - RNA, 64 nt, Human
ugugugcacgugaacgcgugcguguuugugugugugcaugcaugugugugcaugugugugugug

SEQ ID NO: 115285 - RNA, 64 nt, Human
ugcgugugcauguuugugugcauguaugcgugugugcaugcauguguguguaaguaugugguau

SEQ ID NO: 115286 - RNA, 64 nt, Human
gggcagcacuguggccagcugucugucuuuacacugcaugcagaaguuuaaacacugaagugcc

SEQ ID NO: 115287 - RNA, 64 nt, Human
ucucagacacuucccccacccucauagaaccuguugcaugcaacuuaguuucacagcuuugccu

SEQ ID NO: 115288 - RNA, 64 nt, Human
cuaacuggaguaacuuugcuguuuugcugcuuguugcaugcacacaggaauggaaagcgagcuc

SEQ ID NO: 115289 - RNA, 64 nt, Human
cacggucuuuguuucugauuccuuuuaggggaauugcaugcaaacuagacugaaaugauacaaa

SEQ ID NO: 115290 - RNA, 64 nt, Human
guugguagacaaagucauaccacccagggcagccugcaugcagcgagucugcguggcuucccug

SEQ ID NO: 115291 - RNA, 64 nt, Human
ucauuuuggcguuguuucugggaguggaaugcuuugcaugcauugguacgaugacaaacaacua

SEQ ID NO: 115292 - RNA, 64 nt, Human
augccccucauaguguaggcuaaggugaguuuggugcaugcaaaccugugugcucacccacaga

SEQ ID NO: 115293 - RNA, 64 nt, Human
gcuuuuauaugcagaacugguuugugaggaaacaugcaugcagcugugggaagauagaaagcug

SEQ ID NO: 115294 - RNA, 64 nt, Human
ucugaguguugauggcaacagcuuggaagaugauugcaugcauccucauaaucauguauucaau

SEQ ID NO: 115295 - RNA, 64 nt, Human
uaguauuagaucugaucaagguaggaauuacaauugcaugcagguagcaagcaagaaagcagaa

SEQ ID NO: 115296 - RNA, 64 nt, Human
aucugcccaggaaagggaugcauugacacucuccugcaugcaccuggcgagaagccaccugaaa

SEQ ID NO: 115297 - RNA, 64 nt, Human
acucauuuucagguaccuaauguagcugcuagcaugcaugcacaacaauacaauuuauauggua

SEQ ID NO: 115298 - RNA, 64 nt, Human
ggcggguguggagaccaggcuccugaccccgccaugcaugcagcgccaccuggaagccgcgcgg

SEQ ID NO: 115299 - RNA, 64 nt, Human
agcaggaggggguguguuuccuuuuuguggguguugcaugcaaaucaaguggacaagaaaaaau

SEQ ID NO: 115300 - RNA, 64 nt, Human
gagucgggccccaggucgcccccgcccccagcccugcaugcaggugcccucgcuccgccccauc

SEQ ID NO: 115301 - RNA, 64 nt, Human
ugguguaguguauucucuaaaagcuuuaaaugucugcaugcagccagccaucaaauagugaaug

SEQ ID NO: 115302 - RNA, 64 nt, Human
ccucccccaggcagaagagcaugcccuuugccguugcaugcaaccagcccugugauuccacgug

SEQ ID NO: 115303 - RNA, 64 nt, Human
gaaacuugaugggaguuggggagggacugaaggaugcaugcaagguucugggaaggagugagaa

SEQ ID NO: 115304 - RNA, 64 nt, Human
ugugacucccucccacacacgcuuaagacaccucugcaugcagucaaagccacugucacaagcc

SEQ ID NO: 115305 - RNA, 64 nt, Human
gucugccugggccacagcccucucacccugguacugcaugcacgcaaugcuagcugccccuuuc

SEQ ID NO: 115306 - RNA, 64 nt, Human
gcuacucugacaucccgaguuucuguccacacauugcaugcacagcgccccacacauuggauac

SEQ ID NO: 115307 - RNA, 64 nt, Human
agcccccuuaugaguacccaagaaggacugucuaugcaugcacacccacaagccuauacaccau

SEQ ID NO: 115308 - RNA, 64 nt, Human
cccaaccacccagggccaccaucagacaacucccugcaugcaaaccccuaguacccucucacac

SEQ ID NO: 115309 - RNA, 64 nt, Human
auuuaguugugagcauccucccgaugcuucaagcugcaugcauuaacagacaguuuaauuaagc

SEQ ID NO: 115310 - RNA, 64 nt, Human
aagccaguuaacaguuaauuaccagauauguuugugcaugcagugauuuugaaaaauauaauac

SEQ ID NO: 115311 - RNA, 64 nt, Human
uggugugcuguauucucuaaaaccuuuaaauguuugcaugcagccauucgucaaaugucaaaua

SEQ ID NO: 115312 - RNA, 64 nt, Human
uuguauguuaacaguacuuuauugagguguaaucugcaugcaguaacaugcacaagucucaagu

SEQ ID NO: 115313 - RNA, 64 nt, Human
uacagaauuuauuuggaaaucaccaguuuuaacaugcaugcauuuuuguuuguuuuuuauaugu

SEQ ID NO: 115314 - RNA, 64 nt, Human
acuugguggauucuugggucccugugggaccuugugcaugcaugguccucucugagccuugguu

SEQ ID NO: 115315 - RNA, 64 nt, Human
aagcuacacuggaggaauuuuuauagccuuugaaugcaugcauauacaugaaaaucugaaagau

SEQ ID NO: 115316 - RNA, 64 nt, Human
ucugcucggugcccuccacgugaggcggggcaccugcaugcacugggagggggcggcuggccca

SEQ ID NO: 115317 - RNA, 64 nt, Human
acaaaaaacagugcauuagcaauuucauagcaagugcaugcacuaggaaaagaaaacucugucu

SEQ ID NO: 115318 - RNA, 64 nt, Human
ggccucugccuccacccuccuccucuucaccaggugcaugcaugcccucucugagucuggacuu

SEQ ID NO: 115319 - RNA, 64 nt, Human
guggagcacgcguggcuccuggaggacuuggagaugcaugcacauuuaggguguuuucccuaga

SEQ ID NO: 115320 - RNA, 64 nt, Human
uccgcucuggaacucacucucagccacagggagcugcaugcaccacaggggcaaugcaccuuug

SEQ ID NO: 115321 - RNA, 64 nt, Human
gccaggaagggaaggagucugugugguguguaugugcaugcagccuacacccacacguguguac

SEQ ID NO: 115322 - RNA, 64 nt, Human
ccuccagauccugcuggcaucaccuccagagcccugcaugcacuggcugaagaguuggucugug

SEQ ID NO: 115323 - RNA, 64 nt, Human
uaucagagguaggguggucuuuagcacaaagacuugcaugcagagaucccuggcagaacaccca

SEQ ID NO: 115324 - RNA, 64 nt, Human
gcccagcccucccuggggccugcgggagcccuuuugcaugcaagggaggauggaggcuggcccc

SEQ ID NO: 115325 - RNA, 64 nt, Human
aaauaugauuucauaaauguaaaaugcacagaaaugcaugcaauacuuauaagacuuaaaaauu

SEQ ID NO: 115326 - RNA, 64 nt, Human
cagagcacacugcacacaugcacacacacacgcgugcaugcacacuccucgcacuuccagccuu

SEQ ID NO: 115327 - RNA, 64 nt, Human
acaaucguucuguguuugauauuuguguaaaguaugcaugcagucuuguacugugaccuaagaa

SEQ ID NO: 115328 - RNA, 64 nt, Human
gccuuuguugucucaaauuggguuuguacacacaugcaugcauguguguauacaacuguaaucu

SEQ ID NO: 115329 - RNA, 64 nt, Human
aagcugauaguguuucguuaagcaguacaucuugugcaugcaaaaaugaauucaccccucccac

SEQ ID NO: 115330 - RNA, 64 nt, Human
gcacagaggaggccaaggagagguuguuuguucaugcaugcauucauccgugacacaugaguac

SEQ ID NO: 115331 - RNA, 64 nt, Human
ugugacagagagagagcgagagagccugugugugugcaugcaggggugagguauuuucacugcc

SEQ ID NO: 115332 - RNA, 64 nt, Human
ucauucugcauacuuggacacuaaagccaggaugugcaugcaucuugaagcaacaaagcagcca

SEQ ID NO: 115333 - RNA, 64 nt, Human
gugugggacuuaagucaccauaauuuugaagacuugcaugcagagggcuccaggaauuguagac

SEQ ID NO: 115334 - RNA, 64 nt, Human
agaccucaccaccacaccugcacucaccccaccuugcaugcaccuugcuaccugcuugcggcuu

SEQ ID NO: 115335 - RNA, 64 nt, Human
uggcaggugggagucuaaugcagucaggagcauuugcaugcaguggguggagagucggccacca

SEQ ID NO: 115336 - RNA, 64 nt, Human
accccucgccuucaggagaaucuacacgcauguaugcaugcacaaacauguguguacaugugcu

SEQ ID NO: 115337 - RNA, 64 nt, Human
uuccauuaaguguguagauugagcagguaguaauugcaugcaguuuguacauuagugcauuaaa

SEQ ID NO: 115338 - RNA, 64 nt, Human
uggugggaaucaaugcuguuucacucaaaaguguugcaugcaaacacuucucuuuauucugcau

SEQ ID NO: 115339 - RNA, 64 nt, Human
aauaguccauauugaauuuaauuaaaacaagggaugcaugcagucaaauugauaguuuaauucu

SEQ ID NO: 115340 - RNA, 64 nt, Human
acuggauacuuguucuuuugucagauuuguuaaaugcaugcagaauaauauuuuuaagaguauu

SEQ ID NO: 115341 - RNA, 64 nt, Human
uuuuauaauaaauuauguuauuauguaaacgaauugcaugcauguugaaauuuuuuagcaguac

SEQ ID NO: 115342 - RNA, 64 nt, Human
aacuaggcacauccgcagugcgcaugugugugcgugcaugcacauauguguauguguguggauc

SEQ ID NO: 115343 - RNA, 64 nt, Human
aucucuucucggggacaacaucugaaggguauguugcaugcauuaaaaaaaaucaucucacaug

SEQ ID NO: 115344 - RNA, 64 nt, Human
uguguggccuauuucccccgucagguugcacaggugcaugcaagagcauucuuaggagaccacu

SEQ ID NO: 115345 - RNA, 64 nt, Human
agguaggcauuacaugcauauguauguagacauaugcaugcauguauauguaaaauauauacuu

SEQ ID NO: 115346 - RNA, 64 nt, Human
auguacuaguggcauggagaaugcaccauacucaugcaugcaaauuagacaaccaaguaugaau

SEQ ID NO: 115347 - RNA, 64 nt, Human
uggugaaugucaugaugauuuuuaacaugcauuuugcaugcaucccccaauaagaagagaugag

SEQ ID NO: 115348 - RNA, 64 nt, Human
cccuucucuuggggacaacaucugaaggguauguugcaugcauuuuuaaaaaaaucaucucaua

SEQ ID NO: 115349 - RNA, 64 nt, Human
accacaauagcuguauuuuucccaauccccuuaacgaucauaaaagaggcaaguuaaguauuuc

SEQ ID NO: 115350 - RNA, 64 nt, Human
guugaaacuucagacaggguugauaaagugaggacgaucauagacauggaguacuuagacauau

SEQ ID NO: 115351 - RNA, 64 nt, Human
uggaucugccugguucucaauuugacacccuaagcgaucauacucaagaauaguacagaugugu

SEQ ID NO: 115352 - RNA, 64 nt, Human
uuaugcccuugagucuagauggauauuagaugcccgaucauauagauauuuuuaagugcaacau

SEQ ID NO: 115353 - RNA, 64 nt, Human
caaaacuuuuagaucugaaauacagccaugugaucgaucauauucuaaaggcuauuuaaaacau

SEQ ID NO: 115354 - RNA, 64 nt, Human
guaaacaaaacccacgcgaaugggcacuuguacccgaucauaauaaaaauggauaauaauguga

SEQ ID NO: 115355 - RNA, 64 nt, Human
cccaacaacuucauuccuagccaugaaaguagcacgaucauauuguacuguauuguuauuguaa

SEQ ID NO: 115356 - RNA, 64 nt, Human
aucuuccauggccguuccuugucccacccccacccgaucauaccuuccccccucugccacagcu

SEQ ID NO: 115357 - RNA, 64 nt, Human
cuugcucaauuucuuaggcuggagugcaguggcacgaucauagcucacugaaguuucgaccugg

SEQ ID NO: 115358 - RNA, 64 nt, Human
aaaacaccaauacccagauuuaaaaaaaaaaaaacgaucauagucuuaggaguucauuuaaacc

SEQ ID NO: 115359 - RNA, 64 nt, Human
cucacucugucacccaggccagagugcaguggcacgaucauaguuaccgcagcaucaaauuccu

SEQ ID NO: 115360 - RNA, 64 nt, Human
ccauugcaugcauuagcagcucaaagaugaaauacgaucauaucaauagguacagaaaaagcau

SEQ ID NO: 115361 - RNA, 64 nt, Human
augagaacucuaaaugaggugguguauggaaagccgaucauaauucauagaguagagugaaccu

SEQ ID NO: 115362 - RNA, 64 nt, Human
auuggaaaaaauuagacaagucuaguggaaccaacgaucauaucuguaugccucauuuuauucu

SEQ ID NO: 115363 - RNA, 64 nt, Human
ucugcccucugggucccuccucucaccucucccucgaucauauuuccccuuggacacuugguua

SEQ ID NO: 115364 - RNA, 64 nt, Human
cuugcucugucaugcaggcuggagugcgguggugcgaucauagcucacugcagccucgaacucu

SEQ ID NO: 115365 - RNA, 64 nt, Human
cuuacagugagacaacaggcgaugucagugagggcgaucauagggcauaagccuaagccauacc

SEQ ID NO: 115366 - RNA, 64 nt, Human
ugcccucauuagguuuaauuacaaaauuugaucacgaucauauuguagucucucaaagugcucu

SEQ ID NO: 115367 - RNA, 63 nt, Human
agaaucugcagaaauuaggaggcaccgagcccagcgcagcagccucggacccggauugcguuu

SEQ ID NO: 115368 - RNA, 63 nt, Human
aucucagggauagccagcagcagcuccaggucugcgcagcaggaauuacuuuuuguuguuuuu

SEQ ID NO: 115369 - RNA, 63 nt, Human
agcuguuccccucgggaacaugagguggugguggcgcagcagacugcgaucaauucugcaugg

SEQ ID NO: 115370 - RNA, 63 nt, Human
auguaugugcagacucuuggaugcuuuaugccugcgcagcaggagcccuguccucacguuccc

SEQ ID NO: 115371 - RNA, 63 nt, Human
cacacagaacuucugagaggggcuguuagcauugcgcagcaucuucaguucuccaguaaauga

SEQ ID NO: 115372 - RNA, 63 nt, Human
uagccccaggguuagagugggcagggcagagccgcgcagcaccugggagcgguaccuuucccu

SEQ ID NO: 115373 - RNA, 63 nt, Human
guuucagcccucauuuaauucaauuuguaaguagcgcagcagccucugugggggaggauaggc

SEQ ID NO: 115374 - RNA, 63 nt, Human
acagagcuuucaagaacacacaaugcaaagugagcgcagcauagcuguuaacaaacauacaac

SEQ ID NO: 115375 - RNA, 63 nt, Human
ggucuaggggaauccugccugccccauggaguugcgcagcacaacccuggcuccaauugccag

SEQ ID NO: 115376 - RNA, 63 nt, Human
gccgggacacugcugccagaccugcccccaggagcgcagcaguucggagcggcagccgagcgg

SEQ ID NO: 115377 - RNA, 63 nt, Human
cccagcccuacacuuugguuugucauggugucagcgcagcagccuacaacuaaguuccuaaac

SEQ ID NO: 115378 - RNA, 63 nt, Human
gcgcuaggaaaugacccgagaaccccguuggaagcgcagcagcgggagcuaggggcgggggcg

SEQ ID NO: 115379 - RNA, 63 nt, Human
ggccgcgcuccuccccuccuagaguucguggaggcgcagcagagggccgucccucuuccggau

SEQ ID NO: 115380 - RNA, 63 nt, Human
ccucuaaacucccuuacagcucucagccuaagagcgcagcacugaacagccucaucauuccac

SEQ ID NO: 115381 - RNA, 63 nt, Human
uucccacugcuuagagcgagagcagagcaaacugcgcagcaggcaccuccagaaagguaaugg

SEQ ID NO: 115382 - RNA, 63 nt, Human
gcgaugacaagucugaacccacgaaaauacccagcgcagcaucuacacauucaaaagauaagc

SEQ ID NO: 115383 - RNA, 63 nt, Human
ucuccacgcuagugugaacgccucugucccgaggcgcagcaauaauaaggcagcuguugaaug

SEQ ID NO: 115384 - RNA, 63 nt, Human
cccugaauccgugugcacacugcguauguguacgcgcagcaugcuauacugaacucaacaaga

SEQ ID NO: 115385 - RNA, 63 nt, Human
cagccucuuggagcagagugccccguggcaggagcgcagcaccaugucccugccccccgggcu

SEQ ID NO: 115386 - RNA, 63 nt, Human
gacgcgcucaacuucuucugugagcagcugcgggcgcagcagcggaguucgcuccaggagaag

SEQ ID NO: 115387 - RNA, 63 nt, Human
cagggcagcuuuccccaccuggugacaggcugugcgcagcagccccaggaccucacccugagc

SEQ ID NO: 115388 - RNA, 63 nt, Human
acuccauauauguuagucuuccuuuaucuuacagcgcagcauuuauuuuaugauauaaugaaa

SEQ ID NO: 115389 - RNA, 63 nt, Human
cagguugauacugccuggauggucaccucuggugcgcagcaagugcaaagccagugggggacu

SEQ ID NO: 115390 - RNA, 63 nt, Human
ugcuuucugugaaagccuuaagaagauaaaugagcgcagcagagauggagaaauagacuuugc

SEQ ID NO: 115391 - RNA, 63 nt, Human
uagccacguggccagcagcuaccacacuggucagcgcagcaccugaggaaaugcacugugugg

SEQ ID NO: 115392 - RNA, 63 nt, Human
aggauaaaaaaaaaaaaaaacaacuaauaccgggcgcagcaucuuuccagguguggcucugcg

SEQ ID NO: 115393 - RNA, 63 nt, Human
cuuagcacauccagucccagcguggcccuuggcgcgcagcagcaggcgaacucccagaaggug

SEQ ID NO: 115394 - RNA, 63 nt, Human
acacacacaaaauaaagacacacaaggacgucugcgcagcaagaaaagaaucucaguugccaa

SEQ ID NO: 115395 - RNA, 63 nt, Human
cugaucagagccgacaccagacgugauuagcaggcgcagcaaauucaauuuguuaaaugaaau

SEQ ID NO: 115396 - RNA, 63 nt, Human
agguaaccccagauucaugcacuguagggugcugcgcagcaucccuagucucuacccaguaga

SEQ ID NO: 115397 - RNA, 63 nt, Human
ccaauggugccaaacccuucaucuccccaagaagcgcagcauaccccugggaccccucggcca

SEQ ID NO: 115398 - RNA, 63 nt, Human
ggggccucucucccucucccuguccccaccccagcgcagcagcccuccccgcagcuagcagcg

SEQ ID NO: 115399 - RNA, 63 nt, Human
ggcccaggcagcucggacaccaggcugagcccggcgcagcaccugggcaguguccccacccca

SEQ ID NO: 115400 - RNA, 63 nt, Human
aaaugagauaacugggggcaaagguugggauaggcgcagcagcuauaagacaagcuccuacgc

SEQ ID NO: 115401 - RNA, 63 nt, Human
ccgccaagcugggggcaucggcaaggccaagcugcgcagcaugaaggagcgaaagcuggagaa

SEQ ID NO: 115402 - RNA, 63 nt, Human
ccaccuggccucugcacuccccugcuggguguggcgcagcauauucaggaagcucagggccug

SEQ ID NO: 115403 - RNA, 63 nt, Human
acugcccaucgggacgcccggccagccgcucgggcgcagcacaagggacaggggaccaagguc

SEQ ID NO: 115404 - RNA, 63 nt, Human
gcggauccgccaggcugagacccuggagcaagugcgcagcaucauggaugaggcgccacucac

SEQ ID NO: 115405 - RNA, 63 nt, Human
ccagugagaccggaggaugaucccccaaggacugcgcagcaucagcucuuggugggccucugc

SEQ ID NO: 115406 - RNA, 63 nt, Human
ucucuguguccucugcaguggggguuguggggggcgcagcauccacgccuugcugcccuucuu

SEQ ID NO: 115407 - RNA, 63 nt, Human
gaagaauggaaguuuggaucugcuccucgucaggcgcagcaucucugaagcuuggaaagcugu

SEQ ID NO: 115408 - RNA, 63 nt, Human
gccaacacaaguaggauugacuuaaacucuuaagcgcagcauauugcuguacacauuuacaga

SEQ ID NO: 115409 - RNA, 63 nt, Human
gaacagacagacagacgcacacacacaacagaugcgcagcaacuccccgcccagggaccccuc

SEQ ID NO: 115410 - RNA, 63 nt, Human
ccagcucucccagccccucagcuucgcagccuggcgcagcauccucugaggccccggggccug

SEQ ID NO: 115411 - RNA, 63 nt, Human
uuccacccuacagcuggccucggaccccgcccugcgcagcaagcugguccgccuguccuccga

SEQ ID NO: 115412 - RNA, 63 nt, Human
agaccaggucccaagggagcaagaccucgcgaagcgcagcagccccggcccuucccccguuuu

SEQ ID NO: 115413 - RNA, 63 nt, Human
cguggccuuuucccacagugcuuccuucucacugcgcagcaaaguucguccccuguggcaaga

SEQ ID NO: 115414 - RNA, 63 nt, Human
cuucuuagaagaggagugagaggaaggcggggggcgcagcaacgcaucguguggcccuccccu

SEQ ID NO: 115415 - RNA, 50 nt, Human; identical to SEQ ID NO: 31154

SEQ ID NO: 115416 - RNA, 63 nt, Human
ccaggggccucaugaaucucuccguugcccuccgcgcagcaggaggcugccuguguguuuccu

SEQ ID NO: 115417 - RNA, 63 nt, Human
gccauuccuauuaccuccccaggaggcaagugggcgcagcaccagggaaauguaucuccacag

SEQ ID NO: 115418 - RNA, 63 nt, Human
cuggucggccacaccagugucccaaagaggagagcgcagcagagccaggggucuguucuguag

SEQ ID NO: 115419 - RNA, 63 nt, Human
ggccguuugcugcgucuagggguguucuauguagcgcagcaguucgcagcgauugcgcagugc

SEQ ID NO: 115420 - RNA, 63 nt, Human
uuucuccucaccuaaacccaucuccuacuuugggcgcagcacacauauuuucuugucaacuuu

SEQ ID NO: 115421 - RNA, 63 nt, Human
ccuggcacuaccaaaggacacuuauccacgagagcgcagcauccgaccagguugucacugaga

SEQ ID NO: 115422 - RNA, 64 nt, Human
uuccuguucucuguucuccacuggaaagguuguuuacgacaaaccuccuugucaaaguguguaa

SEQ ID NO: 115423 - RNA, 64 nt, Human
acggguucccacgcugcugugacugcccugccucuacgacaaaagccaacgggucuucaguacu

SEQ ID NO: 115424 - RNA, 64 nt, Human
uucaagauacauuucaucugcugcugaaacuguguacgacaaagcaucauuguaaauuauuuca

SEQ ID NO: 115425 - RNA, 64 nt, Human
acuaaaucuuuaucuugaauuuuacacaacuacuuacgacaagggagauguuuagaccuguugu

SEQ ID NO: 115426 - RNA, 64 nt, Human
uaaggacugagaaaugaccauaucuuaaacuaucuacgacaaagugaacuuaaaaggacaugcc

SEQ ID NO: 115427 - RNA, 64 nt, Human
uaaauaaauaaauggucucagguuuaauuuguaauacgacaaacacuggaagauauaacccaca

SEQ ID NO: 115428 - RNA, 64 nt, Human
auuuagaaaggaaauauaauccaacuucucaccauacgacaacagaucauauuccugaaaagaa

SEQ ID NO: 115429 - RNA, 64 nt, Human
aaaucuaaagugaaaauuuugcuuagaaauaaaauacgacaaguuauguuuugaguuugaugcc

SEQ ID NO: 115430 - RNA, 64 nt, Human
cuuuggugaacauugcaauagaaauccaauuggauacgacaacuugcacguauuuuaauagcgu

SEQ ID NO: 115431 - RNA, 64 nt, Human
ucuuaaaucagucaccaguuccagaaaaguucuuuacgacaauguuuaaaaauuauuuuucuac

SEQ ID NO: 115432 - RNA, 64 nt, Human
uaccuuuggcuggaggugagcugcacugaaacuuuacgacaaaaugucucuggacaaagagagu

SEQ ID NO: 115433 - RNA, 64 nt, Human
aagaaaaucauauaaaaagcauuugaagaaauaguacgacaacuuauuuuuaaucacuuuuaaa

SEQ ID NO: 115434 - RNA, 64 nt, Human
gaccucagaggaguuuaacgcgaucuucacauuuuacgacaaggauagaagcggcuacauugac

SEQ ID NO: 115435 - RNA, 64 nt, Human
cgaucugaguacucuacucuugcucaagaaguaauacgacaaucagaauacaaaccaguaaggc

SEQ ID NO: 115436 - RNA, 64 nt, Human
cauuaaguuguaaaaugucaagaaauucugcuguuacgacaaagaaacauuuuacgcuagauua

SEQ ID NO: 115437 - RNA, 64 nt, Human
ggccuccacaccugccucaucacggcggcgaggcuacgacaauccggcugggagcaugaccuug

SEQ ID NO: 115438 - RNA, 64 nt, Human
cucccuccugaagaugaacacacaauacacggaagagcgccagccucugcuuucaggaaagguu

SEQ ID NO: 115439 - RNA, 64 nt, Human
gcuuugugcaggcagccccgacgguuuccacagcgagcgccagcuccggccagccugggacagc

SEQ ID NO: 115440 - RNA, 64 nt, Human
uaagaaggagauugagcgucugcagaaagaaauugagcgccauaagcagaagaucaaaaugcua

SEQ ID NO: 115441 - RNA, 64 nt, Human
uuccgcguuggaggcacguguucagagagcugcugagcgccacccucuacccggcugacagaca

SEQ ID NO: 115442 - RNA, 64 nt, Human
ugcuguggccugagcuccccagaguccugaggaggagcgccaguugccccucgcucacagacca

SEQ ID NO: 115443 - RNA, 64 nt, Human
agauccaaugccugcugccuccagacucuuucaugagcgccaaucucugccaggggcuccggcu

SEQ ID NO: 115444 - RNA, 64 nt, Human
cacagucuucugagcgagugcucucacuguauuagagcgccagcuccuuggggcagggccuggg

SEQ ID NO: 115445 - RNA, 64 nt, Human
ggugaugucugucugcugccaggauggagcagaggagcgccacacauggaggaaagccccugua

SEQ ID NO: 115446 - RNA, 64 nt, Human
auggacaggagccuugagcuggcgugugggaauugagcgccaugucaggcuguuguggguaucc

SEQ ID NO: 115447 - RNA, 64 nt, Human
accacucucagggauccugccccaaaugcggucggagcgccagugacccugaggaagcccgucc

SEQ ID NO: 115448 - RNA, 64 nt, Human
cuagugugugacucacaccuuguggcugccuucagagcgccaccuccagaucagauggggacac

SEQ ID NO: 115449 - RNA, 64 nt, Human
gagcgccaaggaaaagaaacuaucucggucacgugagcgccagcgaaaagaaacuguaucaguc

SEQ ID NO: 115450 - RNA, 64 nt, Human
aucaacggaauuagggccuuccuuuuugccuugugagcgccaaggaaaagaaacuaucucgguc

SEQ ID NO: 115451 - RNA, 64 nt, Human
uccucauagguacugggaaguccauuugcaagcugagcgccaggccuggggaggaagaggcuug

SEQ ID NO: 115452 - RNA, 64 nt, Human
aguuucuagugcugggaagucuuagccagcaccagagcgccaggccucucccuggccucuuacc

SEQ ID NO: 115453 - RNA, 64 nt, Human
uggcaucccagagcugcgcccugcuggucucugugagcgccacgcugcugugcuggaaaugccg

SEQ ID NO: 115454 - RNA, 64 nt, Human
cggcguggauccacggggccaggccacccugcgggagcgccacacgcauccacuucggauucag

SEQ ID NO: 115455 - RNA, 64 nt, Human
gggcgcccuggccgcagacacgcucgacgaggcggagcgccaguggaaggccgaguuccaccgc

SEQ ID NO: 115456 - RNA, 64 nt, Human
agugcacaccaucaugucaaggugcauacuuagugagcgccauccugcugaacguguauuucag

SEQ ID NO: 115457 - RNA, 64 nt, Human
ccacgugggccucacauuccaguccuuugagauugagcgccacgacagcugugccuacgacuau

SEQ ID NO: 115458 - RNA, 64 nt, Human
gagcuggcaugaaugaauaagaggauguggcacugagcgccaagggcuaccuuggaacgcaccg

SEQ ID NO: 115459 - RNA, 64 nt, Human
ugaacauuuucaagaacucugcugaggucacuuagagcgccaucacaacuuauuugugugacua

SEQ ID NO: 115460 - RNA, 64 nt, Human
guucuggguuucuagaggucaggacggcuccucagagcgccaggaagccagagccccaagcagg

SEQ ID NO: 115461 - RNA, 64 nt, Human
gugugaggagggcgagcugucuuucuaugacgcggagcgccacugccaccuguacaccuuccac

SEQ ID NO: 115462 - RNA, 64 nt, Human
cugcagcagagggcaggagccccagcuuagcccugagcgccagcgcgaggaccagggccugcca

SEQ ID NO: 115463 - RNA, 64 nt, Human
auuggccucuguuagacauugacucagggagccggagcgccaaguggagguuguaccuuucagc

SEQ ID NO: 115464 - RNA, 64 nt, Human
gucuucaacccugcccugcaccuugggcacgggagagcgccacccgcccgcccccgcccucgcu

SEQ ID NO: 115465 - RNA, 64 nt, Human
agaggaaccauuggccuagagcuccugugaccgagagcgccacggaagccuggggaugacgucg

SEQ ID NO: 115466 - RNA, 64 nt, Human
aagacgauucagaacacaagaggagaaugagcuggagcgccagcaccacgauggccccaggacg

SEQ ID NO: 115467 - RNA, 64 nt, Human
gcccuaccgauccucugcccccuuugcgggccuggagcgccauagcacagucgauuucguuucg

SEQ ID NO: 115468 - RNA, 64 nt, Human
uuucccgggcgucgccuccuguguggugccggaagagcgccagguucaguguuacccugagggc

SEQ ID NO: 115469 - RNA, 64 nt, Human
cacacagcccguucgaaggugugcagagggcucugagcgccaggauggccagggcuguuuuugc

SEQ ID NO: 115470 - RNA, 64 nt, Human
agcacauuuuccuaaggcccugcugucugccgaggagcgccaagaagaugucacuuguuuacac

SEQ ID NO: 115471 - RNA, 64 nt, Human
uguccugcuucuaccccgaggacuccucugcagggagcgccaucugugugcgugugcaaauaug

SEQ ID NO: 115472 - RNA, 64 nt, Human
gccaggccgggccggaggcucgaaagucccgcgcgagcgccacggccuccgggcgcgccuggac

SEQ ID NO: 115473 - RNA, 64 nt, Human
gagugagagggaaagaggucagauuuauacaacugagcgccagaggggaaaaugcaccuuguug

SEQ ID NO: 115474 - RNA, 64 nt, Human
gcgugucccuucccagcgcugcuggucagucguggagcgccaucaugucuuaccagugacgcug

SEQ ID NO: 115475 - RNA, 64 nt, Human
gcccuaggcccgucccacucaccuccccccuguggagcgccaggcagaggcuguucuggaaggc

SEQ ID NO: 115476 - RNA, 64 nt, Human
agaaccugcacacaggacagcgggaaaaaucgaugagcgccaccucuuuaaaaacucacuuacg

SEQ ID NO: 115477 - RNA, 64 nt, Human
accgagacacuuuauauggcccugcacagaccuggagcgccacacacugcacaucuuuugguga

SEQ ID NO: 115478 - RNA, 64 nt, Human
agacuggccacuggggguggcuguucgggacugagagcgccaagggucuuugccagcaaaggag

SEQ ID NO: 115479 - RNA, 64 nt, Human
ccaagccuggcagaaugagagggguugaggucccgagcgccacuccuagccuugccgccuucaa

SEQ ID NO: 115480 - RNA, 64 nt, Human
acgcauguggcuccagcccggccuggccgccagggagcgccacuggcuucccgccacccgaagg

SEQ ID NO: 115481 - RNA, 64 nt, Human
ugaagccgaguugcugugggcgugcccggaagcagagcgccacacucgcugcuuaagcuccccc

SEQ ID NO: 115482 - RNA, 64 nt, Human
aaugacagcauccuggcgacuccacaguggagcugagcgccacucccuguagccgaucugggac

SEQ ID NO: 115483 - RNA, 64 nt, Human
gagggaauccugucaccaucaauaaucacuuguggagcgccagcucugcccaaggcgccaccug

SEQ ID NO: 115484 - RNA, 64 nt, Human
cuuugacugacagagcaccauccaggcaaaauuagagcgccaaaugguuuucuucucaaucuua

SEQ ID NO: 115485 - RNA, 64 nt, Human
uugugagaaggcauuugccaaaccaagccagcuggagcgccacagccgcauacauacagguaac

SEQ ID NO: 115486 - RNA, 64 nt, Human
uccaggugggggcuggcacaucacagacugucgagagcgccaugucccagggcaugcagaggau

SEQ ID NO: 115487 - RNA, 55 nt, Human
ggcugccuaugggggacugaugccugagcgccaccuacugcauuuuggacaccuc

SEQ ID NO: 115488 - RNA, 56 nt, Human
cgucguccuguuccucaugaugucaggagcgccagacaccgggggccagggugggg

SEQ ID NO: 115489 - RNA, 64 nt, Human
ucuaaacuccacgcagccaaucgcuuuccuggaggagcgccaaccucgaagacaacucagcacu

SEQ ID NO: 115490 - RNA, 64 nt, Human
gaguuaacagacagguggccccccaggaagcagagagcgccagauuugugguggaaaaggcggc

SEQ ID NO: 115491 - RNA, 64 nt, Human
cauaacaagaaaaucaaagcugaggacagggugugagcgccacaucucugaaagcacaggagac

SEQ ID NO: 115492 - RNA, 64 nt, Human
ugggcuggcuggcaugaggccaagggguaggccugagcgccagagucgcccagguuagcccaca

SEQ ID NO: 115493 - RNA, 64 nt, Human
cucugcaucaucuugaggugggaggcagggaaaggagcgccaaugagguucccugcaacccccg

SEQ ID NO: 115494 - RNA, 64 nt, Human
auccgacuguccgggcuccugguccgcaguggcagagcgccaggcagagcccaaucagggucuc

SEQ ID NO: 115495 - RNA, 64 nt, Human
gcugggacguggcucagccagcacuuguccagcugagcgccaggauggaacacggccacaucaa

SEQ ID NO: 115496 - RNA, 64 nt, Human
ggaaucgggggguggcucuccugccacccauggggagcgccaggagaggagggucauggaggau

SEQ ID NO: 115497 - RNA, 64 nt, Human
gcauuccugaagcucccagcuggacaccacuccugagcgccacaucccaugaucacuucaacca

SEQ ID NO: 115498 - RNA, 64 nt, Human
cuaucugcauuugagcccucaaacucaccuugcagagcgccaagucccgaguggccuucuuuga

SEQ ID NO: 115499 - RNA, 64 nt, Human
aagcaagacuggcauaugugccccaacaucuucugagcgccacccuugcaacaaauacaggcgc

SEQ ID NO: 115500 - RNA, 64 nt, Human
cucagcucgcuggauggcggaagcugcuacucgugagcgccagugcgggugcagacaaucuucu

SEQ ID NO: 115501 - RNA, 64 nt, Human
ucauggguuuggcuuaggcugguagcuucuauguaauucgcaaugauuccaucuaaauaaaagu

SEQ ID NO: 115502 - RNA, 64 nt, Human
agaaaguacaaguuuauaaaguauuauagugaaaaauucgcauucuggcugauuuuaagccauu

SEQ ID NO: 115503 - RNA, 64 nt, Human
gagguuccuucccugcaaaugcugaaucuagccuaauucgcaaccacacagaauuucauggcuu

SEQ ID NO: 115504 - RNA, 64 nt, Human
ucucaugacaguuucucaacaauccugugaggcaaauucgcauguacccucuguauuagugugu

SEQ ID NO: 115505 - RNA, 64 nt, Human
agcauuaacagcaggguguuacagcauaauuguuaauucgcacaucuauuaggauccuuaaaua

SEQ ID NO: 115506 - RNA, 59 nt, Human
cuccaccaccuccucuuugaugacaucccaauucgcagacaauguccucugugcuguau

SEQ ID NO: 115507 - RNA, 64 nt, Human
ccuucuggcccccaucccggaacauuccugagugaauucgcaagcgcacuagcaugugauauua

SEQ ID NO: 115508 - RNA, 62 nt, Human
guccgucccuccgacacugaggcugcagcgggaauucgcacucggcaccaaucagagcccca

SEQ ID NO: 115509 - RNA, 64 nt, Human
uugaucuuuggaaacugauguuacauuagguuccaauucgcaauaguagcagagacugacaugc

SEQ ID NO: 115510 - RNA, 64 nt, Human
aauagucuauguaaagucacaaauuaaugaaaaaaauucgcaugaaaaugacagauaacacugu

SEQ ID NO: 115511 - RNA, 64 nt, Human
cauucaguaacuaauggaacacaccgucaacaugaauucgcaccuuacaugacagaagugauuc

SEQ ID NO: 115512 - RNA, 64 nt, Human
caucuucccauuggaaaguggcagcuaaacauuaaauucgcaugaaccacagaugcuggagauc

SEQ ID NO: 115513 - RNA, 64 nt, Human
auuauauaauacagaauugucuuaaacuuuaauaaauucgcauuuuaaagguguuuacagauua

SEQ ID NO: 115514 - RNA, 64 nt, Human
gcagcagucgacauguaaaugaagguguucuuagaauucgcauuuugccagcucagcgcaccuc

SEQ ID NO: 115515 - RNA, 64 nt, Human
caccuguuugcuugcuuucaaugaaccuuucauaaauucgcagucucagcuuaugguuuauggc

SEQ ID NO: 115516 - RNA, 64 nt, Human
guuguucaugaaaaacugauagaagcaacagaagaauucgcaggaagaaaaaucauaguguuaa

SEQ ID NO: 115517 - RNA, 64 nt, Human
uucuguagucgcauuugcacuccauuuuuacauuaauucgcaguugcuuuguaucauuguuuug

SEQ ID NO: 115518 - RNA, 64 nt, Human
uuuuagaagccaagagaagccacauggagacucaaauucgcaucuucucuauccacaucaugac

SEQ ID NO: 115519 - RNA, 64 nt, Human
acagcagggcuuuggccaagcccuugucuucacaaauucgcaacacaacaaucagauggcacca

SEQ ID NO: 115520 - RNA, 64 nt, Human
cccauaaguuauagagagaauucuaauucccuguaauucgcauaagucauagaauucuaaucag

SEQ ID NO: 115521 - RNA, 64 nt, Human
cggcccaggauggcuuugaaugcggcccaacgcaaauucgcaaacuuucuuaaaacauuaugag

SEQ ID NO: 115522 - RNA, 64 nt, Human
cuggugaaaaggcagauucuuaggcccaacuguagaccuucagagucagaaugucugguuguug

SEQ ID NO: 115523 - RNA, 64 nt, Human
ggauucauggcuuaugcuuguuucauacauguagaauucgcagugauauacuuaaguuaugugc

SEQ ID NO: 115524 - RNA, 64 nt, Human
caagcgcgcaagggcgcgggcgagcaggccugugaauucgcaggaucauuucagacccgcacuu

SEQ ID NO: 115525 - RNA, 64 nt, Human
cacaauucacaccaaaaugucuguacuuagagcuaauucgcauauauacaggaagggcucuuag

SEQ ID NO: 115526 - RNA, 64 nt, Human
gaugcccauucuacuuuugaauuuagcuuuuacuaauucgcaucuggaagcucagcaagugcac

SEQ ID NO: 115527 - RNA, 64 nt, Human
uugcagucuuucccccaggaaaaaaaaaaaaagaaauucgcauguuuaaugugaacucuccccu

SEQ ID NO: 115528 - RNA, 64 nt, Human
uagucaucuugugguggacaugucgcuauuaccgaauucgcaccaaauauuucucauugaguuu

SEQ ID NO: 115529 - RNA, 64 nt, Human
uuauggguaugcuguggcauaucccugagauuuuaauucgcauuuuccagugacuaaggguguu

SEQ ID NO: 115530 - RNA, 64 nt, Human
uggguccugaugguuucccguuuucaugguaacaaauucgcacagagguuuugcuuuaugcugu

SEQ ID NO: 115531 - RNA, 64 nt, Human
uccaccauuccgucgagacuuacaggcuuacgcugggcgucaggcuucccagacagagagugcg

SEQ ID NO: 115532 - RNA, 64 nt, Human
agcuacaauuccagcauuggagaagcgaggggcggggcgucaacggcacugcuucaggacgcgc

SEQ ID NO: 115533 - RNA, 64 nt, Human
ccagaccaccggccucggccccggcaucccuguugggcgucagccugagagucccuacugugcg

SEQ ID NO: 115534 - RNA, 64 nt, Human
ugucccugagcugggaggcggcuuuggaugguccgggcgucaagagcaggggugggccggggag

SEQ ID NO: 115535 - RNA, 64 nt, Human
accuuugacauuugaccuuugcagugucaugugagggcgucaguauagaggccuuugcaucugg

SEQ ID NO: 115536 - RNA, 64 nt, Human
uuccucuaaaaaccaccugaacguaaccuucgcagggcgucaagucaucuuuucuugccuucgg

SEQ ID NO: 115537 - RNA, 64 nt, Human
gcaagagaaaacacucuagggaguaaagcuccccgggcgucagaguugagcccugccugggcug

SEQ ID NO: 115538 - RNA, 64 nt, Human
cugcacagaggcaaggacccagauguggcagcaugggcgucaugcuccuuugcacagcccaggg

SEQ ID NO: 115539 - RNA, 64 nt, Human
gauugaaaaaacaaaacaaaacaaaaaaacccaggggcgucagucgauauucccagggccgcuu

SEQ ID NO: 115540 - RNA, 64 nt, Human
cacuccugggacaggucucuuugucagugaacaagggcgucacucugggaggggucggcggugc

SEQ ID NO: 115541 - RNA, 64 nt, Human
caacaguaauuuauauccaggacaaauacagucugggcgucacuauccuaccaucucuuccuca

SEQ ID NO: 115542 - RNA, 64 nt, Human
cccacacagagcuggcugcugugcccacccucaggggcgucaggagacacagccuggccuccuc

SEQ ID NO: 115543 - RNA, 64 nt, Human
uuuugugguuuugagaaaguacagcaguagacuggggcgucaccuccaggccguuucucauacu

SEQ ID NO: 115544 - RNA, 64 nt, Human
aagagggagaccaaaugucgggguuggggugggagggcgucaggcagaggcaacugacuucauu

SEQ ID NO: 115545 - RNA, 64 nt, Human
aagguguaaaauaauccgagggggaauauuugcugggcgucaggaaagacucagaugaaauuuc

SEQ ID NO: 115546 - RNA, 64 nt, Human
acagagaguaggcggcugggccacguccuucacagggcgucaugugccuuucuauuuucaucuu

SEQ ID NO: 115547 - RNA, 64 nt, Human
caggaagccgaggaauaagcaggcuggggcuggugggcgucaacaucccaguuuuguucuaucu

SEQ ID NO: 115548 - RNA, 64 nt, Human
ccagccuugauggaggagggagggcuucaggacggggcgucagagggagcccccucugggaggg

SEQ ID NO: 115549 - RNA, 64 nt, Human
ccagguugcaccccaugccaaugaaaucauuucugggcgucagcgccaggcaguuguauuuuuu

SEQ ID NO: 115550 - RNA, 64 nt, Human
aucuaggagaggaguccaugguguccaggcaucggggcgucacaccuguugaggaguggggugg

SEQ ID NO: 115551 - RNA, 64 nt, Human
gggacaguagucuccccugccagccuaggauuuugggcgucauucacccacuaccccuagugcu

SEQ ID NO: 115552 - RNA, 64 nt, Human
auuagcaaugguugaaaucauguggcuuguguuugggcgucauuuuuguauggauccuuucacu

SEQ ID NO: 115553 - RNA, 64 nt, Human
uagaaaggaacucucuuucuucucuuggcacugggggcgucaggcugucggauguuccuuccuu

SEQ ID NO: 115554 - RNA, 64 nt, Human; identical to SEQ ID NO: 115536

SEQ ID NO: 115555 - RNA, 64 nt, Human
ucccugguggucccgccgcaccucugcaucuccugggcgucaccaggaaggcucugaagucccg

SEQ ID NO: 115556 - RNA, 64 nt, Human; identical to SEQ ID NO: 115536

SEQ ID NO: 115557 - RNA, 64 nt, Human
gggggccaaacacauggaugguggaguacggccggggcgucaucccauccacccuggccuucgc

SEQ ID NO: 115558 - RNA, 64 nt, Human
cggggcugcugggguuuccgaggaaguggggccagggcgucaagggagggcuggugccuucgga

SEQ ID NO: 115559 - RNA, 64 nt, Human
gguguggggguccggcucuaggaacgggcuuugggggcgucaggucuuuccaagguugggaccc

SEQ ID NO: 115560 - RNA, 64 nt, Human
ugggagaccaaauagggaucaccaggcuaauggggggcgucagcagcuuucucucccuccuauc

SEQ ID NO: 115561 - RNA, 64 nt, Human
uccaggacuccaccccggcucccggacgccagcugggcgucagaccccaccggggcaaccuugc

SEQ ID NO: 115562 - RNA, 64 nt, Human
uaucuccugccucagccccccuggcccagugcuggggcgucagcuaaaccugagcuuccaagaa

SEQ ID NO: 115563 - RNA, 64 nt, Human
uccccaagcacguggucucugcgccaggcagcccgggcgucagagcucaagcaccugccccgac

SEQ ID NO: 115564 - RNA, 64 nt, Human
ugggcucugggccuuggcaggugcacagacgggcgggcgucacguguguucagagcuugucucc

SEQ ID NO: 115565 - RNA, 64 nt, Human
gaaaacugacugcuggcccagggccccugcugaggggcgucaggccaggcuugacccauucccu

SEQ ID NO: 115566 - RNA, 64 nt, Human
ugcguucuuccucuggauagaaccaccaccuccugggcgucacugacaagcuccaucuuaaccu

SEQ ID NO: 115567 - RNA, 64 nt, Human
gggcccagcuggugcuguagggccacgcaggcaggggcgucaagggguuucucugcccaaggaa

SEQ ID NO: 115568 - RNA, 64 nt, Human
cucuaugacuguaugccguggacaagagaugccugggcgucaccaugccacagcuacccacuug

SEQ ID NO: 115569 - RNA, 64 nt, Human
gccucaccuccuccccaucaucuuguccuagagugggcgucaccuuggagcuucucuuccuucc

SEQ ID NO: 115570 - RNA, 64 nt, Human
uggaacagcuuccggcucucaagcgucaccccaggggcgucaguuuuacggacucaaggucacc

SEQ ID NO: 115571 - RNA, 64 nt, Human
cccgugcugcugugcaguucuugccucccucacggggcgucacccccagcccagcuccguugua

SEQ ID NO: 115572 - RNA, 64 nt, Human
gcccaugguaacgaaccccuagaaaggagagaacgggcgucaggggugcacaguccacagcuga

SEQ ID NO: 115573 - RNA, 57 nt, Human
uggcggucacucuccgcugaggacccagggcgucagcacccagcacugccacauguc

SEQ ID NO: 115574 - RNA, 64 nt, Human
acuggauuccaucacccugagcgguaaaccagaugggcgucaccccaguucugcagacacauac

SEQ ID NO: 115575 - RNA, 64 nt, Human
gaggacgcgaggggaaaggccuguggggagccgagggcgucagagagacccgggaaggaaggcu

SEQ ID NO: 115576 - RNA, 64 nt, Human
uguuuaaucauuaguuacaagaaugcaguaucuggggcgucaacauggggacucgaguaaaccu

SEQ ID NO: 115577 - RNA, 64 nt, Human
uuuuucccacgucuaacuggaaacaaaacagaaggggcgucauaaauuugaauaagcagaacau

SEQ ID NO: 115578 - RNA, 64 nt, Human
uggcugggaggagaggcccucucgggggugaccugggcgucagccguggaacccccuccuccuc

SEQ ID NO: 115579 - RNA, 64 nt, Human
uuccucaucaauagaaaggauguguucggggugggggcgucaggugagaacguuugcugggaag

SEQ ID NO: 115580 - RNA, 64 nt, Human
gcccgcaguugccaaagagccgccuugucgcugugggcgucagggcuuggcuggcucagugcac

SEQ ID NO: 115581 - RNA, 64 nt, Human
uuacuuauucauuuauuuauguauucaacuccaagggcgucacccccauuuucuacccaucccc

SEQ ID NO: 115582 - RNA, 64 nt, Human
cccgccccgcauccgcgaaggcuuuuaaugggaggggcgucaaagcucaaaacuguuuuccucu

SEQ ID NO: 115583 - RNA, 64 nt, Human
guaaguguagaauugcugugagguauggggcuaggggcgucaguagggccuugaagguuaugga

SEQ ID NO: 115584 - RNA, 64 nt, Human
gcccucauucugguaaaccagcagccuccagcaugggcgucauagccaucacgagcaugucaca

SEQ ID NO: 115585 - RNA, 64 nt, Human
ugggcccagcccugagccccgggccggcgcaggugggcgucaccuggggacuccccacugucag

SEQ ID NO: 115586 - RNA, 64 nt, Human
ucggcuaugagaaggggaagccugugggucuagugggcgucacagagcuuucagacgcccagaa

SEQ ID NO: 115587 - RNA, 64 nt, Human
cacuugacuguagacuggucuggccugcuggccugggcgucagggcgcaucaauaaaguacuug

SEQ ID NO: 115588 - RNA, 64 nt, Human
gugcccgcagaggaucagcacugccaguggagaugggcgucacuacugcuacccucauuucacc

SEQ ID NO: 115589 - RNA, 64 nt, Human
uccugcugagcaccguggggcacccagggagcaggggcgucagggauccugcugccggcacccc

SEQ ID NO: 115590 - RNA, 64 nt, Human
ggaggacgaggagugagggguccagagggugggggggcgucagcccuggccugcaugauggguu

SEQ ID NO: 115591 - RNA, 64 nt, Human
aacccuacgggaaggccguagaugugugggcccugggcgucaucuccuacauccugugagugac

SEQ ID NO: 115592 - RNA, 64 nt, Human
ggaaucauuguccagagcugcuuccccgucaccugggcgucaucugguccugguaagaggagug

SEQ ID NO: 115593 - RNA, 64 nt, Human
gcuggaaucccgccccuagugguacccuccagaccagcgccaccgccuccgacaguguccucgc

SEQ ID NO: 115594 - RNA, 64 nt, Human
acugggaaacacaagaaguacaaccaacaggaaccagcgccaagggcaggcagcggccuccuug

SEQ ID NO: 115595 - RNA, 64 nt, Human
agaaucuggggugucuguaaugucaccccuccagcagcgccacaaggacugagguuggguaggu

SEQ ID NO: 115596 - RNA, 64 nt, Human
aacacugccaaccugacccugucaucccgauugacagcgccacuucagguggcugggugacuaa

SEQ ID NO: 115597 - RNA, 64 nt, Human
cccaggauuauugucaaagaagucauucuuuaagcagcgccagugacagucagggaaggugccu

SEQ ID NO: 115598 - RNA, 64 nt, Human
caugggagagaaaagcugccaccuuuuuaggagccagcgccaccuugggacaaaaagggaaacc

SEQ ID NO: 115599 - RNA, 64 nt, Human
ggcguuccaccuccaagccuauaccagcuguguacagcgccaucucucugccuucuguugcccc

SEQ ID NO: 115600 - RNA, 64 nt, Human
caugaggccaucucaggagauggagggcuuggcccagcgccaaguaaacaggguaccucaagcc

SEQ ID NO: 115601 - RNA, 64 nt, Human
gacaggucacauaacagcugcaucauugaccgcacagcgccaucucucccugagaauaaagccg

SEQ ID NO: 115602 - RNA, 64 nt, Human
gucuucagauuuagacucuucuccaugucagcugcagcgccacccgccuuacaccugcccggcc

SEQ ID NO: 115603 - RNA, 64 nt, Human
gagaagcagacucugcugaauuuccaggaacucccagcgccagauucaucaugucuguugugac

SEQ ID NO: 115604 - RNA, 64 nt, Human
aacaacaaggaaguaaaaccaaagacaggcagcccagcgccaggcccaaaaccaggccugggcc

SEQ ID NO: 115605 - RNA, 64 nt, Human
gucucuguguguuuauuugccugccagugcucuccagcgccauccugcccuggacaccacccug

SEQ ID NO: 115606 - RNA, 64 nt, Human
ucugcgcagugguugcuguccucucauuugcagucagcgccagcacuguauuccugucauugcg

SEQ ID NO: 115607 - RNA, 64 nt, Human
guacuuuggaagcacaacguccaggcugguaccgcagcgccaugcccauuccucgccucauuca

SEQ ID NO: 115608 - RNA, 64 nt, Human
cuuuagugcaagaagccuaggcucagaagcacagcagcgccaucuuuccguuucagggguugug

SEQ ID NO: 115609 - RNA, 64 nt, Human
uuuucgucuaguaacuuaagugagagagaaagggcagcgccacagaagccccuaaacgccgccu

SEQ ID NO: 115610 - RNA, 64 nt, Human
gccuuccucuauaacccccagagacaggcuggggcagcgccaaggcggucucgcgcgggacuuu

SEQ ID NO: 115611 - RNA, 50 nt, Human
gcgcugauacuggucgcugacagcgccaaagagaccaacaagaugauuuu

SEQ ID NO: 115612 - RNA, 64 nt, Human
augucacaggcgggacuuucuucagagaguggugcagcgccagacauuuugcacauaaggcacc

SEQ ID NO: 115613 - RNA, 64 nt, Human
cucuuguacccccagguggaaggcagacagcaggcagcgccaagugcgugccgugugaguguga

SEQ ID NO: 115614 - RNA, 64 nt, Human
ugaggcccagggaggugacccgaauuauaaaggccagcgccagaacccagauuuccuaacucug

SEQ ID NO: 115615 - RNA, 64 nt, Human
caccugagguggucaugugaggggcgcauuccuccagcgccaagcgucagagccugcagacaac

SEQ ID NO: 115616 - RNA, 64 nt, Human
ugcggacaccacuccucucugcagcacugccucccagcgccagggucgcgggcacaucccacug

SEQ ID NO: 115617 - RNA, 64 nt, Human
cuugguuuuuacaguuuauaaucugacaucaccccagcgccauuuguaaagagcaacuuuccag

SEQ ID NO: 115618 - RNA, 64 nt, Human
cccucacaucaggagguagauagcucugaaaugacagcgccacagccauagugacugcaugagc

SEQ ID NO: 115619 - RNA, 64 nt, Human
uccauucuucgacauccgucauugcugcugcuaccagcgccaaauguucauccucauugccucc

SEQ ID NO: 115620 - RNA, 60 nt, Human
ugggugaggaugagugcugaguuccucgcccagcgccaucuucccucccaguaucuuugc

SEQ ID NO: 115621 - RNA, 64 nt, Human
uuggaaucuucaacuucugaagugaauguggauacagcgccacuccugcccccucuuggcccca

SEQ ID NO: 115622 - RNA, 64 nt, Human
gcugggcaguucugcucuguggaggggcgggcaccagcgccacuuaugugccucugcuccgagg

SEQ ID NO: 115623 - RNA, 64 nt, Human
agaaggggugcucaggcugcgggccacaguccagcagcgccagaagcacucauuucugaccacc

SEQ ID NO: 115624 - RNA, 64 nt, Human
ccaggagccaacaccagaggccacuccacaaccccagcgccagucagcaaggaagccggguguc

SEQ ID NO: 115625 - RNA, 64 nt, Human
gccacuccugaaccccgucgaggggcucucagcucagcgccagccugucccauggacacuccag

SEQ ID NO: 115626 - RNA, 64 nt, Human
uccagaagcggccugugcguucccuucaguacugcagcgccacccaguggaaggacacucuugg

SEQ ID NO: 115627 - RNA, 64 nt, Human
ggcucuucucucguuuacaggaugugcgagacgucagcgccacguuccuuucagaccuggaaga

SEQ ID NO: 115628 - RNA, 64 nt, Human
cuuugcuggugagaucagagcccuccugagcaggcagcgccacuccaggguucagacagggcug

SEQ ID NO: 115629 - RNA, 64 nt, Human
uggagcacguuucugugaacguuaacccagagcacagcgccaaggccugucuucccuuuauugg

SEQ ID NO: 115630 - RNA, 64 nt, Human
ugcaccccaugccaaugaaaucauuucugggcgucagcgccaggcaguuguauuuuuuuuuuuu

SEQ ID NO: 115631 - RNA, 64 nt, Human
ggaguucugauuuccucaguccuuuagguuaaagcagcgccaggaggaagcugacagaagcagc

SEQ ID NO: 115632 - RNA, 64 nt, Human
uggcuuauccuuaaagaucaucucccauccuccccagcgccaucugugugcagcaaccagaaag

SEQ ID NO: 115633 - RNA, 64 nt, Human
cacgcagcagaguugcccuacaaauuucauuuggcagcgccauaacauucauuuaaaaaguuua

SEQ ID NO: 115634 - RNA, 64 nt, Human
ggucccagcagcccagcccccacccuccuggcagcagcgccaggaaggcuuugacaauuaccuc

SEQ ID NO: 115635 - RNA, 64 nt, Human
ggcacccgccggaugcgcagccuggccucuacuacagcgccaacgagcagugccgcguggccuu

SEQ ID NO: 115636 - RNA, 64 nt, Human
guacagagagacgcguguggagagagccgcacaccagcgccacccaggaaaggcggagcgguua

SEQ ID NO: 115637 - RNA, 64 nt, Human
cugcuggccacggagggcuccugccucucuucuucagcgccacaaaauuacauggaggccagcu

SEQ ID NO: 115638 - RNA, 64 nt, Human
auggccagugucugucccgggguccuguggcaggcagcgccaagcaaccuggguccaaauaaaa

SEQ ID NO: 115639 - RNA, 64 nt, Human
ggacccugaccaucggcagcgccggcaagaccuucagcgccacuggcuggaaggugaguugcug

SEQ ID NO: 115640 - RNA, 64 nt, Human
cagauguguacagcugcuccucccuuucauaaagcagcgccaugugugcagaggccacucuuga

SEQ ID NO: 115641 - RNA, 64 nt, Human
ccaaggacguguccuuaggcggcucuggaaggcccagcgccagcccccguccucuguuaaaggg

SEQ ID NO: 115642 - RNA, 64 nt, Human
cacuauuggcaauguugacccuccucugucaucacagcgccagggcagcugugccugggacagg

SEQ ID NO: 115643 - RNA, 64 nt, Human
cuuucugccgcagcccucgcagagggcgggugcacagcgccaugagcgggcagcgccuccugua

SEQ ID NO: 115644 - RNA, 64 nt, Human
uugugccuggcagcuaacacgcccgggguggccacagcgccagccucagacuggagggcaaggg

SEQ ID NO: 115645 - RNA, 64 nt, Human
uugugucgugcagugacguggugggaagagaugccagcgccacgagaggacacuucgugagccu

SEQ ID NO: 115646 - RNA, 64 nt, Human
uaagcuucgugaggcccucaccagaagcagaugccagcgccaugcuuccuauacaguucuaugc

SEQ ID NO: 115647 - RNA, 64 nt, Human
ucggggcagaggggcggugucuuguagcgggcggcagcgccagcgccccucugucaggcugggg

SEQ ID NO: 115648 - RNA, 64 nt, Human
cagcccuggggacaccccuaggcaacgauuccgacagcgccauccaggcccccugggggcgccc

SEQ ID NO: 115649 - RNA, 64 nt, Human
accaugcagaccuuccaggcagcauggaaaauaccagcgccaucuuucagaaggccucaucucc

SEQ ID NO: 115650 - RNA, 64 nt, Human
cccuggauagcagcagccucagccucugccuguccagcgccaacagccucuaugacgacaucga

SEQ ID NO: 115651 - RNA, 64 nt, Human
gacaagcuuguccuauguccuauuugaguggcagcagcgccagcccagcaagaaggcugggggu

SEQ ID NO: 115652 - RNA, 64 nt, Human
ggcuugcagggguccuaagaaacuccacucuggacagcgccaggaggcccuggguuccauuccu

SEQ ID NO: 115653 - RNA, 64 nt, Human
ccagcugcauuagguuaagagacucuuccagagccagcgccaggucuugaauggcaccucuccc

SEQ ID NO: 115654 - RNA, 64 nt, Human
ucccuggaucucccucagauccccucuucucagacagcgccaggccgggguggggccgggguug

SEQ ID NO: 115655 - RNA, 64 nt, Human
guuggucaucccaugaccacugaagcuuaguaaccagcgccaaaaaguagauucaucaaacuag

SEQ ID NO: 115656 - RNA, 64 nt, Human
acauuccccagugccauggccaguugccaggccccagcgccagccagucuggccuuacccuccg

SEQ ID NO: 115657 - RNA, 64 nt, Human
aacccucuuuggccagguaaacauuguauuguaucagcgccagcuacagauugaaaaaaaaaaa

SEQ ID NO: 115658 - RNA, 64 nt, Human
uccgcuccccacgcccccauauuggcaacacccccagcgccaccccaugcuccccaagaacgcg

SEQ ID NO: 115659 - RNA, 64 nt, Human
gcagagcucggcgccgcugcucccgccgccgccucagcgccacacaucgccgggacacccgcgc

SEQ ID NO: 115660 - RNA, 64 nt, Human
cuccaccgaagaggugcgccacugggagccaccccagcgccaggcgcccguccagggacacaca

SEQ ID NO: 115661 - RNA, 64 nt, Human
cggaggugaugugucacgggcccugacugagcuacagcgccaacgccuagagcccuuccgccag

SEQ ID NO: 115662 - RNA, 64 nt, Human
gaaagaggggaagaagaugagagaccugcaaauccagcgccacagaagccaggugaccagggac

SEQ ID NO: 115663 - RNA, 64 nt, Human
uguuuuuuguagauucucguucuauaucucaucacagcgccagcccuguuuuuagccggaaagg

SEQ ID NO: 115664 - RNA, 64 nt, Human
aucuaacuuugucacugugacuacauuaccucuucagcgccagagggcacccgugggccucccg

SEQ ID NO: 115665 - RNA, 64 nt, Human
gcuaaaaacucaguucccaaauccccaguuuaugcagcgccaucagguauuuuaagcuaaacuu

SEQ ID NO: 115666 - RNA, 64 nt, Human
cuguggaagcagccaaggcacuuccucacccccucagcgccacggaccucucuggggaguggcc

SEQ ID NO: 115667 - RNA, 64 nt, Human
cuuaaagacagacauugaggagagcaaauaccgacagcgccaccugaagguggaguugaagagc

SEQ ID NO: 115668 - RNA, 64 nt, Human
cuuccaggcacucaaaagcugggaaccagcaucucagcgccagcucuaccaguucucguuuugg

SEQ ID NO: 115669 - RNA, 64 nt, Human
ccuccuucccccagccucaucaccgugcucuucucagcgccacccucagcagccagauugcaac

SEQ ID NO: 115670 - RNA, 64 nt, Human
cugaagcugggcccucacuggccugucccugcugcagcgccaggacccccggagguagaggcga

SEQ ID NO: 115671 - RNA, 64 nt, Human
caagcagggcagccuggacacugcccucacaggacagcgccaauaacaauacagugucugagua

SEQ ID NO: 115672 - RNA, 64 nt, Human
caagggcagggauaggcgcaguggucagaugaagcagcgccagagaggggaccucccagcucuu

SEQ ID NO: 115673 - RNA, 64 nt, Human
auggugcaugggcucgccgugucucagccucugccagcgccaaaacaagccaaagagccuccca

SEQ ID NO: 115674 - RNA, 64 nt, Human
ucacucaugcaaacugcuuuauuuucccuacuugcagcgccaaguggccacuggcaucgcagcu

SEQ ID NO: 115675 - RNA, 64 nt, Human
ugccaaaaccaagauuuugaaggaaaugaguggccagcgccagggcccaggccauguggccugc

SEQ ID NO: 115676 - RNA, 64 nt, Human
ucccaggccagaggcugcaugccacuguccccggcagcgccaaccccugcuuggcuguuauggu

SEQ ID NO: 115677 - RNA, 58 nt, Human
ucaguggagcucugcccuagugugggcccagcgccagacuggacagaagcccuggggc

SEQ ID NO: 115678 - RNA, 64 nt, Human
gaccauggugggaacugcaccaggguacuccucacagcgccaucaccaauggccaaaacuccuc

SEQ ID NO: 115679 - RNA, 64 nt, Human
cagccuuuggauggugccuugggccccuuagccccagcgccagggccucccagcugaggccaca

SEQ ID NO: 115680 - RNA, 64 nt, Human
uaaugccaccuucugucuccuacgacuccaugagcagcgccagcccagcucuccccucugcacc

SEQ ID NO: 115681 - RNA, 64 nt, Human
gcacuugcugugggcccaucuggucuugccuucucagcgccacagggaaggccaagcuguucua

SEQ ID NO: 115682 - RNA, 64 nt, Human
cgcagagaagccccgggcuuggcggcucuagccccagcgccaaaggagacccgccccagggccg

SEQ ID NO: 115683 - RNA, 64 nt, Human
uaagcacuggucuaacacagccaacccuccuccacagcgccauauuaauggaggaggggaggaa

SEQ ID NO: 115684 - RNA, 64 nt, Human
uguggagaccaggcuccugaccccgccaugcaugcagcgccaccuggaagccgcgcggccgcuu

SEQ ID NO: 115685 - RNA, 64 nt, Human
caagccggaggacgcagcccccaagaccagcggacagcgccagaaggaaucgucgaaacagccu

SEQ ID NO: 115686 - RNA, 64 nt, Human
ccaacugagaagcugcucccucccccagcaagcccagcgccaggugcucuugccuuuucccacu

SEQ ID NO: 115687 - RNA, 64 nt, Human
ccaggcugccugugucuucaccuguccuguccaccagcgccaacagccguggggaagccaagga

SEQ ID NO: 115688 - RNA, 64 nt, Human
ccgaccuugggcugcuguuagagaacucaggcagcagcgccagugacacggggcacuagucagg

SEQ ID NO: 115689 - RNA, 62 nt, Human
cgcccuggcccuuggguuagccgccucccggccagcgccaucucccgcccuuggugcugccc

SEQ ID NO: 115690 - RNA, 64 nt, Human
uuggugcugcccccgggcgguaccugcucucucccagcgccacuuggccucuuccucuccuccu

SEQ ID NO: 115691 - RNA, 64 nt, Human
ggaaagcacggggccuuucccacccacccucagccagcgccacacggcacccacagacugggug

SEQ ID NO: 115692 - RNA, 64 nt, Human
acgccugcuggaccaacgcggguucuggggugcacagcgccagguuaacgcugaagccugcccc

SEQ ID NO: 115693 - RNA, 64 nt, Human
ugcgccucccaucgcccgggugccuguccuugcccagcgccaccaggcuggaggcggaguggga

SEQ ID NO: 115694 - RNA, 64 nt, Human
gcagagaggagcugacaggguaccugcuccgggccagcgccaucugcuccaaguugggccuggc

SEQ ID NO: 115695 - RNA, 64 nt, Human
agcugguggcccuccaagggcagcauccacccugcagcgccaaugaggaucugcugcaccugcu

SEQ ID NO: 115696 - RNA, 64 nt, Human
cagugaauuucucaaucuugccucacagugacugcagcgccaagcggcauccaccaagcaucaa

SEQ ID NO: 115697 - RNA, 64 nt, Human
gucagcccagcugcaggagaagcuggcaggagcccagcgccagcuggggcagcuccgggcucag

SEQ ID NO: 115698 - RNA, 64 nt, Human
ccagacagugccggccagcagagaagcagagagccagcgccacacaacaucaagaaggccgaca

SEQ ID NO: 115699 - RNA, 64 nt, Human
ccuggaagccggccggcugggaucaagaaggggacagcgccaccucuugucagugcucggcugu

SEQ ID NO: 115700 - RNA, 64 nt, Human
ccacgccccuccccagcccccacccaugccagcgcagcgccagggcucagauggggccugggcu

SEQ ID NO: 115701 - RNA, 64 nt, Human
ggugcaggagcacacggaccagauuuggaaguuccagcgccaugaccugaucgaggaguaccac

SEQ ID NO: 115702 - RNA, 64 nt, Human
cauucguucuguggagggacaaguggacucagggcagcgccaggcugaccacagcacagccaac

SEQ ID NO: 115703 - RNA, 64 nt, Human
uuuuuuuuuuugacguauuauugacaaauguauucagcgccauacacaagagaaauauuauuac

SEQ ID NO: 115704 - RNA, 64 nt, Human
ggguccccaggguccugaugaagaccuccgaccccagcgccaggcuccucggagcccaacaguc

SEQ ID NO: 115705 - RNA, 64 nt, Human
aucuucuggcaaggacagaggcgaggggacagcccagcgccauccugaggaucgggugggggug

SEQ ID NO: 115706 - RNA, 64 nt, Human
guaacucuuuggcuauuguccuuguguauccugacagcgccaugugugucagcccaugucaauc

SEQ ID NO: 115707 - RNA, 64 nt, Human
aggagacacuggcaggagaugugcuguccugcaccagcgccagcccagcucccugggcagaugu

SEQ ID NO: 115708 - RNA, 64 nt, Human
gggaggaguggauuccuccccacccugucccaggcagcgccacuguccgcugucucccuccuga

SEQ ID NO: 115709 - RNA, 64 nt, Human
agcgagagcagcaggucacgcagaaaaaacugagcagcgccaacucccugccagcgggcgagca

SEQ ID NO: 115710 - RNA, 64 nt, Human
agaagacagucacagaacagcacacauccaaauucagcgccauugaaaguuggccuaaggcuca

SEQ ID NO: 115711 - RNA, 64 nt, Human
cuacuugggaggcugaggcaggagaaucgcuugaacccgggaggcacagguuccagugagccaa

SEQ ID NO: 115712 - RNA, 64 nt, Human
cuacucagaagccugaggcugggaaaucguuugaacccgggaagcggagguugcagggagccga

SEQ ID NO: 115713 - RNA, 64 nt, Human
ugccgccugcccuccacacaucccuguccccccaacccgggaaccccugcccuccuccagcagg

SEQ ID NO: 115714 - RNA, 64 nt, Human
cuacucaggaggcugaggcaggagaaucacuugaacccgggagguggagguugccgugaguuga

SEQ ID NO: 115715 - RNA, 64 nt, Human
cuacuugggaggcugaggcaggagaaucgcuugaacccgggaggcggagguugcagugagcuga

SEQ ID NO: 115716 - RNA, 64 nt, Human
cuacuugggaggcugaggcaggagaauugcuugaacccgggaggcggagguugcaguaagccga

SEQ ID NO: 115717 - RNA, 64 nt, Human
cuacuugggaggcugaggcaggagaauggugugaacccgggaggcggagcuugcagugagccga

SEQ ID NO: 115718 - RNA, 63 nt, Human
uucuccagagucggaacugaggguuggaacuauacccgggaccaaacucacggaccacucgag

SEQ ID NO: 115719 - RNA, 64 nt, Human
cuacucaggaggcugaggcaggagaauggcgugaacccgggaggcggagcuugcagugagccuu

SEQ ID NO: 115720 - RNA, 64 nt, Human
cuacucaggaggcugaagcaggagaaucgcuugaacccgggagguggagguugcagcaagccga

SEQ ID NO: 115721 - RNA, 64 nt, Human
aaaucggauuccuuguguccuuugugcuaguguaacccgggacuggaauguaaagugaaguucg

SEQ ID NO: 115722 - RNA, 64 nt, Human
gcguuauguguaaaaaacaaguaucuguaugacaacccgggaucguuugcaaguaacugaaucc

SEQ ID NO: 115723 - RNA, 64 nt, Human
cuacuugggaggcugaggcaggagaaucgcuugaacccgggaggcggagguuacagugagccga

SEQ ID NO: 115724 - RNA, 64 nt, Human
uuucucaguaaacaguucugaaggcaggaguggaacccgggaguauuuucaugucuuucauccu

SEQ ID NO: 115725 - RNA, 64 nt, Human
cuacucaggaggcugaggcaggagaaucgcuugaacccgggaggcggagguugcggugagcuga

SEQ ID NO: 115726 - RNA, 64 nt, Human
cuacuugggaggcugaggcaggagaaucacuugaacccgggaggcagaggucauggugagccga

SEQ ID NO: 115727 - RNA, 64 nt, Human
cuacucgggaggcugaggcaggagaauagcuugaacccgggagguggagguugcagugagucga

SEQ ID NO: 115728 - RNA, 64 nt, Human
cuacucgggaggcugaagcaggagaaucacuugaacccgggaggcagagguugcagugagcuga

SEQ ID NO: 115729 - RNA, 64 nt, Human
cuacuagggaggcugaggcaggagaaucacuugaacccgggaggcagagguugcagugagcuga

SEQ ID NO: 115730 - RNA, 64 nt, Human
cuacuugggaggcugagaugggagaaucacuugaacccgggaggcagagguugcagugagccga

SEQ ID NO: 115731 - RNA, 64 nt, Human
ccguuuuuuuuuugagauggagucucacacagucacccgggauuggaaugcaauggcgcgaucu

SEQ ID NO: 115732 - RNA, 64 nt, Human
cuacuccggaggcugaggcaggagaauggcgugaacccgggaggcggagcuugcagugagcuga

SEQ ID NO: 115733 - RNA, 64 nt, Human
ucccuuucucaucugguaggaugaaaagauccagacccgggaagggaaguccgcagccgacgcc

SEQ ID NO: 115734 - RNA, 64 nt, Human
acacccuuuagaaccuuaaagaaccaucagcaucacccgggaacuuuuuuagaaaugcaaaauc

SEQ ID NO: 115735 - RNA, 64 nt, Human
uuacuugggaggccgaggcacgagaauugcuugaacccgggagguggagguugccgugagccaa

SEQ ID NO: 115736 - RNA, 64 nt, Human
cuacucaggaggcugaggcaggagaagggugggaacccgggaggcagagcuugcagugagccga

SEQ ID NO: 115737 - RNA, 64 nt, Human
uugcagauuuuuuuuuauucugcucccaccucccacccgggacuacuugcuggugacuuuuuuu

SEQ ID NO: 115738 - RNA, 64 nt, Human
cuccucugugagcucugggcuucccaguuuguuuacccgggaaaguacgucuagauuguguggu

SEQ ID NO: 115739 - RNA, 64 nt, Human
cuacuugagaggcugaggcaagagaauuguuugaacccgggaggcagagguugcagugugguga

SEQ ID NO: 115740 - RNA, 64 nt, Human
cuacucuggaggcugaggcaggagaauggcgugaacccgggaggcggagcuugcagugagccga

SEQ ID NO: 115741 - RNA, 64 nt, Human
cuacucgggaggcugaggcaggagauucgccugaacccgggaggcagagguugcagugagccga

SEQ ID NO: 115742 - RNA, 64 nt, Human
cuacuugggacacugaggcaggagaaucacuugaacccgggaggcggagguugcagugagccga

SEQ ID NO: 115743 - RNA, 64 nt, Human
cccaugcugaugucuaaguggugaccgcagcaguacccgggaaccccaacaguugguugucuug

SEQ ID NO: 115744 - RNA, 64 nt, Human
ugucccucccccgcuuccucccucugcggggaggacccgggaccacagcugcuggccaggguag

SEQ ID NO: 115745 - RNA, 64 nt, Human
ccacuugggaggcugaggcaggagaauugcuugaacccgggagguggaggcugcggugagccaa

SEQ ID NO: 115746 - RNA, 64 nt, Human
cuacucgggaggcugaggcaugagaauugcuugaacccgggaggcggagguugcagugagccua

SEQ ID NO: 115747 - RNA, 64 nt, Human
guccucuccucccaggaaccucauucaaauauuuacccgggacacacacccccccccacacaca

SEQ ID NO: 115748 - RNA, 64 nt, Human
cuacucaagaggcugaggcacgagaaucacuugaacccgggagggagagguugcagugagccaa

SEQ ID NO: 115749 - RNA, 64 nt, Human
cuacucaggaggcugaggcaggagaauugcuugaacccgggagguggagguugcagugaaccaa

SEQ ID NO: 115750 - RNA, 64 nt, Human
cuacucgggaggcugaggcaggagaaucgcuugaacccgggaggcggagguugcaugagccgag

SEQ ID NO: 115751 - RNA, 64 nt, Human
cuauugaggaggcugaggcaggagaauugcuugaacccgggaggcggagguugcagugagccaa

SEQ ID NO: 115752 - RNA, 64 nt, Human
cuacuugggaggcugaggcaggagaauggcgugaacccgggaggcggagcuugcagugagccga

SEQ ID NO: 115753 - RNA, 64 nt, Human
cuacucggcaggcugcagcaggaaaauggcauaaacccgggagguggagcuugcagugagccga

SEQ ID NO: 115754 - RNA, 64 nt, Human
cuacucgggaggcugaggcggaagaaucacuugaacccgggaggcggagguuccagugagccga

SEQ ID NO: 115755 - RNA, 64 nt, Human
cuacucaggaggcugaggcaggagaauuacuugaacccgggaggcggagguugcaguaagcaga

SEQ ID NO: 115756 - RNA, 64 nt, Human
cuacucaggaggcugaggcgggagaauggcaugaacccgggagguggagcuugcagugagccaa

SEQ ID NO: 115757 - RNA, 64 nt, Human
cuacucgggaggcugaggcaggagaauggcaugaacccgggaggcagagguugcagugagccga

SEQ ID NO: 115758 - RNA, 64 nt, Human
cuacucgggaggcugaggcaggagaauugcuugaacccgggaggcggagguuguggugagcuga

SEQ ID NO: 115759 - RNA, 64 nt, Human
ccacuagggcggcugagacgcaagacuugcuugaacccgggaggcagagguugcagugagccaa

SEQ ID NO: 115760 - RNA, 64 nt, Human
aaggaaggaggcagacugauggcgauucccucucacccgggacucucccccuuucaaggaaagu

SEQ ID NO: 115761 - RNA, 64 nt, Human
cucuucguggugcccacgaugcucagguuugguaacccgggaguguucccagguggccuuagaa

SEQ ID NO: 115762 - RNA, 64 nt, Human
cuacucgggaggcugaggcaggagaaucgcuugaacccgggaggcagagguugcagugagccga

SEQ ID NO: 115763 - RNA, 64 nt, Human
cuacuugggaggcugaggcaggagaauugcucaaacccgggaggcagagguugcagugacccaa

SEQ ID NO: 115764 - RNA, 64 nt, Human
aacaggucccgcaccucaugccugucugccauacacccgggagcucuuucccucagggucucag

SEQ ID NO: 115765 - RNA, 64 nt, Human
cuacucaggaggcugagggaggagaaucccuugaacccgggaggcggagguucauggggaaccc

SEQ ID NO: 115766 - RNA, 64 nt, Human
cuacuugggaggccgaggcaggagaauugcuugaacccgggaggcagagguugcagugagcuga

SEQ ID NO: 115767 - RNA, 64 nt, Human
cuauuugggaggcuaaggcaggagaauggcgugaacccgggaggcggagcuugcagugagccga

SEQ ID NO: 115768 - RNA, 64 nt, Human
cuacucaggaggcugaggcagaagaauggcaugaacccgggaggaggagcuugcagugagccga

SEQ ID NO: 115769 - RNA, 64 nt, Human
cuacucgggaggcugagacaggagauuugcuugaacccgggaggcggagguugcagugagccaa

SEQ ID NO: 115770 - RNA, 64 nt, Human
cuacuugggaggcugaggcaggagaauggcgugaacccgggaagcggagcuugcagugagccga

SEQ ID NO: 115771 - RNA, 64 nt, Human
cuacuugggaggcugaggcaggagaaucacuugaacccgggagaugaagguugcagugagcuga

SEQ ID NO: 115772 - RNA, 64 nt, Human
cuauuugggaggccaaggcaggagaauugccugaacccgggaggcggagguugcagugagcuga

SEQ ID NO: 115773 - RNA, 64 nt, Human
cuacucaggaggcuaaggcaggagaaucgcuugaacccgggagguggagguugcagugagccga

SEQ ID NO: 115774 - RNA, 64 nt, Human
cacaagacccuccccauaagcaggggaccagcauacccgggagcugucccugucugucacagca

SEQ ID NO: 115775 - RNA, 64 nt, Human
cuacuugggaggcuaaggcaggagaaucgcuugaacccgggaggcggagguugcagugagccga

SEQ ID NO: 115776 - RNA, 64 nt, Human
guggagugccgggacccucagaguggagagagagacccgggaugugugugcuguaccccaagcu

SEQ ID NO: 115777 - RNA, 64 nt, Human
cuacuccggaggcugaggcaggagaauggcgugaacccgggaggcggagcuugcagugagccga

SEQ ID NO: 115778 - RNA, 64 nt, Human
cuacccaggaggcugaggcaagagaaucacuugaacccgggaggcagagggugcaguaagccga

SEQ ID NO: 115779 - RNA, 64 nt, Human
cuacucgggaggcugaggcuggagaguugcucaaacccgggaggcggagauugcagugagccaa

SEQ ID NO: 115780 - RNA, 64 nt, Human
cuacuugggaggcugaggcaugagaauugcuugaacccgggaagugaagguugccgugagcuga

SEQ ID NO: 115781 - RNA, 64 nt, Human
uucuuccgcauccacacacagccggcugcccuugacccgggaggccccggcucuccucuccccu

SEQ ID NO: 115782 - RNA, 64 nt, Human
auacucgggaggcugaagcaggagaauugcuugaacccgggaggcagagguugcagugagugga

SEQ ID NO: 115783 - RNA, 64 nt, Human
uggagcuggagaaaccaaaacugggucucucuccacccgggagcugaggaggggugggggccgu

SEQ ID NO: 115784 - RNA, 64 nt, Human
cuauucaagaggcugaggcaugaggaucucuugaacccgggaggugggaguuguagugagccga

SEQ ID NO: 115785 - RNA, 64 nt, Human
gcaagcugaaggcugaggcaggagaaucacucgaacccgggaggcagagguugcagugagccga

SEQ ID NO: 115786 - RNA, 64 nt, Human
cuacucaugaggcugaggcaggagaauggcgugaacccgggagguggagcuugcaaugagccaa

SEQ ID NO: 115787 - RNA, 64 nt, Human
cagcuacuugggaggcugaggcagcauugcuugaacccgggagguggaggcugcaaugagcuga

SEQ ID NO: 115788 - RNA, 64 nt, Human
cuacucgggaggcugaggcaggagaauugcuugaacccgggagacggagguugcagugagcuga

SEQ ID NO: 115789 - RNA, 64 nt, Human
cuacucaggaggcugaggcagcagaaucguuugaacccgggaggcggagguugcagugagugga

SEQ ID NO: 115790 - RNA, 64 nt, Human
ccugaaagcuugggggucccacccuucuuaccccacccgggaggaacgcccagggccccgggcu

SEQ ID NO: 115791 - RNA, 64 nt, Human
ucaccuucuuaaaagagacaggagaaucacuugaacccgggagguggagguuguggugagccaa

SEQ ID NO: 115792 - RNA, 64 nt, Human
cugcucaggaggcugaggcaggagaauugauugaacccgggaggcagagguugcacugagcuga

SEQ ID NO: 115793 - RNA, 64 nt, Human
cucugacuccucaacaggcauaaucaccagcaacacccgggacaauaauacgggggccaccuac

SEQ ID NO: 115794 - RNA, 64 nt, Human
cuacucggaaggcugaggcaggagaauugcuugaacccgggaggcagagguugcagugagccga

SEQ ID NO: 115795 - RNA, 64 nt, Human
cucagagaaacaccaacugaaaagagccaggaaaacccgggaauuuuccaaaaggucuucacgu

SEQ ID NO: 115796 - RNA, 64 nt, Human
cuacuugggaggcugaggcaggagaauggugugaacccgggagcggagguugcagugagcugag

SEQ ID NO: 115797 - RNA, 64 nt, Human
cuacuugggaggcugaggcagaagaaucacuugaacccgggaaggggagguugcagugagcgga

SEQ ID NO: 115798 - RNA, 64 nt, Human
cuacucaggaggcuaaggcaggagaaucgcuugaacccgggagguggagguugccgugagcuga

SEQ ID NO: 115799 - RNA, 64 nt, Human
cuacucgggaggcugaggcaggagaaucgcuugaacccgggagguggagguuacagugagccga

SEQ ID NO: 115800 - RNA, 64 nt, Human
uacucgggaggcugaggcaggaagaaucgcuugaacccgggaggcagagguugcagugagccga

SEQ ID NO: 115801 - RNA, 64 nt, Human
gcuucucaaauuuugaugugagugccacuuccccacccgggaaaggcugccgccaccaccacca

SEQ ID NO: 115802 - RNA, 64 nt, Human
cuacucgggaggcugaggcaggagaauggugugaacccgggaggcggagcuugcaguggagcca

SEQ ID NO: 115803 - RNA, 64 nt, Human
cuacuccggaggcugaggcaggagaauggcgugaacccgggaggcggaucuugcagugagcgga

SEQ ID NO: 115804 - RNA, 64 nt, Human
cuacucgggaggcugaggcagaaggauuguuugaacccgggagguggagguugcagugagccga

SEQ ID NO: 115805 - RNA, 64 nt, Human
ccaaaccuuaucuccacaaccucuuccccccaaaacccgggaaccuccccagccugcgccugcu

SEQ ID NO: 115806 - RNA, 64 nt, Human
cuacucgggaggcugaggcaggagaaucacuugaacccgggaggcggcgguugcagugagccga

SEQ ID NO: 115807 - RNA, 64 nt, Human
cuacucgggaggcugaggcacaagaaucacuugaacccgggaggcagagguuguagugagccca

SEQ ID NO: 115808 - RNA, 64 nt, Human
gaaggugauuaaagauacggagucccuguucaaaacccgggagaaggaguaucaggagaccauu

SEQ ID NO: 115809 - RNA, 64 nt, Human
cuacuugggaagcugaggcgggagaaucaugugaacccgggacgcagggguugcagugagcgga

SEQ ID NO: 115810 - RNA, 64 nt, Human
cgugguuuccguaucgucaacccuucagccgccgacccgggaggggucuggccuacacuggucu

SEQ ID NO: 115811 - RNA, 64 nt, Human
cuacucaggaggcugaggcaggagaauggugugaacccgggaggcagagcuugcagugagccga

SEQ ID NO: 115812 - RNA, 64 nt, Human
cuacuuggaaggcugaggcaggagaauggcgugaacccgggaggcagagcuugcagugagccaa

SEQ ID NO: 115813 - RNA, 64 nt, Human
cuacucaggaggcugaggcaggagaaucgcuugaacccgggagguggagguugcagugagcuga

SEQ ID NO: 115814 - RNA, 64 nt, Human
cuacuugggaggcugaggcaggaaaauggcuugaacccgggagguggagguugcagugagcuga

SEQ ID NO: 115815 - RNA, 64 nt, Human
cuacucaggaggcugaggcaggagaaucgcuugaacccgggaggcagagguugcagugaacuga

SEQ ID NO: 115816 - RNA, 64 nt, Human
cuacucgagaggcugaggcaggagaauggcgugaacccgggagguggagcuugcagugagcgga

SEQ ID NO: 115817 - RNA, 64 nt, Human
cuacccaggaggcugaggcaggagaauugcugaaacccgggagucagaggcugcagagagccga

SEQ ID NO: 115818 - RNA, 50 nt, Human
aaaagccaucuauguacugaacccgggacuagaaggaaaauaaaugaucu

SEQ ID NO: 115819 - RNA, 64 nt, Human
cuacucuggaggcugaggcaaaagaaucgcuugaacccgggagguggagguugcagugagcuga

SEQ ID NO: 115820 - RNA, 64 nt, Human
cuacucaggaagcugaggcgagagaaucgcuugaacccgggaggcaaagguugcagugagcuga

SEQ ID NO: 115821 - RNA, 64 nt, Human
cuacucgggaggcugagacaggagacuugcuugaacccgggagguggagguugcccugagcuga

SEQ ID NO: 115822 - RNA, 64 nt, Human
auuggaagcagcccacaccugauguggacuccugacccgggacucacucuucauucagaagacu

SEQ ID NO: 115823 - RNA, 64 nt, Human
acuccuucucucacuguguuacugcuuugcaaagacccgggagcuggcggggaacccugggagu

SEQ ID NO: 115824 - RNA, 64 nt, Human
cuacuugggaggcugagacaggagaaucacuugaacccgggaggcagagguugcagugagccaa

SEQ ID NO: 115825 - RNA, 64 nt, Human
cugcucaggaggcugaggcaggagaaucgcuugaacccgggaggcagagauugcaguaagcuga

SEQ ID NO: 115826 - RNA, 64 nt, Human
uacucggagaggcugaggcaggagaauggcgugaacccgggagguggagcuugcagugagccga

SEQ ID NO: 115827 - RNA, 64 nt, Human
cuacucuggaggcugaggcaggagaaucaauugaacccgggaggcggagcuuacagugagcuga

SEQ ID NO: 115828 - RNA, 64 nt, Human
agugguacugccugguaaaagaauugguucugugacccgggaagcuuugguuggccuugauuuc

SEQ ID NO: 115829 - RNA, 64 nt, Human
cuacucaggaggcagaggcaggagaaucacuugaacccgggagguggaggcugcagugaacaga

SEQ ID NO: 115830 - RNA, 64 nt, Human
acauggaaccggacuccaagaugacgaucuaaagacccgggagcgagaagccaaggccagguuc

SEQ ID NO: 115831 - RNA, 64 nt, Human
caugaguccccuguuuguuucugaaagggacgcuacccgggaagggggcugggacaugggaaag

SEQ ID NO: 115832 - RNA, 64 nt, Human
cuacucgggaggcugaggcaggaaaaucacuugaacccgggaggcggagguugcggugagccaa

SEQ ID NO: 115833 - RNA, 64 nt, Human
cuacaggggaggcugaggcaggagaaucgcuugaacccgggagguguagguugcagugagccga

SEQ ID NO: 115834 - RNA, 64 nt, Human
ugagucucgacugucaaaucuucuucagaggaucacccgggaaaacgaccgagaccgaagauug

SEQ ID NO: 115835 - RNA, 64 nt, Human
ugagucucgacugucaaaucuucuucggaggaucacccgggaagacgacagagacugaagauug

SEQ ID NO: 115836 - RNA, 64 nt, Human
cuacucgagaggcugaggcagcagaauugcuugaacccgggagguggagguuacagugagcuga

SEQ ID NO: 115837 - RNA, 64 nt, Human
cuacuagggaggcugaggcaggagaaucacucgaacccgggaggcagagguugcagugagucaa

SEQ ID NO: 115838 - RNA, 64 nt, Human
cuacuugggagacugaggcaagagaaucacuugaacccgggagguggagguggcagugagccga

SEQ ID NO: 115839 - RNA, 64 nt, Human
cagguagcagggccccagccaguacccguggaggacccgggaaauugcaccuuacagacagugg

SEQ ID NO: 115840 - RNA, 64 nt, Human
cagcucuuaaggcugaggcacaagaauugcuugaacccgggaggcagaggcuguagugagccaa

SEQ ID NO: 115841 - RNA, 64 nt, Human
uuggccaccuuggaguagacccagaccccucgggacccgggacauuagucucaggcugcugaug

SEQ ID NO: 115842 - RNA, 64 nt, Human
cuacuggggaggcugaggcaggagaauggcaugaacccgggagguggagguugcagggagccga

SEQ ID NO: 115843 - RNA, 64 nt, Human
cuacucgggaggcugaggcaggagaaucacuugaacccgggaaguggagguugcagugagccaa

SEQ ID NO: 115844 - RNA, 64 nt, Human
cuacucgggagguugaggcaggagaauggggugaacccgggaggaagagcuugcagugagccga

SEQ ID NO: 115845 - RNA, 64 nt, Human
cuacucaggaggcugaggcaggagaauugcuugaacccgggaggcggagguugcaguuagcuga

SEQ ID NO: 115846 - RNA, 64 nt, Human
cuacucgggaggcugaggcaggagaauggcgugaacccgggaggcggagcuugcagugagccga

SEQ ID NO: 115847 - RNA, 64 nt, Human
cuacuccagaggcugaggcaagagaaucacuugaacccgggaggcggagguuucagugagccga

SEQ ID NO: 115848 - RNA, 64 nt, Human
aaaauugaguccaaggaaaaagagagacucagagacccgggagggccuuccucugaaaggccaa

SEQ ID NO: 115849 - RNA, 64 nt, Human
gaaaggccuguggggagccgagggcgucagagagacccgggaaggaaggcucucggguggggga

SEQ ID NO: 115850 - RNA, 64 nt, Human
cuacuugggaggcugaggcaggagaauggugugaacccgggagauggcgcuugcagugagcuga

SEQ ID NO: 115851 - RNA, 64 nt, Human
cuacuuggcaggcugaggcagaagaaucaccugaacccgggagguggagguugcagugagccaa

SEQ ID NO: 115852 - RNA, 64 nt, Human
cuacuugggaggcugaggcaggagaauggccugaacccgggaggcggagcuugcagugagccga

SEQ ID NO: 115853 - RNA, 64 nt, Human
cuucucaggaggcugagacaggagaaucgcuugaacccgggaggcagagguugcagugagcuga

SEQ ID NO: 115854 - RNA, 64 nt, Human
cuacucgggaggcugaggcaggggaauugcuugaacccgggaggcggaguuugccagccuggca

SEQ ID NO: 115855 - RNA, 64 nt, Human
cuacuugggaggcugaggcagaagaaucacuugaacccgggaggcagagguuacagugagcuga

SEQ ID NO: 115856 - RNA, 64 nt, Human
cuacuugggaggcugaggcaggagaauggcgugaacccgggagguggagcuugcagugagccaa

SEQ ID NO: 115857 - RNA, 64 nt, Human
ucugggggagggggaaccccggggacaugcccccacccgggaggggccgguaaccccugggcua

SEQ ID NO: 115858 - RNA, 64 nt, Human
cuacucaggaggcugaggcaggagaauggugugaacccgggagguggagcuugcagugagccga

SEQ ID NO: 115859 - RNA, 64 nt, Human
gguguagacuggucgccaucacguguaauaaagcacccgggaaaggcagaguguggacgcgucc

SEQ ID NO: 115860 - RNA, 64 nt, Human
acuggagggccaggccccgccacccccacgggagacccgggacagggcgucuuccuaaguuauu

SEQ ID NO: 115861 - RNA, 64 nt, Human
cgacacucagacacaaggcaaagagggccacaggacccgggaaauacacacagagccaggagca

SEQ ID NO: 115862 - RNA, 64 nt, Human
ccuggugugguggcccgcaccuguggucccagcuacccgggaggcugaguugggaggauccuuu

SEQ ID NO: 115863 - RNA, 64 nt, Human
cuacucgggaggcugaggcaggagaauggugugaacccgggaagcggagcuugcagugagccga

SEQ ID NO: 115864 - RNA, 64 nt, Human
ggccccacaccauggcauccgggggucuucgggaacccgggaaauggaauaaagauguuuuugg

SEQ ID NO: 115865 - RNA, 64 nt, Human
cuacuugggagccugaggcgggagaauugcuugaacccgggaggcagagguugcagugagccga

SEQ ID NO: 115866 - RNA, 64 nt, Human
cuacucgggaggcugaggcaggagaauugcuugaacccgggaggcagagguugaagugagcuga

SEQ ID NO: 115867 - RNA, 64 nt, Human
cuacucgggaggcugaagcagaagaaucgcuugaacccgggaggcggagguuacagugagcuga

SEQ ID NO: 115868 - RNA, 64 nt, Human
uuacucgggaggcugaggcaggagaaucgcuugaacccgggagguggagauugcagugagccca

SEQ ID NO: 115869 - RNA, 64 nt, Human
cuacucaggaggcugaggcaggagaauggcgugaacccgggaggcggagcuugcagugagccga

SEQ ID NO: 115870 - RNA, 64 nt, Human
uuuuuuccuuuggaugguuaaaagcauugcaggcacccgggaaggugagcagaggguagguggg

SEQ ID NO: 115871 - RNA, 64 nt, Human
ccaugggcguggaggggcuucccggacaccgcccacccgggacccgccucuuccaccaagacag

SEQ ID NO: 115872 - RNA, 64 nt, Human
cuacucgggaggcugaggcaggagaaucgcuugaacccgggagguggagguugcggugagccaa

SEQ ID NO: 115873 - RNA, 64 nt, Human
cuacuugguaggcugaggcaggagaauggcgggaacccgggaggcagagguugcagugagcuga

SEQ ID NO: 115874 - RNA, 64 nt, Human
cugggcccuggggaacuggcuuacuuggggccccacccgggagugaugguucuggcugauuugu

SEQ ID NO: 115875 - RNA, 64 nt, Human
acucaggaggcugaggcaggauaauuuugcuuaaacccgggaggcggagguugcagugagccga

SEQ ID NO: 115876 - RNA, 64 nt, Human
ccugaccgcugagagcgcagacacccuucuucacacccgggacccccagguuuuugcgaacccc

SEQ ID NO: 115877 - RNA, 64 nt, Human
cagggcccagggacuccccccacagcagggugggacccgggacccgcggcucaguggcccgcua

SEQ ID NO: 115878 - RNA, 64 nt, Human
cugguuguuucacaagacagauucuguccuugucacccgggacagaaaacucagucuuuucacc

SEQ ID NO: 115879 - RNA, 64 nt, Human
cuugggcgcggccccaaaauugccuucaaaacaaacccgggacgguugaaagccuucgaaccgu

SEQ ID NO: 115880 - RNA, 64 nt, Human
cuaugcgagaggcugaggcaggagaauggcgugaacccgggaggcggagcuugcagugagccga

SEQ ID NO: 115881 - RNA, 64 nt, Human
acugcccacucugcccacacuucccugccuagagacccgggaaggggcugugucgguaguggug

SEQ ID NO: 115882 - RNA, 64 nt, Human
agcuacucgggagacuaggcagagaauugguugaacccgggagguggagguugcagugagccga

SEQ ID NO: 115883 - RNA, 64 nt, Human
caggaguccaggcccccagccccuccucccucagacccgggaguccaggcccccagccccuccu

SEQ ID NO: 115884 - RNA, 64 nt, Human
cuacucaggaggcugaggcaggagaaucgcuugaacccgggagguggagguugcagugagccga

SEQ ID NO: 115885 - RNA, 64 nt, Human
ccaggcauaguugugggcaccuguaaucccagcuacccgggaggcugaggcaggagaauugcuu

SEQ ID NO: 115886 - RNA, 64 nt, Human
uagccauccaaugggcauugugugggugcuuggaacccgggaugacugagggggacacuggagu

SEQ ID NO: 115887 - RNA, 64 nt, Human
cuacucaagaggcugaggcaggagaauagcuugaacccgggaggcagagguugcagugagccga

SEQ ID NO: 115888 - RNA, 64 nt, Human
uggguccuugcccccgacagacagagcagcccccacccgggagccuugaugggggucaggcaga

SEQ ID NO: 115889 - RNA, 64 nt, Human
uuacucgagaggcugaggcaggaaaaucgcuugaacccgggaggcagagguuacagugagccaa

SEQ ID NO: 115890 - RNA, 64 nt, Human
cagguugugggccauuuuccugaacucaccacuuacccgggauaguaaacaugauacacaucaa

SEQ ID NO: 115891 - RNA, 64 nt, Human
cuacuccggaggcugagggaggagaauggugugaacccgggagguggagcuuccagugagccga

SEQ ID NO: 115892 - RNA, 64 nt, Human
ccuagagaagcugcacacccaggagcuuuccaugacccgggagcaugagugaauggggguucca

SEQ ID NO: 115893 - RNA, 64 nt, Human
cuacgugggaggcugaggcagcagacuggugugaacccgggagguggagcuugcagugagccga

SEQ ID NO: 115894 - RNA, 64 nt, Human
cuacucgagugccugaggcaggagaauugcaugaacccgggaggaggaggaggagguugcagug

SEQ ID NO: 115895 - RNA, 64 nt, Human
cuacucgggaggcugaggcaggagaauggcuagaacccgggaggcggagguugccgugagucga

SEQ ID NO: 115896 - RNA, 64 nt, Human
cagaugaccucaugaacuggaaggggucaaggugacccgggaggagagcucaagacagggcaca

SEQ ID NO: 115897 - RNA, 64 nt, Human
guucuaaugcugcacaccaguuacuguucauggcacccgggaaugacuugggccaaucacugag

SEQ ID NO: 115898 - RNA, 64 nt, Human
cuacucaggaggcugaggcaggagaaucgcuugaacccgggaggcagagguagcagugagcuga

SEQ ID NO: 115899 - RNA, 64 nt, Human
aggcuuucagcaaaaaggcugcuuaaaagcaugaacccgggaugcagagcagcuuuugugcacg

SEQ ID NO: 115900 - RNA, 64 nt, Human
agccgcagggacccacgcugucugcgcuggcuccacccgggaacccgccgcacgcuguguucua

SEQ ID NO: 115901 - RNA, 64 nt, Human
ccaggcccucacccaguucagauccacggccuccacccgggacgccuuccuccucugcucccaa

SEQ ID NO: 115902 - RNA, 64 nt, Human
uauauacauaucuagggcuaguacuuaguuucacacccgggagcugggagaaaaaaccuguaca

SEQ ID NO: 115903 - RNA, 64 nt, Human
cuacucuggaggcugaggcaggagaguagcgugaacccgggaggcagagcuugcggugagccga

SEQ ID NO: 115904 - RNA, 64 nt, Human
ugcagacuggaccugugguucauaccuugucaccacccgggaagcugaaggccacuuccuccca

SEQ ID NO: 115905 - RNA, 64 nt, Human
cuacucgggaggcugaggcaggagaauaacuuaaacccgggaggcggagguuacagugagcuga

SEQ ID NO: 115906 - RNA, 64 nt, Human
gagggagagggggccgggagggguugucaagcccacccgggaaacugagcccuggagaggggaa

SEQ ID NO: 115907 - RNA, 64 nt, Human
acugcguggccccucagaugcugggacacaacagacccgggacccagcugugcuacccaccccu

SEQ ID NO: 115908 - RNA, 64 nt, Human
gcagagcuucagagguggccccaccugagcccccacccgggagcaguguccugugcuuucugca

SEQ ID NO: 115909 - RNA, 64 nt, Human
uuuaacaguguaaugggaggaucugaaagguuggacccgggagggguagcugccgaugugucuu

SEQ ID NO: 115910 - RNA, 64 nt, Human
cuacucaggaggcugagacaggacacuugcuugaacccgggagguggagguugcaaugagccaa

SEQ ID NO: 115911 - RNA, 64 nt, Human
ugacuugggaggcugaggcaggagaaucgcuugaacccgggaggcggagguugcagugagcuaa

SEQ ID NO: 115912 - RNA, 64 nt, Human
cuacuuggggugcugaggcaggagaaucaacugaacccgggaggcggaggcugcagugggccgg

SEQ ID NO: 115913 - RNA, 64 nt, Human
cuacucgggaggcugaggcaggagaauggugugaacccgggaggcagagcuugcagugagccga

SEQ ID NO: 115914 - RNA, 64 nt, Human
cuacucgggaggcugaggcaggagaaucgcuugaacccgggaggcagaggcugcaguaagccga

SEQ ID NO: 115915 - RNA, 64 nt, Human
uuacucgggaggcugaggcaggagaaucacuugaacccgggaggcagagguugcggugagccaa

SEQ ID NO: 115916 - RNA, 64 nt, Human; identical to SEQ ID NO: 86684

SEQ ID NO: 115917 - RNA, 64 nt, Human; identical to SEQ ID NO: 86685

SEQ ID NO: 115918 - RNA, 64 nt, Human; identical to SEQ ID NO: 86686

SEQ ID NO: 115919 - RNA, 64 nt, Human; identical to SEQ ID NO: 86687

SEQ ID NO: 115920 - RNA, 64 nt, Human; identical to SEQ ID NO: 86688

SEQ ID NO: 115921 - RNA, 64 nt, Human; identical to SEQ ID NO: 86689

SEQ ID NO: 115922 - RNA, 64 nt, Human; identical to SEQ ID NO: 86690

SEQ ID NO: 115923 - RNA, 64 nt, Human; identical to SEQ ID NO: 86691

SEQ ID NO: 115924 - RNA, 64 nt, Human; identical to SEQ ID NO: 86692

SEQ ID NO: 115925 - RNA, 64 nt, Human; identical to SEQ ID NO: 86693

SEQ ID NO: 115926 - RNA, 64 nt, Human; identical to SEQ ID NO: 86694

SEQ ID NO: 115927 - RNA, 64 nt, Human; identical to SEQ ID NO: 86695

SEQ ID NO: 115928 - RNA, 64 nt, Human; identical to SEQ ID NO: 86696

SEQ ID NO: 115929 - RNA, 64 nt, Human; identical to SEQ ID NO: 86697

SEQ ID NO: 115930 - RNA, 64 nt, Human; identical to SEQ ID NO: 86698

SEQ ID NO: 115931 - RNA, 64 nt, Human; identical to SEQ ID NO: 86699

SEQ ID NO: 115932 - RNA, 64 nt, Human; identical to SEQ ID NO: 86700

SEQ ID NO: 115933 - RNA, 64 nt, Human; identical to SEQ ID NO: 86701

SEQ ID NO: 115934 - RNA, 64 nt, Human; identical to SEQ ID NO: 86702

SEQ ID NO: 115935 - RNA, 64 nt, Human; identical to SEQ ID NO: 86703

SEQ ID NO: 115936 - RNA, 64 nt, Human; identical to SEQ ID NO: 86704

SEQ ID NO: 115937 - RNA, 64 nt, Human; identical to SEQ ID NO: 86705

SEQ ID NO: 115938 - RNA, 64 nt, Human; identical to SEQ ID NO: 86706

SEQ ID NO: 115939 - RNA, 64 nt, Human; identical to SEQ ID NO: 86707

SEQ ID NO: 115940 - RNA, 64 nt, Human; identical to SEQ ID NO: 86708

SEQ ID NO: 115941 - RNA, 64 nt, Human; identical to SEQ ID NO: 86709

SEQ ID NO: 115942 - RNA, 64 nt, Human; identical to SEQ ID NO: 86710

SEQ ID NO: 115943 - RNA, 64 nt, Human; identical to SEQ ID NO: 86711

SEQ ID NO: 115944 - RNA, 64 nt, Human; identical to SEQ ID NO: 86712

SEQ ID NO: 115945 - RNA, 64 nt, Human; identical to SEQ ID NO: 86713

SEQ ID NO: 115946 - RNA, 64 nt, Human; identical to SEQ ID NO: 86714

SEQ ID NO: 115947 - RNA, 64 nt, Human; identical to SEQ ID NO: 86715

SEQ ID NO: 115948 - RNA, 64 nt, Human; identical to SEQ ID NO: 86716

SEQ ID NO: 115949 - RNA, 64 nt, Human; identical to SEQ ID NO: 86717

SEQ ID NO: 115950 - RNA, 64 nt, Human; identical to SEQ ID NO: 86718

SEQ ID NO: 115951 - RNA, 64 nt, Human; identical to SEQ ID NO: 86719

SEQ ID NO: 115952 - RNA, 64 nt, Human; identical to SEQ ID NO: 86720

SEQ ID NO: 115953 - RNA, 64 nt, Human; identical to SEQ ID NO: 86721

SEQ ID NO: 115954 - RNA, 64 nt, Human; identical to SEQ ID NO: 86722

SEQ ID NO: 115955 - RNA, 64 nt, Human; identical to SEQ ID NO: 86723

SEQ ID NO: 115956 - RNA, 64 nt, Human; identical to SEQ ID NO: 86724

SEQ ID NO: 115957 - RNA, 64 nt, Human; identical to SEQ ID NO: 86725

SEQ ID NO: 115958 - RNA, 64 nt, Human; identical to SEQ ID NO: 86726

SEQ ID NO: 115959 - RNA, 64 nt, Human; identical to SEQ ID NO: 86727

SEQ ID NO: 115960 - RNA, 64 nt, Human; identical to SEQ ID NO: 86728

SEQ ID NO: 115961 - RNA, 64 nt, Human; identical to SEQ ID NO: 86729

SEQ ID NO: 115962 - RNA, 64 nt, Human; identical to SEQ ID NO: 86730

SEQ ID NO: 115963 - RNA, 64 nt, Human; identical to SEQ ID NO: 86731

SEQ ID NO: 115964 - RNA, 64 nt, Human; identical to SEQ ID NO: 86732

SEQ ID NO: 115965 - RNA, 64 nt, Human; identical to SEQ ID NO: 86733

SEQ ID NO: 115966 - RNA, 64 nt, Human; identical to SEQ ID NO: 86734

SEQ ID NO: 115967 - RNA, 64 nt, Human; identical to SEQ ID NO: 86735

SEQ ID NO: 115968 - RNA, 64 nt, Human; identical to SEQ ID NO: 86736

SEQ ID NO: 115969 - RNA, 64 nt, Human; identical to SEQ ID NO: 86737

SEQ ID NO: 115970 - RNA, 64 nt, Human; identical to SEQ ID NO: 86738

SEQ ID NO: 115971 - RNA, 64 nt, Human; identical to SEQ ID NO: 86739

SEQ ID NO: 115972 - RNA, 64 nt, Human; identical to SEQ ID NO: 86740

SEQ ID NO: 115973 - RNA, 64 nt, Human; identical to SEQ ID NO: 86741

SEQ ID NO: 115974 - RNA, 64 nt, Human; identical to SEQ ID NO: 86742

SEQ ID NO: 115975 - RNA, 64 nt, Human; identical to SEQ ID NO: 86743

SEQ ID NO: 115976 - RNA, 64 nt, Human; identical to SEQ ID NO: 86744

SEQ ID NO: 115977 - RNA, 64 nt, Human; identical to SEQ ID NO: 86745

SEQ ID NO: 115978 - RNA, 64 nt, Human; identical to SEQ ID NO: 86746

SEQ ID NO: 115979 - RNA, 64 nt, Human; identical to SEQ ID NO: 86747

SEQ ID NO: 115980 - RNA, 64 nt, Human; identical to SEQ ID NO: 86748

SEQ ID NO: 115981 - RNA, 64 nt, Human; identical to SEQ ID NO: 86749

SEQ ID NO: 115982 - RNA, 64 nt, Human; identical to SEQ ID NO: 86750

SEQ ID NO: 115983 - RNA, 64 nt, Human; identical to SEQ ID NO: 86751

SEQ ID NO: 115984 - RNA, 64 nt, Human; identical to SEQ ID NO: 86752

SEQ ID NO: 115985 - RNA, 64 nt, Human; identical to SEQ ID NO: 86753

SEQ ID NO: 115986 - RNA, 64 nt, Human; identical to SEQ ID NO: 86754

SEQ ID NO: 115987 - RNA, 64 nt, Human; identical to SEQ ID NO: 86755

SEQ ID NO: 115988 - RNA, 64 nt, Human; identical to SEQ ID NO: 86756

SEQ ID NO: 115989 - RNA, 59 nt, Human; identical to SEQ ID NO: 86757

SEQ ID NO: 115990 - RNA, 64 nt, Human; identical to SEQ ID NO: 86758

SEQ ID NO: 115991 - RNA, 64 nt, Human; identical to SEQ ID NO: 86759

SEQ ID NO: 115992 - RNA, 64 nt, Human; identical to SEQ ID NO: 86760

SEQ ID NO: 115993 - RNA, 52 nt, Human; identical to SEQ ID NO: 86761

SEQ ID NO: 115994 - RNA, 64 nt, Human; identical to SEQ ID NO: 86762

SEQ ID NO: 115995 - RNA, 64 nt, Human; identical to SEQ ID NO: 86763

SEQ ID NO: 115996 - RNA, 64 nt, Human; identical to SEQ ID NO: 86764

SEQ ID NO: 115997 - RNA, 64 nt, Human; identical to SEQ ID NO: 86765

SEQ ID NO: 115998 - RNA, 64 nt, Human; identical to SEQ ID NO: 86766

SEQ ID NO: 115999 - RNA, 64 nt, Human; identical to SEQ ID NO: 86767

SEQ ID NO: 116000 - RNA, 64 nt, Human; identical to SEQ ID NO: 86768

SEQ ID NO: 116001 - RNA, 64 nt, Human; identical to SEQ ID NO: 86769

SEQ ID NO: 116002 - RNA, 64 nt, Human; identical to SEQ ID NO: 86770

SEQ ID NO: 116003 - RNA, 64 nt, Human; identical to SEQ ID NO: 86771

SEQ ID NO: 116004 - RNA, 64 nt, Human; identical to SEQ ID NO: 86772

SEQ ID NO: 116005 - RNA, 64 nt, Human; identical to SEQ ID NO: 86773

SEQ ID NO: 116006 - RNA, 64 nt, Human; identical to SEQ ID NO: 86774

SEQ ID NO: 116007 - RNA, 64 nt, Human; identical to SEQ ID NO: 86775

SEQ ID NO: 116008 - RNA, 64 nt, Human; identical to SEQ ID NO: 86776

SEQ ID NO: 116009 - RNA, 64 nt, Human; identical to SEQ ID NO: 86777

SEQ ID NO: 116010 - RNA, 64 nt, Human; identical to SEQ ID NO: 86778

SEQ ID NO: 116011 - RNA, 64 nt, Human; identical to SEQ ID NO: 86779

SEQ ID NO: 116012 - RNA, 64 nt, Human; identical to SEQ ID NO: 86780

SEQ ID NO: 116013 - RNA, 64 nt, Human; identical to SEQ ID NO: 86781

SEQ ID NO: 116014 - RNA, 64 nt, Human; identical to SEQ ID NO: 86782

SEQ ID NO: 116015 - RNA, 64 nt, Human; identical to SEQ ID NO: 86783

SEQ ID NO: 116016 - RNA, 64 nt, Human; identical to SEQ ID NO: 86784

SEQ ID NO: 116017 - RNA, 64 nt, Human; identical to SEQ ID NO: 86785

SEQ ID NO: 116018 - RNA, 64 nt, Human
aguauggaagucacaacuacacagagauuucucagccuacaaauugugucuauacauuucuaag

SEQ ID NO: 116019 - RNA, 64 nt, Human
aaguucuacauucauucagaaaaauguuuuuugagccuacaauacugagcgcaacaaggcugug

SEQ ID NO: 116020 - RNA, 64 nt, Human
gcuauuugaacaaagcaaauuaaaacgauaucaugccuacaaugguuggaagaaaaaauacuug

SEQ ID NO: 116021 - RNA, 64 nt, Human
uccaccucggaaaugcagcuuucccuagggggaggccuacaacaggacgaccauucugagccag

SEQ ID NO: 116022 - RNA, 64 nt, Human
agcaaaaaucugagaaaaaaagugagagaccucugccuacaaaaccucaaaccagucacuuuug

SEQ ID NO: 116023 - RNA, 64 nt, Human
accucuugggauaaaacccaaaguccuuaucauggccuacaaggcccugucugauuuggcuccc

SEQ ID NO: 116024 - RNA, 64 nt, Human
cugaaugaucuggaccaggggucagcaaagugcagccuacaagcuauugcagucagcugccagu

SEQ ID NO: 116025 - RNA, 64 nt, Human
uuauuaggacacuaugguuauaaacuguguuuaagccuacaaucauugauuuuuuuuuguuaug

SEQ ID NO: 116026 - RNA, 64 nt, Human
uuucuuuuuuccucugaguucuguacuucaaccagccuacaagcuggcacuugcuaacaaauca

SEQ ID NO: 116027 - RNA, 64 nt, Human
caaggaaggauauacugagcugauacucuuccaagccuacaacuucaaguuuuaucauuugaac

SEQ ID NO: 116028 - RNA, 64 nt, Human
ccccugugcaccacccaagaaagaggaaaacuuugccuacaacuuuggaaaugcuggggucccu

SEQ ID NO: 116029 - RNA, 64 nt, Human
gguguaccuccaacccuagccuucucccacagcugccuacaacagagucucccagccuucucag

SEQ ID NO: 116030 - RNA, 64 nt, Human
caggguugggaaucaccaaugugggugugaaaaugccuacaaaggguuuuagugccuuagaagu

SEQ ID NO: 116031 - RNA, 64 nt, Human
uguguccuuugugggugccagcggcuguccugaggccuacaagcggcuccuauccagcuucuac

SEQ ID NO: 116032 - RNA, 64 nt, Human
ccaugguguuguguacacuguggagucgacaggggccuacaacaggcagguacugcugccaggg

SEQ ID NO: 116033 - RNA, 64 nt, Human
cuacaggucaccucugugcccaacaacuuuacuugccuacaacgguucacaaacuggaacaggc

SEQ ID NO: 116034 - RNA, 64 nt, Human
cuuugaaaugaguaguugcaauagagaugguaaagccuacaaagccuaauuauuuacugucugg

SEQ ID NO: 116035 - RNA, 64 nt, Human
gauuagagagagaaaauguagaucaaggcgagcugccuacaaauuacucugucuccaaaggcaa

SEQ ID NO: 116036 - RNA, 64 nt, Human
ccacauuuaggaugugcugacagauaagcucuuugccuacaauacauggauaauuagugcuaua

SEQ ID NO: 116037 - RNA, 64 nt, Human
aaaaaguuuugaugggauuuuaaauucaggcaaagccuacaacgcugagacaauccccuaacaa

SEQ ID NO: 116038 - RNA, 64 nt, Human
uuuaccagggugcuuuuaaguuacuuuaaaaaaagccuacaaaauauuuuuuuucuuuuauuug

SEQ ID NO: 116039 - RNA, 64 nt, Human
auggcauaggucacauuuugggaguucagaggaggccuacaagggcaaggucagauggcagagc

SEQ ID NO: 116040 - RNA, 64 nt, Human
aaaaacgugugaugauccugaagcuuacuaugcagccuacaaacagccuuaguaauuaaaacau

SEQ ID NO: 116041 - RNA, 64 nt, Human
gagccaggcuguugaauggaauuucucaguagcagccuacaacugaauagcaaguggcauaaag

SEQ ID NO: 116042 - RNA, 64 nt, Human
uaggcagccugccagugaaggucacuggacucuagccuacaacaugcugagcuacagcccagaa

SEQ ID NO: 116043 - RNA, 64 nt, Human
aauuuaauguccugcuuucacauugaagggcagagccuacaaaacauuguauauuucaaaagac

SEQ ID NO: 116044 - RNA, 64 nt, Human
cccgcccuccaucaaugguggucgugugauugaagccuacaaggggcagaccacgcugauucag

SEQ ID NO: 116045 - RNA, 64 nt, Human
cacuggaaauagcaugaacaaaugcaugaaaauugccuacaacaugccuggcacauagcuguga

SEQ ID NO: 116046 - RNA, 64 nt, Human
uugcacccauuuaacuaucccaaagagccacagugccuacaacccaggcccuaaguugaugaag

SEQ ID NO: 116047 - RNA, 64 nt, Human
gagaauaaugauaaccagaacuugcuggaaaugugccuacaauggccuuguaacagccauuguu

SEQ ID NO: 116048 - RNA, 64 nt, Human
ugcugggauuuacaggcaugagccaccgcacccagccuacaauaauuuucuuaaacuuuaccuu

SEQ ID NO: 116049 - RNA, 64 nt, Human
caucugugucugcuguauuauaaacagauaagcagccuacaagauaacuguauuuauaaaccac

SEQ ID NO: 116050 - RNA, 64 nt, Human
auuuuuuuuuuuaaccacucaaucccaaauggaggccuacaaagaacaucguaauaacacaugg

SEQ ID NO: 116051 - RNA, 64 nt, Human
auaauaacugguuuugccagacagcagguugucugaccuucaaccacugggcaauugccuggca

SEQ ID NO: 116052 - RNA, 64 nt, Human
cuacacuuugguuugucauggugucagcgcagcagccuacaacuaaguuccuaaacgccacuuu

SEQ ID NO: 116053 - RNA, 64 nt, Human
aauccugugcugaacccgaaucuuccaaaaaacagccuacaaucugugaccaccacaagaugug

SEQ ID NO: 116054 - RNA, 64 nt, Human
cccacuuuugaugccugugaugcaauuuuuuauugccuacaaugagauacacuuaguacaaaaa

SEQ ID NO: 116055 - RNA, 64 nt, Human
aaggcgagacuccgccuuucuaaucacaaauguagccuacaagcaagcggcuuuggauugcuua

SEQ ID NO: 116056 - RNA, 64 nt, Human
ccaaugcucguuaacagcugcuguaacuagucuggccuacaauagugugauucauguaggacuu

SEQ ID NO: 116057 - RNA, 64 nt, Human
auagguuucuaaaaagucagauguuugagcaguggccuacaaaucaguaauuuucggaugggag

SEQ ID NO: 116058 - RNA, 64 nt, Human
cauagcuuuauuacucuaaucccagguaagucaagccuacaaugcccuagaggaagaguaaaac

SEQ ID NO: 116059 - RNA, 64 nt, Human
accuuacuauacagaaauucauacuggagagaaagccuacaauugugaagaauguggcaaagcu

SEQ ID NO: 116060 - RNA, 64 nt, Human
uacugaacauaagaaaauuuacacuagagagaaagccuacaaaugugaagaauguggcaaagcc

SEQ ID NO: 116061 - RNA, 64 nt, Human
ucgaaauaauaauuccacagccucuucuaacaaugccuacaaugugaauuccucccaaccucug

SEQ ID NO: 116062 - RNA, 64 nt, Human
uuccaaagacuccccccagguacagugccuucgagccuacaagccccgagagaaugaugaauug

SEQ ID NO: 116063 - RNA, 64 nt, Human
uugugcaagucaggcccuucuggaacacagcagggccuacaacgaggggccuuugcgaugggcu

SEQ ID NO: 116064 - RNA, 64 nt, Human
aguauuuauuacuaaccucccuuaagcagcaacagccuacaaagagaugcuuggagcaaucaga

SEQ ID NO: 116065 - RNA, 64 nt, Human
ucgagggucaaaauacaaagacauuuuugcuagggccuacaaauugaauuuaaaaacucacugc

SEQ ID NO: 116066 - RNA, 64 nt, Human
caaggcucucuaccuaccuagauguuuuucagaggccuacaaauacaaguaucuuucuuauaug

SEQ ID NO: 116067 - RNA, 54 nt, Human
uagaaaaaccuaacaaauaggccugccuacaauauucucauuauuaacuuccuc

SEQ ID NO: 116068 - RNA, 64 nt, Human
guaagguuaucugguuuuaaaagaaaaaaaaaaagccuacaaacucagugaccuacuacgcaga

SEQ ID NO: 116069 - RNA, 52 nt, Human; identical to SEQ ID NO: 14036

SEQ ID NO: 116070 - RNA, 64 nt, Human
auucucuuacuuaaauacguuugauuucugaaaagccuacaaauggaggggaaaugagauugug

SEQ ID NO: 116071 - RNA, 64 nt, Human
cuaccaccuuuuccuuauacuguauaugauuauggccuacaauguuguauuuguuauuuauuaa

SEQ ID NO: 116072 - RNA, 64 nt, Human
ugagaggguuuuaacaaaucauauuagccaaaaagccuacaacauagaugcauuuagcaaacca

SEQ ID NO: 116073 - RNA, 64 nt, Human
aauuauuauuauaaaucaccaauauaaauuuauugccuacaauuguggacuuaucauauuuuua

SEQ ID NO: 116074 - RNA, 64 nt, Human
acaggugcgucagaugcuguucgaccuggagucagccuacaacgccuucaaccgcuuccugcau

SEQ ID NO: 116075 - RNA, 64 nt, Human
cucagucucaaagucaccuugaaagcuucaccuggccuacaacuuuuauuuuaaaaagaugauc

SEQ ID NO: 116076 - RNA, 64 nt, Human
uguucuaucuccaaaugagacacauuaaaggguagccuacaaauguuuucaggcuucuuucaaa

SEQ ID NO: 116077 - RNA, 64 nt, Human
gcucacgggcggcggcggaccccgaccuccaguugccuacaauuccagucgcugacuugguccu

SEQ ID NO: 116078 - RNA, 64 nt, Human
ugagauuuucaggacacagacauaugaugugaaugccuacaaagccagugcgcauaggaacagu

SEQ ID NO: 116079 - RNA, 64 nt, Human
aggacucauuguuccacccccaaccaauuugaaugccuacaauaaguucaggagcugugccaag

SEQ ID NO: 116080 - RNA, 64 nt, Human
cccucuccugcgcuuccuccuggaguccggagccgccuacaacugcucccugcacggugcgucc

SEQ ID NO: 116081 - RNA, 64 nt, Human
cuguuuucuguuucauaacacaaggcugguuguggccuacaaaccuaauuucaugacccagugg

SEQ ID NO: 116082 - RNA, 64 nt, Human
ccccuggcagggcuuccuuccaagggccccugcagccuacaaacugggccucgggcgacucaaa

SEQ ID NO: 116083 - RNA, 64 nt, Human
ccugugagagaggauuagauaggguuccaacugggccuacaagcucaagccauacauaaaagga

SEQ ID NO: 116084 - RNA, 64 nt, Human
uugcuauacguguuuuggggcuauuuugucagaugccuacaaauuuaggauuguuuuaucuucc

SEQ ID NO: 116085 - RNA, 64 nt, Human
cccaguuccaucuucauccauggccacaggcccugccuacaacgcacuagggacgucccucccu

SEQ ID NO: 116086 - RNA, 64 nt, Human
uguagggacaaaugugcauuuguuuguggcaaaagccuacaauugacaaacuuguaaauuucuu

SEQ ID NO: 116087 - RNA, 64 nt, Human
uuaaggcacugagugggcgggggaggcugggagccggcggcaggauuagcuggugcugaacuuu

SEQ ID NO: 116088 - RNA, 64 nt, Human
ccagcugaaucucaaacagaaggcaguaaugagagccuacaaaugggagggaccuaagugccua

SEQ ID NO: 116089 - RNA, 64 nt, Human
gccuuccugguuuuguucacugcuguacccagaugccuacaaccaucccugccacauacaggug

SEQ ID NO: 116090 - RNA, 64 nt, Human
uaggggucaaggacccucuuuauagcuaccauuugccuacaauaaauuauugcagcaguuugca

SEQ ID NO: 116091 - RNA, 64 nt, Human
gugagcggagacugcaccacugcauuccagcccggccuacaagaacaaaacuccaucucaaaau

SEQ ID NO: 116092 - RNA, 64 nt, Human
gcgugggagccaggaucagcgcccccugccaugugccuacaaaugucaguugugauuuccacug

SEQ ID NO: 116093 - RNA, 64 nt, Human
uuguaauguucuuuacaggaguuuaaaacguauagccuacaaaguaccagcagcaaauuagcaa

SEQ ID NO: 116094 - RNA, 64 nt, Human
uauaauguucacuaaugugguuauuuuacauuaagccuacaacauuuuucaguuugcaaauaga

SEQ ID NO: 116095 - RNA, 64 nt, Human
gugcugggauuacaggcgugagccaccgugcccggccuacaaauguuaacaaagcaauuaccaa

SEQ ID NO: 116096 - RNA, 64 nt, Human
uuuacggauuuccuugaagccucucuccuucucugccuacaaagacccuauacucucagucucc

SEQ ID NO: 116097 - RNA, 64 nt, Human
ucaaacgcuguguuuaaacaacguuaaacucuuagccuacaagguggcucuuauguacauaguu

SEQ ID NO: 116098 - RNA, 64 nt, Human
agggguguuucuauugaaacuguacuaaauuuuugccuacaauuuaccuuguuaaauauuguag

SEQ ID NO: 116099 - RNA, 64 nt, Human
uaugcauaaagccaaauuuccaguuuaaguaauugccuacaauaaaaagaaauuuugccugcca

SEQ ID NO: 116100 - RNA, 64 nt, Human
acuuacuuuuauggcaauggcaucagagcccaaugccuacaaguugcaaaaacaggugaaaaau

SEQ ID NO: 116101 - RNA, 64 nt, Human
cgugucuuaaccuaagugcuuucuuguuugaaacgccuacaaaccuccaugugguagcuccuuu

SEQ ID NO: 116102 - RNA, 64 nt, Human
aaagaugaaaauaaaauaaaauauauauuuacaggccuacaacuuuugccucagacuguucccc

SEQ ID NO: 116103 - RNA, 64 nt, Human
auucccaguggauucuuuacccuuaaguuuuacagccuacaacaagauuuuuuguuuuguuuuu

SEQ ID NO: 116104 - RNA, 64 nt, Human
acuuccccucgaagacguugugccucacagcgaggccuacaagggaugggaacuuuuauuucaa

SEQ ID NO: 116105 - RNA, 64 nt, Human
acccccaggcuuguucuuguuuuacuguauugagcggcggcacccgccggacccgcauuauggc

SEQ ID NO: 116106 - RNA, 64 nt, Human
ugcaucauacauuuuuugaaagauuuuuaaaaaagccuacaacuuacauauguaguagaaucag

SEQ ID NO: 116107 - RNA, 64 nt, Human
cugcaauucugcauuucaacucuucacuuccucagccuacaaauagcucauuagaugacauuca

SEQ ID NO: 116108 - RNA, 64 nt, Human
gugaccuugauugaguugcuugggcuuuacuucugccuacaaaucagggguaaaaauaccuguu

SEQ ID NO: 116109 - RNA, 64 nt, Human
auccucuuuuaaaaccaaauuuuuuuuucuucuggccuacaaguauuuuuuuuuuaaaaaagaa

SEQ ID NO: 116110 - RNA, 64 nt, Human
aagguuagcugucuuaacccaagugacuuaccaggccuacaaaagaguccaguccagucacuug

SEQ ID NO: 116111 - RNA, 64 nt, Human
aggcauagaaggaaaaacgaagggccuuagaggggccuacaaaccagcaacaugaaauggacaa

SEQ ID NO: 116112 - RNA, 64 nt, Human
ugucuccuuucaccccagggccugagccuggccagccuacaauggggauguuguguuucuguuc

SEQ ID NO: 116113 - RNA, 64 nt, Human
ucaaauuaaacaauucaugccuuuauagggucaggccuacaaugaauagguauggugguuucac

SEQ ID NO: 116114 - RNA, 64 nt, Human
uggcuauucacagaugcuaucauagcacacuacagccuacaacucuugggcucaagcaucacgc

SEQ ID NO: 116115 - RNA, 64 nt, Human
uggacauaaucucccagggaaaucugggcucgaggccuacaacuuaggggcuggaaucacaggu

SEQ ID NO: 116116 - RNA, 64 nt, Human
uuuuauuggaaugacaguguucucggaaggagcagccuacaagauaacuugaauuugccaauuc

SEQ ID NO: 116117 - RNA, 64 nt, Human
auauguuucuagaaauuacaagcauauaacuuuagccuacaaucucuuauuaaaaauuuuuaac

SEQ ID NO: 116118 - RNA, 64 nt, Human
gcuaacugcagcuuuugccuugguucuuccuagugccuacaaugggaaaacuucacuccaaaga

SEQ ID NO: 116119 - RNA, 64 nt, Human
acgucuggguggcggcagcagcuuugcucugagugccuacaaagcuaaugcuuggugcuagaaa

SEQ ID NO: 116120 - RNA, 64 nt, Human
uuuuccaauaaagauuguuguaauauugaaaugagccuacaaaaaccuaggaagagauaacuag

SEQ ID NO: 116121 - RNA, 64 nt, Human
uggcaauagcuuuguaagugauguggacauaauugccuacaauaaugaaaaccuacaggaauuu

SEQ ID NO: 116122 - RNA, 64 nt, Human
ucugucacaaugccucaaaagacauggaacccaggccuacaaccgucccaacugcuaauucuuu

SEQ ID NO: 116123 - RNA, 64 nt, Human
guggccccaguuucuagcggcuuuugcagcauuagccuacaagcuuugucacucccugcccucu

SEQ ID NO: 116124 - RNA, 64 nt, Human
uucggagacagugacuggugccagugucauccgggccuacaaccgcagccgggauuuugagauc

SEQ ID NO: 116125 - RNA, 64 nt, Human
uaauucacauaacuucucugagucugaauuuccugccuacaaaauggagaaauaggaccuucca

SEQ ID NO: 116126 - RNA, 64 nt, Human
gagaggacaggcuaagugaaguguggucccuggagccuacaaguggucuggguuagaggcgagc

SEQ ID NO: 116127 - RNA, 64 nt, Human
uguccuuuauguaagaaugauauaaccaaaaggagccuacaagaaaguacgagauuuagucaac

SEQ ID NO: 116128 - RNA, 64 nt, Human
uucucuuucccaggagcccugccaggggcugugggccuacaaggcuuccaggggaugccaucca

SEQ ID NO: 116129 - RNA, 64 nt, Human
uggaagggcuggugaggacucugccuccuugccugccuacaaggugccugguuugcagcaggcu

SEQ ID NO: 116130 - RNA, 64 nt, Human
ucauacuuucucauuuuacagaugaggaaauaaagccuacaagugugaaauuaauuuccuuaca

SEQ ID NO: 116131 - RNA, 64 nt, Human
gccuuccaaacgcagguagccgaccugcaggagggccuacaaacgggcccagcaagagcugggc

SEQ ID NO: 116132 - RNA, 64 nt, Human
cuuacuaaacaugagaacacauguggaagauaaagccuacaaauaugaagaaugugacaaggcc

SEQ ID NO: 116133 - RNA, 64 nt, Human
cucauuuaugcauuguuuuguuuaaguaaauucugccuacaagugaaaaggucggugcgcucuu

SEQ ID NO: 116134 - RNA, 64 nt, Human
auacaaaaaugaacaggcugggagugguggcucagccuacaaucccaacacuuugggaggcuga

SEQ ID NO: 116135 - RNA, 64 nt, Human
gagauauugccccuugaugagagucaaacacccugccuacaaggagauguuuugaaauggagag

SEQ ID NO: 116136 - RNA, 64 nt, Human
aguuucccugccuuauuuuaccugcaauaggugugccuacaaaagucuuucugacauacacacu

SEQ ID NO: 116137 - RNA, 64 nt, Human
auggccucccuuaaggcauuuuacaaacccauaagccuacaauagaugaguauuuuuacuauuu

SEQ ID NO: 116138 - RNA, 64 nt, Human
aggccagagcuggguucuugcagaaagcaucagugccuacaaauggagcuccacccuucagucu

SEQ ID NO: 116139 - RNA, 64 nt, Human
cccaucaugccccucaaccuaucccguuccuucugccuacaaauaaaaagugcaggcuggaaug

SEQ ID NO: 116140 - RNA, 64 nt, Human
uuucuaucuuccuuucucaaacugucuuaggaaggaccuucagugcagaucaggugcaguaaug

SEQ ID NO: 116141 - RNA, 64 nt, Human
ucucaaaucaugaagugauauaaaagcugcauaugccuacaaagcucugaauucaggucccagu

SEQ ID NO: 116142 - RNA, 64 nt, Human
cccccaagacaacacucggaagccagggcccgcggccuacaacguggaucagguggccuggagc

SEQ ID NO: 116143 - RNA, 64 nt, Human
cccauaaggcacacucucuaaggccuuuuaaggggccuacaaaaauguuuuauuuuauaaucag

SEQ ID NO: 116144 - RNA, 64 nt, Human
cucacccugguuccacuggucucaaaagucaccugccuacaaauguacaaaaggcgaagguucu

SEQ ID NO: 116145 - RNA, 64 nt, Human
ccccuuucucuaauagcgaggcucuaaccacacagccuacaaugcugcgucucccaucuuaacu

SEQ ID NO: 116146 - RNA, 64 nt, Human
uguacuucaagacugcuaauuguuucaucugaaagccuacaaugaaucauuguucaaccuugaa

SEQ ID NO: 116147 - RNA, 64 nt, Human
ccuaggccuagauucugagaucuucccauucuaggccuacaagcacuacuugcuguagcugaga

SEQ ID NO: 116148 - RNA, 64 nt, Human
uuaauuccuauucucugacgaauaaagacuuacugccuacaagaggagaggaggaggucauggc

SEQ ID NO: 116149 - RNA, 64 nt, Human
gugcccaagccagaggcuggguucauuuguguaacgacaauaaacgguacuugucauuucgggc

SEQ ID NO: 116150 - RNA, 64 nt, Human
gaucacuggcauucacccccugcaaaaaucggggcgacaauagcucacugccuacuugcugcag

SEQ ID NO: 116151 - RNA, 64 nt, Human
augaaacucacaaaugaugguaggaagaagcucucgacaauacccguuggcaaggagucugccu

SEQ ID NO: 116152 - RNA, 64 nt, Human
ucucccuggugccaccugcagcauuucuagauaccgacaauaagggucucccuauccccaacuu

SEQ ID NO: 116153 - RNA, 64 nt, Human
aauuagucagcugauuugauuacaauggaguaaccgacaauauauuuauuuauaaagcacauau

SEQ ID NO: 116154 - RNA, 64 nt, Human
ccguuguauuuaaguaucuuuuauuuuuuaauuucgacaauaaaaaggucaggauggcguuuuc

SEQ ID NO: 116155 - RNA, 64 nt, Human
cagcagugcucagaaacaauuuaacauguugaaacgacaauauucuaaaauacugaugaaucuu

SEQ ID NO: 116156 - RNA, 64 nt, Human
gagcaccuccuuuugugcaaaguuaauuuuuucucgacaauaaagauauuccgugucuuuaccc

SEQ ID NO: 116157 - RNA, 64 nt, Human
uccuuaugcccaacacugggucaggcagagugggcgacaauaaacgcugcuaggagaaucgagc

SEQ ID NO: 116158 - RNA, 64 nt, Human
agauggauuugccugugccacccaccagggcgaacgacaauagcuuuacccucaggcauaggcc

SEQ ID NO: 116159 - RNA, 63 nt, Human
caacuaaaaaauauaucuaagcauuugcaaaggcgacaauaaauuauugacgcuuaaccuuuc

SEQ ID NO: 116160 - RNA, 64 nt, Human
cauccaaagcccccauggacgcauggacgcagggcgacaauaaacuguauuuucguuucuaacu

SEQ ID NO: 116161 - RNA, 64 nt, Human
gagcauuuagagggaagcagggcagaacucugaacgacaauacgucucucugagcagagacccc

SEQ ID NO: 116162 - RNA, 59 nt, Human
uuuagcagcaugcuuuuugaagauuaacucgacaauauggccagcuaaugaaauuaaaa

SEQ ID NO: 116163 - RNA, 64 nt, Human
ccuccccuccacugccugcauggggggcgcggggagugaccaggcgggggccucaccgccccag

SEQ ID NO: 116164 - RNA, 64 nt, Human
ugugggaaaaugacagcuucacagccccuugaggagugaccaagccacaaaguaaauccuaaag

SEQ ID NO: 116165 - RNA, 64 nt, Human
uuuuuccaaaguagaaaggaagcacuucugagccagugaccacugaaagguaugugcuaugaua

SEQ ID NO: 116166 - RNA, 64 nt, Human
guugugaaaaacgauuugcauuuggguaaaauaaagugaccaugcuuuuguucuguaauacugu

SEQ ID NO: 116167 - RNA, 64 nt, Human
ggagaaucgcuugaacccaggaggugaagguugcagugaccagagaugacgccauugcacucca

SEQ ID NO: 116168 - RNA, 64 nt, Human
ucuucaaggauuuuccuuuuucuuuuuaccccccagugaccacucugcucuuuaggauucuagu

SEQ ID NO: 116169 - RNA, 64 nt, Human
gucuuuuuuugugcguaauaaagucaacugaccaagugaccaugaaaaggggcugucuggggcu

SEQ ID NO: 116170 - RNA, 64 nt, Human
ucuucuagaacaucccuacccuuggcaguguggcagugaccauggcacuacacggcugugacga

SEQ ID NO: 116171 - RNA, 64 nt, Human
ccuccuuuuauauccuccucuccuugaguaaugaagugaccagccuguguagugugacaaacgu

SEQ ID NO: 116172 - RNA, 64 nt, Human
aagggcugaaggccgaggauggaugcccugugccagugaccagagcacccagggcuggccaguc

SEQ ID NO: 116173 - RNA, 64 nt, Human
gugguuugggaggauccaugucggcucugccugcagugaccagugcucuguggggcagaggagc

SEQ ID NO: 116174 - RNA, 64 nt, Human
caccaccaucaccagacaggugcgaaaggaugaaagugaccauguuuuguuuacgguuuuccag

SEQ ID NO: 116175 - RNA, 64 nt, Human
acuucagacaaaauguugcauccaagguacaucaagugaccauuugccuugaaccuugauuuca

SEQ ID NO: 116176 - RNA, 64 nt, Human
cuaaguauaacaagggauguauuuuuuguugggaagugaccauuucuaggcuuauacauaauag

SEQ ID NO: 116177 - RNA, 64 nt, Human
gugcaggaauccagguaguggaggaugaucucagagugaccaacccaaagaggacagccucggc

SEQ ID NO: 116178 - RNA, 64 nt, Human
ccccuggcagcagaagugggugcaggaagguggcagugaccagcgcccuggaccaugcaguucg

SEQ ID NO: 116179 - RNA, 64 nt, Human
ggucccagaacccuauucucccacgaggauccucagugaccaugguggccacacgccuggccag

SEQ ID NO: 116180 - RNA, 64 nt, Human
gagaaugcaaguaaggaauuaauaggagguucuuagugaccagauguuguaaugggcuauacag

SEQ ID NO: 116181 - RNA, 64 nt, Human
gaaggacaaaacucucaaaaauguauuucaagucagugaccagaaaaaucccaccccuugcccu

SEQ ID NO: 116182 - RNA, 64 nt, Human
aagaaguuacccuuaagcuaggauguugcucagaagugaccaucccaacuuuggugcgggcaca

SEQ ID NO: 116183 - RNA, 63 nt, Human
ugagggaagacuggcuggcaauaaagucaaauuaagugaccacaacucugcaggagcuguguu

SEQ ID NO: 116184 - RNA, 64 nt, Human
ugaacccuccaggaggcugcuuccccaugacacuagugaccaguaaaaugaaaaggaggagcaa

SEQ ID NO: 116185 - RNA, 64 nt, Human
accuacacaguguuaaaaaucagauaccuccuuuagugaccaguucaaauuuuaauagcgauag

SEQ ID NO: 116186 - RNA, 64 nt, Human
aaugggauucagauugggaacuuguggggaugagagugaccagguugaacugggaaguggaaaa

SEQ ID NO: 116187 - RNA, 64 nt, Human
agaagugaccauuguuggagcaccauccagagcuagugaccaguccaguggacaguuaguggga

SEQ ID NO: 116188 - RNA, 64 nt, Human
cuaucaccaaggagccaaacauccuacaagacacagugaccauacuaauuauacccccugcaaa

SEQ ID NO: 116189 - RNA, 64 nt, Human
gugaagccucaagcgucagccuuggagaugccaaagugaccagccaccccaucccuccccuacc

SEQ ID NO: 116190 - RNA, 64 nt, Human
agaacagcucuuguuggucugagaaggcaggauaagugaccacauauuuaugccacuaccucca

SEQ ID NO: 116191 - RNA, 64 nt, Human
gugcuuggccacaggcagguccagucacugcaaaagugaccaagccagcaggucacccuuaacu

SEQ ID NO: 116192 - RNA, 64 nt, Human
cuuuuccucauugcuacagcaagccacaggguagagugaccaguucuccuauccaaaaauaaau

SEQ ID NO: 116193 - RNA, 64 nt, Human
aguggcuauugaagugucuuuggauagcugucugagugaccacggacaaagucuuaacaaaacu

SEQ ID NO: 116194 - RNA, 64 nt, Human
uuacagaugagaauacugaggccuggacaggugaagugaccagagagcaaaaggcaaaggggug

SEQ ID NO: 116195 - RNA, 64 nt, Human
ucaggcauaugucaggcuccacucuuaaggagucagugaccaugaccucuuugcauauccugga

SEQ ID NO: 116196 - RNA, 64 nt, Human
augaccacuaguguauaagugaucacuggaacggagugaccacugagaugcugggggucacugg

SEQ ID NO: 116197 - RNA, 64 nt, Human
agggaagcauagaccuauaguacaacagggguguagugaccacuggaccugaugaagcgaaucu

SEQ ID NO: 116198 - RNA, 64 nt, Human
uucauuuggaagaauucaaugaaccauuuuuccaagugaccaguacgugauguuacaaaaucau

SEQ ID NO: 116199 - RNA, 64 nt, Human
ccugaguauuuucaaauauaugauugcugauaguagugaccaaaacuacuuuguuccuuucuua

SEQ ID NO: 116200 - RNA, 64 nt, Human
acagugcccauuuugaaauugccuauacagucuuagugaccauuuaaaccggacgaacuaggug

SEQ ID NO: 116201 - RNA, 64 nt, Human
acauuuccgaagaccuucugaagaucucagauaaagugaccaggcucacaacuguuuuugaaga

SEQ ID NO: 116202 - RNA, 64 nt, Human
cuuacccccucguauuuauaaucuuaauuuauauagugaccaccguggaaacaaacgccucuug

SEQ ID NO: 116203 - RNA, 64 nt, Human
ccaccuaccugccggacacagagggggccuucacagugaccaucgcaaccaggauugacaggug

SEQ ID NO: 116204 - RNA, 64 nt, Human
uuccacuacagugauauugacugcaucuuuaagaagugaccauuauacuguguauauauauaua

SEQ ID NO: 116205 - RNA, 64 nt, Human
gauugcuuggauuuaggaauucaauuuuuguuucagugaccaaugucaaguugcaggcuuugug

SEQ ID NO: 116206 - RNA, 64 nt, Human
ucuuuguuuuugauguuaaacaguaaaugccaguagugaccaagaacacagugauuauauacac

SEQ ID NO: 116207 - RNA, 64 nt, Human
uccugugugucacugcugcauugguguggcagcaagugaccaaaugcuacaggucuuacuaugg

SEQ ID NO: 116208 - RNA, 64 nt, Human
cugguucgggucagugucuacgggugguggauuuagugaccacccuccucccacuucuuucucu

SEQ ID NO: 116209 - RNA, 64 nt, Human
agcgucaaugaagggguggaaguggauguggaggagugaccagaccagaccagaccagaccaga

SEQ ID NO: 116210 - RNA, 64 nt, Human
acccggggccaaccucuccacgcgcacucaggaaagugaccagugaccacuggcguuaggaagg

SEQ ID NO: 116211 - RNA, 64 nt, Human
gccaaccucuccacgcgcacucaggaaagugaccagugaccacuggcguuaggaagguggcucc

SEQ ID NO: 116212 - RNA, 64 nt, Human
ugggguuuuuaaucucuugucauucucauccaaaagugaccagcauaccaguucuugcaauaag

SEQ ID NO: 116213 - RNA, 64 nt, Human
cacuccuuuccuuaccacaucaacugauuaaagcagugaccagcaggaacugcccagagaacug

SEQ ID NO: 116214 - RNA, 64 nt, Human
aagagaagguauguacugccugaggucacaugacagugaccaaguggagacaguaaguuagauc

SEQ ID NO: 116215 - RNA, 64 nt, Human
cgugauucccuugcacagucagggccaagagagcagugaccacugaggauucagacacuguauc

SEQ ID NO: 116216 - RNA, 64 nt, Human
aaugugauugaaaauaagucuaaacagcuguaaaagugaccacaaugacaugaaauaaauuuaa

SEQ ID NO: 116217 - RNA, 64 nt, Human
cagaauuguaacucgggguugggccucuauauggagugaccaaaaugccaaaauuguccaucug

SEQ ID NO: 116218 - RNA, 64 nt, Human
acucucaccauugguauagccaaaaaagcuuggaagugaccaaggcuaggucacaaaauacacu

SEQ ID NO: 116219 - RNA, 64 nt, Human
cuugggcucccaaaguguugggauuacaggcgugagugaccaugccuagcucacuuccagguuu

SEQ ID NO: 116220 - RNA, 64 nt, Human
uggccuggaucuaucugggccaugagugacgggcagugaccagagggacuggaggccagcggug

SEQ ID NO: 116221 - RNA, 64 nt, Human
ggagaccuugcuggcagugcuagccaggaaacagagugaccaagggacaagaagggacuugccu

SEQ ID NO: 116222 - RNA, 64 nt, Human
uccccaccuccggcccuuugguuuugauauggcuagugaccagcacugaccaccaucccaagcu

SEQ ID NO: 116223 - RNA, 64 nt, Human
cugggacaagugaggaacuagcugcagagggaugagugaccaccauccaggcugagacugaaag

SEQ ID NO: 116224 - RNA, 64 nt, Human
agccgaaggcucuuagggagcagccagagggccaagugaccaagaggauggggccugagcuggg

SEQ ID NO: 116225 - RNA, 64 nt, Human
auuuaauuugcaaccaucagaauucagaaucuauagugaccagugaucaaggcuaauuggaaaa

SEQ ID NO: 116226 - RNA, 64 nt, Human
acaguuuggcaguaccucaaaaaguuaaacguagagugaccauaugacccaggaaugccacucc

SEQ ID NO: 116227 - RNA, 58 nt, Human
uugacaucguucagcccuaguagggaccagugaccaucacaucccuucaagaguccug

SEQ ID NO: 116228 - RNA, 64 nt, Human
acuugcacaagcaguguucacagccuuauucugaagugaccacuuuucuucucuuugaggcacu

SEQ ID NO: 116229 - RNA, 64 nt, Human
uucucacguaauaaacaaauuaucgagacaugggagugaccagcaccuuuucuuuaaauggugg

SEQ ID NO: 116230 - RNA, 64 nt, Human
guggacccugucuucugggcacaguggacucagcagugaccacaccaacacugacccuugaacc

SEQ ID NO: 116231 - RNA, 64 nt, Human
uaaaggcuuauuguuguauuuuguagcagcuucaagugaccaaaagacuaaaaucuuucaacgu

SEQ ID NO: 116232 - RNA, 64 nt, Human
gauaauccagguaacuuugaagagaugagcagugagugaccaggcaguuuuucugccuuuagcu

SEQ ID NO: 116233 - RNA, 64 nt, Human
uuucuuuuuucaggaugcuauagucaauuuaguaagugaccaccaaauuguuauuugcacuaac

SEQ ID NO: 116234 - RNA, 64 nt, Human
ucuugcucucacuaguugucagcuucucuggauaagugaccacagaagcaggaguccuccugcu

SEQ ID NO: 116235 - RNA, 64 nt, Human
ggccccuggcccaggaggaggauugugcugauguagugaccaagugcaauaugggcgggcaguc

SEQ ID NO: 116236 - RNA, 64 nt, Human
uggguagaucacgagaucaagagaucaagaccauagugaccaacauagugaaaccccaucucua

SEQ ID NO: 116237 - RNA, 64 nt, Human
uugccgccugagagccccaggagacaucggcuagagugaccauggcuaugcucccgucuggaag

SEQ ID NO: 116238 - RNA, 64 nt, Human
gcugcuauuuuagaauuugaauaaguacuccuaaagugaccauuauuagggaccagaaaauuau

SEQ ID NO: 116239 - RNA, 64 nt, Human
uccacaagcaauauuagcagggcuucuguuucuaagugaccacagacuaacccuuucuaggcuu

SEQ ID NO: 116240 - RNA, 64 nt, Human
accagccaacucagcuuugggacaaacccagccaagugaccaggacacuuuagugcaaagagcu

SEQ ID NO: 116241 - RNA, 64 nt, Human
aaaauagcuccauuuuuuggugcuugggaagcacagugaccaaaaaaguuguauggcugcuuau

SEQ ID NO: 116242 - RNA, 64 nt, Human
acagaauaaaaauuaaaaauaaugccagggugcaagugaccaaggccuuaucuugaaaguuaaa

SEQ ID NO: 116243 - RNA, 64 nt, Human
gauauacaagaaaauaaccaccguguugugaaaaagugaccaaaaucauguacuaaaugcacag

SEQ ID NO: 116244 - RNA, 64 nt, Human
uuuucucuuugcccuuaccacucccagaaacauaagugaccaauuuaaaaugcuagggaacagg

SEQ ID NO: 116245 - RNA, 64 nt, Human
aaucuuacaaugaaaaggacuuuauagaucagccagugaccaaccuuuucccaaccauacaaaa

SEQ ID NO: 116246 - RNA, 64 nt, Human
uuguucuguuuugaggguuauuggaaaacagagcagugaccacuuccuguaaguaaagaaaaua

SEQ ID NO: 116247 - RNA, 64 nt, Human
ccugaacaaauggugcuuacccuuugaacagcagagugaccacguagaaggaaggaaaagggca

SEQ ID NO: 116248 - RNA, 53 nt, Human
ggugcacauuccugccauagcgcagugaccaccauccaagcucagaucugugu

SEQ ID NO: 116249 - RNA, 64 nt, Human
ucaucugcugucuugugauuaaaaucaucucuguagugaccacguauauuuucaaggacucacu

SEQ ID NO: 116250 - RNA, 64 nt, Human
uguagaguuuagucugccugcccgccuugguaguagugaccagucagugucagcaucagugucc

SEQ ID NO: 116251 - RNA, 64 nt, Human
aacagacauaacauucaauuuuucauuuaugcuaagugaccacaguauacaaaguaauaagcag

SEQ ID NO: 116252 - RNA, 64 nt, Human
cugaaguuguagauugagcugaauaaccaugggaagugaccaagcaaagacacucgauuggagu

SEQ ID NO: 116253 - RNA, 64 nt, Human
ccugagaaggacccugggagcucugggaauuuggagugaccaaaggugugcccuguacacaggc

SEQ ID NO: 116254 - RNA, 64 nt, Human
aauugauuuuuauauuuggggcaucucuauagaaagugaccaccaaggccaguaaguacgggaa

SEQ ID NO: 116255 - RNA, 64 nt, Human
ggagucaccuccugagccacuucagaguucuggaagugaccacggaccaggguggaggaauaga

SEQ ID NO: 116256 - RNA, 64 nt, Human
auucuucucaacccaagaaccuguuuccuggaccagugaccaaaccucauaugugaaauggcca

SEQ ID NO: 116257 - RNA, 64 nt, Human
uccacuuguaccagugacaagaagucacuuguauagugaccaaguacacauaaaauacugauua

SEQ ID NO: 116258 - RNA, 64 nt, Human
ugaucauuauaaagauuuaacuauuuuaugcugaagugaccauauuuucaaggggugaaaccau

SEQ ID NO: 116259 - RNA, 64 nt, Human
uauucuauauauaauuuccuuaauuuguaaauuuagugaccauuagcuagugaucauuuaaugg

SEQ ID NO: 116260 - RNA, 64 nt, Human
cucagcaugagguggagcagugaccagguggagcagugaccaggacgccucuggcccagugcug

SEQ ID NO: 116261 - RNA, 64 nt, Human
ugacacacaggcuccucucagcaugagguggagcagugaccagguggagcagugaccaggacgc

SEQ ID NO: 116262 - RNA, 64 nt, Human
agagaugacuuuggagaaagcaaagcagugacccagugaccaggcacauuacucgugagcgagg

SEQ ID NO: 116263 - RNA, 64 nt, Human
aggcauagaagccaguucaggguccauaauauuuagugaccaacauuuuaaaguauagcagcaa

SEQ ID NO: 116264 - RNA, 64 nt, Human
gacgagccccaucaaacuaguugggaagggccccagugaccaaguguauaagcaucccuugaag

SEQ ID NO: 116265 - RNA, 64 nt, Human
cuccaguucucucacuacuuuuuccuccucugugagugaccauccaggcagucaccauaacugc

SEQ ID NO: 116266 - RNA, 64 nt, Human
caaacaaaaacgaggucaaucaugccauugaccgagugaccacuucuguguagaguuucaccuc

SEQ ID NO: 116267 - RNA, 64 nt, Human
cuuguauucuauuaugaguuuagcagucuuuuggagugaccagcaacuuugauguuugcacuaa

SEQ ID NO: 116268 - RNA, 64 nt, Human
ccuguugguuggaugacagaccacacagagggagagugaccaggcuuugcuuguggagcgggca

SEQ ID NO: 116269 - RNA, 64 nt, Human
cuggcagagaaggauaggaguggaaugcccacacagugaccaacagaacuggucugcgugcaua

SEQ ID NO: 116270 - RNA, 64 nt, Human
gcagcgagacgcaguugcucugggaagaugccacagugaccagggccauggccggucccucugg

SEQ ID NO: 116271 - RNA, 64 nt, Human
auaagcccaacaaguugaagaagcuggcggaucuagugaccagauauauagaaggacugcagcc

SEQ ID NO: 116272 - RNA, 64 nt, Human
auggggaacaggcccuccccaucaguauugguaaagugaccaugauuccuacauagaggcucug

SEQ ID NO: 116273 - RNA, 64 nt, Human
cuacuguagugacaucugagaaaugggauggaagagugaccauguuuuauuuucuuguucuugu

SEQ ID NO: 116274 - RNA, 64 nt, Human
aggaggcccaucaucuuccuggaguaacaucaccagugaccagcagacagugagcuucuauccc

SEQ ID NO: 116275 - RNA, 64 nt, Human
cuaguguauuuuuuuaugagcaauaucaauuuggagugaccaaaagauacuuaaaaauggguuu

SEQ ID NO: 116276 - RNA, 64 nt, Human
auaccaaccagggaggauugucuaaucaaaaacuagugaccaauuugucauaauggagaguagu

SEQ ID NO: 116277 - RNA, 64 nt, Human
augagacaaucauuuuaaguuuuaagauaacagaagugaccaauguaauuucacaacaccuaag

SEQ ID NO: 116278 - RNA, 64 nt, Human
uuuuuaucucacauacuuacaacucaacacacagagugaccaugugcagcuuucuuuuuuguua

SEQ ID NO: 116279 - RNA, 64 nt, Human
cagaccccggccucggagcccgucuggcacccagagugaccacaaguccagcagggaggcggcg

SEQ ID NO: 116280 - RNA, 64 nt, Human
uuuaucuaauucuuaucuacagacacuuacuuccagugaccauauuuuacuaaaucagcuuauu

SEQ ID NO: 116281 - RNA, 64 nt, Human
uacugggguaaaaaaacccugcugaagagaggacagugaccacagaacucaguguaccaaacau

SEQ ID NO: 116282 - RNA, 64 nt, Human
aggauugaacaguucaguuguaucuaugccccacagugaccaguaaaguccaauuaaaauaugg

SEQ ID NO: 116283 - RNA, 64 nt, Human
cuacagacaauagugcaugagagucuagagaaguagugaccagaacagggcagaguaggucccc

SEQ ID NO: 116284 - RNA, 64 nt, Human
guaggggaaagaugaggcacaguguugauggggcagugaccagacaguccugagacccagaagg

SEQ ID NO: 116285 - RNA, 64 nt, Human
uguuguauuacacauauuagccacgaguuuuugcagugaccagauaaacuugaauugacacgug

SEQ ID NO: 116286 - RNA, 64 nt, Human
cacuguagguacugugcccaggaaggcugggugaagugaccaucuaaauugcaggauggugaaa

SEQ ID NO: 116287 - RNA, 64 nt, Human
aauaguucagaaccuuuuuaagagccauucuaaaagugaccagcaggagggaucuaguagugaa

SEQ ID NO: 116288 - RNA, 64 nt, Human
ggguggauuucagagccucucauggcagcaucuaagugaccagagcugggaugagagaggggaa

SEQ ID NO: 116289 - RNA, 64 nt, Human
guaacucacuccaggccaagugugccuuagcacgagugaccacaguuuaauagaccacacacau

SEQ ID NO: 116290 - RNA, 64 nt, Human
aggagggccugaucccaggagacaccagggccagagugaccacagcagggcaggcaucaugugu

SEQ ID NO: 116291 - RNA, 64 nt, Human
acauauacacauauuuuuuugauaauguaaauacagugaccauguuaaccuacccugcacugcu

SEQ ID NO: 116292 - RNA, 64 nt, Human
aaggucgacccagggcuguaggaagccauaggagagugaccacgggauucccugagaaacaggg

SEQ ID NO: 116293 - RNA, 64 nt, Human
uuaagaccauuagaaagcaccaggccgugggagcagugaccaucugcugacuguucuuguggau

SEQ ID NO: 116294 - RNA, 56 nt, Human
aggccaagugcugcaagugagcugggagugaccagaagaaaugacgcagaagugaa

SEQ ID NO: 116295 - RNA, 64 nt, Human
cgaggcuuucugcacuuucugcacccccuuccaaagugaccacaaaauuucaaagggacucaua

SEQ ID NO: 116296 - RNA, 64 nt, Human
cagcagaaggugcuccuugaauucaugaugccucagugaccaccucuuucccugggaccagauc

SEQ ID NO: 116297 - RNA, 64 nt, Human
gccaaaacugaccaaggcuauucagcagugaaccagugaccaaagaauuaauuacccuccguuu

SEQ ID NO: 116298 - RNA, 64 nt, Human
cugacaugacauauuuucauuaauaguuuaaaucagugaccaucauaauaaagauaaaauuuag

SEQ ID NO: 116299 - RNA, 64 nt, Human
ggauauaaugugugcuuuauugaauuagaaaauuagugaccauuauucacagguggacaaaugu

SEQ ID NO: 116300 - RNA, 64 nt, Human
aaaguuugggaauaggcugaccacauauuaugccagugaccaguaugacaggagauggggcccu

SEQ ID NO: 116301 - RNA, 64 nt, Human
auauugugcuaugauaaccaaccuucuuccaaggagugaccauuacugccuacauuugcguugc

SEQ ID NO: 116302 - RNA, 64 nt, Human
uuguucauaaccaugacuaaucugugugugcuguagugaccagcggcuccuaacgugucugugu

SEQ ID NO: 116303 - RNA, 64 nt, Human
cagagcauaaggcuucagggcccaaguugggagaagugaccaaaguguagccaguuuucugagu

SEQ ID NO: 116304 - RNA, 64 nt, Human
ggcuuugccccagacccuuauuccagaugcugagagugaccaggacagcagcuccugaggccca

SEQ ID NO: 116305 - RNA, 64 nt, Human
aggacacacagcagguccguggaugggcuggaugagugaccagggccagccucugucucaggac

SEQ ID NO: 116306 - RNA, 64 nt, Human
gguuaugucaaguuaauucagaaagagaagagacagugaccaacccugagaggccuaauagggc

SEQ ID NO: 116307 - RNA, 64 nt, Human
uguucaucuccuaugugaugcugaagaccaagagagugaccaagaaggcucagugaaggucccg

SEQ ID NO: 116308 - RNA, 64 nt, Human
gggccgggcuuggaacgauguacgauacccucauagugaccauuaaaccugauccuccaccgcg

SEQ ID NO: 116309 - RNA, 64 nt, Human
cuguauacaauugcaaaugauaagcauuuuugugagugaccaccuuugcaauauguuuguuaau

SEQ ID NO: 116310 - RNA, 64 nt, Human
gcccagcagcacccaguguuggucuguguccaucagugaccaccaacauucuguguucacaugu

SEQ ID NO: 116311 - RNA, 64 nt, Human
guguaggcugcccuuggugaagcugugacaagggagugaccauccauccccuccacaggagggu

SEQ ID NO: 116312 - RNA, 64 nt, Human
cuuuuaaaaaugguagcuuuugugaaauagaaucagugaccaguauagcacuuagaucccuucu

SEQ ID NO: 116313 - RNA, 64 nt, Human
uccaggaaaggggaaaaggaacuuugccaaugauagugaccacagcaaaagcaaauaauaauaa

SEQ ID NO: 116314 - RNA, 64 nt, Human
ggcaccuggcaccuggccugcagaugcugcuacgagugaccagugcuguguggaggaggccaag

SEQ ID NO: 116315 - RNA, 64 nt, Human
gacuggcgagucaaaaacucagaucuaucuuaagagugaccaggaagagguucauugaaauaau

SEQ ID NO: 116316 - RNA, 64 nt, Human
auuuuaauguucagugagaaguaaacagagcagaagugaccacugggacuucaggcaagaagcu

SEQ ID NO: 116317 - RNA, 64 nt, Human
acucuaaaagcaaucaaacauguuucugcuggacagugaccaagaauuauaguaccuucuuaua

SEQ ID NO: 116318 - RNA, 64 nt, Human
uagaggucgacaugagauaccuggcauuuugggaagugaccaaagauggccagcuagagauuca

SEQ ID NO: 116319 - RNA, 64 nt, Human
gagggccgacugcauuuccugguuacucuaucccagugaccagccacaggagauguccaauaaa

SEQ ID NO: 116320 - RNA, 64 nt, Human
ucaggugaguccagcauauccacaccacccaagaagugaccagugcugcauuucaguucuggcu

SEQ ID NO: 116321 - RNA, 64 nt, Human
aacuuuuuccauccagcaacauccagacgauuucagugaccaaaugcucagcuguaaccacagc

SEQ ID NO: 116322 - RNA, 64 nt, Human
uuggaccaaauaaucucaaaggcccagagaggacagugaccauccacagacacacagcacaggc

SEQ ID NO: 116323 - RNA, 64 nt, Human
gcuaucauaaggggucagggacauuccggggagaagugaccacuaaggugaggauuagagagug

SEQ ID NO: 116324 - RNA, 64 nt, Human
auacgcaccacaucucuaucuggccuuugcauggagugaccauagcuccuucucucuuacauug

SEQ ID NO: 116325 - RNA, 64 nt, Human
aggagagaggagccagccagggaggggcagcugcagugaccaggcccagcagggaggacuugug

SEQ ID NO: 116326 - RNA, 64 nt, Human
uaccugaacugucaucauuccuacuguguuugauagugaccaguaggacaaagccacgugccga

SEQ ID NO: 116327 - RNA, 63 nt, Human
uucgaguaggugaaucuuaaagaaauaaaauucaagugaccacaaagucuggagacaauauau

SEQ ID NO: 116328 - RNA, 64 nt, Human
agcuaucuccaaacacaucugaguucauuucaaaagugaccaagggaaucuccgcacaaaagug

SEQ ID NO: 116329 - RNA, 64 nt, Human
aaauuucaaguuuaauaaaauagcaauuagcagaagugaccaaauugggagauaauuaucaguc

SEQ ID NO: 116330 - RNA, 64 nt, Human
aaaaauuucaacaaauccugaagucuuucugugaagugaccaguucugaacuuugaagauaaau

SEQ ID NO: 116331 - RNA, 64 nt, Human
gaauugcacuaauucauagaacucuuuacauuguagugaccaaugcacauauaauuuaaaucuu

SEQ ID NO: 116332 - RNA, 64 nt, Human
ccuaaaaugagaaguccaaggucaucucuggcccagugaccacagagagaucugcaccucccgg

SEQ ID NO: 116333 - RNA, 64 nt, Human
gcugggagcacaggcacugcaggagagaaugcccagugaccagucacugacccugugcagaacc

SEQ ID NO: 116334 - RNA, 64 nt, Human
uuggggcucagaaggcccugcucucucccauccaagugaccagaugcccuacucagcuuccauc

SEQ ID NO: 116335 - RNA, 50 nt, Human
agaagaaagagaagaaaugaagugaccauccagccuuucccaauuagacu

SEQ ID NO: 116336 - RNA, 64 nt, Human
agcaguuggaucuuuugaagggagaagacacugcagugaccacuuauucuguauugccaugguc

SEQ ID NO: 116337 - RNA, 64 nt, Human
ccauuuuaugcaauuaaccaaaucaaccaaaaaaagugaccaugaaguccuguauuugucuuuu

SEQ ID NO: 116338 - RNA, 64 nt, Human
augaagguauuuuuauauuuugacaauaggaaacagugaccauuuucagaguaaucaaaucugg

SEQ ID NO: 116339 - RNA, 64 nt, Human
uaccaaauaauuucauauucaagcuucagaagcuagugaccaucuucauaauuugcuggagaag

SEQ ID NO: 116340 - RNA, 64 nt, Human
ccugcuuuguucuuucccugagaaacaguucagcagugaccaccacccacaugacauuucaaag

SEQ ID NO: 116341 - RNA, 64 nt, Human
cuggacaugcuuuggcaauuuuuuuauacuaccaagugaccauaaaggcauggcauuuguugug

SEQ ID NO: 116342 - RNA, 64 nt, Human
accuuguauuguguuuuuggccuugaaaguagcaagugaccagaaucugccauggcaacaggcu

SEQ ID NO: 116343 - RNA, 64 nt, Human
ugaagcagcagcacugccacuacauguggacaaaagugaccauauaaaagaaguugugcuauuu

SEQ ID NO: 116344 - RNA, 64 nt, Human
ccaaaggauuuuuggaagguaaagaaggcugaauagugaccacaugggccuguuuucagggucc

SEQ ID NO: 116345 - RNA, 64 nt, Human
cagugcucccucauauugagggcaguggcagaaaagugaccacucugcaggcugggcccaggau

SEQ ID NO: 116346 - RNA, 64 nt, Human
guguggcucugugccuaugcucuccccagcggaaagugaccagaagaggugugcaguuuccagg

SEQ ID NO: 116347 - RNA, 64 nt, Human
cccgauuccuggaaguaugauggaucacguggaaagugaccagauggccgucauaguccuuuuc

SEQ ID NO: 116348 - RNA, 64 nt, Human
ggacagcagaggcugaggggccgggguguggcugagugaccagggugucacccacugcaucugg

SEQ ID NO: 116349 - RNA, 64 nt, Human
ccuccugaugccaaggccacauccccgugcuuccagugaccagaccacugaccacccugacugu

SEQ ID NO: 116350 - RNA, 64 nt, Human
acgcaggucccaggacgugcugcucccuugugugagugaccacggccccaagcccagggcugga

SEQ ID NO: 116351 - RNA, 64 nt, Human
gguauuacauuuaaaauuuagaaaucaucaguccagugaccauauuuaugaaaagcuguagccc

SEQ ID NO: 116352 - RNA, 64 nt, Human
agacagugggcacggggacagugaucaggcugacagugaccaagacacuaacaaaggcuccugc

SEQ ID NO: 116353 - RNA, 64 nt, Human
ccugaugaguguuuccacgcagcccugcauauuuagugaccaaggcaucaaggacaucccgaaa

SEQ ID NO: 116354 - RNA, 64 nt, Human
aaguuauccuaccucgccaagugguaugaaauuaagugaccaaaugaagugcacucuuuucuuu

SEQ ID NO: 116355 - RNA, 64 nt, Human
ccucccaggugccuguccugacccucgugacuccagugaccaaugccuccaccucuuggaccag

SEQ ID NO: 116356 - RNA, 64 nt, Human
gcucaucacugaagaauugcaggccacucaugucagugaccagauuuguggcuuauaaacauua

SEQ ID NO: 116357 - RNA, 64 nt, Human
cacgccuuaaaaauugacaguugaaaaaaaaaagagugaccagagggcaaaggacccauucuca

SEQ ID NO: 116358 - RNA, 64 nt, Human
guggauuucaccucacccuuuguaccagauguugagugaccagcucuguggcccugugucguca

SEQ ID NO: 116359 - RNA, 64 nt, Human
uacacacuugaccuucugucguccccagaccaguagugaccaaucgggaguagcaaggaaggac

SEQ ID NO: 116360 - RNA, 64 nt, Human
aucuaaaauccuuaaaaauacucuaauagccuugagugaccaacuuuuuuuuuaaagcacagau

SEQ ID NO: 116361 - RNA, 64 nt, Human
ugguggguaggcaaguagcucuggggccaccucaagugaccaaaugcuauuaauuuccauccuu

SEQ ID NO: 116362 - RNA, 64 nt, Human
aauaauguuuagcucaguaaguacugaaauaaugagugaccaauuugaaggauuuuuagauuau

SEQ ID NO: 116363 - RNA, 64 nt, Human
gcccagccacugccaucaucuuuaggaagagagaagugaccaugccugaaccagucauuggcaa

SEQ ID NO: 116364 - RNA, 64 nt, Human
aauuuauacccaugaaaguucagccaaugcccagagugaccaagcagcaccagcaggccugccc

SEQ ID NO: 116365 - RNA, 64 nt, Human
caggcuagugguuuucuuuguuaaaguguaaaacagugaccagaauauauauaucuauaccugc

SEQ ID NO: 116366 - RNA, 64 nt, Human
cuuacauagguauuucucccacagaaaugaugaaagugaccagaaaaaaacaaaaacaaaaccc

SEQ ID NO: 116367 - RNA, 64 nt, Human
cgggaccagguauucuuaauugggaaaacagucaagugaccaucauagcuuuuuauucugaaaa

SEQ ID NO: 116368 - RNA, 64 nt, Human
ugacaccugggcuauggagagguuggcgccugucagugaccauccuaaugccucucgcucacuc

SEQ ID NO: 116369 - RNA, 64 nt, Human
cagggacccccaagcauccccagcaccccccgugagugaccagacccuccccugcugccccugc

SEQ ID NO: 116370 - RNA, 64 nt, Human
aggagggguggggaggaagccggggcagucaccgagugaccaccaagaggaagacccaccccac

SEQ ID NO: 116371 - RNA, 64 nt, Human
gacuucuggaggaauugguuguauagaagauccuagugaccaaauucagccuacugccucggau

SEQ ID NO: 116372 - RNA, 64 nt, Human
uguaauuguaacuauaccucugguucccauuaaaagugaccauuuuaguuaaauuuuguuccuc

SEQ ID NO: 116373 - RNA, 64 nt, Human
uacuauacugaaaucugugcucucaagaucuagcagugaccagggcugcccggcgggggcucuc

SEQ ID NO: 116374 - RNA, 64 nt, Human
auggcaggacaggcuccagcagagagaacugcacagugaccacuguauuuuucacgcucuucca

SEQ ID NO: 116375 - RNA, 64 nt, Human
aaaauaucauguuccuaaucuguugucucagauaagugaccaagacgggacuuuccacauuuua

SEQ ID NO: 116376 - RNA, 64 nt, Human
gcccaagcagacagcccuggcaaaugccugacucagugaccagugccugugagcauggggccag

SEQ ID NO: 116377 - RNA, 64 nt, Human
gcuuguaggugccugccuucaucugguccaggacagugaccaucugggucuguguagcugggga

SEQ ID NO: 116378 - RNA, 64 nt, Human
cuccuggggaaggggcugccaacgaaccagacucagugaccacgucaugacagaacagcacauc

SEQ ID NO: 116379 - RNA, 64 nt, Human
aaaccuucgucaauugcacaccggugcuguugggagugaccaaaccacaugaaccagacuuuuc

SEQ ID NO: 116380 - RNA, 64 nt, Human
gcaugugccaaagaagaggcccucugggugaugaagugaccaucacauuuggaaagugaucaac

SEQ ID NO: 116381 - RNA, 64 nt, Human
aggugauggagggccgggucaccuuuggaaacagagugaccagcucauugggagacaucccugu

SEQ ID NO: 116382 - RNA, 64 nt, Human
accugcauugaacaguccuguggaaaggccaagcagugaccaggaagagggagaaacuucugcu

SEQ ID NO: 116383 - RNA, 64 nt, Human
caguaaacugacuguagaaugauaauugugguauagugaccaauagaugccaaacagcuugugg

SEQ ID NO: 116384 - RNA, 64 nt, Human
aaucuuaaaggagguucucaugcccaggguccacagugaccagccagcaagucucugguagaaa

SEQ ID NO: 116385 - RNA, 64 nt, Human
ggaucccagggaaauaucagccuugggcaacugcagugaccaggggcaccggcugcccacaggg

SEQ ID NO: 116386 - RNA, 64 nt, Human
uuucccacuccccucuuccacaagugugauuaaaagugaccagaaacacagaaggugagaucac

SEQ ID NO: 116387 - RNA, 64 nt, Human
ugacuccuuucagacucaacacaguucccuucuuagugaccaaaaugguggccuacuggcuggu

SEQ ID NO: 116388 - RNA, 64 nt, Human
gacagugguacuuagcaaaggccacuguuuccauagugaccagcugauaccucuuccugcccuc

SEQ ID NO: 116389 - RNA, 64 nt, Human
caguacuuuacaaacuucuaguucguugagacuuagugaccauuuggcaucaaguuaacaucac

SEQ ID NO: 116390 - RNA, 64 nt, Human
aauaucuuugggucuuacuauuuuuacccauaaaagugaccagguagacccuuuuuaauuacau

SEQ ID NO: 116391 - RNA, 64 nt, Human
gauuuugauugaaaaugaacuauuugaaacacacagugaccaagggaagugaccaaggugaaga

SEQ ID NO: 116392 - RNA, 64 nt, Human
aaugaacuauuugaaacacacagugaccaagggaagugaccaaggugaagauggccuaggaucu

SEQ ID NO: 116393 - RNA, 64 nt, Human
acccacgguggggcggguggggggagccuggaacagugaccagaucugggggccugagugggga

SEQ ID NO: 116394 - RNA, 64 nt, Human
ugcccuuugcuuguagaauaaagaagugcgcggaagugaccacagaagacccgcucuccaucuu

SEQ ID NO: 116395 - RNA, 64 nt, Human
uggcccacguccuucucagccugcccucgacaacagugaccaacagacaggcagcuggguuucc

SEQ ID NO: 116396 - RNA, 64 nt, Human
ggccacccuaggacuugaaaggaccgugcagcccagugaccacugcccagugggaggcgccacu

SEQ ID NO: 116397 - RNA, 64 nt, Human
aguggcgugagcugcccggcgccugcccugcccaagugaccagggaaguguguguguguccaug

SEQ ID NO: 116398 - RNA, 64 nt, Human
cccuuuuacauuuugaugugucaaaggcuuuuggagugaccaaaagcacagaggcagcgggugg

SEQ ID NO: 116399 - RNA, 64 nt, Human
aacacgaaaugguaaugugaagcuaagagcagagagugaccaacaguaaacaacacgcgcagac

SEQ ID NO: 116400 - RNA, 64 nt, Human
cugcuggacagugacccucuucccaggccucaggagugaccauagccacugcugaaaagucacg

SEQ ID NO: 116401 - RNA, 64 nt, Human
aaagauggaacuugcugcugagugcaccacuucaagugaccaccaggaggugcuaucgcaccac

SEQ ID NO: 116402 - RNA, 64 nt, Human
gacgugucauguacauuuguaucaaaaauaaagaagugaccaugagcuguuucugaugcuuaga

SEQ ID NO: 116403 - RNA, 64 nt, Human
aguguucuuuagcuuuuuauaauacugucuaaauagugaccaucucaugggcauuguuuucuuc

SEQ ID NO: 116404 - RNA, 64 nt, Human
ccuccccgcuuccugaccucugaagagguugggaagugaccauuuggaugucugggcccugcca

SEQ ID NO: 116405 - RNA, 64 nt, Human
ugcuccagucgaguuggccugacccgcuuggaucagugaccauuugcuggcagacaggggagag

SEQ ID NO: 116406 - RNA, 64 nt, Human
uauuaugauucagugcuauuuguaacugugucccagugaccaaauugcacucgacucgaucagc

SEQ ID NO: 116407 - RNA, 64 nt, Human
uagcccaagacuuggagucgaccccaagcgacagagugaccagaaacccuuuuacagucacauu

SEQ ID NO: 116408 - RNA, 64 nt, Human
uaauucuagacucuaaaucuucucuccugguuacagugaccauuugaacauuggugaguggaga

SEQ ID NO: 116409 - RNA, 64 nt, Human
uaaauccucuauugcuguuucuauucucucuuauagugaccaacaucuuuuuaauuuagaucca

SEQ ID NO: 116410 - RNA, 64 nt, Human
gguuuacauuaguuacuucaugcuggcugggguuagugaccauuugcauacucuuuuaaaucaa

SEQ ID NO: 116411 - RNA, 64 nt, Human
agagagagaacugugcuuccaaacagaaaucaggagugaccacaaagccugaaaacacuuugcc

SEQ ID NO: 116412 - RNA, 64 nt, Human
aaauccggcaucuggucgcugaguggccucaggcagugaccacgcucccggacccaaccuucag

SEQ ID NO: 116413 - RNA, 64 nt, Human
ucaacacaggacuucccuuaacaguuuccggaucagugaccaccaccacguucagguuucugaa

SEQ ID NO: 116414 - RNA, 64 nt, Human
ccacccucaacccauugcgcccaguccccaccacagugaccacacccucacuggcucggcccug

SEQ ID NO: 116415 - RNA, 64 nt, Human
acuucucuccaagccccugugggaggcggacagcagugaccaccuccccuucuuuuggacugcg

SEQ ID NO: 116416 - RNA, 64 nt, Human
ugugcaaggccuuuuuaggcacuagagauauagcagugaccaaaacagacacaaauccugcccu

SEQ ID NO: 116417 - RNA, 64 nt, Human
gacauacuuaggggucaaaccugugguguguggaagugaccacugggaugucaucauucaccau

SEQ ID NO: 116418 - RNA, 64 nt, Human
accuuacaaguguaaugaguguggcaaagccuuuagugaccagucaacacuuaccaucaggcca

SEQ ID NO: 116419 - RNA, 64 nt, Human
aauucuccacuuuuuuuuuucuugaguagacuucagugaccacacuguggaaaauaccuuugca

SEQ ID NO: 116420 - RNA, 64 nt, Human
guucaccuuggcuguccuaacagggccaaucaccagugaccagcuagacugugauuuugauagc

SEQ ID NO: 116421 - RNA, 64 nt, Human
guggauuuugcaccuggcuuuggggcaggggugaagugaccaggcuuagcuuguggaguuuaug

SEQ ID NO: 116422 - RNA, 64 nt, Human
caaaaaaggaaagucacaagccuguuuaaaaugaagugaccaccuuuucuugcauagacuaaau

SEQ ID NO: 116423 - RNA, 64 nt, Human
caggaaggggccccacagccgagacgacguguccagugaccaucucagaagccguccaucaguc

SEQ ID NO: 116424 - RNA, 64 nt, Human
aaccuguguaugcaggggucaugaacaagaccugagugaccagucaagccucauguuaccccag

SEQ ID NO: 116425 - RNA, 64 nt, Human
gcuucccccaccccacuggcucuucuuaauuagaagugaccaguucaccucuguguccuuuuga

SEQ ID NO: 116426 - RNA, 64 nt, Human
ccgcuacaguuuuuauuuagcauggggauugcagagugaccagcacacuggacuccgagguggu

SEQ ID NO: 116427 - RNA, 64 nt, Human
ggauaacauguaucacucacugccaaaaauagaaagugaccaugaaaaauaaauucgcugggga

SEQ ID NO: 116428 - RNA, 64 nt, Human
cuguccauggcugaguuuauuaguacaugggcuuagugaccacaaaauauuuuauuaagaaacu

SEQ ID NO: 116429 - RNA, 64 nt, Human
acaggaggcaaauccagagccuggcuguggggaaagugaccacucugcccugaccccgaucagu

SEQ ID NO: 116430 - RNA, 64 nt, Human
acccccuuccccgcccccaccccugggacguuaaagugaccagagcggauguucgauggcgccu

SEQ ID NO: 116431 - RNA, 64 nt, Human
uguucgagcuuuggaucaugcuaugucuguugcaagugaccacaaugugaaagaauuuaagucu

SEQ ID NO: 116432 - RNA, 64 nt, Human
ccgggcuuggcuuccuauugugacugaugagaaaagugaccacgugggggucagucgggggcaa

SEQ ID NO: 116433 - RNA, 64 nt, Human
uuggggacccagcuugucucggcagcuaagaagcagugaccaggauguggauuuuggcgaccug

SEQ ID NO: 116434 - RNA, 64 nt, Human
aaacccagugggcucugcccacgccgggccccaaagugaccagacuccagcacaccugucuccu

SEQ ID NO: 116435 - RNA, 64 nt, Human
gaggugauuucccccugacccccucccccaggugagugaccaccugggugccaguuacaggugu

SEQ ID NO: 116436 - RNA, 64 nt, Human
gaugucuggcaucgucuggccccuccuuuuccaaagugaccagaagauuguacuuccuagagau

SEQ ID NO: 116437 - RNA, 64 nt, Human
gcucuuaaaacauggugaggaaugccuaagucuuagugaccaaacgugaccuugaaagcagaca

SEQ ID NO: 116438 - RNA, 64 nt, Human
uccaguggaauggagauuucauuuugucagcagcagugaccacagccuuaccaaagcagacgcg

SEQ ID NO: 116439 - RNA, 64 nt, Human
agaaguaaaccacaggucccaccagcuccaugggagugaccaccucaguccagggaaaacagcu

SEQ ID NO: 116440 - RNA, 64 nt, Human
cacucuagacccaaaggugugcuaaucacuucacagugaccacuacagaguacuaagaagagaa

SEQ ID NO: 116441 - RNA, 64 nt, Human
gcuuggcaaauccccaucugagauaaaguaaacaagugaccagcagcccacagaugauuccuuu

SEQ ID NO: 116442 - RNA, 64 nt, Human
cugaaucgcagcccaaacagggcagcaauguugaagugaccauaaaguggucacuuccaccgug

SEQ ID NO: 116443 - RNA, 64 nt, Human
acugaguguaaaauaugugccaagucugcagcacagugaccaaaucugacaaucgagcucugga

SEQ ID NO: 116444 - RNA, 64 nt, Human
ugcugcuggcuuuugugcccuggaagaucauaauagugaccaaaauauacaugcagacuuguuu

SEQ ID NO: 116445 - RNA, 64 nt, Human
acuuaagucuggaagggaauuacuuuacugauuaagugaccaauauguucauauuaagcaguac

SEQ ID NO: 116446 - RNA, 64 nt, Human
ccagguugcuaagaaaccaggaguaaaagagucaagugaccaucauuucaccugcugcuugccc

SEQ ID NO: 116447 - RNA, 64 nt, Human
guugaaacuuaaacuauuuaaugucauuuaauaaagugaccaaaauguguugugcucuuuauug

SEQ ID NO: 116448 - RNA, 64 nt, Human
uuuuuauguagaaauuugacagcauuacaaauuaagugaccauuaaaaacacagcaaucauuca

SEQ ID NO: 116449 - RNA, 64 nt, Human
uugcuguguagguuuggugcucuauugauuggugagugaccagagcaaguaugaaggugaugcu

SEQ ID NO: 116450 - RNA, 64 nt, Human
agaagggacgcuuuucuuccuucugcccaaguaaagugaccaugccaguggccagcacuggggg

SEQ ID NO: 116451 - RNA, 64 nt, Human
gcucccuggccccaacacaucggggcuccgaggcagugaccagaacguggucucaagguggugg

SEQ ID NO: 116452 - RNA, 64 nt, Human
aaaaauuugaaauauuagaauggccgaccauggcagugaccaggccucacuacaggccugguug

SEQ ID NO: 116453 - RNA, 64 nt, Human
uucugaccuuacaaaagugucccuugagugaggcagugaccacgcauugucacagcuaccaaag

SEQ ID NO: 116454 - RNA, 62 nt, Human
ccgcccccaguccccaccccugcccccagccccggggugaguccauucucccagguaccagc

SEQ ID NO: 116455 - RNA, 62 nt, Human
uaagcagagaggguugauaggcuggccguguccggggugaaauuggaaauccagcugccuag

SEQ ID NO: 116456 - RNA, 62 nt, Human
acccacagaccuuaggaggaggaaggcgagggcggggugacuucuggugaugauaaaaaugg

SEQ ID NO: 116457 - RNA, 62 nt, Human
cgcugcugaguggcaguuuacagaagaggucgcggggugagccucuuagcaggacagaaaac

SEQ ID NO: 116458 - RNA, 62 nt, Human
ccguuugcaauaaugucgucuuauuuauuuagcggggugaauauuuuauacuguaagugagc

SEQ ID NO: 116459 - RNA, 62 nt, Human
cccgcgggccggggagggaagccucggggcugcggggugagaggaagaaagcaaacccgggg

SEQ ID NO: 116460 - RNA, 62 nt, Human
auuucgauacuguguacauagcagggagugaucggggugaaauaacuugggccagaauauua

SEQ ID NO: 116461 - RNA, 62 nt, Human
gcagccuacaggauaaggaaguucacagccugcggggugaaugaacccaugugugaacugca

SEQ ID NO: 116462 - RNA, 62 nt, Human
aauucugaauauuuuuugaggcuaaagaagaccggggugacaagcagauacugcuguguaau

SEQ ID NO: 116463 - RNA, 62 nt, Human
aguaucaaaagaaagaaaaucaggcuggccaacggggugaaacccugucucuacuaaaaaua

SEQ ID NO: 116464 - RNA, 62 nt, Human
agugaaccaagauugcaccacugcacuccagccggggugacagagugagacuccgacugaaa

SEQ ID NO: 116465 - RNA, 62 nt, Human
gggguggugcuccuggcuucuccuguggagcccggggugaugcauaaaauccugugugccug

SEQ ID NO: 116466 - RNA, 62 nt, Human
ugaguacuuucaggaagacugacuuaaauauucggggugaguaaguaguuggguauaagauc

SEQ ID NO: 116467 - RNA, 62 nt, Human
ggguggggggagggggagccugcgaauuugaacggggugaguuguuucuuuuagugcauuuc

SEQ ID NO: 116468 - RNA, 62 nt, Human
cucccuugcgaccucgcaauaaauuggccccacggggugauuuugacagucugugcugugcu

SEQ ID NO: 116469 - RNA, 62 nt, Human
uccaugacaccuaaguugggauguggaugugccggggugaggaagauguggcugcaaggucu

SEQ ID NO: 116470 - RNA, 62 nt, Human
gcgauggugacuaguccaccaggaguucccagcggggugacagucugaagaccucgucaccu

SEQ ID NO: 116471 - RNA, 62 nt, Human
acgugaccucugacaaagcccaucccaggagacggggugaagcuauuccccacacucuccug

SEQ ID NO: 116472 - RNA, 57 nt, Human
uggcggcguucaccaaguaacucugcucggggugaaccauucuccuuucucucaagu

SEQ ID NO: 116473 - RNA, 62 nt, Human
agugagucgugauugugccacugcacuccagccggggugacagaagagaccuugucucgaaa

SEQ ID NO: 116474 - RNA, 62 nt, Human
uuuuuuaaacgcgugaugaagacagaaggcuccggggugacgaauuuggccgauggcagaug

SEQ ID NO: 116475 - RNA, 62 nt, Human
cagagagaggugacaacagaggggguagggcccggggugagcucuucucaggagccuucugc

SEQ ID NO: 116476 - RNA, 62 nt, Human
ugcagccagaacagguggcugagcuguggggccggggugaccggaucgaaucucucagcgac

SEQ ID NO: 116477 - RNA, 62 nt, Human
cacaccugaucugcucucggcuggucccagagcggggugagggggcuuaugccccccccucc

SEQ ID NO: 116478 - RNA, 62 nt, Human
cgcgacuuguaacgagucuucccgggaaggggcggggugaggacagagaggagucgaggguu

SEQ ID NO: 116479 - RNA, 62 nt, Human
aguuacuguucaggggauccuucuguuucucacggggugaaacaugucuuuaguuccucaug

SEQ ID NO: 116480 - RNA, 62 nt, Human
ggucggcaggcuccgccuucuuuucuucuccgcggggugauucaguccagugauuggguuug

SEQ ID NO: 116481 - RNA, 62 nt, Human
gagcuggacuuccuccuccuccuccucaugaccggggugaauuagaacguuuuuaaagacac

SEQ ID NO: 116482 - RNA, 62 nt, Human
acuaagucccaccagcugagguccgaggaaagcggggugacucauuucccuuguccagggcc

SEQ ID NO: 116483 - RNA, 62 nt, Human
cuggauaccauuguccccaaguaugaggugaacggggugaaaccucccauuggccaaaggac

SEQ ID NO: 116484 - RNA, 62 nt, Human
cugcggcucagguggccaaccaggcccugauccggggugacuggaaccggggcgguggggug

SEQ ID NO: 116485 - RNA, 62 nt, Human
cccaggaggcagcagcaaccuugggcuuccugcggggugacuaccuugcccuccggcccugc

SEQ ID NO: 116486 - RNA, 62 nt, Human
cuugauuccagaaacauaugggcugauaaacccggggugaccucaugaaaugaguugcagca

SEQ ID NO: 116487 - RNA, 62 nt, Human
ugcccaacaugcuggggguccagaaaccaccucggggugacugagcggaaggccaggcaggg

SEQ ID NO: 116488 - RNA, 62 nt, Human
cugaaagaaagcagagcugcguaaaguuaccccggggugauauaggggggccagacgugugc

SEQ ID NO: 116489 - RNA, 62 nt, Human
gccacucuucauuaaacaucagagaauucacacggggugaaaccugggucagcaucccuagg

SEQ ID NO: 116490 - RNA, 62 nt, Human
uaaacaacaaaaaucucauugugucuacacaucggggugaccuuaggucgguuuguaagugg

SEQ ID NO: 116491 - RNA, 62 nt, Human
cuacauugccuucaggugaugccuguucuccccggggugaugggcagagggcaggagggugg

SEQ ID NO: 116492 - RNA, 62 nt, Human
cucagaugcugcuggcagaguugucucgggagcggggugagcugcagggugaacgcggggag

SEQ ID NO: 116493 - RNA, 62 nt, Human
cuuuguugaauugugguagcuuaggaggaugucggggugaagggugguaucuuggcaguuga

SEQ ID NO: 116494 - RNA, 62 nt, Human
guugaaagcaaccugcaugcuaaucgugguuucggggugagaauaaaacacccccacauaac

SEQ ID NO: 116495 - RNA, 62 nt, Human
gccaagaucacaucacugcacugcacuccagccggggugacagagcgaaccucugucucaaa

SEQ ID NO: 116496 - RNA, 62 nt, Human
auuccuagaauuaaaccagauuggagcaauuacggggugaccuuaugagaaacugcaugugg

SEQ ID NO: 116497 - RNA, 62 nt, Human
uguaaagugauuuuuggucuucuguugacauucggggugauccuguucugcgcuguguacaa

SEQ ID NO: 116498 - RNA, 62 nt, Human
cauggcacagccagcuucucugaccaguaauccggggugacuugagggucugcaaaggcaua

SEQ ID NO: 116499 - RNA, 62 nt, Human
ggaaaacaauauaaaggacauccucaucaucacggggugaaggucagacuaaggcagccuuc

SEQ ID NO: 116500 - RNA, 62 nt, Human
gacagcugggcacguccacucgcagggaaacacggggugagacagcaggaaggggcccugca

SEQ ID NO: 116501 - RNA, 62 nt, Human
gggaauucuggccacccugggugggguguggucggggugagaacccaagcguuggaacugua

SEQ ID NO: 116502 - RNA, 62 nt, Human
cuacacagugcugaaguccagcugguacacaccggggugacaccuuggcugcaucuguucuc

SEQ ID NO: 116503 - RNA, 62 nt, Human
uuuccugccaccaccuuccaggacauccagcgcggggugacaagugccgugaacaucaugca

SEQ ID NO: 116504 - RNA, 62 nt, Human
ugugcugucuccuccuccgugcgccucagacucggggugagggaggcgggcagccucucgcc

SEQ ID NO: 116505 - RNA, 62 nt, Human
cccagcuucccuuggucagccccacuccagcacggggugaacggaggcccagaguacuaggg

SEQ ID NO: 116506 - RNA, 62 nt, Human
aucgguugacccuacuguggauugguggguuucggggugaagcaaguucacuacagcaucaa

SEQ ID NO: 116507 - RNA, 62 nt, Human
augugugcaugacggugggggugcuggggggacggggugaguggaaacuuaguuugaguaau

SEQ ID NO: 116508 - RNA, 62 nt, Human
aagcacaaagccauucuaagucauuggggaaacggggugaacuucagguggaugaggagaca

SEQ ID NO: 116509 - RNA, 62 nt, Human
acauggugguggcuuugaaggagcugucuauucggggugacuuucgaacuacaguugaauac

SEQ ID NO: 116510 - RNA, 62 nt, Human
agcaaaacaguucucagaaaugucaugauugccggggugaaggcaagagaugaauugcauua

SEQ ID NO: 116511 - RNA, 62 nt, Human
auggugauugaagcaaaauauguaaacuuguacggggugaucgugugcuuuggaacagagua

SEQ ID NO: 116512 - RNA, 62 nt, Human
agugagccgugauggcaccauugcacuccaaccggggugacagaugagguccucuguuuacc

SEQ ID NO: 116513 - RNA, 62 nt, Human
gccugggaucugagaggaggcugcugggccuucggggugagcccccagagcuggaccugagc

SEQ ID NO: 116514 - RNA, 62 nt, Human
uagccccaaaggagaagugaaaaggccccagccggggugaaucaucaguccuggggaagaac

SEQ ID NO: 116515 - RNA, 62 nt, Human
uggcaccacagaggagccgagcuauaggagggcggggugaccccucacccgcuguggacucu

SEQ ID NO: 116516 - RNA, 62 nt, Human
uaacuccugccagcccuucuaagacccacgagcggggugagagaagugugcaauagucugga

SEQ ID NO: 116517 - RNA, 62 nt, Human
guaaacugcuaccccuggggccuucugcaccccggggugaggccuccugccugccuggugcc

SEQ ID NO: 116518 - RNA, 62 nt, Human
aggaauucagcuccaguaaggccuggauugcccggggugagcguguguguggugggaagacc

SEQ ID NO: 116519 - RNA, 62 nt, Human
uccggcaaagcaaagcagaagcugcugaagcacggggugaacuugcucugaacugcacccag

SEQ ID NO: 116520 - RNA, 62 nt, Human
ccccagcccccuccuggugccaccucagaccccggggugagggggggcucccuggggggagg

SEQ ID NO: 116521 - RNA, 62 nt, Human
gcuggcggagaagggcagguguccggagcugucggggugaaggcuucccuggggcuccucug

SEQ ID NO: 116522 - RNA, 62 nt, Human
gcuggccuggggucaggccgggcagagcacagcggggugagagggauuccuaaucacucaga

SEQ ID NO: 116523 - RNA, 64 nt, Human
cuacuguaggagauagguacuguuguuuuuuauuaccgccgaagaaacaggccagauaagugaa

SEQ ID NO: 116524 - RNA, 64 nt, Human
uucugaggggcagcggggccuggcgggaugggccaccgccgacuuuguaccccccaaccccuga

SEQ ID NO: 116525 - RNA, 64 nt, Human
guccucugugcccacggucugagcuagcuagcgcaccgccgaguuaaagaggagaaggaaaaca

SEQ ID NO: 116526 - RNA, 64 nt, Human
cucaacgagacccaagugaagaucugguuccagaaccgccgaaugaagcaaaagaaacgugaga

SEQ ID NO: 116527 - RNA, 64 nt, Human
gcccagugggggcugggcaggcccauugagggccaccgccgagguuucuccuagggcuguuccu

SEQ ID NO: 116528 - RNA, 64 nt, Human
cuagcgcucgaaagcccaacgccucccggaccggaccgccgaggggagcugggaccuccucugc

SEQ ID NO: 116529 - RNA, 64 nt, Human
agcuggcugggcuggacccggucccuaggcugugaccgccgaacuccacugcaacagacgggcg

SEQ ID NO: 116530 - RNA, 64 nt, Human
ccagcgagccggggacccacccaccaccccccgcaccgccgacgccgccucguucguccggccc

SEQ ID NO: 116531 - RNA, 64 nt, Human
ucaaggcaguuuuuaaagaagucuuggaaacagacggcggcaccuuuccucuaauccagcaaag

SEQ ID NO: 116532 - RNA, 64 nt, Human
cugcaggaccaggugccagccacuaagggggggcaccgccgaugccagggguuuugcccacccg

SEQ ID NO: 116533 - RNA, 64 nt, Human
aaguagggcgugugguuucccugccccuguccggaccgccgaucccaggugcgugugucucugu

SEQ ID NO: 116534 - RNA, 64 nt, Human
cgccuacucccagcugguggccgugcuggucuacaccgccgagcgggccaaguucgccaccggg

SEQ ID NO: 116535 - RNA, 64 nt, Human
guccccaucauucagucaccuccccccaggccccaccgccgauucugaggaugacaauuccaca

SEQ ID NO: 116536 - RNA, 64 nt, Human
uuugguucuuuuguuuuguuuuuuaacacuugucuccccucauacacaaaaguacaauaugaag

SEQ ID NO: 116537 - RNA, 61 nt, Human
aggugcccuugaugcuauagcgccuccccucuccccucagagggcacagcugcaggccuga

SEQ ID NO: 116538 - RNA, 64 nt, Human
ccucacgccuuucuguuccuuguccucaccuuacuccccucaggacccuaccccacccucuuug

SEQ ID NO: 116539 - RNA, 64 nt, Human
uuucccuaaaggggagucaaguucccuggguuguuccccucauaagguauuagggacuuguguc

SEQ ID NO: 116540 - RNA, 64 nt, Human
caccccauuaacuucgcucccaugggagauggcuuccccucaugcaacaggcagguuugggagu

SEQ ID NO: 116541 - RNA, 64 nt, Human
uaaggccaucuagugccaacuccccccccaccauuccccucacugcacuuuggaccccuggggc

SEQ ID NO: 116542 - RNA, 64 nt, Human
cuggcuuuucugccguggauucucccccgucuucuccccucagcaauuccugcaaaggguuaaa

SEQ ID NO: 116543 - RNA, 64 nt, Human
agugaagcgggcagggccccuggacugucguggcuccccucaucagcuccccacaccagucaag

SEQ ID NO: 116544 - RNA, 64 nt, Human
cugccagagcuucuccaggaggccaagcagaggcuccccucaugaaggaagccauugcacugug

SEQ ID NO: 116545 - RNA, 64 nt, Human
acuuuauaucuguaaugauacugauuaugaaauguccccucaaacucauugcagcagauaacuu

SEQ ID NO: 116546 - RNA, 64 nt, Human
cuccaauuguucacauagcugggauauuuguugcuccccucaccccuuggauuauguagggagc

SEQ ID NO: 116547 - RNA, 64 nt, Human
gcgggcaggcccagggagcaggcagcaguguucuuccccucagagugacuuggggagggagaaa

SEQ ID NO: 116548 - RNA, 64 nt, Human
acugcccuggaauggguguugcucuuaggauguauccccucaaaccuaccuggugguucugugc

SEQ ID NO: 116549 - RNA, 64 nt, Human
agcuggaguggaguugaggacuauuagaacugguuccccucaccacccaaccuacccaccuaug

SEQ ID NO: 116550 - RNA, 64 nt, Human
ucagagggucugaggugacucuugcaggagccuguccccucaucacaggcuaaagaagagcagu

SEQ ID NO: 116551 - RNA, 64 nt, Human
cucaugugacuuggaggcaggauccaggcacagcuccccucacuuggagaaccuugacucucuu

SEQ ID NO: 116552 - RNA, 64 nt, Human
ggugcuauggucuguucuuuaguucuaguuuguauccccucaaaagccauuauguugaaauccu

SEQ ID NO: 116553 - RNA, 64 nt, Human
ccucugcaggcucauuccuccuuggucuccugcuuccccucacgcgaauuucuuucaaagccau

SEQ ID NO: 116554 - RNA, 64 nt, Human
ccaucuuuaacuuuuaaaguacuucuuccccuuauccccucaauaaagaaaggaaauccaaauu

SEQ ID NO: 116555 - RNA, 64 nt, Human
gggagagucaaguagucuaggguuucagguugccuccccucauaugguuuuuggccaagugacu

SEQ ID NO: 116556 - RNA, 64 nt, Human
ucuuauaagauucaguuggcuguccuuuuccugcuccccucaaaagauuuuuagucauacagaa

SEQ ID NO: 116557 - RNA, 64 nt, Human
uuccuguucccugaucaacuuccuggaguuuauauccccucaggauaaucuauucucuagcuua

SEQ ID NO: 116558 - RNA, 64 nt, Human
aaggcaguccugaggacaugggcucaagucucaguccccucagaccacggugaugccuugacca

SEQ ID NO: 116559 - RNA, 64 nt, Human
gcagcauaaagucacucauuucuuaccauuuuauuccccucaauucucaauauauucaguaaug

SEQ ID NO: 116560 - RNA, 64 nt, Human
cuauccaaccguacuaacguggacacccuacaccuccccucagaacuucaaaagggcaagaucu

SEQ ID NO: 116561 - RNA, 64 nt, Human
ggcuguuccagccccagguauuaggacucagggcuccccucaggaagcugggcccagcugggau

SEQ ID NO: 116562 - RNA, 64 nt, Human
gcagccccuggguuucucuuggaaauggucaguuuccccucaaaguacccaaaguagccuuggc

SEQ ID NO: 116563 - RNA, 64 nt, Human
cucaacuccccaccucugggcacugaggaguauuuccccucauucuaccucucuaaggcuaugc

SEQ ID NO: 116564 - RNA, 64 nt, Human
uggaccaucccgcguagggguggcagcccccagcuccccucagugcugcugucaguguagcaaa

SEQ ID NO: 116565 - RNA, 64 nt, Human
agugucccccacccccaccacccucgagcgggguuccccucauuguacagauggggcaggaccc

SEQ ID NO: 116566 - RNA, 64 nt, Human
ccagaucuggacuauccacgugcuuugaaacuuuuccccucacccuccagcccuggaggcuuuu

SEQ ID NO: 116567 - RNA, 64 nt, Human
gggcaguaacaccagggccagcaggcagcgccuguccccucacagacucuuccaccagagcagg

SEQ ID NO: 116568 - RNA, 64 nt, Human
gaaaggcagaggggcuccagguccuguuuccagcuccccucacugcacauggugaagcucgcuc

SEQ ID NO: 116569 - RNA, 64 nt, Human
uuugcccgucuucucccuuggcugagcaaagccauccccucaauucagggaagggcaaggagcc

SEQ ID NO: 116570 - RNA, 64 nt, Human
cugcucaugcuaggcaaggcccaccuuccugaccuccccucauuguggccccacacccagucug

SEQ ID NO: 116571 - RNA, 64 nt, Human
uauccaggagcugguggggagggcaucucccugcuccccucaacccccucccaccccauccacg

SEQ ID NO: 116572 - RNA, 64 nt, Human
auuaaaaguaacuacuaaggaaagguuaaaaacuuccccucaaaaaggaaucaaccccaggaag

SEQ ID NO: 116573 - RNA, 64 nt, Human
cucugccucugacuacaucugccaccaacaacccuccccucaccccugccaggggcagacaggc

SEQ ID NO: 116574 - RNA, 64 nt, Human
ugggaauuuuaaauacguuugcagaaacugccccuccccucauugagggucacugcucaagagu

SEQ ID NO: 116575 - RNA, 64 nt, Human
gaagcagccaggacucuuccuaccacaaacugaguccccucaccugaacucugggcuggaggca

SEQ ID NO: 116576 - RNA, 64 nt, Human
gaaugccugcccgcuaucccuguggcaggaaauauccccucaugucccagggaauugcagaugg

SEQ ID NO: 116577 - RNA, 64 nt, Human
uggaaagagccuuuuccuucuccuuuucuuacucuccccucaugguguuccccucuuaaaggag

SEQ ID NO: 116578 - RNA, 64 nt, Human
acccuacucuguguggcugcuuucuuuggugcccuccccucaccccacuguagcugugacgugu

SEQ ID NO: 116579 - RNA, 64 nt, Human
aauagcacagcugcccucccaugcucccuaccuguccccucacagggaggggagcaggggaggg

SEQ ID NO: 116580 - RNA, 64 nt, Human
uccucugaaagccuggcugaccaggaauggggucuccccucacauuggggagcuugcccuuuac

SEQ ID NO: 116581 - RNA, 64 nt, Human
uuuuauccugucuuugggggcaaugugucaaaaguccccucaggaauuuucagaggaaagaaca

SEQ ID NO: 116582 - RNA, 64 nt, Human
cacaggggagaugguggaaucuucccuguuuuuauccccucagggucaguuacauagaagcugc

SEQ ID NO: 116583 - RNA, 64 nt, Human
agcuaaaacguuuauuucucacucaaaacuuauuuccccucaacccuauacccaaagaagaaau

SEQ ID NO: 116584 - RNA, 64 nt, Human
ugaaggcgaaacccugccauauccccagugccaguccccucagccugugguggccuugcauccu

SEQ ID NO: 116585 - RNA, 64 nt, Human
agggcugugggcagggccaugucccuuucuccucuccccucaaccucuuacugcuguucucccu

SEQ ID NO: 116586 - RNA, 64 nt, Human
uucuggggcucaggcuugagccacuacucccucauccccucaggagucugaacacugggcuuau

SEQ ID NO: 116587 - RNA, 64 nt, Human
gcucaagcugugauaaagaagggcccauccuauuuccccucaucuaguccauuuacgauucuca

SEQ ID NO: 116588 - RNA, 64 nt, Human
gggcauggagugcccaugcauacucugcugccgguccccucaccugcacuugaggggucugggc

SEQ ID NO: 116589 - RNA, 64 nt, Human
gaagaguccugaggggcaacacacaagaaccagguccccucagcccacagcacugucuuuuugc

SEQ ID NO: 116590 - RNA, 64 nt, Human
cuauaugguaacucaucauuaaccagaacaccucuccccucaaauuccgugaccaaguugugca

SEQ ID NO: 116591 - RNA, 64 nt, Human
ucuuuccaaagcugcacuucucuuaauaauucucuccccucaaaagaaagauuaugauaaagaa

SEQ ID NO: 116592 - RNA, 64 nt, Human
gguagauuaggucaacccuccuuuaagcuuacucuccccucaccuuuucuuuucacuguauaua

SEQ ID NO: 116593 - RNA, 64 nt, Human
ugugccugcccuggcguucucacagccucccccuuccccucagcaggcggcucucuuugccuua

SEQ ID NO: 116594 - RNA, 64 nt, Human
gccucccuccuccaccugaccaacgcgacauuccuccccucacgccuggcccggucccuuccag

SEQ ID NO: 116595 - RNA, 64 nt, Human
gagcuaaacucggccaaccaaggcacgcagcauguccccucaggucuccagucaguccagguug

SEQ ID NO: 116596 - RNA, 64 nt, Human
caguggagucauucagcgggagcacugcgcgcuauccccucacauucucuauguacuauguaug

SEQ ID NO: 116597 - RNA, 64 nt, Human
uugcucugaauuuggcauccagaguuaacauuucuccccucacucccuugcuggugucauaguu

SEQ ID NO: 116598 - RNA, 64 nt, Human
caugagaauugaaguguugaaggaugauuuuuuuuccccucaucuuggucagagaguggauuuu

SEQ ID NO: 116599 - RNA, 64 nt, Human
gcaucagcuuucccuggcucagggaucuucucccuccccucacccgcugcccagcccucccagc

SEQ ID NO: 116600 - RNA, 64 nt, Human
gcucagagggucucugcugcucuccccugggaaauccccucauccugcccucuggcugccuccc

SEQ ID NO: 116601 - RNA, 64 nt, Human
ggaggcauucuugaacugcugaggaugggggguguccccucagcggaggccaagggaggggagc

SEQ ID NO: 116602 - RNA, 64 nt, Human
gaaaagacaacaaaaguaucuucauacuuccucauccccucauugcaacaaaaccuuaaacugg

SEQ ID NO: 116603 - RNA, 64 nt, Human
aaaauucccauuuuucaucuuuacacuccuuuucuccccucauuuccucuucuccuuacuaagg

SEQ ID NO: 116604 - RNA, 64 nt, Human
gucccccauguuucugaaaagugcuguaguuuaguccccucacccccagcacugcccaaacagg

SEQ ID NO: 116605 - RNA, 64 nt, Human
aaacugugaauguuccaacaccugccuccacuucuccccucaagaaauuuucaacgccaggaau

SEQ ID NO: 116606 - RNA, 64 nt, Human
cuggugacccuccaagaugccccugcccucaguuuccccucaugaucuggccucugcccccuuc

SEQ ID NO: 116607 - RNA, 64 nt, Human
ugccuugucugccuggcaaguucaucucucacgauccccucaaaggcccccuccuccaggaagg

SEQ ID NO: 116608 - RNA, 64 nt, Human
uuccaucccaggacaccacacccagccucaguccuccccucacagccucugaccccuccucacu

SEQ ID NO: 116609 - RNA, 64 nt, Human
gguaaaucagaugcaaaccccaagccuucuccuuuccccucacacgugagaaccaugaacaagc

SEQ ID NO: 116610 - RNA, 64 nt, Human
cccccaguccugccccccaggagcacaagcaggguccccucagucaaggcagugggaugggcgg

SEQ ID NO: 116611 - RNA, 64 nt, Human
ccucucuaccugcagugaguuccagaccugcccguccccucaccagcgccuccccacccuguug

SEQ ID NO: 116612 - RNA, 64 nt, Human
cgcccugggagcugagccugggacuuccaggaccuccccucagguuguucucugauucuuccuc

SEQ ID NO: 116613 - RNA, 64 nt, Human
auccuggcaccagccaccccuccacucagugcacuccccucacuuaggcaaagcauuauucauu

SEQ ID NO: 116614 - RNA, 64 nt, Human
ucuggcagagccucugagaugaugcaugaugcccuccccucagcgcaggcugcagagcccggcc

SEQ ID NO: 116615 - RNA, 64 nt, Human
ugcacagcccugcauguacuagcaccuucaucacuccccucagggcauggucucaucuccgcau

SEQ ID NO: 116616 - RNA, 64 nt, Human
cugcuguccuuccugcagaaacaguuucuccuccuccccucagccuuguggccaguuccucuuc

SEQ ID NO: 116617 - RNA, 64 nt, Human
cuaacaagucaccuccacuaugugggucuuccuuuccccucaagagaaggagcaauuguucccc

SEQ ID NO: 116618 - RNA, 64 nt, Human
ucgggaaggcaccuaccaccugcccuggcuuucuuccccucaacucuggagccccauccccacc

SEQ ID NO: 116619 - RNA, 64 nt, Human
ugaguccugcagccaggaggguaauacacucugauccccucagucugaaucuucucauugucuu

SEQ ID NO: 116620 - RNA, 64 nt, Human
guggacuggugggcuccccucugggccagcacaguccccucaccucuggcagggcugcuaccuc

SEQ ID NO: 116621 - RNA, 64 nt, Human
agcuugcuuuaaugaaauggaugugccuaaaagcuccccucaaaaaacugcagauuuugccuug

SEQ ID NO: 116622 - RNA, 64 nt, Human
cacggugauucagauugagcaccaacuuguuuccuccccucaaaguucugccuaagccguucag

SEQ ID NO: 116623 - RNA, 64 nt, Human
aagcguucauaacuuccuaaaacauggaagguuuuccccucaacaauuuugaagcugugaaauu

SEQ ID NO: 116624 - RNA, 64 nt, Human
gccccuucuugucuuggcacaugcacagacccaguccccucacgguagggcaccccugaccuac

SEQ ID NO: 116625 - RNA, 64 nt, Human
gcuuugcguuagggugaagacccuagcguccagcuccccucaacgcuauauuuugacacuaaaa

SEQ ID NO: 116626 - RNA, 64 nt, Human
ugggugugaagccuucaugaaugguuuggcaccguccccucagugcuggucucaugacagugag

SEQ ID NO: 116627 - RNA, 64 nt, Human
uaauuguauauuuauaucaugugcuuuaucguuuuccccucauguauccaaguaauuuuuauuu

SEQ ID NO: 116628 - RNA, 64 nt, Human
uuuuuccucuuacuuuaauugaaauacucugaauuccccucauggaaacagagagcauugagag

SEQ ID NO: 116629 - RNA, 64 nt, Human
cauaccuacaaugcuggggaggcccugcuuccacuccccucagaggcuuuuggucauccucugc

SEQ ID NO: 116630 - RNA, 64 nt, Human
cacucagcuuccuacccacaccucugccagaagauccccucaggacugcaacaggcuugugcaa

SEQ ID NO: 116631 - RNA, 64 nt, Human
uuaagugccuaugggaaugugggucugcaccuuguccccucauaggaugguaccaagcauuuag

SEQ ID NO: 116632 - RNA, 64 nt, Human
cuuccgucuggcaaggccggggcacaauuugcacuccccucagcuagacgcacagacucagcaa

SEQ ID NO: 116633 - RNA, 64 nt, Human
uccucuuuccucucuuuguucucagcucccccuguccccucagcuccagacguaggggaggggu

SEQ ID NO: 116634 - RNA, 64 nt, Human
gagccagcaggcugguagccuggcagccuacaucuccccucagccucuccucacuauggcccca

SEQ ID NO: 116635 - RNA, 64 nt, Human
cgcucuccccugagggagucccugggccuagccauccccucacuauucccgacccaaaggguga

SEQ ID NO: 116636 - RNA, 64 nt, Human
aacagacuugaggaaccccucucccuuccauaauuccccucauccaccgcccacuccaggcacu

SEQ ID NO: 116637 - RNA, 64 nt, Human
cuucaucuuuaaaauaaggauaauaaucauucuuuccccucagagcucuuauguggauuaaacg

SEQ ID NO: 116638 - RNA, 64 nt, Human
uguguguugaguggggcucugcacacaccugucuuccccucaucaggauucaggagcugggaug

SEQ ID NO: 116639 - RNA, 64 nt, Human
cugccuuuugcuuggauacauaugaaugaugcuuuccccucaaauaaaacaucugcauuauucu

SEQ ID NO: 116640 - RNA, 64 nt, Human
aacuacuacuauagggaaaagaugccaaaacauguccccucacccagacuaaacuugauacugu

SEQ ID NO: 116641 - RNA, 64 nt, Human
gggcauaucccccaugccacucagcccugcccuauccccucacccccaucccggcuccaucugu

SEQ ID NO: 116642 - RNA, 64 nt, Human
gcaccgacaucaggaacccacggccaccaccuccuccccucaaggcaugcugagcaugggcaca

SEQ ID NO: 116643 - RNA, 64 nt, Human
guggcucuuaauuuauugcauaaugauauucacauccccucaguugcagugaauugugagcaaa

SEQ ID NO: 116644 - RNA, 64 nt, Human
cggggacuaacaaagacagcuguuuagggucuucuccccucacccaugcuuucaucauccccuc

SEQ ID NO: 116645 - RNA, 64 nt, Human
caucuauagacuuaguuguuacucuuuggaccacuccccucaaaacuuggaauucucucaccuc

SEQ ID NO: 116646 - RNA, 64 nt, Human
cucuggaaugcucugaaguuauggcugggaccuauccccucacaucuaaugaaugaauuauaaa

SEQ ID NO: 116647 - RNA, 64 nt, Human
caaagcaccauucugcuuucugugagaagggauuuccccucaacaacuucugucccauuuuuca

SEQ ID NO: 116648 - RNA, 64 nt, Human
ucuaauggcuuaacaguuguucuggguggaaacguccccucauuugaaugcuccucuaaaaaaa

SEQ ID NO: 116649 - RNA, 64 nt, Human
uuucgcuuuccuaagcuccugucgcuccucuuuguccccucaguuuauguccuccugugcucac

SEQ ID NO: 116650 - RNA, 64 nt, Human
acaaaagcuugucaccaaaagaaagaggugguauuccccucaguucaucuuuaccaaagacacu

SEQ ID NO: 116651 - RNA, 64 nt, Human
ucaccgcagucgucgcacagucucucucucucucuccccucaaagucugcaacuuuaagcagcu

SEQ ID NO: 116652 - RNA, 64 nt, Human
gccugggucuuagcauugaucagugacacaccucuccccucaaccuugaccaucuccaucugcc

SEQ ID NO: 116653 - RNA, 64 nt, Human
uucucuuguuugugcuauggcuugacccagcauguccccucaaaugaaaguucuccccuugauu

SEQ ID NO: 116654 - RNA, 64 nt, Human
ggaaugcaaaaaagccaagcccuccgccuagagguccccucacgugaccagccccguguagccc

SEQ ID NO: 116655 - RNA, 64 nt, Human
ccugucacgcucuggugcagucaaaggaacgccuuccccucaguuguuucuaagagcagagucu

SEQ ID NO: 116656 - RNA, 64 nt, Human
uguccccaaggucucagcgcugcggucucacuccuccccucauuuaagaagacuauccuuaccu

SEQ ID NO: 116657 - RNA, 64 nt, Human
aacacagcuguucuucuguucugcagacacgccuuccccucagccacacccaggcacuuaagca

SEQ ID NO: 116658 - RNA, 64 nt, Human
aauauuccucuuggccuugugagaaaccauucuuuccccucaggaguuucuauaggugucuuca

SEQ ID NO: 116659 - RNA, 64 nt, Human
gauuugcaaguaguaaacaguucauauuuugauuuccccucauuuuaguuuaauauaauuugca

SEQ ID NO: 116660 - RNA, 64 nt, Human
gcuagcaggcuguggggcagcugagcagcuuuucuccccucauaucugcgugcacuucccagag

SEQ ID NO: 116661 - RNA, 64 nt, Human
aacugugaguuuuccagaaucuguuucccaguuuuccccucagcuuuccuggucucccauccga

SEQ ID NO: 116662 - RNA, 64 nt, Human
cuuucuguuuugcuguuguugcuuugcaaagcuuuccccucauagccuguaccuguuaucaaua

SEQ ID NO: 116663 - RNA, 64 nt, Human
uccugugaugucaugaaagcaccugcccucuguuuccccucagaacacccuguaccauccaugg

SEQ ID NO: 116664 - RNA, 64 nt, Human
auuuacccacaggacucugaaucauguuacccacuccccucacaauguuguccacuuagugagu

SEQ ID NO: 116665 - RNA, 64 nt, Human
ucucucucucucuccucugcugaugggacccuuuuccccucacccucugcccuucuaagucaua

SEQ ID NO: 116666 - RNA, 64 nt, Human
gcuggccuuuaacuucugagcucaagagaugcacuccccucagccucccaaagugcugggauua

SEQ ID NO: 116667 - RNA, 64 nt, Human
gggcaucccuggucaacccucaaacauuccggacuccccucauaacaauagacacaugugccca

SEQ ID NO: 116668 - RNA, 64 nt, Human
cccucucuacagguccguuuccuuacacauuuuauccccucagaacacgauaaaccauggccaa

SEQ ID NO: 116669 - RNA, 64 nt, Human
augcccuucugauuccccuccaccaaaccccacuuccccucauaaguuuguuuaaacacuuauc

SEQ ID NO: 116670 - RNA, 64 nt, Human
gcuggcccuucucccaugcaggguccagguccucuccccucauuuccaucucccagcccccagg

SEQ ID NO: 116671 - RNA, 64 nt, Human
ccagagcuccucuuccuuuaccaggcaaggugcauccccucagcccuccuggcccuucagucuu

SEQ ID NO: 116672 - RNA, 64 nt, Human
ggccacgaacccggccagcccugacgccccacuguccccucacagcccucagcucuacucccgg

SEQ ID NO: 116673 - RNA, 64 nt, Human
gcccugggcuuugccugguuugcgggagauuuccuccccucagucaacccccauaaccugggga

SEQ ID NO: 116674 - RNA, 64 nt, Human
ggcugauaacaguguuguugauucugauugugaauccccucaacucuagcagacacauacacac

SEQ ID NO: 116675 - RNA, 64 nt, Human
cucaugcugugaaucccccccauucuaccacuucuccccucaucacuggcuugcuguaggauca

SEQ ID NO: 116676 - RNA, 64 nt, Human
uagggauuuaaaggaaaaaaaaaaagaauucuguuccccucauaucaugaacacaguaacugau

SEQ ID NO: 116677 - RNA, 64 nt, Human
uuuuuuucuucuucagccuccaucccuggccuccuccccucacacacacuggacuugguacaaa

SEQ ID NO: 116678 - RNA, 64 nt, Human
cucucaccuuuucucugggacuuaagcugcuauauccccucagagcucacaaaugccuuuacau

SEQ ID NO: 116679 - RNA, 64 nt, Human
gcuagguaaggcuggggggaggguggggccgugguccccucagccuccauggggagggaagaag

SEQ ID NO: 116680 - RNA, 64 nt, Human
ccagguaaagagagagagccagcccagcccuguuuccccucaguccuccuuugcuccugcugcu

SEQ ID NO: 116681 - RNA, 64 nt, Human
ucaccgagugggggcaucaucaaaaacuuuggaguccccucaccuccucuaagguugggcaggg

SEQ ID NO: 116682 - RNA, 64 nt, Human
gugucaggggcagcugagcaagacagcaguuguauccccucaccuuccucccgucccaccccag

SEQ ID NO: 116683 - RNA, 64 nt, Human
agagaggaagcaacucuccuucugguugucugccuccccucagauuuccugauaggcugauggc

SEQ ID NO: 116684 - RNA, 64 nt, Human
uccgacuggggcucccugaggacagggcugugucuccccucagccuggggcucccugagucagg

SEQ ID NO: 116685 - RNA, 64 nt, Human
cucagccuggggcucccugagucagggcugugucuccccucagacuggggcucccugaggacgg

SEQ ID NO: 116686 - RNA, 64 nt, Human
ucaaaguggggcucccucaggacagcguugugucuccccucagacugcggcucccugaggacgg

SEQ ID NO: 116687 - RNA, 64 nt, Human
augaguucugcaaaaaaagccuaauauucugugguccccucacucagucucucauuugguaaac

SEQ ID NO: 116688 - RNA, 64 nt, Human
cagcucugcaaagcucucucgacagcaaaugguuuccccucaccucuggaauuaaagaaggaac

SEQ ID NO: 116689 - RNA, 64 nt, Human
acuucugagaccuuguuucaaucuuugcuguauauccccucaaaauccaaguuauuaaucuuau

SEQ ID NO: 116690 - RNA, 64 nt, Human
auauguuaacaccuagguguucccaauaccuuuuuccccucaugucacuacugaauuuugacag

SEQ ID NO: 116691 - RNA, 64 nt, Human
gggucucuuggcugcucuuucuccaggugucagguccccucauugcucuucucagguggccaca

SEQ ID NO: 116692 - RNA, 64 nt, Human
aucccccuucucaccacuguuccucuugcacguuuccccucauucauguggcuguacuuaaccu

SEQ ID NO: 116693 - RNA, 64 nt, Human
gaagcauccuaggaugccucuacauguauuucauuccccucaucuucaaacaucauuauuauuc

SEQ ID NO: 116694 - RNA, 64 nt, Human
ucccauccucagcccugaacuagcuaccaucugauccccucagacauucucaggauuuuacaag

SEQ ID NO: 116695 - RNA, 64 nt, Human
agggccacccccgcugaugacuccuugcauucccuccccucacaacaaagaacuccacuguggg

SEQ ID NO: 116696 - RNA, 64 nt, Human
gcccagggaggguaucaguaucauucauucucucuccccucacugguauggguucagagcaaug

SEQ ID NO: 116697 - RNA, 64 nt, Human
ugccaacaauuaucucugaauucccuauccaggcuccccucauuucaccuucagcauauauucu

SEQ ID NO: 116698 - RNA, 64 nt, Human
uucuacaacauuuacguucuuuucucaccuuugauccccucacuccucugugacccccuucaag

SEQ ID NO: 116699 - RNA, 64 nt, Human
ggcugcuccgacaggggagacuugucucccuuguuccccucaggauccauagaguggacaguaa

SEQ ID NO: 116700 - RNA, 64 nt, Human
uagagcugggauugguggagggagcaggugccaguccccucacucucugggagcugugaaaggg

SEQ ID NO: 116701 - RNA, 64 nt, Human
uuuuguguuuuaucuuuuguuuuuccaucuguacuccccucauccuccuaauguugagaaaauc

SEQ ID NO: 116702 - RNA, 64 nt, Human
cccccgaguucaguuucuaggagccaaugaaacuuccccucaccuccucaucuuuccaaguugu

SEQ ID NO: 116703 - RNA, 64 nt, Human
gagauugugugcuaggaacagccuucccuccguuuccccucagucaaacuugagccagccucug

SEQ ID NO: 116704 - RNA, 64 nt, Human
uauacuguagaaaaacccaggagugagagggauuuccccucauaguacaacuggaaggauagug

SEQ ID NO: 116705 - RNA, 64 nt, Human
ugaaacauacccccuauuuuacagagcucuuuuuuccccucauaaccuuguuuuugguagaaaa

SEQ ID NO: 116706 - RNA, 64 nt, Human
caagucagcaagcaaucagguaaugaugugcgaguccccucagguuauagaaauuauguuguau

SEQ ID NO: 116707 - RNA, 64 nt, Human
accuucugaaccuucuucaaacaguaguacaagcuccccucagccagccugccugcccagcgag

SEQ ID NO: 116708 - RNA, 64 nt, Human
aacugcgcucccccaaccccucgcccugccaucuuccccucaagccugcuaaguuaucccaggc

SEQ ID NO: 116709 - RNA, 64 nt, Human
aucgaugccuccuuucugggacucccggcacaacuccccucauccagggagggaggcagcugcu

SEQ ID NO: 116710 - RNA, 64 nt, Human
gcuuggcuagguaguucuguguggcgguggucauuccccucauuaaacaccaguucuuggugac

SEQ ID NO: 116711 - RNA, 64 nt, Human
gcuccaccucacccagagcaccucccagccaccguccccucaagagcccccagaacgagacccu

SEQ ID NO: 116712 - RNA, 64 nt, Human
ugcuagcacuuccaaacaagcucagagauguuccuccccucaucugcccggguucaguaccaug

SEQ ID NO: 116713 - RNA, 64 nt, Human
uccuucuggcugcaggugcagacccaaacuuagauccccucaacugucuacuuguugcagugag

SEQ ID NO: 116714 - RNA, 64 nt, Human
guuuagcagggcguacugcgguuggugacggggguccccucagucacacucacuuuuuuccuug

SEQ ID NO: 116715 - RNA, 64 nt, Human
ucuacuucugugucugucaccacaucuugucuuuuccccucauugcauuuauugcaguuuauau

SEQ ID NO: 116716 - RNA, 64 nt, Human
ccaaccuggagcaguuccccaacuacaccccgccuccccucaucugcucuaguggugaccuggc

SEQ ID NO: 116717 - RNA, 64 nt, Human
acgugggaaaggaaugguaugugggggaaaugcauccccucagaggacugaggcauagucucuc

SEQ ID NO: 116718 - RNA, 64 nt, Human
agcucuccagggccgcgucuugccucgccucgccuccccucaccuugccucaccucgcagcagc

SEQ ID NO: 116719 - RNA, 64 nt, Human
cauguaaugauagggaacaggaccccagucccuuuccccucagccaaggguguauuuguaaacu

SEQ ID NO: 116720 - RNA, 64 nt, Human
agcacccacagagaggcaaugggugagacaggaauccccucacagugggcgacagaucugaagu

SEQ ID NO: 116721 - RNA, 64 nt, Human
uaggccucuucccugucccugucuccaguuccucuccccucaggaggccaccucaggaaggauu

SEQ ID NO: 116722 - RNA, 64 nt, Human
gucaucagucaucaggugugcucaggggacaaucuccccucaaccgcacaugugccacuguuca

SEQ ID NO: 116723 - RNA, 64 nt, Human
agauuauugugcaugcugaaaagaguaugaaaaauccccucagcaggcauaggauagaaacgua

SEQ ID NO: 116724 - RNA, 64 nt, Human
uuuuauuuugcaugaguuugguaacugauuacucuccccucaaagaaaagacauucagguguuu

SEQ ID NO: 116725 - RNA, 64 nt, Human
aagagugaagcuaauucuuuggucaauguucuuuuccccucagugucuaguuuaaggcuuuuag

SEQ ID NO: 116726 - RNA, 64 nt, Human
cagggccaucugagccagaagaagacggucaccauccccucaggcagcacccucgcauuccggg

SEQ ID NO: 116727 - RNA, 64 nt, Human
ccgugaaucccagcucacccauggacagaagaccuccccucaucugaaagccuuucugccuucc

SEQ ID NO: 116728 - RNA, 64 nt, Human
aaaagugaauuaucuuuauuuuaaaauguauguuuccccucacuguuugcagcucccaauguug

SEQ ID NO: 116729 - RNA, 64 nt, Human
gaacacuguuguaguuuagaaggcuuuucauaaauccccucauaggcaaagaugaaaacuuccc

SEQ ID NO: 116730 - RNA, 64 nt, Human
agucacccuuccaccauuguccuagcuacuugguuccccucagaaaaaaauucaugauacucau

SEQ ID NO: 116731 - RNA, 64 nt, Human
acuaaucucacuuggcacauuauaacuaaaggaauccccucaauucaaaagcauagauggauac

SEQ ID NO: 116732 - RNA, 64 nt, Human
uggugguaauccugugauuuuuuuuucucccccauccccucacuggcccaucccucucacccuc

SEQ ID NO: 116733 - RNA, 64 nt, Human
ucuugcugccagacugaaagcaaaaggaauuauuuccccucaaguuuucuaagugauuuccaaa

SEQ ID NO: 116734 - RNA, 64 nt, Human
uuccuuauccaugccuguacauagcauguccuccuccccucagcuuugcuaauaccaguccccu

SEQ ID NO: 116735 - RNA, 64 nt, Human
ugucucccuuugcugggaauucugcaccaaugucuccccucaacccauucccugguugguccua

SEQ ID NO: 116736 - RNA, 64 nt, Human
ugccaaauugauuacuggauccagaacacaauuuuccccucagaacagauagacagacugaagc

SEQ ID NO: 116737 - RNA, 64 nt, Human
guaccacacacucuggaaugcuuuaguuuccuuuuccccucaagaugucugagucagcuaggau

SEQ ID NO: 116738 - RNA, 64 nt, Human
gcagggccagggcagggaggcuuccagccuguguuccccucacuuggaggaaccagcacucucc

SEQ ID NO: 116739 - RNA, 64 nt, Human
gggacuugaauccccauccuagcuucucucuccuuccccucaagaccugaucugguuuuaaggg

SEQ ID NO: 116740 - RNA, 64 nt, Human
aagcagggaguaaggcuggacuccaauggcccauuccccucaccccagcccaagacgugggagg

SEQ ID NO: 116741 - RNA, 64 nt, Human
ggcuccauggggagguuuagaaccaaaccacaaguccccucaaggacaaccacuauuucuauau

SEQ ID NO: 116742 - RNA, 64 nt, Human
acacaaaaggacaguucuguguugaaacaccccauccccucacguucucaccccaggcccagaa

SEQ ID NO: 116743 - RNA, 64 nt, Human
gucaccaagagaagugacuucccaggagcaccaguccccucacagaggugcugugagcgaggcc

SEQ ID NO: 116744 - RNA, 64 nt, Human
cauccagcucuggcacgcugauaccuccagguacuccccucacugucaaagcuggggcucagcc

SEQ ID NO: 116745 - RNA, 64 nt, Human
ggaucuuggauggugacauugaaacuacacuaaauccccucacuaugaauggguuguuaaaggc

SEQ ID NO: 116746 - RNA, 64 nt, Human
aagccccucccuuccuguccuucuguggccuccauccccucaugggugcugccauccuuccugg

SEQ ID NO: 116747 - RNA, 64 nt, Human
cuuuauucuuugcuuggcuuugguaacuaggugguccccucaagcauccucaguuccucuugcu

SEQ ID NO: 116748 - RNA, 64 nt, Human
uuuuugucagaugacacugguggcuccccuuuucuccccucacaguuucuuguuucgagugcug

SEQ ID NO: 116749 - RNA, 64 nt, Human
cuguugagcagcauaauaaucccgggagaaugauuccccucauagaaagacaaaagcauccauc

SEQ ID NO: 116750 - RNA, 64 nt, Human
aaugauuccccucauagaaagacaaaagcauccauccccucauaguuaaguagccacugguguc

SEQ ID NO: 116751 - RNA, 64 nt, Human
ugaaauacguguaucauggagaaugagguauccauccccucaagcauuuuuccuuugaauuaca

SEQ ID NO: 116752 - RNA, 64 nt, Human
cuuucugcucugccaucuucaggauauugguucuuccccucauaguaauaagauggcuguggca

SEQ ID NO: 116753 - RNA, 64 nt, Human
ucucagucagaagagacccccuguguggccugaguccccucaggaggaagguggacaacagaga

SEQ ID NO: 116754 - RNA, 64 nt, Human
aguagcauugcaguagucuacuuuuacaacgcuuuccccucauucuugaugugguguaauugaa

SEQ ID NO: 116755 - RNA, 64 nt, Human
gcccccacacugccuuucgcccuacugagacugguccccucaaaagguagacaaaacagcagcu

SEQ ID NO: 116756 - RNA, 64 nt, Human
ggugcaacuccugccuccaucccccuugcugggguccccucauccacuugagggcgccugaggg

SEQ ID NO: 116757 - RNA, 64 nt, Human
uccuccaaagucacacagagugccugccuccugguccccucagcucugccucugcagcccacug

SEQ ID NO: 116758 - RNA, 64 nt, Human
gucuaaacccugagaagguggcagugaggaaguauccccucaggugacuggaucuguguuccuc

SEQ ID NO: 116759 - RNA, 64 nt, Human
ugggcccugccccacccacuccaggauguuaggguccccucagccaaaaaggcagcugccugug

SEQ ID NO: 116760 - RNA, 64 nt, Human
ucauacacuuggcauguuucauucccaucuccuuuccccucaccuuaaaggagacuaccccuuu

SEQ ID NO: 116761 - RNA, 64 nt, Human
uggagcaaagucggaaacacagagaagcacggcuuccccucagcacagacccuccagacugggu

SEQ ID NO: 116762 - RNA, 64 nt, Human
acaagccaccggcauccuguaucagcuuccagccuccccucaggcuuuccagucaccagggaca

SEQ ID NO: 116763 - RNA, 64 nt, Human
gggagagcgggucuucuccccccucccucuccaguccccucacaaucccagauggguucuaaug

SEQ ID NO: 116764 - RNA, 64 nt, Human
ucucccucuccacucccagaagaccaaacugccuuccccucagggcucaagaauguguacaguc

SEQ ID NO: 116765 - RNA, 64 nt, Human
caaucacuuacugugcggguuugacucagucccuuccccucacuaggucccaguuucuccauuu

SEQ ID NO: 116766 - RNA, 64 nt, Human
ugggcccugggaucuggaaccaacacaccccuguuccccucagcuuucccuccucgcuggccug

SEQ ID NO: 116767 - RNA, 64 nt, Human
agccccugcccacccugacagagggagcugggccuccccucauccucuguaacucccgccuuca

SEQ ID NO: 116768 - RNA, 64 nt, Human
agaaggucagcccacucccagggccccacucuccuccccucauuaaaccauccaccugacacca

SEQ ID NO: 116769 - RNA, 64 nt, Human
cugugcaaguaagcaucuuacaacuggcucuuccuccccucacuaagaagacccaaaccucugc

SEQ ID NO: 116770 - RNA, 64 nt, Human
cucuaggcccugagguacaggaaccggagaaacguccccucaccccaucccucagccagugaca

SEQ ID NO: 116771 - RNA, 51 nt, Human
auaaggaguucaaguuuuagguccccucacacuagcccuuuuuuuggcccu

SEQ ID NO: 116772 - RNA, 64 nt, Human
ccugcccuguguugggcaccgugacaggcugcccuccccucacaguuccugcaccucagcagcc

SEQ ID NO: 116773 - RNA, 64 nt, Human
gcuaaaucugcgcuucucccuggugccagcagguuccccucacagucaaugcagugguauagca

SEQ ID NO: 116774 - RNA, 64 nt, Human
gaggaagauuuuuaacaaaagccuccagaagauuuccccucaguuuccauugacuuagaucagg

SEQ ID NO: 116775 - RNA, 64 nt, Human
uuuguuugaaguacugcaaaauuauauuguaacuuccccucaccccaguugcaauugugucaua

SEQ ID NO: 116776 - RNA, 64 nt, Human
gaaaaaggaggauaugauggucacauggggaaccuccccucaucgggccucuggggcaggaagc

SEQ ID NO: 116777 - RNA, 64 nt, Human
gacgauuaguucuaaaaucuuauuccuccucuucuccccucacuuuucccuacuuccucugcaa

SEQ ID NO: 116778 - RNA, 64 nt, Human
ucuccaaaggcacugacccucggccucuacuuuguccccucaccuccacccccuccugucaccg

SEQ ID NO: 116779 - RNA, 64 nt, Human
gguaagggccaggagaagaggccuuucugcuguguccccucacggccuugcccucgaauucugc

SEQ ID NO: 116780 - RNA, 64 nt, Human
caggaaauaaguagaaacauuucagcaggccaccuccccucaucuuccccgcccuguccagcgc

SEQ ID NO: 116781 - RNA, 64 nt, Human
uggcuacgggguggugauguuccucuuccagcuguccccucagcuaaggggcuuaguuuccaug

SEQ ID NO: 116782 - RNA, 64 nt, Human
gcagcagguguucauauccuugauuuugagaauuuccccucaaguauguggcaguaaauacaac

SEQ ID NO: 116783 - RNA, 64 nt, Human
auaggcuacugaaagaaggauucugcauuucuauuccccucagccuacccacugaagucuuugg

SEQ ID NO: 116784 - RNA, 64 nt, Human
ggcucccaagagcuccugguggugcagccugugcuccccucagaagcucugcucuucccagggc

SEQ ID NO: 116785 - RNA, 64 nt, Human
gguggguggggugggguggggcaagugccccaacuccccucaccaggagaggcaccugcuuggu

SEQ ID NO: 116786 - RNA, 64 nt, Human
gccccuuggcuguggcauggcaacugacuuaccuuccccucaugccgcucccaucucuacccag

SEQ ID NO: 116787 - RNA, 64 nt, Human
gaaaagacaacaaaaauaucuucauacuuccucauccccucauuggaacaaaaccuuaaacugg

SEQ ID NO: 116788 - RNA, 64 nt, Human
cacucuaggcccaagggcuaguccucuuccccaguccccucagaggcccccgccagccccaccu

SEQ ID NO: 116789 - RNA, 64 nt, Human
cuguucagcaccuuuuagcucuauacucucuggcuccccucauccucauggucacugaauuaaa

SEQ ID NO: 116790 - RNA, 64 nt, Human
ccuaccacuucucugcugagaaccuuccagugguuccccucaccuucugcagaagucuccaaua

SEQ ID NO: 116791 - RNA, 64 nt, Human
uuuucuggggcaccuauuccucugccaguccugcuccccucaccuuccuugggcccgucagagu

SEQ ID NO: 116792 - RNA, 64 nt, Human
aauguugcaaauacgauaaccuuaacaaaguucuuccccucaauguugggauggccugggucgc

SEQ ID NO: 116793 - RNA, 64 nt, Human
acauuagaaauauauaauggagcaauuguggauuuccccucaaaucagaugccucuaaggacuu

SEQ ID NO: 116794 - RNA, 64 nt, Human
caguuuccccucucggccagguugugucccaaaauccccucagccucuucucugcacguugcug

SEQ ID NO: 116795 - RNA, 64 nt, Human
ccauccucucccuucuuacaccgugaggccaagauccccucagaaggcaggagugcugcccucu

SEQ ID NO: 116796 - RNA, 64 nt, Human
caacagugccauguuaggguuauguuuuuaggauuccccucaaugcagucaguguuucuuuuaa

SEQ ID NO: 116797 - RNA, 64 nt, Human
uauaguuuggaguuuggcuucaucuuccugggguuccccucacucccuuuuuugucaaccccau

SEQ ID NO: 116798 - RNA, 64 nt, Human
caggagcccccccauggaacugcagcccccugucuccccucagcagucugagugcaaccccguu

SEQ ID NO: 116799 - RNA, 64 nt, Human
aggguucccgcggggcugucggcgcugccccaucuccccucagcucggcucagcucgguacccg

SEQ ID NO: 116800 - RNA, 64 nt, Human
cucacaccccugcccccaccccaugcccccacccuccccucacacacaaauugacucuuauuua

SEQ ID NO: 116801 - RNA, 64 nt, Human
ggaacuuaugacuugggccucuaggcugucucuguccccucagcuccccgacaugcauuuacuc

SEQ ID NO: 116802 - RNA, 64 nt, Human
aacuguggcucuguaacucuucaaaggcccaguuuccccucacgcagccucuuagguagcguuu

SEQ ID NO: 116803 - RNA, 64 nt, Human
ccaagaucccuagcagaagauuuagccauguccuuccccucacuugugugaguggccccuucug

SEQ ID NO: 116804 - RNA, 64 nt, Human
gugacugcugccuccccccacaagaacucccuucuccccucagccaaugaaucaaugugcuccu

SEQ ID NO: 116805 - RNA, 57 nt, Human
ugcacguguucaaguccugaaacaggcuccccucaccaggacagucacccccaaacu

SEQ ID NO: 116806 - RNA, 64 nt, Human
ccagggaagagaaagugauuucuagaaagccuguuccccucacuggaugaaauaacuccuucuu

SEQ ID NO: 116807 - RNA, 64 nt, Human
ucugaacucagucuucuuuaccucauuaucaccuuccccucacacuccuaaaauugcaugaaag

SEQ ID NO: 116808 - RNA, 64 nt, Human
ggagaaaacacuuguaaguugcuaaacgagucaauccccucauucaggaaaacugacagaggag

SEQ ID NO: 116809 - RNA, 64 nt, Human
uguccuggggcauuuggaagggacuggaccucuuuccccucaucaaaggaaacagcagucuuug

SEQ ID NO: 116810 - RNA, 64 nt, Human
guagcuagggguugguuaucaucagaagguggucuccccucaggccugggggauaaggacgugg

SEQ ID NO: 116811 - RNA, 64 nt, Human
cuaccuguuccugaggccucauuuagaaagaaaauccccucagaaggcugucuggcacccagug

SEQ ID NO: 116812 - RNA, 64 nt, Human
aggucugcauuuagacggaaacagaaauugcuuuuccccucacuguuccugaaugcucuauacu

SEQ ID NO: 116813 - RNA, 64 nt, Human
auucaguaauuuuucuucuuuauugacgaauuccuccccucacaaaacuguucuuucccaccuc

SEQ ID NO: 116814 - RNA, 64 nt, Human
cucacuguccuuccaguguuggccucuggccucuuccccucacauuuauguucauucuccgggc

SEQ ID NO: 116815 - RNA, 64 nt, Human
uguggcgaaguugccggcuggacagggaagcgguuccccucagcagccccucuccuucucgugc

SEQ ID NO: 116816 - RNA, 64 nt, Human
gggggaggccgaaagguagggcggggacuggagauccccucauuaaaagaacagugaugauggu

SEQ ID NO: 116817 - RNA, 64 nt, Human
cgggggugaggggcuccccccuccccuguuucuguccccucagacaccguuacuguaagcuugc

SEQ ID NO: 116818 - RNA, 64 nt, Human
cuucuauaauuguauauaugccuuugauguauuuuccccucaagauuaucaacuguguguucga

SEQ ID NO: 116819 - RNA, 64 nt, Human
aaaaugcaucugagcaagucagccagccccgaaguccccucagugugugugucucgaguggcua

SEQ ID NO: 116820 - RNA, 64 nt, Human
agcuccucgagggaccaaaucuccaacuuuuuuuuccccucacuagcaccuggaaugaugcuuu

SEQ ID NO: 116821 - RNA, 64 nt, Human
gccaaacgugcccugagcccucuccuccaagagguccccucagcaucaagcagcccaaccaagg

SEQ ID NO: 116822 - RNA, 64 nt, Human
cugcguccccacguccccucgucccauccccacguccccucaucccgucaccucguccccacau

SEQ ID NO: 116823 - RNA, 64 nt, Human
cuucaccauuuugaguugagcuuuagcaaaaguuuccccucauaauucuuugcucuuguuucag

SEQ ID NO: 116824 - RNA, 64 nt, Human
uccgcaccacuccccuacacccagagcauucucuuccccucaucucuuggggcuguuccugguu

SEQ ID NO: 116825 - RNA, 64 nt, Human
cuaacggaguccacuccugggcccacugugccucuccccucagugucccuucugacagugacuc

SEQ ID NO: 116826 - RNA, 64 nt, Human
cauguuggagguuggggaagaaccugggcauccuuccccucaagccugggcucauggagccccu

SEQ ID NO: 116827 - RNA, 64 nt, Human
auucauucuuuuguuuuuaauaacuaaaguuuuuuccccucauuauuaaaaugaauuuaccagu

SEQ ID NO: 116828 - RNA, 64 nt, Human
cccagccucagaagccuucuugcugcccacaacguccccucaagccccuucucucaaucccuuu

SEQ ID NO: 116829 - RNA, 64 nt, Human
aucaugcaggaacugaaaaccagucuucucccuguccccucaugggucccggguuagccuggug

SEQ ID NO: 116830 - RNA, 64 nt, Human
aucugccuuccugcugaaacuuguuccaccucaguccccucaucugucacacgcauguggggug

SEQ ID NO: 116831 - RNA, 64 nt, Human
agcccaacuuccugugaggcccucccggggcgccuccccucacccccaggcgcacgucuggccc

SEQ ID NO: 116832 - RNA, 64 nt, Human
ccugauaacaaccuggagaccaggauuuuauggcuccccucacugauggacaaggaggucugug

SEQ ID NO: 116833 - RNA, 64 nt, Human
ucugacuuuaccuugagaucugucuucauacccuuccccucaaacuaacaaaaacauuuccaau

SEQ ID NO: 116834 - RNA, 64 nt, Human
aaguuuggauaccacuagcuauauuuugcuuuuuuccccucacauugaauuuuaauuccauucu

SEQ ID NO: 116835 - RNA, 64 nt, Human
ugggggcuuuugccacuccuugucccccgugaucuccccucacacuuugccauuugcuuguacu

SEQ ID NO: 116836 - RNA, 64 nt, Human
gagggccccucccccaacccaacucgacccucccuccccucacccccaagguguagaauuguga

SEQ ID NO: 116837 - RNA, 64 nt, Human
acuacaaccuugugcugguaagguccuagcaucuuccccucaccuuccacccaugagaacagcg

SEQ ID NO: 116838 - RNA, 64 nt, Human
aguggcuuuuccuccaggaaggggcuucuggguguccccucauccccaguagccucuuucuugc

SEQ ID NO: 116839 - RNA, 64 nt, Human
cuucuuccaauuaaaacccccaccgugggcugucuccccucauuucauuuuucuaaaggggcag

SEQ ID NO: 116840 - RNA, 64 nt, Human
ggcauuggggggccgggcagguccugcccauguguccccucacucugucagccagccgcccugg

SEQ ID NO: 116841 - RNA, 64 nt, Human
ugugagcagggaccugccugccccuuucaaccuuuccccucaccuuuuuugagauuuuugcugc

SEQ ID NO: 116842 - RNA, 64 nt, Human
gguacaauguccuacccacaacuccucugccgccuccccucaugccucaccgugucucaggaga

SEQ ID NO: 116843 - RNA, 64 nt, Human
cagccccuuucccugccaccccaggagccaggcuuccccucagcugggugaagacuacagacuc

SEQ ID NO: 116844 - RNA, 64 nt, Human
ggcacgcuccagcagcccuccucuggaagcugcguccccucacccccuguuucaggucucccau

SEQ ID NO: 116845 - RNA, 64 nt, Human
cuuccacaauguugugacugauuauaacccuguuuccccucagagaagagcuauggcucaggga

SEQ ID NO: 116846 - RNA, 64 nt, Human
gccccggugcuggcaucugguggagcggacccacuccccucacauuccacaggcccauggacuc

SEQ ID NO: 116847 - RNA, 64 nt, Human
gaccaucccuguguuuggaguggauaauugucccuccccucagcccugcaccagaggucucaua

SEQ ID NO: 116848 - RNA, 64 nt, Human
gccuccauuccuggagcccgaggcaccaguguccuccccucaaggacaaagucuccagcccacg

SEQ ID NO: 116849 - RNA, 64 nt, Human
auaagccagauguuuuuaaaagcauauguguguuuccccucauggugacgugaggcaggagcag

SEQ ID NO: 116850 - RNA, 64 nt, Human
ucgccccgccccugcagugugaaugugugaaacauccccucaggcugaagccccccacccccac

SEQ ID NO: 116851 - RNA, 64 nt, Human
gaaucuaaauaugacauaaguauuuguggcuguguccccucacuuguccaagaccaaagcucca

SEQ ID NO: 116852 - RNA, 64 nt, Human
caguggggagcugacagcugugagcacaccacuguccccucauccaccucggccugcauggggc

SEQ ID NO: 116853 - RNA, 64 nt, Human
uggugagugagaaaaggcuggggcgugugauccauccccucacguuucagaacuuccaggcuuu

SEQ ID NO: 116854 - RNA, 64 nt, Human
ugaaaccaaauggacucagcccucucccacauuuuccccucacccuccaaguccuaaccccucc

SEQ ID NO: 116855 - RNA, 64 nt, Human
cugcaaggguaggggacaagauguaggcuccagcuccccucagaccuccucaucucaugagcuu

SEQ ID NO: 116856 - RNA, 64 nt, Human
ucgcacucuugucuucuggucacaccucacuauguccccucagcuccuaucucuguauggccug

SEQ ID NO: 116857 - RNA, 64 nt, Human
uuaccuaugugucgugucugcuuacauuuccuucuccccucaggcuuuuuuugggugguccucc

SEQ ID NO: 116858 - RNA, 64 nt, Human
gcuugagagccacagacgccuggcuucuccggccuccccucaccgcacaguucuggccacagcu

SEQ ID NO: 116859 - RNA, 64 nt, Human
aauuaagacugcauuaugaaagucaacagcucuuuccccucagcucuucuccuggaaugacugg

SEQ ID NO: 116860 - RNA, 64 nt, Human
uuuccccucagcucuucuccuggaaugacuggcuuccccucaaauuggcacugagauuugcuac

SEQ ID NO: 116861 - RNA, 64 nt, Human
aaguuugagagaagaaugaaucaacugcuauccuuccccucaccccucagcccaggagggaaag

SEQ ID NO: 116862 - RNA, 64 nt, Human
gagcggaugggcacacacacccgcccuguguguguccccucacgcaagugccagggcugggccc

SEQ ID NO: 116863 - RNA, 64 nt, Human
ucacuuuguggccugugggugaggugacaucucauccccucacugaagcaacagcaucccaagg

SEQ ID NO: 116864 - RNA, 64 nt, Human
aggagacccuccccugccuccgaggccuaccugcuccccucaaaagcuucgugccaacagagag

SEQ ID NO: 116865 - RNA, 64 nt, Human
cauuuuguaucauguauggucugugucuccccaguccccucagaaccaugcccauggaugguga

SEQ ID NO: 116866 - RNA, 64 nt, Human
cuccuuuacagaccuguguuccugaaugcacucauccccucaaaguggggaccugucccaagga

SEQ ID NO: 116867 - RNA, 64 nt, Human
cccggaagaauccucuucauucauugcuagugcuuccccucaccucccacucuccacuucccag

SEQ ID NO: 116868 - RNA, 64 nt, Human
uauauggcuuaugacauacucuguaucaaugagauccccucacccucaccccauccuuccccac

SEQ ID NO: 116869 - RNA, 64 nt, Human
gaggcgagaguggaggcucuucuucugccccgucuccccucaaagaugagaaacauguucagaa

SEQ ID NO: 116870 - RNA, 64 nt, Human
ugaaaaaguaaaguguuauugaaugugugggguuuccccucaggaauuugucuaacacauuuca

SEQ ID NO: 116871 - RNA, 64 nt, Human
ggugacucugucggggaagaauccggucacagccuccccucagagacaggccucaguucgaggg

SEQ ID NO: 116872 - RNA, 64 nt, Human
ugucaaugggggauugucccagccccucuucccuuccccucaccuggaagcuucuucaaccaau

SEQ ID NO: 116873 - RNA, 64 nt, Human
aagcuguggccuuggugaagcugcccuccucuucuccccucacacuacagcccuggugggggag

SEQ ID NO: 116874 - RNA, 64 nt, Human
uucagccccccuucugaccucucauaccaaccacuccccucagucugccaaaaaugggggccuu

SEQ ID NO: 116875 - RNA, 64 nt, Human
uggggcagguggagggagcagucuucguucuuccuccccucaguggcaguuuggucuucaccug

SEQ ID NO: 116876 - RNA, 64 nt, Human
ccugccguacgugccauuccacucucuucagcucuccccucaacagcaugcgagcccauaccuu

SEQ ID NO: 116877 - RNA, 64 nt, Human
ucauggggaucccgaggccccaagaggggcagauuccccucacagcugcacagcagcucggugc

SEQ ID NO: 116878 - RNA, 64 nt, Human
ugaguagagauggggaacaagaacccagaugcuguccccucacccccucuccuguauuucucag

SEQ ID NO: 116879 - RNA, 64 nt, Human
acuucauacauccaucuaaauggauaccuuuccauccccucaaacgagaacaaaaaguauuccc

SEQ ID NO: 116880 - RNA, 64 nt, Human
ugaugaggcugcuggaagcuuugaagucucccauuccccucaugcuauaaaaagaacuaccuuu

SEQ ID NO: 116881 - RNA, 64 nt, Human
caaccaggggagccacuaagcugacuaacaacuguccccucacccaccagcuauuuccccaggg

SEQ ID NO: 116882 - RNA, 64 nt, Human
uuggccugugggccucaccugccccucuguucucuccccucacauccuccugcccagcuccuca

SEQ ID NO: 116883 - RNA, 64 nt, Human
uccuuaccccgcaggacgggccuacaggggggucuccccucaccccugcacccccagcuggggg

SEQ ID NO: 116884 - RNA, 64 nt, Human
uucuggccaucucagggaggggccaccagguuccuccccucaccccauauuccaucaccuuccu

SEQ ID NO: 116885 - RNA, 64 nt, Human
ccuuuccaugugggucaaacuaaaauuagaaauguccccucacugcagaucaaauguaaagcuu

SEQ ID NO: 116886 - RNA, 64 nt, Human
cugaacauuuaguacccugcaggccaggccagcuuccccucacuuaaccaccccauaccaguca

SEQ ID NO: 116887 - RNA, 64 nt, Human
gcugaacuauuagagcugccugugccuuuugccauccccucaacccagcuaugguucucucgca

SEQ ID NO: 116888 - RNA, 64 nt, Human
uccuucugaagccccuuggcucugccuuggcccuuccccucaccacgagcucccggccugccca

SEQ ID NO: 116889 - RNA, 64 nt, Human
ucuagccuccugguucggaaugucaacuaugagauccccucacugaagaagcagauugccaagu

SEQ ID NO: 116890 - RNA, 64 nt, Human
uugaacuauaagaaaguaauaauuccauuuucuauccccucagggacugaacaaauggaaauaa

SEQ ID NO: 116891 - RNA, 64 nt, Human
uugugucuguguccuuguuuaauaucuuaagacuuccccucaacaugcugccccaguuaaucag

SEQ ID NO: 116892 - RNA, 64 nt, Human
ucgugaccaccagcuugcucagauauucuccuccuccccucacuggccccacaccccuggcucu

SEQ ID NO: 116893 - RNA, 64 nt, Human
ccugacucuguugaucuacccgugccugggccccuccccucagagcccaugguaacgaaccccu

SEQ ID NO: 116894 - RNA, 64 nt, Human
ugccuuaagaucaaacuaacaagaucugacccucuccccucacagugagccacugccccacuuc

SEQ ID NO: 116895 - RNA, 64 nt, Human
gccaccgcacccaauccuauuagguuucuuugaauccccucauggccugccugguuuuugcuca

SEQ ID NO: 116896 - RNA, 64 nt, Human
ggcccugcucccagauggcggucuccuggcagccuccccucagucuuccuccacccgcucuucc

SEQ ID NO: 116897 - RNA, 64 nt, Human
uuguuucuucuccuucccccucccccuaccuccuuccccucacuccuccccuccuucgcucgcu

SEQ ID NO: 116898 - RNA, 64 nt, Human
uccgucuagcuuccucuucaggaaauguccugacuccccucagcucccccuucaccccuccuug

SEQ ID NO: 116899 - RNA, 64 nt, Human
ggggcaguuagagcagccucguggagcucgccccuccccucagccugcccaccucucccugcau

SEQ ID NO: 116900 - RNA, 64 nt, Human
cuucugcuccagccccuuugccucuguccucccauccccucaacacccugcuucucccggggac

SEQ ID NO: 116901 - RNA, 64 nt, Human
ucgcaauagauaacauugccaucgcccccaccaguccccucaugccucugggcaguccaaccac

SEQ ID NO: 116902 - RNA, 64 nt, Human
auccuuaccuguauucccaucuccccagugucacuccccucaccaaucacuccagaugguuuug

SEQ ID NO: 116903 - RNA, 64 nt, Human
aguccauuuuuggaggucacucuuuccccccucauccccucaccuccuucucuuuacccccuuc

SEQ ID NO: 116904 - RNA, 64 nt, Human
agccaugaccugcagggcccagagacacuguccuuccccucauccacccaaggccccagccagc

SEQ ID NO: 116905 - RNA, 64 nt, Human
ugcgcugggggagggaagcgugccuccccaccccuccccucacggggaagguuuccuuuccucg

SEQ ID NO: 116906 - RNA, 64 nt, Human
guuucugcuugcucuuguccuagcuugggaggcuuccccucacuauccuaccccacccgcuccu

SEQ ID NO: 116907 - RNA, 64 nt, Human
uucuaacucaggggugauucugaaaccuguuggcuccccucaccugucgguugcccuucugaug

SEQ ID NO: 116908 - RNA, 64 nt, Human
ggggauccugcccccgcccugcuggccucccuucuccccucaacccuugagaugauuuucucuu

SEQ ID NO: 116909 - RNA, 64 nt, Human
uggcagcugccacgccgcccuaaaagcacacucauccccucacuugccgcgucgcccucccagg

SEQ ID NO: 116910 - RNA, 64 nt, Human
cccccgccaaaagcugcucagggaaaagcagcucuccccucagagugcaagccccugcuccaga

SEQ ID NO: 116911 - RNA, 64 nt, Human
aauaggagaagguggaaaugggugaagagagaaguccccucacuagcugcaugagaaaucuauc

SEQ ID NO: 116912 - RNA, 64 nt, Human
auuccacgguuaggccccccugggggggcugccuuccccucagccucuccccacaccacccacc

SEQ ID NO: 116913 - RNA, 64 nt, Human
cauuuguuacugagccacagauaauacaagagcguccccucacaaauaaauuaaagcguaaaag

SEQ ID NO: 116914 - RNA, 64 nt, Human
gcgguagaauccauguaguucccaccaguugccuuccccucagggauggaaggaagaggguuuc

SEQ ID NO: 116915 - RNA, 64 nt, Human
gucccccgugcacgguucaaugguagauucgcuguccccucagcgggggccuugaagacucccu

SEQ ID NO: 116916 - RNA, 64 nt, Human
cuuuuuuuucuuuuuggcugaguuauucccucccuccccucaauacccucaguacugacuacuu

SEQ ID NO: 116917 - RNA, 64 nt, Human
cacacuccugccucaucgaccgucugcccccugcuccccucaucaggaccaacccggggacugg

SEQ ID NO: 116918 - RNA, 64 nt, Human
ggagagauacagggaaaggagcuguucuucaagguccccucaacaugagcggaagagcgaaccc

SEQ ID NO: 116919 - RNA, 64 nt, Human
uguugacucuugucauuuagugacuucaucccccuccccucagucugaucuugucuaaguagaa

SEQ ID NO: 116920 - RNA, 64 nt, Human
cuggccuccgagcccccagguccaccgucuccccuccccucauuuguaagaauagcuacacacu

SEQ ID NO: 116921 - RNA, 64 nt, Human
ucugugucgaccaccaagccucuggcuaccucuguccccucagguuugguuguguagcuucugu

SEQ ID NO: 116922 - RNA, 64 nt, Human
gcgggucgcaggugaccccgggaccagaugucccuccccucaugagcgugcaacagggagcagc

SEQ ID NO: 116923 - RNA, 64 nt, Human
uugaauauaguuuugaaaggaguuuugacuuuuuuccccucauucaucucaguauagagugcgc

SEQ ID NO: 116924 - RNA, 64 nt, Human
agcccccucacaguauugcucacccagugcccucuccccucagccucuccccugccugcccugg

SEQ ID NO: 116925 - RNA, 64 nt, Human
auggagggguccggcagcggccacaauugucuuguccccucaccccccaacucccccuggaaca

SEQ ID NO: 116926 - RNA, 64 nt, Human
ugguuaauuuauaacaccccgauuuccucuuggguccccucaagcagacggggcucaagggggu

SEQ ID NO: 116927 - RNA, 64 nt, Human
gauaauuccuauguggaaaugauuccagccaugguccccucacuugagcaugugaauauucuca

SEQ ID NO: 116928 - RNA, 64 nt, Human
cugcccgguuuuggaaaaaaacaauaaaggacuguccccucaaaaccagccgggggacuguuaa

SEQ ID NO: 116929 - RNA, 64 nt, Human
caacuccaagggcgucacccccauuuucuacccauccccucaauaaaguuuuuauaaaggaacu

SEQ ID NO: 116930 - RNA, 64 nt, Human
uccccagaccucugucccuguuccccuccacuccuccccucacuccccugcucccccgaccacc

SEQ ID NO: 116931 - RNA, 64 nt, Human
uguuccugguucccgcuuuccacuuccaaaucccuccccucaccuucccccacugccccccaag

SEQ ID NO: 116932 - RNA, 64 nt, Human
accaaaaggaguuggcuccaaccaaugggagccuuccccucacuucuuagaauccuccugcaag

SEQ ID NO: 116933 - RNA, 64 nt, Human
gccccccgcacugaccacacccaccgcaaccucauccccucagcacuaaccacauccacucuca

SEQ ID NO: 116934 - RNA, 63 nt, Human
gccagaaccgcaccagaugaggcccagcgcccuuccccucaaccaaagagccccccgggucac

SEQ ID NO: 116935 - RNA, 64 nt, Human
uccccuagcucccuccaggugucugcagugguuguccccucaaagcugucccacacccuccucc

SEQ ID NO: 116936 - RNA, 64 nt, Human
accuaauccccccgccccgcugccuuucccaggcuccccucaccccagcggguaaugagcccuu

SEQ ID NO: 116937 - RNA, 64 nt, Human
augccugucuccaaucccaacccugcccccaaucuccccucaacuccaauccauaacccccuuc

SEQ ID NO: 116938 - RNA, 64 nt, Human
ugggggucagagaggcagauuccuuccccucccguccccucacgcucaaacccccacuuccugc

SEQ ID NO: 116939 - RNA, 64 nt, Human
ccucggucucccuuccguccaucccccuucuuccuccccucaacagugaguuagacucaagggg

SEQ ID NO: 116940 - RNA, 64 nt, Human
caccaccuccccaccccaccccccacccccugcuuccccucacugcccaggucgaucaaguggc

SEQ ID NO: 116941 - RNA, 64 nt, Human
ucuucgcccaucuauggcuguguugucacaucuguccccucauuuuugagaucccccaauucuc

SEQ ID NO: 116942 - RNA, 64 nt, Human
ccucccuucuguguccccuugaggguacccuggguccccucaucaggggcagaggcaugaaaga

SEQ ID NO: 116943 - RNA, 64 nt, Human
uaaggcacuuaucccugguuccuagcaccgcuuauccccucagaauccacaacuuguaccaagu

SEQ ID NO: 116944 - RNA, 64 nt, Human
cgugcuguuccaccuucccucaugcuguuccaccuccccucagacuagcuuucagccuucuguc

SEQ ID NO: 116945 - RNA, 64 nt, Human
cguguuguuccaccuucccucaugcuguuccaccuccccucagacuagcuuucagucuucuguc

SEQ ID NO: 116946 - RNA, 64 nt, Human
cuugcuguuccaccuucccucaugcuguuccaccuccccucagacuaucuuucagccuucuguc

SEQ ID NO: 116947 - RNA, 64 nt, Human
uggggggaagguuggggggugucuggaggcauguuccccucaccaccccccgugggucucaggg

SEQ ID NO: 116948 - RNA, 64 nt, Human
ucccaacccccagucaguguuugagccuccucguuccccucacgcacccgcucacgcacccucg

SEQ ID NO: 116949 - RNA, 64 nt, Human
cgccaaccauuaccaaagcuugaauaggugguuuuccccucacagcguaaacaaagccaugggg

SEQ ID NO: 116950 - RNA, 64 nt, Human
cguacauucauacacaagccuuuucacacagcacuccccucagacacccucagagaguucacac

SEQ ID NO: 116951 - RNA, 64 nt, Human
gcagucauugugggaaagcuuucauccagaggucuccccucaucaugcaccagaggacgcaugu

SEQ ID NO: 116952 - RNA, 64 nt, Human
cuggccgcuggagagaugcccgcugaggguauucuccccucaacccacugccucuguucaucca

SEQ ID NO: 116953 - RNA, 64 nt, Human
ugaaggcaccuuggggcuucccugccgcauccucuccccucaggaaggggacugaccugggcuu

SEQ ID NO: 116954 - RNA, 64 nt, Human
uggggaggcacagagcucgccagcgucccuggaguccccucaggaauggaaaguggagugcccu

SEQ ID NO: 116955 - RNA, 64 nt, Human
cuggauccuggggcccccaucacuggaucccagauccccucacuccacccacuggauuccugca

SEQ ID NO: 116956 - RNA, 64 nt, Human
uucccacaggccccaugcauccucccugccucacuccccucagccccugccgaccuuagcuuau

SEQ ID NO: 116957 - RNA, 64 nt, Human
ccuggcgugauccagucagaucaagccuccugaauccccucauuacaagauccaaucauaucau

SEQ ID NO: 116958 - RNA, 64 nt, Human
agcucucaccucgagacaccucccagaccccacauccccucagaacgcugcgcccagccacacc

SEQ ID NO: 116959 - RNA, 64 nt, Human
ccuuuucccauuguagaagggacagggagucagauccccucaaccccccggcuucagggacccc

SEQ ID NO: 116960 - RNA, 64 nt, Human
cucuccaggugccccucagccaugggcccuacaguccccucaggggacucuaaccugggggccu

SEQ ID NO: 116961 - RNA, 64 nt, Human
gaauucccaagcccugcauuguacagccccccacuccccucaccaccuaauaaaggaauaguua

SEQ ID NO: 116962 - RNA, 64 nt, Human
ccucaauacgguggaugcuguuaacuuucuuccuuccccucaggcaauggcggugacuuacaau

SEQ ID NO: 116963 - RNA, 64 nt, Human
cucugucccuuggcaaauggacaccaggggcuucuccccucaaagccauaccccgccucugggc

SEQ ID NO: 116964 - RNA, 64 nt, Human
aguguuugucccaucgguagcuugaaauaaacgcuccccucagacacccgcuggguucucugau

SEQ ID NO: 116965 - RNA, 64 nt, Human
caugagugcugaugagggcaccucuugugcugaguccccucagcuaucaguguucuucucaagg

SEQ ID NO: 116966 - RNA, 64 nt, Human
gaaaaaaaaaaaaaaaaaaaaacugggacagcuuuccccucauuuuuuuuuuuguuucugagaa

SEQ ID NO: 116967 - RNA, 64 nt, Human
gcucaggaugcuggugaugcuaggaagaugucccuccccucacugccccacauucucccagugg

SEQ ID NO: 116968 - RNA, 64 nt, Human
gaggcucggccuggaaacaguccccugcccagaguccccucagccuccaugacaggucccuccc

SEQ ID NO: 116969 - RNA, 64 nt, Human
uuuaagacuucuugguaccuaugaacauagguccuccccucaccccaacucuagguuuccaggc

SEQ ID NO: 116970 - RNA, 64 nt, Human
cugggcugcaaaaccuaccuuccucucucccgccuccccucacccucaacucucaaugucuugc

SEQ ID NO: 116971 - RNA, 64 nt, Human
gagcccccgccgcgcuucugcgcucucucccuucuccccucaccccgcccccaccagcccagug

SEQ ID NO: 116972 - RNA, 64 nt, Human
ggugcuggggagggaggacugugaauggcuguucuccccucacugcugagucucccaggacccc

SEQ ID NO: 116973 - RNA, 64 nt, Human
guuucuugcucaugguggcucauuuauuacauaguccccucaccccacuaauggauaaugggag

SEQ ID NO: 116974 - RNA, 64 nt, Human
auccuuggugugguuucuggugucugcucagcuguccccucauucuacuaaugugaugcuuuca

SEQ ID NO: 116975 - RNA, 64 nt, Human
cugggaagcucccaccccacucaggggaccccacuccccucacacacacccccccacaaggaac

SEQ ID NO: 116976 - RNA, 64 nt, Human
gacgaaugccuuaguuuccacuuuccagccuggauccccucacacugaacccuucuucguugca

SEQ ID NO: 116977 - RNA, 64 nt, Human
ugcaggggcuggggccuccggagcugcugcgggcuccccucaggcucugcuucgugacccguga

SEQ ID NO: 116978 - RNA, 64 nt, Human
agauucucuggggguccccacauccucccaaggcuccccucacagccucuccuuugcuugaagc

SEQ ID NO: 116979 - RNA, 64 nt, Human
cccagggacuuaacgugcugccuguuguacucuguccccucaugacuuuuuagacacagggacu

SEQ ID NO: 116980 - RNA, 64 nt, Human
ugcauauuaaaaauguaauguaauuauaagcgauuccccucaacaauccagagaaaguaguucu

SEQ ID NO: 116981 - RNA, 64 nt, Human
gacaacauuggucuaggacauauauuuuguauuuuccccucacccaccauccaauaaugaguaa

SEQ ID NO: 116982 - RNA, 64 nt, Human
aaaaacugaauauauucaggaccaacucucucccuccccucaucccacaucucaaagcagacaa

SEQ ID NO: 116983 - RNA, 64 nt, Human
cuauccucugaguguuuggaaauaaacugugcaauccccucaaaaaaauaaaaauaaaaaaaau

SEQ ID NO: 116984 - RNA, 64 nt, Human
caagagaaagaagaggagauuuucuguuuguuuuuccccucagcccugccaccguggggagucu

SEQ ID NO: 116985 - RNA, 64 nt, Human
ucuaagagugaccuaagcauaagugaaagacaccuccccucacccuucuagcccccuacaaggu

SEQ ID NO: 116986 - RNA, 64 nt, Human
cauuacugaagcuaaaucuuucaacucuccccaguccccucauccccuggccuccucccacuua

SEQ ID NO: 116987 - RNA, 64 nt, Human
ucaagaucuguuccacagggcuaaugccaccaucuccccucaaaauuuuguagagguucuaaaa

SEQ ID NO: 116988 - RNA, 64 nt, Human
ggaugggggugcaggcagccuugaccacggcuguuccccucacccaaaagaauuaucaucccaa

SEQ ID NO: 116989 - RNA, 64 nt, Human
ugaguggauggacggcaagcuuagcaagccuaaguccccucauguucagugagccuguuucauu

SEQ ID NO: 116990 - RNA, 64 nt, Human
cagagaaccaccccgucagguuccuuguggaagcuccccucauccguggugcagcaggcugagc

SEQ ID NO: 116991 - RNA, 64 nt, Human
cucucucacacagcccugccaugcugacucgguuuccccucagagccauuguugucugggcucg

SEQ ID NO: 116992 - RNA, 64 nt, Human
cggcagccucaaccucccuggcucaagcgaucccuccccucagccuccugaguagcugagacua

SEQ ID NO: 116993 - RNA, 64 nt, Human
ggcuggaccugaacuccugggcuugagcaagucuuccccucagccucuggaguagcugggccua

SEQ ID NO: 116994 - RNA, 64 nt, Human
ggcaucaucucccuccugcgaggagcugagccaguccccucacagauggauaaaugaggcugau

SEQ ID NO: 116995 - RNA, 64 nt, Human
cugggcugugcucuguuugaagggggcgcccugcuccccucagaucagucaggaggaagaugac

SEQ ID NO: 116996 - RNA, 64 nt, Human
aaaauguuuaaaaaaaaaaaaaaacugccuuucuuccccucaagucaacuuuugugcuccagaa

SEQ ID NO: 116997 - RNA, 64 nt, Human
aagacucagggccaauuauuggcugagcccacgguccccucagcagggaugcgauggucucuga

SEQ ID NO: 116998 - RNA, 64 nt, Human
agcaggcucuugggacuuuuacacaggccuaggguccccucagucuuggucccaggagaugggg

SEQ ID NO: 116999 - RNA, 64 nt, Human
guccggcuuuugaaacuuagguauuuuauauuuuuccccucaagaacuuuuuuuuaagagacag

SEQ ID NO: 117000 - RNA, 64 nt, Human
gcagcccucguccugggucugcaccgggcagcucuccccucacucuccuccaccugccccccug

SEQ ID NO: 117001 - RNA, 64 nt, Human
cccuccugccccacuccuggcugugccucccauuuccccucaccuguacccacaccuccagaau

SEQ ID NO: 117002 - RNA, 64 nt, Human
cgccgcugagacccuucugcugagagcucugcccuccccucaucaccuggccugugcagaaacg

SEQ ID NO: 117003 - RNA, 64 nt, Human
uuuuucaccuggucauucugugaccaccacccccuccccucaccgccucccagguggcccggga

SEQ ID NO: 117004 - RNA, 64 nt, Human
agccacaggcagggccugagggagccccuggcuuuccccucagccucaggaaagguggucagga

SEQ ID NO: 117005 - RNA, 64 nt, Human
cuagggcuucacaucccuuccccuccccuccccuuccccucaucuuccaggcaacagugccugc

SEQ ID NO: 117006 - RNA, 51 nt, Human
cugaggaagaugacaaguaacuccccucagggauacgacacaugcccauga

SEQ ID NO: 117007 - RNA, 64 nt, Human
gccccccucacucuguuuccuguucagcauguacuccccucauccgauuccccucuaucaguca

SEQ ID NO: 117008 - RNA, 64 nt, Human
gccccccucacucuguuuccuguucagcauguacuccccucauccgauuccccuguaucaguca

SEQ ID NO: 117009 - RNA, 64 nt, Human; identical to SEQ ID NO: 117007

SEQ ID NO: 117010 - RNA, 64 nt, Human
gagaucagcgacccugaggaagaugacgaguaacuccccucagggauacgacacaugcccauga

SEQ ID NO: 117011 - RNA, 64 nt, Human
cugcuuuucccauugccaugcguccuggucaagcuccccucacucuguuuccuggucagcaugu

SEQ ID NO: 117012 - RNA, 64 nt, Human
gcuccccucacucuguuuccuggucagcauguacuccccucauccgauuccccuguagcaguca

SEQ ID NO: 117013 - RNA, 64 nt, Human
guuagaguuucccuaacaaaaaagcuaacccagguccccucauuccuucaacuugugccuggga

SEQ ID NO: 117014 - RNA, 64 nt, Human
acuuccaccgugaagcgaaagagccaguagugaauccccucauuuugugcauucacuuugaaga

SEQ ID NO: 117015 - RNA, 64 nt, Human
cccuccaucuagauggggggcucccuugcuuagcuccccucacccugcacugaacauaccccaa

SEQ ID NO: 117016 - RNA, 64 nt, Human
uucacacuccucaauaacauuauauugauuguguuccccucaagcaucauauuuuacauuuuuu

SEQ ID NO: 117017 - RNA, 64 nt, Human
uggugacgaguagcaagagaccaaagcauuauuuuccccucaagacaacagaaaccauucagag

SEQ ID NO: 117018 - RNA, 64 nt, Human
uuuccagccuuucaacccuccccgacucugcggcuccccucagcccccuugcaaguucauggcc

SEQ ID NO: 117019 - RNA, 64 nt, Human
ugacggcagggacgcagccacaguucagacccuguccccucagcaccuggauggacucccacug

SEQ ID NO: 117020 - RNA, 64 nt, Human
accccccagcagugggguaagauugcgcgcuucauccccucaaaaugcaguucagccccacucc

SEQ ID NO: 117021 - RNA, 64 nt, Human
uuagcuaacauuuuuaaguuuuuuuaaacuuucuuccccucaguuguacuuaauauuuagugga

SEQ ID NO: 117022 - RNA, 64 nt, Human
auagaauguuuugcuuggaagaaaccugguccauuccccucauugugaagaaucccgaauccug

SEQ ID NO: 117023 - RNA, 64 nt, Human; identical to SEQ ID NO: 117007

SEQ ID NO: 117024 - RNA, 64 nt, Human
gcuucccucacucuguuuccuggucagcauguacuccccucauccgauuccccuguagcaguca

SEQ ID NO: 117025 - RNA, 64 nt, Human
gccccccucacucuguuuccuguucagcauguacuccccucauccgauuccguuguaucaguca

SEQ ID NO: 117026 - RNA, 64 nt, Human
cuauuuaucugucugagcccugcccucacuccacuccccucauccacuaggugcccagucuuga

SEQ ID NO: 117027 - RNA, 64 nt, Human
accccaccccuccuauccaccccuccccccacccuccccucacaccccgcacucaccccuucca

SEQ ID NO: 117028 - RNA, 64 nt, Human
cagguguuuauaucuccuuuguauucugucuucauccccucagaaggucuguuuugaguuccua

SEQ ID NO: 117029 - RNA, 64 nt, Human
cucagaggaagccugagugcucacuuaaacacuauccccucagacucccugugugaggccugca

SEQ ID NO: 117030 - RNA, 64 nt, Human
gauccagcugcccuuccuuagaccaucacaugccuccccucaaucacagguuuuaaaauuacug

SEQ ID NO: 117031 - RNA, 64 nt, Human
agccugccccgcuacccaagcagccccgcccucuuccccucaaccccggcccaggccgcccugg

SEQ ID NO: 117032 - RNA, 64 nt, Human; identical to SEQ ID NO: 94676

SEQ ID NO: 117033 - RNA, 64 nt, Human; identical to SEQ ID NO: 94677

SEQ ID NO: 117034 - RNA, 59 nt, Human; identical to SEQ ID NO: 94678

SEQ ID NO: 117035 - RNA, 64 nt, Human; identical to SEQ ID NO: 94679

SEQ ID NO: 117036 - RNA, 64 nt, Human; identical to SEQ ID NO: 94680

SEQ ID NO: 117037 - RNA, 64 nt, Human; identical to SEQ ID NO: 94681

SEQ ID NO: 117038 - RNA, 64 nt, Human; identical to SEQ ID NO: 94682

SEQ ID NO: 117039 - RNA, 64 nt, Human; identical to SEQ ID NO: 94683

SEQ ID NO: 117040 - RNA, 64 nt, Human; identical to SEQ ID NO: 94684

SEQ ID NO: 117041 - RNA, 64 nt, Human; identical to SEQ ID NO: 94685

SEQ ID NO: 117042 - RNA, 64 nt, Human; identical to SEQ ID NO: 94686

SEQ ID NO: 117043 - RNA, 64 nt, Human; identical to SEQ ID NO: 94687

SEQ ID NO: 117044 - RNA, 64 nt, Human; identical to SEQ ID NO: 94688

SEQ ID NO: 117045 - RNA, 64 nt, Human; identical to SEQ ID NO: 94689

SEQ ID NO: 117046 - RNA, 64 nt, Human; identical to SEQ ID NO: 94690

SEQ ID NO: 117047 - RNA, 64 nt, Human; identical to SEQ ID NO: 94691

SEQ ID NO: 117048 - RNA, 64 nt, Human; identical to SEQ ID NO: 94692

SEQ ID NO: 117049 - RNA, 64 nt, Human; identical to SEQ ID NO: 94693

SEQ ID NO: 117050 - RNA, 64 nt, Human; identical to SEQ ID NO: 94694

SEQ ID NO: 117051 - RNA, 64 nt, Human; identical to SEQ ID NO: 94695

SEQ ID NO: 117052 - RNA, 64 nt, Human; identical to SEQ ID NO: 94696

SEQ ID NO: 117053 - RNA, 64 nt, Human; identical to SEQ ID NO: 94697

SEQ ID NO: 117054 - RNA, 64 nt, Human; identical to SEQ ID NO: 94698

SEQ ID NO: 117055 - RNA, 64 nt, Human; identical to SEQ ID NO: 94699

SEQ ID NO: 117056 - RNA, 64 nt, Human; identical to SEQ ID NO: 94700

SEQ ID NO: 117057 - RNA, 64 nt, Human; identical to SEQ ID NO: 94701

SEQ ID NO: 117058 - RNA, 64 nt, Human; identical to SEQ ID NO: 94702

SEQ ID NO: 117059 - RNA, 64 nt, Human; identical to SEQ ID NO: 94703

SEQ ID NO: 117060 - RNA, 64 nt, Human; identical to SEQ ID NO: 94704

SEQ ID NO: 117061 - RNA, 64 nt, Human; identical to SEQ ID NO: 94705

SEQ ID NO: 117062 - RNA, 64 nt, Human; identical to SEQ ID NO: 94706

SEQ ID NO: 117063 - RNA, 64 nt, Human; identical to SEQ ID NO: 94707

SEQ ID NO: 117064 - RNA, 64 nt, Human; identical to SEQ ID NO: 94708

SEQ ID NO: 117065 - RNA, 64 nt, Human; identical to SEQ ID NO: 94709

SEQ ID NO: 117066 - RNA, 64 nt, Human; identical to SEQ ID NO: 94710

SEQ ID NO: 117067 - RNA, 64 nt, Human; identical to SEQ ID NO: 94711

SEQ ID NO: 117068 - RNA, 64 nt, Human; identical to SEQ ID NO: 94712

SEQ ID NO: 117069 - RNA, 64 nt, Human; identical to SEQ ID NO: 94713

SEQ ID NO: 117070 - RNA, 64 nt, Human; identical to SEQ ID NO: 94714

SEQ ID NO: 117071 - RNA, 64 nt, Human; identical to SEQ ID NO: 94715

SEQ ID NO: 117072 - RNA, 64 nt, Human; identical to SEQ ID NO: 94716

SEQ ID NO: 117073 - RNA, 64 nt, Human; identical to SEQ ID NO: 94717

SEQ ID NO: 117074 - RNA, 64 nt, Human; identical to SEQ ID NO: 94718

SEQ ID NO: 117075 - RNA, 64 nt, Human; identical to SEQ ID NO: 94719

SEQ ID NO: 117076 - RNA, 64 nt, Human; identical to SEQ ID NO: 94720

SEQ ID NO: 117077 - RNA, 64 nt, Human; identical to SEQ ID NO: 94721

SEQ ID NO: 117078 - RNA, 64 nt, Human; identical to SEQ ID NO: 94722

SEQ ID NO: 117079 - RNA, 64 nt, Human; identical to SEQ ID NO: 94723

SEQ ID NO: 117080 - RNA, 64 nt, Human; identical to SEQ ID NO: 94724

SEQ ID NO: 117081 - RNA, 64 nt, Human; identical to SEQ ID NO: 94725

SEQ ID NO: 117082 - RNA, 64 nt, Human; identical to SEQ ID NO: 94726

SEQ ID NO: 117083 - RNA, 64 nt, Human; identical to SEQ ID NO: 94727

SEQ ID NO: 117084 - RNA, 64 nt, Human; identical to SEQ ID NO: 94728

SEQ ID NO: 117085 - RNA, 64 nt, Human; identical to SEQ ID NO: 94729

SEQ ID NO: 117086 - RNA, 64 nt, Human; identical to SEQ ID NO: 94730

SEQ ID NO: 117087 - RNA, 64 nt, Human; identical to SEQ ID NO: 94731

SEQ ID NO: 117088 - RNA, 64 nt, Human; identical to SEQ ID NO: 94732

SEQ ID NO: 117089 - RNA, 64 nt, Human; identical to SEQ ID NO: 94733

SEQ ID NO: 117090 - RNA, 64 nt, Human; identical to SEQ ID NO: 94734

SEQ ID NO: 117091 - RNA, 64 nt, Human; identical to SEQ ID NO: 94735

SEQ ID NO: 117092 - RNA, 64 nt, Human; identical to SEQ ID NO: 94736

SEQ ID NO: 117093 - RNA, 64 nt, Human; identical to SEQ ID NO: 94737

SEQ ID NO: 117094 - RNA, 64 nt, Human; identical to SEQ ID NO: 94738

SEQ ID NO: 117095 - RNA, 64 nt, Human; identical to SEQ ID NO: 94739

SEQ ID NO: 117096 - RNA, 64 nt, Human; identical to SEQ ID NO: 94740

SEQ ID NO: 117097 - RNA, 64 nt, Human; identical to SEQ ID NO: 94741

SEQ ID NO: 117098 - RNA, 64 nt, Human; identical to SEQ ID NO: 94742

SEQ ID NO: 117099 - RNA, 64 nt, Human; identical to SEQ ID NO: 94743

SEQ ID NO: 117100 - RNA, 64 nt, Human; identical to SEQ ID NO: 94744

SEQ ID NO: 117101 - RNA, 64 nt, Human; identical to SEQ ID NO: 94745

SEQ ID NO: 117102 - RNA, 64 nt, Human; identical to SEQ ID NO: 94746

SEQ ID NO: 117103 - RNA, 64 nt, Human; identical to SEQ ID NO: 94747

SEQ ID NO: 117104 - RNA, 64 nt, Human; identical to SEQ ID NO: 94748

SEQ ID NO: 117105 - RNA, 64 nt, Human; identical to SEQ ID NO: 94749

SEQ ID NO: 117106 - RNA, 64 nt, Human; identical to SEQ ID NO: 94750

SEQ ID NO: 117107 - RNA, 64 nt, Human; identical to SEQ ID NO: 94751

SEQ ID NO: 117108 - RNA, 64 nt, Human; identical to SEQ ID NO: 94752

SEQ ID NO: 117109 - RNA, 64 nt, Human; identical to SEQ ID NO: 94753

SEQ ID NO: 117110 - RNA, 64 nt, Human; identical to SEQ ID NO: 94754

SEQ ID NO: 117111 - RNA, 64 nt, Human; identical to SEQ ID NO: 94755

SEQ ID NO: 117112 - RNA, 64 nt, Human; identical to SEQ ID NO: 94756

SEQ ID NO: 117113 - RNA, 64 nt, Human; identical to SEQ ID NO: 94757

SEQ ID NO: 117114 - RNA, 64 nt, Human; identical to SEQ ID NO: 94758

SEQ ID NO: 117115 - RNA, 64 nt, Human; identical to SEQ ID NO: 94759

SEQ ID NO: 117116 - RNA, 64 nt, Human; identical to SEQ ID NO: 94760

SEQ ID NO: 117117 - RNA, 64 nt, Human; identical to SEQ ID NO: 94761

SEQ ID NO: 117118 - RNA, 64 nt, Human; identical to SEQ ID NO: 94762

SEQ ID NO: 117119 - RNA, 64 nt, Human; identical to SEQ ID NO: 94763

SEQ ID NO: 117120 - RNA, 64 nt, Human; identical to SEQ ID NO: 94764

SEQ ID NO: 117121 - RNA, 64 nt, Human; identical to SEQ ID NO: 94765

SEQ ID NO: 117122 - RNA, 64 nt, Human; identical to SEQ ID NO: 94766

SEQ ID NO: 117123 - RNA, 64 nt, Human; identical to SEQ ID NO: 94767

SEQ ID NO: 117124 - RNA, 64 nt, Human; identical to SEQ ID NO: 94768

SEQ ID NO: 117125 - RNA, 64 nt, Human; identical to SEQ ID NO: 94769

SEQ ID NO: 117126 - RNA, 64 nt, Human; identical to SEQ ID NO: 94770

SEQ ID NO: 117127 - RNA, 64 nt, Human; identical to SEQ ID NO: 94771

SEQ ID NO: 117128 - RNA, 64 nt, Human; identical to SEQ ID NO: 94772

SEQ ID NO: 117129 - RNA, 64 nt, Human; identical to SEQ ID NO: 94773

SEQ ID NO: 117130 - RNA, 64 nt, Human; identical to SEQ ID NO: 94774

SEQ ID NO: 117131 - RNA, 64 nt, Human; identical to SEQ ID NO: 94775

SEQ ID NO: 117132 - RNA, 64 nt, Human; identical to SEQ ID NO: 94776

SEQ ID NO: 117133 - RNA, 64 nt, Human; identical to SEQ ID NO: 94777

SEQ ID NO: 117134 - RNA, 64 nt, Human; identical to SEQ ID NO: 94778

SEQ ID NO: 117135 - RNA, 64 nt, Human; identical to SEQ ID NO: 94779

SEQ ID NO: 117136 - RNA, 64 nt, Human; identical to SEQ ID NO: 94780

SEQ ID NO: 117137 - RNA, 64 nt, Human; identical to SEQ ID NO: 94781

SEQ ID NO: 117138 - RNA, 64 nt, Human; identical to SEQ ID NO: 94782

SEQ ID NO: 117139 - RNA, 64 nt, Human; identical to SEQ ID NO: 94783

SEQ ID NO: 117140 - RNA, 64 nt, Human; identical to SEQ ID NO: 94784

SEQ ID NO: 117141 - RNA, 64 nt, Human; identical to SEQ ID NO: 94785

SEQ ID NO: 117142 - RNA, 64 nt, Human; identical to SEQ ID NO: 94786

SEQ ID NO: 117143 - RNA, 64 nt, Human; identical to SEQ ID NO: 94787

SEQ ID NO: 117144 - RNA, 64 nt, Human; identical to SEQ ID NO: 94788

SEQ ID NO: 117145 - RNA, 64 nt, Human; identical to SEQ ID NO: 94789

SEQ ID NO: 117146 - RNA, 64 nt, Human; identical to SEQ ID NO: 94790

SEQ ID NO: 117147 - RNA, 64 nt, Human; identical to SEQ ID NO: 94791

SEQ ID NO: 117148 - RNA, 64 nt, Human; identical to SEQ ID NO: 94792

SEQ ID NO: 117149 - RNA, 64 nt, Human; identical to SEQ ID NO: 94793

SEQ ID NO: 117150 - RNA, 64 nt, Human; identical to SEQ ID NO: 94794

SEQ ID NO: 117151 - RNA, 64 nt, Human; identical to SEQ ID NO: 94795

SEQ ID NO: 117152 - RNA, 64 nt, Human; identical to SEQ ID NO: 94796

SEQ ID NO: 117153 - RNA, 64 nt, Human; identical to SEQ ID NO: 94797

SEQ ID NO: 117154 - RNA, 64 nt, Human; identical to SEQ ID NO: 94798

SEQ ID NO: 117155 - RNA, 64 nt, Human; identical to SEQ ID NO: 94799

SEQ ID NO: 117156 - RNA, 64 nt, Human; identical to SEQ ID NO: 94800

SEQ ID NO: 117157 - RNA, 64 nt, Human; identical to SEQ ID NO: 94801

SEQ ID NO: 117158 - RNA, 64 nt, Human; identical to SEQ ID NO: 94802

SEQ ID NO: 117159 - RNA, 64 nt, Human; identical to SEQ ID NO: 94803

SEQ ID NO: 117160 - RNA, 64 nt, Human; identical to SEQ ID NO: 94804

SEQ ID NO: 117161 - RNA, 64 nt, Human; identical to SEQ ID NO: 94805

SEQ ID NO: 117162 - RNA, 64 nt, Human; identical to SEQ ID NO: 94806

SEQ ID NO: 117163 - RNA, 64 nt, Human; identical to SEQ ID NO: 94807

SEQ ID NO: 117164 - RNA, 64 nt, Human; identical to SEQ ID NO: 94808

SEQ ID NO: 117165 - RNA, 64 nt, Human; identical to SEQ ID NO: 94809

SEQ ID NO: 117166 - RNA, 64 nt, Human; identical to SEQ ID NO: 94810

SEQ ID NO: 117167 - RNA, 64 nt, Human; identical to SEQ ID NO: 94811

SEQ ID NO: 117168 - RNA, 64 nt, Human; identical to SEQ ID NO: 94812

SEQ ID NO: 117169 - RNA, 64 nt, Human; identical to SEQ ID NO: 94813

SEQ ID NO: 117170 - RNA, 64 nt, Human; identical to SEQ ID NO: 94814

SEQ ID NO: 117171 - RNA, 64 nt, Human; identical to SEQ ID NO: 94815

SEQ ID NO: 117172 - RNA, 64 nt, Human; identical to SEQ ID NO: 94816

SEQ ID NO: 117173 - RNA, 64 nt, Human; identical to SEQ ID NO: 94817

SEQ ID NO: 117174 - RNA, 64 nt, Human; identical to SEQ ID NO: 94818

SEQ ID NO: 117175 - RNA, 64 nt, Human; identical to SEQ ID NO: 94819

SEQ ID NO: 117176 - RNA, 64 nt, Human; identical to SEQ ID NO: 94820

SEQ ID NO: 117177 - RNA, 64 nt, Human; identical to SEQ ID NO: 94821

SEQ ID NO: 117178 - RNA, 64 nt, Human; identical to SEQ ID NO: 94822

SEQ ID NO: 117179 - RNA, 64 nt, Human; identical to SEQ ID NO: 94823

SEQ ID NO: 117180 - RNA, 64 nt, Human; identical to SEQ ID NO: 94824

SEQ ID NO: 117181 - RNA, 64 nt, Human; identical to SEQ ID NO: 94825

SEQ ID NO: 117182 - RNA, 64 nt, Human; identical to SEQ ID NO: 94826

SEQ ID NO: 117183 - RNA, 64 nt, Human; identical to SEQ ID NO: 94827

SEQ ID NO: 117184 - RNA, 64 nt, Human; identical to SEQ ID NO: 94828

SEQ ID NO: 117185 - RNA, 64 nt, Human; identical to SEQ ID NO: 94829

SEQ ID NO: 117186 - RNA, 64 nt, Human; identical to SEQ ID NO: 94830

SEQ ID NO: 117187 - RNA, 64 nt, Human; identical to SEQ ID NO: 94831

SEQ ID NO: 117188 - RNA, 64 nt, Human; identical to SEQ ID NO: 94832

SEQ ID NO: 117189 - RNA, 64 nt, Human; identical to SEQ ID NO: 94833

SEQ ID NO: 117190 - RNA, 64 nt, Human; identical to SEQ ID NO: 94834

SEQ ID NO: 117191 - RNA, 64 nt, Human; identical to SEQ ID NO: 94835

SEQ ID NO: 117192 - RNA, 64 nt, Human; identical to SEQ ID NO: 94836

SEQ ID NO: 117193 - RNA, 64 nt, Human; identical to SEQ ID NO: 94837

SEQ ID NO: 117194 - RNA, 64 nt, Human; identical to SEQ ID NO: 94838

SEQ ID NO: 117195 - RNA, 64 nt, Human; identical to SEQ ID NO: 94839

SEQ ID NO: 117196 - RNA, 64 nt, Human; identical to SEQ ID NO: 94840

SEQ ID NO: 117197 - RNA, 64 nt, Human; identical to SEQ ID NO: 94841

SEQ ID NO: 117198 - RNA, 64 nt, Human; identical to SEQ ID NO: 94842

SEQ ID NO: 117199 - RNA, 64 nt, Human; identical to SEQ ID NO: 94843

SEQ ID NO: 117200 - RNA, 64 nt, Human; identical to SEQ ID NO: 94844

SEQ ID NO: 117201 - RNA, 64 nt, Human; identical to SEQ ID NO: 94845

SEQ ID NO: 117202 - RNA, 64 nt, Human; identical to SEQ ID NO: 94846

SEQ ID NO: 117203 - RNA, 64 nt, Human; identical to SEQ ID NO: 94847

SEQ ID NO: 117204 - RNA, 64 nt, Human; identical to SEQ ID NO: 94848

SEQ ID NO: 117205 - RNA, 64 nt, Human; identical to SEQ ID NO: 94849

SEQ ID NO: 117206 - RNA, 64 nt, Human; identical to SEQ ID NO: 94850

SEQ ID NO: 117207 - RNA, 64 nt, Human; identical to SEQ ID NO: 94851

SEQ ID NO: 117208 - RNA, 64 nt, Human; identical to SEQ ID NO: 94852

SEQ ID NO: 117209 - RNA, 64 nt, Human; identical to SEQ ID NO: 94853

SEQ ID NO: 117210 - RNA, 64 nt, Human; identical to SEQ ID NO: 94854

SEQ ID NO: 117211 - RNA, 64 nt, Human; identical to SEQ ID NO: 94855

SEQ ID NO: 117212 - RNA, 64 nt, Human; identical to SEQ ID NO: 94856

SEQ ID NO: 117213 - RNA, 64 nt, Human; identical to SEQ ID NO: 94857

SEQ ID NO: 117214 - RNA, 64 nt, Human; identical to SEQ ID NO: 94858

SEQ ID NO: 117215 - RNA, 64 nt, Human; identical to SEQ ID NO: 94859

SEQ ID NO: 117216 - RNA, 58 nt, Human; identical to SEQ ID NO: 94860

SEQ ID NO: 117217 - RNA, 64 nt, Human; identical to SEQ ID NO: 94861

SEQ ID NO: 117218 - RNA, 64 nt, Human; identical to SEQ ID NO: 94862

SEQ ID NO: 117219 - RNA, 64 nt, Human; identical to SEQ ID NO: 94863

SEQ ID NO: 117220 - RNA, 64 nt, Human; identical to SEQ ID NO: 94864

SEQ ID NO: 117221 - RNA, 64 nt, Human; identical to SEQ ID NO: 94865

SEQ ID NO: 117222 - RNA, 64 nt, Human; identical to SEQ ID NO: 94866

SEQ ID NO: 117223 - RNA, 64 nt, Human; identical to SEQ ID NO: 94867

SEQ ID NO: 117224 - RNA, 64 nt, Human; identical to SEQ ID NO: 94868

SEQ ID NO: 117225 - RNA, 64 nt, Human; identical to SEQ ID NO: 94869

SEQ ID NO: 117226 - RNA, 64 nt, Human; identical to SEQ ID NO: 94870

SEQ ID NO: 117227 - RNA, 64 nt, Human; identical to SEQ ID NO: 94871

SEQ ID NO: 117228 - RNA, 64 nt, Human; identical to SEQ ID NO: 94872

SEQ ID NO: 117229 - RNA, 64 nt, Human; identical to SEQ ID NO: 94873

SEQ ID NO: 117230 - RNA, 64 nt, Human; identical to SEQ ID NO: 94874

SEQ ID NO: 117231 - RNA, 64 nt, Human; identical to SEQ ID NO: 94875

SEQ ID NO: 117232 - RNA, 64 nt, Human; identical to SEQ ID NO: 94876

SEQ ID NO: 117233 - RNA, 64 nt, Human; identical to SEQ ID NO: 94877

SEQ ID NO: 117234 - RNA, 64 nt, Human; identical to SEQ ID NO: 94878

SEQ ID NO: 117235 - RNA, 64 nt, Human; identical to SEQ ID NO: 94879

SEQ ID NO: 117236 - RNA, 64 nt, Human; identical to SEQ ID NO: 94880

SEQ ID NO: 117237 - RNA, 64 nt, Human; identical to SEQ ID NO: 94881

SEQ ID NO: 117238 - RNA, 64 nt, Human; identical to SEQ ID NO: 94882

SEQ ID NO: 117239 - RNA, 64 nt, Human; identical to SEQ ID NO: 94883

SEQ ID NO: 117240 - RNA, 64 nt, Human; identical to SEQ ID NO: 94884

SEQ ID NO: 117241 - RNA, 64 nt, Human; identical to SEQ ID NO: 94885

SEQ ID NO: 117242 - RNA, 64 nt, Human; identical to SEQ ID NO: 94886

SEQ ID NO: 117243 - RNA, 64 nt, Human; identical to SEQ ID NO: 94887

SEQ ID NO: 117244 - RNA, 64 nt, Human; identical to SEQ ID NO: 94888

SEQ ID NO: 117245 - RNA, 64 nt, Human; identical to SEQ ID NO: 94889

SEQ ID NO: 117246 - RNA, 64 nt, Human; identical to SEQ ID NO: 94890

SEQ ID NO: 117247 - RNA, 64 nt, Human; identical to SEQ ID NO: 94891

SEQ ID NO: 117248 - RNA, 64 nt, Human; identical to SEQ ID NO: 94892

SEQ ID NO: 117249 - RNA, 64 nt, Human; identical to SEQ ID NO: 94893

SEQ ID NO: 117250 - RNA, 64 nt, Human; identical to SEQ ID NO: 94894

SEQ ID NO: 117251 - RNA, 64 nt, Human; identical to SEQ ID NO: 94895

SEQ ID NO: 117252 - RNA, 64 nt, Human; identical to SEQ ID NO: 94896

SEQ ID NO: 117253 - RNA, 64 nt, Human; identical to SEQ ID NO: 94897

SEQ ID NO: 117254 - RNA, 64 nt, Human; identical to SEQ ID NO: 94898

SEQ ID NO: 117255 - RNA, 64 nt, Human; identical to SEQ ID NO: 94899

SEQ ID NO: 117256 - RNA, 64 nt, Human; identical to SEQ ID NO: 94900

SEQ ID NO: 117257 - RNA, 64 nt, Human; identical to SEQ ID NO: 94901

SEQ ID NO: 117258 - RNA, 64 nt, Human; identical to SEQ ID NO: 94902

SEQ ID NO: 117259 - RNA, 64 nt, Human; identical to SEQ ID NO: 94903

SEQ ID NO: 117260 - RNA, 64 nt, Human; identical to SEQ ID NO: 94904

SEQ ID NO: 117261 - RNA, 64 nt, Human; identical to SEQ ID NO: 94905

SEQ ID NO: 117262 - RNA, 64 nt, Human; identical to SEQ ID NO: 94906

SEQ ID NO: 117263 - RNA, 64 nt, Human; identical to SEQ ID NO: 94907

SEQ ID NO: 117264 - RNA, 64 nt, Human; identical to SEQ ID NO: 94908

SEQ ID NO: 117265 - RNA, 64 nt, Human; identical to SEQ ID NO: 94909

SEQ ID NO: 117266 - RNA, 64 nt, Human; identical to SEQ ID NO: 94910

SEQ ID NO: 117267 - RNA, 64 nt, Human; identical to SEQ ID NO: 94911

SEQ ID NO: 117268 - RNA, 64 nt, Human; identical to SEQ ID NO: 94912

SEQ ID NO: 117269 - RNA, 64 nt, Human; identical to SEQ ID NO: 94913

SEQ ID NO: 117270 - RNA, 64 nt, Human; identical to SEQ ID NO: 94914

SEQ ID NO: 117271 - RNA, 64 nt, Human; identical to SEQ ID NO: 94915

SEQ ID NO: 117272 - RNA, 64 nt, Human; identical to SEQ ID NO: 94916

SEQ ID NO: 117273 - RNA, 64 nt, Human; identical to SEQ ID NO: 94917

SEQ ID NO: 117274 - RNA, 64 nt, Human; identical to SEQ ID NO: 94918

SEQ ID NO: 117275 - RNA, 64 nt, Human; identical to SEQ ID NO: 94919

SEQ ID NO: 117276 - RNA, 64 nt, Human; identical to SEQ ID NO: 94920

SEQ ID NO: 117277 - RNA, 64 nt, Human; identical to SEQ ID NO: 94921

SEQ ID NO: 117278 - RNA, 64 nt, Human; identical to SEQ ID NO: 94922

SEQ ID NO: 117279 - RNA, 64 nt, Human; identical to SEQ ID NO: 94923

SEQ ID NO: 117280 - RNA, 64 nt, Human; identical to SEQ ID NO: 94924

SEQ ID NO: 117281 - RNA, 64 nt, Human; identical to SEQ ID NO: 94925

SEQ ID NO: 117282 - RNA, 64 nt, Human; identical to SEQ ID NO: 94926

SEQ ID NO: 117283 - RNA, 64 nt, Human; identical to SEQ ID NO: 94927

SEQ ID NO: 117284 - RNA, 64 nt, Human; identical to SEQ ID NO: 94928

SEQ ID NO: 117285 - RNA, 64 nt, Human; identical to SEQ ID NO: 94929

SEQ ID NO: 117286 - RNA, 64 nt, Human; identical to SEQ ID NO: 94930

SEQ ID NO: 117287 - RNA, 64 nt, Human; identical to SEQ ID NO: 94931

SEQ ID NO: 117288 - RNA, 64 nt, Human; identical to SEQ ID NO: 94932

SEQ ID NO: 117289 - RNA, 64 nt, Human; identical to SEQ ID NO: 94933

SEQ ID NO: 117290 - RNA, 64 nt, Human; identical to SEQ ID NO: 94934

SEQ ID NO: 117291 - RNA, 64 nt, Human; identical to SEQ ID NO: 94935

SEQ ID NO: 117292 - RNA, 64 nt, Human; identical to SEQ ID NO: 94936

SEQ ID NO: 117293 - RNA, 64 nt, Human; identical to SEQ ID NO: 94937

SEQ ID NO: 117294 - RNA, 64 nt, Human; identical to SEQ ID NO: 94938

SEQ ID NO: 117295 - RNA, 64 nt, Human; identical to SEQ ID NO: 94939

SEQ ID NO: 117296 - RNA, 64 nt, Human; identical to SEQ ID NO: 94940

SEQ ID NO: 117297 - RNA, 64 nt, Human; identical to SEQ ID NO: 94941

SEQ ID NO: 117298 - RNA, 64 nt, Human; identical to SEQ ID NO: 94942

SEQ ID NO: 117299 - RNA, 64 nt, Human; identical to SEQ ID NO: 94943

SEQ ID NO: 117300 - RNA, 64 nt, Human; identical to SEQ ID NO: 94944

SEQ ID NO: 117301 - RNA, 64 nt, Human; identical to SEQ ID NO: 94945

SEQ ID NO: 117302 - RNA, 64 nt, Human; identical to SEQ ID NO: 94946

SEQ ID NO: 117303 - RNA, 64 nt, Human; identical to SEQ ID NO: 94947

SEQ ID NO: 117304 - RNA, 64 nt, Human; identical to SEQ ID NO: 94948

SEQ ID NO: 117305 - RNA, 64 nt, Human; identical to SEQ ID NO: 94949

SEQ ID NO: 117306 - RNA, 64 nt, Human; identical to SEQ ID NO: 94950

SEQ ID NO: 117307 - RNA, 64 nt, Human
gggcuaccugaaccaaggcgucucuuuaaguggggcgcccgaagucauuuuggacggccaccug

SEQ ID NO: 117308 - RNA, 64 nt, Human
gagccagguccuggggguaugggggcugccaggggcgcccgagcccucuccuggggggccugcu

SEQ ID NO: 117309 - RNA, 64 nt, Human
uaaagggagcggcccacggccuccagcguggggagcgcccgaguccucucggccacgagcugga

SEQ ID NO: 117310 - RNA, 64 nt, Human
gaccugcugccacuucucaucuacguggugucgcgcgcccgaauucagcaccugggagccgaga

SEQ ID NO: 117311 - RNA, 64 nt, Human
ccccuuucucuugcuguuuaccgcccacccagcagcgcccgaggccagggccgccgaagggcag

SEQ ID NO: 117312 - RNA, 64 nt, Human
agagcacagcccagcguuggggccgggaccgcuggcgcccgacgucggaagcauacagguauac

SEQ ID NO: 117313 - RNA, 64 nt, Human
ggccacacuggagcagcucccagcacagccuuacgcgcccgacgcgcgccacccgcggccccag

SEQ ID NO: 117314 - RNA, 64 nt, Human
cgguccugauacucauccugauaaucucuuaagagcgcccgagaagaagaaugaaacgccugua

SEQ ID NO: 117315 - RNA, 64 nt, Human
gacaacgcuguccccgcagcagcgccuccucccggcgcccgagagaccggcacgccacggcccc

SEQ ID NO: 117316 - RNA, 64 nt, Human
gucgccgccgcgguggggcgcgggcccggaggaggcgcccgagggaccaggccuuccggcgggc

SEQ ID NO: 117317 - RNA, 64 nt, Human
uucuguucucucuggcaggucaugaugaugggcagcgcccgaguggcggagcugcugcugcucc

SEQ ID NO: 117318 - RNA, 53 nt, Human
ccgaggaggggggcagcuagcgagcgcccgaacuggccaggacccccgcgccc

SEQ ID NO: 117319 - RNA, 54 nt, Human
gcucccagaccguuaccuagcccagcgcccgaaagccgucucuucuaugcaaua

SEQ ID NO: 117320 - RNA, 64 nt, Human
cugggcugagcgucccaggcauagaaaccucgaagcgcccgaggaaacgagggccugcuggcug

SEQ ID NO: 117321 - RNA, 64 nt, Human
guguuugcgcuugaccauguugcacuguuugcaugcgcccgaggcagacgucugucaggggcuu

SEQ ID NO: 117322 - RNA, 62 nt, Human
ggacucgugagaaggaguaggagcugcugcuggcgcccgagagggaaggagccggccugcug

SEQ ID NO: 117323 - RNA, 64 nt, Human
aaccagaguaaucaagacaauuauugaagagguggcgcccgacgguagaguucuuucaucuaug

SEQ ID NO: 117324 - RNA, 64 nt, Human
uguaggguuugcuuuuaaggaucggcucccugucgcgcccgaggagggccuggaccuuucgugu

SEQ ID NO: 117325 - RNA, 64 nt, Human
ccagccccgcuucggccccucccgggagauccgugcgcccgaccagcaccagcaucgcggaccg

SEQ ID NO: 117326 - RNA, 64 nt, Human
cggaaggcggcuuuccucccccuggugugaggucgcgcccgaggcuuguacccgcuagugaggu

SEQ ID NO: 117327 - RNA, 64 nt, Human
agaggagcccuaggcccuggccgcagugccuucagcgcccgacccgggcccccaccuggucagc

SEQ ID NO: 117328 - RNA, 64 nt, Human
ggcgguuugcggaggaugcagggauaugcucacagcgcccgacacaacccccucccgccgcccc

SEQ ID NO: 117329 - RNA, 64 nt, Human
ucgucuucgaccugucggcuguggaacccgcugagcgcccgagccgggcccgccuggagcugcg

SEQ ID NO: 117330 - RNA, 64 nt, Human
ccugugugacccucagucuuggccagccaugcaugcgcccgaagcucgugcaguuuguacguga

SEQ ID NO: 117331 - RNA, 64 nt, Human
ggcccugggcccggccaccguccuggggccgagggcgcccgacggccaggaucucgcuguaggu

SEQ ID NO: 117332 - RNA, 64 nt, Human
acaccugggaucgcgcagggcccgcagggcacaggcgcccgacagccgggcugagcggagucug

SEQ ID NO: 117333 - RNA, 64 nt, Human
cucucaucuccauucggcccccaggccggcgggcgcgcccgaagcgcccauccucgugguaggc

SEQ ID NO: 117334 - RNA, 64 nt, Human
gaucuucuacuugccuguggggaggggagugacagguccacacaccacacugggucacccuguc

SEQ ID NO: 117335 - RNA, 64 nt, Human
ugaagaacauggaugggaugcuggugguggaagcgguccacaaccucaaggcugucuucaaggg

SEQ ID NO: 117336 - RNA, 53 nt, Human
agaagaccaagcagaaguaaugugguccacagccaugcccuugaggagcuggc

SEQ ID NO: 117337 - RNA, 53 nt, Human
agaagaccaagcagaaguaaugugguccacagccaugcccuugaggagccggc

SEQ ID NO: 117338 - RNA, 64 nt, Human
gcugagaguuaggacaggucaggaagucccccaggguccacaaaggugccugaggcucugguaa

SEQ ID NO: 117339 - RNA, 64 nt, Human
ccaccagcaaggggaccccgagaacccugagcaggguccacagcuggaaaguugggccccugag

SEQ ID NO: 117340 - RNA, 64 nt, Human
gcauuauaggccccuuuguugggggcagccuguugguccacaccuacuugcucaggcaggugcu

SEQ ID NO: 117341 - RNA, 64 nt, Human
aauucauugauuacugaaaauugaauguuuuuuggguccacauuucaaggcugaaguguauagu

SEQ ID NO: 117342 - RNA, 64 nt, Human
agccucagucucccucccuuggggccuaugcagagguccacaacacacagauuugagcucagcc

SEQ ID NO: 117343 - RNA, 64 nt, Human
cuccagaguuaccauuaugaguguguucagcucugguccacagaggauggauaaaaaugguuug

SEQ ID NO: 117344 - RNA, 64 nt, Human
gacagacacagagggacccuuggcuccugugucugguccacacaccacagaagcuuguauuauc

SEQ ID NO: 117345 - RNA, 64 nt, Human
accucugagguccuggggauuuggggacccuugggguccacaugcaccuggcugaccuggcuga

SEQ ID NO: 117346 - RNA, 64 nt, Human
acuccagguggguguuagcacugugguggucucugguccacagccuuagguaaacaacuuagau

SEQ ID NO: 117347 - RNA, 64 nt, Human
acugaagcuaagagaagcuaaguaauaugcccaagguccacaucuaguaacagacaaagcuggg

SEQ ID NO: 117348 - RNA, 64 nt, Human
uggaggccuggacucccuuugcucacuccauucggguccacagcugagguugccgcugacaaga

SEQ ID NO: 117349 - RNA, 64 nt, Human
guugaacaauuccccagaugaugcugaugcuccugguccacaaugugagaaccacuaaguugga

SEQ ID NO: 117350 - RNA, 64 nt, Human
gauaacaaagaagaagcaauggucgugccaaagagguccacaaccaggugugcacuguucacug

SEQ ID NO: 117351 - RNA, 64 nt, Human
ggauccugcagcuggugacauggaacuguuuucugguccacaugaacacaggcuccauccaggc

SEQ ID NO: 117352 - RNA, 64 nt, Human
uggggcucacugcaggcuguggagaggucaugcugguccacaggaacacuuggcagugcucucg

SEQ ID NO: 117353 - RNA, 64 nt, Human
cagcccguggcccucccagacuugcugcuugcuugguccacagucggacugcauugcuuggguc

SEQ ID NO: 117354 - RNA, 64 nt, Human
aucuggcacuugaauuccugcuuuuauugcuggagguccacaucugugguugaccucuguuauu

SEQ ID NO: 117355 - RNA, 64 nt, Human
uacaaaugugaagaauauggcaaagccugugaaugguccacaaaccugaaugagcagaagaaaa

SEQ ID NO: 117356 - RNA, 64 nt, Human
aauaccuuuuauugacuguaauauuccacuguaugguccacaguguauauaaccaacaacucac

SEQ ID NO: 117357 - RNA, 64 nt, Human
auuagauuucuauucaaaguacuaauaucuacaugguccacacuuuucuauuuuaaaaaauugu

SEQ ID NO: 117358 - RNA, 64 nt, Human
acagugaagauguuuacucauugcccccaccucugguccacacuagaaagaagcucgccccacc

SEQ ID NO: 117359 - RNA, 64 nt, Human
acggagaggcuguagauccguguucuaaaccugggguccacagacacccccaagaagagcggau

SEQ ID NO: 117360 - RNA, 64 nt, Human
ugucacccucgugugggagccucugggcucggcagguccacauuucaugagcugaggcgugggc

SEQ ID NO: 117361 - RNA, 64 nt, Human
acugaaagauuggggaugauuugguuuuuuccuugguccacagguaggugucacaauugcuuug

SEQ ID NO: 117362 - RNA, 64 nt, Human
auaccauguaaagcuggcuuucuggagucugccagguccacacgaagugcuacccccaguuucu

SEQ ID NO: 117363 - RNA, 64 nt, Human
uucaucuugccugggaagcccaggaauuccaccugguccacaccggcagaaguuacaguagacu

SEQ ID NO: 117364 - RNA, 64 nt, Human
gaccucucccguagccucagaagagugcaguacugguccacagagaaggcuucaggaccugcuu

SEQ ID NO: 117365 - RNA, 64 nt, Human
uagauaaaguuugagugaguucauugggauaaaugguccacaaucuuaaacagaauacugugag

SEQ ID NO: 117366 - RNA, 64 nt, Human
uauugcucagggucuucugcuuaaaacugaggaagguccacauuccugcaagcauugauugaga

SEQ ID NO: 117367 - RNA, 64 nt, Human
auuagaacuuacuaugugcaaauauagaagcacggguccacagaguuccagagaaugaaugcug

SEQ ID NO: 117368 - RNA, 64 nt, Human
cuggcacagaacaguuccagaucuagacuggagagguccacagccuuguccagaguuccugugu

SEQ ID NO: 117369 - RNA, 58 nt, Human
aaagcucuuccacccuguaagggggaaggguccacauagaaaagcaagacaagccaga

SEQ ID NO: 117370 - RNA, 64 nt, Human
accgcccggcccgagguaucgcaugugcgggggagguccacacuacagcuguccucucgucuag

SEQ ID NO: 117371 - RNA, 64 nt, Human
gcuugcugucgccacucaugucuccuccacaugcgguccacacaucaguaagggccuggagaug

SEQ ID NO: 117372 - RNA, 64 nt, Human
aauagaagcauccuuuuuaaagagaaguugccuugguccacacacuaagcagaaaaccaaguua

SEQ ID NO: 117373 - RNA, 64 nt, Human
ugggcuacgguuccauguucaccaagauuugguggguccacacggucuucacaaagaaggaaga

SEQ ID NO: 117374 - RNA, 64 nt, Human
cgaggccugugcgucucccaaacacgcagcucaagguccacauccgcaaaagccuccucgccuu

SEQ ID NO: 117375 - RNA, 64 nt, Human
agagugggcucccgugggcccagagcugcacgccgguccacagacacacucacgcccgccaccu

SEQ ID NO: 117376 - RNA, 64 nt, Human
gagaagagagccagccacgccaugcugugccugggguccacagagccgggaggucacacaugua

SEQ ID NO: 117377 - RNA, 64 nt, Human
ccuuggaaccguccuuugguaaagggaagcuguggguccacauucccuucagcaucaccucuag

SEQ ID NO: 117378 - RNA, 64 nt, Human
uccugcugugaggauagugggugugacaauggaagguccacagagguuuuuguuuuuugguuuu

SEQ ID NO: 117379 - RNA, 64 nt, Human
cacuuuugggcacagccucccuccauaacugagugguccacagauuugcacuacggguucucca

SEQ ID NO: 117380 - RNA, 64 nt, Human
aucucaccuccacuaggacuuugaccuucccagggguccacacuuuaccuccuguaucuucaua

SEQ ID NO: 117381 - RNA, 64 nt, Human
uuccucucuggcgccuucugaacccgucucagcagguccacagcaccugggcagaggucagaga

SEQ ID NO: 117382 - RNA, 64 nt, Human
cccuggucucaucagucccucuccuggagcuggggguccacacaucucccagccaaguccaaga

SEQ ID NO: 117383 - RNA, 64 nt, Human
uuucccuugugaucaguccagagcuucuucgaaugguccacagagcaacuuccagugugagcag

SEQ ID NO: 117384 - RNA, 64 nt, Human
cacagaugacucaaccuaagcuuuacuuuccagagguccacagccugagagguguccccaaaga

SEQ ID NO: 117385 - RNA, 64 nt, Human
ggaaaaauucauugucucuagagauugucagcuugguccacaucaccagaaaucuaacucccug

SEQ ID NO: 117386 - RNA, 64 nt, Human
uagaaaggacauugcuuucucagccccacccccagguccacaguguccaagguaauggcacaca

SEQ ID NO: 117387 - RNA, 64 nt, Human
uuuuuagcccuucugcaagagaaaaacccucauggguccacauggugagaaguuaaguuuccug

SEQ ID NO: 117388 - RNA, 64 nt, Human
gccugcccuucuccacugcccccuccugugucuggguccacacacccuucaggaagggggagca

SEQ ID NO: 117389 - RNA, 64 nt, Human
uuaccaaagcaucaauacaaccagcccaaccaucgguccacaccugggcauuuggugagaguca

SEQ ID NO: 117390 - RNA, 64 nt, Human
cacucaccuucaguaacccccacuggacugaccugguccacagggcaccugccacccugggccu

SEQ ID NO: 117391 - RNA, 64 nt, Human
uugguuugacgcccuguuuucaguggccuggggagguccacacuggaagucgaauuccagcucg

SEQ ID NO: 117392 - RNA, 64 nt, Human
agccaaggcugggccagccuuuuuugggcagucagguccacaccuauguccagggcaccaggga

SEQ ID NO: 117393 - RNA, 64 nt, Human
ucucaguguuucaaccucaccagggcugucucuugguccacaccucgcucccuguuagugccgu

SEQ ID NO: 117394 - RNA, 64 nt, Human
aagccaacccugagcgagccuguccucuguggcagguccacacggugugggugggcagggcuug

SEQ ID NO: 117395 - RNA, 64 nt, Human
uuggcugggugguccgcacccuggcucuccugcagguccacacaccuuccaggccuguggccug

SEQ ID NO: 117396 - RNA, 64 nt, Human
cugcuugcacauugccugucccagagccccuguggguccacaagccccuguccucuuccuucau

SEQ ID NO: 117397 - RNA, 64 nt, Human
gcaagaaacacggucauucaaucacauugaggaggguccacauggcauugagagggugcugccc

SEQ ID NO: 117398 - RNA, 64 nt, Human
uaaaacauaagaucacugccagagauaaacuaaugguccacacccaauuccacucugauagaau

SEQ ID NO: 117399 - RNA, 64 nt, Human
ggccccuccagccccauuauagugcaccugaagggguccacagccuguguccuagaagagggaa

SEQ ID NO: 117400 - RNA, 64 nt, Human
ccucucaccggcuccccgagcguggcagccaccagguccacagaacuacugcagcccagaggac

SEQ ID NO: 117401 - RNA, 64 nt, Human
guagcagcauccuugggggaagggaaaggugcaugguccacaauguaugguuuggucccauggg

SEQ ID NO: 117402 - RNA, 64 nt, Human
ccaaccuccagggcagaaagagcccaggcuccgggguccacagcacaggauguggggcgagggc

SEQ ID NO: 117403 - RNA, 64 nt, Human
cccgucggcaggggcagcagggggcagggugcaggguccacauagguggugcacacgcaagccc

SEQ ID NO: 117404 - RNA, 64 nt, Human
ugucgggcaguccugaguggguguugcacagacugguccacagggcuccugaaggaagccccug

SEQ ID NO: 117405 - RNA, 64 nt, Human
cccucagcaaucuguccugucugugcucccauucgguccacauagcuuucuuugccucucugag

SEQ ID NO: 117406 - RNA, 64 nt, Human
cagcacaacugugaaacucuguauugcuucuuccgguccacacccuauacucaugacauuaaau

SEQ ID NO: 117407 - RNA, 64 nt, Human
cacuucuggcugccugguggccacugcuacagcugguccacagagaggagcacuugucucccca

SEQ ID NO: 117408 - RNA, 64 nt, Human
uuguuugggcuggcaagcaaauccgacacgacgagguccacaaacuguuucugcaucccagggc

SEQ ID NO: 117409 - RNA, 64 nt, Human
ucucgaucuugccauaacuuuacaggguaacuuggguccacagucacucuuugugccucaguuu

SEQ ID NO: 117410 - RNA, 64 nt, Human
acaacaccagccccacuucugggucaugcacugagguccacagaccuacugcacugaguuaaaa

SEQ ID NO: 117411 - RNA, 64 nt, Human
gauaaucuccacuggaaagguggaauugaaaugugguccacauuuuaacuagcuauuuccuggg

SEQ ID NO: 117412 - RNA, 64 nt, Human
ccugcugucagugcuucucucacuccuuaguugggguccacaucaguauuggaguuuuguucuu

SEQ ID NO: 117413 - RNA, 64 nt, Human
aggcggggcuuggaggcggucccaauguccccuggguccacaguggguccccuuuucacccuug

SEQ ID NO: 117414 - RNA, 64 nt, Human
uuauuucuuuuuuuuuuuuaaauaguaagucacagguccacacuguguaaacaugcaucugaua

SEQ ID NO: 117415 - RNA, 64 nt, Human
cuccaaggacaagugaaggucagccggccgggcggguccacaguuaccagcacgcugucucaga

SEQ ID NO: 117416 - RNA, 64 nt, Human
gugacaugucaucccuugauaugucugcaugcaagguccacacccaaaagugucaauguuugcc

SEQ ID NO: 117417 - RNA, 58 nt, Human
gaccuuguuggcaagucugauaccuguugguccacaucaucuuuucagaagaaaauaa

SEQ ID NO: 117418 - RNA, 64 nt, Human
auuugauugaauguuugcugaaguuuugucucuugguccacaguauuuggaaaggucacugaaa

SEQ ID NO: 117419 - RNA, 64 nt, Human
cgugagaguugaauaguugcaucagagaguauaugguccacaagccuaacuuauucacucucug

SEQ ID NO: 117420 - RNA, 64 nt, Human
accuaauugaaagaaaaccaucugaauuguugcagguccacauuuuugccaaagauacacucua

SEQ ID NO: 117421 - RNA, 64 nt, Human
cccuaacaucaugcauucacaaggucaaaguucugguccacaaacccuucccuauagaaguuca

SEQ ID NO: 117422 - RNA, 64 nt, Human
uagaggguuuuggcuguugcuuuuuuuaaaguuagguccacacagugaagggaaaagagucugu

SEQ ID NO: 117423 - RNA, 64 nt, Human
guaggcagggcgucccuggcucaccaaugcgucugguccacauggcauuugggaaagcagaugg

SEQ ID NO: 117424 - RNA, 64 nt, Human
ucugugcucaggacucagaagccucugggucagugguccacaucccgggacgcagcaggaggcc

SEQ ID NO: 117425 - RNA, 64 nt, Human
gagccauguuaauguaaucugauggcuucuccaggguccacaggaagugaagaaucuguuuccc

SEQ ID NO: 117426 - RNA, 64 nt, Human
aggugaaguugugaccaucuggcugggaagcccagguccacacaguguaggagcagauguuuug

SEQ ID NO: 117427 - RNA, 64 nt, Human
gaggagagggagaaagggaagucccagggcccgggguccacagaggaugaggguuguggcaggg

SEQ ID NO: 117428 - RNA, 64 nt, Human
ccguccucccuccuagggucuuguguugcaaguugguccacagcaucuccggggcuuuguggga

SEQ ID NO: 117429 - RNA, 64 nt, Human
gcguuucccagaacgaacacuaggcggcaccguugguccacacucagaggcccuuggcgccaag

SEQ ID NO: 117430 - RNA, 64 nt, Human
agagcuagcauggaacucacaccacagcuucccugguccacagaggcucucaccgccauugcca

SEQ ID NO: 117431 - RNA, 64 nt, Human
guucagucugaaugcugccacaaccagccaggcagguccacagagagggagagcagagaaagaa

SEQ ID NO: 117432 - RNA, 64 nt, Human
aagccaaaguugacuguguucuugucccgcagccgguccacacugugaggccaggccucaacuu

SEQ ID NO: 117433 - RNA, 64 nt, Human
cgugucuagaggcagguagggggucccuccaagugguccacaagcuucuguccugcccccaagg

SEQ ID NO: 117434 - RNA, 64 nt, Human
agugagccaggaucaugccacugcacuccagccugguccacagagagacacugucacccccuuu

SEQ ID NO: 117435 - RNA, 64 nt, Human
ugaacccaaucuuaaaggagguucucaugcccaggguccacagugaccagccagcaagucucug

SEQ ID NO: 117436 - RNA, 64 nt, Human
aaggcuccaggcccgugugucugaagcagugagugguccacacaggugccaggagugcccauau

SEQ ID NO: 117437 - RNA, 58 nt, Human
augagggcacaagguccuagagacauuagguccacaugaauagcagaacugacuuuga

SEQ ID NO: 117438 - RNA, 64 nt, Human
ugcuaccuucacuucuccccagcucugcccucuggguccacaugaggacagggaagcucgggaa

SEQ ID NO: 117439 - RNA, 64 nt, Human
gcgaacauugaaucucagggauggcccacaacuggguccacauguaaugagcccuguuuaauaa

SEQ ID NO: 117440 - RNA, 64 nt, Human
uuaggggcccgcgcugcacaggaaaguucccuuugguccacagggccauuucaagcaaguucaa

SEQ ID NO: 117441 - RNA, 64 nt, Human
agcuaaaagugaaggaaacgucucaagugacuuugguccacacugagauucugaagcuuuuccc

SEQ ID NO: 117442 - RNA, 64 nt, Human
cccaagucaggguccagaacugccccccaacacagguccacagacaccccaccaccuaggcagg

SEQ ID NO: 117443 - RNA, 64 nt, Human
agccguggcugaggccacccccagaggagccccugguccacagaagcaggccuuguguuuccag

SEQ ID NO: 117444 - RNA, 64 nt, Human
ugaucucugcccacggaaaggauuuaauccaaaugguccacaagaggaaugugcuuaauuccua

SEQ ID NO: 117445 - RNA, 64 nt, Human
gcggcuuccgggguguggcugccgggucggcucugguccacagcacggugccggggcugcaggu

SEQ ID NO: 117446 - RNA, 64 nt, Human
ucuggacggagcaggcacccugaucucauucugagguccacauggcaccuucugggccagcagc

SEQ ID NO: 117447 - RNA, 64 nt, Human
ggaggccaccaggagcauccaugagcggggaagggguccacacccuuacauggcaaguugauac

SEQ ID NO: 117448 - RNA, 64 nt, Human
gcuucgugcccugcucuggggcccaggcggggcugguccacauucccaggccccaacagccuuc

SEQ ID NO: 117449 - RNA, 64 nt, Human
gggccuaggaugggacguuuuucuucuugggcccgguccacagguccaaggacacccucccucc

SEQ ID NO: 117450 - RNA, 64 nt, Human
ggcccgcccaugcggguugcuacguccccuucuugguccacagucugcccucaucccucuggca

SEQ ID NO: 117451 - RNA, 64 nt, Human
agacucaaauguucuaaguuucuaagauucuaaagguccacaggucuagacuauuaggugcaau

SEQ ID NO: 117452 - RNA, 64 nt, Human
cugaugaccaaacucucccuuuccccauccaaucgguccacacuccccgcccuggccucuggua

SEQ ID NO: 117453 - RNA, 64 nt, Human
caugccuccugacggggagacaccucccagcagggguccacagacaccucauacaggagagcuc

SEQ ID NO: 117454 - RNA, 64 nt, Human
gaggcagaagccguaucaugucuaccaccugugagguccacacaguguguaucauuuaccuccu

SEQ ID NO: 117455 - RNA, 64 nt, Human
acagaaagcaaggggugccuaaaucuagacuugggguccacaccgggcagcgggguugcaaccc

SEQ ID NO: 117456 - RNA, 64 nt, Human
acugggccaccagcuucccucccuugacucuggggguccacauccacuccaaggggacuauucc

SEQ ID NO: 117457 - RNA, 64 nt, Human
aaugacgauaauguauucaggaaguuaaaauguagguccacauuuuauuuaguugaccucucua

SEQ ID NO: 117458 - RNA, 64 nt, Human
cugaugaccaaacucucccuuucuccauccaaucgguccacacuccccgcccccggccucuggu

SEQ ID NO: 117459 - RNA, 64 nt, Human
aagucccaggugggacucuucuggggacacuugggguccacaaucccagguccauacucuaggu

SEQ ID NO: 117460 - RNA, 64 nt, Human
aggaggaaaaacacaguccuagggacaaaagccagguccacagcagucauuuuuaaaauaaagu

SEQ ID NO: 117461 - RNA, 64 nt, Human
ccaggcauaguaccuuugccuguguuugcucccugguccacagauuugguggcugggcaggugc

SEQ ID NO: 117462 - RNA, 64 nt, Human
gcagagcuguguuaccgucuuggccucggggucugguccacacucugugcucccagccuugagg

SEQ ID NO: 117463 - RNA, 64 nt, Human
gaagccgggguaggaggaucaccagaggccagcagguccacaccagccugggcaacacagcaag

SEQ ID NO: 117464 - RNA, 64 nt, Human
caggaggagacagucaggaagccuccugcugagugguccacauucugcugcccccagaccccau

SEQ ID NO: 117465 - RNA, 64 nt, Human
acuguacucccucagcaucagagcaugcaucagggguccacacaggcucagcucucuccaccac

SEQ ID NO: 117466 - RNA, 64 nt, Human
uuugauuaacucuaagaguuuaguugcuaccucagguccacaggcaggacuuccuccaacccuc

SEQ ID NO: 117467 - RNA, 64 nt, Human
ccuguugggaccagccacucaccaaggcugaguagguccacaaauaauggggacuuucuaccag

SEQ ID NO: 117468 - RNA, 64 nt, Human
uaggcaaagggaugggcaugagcgaaggcuccaggguccacagagcagggaguguggagaaggu

SEQ ID NO: 117469 - RNA, 64 nt, Human
cacucaggccacuggcacguugggccaggcagaagguccacauggcagggcugccuggaacacc

SEQ ID NO: 117470 - RNA, 64 nt, Human
agggaggccccaggaggggaucuggccagucaaggguccacagggugccagccucucacccuca

SEQ ID NO: 117471 - RNA, 64 nt, Human
ugacauucuuuggacuguauugugacugcugucugguccacaugguaccccuuugguaaguagg

SEQ ID NO: 117472 - RNA, 64 nt, Human
ccugcugcuacaucaugagauagcccuguggaaagguccacaugagugaacuuugaagcauauc

SEQ ID NO: 117473 - RNA, 64 nt, Human
auuugcuccggccaaauuggccguuagccaccuggguccacauccugcuaagacguuuaaaaca

SEQ ID NO: 117474 - RNA, 64 nt, Human
gccuucuagaauacauauuacaagaaaacuacaggguccacacggcaaucagaagaaaggagcu

SEQ ID NO: 117475 - RNA, 64 nt, Human
cccgacuuuugccacccuccugaggaagccccuagguccacacagugaugccaugggggacccu

SEQ ID NO: 117476 - RNA, 64 nt, Human
gggccucagucuuccgcccccagcccacucucaugguccacacugcugggggaaagggaaagga

SEQ ID NO: 117477 - RNA, 64 nt, Human
aaguuuucugaggcuggcuguaaaguaaguguaagguccacauccuuggggaaguaguuaaaua

SEQ ID NO: 117478 - RNA, 64 nt, Human
ccacugagaacuaugcaauggaguuucaugaaaugguccacauaguggggaaguagccaggaaa

SEQ ID NO: 117479 - RNA, 64 nt, Human
uuuaggggaagugagauuuaaaaaaccauucacagguccacaauauucauacuauguguuugca

SEQ ID NO: 117480 - RNA, 64 nt, Human
agagcaaaauucaauuuaagaugggcuucucugagguccacaucauggcaguucauuuacucuu

SEQ ID NO: 117481 - RNA, 64 nt, Human; identical to SEQ ID NO: 42454

SEQ ID NO: 117482 - RNA, 64 nt, Human; identical to SEQ ID NO: 42455

SEQ ID NO: 117483 - RNA, 64 nt, Human; identical to SEQ ID NO: 42456

SEQ ID NO: 117484 - RNA, 64 nt, Human; identical to SEQ ID NO: 42457

SEQ ID NO: 117485 - RNA, 64 nt, Human; identical to SEQ ID NO: 42458

SEQ ID NO: 117486 - RNA, 64 nt, Human; identical to SEQ ID NO: 42459

SEQ ID NO: 117487 - RNA, 64 nt, Human; identical to SEQ ID NO: 42460

SEQ ID NO: 117488 - RNA, 64 nt, Human; identical to SEQ ID NO: 42461

SEQ ID NO: 117489 - RNA, 64 nt, Human; identical to SEQ ID NO: 42462

SEQ ID NO: 117490 - RNA, 64 nt, Human; identical to SEQ ID NO: 42463

SEQ ID NO: 117491 - RNA, 64 nt, Human; identical to SEQ ID NO: 42464

SEQ ID NO: 117492 - RNA, 64 nt, Human; identical to SEQ ID NO: 42465

SEQ ID NO: 117493 - RNA, 64 nt, Human; identical to SEQ ID NO: 42466

SEQ ID NO: 117494 - RNA, 64 nt, Human; identical to SEQ ID NO: 42467

SEQ ID NO: 117495 - RNA, 64 nt, Human; identical to SEQ ID NO: 42468

SEQ ID NO: 117496 - RNA, 64 nt, Human; identical to SEQ ID NO: 42469

SEQ ID NO: 117497 - RNA, 64 nt, Human; identical to SEQ ID NO: 42470

SEQ ID NO: 117498 - RNA, 64 nt, Human; identical to SEQ ID NO: 42471

SEQ ID NO: 117499 - RNA, 64 nt, Human; identical to SEQ ID NO: 42472

SEQ ID NO: 117500 - RNA, 64 nt, Human; identical to SEQ ID NO: 42473

SEQ ID NO: 117501 - RNA, 64 nt, Human; identical to SEQ ID NO: 42474

SEQ ID NO: 117502 - RNA, 64 nt, Human; identical to SEQ ID NO: 42475

SEQ ID NO: 117503 - RNA, 64 nt, Human; identical to SEQ ID NO: 42476

SEQ ID NO: 117504 - RNA, 64 nt, Human; identical to SEQ ID NO: 42477

SEQ ID NO: 117505 - RNA, 64 nt, Human; identical to SEQ ID NO: 42478

SEQ ID NO: 117506 - RNA, 64 nt, Human; identical to SEQ ID NO: 42479

SEQ ID NO: 117507 - RNA, 64 nt, Human; identical to SEQ ID NO: 42480

SEQ ID NO: 117508 - RNA, 64 nt, Human; identical to SEQ ID NO: 42481

SEQ ID NO: 117509 - RNA, 64 nt, Human; identical to SEQ ID NO: 42482

SEQ ID NO: 117510 - RNA, 64 nt, Human; identical to SEQ ID NO: 42483

SEQ ID NO: 117511 - RNA, 64 nt, Human; identical to SEQ ID NO: 42484

SEQ ID NO: 117512 - RNA, 64 nt, Human; identical to SEQ ID NO: 42485

SEQ ID NO: 117513 - RNA, 64 nt, Human; identical to SEQ ID NO: 42486

SEQ ID NO: 117514 - RNA, 64 nt, Human; identical to SEQ ID NO: 42487

SEQ ID NO: 117515 - RNA, 64 nt, Human; identical to SEQ ID NO: 42488

SEQ ID NO: 117516 - RNA, 64 nt, Human; identical to SEQ ID NO: 42489

SEQ ID NO: 117517 - RNA, 64 nt, Human; identical to SEQ ID NO: 42490

SEQ ID NO: 117518 - RNA, 64 nt, Human; identical to SEQ ID NO: 42491

SEQ ID NO: 117519 - RNA, 64 nt, Human; identical to SEQ ID NO: 42492

SEQ ID NO: 117520 - RNA, 64 nt, Human; identical to SEQ ID NO: 42493

SEQ ID NO: 117521 - RNA, 64 nt, Human; identical to SEQ ID NO: 42494

SEQ ID NO: 117522 - RNA, 64 nt, Human; identical to SEQ ID NO: 42495

SEQ ID NO: 117523 - RNA, 64 nt, Human; identical to SEQ ID NO: 42496

SEQ ID NO: 117524 - RNA, 64 nt, Human; identical to SEQ ID NO: 42497

SEQ ID NO: 117525 - RNA, 64 nt, Human; identical to SEQ ID NO: 42498

SEQ ID NO: 117526 - RNA, 64 nt, Human; identical to SEQ ID NO: 42499

SEQ ID NO: 117527 - RNA, 64 nt, Human; identical to SEQ ID NO: 42500

SEQ ID NO: 117528 - RNA, 64 nt, Human; identical to SEQ ID NO: 42501

SEQ ID NO: 117529 - RNA, 64 nt, Human; identical to SEQ ID NO: 42502

SEQ ID NO: 117530 - RNA, 64 nt, Human; identical to SEQ ID NO: 42503

SEQ ID NO: 117531 - RNA, 50 nt, Human; identical to SEQ ID NO: 42504

SEQ ID NO: 117532 - RNA, 64 nt, Human; identical to SEQ ID NO: 42505

SEQ ID NO: 117533 - RNA, 64 nt, Human; identical to SEQ ID NO: 42506

SEQ ID NO: 117534 - RNA, 64 nt, Human; identical to SEQ ID NO: 42507

SEQ ID NO: 117535 - RNA, 64 nt, Human; identical to SEQ ID NO: 42508

SEQ ID NO: 117536 - RNA, 64 nt, Human; identical to SEQ ID NO: 42509

SEQ ID NO: 117537 - RNA, 64 nt, Human; identical to SEQ ID NO: 42510

SEQ ID NO: 117538 - RNA, 64 nt, Human; identical to SEQ ID NO: 42511

SEQ ID NO: 117539 - RNA, 64 nt, Human; identical to SEQ ID NO: 42512

SEQ ID NO: 117540 - RNA, 64 nt, Human; identical to SEQ ID NO: 42513

SEQ ID NO: 117541 - RNA, 64 nt, Human; identical to SEQ ID NO: 42514

SEQ ID NO: 117542 - RNA, 64 nt, Human; identical to SEQ ID NO: 42515

SEQ ID NO: 117543 - RNA, 64 nt, Human; identical to SEQ ID NO: 42516

SEQ ID NO: 117544 - RNA, 64 nt, Human; identical to SEQ ID NO: 42517

SEQ ID NO: 117545 - RNA, 64 nt, Human; identical to SEQ ID NO: 42518

SEQ ID NO: 117546 - RNA, 64 nt, Human; identical to SEQ ID NO: 42519

SEQ ID NO: 117547 - RNA, 64 nt, Human; identical to SEQ ID NO: 42520

SEQ ID NO: 117548 - RNA, 64 nt, Human; identical to SEQ ID NO: 42521

SEQ ID NO: 117549 - RNA, 64 nt, Human; identical to SEQ ID NO: 42522

SEQ ID NO: 117550 - RNA, 64 nt, Human; identical to SEQ ID NO: 42523

SEQ ID NO: 117551 - RNA, 64 nt, Human; identical to SEQ ID NO: 42524

SEQ ID NO: 117552 - RNA, 64 nt, Human; identical to SEQ ID NO: 42525

SEQ ID NO: 117553 - RNA, 64 nt, Human
ccacuagguguccccaacguccccuccgccgugccggcggcagccccacuucacccccaacuuc

SEQ ID NO: 117554 - RNA, 64 nt, Human; identical to SEQ ID NO: 42454

SEQ ID NO: 117555 - RNA, 64 nt, Human; identical to SEQ ID NO: 42455

SEQ ID NO: 117556 - RNA, 64 nt, Human; identical to SEQ ID NO: 42456

SEQ ID NO: 117557 - RNA, 64 nt, Human; identical to SEQ ID NO: 42457

SEQ ID NO: 117558 - RNA, 64 nt, Human; identical to SEQ ID NO: 42458

SEQ ID NO: 117559 - RNA, 64 nt, Human; identical to SEQ ID NO: 42459

SEQ ID NO: 117560 - RNA, 64 nt, Human; identical to SEQ ID NO: 42460

SEQ ID NO: 117561 - RNA, 64 nt, Human; identical to SEQ ID NO: 42461

SEQ ID NO: 117562 - RNA, 64 nt, Human; identical to SEQ ID NO: 42462

SEQ ID NO: 117563 - RNA, 64 nt, Human; identical to SEQ ID NO: 42463

SEQ ID NO: 117564 - RNA, 64 nt, Human; identical to SEQ ID NO: 42464

SEQ ID NO: 117565 - RNA, 64 nt, Human; identical to SEQ ID NO: 42465

SEQ ID NO: 117566 - RNA, 64 nt, Human; identical to SEQ ID NO: 42466

SEQ ID NO: 117567 - RNA, 64 nt, Human; identical to SEQ ID NO: 42467

SEQ ID NO: 117568 - RNA, 64 nt, Human; identical to SEQ ID NO: 42468

SEQ ID NO: 117569 - RNA, 64 nt, Human; identical to SEQ ID NO: 42469

SEQ ID NO: 117570 - RNA, 64 nt, Human; identical to SEQ ID NO: 42470

SEQ ID NO: 117571 - RNA, 64 nt, Human; identical to SEQ ID NO: 42471

SEQ ID NO: 117572 - RNA, 64 nt, Human; identical to SEQ ID NO: 42472

SEQ ID NO: 117573 - RNA, 64 nt, Human; identical to SEQ ID NO: 42473

SEQ ID NO: 117574 - RNA, 64 nt, Human; identical to SEQ ID NO: 42474

SEQ ID NO: 117575 - RNA, 64 nt, Human; identical to SEQ ID NO: 42475

SEQ ID NO: 117576 - RNA, 64 nt, Human; identical to SEQ ID NO: 42476

SEQ ID NO: 117577 - RNA, 64 nt, Human; identical to SEQ ID NO: 42477

SEQ ID NO: 117578 - RNA, 64 nt, Human; identical to SEQ ID NO: 42478

SEQ ID NO: 117579 - RNA, 64 nt, Human; identical to SEQ ID NO: 42479

SEQ ID NO: 117580 - RNA, 64 nt, Human; identical to SEQ ID NO: 42480

SEQ ID NO: 117581 - RNA, 64 nt, Human; identical to SEQ ID NO: 42481

SEQ ID NO: 117582 - RNA, 64 nt, Human; identical to SEQ ID NO: 42482

SEQ ID NO: 117583 - RNA, 64 nt, Human; identical to SEQ ID NO: 42483

SEQ ID NO: 117584 - RNA, 64 nt, Human; identical to SEQ ID NO: 42484

SEQ ID NO: 117585 - RNA, 64 nt, Human; identical to SEQ ID NO: 42485

SEQ ID NO: 117586 - RNA, 64 nt, Human; identical to SEQ ID NO: 42486

SEQ ID NO: 117587 - RNA, 64 nt, Human; identical to SEQ ID NO: 42487

SEQ ID NO: 117588 - RNA, 64 nt, Human; identical to SEQ ID NO: 42488

SEQ ID NO: 117589 - RNA, 64 nt, Human; identical to SEQ ID NO: 42489

SEQ ID NO: 117590 - RNA, 64 nt, Human; identical to SEQ ID NO: 42490

SEQ ID NO: 117591 - RNA, 64 nt, Human; identical to SEQ ID NO: 42491

SEQ ID NO: 117592 - RNA, 64 nt, Human; identical to SEQ ID NO: 42492

SEQ ID NO: 117593 - RNA, 64 nt, Human; identical to SEQ ID NO: 42493

SEQ ID NO: 117594 - RNA, 64 nt, Human; identical to SEQ ID NO: 42494

SEQ ID NO: 117595 - RNA, 64 nt, Human; identical to SEQ ID NO: 42495

SEQ ID NO: 117596 - RNA, 64 nt, Human; identical to SEQ ID NO: 42496

SEQ ID NO: 117597 - RNA, 64 nt, Human; identical to SEQ ID NO: 42497

SEQ ID NO: 117598 - RNA, 64 nt, Human; identical to SEQ ID NO: 42498

SEQ ID NO: 117599 - RNA, 64 nt, Human; identical to SEQ ID NO: 42499

SEQ ID NO: 117600 - RNA, 64 nt, Human; identical to SEQ ID NO: 42500

SEQ ID NO: 117601 - RNA, 64 nt, Human; identical to SEQ ID NO: 42501

SEQ ID NO: 117602 - RNA, 64 nt, Human; identical to SEQ ID NO: 42502

SEQ ID NO: 117603 - RNA, 64 nt, Human; identical to SEQ ID NO: 42503

SEQ ID NO: 117604 - RNA, 50 nt, Human; identical to SEQ ID NO: 42504

SEQ ID NO: 117605 - RNA, 64 nt, Human; identical to SEQ ID NO: 42505

SEQ ID NO: 117606 - RNA, 64 nt, Human; identical to SEQ ID NO: 42506

SEQ ID NO: 117607 - RNA, 64 nt, Human; identical to SEQ ID NO: 42507

SEQ ID NO: 117608 - RNA, 64 nt, Human; identical to SEQ ID NO: 42508

SEQ ID NO: 117609 - RNA, 64 nt, Human; identical to SEQ ID NO: 42509

SEQ ID NO: 117610 - RNA, 64 nt, Human; identical to SEQ ID NO: 42510

SEQ ID NO: 117611 - RNA, 64 nt, Human; identical to SEQ ID NO: 42511

SEQ ID NO: 117612 - RNA, 64 nt, Human; identical to SEQ ID NO: 42512

SEQ ID NO: 117613 - RNA, 64 nt, Human; identical to SEQ ID NO: 42513

SEQ ID NO: 117614 - RNA, 64 nt, Human; identical to SEQ ID NO: 42514

SEQ ID NO: 117615 - RNA, 64 nt, Human; identical to SEQ ID NO: 42515

SEQ ID NO: 117616 - RNA, 64 nt, Human; identical to SEQ ID NO: 42516

SEQ ID NO: 117617 - RNA, 64 nt, Human; identical to SEQ ID NO: 42517

SEQ ID NO: 117618 - RNA, 64 nt, Human; identical to SEQ ID NO: 42518

SEQ ID NO: 117619 - RNA, 64 nt, Human; identical to SEQ ID NO: 42519

SEQ ID NO: 117620 - RNA, 64 nt, Human; identical to SEQ ID NO: 42520

SEQ ID NO: 117621 - RNA, 64 nt, Human; identical to SEQ ID NO: 42521

SEQ ID NO: 117622 - RNA, 64 nt, Human; identical to SEQ ID NO: 42522

SEQ ID NO: 117623 - RNA, 64 nt, Human; identical to SEQ ID NO: 42523

SEQ ID NO: 117624 - RNA, 64 nt, Human; identical to SEQ ID NO: 42524

SEQ ID NO: 117625 - RNA, 64 nt, Human; identical to SEQ ID NO: 42525

SEQ ID NO: 117626 - RNA, 64 nt, Human
caugauucagcaaacaaugaguaccuacuguguguagaagcagcaggacagccugucaucacug

SEQ ID NO: 117627 - RNA, 64 nt, Human
gccucucuaggaagcuguuccuuucuaugcccaauagaagcaacaaggcccuagcuggagacuc

SEQ ID NO: 117628 - RNA, 64 nt, Human
ggaaaugaaaggugaauuaugccccuuauuggucuagaagcauugguuuuuuuuugauccucug

SEQ ID NO: 117629 - RNA, 64 nt, Human
guacuacuuacaccaaagcacuugugcucuaggcuagaagcauuguauuaaagccaugaauacu

SEQ ID NO: 117630 - RNA, 64 nt, Human
acacagaauuuuacaucuaagcaaggacuggcuuuagaagcaguguaguucuaccucucauuuu

SEQ ID NO: 117631 - RNA, 64 nt, Human
uaguaccauuguaguuauaaacaucugcauuuuuuagaagcauuuuacccauuuauuuuuuuaa

SEQ ID NO: 117632 - RNA, 64 nt, Human
aagacugacugacuucaaggaaucagaaauuaccuagaagcaccauguuuuuucuaugaccuuu

SEQ ID NO: 117633 - RNA, 64 nt, Human
acaauacuuuucaggcacuuuagaaauauccuuuuagaagcagcgagugcaugggcuaauuauc

SEQ ID NO: 117634 - RNA, 64 nt, Human
cccuuuuuugcccacagcuugccuacucucggccuagaagcaguuauucucucuccauauuggg

SEQ ID NO: 117635 - RNA, 64 nt, Human
gcuucuccucauuccaauguguuuugcuucaugcuagaagcauaugcaacagugaauaaaagcu

SEQ ID NO: 117636 - RNA, 64 nt, Human
agguucaguagguagagaccaagcaucuaucugauagaagcacauggagugcaauaggacauug

SEQ ID NO: 117637 - RNA, 64 nt, Human
ugaauguaaaugccuuaauauugaagguccugguuagaagcaugauacaagacaucuacuggau

SEQ ID NO: 117638 - RNA, 64 nt, Human
cuaauaauaaauguggauuuuguauuaaaauauauagaagcaauuucuguuuacauguccuugc

SEQ ID NO: 117639 - RNA, 64 nt, Human
uugcaucuugucugcaaacaggucccugccuuuuuagaagcagccucauggucucaugcuuaau

SEQ ID NO: 117640 - RNA, 64 nt, Human
caugcaccuuacaauuucugaacaguuaacccuauagaagcaugcuuuauaugagugucuucug

SEQ ID NO: 117641 - RNA, 64 nt, Human
gagugacacccagcgacaaccgacuggggagugguagaagcaacugaacggaugcgugcgagcu

SEQ ID NO: 117642 - RNA, 64 nt, Human
gaggagaauacuugaagcaguaugcugcugugguuagaagcagauuuuauacuuuuaacuggaa

SEQ ID NO: 117643 - RNA, 64 nt, Human
auuuagcugauggcuaaauagcaaaauuuauauuuagaagcaaaaaaaaaaagcauagagaugu

SEQ ID NO: 117644 - RNA, 64 nt, Human
agcacauauagauagauucaucucguuuuuucaauagaagcagaguauucguuuuacucaauug

SEQ ID NO: 117645 - RNA, 64 nt, Human
ccuugauguuuggggucuuugugguagcuuaucuuagaagcacuacaccuugccuugcuguuug

SEQ ID NO: 117646 - RNA, 64 nt, Human
gaaguggaauuuuugguauaaagcuaaauggucuuagaagcauagaaaaucccuaugugccaaa

SEQ ID NO: 117647 - RNA, 64 nt, Human
uuaugacuaaaauuuaacaaauaguauuuucuuauagaagcaauguauuaaaugauuagauaca

SEQ ID NO: 117648 - RNA, 64 nt, Human
augcaacaggauaccucccuuccaaacugaacuguagaagcagagcagcagcaguuaugugaug

SEQ ID NO: 117649 - RNA, 64 nt, Human
uaucaaauagaagagggcugggagaaggggugauuagaagcagagugagggaacuaaauggagc

SEQ ID NO: 117650 - RNA, 64 nt, Human
uugguugcuuuuuugucacaaguaacuuggaaaauagaagcagaauaguaaagguucuauucag

SEQ ID NO: 117651 - RNA, 64 nt, Human
uuauagauggugccaaagcuaaccuuacauuucuuagaagcaaaauauuacaaaugcauuacca

SEQ ID NO: 117652 - RNA, 64 nt, Human
ccugaaauccucuuuuaggcaauaggccgagcuuuagaagcagccaggucuggugagaaauggg

SEQ ID NO: 117653 - RNA, 64 nt, Human
agucgacauacucauuugguuuaagcaggaauccuagaagcaaauggauggggauaagaauagg

SEQ ID NO: 117654 - RNA, 64 nt, Human
guaguucagcuaccugauuacugccccauucuuuuagaagcacaugucugccaaggagugguuu

SEQ ID NO: 117655 - RNA, 64 nt, Human
acuacauagagauaaauuaagaaagaugccuaaauagaagcaaguuuaaagagcuauauuuuua

SEQ ID NO: 117656 - RNA, 64 nt, Human
ucuaccuuuccaaguucucacugcuggaaagagcuagaagcacaguucaaaguucuggcuucug

SEQ ID NO: 117657 - RNA, 64 nt, Human
ugacccaaacauuaaaaugacaggaaagagaaaguagaagcagcaauaaauacugccccaacuu

SEQ ID NO: 117658 - RNA, 64 nt, Human
uuaaguuccuccuauuugccacugggcuguugguuagaagcauagguaacugauuaaguaggua

SEQ ID NO: 117659 - RNA, 64 nt, Human
gcaaucccacuucagccucuugaauagcugggacuagaagcaugcaccaccaugcccaucuaau

SEQ ID NO: 117660 - RNA, 64 nt, Human
acacccugccauaggggcaguccugccuuacacauagaagcauucaugccugcugcccugcccu

SEQ ID NO: 117661 - RNA, 64 nt, Human
gaagucaacuuacuucaacaaaaaaguuuggauguagaagcagcuguaagaauucaacuguuua

SEQ ID NO: 117662 - RNA, 64 nt, Human
ugaagucuccugcccacagccacauuagugaaccuagaagcagagacucugugagauaaucgau

SEQ ID NO: 117663 - RNA, 64 nt, Human
ggagacagaaacugaaucccacaccuggugcaauuagaagcauaauuagaagcagaagaacaaa

SEQ ID NO: 117664 - RNA, 64 nt, Human
ugaaucccacaccuggugcaauuagaagcauaauuagaagcagaagaacaaaaugccacguaac

SEQ ID NO: 117665 - RNA, 64 nt, Human
uguacagucuguccaaaugggucaagguugccuuuagaagcaaauagugugauuuucaagacuu

SEQ ID NO: 117666 - RNA, 64 nt, Human
uagcuuuagggcuccuccugaguucggcccacaguagaagcaagauuuuaacuagccccuuuuc

SEQ ID NO: 117667 - RNA, 64 nt, Human
gccggugauugccacgaugugauugcaauacucuuagaagcaccauauuaucccagacauguuc

SEQ ID NO: 117668 - RNA, 64 nt, Human
aguucugaagggggccagauguugggugcagauguagaagcagccagucacagacccauucuau

SEQ ID NO: 117669 - RNA, 64 nt, Human
cagcuaauggcaguaccugucucuuguguagaccuagaagcaaucgguggugccucucagagac

SEQ ID NO: 117670 - RNA, 64 nt, Human
uacccacgugacaccaccgaauauauuacugauuuagaagcaaagauuucaguagaauuuuagu

SEQ ID NO: 117671 - RNA, 64 nt, Human
uaacauuuaaaaauguuaaagaacugcuuaguauuagaagcagaucauuucccaaaauucuaag

SEQ ID NO: 117672 - RNA, 64 nt, Human
cacuucacagcaugguuaucauguaagcugcagguagaagcaaagcuguaaaguagauuuauca

SEQ ID NO: 117673 - RNA, 64 nt, Human
agacacuuaaauucugacccauaaaggaaaguucuagaagcaauauuuucacuuauuuaacauu

SEQ ID NO: 117674 - RNA, 64 nt, Human
uucugccaugaguaaaaauuccccgaggacucccuagaagcagauguugccacgcuuccuauau

SEQ ID NO: 117675 - RNA, 64 nt, Human
gggcuguugggaggaacagaugagacaguggcuauagaagcacuuggaaaaugcacuuguccug

SEQ ID NO: 117676 - RNA, 64 nt, Human
caccuccaugcuguagcaaacaauuucuagauacuagaagcauaauagaaacauuuuucuguac

SEQ ID NO: 117677 - RNA, 64 nt, Human
guggccuucagggucuccccaaacagugggcugcuagaagcacgauccgccaaugcacccccaa

SEQ ID NO: 117678 - RNA, 64 nt, Human
uccuguugccaaacaaaagccagucauguaacucuagaagcagugacugguggggcuuucugac

SEQ ID NO: 117679 - RNA, 64 nt, Human
ucugccccugcucagcacagggagaauguugacuuagaagcaauagggggcagcaggccaccaa

SEQ ID NO: 117680 - RNA, 64 nt, Human
aaagcucaacuaguauaagcaaaaauauaacaucuagaagcacaguuuuagccaggauguuuaa

SEQ ID NO: 117681 - RNA, 64 nt, Human
gcuugaaagcucugucugggucauucauuuaaacuagaagcagaggcacuuaaaacauguacca

SEQ ID NO: 117682 - RNA, 64 nt, Human
ccauucuaguuuucagaauaggaccagaugcccauagaagcacaguacagacugaaguaaaccc

SEQ ID NO: 117683 - RNA, 64 nt, Human
uacaaugaaaguuugaaauuuaacugcaaggaauuagaagcauauuugcaaucauugcagcuuc

SEQ ID NO: 117684 - RNA, 64 nt, Human
uaguuuacagaucuuuauaagguguuuuauauauuagaagcaauuauaauuacaucugugauuu

SEQ ID NO: 117685 - RNA, 64 nt, Human
cagaaagcuauauguagcagcuggucuugagaaguagaagcaucuuaacugucauaagagcaua

SEQ ID NO: 117686 - RNA, 64 nt, Human
agagaauuuaggggagguucagaagacagaguuuuagaagcaaagcacaaaaucucugggaggc

SEQ ID NO: 117687 - RNA, 64 nt, Human
aggcuugugacucaacaaagggcuuuuccauugauagaagcaguuugggauuuguaguugcgac

SEQ ID NO: 117688 - RNA, 64 nt, Human
ugcugcucuggcagaggccaguaaauacaguuccuagaagcagccuuugcugucuuuuuacacu

SEQ ID NO: 117689 - RNA, 64 nt, Human
uuauuuuauuucaagggauagggcagauuaccauuagaagcaaaauuaaaaguacaagcugggc

SEQ ID NO: 117690 - RNA, 64 nt, Human
accccaauucauucuuaucugccaaagaauuaucuagaagcacaucaaauaccagcaccccacc

SEQ ID NO: 117691 - RNA, 64 nt, Human
aaauguuuaaucacaucauuacguuucuuuuauauagaagcauaaagaguuguggaucaguagc

SEQ ID NO: 117692 - RNA, 64 nt, Human
ugucaaauagauacacauuuuucuaauagguauuuagaagcacuugaaauaaucucugcaugug

SEQ ID NO: 117693 - RNA, 64 nt, Human
auucuuugaacugccuuacauguugucaccuuuauagaagcaaugcauuacuuguuuuagauca

SEQ ID NO: 117694 - RNA, 64 nt, Human
cugaggguuuguugugagaauugcugaagccacguagaagcaccuugaaaucuguaaaaccaca

SEQ ID NO: 117695 - RNA, 64 nt, Human
uagaggaaaaaaaaauuuuuuuaaaaauacuuauuagaagcaaacugcccuugcauggaaaacu

SEQ ID NO: 117696 - RNA, 64 nt, Human
ccuugucaucagaaacaugguuaaaguuuaaaacuagaagcagcagaaaacuagcuuguaaaau

SEQ ID NO: 117697 - RNA, 64 nt, Human
auuaaaaugaguguaaugaaacaaggugaaaauauagaagcaucccuuuguauacuguuuugcu

SEQ ID NO: 117698 - RNA, 64 nt, Human
uauccuaacuauaaccaguuguugagggguauacuagaagcagaaugaaaccacauuuuuuggu

SEQ ID NO: 117699 - RNA, 64 nt, Human
gaauaaaaaccauuugccaaagcaacacucuacuuagaagcacauguacauacauggaccucau

SEQ ID NO: 117700 - RNA, 64 nt, Human
auccuaaaccuuugguggcugggauaugauggguuagaagcaaggagaaaauauaaggacuuuu

SEQ ID NO: 117701 - RNA, 64 nt, Human
uacuguuuuauuaugauucaucuucaguaauuuuuagaagcaagaagaaagccauuguguccuc

SEQ ID NO: 117702 - RNA, 64 nt, Human
cuguggagugacaccagaacacagccaaagaggcuagaagcaagaaaggaucugcaugauaacu

SEQ ID NO: 117703 - RNA, 64 nt, Human
auauuuguuauucucucaugaauagaaauuuauguagaagcaaacaaaauacuuuuacccacuu

SEQ ID NO: 117704 - RNA, 64 nt, Human
uaccuggucccuaauuaagcugcguuaaauuugguagaagcauuuaaauggucuaucuucaguu

SEQ ID NO: 117705 - RNA, 57 nt, Human
auaaggacagcaugaacugaccacccuuagaagcacuccucgguacucccauaaucc

SEQ ID NO: 117706 - RNA, 64 nt, Human
uuuauaggccucagauacugaagauuauuuuugguagaagcaccguguaggcuuuuucugcaau

SEQ ID NO: 117707 - RNA, 64 nt, Human
ugggaugauaugugggcaaaaucacuuaugaaaguagaagcaagaaucaguugguuugcuacca

SEQ ID NO: 117708 - RNA, 64 nt, Human
uuuauuuuuaucauucugguaaaaaaacaaaaaauagaagcaaaacacauuguauugccauuau

SEQ ID NO: 117709 - RNA, 64 nt, Human
uugaugcacuccagcuuuuguauagguuucuguuuagaagcaccaguuccugcuaugaucaguu

SEQ ID NO: 117710 - RNA, 64 nt, Human
gcuuugggaaagcugccucguuucccuuuuccucuagaagcagaaccagcucuacgagagugag

SEQ ID NO: 117711 - RNA, 64 nt, Human
uguaucacauuccagcuacaauacuuccauuuauuagaagcacauuaaccauuucuauagcaug

SEQ ID NO: 117712 - RNA, 64 nt, Human
cccauauguuaaaauucucauuacucuuaaggaauagaagcaaauuaaacgguaacauccaaaa

SEQ ID NO: 117713 - RNA, 64 nt, Human
guaaaaguaguacagaugugagcuucuauuuguuuagaagcauaaaugugaauuauauacaguu

SEQ ID NO: 117714 - RNA, 64 nt, Human
gggaugggugcaauuuauuccaucuucacuaaaauagaagcaauuccauagguaccauaaaccu

SEQ ID NO: 117715 - RNA, 64 nt, Human
ccuggcuguugaauuguucuuaaggcaucauaucuagaagcaaagaaaaaagaaaaauaacaau

SEQ ID NO: 117716 - RNA, 64 nt, Human
uccaacccagcugugcugcugggaaucaggagaauagaagcaaaaaacgaaagaguucuguuca

SEQ ID NO: 117717 - RNA, 64 nt, Human
gaauaguaaguuucuguguaacccaucucaauuauagaagcaaguucagcuuuauguauuugua

SEQ ID NO: 117718 - RNA, 64 nt, Human
uuuuugacuugaaggaaagaaagaggaaggcugguagaagcaguuagagcaauguguuugaaau

SEQ ID NO: 117719 - RNA, 64 nt, Human
gauggcaauuucacugauguaaguguuguggaaauagaagcaaaugacaaaaagccuuuuccag

SEQ ID NO: 117720 - RNA, 64 nt, Human
auugcgguggugaaauggaauugaggcccaagguuagaagcagccgagacgccacuuggauacu

SEQ ID NO: 117721 - RNA, 64 nt, Human
uaugaaaaaaaaugauuuuuuuaaccuucauacauagaagcaaaaauacuuuaacugcuguaaa

SEQ ID NO: 117722 - RNA, 64 nt, Human
uugggccugggcuuucccaggaaggagaugaagguagaagcaccuggcucgggcaaggcuagaa

SEQ ID NO: 117723 - RNA, 64 nt, Human
ucaugguuaaauuagaacuuacuaugugcaaauauagaagcacggguccacagaguuccagaga

SEQ ID NO: 117724 - RNA, 64 nt, Human
cuccuauucccacgccuuaacacagcucuauaccuagaagcagccagcccaggcaugcagucac

SEQ ID NO: 117725 - RNA, 64 nt, Human
acaacucuccuugcaaaauacugcacucugcuguuagaagcagaggaaaauaucucuucauaau

SEQ ID NO: 117726 - RNA, 64 nt, Human
guuuuguuuugagagagaauuuuucucuccuuaauagaagcauccuuuuuaaagagaaguugcc

SEQ ID NO: 117727 - RNA, 64 nt, Human
uuuggaaaggccaugccaaccgugcuuguacugcuagaagcacuuuauguuuccuuuuugggug

SEQ ID NO: 117728 - RNA, 64 nt, Human
aaccccagagaagugcuucauuuucuuuuuauaguagaagcagguccaugucuuuugugguuuc

SEQ ID NO: 117729 - RNA, 64 nt, Human
acuuuuuuucuauauaguucagcaauggccugaauagaagcaaccaggcaccaucucagcaaug

SEQ ID NO: 117730 - RNA, 64 nt, Human
agaauagccaguacagcauacaaucucagaaacuuagaagcaaguagaaaauaauugguugaug

SEQ ID NO: 117731 - RNA, 64 nt, Human
uaaaucugaaugcgaucacacuguagugauauaguagaagcagugaugauauucagauuguuuu

SEQ ID NO: 117732 - RNA, 64 nt, Human
uuuuuuaaaauauuauugcaaagagcucuauuuguagaagcaaauuauaggcagauuaccaggu

SEQ ID NO: 117733 - RNA, 64 nt, Human
uuuccuuuggggcaugauguuuuaaccuuugcuuuagaagcacaagcuguaaaucuaaaaggca

SEQ ID NO: 117734 - RNA, 64 nt, Human
aacagaaaccaagagacacaauuacgcagguauuuagaagcagagggacaaccagaaggcccuu

SEQ ID NO: 117735 - RNA, 64 nt, Human
gcacauaacaccccauaagagaugauuauguuuuuagaagcaagagcaaaauuaugaaaccucu

SEQ ID NO: 117736 - RNA, 64 nt, Human
uuuaaagccaccagggcuucuggaacaccugucauagaagcaauaacucuaacucuauacugua

SEQ ID NO: 117737 - RNA, 64 nt, Human
aauaacagucugagacuccucauaccucagugguuagaagcaugucucucuugagcuacaguag

SEQ ID NO: 117738 - RNA, 64 nt, Human
gagucucaacaaagacuaccuuuggcuaaaugucuagaagcagagaaguaaagugagcaaaauc

SEQ ID NO: 117739 - RNA, 64 nt, Human
uaauuaucacagugacauagacuagaacagaaauuagaagcauaguaagauugccaaaaucaga

SEQ ID NO: 117740 - RNA, 64 nt, Human
aggcuagaggaaugccaguguuaccuuacgcuucuagaagcagagccacuccagccagaaccca

SEQ ID NO: 117741 - RNA, 64 nt, Human
uuguuguuucuuucuaguggucuuuguaagaguguagaagcauuccuucuuugauaauguuaaa

SEQ ID NO: 117742 - RNA, 64 nt, Human
ggaagacagagggcaaggaggugauagauggauauagaagcauuucucugcaggauaccaguuc

SEQ ID NO: 117743 - RNA, 64 nt, Human
uucuuaaaggaauguguuguucaugaaaaacugauagaagcaacagaagaauucgcaggaagaa

SEQ ID NO: 117744 - RNA, 64 nt, Human
uuagauuagaacacucgcacaagaugaccacauauagaagcagaaagccccaaauucccuggga

SEQ ID NO: 117745 - RNA, 64 nt, Human
ucacucugugucugaucuaaacgucauucagcccuagaagcaugaauugcuucaaauuauuguc

SEQ ID NO: 117746 - RNA, 64 nt, Human
gagaacuccagauucacgacauuccugucccauguagaagcauuuccauucaaccguggccccu

SEQ ID NO: 117747 - RNA, 64 nt, Human
cagagugagacuccgucucaaaaaauaaauaaaauagaagcagccuuguaacuguauuuaccau

SEQ ID NO: 117748 - RNA, 64 nt, Human
aaaguaggaagguguuuccaaguucagauuaaaauagaagcagcuggccgggugcgguggcuca

SEQ ID NO: 117749 - RNA, 64 nt, Human
aauuuuccucccccaaaaagucauguguugauaguagaagcagugguaguuguuguaacaguaa

SEQ ID NO: 117750 - RNA, 64 nt, Human
cugccaucuucuaagagacuuuguagcugccuccuagaagcacauucugagcacauuugagacc

SEQ ID NO: 117751 - RNA, 64 nt, Human
aaaagcuguugcuacuugguggaggaacaccuccuagaagcagcaggccucgguggugggggag

SEQ ID NO: 117752 - RNA, 64 nt, Human
auugaauguuugcauuaaaaguguuuauauaacuuagaagcagaugaauauuucuaauaaauga

SEQ ID NO: 117753 - RNA, 64 nt, Human
acuuuuauagaacaauucuggcuucaggaaagucuagaagcaauauuucuucaaauaaaaggug

SEQ ID NO: 117754 - RNA, 64 nt, Human
uuuuucucuaacacugauuuaauagcuaacgagguagaagcaacauucauucuccuggucuuac

SEQ ID NO: 117755 - RNA, 64 nt, Human
gagaguaaagcuaaguauaguugauguaacauuguagaagcagcauaggaacaauaagaacaau

SEQ ID NO: 117756 - RNA, 55 nt, Human
caagguuccauauuauauaaggagcuagaagcauuauagcuaguguuugauucac

SEQ ID NO: 117757 - RNA, 64 nt, Human
caagcuuuuguagaugcauuguaguagucuagcuuagaagcaaaugcaaguuauuuuaauguac

SEQ ID NO: 117758 - RNA, 64 nt, Human
cuuguucuugagaacuuucccaucaagaauuuaguagaagcagguauacuucuaucauuuugau

SEQ ID NO: 117759 - RNA, 64 nt, Human
cgaagcauuugcaggaaccuacugugcaguaucauagaagcaagcagauaccaagcaaaaaacu

SEQ ID NO: 117760 - RNA, 64 nt, Human
ugugagauaugugcaaacauguacauauuuccccuagaagcaaugguuuucagccuugguggug

SEQ ID NO: 117761 - RNA, 64 nt, Human
agaaucucuuuagauuuuguuggcaaaagccuuauagaagcaguaagaggcuugaccacgccgg

SEQ ID NO: 117762 - RNA, 64 nt, Human
cacacuacugcgucuuuguuucuaucagucuuuguagaagcagguggugguggaaauuccagca

SEQ ID NO: 117763 - RNA, 64 nt, Human
agaggaugaauaaguuaaauacaugcuuugaggauagaagcagauguucuguuuggcaccacgu

SEQ ID NO: 117764 - RNA, 64 nt, Human
agcaacagauuugguggugauggggggauagagguagaagcagauagaagguaauuuuaaaguu

SEQ ID NO: 117765 - RNA, 64 nt, Human
gccuguuuuucuguuuuuaguccuuuaaaaugaguagaagcaaccuguuacccuggaaagagca

SEQ ID NO: 117766 - RNA, 64 nt, Human
gccuuuuccacuaacuccuauagacuccuggagcuagaagcacuugugauucuuguuuuaauuu

SEQ ID NO: 117767 - RNA, 64 nt, Human
cucaguguguucuggucaucuuguggcuuaguuguagaagcaggugugucucuugccucugcuu

SEQ ID NO: 117768 - RNA, 64 nt, Human
uguaguagaaaggguggaauguauugaaaauuauuagaagcagggaaguauuguuagucuagcu

SEQ ID NO: 117769 - RNA, 64 nt, Human
uaauguggauaucuaauucuaaagucuguuccauuagaagcaauuggcacaucuuucuauacuu

SEQ ID NO: 117770 - RNA, 64 nt, Human
auuacagaaaauauuuaaaugcaacuuauugcuauagaagcaaagaggacuaaagggcaaaauu

SEQ ID NO: 117771 - RNA, 64 nt, Human
gauccgacuuuggccucugauacagacagcagucuagaagcagcagcugggccucugggcugcu

SEQ ID NO: 117772 - RNA, 64 nt, Human
aauaaaccuuuaaauuggauuuucagugagaauuuagaagcaaucacuaccuuucucguuucau

SEQ ID NO: 117773 - RNA, 64 nt, Human
ugaaacauauggcuacuugagauaaugggagugcuagaagcaaggagccagcaagucuggacac

SEQ ID NO: 117774 - RNA, 64 nt, Human
gagguggcucaucuagaccuggcaagaauguauauagaagcaggcaaucacagaaaagcugaag

SEQ ID NO: 117775 - RNA, 64 nt, Human
acacauguguauguguacauuggguccugaaagcuagaagcaggcaugcuagccuaguauguuc

SEQ ID NO: 117776 - RNA, 64 nt, Human
aaacuauuaaggauguagcuuuucaccuuuacuuuagaagcacaguaaauaucccaaacuguga

SEQ ID NO: 117777 - RNA, 64 nt, Human
gaaggcuaaauagagaggaguuuagaggaaaguuuagaagcaggggaaauacaauuuugguugc

SEQ ID NO: 117778 - RNA, 64 nt, Human
gugugacuaaauuuuaaaugucaaacuauaaauauagaagcagcuuuauugugguaauaauuca

SEQ ID NO: 117779 - RNA, 64 nt, Human
guuuauaacaccauuauuuacaguagccaaaagguagaagcagcccaagugucaucccauucac

SEQ ID NO: 117780 - RNA, 64 nt, Human
uccuaaauguucuucaccaacuuuuucuuccucauagaagcaacauggcauaguuaagggugug

SEQ ID NO: 117781 - RNA, 64 nt, Human
gcuuugguggagcuagcacugcccccuuuccaccuagaagcagguucuuccuaaaacuuagccc

SEQ ID NO: 117782 - RNA, 64 nt, Human
guucuggaaguguuuuugauuaagcaaugcagccuagaagcaaugguucuguucaaucauucag

SEQ ID NO: 117783 - RNA, 64 nt, Human
uuguuugaauauuuguuuuaauaccacagcuauuuagaagcaucaucacgacacauuugccuuc

SEQ ID NO: 117784 - RNA, 64 nt, Human
uagaaaugcauauauuuagcggguauuugaaagauagaagcauuauuuauaacugaagaguaua

SEQ ID NO: 117785 - RNA, 64 nt, Human
cugcuuggagaggacaagugcagccugucaguuuuagaagcaaguaaaucauccucuuuucaag

SEQ ID NO: 117786 - RNA, 64 nt, Human
agauuuaguuuuacugcuuugacuggugggucucuagaagcaaaacugagugauaacucaugag

SEQ ID NO: 117787 - RNA, 64 nt, Human
uccucauucagacauccuccaccauaccaguguuuagaagcaaaacaugaagggcuagcgccac

SEQ ID NO: 117788 - RNA, 64 nt, Human
gcaugcccuccccacuucccccgauucagagacuuagaagcaucagaguugauaaauuagauug

SEQ ID NO: 117789 - RNA, 64 nt, Human
ugccuccuucagugacaaguagggcacaaaauucuagaagcagaagguuguuuuuuuuuuuuuu

SEQ ID NO: 117790 - RNA, 64 nt, Human
uauuuuucuacuuggggggaaaaaaguccucauguagaagcacccacuuuugcaauguuguucu

SEQ ID NO: 117791 - RNA, 64 nt, Human
cauagauggugccuucucgcuguauccucaaugguagaagcacaaacaagcaagcuccuuccug

SEQ ID NO: 117792 - RNA, 64 nt, Human
uuuguuuuuauugcagagcaaaaauaaaucaaauuagaagcaauacuuucaugugcuaccuacu

SEQ ID NO: 117793 - RNA, 64 nt, Human
agcgacagccugaagcagccacaaaauccuguguuagaagcagcugugggggucccaguggaga

SEQ ID NO: 117794 - RNA, 64 nt, Human
caagagaagggaugaggccaaggcugccuucaauuagaagcagccgcccacagagacaggcacu

SEQ ID NO: 117795 - RNA, 64 nt, Human
uaauuagugcuuuacauguguuaguuauacauauuagaagcauauuugccuaguaaggcuagua

SEQ ID NO: 117796 - RNA, 64 nt, Human
cuuggaagcuuaaaaagguguuuugucuggaacuuagaagcagcucuaaaucuaguagagcaga

SEQ ID NO: 117797 - RNA, 64 nt, Human
aguacaaucuaacucagaaugggauuaaaaauuuuagaagcagaagcuaauauauaaaugaagu

SEQ ID NO: 117798 - RNA, 64 nt, Human
cuguuugaaggcuuacuguagaaguggcuuacuguagaagcagcuugcugagccccuccgagcg

SEQ ID NO: 117799 - RNA, 64 nt, Human
agaggagaggaggaagauggugacaugauuugguuagaagcacaagcaaacugaucagccuccc

SEQ ID NO: 117800 - RNA, 64 nt, Human
auuggaccaaaauguaaacuucauuggucagauuuagaagcauucaugcucacaaguuuuggga

SEQ ID NO: 117801 - RNA, 64 nt, Human
agaacuagguuuaaaacagccuggguaggaaaauuagaagcaagcuggaugcaguggcucaugc

SEQ ID NO: 117802 - RNA, 64 nt, Human
agcuaauacugucuacaguggagcuuggugcaauuagaagcaaaagacuguaccuaacuggaau

SEQ ID NO: 117803 - RNA, 64 nt, Human
uugaaaagaauucuuuuucucacuauuaaugcuuuagaagcaagacgcaauuuuaaagcuuuag

SEQ ID NO: 117804 - RNA, 64 nt, Human
ggagagagguaggagcuggagaugaagaggcugcuagaagcagcaggaagccugcccuucugcc

SEQ ID NO: 117805 - RNA, 64 nt, Human
gcucggaacaagugaaccugagacugguggcuucuagaagcagccauuaccaacuguaccuucc

SEQ ID NO: 117806 - RNA, 64 nt, Human
ucauauaauuuauauuuuuuaaaagcugaaaauuuagaagcaagaugaaaaaaaggaaaagcag

SEQ ID NO: 117807 - RNA, 64 nt, Human
ggaguaaagcaaagucucuaaagcuccuaguaccuagaagcauuaugaagcagucaacaauuua

SEQ ID NO: 117808 - RNA, 64 nt, Human
gggguauggugagugcggcaaucccucauccucuuagaagcaccugugaaugggaauugagcca

SEQ ID NO: 117809 - RNA, 64 nt, Human
gucuagauguuacagcaaagccccaacuaaucuuuagaagcauauuggaacugauaacuccauu

SEQ ID NO: 117810 - RNA, 64 nt, Human
uggaauauuguaaaaccuacaugagcagaugaaauagaagcauuaaauauuuuuaucuauaucc

SEQ ID NO: 117811 - RNA, 64 nt, Human
acugcagccacuggaaauacauucugugguguccuagaagcauuauugguagguucuaaaguuu

SEQ ID NO: 117812 - RNA, 64 nt, Human
guuauuuaaccugaguauaguauuuaacgaagccuagaagcacggcuguggguggugauuuggu

SEQ ID NO: 117813 - RNA, 64 nt, Human
uccaaaauuagcucugauuagcuuucacuuccuguagaagcaagaacaagcuccucugcuuggu

SEQ ID NO: 117814 - RNA, 64 nt, Human
gaggagaagaagccucaacuuacccaggaggagcuagaagcaaagcaagguuuguugauagcuu

SEQ ID NO: 117815 - RNA, 64 nt, Human
gggauugugaaaauagcaggacuuguuuccauccuagaagcagucccaugugcuucuagcugga

SEQ ID NO: 117816 - RNA, 64 nt, Human
aaaaucugcacugugggcuuuuauugccaugagcuagaagcaucacagguugaccaauaaccau

SEQ ID NO: 117817 - RNA, 64 nt, Human
cauuucuuacguucuuucacuucaagggagaauauagaagcauuugauauuaucuacaaacacu

SEQ ID NO: 117818 - RNA, 64 nt, Human
cucaugguugcuaggaaagcuaggccucugaucauagaagcagauagcuucagucccagucuag

SEQ ID NO: 117819 - RNA, 64 nt, Human
uuauuuuaucuaacaccauuucaaaacaaaacuguagaagcagcugcugcucccauguuauuuu

SEQ ID NO: 117820 - RNA, 64 nt, Human
uuggguuucaugccugccccccacaaauuauguuuagaagcagcacugcaucuuagcacaugcu

SEQ ID NO: 117821 - RNA, 64 nt, Human
gugugagucuggcaggcaggagaagggguguucauagaagcagugugcaggugaggcaaagugc

SEQ ID NO: 117822 - RNA, 64 nt, Human
gagggcuguuggcauuuugaaaaagguuaauaaguagaagcauacauguuuuccuuuuguuuuu

SEQ ID NO: 117823 - RNA, 64 nt, Human
auaucaucuuugaaggacacucaaauuuauaagguagaagcaauuucccagauauaggcugaac

SEQ ID NO: 117824 - RNA, 64 nt, Human
gaucacucccgugaggagggccuucacccuguucuagaagcacaugguuguccuccuguuguug

SEQ ID NO: 117825 - RNA, 64 nt, Human
agaauccaguacuuuuaauggugggaauuuacaguagaagcauccuuugcugaguuauacauuc

SEQ ID NO: 117826 - RNA, 64 nt, Human
gagcgugcugcucagugcugacugcagaaugaaauagaagcaaaguguuacaggaucaguguuu

SEQ ID NO: 117827 - RNA, 64 nt, Human
aaaagaauaacuuuuuuugccucuuuagauuacauagaagcauuguagucuugguagaaccagu

SEQ ID NO: 117828 - RNA, 64 nt, Human
acacacugcauaaauuugccugguucaguauguauagaagcauauucaguggucuuuucaagag

SEQ ID NO: 117829 - RNA, 64 nt, Human
cacccaucuagaguuugacacgaagccuuauuucuagaagcacauguguauuuauacccccagg

SEQ ID NO: 117830 - RNA, 64 nt, Human
ggguuaaggccaauuugcaauuuuuuuuuaaacuuagaagcaaugaauguuuucaucagucaag

SEQ ID NO: 117831 - RNA, 64 nt, Human
cuuguaagucaaucaguguuaaaguauuuguaaauagaagcaagcuauuauuaacaacuuuugu

SEQ ID NO: 117832 - RNA, 64 nt, Human
uuucauuuuccuacagaggaaaauagaacaauuuuagaagcaaggaacaaucucuuuucuaagu

SEQ ID NO: 117833 - RNA, 64 nt, Human
agaauccuaaaggacauaacaguuguuccguaacuagaagcauucuuugauuuuaaauuugaag

SEQ ID NO: 117834 - RNA, 64 nt, Human
gauaugcuaucauugccuuaauaauggaacaaaauagaagcauaucuaacacuuuuuaaauuga

SEQ ID NO: 117835 - RNA, 64 nt, Human
caggcauauggguucuagaguaccuaccaugaccuagaagcauuuaugauuuauuugaagccac

SEQ ID NO: 117836 - RNA, 64 nt, Human
uuuuuucauguagauuucaauaauugaguaauuuuagaagcauuauuuuaggaauauauaguug

SEQ ID NO: 117837 - RNA, 64 nt, Human
ggucaaugagcagugguguccaucacauauauuauagaagcaagcgaggacauuccacccuaga

SEQ ID NO: 117838 - RNA, 64 nt, Human
cuuuugauucuuaaaaaaacaaaaaacauuccauuagaagcaccaguuuuuuugcucagacuuu

SEQ ID NO: 117839 - RNA, 64 nt, Human
agugugucuguaauucaaucuucgcugugugugguagaagcaguagucacuuuuguaagccagu

SEQ ID NO: 117840 - RNA, 64 nt, Human
acgcccggucaccuuuguccuguuuucuacagguuagaagcaaggcacaagucauaccuacauu

SEQ ID NO: 117841 - RNA, 64 nt, Human
ugguuuaccaaaauuugucaguacauuuuacguguagaagcauuuuaaaaaucauuucuagcaa

SEQ ID NO: 117842 - RNA, 64 nt, Human
gggaggagcaugucagguuugggcuugguuguuuuagaagcaccugggugugccuaccuacucc

SEQ ID NO: 117843 - RNA, 64 nt, Human
uuauucacauuuacauuucuaaguaguuguauaguagaagcaggaagcucuuauugcuuauuug

SEQ ID NO: 117844 - RNA, 64 nt, Human
aaauguacuuuaggacauuaaagaaaacucaaguuagaagcauaccauuuuccuuucauggaag

SEQ ID NO: 117845 - RNA, 64 nt, Human
gugucccaagacagcaaaaaucugguauacccuguagaagcagggggguagcaaauuuaggcuc

SEQ ID NO: 117846 - RNA, 64 nt, Human
caccaccaugccuggcuaauuuuuguauuuucaguagaagcagaguuucaccauauuggccagg

SEQ ID NO: 117847 - RNA, 64 nt, Human
caaaacuucguuucugcaugucagaaaagugcaguagaagcaaagcuacuggaacaaagauaga

SEQ ID NO: 117848 - RNA, 64 nt, Human
uuagcugauuaacccauguaaauaggcacuuaaauagaagcaggaaagggagacaaagacuggc

SEQ ID NO: 117849 - RNA, 64 nt, Human
cugcggcuuagugauaggacucuaccuuuucuccuagaagcaguuacugaacauccaggaguac

SEQ ID NO: 117850 - RNA, 64 nt, Human
ucugaugcagaugauugcauuuuuuggcaaauuuuagaagcauuuauugcuuugucuuuagugu

SEQ ID NO: 117851 - RNA, 64 nt, Human
uuguacccccuuccacuucgucuccccuagcuccuagaagcaaccacugaugugauuucuacca

SEQ ID NO: 117852 - RNA, 64 nt, Human
uuuuauggacugaggacuggugacuggucugugauagaagcaaauuccaauuccaaauguaauu

SEQ ID NO: 117853 - RNA, 64 nt, Human
gaacagacuuuacuuuucuagcccagcauugaucuagaagcagaggaaucccagcgccuuuuaa

SEQ ID NO: 117854 - RNA, 62 nt, Human
acaauucuggacugucauaaguagucauccaguagaagcauaguuagcaucagaaaauguca

SEQ ID NO: 117855 - RNA, 64 nt, Human
uuauggaauuacaugauaaucauauucggauuuauagaagcauuuuacaaguauugcaaucauu

SEQ ID NO: 117856 - RNA, 64 nt, Human
gaguguccacagggacacacgugagccacagggcuagaagcacaggcccgucaccccaggagga

SEQ ID NO: 117857 - RNA, 64 nt, Human
aauuuuuaaaauaggaacuuuugauaagaccuucuagaagcaaaaaaaaaaaaaaaaaaaaaaa

SEQ ID NO: 117858 - RNA, 64 nt, Human
aguuuucccugcuucugguuugcugaagauuuucuagaagcacuauuuacacaaauaugcaaau

SEQ ID NO: 117859 - RNA, 64 nt, Human
accgcgaagccgggcaccgucccacagcaucuccuagaagcagccggcacaggagggaaggugg

SEQ ID NO: 117860 - RNA, 64 nt, Human
gccucuugauauccauaccuuccuguccucugccuagaagcaaggccagcggugccuuuacgga

SEQ ID NO: 117861 - RNA, 64 nt, Human
acacacacaaaguaaauugcaaaaugaaaaaaauuagaagcaaaugaguuuuggaccaauauug

SEQ ID NO: 117862 - RNA, 64 nt, Human
acugugcauucaguagaaguugaagaaucauuguuagaagcauuuccaaacaaaacacuaagca

SEQ ID NO: 117863 - RNA, 64 nt, Human
uugauacacaagugaacuggaaagucacuucccauagaagcaaaaguacuuauuuucuacccua

SEQ ID NO: 117864 - RNA, 64 nt, Human
gguggcucuggggcucugaacucugaccugugaauagaagcagcaugcacuuuggaaauccggc

SEQ ID NO: 117865 - RNA, 64 nt, Human
gcucauuaucugagaaggacuuuucagcacauccuagaagcagcggauggugaggacacagcua

SEQ ID NO: 117866 - RNA, 64 nt, Human
guagauacacacagagacuaggccguauauuaacuagaagcagcuuuaugucuagcuugugucu

SEQ ID NO: 117867 - RNA, 64 nt, Human
accgugcccggccugugcuuaaauauucuaggaguagaagcacucagacuuuuaaaacuaugag

SEQ ID NO: 117868 - RNA, 64 nt, Human
gaccaacguggugaaaccccgucucuacuaaaaauagaagcauuagccgagccugguggugcgu

SEQ ID NO: 117869 - RNA, 64 nt, Human
uuguagcccccagaauugucuggcccaaauugaauagaagcagaaaaacauuuagggauaacau

SEQ ID NO: 117870 - RNA, 64 nt, Human
uuacagcccccaaccuccaacccaccagcugaccuagaagcagcaucuucccauuuccucagua

SEQ ID NO: 117871 - RNA, 64 nt, Human
cugcuuuuugcuauuucugcaguuucaaguuaguuagaagcauguugucaacuaaagacaacaa

SEQ ID NO: 117872 - RNA, 64 nt, Human
acugcuacuugcccagguagugaucagugagaguuagaagcaauuuuuucucuaaccgaugagg

SEQ ID NO: 117873 - RNA, 64 nt, Human
gacagcugagcccccugccuuggcuccagguugguagaagcagccgaagggcuccugacagugg

SEQ ID NO: 117874 - RNA, 64 nt, Human
gggaaucguuuguguucuuuguggaaauguccuuuagaagcacccaugaaguaguguguucaga

SEQ ID NO: 117875 - RNA, 64 nt, Human
acauuucagauccuaagaauucuaagaacacuacuagaagcauuuguucccuccuagucaaugc

SEQ ID NO: 117876 - RNA, 64 nt, Human
cuuugagggaugguggaguccggcucugcuggccuagaagcagagugcacccucgugcucagug

SEQ ID NO: 117877 - RNA, 64 nt, Human
uauuggagaaaaucacccuuucccuuuuucuuuguagaagcaggagcaagaguguuuggcuccc

SEQ ID NO: 117878 - RNA, 64 nt, Human
agguaucggguugaauaugaagcuuuguguaaaguagaagcagaacaaaaugaauuuauugacc

SEQ ID NO: 117879 - RNA, 64 nt, Human
aacccagaccccaccugaauugggcuuuuuaacuuagaagcaacacuugauuaaacaucuuuag

SEQ ID NO: 117880 - RNA, 64 nt, Human
ccacuuggaaaguucucaguucccuccaggcuucuagaagcaucugggccagggcucauggcug

SEQ ID NO: 117881 - RNA, 64 nt, Human
aguaaccuaagaauucaaaagcuggauagaauuuuagaagcaacuacguacaucauuauuaaua

SEQ ID NO: 117882 - RNA, 64 nt, Human
accuuuuugauaaacuuaguaaagucuuggagacuagaagcaagauaguuugugacacauaagc

SEQ ID NO: 117883 - RNA, 64 nt, Human
ucugagcccucccucuucccagcacaggcagggguagaagcaaaggcaggaggugggugagcgg

SEQ ID NO: 117884 - RNA, 64 nt, Human
gacguuuacccucuaucacagaccuuucacaaauuagaagcagugaagcauaacuuuaaccugg

SEQ ID NO: 117885 - RNA, 64 nt, Human
cccaugguucucagcuggggugacacugcuccucuagaagcagguuugaaauuauggguauguu

SEQ ID NO: 117886 - RNA, 64 nt, Human
gcucacugccuauuuaauguagcuaauaaaguuauagaagcagaugaucuguuaauuuccuauc

SEQ ID NO: 117887 - RNA, 64 nt, Human
cacuccacgaccugggggcucacagcacagaaccuagaagcaccugcugacacucuucaacuga

SEQ ID NO: 117888 - RNA, 64 nt, Human
ccauugaaacuguagaacuaugccaugcuuuuauuagaagcagugcucuguguuaacaacaaga

SEQ ID NO: 117889 - RNA, 64 nt, Human
aauauauaauauauaucaagauuuucaaauuauuuagaagcagauuuuccuguagaaaaacuaa

SEQ ID NO: 117890 - RNA, 64 nt, Human
auuugcauacucuuuuaaaucaaggaggcuguaguagaagcaguuuuaagauucuugaaggcaa

SEQ ID NO: 117891 - RNA, 64 nt, Human
ugauguugcauuuuccuuauuguuaaaaacauguuagaagcaaugaauguauauaaaagccuca

SEQ ID NO: 117892 - RNA, 64 nt, Human
ugguccaaaugcggaucacuggucagauggacucuagaagcacugagcucccugucucuggaag

SEQ ID NO: 117893 - RNA, 64 nt, Human
cagcaugagcuugcuguuguacacaggguauuucuagaagcagaaauagacugggaagaugcac

SEQ ID NO: 117894 - RNA, 64 nt, Human
ccuggccgccccgacccccuccacggggcuggccuagaagcaaguaguagaauaaaacuagccu

SEQ ID NO: 117895 - RNA, 64 nt, Human
uaucccuuccccucugccccaguguccugcugguuagaagcaaguucaaguccuucccauacuc

SEQ ID NO: 117896 - RNA, 64 nt, Human
cggcagcccaggggucccugcuggaucagagaaauagaagcacccgaagacgguuaguggcaau

SEQ ID NO: 117897 - RNA, 64 nt, Human
ccuggagccagccagugcauuuauuuuaagcucuuagaagcaacuccuuggcccaggaaugcgu

SEQ ID NO: 117898 - RNA, 64 nt, Human
auccuucuggcaagccugucuucagagaacccacuagaagcaacuaggaaaaucacuugccaaa

SEQ ID NO: 117899 - RNA, 64 nt, Human
ugucuuuagaaaucccauccugccuugugauauuuagaagcacaaguacguuaaacaagugcua

SEQ ID NO: 117900 - RNA, 64 nt, Human
gccaaggaacacacggggcuaccagaagccgagauagaagcauggaacauauguucuaguaaga

SEQ ID NO: 117901 - RNA, 64 nt, Human
aggaaguauuuaaaggaugauagagaccaucagauagaagcagggaagguagauaacuuuuagg

SEQ ID NO: 117902 - RNA, 64 nt, Human
cucuccauuugggagccugccuacauucuuguucuagaagcacaaaaaauccucagaugaauua

SEQ ID NO: 117903 - RNA, 64 nt, Human
uauguuuuuuuaaaugugucuuugaugcauacuuuagaagcacacuggcucgcgguuuccaucc

SEQ ID NO: 117904 - RNA, 64 nt, Human
aaaagccuuaaaauuuagcucccuagcucuugauuagaagcaauuuggaguaaguguguuuuga

SEQ ID NO: 117905 - RNA, 64 nt, Human
caugcaagggaggauggaggcuggccccucuuuauagaagcacauuucugccaccuccccuggg

SEQ ID NO: 117906 - RNA, 64 nt, Human
caggggcagcagugaccagccagggcaaauggcuuagaagcaggccacuccccagccugcugcc

SEQ ID NO: 117907 - RNA, 64 nt, Human
aaaguuguuaucaacacgucgggaguauguguguuagaagcaauuccuuuuauuucuuucaccu

SEQ ID NO: 117908 - RNA, 64 nt, Human
uucuucccaagcaaugcuaauagaguucuauucuuagaagcagggugucagcuacugggaauau

SEQ ID NO: 117909 - RNA, 64 nt, Human
ccagaggcgucuuagucucacccaaugugauuuguagaagcacgagacgcacuuuuauaucccg

SEQ ID NO: 117910 - RNA, 64 nt, Human
aucuguggacugaccuuguaaaagacaguguauguagaagcaugaagucuuaaggacaaagugc

SEQ ID NO: 117911 - RNA, 64 nt, Human
gccguccgggcuuccuguggauuggcggaauguuuagaagcagaacaagccauuccuauuaccu

SEQ ID NO: 117912 - RNA, 64 nt, Human
uacauuucaacagaacagggauccuuggcuacuguagaagcaguccuguauggagaccuuggac

SEQ ID NO: 117913 - RNA, 64 nt, Human
gauaaaaacaaaacaaaaaaacgcugccagguuuuagaagcaguucuggucucaaaaccaucag

SEQ ID NO: 117914 - RNA, 64 nt, Human
cucagcugacgucgggauagcaaggcuagaagccuagaagcagggcagcuuccuucgccagagg

SEQ ID NO: 117915 - RNA, 64 nt, Human
aaagagccaggaauaacaccuugauuuuguaauuuagaagcaacacacauuguaaacuauucau

SEQ ID NO: 117916 - RNA, 64 nt, Human
cagcaauugaaauuuaugugaauuauuuugauuguagaagcacuauaauaugugcugaaacuaa

SEQ ID NO: 117917 - RNA, 64 nt, Human
uggguacaaguggcaaccugcuuccauggccguguagaagcauggugcccuggcuucucugagg

SEQ ID NO: 117918 - RNA, 64 nt, Human
aaggaaguguagugggauuuuuguugauaauuuuuagaagcaaauuuuccugaaaguuuugagu

SEQ ID NO: 117919 - RNA, 64 nt, Human
auuuuaaacaucugucagcuuauguagguaaaaguagaagcauguuuguacacugcuuguaguu

SEQ ID NO: 117920 - RNA, 64 nt, Human
agaagacuaaggcuuuuacuguucucugauauucuagaagcagacgaucucgggcuccaaguau

SEQ ID NO: 117921 - RNA, 64 nt, Human
aagcaaaaaggucccauuguacuggacugaggauuagaagcaauugaaauacaagccuguacca

SEQ ID NO: 117922 - RNA, 64 nt, Human
ccuaagagacuggugacauccacaaaugcaguuuuagaagcagaaaaggucuuggugccucugc

SEQ ID NO: 117923 - RNA, 64 nt, Human
cuuuagucauaaggagaaaaaaacacucaaauaguagaagcagcaaguagcaaacuucaggaga

SEQ ID NO: 117924 - RNA, 64 nt, Human
uauuguugaugauaaguguugacauuggguaguguagaagcaacaagcauguccuuguaguaca

SEQ ID NO: 117925 - RNA, 64 nt, Human
gaaagcuguggugcuacagaaaguacccuagacuuagaagcaguaauacugguuucuaguucua

SEQ ID NO: 117926 - RNA, 64 nt, Human
aucagccuccagccauacagaacaaaugagaaauuagaagcaauuccaagaacgugugauggug

SEQ ID NO: 117927 - RNA, 64 nt, Human
uuucaguuagauggggaacauuuugcuagcccauuagaagcacacagaauuauccuuguccucc

SEQ ID NO: 117928 - RNA, 64 nt, Human
cccccucugccccacgugccggcccuccuggugcucuauccacugcagggccagccacucgcca

SEQ ID NO: 117929 - RNA, 59 nt, Human
ucauccuuccuggcaaauaaauucccguuucuauccaaaagagcaauaaaaaguuuuca

SEQ ID NO: 117930 - RNA, 64 nt, Human
guuucccagcccagaguuuacugacuuguaauucucuauccaggacaucaggagugagggaugg

SEQ ID NO: 117931 - RNA, 64 nt, Human
auauugguuaucaguuugcagaugaauacacaguucuauccaacagaaacuguaucuuucuguu

SEQ ID NO: 117932 - RNA, 64 nt, Human
auuuaaaacuccugaacaauguuucugauggucuucuauccacccuacuugguaacaaaguucu

SEQ ID NO: 117933 - RNA, 64 nt, Human
auguguuguuauaauuuuuguuugggauaaagacucuauccauuguacuagcaaaucuaugggg

SEQ ID NO: 117934 - RNA, 64 nt, Human
ugcuaugguuuucuuaaaauguuacaauucuagaucuauccaccuuguuuuuuuauugucuaca

SEQ ID NO: 117935 - RNA, 64 nt, Human
gcucuugccgaaaagaugagccucgauuuuaaaaucuauccacauccaacugauggcaccauug

SEQ ID NO: 117936 - RNA, 64 nt, Human
uguuuuagucuugaauugccaacuuuccaacugaucuauccauauuccuuaaguacuaaagaca

SEQ ID NO: 117937 - RNA, 64 nt, Human
cgcagcccugcuugggcuauucaaucuuagggugucuauccacgucuggcugugccaaaugguc

SEQ ID NO: 117938 - RNA, 64 nt, Human
ggggacacuguaugacucuccucuccugcaggugucuauccaccugggguauggcaucuaccga

SEQ ID NO: 117939 - RNA, 64 nt, Human
auccuuuagauuaaccucaccaaaugaagcuuuuucuauccauuuuuaauauuguccuuacaua

SEQ ID NO: 117940 - RNA, 64 nt, Human
acguccuaacuacaccccuuccuaucagcuggauucuauccaagugacucuauugauguaugua

SEQ ID NO: 117941 - RNA, 64 nt, Human
aggaauauuuucagaacagauuuuagauauuauuucuauccauauauugaaaagaauaccauug

SEQ ID NO: 117942 - RNA, 64 nt, Human
agguggaccauccucccaaacuagggcccuccacucuauccagggcaggccagggacucccugg

SEQ ID NO: 117943 - RNA, 64 nt, Human
ccacguguuucgggccagggcguggcuuggcauugaccuucaugaccuuacauagcuuuagaga

SEQ ID NO: 117944 - RNA, 64 nt, Human
gugcucucuacgugguggccgguagaauucuccaucuauccaggcuccaggagaccccugggca

SEQ ID NO: 117945 - RNA, 64 nt, Human
ccguaucaguuugaccacgggccuuuugcuacauucuauccagagagcaggccugccagccccu

SEQ ID NO: 117946 - RNA, 64 nt, Human
agugucugaagaccucacccuggcagggugggcuucuauccacccaugaggcaccuggggcuuc

SEQ ID NO: 117947 - RNA, 64 nt, Human
cucaguuuacaaucuaccuggucauuauuuuauuucuauccaguucuaagaacugccuccacug

SEQ ID NO: 117948 - RNA, 64 nt, Human
uuacuggugaacuuuuucaaauguuuaaauaaugucuauccauguaucaugaaggacaguaugc

SEQ ID NO: 117949 - RNA, 64 nt, Human
ccugacgggucguauuuccaagacauuuucauauucuauccauuguuuugugugcauuuuauua

SEQ ID NO: 117950 - RNA, 64 nt, Human
uucugcuuuuccuccucucuuuguucccuuccugucuauccauugaguuuaugaaauggaagag

SEQ ID NO: 117951 - RNA, 64 nt, Human
uaggugaugacuugcaugugacuccuacuuggcuucuauccaccaacagaaauuauaccauaua

SEQ ID NO: 117952 - RNA, 64 nt, Human
augacuuauaaaaacaaaaauguauauggcucuuucuauccaugcagugauagugaguguaaaa

SEQ ID NO: 117953 - RNA, 64 nt, Human
gcuuacgggccaugcguauuucuuuggagaaaggucuauccagguccuuugccuauuuuuaauu

SEQ ID NO: 117954 - RNA, 64 nt, Human
agguggucuuauuuauuggcaacaaaaggaauuuucuauccagaagccuauuucuccuuucauu

SEQ ID NO: 117955 - RNA, 64 nt, Human
uuauaaaauagauuuucaugggaauuuuaaaaacucuauccaaaacauuuuuggagcauuuuaa

SEQ ID NO: 117956 - RNA, 64 nt, Human
ggcccagagcccugugcgggggaauguggcacugucuauccauccgguggacugggcagcauuc

SEQ ID NO: 117957 - RNA, 64 nt, Human
auaggauaaugauauauaggaucaugauauuccuucuauccaugugccaaauggguguaauguu

SEQ ID NO: 117958 - RNA, 64 nt, Human
ucaugcaucaguuuuaacauaugaaguaaaguguucuauccaggauuaaagucaaguuuacuua

SEQ ID NO: 117959 - RNA, 64 nt, Human
aguugcuuuuucaguaucuucugcuuugucugugucuauccaguggccuaggaauuaaagugua

SEQ ID NO: 117960 - RNA, 64 nt, Human
ugcccagcuacgcagaaagcagccggagccucggcggcggcagaaaggggacaaccagggccuc

SEQ ID NO: 117961 - RNA, 64 nt, Human
guauuaacggugguggguuuuguugcuuucacacucuauccacaggauagauugaaacugccag

SEQ ID NO: 117962 - RNA, 64 nt, Human
guguggcucagcuggguuuuuaauuagcgcauucucuauccaacauuuaauuguuugaaagccu

SEQ ID NO: 117963 - RNA, 64 nt, Human
ugaagaauuuaucugcaugacgauaacuaggcauucuauccauuuguagaucagagaaagugaa

SEQ ID NO: 117964 - RNA, 64 nt, Human
aagcaauuucucaaagccagucuaccugacuaggucuauccacgcacgguucccaaccccaagg

SEQ ID NO: 117965 - RNA, 64 nt, Human
ugaaaaugaacuuuaugaaccuuuuccaaguugaucuauccagugacguggccuggugggcguu

SEQ ID NO: 117966 - RNA, 64 nt, Human
cuucuuuuugcuguuguuucuaaacaagaaucagucuauccacagagagucccacugccucagg

SEQ ID NO: 117967 - RNA, 64 nt, Human
aauuugagguuagaugggaggaugaauugucacaucuauccacacugucaaacagguuggugug

SEQ ID NO: 117968 - RNA, 64 nt, Human
auuucucuccuuaaccuccagcagacuccugcucucuauccaaaauaaagaucacagagcagca

SEQ ID NO: 117969 - RNA, 64 nt, Human
gguguugaagaugggaaggauuugcagggcugagucuauccaagaggcuuuguuuaggacgugg

SEQ ID NO: 117970 - RNA, 64 nt, Human
cagauaauuggcaacugggugaaucuggcaggaaucuauccauugaacuaaaauaauuuuauua

SEQ ID NO: 117971 - RNA, 64 nt, Human
gcugccugaaacagccauguccaaguucuucaccucuauccaaagaacuugauuugcauggauu

SEQ ID NO: 117972 - RNA, 64 nt, Human
guucuuguuuguuuuuuagccaguauuugcccuuucuauccagccuuaugaauaauagcaguaa

SEQ ID NO: 117973 - RNA, 64 nt, Human
guaaacaguuacucagugcaauguauagccugagucuauccaugauggcuauauccaauuugac

SEQ ID NO: 117974 - RNA, 64 nt, Human
uugggacagcaggauaggguucuaaaggugguuuucuauccaaacgaccaaaaaaccaacagua

SEQ ID NO: 117975 - RNA, 64 nt, Human
agcacagauuuuaaaacuucuaagauuauucuccucuauccacagcauucacaaaaauuaauau

SEQ ID NO: 117976 - RNA, 64 nt, Human
aaggggaauggagagaaggugccuuugacugucuucuauccauuaguucugcccuggagcacac

SEQ ID NO: 117977 - RNA, 64 nt, Human
auuuuuaagaacacacauugccauggcaggauuaucuauccaauauggacaaucauauuuacaa

SEQ ID NO: 117978 - RNA, 64 nt, Human
uacauugugagcuuucccuuggaaggcucuggacucuauccaagcuuaugauaauucacacaau

SEQ ID NO: 117979 - RNA, 64 nt, Human
gcagccacagauuugcuuuugguuaccgauuagaucuauccauuguagaauucauguaaauaga

SEQ ID NO: 117980 - RNA, 64 nt, Human
uagaauccaugugacuugcagccuaccuguaauuucuauccauugagcaugcauggauauaccc

SEQ ID NO: 117981 - RNA, 64 nt, Human
aaucccguuauggacucugucuccaggagaggggucuauccaccccugcucauugguggauguu

SEQ ID NO: 117982 - RNA, 64 nt, Human
cucaggguccccaguccaagcccuugaccucuccucuauccagacccgcacagcuguuuccugu

SEQ ID NO: 117983 - RNA, 64 nt, Human
gccgcgcuguuguaauacuguauaaagaccucaaucuauccagaguauuuuuauauaauguugg

SEQ ID NO: 117984 - RNA, 64 nt, Human
aauuguuuaacccuggauaagucacuuaaacucaucuauccaggcagggauaauuaaaaccauc

SEQ ID NO: 117985 - RNA, 64 nt, Human
uggggagagagcguagagguuuccgggcaguaauucuauccaacuuaaaaaggcucuuuuaaga

SEQ ID NO: 117986 - RNA, 64 nt, Human
gaauuuaccucuuaugagcuccauguugcuucacucuauccaaagugucacuuggugcauaagc

SEQ ID NO: 117987 - RNA, 64 nt, Human
cuaauuaccuauacuaugccaauauuuccuuauaucuauccauaacauuuauacuacauuugua

SEQ ID NO: 117988 - RNA, 64 nt, Human
uuugcaaucugggcuucuuguucacuccacugccucuauccauugaguacuguaucgauauugu

SEQ ID NO: 117989 - RNA, 64 nt, Human
auauuccugaaaagaaauuuaaaucugaagcucuucuauccacccuuacgucagaugccucuaa

SEQ ID NO: 117990 - RNA, 64 nt, Human
guguuaggauugacuuaugaaaauaaauuuuauuucuauccaaauuugaauguccaaaccauuu

SEQ ID NO: 117991 - RNA, 64 nt, Human
uuuugugaaauuugacaaaggcauagaaucuuuuucuauccagucaggcauugccuauucuuuc

SEQ ID NO: 117992 - RNA, 64 nt, Human
gggggccacacgcugcaccuaaagccuacccuauucuauccaucuccugguguucugcagucau

SEQ ID NO: 117993 - RNA, 64 nt, Human
gcuuuuuuuuuuuucuaugcaaaagucagaugcuucuauccauugcuuucugugauuagggcgg

SEQ ID NO: 117994 - RNA, 52 nt, Human; identical to SEQ ID NO: 14036

SEQ ID NO: 117995 - RNA, 64 nt, Human
caaaaaaucacuugcguuuuugaggcuuaaaucaucuauccaguuucuacauuuugcaugaggc

SEQ ID NO: 117996 - RNA, 64 nt, Human
aacacaaauaccccucuugaaagagauuuacucaucuauccaagcacuuaauuuggaaauuuua

SEQ ID NO: 117997 - RNA, 64 nt, Human
cugccacuaaacugccuguauuucuguauguccuucuauccaaacagacguucacugccacuug

SEQ ID NO: 117998 - RNA, 64 nt, Human
gcaucaaacaaccuuggcuguaaccuauagaaucucuauccacguaucagguuauagacugguu

SEQ ID NO: 117999 - RNA, 64 nt, Human
gaaccuguuuaacagcuguaaccaaugguacugaucuauccauccaauguugucauuauauuug

SEQ ID NO: 118000 - RNA, 64 nt, Human
gagaagccacauggagacucaaauucgcaucuucucuauccacaucaugaccaaaggaaccccu

SEQ ID NO: 118001 - RNA, 64 nt, Human
cuuuuuuacuuuauuaucucuauaauuuauuaucucuauccauauuuguggaucggguaguggg

SEQ ID NO: 118002 - RNA, 64 nt, Human
ucccaauucagucgcuacuuuuacuucugcccuuucuauccaucgucuucauuuuguguguaca

SEQ ID NO: 118003 - RNA, 64 nt, Human
cucccccaucuguuacacuagagggcugcaggacucuauccaccgcccccggguuaucauucag

SEQ ID NO: 118004 - RNA, 64 nt, Human
aauuguuuuuauuuuguaauguggcuuuauauauucuauccauuuuaaauuguuuguaugucaa

SEQ ID NO: 118005 - RNA, 64 nt, Human
ccagauugugaaaucauacaggaagugggaaaacucuauccacuggagauaguauuuggaauga

SEQ ID NO: 118006 - RNA, 64 nt, Human
gcuucaauugcuuacccacugccugcccagacuuucuauccagccucacugagcugcccacuac

SEQ ID NO: 118007 - RNA, 64 nt, Human
accagcagcgcugaccuaagagcucccugugccgucuauccagaccagacuucgguagaugccu

SEQ ID NO: 118008 - RNA, 64 nt, Human
caaaaaauaaccuuccacagagacaaacuguccuucuauccacuuuuaucuuuuaauaaauauc

SEQ ID NO: 118009 - RNA, 64 nt, Human
auggacacauuagauuauauacuacagacacauaucuauccaaaauaccuauuuuaaauuuuua

SEQ ID NO: 118010 - RNA, 64 nt, Human
guaugaauguaaucaguguauguuaguacaaaugucuauccacaggcuaaccccacucuaugaa

SEQ ID NO: 118011 - RNA, 64 nt, Human; identical to SEQ ID NO: 116087

SEQ ID NO: 118012 - RNA, 64 nt, Human
gcggaggaggguccuaagagcugauuauuuaauuucuauccagaaaucuuucuucuucuugcuc

SEQ ID NO: 118013 - RNA, 64 nt, Human
agcuacaaugauagcuguuuccuggauuccucccucuauccagaacuagcugauguccaguggu

SEQ ID NO: 118014 - RNA, 64 nt, Human
auaaaaucuuccaaauccaaaagcaugagauuuuucuauccaaauaugcaaaaaugacccaaga

SEQ ID NO: 118015 - RNA, 64 nt, Human
ggcaugcauuuguaggugcacaugcuuuaagauuucuauccaucuuucagaguugaauguaaua

SEQ ID NO: 118016 - RNA, 64 nt, Human
gacuguccaguucuccuccugugcuaucuucucuucuauccaaguagaauguacgccaggagcu

SEQ ID NO: 118017 - RNA, 64 nt, Human
ccaaacaaauuucucaagauuccuuuuccuuccuucuauccauuuucugcccauaauuuccaag

SEQ ID NO: 118018 - RNA, 64 nt, Human
cucuuagcccaccacccuggccugcuguccugcgucuauccauguggaaugcuggacaauaaag

SEQ ID NO: 118019 - RNA, 64 nt, Human
agaagcaggugaacuuaauuuuuuuuuaacccagucuauccaaaauauuuucauuucaauauaa

SEQ ID NO: 118020 - RNA, 64 nt, Human
cuccccaccucaacugucaccacugcuaagggacucuauccauugagcacauuuuccuaaggcc

SEQ ID NO: 118021 - RNA, 64 nt, Human
cgucagaaggcaacauuuaccauguuccuuucagucuauccaaaguagcaacuuaacuaguugc

SEQ ID NO: 118022 - RNA, 64 nt, Human
caaccucugaguguggacaauagcugcuuucuucucuauccaagagcaccaggcugugcuuggg

SEQ ID NO: 118023 - RNA, 64 nt, Human
acuccaccaaaggagcccagccucucuuugucccucuauccaugcaacagucuucucugugcau

SEQ ID NO: 118024 - RNA, 64 nt, Human
ucuacaaccauuaccaucucacuaaauaagacuuucuauccaauaaugauugauaccucaaaug

SEQ ID NO: 118025 - RNA, 64 nt, Human
guguugucuuugaggucuugggaugaaucagaaaucuauccaggcuaucuuccagauuccuuaa

SEQ ID NO: 118026 - RNA, 64 nt, Human
uucccuuauuuaggagcccugaacucccccagagucuauccauucaugccucuuguauguugau

SEQ ID NO: 118027 - RNA, 64 nt, Human
uuagccauuuucuuccauugugagaccacugccaucuauccaccugcccaccuccccuuuuguu

SEQ ID NO: 118028 - RNA, 64 nt, Human
gccucacacuccugagauccagaccacgagaagugaccuucagggucaucaggcugucccagag

SEQ ID NO: 118029 - RNA, 64 nt, Human
uuuuugaauauaaugugggauuaaauaaagcuaaucuauccaucaccucaaauauuugacauau

SEQ ID NO: 118030 - RNA, 64 nt, Human
aacucuugagagaaaauccaguuggccucucuccucuauccacacaauucaacuugauaacugg

SEQ ID NO: 118031 - RNA, 64 nt, Human
agaaaauguucucuugaugacacagugcuccuacucuauccacauuaaguagcacuuuuguggu

SEQ ID NO: 118032 - RNA, 64 nt, Human
uccacccuggaacauucgagagcaaaucaaaaccucuauccagacaagacaaaauaaaacucac

SEQ ID NO: 118033 - RNA, 64 nt, Human
uugguuuuguuuucuuuuuuuaaugucagaggaaucuauccaugugaaucgaaaggcacaggaa

SEQ ID NO: 118034 - RNA, 64 nt, Human
guaugcauuaauguuuggauguaaagauugugugucuauccaacagggagccacaguauuuaaa

SEQ ID NO: 118035 - RNA, 64 nt, Human
ugaaaucacguugcaguccagcgcacaauugcuaucuauccauagaccauucuugaccaagcaa

SEQ ID NO: 118036 - RNA, 64 nt, Human
ccuuuccaccuccagggcaugaacccugccccuuucuauccaugcuguguccaggaggugaccu

SEQ ID NO: 118037 - RNA, 64 nt, Human
uuaggccuguugaagggcccuccuguagguuucaucuauccaccuggcuuucuccuuauuguuu

SEQ ID NO: 118038 - RNA, 64 nt, Human
guauuucucuacuuucuuuuacauuuccuuuuuuucuauccaaaaacaaugugcuuguugaggc

SEQ ID NO: 118039 - RNA, 64 nt, Human
uaguaugccccuccuuccccuguccuuucauuucucuauccaaguagcagucagguucuuggug

SEQ ID NO: 118040 - RNA, 64 nt, Human
uuaguauuccaugguaucuauguaucacauuuucucuauccaaucuauuguugacucacauuua

SEQ ID NO: 118041 - RNA, 64 nt, Human
uuauugggcauaaagguggcuucugcuccagaacucuauccacuguauuuccacaucgugaguc

SEQ ID NO: 118042 - RNA, 64 nt, Human
uaagagugucuaugacuuauuuccuucacuuaauucuauccacagucaaaaaucccccaaggag

SEQ ID NO: 118043 - RNA, 64 nt, Human
cugagacuggggucucuacuucaccaaacuggccucuauccauaccaaggaggccagccuggcc

SEQ ID NO: 118044 - RNA, 64 nt, Human
ugguuuuccuguuugucccucccauguuuaaaaaucuauccaagguucauguuccaaagucaag

SEQ ID NO: 118045 - RNA, 64 nt, Human; identical to SEQ ID NO: 116105

SEQ ID NO: 118046 - RNA, 64 nt, Human
cuugcauguugccuggauugauuucuucuuucccucuauccaaaggagcuugguaagugccuua

SEQ ID NO: 118047 - RNA, 64 nt, Human
aacuuaaauuggcuacaggacauuuuauuagcuuucuauccagcaucugguccaaacgauggga

SEQ ID NO: 118048 - RNA, 64 nt, Human
uuguuuccgucuagucuaacuuuuugaguguguuucuauccagccacauagcccauaucuacuc

SEQ ID NO: 118049 - RNA, 62 nt, Human
uuauuuguaucuguugcagaaauuccaguggaucuauccaacacagaaacugaacaaaauga

SEQ ID NO: 118050 - RNA, 64 nt, Human
caggagccacagguaaucgagaauguuugugaacucuauccacauccccucccccaccugccaa

SEQ ID NO: 118051 - RNA, 64 nt, Human
uugaacugucagcccacagcagcaauaugcuuauucuauccacaucccuaacaucaugcauuca

SEQ ID NO: 118052 - RNA, 64 nt, Human
gaacacugcucacacgcgaguuuucacaguuauuucuauccacgccuaugaaucuuuggacggu

SEQ ID NO: 118053 - RNA, 64 nt, Human
gaugaggaaguaaggguuuagcaagguuaagagaucuauccaauuuacacagcaaguuaguagu

SEQ ID NO: 118054 - RNA, 64 nt, Human
uaagugcaugcaaaaagccaccaaaugaagggauucuauccagcaagauccuguccaagaguag

SEQ ID NO: 118055 - RNA, 64 nt, Human
agggccugaaauuuugugucugaugcugcucccuucuauccaacauucaacaacgggucugaau

SEQ ID NO: 118056 - RNA, 64 nt, Human
gggaguacacuuggguguucuaggagggaugcagucuauccaugcacuuggguggaggggaguc

SEQ ID NO: 118057 - RNA, 64 nt, Human
accuacaugucagguucuggaguuggcccugagcucuauccaccaagccagcaccccaccaucc

SEQ ID NO: 118058 - RNA, 64 nt, Human
ggaggccgcuaagcaugguagaggcuagaggaagucuauccacaggcaguuguguucccagcaa

SEQ ID NO: 118059 - RNA, 64 nt, Human
cuuaaccguaccaguuuucuauuuauaacucuuaucuauccaugauguuuuaaagucuccacuu

SEQ ID NO: 118060 - RNA, 64 nt, Human
gggggccggggcuuaccauguaggggaggggagaucuauccacauaccucagguaacagggagg

SEQ ID NO: 118061 - RNA, 64 nt, Human
aaaccucuucccgcagccuggcuccuguguucccucuauccagccaaugccuguuuacacagac

SEQ ID NO: 118062 - RNA, 64 nt, Human; identical to SEQ ID NO: 116531

SEQ ID NO: 118063 - RNA, 64 nt, Human
ucccaaguuuccauagcaacaggaaaaaaaaaaaucuauccaaaucugaagauugcgguuuaca

SEQ ID NO: 118064 - RNA, 64 nt, Human
gguuuugugucauuaacugaaaaguagcagcuucucuauccaggaugaugagucaacagguuuc

SEQ ID NO: 118065 - RNA, 64 nt, Human
agguuuuguaauuuagcuucugguacuacauguaucuauccacacacugcugaagggaacuuga

SEQ ID NO: 118066 - RNA, 64 nt, Human
ucccuucuccuccuguguuuaaguggauggccccucuauccauccaggucccaugccaagaacc

SEQ ID NO: 118067 - RNA, 64 nt, Human
uuuucgcacccuuugugaacuaaguucaaugcgcucuauccaaauuugccuaauugaacuauaa

SEQ ID NO: 118068 - RNA, 64 nt, Human
gagcaccuccgcuuccccccugcuuccccaggucucuauccagagagaguccccagguacaaca

SEQ ID NO: 118069 - RNA, 64 nt, Human
uuccaaacugacucaacagucaucgcucguguguucuauccaaacauguauuuauguaaugaag

SEQ ID NO: 118070 - RNA, 64 nt, Human
aacugcuuuauccaagaaugcugaaaaauacuguucuauccagguuuccuaaacuauaaaagca

SEQ ID NO: 118071 - RNA, 64 nt, Human
uuucaauuuuuacauauuuuuaaauuacuuaucuucuauccaaggaggucuacagagaaauuaa

SEQ ID NO: 118072 - RNA, 64 nt, Human
caggcucugggaauauugagauaaauaagaugcuucuauccauuuauucaagcacauauugguc

SEQ ID NO: 118073 - RNA, 64 nt, Human
gccuuugaugaacuguuuuguaagugcugcuauaucuauccauuuuuuaauaaagauaauacug

SEQ ID NO: 118074 - RNA, 64 nt, Human
cuucugugagauuuuccaucaucucaaguucucuucuauccaggagcaaagcacaggaucauaa

SEQ ID NO: 118075 - RNA, 64 nt, Human
augacagggcugacuucauuagcugaggauuauuucuauccaauuuccugaugaaggacauugc

SEQ ID NO: 118076 - RNA, 64 nt, Human
gucugccccguaugauaucaggaccauccugcucucuauccagugccugcuaggacaacucaac

SEQ ID NO: 118077 - RNA, 64 nt, Human
gucacaucacugaguuuauccaccgccauccaccucuauccaccccauaaggucccuacagcaa

SEQ ID NO: 118078 - RNA, 64 nt, Human
cuccgucugcccugugccuauauauacacaugcgucuauccauacugugcuuuuaucugugauu

SEQ ID NO: 118079 - RNA, 64 nt, Human; identical to SEQ ID NO: 117553

SEQ ID NO: 118080 - RNA, 64 nt, Human
agcccggcugcacaccaggcugcugcuuuguccgucuauccacccgcccacccgcccccacccc

SEQ ID NO: 118081 - RNA, 64 nt, Human
uuucugugucaguuucucucccucuccucaccccucuauccauuccucccgccccagccaccuc

SEQ ID NO: 118082 - RNA, 64 nt, Human
guacauagaggauuccaucugggacucagagcuuucuauccaucugagagccaacacaggagaa

SEQ ID NO: 118083 - RNA, 64 nt, Human
ugggugaagaucauugauuaggugaaggauuauuucuauccaauuugugaagaaggaggacuuu

SEQ ID NO: 118084 - RNA, 64 nt, Human
caagagacaucauguaaacauauguggcagagggucuauccaggccucgcagguuacuaggcau

SEQ ID NO: 118085 - RNA, 64 nt, Human
guccaggaaugggugugagcagcccagagcccucucuauccacuuggucuggccagccaggccc

SEQ ID NO: 118086 - RNA, 64 nt, Human
gugggcugggaugugcauccugcuucccaacuccucuauccaagacugugcccacauccgaagc

SEQ ID NO: 118087 - RNA, 64 nt, Human
uuguaugcuuaaauaaagcaauuagugaagcacuucuauccaaaaugacuuuuuuguccuuuuu

SEQ ID NO: 118088 - RNA, 64 nt, Human
agagagcuaauucacucucucuuuaccuucuuguucuauccaggcccucaacaaauuggaugag

SEQ ID NO: 118089 - RNA, 64 nt, Human
uacugggauaauuauccaaauaaauugcaagcauucuauccaaaugguaagcagaacaucuuau

SEQ ID NO: 118090 - RNA, 64 nt, Human
gacccccagauguaggucaguggccuuaccugucucuauccaugcugucaacuccugccuccac

SEQ ID NO: 118091 - RNA, 64 nt, Human
ucagaaaaagcuagcacuaacucguguuuggagcucuauccauauuuuacugaucucuuuaagu

SEQ ID NO: 118092 - RNA, 64 nt, Human
acucugcucuguacccccagauguguauccgccuucuauccagccggcacccuaugcucuacag

SEQ ID NO: 118093 - RNA, 64 nt, Human
auaaguuaaaaugaucaaucaagauaaaaggugaucuauccauccaauggaauauuauuuggcc

SEQ ID NO: 118094 - RNA, 64 nt, Human
aggggaaacuuguuagauguccuuuguaucuuuuucuauccauuuguauuuuuucuuucccaaa

SEQ ID NO: 118095 - RNA, 64 nt, Human
aagcagcaaguagcaaacuucaggagagcuacuuucuauccaaauaauuuaaaaaacacuuuuc

SEQ ID NO: 118096 - RNA, 64 nt, Human
agggagaguuugguuuggggucuauaucuagagggaccuucaaaguauuuguuccuuuaaauuu

SEQ ID NO: 118097 - RNA, 64 nt, Human
ucuagauggaauuggccacauuugcuuuagucucucuauccagcuaaauaggcuuggggaaagc

SEQ ID NO: 118098 - RNA, 64 nt, Human
uuuugcaaauaagaauaugaaaaauacuguuucuucuauccaacucucuuaugaaaaggaacuc

SEQ ID NO: 118099 - RNA, 64 nt, Human
ugugucccauaaucuggcucaugguaccuguucuucuauccaaaccuuucaauucaugcuaccu

SEQ ID NO: 118100 - RNA, 64 nt, Human
ccagggcccugcagaggggaaaccaguguagccuugcccggauucugggaggaagcagguugag

SEQ ID NO: 118101 - RNA, 64 nt, Human
ucaaguuauaaauauccccagaaccuuggcuacgugcccggaagccuguugucucuaacuguac

SEQ ID NO: 118102 - RNA, 64 nt, Human
auugucaaaauaaaaacaauaauucaaguaacaaugcccggaauauacguccuaacuacacccc

SEQ ID NO: 118103 - RNA, 64 nt, Human
cuaauggcuuugacuaaauuacccccauccuccuugcccggaaaagggagagcuagagccacuc

SEQ ID NO: 118104 - RNA, 64 nt, Human
ugaacgcaguuuggaugucuuugaggacagacauugcccggaaacucagucuauuuauucuuca

SEQ ID NO: 118105 - RNA, 64 nt, Human
aggaucccaucagaaaggugcugacuaaacugguugcccggacacucaacagccuccaccuccc

SEQ ID NO: 118106 - RNA, 64 nt, Human
cucaaaaggcaaugauuugugagauaauauggcaugcccggagcccugcucaucaaugaaaaac

SEQ ID NO: 118107 - RNA, 64 nt, Human
gguuuacuuuguucaaguuagugguaggaaacauugcccggaauugaaagcaaauuuauuuuau

SEQ ID NO: 118108 - RNA, 61 nt, Human
aaaagaggaagaagaaguaggaggagcugugugcccggauccgaggagcaaguuaaucugu

SEQ ID NO: 118109 - RNA, 64 nt, Human
gguaagaaacugaaagcaagaggaggaagauaaaugcccggagauuccaaguggcagacauuuc

SEQ ID NO: 118110 - RNA, 64 nt, Human
agcagcacggcuggugagcugcaggcugcggccuugcccggacacuugguaaugccaaacaagu

SEQ ID NO: 118111 - RNA, 64 nt, Human
aaagaagguggccuaaaaacugacacauggccagugcccggaggggucuggaggcauaagucua

SEQ ID NO: 118112 - RNA, 64 nt, Human
gauuccaaaaugaggcccuggagugcgcaaggagugcccggaugcuugggguggguguuccucc

SEQ ID NO: 118113 - RNA, 64 nt, Human
gagcgaggcagcugaucuuccggauugggggccuugcccggaagcuggaccucacggagaugaa

SEQ ID NO: 118114 - RNA, 64 nt, Human
cucaccucacccacgcgaaaaccuuccucagcuaugcccggaccuccaucagagccagucucac

SEQ ID NO: 118115 - RNA, 64 nt, Human
accaguagcuucccaaaaacagccccccugcugcugcccggaggguucacugagggguggcacg

SEQ ID NO: 118116 - RNA, 64 nt, Human
ugcuugcuacacaggcaacgauucccccaucagcugcccggacccuuuggccuggcuuggugug

SEQ ID NO: 118117 - RNA, 64 nt, Human
ucaaagcgcuaaccagccaggggcaggccccugaugcccggaagcuccugcgugcauccccggg

SEQ ID NO: 118118 - RNA, 53 nt, Human
ccgugaaugccagacuuuaagauugcccggaggaagcaaacucuucguauaaa

SEQ ID NO: 118119 - RNA, 64 nt, Human
gucaguggccaaggcuacacagaaggcucccugcugcccggagcagguacauccaccagagcaa

SEQ ID NO: 118120 - RNA, 64 nt, Human
gaggcccgccugcacccugccgggccugcucagcugcccggagagccgccgccgcuggaggaga

SEQ ID NO: 118121 - RNA, 64 nt, Human
aagaaaaugagccaaugggcuucauucucagucaugcccggagaucacccaggagaaauaauac

SEQ ID NO: 118122 - RNA, 64 nt, Human
caaggaacccaaggacugccagaaaaccaccagcugcccggagaggcaggacaggauccuuccc

SEQ ID NO: 118123 - RNA, 64 nt, Human
ugagggagccggggcuccccauugccacccacagugcccggaauggcccuaggaggcccucuga

SEQ ID NO: 118124 - RNA, 64 nt, Human
cuggugccuucugcagccagcgcccacccauccgugcccggacccuugggaaugcccgcggcuc

SEQ ID NO: 118125 - RNA, 64 nt, Human
ucugccagaagccuuccccugcaaggugcccaccugcccggagacagagggagcagcugaggcc

SEQ ID NO: 118126 - RNA, 64 nt, Human
acagcccuuguugaggucagcagggaggaggggcugcccggaguuggguccuugccuggauuuu

SEQ ID NO: 118127 - RNA, 64 nt, Human
auaaggugccaccccaucauccaagcugccacacugcccggagcagccuguuccugcacuccac

SEQ ID NO: 118128 - RNA, 64 nt, Human
ucaucauauuaauauuugaguuauuuuuauuguaugcccggaguuugcaugagauuuuuucuca

SEQ ID NO: 118129 - RNA, 57 nt, Human
cacugggcucccgcaaguaaggaggucugcccggagcagcagcuucuccaggaagcc

SEQ ID NO: 118130 - RNA, 64 nt, Human
ucacccuccugcaaguaaacaacugguucaucaaugcccggaggcgcauccugcagcccaugcu

SEQ ID NO: 118131 - RNA, 64 nt, Human
caggagccaagaaaagagaacuacgaggaacaggugcccggaaccuucuuggcaccaaacacua

SEQ ID NO: 118132 - RNA, 64 nt, Human
ucaaauauauuuuacguuugcagcacaacaccauugcccggaggcuuccgaaucuagcaaagca

SEQ ID NO: 118133 - RNA, 64 nt, Human
gggccaccccgugccccugugcugcggggccuuuugcccggaggccgggcccuaagguuuuguu

SEQ ID NO: 118134 - RNA, 64 nt, Human
agguucugguuggacaaguuuaaaaucaaaguagugcccggaauucccucaaaccacccaacuu

SEQ ID NO: 118135 - RNA, 64 nt, Human
caccgaccuggccuucaagcaggcccgggacggcugcccggagcccucggcugccaugcuguga

SEQ ID NO: 118136 - RNA, 64 nt, Human
guggcauguccuccgaguggcagcggacaugguaugcccggaugcccccgcgagccccagcgcc

SEQ ID NO: 118137 - RNA, 64 nt, Human
cuggcucugccugcuccugcaacagugcggucccugcccggagaacucaggaggccugcagaag

SEQ ID NO: 118138 - RNA, 64 nt, Human
cugcccagccaugcuccaucggcugugagggcagugcccggagaggccagaggguuggagcugc

SEQ ID NO: 118139 - RNA, 64 nt, Human
ugccuuggccucacuguaccagugguucccucucugcccggauucugagcucagugugguguuu

SEQ ID NO: 118140 - RNA, 64 nt, Human
ccgaaagcuuuccaccucagccucagaguccagcugcccggacuccagggcucuccccacccuc

SEQ ID NO: 118141 - RNA, 64 nt, Human
ggcuggggaacguccgcaagucaaugcucagagaugcccggagcugccucuuagacucgucugg

SEQ ID NO: 118142 - RNA, 64 nt, Human
cgggucagacucugaagccgaguugcugugggcgugcccggaagcagagcgccacacucgcugc

SEQ ID NO: 118143 - RNA, 64 nt, Human
agcuaagccucgggccgucagcaauaccucugagugcccggaugcccucccugcacccuuccau

SEQ ID NO: 118144 - RNA, 64 nt, Human
gacucgaaacagccuggaguuagauaucuucuuuugcccggauugauggggaggagggauuaaa

SEQ ID NO: 118145 - RNA, 64 nt, Human
uguauucaugucagcaccugagucacagcccaggugcccggaagcagccucuucgcauaggcag

SEQ ID NO: 118146 - RNA, 64 nt, Human
gccaguccccucgcugguacggaaugccgcugggugcccggaggcggccauggugucucgaugg

SEQ ID NO: 118147 - RNA, 64 nt, Human
aagaaucuucccgaggcugggcuguucccucuccugcccggacuguggccucgccggggagagc

SEQ ID NO: 118148 - RNA, 64 nt, Human
gcuuguguuuucagggccauauccaaaaaaaccuugcccggaccaacgucuugaagcuuuucuc

SEQ ID NO: 118149 - RNA, 64 nt, Human
ccugugucgggggcuuucaggguuucgugggguuugcccggaaggcggcuuuccucccccuggu

SEQ ID NO: 118150 - RNA, 64 nt, Human
cacguugcauuaaaccucacugaaaccugcuccgugcccggauguugaucaugcugguggcuug

SEQ ID NO: 118151 - RNA, 64 nt, Human
gccgggguuucaggcaggagacacgaggagggccugcccggaagucacaucggcagcagcuguc

SEQ ID NO: 118152 - RNA, 64 nt, Human
cagauccucaggaaaagccaaaaccgaggcccauugcccggauucgacacaaaagagggucccu

SEQ ID NO: 118153 - RNA, 64 nt, Human
ucggaccaggcucccucaggaccccauccuuuccugcccggaccgugaauucaucuccuugaag

SEQ ID NO: 118154 - RNA, 64 nt, Human
gcucucaugaucaagauggugaugguagagaagcugcccggaauaaacugaauuucauauguuc

SEQ ID NO: 118155 - RNA, 64 nt, Human
acacccugccuguggccccgccuccacuucauccugcccggaaugccagugcuccgagcucaga

SEQ ID NO: 118156 - RNA, 64 nt, Human
cuggcuugcagugcgcgugcacguggagagcuggugcccggagauuggacggccugaugcuccc

SEQ ID NO: 118157 - RNA, 64 nt, Human
aacuuugcgcguuaagccgggacagcugcuuugcugcccggagaguaguccgcgccaggaagag

SEQ ID NO: 118158 - RNA, 64 nt, Human
ccuggggaggguggcugugggaggccaaguccacugcccggaagucuugucagcccuaagccag

SEQ ID NO: 118159 - RNA, 64 nt, Human
uaacccuggaagggucuuccagucauggccauccugcccggagaggcgccuguaccuggcccag

SEQ ID NO: 118160 - RNA, 64 nt, Human
gcaauucuugcuucaggaucucucccaugcgagcugcccggagggugucagcagggcaagacac

SEQ ID NO: 118161 - RNA, 64 nt, Human
accagaugcuacuuuuuacuguauuguaguuuauugcccggagauguggggcuuuuuuuuuaaa

SEQ ID NO: 118162 - RNA, 64 nt, Human
ccugaguagcugggauuacaggcaugcaccaccaugcccggauaauuuuuguauuuuuaguaga

SEQ ID NO: 118163 - RNA, 64 nt, Human
agcugaggguggcagcagucugugcugggaucugugcccggaucugugcccauucucuucagua

SEQ ID NO: 118164 - RNA, 64 nt, Human
cacagugccuaagggcuaggccacccagagacugugcccggagcuggccgugucucccacucag

SEQ ID NO: 118165 - RNA, 64 nt, Human
gcugggucuuacccgcagcacgagugucucgggcugcccggagucgcccgggagcaggugcugc

SEQ ID NO: 118166 - RNA, 64 nt, Human
cagaugacuuggacuucagcaaccuggcuuuugaugcccggauugcaagaauaaaugcccuaaa

SEQ ID NO: 118167 - RNA, 54 nt, Human
ugcggucccagauagccugaauccugcccggaguggaagcugaagccugcacag

SEQ ID NO: 118168 - RNA, 54 nt, Human
gccgccucuugccacccugagcacugcccggaucccgugcacccugggacccag

SEQ ID NO: 118169 - RNA, 64 nt, Human
uugcagacugaacagacguuuaucuaucccauuuggcgacgaggacucguggcuggagagagcc

SEQ ID NO: 118170 - RNA, 64 nt, Human
aagaagcucgcuaccuguucucucuggucagcagggcgacgagggaagguuuccgacgcaggca

SEQ ID NO: 118171 - RNA, 64 nt, Human
cugccagcagagggagguagaagccaucauggagggcgacgaggaggacagaggcugcugcugc

SEQ ID NO: 118172 - RNA, 64 nt, Human
ucugaaugacucugucuugugggugucugacaguggcgacgaugaacaugccguugguuuuauu

SEQ ID NO: 118173 - RNA, 64 nt, Human
aggugagaaggcguccacaaaagaggggagaaaaggcgacgaaucaggacacagugaacuuggg

SEQ ID NO: 118174 - RNA, 64 nt, Human
ccuuccuaucguguccuuggguucgggucacugcggcgacgacuugcucagacugucccggcgg

SEQ ID NO: 118175 - RNA, 64 nt, Human
gcugagacgcucgccccgacgcauggacccgagaggcgacgacacgagugaauaaagugcacau

SEQ ID NO: 118176 - RNA, 58 nt, Human
ucacccucacgcccugcuaagcucccggggcgacgaggcugcugcguucacacuaaua

SEQ ID NO: 118177 - RNA, 64 nt, Human
ccgacccuuggucuacagcacggguucucagucgggcgacgauuuggcugucuaggcgucauuu

SEQ ID NO: 118178 - RNA, 64 nt, Human
guccucacguucccaggagggcggcuucacccuucguaaccaggagacaaggcggccauggauu

SEQ ID NO: 118179 - RNA, 64 nt, Human
accgccuaagaaacagaacuucgagaaguccuaacguaaccacaguaaagcagacuccccuuuc

SEQ ID NO: 118180 - RNA, 64 nt, Human
gaagcauaauuagaagcagaagaacaaaaugccacguaaccaaagcaucagagccaucauugca

SEQ ID NO: 118181 - RNA, 64 nt, Human
ggaaugcaccccacauucccaugauggaagucugcguaaccaauaaauugugccuuucucacuc

SEQ ID NO: 118182 - RNA, 64 nt, Human
gcaacauuaagugcuaugcuagucacuuagcugacguaaccagcuugguuaagcagcuuaugaa

SEQ ID NO: 118183 - RNA, 64 nt, Human
aaagcacggacucuuacugcuaacuuuuguguaucguaaccagccagauccucuugguuauuug

SEQ ID NO: 118184 - RNA, 64 nt, Human
uuuuaaaaaucauguuugacaucuuucuauugcucguaaccagucccuguagcugucuaaguua

SEQ ID NO: 118185 - RNA, 64 nt, Human
gacaaugucuggcugaagcccgcuuucagcacgccguaaccaggggcugacaaugcgaggucgc

SEQ ID NO: 118186 - RNA, 64 nt, Human
guaacauuggcuuaccuguauauuauaugccacccguaaccauaaaaacaccaggauuuagguu

SEQ ID NO: 118187 - RNA, 64 nt, Human
gaccuugacuacucaguccagcgcucaggaauaucguaaccaguuuuuucaccuccaugucauc

SEQ ID NO: 118188 - RNA, 64 nt, Human
ugauguccuugcaaaugcauuacccuguggaaaacguaaccacuggucagcccuagcugacaaa

SEQ ID NO: 118189 - RNA, 64 nt, Human
acauucaauuccagaguaguuucaaguuucacaucguaaccauuuucgcccccauggcccaugu

SEQ ID NO: 118190 - RNA, 64 nt, Human
uauuugaauagagaguaaagcuccuccgcuguuucguaaccauauccuuucccccgcuaacugg

SEQ ID NO: 118191 - RNA, 64 nt, Human
caccccauccaccuuacagggaccagggggcccacguaaccaggacccagaggguggagcucuu

SEQ ID NO: 118192 - RNA, 64 nt, Human
cuucuuuugcucugaggugugggcucccucaucucguaaccagagaccagcacaugucagggaa

SEQ ID NO: 118193 - RNA, 64 nt, Human
agagggagaagggauggaggucacacugguagaacguaaccacggaaaagagcgcaucaggccu

SEQ ID NO: 118194 - RNA, 64 nt, Human
uaacgaaccguaaaaaaaggagcagguaaugaaucguaaccaaaacuacaguugauccuccgca

SEQ ID NO: 118195 - RNA, 64 nt, Human
auuguuaguugucaaccuuggcugauggaaaucccguaaccacuauuuguugcacugugccuug

SEQ ID NO: 118196 - RNA, 64 nt, Human
ccaaagucaaaggauuugaaccugcaucuggaaacguaaccacucacagcaccuggcccgccaa

SEQ ID NO: 118197 - RNA, 64 nt, Human
agauguaauuauugacagauuaaauagauaacuucguaaccaccagggggcagauucaauacau

SEQ ID NO: 118198 - RNA, 64 nt, Human
cacagagggagcagacaguggguaccacgaucuccguaaccauuugcaugugacuuagcaaggg

SEQ ID NO: 118199 - RNA, 64 nt, Human
gucuuuucugccaccuguuaccccucggagacuccguaaccaaacucuucggacugugagcccu

SEQ ID NO: 118200 - RNA, 64 nt, Human
auaagcacucauguuauuaaagguuuugccuugucguaaccaaccgagccggggguguuuuguu

SEQ ID NO: 118201 - RNA, 64 nt, Human
gccuccgcagaugagguuccugccccuuccuccucguaaccaaaacccucacugcucccaggac

SEQ ID NO: 118202 - RNA, 64 nt, Human
uuuaaaagguaauaauacucugaaagaaaaaugacguaaccacagcguguacuaugaaagcugu

SEQ ID NO: 118203 - RNA, 64 nt, Human
gauucaccuuucguuucccuuuccccaaaaguagcguaaccaacauuuaagcuugcuuaaaaac

SEQ ID NO: 118204 - RNA, 64 nt, Human; identical to SEQ ID NO: 118178

SEQ ID NO: 118205 - RNA, 64 nt, Human; identical to SEQ ID NO: 118179

SEQ ID NO: 118206 - RNA, 64 nt, Human; identical to SEQ ID NO: 118180

SEQ ID NO: 118207 - RNA, 64 nt, Human; identical to SEQ ID NO: 118181

SEQ ID NO: 118208 - RNA, 64 nt, Human; identical to SEQ ID NO: 118182

SEQ ID NO: 118209 - RNA, 64 nt, Human; identical to SEQ ID NO: 118183

SEQ ID NO: 118210 - RNA, 64 nt, Human; identical to SEQ ID NO: 118184

SEQ ID NO: 118211 - RNA, 64 nt, Human; identical to SEQ ID NO: 118185

SEQ ID NO: 118212 - RNA, 64 nt, Human; identical to SEQ ID NO: 118186

SEQ ID NO: 118213 - RNA, 64 nt, Human; identical to SEQ ID NO: 118187

SEQ ID NO: 118214 - RNA, 64 nt, Human; identical to SEQ ID NO: 118188

SEQ ID NO: 118215 - RNA, 64 nt, Human; identical to SEQ ID NO: 118189

SEQ ID NO: 118216 - RNA, 64 nt, Human; identical to SEQ ID NO: 118190

SEQ ID NO: 118217 - RNA, 64 nt, Human; identical to SEQ ID NO: 118191

SEQ ID NO: 118218 - RNA, 64 nt, Human; identical to SEQ ID NO: 118192

SEQ ID NO: 118219 - RNA, 64 nt, Human; identical to SEQ ID NO: 118193

SEQ ID NO: 118220 - RNA, 64 nt, Human; identical to SEQ ID NO: 118194

SEQ ID NO: 118221 - RNA, 64 nt, Human; identical to SEQ ID NO: 118195

SEQ ID NO: 118222 - RNA, 64 nt, Human; identical to SEQ ID NO: 118196

SEQ ID NO: 118223 - RNA, 64 nt, Human; identical to SEQ ID NO: 118197

SEQ ID NO: 118224 - RNA, 64 nt, Human; identical to SEQ ID NO: 118198

SEQ ID NO: 118225 - RNA, 64 nt, Human; identical to SEQ ID NO: 118199

SEQ ID NO: 118226 - RNA, 64 nt, Human; identical to SEQ ID NO: 118200

SEQ ID NO: 118227 - RNA, 64 nt, Human; identical to SEQ ID NO: 118201

SEQ ID NO: 118228 - RNA, 64 nt, Human; identical to SEQ ID NO: 118202

SEQ ID NO: 118229 - RNA, 64 nt, Human; identical to SEQ ID NO: 118203

SEQ ID NO: 118230 - RNA, 64 nt, Human
uuuugucauugauuaaaagugauuuuagcccuaggcccgaaaugacuagcaaauaucauuuucu

SEQ ID NO: 118231 - RNA, 64 nt, Human
ucaggaagugucagagcauggccaguaguuggcagcccgaaagacacacagcacccucuuaugu

SEQ ID NO: 118232 - RNA, 64 nt, Human
ccagaccuacacaaucagaaacucuugggggagggcccgaaauaucuauguuuuaccaagccca

SEQ ID NO: 118233 - RNA, 64 nt, Human
agaagacagaaacaagcaaagccgccaccacagagcccgaaacaacccagccggaagggguggu

SEQ ID NO: 118234 - RNA, 50 nt, Human
augaugagacacauucauaggcccgaaacaccuuaaagacuucugucauu

SEQ ID NO: 118235 - RNA, 64 nt, Human
gaccuaggcggucuuguggcccggagccggcccggcccgaaaaccauagaccugguuguacugu

SEQ ID NO: 118236 - RNA, 64 nt, Human
uccugcagaguguaaucagcaccccauccaacuggcccgaaagcccagaccugcagcagaacuc

SEQ ID NO: 118237 - RNA, 64 nt, Human
uuacagcaugacaagcucaaauaauuaugagucagcccgaaaggauguuaauuaugccuacgau

SEQ ID NO: 118238 - RNA, 64 nt, Human
uuuuuuuuuuuggaaauugaagcuguagagugcugcccgaaaucucuaggaaguugguggcaag

SEQ ID NO: 118239 - RNA, 64 nt, Human
ucuucuuucuuaaugccugaaauuuucuccauuggcccgaaagcaguaaaaauuguucauuaau

SEQ ID NO: 118240 - RNA, 64 nt, Human
uguccaggaugcuggcugguggaacaaccugcuggcccgaaacaaggcugccagguguggauac

SEQ ID NO: 118241 - RNA, 64 nt, Human
cugcaggcaugcugacuguccugauugcgauccagcccgaaauucccuccucugcuuucaaaag

SEQ ID NO: 118242 - RNA, 64 nt, Human
caucaacaucgcagaugagcugccccgcucccgugcccgaaaacuggcggaugaacagcucagu

SEQ ID NO: 118243 - RNA, 64 nt, Human
ccccagccugggccaucucuuaggugagacaguugcccgaaacuaagccaggccuggcuggagg

SEQ ID NO: 118244 - RNA, 64 nt, Human
aaacucuuaauuagaccuaggccucagcugcacugcccgaaaagcauuugggcagacccugagc

SEQ ID NO: 118245 - RNA, 64 nt, Human
aucucauggugaccaacucucagaaacuccagcugcccgaaaacuucgauauccacccuguggg

SEQ ID NO: 118246 - RNA, 64 nt, Human
uuuuuuuuuuuucaaauggggucaguaccugaaagcccgaaaccccauaccaagcuuauaguua

SEQ ID NO: 118247 - RNA, 64 nt, Human
gugacaaguccaaggucacgaagacuuucuuggagcccgaaacaccacccucugcuccuccuuc

SEQ ID NO: 118248 - RNA, 64 nt, Human
ucuuauagagaagugaauuucacuuacuccccuggcccgaaaacuagaccaaaugaggaacugu

SEQ ID NO: 118249 - RNA, 56 nt, Human
gcucccagaccguuaccuagcccagcgcccgaaagccgucucuucuaugcaauaac

SEQ ID NO: 118250 - RNA, 64 nt, Human
cucuuuacucuuacuuuaacuauuuugcuggcuugcccgaaaauuugccuggcaagucuuccuu

SEQ ID NO: 118251 - RNA, 64 nt, Human
cucuacaguaaaaucucuacacuaacaguuuaaagcccgaaagcugaagcauucagccucugca

SEQ ID NO: 118252 - RNA, 64 nt, Human
augcccuguggguaucaguucugcugacacuuuggcccgaaauagauccagugcugagcaagca

SEQ ID NO: 118253 - RNA, 64 nt, Human
ugauguccaggcaaaaauugacaauacauuucuugcccgaaauaagaacccauuauuuccagug

SEQ ID NO: 118254 - RNA, 64 nt, Human
ccccucacccccagcuggaaauuaagaaaaagucgcccgaaacaccaagugaggccauagcaau

SEQ ID NO: 118255 - RNA, 64 nt, Human
ccagcagggucuccugugagccggggaccaugcagcccgaaaccuccagucacugcgcccggca

SEQ ID NO: 118256 - RNA, 64 nt, Human
auaugacguuaccuugcagacuaaaagguugaaggcccgaaacuaacuuuuagcuaacaauaag

SEQ ID NO: 118257 - RNA, 64 nt, Human
guucacggccagcaagugagccgcuccaucaggggcccgaaacucucaagccccuuucuggaga

SEQ ID NO: 118258 - RNA, 64 nt, Human
cuuaagucggggguggcaagggggcggggcgggggcccgaaagcugagacccucgccacgggga

SEQ ID NO: 118259 - RNA, 64 nt, Human
cccuuggagcucugaguuccggcaccaguagcaggcccgaaagaggcacccuuccaucugauuc

SEQ ID NO: 118260 - RNA, 64 nt, Human
ugucuccugauaagauguuaucaaugacaauggugcccgaaaccucauuagcaauuuuaauuuc

SEQ ID NO: 118261 - RNA, 64 nt, Human
cauuuuacccauuuccugucccugagcaaacaacgcccgaaauacccucugcuacccacuagcc

SEQ ID NO: 118262 - RNA, 64 nt, Human
ugacuggcccuuuucccgguguccgugugucacagcccgaaaaccuccuguaugccacgcccuu

SEQ ID NO: 118263 - RNA, 64 nt, Human
gaggcugugguuugggggagaagaaguagggguggcccgaaagggucuccgaaaugcugucuuu

SEQ ID NO: 118264 - RNA, 64 nt, Human
ccuccugguucucaccaggaaaacauccaaagcuuuggaggaaacaggcccugccccuggcucc

SEQ ID NO: 118265 - RNA, 52 nt, Human
gccagcuggagcuggccuagccuuggaggacugcaggaggagggcaggguug

SEQ ID NO: 118266 - RNA, 64 nt, Human
aaaguguuuuuguauauaauguauuuuuucacuuuuggaggauucuuuuuguauaacuucaaua

SEQ ID NO: 118267 - RNA, 64 nt, Human
uuaauuuauauccacccaaguacauaaagcaaauuuggaggaaacaacugaaguugugcaauau

SEQ ID NO: 118268 - RNA, 64 nt, Human
uuaaagugcuuucuaaaaggaaauuuuuucaccuuuggaggagaauauauuagaguugugggua

SEQ ID NO: 118269 - RNA, 64 nt, Human
auucacuuggcuccucagcaaggaagcaaacgccuuggaggagaagcacaugguugcccuuuug

SEQ ID NO: 118270 - RNA, 61 nt, Human
ucugccucaggagaaacugaagccagaauacuuggaggaacuuccuacaaugaugcagcac

SEQ ID NO: 118271 - RNA, 64 nt, Human
uccagcuaaccucucaaucaggcaaacauucuucuuggaggaaucaggcaaacaucucaaaaau

SEQ ID NO: 118272 - RNA, 64 nt, Human
uauaaaaaguuugcccuggaugucauauuggcaguuggaggacacaguuucuauuguaaauuug

SEQ ID NO: 118273 - RNA, 64 nt, Human
gcuuaagacugauuagucuuagcauuuacuguaguuggaggauggagaugcuaugauggaagca

SEQ ID NO: 118274 - RNA, 64 nt, Human
gcuggcucacgcguucugggagcucaaggccaccuuggaggaggaugccacgcacuuccucucu

SEQ ID NO: 118275 - RNA, 64 nt, Human
aggggaagcaaaaaccaaaaugugugacugggcuuuggaggagacuggagccucagcccugucc

SEQ ID NO: 118276 - RNA, 64 nt, Human
ucgcccgccccagcccggggccgcucaggucugcuuggaggaugccucccccaggagggcagug

SEQ ID NO: 118277 - RNA, 64 nt, Human
gugaguugggggaccuggcaauagagcugcuugguuggaggaagugaagcuggcuuaguaccag

SEQ ID NO: 118278 - RNA, 64 nt, Human
gcauaugguauucuauaaaacagacuuacucuccuuggaggauauauuuuggagaaugcuucau

SEQ ID NO: 118279 - RNA, 64 nt, Human
acacuugacccuuccaugcugguucccaagccuauuggaggaauguggguguggccgaggugau

SEQ ID NO: 118280 - RNA, 64 nt, Human
acuaacucaaaucuuucaagccccgccucuccucuuggaggacagggcagccugcagcuguguc

SEQ ID NO: 118281 - RNA, 64 nt, Human
ggacauuugucaguuugccuucugacgguagcuuuuggaggaagauuccugcagccacuaaugc

SEQ ID NO: 118282 - RNA, 64 nt, Human
ugaauuuuugcuucauuacugaccauauaugaccuuggaggaacucuuuuuuuuuuuuccuucu

SEQ ID NO: 118283 - RNA, 64 nt, Human
uugacuccuuucuuuugggugcugccuauaaaucuuggaggaaucauuucuccuccucaaaaac

SEQ ID NO: 118284 - RNA, 64 nt, Human
ugacuuugccaaguaauuuguugacacgaaaauuuuggaggaaccaauugaaaacacacuucca

SEQ ID NO: 118285 - RNA, 64 nt, Human
ccugcuggucaaguuguaaauuaguauagcuacuuuggaggacaauuguaaaauuuaaaucaua

SEQ ID NO: 118286 - RNA, 64 nt, Human
guauauagaauuuugcuguauucaauaaaucuguuuggaggaaaauggaucuuuucuagauucu

SEQ ID NO: 118287 - RNA, 64 nt, Human
ucucuuucugccauacuugcuacugcuacugauuuuggaggaaauuuuucuagaagaacaaagg

SEQ ID NO: 118288 - RNA, 64 nt, Human
cuccugccagcccuacggaaguuccuuuuaugcauuggaggaaaaacauguuggcuuuucucuu

SEQ ID NO: 118289 - RNA, 64 nt, Human
cuuaggccagcccuacagaagugcuguuuacucauuggaggaacaguaccuuggcuuggcucuu

SEQ ID NO: 118290 - RNA, 64 nt, Human
gcuggaggaacagguucuuagaagaugauucaccuuggaggaagcuggggaaagugguuaggga

SEQ ID NO: 118291 - RNA, 64 nt, Human
cugacacaaucucucuuauccuugaggccacagcuuggaggagccuagaggccucaggggaaag

SEQ ID NO: 118292 - RNA, 64 nt, Human
cugauccagauccugaugcugagacaagcgaucuuuggaggaaacaagaaucccaagaggccaa

SEQ ID NO: 118293 - RNA, 64 nt, Human
gcugaccuggauccugaugcugagacaagcgauuuuggaggaaacaagaaucccaagggcccag

SEQ ID NO: 118294 - RNA, 64 nt, Human
cuugcccuaacggcccuccccugcaacauccgucuuggaggagaggcugcagccacagcacccu

SEQ ID NO: 118295 - RNA, 64 nt, Human
gaggguggaagaugaaaugaaagcuaugggacucuuggaggauacccagugucuauucuggguu

SEQ ID NO: 118296 - RNA, 64 nt, Human
aucaccucuucccucuccuacuuggcccagcugcuuggaggaccgaccccauggcugagaauau

SEQ ID NO: 118297 - RNA, 64 nt, Human
gagguggcaccaugaagaggagaagaugggggucuuggaggaaggaggaaaaggcaaggaggcu

SEQ ID NO: 118298 - RNA, 53 nt, Human
cuucugugaagaaaucauaacacuuggaggaaucagaagggaagaucaacagc

SEQ ID NO: 118299 - RNA, 64 nt, Human
aucucaagggugggagauagaaagguuaauagaguuggaggaguggaagcuauuuuguaugcaa

SEQ ID NO: 118300 - RNA, 64 nt, Human
cucagaccccagagcaguauuaaugaugcagagguuggaggagagagguggagacuguggcuca

SEQ ID NO: 118301 - RNA, 64 nt, Human
cccuaugaugaacucccccaaagcaacgccguuuuuggaggaacucaaacccaguccaacaucc

SEQ ID NO: 118302 - RNA, 64 nt, Human
gcuuguuugcuucaacugucuccuaccucugcucuuggaggagauggggacagggcuggaguca

SEQ ID NO: 118303 - RNA, 64 nt, Human
acaaagccaucugggcagucaggggcaaggacuguuggaggagaguuagcccaaguauaggcuc

SEQ ID NO: 118304 - RNA, 64 nt, Human
ccugccccuccaggccacugaguguuuuggccacuuggaggaccugggaggagggagugugucc

SEQ ID NO: 118305 - RNA, 64 nt, Human
uuuuuuuuccccucuccccuauuuuuuaaguaccuuggaggaggagagguuggugacaugcaug

SEQ ID NO: 118306 - RNA, 64 nt, Human
aucagucauuggcuucuuaucuggaugaaggcuuuuggaggagaaccaaaacgacaaguuccaa

SEQ ID NO: 118307 - RNA, 64 nt, Human
acaccuguauucccaacacuuuuggaggcugagguuggaggauugcuugagcccaggaauuuga

SEQ ID NO: 118308 - RNA, 64 nt, Human
auuggaaauacugcagaugaugugaaguuaucaguuggaggagcugugauuaagcuggauaaua

SEQ ID NO: 118309 - RNA, 64 nt, Human
accaaaucaaaaucucuccacuuucagcugucuuuuggaggacguacguaauaagguuuuaauu

SEQ ID NO: 118310 - RNA, 64 nt, Human
ccuguccuuuguuauuauccugcauuuuacgucuuuggaggaacagcucccuaguggcuuccuc

SEQ ID NO: 118311 - RNA, 64 nt, Human
ccuucguuuugaacuacagauguuguaguggguuuuggaggagggaguggaguaagaugcccuc

SEQ ID NO: 118312 - RNA, 64 nt, Human
gaaacaucagagccagcuaagagaaaagaaauauuuggaggauauugaaagugugaaaaaaaag

SEQ ID NO: 118313 - RNA, 64 nt, Human
ccauuacauagaggaacacaaaauuccaggguuuuuggaggaagggauuagauagugacuaagc

SEQ ID NO: 118314 - RNA, 64 nt, Human
auagugauuagcugguuagccaucuuccuguuauuuggaggaguucugccaucuuuuauucggu

SEQ ID NO: 118315 - RNA, 64 nt, Human
uggaauaacccaagucagcaacaauuuaugcaauuuggaggaagcucuggaucacaguugccuc

SEQ ID NO: 118316 - RNA, 64 nt, Human
guggacaggugggaggaaaagaaaacuucuuaccuuggaggagggacaucccgcuuccuuaucc

SEQ ID NO: 118317 - RNA, 64 nt, Human
guguguugauguagacuugaaaugucuccacauuuuggaggacuuccucagcccuuuucauuga

SEQ ID NO: 118318 - RNA, 64 nt, Human
cucacagggcaggccuugcugggguccagggcuguuggaggaccccgagggcugaggagcagcc

SEQ ID NO: 118319 - RNA, 64 nt, Human
ggcuuaccaagggcuaccucagugggagaugagguuggaggaacgaaggcgagguuccuccuug

SEQ ID NO: 118320 - RNA, 64 nt, Human
agccgcuuuuuagacguuaucauuuugccucauguuggaggacuuuauggaauuuaagaaauac

SEQ ID NO: 118321 - RNA, 64 nt, Human
gggaaugaggaaucaggccccaagacagaaguacuuggaggagccagcugcaguaguauccgcc

SEQ ID NO: 118322 - RNA, 64 nt, Human
uaauguucauugacuggcuuuuuaaguguauauuuuggaggacgggugaagaggucauaacgaa

SEQ ID NO: 118323 - RNA, 64 nt, Human
auaaaacucuagcauucuaguuucauuuaaaaaguuggaggaucugaacauacagagcccacau

SEQ ID NO: 118324 - RNA, 64 nt, Human
ugcagcauggugucuguguacccgcuggucuuguuuggaggaggccaagugaaugugcagcuuc

SEQ ID NO: 118325 - RNA, 64 nt, Human
ccagugaggaggaagggaaggcgguucagagauguuggaggacaccccucgccaucucgcccuu

SEQ ID NO: 118326 - RNA, 64 nt, Human
acuauuuuauccuccacaguugcuuaacuugguguuggaggaggguuuaagcauuaagauagga

SEQ ID NO: 118327 - RNA, 64 nt, Human
ggguccuuguugauguuucuucuccuagccacacuuggaggaaaguugcagguggguugggcag

SEQ ID NO: 118328 - RNA, 64 nt, Human
gucccuggcggguaaauuaggaaucugcacuauuuuggaggacaaguagcacaaacuguauaac

SEQ ID NO: 118329 - RNA, 64 nt, Human
ccuuggugcauguucuagcuccacacacuaguccuuggaggaagguugagaccaaugauuuccu

SEQ ID NO: 118330 - RNA, 64 nt, Human
gaauguuauagugaauuaucccuuuucuugacuauuggaggaccaaaaaaauaagguguauugc

SEQ ID NO: 118331 - RNA, 63 nt, Human
aaaucaaagccucuucauaauaccagcucaccuuuggaggaauaaugacccaguauuuguccc

SEQ ID NO: 118332 - RNA, 64 nt, Human
aguguuuugagauuguauacauauauuccagaacuuggaggaaaucuuauuuaaguuuaugaau

SEQ ID NO: 118333 - RNA, 64 nt, Human
uuccaguucacauuuauuugguagcccaccuggguuggaggaagggcacgguggagagaaagug

SEQ ID NO: 118334 - RNA, 64 nt, Human
accuggaacccuggacuucacugggagggccaacuuggaggaucagugcuggcugacaagcccu

SEQ ID NO: 118335 - RNA, 64 nt, Human
gggcacugggaagagccugaagaugaggaaaaguuuggaggagcagcugacucagggguggagg

SEQ ID NO: 118336 - RNA, 64 nt, Human
uucuacagugugccauuuccaaauggaucuguuguuggaggaaacugguugcuagucaauguuc

SEQ ID NO: 118337 - RNA, 64 nt, Human
gacuaaagcuuaucaagucaacaaagaacuuaccuuggaggauagagagagagaagggaccaau

SEQ ID NO: 118338 - RNA, 64 nt, Human
ccugacucugcccccugcuggcucuucugcccaauuggaggaaagcaaccgguggauccucaaa

SEQ ID NO: 118339 - RNA, 61 nt, Human
agggcugcaacaaccaguagcucauggggccuuggaggagccuggccucucagccugcaua

SEQ ID NO: 118340 - RNA, 64 nt, Human
gcagcuggccaggaucagggcugucucaagcuucuuggaggaggcagggagaccguggguuccg

SEQ ID NO: 118341 - RNA, 64 nt, Human
cauacaucuucucuuuccuuguuuuccucuacaauuggaggagaaacaaauauauuucuuacua

SEQ ID NO: 118342 - RNA, 64 nt, Human
cuccaacacugaggaucaaauuucaacaugagauuuggaggaggucaaacaaacuaaacuguag

SEQ ID NO: 118343 - RNA, 64 nt, Human
gugguguuuggagaagcagagggugaacuugcuguuggaggagucuucuugaggaucuuuauug

SEQ ID NO: 118344 - RNA, 64 nt, Human
guuacaucuagaacuucuaugggcaucauuauuguuggaggagugguaagaaacauuacuuuua

SEQ ID NO: 118345 - RNA, 64 nt, Human
uucugccuagggaggagcuaagcaggcccggcaguuggaggaaggccagaggaacagcuuugug

SEQ ID NO: 118346 - RNA, 64 nt, Human
uaaaugcauauucacaaaguuaucugauagggccuuggaggagaagguccaguuuuaaaaaaug

SEQ ID NO: 118347 - RNA, 64 nt, Human
cugaacacugcaguuuguuagacuagagcugagguuggaggauuccauagugcuuuaaacguga

SEQ ID NO: 118348 - RNA, 64 nt, Human
acuugaagagaacugucgugucugauuugcacuauuggaggaggacuaaaguugccugacaacu

SEQ ID NO: 118349 - RNA, 64 nt, Human
ugcuucuguggcccccagcaagcucaccaccuccuuggaggagagagacauacaaggacagugg

SEQ ID NO: 118350 - RNA, 64 nt, Human
guggggaaucuauguuucacucagauuuauauguuuggaggaaaaaagccuuuuuuuguaaaau

SEQ ID NO: 118351 - RNA, 64 nt, Human
ccucccucacuuuuacuuucccuucccccauaaguuggaggauaaaauggguaucaaugcuaau

SEQ ID NO: 118352 - RNA, 64 nt, Human
aagccuuagaagaagagaugcugucuuggucuuguuggaggagcuugcuuuaguuagaugucuu

SEQ ID NO: 118353 - RNA, 64 nt, Human
uccuuccaacccuucccaccuuucccccacucccuuggaggaacugaaguugggguugaggaga

SEQ ID NO: 118354 - RNA, 64 nt, Human
ggcaaggggcaggacaggcccucagaagcagcucuuggaggagaugagcauuuuguuuugcaca

SEQ ID NO: 118355 - RNA, 64 nt, Human
uccaagugaaagguagggaaagugggagagggacuuggaggacccaccugugaggacccugacc

SEQ ID NO: 118356 - RNA, 64 nt, Human
uugagaauaacauagcugugcuauugcacaucuguuggaggacaucccagauuugcuuauacuc

SEQ ID NO: 118357 - RNA, 64 nt, Human
agauuucuucagaaucucaugcuuucugguaguauuggaggaggggguugguuaaaaugaaaau

SEQ ID NO: 118358 - RNA, 64 nt, Human
uuugcugaauccagauggguuagcagagggcaaauuggaggauuccuuugaggaaauguucuca

SEQ ID NO: 118359 - RNA, 59 nt, Human
aauucugcaguaaaaagugagccuccgccuuggaggagacuacugguucgcccaucugu

SEQ ID NO: 118360 - RNA, 64 nt, Human
auacagauguaugcucuccccucucagaugcgauuuggaggaagggccauacucagaucauuaa

SEQ ID NO: 118361 - RNA, 64 nt, Human
gugggaaucgguugagagccgcuuagcccgagccuuggaggagccggagccgcuccaacccggc

SEQ ID NO: 118362 - RNA, 64 nt, Human
ggugugcagggacugggggcucccggaagauuuuuuggaggaaguaacagcuacgaugggaugg

SEQ ID NO: 118363 - RNA, 64 nt, Human
ucucccgcugcaaucugggugguaacugccagccuuggaggaucguggccaacguggaccugcc

SEQ ID NO: 118364 - RNA, 64 nt, Human
auauuuguaagagcuuugaaagccagccugagaauuggaggauuuauucauaagaaaguguaga

SEQ ID NO: 118365 - RNA, 64 nt, Human
ucagcuauugauaauggccagagauauccacagcuuggaggagcccagagaccguuugcuuuau

SEQ ID NO: 118366 - RNA, 64 nt, Human
aucuucucuacuuggauuaugagauaaccuuuucuuggaggaaagaaacaccgcuuuacaaagg

SEQ ID NO: 118367 - RNA, 64 nt, Human
cuguggaaagcccauucggaacaauguuuuucacuuggaggauggugaacccuacugugagacu

SEQ ID NO: 118368 - RNA, 64 nt, Human
ggaaggaggguagagcacacugggagguuucaucuuggaggauuccucagcaggauacuucagc

SEQ ID NO: 118369 - RNA, 64 nt, Human
aacacuaguccuaccucugccacuaaugagguguuuggaggagguaccagccauauaauagggg

SEQ ID NO: 118370 - RNA, 64 nt, Human
cacuaauuuugauagauugcuguccuuaauaauuuuggaggaaauuaagccaaaugauuauugu

SEQ ID NO: 118371 - RNA, 64 nt, Human
auuuuuugccaaacuuaguaacucuguuaaauauuuggaggauuuaaagaacaucccaguuuga

SEQ ID NO: 118372 - RNA, 64 nt, Human
guggauuuguggauagcagagggaucgggaccucuuggaggaacccuggguaccaagcucccag

SEQ ID NO: 118373 - RNA, 64 nt, Human
caguauccuaggacagagagccauaaguagcccuuuggaggacugauggugucaaccaaaggca

SEQ ID NO: 118374 - RNA, 64 nt, Human
aacagaaaugcuuugguaauaccuacuuaguuaauuggaggaaguaguaaauaaacauuaggua

SEQ ID NO: 118375 - RNA, 64 nt, Human
caaaccacccaaaugaccaaggcauauauaguauuuggaggaaucagggguuuggaaggaguag

SEQ ID NO: 118376 - RNA, 64 nt, Human
auuuuucucuuuggcuucaaaagcauucugacauuuggaggagucaguaaccaaucccaccaac

SEQ ID NO: 118377 - RNA, 64 nt, Human
ggaucagcuuguuagccugcagauuccuuuucauuuggaggaaaucacaaguggccgaaaaaaa

SEQ ID NO: 118378 - RNA, 64 nt, Human
ucugcauuaucccuaagucacauuggaagugaacuuggaggaugcauauuuugauaugcuuuga

SEQ ID NO: 118379 - RNA, 64 nt, Human
cuuuguacucugaaaacgucaauuuauauugaacuuggaggaguuuggcaaagucugaauaggu

SEQ ID NO: 118380 - RNA, 64 nt, Human
ugaaucacaucuguaguacuuagccaaagacaauuuggaggagaauaucagccuucuggaagua

SEQ ID NO: 118381 - RNA, 64 nt, Human
aauguuuguaauuuccuagaaggaggauuauuaauuggaggaucugacaacaaacugauuuaua

SEQ ID NO: 118382 - RNA, 64 nt, Human
ccuccuuccagagcccaagaucaaugcucaaguuuuggaggacaugaucaccauccccauggua

SEQ ID NO: 118383 - RNA, 64 nt, Human
uggacaaagcuugacacaucaaguuaucaaggccuuggaggaggcucuguauguccucagggga

SEQ ID NO: 118384 - RNA, 64 nt, Human
cuaccaaccuaaauuucugccaagucaguucucuuuggaggaagcccauuacuccguaacugac

SEQ ID NO: 118385 - RNA, 64 nt, Human
uuccagagccuucugugguggagcauccugcugcuuggaggaugagucugaaguuuaaaaaugg

SEQ ID NO: 118386 - RNA, 64 nt, Human
ggaucaauauauuuaggugguauugaaaaugcuauuggaggagucacacuaauacuaucaacua

SEQ ID NO: 118387 - RNA, 64 nt, Human
cuaguuuuaaaaaccauuucccauuaaaaugaaguuggaggaacagcugcuucuggagccgggg

SEQ ID NO: 118388 - RNA, 64 nt, Human
aacuugaauugucaaugaguauuuuuggaagcauuuggaggaauuccuagacauugcguuuucu

SEQ ID NO: 118389 - RNA, 64 nt, Human
uugacacauugcacacacagucuguucagaggcauuggaggauggggguccugguaugucucac

SEQ ID NO: 118390 - RNA, 64 nt, Human
guggggugggcaugggguggggguaugggaacaguuggaggaaugggauaucuggggauaauuu

SEQ ID NO: 118391 - RNA, 64 nt, Human
uugagacuaaacugguuuguugcagccaaagauuuuggaggagaaggacauuuuacugcaguga

SEQ ID NO: 118392 - RNA, 64 nt, Human
uuaccaacuuuuuguuucucauuacugaagaaaauuggaggaaaaucuucauacugaauucuuc

SEQ ID NO: 118393 - RNA, 64 nt, Human
ccaaagcagccccuuguaagcagcucugagucuuuuggaggacagggacgguuuguggcugaga

SEQ ID NO: 118394 - RNA, 64 nt, Human
gaguaaguugauuguaaccauagguauuuauugauuggaggaagggagggucauauuauuuucg

SEQ ID NO: 118395 - RNA, 64 nt, Human
ggcccuggcucugcauuggaccugcuaugaggcuuuggaggaaucccucacccucucugggccu

SEQ ID NO: 118396 - RNA, 64 nt, Human
gauuuuaggggaggaagagccacguccccagggauuggaggaggcuccgguacccucgacccuc

SEQ ID NO: 118397 - RNA, 64 nt, Human
cauucucuuccagguucugauccaggaugaaaauuuggaggaaaaguggaagauauuaagcaaa

SEQ ID NO: 118398 - RNA, 64 nt, Human
caacgacauaucuuguuaacuuuuacggugacuuuuggaggaggggaguuuggaaauuguaaaa

SEQ ID NO: 118399 - RNA, 64 nt, Human
caugucucucucccccaggguggggggaccuguguuggaggagggguguuggggggcccccuuc

SEQ ID NO: 118400 - RNA, 64 nt, Human
aaacacucagacaucuaguaccagggauuauuaauuggaggaagauuuaugguuaugggucugg

SEQ ID NO: 118401 - RNA, 64 nt, Human
acauuaagacgcaacucauuuuauaucaacacgcuuggaggaaagggacucagggaagggagca

SEQ ID NO: 118402 - RNA, 64 nt, Human
auggcaaauauauuaagaagaguauugaaaguauuuggaggaaaaugguuaauucugggugugc

SEQ ID NO: 118403 - RNA, 64 nt, Human
agagcucagggcacccagugucuuaaggaaccauuuggaggacagucugagagcaggaacuuca

SEQ ID NO: 118404 - RNA, 64 nt, Human
agaaaagcgaaaggacagacuguuggcuuuguguuuggaggauaggagggagagagggaagggg

SEQ ID NO: 118405 - RNA, 64 nt, Human
ucaauguucugggaauaacucucuucccugauccuuggaggagcccgaacugauucuggagcuc

SEQ ID NO: 118406 - RNA, 64 nt, Human
uucucccugccuccagaauguucugggauaacauuuggaggaaggugggaagcagaugacugag

SEQ ID NO: 118407 - RNA, 64 nt, Human
ugacaugugcaaggcugucagcagggacaucguguuggaggagaucaagcucauuagcaagacu

SEQ ID NO: 118408 - RNA, 62 nt, Human
gguuccuuuucucaggagaggauuuucaggauuauuggaggauuaggucauugucagaugac

SEQ ID NO: 118409 - RNA, 64 nt, Human
ccagggaagaggggcugggguuuaaauagcaugcuuggaggaagauuuuccuucaauuuuuccu

SEQ ID NO: 118410 - RNA, 64 nt, Human
gaaaaaaucuguuuguucaggcagagagcuauauuuggaggaagcauuacagaacgaaagagau

SEQ ID NO: 118411 - RNA, 64 nt, Human
uguuuuucuuacagcuuugccgggaaguaaagcuuuggaggaaaaucaauaucaaugaaagugc

SEQ ID NO: 118412 - RNA, 64 nt, Human
acaaggaugaagaaaaacaaaauaacuacuacuuuuggaggaaacuuggaacaagaagaguaca

SEQ ID NO: 118413 - RNA, 64 nt, Human
aaggggagauggauaugauagauuacacaguuuauuggaggacaauaagaguuauggcaaaaag

SEQ ID NO: 118414 - RNA, 64 nt, Human
gcugauggugcaagguccaguccaaagguaucuguuggaggauucucuuguucugggaagagga

SEQ ID NO: 118415 - RNA, 64 nt, Human
ucugcuccgagggccagugggcugcagggccugcuuggaggaaggauuugugugucggaggcca

SEQ ID NO: 118416 - RNA, 64 nt, Human
acuuuuguuucugaucuuguuuucccuguggauauuggaggacagcgagguucuuucugauacu

SEQ ID NO: 118417 - RNA, 64 nt, Human
gaauauauagugucagacggaaguuauaaucaucuuggaggaaccauaagaaaagguguccagg

SEQ ID NO: 118418 - RNA, 64 nt, Human
agcuuccugggaggaauaauaagaaaaacaugcuuuggaggaaaacucaagauacaaaaaugaa

SEQ ID NO: 118419 - RNA, 64 nt, Human
ucugacgcucuguguauugcucuuugaaucgaguuuggaggaagaguugaguuguaugaguggc

SEQ ID NO: 118420 - RNA, 64 nt, Human
guguaaccauaaacuauauucauaucuguuucauuuggaggauuuucuucuuuguaauguaaag

SEQ ID NO: 118421 - RNA, 64 nt, Human
ggccagcuucccuuacucaaggaguugagggaccuuggaggaugaaggcgaguaugugacacug

SEQ ID NO: 118422 - RNA, 64 nt, Human
uccguugcagcuuuuuacaaccauccggugugguuuggaggauuuguuuuuuuuuuuucccaac

SEQ ID NO: 118423 - RNA, 64 nt, Human
agagagggcccaggcaggcggccuauccugauccuuggaggaggaggaagaggaggccacugug

SEQ ID NO: 118424 - RNA, 64 nt, Human
aaaccagaucugucuccaagaccuuggccucuccuuggaggaccuuuaggucaaacucccuagu

SEQ ID NO: 118425 - RNA, 64 nt, Human
ggcccagccuccccaccccaccgcgccccagggguuggaggaccuugucugugucaggacagug

SEQ ID NO: 118426 - RNA, 64 nt, Human
uuguaauuuuuuucaucaguuccuuaaauguuauuuggaggaaacuaaguucuugaccucagua

SEQ ID NO: 118427 - RNA, 64 nt, Human
auuugugccucagccauucuaguuuuguuguguguuggaggacagucuaaugaagacaggauaa

SEQ ID NO: 118428 - RNA, 64 nt, Human
guuuacauuuucaggaauuuaaguuaguaucugguuggaggaacccagaaaaggugauguuaug

SEQ ID NO: 118429 - RNA, 64 nt, Human
aagguuacuaccuaggguuuaugcuuaauuuuaauuggaggaaaugaaugcugauuguaacgga

SEQ ID NO: 118430 - RNA, 64 nt, Human
gaauauauagugucagacggaaguuauaaucaucuuggaggaaccauaagaaaaaguguccagg

SEQ ID NO: 118431 - RNA, 64 nt, Human
uuuccccuaggacugggggcccuguaggcugcuguuggaggacuggguagagacauuggaggga

SEQ ID NO: 118432 - RNA, 64 nt, Human
ucagggagggcacauacuuagauaccuacaagacuuggaggaauuaagaguucacccuucaucu

SEQ ID NO: 118433 - RNA, 64 nt, Human
uaacaaauccgacuaccagaaaaaaaaaauuguuuuggaggaggggcaaaaggaaccaugauca

SEQ ID NO: 118434 - RNA, 64 nt, Human
uuggaggaaugucaucuuccuaaaugaaguuuauuuggaggaacacagucaucuccuuggugaa

SEQ ID NO: 118435 - RNA, 64 nt, Human
agagaagaaagugcauuuauugucuuuccaccuauuggaggaaugucaucuuccuaaaugaagu

SEQ ID NO: 118436 - RNA, 64 nt, Human
gcuuaggauccucguuuucuggguuuuggugauguuggaggaguaccccccagcccaccgcccc

SEQ ID NO: 118437 - RNA, 64 nt, Human
cuucccuccucaaauuccugcacggaccugggacuuggaggauagcaaagaaggaggcccuggg

SEQ ID NO: 118438 - RNA, 64 nt, Human
uggcuuuccaggcagcaagguccuuggggccuucuuggaggagcuugggugacagccaggugag

SEQ ID NO: 118439 - RNA, 64 nt, Human
uccccagacccaaagcaggacgggagacaacugcuuggaggagcgaagagcccuggcauuuuau

SEQ ID NO: 118440 - RNA, 64 nt, Human
aaugaaaacaaaacauaaaaacaucacacuaaucuuggaggaauaagaaaaauuguacauccau

SEQ ID NO: 118441 - RNA, 64 nt, Human
aaagcacauuauagagcuuauguuggaauccaucuuggaggauuuuuguuuuaaacugucuuua

SEQ ID NO: 118442 - RNA, 64 nt, Human
gguauggaaucugagggaagauuuauguuucguuuuggaggauagcucaaguugaauuuucuuu

SEQ ID NO: 118443 - RNA, 64 nt, Human
ggacgagaugccuuguuucuuuuacaauaagucguuggaggaaugccauuaaagugaacucccc

SEQ ID NO: 118444 - RNA, 64 nt, Human
augccuuuagucccagcuacucuggaggcugaaguuggaggauggcuugagcccacgagaugga

SEQ ID NO: 118445 - RNA, 64 nt, Human
aauuucucacaaugcuguaugauacuauuuaaauuuggaggacaacuuaucuucacuaagcuga

SEQ ID NO: 118446 - RNA, 64 nt, Human
gggauuuggacaagaaugaauguggcuucuuauuuuggaggagcucuugcauuuaaauacccca

SEQ ID NO: 118447 - RNA, 64 nt, Human
uagucaaauacuuaccuuuggagaauacuuaccuuuggaggaauguauaaaauuucucaggcag

SEQ ID NO: 118448 - RNA, 64 nt, Human
gggggugcugcgggaccagcuggcccugcgagccuuggaggaggcggugagcgggggagggugc

SEQ ID NO: 118449 - RNA, 64 nt, Human
acaggggguuccaggaauccaaauccagcauggcuuggaggagcucuguuggugagaggucgcc

SEQ ID NO: 118450 - RNA, 64 nt, Human
aaauaaaucucauagcaguuaauauaaaacaucuuuggaggaugggagagaacaggagggaaga

SEQ ID NO: 118451 - RNA, 63 nt, Human
ccauuguggccgaugacugaauccccgucacucuuggaggacuccugugacguggucagccuc

SEQ ID NO: 118452 - RNA, 64 nt, Human
ccaccccacuuccuucucggaaggccagcucuucuuggaggacaagacaggaccaaucaaagag

SEQ ID NO: 118453 - RNA, 64 nt, Human
aacugcuguauguuauucaagggaagcacgcuguuuggaggaaggagcauacuuaauggguagu

SEQ ID NO: 118454 - RNA, 64 nt, Human
cacacuggcacugcaguagggaagcuguugacgcuuggaggacuugggauuuggugguuuguug

SEQ ID NO: 118455 - RNA, 64 nt, Human
cagagaaaagcuguuugcaauccaaauccagccuuuggaggaauagagauggucaauuaacaau

SEQ ID NO: 118456 - RNA, 64 nt, Human
uaaaagaaauuccuauuugaaaugaauuccucauuuggaggaaaaaaagcaugcauucuagcac

SEQ ID NO: 118457 - RNA, 64 nt, Human
aaguugcuucuagccuacugagauccaugugacauuggaggagaucuuuuaaauguuuaguauu

SEQ ID NO: 118458 - RNA, 64 nt, Human
aguucaaaagcuggugguguaggacuuaaccucauuggaggaucucacuuaauucucuaugaca

SEQ ID NO: 118459 - RNA, 64 nt, Human
ccagaugacuucagcaguggcagguguuuucagcuuggaggaggaaguacugcuaucucgcauu

SEQ ID NO: 118460 - RNA, 64 nt, Human
agauuauucuaaaauauaaacuuauuugcauauauuggaggagcauccacuaucaguauuucug

SEQ ID NO: 118461 - RNA, 64 nt, Human
uaugggggugcaccagaucauaggagggcauuauuuggaggaaaccgcuauaauguaaaaucag

SEQ ID NO: 118462 - RNA, 64 nt, Human
ucagcggcuguugauucaaggucaacauugaccauuggaggagugguuuaagagugccaggcga

SEQ ID NO: 118463 - RNA, 64 nt, Human
ggggauguagcuuuuuuaaaagauuugggaacacuuggaggauuugcuaaaaugagccucagaa

SEQ ID NO: 118464 - RNA, 64 nt, Human
gggcagggaggcuuccagccuguguuccccucacuuggaggaaccagcacucuccauccuuuca

SEQ ID NO: 118465 - RNA, 64 nt, Human
ucgggcugugggcacauggggccccgcagguuccuuggaggagcccugagcugggaggcagcaa

SEQ ID NO: 118466 - RNA, 64 nt, Human
ccaugagggagacgguggggaggcuucccaugauuuggaggauagcaacaucaguuaugggagc

SEQ ID NO: 118467 - RNA, 64 nt, Human
ugugaaauuugcccuaguuacuaccauucucguuuuggaggaaacaaucucugccaccaccaag

SEQ ID NO: 118468 - RNA, 64 nt, Human
caggcagagcggugcagcccuccuucccuuccauuuggaggagguggugccaggagccugcccg

SEQ ID NO: 118469 - RNA, 64 nt, Human
cgauuccuuucgaguagaugugggaaagagcccauuggaggauaugagguccugugaaauucag

SEQ ID NO: 118470 - RNA, 64 nt, Human
ccuccaggguugggggagcaggaagcccagauauuuggaggaacagaaacaccagcugcucccu

SEQ ID NO: 118471 - RNA, 64 nt, Human
agugagguuagugggaguggucaaauugguacucuuggaggaagaaaaacuguccuuccuucuc

SEQ ID NO: 118472 - RNA, 64 nt, Human
aaguagaugaccaaugcacgcuccucaaacaucuuuggaggaacuaccuggccaaaacacuggc

SEQ ID NO: 118473 - RNA, 64 nt, Human
acggaaacugagaugaggaaccagccguccucucuuggaggauaaacagccucccccuacccaa

SEQ ID NO: 118474 - RNA, 64 nt, Human
aggcugaagagagcaaauauauuauuaagauggguuggaggauuggcgaguuucuaaauauuaa

SEQ ID NO: 118475 - RNA, 64 nt, Human
uguaauguacaacugacacugccauuuuuccuuuuuggaggaaauggacauagauaaagaagau

SEQ ID NO: 118476 - RNA, 64 nt, Human
uguuacuguugcagcuugugcugagccugcccaguuggaggagacugggcaccccugccuccug

SEQ ID NO: 118477 - RNA, 64 nt, Human
agcauggcuguuccccaagugcacaccugaacacuuggaggaauaaaguucuguuuuuaauugu

SEQ ID NO: 118478 - RNA, 64 nt, Human
auuuguuacuuaagucugugaaaaacauauuucuuuggaggaaaauguaugcauuuauaagugu

SEQ ID NO: 118479 - RNA, 64 nt, Human
caagcugccuggaugagcgcccaugcagcaaggcuuggaggaagcgucagugcccuggagaucc

SEQ ID NO: 118480 - RNA, 64 nt, Human
uuccugguacugucacugccacuggggcuuugauuuggaggaauggggcaggggacuaucugaa

SEQ ID NO: 118481 - RNA, 64 nt, Human
ucuggauggugaagucuggaaucuggguggguccuuggaggaggggcuaggacagccgugggug

SEQ ID NO: 118482 - RNA, 64 nt, Human
gaaggcccccgggccccagcaugggccccgagccuuggaggagcacuggcaguugguggcagug

SEQ ID NO: 118483 - RNA, 64 nt, Human
cauuacagcaagggcaguuuggggguaaagcauuuuggaggaauaaccuuaaaaaguuaaaaag

SEQ ID NO: 118484 - RNA, 64 nt, Human
ggcuucugccaagaacucaggguggcccuaugacuuggaggagcaagaucagaccgcucaaagg

SEQ ID NO: 118485 - RNA, 64 nt, Human
accugguucccgccucccccaaggcucaugguccuuggaggacccguugcagggugaggucaag

SEQ ID NO: 118486 - RNA, 64 nt, Human
accagcagaagccaagacaggaugcacagcugaauuggaggagaguagcucccuucucacacaa

SEQ ID NO: 118487 - RNA, 64 nt, Human
uagaugaggccuucccauggcuacagugugacccuuggaggaaccaaaggcugugcauuguuag

SEQ ID NO: 118488 - RNA, 64 nt, Human
ccccaacaggguggaucccgacugcccacaucucuuggaggagccgaucuugaaauccauugcc

SEQ ID NO: 118489 - RNA, 64 nt, Human
aguguuuuaucuaugacaauuuagaaucauguaauuggaggaaauccuucauacacucuauauu

SEQ ID NO: 118490 - RNA, 64 nt, Human
auucguaacacuguauaugaugaaaggcuucuauuuggaggaagaaaaauuaagaagacaacuu

SEQ ID NO: 118491 - RNA, 64 nt, Human
ucuccuaucucucugucuuuuuucucucuuagaauuggaggauuugccauuguccaggaaagaa

SEQ ID NO: 118492 - RNA, 64 nt, Human
ugucgcccaggccuaagugagucgugugccucuauuggaggauggcuguuccccuggugguugc

SEQ ID NO: 118493 - RNA, 64 nt, Human
auaagaagacugaaaaccauggagauuauuuuuauuggaggaggaagcaucauucaugaaccga

SEQ ID NO: 118494 - RNA, 64 nt, Human
cagucccccaucuaaguggugcuuugcaaaugucuuggaggaguauaggacagaggaccaaaau

SEQ ID NO: 118495 - RNA, 64 nt, Human
accucuccugcgauaguccugggugcuccacugauuggaggauagagccagcugucugacacac

SEQ ID NO: 118496 - RNA, 64 nt, Human
gucuuaacacuaguggacaauucuagcauuuuguuuggaggauuucagaguuaaccucauggaa

SEQ ID NO: 118497 - RNA, 64 nt, Human
gacuaggguagaagaacacuuuucuuggcuacauuuggaggauacccagggagucuuggguguu

SEQ ID NO: 118498 - RNA, 64 nt, Human
aggcuucuggcuuccaacuggagacucacaggccuuggaggaggaggcagguacccucuaugcc

SEQ ID NO: 118499 - RNA, 64 nt, Human
auuuuaaauaugacaauauuuauaaauguaugguuuggaggaaucguuuaaauucucuuuccua

SEQ ID NO: 118500 - RNA, 64 nt, Human
uaugaccuagcccccauaauugggauuuaucauuuuggaggauucuuucuagagcaagauacgc

SEQ ID NO: 118501 - RNA, 64 nt, Human
aggacuuauucaaccuguccuuucagggaguuuauuggaggaucaaagaacugaaagcacuaga

SEQ ID NO: 118502 - RNA, 64 nt, Human
cagccucacccugggcccacagaccggccuuccuuuggaggaaaguguggccuggacugaggga

SEQ ID NO: 118503 - RNA, 64 nt, Human
uagaggcuugagacuuuccuuugugugguaggacuuggaggagaaauccccuggacuuucacua

SEQ ID NO: 118504 - RNA, 64 nt, Human
uucugcugcagguggcagguggccccaggccuguuuggaggaugggcugggugggugggugggg

SEQ ID NO: 118505 - RNA, 64 nt, Human
cuucuguguaucucuuucacauuguuugcugcuauuggaggaucaguuuuuuguuuuacaaugu
